United States Patent 9,624,556 (VIRAL AND VIRAL ASSOCIATED MIRNAS AND USES THEREOF) - sequence listing, part 14

SEQ ID NO: 397486 - RNA, 64 nt, Human; identical to SEQ ID NO: 122485

SEQ ID NO: 397487 - RNA, 64 nt, Human; identical to SEQ ID NO: 122486

SEQ ID NO: 397488 - RNA, 64 nt, Human; identical to SEQ ID NO: 122487

SEQ ID NO: 397489 - RNA, 64 nt, Human; identical to SEQ ID NO: 122488

SEQ ID NO: 397490 - RNA, 64 nt, Human; identical to SEQ ID NO: 122489

SEQ ID NO: 397491 - RNA, 64 nt, Human; identical to SEQ ID NO: 122490

SEQ ID NO: 397492 - RNA, 62 nt, Human
gaugagccggggguuuucucuaaaucugacuaaaggcccaaagugggcccaucugagucagg

SEQ ID NO: 397493 - RNA, 62 nt, Human
uccuguucagcagugagaugagggcugugauuaaggcccaacacccagacuacucuuucggg

SEQ ID NO: 397494 - RNA, 62 nt, Human
uggggccaugcguaugacuggugcagggaggcaaggcccacauucuccuucagagacaggca

SEQ ID NO: 397495 - RNA, 64 nt, Human; identical to SEQ ID NO: 122491

SEQ ID NO: 397496 - RNA, 64 nt, Human; identical to SEQ ID NO: 122492

SEQ ID NO: 397497 - RNA, 64 nt, Human; identical to SEQ ID NO: 122493

SEQ ID NO: 397498 - RNA, 64 nt, Human; identical to SEQ ID NO: 122494

SEQ ID NO: 397499 - RNA, 64 nt, Human; identical to SEQ ID NO: 122495

SEQ ID NO: 397500 - RNA, 64 nt, Human; identical to SEQ ID NO: 122497

SEQ ID NO: 397501 - RNA, 64 nt, Human; identical to SEQ ID NO: 122498

SEQ ID NO: 397502 - RNA, 64 nt, Human; identical to SEQ ID NO: 122499

SEQ ID NO: 397503 - RNA, 64 nt, Human; identical to SEQ ID NO: 122500

SEQ ID NO: 397504 - RNA, 64 nt, Human; identical to SEQ ID NO: 122501

SEQ ID NO: 397505 - RNA, 64 nt, Human; identical to SEQ ID NO: 122502

SEQ ID NO: 397506 - RNA, 64 nt, Human; identical to SEQ ID NO: 122503

SEQ ID NO: 397507 - RNA, 64 nt, Human; identical to SEQ ID NO: 122504

SEQ ID NO: 397508 - RNA, 64 nt, Human; identical to SEQ ID NO: 122505

SEQ ID NO: 397509 - RNA, 64 nt, Human; identical to SEQ ID NO: 122506

SEQ ID NO: 397510 - RNA, 64 nt, Human; identical to SEQ ID NO: 122507

SEQ ID NO: 397511 - RNA, 64 nt, Human; identical to SEQ ID NO: 122508

SEQ ID NO: 397512 - RNA, 64 nt, Human; identical to SEQ ID NO: 122509

SEQ ID NO: 397513 - RNA, 64 nt, Human; identical to SEQ ID NO: 122510

SEQ ID NO: 397514 - RNA, 64 nt, Human; identical to SEQ ID NO: 122511

SEQ ID NO: 397515 - RNA, 64 nt, Human; identical to SEQ ID NO: 122512

SEQ ID NO: 397516 - RNA, 64 nt, Human; identical to SEQ ID NO: 122514

SEQ ID NO: 397517 - RNA, 64 nt, Human; identical to SEQ ID NO: 122515

SEQ ID NO: 397518 - RNA, 64 nt, Human; identical to SEQ ID NO: 122516

SEQ ID NO: 397519 - RNA, 64 nt, Human; identical to SEQ ID NO: 122517

SEQ ID NO: 397520 - RNA, 64 nt, Human; identical to SEQ ID NO: 122518

SEQ ID NO: 397521 - RNA, 64 nt, Human; identical to SEQ ID NO: 122519

SEQ ID NO: 397522 - RNA, 64 nt, Human; identical to SEQ ID NO: 122520

SEQ ID NO: 397523 - RNA, 64 nt, Human; identical to SEQ ID NO: 122521

SEQ ID NO: 397524 - RNA, 64 nt, Human; identical to SEQ ID NO: 122522

SEQ ID NO: 397525 - RNA, 64 nt, Human; identical to SEQ ID NO: 122523

SEQ ID NO: 397526 - RNA, 64 nt, Human; identical to SEQ ID NO: 122524

SEQ ID NO: 397527 - RNA, 62 nt, Human
gcccauccccaggcaccucacaggccccaggaaaggcccagccaccgaagccgccuguggac

SEQ ID NO: 397528 - RNA, 62 nt, Human
uucucccagccacagccaagauucccaaagucaaggcccaaagauuuccaagguucccaaag

SEQ ID NO: 397529 - RNA, 64 nt, Human; identical to SEQ ID NO: 122525

SEQ ID NO: 397530 - RNA, 64 nt, Human; identical to SEQ ID NO: 122526

SEQ ID NO: 397531 - RNA, 64 nt, Human; identical to SEQ ID NO: 122527

SEQ ID NO: 397532 - RNA, 64 nt, Human; identical to SEQ ID NO: 122528

SEQ ID NO: 397533 - RNA, 64 nt, Human; identical to SEQ ID NO: 122529

SEQ ID NO: 397534 - RNA, 64 nt, Human; identical to SEQ ID NO: 122530

SEQ ID NO: 397535 - RNA, 64 nt, Human; identical to SEQ ID NO: 122531

SEQ ID NO: 397536 - RNA, 64 nt, Human; identical to SEQ ID NO: 122532

SEQ ID NO: 397537 - RNA, 64 nt, Human; identical to SEQ ID NO: 122533

SEQ ID NO: 397538 - RNA, 64 nt, Human; identical to SEQ ID NO: 122534

SEQ ID NO: 397539 - RNA, 64 nt, Human; identical to SEQ ID NO: 122535

SEQ ID NO: 397540 - RNA, 64 nt, Human; identical to SEQ ID NO: 122536

SEQ ID NO: 397541 - RNA, 64 nt, Human; identical to SEQ ID NO: 122537

SEQ ID NO: 397542 - RNA, 64 nt, Human; identical to SEQ ID NO: 122538

SEQ ID NO: 397543 - RNA, 64 nt, Human; identical to SEQ ID NO: 122539

SEQ ID NO: 397544 - RNA, 64 nt, Human; identical to SEQ ID NO: 122540

SEQ ID NO: 397545 - RNA, 62 nt, Human
cggagaacucugugucuggcaccucucuccacaaggcccaggcgcccagggucccaccgacc

SEQ ID NO: 397546 - RNA, 62 nt, Human
aauuaaaaaggaccaagaagaggaagaagaccaaggcccaccgugccccagguaacugagca

SEQ ID NO: 397547 - RNA, 62 nt, Human
auauucaaacuuaaaauugagcuuuuuuuuuaaaggcccaaaauuguacagugauacaagga

SEQ ID NO: 397548 - RNA, 64 nt, Human; identical to SEQ ID NO: 122541

SEQ ID NO: 397549 - RNA, 64 nt, Human; identical to SEQ ID NO: 122542

SEQ ID NO: 397550 - RNA, 64 nt, Human; identical to SEQ ID NO: 122543

SEQ ID NO: 397551 - RNA, 64 nt, Human; identical to SEQ ID NO: 122544

SEQ ID NO: 397552 - RNA, 64 nt, Human; identical to SEQ ID NO: 122545

SEQ ID NO: 397553 - RNA, 64 nt, Human; identical to SEQ ID NO: 122546

SEQ ID NO: 397554 - RNA, 64 nt, Human; identical to SEQ ID NO: 122547

SEQ ID NO: 397555 - RNA, 64 nt, Human; identical to SEQ ID NO: 122548

SEQ ID NO: 397556 - RNA, 64 nt, Human; identical to SEQ ID NO: 122549

SEQ ID NO: 397557 - RNA, 64 nt, Human; identical to SEQ ID NO: 122550

SEQ ID NO: 397558 - RNA, 64 nt, Human; identical to SEQ ID NO: 122551

SEQ ID NO: 397559 - RNA, 64 nt, Human; identical to SEQ ID NO: 122552

SEQ ID NO: 397560 - RNA, 64 nt, Human; identical to SEQ ID NO: 122553

SEQ ID NO: 397561 - RNA, 64 nt, Human; identical to SEQ ID NO: 122554

SEQ ID NO: 397562 - RNA, 64 nt, Human; identical to SEQ ID NO: 122555

SEQ ID NO: 397563 - RNA, 64 nt, Human; identical to SEQ ID NO: 122556

SEQ ID NO: 397564 - RNA, 62 nt, Human
ccaugauccccagcacugucccauccuccacaaaggcccacaggcaugccuguacucucuuu

SEQ ID NO: 397565 - RNA, 62 nt, Human
ccauguggcagcccauggguaugacauaggccaaggcccaacuaacagucaagaaacagcuc

SEQ ID NO: 397566 - RNA, 62 nt, Human
aggcaggaggaaagagacugccucuccagagcaaggcccagcugggcagagggugaaaaaga

SEQ ID NO: 397567 - RNA, 64 nt, Human; identical to SEQ ID NO: 122557

SEQ ID NO: 397568 - RNA, 64 nt, Human; identical to SEQ ID NO: 122558

SEQ ID NO: 397569 - RNA, 64 nt, Human; identical to SEQ ID NO: 122559

SEQ ID NO: 397570 - RNA, 64 nt, Human; identical to SEQ ID NO: 122560

SEQ ID NO: 397571 - RNA, 64 nt, Human; identical to SEQ ID NO: 122561

SEQ ID NO: 397572 - RNA, 64 nt, Human; identical to SEQ ID NO: 122563

SEQ ID NO: 397573 - RNA, 64 nt, Human; identical to SEQ ID NO: 122564

SEQ ID NO: 397574 - RNA, 64 nt, Human; identical to SEQ ID NO: 122565

SEQ ID NO: 397575 - RNA, 64 nt, Human; identical to SEQ ID NO: 122566

SEQ ID NO: 397576 - RNA, 64 nt, Human; identical to SEQ ID NO: 122567

SEQ ID NO: 397577 - RNA, 64 nt, Human; identical to SEQ ID NO: 122568

SEQ ID NO: 397578 - RNA, 64 nt, Human; identical to SEQ ID NO: 122569

SEQ ID NO: 397579 - RNA, 64 nt, Human; identical to SEQ ID NO: 122570

SEQ ID NO: 397580 - RNA, 64 nt, Human; identical to SEQ ID NO: 122571

SEQ ID NO: 397581 - RNA, 64 nt, Human; identical to SEQ ID NO: 122572

SEQ ID NO: 397582 - RNA, 64 nt, Human; identical to SEQ ID NO: 122573

SEQ ID NO: 397583 - RNA, 62 nt, Human
uguaguuggauuguuuguauuaggauucaagcaaggcccauauauugcauuuauuugaaaug

SEQ ID NO: 397584 - RNA, 62 nt, Human
agaacccacauaaaagccccagcuuggcucacaaggcccaggagaccuccagcuaaacacca

SEQ ID NO: 397585 - RNA, 62 nt, Human
agagucaggagagcagcaggagaggcgcacagaaggcccaguucucagggguuuuuauucuu

SEQ ID NO: 397586 - RNA, 64 nt, Human; identical to SEQ ID NO: 122574

SEQ ID NO: 397587 - RNA, 64 nt, Human; identical to SEQ ID NO: 122575

SEQ ID NO: 397588 - RNA, 64 nt, Human; identical to SEQ ID NO: 122576

SEQ ID NO: 397589 - RNA, 64 nt, Human; identical to SEQ ID NO: 122577

SEQ ID NO: 397590 - RNA, 64 nt, Human; identical to SEQ ID NO: 122578

SEQ ID NO: 397591 - RNA, 64 nt, Human; identical to SEQ ID NO: 122580

SEQ ID NO: 397592 - RNA, 64 nt, Human; identical to SEQ ID NO: 122581

SEQ ID NO: 397593 - RNA, 64 nt, Human; identical to SEQ ID NO: 122582

SEQ ID NO: 397594 - RNA, 64 nt, Human; identical to SEQ ID NO: 122583

SEQ ID NO: 397595 - RNA, 64 nt, Human; identical to SEQ ID NO: 122584

SEQ ID NO: 397596 - RNA, 64 nt, Human; identical to SEQ ID NO: 122585

SEQ ID NO: 397597 - RNA, 64 nt, Human; identical to SEQ ID NO: 122586

SEQ ID NO: 397598 - RNA, 64 nt, Human; identical to SEQ ID NO: 122587

SEQ ID NO: 397599 - RNA, 64 nt, Human; identical to SEQ ID NO: 122588

SEQ ID NO: 397600 - RNA, 64 nt, Human; identical to SEQ ID NO: 122589

SEQ ID NO: 397601 - RNA, 64 nt, Human; identical to SEQ ID NO: 122590

SEQ ID NO: 397602 - RNA, 62 nt, Human
uaucacccaggcaggagugcaguggugcgaucaaggcccacugcagucuugaccuccugggc

SEQ ID NO: 397603 - RNA, 64 nt, Human; identical to SEQ ID NO: 122591

SEQ ID NO: 397604 - RNA, 64 nt, Human; identical to SEQ ID NO: 122592

SEQ ID NO: 397605 - RNA, 64 nt, Human; identical to SEQ ID NO: 122593

SEQ ID NO: 397606 - RNA, 64 nt, Human; identical to SEQ ID NO: 122594

SEQ ID NO: 397607 - RNA, 64 nt, Human; identical to SEQ ID NO: 122595

SEQ ID NO: 397608 - RNA, 64 nt, Human; identical to SEQ ID NO: 122597

SEQ ID NO: 397609 - RNA, 64 nt, Human; identical to SEQ ID NO: 122598

SEQ ID NO: 397610 - RNA, 64 nt, Human; identical to SEQ ID NO: 122599

SEQ ID NO: 397611 - RNA, 64 nt, Human; identical to SEQ ID NO: 122600

SEQ ID NO: 397612 - RNA, 64 nt, Human; identical to SEQ ID NO: 122601

SEQ ID NO: 397613 - RNA, 64 nt, Human; identical to SEQ ID NO: 122602

SEQ ID NO: 397614 - RNA, 64 nt, Human; identical to SEQ ID NO: 122603

SEQ ID NO: 397615 - RNA, 64 nt, Human; identical to SEQ ID NO: 122604

SEQ ID NO: 397616 - RNA, 64 nt, Human; identical to SEQ ID NO: 122605

SEQ ID NO: 397617 - RNA, 64 nt, Human; identical to SEQ ID NO: 122606

SEQ ID NO: 397618 - RNA, 64 nt, Human; identical to SEQ ID NO: 122607

SEQ ID NO: 397619 - RNA, 62 nt, Human
cucuuauacauuagauaccuauauuuaaaugaaaggcccaauuuguaaacauauacauucau

SEQ ID NO: 397620 - RNA, 62 nt, Human
ucauaacagucuuacugcaggcaagugggauaaaggcccagacuccaugguggaaguuaaag

SEQ ID NO: 397621 - RNA, 62 nt, Human
ugacacuauucacuaaaauuaaucuggaauuuaaggcccaacauuaaacacaaagcuguuga

SEQ ID NO: 397622 - RNA, 64 nt, Human; identical to SEQ ID NO: 122608

SEQ ID NO: 397623 - RNA, 64 nt, Human; identical to SEQ ID NO: 122609

SEQ ID NO: 397624 - RNA, 64 nt, Human; identical to SEQ ID NO: 122610

SEQ ID NO: 397625 - RNA, 64 nt, Human; identical to SEQ ID NO: 122611

SEQ ID NO: 397626 - RNA, 64 nt, Human; identical to SEQ ID NO: 122612

SEQ ID NO: 397627 - RNA, 64 nt, Human; identical to SEQ ID NO: 122613

SEQ ID NO: 397628 - RNA, 64 nt, Human; identical to SEQ ID NO: 122614

SEQ ID NO: 397629 - RNA, 64 nt, Human; identical to SEQ ID NO: 122615

SEQ ID NO: 397630 - RNA, 64 nt, Human; identical to SEQ ID NO: 122616

SEQ ID NO: 397631 - RNA, 64 nt, Human; identical to SEQ ID NO: 122617

SEQ ID NO: 397632 - RNA, 64 nt, Human; identical to SEQ ID NO: 122618

SEQ ID NO: 397633 - RNA, 64 nt, Human; identical to SEQ ID NO: 122619

SEQ ID NO: 397634 - RNA, 64 nt, Human; identical to SEQ ID NO: 122620

SEQ ID NO: 397635 - RNA, 64 nt, Human; identical to SEQ ID NO: 122621

SEQ ID NO: 397636 - RNA, 64 nt, Human; identical to SEQ ID NO: 122622

SEQ ID NO: 397637 - RNA, 64 nt, Human; identical to SEQ ID NO: 122623

SEQ ID NO: 397638 - RNA, 62 nt, Human
cauucucugcaggcuccagcguggccacagcuaaggcccauccauuucccaaagugaggaaa

SEQ ID NO: 397639 - RNA, 62 nt, Human
ucugaguuugcuguuggugcaggaauaagggaaaggcccaagguauccaagccuggggaagg

SEQ ID NO: 397640 - RNA, 62 nt, Human
ccagggaggggacccagagaggccuggcacacaaggcccaagcaccaccgucaacacagccc

SEQ ID NO: 397641 - RNA, 64 nt, Human; identical to SEQ ID NO: 122624

SEQ ID NO: 397642 - RNA, 64 nt, Human; identical to SEQ ID NO: 122625

SEQ ID NO: 397643 - RNA, 64 nt, Human; identical to SEQ ID NO: 122626

SEQ ID NO: 397644 - RNA, 64 nt, Human; identical to SEQ ID NO: 122627

SEQ ID NO: 397645 - RNA, 64 nt, Human; identical to SEQ ID NO: 122628

SEQ ID NO: 397646 - RNA, 64 nt, Human; identical to SEQ ID NO: 122630

SEQ ID NO: 397647 - RNA, 64 nt, Human; identical to SEQ ID NO: 122631

SEQ ID NO: 397648 - RNA, 64 nt, Human; identical to SEQ ID NO: 122632

SEQ ID NO: 397649 - RNA, 64 nt, Human; identical to SEQ ID NO: 122633

SEQ ID NO: 397650 - RNA, 64 nt, Human; identical to SEQ ID NO: 122634

SEQ ID NO: 397651 - RNA, 64 nt, Human; identical to SEQ ID NO: 122635

SEQ ID NO: 397652 - RNA, 64 nt, Human; identical to SEQ ID NO: 122636

SEQ ID NO: 397653 - RNA, 64 nt, Human; identical to SEQ ID NO: 122637

SEQ ID NO: 397654 - RNA, 64 nt, Human; identical to SEQ ID NO: 122638

SEQ ID NO: 397655 - RNA, 64 nt, Human; identical to SEQ ID NO: 122639

SEQ ID NO: 397656 - RNA, 64 nt, Human; identical to SEQ ID NO: 122640

SEQ ID NO: 397657 - RNA, 62 nt, Human
guuuccucccaguuggagaguagaguuaagacaaggcccaguuuuguguuagccgaccgucu

SEQ ID NO: 397658 - RNA, 62 nt, Human
ucccugcagacaccuagagcucaggacugggcaaggcccagggauucucaccccuuccccag

SEQ ID NO: 397659 - RNA, 62 nt, Human
gggggaucggggguuagggguggaguccgccaaaggcccaaaggugauggucaucgagaugg

SEQ ID NO: 397660 - RNA, 62 nt, Human; identical to SEQ ID NO: 122641

SEQ ID NO: 397661 - RNA, 64 nt, Human; identical to SEQ ID NO: 122642

SEQ ID NO: 397662 - RNA, 64 nt, Human; identical to SEQ ID NO: 122643

SEQ ID NO: 397663 - RNA, 64 nt, Human; identical to SEQ ID NO: 122644

SEQ ID NO: 397664 - RNA, 64 nt, Human; identical to SEQ ID NO: 122645

SEQ ID NO: 397665 - RNA, 64 nt, Human; identical to SEQ ID NO: 122647

SEQ ID NO: 397666 - RNA, 64 nt, Human; identical to SEQ ID NO: 122648

SEQ ID NO: 397667 - RNA, 64 nt, Human; identical to SEQ ID NO: 122649

SEQ ID NO: 397668 - RNA, 64 nt, Human; identical to SEQ ID NO: 122650

SEQ ID NO: 397669 - RNA, 64 nt, Human; identical to SEQ ID NO: 122651

SEQ ID NO: 397670 - RNA, 64 nt, Human; identical to SEQ ID NO: 122652

SEQ ID NO: 397671 - RNA, 64 nt, Human; identical to SEQ ID NO: 122653

SEQ ID NO: 397672 - RNA, 64 nt, Human; identical to SEQ ID NO: 122654

SEQ ID NO: 397673 - RNA, 64 nt, Human; identical to SEQ ID NO: 122655

SEQ ID NO: 397674 - RNA, 64 nt, Human; identical to SEQ ID NO: 122656

SEQ ID NO: 397675 - RNA, 64 nt, Human; identical to SEQ ID NO: 122657

SEQ ID NO: 397676 - RNA, 62 nt, Human
cuaagcaccguuaucagugccuaggaauguucaaggcccaggcugggguucagaccugcaga

SEQ ID NO: 397677 - RNA, 64 nt, Human; identical to SEQ ID NO: 122658

SEQ ID NO: 397678 - RNA, 64 nt, Human; identical to SEQ ID NO: 122659

SEQ ID NO: 397679 - RNA, 64 nt, Human; identical to SEQ ID NO: 122660

SEQ ID NO: 397680 - RNA, 64 nt, Human; identical to SEQ ID NO: 122661

SEQ ID NO: 397681 - RNA, 64 nt, Human; identical to SEQ ID NO: 122662

SEQ ID NO: 397682 - RNA, 64 nt, Human; identical to SEQ ID NO: 122663

SEQ ID NO: 397683 - RNA, 64 nt, Human; identical to SEQ ID NO: 122664

SEQ ID NO: 397684 - RNA, 64 nt, Human; identical to SEQ ID NO: 122665

SEQ ID NO: 397685 - RNA, 64 nt, Human; identical to SEQ ID NO: 122666

SEQ ID NO: 397686 - RNA, 64 nt, Human; identical to SEQ ID NO: 122667

SEQ ID NO: 397687 - RNA, 64 nt, Human; identical to SEQ ID NO: 122668

SEQ ID NO: 397688 - RNA, 64 nt, Human; identical to SEQ ID NO: 122669

SEQ ID NO: 397689 - RNA, 64 nt, Human; identical to SEQ ID NO: 122670

SEQ ID NO: 397690 - RNA, 64 nt, Human; identical to SEQ ID NO: 122671

SEQ ID NO: 397691 - RNA, 64 nt, Human; identical to SEQ ID NO: 122672

SEQ ID NO: 397692 - RNA, 64 nt, Human; identical to SEQ ID NO: 122673

SEQ ID NO: 397693 - RNA, 62 nt, Human
ugcguccuaccugugaaacucugggaagcaggaaggcccaagaccuggugcuggauacuaug

SEQ ID NO: 397694 - RNA, 52 nt, Human
agcagaacugcucaugcuaggcaaggcccaccuuccugaccuccccucauug

SEQ ID NO: 397695 - RNA, 62 nt, Human
caacauaaaacaaugaaggaaaaccucacuugaaggcccaggucaacaucuaagccuguuga

SEQ ID NO: 397696 - RNA, 64 nt, Human; identical to SEQ ID NO: 122674

SEQ ID NO: 397697 - RNA, 64 nt, Human; identical to SEQ ID NO: 122675

SEQ ID NO: 397698 - RNA, 64 nt, Human; identical to SEQ ID NO: 122676

SEQ ID NO: 397699 - RNA, 64 nt, Human; identical to SEQ ID NO: 122677

SEQ ID NO: 397700 - RNA, 64 nt, Human; identical to SEQ ID NO: 122678

SEQ ID NO: 397701 - RNA, 63 nt, Human; identical to SEQ ID NO: 122680

SEQ ID NO: 397702 - RNA, 64 nt, Human; identical to SEQ ID NO: 122681

SEQ ID NO: 397703 - RNA, 64 nt, Human; identical to SEQ ID NO: 122682

SEQ ID NO: 397704 - RNA, 58 nt, Human; identical to SEQ ID NO: 122683

SEQ ID NO: 397705 - RNA, 64 nt, Human; identical to SEQ ID NO: 270185

SEQ ID NO: 397706 - RNA, 64 nt, Human; identical to SEQ ID NO: 270186

SEQ ID NO: 397707 - RNA, 64 nt, Human; identical to SEQ ID NO: 270187

SEQ ID NO: 397708 - RNA, 64 nt, Human; identical to SEQ ID NO: 270188

SEQ ID NO: 397709 - RNA, 64 nt, Human; identical to SEQ ID NO: 270189

SEQ ID NO: 397710 - RNA, 64 nt, Human; identical to SEQ ID NO: 270190

SEQ ID NO: 397711 - RNA, 64 nt, Human; identical to SEQ ID NO: 270191

SEQ ID NO: 397712 - RNA, 64 nt, Human; identical to SEQ ID NO: 270192

SEQ ID NO: 397713 - RNA, 64 nt, Human; identical to SEQ ID NO: 270193

SEQ ID NO: 397714 - RNA, 64 nt, Human; identical to SEQ ID NO: 270194

SEQ ID NO: 397715 - RNA, 64 nt, Human; identical to SEQ ID NO: 270195

SEQ ID NO: 397716 - RNA, 62 nt, Human
ugcuuuuauccccucucagaaagacaucacuaaaggcccauuaaaaaucuggcccuaaaagu

SEQ ID NO: 397717 - RNA, 62 nt, Human
uugacuucacuccagggugagacuugaccuuuaaggcccaaacucuggugaacuguuggacu

SEQ ID NO: 397718 - RNA, 62 nt, Human
cccgcccguggagggucccuuuuacgcaccccaaggcccacaccuaagcuuccauguagccc

SEQ ID NO: 397719 - RNA, 62 nt, Human
uccaggggccaucacugcccccgcccugucccaaggcccaggcuguugggacugggacccuc

SEQ ID NO: 397720 - RNA, 62 nt, Human
ccagcuguccacuggggaagucaagauguccuaaggcccaggucagggcaucuggagucuga

SEQ ID NO: 397721 - RNA, 62 nt, Human
uucuaucauuaaucaucuuaccaggaauaaucaaggcccagguagguagaaguuuuuauaua

SEQ ID NO: 397722 - RNA, 62 nt, Human
ccuucccuuuuuuguuguuuuuuuuuugguucaaggcccagcuucaguuaaucccuucaucu

SEQ ID NO: 397723 - RNA, 62 nt, Human
ugccuuccccagcuugcccauuucccugccccaaggcccagagcuccccccagacuggagag

SEQ ID NO: 397724 - RNA, 62 nt, Human
gguauauucauuugccccaucaccucugucuaaaggcccaaguccuagggcugccaugguca

SEQ ID NO: 397725 - RNA, 62 nt, Human
ccuggcccucucugaaggaggccaccuccuaaaaggcccagagagaagagccccacucucag

SEQ ID NO: 397726 - RNA, 62 nt, Human
gcuuuccccaucuguuggaccaaauaaucucaaaggcccagagaggacagugaccauccaca

SEQ ID NO: 397727 - RNA, 62 nt, Human
uucugcaacauuugacaaaacuaaccuugaauaaggcccacuguaauacguagcucucuuaa

SEQ ID NO: 397728 - RNA, 62 nt, Human
cccaacuacguaauaggaaaauguaggaucaaaaggcccauguauauaaguacugaccacug

SEQ ID NO: 397729 - RNA, 62 nt, Human
cuugccugaccaugugagguuaucugaagcacaaggcccacccucaccuaucugucgacccc

SEQ ID NO: 397730 - RNA, 62 nt, Human
ccucuucaaagcagagugggacuuggagagcaaaggcccaugcccccuucgcuccuccucuc

SEQ ID NO: 397731 - RNA, 62 nt, Human
ugccccuuuguccccaugucaggcggaggcggaaggcccaccgugccagaggcugggcacca

SEQ ID NO: 397732 - RNA, 62 nt, Human
aagcugugaacucagagccccucccugcuaccaaggcccagcuauggccccaggguugaaaa

SEQ ID NO: 397733 - RNA, 62 nt, Human
uccaguugaaggcagaacacuaaucagauuucaaggcccacaacuuggggacuagaccaccu

SEQ ID NO: 397734 - RNA, 62 nt, Human
ccaugugugaaagggacucucucggggaaaccaaggcccagccccuccccccucccccaggu

SEQ ID NO: 397735 - RNA, 62 nt, Human
cagcugaagucacagguuucagagaugguuugaaggcccagucuucucucccagccucaguu

SEQ ID NO: 397736 - RNA, 62 nt, Human
ccagugccuugcagagccugaagccuggggagaaggcccagccugggacccucugggcugcu

SEQ ID NO: 397737 - RNA, 62 nt, Human
ucugcagcugcuagcucagacaccaaagggguaaggcccaggacauucauaucuuuaaaagc

SEQ ID NO: 397738 - RNA, 62 nt, Human
cauggaauuagcaauaguuugcuuuuuaauagaaggcccauuuguaagaauguugaaaauau

SEQ ID NO: 397739 - RNA, 62 nt, Human
acggauguggaaggaagaacugucacccucuuaaggcccagggucggagcccagggccucuc

SEQ ID NO: 397740 - RNA, 62 nt, Human
ugagcaaaguguaauuaccgaauccugacugcaaggcccaccugccccucccccacagagcc

SEQ ID NO: 397741 - RNA, 62 nt, Human
accucacgcuggguccuaauuaccagucuuuaaaggcccagccccuagaaacccaagcuccu

SEQ ID NO: 397742 - RNA, 62 nt, Human
cugaggagccuguugugaggggcagaaugagaaaggcccaggggcccccauugacaggagcu

SEQ ID NO: 397743 - RNA, 62 nt, Human
ucucuccaccccauuuuacagaggagaacaccaaggcccagaggaaguuaagggagagucaa

SEQ ID NO: 397744 - RNA, 62 nt, Human
aaaagucaaucugcaugugcuucuuugauuacaaggcccaagggauuuaaauauaacaaaau

SEQ ID NO: 397745 - RNA, 62 nt, Human
ucuuccauuagaaugcuacaaguaacucagugaaggcccaugaaggaaauugggacuaguuu

SEQ ID NO: 397746 - RNA, 62 nt, Human
uuuaaaucuaacaaguccuguucuguuuagugaaggcccaaagacuccucuaagacuuugua

SEQ ID NO: 397747 - RNA, 62 nt, Human
cgguggggagagauggacaguucacacccugcaaggcccacaggaggcaagcaagcucucuu

SEQ ID NO: 397748 - RNA, 62 nt, Human
acugugacagugaaauaagcucccacauguucaaggcccauucugguuccuggcugccugcc

SEQ ID NO: 397749 - RNA, 62 nt, Human
uguuuucugaaagaauuuccuguugagauauaaaggcccaucugaucacuggauugggcuga

SEQ ID NO: 397750 - RNA, 62 nt, Human
acugagauuuaaaugcaaccagaauuguccucaaggcccagccauaaaagcauugucucucu

SEQ ID NO: 397751 - RNA, 62 nt, Human
ugcagugucaacuguggcucuguaacucuucaaaggcccaguuuccccucacgcagccucuu

SEQ ID NO: 397752 - RNA, 62 nt, Human
gugaucacagcucacugcagccucaaccucugaaggcccagaugaucuuccugccucagcuc

SEQ ID NO: 397753 - RNA, 62 nt, Human
ugcugguuccgagcugacacccgucuuaacaaaaggcccaggagugccucuuccaaacaaaa

SEQ ID NO: 397754 - RNA, 62 nt, Human
ccaccaagguugaugccggauucgaagccaggaaggcccagucccuccucugcucuccucaa

SEQ ID NO: 397755 - RNA, 62 nt, Human
ugcucagccuguuucucucugcccucuagagcaaggcccaccagguccauccaggaggcucu

SEQ ID NO: 397756 - RNA, 62 nt, Human
uguccucccgcgggcccuggugcccuggcaugaaggcccagugcgacaggcccuuggugggg

SEQ ID NO: 397757 - RNA, 62 nt, Human
aaugcuuaauaauaauaaacaaauuaauucuaaaggcccaggccuccaguccuugcaugaaa

SEQ ID NO: 397758 - RNA, 62 nt, Human
accauuuaucuucucugcccaagcccugucuuaaggcccagggggagguuaggagacugaua

SEQ ID NO: 397759 - RNA, 62 nt, Human
cucauagaucauaguccaauccccuagacccaaaggcccagacacgcaggguucucuauuuc

SEQ ID NO: 397760 - RNA, 62 nt, Human
aauucaugaucaacaucucugaaguuucaaguaaggcccacacuucuuugaauuacucuuca

SEQ ID NO: 397761 - RNA, 62 nt, Human
augaacaguggccuggcuggcguggcagggccaaggcccacccacugccaucccccuucugu

SEQ ID NO: 397762 - RNA, 62 nt, Human
auaugacauacagugcuggccacaaccuucugaaggcccaugcccuggcuuggcauguguac

SEQ ID NO: 397763 - RNA, 62 nt, Human
ugugacugcccugcauguguucaugaccuccgaaggcccaaauucaugaagcagcaaaccca

SEQ ID NO: 397764 - RNA, 62 nt, Human
gagcguuccacugagucuacuucaggagacagaaggcccaugcugaugggggaggaggaggg

SEQ ID NO: 397765 - RNA, 62 nt, Human
aauugacaaaaggcccuggcaauuaaauugucaaggcccaagggcuaauuuuaauuuucuuu

SEQ ID NO: 397766 - RNA, 62 nt, Human
gcugaggagggaccugcuuuggggaguaggggaaggcccagggaguggggcagggggcugcu

SEQ ID NO: 397767 - RNA, 62 nt, Human
cagccaggggcuccucgggcccugugcucuagaaggcccauucuaugucugcuucgccagca

SEQ ID NO: 397768 - RNA, 62 nt, Human
acacucuuugguggugacugaggcaucauuagaaggcccagacgauuuccacuauucacagc

SEQ ID NO: 397769 - RNA, 62 nt, Human
ggccacagggcucuccucccagucuuuaucugaaggcccagccaaagcaccccucuaaaccg

SEQ ID NO: 397770 - RNA, 62 nt, Human
gcccuguggugcugggagaugcucucugaggcaaggcccagaccuggccucugccauccucc

SEQ ID NO: 397771 - RNA, 62 nt, Human
cagacccucggagggccaggcaacaggcuagcaaggcccacagggagggagcagaauggaga

SEQ ID NO: 397772 - RNA, 62 nt, Human
cgcuucugacacgguccacgugccuggcucugaaggcccaacugucagaccagaccccucac

SEQ ID NO: 397773 - RNA, 62 nt, Human
cagaaguccugcugaccaccuagucauggacaaaggcccaggaccagugacacccugcgucc

SEQ ID NO: 397774 - RNA, 62 nt, Human
gccgggcugugcuggaugcccugcuggagggcaaggcccaguggggggagaaucuucaggug

SEQ ID NO: 397775 - RNA, 62 nt, Human
agacccugcaggccaugaagagccacucagaaaaggcccauggccauggagcuucaaggaaa

SEQ ID NO: 397776 - RNA, 62 nt, Human
accaucccuucuggccauccaucaaguccaucaaggcccagcccugcugagaaaugugcuuc

SEQ ID NO: 397777 - RNA, 62 nt, Human
ugucugcauauacacacggggaaugccagaagaaggcccagucugcaccaggcgucugguca

SEQ ID NO: 397778 - RNA, 62 nt, Human
acuguucacucugugucuuuugaagugccuugaaggcccagaugaaauuuuaaagggagggg

SEQ ID NO: 397779 - RNA, 62 nt, Human
agaaaagacaacauuggugcuaacagugaaguaaggcccaaaggaaagacggcuucccugga

SEQ ID NO: 397780 - RNA, 62 nt, Human
ucugguaugcuuguuccugcugcuaauaaaguaaggcccauuacuguaucgggaauuucuag

SEQ ID NO: 397781 - RNA, 62 nt, Human
auggcagaugccuagguggaaauagcaaaaacaaggcccaggcuggggccagggccagaggg

SEQ ID NO: 397782 - RNA, 62 nt, Human
gggagguuaggacacgcaggaaagaccacaugaaggcccaggagugggagggggaauagcca

SEQ ID NO: 397783 - RNA, 62 nt, Human
ccuggcccuccugucaucugcugacuucacagaaggcccaggcuacaaaccccacaguuuau

SEQ ID NO: 397784 - RNA, 62 nt, Human
ucagagaggauggccugcagccacaugggaggaaggcccagggguggggcccauggggucuc

SEQ ID NO: 397785 - RNA, 62 nt, Human
cugggggccucgggaggcuaggccccuccucaaaggcccaccagcccggcgcucaugcugag

SEQ ID NO: 397786 - RNA, 62 nt, Human
cgggagagccucgccuggaugcuggggcggggaaggcccaguccccggggcucugcugucag

SEQ ID NO: 397787 - RNA, 62 nt, Human
uaucucaaaaugaucucuuuaguucugucuccaaggcccaggacacuugucagaaggaugca

SEQ ID NO: 397788 - RNA, 62 nt, Human
gagucaagacccuggagggucauaggcuuguaaaggcccacgccacacucggcaggggucuc

SEQ ID NO: 397789 - RNA, 62 nt, Human
uggagauuggcucccaacuccucccuauccuaaaggcccacuggcauuaaagugcuguaucc

SEQ ID NO: 397790 - RNA, 62 nt, Human
ucaucaaugcaauaagauugcgccugagauacaaggcccagaagccugaucuuugggcauca

SEQ ID NO: 397791 - RNA, 62 nt, Human
aggaggagggauuaagauccccuugcuccacuaaggcccaagcucuuucucucggcaccuuu

SEQ ID NO: 397792 - RNA, 62 nt, Human
gacuccugucucugggugaggccgcauccuucaaggcccaugugggcugugcguuucucaga

SEQ ID NO: 397793 - RNA, 62 nt, Human
gaugcccuucucccaaauggcuucccuccuggaaggcccagccugaguccucgucuccuuuc

SEQ ID NO: 397794 - RNA, 62 nt, Human
gccuucauaagcacacacguccauucccuacuaaggcccagaccuccugguaucugccccgg

SEQ ID NO: 397795 - RNA, 62 nt, Human
agccacccgcuaugagcacaggccggggguggaaggcccaguagagcugcccuuccccagau

SEQ ID NO: 397796 - RNA, 62 nt, Human
accauggaccuguugcuaggagauagcuggggaaggcccaaggccgcccagggcagagagag

SEQ ID NO: 397797 - RNA, 62 nt, Human
ggcugugacccgccacacucacugucaguauuaaggcccagcagccuguugauaagcuaccc

SEQ ID NO: 397798 - RNA, 62 nt, Human
uccaugaugggaaccagugguuaguggcuucaaaggcccagcugacacccuccacagccuaa

SEQ ID NO: 397799 - RNA, 62 nt, Human
gcccccuuaggaggaggcuagugcuaagagggaaggcccagguuugagagagcccagagggg

SEQ ID NO: 397800 - RNA, 62 nt, Human
ggcucugcccccucccccaugggcuguguccuaaggcccauuugagaagcugaggcuaguuc

SEQ ID NO: 397801 - RNA, 62 nt, Human
uucgauuagggaaguggagagcacaucccuguaaggcccauaagagaaagaggaguuuguua

SEQ ID NO: 397802 - RNA, 62 nt, Human
caacagacuggccuucuguuuguuacuuucaaaaggcccacaugauacaauuagagaauucc

SEQ ID NO: 397803 - RNA, 62 nt, Human
uacagggcugggggggcccuuggcugcgggagaaggcccagagcccuggaggagccaccacc

SEQ ID NO: 397804 - RNA, 62 nt, Human
gcuucagggaucucucuugcacgggccuugccaaggcccaggagggacuugggcaguauguu

SEQ ID NO: 397805 - RNA, 62 nt, Human
cugucccucacuguugaauuuucucuaacuucaaggcccauaucugugaaaugcuggcauuu

SEQ ID NO: 397806 - RNA, 62 nt, Human
acaccaaagucagggagccuggaagccaaacaaaggcccagcagccuucugacaagcaaggg

SEQ ID NO: 397807 - RNA, 62 nt, Human
caugaaaaggguacagcuuagaccccaaugggaaggcccacccucucuuuacuucuaacuuu

SEQ ID NO: 397808 - RNA, 62 nt, Human
gucaggggcggggagggugacaguggccgcccaaggcccacgagcuuguucuuuguucuuug

SEQ ID NO: 397809 - RNA, 62 nt, Human
guguuuucaggccuuccauuccccauagaggcaaggcccaauggccaguguugcuuaucgcu

SEQ ID NO: 397810 - RNA, 62 nt, Human
uagauauuucgacccuggggcgugcagcagggaaggcccaacugguucaggcucaaccuucc

SEQ ID NO: 397811 - RNA, 62 nt, Human
uccagguccgccuggcaugggacaccaaguggaaggcccaagcagcucaucugcucuuggga

SEQ ID NO: 397812 - RNA, 62 nt, Human
uucauuagugagaaucacaaaguauuuuguagaaggcccaaaucacagaauaaaggacuaag

SEQ ID NO: 397813 - RNA, 62 nt, Human
aggacacagcauguccuuugaacucccuaaguaaggcccacaguucuugaugcagagaacca

SEQ ID NO: 397814 - RNA, 62 nt, Human
ggaaugucuacuuuuguaagugacagguguuaaaggcccaggugugcugugccaaagagcuc

SEQ ID NO: 397815 - RNA, 62 nt, Human
cuccaaggauugagacccaagucaucaugaaaaaggcccaaguacagucuuaaugcgauaaa

SEQ ID NO: 397816 - RNA, 62 nt, Human
cccuccauagacauguguagcaucaaaacacaaaggcccacacuuccugacggaugccagcu

SEQ ID NO: 397817 - RNA, 62 nt, Human
gcccaaaucuuuccaucuagggcaaguccugaaaggcccaaggcccccuccccagucuggcc

SEQ ID NO: 397818 - RNA, 62 nt, Human
gagcccacgugggcccaccccgggcagcagagaaggcccagcugacagggggugaggugugg

SEQ ID NO: 397819 - RNA, 62 nt, Human
cuuccgugccccccaacugugaaucuguaaauaaggcccaaggaacaugucgggaggggggu

SEQ ID NO: 397820 - RNA, 62 nt, Human
gguuuccccacauccuucccagcacccuuaggaaggcccaggcagggccuggaagcagcgga

SEQ ID NO: 397821 - RNA, 62 nt, Human
uggccagcagggacaggggcauugucaucucaaaggcccaacccccagaggccacaccaguc

SEQ ID NO: 397822 - RNA, 62 nt, Human
accuucagucauuaccauguaggccucuuuacaaggcccagcuccuugacaauuuggcaaua

SEQ ID NO: 397823 - RNA, 62 nt, Human
uuccucccuggcccaccccacucacacuccccaaggcccacggcucaaaggcaagcgagcuc

SEQ ID NO: 397824 - RNA, 62 nt, Human
ccgccaggcccagggugggguggaugggcccaaaggcccagccccacacuccuuucccgucc

SEQ ID NO: 397825 - RNA, 62 nt, Human
agugcaccuggagggaaaggaaugugcuuauuaaggcccacuguuuuacuggggcccauugu

SEQ ID NO: 397826 - RNA, 62 nt, Human
ugggccagaccaacagcucgagggagaaccugaaggcccaggggguccagggcggaccuggg

SEQ ID NO: 397827 - RNA, 62 nt, Human
acagaacggagccaucccccaagacccuguccaaggcccagauguuagccaaggacuugucc

SEQ ID NO: 397828 - RNA, 62 nt, Human
agagacccagcuaaagucaccugccuguucuaaaggcccagcuacagccaaucagccgauuu

SEQ ID NO: 397829 - RNA, 62 nt, Human
ucuugcagcucugcgggugugcggccaaaggcaaggcccacgggcuggaugucacuuccccg

SEQ ID NO: 397830 - RNA, 62 nt, Human
gaauuaaacuaaaauacaaguaaagcuagacaaaggcccagaaaucauacuguaaggaaaug

SEQ ID NO: 397831 - RNA, 62 nt, Human
gggacaguaaugguccuccugcuggccccagcaaggcccaugagugacugcccugacguauu

SEQ ID NO: 397832 - RNA, 62 nt, Human
gguggggcagaaaggcugcaacgcugauuccuaaggcccagcugccagggaagacagagcag

SEQ ID NO: 397833 - RNA, 62 nt, Human
uaaaauggugauaaaaaccgacagguuguucaaaggcccagaucagcuaaagcauguauaua

SEQ ID NO: 397834 - RNA, 62 nt, Human
uaaugugcaguuguugccuuuugucuguauugaaggcccauugaaugacuaauccaggcugg

SEQ ID NO: 397835 - RNA, 62 nt, Human
ccucuacacauguuguccugccccuggcaauaaaggcccauuucugcacccuucuguguggc

SEQ ID NO: 397836 - RNA, 62 nt, Human
agcaauuccauuuguucuucuccagcaucucuaaggcccacuugaaugcaaaggaaaacacu

SEQ ID NO: 397837 - RNA, 62 nt, Human
gcucugggccgggccuggggcuccgaaauuccaaggcccagacuugcggggggugggggggu

SEQ ID NO: 397838 - RNA, 62 nt, Human
cuccccuccucccucccauccucacccaggccaaggcccaggggcucugccaggacaccaca

SEQ ID NO: 397839 - RNA, 62 nt, Human
gguggaaggagagggaagcagcggccucggccaaggcccaccccauacucuuggcucuguag

SEQ ID NO: 397840 - RNA, 62 nt, Human
ucagccaugccuauccaaugacgucuccauaaaaggcccaggaacacgggagcuucugaaga

SEQ ID NO: 397841 - RNA, 62 nt, Human
caggagaaaagcaggugcccuaagauugcucuaaggcccagcaugugguuacaguucucuga

SEQ ID NO: 397842 - RNA, 62 nt, Human
cacuuucggcccuuuugcucugggggucccacaaggcccagggcagugccugcucccagaau

SEQ ID NO: 397843 - RNA, 62 nt, Human
ccucgugguuauuagcaaggcuggguaaugugaaggcccaagagcagagucugggccucuga

SEQ ID NO: 397844 - RNA, 62 nt, Human
augcuggagaagaaaaauccucuagacacaugaaggcccacauagucaagucuuccagggca

SEQ ID NO: 397845 - RNA, 62 nt, Human
gucuccuguugccgugggagaugcugcuccaaaaggcccaggcuuccuuuucaaccuaacca

SEQ ID NO: 397846 - RNA, 62 nt, Human
aaugagauucaaaagcugcauuccuuccuccaaaggcccaggacaggacagugcuacccuag

SEQ ID NO: 397847 - RNA, 62 nt, Human
ccucuggggaggcccaagcagcuuguuuugcaaaggcccaaguccuccugcuaggaaaagcu

SEQ ID NO: 397848 - RNA, 62 nt, Human
ggggccugggcagagggccuggaccugggaucaaggcccacgcgcuucccugggguuuacug

SEQ ID NO: 397849 - RNA, 62 nt, Human
cccauggugaugugaagaugagaagaaauagcaaggcccaaccaguucuucaucuggagaca

SEQ ID NO: 397850 - RNA, 62 nt, Human
gcuaugucucuaaacuuuauuuucaaaagcuuaaggcccaaauacaaacuucucuggaauaa

SEQ ID NO: 397851 - RNA, 62 nt, Human
caggguguccagaggggguucugccccuugugaaggcccauuccuggcacuuagagacagaa

SEQ ID NO: 397852 - RNA, 62 nt, Human
cucucuuuauaagaacccuggucauugaauuuaaggcccaccccaaguccagaaugaccucg

SEQ ID NO: 397853 - RNA, 62 nt, Human
ggucugaggagacagcugaccuguuggcugaaaaggcccagaucaccgaggaggaggcaaaa

SEQ ID NO: 397854 - RNA, 62 nt, Human
gaggacaugagaguauuuugcaaagugagggcaaggcccaguguggagugauauuguuauuc

SEQ ID NO: 397855 - RNA, 62 nt, Human
aggggcggggcggggccccccugggaccucuuaaggcccaaggugggccccaggaccucugg

SEQ ID NO: 397856 - RNA, 62 nt, Human
agcgcaugagagguguuuccuuggccuuccagaaggcccacuguggagccagccucccuaug

SEQ ID NO: 397857 - RNA, 62 nt, Human
gggcuguaggggagaguguggcaggugacccaaaggcccaaagagggccguggggccugagg

SEQ ID NO: 397858 - RNA, 62 nt, Human
cacuguuuucgugguuguaacuaauauguggaaaggcccauuuccagguuugcguagaagag

SEQ ID NO: 397859 - RNA, 62 nt, Human
ucagcagcgauggugagcauuuugguuuccuuaaggcccagcaagacuuccagggacaucuc

SEQ ID NO: 397860 - RNA, 62 nt, Human
gcaggcagaccacgguguggggggugccccacaaggcccagcccugggcaaggaagcuuugg

SEQ ID NO: 397861 - RNA, 62 nt, Human
gcuaccugggcaguuguggugggguggaugggaaggcccacagcccaagggauccauaauaa

SEQ ID NO: 397862 - RNA, 62 nt, Human
gcaggcagugcaccucugagugucccuuuuguaaggcccagggguugcacugagucugcaga

SEQ ID NO: 397863 - RNA, 62 nt, Human
ggaaucuuccccuuuguucaaggccuuccaguaaggcccagcuguccccuugcugugcaugg

SEQ ID NO: 397864 - RNA, 62 nt, Human
aggacugccuugguggcuuuguuugcugggacaaggcccacaaccugugccucuccuauuga

SEQ ID NO: 397865 - RNA, 62 nt, Human
ggccuuggcuuggaaggcuggagcuucggaccaaggcccagcccugucaccuccucuucaug

SEQ ID NO: 397866 - RNA, 62 nt, Human
uggacaaucaagaggaugaauggggggaucucaaggcccaaaugcuggaccacaucuccugc

SEQ ID NO: 397867 - RNA, 62 nt, Human
gcagcugguucugggaguuaaaggagcauuggaaggcccaaacccucucccuugaguggcca

SEQ ID NO: 397868 - RNA, 62 nt, Human
cuucugccagagacuuccagcgggcggcuccaaaggcccaaugcagaggagcccgcggagca

SEQ ID NO: 397869 - RNA, 62 nt, Human
uauacucacgaggaauggccuuucuacaaagcaaggcccacagacuaccccacucaagaaca

SEQ ID NO: 397870 - RNA, 62 nt, Human
uugacuuucugucuguggagguggaguaggugaaggcccagccuguaacuguccuuuuucuu

SEQ ID NO: 397871 - RNA, 62 nt, Human
agugauuuuuuuuuuauuugaccaaaaaaaaaaaggcccaagaagaagaaaaugaaaaauuu

SEQ ID NO: 397872 - RNA, 62 nt, Human
cagaacguuccuugccaggccaggcaaaagccaaggcccauuagccaguuuagcauuuacuu

SEQ ID NO: 397873 - RNA, 62 nt, Human
aagauauaauaaaacauuuguuuuugcaaaauaaggcccaauguuauggccuaaugaaagcu

SEQ ID NO: 397874 - RNA, 62 nt, Human
uucaaucuaguccuagaguugugucccucugaaaggcccaaugccauguaacuaacuuuaaa

SEQ ID NO: 397875 - RNA, 62 nt, Human
ccccaaaaguccaaaaauguaauaauuuugacaaggcccaaaguugagaugcuaugaagcuu

SEQ ID NO: 397876 - RNA, 62 nt, Human
uaucccccuacuccuacccucaucucauccuuaaggcccagagguagcuuggacaagcccuc

SEQ ID NO: 397877 - RNA, 62 nt, Human
gaugcauuucugagcuuuccugggcugagcugaaggcccagaaucccgcuagaauauauccu

SEQ ID NO: 397878 - RNA, 62 nt, Human
aucuuaaccuaucaacuuucugccccuccuucaaggcccaguauaaaugccaccuccuccau

SEQ ID NO: 397879 - RNA, 62 nt, Human
gauauaaccuacuuacuccguaaggggaaaugaaggcccagagaagggaagggacuugaccg

SEQ ID NO: 397880 - RNA, 62 nt, Human
aggcugaugcugauuuggccagagaugaccucaaggcccaccaaauagagcacaacuuccca

SEQ ID NO: 397881 - RNA, 62 nt, Human
ucuucugucaccucugcuggcacaccaguggcaaggcccagaauggcgaccucucuuuagcu

SEQ ID NO: 397882 - RNA, 64 nt, Human
cggaagaggccccaauggggcggugaccccagccucgcccgacagagcccggggcgcaggcggg

SEQ ID NO: 397883 - RNA, 64 nt, Human
ccggugagcggcgaagacagcccgguaggcugcgucgcccgagccccgggagagaggagcgaag

SEQ ID NO: 397884 - RNA, 64 nt, Human
gggugccugcggccucgcccgcacgccuagagucucgcccgaucccaucggcaucccggggagg

SEQ ID NO: 397885 - RNA, 64 nt, Human
cgcugugcccugaagggggaugaagggcgaugccucgcccgaggcuuugggcugcugcacugca

SEQ ID NO: 397886 - RNA, 64 nt, Human
gacucacccgaucacagacgagcggucaccagaaucgcccgaucacagacgagcagucaucgga

SEQ ID NO: 397887 - RNA, 64 nt, Human
gacucacccgaucacagacgagcggucaccagacucgcccgaucacagacgagcagucaucgga

SEQ ID NO: 397888 - RNA, 64 nt, Human
gacucacccgaucacagacgagcggucaccggaaucgcccgaucacagacgagcggccaccgga

SEQ ID NO: 397889 - RNA, 64 nt, Human
ugcgcaagcuggcccacguggggcgcagccagacucgcccgacggccacggccccccuccugcc

SEQ ID NO: 397890 - RNA, 64 nt, Human
cugcaagggacugaaggcggagcccauccaacccucgcccgacccaaacaccucauuguuuccc

SEQ ID NO: 397891 - RNA, 64 nt, Human
cccgggagcggggccaugccuccagccccccagcucgcccgacccauccuguucgugaauaggu

SEQ ID NO: 397892 - RNA, 64 nt, Human
agacauacacggacacaucaucggcaugggccugucgcccgacaacaggugggccucuugccag

SEQ ID NO: 397893 - RNA, 64 nt, Human
ccauauugagucugaaguuuguguggaagugagcucgcccgaguuguccggucggaguuguagc

SEQ ID NO: 397894 - RNA, 64 nt, Human
ggccccucacccccagcuggaaauuaagaaaaagucgcccgaaacaccaagugaggccauagca

SEQ ID NO: 397895 - RNA, 64 nt, Human
acggcugggcuccagcugccggcccagcggaucgucgcccgaucaguguuuugagggggaaggu

SEQ ID NO: 397896 - RNA, 64 nt, Human
aaguucauacaaagcgugcacaaggauugaaaauucgcccgagcuguuuauguuuuuauaaaaa

SEQ ID NO: 397897 - RNA, 64 nt, Human
cggcccguggacaccccagaccugcgaaggaugaucgcccgauaaagacggauucuaaggacuc

SEQ ID NO: 397898 - RNA, 64 nt, Human
ugugcgugugaaggaagagcaucuagacguggccucgcccgacaaggcuucaaguccagagcug

SEQ ID NO: 397899 - RNA, 62 nt, Human
agcggccgcagcgaagcugccguucauguguuggaggccaaauguggcaaaccaaccccagg

SEQ ID NO: 397900 - RNA, 62 nt, Human
ugguggcucacgccuguaaucccagcacauugggaggccaaggcagguggaucaccugaggu

SEQ ID NO: 397901 - RNA, 62 nt, Human
ucagaaaagggcugggcuugggaaggggagguggaggccagguguccccagaccucuaaccc

SEQ ID NO: 397902 - RNA, 62 nt, Human
uguuccccugggccccucagaaagucgagcuuggaggccagccuggaucugucucucccuuc

SEQ ID NO: 397903 - RNA, 62 nt, Human
ugauacccuggguggagugggggagcugagcaggaggccagguggcaaccaguagcugcugg

SEQ ID NO: 397904 - RNA, 62 nt, Human
ccuggucacauggugccuagggaugcagggcuggaggccagaggugucagcaacacuguguc

SEQ ID NO: 397905 - RNA, 62 nt, Human
cuggggcuaggagggcagcaggguggccucugggaggccaggauggcacuguuggcaccgag

SEQ ID NO: 397906 - RNA, 62 nt, Human
uaaaaagcacagggggaagaagaagagauuucggaggccauccugccaggggcggacggggc

SEQ ID NO: 397907 - RNA, 62 nt, Human
ugguggcucacgcuuguaaucccagcacuuugggaggccaagguggguggaucaccugaggu

SEQ ID NO: 397908 - RNA, 62 nt, Human
ggaggaaguuggcugagccauugagugcugggggaggccauccaagauggcaugaaucgggc

SEQ ID NO: 397909 - RNA, 62 nt, Human
guaucucaggucuggguccucccucuagccgaggaggccaccugcagccuccacccggcucu

SEQ ID NO: 397910 - RNA, 62 nt, Human
gcucuauccacugcagggccagccacucgccaggaggccacgggccacgggaagaaccaagc

SEQ ID NO: 397911 - RNA, 62 nt, Human
uuucccucugggagccuaaaccaggcugcaucggaggccaggacccggaucauucacuguga

SEQ ID NO: 397912 - RNA, 62 nt, Human
auugggggccuuccauguagaaaguggggucaggaggccaagaaagggaauaugaauguaua

SEQ ID NO: 397913 - RNA, 62 nt, Human
caucugggguuggcaacaggacagaguucacaggaggccagugggcgggccaugagggacag

SEQ ID NO: 397914 - RNA, 62 nt, Human
ccggcccccagagcgccccucccuagugacccggaggccacaugagucccagugggaggcgc

SEQ ID NO: 397915 - RNA, 62 nt, Human
cuggagcugcuggaucccaguguggugguguaggaggccacagugagcagguggccccagcu

SEQ ID NO: 397916 - RNA, 62 nt, Human
caccccaucacgguggcccugagggcugacccggaggccaguggagcugccugguguccacg

SEQ ID NO: 397917 - RNA, 62 nt, Human
caguggcucacaccuguaaucccagcacuuugggaggccaaggugaguggaucaccugaggu

SEQ ID NO: 397918 - RNA, 62 nt, Human
cccaagcagacacaacagcagcacagaggucuggaggccacacaaaaagugaugcucgcccu

SEQ ID NO: 397919 - RNA, 62 nt, Human
agccaugauuacuuuagaccuagcccaggcuuggaggccagcuggaggaagaagggucuaaa

SEQ ID NO: 397920 - RNA, 62 nt, Human
caguggcucacgccuguaaucucaacacuuugggaggccaaggugggaagaucacuugaucc

SEQ ID NO: 397921 - RNA, 62 nt, Human
ugguggcucacaccuguaaucccagcacuuugggaggccaaggcaggcaaucaccugagguc

SEQ ID NO: 397922 - RNA, 62 nt, Human
aagugcccugugcugguugccaggcgcagaggggaggccagcccugcccucaggaccugccu

SEQ ID NO: 397923 - RNA, 62 nt, Human
uccuccuuccagcaccugccagagcuucuccaggaggccaagcagaggcuccccucaugaag

SEQ ID NO: 397924 - RNA, 62 nt, Human
ggcugccaaaggcaagggcuggucuucaggauggaggccagccugugcagaaggcugcagcu

SEQ ID NO: 397925 - RNA, 62 nt, Human
cagucaccccaaggcagguguagggagcccagggaggccaaucagcccccugaagacucugg

SEQ ID NO: 397926 - RNA, 62 nt, Human
ugguggcucaugccuguaaucccgacacuuugggaggccaaggcaggaggauggcuugaagc

SEQ ID NO: 397927 - RNA, 62 nt, Human
gucaugguggccacggccacagccacuaaucaggaggccaggccacccugccucuacccaac

SEQ ID NO: 397928 - RNA, 62 nt, Human
cgguggcucacgccuguaauccuagcacuuugggaggccaaggugggaggauugcuugagcu

SEQ ID NO: 397929 - RNA, 62 nt, Human
aaacgggucaguauuaagguuuucaaccggaaggaggccaaccagcccgacagugccauccc

SEQ ID NO: 397930 - RNA, 62 nt, Human
cgguggcucacgccuguaaucccagcacuuugggaggccaaggugggcggaucgccugaggu

SEQ ID NO: 397931 - RNA, 62 nt, Human
ugguggcucacaccuguaaucccagcacuuugggaggccaaggugggugggucaucugaggu

SEQ ID NO: 397932 - RNA, 62 nt, Human
caguggcucaugccuauaauuccagcacuuugggaggccaaggcagaaggaucacuugagac

SEQ ID NO: 397933 - RNA, 62 nt, Human
ugguaguuuaagccuauaaucucagcccuuuuggaggccaagguaagaggaucgcuugaggu

SEQ ID NO: 397934 - RNA, 62 nt, Human
ugguggcucaugccucuaaucucagcacuuugggaggccaaggugggcggaucacuugaggu

SEQ ID NO: 397935 - RNA, 62 nt, Human
caguggcucacaccuguaaucccaacaccuugggaggccaaggugggcggaucacuugaggu

SEQ ID NO: 397936 - RNA, 62 nt, Human
gucagcccccaaaccaaaguugucccaacagaggaggccagugaggcagagacagagcucuc

SEQ ID NO: 397937 - RNA, 62 nt, Human
cugccugcaucugccacuuucugcuacccuagggaggccaggaggagcuucggaggaccauc

SEQ ID NO: 397938 - RNA, 62 nt, Human
ugguggaucacgccuguaaucccagcacucugggaggccaaagcgggcagaucaccugaggu

SEQ ID NO: 397939 - RNA, 62 nt, Human
acugggcugauccugaauggcacaggccaaggggaggccagccucgccuuucuacccaggcc

SEQ ID NO: 397940 - RNA, 62 nt, Human
cgguggcucaugccuauaaucccagcacuuugggaggccaagguggguggaucaccugaggu

SEQ ID NO: 397941 - RNA, 62 nt, Human
ccugcuuuuuucuguuuuuacaguggaaucuaggaggccacuuagucgucuuuuuuuccucu

SEQ ID NO: 397942 - RNA, 62 nt, Human
uccucucugcuguuccucucuacaagaaccugggaggccaacgccuaaagaucauaauauca

SEQ ID NO: 397943 - RNA, 62 nt, Human
cagaaagcaugcugugugggggcugcuucucaggaggccaggcccuucugagcggaaccguc

SEQ ID NO: 397944 - RNA, 62 nt, Human
cgguggcucacgccuguaaucccagcacuuugggaggccaaggugggcggaucacaagguca

SEQ ID NO: 397945 - RNA, 62 nt, Human
cucauggcguaaugggccugcccaaugcuuugggaggccaaggcagguagaucgcuugagcc

SEQ ID NO: 397946 - RNA, 62 nt, Human
ucugcaccacauggcgggguuggggggccgcuggaggccaccugccaaggcgugggauggga

SEQ ID NO: 397947 - RNA, 62 nt, Human
auggagcagcucuugggauccuuuggggaaaaggaggccauucugggccccuuggcaaaccu

SEQ ID NO: 397948 - RNA, 62 nt, Human
cuccccaggcaagcucugaagucccugcagguggaggccaugccugucuuaaacucaguugc

SEQ ID NO: 397949 - RNA, 62 nt, Human
ucuaggugcagcagcuccaagcaugggaccaaggaggccagaaccugucgcuggaaaccagg

SEQ ID NO: 397950 - RNA, 62 nt, Human
agguggcucacgccuguaaucccaguaguuugggaggccaaggcgggcagaucaccugaggu

SEQ ID NO: 397951 - RNA, 62 nt, Human
ugguggcucaugccuguaaucccaacacuuugggaggccaaggcaggcagaucacuuaaggc

SEQ ID NO: 397952 - RNA, 62 nt, Human
gucgggguccuccagggagcugacccagagguggaggccacggaggcagggucucuggggac

SEQ ID NO: 397953 - RNA, 62 nt, Human
ggauacuuguacauagguaaccaauguacaugggaggccacauauuuuguucacuguuguau

SEQ ID NO: 397954 - RNA, 62 nt, Human
ugguggcucacaccuauaaccccagcacuuugggaggccaaggcaggcagaucaccugaagu

SEQ ID NO: 397955 - RNA, 62 nt, Human
gaaagggaccauugggugcauagagauggggaggaggccacugggcugaauuuucucuuuag

SEQ ID NO: 397956 - RNA, 62 nt, Human
gcacaccucaugccuguaaucccagcacucugggaggccaaggcagaugaucaccugagguc

SEQ ID NO: 397957 - RNA, 62 nt, Human
aagcccuguucugagaacgagcagacugcaggggaggccaugggauuccccaggccaguguc

SEQ ID NO: 397958 - RNA, 62 nt, Human
uaauuuacacuuaccaccucauuugcuuuucuggaggccaugcaauauaggcgggacuacag

SEQ ID NO: 397959 - RNA, 62 nt, Human
acgguggcucacgccuguaaucccaguacuugggaggccaaggcaggcauaucaacuugagg

SEQ ID NO: 397960 - RNA, 62 nt, Human
cuguggcucacgccuauaaucccagcacuuugggaggccaaggcaggcggaucccugaguuc

SEQ ID NO: 397961 - RNA, 53 nt, Human; identical to SEQ ID NO: 287217

SEQ ID NO: 397962 - RNA, 62 nt, Human
cuucuguucuugaucucuuagggauccuauagggaggccauuuccuguccuggaauuaguuu

SEQ ID NO: 397963 - RNA, 62 nt, Human
ugguggcucacaccuguaaucccuguacuuugggaggccaaggggggagaucacuugagguc

SEQ ID NO: 397964 - RNA, 62 nt, Human
ugguggcucacgccuguaaucccaacacuuugggaggccaaggcaggcggaucaccugaggu

SEQ ID NO: 397965 - RNA, 62 nt, Human
uauucuuugaggggucacuggcuuuaggacagggaggccagggaagagguggguuggggagg

SEQ ID NO: 397966 - RNA, 62 nt, Human
cccuaccagccagggguuuccaagggaccuuuggaggccaugcuuagacacauuccuguacc

SEQ ID NO: 397967 - RNA, 62 nt, Human
uccccacagggugcccgguccccacggcgcaaggaggccaagcucagcugugugucugagcc

SEQ ID NO: 397968 - RNA, 62 nt, Human
cauggggugccgagccaacgccucaggaaucaggaggccagccugguaccaaaaggaguacc

SEQ ID NO: 397969 - RNA, 62 nt, Human
cuugcucuugugccuccugggcaagggcugaaggaggccacuccaucucaccucggggggcu

SEQ ID NO: 397970 - RNA, 62 nt, Human
uggugggucacgccuguaaucccagcacuuugggaggccaaggcggguugaucacccgaggu

SEQ ID NO: 397971 - RNA, 62 nt, Human
uuugggugagaacugagaggugggagaugauuggaggccauggccuauguacaaacauacug

SEQ ID NO: 397972 - RNA, 62 nt, Human
uuccaaggggguuucagucuggacuuauacagggaggccagaagggcuccaugcacuggaau

SEQ ID NO: 397973 - RNA, 62 nt, Human
ugguggcucaugccuguaaucccagcacuuggggaggccaaggcaggcggaucacaugaggc

SEQ ID NO: 397974 - RNA, 62 nt, Human
agggcgaagacccuuauuacacggaaaacgguggaggccagggcuauagcucaggaccuggg

SEQ ID NO: 397975 - RNA, 62 nt, Human
aaacucacagagcccuugugcagauccagcauggaggccacccucaggagugacuucucauc

SEQ ID NO: 397976 - RNA, 62 nt, Human
agcuuaucaaaugaaguauuauuuuguggacuggaggccaaaaagucaaugugagcuucuca

SEQ ID NO: 397977 - RNA, 62 nt, Human
caccugggggcgcgggcgggggaccccugcugggaggccaggagacugccccugcugccuuc

SEQ ID NO: 397978 - RNA, 62 nt, Human
caggggcucacaccuguaauccuagcacuuugggaggccaaggcggguggaucacuugagac

SEQ ID NO: 397979 - RNA, 62 nt, Human
ggaaaguugugucuucugggaaagagaccuggggaggccaggaguagcugaggguccuuucu

SEQ ID NO: 397980 - RNA, 62 nt, Human
caguggcucacgccuguaaucccagcacuuugggaggccaaggcaaacggaucacgagguca

SEQ ID NO: 397981 - RNA, 62 nt, Human
acucccuuccugcuguguuauagaacuguaggggaggccauggaaaugacucuaaagauaca

SEQ ID NO: 397982 - RNA, 62 nt, Human
ccagcuggggggcaggggggagaggggguaauggaggccaagccugcagcuuucuggaaauu

SEQ ID NO: 397983 - RNA, 62 nt, Human
agcccuagugggagcccagcacacugcuucucggaggccaggcccuccugcuggcugaggcu

SEQ ID NO: 397984 - RNA, 62 nt, Human
gagcagggcccucagaggaaaggcaguauggcggaggccaugggggccccucggcauucaca

SEQ ID NO: 397985 - RNA, 62 nt, Human
cgguggcucacgccuguaaucccaacacuuugggaggccaagguggguggaucacaagguca

SEQ ID NO: 397986 - RNA, 62 nt, Human
uuuucagugucuucucggaaaaaaccauccuuggaggccacaagugaugagaaggauucuuu

SEQ ID NO: 397987 - RNA, 62 nt, Human
cacgguggcucaccuguaaucccagcacuuugggaggccaaggcgggcagaucaccugaggu

SEQ ID NO: 397988 - RNA, 62 nt, Human
acuggauuaacuaauacuuuauaggcuuuucaggaggccacaucacuagcaguagggagaac

SEQ ID NO: 397989 - RNA, 62 nt, Human
gcuugcaccuccacaaaguaagguuggcccuuggaggccauguuugggucuccggccagggc

SEQ ID NO: 397990 - RNA, 62 nt, Human
gaacugcugaggaugggggguguccccucagcggaggccaagggaggggagcagccuaguug

SEQ ID NO: 397991 - RNA, 62 nt, Human
gcacaggccaccccccucuucaggcugcugcaggaggccaggcccaggccagagaccccagg

SEQ ID NO: 397992 - RNA, 62 nt, Human
cgguggcucaggccuguaaucccagcacuuugggaggccaagaugggcggaucaugaaguca

SEQ ID NO: 397993 - RNA, 62 nt, Human
ugguagcacacaccuguagucccagauacuugggaggccaaggcaggaggauugcuugagac

SEQ ID NO: 397994 - RNA, 62 nt, Human
cgguggcucacgccuguaaucccagcacuuugggaggccaaggugggcggaucaccugaugu

SEQ ID NO: 397995 - RNA, 62 nt, Human
uaguggcucacaccuguaaucccagcacuuugggaggccaaggagggcagaucacuucaggu

SEQ ID NO: 397996 - RNA, 62 nt, Human
caguggcucacgccuguaaucccagcacuuugggaggccaagguggguggaucaccuguggu

SEQ ID NO: 397997 - RNA, 62 nt, Human
augcagcccccauuguggucacaggaaguagaggaggccacguucuuacuaguuucccuugc

SEQ ID NO: 397998 - RNA, 62 nt, Human
ugguggcucaugccuguaaucucaguacauugggaggccaaggcagguggaucaccugaggu

SEQ ID NO: 397999 - RNA, 62 nt, Human
gcucugguauuaaccuggaagccccccuggcuggaggccaccgccacccuaggaagggggca

SEQ ID NO: 398000 - RNA, 62 nt, Human
ugguggcuuacgccuguaauccuagcacuuugggaggccaagacgggcggaucaccugaggu

SEQ ID NO: 398001 - RNA, 62 nt, Human
gaaaguauuggacugagauauuugguuaccauggaggccaaugcuuuuuucaucuuauuaaa

SEQ ID NO: 398002 - RNA, 62 nt, Human
cccugcagggucagaaccuccccacccccaggggaggccaggcagaagccugggucacagca

SEQ ID NO: 398003 - RNA, 62 nt, Human
uuguuccuuuuccuacaaaggaagcagucucuggaggccagaaagaaaagccuucuuuuuca

SEQ ID NO: 398004 - RNA, 62 nt, Human
uggugucuguguacccgcuggucuuguuuggaggaggccaagugaaugugcagcuucaaaga

SEQ ID NO: 398005 - RNA, 62 nt, Human
gcagcugcacccacccugcuugaucccaccugggaggccaggacacugaggagcucugaacc

SEQ ID NO: 398006 - RNA, 62 nt, Human
uggcccaugguccugcuucaugcuuugggucaggaggccaaagcugauguucaggccccacc

SEQ ID NO: 398007 - RNA, 62 nt, Human
ugguggcucacgccuguaaucccagcacuuugggaggccauggcggguggaacauuugaggg

SEQ ID NO: 398008 - RNA, 62 nt, Human
cgguggcugacaccuguaaucccagcacuuugggaggccaagguggggggauuacccgaggu

SEQ ID NO: 398009 - RNA, 62 nt, Human
gcaggcaaagccugugugacuguggcagugccggaggccaagggggccaagaggaaaagcau

SEQ ID NO: 398010 - RNA, 62 nt, Human
caaggcugagcaggguuccuguggcccaggauggaggccaccgcugcccugccaucccgucu

SEQ ID NO: 398011 - RNA, 62 nt, Human
ugagcaguucaucuuuuccagagguaaggguaggaggccaacuucagggucugggucugagc

SEQ ID NO: 398012 - RNA, 62 nt, Human
gcguggugugugccuguagucucagcuacuugggaggccauggugggaggauggguugagca

SEQ ID NO: 398013 - RNA, 62 nt, Human
caguggcucacuccuguaauccgagcaauuugggaggccaaggugggaguuuugcuugaggc

SEQ ID NO: 398014 - RNA, 62 nt, Human
ugagcuuuggaaauguuuucuaauagacacagggaggccaguucuguuucagagcaauuauc

SEQ ID NO: 398015 - RNA, 62 nt, Human
acugugcuggccuggagagugcuggggcagguggaggccagggaauggucccauacaguuau

SEQ ID NO: 398016 - RNA, 62 nt, Human
aacucagccucgcaagagguggcagaggcacaggaggccacaguccuuccuggggcauucca

SEQ ID NO: 398017 - RNA, 62 nt, Human
uguauguauuuccaccugaggagaaggccuggggaggccacagugcaccauugcacagggcu

SEQ ID NO: 398018 - RNA, 62 nt, Human
acaugagagaagcagaaggaggaaacauaagaggaggccaaaaguuaaacguucuaaaaaga

SEQ ID NO: 398019 - RNA, 62 nt, Human
gccccucaccccccacccacacugcagguagaggaggccaucugaucccaugggaagccauc

SEQ ID NO: 398020 - RNA, 62 nt, Human
uguuggagaauaagucagucugaggggaaaugggaggccagagaugagaacccuuugaaaag

SEQ ID NO: 398021 - RNA, 62 nt, Human
cucccugaaccagggagacagccucugggauuggaggccagaggccagggucagacccagcc

SEQ ID NO: 398022 - RNA, 62 nt, Human
gcaggccccgcccucucacagaggaugggugaggaggccagaccugcccugccccauugucc

SEQ ID NO: 398023 - RNA, 62 nt, Human
caguggcucacaccuguaaucccagcacguugggaggccaaggcgggcagaucacgagguca

SEQ ID NO: 398024 - RNA, 62 nt, Human
gccaugagugacgggcagugaccagagggacuggaggccagcgguguccacccuugcccuca

SEQ ID NO: 398025 - RNA, 62 nt, Human
uggugacucaugccuguaaucccggcacuuugggaggccaagggaggugaucacuugagccc

SEQ ID NO: 398026 - RNA, 62 nt, Human
guacccaaggugcgguagggggucgagggggaggaggccaccugaccaaaugccgccaaccc

SEQ ID NO: 398027 - RNA, 62 nt, Human
cgugucacccugccuggaagaggucuggguggggaggccaguucccauaggaaggagucugc

SEQ ID NO: 398028 - RNA, 62 nt, Human
ccguccaccccagagacccugcccuuccacccggaggccaaaggccaacuguacucccaaag

SEQ ID NO: 398029 - RNA, 62 nt, Human
auuugauauucacuuuacucacaaguagugcgggaggccagcuccuggcaggcccucgcgau

SEQ ID NO: 398030 - RNA, 62 nt, Human
ugccgcaagggaagccucaggaaccagcaccuggaggccaggauagccaagcccugggugag

SEQ ID NO: 398031 - RNA, 62 nt, Human
ugagcacaucggcacagcaugcauccagcucuggaggccacggugcaggcauagcugccugc

SEQ ID NO: 398032 - RNA, 62 nt, Human
cacacaagcacacacacacaguccucacacacggaggccagacacaggccgugggacccagg

SEQ ID NO: 398033 - RNA, 62 nt, Human
ggagccagcuggaagggaaggagaggggccagggaggccacaggcccggccauaugagcauc

SEQ ID NO: 398034 - RNA, 61 nt, Human; identical to SEQ ID NO: 287304

SEQ ID NO: 398035 - RNA, 62 nt, Human
cuuggaaaagguuuucuggggaggaggaggcuggaggccaggacacuguuuguuguggaacu

SEQ ID NO: 398036 - RNA, 62 nt, Human
ucccaccccuacacacacacucccugcuugcaggaggccaaacugucccucccuugcugaac

SEQ ID NO: 398037 - RNA, 62 nt, Human
ccugcugggcuccccccagugggaugggacagggaggccacacgcacuggugccaaaaccag

SEQ ID NO: 398038 - RNA, 62 nt, Human
agagcugcagccagcucugcccucuacccuagggaggccagaaagacacaaacagcccuccg

SEQ ID NO: 398039 - RNA, 62 nt, Human
cgguggcucaugccuguaaucccagcacuaugggaggccagggagggaggaucuccagaggu

SEQ ID NO: 398040 - RNA, 62 nt, Human
cauccauggcuaaugaaagauaccaagaacauggaggccaagaaacucuccaaggaccggau

SEQ ID NO: 398041 - RNA, 62 nt, Human
gcugccagggccuguggaggacaggccagagaggaggccagcaggcccagaguccccagggg

SEQ ID NO: 398042 - RNA, 62 nt, Human
ggcagauugggugguagugggagguugugcauggaggccagugaaagcugacaucuguaaaa

SEQ ID NO: 398043 - RNA, 62 nt, Human
cucccaccuguccccagaucagucucugggauggaggccagagagcuggucaggcuccccca

SEQ ID NO: 398044 - RNA, 62 nt, Human
uggugacucacaccuguaauuccagcacuucaggaggccaaggugggaagaucauuugaguu

SEQ ID NO: 398045 - RNA, 62 nt, Human
gaguggcuuacaccuauaaucccagcaauuugggaggccaaggugggcagaucacuugaggu

SEQ ID NO: 398046 - RNA, 62 nt, Human
ggucuauucacugcaucccagugauacaaaguggaggccacugccuucugacaucuggcuca

SEQ ID NO: 398047 - RNA, 62 nt, Human
uauaccuuauccauaggcgcaggugcacagggggaggccauaaagaucaaacaugcauggau

SEQ ID NO: 398048 - RNA, 62 nt, Human
uguccccgugcaguaggggcuacugugaccauggaggccagugccagcaccugcccaguggg

SEQ ID NO: 398049 - RNA, 62 nt, Human
cugugacauuucagccugaccaugaagacggcggaggccaggagacguucaacgccaccgga

SEQ ID NO: 398050 - RNA, 62 nt, Human
acgucuguagaucuguacauaucugggccuuuggaggccacguguggcaugggaggggcuac

SEQ ID NO: 398051 - RNA, 62 nt, Human
uggcugggcccucucccaccugccuguucaguggaggccagggcagcagcccagaacagcac

SEQ ID NO: 398052 - RNA, 62 nt, Human
uaguggcucacgccuguaaucccagcacuuuaggaggccaaggcggguggaucaccugaggu

SEQ ID NO: 398053 - RNA, 62 nt, Human
aauggcucacaccuguuaaucccagcacuucgggaggccaaggugggcaguucgcuugggcc

SEQ ID NO: 398054 - RNA, 62 nt, Human
acagauaacauuuuuuuuuguuuuuuggguguggaggccauuuuuagagauacagaauugga

SEQ ID NO: 398055 - RNA, 62 nt, Human
caaugggauaugccugcaggcccagcuacacgggaggccaaggcaggaggaucacuugaaau

SEQ ID NO: 398056 - RNA, 62 nt, Human
cgguggcucacgccuguaaucccagcacuuugggaggccaagguggguggaccacaugaggu

SEQ ID NO: 398057 - RNA, 62 nt, Human
ugguggcucacgccugugaucccagcacuuugggaggccaagacgggcggaucaugagguca

SEQ ID NO: 398058 - RNA, 62 nt, Human
caguggcucaugccuauauucccugcacuuugggaggccaaagcaggaggaucgcuugagcc

SEQ ID NO: 398059 - RNA, 62 nt, Human
cgguggcucaagccuguaaccccagcacuuugggaggccaaggagggaggaucacaagguca

SEQ ID NO: 398060 - RNA, 62 nt, Human
ugacugaugccuguaaucccaacacuuuguugggaggccaaagcaggaggauagcuugaggc

SEQ ID NO: 398061 - RNA, 62 nt, Human
aagucuguuucaaaaaguguggccucagcucuggaggccacccccaggaaggaguuugaggu

SEQ ID NO: 398062 - RNA, 62 nt, Human
cucagcacucggggcaacacaguggaaaguggggaggccauagacccaaacaaguucuuugg

SEQ ID NO: 398063 - RNA, 62 nt, Human
cgguggcucacgccuguaaucccagcacuuuaggaggccaagguagguggaucacuugaggu

SEQ ID NO: 398064 - RNA, 62 nt, Human
cgguggcucacgccuguaaucccagcccuuugggaggccaaggcggguggaucacuugaggu

SEQ ID NO: 398065 - RNA, 62 nt, Human
ugguggcucacaccuauaaucccaacacuuucggaggccaaggagggacaaacgaacccuug

SEQ ID NO: 398066 - RNA, 62 nt, Human
ugagcacauaggacucuagacggcauccagccggaggccagagcugagcccucagcccggga

SEQ ID NO: 398067 - RNA, 62 nt, Human
uagggcuggaaucugucuaggagcccucucucggaggccacagaggcuggggguagccauug

SEQ ID NO: 398068 - RNA, 62 nt, Human
agcaaagugcagguuaugcaagucgccaggcaggaggccauuccaggagugggauuauucau

SEQ ID NO: 398069 - RNA, 62 nt, Human
aaaaccaucuguaaaagacugaggugggggugggaggccagcacgguggugaggcaguugag

SEQ ID NO: 398070 - RNA, 62 nt, Human
aaaaccaucuguaaaagacuggggugggggugggaggccagcacgguggugaggcaguugag

SEQ ID NO: 398071 - RNA, 62 nt, Human
ugguggcucaugccuguaaucccagcacuuugggaggccaagguaggcagaucaccugaggu

SEQ ID NO: 398072 - RNA, 62 nt, Human
ugguggcucacaccuguaauccaagcacuuugggaggccaaggugggagcaucacuugaucc

SEQ ID NO: 398073 - RNA, 62 nt, Human
auccauggaagugcacuuaggcuugcugugguggaggccauaguggagaugaaggcucugcu

SEQ ID NO: 398074 - RNA, 62 nt, Human
aguguagcugccagcguagaaacccaugaaaaggaggccacaggagauuccugggagcacug

SEQ ID NO: 398075 - RNA, 62 nt, Human
uaguggcgcacaccugcaaucccaacacuuugggaggccaagagaggaagauugcuugagcc

SEQ ID NO: 398076 - RNA, 62 nt, Human
gguggccugacaccugcaaucccaacauuuugggaggccaaggugggagggucccuuccuug

SEQ ID NO: 398077 - RNA, 62 nt, Human
caguggcucauuccuguaaucccagcacuuugggaggccaaggcgggcagaucaccuuaggu

SEQ ID NO: 398078 - RNA, 53 nt, Human; identical to SEQ ID NO: 287355

SEQ ID NO: 398079 - RNA, 62 nt, Human
caguggcucacaccuguaaucccagcacuuugggaggccaaaguggguggaucacuugagga

SEQ ID NO: 398080 - RNA, 62 nt, Human
aggcauucgccugccucucacaaauguuucagggaggccaguucugcagggugucagcucca

SEQ ID NO: 398081 - RNA, 62 nt, Human
aggagugcagggaggggcaggaaaggagacaaggaggccaguauggacacuguguccaguau

SEQ ID NO: 398082 - RNA, 62 nt, Human
guuucugcucuuugucagcuuucaggggagaaggaggccacuggaaaauuauuucccuaagu

SEQ ID NO: 398083 - RNA, 62 nt, Human
guaagccuagguguugucagcaggcaggcuggggaggccaguguugugggcuuccugcuggg

SEQ ID NO: 398084 - RNA, 62 nt, Human
caguggcucaugccuauaaucccagcacuuugggaggccaaggugggcggaucaccugagcu

SEQ ID NO: 398085 - RNA, 62 nt, Human
ugguggcucaugccuguaaucccaacacuuugggaggccaaggaggguggaucacuuaaggu

SEQ ID NO: 398086 - RNA, 62 nt, Human
gguagcucacguccuauagucgcagcacuuugggaggccaaggugggcaguucacgugaggu

SEQ ID NO: 398087 - RNA, 62 nt, Human
cuauaagaugcagucucagaggaucagcaaguggaggccaucaguauugacuuucucuuacu

SEQ ID NO: 398088 - RNA, 62 nt, Human
gcagggacugccggccccggagucucccacagggaggccauuccccuucuacucaccgacau

SEQ ID NO: 398089 - RNA, 62 nt, Human
ccgaaucccagggcuggguguagguagccguuggaggccaucgcuacagggcaccuaucugu

SEQ ID NO: 398090 - RNA, 62 nt, Human
aucguccccggggcaguugcgugacccugcugggaggccagaccgggccagacugaggguca

SEQ ID NO: 398091 - RNA, 62 nt, Human
ucucucaacaucacauacagcuucagcugccuggaggccagaaggaaagggcagugcagggg

SEQ ID NO: 398092 - RNA, 62 nt, Human
agcuaucugggacauuauuggcagugggcccuggaggccagucccuagccccccuugccccu

SEQ ID NO: 398093 - RNA, 62 nt, Human
ugcaggggccgugaccagcccucugccuccagggaggccaacugacucugagccaggguucc

SEQ ID NO: 398094 - RNA, 62 nt, Human
ucuagcuucccauucccagagcaaggcaggcgggaggccaaggacuggacuuggcuuauuuc

SEQ ID NO: 398095 - RNA, 62 nt, Human
cucaagaauguacaguggcuccccaaugccuuggaggccauaaggccagccaguucuagcuc

SEQ ID NO: 398096 - RNA, 62 nt, Human
gggucuagcucuaccacauucaggaggccucaggaggccagccugccaugagagcacauguc

SEQ ID NO: 398097 - RNA, 62 nt, Human
cucagugccauagccuuaccgcagccugcgcgggaggccacagcccgugccgauuccagugc

SEQ ID NO: 398098 - RNA, 62 nt, Human
ugguggcucacaccuguaaucccaacacuuugggaggccaaggcagguagaucacuugaugc

SEQ ID NO: 398099 - RNA, 62 nt, Human
cucugcagccggaggaggagauguugaggggaggaggccagccagugugaccggcgcuagga

SEQ ID NO: 398100 - RNA, 62 nt, Human
ugccuacugucaguggcuuugccaagaugggaggaggccagugcccacuugcccaccgaccu

SEQ ID NO: 398101 - RNA, 62 nt, Human
caguggcucacgccuguaaucccaacaccuugggaggccaaggcaggcagaucacgacauca

SEQ ID NO: 398102 - RNA, 62 nt, Human
agagcaacacaggauggucucugccaugaacuggaggccaggaaucuccucacugaaaauua

SEQ ID NO: 398103 - RNA, 62 nt, Human
uguccugcccucccagcaauaaccaccucccuggaggccagcugagaugccuggcuacuugg

SEQ ID NO: 398104 - RNA, 62 nt, Human
cgguggcucacgccuguaaucccagcacuuugggaggccaaggcgggcagaccaugagguca

SEQ ID NO: 398105 - RNA, 62 nt, Human
caguggcucauaccuguaaugccagcacuuugggaggccaaggcgggcagaucacgagguca

SEQ ID NO: 398106 - RNA, 62 nt, Human
gagauucaccaguaaggggagggaggggcccuggaggccacauccugccccaccccaccccc

SEQ ID NO: 398107 - RNA, 62 nt, Human
aguugaugcuuccccagggucccccuggcuggggaggccaagaauagggaagggacuuguag

SEQ ID NO: 398108 - RNA, 62 nt, Human
uggugacucacaccuauaaucccaauacuuugggaggccaaggcaggaggauugcuugaggu

SEQ ID NO: 398109 - RNA, 62 nt, Human
uugccagguaaagaaaccauggcauaaagcugggaggccaaacacccaagcacaaacugucg

SEQ ID NO: 398110 - RNA, 62 nt, Human
caguggcucacaccuguaaucccagcacuuugggaggccaaggcgagcggaucaugagguca

SEQ ID NO: 398111 - RNA, 62 nt, Human
cgguggcucacgccuguaauccuagcacuuugggaggccaaguugggcagaucacaaguuca

SEQ ID NO: 398112 - RNA, 62 nt, Human
ucagcccaagguuccuccucuccuaccaagcaggaggccaggaacuucuuuggacuuggaag

SEQ ID NO: 398113 - RNA, 62 nt, Human
ggcucacgccuguaaucccagcacuuacuuugggaggccaaggugggcagauaaccugcggu

SEQ ID NO: 398114 - RNA, 62 nt, Human
ugguggcucacgccuguaauuccagugcuuugggaggccaagaugggaggaucauuugagcc

SEQ ID NO: 398115 - RNA, 62 nt, Human
ggaggcugggcggguacagcgcggaggaggagggaggccaggcgggcauggcguggaggagg

SEQ ID NO: 398116 - RNA, 62 nt, Human
aucaugcccuuugcagggacauggauggagcuggaggccauuauccuucauaaacuauugca

SEQ ID NO: 398117 - RNA, 61 nt, Human; identical to SEQ ID NO: 287399

SEQ ID NO: 398118 - RNA, 62 nt, Human
cucagaaacugcuagguaaaagaauuccagaaggaggccagggcauaaguuggaugaccuau

SEQ ID NO: 398119 - RNA, 62 nt, Human
ggagaugggaagacagggaaaggaaggcagcaggaggccacaagcccaccaggucuucaugu

SEQ ID NO: 398120 - RNA, 62 nt, Human
ugcaagaaucuggagcugggaaaaggguucuuggaggccaggggaauacggggucccagaga

SEQ ID NO: 398121 - RNA, 62 nt, Human; identical to SEQ ID NO: 287403

SEQ ID NO: 398122 - RNA, 62 nt, Human
caguggcucauuccuguaaucccagcacuuugggaggccaaggggacaggacugcuugaggc

SEQ ID NO: 398123 - RNA, 62 nt, Human
guggcuggggccugggagaggccaggugaaugggaggccagggccccagacuccccgaaguu

SEQ ID NO: 398124 - RNA, 62 nt, Human
aggggacuguguuucuuuaaggaugcugaccuggaggccaccgagaggcuggggcuggggcu

SEQ ID NO: 398125 - RNA, 58 nt, Human; identical to SEQ ID NO: 287410

SEQ ID NO: 398126 - RNA, 62 nt, Human
gggcuccuccucaggcugcugccaacccaccuggaggccaccucccuccaggagaucccagg

SEQ ID NO: 398127 - RNA, 62 nt, Human
cuucccacaugcugaagcgaggacuagaggcuggaggccaagcagcugagccaaagaagauc

SEQ ID NO: 398128 - RNA, 62 nt, Human; identical to SEQ ID NO: 287413

SEQ ID NO: 398129 - RNA, 62 nt, Human; identical to SEQ ID NO: 287414

SEQ ID NO: 398130 - RNA, 62 nt, Human
uggaggcucaugccuguaaucccagcacuuugggaggccaaggugggcggaucacgagguca

SEQ ID NO: 398131 - RNA, 62 nt, Human
acaucaaccuccgccuuaagcuauguauguauggaggccagucgcagcuuuauuaugcagac

SEQ ID NO: 398132 - RNA, 62 nt, Human
cagugccucaugccuauaaucccagcacuuugggaggccaagguggguggaucacuugaguu

SEQ ID NO: 398133 - RNA, 53 nt, Human; identical to SEQ ID NO: 287418

SEQ ID NO: 398134 - RNA, 62 nt, Human
cagggccugcuuggaggaaggauuugugugucggaggccacuccgagggcaauucuguuagg

SEQ ID NO: 398135 - RNA, 62 nt, Human
uuccuucuuggucagagguagcugcagaggggggaggccaaggguuuggucuaagcugugcc

SEQ ID NO: 398136 - RNA, 62 nt, Human
ugggggcagcaggggccugggccauagcugggggaggccagacccugagggcuuugcagggc

SEQ ID NO: 398137 - RNA, 62 nt, Human
ugcuggcucacaucuguaaugccagcacuuugggaggccaagguggguggaucaccugaggg

SEQ ID NO: 398138 - RNA, 62 nt, Human
caguggcucaugccuauaaucuuagcacuuugggaggccaagguaggaggauugcuugaagc

SEQ ID NO: 398139 - RNA, 62 nt, Human
ggccuauccugauccuuggaggaggaggaagaggaggccacuguggcccguggcccugcccu

SEQ ID NO: 398140 - RNA, 62 nt, Human
guagggcacaaagauggauguaaugcacuuugggaggccaaggcgggaggauugcuugagcc

SEQ ID NO: 398141 - RNA, 62 nt, Human
cgguggcuuacaccuguaacccuggcauuuugggaggccaaggugggcagauugccugagcu

SEQ ID NO: 398142 - RNA, 62 nt, Human
ugguggcucaccccuguaaucccagcacuuugggaggccaaggcggguggaucaugagguca

SEQ ID NO: 398143 - RNA, 62 nt, Human
aucagugggccuccaaggaggggcuguaaaauggaggccauugugugagccuaucagaguug

SEQ ID NO: 398144 - RNA, 62 nt, Human
cgguggcucacgccuguaaucccagcacuuugggaggccaagguggggggaucacaagguca

SEQ ID NO: 398145 - RNA, 62 nt, Human
cgguggcucaugccuauaaucccagcacuuugggaggccaaggugggcagaucaggagguca

SEQ ID NO: 398146 - RNA, 62 nt, Human
caaacaugggugguaacaagaguuccaucccaggaggccaaacggugcaacagaaggguagg

SEQ ID NO: 398147 - RNA, 62 nt, Human
gcaguggccucugugggcccuugucaagagcuggaggccacucccaagagccucuccuaugg

SEQ ID NO: 398148 - RNA, 62 nt, Human
gcucucacccacggauaaaaccagaagcgacaggaggccagcuccugggguuccugggagcc

SEQ ID NO: 398149 - RNA, 62 nt, Human
cacaauaaagccggggccgagcagcuggcaggggaggccaaucccucccuccccuccccagu

SEQ ID NO: 398150 - RNA, 62 nt, Human; identical to SEQ ID NO: 287438

SEQ ID NO: 398151 - RNA, 62 nt, Human
ugcuauuuaagccuguaaaucccagcacuuugggaggccagggcggguggaucacgauauaa

SEQ ID NO: 398152 - RNA, 62 nt, Human
uggucgcucaugccuguaaucccagcacuuugggaggccaaggcaggcagaucacuugaggu

SEQ ID NO: 398153 - RNA, 62 nt, Human
ugguaauguucaccugcagucccagcuacuugggaggccaaggcacgagaauugcuugaaca

SEQ ID NO: 398154 - RNA, 62 nt, Human
aagcuagaggaauaaagcugugagcaaacagaggaggccagccucaccucauuccaacaccu

SEQ ID NO: 398155 - RNA, 62 nt, Human
auggagagaaaucauaacagacgguggcacaaggaggccaucuuuuccucaucgguuauugu

SEQ ID NO: 398156 - RNA, 62 nt, Human
acaaugaccacuacccugggugugauaucacaggaggccagagagaggcaaaggcucaggcc

SEQ ID NO: 398157 - RNA, 62 nt, Human
ccccuugacacacgcccuccucaaauccuaggggaggccauucccaugagacugccugucac

SEQ ID NO: 398158 - RNA, 62 nt, Human
gagcucacgcccagagacugggcugcucucccggaggccaaacccaagaaggucuggcaaag

SEQ ID NO: 398159 - RNA, 62 nt, Human
gcaccaggccauccagcgugcagccuugccucggaggccagcccacccccagaagccaggaa

SEQ ID NO: 398160 - RNA, 62 nt, Human
caguggcgcaugccuguaaucccagaacuuugggaggccaagacgggaugauugcuugagcu

SEQ ID NO: 398161 - RNA, 62 nt, Human
ugguggcgggcgccuauaauccuagcuacuagggaggccaaggugggagaucgcuuaaaccc

SEQ ID NO: 398162 - RNA, 62 nt, Human
ugguggcucacgccuauaaucccagcacuuugggaggccaaggcaggcagaucauuugagau

SEQ ID NO: 398163 - RNA, 62 nt, Human
acccucccucaccuguuauaaaaaauucgcugggaggccaauaggcugaaauggcuccugca

SEQ ID NO: 398164 - RNA, 62 nt, Human
cagugccucaugccuguaaucccagcacuuugggaggccaaggugggaggaucguuugagcc

SEQ ID NO: 398165 - RNA, 62 nt, Human
ugguggcucacacuuguaaucccagcacuuugggaggccaaggugggcggaucaugagguca

SEQ ID NO: 398166 - RNA, 62 nt, Human
ugacggugcacaccucuagucccagcuacucgggaggccaagacagaaggaucaccuugagg

SEQ ID NO: 398167 - RNA, 62 nt, Human
cgucuacaauucccaaaagaccucuuacuuugggaggccaaggugggugggucacuugaacc

SEQ ID NO: 398168 - RNA, 62 nt, Human
acugcaugaaucuaccugaguugcuggcauugggaggccaguuacuggaaaggaauggaaaa

SEQ ID NO: 398169 - RNA, 62 nt, Human
agggaggguaaagcagagagaauguauucacaggaggccauaaauuagcauugugccauguc

SEQ ID NO: 398170 - RNA, 62 nt, Human
cccugucccugucuccaguuccucuccccucaggaggccaccucaggaaggauuuugacagg

SEQ ID NO: 398171 - RNA, 62 nt, Human
agugguaaacugugguuuccccaagcugcacaggaggccagaaaccacaaguaugaugacua

SEQ ID NO: 398172 - RNA, 62 nt, Human
accuguaauccgacuguaagcucaucaccuugggaggccacuguaggaggaucaauugagcc

SEQ ID NO: 398173 - RNA, 62 nt, Human
ucguggcacacaccuguaaucccagcuauuugggaggccaaggcaggagaauugccugaacc

SEQ ID NO: 398174 - RNA, 50 nt, Human; identical to SEQ ID NO: 287468

SEQ ID NO: 398175 - RNA, 62 nt, Human
ugguggcuuacgccuguaaucccagcacuuugggaggccaaggcgggcggaucaugagguca

SEQ ID NO: 398176 - RNA, 62 nt, Human
cucuggggagucggauucaggaaacacccccaggaggccaagccugaaaacagaggggaggg

SEQ ID NO: 398177 - RNA, 62 nt, Human
cugccucacugguaagggaaaaccuuggcuugggaggccagcccuggcccuugaagggguug

SEQ ID NO: 398178 - RNA, 62 nt, Human
cgguggcucacaccuguaaucccagcacuuugggaggccaaggcaggcggaucaccugaggu

SEQ ID NO: 398179 - RNA, 62 nt, Human
cgguggcucacaccuguaaucccagcacuuugggaggccaauguggguggaucaugagguca

SEQ ID NO: 398180 - RNA, 62 nt, Human
guggcucaugccuauaaaauuccagcacuuugggaggccaaggcaggaggaucacuugagcc

SEQ ID NO: 398181 - RNA, 62 nt, Human
aaggagucaugugcauacauagaaucagugauggaggccaggcacgguaucucaugccuaua

SEQ ID NO: 398182 - RNA, 62 nt, Human
gccuccagguaccaccccauccuccggcugcaggaggccaagccgcagagguccgcgagguc

SEQ ID NO: 398183 - RNA, 62 nt, Human
cugaagguugcugucugucaugagugcaugaaggaggccaagaguuuaugcuaugggaggaa

SEQ ID NO: 398184 - RNA, 62 nt, Human
agguggcucccgccuguaaucucagcacuuugggaggccaaggcaggcaaucaccugagggc

SEQ ID NO: 398185 - RNA, 62 nt, Human
agccuuaaguuccacuagagccuccggcccagggaggccagaaucagcacaaucccggcccc

SEQ ID NO: 398186 - RNA, 62 nt, Human
uuuagagaaugagaaauggaacagugaggaauggaggccauauuuccaugacuucccuugua

SEQ ID NO: 398187 - RNA, 62 nt, Human
gggcugccaggcucugcaggcacccaggguggggaggccacccuuccugcccuacccgcaga

SEQ ID NO: 398188 - RNA, 62 nt, Human
cacguggagagaaguugcccuccaggccgacaggaggccaugcccaccgccccuggacaggc

SEQ ID NO: 398189 - RNA, 62 nt, Human
ccaaauuucaaggaauaauugagauuaaguauggaggccauucaaggcaaaaauguccuaaa

SEQ ID NO: 398190 - RNA, 62 nt, Human
gugugacccuugcauuggcaccccuccagccuggaggccaggcuuccagcaacuuccuucug

SEQ ID NO: 398191 - RNA, 62 nt, Human
cgguggcucacaccuguaaucccagcacuuuuggaggccaagguggguggaucaccugaggu

SEQ ID NO: 398192 - RNA, 62 nt, Human
caguggcucacgccuguaaucccaacacuuugggaggccaaggaggguggaucaccugaggu

SEQ ID NO: 398193 - RNA, 62 nt, Human
cgcagugaggcuggugcccaugcuccacacugggaggccaggcugaccccaccagccaguca

SEQ ID NO: 398194 - RNA, 62 nt, Human
ugguggcucaugccuauaaucccagcacuuugggaggccaaggcagguggaucaccugaggu

SEQ ID NO: 398195 - RNA, 62 nt, Human
caauggcucaugccuguaaucccaacacuuugggaggccaaggugggaggauggcuuguguc

SEQ ID NO: 398196 - RNA, 62 nt, Human
ucugggcugggcacaguggcucacacacuuugggaggccaagcgggggugcagaucaccuga

SEQ ID NO: 398197 - RNA, 62 nt, Human
caugaacuugguucgcagccugccuugccccuggaggccacgccaggcgcucaccccugagc

SEQ ID NO: 398198 - RNA, 62 nt, Human
cgcaguauuuggauaaucagggucuccucccuggaggccagcucugccccaggggcugagcu

SEQ ID NO: 398199 - RNA, 62 nt, Human
cgguggcucacgccuauaaucccagcacuuagggaggccaaggcgggcagaucaccugaggu

SEQ ID NO: 398200 - RNA, 62 nt, Human
ccuggccagccugcccugcgguccugucaccuggaggccagccucacaugcccaaaucucca

SEQ ID NO: 398201 - RNA, 62 nt, Human
ggcugggcagaggcggucagccugggagucccggaggccaggcugcacaccuggugggagaa

SEQ ID NO: 398202 - RNA, 62 nt, Human
aggcagcaaaggcugaccuaucaaagccucccggaggccaccgugcuggguaccaggacuca

SEQ ID NO: 398203 - RNA, 62 nt, Human
uucuccuugcuuuaagccuugauaggagacggggaggccaacccuucucugcagaccgugau

SEQ ID NO: 398204 - RNA, 62 nt, Human
cccuugcucugacugcggccaagcaccacgcaggaggccacucuugucucucagcagcuguu

SEQ ID NO: 398205 - RNA, 62 nt, Human
caguggcucacaccugugaucccagcacuuugggaggccaaggcagggggauuacuucagcc

SEQ ID NO: 398206 - RNA, 62 nt, Human
ucuggggcuucuccacuccugccccagaguguggaggccacaguggggccucuccguauuug

SEQ ID NO: 398207 - RNA, 62 nt, Human
uucuguuaaagcaucuucauaggugcuuggugggaggccaaggucgccgaauccucgugguu

SEQ ID NO: 398208 - RNA, 62 nt, Human
gugacagagguagaaaacaguaggcccucacaggaggccaccuucgcuagcagggaguggga

SEQ ID NO: 398209 - RNA, 62 nt, Human
ugccucucuucuucagcgccacaaaauuacauggaggccagcugguuuugugaggagauugu

SEQ ID NO: 398210 - RNA, 62 nt, Human
cugguagucauguggccccaccuggaugcagaggaggccaggaugugcagucuccacauagu

SEQ ID NO: 398211 - RNA, 62 nt, Human
ugaaagcaugaaaaagaggacacauggaaucuggaggccauuuagaugauuaguuaauuugu

SEQ ID NO: 398212 - RNA, 62 nt, Human
caguggcucacaccuguaaucccaacacuuugggaggccaagguggguggaucaucuaaggc

SEQ ID NO: 398213 - RNA, 62 nt, Human
gguggcuaacaccuauaauucccagcacuuugggaggccaagaugggcaaaucacuugaguc

SEQ ID NO: 398214 - RNA, 62 nt, Human
cuggugguggcccacaccuaucuucucaccuuggaggccacacccaacuuuccaaagacccu

SEQ ID NO: 398215 - RNA, 62 nt, Human
cugcuccccucugcacggaccaugcgacacugggaggccagugagccacuccggccccgaau

SEQ ID NO: 398216 - RNA, 62 nt, Human
auaaaauccaauauuguaauccuagcacuuugggaggccaaggcggguggaucacaagguca

SEQ ID NO: 398217 - RNA, 62 nt, Human
agaguccacccgguguccugaaguccucggggggaggccagccccuggcucacuggcacagg

SEQ ID NO: 398218 - RNA, 62 nt, Human
aggaggcugugaggcuggagggaccagauggaggaggccagcagcuagccauugcacacugg

SEQ ID NO: 398219 - RNA, 62 nt, Human
gagaaggaggcccagcaaguguauggugggaaggaggccaggacgugaguggggcuggggcu

SEQ ID NO: 398220 - RNA, 62 nt, Human
agcuuccagaacccacccugccccucuaccugggaggccaaaugggugagugggcuggggcu

SEQ ID NO: 398221 - RNA, 62 nt, Human
ugaccccuucccugagguggcugucuccaugaggaggccaacccuugccauugaccguggcc

SEQ ID NO: 398222 - RNA, 62 nt, Human
gacccacgcuccaaggcugagaccaguucccuggaggccacccacccugugccccggcaggc

SEQ ID NO: 398223 - RNA, 62 nt, Human
cugggagcccaugcaguagggcagaaggcagcggaggccaggucugucccggcuggagaaca

SEQ ID NO: 398224 - RNA, 62 nt, Human
uggcugauugguggaaaguaggguggaccaaaggaggccacgugagcagucagcaccaguuc

SEQ ID NO: 398225 - RNA, 62 nt, Human
caguggcucacgccuguaaucccagcacuuugggaggccaaagcagguggauuacccaaggc

SEQ ID NO: 398226 - RNA, 62 nt, Human
gccaggaccccuccacaugcaccugcuaguggggaggccacacccacaagcgcugcgucgug

SEQ ID NO: 398227 - RNA, 62 nt, Human
uggggccguuuguuaagcggcacucauuuugcggaggccaugcgggugcucaccacccccau

SEQ ID NO: 398228 - RNA, 62 nt, Human
ggguggcacaugccuguaaucccagcacuuugggaggccaaggcugguggaucaccugaggu

SEQ ID NO: 398229 - RNA, 62 nt, Human
caaugacucaugccuguaaucccagcacguugggaggccaagucgggcggaucacaagguca

SEQ ID NO: 398230 - RNA, 62 nt, Human
agccaguaaagaauacuucuggcagcacuuugggaggccaaggcgggcggaucacgagguca

SEQ ID NO: 398231 - RNA, 62 nt, Human
cagccaucaucucuuaacuacggaggcccgccggaggccacaccaucccuuaguuucuccuu

SEQ ID NO: 398232 - RNA, 62 nt, Human
acagaccagaucuuuacucacaacucaugcuaggaggccaguccuagcaucaccuuauguug

SEQ ID NO: 398233 - RNA, 62 nt, Human; identical to SEQ ID NO: 397932

SEQ ID NO: 398234 - RNA, 62 nt, Human
cugacgaugcugcagcgccuggagcagcugguggaggccaaguaacuggccaacaccugccu

SEQ ID NO: 398235 - RNA, 62 nt, Human
cgguggcucauaccuguaaucccagcaguuggggaggccaaggugggaggauugcuugagcc

SEQ ID NO: 398236 - RNA, 62 nt, Human
cagaguugagggagccgagcugagccacgcugggaggccagagccuuucucugccaucagcc

SEQ ID NO: 398237 - RNA, 62 nt, Human
uuuccuuucccugccucuuguccaauggagugggaggccaggugaguggagcagagguccug

SEQ ID NO: 398238 - RNA, 62 nt, Human
caguggcucacaccuauaaucccaacacuuugggaggccaggaguuuugagaccagccuggg

SEQ ID NO: 398239 - RNA, 62 nt, Human
gaugcugcuacgagugaccagugcuguguggaggaggccaagggcggccccugggaaaccgg

SEQ ID NO: 398240 - RNA, 50 nt, Human; identical to SEQ ID NO: 287546

SEQ ID NO: 398241 - RNA, 62 nt, Human
cgguggcucaugccuguaaucccagcuacgcaggaggccaaggcaggagaaucacuugaacc

SEQ ID NO: 398242 - RNA, 62 nt, Human
ugguggcucacgccuguaaucccagcacuuugggaggccaaggugggcagaucaugagguca

SEQ ID NO: 398243 - RNA, 62 nt, Human
caguggcucaugccuguaauccuaacacuuugggaggccaaggugggaagauugccugagcu

SEQ ID NO: 398244 - RNA, 62 nt, Human
cugcagagacugauggaaguuagagagguggaggaggccagcucgcuccaaaacccuugggg

SEQ ID NO: 398245 - RNA, 62 nt, Human
gcggcucaugugugcuggcugcauggugcuggggaggccacagccagcccuuccucugcacc

SEQ ID NO: 398246 - RNA, 62 nt, Human
uuuagauacuucauaaaauuaugaacagauauggaggccagagcucauuuggguaaacuuac

SEQ ID NO: 398247 - RNA, 62 nt, Human
gccuggaacccuggaagggagggaggcccaugggaggccaagccugggggcugggggcgggu

SEQ ID NO: 398248 - RNA, 62 nt, Human
ggacugcucagcacucccuaaaaacacaccauggaggccacuggugacugcuggugggcagg

SEQ ID NO: 398249 - RNA, 62 nt, Human
gcucugcuggcaugagccacaguuucuugacuggaggccaucaacccucuugguugaggccu

SEQ ID NO: 398250 - RNA, 62 nt, Human
cucccggccuggauccauggcugacucugccuggaggccauuugugccugccucugugcugc

SEQ ID NO: 398251 - RNA, 62 nt, Human
ugagugaugaagucaggaagcccuguggcucuggaggccacuugugguucauucuuuuccca

SEQ ID NO: 398252 - RNA, 62 nt, Human
ugccgcuucagcuugcugaggacugucuccaaggaggccaaauggaaaaggagaggcuacuu

SEQ ID NO: 398253 - RNA, 62 nt, Human
ugcuggucuaaaccaggcagccucucuugcuaggaggccacuucugcuguuacauaacuccu

SEQ ID NO: 398254 - RNA, 62 nt, Human
uccagguggccgcuggucucccgcuguguucaggaggccacauauacagccccucccagcca

SEQ ID NO: 398255 - RNA, 62 nt, Human
gauggggcugggggaugggccugagugagaggggaggccaagaguggccccaccuggcccuc

SEQ ID NO: 398256 - RNA, 62 nt, Human
gccaagaguggccccaccuggcccucucugaaggaggccaccuccuaaaaggcccagagaga

SEQ ID NO: 398257 - RNA, 62 nt, Human
cacggccaucuuguguugucacugcagaguuuggaggccaguuuuccacagccuaaacaggg

SEQ ID NO: 398258 - RNA, 62 nt, Human
ugguggcucacgccuguaaucccagcacugugggaggccaagccaggcaaaucgcuugaggc

SEQ ID NO: 398259 - RNA, 62 nt, Human
aauuuguucugcauuaaugccacaguggggauggaggccaggccguggccagagcagauacg

SEQ ID NO: 398260 - RNA, 62 nt, Human
ugguggcucaugccuguaaucccagcacuuugggaggccaggaguucgagaccagccuggcc

SEQ ID NO: 398261 - RNA, 62 nt, Human
ggcagaaaccuaucucagggagggaaggggauggaggccagagucucccagugggugaugcu

SEQ ID NO: 398262 - RNA, 62 nt, Human
gcuaaggaaggagauagguggcuccuaaaagaggaggccaucuucucacccaccccuuccuc

SEQ ID NO: 398263 - RNA, 62 nt, Human
acugccaccagccucaccgccugcgggcagggggaggccagcaggcccgggcccagcacccc

SEQ ID NO: 398264 - RNA, 62 nt, Human
cagggcccugggcuggaccucaggacaggcauggaggccacaggggcccagcagcccacccu

SEQ ID NO: 398265 - RNA, 62 nt, Human
gucgccggcgccuuuuucuuuuuagaugggaaggaggccaggaaagggucagcuuaaccauu

SEQ ID NO: 398266 - RNA, 62 nt, Human
ugcagcccuucccacagcuugcaaggaccaagggaggccagcagguggacagggggccucag

SEQ ID NO: 398267 - RNA, 62 nt, Human
agagcugccaggcagugucuuagaugugagacggaggccauggcgagaauccagcuuugacc

SEQ ID NO: 398268 - RNA, 62 nt, Human
gggcccugcccuggcagggucauccugugcucggaggccaucucgggcacaggcccaccccg

SEQ ID NO: 398269 - RNA, 62 nt, Human
uuggcagaaaggauguuuugucccauuuccuuggaggccaccgggacagaccuggacacuag

SEQ ID NO: 398270 - RNA, 62 nt, Human
caguggcucaugccuguaaucucagcaauuugggaggccaaggaaggaggaaugcuugagcc

SEQ ID NO: 398271 - RNA, 62 nt, Human
aguccgaaguggagaaaggcuggugggaacauggaggccaguguuggggagccuguggaggc

SEQ ID NO: 398272 - RNA, 62 nt, Human
gugaagccgcgcuccccuggaagcgacccaggggaggccaaguugucagcuuuuugauccuc

SEQ ID NO: 398273 - RNA, 62 nt, Human
acaguggcucaugcauguaauucuagcacuuuggaggccaaggcaggaggacugcuugagcc

SEQ ID NO: 398274 - RNA, 62 nt, Human
cgguagcuuaugccuguaaucucagcacuuugggaggccaaggcaggcagaucaugagguca

SEQ ID NO: 398275 - RNA, 62 nt, Human
uggugguucuugccuauagucccagugcuuugggaggccauagcaggaggauugcuugagcc

SEQ ID NO: 398276 - RNA, 62 nt, Human
cugcagggcuggucagggugucuggggcaggaggaggccaacucacugaacuagugcagggu

SEQ ID NO: 398277 - RNA, 62 nt, Human
gucugcaggcagggcugacucuaggugcccuuggaggccagccagugaccugaggaagcgug

SEQ ID NO: 398278 - RNA, 62 nt, Human
uggccaugguugcugagcaugggcagaccaguggaggccacccuacuguguuaucugcgccu

SEQ ID NO: 398279 - RNA, 62 nt, Human
aaggggcucaccccuauaaucccaggacuuugggaggccaaggcaggaggaucacuugaguc

SEQ ID NO: 398280 - RNA, 62 nt, Human
cagccuucuccccaaccaggauguuggccuggggaggccacagcagggcugagggaacucug

SEQ ID NO: 398281 - RNA, 62 nt, Human
ccugggcagccucggacuaugacuggcuacggggaggccaccaccaggccccagcucuccac

SEQ ID NO: 398282 - RNA, 62 nt, Human
cuuacuccuccucaaggagucuguaguggaaaggaggccacagaauaagcugcuuauucuga

SEQ ID NO: 398283 - RNA, 62 nt, Human
ucgcuaaacuauaaaugcaguuguguccaguuggaggccaggguaccacaugucacaggcgg

SEQ ID NO: 398284 - RNA, 62 nt, Human
ccaaggcaacuccuucuuucaacguggcccagggaggccaaaagauuggacaccccugcaaa

SEQ ID NO: 398285 - RNA, 62 nt, Human
agcaucucugcugagacaguccuuuugcucucggaggccagggaagaugguacuuagaggcu

SEQ ID NO: 398286 - RNA, 62 nt, Human
ugcuacugcacguaacacuccuccuuaggccuggaggccaagguguggguccccacgccuga

SEQ ID NO: 398287 - RNA, 62 nt, Human
ugucucaccucuaggcccucugcuggugcuguggaggccaagaccccauuaagccuaaaggu

SEQ ID NO: 398288 - RNA, 62 nt, Human
ggguggaggguggaagguccugugcaggacagggaggccaccaaaggggcugcugucuccug

SEQ ID NO: 398289 - RNA, 62 nt, Human
cugcaagugcucagggaaauggccuucccgccggaggccagcuaucugccugacaggcugug

SEQ ID NO: 398290 - RNA, 62 nt, Human
gguacacuggggaauguuagcaagacugggaaggaggccacauuccugucugcagcagccgc

SEQ ID NO: 398291 - RNA, 62 nt, Human
caguggcucacgccuguaaucccagcacuuugggaggccaaggcggguggauuaccuccauc

SEQ ID NO: 398292 - RNA, 62 nt, Human
ccugggcaggggcagccaaggcugggaaaugaggaggccaugcacaggguggggcagcuuuc

SEQ ID NO: 398293 - RNA, 62 nt, Human
ugcaggcaaagcuggacaugugcccuggcccaggaggccauguugggcccucguuuccauug

SEQ ID NO: 398294 - RNA, 62 nt, Human
guugccaauaccucagacuccagggaaagagaggaggccaucauucucacuguaccacuagg

SEQ ID NO: 398295 - RNA, 62 nt, Human
ucuguuugaaaacuauccaguaaaaagcugauggaggccaauuacauggcggguguauugac

SEQ ID NO: 398296 - RNA, 62 nt, Human
aggugggaccuccugcagccuggaaagaggagggaggccaaggccauucccuaacucccucc

SEQ ID NO: 398297 - RNA, 62 nt, Human
gacacacuccuagcagcugguaaaggggugcuggaggccauggaggagcucuagaaacauua

SEQ ID NO: 398298 - RNA, 62 nt, Human
gcggucucacucccagggaccuuuuuggucauggaggccaucgggcucccaguuagacccug

SEQ ID NO: 398299 - RNA, 62 nt, Human
cccgcaucccagcauugggccacccaucugagggaggccaaaaucaucacagaugcugcugu

SEQ ID NO: 398300 - RNA, 62 nt, Human
uugggugcuuacaacaauuuuccucacagucuggaggccagaagucuaaaaucaaaguguca

SEQ ID NO: 398301 - RNA, 62 nt, Human
ugccaguccuccucaggagaaggggaagggaaggaggccacuuugagagggcugaagggagg

SEQ ID NO: 398302 - RNA, 62 nt, Human
gccagcagaagcaggguacccuuuggggagcaggaggccaauaaaaaguucagaguucauug

SEQ ID NO: 398303 - RNA, 62 nt, Human
gguccaaguaaaccgcuagcuuguugcaccguggaggccacaggagcagaaacauggaaugc

SEQ ID NO: 398304 - RNA, 62 nt, Human
gccccgcaggcgaaagcacguuccagccaccaggaggccaccuauuguuucaaaauaaagac

SEQ ID NO: 398305 - RNA, 62 nt, Human
gcgggaaaggauggaguguuuuaguucuugggggaggccaccccaaaccccagccccaacuc

SEQ ID NO: 398306 - RNA, 62 nt, Human
uccagggcaacguccaggccaaugugccagcuggaggccaggcccaggugcgugccuugucc

SEQ ID NO: 398307 - RNA, 62 nt, Human
caauggcucacgccugugaucccagcacuuugggaggccaaggcggguggaucacgagguca

SEQ ID NO: 398308 - RNA, 62 nt, Human
cgguggcucacgccuguaaucccagcacuuugggaggccaaggccagcggaucacuugaggu

SEQ ID NO: 398309 - RNA, 62 nt, Human
ugcaacuggaaagcgggggcgcccgccgacgaggaggccaccgugccaagccggcagagguc

SEQ ID NO: 398310 - RNA, 62 nt, Human
gaaccucuggagagccacaggcacccccagcuggaggccagacuccucucuugugcuagcug

SEQ ID NO: 398311 - RNA, 62 nt, Human
agcauagauuccccaaagugaggcucauggugggaggccacucaccuuccuagcugcugcuc

SEQ ID NO: 398312 - RNA, 62 nt, Human
uaccccguguucguguaccagccggccauccgggaggccaacgggaucguggagugcgggcc

SEQ ID NO: 398313 - RNA, 62 nt, Human
acucucaaguucccccaaagccccaaagaguuggaggccaagggaaggggcagggaggggag

SEQ ID NO: 398314 - RNA, 62 nt, Human
cugucuaggaaucaugugccaagcagagguugggaggccauuuguguuuauauauaagccaa

SEQ ID NO: 398315 - RNA, 62 nt, Human
uauuuuuauucaccuguuccgugcuauauggaggaggccaaguccauuuagugacauuucuu

SEQ ID NO: 398316 - RNA, 62 nt, Human
uuagcuggccaggagugcccuaaggguaagagggaggccacugaggucucuguugaacuggu

SEQ ID NO: 398317 - RNA, 62 nt, Human
cccccagaggggcgccuguggggagggaaccaggaggccacacugggggagcgugcagccag

SEQ ID NO: 398318 - RNA, 62 nt, Human
ggaccagcggcuuguucuagggauuuggaccuggaggccaagggcaauaggagagggucuga

SEQ ID NO: 398319 - RNA, 62 nt, Human
cccucuuuucucccacacaucucacaucauggggaggccagagggggccacacgagagcucc

SEQ ID NO: 398320 - RNA, 62 nt, Human
caguggcucacaccuguaauccuagcacuuugggaggccaaggcagguggaucaccugaggu

SEQ ID NO: 398321 - RNA, 62 nt, Human
aacuacugcugaguuugggugcacccuaagauggaggccagguagcaauggggccggccuca

SEQ ID NO: 398322 - RNA, 62 nt, Human
gcugguaaauauuuacauucagccagggaagaggaggccagaggucgggccagcugccccau

SEQ ID NO: 398323 - RNA, 62 nt, Human
ugguggcucaugccuguaaucccagcauuuugggaggccaaggcgggcggaucacuugaggu

SEQ ID NO: 398324 - RNA, 62 nt, Human
aguggcucacaccuuguaaucccagcacuuugggaggccaaggugggcggaucacccugagg

SEQ ID NO: 398325 - RNA, 62 nt, Human
cgguggcucacgcauguaaucccagcacuuugggaggccaaggcagguggaucacgagguca

SEQ ID NO: 398326 - RNA, 62 nt, Human
acacugaucuuucaagucugggagacagauaaggaggccaggugcaaggcagggaggcagag

SEQ ID NO: 398327 - RNA, 62 nt, Human
gggugucucaugccuauaauuccagcacuuugggaggccaaggcaggcagaucacuuugagg

SEQ ID NO: 398328 - RNA, 62 nt, Human
uacagccuuggacuagcaauuuaugcuucuugggaggccagccuugacugacucaaagcaaa

SEQ ID NO: 398329 - RNA, 62 nt, Human
gcccagccacauuucagccgagguccaaggcaggaggccauuuacuugagacagauucucuc

SEQ ID NO: 398330 - RNA, 62 nt, Human
aguuugacaauucugagaguuguccugcaguuggaggccaccagagguaucugagcucccug

SEQ ID NO: 398331 - RNA, 62 nt, Human
uacuucaccaaacuggccucuauccauaccaaggaggccagccuggcccugagcugcuggau

SEQ ID NO: 398332 - RNA, 62 nt, Human
uuauucuuuagcuuucuuaaucggugcuuuauggaggccaguguaacguuacaugacucguu

SEQ ID NO: 398333 - RNA, 62 nt, Human
cuccagcccuggagaggagggcagggcugcggggaggccaggccgagccccuggaaccaucc

SEQ ID NO: 398334 - RNA, 62 nt, Human
ucccccgcacgcaugcauccacugcggccggaggaggccauggagcccgaguagcugccugg

SEQ ID NO: 398335 - RNA, 62 nt, Human
uccagcuccuuccuuccuucccccaggaacacggaggccaccgagggggcugggccuaucag

SEQ ID NO: 398336 - RNA, 62 nt, Human
ggugcccggcauguaagccccgcccaccccacggaggccacagccacacagccacgcccccu

SEQ ID NO: 398337 - RNA, 62 nt, Human
cuccccacacccgccccugugcucugcugucuggaggccacguggauguucaugagaugcau

SEQ ID NO: 398338 - RNA, 62 nt, Human
ugguggcucaugccuguaauuccagcacuuugggaggccaaggcggguggaucaccugaggu

SEQ ID NO: 398339 - RNA, 62 nt, Human
cugcauguaccacagccccccacgccccauagggaggccaagccccggaccaugcaccaggc

SEQ ID NO: 398340 - RNA, 62 nt, Human
cgcugaauugaagagacaggacuggcaguuggggaggccacagcagcuagaauuuccagggg

SEQ ID NO: 398341 - RNA, 62 nt, Human
ugguggcuuacgccuguaaucccagcacuuugggaggccaaggugggcggaucacaagguca

SEQ ID NO: 398342 - RNA, 62 nt, Human
cuguggcucaugccuguaaucccagcacuuugggaggccaaggcagguggaucaccugaggu

SEQ ID NO: 398343 - RNA, 62 nt, Human
gcguguggggcagguguggagaagggcuuuaaggaggccaauuugcugcgcgggugaccugu

SEQ ID NO: 398344 - RNA, 62 nt, Human
cgguggcucacgccugcagucccagcacuuugggaggccaaggcguguggaucaccugaggu

SEQ ID NO: 398345 - RNA, 62 nt, Human
caggaaagguuuucaaaguucugcccauuucuggaggccaccacuccugucucuuccucuuu

SEQ ID NO: 398346 - RNA, 62 nt, Human
uauucucagaacuguuacuagacucaugacuuggaggccaaaccuuaaauccagagauagca

SEQ ID NO: 398347 - RNA, 62 nt, Human
cgguggcucaccccuguaaucccagcacuuugggaggccaaagcaggcggaucaccugaggu

SEQ ID NO: 398348 - RNA, 62 nt, Human
gcaggcagaucucacccagcacuaggacaccaggaggccagggaaagcaucucuggcucacc

SEQ ID NO: 398349 - RNA, 62 nt, Human
ugagaucuaaauggggacaaggcagguggaggggaggccaguguacauguaaaugcccacag

SEQ ID NO: 398350 - RNA, 62 nt, Human
gucucuaguucaauggccagucauagcagaagggaggccaagcaccaguccaucaccccucc

SEQ ID NO: 398351 - RNA, 62 nt, Human
cagugaugugcaguuauagucccagcuacuugggaggccaaggcaggaggauuacuugagcc

SEQ ID NO: 398352 - RNA, 62 nt, Human
ugaauccugcagggccaaggucugggggugcuggaggccaugcucccuccaggcuugcgggg

SEQ ID NO: 398353 - RNA, 62 nt, Human
agaauacccugaugagaaaagagaagaggaagggaggccauaucuacaacacagccucucgg

SEQ ID NO: 398354 - RNA, 62 nt, Human
ccgggcacgguggcucaugccuggaaucuuugggaggccacggaucacuugaggacaggggu

SEQ ID NO: 398355 - RNA, 62 nt, Human
gaagagccccaaagcaggaagaagcuccggauggaggccagcuaagccacucggggcaggcc

SEQ ID NO: 398356 - RNA, 62 nt, Human
guggggacccauuccuggagggaccaguucauggaggccaucaccgucagugcaggugagaa

SEQ ID NO: 398357 - RNA, 62 nt, Human
ugguggcucacgccuguaaucccagcacuuugggaggccauggcggguggaucacuugaggu

SEQ ID NO: 398358 - RNA, 62 nt, Human
cgguggcucacgccuguaauuccaucauuuugggaggccacagugggcagauugcuugagcc

SEQ ID NO: 398359 - RNA, 62 nt, Human
ccccuggaggaggaguaccuagcacaguugcaggaggccaaggaguacuagugacgggguug

SEQ ID NO: 398360 - RNA, 62 nt, Human
gaccugcccagcugcccgugugccuacccacuggaggccauggacagcccugugagccuaca

SEQ ID NO: 398361 - RNA, 62 nt, Human
gugcagcuaaccccucccuccccacagccagaggaggccacagaccccucaggggaguuccg

SEQ ID NO: 398362 - RNA, 62 nt, Human
ugggucagugguccacaucccgggacgcagcaggaggccaggccggcgagcccuguggauga

SEQ ID NO: 398363 - RNA, 62 nt, Human
cagucgcucaugccucuaaucccagcacgaugggaggccaagacaggcagaucacuugagcc

SEQ ID NO: 398364 - RNA, 62 nt, Human
uguggguucugggcuccaggggagggagcuggggaggccaggguauaagaaaagcaucagaa

SEQ ID NO: 398365 - RNA, 62 nt, Human
cccuugcgccucagcaguuugcagugggguaaggaggccaagcccauuuguguaaucaccca

SEQ ID NO: 398366 - RNA, 62 nt, Human
cgguggcucaugccuguaaucccagcacuuugggaggccaagauggguggaucaccugaagu

SEQ ID NO: 398367 - RNA, 62 nt, Human
ccaagugcagggccuguaaucccagcauuuuaggaggccaagguuggaggaucauuugagcc

SEQ ID NO: 398368 - RNA, 62 nt, Human
ccuggggagcccacugaggggccagggaggaaggaggccacggagcgggaggcagcgcccca

SEQ ID NO: 398369 - RNA, 62 nt, Human
ugccagguggagaaaucacagagagguaaaauggaggccagugccauuucagaggggaggcu

SEQ ID NO: 398370 - RNA, 62 nt, Human
aacacucccuucccaugacccaggcugggcaaggaggccacgugauguggagggcacauucc

SEQ ID NO: 398371 - RNA, 62 nt, Human
gucgggggcuggccuaggagauaucugagggaggaggccaccucuccaagggcuucugcacc

SEQ ID NO: 398372 - RNA, 62 nt, Human
cgauggcucacgccuguaaucccggcacuuugggaggccaagguggguggaucacuugaggu

SEQ ID NO: 398373 - RNA, 62 nt, Human
aaggagagaaugacaucgugcggcaggguccuggaggccacuugcgcggcugggccacagag

SEQ ID NO: 398374 - RNA, 62 nt, Human
caguggcucaugccuguaauccuagcacuuugggaggccaaggcagaaagauagcuugaguc

SEQ ID NO: 398375 - RNA, 62 nt, Human
agcagcuauggcugcauagcaaguaguaggcaggaggccaaagacuucugagaccuggggca

SEQ ID NO: 398376 - RNA, 62 nt, Human
caguggcucacgccuguaaucccagcaguuugggaggccaaggcaaguggaucaugugaggu

SEQ ID NO: 398377 - RNA, 62 nt, Human
ccguggcucacucuuguaaucccaaaacuuuaggaggccaaggugggaggaucgcuugagcc

SEQ ID NO: 398378 - RNA, 62 nt, Human
guucagguacaccaaagaggaagaagagcuguggaggccacccucuacaaagcuuuauagaa

SEQ ID NO: 398379 - RNA, 62 nt, Human
gguggcucaggucuguagucuuugggucuuugggaggccagggugggaggaucacuugagcu

SEQ ID NO: 398380 - RNA, 62 nt, Human
ggggggccagaguagcugauguaggaguacugggaggccagacggcacgaggucuccaaggc

SEQ ID NO: 398381 - RNA, 62 nt, Human
aucuggugaggauaaugguggcuccagcgacaggaggccaacccuggagaccaagaacaggg

SEQ ID NO: 398382 - RNA, 62 nt, Human
ugguggcaagcgcccuuggguccagcuacucaggaggccaaggugggaggaucacuugagcc

SEQ ID NO: 398383 - RNA, 62 nt, Human
cgggggcucacgccugucaccccagagcuuugggaggccaaggugggaggaucgcuugagac

SEQ ID NO: 398384 - RNA, 62 nt, Human
cucuacaaaaaaaaauuaaaaagggggcuuugggaggccaaggcgggcagaucaugagggca

SEQ ID NO: 398385 - RNA, 62 nt, Human
uuaaaacuauuugagaugcacuuuuguacucaggaggccaaggcaggaggauugcuugagcc

SEQ ID NO: 398386 - RNA, 62 nt, Human
cggugguucacgccuguaaucccagcacuuugggaggccaaggaggguggaucaccugaggu

SEQ ID NO: 398387 - RNA, 62 nt, Human
ccuggaccuccggcuucauuucaccccugcugggaggccagguucccaccucaccacccugg

SEQ ID NO: 398388 - RNA, 62 nt, Human
cugggggaggguccuugcaauuccagcgaaucggaggccaggccaggacguccuugcucccu

SEQ ID NO: 398389 - RNA, 62 nt, Human
caguggcucacgccuguaaucccagcacuuugggaggccaagguggguggaucaccugaggu

SEQ ID NO: 398390 - RNA, 62 nt, Human
cucgaagcagccacugagccauaaugcgcaggggaggccagaagcucugugccuggucugua

SEQ ID NO: 398391 - RNA, 62 nt, Human
cucugcaggguauuugaaccuguggaauuggaggaggccauuucacucccugaacccagccu

SEQ ID NO: 398392 - RNA, 62 nt, Human
ugcacaagcuccaagcucccaggcauuccccaggaggccagccuugaccauucuccaccugc

SEQ ID NO: 398393 - RNA, 62 nt, Human
uucuggcugccuguaaccuugaggggcauucaggaggccagcguucccucaggcacuggggg

SEQ ID NO: 398394 - RNA, 62 nt, Human
ugugccucugccuccuaggacuuauuuucccaggaggccauuuacaaggggaucuggaugac

SEQ ID NO: 398395 - RNA, 62 nt, Human
aggaggaacaaagagauugugguggugcuaaaggaggccauaagcuacacagaggccuuggg

SEQ ID NO: 398396 - RNA, 62 nt, Human
caguggcucgcgccuguaaucccagcacuuugggaggccaaggcggacggaucacuugaggu

SEQ ID NO: 398397 - RNA, 62 nt, Human
ugguggcucaggccuguaauccuggcacuuugggaggccaaggugggaagaucgcuugaggc

SEQ ID NO: 398398 - RNA, 62 nt, Human
ccugagaggcaguggccucuugagugaacaggggaggccaguagaugccccagauccagagc

SEQ ID NO: 398399 - RNA, 62 nt, Human
cacaaugccagaaguugggcagagagaggcagggaggccagugagggccagggagugagugu

SEQ ID NO: 398400 - RNA, 62 nt, Human
ugguggcuuaccccuguaaucccagcacuuugggaggccaaagcaggacgaucacuugagcc

SEQ ID NO: 398401 - RNA, 62 nt, Human
augugcugaggccuaaauguuagcaggugggaggaggccacagaacaauaaaaacaaccaaa

SEQ ID NO: 398402 - RNA, 62 nt, Human
uguauaacacucugcuguguggcauggcagaaggaggccagcacgcagccccuccagcucca

SEQ ID NO: 398403 - RNA, 62 nt, Human
ugguggcucacgccuguaaccccagcacuuugggaggccaaggugggcagaucacgagguca

SEQ ID NO: 398404 - RNA, 62 nt, Human
caguggcucccaccuauaauccuagcacuuugggaggccaacgcggguggauugcuugagcc

SEQ ID NO: 398405 - RNA, 62 nt, Human
gagcaggggcuucagccacagagacacacucaggaggccagaagccgacacucaagguguuc

SEQ ID NO: 398406 - RNA, 62 nt, Human
ugguggcaggcgccuguaaucccagcuacucgggaggccaaggcaggagaauugcucgaacu

SEQ ID NO: 398407 - RNA, 62 nt, Human
cgguggcucacgccuguaaucccagcacuuugggaggccaagccagauggaucaugaagcca

SEQ ID NO: 398408 - RNA, 62 nt, Human
accuggccuucugcacggcccaaggagaaccuggaggccaccacuaaagcugaaugaccugu

SEQ ID NO: 398409 - RNA, 62 nt, Human
aggcaccaagugucucaggcagcgaggaaauuggaggccauuuuucagucaauuucccuuuc

SEQ ID NO: 398410 - RNA, 62 nt, Human
ugguggcucacgccuguaaucucagcacuuugggaggccaaggcaggugggucaccuggggu

SEQ ID NO: 398411 - RNA, 62 nt, Human
caguggcucacgccuauaaucccaacacuucgggaggccaaggugagaggauaacuugaaac

SEQ ID NO: 398412 - RNA, 62 nt, Human
caggcccaggcuggcaggcaucucggcuugcaggaggccaacugcugagaccucuucuccau

SEQ ID NO: 398413 - RNA, 62 nt, Human
gugcuuugggaagccgaagcaggaggaucacuggaggccaagaguuggagagcagacugggc

SEQ ID NO: 398414 - RNA, 62 nt, Human
caggcuccugcucucuggccaagcccugggugggaggccaggcccccagcgggcagggucug

SEQ ID NO: 398415 - RNA, 62 nt, Human
agucacuccaggaauaagacaaaaggagaggaggaggccaucaccucuggccucuuccaucg

SEQ ID NO: 398416 - RNA, 51 nt, Human; identical to SEQ ID NO: 287755

SEQ ID NO: 398417 - RNA, 62 nt, Human
ugaaacuugagaagcagagcucgccaccuucuggaggccacugugaugaugagccaagcaau

SEQ ID NO: 398418 - RNA, 62 nt, Human
agaugagcugaucuguaagucacucugccccaggaggccagaguaaaaagugcugcuugccc

SEQ ID NO: 398419 - RNA, 62 nt, Human
gggugauuucugugacucugggcccacagcggggaggccaagaggggcccuguggacuuuca

SEQ ID NO: 398420 - RNA, 62 nt, Human
gccaucgggagagcucugaccugcacaccgcgggaggccagggugcugacugucaagcaucc

SEQ ID NO: 398421 - RNA, 62 nt, Human
aggguccccacagcccgugccccacgccgccuggaggccagaggggucaguggcccugcugu

SEQ ID NO: 398422 - RNA, 62 nt, Human
aguuggggguucgaguagaucucauggguacaggaggccagcagggaccaggccagucagcc

SEQ ID NO: 398423 - RNA, 62 nt, Human
ccagccucuagcuacccuguaucgaggcaaggggaggccaguaaaguuugccaagccugauc

SEQ ID NO: 398424 - RNA, 62 nt, Human
gcuacacaucuugggcucacaagugaggcuguggaggccaggagguucaaguauggagggua

SEQ ID NO: 398425 - RNA, 62 nt, Human
cgguggcucacgccuguaaucccagcacuuugggaggccaaggcgggcggaucaccugaggu

SEQ ID NO: 398426 - RNA, 62 nt, Human
ugguggcucacaccuguaauuccagcacuuugggaggccaaggcaggcggaucacgagguca

SEQ ID NO: 398427 - RNA, 62 nt, Human
ccuccaguccaacugauggcccagaugcagcaggaggccagaggacagagcagaggaucuuu

SEQ ID NO: 398428 - RNA, 62 nt, Human
gauggccuugguugagcugauggacaagugaaggaggccauggggcugugcuguccuuccug

SEQ ID NO: 398429 - RNA, 62 nt, Human
acaugccugucugucaauuucugguugggcugggaggccacacacacacacugacaugacag

SEQ ID NO: 398430 - RNA, 62 nt, Human
aaauaugucuuuaacuguacaucucaguggcuggaggccaugccuuuuaagcauguguaaaa

SEQ ID NO: 398431 - RNA, 62 nt, Human
ccuguuguugaaugguccuggccugcaggaugggaggccagaugccuucaggagcuggugga

SEQ ID NO: 398432 - RNA, 62 nt, Human
agccugagccagggcaauggcccugccacccuggaggccaccucuucuaagagucccaucug

SEQ ID NO: 398433 - RNA, 62 nt, Human
uccaguggaggcugagcugacccugggcugcuggaggccagacugggcuguaguuagcuuuu

SEQ ID NO: 398434 - RNA, 62 nt, Human
caguggcucaccccuguaaucccagcacuuugggaggccaaggcgggucgauuacuugaggu

SEQ ID NO: 398435 - RNA, 62 nt, Human
agguggcucacaccuguaaucccagcacuuugggaggccaaggcggguggaucacaagguca

SEQ ID NO: 398436 - RNA, 62 nt, Human
ucuaccaccagggcaaggagcuggacugcaggggaggccacgugcagcuggcggacggcucu

SEQ ID NO: 398437 - RNA, 62 nt, Human
ucuccgcucauacaggaaugaagccuuagccaggaggccaggcucagcccugugccacucac

SEQ ID NO: 398438 - RNA, 62 nt, Human
uggaagaaugauuggcugggaggccgcgggagggaggccaggaggcccggaccaguugggag

SEQ ID NO: 398439 - RNA, 62 nt, Human
cugggcccuggggcugcccucggcaaccguggggaggccauuugcugcccuggggcaucaug

SEQ ID NO: 398440 - RNA, 62 nt, Human
ugugugagugugacggggguugggguggggcgggaggccacgggggaggccgaggcaggggc

SEQ ID NO: 398441 - RNA, 62 nt, Human
cagaguuguacccucagaaggacggguaagcaggaggccaggggguccccagggcugaggug

SEQ ID NO: 398442 - RNA, 62 nt, Human
gccaugauucgcccaaagccagacagcaacggggaggccaagugcaggcuggcaccgccuuc

SEQ ID NO: 398443 - RNA, 62 nt, Human
cgguggcucacaccuguaaucccagcacuuugggaggccaaggcgggcggaucagcugaggu

SEQ ID NO: 398444 - RNA, 62 nt, Human
guagcaaggccaagcugauggcugcuuguuuaggaggccaucaguuccuuccuguggagaag

SEQ ID NO: 398445 - RNA, 62 nt, Human
cugguggcucaugccuguaauccagcacuuugggaggccaaggcggacagaccaccugaggu

SEQ ID NO: 398446 - RNA, 62 nt, Human
ugugugggugcugcgugacuggagagcuguguggaggccaugugugccccgugcagggauca

SEQ ID NO: 398447 - RNA, 62 nt, Human
aggccuugcugacucucugagcuggggaggugggaggccaggcgagccugacucuguugauc

SEQ ID NO: 398448 - RNA, 62 nt, Human
ggaggcagaggcaggagaccaagauggcagguggaggccaggcuuaccacaacggaagagac

SEQ ID NO: 398449 - RNA, 62 nt, Human
cagggugagccccaaaauugggguucagcgugggaggccacguggauucuuggcuuuguaca

SEQ ID NO: 398450 - RNA, 62 nt, Human
ucuuucccaagccuugccauuaucucugugagggaggccagguagccgagggaucaggaugc

SEQ ID NO: 398451 - RNA, 62 nt, Human
gaugggcggugacccgguaaccgaggcggcaaggaggccagguagucccggcaccucucacu

SEQ ID NO: 398452 - RNA, 62 nt, Human
uguucacuuuaccuucugccaaaugcagagagggaggccagugucagggucggaguggccug

SEQ ID NO: 398453 - RNA, 62 nt, Human
ugguggcucacgccuguaaucccagcacuuugggaggccaagguggguggaucacuugaggu

SEQ ID NO: 398454 - RNA, 62 nt, Human
aaacaggaccugccuacggcugaacggagccaggaggccacgugucccagcccagcguccag

SEQ ID NO: 398455 - RNA, 62 nt, Human
cuggggaagggcugggcgcuuuuccuggaaagggaggccacagauucuuucccaugggggcu

SEQ ID NO: 398456 - RNA, 62 nt, Human
cugggcugaacauggaccacgcaguugcgacaggaggccaggggaaaaaccccugcucacuu

SEQ ID NO: 398457 - RNA, 62 nt, Human
cgguggcucacaccuguaaucccagcauuuugggaggccaagguggguggaucacuugaggc

SEQ ID NO: 398458 - RNA, 62 nt, Human
cggccgcgguccugccacacaagcugggcggcggaggccacgcagccgggccuucuucucuc

SEQ ID NO: 398459 - RNA, 62 nt, Human
agcauggccugagguaugggguaugugcauguggaggccaggguaaggugaauggggaggcu

SEQ ID NO: 398460 - RNA, 62 nt, Human
ccgcugcucucugcaaaaagaaugggcaucccggaggccacgccuaucuucucucucugcuc

SEQ ID NO: 398461 - RNA, 62 nt, Human
cgguggcucaugccuguaaucccagcacuuugggaggccaaggcggguggaucgcgagauca

SEQ ID NO: 398462 - RNA, 62 nt, Human; identical to SEQ ID NO: 397944

SEQ ID NO: 398463 - RNA, 62 nt, Human
cucccuaucacuccauacuggggugggcuggaggaggccacaggccagcuauuguaaaagcu

SEQ ID NO: 398464 - RNA, 62 nt, Human
cucgcugcuugccagccucaccugcuggggcuggaggccauggaucccucauaguauccaag

SEQ ID NO: 398465 - RNA, 62 nt, Human
ugguggcucacgccugaaaucccagcacuuugggaggccaaggugggcggaucaugagguca

SEQ ID NO: 398466 - RNA, 62 nt, Human
ugaaaggcuggcaagugggagggagucaguggggaggccaggauagaacuagagcugguguc

SEQ ID NO: 398467 - RNA, 62 nt, Human
accacggcucacaccuauaaucgagcacuuugggaggccaagacaggaggaucacuugaggc

SEQ ID NO: 398468 - RNA, 60 nt, Human; identical to SEQ ID NO: 287816

SEQ ID NO: 398469 - RNA, 62 nt, Human
caaggggcauuuccucuccaacuuucuuccuuggaggccaaguucucacccuguccaacuau

SEQ ID NO: 398470 - RNA, 62 nt, Human
ucccggccaccuggggaagccgcgccugccaaggaggccaccagagggcagugcaggcuucu

SEQ ID NO: 398471 - RNA, 62 nt, Human
ucccccaugccugcuggguggcuggguccuguggaggccagcagcgguguggcccccgcccc

SEQ ID NO: 398472 - RNA, 62 nt, Human
gugaccccacaguggggcuggaccagggcccuggaggccaauaaagagcuuucuggguagac

SEQ ID NO: 398473 - RNA, 62 nt, Human
gcuggccgcucaggcgacccucagcccggcggggaggccauggcaugccccgggcguucgcu

SEQ ID NO: 398474 - RNA, 62 nt, Human
agccaggugaccccaggugggaggcuguguguggaggccauccuggaaggaaguuuagaccu

SEQ ID NO: 398475 - RNA, 62 nt, Human
cccggcggguggagacuuugggauggacuggaggaggccagcguccagcuggcggugcuccc

SEQ ID NO: 398476 - RNA, 62 nt, Human
ccaccccugccaggugaggggcauggcgggcaggaggccacaccaggccccccgcccugccc

SEQ ID NO: 398477 - RNA, 62 nt, Human
ugguggcucacgcuuguaaucccaguacuuugggaggccaaggcagucugggcaauauagug

SEQ ID NO: 398478 - RNA, 62 nt, Human
gcuuuggguggacggucuccuacauguucaguggaggccaccaggagcauccaugagcgggg

SEQ ID NO: 398479 - RNA, 62 nt, Human
gguauuuccuaguaagcauacuuucuuaagacggaggccauuugguuccugggagaauaggc

SEQ ID NO: 398480 - RNA, 62 nt, Human
cguuggcuuucgccuguaaucccaacacuuugggaggccaggacagaucacuugaggucagg

SEQ ID NO: 398481 - RNA, 62 nt, Human
caguggcucacgccuauaaucucagcacucugggaggccaagauggaggauugcuugaagcc

SEQ ID NO: 398482 - RNA, 62 nt, Human
cgguggcucaugccuguaaucccagcacuuugggaggccaagacgggcggaucuuuugaggu

SEQ ID NO: 398483 - RNA, 62 nt, Human
caagacgggcggaucuuuugaggucgggaguuggaggccagccuggccaaaauggcaaaacc

SEQ ID NO: 398484 - RNA, 62 nt, Human
ccugcaucuggggacacagcugccgugaccagggaggccagccugggagguccagaugccca

SEQ ID NO: 398485 - RNA, 62 nt, Human
cccuuguccuguggguugagggggucugaccaggaggccaccuacagcaggaagugaggcug

SEQ ID NO: 398486 - RNA, 62 nt, Human
uggggggccacccggggccuggaccuaugcagggaggccacgucccaccccaccucuuguuu

SEQ ID NO: 398487 - RNA, 62 nt, Human
cugggguugucaccuggacagggggcagccguggaggccaccguuaccaacugaagcugggg

SEQ ID NO: 398488 - RNA, 62 nt, Human
caggauggcaggggcaaagggcucaagggugaggaggccagugggaccccacagaguugggg

SEQ ID NO: 398489 - RNA, 62 nt, Human
caguggcuuaugcuuguaaucccagcacuuugggaggccaaggcaggaggaucguuugaggc

SEQ ID NO: 398490 - RNA, 62 nt, Human
cgcagcuguccccgauaccacgagcugcugcgggaggccaccgaggccgccgaguaccagga

SEQ ID NO: 398491 - RNA, 62 nt, Human
caguggaucacgccuguaaucccagcacauugggaggccaaggcacauaggucacuugaggu

SEQ ID NO: 398492 - RNA, 62 nt, Human
gguucaagcgauuccucugccucagcacuuugggaggccaaggcaggcagauaacaaaguca

SEQ ID NO: 398493 - RNA, 62 nt, Human
ggguggccagccugucuguguggcugggcuggggaggccacgucugguaucugaaugcuauc

SEQ ID NO: 398494 - RNA, 62 nt, Human
cgguggcucaugccuguaaucccagcacuuugggaggccaaggcagguggaucaccugaggu

SEQ ID NO: 398495 - RNA, 62 nt, Human
cuggccgggcaugguguaauccuaacacuuugggaggccaaggcgggcggauugccugagcu

SEQ ID NO: 398496 - RNA, 62 nt, Human
ccugaugcuuugggaggacaaggugguucauuggaggccaggaguuagagaucagccugggc

SEQ ID NO: 398497 - RNA, 62 nt, Human
gggccugaccuucccgagcccgugggggugggggaggccagccaccuccuuccucugggacu

SEQ ID NO: 398498 - RNA, 62 nt, Human
acgauggggggugcuccuggccuggaguggguggaggccagagacacugcucagcagcaccc

SEQ ID NO: 398499 - RNA, 62 nt, Human
ccccagggaagcuuaccccuccugugcuggguggaggccacgggacaccucaggugccaccc

SEQ ID NO: 398500 - RNA, 62 nt, Human
ccugggcccgcugcgcucagagggugcugguuggaggccagagcucggcagagucacccacc

SEQ ID NO: 398501 - RNA, 62 nt, Human
ugguggcucucgccuguaaucccagcacuuugggaggccaaggcaggcggaucaccugaggu

SEQ ID NO: 398502 - RNA, 62 nt, Human
acagcacugcaaauaacccaucuuccgggaagggaggccaggaugccucaguguuaaaauga

SEQ ID NO: 398503 - RNA, 62 nt, Human
agcgacuuuugugccgggacuuaaaaagauaaggaggccaggugugguggcucaugccugca

SEQ ID NO: 398504 - RNA, 62 nt, Human
cacaaaacucagcccagccaggcccccucccuggaggccagccccuccccgcagggggccag

SEQ ID NO: 398505 - RNA, 62 nt, Human
gaggccgauggcccgggcagcgggggcggcgaggaggccauggccggggccuacgacgcgcc

SEQ ID NO: 398506 - RNA, 62 nt, Human
ggaaggggaguuggaacaaaugucuguucccuggaggccaguccagugcucagaccuuuaga

SEQ ID NO: 398507 - RNA, 62 nt, Human
ccccacaccccagccaucgccgcccgcucccaggaggccagggcaggccugcgugggcugga

SEQ ID NO: 398508 - RNA, 62 nt, Human
ccaucauuucauuucacacccccgaagggaggggaggccaggaggggagcugcuccugccag

SEQ ID NO: 398509 - RNA, 62 nt, Human
caguggcucacaccuguaaucccagcacuuugggaggccaagaugggcggaucacgagguca

SEQ ID NO: 398510 - RNA, 62 nt, Human
cacccccgcacgccuguaaucccagcacuuggggaggccaaggcgggaggaucgcuugagcc

SEQ ID NO: 398511 - RNA, 62 nt, Human
cuccaugagggucacgcccccugaggaccucaggaggccagcagaacccgcaggcuccugaa

SEQ ID NO: 398512 - RNA, 62 nt, Human
uguuggcucaugccuauagucccagcacuuugggaggccaaggugcaaggcaggcagaucau

SEQ ID NO: 398513 - RNA, 62 nt, Human
cgguggcucaugccuguaaucccagcacuuugggaggccauggcagguggaucaccugaggu

SEQ ID NO: 398514 - RNA, 62 nt, Human
ggguggcucacaccuguaaucccugcacuuugggaggccaaggugggaggaucaguugagcc

SEQ ID NO: 398515 - RNA, 62 nt, Human
cugccuuggucccuugccugggaagagggcgaggaggccagugguggggacgcagagggucc

SEQ ID NO: 398516 - RNA, 62 nt, Human
caguggcuuccgccuguaaucccaacauuuugggaggccaaggcgggaggacugcuugaggc

SEQ ID NO: 398517 - RNA, 62 nt, Human
ugaggcaggagaauugcuugaacuugggagguggaggccaagauuguaccacuguauuccag

SEQ ID NO: 398518 - RNA, 62 nt, Human
gccacgcggaugccgccucaagggucuucaggggaggccagaggagagcugcugggccccga

SEQ ID NO: 398519 - RNA, 62 nt, Human
caguggcucacaccuguaaucucagcacuuugggaggccaaggcaggaagaucacuugagcc

SEQ ID NO: 398520 - RNA, 62 nt, Human
ugguuucucacaccuguaauuccagcacgguuggaggccaaggcacauaggucacuugaggu

SEQ ID NO: 398521 - RNA, 62 nt, Human
cucuggcucaugccuguaaucccagcacuuugggaggccaaggugggcagaucaccugagau

SEQ ID NO: 398522 - RNA, 62 nt, Human
cgguggcucacaccuguaaucccaguacuuugggaggccaaggcaagcagaucaccugaagu

SEQ ID NO: 398523 - RNA, 62 nt, Human
caguggaucaugucuguaauccuagcacugugggaggccaaggcaggaggaucgcuugagcc

SEQ ID NO: 398524 - RNA, 62 nt, Human
cuagaaacaccagcucagcauggcagcagugcggaggccaggaaacccugaucgccaguuuc

SEQ ID NO: 398525 - RNA, 62 nt, Human
uggugggucacacuuguaaucccacuacuuugggaggccaaggcaggaagauugcuugagcu

SEQ ID NO: 398526 - RNA, 62 nt, Human
aguguuuugggagacuaaggcaagaacauccuggaggccaggaguucgacacuguauaacag

SEQ ID NO: 398527 - RNA, 62 nt, Human
acagguccagggaugagcugaugguugcuggaggaggccaguguagagccagugagagaacu

SEQ ID NO: 398528 - RNA, 62 nt, Human
cagccauggaagagcagcuggaggguggauggggaggccagagggagcaaugaggggugguc

SEQ ID NO: 398529 - RNA, 62 nt, Human
aaaacccgacaacauuucugccagguuuguuaggaggccacaugauacuuauucaaaaaaau

SEQ ID NO: 398530 - RNA, 62 nt, Human
aaacuaaaucagauuguaaucccaguacuuugggaggccaaggcaggcugauugcuugaggu

SEQ ID NO: 398531 - RNA, 62 nt, Human
acagcaucuuccccaggcagcggcucuguggaggaggccauacuccccuaguuggccacugg

SEQ ID NO: 398532 - RNA, 62 nt, Human
ugguggcucaugccuguaaucccagcacuuugggaggccaaggcaggcggaucacaagguca

SEQ ID NO: 398533 - RNA, 62 nt, Human
ccacuagaucauccuuauaccgacggggaaacggaggccagagagggcgugggcgcuugcac

SEQ ID NO: 398534 - RNA, 62 nt, Human
cgagacuggaguguguuccugaagagcagccaggaggccagcauggcuggagaggcaggcau

SEQ ID NO: 398535 - RNA, 62 nt, Human
uucucauccucucugugccaccucuccacccaggaggccauguagcauaguggaaaaagucc

SEQ ID NO: 398536 - RNA, 62 nt, Human
ucuugagccagccaggcccugccaguggggaaggaggccaagcagugccugccuaugaaauu

SEQ ID NO: 398537 - RNA, 62 nt, Human
caccagcccagugcgcccugccgccgcgcuugggaggccaagcuuuaaacaucucugguucc

SEQ ID NO: 398538 - RNA, 62 nt, Human
guccuggccccuuaccccgcugccugaagcccggaggccacgccuguuggggcugauucgga

SEQ ID NO: 398539 - RNA, 62 nt, Human
gcaggauggcuuugcggaaaggagauggguuuggaggccaacaaaccugcuugucaauauug

SEQ ID NO: 398540 - RNA, 62 nt, Human
auucccguacucaguuguucuuuugucuaaucggaggccacugugcugaggcccugcagugu

SEQ ID NO: 398541 - RNA, 62 nt, Human
gcacccauggauuguguugagugugcagacagggaggccaccccaauaggaauucgucucca

SEQ ID NO: 398542 - RNA, 62 nt, Human
gugugggugcaacagcuacagucucauugaugggaggccauggucguggcuguggccauggg

SEQ ID NO: 398543 - RNA, 62 nt, Human
gaauccacacguggaccauugugggucccuugggaggccagcagccagacuacggaauccac

SEQ ID NO: 398544 - RNA, 62 nt, Human
gggccacggagaugagccuggacccuggagaaggaggccaggagccagccacuggcuggaca

SEQ ID NO: 398545 - RNA, 62 nt, Human
ugguggcucaugccuauuaucccagcacuuugggaggccaagguggguggaucacuugaggu

SEQ ID NO: 398546 - RNA, 62 nt, Human
gggugguccucaccaggucucugagcugggugggaggccauccuggcgaccacugcccauuc

SEQ ID NO: 398547 - RNA, 62 nt, Human
gcagagggaguuccuacacacacuuuuucccuggaggccaaggucuagggguagaaagggga

SEQ ID NO: 398548 - RNA, 62 nt, Human
cuguggcucacgccuguaaucccaggacuuugggaggccaaggcgggcagaucaccggaggu

SEQ ID NO: 398549 - RNA, 62 nt, Human
cagccuucccuggcuagcccaaauggcacuaaggaggccacugagggaauccuccacguggc

SEQ ID NO: 398550 - RNA, 62 nt, Human
augugaaaaggcauugggagaagcagucugggggaggccagcccagugcgggcacagcacaa

SEQ ID NO: 398551 - RNA, 62 nt, Human
gccugggccuagauggggcagccuggcucacaggaggccagccccuccuccuccgcccccuu

SEQ ID NO: 398552 - RNA, 62 nt, Human
uggcaugguguuugucucguacaguugggauaggaggccauucauucccaugggcacagcua

SEQ ID NO: 398553 - RNA, 62 nt, Human
uccugcguccccagaacccaagggaacgucauggaggccacauggggccacccggcucccuc

SEQ ID NO: 398554 - RNA, 62 nt, Human
acgcagcugugaauggccggugauguaugucaggaggccacagggagcagaggagcggggca

SEQ ID NO: 398555 - RNA, 62 nt, Human
caaggcuccggaccacacuggcccccugcggcggaggccaacgcagggcaccaccaccacca

SEQ ID NO: 398556 - RNA, 62 nt, Human
ccagcacugugaugggaguccacggcuagggaggaggccaagcuggccccgcagcgccucuu

SEQ ID NO: 398557 - RNA, 62 nt, Human
gauuuauuaugggaauuggcucucgcaauuauggaggccaagaagucccacagucuugcauu

SEQ ID NO: 398558 - RNA, 62 nt, Human
aguggcucaugccuauaaucucagcacuuuugggaggccaagacaggaggaucacuucaggc

SEQ ID NO: 398559 - RNA, 62 nt, Human
cgguggcucacaccuguaaucucagcacuuugggaggccaaggcaggcagaucacuugaggu

SEQ ID NO: 398560 - RNA, 62 nt, Human
aaggaccccaggcccuggggaggguggcugugggaggccaaguccacugcccggaagucuug

SEQ ID NO: 398561 - RNA, 62 nt, Human
gugauguggccgggccaaggacaggcagggagggaggccaggccucgcuugcaccgcgggac

SEQ ID NO: 398562 - RNA, 62 nt, Human
ccagggcugcccccgacaggcuggcucucaguggaggccagagaucuggaaucggggucagc

SEQ ID NO: 398563 - RNA, 62 nt, Human
caagagcaugcaaaacgucgcauugcagagcgggaggccaggagguaauucucaaaacccuu

SEQ ID NO: 398564 - RNA, 62 nt, Human
auaaacaugauaucaucacacuucuugguguuggaggccacuggguaacaacagaagaaaac

SEQ ID NO: 398565 - RNA, 62 nt, Human
cucuaacagggccagcugagcagcacaggccaggaggccacaguguaagcaauaacagaucu

SEQ ID NO: 398566 - RNA, 62 nt, Human
cggugguucgugccuguaaucccagcucuuugggaggccaaggcagguagaucacaagguca

SEQ ID NO: 398567 - RNA, 62 nt, Human
aagagaaggagggaccuucugcagagacuccgggaggccacccucaugcacauaacccugga

SEQ ID NO: 398568 - RNA, 62 nt, Human
cgguggcgcaugccuguaaucccagcacuuugggaggccaaggugggugaaucaccugaagu

SEQ ID NO: 398569 - RNA, 62 nt, Human
ggcugaaucaaaugggagcccuccagacauaaggaggccagaggcugcaaggagcggggucg

SEQ ID NO: 398570 - RNA, 62 nt, Human
ccauggcucacaccuguaaucuuaacacugugggaggccaaggcaaggggaucacuugagcc

SEQ ID NO: 398571 - RNA, 62 nt, Human
uguuaagagccucacaaggaaacuggguuauuggaggccaaggcggcuuacaguucucugcg

SEQ ID NO: 398572 - RNA, 62 nt, Human
uggcagcucaugacuguaaucccagcacuuugggaggccaaggugggaggaucaauugaggc

SEQ ID NO: 398573 - RNA, 62 nt, Human
cggcggcucacgcauguaaucccagcacuuugggaggccaaggcgggcggaucacgagguca

SEQ ID NO: 398574 - RNA, 62 nt, Human
cauccauguuuugugccugcccucccucuuggggaggccaugcuugacucugcugaaagcug

SEQ ID NO: 398575 - RNA, 62 nt, Human
gagauggccuguguguacaagggcggcuacugggaggccaaggagaagcaagacuggcauau

SEQ ID NO: 398576 - RNA, 62 nt, Human
agacgcuuccauggugggcacugaggcacagaggaggccaaggagagguuguuuguucaugc

SEQ ID NO: 398577 - RNA, 62 nt, Human
uaguggcucaugccuguaauccgagcacuuugggaggccaaggcgggcggaucacgagguca

SEQ ID NO: 398578 - RNA, 62 nt, Human
gggaggaaaggcggaggcgagcccuggaggagggaggccacaacuccgagcugcccaccugg

SEQ ID NO: 398579 - RNA, 62 nt, Human
caguggcuuauaccuguaauuucagcacuuggggaggccaaggcaggaggcuugcuugaggc

SEQ ID NO: 398580 - RNA, 62 nt, Human
gcgguggcucacgccuguaaucccagcacuuuggaggccaaggcggguggaucacgagguca

SEQ ID NO: 398581 - RNA, 62 nt, Human
cgcauccccaugcccagccuuucgcgucaccuggaggccacaucuucccaccccaccugcca

SEQ ID NO: 398582 - RNA, 62 nt, Human
cucccaggcaggggugaggguggccuggcccaggaggccaggaaggagggcccugucugccu

SEQ ID NO: 398583 - RNA, 62 nt, Human
uccugggggcccccaaggcuccccuccuguggggaggccaccuuuuaaggcaccacuagcag

SEQ ID NO: 398584 - RNA, 62 nt, Human
guggagagcaccagcuagccccuuccagaaggggaggccacauuugcccggcccccuggagc

SEQ ID NO: 398585 - RNA, 62 nt, Human
caguggcacacggcuguaaucccagcacuuugggaggccaagguuggcagaucaccugaggu

SEQ ID NO: 398586 - RNA, 62 nt, Human
gagcccagcugaucugcaguggcugacagcagggaggccaugugcucagccuggccacguug

SEQ ID NO: 398587 - RNA, 62 nt, Human
uggccauggagacuccaccuggauccccuguaggaggccagggaggggaacucagcaguuca

SEQ ID NO: 398588 - RNA, 62 nt, Human
ccguggcucacaccuguaauccuagcacauugggaggccaaggcaggcacaucaccugaguu

SEQ ID NO: 398589 - RNA, 62 nt, Human
uggcccaggccgagggauggugccagcaggguggaggccaagucccaggcuuucaggugugu

SEQ ID NO: 398590 - RNA, 62 nt, Human
aaauacuaaaaagaagugcugccgcgcaguguggaggccacuguuuggaaauaaaucuuccu

SEQ ID NO: 398591 - RNA, 62 nt, Human
gacggcaaccucugagccaucccagagccuggggaggccaggguagaggcugacggcgcaag

SEQ ID NO: 398592 - RNA, 62 nt, Human
agggcacacggugcgcccgccgccagcuccucggaggccagacccagguaugcagguggggc

SEQ ID NO: 398593 - RNA, 62 nt, Human
ccacacuugccccgcccucccacaccugcuugggaggccagagaggccagacaagccgagag

SEQ ID NO: 398594 - RNA, 62 nt, Human
cgguggcucacgccuguaaucccagcacuuugggaggccaagauggguggaucaccugaggu

SEQ ID NO: 398595 - RNA, 62 nt, Human
uguccaguggcuagagguggggugggaagagaggaggccaggccaggcccucaggaauuccc

SEQ ID NO: 398596 - RNA, 62 nt, Human
cacuacuuaaguacuugucauguacucuuagaggaggccaguaaugaucagaaccauuuuac

SEQ ID NO: 398597 - RNA, 62 nt, Human
ccugcaggacuuccguggcugaggcugugaccggaggccaggaaugccguuggguggauugu

SEQ ID NO: 398598 - RNA, 62 nt, Human
uccagccuggagggaaggggacaaagaccccaggaggccaaagggcugcagucaccccuugu

SEQ ID NO: 398599 - RNA, 62 nt, Human
cugccaggagagggcuuguuccuccaacucuaggaggccaggcaagcauggacaggagccaa

SEQ ID NO: 398600 - RNA, 62 nt, Human
cagagccuugcaugucaguaaacaggaaggaaggaggccaucuguucaaaaauugugacauu

SEQ ID NO: 398601 - RNA, 62 nt, Human
agcagcgggcucacccaggcaccugucugccaggaggccacguguguccugcccacccaggg

SEQ ID NO: 398602 - RNA, 62 nt, Human
uucuuuagcucuggaaagaauaaggcugccuuggaggccaucgagcgugccgcuuucuucgu

SEQ ID NO: 398603 - RNA, 62 nt, Human
agcuuaaaguguccaggcaucacagaagcacaggaggccaguucugaaaggcgagcagaacu

SEQ ID NO: 398604 - RNA, 62 nt, Human
cuagugguguugucgugagugccaccuaaccaggaggccagagcgguuugaaaacauccuga

SEQ ID NO: 398605 - RNA, 62 nt, Human
ggauguggaucagguuuacuagcaccugccagggaggccaucuggggcuccuucuccacccc

SEQ ID NO: 398606 - RNA, 62 nt, Human
gacaccuucaaagucuuauugacacaguaaagggaggccaaccacuacuaacaaguucuaga

SEQ ID NO: 398607 - RNA, 62 nt, Human
cauuuucaacucugguuaggccuccuaccuggggaggccaggucacugcacugggagguccu

SEQ ID NO: 398608 - RNA, 62 nt, Human
agagcuggggggcagagguaaagcccugcaggggaggccacaggguccaucccgucuucagg

SEQ ID NO: 398609 - RNA, 62 nt, Human
ugguagcucaugcuuguaaucucaccacuuugggaggccaagaugggaggagugcuugaggu

SEQ ID NO: 398610 - RNA, 62 nt, Human
ccccggaaggcguggagacacccacggaccagggaggccaagcagccgagcgagagcagcag

SEQ ID NO: 398611 - RNA, 62 nt, Human
caggccuugcuauggaugcgcuuaaucaccauggaggccagcaauacccaucucagcauggc

SEQ ID NO: 398612 - RNA, 62 nt, Human
gaggaggaggaggaggaggaggaggaggaggaggaggccagguccugguggagccuuugccc

SEQ ID NO: 398613 - RNA, 62 nt, Human
gugguggcucaucccuauaauccuacacuuugggaggccaaggugggcggaucacuugagcu

SEQ ID NO: 398614 - RNA, 62 nt, Human
aucuuggagagcuggggaccagcagucugccuggaggccagggagcaguggcugaguagcuc

SEQ ID NO: 398615 - RNA, 62 nt, Human
cuuccuagccuugcacuuucagacucucucugggaggccauaaaauaaggagcauauguccu

SEQ ID NO: 398616 - RNA, 62 nt, Human
cagugacuuacgccuguaaucucagcacuuugggaggccaaggcaggcagaucacgagguca

SEQ ID NO: 398617 - RNA, 62 nt, Human
ugggagccgggcaaacuggccgcgggggcaggggaggccaucuggagagcccagaguccccc

SEQ ID NO: 398618 - RNA, 62 nt, Human
ccacagacgagcuccgagccaggucaggcuucggaggccacaagcucagccucaggcccagg

SEQ ID NO: 398619 - RNA, 62 nt, Human
cgguggcucacgccuguaaucccagcacuuugggaggccaaggcaggaggaucgcuggagcc

SEQ ID NO: 398620 - RNA, 62 nt, Human
gcuagcacggccagugccaggaccgggccgagggaggccagaccaagggaggcacgcgcgcu

SEQ ID NO: 398621 - RNA, 62 nt, Human
gagugugucaugccugcaaucccagcacuuugggaggccaaggcaggcagaucaccugaggu

SEQ ID NO: 398622 - RNA, 62 nt, Human
ugcccuuuugacaucaaagaccugcugacaauggaggccacgccugcuucucccaucgccug

SEQ ID NO: 398623 - RNA, 62 nt, Human
accccacagggagccuuggagcccugcguccaggaggccacugcacugcucacuuguggccc

SEQ ID NO: 398624 - RNA, 62 nt, Human
cgguggcucacgccuguaaucccagcacuuugggaggccaaggcaggcggaucaccugaggu

SEQ ID NO: 398625 - RNA, 62 nt, Human
agagacggaagaggagacacagacacaaagcaggaggccacauaaagacagaggcagagacu

SEQ ID NO: 398626 - RNA, 62 nt, Human
ugagccaagacuacgccacugcacuccagccuggaggccagagugagacuccgucucaaaac

SEQ ID NO: 398627 - RNA, 64 nt, Human
uaaauauuugggguuuugguuuuaaagccagaauuacggcuagcaccuagcauuucagcagagg

SEQ ID NO: 398628 - RNA, 64 nt, Human
cuuuagauucugaggcuaggcugaguacuuauuauacggcuacauuuacacauuuacacuuauc

SEQ ID NO: 398629 - RNA, 64 nt, Human
gggcuggcagaaagggaacagaaagguuuuugaguacggcuauagccuggacuuuccuguuguc

SEQ ID NO: 398630 - RNA, 64 nt, Human
cugacugugggcccggcccucagauguguacauauacggcuauuuccuauuuuacuguucuuca

SEQ ID NO: 398631 - RNA, 64 nt, Human
ggcuucccacuuugccccagggaaaguuggagaguacggcuaccugggucaacccaacgcggug

SEQ ID NO: 398632 - RNA, 64 nt, Human
acuagaaggacgaacaauugcccuccuuuggaaguacggcuaauagaagcccuagauccgaaua

SEQ ID NO: 398633 - RNA, 64 nt, Human
ugaucuuugcagaucuuuaaguugucacuguuucuacggcuagacaaauaugacugguggucua

SEQ ID NO: 398634 - RNA, 64 nt, Human
uuucacaacugguauuaugucacuagcuaccugauacggcuauuucccuuauaacucaauagua

SEQ ID NO: 398635 - RNA, 64 nt, Human
ugcucagaaaggcucgguaaugagucccaggucauacggcuagcgaguggcgggccugggguuc

SEQ ID NO: 398636 - RNA, 64 nt, Human
gaguucuaucuaggugugucuuccagaaccuguuuacggcuaacuggauaacugagagacuugu

SEQ ID NO: 398637 - RNA, 64 nt, Human
ucaucuguaagagcuugcuccagauucugaugcauacggcuauauugguuuauguagucaguug

SEQ ID NO: 398638 - RNA, 64 nt, Human
cucucaggggaaaguuggggacaugcugcuacaauacggcuaaucuuucauugggaccgaaagc

SEQ ID NO: 398639 - RNA, 64 nt, Human
gaaauaucucuuuauuuaaaaaauuguuacuccauacggcuaaacucggauugugaugguugaa

SEQ ID NO: 398640 - RNA, 64 nt, Human
gggcaacucucacaucuugcugcauguacauguauacggcuacuauugaaguguaauugugaga

SEQ ID NO: 398641 - RNA, 64 nt, Human; identical to SEQ ID NO: 316805

SEQ ID NO: 398642 - RNA, 64 nt, Human; identical to SEQ ID NO: 316806

SEQ ID NO: 398643 - RNA, 64 nt, Human; identical to SEQ ID NO: 316807

SEQ ID NO: 398644 - RNA, 64 nt, Human; identical to SEQ ID NO: 316808

SEQ ID NO: 398645 - RNA, 64 nt, Human; identical to SEQ ID NO: 316809

SEQ ID NO: 398646 - RNA, 64 nt, Human; identical to SEQ ID NO: 316810

SEQ ID NO: 398647 - RNA, 64 nt, Human; identical to SEQ ID NO: 316811

SEQ ID NO: 398648 - RNA, 64 nt, Human; identical to SEQ ID NO: 316812

SEQ ID NO: 398649 - RNA, 64 nt, Human; identical to SEQ ID NO: 316813

SEQ ID NO: 398650 - RNA, 64 nt, Human; identical to SEQ ID NO: 316814

SEQ ID NO: 398651 - RNA, 64 nt, Human; identical to SEQ ID NO: 316815

SEQ ID NO: 398652 - RNA, 64 nt, Human; identical to SEQ ID NO: 316816

SEQ ID NO: 398653 - RNA, 64 nt, Human; identical to SEQ ID NO: 316817

SEQ ID NO: 398654 - RNA, 64 nt, Human; identical to SEQ ID NO: 316818

SEQ ID NO: 398655 - RNA, 64 nt, Human; identical to SEQ ID NO: 316819

SEQ ID NO: 398656 - RNA, 64 nt, Human; identical to SEQ ID NO: 316823

SEQ ID NO: 398657 - RNA, 64 nt, Human; identical to SEQ ID NO: 316824

SEQ ID NO: 398658 - RNA, 64 nt, Human; identical to SEQ ID NO: 316825

SEQ ID NO: 398659 - RNA, 64 nt, Human; identical to SEQ ID NO: 316826

SEQ ID NO: 398660 - RNA, 64 nt, Human; identical to SEQ ID NO: 316827

SEQ ID NO: 398661 - RNA, 64 nt, Human; identical to SEQ ID NO: 316828

SEQ ID NO: 398662 - RNA, 64 nt, Human; identical to SEQ ID NO: 316829

SEQ ID NO: 398663 - RNA, 64 nt, Human; identical to SEQ ID NO: 316830

SEQ ID NO: 398664 - RNA, 64 nt, Human; identical to SEQ ID NO: 316831

SEQ ID NO: 398665 - RNA, 64 nt, Human; identical to SEQ ID NO: 316832

SEQ ID NO: 398666 - RNA, 63 nt, Human; identical to SEQ ID NO: 316833

SEQ ID NO: 398667 - RNA, 64 nt, Human; identical to SEQ ID NO: 316834

SEQ ID NO: 398668 - RNA, 64 nt, Human; identical to SEQ ID NO: 316835

SEQ ID NO: 398669 - RNA, 64 nt, Human; identical to SEQ ID NO: 316836

SEQ ID NO: 398670 - RNA, 64 nt, Human; identical to SEQ ID NO: 316837

SEQ ID NO: 398671 - RNA, 64 nt, Human; identical to SEQ ID NO: 316841

SEQ ID NO: 398672 - RNA, 64 nt, Human; identical to SEQ ID NO: 316842

SEQ ID NO: 398673 - RNA, 64 nt, Human; identical to SEQ ID NO: 316843

SEQ ID NO: 398674 - RNA, 64 nt, Human; identical to SEQ ID NO: 316844

SEQ ID NO: 398675 - RNA, 64 nt, Human; identical to SEQ ID NO: 316845

SEQ ID NO: 398676 - RNA, 64 nt, Human; identical to SEQ ID NO: 316846

SEQ ID NO: 398677 - RNA, 64 nt, Human; identical to SEQ ID NO: 316847

SEQ ID NO: 398678 - RNA, 64 nt, Human; identical to SEQ ID NO: 316848

SEQ ID NO: 398679 - RNA, 64 nt, Human; identical to SEQ ID NO: 316849

SEQ ID NO: 398680 - RNA, 64 nt, Human; identical to SEQ ID NO: 316850

SEQ ID NO: 398681 - RNA, 64 nt, Human; identical to SEQ ID NO: 316851

SEQ ID NO: 398682 - RNA, 64 nt, Human; identical to SEQ ID NO: 316852

SEQ ID NO: 398683 - RNA, 64 nt, Human; identical to SEQ ID NO: 316853

SEQ ID NO: 398684 - RNA, 64 nt, Human; identical to SEQ ID NO: 316854

SEQ ID NO: 398685 - RNA, 64 nt, Human; identical to SEQ ID NO: 316855

SEQ ID NO: 398686 - RNA, 64 nt, Human; identical to SEQ ID NO: 316859

SEQ ID NO: 398687 - RNA, 64 nt, Human; identical to SEQ ID NO: 316860

SEQ ID NO: 398688 - RNA, 64 nt, Human; identical to SEQ ID NO: 316861

SEQ ID NO: 398689 - RNA, 64 nt, Human; identical to SEQ ID NO: 316862

SEQ ID NO: 398690 - RNA, 64 nt, Human; identical to SEQ ID NO: 316863

SEQ ID NO: 398691 - RNA, 64 nt, Human; identical to SEQ ID NO: 316864

SEQ ID NO: 398692 - RNA, 64 nt, Human; identical to SEQ ID NO: 316865

SEQ ID NO: 398693 - RNA, 64 nt, Human; identical to SEQ ID NO: 316866

SEQ ID NO: 398694 - RNA, 64 nt, Human; identical to SEQ ID NO: 316867

SEQ ID NO: 398695 - RNA, 64 nt, Human; identical to SEQ ID NO: 316868

SEQ ID NO: 398696 - RNA, 64 nt, Human; identical to SEQ ID NO: 316869

SEQ ID NO: 398697 - RNA, 64 nt, Human; identical to SEQ ID NO: 316870

SEQ ID NO: 398698 - RNA, 64 nt, Human; identical to SEQ ID NO: 316871

SEQ ID NO: 398699 - RNA, 64 nt, Human; identical to SEQ ID NO: 316872

SEQ ID NO: 398700 - RNA, 64 nt, Human; identical to SEQ ID NO: 316873

SEQ ID NO: 398701 - RNA, 64 nt, Human; identical to SEQ ID NO: 316877

SEQ ID NO: 398702 - RNA, 64 nt, Human; identical to SEQ ID NO: 316878

SEQ ID NO: 398703 - RNA, 64 nt, Human; identical to SEQ ID NO: 316879

SEQ ID NO: 398704 - RNA, 64 nt, Human; identical to SEQ ID NO: 316880

SEQ ID NO: 398705 - RNA, 64 nt, Human; identical to SEQ ID NO: 316881

SEQ ID NO: 398706 - RNA, 64 nt, Human; identical to SEQ ID NO: 316882

SEQ ID NO: 398707 - RNA, 64 nt, Human; identical to SEQ ID NO: 316883

SEQ ID NO: 398708 - RNA, 64 nt, Human; identical to SEQ ID NO: 316884

SEQ ID NO: 398709 - RNA, 64 nt, Human; identical to SEQ ID NO: 316885

SEQ ID NO: 398710 - RNA, 64 nt, Human; identical to SEQ ID NO: 316886

SEQ ID NO: 398711 - RNA, 64 nt, Human; identical to SEQ ID NO: 316887

SEQ ID NO: 398712 - RNA, 64 nt, Human; identical to SEQ ID NO: 316888

SEQ ID NO: 398713 - RNA, 64 nt, Human; identical to SEQ ID NO: 316889

SEQ ID NO: 398714 - RNA, 64 nt, Human; identical to SEQ ID NO: 316890

SEQ ID NO: 398715 - RNA, 64 nt, Human; identical to SEQ ID NO: 316891

SEQ ID NO: 398716 - RNA, 64 nt, Human; identical to SEQ ID NO: 316895

SEQ ID NO: 398717 - RNA, 64 nt, Human; identical to SEQ ID NO: 316896

SEQ ID NO: 398718 - RNA, 52 nt, Human; identical to SEQ ID NO: 316897

SEQ ID NO: 398719 - RNA, 64 nt, Human; identical to SEQ ID NO: 316898

SEQ ID NO: 398720 - RNA, 64 nt, Human; identical to SEQ ID NO: 316899

SEQ ID NO: 398721 - RNA, 64 nt, Human; identical to SEQ ID NO: 316900

SEQ ID NO: 398722 - RNA, 64 nt, Human; identical to SEQ ID NO: 316901

SEQ ID NO: 398723 - RNA, 64 nt, Human; identical to SEQ ID NO: 316902

SEQ ID NO: 398724 - RNA, 64 nt, Human; identical to SEQ ID NO: 316903

SEQ ID NO: 398725 - RNA, 64 nt, Human; identical to SEQ ID NO: 316904

SEQ ID NO: 398726 - RNA, 64 nt, Human; identical to SEQ ID NO: 316905

SEQ ID NO: 398727 - RNA, 64 nt, Human; identical to SEQ ID NO: 316906

SEQ ID NO: 398728 - RNA, 64 nt, Human; identical to SEQ ID NO: 316907

SEQ ID NO: 398729 - RNA, 64 nt, Human; identical to SEQ ID NO: 316908

SEQ ID NO: 398730 - RNA, 64 nt, Human; identical to SEQ ID NO: 316909

SEQ ID NO: 398731 - RNA, 64 nt, Human; identical to SEQ ID NO: 316913

SEQ ID NO: 398732 - RNA, 64 nt, Human; identical to SEQ ID NO: 316914

SEQ ID NO: 398733 - RNA, 64 nt, Human; identical to SEQ ID NO: 316915

SEQ ID NO: 398734 - RNA, 64 nt, Human; identical to SEQ ID NO: 316916

SEQ ID NO: 398735 - RNA, 64 nt, Human; identical to SEQ ID NO: 316917

SEQ ID NO: 398736 - RNA, 64 nt, Human; identical to SEQ ID NO: 316918

SEQ ID NO: 398737 - RNA, 64 nt, Human; identical to SEQ ID NO: 316919

SEQ ID NO: 398738 - RNA, 64 nt, Human; identical to SEQ ID NO: 316920

SEQ ID NO: 398739 - RNA, 64 nt, Human; identical to SEQ ID NO: 316921

SEQ ID NO: 398740 - RNA, 64 nt, Human; identical to SEQ ID NO: 316922

SEQ ID NO: 398741 - RNA, 64 nt, Human; identical to SEQ ID NO: 316923

SEQ ID NO: 398742 - RNA, 64 nt, Human; identical to SEQ ID NO: 316924

SEQ ID NO: 398743 - RNA, 64 nt, Human; identical to SEQ ID NO: 316925

SEQ ID NO: 398744 - RNA, 64 nt, Human; identical to SEQ ID NO: 316926

SEQ ID NO: 398745 - RNA, 64 nt, Human; identical to SEQ ID NO: 316927

SEQ ID NO: 398746 - RNA, 64 nt, Human; identical to SEQ ID NO: 316931

SEQ ID NO: 398747 - RNA, 64 nt, Human; identical to SEQ ID NO: 316932

SEQ ID NO: 398748 - RNA, 64 nt, Human; identical to SEQ ID NO: 316933

SEQ ID NO: 398749 - RNA, 64 nt, Human; identical to SEQ ID NO: 316934

SEQ ID NO: 398750 - RNA, 64 nt, Human; identical to SEQ ID NO: 316935

SEQ ID NO: 398751 - RNA, 64 nt, Human; identical to SEQ ID NO: 316936

SEQ ID NO: 398752 - RNA, 64 nt, Human; identical to SEQ ID NO: 316937

SEQ ID NO: 398753 - RNA, 64 nt, Human; identical to SEQ ID NO: 316938

SEQ ID NO: 398754 - RNA, 53 nt, Human; identical to SEQ ID NO: 316939

SEQ ID NO: 398755 - RNA, 64 nt, Human; identical to SEQ ID NO: 316940

SEQ ID NO: 398756 - RNA, 64 nt, Human; identical to SEQ ID NO: 316941

SEQ ID NO: 398757 - RNA, 64 nt, Human; identical to SEQ ID NO: 316942

SEQ ID NO: 398758 - RNA, 64 nt, Human; identical to SEQ ID NO: 316943

SEQ ID NO: 398759 - RNA, 64 nt, Human; identical to SEQ ID NO: 316944

SEQ ID NO: 398760 - RNA, 64 nt, Human; identical to SEQ ID NO: 316945

SEQ ID NO: 398761 - RNA, 64 nt, Human; identical to SEQ ID NO: 316949

SEQ ID NO: 398762 - RNA, 64 nt, Human; identical to SEQ ID NO: 316950

SEQ ID NO: 398763 - RNA, 64 nt, Human; identical to SEQ ID NO: 316951

SEQ ID NO: 398764 - RNA, 64 nt, Human; identical to SEQ ID NO: 316952

SEQ ID NO: 398765 - RNA, 64 nt, Human; identical to SEQ ID NO: 316953

SEQ ID NO: 398766 - RNA, 64 nt, Human; identical to SEQ ID NO: 316954

SEQ ID NO: 398767 - RNA, 64 nt, Human; identical to SEQ ID NO: 316955

SEQ ID NO: 398768 - RNA, 64 nt, Human; identical to SEQ ID NO: 316956

SEQ ID NO: 398769 - RNA, 64 nt, Human; identical to SEQ ID NO: 316957

SEQ ID NO: 398770 - RNA, 64 nt, Human; identical to SEQ ID NO: 316958

SEQ ID NO: 398771 - RNA, 64 nt, Human; identical to SEQ ID NO: 316959

SEQ ID NO: 398772 - RNA, 64 nt, Human; identical to SEQ ID NO: 316960

SEQ ID NO: 398773 - RNA, 64 nt, Human; identical to SEQ ID NO: 316961

SEQ ID NO: 398774 - RNA, 64 nt, Human; identical to SEQ ID NO: 316962

SEQ ID NO: 398775 - RNA, 64 nt, Human; identical to SEQ ID NO: 316963

SEQ ID NO: 398776 - RNA, 64 nt, Human; identical to SEQ ID NO: 316967

SEQ ID NO: 398777 - RNA, 64 nt, Human; identical to SEQ ID NO: 316968

SEQ ID NO: 398778 - RNA, 64 nt, Human; identical to SEQ ID NO: 316969

SEQ ID NO: 398779 - RNA, 64 nt, Human; identical to SEQ ID NO: 316970

SEQ ID NO: 398780 - RNA, 64 nt, Human; identical to SEQ ID NO: 316971

SEQ ID NO: 398781 - RNA, 64 nt, Human; identical to SEQ ID NO: 316972

SEQ ID NO: 398782 - RNA, 64 nt, Human; identical to SEQ ID NO: 316973

SEQ ID NO: 398783 - RNA, 64 nt, Human; identical to SEQ ID NO: 316974

SEQ ID NO: 398784 - RNA, 64 nt, Human; identical to SEQ ID NO: 316975

SEQ ID NO: 398785 - RNA, 64 nt, Human; identical to SEQ ID NO: 316976

SEQ ID NO: 398786 - RNA, 64 nt, Human; identical to SEQ ID NO: 316977

SEQ ID NO: 398787 - RNA, 64 nt, Human; identical to SEQ ID NO: 316978

SEQ ID NO: 398788 - RNA, 64 nt, Human; identical to SEQ ID NO: 316979

SEQ ID NO: 398789 - RNA, 64 nt, Human; identical to SEQ ID NO: 316980

SEQ ID NO: 398790 - RNA, 64 nt, Human; identical to SEQ ID NO: 316981

SEQ ID NO: 398791 - RNA, 64 nt, Human; identical to SEQ ID NO: 316985

SEQ ID NO: 398792 - RNA, 64 nt, Human; identical to SEQ ID NO: 316986

SEQ ID NO: 398793 - RNA, 64 nt, Human; identical to SEQ ID NO: 316987

SEQ ID NO: 398794 - RNA, 64 nt, Human; identical to SEQ ID NO: 316988

SEQ ID NO: 398795 - RNA, 64 nt, Human; identical to SEQ ID NO: 316989

SEQ ID NO: 398796 - RNA, 64 nt, Human; identical to SEQ ID NO: 316990

SEQ ID NO: 398797 - RNA, 64 nt, Human; identical to SEQ ID NO: 316991

SEQ ID NO: 398798 - RNA, 64 nt, Human; identical to SEQ ID NO: 316992

SEQ ID NO: 398799 - RNA, 64 nt, Human; identical to SEQ ID NO: 316993

SEQ ID NO: 398800 - RNA, 64 nt, Human; identical to SEQ ID NO: 316994

SEQ ID NO: 398801 - RNA, 64 nt, Human; identical to SEQ ID NO: 316995

SEQ ID NO: 398802 - RNA, 64 nt, Human; identical to SEQ ID NO: 316996

SEQ ID NO: 398803 - RNA, 64 nt, Human; identical to SEQ ID NO: 316997

SEQ ID NO: 398804 - RNA, 64 nt, Human; identical to SEQ ID NO: 316998

SEQ ID NO: 398805 - RNA, 64 nt, Human; identical to SEQ ID NO: 316999

SEQ ID NO: 398806 - RNA, 64 nt, Human; identical to SEQ ID NO: 317003

SEQ ID NO: 398807 - RNA, 64 nt, Human; identical to SEQ ID NO: 317004

SEQ ID NO: 398808 - RNA, 64 nt, Human; identical to SEQ ID NO: 317005

SEQ ID NO: 398809 - RNA, 64 nt, Human; identical to SEQ ID NO: 317006

SEQ ID NO: 398810 - RNA, 64 nt, Human; identical to SEQ ID NO: 317007

SEQ ID NO: 398811 - RNA, 64 nt, Human; identical to SEQ ID NO: 317008

SEQ ID NO: 398812 - RNA, 64 nt, Human; identical to SEQ ID NO: 317009

SEQ ID NO: 398813 - RNA, 64 nt, Human; identical to SEQ ID NO: 317010

SEQ ID NO: 398814 - RNA, 64 nt, Human; identical to SEQ ID NO: 317011

SEQ ID NO: 398815 - RNA, 64 nt, Human; identical to SEQ ID NO: 317012

SEQ ID NO: 398816 - RNA, 64 nt, Human; identical to SEQ ID NO: 317013

SEQ ID NO: 398817 - RNA, 64 nt, Human; identical to SEQ ID NO: 317014

SEQ ID NO: 398818 - RNA, 64 nt, Human; identical to SEQ ID NO: 317015

SEQ ID NO: 398819 - RNA, 64 nt, Human; identical to SEQ ID NO: 317016

SEQ ID NO: 398820 - RNA, 64 nt, Human; identical to SEQ ID NO: 317017

SEQ ID NO: 398821 - RNA, 64 nt, Human; identical to SEQ ID NO: 317021

SEQ ID NO: 398822 - RNA, 64 nt, Human; identical to SEQ ID NO: 317022

SEQ ID NO: 398823 - RNA, 64 nt, Human; identical to SEQ ID NO: 317023

SEQ ID NO: 398824 - RNA, 64 nt, Human; identical to SEQ ID NO: 317024

SEQ ID NO: 398825 - RNA, 64 nt, Human; identical to SEQ ID NO: 317025

SEQ ID NO: 398826 - RNA, 64 nt, Human; identical to SEQ ID NO: 317026

SEQ ID NO: 398827 - RNA, 64 nt, Human; identical to SEQ ID NO: 317027

SEQ ID NO: 398828 - RNA, 64 nt, Human; identical to SEQ ID NO: 317028

SEQ ID NO: 398829 - RNA, 64 nt, Human; identical to SEQ ID NO: 317029

SEQ ID NO: 398830 - RNA, 64 nt, Human; identical to SEQ ID NO: 317030

SEQ ID NO: 398831 - RNA, 64 nt, Human; identical to SEQ ID NO: 317031

SEQ ID NO: 398832 - RNA, 64 nt, Human; identical to SEQ ID NO: 317032

SEQ ID NO: 398833 - RNA, 64 nt, Human; identical to SEQ ID NO: 317033

SEQ ID NO: 398834 - RNA, 64 nt, Human; identical to SEQ ID NO: 317034

SEQ ID NO: 398835 - RNA, 64 nt, Human; identical to SEQ ID NO: 317035

SEQ ID NO: 398836 - RNA, 64 nt, Human; identical to SEQ ID NO: 317039

SEQ ID NO: 398837 - RNA, 64 nt, Human; identical to SEQ ID NO: 317040

SEQ ID NO: 398838 - RNA, 64 nt, Human; identical to SEQ ID NO: 317041

SEQ ID NO: 398839 - RNA, 64 nt, Human; identical to SEQ ID NO: 317042

SEQ ID NO: 398840 - RNA, 64 nt, Human; identical to SEQ ID NO: 317043

SEQ ID NO: 398841 - RNA, 64 nt, Human; identical to SEQ ID NO: 317044

SEQ ID NO: 398842 - RNA, 64 nt, Human; identical to SEQ ID NO: 317045

SEQ ID NO: 398843 - RNA, 64 nt, Human; identical to SEQ ID NO: 317046

SEQ ID NO: 398844 - RNA, 64 nt, Human; identical to SEQ ID NO: 317047

SEQ ID NO: 398845 - RNA, 64 nt, Human; identical to SEQ ID NO: 317048

SEQ ID NO: 398846 - RNA, 64 nt, Human; identical to SEQ ID NO: 317049

SEQ ID NO: 398847 - RNA, 64 nt, Human; identical to SEQ ID NO: 317050

SEQ ID NO: 398848 - RNA, 64 nt, Human; identical to SEQ ID NO: 317051

SEQ ID NO: 398849 - RNA, 64 nt, Human; identical to SEQ ID NO: 317052

SEQ ID NO: 398850 - RNA, 64 nt, Human; identical to SEQ ID NO: 317053

SEQ ID NO: 398851 - RNA, 64 nt, Human; identical to SEQ ID NO: 317057

SEQ ID NO: 398852 - RNA, 64 nt, Human; identical to SEQ ID NO: 317058

SEQ ID NO: 398853 - RNA, 64 nt, Human; identical to SEQ ID NO: 317059

SEQ ID NO: 398854 - RNA, 64 nt, Human; identical to SEQ ID NO: 317060

SEQ ID NO: 398855 - RNA, 64 nt, Human; identical to SEQ ID NO: 317061

SEQ ID NO: 398856 - RNA, 64 nt, Human; identical to SEQ ID NO: 317062

SEQ ID NO: 398857 - RNA, 64 nt, Human; identical to SEQ ID NO: 317063

SEQ ID NO: 398858 - RNA, 64 nt, Human; identical to SEQ ID NO: 317064

SEQ ID NO: 398859 - RNA, 64 nt, Human; identical to SEQ ID NO: 317065

SEQ ID NO: 398860 - RNA, 64 nt, Human; identical to SEQ ID NO: 317066

SEQ ID NO: 398861 - RNA, 64 nt, Human; identical to SEQ ID NO: 317067

SEQ ID NO: 398862 - RNA, 64 nt, Human; identical to SEQ ID NO: 317068

SEQ ID NO: 398863 - RNA, 64 nt, Human; identical to SEQ ID NO: 317069

SEQ ID NO: 398864 - RNA, 64 nt, Human; identical to SEQ ID NO: 317070

SEQ ID NO: 398865 - RNA, 64 nt, Human; identical to SEQ ID NO: 317071

SEQ ID NO: 398866 - RNA, 64 nt, Human; identical to SEQ ID NO: 317075

SEQ ID NO: 398867 - RNA, 64 nt, Human; identical to SEQ ID NO: 317076

SEQ ID NO: 398868 - RNA, 64 nt, Human; identical to SEQ ID NO: 317077

SEQ ID NO: 398869 - RNA, 64 nt, Human; identical to SEQ ID NO: 317078

SEQ ID NO: 398870 - RNA, 64 nt, Human; identical to SEQ ID NO: 317079

SEQ ID NO: 398871 - RNA, 64 nt, Human; identical to SEQ ID NO: 317080

SEQ ID NO: 398872 - RNA, 53 nt, Human; identical to SEQ ID NO: 317081

SEQ ID NO: 398873 - RNA, 64 nt, Human; identical to SEQ ID NO: 317082

SEQ ID NO: 398874 - RNA, 64 nt, Human; identical to SEQ ID NO: 317083

SEQ ID NO: 398875 - RNA, 64 nt, Human; identical to SEQ ID NO: 317084

SEQ ID NO: 398876 - RNA, 64 nt, Human; identical to SEQ ID NO: 317085

SEQ ID NO: 398877 - RNA, 64 nt, Human; identical to SEQ ID NO: 317086

SEQ ID NO: 398878 - RNA, 64 nt, Human; identical to SEQ ID NO: 317087

SEQ ID NO: 398879 - RNA, 64 nt, Human; identical to SEQ ID NO: 317088

SEQ ID NO: 398880 - RNA, 64 nt, Human; identical to SEQ ID NO: 317089

SEQ ID NO: 398881 - RNA, 64 nt, Human; identical to SEQ ID NO: 317093

SEQ ID NO: 398882 - RNA, 64 nt, Human; identical to SEQ ID NO: 317094

SEQ ID NO: 398883 - RNA, 64 nt, Human; identical to SEQ ID NO: 317095

SEQ ID NO: 398884 - RNA, 64 nt, Human; identical to SEQ ID NO: 317096

SEQ ID NO: 398885 - RNA, 64 nt, Human; identical to SEQ ID NO: 317097

SEQ ID NO: 398886 - RNA, 64 nt, Human; identical to SEQ ID NO: 317098

SEQ ID NO: 398887 - RNA, 64 nt, Human; identical to SEQ ID NO: 317099

SEQ ID NO: 398888 - RNA, 64 nt, Human; identical to SEQ ID NO: 317100

SEQ ID NO: 398889 - RNA, 64 nt, Human; identical to SEQ ID NO: 317101

SEQ ID NO: 398890 - RNA, 64 nt, Human; identical to SEQ ID NO: 317102

SEQ ID NO: 398891 - RNA, 64 nt, Human; identical to SEQ ID NO: 317103

SEQ ID NO: 398892 - RNA, 64 nt, Human; identical to SEQ ID NO: 317104

SEQ ID NO: 398893 - RNA, 64 nt, Human; identical to SEQ ID NO: 317105

SEQ ID NO: 398894 - RNA, 64 nt, Human; identical to SEQ ID NO: 317106

SEQ ID NO: 398895 - RNA, 64 nt, Human; identical to SEQ ID NO: 317107

SEQ ID NO: 398896 - RNA, 64 nt, Human; identical to SEQ ID NO: 317109

SEQ ID NO: 398897 - RNA, 64 nt, Human; identical to SEQ ID NO: 317110

SEQ ID NO: 398898 - RNA, 64 nt, Human; identical to SEQ ID NO: 317111

SEQ ID NO: 398899 - RNA, 64 nt, Human; identical to SEQ ID NO: 317112

SEQ ID NO: 398900 - RNA, 64 nt, Human; identical to SEQ ID NO: 317113

SEQ ID NO: 398901 - RNA, 64 nt, Human; identical to SEQ ID NO: 317114

SEQ ID NO: 398902 - RNA, 64 nt, Human; identical to SEQ ID NO: 317115

SEQ ID NO: 398903 - RNA, 64 nt, Human; identical to SEQ ID NO: 317116

SEQ ID NO: 398904 - RNA, 64 nt, Human; identical to SEQ ID NO: 317117

SEQ ID NO: 398905 - RNA, 64 nt, Human; identical to SEQ ID NO: 317118

SEQ ID NO: 398906 - RNA, 64 nt, Human; identical to SEQ ID NO: 317119

SEQ ID NO: 398907 - RNA, 64 nt, Human; identical to SEQ ID NO: 317120

SEQ ID NO: 398908 - RNA, 64 nt, Human; identical to SEQ ID NO: 317121

SEQ ID NO: 398909 - RNA, 64 nt, Human; identical to SEQ ID NO: 317122

SEQ ID NO: 398910 - RNA, 64 nt, Human; identical to SEQ ID NO: 317123

SEQ ID NO: 398911 - RNA, 64 nt, Human; identical to SEQ ID NO: 317127

SEQ ID NO: 398912 - RNA, 64 nt, Human; identical to SEQ ID NO: 317128

SEQ ID NO: 398913 - RNA, 64 nt, Human; identical to SEQ ID NO: 317129

SEQ ID NO: 398914 - RNA, 64 nt, Human; identical to SEQ ID NO: 317130

SEQ ID NO: 398915 - RNA, 64 nt, Human; identical to SEQ ID NO: 317131

SEQ ID NO: 398916 - RNA, 64 nt, Human; identical to SEQ ID NO: 317132

SEQ ID NO: 398917 - RNA, 64 nt, Human; identical to SEQ ID NO: 317133

SEQ ID NO: 398918 - RNA, 64 nt, Human; identical to SEQ ID NO: 317134

SEQ ID NO: 398919 - RNA, 64 nt, Human; identical to SEQ ID NO: 317135

SEQ ID NO: 398920 - RNA, 64 nt, Human; identical to SEQ ID NO: 317136

SEQ ID NO: 398921 - RNA, 64 nt, Human; identical to SEQ ID NO: 317137

SEQ ID NO: 398922 - RNA, 64 nt, Human; identical to SEQ ID NO: 317138

SEQ ID NO: 398923 - RNA, 64 nt, Human; identical to SEQ ID NO: 317139

SEQ ID NO: 398924 - RNA, 64 nt, Human; identical to SEQ ID NO: 317140

SEQ ID NO: 398925 - RNA, 60 nt, Human; identical to SEQ ID NO: 317141

SEQ ID NO: 398926 - RNA, 52 nt, Human; identical to SEQ ID NO: 317145

SEQ ID NO: 398927 - RNA, 64 nt, Human; identical to SEQ ID NO: 317146

SEQ ID NO: 398928 - RNA, 64 nt, Human; identical to SEQ ID NO: 317147

SEQ ID NO: 398929 - RNA, 64 nt, Human; identical to SEQ ID NO: 317148

SEQ ID NO: 398930 - RNA, 64 nt, Human; identical to SEQ ID NO: 317149

SEQ ID NO: 398931 - RNA, 64 nt, Human; identical to SEQ ID NO: 317150

SEQ ID NO: 398932 - RNA, 64 nt, Human; identical to SEQ ID NO: 317151

SEQ ID NO: 398933 - RNA, 64 nt, Human; identical to SEQ ID NO: 317152

SEQ ID NO: 398934 - RNA, 64 nt, Human; identical to SEQ ID NO: 317153

SEQ ID NO: 398935 - RNA, 64 nt, Human; identical to SEQ ID NO: 317154

SEQ ID NO: 398936 - RNA, 64 nt, Human; identical to SEQ ID NO: 317155

SEQ ID NO: 398937 - RNA, 64 nt, Human; identical to SEQ ID NO: 317156

SEQ ID NO: 398938 - RNA, 64 nt, Human; identical to SEQ ID NO: 317157

SEQ ID NO: 398939 - RNA, 64 nt, Human; identical to SEQ ID NO: 317158

SEQ ID NO: 398940 - RNA, 64 nt, Human; identical to SEQ ID NO: 317159

SEQ ID NO: 398941 - RNA, 64 nt, Human; identical to SEQ ID NO: 317163

SEQ ID NO: 398942 - RNA, 64 nt, Human; identical to SEQ ID NO: 317164

SEQ ID NO: 398943 - RNA, 64 nt, Human; identical to SEQ ID NO: 317165

SEQ ID NO: 398944 - RNA, 64 nt, Human; identical to SEQ ID NO: 317166

SEQ ID NO: 398945 - RNA, 64 nt, Human; identical to SEQ ID NO: 317167

SEQ ID NO: 398946 - RNA, 64 nt, Human; identical to SEQ ID NO: 317168

SEQ ID NO: 398947 - RNA, 64 nt, Human; identical to SEQ ID NO: 317169

SEQ ID NO: 398948 - RNA, 64 nt, Human; identical to SEQ ID NO: 317170

SEQ ID NO: 398949 - RNA, 64 nt, Human; identical to SEQ ID NO: 317171

SEQ ID NO: 398950 - RNA, 64 nt, Human; identical to SEQ ID NO: 317172

SEQ ID NO: 398951 - RNA, 64 nt, Human; identical to SEQ ID NO: 317173

SEQ ID NO: 398952 - RNA, 64 nt, Human; identical to SEQ ID NO: 317174

SEQ ID NO: 398953 - RNA, 64 nt, Human; identical to SEQ ID NO: 317175

SEQ ID NO: 398954 - RNA, 64 nt, Human
ucagggucagcucccccgcggagcugacuucagcagcccacagcuguggggcuucagcagccac

SEQ ID NO: 398955 - RNA, 64 nt, Human
ugggcggugcagcuccgcccggcuccgccccugcagcccacacagcacaacgucuuaccgugcc

SEQ ID NO: 398956 - RNA, 64 nt, Human
ucugcagauggggcuaggacugugggcuuuuagcagcccacaggugauccuaacauaucaggcc

SEQ ID NO: 398957 - RNA, 64 nt, Human; identical to SEQ ID NO: 20268

SEQ ID NO: 398958 - RNA, 64 nt, Human; identical to SEQ ID NO: 20269

SEQ ID NO: 398959 - RNA, 64 nt, Human; identical to SEQ ID NO: 20270

SEQ ID NO: 398960 - RNA, 64 nt, Human; identical to SEQ ID NO: 20271

SEQ ID NO: 398961 - RNA, 64 nt, Human; identical to SEQ ID NO: 20272

SEQ ID NO: 398962 - RNA, 54 nt, Human; identical to SEQ ID NO: 20273

SEQ ID NO: 398963 - RNA, 64 nt, Human; identical to SEQ ID NO: 20274

SEQ ID NO: 398964 - RNA, 59 nt, Human; identical to SEQ ID NO: 20275

SEQ ID NO: 398965 - RNA, 64 nt, Human; identical to SEQ ID NO: 20276

SEQ ID NO: 398966 - RNA, 64 nt, Human; identical to SEQ ID NO: 20277

SEQ ID NO: 398967 - RNA, 64 nt, Human; identical to SEQ ID NO: 20278

SEQ ID NO: 398968 - RNA, 64 nt, Human; identical to SEQ ID NO: 20279

SEQ ID NO: 398969 - RNA, 64 nt, Human; identical to SEQ ID NO: 20280

SEQ ID NO: 398970 - RNA, 64 nt, Human; identical to SEQ ID NO: 20281

SEQ ID NO: 398971 - RNA, 64 nt, Human
uuccuagaaauaagcaacaccucucccaaaaagcagcccacaaggcaggggcccagcagcccag

SEQ ID NO: 398972 - RNA, 64 nt, Human
gggcgauuacaauccaauuaccuauugucgacucagcccacacaagcuuuucuccuccucuugc

SEQ ID NO: 398973 - RNA, 64 nt, Human
cugcuccgcuuccccauaccccagcccgaggugaagcccacaccuacacacccucugcauggcc

SEQ ID NO: 398974 - RNA, 59 nt, Human; identical to SEQ ID NO: 20282

SEQ ID NO: 398975 - RNA, 64 nt, Human; identical to SEQ ID NO: 20283

SEQ ID NO: 398976 - RNA, 64 nt, Human; identical to SEQ ID NO: 20284

SEQ ID NO: 398977 - RNA, 64 nt, Human; identical to SEQ ID NO: 20285

SEQ ID NO: 398978 - RNA, 64 nt, Human; identical to SEQ ID NO: 20286

SEQ ID NO: 398979 - RNA, 64 nt, Human; identical to SEQ ID NO: 20287

SEQ ID NO: 398980 - RNA, 64 nt, Human; identical to SEQ ID NO: 20288

SEQ ID NO: 398981 - RNA, 64 nt, Human; identical to SEQ ID NO: 20289

SEQ ID NO: 398982 - RNA, 64 nt, Human; identical to SEQ ID NO: 20290

SEQ ID NO: 398983 - RNA, 64 nt, Human; identical to SEQ ID NO: 20291

SEQ ID NO: 398984 - RNA, 64 nt, Human; identical to SEQ ID NO: 20292

SEQ ID NO: 398985 - RNA, 64 nt, Human; identical to SEQ ID NO: 20293

SEQ ID NO: 398986 - RNA, 64 nt, Human; identical to SEQ ID NO: 20294

SEQ ID NO: 398987 - RNA, 64 nt, Human; identical to SEQ ID NO: 20295

SEQ ID NO: 398988 - RNA, 64 nt, Human
cuuagccaucucccuguccccagcaccccuccccagcccacagugguggccucugccucuuucc

SEQ ID NO: 398989 - RNA, 64 nt, Human
gcugaagacaggagaguacagaaugacaacauugagcccacacugcaguuuugaagauaguaac

SEQ ID NO: 398990 - RNA, 64 nt, Human
caugaaaagagacuaggugaagagagggcaggggagcccacaucuggggcuggcccacaauacc

SEQ ID NO: 398991 - RNA, 64 nt, Human
gggugggcgugcugcggguggguaucccaccuccagcccacagugcucaguuguacuuuuuauu

SEQ ID NO: 398992 - RNA, 64 nt, Human; identical to SEQ ID NO: 20296

SEQ ID NO: 398993 - RNA, 64 nt, Human; identical to SEQ ID NO: 20297

SEQ ID NO: 398994 - RNA, 64 nt, Human; identical to SEQ ID NO: 20298

SEQ ID NO: 398995 - RNA, 64 nt, Human; identical to SEQ ID NO: 20299

SEQ ID NO: 398996 - RNA, 64 nt, Human; identical to SEQ ID NO: 20300

SEQ ID NO: 398997 - RNA, 64 nt, Human; identical to SEQ ID NO: 20301

SEQ ID NO: 398998 - RNA, 64 nt, Human; identical to SEQ ID NO: 20302

SEQ ID NO: 398999 - RNA, 64 nt, Human; identical to SEQ ID NO: 20303

SEQ ID NO: 399000 - RNA, 64 nt, Human; identical to SEQ ID NO: 20304

SEQ ID NO: 399001 - RNA, 64 nt, Human; identical to SEQ ID NO: 20305

SEQ ID NO: 399002 - RNA, 64 nt, Human; identical to SEQ ID NO: 20306

SEQ ID NO: 399003 - RNA, 64 nt, Human; identical to SEQ ID NO: 20307

SEQ ID NO: 399004 - RNA, 64 nt, Human; identical to SEQ ID NO: 20308

SEQ ID NO: 399005 - RNA, 55 nt, Human; identical to SEQ ID NO: 20309

SEQ ID NO: 399006 - RNA, 64 nt, Human
uuuauaagagggaacaaauuuucacaauuugaaaagcccacauaaguuuucucuuuuaagguag

SEQ ID NO: 399007 - RNA, 64 nt, Human
uuuuuaaauuuccccccuuuuaaaauuguucgaaagcccacaguuauggaaagaauuacugucu

SEQ ID NO: 399008 - RNA, 64 nt, Human
cuacggccacaccagcaccuccuggcugaaggucagcccacacucugguccaugaggcagcaag

SEQ ID NO: 399009 - RNA, 64 nt, Human
agucugaagaggaaggaagcagcaguaucugcguagcccacagagggcccaggccccugcccag

SEQ ID NO: 399010 - RNA, 60 nt, Human; identical to SEQ ID NO: 20310

SEQ ID NO: 399011 - RNA, 64 nt, Human; identical to SEQ ID NO: 20311

SEQ ID NO: 399012 - RNA, 64 nt, Human; identical to SEQ ID NO: 20312

SEQ ID NO: 399013 - RNA, 57 nt, Human; identical to SEQ ID NO: 20313

SEQ ID NO: 399014 - RNA, 64 nt, Human; identical to SEQ ID NO: 20314

SEQ ID NO: 399015 - RNA, 64 nt, Human; identical to SEQ ID NO: 20315

SEQ ID NO: 399016 - RNA, 64 nt, Human; identical to SEQ ID NO: 20316

SEQ ID NO: 399017 - RNA, 64 nt, Human; identical to SEQ ID NO: 20317

SEQ ID NO: 399018 - RNA, 64 nt, Human; identical to SEQ ID NO: 20318

SEQ ID NO: 399019 - RNA, 64 nt, Human; identical to SEQ ID NO: 20319

SEQ ID NO: 399020 - RNA, 64 nt, Human; identical to SEQ ID NO: 20320

SEQ ID NO: 399021 - RNA, 64 nt, Human; identical to SEQ ID NO: 20321

SEQ ID NO: 399022 - RNA, 64 nt, Human; identical to SEQ ID NO: 20322

SEQ ID NO: 399023 - RNA, 64 nt, Human; identical to SEQ ID NO: 20323

SEQ ID NO: 399024 - RNA, 64 nt, Human
gccugaugacuagaccccgccuuccgcucccaccagcccacauccaguggggucucaguccagu

SEQ ID NO: 399025 - RNA, 64 nt, Human
gugccaacauugcuugcccugcaaggugcaacugagcccacauagcgcauucauaguuucccug

SEQ ID NO: 399026 - RNA, 64 nt, Human
gccaguuugguagucccccuuucuggccccuuggagcccacacacguuucaucuuuuuccccuc

SEQ ID NO: 399027 - RNA, 64 nt, Human
caucaccucggacaaauucaggaagcauuucuuuagcccacaaguccagacccaggugcucugu

SEQ ID NO: 399028 - RNA, 64 nt, Human; identical to SEQ ID NO: 20324

SEQ ID NO: 399029 - RNA, 64 nt, Human; identical to SEQ ID NO: 20325

SEQ ID NO: 399030 - RNA, 64 nt, Human; identical to SEQ ID NO: 20326

SEQ ID NO: 399031 - RNA, 64 nt, Human; identical to SEQ ID NO: 20327

SEQ ID NO: 399032 - RNA, 64 nt, Human; identical to SEQ ID NO: 20328

SEQ ID NO: 399033 - RNA, 64 nt, Human; identical to SEQ ID NO: 20329

SEQ ID NO: 399034 - RNA, 64 nt, Human; identical to SEQ ID NO: 20330

SEQ ID NO: 399035 - RNA, 64 nt, Human; identical to SEQ ID NO: 20331

SEQ ID NO: 399036 - RNA, 59 nt, Human; identical to SEQ ID NO: 20282

SEQ ID NO: 399037 - RNA, 64 nt, Human; identical to SEQ ID NO: 20333

SEQ ID NO: 399038 - RNA, 64 nt, Human; identical to SEQ ID NO: 20334

SEQ ID NO: 399039 - RNA, 64 nt, Human
cugugcucccacgguucccaggggccaggcugggagcccacagccaccccacuaugccgcaggc

SEQ ID NO: 399040 - RNA, 51 nt, Human
ggcagaccccugggugcuagaagcccacacccucuacccuguuccucagca

SEQ ID NO: 399041 - RNA, 64 nt, Human
cacaucaguguuuccgucugcucaccugccacagagcccacacccaugcccaccaguguugguc

SEQ ID NO: 399042 - RNA, 64 nt, Human
cuacuuauacuuacaguaguaaguuauacuugugagcccacagaguggcagacagcauggcucu

SEQ ID NO: 399043 - RNA, 64 nt, Human
ugcccccagccuggcuggacagcaaggaauccacagcccacacgugagcucccuccucaccccc

SEQ ID NO: 399044 - RNA, 64 nt, Human
gcccuuccaccagaaaagcuagucuaggugugagagcccacauugucuguagccaucaaaaaua

SEQ ID NO: 399045 - RNA, 64 nt, Human
uuggucagagggacagagcaaggaaugcauccugagcccacagcuuugaccacugugauccaga

SEQ ID NO: 399046 - RNA, 64 nt, Human
uaccccaucccuuccuccccagucuacguucuccagcccacaccccuccaaagccccaccuuua

SEQ ID NO: 399047 - RNA, 64 nt, Human
gaaaaacauaaauuuaggucuaugggcuagauuuagcccacaguugccaguuucuagcgcuacc

SEQ ID NO: 399048 - RNA, 64 nt, Human
uuccauuucgccccucauuuaucccucaacccccagcccacagguguuuauacagcucagcuuu

SEQ ID NO: 399049 - RNA, 64 nt, Human
uauauucugugucauuuuucuucaugggagaaacagcccacagagcucaccaacaaguacucca

SEQ ID NO: 399050 - RNA, 64 nt, Human
uugaauguuuguccuuaggauaggccuaugugcuagcccacaaagaauauugucucauuagccu

SEQ ID NO: 399051 - RNA, 64 nt, Human
ccugaggggcaacacacaagaaccagguccccucagcccacagcacugucuuuuugcugaucca

SEQ ID NO: 399052 - RNA, 64 nt, Human
uggccugcuguacaagcuucaaaaagugucccagagcccacacggcucggugucagaugguguc

SEQ ID NO: 399053 - RNA, 64 nt, Human
guuaugugggaaagguaaagcaacaccaaauaaaagcccacagcagcuucaucuuuacgauaac

SEQ ID NO: 399054 - RNA, 64 nt, Human
uacauaggagauugauaauacuguauuuguuuuaagcccacaguguuuuacuccacuuucaaaa

SEQ ID NO: 399055 - RNA, 64 nt, Human
uuccugaggccuccccagaagcagaagcauguaaagcccacagaaccgugaguugauuaaaucu

SEQ ID NO: 399056 - RNA, 64 nt, Human
cuuccugccugaaauugcugcugcccaucgcaugagcccacacaguagcacccccguccuuagg

SEQ ID NO: 399057 - RNA, 64 nt, Human
ccuuggccucggcgggcuuuucuggggcccaggaagcccacacuaugcacagagcccaaugcau

SEQ ID NO: 399058 - RNA, 64 nt, Human
acucugacgggagcaucuguauuuuuauguuaaaagcccacaaaauaaaaauaaaaaguaacug

SEQ ID NO: 399059 - RNA, 64 nt, Human
cuggaugggaggaagggcagacgguacaugucccagcccacauagaugccccuugcugagggua

SEQ ID NO: 399060 - RNA, 64 nt, Human
ugcaaggagcagaguguguucaccuugagucuccagcccacagccaagguggacguaccucucc

SEQ ID NO: 399061 - RNA, 64 nt, Human
uaguggcuuccuccgucugcaaugucccuugcacagcccacacaugaaccauccuucccaugau

SEQ ID NO: 399062 - RNA, 64 nt, Human
gggaauggugaaaugacuggauugcucuuuauccagcccacagcaggggaaagaaaggcaacuc

SEQ ID NO: 399063 - RNA, 64 nt, Human
gaucugaauagagaaaugcuuacagauaaucauuagcccacauaccaguaacuuauacuuaaag

SEQ ID NO: 399064 - RNA, 64 nt, Human
aggagcagagccagggccuggcgagcuggcguggagcccacaggauucagcagcauggacaguc

SEQ ID NO: 399065 - RNA, 64 nt, Human
uacuaucuccuuggggguuagggaugcuaagaagagcccacaaauagaggauuacucuuccccu

SEQ ID NO: 399066 - RNA, 64 nt, Human
ccacuuccguggccaccuccaugcagaagcccuaagcccacauucuuucgauagcucacggugg

SEQ ID NO: 399067 - RNA, 64 nt, Human
ggccuacagaggaggccucaaagcaacccgcuggagcccacagcgagccugugccuuccucccc

SEQ ID NO: 399068 - RNA, 64 nt, Human
cuguagggguucuaaaggacagcaccagcgggacagcccacaaggcuggggcuggagaaugaga

SEQ ID NO: 399069 - RNA, 64 nt, Human
uucauuuaaaaaguuggaggaucugaacauacagagcccacauuuccacaccagaacuggaacu

SEQ ID NO: 399070 - RNA, 64 nt, Human
aagauucugugggcagcuggcucugaauguagccagcccacauccauuccagagcugcagaacc

SEQ ID NO: 399071 - RNA, 64 nt, Human
cugggaggccaggacacugaggagcucugaacccagcccacagggaagcagaggaaggugagcc

SEQ ID NO: 399072 - RNA, 64 nt, Human
cucuagcaauuauggaccauaagcacuucccuccagcccacaagucacagccuggugccgaggc

SEQ ID NO: 399073 - RNA, 64 nt, Human
uguaagccuucagccuggcaaguuacauguagaaagcccacacuugugaagguuuuguuuuaca

SEQ ID NO: 399074 - RNA, 64 nt, Human
uggaaccacccagacaucugcuuccacccagccaagcccacaucacaucuccuggccgagagca

SEQ ID NO: 399075 - RNA, 64 nt, Human
ggcugccuaucugggcgaguagaccgccuggcucagcccacaggccugcagcaucccauagcac

SEQ ID NO: 399076 - RNA, 64 nt, Human
cagucgggccacaacugucucuguuucaacuuuaagcccacacacucuguagcuuuucuaaaac

SEQ ID NO: 399077 - RNA, 64 nt, Human
cugagguuuaccuggaucuggcuacugaggcuagagcccacagcagaaugggguugggccugug

SEQ ID NO: 399078 - RNA, 64 nt, Human
cuaguuuccaucucuaucauuuuauaauaaccguagcccacauuguaguaguuuuucagcucuu

SEQ ID NO: 399079 - RNA, 64 nt, Human
gauauauuuagagagagagauauuuuuaagacaaagcccacaauuagcuguccuuuaacaccgc

SEQ ID NO: 399080 - RNA, 64 nt, Human
acaaccaccaccagugcuaccaccguugccacugagcccacaucccaagagacaggcccagagc

SEQ ID NO: 399081 - RNA, 64 nt, Human
uuuaaauaaacacaguccagacucaaacggaggaagcccacauauucuauuauagauauauaaa

SEQ ID NO: 399082 - RNA, 64 nt, Human
cauucaccauggcaucccagagcaaggacacaggagcccacaggccaguugagguugggcaagg

SEQ ID NO: 399083 - RNA, 64 nt, Human
gaaaacuugcuaagugaaagaagccaggugcaaaagcccacauauugucugacugcauugaaau

SEQ ID NO: 399084 - RNA, 64 nt, Human
gcaggccccagugugaccaccacugcgaccccugagcccacaagggcagagcagcauucugaga

SEQ ID NO: 399085 - RNA, 64 nt, Human
ccaggagacucaugaggacugugugaccugcacaagcccacaccugggcaggcuguuggugucu

SEQ ID NO: 399086 - RNA, 64 nt, Human
uuuagaagggguguccacuucaccaggucaccacagcccacacuacgcccuaucacuucccaca

SEQ ID NO: 399087 - RNA, 64 nt, Human
ccccaacagcccauuugcccacuucccacugcucagcccacaccagaccuccaggagacauccc

SEQ ID NO: 399088 - RNA, 64 nt, Human
caauggagccccggaucccaagcccugcauuguaagcccacaguaggcacucaauaaaugcuug

SEQ ID NO: 399089 - RNA, 64 nt, Human
uugcucuuccuagaugcccaccuccuacaaucucagcccacaaguccucuccacccuagggggc

SEQ ID NO: 399090 - RNA, 64 nt, Human
cccaucuucauucacccagaagaaacagagcaugagcccacaaaaauguucuacaaaaaagaag

SEQ ID NO: 399091 - RNA, 64 nt, Human
cuuugccacuucccucuucuuuguccagagagccagcccacagccaaugcuuauugaucuguuc

SEQ ID NO: 399092 - RNA, 64 nt, Human
ucagaccaggcuacccagucgaguccucuuguggagcccacaguccucauggagcuaacuucuc

SEQ ID NO: 399093 - RNA, 64 nt, Human
cacagagaagaccuucuagugagccugggccaggagcccacagugccuguacaggaaggugccu

SEQ ID NO: 399094 - RNA, 64 nt, Human
agagcaccggcacccccagaagacucugcuucuuagcccacauuccuccgggccuuauggagaa

SEQ ID NO: 399095 - RNA, 64 nt, Human
aaguguuccguacccacugcugaugguuucccagagcccacacugaguugaagaaccuauuguu

SEQ ID NO: 399096 - RNA, 64 nt, Human
gaaacaugagauucuccucuauuggaagcuaauuagcccacaaaggugguaaaccuguagauug

SEQ ID NO: 399097 - RNA, 64 nt, Human
gcagaaggugugcuauucacaguaccaugcgaguagcccacaguuaauucccggcagauucuuu

SEQ ID NO: 399098 - RNA, 64 nt, Human
ugcaauaaaggccauucguuaccuacuuuucagcagcccacaagauguagcacuauuagugucc

SEQ ID NO: 399099 - RNA, 64 nt, Human
gaucaggacccaaacuugggcagucugggcugggagcccacaccccacucaccaguucugcugc

SEQ ID NO: 399100 - RNA, 64 nt, Human
augucugcucuguucaaaaggcagcugggaucccagcccacaagugaucagcagaguugcauuu

SEQ ID NO: 399101 - RNA, 64 nt, Human
ggcaggauuuggaaucaggccaugucuucuccagagcccacauccauccuuucucuauauugcc

SEQ ID NO: 399102 - RNA, 64 nt, Human
cccggggcuccugagccucugcgugugcccucccagcccacaccagugcucucggccacugagc

SEQ ID NO: 399103 - RNA, 64 nt, Human
uuuuguugaguugcugcuauugcacugccagugcagcccacaccaaaucacaacccaagauacu

SEQ ID NO: 399104 - RNA, 64 nt, Human
uagcaggccaagauaaaauuuugacagcucuuuaagcccacaugcagcagugggucagauaacc

SEQ ID NO: 399105 - RNA, 64 nt, Human
acuaaaugauauuuagccuaucaaaacuuccaaaagcccacaccaccaguuccugacucaaauu

SEQ ID NO: 399106 - RNA, 64 nt, Human
ugagcagcugaggugcugcagccccuucccuuccagcccacaagugugugcauauugagcuccu

SEQ ID NO: 399107 - RNA, 64 nt, Human
ucacuggugaaggacagucaggugaaggacuguaagcccacacaagcucuucuuaucucuacua

SEQ ID NO: 399108 - RNA, 64 nt, Human
ccuaaccuccugcucccccucaagccaacuaugcagcccacaagaaggcccugcgggccccccc

SEQ ID NO: 399109 - RNA, 64 nt, Human
uccagagaauaguuuugacuuaacaugucuguuuagcccacaucacgucaguuaucaacaccgc

SEQ ID NO: 399110 - RNA, 64 nt, Human
cuuuaaacccaugaguuuaugcccugggcuccuuagcccacaauaguguaauaaaagugccccg

SEQ ID NO: 399111 - RNA, 64 nt, Human
acugggaaaugggagcacaguacugggaaaugggagcccacaguacugggaaaggggaguucac

SEQ ID NO: 399112 - RNA, 64 nt, Human
cagccacuucuuuucauaagcacugacagggcccagcccacagccacaggugcgaucagugccu

SEQ ID NO: 399113 - RNA, 64 nt, Human
uguggccguuuucugaugccuaaguauuauacagagcccacaauggccaguuuacuaccagaaa

SEQ ID NO: 399114 - RNA, 64 nt, Human
uaauuagaaaaaggcuuggugaggcugagaaaccagcccacaauuacacaaagacaaaaaaagg

SEQ ID NO: 399115 - RNA, 64 nt, Human
ugucagaagcaagcauaaucauugcuguguccucagcccacagagcugcaucucuugaagcugu

SEQ ID NO: 399116 - RNA, 64 nt, Human
aaguaauagauuuucuuggcaaaucuaaugauucagcccacaggacuguugaaacuacugcgga

SEQ ID NO: 399117 - RNA, 64 nt, Human
ccucuuccccuccaccacacccagguggacuugcagcccacaaggggugaggaaaggacagcag

SEQ ID NO: 399118 - RNA, 64 nt, Human
aauguucccuugaccauuggcugcgcuaacccccagcccacagagccugaauuuguaagcaacu

SEQ ID NO: 399119 - RNA, 64 nt, Human
uuuugauuguaaaccauaaaauaguucagcaaguagcccacaguucuggccuaacagcagacuu

SEQ ID NO: 399120 - RNA, 64 nt, Human
ccuuggccuugaguagcaggggccugguccccacagcccacaggauggaccaaagggggcaggu

SEQ ID NO: 399121 - RNA, 64 nt, Human
gggagccugcgaaggagagguucuguagaauccaagcccacauuuccaaagucacccccaacgc

SEQ ID NO: 399122 - RNA, 64 nt, Human
cgggcuucugaggguacccuguggccagcccugaagcccacauuucugggggugucgucacugc

SEQ ID NO: 399123 - RNA, 64 nt, Human
ugaagauaaaugugcuguuucuaguuucuuaaauagcccacaccccuggaugcaaaaaggcagg

SEQ ID NO: 399124 - RNA, 64 nt, Human
ucuuuuccagccugauuuuuuuucccacaggaagagcccacauguagcccugagguuuccuucc

SEQ ID NO: 399125 - RNA, 64 nt, Human
agaggggagcugcuuuagaggcuaaguugcuuugagcccacaagguaauggagggcuccuacuu

SEQ ID NO: 399126 - RNA, 64 nt, Human
ucucugccaggcuccucaggcccagacagaggccagcccacaaccuaugacccccucccccagg

SEQ ID NO: 399127 - RNA, 64 nt, Human
ucucugaccccucacguuccuaccacagggccacagcccacacagcccugggacacugcccugg

SEQ ID NO: 399128 - RNA, 61 nt, Human
uuguccaccauguggccuaagagcucuggggagcccacacuccccaaagcaguuagacuau

SEQ ID NO: 399129 - RNA, 64 nt, Human
aagaauauuguuauagauggaaguuaggaccauuagcccacagaugcauguauucucucagaca

SEQ ID NO: 399130 - RNA, 64 nt, Human
ccuucucuuuucugccucuuacaugugaauguugagcccacaaucaacagugguuuuauuuuuu

SEQ ID NO: 399131 - RNA, 64 nt, Human
uacuuuaucaugagauguguguuaagaaggcugcagcccacaggaguccagggaaggcggggac

SEQ ID NO: 399132 - RNA, 64 nt, Human
gugacaagaugguguucugcuaauguuaaaugucagcccacagagcuaauaauaccucaguaua

SEQ ID NO: 399133 - RNA, 64 nt, Human
augucuuuaguuccucauguuaacacgaagccagagcccacaugaacuguuggaugucuuccuu

SEQ ID NO: 399134 - RNA, 64 nt, Human
aagauucauccaguuguuugugacagcaaagaugagcccacagagaagcaggcucacuuccugc

SEQ ID NO: 399135 - RNA, 64 nt, Human
cacagcagcuacuagaccccauuagcaccucauuagcccacaagccagccaggggccccaggaa

SEQ ID NO: 399136 - RNA, 64 nt, Human
ggccauagcccuaaggacuccugccagaccacacagcccacaccuggcccuguucacggcuguu

SEQ ID NO: 399137 - RNA, 64 nt, Human
ggaccccgcucagcauggcugcagguaccuugauagcccacagagagaucugggaaggaagggc

SEQ ID NO: 399138 - RNA, 64 nt, Human
ggcucagcauguuuggggucagucaguguuggagagcccacauaugggauugccacuagcuucu

SEQ ID NO: 399139 - RNA, 64 nt, Human
guaguacuucuucuguaauauuuacaauguauuaagcccacaguauauuuuauuucaauguaau

SEQ ID NO: 399140 - RNA, 64 nt, Human
ccacccaccccuccugggcccaggcagcaccuggagcccacagagucuguguguagccaggaag

SEQ ID NO: 399141 - RNA, 64 nt, Human
agaggaugacacaucaaauaauaacucggauuccagcccacauuggauucaucagcauuuggac

SEQ ID NO: 399142 - RNA, 64 nt, Human
agcccacauuggauucaucagcauuuggaccaauagcccacagcugagaauguggaauaccuaa

SEQ ID NO: 399143 - RNA, 64 nt, Human
agggccuguugaugggcuuugcaggcaguccagcagcccacaccugcaggcaggaugcugucgu

SEQ ID NO: 399144 - RNA, 64 nt, Human
uggcacacaccccuccggacauccagcgugacggagcccacacugccaccuuguggccgccuga

SEQ ID NO: 399145 - RNA, 64 nt, Human
cagagcaaaggaugguggccgcaggccccacgcgagcccacaggacaccggccccuagauucca

SEQ ID NO: 399146 - RNA, 64 nt, Human
gcugcuuggcgagcuaacagcugaccuuucgggaagcccacagacgcuggaggaaucuugaguu

SEQ ID NO: 399147 - RNA, 64 nt, Human
ccaaacuggguuauuugacccugaucuuguguacagcccacacccugguguacggugggaagag

SEQ ID NO: 399148 - RNA, 64 nt, Human
gcgguguggcugcagccucagucccugccccuccagcccacagcccccaucccguagcccuucc

SEQ ID NO: 399149 - RNA, 64 nt, Human
gcauuguuauuggagccuguacuuagagggauuaagcccacacccuggcuuccauuccauauca

SEQ ID NO: 399150 - RNA, 64 nt, Human
acauaaauuauguuuuguauuauaugacuuuaagagcccacauuagguuuuaugauucauuugc

SEQ ID NO: 399151 - RNA, 64 nt, Human
ugcuuccucagccuuguagcaaaggcuacacagcagcccacaguccacagucuuuuugggaaaa

SEQ ID NO: 399152 - RNA, 64 nt, Human
cagguuggaggcagaggagccgauggcuggaggaagcccacaggcggauguuccccacuugccu

SEQ ID NO: 399153 - RNA, 64 nt, Human
ccggccagcucuaggcucuggggggccccgcugcagcccacacuggguguggugccccaggccu

SEQ ID NO: 399154 - RNA, 64 nt, Human
gcccuugggucgggcccuggagacgacacacggcagcccacaggccacgacagacgcuggaugc

SEQ ID NO: 399155 - RNA, 64 nt, Human
gccucuauccccuuccccacguuccagccccugcagcccacauuuuaaguauauuccuucaagu

SEQ ID NO: 399156 - RNA, 64 nt, Human
caggcauuguuuaccugcucuugcuccccgcuguagcccacagccauaucugucaugcuucccc

SEQ ID NO: 399157 - RNA, 64 nt, Human
cacacacacacagacucauccacacuucaaauugagcccacaaucuugaauuucugaacggauc

SEQ ID NO: 399158 - RNA, 64 nt, Human
ccuucagugaaguccugacaacuagugguguguuagcccacaguucucugcaguggugccguca

SEQ ID NO: 399159 - RNA, 64 nt, Human
auauuuuauugaaacugcuuauguaugucaaaggagcccacaacuucagcuacacaacuuuuug

SEQ ID NO: 399160 - RNA, 64 nt, Human
ggaccagcccugcagaccacucugacaagucuucagcccacacccugccagccccacagauuuu

SEQ ID NO: 399161 - RNA, 64 nt, Human
guaucucagccuucauccauuaacucuacuagggagcccacagccaccauuuccacuaggaggu

SEQ ID NO: 399162 - RNA, 64 nt, Human
aagggaaagguuuuucuuguagggaacuggaaccagcccacaacugcacacuugugagcuguca

SEQ ID NO: 399163 - RNA, 64 nt, Human
cagcggggacggccuccugcugcagguccugggcagcccacaguagugcuagcugaggcccaga

SEQ ID NO: 399164 - RNA, 64 nt, Human
ugccccuggaggccacgccaggcgcucaccccugagcccacagccccugcuugggcugccuggc

SEQ ID NO: 399165 - RNA, 64 nt, Human
ccugucugcugagguaaggugggaggagggcuacagcccacaucccacccccucguccaauccc

SEQ ID NO: 399166 - RNA, 64 nt, Human
cccagcucuucuguccuuggccaccagagacugcagcccacaacccuuggagggguugggccgg

SEQ ID NO: 399167 - RNA, 64 nt, Human
cuuugucugcauugacggcccugugacggccuccagcccacaggccugcuuucuccuguccuaa

SEQ ID NO: 399168 - RNA, 64 nt, Human
cgaaccaguaaugggggcaaggcuggggcaucccagcccacacacccuggaugcccagcaaggc

SEQ ID NO: 399169 - RNA, 64 nt, Human
cccagagcugagaugggagugcgguacaaucuggagcccacagcugucggucagaaccuccugu

SEQ ID NO: 399170 - RNA, 64 nt, Human
cagucauguugggagcagguuacaauguuacuucagcccacaguuuauuucuauacuugaguuc

SEQ ID NO: 399171 - RNA, 64 nt, Human
caguguagacucagggucccuguggaggugcugaagcccacaguuccacacagggcagcaggga

SEQ ID NO: 399172 - RNA, 64 nt, Human
ucauccucauuagcaguggguuuccaggguuggcagcccacaccagcauuaauuucaaugaagg

SEQ ID NO: 399173 - RNA, 64 nt, Human
ugcaaaagguggcccuucacuguccauuccaaauagcccacacgugcucucugcuggauucuaa

SEQ ID NO: 399174 - RNA, 64 nt, Human
agaccccacccagcaccuucccagacacgcaggaagcccacagaaggcucagcugguuccucac

SEQ ID NO: 399175 - RNA, 64 nt, Human
agcacugcuguccagccacagccccagcccaggcagcccacagugcugcacguagccaugggcc

SEQ ID NO: 399176 - RNA, 64 nt, Human
ggacccaccagggugcagcugggcuccaggguccagcccacaagcugcaucaggcucucuggga

SEQ ID NO: 399177 - RNA, 64 nt, Human
ggacuagugggaaggcggaggugggcccccacagagcccacaggcagcugcgucccggaugcug

SEQ ID NO: 399178 - RNA, 64 nt, Human
uuacaguguaggcaccccggcccagcagcccagcagcccacauguguucaggacccucccugcc

SEQ ID NO: 399179 - RNA, 64 nt, Human
aaaaucuuuccauuucagcauguuuaaggaaaauagcccacaaugucugcccugaucaauaugu

SEQ ID NO: 399180 - RNA, 64 nt, Human
cuaauggugcuucucccuuggaaaugccauaggaagcccacaaccgcuaacacuuacaauuuug

SEQ ID NO: 399181 - RNA, 64 nt, Human
uaguauggaggcugugaaguccccaagcucuggaagcccacacuauuuguuggugaucaaacaa

SEQ ID NO: 399182 - RNA, 64 nt, Human
gacccuuugaguccccuugagugucuuaagaaccagcccacaacagccucucuuucuccuccac

SEQ ID NO: 399183 - RNA, 64 nt, Human
gccauauuucauuuugaaucugcaguggaaaaaaagcccacauuugagguggcucaucuagacc

SEQ ID NO: 399184 - RNA, 64 nt, Human
cuccccucgaagacaccucaauucacagacucucagcccacacaaugccccaguguccccagcu

SEQ ID NO: 399185 - RNA, 64 nt, Human
guguuuacuuaagaccgauagcaggugaacucgaagcccacaauccucgucugaaucauccgag

SEQ ID NO: 399186 - RNA, 64 nt, Human
agcaggaaauggugaaagcauguggcuaugguauagcccacagggcugagauugcuguguugca

SEQ ID NO: 399187 - RNA, 64 nt, Human
caggggcgcucuugacacugugccuucauuuuccagcccacagccugggucucagggaucuuga

SEQ ID NO: 399188 - RNA, 64 nt, Human
acaggacaccugcuguuccuggagucgaaggacaagcccacagcccagauuccgguucucccaa

SEQ ID NO: 399189 - RNA, 64 nt, Human
gucugaucuccagacccgucagaauggaauacacagcccacaucugucacugaaggagguggag

SEQ ID NO: 399190 - RNA, 64 nt, Human
auucagcuggggcuagcugggccgcuccucuggaagcccacacuuguggggacuuaggcaugac

SEQ ID NO: 399191 - RNA, 64 nt, Human
agcacacugaugcuccuuaagauuguuuaucuggagcccacauaguguggaacaaaaagucacc

SEQ ID NO: 399192 - RNA, 64 nt, Human
gcccauccuuaggccaaacaguacccaaggccucagcccacaccaagacuaaucucagccaaac

SEQ ID NO: 399193 - RNA, 64 nt, Human
aauugaguuguuucucuauguucuucagaugugcagcccacaauuccucgggaaaggugaaccu

SEQ ID NO: 399194 - RNA, 64 nt, Human
cacuaaagaaggugugggccagacaaggccuuggagcccacacaugggaucaaguccugcaagc

SEQ ID NO: 399195 - RNA, 64 nt, Human
caucuaaagacaccuuccuuuccacuggcugucaagcccacagggcaccagugccacccagggc

SEQ ID NO: 399196 - RNA, 64 nt, Human
ugcccugcucaccacccugucacagccacucccaagcccacacccacaggggcucacugcccca

SEQ ID NO: 399197 - RNA, 64 nt, Human
agagcuucucaagggaggguaagggggcacccugagcccacaggaccccuacuucacagcucac

SEQ ID NO: 399198 - RNA, 64 nt, Human
cgcccaccugccuucagccugcuugccucucccuagcccacacgcagacuuugaccaggaguau

SEQ ID NO: 399199 - RNA, 64 nt, Human
ugggaguccccauuugcagguggguagggccuccagcccacaccacccagaccuaggcuucccu

SEQ ID NO: 399200 - RNA, 64 nt, Human
uaucauacagacagaaaauccagaaucuuuucaaagcccacauaugguagcacaggcuggccug

SEQ ID NO: 399201 - RNA, 64 nt, Human
aaauguguuaucuguaaucuuuccuaaacagaguagcccacaagaaucaugcacuuuuuaaaau

SEQ ID NO: 399202 - RNA, 64 nt, Human
caguuccugcuccucugucagggaagccaggcagagcccacagagcaugguccauccagagugu

SEQ ID NO: 399203 - RNA, 64 nt, Human
gcuucccaagaugccauggcuggacuggacccccagcccacaugaccaugccucagacugucac

SEQ ID NO: 399204 - RNA, 64 nt, Human
acgugccucccguguguuauuuaaucccuucaggagcccacaagauggguguuauucucauuuu

SEQ ID NO: 399205 - RNA, 64 nt, Human; identical to SEQ ID NO: 399063

SEQ ID NO: 399206 - RNA, 64 nt, Human
aggaaggaauacauuuuauaaaauguuguagugaagcccacaauugaccuuugacuaauaggag

SEQ ID NO: 399207 - RNA, 64 nt, Human
accaugacuuucauugggcagacagagucuucuaagcccacagggauccccagauggauuuuuc

SEQ ID NO: 399208 - RNA, 64 nt, Human
uacauuuguuuauaaccagaagcaaaauaaacucagcccacaaagcuagaaucuuuuccuggac

SEQ ID NO: 399209 - RNA, 64 nt, Human
uucguugauggccaaagcaaaggagaguccugggagcccacaagauccaggcagaaggagaugg

SEQ ID NO: 399210 - RNA, 64 nt, Human
ugcuaagcugcccugaggguuuccuucggggaccagcccacagcacaccaagguggcccggaag

SEQ ID NO: 399211 - RNA, 64 nt, Human
ggccagagaaaaugaaggaaggccacaagcucagagcccacaucaacacugccccccucccagc

SEQ ID NO: 399212 - RNA, 64 nt, Human
auugucuccaugggacgaucccagugggacugucagcccacagcucgaguggguuggaugcuug

SEQ ID NO: 399213 - RNA, 64 nt, Human
ucuggugccauaacuaaugagaaacuccuuuaauagcccacaaucaguguucuguucuagcugg

SEQ ID NO: 399214 - RNA, 64 nt, Human
aguccucugcauguucugcucuugugcccuucugagcccacaauaaaggcugagcucuuaucuu

SEQ ID NO: 399215 - RNA, 64 nt, Human
ccagguuuagacaguaugagucaaugugcaguguagcccacacuugagaggaugaauguaugug

SEQ ID NO: 399216 - RNA, 64 nt, Human
gccaacuccguguccgcugcccacagcccaagccagcccacagcggaugcugcaaaaaucaaua

SEQ ID NO: 399217 - RNA, 61 nt, Human
uaucgcaugaugagcuaugaaccacuggagcagcccacacuggcuugauggaucaccccca

SEQ ID NO: 399218 - RNA, 64 nt, Human
uuucaacucuaaaaauugacccuaucaacuggagagcccacaaggcauagggaauagagaaaag

SEQ ID NO: 399219 - RNA, 64 nt, Human
ggguccaagaagacguaggcuucauuuucacaccagcccacaccauuccagugcucagccuagc

SEQ ID NO: 399220 - RNA, 64 nt, Human
auuauaugcagaauuacauaaacgaagcucucaaagcccacauacuggaugguaucaaucuuug

SEQ ID NO: 399221 - RNA, 64 nt, Human
ggacuggcuuuccacaggaaguaaacugcuucagagcccacaguccccugcucaguguccggaa

SEQ ID NO: 399222 - RNA, 64 nt, Human
aaauuguugaauauuucucucucccagucuuaaaagcccacaggcaagaauuaaugcuuucuua

SEQ ID NO: 399223 - RNA, 64 nt, Human
uccagaauacucucucugggguugugagucagucagcccacaagcauucacagagugcuuaccu

SEQ ID NO: 399224 - RNA, 64 nt, Human
uuguuagucuccauuucauagaugaaaauagugaagcccacagaaaauaaguagcuccuccaca

SEQ ID NO: 399225 - RNA, 64 nt, Human
guguucuugagaaggaucuaauuuuucuguauauagcccacaucacacuugcuuugucuuguau

SEQ ID NO: 399226 - RNA, 64 nt, Human
agcuucuccaggcgucugcggagcccacaguugaagcccacaucguuuugcuguugaauggggu

SEQ ID NO: 399227 - RNA, 64 nt, Human
aggugugggcuccagcuucuccaggcgucugcggagcccacaguugaagcccacaucguuuugc

SEQ ID NO: 399228 - RNA, 62 nt, Human
gaaccccgucccgccucugaggaccgggagacagcccacaggccagaguugggcucuagcuc

SEQ ID NO: 399229 - RNA, 64 nt, Human
aggaaccccgucccgccucugaggaccgggagacagcccacaggccagaguugggcucuagcuc

SEQ ID NO: 399230 - RNA, 64 nt, Human
gaccuuuuauaucuaagaccaguauaguaaacuuagcccacaguggcaaauaaugaguaauauu

SEQ ID NO: 399231 - RNA, 64 nt, Human
agcuguaacuagaugcagagcaagauaugacuauagcccacaacccaaagaagcaaaaauucgu

SEQ ID NO: 399232 - RNA, 64 nt, Human
acagccuggcuauacagugcauccuugaacugucagcccacagcagcaauaugcuuauucuauc

SEQ ID NO: 399233 - RNA, 64 nt, Human
ccugggagaggaagggaguccagaucccaugaauagcccacacagguaccggcucucagagggu

SEQ ID NO: 399234 - RNA, 64 nt, Human
uaucaucauugucauuguuauugugacacccaugagcccacagacagagcuguauuaaguaacc

SEQ ID NO: 399235 - RNA, 64 nt, Human
ucucaaaaugcguauacugggaacaggaugccuuagcccacaacagaaccagaaugaaucuuug

SEQ ID NO: 399236 - RNA, 64 nt, Human
ccaacuuccgugaugugaucuggcuacaguuuggagcccacauauuucaauaguuauccccagg

SEQ ID NO: 399237 - RNA, 64 nt, Human
uggcucccaaaguuggagccuggcaugggcagggagcccacaaaacucuaaccaaacuggaggc

SEQ ID NO: 399238 - RNA, 64 nt, Human
gagggguccccuccccuuacgaacacagaaacccagcccacaugacuagcacgcugagcucugc

SEQ ID NO: 399239 - RNA, 64 nt, Human
auguugugaggacacucaagcagcccuauggaggagcccacauggugagguacugaggccucuu

SEQ ID NO: 399240 - RNA, 64 nt, Human
aucugcacuuccaggugccccaccuauuuaucugagcccacagguggaaaggggaacugccuca

SEQ ID NO: 399241 - RNA, 64 nt, Human
ugacaaucuccaggagaaccuacagauuggaagcagcccacaccugauguggacuccugacccg

SEQ ID NO: 399242 - RNA, 64 nt, Human
acacacaagcaacaaaccucacugagaggccuggagcccacaaccuucggcuccgggcaaaugg

SEQ ID NO: 399243 - RNA, 64 nt, Human
ggcaagcaauauggaaucuugccugguaucauugagcccacacauggaggaagcagaacucauc

SEQ ID NO: 399244 - RNA, 64 nt, Human
gguucugcccacugcccaguugagcagagguuugagcccacaccucaccucuguucuuccuauu

SEQ ID NO: 399245 - RNA, 64 nt, Human
uuuuaugagacucuuuacucaggugcaugguuacagcccacagggaggcauggagugccaugga

SEQ ID NO: 399246 - RNA, 64 nt, Human
cacacuagguaucagggaucccgagauggguaccagcccacaguccuuaccugccacgagccca

SEQ ID NO: 399247 - RNA, 64 nt, Human
uggugucugcagcaccccucaguuccugugccucagcccacaggccacugugauaauggucugu

SEQ ID NO: 399248 - RNA, 64 nt, Human
uugucacuccagugaguuacccagggcuccagggagcccacagcagcaucagacccauccaggg

SEQ ID NO: 399249 - RNA, 64 nt, Human
cuccccaucucuucaauggggcugauaccuucacagcccacagcaugggcacuuaugaggacaa

SEQ ID NO: 399250 - RNA, 64 nt, Human
uguaccuccagccuuucacuccucgguccuccggagcccacaaccuggacacagcuccucaaga

SEQ ID NO: 399251 - RNA, 64 nt, Human
ugaugaaaucaggaagaggacaaguggccuggccagcccacaacuaguauucagccauugggag

SEQ ID NO: 399252 - RNA, 64 nt, Human
cgcaggaccaacuaccuccgucagcaagaacccaagcccacauccaaaccugccugucccaaac

SEQ ID NO: 399253 - RNA, 64 nt, Human
acucaggagaggggagaaaggaggugcaccuggcagcccacauuuuuguugcuccccaaauccc

SEQ ID NO: 399254 - RNA, 64 nt, Human
gccccccagggggcugcuggacuuugggagagacagcccacaccugugggaccgcgggucuuag

SEQ ID NO: 399255 - RNA, 64 nt, Human
ggggagcccaggcugcccugcacuccugccucccagcccacagccaggugcuuucaucacagcu

SEQ ID NO: 399256 - RNA, 64 nt, Human
aagcacuuuggcaggguuuaaaauauuugugagaagcccacauuucaguauacauccucacugg

SEQ ID NO: 399257 - RNA, 64 nt, Human
ucggggcucgggaucugcagcaucuauguggaucagcccacacccuucccagagccagggagcc

SEQ ID NO: 399258 - RNA, 64 nt, Human
ucagguugucugaagucacugcacagugcaucucagcccacauagugaugguuccccuguucac

SEQ ID NO: 399259 - RNA, 64 nt, Human
ggacugaggaaagcagugggcaggggcgcucggcagcccacagggccuggccucagcccccacu

SEQ ID NO: 399260 - RNA, 64 nt, Human
cgucagggcaggaaccccacagacugucccuuccagcccacacucugccaccuccuggcccugu

SEQ ID NO: 399261 - RNA, 64 nt, Human
acucuauaaaagugcuucaugagcccagaccaaaagcccacagugaaaugaaguacccuuuugu

SEQ ID NO: 399262 - RNA, 64 nt, Human
gcacccuuaagaguauucagagagcaucaaaaggagcccacaccuucagcagugaaggauucua

SEQ ID NO: 399263 - RNA, 64 nt, Human
ggccucagcccagcccacccucaccugcuuuuccagcccacaaagggggacgaucacggcccag

SEQ ID NO: 399264 - RNA, 56 nt, Human
cugccucccagggucacuaggcgggcagcccacacccaccccagacggccaccaca

SEQ ID NO: 399265 - RNA, 64 nt, Human
caucaaaugcucaagcccugaguugccgccgagaagcccacaagaucugagugaaacgagcaaa

SEQ ID NO: 399266 - RNA, 64 nt, Human
ccacuucuuccuggagcgucccugccuagagcucagcccacaggacugcuucaggccguggcca

SEQ ID NO: 399267 - RNA, 64 nt, Human
caggcaaagugcugugaagggggucugagcacuuagcccacaaguucccugacuacggagccgg

SEQ ID NO: 399268 - RNA, 64 nt, Human
uuuugaacuaucuuuuuuuaaaaaaaaaaaaaaaagcccacaucuuauacuccaaugagugugu

SEQ ID NO: 399269 - RNA, 64 nt, Human
agagagcacgguguccagagcuggcccuucccccagcccacagccagcuccgugcccgaguggg

SEQ ID NO: 399270 - RNA, 64 nt, Human
uagcccaaucugaggcuaagauugguaaacuguaagcccacacuuaaccuugucaauagguucu

SEQ ID NO: 399271 - RNA, 64 nt, Human
gggaaguuaggaagaagggugugcugggcuaaccagcccacagagcucacauuccugucccuug

SEQ ID NO: 399272 - RNA, 64 nt, Human
uguuuuaaaagcuuaauagguuggcaucaguuguagcccacaaacauggcuagggcuuugggga

SEQ ID NO: 399273 - RNA, 64 nt, Human
uccugggggagcugaggcucugugcugcacccccagcccacagcuggggcaucucacuggagcu

SEQ ID NO: 399274 - RNA, 64 nt, Human
cccccagcgcaggggcacaagcugagcuuguaaaagcccacagauguugggggcuggagaaggg

SEQ ID NO: 399275 - RNA, 64 nt, Human
cuccauucacccagcgggaggugggaugugagacagcccacauuggaaaauccagaaaaccggg

SEQ ID NO: 399276 - RNA, 64 nt, Human
aaaagccucucaucccccauuaaccagggcaccaagcccacagguguccccagcccacuggauc

SEQ ID NO: 399277 - RNA, 64 nt, Human
auuucugaagaggcuucugucuuauuugaaggccagcccacacccagcuacuuuaacaccaggu

SEQ ID NO: 399278 - RNA, 64 nt, Human
gcaucuucccauuuccucaguacccacaaagugcagcccacauuggaccccagacaccccucug

SEQ ID NO: 399279 - RNA, 64 nt, Human
cuuccaaguggaugucccguugccuuauucccccagcccacaaaggcacccuggccuuggccug

SEQ ID NO: 399280 - RNA, 64 nt, Human
ugcgggaggagcagccacuaggacuuuagcaggaagcccacauggaggcuccgccaggcugugg

SEQ ID NO: 399281 - RNA, 64 nt, Human
cuuucauguuaaaauguuaaucaugauuacuuuaagcccacauccacugaguaaagagucacuu

SEQ ID NO: 399282 - RNA, 64 nt, Human
gcugagggcugggaugcucugugaccccagcuggagcccacaccuaagggcuggcauccacauc

SEQ ID NO: 399283 - RNA, 64 nt, Human
uggccaucuagccccaguucagggcagcauccauagcccacaagccagcguggguggggcgggg

SEQ ID NO: 399284 - RNA, 64 nt, Human
ucguugagggccauccauaugccagcugggggccagcccacaguggccauauuggcugcagcag

SEQ ID NO: 399285 - RNA, 64 nt, Human
ggucgcugccacccuugcccggggcagaggcagaagcccacauaugcugugacgcuggccaccu

SEQ ID NO: 399286 - RNA, 64 nt, Human
uuaugagcugaggucagccuggaucuggaauugcagcccacauaaacauaaaggaggauguccc

SEQ ID NO: 399287 - RNA, 64 nt, Human
gugaagcacguuggccuaagugugccgugaucccagcccacacuagccugggugcaucugcuaa

SEQ ID NO: 399288 - RNA, 64 nt, Human
ccuccugccagcuucccccgucagccccaaccccagcccacacauuguaccaucucuucugcug

SEQ ID NO: 399289 - RNA, 64 nt, Human
gcccagcuugugauuaucguuuuuggagaccugaagcccacacucgggucguauggacuucugg

SEQ ID NO: 399290 - RNA, 64 nt, Human
ggccugcccugaugcucuccuccuaccagagugaagcccacagagucccuccaccuccacacca

SEQ ID NO: 399291 - RNA, 64 nt, Human
uccaccccagggccaagagaaaggccugcacacaagcccacagcacagcucccugccaaacuga

SEQ ID NO: 399292 - RNA, 64 nt, Human
ugugacuuauucccugagacuuuucaggagagccagcccacagaugaugaagaaaugauggaag

SEQ ID NO: 399293 - RNA, 57 nt, Human
cagcuccuggccaucuguaggagucagagcccacauggccgggcccucuguagcucc

SEQ ID NO: 399294 - RNA, 64 nt, Human
acuggucuucccagcccuaaacccugccccaggaagcccacagccucaccugcugcugccccuc

SEQ ID NO: 399295 - RNA, 64 nt, Human
uuguugccccgcucuagacuuuuagcagaucugcagcccacaggcuuuuuuggaaggaguggcu

SEQ ID NO: 399296 - RNA, 64 nt, Human
gagaagcaccuuccuccuacaggaggggaaacugagcccacagugaguauguaacuugaccaag

SEQ ID NO: 399297 - RNA, 64 nt, Human
gaaggagcaggaaguugcuguuucuccucugaccagcccacacuccaaaggaaacagacgccau

SEQ ID NO: 399298 - RNA, 64 nt, Human
uuucagcccccccacucccguuccguaguguagaagcccacagguguagaacucagucuuaaac

SEQ ID NO: 399299 - RNA, 64 nt, Human
gagaggugccgcccagcuucccaugccagcccggagcccacagugcugcccagcguaccucccu

SEQ ID NO: 399300 - RNA, 64 nt, Human
agaggcugagggacucacuggagggcaccaagccagcccacagccagggaaguggggagggggg

SEQ ID NO: 399301 - RNA, 64 nt, Human
cugcuccuacagguuuagcucgcuccugccucacagcccacacucccuggggcuggaccacaac

SEQ ID NO: 399302 - RNA, 64 nt, Human
acuccuccaucucauggggcucacggccuacagcagcccacaagcugccacuggccggcgacac

SEQ ID NO: 399303 - RNA, 64 nt, Human
aagggccgugguccacgguacuugaagaagccagagcccacauccugugcacugcugaaggacc

SEQ ID NO: 399304 - RNA, 64 nt, Human
cuuccuagauaugauaaauauaacaucuaugaaaagcccacaccuaacauuauacuucauggug

SEQ ID NO: 399305 - RNA, 64 nt, Human
augaugauuuaaaaaaaacaacagcguaaauauuagcccacaagagcaguccuaaacaaucaca

SEQ ID NO: 399306 - RNA, 64 nt, Human
ccauuucuuuuuggcuuuuuugccuccaccuuuuagcccacaucauuuaacuccacuacuguga

SEQ ID NO: 399307 - RNA, 64 nt, Human
uaaaauagcaugccuuucucucuuucucuuaauaagcccacauauaaauguacuuuuccuucca

SEQ ID NO: 399308 - RNA, 64 nt, Human
uaaaauagcaugccuuucucucuuucucuuaauaagcccacauauaaauguacuuuuucuucca

SEQ ID NO: 399309 - RNA, 64 nt, Human
ugcaaccagucuggggccauucagccagggacagagcccacagagcccauacaccugucuccca

SEQ ID NO: 399310 - RNA, 64 nt, Human
cuugaauauaagcaauguccacacguuuuuagccagcccacaugcuuucaacaacauguaagaa

SEQ ID NO: 399311 - RNA, 64 nt, Human
acacuacuuuaaaguucauauggaaccaaaaaagagcccacauugccaagucaauccuaagcca

SEQ ID NO: 399312 - RNA, 64 nt, Human
acagaggcuggcacugagccugcuuguugggaaaagcccacaggccuguucccuuguggcuugg

SEQ ID NO: 399313 - RNA, 64 nt, Human
aggacccuuuguguaucuccuccagcuaccgcagagcccacaaacccaggcaucuaucaaaguc

SEQ ID NO: 399314 - RNA, 64 nt, Human
cagggccuaccaaugcuuaaaaccacacccagggagcccacagaggcacucagugggugguggg

SEQ ID NO: 399315 - RNA, 64 nt, Human
uagccagguaacccaccaacuccccuggaucugcagcccacacgugggagucuggcugucaccu

SEQ ID NO: 399316 - RNA, 64 nt, Human
aucgggggcuugaacccagguggucaggcucuggagcccacaauugucuuacccacuaugcccc

SEQ ID NO: 399317 - RNA, 64 nt, Human
cccacugccugcuggagagaaaacacacuugcuuagcccacaauucuccauuucacuugacccc

SEQ ID NO: 399318 - RNA, 64 nt, Human
cugccugcuggagagaaaacacacuccuuugcuuagcccacaauucuccauuucacuugacccc

SEQ ID NO: 399319 - RNA, 64 nt, Human
cugccugcugcagagaaaacacacuccuuugcuuagcccacaauucucuauuucacuugacccc

SEQ ID NO: 399320 - RNA, 64 nt, Human
cugccugcuggaaagaaaacacacuccuuugcuuagcccacaguucuccauuucacuugacccc

SEQ ID NO: 399321 - RNA, 64 nt, Human; identical to SEQ ID NO: 399318

SEQ ID NO: 399322 - RNA, 64 nt, Human
cugccugcugcagagaaaacacacuccuuugcuuagcccacaaguaucuauuucacuugacccc

SEQ ID NO: 399323 - RNA, 64 nt, Human
ccugcuucaguuguccuccacagcacugauuugcagcccacaagcuggcagguuuaucugucuc

SEQ ID NO: 399324 - RNA, 64 nt, Human
uagggcagggaggggacuggggaagugcgcacacagcccacacagacaacacgcacccacacag

SEQ ID NO: 399325 - RNA, 64 nt, Human
cacccgcuguucacgucccgucggccuccugcacagcccacacgcugcgcccggaaggccccug

SEQ ID NO: 399326 - RNA, 64 nt, Human
cuccugaugaagcacaacuccccgcagggcccccagcccacagggguggccauauuugggcagu

SEQ ID NO: 399327 - RNA, 64 nt, Human
caggucccugaucuccaggcuuggccuccagagcagcccacaccaaccccaaaauaaaaaaaug

SEQ ID NO: 399328 - RNA, 64 nt, Human
guaaagaguacgagcgcgccauucaucaucagacagcccacacuggugagaaaugauggaaugu

SEQ ID NO: 399329 - RNA, 64 nt, Human
agugcugggauuacaggcaugagccaccacggccagcccacaaugauauuacaaaccuauuaaa

SEQ ID NO: 399330 - RNA, 64 nt, Human
ccccagaccucuggaggagacaauggaugcaaacagcccacacaggaaagacaaagcaggagcg

SEQ ID NO: 399331 - RNA, 64 nt, Human
uccccaaacccagcaccccccucucccuggcugcagcccacacuguaacaucccuagugaggcu

SEQ ID NO: 399332 - RNA, 64 nt, Human
ccccgccaccuccccacuccagcagauaaggccgagcccacaccaucuggcccaggcuggcccc

SEQ ID NO: 399333 - RNA, 54 nt, Human
ccaagguccaggacccgugagaggagcccacagcuacagcugcagggacugcug

SEQ ID NO: 399334 - RNA, 64 nt, Human
ccgggacuugggcggggccugcccuacagugagcagcccacacaggaacgcuccucucgcgagc

SEQ ID NO: 399335 - RNA, 64 nt, Human
gauuccaucccaggaacccaacagagcucaggacagcccacagggaggugguggacggacugua

SEQ ID NO: 399336 - RNA, 64 nt, Human
ucccugagccagccuccgcucaguguggcuccucagcccacagaggggagggagcauggggcca

SEQ ID NO: 399337 - RNA, 64 nt, Human
agggguaggccugagcgccagagucgcccagguuagcccacaggauuccuuugugugccaugga

SEQ ID NO: 399338 - RNA, 64 nt, Human
ccccaggccacagugauaccaucccagugccaugagcccacacugcccgcccucaggcucucag

SEQ ID NO: 399339 - RNA, 64 nt, Human
ccaggcauuccugccccaggauaaggaaaaccugagcccacaucugauugccaacggcuguagc

SEQ ID NO: 399340 - RNA, 64 nt, Human
uugagguuagauuuuaaggaguggggaauugugaagcccacagaugcgcacgcaaugaccagca

SEQ ID NO: 399341 - RNA, 64 nt, Human
ucaggccucucgugccuggugucagagaaggcagagcccacaguaggugcacggugcaaggccc

SEQ ID NO: 399342 - RNA, 64 nt, Human
ugcacucgcuccguaccuggaccugcugaaucauagcccacauguccaggugagaagcugacaa

SEQ ID NO: 399343 - RNA, 64 nt, Human
ccagccagcauggccacccucaagaggcgagaugagcccacagaggcauauccugcggggaugc

SEQ ID NO: 399344 - RNA, 64 nt, Human
ugaaugaaugaaugagccaaagaacaaauaaaugagcccacacacccugaacgcaugcgacaca

SEQ ID NO: 399345 - RNA, 64 nt, Human
aaucugcaagguccaguaugaaauaagaauaagcagcccacacaacugggcauagugguucaug

SEQ ID NO: 399346 - RNA, 64 nt, Human
aaucaugggcauugcuggacugaugguugcuuugagcccacaggagcucccuuuuugaauugug

SEQ ID NO: 399347 - RNA, 64 nt, Human
uucaggcaugcaauaugccagaacuacagacaacagcccacaggaugcaaaagugcuuugccau

SEQ ID NO: 399348 - RNA, 64 nt, Human
cugcuccgggcccaugccccaaggagcccuucagagcccacacugccagucgaggccuggcugg

SEQ ID NO: 399349 - RNA, 64 nt, Human
uucccuuuucucucucuccuccuuuuucccuuuaagcccacagauucaggucaugccaaaagcu

SEQ ID NO: 399350 - RNA, 64 nt, Human
aggaugcauguuuauuugaggggauguggcacugagcccacaggaguaaaagcccaguuugcua

SEQ ID NO: 399351 - RNA, 64 nt, Human
ggaccuagaggauuguccaccuucugccaaggccagcccacacagcccgagccccuuggggagc

SEQ ID NO: 399352 - RNA, 56 nt, Human
acccuggccauauggaguagcugaucagcccacacuugccccgcccucccacaccu

SEQ ID NO: 399353 - RNA, 57 nt, Human
auucuggggagaagcuauagaaagaggagcccacacaaagcuugaaagccugugcca

SEQ ID NO: 399354 - RNA, 64 nt, Human
aguucucccaggauguguggcgagagccugggccagcccacagcguuccuagucaggcagccac

SEQ ID NO: 399355 - RNA, 64 nt, Human
accauugcuccagacguguuccgaccccuuucccagcccacagggcuugaagugaaggaacaga

SEQ ID NO: 399356 - RNA, 64 nt, Human
aggaaggaggugacagcacuugcauggucacuugagcccacacacacgcucaaccccaaguccu

SEQ ID NO: 399357 - RNA, 64 nt, Human
gucggggcuugcccuccaccuuggacuuggaagaagcccacauuggagaggugaggaccccaug

SEQ ID NO: 399358 - RNA, 64 nt, Human
agugcugggauuacaggcgugagccaccuugcccagcccacaucauacaguuugaaaugaaacu

SEQ ID NO: 399359 - RNA, 64 nt, Human
uccccaucugagauaaaguaaacaagugaccagcagcccacagaugauuccuuuauauagaugu

SEQ ID NO: 399360 - RNA, 64 nt, Human
uuuauggaaugacagucccuacaauauuguuuuaagcccacacuacccaaaacaaagaauggga

SEQ ID NO: 399361 - RNA, 64 nt, Human
uccucaccuucuguuuuagaguugagcaaacugaagcccacagagguggaacuuaauuaccuaa

SEQ ID NO: 399362 - RNA, 64 nt, Human
ugccccuguacaguccugccccccagcacccuccagcccacaaacagggcccuaagcacuucau

SEQ ID NO: 399363 - RNA, 64 nt, Human
caguuugcuccacauggccgccacccccugcaccagcccacauccccacugccccuguacaguc

SEQ ID NO: 399364 - RNA, 64 nt, Human
guucaaagguugccauguggcuggcagugguucaagcccacauuugacacugcugcucuagagg

SEQ ID NO: 399365 - RNA, 58 nt, Human
aagagaggacugugcacuagaaaguugcagcccacagcccuucauguggacucuguca

SEQ ID NO: 399366 - RNA, 62 nt, Human
gugaaguuguaaaaagaaaaggaaugaaauaaccgacccaucaucuucucacccacccucau

SEQ ID NO: 399367 - RNA, 62 nt, Human
uguccucuuuuuuccaguucaccugugcgaauccgacccaccucccagagccuggcugaaac

SEQ ID NO: 399368 - RNA, 62 nt, Human
uccacugccucagaggcaguaagaaagagaggccgacccaggaggaaacaaagggugaauga

SEQ ID NO: 399369 - RNA, 62 nt, Human
gccccugugguuggaacauccuggggugacccccgacccagccucgcugggcuguccccugu

SEQ ID NO: 399370 - RNA, 62 nt, Human
cguuuugcagccacgccugccgggccaccugcccgacccacaugggagagaaaagcugccac

SEQ ID NO: 399371 - RNA, 62 nt, Human
uaggaagaggagccuugccuugaguuccuaaaccgacccacugcagacacaggcucugauuc

SEQ ID NO: 399372 - RNA, 62 nt, Human
ccgccggccgcgggucucccggcccaaccccaccgacccagaccaagaccgcgccgagccgc

SEQ ID NO: 399373 - RNA, 62 nt, Human
cgcacugcagacgggaaugccuaggucccuucccgacccagccagcugcagggcacggggac

SEQ ID NO: 399374 - RNA, 62 nt, Human
gccgcuuuguccuaacaguccacaguccugccccgacccaccccaucccuuuucucuggcac

SEQ ID NO: 399375 - RNA, 62 nt, Human
ggaugggaagccaugaggaccuggccuucugcccgacccaggcagccauucaaguugagcaa

SEQ ID NO: 399376 - RNA, 62 nt, Human
agucccugggccuagccauccccucacuauucccgacccaaagggugacuuuucaucugaac

SEQ ID NO: 399377 - RNA, 62 nt, Human
acaaacuauugggugagguuuuucagcuguuaccgacccacguccugcugucucuguguggu

SEQ ID NO: 399378 - RNA, 62 nt, Human
caaacuuuccgauagggcucaguaggaucaagccgacccagagugggcaugggaugcuccag

SEQ ID NO: 399379 - RNA, 62 nt, Human
cacacuccccaaagcaguuagacuauggagagccgacccagccccucaggaacccucauccu

SEQ ID NO: 399380 - RNA, 62 nt, Human
ccccuguuuuaguuaaaaaauuggaaaagaaaccgacccauuuuuuucccagaucaagauga

SEQ ID NO: 399381 - RNA, 62 nt, Human
gcacugcaccugcuuccuucccuucagugcggccgacccauuucuguugaacagaugucucc

SEQ ID NO: 399382 - RNA, 62 nt, Human
cgggagcugcaggcccgucaccaagcccucucccgacccaggcuuuguggggcaggcaccug

SEQ ID NO: 399383 - RNA, 60 nt, Human
ugcgcuuccugugggagugacccgccgcccccgacccaggugcccagcucucggaaugac

SEQ ID NO: 399384 - RNA, 62 nt, Human
guugggggaggcgcgagugcgugugagaagaaccgacccaccccgcgcaaggggaagccucc

SEQ ID NO: 399385 - RNA, 62 nt, Human
gcaccacaccccaaccccagcgucucgugaguccgacccagacauccaaacuaaaaggaagu

SEQ ID NO: 399386 - RNA, 62 nt, Human
aagccuuaaacacacccccgaaaaacacaagaccgacccaaaaucuagaggaaagcgaaaag

SEQ ID NO: 399387 - RNA, 62 nt, Human
uuccugcccuucccucugggcacgccugcuggccgacccacugacccacucggauggaccaa

SEQ ID NO: 399388 - RNA, 62 nt, Human
gggacugaaggcggagcccauccaacccucgcccgacccaaacaccucauuguuucccccac

SEQ ID NO: 399389 - RNA, 62 nt, Human
ugccuucuuggagggugaggguggcuugggaaccgacccagugaucaugccuacuuucuucu

SEQ ID NO: 399390 - RNA, 62 nt, Human
agcggggccaugccuccagccccccagcucgcccgacccauccuguucgugaauaggucuca

SEQ ID NO: 399391 - RNA, 62 nt, Human
cucuuggcuccaagaugagcacccacaggaagccgacccaggccugaggggccaggaacuug

SEQ ID NO: 399392 - RNA, 62 nt, Human
uuuugaaaggugauuauuugugaagcugauaaccgacccagacugcuuugugacaugaagcu

SEQ ID NO: 399393 - RNA, 62 nt, Human
ccagccuggggucugccagccagcccuccuccccgacccagcgccuaagcucacagaguguc

SEQ ID NO: 399394 - RNA, 58 nt, Human
ucccguuccgcuggagcugagccacgggccgacccagccacaaguacuggaguagaua

SEQ ID NO: 399395 - RNA, 62 nt, Human
ccaggaaugccgugaaaggagacaaggucugcccgacccaugucuaugcucuacccccaggg

SEQ ID NO: 399396 - RNA, 56 nt, Human
gcacaccccagaagaagugacgguccccgacccaggagaacgguggcucccacagg

SEQ ID NO: 399397 - RNA, 62 nt, Human
cucugugcaucacucugcuagguugggggcccccgacccaccauaccuacgccuagggagcc

SEQ ID NO: 399398 - RNA, 62 nt, Human
aaagcgcuuuuccuuggcauuccgcaucccuaccgacccaggguucccgcggggcugucggc

SEQ ID NO: 399399 - RNA, 62 nt, Human
cucacagcugacaaagauguucuuccucuuccccgacccacauuucaagcggacaaagcaca

SEQ ID NO: 399400 - RNA, 62 nt, Human
ugguaggaugguccucuuguacuucgugugcuccgacccauggugacgaugacacacccugg

SEQ ID NO: 399401 - RNA, 62 nt, Human
gcucugagcuucugcccccagaaucauuccaaccgacccacugcaaagacuaugacagcauc

SEQ ID NO: 399402 - RNA, 62 nt, Human
caagaccacaugcuugcaguccuacaggcuucccgacccacaggccagcuacggauuuugca

SEQ ID NO: 399403 - RNA, 62 nt, Human
gagcagucggcacagugcagcaagccuggcccccgacccagcucuacuccaggcuuccacac

SEQ ID NO: 399404 - RNA, 62 nt, Human
ucacuugccuuuggcuuccuguugacuucuucccgacccagaaagcauggggaaugugaagg

SEQ ID NO: 399405 - RNA, 62 nt, Human
auggucugcucuguagcagucucagagccuccccgacccacuaccuggagauagccagauag

SEQ ID NO: 399406 - RNA, 62 nt, Human
gccccaacuucccaaagagcagcaucccucccccgacccauagccauguuuuaaagucaccu

SEQ ID NO: 399407 - RNA, 62 nt, Human
ggggccuggcagggccccugccuccccgacccccgacccacugcaaauccccguuccccugc

SEQ ID NO: 399408 - RNA, 62 nt, Human
cucuugcucuugcaguaauuucuaugcagcccccgacccagagccgagcuccacuucugcuc

SEQ ID NO: 399409 - RNA, 62 nt, Human
acccuaacccucagccgacagucucagccccaccgacccacuuucuuggcauauagccccac

SEQ ID NO: 399410 - RNA, 62 nt, Human
cccaccgcugccgcggauaaauuauucccuccccgacccagcccagugccaccucuaucugu

SEQ ID NO: 399411 - RNA, 62 nt, Human
augugguugcgacacucccaaagccguaagggccgacccaggcaucuuggcccccagccccu

SEQ ID NO: 399412 - RNA, 62 nt, Human
acaccaugugauuaaggucggcgcugccucccccgacccacucagcgaugggaaaugaauug

SEQ ID NO: 399413 - RNA, 62 nt, Human
ccacucuggcuucugugcauccacccaggcccccgacccaucacugccacauucuccggguc

SEQ ID NO: 399414 - RNA, 62 nt, Human
acucacuuccacaccgucuuccccagcgucccccgacccacuucauccuuuccggccauccc

SEQ ID NO: 399415 - RNA, 62 nt, Human
uuccccugcggaguuccccugucugucccaggccgacccaagggagugucagccuugggcuc

SEQ ID NO: 399416 - RNA, 62 nt, Human
caagugccagcucugccacugacccuggggccccgacccagcccugccuccucagccagugu

SEQ ID NO: 399417 - RNA, 62 nt, Human
gagcucccuggaguccgacgcggguuuucucucugggggaccugggugguccccgcuguggu

SEQ ID NO: 399418 - RNA, 62 nt, Human
cccccuccccagaaggccaagggaugugggggcugggggacugggaggccuggcagucuuca

SEQ ID NO: 399419 - RNA, 62 nt, Human
aaggaaacacgcggaucugaacagcaguaauccugggggauacggggguugggcuagauuac

SEQ ID NO: 399420 - RNA, 62 nt, Human
cccucugccugccucagcugcugccugaccggcugggggaggcacuggcgggaggccucggg

SEQ ID NO: 399421 - RNA, 62 nt, Human
guggugggcugagguuaaucagggaagguuuccugggggaggugauccuugaacuggcuccc

SEQ ID NO: 399422 - RNA, 60 nt, Human
ucccacggcagaagcccugaggacugacuccugggggagaacagcauucccgccgccucc

SEQ ID NO: 399423 - RNA, 62 nt, Human
ccugcugacccugccccacuuccagggaaaagcugggggagguuggaccccucucacugacu

SEQ ID NO: 399424 - RNA, 62 nt, Human
uaaugacuuugcaucugcaccuggaacggggccugggggaccuggggucuggugugccaggc

SEQ ID NO: 399425 - RNA, 62 nt, Human
auccuccuggaauuucuuggagacgaaaguaucugggggauuguuggguacuagggagacug

SEQ ID NO: 399426 - RNA, 62 nt, Human
gagggggaggaaguuggcugagccauugagugcugggggaggccauccaagauggcaugaau

SEQ ID NO: 399427 - RNA, 62 nt, Human
ugagcacauaacucuaugucugaucuaggaggcugggggaagagccucccauaaaaucacac

SEQ ID NO: 399428 - RNA, 62 nt, Human
ggcagagugacaaaggcucaggacggcuggcucugggggacucaggccaagccccuuggcac

SEQ ID NO: 399429 - RNA, 62 nt, Human
ggacagccaggcaccugcuccucuugcccuuccugggggaagggagcugccuucugucccug

SEQ ID NO: 399430 - RNA, 62 nt, Human
cucaaaaaacaaauguguggcuaaggaguuaccugggggaaguagaaugagaggucuguugg

SEQ ID NO: 399431 - RNA, 62 nt, Human
aaagcuuuagcagcuuaauuaaaucuguuggacugggggaggagagagcuguucucuagugg

SEQ ID NO: 399432 - RNA, 62 nt, Human
ccccuaggccuaguggugaucccagugcucuacugggggaugagagaaaggcauuuuauagc

SEQ ID NO: 399433 - RNA, 62 nt, Human
cuggcugcagcuagaggacaggcaagccagcucugggggagucuuaggaacugggaguuggu

SEQ ID NO: 399434 - RNA, 62 nt, Human
uuaacugagguuuaugaauauucaaaccuuugcugggggaaagaaaugaaaguuaaugagca

SEQ ID NO: 399435 - RNA, 62 nt, Human
guguccucuccacguaacucauuaugccccuccugggggagauugcaucuccaggacaagca

SEQ ID NO: 399436 - RNA, 62 nt, Human
ucugcugcuucacuggggcccgaugacuuuggcugggggagggggccuagggccucuucuca

SEQ ID NO: 399437 - RNA, 62 nt, Human
cagcugaacugccccuccaagggacaggaaggcugggggagggaguuuacaacccaagccau

SEQ ID NO: 399438 - RNA, 62 nt, Human
ugcaggggcccacugaagcagaagguuuuucucugggggaaccugucucaguguugacugca

SEQ ID NO: 399439 - RNA, 62 nt, Human
ccugauggggaugccugugggauggcccacaccugggggaccuggcagauggggugaguugg

SEQ ID NO: 399440 - RNA, 62 nt, Human
gacacagauguccagagugauuggagaauguccugggggaaugaaguuccuuccacaaacac

SEQ ID NO: 399441 - RNA, 62 nt, Human
ccuggggacggcuuuuacuuaaaccgccaaggcugggggaagaagcucucuccucccuuucu

SEQ ID NO: 399442 - RNA, 62 nt, Human
aggguuuagccgggccccauggucacagaccccugggggaggcuuccagcucagucccacag

SEQ ID NO: 399443 - RNA, 62 nt, Human
accccuuccccaccaggcuaggccccccacaccugggggacccccuggccccucuuuugucu

SEQ ID NO: 399444 - RNA, 62 nt, Human
aaauccucucguaucucaccccaaaccccaaacugggggaaaaaaaguuaacucuuugugaa

SEQ ID NO: 399445 - RNA, 62 nt, Human
uuucauauucuuuuaauacaucuugaucacagcugggggaaaaaaagcuuuuuaauucuaua

SEQ ID NO: 399446 - RNA, 62 nt, Human
ugauucugcauuugaggaaggucagggugccgcugggggagcagggagcggggagggaggaa

SEQ ID NO: 399447 - RNA, 62 nt, Human
aacccugagagagacagucuugugagggagaucugggggaggcaggaagcuccucagauuuu

SEQ ID NO: 399448 - RNA, 62 nt, Human
uggaggcacccagguuguccaugcuugggauucugggggaaggagagaagggcagcucaggg

SEQ ID NO: 399449 - RNA, 62 nt, Human
agcaacugugaacagagaggucgggauuugcccugggggaggaagagaggccaaguucagag

SEQ ID NO: 399450 - RNA, 62 nt, Human
ucucugauuuucguguucucugcccagaugggcugggggaguugagagugugcuuauuuuca

SEQ ID NO: 399451 - RNA, 62 nt, Human
ggugguggucagggccugggggcuuggccaugcugggggaauggggcucuggguuccugccu

SEQ ID NO: 399452 - RNA, 62 nt, Human
gugcauucuguaaccauggagucuucuguuuccugggggaaaggggcauucaugaccugaac

SEQ ID NO: 399453 - RNA, 62 nt, Human
cugugcacgacguggaugccguaugcauguugcugggggaagccacuccggacacuguguuu

SEQ ID NO: 399454 - RNA, 62 nt, Human
gcuuuauucaucccuucuguucauuuaccaaccugggggauugauacgaccggggaaaaugu

SEQ ID NO: 399455 - RNA, 62 nt, Human
agcaaugggucccucuagccuguggacaccagcugggggauccagggucaggcccccuccuc

SEQ ID NO: 399456 - RNA, 62 nt, Human
uaaggcuaugcaacccuccccacgucuuccagcugggggaugggggggagucauaggaaaag

SEQ ID NO: 399457 - RNA, 62 nt, Human
gggcaccuuaccaccggagccgaaucuggucccugggggacccccaguuucucuucagacac

SEQ ID NO: 399458 - RNA, 62 nt, Human
ugauggaguggggaacaagcaguagagugggacugggggagacccaggccccgggcugagca

SEQ ID NO: 399459 - RNA, 62 nt, Human
caggggacaaaccagggguaccaggcacauggcugggggagggacugcugacccaccaaggu

SEQ ID NO: 399460 - RNA, 62 nt, Human
cagccaaccacauagccuugggaccagccucucugggggaccagaaguagugagagaaggaa

SEQ ID NO: 399461 - RNA, 62 nt, Human
agucuucuccuccaugaacaucauggacugagcugggggaagaagggauaucuacugugguc

SEQ ID NO: 399462 - RNA, 62 nt, Human
cugggcagggaggcgccguggacucagccaggcugggggagccggacauggcuuggccuggg

SEQ ID NO: 399463 - RNA, 62 nt, Human
ucguuuggcccucugaacaaggugcacgcgagcugggggaugaagacggcucccacuuccuu

SEQ ID NO: 399464 - RNA, 62 nt, Human
agcgcugagggccagggucuugugcuguggggcugggggaugcccucuuuucuauauuuauu

SEQ ID NO: 399465 - RNA, 62 nt, Human
ucccacucucugaacuacaaucacugugcucccugggggagauccuucauguugaggguuuu

SEQ ID NO: 399466 - RNA, 62 nt, Human
ccaccuguccugcuucucugcaggugaaaacucugggggaugcugaucaauagagcuugguc

SEQ ID NO: 399467 - RNA, 62 nt, Human
aggggaggaaugacacaaauggcagggagcugcugggggacugaccccucggcgccuggccu

SEQ ID NO: 399468 - RNA, 62 nt, Human
guaaccuuacucaaaagaagggucagugugugcugggggacuuuugccuuguuuguaauguu

SEQ ID NO: 399469 - RNA, 62 nt, Human
uacacucuuccaucagcaugaguccuggagagcugggggaacguaggaagaggagccuugcc

SEQ ID NO: 399470 - RNA, 62 nt, Human
auaauugcuuuuucuguguauuuuguauugggcugggggauagcaucaaagguugaacuuuu

SEQ ID NO: 399471 - RNA, 62 nt, Human
cucgggugcccucucacaucuccuguuggaugcugggggagaagcaauaaaccucagcccuc

SEQ ID NO: 399472 - RNA, 62 nt, Human
uuaguuagccacuugugucauuuccagguuuucugggggagugcagggggagaugggugaug

SEQ ID NO: 399473 - RNA, 62 nt, Human
gaaggcaugggguggcugggauuuaaggacuucugggggaccaagacauccucaagaaaaca

SEQ ID NO: 399474 - RNA, 62 nt, Human
ugaugcuacuguugguaugugugcaaugauggcugggggaaucgucaugacugccaaucuca

SEQ ID NO: 399475 - RNA, 62 nt, Human
gguggccccugaauucugcgcaagggaugggccugggggaacucaagggagggccuaaagca

SEQ ID NO: 399476 - RNA, 62 nt, Human
cuuccccugcuccgcauuuuguaaaauggccccugggggaguguuuuugcuggaucugcucc

SEQ ID NO: 399477 - RNA, 62 nt, Human
aggggacguccuuggucuugcacgcacacuaccugggggagucaacacugggauggucugug

SEQ ID NO: 399478 - RNA, 62 nt, Human
uucuuuuucuuuaaucucccuuguuucuugggcugggggagggguggggggaacaacuggcu

SEQ ID NO: 399479 - RNA, 62 nt, Human
guucacuggaaauugcccucagauuuuauaaacugggggauuucuuaauuagauaaaaguuc

SEQ ID NO: 399480 - RNA, 62 nt, Human
gugcuucagggguagggcugggcccacagagccugggggagugucaccgccuuugcugccuc

SEQ ID NO: 399481 - RNA, 62 nt, Human
caccacccagcaucccaggcugguggcaggagcugggggagaggacucuccccugugagacu

SEQ ID NO: 399482 - RNA, 62 nt, Human
uuuacauuuauaggaccacauaucccugguuucugggggaggguuucacuguuacaucacca

SEQ ID NO: 399483 - RNA, 62 nt, Human
ucauaggaaacauauuaugugcagguccuagccugggggaggaaaguagauagacagaaaau

SEQ ID NO: 399484 - RNA, 62 nt, Human
gaaauuguucacuugagggauuagucaaccaucugggggagaaguugcucacugucaaauac

SEQ ID NO: 399485 - RNA, 62 nt, Human
ugaaagucuuguguaccccaccucugaagaugcugggggaggcagcugggaugggagccagc

SEQ ID NO: 399486 - RNA, 62 nt, Human
auauuuuaaaaauucuugguaguugagcagcucugggggaauaagggcaaauaugcuuguua

SEQ ID NO: 399487 - RNA, 62 nt, Human
guuccccacagggagaggcucuggggggauggcugggggaugcagagccucagagcaaauaa

SEQ ID NO: 399488 - RNA, 62 nt, Human
agggggaccugccaccagggagcuuccuggcucugggggacccaggugggacuuagcaguga

SEQ ID NO: 399489 - RNA, 62 nt, Human
uuuuuuugcuuguuacucaucuguugaccuaccugggggaaguagcacccuugcauuucaaa

SEQ ID NO: 399490 - RNA, 62 nt, Human
gugaggggagagguuuuacaagccagacaggccugggggacugcaguccccaaggagacccu

SEQ ID NO: 399491 - RNA, 62 nt, Human
auacuuuugguccauguaagugcuacccguugcugggggaggagucaugguuuauuuggaaa

SEQ ID NO: 399492 - RNA, 62 nt, Human
caccgcccccaaucuaucuuggcucacucgcucugggggaagcuagcugccaugcuaugagc

SEQ ID NO: 399493 - RNA, 62 nt, Human
gaaccagugcuuauguggugugcccuuggcuucugggggagagcuuggggcagcagaggccc

SEQ ID NO: 399494 - RNA, 62 nt, Human
uaguuacaaaucacaguauaagauuuaagugccugggggaaggauacaauuuuuagaaauua

SEQ ID NO: 399495 - RNA, 62 nt, Human
cggaguccucccuaggagaggggcucgaugggcugggggaaggagccugaagguugccccug

SEQ ID NO: 399496 - RNA, 62 nt, Human
ugccugucuaugugcuguuggugugccuaugccugggggaggucaguaggggcccccucccc

SEQ ID NO: 399497 - RNA, 62 nt, Human
uccacugcccccaggggcuguggacaaaccggcugggggacugcccagccucccaccuguuu

SEQ ID NO: 399498 - RNA, 62 nt, Human
uccaagaacagaagcggcauguugaagaaaaucugggggauugggauggggguaugugugga

SEQ ID NO: 399499 - RNA, 62 nt, Human
caugcuggucuuuccgaccuggugcucuucugcugggggacugaggcuggcccucauucggg

SEQ ID NO: 399500 - RNA, 62 nt, Human
cggcaccgccgccgucgucucccggccccucgcugggggagaaagcaucugcuccaaggagg

SEQ ID NO: 399501 - RNA, 62 nt, Human
cauugugugauaagcacuaagcagucaguccccugggggaaucuggcauaauucggcuauaa

SEQ ID NO: 399502 - RNA, 62 nt, Human
aggugacuucucucuguuugucuuaaguugcacugggggauuucugacuugaggcccaucuc

SEQ ID NO: 399503 - RNA, 62 nt, Human
ggcucugugggucccugggcucuggacaagcacugggggacgugcccccagagccacccacu

SEQ ID NO: 399504 - RNA, 62 nt, Human
caggguucuuguggcuguugucagagcaggagcugggggagggaagacuuguucucucuuuc

SEQ ID NO: 399505 - RNA, 62 nt, Human
cagggccagaaguucaggcugccccgccuccacugggggaucgcaccugugaauuaccugag

SEQ ID NO: 399506 - RNA, 62 nt, Human
aaaacaaaacuggacagaaacaggaaugugagcugggggagcuggcuugaguuucucaaaag

SEQ ID NO: 399507 - RNA, 62 nt, Human
ugacaugagccucagagaccccaaucccaugccugggggagagacagcggcucaggaguggg

SEQ ID NO: 399508 - RNA, 62 nt, Human
cccuuguugguacauuccagaggcgcaggggccugggggauaugaagcuagggaagccccug

SEQ ID NO: 399509 - RNA, 62 nt, Human
agugagccaugaguaugccacugcacuccagccugggggacagagcaagacccugccucaaa

SEQ ID NO: 399510 - RNA, 62 nt, Human
ucaggcagcaugcuuagggacaacucuguggccugggggacaucugugucacaguauaggau

SEQ ID NO: 399511 - RNA, 62 nt, Human
accaagaacagcuuuugagucuguauccuccacugggggaagugcucccaguucagaacaag

SEQ ID NO: 399512 - RNA, 62 nt, Human
cagcgaugcgucagaucuuacguggcuuccugcugggggagauggccuucacccacgggaug

SEQ ID NO: 399513 - RNA, 62 nt, Human
acauugagccuucgaguggccagcuucacucucugggggagugcaggguggacaucaccuug

SEQ ID NO: 399514 - RNA, 62 nt, Human
guaggaaauggugaagcauagcucugggucuccugggggagaccaggcuuggcugcgggaga

SEQ ID NO: 399515 - RNA, 62 nt, Human
gugaacccccucagaucaguagaauauaguaucugggggagaagacuuacuuccuucagggc

SEQ ID NO: 399516 - RNA, 62 nt, Human
cuguagacguacgcucaggcgcuccugcuguccugggggagagaagguucgccccuccccga

SEQ ID NO: 399517 - RNA, 62 nt, Human
ggcgacuagggcaccauacucacuuuccagggcugggggaagggggacgcaggaucaucccc

SEQ ID NO: 399518 - RNA, 62 nt, Human
ccagaguagccaugaggaggcagagagggucacugggggacacuguggcagcaggagggacu

SEQ ID NO: 399519 - RNA, 62 nt, Human
cagcagacucuccagcccucuuccuccuuccucugggggaggagggguuccugagggaccug

SEQ ID NO: 399520 - RNA, 62 nt, Human
guguucccaugcacagggccauucaggaagggcugggggaguguguguggcaauaaagcuug

SEQ ID NO: 399521 - RNA, 62 nt, Human
agaaugcagucaucagaccugaaaaaacaacacugggggagggggacggugaaggccaaguu

SEQ ID NO: 399522 - RNA, 62 nt, Human
uauuuuguuuaccuacuguaucaaaggggagucugggggagaaugguaguauuuuuuuuuuu

SEQ ID NO: 399523 - RNA, 62 nt, Human
cugcugccaaggguggacacggcugcagacuucugggggaauugucgccuccugcucuuuug

SEQ ID NO: 399524 - RNA, 62 nt, Human
accugacaguccaggagauggacuggcuggugcugggggagcugcagauggcccuggagugg

SEQ ID NO: 399525 - RNA, 62 nt, Human
ucucaacaguggggucgggggcccacccccagcugggggaccccaugcaggcugaugggccc

SEQ ID NO: 399526 - RNA, 62 nt, Human
ggccugcccauccagaagggacuccccagggccugggggaggagacccuuggaaaaguccuc

SEQ ID NO: 399527 - RNA, 62 nt, Human
auagaaugaaccagaacuaguggauuccagggcugggggaaaaaaaaaaagaaaaaaccuca

SEQ ID NO: 399528 - RNA, 62 nt, Human
guggaaugagugugcauggaggcccuccugugcugggggaaugagcccagagaacagcgaag

SEQ ID NO: 399529 - RNA, 62 nt, Human
acccacccgaccuggcugccccucaccuugggcugggggacuggggggccauuuccuuuucu

SEQ ID NO: 399530 - RNA, 62 nt, Human
gggcaccccaaagagggggcacugccagguagcugggggaguggcauggggcaggggcccag

SEQ ID NO: 399531 - RNA, 62 nt, Human
ccaaaucccccgacucccuccccagaucuguccugggggaugcaaauaaagccugcucuccc

SEQ ID NO: 399532 - RNA, 62 nt, Human
acgggucacccugcugaagaucacucugugcccugggggaggagccaagcccucaccccaca

SEQ ID NO: 399533 - RNA, 62 nt, Human
cugaaugcauuggccggugcccggcucauggucugggggaugcaggcaggggaagggcagag

SEQ ID NO: 399534 - RNA, 62 nt, Human
gagccccgugcauccaggcggccaagcacaaacugggggagaggaggccgccagcccggagg

SEQ ID NO: 399535 - RNA, 62 nt, Human
uuuaauggcgacuuggggggaagggagccacccugggggagucugaggaguucagacugugc

SEQ ID NO: 399536 - RNA, 62 nt, Human
guauuugugguguugccuugccuugcaugaugcugggggaaaaagagaaaagaaaugguuuu

SEQ ID NO: 399537 - RNA, 62 nt, Human
ccugucuucuguuuuauagaaauugaucuucccugggggacuuuaacucuugaccuguaugc

SEQ ID NO: 399538 - RNA, 62 nt, Human
agcuggggguuggggguggugggggucggggccugggggacugggagccgcagcagcucccc

SEQ ID NO: 399539 - RNA, 62 nt, Human
auuacugcuucccauugaguaaucauacucaacugggggaaggggugcuccuuaaauauaua

SEQ ID NO: 399540 - RNA, 62 nt, Human
ccuuggauggugucaguuacaccuucaaugggcugggggacuuccugcuggucggggcccaa

SEQ ID NO: 399541 - RNA, 62 nt, Human
aggaaagacaacuggggaaagaagaccuaggacugggggaacccaaacagccuguccugcaa

SEQ ID NO: 399542 - RNA, 62 nt, Human
ggucagcacuugggcccacugacagugacugacugggggagaagguccugcagcccccuucc

SEQ ID NO: 399543 - RNA, 62 nt, Human
cccugccccuuguccucucagagccucagcuucugggggagacaugcucuccccacaggggg

SEQ ID NO: 399544 - RNA, 62 nt, Human
cacugcuacaccuuagcagcucuuccccuuuccugggggaugugcacggcagcuugagccug

SEQ ID NO: 399545 - RNA, 62 nt, Human
gucacguggucaaggcccggccccaucagaggcugggggaggcggcacauuggcaguguguc

SEQ ID NO: 399546 - RNA, 62 nt, Human
aauaaacauaagacguauguaaacaaaaacaacugggggaaucaaaucaaacaguuggauuc

SEQ ID NO: 399547 - RNA, 62 nt, Human
uuugucagagauggguguggauuuagguuauacugggggagaacuuuucucagcacagauuc

SEQ ID NO: 399548 - RNA, 62 nt, Human
guguuguauucagcacuaaaaaauggugggagcugggggagaaugaagacuguuaaaugaaa

SEQ ID NO: 399549 - RNA, 62 nt, Human
auguggauaggcuauagcuguucagaggucuccugggggagcuuaaaacgggggaaacacug

SEQ ID NO: 399550 - RNA, 62 nt, Human
ccuaguaauuuugacuuggauuauuuucuagccugggggaugggguucauauguguuguugu

SEQ ID NO: 399551 - RNA, 62 nt, Human
aagaguuaauauauagaaggguaccuugaacacugggggaggggacauugaacaaguuguuu

SEQ ID NO: 399552 - RNA, 62 nt, Human
uaaagaccuuccagcuccuguguucuagaccucugggggauaagggaguccaggguggauga

SEQ ID NO: 399553 - RNA, 62 nt, Human
uaugagcaauacucuguggaggucugguggggcugggggagcacccaggcggaucugcaagc

SEQ ID NO: 399554 - RNA, 62 nt, Human
ggagggcagagccagaagaaggcucauuagaccugggggacccaaagggucuggccucuuug

SEQ ID NO: 399555 - RNA, 62 nt, Human
cacuguguuauuugguuuaaaucaaagugauucugggggaagcuaugcucuuucaguggaua

SEQ ID NO: 399556 - RNA, 62 nt, Human
uuuagaggucuuacugcaauaagaaguaaugccugggggacgguaauccuaauaggacgucc

SEQ ID NO: 399557 - RNA, 62 nt, Human
ggccgcuggaggaagggcagccgacccggccgcugggggaagugccaggggcccggggcacc

SEQ ID NO: 399558 - RNA, 62 nt, Human
cugucccaggcgucacaacccauccucccaggcugggggagaaaggaccuccuggaacugac

SEQ ID NO: 399559 - RNA, 62 nt, Human
uuccuggaguggauguggcccagagaaggaggcugggggaucaccagccccaaggucccgaa

SEQ ID NO: 399560 - RNA, 62 nt, Human
ugugcuacugaagggaacugccuuucccccuucugggggagacuuaacagagcguggaaggg

SEQ ID NO: 399561 - RNA, 62 nt, Human
agugagccgagauggcgccacugcacuccagccugggggacagagcgagacuccaucucaaa

SEQ ID NO: 399562 - RNA, 62 nt, Human
accaccuguuuccccuuccauuagcagaaacucugggggaacuuugugucucaguccuagaa

SEQ ID NO: 399563 - RNA, 62 nt, Human
uuggaaauaaguggaaaauacgggauguaccccugggggaaaagccuggguuggguuuagaa

SEQ ID NO: 399564 - RNA, 62 nt, Human
uguugucaucacugagucagcacucaccuggccugggggaauuaaaggaauuccccguaagg

SEQ ID NO: 399565 - RNA, 62 nt, Human
augaauguauuuauuugggagaccgggguauccugggggacccaauguaggagcugccuugg

SEQ ID NO: 399566 - RNA, 62 nt, Human
uucuccccugugccguaguuugucuccugggacugggggaggaguccgaggugggguugguu

SEQ ID NO: 399567 - RNA, 62 nt, Human
ccccauccucugccucaucguuccccugagcacugggggacagacccucacccccacccugg

SEQ ID NO: 399568 - RNA, 62 nt, Human
uguuggggggcccccuuccaugacucuguccccugggggagguaggacagggcugggcuucc

SEQ ID NO: 399569 - RNA, 62 nt, Human
uccaagcacuacauuuuggcggcugccggccucugggggagguggcaguuaugcuguuacua

SEQ ID NO: 399570 - RNA, 62 nt, Human
ccagccaccuccucagccccaugugaugcucccugggggagcccuacuccccuugcuacaug

SEQ ID NO: 399571 - RNA, 62 nt, Human
gcagccaugggaaggagcccaggggagcuggccugggggagcgaagcccauguucgcuuccu

SEQ ID NO: 399572 - RNA, 62 nt, Human
cccugccccccucccuuccgcuccugcccagccugggggaaggagaaaggaggggagaaagc

SEQ ID NO: 399573 - RNA, 62 nt, Human
ucccagugcugcaaucacacauccauucugcccugggggacccuggagccuacuugugcgcu

SEQ ID NO: 399574 - RNA, 57 nt, Human
ugcagacgcccguccagugaacucgagcugggggaggggcagagcgcggggcucccc

SEQ ID NO: 399575 - RNA, 62 nt, Human
cacaaaguaaacuucauuuucaggcaguguuucugggggagguuauggagggaagaaaaaag

SEQ ID NO: 399576 - RNA, 62 nt, Human
ucuuugugaaccugugaguacuccacaguuuacugggggaaaaggcuucaguaaagcagagg

SEQ ID NO: 399577 - RNA, 62 nt, Human
acagcagugaucaagugucaucccuuacgugacugggggaugucuguccuaaaagcugacug

SEQ ID NO: 399578 - RNA, 62 nt, Human
accguaaguaaaaacacacagaauuguguugacugggggaggugaaucacaaaaaaguuacg

SEQ ID NO: 399579 - RNA, 62 nt, Human
acagaccagcccuuccccauccugggguugcccugggggauaccagcugagucugaauucug

SEQ ID NO: 399580 - RNA, 62 nt, Human
gagaguggcuuucuaccacacacagccugucccugggggaguaauucugucauuccuaaaac

SEQ ID NO: 399581 - RNA, 62 nt, Human
ugauuacaauuuuuuccuuugcagaugccuuccugggggauacuccuccccacccuaaaggg

SEQ ID NO: 399582 - RNA, 62 nt, Human
uagccucagcccccagcugggucucagaggagcugggggagcgguggccagcccauuuucug

SEQ ID NO: 399583 - RNA, 62 nt, Human
ccuguuguauacuaggagagaacuuaacccaccugggggaaaauagcuccccaagagcuggc

SEQ ID NO: 399584 - RNA, 62 nt, Human
uguggggagaguggaagaggcagggaguaauccugggggacagcagggaggaggcacuucuu

SEQ ID NO: 399585 - RNA, 62 nt, Human
guagcacaaguuauuuaaaucuguuuuucuaacugggggaaaagauucccacccaauucaaa

SEQ ID NO: 399586 - RNA, 62 nt, Human
agugagccaugaucauuccacugcauuucagccugggggauacagugagaccuugucuuuaa

SEQ ID NO: 399587 - RNA, 62 nt, Human
agugagccaagaucacgccauugcacuccagccugggggacagagcaagacucuaucuccaa

SEQ ID NO: 399588 - RNA, 62 nt, Human
gccagggcggccgggcgccccaucgccacauccugggggagcauacccagugucuaccuuca

SEQ ID NO: 399589 - RNA, 62 nt, Human
agggcugagggggugcagcuugcugguguucacugggggagggccugugggcacacauggca

SEQ ID NO: 399590 - RNA, 62 nt, Human
uuuaggacuucaagaucacacuugugggcaaucugggggagccacaacuuuucaugaagugc

SEQ ID NO: 399591 - RNA, 62 nt, Human
ugucccagauacucuaaaugugaauguaugagcugggggagucaacccagcccaccaugccu

SEQ ID NO: 399592 - RNA, 62 nt, Human
ccuucccagccagccagcaggagaggcaagaacugggggaacacaggaaccuaggggaggag

SEQ ID NO: 399593 - RNA, 62 nt, Human
ccaugugggggcagcaggggccugggccauagcugggggaggccagacccugagggcuuugc

SEQ ID NO: 399594 - RNA, 62 nt, Human
caccaacuguccccugcgaggagaaaucacuccugggggagaaccacugacccaaaugaauu

SEQ ID NO: 399595 - RNA, 62 nt, Human
aagaggcucaaaugcuguccccggcagcuuuccugggggacuagagcuccuucuggccaugu

SEQ ID NO: 399596 - RNA, 62 nt, Human
ccagccuuggcccugcagccuccaccucgccgcugggggaccaacagguugcuuacagcuuu

SEQ ID NO: 399597 - RNA, 62 nt, Human
agaaccaaaaacgccagucaugggaggcagagcugggggagcgaggcugacaaugacuccug

SEQ ID NO: 399598 - RNA, 62 nt, Human
cucagccccuagccuggccucuuugcauggggcugggggagauggggcgcugggagugagug

SEQ ID NO: 399599 - RNA, 62 nt, Human
auguacaaacauguuguuuguuuuauuuggggcugggggagguauaugaugagcagacuucu

SEQ ID NO: 399600 - RNA, 57 nt, Human
cgccuccugagcgagacuagggcugggcugggggagggcagggccggacggagugga

SEQ ID NO: 399601 - RNA, 62 nt, Human
ggccugcuuuaagggugcagccccucgcccgucugggggauggagggggguggcauugguuc

SEQ ID NO: 399602 - RNA, 62 nt, Human
gccaagcaucaguguuagggcuggggcucagccugggggagccuacuggggacugagccccc

SEQ ID NO: 399603 - RNA, 62 nt, Human
gccuguaaacccagggcuuuagaaggcugaggcugggggauugcuugaagucaggaguucaa

SEQ ID NO: 399604 - RNA, 62 nt, Human
cagaagaguaaacacucucggaugccgcuguccugggggagcccgcgggagccugugaaugu

SEQ ID NO: 399605 - RNA, 62 nt, Human
ugggugaugagcagcuuuuccccccuggcuuucugggggaggagugggccuccuuagggaga

SEQ ID NO: 399606 - RNA, 62 nt, Human
aggccugguggcccugcugggcagcccaacugcugggggagacguuucugccacccugggug

SEQ ID NO: 399607 - RNA, 62 nt, Human
ccccggggggcagcaggugggcucgggacgggcugggggagggacggccauggcacuugggg

SEQ ID NO: 399608 - RNA, 62 nt, Human
gcacagguguccugugcuuccugugagacuuccugggggaaauauacaaacuaauauauuuu

SEQ ID NO: 399609 - RNA, 62 nt, Human
uguuugcuuggugcugguuuauuuguuguuuucugggggaaaaagccauaucaugcuaaaau

SEQ ID NO: 399610 - RNA, 62 nt, Human
aucuuuggggguugguuugaggucuuagaacucugggggauauuccccugagcaaaacaaac

SEQ ID NO: 399611 - RNA, 62 nt, Human
ggaggagggagcagauguaagcucccaagagccugggggaucacaggucccucugcaaaacu

SEQ ID NO: 399612 - RNA, 62 nt, Human
gagacccucccacccagcagaccaggagauagcugggggacaagggcagacggccccugccu

SEQ ID NO: 399613 - RNA, 62 nt, Human
uaacucagauggugcucggcuggacaaggggacugggggaggggccaaagcagggacagugg

SEQ ID NO: 399614 - RNA, 62 nt, Human
cacagaaauuguuugggggauggggggggggacugggggagggguagcugcuaucuuugaga

SEQ ID NO: 399615 - RNA, 62 nt, Human
cccaggacaagugagcuggugucaccuccugccugggggaagagccaggcccugaggaacag

SEQ ID NO: 399616 - RNA, 62 nt, Human
cuuaacucacccaccacgaggcacuuuacagacugggggaggggguuuuucuuuuuauuuuu

SEQ ID NO: 399617 - RNA, 62 nt, Human
accgcaggggcccuccacauucuggccgguaacugggggaaggugauggggcgggggucccc

SEQ ID NO: 399618 - RNA, 62 nt, Human
cugcagugaauguucaacaguuugcccaggaacugggggaucauauaugucuuaguggacag

SEQ ID NO: 399619 - RNA, 62 nt, Human
gcgcagugcaugcugggugcaugaagggcagccugggggacagacuguugugggaacguccc

SEQ ID NO: 399620 - RNA, 62 nt, Human
ccauuugggaaacugagcuucuuucuucugcacugggggacuggaugcuagccaucuccagg

SEQ ID NO: 399621 - RNA, 62 nt, Human
ccuucacaugcucuuguuuuccagcugcuuuccugggggaucagacugugaagcaggaagac

SEQ ID NO: 399622 - RNA, 62 nt, Human
aaacucuaaaaagccauugaugagauguauagcugggggacaaaacauaaagccaucaagca

SEQ ID NO: 399623 - RNA, 62 nt, Human
acacucacuagggggcagggcgcugcugguuccugggggacugggugggaagggugguggga

SEQ ID NO: 399624 - RNA, 62 nt, Human
ugacaucccuuuccacugugugugugaccaugcugggggagggggacucugcuuggaauuaa

SEQ ID NO: 399625 - RNA, 62 nt, Human
uccugaagauggagccucaggagguggagucccugggggagaccuaugacuucgacagcauc

SEQ ID NO: 399626 - RNA, 62 nt, Human
guacugccacucugcagguggagcgggugacucugggggaccauuaagaccuccagaccggg

SEQ ID NO: 399627 - RNA, 62 nt, Human
uucugaaauaaugcauccaaaggguugauauucugggggaggucacugcagaaggauggaac

SEQ ID NO: 399628 - RNA, 62 nt, Human
cacaggcucugcuagguuccggacacaggcuucugggggaagggucucccuuggccaucacg

SEQ ID NO: 399629 - RNA, 62 nt, Human
aagcuuuuugacugugaaggcagaggucagcacugggggaaacuugcugguggucucuccca

SEQ ID NO: 399630 - RNA, 62 nt, Human
augcacacacuugcauacauauauauuuuuggcugggggagugugaguuuugccuuucuaag

SEQ ID NO: 399631 - RNA, 62 nt, Human
acgugaaaggcagcucuagacaucaaccaguccugggggaggggagugggaaccgggcacaa

SEQ ID NO: 399632 - RNA, 62 nt, Human
acagccuuuagaagccgcugcugaaauugauacugggggaaggguuccccuuccuucuagag

SEQ ID NO: 399633 - RNA, 62 nt, Human
gcaccugcagcuccagggaguuaacucuucuucugggggacugagaacuguagaaagccaca

SEQ ID NO: 399634 - RNA, 62 nt, Human
augcuuccgaccuuucaggugacgcaggaacacugggggagucugaaugauuggggugaaga

SEQ ID NO: 399635 - RNA, 62 nt, Human
ggaggcugucgucgcccccaggaaagacgggccugggggaggcgggacagugggagaggcgc

SEQ ID NO: 399636 - RNA, 62 nt, Human
ccugggucuugcuggacgaguguggccuagagcugggggaggacacuccccacgugugcugg

SEQ ID NO: 399637 - RNA, 62 nt, Human
caggcccagcggaugcuggcacccaagcgcagcugggggaccccucagcuccgucucagagu

SEQ ID NO: 399638 - RNA, 62 nt, Human
gcggccuccuguagcaccaucuugggaaaguccugggggacgugugugucgugcuuuuuacc

SEQ ID NO: 399639 - RNA, 62 nt, Human
ccacccuggucccaguuucccgcaaagugccucugggggaccccccagccucccacccuggu

SEQ ID NO: 399640 - RNA, 62 nt, Human
gguggauggaagguucugggugcccgcaggggcugggggaugcuaggacugagacccugggu

SEQ ID NO: 399641 - RNA, 62 nt, Human
guacuggacuaucuaccugccuugucccuguucugggggaagguguccaccccgaucaagaa

SEQ ID NO: 399642 - RNA, 62 nt, Human
uaacagucuagugcaaaagauuaagauuuuaucugggggaaagaaaagaauuuuuuaaaaaa

SEQ ID NO: 399643 - RNA, 62 nt, Human
aauaacccuguaguggcuugaugcagggaacccugggggacuuucagcgaagagcugugcuc

SEQ ID NO: 399644 - RNA, 62 nt, Human
uggcugcagagaggcggaggaggaagcuggcgcugggggaggcugagggugagggaacagcc

SEQ ID NO: 399645 - RNA, 62 nt, Human
uagucuccaauauggagcaucucaagcuucuccugggggauggggauugggaugggcagaau

SEQ ID NO: 399646 - RNA, 62 nt, Human
cuggcucaggguucaucguucugccuuguccacugggggaccagcccugcagaccacucuga

SEQ ID NO: 399647 - RNA, 62 nt, Human
cccgggacuguccguucucggggccagagcugcugggggaccgaguuuguacauuuuccauu

SEQ ID NO: 399648 - RNA, 62 nt, Human
caaccucaaaggagcaagccuugaaacaguugcugggggaaguggccagaguagagaugcug

SEQ ID NO: 399649 - RNA, 62 nt, Human
cccauaguuguauaaaggucauagugaagaagcugggggaagacugcuucagccagauccug

SEQ ID NO: 399650 - RNA, 62 nt, Human
cagcaagauucuuucauucgucuccuccuagccugggggaccaggcucgaacugacccugga

SEQ ID NO: 399651 - RNA, 62 nt, Human
uuuaaaaguuaaggggcaagcagcauugcauucugggggaacgauccuggccacagccgcca

SEQ ID NO: 399652 - RNA, 62 nt, Human
cucccgccuugcgggcagugcuaaagguggagcugggggauuuuccugggaaugauuugagg

SEQ ID NO: 399653 - RNA, 62 nt, Human
cggcugguguuggucagaugcaccugugugcacugggggagggaugguuugggcaggugcag

SEQ ID NO: 399654 - RNA, 62 nt, Human
accggaggcccggugaccacggaacucaccgucugggggaggaggagagaaggaaggggugg

SEQ ID NO: 399655 - RNA, 62 nt, Human
agccagcucugccucucucagggccuggaguccugggggagcucagccagcucugccuuucu

SEQ ID NO: 399656 - RNA, 62 nt, Human
gggccacguacaagcagggcuucggcagucggcugggggaguucuggcuggggaaugacaac

SEQ ID NO: 399657 - RNA, 62 nt, Human
ugaggaggggugggggccguuuguucaguuaccugggggaaccucacccagcacccugcccc

SEQ ID NO: 399658 - RNA, 62 nt, Human
uaggguggucagaggaagccagcagggaagaucugggggacagaggaaggccuccugaggga

SEQ ID NO: 399659 - RNA, 62 nt, Human
aagcacauuagagacuaacuguaacuuaagugcugggggaaaaaaaaugugaacuaacuuau

SEQ ID NO: 399660 - RNA, 62 nt, Human
ggagauguuuaggucucuuuauuuagugcaaucugggggauggcaacagagaaagaggaaag

SEQ ID NO: 399661 - RNA, 62 nt, Human
ucccagccugagagaugcucaaagguggggagcugggggagccaccccucggccauucccuc

SEQ ID NO: 399662 - RNA, 62 nt, Human
gcugugaccccucaggcuagcccuucuccacucugggggaggaggugggaagggccaccagg

SEQ ID NO: 399663 - RNA, 62 nt, Human
aguauucuccuggauccuggggccugggugggcugggggacagcugaggaugggccuagcag

SEQ ID NO: 399664 - RNA, 62 nt, Human
ggccuugcuggaauggaggcauccuuccaaaccugggggacggggguggggggugguagugg

SEQ ID NO: 399665 - RNA, 62 nt, Human
uaaaauuuuuugugagcacuuugagauuuuugcugggggagggguguuuugugaaagugaug

SEQ ID NO: 399666 - RNA, 62 nt, Human
gaccugucuggcucaggaaugggcucuggcugcugggggagccgugucacuccugggccaug

SEQ ID NO: 399667 - RNA, 62 nt, Human
ugaagggucagacacagucuacccaggggugucugggggacaagggggucucuggagauguc

SEQ ID NO: 399668 - RNA, 62 nt, Human
aaguguccugagugaaggaggggacccccauccugggggaugcugggagugagugagugaga

SEQ ID NO: 399669 - RNA, 62 nt, Human
gcuuagugcuucagcugucccuuccuuguguccugggggaccugcuggcggccucuuccugg

SEQ ID NO: 399670 - RNA, 62 nt, Human
aaccucaccaaacugaggccagagcugagcuccugggggaguuaauucagaggggagaggcc

SEQ ID NO: 399671 - RNA, 62 nt, Human
agaaaucuugaguuaagugaguucugaggcugcugggggaaccagaucaauucaaagcuaaa

SEQ ID NO: 399672 - RNA, 62 nt, Human
gaauauucagcauaaugcuggcucuuguuucacugggggaaacaaguuauucucaaauauuu

SEQ ID NO: 399673 - RNA, 62 nt, Human
acagcuacacgcccauuaaagcacagcacguccugggggaggggggcauuuuuuauguuaca

SEQ ID NO: 399674 - RNA, 62 nt, Human
agguagacaccagccagcaugguggcccuguucugggggagcaggguaaggcaggaggaagu

SEQ ID NO: 399675 - RNA, 62 nt, Human
agugagcugugaucgugccacugaccuccagccugggggacagagcaagaccgugucucaaa

SEQ ID NO: 399676 - RNA, 62 nt, Human
ugcuuugagcuccuggacucaccugaggcucccugggggaugacacucaguucugucacugu

SEQ ID NO: 399677 - RNA, 62 nt, Human
acaggaucuccugggccuuggagcaccucacgcugggggaaucaaucccugagggacucaga

SEQ ID NO: 399678 - RNA, 62 nt, Human
ccuugggugcggggucucugugcacuugagagcugggggacccacccaccgucucccacucc

SEQ ID NO: 399679 - RNA, 62 nt, Human
ucggacgcagcggcuucgggaacaaguuagcgcugggggacuaucugggcucgucucucucu

SEQ ID NO: 399680 - RNA, 62 nt, Human
cgguuacauuauuaaaugauucuagggauucacugggggauauuuuuguugcuuuuacuuuc

SEQ ID NO: 399681 - RNA, 62 nt, Human
acauuuuuaacuuuaugaccagccuaaauauucugggggaagugggguauaauauuuaacga

SEQ ID NO: 399682 - RNA, 62 nt, Human
caagcaauuaagagcaguuauaauagaggaagcugggggacccauuuugcaccaugaguuug

SEQ ID NO: 399683 - RNA, 62 nt, Human
cuggugacugcuggugggcaggcuggcccugccugggggaguccguggcgaugggcgcuggg

SEQ ID NO: 399684 - RNA, 55 nt, Human
caaacuuugaggucaucuagcccagcugggggacagugggcuguuguggcugggu

SEQ ID NO: 399685 - RNA, 62 nt, Human
accacagcauugguuuuuuucuacuugugugucugggggaaugaacgcacagaucuguuuga

SEQ ID NO: 399686 - RNA, 62 nt, Human
uggcugccccaggccuccuuggcccaugggugcugggggagguggaugucagaucugguagg

SEQ ID NO: 399687 - RNA, 62 nt, Human
ggcucagcaggaggaggcuguggcugcagagccugggggagcuuuuagguguugagaugggg

SEQ ID NO: 399688 - RNA, 62 nt, Human
guaaaacucgcagcagauaucagugggaagggcugggggagggggcacccagcugccuuucc

SEQ ID NO: 399689 - RNA, 62 nt, Human
cagaaucagggaaagaaccauuaggaguggaacugggggaaucugaguugugucacuucagu

SEQ ID NO: 399690 - RNA, 62 nt, Human
ggaggggcgaccagauaaggagccccucucugcugggggagaagggaagacgaggaacccca

SEQ ID NO: 399691 - RNA, 62 nt, Human
auaugggacuugagcauuuguggauuuugauacugggggauccuggaaccaaucccccaugg

SEQ ID NO: 399692 - RNA, 62 nt, Human
augcugcaccauugcugaaaugaaagaugacucugggggagcagagcuuggccuugugccca

SEQ ID NO: 399693 - RNA, 62 nt, Human
ugaucucuuccuugcagggaacagcuuuggggcugggggaacuagaacccacauguuggucu

SEQ ID NO: 399694 - RNA, 62 nt, Human
agcugugcgcugcucugcaggcuggggaggugcugggggagcccuggguuccgguuguugau

SEQ ID NO: 399695 - RNA, 62 nt, Human
gucgggucccagagagggagcccaccugcugccugggggagagccuggccuggccgcgucau

SEQ ID NO: 399696 - RNA, 62 nt, Human
ugaacaccacuucuacacaacccuccuugguacugggggagggagagaucugacaaauacug

SEQ ID NO: 399697 - RNA, 62 nt, Human
ccccgaugagggguccugaggaggggauggggcugggggaugggccugagugagaggggagg

SEQ ID NO: 399698 - RNA, 62 nt, Human
ucaagacugacucugauaguguagcauuuucccugggggaguuuugguuuuaauuagauggu

SEQ ID NO: 399699 - RNA, 62 nt, Human
aggauuccugccacuuuggucccuggccucuccugggggaggcugcuguucuuaggugcucu

SEQ ID NO: 399700 - RNA, 62 nt, Human
gugccucugaggcagaaccaaaggagccugcacugggggaaaucccuuuuccugccugccug

SEQ ID NO: 399701 - RNA, 62 nt, Human
agugagcugagaucgugcuacugcacuccagccugggggacagaaagagacuccgucucaaa

SEQ ID NO: 399702 - RNA, 62 nt, Human
guugacacucaugauucugaauguugccugggcugggggaguaccuguagcacgccagugcu

SEQ ID NO: 399703 - RNA, 62 nt, Human
cccuuggaccugacucagcuaacaaucuagcccugggggaaugugaucuaccugaugcgacc

SEQ ID NO: 399704 - RNA, 62 nt, Human
aguugcaccgcggcagcuccauggaaaucaaucugggggagaaggacacugcaucccagauc

SEQ ID NO: 399705 - RNA, 62 nt, Human
cuuccagguggcucccgcugaggcagcggucucugggggaucccccagcugaaggaggcugg

SEQ ID NO: 399706 - RNA, 62 nt, Human
gcccuguccaggugggaagcugagucccagugcugggggacuguggccugggcugaucuuga

SEQ ID NO: 399707 - RNA, 62 nt, Human
agacccguguuggggguacugaaggagaggcccugggggacccucugaagcauuucugccuc

SEQ ID NO: 399708 - RNA, 62 nt, Human
ugcauaaaggagaaaacaacucuauguacaugcugggggagagugccuaaugugggagacca

SEQ ID NO: 399709 - RNA, 62 nt, Human
ccugaacucugugauagagugugacugagcugcugggggacaugugagccucaaauccauag

SEQ ID NO: 399710 - RNA, 62 nt, Human
acagucaccgcaggugcaggcaggaagcagcccugggggacuggacgcugcuauugauucau

SEQ ID NO: 399711 - RNA, 62 nt, Human
cuuuuccgaugucacaauguggaggaaagcaccugggggacaacagugcucgugcagguggg

SEQ ID NO: 399712 - RNA, 62 nt, Human
auucagauggagcacugucacuuagacauucucugggggauuuucugcuugucuuucuugag

SEQ ID NO: 399713 - RNA, 62 nt, Human
cacacuguccuguuggcaucacagccccaaggcugggggaacuucaugcugggacaagcagc

SEQ ID NO: 399714 - RNA, 62 nt, Human
cuagcauaggaaaagcuuccuugaugugagcucugggggagugugaaggaugcaucucuagc

SEQ ID NO: 399715 - RNA, 62 nt, Human
uuugcuauuaaaacuacuguucauuuugggggcugggggaagugagccuguuuggaugaugg

SEQ ID NO: 399716 - RNA, 62 nt, Human
gggugcaagaggaaggagugugcccagaccagcugggggagcauugaaaggacagcuugggg

SEQ ID NO: 399717 - RNA, 62 nt, Human
ggguugccgcagugucaccucaguggaccagccugggggaaggagcuuaauugcugagacau

SEQ ID NO: 399718 - RNA, 62 nt, Human
ugagcccucccagggacccuccacgaccagcucugggggaggcacaggcccucauccacccu

SEQ ID NO: 399719 - RNA, 62 nt, Human
gguuccuuuguucccuaaguccaacuacuaaacugggggauauuaugaagggccuugagcau

SEQ ID NO: 399720 - RNA, 62 nt, Human
cucuggcccagugaauuuggucucucccagcucugggggacuccuuccuugaacccuaauaa

SEQ ID NO: 399721 - RNA, 62 nt, Human
gugccucaggaucuuauggcuccuuccuccagcugggggacucuuaaaggggcugggguaga

SEQ ID NO: 399722 - RNA, 62 nt, Human
cuuggcagacccuugacuccaggggagaugaccugggggaggaagugugucaacuauuucuu

SEQ ID NO: 399723 - RNA, 62 nt, Human
caggagugggcagcagucagggagagacagaacugggggaaagggaugguugugggucuuuc

SEQ ID NO: 399724 - RNA, 62 nt, Human
cagucuauaccagcaugaguacugccccaccccugggggaaaccuggcuccaaccaaccccu

SEQ ID NO: 399725 - RNA, 62 nt, Human
ccuuaacugcugagccucagccagcguggguccugggggaaauaccauuccaaaggaagcca

SEQ ID NO: 399726 - RNA, 62 nt, Human
ccaccuuugucugauacuuguuuccagggaagcugggggaacugccacaucugaggaacugg

SEQ ID NO: 399727 - RNA, 62 nt, Human
aggacccaggggagguuuagggguccuaucuccugggggaaggggagaucuaagauguccca

SEQ ID NO: 399728 - RNA, 62 nt, Human
gccagggcugcaaagcaaggucuugcuucuaucugggggacgcugcucgagagaggccaaga

SEQ ID NO: 399729 - RNA, 62 nt, Human
gaccacuacuauacugauggugggauugggaccugggggauacaggggccccaggaagaagc

SEQ ID NO: 399730 - RNA, 62 nt, Human
aaugaaacuuguggagagcuuauacagagccucugggggaaaaaagagcccuuauuuguggg

SEQ ID NO: 399731 - RNA, 62 nt, Human
gaaggggagacucccuccucuguaacuucuuucugggggauuggggugggcaguaccuaucc

SEQ ID NO: 399732 - RNA, 62 nt, Human
caacuugguugugaaccaacugccuuaaccuucugggggagggggauuagcuagacuaggag

SEQ ID NO: 399733 - RNA, 62 nt, Human
gguggcuuuaggggaagggggaaagguguaggcugggggauugagguggggaaucauuuuag

SEQ ID NO: 399734 - RNA, 62 nt, Human
gccugcguugguccagagcggaggcugugugccugggggaguuuuccucuauacaucucucc

SEQ ID NO: 399735 - RNA, 62 nt, Human
accaagaaggagaccuuuucacaauggaaaaccugggggauggucagagcccagucgagacc

SEQ ID NO: 399736 - RNA, 62 nt, Human
ucaguaaacagacuguagagugucugacuauacugggggaagaggagccaaugacaggguag

SEQ ID NO: 399737 - RNA, 62 nt, Human
cauuacuagaaucauuucauuauuucugcuuccugggggaaggaugcagaaggagucugaug

SEQ ID NO: 399738 - RNA, 62 nt, Human
auucacccaggcuuccuucucaguagcucuagcugggggaggugucagcugggccccuccug

SEQ ID NO: 399739 - RNA, 52 nt, Human
ccacugggaguagcggcuaaagcugggggauagaggggcugcagggccacug

SEQ ID NO: 399740 - RNA, 62 nt, Human
cucucccaucaagcuucagaugccauguuguacugggggaauguagcccuugugcuccccac

SEQ ID NO: 399741 - RNA, 62 nt, Human
aggagguuuccaguucauuuacauuaagggcccugggggagaauaaagcucagagcaggagg

SEQ ID NO: 399742 - RNA, 62 nt, Human
acguuccugcccuuuacuauugcugauggagccugggggaaccaucacuuuuuuugugugcu

SEQ ID NO: 399743 - RNA, 62 nt, Human
agcaacccagagauggccaaaagcauucaagccugggggaagauguuugacuauugcugcuc

SEQ ID NO: 399744 - RNA, 62 nt, Human
gcuggaggccaggcccaggugcgugccuuguccugggggauugaccaucaugucuucccugc

SEQ ID NO: 399745 - RNA, 61 nt, Human
auccuccaaaagacagaugaugcggagguuccugggggaaucaaagagaaaugugccucau

SEQ ID NO: 399746 - RNA, 62 nt, Human
gucugcuugcaaaguuggcccuuggcuggcaucugggggaacuugguucuuggauggauucc

SEQ ID NO: 399747 - RNA, 62 nt, Human
guagcagucgcuggcagagcacacaggcugcucugggggaugagcuggugcguuuaaggaac

SEQ ID NO: 399748 - RNA, 62 nt, Human
ggccacagagggcaaggacugugccggagucccugggggaggugcuggcgcgggaugaggac

SEQ ID NO: 399749 - RNA, 62 nt, Human
cuuccauguuguaaaggaacagccccagugcacugggggaggggagggagugaggggcagug

SEQ ID NO: 399750 - RNA, 62 nt, Human
gccucucccaccacaagcccagaguggaugggcugggggaggggugcuguuuuaauuucuaa

SEQ ID NO: 399751 - RNA, 62 nt, Human
aagucauguauaggcuaagauuuuaagaagaucugggggaauaaaaagccaacaguaagccc

SEQ ID NO: 399752 - RNA, 62 nt, Human
auaaggccaugcuccugacaggucuaggcaaccugggggaugacuuagguuaaugugcuagg

SEQ ID NO: 399753 - RNA, 62 nt, Human
cacucucauuccccagguggcugacccagucccugggggaagcccuggauuucagaaagagc

SEQ ID NO: 399754 - RNA, 62 nt, Human
aaaagaccuuuuucagguucuuucacuauugucugggggacucagaacaagauuguucucug

SEQ ID NO: 399755 - RNA, 51 nt, Human
guggagagaagaagcccugagcugggggaaggggucaugcagcaccagggg

SEQ ID NO: 399756 - RNA, 62 nt, Human
ggcgccuguggggagggaaccaggaggccacacugggggagcgugcagccagcaugugcagu

SEQ ID NO: 399757 - RNA, 62 nt, Human
ugaggugugauugggcccuccggcuggauguucugggggaggaggcaaucgcuguagcugcc

SEQ ID NO: 399758 - RNA, 62 nt, Human
gcaaauuaaacaauaaaccagacagcaaggcccugggggaaaggacaacauccugaaauaaa

SEQ ID NO: 399759 - RNA, 62 nt, Human
agaaauagaggcucccaaaguagggaaggcagcugggggaggguucagggcagcaaugcuga

SEQ ID NO: 399760 - RNA, 62 nt, Human
agcagacugaccaucucccagaccgccagugacugggggaggaccugcucugcccucucccc

SEQ ID NO: 399761 - RNA, 62 nt, Human
auguaggggucuggucuccucagccuccucaucugggggaguggaauaguauccuccagguu

SEQ ID NO: 399762 - RNA, 62 nt, Human
acugcagaacaaaccguggggcucucuggggucugggggaauacgggcaacagcagucagga

SEQ ID NO: 399763 - RNA, 62 nt, Human
gguuaucaucagaagguggucuccccucaggccugggggauaaggacgugggcccagccaca

SEQ ID NO: 399764 - RNA, 62 nt, Human
ggaacauuuccuuagauguuacccagaugguucugggggagacagaaaagaggugcggcagg

SEQ ID NO: 399765 - RNA, 62 nt, Human
guuuuguuuuguugccaacgaggaacacagcucugggggaauggugucauccaccucgcuuu

SEQ ID NO: 399766 - RNA, 62 nt, Human
ucccacuggacaugguugcagcugggagugggcugggggaggggaacaggaugcccagccca

SEQ ID NO: 399767 - RNA, 62 nt, Human
guuuuuauggaucugcaccagacuguuaccuucugggggagauggagauuugacuguuuaaa

SEQ ID NO: 399768 - RNA, 62 nt, Human
auauuuauuguacuaagaguugucaaugcucccugggggagcccucggaaucuauuuaauaa

SEQ ID NO: 399769 - RNA, 62 nt, Human
ccagucucacugugaaccacacgaaaccucaacugggggagugaggggcuggccaggucugg

SEQ ID NO: 399770 - RNA, 62 nt, Human
gagccaggagugaauggcccuuccuuaguagccugggggauguccagagacuaggccucucc

SEQ ID NO: 399771 - RNA, 62 nt, Human
uagaaauugagcucuuacucucuucuguaauacugggggaccuacagcugccguggggcuga

SEQ ID NO: 399772 - RNA, 62 nt, Human
aacuuaguaaaauugaccuucgcaaaaccucacugggggagugccuuguagagcugugggug

SEQ ID NO: 399773 - RNA, 62 nt, Human
uugugccucagacuuggggguugcauguggcccugggggaguuacuacccuugguaugcaug

SEQ ID NO: 399774 - RNA, 62 nt, Human
cauggcagggagggcugcacugacauugaugccugggggaccuuuugccucgaggcugagcu

SEQ ID NO: 399775 - RNA, 62 nt, Human
uuaggggcacaggagauguagucguuccagggcugggggaggugggagggaucacgccuaua

SEQ ID NO: 399776 - RNA, 53 nt, Human
ccauucugucccugguguagagccugggggacccaucuuccaccucaccucuu

SEQ ID NO: 399777 - RNA, 62 nt, Human
guggcccucaggccuggugcugccuuggagggcugggggaaggaguguguggaggagggagg

SEQ ID NO: 399778 - RNA, 62 nt, Human
aagagauugguuaguauggccugaacugguggcugggggaacugugucuggucaaguuaugg

SEQ ID NO: 399779 - RNA, 62 nt, Human
uagggaggcugaggugggaggaucacuugagccugggggacugaggcugcagugagccauga

SEQ ID NO: 399780 - RNA, 62 nt, Human
auucucauuaauacucuuuauuuauccuauuucugggggaggauguacguggccauguauga

SEQ ID NO: 399781 - RNA, 62 nt, Human
uucccagauugugccuuauaaccugccuuugccugggggaguggugccucgcaugcugauaa

SEQ ID NO: 399782 - RNA, 59 nt, Human
ccuugaacucugucgguugaugcugacuccugggggagggaggagucauguuggagguu

SEQ ID NO: 399783 - RNA, 62 nt, Human
uggggagguggauuuagcagaaggcaacuccucugggggauuugaaccggucugucuucacu

SEQ ID NO: 399784 - RNA, 62 nt, Human
gacuaggagcccagccuugcgccgcauucgcacugggggacaugggaggggucuagcuggcc

SEQ ID NO: 399785 - RNA, 62 nt, Human
guaugagagucggaccuggacagggccagcugcugggggagcggcacuggggacuggaggcu

SEQ ID NO: 399786 - RNA, 62 nt, Human
caccugcagagaaacgcgcuccuuggcggacacugggggaggagaggaagaagcgcggcuaa

SEQ ID NO: 399787 - RNA, 62 nt, Human
aggugauuguacgugguugcucuucuccuuggcugggggagguaaugagcagaucucugugg

SEQ ID NO: 399788 - RNA, 58 nt, Human
augugaucauacaagacugaguggggagcugggggaggggaggucuguuacugaaaga

SEQ ID NO: 399789 - RNA, 62 nt, Human
aacucugggaguuguggugggaggaggcacuucugggggauaggaccagacaagauaacagg

SEQ ID NO: 399790 - RNA, 62 nt, Human
gcucccggagagggagucagucuucacuugcacugggggaacagaugcuaauaaacuguuuu

SEQ ID NO: 399791 - RNA, 62 nt, Human
guugcagucccgacacggcuuuaggaagauaccugggggauggagggguggugaugucaggg

SEQ ID NO: 399792 - RNA, 62 nt, Human
gaggaaguggaagugccuuuaggauggugauacugggggaccggguagugcuggggagagau

SEQ ID NO: 399793 - RNA, 62 nt, Human
uuuauuucuacguuuuuaguaaauuuaauauucugggggaaaaaaggccuugauuuuagggu

SEQ ID NO: 399794 - RNA, 62 nt, Human
uuuccacucgcauuauuuaaugauggaagauucugggggagaguuguggauuucauaaagcc

SEQ ID NO: 399795 - RNA, 62 nt, Human
gggguguguacaacuuaacaccuggacuuuuacugggggagugggaaagugauucuguaacc

SEQ ID NO: 399796 - RNA, 62 nt, Human
auauuacauaagggaaaccuugagugguggugcugggggaggcaccccacagacucagcgcc

SEQ ID NO: 399797 - RNA, 62 nt, Human
ggauaaggcaaauucaacuuucagucucuuuucugggggaaaaaaauaauaaaccuagccua

SEQ ID NO: 399798 - RNA, 62 nt, Human
gagaucacacuacuguacuacuguacuccagccugggggaaagagugaaacuccaucucaaa

SEQ ID NO: 399799 - RNA, 62 nt, Human
ugugagaaggaagacagagaaguucuugaaagcugggggaugugugggcaagagguggauug

SEQ ID NO: 399800 - RNA, 62 nt, Human
cuugauuucacuucugauggaugcauggggcucugggggaaugcugggaaaaugggcaagca

SEQ ID NO: 399801 - RNA, 62 nt, Human
ucuggccagggagauccaugugcucaauguugcugggggaccuacaaaagucaaacauugcu

SEQ ID NO: 399802 - RNA, 62 nt, Human
gcgucuuuaaaaauagucucuguggcaggucacugggggacaauguacagcauucuggccau

SEQ ID NO: 399803 - RNA, 62 nt, Human
uuaacagaaauguacagcaaggagauuuacaacugggggagggugaagugaagacaaugacu

SEQ ID NO: 399804 - RNA, 62 nt, Human
acugaggggugggcugcagaacggggugggaacugggggaccugggccucaggccugcucca

SEQ ID NO: 399805 - RNA, 62 nt, Human
caauagcaauccagaauugggguuuuggggggcugggggaugggucugaccccaccuagagc

SEQ ID NO: 399806 - RNA, 62 nt, Human
auggcccugaagggcuguaggacggagguucccugggggaagucuguucuuugguauggaau

SEQ ID NO: 399807 - RNA, 62 nt, Human
agcaggaugcccuggaccuguaccagcacagccugggggagcuacugcuguugcuggcaggu

SEQ ID NO: 399808 - RNA, 62 nt, Human
ggcugagacucuggacagaggcugggguccuccugggggacagcacagucaguggagagagc

SEQ ID NO: 399809 - RNA, 62 nt, Human
aaaggcagcgggcgcugcuagugcgcaccgugcugggggaagggggaaccccuccccacccu

SEQ ID NO: 399810 - RNA, 62 nt, Human
uggcagcuuuuaacauuauagcaaauuugugucugggggacugcuggucacuguuucucaca

SEQ ID NO: 399811 - RNA, 62 nt, Human
cauggugggcacaguucucccugccccucagccugggggaagaagagggccucgggggccuc

SEQ ID NO: 399812 - RNA, 62 nt, Human
ucuagcucccucagccgaacagcacccugcaucugggggauugaagcagucgcugacccccg

SEQ ID NO: 399813 - RNA, 62 nt, Human
ucgaagugacuccgggcugagcaguggggcggcugggggaggggugacgauucuccucaggc

SEQ ID NO: 399814 - RNA, 62 nt, Human
auuccugccuccuuccugagccaguucagggccugggggagagccagcuugggguaggaagu

SEQ ID NO: 399815 - RNA, 62 nt, Human
cuuauccagacaguggggaaggcaugacacaccugggggaaauuggcgaugucacccgugua

SEQ ID NO: 399816 - RNA, 62 nt, Human
gagaugugcgugucaaauauucaucuaguccccugggggaggggaagggugggucuagacau

SEQ ID NO: 399817 - RNA, 62 nt, Human
ccuaccacccaaguccucaugcccuccgagggcugggggaggaggggcucaaggaagggggg

SEQ ID NO: 399818 - RNA, 62 nt, Human
cugccccugcuaccugcuucauuguccauccccugggggagugggucagagguacuggaggg

SEQ ID NO: 399819 - RNA, 62 nt, Human
aaaggacacacacaggauaugggagccaggggcugggggagguggaaggggcggggggcggg

SEQ ID NO: 399820 - RNA, 62 nt, Human
gaaguguuacuugaaccgggggaaucucggaccugggggagccggggugugaggggacugga

SEQ ID NO: 399821 - RNA, 62 nt, Human
ucaugauggccuccuccuucaggccucaaugccugggggaggccugcacuguccugauuggc

SEQ ID NO: 399822 - RNA, 62 nt, Human
ccucugaacuucaagucuccaaagaucagaaucugggggagggagcgcgugcagggaggggc

SEQ ID NO: 399823 - RNA, 62 nt, Human
acucuauucccacccuugagggagcccccuuacugggggaggguccuugcaauuccagcgaa

SEQ ID NO: 399824 - RNA, 62 nt, Human
caugaggacaugggaagguaggaguugccgcccugggggagggucccgggcugcucaccucu

SEQ ID NO: 399825 - RNA, 62 nt, Human
aaaaccaugcagcucagaggucccugugggggcugggggagcugcccugcaggucuuggcac

SEQ ID NO: 399826 - RNA, 62 nt, Human
cagcaaggcaguccccccacgcccgagaaagccugggggacccagacaccuguccccacagu

SEQ ID NO: 399827 - RNA, 62 nt, Human
cauuuggguucaggcgcacuucaaaacccucccugggggaggcuguuucuucucaggauucc

SEQ ID NO: 399828 - RNA, 62 nt, Human
cuggccuccaggugugcagcaggggcugugugcugggggagguuccaguuaggcgaugggau

SEQ ID NO: 399829 - RNA, 62 nt, Human
cgugcucugucggcccgagacauuuggaaguccugggggaugcuggcaaaucucagcuguug

SEQ ID NO: 399830 - RNA, 62 nt, Human
ugcccuuugguucauuuuucugcuucucuuggcugggggacucuggugccagccuugaaagu

SEQ ID NO: 399831 - RNA, 62 nt, Human
ggguuguggggccugaaccccggccucccacccugggggaggcccucugugaaugggucucu

SEQ ID NO: 399832 - RNA, 62 nt, Human
cgggguuugaaggcagggccccugccacccuccugggggacacccgugcauguuuacgccuu

SEQ ID NO: 399833 - RNA, 62 nt, Human
ggccuuccugccacugcagagugggaagcuuccugggggaccucagccagcuccggggcucu

SEQ ID NO: 399834 - RNA, 62 nt, Human
cugcuuccaggagccuagagugggaaaggcaccugggggagcccuggugaagggcuggaccu

SEQ ID NO: 399835 - RNA, 62 nt, Human
ggggcgucugcugugccccgccaaucacgagacugggggaccggccgggccuggcaccaauc

SEQ ID NO: 399836 - RNA, 62 nt, Human
uagagaaaggucacuggcccgggcuugggagccugggggaugcagcucucucugugggcuuc

SEQ ID NO: 399837 - RNA, 62 nt, Human
cuucuagagaaaggccuggugcaggcggcuugcugggggaugugagcgcucaggacgugaug

SEQ ID NO: 399838 - RNA, 62 nt, Human
acuugacaccacuaagaugauuuuuuaaggagcugggggaaggcaggagccuuccuuucucc

SEQ ID NO: 399839 - RNA, 62 nt, Human
ccuggccugccagacacugcgccccgccugaccugggggagccgaccaauuagucacugcug

SEQ ID NO: 399840 - RNA, 62 nt, Human
uagcccaaggaggcaccacaggucuaugugugcugggggaugucaggugccacccaacgcug

SEQ ID NO: 399841 - RNA, 62 nt, Human
gcugccugcacuggaacccacagaccucacaccugggggacagaggcagauaagaaggugcg

SEQ ID NO: 399842 - RNA, 62 nt, Human
aucuuugagaccaaaacagaugcuccuguuugcugggggagggugugagcacggaguauuuc

SEQ ID NO: 399843 - RNA, 62 nt, Human
aagaaucccugcagccugguagaauugggaagcugggggaaggguggucugagcacccccuc

SEQ ID NO: 399844 - RNA, 62 nt, Human
accuuccagagaggacagacacagauuuccugcugggggagggaggaguccacgcauccuga

SEQ ID NO: 399845 - RNA, 62 nt, Human
gaugcccucagaauuggggcaugggaggggggcugggggaccccaugauucagccacggacu

SEQ ID NO: 399846 - RNA, 62 nt, Human
aauauccuucaaguuccacuucccagggagcucugggggaggggcggccauucuggcuccgu

SEQ ID NO: 399847 - RNA, 62 nt, Human
aguggucuggcuggaacuccaaguggcuuagucugggggaucaggaggugggagguggaugg

SEQ ID NO: 399848 - RNA, 62 nt, Human
ucacuaggugacagcggccaccaggcucugugcugggggacgauacuggcccuggccucgac

SEQ ID NO: 399849 - RNA, 62 nt, Human
aggugaguguuuucuucaggcagcugaggguccugggggagcugaggcucugugcugcaccc

SEQ ID NO: 399850 - RNA, 62 nt, Human
cccugggaacugggggugcgggaguucucccucugggggacagaaaaucugacuacuaggaa

SEQ ID NO: 399851 - RNA, 62 nt, Human
ugugcagaaggcuacugccccuuaggccucagcugggggaaaggcaguucuggugcuguaga

SEQ ID NO: 399852 - RNA, 62 nt, Human
gguucaggcaguuccugucaucucugaaaagacugggggauaugaaaucuucccccuacccc

SEQ ID NO: 399853 - RNA, 62 nt, Human
ucagguagcccagacuggugauggagcagagucugggggaagggucguggguggggaauuua

SEQ ID NO: 399854 - RNA, 62 nt, Human
uuucucucuggauggaacgggcaugggccucucugggggaggcagggcuggaaugggagacc

SEQ ID NO: 399855 - RNA, 62 nt, Human
cucccaggcugucccccuccucccagggccuccugggggaccuuuguauuaagccaauuaaa

SEQ ID NO: 399856 - RNA, 62 nt, Human
ugaacuugcuauggaaaggacagugugggaggcugggggagcuguguccugcaguucccagg

SEQ ID NO: 399857 - RNA, 62 nt, Human
caccuugaccguaggggaaggaggaaugugggcugggggaagaugcccucaacucacccccu

SEQ ID NO: 399858 - RNA, 62 nt, Human
ccugcccucccgggcaguacuggggaccuucccugggggacggggagggaggaggcagcgac

SEQ ID NO: 399859 - RNA, 62 nt, Human
aggggggucuccccucaccccugcacccccagcugggggagcuggcucugccccgaccuccu

SEQ ID NO: 399860 - RNA, 62 nt, Human
agagggagaaggagaggcucugaaagcugcuucugggggauuucaagggacugggggugcca

SEQ ID NO: 399861 - RNA, 62 nt, Human
ucccgggucugucucucucacucucgcucucacugggggagggaaagaauggcuuugguggc

SEQ ID NO: 399862 - RNA, 62 nt, Human
gaugucugggccacucaggggucauucauggccugggggauguaccagcaucucccaguuca

SEQ ID NO: 399863 - RNA, 62 nt, Human
ggccagccuagggcucauggcaugggcccccacugggggagggaggcaucuuguuucuugug

SEQ ID NO: 399864 - RNA, 62 nt, Human
uuugauggaauugauuuucccugaguggagugcugggggaaggaggagguccaggccgguag

SEQ ID NO: 399865 - RNA, 62 nt, Human
uggcugagauuggggcagcggcucagcagucccugggggaagccauugacguguaccaggcg

SEQ ID NO: 399866 - RNA, 62 nt, Human
ccccagcuucgcacaggcuccuggagggcugccugggggaggcagacaugggagugccaagg

SEQ ID NO: 399867 - RNA, 62 nt, Human
gcuaagggcgaggcccuucccuucagaggcuccugggggauuagggugugguguuugccaag

SEQ ID NO: 399868 - RNA, 62 nt, Human
guccccccaccguggugccccucaccauccuccugggggagcaggggguggguucucccuga

SEQ ID NO: 399869 - RNA, 62 nt, Human
ggaaauggaugauuucucuuuuccauaugucacugggggaaaggcugccuguaccucucaag

SEQ ID NO: 399870 - RNA, 62 nt, Human
acaucuacaacuccaagauugccgggaagcuccugggggaugcucuaaagcugggcucaagc

SEQ ID NO: 399871 - RNA, 62 nt, Human
cuguggaacugccgcagccacgcaggaggucccugggggaugcuuugggaaguccuugcccc

SEQ ID NO: 399872 - RNA, 62 nt, Human
agcucugcaguggggggcugguggcuccggggcugggggaucacaggcuggugaaccccggu

SEQ ID NO: 399873 - RNA, 62 nt, Human
guuccaggcuccuguucucuggacuucagauccugggggagccccuccccccccugaauccc

SEQ ID NO: 399874 - RNA, 62 nt, Human
gcagcucccugcccuccgugugugucuguuaucugggggagaggaguguggaaggguugggg

SEQ ID NO: 399875 - RNA, 62 nt, Human
ggcuggguucccagucggagccuuucggggaucugggggaugagggcggaaggccuagcucc

SEQ ID NO: 399876 - RNA, 62 nt, Human
agugcacgcaagcagggacauuuccuagccagcugggggacacuggaaauucgggaaaccaa

SEQ ID NO: 399877 - RNA, 62 nt, Human
ugcucugggcagggugugcgggccgggcccggcugggggagggcagcucugggcacgccgca

SEQ ID NO: 399878 - RNA, 62 nt, Human
agcucugggcacgccgcacccacgccccccaccugggggaaacaggcgguuccugcccgguu

SEQ ID NO: 399879 - RNA, 62 nt, Human
ccucgggcaccugggcccccccgcuuggcucccugggggaauggcccaggcgggccgcgguu

SEQ ID NO: 399880 - RNA, 62 nt, Human
ggagcuaccguguccaggaugaagcugcaggucugggggacacugaccagcuugggcuccac

SEQ ID NO: 399881 - RNA, 62 nt, Human
ugcggccccaggggccucccuccuguugaagacugggggagagcaguggguucugggggggc

SEQ ID NO: 399882 - RNA, 62 nt, Human
agugugcgggggacggagguaagcuggauauccugggggaggaggggaaugcgcucuggaaa

SEQ ID NO: 399883 - RNA, 62 nt, Human
ggaggagggcuuguuuggagaagggaggcuggcugggggagaaacccggaucccgcugcauc

SEQ ID NO: 399884 - RNA, 62 nt, Human
aaggccugccuggcucugucugaacagaaggucugggggaagcgacggguggaguacaauaa

SEQ ID NO: 399885 - RNA, 62 nt, Human
cucuucgugccuggucugggacugggucagcccugggggaucagaaggggccaucugggccc

SEQ ID NO: 399886 - RNA, 62 nt, Human
gaaugcagcccccugaagacagcacuacaagucugggggagccaguuuuaacaucagugcac

SEQ ID NO: 399887 - RNA, 62 nt, Human
acagguuuccaggagaugguagacauugggaccugggggaccucagagcagagugccacauu

SEQ ID NO: 399888 - RNA, 62 nt, Human
guguuccggcaaagacagagccagcagcugcgcugggggagggaagcgugccuccccacccc

SEQ ID NO: 399889 - RNA, 62 nt, Human
aguaauguuuggugucuguuucuuaggagugacugggggagggaagauuauuuuagcuauuu

SEQ ID NO: 399890 - RNA, 62 nt, Human
acccccccauuucccgcacaugguguggggggcugggggagguccaagcagaguguuuuauu

SEQ ID NO: 399891 - RNA, 62 nt, Human
cacugagcucuucuucauucucacccugaucccugggggacucaaagccaaaacugcccaaa

SEQ ID NO: 399892 - RNA, 62 nt, Human
agaguguggguucuaaguacaggcauucaaggcugggggaaggaaagcuacgccauccuucc

SEQ ID NO: 399893 - RNA, 62 nt, Human
cccaaccacagagaacaagaguuuguucuguucugggggacagagaaggcgcuucccaacuu

SEQ ID NO: 399894 - RNA, 62 nt, Human
gcuauagggucacuugccauuuccuaccuucucugggggauuugaggguagaggcaggggaa

SEQ ID NO: 399895 - RNA, 62 nt, Human
auagugugcuuguguguuuguuuuagauccuccugggggauggggauggggccaggcucagu

SEQ ID NO: 399896 - RNA, 62 nt, Human
gcccgcuccugcccgcccagcacccccaggcccugggggaccugggguucucagacugccaa

SEQ ID NO: 399897 - RNA, 54 nt, Human
cuggaaccccacuggcuuagagggcugggggagagaaacacugcugcccucuuu

SEQ ID NO: 399898 - RNA, 62 nt, Human
cuccucugggcccugucgccccuccuuuuggccugggggaggucagaacauucgaaucucug

SEQ ID NO: 399899 - RNA, 62 nt, Human
ccaucaaggcccugugcugcaacagagccccucugggggacuggaaugaccuccugaccacu

SEQ ID NO: 399900 - RNA, 62 nt, Human
ccuugcgugcuuuucuggguuuugaggggugucugggggaagcgguaaugguggcugugcau

SEQ ID NO: 399901 - RNA, 62 nt, Human
guuaacccucuagcugauaaugcaaacacuaacugggggauuuuauuuauaagggcucuaga

SEQ ID NO: 399902 - RNA, 62 nt, Human
ccuggcuuaaaagcaggauugaagaaaagggacugggggaaggaaacuuauuggaaaacuug

SEQ ID NO: 399903 - RNA, 62 nt, Human
gagcagcagcagcaggauggugaaguaguaaacugggggaggcagggcacagggagaugcuc

SEQ ID NO: 399904 - RNA, 62 nt, Human
ggaccuuucccucccaggaguccccuagguggcugggggaggcaggcucacuggccauuuuc

SEQ ID NO: 399905 - RNA, 62 nt, Human
uguggauggggcggagcagggcagaagauggacugggggagggggcagagagaggagaccaa

SEQ ID NO: 399906 - RNA, 62 nt, Human
ggcagagcgaaguucugggugggaugaccgcacugggggaggggccucaguccagaaaccuc

SEQ ID NO: 399907 - RNA, 62 nt, Human
acaugugugugucuacgugugugcgugcguggcugggggaggccuuuucuuugaggacguac

SEQ ID NO: 399908 - RNA, 62 nt, Human
uguguauaugcauggggaaaggcaccuggggccugggggaggcuauaggauauaagcauuag

SEQ ID NO: 399909 - RNA, 62 nt, Human
ugauuuagaaauaacauuuaaaugccaaguaucugggggauugaaggaagggucuauaugag

SEQ ID NO: 399910 - RNA, 62 nt, Human
agggcacuguguccggcggagccaaguccacucugggggagcucuggcggggaccacgggcc

SEQ ID NO: 399911 - RNA, 62 nt, Human
ccugugugggcccaaccaguggacaauggagucugggggagggggaaccccggggacaugcc

SEQ ID NO: 399912 - RNA, 62 nt, Human
aggugacggcgcccgccgcagguggggcgaggcugggggagggcggcgccgcggcgggccug

SEQ ID NO: 399913 - RNA, 62 nt, Human
gacggggaggggccaggacccacccacugcuccugggggaugagguccugguuuuaaagccc

SEQ ID NO: 399914 - RNA, 62 nt, Human
ggcaaccguugcuguucacacgcucagccugucugggggagcgggccucuagcuucagccag

SEQ ID NO: 399915 - RNA, 62 nt, Human
cccccacccccuucaguguuaaguggggagcccugggggagucucuccugccucccagccuc

SEQ ID NO: 399916 - RNA, 62 nt, Human
agugagccuugaucgugccacugcacuccagccugggggacagagcacgacccugucuccaa

SEQ ID NO: 399917 - RNA, 62 nt, Human
cuccuggcgauacugacuagaaagucagggagcugggggagcuguucacuuuaggauacggg

SEQ ID NO: 399918 - RNA, 62 nt, Human
aacgcaaaccaaagcaggcaggcagacagcugcugggggaaauccugggguccuugagacag

SEQ ID NO: 399919 - RNA, 62 nt, Human
gcagaccugaggcgaggccaccccccuccauccugggggaagcgcccgcgaaaaccguggag

SEQ ID NO: 399920 - RNA, 62 nt, Human
gcugaggcucagccccucaacccgguggcauucugggggaggaguggggcccacagcucucc

SEQ ID NO: 399921 - RNA, 62 nt, Human
gccucuaaucccagcacuuugggaggcugaggcugggggaucaccugaggucaggaguucga

SEQ ID NO: 399922 - RNA, 62 nt, Human
agugagcugagguggugccacuacgcuccagccugggggagggggacauagcgagacucggu

SEQ ID NO: 399923 - RNA, 62 nt, Human
ggugccgccucauaggcagacgaggaucaucgcugggggaccuuucccgugggcuuucuucc

SEQ ID NO: 399924 - RNA, 62 nt, Human
ccuuaguccccaagccccucccccuaaggcagcugggggagaggugaccuaguacuggaaaa

SEQ ID NO: 399925 - RNA, 62 nt, Human
cucccuggugcucauuggaaucugaguagagucugggggaggguccccaccuuccuguaccu

SEQ ID NO: 399926 - RNA, 62 nt, Human
agaggcuuuggaguucaaucuugaaggggugucugggggaacuuuacuguugcaaguuguaa

SEQ ID NO: 399927 - RNA, 62 nt, Human
gccugacgcuguggccccgggacccagcagagcugggggagggaucagcccccaaagaaaug

SEQ ID NO: 399928 - RNA, 62 nt, Human
cagcugccaugaugccuugggaugcccugguccugggggacucaggugccucccugauuccu

SEQ ID NO: 399929 - RNA, 62 nt, Human
gggagagcugcugagccuaaagacuggagaaucugggggacugggagugggggucagagagg

SEQ ID NO: 399930 - RNA, 62 nt, Human
uggacaggggccugggcuuucuuccaagggcacugggggagccauggcaagguuguagguag

SEQ ID NO: 399931 - RNA, 62 nt, Human
acagaggaagacaacauaugucacuggggaggcugggggagcuagacaaaauucacacggga

SEQ ID NO: 399932 - RNA, 62 nt, Human
cuccccaccucccucccccgucagugggaugacugggggaggguugcugcagggaagaggag

SEQ ID NO: 399933 - RNA, 62 nt, Human
gagcacacccgaggcucccaccugcggagccgcugggggaccucacgucccagccaggaucc

SEQ ID NO: 399934 - RNA, 62 nt, Human
cacgguuuggggacuugggguguucccaagaccugggggacgacagacaucacgggaggaag

SEQ ID NO: 399935 - RNA, 56 nt, Human
accgccgggacuucugguagaggcggcugggggagggugggggcagggcuggcugg

SEQ ID NO: 399936 - RNA, 62 nt, Human
gaggacccugggccccaggccagcucccaucgcugggggacggugaacggccauguguuaau

SEQ ID NO: 399937 - RNA, 62 nt, Human
uccugucccucacauuugaucacugugaccuucugggggaggggggaguugaaaaugcacau

SEQ ID NO: 399938 - RNA, 62 nt, Human
agugagccaagaucgcgccauugcacuccagccugggggacaagagugagacuuagucucaa

SEQ ID NO: 399939 - RNA, 62 nt, Human
gugugugaccaucagcaguggugugcacauggcugggggacacucgguuugaccgccagcgg

SEQ ID NO: 399940 - RNA, 62 nt, Human
cucaaaggcaagcgagcucucccucugcuucccugggggagccccgacggccacaggacucc

SEQ ID NO: 399941 - RNA, 62 nt, Human
cccaaauaucaaacacggacccauagacagcccugggggagccucuuacggaaaauccgaca

SEQ ID NO: 399942 - RNA, 62 nt, Human
gcugaggagggugcugggaacggcaaggcggucugggggauggggaggggcaaaggugagag

SEQ ID NO: 399943 - RNA, 62 nt, Human
gggaaugggggcuuugggucaucucccacugccugggggagucagauggggugcaggaaucu

SEQ ID NO: 399944 - RNA, 62 nt, Human
cuuuccuuuugguuuugggauuacuuuugauccugggggaccaaugaggugagggggguucu

SEQ ID NO: 399945 - RNA, 62 nt, Human
auacuugccaaaaugagacucuccgucggcagcugggggaagggucugagacucccuuuccu

SEQ ID NO: 399946 - RNA, 62 nt, Human
gugugacuucuuaucaccuggauucagagagucugggggacaggaauccugauuuuuuuuuu

SEQ ID NO: 399947 - RNA, 62 nt, Human
agggcaguagggauuggguugggggaagauaacugggggaaggccagggccccuaggcuaca

SEQ ID NO: 399948 - RNA, 62 nt, Human
agggggaaagggggugggacagggacucggggcugggggacggggcggggcuugaccugcgg

SEQ ID NO: 399949 - RNA, 51 nt, Human
cagaauccagaaagguuugaucugggggaccacccauacugaggaguugaa

SEQ ID NO: 399950 - RNA, 62 nt, Human
cccaugucccagagccucagaacccacccucccugggggacccucgaaggaggcugucagag

SEQ ID NO: 399951 - RNA, 62 nt, Human
ggcucccccucgaggcgaggggccaugcaugucugggggaccccugccccccaaaacccucu

SEQ ID NO: 399952 - RNA, 62 nt, Human
gggcagaggcgcagaauccugugagggugacucugggggaccccuggucugugggggcaucc

SEQ ID NO: 399953 - RNA, 62 nt, Human
guucaguccuggcuggaggagccacagccugucugggggaaaggacaagucagggaccacuu

SEQ ID NO: 399954 - RNA, 58 nt, Human
uggaguuacaggcaaagugaggagggagcugggggacacuuucgagcucccagcucca

SEQ ID NO: 399955 - RNA, 62 nt, Human
ggggccaccaaaaacccacaaaggccccggagcugggggaccacaaacaaacaggguccuua

SEQ ID NO: 399956 - RNA, 62 nt, Human
cugcccagagaacucacaacccccucucugaccugggggacaaugcaaacaggucacagugc

SEQ ID NO: 399957 - RNA, 62 nt, Human
aaacugcaggagcucagcauagacccagcucucugggggauggucaccuggugauuucaaug

SEQ ID NO: 399958 - RNA, 62 nt, Human
gaaacgcuccuuugugugugugucagcugaggcugggggagagccguggucccugaggaugg

SEQ ID NO: 399959 - RNA, 62 nt, Human
ggaauagcaaagagugcaaacuugggguaugacugggggagaguggaacaugccuuuuccgc

SEQ ID NO: 399960 - RNA, 62 nt, Human
ugcgcccugcacuccccgaacccgaguccgcgcugggggagccucgcccccgcccccaccgg

SEQ ID NO: 399961 - RNA, 62 nt, Human
ccugauggccugagcaucccccagauccaagccugggggaucccgggaaagcgauggacaga

SEQ ID NO: 399962 - RNA, 62 nt, Human
caguaaauaccuggaagagggaaccugaaucccugggggagacagaaggggcaggggccacc

SEQ ID NO: 399963 - RNA, 62 nt, Human
auucuuucauucccugaccagugagaggguuccugggggaaguauggugaauaaacugacau

SEQ ID NO: 399964 - RNA, 62 nt, Human
guuuuguagauuucagaugacuaugcagaggccugggggaccccuggcucugggccgggccu

SEQ ID NO: 399965 - RNA, 62 nt, Human
auggauaaacugagccucacuugcccucgugccugggggagagaggcagcaagucuuaacaa

SEQ ID NO: 399966 - RNA, 62 nt, Human
caguggaagagacaucccuugacuuuuguggccugggggagggguagugcuccacagcuuuu

SEQ ID NO: 399967 - RNA, 62 nt, Human
uucuguggagggagggcagcuggcccccagcccugggggauuccugagcuggccugucugcg

SEQ ID NO: 399968 - RNA, 62 nt, Human
cuccaccgcacagacugggaaccccuccuggccugggggaagaguuuguuaccuaccuuacu

SEQ ID NO: 399969 - RNA, 62 nt, Human
agaacccaucuggccagagaagcagcagcauccugggggauggccgugcaugggguguacac

SEQ ID NO: 399970 - RNA, 62 nt, Human
gugcucccaccccuggacugguggcccccacccugggggaggucuccucaugcgccugcacc

SEQ ID NO: 399971 - RNA, 62 nt, Human
auggucugcccugggcaagauggaggugggggcugggggaauaugcauguugcagaagccgg

SEQ ID NO: 399972 - RNA, 62 nt, Human
ugcugcagccaccuggugccuuaguccuugggcugggggagggggcccacccuuaaaggcgg

SEQ ID NO: 399973 - RNA, 62 nt, Human
gccuuccacgccccccaggacgggcccagaggcugggggagccccgcggcggccugaacccu

SEQ ID NO: 399974 - RNA, 62 nt, Human
gacucagccaagacaaggagguagagaggggacugggggacugggagucagagcccuggcug

SEQ ID NO: 399975 - RNA, 62 nt, Human
aagaaaugugaaaaggcauugggagaagcagucugggggaggccagcccagugcgggcacag

SEQ ID NO: 399976 - RNA, 62 nt, Human
caaagaaaaaucccccuuauuuagaaauguuccugggggaugaagaaaccauaauuacuuga

SEQ ID NO: 399977 - RNA, 62 nt, Human
ucuauaaaccagugacuucucugggccugggucugggggagaggguugccagggagacucag

SEQ ID NO: 399978 - RNA, 62 nt, Human
agucgggaaggggcgggucacucaauccuggccugggggagaaugcuggagggagcacgccg

SEQ ID NO: 399979 - RNA, 62 nt, Human
aaaagggaccccauauguagcaaaaaucagggcugggggagagccggguucauucccugucc

SEQ ID NO: 399980 - RNA, 62 nt, Human
agucuuccagcugccaccacggcugggacacgcugggggagggcuccucccaugccuccugc

SEQ ID NO: 399981 - RNA, 62 nt, Human
aguaaacaucucugccuuugccuguguguguucugggggaggggggacauggaaaaauauug

SEQ ID NO: 399982 - RNA, 62 nt, Human
ugccuuguccccaacguuccacaacagucccgcugggggauugaagcgguuucacuccgcaa

SEQ ID NO: 399983 - RNA, 62 nt, Human
cauaaccccuucugugccuugggaugccggagcugggggaccuggaggcccaucagccggag

SEQ ID NO: 399984 - RNA, 62 nt, Human
uccauguguguccguggguaccguaagggcuacugggggaagaaccuguaagcaggguguga

SEQ ID NO: 399985 - RNA, 62 nt, Human
aaagaggaguaaccaucucugagggugggauucugggggaauuuuuguuuuuuucuguuuuc

SEQ ID NO: 399986 - RNA, 62 nt, Human
uggcucacgggcagagaaggguagcccuggggcugggggagggauuggaagccucccuggag

SEQ ID NO: 399987 - RNA, 62 nt, Human
acaagauacucaccaggaccaggaaggggacucugggggacuggcuuccccugugagcagca

SEQ ID NO: 399988 - RNA, 62 nt, Human
ucccugucccucaggguagcaccauggcaggacugggggaacuggaguguccuugcuguauc

SEQ ID NO: 399989 - RNA, 62 nt, Human
gcuucgcaagcccccucauuagcagggcuuaucugggggagcugcugauggaguccucgcug

SEQ ID NO: 399990 - RNA, 62 nt, Human
uuugaaguuugcuuuggcuaaauuuugacacccugggggauguccugggagaaugccaguac

SEQ ID NO: 399991 - RNA, 62 nt, Human
acaagauacucaccaggaccaggaaggggacucugggggaccggcuuccccugugagcagca

SEQ ID NO: 399992 - RNA, 62 nt, Human
cugcugauuuucuaugucuuugcuccauacugcugggggaugggagagccacaguguguuuc

SEQ ID NO: 399993 - RNA, 62 nt, Human
cugugcgucugugucuuugugccuguaucucgcugggggacuucacaggaagcaggauuugg

SEQ ID NO: 399994 - RNA, 62 nt, Human
acagggcacaggcagggacagaaagccuucuccugggggagggugggaagccaggguguccu

SEQ ID NO: 399995 - RNA, 62 nt, Human
gucuuggccauggggaagcacuauggccucagcugggggaaagacccuggccuaggggucuu

SEQ ID NO: 399996 - RNA, 53 nt, Human
agcccagcaagggucuuugagaccugggggaucucaggagccaccugggaugg

SEQ ID NO: 399997 - RNA, 62 nt, Human
cugaaacaaacagucacaagcaaaggaagaggcugggggacuagaaagaggcccugcccucu

SEQ ID NO: 399998 - RNA, 62 nt, Human
uguggcuggggguguggaggcagugggaugaacugggggacaggucugcgcugcagugggau

SEQ ID NO: 399999 - RNA, 62 nt, Human
cugaggguagcaagcagggguugugagucaggcugggggacuuguuugaaagaaagaggagu

SEQ ID NO: 400000 - RNA, 62 nt, Human
ugugaggugugggaggugggaagggugagggucugggggaaugcggagaaaagggaggcuug

SEQ ID NO: 400001 - RNA, 62 nt, Human
uuuaugcuggaaauaugacccugugcagacugcugggggaggcaggaggaugccugccugga

SEQ ID NO: 400002 - RNA, 62 nt, Human
uuuuugcuuccucaguuuuuaucaggcuuucucugggggacagcagucucugagcaccaggg

SEQ ID NO: 400003 - RNA, 62 nt, Human
caaaacaaagcuguuugccucacucaggagaucugggggagguuucauuuaaaagugcuggg

SEQ ID NO: 400004 - RNA, 62 nt, Human
guggccaagaugaugccaggcugcccuauacacugggggauucugcccuggcccaugcacac

SEQ ID NO: 400005 - RNA, 62 nt, Human
aaggagccuaaacacccugaaauugugacccccugggggacagcugccagacacagcuggcg

SEQ ID NO: 400006 - RNA, 62 nt, Human
ucugcccauccucccagcuccugugucagagccugggggacgagucacccagcucaccccca

SEQ ID NO: 400007 - RNA, 62 nt, Human
gcagcaccuccgggacugaccuucggcaguggcugggggacugcuuucagugccugcuguuc

SEQ ID NO: 400008 - RNA, 62 nt, Human
gccuaggcagcucugcaagccucucugcauggcugggggagucagggcagagcuuacuuuaa

SEQ ID NO: 400009 - RNA, 62 nt, Human
agugagcuaagaucaugccaucgcacuccagccugggggacaaaagugagacaucgucucaa

SEQ ID NO: 400010 - RNA, 62 nt, Human
acugagggcgugcaaaguugaaaguggcaaggcugggggagggugucggguagagggaagag

SEQ ID NO: 400011 - RNA, 62 nt, Human
caccaugaguccuguguccaggccggacauggcugggggaccaacuacucuggcaggaucug

SEQ ID NO: 400012 - RNA, 62 nt, Human
aggaagggaaugcgccugcguguguauacccacugggggaauucuccggccguggggucccc

SEQ ID NO: 400013 - RNA, 62 nt, Human
ugggggguggggccuccuucagcccccuccuccugggggaugcuccccaggguuagggugcu

SEQ ID NO: 400014 - RNA, 62 nt, Human
agaaggugcauguccgggcucucgggggcccccugggggaccugggcccugcccuuggcuca

SEQ ID NO: 400015 - RNA, 62 nt, Human
agaauuaccaaaguguaucuggugcugaaugacugggggacaagcagaaguggaagagaucu

SEQ ID NO: 400016 - RNA, 62 nt, Human
gacagaaaauuaacugaaaagcaguuuagagacugggggaggccggaucucuagagccaucc

SEQ ID NO: 400017 - RNA, 62 nt, Human
gaccuucuggaggaagguggggguuucaaagacugggggaccccuuccuccugacuccagca

SEQ ID NO: 400018 - RNA, 62 nt, Human
ugguuuguucucuguggggcaguuggugggggcugggggaagaggcuggcagaaguuacccu

SEQ ID NO: 400019 - RNA, 62 nt, Human
agguggcucaugggcuguagugagccagcucccugggggaaaaggcugugggccguuaggac

SEQ ID NO: 400020 - RNA, 62 nt, Human
gcagggugggagcaggggcuggcgugggaggucugggggacagacaaggaugauggaccccu

SEQ ID NO: 400021 - RNA, 62 nt, Human
gagaggaggcuguugguaggaaaguggcagggcugggggagacccagccccaaggguccggg

SEQ ID NO: 400022 - RNA, 62 nt, Human
guuaagugcaaaaugacugauguuaaaaccaucugggggaaaucuugggaugcuuuuuccua

SEQ ID NO: 400023 - RNA, 62 nt, Human
caacuucgguaaugaggaagaaggagaaagagcugggggaagggcagaagacugguuuagga

SEQ ID NO: 400024 - RNA, 55 nt, Human
cugaggaagaugacgaguaacuccccugggggauacgacacaugcccuugaugag

SEQ ID NO: 400025 - RNA, 62 nt, Human
agagacccugaggaagaugaugaguaacuccccugggggauaugacacaugcccaugaugag

SEQ ID NO: 400026 - RNA, 62 nt, Human
gccuuaaagucaguaacuuacccuuagggaggcugggggaaaagguuagauuuuguauucag

SEQ ID NO: 400027 - RNA, 62 nt, Human
ccuuuggaaccucuccauauacuuucuaagcucugggggaggaggaggaugggaccuccugg

SEQ ID NO: 400028 - RNA, 62 nt, Human
auuucuuuaucauuccaguggguaggguuuagcugggggaaggacauuucauaaggguuagu

SEQ ID NO: 400029 - RNA, 62 nt, Human
aguaaaccaguuuuucuagggauggcccuuggcugggggaugacagugugggagcugugggg

SEQ ID NO: 400030 - RNA, 62 nt, Human
guuucuauacuuuuaagaagagcucuuuguuccugggggaggggggcagggggugaauuuua

SEQ ID NO: 400031 - RNA, 62 nt, Human
gccugccuuucccugacacuuuuggggucugccugggggaggaggggagaaagcaccaugag

SEQ ID NO: 400032 - RNA, 62 nt, Human
gcugccccagccccucccagcccuugcccagccugggggaguggggaaggcuugggcauggc

SEQ ID NO: 400033 - RNA, 62 nt, Human
ccgcccccagcccacucucaugguccacacugcugggggaaagggaaaggaaaucagcaacu

SEQ ID NO: 400034 - RNA, 62 nt, Human
cccugccagcgggcgagcaggacaguccgcgccugggggacgcuggcuggcucgacuggcag

SEQ ID NO: 400035 - RNA, 62 nt, Human
ucaugguauccugguuauuuuuuuuaagucaucugggggaaaaccuguuuaucacuccagug

SEQ ID NO: 400036 - RNA, 62 nt, Human
auuaccuaagagccacaauaagccacugguaucugggggacuagaacacaaauccaacgcuu

SEQ ID NO: 400037 - RNA, 62 nt, Human
agucuacugaugggagcaacaguuauggcaugcugggggaagagaagggacuuuuccuugug

SEQ ID NO: 400038 - RNA, 62 nt, Human
ugcuuaccugccucagcccaggauucuuuauucugggggagguaaugcccuguuguuacccc

SEQ ID NO: 400039 - RNA, 62 nt, Human
acccucccaugagacugcccugcccagguauccugggggaagaggagaugugaucaggcccc

SEQ ID NO: 400040 - RNA, 62 nt, Human
cauuccagagacaaggccaguguauaugcaaacugggggacucuccucccuucucuccccag

SEQ ID NO: 400041 - RNA, 62 nt, Human
caacugagugguacagauaugacauggaagaucugggggaggaaguucaaggaaggcaccac

SEQ ID NO: 400042 - RNA, 62 nt, Human
gacacccugaggcuugcugggagugggguggccugggggacccuagacagccgggaaggcug

SEQ ID NO: 400043 - RNA, 62 nt, Human
gugcagcauggaacucaggccaggcuccgaggcugggggaucugcuuggaguuuucugcccc

SEQ ID NO: 400044 - RNA, 64 nt, Human
auuuccuucguggaaaggauuuagauuguaacccgcacacaaaagcacgguguuugugaauaua

SEQ ID NO: 400045 - RNA, 64 nt, Human
ggcucagccuugccgugugcugcuucucaucacugcacacaagugccaugcuuugccaccacca

SEQ ID NO: 400046 - RNA, 64 nt, Human
uuauuaaauguugauugauggcuuguaauguacugcacacaauauauguuaacucugcagaaug

SEQ ID NO: 400047 - RNA, 64 nt, Human
ggcagggaaggcucugggggucggagacaccgcugcuuagcacccccagccagaacacccugag

SEQ ID NO: 400048 - RNA, 64 nt, Human
aaaauuuuuuucccuuucagucauugucuuauaugcuuagcauagauuugcagcucaguaguau

SEQ ID NO: 400049 - RNA, 64 nt, Human
ccaucccuggcuguccugaguggugagcaucuuagcuuagcaccaaccaacacagucucaccua

SEQ ID NO: 400050 - RNA, 64 nt, Human
cuugucccaugggcggguggugggccaaggaggagcuuagcaagucugcagcccagccccaccu

SEQ ID NO: 400051 - RNA, 64 nt, Human
cagcguggauuuuacuuaucuguguauucacagagcuuagcacagugccugguaaugagcaagc

SEQ ID NO: 400052 - RNA, 64 nt, Human
aacucuuccuguuucuguccaucuuguuccuguggcuuagcacauacagaccucagaucuuacu

SEQ ID NO: 400053 - RNA, 64 nt, Human
gaaguuuuuucauuuuguuagccgacuucugguagcuuagcaaagagaccagcugacugucucu

SEQ ID NO: 400054 - RNA, 64 nt, Human
ggcagagggaggaaggcagagcaaguggagcagggcuuagcaggagcaguuucuggccagaagc

SEQ ID NO: 400055 - RNA, 64 nt, Human
uaaaacacuaauguuuuaagagcuuuaguauuuugcuuagcauucaauacuagcagauucauaa

SEQ ID NO: 400056 - RNA, 64 nt, Human
cuucccacuccccugcuccacaugagccaugcaugcuuagcaauccaagugcagagcucuuugc

SEQ ID NO: 400057 - RNA, 64 nt, Human
cggggggccccacgaguuccuggcauucagcacugcuuagcauucucggaagguuucuucaacu

SEQ ID NO: 400058 - RNA, 64 nt, Human
cuuggcuuuaaagugaggggugacccuuuagugagcuuagcacagcgggauuaaacaguccuuu

SEQ ID NO: 400059 - RNA, 64 nt, Human
ugcuacuuaaccaucuauuaaugcaccauuaaaggcuuagcauuuaaguagcaacauugcgguu

SEQ ID NO: 400060 - RNA, 64 nt, Human
ggaacagacagaaaaaucuaucauuucaagauaggcuuagcaggaugggcgcaguggcucacgc

SEQ ID NO: 400061 - RNA, 64 nt, Human
gcaauauguauauaauuaagcacuaauuuguacugcuuagcauaaaagaacauccagucuuaga

SEQ ID NO: 400062 - RNA, 64 nt, Human; identical to SEQ ID NO: 75626

SEQ ID NO: 400063 - RNA, 64 nt, Human; identical to SEQ ID NO: 75627

SEQ ID NO: 400064 - RNA, 64 nt, Human; identical to SEQ ID NO: 75630

SEQ ID NO: 400065 - RNA, 64 nt, Human; identical to SEQ ID NO: 75631

SEQ ID NO: 400066 - RNA, 64 nt, Human
ugaaagguagucuuacuucuuuuuaguuuuuauagcuuagcauuagugacuuauuucaaaagac

SEQ ID NO: 400067 - RNA, 64 nt, Human
auagaacucggauucuuuugcaugaugggguaaagcuuagcagagaaucaugggagcuaaccuu

SEQ ID NO: 400068 - RNA, 64 nt, Human
acucuuuuaaauggugcccaacuuuucuaagugagcuuagcaaugagaagaaaaaaaaacauga

SEQ ID NO: 400069 - RNA, 64 nt, Human
gcacccaucucuuaguguugccugagacuaaagugcuuagcacagaaccuggugcguaguagau

SEQ ID NO: 400070 - RNA, 64 nt, Human
ccuuguuuuagcgaacucuagcaaaacuuguuuagcuuagcaaaaacaaacacacaaaaaacug

SEQ ID NO: 400071 - RNA, 64 nt, Human
caauaaagauauuuggccuucuuuggcuuucuuugcuuagcagcgccuagccugugaggaaugg

SEQ ID NO: 400072 - RNA, 64 nt, Human
cuucaguguugauguaaauguguuuuguaguguugcuuagcacuuugcgcauuguguaaguugg

SEQ ID NO: 400073 - RNA, 64 nt, Human
gcauuccagauuuuacugccuuugcuaggcuuuugcuuagcaaagggcugacuuuccauuguua

SEQ ID NO: 400074 - RNA, 64 nt, Human
uuucaugcagugcccugggagucuuaaaagcagugcuuagcaacauuggugauagcauguggcu

SEQ ID NO: 400075 - RNA, 64 nt, Human
auauaaauacgcauauauuguaauuuuaaugucugcuuagcaccccacugauaaccaaaucaca

SEQ ID NO: 400076 - RNA, 64 nt, Human
ugacucaauuucuauugugguaagcucauuggcagcuuagcauuuugcaaaggaauugcuuugc

SEQ ID NO: 400077 - RNA, 64 nt, Human
ccauauaagccuuguucacuguuauaucucuagugcuuagcacaaugccuggcauuucaauaaa

SEQ ID NO: 400078 - RNA, 64 nt, Human
aauuauggaaauauaguucugaugggucccaaaagcuuagcagggugcuaacguaucucuaggc

SEQ ID NO: 400079 - RNA, 64 nt, Human
cgaagauuuuaauuaaggaauugcuuauuguugagcuuagcaaauuaauaacacuauuucuguc

SEQ ID NO: 400080 - RNA, 64 nt, Human
guuugauuuuuacuuuucuuucuaacauaucaaugcuuagcagaacuauucagauugucaguag

SEQ ID NO: 400081 - RNA, 64 nt, Human; identical to SEQ ID NO: 75638

SEQ ID NO: 400082 - RNA, 64 nt, Human; identical to SEQ ID NO: 75639

SEQ ID NO: 400083 - RNA, 64 nt, Human; identical to SEQ ID NO: 75640

SEQ ID NO: 400084 - RNA, 64 nt, Human; identical to SEQ ID NO: 75641

SEQ ID NO: 400085 - RNA, 57 nt, Human
agagcauuaagcuuaaaugaaguuuuugcuuagcauaagguuuuuggcaguuuugga

SEQ ID NO: 400086 - RNA, 64 nt, Human
uauuuccuagaccuuuuaaaagaugugcagagcagcuuagcauucguugcagcugagccuaauu

SEQ ID NO: 400087 - RNA, 64 nt, Human
uaauaauagcuaauaauaccuuguuccaaauacugcuuagcauuuugcauguuuuacuuuuauc

SEQ ID NO: 400088 - RNA, 64 nt, Human
uuugcugacuccuaugagcccauaaggguucugugcuuagcauuaacaaaauaagguuuauagg

SEQ ID NO: 400089 - RNA, 64 nt, Human
cuuguuacugauauugacauaaaauaugaauauggcuuagcaaagagcaacuaauauguuuucu

SEQ ID NO: 400090 - RNA, 64 nt, Human
gaugcacaaaauaagcuggaaaaaucugaggcuggcuuagcaggagcuccagcccgugcuguau

SEQ ID NO: 400091 - RNA, 64 nt, Human
caaggagaaauugaagccauagucgugccuguuugcuuagcauuccuauugacaacucuucugg

SEQ ID NO: 400092 - RNA, 64 nt, Human
gugcugaagguuuccagagaaagcaaauaagugugcuuagcaaaauugcucuaagugaaagaac

SEQ ID NO: 400093 - RNA, 64 nt, Human
uacaguauaaagauaaacagaaaugcugagauaagcuuagcacuugaguuguacaacagaacac

SEQ ID NO: 400094 - RNA, 64 nt, Human
ccccacccgaucauaccuuccccccucugccacagcuuagcaugaaucuucuuuauuguccuga

SEQ ID NO: 400095 - RNA, 64 nt, Human
gccuugccaucaauggaauacugccauuuauauugcuuagcagggcauuugacuacuuuaucug

SEQ ID NO: 400096 - RNA, 64 nt, Human
gaauacuuaauuuuuauccauuuuauggaaauuagcuuagcaauuuuuuuuucucuuuuaagaa

SEQ ID NO: 400097 - RNA, 64 nt, Human
cuauucccaccagaccguuuagccucugcuucaagcuuagcaauauauucaguggcacucuuau

SEQ ID NO: 400098 - RNA, 64 nt, Human
gaugaccaaaccauccuguacuacccaagcaccugcuuagcauguguguguagcugugugugug

SEQ ID NO: 400099 - RNA, 64 nt, Human
caagacugguggucagcggggggacuuccaucgggcuuagcaccugcccuucucacccauggcc

SEQ ID NO: 400100 - RNA, 64 nt, Human; identical to SEQ ID NO: 75642

SEQ ID NO: 400101 - RNA, 64 nt, Human; identical to SEQ ID NO: 75643

SEQ ID NO: 400102 - RNA, 64 nt, Human; identical to SEQ ID NO: 75644

SEQ ID NO: 400103 - RNA, 64 nt, Human; identical to SEQ ID NO: 75645

SEQ ID NO: 400104 - RNA, 64 nt, Human
cuaaauugaccuuuagguauuacacaagaccagugcuuagcaaaaaauaaugacaggcauccaa

SEQ ID NO: 400105 - RNA, 64 nt, Human
gacaguuugauguguccauucugggccucucagugcuuagcaaguagauaauguaagggaugug

SEQ ID NO: 400106 - RNA, 64 nt, Human
gacaucuuacaagagaauuugcacaucucuggaagcuuagcaaucuuauugcacacuguucgcu

SEQ ID NO: 400107 - RNA, 64 nt, Human
gcagugcugugcgcugcucauggagaagaccugggcuuagcaaucuccuuaguucuugcuacac

SEQ ID NO: 400108 - RNA, 64 nt, Human
ucacaaauucaucuuuacagaaaaccagcaucuagcuuagcaucuuuccccuuuuaauuuguag

SEQ ID NO: 400109 - RNA, 64 nt, Human
aguuugacugggagcguguguuucauugcacugggcuuagcauacggcuggcccugguggcugu

SEQ ID NO: 400110 - RNA, 64 nt, Human
aaauauauuccaucuuuuuaacauaaaauguaaagcuuagcacccaucauuaauuuaugucucu

SEQ ID NO: 400111 - RNA, 64 nt, Human
uaccagaggcagagagugcuggucugucugggaagcuuagcaauguaucuucaaauuuauuuuu

SEQ ID NO: 400112 - RNA, 64 nt, Human
acaccuguacauaguguccgcugcccugacucccgcuuagcacacccuuaggcaggcgccccuu

SEQ ID NO: 400113 - RNA, 64 nt, Human
uaacugcacauuuauauauaggauauuggacucugcuuagcauuuucaagccacauagcaugac

SEQ ID NO: 400114 - RNA, 64 nt, Human
caaauuuaugcuauuccuggaaaaauacauuguggcuuagcaaauaagcaaguucccacguuac

SEQ ID NO: 400115 - RNA, 64 nt, Human
uuaaaagauacucuaggaugaucacuugugcuuagcuuagcauuguaacucuuuaagucuauau

SEQ ID NO: 400116 - RNA, 64 nt, Human
gagcauagaaaagcaugcaaggaagaccagaugggcuuagcauugggaagacagagggcaagga

SEQ ID NO: 400117 - RNA, 64 nt, Human
auucaucaccuuuguagcauuugacaaauuuuaugcuuagcagcuucuucacuguuuugaaaua

SEQ ID NO: 400118 - RNA, 64 nt, Human
uguuugucuguugcgcauaauaaugacauaaucugcuuagcagaaaaugacgauuaaucuauag

SEQ ID NO: 400119 - RNA, 64 nt, Human; identical to SEQ ID NO: 75646

SEQ ID NO: 400120 - RNA, 64 nt, Human; identical to SEQ ID NO: 75647

SEQ ID NO: 400121 - RNA, 64 nt, Human; identical to SEQ ID NO: 75648

SEQ ID NO: 400122 - RNA, 64 nt, Human; identical to SEQ ID NO: 75649

SEQ ID NO: 400123 - RNA, 64 nt, Human
ucuauuuuuaccuauuuucuaaauuuauuuaaaugcuuagcaggaagcauaaggaaaagccauc

SEQ ID NO: 400124 - RNA, 64 nt, Human
uucugaugaaaacgaaaacaaaguaaaaugacuggcuuagcagauucuuugaaauguagcagcc

SEQ ID NO: 400125 - RNA, 64 nt, Human
cuaguugcuccaauaugaggcagcuucaugugcagcuuagcacuuguuguugagaucggacccu

SEQ ID NO: 400126 - RNA, 64 nt, Human
gcucucauuguauugaaggcugugcccuuggugugcuuagcagugagcagcgucuucauuaggu

SEQ ID NO: 400127 - RNA, 64 nt, Human
gugucauggcaugagggggaauugacgagugcuugcuuagcaucagcucucauuguauugaagg

SEQ ID NO: 400128 - RNA, 64 nt, Human
aaaagaaaugauguggaccuugcuggaaacaaaggcuuagcaaacaauuuuuguucaaugccca

SEQ ID NO: 400129 - RNA, 64 nt, Human
guuaagaugcgugggcagggcaccuugaacucuggcuuagcaagcaucuaggcugccucuucac

SEQ ID NO: 400130 - RNA, 64 nt, Human
aagagacaggugacaucuaagggaaaugaagagugcuuagcauguguggaauguuuuccauauu

SEQ ID NO: 400131 - RNA, 64 nt, Human
cccucaaugaggaccaaauaaagaugauuuuugugcuuagcaguuuaagguauauggcugcaua

SEQ ID NO: 400132 - RNA, 64 nt, Human
ggaguggcauuuuagaugcccucacgaauaugaagcuuagcacagcucuaguuacauucuuaug

SEQ ID NO: 400133 - RNA, 64 nt, Human
acacuggcgaccugacuagcagcccucucucucagcuuagcaguucgcucuccagccaccagag

SEQ ID NO: 400134 - RNA, 64 nt, Human
cuauggaugugguuguuuggaugugguagggagugcuuagcagaauguguguguaucucugagg

SEQ ID NO: 400135 - RNA, 64 nt, Human
uccucucggggcagacccuccccguccucguggagcuuagcaggcagcugggcauggaggugcu

SEQ ID NO: 400136 - RNA, 64 nt, Human
cacuaggccauuuucagaucagcagucacccaucgcuuagcauagaaaucccaaaaccuccagc

SEQ ID NO: 400137 - RNA, 64 nt, Human
accagagcagcccccgcgugaaaugagaaggcaugcuuagcacugggaggaaaagcugaguuaa

SEQ ID NO: 400138 - RNA, 64 nt, Human; identical to SEQ ID NO: 75650

SEQ ID NO: 400139 - RNA, 64 nt, Human; identical to SEQ ID NO: 75651

SEQ ID NO: 400140 - RNA, 64 nt, Human; identical to SEQ ID NO: 75652

SEQ ID NO: 400141 - RNA, 64 nt, Human; identical to SEQ ID NO: 75653

SEQ ID NO: 400142 - RNA, 64 nt, Human
auugagauuguauuugcccugaguauuaaagcuagcuuagcaaaauacuuuuaaaaacauauug

SEQ ID NO: 400143 - RNA, 64 nt, Human
ucauaauuggaauauacggaauauuuaaacaguagcuuagcaucagagguuugcuuccucagua

SEQ ID NO: 400144 - RNA, 64 nt, Human
gagugagcuaaauugaucccaauuaaguuuuucugcuuagcagacagaagguauaauuuuuuga

SEQ ID NO: 400145 - RNA, 64 nt, Human
auaccaucugguccagugguuuuuaaacaaagcugcuuagcaccuggaauucccuggucaggga

SEQ ID NO: 400146 - RNA, 64 nt, Human
ugcucccuggugucugcugcauggcauccuggaugcuuagcaugcaaguucccuccaucauugc

SEQ ID NO: 400147 - RNA, 64 nt, Human
uuuccagguuucauagacuuggugagggaucacagcuuagcaugggugagagaugauuuaaagc

SEQ ID NO: 400148 - RNA, 64 nt, Human
auaaaggaaaccaaaucacaaaggagaugguguggcuuagcaaggaaacagugcaggaaaugua

SEQ ID NO: 400149 - RNA, 62 nt, Human
gcaguggcagaagauuuuaauuaggaaacaaagcuuagcaggagaggagagccagagaagug

SEQ ID NO: 400150 - RNA, 64 nt, Human
ggaacuauguuguugccagcaugaucuuuuuggggcuuagcagcaguucagucaaugucauaua

SEQ ID NO: 400151 - RNA, 64 nt, Human
ggcugggcacuuggaccuuuggguggcaauuccagcuuagcaacgcagaagaguacaaagugug

SEQ ID NO: 400152 - RNA, 64 nt, Human
acucagcuucacagagaugucuuugugaugugaugcuuagcaguuuggcccgaagaaggaaaau

SEQ ID NO: 400153 - RNA, 64 nt, Human
guccaacauuauuugaauugagcaccucaagcaugcuuagcaauguucuaaucacuauggacag

SEQ ID NO: 400154 - RNA, 64 nt, Human
cuccauucagccaucacauauugacugaguggcugcuuagcaugggccaccgcgcuaggcucgg

SEQ ID NO: 400155 - RNA, 62 nt, Human; identical to SEQ ID NO: 400149

SEQ ID NO: 400156 - RNA, 64 nt, Human
cauuguaauaauuuuuuagaguuuaauuuguaaagcuuagcaaauaaaaucuuguacuaugaau

SEQ ID NO: 400157 - RNA, 64 nt, Human; identical to SEQ ID NO: 75654

SEQ ID NO: 400158 - RNA, 64 nt, Human; identical to SEQ ID NO: 75655

SEQ ID NO: 400159 - RNA, 61 nt, Human; identical to SEQ ID NO: 75656

SEQ ID NO: 400160 - RNA, 64 nt, Human; identical to SEQ ID NO: 75657

SEQ ID NO: 400161 - RNA, 64 nt, Human
gauacaucauugaacugcacuuuauauaaccaaagcuuagcaguuuguuagauaagagucuaug

SEQ ID NO: 400162 - RNA, 64 nt, Human
uuggaggcaauccuaccuugcuuuugcuucuagagcuuagcauaucugauuguugucaggccau

SEQ ID NO: 400163 - RNA, 64 nt, Human
uuugcauuacgucacucgaaacguuuucauccaugcuuagcaucuacucuguauaacgcaugag

SEQ ID NO: 400164 - RNA, 64 nt, Human
aagcaccgagucaggugccugauacgcaguaggugcuuagcaaacgguagcuaauacuaucauc

SEQ ID NO: 400165 - RNA, 64 nt, Human
cuuaguucauauuugcauuuucguucaaggauaugcuuagcaauaaaauguucuucccaaaacc

SEQ ID NO: 400166 - RNA, 64 nt, Human
cauagcagaagaaauaggauuaucaaugugaacugcuuagcauggugccugguauauacgagag

SEQ ID NO: 400167 - RNA, 64 nt, Human
gcuggaggagacacaauggaugguucauguucuggcuuagcaagagccaccaagaacuuugggu

SEQ ID NO: 400168 - RNA, 64 nt, Human
cucacucuucaugaguauccuggguugugcagaagcuuagcauaugcccuuguguucggaucag

SEQ ID NO: 400169 - RNA, 64 nt, Human
ggaggcccaggagaccaaagggaggggcucugccgcuuagcagagaagaaagggccugggaggu

SEQ ID NO: 400170 - RNA, 64 nt, Human
aauuguuucauucauccugaccaagacugagccagcuuagcaacugcuggggagacaaaucuca

SEQ ID NO: 400171 - RNA, 64 nt, Human
gcacuaguacauguaggcuucucccuugugcaaagcuuagcaauuuguaggaaacuuugaucuu

SEQ ID NO: 400172 - RNA, 64 nt, Human
augggaaacugugguacagauagacaugaagagagcuuagcagugauugagguggugacuaaau

SEQ ID NO: 400173 - RNA, 64 nt, Human
uuuguucacucugagaucuguuugcagagugggugcuuagcagacagagugaagcuggcugggg

SEQ ID NO: 400174 - RNA, 64 nt, Human
gagauguacuacuguuccaaguguaagacccacugcuuagcaacaaagaagcuggaucucugga

SEQ ID NO: 400175 - RNA, 64 nt, Human
aaugggcgcauaaccugcgcugaccaguuuaggggcuuagcagaugccugccagcugaccucgu

SEQ ID NO: 400176 - RNA, 64 nt, Human; identical to SEQ ID NO: 75658

SEQ ID NO: 400177 - RNA, 64 nt, Human; identical to SEQ ID NO: 75659

SEQ ID NO: 400178 - RNA, 64 nt, Human; identical to SEQ ID NO: 75660

SEQ ID NO: 400179 - RNA, 64 nt, Human; identical to SEQ ID NO: 75661

SEQ ID NO: 400180 - RNA, 64 nt, Human
ccgccuucuccgugcucuggggccgggccucgcugcuuagcagcggccucuagcuccgucuccc

SEQ ID NO: 400181 - RNA, 64 nt, Human
gagcagcgggggagccuuggccgaagagaaccaugcuuggcaccgucuguguccccucggccgc

SEQ ID NO: 400182 - RNA, 64 nt, Human
guggguuggcucagguuaagcugagcuuggcugggcuuggcagcaagucucagauuugaucaag

SEQ ID NO: 400183 - RNA, 64 nt, Human
cucauauaauuuuucucagccaauccauucacaagcuuggcauugacaugugcugcuaguuuau

SEQ ID NO: 400184 - RNA, 64 nt, Human
cguuguguguuuucugcaauguggaguugacuuagcuuggcauuuuagauuuguuaaaacuauu

SEQ ID NO: 400185 - RNA, 64 nt, Human
aagcaucuuguuacagagacauacauccauuauggcuuggcaaucucuuuuauuuguugacucu

SEQ ID NO: 400186 - RNA, 64 nt, Human
uuaucuuggcauaauggccagaaaauauuguauugcuuggcagaaaagaaaauaaggucuaaag

SEQ ID NO: 400187 - RNA, 64 nt, Human
uugcagugagccgagaucgcaccacugcacuccagcuuggcaauagagugagacuccaucucaa

SEQ ID NO: 400188 - RNA, 64 nt, Human
gggcaggacaugguccuaggaagccugaaccuuggcuuggcaugccuucucagacagcacggcc

SEQ ID NO: 400189 - RNA, 64 nt, Human
aggggagaagaauguaaaaguuuggugguggguggcuuggcauugccccuuuuucccaccgauu

SEQ ID NO: 400190 - RNA, 64 nt, Human
ccaaaauguugcaauuacaggcaugagccacugugcuuggcaagcuaaggaggauuuucacuag

SEQ ID NO: 400191 - RNA, 64 nt, Human
aaguuccaaacagcaacuuugagagcaguggggugcuuggcagcuguucuguguuuuccaggaa

SEQ ID NO: 400192 - RNA, 64 nt, Human
cuggaaacuuacaaugcacuuuagcgcaguaagggcuuggcauccgguagugaaaaacugucua

SEQ ID NO: 400193 - RNA, 64 nt, Human
cccagcguccaagggacagacucagcuccaggcugcuuggcagcccagccuggaggagaaggcu

SEQ ID NO: 400194 - RNA, 64 nt, Human
aacauuaacauguccuaagacuuagugcagagaagcuuggcaguacguucuuugacuuaaggau

SEQ ID NO: 400195 - RNA, 64 nt, Human
auaaagcucucucggcagucgcucacacuacaaugcacacaaggauugagaagaguuaaaggcu

SEQ ID NO: 400196 - RNA, 64 nt, Human
ugguguuuguguggaaauuaucugccuggugugugcacacaagucuuacuuggaauaaauuuac

SEQ ID NO: 400197 - RNA, 64 nt, Human
agauagaagaacuauagggccuaguacagaaggugcacacaaauguuggcaaagucaaaacccc

SEQ ID NO: 400198 - RNA, 64 nt, Human
gaagccugaaaaacuaagaugcugccugcccagugcacacaaguguagguaucauuuucugcau

SEQ ID NO: 400199 - RNA, 64 nt, Human
ucaaguccucugguaggaggcaaagguucuaucugcuuagcaacuaguuaauaagugguaucug

SEQ ID NO: 400200 - RNA, 64 nt, Human
caaguauuuugguggggaaaagcaaguaucuauugcuuagcauauguaaaguuguagucuauau

SEQ ID NO: 400201 - RNA, 64 nt, Human
cucggcacuguuucucguguaauauccuucuaaugcuuagcaacaacaacaaaaaauugcucuc

SEQ ID NO: 400202 - RNA, 64 nt, Human
uauguuuuggaagugagugucacuacuuggcuuugcuuagcagguucugcuucacacuuguucu

SEQ ID NO: 400203 - RNA, 64 nt, Human
uacacaaauacugagugguggucuuuuguuacaggcuuagcaacaaagcugugcccugggcaug

SEQ ID NO: 400204 - RNA, 64 nt, Human
ccagggaugccccagaucaggggccagaggggaugcuuagcaaacccaaucccagaguaacugg

SEQ ID NO: 400205 - RNA, 64 nt, Human
gcccuguccagguggcuccgcgcccagggcccaggcuuagcagugcucccugcccuaucuuugg

SEQ ID NO: 400206 - RNA, 64 nt, Human
gagugugguuucgucgugaguggauggacggcaagcuuagcaagccuaaguccccucauguuca

SEQ ID NO: 400207 - RNA, 64 nt, Human
cugucaccaaggcuccuccaacaugcgggaggaggcuuagcagacuugcgcugcaccagcgaau

SEQ ID NO: 400208 - RNA, 64 nt, Human
ccacugcuggcuucagccccuugagcagcccauggcuuagcagacccccagauguaggucagug

SEQ ID NO: 400209 - RNA, 64 nt, Human
gcaguggaagcccuugacacucuuguuuuccuucgcuuagcaccuaggaagucgugugcaggag

SEQ ID NO: 400210 - RNA, 64 nt, Human
ugagcacccuuugugugcagacauggcuccaggugcuuagcaaucaauggugagcgugguauuc

SEQ ID NO: 400211 - RNA, 64 nt, Human
aagaugaccuguugugucauauaauuuaagcagagcuuagcauuuauuuuauucuuuagaaaac

SEQ ID NO: 400212 - RNA, 64 nt, Human
gcuuucacaaaaauccgggaagagauaauuaagagcuuagcaucccucuuagaguagaaggcag

SEQ ID NO: 400213 - RNA, 64 nt, Human
cccuaggcgcagccugucccgcagggccuggcuggcuuagcaaucugagccaccuuccuuaaag

SEQ ID NO: 400214 - RNA, 64 nt, Human
auaauguauauaaaguacuuuagccugguaccuagcacacaauaagcauucaauaaauauuagu

SEQ ID NO: 400215 - RNA, 64 nt, Human
gaaugaagcuuaucugacacauaagcuucauaaggcacacaacagccuuuuuacccuuaggaac

SEQ ID NO: 400216 - RNA, 64 nt, Human
caugguaguacuuacuagaucacauugauguuaagcacacaaugggcaaaugcagaauuauagu

SEQ ID NO: 400217 - RNA, 64 nt, Human
uuggaacugucguacacauucuauauguaagauagcacacaaguagaaauauuuaaaagcaguc

SEQ ID NO: 400218 - RNA, 64 nt, Human
gaugauggcucccgacacaagcgccagggccagggcuuagcagggccuggucuggaagucgaca

SEQ ID NO: 400219 - RNA, 64 nt, Human
uguugaggauuaagugaaccaauacauauacagugcuuagcacuuaauaaguauuccccccugc

SEQ ID NO: 400220 - RNA, 64 nt, Human
acuccuauuacauuuucuauguguaaauaaaacugcuuagcauuguacagaaacuuuuauuaaa

SEQ ID NO: 400221 - RNA, 64 nt, Human
agcaagugaccccucccaagcucccaucuauggggcuuagcaaaaaaagggaggaagugggggc

SEQ ID NO: 400222 - RNA, 64 nt, Human
cccccaacccucaauguauaaauugcuucuugaugcuuagcauucacaauuuuugauugaucgu

SEQ ID NO: 400223 - RNA, 64 nt, Human
uggccuucaagauccaucgaccuuaaacaggaaugcuuagcacguuuaccauacguuuaaaauc

SEQ ID NO: 400224 - RNA, 64 nt, Human
cuguauaaacaggaauauuuagaggguguuuccugcuuagcauuuuuuugcaguuaaaucaucu

SEQ ID NO: 400225 - RNA, 64 nt, Human
cugcuuuuuaacuggaggaaaaauacuucaggaggcuuagcauauugcuuggauucuacgugca

SEQ ID NO: 400226 - RNA, 64 nt, Human; identical to SEQ ID NO: 75614

SEQ ID NO: 400227 - RNA, 64 nt, Human; identical to SEQ ID NO: 75615

SEQ ID NO: 400228 - RNA, 64 nt, Human; identical to SEQ ID NO: 75616

SEQ ID NO: 400229 - RNA, 64 nt, Human; identical to SEQ ID NO: 75617

SEQ ID NO: 400230 - RNA, 64 nt, Human; identical to SEQ ID NO: 75618

SEQ ID NO: 400231 - RNA, 64 nt, Human; identical to SEQ ID NO: 75619

SEQ ID NO: 400232 - RNA, 64 nt, Human; identical to SEQ ID NO: 75620

SEQ ID NO: 400233 - RNA, 64 nt, Human; identical to SEQ ID NO: 75621

SEQ ID NO: 400234 - RNA, 64 nt, Human; identical to SEQ ID NO: 75622

SEQ ID NO: 400235 - RNA, 64 nt, Human; identical to SEQ ID NO: 75623

SEQ ID NO: 400236 - RNA, 64 nt, Human; identical to SEQ ID NO: 75624

SEQ ID NO: 400237 - RNA, 64 nt, Human; identical to SEQ ID NO: 75625

SEQ ID NO: 400238 - RNA, 64 nt, Human; identical to SEQ ID NO: 75662

SEQ ID NO: 400239 - RNA, 64 nt, Human; identical to SEQ ID NO: 75663

SEQ ID NO: 400240 - RNA, 64 nt, Human; identical to SEQ ID NO: 75664

SEQ ID NO: 400241 - RNA, 64 nt, Human; identical to SEQ ID NO: 75665

SEQ ID NO: 400242 - RNA, 64 nt, Human; identical to SEQ ID NO: 75666

SEQ ID NO: 400243 - RNA, 64 nt, Human; identical to SEQ ID NO: 75667

SEQ ID NO: 400244 - RNA, 64 nt, Human; identical to SEQ ID NO: 75668

SEQ ID NO: 400245 - RNA, 64 nt, Human; identical to SEQ ID NO: 75669

SEQ ID NO: 400246 - RNA, 64 nt, Human; identical to SEQ ID NO: 75670

SEQ ID NO: 400247 - RNA, 64 nt, Human; identical to SEQ ID NO: 75671

SEQ ID NO: 400248 - RNA, 64 nt, Human; identical to SEQ ID NO: 75672

SEQ ID NO: 400249 - RNA, 64 nt, Human; identical to SEQ ID NO: 75673

SEQ ID NO: 400250 - RNA, 64 nt, Human; identical to SEQ ID NO: 75674

SEQ ID NO: 400251 - RNA, 64 nt, Human; identical to SEQ ID NO: 75675

SEQ ID NO: 400252 - RNA, 64 nt, Human; identical to SEQ ID NO: 75676

SEQ ID NO: 400253 - RNA, 64 nt, Human; identical to SEQ ID NO: 75677

SEQ ID NO: 400254 - RNA, 64 nt, Human; identical to SEQ ID NO: 75678

SEQ ID NO: 400255 - RNA, 64 nt, Human; identical to SEQ ID NO: 75679

SEQ ID NO: 400256 - RNA, 64 nt, Human; identical to SEQ ID NO: 75680

SEQ ID NO: 400257 - RNA, 64 nt, Human; identical to SEQ ID NO: 75681

SEQ ID NO: 400258 - RNA, 64 nt, Human; identical to SEQ ID NO: 75682

SEQ ID NO: 400259 - RNA, 64 nt, Human; identical to SEQ ID NO: 75683

SEQ ID NO: 400260 - RNA, 64 nt, Human; identical to SEQ ID NO: 75684

SEQ ID NO: 400261 - RNA, 64 nt, Human; identical to SEQ ID NO: 75685

SEQ ID NO: 400262 - RNA, 64 nt, Human; identical to SEQ ID NO: 75686

SEQ ID NO: 400263 - RNA, 64 nt, Human; identical to SEQ ID NO: 75687

SEQ ID NO: 400264 - RNA, 64 nt, Human; identical to SEQ ID NO: 75688

SEQ ID NO: 400265 - RNA, 64 nt, Human; identical to SEQ ID NO: 75689

SEQ ID NO: 400266 - RNA, 64 nt, Human; identical to SEQ ID NO: 75690

SEQ ID NO: 400267 - RNA, 64 nt, Human; identical to SEQ ID NO: 75691

SEQ ID NO: 400268 - RNA, 64 nt, Human; identical to SEQ ID NO: 75692

SEQ ID NO: 400269 - RNA, 64 nt, Human; identical to SEQ ID NO: 75693

SEQ ID NO: 400270 - RNA, 64 nt, Human; identical to SEQ ID NO: 75694

SEQ ID NO: 400271 - RNA, 64 nt, Human; identical to SEQ ID NO: 75695

SEQ ID NO: 400272 - RNA, 64 nt, Human; identical to SEQ ID NO: 75696

SEQ ID NO: 400273 - RNA, 64 nt, Human; identical to SEQ ID NO: 75697

SEQ ID NO: 400274 - RNA, 64 nt, Human; identical to SEQ ID NO: 75698

SEQ ID NO: 400275 - RNA, 64 nt, Human; identical to SEQ ID NO: 75699

SEQ ID NO: 400276 - RNA, 64 nt, Human; identical to SEQ ID NO: 75700

SEQ ID NO: 400277 - RNA, 64 nt, Human; identical to SEQ ID NO: 75701

SEQ ID NO: 400278 - RNA, 64 nt, Human; identical to SEQ ID NO: 75702

SEQ ID NO: 400279 - RNA, 64 nt, Human; identical to SEQ ID NO: 75703

SEQ ID NO: 400280 - RNA, 64 nt, Human; identical to SEQ ID NO: 75704

SEQ ID NO: 400281 - RNA, 64 nt, Human; identical to SEQ ID NO: 75705

SEQ ID NO: 400282 - RNA, 64 nt, Human; identical to SEQ ID NO: 75706

SEQ ID NO: 400283 - RNA, 64 nt, Human; identical to SEQ ID NO: 75707

SEQ ID NO: 400284 - RNA, 64 nt, Human; identical to SEQ ID NO: 75708

SEQ ID NO: 400285 - RNA, 64 nt, Human; identical to SEQ ID NO: 75709

SEQ ID NO: 400286 - RNA, 64 nt, Human; identical to SEQ ID NO: 75710

SEQ ID NO: 400287 - RNA, 64 nt, Human; identical to SEQ ID NO: 75711

SEQ ID NO: 400288 - RNA, 64 nt, Human; identical to SEQ ID NO: 75712

SEQ ID NO: 400289 - RNA, 64 nt, Human; identical to SEQ ID NO: 75713

SEQ ID NO: 400290 - RNA, 64 nt, Human; identical to SEQ ID NO: 75714

SEQ ID NO: 400291 - RNA, 64 nt, Human; identical to SEQ ID NO: 75715

SEQ ID NO: 400292 - RNA, 64 nt, Human; identical to SEQ ID NO: 75716

SEQ ID NO: 400293 - RNA, 64 nt, Human; identical to SEQ ID NO: 75717

SEQ ID NO: 400294 - RNA, 64 nt, Human; identical to SEQ ID NO: 75718

SEQ ID NO: 400295 - RNA, 64 nt, Human; identical to SEQ ID NO: 75719

SEQ ID NO: 400296 - RNA, 64 nt, Human; identical to SEQ ID NO: 75720

SEQ ID NO: 400297 - RNA, 64 nt, Human; identical to SEQ ID NO: 75721

SEQ ID NO: 400298 - RNA, 64 nt, Human; identical to SEQ ID NO: 75722

SEQ ID NO: 400299 - RNA, 64 nt, Human; identical to SEQ ID NO: 75723

SEQ ID NO: 400300 - RNA, 64 nt, Human; identical to SEQ ID NO: 75724

SEQ ID NO: 400301 - RNA, 64 nt, Human; identical to SEQ ID NO: 75725

SEQ ID NO: 400302 - RNA, 64 nt, Human; identical to SEQ ID NO: 75726

SEQ ID NO: 400303 - RNA, 60 nt, Human; identical to SEQ ID NO: 75727

SEQ ID NO: 400304 - RNA, 64 nt, Human; identical to SEQ ID NO: 75728

SEQ ID NO: 400305 - RNA, 64 nt, Human; identical to SEQ ID NO: 75729

SEQ ID NO: 400306 - RNA, 64 nt, Human; identical to SEQ ID NO: 75730

SEQ ID NO: 400307 - RNA, 64 nt, Human; identical to SEQ ID NO: 75731

SEQ ID NO: 400308 - RNA, 64 nt, Human; identical to SEQ ID NO: 75732

SEQ ID NO: 400309 - RNA, 64 nt, Human; identical to SEQ ID NO: 75733

SEQ ID NO: 400310 - RNA, 64 nt, Human; identical to SEQ ID NO: 75734

SEQ ID NO: 400311 - RNA, 64 nt, Human; identical to SEQ ID NO: 75735

SEQ ID NO: 400312 - RNA, 64 nt, Human; identical to SEQ ID NO: 75736

SEQ ID NO: 400313 - RNA, 64 nt, Human; identical to SEQ ID NO: 75737

SEQ ID NO: 400314 - RNA, 64 nt, Human; identical to SEQ ID NO: 75738

SEQ ID NO: 400315 - RNA, 64 nt, Human; identical to SEQ ID NO: 75739

SEQ ID NO: 400316 - RNA, 64 nt, Human; identical to SEQ ID NO: 75740

SEQ ID NO: 400317 - RNA, 64 nt, Human; identical to SEQ ID NO: 75741

SEQ ID NO: 400318 - RNA, 64 nt, Human; identical to SEQ ID NO: 75742

SEQ ID NO: 400319 - RNA, 64 nt, Human; identical to SEQ ID NO: 75743

SEQ ID NO: 400320 - RNA, 64 nt, Human; identical to SEQ ID NO: 75744

SEQ ID NO: 400321 - RNA, 64 nt, Human; identical to SEQ ID NO: 75745

SEQ ID NO: 400322 - RNA, 64 nt, Human; identical to SEQ ID NO: 75746

SEQ ID NO: 400323 - RNA, 64 nt, Human; identical to SEQ ID NO: 75747

SEQ ID NO: 400324 - RNA, 64 nt, Human; identical to SEQ ID NO: 75748

SEQ ID NO: 400325 - RNA, 64 nt, Human; identical to SEQ ID NO: 75749

SEQ ID NO: 400326 - RNA, 51 nt, Human; identical to SEQ ID NO: 75750

SEQ ID NO: 400327 - RNA, 64 nt, Human; identical to SEQ ID NO: 75751

SEQ ID NO: 400328 - RNA, 64 nt, Human; identical to SEQ ID NO: 75752

SEQ ID NO: 400329 - RNA, 64 nt, Human; identical to SEQ ID NO: 75753

SEQ ID NO: 400330 - RNA, 64 nt, Human; identical to SEQ ID NO: 75754

SEQ ID NO: 400331 - RNA, 64 nt, Human; identical to SEQ ID NO: 75755

SEQ ID NO: 400332 - RNA, 64 nt, Human; identical to SEQ ID NO: 75756

SEQ ID NO: 400333 - RNA, 64 nt, Human; identical to SEQ ID NO: 75757

SEQ ID NO: 400334 - RNA, 64 nt, Human; identical to SEQ ID NO: 75758

SEQ ID NO: 400335 - RNA, 64 nt, Human; identical to SEQ ID NO: 75759

SEQ ID NO: 400336 - RNA, 64 nt, Human; identical to SEQ ID NO: 75760

SEQ ID NO: 400337 - RNA, 64 nt, Human; identical to SEQ ID NO: 75761

SEQ ID NO: 400338 - RNA, 64 nt, Human; identical to SEQ ID NO: 75762

SEQ ID NO: 400339 - RNA, 64 nt, Human; identical to SEQ ID NO: 75763

SEQ ID NO: 400340 - RNA, 64 nt, Human; identical to SEQ ID NO: 75764

SEQ ID NO: 400341 - RNA, 64 nt, Human; identical to SEQ ID NO: 75765

SEQ ID NO: 400342 - RNA, 64 nt, Human; identical to SEQ ID NO: 75766

SEQ ID NO: 400343 - RNA, 64 nt, Human; identical to SEQ ID NO: 75767

SEQ ID NO: 400344 - RNA, 64 nt, Human; identical to SEQ ID NO: 75768

SEQ ID NO: 400345 - RNA, 64 nt, Human; identical to SEQ ID NO: 75769

SEQ ID NO: 400346 - RNA, 64 nt, Human; identical to SEQ ID NO: 75770

SEQ ID NO: 400347 - RNA, 64 nt, Human; identical to SEQ ID NO: 75771

SEQ ID NO: 400348 - RNA, 64 nt, Human; identical to SEQ ID NO: 75772

SEQ ID NO: 400349 - RNA, 64 nt, Human; identical to SEQ ID NO: 75773

SEQ ID NO: 400350 - RNA, 64 nt, Human; identical to SEQ ID NO: 75774

SEQ ID NO: 400351 - RNA, 64 nt, Human; identical to SEQ ID NO: 75775

SEQ ID NO: 400352 - RNA, 64 nt, Human; identical to SEQ ID NO: 75776

SEQ ID NO: 400353 - RNA, 64 nt, Human; identical to SEQ ID NO: 75777

SEQ ID NO: 400354 - RNA, 64 nt, Human; identical to SEQ ID NO: 75778

SEQ ID NO: 400355 - RNA, 64 nt, Human; identical to SEQ ID NO: 75779

SEQ ID NO: 400356 - RNA, 64 nt, Human; identical to SEQ ID NO: 75780

SEQ ID NO: 400357 - RNA, 64 nt, Human; identical to SEQ ID NO: 75781

SEQ ID NO: 400358 - RNA, 64 nt, Human; identical to SEQ ID NO: 75782

SEQ ID NO: 400359 - RNA, 64 nt, Human; identical to SEQ ID NO: 75783

SEQ ID NO: 400360 - RNA, 64 nt, Human; identical to SEQ ID NO: 75784

SEQ ID NO: 400361 - RNA, 64 nt, Human; identical to SEQ ID NO: 75785

SEQ ID NO: 400362 - RNA, 64 nt, Human; identical to SEQ ID NO: 75786

SEQ ID NO: 400363 - RNA, 64 nt, Human; identical to SEQ ID NO: 75787

SEQ ID NO: 400364 - RNA, 64 nt, Human; identical to SEQ ID NO: 75788

SEQ ID NO: 400365 - RNA, 64 nt, Human; identical to SEQ ID NO: 75789

SEQ ID NO: 400366 - RNA, 64 nt, Human; identical to SEQ ID NO: 75790

SEQ ID NO: 400367 - RNA, 64 nt, Human; identical to SEQ ID NO: 75791

SEQ ID NO: 400368 - RNA, 64 nt, Human; identical to SEQ ID NO: 75792

SEQ ID NO: 400369 - RNA, 64 nt, Human; identical to SEQ ID NO: 75793

SEQ ID NO: 400370 - RNA, 64 nt, Human; identical to SEQ ID NO: 75794

SEQ ID NO: 400371 - RNA, 64 nt, Human; identical to SEQ ID NO: 75795

SEQ ID NO: 400372 - RNA, 64 nt, Human; identical to SEQ ID NO: 75796

SEQ ID NO: 400373 - RNA, 58 nt, Human; identical to SEQ ID NO: 75797

SEQ ID NO: 400374 - RNA, 64 nt, Human; identical to SEQ ID NO: 75798

SEQ ID NO: 400375 - RNA, 64 nt, Human; identical to SEQ ID NO: 75799

SEQ ID NO: 400376 - RNA, 64 nt, Human; identical to SEQ ID NO: 75800

SEQ ID NO: 400377 - RNA, 63 nt, Human; identical to SEQ ID NO: 75801

SEQ ID NO: 400378 - RNA, 64 nt, Human; identical to SEQ ID NO: 75802

SEQ ID NO: 400379 - RNA, 64 nt, Human; identical to SEQ ID NO: 75803

SEQ ID NO: 400380 - RNA, 64 nt, Human; identical to SEQ ID NO: 75804

SEQ ID NO: 400381 - RNA, 64 nt, Human; identical to SEQ ID NO: 75805

SEQ ID NO: 400382 - RNA, 64 nt, Human; identical to SEQ ID NO: 75806

SEQ ID NO: 400383 - RNA, 64 nt, Human; identical to SEQ ID NO: 75807

SEQ ID NO: 400384 - RNA, 64 nt, Human; identical to SEQ ID NO: 75808

SEQ ID NO: 400385 - RNA, 64 nt, Human; identical to SEQ ID NO: 75809

SEQ ID NO: 400386 - RNA, 64 nt, Human; identical to SEQ ID NO: 75810

SEQ ID NO: 400387 - RNA, 64 nt, Human; identical to SEQ ID NO: 75811

SEQ ID NO: 400388 - RNA, 64 nt, Human; identical to SEQ ID NO: 75812

SEQ ID NO: 400389 - RNA, 64 nt, Human; identical to SEQ ID NO: 75813

SEQ ID NO: 400390 - RNA, 64 nt, Human; identical to SEQ ID NO: 75814

SEQ ID NO: 400391 - RNA, 64 nt, Human; identical to SEQ ID NO: 75815

SEQ ID NO: 400392 - RNA, 64 nt, Human; identical to SEQ ID NO: 75816

SEQ ID NO: 400393 - RNA, 64 nt, Human; identical to SEQ ID NO: 75817

SEQ ID NO: 400394 - RNA, 64 nt, Human; identical to SEQ ID NO: 75818

SEQ ID NO: 400395 - RNA, 64 nt, Human; identical to SEQ ID NO: 75819

SEQ ID NO: 400396 - RNA, 64 nt, Human; identical to SEQ ID NO: 75820

SEQ ID NO: 400397 - RNA, 64 nt, Human; identical to SEQ ID NO: 75821

SEQ ID NO: 400398 - RNA, 64 nt, Human; identical to SEQ ID NO: 75822

SEQ ID NO: 400399 - RNA, 64 nt, Human; identical to SEQ ID NO: 75823

SEQ ID NO: 400400 - RNA, 64 nt, Human; identical to SEQ ID NO: 75824

SEQ ID NO: 400401 - RNA, 64 nt, Human; identical to SEQ ID NO: 75825

SEQ ID NO: 400402 - RNA, 64 nt, Human; identical to SEQ ID NO: 75826

SEQ ID NO: 400403 - RNA, 64 nt, Human; identical to SEQ ID NO: 75827

SEQ ID NO: 400404 - RNA, 64 nt, Human; identical to SEQ ID NO: 75828

SEQ ID NO: 400405 - RNA, 64 nt, Human; identical to SEQ ID NO: 75829

SEQ ID NO: 400406 - RNA, 64 nt, Human; identical to SEQ ID NO: 75830

SEQ ID NO: 400407 - RNA, 64 nt, Human; identical to SEQ ID NO: 75831

SEQ ID NO: 400408 - RNA, 64 nt, Human; identical to SEQ ID NO: 75832

SEQ ID NO: 400409 - RNA, 64 nt, Human; identical to SEQ ID NO: 75833

SEQ ID NO: 400410 - RNA, 64 nt, Human; identical to SEQ ID NO: 75834

SEQ ID NO: 400411 - RNA, 64 nt, Human; identical to SEQ ID NO: 75835

SEQ ID NO: 400412 - RNA, 64 nt, Human; identical to SEQ ID NO: 75836

SEQ ID NO: 400413 - RNA, 64 nt, Human; identical to SEQ ID NO: 75837

SEQ ID NO: 400414 - RNA, 64 nt, Human; identical to SEQ ID NO: 75838

SEQ ID NO: 400415 - RNA, 64 nt, Human; identical to SEQ ID NO: 75839

SEQ ID NO: 400416 - RNA, 64 nt, Human; identical to SEQ ID NO: 75840

SEQ ID NO: 400417 - RNA, 64 nt, Human; identical to SEQ ID NO: 75841

SEQ ID NO: 400418 - RNA, 64 nt, Human; identical to SEQ ID NO: 75842

SEQ ID NO: 400419 - RNA, 64 nt, Human; identical to SEQ ID NO: 75843

SEQ ID NO: 400420 - RNA, 53 nt, Human; identical to SEQ ID NO: 75844

SEQ ID NO: 400421 - RNA, 55 nt, Human; identical to SEQ ID NO: 75845

SEQ ID NO: 400422 - RNA, 64 nt, Human; identical to SEQ ID NO: 75846

SEQ ID NO: 400423 - RNA, 64 nt, Human; identical to SEQ ID NO: 75847

SEQ ID NO: 400424 - RNA, 64 nt, Human; identical to SEQ ID NO: 75848

SEQ ID NO: 400425 - RNA, 64 nt, Human; identical to SEQ ID NO: 75849

SEQ ID NO: 400426 - RNA, 64 nt, Human; identical to SEQ ID NO: 75850

SEQ ID NO: 400427 - RNA, 64 nt, Human; identical to SEQ ID NO: 75851

SEQ ID NO: 400428 - RNA, 64 nt, Human; identical to SEQ ID NO: 75852

SEQ ID NO: 400429 - RNA, 64 nt, Human; identical to SEQ ID NO: 75853

SEQ ID NO: 400430 - RNA, 64 nt, Human; identical to SEQ ID NO: 75854

SEQ ID NO: 400431 - RNA, 64 nt, Human; identical to SEQ ID NO: 75855

SEQ ID NO: 400432 - RNA, 64 nt, Human; identical to SEQ ID NO: 75856

SEQ ID NO: 400433 - RNA, 64 nt, Human; identical to SEQ ID NO: 75857

SEQ ID NO: 400434 - RNA, 64 nt, Human; identical to SEQ ID NO: 75858

SEQ ID NO: 400435 - RNA, 64 nt, Human; identical to SEQ ID NO: 75859

SEQ ID NO: 400436 - RNA, 64 nt, Human; identical to SEQ ID NO: 75860

SEQ ID NO: 400437 - RNA, 64 nt, Human; identical to SEQ ID NO: 75861

SEQ ID NO: 400438 - RNA, 64 nt, Human; identical to SEQ ID NO: 75862

SEQ ID NO: 400439 - RNA, 64 nt, Human; identical to SEQ ID NO: 75863

SEQ ID NO: 400440 - RNA, 64 nt, Human; identical to SEQ ID NO: 75864

SEQ ID NO: 400441 - RNA, 64 nt, Human; identical to SEQ ID NO: 75865

SEQ ID NO: 400442 - RNA, 64 nt, Human; identical to SEQ ID NO: 75866

SEQ ID NO: 400443 - RNA, 64 nt, Human; identical to SEQ ID NO: 75867

SEQ ID NO: 400444 - RNA, 64 nt, Human; identical to SEQ ID NO: 75868

SEQ ID NO: 400445 - RNA, 64 nt, Human; identical to SEQ ID NO: 75869

SEQ ID NO: 400446 - RNA, 64 nt, Human; identical to SEQ ID NO: 75870

SEQ ID NO: 400447 - RNA, 64 nt, Human; identical to SEQ ID NO: 75871

SEQ ID NO: 400448 - RNA, 64 nt, Human; identical to SEQ ID NO: 75872

SEQ ID NO: 400449 - RNA, 64 nt, Human; identical to SEQ ID NO: 75873

SEQ ID NO: 400450 - RNA, 64 nt, Human; identical to SEQ ID NO: 75874

SEQ ID NO: 400451 - RNA, 64 nt, Human; identical to SEQ ID NO: 75875

SEQ ID NO: 400452 - RNA, 64 nt, Human; identical to SEQ ID NO: 75876

SEQ ID NO: 400453 - RNA, 64 nt, Human; identical to SEQ ID NO: 75877

SEQ ID NO: 400454 - RNA, 64 nt, Human; identical to SEQ ID NO: 75878

SEQ ID NO: 400455 - RNA, 64 nt, Human; identical to SEQ ID NO: 75879

SEQ ID NO: 400456 - RNA, 64 nt, Human; identical to SEQ ID NO: 75880

SEQ ID NO: 400457 - RNA, 64 nt, Human; identical to SEQ ID NO: 75881

SEQ ID NO: 400458 - RNA, 64 nt, Human; identical to SEQ ID NO: 75882

SEQ ID NO: 400459 - RNA, 64 nt, Human; identical to SEQ ID NO: 75883

SEQ ID NO: 400460 - RNA, 64 nt, Human; identical to SEQ ID NO: 75884

SEQ ID NO: 400461 - RNA, 64 nt, Human; identical to SEQ ID NO: 75885

SEQ ID NO: 400462 - RNA, 64 nt, Human; identical to SEQ ID NO: 75886

SEQ ID NO: 400463 - RNA, 50 nt, Human; identical to SEQ ID NO: 75887

SEQ ID NO: 400464 - RNA, 64 nt, Human; identical to SEQ ID NO: 75888

SEQ ID NO: 400465 - RNA, 64 nt, Human; identical to SEQ ID NO: 75889

SEQ ID NO: 400466 - RNA, 64 nt, Human; identical to SEQ ID NO: 75890

SEQ ID NO: 400467 - RNA, 64 nt, Human; identical to SEQ ID NO: 75891

SEQ ID NO: 400468 - RNA, 64 nt, Human; identical to SEQ ID NO: 75892

SEQ ID NO: 400469 - RNA, 64 nt, Human; identical to SEQ ID NO: 75893

SEQ ID NO: 400470 - RNA, 64 nt, Human; identical to SEQ ID NO: 75894

SEQ ID NO: 400471 - RNA, 64 nt, Human; identical to SEQ ID NO: 75895

SEQ ID NO: 400472 - RNA, 64 nt, Human; identical to SEQ ID NO: 75896

SEQ ID NO: 400473 - RNA, 64 nt, Human; identical to SEQ ID NO: 75897

SEQ ID NO: 400474 - RNA, 64 nt, Human; identical to SEQ ID NO: 75898

SEQ ID NO: 400475 - RNA, 64 nt, Human; identical to SEQ ID NO: 75899

SEQ ID NO: 400476 - RNA, 64 nt, Human; identical to SEQ ID NO: 75900

SEQ ID NO: 400477 - RNA, 64 nt, Human; identical to SEQ ID NO: 75901

SEQ ID NO: 400478 - RNA, 64 nt, Human; identical to SEQ ID NO: 75902

SEQ ID NO: 400479 - RNA, 64 nt, Human; identical to SEQ ID NO: 75903

SEQ ID NO: 400480 - RNA, 64 nt, Human; identical to SEQ ID NO: 75904

SEQ ID NO: 400481 - RNA, 64 nt, Human; identical to SEQ ID NO: 75905

SEQ ID NO: 400482 - RNA, 64 nt, Human; identical to SEQ ID NO: 75906

SEQ ID NO: 400483 - RNA, 64 nt, Human; identical to SEQ ID NO: 75907

SEQ ID NO: 400484 - RNA, 64 nt, Human; identical to SEQ ID NO: 75908

SEQ ID NO: 400485 - RNA, 64 nt, Human; identical to SEQ ID NO: 75909

SEQ ID NO: 400486 - RNA, 64 nt, Human; identical to SEQ ID NO: 75910

SEQ ID NO: 400487 - RNA, 64 nt, Human; identical to SEQ ID NO: 75911

SEQ ID NO: 400488 - RNA, 64 nt, Human; identical to SEQ ID NO: 75912

SEQ ID NO: 400489 - RNA, 64 nt, Human; identical to SEQ ID NO: 75913

SEQ ID NO: 400490 - RNA, 64 nt, Human; identical to SEQ ID NO: 75914

SEQ ID NO: 400491 - RNA, 64 nt, Human; identical to SEQ ID NO: 75915

SEQ ID NO: 400492 - RNA, 64 nt, Human; identical to SEQ ID NO: 75916

SEQ ID NO: 400493 - RNA, 64 nt, Human; identical to SEQ ID NO: 75917

SEQ ID NO: 400494 - RNA, 64 nt, Human; identical to SEQ ID NO: 75918

SEQ ID NO: 400495 - RNA, 64 nt, Human; identical to SEQ ID NO: 75919

SEQ ID NO: 400496 - RNA, 64 nt, Human; identical to SEQ ID NO: 75920

SEQ ID NO: 400497 - RNA, 64 nt, Human; identical to SEQ ID NO: 75921

SEQ ID NO: 400498 - RNA, 64 nt, Human; identical to SEQ ID NO: 75922

SEQ ID NO: 400499 - RNA, 64 nt, Human; identical to SEQ ID NO: 75923

SEQ ID NO: 400500 - RNA, 64 nt, Human; identical to SEQ ID NO: 75924

SEQ ID NO: 400501 - RNA, 64 nt, Human; identical to SEQ ID NO: 75925

SEQ ID NO: 400502 - RNA, 64 nt, Human; identical to SEQ ID NO: 75926

SEQ ID NO: 400503 - RNA, 64 nt, Human; identical to SEQ ID NO: 75927

SEQ ID NO: 400504 - RNA, 64 nt, Human; identical to SEQ ID NO: 75928

SEQ ID NO: 400505 - RNA, 64 nt, Human; identical to SEQ ID NO: 75929

SEQ ID NO: 400506 - RNA, 64 nt, Human; identical to SEQ ID NO: 75930

SEQ ID NO: 400507 - RNA, 64 nt, Human; identical to SEQ ID NO: 75931

SEQ ID NO: 400508 - RNA, 64 nt, Human; identical to SEQ ID NO: 75932

SEQ ID NO: 400509 - RNA, 64 nt, Human; identical to SEQ ID NO: 75933

SEQ ID NO: 400510 - RNA, 64 nt, Human; identical to SEQ ID NO: 75934

SEQ ID NO: 400511 - RNA, 64 nt, Human; identical to SEQ ID NO: 75935

SEQ ID NO: 400512 - RNA, 64 nt, Human; identical to SEQ ID NO: 75936

SEQ ID NO: 400513 - RNA, 64 nt, Human; identical to SEQ ID NO: 75937

SEQ ID NO: 400514 - RNA, 64 nt, Human; identical to SEQ ID NO: 75938

SEQ ID NO: 400515 - RNA, 64 nt, Human; identical to SEQ ID NO: 75939

SEQ ID NO: 400516 - RNA, 64 nt, Human; identical to SEQ ID NO: 75940

SEQ ID NO: 400517 - RNA, 64 nt, Human; identical to SEQ ID NO: 75941

SEQ ID NO: 400518 - RNA, 64 nt, Human; identical to SEQ ID NO: 75942

SEQ ID NO: 400519 - RNA, 64 nt, Human; identical to SEQ ID NO: 75943

SEQ ID NO: 400520 - RNA, 64 nt, Human; identical to SEQ ID NO: 75944

SEQ ID NO: 400521 - RNA, 64 nt, Human; identical to SEQ ID NO: 75945

SEQ ID NO: 400522 - RNA, 64 nt, Human; identical to SEQ ID NO: 75946

SEQ ID NO: 400523 - RNA, 64 nt, Human; identical to SEQ ID NO: 75947

SEQ ID NO: 400524 - RNA, 64 nt, Human; identical to SEQ ID NO: 75948

SEQ ID NO: 400525 - RNA, 64 nt, Human; identical to SEQ ID NO: 75949

SEQ ID NO: 400526 - RNA, 64 nt, Human; identical to SEQ ID NO: 75950

SEQ ID NO: 400527 - RNA, 64 nt, Human; identical to SEQ ID NO: 75951

SEQ ID NO: 400528 - RNA, 64 nt, Human; identical to SEQ ID NO: 75952

SEQ ID NO: 400529 - RNA, 64 nt, Human; identical to SEQ ID NO: 75953

SEQ ID NO: 400530 - RNA, 64 nt, Human; identical to SEQ ID NO: 75954

SEQ ID NO: 400531 - RNA, 64 nt, Human; identical to SEQ ID NO: 75955

SEQ ID NO: 400532 - RNA, 64 nt, Human; identical to SEQ ID NO: 75956

SEQ ID NO: 400533 - RNA, 64 nt, Human; identical to SEQ ID NO: 75957

SEQ ID NO: 400534 - RNA, 64 nt, Human; identical to SEQ ID NO: 75958

SEQ ID NO: 400535 - RNA, 64 nt, Human; identical to SEQ ID NO: 75959

SEQ ID NO: 400536 - RNA, 64 nt, Human; identical to SEQ ID NO: 75960

SEQ ID NO: 400537 - RNA, 64 nt, Human; identical to SEQ ID NO: 75961

SEQ ID NO: 400538 - RNA, 64 nt, Human; identical to SEQ ID NO: 75962

SEQ ID NO: 400539 - RNA, 64 nt, Human; identical to SEQ ID NO: 75963

SEQ ID NO: 400540 - RNA, 64 nt, Human; identical to SEQ ID NO: 75964

SEQ ID NO: 400541 - RNA, 64 nt, Human; identical to SEQ ID NO: 75965

SEQ ID NO: 400542 - RNA, 64 nt, Human; identical to SEQ ID NO: 75966

SEQ ID NO: 400543 - RNA, 64 nt, Human; identical to SEQ ID NO: 75967

SEQ ID NO: 400544 - RNA, 64 nt, Human; identical to SEQ ID NO: 75968

SEQ ID NO: 400545 - RNA, 64 nt, Human; identical to SEQ ID NO: 75969

SEQ ID NO: 400546 - RNA, 64 nt, Human; identical to SEQ ID NO: 75970

SEQ ID NO: 400547 - RNA, 64 nt, Human; identical to SEQ ID NO: 75971

SEQ ID NO: 400548 - RNA, 64 nt, Human; identical to SEQ ID NO: 75972

SEQ ID NO: 400549 - RNA, 64 nt, Human; identical to SEQ ID NO: 75973

SEQ ID NO: 400550 - RNA, 64 nt, Human; identical to SEQ ID NO: 75974

SEQ ID NO: 400551 - RNA, 64 nt, Human; identical to SEQ ID NO: 75975

SEQ ID NO: 400552 - RNA, 64 nt, Human; identical to SEQ ID NO: 75976

SEQ ID NO: 400553 - RNA, 64 nt, Human; identical to SEQ ID NO: 75977

SEQ ID NO: 400554 - RNA, 64 nt, Human; identical to SEQ ID NO: 75978

SEQ ID NO: 400555 - RNA, 64 nt, Human; identical to SEQ ID NO: 75979

SEQ ID NO: 400556 - RNA, 64 nt, Human; identical to SEQ ID NO: 75980

SEQ ID NO: 400557 - RNA, 64 nt, Human; identical to SEQ ID NO: 75981

SEQ ID NO: 400558 - RNA, 64 nt, Human; identical to SEQ ID NO: 75982

SEQ ID NO: 400559 - RNA, 64 nt, Human; identical to SEQ ID NO: 75983

SEQ ID NO: 400560 - RNA, 64 nt, Human; identical to SEQ ID NO: 75984

SEQ ID NO: 400561 - RNA, 64 nt, Human; identical to SEQ ID NO: 75985

SEQ ID NO: 400562 - RNA, 64 nt, Human; identical to SEQ ID NO: 75986

SEQ ID NO: 400563 - RNA, 52 nt, Human; identical to SEQ ID NO: 75987

SEQ ID NO: 400564 - RNA, 64 nt, Human; identical to SEQ ID NO: 75988

SEQ ID NO: 400565 - RNA, 64 nt, Human; identical to SEQ ID NO: 75989

SEQ ID NO: 400566 - RNA, 64 nt, Human; identical to SEQ ID NO: 75990

SEQ ID NO: 400567 - RNA, 64 nt, Human; identical to SEQ ID NO: 75991

SEQ ID NO: 400568 - RNA, 64 nt, Human; identical to SEQ ID NO: 75992

SEQ ID NO: 400569 - RNA, 64 nt, Human; identical to SEQ ID NO: 75993

SEQ ID NO: 400570 - RNA, 55 nt, Human; identical to SEQ ID NO: 75994

SEQ ID NO: 400571 - RNA, 64 nt, Human; identical to SEQ ID NO: 75995

SEQ ID NO: 400572 - RNA, 64 nt, Human; identical to SEQ ID NO: 75996

SEQ ID NO: 400573 - RNA, 64 nt, Human; identical to SEQ ID NO: 75997

SEQ ID NO: 400574 - RNA, 64 nt, Human; identical to SEQ ID NO: 75998

SEQ ID NO: 400575 - RNA, 64 nt, Human; identical to SEQ ID NO: 75999

SEQ ID NO: 400576 - RNA, 64 nt, Human; identical to SEQ ID NO: 76000

SEQ ID NO: 400577 - RNA, 64 nt, Human; identical to SEQ ID NO: 76001

SEQ ID NO: 400578 - RNA, 64 nt, Human; identical to SEQ ID NO: 76002

SEQ ID NO: 400579 - RNA, 64 nt, Human; identical to SEQ ID NO: 76003

SEQ ID NO: 400580 - RNA, 64 nt, Human; identical to SEQ ID NO: 76004

SEQ ID NO: 400581 - RNA, 64 nt, Human; identical to SEQ ID NO: 76005

SEQ ID NO: 400582 - RNA, 64 nt, Human; identical to SEQ ID NO: 76006

SEQ ID NO: 400583 - RNA, 64 nt, Human; identical to SEQ ID NO: 76007

SEQ ID NO: 400584 - RNA, 63 nt, Human; identical to SEQ ID NO: 76008

SEQ ID NO: 400585 - RNA, 64 nt, Human; identical to SEQ ID NO: 76009

SEQ ID NO: 400586 - RNA, 64 nt, Human; identical to SEQ ID NO: 76010

SEQ ID NO: 400587 - RNA, 64 nt, Human; identical to SEQ ID NO: 76011

SEQ ID NO: 400588 - RNA, 64 nt, Human; identical to SEQ ID NO: 76012

SEQ ID NO: 400589 - RNA, 64 nt, Human; identical to SEQ ID NO: 76013

SEQ ID NO: 400590 - RNA, 64 nt, Human; identical to SEQ ID NO: 76014

SEQ ID NO: 400591 - RNA, 64 nt, Human; identical to SEQ ID NO: 76015

SEQ ID NO: 400592 - RNA, 64 nt, Human; identical to SEQ ID NO: 76016

SEQ ID NO: 400593 - RNA, 64 nt, Human; identical to SEQ ID NO: 76017

SEQ ID NO: 400594 - RNA, 64 nt, Human; identical to SEQ ID NO: 76018

SEQ ID NO: 400595 - RNA, 64 nt, Human; identical to SEQ ID NO: 76019

SEQ ID NO: 400596 - RNA, 64 nt, Human; identical to SEQ ID NO: 76020

SEQ ID NO: 400597 - RNA, 64 nt, Human; identical to SEQ ID NO: 76021

SEQ ID NO: 400598 - RNA, 64 nt, Human; identical to SEQ ID NO: 76022

SEQ ID NO: 400599 - RNA, 64 nt, Human; identical to SEQ ID NO: 76023

SEQ ID NO: 400600 - RNA, 64 nt, Human; identical to SEQ ID NO: 76024

SEQ ID NO: 400601 - RNA, 64 nt, Human; identical to SEQ ID NO: 76025

SEQ ID NO: 400602 - RNA, 64 nt, Human; identical to SEQ ID NO: 76026

SEQ ID NO: 400603 - RNA, 64 nt, Human; identical to SEQ ID NO: 76027

SEQ ID NO: 400604 - RNA, 64 nt, Human; identical to SEQ ID NO: 76028

SEQ ID NO: 400605 - RNA, 64 nt, Human; identical to SEQ ID NO: 76029

SEQ ID NO: 400606 - RNA, 64 nt, Human; identical to SEQ ID NO: 76030

SEQ ID NO: 400607 - RNA, 64 nt, Human; identical to SEQ ID NO: 76031

SEQ ID NO: 400608 - RNA, 64 nt, Human; identical to SEQ ID NO: 76032

SEQ ID NO: 400609 - RNA, 64 nt, Human; identical to SEQ ID NO: 76033

SEQ ID NO: 400610 - RNA, 64 nt, Human; identical to SEQ ID NO: 76034

SEQ ID NO: 400611 - RNA, 64 nt, Human; identical to SEQ ID NO: 76035

SEQ ID NO: 400612 - RNA, 64 nt, Human; identical to SEQ ID NO: 76036

SEQ ID NO: 400613 - RNA, 64 nt, Human; identical to SEQ ID NO: 76037

SEQ ID NO: 400614 - RNA, 64 nt, Human; identical to SEQ ID NO: 76038

SEQ ID NO: 400615 - RNA, 64 nt, Human; identical to SEQ ID NO: 76039

SEQ ID NO: 400616 - RNA, 64 nt, Human; identical to SEQ ID NO: 76040

SEQ ID NO: 400617 - RNA, 64 nt, Human; identical to SEQ ID NO: 76041

SEQ ID NO: 400618 - RNA, 56 nt, Human; identical to SEQ ID NO: 76042

SEQ ID NO: 400619 - RNA, 64 nt, Human; identical to SEQ ID NO: 76043

SEQ ID NO: 400620 - RNA, 64 nt, Human; identical to SEQ ID NO: 76044

SEQ ID NO: 400621 - RNA, 64 nt, Human; identical to SEQ ID NO: 76045

SEQ ID NO: 400622 - RNA, 64 nt, Human; identical to SEQ ID NO: 76046

SEQ ID NO: 400623 - RNA, 64 nt, Human; identical to SEQ ID NO: 76047

SEQ ID NO: 400624 - RNA, 64 nt, Human; identical to SEQ ID NO: 76048

SEQ ID NO: 400625 - RNA, 64 nt, Human; identical to SEQ ID NO: 76049

SEQ ID NO: 400626 - RNA, 64 nt, Human; identical to SEQ ID NO: 76050

SEQ ID NO: 400627 - RNA, 64 nt, Human; identical to SEQ ID NO: 76051

SEQ ID NO: 400628 - RNA, 64 nt, Human; identical to SEQ ID NO: 76052

SEQ ID NO: 400629 - RNA, 63 nt, Human; identical to SEQ ID NO: 76053

SEQ ID NO: 400630 - RNA, 64 nt, Human; identical to SEQ ID NO: 76054

SEQ ID NO: 400631 - RNA, 64 nt, Human; identical to SEQ ID NO: 76055

SEQ ID NO: 400632 - RNA, 64 nt, Human; identical to SEQ ID NO: 76056

SEQ ID NO: 400633 - RNA, 64 nt, Human; identical to SEQ ID NO: 76057

SEQ ID NO: 400634 - RNA, 64 nt, Human; identical to SEQ ID NO: 76058

SEQ ID NO: 400635 - RNA, 64 nt, Human; identical to SEQ ID NO: 76059

SEQ ID NO: 400636 - RNA, 64 nt, Human; identical to SEQ ID NO: 76060

SEQ ID NO: 400637 - RNA, 64 nt, Human; identical to SEQ ID NO: 76061

SEQ ID NO: 400638 - RNA, 64 nt, Human; identical to SEQ ID NO: 76062

SEQ ID NO: 400639 - RNA, 64 nt, Human; identical to SEQ ID NO: 76063

SEQ ID NO: 400640 - RNA, 64 nt, Human; identical to SEQ ID NO: 76064

SEQ ID NO: 400641 - RNA, 64 nt, Human; identical to SEQ ID NO: 76065

SEQ ID NO: 400642 - RNA, 64 nt, Human; identical to SEQ ID NO: 76066

SEQ ID NO: 400643 - RNA, 64 nt, Human; identical to SEQ ID NO: 76067

SEQ ID NO: 400644 - RNA, 64 nt, Human; identical to SEQ ID NO: 76068

SEQ ID NO: 400645 - RNA, 64 nt, Human; identical to SEQ ID NO: 76069

SEQ ID NO: 400646 - RNA, 64 nt, Human; identical to SEQ ID NO: 76070

SEQ ID NO: 400647 - RNA, 64 nt, Human; identical to SEQ ID NO: 76071

SEQ ID NO: 400648 - RNA, 64 nt, Human; identical to SEQ ID NO: 76072

SEQ ID NO: 400649 - RNA, 64 nt, Human; identical to SEQ ID NO: 76073

SEQ ID NO: 400650 - RNA, 64 nt, Human; identical to SEQ ID NO: 76074

SEQ ID NO: 400651 - RNA, 64 nt, Human; identical to SEQ ID NO: 76075

SEQ ID NO: 400652 - RNA, 64 nt, Human; identical to SEQ ID NO: 76076

SEQ ID NO: 400653 - RNA, 64 nt, Human; identical to SEQ ID NO: 76077

SEQ ID NO: 400654 - RNA, 64 nt, Human; identical to SEQ ID NO: 76078

SEQ ID NO: 400655 - RNA, 64 nt, Human; identical to SEQ ID NO: 76079

SEQ ID NO: 400656 - RNA, 64 nt, Human; identical to SEQ ID NO: 76080

SEQ ID NO: 400657 - RNA, 64 nt, Human; identical to SEQ ID NO: 76081

SEQ ID NO: 400658 - RNA, 64 nt, Human; identical to SEQ ID NO: 76082

SEQ ID NO: 400659 - RNA, 64 nt, Human; identical to SEQ ID NO: 76083

SEQ ID NO: 400660 - RNA, 64 nt, Human; identical to SEQ ID NO: 76084

SEQ ID NO: 400661 - RNA, 64 nt, Human; identical to SEQ ID NO: 76085

SEQ ID NO: 400662 - RNA, 64 nt, Human; identical to SEQ ID NO: 76086

SEQ ID NO: 400663 - RNA, 64 nt, Human; identical to SEQ ID NO: 76087

SEQ ID NO: 400664 - RNA, 64 nt, Human; identical to SEQ ID NO: 76088

SEQ ID NO: 400665 - RNA, 64 nt, Human; identical to SEQ ID NO: 76089

SEQ ID NO: 400666 - RNA, 64 nt, Human; identical to SEQ ID NO: 76090

SEQ ID NO: 400667 - RNA, 64 nt, Human; identical to SEQ ID NO: 76091

SEQ ID NO: 400668 - RNA, 64 nt, Human; identical to SEQ ID NO: 76092

SEQ ID NO: 400669 - RNA, 64 nt, Human; identical to SEQ ID NO: 76093

SEQ ID NO: 400670 - RNA, 64 nt, Human; identical to SEQ ID NO: 76094

SEQ ID NO: 400671 - RNA, 64 nt, Human; identical to SEQ ID NO: 76095

SEQ ID NO: 400672 - RNA, 64 nt, Human; identical to SEQ ID NO: 76096

SEQ ID NO: 400673 - RNA, 64 nt, Human; identical to SEQ ID NO: 76097

SEQ ID NO: 400674 - RNA, 64 nt, Human; identical to SEQ ID NO: 76098

SEQ ID NO: 400675 - RNA, 64 nt, Human; identical to SEQ ID NO: 76099

SEQ ID NO: 400676 - RNA, 64 nt, Human; identical to SEQ ID NO: 76100

SEQ ID NO: 400677 - RNA, 64 nt, Human; identical to SEQ ID NO: 76101

SEQ ID NO: 400678 - RNA, 64 nt, Human; identical to SEQ ID NO: 76102

SEQ ID NO: 400679 - RNA, 64 nt, Human; identical to SEQ ID NO: 76103

SEQ ID NO: 400680 - RNA, 64 nt, Human; identical to SEQ ID NO: 76104

SEQ ID NO: 400681 - RNA, 64 nt, Human; identical to SEQ ID NO: 76105

SEQ ID NO: 400682 - RNA, 64 nt, Human; identical to SEQ ID NO: 76106

SEQ ID NO: 400683 - RNA, 64 nt, Human; identical to SEQ ID NO: 76107

SEQ ID NO: 400684 - RNA, 64 nt, Human; identical to SEQ ID NO: 76108

SEQ ID NO: 400685 - RNA, 64 nt, Human; identical to SEQ ID NO: 76109

SEQ ID NO: 400686 - RNA, 64 nt, Human; identical to SEQ ID NO: 76110

SEQ ID NO: 400687 - RNA, 64 nt, Human; identical to SEQ ID NO: 76111

SEQ ID NO: 400688 - RNA, 64 nt, Human; identical to SEQ ID NO: 76112

SEQ ID NO: 400689 - RNA, 64 nt, Human; identical to SEQ ID NO: 76113

SEQ ID NO: 400690 - RNA, 64 nt, Human; identical to SEQ ID NO: 76114

SEQ ID NO: 400691 - RNA, 64 nt, Human; identical to SEQ ID NO: 76115

SEQ ID NO: 400692 - RNA, 64 nt, Human; identical to SEQ ID NO: 76116

SEQ ID NO: 400693 - RNA, 64 nt, Human; identical to SEQ ID NO: 76117

SEQ ID NO: 400694 - RNA, 64 nt, Human; identical to SEQ ID NO: 76118

SEQ ID NO: 400695 - RNA, 64 nt, Human; identical to SEQ ID NO: 76119

SEQ ID NO: 400696 - RNA, 64 nt, Human; identical to SEQ ID NO: 76120

SEQ ID NO: 400697 - RNA, 64 nt, Human; identical to SEQ ID NO: 76121

SEQ ID NO: 400698 - RNA, 64 nt, Human; identical to SEQ ID NO: 76122

SEQ ID NO: 400699 - RNA, 64 nt, Human; identical to SEQ ID NO: 76123

SEQ ID NO: 400700 - RNA, 64 nt, Human; identical to SEQ ID NO: 76124

SEQ ID NO: 400701 - RNA, 64 nt, Human; identical to SEQ ID NO: 76125

SEQ ID NO: 400702 - RNA, 64 nt, Human; identical to SEQ ID NO: 76126

SEQ ID NO: 400703 - RNA, 64 nt, Human; identical to SEQ ID NO: 76127

SEQ ID NO: 400704 - RNA, 64 nt, Human; identical to SEQ ID NO: 76128

SEQ ID NO: 400705 - RNA, 64 nt, Human; identical to SEQ ID NO: 76129

SEQ ID NO: 400706 - RNA, 64 nt, Human; identical to SEQ ID NO: 76130

SEQ ID NO: 400707 - RNA, 64 nt, Human; identical to SEQ ID NO: 76131

SEQ ID NO: 400708 - RNA, 64 nt, Human; identical to SEQ ID NO: 76132

SEQ ID NO: 400709 - RNA, 64 nt, Human; identical to SEQ ID NO: 76133

SEQ ID NO: 400710 - RNA, 64 nt, Human; identical to SEQ ID NO: 76134

SEQ ID NO: 400711 - RNA, 64 nt, Human; identical to SEQ ID NO: 76135

SEQ ID NO: 400712 - RNA, 64 nt, Human; identical to SEQ ID NO: 76136

SEQ ID NO: 400713 - RNA, 64 nt, Human; identical to SEQ ID NO: 76137

SEQ ID NO: 400714 - RNA, 64 nt, Human; identical to SEQ ID NO: 76138

SEQ ID NO: 400715 - RNA, 64 nt, Human; identical to SEQ ID NO: 76139

SEQ ID NO: 400716 - RNA, 64 nt, Human; identical to SEQ ID NO: 76140

SEQ ID NO: 400717 - RNA, 64 nt, Human; identical to SEQ ID NO: 76141

SEQ ID NO: 400718 - RNA, 64 nt, Human; identical to SEQ ID NO: 76142

SEQ ID NO: 400719 - RNA, 64 nt, Human; identical to SEQ ID NO: 76143

SEQ ID NO: 400720 - RNA, 64 nt, Human; identical to SEQ ID NO: 76144

SEQ ID NO: 400721 - RNA, 64 nt, Human; identical to SEQ ID NO: 76145

SEQ ID NO: 400722 - RNA, 64 nt, Human; identical to SEQ ID NO: 76146

SEQ ID NO: 400723 - RNA, 64 nt, Human; identical to SEQ ID NO: 76147

SEQ ID NO: 400724 - RNA, 64 nt, Human; identical to SEQ ID NO: 76148

SEQ ID NO: 400725 - RNA, 64 nt, Human; identical to SEQ ID NO: 76149

SEQ ID NO: 400726 - RNA, 64 nt, Human; identical to SEQ ID NO: 76150

SEQ ID NO: 400727 - RNA, 64 nt, Human; identical to SEQ ID NO: 76151

SEQ ID NO: 400728 - RNA, 64 nt, Human; identical to SEQ ID NO: 76152

SEQ ID NO: 400729 - RNA, 64 nt, Human; identical to SEQ ID NO: 76153

SEQ ID NO: 400730 - RNA, 64 nt, Human; identical to SEQ ID NO: 76154

SEQ ID NO: 400731 - RNA, 51 nt, Human; identical to SEQ ID NO: 76155

SEQ ID NO: 400732 - RNA, 64 nt, Human; identical to SEQ ID NO: 76156

SEQ ID NO: 400733 - RNA, 64 nt, Human; identical to SEQ ID NO: 76157

SEQ ID NO: 400734 - RNA, 64 nt, Human; identical to SEQ ID NO: 76158

SEQ ID NO: 400735 - RNA, 64 nt, Human; identical to SEQ ID NO: 76159

SEQ ID NO: 400736 - RNA, 64 nt, Human; identical to SEQ ID NO: 76160

SEQ ID NO: 400737 - RNA, 64 nt, Human; identical to SEQ ID NO: 76161

SEQ ID NO: 400738 - RNA, 64 nt, Human; identical to SEQ ID NO: 76162

SEQ ID NO: 400739 - RNA, 64 nt, Human; identical to SEQ ID NO: 76163

SEQ ID NO: 400740 - RNA, 64 nt, Human; identical to SEQ ID NO: 76164

SEQ ID NO: 400741 - RNA, 64 nt, Human; identical to SEQ ID NO: 76165

SEQ ID NO: 400742 - RNA, 64 nt, Human; identical to SEQ ID NO: 76166

SEQ ID NO: 400743 - RNA, 64 nt, Human; identical to SEQ ID NO: 76167

SEQ ID NO: 400744 - RNA, 64 nt, Human; identical to SEQ ID NO: 76168

SEQ ID NO: 400745 - RNA, 64 nt, Human; identical to SEQ ID NO: 76169

SEQ ID NO: 400746 - RNA, 64 nt, Human; identical to SEQ ID NO: 76170

SEQ ID NO: 400747 - RNA, 64 nt, Human; identical to SEQ ID NO: 76171

SEQ ID NO: 400748 - RNA, 64 nt, Human; identical to SEQ ID NO: 76172

SEQ ID NO: 400749 - RNA, 64 nt, Human; identical to SEQ ID NO: 76173

SEQ ID NO: 400750 - RNA, 64 nt, Human; identical to SEQ ID NO: 76174

SEQ ID NO: 400751 - RNA, 64 nt, Human; identical to SEQ ID NO: 76175

SEQ ID NO: 400752 - RNA, 64 nt, Human; identical to SEQ ID NO: 76176

SEQ ID NO: 400753 - RNA, 64 nt, Human; identical to SEQ ID NO: 76177

SEQ ID NO: 400754 - RNA, 64 nt, Human; identical to SEQ ID NO: 76178

SEQ ID NO: 400755 - RNA, 64 nt, Human; identical to SEQ ID NO: 76179

SEQ ID NO: 400756 - RNA, 64 nt, Human; identical to SEQ ID NO: 76180

SEQ ID NO: 400757 - RNA, 64 nt, Human; identical to SEQ ID NO: 76181

SEQ ID NO: 400758 - RNA, 64 nt, Human; identical to SEQ ID NO: 76182

SEQ ID NO: 400759 - RNA, 64 nt, Human; identical to SEQ ID NO: 76183

SEQ ID NO: 400760 - RNA, 64 nt, Human; identical to SEQ ID NO: 76184

SEQ ID NO: 400761 - RNA, 64 nt, Human; identical to SEQ ID NO: 76185

SEQ ID NO: 400762 - RNA, 64 nt, Human; identical to SEQ ID NO: 76186

SEQ ID NO: 400763 - RNA, 64 nt, Human; identical to SEQ ID NO: 76187

SEQ ID NO: 400764 - RNA, 64 nt, Human; identical to SEQ ID NO: 76188

SEQ ID NO: 400765 - RNA, 64 nt, Human; identical to SEQ ID NO: 76189

SEQ ID NO: 400766 - RNA, 64 nt, Human; identical to SEQ ID NO: 76190

SEQ ID NO: 400767 - RNA, 64 nt, Human; identical to SEQ ID NO: 76191

SEQ ID NO: 400768 - RNA, 64 nt, Human; identical to SEQ ID NO: 76192

SEQ ID NO: 400769 - RNA, 64 nt, Human; identical to SEQ ID NO: 76193

SEQ ID NO: 400770 - RNA, 64 nt, Human; identical to SEQ ID NO: 76194

SEQ ID NO: 400771 - RNA, 64 nt, Human; identical to SEQ ID NO: 76195

SEQ ID NO: 400772 - RNA, 64 nt, Human; identical to SEQ ID NO: 76196

SEQ ID NO: 400773 - RNA, 64 nt, Human; identical to SEQ ID NO: 76197

SEQ ID NO: 400774 - RNA, 64 nt, Human; identical to SEQ ID NO: 76198

SEQ ID NO: 400775 - RNA, 60 nt, Human; identical to SEQ ID NO: 76199

SEQ ID NO: 400776 - RNA, 64 nt, Human; identical to SEQ ID NO: 76200

SEQ ID NO: 400777 - RNA, 64 nt, Human; identical to SEQ ID NO: 76201

SEQ ID NO: 400778 - RNA, 64 nt, Human; identical to SEQ ID NO: 76202

SEQ ID NO: 400779 - RNA, 64 nt, Human; identical to SEQ ID NO: 76203

SEQ ID NO: 400780 - RNA, 64 nt, Human; identical to SEQ ID NO: 76204

SEQ ID NO: 400781 - RNA, 52 nt, Human; identical to SEQ ID NO: 76205

SEQ ID NO: 400782 - RNA, 64 nt, Human; identical to SEQ ID NO: 76206

SEQ ID NO: 400783 - RNA, 64 nt, Human; identical to SEQ ID NO: 76207

SEQ ID NO: 400784 - RNA, 64 nt, Human; identical to SEQ ID NO: 76208

SEQ ID NO: 400785 - RNA, 64 nt, Human; identical to SEQ ID NO: 76209

SEQ ID NO: 400786 - RNA, 61 nt, Human; identical to SEQ ID NO: 76210

SEQ ID NO: 400787 - RNA, 64 nt, Human; identical to SEQ ID NO: 76211

SEQ ID NO: 400788 - RNA, 64 nt, Human; identical to SEQ ID NO: 76212

SEQ ID NO: 400789 - RNA, 51 nt, Human; identical to SEQ ID NO: 76213

SEQ ID NO: 400790 - RNA, 64 nt, Human; identical to SEQ ID NO: 76214

SEQ ID NO: 400791 - RNA, 64 nt, Human; identical to SEQ ID NO: 76215

SEQ ID NO: 400792 - RNA, 64 nt, Human; identical to SEQ ID NO: 76216

SEQ ID NO: 400793 - RNA, 64 nt, Human; identical to SEQ ID NO: 76217

SEQ ID NO: 400794 - RNA, 64 nt, Human; identical to SEQ ID NO: 76218

SEQ ID NO: 400795 - RNA, 64 nt, Human; identical to SEQ ID NO: 76219

SEQ ID NO: 400796 - RNA, 64 nt, Human; identical to SEQ ID NO: 76220

SEQ ID NO: 400797 - RNA, 64 nt, Human; identical to SEQ ID NO: 76221

SEQ ID NO: 400798 - RNA, 64 nt, Human; identical to SEQ ID NO: 76222

SEQ ID NO: 400799 - RNA, 64 nt, Human; identical to SEQ ID NO: 76223

SEQ ID NO: 400800 - RNA, 64 nt, Human; identical to SEQ ID NO: 76224

SEQ ID NO: 400801 - RNA, 64 nt, Human; identical to SEQ ID NO: 76225

SEQ ID NO: 400802 - RNA, 64 nt, Human; identical to SEQ ID NO: 76226

SEQ ID NO: 400803 - RNA, 64 nt, Human; identical to SEQ ID NO: 76227

SEQ ID NO: 400804 - RNA, 64 nt, Human; identical to SEQ ID NO: 76228

SEQ ID NO: 400805 - RNA, 64 nt, Human; identical to SEQ ID NO: 76229

SEQ ID NO: 400806 - RNA, 64 nt, Human; identical to SEQ ID NO: 76230

SEQ ID NO: 400807 - RNA, 64 nt, Human; identical to SEQ ID NO: 76231

SEQ ID NO: 400808 - RNA, 64 nt, Human; identical to SEQ ID NO: 76232

SEQ ID NO: 400809 - RNA, 64 nt, Human; identical to SEQ ID NO: 76233

SEQ ID NO: 400810 - RNA, 64 nt, Human; identical to SEQ ID NO: 76234

SEQ ID NO: 400811 - RNA, 64 nt, Human; identical to SEQ ID NO: 76235

SEQ ID NO: 400812 - RNA, 64 nt, Human; identical to SEQ ID NO: 76236

SEQ ID NO: 400813 - RNA, 64 nt, Human; identical to SEQ ID NO: 76237

SEQ ID NO: 400814 - RNA, 64 nt, Human; identical to SEQ ID NO: 76238

SEQ ID NO: 400815 - RNA, 64 nt, Human; identical to SEQ ID NO: 76239

SEQ ID NO: 400816 - RNA, 64 nt, Human; identical to SEQ ID NO: 76240

SEQ ID NO: 400817 - RNA, 64 nt, Human; identical to SEQ ID NO: 76241

SEQ ID NO: 400818 - RNA, 64 nt, Human; identical to SEQ ID NO: 76242

SEQ ID NO: 400819 - RNA, 64 nt, Human; identical to SEQ ID NO: 76243

SEQ ID NO: 400820 - RNA, 64 nt, Human; identical to SEQ ID NO: 76244

SEQ ID NO: 400821 - RNA, 64 nt, Human; identical to SEQ ID NO: 76245

SEQ ID NO: 400822 - RNA, 64 nt, Human; identical to SEQ ID NO: 76246

SEQ ID NO: 400823 - RNA, 64 nt, Human; identical to SEQ ID NO: 76247

SEQ ID NO: 400824 - RNA, 64 nt, Human; identical to SEQ ID NO: 76248

SEQ ID NO: 400825 - RNA, 64 nt, Human; identical to SEQ ID NO: 76249

SEQ ID NO: 400826 - RNA, 64 nt, Human; identical to SEQ ID NO: 76250

SEQ ID NO: 400827 - RNA, 64 nt, Human; identical to SEQ ID NO: 76251

SEQ ID NO: 400828 - RNA, 59 nt, Human; identical to SEQ ID NO: 76252

SEQ ID NO: 400829 - RNA, 64 nt, Human; identical to SEQ ID NO: 76253

SEQ ID NO: 400830 - RNA, 60 nt, Human; identical to SEQ ID NO: 76254

SEQ ID NO: 400831 - RNA, 64 nt, Human; identical to SEQ ID NO: 76255

SEQ ID NO: 400832 - RNA, 64 nt, Human; identical to SEQ ID NO: 76256

SEQ ID NO: 400833 - RNA, 64 nt, Human; identical to SEQ ID NO: 76257

SEQ ID NO: 400834 - RNA, 64 nt, Human; identical to SEQ ID NO: 76258

SEQ ID NO: 400835 - RNA, 64 nt, Human; identical to SEQ ID NO: 76259

SEQ ID NO: 400836 - RNA, 64 nt, Human; identical to SEQ ID NO: 76260

SEQ ID NO: 400837 - RNA, 64 nt, Human; identical to SEQ ID NO: 76261

SEQ ID NO: 400838 - RNA, 64 nt, Human; identical to SEQ ID NO: 76262

SEQ ID NO: 400839 - RNA, 64 nt, Human; identical to SEQ ID NO: 76263

SEQ ID NO: 400840 - RNA, 64 nt, Human; identical to SEQ ID NO: 76264

SEQ ID NO: 400841 - RNA, 59 nt, Human; identical to SEQ ID NO: 76265

SEQ ID NO: 400842 - RNA, 59 nt, Human; identical to SEQ ID NO: 76266

SEQ ID NO: 400843 - RNA, 64 nt, Human; identical to SEQ ID NO: 76267

SEQ ID NO: 400844 - RNA, 64 nt, Human; identical to SEQ ID NO: 76268

SEQ ID NO: 400845 - RNA, 58 nt, Human; identical to SEQ ID NO: 76269

SEQ ID NO: 400846 - RNA, 64 nt, Human; identical to SEQ ID NO: 76270

SEQ ID NO: 400847 - RNA, 64 nt, Human; identical to SEQ ID NO: 76271

SEQ ID NO: 400848 - RNA, 64 nt, Human; identical to SEQ ID NO: 76272

SEQ ID NO: 400849 - RNA, 64 nt, Human; identical to SEQ ID NO: 76273

SEQ ID NO: 400850 - RNA, 54 nt, Human; identical to SEQ ID NO: 76274

SEQ ID NO: 400851 - RNA, 64 nt, Human; identical to SEQ ID NO: 76275

SEQ ID NO: 400852 - RNA, 64 nt, Human; identical to SEQ ID NO: 76276

SEQ ID NO: 400853 - RNA, 64 nt, Human; identical to SEQ ID NO: 76277

SEQ ID NO: 400854 - RNA, 64 nt, Human; identical to SEQ ID NO: 76278

SEQ ID NO: 400855 - RNA, 64 nt, Human; identical to SEQ ID NO: 76279

SEQ ID NO: 400856 - RNA, 64 nt, Human; identical to SEQ ID NO: 76280

SEQ ID NO: 400857 - RNA, 64 nt, Human; identical to SEQ ID NO: 76281

SEQ ID NO: 400858 - RNA, 64 nt, Human; identical to SEQ ID NO: 76282

SEQ ID NO: 400859 - RNA, 64 nt, Human; identical to SEQ ID NO: 76283

SEQ ID NO: 400860 - RNA, 64 nt, Human; identical to SEQ ID NO: 76284

SEQ ID NO: 400861 - RNA, 64 nt, Human; identical to SEQ ID NO: 76285

SEQ ID NO: 400862 - RNA, 64 nt, Human; identical to SEQ ID NO: 76286

SEQ ID NO: 400863 - RNA, 64 nt, Human; identical to SEQ ID NO: 76287

SEQ ID NO: 400864 - RNA, 64 nt, Human; identical to SEQ ID NO: 76288

SEQ ID NO: 400865 - RNA, 64 nt, Human; identical to SEQ ID NO: 76289

SEQ ID NO: 400866 - RNA, 64 nt, Human; identical to SEQ ID NO: 76290

SEQ ID NO: 400867 - RNA, 64 nt, Human; identical to SEQ ID NO: 76291

SEQ ID NO: 400868 - RNA, 64 nt, Human; identical to SEQ ID NO: 76292

SEQ ID NO: 400869 - RNA, 64 nt, Human; identical to SEQ ID NO: 76293

SEQ ID NO: 400870 - RNA, 64 nt, Human; identical to SEQ ID NO: 76294

SEQ ID NO: 400871 - RNA, 64 nt, Human; identical to SEQ ID NO: 76295

SEQ ID NO: 400872 - RNA, 64 nt, Human; identical to SEQ ID NO: 76296

SEQ ID NO: 400873 - RNA, 64 nt, Human; identical to SEQ ID NO: 76297

SEQ ID NO: 400874 - RNA, 64 nt, Human; identical to SEQ ID NO: 76298

SEQ ID NO: 400875 - RNA, 64 nt, Human; identical to SEQ ID NO: 76299

SEQ ID NO: 400876 - RNA, 64 nt, Human; identical to SEQ ID NO: 76300

SEQ ID NO: 400877 - RNA, 64 nt, Human; identical to SEQ ID NO: 76301

SEQ ID NO: 400878 - RNA, 64 nt, Human; identical to SEQ ID NO: 76302

SEQ ID NO: 400879 - RNA, 64 nt, Human; identical to SEQ ID NO: 76303

SEQ ID NO: 400880 - RNA, 64 nt, Human; identical to SEQ ID NO: 76304

SEQ ID NO: 400881 - RNA, 64 nt, Human; identical to SEQ ID NO: 76305

SEQ ID NO: 400882 - RNA, 64 nt, Human; identical to SEQ ID NO: 76306

SEQ ID NO: 400883 - RNA, 64 nt, Human; identical to SEQ ID NO: 76307

SEQ ID NO: 400884 - RNA, 64 nt, Human; identical to SEQ ID NO: 76308

SEQ ID NO: 400885 - RNA, 64 nt, Human; identical to SEQ ID NO: 76309

SEQ ID NO: 400886 - RNA, 64 nt, Human; identical to SEQ ID NO: 76310

SEQ ID NO: 400887 - RNA, 64 nt, Human; identical to SEQ ID NO: 76311

SEQ ID NO: 400888 - RNA, 64 nt, Human; identical to SEQ ID NO: 76312

SEQ ID NO: 400889 - RNA, 64 nt, Human; identical to SEQ ID NO: 76313

SEQ ID NO: 400890 - RNA, 64 nt, Human; identical to SEQ ID NO: 76314

SEQ ID NO: 400891 - RNA, 64 nt, Human; identical to SEQ ID NO: 76315

SEQ ID NO: 400892 - RNA, 64 nt, Human; identical to SEQ ID NO: 76316

SEQ ID NO: 400893 - RNA, 64 nt, Human; identical to SEQ ID NO: 76317

SEQ ID NO: 400894 - RNA, 64 nt, Human; identical to SEQ ID NO: 76318

SEQ ID NO: 400895 - RNA, 64 nt, Human; identical to SEQ ID NO: 76319

SEQ ID NO: 400896 - RNA, 64 nt, Human; identical to SEQ ID NO: 76320

SEQ ID NO: 400897 - RNA, 64 nt, Human; identical to SEQ ID NO: 76321

SEQ ID NO: 400898 - RNA, 64 nt, Human; identical to SEQ ID NO: 76322

SEQ ID NO: 400899 - RNA, 64 nt, Human; identical to SEQ ID NO: 76323

SEQ ID NO: 400900 - RNA, 64 nt, Human; identical to SEQ ID NO: 76324

SEQ ID NO: 400901 - RNA, 64 nt, Human; identical to SEQ ID NO: 76325

SEQ ID NO: 400902 - RNA, 64 nt, Human; identical to SEQ ID NO: 76326

SEQ ID NO: 400903 - RNA, 64 nt, Human; identical to SEQ ID NO: 76327

SEQ ID NO: 400904 - RNA, 64 nt, Human; identical to SEQ ID NO: 76328

SEQ ID NO: 400905 - RNA, 64 nt, Human; identical to SEQ ID NO: 76329

SEQ ID NO: 400906 - RNA, 64 nt, Human; identical to SEQ ID NO: 76330

SEQ ID NO: 400907 - RNA, 64 nt, Human; identical to SEQ ID NO: 76331

SEQ ID NO: 400908 - RNA, 64 nt, Human; identical to SEQ ID NO: 76332

SEQ ID NO: 400909 - RNA, 64 nt, Human; identical to SEQ ID NO: 76333

SEQ ID NO: 400910 - RNA, 64 nt, Human; identical to SEQ ID NO: 76334

SEQ ID NO: 400911 - RNA, 64 nt, Human; identical to SEQ ID NO: 76335

SEQ ID NO: 400912 - RNA, 62 nt, Human
uuccccuucauguggcaccuuugugccaggccaccaggcagacucuucccaccuucucccac

SEQ ID NO: 400913 - RNA, 62 nt, Human
ucaugaccaccucugaugucugugcugcugucaccaggcaccuuuguuuuucaagacaacau

SEQ ID NO: 400914 - RNA, 62 nt, Human
aucaggagaugaauauggaacaucuccuauguaccaggcacugugcuaagugcuggaauaca

SEQ ID NO: 400915 - RNA, 62 nt, Human
cucaaaggcacuuuguuucucccaaguaggccaccaggcagccucuagaguugcuuuaccca

SEQ ID NO: 400916 - RNA, 62 nt, Human
agcgcaggaggacaggcaccaccggaugccacaccaggcaggaggagguguggacagugaug

SEQ ID NO: 400917 - RNA, 62 nt, Human
cucugggucauauggugcagacugugaccagcaccaggcaggcaguccugucugcgugugga

SEQ ID NO: 400918 - RNA, 62 nt, Human
aagguuggagucugcuggugcgguguuuacacaccaggcagggcugucugccaccuugugug

SEQ ID NO: 400919 - RNA, 62 nt, Human
auagccaaagcaucuuugacagaagguucugcaccaggcaaaaagaucugaaacauuaguuu

SEQ ID NO: 400920 - RNA, 62 nt, Human
agaccaucuaaguagccauuuucgaacaauucaccaggcauguaaacucaucugcagaaaau

SEQ ID NO: 400921 - RNA, 62 nt, Human
guucuugaacaccugaggccuuccuggugcccaccaggcacuacggcuuccucuccagaaug

SEQ ID NO: 400922 - RNA, 62 nt, Human
agucucuuuagggauuuucccuaagguguaccaccaggcacaccucagucuucuugacccag

SEQ ID NO: 400923 - RNA, 62 nt, Human
ggagacauacuacugaccccauuggaagaagaaccaggcauggaaagauggggagcucugga

SEQ ID NO: 400924 - RNA, 62 nt, Human
uuauuacugaguuaaauugaaaaguccaguggaccaggcauuucuuauauaaauaaaauugg

SEQ ID NO: 400925 - RNA, 62 nt, Human
agagccccaugggcccagccccugcccugggaaccaggcagccuuccagaccucaggggcug

SEQ ID NO: 400926 - RNA, 62 nt, Human
cccacgcaaggauuuucuuuaaauugagaggcaccaggcaguaacuuccaugaugacacuga

SEQ ID NO: 400927 - RNA, 62 nt, Human
cugcgcuugaucaacugaaccaguaugccaaaaccaggcauccaauuuguaaaccaauuaug

SEQ ID NO: 400928 - RNA, 62 nt, Human
ucuuuggguuuagaagaccaaguauggggaaaaccaggcaccagccucugcagcaauggguc

SEQ ID NO: 400929 - RNA, 62 nt, Human
gcagcauggaacaugcagcugggcuuccugugaccaggcacccucuggcacuguugcuugcc

SEQ ID NO: 400930 - RNA, 62 nt, Human
aggcugaggauggccugaaccuggagcagcggaccaggcagacgggcugaagugggguccca

SEQ ID NO: 400931 - RNA, 62 nt, Human
guuuuuggguccucauguuauuuauugccgaaaccaggcaggcaaccccaagggcaccaacc

SEQ ID NO: 400932 - RNA, 62 nt, Human
guccugccccacgaaggauccaaggccaguuaaccaggcaagacacaagccuuggcuggaaa

SEQ ID NO: 400933 - RNA, 62 nt, Human
uaccucaaaccccagcugggcccgcuuagcccaccaggcaugaggccaagggcuccacugac

SEQ ID NO: 400934 - RNA, 62 nt, Human
augcuuaaaaaacacuuguuaguuuucccuguaccaggcaaugguuauaauuaaaaugauau

SEQ ID NO: 400935 - RNA, 62 nt, Human
ggcccugcuuuaucaggggacaaaccagggguaccaggcacauggcugggggagggacugcu

SEQ ID NO: 400936 - RNA, 62 nt, Human
agggcaauacaggcauuuaaaaaauuaaaaugaccaggcacaguggcucacgccuguaaucu

SEQ ID NO: 400937 - RNA, 62 nt, Human
agccagccccucuuccccaaugcuccaucccaaccaggcaccucuuccuugauguuuggggu

SEQ ID NO: 400938 - RNA, 62 nt, Human
gcaaauguucauggaucaccggcuaccaagguaccaggcaccaugcuagguauuggggaaga

SEQ ID NO: 400939 - RNA, 62 nt, Human
uugcaaauuaaaaagggccagaaaaauuuggcaccaggcaaacgaauaaagauaggauuggg

SEQ ID NO: 400940 - RNA, 62 nt, Human
cucacagggaggggagcaggggagggaaagaaaccaggcaucuggucaaaccagcagaucaa

SEQ ID NO: 400941 - RNA, 62 nt, Human
agugccacuugcuccuuagagucuguuugucaaccaggcagagucccuuucuuuucugcucc

SEQ ID NO: 400942 - RNA, 62 nt, Human
cacccauccuccuuucagcccccuuuauggggaccaggcagcucuggagccagccacagggg

SEQ ID NO: 400943 - RNA, 62 nt, Human
ugggcucaagcaauguauugaauuuuaaaauaaccaggcacucacucuuaugaauuaauaaa

SEQ ID NO: 400944 - RNA, 62 nt, Human
auggcuaaauauuuauggagggccuacuguggaccaggcacugggcuaaauacuuacauuua

SEQ ID NO: 400945 - RNA, 62 nt, Human
uguccuuugaggggcugauggcaauaucuaaaaccaggcaccagcaugaacaccaagcuggg

SEQ ID NO: 400946 - RNA, 62 nt, Human
ccaccagguacgacgaccagguaccagaaaccaccaggcacacggggcagaaagccagcguc

SEQ ID NO: 400947 - RNA, 62 nt, Human
cugagauggggaugaagguaagaugccgcaucaccaggcacgccgccccugacagcugccuu

SEQ ID NO: 400948 - RNA, 62 nt, Human
cucaacaaauauuuaucgagcaccuuuuauguaccaggcacuguuguaggugcuuaggauau

SEQ ID NO: 400949 - RNA, 62 nt, Human
cugggcucagccagguggaaggaaccugccuaaccaggcaccuguguuaagagcaugauggu

SEQ ID NO: 400950 - RNA, 62 nt, Human
aaagcaguguaguggugauuggucagugacuaaccaggcagcuaagaagucuuaggcagcag

SEQ ID NO: 400951 - RNA, 62 nt, Human
ugcagaugacagggaggugcugugagaagugcaccaggcagcuuucucucugugguagacua

SEQ ID NO: 400952 - RNA, 62 nt, Human
ucacggggagcucagagguccaugccgaggagaccaggcaggaccucccgaggcugcgcccc

SEQ ID NO: 400953 - RNA, 62 nt, Human
gugacaggaagaggagggagagggugacgaacaccaggcauuuccaggggcuauauuucacu

SEQ ID NO: 400954 - RNA, 62 nt, Human
gguuugauugugaaguccgcaugaaacacugcaccaggcagggcuuugcaaagugcaaggua

SEQ ID NO: 400955 - RNA, 62 nt, Human
uuaagggauuuaguaacaucauuuuguuuuccaccaggcagggaguagggcuuaguguuuua

SEQ ID NO: 400956 - RNA, 62 nt, Human
acagcaucaauucccuugauccagcccaagagaccaggcagccauggccacugccuuccucu

SEQ ID NO: 400957 - RNA, 62 nt, Human
gugguucuuugcaguuucuuguaaauuuauaaaccaggcacaagguucaaguuuagauuuua

SEQ ID NO: 400958 - RNA, 62 nt, Human
gccauccagccaccaccuacagcccaguggguaccaggcaggcucccuuccuggggaaaaga

SEQ ID NO: 400959 - RNA, 62 nt, Human
aggaaagccacugacccagcccgggaggcagaaccaggcagccucccuggccccaggcagcc

SEQ ID NO: 400960 - RNA, 62 nt, Human
uaucugccauauuaaccccuuuguguauaaugaccaggcaguguuaaacugaguuuuuaauu

SEQ ID NO: 400961 - RNA, 62 nt, Human
guuacuuuugagaguuuucuggucaagcuuuuaccaggcauucucuagccuugguacaaaaa

SEQ ID NO: 400962 - RNA, 62 nt, Human
aaacuuuucugaaugccuaccuggcgguguauaccaggcagugugccaguuuaaaaagauga

SEQ ID NO: 400963 - RNA, 62 nt, Human
ccgggauacuuucagaugcucgccuguaccucaccaggcagaguaaauaucuacucacucau

SEQ ID NO: 400964 - RNA, 62 nt, Human
auuuaugggaaccccuucauccucugagugugaccaggcauccuccacaauagcagacagug

SEQ ID NO: 400965 - RNA, 62 nt, Human
guagacauugccccacuguaagcuguggccucaccaggcaagcugaggccaggagggacccu

SEQ ID NO: 400966 - RNA, 62 nt, Human
caagcaggugggcaggaaggacaugcaccgagaccaggcaggggcccaacuuucacguccag

SEQ ID NO: 400967 - RNA, 62 nt, Human
guccuccucuaccuuggaagcaguuagaaucuaccaggcacagaugaggccgcccuugccug

SEQ ID NO: 400968 - RNA, 62 nt, Human
uguaaugugauggaauuuaaaaguuuuaugagaccaggcacaguggcucacgacuguaauuc

SEQ ID NO: 400969 - RNA, 62 nt, Human
uccaauggcugcuuagagucagccuggguggcaccaggcaaugcaggugaaguggcugccuu

SEQ ID NO: 400970 - RNA, 62 nt, Human
ucugugaugaagaguagugaauacaacacacaaccaggcagccuucuugacuauacuuugca

SEQ ID NO: 400971 - RNA, 62 nt, Human
ucagagcagcagugaaaacaagugcuggcaccaccaggcaccucacagaaaugagaucaggc

SEQ ID NO: 400972 - RNA, 62 nt, Human
ugauucacagugugaaucuuggugucuacguuaccaggcaggaaggcugagaggagagagac

SEQ ID NO: 400973 - RNA, 62 nt, Human
cugaugcaagcaagaaacacugggcuucuagaaccaggcaacuugggaacuagacucccaag

SEQ ID NO: 400974 - RNA, 62 nt, Human
ccuccccacuagcauuuucucuaccuucaagaaccaggcagcccugccaugucacaauaggc

SEQ ID NO: 400975 - RNA, 62 nt, Human
caacacacauccaucucaagaggaacauuuauaccaggcagucagagcuggaaguguaugga

SEQ ID NO: 400976 - RNA, 62 nt, Human
guguaaauuuugugaauauguauuauauuaaaaccaggcaacuuggaaucccuaaauucugu

SEQ ID NO: 400977 - RNA, 62 nt, Human
guucagaaaauagaugugguauugcucugaggaccaggcaggaggaacucuacaaccugagu

SEQ ID NO: 400978 - RNA, 62 nt, Human
gaggcccaauccuaaaaguuugggcagagggaaccaggcacguuaaagaagacagaaagcgg

SEQ ID NO: 400979 - RNA, 62 nt, Human
ucugagguagcaagugcagccucacgacagauaccaggcaauccagagccacaaaacgugau

SEQ ID NO: 400980 - RNA, 62 nt, Human
ggacagaaaggggauaguggaguuaugggcccaccaggcaagccugggccuucuggucaacc

SEQ ID NO: 400981 - RNA, 62 nt, Human
gaguaagaaaugggccucagccccgcggaucaaccaggcagaguucuguggcgccgcgugga

SEQ ID NO: 400982 - RNA, 62 nt, Human
ccagguaacuuugaagagaugagcagugagugaccaggcaguuuuucugccuuuagcuuuga

SEQ ID NO: 400983 - RNA, 62 nt, Human
ugcagccaccauuuauucagcaccuguuaugcaccaggcacuuuauguaucuuauugcuaac

SEQ ID NO: 400984 - RNA, 62 nt, Human
aaugucauauuuuugaguuuuguaauggaagaaccaggcacagaaacagacagaaaugauac

SEQ ID NO: 400985 - RNA, 62 nt, Human
uaaaugcaccuuagcagaaggucgaugugucuaccaggcagacgaagcucucuuacaaaccc

SEQ ID NO: 400986 - RNA, 62 nt, Human
augucuccugcauagcuuuucccuguccugacaccaggcaagaaaagcgcagagaaaucggu

SEQ ID NO: 400987 - RNA, 62 nt, Human
ccauagagaagaaaucaguaucugaguugcauaccaggcaguauuaaaaucuaacaggucug

SEQ ID NO: 400988 - RNA, 62 nt, Human
uaacaaacaaagcuauuggguguccaugauauaccaggcacuaugcuagguguugagaaugu

SEQ ID NO: 400989 - RNA, 62 nt, Human
aaaagguagauuauguaaccaaucagguacguaccaggcagugaugugcuaauacacugauc

SEQ ID NO: 400990 - RNA, 62 nt, Human
cacuguccccuugcugauggcauggggguccgaccaggcacugacaccgcaggcagagguug

SEQ ID NO: 400991 - RNA, 62 nt, Human
aguagcugagccacugugcccaggcugugggcaccaggcagagugggagccuaggucaggcc

SEQ ID NO: 400992 - RNA, 62 nt, Human
gugggccuuagccgucacccaccagcuuccucaccaggcaaggaggccccggagccuuagca

SEQ ID NO: 400993 - RNA, 62 nt, Human
ucauuucauccuggucagucuagagucugugcaccaggcaguccauccacugaaggcugugu

SEQ ID NO: 400994 - RNA, 62 nt, Human
ucauuccucaggcacuugagugacaguuguuuaccaggcacuguguguagccccaggguuug

SEQ ID NO: 400995 - RNA, 62 nt, Human
ggagcugacacuucuguaaaacuagaagauaaaccaggcaauguaaguguucgagguguuga

SEQ ID NO: 400996 - RNA, 62 nt, Human
aaaccucgucucuacuaaaaauacaaaaaucaaccaggcaugacggugcacgccuguuauca

SEQ ID NO: 400997 - RNA, 62 nt, Human
ggaaaggaagggaagagugcuccaagacuuggaccaggcacacacacaccuccagaucaccu

SEQ ID NO: 400998 - RNA, 62 nt, Human
gaaaacuuuaaagcguuugcacagaucaacuuaccaggcaccaaaagaaguaaaagcaaaaa

SEQ ID NO: 400999 - RNA, 62 nt, Human
agggucuagugauggaaguuuuguagauaaguaccaggcaucucaguaacuccuagacuuuu

SEQ ID NO: 401000 - RNA, 62 nt, Human
aaggaaugaauugaaucuugagacggguccucaccaggcaagagucuugcuuauugggcugc

SEQ ID NO: 401001 - RNA, 62 nt, Human
auucuauaagcccagcauuaccugauaccaaaaccaggcaaagaaaacagaagaagaggaag

SEQ ID NO: 401002 - RNA, 62 nt, Human
cccgcccugggcugcagccucugcacgcaagcaccaggcauccuuuguguugucaacuccgu

SEQ ID NO: 401003 - RNA, 62 nt, Human
aauaccucaaauaguccaguagagggcaguccaccaggcagaaaagguuaggcguuuugguu

SEQ ID NO: 401004 - RNA, 62 nt, Human
cauuugugacaacauuucauaucaccagacacaccaggcaacagaaguugaagcacaaccac

SEQ ID NO: 401005 - RNA, 62 nt, Human
caagggacaguagccagagcuccucuuccuuuaccaggcaaggugcauccccucagcccucc

SEQ ID NO: 401006 - RNA, 62 nt, Human
gacuuuggagaaagcaaagcagugacccagugaccaggcacauuacucgugagcgagguauu

SEQ ID NO: 401007 - RNA, 62 nt, Human
ccuguccucagccucccaaaaugcugggagccaccaggcaccaggugugaucuaccacaccu

SEQ ID NO: 401008 - RNA, 62 nt, Human
accaacaaagauguacucuuaaacucaguaucaccaggcacuauauuucaucuuugaggcuu

SEQ ID NO: 401009 - RNA, 62 nt, Human
guagaaugugaugucagaacucaaacaggcucaccaggcagugugcuuccuuccuugcauga

SEQ ID NO: 401010 - RNA, 62 nt, Human
uuuggagggaaaaaaaaaauaucacuacacaaaccaggcacucucccuuucugucuuucuag

SEQ ID NO: 401011 - RNA, 62 nt, Human
cccugaaggcuccuuugggugagaacaugugaaccaggcacccugguuuguuuggagcauug

SEQ ID NO: 401012 - RNA, 62 nt, Human
uaaugauguguuuugaccuuugcaggcgaguaaccaggcaauggaguggagugucuccugga

SEQ ID NO: 401013 - RNA, 62 nt, Human
ucuucucugaaacuucaggaugcuccuuggucaccaggcaaugggagcuguagaccagccgc

SEQ ID NO: 401014 - RNA, 62 nt, Human
ccccaucucuacaaagaaagauuuaaaaauuaaccaggcaugguggcucgcaccuguauucc

SEQ ID NO: 401015 - RNA, 62 nt, Human
ccugcuggccgcugccuccuuagaaagcugugaccaggcagcuaagagccucugggcugcag

SEQ ID NO: 401016 - RNA, 62 nt, Human
uauauaguucagcaauggccugaauagaagcaaccaggcaccaucucagcaauguuuucucu

SEQ ID NO: 401017 - RNA, 62 nt, Human
aauuuuggguagguauucacaugcacuaaaaaaccaggcaaacaucugacucccaggauaaa

SEQ ID NO: 401018 - RNA, 62 nt, Human
ucuugaacauuaauccacauguuucagagcucaccaggcaguaccaaugcucuuuucacagc

SEQ ID NO: 401019 - RNA, 62 nt, Human
uuuacuaagcagauggucgggcacugcagggcaccaggcaggauccuagggcgccucuuauu

SEQ ID NO: 401020 - RNA, 62 nt, Human
uuccauggacauuuaguuagugcuuuuuauauaccaggcaugaugcugagugacacucuugu

SEQ ID NO: 401021 - RNA, 62 nt, Human
gaugcccaggggaaggcauacaggccucauccaccaggcaauagacaggagagaggugagaa

SEQ ID NO: 401022 - RNA, 62 nt, Human
cuagcuccccgcccuaaaaggaggcagugaggaccaggcacuauuuccuccgagguuacuuc

SEQ ID NO: 401023 - RNA, 62 nt, Human
gaaggcgaguaugugacacuggagaaaaguggaccaggcaugucuuuugcuuugaucuggag

SEQ ID NO: 401024 - RNA, 62 nt, Human
acaaguuuuuaccuagccaguuguuucugaggaccaggcaacuuuugaacuccugucucugu

SEQ ID NO: 401025 - RNA, 62 nt, Human
ggugaaucauuagguauaaaaaauaaucaucaaccaggcaaauuacuuugcuuccuagcuga

SEQ ID NO: 401026 - RNA, 62 nt, Human
uaauaagcuggcuacacagaaccccacuacuuaccaggcauggauugaagaagauugucuac

SEQ ID NO: 401027 - RNA, 62 nt, Human
uccuuuacucuagauucauucagcuuuuccagaccaggcaucaccgagcggagagaggggaa

SEQ ID NO: 401028 - RNA, 62 nt, Human
ugcuggagauugggucccucggucucccuugcaccaggcacccuugggcuccaggggagggu

SEQ ID NO: 401029 - RNA, 62 nt, Human
auucaucccuucaguucuggagaaagccugauaccaggcacagccuacugaccccaaggagc

SEQ ID NO: 401030 - RNA, 62 nt, Human
uaggaaccuucuuggagaccccuuugaagaaaaccaggcagccaagggagccaaacacacua

SEQ ID NO: 401031 - RNA, 62 nt, Human
uuuguccucaauccagucaacaccuacuauguaccaggcaccaggaagccagaagcucaggg

SEQ ID NO: 401032 - RNA, 62 nt, Human
gaagugggcgugaguggacgugucaggugguuaccaggcacugguuguugauggucgguggu

SEQ ID NO: 401033 - RNA, 62 nt, Human
gugacauuucccaggacagcauggugaacauuaccaggcaugcuagcuggcccguguaaucc

SEQ ID NO: 401034 - RNA, 62 nt, Human
cagaaacauaccugaccaaaaaauucccaguaaccaggcaugaucaauuuauaguggucguu

SEQ ID NO: 401035 - RNA, 62 nt, Human
agcuggagaagaaugaaaagaacucccaagaaaccaggcaggcagaagcuccugaaugcugg

SEQ ID NO: 401036 - RNA, 62 nt, Human
ggacgugcaucaucacugcaaucagcaugaacaccaggcaccccugggacaccuaacgccca

SEQ ID NO: 401037 - RNA, 62 nt, Human
gaaugggguagggggguuuaccugguuuuaugaccaggcauaguaucuauuauauuugcuuu

SEQ ID NO: 401038 - RNA, 62 nt, Human
ucccagauguuggaccaacaccccucccugccaccaggcacugccuggagggcagggagugg

SEQ ID NO: 401039 - RNA, 61 nt, Human
gcggcugucugcgaccacagcagccucgaaacaccaggcagcagccuugcugggaguccac

SEQ ID NO: 401040 - RNA, 62 nt, Human
ggcaugucuuaacgaagaucagcaaagaaaacaccaggcacccucugccacuuagacauaau

SEQ ID NO: 401041 - RNA, 62 nt, Human
acuugaaauucaucaugggagucugcugcuauaccaggcacaagauaaaacuccaaaauuuc

SEQ ID NO: 401042 - RNA, 62 nt, Human
ccuauaauucugucuugcugguguggauagaaaccaggcaggacaguagaucccuaugguug

SEQ ID NO: 401043 - RNA, 62 nt, Human
cagccacgaguaugccacagggggcuuucaaaaccaggcagggccaagccuuggccccacug

SEQ ID NO: 401044 - RNA, 62 nt, Human
gugaaguaauguuugaacuggaagaugagcucaccaggcaaagcuaaggaaggauauacuag

SEQ ID NO: 401045 - RNA, 62 nt, Human
aauuuggucccuggauggcuagggauccaugaaccaggcagguaccuuuuuuguuuuuguuu

SEQ ID NO: 401046 - RNA, 62 nt, Human
gggacggaugaggaaggagcucuuugcagugcaccaggcacguugagaguggaggcacaaug

SEQ ID NO: 401047 - RNA, 62 nt, Human
acagugggcggcuucccugcgacggaggcaggaccaggcauuuagcuaguuagagacucgcc

SEQ ID NO: 401048 - RNA, 62 nt, Human
gucagcugccucacugcauacucuuuaauaguaccaggcaaagauuuucuucaacuauagua

SEQ ID NO: 401049 - RNA, 62 nt, Human
gcucucguuuuuggggucauggggaggguagcaccaggcauagccacuuuugcccugaggga

SEQ ID NO: 401050 - RNA, 62 nt, Human
acugaaagauguaggcaggggcaggucucucaaccaggcauauuuuuaaaaguugcuucugu

SEQ ID NO: 401051 - RNA, 62 nt, Human
ggcacuuuugauaugagacaauguagcagaauaccaggcagacagaaccuugcaaacaccuu

SEQ ID NO: 401052 - RNA, 62 nt, Human
cauuaguaucauaaacgucaaggauugauuggaccaggcaagagccauguuuuugagaaggu

SEQ ID NO: 401053 - RNA, 62 nt, Human
gcuauuuaggggaacaaggggauucaggagaaaccaggcagcaggggaugaaauacaugaau

SEQ ID NO: 401054 - RNA, 62 nt, Human
aggugguagggagugagucaaagcacuaauagaccaggcaacuuaccacuuggaguggauuu

SEQ ID NO: 401055 - RNA, 62 nt, Human
ggcaaauggggucggggggacuggggcaccagaccaggcaccaccuggacacuuucuuguug

SEQ ID NO: 401056 - RNA, 62 nt, Human
augcccaagagaucugugccauagaacaagauaccaggcacuuaaagccuuuuccugaauug

SEQ ID NO: 401057 - RNA, 62 nt, Human
agacaccaaaguguuucucuuccaguuugaaaaccaggcagguuuacacguggguuucagug

SEQ ID NO: 401058 - RNA, 62 nt, Human
cacugcucaccgcccaaggcgacgccggcuggaccaggcacugcuggccuuucuccugcccg

SEQ ID NO: 401059 - RNA, 62 nt, Human
uggguggaagggcugggugucgaaaucaaaccaccaggcauccggcccuuaccggcaagcag

SEQ ID NO: 401060 - RNA, 62 nt, Human
uuuugugaggccaguauuacccuaauagcaaaaccaggcaaagauauuacaagaaaggaaaa

SEQ ID NO: 401061 - RNA, 62 nt, Human
uauguuauaaaagaggauuuucccaccuugacaccaggcaauguaguuagcauauuuuaugu

SEQ ID NO: 401062 - RNA, 62 nt, Human
agcugcugaccaaaccccacagaacagagggcaccaggcaucacacgacaucuuucccuccc

SEQ ID NO: 401063 - RNA, 62 nt, Human
cuugagcaagugagaagagaggccaggguccaaccaggcacccguccuugggaccagcagua

SEQ ID NO: 401064 - RNA, 62 nt, Human
aaaaugaugaugaugauaaaaaccacgacccaaccaggcacaggacuuuuuuguuuuuugca

SEQ ID NO: 401065 - RNA, 62 nt, Human
gcugcagccuuggaaggaggcaccgacacgacaccaggcaggagugagccucaggccccguc

SEQ ID NO: 401066 - RNA, 62 nt, Human
acuugggaggcugaggcaggagaaucgcuugaaccaggcagucggaacuuguagugagccaa

SEQ ID NO: 401067 - RNA, 62 nt, Human
agccucuaacagcacagggaagcaaauaucuuaccaggcagccuaugaauuaacccaaagaa

SEQ ID NO: 401068 - RNA, 62 nt, Human
gaugggauugcacgguuuggguauucuuaaugaccaggcaaaugccuuaaguaaacaaacaa

SEQ ID NO: 401069 - RNA, 62 nt, Human
uguuggaaggguuaauuuauuccugaauuaguaccaggcagugaauaagcccuaggcagaau

SEQ ID NO: 401070 - RNA, 62 nt, Human
ucccuggcuccaggggugugggggaccccagaaccaggcagagugggaacuugaaacuguug

SEQ ID NO: 401071 - RNA, 62 nt, Human
ugaccacugggacuucaggcaagaagcucaccaccaggcacacagcaaagggacugaacuga

SEQ ID NO: 401072 - RNA, 62 nt, Human
uuggccucucugguccccauggacuuagggggaccaggcaagaacucugacagagcuuuggg

SEQ ID NO: 401073 - RNA, 62 nt, Human
uccucaucaucgcucauaagcugcuggucuaaaccaggcagccucucuugcuaggaggccac

SEQ ID NO: 401074 - RNA, 62 nt, Human
gggugaaaaagcccaaaugcugcugugguucaaccaggcaagaucauccggugaaagaacca

SEQ ID NO: 401075 - RNA, 62 nt, Human
aaaacacgugauguaaacuugcaagcauaucaaccaggcaagucuugcuguaaaaaugaaaa

SEQ ID NO: 401076 - RNA, 62 nt, Human
gacucggggacuuggcuuccuuccuggcaaggaccaggcaguggggaaggaggagguccucc

SEQ ID NO: 401077 - RNA, 62 nt, Human
caacuauaaaacuaggugcugcagccccugggaccaggcacccccagaaugaccuggccgca

SEQ ID NO: 401078 - RNA, 62 nt, Human
aauggugggagagagucugcugcaagggugagaccaggcagccugcugggccacacuguccu

SEQ ID NO: 401079 - RNA, 62 nt, Human
caacccugucucuacaaaaaauacaaaaauuaaccaggcaugguggcaugcaccuguagucc

SEQ ID NO: 401080 - RNA, 62 nt, Human
ucuucauauaccucccuuuaguuaaguaauagaccaggcagcuucucaucucagcauuuacc

SEQ ID NO: 401081 - RNA, 62 nt, Human
ucuuaacuagguuuacaacugguggaccacacaccaggcacuaaucaccuggugaggauuug

SEQ ID NO: 401082 - RNA, 62 nt, Human
ugcaggcgaggccgcggccccagaguccccgcaccaggcagagccguaccugucacccuccc

SEQ ID NO: 401083 - RNA, 62 nt, Human
cagugcuuagggccuacugagggaaagaaguaaccaggcaacuacaaaacagugauaaguau

SEQ ID NO: 401084 - RNA, 62 nt, Human
agggagcccucugcacucgugugcaggcucugaccaggcagaacaggcaagaggggagggaa

SEQ ID NO: 401085 - RNA, 62 nt, Human
ccaaccccuccccugccuccaccauauccacuaccaggcacccuuuagaacaggggucuggg

SEQ ID NO: 401086 - RNA, 62 nt, Human
agcugcuaggcugaggcugcauggacaggaacaccaggcacccuccgugugcuucugagcug

SEQ ID NO: 401087 - RNA, 62 nt, Human
gccugcacagcuguggccguggagcugaccugaccaggcaaggcugcugucuccaucccuga

SEQ ID NO: 401088 - RNA, 62 nt, Human
ggacuuccgcccuaaggcugugccucacugccaccaggcacagccgccuccggaaugcacag

SEQ ID NO: 401089 - RNA, 62 nt, Human
ccaccguggucuuugaacucacccaagcacccaccaggcaggcuacaagugaggcuaccuuu

SEQ ID NO: 401090 - RNA, 62 nt, Human
caggccuaauaguuaaaagcaaguugagacaaaccaggcagauucaguguguggaacaggaa

SEQ ID NO: 401091 - RNA, 62 nt, Human
ggccggguaucaauuauugcuugcuguuugcaaccaggcauaaaaucacuuucucaaaucau

SEQ ID NO: 401092 - RNA, 62 nt, Human
uccucucccucugcaugugucuaaaaggugguaccaggcaucccuuuccuggcuuauggcca

SEQ ID NO: 401093 - RNA, 62 nt, Human
ugggcaaggcgcucaggcaugcaaccaugggcaccaggcaauacccauccaucacccaucuc

SEQ ID NO: 401094 - RNA, 62 nt, Human
cuaucucacacugcaccaagcacccacugugcaccaggcacuaagucucuagccucuuucuc

SEQ ID NO: 401095 - RNA, 62 nt, Human
ucauggcacuuuuuaacgcuucagcaacaaacaccaggcagcuguugccacuggccuccuac

SEQ ID NO: 401096 - RNA, 62 nt, Human
agaggugagaauggggaggcaagaucucaggcaccaggcaggaggugccuuguaagcuaacu

SEQ ID NO: 401097 - RNA, 62 nt, Human
gauguuauuuuguaaacagaugacauuuucugaccaggcacaugccauccaauuuucuguca

SEQ ID NO: 401098 - RNA, 62 nt, Human
aggugcagggggaccuuaggcacgccccaagcaccaggcaccagggcccaaggacgcgcagg

SEQ ID NO: 401099 - RNA, 62 nt, Human
guuaaugcuuugugccuggugcucuguaaugaaccaggcaaugagauaguuuucucaguuug

SEQ ID NO: 401100 - RNA, 62 nt, Human
ggaagauuccaaagacguuuaccaguaauaucaccaggcaccugcagaagaggaaaaucacu

SEQ ID NO: 401101 - RNA, 62 nt, Human
ggugagguggguuuucuucccaucacuggagcaccaggcacgaacccaccugcugagagacc

SEQ ID NO: 401102 - RNA, 62 nt, Human
cagcuaaguauuaauccccagugcuaaaagauaccaggcaucuaguuuagcaauggagggaa

SEQ ID NO: 401103 - RNA, 62 nt, Human
uuccucucccagcuccaucucuuucccuagggaccaggcacucauauggcgggguggggucc

SEQ ID NO: 401104 - RNA, 62 nt, Human
gcagccucccgccuggaagggccugugccagcaccaggcagagggcaagacggagagggcag

SEQ ID NO: 401105 - RNA, 62 nt, Human
gcagcaaacguuguuuaagcauuuuaguuugaaccaggcauuguguuaggaauccagggaua

SEQ ID NO: 401106 - RNA, 62 nt, Human
uaauaagaugggugccuacugugaugcauuuuaccaggcauuuuaccuucauuauuacucau

SEQ ID NO: 401107 - RNA, 62 nt, Human
gacucagacugugcauguugggaaggggucugaccaggcaagcugugaucugaaaggagcaa

SEQ ID NO: 401108 - RNA, 62 nt, Human
gucucuguggccacccgggugucacugccagcaccaggcacugcuuucacguaaaaugucca

SEQ ID NO: 401109 - RNA, 62 nt, Human
caucuggcuuggagcaaguggguguucugcacaccaggcagcugcaccucacuggaucuagu

SEQ ID NO: 401110 - RNA, 62 nt, Human
guuuuguguagcuucagaguuagauugaaauuaccaggcacagauuuagucuugucauuuug

SEQ ID NO: 401111 - RNA, 62 nt, Human
augggggcaggagcucccauccugggcagccaaccaggcaacaccaaggacucuuuguaaac

SEQ ID NO: 401112 - RNA, 62 nt, Human
gaccuuauccuggcagaggcuauaaaagauucaccaggcacuggcaugaagaaagagucuuu

SEQ ID NO: 401113 - RNA, 62 nt, Human
aauaaaagcuuuuaauugagaaccuacuauugaccaggcacuguucaagacacuagaacauu

SEQ ID NO: 401114 - RNA, 62 nt, Human
cgucccccuaggagcagacccaagcuuguggcaccaggcaucugauggugccaggaaagcca

SEQ ID NO: 401115 - RNA, 62 nt, Human
acggcugcggacacuggcuccuuccacgucucaccaggcagacagucugccuaggacccagu

SEQ ID NO: 401116 - RNA, 62 nt, Human
ggcaugccgccuccgggaaugagacccccuccaccaggcauuagaggugagugggagcauag

SEQ ID NO: 401117 - RNA, 62 nt, Human
ccccagcccaccccuaagcauggucccuugucaccaggcaaccaggaaacugcuacuugugg

SEQ ID NO: 401118 - RNA, 62 nt, Human
acuuagguuuuguccaucagauucugugagacaccaggcaucguuuugaggauguggguuau

SEQ ID NO: 401119 - RNA, 62 nt, Human
cuugcccagcaaacccugcgugccauucuucuaccaggcagccgagaacagggagauaaaca

SEQ ID NO: 401120 - RNA, 62 nt, Human
ccaucucuggaugccugauugccaagcucaggaccaggcaaugugacuuugcaucagcaaca

SEQ ID NO: 401121 - RNA, 62 nt, Human
ugggccugggguaccaagagacuccuugagagaccaggcaaagcaagugauugggacagagg

SEQ ID NO: 401122 - RNA, 62 nt, Human
cgggcugguucucuccgggccaccuucuccccaccaggcacugcagcagacggagcuguacu

SEQ ID NO: 401123 - RNA, 62 nt, Human
cuccucuaagaaucagaguaggguaacaauguaccaggcaaauuguaaguugaaauucuaga

SEQ ID NO: 401124 - RNA, 62 nt, Human
augacuuuuuaaggaaauguaauacaagucaaaccaggcaauacagaggagaagggaaaggc

SEQ ID NO: 401125 - RNA, 62 nt, Human
uuggcgggcaucgccgacccuauuauuccauuaccaggcacuccgccacccacaugccaacu

SEQ ID NO: 401126 - RNA, 62 nt, Human
cagguuccucuaacaucugucacugucacuucaccaggcaggccuuggaguuccaugacaaa

SEQ ID NO: 401127 - RNA, 62 nt, Human
cucacucugcaccccaccagggucccgcucacaccaggcagccuucauaguggucucccugg

SEQ ID NO: 401128 - RNA, 62 nt, Human
augggcaggggucucuucucaucaagccuuguaccaggcaaaagacaggcccugcuuggccg

SEQ ID NO: 401129 - RNA, 62 nt, Human
agauuuuccugagaugacugaguauggagauuaccaggcagaugauaccgaaaugcuuaaag

SEQ ID NO: 401130 - RNA, 62 nt, Human
ucuguacauuucuagaugcaaauaacuccuucaccaggcagugaguggcguaggcucuggag

SEQ ID NO: 401131 - RNA, 62 nt, Human
caucuggacaacagccacaagggggcgcucggaccaggcagccacuuuccuggugcucucug

SEQ ID NO: 401132 - RNA, 62 nt, Human
cccugcuacauaccccuguuccagcauuaacuaccaggcaccaaaacaguaggcauuagugc

SEQ ID NO: 401133 - RNA, 62 nt, Human
cuggugccccuuuccccccacuuucagggcucaccaggcacuggcagggaggguaagggcug

SEQ ID NO: 401134 - RNA, 62 nt, Human
guucacuggacucugauaguuggagcucccagaccaggcagugcugggagcaaccaccuuug

SEQ ID NO: 401135 - RNA, 62 nt, Human
gacagccccagguggccaggccuccaggaggcaccaggcaggcccuguaucaggcuaggacg

SEQ ID NO: 401136 - RNA, 62 nt, Human
acugauaccugagcccuuugugucugcuacaaaccaggcaggugguguguguggacucacac

SEQ ID NO: 401137 - RNA, 62 nt, Human
aucugcccugggguggaggcaccaucaccaucaccaggcaugucugcagagccuggacacca

SEQ ID NO: 401138 - RNA, 62 nt, Human
gccauccagggcuacccacugcuuacucagggaccaggcagcccccauggcaguaaaagcag

SEQ ID NO: 401139 - RNA, 62 nt, Human
aagcccuggcuggccccacuugguaccaauccaccaggcagcucagggcuccugcccagccc

SEQ ID NO: 401140 - RNA, 62 nt, Human
aguggaccuagccuggauggccccuccuugcaaccaggcagcugagaccagggucuuaccuc

SEQ ID NO: 401141 - RNA, 62 nt, Human
agcggguggcauccaggcugcccguguguugcaccaggcacugcugcacaacaagauacgcu

SEQ ID NO: 401142 - RNA, 62 nt, Human
uacacauugccuucaucuguacauucugugauaccaggcaaauuaccaauuacacacagcua

SEQ ID NO: 401143 - RNA, 62 nt, Human
accuacgagugaaacucuguccucccgcgaggaccaggcaucgcugugugaggacggcacgg

SEQ ID NO: 401144 - RNA, 62 nt, Human
ggggagccauccccgccgcccucacaggacccaccaggcagcggagacauguggaauuagag

SEQ ID NO: 401145 - RNA, 62 nt, Human
gccggcaggcgccccuguacgucugcucaugcaccaggcagcacagccgcaguuccucaguu

SEQ ID NO: 401146 - RNA, 62 nt, Human
gccaccagugauccccaagcauccaguacagaaccaggcaucgagcuagcucccugcacggc

SEQ ID NO: 401147 - RNA, 62 nt, Human
cccuugcacuggacuacgccaaaaccacacugaccaggcacuugccuucccucucuuccccc

SEQ ID NO: 401148 - RNA, 62 nt, Human
cuaaaaagaauaggcugaggaggaagucuucuaccaggcauauucaugcgcuugaacuagua

SEQ ID NO: 401149 - RNA, 62 nt, Human
uagggagcuggggcuggggcuccccucccaugaccaggcaguggucaccccaugggacaggc

SEQ ID NO: 401150 - RNA, 62 nt, Human
uggugccaaaccccaaaucuccaaagagacauaccaggcaagacaaacccccaaacaccucc

SEQ ID NO: 401151 - RNA, 62 nt, Human
ucuggccugcacccuugacaaaggaccccaggaccaggcagaaggcgccuccguccuagcca

SEQ ID NO: 401152 - RNA, 62 nt, Human
acacaggaguaaguagcagugcugguauuugaaccaggcauccuggcuccagagcccauucu

SEQ ID NO: 401153 - RNA, 62 nt, Human
gccuuuggucaguaaugcguucaggaguccacaccaggcacagauggggccuugaaacgcuu

SEQ ID NO: 401154 - RNA, 62 nt, Human
cuagaaaucaaacaacuuggaaaucgaucacaaccaggcauuaaguucacaguaagaucauu

SEQ ID NO: 401155 - RNA, 62 nt, Human
ucauucuaacaacccagguuauuuucaaucagaccaggcauucgauaacacacuaagggggu

SEQ ID NO: 401156 - RNA, 62 nt, Human
uauuuuuaacaccagaaagaaccuugccgaucaccaggcauaaccuaauuuuauccauggaa

SEQ ID NO: 401157 - RNA, 62 nt, Human
acaggagcccugcugccagaacaggccuccauaccaggcauguguuucucucuaaacgccau

SEQ ID NO: 401158 - RNA, 62 nt, Human
uauggagguuccacgucuuucuuuaggcagggaccaggcaggacuucagaaaaacccucaug

SEQ ID NO: 401159 - RNA, 62 nt, Human
accaagggaggcacaauuagaggcagagggaaaccaggcagacggcugcucuuuuugaguug

SEQ ID NO: 401160 - RNA, 62 nt, Human
uguuguuuuaaaauauuaugauuuggcuacagaccaggcagggaaagagacccgguaauugg

SEQ ID NO: 401161 - RNA, 62 nt, Human
accuccccccucgucaccagccaucccucuggaccaggcagagggcggaccgggugggcagg

SEQ ID NO: 401162 - RNA, 62 nt, Human
cagaaaggggaccccggagccgagcgaggaggaccaggcagccgccgcugccgcgcuaagcc

SEQ ID NO: 401163 - RNA, 62 nt, Human
cccccucgaaguucagguucagcuccuggaugaccaggcaccgcuguugagcagccuggugg

SEQ ID NO: 401164 - RNA, 62 nt, Human
uuguauuuuuccuucuuuaaaauugcaucuugaccaggcacaguggcucaugccuauaaucc

SEQ ID NO: 401165 - RNA, 62 nt, Human
ccaucucuacacacaaaaaaauuuuuuaaugaaccaggcauuguggcaugcgccuauagucc

SEQ ID NO: 401166 - RNA, 62 nt, Human
uuguagcuggccagagggacgccgcagcugggaccaggcacgcggcccauggggcugggccc

SEQ ID NO: 401167 - RNA, 62 nt, Human
acccagaguggcccaagacucccagaucagcuaccaggcaggauauuccaagggcuuagaga

SEQ ID NO: 401168 - RNA, 62 nt, Human
cauagcucacacucacugagcaccuacuggguaccaggcaccauucucaguguuucaccugg

SEQ ID NO: 401169 - RNA, 62 nt, Human
cagcauccccuugguaaagacccccgcaggccaccaggcauucuggacacgcacacacacac

SEQ ID NO: 401170 - RNA, 62 nt, Human
caucauucaccauuuauccaggauggccgcucaccaggcaauuugcuaggcucgggggcggg

SEQ ID NO: 401171 - RNA, 62 nt, Human
cuuuucguauugcuuagaauaugacaugcugaaccaggcaugguggcucaugcuuguaaacc

SEQ ID NO: 401172 - RNA, 62 nt, Human
caaacaggcaugccccuuagaagacaugccuaaccaggcacuguaacguaccaacguaccaa

SEQ ID NO: 401173 - RNA, 62 nt, Human
ccugugagagccaccucacaggcagagcccccaccaggcagggcaaggagacuccgcucacu

SEQ ID NO: 401174 - RNA, 62 nt, Human
cugcuucguuccaccccggguccugguggagcaccaggcaggugguccucgcugugacacug

SEQ ID NO: 401175 - RNA, 62 nt, Human
ggguguggggcccgugggaugggccucaggccaccaggcaauaaccacagggccugcagcag

SEQ ID NO: 401176 - RNA, 62 nt, Human
ccgguuugcuuccaaaugaaggccauuuguccaccaggcauugaaaagacaugacuuaccca

SEQ ID NO: 401177 - RNA, 62 nt, Human
ggcacaauggcagcccugccugggaggacuggaccaggcaguggcugcagagggagccuccu

SEQ ID NO: 401178 - RNA, 62 nt, Human
ggaaaccauugcccuccagaacaaccgugagaaccaggcauucagguaaggggggcccugcc

SEQ ID NO: 401179 - RNA, 62 nt, Human
ccccaucucuacuaaaaauuaccaaaaaaugaaccaggcaugguagugcaugccucuaaucc

SEQ ID NO: 401180 - RNA, 62 nt, Human
aaaaaaagguagggggagcaaaaccaucaaccaccaggcagccaggccaucagcccaccucc

SEQ ID NO: 401181 - RNA, 62 nt, Human
agaagcuucucuggauguguaaagcacaggaaaccaggcagaggaggcacagggugcucucc

SEQ ID NO: 401182 - RNA, 62 nt, Human
ugauuuugucgugagagauccacucaauaaaaaccaggcaaauguagugaaucuggaaaggu

SEQ ID NO: 401183 - RNA, 62 nt, Human
ucaugaagaauagcaaacucaucccuguagggaccaggcagguaacauagacgagugacucu

SEQ ID NO: 401184 - RNA, 62 nt, Human
gcugugugaccauccagggguggagggggaaaaccaggcaauuucguuccuggaaucaacca

SEQ ID NO: 401185 - RNA, 62 nt, Human
cauggcagggguggauucgggagcugggaguaaccaggcaaagucaaccagaugccuagcuc

SEQ ID NO: 401186 - RNA, 62 nt, Human
agggcaaguggaugggaauuugucagcguucuaccaggcaaauucacuguuucacugaaaug

SEQ ID NO: 401187 - RNA, 62 nt, Human
aaggcuggaaggcauagaacuggcaccuugggaccaggcauaauggcucacaccuauaaucc

SEQ ID NO: 401188 - RNA, 62 nt, Human
auucugggaacauguuguaagcacugacugggaccaggcaccaggcagggucuagaaggcug

SEQ ID NO: 401189 - RNA, 62 nt, Human
gaacauguuguaagcacugacugggaccaggcaccaggcagggucuagaaggcuguggugag

SEQ ID NO: 401190 - RNA, 62 nt, Human
aucauaaagacacugccugucuucuaggaaugaccaggcacccagcucccacuggacuccaa

SEQ ID NO: 401191 - RNA, 62 nt, Human
ccaacaguuagacauugaggggcuucacuguuaccaggcauguaacagaaggaggaagacua

SEQ ID NO: 401192 - RNA, 62 nt, Human
ggaguucugcccaggggugcugcauaucggucaccaggcacccagggccaugccagggaaag

SEQ ID NO: 401193 - RNA, 62 nt, Human
ucucuacgguuuuauaaaagccuuggguuccaaccaggcaguagaugugcuucugaaccgca

SEQ ID NO: 401194 - RNA, 62 nt, Human
cuguuccuggucccggucccggucccagucccaccaggcaacuccuuccacccggaaauucu

SEQ ID NO: 401195 - RNA, 62 nt, Human
gugaauuacacucaaggaaaagaugugcucccaccaggcagcuccagcuguuaccugagaua

SEQ ID NO: 401196 - RNA, 62 nt, Human
gagaggcuuccucaguccagucgcuccuuagcaccaggcaccguggguccuggauggggaac

SEQ ID NO: 401197 - RNA, 62 nt, Human
gaguaagugagggaugucuccaucuugagaucaccaggcaagagaguugccugcaccaggua

SEQ ID NO: 401198 - RNA, 62 nt, Human
cuuccuaggaauguuuagcagcaaccgaauauaccaggcaaaacuccuuggugccugcgcug

SEQ ID NO: 401199 - RNA, 62 nt, Human
ugcugacugugggguguggauggggcugcagcaccaggcagagccccucagggcgccgaugu

SEQ ID NO: 401200 - RNA, 62 nt, Human
agagacccauggccaucuuuguggcugugggcaccaggcaugggacugagcccaugucuccu

SEQ ID NO: 401201 - RNA, 62 nt, Human
aggcuggacucagcaggaacaccaaaucccggaccaggcagaaaccacccaagacugagggg

SEQ ID NO: 401202 - RNA, 62 nt, Human
agacuaacggcuaaagagacugaugcaucaacaccaggcagagaauaaagcagauuuuuuug

SEQ ID NO: 401203 - RNA, 62 nt, Human
ccuugggcuccuugggccuagagccacuucuuaccaggcaacgggcacagccacccuggcac

SEQ ID NO: 401204 - RNA, 62 nt, Human
gcaggauuggggaagagagccugcaggaucucaccaggcagccucugggggguggccaggcc

SEQ ID NO: 401205 - RNA, 62 nt, Human
cucuuccucuccccugcucuaccuucuccggcaccaggcagccccuuaaaggaggacaaagu

SEQ ID NO: 401206 - RNA, 62 nt, Human
cccgcucugcccacggcuguguacgacaucagaccaggcacucucagggccgcucuccagcu

SEQ ID NO: 401207 - RNA, 62 nt, Human
ggcugggccagccugcugcugucugcuucaggaccaggcagagagugaggcuggggguucuc

SEQ ID NO: 401208 - RNA, 62 nt, Human
cagccucccgagugcugacccacauggucaagaccaggcagaagcucccagagccccugucu

SEQ ID NO: 401209 - RNA, 62 nt, Human
uaguuccauccacgcucaagacccgcccuuagaccaggcaggcaaaggcccccaucacacuc

SEQ ID NO: 401210 - RNA, 62 nt, Human
aggaggaggagucaagggagcagggcagcucuaccaggcaagguguuuccccagcauaggcg

SEQ ID NO: 401211 - RNA, 55 nt, Human; identical to SEQ ID NO: 305984

SEQ ID NO: 401212 - RNA, 62 nt, Human
cuguagaaacuaacauuagcuauuauacacuaaccaggcauuuuucccaaauuaauuacaau

SEQ ID NO: 401213 - RNA, 58 nt, Human; identical to SEQ ID NO: 305986

SEQ ID NO: 401214 - RNA, 62 nt, Human
gauguugccuugaccagccuuggcuggacuuuaccaggcaugcagaagccuguaccaacaca

SEQ ID NO: 401215 - RNA, 62 nt, Human
gcauguuuacugcucuaugccuccugauccagaccaggcauugcccagccugggaaucuuuu

SEQ ID NO: 401216 - RNA, 62 nt, Human
uauaagcaaaggggucagggcaagugugacccaccaggcaaaauugagcagcauuuucauag

SEQ ID NO: 401217 - RNA, 62 nt, Human
cacacuuggguuuagggguguuuuuuuuuaaaaccaggcagguuagcuagcccacccugugc

SEQ ID NO: 401218 - RNA, 62 nt, Human
gcugcagauacuacugaccagacaagcuguugaccaggcaccuccccucccgcccaaaccuu

SEQ ID NO: 401219 - RNA, 64 nt, Human
gugauaaauuguugauaaauuccacuggacuugagcuuggcagcugaacuauuggaggguggga

SEQ ID NO: 401220 - RNA, 64 nt, Human
gcagagagggcugguuagccggaaaaggccucgggcuuggcaaauggaagaacuugagugagag

SEQ ID NO: 401221 - RNA, 64 nt, Human
cugggauacccaguucuguuuucaguaucaucuggcacacaacuguccaagcucucagccccac

SEQ ID NO: 401222 - RNA, 64 nt, Human
agggugcuacuugggggauaucuauuacuaaucagcacacaauagcugggugggcacccccucu

SEQ ID NO: 401223 - RNA, 64 nt, Human
uuauuucuuacaggcacaaaaugauggacccaaugcacacaaaacaacccuagaguguuguuga

SEQ ID NO: 401224 - RNA, 64 nt, Human
gacuaaggggcagcuccugaccaaagacgauacagcuuggcacuuuaaagcauuaacagcaggu

SEQ ID NO: 401225 - RNA, 64 nt, Human
caccgcugggcccaucaguguguguuggggggaugcuuggcagcugggggugaggagacaacaa

SEQ ID NO: 401226 - RNA, 64 nt, Human
uagucuaacccuuuuaaugccuuuaccucaaguugcuuggcagcacaacuaucuuugcaaaaaa

SEQ ID NO: 401227 - RNA, 64 nt, Human
accuacauaagucuauuccauuauuauauuuugcgcuuggcauauuuauuccuuuaugcuuuua

SEQ ID NO: 401228 - RNA, 64 nt, Human
guagagucacucaacuuacaacuuuauuuauguggcuuggcaaaaaucacuauaaggcagcucu

SEQ ID NO: 401229 - RNA, 64 nt, Human
guguguuaucuguaaccauuacagccuaaauaaagcuuggcaacuuuuuuuccuuuuuugcuuc

SEQ ID NO: 401230 - RNA, 64 nt, Human
aguaagauuguggcaagaccuggcacuccuccaagcuuggcacagugagcccaccagcucagau

SEQ ID NO: 401231 - RNA, 64 nt, Human
ugggcuucuuccuccaagaucucagucucucagugcuuggcagaggggugaggcccuggggagg

SEQ ID NO: 401232 - RNA, 64 nt, Human
uuccccacccuccauugccuggcccaggugagcagcuuggcaggucuccaaguggaacccgguc

SEQ ID NO: 401233 - RNA, 64 nt, Human
gaagaacgagggcugacagccagccuggaagaccgcuuggcagcccuucuggccacggcuguuu

SEQ ID NO: 401234 - RNA, 64 nt, Human
cauuuuguugauugucuuucuucauagcuucucugcuuggcaaagagaugggagggggccagau

SEQ ID NO: 401235 - RNA, 64 nt, Human
uacugaagaucccuuugaccaggaugacuggggagcuuggcagaaguucacggccagugcagga

SEQ ID NO: 401236 - RNA, 64 nt, Human
ugccaaagcuuucugcaggagggugaaugccgcagcuuggcagccccuggguuucucuuggaaa

SEQ ID NO: 401237 - RNA, 64 nt, Human
ugggcaagggcagcucaagaggacaggaccaggcgcuuggcaagacaucagacacacccaaccc

SEQ ID NO: 401238 - RNA, 64 nt, Human
ccuggcagaaagcaggcgaagggcaggaggagcugcuuggcagaaggaccuccugcccagaccu

SEQ ID NO: 401239 - RNA, 64 nt, Human
ggugcccgcucagcucagcaagguucucaacugccucgaguacccaccagaccaagaaggccug

SEQ ID NO: 401240 - RNA, 64 nt, Human
ccuccucugaaacagcugccuuagcuucaggaaccucgaguacugugggcaauuuagaaaaaga

SEQ ID NO: 401241 - RNA, 64 nt, Human
ggcaaaggccagggaggggacccagagaggccuggcacacaaggcccaagcaccaccgucaaca

SEQ ID NO: 401242 - RNA, 64 nt, Human
aaccaucuguuuggggagcacacucuuccauuaugcuuggcacauagaucucccugugguggga

SEQ ID NO: 401243 - RNA, 64 nt, Human
guuggcaacuuucccaaugucugcuuacucugaggcuuggcacugggggccagggccugcccca

SEQ ID NO: 401244 - RNA, 64 nt, Human
agucauugaaggguguucacccaucccacccaaggcuuggcacacugccagugucuuagcaggg

SEQ ID NO: 401245 - RNA, 64 nt, Human
agacaugguacgcauuccagggcugaauacuauugcuuggcauucuguauguauauacuaguga

SEQ ID NO: 401246 - RNA, 64 nt, Human
aaaaguaaaacaaacaaaaacaaaccugaaaacugcuuggcauuugaguagcuucuccaugcua

SEQ ID NO: 401247 - RNA, 64 nt, Human
agaguuaaaaacaaccacaggucaugagcaguaggcuuggcaguuauaccccaugcagucauag

SEQ ID NO: 401248 - RNA, 64 nt, Human
cgcaaacacugcgugacagcucuguaugacugacgcuuggcagcagcuuuuguguccggucacc

SEQ ID NO: 401249 - RNA, 64 nt, Human
uaaagucaagauauuuuucucugaagugauuucugcuuggcacgcuacccucaucaucuuacuc

SEQ ID NO: 401250 - RNA, 64 nt, Human
uccagucauaaaaauguguucuuuacaaauauuugcuuggcaacacgacuugaaauaaauaaaa

SEQ ID NO: 401251 - RNA, 64 nt, Human
cuuugcauccguuguagcuggguuuagugaacuugcuuggcagugauauuucagcuuggacauu

SEQ ID NO: 401252 - RNA, 64 nt, Human
uccccuugugucagagacagaccccuuggcuuuugcuuggcagagaggaccccacuggacuggg

SEQ ID NO: 401253 - RNA, 64 nt, Human
acccuuugcuucccuucaccucuuguaaaauuuggcuuggcaacaaugacauugucaugcuuau

SEQ ID NO: 401254 - RNA, 64 nt, Human
uuugaacuaugugcagcuagcuuuguuuuaaucugcuuggcaaccaguguagcugcuguaacaa

SEQ ID NO: 401255 - RNA, 64 nt, Human
gcaaggccacccgcgggggcgugugugugguggggcuuggcaugugauggcagcuccaggcaug

SEQ ID NO: 401256 - RNA, 64 nt, Human
uuaaugugagaccacagguggcaggcagauuccugcuuggcauaagcauuuguaggucuucauu

SEQ ID NO: 401257 - RNA, 64 nt, Human
acauggccuuagugaguccugccuuuccuagcaugcacacaacauccucucuuugaguuugggu

SEQ ID NO: 401258 - RNA, 64 nt, Human
ccugcuuuucuuuccuacuccuuuccacacauacgcacacaaucuucuaccuuuuaaaggauca

SEQ ID NO: 401259 - RNA, 64 nt, Human
guggugauggcccuaaguuaagcaaaaugcuucugcacacaaaacucucugguuuacuucaaau

SEQ ID NO: 401260 - RNA, 64 nt, Human
uucucugggcagguggccauggggaggggccauggcuuggcauguccaacagaaauaguuuuug

SEQ ID NO: 401261 - RNA, 64 nt, Human
cagcuccaggcaggaaaccccgagaaggaauggugcuuggcaggaaccauggaccugcacuugg

SEQ ID NO: 401262 - RNA, 64 nt, Human
gccuggcuucaacauugggccaguaggcaucuuagcuuggcaggugucgggggaaugggccaga

SEQ ID NO: 401263 - RNA, 64 nt, Human
uuuuuugcuacaugagugcauuuaucuuuuaaaugcuuggcaauguuaaauguauuuauuaacu

SEQ ID NO: 401264 - RNA, 64 nt, Human
gaugcuuaggcaggguacuucguucaagaccggcgcuuggcacccuuguuggaaagggauuuuc

SEQ ID NO: 401265 - RNA, 64 nt, Human
aaacgggccccucucucgggggaaccggacagcagcuuggcaaaggccucccuaaaaggccgca

SEQ ID NO: 401266 - RNA, 64 nt, Human
ucaaagagaaucaagaaauaauaagguauaacaagcuuggcaaaguguuggcuuuuuaaaaaaa

SEQ ID NO: 401267 - RNA, 64 nt, Human
aaauccagugaaaacucucaguucuuguuucacugcuuggcaguauugacauugaauauucucu

SEQ ID NO: 401268 - RNA, 64 nt, Human
cuggacacauaggccauuauccuguauuccuuuggcuuggcaucuuuuagcucaggaagguaga

SEQ ID NO: 401269 - RNA, 64 nt, Human
ggaggagcuagggacuaacuguugcucuuggugggcuuggcagggacuaggcugaagauguguc

SEQ ID NO: 401270 - RNA, 64 nt, Human
cuggacauauacugggcuucacacuuaucuuauggcuuggcagaaucuuuguagugugugggau

SEQ ID NO: 401271 - RNA, 64 nt, Human
gcugagagagucagcaggcagagccagaugccaugcuuggcagcagcaguaggacuauaaacca

SEQ ID NO: 401272 - RNA, 64 nt, Human
aacucccuugcccuucucuugcuuugucaugcucgcuuggcaaaaccucaucucugacuaaaug

SEQ ID NO: 401273 - RNA, 64 nt, Human
aggaugcaugugaggagcccaugggaugugccuggcuuggcacauuguggcauuuuuccuugcc

SEQ ID NO: 401274 - RNA, 64 nt, Human
gguguuuguucuauauuauaaaucugcugucuuugcuuggcauuuuauaguuaaauuaauuaga

SEQ ID NO: 401275 - RNA, 64 nt, Human
aaaauuguauauucagugacuuacacuaugccuagcacacaacacacacugaguaaauauuugu

SEQ ID NO: 401276 - RNA, 64 nt, Human
uuaaacauuauuauuaaaauaaauuauuucauuugcacacaaugauaauaaugaugauaauaau

SEQ ID NO: 401277 - RNA, 64 nt, Human
uuucaagaauguuucaguuauagagguaaaauuugcacacaaaacaucuuaggcacuuuuuaac

SEQ ID NO: 401278 - RNA, 64 nt, Human
acccugcagucauuggagcacccgggucagcaaagcacacaagcucacucaagaccagauggag

SEQ ID NO: 401279 - RNA, 64 nt, Human
gaaguaacucgacuauagaguuauguucugcuuugcuuggcacaaaauaaauguaaccuggagg

SEQ ID NO: 401280 - RNA, 64 nt, Human
ucucagauauccuacggugagaagcuuaccauaagcuuggcaccuauaccuugaauaucugcua

SEQ ID NO: 401281 - RNA, 64 nt, Human
ugagaagccaggaggccugcaccaaaugucagaagcuuggcaugaccucauuccggccacauca

SEQ ID NO: 401282 - RNA, 64 nt, Human
acugcacuaaauguuuuccucuguuuuacaaacugcuuggcagccccaggugaagcaucaagga

SEQ ID NO: 401283 - RNA, 64 nt, Human
agccuggaagaggagaaaauguggcuccucuggagcuuggcagaccacuuuucggucuuugcgu

SEQ ID NO: 401284 - RNA, 64 nt, Human
cagcugugccuagggcgccccuccuaccccggcugcuuggcaguugcagugcugcugucucggg

SEQ ID NO: 401285 - RNA, 64 nt, Human
ggcugccuuaggaaggaagaggugccccuggugggcuuggcagcagggacagggugcccuugga

SEQ ID NO: 401286 - RNA, 64 nt, Human
caaacagcccuccgggccuuuacgcuggacucuggcuuggcaggcuccaggcaggguccucugg

SEQ ID NO: 401287 - RNA, 64 nt, Human
acucuauuacguuuguauaguaaguuuguaaacugcuuggcaaacugauuaagaaauaauuugc

SEQ ID NO: 401288 - RNA, 64 nt, Human
agugacauggcccaggcuuuccuuccagggccaugcuuggcaagguuggcugagggcacccucc

SEQ ID NO: 401289 - RNA, 64 nt, Human
uuguucauaguguauccccagagccuggaccagugcuuggcacauaggagauggcaauaaaugc

SEQ ID NO: 401290 - RNA, 64 nt, Human
acucuggagauucuagcaagaagugccaagauuggcuuggcaucugcacuccagcccaggacug

SEQ ID NO: 401291 - RNA, 64 nt, Human
uccagggcgcaggggagggugcggcagggcaggagcuuggcagagagauagccgggcuccaggg

SEQ ID NO: 401292 - RNA, 64 nt, Human
gcaucucuuuccaguuuugcauccagugacgucugcuuggcaucuugagauuguuauggugaga

SEQ ID NO: 401293 - RNA, 64 nt, Human
caucaagucuccacguguuucgggccagggcguggcuuggcauugaccuucaugaccuuacaua

SEQ ID NO: 401294 - RNA, 64 nt, Human
auauuugcaaacuucuuuauaaaaggugaaaaaagcacacaaaagagagggugucuucauauua

SEQ ID NO: 401295 - RNA, 64 nt, Human
gauuucaguucacggcgauaaagaaguaggugcugcacacaaauauguaaagcaauuguaggaa

SEQ ID NO: 401296 - RNA, 64 nt, Human; identical to SEQ ID NO: 162811

SEQ ID NO: 401297 - RNA, 64 nt, Human
uucucccccauuauuuggccaggaauugagcuuggcuuggcaaaguuccuuuuacccuguucug

SEQ ID NO: 401298 - RNA, 64 nt, Human
ggggaaugcugugguuugcauuuucauauucuucgcuuggcaguguguauucuuuucacaaguu

SEQ ID NO: 401299 - RNA, 64 nt, Human
agacccccaucucugcaaaaaaauaagaaaauuagcuuggcaugguggcacgugccuguagucc

SEQ ID NO: 401300 - RNA, 64 nt, Human
caaccuuuuuauuuucacuccuuuuauuucugcugcuuggcacauuuuugaguuuucccacauu

SEQ ID NO: 401301 - RNA, 64 nt, Human
aacgcagcuacaccuggagcaaggucucuucccggcuuggcaaucucagcugugccggcgcuac

SEQ ID NO: 401302 - RNA, 64 nt, Human
gugugugcgcgcaagguuagcaacaaacguacccgcuuggcaagcccacccuuccuguggccuc

SEQ ID NO: 401303 - RNA, 64 nt, Human
auugcuuguucauguaaucuucugugauaauuuggcuuggcaugccagucuuauaauuaacaua

SEQ ID NO: 401304 - RNA, 64 nt, Human
agaaugaaaggaaguauaaaguaacccauaaucugcuuggcaauaguuaagucaaucuaucuuc

SEQ ID NO: 401305 - RNA, 64 nt, Human
guccucagcuccacggcccaugccagugcccagagcuuggcaggaggcucccggcggaccaagg

SEQ ID NO: 401306 - RNA, 64 nt, Human
ucuuguccuucacaucacccauguugagaccucagcuuggcacucaggugcugaaggguaauau

SEQ ID NO: 401307 - RNA, 64 nt, Human
uggagcauugcagcuccaggaagaugaauacauggcuuggcauuuucuaugguuacaaggggcu

SEQ ID NO: 401308 - RNA, 64 nt, Human
aagcugggcagcccauugcaugcccucaacucuugcuuggcagggguaccagagacugaaagac

SEQ ID NO: 401309 - RNA, 64 nt, Human
ucugccccggcuuugcaggaugaaaagcuuuccugcuuggcaguuauucuuccacaagagaggg

SEQ ID NO: 401310 - RNA, 64 nt, Human
ugugcuggcccaggcguggggcuaccaagcaaaggcuuggcauauaccaaaggccagcugcaug

SEQ ID NO: 401311 - RNA, 64 nt, Human
uaaaugaggucacuguugaucaguguugcuaguagcuuggcagcucuucauaaaagcauauugg

SEQ ID NO: 401312 - RNA, 64 nt, Human; identical to SEQ ID NO: 162816

SEQ ID NO: 401313 - RNA, 64 nt, Human; identical to SEQ ID NO: 162821

SEQ ID NO: 401314 - RNA, 64 nt, Human; identical to SEQ ID NO: 162827

SEQ ID NO: 401315 - RNA, 64 nt, Human
acuguguagagcuugguuaucggccggcccgguggcuuggcaggcagugcugugcgcugcucau

SEQ ID NO: 401316 - RNA, 64 nt, Human
gaccagaugugacuuauuuuccuuuuacuauacagcuuggcagagaaaauaaauaucaucaaau

SEQ ID NO: 401317 - RNA, 64 nt, Human
accaugacuuuuguuaaagccaugacuuuuguuugcuuggcagacaaacccuuuuuuuaaaacu

SEQ ID NO: 401318 - RNA, 64 nt, Human
ccccagugaggaugaggccucagggcucccuccggcuuggcagacucagccugucaccccaaau

SEQ ID NO: 401319 - RNA, 64 nt, Human
uuugcuuuuuuuuuuuuacucaguugcaacuuacgcuuggcaucuucagaaugcuuuucuagca

SEQ ID NO: 401320 - RNA, 64 nt, Human
uuguccuuuaugguucuuuaggaaagcucuccaagcuuggcauuugucagggugggaggaaaac

SEQ ID NO: 401321 - RNA, 64 nt, Human
ccuuguuuguuuuauucaccaucauguaccaagugcuuggcacauagugggccuucauuaaaug

SEQ ID NO: 401322 - RNA, 64 nt, Human
uugucuuccuggauauuugggggugacucgccaugcuuggcacccucugcuuccuggugcugcu

SEQ ID NO: 401323 - RNA, 64 nt, Human
guugcuaugaaugauuuugagccuuuuuuuuuaagcuuggcaaacaucccagcuaaucaaaaua

SEQ ID NO: 401324 - RNA, 64 nt, Human
uauucuuacuaagcagaucaucaauguaucaugugcuuggcacucaaggaucuuccaaaacaga

SEQ ID NO: 401325 - RNA, 64 nt, Human
ccuuuuuaagauaugaaauaugccuacccgcagagcuuggcacaaaguggagucaaucuuuuaa

SEQ ID NO: 401326 - RNA, 64 nt, Human
ucuuccugggacgaggagacguccucucuguuaggcuuggcaggcccugccaagcagaugcaua

SEQ ID NO: 401327 - RNA, 64 nt, Human
aaggcguuuuccuagccuggagaugggaaaauaugcuuggcagagacaggaaugcugugugcuu

SEQ ID NO: 401328 - RNA, 64 nt, Human
ccaccagcacaucacucuuauguaauccccaaaggcuuggcaugccguaaguguguggugggua

SEQ ID NO: 401329 - RNA, 64 nt, Human
cgaaaccccaucucuacuaaaaauacaaaaauuagcuuggcaugguggugcgugccuguaaucc

SEQ ID NO: 401330 - RNA, 64 nt, Human; identical to SEQ ID NO: 162831

SEQ ID NO: 401331 - RNA, 64 nt, Human; identical to SEQ ID NO: 162837

SEQ ID NO: 401332 - RNA, 64 nt, Human; identical to SEQ ID NO: 162843

SEQ ID NO: 401333 - RNA, 64 nt, Human
aucuuaucuaugcuauuuaggacuacuuucuggagcuuggcagauuuuccucugacaccagaga

SEQ ID NO: 401334 - RNA, 64 nt, Human
cuuugaguuuuauuuauuuaaauaguaguuggaugcuuggcacgucguccuguaauaggaaacc

SEQ ID NO: 401335 - RNA, 64 nt, Human
cauccucagugaugugaaggugggaaggaaaggagcuuggcauugggagcccuucaagaaggua

SEQ ID NO: 401336 - RNA, 64 nt, Human
cagccaguccucagauuucagagacugcggaggggcuuggcagacggucuuagccaagggcugu

SEQ ID NO: 401337 - RNA, 64 nt, Human
uacacauguguggauaauuucauguuccaggggcgcuuggcaucucccauggacugauucccag

SEQ ID NO: 401338 - RNA, 64 nt, Human
ugccuugggcaaggacaccauagugucacagagagcuuggcaauucauggggcaucugaagcuu

SEQ ID NO: 401339 - RNA, 64 nt, Human
gcaugacuauuuccaccaucaaaugcuguagaaugcuuggcacucccuaaccaaaugcugucuc

SEQ ID NO: 401340 - RNA, 64 nt, Human
cuuuuucuccccagcagcucugcagagguggccugcuuggcagugggacaucaggggaccgguc

SEQ ID NO: 401341 - RNA, 64 nt, Human
uguggcuguuccccccacaagaagcaccucccuugcuuggcaaccuucaccagcauuucccaaa

SEQ ID NO: 401342 - RNA, 64 nt, Human
gauucccauguaacaguccagugggggugcuucugcuuggcagguugguucacacagugaugca

SEQ ID NO: 401343 - RNA, 64 nt, Human
gagcgcuggggacauugccaugggacggaagucugcuuggcaguggcuuugauaagcgaugcuu

SEQ ID NO: 401344 - RNA, 64 nt, Human
cccugggaagugggcgcagcccuguguucccccagcuuggcagaugggcugcaugcggcgcucc

SEQ ID NO: 401345 - RNA, 64 nt, Human
cgcucacacacaaaccugcucacgcagcugugaugcuuggcacgggguggccagugcagaugga

SEQ ID NO: 401346 - RNA, 64 nt, Human
guguggaggcuccaucccagcacacaggccuggggcuuggcaggggcccagcuggggcugggcc

SEQ ID NO: 401347 - RNA, 64 nt, Human
gacacacagccucugguuaaaucccuccccuccugcuuggcaacuucagcuagcuagauauauc

SEQ ID NO: 401348 - RNA, 64 nt, Human; identical to SEQ ID NO: 162848

SEQ ID NO: 401349 - RNA, 64 nt, Human; identical to SEQ ID NO: 162852

SEQ ID NO: 401350 - RNA, 64 nt, Human; identical to SEQ ID NO: 162853

SEQ ID NO: 401351 - RNA, 64 nt, Human
acucagcgccugcugcacuugccugcccugccuugcuuggcacccgcuccggcgacccuccccg

SEQ ID NO: 401352 - RNA, 64 nt, Human
cggucaccagcggccccauguccccagagggcucaccuuccaagucucccucaaagaagaaaaa

SEQ ID NO: 401353 - RNA, 64 nt, Human
caugggaagcagccuucagugccuucaugaauucaccuuccagcuuccucagaauaaaaugcug

SEQ ID NO: 401354 - RNA, 64 nt, Human
ccucccuuucuguaacagccucaaauaaagguguaccuuccauguuauauuauuuuuguuuuua

SEQ ID NO: 401355 - RNA, 64 nt, Human
aagaccacuuauuugaaaacaaagaugaagucucaccuuccaguuugcuuucucauuaguuuuu

SEQ ID NO: 401356 - RNA, 64 nt, Human
gaaguuuuauugggcagugcugcucuuaaauccuaccuuccacucaacucccauacaacuuucu

SEQ ID NO: 401357 - RNA, 64 nt, Human
cacccucaugaccuaaacaucuccauuaggcuccaccuuccaaugcaacaguuagcauaaguuu

SEQ ID NO: 401358 - RNA, 64 nt, Human
ugagucauaaaacaucauuugccuuucaauuuauaccuuccaagugaauaugauuauugaggau

SEQ ID NO: 401359 - RNA, 64 nt, Human
aacgcugcaaccaauacuguuguucuccucgcugaccuuccauggaggccguguguuggagagu

SEQ ID NO: 401360 - RNA, 64 nt, Human
caacauauguaagcaacgcuacugguucaccccaaccuuccauauuuaucuguucaaaggagca

SEQ ID NO: 401361 - RNA, 64 nt, Human
ggcugagugcgaccaccacuugaugucugaggauaccuuccaucucaaccuaccucgaguggcg

SEQ ID NO: 401362 - RNA, 64 nt, Human
uuccugggacucuacacccaucuuaaggugguauaccuuccaaauccugguucagauggaagaa

SEQ ID NO: 401363 - RNA, 64 nt, Human
ccgccuccuccugcucaugcucagcugcuucuggaccuuccagggcccaugcagggugagggaa

SEQ ID NO: 401364 - RNA, 64 nt, Human
uccagcuggguuggaaaacaguauuuuccaaacuaccuuccaguuccucauuuuugaauacagg

SEQ ID NO: 401365 - RNA, 64 nt, Human
ccucuccuuggccuuggcuguuugguuaacugucaccuuccacucagggccucugcucuauauc

SEQ ID NO: 401366 - RNA, 64 nt, Human
uuguggucccuuuugcuuguauuaauggcugcugaccuuccaaagcacuuuuuauuuucauuuu

SEQ ID NO: 401367 - RNA, 64 nt, Human; identical to SEQ ID NO: 162850

SEQ ID NO: 401368 - RNA, 64 nt, Human; identical to SEQ ID NO: 162851

SEQ ID NO: 401369 - RNA, 64 nt, Human; identical to SEQ ID NO: 162854

SEQ ID NO: 401370 - RNA, 64 nt, Human
uacacaguagcucuuccugcuacucgguuaaugagcuuggcagguucuuugucucacugaauuc

SEQ ID NO: 401371 - RNA, 64 nt, Human
auguuuggcaagagguggcugagcacuggggugggcuuggcacugugccaagccuggggccaau

SEQ ID NO: 401372 - RNA, 64 nt, Human
agcccacgggauucucuguaucaucagaggcugggcuuggcagaggggaggggccugugcccgu

SEQ ID NO: 401373 - RNA, 64 nt, Human
ggcugggagguccaagagcaugguaccagcaucugcuuggcaucuggugacagcuuucuugcug

SEQ ID NO: 401374 - RNA, 64 nt, Human
caacuucuggugguuuuuuuuucucacgcugauggcuuggcagagcaccuucgguuaacuugca

SEQ ID NO: 401375 - RNA, 64 nt, Human
auuccgccugcuccgucuuugugggggcucucaggcuuggcacagcccugacuugaacucuggg

SEQ ID NO: 401376 - RNA, 64 nt, Human
agaucuguuucgugcauuggaagaccccacccaagcuuggcagccgagcucguguauccugggg

SEQ ID NO: 401377 - RNA, 64 nt, Human
ccagggaauaaaguggaauaauguugauaacagugcuuggcaccuggaaguagguggcagaugu

SEQ ID NO: 401378 - RNA, 64 nt, Human
guaaagguagauauggcuuuuagaguuacauuaugcuuggcaugaauaaggugccaggaaaaca

SEQ ID NO: 401379 - RNA, 64 nt, Human
gcugcacauggcauuaaaggacagccaccaguaggcuuggcagugggcugcaguggaaaucaac

SEQ ID NO: 401380 - RNA, 64 nt, Human
agggaauacccucugccccacaggauugaagacugcuuggcaguccucccaaucccacaccucc

SEQ ID NO: 401381 - RNA, 64 nt, Human
aaaaccuuagauaucugguucuguuuugcacccagcuuggcagauguggauuugaauccaagcc

SEQ ID NO: 401382 - RNA, 64 nt, Human
auuagugcauugggaaggaucuuuacugcuuugugcuuggcaugucauuauuuuccauuugaca

SEQ ID NO: 401383 - RNA, 64 nt, Human
cuucccacagugccuauugauacuuggggagggugcuuggcacuuauugaauauaugaucggcc

SEQ ID NO: 401384 - RNA, 64 nt, Human
ugugggguuucaacaggcguucauaggcacccuugcuuggcaauauaacauggcuuuugauguu

SEQ ID NO: 401385 - RNA, 64 nt, Human
uuuaauuuucugucugaugucacagaucauuguugcacacaaacguggcauagaaaagaacaug

SEQ ID NO: 401386 - RNA, 64 nt, Human
uacuuucauuuuuugauuacaaauuucucuugacgcacacaauuaugucugcuaauccucuucu

SEQ ID NO: 401387 - RNA, 64 nt, Human
ucaucuaagaaaaugauuccauacaaauaacucagcacacaagugacccaggacauaugccugc

SEQ ID NO: 401388 - RNA, 64 nt, Human
auaauacuuaccuaccucacaggacuguugugaggcuuggcaaguuuugucuaaaaacaucuuu

SEQ ID NO: 401389 - RNA, 64 nt, Human
gagauuugacacucaaaucaguguuuagucuucugcuuggcaccauagcuuaaccugcaguuuc

SEQ ID NO: 401390 - RNA, 64 nt, Human
aagccagaauuacuauuucuuugacuuauuauuagcuuggcaguugcuuuugauuugauuguuu

SEQ ID NO: 401391 - RNA, 64 nt, Human
aggggcaggggguggagguuggggucaccggccugcuuggcacccccaucugaaagagcagcac

SEQ ID NO: 401392 - RNA, 64 nt, Human
ccgcauccuccucuauccuguuucgagguagagagcuuggcacuucuguuacaagcugagaguc

SEQ ID NO: 401393 - RNA, 64 nt, Human
gaaucuguuuguucuaaccaacccguucucccuggcuuggcacgugccgugagagcgcagcuug

SEQ ID NO: 401394 - RNA, 64 nt, Human
agugaaccuaccuucauuucaggagggauuggccgcuuggcacaugacaacuuugccagcuuuu

SEQ ID NO: 401395 - RNA, 64 nt, Human; identical to SEQ ID NO: 401394

SEQ ID NO: 401396 - RNA, 64 nt, Human
gcucuaguucucccccagcaucacuaacaaauaugcuuggcaagaccgaggucgauuuguccca

SEQ ID NO: 401397 - RNA, 64 nt, Human
cccacucagccugcaauaguguuucccacucucugcuuggcaucaauagaugcauaagggucaa

SEQ ID NO: 401398 - RNA, 64 nt, Human
cccacagcacucguugggguaugaggaaaccagggcuuggcacaggaaguuccccuuuguagcu

SEQ ID NO: 401399 - RNA, 64 nt, Human
ugcuggccacaaccuucugaaggcccaugcccuggcuuggcauguguacaaugaaaaguuuagg

SEQ ID NO: 401400 - RNA, 64 nt, Human
cacccugcccugagguccuuguguggccgcccuggcuuggcagcccugcccacgcugcccccgc

SEQ ID NO: 401401 - RNA, 64 nt, Human
gagaauuagcauggauauaccgggaccucaugcagcuuggcagauaucugagaaaugguuuaau

SEQ ID NO: 401402 - RNA, 64 nt, Human
gcucaggacaaacuaggccagugguuuucaaacugcuuggcagagcccugaaguuuccuagggg

SEQ ID NO: 401403 - RNA, 64 nt, Human
auguuuuuguucucauuuaugccuuuguccauuugcacacaacagaaauuguaaugagcuucac

SEQ ID NO: 401404 - RNA, 64 nt, Human
cuucugacaauugccagaucuauggcauaaauaggcacacaaaaagguacuuaaacaguuauag

SEQ ID NO: 401405 - RNA, 64 nt, Human
uauguacacacacacacacgugugcacacacaaugcacacaacuccuaugacuggcuccuacuu

SEQ ID NO: 401406 - RNA, 64 nt, Human
acuuucauuucauuuugauuaauaauucuuggaugcuuggcaucgaucguaucacugcuccuag

SEQ ID NO: 401407 - RNA, 64 nt, Human
guauacacccaguucugaauaacuugaagaacaggcuuggcaaagaaguaaguuuauccaaauc

SEQ ID NO: 401408 - RNA, 64 nt, Human
aucugaugguuuuguaagggaauuuucccccuuugcuuggcacuucuuccugcugccaugugaa

SEQ ID NO: 401409 - RNA, 64 nt, Human
gggagggagcuaagcuugggcugggcugcuuggggcuuggcauaggguggaaagggcuacccug

SEQ ID NO: 401410 - RNA, 64 nt, Human
ggccaggcuuccccuguccucccaccggucggcugcuuggcaaggcuguucaggacgugcacuu

SEQ ID NO: 401411 - RNA, 64 nt, Human
acaccaaauaugaauuuuaugauguacacuuugugcuuggcauuaaaagaaaaaaacacacauc

SEQ ID NO: 401412 - RNA, 64 nt, Human
ccucacacacuucuagauucuucccagcucagaggcuuggcauuugccauaucaucaucuuuuu

SEQ ID NO: 401413 - RNA, 64 nt, Human
ggcuuggccccaggcagggcaaccccggggcgcugcuuggcaccuuagcagacugcuggaaccu

SEQ ID NO: 401414 - RNA, 64 nt, Human
ucucugucugccuggcaaaggugcuguggaauaggcuuggcaugccacccuguuuuagagagug

SEQ ID NO: 401415 - RNA, 64 nt, Human
cugaaucuucaagaccaaagcagaaaagaaaggcgcuuggcaucacacaucacucuucuccccg

SEQ ID NO: 401416 - RNA, 64 nt, Human
ggucccugggaggacugggccccucaugccucgagcuuggcaaccgaaaacccgagggaggaga

SEQ ID NO: 401417 - RNA, 64 nt, Human
cucucugcccucccugcugccguggcuuucaagcgcuuggcagaaucuuguacuucguguccac

SEQ ID NO: 401418 - RNA, 64 nt, Human
aguguccucauucugaagacauucaccaaauggagcuuggcacuaaaauuuauguaaaagaaaa

SEQ ID NO: 401419 - RNA, 60 nt, Human
ggcgcucagcgagaggcugauccaagaacggcuuggcagccaguccggcuaaguggagcu

SEQ ID NO: 401420 - RNA, 64 nt, Human
gugugcugcccaugcaccuuccagcccggggccagcuuggcagggauccccaggaggccugggc

SEQ ID NO: 401421 - RNA, 64 nt, Human
ugcugcagaaauguccuaugcacucuuugcaagagcacacaacaaaugucagauaccaauuuuu

SEQ ID NO: 401422 - RNA, 64 nt, Human
uuuuuuuuuuucugaaaaaaggaaaaagcacacagcacacaauuucaagccauuuucagaucag

SEQ ID NO: 401423 - RNA, 64 nt, Human
aaagugagagccugucucuacaaaaaauagucaugcacacaaaauuagcugggcaugguggccu

SEQ ID NO: 401424 - RNA, 64 nt, Human
uuccuggagggcagccccacaggacgguuuaugagcacacaauuauagcuuguuucuacuuuaa

SEQ ID NO: 401425 - RNA, 64 nt, Human
gucccacucccugugggcuccuuuuggggcuugugcuuggcaguuccugugcuguccugucucc

SEQ ID NO: 401426 - RNA, 64 nt, Human
uuugaugcauucagauucucguguaacacuuguugcuuggcaacaguacugguuggguugacca

SEQ ID NO: 401427 - RNA, 64 nt, Human
agucaauggcuggccaguguagugugaagucccagcuuggcagagacuugcccaaggcuggaua

SEQ ID NO: 401428 - RNA, 64 nt, Human
cagccuggcaucugugcguguggcguggcccguggcuuggcaucugugugcgugguguggcccg

SEQ ID NO: 401429 - RNA, 64 nt, Human
agucugagcuccagaagagacugugcuggguguggcuuggcacccaggggaugagagcccugag

SEQ ID NO: 401430 - RNA, 64 nt, Human
guacuccuuccuucuccuguccacugugggggaagcuuggcagguauauuauauuucaucauuu

SEQ ID NO: 401431 - RNA, 64 nt, Human
uagagugguuggcuuuuaagguucagagacuguggcuuggcaccugcgcccaggcuuugugggc

SEQ ID NO: 401432 - RNA, 64 nt, Human
ccugacucucagcagcuaugguaggaacugcugggcuuggcagcccgggucaucuguaccucug

SEQ ID NO: 401433 - RNA, 64 nt, Human
cccuggcccugccggccacuguggacgcccuggggcuuggcacccaccucuggagaaacucggg

SEQ ID NO: 401434 - RNA, 64 nt, Human
uccugagagucuuuuuuugcacuguugaaauugggcuuggcacucaagucaaagaugaacaucg

SEQ ID NO: 401435 - RNA, 64 nt, Human
acuuuucuguggaaacaucuucacccuuuaccaggcuuggcauggucugaacuggaaacccuga

SEQ ID NO: 401436 - RNA, 64 nt, Human
ucagccaugaauucacuucucuucaggagguuuggcuuggcaugaaaauacuucauucagagua

SEQ ID NO: 401437 - RNA, 64 nt, Human
auccuuuguugcaaaaguguggacacuuuugacagcuuggcagauuuuaacuccagaagcacuu

SEQ ID NO: 401438 - RNA, 64 nt, Human
auucccgugacucguggcaugcgcaggugcuggagcuuggcagccgcgcaggagcauguaggca

SEQ ID NO: 401439 - RNA, 64 nt, Human
ucccucuuagcugggaaacuuuuacucuucaggagcuuggcaucauggacuguuaauguaugug

SEQ ID NO: 401440 - RNA, 64 nt, Human; identical to SEQ ID NO: 162865

SEQ ID NO: 401441 - RNA, 64 nt, Human; identical to SEQ ID NO: 162866

SEQ ID NO: 401442 - RNA, 64 nt, Human; identical to SEQ ID NO: 162867

SEQ ID NO: 401443 - RNA, 53 nt, Human
aagccauugcugcacucugaggggcuuggcauggccgcagugggggcugggga

SEQ ID NO: 401444 - RNA, 64 nt, Human
gagggccuuccucugaaaggccaagccaagccaugcuuggcagggugaggggccaguugaguuc

SEQ ID NO: 401445 - RNA, 64 nt, Human
ccguggggacaggccauccuacugacuaccucuugcuuggcaugaaauaaacugcuauccuccc

SEQ ID NO: 401446 - RNA, 64 nt, Human
aacuuauuggaaaacuugaugcgaaugaguuucugcuuggcacagucucugccugcuugcucuc

SEQ ID NO: 401447 - RNA, 64 nt, Human
acugggagggucuggcacuugauggggguuaguugcuuggcagccugccugccacugagggaag

SEQ ID NO: 401448 - RNA, 64 nt, Human
uccaggaggagagcaggggagagagugagcgugagcuuggcauagugauuuuuauuucugggug

SEQ ID NO: 401449 - RNA, 64 nt, Human
ucucgucccacccggagggcacagacaccggcuugcuuggcaggcugggccucugugucaccca

SEQ ID NO: 401450 - RNA, 64 nt, Human
gguaagcaaauuucuaaaacuccaaguugcugcagcuuggcauucuucuuauucuagaggucuc

SEQ ID NO: 401451 - RNA, 64 nt, Human
aaagcaacaucgucugcuucauacuuuuuccuaggcuuggcacugccuuuuccuuucucaggcc

SEQ ID NO: 401452 - RNA, 64 nt, Human
ugcugggucccugcugcuuucucuaccucaaggggcuuggcaggggucccugcugcugaccucc

SEQ ID NO: 401453 - RNA, 64 nt, Human
cagcucuuaacaaacacaggaggacuuaauggcagcuuggcauuuaaugucaaaauccaagccg

SEQ ID NO: 401454 - RNA, 64 nt, Human
gccuauuuuccaacagcucuucgcagacccaagagcuuggcacauuuccggguuaggguggaau

SEQ ID NO: 401455 - RNA, 64 nt, Human
ccuugcucugaacacugguaauuccaggugcugcgcuuggcagaggggucucgccaaagcgcau

SEQ ID NO: 401456 - RNA, 64 nt, Human
uuuuaauuuguccuugcuuaugccugccucuuucgcuuggcaggaugaugcugucauuaguauu

SEQ ID NO: 401457 - RNA, 64 nt, Human
aagccuggaaguucucaucaccuccagguggacugcuuggcagugcuaggagguggacucagga

SEQ ID NO: 401458 - RNA, 64 nt, Human
auaaucaacaaacuuaugguuuguuucaauugaugcacacaaaaaauaacuuauaguuagacuu

SEQ ID NO: 401459 - RNA, 64 nt, Human
gugaggaguucugauauuaagcacacacacacaugcacacaaauggacuucucugaagcugugu

SEQ ID NO: 401460 - RNA, 64 nt, Human
uccacaggugccuggaagggguccagaugggaaugcacacaaccuccgcuuugaagggauggag

SEQ ID NO: 401461 - RNA, 64 nt, Human
augcguggagccauuugaaacucguaggggauuugcacacaaaugcagcagagucuggcucccc

SEQ ID NO: 401462 - RNA, 64 nt, Human
uacauaccaucguccguuaaacagagaaagagcugcuuggcauucuucuuccgacugguacuga

SEQ ID NO: 401463 - RNA, 64 nt, Human
uagugaaauggugccuguaaagcucucagcauuggcuuggcacaugcaguugguacucaauaaa

SEQ ID NO: 401464 - RNA, 64 nt, Human
ggggugagguguaggcagagcccccauacggggagcuuggcagaagggguggggugggaggagg

SEQ ID NO: 401465 - RNA, 64 nt, Human
uccaaaaguaccagauggcuuaaauaauagucuggcuuggcacaacgauguuuuuuuucuuuga

SEQ ID NO: 401466 - RNA, 64 nt, Human
aucucaagcaagggguuccuccccuagcaccugggcuuggcagaagggccauaguucauccagc

SEQ ID NO: 401467 - RNA, 64 nt, Human
uccuggggauccaguaugaugaagugcgccaggggcuuggcauggugcccggcacgcagaaagu

SEQ ID NO: 401468 - RNA, 64 nt, Human
accacaggaacccuucaagaagcucccaucacaagcuuggcauugcucucugccacacgugggc

SEQ ID NO: 401469 - RNA, 64 nt, Human
uaaaaaaugcaagaggcaguuguuagucuucagggcuuggcaacugaaauagcuauguggcgga

SEQ ID NO: 401470 - RNA, 64 nt, Human
agcccugugacgucuccucagggcagcuggacaggcuuggcacugcccgggaagugcagcaggc

SEQ ID NO: 401471 - RNA, 64 nt, Human
auuaaauuccaggcaaccagcacaagagccgugagcuuggcacaugugcugcucgugagcagga

SEQ ID NO: 401472 - RNA, 64 nt, Human
auuugcuaagucucuacuguaugccagggaucaugcuuggcacuuuccauaggacauuucacac

SEQ ID NO: 401473 - RNA, 64 nt, Human
uggcuccaccacugauauccuccuuuggggaaaggcuuggcacacagcaggcuuucaagaagug

SEQ ID NO: 401474 - RNA, 64 nt, Human
cguugccuuucacggaccccgcuggaagcuuguagcuuggcaaggcugaugcuucugcccuggc

SEQ ID NO: 401475 - RNA, 64 nt, Human
gagucuugcacacacacaagugcccaggcaaggugcuuggcagaaccgcagagugggaagagag

SEQ ID NO: 401476 - RNA, 64 nt, Human
ccagacgucuccucuccugccugggcaaaguccagcuuggcaccccgucuggggccugccugug

SEQ ID NO: 401477 - RNA, 64 nt, Human
aagacuucccagaguguuaauauauaucagaaaugcacacaacagaaccauaggcaacaccaac

SEQ ID NO: 401478 - RNA, 64 nt, Human
aauacuaauugagaaacaugaauuauuuccaggggcacacaaugcuauugaaauuacugaaaac

SEQ ID NO: 401479 - RNA, 64 nt, Human
cagaacacuggugguggacacagcuuuccugucagcacacaaaagaccuguuccucuuccaaaa

SEQ ID NO: 401480 - RNA, 64 nt, Human
uacacuacacugaacacuaaagaauaauauauaagcacacaaauuggugacagaauuucaauua

SEQ ID NO: 401481 - RNA, 64 nt, Human
uugugaacaucaguggccacaggcccagugugcugcuuggcacugcacuaguuuaggaccugca

SEQ ID NO: 401482 - RNA, 58 nt, Human
accaaauuacaacagugugauaaugucugcuuggcauauuuucaccuuaggucuuauc

SEQ ID NO: 401483 - RNA, 64 nt, Human
uggaguuaauguaauacucaucauuuaccacugugcuuggcagagagcggauacucaaguaagu

SEQ ID NO: 401484 - RNA, 64 nt, Human
ugaauuuuuuaaagaaauaggcauuugauaaccagcuuggcaaguaacucuacuaacagauguu

SEQ ID NO: 401485 - RNA, 64 nt, Human
auuguagauauucagagagaagaacaaauggcuggcuuggcaaauccccaucugagauaaagua

SEQ ID NO: 401486 - RNA, 64 nt, Human
uuaagaaucacauacagugcugcuggcuuuuugugcuuggcaaaugagugacaauagaagaaau

SEQ ID NO: 401487 - RNA, 64 nt, Human
ucacaaguguguaaagcacagauuucaacagagugcuuggcauauuguagggugcucaauggug

SEQ ID NO: 401488 - RNA, 64 nt, Human
acucaauucacaacuuagcauuuugccaucugaagcuuggcaaacuaguaucugcuguaaaaca

SEQ ID NO: 401489 - RNA, 64 nt, Human
acauguccggagcaacacuuugaaaaccaaagacgcuuggcagaacccuguuccuuuccagaga

SEQ ID NO: 401490 - RNA, 64 nt, Human
cuuuauggccauuuuggagggagcaggggaugaggcuuggcauaguccaaaauuuaagucucca

SEQ ID NO: 401491 - RNA, 64 nt, Human
aaaacauuaaccccuaauucacucuucuuaaauagcuuggcaaauaagacuuuaccuuuaaaug

SEQ ID NO: 401492 - RNA, 64 nt, Human
ucagcccuagacucccuccuccugccacuggugccucgaguagccauggcaacgggcccagugu

SEQ ID NO: 401493 - RNA, 64 nt, Human
cuccuugguucaagcaauucuccugccucagccucucgaguagcugggauuauaggcguccgcc

SEQ ID NO: 401494 - RNA, 64 nt, Human
cuccuggguucaagcgauucuccugccucagccucucgaguagcugggauuacaggcaccugcc

SEQ ID NO: 401495 - RNA, 64 nt, Human
cucccgggcucaagcgauucuccugccucagccucucgaguagcugggauuacaggcaugcguc

SEQ ID NO: 401496 - RNA, 64 nt, Human
auuggccaauaacaaaacaccccauggacugugacucgaguauccaacaggcagucagagcucu

SEQ ID NO: 401497 - RNA, 64 nt, Human
cuccugggcucaagccaucccccaaccuuggccucucgaguagaugggauuauaggcaugugcc

SEQ ID NO: 401498 - RNA, 64 nt, Human
gacuuauuaggggcuguuuuucuagcuauagugucucgaguacuaauaugcaauuaugaaaauu

SEQ ID NO: 401499 - RNA, 64 nt, Human
uuccuggcuuaaagugauucuccugccucagccucucgaguagcugggauuacaggcaugcacc

SEQ ID NO: 401500 - RNA, 64 nt, Human
ucaccugcagauuuaaagccuacucugccacagacucgaguaagaaaauguucucuugaugaca

SEQ ID NO: 401501 - RNA, 64 nt, Human
ggaggggaaaacauuaagaauuuauucauuauuucucgaguacuuucagaaagucugacacuuu

SEQ ID NO: 401502 - RNA, 64 nt, Human
auccugaucgcaguaaagugguccuugguaacugcucgaguagaacaugucugcauccgccaau

SEQ ID NO: 401503 - RNA, 64 nt, Human
cuccuggguucaagcgauucuccugccucagcaucucgaguagcugggauuacaggcaugcacc

SEQ ID NO: 401504 - RNA, 64 nt, Human
uucccggguucaagcaauucuccugccucagccucucgaguagcugggauuacaggcauccgcc

SEQ ID NO: 401505 - RNA, 64 nt, Human
cucaggcuggagugcggugguauaaucucagccucucgaguagcugggacuacaggcgugagcc

SEQ ID NO: 401506 - RNA, 64 nt, Human
gauggagcauuacuggcuacugcaucuuaugauacucgaguauauaucugggauccacauaaug

SEQ ID NO: 401507 - RNA, 64 nt, Human
caagaaugcaguaucuggggcgucaacauggggacucgaguaaaccugacccaccaauaaggau

SEQ ID NO: 401508 - RNA, 64 nt, Human
ucccgaggcucaggugauccucccaucucagccucucgaguagcugggaccacaguugugugcc

SEQ ID NO: 401509 - RNA, 64 nt, Human
guccaaugcacauuaauauauuugacaugggauacucgaguagcuuucuaauuggucuccuugu

SEQ ID NO: 401510 - RNA, 64 nt, Human
guccugugcuuaagcgauccucccaccucagccucucgaguagccgggaccacaggugcgagcc

SEQ ID NO: 401511 - RNA, 64 nt, Human
uuugguugcuaagaccugaaucccauauugagaucucgaguagaauccuuggugugguuucugg

SEQ ID NO: 401512 - RNA, 64 nt, Human
gacgagcaucagcuacugcggugucagaucacuucucgaguagaggucugccuagugagugagc

SEQ ID NO: 401513 - RNA, 64 nt, Human
cgauaccccauuuagcuccagaaagcaaagaaaacucgaguaacacuuguuugaaagagaucau

SEQ ID NO: 401514 - RNA, 64 nt, Human
uaggacuuucucuucuacacagcaauacgucgugcucgaguauccuuguagcaaagcacauaga

SEQ ID NO: 401515 - RNA, 64 nt, Human
gugaaauugagcccccaaaagguuguuucugaagcucgaguacuucccaaugccgcuacuuugc

SEQ ID NO: 401516 - RNA, 64 nt, Human
uauuaauuugagaaagucaccuugacaguucuuugcacacaaguuuuacaccucucuggauucg

SEQ ID NO: 401517 - RNA, 64 nt, Human
guuucaacacacacagacaaacacagccacacgcgcacacaaguauaagacuuuuuguauuacu

SEQ ID NO: 401518 - RNA, 64 nt, Human
cagggagaauaaagauaauuguauuuuauguuuugcacacaaacgcagaauuuguauaaccaua

SEQ ID NO: 401519 - RNA, 64 nt, Human
ucgggagcugcgguggcuccggccgguuguccuggcacacaaggaggcgaggcuaugcguucga

SEQ ID NO: 401520 - RNA, 64 nt, Human
aaauaguguugaucagaucuuacaaguuuauguggcacacaauccuauaaaugugauuuuuuua

SEQ ID NO: 401521 - RNA, 64 nt, Human
auuaucaaacauuaccaguguugaacuauuaaaagcacacaauguguaguaaacuaucauagga

SEQ ID NO: 401522 - RNA, 64 nt, Human
gagaauuuuguaucuuugguuuuuguguuuugcugcacacaaaaacaaaagauauaaaaaugga

SEQ ID NO: 401523 - RNA, 64 nt, Human
guuguuuuuuuuuauuuacuuauaugauuucuaugcacacaaaaacaguuauauuaaagauauu

SEQ ID NO: 401524 - RNA, 64 nt, Human
cauguccugugcucacuuuauuaaaaauucuuuugcacacaauguuuaugaaaaggccagaucc

SEQ ID NO: 401525 - RNA, 64 nt, Human
uaaccucuuauacauuauagauaauucuaagacagcacacaaacuuaucaauaaagccaucucc

SEQ ID NO: 401526 - RNA, 64 nt, Human
cacuuaggggaggaguggccccagaauucagcacgcacacaacacacaagggagagaaccccca

SEQ ID NO: 401527 - RNA, 64 nt, Human
caaccuccuggguccaagugauccucccaccucagcacacaacaccaugcccaauuuuaagugc

SEQ ID NO: 401528 - RNA, 64 nt, Human
uauauguggaaucuuugaaaguuuggcugaaaaugcacacaaauguguacauucugaacauuuu

SEQ ID NO: 401529 - RNA, 64 nt, Human
ggguaaccugcuuacaucuggacuuuagaaucuggcacacaacaaaagugccuggcauccacua

SEQ ID NO: 401530 - RNA, 64 nt, Human
aagucaaagacaacauuauaacuaaaagucgaaagcacacaaaauauaaauaauaguguaugca

SEQ ID NO: 401531 - RNA, 64 nt, Human
uguguuuuucuccucuugguuuucauuugcucaagcacacaaaagggacuuuuguuuacucuau

SEQ ID NO: 401532 - RNA, 64 nt, Human
ucuccaagccaugugcacagcacacacgugcagugcacacaaagaaaugacauggaaauagaug

SEQ ID NO: 401533 - RNA, 64 nt, Human
accccaucccccacccccacacacacacacacaugcacacaacacauacacacacacgcacaga

SEQ ID NO: 401534 - RNA, 64 nt, Human
cagacagcuuggucacaacacaacuguguccugagcacacaagauuccaucagcccugaaggac

SEQ ID NO: 401535 - RNA, 64 nt, Human
gauucaccaccccagggccuccuuauaguucucugcacacaauaggugcuucuuggauguucuu

SEQ ID NO: 401536 - RNA, 64 nt, Human
gcauuaaguaauuuucuuuuugacuuaguauccggcacacaaaguggguuaguacuacaguauu

SEQ ID NO: 401537 - RNA, 64 nt, Human
aaauugggugagaggagauagguagcuccauaaggcacacaaauucaaauauuaucauuccuau

SEQ ID NO: 401538 - RNA, 64 nt, Human
aguaaauccgggucucuaggaugccagaggcagcgcacacaagcugggaaauccucagggcucc

SEQ ID NO: 401539 - RNA, 64 nt, Human
agugcuguuuuaaaaaacauuugaaauaaauaccgcacacaaaggcagucauuuuauucuuuua

SEQ ID NO: 401540 - RNA, 64 nt, Human
uuuuugcacacauuuugaucgaacuauauucuaagcacacaaaaagcacaguagaacagaaaug

SEQ ID NO: 401541 - RNA, 64 nt, Human
cuguaucucuugagagagguggccauaagacauggcacacaauucccaauuucacaaauuccuc

SEQ ID NO: 401542 - RNA, 64 nt, Human
auuucauguccauaaaagagaccacccauaucaugcacacaauuagauuucucacacucuaacu

SEQ ID NO: 401543 - RNA, 64 nt, Human
cauucuucaauguugcauguggcuguuugccaaggcacacaaagugcuuguaggcagcaaccau

SEQ ID NO: 401544 - RNA, 64 nt, Human
guauucuuuuucuuuuuuaaauuaauaucuuucugcacacaaauauuauuuguguuuccuaaau

SEQ ID NO: 401545 - RNA, 64 nt, Human
acuaguuccuacuuagaacaaaaguaucaaguuugcacacaaguaaucugccagcugaccuuug

SEQ ID NO: 401546 - RNA, 64 nt, Human
aguuguauaaauuuuuaaaugccgucaguagaaagcacacaagguuaugauuuuuuuaauuacu

SEQ ID NO: 401547 - RNA, 64 nt, Human
auauacaaugauccuggaaauugcaguaacaaaagcacacaacgauuauaguaacuauaagaua

SEQ ID NO: 401548 - RNA, 64 nt, Human
uacauugugaaugcugugggaaggcaauuucucugcacacaagaggcuacguuuuggaagugau

SEQ ID NO: 401549 - RNA, 64 nt, Human
ggcaacccuugcauuccacccugaguuugccaaggcacacaaaaauagggaacauuuucuuaaa

SEQ ID NO: 401550 - RNA, 64 nt, Human
uuauuaaaguugagaaauuucacaaaacugccuggcacacaagcacacacauacauagacacau

SEQ ID NO: 401551 - RNA, 64 nt, Human
ccucccccaaaaaacuuauaaaaugcaauagaaugcacacaaagacagcaacuuuuguacagag

SEQ ID NO: 401552 - RNA, 64 nt, Human
ccacaggcaaagaaaaccacuaggaccaccaggagcacacaaccccagacccacgccggagggc

SEQ ID NO: 401553 - RNA, 64 nt, Human
accgugggcgcuggccuuuuauacugaagaugccgcacacaaacaaugcaaacggggcaggggc

SEQ ID NO: 401554 - RNA, 64 nt, Human
cacuuguucugugguuuuggucucuuguuuaauugcacacaaguaauacuacuggguaaccaga

SEQ ID NO: 401555 - RNA, 64 nt, Human
cggggaagcuggcagcacucagugaggccgcccggcacacaaggcacguuuggcauuucucuuu

SEQ ID NO: 401556 - RNA, 64 nt, Human
aucaauaccuuuauagacaaauacgaacauguaugcacacaaaacauuuaacuaugguauuuau

SEQ ID NO: 401557 - RNA, 64 nt, Human
ugguggugguauauuaaaaaaagaaagaaugaaagcacacaaaaugagucaguuuggggucagu

SEQ ID NO: 401558 - RNA, 64 nt, Human
uacgcacacacacaugcacugcacacauauccaugcacacaaacacauauauacacaugcacau

SEQ ID NO: 401559 - RNA, 64 nt, Human
acauauacauauguauguguauggauuuauauaugcacacaaacauauaauaugugauguaaca

SEQ ID NO: 401560 - RNA, 64 nt, Human
cauacauagugggaacucccugguaugccauagagcacacaagaaccccaauauuaaugcuaac

SEQ ID NO: 401561 - RNA, 64 nt, Human
uggaggaggcggugagcgggggagggugcccggggcacacaaggccugcccagccagccagacu

SEQ ID NO: 401562 - RNA, 64 nt, Human
aguccugagaguguguguugguggcugugcgcacgcacacaagacgggagucacccugugcuuc

SEQ ID NO: 401563 - RNA, 64 nt, Human
uuugaagauuguugcaccuuggaacuaccagugugcacacaaucuggcucaauguauauauugg

SEQ ID NO: 401564 - RNA, 64 nt, Human
cuuugccucugaugcucagccccacccccaaauagcacacaagcuuguuaaccccaccucuuac

SEQ ID NO: 401565 - RNA, 64 nt, Human
augacauggcacauagagaaaauauuuuuuucuagcacacaagagcaaccugaaaggcugcucc

SEQ ID NO: 401566 - RNA, 64 nt, Human
ugacuguggacuucccugcuguugccaucagggugcacacaagcaggugcagugcugucaccug

SEQ ID NO: 401567 - RNA, 64 nt, Human
cucugcagcugcggacagcgucaggggcagaggggcacacaacuuuccccagagcaccccaagg

SEQ ID NO: 401568 - RNA, 64 nt, Human
ucaugacagugagacggugagauggauucguuuugcacacaacauucaaaacacuucauauugc

SEQ ID NO: 401569 - RNA, 64 nt, Human
gggcaacuccuggcacacaucaugggcuuuggaggcacacaagccuggauucgaaucugggcuc

SEQ ID NO: 401570 - RNA, 64 nt, Human
augccuccuuuguuacacacucaagaauuugucagcacacaauuaauugcagccauaguaccuu

SEQ ID NO: 401571 - RNA, 64 nt, Human
gggagguuuuugcuuuacccccgccagcacuuccgcacacaaucauagagaaccucucugcucu

SEQ ID NO: 401572 - RNA, 64 nt, Human
aggaugaaugaagccaauaggaaauaaaaaacaggcacacaacauuauuuggggaaaaacaccu

SEQ ID NO: 401573 - RNA, 64 nt, Human
ggcacaccugggauguggaagcugaggaccagaugcacacaaggcauugcucuguuugcuguuc

SEQ ID NO: 401574 - RNA, 64 nt, Human
uucuaaaacacuuuccugcuccucucugucucuagcacacaacugugaauguccuguggaauua

SEQ ID NO: 401575 - RNA, 64 nt, Human
gugccauugacugcccugauguucagagagaaacgcacacaagguuugcccaugagaauugggg

SEQ ID NO: 401576 - RNA, 64 nt, Human
caugcuuguccucaaaauguccauccuggucacagcacacaagauggcuauuggucugcuuuua

SEQ ID NO: 401577 - RNA, 64 nt, Human
gagcauaugggagggcagggguuugggugugggugcacacaaagcaagcaccaucugggauugg

SEQ ID NO: 401578 - RNA, 64 nt, Human
aagaaauauguuuuuguaagugguaggaacaugugcacacaauagaacaugaaauaaguuuuuu

SEQ ID NO: 401579 - RNA, 64 nt, Human
aggcugauaccccugaccuaucugcagucccccagcacacaaggaagaccagauguagcuacag

SEQ ID NO: 401580 - RNA, 64 nt, Human
gaaaacacucuugguggugucuuggggauuuggugcacacaagaccaaggaaaggacagaauga

SEQ ID NO: 401581 - RNA, 64 nt, Human
agcuaauggcgaaucacgaugaccuuguagacaugcacacaacuauaccuuuguccaacagauc

SEQ ID NO: 401582 - RNA, 64 nt, Human
ggugauggguucguuagaaguccaaaccucagcagcacacaauauacucauguaacaagccugc

SEQ ID NO: 401583 - RNA, 64 nt, Human
uugaaagaccuuucaugaaauauaagucuccagagcacacaagaguauuucuucugaaaaaaau

SEQ ID NO: 401584 - RNA, 64 nt, Human
ggaaccugggggccugugaaacuacaaccaaaaggcacacaaaaccguuuccaguuggcagcag

SEQ ID NO: 401585 - RNA, 64 nt, Human
caaccagucauguuccaacuucaagccgguaacugcacacaacaggccugggagcgaacugugu

SEQ ID NO: 401586 - RNA, 64 nt, Human
cauucccaaauuuggcucugagucgaggcaaccugcacacaagaccccaccaaggaaugugcaa

SEQ ID NO: 401587 - RNA, 64 nt, Human
agagcuaagaaauaaccuccaucccuaccccucagcacacaaccccuacgguaacagcacacug

SEQ ID NO: 401588 - RNA, 64 nt, Human
aggguugugacccuucauacacacacgcacgcacgcacacaaacaugcacacacgcaugcacac

SEQ ID NO: 401589 - RNA, 64 nt, Human
cugucuaaaccccugaagccuaacacaguuccuggcacacaacagguguucaacagauauugug

SEQ ID NO: 401590 - RNA, 64 nt, Human
ucaccucagccucccaaguaguugugccuccuaggcacacaacacuaugcccggcaaauuuuuu

SEQ ID NO: 401591 - RNA, 64 nt, Human
uauuguaaaauaaaaauguauauaaagcauaugagcacacaaauggacaauaaaugccacagcg

SEQ ID NO: 401592 - RNA, 64 nt, Human
cuugacuugacuuuggggguaaagucuuucaccagcacacaagaguuugauuguacaaauauau

SEQ ID NO: 401593 - RNA, 64 nt, Human
uauucuacuuuaaaggaagccuuuuuauuuugcugcacacaaucuagcaggaaucuuuuuuuuu

SEQ ID NO: 401594 - RNA, 64 nt, Human
uacaaaaauucuaaaucaauuauugaaauaggaugcacacaauuacuaaaguacagacauccua

SEQ ID NO: 401595 - RNA, 64 nt, Human
gucagcuguaccaagccccuuggcccucucccaugcacacaaacaccuccuagcaagaccuguu

SEQ ID NO: 401596 - RNA, 64 nt, Human
caaaaugccauacccaaauacacagcaaugaauggcacacaaguaauccacauaaugcauaagc

SEQ ID NO: 401597 - RNA, 64 nt, Human
uuuuguuucaugauuuugauuuuuaaaauuauuagcacacaacuauuuucagcccuuuaauaau

SEQ ID NO: 401598 - RNA, 64 nt, Human
caccacaaacgugcaagcuccugcacacaugcaugcacacaaacguguacacaagugugagcuc

SEQ ID NO: 401599 - RNA, 64 nt, Human
aagauguucccuguaggucacggcacucccaaaagcacacaagcacauacagacauaugcaucc

SEQ ID NO: 401600 - RNA, 64 nt, Human
acaaaaaaaaucaaaaaauuaucugauccuuguggcacacaacuguggucccagcuacagggga

SEQ ID NO: 401601 - RNA, 64 nt, Human
uuuuuaguguguggagauuguaauugccaucuaggcacacaaacauuuaaaaggauuuggacug

SEQ ID NO: 401602 - RNA, 64 nt, Human
aaggguagggcagccagagaaaggagcagagaaggcacacaaacgaggaaugaggggcuucacg

SEQ ID NO: 401603 - RNA, 64 nt, Human
gcgauuauuaaucccacuccccacuuauucuagggcacacaaacacuauuuuacuuuuuuaaaa

SEQ ID NO: 401604 - RNA, 64 nt, Human
gauacagucuguaaauguuuauugagaacaucuugcacacaauuugaauuauguagaaugucaa

SEQ ID NO: 401605 - RNA, 64 nt, Human
aaaggcuugaaacacgagaagcagcaaagacagagcacacaagugcauaaggcuguugucuucg

SEQ ID NO: 401606 - RNA, 64 nt, Human
uuucagaggaagcagcucauagaaacauacaaaagcacacaaguauuuugggaaaaaauccuaa

SEQ ID NO: 401607 - RNA, 64 nt, Human
caacgaaugugggaaggaccuggcuuuaaaacacgcacacaaacacacaaauaaacagacauaa

SEQ ID NO: 401608 - RNA, 64 nt, Human
ggugggccuuggaacgcugccuccacugaggcgggcacacaaggcggacccuccugaaacagcc

SEQ ID NO: 401609 - RNA, 64 nt, Human
cuccaacaauaaagcacagaguggauuuaauuaagcacacaaaugcuaaggcagaauuuugagg

SEQ ID NO: 401610 - RNA, 64 nt, Human
ccaacugcagugguuguuuaaaaugcugguuccugcacacaauucucuaucuacugaagcacau

SEQ ID NO: 401611 - RNA, 64 nt, Human
ugagauaguuuucauuuuaacuggcaugucauuugcacacaaaaauaaagacuagagcaaaaua

SEQ ID NO: 401612 - RNA, 64 nt, Human
acagcuagcagaucucuucccuccugcucccagcgcacacaaacccgcccuccccuugguguug

SEQ ID NO: 401613 - RNA, 64 nt, Human
ugugaaugaaacuuuuucuaagcacuauucuauugcacacaaacagaaaaccaaagccuuauua

SEQ ID NO: 401614 - RNA, 64 nt, Human
uuccccuguauacuaccaguugugucuuuagauggcacacaaguccaaauaaguggucauacuu

SEQ ID NO: 401615 - RNA, 64 nt, Human
uccugaacaugcacagugauuuuccucucccguugcacacaaaccuuuaaaaguuccccggccc

SEQ ID NO: 401616 - RNA, 64 nt, Human
gacaagcuccauguccuuuaaaaucagucacucugcacacaagagaaaucaacuucgugguugg

SEQ ID NO: 401617 - RNA, 64 nt, Human
uucuuuaccuaccccucaguuuuccuuaaaacgcgcacacaacucuagagaguguuaagaauaa

SEQ ID NO: 401618 - RNA, 64 nt, Human
ggaucagaaacuuuuucauauaaccugucugaaagcacacaaagucuuguuuacuacuguuuag

SEQ ID NO: 401619 - RNA, 64 nt, Human
augcacccagugcaagacgguugugggugcgggugcacacaaaugaguggguugcugugcuguc

SEQ ID NO: 401620 - RNA, 64 nt, Human
ugcaaaauuuucuucaaagcaacaaguccuaggagcacacaaagcaacccaaaggcuuuucccu

SEQ ID NO: 401621 - RNA, 64 nt, Human
cuggcucacauccagucacucccaacagcguccagcacacaaauaaaagacccuugggcccugg

SEQ ID NO: 401622 - RNA, 64 nt, Human
guacacucccagcaacaaacuccucaugauaacugcacacaaucugaaaaccacugaaggacaa

SEQ ID NO: 401623 - RNA, 64 nt, Human
auagaauuaggaugggaaaacacugucugauucugcacacaaaaguggguuucaaaaauacauc

SEQ ID NO: 401624 - RNA, 64 nt, Human
cuaucauuuagaugcauggaaaaaaaugggcuuugcacacaauggguuuggagcugacugggaa

SEQ ID NO: 401625 - RNA, 64 nt, Human
uuucuguaucagaagcccugucuucacaacacaggcacacaauuucagucccagccaaagcaga

SEQ ID NO: 401626 - RNA, 64 nt, Human
cuguuuaguccguaaguuaccaugcuaaugaggugcacacaauaacuuagcacuacuccgcagc

SEQ ID NO: 401627 - RNA, 64 nt, Human
uaacaccccccuggaggcaugccccuuuucuccagcacacaagcacauuggggcaccuggaaau

SEQ ID NO: 401628 - RNA, 64 nt, Human
guguugugugcucacgugccacacagugucucaugcacacaacccaguguacacaccaccuacg

SEQ ID NO: 401629 - RNA, 64 nt, Human
acacacauccaccccagggccaagagaaaggccugcacacaagcccacagcacagcucccugcc

SEQ ID NO: 401630 - RNA, 64 nt, Human
gcugucugagcagcuccuggcuccggugggaacugcacacaaguccacuggccuggcuuggccc

SEQ ID NO: 401631 - RNA, 64 nt, Human
aggcugaacaggggacuagugcccaggugacacugcacacaaagccaagggcaaacccuauaga

SEQ ID NO: 401632 - RNA, 64 nt, Human
ggaggcagauaaauaaaggccuuaucuuaugaaagcacacaagagccuccauacuauuaauauc

SEQ ID NO: 401633 - RNA, 64 nt, Human
cgucccuggguaaccuaauggccacuggcuagcagcacacaaucucgccagggaaaaucugagg

SEQ ID NO: 401634 - RNA, 64 nt, Human
ugcccguccuggaguugcaccacugauagucacagcacacaaugauugacaacucacuuuuuuu

SEQ ID NO: 401635 - RNA, 64 nt, Human
cuuuuuauacgaugccccaguuccccauaacuuugcacacaagcuucuguguucaguugaauug

SEQ ID NO: 401636 - RNA, 64 nt, Human
aaaaacccucaaagauuacuauaaacaccuguaugcacacaaacuagaaaaccuagaaaaaauu

SEQ ID NO: 401637 - RNA, 64 nt, Human
auuguaaauggcauugauguuugaacuuugaauugcacacaauuuuugguaguauacagaaaua

SEQ ID NO: 401638 - RNA, 64 nt, Human
aggucucaauauaagggacucagagcugugccuggcacacaaugaaugcuaaauauauggagcc

SEQ ID NO: 401639 - RNA, 64 nt, Human
ggucauuauaucuacuauguugauuuaucaucaggcacacaacuucuguuuccuucucuugugu

SEQ ID NO: 401640 - RNA, 64 nt, Human
acuuccuuccaucuucucugcauaaaaacuuguggcacacaaugcuuauucacuaguguguccc

SEQ ID NO: 401641 - RNA, 64 nt, Human
gauauuaggaucuuccuuggagacucugaaaauggcacacaaagaauggcaguuaugaacguga

SEQ ID NO: 401642 - RNA, 64 nt, Human
gcgagugcuugggauccgcauccagccgugcugagcacacaacaggcuguguguggaaauggcc

SEQ ID NO: 401643 - RNA, 64 nt, Human
guagacggggucugugggugcaggcccuggaggggcacacaauugccuggaggcuucugugaga

SEQ ID NO: 401644 - RNA, 64 nt, Human
ucuuuuggaucauaaacuggaaauacugauggaagcacacaaguggagagaaguugacauggaa

SEQ ID NO: 401645 - RNA, 64 nt, Human
ccacauccaccucgaggggacccuggcaccccgggcacacaaaccucugugguauaggugaggg

SEQ ID NO: 401646 - RNA, 64 nt, Human
ccuagggagcuggcgccaaggccucucccugauggcacacaaggagccuccuuccuguagcagc

SEQ ID NO: 401647 - RNA, 64 nt, Human
uuuuuuaaagaauggaguuguuggggcaggacaugcacacaaugugaaacagacaaaaugcauu

SEQ ID NO: 401648 - RNA, 64 nt, Human
aggugagccacaggcaacucuucucucggaaccugcacacaaacuggggcuauagagauucucc

SEQ ID NO: 401649 - RNA, 64 nt, Human
gcacagcaggagcuuccgccuccucuccacuggagcacacaacuugaaccuggcuuauuuucug

SEQ ID NO: 401650 - RNA, 64 nt, Human
uuucagauuuuuuccucugcauuuacacacacacgcacacaaaccacaccacacacacacacac

SEQ ID NO: 401651 - RNA, 64 nt, Human
ucugacugaauagacagugguauagguugacacagcacacaaguggcuauugugauguaugaug

SEQ ID NO: 401652 - RNA, 64 nt, Human
cuuuuuucagggguaauuuccaacacacauacaugcacacaaacaaaauguuuuaaaaugugau

SEQ ID NO: 401653 - RNA, 64 nt, Human
uaauugguguccaccagguccucacaacuucucugcacacaagcuucuaaaauuccuuucaaau

SEQ ID NO: 401654 - RNA, 64 nt, Human
ggacuacugauguucugugauacaucagguuucagcacacaacuuacauuucuuugccuccaaa

SEQ ID NO: 401655 - RNA, 64 nt, Human
ucuucucuauagaccugcagaggaagcugcuaaagcacacaaaauguccacgaaacguggacuc

SEQ ID NO: 401656 - RNA, 64 nt, Human
gaauaacugugccccucuaagagugcacacacacgcacacaagaggguaagagacaagguucug

SEQ ID NO: 401657 - RNA, 64 nt, Human
gcgaauuacccuaauucucaaaagcaaaacaagagcacacaagcgugaagaaaaggaucuuaaa

SEQ ID NO: 401658 - RNA, 64 nt, Human
uaacuguuucuugugaccuggaacuaacgucaaagcacacaagacauaauaauaaagacaugua

SEQ ID NO: 401659 - RNA, 64 nt, Human
uuugacugaauagacagugguauagguugacacagcacacaaguggcuauugugauguaugaug

SEQ ID NO: 401660 - RNA, 64 nt, Human
gaccauggaaugguaguugagaagaaaacuauuugcacacaacagauuuuagauacuuuuugcu

SEQ ID NO: 401661 - RNA, 64 nt, Human
cuaucuacuaaaacuauggagaaacuuuguaugugcacacaaaaguauucaagagacaguauug

SEQ ID NO: 401662 - RNA, 64 nt, Human
guaaacacuuuaguugcuuucagggaugacacaagcacacaaugauuuuugcuuacaaucacuu

SEQ ID NO: 401663 - RNA, 64 nt, Human; identical to SEQ ID NO: 162868

SEQ ID NO: 401664 - RNA, 64 nt, Human; identical to SEQ ID NO: 162869

SEQ ID NO: 401665 - RNA, 64 nt, Human; identical to SEQ ID NO: 162870

SEQ ID NO: 401666 - RNA, 64 nt, Human; identical to SEQ ID NO: 53668

SEQ ID NO: 401667 - RNA, 64 nt, Human; identical to SEQ ID NO: 53669

SEQ ID NO: 401668 - RNA, 56 nt, Human; identical to SEQ ID NO: 53670

SEQ ID NO: 401669 - RNA, 64 nt, Human; identical to SEQ ID NO: 53671

SEQ ID NO: 401670 - RNA, 64 nt, Human; identical to SEQ ID NO: 53672

SEQ ID NO: 401671 - RNA, 64 nt, Human; identical to SEQ ID NO: 53673

SEQ ID NO: 401672 - RNA, 64 nt, Human; identical to SEQ ID NO: 53674

SEQ ID NO: 401673 - RNA, 64 nt, Human; identical to SEQ ID NO: 53675

SEQ ID NO: 401674 - RNA, 64 nt, Human; identical to SEQ ID NO: 53676

SEQ ID NO: 401675 - RNA, 64 nt, Human; identical to SEQ ID NO: 53677

SEQ ID NO: 401676 - RNA, 64 nt, Human; identical to SEQ ID NO: 53678

SEQ ID NO: 401677 - RNA, 64 nt, Human; identical to SEQ ID NO: 53679

SEQ ID NO: 401678 - RNA, 64 nt, Human; identical to SEQ ID NO: 53680

SEQ ID NO: 401679 - RNA, 64 nt, Human; identical to SEQ ID NO: 53681

SEQ ID NO: 401680 - RNA, 51 nt, Human; identical to SEQ ID NO: 53682

SEQ ID NO: 401681 - RNA, 64 nt, Human; identical to SEQ ID NO: 162797

SEQ ID NO: 401682 - RNA, 64 nt, Human; identical to SEQ ID NO: 162798

SEQ ID NO: 401683 - RNA, 55 nt, Human; identical to SEQ ID NO: 162847

SEQ ID NO: 401684 - RNA, 64 nt, Human; identical to SEQ ID NO: 53683

SEQ ID NO: 401685 - RNA, 64 nt, Human; identical to SEQ ID NO: 53684

SEQ ID NO: 401686 - RNA, 64 nt, Human; identical to SEQ ID NO: 53685

SEQ ID NO: 401687 - RNA, 64 nt, Human; identical to SEQ ID NO: 53686

SEQ ID NO: 401688 - RNA, 64 nt, Human; identical to SEQ ID NO: 53687

SEQ ID NO: 401689 - RNA, 64 nt, Human; identical to SEQ ID NO: 53688

SEQ ID NO: 401690 - RNA, 64 nt, Human; identical to SEQ ID NO: 53689

SEQ ID NO: 401691 - RNA, 64 nt, Human; identical to SEQ ID NO: 53690

SEQ ID NO: 401692 - RNA, 64 nt, Human; identical to SEQ ID NO: 53691

SEQ ID NO: 401693 - RNA, 64 nt, Human; identical to SEQ ID NO: 53692

SEQ ID NO: 401694 - RNA, 64 nt, Human; identical to SEQ ID NO: 53693

SEQ ID NO: 401695 - RNA, 64 nt, Human; identical to SEQ ID NO: 53694

SEQ ID NO: 401696 - RNA, 64 nt, Human; identical to SEQ ID NO: 53695

SEQ ID NO: 401697 - RNA, 64 nt, Human; identical to SEQ ID NO: 53696

SEQ ID NO: 401698 - RNA, 64 nt, Human; identical to SEQ ID NO: 53697

SEQ ID NO: 401699 - RNA, 64 nt, Human
aaagagcaaaauuuuacuguugugauguaccaauucuaacuaauuguaauuuuuaauuucaugc

SEQ ID NO: 401700 - RNA, 64 nt, Human
cuucagaaaagacacuucaaugggagugaacauuucuaacuaaggacaggauggcugugugugg

SEQ ID NO: 401701 - RNA, 64 nt, Human
guaaauuuaauaaugaaccaauuacacucuugagucuaacuaaacuguacacuguagcacggug

SEQ ID NO: 401702 - RNA, 64 nt, Human; identical to SEQ ID NO: 53698

SEQ ID NO: 401703 - RNA, 64 nt, Human; identical to SEQ ID NO: 53699

SEQ ID NO: 401704 - RNA, 64 nt, Human; identical to SEQ ID NO: 53700

SEQ ID NO: 401705 - RNA, 64 nt, Human; identical to SEQ ID NO: 53701

SEQ ID NO: 401706 - RNA, 64 nt, Human; identical to SEQ ID NO: 53702

SEQ ID NO: 401707 - RNA, 64 nt, Human; identical to SEQ ID NO: 53703

SEQ ID NO: 401708 - RNA, 64 nt, Human; identical to SEQ ID NO: 53704

SEQ ID NO: 401709 - RNA, 64 nt, Human; identical to SEQ ID NO: 53705

SEQ ID NO: 401710 - RNA, 64 nt, Human; identical to SEQ ID NO: 53706

SEQ ID NO: 401711 - RNA, 64 nt, Human; identical to SEQ ID NO: 53707

SEQ ID NO: 401712 - RNA, 64 nt, Human; identical to SEQ ID NO: 53708

SEQ ID NO: 401713 - RNA, 64 nt, Human; identical to SEQ ID NO: 53709

SEQ ID NO: 401714 - RNA, 64 nt, Human; identical to SEQ ID NO: 53710

SEQ ID NO: 401715 - RNA, 64 nt, Human; identical to SEQ ID NO: 53711

SEQ ID NO: 401716 - RNA, 64 nt, Human
auuucuacauauuucuuccauguaucugagaauaucuaacuagaaggaugagaaggaaauaaaa

SEQ ID NO: 401717 - RNA, 64 nt, Human
acauggugcccagucaccaauauuuauaaugaggucuaacuacagcaguaguuuuucauauaua

SEQ ID NO: 401718 - RNA, 64 nt, Human
gcuccaucucuacuggugugugcauuuaaugacaucuaacuacagaugccgcacagccacaaug

SEQ ID NO: 401719 - RNA, 64 nt, Human
cucacagaguuuaaacuauuuucuuguccccaccaccuuccaagaaccugcgaggguaguaauc

SEQ ID NO: 401720 - RNA, 64 nt, Human
ucauccuuguagaucccuuuccuauugauuucccaccuuccagugaaauucugaaagucuuauc

SEQ ID NO: 401721 - RNA, 64 nt, Human
gccgccaugugaagaaggucguugcuuccccuucaccuuccaccaccaugauuguaaguuccuu

SEQ ID NO: 401722 - RNA, 64 nt, Human
accuuuuagugaauaagcugaguccauauacuugucuaacuaagaaagcaguacagaggaaaac

SEQ ID NO: 401723 - RNA, 64 nt, Human
uuuuuuuuuuuaacucuaacacccuucagaaauuucuaacuacuuuguaacugcauggcuuaac

SEQ ID NO: 401724 - RNA, 64 nt, Human
aucugagauuacagagaucucagagguuauguguucuaacuauuaucaaaugaauaaauccucu

SEQ ID NO: 401725 - RNA, 64 nt, Human
ccuaguugaccugucuauaagagaauuauauauuucuaacuauauaacccuaggaauuuagaca

SEQ ID NO: 401726 - RNA, 64 nt, Human
agcuauaugguuagacguuucuccccuuuucccuaccuuccaugguccugguuggcccuggcuu

SEQ ID NO: 401727 - RNA, 64 nt, Human
auuuggggcauuuuuauuuaacagaacuucucuaaccuuccaacugcuucccacaaacacauug

SEQ ID NO: 401728 - RNA, 64 nt, Human
ccacguguagcuacugaucccauauuuccuacucaccuuccaaauggugcgacccaacuucauu

SEQ ID NO: 401729 - RNA, 64 nt, Human
uuuuuuuuugcacaugacaguguuuguauugaggaccuuccaaggaagagggaugcuguagcag

SEQ ID NO: 401730 - RNA, 64 nt, Human
ccuugcuggucccuaggccaagccaccaagugaaaccuuccaggauacuagcccgccagcugug

SEQ ID NO: 401731 - RNA, 64 nt, Human
aggggguacacagaccaagucccuauaaacaaggaccuuccaguccaggggaaugacugugcaa

SEQ ID NO: 401732 - RNA, 64 nt, Human
cugcugauguggaugcguccacaccccuuuuugaaccuuccaagcagcuggaggguuuuuggau

SEQ ID NO: 401733 - RNA, 64 nt, Human
cuagggaggggagugucuucucucuccagguuucaccuuccagugugcagaaguuagaaggguc

SEQ ID NO: 401734 - RNA, 64 nt, Human
ccuccuggcugcuggccaggaugucgccagcauuaccuuccacugccuuucucccugggaagca

SEQ ID NO: 401735 - RNA, 64 nt, Human
cugauuuuaagccauuuaaaauuuauauaaaacaaccuuccauaaaaauuugacaggugcccag

SEQ ID NO: 401736 - RNA, 64 nt, Human
gcauguccaauuugcuugcacuuuuccacaucagaccuuccacuuaaggguaccaauucaauac

SEQ ID NO: 401737 - RNA, 64 nt, Human
uaccuauguacuacucuacccccugccuuagagcaccuuccagagaagcuauuccaggucucaa

SEQ ID NO: 401738 - RNA, 64 nt, Human
uaggaaaagcccccaucucccaucugggauagggaccuuccaucagccuuaacccugggaaaug

SEQ ID NO: 401739 - RNA, 64 nt, Human
caccccucguugcugaguccccucuucccuggaaaccuuccacccagugcugaauuucccucuc

SEQ ID NO: 401740 - RNA, 64 nt, Human
caucaucccuccccaaccccagcucucucugcucaccuuccaaaggcaccuggaggugcaagcc

SEQ ID NO: 401741 - RNA, 64 nt, Human
acccucauccccaucuucucaggggcaggggacuaccuuccagugucucccuccagcccagccc

SEQ ID NO: 401742 - RNA, 64 nt, Human; identical to SEQ ID NO: 162841

SEQ ID NO: 401743 - RNA, 64 nt, Human; identical to SEQ ID NO: 162842

SEQ ID NO: 401744 - RNA, 64 nt, Human
aacuuuugagaucuucauuuuacaggcagaccugucuaacuacaagccagacuuggguuuucuc

SEQ ID NO: 401745 - RNA, 64 nt, Human
aaaaaugugguuguagauguugcucuacauucaaaccuuccaggcuacacucuuccaucagcau

SEQ ID NO: 401746 - RNA, 64 nt, Human
ugauguuccucaguagaacugggaagagaagguaaccuuccaagguuuaacuaucuaucuaucu

SEQ ID NO: 401747 - RNA, 64 nt, Human
ugaccuuuuuuuuccaguugaaauguauuaacacaccuuccacaaucauuuuauaagagucagc

SEQ ID NO: 401748 - RNA, 64 nt, Human
ucuggguugaaagaagauuaggggaaaagaggucaccuuccagcagugaaaugaacaaauagaa

SEQ ID NO: 401749 - RNA, 64 nt, Human
cuggccacaauucaaauuaaggcaacaaacauauaccuuccaugaagcacacacagacuuuuga

SEQ ID NO: 401750 - RNA, 64 nt, Human
ccuaagaguuuucucaccuguucagucucaucuaaccuuccaaugucugauguuccugccaaau

SEQ ID NO: 401751 - RNA, 64 nt, Human
cagcagagcagcagcuagagaccccuuuggccacaccuuccaggcacuggccugaugccccgcc

SEQ ID NO: 401752 - RNA, 64 nt, Human
gaggugaggucucccuaaucaugguaaaguguuaaccuuccaccuccucccuucccuccuccuu

SEQ ID NO: 401753 - RNA, 64 nt, Human
cacuguugccccccauggcggcaugggcaagaugaccuuccauuagcuucaagucuuguucucu

SEQ ID NO: 401754 - RNA, 64 nt, Human
cacaauauuguaaugcuggguuccaucaacacccaccuuccacaacucagucugcaccucaguu

SEQ ID NO: 401755 - RNA, 64 nt, Human
gcccuuuggacucuaccucagaaauauuucuuggaccuuccacuucuccuccaacuccuugacc

SEQ ID NO: 401756 - RNA, 64 nt, Human
cuggggggccaaacuuuugcagugaauauugggaaccuuccagugguuuuauguuuuguuuugu

SEQ ID NO: 401757 - RNA, 64 nt, Human
cuuaucugucuuaugcugguuauuucacugcuucaccuuccaggcuugacuuaacaaauguaga

SEQ ID NO: 401758 - RNA, 64 nt, Human
agagaaaccagggagccccuuugaugauuaauucaccuuccagugucucggagggauuccccua

SEQ ID NO: 401759 - RNA, 64 nt, Human
uaugggucuuagucuuaaggguaacagagugaauaccuuccaaauaaaaagcuaaauauuccuc

SEQ ID NO: 401760 - RNA, 64 nt, Human
gaauaacuuuaguaaguuagcugccagcauuagaaccuuccaggaagaauuuuaacuaguaugc

SEQ ID NO: 401761 - RNA, 64 nt, Human
cugguauagaagauggauguaggagagcuucuuuucuaacuaccaucugaucagacaaggaaug

SEQ ID NO: 401762 - RNA, 64 nt, Human
uccaaacccuugugccucccaguucuuccaagugucuaacuagucuucgcugcagcgucagcca

SEQ ID NO: 401763 - RNA, 64 nt, Human
augagcauguuuagacuuuaacauaagcuauuuuucuaacuacaaagguuuaaaugaacaagag

SEQ ID NO: 401764 - RNA, 64 nt, Human
guuugaaauuauuuuuucuaagaguuuuucuauaaccuuccaaaagucgugauguuuguaguua

SEQ ID NO: 401765 - RNA, 64 nt, Human
auuuuacaguuucuuaaacauaauuuaaugcaucaccuuccacuugcuaacauaccaagucagu

SEQ ID NO: 401766 - RNA, 64 nt, Human
aauguccuucaaguuuucaugaacuagcaaccccaccuuccaccaugguucugggcgccugauu

SEQ ID NO: 401767 - RNA, 64 nt, Human
caucacagaccuucgaugagcguuugaguccaacaccuuccaagaacaacaaaaccauaucagu

SEQ ID NO: 401768 - RNA, 64 nt, Human
gggucaaaggacauauagaaauguggauuucagcaccuuccaaaguucagccaguuaucaguag

SEQ ID NO: 401769 - RNA, 64 nt, Human
uguggucuucuccaucucaguuaaugcaacuucaaccuuccagaugcucaggucaaaaacugaa

SEQ ID NO: 401770 - RNA, 64 nt, Human
uaccaaaaccugacuugaaaugccauuucuuuuaaccuuccaaauccuaaauguuuccuucaag

SEQ ID NO: 401771 - RNA, 64 nt, Human
acuugauaaaauuaaauauagauuuaauuuaugaaccuuccaucaugauguuuguguauugcuu

SEQ ID NO: 401772 - RNA, 64 nt, Human
cccuagagucccuucuauagggagggggcaggagaccuuccagacuucggcugagcuuggaggg

SEQ ID NO: 401773 - RNA, 64 nt, Human
gacaugcaggcaccucucuuucauccuuuaagggaccuuccaccugccaugcgcacucuccagc

SEQ ID NO: 401774 - RNA, 64 nt, Human
cagguucuugccuugggaaacacuacuagcucugaccuuccauaccucacuugggggagcacag

SEQ ID NO: 401775 - RNA, 64 nt, Human
gacccucucagacaagcguggcacagccaugcugaccuuccaucuggugaaccaaguggcagcc

SEQ ID NO: 401776 - RNA, 64 nt, Human
gugcaugccacaguucgcaguagaggguguuuucaccuuccaagacauggggcaaaguuuggag

SEQ ID NO: 401777 - RNA, 64 nt, Human
uugcuuuaaacuagaucaucuuagacuuguuuauaccuuccagauuugauuguuuuacucccaa

SEQ ID NO: 401778 - RNA, 64 nt, Human
cucuggcgggcagcgggagaggcgcucgcucgggaccuuccaccucuccaacauuguccccugg

SEQ ID NO: 401779 - RNA, 64 nt, Human
uauauguauaguguuucacaaagcuuagaccuuuaccuuccagccaccccacagugcuugauau

SEQ ID NO: 401780 - RNA, 64 nt, Human
uucugugaagaauguuuucaugguuaucauuauaucuaacuauaaccucccccauaguuaugaa

SEQ ID NO: 401781 - RNA, 58 nt, Human
aaagcaucuuugacagaagguucugcaccaggcaaaaagaucugaaacauuaguuugg

SEQ ID NO: 401782 - RNA, 58 nt, Human
ccuguuuacacuggggauuuggagggggcaggcaaagucaaagugaaugaccucuguc

SEQ ID NO: 401783 - RNA, 64 nt, Human
uccagcaguuaggcaccuuaacuggagaccagaaaccuuccagagaacacagggcugcaucccg

SEQ ID NO: 401784 - RNA, 64 nt, Human
uguuacugaaagugguuugaaagugaauaaacuucagcaccauggacagaagacaaaugccugc

SEQ ID NO: 401785 - RNA, 64 nt, Human
cuggugccaaagucuggaucuuuccacauuucagcagcaccaacaucugcugcuacucaaaaug

SEQ ID NO: 401786 - RNA, 64 nt, Human
gacuacuacucugccaaucggcuaccccucgacucagcaccacauugccucauuucuuccucug

SEQ ID NO: 401787 - RNA, 64 nt, Human
ugugauggugcgcagagaggaaccucuugggauucagcaccagacgucugugcugccugguuug

SEQ ID NO: 401788 - RNA, 64 nt, Human
uucuugugcuuugcaccccuguguagccgauggccagcaccaggagaggagucaggccgcgacu

SEQ ID NO: 401789 - RNA, 64 nt, Human
uuucaaucuucugcauauggcuagccaguaaucccagcaccauuuauuaaauggggacuucuuu

SEQ ID NO: 401790 - RNA, 64 nt, Human
gauggguuugugcucagccuuuuaaagcugcaggcagcaccacuugagauuuccagaggaccca

SEQ ID NO: 401791 - RNA, 64 nt, Human
aaagucuguguccaauuaugcacuggccacccaacagcaccaauuguacauucccugcauccaa

SEQ ID NO: 401792 - RNA, 64 nt, Human
cggaucgugcugcucccuggccagccuuuggccacagcaccaccagcugcuguugcugagagag

SEQ ID NO: 401793 - RNA, 64 nt, Human
cuccugguuguguaacugaagauguucugcccaccagcaccagaggucacucuccacauccccg

SEQ ID NO: 401794 - RNA, 64 nt, Human
cccaguagagaaggccaagcaaccuccacuucuucagcaccacacacacgcacacacacacaca

SEQ ID NO: 401795 - RNA, 64 nt, Human
guuauuggauuagaccaauuacugcacucuuaaacagcaccaccauuuaauuucauguauaucu

SEQ ID NO: 401796 - RNA, 64 nt, Human
ugcugagaauuucuggacuguguccugauggacgcagcaccaucaaagcccagaauuucugaaa

SEQ ID NO: 401797 - RNA, 64 nt, Human
cauguauuauuucacauguuuugacucuggcuugcagcaccauucggaguaaggaugacagcag

SEQ ID NO: 401798 - RNA, 64 nt, Human
agagacaacuuugaauccuugucagccuggagaccagcaccagaggaaucuacaaggcaaacuc

SEQ ID NO: 401799 - RNA, 58 nt, Human
gaauacaguguguuguuaauagucacuacaggcaaaaaacaguaagagcuugcuuuua

SEQ ID NO: 401800 - RNA, 58 nt, Human
ccagauaaagcugcaggaaauagcauuccaggcaaaggaacaaaacuggugcagaccc

SEQ ID NO: 401801 - RNA, 58 nt, Human
guggauggagaaggggagagcaucuaggcaggcaaacagaagggaaguggaguuaaac

SEQ ID NO: 401802 - RNA, 58 nt, Human
agaagagaguaacgccacauauuuuaaacaggcaaaaauaugauaauaaaaauguuua

SEQ ID NO: 401803 - RNA, 64 nt, Human
cacaagaacacaacaccuugccaguaucucaggcaccuuccaaaccaaaucugacaagugaaca

SEQ ID NO: 401804 - RNA, 64 nt, Human
caaguuacuauaaaggacacaaagagaaaacuuuaccuuccagaacaaaaugacuccugaugaa

SEQ ID NO: 401805 - RNA, 64 nt, Human
accaagauguguacagcacuaugagcauuaaaaaaccuuccagaaucaauaauccguggcaaca

SEQ ID NO: 401806 - RNA, 64 nt, Human
auaugaccuaacuuaauuguagccauauucugguaccuuccauuuugaaaaguagagguugcuu

SEQ ID NO: 401807 - RNA, 64 nt, Human
aucugccuguaucucucacuauuaucuaaaagaaaccuuccaaugcuucuguugaucucaguau

SEQ ID NO: 401808 - RNA, 64 nt, Human
uaacauuagaauuguaaauguuauuuauggaaauaccuuccaaugcuauugagaaauucaaauc

SEQ ID NO: 401809 - RNA, 64 nt, Human
guuguguugucugucuucauuuuguaacagcuggaccuuccauucuagaauuaugagaccaccu

SEQ ID NO: 401810 - RNA, 64 nt, Human
uuacucuuauauuuucccgucauucucucugcuaaccuuccaccuuaugcacacacuuucccua

SEQ ID NO: 401811 - RNA, 64 nt, Human
uuggaguggaccuuuugcaaaaggccuugucaucaccuuccaagaaaguuuccuucuguugucc

SEQ ID NO: 401812 - RNA, 64 nt, Human
cacugcauccugucuuaauccaagguacuggaaaaccuuccacaugcccaaccugagaccuguu

SEQ ID NO: 401813 - RNA, 64 nt, Human
ucuguacaaugguggagugaguacgcuguaaaggaccuuccauucauuuugcugaauuccagag

SEQ ID NO: 401814 - RNA, 64 nt, Human
acauuuuuaccauugugggguccaaauuuaagauaccuuccacucacuaauaauaugaacuuau

SEQ ID NO: 401815 - RNA, 64 nt, Human
agugugcccaagggggaguucacucauuacugugaccuuccagcucaguccccacccaugggag

SEQ ID NO: 401816 - RNA, 64 nt, Human
acauaauuauauauagagauagacuuguguauacaccuuccacaaacacauccucacggagaua

SEQ ID NO: 401817 - RNA, 64 nt, Human
uaccucugauuuugcuuugcugucaaaguuuaacaccuuccaacuacuuauguguguccuguaa

SEQ ID NO: 401818 - RNA, 64 nt, Human
ccauggaguuccagcaggucacucucccuggcacaccuuccaggcuggauuuuuaaugaaacag

SEQ ID NO: 401819 - RNA, 58 nt, Human
aauauguacauauguagucuaguaaaagcaggcaaacacauaucuuucugauaaaaac

SEQ ID NO: 401820 - RNA, 58 nt, Human
gauuuucaaauggggguauauuaauccucaggcaaaugcuacacccguacccaaagcc

SEQ ID NO: 401821 - RNA, 58 nt, Human
auuaaaaagggccagaaaaauuuggcaccaggcaaacgaauaaagauaggauugggaa

SEQ ID NO: 401822 - RNA, 64 nt, Human
uauuuagacucaucuuacuguaccuguuccuuagaccuuccauaaugcuacugucucacugaaa

SEQ ID NO: 401823 - RNA, 64 nt, Human
agucaccaagcuggcaacggccaaaccaaggaguaccuuccacuggaagaaucucaaacagcgc

SEQ ID NO: 401824 - RNA, 64 nt, Human
uccaaucuguaauuucacuuuagaagguuguauuaccuuccacuuccauguugucuuauaaaca

SEQ ID NO: 401825 - RNA, 64 nt, Human
ucuagucuucacuugccugugcagcugggcgcugaccuuccagguagagcacagauggcacaac

SEQ ID NO: 401826 - RNA, 64 nt, Human
uagcuacacuaaagaaaaugaacuccgccauccgaccuuccauccaguugcugaugcuuugucu

SEQ ID NO: 401827 - RNA, 64 nt, Human
aaaucuauagcauuuaaagauaccaaauagaaacaccuuccagcuuuaaaaaaaaaaaaaaaaa

SEQ ID NO: 401828 - RNA, 64 nt, Human
guugucaagauuagaacugggguucauguuaaaaaccuuccauauuaccugaggguaccugugg

SEQ ID NO: 401829 - RNA, 64 nt, Human
uggcccaucugugcaguaagccuguuggauaaagaccuuccagcuccuguguucuagaccucug

SEQ ID NO: 401830 - RNA, 64 nt, Human
gcaagcccacccuuccuguggccucugugcacgcaccuuccagugaacagagacucuucaccuu

SEQ ID NO: 401831 - RNA, 64 nt, Human
guucuccuggaggcaggggcugcugccuuguuucaccuuccaugucaggccagccugucccuga

SEQ ID NO: 401832 - RNA, 64 nt, Human
acaggaggcugugcugaccuccugagcggcagacaccuuccaggagcccugaggguggcaggag

SEQ ID NO: 401833 - RNA, 64 nt, Human
cugaauccauaaaggcauaccuuaaacaagcuccaccuuccaaaggaccuacuguucggacaaa

SEQ ID NO: 401834 - RNA, 64 nt, Human
agcauugucaguggaggcugggccaccauggcagaccuuccaaaaguagugagcuacauagacu

SEQ ID NO: 401835 - RNA, 64 nt, Human
uuugugaucauguugucuuucaauacaggcauaaaccuuccacucuugaacaaagcagcugcuu

SEQ ID NO: 401836 - RNA, 64 nt, Human
uuacauugcugcugcuagagaggguggggauugcaccuuccaaaucuguuucuguaccaauauu

SEQ ID NO: 401837 - RNA, 64 nt, Human
uguggcuugucuugccaauagacuccaggcuuauaccuuccauuuccaucguauucuccaguuu

SEQ ID NO: 401838 - RNA, 64 nt, Human; identical to SEQ ID NO: 162812

SEQ ID NO: 401839 - RNA, 64 nt, Human; identical to SEQ ID NO: 162813

SEQ ID NO: 401840 - RNA, 64 nt, Human; identical to SEQ ID NO: 162814

SEQ ID NO: 401841 - RNA, 64 nt, Human
aguguacuuggaguauuggggucugaccccaaacaccuuccagcuccuguaacauacuggccug

SEQ ID NO: 401842 - RNA, 64 nt, Human
caagggguuccuucugguccucccauccacugccaccuuccauuuuguccaucucaugcuggcc

SEQ ID NO: 401843 - RNA, 64 nt, Human
ggguuuuuauuuccuaugauguauacugccacuaaccuuccaaaaauuacuuaguauugcaaag

SEQ ID NO: 401844 - RNA, 64 nt, Human
ccggggagagauuuauaaaaguaaacaaaagaaaaccuuccagcaacaaauuaaaaaauaauaa

SEQ ID NO: 401845 - RNA, 64 nt, Human
ucaguuaaagaacaaaccaugugacaaaauuguuaccuuccacuuacuguagcaaauaauaccu

SEQ ID NO: 401846 - RNA, 64 nt, Human
ucaccacucccgucaugccugcugucggcguuugaccuuccacgugacaguucuucacaauucc

SEQ ID NO: 401847 - RNA, 64 nt, Human
aagacugugcugagaagcaguauaagccuuuuuaaccuuccaagacugaagacugcacagguga

SEQ ID NO: 401848 - RNA, 64 nt, Human
gcuuuguauaaguggucuuucuaugggcaguuucaccuuccaugaaggcuuauaacucaaccac

SEQ ID NO: 401849 - RNA, 64 nt, Human
cuauucggcaaggaaguuaguuuuuaaucucuccaccuuccaaagagugcuaagcauuagcuuu

SEQ ID NO: 401850 - RNA, 64 nt, Human
aaaucugggaagcauaguuuauuugcaaguguucaccuuccaaaucaugaggcauagcaugacu

SEQ ID NO: 401851 - RNA, 64 nt, Human
gucaauuuaccgugucuuaauuuaaucuuuguacaccuuccauuuuuaagugcuuaaaugagua

SEQ ID NO: 401852 - RNA, 63 nt, Human
ccuggaauuugagagagcaaauaaagaccugagaaccuuccagaaucugcauguucgcugugc

SEQ ID NO: 401853 - RNA, 64 nt, Human
uuaaaguucuaucuucccuuucccaccuuuuuugaccuuccacuagaccaugagcaccugggcg

SEQ ID NO: 401854 - RNA, 64 nt, Human
uauaaccaaguuggauaccuguguauagcuucccaccuuccaugagugcagcacacagguagug

SEQ ID NO: 401855 - RNA, 64 nt, Human
ugggggaaaacgggcagucugcucugcugcucugaccuuccagagcccaaggucagggaggggc

SEQ ID NO: 401856 - RNA, 64 nt, Human
ucccaaggcacccugugccugcuucccucagaggaccuuccaauccauuugccccgcaacccug

SEQ ID NO: 401857 - RNA, 64 nt, Human; identical to SEQ ID NO: 162855

SEQ ID NO: 401858 - RNA, 64 nt, Human; identical to SEQ ID NO: 162856

SEQ ID NO: 401859 - RNA, 64 nt, Human; identical to SEQ ID NO: 162857

SEQ ID NO: 401860 - RNA, 64 nt, Human
cggaacugggaguggggggccaggggccuuccuaaccuuccaucauccucagcuagauguaugc

SEQ ID NO: 401861 - RNA, 64 nt, Human
guucccuuaagucuugcccuagcugugcucugccaccuuccagacucacuccccucugcaaaua

SEQ ID NO: 401862 - RNA, 64 nt, Human
guucaacacccugcucccugaucugucagagcuuaccuuccaaccacaaggcaacuuccuggcu

SEQ ID NO: 401863 - RNA, 64 nt, Human
ugcaguggcacgaucuuggcucacuccaaccuccaccuuccagguucaagugauucuccugccu

SEQ ID NO: 401864 - RNA, 64 nt, Human
aucuccacaaggcggccagcccagcccuguccucaccuuccagccccagcugagcagccccucc

SEQ ID NO: 401865 - RNA, 64 nt, Human
acuguguucugcguuuggucucauaccugcgucuaccuuccaucuguguccagcggccccggcu

SEQ ID NO: 401866 - RNA, 64 nt, Human
cuagugauaauacauugucagccuuuucuguggcaccuuccagaugagaaugagggagcgacca

SEQ ID NO: 401867 - RNA, 64 nt, Human
guggaagggagcucccagcgcagccguggcagccaccuuccaggagcaggggcuggaauguccu

SEQ ID NO: 401868 - RNA, 64 nt, Human
gagguaggggcucuuaagguacagaacuccacaaaccuuccaaaucuggaggagggcccccaua

SEQ ID NO: 401869 - RNA, 64 nt, Human
ugaguccugggcuaacuaccucugauccucuuugaccuuccauuacauaccuaauccuagcugu

SEQ ID NO: 401870 - RNA, 64 nt, Human
guggcaagaagaggacaguggaccagcuccugggaccuuccaaaacauuggcuuugacaucugc

SEQ ID NO: 401871 - RNA, 64 nt, Human
ucaaccugcauagccggugggugaggagauucccaccuuccauagccuccaaacauguucccaa

SEQ ID NO: 401872 - RNA, 64 nt, Human
gccuuaugucaccaaccagaccuaucaggaacgcaccuuccagagccugaugugagacucaucc

SEQ ID NO: 401873 - RNA, 64 nt, Human
uuuuauuuuuaaaaaaacuagggggaaaauagcaaccuuccauuugguuucccuucuauaauag

SEQ ID NO: 401874 - RNA, 64 nt, Human
gaaacauauuaagauagauacagaaauguguucaaccuuccaucuuggcuaguuguggcguuua

SEQ ID NO: 401875 - RNA, 64 nt, Human
uuggcucuugaacugagcuuggaagcuucuggugaccuuccaagagccugagagugagguggaa

SEQ ID NO: 401876 - RNA, 64 nt, Human; identical to SEQ ID NO: 162817

SEQ ID NO: 401877 - RNA, 64 nt, Human; identical to SEQ ID NO: 162818

SEQ ID NO: 401878 - RNA, 64 nt, Human; identical to SEQ ID NO: 162819

SEQ ID NO: 401879 - RNA, 64 nt, Human
ugacacuuauaaauccuaauaaacuguuaaacccaccuuccagccuuuuaggaguugcuaaaau

SEQ ID NO: 401880 - RNA, 64 nt, Human
agugaagcaguuugguuuauauucuuauguuaucaccuuccaaacaaaagcacuuacuuuuuuu

SEQ ID NO: 401881 - RNA, 64 nt, Human
ggaaaaggcuucgugaaauguuaaugaugcguacaccuuccagauggcacagcacuuucccaug

SEQ ID NO: 401882 - RNA, 64 nt, Human
gguugggcccccggggccagguugaucuaccgacaccuuccacuucuuuccugggagagacugc

SEQ ID NO: 401883 - RNA, 64 nt, Human
ucuccuguauguguagccacucgaugccuaaccuaccuuccacaagccagccccgcaucccugc

SEQ ID NO: 401884 - RNA, 64 nt, Human
acccccaucccucgggaagcagccagcuccccacaccuuccagggcccuaggccccuccuagac

SEQ ID NO: 401885 - RNA, 64 nt, Human
agacguccuucucuucccggauaagaagcagaggaccuuccagccacccgcgacaggugagagc

SEQ ID NO: 401886 - RNA, 64 nt, Human
agucuuuaacuuccaauacuucaucauguauguaaccuuccauguuugcuucugauaaauggaa

SEQ ID NO: 401887 - RNA, 64 nt, Human
ccaucuccaugugaccgaacacugcagcugucugaccuuccaaagacuaagacucgcggcaggu

SEQ ID NO: 401888 - RNA, 64 nt, Human
aggcggaggcugugcuccgccauggugucccgguaccuuccauacacagaggagugcagccuuc

SEQ ID NO: 401889 - RNA, 64 nt, Human
uuucuaugacgcggagcgccacugccaccuguacaccuuccacgcccgcuuuggggagguucgc

SEQ ID NO: 401890 - RNA, 64 nt, Human
ccgcucugcgggaguguccucgggacacacuuaaaccuuccaaguagcacagaagcccccucca

SEQ ID NO: 401891 - RNA, 64 nt, Human
gaagggacaagaggcuggccucuacaucacucucaccuuccaaaucuuguggaagugcaucuac

SEQ ID NO: 401892 - RNA, 64 nt, Human
cucccccaagccaggccccuguccccaccccaccaccuuccagggugccaggcagggcuggccu

SEQ ID NO: 401893 - RNA, 64 nt, Human
ccacagggacacugcucugccugccuggcccucaaccuuccaugaccagcgugugcgcagggcc

SEQ ID NO: 401894 - RNA, 64 nt, Human
cugcccccugggugguaaguuuccuccuuucucaaccuuccacgaggaggaaagaagugugcag

SEQ ID NO: 401895 - RNA, 64 nt, Human; identical to SEQ ID NO: 162809

SEQ ID NO: 401896 - RNA, 51 nt, Human; identical to SEQ ID NO: 162810

SEQ ID NO: 401897 - RNA, 64 nt, Human; identical to SEQ ID NO: 162820

SEQ ID NO: 401898 - RNA, 64 nt, Human
acacacagcaauaagugauuacagcuccuagacuaccuuccaaaaccuguuugggaagcauauu

SEQ ID NO: 401899 - RNA, 64 nt, Human
cgagaacccucucggcagcagccaggagcuguucaccuuccagaagcagggccuguggcagccu

SEQ ID NO: 401900 - RNA, 64 nt, Human
aaucauuugaauuuuguuuuuguacguaaaguuaaccuuccaauugucugagcugucgucacug

SEQ ID NO: 401901 - RNA, 64 nt, Human
augcuuuucucucagcauagguaugcuuacuaugaccuuccaaguuugacuuguauaacaucac

SEQ ID NO: 401902 - RNA, 64 nt, Human
ugcgucgggcaugcuuggaagcuggccugccaggaccuuccacccuggggccugugucagccgc

SEQ ID NO: 401903 - RNA, 64 nt, Human
gagacucacaggaaggaggagccgaccgggaauaaccuuccauacauuuuuuucuuugucuuau

SEQ ID NO: 401904 - RNA, 64 nt, Human
uauuugaaauuuuauuucugauuaugucaaauacaccuuccauuuugucauuuuuguuuaaacu

SEQ ID NO: 401905 - RNA, 64 nt, Human
cauuccccuaaacagaagaaaagaccaaauaauuaccuuccauuccucuucaugugggaauaua

SEQ ID NO: 401906 - RNA, 64 nt, Human
guuuucugcuuuuacuuccaucucuccccucuugaccuuccacccacuccccuccagggagaga

SEQ ID NO: 401907 - RNA, 64 nt, Human
acggcaauuucuuauaaaugagggaagucuuaagaccuuccauuuuuuagagacauacaaauuu

SEQ ID NO: 401908 - RNA, 64 nt, Human
ugguccgcacccuggcucuccugcagguccacacaccuuccaggccuguggccugccuccaaag

SEQ ID NO: 401909 - RNA, 64 nt, Human
ggggaaaguccuuuuugcccuucuccaaaaaauaaccuuccacagagacaaacuguccuucuau

SEQ ID NO: 401910 - RNA, 64 nt, Human
guaucuauuaaauaaaccaaagcaguaauuaauaaccuuccaaggccagguacagugguucaug

SEQ ID NO: 401911 - RNA, 64 nt, Human
acccccuccccaccaccuacacacaugcuguuuuaccuuccaagaauaggacaugugcaaaaac

SEQ ID NO: 401912 - RNA, 64 nt, Human
aaguucugugguuucaguuaagcauuccaauaacaccuuccaaaaaccuggaguguaagagcuu

SEQ ID NO: 401913 - RNA, 64 nt, Human
uucccggucccuccgcgugugccgauuccagaugaccuuccaguguccccaagguucuuccauc

SEQ ID NO: 401914 - RNA, 64 nt, Human; identical to SEQ ID NO: 162803

SEQ ID NO: 401915 - RNA, 64 nt, Human; identical to SEQ ID NO: 162804

SEQ ID NO: 401916 - RNA, 64 nt, Human; identical to SEQ ID NO: 162815

SEQ ID NO: 401917 - RNA, 64 nt, Human
ccuagagcuuaauuaaguuuuagaaauauguaauaccuuccaucauuccaucauccuuaaauuc

SEQ ID NO: 401918 - RNA, 64 nt, Human
gagacuccaucucaauaaaauuaauaauaauaaaaccuuccaaaaaaagugccgggaccaaaug

SEQ ID NO: 401919 - RNA, 64 nt, Human
auaucuauuaaauaaauugaagcaguaauuaauaaccuuccaagaccaggcgcgguggcuaaaa

SEQ ID NO: 401920 - RNA, 64 nt, Human
ucuuccucucacuaugugaugccugcuccccuucaccuuccaccaugaguggaagcaccuauac

SEQ ID NO: 401921 - RNA, 64 nt, Human
uaaaucugcacucugcugcuccucccccacccccaccuuccacuccauacaaucugggccuggu

SEQ ID NO: 401922 - RNA, 64 nt, Human
gucuguuagaauaggcucucuacccagcuagaacaccuuccagacacuugcuggacagcuaucu

SEQ ID NO: 401923 - RNA, 64 nt, Human
gagcucugcccuugaccuguauuccacuuacuccaccuuccauuccucgcccuguccccacagc

SEQ ID NO: 401924 - RNA, 64 nt, Human
aggugaagccugagacgaauggcuuucccaggcuaccuuccaucacuguuguacagaaaagaaa

SEQ ID NO: 401925 - RNA, 64 nt, Human
aaacuuguuaccccuaacacaugcuaccaugcagaccuuccaggcagcauggaaaauaccagcg

SEQ ID NO: 401926 - RNA, 64 nt, Human
cucccucugucccucuccuugcccccagugccucaccuuccaacacuccauuauuccucucacc

SEQ ID NO: 401927 - RNA, 64 nt, Human
gggggggaaauaccaaagugugaaauacugugcuaccuuccagaguucccacaugggcugggau

SEQ ID NO: 401928 - RNA, 64 nt, Human
uccacuguccacccuaacacauacccucccacccaccuuccagacccccuugguuggcacccuc

SEQ ID NO: 401929 - RNA, 64 nt, Human
aaaagagagaaggcagggagaguagggagagaaaaccuuccagcagcccaguaaacugcgggcg

SEQ ID NO: 401930 - RNA, 64 nt, Human
ccaaucaaacuuagucuuuuuaugagaaaccuggaccuuccaugaauguugccagcaauaaagu

SEQ ID NO: 401931 - RNA, 64 nt, Human
gucaaaugggcaaggccugccucggggaacuagaaccuuccaggaucuggagcccgggagagcc

SEQ ID NO: 401932 - RNA, 64 nt, Human
gccccgcggaagaccgcccagugagccagcccccaccuuccaggcgccuucgcccuggggaucc

SEQ ID NO: 401933 - RNA, 64 nt, Human; identical to SEQ ID NO: 162822

SEQ ID NO: 401934 - RNA, 64 nt, Human; identical to SEQ ID NO: 162823

SEQ ID NO: 401935 - RNA, 64 nt, Human; identical to SEQ ID NO: 162824

SEQ ID NO: 401936 - RNA, 64 nt, Human
uuuccuccaccccuccaucccccaaugcuuguagaccuuccauucauuccgucucaucgugcgu

SEQ ID NO: 401937 - RNA, 64 nt, Human
aaaugcuaaggagcugagggugcccaccaagcccaccuuccagaaacuuggagaaauggggguu

SEQ ID NO: 401938 - RNA, 64 nt, Human
gagaguggucacuggggaaaaggaccuggccaucaccuuccaauaccugcugccugucucccug

SEQ ID NO: 401939 - RNA, 64 nt, Human
aucuaagugcaacccuaccacuucucugcugagaaccuuccagugguuccccucaccuucugca

SEQ ID NO: 401940 - RNA, 64 nt, Human
aaaaaaugagaguguucuacccaguuuucaauaaaccuuccaggcugcaauaaccagcaagguu

SEQ ID NO: 401941 - RNA, 55 nt, Human
ccaaaaguaaaaacuauugagguguaccuuccauuuuaaaauuuuucuucagauc

SEQ ID NO: 401942 - RNA, 64 nt, Human
uccaugcaccaaacuaauaaaacuuugacgagucaccuuccaggaccccuggguagaaggcagc

SEQ ID NO: 401943 - RNA, 64 nt, Human
gaauuuuuuucugcacagcuuuuccaaaauaaaaaccuuccaaacaauucugccacucgcaauc

SEQ ID NO: 401944 - RNA, 64 nt, Human
auggcacugaaggggcuggggaaacccugcugagaccuuccaaggacagccguguugguuggac

SEQ ID NO: 401945 - RNA, 64 nt, Human
cggcaagugucuuuuaugaauuaaaaugaacuaaaccuuccacuucaggguuuggaugaaacua

SEQ ID NO: 401946 - RNA, 64 nt, Human
aaaaccuaaagguggccucuaggagaugagaccuaccuuccaguugucagcaagcaggaaaaaa

SEQ ID NO: 401947 - RNA, 64 nt, Human
uuaguuauaagguuguggaauuuaugcuuggcccaccuuccaagacuggcacugcccaacagac

SEQ ID NO: 401948 - RNA, 64 nt, Human
gugauuacaucuuuccauaucuuuuacacuuaccaccuuccagcucuguuuugcuguguauuuu

SEQ ID NO: 401949 - RNA, 64 nt, Human
ucuggggcuugggggucaacuccccccaggacuuaccuuccaaaacaaacuuucuucacuuugu

SEQ ID NO: 401950 - RNA, 64 nt, Human
aauuuugacacauuacagcugaaggaagaggaucaccuuccaagacaaaacagucuucaugggg

SEQ ID NO: 401951 - RNA, 64 nt, Human
auuccagaugagucacuguaacucuagaagauuaaccuuccagccaaccuauuuuccuuucccu

SEQ ID NO: 401952 - RNA, 64 nt, Human; identical to SEQ ID NO: 162825

SEQ ID NO: 401953 - RNA, 64 nt, Human; identical to SEQ ID NO: 162826

SEQ ID NO: 401954 - RNA, 64 nt, Human; identical to SEQ ID NO: 162828

SEQ ID NO: 401955 - RNA, 64 nt, Human
uucaccauaucccagccuccaaaucuauccuccuaccuuccaacgcaugaccuguuggggagca

SEQ ID NO: 401956 - RNA, 64 nt, Human
ccugggaagaccagguggcaggucgcaguuggguaccuuccauucccaccacacagacucuggg

SEQ ID NO: 401957 - RNA, 64 nt, Human
cuuggggugcucuucugugacacuugccaccaccaccuuccaguagcaagcugguagagcugua

SEQ ID NO: 401958 - RNA, 64 nt, Human
gagaaacauccugccagguuuaaacaucacuuguaccuuccacaagacucagaauccacagugu

SEQ ID NO: 401959 - RNA, 64 nt, Human
caugaaucagauguguguucucagugaaauaacuaccuuccacucuggaaccuuauuccagcag

SEQ ID NO: 401960 - RNA, 64 nt, Human
cucuucuuccauauuagugucaucuugccucccuaccuuccacaugccccaugacuugaugcag

SEQ ID NO: 401961 - RNA, 64 nt, Human
gaaccaggaaugaguaucuaauagcuuuuguagaaccuuccagaauauguggggaaaaagggcu

SEQ ID NO: 401962 - RNA, 64 nt, Human
cugccccuaggaccccuccuuugccucaugagucaccuuccacucaccugugugcagacccuca

SEQ ID NO: 401963 - RNA, 64 nt, Human
ggagguggggagucaccuuguggcaucuccccccaccuuccaaacaaaaaccugccauuuucac

SEQ ID NO: 401964 - RNA, 64 nt, Human
accgccacugcucacgugggcuuuacauacauugaccuuccauucacugcagugggaauucuca

SEQ ID NO: 401965 - RNA, 64 nt, Human
aaaauuuuuuuugaaaaaaacaaggccagccccaaccuuccaaaccuccaucaccaacaaccca

SEQ ID NO: 401966 - RNA, 64 nt, Human
ugcaucagacaaugccauuucuccccaccacggaaccuuccaucuaagauuucuuccagggaau

SEQ ID NO: 401967 - RNA, 64 nt, Human
gauguggcuccuagugcaaaccggaaaccauggcaccuuccagagccguggucucaaggaguca

SEQ ID NO: 401968 - RNA, 64 nt, Human
acaaaugugcccagaucuaacaaaguaggcuaagaccuuccacuuaaaagcauguuuaacugga

SEQ ID NO: 401969 - RNA, 64 nt, Human
aaguaacuuuguuugguaaagcaccaguacuccaaccuuccagaaagccgauuaucuucauugc

SEQ ID NO: 401970 - RNA, 64 nt, Human
uuuuuuaucuccaagggacucucccggcacuucuaccuuccagaguuacuucagugcauaaagu

SEQ ID NO: 401971 - RNA, 64 nt, Human; identical to SEQ ID NO: 162835

SEQ ID NO: 401972 - RNA, 64 nt, Human; identical to SEQ ID NO: 162836

SEQ ID NO: 401973 - RNA, 64 nt, Human; identical to SEQ ID NO: 162858

SEQ ID NO: 401974 - RNA, 64 nt, Human
aauaagcauaugcuucuguuuauuaaaaaaagaaaccuuccaauguccaaaacugcuaacccuc

SEQ ID NO: 401975 - RNA, 64 nt, Human
ugacugaaacacccugguggaaaccuguugacagaccuuccacuuucucuucagaauaaguagc

SEQ ID NO: 401976 - RNA, 64 nt, Human
acuaugcuaagcacuuugggagcaagaaccuccuaccuuccaguuuaaacacuagugguauugu

SEQ ID NO: 401977 - RNA, 64 nt, Human
ugcuguguguccugcagggaguggccaacucuccaccuuccagcaccauuaucagaggguggga

SEQ ID NO: 401978 - RNA, 64 nt, Human
uucugcaacgugacauaucccccaaaaugaaguuaccuuccaaguuggacacgucccguaguug

SEQ ID NO: 401979 - RNA, 64 nt, Human
uuuuaaacgguccuuaacaugccuuuguucaagcaccuuccagaauguaagguucagcagcucu

SEQ ID NO: 401980 - RNA, 64 nt, Human
caggaggcagggagacagggcugcagggccucccaccuuccaacagacaggcucugcuguaucu

SEQ ID NO: 401981 - RNA, 64 nt, Human
uuuagaaaucugaucucggcuccaaccaacagccaccuuccagggauggggggccugaagccuc

SEQ ID NO: 401982 - RNA, 53 nt, Human
auaaucauagcgggaaauaaagcaccuuccaagcuugccuccaagaguuacga

SEQ ID NO: 401983 - RNA, 64 nt, Human
agguuuucaaaaccuuuagcacaaagagagcaaaaccuuccagccuugccugcuugguguccag

SEQ ID NO: 401984 - RNA, 64 nt, Human
ggaugaaacccagcaucagagagguuuucagcaaaccuuccaugcucaccuuuggccaggugcu

SEQ ID NO: 401985 - RNA, 64 nt, Human
accccucuagcucucggaggggcgaucaugagaaaccuuccagggaaacugagcacaggaugaa

SEQ ID NO: 401986 - RNA, 64 nt, Human
ccuugugcugguaagguccuagcaucuuccccucaccuuccacccaugagaacagcgugagcug

SEQ ID NO: 401987 - RNA, 64 nt, Human
auugagccccaagaaaaaucgcugauucugaggaaccuuccaacuuuaacaauuucaggacguc

SEQ ID NO: 401988 - RNA, 64 nt, Human
gugucaaauuuugaaguguuaauuuugucuuagaaccuuccaguaagugaaauacaaccuaguu

SEQ ID NO: 401989 - RNA, 64 nt, Human
agcuagcacugggacacagauccuugucuucagcaccuuccaaggagccaacuuuuauucccuu

SEQ ID NO: 401990 - RNA, 64 nt, Human; identical to SEQ ID NO: 162832

SEQ ID NO: 401991 - RNA, 64 nt, Human; identical to SEQ ID NO: 162833

SEQ ID NO: 401992 - RNA, 64 nt, Human; identical to SEQ ID NO: 162834

SEQ ID NO: 401993 - RNA, 64 nt, Human
ggauacuacugggaaggggauggcagcuacugccaccuuccagaugguuccauggaguucugau

SEQ ID NO: 401994 - RNA, 64 nt, Human
gauguuccaugcaugucccugcuuccaaagccugaccuuccaaagcuugcuuccuuccuccugg

SEQ ID NO: 401995 - RNA, 64 nt, Human
gagugucugaucaucucucuuggaaguuuucugaaccuuccaagcucuguggugaggacaaacc

SEQ ID NO: 401996 - RNA, 64 nt, Human
acagaguuggaaacccucaccaacuggccucuucaccuuccacauuaucccgcugccaccggcu

SEQ ID NO: 401997 - RNA, 64 nt, Human
ccccucugccccuggcaccauuccagaacugcccaccuuccacacugagguagccgagccucuc

SEQ ID NO: 401998 - RNA, 64 nt, Human
gcaaaugcuucuaagaugccuucucucuccaucuaccuuccagucaggaugacgguauuaugcu

SEQ ID NO: 401999 - RNA, 64 nt, Human
aagagaaccuucagauccuaccagcaaccguagcaccuuccacccaggggacucccagaagcca

SEQ ID NO: 402000 - RNA, 64 nt, Human
aaugcuccagaucccaguauucagaugugucuauaccuuccacuaugaacacagauaaacugag

SEQ ID NO: 402001 - RNA, 64 nt, Human
acucagcuguccugcagcaaacacuccacccuccaccuuccauuuucccccacuacugcagcac

SEQ ID NO: 402002 - RNA, 64 nt, Human
acuuuuaaauaaacaacuuugaugauguaacuugaccuuccagaguuauggaaauuuugucccc

SEQ ID NO: 402003 - RNA, 64 nt, Human
cuucacaucaucagaggacgccccgugcgcugucaccuuccaccccacaaggccaaccuuuuuc

SEQ ID NO: 402004 - RNA, 64 nt, Human
ucccugcccagcugggccucucuggccuauuccuaccuuccaggcccacugcacuccugucugg

SEQ ID NO: 402005 - RNA, 64 nt, Human
ucaccucugaggccugggcccaggguucaggggaaccuuccaaggugucugguugcccugccuc

SEQ ID NO: 402006 - RNA, 64 nt, Human
guuuugcuccauacuaaaugacaaaaccauaaaaaccuuccaauguggggagaaaggaagcuuu

SEQ ID NO: 402007 - RNA, 64 nt, Human
gcggcaucuuuccuugucgaaugauacuguaaugaccuuccaaagugaagaguagcacauuaaa

SEQ ID NO: 402008 - RNA, 64 nt, Human
uccugcauucacccagacagcucccucugccugaaccuuccaucucgccaccccuccuuccuug

SEQ ID NO: 402009 - RNA, 64 nt, Human; identical to SEQ ID NO: 162838

SEQ ID NO: 402010 - RNA, 64 nt, Human; identical to SEQ ID NO: 162839

SEQ ID NO: 402011 - RNA, 64 nt, Human; identical to SEQ ID NO: 162840

SEQ ID NO: 402012 - RNA, 64 nt, Human
guccuguacccaguguuacccucguuauuuuguaaccuuccaauuccugaucacccaaggguuu

SEQ ID NO: 402013 - RNA, 64 nt, Human
cguccacccugugcugcuucccuucacagcauuaaccuuccagucugggucccacugagccuca

SEQ ID NO: 402014 - RNA, 64 nt, Human
aagggagcugccaucugucccucugcagagggauaccuuccaauaguaaauuaucugguuccuc

SEQ ID NO: 402015 - RNA, 64 nt, Human
guggguggauccugguuucgugugcugcccaugcaccuuccagcccggggccagcuuggcaggg

SEQ ID NO: 402016 - RNA, 64 nt, Human
gccccacuuugucuuucuaagguaagaagccuucaccuuccagcuuuugucuggccugugcugc

SEQ ID NO: 402017 - RNA, 64 nt, Human
aauacuaaaacccaacaaaaugcaacugaaaaauaccuuccaaauuugccaagaaaaaaaauuc

SEQ ID NO: 402018 - RNA, 64 nt, Human
acggacuucugcugcugccaccugcgccagcccuaccuuccaccacagaugucucccagauggg

SEQ ID NO: 402019 - RNA, 64 nt, Human
ucugccguccagaugcugcaguguggccagauuuaccuuccaguaacauacuucuagucacccc

SEQ ID NO: 402020 - RNA, 64 nt, Human
aggaaguggauaugaagauggauugauucagcucaccuuccaugauugcuuuugagggaaaagc

SEQ ID NO: 402021 - RNA, 64 nt, Human
guguaauaagcugcggaugggcuuuccugccaccaccuuccaggacauccagcgcggggugaca

SEQ ID NO: 402022 - RNA, 64 nt, Human
agcacgccuguacuagagcaagcaggaaucagagaccuuccagaaauacuacuguguaagggcc

SEQ ID NO: 402023 - RNA, 64 nt, Human
caggccuugcauuuucuacugggagguucaucaaaccuuccacuuagcaauagcccugacucag

SEQ ID NO: 402024 - RNA, 64 nt, Human
gcacaucugccugucccuguaucagcggcuacccaccuuccaaaccacucaggacaguacccgu

SEQ ID NO: 402025 - RNA, 64 nt, Human
ggguggaauacauguccuggacuaagccaaugacaccuuccaucuuuccagcuauggugacugg

SEQ ID NO: 402026 - RNA, 64 nt, Human
ugcauuccugucuggaaccagugaaugcauuagaaccuuccauaggaaaagaaaaggggcugag

SEQ ID NO: 402027 - RNA, 64 nt, Human
gucagaugaagcacguucugccggggaggcccucaccuuccagagaggacagacacagauuucc

SEQ ID NO: 402028 - RNA, 64 nt, Human; identical to SEQ ID NO: 162844

SEQ ID NO: 402029 - RNA, 64 nt, Human; identical to SEQ ID NO: 162845

SEQ ID NO: 402030 - RNA, 64 nt, Human; identical to SEQ ID NO: 162846

SEQ ID NO: 402031 - RNA, 64 nt, Human
ccccgcccagcagcccccagagacacaacaaccuaccuuccagccuuaacucgaugguccgucc

SEQ ID NO: 402032 - RNA, 64 nt, Human
cgggcaccuguucgugcagcagcacacacacccuaccuuccacgcgcugcgcagccucgaccag

SEQ ID NO: 402033 - RNA, 64 nt, Human
gcuucuuccccaggaagcggggucuuggccuggaaccuuccagagaggaggcgggagcaauuuu

SEQ ID NO: 402034 - RNA, 64 nt, Human
aggcuccaagugcaauuaauaauaacucauuuauaccuuccacagaauuuaauaaagauucuac

SEQ ID NO: 402035 - RNA, 64 nt, Human
cccuagcuggccggccaccuccuuuccucucgccaccuuccaccccugcgcugugcugacccca

SEQ ID NO: 402036 - RNA, 64 nt, Human
agcucugcacuucgugucugcugagagcaaccagaccuuccauguccucgggcagcugcaacuc

SEQ ID NO: 402037 - RNA, 64 nt, Human
ucggauggguggguaagcccaggauuugcacaugaccuuccauccuuaccuguauucccaucuc

SEQ ID NO: 402038 - RNA, 64 nt, Human
gaaccacagcccaggucuccugacuccaucccauaccuuccaggccuaggccucugccuguuuu

SEQ ID NO: 402039 - RNA, 64 nt, Human
ucugaauuuccugccuacaaaauggagaaauaggaccuuccacacagggugcaugugaggauga

SEQ ID NO: 402040 - RNA, 64 nt, Human
aucugcuccagggggacagccccucguguccagaaccuuccauacccccaagacagugucuugu

SEQ ID NO: 402041 - RNA, 64 nt, Human
uguaaaugccugcaacccagggcagggggcugagaccuuccaggcccugaggaaucccgggcgc

SEQ ID NO: 402042 - RNA, 64 nt, Human
ggcuguggguggggaaggaaggcguguccaggagaccuuccacaaaggguagccuggcuuuucu

SEQ ID NO: 402043 - RNA, 64 nt, Human
ggcccuagacccucccccaccauuccacauccccaccuuccaaggaaaagcagaaguucauggg

SEQ ID NO: 402044 - RNA, 64 nt, Human
gugcagcagggaaggcccaacugguucaggcucaaccuuccaacuuccuguggccugaagaagc

SEQ ID NO: 402045 - RNA, 64 nt, Human
uguuggaacuggagcaucauaaagauagcaagcuaccuuccaaggccgagccagcccagagagg

SEQ ID NO: 402046 - RNA, 64 nt, Human
cguucuuucagcaaaaagucuaauucagagacucaccuuccauccuggcacuaaacaauaguac

SEQ ID NO: 402047 - RNA, 64 nt, Human; identical to SEQ ID NO: 162859

SEQ ID NO: 402048 - RNA, 64 nt, Human; identical to SEQ ID NO: 162860

SEQ ID NO: 402049 - RNA, 64 nt, Human; identical to SEQ ID NO: 162861

SEQ ID NO: 402050 - RNA, 64 nt, Human
ugaaagagaacugaggggccacaaaauaaacuucaccuuccauuaaguguucaagcaugucugc

SEQ ID NO: 402051 - RNA, 64 nt, Human
ugcaguggcaugaucauggcucacugcagccuugaccuuccagccugccaaguagcugggauua

SEQ ID NO: 402052 - RNA, 64 nt, Human
ggccugacaugguugucaucacuaguggcaaaugaccuuccaaguaagcagaugggaacugaau

SEQ ID NO: 402053 - RNA, 64 nt, Human
aaucucagagcuuagaagccaacccagugacuagaccuuccagugaagaaagugaucucaagag

SEQ ID NO: 402054 - RNA, 64 nt, Human
gugaacugcaacaacgccuggugccccagcaccaaccuuccaaguguaaaaacaaugugcugcu

SEQ ID NO: 402055 - RNA, 64 nt, Human
ucuccugucccuucccaucccaccccuuuagacuaccuuccaguaaaucacacugucauuuggu

SEQ ID NO: 402056 - RNA, 64 nt, Human
uggcacauaaagaaaucuugaggacuuuguuuaaaccuuccauaaaaaaacaauuuucgguuuc

SEQ ID NO: 402057 - RNA, 64 nt, Human
cccccgggaaaugagcucccagggcuggcgucccaccuuccaggugggggcuggcacaucacag

SEQ ID NO: 402058 - RNA, 64 nt, Human
gccgcaccccccuuuccaggguccuccggaccccaccuuccacacucugaucacagccccccua

SEQ ID NO: 402059 - RNA, 64 nt, Human
gaaaaaaguuguaugaauauaaaaauguacuaaaaccuuccauuuuuuucaguaccuuuugaaa

SEQ ID NO: 402060 - RNA, 64 nt, Human
caccuggccaaugugcauuuuugcacaugcuggaaccuuccaugggggucugggcuauuggcug

SEQ ID NO: 402061 - RNA, 64 nt, Human
cauugcugcuuguucuggagacccccgcccccgcaccuuccagacuuagcagaagaacaaacug

SEQ ID NO: 402062 - RNA, 64 nt, Human
uuucccaugcccugguuccagauacauuuugaaaaccuuccaucuuauuggcauuuucuggggu

SEQ ID NO: 402063 - RNA, 64 nt, Human
cugggguccuugacacacauaaaggugcccccccaccuuccaccucuuagcacuggugacccca

SEQ ID NO: 402064 - RNA, 64 nt, Human
gaagagaacacuuccuguuggucugucucuucccaccuuccaucugcacacacccccaagguaa

SEQ ID NO: 402065 - RNA, 64 nt, Human
agaacauguaaacucuucaccucaacuagcuacaaccuuccacuccuaaccucccaagcuucuc

SEQ ID NO: 402066 - RNA, 64 nt, Human; identical to SEQ ID NO: 162800

SEQ ID NO: 402067 - RNA, 64 nt, Human; identical to SEQ ID NO: 162801

SEQ ID NO: 402068 - RNA, 64 nt, Human; identical to SEQ ID NO: 162802

SEQ ID NO: 402069 - RNA, 64 nt, Human
uuugcuaaguguaugaugucacacaagcuccuuaaccuuccaugucuccauuuucuucucugug

SEQ ID NO: 402070 - RNA, 64 nt, Human
agguuacugccuuacccugggccucaguuuccccaccuuccaaagggaggagcaucauuccuuc

SEQ ID NO: 402071 - RNA, 64 nt, Human
uaaaaaccuagccucuaacaccuuguuccagguuaccuuccaaaguuucuaucuugugucacua

SEQ ID NO: 402072 - RNA, 64 nt, Human
cuauuucaacauguggguucacagauuuauucuaaccuuccaaguaaaguuguuccacuaguaa

SEQ ID NO: 402073 - RNA, 64 nt, Human
uuucugucuuguuaauauugauuaauuuuuauugaccuuccaugguccucacugauuguuuucu

SEQ ID NO: 402074 - RNA, 64 nt, Human
cagugaaaauggccucaucucauaccauggcuccaccuuccauacaccagccacacggaacuac

SEQ ID NO: 402075 - RNA, 64 nt, Human
uggggacuuuaccugcugggaccugcucccagagaccuuccacacugaaucucaccugcuagga

SEQ ID NO: 402076 - RNA, 64 nt, Human
caucugcuccaaguugggccuggccuuccugcacaccuuccaugaggucaccuuccgaaagccu

SEQ ID NO: 402077 - RNA, 64 nt, Human
acaguagggcucccagguggcugguucucagcacaccuuccaugaaucugcuugcugcugcuuc

SEQ ID NO: 402078 - RNA, 64 nt, Human
uucacacuccauuucccaguuucuguugacccccaccuuccaguguuggacaggauggaggggg

SEQ ID NO: 402079 - RNA, 64 nt, Human
aacacgcugggccccucccuggggcggggacucuaccuuccagauucagucccuagucuugcga

SEQ ID NO: 402080 - RNA, 64 nt, Human
agagaaaccuuaaaaguguaaugaguguggcaacaccuuccaucacaauucaacccuuguaagu

SEQ ID NO: 402081 - RNA, 64 nt, Human
agagaagccuuaauaguguaaugaguguggcaagaccuuccaucacaauucaacccuguaaguc

SEQ ID NO: 402082 - RNA, 64 nt, Human
gugaacuuugaaaucuuauugugcauccuuacacaccuuccauggugcuuucuuggaaagauca

SEQ ID NO: 402083 - RNA, 64 nt, Human
cccuuaagcuuccucugacgguuacccuccccccaccuuccaccccaaccaucugaaccauucc

SEQ ID NO: 402084 - RNA, 64 nt, Human
agagcagggcacugcuggugggaagaggcauuuuaccuuccagugcaaauccugcuccuuugau

SEQ ID NO: 402085 - RNA, 64 nt, Human; identical to SEQ ID NO: 162862

SEQ ID NO: 402086 - RNA, 64 nt, Human; identical to SEQ ID NO: 162863

SEQ ID NO: 402087 - RNA, 64 nt, Human; identical to SEQ ID NO: 162864

SEQ ID NO: 402088 - RNA, 64 nt, Human
ucccgugaucauuaccuggggagggguuccugaaaccuuccacaaugggaucuguggacuuuca

SEQ ID NO: 402089 - RNA, 64 nt, Human
ugcaguggcgugaucuuggcucacuacaaccuccaccuuccaggcuuaagcgauucucaugccu

SEQ ID NO: 402090 - RNA, 64 nt, Human
guggcuccagaugucaggagggacugaccucaggaccuuccagguuccucugugccaggaauga

SEQ ID NO: 402091 - RNA, 64 nt, Human
agcaggugauucagcuacuugaggucgguaacagaccuuccauuccucacugaaggugggguuu

SEQ ID NO: 402092 - RNA, 64 nt, Human
gcgggauucccucauugacagccucaccugagucaccuuccaaguuguuccaugggcuccuggc

SEQ ID NO: 402093 - RNA, 64 nt, Human
uucucuggggauugcugggucacaggugccccucaccuuccacagucaggcagggaaguuauag

SEQ ID NO: 402094 - RNA, 64 nt, Human
aguucuuccucccacaauguaggaccuuuccuuuaccuuccaauggauaaaauaguucagaguu

SEQ ID NO: 402095 - RNA, 64 nt, Human
ccucaaguuccuuuuugcaccgucaccacccaacaccuuccaugacacuuccuugcuuuggcca

SEQ ID NO: 402096 - RNA, 64 nt, Human
cucuuuccugggcucggggcaucugccuggaguuaccuuccaucauggcuaccugcugugguuu

SEQ ID NO: 402097 - RNA, 64 nt, Human
acuaauacagcugccugugacccugggacccgcaaccuuccagcugcuucccuuugucaaaguc

SEQ ID NO: 402098 - RNA, 64 nt, Human
gggagagcgaggccgagcaaggaaagcauuucgaaccuuccaguccagaggaagggacugucgg

SEQ ID NO: 402099 - RNA, 64 nt, Human
accucgacacugagggcccucggugugaagaugaaccuuccaccgucuucacugcauccuggag

SEQ ID NO: 402100 - RNA, 64 nt, Human
gcugcucaaccuccucaucgccauguucaacuacaccuuccagcaggugcaggagcacacggac

SEQ ID NO: 402101 - RNA, 64 nt, Human
agcugccagaaguacagaaguuggagccuccaccaccuuccagaucuguuucuccucaguguaa

SEQ ID NO: 402102 - RNA, 64 nt, Human
ccuagcaccugcucuuggccuggugagccccuccaccuuccaggcuuacucaaagaauucuuuc

SEQ ID NO: 402103 - RNA, 64 nt, Human
cuuacuguaauuguuucugguucuuuccucuaacaccuuccauguaugucaacuuuuuaucacc

SEQ ID NO: 402104 - RNA, 64 nt, Human; identical to SEQ ID NO: 162829

SEQ ID NO: 402105 - RNA, 64 nt, Human; identical to SEQ ID NO: 162830

SEQ ID NO: 402106 - RNA, 64 nt, Human; identical to SEQ ID NO: 162849

SEQ ID NO: 402107 - RNA, 64 nt, Human
acguugcuggggagagaaaagcaguauagacuccaccuuccaggauguccauuucggggagagg

SEQ ID NO: 402108 - RNA, 64 nt, Human
cucuccucguccccacccacccccacauuugcacaccuuccacagggucaggauggaguagcug

SEQ ID NO: 402109 - RNA, 64 nt, Human
cccuaucuugcugcuccucuuggcacucaggggcaccuuccauggagccagaccggguggaggg

SEQ ID NO: 402110 - RNA, 64 nt, Human
acaugucugugugcaccccccuccucuccacccuaccuuccaucaaccagggcagauccaccgu

SEQ ID NO: 402111 - RNA, 64 nt, Human
ccagucugguuacgauggucugagcuuccuuagaaccuuccaugguugucuuuucccagcagau

SEQ ID NO: 402112 - RNA, 64 nt, Human
aauauauccagagauuuugcacaauucguguugaaccuuccaaaacaaaaauaaagaccugucc

SEQ ID NO: 402113 - RNA, 64 nt, Human
gcggggcggggagacccagacccuccgcugggagaccuuccaaaagcaaaaacaaaaaacaaaa

SEQ ID NO: 402114 - RNA, 64 nt, Human
ucugggcuccgggguggcagugaggaccaccuucaccuuccaccugagaggggacucucguugc

SEQ ID NO: 402115 - RNA, 64 nt, Human
cauuauaacugaaagaagguuuaucauuacaaauaccuuccaaugaaaccaagaauuucucaaa

SEQ ID NO: 402116 - RNA, 64 nt, Human
gaagagaugagugaauucugugguugguuaccuuaccuuccaagauacaggguccacuagaaau

SEQ ID NO: 402117 - RNA, 64 nt, Human
cguaaggcugcuggcugaaaacugugucuaugcaaccuuccaagugcggagugucaaccaacug

SEQ ID NO: 402118 - RNA, 64 nt, Human
gcauuuucugcaucuccacuuggcauuagcuaaaaccuuccaugucaagauucagcuaguggcc

SEQ ID NO: 402119 - RNA, 64 nt, Human
aggugucauagaaaaguggaagugcaaagaguggaccuuccaggcaguugcguccaugacacca

SEQ ID NO: 402120 - RNA, 64 nt, Human
cugucucaagcugcugggauguaucucuaggaaaaccuuccaguggguaaaucuuuuucuuuag

SEQ ID NO: 402121 - RNA, 64 nt, Human
ccauuuuacacagcaccacagugaauccagaccaaccuuccauucacaccagcuaaggaguccc

SEQ ID NO: 402122 - RNA, 64 nt, Human
ucuaacacuucucuccuccacucugagcccccugaccuuccaaaccucaauaaacuagccucuu

SEQ ID NO: 402123 - RNA, 64 nt, Human; identical to SEQ ID NO: 162806

SEQ ID NO: 402124 - RNA, 64 nt, Human; identical to SEQ ID NO: 162807

SEQ ID NO: 402125 - RNA, 64 nt, Human; identical to SEQ ID NO: 162808

SEQ ID NO: 402126 - RNA, 64 nt, Human
uuuucacauauuccuuucuucucccucuugggugaccuuccaaaacucugcucucaggcugaaa

SEQ ID NO: 402127 - RNA, 64 nt, Human
aacccuggaccaaagcuuuuccagaccccacccuaccuuccaacccaggucaagacauugccaa

SEQ ID NO: 402128 - RNA, 64 nt, Human
auuuaccaacuaaguauucauguucaaauuacuuaccuuccacucugaagacuuuaaggucauu

SEQ ID NO: 402129 - RNA, 64 nt, Human
cuccucaucucgcucaucccugggcgcgccucccaccuuccacccccaacucccuuccaggguu

SEQ ID NO: 402130 - RNA, 64 nt, Human
auugcccacaaauccuuuuaggaaugggacagguaccuuccacuuguuguauuuauuaguguag

SEQ ID NO: 402131 - RNA, 64 nt, Human
gccagggccacugcgaggggggcugggccagugcaccuuccagggcuccguccacuaguuuccc

SEQ ID NO: 402132 - RNA, 64 nt, Human
gccagggccagugggagggggucugggccagugcaccuuccaaggccccauccauuaguuucca

SEQ ID NO: 402133 - RNA, 64 nt, Human
gccagggccagugggagggggucugggccagugcaccuuccagggccccauccauuagcuucca

SEQ ID NO: 402134 - RNA, 64 nt, Human
gccaaggccagugggagggggacugggccagugcaccuuccagggccgcguccagcagcuuccc

SEQ ID NO: 402135 - RNA, 64 nt, Human
uuuuauauauauaugucuuguguggguguccucgaccuuccaaucuuauuucgucucuuggaga

SEQ ID NO: 402136 - RNA, 64 nt, Human
augguuuucacagguacauguggaacagcguucaaccuuccagggaauacgaccccuucucccu

SEQ ID NO: 402137 - RNA, 64 nt, Human
cauaaaacuguugacuaaaagcuaugucuaugcaaccuuccaagaauaguaugucaagcaacug

SEQ ID NO: 402138 - RNA, 64 nt, Human; identical to SEQ ID NO: 162790

SEQ ID NO: 402139 - RNA, 64 nt, Human; identical to SEQ ID NO: 162791

SEQ ID NO: 402140 - RNA, 64 nt, Human; identical to SEQ ID NO: 162792

SEQ ID NO: 402141 - RNA, 64 nt, Human; identical to SEQ ID NO: 162793

SEQ ID NO: 402142 - RNA, 64 nt, Human; identical to SEQ ID NO: 162794

SEQ ID NO: 402143 - RNA, 64 nt, Human; identical to SEQ ID NO: 162795

SEQ ID NO: 402144 - RNA, 64 nt, Human; identical to SEQ ID NO: 162796

SEQ ID NO: 402145 - RNA, 64 nt, Human; identical to SEQ ID NO: 162871

SEQ ID NO: 402146 - RNA, 64 nt, Human; identical to SEQ ID NO: 162872

SEQ ID NO: 402147 - RNA, 64 nt, Human; identical to SEQ ID NO: 162873

SEQ ID NO: 402148 - RNA, 64 nt, Human; identical to SEQ ID NO: 162874

SEQ ID NO: 402149 - RNA, 64 nt, Human; identical to SEQ ID NO: 162875

SEQ ID NO: 402150 - RNA, 64 nt, Human; identical to SEQ ID NO: 162876

SEQ ID NO: 402151 - RNA, 64 nt, Human; identical to SEQ ID NO: 162877

SEQ ID NO: 402152 - RNA, 64 nt, Human; identical to SEQ ID NO: 162878

SEQ ID NO: 402153 - RNA, 64 nt, Human; identical to SEQ ID NO: 162879

SEQ ID NO: 402154 - RNA, 64 nt, Human; identical to SEQ ID NO: 162880

SEQ ID NO: 402155 - RNA, 64 nt, Human; identical to SEQ ID NO: 162881

SEQ ID NO: 402156 - RNA, 64 nt, Human; identical to SEQ ID NO: 162882

SEQ ID NO: 402157 - RNA, 64 nt, Human; identical to SEQ ID NO: 162883

SEQ ID NO: 402158 - RNA, 64 nt, Human; identical to SEQ ID NO: 162884

SEQ ID NO: 402159 - RNA, 64 nt, Human; identical to SEQ ID NO: 162885

SEQ ID NO: 402160 - RNA, 64 nt, Human; identical to SEQ ID NO: 162886

SEQ ID NO: 402161 - RNA, 64 nt, Human; identical to SEQ ID NO: 162887

SEQ ID NO: 402162 - RNA, 64 nt, Human; identical to SEQ ID NO: 162888

SEQ ID NO: 402163 - RNA, 64 nt, Human; identical to SEQ ID NO: 162889

SEQ ID NO: 402164 - RNA, 64 nt, Human; identical to SEQ ID NO: 162890

SEQ ID NO: 402165 - RNA, 64 nt, Human; identical to SEQ ID NO: 162891

SEQ ID NO: 402166 - RNA, 64 nt, Human; identical to SEQ ID NO: 162892

SEQ ID NO: 402167 - RNA, 64 nt, Human; identical to SEQ ID NO: 162893

SEQ ID NO: 402168 - RNA, 64 nt, Human; identical to SEQ ID NO: 162894

SEQ ID NO: 402169 - RNA, 64 nt, Human; identical to SEQ ID NO: 162895

SEQ ID NO: 402170 - RNA, 64 nt, Human; identical to SEQ ID NO: 162896

SEQ ID NO: 402171 - RNA, 64 nt, Human; identical to SEQ ID NO: 162897

SEQ ID NO: 402172 - RNA, 64 nt, Human; identical to SEQ ID NO: 162898

SEQ ID NO: 402173 - RNA, 64 nt, Human; identical to SEQ ID NO: 162899

SEQ ID NO: 402174 - RNA, 64 nt, Human; identical to SEQ ID NO: 162900

SEQ ID NO: 402175 - RNA, 64 nt, Human; identical to SEQ ID NO: 162901

SEQ ID NO: 402176 - RNA, 64 nt, Human; identical to SEQ ID NO: 162902

SEQ ID NO: 402177 - RNA, 64 nt, Human; identical to SEQ ID NO: 162903

SEQ ID NO: 402178 - RNA, 64 nt, Human; identical to SEQ ID NO: 162904

SEQ ID NO: 402179 - RNA, 64 nt, Human; identical to SEQ ID NO: 162905

SEQ ID NO: 402180 - RNA, 64 nt, Human; identical to SEQ ID NO: 162906

SEQ ID NO: 402181 - RNA, 64 nt, Human; identical to SEQ ID NO: 162907

SEQ ID NO: 402182 - RNA, 64 nt, Human; identical to SEQ ID NO: 162908

SEQ ID NO: 402183 - RNA, 64 nt, Human; identical to SEQ ID NO: 162909

SEQ ID NO: 402184 - RNA, 64 nt, Human; identical to SEQ ID NO: 162910

SEQ ID NO: 402185 - RNA, 64 nt, Human; identical to SEQ ID NO: 162911

SEQ ID NO: 402186 - RNA, 64 nt, Human; identical to SEQ ID NO: 162912

SEQ ID NO: 402187 - RNA, 64 nt, Human; identical to SEQ ID NO: 162913

SEQ ID NO: 402188 - RNA, 64 nt, Human; identical to SEQ ID NO: 162914

SEQ ID NO: 402189 - RNA, 64 nt, Human; identical to SEQ ID NO: 162915

SEQ ID NO: 402190 - RNA, 64 nt, Human; identical to SEQ ID NO: 162916

SEQ ID NO: 402191 - RNA, 64 nt, Human; identical to SEQ ID NO: 162917

SEQ ID NO: 402192 - RNA, 64 nt, Human; identical to SEQ ID NO: 162918

SEQ ID NO: 402193 - RNA, 64 nt, Human; identical to SEQ ID NO: 162919

SEQ ID NO: 402194 - RNA, 64 nt, Human; identical to SEQ ID NO: 162920

SEQ ID NO: 402195 - RNA, 64 nt, Human; identical to SEQ ID NO: 162921

SEQ ID NO: 402196 - RNA, 64 nt, Human; identical to SEQ ID NO: 162922

SEQ ID NO: 402197 - RNA, 64 nt, Human; identical to SEQ ID NO: 162923

SEQ ID NO: 402198 - RNA, 64 nt, Human; identical to SEQ ID NO: 162924

SEQ ID NO: 402199 - RNA, 64 nt, Human; identical to SEQ ID NO: 162925

SEQ ID NO: 402200 - RNA, 64 nt, Human; identical to SEQ ID NO: 162926

SEQ ID NO: 402201 - RNA, 64 nt, Human; identical to SEQ ID NO: 162927

SEQ ID NO: 402202 - RNA, 64 nt, Human; identical to SEQ ID NO: 162928

SEQ ID NO: 402203 - RNA, 57 nt, Human; identical to SEQ ID NO: 162929

SEQ ID NO: 402204 - RNA, 64 nt, Human; identical to SEQ ID NO: 162930

SEQ ID NO: 402205 - RNA, 64 nt, Human; identical to SEQ ID NO: 162931

SEQ ID NO: 402206 - RNA, 64 nt, Human; identical to SEQ ID NO: 162932

SEQ ID NO: 402207 - RNA, 64 nt, Human; identical to SEQ ID NO: 162933

SEQ ID NO: 402208 - RNA, 64 nt, Human; identical to SEQ ID NO: 162934

SEQ ID NO: 402209 - RNA, 64 nt, Human; identical to SEQ ID NO: 162935

SEQ ID NO: 402210 - RNA, 64 nt, Human; identical to SEQ ID NO: 162936

SEQ ID NO: 402211 - RNA, 64 nt, Human; identical to SEQ ID NO: 162937

SEQ ID NO: 402212 - RNA, 64 nt, Human; identical to SEQ ID NO: 162938

SEQ ID NO: 402213 - RNA, 64 nt, Human; identical to SEQ ID NO: 162939

SEQ ID NO: 402214 - RNA, 64 nt, Human; identical to SEQ ID NO: 162940

SEQ ID NO: 402215 - RNA, 64 nt, Human; identical to SEQ ID NO: 162941

SEQ ID NO: 402216 - RNA, 64 nt, Human; identical to SEQ ID NO: 162942

SEQ ID NO: 402217 - RNA, 64 nt, Human; identical to SEQ ID NO: 162943

SEQ ID NO: 402218 - RNA, 64 nt, Human; identical to SEQ ID NO: 162944

SEQ ID NO: 402219 - RNA, 64 nt, Human; identical to SEQ ID NO: 162945

SEQ ID NO: 402220 - RNA, 64 nt, Human; identical to SEQ ID NO: 162946

SEQ ID NO: 402221 - RNA, 64 nt, Human; identical to SEQ ID NO: 162947

SEQ ID NO: 402222 - RNA, 64 nt, Human; identical to SEQ ID NO: 162948

SEQ ID NO: 402223 - RNA, 64 nt, Human; identical to SEQ ID NO: 162949

SEQ ID NO: 402224 - RNA, 64 nt, Human; identical to SEQ ID NO: 162950

SEQ ID NO: 402225 - RNA, 64 nt, Human; identical to SEQ ID NO: 162951

SEQ ID NO: 402226 - RNA, 64 nt, Human; identical to SEQ ID NO: 162952

SEQ ID NO: 402227 - RNA, 64 nt, Human; identical to SEQ ID NO: 162953

SEQ ID NO: 402228 - RNA, 64 nt, Human; identical to SEQ ID NO: 162954

SEQ ID NO: 402229 - RNA, 64 nt, Human; identical to SEQ ID NO: 162955

SEQ ID NO: 402230 - RNA, 64 nt, Human; identical to SEQ ID NO: 162956

SEQ ID NO: 402231 - RNA, 64 nt, Human; identical to SEQ ID NO: 162957

SEQ ID NO: 402232 - RNA, 64 nt, Human; identical to SEQ ID NO: 162958

SEQ ID NO: 402233 - RNA, 64 nt, Human; identical to SEQ ID NO: 162959

SEQ ID NO: 402234 - RNA, 64 nt, Human; identical to SEQ ID NO: 162960

SEQ ID NO: 402235 - RNA, 64 nt, Human; identical to SEQ ID NO: 162961

SEQ ID NO: 402236 - RNA, 64 nt, Human; identical to SEQ ID NO: 162962

SEQ ID NO: 402237 - RNA, 64 nt, Human; identical to SEQ ID NO: 162963

SEQ ID NO: 402238 - RNA, 64 nt, Human; identical to SEQ ID NO: 162964

SEQ ID NO: 402239 - RNA, 64 nt, Human; identical to SEQ ID NO: 162965

SEQ ID NO: 402240 - RNA, 64 nt, Human; identical to SEQ ID NO: 162966

SEQ ID NO: 402241 - RNA, 64 nt, Human; identical to SEQ ID NO: 162967

SEQ ID NO: 402242 - RNA, 64 nt, Human; identical to SEQ ID NO: 162968

SEQ ID NO: 402243 - RNA, 64 nt, Human; identical to SEQ ID NO: 162969

SEQ ID NO: 402244 - RNA, 64 nt, Human; identical to SEQ ID NO: 162970

SEQ ID NO: 402245 - RNA, 64 nt, Human; identical to SEQ ID NO: 162971

SEQ ID NO: 402246 - RNA, 64 nt, Human; identical to SEQ ID NO: 162972

SEQ ID NO: 402247 - RNA, 64 nt, Human; identical to SEQ ID NO: 162973

SEQ ID NO: 402248 - RNA, 64 nt, Human; identical to SEQ ID NO: 162974

SEQ ID NO: 402249 - RNA, 64 nt, Human; identical to SEQ ID NO: 162975

SEQ ID NO: 402250 - RNA, 64 nt, Human; identical to SEQ ID NO: 162976

SEQ ID NO: 402251 - RNA, 64 nt, Human; identical to SEQ ID NO: 162977

SEQ ID NO: 402252 - RNA, 64 nt, Human; identical to SEQ ID NO: 162978

SEQ ID NO: 402253 - RNA, 64 nt, Human; identical to SEQ ID NO: 162979

SEQ ID NO: 402254 - RNA, 64 nt, Human; identical to SEQ ID NO: 162980

SEQ ID NO: 402255 - RNA, 64 nt, Human; identical to SEQ ID NO: 162981

SEQ ID NO: 402256 - RNA, 64 nt, Human; identical to SEQ ID NO: 162982

SEQ ID NO: 402257 - RNA, 64 nt, Human; identical to SEQ ID NO: 162983

SEQ ID NO: 402258 - RNA, 64 nt, Human; identical to SEQ ID NO: 162984

SEQ ID NO: 402259 - RNA, 64 nt, Human; identical to SEQ ID NO: 162985

SEQ ID NO: 402260 - RNA, 64 nt, Human; identical to SEQ ID NO: 162986

SEQ ID NO: 402261 - RNA, 64 nt, Human; identical to SEQ ID NO: 162987

SEQ ID NO: 402262 - RNA, 64 nt, Human; identical to SEQ ID NO: 162988

SEQ ID NO: 402263 - RNA, 64 nt, Human; identical to SEQ ID NO: 162989

SEQ ID NO: 402264 - RNA, 64 nt, Human; identical to SEQ ID NO: 162990

SEQ ID NO: 402265 - RNA, 64 nt, Human; identical to SEQ ID NO: 162991

SEQ ID NO: 402266 - RNA, 64 nt, Human; identical to SEQ ID NO: 162992

SEQ ID NO: 402267 - RNA, 64 nt, Human; identical to SEQ ID NO: 162993

SEQ ID NO: 402268 - RNA, 64 nt, Human; identical to SEQ ID NO: 162994

SEQ ID NO: 402269 - RNA, 64 nt, Human; identical to SEQ ID NO: 162995

SEQ ID NO: 402270 - RNA, 64 nt, Human; identical to SEQ ID NO: 162996

SEQ ID NO: 402271 - RNA, 64 nt, Human; identical to SEQ ID NO: 162997

SEQ ID NO: 402272 - RNA, 64 nt, Human; identical to SEQ ID NO: 162998

SEQ ID NO: 402273 - RNA, 64 nt, Human; identical to SEQ ID NO: 162999

SEQ ID NO: 402274 - RNA, 64 nt, Human; identical to SEQ ID NO: 163000

SEQ ID NO: 402275 - RNA, 64 nt, Human; identical to SEQ ID NO: 163001

SEQ ID NO: 402276 - RNA, 64 nt, Human; identical to SEQ ID NO: 163002

SEQ ID NO: 402277 - RNA, 64 nt, Human; identical to SEQ ID NO: 163003

SEQ ID NO: 402278 - RNA, 64 nt, Human; identical to SEQ ID NO: 163004

SEQ ID NO: 402279 - RNA, 64 nt, Human; identical to SEQ ID NO: 163005

SEQ ID NO: 402280 - RNA, 64 nt, Human; identical to SEQ ID NO: 163006

SEQ ID NO: 402281 - RNA, 64 nt, Human; identical to SEQ ID NO: 163007

SEQ ID NO: 402282 - RNA, 64 nt, Human; identical to SEQ ID NO: 163008

SEQ ID NO: 402283 - RNA, 64 nt, Human; identical to SEQ ID NO: 163009

SEQ ID NO: 402284 - RNA, 64 nt, Human; identical to SEQ ID NO: 163010

SEQ ID NO: 402285 - RNA, 64 nt, Human; identical to SEQ ID NO: 163011

SEQ ID NO: 402286 - RNA, 64 nt, Human; identical to SEQ ID NO: 163012

SEQ ID NO: 402287 - RNA, 64 nt, Human; identical to SEQ ID NO: 163013

SEQ ID NO: 402288 - RNA, 64 nt, Human; identical to SEQ ID NO: 163014

SEQ ID NO: 402289 - RNA, 64 nt, Human; identical to SEQ ID NO: 163015

SEQ ID NO: 402290 - RNA, 64 nt, Human; identical to SEQ ID NO: 163016

SEQ ID NO: 402291 - RNA, 64 nt, Human; identical to SEQ ID NO: 163017

SEQ ID NO: 402292 - RNA, 64 nt, Human; identical to SEQ ID NO: 163018

SEQ ID NO: 402293 - RNA, 64 nt, Human; identical to SEQ ID NO: 163019

SEQ ID NO: 402294 - RNA, 64 nt, Human; identical to SEQ ID NO: 163020

SEQ ID NO: 402295 - RNA, 64 nt, Human; identical to SEQ ID NO: 163021

SEQ ID NO: 402296 - RNA, 64 nt, Human; identical to SEQ ID NO: 163022

SEQ ID NO: 402297 - RNA, 64 nt, Human; identical to SEQ ID NO: 163023

SEQ ID NO: 402298 - RNA, 64 nt, Human; identical to SEQ ID NO: 163024

SEQ ID NO: 402299 - RNA, 64 nt, Human; identical to SEQ ID NO: 163025

SEQ ID NO: 402300 - RNA, 64 nt, Human; identical to SEQ ID NO: 163026

SEQ ID NO: 402301 - RNA, 64 nt, Human; identical to SEQ ID NO: 163027

SEQ ID NO: 402302 - RNA, 64 nt, Human; identical to SEQ ID NO: 163028

SEQ ID NO: 402303 - RNA, 64 nt, Human; identical to SEQ ID NO: 163029

SEQ ID NO: 402304 - RNA, 64 nt, Human; identical to SEQ ID NO: 163030

SEQ ID NO: 402305 - RNA, 64 nt, Human; identical to SEQ ID NO: 163031

SEQ ID NO: 402306 - RNA, 64 nt, Human; identical to SEQ ID NO: 163032

SEQ ID NO: 402307 - RNA, 64 nt, Human; identical to SEQ ID NO: 163033

SEQ ID NO: 402308 - RNA, 64 nt, Human; identical to SEQ ID NO: 163034

SEQ ID NO: 402309 - RNA, 64 nt, Human; identical to SEQ ID NO: 163035

SEQ ID NO: 402310 - RNA, 64 nt, Human; identical to SEQ ID NO: 163036

SEQ ID NO: 402311 - RNA, 64 nt, Human; identical to SEQ ID NO: 163037

SEQ ID NO: 402312 - RNA, 64 nt, Human; identical to SEQ ID NO: 163038

SEQ ID NO: 402313 - RNA, 64 nt, Human; identical to SEQ ID NO: 163039

SEQ ID NO: 402314 - RNA, 64 nt, Human; identical to SEQ ID NO: 163040

SEQ ID NO: 402315 - RNA, 64 nt, Human; identical to SEQ ID NO: 163041

SEQ ID NO: 402316 - RNA, 64 nt, Human; identical to SEQ ID NO: 163042

SEQ ID NO: 402317 - RNA, 64 nt, Human; identical to SEQ ID NO: 163043

SEQ ID NO: 402318 - RNA, 64 nt, Human; identical to SEQ ID NO: 163044

SEQ ID NO: 402319 - RNA, 64 nt, Human; identical to SEQ ID NO: 163045

SEQ ID NO: 402320 - RNA, 64 nt, Human; identical to SEQ ID NO: 163046

SEQ ID NO: 402321 - RNA, 64 nt, Human; identical to SEQ ID NO: 163047

SEQ ID NO: 402322 - RNA, 64 nt, Human; identical to SEQ ID NO: 163048

SEQ ID NO: 402323 - RNA, 64 nt, Human; identical to SEQ ID NO: 163049

SEQ ID NO: 402324 - RNA, 64 nt, Human; identical to SEQ ID NO: 163050

SEQ ID NO: 402325 - RNA, 64 nt, Human; identical to SEQ ID NO: 163051

SEQ ID NO: 402326 - RNA, 64 nt, Human; identical to SEQ ID NO: 163052

SEQ ID NO: 402327 - RNA, 64 nt, Human; identical to SEQ ID NO: 163053

SEQ ID NO: 402328 - RNA, 64 nt, Human; identical to SEQ ID NO: 163054

SEQ ID NO: 402329 - RNA, 64 nt, Human; identical to SEQ ID NO: 163055

SEQ ID NO: 402330 - RNA, 64 nt, Human; identical to SEQ ID NO: 163056

SEQ ID NO: 402331 - RNA, 64 nt, Human; identical to SEQ ID NO: 163057

SEQ ID NO: 402332 - RNA, 64 nt, Human; identical to SEQ ID NO: 163058

SEQ ID NO: 402333 - RNA, 64 nt, Human; identical to SEQ ID NO: 163059

SEQ ID NO: 402334 - RNA, 64 nt, Human; identical to SEQ ID NO: 163060

SEQ ID NO: 402335 - RNA, 64 nt, Human; identical to SEQ ID NO: 163061

SEQ ID NO: 402336 - RNA, 64 nt, Human; identical to SEQ ID NO: 163062

SEQ ID NO: 402337 - RNA, 64 nt, Human; identical to SEQ ID NO: 163063

SEQ ID NO: 402338 - RNA, 64 nt, Human; identical to SEQ ID NO: 163064

SEQ ID NO: 402339 - RNA, 64 nt, Human; identical to SEQ ID NO: 163065

SEQ ID NO: 402340 - RNA, 64 nt, Human; identical to SEQ ID NO: 163066

SEQ ID NO: 402341 - RNA, 64 nt, Human; identical to SEQ ID NO: 163067

SEQ ID NO: 402342 - RNA, 60 nt, Human; identical to SEQ ID NO: 163068

SEQ ID NO: 402343 - RNA, 64 nt, Human; identical to SEQ ID NO: 163069

SEQ ID NO: 402344 - RNA, 64 nt, Human; identical to SEQ ID NO: 163070

SEQ ID NO: 402345 - RNA, 64 nt, Human; identical to SEQ ID NO: 163071

SEQ ID NO: 402346 - RNA, 64 nt, Human; identical to SEQ ID NO: 163072

SEQ ID NO: 402347 - RNA, 64 nt, Human; identical to SEQ ID NO: 163073

SEQ ID NO: 402348 - RNA, 64 nt, Human; identical to SEQ ID NO: 163074

SEQ ID NO: 402349 - RNA, 64 nt, Human; identical to SEQ ID NO: 163075

SEQ ID NO: 402350 - RNA, 64 nt, Human; identical to SEQ ID NO: 163076

SEQ ID NO: 402351 - RNA, 64 nt, Human; identical to SEQ ID NO: 163077

SEQ ID NO: 402352 - RNA, 64 nt, Human; identical to SEQ ID NO: 163078

SEQ ID NO: 402353 - RNA, 64 nt, Human; identical to SEQ ID NO: 163079

SEQ ID NO: 402354 - RNA, 64 nt, Human; identical to SEQ ID NO: 163080

SEQ ID NO: 402355 - RNA, 64 nt, Human; identical to SEQ ID NO: 163081

SEQ ID NO: 402356 - RNA, 64 nt, Human; identical to SEQ ID NO: 163082

SEQ ID NO: 402357 - RNA, 64 nt, Human; identical to SEQ ID NO: 163083

SEQ ID NO: 402358 - RNA, 64 nt, Human; identical to SEQ ID NO: 163084

SEQ ID NO: 402359 - RNA, 64 nt, Human; identical to SEQ ID NO: 163085

SEQ ID NO: 402360 - RNA, 64 nt, Human; identical to SEQ ID NO: 163086

SEQ ID NO: 402361 - RNA, 52 nt, Human; identical to SEQ ID NO: 163087

SEQ ID NO: 402362 - RNA, 64 nt, Human; identical to SEQ ID NO: 163088

SEQ ID NO: 402363 - RNA, 64 nt, Human; identical to SEQ ID NO: 163089

SEQ ID NO: 402364 - RNA, 64 nt, Human; identical to SEQ ID NO: 163090

SEQ ID NO: 402365 - RNA, 64 nt, Human; identical to SEQ ID NO: 163091

SEQ ID NO: 402366 - RNA, 64 nt, Human; identical to SEQ ID NO: 163092

SEQ ID NO: 402367 - RNA, 64 nt, Human; identical to SEQ ID NO: 163093

SEQ ID NO: 402368 - RNA, 64 nt, Human; identical to SEQ ID NO: 163094

SEQ ID NO: 402369 - RNA, 64 nt, Human; identical to SEQ ID NO: 163095

SEQ ID NO: 402370 - RNA, 64 nt, Human; identical to SEQ ID NO: 163096

SEQ ID NO: 402371 - RNA, 64 nt, Human; identical to SEQ ID NO: 163097

SEQ ID NO: 402372 - RNA, 64 nt, Human; identical to SEQ ID NO: 163098

SEQ ID NO: 402373 - RNA, 54 nt, Human; identical to SEQ ID NO: 163099

SEQ ID NO: 402374 - RNA, 64 nt, Human; identical to SEQ ID NO: 163100

SEQ ID NO: 402375 - RNA, 64 nt, Human; identical to SEQ ID NO: 163101

SEQ ID NO: 402376 - RNA, 64 nt, Human; identical to SEQ ID NO: 163102

SEQ ID NO: 402377 - RNA, 64 nt, Human; identical to SEQ ID NO: 163103

SEQ ID NO: 402378 - RNA, 64 nt, Human; identical to SEQ ID NO: 163104

SEQ ID NO: 402379 - RNA, 64 nt, Human; identical to SEQ ID NO: 163105

SEQ ID NO: 402380 - RNA, 64 nt, Human; identical to SEQ ID NO: 163106

SEQ ID NO: 402381 - RNA, 64 nt, Human; identical to SEQ ID NO: 163107

SEQ ID NO: 402382 - RNA, 64 nt, Human; identical to SEQ ID NO: 163108

SEQ ID NO: 402383 - RNA, 64 nt, Human; identical to SEQ ID NO: 163109

SEQ ID NO: 402384 - RNA, 64 nt, Human; identical to SEQ ID NO: 163110

SEQ ID NO: 402385 - RNA, 64 nt, Human; identical to SEQ ID NO: 163111

SEQ ID NO: 402386 - RNA, 64 nt, Human; identical to SEQ ID NO: 163112

SEQ ID NO: 402387 - RNA, 64 nt, Human; identical to SEQ ID NO: 163113

SEQ ID NO: 402388 - RNA, 64 nt, Human; identical to SEQ ID NO: 163114

SEQ ID NO: 402389 - RNA, 64 nt, Human; identical to SEQ ID NO: 163115

SEQ ID NO: 402390 - RNA, 64 nt, Human; identical to SEQ ID NO: 163116

SEQ ID NO: 402391 - RNA, 64 nt, Human; identical to SEQ ID NO: 163117

SEQ ID NO: 402392 - RNA, 64 nt, Human; identical to SEQ ID NO: 163118

SEQ ID NO: 402393 - RNA, 64 nt, Human; identical to SEQ ID NO: 163119

SEQ ID NO: 402394 - RNA, 64 nt, Human; identical to SEQ ID NO: 163120

SEQ ID NO: 402395 - RNA, 64 nt, Human; identical to SEQ ID NO: 163121

SEQ ID NO: 402396 - RNA, 64 nt, Human; identical to SEQ ID NO: 163122

SEQ ID NO: 402397 - RNA, 64 nt, Human; identical to SEQ ID NO: 163123

SEQ ID NO: 402398 - RNA, 61 nt, Human; identical to SEQ ID NO: 163124

SEQ ID NO: 402399 - RNA, 64 nt, Human; identical to SEQ ID NO: 163125

SEQ ID NO: 402400 - RNA, 64 nt, Human; identical to SEQ ID NO: 163126

SEQ ID NO: 402401 - RNA, 64 nt, Human; identical to SEQ ID NO: 163127

SEQ ID NO: 402402 - RNA, 64 nt, Human; identical to SEQ ID NO: 163128

SEQ ID NO: 402403 - RNA, 64 nt, Human; identical to SEQ ID NO: 163129

SEQ ID NO: 402404 - RNA, 64 nt, Human; identical to SEQ ID NO: 163130

SEQ ID NO: 402405 - RNA, 64 nt, Human; identical to SEQ ID NO: 163131

SEQ ID NO: 402406 - RNA, 64 nt, Human; identical to SEQ ID NO: 163132

SEQ ID NO: 402407 - RNA, 64 nt, Human; identical to SEQ ID NO: 163133

SEQ ID NO: 402408 - RNA, 64 nt, Human; identical to SEQ ID NO: 163134

SEQ ID NO: 402409 - RNA, 64 nt, Human; identical to SEQ ID NO: 163135

SEQ ID NO: 402410 - RNA, 64 nt, Human; identical to SEQ ID NO: 163136

SEQ ID NO: 402411 - RNA, 64 nt, Human; identical to SEQ ID NO: 163137

SEQ ID NO: 402412 - RNA, 64 nt, Human; identical to SEQ ID NO: 163138

SEQ ID NO: 402413 - RNA, 64 nt, Human; identical to SEQ ID NO: 163139

SEQ ID NO: 402414 - RNA, 64 nt, Human; identical to SEQ ID NO: 163140

SEQ ID NO: 402415 - RNA, 64 nt, Human; identical to SEQ ID NO: 163141

SEQ ID NO: 402416 - RNA, 64 nt, Human; identical to SEQ ID NO: 163142

SEQ ID NO: 402417 - RNA, 64 nt, Human; identical to SEQ ID NO: 163143

SEQ ID NO: 402418 - RNA, 64 nt, Human; identical to SEQ ID NO: 163144

SEQ ID NO: 402419 - RNA, 64 nt, Human; identical to SEQ ID NO: 163145

SEQ ID NO: 402420 - RNA, 64 nt, Human; identical to SEQ ID NO: 163146

SEQ ID NO: 402421 - RNA, 64 nt, Human; identical to SEQ ID NO: 163147

SEQ ID NO: 402422 - RNA, 64 nt, Human; identical to SEQ ID NO: 163148

SEQ ID NO: 402423 - RNA, 64 nt, Human; identical to SEQ ID NO: 163149

SEQ ID NO: 402424 - RNA, 64 nt, Human; identical to SEQ ID NO: 163150

SEQ ID NO: 402425 - RNA, 64 nt, Human; identical to SEQ ID NO: 163151

SEQ ID NO: 402426 - RNA, 64 nt, Human; identical to SEQ ID NO: 163152

SEQ ID NO: 402427 - RNA, 64 nt, Human; identical to SEQ ID NO: 163153

SEQ ID NO: 402428 - RNA, 64 nt, Human; identical to SEQ ID NO: 163154

SEQ ID NO: 402429 - RNA, 64 nt, Human; identical to SEQ ID NO: 163155

SEQ ID NO: 402430 - RNA, 64 nt, Human; identical to SEQ ID NO: 163156

SEQ ID NO: 402431 - RNA, 64 nt, Human; identical to SEQ ID NO: 163157

SEQ ID NO: 402432 - RNA, 64 nt, Human; identical to SEQ ID NO: 163158

SEQ ID NO: 402433 - RNA, 64 nt, Human; identical to SEQ ID NO: 163159

SEQ ID NO: 402434 - RNA, 64 nt, Human; identical to SEQ ID NO: 163160

SEQ ID NO: 402435 - RNA, 64 nt, Human; identical to SEQ ID NO: 163161

SEQ ID NO: 402436 - RNA, 64 nt, Human; identical to SEQ ID NO: 163162

SEQ ID NO: 402437 - RNA, 64 nt, Human; identical to SEQ ID NO: 163163

SEQ ID NO: 402438 - RNA, 64 nt, Human; identical to SEQ ID NO: 163164

SEQ ID NO: 402439 - RNA, 64 nt, Human; identical to SEQ ID NO: 163165

SEQ ID NO: 402440 - RNA, 64 nt, Human; identical to SEQ ID NO: 163166

SEQ ID NO: 402441 - RNA, 64 nt, Human; identical to SEQ ID NO: 163167

SEQ ID NO: 402442 - RNA, 64 nt, Human; identical to SEQ ID NO: 163168

SEQ ID NO: 402443 - RNA, 64 nt, Human; identical to SEQ ID NO: 163169

SEQ ID NO: 402444 - RNA, 64 nt, Human; identical to SEQ ID NO: 163170

SEQ ID NO: 402445 - RNA, 64 nt, Human; identical to SEQ ID NO: 163171

SEQ ID NO: 402446 - RNA, 64 nt, Human; identical to SEQ ID NO: 163172

SEQ ID NO: 402447 - RNA, 64 nt, Human; identical to SEQ ID NO: 163173

SEQ ID NO: 402448 - RNA, 64 nt, Human; identical to SEQ ID NO: 163174

SEQ ID NO: 402449 - RNA, 55 nt, Human; identical to SEQ ID NO: 163175

SEQ ID NO: 402450 - RNA, 64 nt, Human; identical to SEQ ID NO: 163176

SEQ ID NO: 402451 - RNA, 64 nt, Human; identical to SEQ ID NO: 163177

SEQ ID NO: 402452 - RNA, 64 nt, Human; identical to SEQ ID NO: 163178

SEQ ID NO: 402453 - RNA, 64 nt, Human; identical to SEQ ID NO: 163179

SEQ ID NO: 402454 - RNA, 64 nt, Human; identical to SEQ ID NO: 163180

SEQ ID NO: 402455 - RNA, 64 nt, Human; identical to SEQ ID NO: 163181

SEQ ID NO: 402456 - RNA, 64 nt, Human; identical to SEQ ID NO: 163182

SEQ ID NO: 402457 - RNA, 64 nt, Human; identical to SEQ ID NO: 163183

SEQ ID NO: 402458 - RNA, 64 nt, Human; identical to SEQ ID NO: 163184

SEQ ID NO: 402459 - RNA, 64 nt, Human; identical to SEQ ID NO: 163185

SEQ ID NO: 402460 - RNA, 64 nt, Human; identical to SEQ ID NO: 163186

SEQ ID NO: 402461 - RNA, 64 nt, Human; identical to SEQ ID NO: 163187

SEQ ID NO: 402462 - RNA, 64 nt, Human; identical to SEQ ID NO: 163188

SEQ ID NO: 402463 - RNA, 64 nt, Human; identical to SEQ ID NO: 163189

SEQ ID NO: 402464 - RNA, 64 nt, Human; identical to SEQ ID NO: 163190

SEQ ID NO: 402465 - RNA, 64 nt, Human; identical to SEQ ID NO: 163191

SEQ ID NO: 402466 - RNA, 64 nt, Human; identical to SEQ ID NO: 163192

SEQ ID NO: 402467 - RNA, 64 nt, Human; identical to SEQ ID NO: 163193

SEQ ID NO: 402468 - RNA, 64 nt, Human; identical to SEQ ID NO: 163194

SEQ ID NO: 402469 - RNA, 64 nt, Human; identical to SEQ ID NO: 163195

SEQ ID NO: 402470 - RNA, 64 nt, Human; identical to SEQ ID NO: 163196

SEQ ID NO: 402471 - RNA, 64 nt, Human; identical to SEQ ID NO: 163197

SEQ ID NO: 402472 - RNA, 64 nt, Human; identical to SEQ ID NO: 163198

SEQ ID NO: 402473 - RNA, 64 nt, Human; identical to SEQ ID NO: 163199

SEQ ID NO: 402474 - RNA, 64 nt, Human; identical to SEQ ID NO: 163200

SEQ ID NO: 402475 - RNA, 64 nt, Human; identical to SEQ ID NO: 163201

SEQ ID NO: 402476 - RNA, 64 nt, Human; identical to SEQ ID NO: 163202

SEQ ID NO: 402477 - RNA, 64 nt, Human; identical to SEQ ID NO: 163203

SEQ ID NO: 402478 - RNA, 64 nt, Human; identical to SEQ ID NO: 163204

SEQ ID NO: 402479 - RNA, 56 nt, Human; identical to SEQ ID NO: 163205

SEQ ID NO: 402480 - RNA, 64 nt, Human; identical to SEQ ID NO: 163206

SEQ ID NO: 402481 - RNA, 64 nt, Human; identical to SEQ ID NO: 163207

SEQ ID NO: 402482 - RNA, 64 nt, Human; identical to SEQ ID NO: 163208

SEQ ID NO: 402483 - RNA, 64 nt, Human; identical to SEQ ID NO: 163209

SEQ ID NO: 402484 - RNA, 64 nt, Human; identical to SEQ ID NO: 163210

SEQ ID NO: 402485 - RNA, 64 nt, Human; identical to SEQ ID NO: 163211

SEQ ID NO: 402486 - RNA, 64 nt, Human; identical to SEQ ID NO: 163212

SEQ ID NO: 402487 - RNA, 64 nt, Human; identical to SEQ ID NO: 163213

SEQ ID NO: 402488 - RNA, 64 nt, Human; identical to SEQ ID NO: 163214

SEQ ID NO: 402489 - RNA, 64 nt, Human; identical to SEQ ID NO: 163215

SEQ ID NO: 402490 - RNA, 64 nt, Human; identical to SEQ ID NO: 163216

SEQ ID NO: 402491 - RNA, 64 nt, Human; identical to SEQ ID NO: 163217

SEQ ID NO: 402492 - RNA, 64 nt, Human; identical to SEQ ID NO: 163218

SEQ ID NO: 402493 - RNA, 64 nt, Human; identical to SEQ ID NO: 163219

SEQ ID NO: 402494 - RNA, 64 nt, Human; identical to SEQ ID NO: 163220

SEQ ID NO: 402495 - RNA, 64 nt, Human; identical to SEQ ID NO: 163221

SEQ ID NO: 402496 - RNA, 64 nt, Human; identical to SEQ ID NO: 163222

SEQ ID NO: 402497 - RNA, 64 nt, Human; identical to SEQ ID NO: 163223

SEQ ID NO: 402498 - RNA, 64 nt, Human; identical to SEQ ID NO: 163224

SEQ ID NO: 402499 - RNA, 64 nt, Human; identical to SEQ ID NO: 163225

SEQ ID NO: 402500 - RNA, 64 nt, Human; identical to SEQ ID NO: 163226

SEQ ID NO: 402501 - RNA, 64 nt, Human; identical to SEQ ID NO: 163227

SEQ ID NO: 402502 - RNA, 64 nt, Human; identical to SEQ ID NO: 163228

SEQ ID NO: 402503 - RNA, 64 nt, Human; identical to SEQ ID NO: 163229

SEQ ID NO: 402504 - RNA, 64 nt, Human; identical to SEQ ID NO: 163230

SEQ ID NO: 402505 - RNA, 64 nt, Human; identical to SEQ ID NO: 163231

SEQ ID NO: 402506 - RNA, 64 nt, Human; identical to SEQ ID NO: 163232

SEQ ID NO: 402507 - RNA, 53 nt, Human; identical to SEQ ID NO: 163233

SEQ ID NO: 402508 - RNA, 64 nt, Human; identical to SEQ ID NO: 163234

SEQ ID NO: 402509 - RNA, 64 nt, Human; identical to SEQ ID NO: 163235

SEQ ID NO: 402510 - RNA, 64 nt, Human; identical to SEQ ID NO: 163236

SEQ ID NO: 402511 - RNA, 64 nt, Human; identical to SEQ ID NO: 163237

SEQ ID NO: 402512 - RNA, 64 nt, Human; identical to SEQ ID NO: 163238

SEQ ID NO: 402513 - RNA, 64 nt, Human; identical to SEQ ID NO: 163239

SEQ ID NO: 402514 - RNA, 64 nt, Human; identical to SEQ ID NO: 163240

SEQ ID NO: 402515 - RNA, 64 nt, Human; identical to SEQ ID NO: 163241

SEQ ID NO: 402516 - RNA, 64 nt, Human; identical to SEQ ID NO: 163242

SEQ ID NO: 402517 - RNA, 64 nt, Human; identical to SEQ ID NO: 163243

SEQ ID NO: 402518 - RNA, 64 nt, Human; identical to SEQ ID NO: 163244

SEQ ID NO: 402519 - RNA, 64 nt, Human; identical to SEQ ID NO: 163245

SEQ ID NO: 402520 - RNA, 64 nt, Human; identical to SEQ ID NO: 163246

SEQ ID NO: 402521 - RNA, 64 nt, Human; identical to SEQ ID NO: 163247

SEQ ID NO: 402522 - RNA, 64 nt, Human; identical to SEQ ID NO: 163248

SEQ ID NO: 402523 - RNA, 64 nt, Human; identical to SEQ ID NO: 163249

SEQ ID NO: 402524 - RNA, 64 nt, Human; identical to SEQ ID NO: 163250

SEQ ID NO: 402525 - RNA, 64 nt, Human; identical to SEQ ID NO: 163251

SEQ ID NO: 402526 - RNA, 64 nt, Human; identical to SEQ ID NO: 163252

SEQ ID NO: 402527 - RNA, 64 nt, Human; identical to SEQ ID NO: 163253

SEQ ID NO: 402528 - RNA, 64 nt, Human; identical to SEQ ID NO: 163254

SEQ ID NO: 402529 - RNA, 64 nt, Human; identical to SEQ ID NO: 163255

SEQ ID NO: 402530 - RNA, 64 nt, Human; identical to SEQ ID NO: 163256

SEQ ID NO: 402531 - RNA, 64 nt, Human; identical to SEQ ID NO: 163257

SEQ ID NO: 402532 - RNA, 64 nt, Human; identical to SEQ ID NO: 163258

SEQ ID NO: 402533 - RNA, 64 nt, Human; identical to SEQ ID NO: 163259

SEQ ID NO: 402534 - RNA, 64 nt, Human; identical to SEQ ID NO: 163260

SEQ ID NO: 402535 - RNA, 64 nt, Human; identical to SEQ ID NO: 163261

SEQ ID NO: 402536 - RNA, 64 nt, Human; identical to SEQ ID NO: 163262

SEQ ID NO: 402537 - RNA, 64 nt, Human; identical to SEQ ID NO: 163263

SEQ ID NO: 402538 - RNA, 64 nt, Human; identical to SEQ ID NO: 163264

SEQ ID NO: 402539 - RNA, 64 nt, Human; identical to SEQ ID NO: 163265

SEQ ID NO: 402540 - RNA, 64 nt, Human; identical to SEQ ID NO: 163266

SEQ ID NO: 402541 - RNA, 64 nt, Human; identical to SEQ ID NO: 163267

SEQ ID NO: 402542 - RNA, 64 nt, Human; identical to SEQ ID NO: 163268

SEQ ID NO: 402543 - RNA, 64 nt, Human; identical to SEQ ID NO: 163269

SEQ ID NO: 402544 - RNA, 64 nt, Human; identical to SEQ ID NO: 163270

SEQ ID NO: 402545 - RNA, 64 nt, Human; identical to SEQ ID NO: 163271

SEQ ID NO: 402546 - RNA, 64 nt, Human; identical to SEQ ID NO: 163272

SEQ ID NO: 402547 - RNA, 64 nt, Human; identical to SEQ ID NO: 163273

SEQ ID NO: 402548 - RNA, 64 nt, Human; identical to SEQ ID NO: 163274

SEQ ID NO: 402549 - RNA, 64 nt, Human; identical to SEQ ID NO: 163275

SEQ ID NO: 402550 - RNA, 64 nt, Human; identical to SEQ ID NO: 163276

SEQ ID NO: 402551 - RNA, 64 nt, Human; identical to SEQ ID NO: 163277

SEQ ID NO: 402552 - RNA, 64 nt, Human; identical to SEQ ID NO: 163278

SEQ ID NO: 402553 - RNA, 64 nt, Human; identical to SEQ ID NO: 163279

SEQ ID NO: 402554 - RNA, 64 nt, Human; identical to SEQ ID NO: 163280

SEQ ID NO: 402555 - RNA, 64 nt, Human; identical to SEQ ID NO: 163281

SEQ ID NO: 402556 - RNA, 64 nt, Human; identical to SEQ ID NO: 163282

SEQ ID NO: 402557 - RNA, 64 nt, Human; identical to SEQ ID NO: 163283

SEQ ID NO: 402558 - RNA, 56 nt, Human; identical to SEQ ID NO: 163284

SEQ ID NO: 402559 - RNA, 64 nt, Human; identical to SEQ ID NO: 163285

SEQ ID NO: 402560 - RNA, 64 nt, Human; identical to SEQ ID NO: 163286

SEQ ID NO: 402561 - RNA, 56 nt, Human; identical to SEQ ID NO: 163284

SEQ ID NO: 402562 - RNA, 64 nt, Human; identical to SEQ ID NO: 163288

SEQ ID NO: 402563 - RNA, 64 nt, Human; identical to SEQ ID NO: 163289

SEQ ID NO: 402564 - RNA, 64 nt, Human; identical to SEQ ID NO: 163290

SEQ ID NO: 402565 - RNA, 64 nt, Human; identical to SEQ ID NO: 163291

SEQ ID NO: 402566 - RNA, 64 nt, Human; identical to SEQ ID NO: 163292

SEQ ID NO: 402567 - RNA, 64 nt, Human; identical to SEQ ID NO: 163293

SEQ ID NO: 402568 - RNA, 64 nt, Human; identical to SEQ ID NO: 163294

SEQ ID NO: 402569 - RNA, 64 nt, Human; identical to SEQ ID NO: 163295

SEQ ID NO: 402570 - RNA, 64 nt, Human; identical to SEQ ID NO: 163296

SEQ ID NO: 402571 - RNA, 64 nt, Human; identical to SEQ ID NO: 163297

SEQ ID NO: 402572 - RNA, 53 nt, Human; identical to SEQ ID NO: 163298

SEQ ID NO: 402573 - RNA, 64 nt, Human; identical to SEQ ID NO: 163299

SEQ ID NO: 402574 - RNA, 64 nt, Human; identical to SEQ ID NO: 163300

SEQ ID NO: 402575 - RNA, 64 nt, Human; identical to SEQ ID NO: 163301

SEQ ID NO: 402576 - RNA, 64 nt, Human; identical to SEQ ID NO: 163302

SEQ ID NO: 402577 - RNA, 64 nt, Human; identical to SEQ ID NO: 163303

SEQ ID NO: 402578 - RNA, 64 nt, Human; identical to SEQ ID NO: 163304

SEQ ID NO: 402579 - RNA, 64 nt, Human; identical to SEQ ID NO: 163305

SEQ ID NO: 402580 - RNA, 64 nt, Human; identical to SEQ ID NO: 163306

SEQ ID NO: 402581 - RNA, 64 nt, Human; identical to SEQ ID NO: 163307

SEQ ID NO: 402582 - RNA, 64 nt, Human; identical to SEQ ID NO: 163308

SEQ ID NO: 402583 - RNA, 64 nt, Human; identical to SEQ ID NO: 163309

SEQ ID NO: 402584 - RNA, 64 nt, Human; identical to SEQ ID NO: 163310

SEQ ID NO: 402585 - RNA, 64 nt, Human; identical to SEQ ID NO: 163311

SEQ ID NO: 402586 - RNA, 64 nt, Human; identical to SEQ ID NO: 163312

SEQ ID NO: 402587 - RNA, 64 nt, Human; identical to SEQ ID NO: 163313

SEQ ID NO: 402588 - RNA, 64 nt, Human; identical to SEQ ID NO: 163314

SEQ ID NO: 402589 - RNA, 64 nt, Human; identical to SEQ ID NO: 163315

SEQ ID NO: 402590 - RNA, 64 nt, Human; identical to SEQ ID NO: 163316

SEQ ID NO: 402591 - RNA, 64 nt, Human; identical to SEQ ID NO: 163317

SEQ ID NO: 402592 - RNA, 56 nt, Human; identical to SEQ ID NO: 163318

SEQ ID NO: 402593 - RNA, 64 nt, Human; identical to SEQ ID NO: 163319

SEQ ID NO: 402594 - RNA, 64 nt, Human; identical to SEQ ID NO: 163320

SEQ ID NO: 402595 - RNA, 64 nt, Human; identical to SEQ ID NO: 163321

SEQ ID NO: 402596 - RNA, 64 nt, Human; identical to SEQ ID NO: 163322

SEQ ID NO: 402597 - RNA, 64 nt, Human; identical to SEQ ID NO: 163323

SEQ ID NO: 402598 - RNA, 64 nt, Human; identical to SEQ ID NO: 163324

SEQ ID NO: 402599 - RNA, 64 nt, Human; identical to SEQ ID NO: 163325

SEQ ID NO: 402600 - RNA, 64 nt, Human; identical to SEQ ID NO: 163326

SEQ ID NO: 402601 - RNA, 64 nt, Human; identical to SEQ ID NO: 163327

SEQ ID NO: 402602 - RNA, 64 nt, Human; identical to SEQ ID NO: 163328

SEQ ID NO: 402603 - RNA, 64 nt, Human; identical to SEQ ID NO: 163329

SEQ ID NO: 402604 - RNA, 64 nt, Human; identical to SEQ ID NO: 163330

SEQ ID NO: 402605 - RNA, 64 nt, Human; identical to SEQ ID NO: 163331

SEQ ID NO: 402606 - RNA, 64 nt, Human; identical to SEQ ID NO: 163332

SEQ ID NO: 402607 - RNA, 64 nt, Human; identical to SEQ ID NO: 163333

SEQ ID NO: 402608 - RNA, 64 nt, Human; identical to SEQ ID NO: 163334

SEQ ID NO: 402609 - RNA, 64 nt, Human; identical to SEQ ID NO: 163335

SEQ ID NO: 402610 - RNA, 64 nt, Human; identical to SEQ ID NO: 163336

SEQ ID NO: 402611 - RNA, 64 nt, Human; identical to SEQ ID NO: 163337

SEQ ID NO: 402612 - RNA, 64 nt, Human; identical to SEQ ID NO: 163338

SEQ ID NO: 402613 - RNA, 64 nt, Human; identical to SEQ ID NO: 163339

SEQ ID NO: 402614 - RNA, 64 nt, Human; identical to SEQ ID NO: 163340

SEQ ID NO: 402615 - RNA, 64 nt, Human; identical to SEQ ID NO: 163341

SEQ ID NO: 402616 - RNA, 64 nt, Human; identical to SEQ ID NO: 163342

SEQ ID NO: 402617 - RNA, 64 nt, Human; identical to SEQ ID NO: 163343

SEQ ID NO: 402618 - RNA, 64 nt, Human; identical to SEQ ID NO: 163344

SEQ ID NO: 402619 - RNA, 64 nt, Human; identical to SEQ ID NO: 163345

SEQ ID NO: 402620 - RNA, 64 nt, Human; identical to SEQ ID NO: 163346

SEQ ID NO: 402621 - RNA, 64 nt, Human; identical to SEQ ID NO: 163347

SEQ ID NO: 402622 - RNA, 64 nt, Human; identical to SEQ ID NO: 163348

SEQ ID NO: 402623 - RNA, 64 nt, Human; identical to SEQ ID NO: 163349

SEQ ID NO: 402624 - RNA, 64 nt, Human; identical to SEQ ID NO: 163350

SEQ ID NO: 402625 - RNA, 64 nt, Human; identical to SEQ ID NO: 163351

SEQ ID NO: 402626 - RNA, 64 nt, Human; identical to SEQ ID NO: 163352

SEQ ID NO: 402627 - RNA, 64 nt, Human; identical to SEQ ID NO: 163353

SEQ ID NO: 402628 - RNA, 64 nt, Human; identical to SEQ ID NO: 163354

SEQ ID NO: 402629 - RNA, 64 nt, Human; identical to SEQ ID NO: 163355

SEQ ID NO: 402630 - RNA, 64 nt, Human; identical to SEQ ID NO: 163356

SEQ ID NO: 402631 - RNA, 64 nt, Human; identical to SEQ ID NO: 163357

SEQ ID NO: 402632 - RNA, 64 nt, Human; identical to SEQ ID NO: 163358

SEQ ID NO: 402633 - RNA, 64 nt, Human; identical to SEQ ID NO: 163359

SEQ ID NO: 402634 - RNA, 64 nt, Human; identical to SEQ ID NO: 163360

SEQ ID NO: 402635 - RNA, 64 nt, Human; identical to SEQ ID NO: 163361

SEQ ID NO: 402636 - RNA, 64 nt, Human; identical to SEQ ID NO: 163362

SEQ ID NO: 402637 - RNA, 64 nt, Human; identical to SEQ ID NO: 163363

SEQ ID NO: 402638 - RNA, 64 nt, Human; identical to SEQ ID NO: 163364

SEQ ID NO: 402639 - RNA, 64 nt, Human; identical to SEQ ID NO: 163365

SEQ ID NO: 402640 - RNA, 64 nt, Human; identical to SEQ ID NO: 163366

SEQ ID NO: 402641 - RNA, 64 nt, Human; identical to SEQ ID NO: 163367

SEQ ID NO: 402642 - RNA, 64 nt, Human; identical to SEQ ID NO: 163368

SEQ ID NO: 402643 - RNA, 64 nt, Human; identical to SEQ ID NO: 163369

SEQ ID NO: 402644 - RNA, 64 nt, Human; identical to SEQ ID NO: 163370

SEQ ID NO: 402645 - RNA, 64 nt, Human; identical to SEQ ID NO: 163371

SEQ ID NO: 402646 - RNA, 64 nt, Human; identical to SEQ ID NO: 163372

SEQ ID NO: 402647 - RNA, 64 nt, Human; identical to SEQ ID NO: 163373

SEQ ID NO: 402648 - RNA, 64 nt, Human; identical to SEQ ID NO: 163374

SEQ ID NO: 402649 - RNA, 64 nt, Human; identical to SEQ ID NO: 163375

SEQ ID NO: 402650 - RNA, 64 nt, Human; identical to SEQ ID NO: 163376

SEQ ID NO: 402651 - RNA, 64 nt, Human; identical to SEQ ID NO: 163377

SEQ ID NO: 402652 - RNA, 64 nt, Human; identical to SEQ ID NO: 163378

SEQ ID NO: 402653 - RNA, 57 nt, Human; identical to SEQ ID NO: 163379

SEQ ID NO: 402654 - RNA, 64 nt, Human; identical to SEQ ID NO: 163380

SEQ ID NO: 402655 - RNA, 64 nt, Human; identical to SEQ ID NO: 163381

SEQ ID NO: 402656 - RNA, 64 nt, Human; identical to SEQ ID NO: 163382

SEQ ID NO: 402657 - RNA, 64 nt, Human; identical to SEQ ID NO: 163383

SEQ ID NO: 402658 - RNA, 64 nt, Human; identical to SEQ ID NO: 163384

SEQ ID NO: 402659 - RNA, 64 nt, Human; identical to SEQ ID NO: 163385

SEQ ID NO: 402660 - RNA, 64 nt, Human; identical to SEQ ID NO: 163386

SEQ ID NO: 402661 - RNA, 64 nt, Human; identical to SEQ ID NO: 163387

SEQ ID NO: 402662 - RNA, 64 nt, Human; identical to SEQ ID NO: 163388

SEQ ID NO: 402663 - RNA, 64 nt, Human; identical to SEQ ID NO: 163389

SEQ ID NO: 402664 - RNA, 64 nt, Human; identical to SEQ ID NO: 163390

SEQ ID NO: 402665 - RNA, 64 nt, Human; identical to SEQ ID NO: 163391

SEQ ID NO: 402666 - RNA, 64 nt, Human; identical to SEQ ID NO: 163392

SEQ ID NO: 402667 - RNA, 64 nt, Human; identical to SEQ ID NO: 163393

SEQ ID NO: 402668 - RNA, 64 nt, Human; identical to SEQ ID NO: 163394

SEQ ID NO: 402669 - RNA, 64 nt, Human; identical to SEQ ID NO: 163395

SEQ ID NO: 402670 - RNA, 64 nt, Human; identical to SEQ ID NO: 163396

SEQ ID NO: 402671 - RNA, 64 nt, Human; identical to SEQ ID NO: 163397

SEQ ID NO: 402672 - RNA, 64 nt, Human; identical to SEQ ID NO: 163398

SEQ ID NO: 402673 - RNA, 64 nt, Human; identical to SEQ ID NO: 163399

SEQ ID NO: 402674 - RNA, 64 nt, Human; identical to SEQ ID NO: 163400

SEQ ID NO: 402675 - RNA, 64 nt, Human; identical to SEQ ID NO: 163401

SEQ ID NO: 402676 - RNA, 64 nt, Human; identical to SEQ ID NO: 163402

SEQ ID NO: 402677 - RNA, 64 nt, Human; identical to SEQ ID NO: 163403

SEQ ID NO: 402678 - RNA, 64 nt, Human; identical to SEQ ID NO: 163404

SEQ ID NO: 402679 - RNA, 64 nt, Human; identical to SEQ ID NO: 163405

SEQ ID NO: 402680 - RNA, 64 nt, Human; identical to SEQ ID NO: 163406

SEQ ID NO: 402681 - RNA, 64 nt, Human; identical to SEQ ID NO: 163388

SEQ ID NO: 402682 - RNA, 64 nt, Human; identical to SEQ ID NO: 163408

SEQ ID NO: 402683 - RNA, 64 nt, Human; identical to SEQ ID NO: 163409

SEQ ID NO: 402684 - RNA, 64 nt, Human; identical to SEQ ID NO: 163410

SEQ ID NO: 402685 - RNA, 64 nt, Human; identical to SEQ ID NO: 163411

SEQ ID NO: 402686 - RNA, 64 nt, Human; identical to SEQ ID NO: 163412

SEQ ID NO: 402687 - RNA, 64 nt, Human; identical to SEQ ID NO: 163413

SEQ ID NO: 402688 - RNA, 56 nt, Human; identical to SEQ ID NO: 163414

SEQ ID NO: 402689 - RNA, 64 nt, Human; identical to SEQ ID NO: 163415

SEQ ID NO: 402690 - RNA, 64 nt, Human; identical to SEQ ID NO: 163416

SEQ ID NO: 402691 - RNA, 64 nt, Human; identical to SEQ ID NO: 163417

SEQ ID NO: 402692 - RNA, 64 nt, Human; identical to SEQ ID NO: 163418

SEQ ID NO: 402693 - RNA, 64 nt, Human; identical to SEQ ID NO: 163419

SEQ ID NO: 402694 - RNA, 64 nt, Human; identical to SEQ ID NO: 163420

SEQ ID NO: 402695 - RNA, 64 nt, Human; identical to SEQ ID NO: 163421

SEQ ID NO: 402696 - RNA, 64 nt, Human; identical to SEQ ID NO: 163422

SEQ ID NO: 402697 - RNA, 64 nt, Human; identical to SEQ ID NO: 163423

SEQ ID NO: 402698 - RNA, 64 nt, Human; identical to SEQ ID NO: 163424

SEQ ID NO: 402699 - RNA, 64 nt, Human; identical to SEQ ID NO: 163425

SEQ ID NO: 402700 - RNA, 64 nt, Human; identical to SEQ ID NO: 163426

SEQ ID NO: 402701 - RNA, 64 nt, Human; identical to SEQ ID NO: 163427

SEQ ID NO: 402702 - RNA, 64 nt, Human; identical to SEQ ID NO: 163428

SEQ ID NO: 402703 - RNA, 64 nt, Human; identical to SEQ ID NO: 163429

SEQ ID NO: 402704 - RNA, 64 nt, Human; identical to SEQ ID NO: 163430

SEQ ID NO: 402705 - RNA, 64 nt, Human; identical to SEQ ID NO: 163431

SEQ ID NO: 402706 - RNA, 64 nt, Human; identical to SEQ ID NO: 163432

SEQ ID NO: 402707 - RNA, 64 nt, Human; identical to SEQ ID NO: 163433

SEQ ID NO: 402708 - RNA, 64 nt, Human; identical to SEQ ID NO: 163434

SEQ ID NO: 402709 - RNA, 64 nt, Human; identical to SEQ ID NO: 163435

SEQ ID NO: 402710 - RNA, 64 nt, Human; identical to SEQ ID NO: 163436

SEQ ID NO: 402711 - RNA, 64 nt, Human; identical to SEQ ID NO: 163437

SEQ ID NO: 402712 - RNA, 64 nt, Human; identical to SEQ ID NO: 163438

SEQ ID NO: 402713 - RNA, 64 nt, Human; identical to SEQ ID NO: 163439

SEQ ID NO: 402714 - RNA, 64 nt, Human; identical to SEQ ID NO: 163440

SEQ ID NO: 402715 - RNA, 64 nt, Human; identical to SEQ ID NO: 163441

SEQ ID NO: 402716 - RNA, 64 nt, Human; identical to SEQ ID NO: 163442

SEQ ID NO: 402717 - RNA, 64 nt, Human; identical to SEQ ID NO: 163443

SEQ ID NO: 402718 - RNA, 64 nt, Human; identical to SEQ ID NO: 163444

SEQ ID NO: 402719 - RNA, 64 nt, Human
ugucugccugagcaacucuauuucaggugccccacaccggcaaguaccagccagcaacaccaac

SEQ ID NO: 402720 - RNA, 64 nt, Human
acagaaauggguacagcucaucaaaaaugugcagcaccggcagagggaagauacggggcaaaug

SEQ ID NO: 402721 - RNA, 64 nt, Human
uccugccucucccgugagucuccagccugcccagcaccggcagcuguggagcacguggaugcug

SEQ ID NO: 402722 - RNA, 64 nt, Human
cugcgcucuagccccgcgcgccguggcaccccaacaccggcagggaaccuacccucggcucccg

SEQ ID NO: 402723 - RNA, 64 nt, Human
cuccugggcuuagcugugggaagccaaguacccucaccggcaugggacaugaggggcagcuaga

SEQ ID NO: 402724 - RNA, 64 nt, Human
ugccuggcgccccugccccccgccccucuccaaacaccggcagaaaacggagagugcuugggug

SEQ ID NO: 402725 - RNA, 64 nt, Human
cgcagcgguggcucgcaccugugggaccucagggcaccggcaccgggcgccucucgccgcucga

SEQ ID NO: 402726 - RNA, 64 nt, Human
aagcugggccugccaaagccugggcccacagcugcaccggcagcccaaggggaaggaccgguug

SEQ ID NO: 402727 - RNA, 64 nt, Human
ccuuacccagggcugcacagccaggugugagggucaccggcaggugggcugguggcugcagccu

SEQ ID NO: 402728 - RNA, 64 nt, Human
aguuauuacgcuacaugacaacguuucgacauuucaccggcaacaccaagaggguuuuuagugg

SEQ ID NO: 402729 - RNA, 64 nt, Human
uuuugaguuuauaugcaaugccuucauuagguaccaccggcacuuacaaaaugugcggacugaa

SEQ ID NO: 402730 - RNA, 64 nt, Human
cucaggcugucaccgugccuacuguggagauggucaccggcaugaggguguggaggacugugac

SEQ ID NO: 402731 - RNA, 64 nt, Human
aggaggaccccaggggagaggagagcugugagagcaccggcacccccagaagacucugcuucuu

SEQ ID NO: 402732 - RNA, 64 nt, Human
ugagccugugcugagccccaguggguugcaccuccaccggcagucagcgagcuggggcugcacu

SEQ ID NO: 402733 - RNA, 64 nt, Human
ggagaaggugaugguaauuucauuagucccaaaacaccggcauaagaaauuugacauuucacag

SEQ ID NO: 402734 - RNA, 64 nt, Human
cccaccccucugcagacugccccgcggccucggccaccggcaggggaaccgagaccagcacccc

SEQ ID NO: 402735 - RNA, 64 nt, Human
uacuaaacagcuuccuucagaucuggaagccaaacaccggcauuuuauguacuuuguccuucag

SEQ ID NO: 402736 - RNA, 64 nt, Human
uugccugggaagcccaggaauuccaccugguccacaccggcagaaguuacaguagacugugagg

SEQ ID NO: 402737 - RNA, 64 nt, Human
auuaugcuuuugcacacacacaccuguacacacacaccggcauguuuauacacagggaguguau

SEQ ID NO: 402738 - RNA, 64 nt, Human
aacauucaagaguaugcccacccagccccaaagccaccggcaugugaagcugccggaaagugga

SEQ ID NO: 402739 - RNA, 64 nt, Human
acagccugccucugcccagcuccccauucacacacaccggcacuuucauacccugaccucugac

SEQ ID NO: 402740 - RNA, 64 nt, Human
aaggacaugucaaucuuggucauccaugacaccacaccggcaucagaggaccccagaaaacuac

SEQ ID NO: 402741 - RNA, 64 nt, Human
cgcgcccagugacugcaccccggcccucaucacccaccggcacugaucggggcaccgccuggcc

SEQ ID NO: 402742 - RNA, 64 nt, Human
cagcuccuaaaacaccuggacauuccccauccugcaccggcacuguguuuguucagagaaaacg

SEQ ID NO: 402743 - RNA, 64 nt, Human
ccaucuacacagcacccaaggggagggcugggggcaccggcacgggggcagcgugcagcccugc

SEQ ID NO: 402744 - RNA, 64 nt, Human
ugggugcccaucgccgggaguaugguucagcugccaccggcacuguccauuugccugucuguca

SEQ ID NO: 402745 - RNA, 64 nt, Human
gugagugggggcgugcuugggaggcgcaggauggcaccggcacaucuaacaucuacacuucucu

SEQ ID NO: 402746 - RNA, 64 nt, Human
gcagggacagggguucugcuccuucucacuucaccaccggcacacagcuugccccugucuuugc

SEQ ID NO: 402747 - RNA, 64 nt, Human
aucccccguggcaucacagcuaaguagcuguggccaccggcaguuucacagcauccugaaagcu

SEQ ID NO: 402748 - RNA, 64 nt, Human
ccucccccuccuccaugcugucccugugggcucacaccggcacugugcacucuacucugcgacg

SEQ ID NO: 402749 - RNA, 64 nt, Human
cugggucuguggcauuuuccaagggcccacguagcaccggcaaccgccaaguggcccaggcucu

SEQ ID NO: 402750 - RNA, 53 nt, Human
cauugcuacaagaaaaauaaggacaccggcagcccuuaguuucacuguuugcc

SEQ ID NO: 402751 - RNA, 64 nt, Human
aggaaagaggaggagggugcagccaaacuuaaggcaccggcaaguguugucagcacuggaggag

SEQ ID NO: 402752 - RNA, 64 nt, Human
aucacuuauuggcaguaaagacucaguauaaaagcaccggcaucccuacuugggugauggggau

SEQ ID NO: 402753 - RNA, 64 nt, Human
ccuagauggugcaaagcuggggccagccugucuucaccggcacccucaccugugacaccaagac

SEQ ID NO: 402754 - RNA, 64 nt, Human
guccugagggcugcaucucuguuguaggcccagccaccggcacaaagcuggauucaugcucccu

SEQ ID NO: 402755 - RNA, 64 nt, Human
cguggggcggccgagaccugcacggcccagcgggcaccggcacugcggggucuucguucucaga

SEQ ID NO: 402756 - RNA, 64 nt, Human
uucaggaagaaagagcucauucugucucacaagccaccggcauccuguaucagcuuccagccuc

SEQ ID NO: 402757 - RNA, 64 nt, Human
ugcggggcuucuggguggcuccugccacugaccucaccggcaugcuggccuguggcaggccuag

SEQ ID NO: 402758 - RNA, 64 nt, Human
uguucccgcuggaggguuggugcuguggagccuacaccggcagggacagccuggggcugacagg

SEQ ID NO: 402759 - RNA, 64 nt, Human
gcacugucauucuuggugccaucuuccccugccgcaccggcagucucagcccagcccccaccuu

SEQ ID NO: 402760 - RNA, 64 nt, Human
gaucccggccuuucccugugacuuacgugucugucaccggcaggcagcccuacaaauccuggug

SEQ ID NO: 402761 - RNA, 64 nt, Human
cagcauccugccgccuccucucugccugcccacucaccggcaagguugucccucugcccagggc

SEQ ID NO: 402762 - RNA, 64 nt, Human
gccggcgccccguccccuucugcaugucugaggccaccggcaaccgccgccccacuccagauuu

SEQ ID NO: 402763 - RNA, 64 nt, Human
ggugccccauuccaucggcacuaacgccccgcuccaccggcaccagugccucgcuccauuggca

SEQ ID NO: 402764 - RNA, 64 nt, Human
cagccccucucugguuccagaagauuacccuucgcaccggcacaggagagaucuuaaauggucu

SEQ ID NO: 402765 - RNA, 64 nt, Human
gccaucaugugacgccugcgcgccccucgggcugcaccggcacuggccgagcggagggcggggc

SEQ ID NO: 402766 - RNA, 64 nt, Human
ucuuugugaggccaggccuucugacugucagcaccaccggcacagggcagagaugcggguggcc

SEQ ID NO: 402767 - RNA, 64 nt, Human
gagggcaucgucauugcccugagcguggacacgccaccggcagccguaagggaaaagggugucc

SEQ ID NO: 402768 - RNA, 64 nt, Human
guccuuuuucuuccucaaauucagacccuccuuccaccggcaccccccuacuccacccucagcu

SEQ ID NO: 402769 - RNA, 64 nt, Human
acucagcccugagcagggaacagggcccagcuuccaccggcagggaguugugagcgccuuccca

SEQ ID NO: 402770 - RNA, 64 nt, Human
gaggggagcagcccaaggcaccuguccucugacccaccggcagcgagugcgcaggugugagugu

SEQ ID NO: 402771 - RNA, 64 nt, Human
cgcccgagccccugcccacgcccuuggagccuuccaccggcacucaugacggccugccugcaaa

SEQ ID NO: 402772 - RNA, 64 nt, Human
ccacacgugggugcugaacucggggcgccgugcccaccggcaugguccucccgagcuccgacag

SEQ ID NO: 402773 - RNA, 64 nt, Human
gcgaaaagaaaaccuuggguggcagugauuugaacaccggcagugcuggggcaggacccgagcc

SEQ ID NO: 402774 - RNA, 64 nt, Human
guccgucuauccacccgcccacccgcccccaccccaccggcagcguccaggugcggggccggga

SEQ ID NO: 402775 - RNA, 64 nt, Human
ggggccugagugcccauccaagggcucucaaggacaccggcaaggccuccaggcccugagcccc

SEQ ID NO: 402776 - RNA, 64 nt, Human
caggccaacuccugagucaucccaggacucagcacaccggcauccccaccugcugcagggacag

SEQ ID NO: 402777 - RNA, 64 nt, Human
acuuggcuuggugcuuuugaucccaaaguucccacaccggcaguggccugcuggggcaauggca

SEQ ID NO: 402778 - RNA, 64 nt, Human
aggggcacagcagagguuugggaagcggucuccccaccggcacugggauuggcggguccaagcc

SEQ ID NO: 402779 - RNA, 64 nt, Human
ggggccccguggagggcgcccguagugauaagcacaccggcacgaacgucagguccauuccucg

SEQ ID NO: 402780 - RNA, 64 nt, Human
uuuuauuuaugacuuacgcucccgucugcccaugcaccggcaugcagugguaauuauuuuagaa

SEQ ID NO: 402781 - RNA, 64 nt, Human
caaccacaaaaccagagcggaaggagggacuucccaccggcauccggccccagugccauguuuu

SEQ ID NO: 402782 - RNA, 64 nt, Human
ccuuacuuuucuugagcuaaagacaggcuuuuuccaccggcaucaucacugcuaucaucauuaa

SEQ ID NO: 402783 - RNA, 64 nt, Human
cgccacaucacccauccccauccccugacucuuucaccggcaggggcacguggucaacaggacu

SEQ ID NO: 402784 - RNA, 64 nt, Human
ugcacuggcacccucagaaggcuugucucaccuccaccggcauccacacaaaaccaaacaggag

SEQ ID NO: 402785 - RNA, 64 nt, Human
gggcuuccuccaagccccgcucuuccagcacuuccaccggcagagucccagagccacuucaccc

SEQ ID NO: 402786 - RNA, 64 nt, Human
aaccugagagugccuaguccccauccugucccagcaccggcaccgcgucaggacugacuggccc

SEQ ID NO: 402787 - RNA, 64 nt, Human
uuuccagcucuccccaugcccccucccugagcaccaccggcaccgccucccaaacagggcugcu

SEQ ID NO: 402788 - RNA, 64 nt, Human
gccacgcgcugucaagcaacacucugcggaccugccggcguaguugcagcgggggcuuggggag

SEQ ID NO: 402789 - RNA, 64 nt, Human
cuccugaccucaggugaucugccugucuuggccuccggcguaacacuuuuuaagaccaguguaa

SEQ ID NO: 402790 - RNA, 64 nt, Human
cccuagcuauuagcuccacuucacaugcuggagaccggcguagggacagauguauucauccugg

SEQ ID NO: 402791 - RNA, 64 nt, Human
ccaccggccucggccucccaaagugcugggauuaccggcguaagccaccacgcccggcccacuc

SEQ ID NO: 402792 - RNA, 64 nt, Human
ucccaaaguaggccucgccaggcccaccuccugcccggcguaggcccugaggggcgcggccccu

SEQ ID NO: 402793 - RNA, 64 nt, Human
gccggggccguccagacagcaacaagaccgagaaccggcguaucacacacaucuccgcggagca

SEQ ID NO: 402794 - RNA, 64 nt, Human
uccuauauucauugaauaguugaacuguauccacccggcguaauacccauggcaacuggucuuc

SEQ ID NO: 402795 - RNA, 64 nt, Human
aagccuguccuucccuaaauguaaagccaucuguccggcguaaggacgacaccgucagcugucc

SEQ ID NO: 402796 - RNA, 64 nt, Human; identical to SEQ ID NO: 221551

SEQ ID NO: 402797 - RNA, 64 nt, Human; identical to SEQ ID NO: 221552

SEQ ID NO: 402798 - RNA, 64 nt, Human; identical to SEQ ID NO: 221553

SEQ ID NO: 402799 - RNA, 64 nt, Human; identical to SEQ ID NO: 221554

SEQ ID NO: 402800 - RNA, 64 nt, Human; identical to SEQ ID NO: 221555

SEQ ID NO: 402801 - RNA, 64 nt, Human; identical to SEQ ID NO: 221556

SEQ ID NO: 402802 - RNA, 64 nt, Human; identical to SEQ ID NO: 221557

SEQ ID NO: 402803 - RNA, 64 nt, Human; identical to SEQ ID NO: 221558

SEQ ID NO: 402804 - RNA, 64 nt, Human; identical to SEQ ID NO: 221559

SEQ ID NO: 402805 - RNA, 64 nt, Human; identical to SEQ ID NO: 221560

SEQ ID NO: 402806 - RNA, 64 nt, Human; identical to SEQ ID NO: 221561

SEQ ID NO: 402807 - RNA, 64 nt, Human; identical to SEQ ID NO: 221562

SEQ ID NO: 402808 - RNA, 64 nt, Human; identical to SEQ ID NO: 221566

SEQ ID NO: 402809 - RNA, 64 nt, Human; identical to SEQ ID NO: 221567

SEQ ID NO: 402810 - RNA, 53 nt, Human; identical to SEQ ID NO: 221598

SEQ ID NO: 402811 - RNA, 62 nt, Human
caagcccugugcuccggccauggccgcuguguccgccgcaccagccaccccaaagcccuccu

SEQ ID NO: 402812 - RNA, 62 nt, Human
cagcugauuugcugcagggauggagaggaccaccgccgcaggguucuuuuaccugugccacc

SEQ ID NO: 402813 - RNA, 64 nt, Human; identical to SEQ ID NO: 221568

SEQ ID NO: 402814 - RNA, 64 nt, Human; identical to SEQ ID NO: 221569

SEQ ID NO: 402815 - RNA, 64 nt, Human; identical to SEQ ID NO: 221570

SEQ ID NO: 402816 - RNA, 64 nt, Human; identical to SEQ ID NO: 221571

SEQ ID NO: 402817 - RNA, 64 nt, Human; identical to SEQ ID NO: 221572

SEQ ID NO: 402818 - RNA, 64 nt, Human; identical to SEQ ID NO: 221573

SEQ ID NO: 402819 - RNA, 64 nt, Human; identical to SEQ ID NO: 221574

SEQ ID NO: 402820 - RNA, 64 nt, Human; identical to SEQ ID NO: 221575

SEQ ID NO: 402821 - RNA, 64 nt, Human; identical to SEQ ID NO: 221576

SEQ ID NO: 402822 - RNA, 64 nt, Human; identical to SEQ ID NO: 221577

SEQ ID NO: 402823 - RNA, 64 nt, Human; identical to SEQ ID NO: 221578

SEQ ID NO: 402824 - RNA, 64 nt, Human; identical to SEQ ID NO: 221579

SEQ ID NO: 402825 - RNA, 64 nt, Human; identical to SEQ ID NO: 221580

SEQ ID NO: 402826 - RNA, 64 nt, Human; identical to SEQ ID NO: 221584

SEQ ID NO: 402827 - RNA, 64 nt, Human; identical to SEQ ID NO: 221585

SEQ ID NO: 402828 - RNA, 64 nt, Human; identical to SEQ ID NO: 221586

SEQ ID NO: 402829 - RNA, 64 nt, Human
auuuuaguuguugugcuaaacucaauaaugcuguucuaacuacagugcucaauaaaaugauuaa

SEQ ID NO: 402830 - RNA, 64 nt, Human
uccauuguggucugccuuccaggcucauuaauagucuaacuacguaauaacugaagaccuaucu

SEQ ID NO: 402831 - RNA, 50 nt, Human; identical to SEQ ID NO: 84347

SEQ ID NO: 402832 - RNA, 62 nt, Human
gcgagcgcccgaacuggccaggacccccgcgcccgccgcacagcgcgcagccgggcgcucaa

SEQ ID NO: 402833 - RNA, 64 nt, Human; identical to SEQ ID NO: 221587

SEQ ID NO: 402834 - RNA, 64 nt, Human; identical to SEQ ID NO: 221588

SEQ ID NO: 402835 - RNA, 64 nt, Human; identical to SEQ ID NO: 221589

SEQ ID NO: 402836 - RNA, 64 nt, Human; identical to SEQ ID NO: 221590

SEQ ID NO: 402837 - RNA, 64 nt, Human; identical to SEQ ID NO: 221591

SEQ ID NO: 402838 - RNA, 64 nt, Human; identical to SEQ ID NO: 221592

SEQ ID NO: 402839 - RNA, 64 nt, Human; identical to SEQ ID NO: 221593

SEQ ID NO: 402840 - RNA, 64 nt, Human; identical to SEQ ID NO: 221594

SEQ ID NO: 402841 - RNA, 64 nt, Human; identical to SEQ ID NO: 221595

SEQ ID NO: 402842 - RNA, 64 nt, Human; identical to SEQ ID NO: 221596

SEQ ID NO: 402843 - RNA, 64 nt, Human; identical to SEQ ID NO: 221597

SEQ ID NO: 402844 - RNA, 64 nt, Human; identical to SEQ ID NO: 221602

SEQ ID NO: 402845 - RNA, 64 nt, Human; identical to SEQ ID NO: 221603

SEQ ID NO: 402846 - RNA, 64 nt, Human; identical to SEQ ID NO: 221604

SEQ ID NO: 402847 - RNA, 64 nt, Human; identical to SEQ ID NO: 221605

SEQ ID NO: 402848 - RNA, 64 nt, Human; identical to SEQ ID NO: 221606

SEQ ID NO: 402849 - RNA, 62 nt, Human
gacuaccgcucugcuacuuaggcacagggacuccgccgcacgcugacggaccacgagggcug

SEQ ID NO: 402850 - RNA, 64 nt, Human
cagcaugauggaccggugauggcggagccuugugcgucgccaggacuucucugggcuguguuua

SEQ ID NO: 402851 - RNA, 64 nt, Human; identical to SEQ ID NO: 358055

SEQ ID NO: 402852 - RNA, 64 nt, Human; identical to SEQ ID NO: 221607

SEQ ID NO: 402853 - RNA, 64 nt, Human; identical to SEQ ID NO: 221608

SEQ ID NO: 402854 - RNA, 64 nt, Human; identical to SEQ ID NO: 221609

SEQ ID NO: 402855 - RNA, 64 nt, Human; identical to SEQ ID NO: 221610

SEQ ID NO: 402856 - RNA, 64 nt, Human; identical to SEQ ID NO: 221611

SEQ ID NO: 402857 - RNA, 64 nt, Human; identical to SEQ ID NO: 221612

SEQ ID NO: 402858 - RNA, 64 nt, Human; identical to SEQ ID NO: 221613

SEQ ID NO: 402859 - RNA, 64 nt, Human; identical to SEQ ID NO: 221614

SEQ ID NO: 402860 - RNA, 64 nt, Human; identical to SEQ ID NO: 221615

SEQ ID NO: 402861 - RNA, 64 nt, Human; identical to SEQ ID NO: 221616

SEQ ID NO: 402862 - RNA, 64 nt, Human; identical to SEQ ID NO: 221620

SEQ ID NO: 402863 - RNA, 64 nt, Human; identical to SEQ ID NO: 221621

SEQ ID NO: 402864 - RNA, 64 nt, Human; identical to SEQ ID NO: 221622

SEQ ID NO: 402865 - RNA, 64 nt, Human; identical to SEQ ID NO: 221623

SEQ ID NO: 402866 - RNA, 64 nt, Human; identical to SEQ ID NO: 221624

SEQ ID NO: 402867 - RNA, 64 nt, Human; identical to SEQ ID NO: 221625

SEQ ID NO: 402868 - RNA, 64 nt, Human; identical to SEQ ID NO: 358098

SEQ ID NO: 402869 - RNA, 64 nt, Human; identical to SEQ ID NO: 358103

SEQ ID NO: 402870 - RNA, 64 nt, Human; identical to SEQ ID NO: 358129

SEQ ID NO: 402871 - RNA, 63 nt, Human; identical to SEQ ID NO: 221626

SEQ ID NO: 402872 - RNA, 64 nt, Human; identical to SEQ ID NO: 221627

SEQ ID NO: 402873 - RNA, 64 nt, Human; identical to SEQ ID NO: 221628

SEQ ID NO: 402874 - RNA, 64 nt, Human; identical to SEQ ID NO: 221629

SEQ ID NO: 402875 - RNA, 64 nt, Human; identical to SEQ ID NO: 221630

SEQ ID NO: 402876 - RNA, 64 nt, Human; identical to SEQ ID NO: 221631

SEQ ID NO: 402877 - RNA, 64 nt, Human; identical to SEQ ID NO: 221632

SEQ ID NO: 402878 - RNA, 64 nt, Human; identical to SEQ ID NO: 221633

SEQ ID NO: 402879 - RNA, 64 nt, Human; identical to SEQ ID NO: 221634

SEQ ID NO: 402880 - RNA, 64 nt, Human; identical to SEQ ID NO: 221638

SEQ ID NO: 402881 - RNA, 64 nt, Human; identical to SEQ ID NO: 221639

SEQ ID NO: 402882 - RNA, 64 nt, Human; identical to SEQ ID NO: 221640

SEQ ID NO: 402883 - RNA, 64 nt, Human; identical to SEQ ID NO: 221641

SEQ ID NO: 402884 - RNA, 64 nt, Human; identical to SEQ ID NO: 221642

SEQ ID NO: 402885 - RNA, 64 nt, Human; identical to SEQ ID NO: 221643

SEQ ID NO: 402886 - RNA, 64 nt, Human; identical to SEQ ID NO: 221644

SEQ ID NO: 402887 - RNA, 64 nt, Human; identical to SEQ ID NO: 358205

SEQ ID NO: 402888 - RNA, 64 nt, Human; identical to SEQ ID NO: 358247

SEQ ID NO: 402889 - RNA, 64 nt, Human; identical to SEQ ID NO: 358329

SEQ ID NO: 402890 - RNA, 64 nt, Human; identical to SEQ ID NO: 221645

SEQ ID NO: 402891 - RNA, 64 nt, Human; identical to SEQ ID NO: 221646

SEQ ID NO: 402892 - RNA, 64 nt, Human; identical to SEQ ID NO: 221647

SEQ ID NO: 402893 - RNA, 64 nt, Human; identical to SEQ ID NO: 221648

SEQ ID NO: 402894 - RNA, 64 nt, Human; identical to SEQ ID NO: 221649

SEQ ID NO: 402895 - RNA, 64 nt, Human; identical to SEQ ID NO: 221650

SEQ ID NO: 402896 - RNA, 64 nt, Human; identical to SEQ ID NO: 221651

SEQ ID NO: 402897 - RNA, 64 nt, Human; identical to SEQ ID NO: 221652

SEQ ID NO: 402898 - RNA, 64 nt, Human; identical to SEQ ID NO: 221656

SEQ ID NO: 402899 - RNA, 64 nt, Human; identical to SEQ ID NO: 221657

SEQ ID NO: 402900 - RNA, 64 nt, Human; identical to SEQ ID NO: 221658

SEQ ID NO: 402901 - RNA, 64 nt, Human; identical to SEQ ID NO: 221659

SEQ ID NO: 402902 - RNA, 64 nt, Human; identical to SEQ ID NO: 221660

SEQ ID NO: 402903 - RNA, 64 nt, Human; identical to SEQ ID NO: 221661

SEQ ID NO: 402904 - RNA, 64 nt, Human; identical to SEQ ID NO: 221662

SEQ ID NO: 402905 - RNA, 64 nt, Human; identical to SEQ ID NO: 221663

SEQ ID NO: 402906 - RNA, 64 nt, Human
acucguacuaugaaauuuuuaagccuuuuauuuuucuaacuauauuacuguaggacuggauauu

SEQ ID NO: 402907 - RNA, 64 nt, Human
aaucauagauccugaccagcauuuguaacacugcucuaacuaggacacagcaugcagcagccac

SEQ ID NO: 402908 - RNA, 58 nt, Human
cuccugccccaaucuaucuaguacuucccaggcaaauaggccccuuugaggcuccuga

SEQ ID NO: 402909 - RNA, 58 nt, Human
uggaguauuuucuuuauaauuucuugaacaggcaaaugaaagcuuauuauagaaugca

SEQ ID NO: 402910 - RNA, 64 nt, Human
acaaaauaaaggagcccaaggggucauucugucucagcaccauccagccuggcacuucucuucc

SEQ ID NO: 402911 - RNA, 64 nt, Human
auagaaccaacagcaucugagcccucaacaccaacagcaccauccucuguagcagacaggccuc

SEQ ID NO: 402912 - RNA, 64 nt, Human
ggcucccucugggucauauggugcagacugugaccagcaccaggcaggcaguccugucugcgug

SEQ ID NO: 402913 - RNA, 64 nt, Human
gaggcuggagccaggggccacuucugaacugcaccagcaccaggcccacccucgucucugccug

SEQ ID NO: 402914 - RNA, 64 nt, Human
ccguuaagaugguggcggcacacgcucccucccgcagcaccacgccagcuggugcggcccccac

SEQ ID NO: 402915 - RNA, 64 nt, Human
agaaugcauguauuuucuuuuaucuuuggaacaucagcaccaguauauugcuggcagcuauugu

SEQ ID NO: 402916 - RNA, 64 nt, Human
ccccacccggcccacuggcagacacagacccaggcagcaccaggccccagcucccuccgggggc

SEQ ID NO: 402917 - RNA, 64 nt, Human
gcucugagugggccugcucucuguagacugaauucagcaccagugaaaggcuuugagaaggacg

SEQ ID NO: 402918 - RNA, 64 nt, Human
ccauagaggcccaggcaccaccaggagcagcagccagcaccaccuacacaggagucuucagacc

SEQ ID NO: 402919 - RNA, 64 nt, Human
gcccugaggacacuucuuggagauuucagacaggcagcaccagggcuccugacugaaaggggag

SEQ ID NO: 402920 - RNA, 64 nt, Human
gguucuccccauccccacaaaggcuguugaaccacagcaccaggaagccugagaaugaauccug

SEQ ID NO: 402921 - RNA, 64 nt, Human
ggguacuugcccuuugucccacuagacucuaacccagcaccagggugcccaccuaggaccuuuc

SEQ ID NO: 402922 - RNA, 64 nt, Human
cuggaauugaggugguagugaacagcagaucggucagcaccagaagucaacugaguuaaggcag

SEQ ID NO: 402923 - RNA, 64 nt, Human
guuuuuguaacuugcauuuuacaagaguucugaccagcaccagauaagcuucagugcucuccuu

SEQ ID NO: 402924 - RNA, 64 nt, Human
ccugcucuguguguggggggggaggggggagggggguacgcauauucacuugaagucgagguuc

SEQ ID NO: 402925 - RNA, 64 nt, Human
caccugggggaaauuggcgaugucacccguguacgguacgcagcccagagcagacccucaauaa

SEQ ID NO: 402926 - RNA, 64 nt, Human
aaccaaugaacauuugcuaguuguaucaaaucuugguacgcaguauuuuuauaccaguauuuua

SEQ ID NO: 402927 - RNA, 64 nt, Human
cuuauuuccagaaucucgaagaaaaaagaaaaaagagugguauuauuaugggcaaauaaucaua

SEQ ID NO: 402928 - RNA, 64 nt, Human
uuaaugguagcagggaacugccuccucuccccaccagcaccauggcuggcaucgcucagguggg

SEQ ID NO: 402929 - RNA, 64 nt, Human
caguuucuugguugggacacuccucuggcagccccagcaccaccacaaccccuugcagugugcc

SEQ ID NO: 402930 - RNA, 64 nt, Human
uugaagaccauuuucuuccauuauuguaguugagcagcaccaaguggacugucaggcuaacagg

SEQ ID NO: 402931 - RNA, 64 nt, Human
gacucuccucccucaccagcucuuacgccucagccagcaccacugccaccagggcaacugcagc

SEQ ID NO: 402932 - RNA, 64 nt, Human
agacaagaaaaucaucacucuggugccuugguggcagcaccacugccugcucccuggaagguag

SEQ ID NO: 402933 - RNA, 64 nt, Human
acuaccccaagacauaccaacagugaagccaggacagcaccaugccaucggcgcuccagucugu

SEQ ID NO: 402934 - RNA, 64 nt, Human
uuugugggaaaucacuaaugagaaggcuaaccugcagcaccagagaaaccuuuccaagugcuag

SEQ ID NO: 402935 - RNA, 64 nt, Human
uacacaguaugugggauaugucagucaaguuggucagcaccagcaucuguccagcuguucagua

SEQ ID NO: 402936 - RNA, 64 nt, Human
auccuucaccuuugcugaaaagugagcucagauccagcaccauguuccuccugacccauccugu

SEQ ID NO: 402937 - RNA, 64 nt, Human
cuugaagaauccgauuuugugcauaguaaugacacagcaccauuccugagaaauaggaaauaua

SEQ ID NO: 402938 - RNA, 64 nt, Human
ggacccagugcccucugcagaccccucccagccgcagcaccaagggcuugcugccuuguuuccu

SEQ ID NO: 402939 - RNA, 64 nt, Human
uucugauuuggcccccugcccgcuuggagccucccagcaccagacagggcagguuuggggagcc

SEQ ID NO: 402940 - RNA, 64 nt, Human
gacgccaggcaggccaggccgcucuccggggccgcagcaccaaagacgcccgccuccgccccgc

SEQ ID NO: 402941 - RNA, 64 nt, Human
gcuuccgagcacgcuguaggguaugggaagaacccagcaccacuaauaaagcugcugcuuggcu

SEQ ID NO: 402942 - RNA, 64 nt, Human
ucacuuauuaagccgcuggcacggcccugcguagcagcaccagccggccccaccccugcucgcc

SEQ ID NO: 402943 - RNA, 64 nt, Human
guccuuucagcucccagucugaugagaccucucucagcaccacugccucaucugccacgcccac

SEQ ID NO: 402944 - RNA, 58 nt, Human
ugggaaauuuacuggggggcaaagaguacaggcaaauguggaagauaaagauggccuc

SEQ ID NO: 402945 - RNA, 58 nt, Human
uaaaaaaaugacagauguugaaugcccacaggcaaaugcauggaggguuguuaauggu

SEQ ID NO: 402946 - RNA, 58 nt, Human
gggaggaaaacacauucuuugccacagacaggcaaagcaacacaugcucauccuccug

SEQ ID NO: 402947 - RNA, 58 nt, Human
ccagccaguguuuuuugugguaugagaacaggcaaaaagagaugccccgagauagaag

SEQ ID NO: 402948 - RNA, 64 nt, Human
uuccacuugagucacuuugaaauaguuaauucaacagcaccauguuagaaauauauuggcagcc

SEQ ID NO: 402949 - RNA, 61 nt, Human
ggugaggccugucugugaccugcaucuaagcccaugggacaaauugcacagaaguccugua

SEQ ID NO: 402950 - RNA, 61 nt, Human
gccaccagggcuggucucccaggaguagagaccaugggaaaugggguggauuaggauugag

SEQ ID NO: 402951 - RNA, 61 nt, Human
uguucugagaacgagcagacugcaggggaggccaugggauuccccaggccagugucugugc

SEQ ID NO: 402952 - RNA, 61 nt, Human
gccacucaacuccugcuuguuuuuccuuuggccaugggaagguuuaccaguagaauccuug

SEQ ID NO: 402953 - RNA, 61 nt, Human
cugcccuccucucccucccagauggacccuuccaugggaggaaauaaaguuuccaucgcag

SEQ ID NO: 402954 - RNA, 61 nt, Human
ccaucucuggggcccacucucuucugucuucccaugggaagugccacugggaucccucugc

SEQ ID NO: 402955 - RNA, 61 nt, Human
acuuuccuuuaaaaguugagggagcagaggcccaugggauuaaauggcugguccaggucag

SEQ ID NO: 402956 - RNA, 61 nt, Human
cauuaaagguacuuugcaggaaauccuugcaccaugggauuaauauccaauugcugcuugu

SEQ ID NO: 402957 - RNA, 61 nt, Human
gacucaaagcaaacacgugggugcagaagacccaugggaggaggagguggggcccacucaa

SEQ ID NO: 402958 - RNA, 61 nt, Human
uggcugaccugcuguggaugucccuauucugccaugggagaguccaggccugggucacgcu

SEQ ID NO: 402959 - RNA, 61 nt, Human
cuccccacccuggcccccugccccugcacucccaugggaaugccgcagggagccaggcugg

SEQ ID NO: 402960 - RNA, 61 nt, Human
caucuuucauuggauuuuggaaaauuguuccccaugggauucuaaccucacuaccaaauga

SEQ ID NO: 402961 - RNA, 61 nt, Human
ugcaugggaguuucuaggaugaaacacuccuccaugggauuugaacauaugaaaguuauuu

SEQ ID NO: 402962 - RNA, 61 nt, Human
cugagggacagagagaugaacugcucaguuaccaugggagaaggaccaagaucaaaggccu

SEQ ID NO: 402963 - RNA, 64 nt, Human
caucaguguugauuaacacucauaacuagggagugagugguaguuacuuaaguaauugaccaaa

SEQ ID NO: 402964 - RNA, 64 nt, Human
gcugauccuauuaaaggaaugaguccugcuacccgagugguagucauagcccuagaugacucuc

SEQ ID NO: 402965 - RNA, 64 nt, Human
gugaacuaaaagaguucuaaaggaguucuuaaaggagugguagaauuuggguaggaaagugauu

SEQ ID NO: 402966 - RNA, 64 nt, Human
ccuagaucugcacucaccucacuguucaaucauugagugguaaaggacagaaguauuuucuagu

SEQ ID NO: 402967 - RNA, 64 nt, Human
ugcgccccauauucccagcaucauagacauccaacagcaccagcaggagagugggcuagccugc

SEQ ID NO: 402968 - RNA, 64 nt, Human
cccuggugcuuaugcucuuaauugccaccucuaacagcaccaaaucaaaaucucuccacuuuca

SEQ ID NO: 402969 - RNA, 64 nt, Human
ugacccacccccaugggcccccgucccaggcagccagcaccaugggcaggcccugccauggaca

SEQ ID NO: 402970 - RNA, 64 nt, Human
agaacguguacgacgagcuggggggcagcccaggcagcaccagcgcggccacgugcacgcgccg

SEQ ID NO: 402971 - RNA, 64 nt, Human
augccaggaaagaccaaagcagaugcugcugacccagcaccacuucccagccaggagcccccca

SEQ ID NO: 402972 - RNA, 64 nt, Human
uucaggcugauaggaaauucaaagagucuccugccagcaccaagcaagcuugauggacaaugga

SEQ ID NO: 402973 - RNA, 64 nt, Human
auucacuuugaaacaggccucaucccacuuccaccagcaccauagaagaauaauucugggcaga

SEQ ID NO: 402974 - RNA, 53 nt, Human
ggaaccgcaaucagcugugaagccagcaccaccucagagacacuguucccugc

SEQ ID NO: 402975 - RNA, 64 nt, Human
cccacauucaaggcccgugauacagggaugaggucagcaccagcaaacucuggacugguggaag

SEQ ID NO: 402976 - RNA, 64 nt, Human
gaucaggaaucaaaccagcaucggaaagacuucccagcaccaagcuugagcugugucguuucgu

SEQ ID NO: 402977 - RNA, 64 nt, Human
auaaguugcaaaugcaguuccuuucauaauaucucagcaccagaaacaaaaauuaagauuauca

SEQ ID NO: 402978 - RNA, 64 nt, Human
uuaaaagaaauaauauauguaaagcacuuuaacacagcaccaggcccacggaaaguggcuaaug

SEQ ID NO: 402979 - RNA, 64 nt, Human
uacucucuuucuacauauggcuagccaguuuucccagcaccauuuauuaaauagggaauccuuu

SEQ ID NO: 402980 - RNA, 64 nt, Human
acccuuucgacaagacguuccgccuuccccuccccagcaccaaagaaugccagccuaucaggaa

SEQ ID NO: 402981 - RNA, 64 nt, Human
agguuacuuaauucaacuuaacuaucaucuuauucagcaccaagcaugucccaggcacuguacu

SEQ ID NO: 402982 - RNA, 64 nt, Human
aggggccccagcgucugcagggugacgccugagacagcaccacugcugaggagucugaggacug

SEQ ID NO: 402983 - RNA, 58 nt, Human
auacuuuuugugaaucuacaaccagagacaggcaaaaacuuguaaaguaagggauagu

SEQ ID NO: 402984 - RNA, 58 nt, Human
cuugaauuagcagagucuaaaaucagggcaggcaaacgauaaucugagugcaagucug

SEQ ID NO: 402985 - RNA, 58 nt, Human
aaaucaccguacgacucuuuuccaaacacaggcaaauccgaaaucagcaggacgacug

SEQ ID NO: 402986 - RNA, 58 nt, Human
agcaaaaucauggaaaauuuuuguuguccaggcaaauaaaaggucauuuuaauuuagc

SEQ ID NO: 402987 - RNA, 64 nt, Human
gaaacucuucucuccaaaucccaggccuggcuuccagcaccauccagcugugcccaagaagcca

SEQ ID NO: 402988 - RNA, 63 nt, Human
agcaaaaaacucuccuguagggguucuaaaggacagcaccagcgggacagcccacaaggcugg

SEQ ID NO: 402989 - RNA, 64 nt, Human
gcagcauucccucccagccacugagcugucgugccagcaccauuccuggucacgcaaaacagaa

SEQ ID NO: 402990 - RNA, 64 nt, Human
uccgaugaguuugggacuucaggaaaaaucaacccagcaccagcagcuaccaaccaccauucca

SEQ ID NO: 402991 - RNA, 64 nt, Human
cuagacucaucccaugucagcucccuaggagccacagcaccaggaagggaugcugccuucaucu

SEQ ID NO: 402992 - RNA, 64 nt, Human
guuuccuugaagcgcccgccgcacacgcccuauucagcaccagcuccgcggacaguucccgcgg

SEQ ID NO: 402993 - RNA, 64 nt, Human
cucaaccucccgacuagcuggcauuacaggcgugcagcaccaccccaggcuaauuuaaaaaacu

SEQ ID NO: 402994 - RNA, 64 nt, Human
gguucugaaauuugcagugucugcuccugggaggcagcaccagaaagggcacugaaauguacua

SEQ ID NO: 402995 - RNA, 64 nt, Human
aaaaucagugcacaagaauugggcugguuaggcccagcaccacacugaagugggcucagugguu

SEQ ID NO: 402996 - RNA, 64 nt, Human
gcccccagcgggcucugcccuggugcgcuucacacagcaccaagcagcaacaagaacagcagaa

SEQ ID NO: 402997 - RNA, 64 nt, Human
guucuccaguugcacugaggaaugcacugucucgcagcaccagcucugcagagcccuugcccca

SEQ ID NO: 402998 - RNA, 64 nt, Human
auuaauucauaaguuuuaaagggcauggugcucccagcaccagaaaacuaucaguguuuuuaaa

SEQ ID NO: 402999 - RNA, 64 nt, Human
ggcagccacuucggccaggucacacgaccggggccagcaccacuuccuuuaaagaugaacucug

SEQ ID NO: 403000 - RNA, 64 nt, Human
uuggccacugaaggguacaaaggcaaaaggaccacagcaccacuuagguguagcauggauuuua

SEQ ID NO: 403001 - RNA, 64 nt, Human
gaaaccagcugcgguacugucccauuuuugucaucagcaccaguguccgucaggaaggcaggug

SEQ ID NO: 403002 - RNA, 64 nt, Human
cugagggcagaaagguucugcccgggaaggucaccagcaccaacaccacgguagugccugaaau

SEQ ID NO: 403003 - RNA, 64 nt, Human
accccaaugucugcuguuuccaacacuggugauuucuaacuacggcccacagcagaugcuguug

SEQ ID NO: 403004 - RNA, 64 nt, Human
gaauccccaccccaaucccaaauuuuguuuugguucuaacuaccuccagaauguguucaauaaa

SEQ ID NO: 403005 - RNA, 64 nt, Human
uggcuuaagauuaaacaaaaacauuuuucaagucucuaacuagagugaacucuagagcacagua

SEQ ID NO: 403006 - RNA, 64 nt, Human
ugauuauuaaguuuagaaugcauuuuuacaaguaucuaacuaucaaauuguguuuaguaacuug

SEQ ID NO: 403007 - RNA, 64 nt, Human
agccagacccuccuugggcagacaggcugacuggcagcaccagcuuugggggcagaguccuagg

SEQ ID NO: 403008 - RNA, 64 nt, Human
gauguggcuguauuuguuuugaguucuaggagcacagcaccaaauguggucucuuaagggaaga

SEQ ID NO: 403009 - RNA, 64 nt, Human
cugaggcccugaguguccagccacaugguggcaccagcaccacuccuuuccuuaccacaucaac

SEQ ID NO: 403010 - RNA, 64 nt, Human
auguccccacaucccugcucccuccuuccucauccagcaccaaaucuuugcuuauguccacagg

SEQ ID NO: 403011 - RNA, 64 nt, Human
agugcauguacacgaaugcccuacgucauccuuccagcaccacugcugcaugggucacucucgg

SEQ ID NO: 403012 - RNA, 64 nt, Human
ggagagcccgugggggcaggggaccuggagcugccagcaccaagcgugauuccugcugccugua

SEQ ID NO: 403013 - RNA, 64 nt, Human
uucaggaacuaagagugagucacucccaugagaacagcaccaagccauucaugggggaaucugc

SEQ ID NO: 403014 - RNA, 64 nt, Human
aaccaaaaaugauucaauacuguuaucacuaaaacagcaccaagaccugaagccaucuucccuu

SEQ ID NO: 403015 - RNA, 64 nt, Human
cccaaggggcuucccugccagggcugaaugaccccagcaccaaaugacuggagacgcauccuua

SEQ ID NO: 403016 - RNA, 64 nt, Human
acuggcuuguugggauuuuuaauuuaucuucacucagcaccaagggcccccgacacuccacucc

SEQ ID NO: 403017 - RNA, 64 nt, Human
guuccaaauugggcuucugugcccagagcguccacagcaccauucccaguguagacucccaguc

SEQ ID NO: 403018 - RNA, 64 nt, Human
ugaccacuuuucuucucuuugaggcacuaccuggcagcaccaucuaaaccuguaucaucugcug

SEQ ID NO: 403019 - RNA, 64 nt, Human
ggccagaaauggccuccgaacugugcagcuccugcagcaccauuuguaucauagcauaucuguu

SEQ ID NO: 403020 - RNA, 64 nt, Human
agccugccugcuaggaugugacgcuggggaagugcagcaccauguccuuuggagcccuucugga

SEQ ID NO: 403021 - RNA, 64 nt, Human
gauagcagaauaaauugguguuucccuguugacccagcaccauuucugugggccuagaauaugg

SEQ ID NO: 403022 - RNA, 64 nt, Human
augaaccaaggaguggccccuaugguagggacuccagcaccagguggaaguccauauggacaac

SEQ ID NO: 403023 - RNA, 64 nt, Human
aucugaaaauggaguuuuagaggaaaagucaacaucuaacuagugaggaaaagugccuaauaca

SEQ ID NO: 403024 - RNA, 64 nt, Human
uugcuuuuauagagaauagaaugacacucacaacucuaacuaccugucagauacuugcagcucu

SEQ ID NO: 403025 - RNA, 64 nt, Human
uaacucucaugcuucagcucuuggauuuguuguuucuaacuaacaugucauguacaccaaacau

SEQ ID NO: 403026 - RNA, 64 nt, Human
uauuuauuauuagacauuacuacuaaaagguacaucuaacuauucagggacauuuuuccauuuc

SEQ ID NO: 403027 - RNA, 64 nt, Human
gcuaugaaauaaccaacaguauucaagaagcaaccagcaccaucaugugauaaugguacuaugg

SEQ ID NO: 403028 - RNA, 64 nt, Human
gcuguagccagcccugugagaccugccagcccuucagcaccacugcaggauaaccgaacucaag

SEQ ID NO: 403029 - RNA, 64 nt, Human
cccagcagcacagagaagcucugauagcacagaucagcaccaacguugaacagcuaaugaguau

SEQ ID NO: 403030 - RNA, 64 nt, Human
agcucaauagcucaaaagugacaaguccuuuucacagcaccauucucagaacaccucugaguaa

SEQ ID NO: 403031 - RNA, 64 nt, Human
gcuccucaagcuacccaugcccagcgcccuaaagcagcaccagaugcuuuggaauuggggugaa

SEQ ID NO: 403032 - RNA, 64 nt, Human
guugccuauggcugggugugcccugcccuaaaugcagcaccacuuucaagcuuaguaggaccau

SEQ ID NO: 403033 - RNA, 59 nt, Human
ccgcagcccugggucugugacgccaacgccagcaccaaugucgcgccugucccgcggca

SEQ ID NO: 403034 - RNA, 62 nt, Human
ccgccgccgccaggcacuccggagcuguccgcuucagcaccacggcggccgcgguagcggcg

SEQ ID NO: 403035 - RNA, 64 nt, Human
ccggagugaggaacugaauuuggcuccucagccccagcaccaccagcugugggcagucaguagc

SEQ ID NO: 403036 - RNA, 64 nt, Human
cuuccucucgccccugugcacccggagaugcccacagcaccagcaccugagcucaccuccgaac

SEQ ID NO: 403037 - RNA, 64 nt, Human
uaugagagagaauucacacucaacaagacacuaccagcaccacguuuacagaggaugaaaacac

SEQ ID NO: 403038 - RNA, 64 nt, Human
ugugacguguguauaguaaaugcaggcccucuggcagcaccauaauuggucgguuacccugagc

SEQ ID NO: 403039 - RNA, 64 nt, Human
ccagugcccaugguuccucacuccuaccagcaagcagcaccaucccgcaggcuucucccaccug

SEQ ID NO: 403040 - RNA, 64 nt, Human
cucagccucucgacuaacagggacuauaaucuugcagcaccaugccgagcuaauuuuauuuuuu

SEQ ID NO: 403041 - RNA, 64 nt, Human
caugucauuuucagauuaugguagcaugcugauacagcaccaugaaagaacucaaggaaaauau

SEQ ID NO: 403042 - RNA, 64 nt, Human
cugccucagccucccaaguagcugggauuacaggcagcaccacaccuggcuaauuuucauauuu

SEQ ID NO: 403043 - RNA, 58 nt, Human
gcauugaauuuaaaacuucuaaaaauaacaggcaaauauuguagcuauauuacagugg

SEQ ID NO: 403044 - RNA, 58 nt, Human
auggaguggugacaugucaguaugagaacaggcaaaagguaaauuuuuuuuuuuuuuu

SEQ ID NO: 403045 - RNA, 58 nt, Human
ccuggagcggcucuccugagaggugcugcaggcaaagugagacugacaccucacugag

SEQ ID NO: 403046 - RNA, 58 nt, Human
ugggcuccuuauaacauaaucguguguccaggcaaacgcacacuagugucugacugga

SEQ ID NO: 403047 - RNA, 64 nt, Human
guuuuacauuuuaaaauguuuaaauucucuuucacagcaccaaaggcucagcuuggauuugugu

SEQ ID NO: 403048 - RNA, 64 nt, Human
aauacaguuugaauauauguaugcauauauuguucagcaccacgaugcucugauuuaauucuag

SEQ ID NO: 403049 - RNA, 64 nt, Human
cguggaggcuaggaggucucaggugcugcccuggcagcaccagagugugggccgggcccgagug

SEQ ID NO: 403050 - RNA, 57 nt, Human
aauugaagaacgggaccuaggggacagcagcaccacuccagccucagagacugcaca

SEQ ID NO: 403051 - RNA, 64 nt, Human
uaaccaaggggugcgaaacccuggcagucccaggcagcaccaggccagggguugauuugaaacg

SEQ ID NO: 403052 - RNA, 64 nt, Human
uuuucugcacgugguugccuuagucaucuuccuacagcaccaucuagacaucaaaaauugugcu

SEQ ID NO: 403053 - RNA, 64 nt, Human
aacaguaaaccaucuuuauuauggucauauuucacagcaccaaaauaaaucaucuuuauuaagu

SEQ ID NO: 403054 - RNA, 64 nt, Human
cucugaguugaccagcagcaggucugccgaccaccagcaccauccucuccucccagcagccucc

SEQ ID NO: 403055 - RNA, 64 nt, Human
aaauacaccaagauggucaaauuacuacacaaaucagcaccagcacagucugauagcugcaaau

SEQ ID NO: 403056 - RNA, 64 nt, Human
ucaauuuuagcacucuccaggcacaaggacagcccagcaccagcuuuacagggcaguguuucag

SEQ ID NO: 403057 - RNA, 64 nt, Human
cuuuccuucaggucacgcagcccuguacuguauccagcaccacagaaaccucaguguuuuuccu

SEQ ID NO: 403058 - RNA, 61 nt, Human
uuccugaaauggucccuuaacuggauuauuacagcaccaaaaaacuucucugaagccuuuc

SEQ ID NO: 403059 - RNA, 64 nt, Human
ugucacaguggagccucucaacaacgcugugaggcagcaccauuugacagguuaggaugcuggg

SEQ ID NO: 403060 - RNA, 64 nt, Human
agaagagaaagcauguugcuuaaacauccuuccccagcaccagcuauugguguaccuauaauuu

SEQ ID NO: 403061 - RNA, 64 nt, Human
cacccuggugcuucccagacccuguggagccucccagcaccaacuugcuuaauguguuuuucuu

SEQ ID NO: 403062 - RNA, 64 nt, Human
cagagauuuaagaaucuccuccuaccuccugacucagcaccauguaaucauuaaacucucugcu

SEQ ID NO: 403063 - RNA, 64 nt, Human
uugagcugguugaauacuuugaaaaaugcucaguucuaacuaaugaaauggauuucccaguagg

SEQ ID NO: 403064 - RNA, 64 nt, Human
aaauuaacuaccuggagcaaaacagaugugcagaucuaacuaaaacagagcuauagugaaacaa

SEQ ID NO: 403065 - RNA, 64 nt, Human
gaauguuuucaaaacugaauagauaacauaguacucuaacuaaagucuccaaguuauguauuau

SEQ ID NO: 403066 - RNA, 64 nt, Human
gcuggacuuuggaaacaugauugcggaugauaugucuaacuacgaugaagaagguaccggaagu

SEQ ID NO: 403067 - RNA, 64 nt, Human
aaauaaaaaauuagagaucacucuuggcugauuucagcaccaggaacuguauuacaguuuuaga

SEQ ID NO: 403068 - RNA, 64 nt, Human
uuaaaaauauuuacuguacuuuaucucacuacaacagcaccacaauuuaaauuauaaaacgggc

SEQ ID NO: 403069 - RNA, 64 nt, Human
aggccauuccccuucuacucaccgacaucccucccagcaccacacaccccgccccugaaaggag

SEQ ID NO: 403070 - RNA, 64 nt, Human
uuaaaauaugcauuauuuaauuuaaucuuacucccagcaccaaaagguaauugaccagccucaa

SEQ ID NO: 403071 - RNA, 64 nt, Human
gauaguugucaugcgacagccugagaacgcugggcagcaccacacccuccaauucacacugccu

SEQ ID NO: 403072 - RNA, 64 nt, Human
cgcuguaaguguaguucaguguaggugaagaaaacagcaccacugagaugaaucucauggcaga

SEQ ID NO: 403073 - RNA, 64 nt, Human
agccacgucaaacuucucucccucagggacucuccagcaccaaaaggcagaagguggaagccgu

SEQ ID NO: 403074 - RNA, 64 nt, Human
uugaagucacacccuccgaaagaugaguagaaaccagcaccagcacagcccagaucuucucuuu

SEQ ID NO: 403075 - RNA, 64 nt, Human
gcuuuggcgggcacuucugccaagaaaugguuaucagcaccagccgccauggccaagccugauu

SEQ ID NO: 403076 - RNA, 64 nt, Human
gugguuuaacccuuuugaucacuaccaccauuaucagcaccagacugagcagcuauauccuuuu

SEQ ID NO: 403077 - RNA, 64 nt, Human
uggacuguaaaugaaacauugcauccaugaaggacagcaccaagcaccuuuuugaauacagaau

SEQ ID NO: 403078 - RNA, 64 nt, Human
uuccauauucuguauuaggagaaaauuacccucccagcaccagccccccucucaaacccccaac

SEQ ID NO: 403079 - RNA, 64 nt, Human
uccaccccaaaucuuaccccaccacuggcacuuucagcaccagggggucugaaggauggugacu

SEQ ID NO: 403080 - RNA, 64 nt, Human
cuucucuuccuuuccugugcaccccacccuguaacagcaccaaccaccaggauuggacaucacc

SEQ ID NO: 403081 - RNA, 64 nt, Human
ggggaccucuggggcaaggagcugagaaguccugcagcaccaggugagacuugcuuacagugga

SEQ ID NO: 403082 - RNA, 64 nt, Human
aagugugcaguuucuagugcugggaagucuuagccagcaccagagcgccaggccucucccuggc

SEQ ID NO: 403083 - RNA, 64 nt, Human
ucuaacauggccacuucucagcacguccaagaagucuaacuaucaaaaagggcagacuuccugc

SEQ ID NO: 403084 - RNA, 64 nt, Human
uccaaguuggacacgucccguaguugggcauaugucuaacuaaaaguuucugacuuuuaguaaa

SEQ ID NO: 403085 - RNA, 58 nt, Human
guguauucugcuccuagcagagugaccucaggcaaaugacuuuauaggcaucguccgu

SEQ ID NO: 403086 - RNA, 58 nt, Human
ugaacuuacacuuggagcccgugcaguacaggcaaaacacgcaagggcaucaggcacu

SEQ ID NO: 403087 - RNA, 64 nt, Human
ugccaaagaagccuuugauuuacaggcuuaaugccagcaccaguccucuggggcacaugguuug

SEQ ID NO: 403088 - RNA, 64 nt, Human
aagagacucucuuagggaaaccaauaguccccaucagcaccauggaggcaggcucccccugccu

SEQ ID NO: 403089 - RNA, 64 nt, Human
agagcaaggaugaaaaauugaagucacagccccucagcaccaagcagaaggugaggacagggag

SEQ ID NO: 403090 - RNA, 64 nt, Human
uuuaccugaaaacaaacaaacaaacccuaaaacucagcaccacuaccauuuccagaagcuuuuu

SEQ ID NO: 403091 - RNA, 64 nt, Human
agcaacaaauuaaaaaauaauaacaaaucaaccccagcaccaaacccacccaggcaggaagaag

SEQ ID NO: 403092 - RNA, 64 nt, Human
ggugagccgccugccaguggaggacagcaccccucagcaccacccacccucauucagagcacac

SEQ ID NO: 403093 - RNA, 64 nt, Human
gguucugagucagggugaucuguggacgggaccccagcaccaagucuacgggugccagaucagu

SEQ ID NO: 403094 - RNA, 64 nt, Human
gaaccuauuuuuguugugguacaacaguugagagcagcaccaagugcauuuaguugaaugaagu

SEQ ID NO: 403095 - RNA, 64 nt, Human
cugggagucuucccacauguggcacuucaaaaggcagcaccacugggcgccugcacuuauuuga

SEQ ID NO: 403096 - RNA, 64 nt, Human
accuggacagguguacgucugcacccaucacccucagcaccaggccacccugcaguccacuuac

SEQ ID NO: 403097 - RNA, 64 nt, Human
uuugcugcugguaacaguuccaccauuuagguuccagcaccaagcaaacuaacacccgacucag

SEQ ID NO: 403098 - RNA, 64 nt, Human
ccagcacaugaggcugaggcugaggggcagucaccagcaccaggaagaaggugguaggaggagu

SEQ ID NO: 403099 - RNA, 59 nt, Human
acccuuggcuuaacuccuaagccccugcccagcaccacagcagagaucacacacugacc

SEQ ID NO: 403100 - RNA, 64 nt, Human
cacggguugaggaagucaggcuguuggcgugucccagcaccacaccaccccuaaagugccaggu

SEQ ID NO: 403101 - RNA, 64 nt, Human
gcugugcugaggaaaggggaugcagagcccugcccagcaccaccaccuccuaugcuccuggauc

SEQ ID NO: 403102 - RNA, 64 nt, Human
augggaacuccagccugcuaucuuucaugaaggucagcaccaucccuggccuccucacauagga

SEQ ID NO: 403103 - RNA, 64 nt, Human
gguuaggaccuuccuguaaacucuugccccuacuucuaacuacucuauaaauauauacauauau

SEQ ID NO: 403104 - RNA, 64 nt, Human
uuccuugggaaauuauuguggccuuuauuuaauuucuaacuacguaccugggugccuauaucga

SEQ ID NO: 403105 - RNA, 64 nt, Human
acaauucuuuauguguauagcauguguauuaaugucuaacuacauacgcaaaaacuuccuuuac

SEQ ID NO: 403106 - RNA, 64 nt, Human
ugacguugagaugucaucaucuuacaucagacuuucuaacuaguaucaagaucagugucagaua

SEQ ID NO: 403107 - RNA, 64 nt, Human
aaggcucugccagacaccuccaagcuugagagcucagcaccaugcaccaagagcaggagaaaag

SEQ ID NO: 403108 - RNA, 64 nt, Human
ggagggcagcugucuugugcauuacuuguguuuccagcaccaaaguugugggacauguugcugu

SEQ ID NO: 403109 - RNA, 64 nt, Human
ggcaagaaauuuguguucuucugaaugcuacuagcagcaccagccuuguuuuaaauguuuucuu

SEQ ID NO: 403110 - RNA, 64 nt, Human
uguuaagacuugacaguggaacuacauuaguacacagcaccagaauguauauuaagguguggcu

SEQ ID NO: 403111 - RNA, 64 nt, Human
guuccaguuccaagcauggaggcucauucugaagcagcaccaacugagcaaaccccuguggucc

SEQ ID NO: 403112 - RNA, 64 nt, Human
aucccgguuccaagccuagaggauccuuccaaaccagcaccaacagagccaaggccuugggagc

SEQ ID NO: 403113 - RNA, 64 nt, Human
acuccuuuccuucaagccggaauuuuccuuuuuucagcaccaguagguacuaagucuccagaug

SEQ ID NO: 403114 - RNA, 64 nt, Human
uucuaauccaucagggaaaugagcugaauggccccagcaccauccaaguugacacagcuaaagg

SEQ ID NO: 403115 - RNA, 64 nt, Human
uauacuugcaagauaauuuucagcugcaaggauucagcaccaguuauguuugaaugaacccucc

SEQ ID NO: 403116 - RNA, 64 nt, Human
cccaccagcacaccccguacccugccuggaaucccagcaccagccccccugccucuccucugcc

SEQ ID NO: 403117 - RNA, 64 nt, Human
agccgcuggugcagugagcauagcagguggcaggcagcaccaucauucaucuuucucacugcag

SEQ ID NO: 403118 - RNA, 54 nt, Human
aacgccaguugcuuaaauaauaugcagcaccacuagcuugugcugguuuuuaga

SEQ ID NO: 403119 - RNA, 64 nt, Human
gucucacgucgcagugccauggacgcagcaguuacagcaccauuguuuuagcagugcguguuca

SEQ ID NO: 403120 - RNA, 64 nt, Human
augagggccuugagucccccaaaacaccggguuccagcaccacacucagcccucauuggcucuu

SEQ ID NO: 403121 - RNA, 64 nt, Human
ugaucaugaugcuucuugucaacacccucuuaagcagcaccagaaacagugaguuugucuguac

SEQ ID NO: 403122 - RNA, 64 nt, Human
uguaauaacaaugaggaauagccacggcgaucuccagcaccaaucucuccauguuuuccacagc

SEQ ID NO: 403123 - RNA, 64 nt, Human
aauauuaaaugugcagauaugcuucgagcacuuuucuaacuaaugagcucugugguaagaaaaa

SEQ ID NO: 403124 - RNA, 64 nt, Human
guauguuuuaagaccuaauccccaccucccuucuucuaacuaaauauaaaaagauccaggggac

SEQ ID NO: 403125 - RNA, 64 nt, Human
gggguggacgauguuugaugauuagacggucaucucuaacuacuaaacuaauaucugcauucuu

SEQ ID NO: 403126 - RNA, 64 nt, Human
accaaaggaacuuacgcaacacaccacugaguccucuaacuaaucauaugugcucagacacagc

SEQ ID NO: 403127 - RNA, 64 nt, Human
cacuggaggauggccugcucuugagguauccaggcagcaccacugauggcuccucugcucccau

SEQ ID NO: 403128 - RNA, 64 nt, Human
cauuucucuagcucagccucacaggccaaagcaucagcaccagaacgcacacccagcccagccc

SEQ ID NO: 403129 - RNA, 64 nt, Human
cacuucucuagcucagccucacaggccaaagcaucagcaccagaacgcacacccagcccagccc

SEQ ID NO: 403130 - RNA, 64 nt, Human
ggcagggacccuuccaggccacaguaggcugaagcagcaccaggauccuggccuggccuggccu

SEQ ID NO: 403131 - RNA, 64 nt, Human
cacaccucuaguccggucugccgguggccuccagcagcaccacagagcuccagaccaaccaccc

SEQ ID NO: 403132 - RNA, 64 nt, Human
acaugcuucgcuguuagugucuucuuccugcccucagcaccacagcucaagaaaaccuaaaguu

SEQ ID NO: 403133 - RNA, 52 nt, Human
ccccggaagggcaggucugagccagcaccagggcggugggagacuccugucc

SEQ ID NO: 403134 - RNA, 64 nt, Human
cagccaucucuccucccagggguccugaggguuucagcaccaggguucucugcagccacacaau

SEQ ID NO: 403135 - RNA, 64 nt, Human
ggcauuuagaauuuagaaucugagcacaucacaccagcaccagcucccugucucuucuagccac

SEQ ID NO: 403136 - RNA, 64 nt, Human
ugacuugggcugauccccacccuuucugggccuacagcaccacaggccgcuguacccccuuaga

SEQ ID NO: 403137 - RNA, 64 nt, Human
agcauuuuccaaguucccgauggcgaacggggcucagcaccagagaccagggaguauucacugc

SEQ ID NO: 403138 - RNA, 64 nt, Human
gccucuuggagcagagugccccguggcaggagcgcagcaccaugucccugccccccgggcuccu

SEQ ID NO: 403139 - RNA, 64 nt, Human
gcccugucugccagcccaccccagggacugggggcagcaccaggucccggggagagggauugag

SEQ ID NO: 403140 - RNA, 64 nt, Human
ugaguuacaaacaguguaugaagcauucguccagcagcaccaggcugaaaaaacagaacgagag

SEQ ID NO: 403141 - RNA, 64 nt, Human
cauuuagaguaguguugaaauacucggcuagcaucagcaccacuauagcacuguccgugucaua

SEQ ID NO: 403142 - RNA, 64 nt, Human
gagugguuucuucauucaugugaaaauuauuagccagcaccagaugcaugagcuaauuaucucu

SEQ ID NO: 403143 - RNA, 64 nt, Human
aauucugacuuguguucuuuucgucuucauaaauucuaacuaaggccacugugccacugugcac

SEQ ID NO: 403144 - RNA, 64 nt, Human
uuucauaucuuugaaauagaguaguagcucuauuucuaacuaaauucuauuuauguaacaacac

SEQ ID NO: 403145 - RNA, 64 nt, Human
auuuucuuuuuuuucccuccccaggucuaguagcucuaacuaaaaaguucuuggagccaucgug

SEQ ID NO: 403146 - RNA, 64 nt, Human
acuuugacugguacauggaggcuauuuuaauccuucuaacuaaacuaaaauagauuaaaggaau

SEQ ID NO: 403147 - RNA, 64 nt, Human
gcgggggugggguuuguccacagagcugcuggagcagcaccaagagccagucuugaccgggaug

SEQ ID NO: 403148 - RNA, 64 nt, Human
gagaaagguguaagaaauaggauaaaaagaaggucagcaccauguaccaggaauagcuuuacuu

SEQ ID NO: 403149 - RNA, 64 nt, Human
cuccaccccaaaucaacagaauauacauucuucucagcaccacaucacacuuauuuccacauug

SEQ ID NO: 403150 - RNA, 64 nt, Human
cuuuuccugcucccuaaccuuucgccgaauggggcagcaccacugacguuucugggcggccagu

SEQ ID NO: 403151 - RNA, 64 nt, Human
ucccccagacuuggggugggggcccugccagcuccagcaccacccuugccccaagucuuuuaac

SEQ ID NO: 403152 - RNA, 64 nt, Human
acgucuuaaaucucaucaaugaaauccagugaaacagcaccauuucuuaguaucauuaaauaac

SEQ ID NO: 403153 - RNA, 64 nt, Human
gccacuuuaccauucuauuucccaagggaaccaucagcaccaaccugcuaaaugccuguauuug

SEQ ID NO: 403154 - RNA, 64 nt, Human
ggccaucagaaggaagccaaagaguucacagccucagcaccaacaacucaacauggucaucaug

SEQ ID NO: 403155 - RNA, 64 nt, Human
accugagcguggaugcaccgugccuuaucaaagccagcaccacuuugccuuacuugagucgucu

SEQ ID NO: 403156 - RNA, 64 nt, Human
ccugcucagcugcuggcccgggcgaccugggacucagcaccaacggcugaaguuucucagcugg

SEQ ID NO: 403157 - RNA, 64 nt, Human
gcuuggagcagagacggcagccccauccuucccgcagcaccagccugagccacaguggggccca

SEQ ID NO: 403158 - RNA, 64 nt, Human
cucccucugcccucccgucugugagcucccugcccagcaccaccuccugcacugcacuucugcc

SEQ ID NO: 403159 - RNA, 64 nt, Human
auccccaguucuuagccaguugagccagcgacaacagcaccagagccaggcagucacuguuccu

SEQ ID NO: 403160 - RNA, 64 nt, Human
gaccugcccucucugcgcugaggcccagccccuccagcaccacuuuggcuuaaagcauccuccu

SEQ ID NO: 403161 - RNA, 64 nt, Human
ccaacauggcugcaguagacuucuuagugguauccagcaccacuugcagagggcugcuuuauca

SEQ ID NO: 403162 - RNA, 64 nt, Human
ucccacacaucacacaggcugguaaucucuucaccagcaccaauuucauuuuacuccaggcaca

SEQ ID NO: 403163 - RNA, 64 nt, Human
cacgcgcuuuguccuuagcgccugucugcucuccucuaacuaggacccagggccuuuggcuucc

SEQ ID NO: 403164 - RNA, 64 nt, Human
auucagaauaccacaucuguacagcguugacaacucuaacuaaaaggauuacagcccuuaaaau

SEQ ID NO: 403165 - RNA, 58 nt, Human
cucuguaagaaagaaaaggucagccucccaggcaaaccaguaguggagguuuuacauu

SEQ ID NO: 403166 - RNA, 58 nt, Human
aaacuucugcauuuaguuucuaucuuuccaggcaaaacaaauggguauucuuuucaua

SEQ ID NO: 403167 - RNA, 64 nt, Human
accugaccccuagaggagacaguuuugaccucuucagcaccaggaaggaagcucugaggauggu

SEQ ID NO: 403168 - RNA, 64 nt, Human
aagaguaaagggcugggucugccucagaaggcaccagcaccagggcccagguauuaaggcugag

SEQ ID NO: 403169 - RNA, 64 nt, Human
agccaagggaugagguuguccaggcugugcuggacagcaccaccuucuucccugaagacgagca

SEQ ID NO: 403170 - RNA, 64 nt, Human
uggcgguggcugccccggccuccucggagagcagcagcaccaaccacagcaucgggagcaccca

SEQ ID NO: 403171 - RNA, 64 nt, Human
ggagcugggaacuugguguugcccccucaauuuccagcaccagaaagagagauugugugggggu

SEQ ID NO: 403172 - RNA, 64 nt, Human
ccaagcaggacuuggcacaugagcacccaccccacagcaccaucaggcagcacccaugggcucc

SEQ ID NO: 403173 - RNA, 64 nt, Human
ccaggcugacagcuuuuugcaagaggagggggaccagcaccagcugggaggcauaggcuaggac

SEQ ID NO: 403174 - RNA, 64 nt, Human
aguaggguggaccaaaggaggccacgugagcagucagcaccaguucugcaccagcagcgccucc

SEQ ID NO: 403175 - RNA, 64 nt, Human
cuucuaaagcccccccugucgucugcucuucacccagcaccacagaggcaccugcugcacacac

SEQ ID NO: 403176 - RNA, 64 nt, Human
uacagcauggguggcaggguuuggacccgcccagcagcaccacggaccccagccacucucgggg

SEQ ID NO: 403177 - RNA, 64 nt, Human
uguccacccaccucgcucagcggcucccggggcccagcaccagcucagaauaaagcgauuccac

SEQ ID NO: 403178 - RNA, 64 nt, Human
ucccugcccacccccucccugccguaucgaucaccagcaccaggguggcccgugugcguggggc

SEQ ID NO: 403179 - RNA, 64 nt, Human
auuacuaccuuuuaaaauauuuuagauaaaugcacagcaccacagcaccacaucuaagcauuag

SEQ ID NO: 403180 - RNA, 64 nt, Human
cuuuuaaaauauuuuagauaaaugcacagcaccacagcaccacaucuaagcauuagugaugggu

SEQ ID NO: 403181 - RNA, 64 nt, Human
cagccuauggauccgugaccaaugugagggucaacagcaccaugacaacccugcaggugcucac

SEQ ID NO: 403182 - RNA, 64 nt, Human
cugcaugcagcacagaagggugugaccaugcccucagcaccacucuuguccccacugaacggca

SEQ ID NO: 403183 - RNA, 64 nt, Human
uuugcugcuugcugacguaagcaauaaguaacccucuaacuaaugguaucuacauauuucugua

SEQ ID NO: 403184 - RNA, 64 nt, Human
guaaccuuuauuucaugaaggacuucuuuuuguuucuaacuauaaacuuggaucaccuauguua

SEQ ID NO: 403185 - RNA, 58 nt, Human
ccccaaggcagaaaccaagaacugucugcaggcaaauaagcacccagcacccauccug

SEQ ID NO: 403186 - RNA, 58 nt, Human
cgagauuggaguacacugucaccaagggcaggcaaagaugcccucugggguugucugg

SEQ ID NO: 403187 - RNA, 64 nt, Human
auucagaacacaagaggagaaugagcuggagcgccagcaccacgauggccccaggacguuguuu

SEQ ID NO: 403188 - RNA, 64 nt, Human
uggguucagacuucacacugugaguucagacucccagcaccaacucacucugauucugguccau

SEQ ID NO: 403189 - RNA, 64 nt, Human
cuuccugaggccucccuggaagcugagcagaugccagcaccaugcuuccuguacauccugcaga

SEQ ID NO: 403190 - RNA, 64 nt, Human
agggaucuaaaugacaucagaacucuucagguaccagcaccaggaagacugaauauccuuuuua

SEQ ID NO: 403191 - RNA, 64 nt, Human
uucuaaauuagagacacauauaguuucucucuuucagcaccagcucuugccccuaugcugggua

SEQ ID NO: 403192 - RNA, 64 nt, Human
ggucacccgauucccgccaagccggaagucccugcagcaccaccuuuggcuaggagggaggggu

SEQ ID NO: 403193 - RNA, 64 nt, Human
ccuuuugugggcaaucacuaaaaaugaucacuaacagcaccaacaaagcaauaauaguaguagu

SEQ ID NO: 403194 - RNA, 64 nt, Human
aagucuguaaagcucagacauuugucagccucaacagcaccacccauucaagcauccuguggau

SEQ ID NO: 403195 - RNA, 64 nt, Human
cugucucuuuagcugccagagacauuuaugcccccagcaccaauuacugcuccaguuaugagcc

SEQ ID NO: 403196 - RNA, 64 nt, Human
uguucuauaccuaaaggaugaccugcuccagaaacagcaccagcacagcauguauuuucuucuc

SEQ ID NO: 403197 - RNA, 64 nt, Human
uuuuacaugucuaguaauucuugauguucaucuucagcaccaguggaaacacaugaacuucgau

SEQ ID NO: 403198 - RNA, 64 nt, Human
uuaccuaggcuguguuuccuaagcucugaguuuucagcaccaguagauuuguauuaaaagaaaa

SEQ ID NO: 403199 - RNA, 64 nt, Human
cccugggagcucauuccuggccaacacgcccuggcagcaccagcagcucuugccaccuccagcu

SEQ ID NO: 403200 - RNA, 64 nt, Human
gaggguuaaaugaaaauaaaaagaaaaugugaaacagcaccacagguacuugacaaugauguug

SEQ ID NO: 403201 - RNA, 64 nt, Human
guguccccucuccccacuucagaggccacccacucagcaccaccggccuggccuugccugcaga

SEQ ID NO: 403202 - RNA, 64 nt, Human
gagaggacaggccuggcaggggcccacuggugcccagcaccaaggcgagcuccgggcucagacc

SEQ ID NO: 403203 - RNA, 64 nt, Human
aacauauaaggugaaauucagaauuccguuuccuucuaacuaaugaaaaacugcuuacuaaaaa

SEQ ID NO: 403204 - RNA, 64 nt, Human
uccuuuggauaugugcuguuaacuggggaaggcaucuaacuaguagccugcuacuccauaguau

SEQ ID NO: 403205 - RNA, 58 nt, Human
gaguaacuuugauaaaguuuuucaugcacaggcaaaauguauucacuagauuucuacg

SEQ ID NO: 403206 - RNA, 58 nt, Human
gaaacccaggaguggauaacacuggcuucaggcaaagcuugaaucaggacucaaucua

SEQ ID NO: 403207 - RNA, 64 nt, Human
uuagugaguaccuagggcggcucaacuccucccacagcaccaacccagcauggucccacugaag

SEQ ID NO: 403208 - RNA, 64 nt, Human
guccuggugcccaggcccucacaaguaccaaagccagcaccaaaggagucagggaagggguugg

SEQ ID NO: 403209 - RNA, 64 nt, Human
gucugugcauuucugguugcaccgcggcgcuucccagcaccaacauguaaccggcauguuucca

SEQ ID NO: 403210 - RNA, 64 nt, Human
gguggagagacacccauguggcuccccuuagggccagcaccaagcaccacgcucucauccugca

SEQ ID NO: 403211 - RNA, 64 nt, Human
cauugaagauuuguuuugggacaacuggaagaaucagcaccauggauacucgcccgugggcagg

SEQ ID NO: 403212 - RNA, 64 nt, Human
ggcucccacaccucccucagguccccacucagaccagcaccagugucugccucugagaauguug

SEQ ID NO: 403213 - RNA, 64 nt, Human
cagggggcucguugcuguggcacccccucucugccagcaccaagagauuauuuaaugggcuauu

SEQ ID NO: 403214 - RNA, 64 nt, Human
agcauguucaccacuggucguucagcagccacgacagcaccaugugagauggcgagguggcugg

SEQ ID NO: 403215 - RNA, 64 nt, Human
cgacagcaccaugugagauggcgagguggcuggacagcaccagcagcgcaucccggcgggaacc

SEQ ID NO: 403216 - RNA, 64 nt, Human
cagaaacuuguauucucaggauucaggaucuacccagcaccaaagauguauuuucaggagaaca

SEQ ID NO: 403217 - RNA, 64 nt, Human
ccccagaggcuggaggaacaacugggcccuggaccagcaccacuuccgagguccccagaccccc

SEQ ID NO: 403218 - RNA, 64 nt, Human
ccugccccgcuagacugccccuccagcuugcacccagcaccaccugagucuaaccagcguauaa

SEQ ID NO: 403219 - RNA, 64 nt, Human
agccucaguuggagccaaagcuuuguccuuuagccagcaccaagauagcuauggaucuuaagag

SEQ ID NO: 403220 - RNA, 55 nt, Human
ucaagggcaucgacaucugaccucccagcaccagccagcagcaggacugagaaag

SEQ ID NO: 403221 - RNA, 64 nt, Human
uuacaugaaauagugccagcuggagguucuuugccagcaccaugccaagugaaauaauauauuu

SEQ ID NO: 403222 - RNA, 64 nt, Human
gauggacagacaggccauggaggcagcacugagccagcaccacacguccauccugggacagacg

SEQ ID NO: 403223 - RNA, 64 nt, Human
acaagcuuaaccaauuagaaaccaccaucuaaccucuaacuagguccuuucaacuuuaaccaag

SEQ ID NO: 403224 - RNA, 64 nt, Human
gaaacucggcauuuccuuuuuaaaaaagccuguuucuaacuaugaauaugagaacuucuaggaa

SEQ ID NO: 403225 - RNA, 64 nt, Human
guuuggggaaaaaguauaaugaguguacuaccaaucuaacuaagauuauuauagucugguuguu

SEQ ID NO: 403226 - RNA, 64 nt, Human
uuuuuguuucuccugacauccagacuuggaaauaucuaacuacuugcaaaacuaaaaaugaggc

SEQ ID NO: 403227 - RNA, 64 nt, Human
gccucccuuuguaaugcugcuccucuccacugcccagcaccaugaguugggugcagacaccuag

SEQ ID NO: 403228 - RNA, 64 nt, Human
cucuugggucagcccuccuugacugugucccagccagcaccaggccagcagccucaucccugcc

SEQ ID NO: 403229 - RNA, 64 nt, Human
uaaaaaauaaccccuccauccaggauauggaauccagcaccacagugcacaggucagggcucgg

SEQ ID NO: 403230 - RNA, 64 nt, Human
aguggaaaggaacaccaaggccauuucaauuuugcagcaccauccaagaaacuacuaccuauca

SEQ ID NO: 403231 - RNA, 64 nt, Human
ggcccgagagaccugauggccagggugggguguccagcaccagccaagcuggugcuccagcgca

SEQ ID NO: 403232 - RNA, 64 nt, Human
cuugagaaugcaggagcucugugagcuccaccgucagcaccauucagcugcaucccuugugcac

SEQ ID NO: 403233 - RNA, 64 nt, Human
gccugucugauccaagagcugagacacggccacccagcaccagucacuccucuguucaccuuaa

SEQ ID NO: 403234 - RNA, 64 nt, Human
uagugcugccucacauugggccucagcagcuccccagcaccaauucacaggucaccccucucuu

SEQ ID NO: 403235 - RNA, 64 nt, Human
aggucuucauugaguccaaaguguuugaugucaucagcaccauccaucaggacuggcuccccca

SEQ ID NO: 403236 - RNA, 64 nt, Human
cauaggugagaucaagaggccaccaguuguacuucagcaccaaugugucuuacuuuauagaaau

SEQ ID NO: 403237 - RNA, 64 nt, Human
cucacugccaccugggccaucaacugugaauucucagcaccaguugccuuuuaggaacguaaag

SEQ ID NO: 403238 - RNA, 64 nt, Human
caucgugaaaucuuuuauuuuuuuacucugagaccagcaccagauguaaguaagcaucucauau

SEQ ID NO: 403239 - RNA, 64 nt, Human
cugacuuauugaacuuuuacaaacuaacagucaccagcaccaaagaauuaagucaacuaaccug

SEQ ID NO: 403240 - RNA, 64 nt, Human
auggauguguuuagggacacagggcuuuugagagcagcaccaccccacuggggcauccccagac

SEQ ID NO: 403241 - RNA, 64 nt, Human
auacuggccaaggucaggaggagcaaaaaugagccagcaccagcgccuuggcuuuguguuagca

SEQ ID NO: 403242 - RNA, 64 nt, Human
ccuugucccucaaccugcucuggugccccacucucagcaccacagaaugauccggguucagguu

SEQ ID NO: 403243 - RNA, 64 nt, Human
cggaccuugagaggaaagccagcuccccuucuccucuaacuauuggaacgccagaaagucagag

SEQ ID NO: 403244 - RNA, 64 nt, Human
cuuuguaacuguuuaauucaaucuguaauaaaaaucuaacuaacuaacucauuuauuucuauua

SEQ ID NO: 403245 - RNA, 64 nt, Human
uguaggaggacccaguuuccccaugacagugccuucuaacuagccagagaauagguagcuuccc

SEQ ID NO: 403246 - RNA, 64 nt, Human
cacguguuaucauuauagauuuuauaguugccuuucuaacuacuuagcacaguuugagaauacg

SEQ ID NO: 403247 - RNA, 64 nt, Human
ucccaccucacaauccuuccgaaugugcuccaggcagcaccauuugccauccugcuucuaacgc

SEQ ID NO: 403248 - RNA, 64 nt, Human
agcugauaguaguuagaggcuuacaacuuaggagcagcaccaacugaaggugcuaauugcuugg

SEQ ID NO: 403249 - RNA, 64 nt, Human
cagauagccggagaggagccaagaucccuccagacagcaccagcucacagacgcucuuguugug

SEQ ID NO: 403250 - RNA, 64 nt, Human
aguucugguuccuacugggggcaacccuggugaccagcaccaucucuccuccuuuucacaguuc

SEQ ID NO: 403251 - RNA, 64 nt, Human
aaugaauuuuugaacugaagcuacugguacuccccagcaccaccucauacuaagaauuccucac

SEQ ID NO: 403252 - RNA, 64 nt, Human
gcaguaccccccuaccacacacaccccuguccuccagcaccauagagaggcgcuagagcccauu

SEQ ID NO: 403253 - RNA, 64 nt, Human
gagaagaagcccugagcugggggaaggggucaugcagcaccaggggauaugcccaacucacugc

SEQ ID NO: 403254 - RNA, 64 nt, Human
cagucugcuagaggcagaggaagaagggugaggacagcaccagacuuagccccaggaaggaucc

SEQ ID NO: 403255 - RNA, 64 nt, Human
acaaagaaggggaaaaacugacaacuaacaaaaccagcaccacaucgcuagguggugcuuacua

SEQ ID NO: 403256 - RNA, 64 nt, Human
gaacccaggaggcagagguugcagugagccaagacagcaccauugcaccccagccugagcaaca

SEQ ID NO: 403257 - RNA, 64 nt, Human
ucuguuccuuuggcuuucucuuggaggugggucgcagcaccagauggggagcuuuaugacauga

SEQ ID NO: 403258 - RNA, 64 nt, Human
ggcuugagucccacgugggggaggaggaggcaggcagcaccagcagggguccaccaagagccca

SEQ ID NO: 403259 - RNA, 64 nt, Human
ggucuuugggaggcaauaggccaccaugccuggucagcaccaauucaagccaugccaggaaucu

SEQ ID NO: 403260 - RNA, 64 nt, Human
uuguuauuaucacuuccugauucuuaagcuucaucagcaccagaacacuuaauucucuucaauu

SEQ ID NO: 403261 - RNA, 64 nt, Human
ugagacgcagccucccgccuggaagggccugugccagcaccaggcagagggcaagacggagagg

SEQ ID NO: 403262 - RNA, 64 nt, Human
uggcagcuguacuaucuaccaaccaugcugaggacagcaccaaagguuccucuccucaccccac

SEQ ID NO: 403263 - RNA, 58 nt, Human
gugccccuuuccugucccuaacaguccacaggcaaacaaaugguacagucauaagagc

SEQ ID NO: 403264 - RNA, 58 nt, Human
ccuacuacacuuugcuagugaaacugcccaggcaaagugcaccucaaaucuucuaauu

SEQ ID NO: 403265 - RNA, 58 nt, Human
gugaacucuaucaauagucucuuuuccgcaggcaaaguggcauuuucuaaacauguuu

SEQ ID NO: 403266 - RNA, 58 nt, Human
ccuucuaccugccgcaggguaggagggccaggcaaaguucaccagcuugcucuaagag

SEQ ID NO: 403267 - RNA, 64 nt, Human
uugucucuaacccauguggguagcccgaccaugacagcaccacgcuaacagugacccagagcca

SEQ ID NO: 403268 - RNA, 64 nt, Human
gugucacaagcaugaaaacccgugugucauugaucagcaccauuugugguauguuccgugauga

SEQ ID NO: 403269 - RNA, 64 nt, Human
aaaacuaccugacaguauuugacaguguccuuuccagcaccauuauuugggucuuucagggugg

SEQ ID NO: 403270 - RNA, 64 nt, Human
ccacccccgucuugccugggucggggccugcggccagcaccauuucacacacacuccuuguaga

SEQ ID NO: 403271 - RNA, 64 nt, Human
guguccugcagggaguggccaacucuccaccuuccagcaccauuaucagagggugggaaaaggc

SEQ ID NO: 403272 - RNA, 64 nt, Human
uaaaacaauguuuuauguaaaaaguguuuaucuucagcaccaaauacaugauaaauguaucaau

SEQ ID NO: 403273 - RNA, 64 nt, Human
uggaauccuuucaaaugacgagcugcagagaacucagcaccaagggcugccuaucuguagauag

SEQ ID NO: 403274 - RNA, 64 nt, Human
agggucccauggccugcucccucaggaacagcuccagcaccaauaaagaggcaucuuaccaccc

SEQ ID NO: 403275 - RNA, 64 nt, Human
acccuagggcauucguguccuauuuaucaaucuucagcaccaccucuaagaucucugagagagg

SEQ ID NO: 403276 - RNA, 64 nt, Human
ccgcgaccacgggaaccagcggugaggccugacccagcaccacguucuucuugcuuugcuuuuu

SEQ ID NO: 403277 - RNA, 64 nt, Human
ucuaacaaaauaagguuauaugaguagauacucucagcaccaagagcagcugggaacugacaua

SEQ ID NO: 403278 - RNA, 64 nt, Human
agaagagcccgagaaauugggucaguucccucaucagcaccagaggcucagcugaggcaagaag

SEQ ID NO: 403279 - RNA, 64 nt, Human
ccucacgucucuguggccacccgggugucacugccagcaccaggcacugcuuucacguaaaaug

SEQ ID NO: 403280 - RNA, 64 nt, Human
cuaucaauccucacugcugaguggcagggagaagcagcaccacucucagcucuuuucuaaucuu

SEQ ID NO: 403281 - RNA, 64 nt, Human
cacagcccagcauuggguuucccucccaaggccccagcaccaaccucugagcccaagaccuugc

SEQ ID NO: 403282 - RNA, 64 nt, Human
aagaggcuguguuuugucacacagggcagucauucagcaccagagcacgugauggucugagacu

SEQ ID NO: 403283 - RNA, 64 nt, Human
gucauacauguggguauaaaguacauaaaauauaucuaacuauucauaaugugggguggguaau

SEQ ID NO: 403284 - RNA, 64 nt, Human
uugucacuggaaguacugucaaagacuuugggggucuaacuaaaauggccaaaguuccaacuuc

SEQ ID NO: 403285 - RNA, 64 nt, Human
aucagcauccagucacggugcacacauugcauuuucuaacuauguuuuuaaaaccucuuugaau

SEQ ID NO: 403286 - RNA, 64 nt, Human
ggagaaaaggggcauuagguauuaauugcaugggucuaacuacauugaugaugagaguuuaauu

SEQ ID NO: 403287 - RNA, 64 nt, Human
cccugcagccacucccagcacacccgcacacagccagcaccaccgcccccaccgugcacuucuc

SEQ ID NO: 403288 - RNA, 64 nt, Human
uuuuucccccuugagauaauggauauuugcuaugcagcaccaugaagaagagagacuaucgauc

SEQ ID NO: 403289 - RNA, 64 nt, Human
ccucagacaacagccucuacaccaacgccaagggcagcaccaucucugccuucgaugggggcuc

SEQ ID NO: 403290 - RNA, 64 nt, Human
gcugggacgugccuggccuaaggcauccuaccaacagcaccaucaaggcacguuggagcuuucu

SEQ ID NO: 403291 - RNA, 64 nt, Human
ggagagagccgggagagagccgcagcuccguccacagcaccacggagaggacagcgccucuugg

SEQ ID NO: 403292 - RNA, 64 nt, Human
gggacugccuugucucuaguaguguggccugugccagcaccacagccggucagaggagcgcagg

SEQ ID NO: 403293 - RNA, 64 nt, Human
ugcuugcgaccugcugagggcuugucugcucccacagcaccaucuaagaccccuccucuagaag

SEQ ID NO: 403294 - RNA, 64 nt, Human
gagcuuuguggacaaagaugagaaggcccgucugcagcaccaggucacugaggauggagaguuc

SEQ ID NO: 403295 - RNA, 64 nt, Human
ugcaacgugacaaaaaaaauuguguaguauuuaccagcaccauucaguaauacagccuuaacca

SEQ ID NO: 403296 - RNA, 64 nt, Human
ucuggucuugcuaagucuugaucuugcuuccugccagcaccaaacauuacauucaggggauuuc

SEQ ID NO: 403297 - RNA, 64 nt, Human
aggcccuugucgugggauggcauuuggucucaggcagcaccacacugggugcgucuccagucau

SEQ ID NO: 403298 - RNA, 64 nt, Human
gaaugagaacuggaagccacugcuaccgucuacccagcaccaguagugccgaugugccacacug

SEQ ID NO: 403299 - RNA, 64 nt, Human
ggaugaggagcagcagcccagggcuugucuggaucagcaccaacgauuuuaaagaaaaaaggaa

SEQ ID NO: 403300 - RNA, 64 nt, Human
gcggcccucggaagucuggucgcaguggcaaagccagcaccauggccagcagagcggugagcag

SEQ ID NO: 403301 - RNA, 64 nt, Human
caugaaaguucagccaaugcccagagugaccaagcagcaccagcaggccugcccaggaugcuga

SEQ ID NO: 403302 - RNA, 64 nt, Human
agagagccaaaauguguggcccuguccccaagcucagcaccaccggccaugaccagagguugcu

SEQ ID NO: 403303 - RNA, 64 nt, Human
uaucccgcuguaauucccaaaacucucauuauucucuaacuauuacacaugggcauauucugau

SEQ ID NO: 403304 - RNA, 64 nt, Human
uuucuaucuuaaauuugucaaaauaaaguaugagucuaacuauuaaaggauacauuguuagaaa

SEQ ID NO: 403305 - RNA, 64 nt, Human
uagacauucauaguagauuuuaauuaguuagcuuucuaacuagucagauuucugcccaaagugc

SEQ ID NO: 403306 - RNA, 64 nt, Human
uuuauuugccuuaauauaagcuuuuaagcaguuaucuaacuaguguccacaacccuguaaccau

SEQ ID NO: 403307 - RNA, 64 nt, Human
gacuccaugugcuugggcagcuugagaaggcguucagcaccacgccuagcaggcagaccuugaa

SEQ ID NO: 403308 - RNA, 64 nt, Human
gcuggagggacacucaccccaucugcucccacggcagcaccaucaacucaacaagucagaagcc

SEQ ID NO: 403309 - RNA, 64 nt, Human
aagguagggccaauuaaggauucuaacccuaacccagcaccacaaagccccccuggagcaucuu

SEQ ID NO: 403310 - RNA, 64 nt, Human
acagguggucugguggauagcggggagcauggcucagcaccagagcagaggcccagccagcccu

SEQ ID NO: 403311 - RNA, 64 nt, Human
cagcuggccaccauggcacccugcaccaggccaucagcaccacgugccaaggagcucagcgguc

SEQ ID NO: 403312 - RNA, 64 nt, Human
agggucccaaccgccugcuguacaaagacggcuucagcaccauccugcaccugcugcuggguuc

SEQ ID NO: 403313 - RNA, 64 nt, Human
gcccuucccccggguggaacccagcccucaggaccagcaccagccaagggaaugccaccucuuc

SEQ ID NO: 403314 - RNA, 64 nt, Human
gucuuugaugguggugagggugggugauggugcccagcaccaacaguuuuaguggccuguccuu

SEQ ID NO: 403315 - RNA, 64 nt, Human
guuauuucugcagauccagcucguggaccagcugcagcaccagagaaaagaguagcagagaugg

SEQ ID NO: 403316 - RNA, 64 nt, Human
gggcucccuucugugcagacuuuuggacccagcucagcaccagcacccgggcguccugagcacu

SEQ ID NO: 403317 - RNA, 64 nt, Human
gccuuuccgucugauggacagcagaccccgccuccagcaccaagcagugucccuacacucaauu

SEQ ID NO: 403318 - RNA, 64 nt, Human
ucuaguguucugucucccagucaccucgcucucccagcaccagugcccuucuccugcucccaga

SEQ ID NO: 403319 - RNA, 64 nt, Human
gcuggggacuggggaaggggaggguguucagaggcagcaccaccacacagucaccccucccucc

SEQ ID NO: 403320 - RNA, 64 nt, Human
gcccccuuaucugcccccgccccacgcgcccuggcagcaccaugagccgccagcuucugccugu

SEQ ID NO: 403321 - RNA, 64 nt, Human
cgcugugggugggaggaggcagcgcccaucucagcagcaccaggacugccugggacucccuggc

SEQ ID NO: 403322 - RNA, 64 nt, Human
uggcuuuauucuugggcuucacaguguggccccacagcaccaguuauugauaaaaagagcuccc

SEQ ID NO: 403323 - RNA, 58 nt, Human
cuggucagucuccagcuaaccucucaaucaggcaaacauucuucuuggaggaaucagg

SEQ ID NO: 403324 - RNA, 58 nt, Human
aucaggcaaacauucuucuuggaggaaucaggcaaacaucucaaaaauucucuuucca

SEQ ID NO: 403325 - RNA, 58 nt, Human
acgucuuagguggcagggcuguucccuccaggcaaaugcccuucaaaccgacgaucau

SEQ ID NO: 403326 - RNA, 58 nt, Human
acaaccauuuccuacacaguuugcaccccaggcaaagcagagagcagagguucuucag

SEQ ID NO: 403327 - RNA, 64 nt, Human
acuuggagcagggaagugggcacccugaggccuccagcaccaguuccgucauucucguuccugg

SEQ ID NO: 403328 - RNA, 64 nt, Human
aaaugcaaagcacccaaaccacuaacacauccaacagcaccaacaaaucucagguguguggaac

SEQ ID NO: 403329 - RNA, 64 nt, Human
aggagggaagggugggguggaacugggcacaugccagcaccacuucuagcuuccuucgcuaucc

SEQ ID NO: 403330 - RNA, 64 nt, Human
cugggccccugguucacugcagacaguggcaccccagcaccagagcacaaugagaaacggcagc

SEQ ID NO: 403331 - RNA, 55 nt, Human
ucuuugcugucaggcagugaauuuccagcaccaggggagaaggggcgucuucagg

SEQ ID NO: 403332 - RNA, 64 nt, Human
auguccuccuuucuccuuugugcccagccugagucagcaccaaucccgcauucagaaccuccca

SEQ ID NO: 403333 - RNA, 64 nt, Human
aucugaaaagccagauaugccuguuuccuuuucccagcaccaugccuguggaggggacagucag

SEQ ID NO: 403334 - RNA, 64 nt, Human
gccccucagcagggaugacucagcagggaugacucagcaccaccccucaacagggaugacucag

SEQ ID NO: 403335 - RNA, 64 nt, Human
ccgucuuggcccagguccugggggcugcugaacccagcaccaguguccccuugugcccaggggg

SEQ ID NO: 403336 - RNA, 64 nt, Human
cuugggggcuggccccccaccaggccuucuagagcagcaccagucucagggcccugggaccagc

SEQ ID NO: 403337 - RNA, 63 nt, Human
cucuccugauccagagcugaggggcuagggucccagcaccacuucccccuucuccacccucua

SEQ ID NO: 403338 - RNA, 64 nt, Human
uggcccuggguggggauaguuuacacccgggcagcagcaccacacaugaacccaaagacauguu

SEQ ID NO: 403339 - RNA, 64 nt, Human
gaugugcggcccccaggcccccgcacaccucccucagcaccaagaccgggacccccccacccac

SEQ ID NO: 403340 - RNA, 64 nt, Human
ugcaagagacuccaauaauccauauugaaagagucagcaccagcagaggcuacucgacuuagga

SEQ ID NO: 403341 - RNA, 64 nt, Human
gaaggcuacuugagccggacaccaagcccgccuccagcaccaagggcgggcagcacccuccgac

SEQ ID NO: 403342 - RNA, 64 nt, Human
gaccgggacuggagccagggucuggggagagcaacagcaccaggcuuuuccugguaguuggauu

SEQ ID NO: 403343 - RNA, 64 nt, Human
acauuguggccaccauguggcuuaaaugauuuuuucuaacuaauaaaguggaauauauauuucu

SEQ ID NO: 403344 - RNA, 64 nt, Human
ggaaucauugcaauguauauucuaaauaaagucaucuaacuauuaaaaaaaaaacacccuuccu

SEQ ID NO: 403345 - RNA, 64 nt, Human
uggauaagcacucugugaauuuuuacagcaagauucuaacuaacuaugaaugacuuugaaacua

SEQ ID NO: 403346 - RNA, 64 nt, Human
cgcgaacauugacuccuuacgaaagucacuucauucuaacuagaugcgcccacuuccggucauu

SEQ ID NO: 403347 - RNA, 64 nt, Human
aaguauccagacccaaccuguuagcuacccucaccagcaccaaaucuucccuucucagacagca

SEQ ID NO: 403348 - RNA, 64 nt, Human
agaccuggucggggcccacuggaagcauccagaacagcaccaccaucuagcggccgcucgaggg

SEQ ID NO: 403349 - RNA, 64 nt, Human
ggaaaugggagaaaauaaugugacauuucaaaaacagcaccaaagcagucagcauuggaaggaa

SEQ ID NO: 403350 - RNA, 64 nt, Human
ugauguuucagugugcaaaaacuauagagccugucagcaccaaagcugacagaaguuauaccuu

SEQ ID NO: 403351 - RNA, 64 nt, Human
gcagcuucuuugugaggccaggccuucugacugucagcaccaccggcacagggcagagaugcgg

SEQ ID NO: 403352 - RNA, 64 nt, Human
aucaaaugacaaaucuuuauugaaugguuuugcucagcaccaccuuuuaauauauuggcaguac

SEQ ID NO: 403353 - RNA, 64 nt, Human
agguuuguuuagaagaagugugucacccuuaggccagcaccaucucuuuaccuccuaauuccac

SEQ ID NO: 403354 - RNA, 64 nt, Human
aaguucuuuuuuagcuguaccuacguacuuauaucagcaccauguauguaggugugauaguacu

SEQ ID NO: 403355 - RNA, 64 nt, Human
cggugcggauguuugaccuccgccaucuagaacacagcaccaucauuuacgaagacccacagca

SEQ ID NO: 403356 - RNA, 64 nt, Human
uguguguuaucucugccccacagcagccccugggcagcaccaguggccacugggcuccccccgg

SEQ ID NO: 403357 - RNA, 63 nt, Human
ucagcggggagucccuguaggcucugccaucaucagcaccaggagagccgaccccucccggga

SEQ ID NO: 403358 - RNA, 64 nt, Human
ggucccgcccucccguggucacuggcuccgcccccagcaccaggcgcccaguggagccguuugg

SEQ ID NO: 403359 - RNA, 64 nt, Human
cacguccagugccacaguccccaguagccucaagcagcaccaauggggaugacccugacaggug

SEQ ID NO: 403360 - RNA, 64 nt, Human
gcagagcaaggguauaaagggggaaauuguuuggcagcaccaacagaaaacaaacaaacaaaaa

SEQ ID NO: 403361 - RNA, 64 nt, Human
aggauugagggagccaggggaggggcaggagucccagcaccaucgguucauagugugcuugugu

SEQ ID NO: 403362 - RNA, 64 nt, Human
cucugccucccaaguagcugggaccacaggugggcagcaccacaccuggcuaauuuuuuaaauu

SEQ ID NO: 403363 - RNA, 64 nt, Human
agaaugucaaaucagaugaaguuauaguuaggauucuaacuacuguaaaagauuuuugcuuccc

SEQ ID NO: 403364 - RNA, 64 nt, Human
acucuuuccuguuuugguuuggagaguaguucucucuaacuagagacaggaguggccuugaaau

SEQ ID NO: 403365 - RNA, 64 nt, Human
aaaacugguacaacaggucucuacaacgccaagaucuaacuaagcuuuaaaaggucaagaaguu

SEQ ID NO: 403366 - RNA, 64 nt, Human
cauggaagaacucuugaauguguuggccauuuucucuaacuaacaugugguauguauggucccc

SEQ ID NO: 403367 - RNA, 64 nt, Human
uccuccucuucuuccuguccaugccggccccucccagcaccagcucugcucaggccccuucagc

SEQ ID NO: 403368 - RNA, 64 nt, Human
cuccagcccuggcugcaaugucucuaccacaucccagcaccagggggagcaaacccugccccug

SEQ ID NO: 403369 - RNA, 64 nt, Human
cugcccuugguguggacacacccucucaugcuaccagcaccauaauccagugggggugacuggg

SEQ ID NO: 403370 - RNA, 64 nt, Human
aggaaugugacucccugggcccccagauggcgagcagcaccaccuccaagccgucaucaucauc

SEQ ID NO: 403371 - RNA, 64 nt, Human
gucccucuacuacaggcaguggaccuuggcccggcagcaccacgcugacuauagcaaccagcug

SEQ ID NO: 403372 - RNA, 64 nt, Human
uaauuuccugaaagccauaggacaugucuguagucagcaccacgauagcaccguuucaugaaag

SEQ ID NO: 403373 - RNA, 64 nt, Human
ggcaacgugugaacugcaacaacgccuggugccccagcaccaaccuuccaaguguaaaaacaau

SEQ ID NO: 403374 - RNA, 64 nt, Human
agcugcguaccucccgcugcuucuccuugugguccagcaccaccugcuggucaguggcagaacu

SEQ ID NO: 403375 - RNA, 64 nt, Human
acaagaggcugguuuuuaauaacgaaugcagccacagcaccagaccaggggcuauuuuugugac

SEQ ID NO: 403376 - RNA, 64 nt, Human
cccuggaacaccucucccaggcaagacauuuucacagcaccauucacaacgguugggccaaaaa

SEQ ID NO: 403377 - RNA, 64 nt, Human
acuacgggagcuaggggcccgccccgcggacugacagcaccaggaaaccaaaugaugucccugc

SEQ ID NO: 403378 - RNA, 64 nt, Human
cuucggccccucccgggagauccgugcgcccgaccagcaccagcaucgcggaccgcaaaggccg

SEQ ID NO: 403379 - RNA, 64 nt, Human
acaugguccuccugaaguuggggcacccuccucucagcaccaaaauggcccccacuccuucgug

SEQ ID NO: 403380 - RNA, 64 nt, Human
agaggcgugaccaaggccacagagcuaugggugucagcaccaggauuugaagccaggugaaucc

SEQ ID NO: 403381 - RNA, 64 nt, Human
gcagccaacaccccggccucggggcuccugguggcagcaccaggggacacaccugccaaaccca

SEQ ID NO: 403382 - RNA, 64 nt, Human
auaacccccuuccucacuggccaccaccugacaucagcaccagugacaggcuggucagagggcg

SEQ ID NO: 403383 - RNA, 64 nt, Human
acaagcuugugaauauguaaauuuuaaacuauuaucuaacuaaguguacugaauugucguuugc

SEQ ID NO: 403384 - RNA, 64 nt, Human
ccuuuggcuuucaauuccaaaacaugauuuaauuucuaacuaaauuaguauggcacuaguuaug

SEQ ID NO: 403385 - RNA, 64 nt, Human
uagaacugucccacaaaauauuucuaagcuuauuucuaacuauuaggaggaaugugcuuuucca

SEQ ID NO: 403386 - RNA, 64 nt, Human
agcagucagucucaagagguuacugcacuucaguucuaacuagacauuuguacuaagguauuuc

SEQ ID NO: 403387 - RNA, 64 nt, Human
cuccaccccaaauuaacagaauauacauuuuuuucagcaccacaccacaccuauuccaaaauug

SEQ ID NO: 403388 - RNA, 64 nt, Human
cuucacugaaacugaaugcucacugcuguguugccagcaccacccagcccagggcugugaacgg

SEQ ID NO: 403389 - RNA, 64 nt, Human
uccucaccccuuccccuacacuugaucauuaaaacagcaccaaacuucacaugauugguucuug

SEQ ID NO: 403390 - RNA, 64 nt, Human
ccucuguguuuccagccaucucgcccugccagcccagcaccacugggaaucauggugaagcuga

SEQ ID NO: 403391 - RNA, 64 nt, Human
cugugcccguccucggccccccacccugaagugccagcaccaccagcaccagauccuccgccgc

SEQ ID NO: 403392 - RNA, 64 nt, Human
uccucggccccccacccugaagugccagcaccaccagcaccagauccuccgccgccacaccgca

SEQ ID NO: 403393 - RNA, 64 nt, Human
uggaagagucuuuaaccaaaauucucaucucauucagcaccagaaaguucacaccagauaaaga

SEQ ID NO: 403394 - RNA, 64 nt, Human
auuacacccccguggggggacagccgaugggagccagcaccagcaggauccgagggcgccccgg

SEQ ID NO: 403395 - RNA, 64 nt, Human
cagcgccugccgccccggggacucgcagcacccacagcaccacguccucgaauucucagacgac

SEQ ID NO: 403396 - RNA, 64 nt, Human
agagggucuggucuggugagcuccugaggccacacagcaccauaaagucucgcaucuacaggcc

SEQ ID NO: 403397 - RNA, 64 nt, Human
gcaagagcauggaaaugugaguggggaaaauuuucagcaccaaagcuucacucauacccaguuu

SEQ ID NO: 403398 - RNA, 64 nt, Human
ggacaugcagcugcugugggagaaggcaguccaacagcaccagcacggcuaugacagugaugag

SEQ ID NO: 403399 - RNA, 64 nt, Human
cugacugacuggcaggacaaggucuggcauggcacagcaccacugccaggccuccccaggcaca

SEQ ID NO: 403400 - RNA, 64 nt, Human
aaugugcuuccaugagacuggcuugagaagucuucagcaccaaguuccugaaagcuuuucugug

SEQ ID NO: 403401 - RNA, 64 nt, Human
uuuuucacugcugggguugugauagaagccaugucagcaccacacacugcagcucuccaaagag

SEQ ID NO: 403402 - RNA, 64 nt, Human
cccacgaggacggaccacuguacuacccgacugucagcaccaucagccugggcucccacaccgu

SEQ ID NO: 403403 - RNA, 64 nt, Human
auguauggaaaccuuaaaaaguaaacuuauuuuuucuaacuagaaggcucucauaaguuucugu

SEQ ID NO: 403404 - RNA, 64 nt, Human
guagcuuuucaaagcuuuaaauuuguagaacucaucuaacuaaaguaaauucugcugugacuaa

SEQ ID NO: 403405 - RNA, 58 nt, Human
guggaaagcgguuuggaugaaaagauuucaggcaaagacuugcaggaagaugaugaua

SEQ ID NO: 403406 - RNA, 58 nt, Human
ugacugucagcuacauguugguaagacacaggcaaaguauuacuguaacuaaguuauu

SEQ ID NO: 403407 - RNA, 64 nt, Human
gacucaaggacucccaugcccaccugagcccugacagcaccaaggugaaucccacuacccuccc

SEQ ID NO: 403408 - RNA, 64 nt, Human
gauuggucuauucaccaucccccugcuguaccggcagcaccaggcucagaucgaccaauaugug

SEQ ID NO: 403409 - RNA, 64 nt, Human
ugaccucuggucguccucacugcuacacuccugacagcaccaugacaguuuacaaaugccaugg

SEQ ID NO: 403410 - RNA, 64 nt, Human
cuuccugaggcuucccuagagggugaucagaugccagcaccauguuuucauuuaagccuucaga

SEQ ID NO: 403411 - RNA, 64 nt, Human
gucuagaacuaaucagauuacugauuuuagggcacagcaccagaugaauuguuguauaugcuug

SEQ ID NO: 403412 - RNA, 64 nt, Human
ggaauguuucacugcuacccgcauccagcgacugcagcaccagaaaacgacuaauguaacuaug

SEQ ID NO: 403413 - RNA, 64 nt, Human
agggggugcccaggugguggcugcaagguggcuccagcaccauccgccagggcccacacccccu

SEQ ID NO: 403414 - RNA, 64 nt, Human
ugagccccggacucugcuuacccugauggcugcucagcaccacagagugcuugggcugagggac

SEQ ID NO: 403415 - RNA, 64 nt, Human
aucagccagacaugucuagggugagaccagugcucagcaccacccgccaaggaacacugaugag

SEQ ID NO: 403416 - RNA, 64 nt, Human
uaggcaccgcauucugaucuggacaaagucgggacagcaccaucccagccccgaagccagggcc

SEQ ID NO: 403417 - RNA, 64 nt, Human
cugacaucgccagccgacgcccugaaucuuggugcagcaccaaccgcgugccuguguggcggga

SEQ ID NO: 403418 - RNA, 64 nt, Human
auuacuaagggggucaggcacugcaugcucguuccagcaccaucugggacuggguacaguaccu

SEQ ID NO: 403419 - RNA, 64 nt, Human
ggaggacuauuuuccuguggacgccggggaagcacagcaccacccccgcaccugcccucggccu

SEQ ID NO: 403420 - RNA, 64 nt, Human
accuauuucugacaugcagcacugccaucucuuccagcaccaucaggguuuuaauggcccucua

SEQ ID NO: 403421 - RNA, 64 nt, Human
aggugagagagaugcaucugcacguuuucuucaacagcaccaggugauucagcauauuccuaau

SEQ ID NO: 403422 - RNA, 64 nt, Human
acacccugugcaccagcugcacuggcuucccccucagcaccaggguaccaggugagccagaggc

SEQ ID NO: 403423 - RNA, 64 nt, Human
agaaacaugccagaaggaaucuucucaucuuuuaucuaacuauauguacagcucuccccucccu

SEQ ID NO: 403424 - RNA, 64 nt, Human
uauuacacagggaaagcuaugacugcaggaucagucuaacuauacuauuaggugcauguauucu

SEQ ID NO: 403425 - RNA, 64 nt, Human
uaccuuuguauguaugagacacauuccaaagagcucuaacuaugauagguccugauuacuaaag

SEQ ID NO: 403426 - RNA, 64 nt, Human
ugcaguguuguuucuguucaucaggguuaauauuucuaacuauauugcuuguaggugaccccau

SEQ ID NO: 403427 - RNA, 64 nt, Human
gauuuggugagaaaucguugcugcacccuucccccagcaccauuuaugagucucaaguuuuauu

SEQ ID NO: 403428 - RNA, 64 nt, Human
cacuggaccuagcugugcccccaaccuagauuggcagcaccaccccagggcagaggacucucug

SEQ ID NO: 403429 - RNA, 64 nt, Human
uuuuauagcaagucuccuuccuccauagggacagcagcaccagcccuguggggcauggagugga

SEQ ID NO: 403430 - RNA, 64 nt, Human
accccaugccaaagcuaggguggcccuugcaguucagcaccacccuagucccuuccccucccug

SEQ ID NO: 403431 - RNA, 64 nt, Human
guauguaaggccuugagaggacccugcaggcagucagcaccagccucagcaacugugcagagac

SEQ ID NO: 403432 - RNA, 64 nt, Human
caggguucacugcugguuuacacuucaccugugucagcaccaucuucaggugcuuagaauggcc

SEQ ID NO: 403433 - RNA, 64 nt, Human
cacaggcagggguaugagugcgucccacccaacgcagcaccagccccggccaccgcuccccgug

SEQ ID NO: 403434 - RNA, 64 nt, Human
uccauucaaaaugugguucacagacccgccacaucagcaccauccgagagcuuauuaguaaugu

SEQ ID NO: 403435 - RNA, 64 nt, Human
gcccuugggcaggcuggggugacggcagaggccacagcaccagcucugacaaguccuaucaucc

SEQ ID NO: 403436 - RNA, 64 nt, Human
aauuuauuuuauuucuaaagguauucaaauguuucagcaccauauaauagaaauacccaauuau

SEQ ID NO: 403437 - RNA, 64 nt, Human
ugaugggcugucucuacccggagcgugcgggauucagcaccaggcucuucccaguaccccagac

SEQ ID NO: 403438 - RNA, 64 nt, Human
uugaauuauaaaugugguguuuggccugccucagcagcaccaguugacugcucgugugccagcg

SEQ ID NO: 403439 - RNA, 64 nt, Human
ggcggcugcugacugugggguguggauggggcugcagcaccaggcagagccccucagggcgccg

SEQ ID NO: 403440 - RNA, 64 nt, Human
gggccacagcccccagcugacccuaauuuauucucagcaccacccccucccaggucauuguguc

SEQ ID NO: 403441 - RNA, 64 nt, Human
gugcaccuucccugcuggccugcacacagcugcucagcaccacuuucauucuggaccugggacc

SEQ ID NO: 403442 - RNA, 64 nt, Human
ucaugcugugaggccuugcaccaggugggggccacagcaccagcagcaucuuugcugggcaggg

SEQ ID NO: 403443 - RNA, 64 nt, Human
gagaucugaggaggcuucgugggcuuuuggguccucuaacuaggacucccucauuccuagaaau

SEQ ID NO: 403444 - RNA, 64 nt, Human
cucguggcuugccuuggucucuugggaauacuuuucuaacuaggguugcucucaccugagacau

SEQ ID NO: 403445 - RNA, 64 nt, Human
cacaguauuuagaacacaauauuagaaacacaauucuaacuaaagauaaauaaggagaaaacau

SEQ ID NO: 403446 - RNA, 64 nt, Human
ggguuuaauguuauagaaauaaaugaugauaaacucuaacuaauaaaggaaagagaauauuugg

SEQ ID NO: 403447 - RNA, 64 nt, Human
cauuccuauuaccuccccaggaggcaagugggcgcagcaccagggaaauguaucuccacagguu

SEQ ID NO: 403448 - RNA, 53 nt, Human
ccagcaagcuccaagacugagcccagcaccaccccugggcagcagcauccucc

SEQ ID NO: 403449 - RNA, 64 nt, Human
ccccugggggacagcugccagacacagcuggcggcagcaccagaugcuaagcgcuucagagagg

SEQ ID NO: 403450 - RNA, 64 nt, Human
agcaucuccagcaggacuccaggaugguucagcccagcaccauccaaagggugggagcacaucu

SEQ ID NO: 403451 - RNA, 64 nt, Human
aguaccucccagcagggugaagaguccaagaagccagcaccaccccauccgcaucucaaguaag

SEQ ID NO: 403452 - RNA, 64 nt, Human
ucagccuuccaaagggaacaggaacaaauuuccccagcaccacuguuugggucccgcuuuuccu

SEQ ID NO: 403453 - RNA, 64 nt, Human
cucccccggcaggcaauguccuggcuucucagcccagcaccaucuguuccccuagacuucucag

SEQ ID NO: 403454 - RNA, 64 nt, Human
ccagggccuccuccacagccucagcuggggcucucagcaccaaagaacgaggggcccaggucuu

SEQ ID NO: 403455 - RNA, 64 nt, Human
agccaucuugcaggugaggggggugugagcgccgcagcaccaguggcuuuagggccugucgcuu

SEQ ID NO: 403456 - RNA, 64 nt, Human
cccacauucuaggcccgugauacagggaugaggucagcaccagcaaacucuggacugguggaag

SEQ ID NO: 403457 - RNA, 64 nt, Human
ugaauucagaucuaaucauuuuuaugacaaauugcagcaccaaacaaacuaauagcaacccaug

SEQ ID NO: 403458 - RNA, 64 nt, Human
uugacugcuucauccagggagggagaaggcuuuucagcaccaucuaauguuuuaaaaggcacua

SEQ ID NO: 403459 - RNA, 64 nt, Human
caagcuuaagccaugaagucauggauuuguggcucagcaccagguccugaggggagcguauccu

SEQ ID NO: 403460 - RNA, 64 nt, Human
aacaaccagaucucgugagaagcuacucccuccgcagcaccaagcgggggauggugcucaacca

SEQ ID NO: 403461 - RNA, 64 nt, Human
ggcugaguaaauaaacauguucugucacaaauagcagcaccacuuuggauugauuuugcucucc

SEQ ID NO: 403462 - RNA, 64 nt, Human
uuucccagguguuaaaaaaaaaauccauuuuacacagcaccacagugaauccagaccaaccuuc

SEQ ID NO: 403463 - RNA, 64 nt, Human
gcgccccgcgcgcgccccgaaaggucaccucacucagcaccacucaagaccaaauggaaacaga

SEQ ID NO: 403464 - RNA, 64 nt, Human
uucaauuaugaaagugaaaugcaaaugucuguuaucuaacuacaaauugucagauuucuuaaaa

SEQ ID NO: 403465 - RNA, 64 nt, Human
uuaugaaaucaguggguauuuugaauguguucuuucuaacuacaugcaucucuccacucaacuc

SEQ ID NO: 403466 - RNA, 64 nt, Human
gcuucaauuaauaaaaaauggaaagaaucuaauagagugguacagcacuguuauuuuucaaaga

SEQ ID NO: 403467 - RNA, 64 nt, Human
cugcccugugcccacucccuucucuacucuuccccagcaccaugccaaaaggucuuaucugaaa

SEQ ID NO: 403468 - RNA, 64 nt, Human
caauauccucgcucccgggacucacuggcagccccagcaccaccaggucucccgggaagccacc

SEQ ID NO: 403469 - RNA, 64 nt, Human
caaagacucccauuugagacuuuccggacauacgcagcaccauacaauauuucacaagcaaugg

SEQ ID NO: 403470 - RNA, 64 nt, Human
ucuucacuccugauugaggcccggguuuguuguccagcaccaauucuggcugucaauggggaga

SEQ ID NO: 403471 - RNA, 64 nt, Human
ucaccuugguucccuaucaguagagcuaguaaggcagcaccaaucucuaaauauagaagaaauu

SEQ ID NO: 403472 - RNA, 64 nt, Human
acccacuuggagccccugcaaggagcgaaccggucagcaccaaguaacaccacacacacgcagc

SEQ ID NO: 403473 - RNA, 64 nt, Human
ugccgaaauucaagagccagcucugauagaaagccagcaccagccucgggagcugcugagccac

SEQ ID NO: 403474 - RNA, 64 nt, Human
ugcugguucaaguucccagccagccaauggaugccagcaccauuuuuacuccccuuucccaagc

SEQ ID NO: 403475 - RNA, 64 nt, Human
cuaugacucuugucuccuccuccaggaggacuguucuaacuaguaaucuuggcccuauucauua

SEQ ID NO: 403476 - RNA, 64 nt, Human
ucuaauuacauuucacuucaaggcucaaugcuauucuaacuaaugacaaguauuuucuacuaaa

SEQ ID NO: 403477 - RNA, 64 nt, Human
aacgcacuuuauaaaagcaaaagcucuguguaaaucuaacuacaaggacaaugccuugggagag

SEQ ID NO: 403478 - RNA, 64 nt, Human
aaugauaacugggaaauguuuuucuuccucuuuaucuaacuauauuacacuuauccaucagguu

SEQ ID NO: 403479 - RNA, 64 nt, Human
auucagugcuguggccugggcaagauaacgcacuucuaacuagaaaucugccaauuuuuuaaaa

SEQ ID NO: 403480 - RNA, 64 nt, Human
gggcagguaucaacauuggggaagagauuucaugucuaacuaacuaacuuuauacaugauuuuu

SEQ ID NO: 403481 - RNA, 64 nt, Human
auuccccuuggaaauuccuuaauguuuauuagcuucuaacuaguguuguaaguccgaugccaga

SEQ ID NO: 403482 - RNA, 64 nt, Human
cuaauguggggugcuauguaaauuagcaaagcagucuaacuagaauggauuuuacugaaccagu

SEQ ID NO: 403483 - RNA, 64 nt, Human
cuucccuacauuacacacacucagguugagucauucuaacuauaaaagugcaaugacuaagauc

SEQ ID NO: 403484 - RNA, 64 nt, Human
ucagaaaguguauccgcuacaauaaaguucugguucuaacuaacuccagccggagcgggguuug

SEQ ID NO: 403485 - RNA, 64 nt, Human
caguugcaccacuucuagaugugccuuuaaaagaucuaacuaugggaugggagaacuugagggu

SEQ ID NO: 403486 - RNA, 64 nt, Human
cccggcugggacggucucuccauaccccagccccucuaacuagaguggggagcaugccagagag

SEQ ID NO: 403487 - RNA, 64 nt, Human
agggcauuuccaaguuaaggcuaagacuugcuuuucuaacuaagagaaugugcucaugcauugc

SEQ ID NO: 403488 - RNA, 64 nt, Human
cgguugccuacccuguagauauguggaugaagagucuaacuagaauaaugacuuguaaacccac

SEQ ID NO: 403489 - RNA, 64 nt, Human
agagcaacagcuacaacaaugaagaauucccugaucuaacuauguuuccccccuuuucagaaua

SEQ ID NO: 403490 - RNA, 64 nt, Human
uuucauuaauccagaaggaugaacauggucaccaucuaacuauucaggaauuguagucugaggg

SEQ ID NO: 403491 - RNA, 64 nt, Human
acauugagucugacaacuguuaguuuucugguugucuaacuaccauaugaagcuagaaaaugca

SEQ ID NO: 403492 - RNA, 64 nt, Human
uaaaaauuauuaagguuuuaugaaguugacaaaaucuaacuauauuuggugcaucacaauggac

SEQ ID NO: 403493 - RNA, 64 nt, Human
auauaguucccuuuccagacuguuuucuuuugacucuaacuauaaucauaagucugugcuucca

SEQ ID NO: 403494 - RNA, 64 nt, Human
uuacaacacaguagguaauaaaggcuuuuaugugucuaacuagagacauaaagugacuguggaa

SEQ ID NO: 403495 - RNA, 64 nt, Human
aaggacaucaucauagauaugaucuaacaguauuucuaacuauauuugaucauuaaaagccucu

SEQ ID NO: 403496 - RNA, 64 nt, Human
uggguuuuuauuuggcacauuuaaauaaaauguuucuaacuagauuuuugauuuguguucaaua

SEQ ID NO: 403497 - RNA, 64 nt, Human
aucauaaacagaguggaauaaauauaaaugagauucuaacuaggaugaaugugguaguaaugau

SEQ ID NO: 403498 - RNA, 64 nt, Human
cacauuuaguuagaagaacuuuaaaaaauugguuucuaacuagacuaccuuuacugaacuuaau

SEQ ID NO: 403499 - RNA, 58 nt, Human
auguuugcccuggugguuccuaucucuucaggcaaacauggucaguauucuguaaagu

SEQ ID NO: 403500 - RNA, 58 nt, Human
aaaaucaaaacaaaaaccccaaaaacagcaggcaaaugcuuuuuaacucugacaccgu

SEQ ID NO: 403501 - RNA, 58 nt, Human
cagaacugaagagcggcaccgggcccagcaggcaaagagagaggccucccuggcuucg

SEQ ID NO: 403502 - RNA, 58 nt, Human
aacaaaagccagacaaacccaaguuguccaggcaaauaaacucaaaucuuugucacgu

SEQ ID NO: 403503 - RNA, 58 nt, Human
caaaaaaguuuugaugggauuuuaaauucaggcaaagccuacaacgcugagacaaucc

SEQ ID NO: 403504 - RNA, 58 nt, Human
agguacccgaagaagcagaggcugagggcaggcaaagccugugugacuguggcagugc

SEQ ID NO: 403505 - RNA, 58 nt, Human
ccucuggaguuucauguuaugccuguugcaggcaaauguaaagucuagaaaauaaugc

SEQ ID NO: 403506 - RNA, 58 nt, Human
ccauaaugcucccuacaucucacacuaacaggcaaauucagaugcugggauuggcaau

SEQ ID NO: 403507 - RNA, 58 nt, Human
guuauuuaugaugcuuagccauaguauucaggcaaauguucauuucuccugguaccug

SEQ ID NO: 403508 - RNA, 58 nt, Human
cuggcccaaccagacuucucccgugagccaggcaaaggaaauugucaucugccaacug

SEQ ID NO: 403509 - RNA, 58 nt, Human
uugacuuucacaaaauuuaaaucauaaacaggcaaaccaaacagcacacuguagcuau

SEQ ID NO: 403510 - RNA, 58 nt, Human
aucuccauccacaucagggagcuuuccccaggcaaauacaaaccgccccguggccugc

SEQ ID NO: 403511 - RNA, 58 nt, Human
uccacacugcacuguuaauaacucucagcaggcaaagaccgauugcauaggaauugca

SEQ ID NO: 403512 - RNA, 58 nt, Human
ccagucucugaugccacuauguucuuugcaggcaaagacuuguucaaugcgaauuucc

SEQ ID NO: 403513 - RNA, 58 nt, Human
cucccagauccuaaauccaguagccucccaggcaaaauauagcaaucugccacaacug

SEQ ID NO: 403514 - RNA, 58 nt, Human
gaauguacuauuugauccucauuguguucaggcaaaaaauaggaaaugaguaauuuug

SEQ ID NO: 403515 - RNA, 58 nt, Human
cuggauuccagguggacuggaccaagagcaggcaaagacacgggaacugaaaaacucc

SEQ ID NO: 403516 - RNA, 58 nt, Human
cuaauggcuuuauugcagcgauuaauaacaggcaaaaggaagcaggguugguuucccu

SEQ ID NO: 403517 - RNA, 58 nt, Human
cccuuacucuuggaugcuucuuaacccucaggcaaaccuguguucccccuguauucag

SEQ ID NO: 403518 - RNA, 58 nt, Human
gaccacagcucaaguaaaaaaacaaaaacaggcaaauaaauaaacaugcuuaacaugu

SEQ ID NO: 403519 - RNA, 58 nt, Human
gaauaguuuugcaauguguauauaguugcaggcaaaaaaaaaaccaccucacugcaaa

SEQ ID NO: 403520 - RNA, 58 nt, Human
cuguuaacugguauauacauauauaugucaggcaaagugcugcuggaaguagaauuug

SEQ ID NO: 403521 - RNA, 58 nt, Human
uaaaauaaugcauaguuguguuaaacuacaggcaaacauagcccacgggaauaucucc

SEQ ID NO: 403522 - RNA, 58 nt, Human
uaauugcaaugaaugugaauuauacagacaggcaaacauuuuguaaucauaauucaca

SEQ ID NO: 403523 - RNA, 58 nt, Human
aucccguaucuacgcacccccccccccccaggcaaagcagugcucugaguaucacauc

SEQ ID NO: 403524 - RNA, 58 nt, Human
ccaaacccuagagcuagcaguucccauucaggcaaacaagggcagugguuuuguuugu

SEQ ID NO: 403525 - RNA, 58 nt, Human
cuacggguggguucccaaggacaugggacaggcaaagugugagccaaaggauccuucc

SEQ ID NO: 403526 - RNA, 58 nt, Human
aaagcuggaagagcucgagaucaugccucaggcaaaggcguggguccaucguucuucc

SEQ ID NO: 403527 - RNA, 58 nt, Human
ucacaauaaggcaaugguuuugagaggccaggcaaauaaucuuucucaccguagaaca

SEQ ID NO: 403528 - RNA, 58 nt, Human
uagcugcuuucaggguuuuaugaauuuucaggcaaagcuuuaauuuacacuaagcuua

SEQ ID NO: 403529 - RNA, 58 nt, Human
caggcaaccagcacugcagaaaccacuccaggcaaaguagugaaggaaaaaagccugc

SEQ ID NO: 403530 - RNA, 58 nt, Human
auuuuagauagaugaagaagcuagaaaacaggcaaauuccugacugcuaguuuauaua

SEQ ID NO: 403531 - RNA, 58 nt, Human
ugauauauuuaucaaaucucacagacaucaggcaaauuauagccuggugacaaaagug

SEQ ID NO: 403532 - RNA, 58 nt, Human
aaucaaucuaaauaauagacuuuuuuuacaggcaaaaugaaagaggaggaagucuggg

SEQ ID NO: 403533 - RNA, 58 nt, Human
aauaaugccaccucugcaguuuugggaacaggcaaauaaaguaucaguauacauggug

SEQ ID NO: 403534 - RNA, 58 nt, Human
acauuuuaguuauucuuauaaaagcaaacaggcaaacaugaguguaaauuaaagacaa

SEQ ID NO: 403535 - RNA, 58 nt, Human
uuguaaugaacuuaaaucuggacuguuccaggcaaaccagacuuaucuugcaauauga

SEQ ID NO: 403536 - RNA, 58 nt, Human
caacagaaauaaucugacacuaccuuaucaggcaaauuggggaggggaggguguaucu

SEQ ID NO: 403537 - RNA, 58 nt, Human
gccucagccucccaaagugcugggauuacaggcaaaagccaacacacccggccuggau

SEQ ID NO: 403538 - RNA, 58 nt, Human
uuucagccuccuugucauauaaucauuucaggcaaacugaggcaacacuaacagcuaa

SEQ ID NO: 403539 - RNA, 58 nt, Human
cauagauuacuuacuauuuaguccuuuacaggcaaaguuuccucaccccugaccuaga

SEQ ID NO: 403540 - RNA, 58 nt, Human
ggcucuguacugacacuuauuaucgguacaggcaaagaggagccuguugucuguuagg

SEQ ID NO: 403541 - RNA, 58 nt, Human
uguguaaagacuugagaagucuaauucacaggcaaaccaauacagaauugacugcagu

SEQ ID NO: 403542 - RNA, 58 nt, Human
uaagcccagcauuaccugauaccaaaaccaggcaaagaaaacagaagaagaggaagga

SEQ ID NO: 403543 - RNA, 58 nt, Human
cagccacaggugcgaucagugccucacgcaggcaaaugcacugaaacccaggggcaca

SEQ ID NO: 403544 - RNA, 58 nt, Human
ccuggggacuggaaaguaagucaucagccaggcaaaugacucaugcugaagagagucc

SEQ ID NO: 403545 - RNA, 58 nt, Human
auugucagauuucuuaaaaggacacugucaggcaaauuugaaaauauacacauugaga

SEQ ID NO: 403546 - RNA, 58 nt, Human
aaugggaacuugaggcaauucagguauccaggcaaaucuuuguauauauuuuuuugug

SEQ ID NO: 403547 - RNA, 58 nt, Human
augguguuaauuugaaaugccuuaauggcaggcaaaaaccagucauuucauuuuugua

SEQ ID NO: 403548 - RNA, 58 nt, Human
auaucagaaucauugaaguauuuuccuccaggcaaaauugauauacuuuuuucuuauu

SEQ ID NO: 403549 - RNA, 58 nt, Human
cuaguugcguguugaauuauaucccuuacaggcaaaacuuuugaagugguggaugugg

SEQ ID NO: 403550 - RNA, 58 nt, Human
ccaaaaauggcucucuaggugggcugugcaggcaaagcaaagcucagggcugguuccc

SEQ ID NO: 403551 - RNA, 58 nt, Human
ggucagugggaaaacuaagggccuccaacaggcaaauucagggaggauagguuucagg

SEQ ID NO: 403552 - RNA, 58 nt, Human
guaagcagcacacuaggaggcccaggcgcaggcaaagagaagauggugcugucaugaa

SEQ ID NO: 403553 - RNA, 58 nt, Human
caaaucaugucuuauacauggauggcagcaggcaaagagagaacuugugcaggggaac

SEQ ID NO: 403554 - RNA, 58 nt, Human
ccacaaaagacagacccagugagugaaucaggcaaagugcuuauaauguguguugugu

SEQ ID NO: 403555 - RNA, 58 nt, Human
uugacgugauaaaaguucauuuauugggcaggcaaaguccucugcaggccuggaaacc

SEQ ID NO: 403556 - RNA, 58 nt, Human
guuuuaaaaaugaaauacuuuaugcaaacaggcaaaauugguaccaaagggaaacauu

SEQ ID NO: 403557 - RNA, 58 nt, Human
ggguagguauucacaugcacuaaaaaaccaggcaaacaucugacucccaggauaaagu

SEQ ID NO: 403558 - RNA, 58 nt, Human
ugugacaguaauuccagcucggucccuccaggcaaaggagaaacgggacuuacuucac

SEQ ID NO: 403559 - RNA, 58 nt, Human
acccuguuguuacuuuauauuucauaaucaggcaaaaauacuuacaguuaauaauaua

SEQ ID NO: 403560 - RNA, 58 nt, Human
gagagggaccuuaggggagcagagaagacaggcaaaguuguggacuguuugaucuugu

SEQ ID NO: 403561 - RNA, 58 nt, Human
agggcuacuggugagauugagaucugagcaggcaaagcucaaaagagaguuuggaggu

SEQ ID NO: 403562 - RNA, 58 nt, Human
aguucugucucugucuuuggcuucuguccaggcaaagcuaaauaagacagcaaaguca

SEQ ID NO: 403563 - RNA, 58 nt, Human
aauuuaaaauuuaacagcaaucagcuaacaggcaaauuaagauuuuuacuucuggcug

SEQ ID NO: 403564 - RNA, 58 nt, Human
ucauuagguauaaaaaauaaucaucaaccaggcaaauuacuuugcuuccuagcugaug

SEQ ID NO: 403565 - RNA, 58 nt, Human
aagaaaccucuguuuacuguguggcacccaggcaaaacaugcuccacaaauucaacuu

SEQ ID NO: 403566 - RNA, 58 nt, Human
uguccaaguaaugguguauguaaugguacaggcaaaugugacuggauuucccucaaaa

SEQ ID NO: 403567 - RNA, 58 nt, Human
cugccaguauccagcaguaucuggaccacaggcaaagaaaaccacuaggaccaccagg

SEQ ID NO: 403568 - RNA, 58 nt, Human
ugccugaggggaucaggcuuuucuacuccaggcaaaccugccccaucuugucgcuuuu

SEQ ID NO: 403569 - RNA, 58 nt, Human
ccaggcaguaccauucaggacauaggcacaggcaaagauuucaugacgaagacgccaa

SEQ ID NO: 403570 - RNA, 58 nt, Human
uaauaguuuuauaaaauuguugacauuucaggcaaauuuggccaauauuaucauugaa

SEQ ID NO: 403571 - RNA, 58 nt, Human
acaaggguaaucagaaauggaaucagugcaggcaaaauuuaggauuugccgcuuccau

SEQ ID NO: 403572 - RNA, 58 nt, Human
augcuauuguuuaugauuugaaaacuuucaggcaaaauccaauuuacauuuuucccuu

SEQ ID NO: 403573 - RNA, 58 nt, Human
aauuugucuuccucaccagccagguccucaggcaaaguccucagccagugcuuuagag

SEQ ID NO: 403574 - RNA, 58 nt, Human
uguuaauucguuuugcaguugaaaagagcaggcaaaagaauccucgaagcuuauguau

SEQ ID NO: 403575 - RNA, 58 nt, Human
ggggcuccauaugucccuacgcgugcagcaggcaaacaagaaagaccauccugagcug

SEQ ID NO: 403576 - RNA, 58 nt, Human
ccucgacuagagugaaauugaacuccaucaggcaaaauuuaaaaucacaaauuggcua

SEQ ID NO: 403577 - RNA, 58 nt, Human
ugcuggagacacucggagcggcgggccccaggcaaacuugcacgacgccugccaggua

SEQ ID NO: 403578 - RNA, 58 nt, Human
agaucucuccugcaaaaguaaauguugacaggcaaauuucauacccaugucagauuga

SEQ ID NO: 403579 - RNA, 58 nt, Human
aaugcuccugacaguguggagaaaccaacaggcaaaacgugggugcaaaagugaugag

SEQ ID NO: 403580 - RNA, 58 nt, Human
agugacuuuucauuuuuuguuuuaacuucaggcaaaaucuuuaaccacucuggccucu

SEQ ID NO: 403581 - RNA, 58 nt, Human
auagugacaugcaggcaccucuuuuaaacaggcaaaacaggaagggggaaaagguggg

SEQ ID NO: 403582 - RNA, 58 nt, Human
aguuaccugacgggugagaagaaaagagcaggcaaaauuagugauuuuuuuagaaguc

SEQ ID NO: 403583 - RNA, 58 nt, Human
uugaaauuauguaaauuauguaaauuaucaggcaaauuugcauuaaauuacagaaauu

SEQ ID NO: 403584 - RNA, 58 nt, Human
uagugauaaagcaaauucuccuuggccucaggcaaauaguuucuaaagauucugugaa

SEQ ID NO: 403585 - RNA, 58 nt, Human
uaauguuugaacuggaagaugagcucaccaggcaaagcuaaggaaggauauacuaguu

SEQ ID NO: 403586 - RNA, 58 nt, Human
gagagcccugcaccuggccagagugucacaggcaaaaggcaucgggaagcaggagcau

SEQ ID NO: 403587 - RNA, 58 nt, Human
aguagcagggccgcgcccuuggugaccucaggcaaagcacccccaaacuuaccucagg

SEQ ID NO: 403588 - RNA, 58 nt, Human
uccuccugguuuggaguccuuuccuucccaggcaaaacuucgagaaucaacaccugga

SEQ ID NO: 403589 - RNA, 58 nt, Human
ugccucacugcauacucuuuaauaguaccaggcaaagauuuucuucaacuauaguaca

SEQ ID NO: 403590 - RNA, 58 nt, Human
agcuuuuccaugcugggcagaguagucucaggcaaaagugccugaaaagaucagaaua

SEQ ID NO: 403591 - RNA, 58 nt, Human
gauucuuuguggcuauuggugugucucacaggcaaaauuugauuuggcuaaaauaggc

SEQ ID NO: 403592 - RNA, 58 nt, Human
gucugaaugacacggaacgcucccacugcaggcaaaccgugacgcccuccccacucgg

SEQ ID NO: 403593 - RNA, 58 nt, Human
agaacuuucugugccacuguagauagcucaggcaaaacuauuaccuggguauuuaucc

SEQ ID NO: 403594 - RNA, 58 nt, Human
gaggccaguauuacccuaauagcaaaaccaggcaaagauauuacaagaaaggaaaacu

SEQ ID NO: 403595 - RNA, 58 nt, Human
cucuuccagaaucccaagacccagggcccaggcaaaucaguuacuaagaagaaaauug

SEQ ID NO: 403596 - RNA, 58 nt, Human
cuuugaauccagcucuagucagucuaagcaggcaaagguaacugaugacuaaauuuca

SEQ ID NO: 403597 - RNA, 58 nt, Human
gaaaucuuaggacugacaucccuuuacucaggcaaacagaaguuccaaccccagacua

SEQ ID NO: 403598 - RNA, 58 nt, Human
gcauaaacagcuggaccucagcaagggucaggcaaacccagucacucggaaggcagcu

SEQ ID NO: 403599 - RNA, 58 nt, Human
uguuuaccaagggccccuucauaaauagcaggcaaaugccuagcuuugggagaaaagg

SEQ ID NO: 403600 - RNA, 58 nt, Human
ggccaacagaauccuucuugauaguuugcaggcaaaacaaauguaauguugcagaucc

SEQ ID NO: 403601 - RNA, 58 nt, Human
ucuauuguuuugcaauauagguuauaaacaggcaaaaugcaauaaaauauauaucugg

SEQ ID NO: 403602 - RNA, 58 nt, Human
cuguggagucugagggaggggcuccauucaggcaaagggguuuuagcugcagccuugg

SEQ ID NO: 403603 - RNA, 58 nt, Human
aaucucuugcugaguccaggccaccaaucaggcaaauagcccauacauuugaucguug

SEQ ID NO: 403604 - RNA, 58 nt, Human
cacugacauaaaguugaaaaaauaaaugcaggcaaauaacuagagacuucuuuuaagg

SEQ ID NO: 403605 - RNA, 58 nt, Human
gugcacuuuuagauauuaacuacauuuacaggcaaaucacuguaaugagaaugguacu

SEQ ID NO: 403606 - RNA, 58 nt, Human
auugcacgguuuggguauucuuaaugaccaggcaaaugccuuaaguaaacaaacaaga

SEQ ID NO: 403607 - RNA, 58 nt, Human
gaggccaggauuacccuaauaccaaagccaggcaaaaacauuacaagaaaggaaaacu

SEQ ID NO: 403608 - RNA, 58 nt, Human
gaugcagggaguagaagcuuuguggugucaggcaaacggacucuguuaguaagaguug

SEQ ID NO: 403609 - RNA, 58 nt, Human
gggaaaucuguaaggaaguaacugauuccaggcaaauuguuuucuuccuucuacccac

SEQ ID NO: 403610 - RNA, 58 nt, Human
uaaaauacuugauuuaaaaacaauugcucaggcaaaacauaauucauaaacuaaaagg

SEQ ID NO: 403611 - RNA, 58 nt, Human
ggugguaaggcuuugcuggacccuguugcaggcaaaaggaguaauugauuuaaaguac

SEQ ID NO: 403612 - RNA, 58 nt, Human
aaauagaagguggcuuuguaggggcaagcaggcaaagaguacuauccacauggcaggc

SEQ ID NO: 403613 - RNA, 58 nt, Human
guaaucccagcacugugggaggccaagccaggcaaaucgcuugaggcugaggaguuca

SEQ ID NO: 403614 - RNA, 58 nt, Human
aagggccagcauggggaagagaugguugcaggcaaaaugcacuuuauagagauuuucu

SEQ ID NO: 403615 - RNA, 58 nt, Human
caugugccuuuucugaauuaugcuuccacaggcaaaacucaguagagaucuauauuuu

SEQ ID NO: 403616 - RNA, 58 nt, Human
gccucagucuccugagcagcugggauuacaggcaaacgccaccacacccagcuaaauu

SEQ ID NO: 403617 - RNA, 58 nt, Human
ucuaagguccucauuuuuacagaguauacaggcaaagugacaggggaaaaggaauuag

SEQ ID NO: 403618 - RNA, 58 nt, Human
cuuucccaagcacuguaagugagugggucaggcaaagccccaaauggaggguugguua

SEQ ID NO: 403619 - RNA, 58 nt, Human
gaaaugggccugucuggcauuucagagucaggcaaagcaggcagggccagggagcuuc

SEQ ID NO: 403620 - RNA, 58 nt, Human
cacaacaagagacgucauuguucaguagcaggcaaagagggagcacacagcauuauuc

SEQ ID NO: 403621 - RNA, 58 nt, Human
gucuccugagccaacugugaaccucacccaggcaaaauggcuaccaccuacuuggguc

SEQ ID NO: 403622 - RNA, 58 nt, Human
accagcauucugggggccauuuucucuacaggcaaauggaauugcuuuuccauaacau

SEQ ID NO: 403623 - RNA, 58 nt, Human
caguugguauuaccucugugcucagugccaggcaaaacacuagcucaaaggagaguca

SEQ ID NO: 403624 - RNA, 58 nt, Human
gugcucagagacacuguugauaaaaacucaggcaaagaaaaugaaaugcauauuugca

SEQ ID NO: 403625 - RNA, 58 nt, Human
aggaugccauccucuggaauccuaauggcaggcaaagggagagaggaagggugacggc

SEQ ID NO: 403626 - RNA, 58 nt, Human
ccagggcacugacggaaagccagggcugcaggcaaagcuggacaugugcccuggccca

SEQ ID NO: 403627 - RNA, 58 nt, Human
caacaugcuugauguuuggccugaucuccaggcaaaaggagugagaugaaucaaaacc

SEQ ID NO: 403628 - RNA, 58 nt, Human
gauuuaggauugcuguugaaggcuuccucaggcaaacuccagcuuaaagcccuagaca

SEQ ID NO: 403629 - RNA, 58 nt, Human
ugccauuacuucugcuuucguaucuccucaggcaaaaguggagggugccuuaugggcc

SEQ ID NO: 403630 - RNA, 58 nt, Human
gccccucugccccagcaaaugcccagcccaggcaaauuguauuuaaagaauccugggg

SEQ ID NO: 403631 - RNA, 58 nt, Human
ggccaagguaggggaguaaaaaggaggucaggcaaaagggaggaguuuucuguccuuu

SEQ ID NO: 403632 - RNA, 58 nt, Human
ccaaccaugagcaaugccaucugguucccaggcaaagacacccuuagcucaccuuuaa

SEQ ID NO: 403633 - RNA, 58 nt, Human
gugaauccaauuuuguagaauuccuacacaggcaaaauagcaugaucugagcagcagc

SEQ ID NO: 403634 - RNA, 58 nt, Human
caaagagaaauaaaauccauucucacggcaggcaaaucagugagaaaaauguaaagau

SEQ ID NO: 403635 - RNA, 58 nt, Human
gaccagcugggccccaccacggccacgccaggcaaagcgccagcagcccugcacucca

SEQ ID NO: 403636 - RNA, 58 nt, Human
caaggucuggcgucccaaaugaaagaagcaggcaaagggaaggagccccugagaacaa

SEQ ID NO: 403637 - RNA, 58 nt, Human
ggcaugagccggaagaucuggcgaagcucaggcaaaaacaccaccaaucacguggaag

SEQ ID NO: 403638 - RNA, 58 nt, Human
acucucucauguuagagcaauacuggcucaggcaaaacaccuggugggaaguuguauc

SEQ ID NO: 403639 - RNA, 58 nt, Human
aaagaugcuugaaaugcuuuuguuauuucaggcaaaucaaauuaaaucagacuaucaa

SEQ ID NO: 403640 - RNA, 58 nt, Human
guccccgacucguggccacauggagaaacaggcaaaccagaaucacugugaaucaagu

SEQ ID NO: 403641 - RNA, 58 nt, Human
ucugcaacagaauaugacaccaucuucccaggcaaaagcaacaucugguugaccauga

SEQ ID NO: 403642 - RNA, 58 nt, Human
agcuuuggccuuggucuaccugccaggccaggcaaagcgccuuuacacaggccucgga

SEQ ID NO: 403643 - RNA, 58 nt, Human
uuguuguuuuuaaagaggcugcuggccacaggcaaaaaaaaugaccuagcaacucuug

SEQ ID NO: 403644 - RNA, 58 nt, Human
uccuuucuuucgugggcugagaaaggggcaggcaaaaugaagcuggccacugaaaacu

SEQ ID NO: 403645 - RNA, 58 nt, Human
gugguaaaauugggcccaagcugaaguacaggcaaacuugauguuugaaagauaaguu

SEQ ID NO: 403646 - RNA, 58 nt, Human
guuaaauagacauguuacuggcugcacacaggcaaauucuaguuuguuuuuuuuaagu

SEQ ID NO: 403647 - RNA, 58 nt, Human
augguaauuaggagcaaaugaguuauuacaggcaaaacacuuagaacaguuccuggca

SEQ ID NO: 403648 - RNA, 58 nt, Human
uggcaccaagguaagagguggggcugcccaggcaaagucagugaacaugaaaacucag

SEQ ID NO: 403649 - RNA, 58 nt, Human
gauuccacuuguguggagggauugaacacaggcaaagaggugcugcuuugcuucuuca

SEQ ID NO: 403650 - RNA, 58 nt, Human
auuacaagucagauuuuucuuaaacuagcaggcaaaaacaguacuuccaaauuuuaag

SEQ ID NO: 403651 - RNA, 58 nt, Human
auccuuggcugcuugcagggccacuguccaggcaaaugccaggccuuguccccagaug

SEQ ID NO: 403652 - RNA, 58 nt, Human
uguauaaaauuggaaagucucuaagacacaggcaaaccaggggacuuaaugauuuggu

SEQ ID NO: 403653 - RNA, 58 nt, Human
uauaguccaacauucguugaucccaauacaggcaaacaaccuggucaaccuuuugaag

SEQ ID NO: 403654 - RNA, 58 nt, Human
auaaaaaaugaaauuauuuagaacggggcaggcaaacuacauccugcaggccaaaucu

SEQ ID NO: 403655 - RNA, 58 nt, Human
caaggcagagguaugcuccugcuguaaucaggcaaaugaguucaacuggauuucuuuu

SEQ ID NO: 403656 - RNA, 58 nt, Human
agguuuguucccuugaauuucaucucaucaggcaaauuguacuaguuguaguuacgag

SEQ ID NO: 403657 - RNA, 58 nt, Human
ggcacacagaauacagcagugaauuaaacaggcaaaaauuccuccccuccuggagcuc

SEQ ID NO: 403658 - RNA, 58 nt, Human
acaggaaggaaagugaaggcagagugagcaggcaaaguagaaaauucgaaaagguccu

SEQ ID NO: 403659 - RNA, 58 nt, Human
ggucuuuuuaaauaaccucauguuacuucaggcaaaucugguacaggagaagcccaag

SEQ ID NO: 403660 - RNA, 58 nt, Human
aaaacugaaaggauaugacaugcuggaacaggcaaaacuacaaagacaguaaaaagau

SEQ ID NO: 403661 - RNA, 58 nt, Human
ugggguaccaagagacuccuugagagaccaggcaaagcaagugauugggacagagguu

SEQ ID NO: 403662 - RNA, 58 nt, Human
ucuaagggaccagaauaagacucagcuacaggcaaaagggcuccuucccguggcugcu

SEQ ID NO: 403663 - RNA, 58 nt, Human
uaagaaucagaguaggguaacaauguaccaggcaaauuguaaguugaaauucuagaua

SEQ ID NO: 403664 - RNA, 58 nt, Human
uucauuucacgggucugaaagugauguccaggcaaaaauugacaauacauuucuugcc

SEQ ID NO: 403665 - RNA, 58 nt, Human
uucuucguugcugcauuuucuucacuugcaggcaaacuuggcucucaauaaacuuuua

SEQ ID NO: 403666 - RNA, 58 nt, Human
acacugcacaucuuuuggugaucggggucaggcaaaggaggggaaacaaugaaaacaa

SEQ ID NO: 403667 - RNA, 58 nt, Human
gccccgccgagagaacugcugucacuuucaggcaaagcucaaagguccuaggcccaca

SEQ ID NO: 403668 - RNA, 58 nt, Human
uuucuguuucauaucauuuggggcgagucaggcaaaaguauuugauuugacuuuauag

SEQ ID NO: 403669 - RNA, 58 nt, Human
aggggucucuucucaucaagccuuguaccaggcaaaagacaggcccugcuuggccgug

SEQ ID NO: 403670 - RNA, 58 nt, Human
ucagugucuugauguaucauucauggagcaggcaaaaccagacgucugggaagaccgu

SEQ ID NO: 403671 - RNA, 58 nt, Human
accuugaucagcgucccaguuucacagccaggcaaaccgacacagggcuuggaaggga

SEQ ID NO: 403672 - RNA, 58 nt, Human
cuguguacaaagagaugugaaauacuuucaggcaaaaauaaacuguaagugacucauc

SEQ ID NO: 403673 - RNA, 58 nt, Human
auuuggugcaggaauauguguucauauccaggcaaacggguguguuuuuaucuucaga

SEQ ID NO: 403674 - RNA, 58 nt, Human
guuccacgggguugcccuagagagaaaacaggcaaacucacagguuagaagacauaca

SEQ ID NO: 403675 - RNA, 58 nt, Human
cuucccucauucuucagcggaaauucuccaggcaaaugaccuccucacccaaggaguu

SEQ ID NO: 403676 - RNA, 58 nt, Human
uuuggcauagcaacaacaacacauuucucaggcaaaauggauuuccagcuucucuuga

SEQ ID NO: 403677 - RNA, 58 nt, Human
uuuaaaucaaggaaaggcucauuuaaaacaggcaaaguuuuacagagaggauacauuu

SEQ ID NO: 403678 - RNA, 58 nt, Human
uuugcugcuauugauuuguccccgacagcaggcaaagccucacauugcccucaauuuu

SEQ ID NO: 403679 - RNA, 58 nt, Human
ugaagaaaaggugaagagcgaguucccgcaggcaaauuggaugggcgucuggccgccg

SEQ ID NO: 403680 - RNA, 58 nt, Human
ucucccagcucucccgagucugugacuacaggcaaaucacgccaccuccucucugagc

SEQ ID NO: 403681 - RNA, 58 nt, Human
cuucucaaaccgccggccacacuggucacaggcaaaguccagcucagucucagccuug

SEQ ID NO: 403682 - RNA, 58 nt, Human
acaggccagaaagugaauccagggaacacaggcaaauuauuuguggggguaggaaucu

SEQ ID NO: 403683 - RNA, 58 nt, Human
gugugaaagugucaucuucacugccaaucaggcaaagaccggaaagauuugcauuuua

SEQ ID NO: 403684 - RNA, 58 nt, Human
agaccagcuaguuuggggcuggggagcucaggcaaaagagguuuccaggaugcagauu

SEQ ID NO: 403685 - RNA, 58 nt, Human
gggaagugcaucugucagccagacuggacaggcaaagacugcaguauccauaaccccc

SEQ ID NO: 403686 - RNA, 58 nt, Human
ggguuuaaguaugcuacaauauacaguucaggcaaaauuuaagauguaauuaucuuca

SEQ ID NO: 403687 - RNA, 58 nt, Human
cagggaaugcagcaggaaggaacaaagacaggcaaacggcaacguagccugggcucac

SEQ ID NO: 403688 - RNA, 58 nt, Human
aaacacuuccugagcaccugcuacaugccaggcaaaaugugaaauuugcaugcuauga

SEQ ID NO: 403689 - RNA, 58 nt, Human
acagguggacguagaguuggccuuuuuacaggcaaagaggcgaauuguagaauuguua

SEQ ID NO: 403690 - RNA, 58 nt, Human
uugccuucaucuguacauucugugauaccaggcaaauuaccaauuacacacagcuacu

SEQ ID NO: 403691 - RNA, 58 nt, Human
ugcacuggccucuccugcauucuguuugcaggcaaaugcuucagcucacauguccccc

SEQ ID NO: 403692 - RNA, 58 nt, Human
gccuuaugggugggccagauccaaaccgcaggcaaacgggucgugauggcguggcaac

SEQ ID NO: 403693 - RNA, 58 nt, Human
caucaagaguccuuauguuauugggaugcaggcaaaccucugugguccuaagaccugg

SEQ ID NO: 403694 - RNA, 58 nt, Human
cccuuucuuugacugacagagcaccauccaggcaaaauuagagcgccaaaugguuuuc

SEQ ID NO: 403695 - RNA, 58 nt, Human
aagaguaaaguuuaugaaaagaaaguggcaggcaaacacaacucuugacugcccuccc

SEQ ID NO: 403696 - RNA, 58 nt, Human
guaaggacagugggauuuaugugaacaucaggcaaagccaugagaucaaaccauccca

SEQ ID NO: 403697 - RNA, 58 nt, Human
uacauacuuagagagagacucuuuuagccaggcaaagucuuuuuuggcuguggcugga

SEQ ID NO: 403698 - RNA, 58 nt, Human
cucuccagauuagccucucuuccucugucaggcaaagaugaggagcccguguucccau

SEQ ID NO: 403699 - RNA, 58 nt, Human
agcauuauggaugaccucaucagcuccccaggcaaaaacaaaagugggaggggacaca

SEQ ID NO: 403700 - RNA, 58 nt, Human
cuuccuuuuagaauaauauuuuaauugccaggcaaaauggguuucaguuuuugaaucu

SEQ ID NO: 403701 - RNA, 58 nt, Human
acuuaaugcuauuuauguugugccucugcaggcaaagcccuuaauaaauauuuuacau

SEQ ID NO: 403702 - RNA, 58 nt, Human
uacuauaaauaaguggauuauuucaaugcaggcaaaauugugaaguucuguugggaaa

SEQ ID NO: 403703 - RNA, 58 nt, Human
uuaucuuaucaguaguuuuauugcugaucaggcaaaaauaguuuuccaaaguuauuuu

SEQ ID NO: 403704 - RNA, 58 nt, Human
guugggaccagacuggcuuuuauagugacaggcaaagaggaauuuauugagaucacug

SEQ ID NO: 403705 - RNA, 58 nt, Human
acacacacacacaacaauuaacagucuucaggcaaaacgucgaaucagcuauuuacug

SEQ ID NO: 403706 - RNA, 58 nt, Human
uggagcagaggggcucccucaccccgggcaggcaaaggcaguggguagaggaggcacu

SEQ ID NO: 403707 - RNA, 58 nt, Human
gcuaaaugcuccaauuaaaagacacagacaggcaaauuggauaaauagucaagaccca

SEQ ID NO: 403708 - RNA, 58 nt, Human
aaaacauuuagccacagcccaaaucuuccaggcaaauguaauaaacgugacauugccg

SEQ ID NO: 403709 - RNA, 58 nt, Human
ccacucagagacuucaccuaacuagagacaggcaaacugcaaaccauggugagaaauu

SEQ ID NO: 403710 - RNA, 58 nt, Human
ggugcccugggccgucccugugugaacgcaggcaaaagcagcccagucccccucacug

SEQ ID NO: 403711 - RNA, 58 nt, Human
caggugcccuuagagaggaaaaccaugacaggcaaaugcauuuccucuggaguuugag

SEQ ID NO: 403712 - RNA, 58 nt, Human
gggcuuugagaaggggacccauauccuacaggcaaaaagcaggcuaggugaccuuggg

SEQ ID NO: 403713 - RNA, 58 nt, Human
auaauaaaaaggaaggacaggaggaagacaggcaaauguacuucucacccagucuucu

SEQ ID NO: 403714 - RNA, 58 nt, Human
cauagauagaaugaaccaauaugaacugcaggcaaagucugaagucagccuugguuug

SEQ ID NO: 403715 - RNA, 58 nt, Human
auccuauuaaaauguaugcugugauacacaggcaaauuugauguuaaccuaagcacau

SEQ ID NO: 403716 - RNA, 58 nt, Human
ugucgugagagauccacucaauaaaaaccaggcaaauguagugaaucuggaaagguua

SEQ ID NO: 403717 - RNA, 58 nt, Human
uaauuucuuuuaaccuuuuaauuauguacaggcaaaaaugcagcauuccgcuuuuaac

SEQ ID NO: 403718 - RNA, 58 nt, Human
agggguggauucgggagcugggaguaaccaggcaaagucaaccagaugccuagcuccu

SEQ ID NO: 403719 - RNA, 58 nt, Human
aguggaugggaauuugucagcguucuaccaggcaaauucacuguuucacugaaauguu

SEQ ID NO: 403720 - RNA, 58 nt, Human
auuuauuuauuggagauaaucuagaacacaggcaaaauccuugcuuaugacaucacuu

SEQ ID NO: 403721 - RNA, 58 nt, Human
gccagccacaugccaucuucccugcgaucaggcaaaaaaguggaauuaaaaagucaaa

SEQ ID NO: 403722 - RNA, 58 nt, Human
agccucccuugucccuggccuuuggacccaggcaaaggcuucugagcccugggcaggg

SEQ ID NO: 403723 - RNA, 58 nt, Human
guuugaucuacuucauagcuccuuggagcaggcaaaaaagggacagcaugccccuugg

SEQ ID NO: 403724 - RNA, 58 nt, Human
caagcauaaaaaggaaaaaaaggaaacucaggcaaagggauccauaugugcaauggca

SEQ ID NO: 403725 - RNA, 58 nt, Human
uccaaugaacaagauccuacaagcugugcaggcaaaaccuagcaggaaaaaaaaacaa

SEQ ID NO: 403726 - RNA, 58 nt, Human
cugccccuuucucaauuuuuaugacgugcaggcaaauuaucauuuucugugaacacag

SEQ ID NO: 403727 - RNA, 58 nt, Human
aacuucucugcugcaaugaaagaucugucaggcaaacauccugugucugcuuugaugg

SEQ ID NO: 403728 - RNA, 58 nt, Human
auugugugugaugugaagccaauucagacaggcaaauaaaagugaccuuuuacacuga

SEQ ID NO: 403729 - RNA, 58 nt, Human
aggaauguuuagcagcaaccgaauauaccaggcaaaacuccuuggugccugcgcugug

SEQ ID NO: 403730 - RNA, 58 nt, Human
ugcuucauguaucaguuuuaaagcagcccaggcaaagaucaucuacagauucuaggaa

SEQ ID NO: 403731 - RNA, 58 nt, Human
gagcgguauuauaccuauguuguauuugcaggcaaaugagauggagcccucucuguaa

SEQ ID NO: 403732 - RNA, 58 nt, Human
cccaaaccgcaggcccugcucuggcaggcaggcaaagcuaggcagaagaggauuccca

SEQ ID NO: 403733 - RNA, 58 nt, Human
gccauuguagaagaucugcugguccuugcaggcaaagcuacagccagaauguccguuu

SEQ ID NO: 403734 - RNA, 58 nt, Human
ccagaaggcuucccuggugcucucaguccaggcaaagcccagagcaucugagcacguc

SEQ ID NO: 403735 - RNA, 58 nt, Human
cauguucaauuauuucccccauuuuucccaggcaaauaaaauucccuaaagccaaaau

SEQ ID NO: 403736 - RNA, 58 nt, Human
gagucucuccugcccucccuccuuccugcaggcaaauauacaagcuagacccuguucc

SEQ ID NO: 403737 - RNA, 58 nt, Human
cacgcucaagacccgcccuuagaccaggcaggcaaaggcccccaucacacucggccac

SEQ ID NO: 403738 - RNA, 58 nt, Human
gaaaaacagucucauuacucauauacagcaggcaaagagacagaaaauuaacugaaaa

SEQ ID NO: 403739 - RNA, 58 nt, Human
gcacuguugcugggcugaccuggcugagcaggcaaaaggugggugcagacuggccucc

SEQ ID NO: 403740 - RNA, 58 nt, Human
gccuuaggccaggcccugggagggcaggcaggcaaaggggagaccagagggucugugu

SEQ ID NO: 403741 - RNA, 58 nt, Human
gccuuugggucuuguucauagugcuguucaggcaaaauggaauagucucaggugggaa

SEQ ID NO: 403742 - RNA, 58 nt, Human
gcuuuaaaaaacacagucacgcaccaagcaggcaaauagcuuuaguccuucucaccuc

SEQ ID NO: 403743 - RNA, 58 nt, Human
uaagaaaacaaacagcccaagugaaaagcaggcaaaagacuugaauagacacuucacc

SEQ ID NO: 403744 - RNA, 58 nt, Human
aggcuggaagacagaaacgaagugaguucaggcaaauucacuguauuguaauuuauuu

SEQ ID NO: 403745 - RNA, 58 nt, Human
uugcuccauucacucccaggugagaauucaggcaaacguccacaaaggucacaggcag

SEQ ID NO: 403746 - RNA, 58 nt, Human
ccugucccaaucauuuucaaaaucuagccaggcaaauuucuguuauauuucaaggccu

SEQ ID NO: 403747 - RNA, 58 nt, Human
gcccuuuaaguaccuuucuguugcagcccaggcaaauaucacuuggccauucagaugg

SEQ ID NO: 403748 - RNA, 58 nt, Human
agaagggauaaucauuaagauaguaaaacaggcaaagcagaaucacaugugcacacac

SEQ ID NO: 403749 - RNA, 58 nt, Human
aauccccacaacuuugucaaauaauguacaggcaaacacuuucaaauauaauuuccuu

SEQ ID NO: 403750 - RNA, 58 nt, Human
acccuuagcguaucuugccaugugucagcaggcaaacuugaggaagcccugguucuau

SEQ ID NO: 403751 - RNA, 58 nt, Human
ugacaagacagaacguuccuugccaggccaggcaaaagccaaggcccauuagccaguu

SEQ ID NO: 403752 - RNA, 58 nt, Human
uguaaggaaaugaaaagaccaaaaucuucaggcaaaaagcaaguugcaaaauuagaaa

SEQ ID NO: 403753 - RNA, 58 nt, Human
uaagaggccugcauauagauaagaauuucaggcaaaacuacauuuauuguuaauaaca

SEQ ID NO: 403754 - RNA, 58 nt, Human
accaagagcaaggaagguaaaaaguuaacaggcaaacauuuucucuuagaaaagguga

SEQ ID NO: 403755 - RNA, 58 nt, Human
caaaggggucagggcaagugugacccaccaggcaaaauugagcagcauuuucauaggg

SEQ ID NO: 403756 - RNA, 58 nt, Human
uugcaaaguggcgugccccuuggccucacaggcaaagaauaacuuaaaagcugacgau

SEQ ID NO: 403757 - RNA, 58 nt, Human
uugauaucccaaucuugcaguccuaacucaggcaaauugugcacugccagaggggccc

SEQ ID NO: 403758 - RNA, 58 nt, Human
gucccccagcaaaggaagacguugcaagcaggcaaaaugcgucgauuuuuuuuuuuug

SEQ ID NO: 403759 - RNA, 64 nt, Human; identical to SEQ ID NO: 403479

SEQ ID NO: 403760 - RNA, 64 nt, Human; identical to SEQ ID NO: 403480

SEQ ID NO: 403761 - RNA, 64 nt, Human; identical to SEQ ID NO: 403481

SEQ ID NO: 403762 - RNA, 64 nt, Human; identical to SEQ ID NO: 403482

SEQ ID NO: 403763 - RNA, 64 nt, Human; identical to SEQ ID NO: 403483

SEQ ID NO: 403764 - RNA, 64 nt, Human; identical to SEQ ID NO: 403484

SEQ ID NO: 403765 - RNA, 64 nt, Human; identical to SEQ ID NO: 403485

SEQ ID NO: 403766 - RNA, 64 nt, Human; identical to SEQ ID NO: 403486

SEQ ID NO: 403767 - RNA, 64 nt, Human; identical to SEQ ID NO: 403487

SEQ ID NO: 403768 - RNA, 64 nt, Human; identical to SEQ ID NO: 403488

SEQ ID NO: 403769 - RNA, 64 nt, Human; identical to SEQ ID NO: 403489

SEQ ID NO: 403770 - RNA, 64 nt, Human; identical to SEQ ID NO: 403490

SEQ ID NO: 403771 - RNA, 64 nt, Human; identical to SEQ ID NO: 403491

SEQ ID NO: 403772 - RNA, 64 nt, Human; identical to SEQ ID NO: 403492

SEQ ID NO: 403773 - RNA, 64 nt, Human; identical to SEQ ID NO: 403493

SEQ ID NO: 403774 - RNA, 64 nt, Human; identical to SEQ ID NO: 403494

SEQ ID NO: 403775 - RNA, 64 nt, Human; identical to SEQ ID NO: 403495

SEQ ID NO: 403776 - RNA, 64 nt, Human; identical to SEQ ID NO: 403496

SEQ ID NO: 403777 - RNA, 64 nt, Human; identical to SEQ ID NO: 403497

SEQ ID NO: 403778 - RNA, 64 nt, Human; identical to SEQ ID NO: 403498

SEQ ID NO: 403779 - RNA, 64 nt, Human; identical to SEQ ID NO: 402829

SEQ ID NO: 403780 - RNA, 64 nt, Human; identical to SEQ ID NO: 402830

SEQ ID NO: 403781 - RNA, 64 nt, Human; identical to SEQ ID NO: 401699

SEQ ID NO: 403782 - RNA, 64 nt, Human; identical to SEQ ID NO: 403243

SEQ ID NO: 403783 - RNA, 64 nt, Human; identical to SEQ ID NO: 403244

SEQ ID NO: 403784 - RNA, 64 nt, Human; identical to SEQ ID NO: 403245

SEQ ID NO: 403785 - RNA, 64 nt, Human; identical to SEQ ID NO: 403246

SEQ ID NO: 403786 - RNA, 64 nt, Human; identical to SEQ ID NO: 403383

SEQ ID NO: 403787 - RNA, 64 nt, Human; identical to SEQ ID NO: 403384

SEQ ID NO: 403788 - RNA, 64 nt, Human; identical to SEQ ID NO: 401700

SEQ ID NO: 403789 - RNA, 64 nt, Human; identical to SEQ ID NO: 403283

SEQ ID NO: 403790 - RNA, 64 nt, Human; identical to SEQ ID NO: 403284

SEQ ID NO: 403791 - RNA, 64 nt, Human; identical to SEQ ID NO: 403285

SEQ ID NO: 403792 - RNA, 64 nt, Human; identical to SEQ ID NO: 403286

SEQ ID NO: 403793 - RNA, 64 nt, Human; identical to SEQ ID NO: 403464

SEQ ID NO: 403794 - RNA, 64 nt, Human; identical to SEQ ID NO: 403465

SEQ ID NO: 403795 - RNA, 64 nt, Human; identical to SEQ ID NO: 401701

SEQ ID NO: 403796 - RNA, 64 nt, Human; identical to SEQ ID NO: 403303

SEQ ID NO: 403797 - RNA, 64 nt, Human; identical to SEQ ID NO: 403304

SEQ ID NO: 403798 - RNA, 64 nt, Human; identical to SEQ ID NO: 403305

SEQ ID NO: 403799 - RNA, 64 nt, Human; identical to SEQ ID NO: 403306

SEQ ID NO: 403800 - RNA, 64 nt, Human; identical to SEQ ID NO: 403223

SEQ ID NO: 403801 - RNA, 64 nt, Human; identical to SEQ ID NO: 403224

SEQ ID NO: 403802 - RNA, 64 nt, Human; identical to SEQ ID NO: 401716

SEQ ID NO: 403803 - RNA, 64 nt, Human; identical to SEQ ID NO: 403343

SEQ ID NO: 403804 - RNA, 64 nt, Human; identical to SEQ ID NO: 403344

SEQ ID NO: 403805 - RNA, 64 nt, Human; identical to SEQ ID NO: 403345

SEQ ID NO: 403806 - RNA, 64 nt, Human; identical to SEQ ID NO: 403346

SEQ ID NO: 403807 - RNA, 64 nt, Human; identical to SEQ ID NO: 403423

SEQ ID NO: 403808 - RNA, 64 nt, Human; identical to SEQ ID NO: 403424

SEQ ID NO: 403809 - RNA, 64 nt, Human; identical to SEQ ID NO: 401717

SEQ ID NO: 403810 - RNA, 64 nt, Human; identical to SEQ ID NO: 403363

SEQ ID NO: 403811 - RNA, 64 nt, Human; identical to SEQ ID NO: 403364

SEQ ID NO: 403812 - RNA, 64 nt, Human; identical to SEQ ID NO: 403365

SEQ ID NO: 403813 - RNA, 64 nt, Human; identical to SEQ ID NO: 403366

SEQ ID NO: 403814 - RNA, 64 nt, Human; identical to SEQ ID NO: 403203

SEQ ID NO: 403815 - RNA, 64 nt, Human; identical to SEQ ID NO: 403204

SEQ ID NO: 403816 - RNA, 64 nt, Human; identical to SEQ ID NO: 401718

SEQ ID NO: 403817 - RNA, 64 nt, Human; identical to SEQ ID NO: 403385

SEQ ID NO: 403818 - RNA, 64 nt, Human; identical to SEQ ID NO: 403386

SEQ ID NO: 403819 - RNA, 64 nt, Human; identical to SEQ ID NO: 403475

SEQ ID NO: 403820 - RNA, 64 nt, Human; identical to SEQ ID NO: 403476

SEQ ID NO: 403821 - RNA, 64 nt, Human; identical to SEQ ID NO: 401722

SEQ ID NO: 403822 - RNA, 64 nt, Human; identical to SEQ ID NO: 403425

SEQ ID NO: 403823 - RNA, 64 nt, Human; identical to SEQ ID NO: 403426

SEQ ID NO: 403824 - RNA, 64 nt, Human; identical to SEQ ID NO: 403403

SEQ ID NO: 403825 - RNA, 64 nt, Human; identical to SEQ ID NO: 403404

SEQ ID NO: 403826 - RNA, 64 nt, Human; identical to SEQ ID NO: 401723

SEQ ID NO: 403827 - RNA, 64 nt, Human; identical to SEQ ID NO: 403443

SEQ ID NO: 403828 - RNA, 64 nt, Human; identical to SEQ ID NO: 403444

SEQ ID NO: 403829 - RNA, 64 nt, Human; identical to SEQ ID NO: 403445

SEQ ID NO: 403830 - RNA, 64 nt, Human; identical to SEQ ID NO: 403446

SEQ ID NO: 403831 - RNA, 64 nt, Human; identical to SEQ ID NO: 403225

SEQ ID NO: 403832 - RNA, 64 nt, Human; identical to SEQ ID NO: 403226

SEQ ID NO: 403833 - RNA, 64 nt, Human; identical to SEQ ID NO: 401724

SEQ ID NO: 403834 - RNA, 64 nt, Human; identical to SEQ ID NO: 403477

SEQ ID NO: 403835 - RNA, 64 nt, Human; identical to SEQ ID NO: 403478

SEQ ID NO: 403836 - RNA, 64 nt, Human; identical to SEQ ID NO: 403023

SEQ ID NO: 403837 - RNA, 64 nt, Human; identical to SEQ ID NO: 403024

SEQ ID NO: 403838 - RNA, 64 nt, Human; identical to SEQ ID NO: 401725

SEQ ID NO: 403839 - RNA, 64 nt, Human; identical to SEQ ID NO: 403003

SEQ ID NO: 403840 - RNA, 64 nt, Human; identical to SEQ ID NO: 403004

SEQ ID NO: 403841 - RNA, 64 nt, Human; identical to SEQ ID NO: 403005

SEQ ID NO: 403842 - RNA, 64 nt, Human; identical to SEQ ID NO: 403006

SEQ ID NO: 403843 - RNA, 64 nt, Human; identical to SEQ ID NO: 403025

SEQ ID NO: 403844 - RNA, 64 nt, Human; identical to SEQ ID NO: 403026

SEQ ID NO: 403845 - RNA, 64 nt, Human; identical to SEQ ID NO: 401744

SEQ ID NO: 403846 - RNA, 64 nt, Human; identical to SEQ ID NO: 403063

SEQ ID NO: 403847 - RNA, 64 nt, Human; identical to SEQ ID NO: 403064

SEQ ID NO: 403848 - RNA, 64 nt, Human; identical to SEQ ID NO: 403065

SEQ ID NO: 403849 - RNA, 64 nt, Human; identical to SEQ ID NO: 403066

SEQ ID NO: 403850 - RNA, 64 nt, Human; identical to SEQ ID NO: 403083

SEQ ID NO: 403851 - RNA, 64 nt, Human; identical to SEQ ID NO: 403084

SEQ ID NO: 403852 - RNA, 64 nt, Human; identical to SEQ ID NO: 401761

SEQ ID NO: 403853 - RNA, 64 nt, Human; identical to SEQ ID NO: 403103

SEQ ID NO: 403854 - RNA, 64 nt, Human; identical to SEQ ID NO: 403104

SEQ ID NO: 403855 - RNA, 64 nt, Human; identical to SEQ ID NO: 403105

SEQ ID NO: 403856 - RNA, 64 nt, Human; identical to SEQ ID NO: 403106

SEQ ID NO: 403857 - RNA, 64 nt, Human; identical to SEQ ID NO: 403183

SEQ ID NO: 403858 - RNA, 64 nt, Human; identical to SEQ ID NO: 403184

SEQ ID NO: 403859 - RNA, 64 nt, Human; identical to SEQ ID NO: 401762

SEQ ID NO: 403860 - RNA, 64 nt, Human; identical to SEQ ID NO: 403123

SEQ ID NO: 403861 - RNA, 64 nt, Human; identical to SEQ ID NO: 403124

SEQ ID NO: 403862 - RNA, 64 nt, Human; identical to SEQ ID NO: 403125

SEQ ID NO: 403863 - RNA, 64 nt, Human; identical to SEQ ID NO: 403126

SEQ ID NO: 403864 - RNA, 64 nt, Human; identical to SEQ ID NO: 402906

SEQ ID NO: 403865 - RNA, 64 nt, Human; identical to SEQ ID NO: 402907

SEQ ID NO: 403866 - RNA, 64 nt, Human; identical to SEQ ID NO: 401763

SEQ ID NO: 403867 - RNA, 64 nt, Human; identical to SEQ ID NO: 403143

SEQ ID NO: 403868 - RNA, 64 nt, Human; identical to SEQ ID NO: 403144

SEQ ID NO: 403869 - RNA, 64 nt, Human; identical to SEQ ID NO: 403145

SEQ ID NO: 403870 - RNA, 64 nt, Human; identical to SEQ ID NO: 403146

SEQ ID NO: 403871 - RNA, 64 nt, Human; identical to SEQ ID NO: 403163

SEQ ID NO: 403872 - RNA, 64 nt, Human; identical to SEQ ID NO: 403164

SEQ ID NO: 403873 - RNA, 64 nt, Human; identical to SEQ ID NO: 401780

SEQ ID NO: 403874 - RNA, 58 nt, Human; identical to SEQ ID NO: 403185

SEQ ID NO: 403875 - RNA, 58 nt, Human; identical to SEQ ID NO: 403186

SEQ ID NO: 403876 - RNA, 58 nt, Human; identical to SEQ ID NO: 402908

SEQ ID NO: 403877 - RNA, 58 nt, Human; identical to SEQ ID NO: 402909

SEQ ID NO: 403878 - RNA, 58 nt, Human; identical to SEQ ID NO: 401781

SEQ ID NO: 403879 - RNA, 58 nt, Human; identical to SEQ ID NO: 403263

SEQ ID NO: 403880 - RNA, 58 nt, Human; identical to SEQ ID NO: 403264

SEQ ID NO: 403881 - RNA, 58 nt, Human; identical to SEQ ID NO: 403265

SEQ ID NO: 403882 - RNA, 58 nt, Human; identical to SEQ ID NO: 403266

SEQ ID NO: 403883 - RNA, 58 nt, Human; identical to SEQ ID NO: 403323

SEQ ID NO: 403884 - RNA, 58 nt, Human; identical to SEQ ID NO: 403324

SEQ ID NO: 403885 - RNA, 58 nt, Human; identical to SEQ ID NO: 401782

SEQ ID NO: 403886 - RNA, 58 nt, Human; identical to SEQ ID NO: 403325

SEQ ID NO: 403887 - RNA, 58 nt, Human; identical to SEQ ID NO: 403326

SEQ ID NO: 403888 - RNA, 58 nt, Human; identical to SEQ ID NO: 403085

SEQ ID NO: 403889 - RNA, 58 nt, Human; identical to SEQ ID NO: 403086

SEQ ID NO: 403890 - RNA, 58 nt, Human; identical to SEQ ID NO: 401799

SEQ ID NO: 403891 - RNA, 58 nt, Human; identical to SEQ ID NO: 401800

SEQ ID NO: 403892 - RNA, 58 nt, Human; identical to SEQ ID NO: 401801

SEQ ID NO: 403893 - RNA, 58 nt, Human; identical to SEQ ID NO: 401802

SEQ ID NO: 403894 - RNA, 58 nt, Human; identical to SEQ ID NO: 401819

SEQ ID NO: 403895 - RNA, 58 nt, Human; identical to SEQ ID NO: 401820

SEQ ID NO: 403896 - RNA, 58 nt, Human; identical to SEQ ID NO: 401821

SEQ ID NO: 403897 - RNA, 58 nt, Human; identical to SEQ ID NO: 402944

SEQ ID NO: 403898 - RNA, 58 nt, Human; identical to SEQ ID NO: 402945

SEQ ID NO: 403899 - RNA, 58 nt, Human; identical to SEQ ID NO: 402946

SEQ ID NO: 403900 - RNA, 58 nt, Human; identical to SEQ ID NO: 402947

SEQ ID NO: 403901 - RNA, 58 nt, Human; identical to SEQ ID NO: 402983

SEQ ID NO: 403902 - RNA, 58 nt, Human; identical to SEQ ID NO: 402984

SEQ ID NO: 403903 - RNA, 58 nt, Human; identical to SEQ ID NO: 402985

SEQ ID NO: 403904 - RNA, 58 nt, Human; identical to SEQ ID NO: 402986

SEQ ID NO: 403905 - RNA, 58 nt, Human; identical to SEQ ID NO: 403043

SEQ ID NO: 403906 - RNA, 58 nt, Human; identical to SEQ ID NO: 403044

SEQ ID NO: 403907 - RNA, 58 nt, Human; identical to SEQ ID NO: 403045

SEQ ID NO: 403908 - RNA, 58 nt, Human; identical to SEQ ID NO: 403046

SEQ ID NO: 403909 - RNA, 58 nt, Human; identical to SEQ ID NO: 403165

SEQ ID NO: 403910 - RNA, 58 nt, Human; identical to SEQ ID NO: 403166

SEQ ID NO: 403911 - RNA, 58 nt, Human; identical to SEQ ID NO: 403205

SEQ ID NO: 403912 - RNA, 58 nt, Human; identical to SEQ ID NO: 403206

SEQ ID NO: 403913 - RNA, 58 nt, Human; identical to SEQ ID NO: 403405

SEQ ID NO: 403914 - RNA, 58 nt, Human; identical to SEQ ID NO: 403406

SEQ ID NO: 403915 - RNA, 58 nt, Human; identical to SEQ ID NO: 403499

SEQ ID NO: 403916 - RNA, 58 nt, Human; identical to SEQ ID NO: 403500

SEQ ID NO: 403917 - RNA, 58 nt, Human; identical to SEQ ID NO: 403501

SEQ ID NO: 403918 - RNA, 58 nt, Human; identical to SEQ ID NO: 403502

SEQ ID NO: 403919 - RNA, 58 nt, Human; identical to SEQ ID NO: 403503

SEQ ID NO: 403920 - RNA, 58 nt, Human; identical to SEQ ID NO: 403504

SEQ ID NO: 403921 - RNA, 58 nt, Human; identical to SEQ ID NO: 403505

SEQ ID NO: 403922 - RNA, 58 nt, Human; identical to SEQ ID NO: 403506

SEQ ID NO: 403923 - RNA, 58 nt, Human; identical to SEQ ID NO: 403507

SEQ ID NO: 403924 - RNA, 58 nt, Human; identical to SEQ ID NO: 403508

SEQ ID NO: 403925 - RNA, 58 nt, Human; identical to SEQ ID NO: 403509

SEQ ID NO: 403926 - RNA, 58 nt, Human; identical to SEQ ID NO: 403510

SEQ ID NO: 403927 - RNA, 58 nt, Human; identical to SEQ ID NO: 403511

SEQ ID NO: 403928 - RNA, 58 nt, Human; identical to SEQ ID NO: 403512

SEQ ID NO: 403929 - RNA, 58 nt, Human; identical to SEQ ID NO: 403513

SEQ ID NO: 403930 - RNA, 58 nt, Human; identical to SEQ ID NO: 403514

SEQ ID NO: 403931 - RNA, 58 nt, Human; identical to SEQ ID NO: 403515

SEQ ID NO: 403932 - RNA, 58 nt, Human; identical to SEQ ID NO: 403516

SEQ ID NO: 403933 - RNA, 58 nt, Human; identical to SEQ ID NO: 403517

SEQ ID NO: 403934 - RNA, 58 nt, Human; identical to SEQ ID NO: 403518

SEQ ID NO: 403935 - RNA, 58 nt, Human; identical to SEQ ID NO: 403519

SEQ ID NO: 403936 - RNA, 58 nt, Human; identical to SEQ ID NO: 403520

SEQ ID NO: 403937 - RNA, 58 nt, Human; identical to SEQ ID NO: 403521

SEQ ID NO: 403938 - RNA, 58 nt, Human; identical to SEQ ID NO: 403522

SEQ ID NO: 403939 - RNA, 58 nt, Human; identical to SEQ ID NO: 403523

SEQ ID NO: 403940 - RNA, 58 nt, Human; identical to SEQ ID NO: 403524

SEQ ID NO: 403941 - RNA, 58 nt, Human; identical to SEQ ID NO: 403525

SEQ ID NO: 403942 - RNA, 58 nt, Human; identical to SEQ ID NO: 403526

SEQ ID NO: 403943 - RNA, 58 nt, Human; identical to SEQ ID NO: 403527

SEQ ID NO: 403944 - RNA, 58 nt, Human; identical to SEQ ID NO: 403528

SEQ ID NO: 403945 - RNA, 58 nt, Human; identical to SEQ ID NO: 403529

SEQ ID NO: 403946 - RNA, 58 nt, Human; identical to SEQ ID NO: 403530

SEQ ID NO: 403947 - RNA, 58 nt, Human; identical to SEQ ID NO: 403531

SEQ ID NO: 403948 - RNA, 58 nt, Human; identical to SEQ ID NO: 403532

SEQ ID NO: 403949 - RNA, 58 nt, Human; identical to SEQ ID NO: 403533

SEQ ID NO: 403950 - RNA, 58 nt, Human; identical to SEQ ID NO: 403534

SEQ ID NO: 403951 - RNA, 58 nt, Human; identical to SEQ ID NO: 403535

SEQ ID NO: 403952 - RNA, 58 nt, Human; identical to SEQ ID NO: 403536

SEQ ID NO: 403953 - RNA, 58 nt, Human; identical to SEQ ID NO: 403537

SEQ ID NO: 403954 - RNA, 58 nt, Human; identical to SEQ ID NO: 403538

SEQ ID NO: 403955 - RNA, 58 nt, Human; identical to SEQ ID NO: 403539

SEQ ID NO: 403956 - RNA, 58 nt, Human; identical to SEQ ID NO: 403540

SEQ ID NO: 403957 - RNA, 58 nt, Human; identical to SEQ ID NO: 403541

SEQ ID NO: 403958 - RNA, 58 nt, Human; identical to SEQ ID NO: 403542

SEQ ID NO: 403959 - RNA, 58 nt, Human; identical to SEQ ID NO: 403543

SEQ ID NO: 403960 - RNA, 58 nt, Human; identical to SEQ ID NO: 403544

SEQ ID NO: 403961 - RNA, 58 nt, Human; identical to SEQ ID NO: 403545

SEQ ID NO: 403962 - RNA, 58 nt, Human; identical to SEQ ID NO: 403546

SEQ ID NO: 403963 - RNA, 58 nt, Human; identical to SEQ ID NO: 403547

SEQ ID NO: 403964 - RNA, 58 nt, Human; identical to SEQ ID NO: 403548

SEQ ID NO: 403965 - RNA, 58 nt, Human; identical to SEQ ID NO: 403549

SEQ ID NO: 403966 - RNA, 58 nt, Human; identical to SEQ ID NO: 403550

SEQ ID NO: 403967 - RNA, 58 nt, Human; identical to SEQ ID NO: 403551

SEQ ID NO: 403968 - RNA, 58 nt, Human; identical to SEQ ID NO: 403552

SEQ ID NO: 403969 - RNA, 58 nt, Human; identical to SEQ ID NO: 403553

SEQ ID NO: 403970 - RNA, 58 nt, Human; identical to SEQ ID NO: 403554

SEQ ID NO: 403971 - RNA, 58 nt, Human; identical to SEQ ID NO: 403555

SEQ ID NO: 403972 - RNA, 58 nt, Human; identical to SEQ ID NO: 403556

SEQ ID NO: 403973 - RNA, 58 nt, Human; identical to SEQ ID NO: 403557

SEQ ID NO: 403974 - RNA, 58 nt, Human; identical to SEQ ID NO: 403558

SEQ ID NO: 403975 - RNA, 58 nt, Human; identical to SEQ ID NO: 403559

SEQ ID NO: 403976 - RNA, 58 nt, Human; identical to SEQ ID NO: 403560

SEQ ID NO: 403977 - RNA, 58 nt, Human; identical to SEQ ID NO: 403561

SEQ ID NO: 403978 - RNA, 58 nt, Human; identical to SEQ ID NO: 403562

SEQ ID NO: 403979 - RNA, 58 nt, Human; identical to SEQ ID NO: 403563

SEQ ID NO: 403980 - RNA, 58 nt, Human; identical to SEQ ID NO: 403564

SEQ ID NO: 403981 - RNA, 58 nt, Human; identical to SEQ ID NO: 403565

SEQ ID NO: 403982 - RNA, 58 nt, Human; identical to SEQ ID NO: 403566

SEQ ID NO: 403983 - RNA, 58 nt, Human; identical to SEQ ID NO: 403567

SEQ ID NO: 403984 - RNA, 58 nt, Human; identical to SEQ ID NO: 403568

SEQ ID NO: 403985 - RNA, 58 nt, Human; identical to SEQ ID NO: 403569

SEQ ID NO: 403986 - RNA, 58 nt, Human; identical to SEQ ID NO: 403570

SEQ ID NO: 403987 - RNA, 58 nt, Human; identical to SEQ ID NO: 403571

SEQ ID NO: 403988 - RNA, 58 nt, Human; identical to SEQ ID NO: 403572

SEQ ID NO: 403989 - RNA, 58 nt, Human; identical to SEQ ID NO: 403573

SEQ ID NO: 403990 - RNA, 58 nt, Human; identical to SEQ ID NO: 403574

SEQ ID NO: 403991 - RNA, 58 nt, Human; identical to SEQ ID NO: 403575

SEQ ID NO: 403992 - RNA, 58 nt, Human; identical to SEQ ID NO: 403576

SEQ ID NO: 403993 - RNA, 58 nt, Human; identical to SEQ ID NO: 403577

SEQ ID NO: 403994 - RNA, 58 nt, Human; identical to SEQ ID NO: 403578

SEQ ID NO: 403995 - RNA, 58 nt, Human; identical to SEQ ID NO: 403579

SEQ ID NO: 403996 - RNA, 58 nt, Human; identical to SEQ ID NO: 403580

SEQ ID NO: 403997 - RNA, 58 nt, Human; identical to SEQ ID NO: 403581

SEQ ID NO: 403998 - RNA, 58 nt, Human; identical to SEQ ID NO: 403582

SEQ ID NO: 403999 - RNA, 58 nt, Human; identical to SEQ ID NO: 403583

SEQ ID NO: 404000 - RNA, 58 nt, Human; identical to SEQ ID NO: 403584

SEQ ID NO: 404001 - RNA, 58 nt, Human; identical to SEQ ID NO: 403585

SEQ ID NO: 404002 - RNA, 58 nt, Human; identical to SEQ ID NO: 403586

SEQ ID NO: 404003 - RNA, 58 nt, Human; identical to SEQ ID NO: 403587

SEQ ID NO: 404004 - RNA, 58 nt, Human; identical to SEQ ID NO: 403588

SEQ ID NO: 404005 - RNA, 58 nt, Human; identical to SEQ ID NO: 403589

SEQ ID NO: 404006 - RNA, 58 nt, Human; identical to SEQ ID NO: 403590

SEQ ID NO: 404007 - RNA, 58 nt, Human; identical to SEQ ID NO: 403591

SEQ ID NO: 404008 - RNA, 58 nt, Human; identical to SEQ ID NO: 403592

SEQ ID NO: 404009 - RNA, 58 nt, Human; identical to SEQ ID NO: 403593

SEQ ID NO: 404010 - RNA, 58 nt, Human; identical to SEQ ID NO: 403594

SEQ ID NO: 404011 - RNA, 58 nt, Human; identical to SEQ ID NO: 403595

SEQ ID NO: 404012 - RNA, 58 nt, Human; identical to SEQ ID NO: 403596

SEQ ID NO: 404013 - RNA, 58 nt, Human; identical to SEQ ID NO: 403597

SEQ ID NO: 404014 - RNA, 58 nt, Human; identical to SEQ ID NO: 403598

SEQ ID NO: 404015 - RNA, 58 nt, Human; identical to SEQ ID NO: 403599

SEQ ID NO: 404016 - RNA, 58 nt, Human; identical to SEQ ID NO: 403600

SEQ ID NO: 404017 - RNA, 58 nt, Human; identical to SEQ ID NO: 403601

SEQ ID NO: 404018 - RNA, 58 nt, Human; identical to SEQ ID NO: 403602

SEQ ID NO: 404019 - RNA, 58 nt, Human; identical to SEQ ID NO: 403603

SEQ ID NO: 404020 - RNA, 58 nt, Human; identical to SEQ ID NO: 403604

SEQ ID NO: 404021 - RNA, 58 nt, Human; identical to SEQ ID NO: 403605

SEQ ID NO: 404022 - RNA, 58 nt, Human; identical to SEQ ID NO: 403606

SEQ ID NO: 404023 - RNA, 58 nt, Human; identical to SEQ ID NO: 403607

SEQ ID NO: 404024 - RNA, 58 nt, Human; identical to SEQ ID NO: 403608

SEQ ID NO: 404025 - RNA, 58 nt, Human; identical to SEQ ID NO: 403609

SEQ ID NO: 404026 - RNA, 58 nt, Human; identical to SEQ ID NO: 403610

SEQ ID NO: 404027 - RNA, 58 nt, Human; identical to SEQ ID NO: 403611

SEQ ID NO: 404028 - RNA, 58 nt, Human; identical to SEQ ID NO: 403612

SEQ ID NO: 404029 - RNA, 58 nt, Human; identical to SEQ ID NO: 403613

SEQ ID NO: 404030 - RNA, 58 nt, Human; identical to SEQ ID NO: 403614

SEQ ID NO: 404031 - RNA, 58 nt, Human; identical to SEQ ID NO: 403615

SEQ ID NO: 404032 - RNA, 58 nt, Human; identical to SEQ ID NO: 403616

SEQ ID NO: 404033 - RNA, 58 nt, Human; identical to SEQ ID NO: 403617

SEQ ID NO: 404034 - RNA, 58 nt, Human; identical to SEQ ID NO: 403618

SEQ ID NO: 404035 - RNA, 58 nt, Human; identical to SEQ ID NO: 403619

SEQ ID NO: 404036 - RNA, 58 nt, Human; identical to SEQ ID NO: 403620

SEQ ID NO: 404037 - RNA, 58 nt, Human; identical to SEQ ID NO: 403621

SEQ ID NO: 404038 - RNA, 58 nt, Human; identical to SEQ ID NO: 403622

SEQ ID NO: 404039 - RNA, 58 nt, Human; identical to SEQ ID NO: 403623

SEQ ID NO: 404040 - RNA, 58 nt, Human; identical to SEQ ID NO: 403624

SEQ ID NO: 404041 - RNA, 58 nt, Human; identical to SEQ ID NO: 403625

SEQ ID NO: 404042 - RNA, 58 nt, Human; identical to SEQ ID NO: 403626

SEQ ID NO: 404043 - RNA, 58 nt, Human; identical to SEQ ID NO: 403627

SEQ ID NO: 404044 - RNA, 58 nt, Human; identical to SEQ ID NO: 403628

SEQ ID NO: 404045 - RNA, 58 nt, Human; identical to SEQ ID NO: 403629

SEQ ID NO: 404046 - RNA, 58 nt, Human; identical to SEQ ID NO: 403630

SEQ ID NO: 404047 - RNA, 58 nt, Human; identical to SEQ ID NO: 403631

SEQ ID NO: 404048 - RNA, 58 nt, Human; identical to SEQ ID NO: 403632

SEQ ID NO: 404049 - RNA, 58 nt, Human; identical to SEQ ID NO: 403633

SEQ ID NO: 404050 - RNA, 58 nt, Human; identical to SEQ ID NO: 403634

SEQ ID NO: 404051 - RNA, 58 nt, Human; identical to SEQ ID NO: 403635

SEQ ID NO: 404052 - RNA, 58 nt, Human; identical to SEQ ID NO: 403636

SEQ ID NO: 404053 - RNA, 58 nt, Human; identical to SEQ ID NO: 403637

SEQ ID NO: 404054 - RNA, 58 nt, Human; identical to SEQ ID NO: 403638

SEQ ID NO: 404055 - RNA, 58 nt, Human; identical to SEQ ID NO: 403639

SEQ ID NO: 404056 - RNA, 58 nt, Human; identical to SEQ ID NO: 403640

SEQ ID NO: 404057 - RNA, 58 nt, Human; identical to SEQ ID NO: 403641

SEQ ID NO: 404058 - RNA, 58 nt, Human; identical to SEQ ID NO: 403642

SEQ ID NO: 404059 - RNA, 58 nt, Human; identical to SEQ ID NO: 403643

SEQ ID NO: 404060 - RNA, 58 nt, Human; identical to SEQ ID NO: 403644

SEQ ID NO: 404061 - RNA, 58 nt, Human; identical to SEQ ID NO: 403645

SEQ ID NO: 404062 - RNA, 58 nt, Human; identical to SEQ ID NO: 403646

SEQ ID NO: 404063 - RNA, 58 nt, Human; identical to SEQ ID NO: 403647

SEQ ID NO: 404064 - RNA, 58 nt, Human; identical to SEQ ID NO: 403648

SEQ ID NO: 404065 - RNA, 58 nt, Human; identical to SEQ ID NO: 403649

SEQ ID NO: 404066 - RNA, 58 nt, Human; identical to SEQ ID NO: 403650

SEQ ID NO: 404067 - RNA, 58 nt, Human; identical to SEQ ID NO: 403651

SEQ ID NO: 404068 - RNA, 58 nt, Human; identical to SEQ ID NO: 403652

SEQ ID NO: 404069 - RNA, 58 nt, Human; identical to SEQ ID NO: 403653

SEQ ID NO: 404070 - RNA, 58 nt, Human; identical to SEQ ID NO: 403654

SEQ ID NO: 404071 - RNA, 58 nt, Human; identical to SEQ ID NO: 403655

SEQ ID NO: 404072 - RNA, 58 nt, Human; identical to SEQ ID NO: 403656

SEQ ID NO: 404073 - RNA, 58 nt, Human; identical to SEQ ID NO: 403657

SEQ ID NO: 404074 - RNA, 58 nt, Human; identical to SEQ ID NO: 403658

SEQ ID NO: 404075 - RNA, 58 nt, Human; identical to SEQ ID NO: 403659

SEQ ID NO: 404076 - RNA, 58 nt, Human; identical to SEQ ID NO: 403660

SEQ ID NO: 404077 - RNA, 58 nt, Human; identical to SEQ ID NO: 403661

SEQ ID NO: 404078 - RNA, 58 nt, Human; identical to SEQ ID NO: 403662

SEQ ID NO: 404079 - RNA, 58 nt, Human; identical to SEQ ID NO: 403663

SEQ ID NO: 404080 - RNA, 58 nt, Human; identical to SEQ ID NO: 403664

SEQ ID NO: 404081 - RNA, 58 nt, Human; identical to SEQ ID NO: 403665

SEQ ID NO: 404082 - RNA, 58 nt, Human; identical to SEQ ID NO: 403666

SEQ ID NO: 404083 - RNA, 58 nt, Human; identical to SEQ ID NO: 403667

SEQ ID NO: 404084 - RNA, 58 nt, Human; identical to SEQ ID NO: 403668

SEQ ID NO: 404085 - RNA, 58 nt, Human; identical to SEQ ID NO: 403669

SEQ ID NO: 404086 - RNA, 58 nt, Human; identical to SEQ ID NO: 403670

SEQ ID NO: 404087 - RNA, 58 nt, Human; identical to SEQ ID NO: 403671

SEQ ID NO: 404088 - RNA, 58 nt, Human; identical to SEQ ID NO: 403672

SEQ ID NO: 404089 - RNA, 58 nt, Human; identical to SEQ ID NO: 403673

SEQ ID NO: 404090 - RNA, 58 nt, Human; identical to SEQ ID NO: 403674

SEQ ID NO: 404091 - RNA, 58 nt, Human; identical to SEQ ID NO: 403675

SEQ ID NO: 404092 - RNA, 58 nt, Human; identical to SEQ ID NO: 403676

SEQ ID NO: 404093 - RNA, 58 nt, Human; identical to SEQ ID NO: 403677

SEQ ID NO: 404094 - RNA, 58 nt, Human; identical to SEQ ID NO: 403678

SEQ ID NO: 404095 - RNA, 58 nt, Human; identical to SEQ ID NO: 403679

SEQ ID NO: 404096 - RNA, 58 nt, Human; identical to SEQ ID NO: 403680

SEQ ID NO: 404097 - RNA, 58 nt, Human; identical to SEQ ID NO: 403681

SEQ ID NO: 404098 - RNA, 58 nt, Human; identical to SEQ ID NO: 403682

SEQ ID NO: 404099 - RNA, 58 nt, Human; identical to SEQ ID NO: 403683

SEQ ID NO: 404100 - RNA, 58 nt, Human; identical to SEQ ID NO: 403684

SEQ ID NO: 404101 - RNA, 58 nt, Human; identical to SEQ ID NO: 403685

SEQ ID NO: 404102 - RNA, 58 nt, Human; identical to SEQ ID NO: 403686

SEQ ID NO: 404103 - RNA, 58 nt, Human; identical to SEQ ID NO: 403687

SEQ ID NO: 404104 - RNA, 58 nt, Human; identical to SEQ ID NO: 403688

SEQ ID NO: 404105 - RNA, 58 nt, Human; identical to SEQ ID NO: 403689

SEQ ID NO: 404106 - RNA, 58 nt, Human; identical to SEQ ID NO: 403690

SEQ ID NO: 404107 - RNA, 58 nt, Human; identical to SEQ ID NO: 403691

SEQ ID NO: 404108 - RNA, 58 nt, Human; identical to SEQ ID NO: 403692

SEQ ID NO: 404109 - RNA, 58 nt, Human; identical to SEQ ID NO: 403693

SEQ ID NO: 404110 - RNA, 58 nt, Human; identical to SEQ ID NO: 403694

SEQ ID NO: 404111 - RNA, 58 nt, Human; identical to SEQ ID NO: 403695

SEQ ID NO: 404112 - RNA, 58 nt, Human; identical to SEQ ID NO: 403696

SEQ ID NO: 404113 - RNA, 58 nt, Human; identical to SEQ ID NO: 403697

SEQ ID NO: 404114 - RNA, 58 nt, Human; identical to SEQ ID NO: 403698

SEQ ID NO: 404115 - RNA, 58 nt, Human; identical to SEQ ID NO: 403699

SEQ ID NO: 404116 - RNA, 58 nt, Human; identical to SEQ ID NO: 403700

SEQ ID NO: 404117 - RNA, 58 nt, Human; identical to SEQ ID NO: 403701

SEQ ID NO: 404118 - RNA, 58 nt, Human; identical to SEQ ID NO: 403702

SEQ ID NO: 404119 - RNA, 58 nt, Human; identical to SEQ ID NO: 403703

SEQ ID NO: 404120 - RNA, 58 nt, Human; identical to SEQ ID NO: 403704

SEQ ID NO: 404121 - RNA, 58 nt, Human; identical to SEQ ID NO: 403705

SEQ ID NO: 404122 - RNA, 58 nt, Human; identical to SEQ ID NO: 403706

SEQ ID NO: 404123 - RNA, 58 nt, Human; identical to SEQ ID NO: 403707

SEQ ID NO: 404124 - RNA, 58 nt, Human; identical to SEQ ID NO: 403708

SEQ ID NO: 404125 - RNA, 58 nt, Human; identical to SEQ ID NO: 403709

SEQ ID NO: 404126 - RNA, 58 nt, Human; identical to SEQ ID NO: 403710

SEQ ID NO: 404127 - RNA, 58 nt, Human; identical to SEQ ID NO: 403711

SEQ ID NO: 404128 - RNA, 58 nt, Human; identical to SEQ ID NO: 403712

SEQ ID NO: 404129 - RNA, 58 nt, Human; identical to SEQ ID NO: 403713

SEQ ID NO: 404130 - RNA, 58 nt, Human; identical to SEQ ID NO: 403714

SEQ ID NO: 404131 - RNA, 58 nt, Human; identical to SEQ ID NO: 403715

SEQ ID NO: 404132 - RNA, 58 nt, Human; identical to SEQ ID NO: 403716

SEQ ID NO: 404133 - RNA, 58 nt, Human; identical to SEQ ID NO: 403717

SEQ ID NO: 404134 - RNA, 58 nt, Human; identical to SEQ ID NO: 403718

SEQ ID NO: 404135 - RNA, 58 nt, Human; identical to SEQ ID NO: 403719

SEQ ID NO: 404136 - RNA, 58 nt, Human; identical to SEQ ID NO: 403720

SEQ ID NO: 404137 - RNA, 58 nt, Human; identical to SEQ ID NO: 403721

SEQ ID NO: 404138 - RNA, 58 nt, Human; identical to SEQ ID NO: 403722

SEQ ID NO: 404139 - RNA, 58 nt, Human; identical to SEQ ID NO: 403723

SEQ ID NO: 404140 - RNA, 58 nt, Human; identical to SEQ ID NO: 403724

SEQ ID NO: 404141 - RNA, 58 nt, Human; identical to SEQ ID NO: 403725

SEQ ID NO: 404142 - RNA, 58 nt, Human; identical to SEQ ID NO: 403726

SEQ ID NO: 404143 - RNA, 58 nt, Human; identical to SEQ ID NO: 403727

SEQ ID NO: 404144 - RNA, 58 nt, Human; identical to SEQ ID NO: 403728

SEQ ID NO: 404145 - RNA, 58 nt, Human; identical to SEQ ID NO: 403729

SEQ ID NO: 404146 - RNA, 58 nt, Human; identical to SEQ ID NO: 403730

SEQ ID NO: 404147 - RNA, 58 nt, Human; identical to SEQ ID NO: 403731

SEQ ID NO: 404148 - RNA, 58 nt, Human; identical to SEQ ID NO: 403732

SEQ ID NO: 404149 - RNA, 58 nt, Human; identical to SEQ ID NO: 403733

SEQ ID NO: 404150 - RNA, 58 nt, Human; identical to SEQ ID NO: 403734

SEQ ID NO: 404151 - RNA, 58 nt, Human; identical to SEQ ID NO: 403735

SEQ ID NO: 404152 - RNA, 58 nt, Human; identical to SEQ ID NO: 403736

SEQ ID NO: 404153 - RNA, 58 nt, Human; identical to SEQ ID NO: 403737

SEQ ID NO: 404154 - RNA, 58 nt, Human; identical to SEQ ID NO: 403738

SEQ ID NO: 404155 - RNA, 58 nt, Human; identical to SEQ ID NO: 403739

SEQ ID NO: 404156 - RNA, 58 nt, Human; identical to SEQ ID NO: 403740

SEQ ID NO: 404157 - RNA, 58 nt, Human; identical to SEQ ID NO: 403741

SEQ ID NO: 404158 - RNA, 58 nt, Human; identical to SEQ ID NO: 403742

SEQ ID NO: 404159 - RNA, 58 nt, Human; identical to SEQ ID NO: 403743

SEQ ID NO: 404160 - RNA, 58 nt, Human; identical to SEQ ID NO: 403744

SEQ ID NO: 404161 - RNA, 58 nt, Human; identical to SEQ ID NO: 403745

SEQ ID NO: 404162 - RNA, 58 nt, Human; identical to SEQ ID NO: 403746

SEQ ID NO: 404163 - RNA, 58 nt, Human; identical to SEQ ID NO: 403747

SEQ ID NO: 404164 - RNA, 58 nt, Human; identical to SEQ ID NO: 403748

SEQ ID NO: 404165 - RNA, 58 nt, Human; identical to SEQ ID NO: 403749

SEQ ID NO: 404166 - RNA, 58 nt, Human; identical to SEQ ID NO: 403750

SEQ ID NO: 404167 - RNA, 58 nt, Human; identical to SEQ ID NO: 403751

SEQ ID NO: 404168 - RNA, 58 nt, Human; identical to SEQ ID NO: 403752

SEQ ID NO: 404169 - RNA, 58 nt, Human; identical to SEQ ID NO: 403753

SEQ ID NO: 404170 - RNA, 58 nt, Human; identical to SEQ ID NO: 403754

SEQ ID NO: 404171 - RNA, 58 nt, Human; identical to SEQ ID NO: 403755

SEQ ID NO: 404172 - RNA, 58 nt, Human; identical to SEQ ID NO: 403756

SEQ ID NO: 404173 - RNA, 58 nt, Human; identical to SEQ ID NO: 403757

SEQ ID NO: 404174 - RNA, 58 nt, Human; identical to SEQ ID NO: 403758

SEQ ID NO: 404175 - RNA, 64 nt, Human; identical to SEQ ID NO: 275019

SEQ ID NO: 404176 - RNA, 64 nt, Human; identical to SEQ ID NO: 275019

SEQ ID NO: 404177 - RNA, 64 nt, Human; identical to SEQ ID NO: 275021

SEQ ID NO: 404178 - RNA, 64 nt, Human; identical to SEQ ID NO: 275022

SEQ ID NO: 404179 - RNA, 64 nt, Human
ucauuaaagacaugaauuuagaauugauuucuuugagugguauuucucuugauugagcagcuag

SEQ ID NO: 404180 - RNA, 64 nt, Human
acggauguauggauguucuugaacauuucagaaggagugguagaaaaaaacacacauucagcca

SEQ ID NO: 404181 - RNA, 64 nt, Human
gcaaauuggagaaaaagaaaaaauauauacucaagagugguaucuugcaguaucggcacuguac

SEQ ID NO: 404182 - RNA, 64 nt, Human; identical to SEQ ID NO: 275023

SEQ ID NO: 404183 - RNA, 64 nt, Human; identical to SEQ ID NO: 275024

SEQ ID NO: 404184 - RNA, 64 nt, Human; identical to SEQ ID NO: 275025

SEQ ID NO: 404185 - RNA, 64 nt, Human; identical to SEQ ID NO: 275026

SEQ ID NO: 404186 - RNA, 64 nt, Human; identical to SEQ ID NO: 275027

SEQ ID NO: 404187 - RNA, 64 nt, Human; identical to SEQ ID NO: 275028

SEQ ID NO: 404188 - RNA, 64 nt, Human; identical to SEQ ID NO: 275029

SEQ ID NO: 404189 - RNA, 64 nt, Human; identical to SEQ ID NO: 275030

SEQ ID NO: 404190 - RNA, 64 nt, Human; identical to SEQ ID NO: 275031

SEQ ID NO: 404191 - RNA, 64 nt, Human; identical to SEQ ID NO: 275032

SEQ ID NO: 404192 - RNA, 64 nt, Human; identical to SEQ ID NO: 275033

SEQ ID NO: 404193 - RNA, 64 nt, Human; identical to SEQ ID NO: 275034

SEQ ID NO: 404194 - RNA, 64 nt, Human; identical to SEQ ID NO: 275039

SEQ ID NO: 404195 - RNA, 64 nt, Human; identical to SEQ ID NO: 275040

SEQ ID NO: 404196 - RNA, 64 nt, Human; identical to SEQ ID NO: 275041

SEQ ID NO: 404197 - RNA, 64 nt, Human; identical to SEQ ID NO: 275042

SEQ ID NO: 404198 - RNA, 62 nt, Human
gcuggaacccacugagcccuucccgggguuucccgccgcacucaguguguuccuucaggcua

SEQ ID NO: 404199 - RNA, 62 nt, Human
ucuccaccgcccgaggccugcgccgguggcucccgccgcaguugcguuugcuuuggaccuug

SEQ ID NO: 404200 - RNA, 64 nt, Human
gcauuucacguuuuauuggacauuuuaccccacugagugguaaaaaggacagaggcuacagaug

SEQ ID NO: 404201 - RNA, 64 nt, Human; identical to SEQ ID NO: 275043

SEQ ID NO: 404202 - RNA, 64 nt, Human; identical to SEQ ID NO: 275044

SEQ ID NO: 404203 - RNA, 64 nt, Human; identical to SEQ ID NO: 275045

SEQ ID NO: 404204 - RNA, 64 nt, Human; identical to SEQ ID NO: 275046

SEQ ID NO: 404205 - RNA, 64 nt, Human; identical to SEQ ID NO: 275047

SEQ ID NO: 404206 - RNA, 64 nt, Human; identical to SEQ ID NO: 275048

SEQ ID NO: 404207 - RNA, 64 nt, Human; identical to SEQ ID NO: 275049

SEQ ID NO: 404208 - RNA, 64 nt, Human; identical to SEQ ID NO: 275050

SEQ ID NO: 404209 - RNA, 64 nt, Human; identical to SEQ ID NO: 275051

SEQ ID NO: 404210 - RNA, 64 nt, Human; identical to SEQ ID NO: 275052

SEQ ID NO: 404211 - RNA, 64 nt, Human; identical to SEQ ID NO: 275053

SEQ ID NO: 404212 - RNA, 64 nt, Human; identical to SEQ ID NO: 275054

SEQ ID NO: 404213 - RNA, 64 nt, Human; identical to SEQ ID NO: 275059

SEQ ID NO: 404214 - RNA, 64 nt, Human; identical to SEQ ID NO: 275060

SEQ ID NO: 404215 - RNA, 64 nt, Human; identical to SEQ ID NO: 275061

SEQ ID NO: 404216 - RNA, 64 nt, Human; identical to SEQ ID NO: 275062

SEQ ID NO: 404217 - RNA, 64 nt, Human
caaagugccuuaaaagaaaucagacaaaugcccugagugguaacuucuguguuauuuuacucuu

SEQ ID NO: 404218 - RNA, 64 nt, Human
cugagauuuuuuuguguauguuuuugacucuuuugagugguaaucauaugugucuuuauagaug

SEQ ID NO: 404219 - RNA, 64 nt, Human
cuuggacaaaggcuggauucucuucacuauaacugagugguaauuuaaagacaacaauuuaaug

SEQ ID NO: 404220 - RNA, 64 nt, Human; identical to SEQ ID NO: 275063

SEQ ID NO: 404221 - RNA, 64 nt, Human; identical to SEQ ID NO: 275064

SEQ ID NO: 404222 - RNA, 64 nt, Human; identical to SEQ ID NO: 275065

SEQ ID NO: 404223 - RNA, 64 nt, Human; identical to SEQ ID NO: 275066

SEQ ID NO: 404224 - RNA, 64 nt, Human; identical to SEQ ID NO: 275067

SEQ ID NO: 404225 - RNA, 64 nt, Human; identical to SEQ ID NO: 275068

SEQ ID NO: 404226 - RNA, 64 nt, Human; identical to SEQ ID NO: 275069

SEQ ID NO: 404227 - RNA, 64 nt, Human; identical to SEQ ID NO: 275070

SEQ ID NO: 404228 - RNA, 64 nt, Human; identical to SEQ ID NO: 275071

SEQ ID NO: 404229 - RNA, 64 nt, Human; identical to SEQ ID NO: 275072

SEQ ID NO: 404230 - RNA, 64 nt, Human; identical to SEQ ID NO: 275073

SEQ ID NO: 404231 - RNA, 64 nt, Human; identical to SEQ ID NO: 275074

SEQ ID NO: 404232 - RNA, 64 nt, Human; identical to SEQ ID NO: 275079

SEQ ID NO: 404233 - RNA, 64 nt, Human; identical to SEQ ID NO: 275080

SEQ ID NO: 404234 - RNA, 64 nt, Human; identical to SEQ ID NO: 275081

SEQ ID NO: 404235 - RNA, 64 nt, Human; identical to SEQ ID NO: 275082

SEQ ID NO: 404236 - RNA, 64 nt, Human
ccagcaaggaaugacauucaguucuguaagaaaugagugguauuugauguauuuacucaaaaca

SEQ ID NO: 404237 - RNA, 64 nt, Human
gcugccucuuuccugugauauguagacuagcacagagugguacauccuaaaaacuugggaaaca

SEQ ID NO: 404238 - RNA, 64 nt, Human
aggaaacugggacccucaauuaugcagaauggaugagugguaccgccaaaauucaaaccccaga

SEQ ID NO: 404239 - RNA, 64 nt, Human; identical to SEQ ID NO: 275083

SEQ ID NO: 404240 - RNA, 64 nt, Human; identical to SEQ ID NO: 275084

SEQ ID NO: 404241 - RNA, 64 nt, Human; identical to SEQ ID NO: 275085

SEQ ID NO: 404242 - RNA, 64 nt, Human; identical to SEQ ID NO: 275086

SEQ ID NO: 404243 - RNA, 64 nt, Human; identical to SEQ ID NO: 275087

SEQ ID NO: 404244 - RNA, 64 nt, Human; identical to SEQ ID NO: 275088

SEQ ID NO: 404245 - RNA, 64 nt, Human; identical to SEQ ID NO: 275089

SEQ ID NO: 404246 - RNA, 52 nt, Human; identical to SEQ ID NO: 275090

SEQ ID NO: 404247 - RNA, 64 nt, Human; identical to SEQ ID NO: 275091

SEQ ID NO: 404248 - RNA, 64 nt, Human; identical to SEQ ID NO: 275092

SEQ ID NO: 404249 - RNA, 64 nt, Human; identical to SEQ ID NO: 275093

SEQ ID NO: 404250 - RNA, 64 nt, Human; identical to SEQ ID NO: 275094

SEQ ID NO: 404251 - RNA, 64 nt, Human; identical to SEQ ID NO: 275099

SEQ ID NO: 404252 - RNA, 64 nt, Human; identical to SEQ ID NO: 275100

SEQ ID NO: 404253 - RNA, 62 nt, Human; identical to SEQ ID NO: 275101

SEQ ID NO: 404254 - RNA, 64 nt, Human; identical to SEQ ID NO: 275102

SEQ ID NO: 404255 - RNA, 64 nt, Human
uguaaaugugggacuacaagaagaggagcugccugagugguacuuucucuuccugguaauccuc

SEQ ID NO: 404256 - RNA, 64 nt, Human
uuguuuguuuguguuuuuguucuuuugaagaauagagugguauuuagaaaauaaauugcauugc

SEQ ID NO: 404257 - RNA, 64 nt, Human
uguuuuuccugcuuuguggaugaaaaauauuucugagugguaguuuuuugacagguagaccaug

SEQ ID NO: 404258 - RNA, 64 nt, Human; identical to SEQ ID NO: 275103

SEQ ID NO: 404259 - RNA, 64 nt, Human; identical to SEQ ID NO: 275104

SEQ ID NO: 404260 - RNA, 64 nt, Human; identical to SEQ ID NO: 275105

SEQ ID NO: 404261 - RNA, 64 nt, Human; identical to SEQ ID NO: 275106

SEQ ID NO: 404262 - RNA, 64 nt, Human; identical to SEQ ID NO: 275107

SEQ ID NO: 404263 - RNA, 64 nt, Human; identical to SEQ ID NO: 275108

SEQ ID NO: 404264 - RNA, 64 nt, Human; identical to SEQ ID NO: 275109

SEQ ID NO: 404265 - RNA, 64 nt, Human; identical to SEQ ID NO: 275110

SEQ ID NO: 404266 - RNA, 64 nt, Human; identical to SEQ ID NO: 275111

SEQ ID NO: 404267 - RNA, 64 nt, Human; identical to SEQ ID NO: 275112

SEQ ID NO: 404268 - RNA, 64 nt, Human; identical to SEQ ID NO: 275113

SEQ ID NO: 404269 - RNA, 64 nt, Human; identical to SEQ ID NO: 275114

SEQ ID NO: 404270 - RNA, 64 nt, Human; identical to SEQ ID NO: 275119

SEQ ID NO: 404271 - RNA, 61 nt, Human; identical to SEQ ID NO: 275120

SEQ ID NO: 404272 - RNA, 64 nt, Human
aaacaggaaucacuugcuuuuauguccacuuuuugagugguacuuaaauguaaaguaacaaccu

SEQ ID NO: 404273 - RNA, 61 nt, Human
ccccaucccccaacagaacucccgggccccaauccaguauacccuaacccuugaugucccg

SEQ ID NO: 404274 - RNA, 61 nt, Human
caacagggugugcucccacgagacuuucagcauccaguagaugggaccucgaggcucgagc

SEQ ID NO: 404275 - RNA, 61 nt, Human
agcugcaggcgggaagccaggcggguggagcccaugggagcaagggcgaguggccgguccc

SEQ ID NO: 404276 - RNA, 61 nt, Human
ccuggucuucccucauccuccguggcugccuccaugggacaaggaccgauuccaacacagg

SEQ ID NO: 404277 - RNA, 61 nt, Human
ugguccagccaccaggcucccugugucccuuccaugggaaggucuuccgcugugccucuca

SEQ ID NO: 404278 - RNA, 61 nt, Human
uuuagacauuccucgucaguauuaggaauuuccaugggaaaagagguuugcaugcugguaa

SEQ ID NO: 404279 - RNA, 61 nt, Human
auaagccaaauauuuggcucagaacagguguccaugggacaaaaaagaacgauccuccacu

SEQ ID NO: 404280 - RNA, 61 nt, Human
aauauagccucccaccccauuaacuucgcucccaugggagauggcuuccccucaugcaaca

SEQ ID NO: 404281 - RNA, 61 nt, Human
cugccucgucuuaagacauauuuauguaauaccaugggacaagagaagcuuacuggcccag

SEQ ID NO: 404282 - RNA, 61 nt, Human
ccacucaaaugaccugccuguguugucauuuccaugggaaagaacucuuuccacgagaucu

SEQ ID NO: 404283 - RNA, 61 nt, Human
gugccacuggguucuuugcccucccuucacaccaugggauaaaucuguaucaagacgguuc

SEQ ID NO: 404284 - RNA, 61 nt, Human
gccaaugggagguagacacaauaaaauaaugccaugggagucacacugaaagcaauuuuga

SEQ ID NO: 404285 - RNA, 61 nt, Human
uuggaacaacccauaaggccugcuucccaguccaugggagauuccaaguggccacugcagg

SEQ ID NO: 404286 - RNA, 61 nt, Human
uucacuuuaccagcuuugggaagcagcagccccaugggaucuaaaaguguggagucugcau

SEQ ID NO: 404287 - RNA, 61 nt, Human
aauaauguauuaaaauuuacaucuuaaaaaaauccaguacagugcaugaagcauauuuuua

SEQ ID NO: 404288 - RNA, 61 nt, Human
uuuucaaagguggagcgugaauaccagaaggauccaguauucagucacuuaaaugaagucu

SEQ ID NO: 404289 - RNA, 61 nt, Human
uuuuuugcuucuucccuuaaaauuuauauguauccaguacauuuaauugagaagcguaugu

SEQ ID NO: 404290 - RNA, 61 nt, Human
gucucaauuuuguauuuaaugauuuuuguguauccaguaugcacguuaacagcgugucaac

SEQ ID NO: 404291 - RNA, 61 nt, Human
ccucaaccgacccuggcucaggagguugaugccaugggaaccugaaccugaaacacuucau

SEQ ID NO: 404292 - RNA, 61 nt, Human
ugccuggaaaucaccaugguccucauaucucccaugggaauccuguccugccucgaaggag

SEQ ID NO: 404293 - RNA, 61 nt, Human
aguccaauuuuccuaaguuucuuugaggguuccaugggagcaaauaucuaaauaauggccu

SEQ ID NO: 404294 - RNA, 61 nt, Human
uccuguccugugguuuuccaguuggugaccaccaugggaggucgcuggcucggcucacucc

SEQ ID NO: 404295 - RNA, 61 nt, Human
cuguauucucuguauguccagcacuuuguagccaugggaggaaagggacuauaaaagugua

SEQ ID NO: 404296 - RNA, 61 nt, Human
ggcuggcagggaagacaaaucugcuacaaguccaugggaagacccuacaaugaaauguuca

SEQ ID NO: 404297 - RNA, 61 nt, Human
gagaagaauggcccaaggaacuaggaagcagccaugggagaggggaaggguucaagcccgg

SEQ ID NO: 404298 - RNA, 61 nt, Human
gcucuaggcugccuggagggaaggaacaggcccaugggaagaaggggguuuuaaaaacaug

SEQ ID NO: 404299 - RNA, 61 nt, Human
gcacuugauucguuguugcugugaaauauguccaugggacaaaagagggaauaugaaauau

SEQ ID NO: 404300 - RNA, 61 nt, Human
ccagugcagugagaacagcagccccacggccccaugggaggcggcgcugcucuccccgagg

SEQ ID NO: 404301 - RNA, 61 nt, Human
cuugccacggaugggccacggauggagcuugccaugggaagcacugggaaguaauggggug

SEQ ID NO: 404302 - RNA, 61 nt, Human
gccuccuccagcugcuggcaggggcuggcacccaugggacacccucugcccccagccgcag

SEQ ID NO: 404303 - RNA, 61 nt, Human
caccuggcgaggguuucacucaucauggaugccaugggacagguaucauugguuuaugaga

SEQ ID NO: 404304 - RNA, 61 nt, Human
ucaacuucccccuccugcaggggauccggguccaugggauggaggcgcuggggagcuucua

SEQ ID NO: 404305 - RNA, 61 nt, Human
auggauggauaaauagauugggaccaucagaccaugggaccaucagaccaugaccacugua

SEQ ID NO: 404306 - RNA, 61 nt, Human
cacaaccacacacacaaaugggggcaaccacauccaguacaagcuuuuacaaauguuauua

SEQ ID NO: 404307 - RNA, 61 nt, Human
cagcugcugaagaggcaagagacagaaugauauccaguaagcacauguuuauucaugggug

SEQ ID NO: 404308 - RNA, 61 nt, Human
gcacuauucuuguuuuuacugcaugaacguaauccaguauuuggaaaguaauccaguuuga

SEQ ID NO: 404309 - RNA, 61 nt, Human
ccuugugaaaauauaaauuuaauuuucaggaauccaguauauuccaaacaucacauauuua

SEQ ID NO: 404310 - RNA, 61 nt, Human
uuuuucucccucuggaucaaaguaggcaggaccaugggaccaggucuuggagcugagccuc

SEQ ID NO: 404311 - RNA, 61 nt, Human
aaccaaaaaggcuguuuuauaaaagugaaauauccaguauuucagagggccaggcaagagc

SEQ ID NO: 404312 - RNA, 61 nt, Human
ccacucugauuaucuucccugcacaacuaacauccaguaauaauucuucacuuuuaaaauu

SEQ ID NO: 404313 - RNA, 61 nt, Human
cauccagauagguuaccaguaacggaacaguauccaguacuccugguuccuaggugagcag

SEQ ID NO: 404314 - RNA, 61 nt, Human
auuuuuacuuuucugauacuguaaagaauauauccaguauguaaaugaauguucuauaaau

SEQ ID NO: 404315 - RNA, 61 nt, Human
aaucaauucauguuuaacguuucucauuaaaauccaguauuauauuaucauaucucucuuu

SEQ ID NO: 404316 - RNA, 61 nt, Human
guaaagauaacuaaaaaauuuagaaaaauaaauccaguauuuguaaagugaauaacuucau

SEQ ID NO: 404317 - RNA, 61 nt, Human
aaaggggaggaggccgaaguuguucccauuuauccaguauuggaaaauauuugacccccuu

SEQ ID NO: 404318 - RNA, 61 nt, Human
ggaaacuccuggaagacaugauaaccaucuaauccaguaaggagaaacagagaggggcaaa

SEQ ID NO: 404319 - RNA, 61 nt, Human
gaggcccgacacuaggauucucaaugcaagaauccaguaccuugcacauagaaguagcaac

SEQ ID NO: 404320 - RNA, 61 nt, Human
cuccaguucugguuuaaucuguuugaaaacuauccaguaaaaagcugauggaggccaauua

SEQ ID NO: 404321 - RNA, 61 nt, Human
ugcagauaccggcggccgcaggaggggcagcauccaguagaggacuggcguuggagucaca

SEQ ID NO: 404322 - RNA, 61 nt, Human
gaggauuuacuuaguaucgcuaacaagcuggauccaguagaugcguauggaauuucaaaua

SEQ ID NO: 404323 - RNA, 61 nt, Human
ugcuuagcaguuuggcccgaagaaggaaaauauccaguaccaugcuguuuuguggcaugaa

SEQ ID NO: 404324 - RNA, 61 nt, Human
cuugaauuucuugaggcugagacaaacuaggauccaguagccuagauuuugccccaguuuc

SEQ ID NO: 404325 - RNA, 61 nt, Human
uccuaauuaauguagcuuucggaugacauaaauccaguaucucugcuuaugacauaaaucc

SEQ ID NO: 404326 - RNA, 61 nt, Human
gauaaagggaggaggaggagcuagcagacacauccaguaucuccuucuggagcacaggaug

SEQ ID NO: 404327 - RNA, 61 nt, Human
ccuucuugcucagucccucugggugggaaccauccaguacuuguggacacuacacguuuca

SEQ ID NO: 404328 - RNA, 61 nt, Human
uucuuuuugaaggcagcugaggaaguuggauauccaguaaugaucaaggccucagagggag

SEQ ID NO: 404329 - RNA, 61 nt, Human
uaguaguuauguguacagguaauguaucaugauccaguaucacaguauugugcuguuuaua

SEQ ID NO: 404330 - RNA, 57 nt, Human
uuuuucuauaggcaaguuaaccgauauccaugggaauguucuucaguaccacaagga

SEQ ID NO: 404331 - RNA, 61 nt, Human
gaggcucucuuccuguucugcaccccucuccccaugggaccuuggagaaaacugaacuguu

SEQ ID NO: 404332 - RNA, 61 nt, Human
aacacugucagauaagcucaguaauauguuaccaugggauaaaaauauguaucccugccua

SEQ ID NO: 404333 - RNA, 61 nt, Human
aagagcuauauuuuuaaacaugaacaaacucccaugggagccaugccaguguaguggaaaa

SEQ ID NO: 404334 - RNA, 61 nt, Human
uugcucucagguagugagcguucggguggugccaugggagcacucucccucccccagguaa

SEQ ID NO: 404335 - RNA, 61 nt, Human
uauuggaagacuuggguugaucucuuagaagccaugggaccuccucccucauucaucuugc

SEQ ID NO: 404336 - RNA, 61 nt, Human
caugagccugagcagaaagggugaagaagagccaugggacacagaguugacccagccaggg

SEQ ID NO: 404337 - RNA, 61 nt, Human
uccuccaucuagagauuuucuuggcaguauuccaugggauguuaagcaaaggaaaccaaag

SEQ ID NO: 404338 - RNA, 61 nt, Human
ucucuccaucugaggcuccuucacuuucucuccaugggauagggguuggggguacucccua

SEQ ID NO: 404339 - RNA, 61 nt, Human
acggggacugcuucguguucuguauucugacccaugggagauuuggagcugucuacucuuc

SEQ ID NO: 404340 - RNA, 61 nt, Human
ucaccuuucuaagcccuggggcgcccaagucccaugggacagggaaacgugguccucagug

SEQ ID NO: 404341 - RNA, 61 nt, Human
gucauccuggaaaacuggguaguucaucugaccaugggauguguuuguuaugaagaaaauc

SEQ ID NO: 404342 - RNA, 61 nt, Human
ugacccucugcuggccggucuugugugcgccccaugggacccccaguguucuugccuguga

SEQ ID NO: 404343 - RNA, 61 nt, Human
ugugccuaaccugggagacggaagaagcacgccaugggaaguguuuacacuuggggacaag

SEQ ID NO: 404344 - RNA, 61 nt, Human
cucaucauuaaaaaggaaauuguaucaggacccaugggauauauccagaggcaaacuuuau

SEQ ID NO: 404345 - RNA, 61 nt, Human
auuuagauuggaauaauuaacuggagauaauauccaguaaaauagauuaaacuuccauuua

SEQ ID NO: 404346 - RNA, 61 nt, Human
gugguacuggcuaaaaagaaaggaagauaacauccaguaaccacaggaauauauucucugu

SEQ ID NO: 404347 - RNA, 61 nt, Human
cuucuacagcuccauuuuugauaguuggauaauccaguaucugccaagagcauguuggguc

SEQ ID NO: 404348 - RNA, 61 nt, Human
ccaacacaugcuuuucuguuacuguuauauuauccaguagaaaauguuaggauaugugugc

SEQ ID NO: 404349 - RNA, 61 nt, Human
cucccagaagcccucgggcaugcccagugcaccaugggaugaugaaauuaaggagaacagc

SEQ ID NO: 404350 - RNA, 61 nt, Human
gccaccgcugcccugccaucccgucugccugccaugggacggcuccucugaguguucccug

SEQ ID NO: 404351 - RNA, 61 nt, Human
auuuuaagaaauucuugaaaaacccuauguuccaugggaacauaaaguuauuauagugccu

SEQ ID NO: 404352 - RNA, 61 nt, Human
ccacacugcagguagaggaggccaucugaucccaugggaagccaucagagacacugcuggu

SEQ ID NO: 404353 - RNA, 61 nt, Human
uaaagaacucgauuaagaaaggagacaaguuccaugggauacaaccucccucuuguuuugu

SEQ ID NO: 404354 - RNA, 61 nt, Human
ugcuuuauuuuauaggaugcaugugaggagcccaugggaugugccuggcuuggcacauugu

SEQ ID NO: 404355 - RNA, 61 nt, Human
cucucuuaccuccuccucucccuuccuucugccaugggaggaugaaacaugaaggcccugg

SEQ ID NO: 404356 - RNA, 61 nt, Human
ucuuccacauuugaggauccuuccuaucucuccaugggacuagacugcuuuguuauucuau

SEQ ID NO: 404357 - RNA, 61 nt, Human
ggggagggagggcaauaguggaacgaacuuuccaugggaaacuuucccuuuuguaaguuga

SEQ ID NO: 404358 - RNA, 61 nt, Human
aguguguggaauuuuauuuugaaggauaagaccaugggaaaauugugguaaagacuguuug

SEQ ID NO: 404359 - RNA, 61 nt, Human
ggcccgggcgcuggcugcagcucacguccagccaugggaaucccacggaccucucgcgugu

SEQ ID NO: 404360 - RNA, 61 nt, Human
uuaugguaaaggcauaauauaaaauguaucuccaugggaggcugaggcaggagaaucaguu

SEQ ID NO: 404361 - RNA, 51 nt, Human
cgucagugcugugcuccuaagccaugggacccgaggacugccccccggcgc

SEQ ID NO: 404362 - RNA, 61 nt, Human
cugugggcuccauucaaagugagcuccuaagccaugggagacacugauguaugaggaauuu

SEQ ID NO: 404363 - RNA, 61 nt, Human
ccucaccaaaacuuggcaguucuuuuuggggccaugggacaccuuucucugaagagggguu

SEQ ID NO: 404364 - RNA, 64 nt, Human
cgcgcagggcccacugugcccgggacaaccgcagcgucgccacaguggcggcuccaccucucgg

SEQ ID NO: 404365 - RNA, 51 nt, Human
aaaacaguguggccaucuaagcgucgccacccuuugguuauuucagccccc

SEQ ID NO: 404366 - RNA, 64 nt, Human
gcagguggaggagcugcggguuuucacagggccgcgucgccacggcuccucugauccuuuaggg

SEQ ID NO: 404367 - RNA, 64 nt, Human
aggauuugcuccacccucgagggcagccagacagcgucgccaggcaaugaggaaagcagagaca

SEQ ID NO: 404368 - RNA, 61 nt, Human
ggauuugcagguggcaggccagggauuuguaccaugggacuuggguaaauaaaggggacug

SEQ ID NO: 404369 - RNA, 61 nt, Human
uuacuuaaacaucauuggauaaauuugaacuccaugggauuuuaucuguggauucagcuuc

SEQ ID NO: 404370 - RNA, 61 nt, Human
uuaaaaacaacacauuauuuggaaagacaagccaugggaaagaaauauggcguuucuauuu

SEQ ID NO: 404371 - RNA, 61 nt, Human
uuuguuuaaaaaaaaaaaggcagaaaacccaccaugggaaaauaagcauuuuuuaaaaucu

SEQ ID NO: 404372 - RNA, 61 nt, Human
auuuguuuaccuacuaucuaugauuguucaaccaugggagaguugaguaauugugacaugg

SEQ ID NO: 404373 - RNA, 61 nt, Human
cauuacugugaccuuccagcucaguccccacccaugggagccuguguugcuccucucacuc

SEQ ID NO: 404374 - RNA, 61 nt, Human
aggaaaucuauggaguauuauagggacauucccaugggaauguaucuuccuccauggcaug

SEQ ID NO: 404375 - RNA, 61 nt, Human
gucuagcagcuucagacauuugguuaagaacccaugggaaaaaaaaaauccuugcuaaugu

SEQ ID NO: 404376 - RNA, 61 nt, Human
gccugcuuagucagccccggcagcagggcagccaugggaacucaggaaaagcaggaacccu

SEQ ID NO: 404377 - RNA, 61 nt, Human
aaaugcugguauauccagugcauuguuggcaccaugggaccagaagguggugaccccccug

SEQ ID NO: 404378 - RNA, 61 nt, Human
cggaaacacugacuuagguuucaggaaguugccaugggaaacaaauaauuugaacuuugga

SEQ ID NO: 404379 - RNA, 61 nt, Human
gacugcagggagggaugcacccaucauuuacccaugggagcaucuguaggaccaucucucu

SEQ ID NO: 404380 - RNA, 61 nt, Human
uaaugaugggggugcuacuggccuucugcugccaugggaccaggaugcuaaaugucaaggu

SEQ ID NO: 404381 - RNA, 61 nt, Human
agguggacuguuuuggauuuaaccauguaauccaugggaccaauugagagucagcuacuuu

SEQ ID NO: 404382 - RNA, 61 nt, Human
aaucuggcauauaguuuuauugguuccuuagccaugggauuauugaggcuuucacauauca

SEQ ID NO: 404383 - RNA, 64 nt, Human
uuguggaaaaucauuucgccacaguucuucguuccgucgccaucagagaguucauacuggaaug

SEQ ID NO: 404384 - RNA, 64 nt, Human
auagaccauuauacuauguguauguuugauacagcgucgccaaaacuaguguucuuuauuagug

SEQ ID NO: 404385 - RNA, 61 nt, Human
gugagacucaauacauauuuuugaagauaguccaugggauuuuuagaaugucguugucaag

SEQ ID NO: 404386 - RNA, 61 nt, Human
aucuucuaucauuuugaaacacugcaguuuaccaugggacacuguauauauuucuugccau

SEQ ID NO: 404387 - RNA, 61 nt, Human
cugacuugcuuucacuuauuaaacauguucaccaugggaugaugucuguaacaucagauau

SEQ ID NO: 404388 - RNA, 61 nt, Human
ucugguuaaaagcuuccuaacggguaacagaccaugggagagauaugugguuggguaaugc

SEQ ID NO: 404389 - RNA, 61 nt, Human
gcuuauaaacacauugaaugcgcuuuauugcccaugggauaugugguguauauccuuccaa

SEQ ID NO: 404390 - RNA, 61 nt, Human
aagcuggccuucauuguuggugacagggcaaccaugggacuaggagguggcccauacacau

SEQ ID NO: 404391 - RNA, 61 nt, Human
ccagaagccaggaagccugcaagggaugaggccaugggaauggagagaaggggccacccac

SEQ ID NO: 404392 - RNA, 61 nt, Human
caaguagcuggcuuguaaagggugaacagagccaugggaggaaggucuggcauugggaugc

SEQ ID NO: 404393 - RNA, 61 nt, Human
ugguuuccuaauucggagaugccuuucccagccaugggagugugaagugcuaggaugaacc

SEQ ID NO: 404394 - RNA, 61 nt, Human
cacgacugaaguuguagauugagcugaauaaccaugggaagugaccaagcaaagacacucg

SEQ ID NO: 404395 - RNA, 61 nt, Human
aggacaauuuugcaaaagaaguagcuggaagccaugggacuggcgggagccuguuuggggg

SEQ ID NO: 404396 - RNA, 61 nt, Human
ugcucagcucuuacacagugauagguuuguuccaugggacuuaucauaggccuggugauuc

SEQ ID NO: 404397 - RNA, 61 nt, Human
ugauuaugucacgagaggagaggcuggagggccaugggaguucccagcuggcucacucauc

SEQ ID NO: 404398 - RNA, 61 nt, Human
gagguauuuauucucaauaccugacaggggcccaugggaaugacuucagaagcaucccgga

SEQ ID NO: 404399 - RNA, 61 nt, Human
caacuaauccuauuugguuuuaaugauuucaccaugggauuaagaacuauaucaggaacau

SEQ ID NO: 404400 - RNA, 61 nt, Human
uagauucauuucucuaaugugagaaaaauauauccaguaauaguauugacuguuuaaaaaa

SEQ ID NO: 404401 - RNA, 61 nt, Human
agacacaguuguucauguuauuuaaaguuuuauccaguauucuaggaauuuucagcaauac

SEQ ID NO: 404402 - RNA, 64 nt, Human
ucauagugguuguuucucuggucuugagugacuguguccacaguucauuuuuuuccgguaggaa

SEQ ID NO: 404403 - RNA, 64 nt, Human
uucacaggguccccacccccacuggcuuuggugcuguccacacagugcccaccagaaggcagag

SEQ ID NO: 404404 - RNA, 61 nt, Human
uuuaaucagcacucacgcaccggaguucugcccaugggaaguaaacugcagcaggccacug

SEQ ID NO: 404405 - RNA, 61 nt, Human
uguucauaauuucagcagggcagaauaaaaaccaugggaggcaaagaaaggaaauccggaa

SEQ ID NO: 404406 - RNA, 61 nt, Human
aacuucccagggccccucccucaaauugucuccaugggaaacuugacccaguggcaaguug

SEQ ID NO: 404407 - RNA, 61 nt, Human
guauaacagcucugcuggacacccaagaaagccaugggaacgccaacuggaaagguccccu

SEQ ID NO: 404408 - RNA, 61 nt, Human
uaacaaaaccucuuuaagcaauuggugauugccaugggacuuuucccaugucuucugcugu

SEQ ID NO: 404409 - RNA, 61 nt, Human
ggggggaggaggaccugugugucaggcucugccaugggaacgaguguaaaccguggcuguc

SEQ ID NO: 404410 - RNA, 61 nt, Human
cuuaaagcuuaaaugugugguuuuuuccauuccaugggauucacauugguuuguagcauuu

SEQ ID NO: 404411 - RNA, 61 nt, Human
uccgcaggugcuggucccggggccagcacuuccaugggaaugucucuuuggcgaccuccuu

SEQ ID NO: 404412 - RNA, 61 nt, Human
auaguguuugggcuaguggguuucugacagcccaugggaaugcccugaaacuacuguaucu

SEQ ID NO: 404413 - RNA, 61 nt, Human
gguaggauggaugggguuugggguggguaggccaugggaggggagaagccccuccuuggca

SEQ ID NO: 404414 - RNA, 61 nt, Human
uucacccuucauaccagcuccaagccccagaccaugggagcugucugggauguugauccuu

SEQ ID NO: 404415 - RNA, 61 nt, Human
aguugaacccacuguuaccauuguucuuaucccaugggaagcaguugguuacacgauucuu

SEQ ID NO: 404416 - RNA, 61 nt, Human
caguuugccuugcggggagggggcuccugggccaugggacuuccagugcuaaaacugggaa

SEQ ID NO: 404417 - RNA, 61 nt, Human
gcccccuccucugccugcugcguggaggcagccaugggaaggagcccaggggagcuggccu

SEQ ID NO: 404418 - RNA, 61 nt, Human
ccccguuugcugggggcuccuccagccgcccccaugggaagaggccugguaccgccucacc

SEQ ID NO: 404419 - RNA, 64 nt, Human; identical to SEQ ID NO: 358053

SEQ ID NO: 404420 - RNA, 64 nt, Human; identical to SEQ ID NO: 358054

SEQ ID NO: 404421 - RNA, 64 nt, Human
uggaucuguccucccucaccccuuucaccugagcuguccacaguaggaaacauaaagaaacaau

SEQ ID NO: 404422 - RNA, 64 nt, Human
cuccagagggucucuccguccucaugcuccucaguguccacacuucaaggccaaggauaguuuc

SEQ ID NO: 404423 - RNA, 61 nt, Human
ggagaauguuuucucucaaauuuccucugacccaugggaaugaaaauacuuaaauacugua

SEQ ID NO: 404424 - RNA, 61 nt, Human
auguuuauuacaguauaauuaacauguuaaaccaugggauaaaugccaucaauaaaaaauu

SEQ ID NO: 404425 - RNA, 61 nt, Human
cuugaugaugguuaaaaucgguuugauagcaccaugggacauuuuucuaacaaaaauaaau

SEQ ID NO: 404426 - RNA, 61 nt, Human
aagugauuggaagaagucauuugauaagaggccaugggagaguggucuggaaguuguagga

SEQ ID NO: 404427 - RNA, 61 nt, Human
ggaacagggauuuaacuccccgcccacagguccaugggagcuugaggcaguaagggggauc

SEQ ID NO: 404428 - RNA, 61 nt, Human
agauucugagcagguugagauguggauaucuccaugggaagcuugaaccaggcuagaacag

SEQ ID NO: 404429 - RNA, 61 nt, Human
cuugacaucaccugagcccccaccuagccauccaugggagagagaaggcccagccccuucu

SEQ ID NO: 404430 - RNA, 61 nt, Human
uuuucuuccucuucccccaaccuaacuucugccaugggaacugguuaaaaacacugcucua

SEQ ID NO: 404431 - RNA, 61 nt, Human
guggagucuauuguacacuguggaaaaauacccaugggaccagauccugccaaauucuucc

SEQ ID NO: 404432 - RNA, 61 nt, Human
cuucuccccaugaaauuaucucaaggaucuuccaugggaagaugugacagaaccaggacac

SEQ ID NO: 404433 - RNA, 61 nt, Human
uauaaugacugauaagaguacaauacaggugccaugggaacacgugacaucacugaagacu

SEQ ID NO: 404434 - RNA, 61 nt, Human
gucaccacagcccugcccuucaugcccagccccaugggacacccgguggucuuucccaaac

SEQ ID NO: 404435 - RNA, 61 nt, Human
agucuuuaagauauuagacaguuuuuuuaguccaugggauuguaaauauaaacauuaacuu

SEQ ID NO: 404436 - RNA, 61 nt, Human
aauguggauguaucagauuugguuuauccagccaugggagagaaaacaaaccuaaguuuac

SEQ ID NO: 404437 - RNA, 61 nt, Human
cuugguggagcauuuucccauugagagccuuccaugggaacucaauguucccauuguaagu

SEQ ID NO: 404438 - RNA, 55 nt, Human; identical to SEQ ID NO: 84338

SEQ ID NO: 404439 - RNA, 62 nt, Human
ugucugaggaaaccuccaggcugaggaggucuccgccgcagccuugcuggagccgggucggg

SEQ ID NO: 404440 - RNA, 64 nt, Human
uuccuuugagcagugcucucaagagcuccgugccuguccacaaugaccuagagugcauccugcu

SEQ ID NO: 404441 - RNA, 64 nt, Human
uugaucuccguggcuuugguuuaaaagacacacuuguccacauagguuuagagauaagaguugg

SEQ ID NO: 404442 - RNA, 61 nt, Human
aucugcuccaugacauucacaauaccagggaccaugggagacacaagaaaugugugucugc

SEQ ID NO: 404443 - RNA, 61 nt, Human
aagagcuuucuagccagaaucuggaccuauaccaugggaaaauuuaggggugcugggaauc

SEQ ID NO: 404444 - RNA, 61 nt, Human
ccccagguuguacauucagagggcucuuucuccaugggagcuccuggugccgccucggccc

SEQ ID NO: 404445 - RNA, 61 nt, Human
gaaaaacccgugaaacaugaaaaaggaaauaccaugggaaacgugauucucagugugauuc

SEQ ID NO: 404446 - RNA, 61 nt, Human
gccuaugaagagugguaagccaaauaggucuccaugggagauacauuauguaaauaaauaa

SEQ ID NO: 404447 - RNA, 61 nt, Human
gggcaugggugcaccccacccccuaggguccccaugggaaagggacaugcaaggaaacagc

SEQ ID NO: 404448 - RNA, 61 nt, Human
uugugccucucacaggcgccuaaagucauugccaugggaggaagacgauuuggggggggag

SEQ ID NO: 404449 - RNA, 61 nt, Human
cugcccuuugugugcuucacaagaggcagucccaugggaggugggucuggccaauggagau

SEQ ID NO: 404450 - RNA, 61 nt, Human
agcggacgcccccagggagcuggggacacccccaugggacaggugaggggcucggacggag

SEQ ID NO: 404451 - RNA, 61 nt, Human
guggagucugggccuguggcucccgucugccccaugggacuucuguagugcugcagggucc

SEQ ID NO: 404452 - RNA, 61 nt, Human
uucaaagaugauauuucugugaacagagaggccaugggaagauuugaaaauuauuaaagaa

SEQ ID NO: 404453 - RNA, 61 nt, Human
aucacgauuuuuagccauggaacaauauaucccaugggagaagaccuuucagugugaacug

SEQ ID NO: 404454 - RNA, 61 nt, Human
gccuggagccuugucugugucacauuagguaccaugggagcugcugagaccugacauuuug

SEQ ID NO: 404455 - RNA, 61 nt, Human
aggaaacccacuuccugaagccaggacuuccccaugggaagugcaggggccacugggcagc

SEQ ID NO: 404456 - RNA, 61 nt, Human
gcucauggcaguaaacuuugaacauugauauccaugggaauaggauuagaaaaggauugcu

SEQ ID NO: 404457 - RNA, 64 nt, Human
gcuggcgcuccccgcucgcugaaccccguuugccuguccacacccccucgcuccccaccauuuu

SEQ ID NO: 404458 - RNA, 64 nt, Human
uucaaacaaugguuugaaacaacuacuggaauauuguccacaauaagcuggaaguuuguuguag

SEQ ID NO: 404459 - RNA, 64 nt, Human
ccugaugucagcugcuuugcacaaagguccuucuuguccacaccccuuauccccaggcuggugc

SEQ ID NO: 404460 - RNA, 64 nt, Human
auagaucacauuccuaauaccauucgaacucuguuguccacacuccccagcugcacugaccagu

SEQ ID NO: 404461 - RNA, 61 nt, Human
aaaaaacuugaaaauaguaauaccugaguacccaugggaauaauagacacuggggagguag

SEQ ID NO: 404462 - RNA, 61 nt, Human
uuuuuaaaaaagaaaaagacaauaguauuacccaugggacaaaauuuguacuauuagcaag

SEQ ID NO: 404463 - RNA, 61 nt, Human
cgcccucacugcuguucuugccuuacagccaccaugggaaagcugcaaccuuucuguuuua

SEQ ID NO: 404464 - RNA, 61 nt, Human
ccccacacccaguccucacccuuaacuucugccaugggaauuccuccaucugcagcgguca

SEQ ID NO: 404465 - RNA, 61 nt, Human
caacuccugucuucaggccacaccacaucuuccaugggacuuccccccaacaacugagucu

SEQ ID NO: 404466 - RNA, 61 nt, Human
ggucacucugugcccacuucaacgaaaaccaccaugggaaacagaauuucaugcacaaucc

SEQ ID NO: 404467 - RNA, 61 nt, Human
aacccuacauuuuauaguugccauaucaaagccaugggagaguuuuaauucguuauucuaa

SEQ ID NO: 404468 - RNA, 61 nt, Human
gaaaaccucuggccucuguucagaaugagucccaugggauuccccggcugugacacucuac

SEQ ID NO: 404469 - RNA, 61 nt, Human
cccauaccacaauuaauauuaggcuggauugccaugggaaacauuuuuuggcauuaaugca

SEQ ID NO: 404470 - RNA, 61 nt, Human
cgguacaggcugagguacacgguuagcaaaaccaugggaaggggaauggcggugcauauca

SEQ ID NO: 404471 - RNA, 61 nt, Human
ggcacucaagugacuucauauuucucucugcccaugggaaaagagauaggcuuuauauuuc

SEQ ID NO: 404472 - RNA, 61 nt, Human
augguagacuguguugggauuggggggagggccaugggagggguacaucgucaacauagcc

SEQ ID NO: 404473 - RNA, 61 nt, Human
gagaaaauguaaggauucuggaauacauauuccaugggacuuuccuucccucuccugcuuc

SEQ ID NO: 404474 - RNA, 61 nt, Human
cucucccagucuacccagagaagccccuuccccaugggaagacgaggcccucgggcccagc

SEQ ID NO: 404475 - RNA, 61 nt, Human
ucauuucaugaucaguguuaagcauuuuccuccaugggaaggaagcaugggauauagaaaa

SEQ ID NO: 404476 - RNA, 64 nt, Human
cgaggagucaguguuauuacugguggaugcaccguguccacagcagcccccaaucccagcgaug

SEQ ID NO: 404477 - RNA, 64 nt, Human
gaguuaauuuggaaugauaauuccagagauaaaguguccacaacaguuagggaaaugaugcuag

SEQ ID NO: 404478 - RNA, 64 nt, Human
gguuugggcuguauugauauugucgaucaugaaauguccacacuuauucuaaguggccaauuau

SEQ ID NO: 404479 - RNA, 64 nt, Human
agaaagugucuggacuuguaaucgggugcccugcuguccacagguggacucuggggaagccagg

SEQ ID NO: 404480 - RNA, 61 nt, Human
gacuucagcagagugguccggggcgaaccagccaugggacggucacccagcagugccgggc

SEQ ID NO: 404481 - RNA, 61 nt, Human
uauccaugcuuauguauccaaacacagagacccaugggaacaaaugagacacauauagaua

SEQ ID NO: 404482 - RNA, 61 nt, Human
cccaauaugccguuuauucagguggggcugaccaugggauguggugcuaaugauaaauauu

SEQ ID NO: 404483 - RNA, 61 nt, Human
acugcuuuuaacauuagggacugggagcaguccaugggauaaaaaggaaaguguuuucuca

SEQ ID NO: 404484 - RNA, 61 nt, Human
ccuucugagaaaagagcuucuaguaauugaaccaugggaaacccagcuucuggaggguugg

SEQ ID NO: 404485 - RNA, 61 nt, Human
aacuagucaccugggugcugugcugaaagucccaugggagaacucaaagcgugcauuauca

SEQ ID NO: 404486 - RNA, 61 nt, Human
ggguauugcccuccgugagcacagagacucuccaugggagggggagcaguauucuccugga

SEQ ID NO: 404487 - RNA, 61 nt, Human
acccaccugccucugccaggaacagccaacuccaugggaacucuaugggaguggcuuuuaa

SEQ ID NO: 404488 - RNA, 61 nt, Human
ggcccccuaggagggagcgcuggggacauugccaugggacggaagucugcuuggcaguggc

SEQ ID NO: 404489 - RNA, 61 nt, Human
ccccuuccugcugggguucccuguuuucgagccaugggaggcaggcugcucacgccuccuc

SEQ ID NO: 404490 - RNA, 61 nt, Human
caagaaucagaggggccacagcccuucuccuccaugggaggcccuggagccugauagaaau

SEQ ID NO: 404491 - RNA, 61 nt, Human
gcccacaaugucugcccugaucaauauguauccaugggacuuugaagauccuaagccaggu

SEQ ID NO: 404492 - RNA, 61 nt, Human
ucacguuguaaauauguuuuguagagugaagccaugggaagccauguguaacagagcuuag

SEQ ID NO: 404493 - RNA, 61 nt, Human
aacuuggcggagcuaaggagaucuuauucuaccaugggacauaaggagcauccacugcaca

SEQ ID NO: 404494 - RNA, 61 nt, Human
gaccaucugugaguucugagaggcauuuaggccaugggacagggaggacgcucucuggccu

SEQ ID NO: 404495 - RNA, 64 nt, Human
acagcccccugaggcccagagacaugcagcucucuguccacaaccaugccacuugcaugggagc

SEQ ID NO: 404496 - RNA, 64 nt, Human
augaguaaaaugaauuacuguauuuuuccuuuuauguccacagaaugagagucauauguuguua

SEQ ID NO: 404497 - RNA, 64 nt, Human
aggacccccucagaccaggcccuugucugugcccuguccacacccaggagccauccucaguguc

SEQ ID NO: 404498 - RNA, 64 nt, Human
auaucuuuaccaacaucuugaauauauauucuaguguccacaagauuuagcaaaaagauaaagc

SEQ ID NO: 404499 - RNA, 61 nt, Human
aggcagcugguguggagccccuuggccagggccaugggagucccgcgcagucagcuccaca

SEQ ID NO: 404500 - RNA, 61 nt, Human
aaauacguuugaaauaguugaucuacaaaggccaugggaaaaauucagagaguuaggaagg

SEQ ID NO: 404501 - RNA, 61 nt, Human
agucaggaaaggaaucauuucuauuucuccuccaugggagaaaauagauaagaguagaaac

SEQ ID NO: 404502 - RNA, 61 nt, Human
agagcauuucaaggccacagcuccacaccugccaugggauguuaauguggcaggggguggg

SEQ ID NO: 404503 - RNA, 61 nt, Human
acaggccuggaacccuggaagggagggaggcccaugggaggccaagccugggggcuggggg

SEQ ID NO: 404504 - RNA, 61 nt, Human
gaccaucugugaguucugagaggcauuuaggccaugggacagggaggauccugucuggccu

SEQ ID NO: 404505 - RNA, 61 nt, Human
cuuuaaaaaauauucaaaauguguuuguuucccaugggauuauucucuaucccacacgaau

SEQ ID NO: 404506 - RNA, 61 nt, Human
ugccccucuccuccucacuauucucaccaggccaugggacuuugggggcagugagagagag

SEQ ID NO: 404507 - RNA, 61 nt, Human
aaugauccuguauucagacagaugaggcuuuccaugggaccacaacuauuuucagauguga

SEQ ID NO: 404508 - RNA, 61 nt, Human
cuccagguccccugaucuuggggccuguuucccaugggauucaagagggacagccccagcu

SEQ ID NO: 404509 - RNA, 61 nt, Human
aggggcuggggucuucuccugaagccugacuccaugggaccccaaagaagcagauggaaaa

SEQ ID NO: 404510 - RNA, 61 nt, Human
cacugggagcacuuuguaggcauugcaugaaccaugggaugaugauucuguggagguauug

SEQ ID NO: 404511 - RNA, 61 nt, Human
ugugguagaaaauauugagacagagcauuugccaugggacauuuacagccuuuauacaaau

SEQ ID NO: 404512 - RNA, 61 nt, Human
auccaaaagacucauuuguguggaugcgugaccaugggaaaaagaaaaaaaaaaagaucca

SEQ ID NO: 404513 - RNA, 61 nt, Human
aggugcaugguccacaauguaugguuuggucccaugggacaugucauagccuugguuuagu

SEQ ID NO: 404514 - RNA, 64 nt, Human
cuugugaccaguaccaaucuugaguuucuuuuucuguccacaaguaaauuaauaucugcucuga

SEQ ID NO: 404515 - RNA, 64 nt, Human
aucuaucucuugccuucccccaugaacuucagccuguccacacaaaagccacauaaacucaagc

SEQ ID NO: 404516 - RNA, 64 nt, Human
cuuuuuucccagcccaaauucuccucucuaaaaguguccacaagaagggguguuuauucuucca

SEQ ID NO: 404517 - RNA, 64 nt, Human
cucaucuguugggaaccugugauauaccuccauuuguccacaagaugguguuuaaaacaauuug

SEQ ID NO: 404518 - RNA, 61 nt, Human
ccccagggcugccuaaggacacagagauucuccaugggaaggggacugccaagcaugagga

SEQ ID NO: 404519 - RNA, 61 nt, Human
uucuuauacccuaaaaccuucuacacuagugccaugggaaccaggucugaaaaaguagaga

SEQ ID NO: 404520 - RNA, 61 nt, Human
uguuuuagcaaacagauggauucucuccaggccaugggauuugggaaccaccaugccaauc

SEQ ID NO: 404521 - RNA, 61 nt, Human
gaauagugacagagucaggccaccccaagggccaugggagccagcugaccugcuugaccga

SEQ ID NO: 404522 - RNA, 61 nt, Human
uggaccacccucauccaugcaacuccaggccccaugggaacggauguggaaggaagaacug

SEQ ID NO: 404523 - RNA, 61 nt, Human
cucccccuccucuccaccaucgucuucuuggccaugggaggccuuucccuaagccagcugc

SEQ ID NO: 404524 - RNA, 61 nt, Human
uuaaaaaacuugaaaugcucgccaaauguccccaugggauuuuugaccaaaaguaagguga

SEQ ID NO: 404525 - RNA, 61 nt, Human
ggccacugcaaagagagacgggcuggcuaacccaugggauuuagcuuauaagaacaaagca

SEQ ID NO: 404526 - RNA, 53 nt, Human
agugucugggagcacagugaagaccaugggagcacccuggcaccugggagcac

SEQ ID NO: 404527 - RNA, 61 nt, Human
gccuuuuguuccuccugucccaguuugguuuccaugggaaccugaguggcagcgucaucac

SEQ ID NO: 404528 - RNA, 61 nt, Human
guguacuuuuggguucacagaagcacagcacccaugggaaggguccaucucagagaauuua

SEQ ID NO: 404529 - RNA, 61 nt, Human
uggcuccccaucucggguccauccuauacuuccaugggacucccuauggcugaaggccuua

SEQ ID NO: 404530 - RNA, 61 nt, Human
uccuuuuagcccuuauuuauugucggucugcccaugggacugggagccgcccacuuuuguc

SEQ ID NO: 404531 - RNA, 61 nt, Human
uccugguggaagucuuggguguuagugucagccaugggaaaugagccagcccaagggcauc

SEQ ID NO: 404532 - RNA, 61 nt, Human
uggaagcuuucauuugccgggacacucgggcccaugggauugcacagagcuggagggaggg

SEQ ID NO: 404533 - RNA, 52 nt, Human; identical to SEQ ID NO: 12579

SEQ ID NO: 404534 - RNA, 64 nt, Human
auuucuaucagguaaacugucacuuaaauggagguguccacaucuuaauuguuucuccuugaca

SEQ ID NO: 404535 - RNA, 64 nt, Human
ccucagacuguggggacagauacaauuccacuccuguccacaggaacaugagauuuagcagacu

SEQ ID NO: 404536 - RNA, 64 nt, Human
uuggggccugagaaggccuugcgggggugggguuuguccacagagcugcuggagcagcaccaag

SEQ ID NO: 404537 - RNA, 61 nt, Human
uuuagcucaugcaaaagacuugcaauugucuccaugggacgaucccagugggacugucagc

SEQ ID NO: 404538 - RNA, 61 nt, Human
ggcuaaacaaccuugaucauugagccucgagccaugggagagaugcugaccauguggacug

SEQ ID NO: 404539 - RNA, 61 nt, Human
uguuuuuauuacguuuccuuuuucaaacuguccaugggaaggcugaauugagugacucccc

SEQ ID NO: 404540 - RNA, 61 nt, Human
aaaauaaauacacaugcacacauuacauuagccaugggagcaauaaugucaccacacacac

SEQ ID NO: 404541 - RNA, 61 nt, Human
ggggagcacuggaggguuacugacucucuggccaugggaacucagagauucucauccccaa

SEQ ID NO: 404542 - RNA, 61 nt, Human
acaaaaggggaacugcaccauggcacuuggcccaugggaaagaggguaugguggugugccg

SEQ ID NO: 404543 - RNA, 61 nt, Human
cagccaagcaagacugagcagcagcagggccccaugggauccauccugucucccucagaga

SEQ ID NO: 404544 - RNA, 61 nt, Human
ugaauguaagauggucccauuucaauuuccaccaugggagagccuaaaaauaaauuaugac

SEQ ID NO: 404545 - RNA, 61 nt, Human
cccagaucacaaugacaagaugccacuccaaccaugggacaccuucaugauacuagguuug

SEQ ID NO: 404546 - RNA, 61 nt, Human
uaugcauauauaaguuuacaccuuuaucuuuccaugggagccagcugcuuuuugugauuuu

SEQ ID NO: 404547 - RNA, 61 nt, Human
auacauaaaaugcacgcaagccauuaucucuccaugggaagcuaaguuauaaaaauaggug

SEQ ID NO: 404548 - RNA, 61 nt, Human
ugcccagccuguggugcuugaaacguuugccccaugggaaacguaugugugcaggagccuc

SEQ ID NO: 404549 - RNA, 61 nt, Human
uggaauuugcugcuauaagaauguccagcuaccaugggaacgcaaggcagcaacucucuaa

SEQ ID NO: 404550 - RNA, 61 nt, Human
uacucucccacugugccugccauccaggcagccaugggaggcggccucccuguuccacuuu

SEQ ID NO: 404551 - RNA, 61 nt, Human
aaaaacagucacucuguuaagugacuauaugccaugggauauauggaaaaaagauauuaau

SEQ ID NO: 404552 - RNA, 64 nt, Human
ccugucugacuagcaaaacgcagaaccuuaagauuguccacauccuucaugcaagacugcugcc

SEQ ID NO: 404553 - RNA, 64 nt, Human
uagcagccuccuggacuuccugaggacucgacauuguccacagauguacuggccauuacaugaa

SEQ ID NO: 404554 - RNA, 64 nt, Human
cuccacagccugucacugcccccuccccagccuguguccacagugcugugaucccgagggaagu

SEQ ID NO: 404555 - RNA, 64 nt, Human
uguugcguguuccuuguagccauagaugugauuauguccacaccgggcugccuuaaucuguccu

SEQ ID NO: 404556 - RNA, 61 nt, Human
caagagucaagguugcgaguacaggccaagaccaugggaaaaaaagccaugcucacuggcc

SEQ ID NO: 404557 - RNA, 61 nt, Human
gucagaggguaggugggaaagaacagacaagccaugggaaguuggcaguggggagauuucc

SEQ ID NO: 404558 - RNA, 61 nt, Human
ggcgccucacggauggcaaagcucuccucacccaugggacuguagugcaauuaaacccgcg

SEQ ID NO: 404559 - RNA, 61 nt, Human
gcauggaauugguagaagucuugggaucuugccaugggacagaguccccaagguuccuguu

SEQ ID NO: 404560 - RNA, 61 nt, Human
ucuggaaaccuggguccuagucccagcucuuccaugggaucccccugucacccugagcaaa

SEQ ID NO: 404561 - RNA, 61 nt, Human
gccccagcguucagaaggccagcauugucuuccaugggagaugacucuuaagccauagggg

SEQ ID NO: 404562 - RNA, 61 nt, Human
gauagccugugggcaccagcagcaagggcugccaugggauacagcacccaucuacaaagac

SEQ ID NO: 404563 - RNA, 61 nt, Human
gcagaugcauucuccuggcugcugggagagcccaugggaaccuugcuuagcgcccaaggua

SEQ ID NO: 404564 - RNA, 61 nt, Human
aagcauauauauauauaaaauaaaauuuaggccaugggaacuggcauuuuacuugguauag

SEQ ID NO: 404565 - RNA, 61 nt, Human
cagauggcacaccagaacuuaaugcuggaucccaugggaucgaugucugaggucccaccua

SEQ ID NO: 404566 - RNA, 61 nt, Human
gcuguguaaguagacguuaaucuggcuggaaccaugggaagcacuuugcaguguucagaag

SEQ ID NO: 404567 - RNA, 60 nt, Human
agugcgauggggccacguagggugggcaccccaugggacucaguggcucacauuuccugc

SEQ ID NO: 404568 - RNA, 61 nt, Human
cagcuuuaaucuccagaagaaaaccaaaauaccaugggauuuaugcuguauugacaucuug

SEQ ID NO: 404569 - RNA, 61 nt, Human
caaucuugaacuguacacaacaaagguacagccaugggaauacagaaugauagaagagacu

SEQ ID NO: 404570 - RNA, 61 nt, Human
agcugcccagaacccugcugaugagccugcuccaugggacccagccccccaggagauuggg

SEQ ID NO: 404571 - RNA, 62 nt, Human
accgcugccuuuugcugcugcugcugcggcgaccgccgcagggacggggacuggcccucccu

SEQ ID NO: 404572 - RNA, 62 nt, Human
ccacgcugucugcgcuggcuccacccgggaacccgccgcacgcuguguucuaggcccgccca

SEQ ID NO: 404573 - RNA, 64 nt, Human
uuucuaguccuggggccuagauucugcacuuggggucucugacacaacacaccaucccaaagua

SEQ ID NO: 404574 - RNA, 64 nt, Human
acaaaauuccucagggauuucauuuugcaggcaugucucugagcuucuauaccugcucaagguc

SEQ ID NO: 404575 - RNA, 61 nt, Human
cuuuuuauuagacacggccaggcagagaagaccaugggaguucccgaggggccccagcuuu

SEQ ID NO: 404576 - RNA, 61 nt, Human
ugcuugagcccuggacucaucuugggaagggccaugggagguccuggcuagaguucugccc

SEQ ID NO: 404577 - RNA, 61 nt, Human
auggcugggggcgccagcccaagaauggggaccaugggacuccuccagccuggcucuuccc

SEQ ID NO: 404578 - RNA, 61 nt, Human
gcuaaggcuggaaauggcccccucuuaguugccaugggaaccuaguaacagacucugcugg

SEQ ID NO: 404579 - RNA, 61 nt, Human
agcccucccugccccucccuucaaccauuccccaugggaaaugucaacaaguaugaauaaa

SEQ ID NO: 404580 - RNA, 61 nt, Human
uggagcuacagugucccccaccuuccuugccccaugggaaccuccaccuccuacuccccac

SEQ ID NO: 404581 - RNA, 61 nt, Human
gucccacauucccaacaccgcccucugaucaccaugggaaucuuuggacucaggacagggc

SEQ ID NO: 404582 - RNA, 61 nt, Human
gcagagccuggacaccaacuuuauggacugcccaugggagugcuccaaaugucaggguguu

SEQ ID NO: 404583 - RNA, 61 nt, Human
cccuucugugggucgcucccagagccauggcccaugggaaggacagaguguguguguccuu

SEQ ID NO: 404584 - RNA, 61 nt, Human
guguuuuguuuuuguuuuccauuugggggccccaugggaaagagcuucugaacucuuuccu

SEQ ID NO: 404585 - RNA, 61 nt, Human
ccucccagggcugucucuccuacaccuggagccaugggaucuacugaggaccauccuggag

SEQ ID NO: 404586 - RNA, 61 nt, Human
ugccugguggauguuucuggcccuuuuuccaccaugggaauuucucaccucuagcucuaag

SEQ ID NO: 404587 - RNA, 61 nt, Human
cuugcugccacaguagaccuaguuccaggauccaugggagcauucucaaaggcuuuagccc

SEQ ID NO: 404588 - RNA, 61 nt, Human
gcgugcuucaggcuccucccucuaaggggcgccaugggaacaggcuccggagggagccggc

SEQ ID NO: 404589 - RNA, 61 nt, Human
ccuguaguaggacauggugauuuguuaauuuccaugggaagccaugauggccuagcaugga

SEQ ID NO: 404590 - RNA, 62 nt, Human
ccuaaaaagcagacccaaguuuccuuucuccuccgccgcaaaggagaggcuucccagccccg

SEQ ID NO: 404591 - RNA, 62 nt, Human
aauguauauagcgaccagagcauucuuaauucccgccgcagaccuggcgcccccgccuuggc

SEQ ID NO: 404592 - RNA, 62 nt, Human
auaccuacuuguacguacauguaaaacaaaucccgccgcaacuguuuucuguucuguuguuu

SEQ ID NO: 404593 - RNA, 61 nt, Human
cucccuggaccccauucugagcuccccaucaccaugggagguggggccucaaucuaaggcc

SEQ ID NO: 404594 - RNA, 61 nt, Human
aggucagucauuacagccccuuaugccucuuccaugggaacaaauacugugcagauguuug

SEQ ID NO: 404595 - RNA, 61 nt, Human
gcugggaggggcccgccccggcacaaagcacccaugggaauaaaggccaagccgcgacagu

SEQ ID NO: 404596 - RNA, 61 nt, Human
accuacgugaagaccuccugguaggaucuguccaugggauggagaaccacucuguccagau

SEQ ID NO: 404597 - RNA, 61 nt, Human
uggaagaaugaggcucaccugaugcucguugccaugggacaccuccgagagaguggaggga

SEQ ID NO: 404598 - RNA, 61 nt, Human
uggaaucagaacugcacaaucaagagggaacccaugggacucucugcuacauucaguucuu

SEQ ID NO: 404599 - RNA, 61 nt, Human
gcccugccaggcaccaagcacugcccugggcccaugggauagagcggggaaggugauggcu

SEQ ID NO: 404600 - RNA, 61 nt, Human
guuuuugcuccuagaaagcuacccugguugaccaugggauccggcgccuuacuuuccuggu

SEQ ID NO: 404601 - RNA, 61 nt, Human
uccucugacuggagucuaggaagggcgugucccaugggaaguggauacucuggggugcccc

SEQ ID NO: 404602 - RNA, 61 nt, Human
gagugcuacuuuuucacucaaaaaauagcauccaugggacuuuuuaucaucuaaguaaccu

SEQ ID NO: 404603 - RNA, 61 nt, Human
acccuuacccccauccacucuagcuuugugaccaugggacugaaguuugugauggcuuuuu

SEQ ID NO: 404604 - RNA, 61 nt, Human
uuuggccagccaagguucacggcgauucuccccaugggaucuugagggaccaagcugcugg

SEQ ID NO: 404605 - RNA, 61 nt, Human
aaagauugaauccuaaaggggaucccugcccccaugggaggcccccuacuagaaggacgug

SEQ ID NO: 404606 - RNA, 61 nt, Human
ugcaaaaggggacaagaaaaucccucuuccuccaugggauggauuuaagcucuugcugugu

SEQ ID NO: 404607 - RNA, 61 nt, Human
gcuccccucccaugaccaggcaguggucaccccaugggacaggcacagcuacuuacgcgaa

SEQ ID NO: 404608 - RNA, 62 nt, Human
cuugggggggaagacccucgcugcgccgcuucccgccgcagcgcccgcgccuccgaggggac

SEQ ID NO: 404609 - RNA, 62 nt, Human
uaaaagcauaacuggcuaagucaccgccccacccgccgcauuacauuuccuaaaacauacug

SEQ ID NO: 404610 - RNA, 64 nt, Human
cuggauucacagaccaaguccaagcccguucuuacgucgccauaaaggcccccgaacggcauuc

SEQ ID NO: 404611 - RNA, 64 nt, Human
ucacaaaaacaccguggaugcugaaguuagagcacgucgccacagagcuugacaucaauguuag

SEQ ID NO: 404612 - RNA, 52 nt, Human
ugauguauggcaaugagugagcccaugggaaacagguggagauggggaagcc

SEQ ID NO: 404613 - RNA, 61 nt, Human
agccacaguccagcccaaccacugccacuuuccaugggacuuagaacuucggaguugcugc

SEQ ID NO: 404614 - RNA, 61 nt, Human
acacccaggcccgagcgccugcguucccagaccaugggaaaugggaauugcgcucaggggc

SEQ ID NO: 404615 - RNA, 61 nt, Human
ggcuuuucuggcuucugccaugaaauccuggccaugggaccccagugacagaugaugucuu

SEQ ID NO: 404616 - RNA, 61 nt, Human
auccagaggcccugucauggcccgcccccagccaugggaaagcaaacuucauccuaaggug

SEQ ID NO: 404617 - RNA, 61 nt, Human
ugcagccuuuuggguaucaaaugggucaaaaccaugggaccugccaccucccaucagcaau

SEQ ID NO: 404618 - RNA, 61 nt, Human
acgucugacuccuucacgucaggcucagguuccaugggaggacgaagcaguggacgcauug

SEQ ID NO: 404619 - RNA, 61 nt, Human
uuaacaggaacccagucaaggccauucauggccaugggaccacgcauaaauggagaacgag

SEQ ID NO: 404620 - RNA, 61 nt, Human
uaaaccgagaaaucaugagaaaugucuaaucccaugggaaaaccuguaugccgauuuuccu

SEQ ID NO: 404621 - RNA, 53 nt, Human
agcuccuuaauucuuccugagugccaugggaugcuacaccuugaagcugacag

SEQ ID NO: 404622 - RNA, 61 nt, Human
caggcaucugagcucugugccggggccguggccaugggaagauguuccacgcugccuccuc

SEQ ID NO: 404623 - RNA, 61 nt, Human
gguguuugcuguccgaaggaccugggccggcccaugggagccugggguucuguccagauag

SEQ ID NO: 404624 - RNA, 61 nt, Human
cauggcacaggcccgcccucugccuccucagccaugggaaccucauaugcaauuugggauu

SEQ ID NO: 404625 - RNA, 61 nt, Human
ucauuguugaggaaucccucuuucuaccugaccaugggauucccagaaccugcuaacagaa

SEQ ID NO: 404626 - RNA, 61 nt, Human
ucauuguugaggaaucccucuuucuaccugaccaugggauucccagagccuacuaacagaa

SEQ ID NO: 404627 - RNA, 60 nt, Human; identical to SEQ ID NO: 84341

SEQ ID NO: 404628 - RNA, 62 nt, Human
uaaggagcgcaccaaagcgcagagcuugcugcccgccgcacgcacgcgcgccugcgugcggg

SEQ ID NO: 404629 - RNA, 62 nt, Human
agugaggagcucacagguccucccugguggucccgccgcaccucugcaucuccugggcguca

SEQ ID NO: 404630 - RNA, 62 nt, Human
ucuuauggagccccucccauggagcucucuucccgccgcacuuucuaccccgggcagaggcg

SEQ ID NO: 404631 - RNA, 61 nt, Human
gcgccagucuggcuggaggagcccugagaugccaugggaggccugagguuggccacggggg

SEQ ID NO: 404632 - RNA, 61 nt, Human
cugagcgacaagaggcucagagggcaugaccccaugggacuggaugcggccugagggcuga

SEQ ID NO: 404633 - RNA, 61 nt, Human
uacuuuauguauggagcucuaacccauggguccaugggaauaaagcagugaauaguaacaa

SEQ ID NO: 404634 - RNA, 61 nt, Human
cccucagagaguucacacugaugggaaaugaccaugggaccaccaagcucuaggucaucca

SEQ ID NO: 404635 - RNA, 61 nt, Human
gugacuccuggaaccugcguccuccccaaagccaugggagggguguccuccucagaccaug

SEQ ID NO: 404636 - RNA, 61 nt, Human
aggcagguggcaggcagcucacccacccaccccaugggaucccccagcccuucacccgcgc

SEQ ID NO: 404637 - RNA, 61 nt, Human
aauucaggugaucacaggugucuuguggccuccaugggagguugaaaaccagagaagguga

SEQ ID NO: 404638 - RNA, 61 nt, Human
ucgcuguagggggcgggacuggauucuguauccaugggauuggguguucauccagaggcga

SEQ ID NO: 404639 - RNA, 61 nt, Human
gguccuaggcuggaaggaggaagaauagggcccaugggagggagcugagaagacucaaguc

SEQ ID NO: 404640 - RNA, 61 nt, Human
gccccaguuugucccaaagcaggaguguuuuccaugggauaaaggacacccuagguuuuuc

SEQ ID NO: 404641 - RNA, 61 nt, Human
gaagggccaugaccacccucguagacuuuuuccaugggauacaguuuaggacacggguuuc

SEQ ID NO: 404642 - RNA, 61 nt, Human
cugagggccugcuggaggccucaggugcuguccaugggaaagaugguguggguguccugcc

SEQ ID NO: 404643 - RNA, 61 nt, Human
caguucccagggcacauuucuggaucagaacccaugggaaacaggagguacuaagugcaau

SEQ ID NO: 404644 - RNA, 60 nt, Human
ugugccuuguggugagauaauaaauuauggccaugggaaacauuguauauuuagugugug

SEQ ID NO: 404645 - RNA, 61 nt, Human
ugccgcacacccacccagagcacgccacccgccaugggagugugcucaggagucgcgggca

SEQ ID NO: 404646 - RNA, 64 nt, Human
aggaugccuuaucucuucucacuuuccuuuucuugucucugaggcucuccaaauuuugcuuuag

SEQ ID NO: 404647 - RNA, 64 nt, Human
ccaauggauucugcgaugcugucuggacuuugcugucucugaacaguauguguguguugcuuua

SEQ ID NO: 404648 - RNA, 64 nt, Human
auuuuccuccuaaacaaaaacacauugaguuuaagucucugacucuugccuuuccaccugcuuu

SEQ ID NO: 404649 - RNA, 64 nt, Human
ugaacuccugagcucaagaaauccuccugccugagucucugaaagugcugggauuacaggcgug

SEQ ID NO: 404650 - RNA, 61 nt, Human
gggcagcuggcuggaccagaaaguagagggcccaugggagugacugcacccuugguggcug

SEQ ID NO: 404651 - RNA, 61 nt, Human
accucugaauggggcuggauaaccggagaccccaugggaggucccugaagaucagaagggg

SEQ ID NO: 404652 - RNA, 61 nt, Human
cauugaugggaggccauggucguggcuguggccaugggagaggaggggccuggaguugccg

SEQ ID NO: 404653 - RNA, 61 nt, Human
cagcagccagacuacggaauccacauguggaccaugggaagucagucucuugcguguccua

SEQ ID NO: 404654 - RNA, 61 nt, Human
ugccaugaggggggcguguccaggagggugaccaugggauggcuuauacacacaggccucc

SEQ ID NO: 404655 - RNA, 61 nt, Human
cagugucucuauucacgguccugagcaggggccaugggauugggcucugggcacugacuca

SEQ ID NO: 404656 - RNA, 61 nt, Human
caaggucuucauucaugguccugagcaggugccaugggauugggcucugggcacugacuua

SEQ ID NO: 404657 - RNA, 61 nt, Human
uuggcaagucucaucuucaguaauacggaugccaugggaguggccaggccagauugaaggu

SEQ ID NO: 404658 - RNA, 61 nt, Human
gccccugaacaagaauuggaagcugcccugcccaugggagcugguuagaaaugcagaaucc

SEQ ID NO: 404659 - RNA, 61 nt, Human
gggcucacggggccuccaacccauuuaaucaccaugggaaacuguugugggcgcugcuucc

SEQ ID NO: 404660 - RNA, 61 nt, Human
gcuuauggauggggaugacuucccuaagaucccaugggacaaggauguggcaaggcuugga

SEQ ID NO: 404661 - RNA, 61 nt, Human
caaucucugggccaagaucacaugcaggauaccaugggaaggagccaucuccacucuccuu

SEQ ID NO: 404662 - RNA, 61 nt, Human
gggccuggcacagaccccuaggugccucgcuccaugggauugcaacaagcuaguuuaggaa

SEQ ID NO: 404663 - RNA, 61 nt, Human
agcagacucccagcugcuacccccucccuucccaugggaguggcuuuccauuuugggcaga

SEQ ID NO: 404664 - RNA, 61 nt, Human
cauguuauggcagauugaaaaggaucucauuccaugggaaaaaaaaaaauccugucuuguu

SEQ ID NO: 404665 - RNA, 62 nt, Human
cuccugugacggcggcgaggcuugggaggaaaccgccgcaaugggggugucuucccucgggg

SEQ ID NO: 404666 - RNA, 62 nt, Human
cagcugcacucagcaccuaggccaggguggggccgccgcagaugggcucaggaagccccagg

SEQ ID NO: 404667 - RNA, 62 nt, Human
gacucgcagccccaucggacgcucucccgggaccgccgcaggaccaguuuccauagacugcg

SEQ ID NO: 404668 - RNA, 61 nt, Human
agcuaagaaucgugggcugagcagaguuaaaccaugggacaaacccauaacauguucacca

SEQ ID NO: 404669 - RNA, 61 nt, Human
gcagagaggaaggacgcggccgccauggaccccaugggagagugaguaugagccgcugucc

SEQ ID NO: 404670 - RNA, 61 nt, Human
gggaagccaugauuuuccuaagaauccagggccaugggagauacaauuccaaguucucgcu

SEQ ID NO: 404671 - RNA, 61 nt, Human
caguccacaaagcauuuucauuucuaauggcccaugggagccaggcccagaaagcaggaau

SEQ ID NO: 404672 - RNA, 61 nt, Human
agucgcucucccacccagccuggacuuggccccaugggacccauccucagugcucccucca

SEQ ID NO: 404673 - RNA, 61 nt, Human
auuucccagccuuucuugcuguuaggggcuaccaugggaccagcucuggccagagggaacu

SEQ ID NO: 404674 - RNA, 61 nt, Human
acugaauucucuggguggcuuucuuguggccccaugggaugcagcgugggggcugucugaa

SEQ ID NO: 404675 - RNA, 61 nt, Human
uguuagaaguaaaccacaggucccaccagcuccaugggagugaccaccucaguccagggaa

SEQ ID NO: 404676 - RNA, 61 nt, Human
guuguuuaaugccugaaauccaagucuuccuccaugggaaaauacuguuauaccaaauaau

SEQ ID NO: 404677 - RNA, 61 nt, Human
gaugggacuagauucuaaaauuuauuugggaccaugggaaugauaguugggaagaaaacua

SEQ ID NO: 404678 - RNA, 61 nt, Human
gcccuggagucaugccaagcauuuaauguagccaugggaccaaaccuagccccuuagcccc

SEQ ID NO: 404679 - RNA, 61 nt, Human
cucccccagguugggggggagggggcuccucccaugggagguguaggauaaggugggggcg

SEQ ID NO: 404680 - RNA, 61 nt, Human
ucauuuuuuacauugugugccauagacuuacccaugggacaacagagcuccuucauuuuug

SEQ ID NO: 404681 - RNA, 61 nt, Human
agagccgggccacaccucagugccaaagaccccaugggagugggagggaugacaagcggcc

SEQ ID NO: 404682 - RNA, 61 nt, Human
uuggaucauggcccuaaucccaaccccaaccccaugggaggaggaggaggaggaagaagag

SEQ ID NO: 404683 - RNA, 64 nt, Human
ccacuguggcuucaagcaccucuguucauagagcgucucugaaauugagucucggucaugacuu

SEQ ID NO: 404684 - RNA, 64 nt, Human
ggcaggucuguguuuauuacuacauuaaaacaaagucucugacuuauaaagcgagguuguaaaa

SEQ ID NO: 404685 - RNA, 64 nt, Human
ggcuugaucaagggccuuauguggagcagagguugucucugaaccaggagagaagguacuauac

SEQ ID NO: 404686 - RNA, 64 nt, Human
cuuugucucauuuuaacccaacaucugggucugugucucugauuuccauguaaauguugcaaaa

SEQ ID NO: 404687 - RNA, 61 nt, Human
aucagcaguaccacugaggaagccacugccaccaugggagcuacuucucgguucccucccc

SEQ ID NO: 404688 - RNA, 51 nt, Human
gugacacagaugaugacugacccaugggacuccucccaucccccaggcugg

SEQ ID NO: 404689 - RNA, 61 nt, Human
aagauguuuagaagaaaucuuacggaguuugccaugggaugugugauaucagcagucuuca

SEQ ID NO: 404690 - RNA, 61 nt, Human
gaauguggagacugggagucuguccuaaaccccaugggagaagacuucaucaugacaggac

SEQ ID NO: 404691 - RNA, 61 nt, Human
ugggauccaggccccucccucuccagcaggcccaugggaggcuggaguuggggcagaggag

SEQ ID NO: 404692 - RNA, 61 nt, Human
cccauucuccaaggcccgggggggcgguuucccaugggaugugaaaggcuggccauuauua

SEQ ID NO: 404693 - RNA, 62 nt, Human; identical to SEQ ID NO: 84323

SEQ ID NO: 404694 - RNA, 62 nt, Human
gugccaacucacugagccgccugccgcuggggccgccgcacccugcaccuuggaccggcauc

SEQ ID NO: 404695 - RNA, 62 nt, Human
cacugaccccaucuccugccgccgcccuggggccgccgcagggaugccuugccuuuucagga

SEQ ID NO: 404696 - RNA, 62 nt, Human
guuccuuccccuccacccucgccccgucuccgccgccgcaccccuguccagcuguugagcug

SEQ ID NO: 404697 - RNA, 62 nt, Human
gugugcucagaggugguuguuggcggagaacgccgccgcaguguuugaccucuagcggugaa

SEQ ID NO: 404698 - RNA, 62 nt, Human
ucaggggcugccccggaaucagcuccccggggccgccgcaacgaagguggauccgcaucuug

SEQ ID NO: 404699 - RNA, 62 nt, Human
cggcugccuagcccuccccccagcucccugcaccgccgcagaagcagccccucgaggccuac

SEQ ID NO: 404700 - RNA, 62 nt, Human
cuccggucccgcuuccaguuuccuugaagcgcccgccgcacacgcccuauucagcaccagcu

SEQ ID NO: 404701 - RNA, 62 nt, Human
gcaugcguguggaguguccgguggugcucgggccgccgcagugcagcgacugcccggcccuc

SEQ ID NO: 404702 - RNA, 62 nt, Human
gagaaagccaugaagguggauauggacaucugccgccgcaucgacaucaccgccaagcucug

SEQ ID NO: 404703 - RNA, 62 nt, Human
gcuggugcagcggcagaugcuggggcuucagcccgccgcagacuucacagcuggccacaacg

SEQ ID NO: 404704 - RNA, 62 nt, Human
ccucccugugcgugugcgucucugccuuccguccgccgcacacccgccugccuggccgcagg

SEQ ID NO: 404705 - RNA, 62 nt, Human
uaaugacgaagcugcucagcaacuccaccugcccgccgcaggaaggagcaguccccugcuau

SEQ ID NO: 404706 - RNA, 55 nt, Human; identical to SEQ ID NO: 84356

SEQ ID NO: 404707 - RNA, 62 nt, Human
acccaugcccuggaccagccgcccagaucaugccgccgcagcugguugggggcaccaucugg

SEQ ID NO: 404708 - RNA, 62 nt, Human
guccugcuacagcuagugugcuuuuagacuuuccgccgcagacuacauuucuagaguuagag

SEQ ID NO: 404709 - RNA, 62 nt, Human
cggaaccagcccuacauccgcgcagacacaggccgccgcagugcccgucggcgucccccggg

SEQ ID NO: 404710 - RNA, 62 nt, Human
gucaccuggagcugggcacuaaccauuccaagccgccgcaucgcuuguuuccaccuccuggg

SEQ ID NO: 404711 - RNA, 62 nt, Human
ugaguucagcugugacguuagcuucaguggcuccgccgcauccucacacugacgggggcucc

SEQ ID NO: 404712 - RNA, 62 nt, Human
guuuaaacacugaagugccgaaguggcccgugccgccgcacagagaccccgacuuuaguuug

SEQ ID NO: 404713 - RNA, 62 nt, Human
gacuguccccaugcccacggaugcucagcagcccgccgcacuggggcagaugucuccccugc

SEQ ID NO: 404714 - RNA, 62 nt, Human
cuccgcagggcgcccagcgccguccggcggccccgccgcagaccagcuggcggguguggaga

SEQ ID NO: 404715 - RNA, 62 nt, Human
ucgcagggacagcgcuggggaggugacggcgcccgccgcagguggggcgaggcugggggagg

SEQ ID NO: 404716 - RNA, 62 nt, Human
uggccuucagaggcuccuccugggacugggaaccgccgcagggccaggcggacggcgugagg

SEQ ID NO: 404717 - RNA, 62 nt, Human
ccuccuaggaaucacagcuccccguacuggugccgccgcaguggccaaguugcgacacugcc

SEQ ID NO: 404718 - RNA, 62 nt, Human
ccaagcacugcggccacucagcagcuauguucccgccgcaguggggcccugacgcccaccuc

SEQ ID NO: 404719 - RNA, 62 nt, Human
ggugugagccacagcacccaaccuuuuuuuccccgccgcaccccaagauggugucucacucu

SEQ ID NO: 404720 - RNA, 62 nt, Human
cucucuggucaucgccugggaggaagaugccaccgccgcagcaaggucccugcggccaccac

SEQ ID NO: 404721 - RNA, 62 nt, Human
cuccuugccucccacaacaacuacgcccgcuaccgccgcaccugggcuggcugcgcggguuu

SEQ ID NO: 404722 - RNA, 64 nt, Human
agcuccugggagucccagcuguuguucccagcaacgucgccacugcccuccuacucuccaggcu

SEQ ID NO: 404723 - RNA, 64 nt, Human
ccucagagaccugcggaaagcccccucccugagucgucgccacaccaggcgacaggcaccaccc

SEQ ID NO: 404724 - RNA, 64 nt, Human
gacuuaaucuuuauauuuuauaagaauggccucccgucgccagaacggucauauguguucaacg

SEQ ID NO: 404725 - RNA, 64 nt, Human
gucccucugcuccgugugucucaugccagcagcacgucgccauccgucaccagaauuaguccuc

SEQ ID NO: 404726 - RNA, 64 nt, Human
gucaccucccuggugugagcccaccagcgcgcaccgucgccacggaucgccgcccccacccagc

SEQ ID NO: 404727 - RNA, 64 nt, Human
uucccaugagcagcaguucauuuaauugucacagcgucgccaggaagaagaucugauaaaccua

SEQ ID NO: 404728 - RNA, 64 nt, Human
uggacaacugagaauucucccagcugccugaaagcgucgccaacugugguuauccugcaagcug

SEQ ID NO: 404729 - RNA, 64 nt, Human
cgucgccggccucguccagcuccaugucgcccuccgucgccaggaugcgcugcacggucugcag

SEQ ID NO: 404730 - RNA, 64 nt, Human
cguccaguuccuacuaacucugagcugaagccgacgucgccagccugggagcgaccacuuuggc

SEQ ID NO: 404731 - RNA, 64 nt, Human; identical to SEQ ID NO: 137716

SEQ ID NO: 404732 - RNA, 64 nt, Human; identical to SEQ ID NO: 137717

SEQ ID NO: 404733 - RNA, 64 nt, Human; identical to SEQ ID NO: 137718

SEQ ID NO: 404734 - RNA, 64 nt, Human; identical to SEQ ID NO: 137719

SEQ ID NO: 404735 - RNA, 64 nt, Human; identical to SEQ ID NO: 137720

SEQ ID NO: 404736 - RNA, 64 nt, Human; identical to SEQ ID NO: 137721

SEQ ID NO: 404737 - RNA, 64 nt, Human; identical to SEQ ID NO: 137722

SEQ ID NO: 404738 - RNA, 64 nt, Human; identical to SEQ ID NO: 137723

SEQ ID NO: 404739 - RNA, 64 nt, Human; identical to SEQ ID NO: 137724

SEQ ID NO: 404740 - RNA, 64 nt, Human; identical to SEQ ID NO: 137725

SEQ ID NO: 404741 - RNA, 64 nt, Human; identical to SEQ ID NO: 137726

SEQ ID NO: 404742 - RNA, 64 nt, Human; identical to SEQ ID NO: 137727

SEQ ID NO: 404743 - RNA, 64 nt, Human; identical to SEQ ID NO: 137728

SEQ ID NO: 404744 - RNA, 64 nt, Human; identical to SEQ ID NO: 137729

SEQ ID NO: 404745 - RNA, 64 nt, Human; identical to SEQ ID NO: 137730

SEQ ID NO: 404746 - RNA, 64 nt, Human; identical to SEQ ID NO: 137731

SEQ ID NO: 404747 - RNA, 64 nt, Human
ugucugggacccccaaagggauccuuucucuaaggucucugacgguggguccaggaccagaccu

SEQ ID NO: 404748 - RNA, 64 nt, Human
uccugagaauggcuuaguccugagaaucugcaaagucucugaagagaacucucucuucccacua

SEQ ID NO: 404749 - RNA, 64 nt, Human
ccuaaaaucaaaaagauuucaguuuugucauucugucucugagauucuauuuccacaucuagag

SEQ ID NO: 404750 - RNA, 64 nt, Human; identical to SEQ ID NO: 137732

SEQ ID NO: 404751 - RNA, 64 nt, Human; identical to SEQ ID NO: 137733

SEQ ID NO: 404752 - RNA, 64 nt, Human; identical to SEQ ID NO: 137734

SEQ ID NO: 404753 - RNA, 64 nt, Human; identical to SEQ ID NO: 137735

SEQ ID NO: 404754 - RNA, 64 nt, Human; identical to SEQ ID NO: 137736

SEQ ID NO: 404755 - RNA, 64 nt, Human; identical to SEQ ID NO: 137737

SEQ ID NO: 404756 - RNA, 64 nt, Human; identical to SEQ ID NO: 137738

SEQ ID NO: 404757 - RNA, 64 nt, Human; identical to SEQ ID NO: 137739

SEQ ID NO: 404758 - RNA, 64 nt, Human; identical to SEQ ID NO: 137740

SEQ ID NO: 404759 - RNA, 64 nt, Human; identical to SEQ ID NO: 137741

SEQ ID NO: 404760 - RNA, 64 nt, Human; identical to SEQ ID NO: 137742

SEQ ID NO: 404761 - RNA, 64 nt, Human; identical to SEQ ID NO: 137743

SEQ ID NO: 404762 - RNA, 64 nt, Human; identical to SEQ ID NO: 137744

SEQ ID NO: 404763 - RNA, 64 nt, Human; identical to SEQ ID NO: 137745

SEQ ID NO: 404764 - RNA, 64 nt, Human; identical to SEQ ID NO: 137746

SEQ ID NO: 404765 - RNA, 64 nt, Human; identical to SEQ ID NO: 137747

SEQ ID NO: 404766 - RNA, 64 nt, Human
aaagugcucuuauauuuucaugaguuuuuauuuugucucugagauuuuguauuccacauucuag

SEQ ID NO: 404767 - RNA, 64 nt, Human
uuuccacauaaggaaacuggguuccugcaaugaagucucugaagugaaacugcuuguuuccuag

SEQ ID NO: 404768 - RNA, 64 nt, Human
guuuauauuugggucuuuauguuggugcugccaggucucugagcuccagagguggccucuugga

SEQ ID NO: 404769 - RNA, 64 nt, Human; identical to SEQ ID NO: 137748

SEQ ID NO: 404770 - RNA, 64 nt, Human; identical to SEQ ID NO: 137749

SEQ ID NO: 404771 - RNA, 64 nt, Human; identical to SEQ ID NO: 137750

SEQ ID NO: 404772 - RNA, 64 nt, Human; identical to SEQ ID NO: 137751

SEQ ID NO: 404773 - RNA, 64 nt, Human; identical to SEQ ID NO: 137752

SEQ ID NO: 404774 - RNA, 64 nt, Human; identical to SEQ ID NO: 137753

SEQ ID NO: 404775 - RNA, 64 nt, Human; identical to SEQ ID NO: 137754

SEQ ID NO: 404776 - RNA, 64 nt, Human; identical to SEQ ID NO: 137755

SEQ ID NO: 404777 - RNA, 64 nt, Human; identical to SEQ ID NO: 137756

SEQ ID NO: 404778 - RNA, 64 nt, Human; identical to SEQ ID NO: 137757

SEQ ID NO: 404779 - RNA, 64 nt, Human; identical to SEQ ID NO: 137758

SEQ ID NO: 404780 - RNA, 64 nt, Human; identical to SEQ ID NO: 137759

SEQ ID NO: 404781 - RNA, 64 nt, Human; identical to SEQ ID NO: 137760

SEQ ID NO: 404782 - RNA, 64 nt, Human; identical to SEQ ID NO: 137761

SEQ ID NO: 404783 - RNA, 64 nt, Human; identical to SEQ ID NO: 137762

SEQ ID NO: 404784 - RNA, 64 nt, Human; identical to SEQ ID NO: 137763

SEQ ID NO: 404785 - RNA, 64 nt, Human
gcugcaccccagcgccugggcccgccccacgcucuguccacacccacgcgccccgggagcgggg

SEQ ID NO: 404786 - RNA, 64 nt, Human
cuaauuuauugccguccuggacucugugugagcguguccacagaguuuguaguaaauauuauga

SEQ ID NO: 404787 - RNA, 64 nt, Human
aaacguggugcccagggugcccugccucaggacauguccacacccacgucacaagcaccugagg

SEQ ID NO: 404788 - RNA, 64 nt, Human; identical to SEQ ID NO: 137764

SEQ ID NO: 404789 - RNA, 64 nt, Human; identical to SEQ ID NO: 137765

SEQ ID NO: 404790 - RNA, 64 nt, Human; identical to SEQ ID NO: 137766

SEQ ID NO: 404791 - RNA, 64 nt, Human; identical to SEQ ID NO: 137767

SEQ ID NO: 404792 - RNA, 64 nt, Human; identical to SEQ ID NO: 137768

SEQ ID NO: 404793 - RNA, 64 nt, Human; identical to SEQ ID NO: 137769

SEQ ID NO: 404794 - RNA, 64 nt, Human; identical to SEQ ID NO: 137770

SEQ ID NO: 404795 - RNA, 64 nt, Human; identical to SEQ ID NO: 137771

SEQ ID NO: 404796 - RNA, 64 nt, Human; identical to SEQ ID NO: 137772

SEQ ID NO: 404797 - RNA, 51 nt, Human; identical to SEQ ID NO: 137773

SEQ ID NO: 404798 - RNA, 64 nt, Human; identical to SEQ ID NO: 137774

SEQ ID NO: 404799 - RNA, 64 nt, Human; identical to SEQ ID NO: 137775

SEQ ID NO: 404800 - RNA, 64 nt, Human; identical to SEQ ID NO: 137776

SEQ ID NO: 404801 - RNA, 64 nt, Human; identical to SEQ ID NO: 137777

SEQ ID NO: 404802 - RNA, 64 nt, Human; identical to SEQ ID NO: 137778

SEQ ID NO: 404803 - RNA, 64 nt, Human; identical to SEQ ID NO: 137779

SEQ ID NO: 404804 - RNA, 64 nt, Human
ugaaucuuccgcuuccuccccaccgauuucagcguguccacaucacagcucccuccagaagcug

SEQ ID NO: 404805 - RNA, 64 nt, Human
ucugagaccacaaaauacaaggccagaccuagaguguccacagcaggccugugcugcccgccuc

SEQ ID NO: 404806 - RNA, 64 nt, Human
agcagcaggcagaaccgugucuguggucgggugcuguccacagcucugucugccuuguucuugg

SEQ ID NO: 404807 - RNA, 64 nt, Human; identical to SEQ ID NO: 137780

SEQ ID NO: 404808 - RNA, 64 nt, Human; identical to SEQ ID NO: 137781

SEQ ID NO: 404809 - RNA, 64 nt, Human; identical to SEQ ID NO: 137782

SEQ ID NO: 404810 - RNA, 64 nt, Human; identical to SEQ ID NO: 137783

SEQ ID NO: 404811 - RNA, 64 nt, Human; identical to SEQ ID NO: 137784

SEQ ID NO: 404812 - RNA, 64 nt, Human; identical to SEQ ID NO: 137785

SEQ ID NO: 404813 - RNA, 64 nt, Human; identical to SEQ ID NO: 137786

SEQ ID NO: 404814 - RNA, 64 nt, Human; identical to SEQ ID NO: 137787

SEQ ID NO: 404815 - RNA, 64 nt, Human; identical to SEQ ID NO: 137788

SEQ ID NO: 404816 - RNA, 64 nt, Human; identical to SEQ ID NO: 137789

SEQ ID NO: 404817 - RNA, 64 nt, Human; identical to SEQ ID NO: 137790

SEQ ID NO: 404818 - RNA, 64 nt, Human; identical to SEQ ID NO: 137791

SEQ ID NO: 404819 - RNA, 64 nt, Human; identical to SEQ ID NO: 137792

SEQ ID NO: 404820 - RNA, 64 nt, Human; identical to SEQ ID NO: 137793

SEQ ID NO: 404821 - RNA, 64 nt, Human; identical to SEQ ID NO: 137794

SEQ ID NO: 404822 - RNA, 64 nt, Human; identical to SEQ ID NO: 137795

SEQ ID NO: 404823 - RNA, 64 nt, Human
cgauuuggcaggaaauaaggcgauuaacccuauguguccacaagccucaagccuuguuucaggu

SEQ ID NO: 404824 - RNA, 64 nt, Human
cuagacaaugacauauaagccguauauagaucaauguccacauauauauacacacacacauaua

SEQ ID NO: 404825 - RNA, 64 nt, Human
aaaggaucgaggcauggggcauguccuuuccaucuguccacauccccagagcccagcucuugcu

SEQ ID NO: 404826 - RNA, 64 nt, Human; identical to SEQ ID NO: 137796

SEQ ID NO: 404827 - RNA, 64 nt, Human; identical to SEQ ID NO: 137797

SEQ ID NO: 404828 - RNA, 64 nt, Human; identical to SEQ ID NO: 137798

SEQ ID NO: 404829 - RNA, 64 nt, Human; identical to SEQ ID NO: 137799

SEQ ID NO: 404830 - RNA, 64 nt, Human; identical to SEQ ID NO: 137800

SEQ ID NO: 404831 - RNA, 64 nt, Human; identical to SEQ ID NO: 137801

SEQ ID NO: 404832 - RNA, 64 nt, Human; identical to SEQ ID NO: 137802

SEQ ID NO: 404833 - RNA, 64 nt, Human; identical to SEQ ID NO: 137803

SEQ ID NO: 404834 - RNA, 64 nt, Human; identical to SEQ ID NO: 137804

SEQ ID NO: 404835 - RNA, 64 nt, Human; identical to SEQ ID NO: 137805

SEQ ID NO: 404836 - RNA, 64 nt, Human; identical to SEQ ID NO: 137806

SEQ ID NO: 404837 - RNA, 64 nt, Human; identical to SEQ ID NO: 137807

SEQ ID NO: 404838 - RNA, 64 nt, Human; identical to SEQ ID NO: 137808

SEQ ID NO: 404839 - RNA, 64 nt, Human; identical to SEQ ID NO: 137809

SEQ ID NO: 404840 - RNA, 64 nt, Human; identical to SEQ ID NO: 137810

SEQ ID NO: 404841 - RNA, 64 nt, Human; identical to SEQ ID NO: 137811

SEQ ID NO: 404842 - RNA, 64 nt, Human
uugaccguuuuuauauuacuuuuguaaauauucuuguccacauucuacuucagcuuuggaugug

SEQ ID NO: 404843 - RNA, 64 nt, Human
gauauuuggaagcaaaugauauuuccucuugcaguguccacaaaucugaauauuaggggcauga

SEQ ID NO: 404844 - RNA, 64 nt, Human
aaggcaggugggcagacagugaccucucuagguguguccacagaguuuuucaggagagaaaacu

SEQ ID NO: 404845 - RNA, 64 nt, Human; identical to SEQ ID NO: 137812

SEQ ID NO: 404846 - RNA, 64 nt, Human; identical to SEQ ID NO: 137813

SEQ ID NO: 404847 - RNA, 64 nt, Human; identical to SEQ ID NO: 137814

SEQ ID NO: 404848 - RNA, 64 nt, Human; identical to SEQ ID NO: 137815

SEQ ID NO: 404849 - RNA, 64 nt, Human; identical to SEQ ID NO: 137816

SEQ ID NO: 404850 - RNA, 64 nt, Human; identical to SEQ ID NO: 137817

SEQ ID NO: 404851 - RNA, 64 nt, Human; identical to SEQ ID NO: 137818

SEQ ID NO: 404852 - RNA, 64 nt, Human; identical to SEQ ID NO: 137819

SEQ ID NO: 404853 - RNA, 64 nt, Human; identical to SEQ ID NO: 137820

SEQ ID NO: 404854 - RNA, 64 nt, Human; identical to SEQ ID NO: 137821

SEQ ID NO: 404855 - RNA, 64 nt, Human; identical to SEQ ID NO: 137822

SEQ ID NO: 404856 - RNA, 64 nt, Human; identical to SEQ ID NO: 137823

SEQ ID NO: 404857 - RNA, 64 nt, Human; identical to SEQ ID NO: 137824

SEQ ID NO: 404858 - RNA, 64 nt, Human; identical to SEQ ID NO: 137825

SEQ ID NO: 404859 - RNA, 64 nt, Human; identical to SEQ ID NO: 137826

SEQ ID NO: 404860 - RNA, 64 nt, Human; identical to SEQ ID NO: 137827

SEQ ID NO: 404861 - RNA, 64 nt, Human
ccaggccagccuguguccccucccgcaggccuccuguccacaccagcgcccccuggggggccuc

SEQ ID NO: 404862 - RNA, 64 nt, Human
ggagccccguggagcgcggccugcacgggaguuguguccacaaaggcaaaguaaagggguggaa

SEQ ID NO: 404863 - RNA, 64 nt, Human
ggaacuugcugggucagaucuguguggccagcccuguccacaccaugccucuccugcacuggag

SEQ ID NO: 404864 - RNA, 64 nt, Human; identical to SEQ ID NO: 137828

SEQ ID NO: 404865 - RNA, 64 nt, Human; identical to SEQ ID NO: 137829

SEQ ID NO: 404866 - RNA, 64 nt, Human; identical to SEQ ID NO: 137830

SEQ ID NO: 404867 - RNA, 64 nt, Human; identical to SEQ ID NO: 137831

SEQ ID NO: 404868 - RNA, 64 nt, Human; identical to SEQ ID NO: 137832

SEQ ID NO: 404869 - RNA, 64 nt, Human; identical to SEQ ID NO: 137833

SEQ ID NO: 404870 - RNA, 64 nt, Human; identical to SEQ ID NO: 137834

SEQ ID NO: 404871 - RNA, 64 nt, Human; identical to SEQ ID NO: 137835

SEQ ID NO: 404872 - RNA, 64 nt, Human; identical to SEQ ID NO: 137836

SEQ ID NO: 404873 - RNA, 64 nt, Human; identical to SEQ ID NO: 137837

SEQ ID NO: 404874 - RNA, 64 nt, Human; identical to SEQ ID NO: 137838

SEQ ID NO: 404875 - RNA, 64 nt, Human; identical to SEQ ID NO: 137839

SEQ ID NO: 404876 - RNA, 64 nt, Human; identical to SEQ ID NO: 137840

SEQ ID NO: 404877 - RNA, 64 nt, Human; identical to SEQ ID NO: 137841

SEQ ID NO: 404878 - RNA, 64 nt, Human; identical to SEQ ID NO: 137842

SEQ ID NO: 404879 - RNA, 64 nt, Human; identical to SEQ ID NO: 137843

SEQ ID NO: 404880 - RNA, 64 nt, Human
guaccccggaaucccugccgcggccccucgggccuguccacaucccucugccccucccagaccu

SEQ ID NO: 404881 - RNA, 64 nt, Human
caguaguccuuuuguuugcgguuuagauucauuuuguccacacauguacccauuuuaaaaaaca

SEQ ID NO: 404882 - RNA, 64 nt, Human
cccauucuacacagagcaggacugcacagcguccuguccacacccagcucagcauuuccacacc

SEQ ID NO: 404883 - RNA, 64 nt, Human; identical to SEQ ID NO: 137844

SEQ ID NO: 404884 - RNA, 64 nt, Human; identical to SEQ ID NO: 137845

SEQ ID NO: 404885 - RNA, 64 nt, Human; identical to SEQ ID NO: 137846

SEQ ID NO: 404886 - RNA, 64 nt, Human; identical to SEQ ID NO: 137847

SEQ ID NO: 404887 - RNA, 64 nt, Human; identical to SEQ ID NO: 137848

SEQ ID NO: 404888 - RNA, 64 nt, Human; identical to SEQ ID NO: 137849

SEQ ID NO: 404889 - RNA, 64 nt, Human; identical to SEQ ID NO: 137850

SEQ ID NO: 404890 - RNA, 64 nt, Human; identical to SEQ ID NO: 137851

SEQ ID NO: 404891 - RNA, 64 nt, Human; identical to SEQ ID NO: 137852

SEQ ID NO: 404892 - RNA, 64 nt, Human; identical to SEQ ID NO: 137853

SEQ ID NO: 404893 - RNA, 64 nt, Human; identical to SEQ ID NO: 137854

SEQ ID NO: 404894 - RNA, 64 nt, Human; identical to SEQ ID NO: 137855

SEQ ID NO: 404895 - RNA, 64 nt, Human; identical to SEQ ID NO: 137856

SEQ ID NO: 404896 - RNA, 64 nt, Human; identical to SEQ ID NO: 137857

SEQ ID NO: 404897 - RNA, 64 nt, Human; identical to SEQ ID NO: 137858

SEQ ID NO: 404898 - RNA, 64 nt, Human; identical to SEQ ID NO: 137859

SEQ ID NO: 404899 - RNA, 64 nt, Human
cuccauuccugccucucaccaugcacgcauccauuguccacacacacacaaccagauaaucuuc

SEQ ID NO: 404900 - RNA, 64 nt, Human
aggccugggauucauucugguucuuaucaggguguguccacacucugcucacagguggauccac

SEQ ID NO: 404901 - RNA, 64 nt, Human
uacuuagauuuuacagccucaguagucugcccaguguccacauuaaugaaggauccauguuugu

SEQ ID NO: 404902 - RNA, 64 nt, Human; identical to SEQ ID NO: 137860

SEQ ID NO: 404903 - RNA, 64 nt, Human; identical to SEQ ID NO: 137861

SEQ ID NO: 404904 - RNA, 64 nt, Human; identical to SEQ ID NO: 137862

SEQ ID NO: 404905 - RNA, 64 nt, Human; identical to SEQ ID NO: 137863

SEQ ID NO: 404906 - RNA, 64 nt, Human; identical to SEQ ID NO: 137864

SEQ ID NO: 404907 - RNA, 64 nt, Human; identical to SEQ ID NO: 137865

SEQ ID NO: 404908 - RNA, 64 nt, Human; identical to SEQ ID NO: 137866

SEQ ID NO: 404909 - RNA, 64 nt, Human; identical to SEQ ID NO: 137867

SEQ ID NO: 404910 - RNA, 64 nt, Human; identical to SEQ ID NO: 137868

SEQ ID NO: 404911 - RNA, 64 nt, Human; identical to SEQ ID NO: 137869

SEQ ID NO: 404912 - RNA, 64 nt, Human; identical to SEQ ID NO: 137870

SEQ ID NO: 404913 - RNA, 64 nt, Human; identical to SEQ ID NO: 137871

SEQ ID NO: 404914 - RNA, 64 nt, Human; identical to SEQ ID NO: 137872

SEQ ID NO: 404915 - RNA, 64 nt, Human; identical to SEQ ID NO: 137873

SEQ ID NO: 404916 - RNA, 64 nt, Human; identical to SEQ ID NO: 137874

SEQ ID NO: 404917 - RNA, 64 nt, Human; identical to SEQ ID NO: 137875

SEQ ID NO: 404918 - RNA, 64 nt, Human
ugaggaucggugugugagacccgcgagugggcacgucucugaaugugaggucucgggcagcacg

SEQ ID NO: 404919 - RNA, 64 nt, Human
cucaaucucucugucucccugaggcucuauuucugucucugaugcucuucuucugugucucuau

SEQ ID NO: 404920 - RNA, 64 nt, Human
ccccacaauuccuccucuggccacaucuccuguggucucugaccaggugcuguuuuuguucuac

SEQ ID NO: 404921 - RNA, 64 nt, Human; identical to SEQ ID NO: 137876

SEQ ID NO: 404922 - RNA, 64 nt, Human; identical to SEQ ID NO: 137877

SEQ ID NO: 404923 - RNA, 64 nt, Human; identical to SEQ ID NO: 137878

SEQ ID NO: 404924 - RNA, 64 nt, Human; identical to SEQ ID NO: 137879

SEQ ID NO: 404925 - RNA, 64 nt, Human; identical to SEQ ID NO: 137880

SEQ ID NO: 404926 - RNA, 64 nt, Human; identical to SEQ ID NO: 137881

SEQ ID NO: 404927 - RNA, 64 nt, Human; identical to SEQ ID NO: 137882

SEQ ID NO: 404928 - RNA, 64 nt, Human; identical to SEQ ID NO: 137883

SEQ ID NO: 404929 - RNA, 64 nt, Human; identical to SEQ ID NO: 137884

SEQ ID NO: 404930 - RNA, 64 nt, Human; identical to SEQ ID NO: 137885

SEQ ID NO: 404931 - RNA, 64 nt, Human; identical to SEQ ID NO: 137886

SEQ ID NO: 404932 - RNA, 64 nt, Human; identical to SEQ ID NO: 137887

SEQ ID NO: 404933 - RNA, 64 nt, Human; identical to SEQ ID NO: 137888

SEQ ID NO: 404934 - RNA, 64 nt, Human; identical to SEQ ID NO: 137889

SEQ ID NO: 404935 - RNA, 64 nt, Human; identical to SEQ ID NO: 137890

SEQ ID NO: 404936 - RNA, 64 nt, Human; identical to SEQ ID NO: 137891

SEQ ID NO: 404937 - RNA, 64 nt, Human
aggguauuaaggaccuuugugaggcuagguacacuguccacaccucuuuggggaaguuacgauu

SEQ ID NO: 404938 - RNA, 64 nt, Human
cuggggucccucugaagagaccuuggcugcucacuguccacaugugaacuuuuucuagguggca

SEQ ID NO: 404939 - RNA, 64 nt, Human
auuagaaaugauuuuuuagauauuggggauccaguguccacacuuaaaaguuguauguguuuaa

SEQ ID NO: 404940 - RNA, 64 nt, Human; identical to SEQ ID NO: 137892

SEQ ID NO: 404941 - RNA, 64 nt, Human; identical to SEQ ID NO: 137893

SEQ ID NO: 404942 - RNA, 64 nt, Human; identical to SEQ ID NO: 137894

SEQ ID NO: 404943 - RNA, 64 nt, Human; identical to SEQ ID NO: 137895

SEQ ID NO: 404944 - RNA, 64 nt, Human; identical to SEQ ID NO: 137896

SEQ ID NO: 404945 - RNA, 64 nt, Human; identical to SEQ ID NO: 137897

SEQ ID NO: 404946 - RNA, 64 nt, Human; identical to SEQ ID NO: 137898

SEQ ID NO: 404947 - RNA, 64 nt, Human; identical to SEQ ID NO: 137899

SEQ ID NO: 404948 - RNA, 64 nt, Human; identical to SEQ ID NO: 137900

SEQ ID NO: 404949 - RNA, 64 nt, Human; identical to SEQ ID NO: 137901

SEQ ID NO: 404950 - RNA, 64 nt, Human; identical to SEQ ID NO: 137902

SEQ ID NO: 404951 - RNA, 64 nt, Human; identical to SEQ ID NO: 137903

SEQ ID NO: 404952 - RNA, 64 nt, Human; identical to SEQ ID NO: 137904

SEQ ID NO: 404953 - RNA, 64 nt, Human; identical to SEQ ID NO: 137905

SEQ ID NO: 404954 - RNA, 64 nt, Human; identical to SEQ ID NO: 137906

SEQ ID NO: 404955 - RNA, 59 nt, Human; identical to SEQ ID NO: 137907

SEQ ID NO: 404956 - RNA, 64 nt, Human
ggacuuuuguuuacucuaucaugaacaaaggaacuguccacauacuguaaaccaugagcagugu

SEQ ID NO: 404957 - RNA, 64 nt, Human
acacgcacagaggugaacagaaacugaaacauuuuguccacaacuucacgggacguggccagac

SEQ ID NO: 404958 - RNA, 64 nt, Human
cauccuaacuaacagucacgccgugggaugucucuguccacauuaaacuaacagcauuaaugca

SEQ ID NO: 404959 - RNA, 64 nt, Human; identical to SEQ ID NO: 137908

SEQ ID NO: 404960 - RNA, 64 nt, Human; identical to SEQ ID NO: 137909

SEQ ID NO: 404961 - RNA, 64 nt, Human; identical to SEQ ID NO: 137910

SEQ ID NO: 404962 - RNA, 64 nt, Human; identical to SEQ ID NO: 137911

SEQ ID NO: 404963 - RNA, 64 nt, Human; identical to SEQ ID NO: 137912

SEQ ID NO: 404964 - RNA, 64 nt, Human; identical to SEQ ID NO: 137913

SEQ ID NO: 404965 - RNA, 64 nt, Human; identical to SEQ ID NO: 137914

SEQ ID NO: 404966 - RNA, 64 nt, Human; identical to SEQ ID NO: 137915

SEQ ID NO: 404967 - RNA, 64 nt, Human; identical to SEQ ID NO: 137916

SEQ ID NO: 404968 - RNA, 64 nt, Human; identical to SEQ ID NO: 137917

SEQ ID NO: 404969 - RNA, 64 nt, Human; identical to SEQ ID NO: 137918

SEQ ID NO: 404970 - RNA, 64 nt, Human; identical to SEQ ID NO: 137919

SEQ ID NO: 404971 - RNA, 64 nt, Human; identical to SEQ ID NO: 137920

SEQ ID NO: 404972 - RNA, 64 nt, Human; identical to SEQ ID NO: 137921

SEQ ID NO: 404973 - RNA, 64 nt, Human; identical to SEQ ID NO: 137922

SEQ ID NO: 404974 - RNA, 64 nt, Human; identical to SEQ ID NO: 137923

SEQ ID NO: 404975 - RNA, 64 nt, Human
aggccauuacuuaauuuuaaacuuaaucaguguguguccacagagcaccaguggcuucgugagu

SEQ ID NO: 404976 - RNA, 64 nt, Human
acuuaccuguuuucuccucccccaucccuacccuuguccacaggcucaacauuucuacacguug

SEQ ID NO: 404977 - RNA, 64 nt, Human
cuggaccaucuagcccucagcaggccccgccggcuguccacagcggacccugcugaugccucca

SEQ ID NO: 404978 - RNA, 64 nt, Human; identical to SEQ ID NO: 137924

SEQ ID NO: 404979 - RNA, 64 nt, Human; identical to SEQ ID NO: 137925

SEQ ID NO: 404980 - RNA, 64 nt, Human; identical to SEQ ID NO: 137926

SEQ ID NO: 404981 - RNA, 64 nt, Human; identical to SEQ ID NO: 137927

SEQ ID NO: 404982 - RNA, 64 nt, Human; identical to SEQ ID NO: 137928

SEQ ID NO: 404983 - RNA, 64 nt, Human; identical to SEQ ID NO: 137929

SEQ ID NO: 404984 - RNA, 64 nt, Human; identical to SEQ ID NO: 137930

SEQ ID NO: 404985 - RNA, 64 nt, Human; identical to SEQ ID NO: 137931

SEQ ID NO: 404986 - RNA, 64 nt, Human; identical to SEQ ID NO: 137932

SEQ ID NO: 404987 - RNA, 64 nt, Human; identical to SEQ ID NO: 137933

SEQ ID NO: 404988 - RNA, 64 nt, Human; identical to SEQ ID NO: 137934

SEQ ID NO: 404989 - RNA, 64 nt, Human; identical to SEQ ID NO: 137935

SEQ ID NO: 404990 - RNA, 64 nt, Human
uccccugccaggcuggggcuuccucaggcauggguguccacagcacuggcccccucuccccagc

SEQ ID NO: 404991 - RNA, 64 nt, Human
gcaacuggccaaaggagaugcagccagcuaagacuguccacacuuuggcagacaaccgguuuuc

SEQ ID NO: 404992 - RNA, 64 nt, Human
cuuaauauaagcuuuuaagcaguuaucuaacuaguguccacaacccuguaaccauacuuccaca

SEQ ID NO: 404993 - RNA, 64 nt, Human
gcugaggcggguggaucaccugagguuaggaguucgagaccagccuggccaacaugguaaaacc

SEQ ID NO: 404994 - RNA, 64 nt, Human
gccgaggcaggcggaucauuugagguuagagauucgagaccagccgggccaacauggugaaacc

SEQ ID NO: 404995 - RNA, 64 nt, Human
gccaagguaagaggaucgcuugaggucaggaguucgagaccagcuugugcaacaaagugagagc

SEQ ID NO: 404996 - RNA, 64 nt, Human
ugcuugaacccgggaggcggagguugcaguaagccgagaccaugcuuauugcccuccagucugg

SEQ ID NO: 404997 - RNA, 64 nt, Human
aggccgagguggacagaucacgaggucaggaguucgagaccauccuggcuaacacggugaaacc

SEQ ID NO: 404998 - RNA, 64 nt, Human
gccaagguggguggaucaccugaggucaggaguucgagaccagccuggccaacacggugaaacc

SEQ ID NO: 404999 - RNA, 64 nt, Human
gaucgaagccguggagguggagaucggccgcuuccgagaccagcaguacgagaugcucaagcgc

SEQ ID NO: 405000 - RNA, 64 nt, Human
aggccgaggcggguggaucacgaggucaggagaucgagaccauccuggcuaacacagugaaacg

SEQ ID NO: 405001 - RNA, 64 nt, Human
aggccgaggggggcggaucgugaagucaggagaucgagaccauccuggcuaacauggugaaacc

SEQ ID NO: 405002 - RNA, 64 nt, Human
aggccaaggugggcggaucacaaggucaggagaucgagaccauccuggcgaacacggugaaacc

SEQ ID NO: 405003 - RNA, 64 nt, Human
gccgaggcagguggaucaccugaggucaggaguucgagaccagccugaccaacauggcgaaacc

SEQ ID NO: 405004 - RNA, 64 nt, Human
ucccugagguuggcgacugucuacacuccucccccgagaccacccccacccuggggaagcguug

SEQ ID NO: 405005 - RNA, 64 nt, Human
aggccgaggcgggcggaucacgaggucaggaguucgagaccagccugaccaacacggugaaacc

SEQ ID NO: 405006 - RNA, 64 nt, Human
gaggccgaggugggcagaucaugggucaagagaucgagaccauccuggccaacauuguaaaacc

SEQ ID NO: 405007 - RNA, 64 nt, Human
aggccgaggcggguggaucaugaggucaggagaucgagaccauccuggcuaacaaggugaaacc

SEQ ID NO: 405008 - RNA, 64 nt, Human
caaacauggucuagcuucugucucuccgucuucccgccaucauugugcuguagccauauggaac

SEQ ID NO: 405009 - RNA, 64 nt, Human
ugguaacuacauuaggguuugcgggucugauggucgccaucauaacugcauacucaacucugcc

SEQ ID NO: 405010 - RNA, 64 nt, Human
ccuggccucccaaguagcuggaauuacaggugugcgccaucacaacuagcugguggucaguuuu

SEQ ID NO: 405011 - RNA, 64 nt, Human
aggccgagacggguggaucacgaggucaggagaucgagaccauccuggcuaacacggugaaacc

SEQ ID NO: 405012 - RNA, 64 nt, Human
gccgagguggccagaucaccugaggucaggaguucgagaccacccuggccaacauggugaaacc

SEQ ID NO: 405013 - RNA, 64 nt, Human
aggcugaggugggcagaucacgaggucaagagaucgagaccauccuggccaacaugaugaaacc

SEQ ID NO: 405014 - RNA, 64 nt, Human
gccaaggcaggcggaucacaugaggccaggaauucgagaccaaccuggucagcauggcaaaacc

SEQ ID NO: 405015 - RNA, 64 nt, Human
aucagacucuagccuggacaguggccaggaccgucgagaccaccagagcuaccuccccggggac

SEQ ID NO: 405016 - RNA, 64 nt, Human
aggccgaggcaggcggaucacgaggucaggagaucgagaccauccuggcuaacacggugaaacc

SEQ ID NO: 405017 - RNA, 64 nt, Human
gccaaggcggguggaucacuugagaccaggaauucgagaccagccuggccaacauggugaaacc

SEQ ID NO: 405018 - RNA, 64 nt, Human
gccaaggcgggcagaucaccugaggucaagaguucgagaccagccugaccaacauggagaaacc

SEQ ID NO: 405019 - RNA, 64 nt, Human
gcugaaguggguggaucaccagaggucaggaguucgagaccagcccagccaacauggcaaaacc

SEQ ID NO: 405020 - RNA, 64 nt, Human
gccgaggcagggggacugcuugagcucaggaguucgagaccagccugggcaacaaagugagacu

SEQ ID NO: 405021 - RNA, 64 nt, Human
agaccgaggcgggcggaucacgaggucaggagaucgagaccauccuggcuaacacggugaaacc

SEQ ID NO: 405022 - RNA, 64 nt, Human
aggccaagaugggcggaucaugaagucaggaguucgagaccagccugaccaacauggugaaacc

SEQ ID NO: 405023 - RNA, 64 nt, Human
gccaaggugggcggaucaccugaugucagggguucgagaccagccuggccaacauggugaaacc

SEQ ID NO: 405024 - RNA, 64 nt, Human
gccaaggagggcagaucacuucaggucaggaguucgagaccagccuggccaacaugguaaacgc

SEQ ID NO: 405025 - RNA, 64 nt, Human
gccaaggcaggcagaucacuugaggucaggaguucgagaccagccuggccaauacggcaaaacc

SEQ ID NO: 405026 - RNA, 64 nt, Human
agguggccaucacagccccauggacaacacuaauuguccacagcaaagggcaaggaauccucug

SEQ ID NO: 405027 - RNA, 64 nt, Human
agcaaguauucucagccugaggguggguugcuacuguccacauaggcauuuccggaauucacuu

SEQ ID NO: 405028 - RNA, 64 nt, Human
acaagugcuuuaagauuuuaaaaaugugauguuuuguccacaguaguucaggcaauuaagaaua

SEQ ID NO: 405029 - RNA, 64 nt, Human
uggauggugggcagaucacuugaggucaggaguucgagaccagccuggccaacauggcaaaacc

SEQ ID NO: 405030 - RNA, 64 nt, Human
uggcuaaggcaggcggaucaugagaucaggagaucgagaccauccuggcuaacacggugaaacc

SEQ ID NO: 405031 - RNA, 64 nt, Human
aggccgaggugggcagaucaugaggucagaagaucgagaccauccuggcuaacacggugaaacc

SEQ ID NO: 405032 - RNA, 64 nt, Human
aggccgaggcggggggaucacgaggucaagagaucgagaccauccuggccaacauggugaaacc

SEQ ID NO: 405033 - RNA, 64 nt, Human
gcugaggugggcagaucacuugaggccaggaguucgagaccagccuggccaacauggcaaaacc

SEQ ID NO: 405034 - RNA, 64 nt, Human
ggccgaggcaggaggauccuugaggucaggaguucgagaccagccucgccaacauggugaaacc

SEQ ID NO: 405035 - RNA, 64 nt, Human
aggccgaggcggacagaucacgaggucaggaguucgagaccauccuggcuaacacagugaaacc

SEQ ID NO: 405036 - RNA, 64 nt, Human
guaaucauugaccauauagucauaguaagacacacgagaccaggcuuuaccaugaaagcgaccu

SEQ ID NO: 405037 - RNA, 64 nt, Human
gccauggcggguggaacauuugagggcaugaguucgagaccagccuggccaacauggugaaacc

SEQ ID NO: 405038 - RNA, 64 nt, Human
gccaagguggggggauuacccgaggucaggaauucgagaccagccugaccaacauggagaaacc

SEQ ID NO: 405039 - RNA, 64 nt, Human
ggaagacaagcaggugggcaggaaggacaugcaccgagaccaggcaggggcccaacuuucacgu

SEQ ID NO: 405040 - RNA, 64 nt, Human
acaggaucccaccgagaaggagagccaggugugccgagaccauccuaaggguccgaugugacag

SEQ ID NO: 405041 - RNA, 64 nt, Human
aggcugaggcggguggaucaugaggucaggaguucgagaccagcccgcccaauauggugaaacc

SEQ ID NO: 405042 - RNA, 64 nt, Human
aggcugaggcaggcagaucacgaggucaggaguucgagaccagccugaccaacauggugaaaac

SEQ ID NO: 405043 - RNA, 63 nt, Human
cugugggaggggcugggaaaauaaaguccaaggucgagaccagacagcugccagccucuacau

SEQ ID NO: 405044 - RNA, 64 nt, Human
augugugugcacuuggcgagccuccugcccacccuguccacaccuaauaagugcaaucauuuug

SEQ ID NO: 405045 - RNA, 64 nt, Human
ggcuccuaucaggcugggugugcgaguguccaucuguccacauggaugucgagggugguuugug

SEQ ID NO: 405046 - RNA, 64 nt, Human
aauuacagaagaagcuccugaaucccuuucaguuuguccacacaagacagcagagccaucugcg

SEQ ID NO: 405047 - RNA, 64 nt, Human
cgcucuggugauuauuucuugcagaaucaccacacgagaccaucccggcagucaugguuuugcu

SEQ ID NO: 405048 - RNA, 64 nt, Human
aggccgagguggguggaucacgaggucaggagaucgagaccauccuggcuaacacagugaaacc

SEQ ID NO: 405049 - RNA, 64 nt, Human
gucgaggugggugggucaccugagguugggaguucgagaccagcccgaccaacauggugaaacc

SEQ ID NO: 405050 - RNA, 64 nt, Human
gcugagacagguggaucacuugaggucgggaguucgagaccagccuggccaacauagcaaaacc

SEQ ID NO: 405051 - RNA, 64 nt, Human
ggcugaugugggcggauaguugagcccaggaguucgagaccagccugggcaacauggcaagacc

SEQ ID NO: 405052 - RNA, 64 nt, Human
aggccaaggcagguggaucacgaggucaagagaucgagaccauccuggccaacaugaugaaacu

SEQ ID NO: 405053 - RNA, 64 nt, Human
aggccgagaugggugaaucaugaggucaggaguucgagaccagccuaaacaacauagugaaacc

SEQ ID NO: 405054 - RNA, 64 nt, Human
aggccgaggcaggcggaucacaaggucaggaauucgagaccagccugaccaacauggugaaacc

SEQ ID NO: 405055 - RNA, 64 nt, Human
gccagggagggaggaucuccagaggucaggaguucgagaccagccuggccaacauggugaaacc

SEQ ID NO: 405056 - RNA, 64 nt, Human
gccaaggcggguggaucaccugaggucaggaguucgagaccagccuggccaacauggugaaauc

SEQ ID NO: 405057 - RNA, 64 nt, Human
caccccuuaccccaaagagaaagaguuugaaacucgagaccauaaagauauucuuuaguggagg

SEQ ID NO: 405058 - RNA, 64 nt, Human
gccaaggugggcaguucgcuugggcccaagaguucgagaccagccugggcaacauggugaaacc

SEQ ID NO: 405059 - RNA, 64 nt, Human
gcuaagaugaguggauugcuugagccuaggaguucgagaccagccuaggcaacauggagaaacc

SEQ ID NO: 405060 - RNA, 64 nt, Human
aggccaaggagggaggaucacaaggucaggagaucgagaccauccuggcuaacacggugaaacc

SEQ ID NO: 405061 - RNA, 64 nt, Human
gccaagguagguggaucacuugagguugggauuucgagaccagccuggccaacauggugaaacc

SEQ ID NO: 405062 - RNA, 64 nt, Human
ugcugaggugccccugcccagcccuguccagccuuguccacacacacaucucacgccccugguc

SEQ ID NO: 405063 - RNA, 64 nt, Human
gaagcucuuuacuguaaaggcaagccagcauguguguccacacauacauaggauggcuggcucu

SEQ ID NO: 405064 - RNA, 64 nt, Human
ugcagggggaggccugagcauuucccagccccaguguccacaccucucagaaaagagaaaaaag

SEQ ID NO: 405065 - RNA, 64 nt, Human
uccaaggugggcggaucaccugaggucgggaguucgagaccagccugaccaacauggagaagcc

SEQ ID NO: 405066 - RNA, 64 nt, Human
uggagccgggaaagcuguuuuuccguggauuuggcgagaccagagcagucugaaggauucccca

SEQ ID NO: 405067 - RNA, 64 nt, Human
ccucagagguccaccucuuacccuacagacuggccgagaccauaucaaguauuaaaaccauucu

SEQ ID NO: 405068 - RNA, 64 nt, Human
acugccccgcggccucggccaccggcaggggaaccgagaccagcaccccgcacgucagccgggc

SEQ ID NO: 405069 - RNA, 64 nt, Human
aggccgaggcgggcggaucacgaggucaggagaucgagaccaucccggcuaaaacggugaaacc

SEQ ID NO: 405070 - RNA, 64 nt, Human
aggcugaggcggguggaucacgaggucaggagaucgagaccauccuggcuaacacggugaaacc

SEQ ID NO: 405071 - RNA, 64 nt, Human
ggcugaggcaggcaaucacuugaggucaggaguucgagaccagccuggccaucauggcgaaacc

SEQ ID NO: 405072 - RNA, 64 nt, Human
gccaaggugggagcaucacuugauccugggaguucgagaccagccugggcaacauggugaaacc

SEQ ID NO: 405073 - RNA, 64 nt, Human
agguggaggcggguggaucacaaggucaagagaucgagaccauccuggccaacauggugaaacc

SEQ ID NO: 405074 - RNA, 64 nt, Human
gccgaggcggguggaucaccugaagucaggaguucgagaccauccuggcuaacacugugaaacc

SEQ ID NO: 405075 - RNA, 64 nt, Human
gcccaggcaggcagaucaccugaggucgggaguucgagaccagcgugaccaacguggagaaacc

SEQ ID NO: 405076 - RNA, 64 nt, Human
aggccgagguggguggaucacgaggucaggagaucgagaccaucccggcuaacauggugaaacc

SEQ ID NO: 405077 - RNA, 64 nt, Human
aggccgaggugggcggaucacgaggucaggagaucgagaccauccuggcuaacagggugaaacc

SEQ ID NO: 405078 - RNA, 64 nt, Human
gcucaggugggcgaauugcuugagcccaggaguucgagaccagccggggcaacauggcaaaacc

SEQ ID NO: 405079 - RNA, 64 nt, Human
gccgaggugggcggaucaccugaggucaggaguucgagaccagccugaccaacguggagaaacc

SEQ ID NO: 405080 - RNA, 64 nt, Human
gaauaaggaggcaaauagaagaaugagauacugauguccacaguucauuggcagaaucuaaccc

SEQ ID NO: 405081 - RNA, 64 nt, Human
ccguguaaaccaaagcccuaaaauuccacugcguuguccacaagacagaagcugaagugcaucc

SEQ ID NO: 405082 - RNA, 64 nt, Human
gaaaaaauagagaugagacuuuuugugucaacucuguccacaagagugaguuaucuaguaugau

SEQ ID NO: 405083 - RNA, 64 nt, Human
gccaaggugggcaguucacgugagguggggaguucgagaccagccugaccaacauggagaaacc

SEQ ID NO: 405084 - RNA, 64 nt, Human
aggccgaggcgggcagaucauuaggucaggagaucgagaccauccuuacuaagacggugaaccc

SEQ ID NO: 405085 - RNA, 64 nt, Human
gcugaggcgggcgaaucauuugaggugaggaauucgagaccagccuggccagcauggugaaacc

SEQ ID NO: 405086 - RNA, 64 nt, Human
gcugaggugggcagaucaccugaggucaggaguucgagaccagccuggccaacauggugaaacc

SEQ ID NO: 405087 - RNA, 64 nt, Human
aggccgaggcgggcggaucacaaggucaggagaucgagaccauccuggcuaacacggugaaacc

SEQ ID NO: 405088 - RNA, 64 nt, Human
uuuauauggguagaggaagccagggcggcaaaugcgagaccaaauaucauuuugccaaugaguc

SEQ ID NO: 405089 - RNA, 64 nt, Human
aggccgaggcggguggaucacaaggucaggaguucgagaccagccuggccaauauggugaaacc

SEQ ID NO: 405090 - RNA, 64 nt, Human
ugaaucaccuggcccagaagccaggccagcagcccgagaccauccuccuugcaccuuugugcca

SEQ ID NO: 405091 - RNA, 64 nt, Human
gccgaggcagguggaucaccugagguccggaguucgagaccagccuggccaauguggugaaacc

SEQ ID NO: 405092 - RNA, 64 nt, Human
aggccaaggcaggcagaucacgacaucaggagaucgagaccauccuggcuaacacggugaaacc

SEQ ID NO: 405093 - RNA, 64 nt, Human
aggccaaguugggcagaucacaaguucaagagaucgagaccauucuggccaacauggugaaacc

SEQ ID NO: 405094 - RNA, 64 nt, Human
gccgaggugggcagauugccugagcucaagaguucgagaccagccuggccaacauggugaaacc

SEQ ID NO: 405095 - RNA, 64 nt, Human
ggcugaggcgggcggaucaccugagucaggaguucgagaccagccuggccaacauggugaaacc

SEQ ID NO: 405096 - RNA, 64 nt, Human
gccgcgguggguggaucaccugaggucaggaguucgagaccagccuggccaacaugguuaaacc

SEQ ID NO: 405097 - RNA, 64 nt, Human
gggcugaggugggcgaaucaugagaucaggaguucgagaccagccuggccagcauggugaaacc

SEQ ID NO: 405098 - RNA, 64 nt, Human; identical to SEQ ID NO: 358104

SEQ ID NO: 405099 - RNA, 64 nt, Human; identical to SEQ ID NO: 358105

SEQ ID NO: 405100 - RNA, 64 nt, Human; identical to SEQ ID NO: 358106

SEQ ID NO: 405101 - RNA, 64 nt, Human
ggaggcugaagcagaucgcuggagcuuaugaguucgagaccagccuggacaacauagugaaaca

SEQ ID NO: 405102 - RNA, 64 nt, Human
ugggagguggguggaucaccugaggucgggaguucgagaccagccugaccagcaugguggaacc

SEQ ID NO: 405103 - RNA, 64 nt, Human
acuuuuuacuuuuuugcguguggagcuguauucccgagaccaacgaagcguugggauacuucau

SEQ ID NO: 405104 - RNA, 64 nt, Human
aggccgaggcaggcgaaucacgaggucaggaguucgagaccagccugcccaacauggugaaacc

SEQ ID NO: 405105 - RNA, 64 nt, Human
ggaugagguaggcggaucacuggggucaggauuucgagaccagccuggccaacauggcgaaacc

SEQ ID NO: 405106 - RNA, 64 nt, Human
gcugaggcagguggaucaccucaagucaggaguucgagaccagccuggccaacauggugaaacc

SEQ ID NO: 405107 - RNA, 64 nt, Human
aggcugaggcggauggaucacgaggucaggcagucgagaccauccuggccaacauggugaaacc

SEQ ID NO: 405108 - RNA, 64 nt, Human
cacugugcugggagccagggggccugggaggagccgagaccagccuuuuaccucgggguuuuga

SEQ ID NO: 405109 - RNA, 64 nt, Human
aggccgaggcggguggaucacgaggucaggagaucgagaccauccuggcuaacaugguaaaacc

SEQ ID NO: 405110 - RNA, 64 nt, Human
gccaaggugggcagauugccugagcucaggaguucgagaccagccagggcaacauggugaaacc

SEQ ID NO: 405111 - RNA, 64 nt, Human
gcugagguggguggaucaccugaggucaggaguucgagaccagccucgccaacauggcgaaacc

SEQ ID NO: 405112 - RNA, 64 nt, Human
aggccaaggugggcagaucaggaggucaggagaucgagaccaucuuggcuaacaaggugaaacc

SEQ ID NO: 405113 - RNA, 64 nt, Human
gagguugcggguggaucacuugaggucaggaguucgagaccagccuggccaacauggcaaaacc

SEQ ID NO: 405114 - RNA, 64 nt, Human
gcugaggcgggcggaucaccugagguugggaguucgagaccagccugaccaacacggagaaacc

SEQ ID NO: 405115 - RNA, 64 nt, Human
gccuuggcagguggaucaccugagaucgcacguucgagaccagccugaccaacauggagaaacc

SEQ ID NO: 405116 - RNA, 64 nt, Human; identical to SEQ ID NO: 358107

SEQ ID NO: 405117 - RNA, 64 nt, Human; identical to SEQ ID NO: 358108

SEQ ID NO: 405118 - RNA, 64 nt, Human; identical to SEQ ID NO: 358130

SEQ ID NO: 405119 - RNA, 64 nt, Human
gucgaggugggaggaucgcuugaggccaggaguucgagaccacccugggcaacagagcgagauc

SEQ ID NO: 405120 - RNA, 64 nt, Human; identical to SEQ ID NO: 405007

SEQ ID NO: 405121 - RNA, 64 nt, Human
aggccgaggcaggcggaucacaagguccagagaucgagaccauccuggccaacauggugaaacc

SEQ ID NO: 405122 - RNA, 64 nt, Human
aggccaaggugggcggaucaugaggucaggagaucgagaccauccugaccaacguggugaaacc

SEQ ID NO: 405123 - RNA, 64 nt, Human
gcugaggugggagaaucgcuugagcucaggaguucgagaccagccugggcaacguggcgaaauc

SEQ ID NO: 405124 - RNA, 64 nt, Human
gccgaggcagguggaucacuugaggccaggaguucgagaccagccuggucaagauggugaaacc

SEQ ID NO: 405125 - RNA, 64 nt, Human
aggccaaggcgggcggaucaugaggucaggagaucgagaccauccuggcuaacacggugaaaac

SEQ ID NO: 405126 - RNA, 64 nt, Human
gccaaggcaggcggaucaccugagguuaggaguucgagaccacccuggccaacaugcgaaaccc

SEQ ID NO: 405127 - RNA, 64 nt, Human
aggccgaggcgggcggaucaugaggucaggaguucgagaccaaccgaccaacauggugaaaccc

SEQ ID NO: 405128 - RNA, 64 nt, Human
uggauuaccugagaucagguggauuaccuggucucgagaccagccugaccaauauggugaaacc

SEQ ID NO: 405129 - RNA, 64 nt, Human
gcugaggcgggaagaucacuugaggccagaaguucgagaccagccugggcaauguagugagacc

SEQ ID NO: 405130 - RNA, 64 nt, Human
aggccgaggcagguggaucacgaggucaggagaucgagaccauccuggcuaacacggugaaacc

SEQ ID NO: 405131 - RNA, 64 nt, Human
aggccgaggcgggcggaucaugaggucaggagaucgagaccauccuggcuaacacggugaaacc

SEQ ID NO: 405132 - RNA, 64 nt, Human
aggcgggugaaucacuugauugaggucaggaguucgagaccagccuggccaacauggcaaaacc

SEQ ID NO: 405133 - RNA, 64 nt, Human
gccgaggaggguggaucacuugaggucaggaguucgagaccagccugaccaacauggcgaaacc

SEQ ID NO: 405134 - RNA, 64 nt, Human
uggauugacagaggcaccaaaaggcaaaugguacuguccacagugcacugcugcaaugaagaga

SEQ ID NO: 405135 - RNA, 59 nt, Human; identical to SEQ ID NO: 12591

SEQ ID NO: 405136 - RNA, 64 nt, Human
ggucugagccagcaccagggcggugggagacuccuguccacaccucugccccagagcugccucc

SEQ ID NO: 405137 - RNA, 64 nt, Human
aggcugagguaggcggaucacaaggucaggagaucgagaccauccuggccaacauggugaaacc

SEQ ID NO: 405138 - RNA, 64 nt, Human
gccgaggcgggcugaucgcuugaggucaggaguucgagaccagccuggccaaaauagugaaacu

SEQ ID NO: 405139 - RNA, 64 nt, Human
gcagagguggguggaucacucaaguccaggaguucgagaccagccugggcaacauggugaaauc

SEQ ID NO: 405140 - RNA, 64 nt, Human
gcugaggcagguagaucaccugaaguuaggaguucgagaccagccuggccaacauggcgaaacc

SEQ ID NO: 405141 - RNA, 64 nt, Human
uaguguuuagcgauuguguaccgagugggauucacgagaccagcuacacucagaccaacagaug

SEQ ID NO: 405142 - RNA, 64 nt, Human
aggcccaggcgggcggaucacgaggucaggagaucgagaccauccuggcuaacauggugaaacc

SEQ ID NO: 405143 - RNA, 64 nt, Human
aggccgagacggguggaucacaaggucaggagaucgagaccauccuggcuaaugcguugaaacu

SEQ ID NO: 405144 - RNA, 64 nt, Human
aggccgagguggguggaucacaaggucaggaguucgagaccagccugaccaacauggugaaacg

SEQ ID NO: 405145 - RNA, 64 nt, Human
gccaaggaggguggaucaccugaggucaggaguucgagaccagccuggccaacauggcggaacc

SEQ ID NO: 405146 - RNA, 64 nt, Human
gccaaggcagguggaucaccugaggucaggaguucgagaccaaccuggccaacaugacgaaacu

SEQ ID NO: 405147 - RNA, 64 nt, Human
ccaaggcaggcuggaucaccugaggacaggaguucgagaccagucuggccaacauggggaaacc

SEQ ID NO: 405148 - RNA, 64 nt, Human
gccaaggugggaggauggcuuguguccagaaguucgagaccagccuggacaacauagugagauc

SEQ ID NO: 405149 - RNA, 64 nt, Human
gccaaggcgggcagaucaccugaggucaauaguucgagaccagccuggccaacaaggugaaacc

SEQ ID NO: 405150 - RNA, 64 nt, Human
gaggccgaggcggguggaucaccugaggucaguucgagaccagcuuggccaacaugucgaaacu

SEQ ID NO: 405151 - RNA, 64 nt, Human
aucaugacacugcacuccagccugggcaacagagcgagaccaucucuuaaaaaaaggcauuguu

SEQ ID NO: 405152 - RNA, 64 nt, Human; identical to SEQ ID NO: 358076

SEQ ID NO: 405153 - RNA, 64 nt, Human; identical to SEQ ID NO: 358097

SEQ ID NO: 405154 - RNA, 64 nt, Human; identical to SEQ ID NO: 358102

SEQ ID NO: 405155 - RNA, 64 nt, Human
aggccgaggcugguggaucacgaggucagcaguucgagaccagccugaccaacauggugaaacc

SEQ ID NO: 405156 - RNA, 64 nt, Human
gcaagugccauucaccacugcguccugggcuuuacgagaccaugcaagacggggguuagugagg

SEQ ID NO: 405157 - RNA, 64 nt, Human
acaagcccuaugacguguuuggcuguuggcucaccgagaccagccucaucucggggaaccugca

SEQ ID NO: 405158 - RNA, 64 nt, Human
gccaaggcugguggaucaccugaggucaggaguucgagaccagccuggccaacacggugaaacc

SEQ ID NO: 405159 - RNA, 64 nt, Human
gcugagauggguggaucaccugagguugggaguucgagaccagccugacaaaacauagugaaac

SEQ ID NO: 405160 - RNA, 64 nt, Human
aggcugaggcggguggaucacaaggucaggaguucgagaccagccuggucaacauggugaaacc

SEQ ID NO: 405161 - RNA, 64 nt, Human
gccaaggcagaaggaucacuugagaccaggaguucgagaccagccugagaaacauagugagccc

SEQ ID NO: 405162 - RNA, 64 nt, Human
gcugaggcaggcggauugccugagaucgggaguucgagaccagccuggccaacauggugaaacc

SEQ ID NO: 405163 - RNA, 64 nt, Human
aggccgaggcgaguggaucacgaggucaggagaucgagaccauccuggcuaacacggugaaacc

SEQ ID NO: 405164 - RNA, 64 nt, Human
aggccgaggcgggaggaucaugaggucaggagaucgagaccauccuggcuaacguggugaaacc

SEQ ID NO: 405165 - RNA, 64 nt, Human
uaagcccaaauaugacacuggccauuuuuguaaacgagaccaccaggccuucuucacuaagacu

SEQ ID NO: 405166 - RNA, 64 nt, Human
aggccaaggugggcagaucaugaggucaggagaucgagaccauucuggccaacauagugaaacc

SEQ ID NO: 405167 - RNA, 64 nt, Human
gcugaggcggguggauugcuugaggccaggaguucgagaccagccuggccaacguggugaaacg

SEQ ID NO: 405168 - RNA, 64 nt, Human
aggccgaggcgggcggaucacgaggucaggagaucgagaccauccuggcuaacacggugaaacc

SEQ ID NO: 405169 - RNA, 64 nt, Human
gccgagacaggcggaucaccugaggucgggaguucgagaccagccuuaccaacauggagaaacc

SEQ ID NO: 405170 - RNA, 64 nt, Human; identical to SEQ ID NO: 358203

SEQ ID NO: 405171 - RNA, 64 nt, Human; identical to SEQ ID NO: 358204

SEQ ID NO: 405172 - RNA, 64 nt, Human; identical to SEQ ID NO: 358206

SEQ ID NO: 405173 - RNA, 64 nt, Human
ccuguaaucccagcacuuugggaggccaggaguucgagaccagccuggccaacauggugaaacc

SEQ ID NO: 405174 - RNA, 64 nt, Human
aggccgaggcggguggaucacgaggucaggagaucgagaccauccuggcuaacauggugaaacc

SEQ ID NO: 405175 - RNA, 64 nt, Human
aggcugaggaggucggaucaugaggucaagaguucgagaccagccuggccaauauggugaaacc

SEQ ID NO: 405176 - RNA, 64 nt, Human
gagcugaggcgggcggaucacgaggucaagagaucgagaccauccuggccaacauggugaaacc

SEQ ID NO: 405177 - RNA, 64 nt, Human
gccauagcaggaggauugcuugagcccaggaguucgagaccagccagagcaacauagugagacc

SEQ ID NO: 405178 - RNA, 64 nt, Human
aggcugaggcggguggaucaagaggucaggagaucgagaccauccuggcuaagucggucucuaa

SEQ ID NO: 405179 - RNA, 64 nt, Human
aggccgaggcggguggaucaugaggucaggagaucgagaccauccuggcuaacacggugaaacc

SEQ ID NO: 405180 - RNA, 64 nt, Human
gccgaggcgggcggaucacuugagaccaggaguucgagaccagccuggccaacauggugugaga

SEQ ID NO: 405181 - RNA, 64 nt, Human
aggcugaggcgggcagaucacgaagucaggagaucgagaccauccuggcuaacacggugaaacc

SEQ ID NO: 405182 - RNA, 64 nt, Human
cugaggcagggcagauugcaugagcccaggaguucgagaccaacuugggcaacauggugaaaca

SEQ ID NO: 405183 - RNA, 64 nt, Human
gaaaaggaggccuagaaagguuaaguaacuuggucgagaccacucagccuugagaucaagaaaa

SEQ ID NO: 405184 - RNA, 64 nt, Human
aucaccuucugcuccuaggaggcugcuuguugcccgagaccagcccccuccccugauuuaggga

SEQ ID NO: 405185 - RNA, 64 nt, Human
gggaggccgaggcgggcggaucacaaagucaggacgagaccauccuggcuaacacggugaaacc

SEQ ID NO: 405186 - RNA, 64 nt, Human
ugcugacuggccccacacugugccaccggacaaucgagaccacuucccauccaggccucuuccc

SEQ ID NO: 405187 - RNA, 64 nt, Human
accaaggcggguggauaaccugagguagggaguucgagaccagccugaccaacauggagaaacc

SEQ ID NO: 405188 - RNA, 64 nt, Human; identical to SEQ ID NO: 358248

SEQ ID NO: 405189 - RNA, 64 nt, Human; identical to SEQ ID NO: 358249

SEQ ID NO: 405190 - RNA, 64 nt, Human; identical to SEQ ID NO: 358250

SEQ ID NO: 405191 - RNA, 64 nt, Human
aggccgaggcaggcagaucacaaggucaggaguucgagaccagccugaccaacauggugaaacc

SEQ ID NO: 405192 - RNA, 64 nt, Human
aggccgaggcgggcagaucacgaggucaggaguucgagaccagcagccuggccaauauagugaa

SEQ ID NO: 405193 - RNA, 64 nt, Human
gccaaggccagcggaucacuugaggucaggaguucgagaccagccugaccaacauggagaaacc

SEQ ID NO: 405194 - RNA, 64 nt, Human
accaucacgcccggcuaauuuuuguauuuucagucgagaccagccuggccaacauggugaaaca

SEQ ID NO: 405195 - RNA, 64 nt, Human
uggccgaguaugucgccaggaacggccugaaguucgagaccaguguucgugccaagaaugauca

SEQ ID NO: 405196 - RNA, 64 nt, Human
cacuuugggaggccuaggcgggcggucagggguucgagaccagucuggccaacaucgugaaacc

SEQ ID NO: 405197 - RNA, 64 nt, Human
gccuuauccagcagccauaauuugaauaacucuacgagaccagagagacuguaguucccuauuu

SEQ ID NO: 405198 - RNA, 64 nt, Human
gucgagguagguggaucaccugaggucgggaguucgagaccaaccugaccaacauggagaaacc

SEQ ID NO: 405199 - RNA, 64 nt, Human
ccuccugguucccugucccuccccugcgcuccugcgagaccagauauaaaacuagcugccaacc

SEQ ID NO: 405200 - RNA, 64 nt, Human
gccgaggcggguggaucacuugaggucaggaguucgagaccagccuggccaauaaggugaaacc

SEQ ID NO: 405201 - RNA, 64 nt, Human
aucgcgccgcugcauuccagccugggugacagagcgagaccaugucucaaaaaauaaaaauaaa

SEQ ID NO: 405202 - RNA, 64 nt, Human
gcugaggcaggcggaucacuugaggucaggagcucgagaccagccuggccaacacggugaaacc

SEQ ID NO: 405203 - RNA, 64 nt, Human
aggccgagacaggcagaucacgaggucaggagaucgagaccauccuggcuaacacggugaaacc

SEQ ID NO: 405204 - RNA, 64 nt, Human
gccaaggcggguggaucaccugaggucacgaguucgagaccagccugaccaacauggagaaacc

SEQ ID NO: 405205 - RNA, 64 nt, Human
aggccaaggugggcggaucacaaggucaggaguucgagaccagccuggccaauauggugaaacc

SEQ ID NO: 405206 - RNA, 64 nt, Human; identical to SEQ ID NO: 358330

SEQ ID NO: 405207 - RNA, 64 nt, Human
gagaaccucggggacuugagccuucugcaggggauguccacagagagggaagggccgaggggag

SEQ ID NO: 405208 - RNA, 64 nt, Human
ccacccccccaaccuugcccccggcacaccaaaguguccacauuguaccaaagacugacccccg

SEQ ID NO: 405209 - RNA, 64 nt, Human
gcugaggcagacggauuaccugaggucaggaguucgagaccaaccuggccgacauggugaaacg

SEQ ID NO: 405210 - RNA, 64 nt, Human
aagagaaaagacucaagaaacugauccuggagaucgagaccauccuggcuaacauggugaaacc

SEQ ID NO: 405211 - RNA, 64 nt, Human
aggcugaggcgggcagaucacaagaucaggaguucgagaccagccuggccaacccagccugguc

SEQ ID NO: 405212 - RNA, 64 nt, Human
aggccgaggugggcggaucacgaggucaggagaucgagaccaucgugacuaacacagugaaacc

SEQ ID NO: 405213 - RNA, 64 nt, Human
aaagacaagacucuggggaugggaaugacuuccucgagaccauacagccaggaaauagcgguga

SEQ ID NO: 405214 - RNA, 64 nt, Human
gcagaggcagguggaucaccugaggucgggaguucgagaccagccugaccaacauggagauauc

SEQ ID NO: 405215 - RNA, 64 nt, Human
cucaccccacagggaccccagugcaucagcugaacgagaccauugacuacaacgagcaguucac

SEQ ID NO: 405216 - RNA, 64 nt, Human
aggccgaggcgggcggaucacaaggucaggagaucgagaccauccuggcuaacacagugaaacc

SEQ ID NO: 405217 - RNA, 64 nt, Human
gccaagauggguggaucaccugaagucaggaguucgagaccagccugaccaccauggagaaacc

SEQ ID NO: 405218 - RNA, 64 nt, Human
gucgaggugggcguaucaccugagguugggaguucgagaccagccugaccaacguggagaaacc

SEQ ID NO: 405219 - RNA, 64 nt, Human
gccaagguggguggaucacuugaggucaggaguucgagaccagccuggccaagauggcgaaacc

SEQ ID NO: 405220 - RNA, 64 nt, Human
aagccgagggggaugggucaugaggucaggaguucgagaccagccugaccaacauggugaaacc

SEQ ID NO: 405221 - RNA, 64 nt, Human
aggccgaggcgggcggaucacgaggucaggaguucgagaccacggugaaacccugucucuacua

SEQ ID NO: 405222 - RNA, 64 nt, Human
aggccgaggagggcggaucacgaggucaggagaucgagaccauccuggcuaacacagugaaacc

SEQ ID NO: 405223 - RNA, 64 nt, Human
gccaaggcaaguggaucaugugaggucaagaguucgagaccagccuggccaacauggugaaacc

SEQ ID NO: 405224 - RNA, 64 nt, Human
uugcacugcacaccccacggccauguaacucuccuguccacauaugauaauaccauucugcaua

SEQ ID NO: 405225 - RNA, 64 nt, Human
ugcugggacagucaugggacugcaucuuccgacuuguccacagcagaugaggacagugagaauu

SEQ ID NO: 405226 - RNA, 64 nt, Human
agucccccgagucccugccgcgcgcccucgcgccuguccacaucccucugcccauccgagaccu

SEQ ID NO: 405227 - RNA, 64 nt, Human
gcugagggagguagaucaccugaggucagaaguucgagaccagccuuaccaauauggugaagcc

SEQ ID NO: 405228 - RNA, 64 nt, Human
cccaggccccgcccgugagucccaagcgugugugcgagaccagauagcucuaggacguucuucu

SEQ ID NO: 405229 - RNA, 64 nt, Human
gccaaggugggaggaucgcuugagaccaggaguucgagaccagccugggcagcauagcaagauc

SEQ ID NO: 405230 - RNA, 64 nt, Human
gccaagguggguggaucaccugaggucaggagcucgagaccagccuggccaacauggugaaacc

SEQ ID NO: 405231 - RNA, 64 nt, Human
gccgaggcggauggaucaccugaggucgggaauucgagaccagccugaccaacauggagaaacu

SEQ ID NO: 405232 - RNA, 64 nt, Human
gcugagguggguggaucacuugaggucaggagcucgagaccagcuuggccaacauggugagccc

SEQ ID NO: 405233 - RNA, 64 nt, Human
cuggcugucuuuuuuuuuuuuuuuuuuuuuuucccgagaccaaguuucacucuguugcccaagg

SEQ ID NO: 405234 - RNA, 64 nt, Human
aggccaaggugggcagaucacgaggucaagagaucgagaccauccuggcgaacauggugaaacc

SEQ ID NO: 405235 - RNA, 64 nt, Human
ggccgaggcaggcggaucacaaggucaacgagaucgagaccauccuggccaacauggugaaacc

SEQ ID NO: 405236 - RNA, 64 nt, Human
aggccgaggcgggcggaucaugagguuaggagagcgagaccauccuggcuaacacggugaaacc

SEQ ID NO: 405237 - RNA, 64 nt, Human
aggccaagccagauggaucaugaagccaggaguucgagaccagccugaccaacauggugaaacc

SEQ ID NO: 405238 - RNA, 64 nt, Human
ggcugagugagaggaucacuugagcucaggaguucgagaccagccuggccaacauggcaacacc

SEQ ID NO: 405239 - RNA, 64 nt, Human
gcugaggugggaggaucauuugagcccaggaguucgagaccaaccugggcaacauagugagauu

SEQ ID NO: 405240 - RNA, 64 nt, Human
gcugaggcgggcagaucaccugaggccaggaguucgagaccagccugccaacauggugaaaccc

SEQ ID NO: 405241 - RNA, 64 nt, Human
gccaaggcaggugggucaccuggggucaggaguucgagaccagccugaccaauauggugaaacc

SEQ ID NO: 405242 - RNA, 64 nt, Human; identical to SEQ ID NO: 358207

SEQ ID NO: 405243 - RNA, 64 nt, Human; identical to SEQ ID NO: 358208

SEQ ID NO: 405244 - RNA, 64 nt, Human
uuggugaagaaaagaaugaaugauucuuuguaggcgccaucagccacuuuuagaagccaucagc

SEQ ID NO: 405245 - RNA, 64 nt, Human
aggccuaggcgggcggaucaugaagucaagaguucgagaccagcaauggccaguauggugaaac

SEQ ID NO: 405246 - RNA, 64 nt, Human
gccagggcagguggaucgcuugaucccaggaggucgagaccagccuggggaacacauccugucu

SEQ ID NO: 405247 - RNA, 64 nt, Human
gccgagacgggcggaucaccugaggucaggaguucgagaccagccucaacauggagaaaccccg

SEQ ID NO: 405248 - RNA, 64 nt, Human
aggcugaggcgggcggaucacgaggucaggagaucgagaccauccuggcuaacguggugaaacc

SEQ ID NO: 405249 - RNA, 64 nt, Human
aggccgaggcgggcggaucacaaggucaggaguucgagaccauccugucuaacacggugaaacc

SEQ ID NO: 405250 - RNA, 64 nt, Human
gccgaggcaggugguucaucuaaggucuggaguucgagaccagccuggccaacauagcgagagc

SEQ ID NO: 405251 - RNA, 64 nt, Human
aggccaaggcggguggaucacaaggucaagaguucgagaccagccugaccaacguggugaaacc

SEQ ID NO: 405252 - RNA, 64 nt, Human
aggcugaggcaggcggaucacgaggucaggagaucgagaccauccuggccaacacggugaaacc

SEQ ID NO: 405253 - RNA, 64 nt, Human
aggcugagguggccagaucccaaggucagaagaucgagaccauccuggcuaacauggugaaacc

SEQ ID NO: 405254 - RNA, 64 nt, Human
gccgagguggguggaucacccgaggucaggaguucgagaccagccuggccaacauggugaaacc

SEQ ID NO: 405255 - RNA, 64 nt, Human
aggccgaggcggguggaucaugaggucaggaguucgagaccagccuggccaacauagugaaacc

SEQ ID NO: 405256 - RNA, 64 nt, Human
gcggagacgggcagauaaccugaggucaggauuucgagaccaaccugaccuacauggagaaacu

SEQ ID NO: 405257 - RNA, 64 nt, Human
aggccgaggugggcagaucacgaggucaggagaucgagaccauccuggcuaacauggugaaacc

SEQ ID NO: 405258 - RNA, 64 nt, Human
gcuguggggggcggauugccugagcucaggaguucgagaccagccagggcaacauggugaaacc

SEQ ID NO: 405259 - RNA, 64 nt, Human
caagcagggggaugaaaaacucagcagagaaauucgagaccauuuugcaagacugugcccuucu

SEQ ID NO: 405260 - RNA, 64 nt, Human
uucuguuccuggaagacccagaguuaaaugcagauguccacacgaggggucggaguuaccugau

SEQ ID NO: 405261 - RNA, 64 nt, Human
guccuugugcccacacugagccagcaaguccugcuguccacacccacaagcuaccuggagggac

SEQ ID NO: 405262 - RNA, 64 nt, Human
uuugguacagcagguuugcugcaguguuuuuuucuguccacaugcaaauuuuggauucuauccc

SEQ ID NO: 405263 - RNA, 64 nt, Human
gccaagguggguggaucacuugaggucaggaguucgagaccagccuggccaacaugaugaaacc

SEQ ID NO: 405264 - RNA, 64 nt, Human
ggggaggcaggcagauaacuugagaucaggaguucgagaccagccuggccaacacaaugaaacc

SEQ ID NO: 405265 - RNA, 64 nt, Human
gcauugaagcccacgcucugagucucagcgccgacgagaccauggaagagccaucuguccuucu

SEQ ID NO: 405266 - RNA, 64 nt, Human
aggccgaggcuggcagaucacaaggucaggagaucgagaccauccuggcuaacacggugaaacc

SEQ ID NO: 405267 - RNA, 64 nt, Human
aggccaaggcggguggaucgcgagaucaggagcucgagaccacccuggccaacauggugaaacc

SEQ ID NO: 405268 - RNA, 64 nt, Human
aggccaaggugggcggaucacaaggucaggaguucgagaccaaccuagccaacauggugaaacc

SEQ ID NO: 405269 - RNA, 64 nt, Human
aggccgaggcaggcggaucacaaggucaggaguucgagaccagccuggccaacaaggcaaaacc

SEQ ID NO: 405270 - RNA, 64 nt, Human
aggccgaggcggguggaucaugagaucaggagaucgagaccauccuggcuaacacggcgaaacc

SEQ ID NO: 405271 - RNA, 64 nt, Human
aggcugaggcaggugguucacuggagguugaguucgagaccagccuggccacauggugaaaccc

SEQ ID NO: 405272 - RNA, 64 nt, Human
aggccaaggugggcggaucaugaggucaggagaucgagaccauccuggccaacauggugaaacc

SEQ ID NO: 405273 - RNA, 64 nt, Human
aggcugaagcaggcggaucacaaggucaggaguucgagaccagccuggccaacacuggucucug

SEQ ID NO: 405274 - RNA, 64 nt, Human
aggccgaggcggguggaucacgaggucaggagaucgagaccauccuggcgaacauggugagacc

SEQ ID NO: 405275 - RNA, 64 nt, Human
aggcugaggcggggagaucacaaggucaggagaucgagaccagccugaccaacauggugaaacc

SEQ ID NO: 405276 - RNA, 64 nt, Human
aaaacauuaaaauaccuguauguuuuguuuuagacgagaccaaacuaaacaaaaaguaucuguu

SEQ ID NO: 405277 - RNA, 64 nt, Human
aggccgaggcggguggaucaugaggucaggagaucgagaccauccuggcuaacacagugaaacc

SEQ ID NO: 405278 - RNA, 64 nt, Human; identical to SEQ ID NO: 358251

SEQ ID NO: 405279 - RNA, 64 nt, Human; identical to SEQ ID NO: 358252

SEQ ID NO: 405280 - RNA, 64 nt, Human
augaugagguuacaugcugcuugccuccaccagauguccacaacaauaugaaguacagcagaag

SEQ ID NO: 405281 - RNA, 64 nt, Human
gccgaggcaggagaaucgcuugagcccaggaguucgagaccagccuggacaacauagugagacc

SEQ ID NO: 405282 - RNA, 64 nt, Human
gucggaaaugaucuggcugaauccgugguggcaccgagaccaaacucauucaccaaaugaugcc

SEQ ID NO: 405283 - RNA, 64 nt, Human
aggccgaggcggguggaucaugaggucaggagaucgagaccauccuggcuaacacgugaaaccc

SEQ ID NO: 405284 - RNA, 64 nt, Human
ggaggccaggacagaucacuugaggucaggaguucgagaccagcccagccaacauggcgaaacc

SEQ ID NO: 405285 - RNA, 64 nt, Human
gccgaggcaggcagaucgcuugaggucaggaguucgagaccagccuggccaacauggugaaacc

SEQ ID NO: 405286 - RNA, 64 nt, Human
gcugagacgggugaauuacaugagguugggaguucgagaccagccugaccaacauggugaaauc

SEQ ID NO: 405287 - RNA, 64 nt, Human
aggcugagguggguggaucacaaggucaagagaucgagaccauccuggccaacauggugaaacc

SEQ ID NO: 405288 - RNA, 64 nt, Human
gcugaggcagguggaucaccugaggccaggaguucgagaccagccuggccaacauagcgaaacc

SEQ ID NO: 405289 - RNA, 64 nt, Human
gccgaggcagguggaucaccuaaggucaggaguucgagaccagccuggccaauauggugaaacc

SEQ ID NO: 405290 - RNA, 64 nt, Human
uccucucuuccacaguggcgggcccacucagccccgagaccacccaaccucacccuccugaccc

SEQ ID NO: 405291 - RNA, 64 nt, Human
aggccgaggcaggcagaucacgaggucaggaguucgagaccagccuggccaacauggcaagacc

SEQ ID NO: 405292 - RNA, 64 nt, Human
agcccgaggcgggcggaucacaaggucaggaguucgagaccagccuggccaacacggugaaacc

SEQ ID NO: 405293 - RNA, 64 nt, Human
uccagggacgggagagauugugucaugugccacacgagaccaacguggaaaagucugaagggcc

SEQ ID NO: 405294 - RNA, 64 nt, Human
aaggauauuuacagaaaagacucugaccagagaucgagaccauccuagccaacaucgugaaacc

SEQ ID NO: 405295 - RNA, 64 nt, Human
aggccgaggcgggcagaucacgaggucaggagaucgagaccauccuggcuaacacggugaaacc

SEQ ID NO: 405296 - RNA, 64 nt, Human
ucaugcccauaccccuggccaaggaagaucccuuuguccacaaguaaaaggaaaugcuccucca

SEQ ID NO: 405297 - RNA, 64 nt, Human
aaccauauaaagaauucuuuugaggauggaauucuguccacaaaauaauuuugugagcccagau

SEQ ID NO: 405298 - RNA, 64 nt, Human
ucacugccugcagcugagauuccagaacgcccuguguccacagugauuagccucgucuuucagc

SEQ ID NO: 405299 - RNA, 64 nt, Human
acugaggcaggaggaucacuuaaggccaggaguucgagaccagccugggcaacagcaagaccuc

SEQ ID NO: 405300 - RNA, 64 nt, Human
gcugagguaggaugauggcuugagcccaggaguucgagaccagccugggcaacacagcgagauc

SEQ ID NO: 405301 - RNA, 64 nt, Human
aggccgaggcgggcagaucacgaguucaggagaucgagaccaucuuggccaacauggugaaacc

SEQ ID NO: 405302 - RNA, 64 nt, Human
acuaaggcagguggaucaccugaggccaggaguucgagaccagccuggccaacauggcaaaacc

SEQ ID NO: 405303 - RNA, 64 nt, Human
uugaaccccuuuuucuguguggccccuggggcugcgagaccaaaauccaugaguucuguguacc

SEQ ID NO: 405304 - RNA, 64 nt, Human
aggcccaggugggcggaucacgaggucaggagaucgagaccaucuuggcuaacauggugaaacc

SEQ ID NO: 405305 - RNA, 64 nt, Human
gcugaggcgggcggaacaccugaggucagguguucgagaccagccaggccaacauggugaaacc

SEQ ID NO: 405306 - RNA, 64 nt, Human
aggccgaggcaggcggaucacaaggucaggagaucgagaccauccuggccaauauggugaaacc

SEQ ID NO: 405307 - RNA, 64 nt, Human
gccaaggcaggcggaucaccugaggucaggaguucgagaccagccuggcuaacauggcaaaacc

SEQ ID NO: 405308 - RNA, 64 nt, Human
cuucugcaauucaggucuccuuuugcauuuuugccgagaccagcugggucguggagacccuaac

SEQ ID NO: 405309 - RNA, 64 nt, Human
aggccgaggcaggcggaccacgaggucaguaguucgagaccagccuggucaauauggugaaacc

SEQ ID NO: 405310 - RNA, 64 nt, Human
gcugagaugggcagaucacuugaggucaggaguucgagaccagccuggccaacauggugaaacc

SEQ ID NO: 405311 - RNA, 64 nt, Human
gccaaggagggaggaucacuugaacucaggaauucgagaccagccugggcuacauagugagacc

SEQ ID NO: 405312 - RNA, 64 nt, Human
uucccacacagcccauggagguguuuguggacgacgagaccaagcucacgcugcacggccugca

SEQ ID NO: 405313 - RNA, 64 nt, Human
aggccaagaugggcggaucacgaggucaggaguucgagaccagccuggccaacauagugaaacc

SEQ ID NO: 405314 - RNA, 64 nt, Human
aaguuaagguacuucccuauauccaucucuuuuagguacgcaaagagaaccaguggugugaaga

SEQ ID NO: 405315 - RNA, 64 nt, Human
gggggugaagaccaaucccuuccuuugguccuuugguacgcacccccucagagcugagauggaa

SEQ ID NO: 405316 - RNA, 64 nt, Human
aagagugacauugggugacugcugcuuggaaaacuguccacacuugcuacucuuugagaaugaa

SEQ ID NO: 405317 - RNA, 64 nt, Human
gcugaggcagguggaucaccugagguuaggaguucgagaccagccuggccaacauggugaaacc

SEQ ID NO: 405318 - RNA, 64 nt, Human
auccgcgauucccugcgaccaggccccgagagggcgagaccagaggggacggaagcauugcgcc

SEQ ID NO: 405319 - RNA, 64 nt, Human
ugcaaggcaggcagaucauuugaggucagaaauucgagaccagcguggucaacaugguguaacc

SEQ ID NO: 405320 - RNA, 64 nt, Human
gcugaggcggguggaucaccugaggucaggaguucgagaccagccuggccaacaugguaaaacu

SEQ ID NO: 405321 - RNA, 64 nt, Human
aggccgaggcgggcggaucacgaggucaggagaucgagaccauccuggcuaacauggugaaacc

SEQ ID NO: 405322 - RNA, 64 nt, Human
ggaggccggugggcagaucaugaggucaggaguucgagaccagccugaccaucauggugaaacc

SEQ ID NO: 405323 - RNA, 64 nt, Human
gggggggugggggaggaucacggggucaggagaucgagaccauccuggccaacaugaugaaacc

SEQ ID NO: 405324 - RNA, 64 nt, Human
gccaaggcgggcagaugacuugaggucaggaguucgagaccagccuggccaacauggugaaacc

SEQ ID NO: 405325 - RNA, 64 nt, Human
guugaggugggcagaucgccugaggucgggaguucgagaccagccuggccaacuuggugaaacc

SEQ ID NO: 405326 - RNA, 64 nt, Human
gcugaggcagguggaucaccugaggucgggaguucgagaccagccugaccaacauggagaaacc

SEQ ID NO: 405327 - RNA, 64 nt, Human
gccgaggcggggggaucaccugaggucucgaguucgagaccaggcuggccaacacggugaaacg

SEQ ID NO: 405328 - RNA, 64 nt, Human
gcugaggugggcgcaucaccugaggucaggaguucgagaccagcaugaccaacauggugaaacc

SEQ ID NO: 405329 - RNA, 64 nt, Human
aggcggaggcgggcagaucgcgaggucaggagaucgagaccauccuggcuaacguggagaaacc

SEQ ID NO: 405330 - RNA, 64 nt, Human
ggcugaggugagaggauuccuugaggccaggguucgagaccaaccuugggcaacauagcaagac

SEQ ID NO: 405331 - RNA, 64 nt, Human
gccgaggcagguggaucaccugaggucaggaguucgagaccagccuggccaacagggugaaacc

SEQ ID NO: 405332 - RNA, 64 nt, Human
gacagugggucuauucuucauuagcucagugacuuguccacacucgucuuagcacuuacguuuc

SEQ ID NO: 405333 - RNA, 64 nt, Human
cggaguaggagaagaagcccugcacacagggcaguguccacagccagaaaacuccugcugggca

SEQ ID NO: 405334 - RNA, 64 nt, Human
gaugccagugcccagaagcagugagauuagucuguguccacaagcagaggcccccucgauggga

SEQ ID NO: 405335 - RNA, 64 nt, Human
ggaccuaggguggccugagagggcgguggguaugcgagaccagcacggugacucuguccagcuc

SEQ ID NO: 405336 - RNA, 64 nt, Human
uugagaggccaaggcggucacgaggucaggaguucgagaccagccuagccaacauggugaaacc

SEQ ID NO: 405337 - RNA, 64 nt, Human
gccgaagcgggcggaucaccugaggucgggaguucgagaccagccugaccaacauggagaaacc

SEQ ID NO: 405338 - RNA, 64 nt, Human
gccaagguggguggaucacuugaggucaagaguucgagaccagccuggccaacauggcaaaacc

SEQ ID NO: 405339 - RNA, 64 nt, Human
gccaaggcgggcagaucaccggaggucaggaguucgagaccagccugaccaacauggagaaacc

SEQ ID NO: 405340 - RNA, 64 nt, Human
gccgaggcgggcagaucaccugaggucaggaguucgagaccauccuggccaacauggugaaacc

SEQ ID NO: 405341 - RNA, 64 nt, Human
aggcugaggcaggcagaucaugaggucaagagaucgagaccagccuggccaacguggugaaacc

SEQ ID NO: 405342 - RNA, 64 nt, Human
gccaaggcaggcagaucacuugaggucaggaguucgagaccagccugaccaacauggugagacc

SEQ ID NO: 405343 - RNA, 64 nt, Human
aauuuuucauuacaguguuuuguaaauguauccacgagaccaugaugcauuguuuugugcucaa

SEQ ID NO: 405344 - RNA, 64 nt, Human
aggccgaggcgagcagaucacgaggucaggagaccgagaccauccuggcuaacauggugaaacc

SEQ ID NO: 405345 - RNA, 64 nt, Human
gcugaggcaggaggaucacuugagcucaggaauucgagaccagccugggucacauagcaagacc

SEQ ID NO: 405346 - RNA, 64 nt, Human
gcugaggaggguggaucacuugaggccaggaauucgagaccagccuggccaacauggcgaaaac

SEQ ID NO: 405347 - RNA, 64 nt, Human
aggccaaggcgggcggaucacgaggucaggagaucgagaccauccuggcuaacacagugaaacc

SEQ ID NO: 405348 - RNA, 64 nt, Human
aggccaaggcggguggaucacgaggucaggagaucgagaccauccuggcuaacacggugaaacc

SEQ ID NO: 405349 - RNA, 64 nt, Human
gcagaggugagagaaucgcuugagcccaggaauucgagaccagccugggccacaugacaaagcc

SEQ ID NO: 405350 - RNA, 64 nt, Human
ccuccuuccucauccagcaccaaaucuuugcuuauguccacaggccagggccugugcugcaguc

SEQ ID NO: 405351 - RNA, 64 nt, Human
aaaauuuaaaugagauaaugcaguugcaacuguguguccacaaguauggacaucaaaucugugg

SEQ ID NO: 405352 - RNA, 64 nt, Human
ccagugggguccccccugagugggcugggcccucuguccacauguggggacagggcuggugugg

SEQ ID NO: 405353 - RNA, 64 nt, Human
gcuaaggcggguggaucacuugaggucaggaguucgagaccagccuggccaacauggugaaacc

SEQ ID NO: 405354 - RNA, 64 nt, Human
aggccgaggcggguggaucacaaggucagcagaucgagaccauccuggccaacauggugaaacc

SEQ ID NO: 405355 - RNA, 64 nt, Human
gccgaggugggaggaucacuugagcccaggaguucgagaccagccuaggcaacauagcaagacc

SEQ ID NO: 405356 - RNA, 64 nt, Human
caagcccgguuccugcuacgccccauggaggcuccgagaccaucugcccagccucacugaggcu

SEQ ID NO: 405357 - RNA, 64 nt, Human
accgaggcagguggaucaccugaggucaggaguucgagaccagccuggccaacguggugaaacc

SEQ ID NO: 405358 - RNA, 64 nt, Human
gcugaggcgagaggaucacuugagcacaggaguucgagaccagccuggacaacauagugagacc

SEQ ID NO: 405359 - RNA, 64 nt, Human
gccgaggugggcagaucaccggaggucaggaguucgagaccagccuugccaacauagugaaacc

SEQ ID NO: 405360 - RNA, 64 nt, Human
aggccgaggcgggcggaucacgaggucaggaguucgagaccagccuggccaacauggugaaacc

SEQ ID NO: 405361 - RNA, 64 nt, Human
gccgaggcagguggaucaccugaggucaggaguucgagaccagccuggccaacauggcgaaacc

SEQ ID NO: 405362 - RNA, 64 nt, Human
aggcugaggcagguggaucacgaggucaggagaucgagaccauccuggcuaacacggugaaacc

SEQ ID NO: 405363 - RNA, 64 nt, Human
gccgaggcagguggaucaccugaggucaggaguucgagaccagccuggccaacauggcaaaacc

SEQ ID NO: 405364 - RNA, 64 nt, Human
aggccaaggcaggcagaucacgaggucaggaguucgagaccauccuggccaacauggugaaacc

SEQ ID NO: 405365 - RNA, 64 nt, Human
cgagcccagcuacauuccucagcugccaagcacucgagaccauccuggccccuccagacccugc

SEQ ID NO: 405366 - RNA, 64 nt, Human
ccgggcgugguggcucacgcugaggucaggaguucgagaccagccuggccaaccaacaugguga

SEQ ID NO: 405367 - RNA, 64 nt, Human
gccgaggugggcagaucagcugaggucaggagaucgagaccagccuggccaacauggcgaaacc

SEQ ID NO: 405368 - RNA, 64 nt, Human; identical to SEQ ID NO: 358099

SEQ ID NO: 405369 - RNA, 64 nt, Human; identical to SEQ ID NO: 358100

SEQ ID NO: 405370 - RNA, 64 nt, Human; identical to SEQ ID NO: 358101

SEQ ID NO: 405371 - RNA, 64 nt, Human; identical to SEQ ID NO: 358040

SEQ ID NO: 405372 - RNA, 64 nt, Human; identical to SEQ ID NO: 358041

SEQ ID NO: 405373 - RNA, 64 nt, Human; identical to SEQ ID NO: 358042

SEQ ID NO: 405374 - RNA, 64 nt, Human; identical to SEQ ID NO: 358043

SEQ ID NO: 405375 - RNA, 64 nt, Human; identical to SEQ ID NO: 358044

SEQ ID NO: 405376 - RNA, 64 nt, Human; identical to SEQ ID NO: 358045

SEQ ID NO: 405377 - RNA, 64 nt, Human; identical to SEQ ID NO: 358046

SEQ ID NO: 405378 - RNA, 64 nt, Human; identical to SEQ ID NO: 358047

SEQ ID NO: 405379 - RNA, 64 nt, Human; identical to SEQ ID NO: 358048

SEQ ID NO: 405380 - RNA, 64 nt, Human; identical to SEQ ID NO: 358049

SEQ ID NO: 405381 - RNA, 64 nt, Human; identical to SEQ ID NO: 358050

SEQ ID NO: 405382 - RNA, 64 nt, Human; identical to SEQ ID NO: 358051

SEQ ID NO: 405383 - RNA, 64 nt, Human; identical to SEQ ID NO: 358052

SEQ ID NO: 405384 - RNA, 64 nt, Human; identical to SEQ ID NO: 358056

SEQ ID NO: 405385 - RNA, 64 nt, Human; identical to SEQ ID NO: 358057

SEQ ID NO: 405386 - RNA, 64 nt, Human; identical to SEQ ID NO: 358058

SEQ ID NO: 405387 - RNA, 64 nt, Human; identical to SEQ ID NO: 358059

SEQ ID NO: 405388 - RNA, 64 nt, Human; identical to SEQ ID NO: 358060

SEQ ID NO: 405389 - RNA, 64 nt, Human; identical to SEQ ID NO: 358061

SEQ ID NO: 405390 - RNA, 64 nt, Human; identical to SEQ ID NO: 358062

SEQ ID NO: 405391 - RNA, 64 nt, Human; identical to SEQ ID NO: 358063

SEQ ID NO: 405392 - RNA, 64 nt, Human; identical to SEQ ID NO: 358064

SEQ ID NO: 405393 - RNA, 64 nt, Human; identical to SEQ ID NO: 358065

SEQ ID NO: 405394 - RNA, 64 nt, Human; identical to SEQ ID NO: 358066

SEQ ID NO: 405395 - RNA, 64 nt, Human; identical to SEQ ID NO: 358067

SEQ ID NO: 405396 - RNA, 64 nt, Human; identical to SEQ ID NO: 358068

SEQ ID NO: 405397 - RNA, 64 nt, Human; identical to SEQ ID NO: 358069

SEQ ID NO: 405398 - RNA, 64 nt, Human; identical to SEQ ID NO: 358070

SEQ ID NO: 405399 - RNA, 64 nt, Human; identical to SEQ ID NO: 358071

SEQ ID NO: 405400 - RNA, 64 nt, Human; identical to SEQ ID NO: 358072

SEQ ID NO: 405401 - RNA, 64 nt, Human; identical to SEQ ID NO: 358073

SEQ ID NO: 405402 - RNA, 64 nt, Human; identical to SEQ ID NO: 358074

SEQ ID NO: 405403 - RNA, 64 nt, Human; identical to SEQ ID NO: 358075

SEQ ID NO: 405404 - RNA, 64 nt, Human; identical to SEQ ID NO: 358077

SEQ ID NO: 405405 - RNA, 64 nt, Human; identical to SEQ ID NO: 358078

SEQ ID NO: 405406 - RNA, 64 nt, Human; identical to SEQ ID NO: 358079

SEQ ID NO: 405407 - RNA, 64 nt, Human; identical to SEQ ID NO: 358080

SEQ ID NO: 405408 - RNA, 64 nt, Human; identical to SEQ ID NO: 358081

SEQ ID NO: 405409 - RNA, 64 nt, Human; identical to SEQ ID NO: 358082

SEQ ID NO: 405410 - RNA, 64 nt, Human; identical to SEQ ID NO: 358083

SEQ ID NO: 405411 - RNA, 52 nt, Human; identical to SEQ ID NO: 358084

SEQ ID NO: 405412 - RNA, 64 nt, Human; identical to SEQ ID NO: 358085

SEQ ID NO: 405413 - RNA, 64 nt, Human; identical to SEQ ID NO: 358086

SEQ ID NO: 405414 - RNA, 64 nt, Human; identical to SEQ ID NO: 358087

SEQ ID NO: 405415 - RNA, 64 nt, Human; identical to SEQ ID NO: 358088

SEQ ID NO: 405416 - RNA, 64 nt, Human; identical to SEQ ID NO: 358089

SEQ ID NO: 405417 - RNA, 64 nt, Human; identical to SEQ ID NO: 358090

SEQ ID NO: 405418 - RNA, 64 nt, Human; identical to SEQ ID NO: 358091

SEQ ID NO: 405419 - RNA, 64 nt, Human; identical to SEQ ID NO: 358092

SEQ ID NO: 405420 - RNA, 64 nt, Human; identical to SEQ ID NO: 358093

SEQ ID NO: 405421 - RNA, 64 nt, Human; identical to SEQ ID NO: 358094

SEQ ID NO: 405422 - RNA, 64 nt, Human; identical to SEQ ID NO: 358095

SEQ ID NO: 405423 - RNA, 64 nt, Human; identical to SEQ ID NO: 358096

SEQ ID NO: 405424 - RNA, 64 nt, Human; identical to SEQ ID NO: 358109

SEQ ID NO: 405425 - RNA, 64 nt, Human; identical to SEQ ID NO: 358110

SEQ ID NO: 405426 - RNA, 64 nt, Human; identical to SEQ ID NO: 358111

SEQ ID NO: 405427 - RNA, 64 nt, Human; identical to SEQ ID NO: 358112

SEQ ID NO: 405428 - RNA, 64 nt, Human; identical to SEQ ID NO: 358113

SEQ ID NO: 405429 - RNA, 64 nt, Human; identical to SEQ ID NO: 358114

SEQ ID NO: 405430 - RNA, 64 nt, Human; identical to SEQ ID NO: 358115

SEQ ID NO: 405431 - RNA, 64 nt, Human; identical to SEQ ID NO: 358116

SEQ ID NO: 405432 - RNA, 64 nt, Human; identical to SEQ ID NO: 358117

SEQ ID NO: 405433 - RNA, 64 nt, Human; identical to SEQ ID NO: 358118

SEQ ID NO: 405434 - RNA, 64 nt, Human; identical to SEQ ID NO: 358119

SEQ ID NO: 405435 - RNA, 64 nt, Human; identical to SEQ ID NO: 358120

SEQ ID NO: 405436 - RNA, 64 nt, Human; identical to SEQ ID NO: 358121

SEQ ID NO: 405437 - RNA, 64 nt, Human; identical to SEQ ID NO: 358122

SEQ ID NO: 405438 - RNA, 64 nt, Human; identical to SEQ ID NO: 358123

SEQ ID NO: 405439 - RNA, 64 nt, Human; identical to SEQ ID NO: 358124

SEQ ID NO: 405440 - RNA, 64 nt, Human; identical to SEQ ID NO: 358125

SEQ ID NO: 405441 - RNA, 64 nt, Human; identical to SEQ ID NO: 358126

SEQ ID NO: 405442 - RNA, 64 nt, Human; identical to SEQ ID NO: 358127

SEQ ID NO: 405443 - RNA, 64 nt, Human; identical to SEQ ID NO: 358128

SEQ ID NO: 405444 - RNA, 64 nt, Human; identical to SEQ ID NO: 358131

SEQ ID NO: 405445 - RNA, 64 nt, Human; identical to SEQ ID NO: 358132

SEQ ID NO: 405446 - RNA, 64 nt, Human; identical to SEQ ID NO: 358133

SEQ ID NO: 405447 - RNA, 64 nt, Human; identical to SEQ ID NO: 358134

SEQ ID NO: 405448 - RNA, 64 nt, Human; identical to SEQ ID NO: 358135

SEQ ID NO: 405449 - RNA, 64 nt, Human; identical to SEQ ID NO: 358136

SEQ ID NO: 405450 - RNA, 64 nt, Human; identical to SEQ ID NO: 358137

SEQ ID NO: 405451 - RNA, 57 nt, Human; identical to SEQ ID NO: 358138

SEQ ID NO: 405452 - RNA, 64 nt, Human; identical to SEQ ID NO: 358139

SEQ ID NO: 405453 - RNA, 64 nt, Human; identical to SEQ ID NO: 358140

SEQ ID NO: 405454 - RNA, 64 nt, Human; identical to SEQ ID NO: 358141

SEQ ID NO: 405455 - RNA, 64 nt, Human; identical to SEQ ID NO: 358142

SEQ ID NO: 405456 - RNA, 64 nt, Human; identical to SEQ ID NO: 358143

SEQ ID NO: 405457 - RNA, 64 nt, Human; identical to SEQ ID NO: 358144

SEQ ID NO: 405458 - RNA, 64 nt, Human; identical to SEQ ID NO: 358145

SEQ ID NO: 405459 - RNA, 64 nt, Human; identical to SEQ ID NO: 358146

SEQ ID NO: 405460 - RNA, 64 nt, Human; identical to SEQ ID NO: 358147

SEQ ID NO: 405461 - RNA, 64 nt, Human
augggcugcugccagaggaccguggauaccucaguguccacacacccaccaugcccagcccugg

SEQ ID NO: 405462 - RNA, 64 nt, Human
cauugaaucaccaaggccugggaucaaccugggcuguccacacagaaaacaaaaacccaaccaa

SEQ ID NO: 405463 - RNA, 64 nt, Human
uucugugguuugagaggaugaacccugcaggccauguccacaguucugagaggccaccugcuuu

SEQ ID NO: 405464 - RNA, 64 nt, Human; identical to SEQ ID NO: 358148

SEQ ID NO: 405465 - RNA, 64 nt, Human; identical to SEQ ID NO: 358149

SEQ ID NO: 405466 - RNA, 64 nt, Human; identical to SEQ ID NO: 358150

SEQ ID NO: 405467 - RNA, 64 nt, Human; identical to SEQ ID NO: 358151

SEQ ID NO: 405468 - RNA, 64 nt, Human; identical to SEQ ID NO: 358152

SEQ ID NO: 405469 - RNA, 64 nt, Human; identical to SEQ ID NO: 358153

SEQ ID NO: 405470 - RNA, 64 nt, Human; identical to SEQ ID NO: 358154

SEQ ID NO: 405471 - RNA, 64 nt, Human; identical to SEQ ID NO: 358155

SEQ ID NO: 405472 - RNA, 64 nt, Human; identical to SEQ ID NO: 358156

SEQ ID NO: 405473 - RNA, 64 nt, Human; identical to SEQ ID NO: 358157

SEQ ID NO: 405474 - RNA, 64 nt, Human; identical to SEQ ID NO: 358158

SEQ ID NO: 405475 - RNA, 64 nt, Human; identical to SEQ ID NO: 358159

SEQ ID NO: 405476 - RNA, 64 nt, Human; identical to SEQ ID NO: 358160

SEQ ID NO: 405477 - RNA, 64 nt, Human; identical to SEQ ID NO: 358161

SEQ ID NO: 405478 - RNA, 64 nt, Human; identical to SEQ ID NO: 358162

SEQ ID NO: 405479 - RNA, 64 nt, Human; identical to SEQ ID NO: 358163

SEQ ID NO: 405480 - RNA, 64 nt, Human; identical to SEQ ID NO: 358164

SEQ ID NO: 405481 - RNA, 64 nt, Human; identical to SEQ ID NO: 358165

SEQ ID NO: 405482 - RNA, 64 nt, Human
aauggggaggcggccucuccccuguugcugcccguguccacacaggaauguacacugguggcag

SEQ ID NO: 405483 - RNA, 64 nt, Human
uuaggauagauugugggacccaggcaggaacagguguccacaagaacucaggauggcaucaguu

SEQ ID NO: 405484 - RNA, 64 nt, Human; identical to SEQ ID NO: 358166

SEQ ID NO: 405485 - RNA, 64 nt, Human; identical to SEQ ID NO: 358167

SEQ ID NO: 405486 - RNA, 64 nt, Human; identical to SEQ ID NO: 358168

SEQ ID NO: 405487 - RNA, 64 nt, Human; identical to SEQ ID NO: 358169

SEQ ID NO: 405488 - RNA, 64 nt, Human; identical to SEQ ID NO: 358170

SEQ ID NO: 405489 - RNA, 64 nt, Human; identical to SEQ ID NO: 358171

SEQ ID NO: 405490 - RNA, 64 nt, Human; identical to SEQ ID NO: 358172

SEQ ID NO: 405491 - RNA, 64 nt, Human; identical to SEQ ID NO: 358173

SEQ ID NO: 405492 - RNA, 64 nt, Human; identical to SEQ ID NO: 358174

SEQ ID NO: 405493 - RNA, 64 nt, Human; identical to SEQ ID NO: 358175

SEQ ID NO: 405494 - RNA, 63 nt, Human; identical to SEQ ID NO: 358176

SEQ ID NO: 405495 - RNA, 64 nt, Human; identical to SEQ ID NO: 358177

SEQ ID NO: 405496 - RNA, 64 nt, Human; identical to SEQ ID NO: 358178

SEQ ID NO: 405497 - RNA, 64 nt, Human; identical to SEQ ID NO: 358179

SEQ ID NO: 405498 - RNA, 64 nt, Human; identical to SEQ ID NO: 358180

SEQ ID NO: 405499 - RNA, 64 nt, Human; identical to SEQ ID NO: 358181

SEQ ID NO: 405500 - RNA, 64 nt, Human; identical to SEQ ID NO: 358182

SEQ ID NO: 405501 - RNA, 64 nt, Human
ggucugcuguaacauuucccaccaacucucuugcuguccacaucaacagcuaaaucauuuauuc

SEQ ID NO: 405502 - RNA, 64 nt, Human
auuuaauaaugucauguauaaaauaugaauaaaauguccacauaggaaauuaacacauauauac

SEQ ID NO: 405503 - RNA, 64 nt, Human
aagauggagugaaauugcaucgaggguaagacuguguccacagguuuaaaauucucucuucuga

SEQ ID NO: 405504 - RNA, 64 nt, Human; identical to SEQ ID NO: 358183

SEQ ID NO: 405505 - RNA, 64 nt, Human; identical to SEQ ID NO: 358184

SEQ ID NO: 405506 - RNA, 64 nt, Human; identical to SEQ ID NO: 358185

SEQ ID NO: 405507 - RNA, 64 nt, Human; identical to SEQ ID NO: 358186

SEQ ID NO: 405508 - RNA, 64 nt, Human; identical to SEQ ID NO: 358187

SEQ ID NO: 405509 - RNA, 64 nt, Human; identical to SEQ ID NO: 358188

SEQ ID NO: 405510 - RNA, 64 nt, Human; identical to SEQ ID NO: 358189

SEQ ID NO: 405511 - RNA, 64 nt, Human; identical to SEQ ID NO: 358190

SEQ ID NO: 405512 - RNA, 64 nt, Human; identical to SEQ ID NO: 358191

SEQ ID NO: 405513 - RNA, 64 nt, Human; identical to SEQ ID NO: 358192

SEQ ID NO: 405514 - RNA, 64 nt, Human; identical to SEQ ID NO: 358193

SEQ ID NO: 405515 - RNA, 64 nt, Human; identical to SEQ ID NO: 358194

SEQ ID NO: 405516 - RNA, 64 nt, Human; identical to SEQ ID NO: 358195

SEQ ID NO: 405517 - RNA, 64 nt, Human; identical to SEQ ID NO: 358196

SEQ ID NO: 405518 - RNA, 64 nt, Human; identical to SEQ ID NO: 358197

SEQ ID NO: 405519 - RNA, 64 nt, Human; identical to SEQ ID NO: 358198

SEQ ID NO: 405520 - RNA, 64 nt, Human; identical to SEQ ID NO: 358199

SEQ ID NO: 405521 - RNA, 64 nt, Human; identical to SEQ ID NO: 358200

SEQ ID NO: 405522 - RNA, 64 nt, Human; identical to SEQ ID NO: 358201

SEQ ID NO: 405523 - RNA, 64 nt, Human; identical to SEQ ID NO: 358202

SEQ ID NO: 405524 - RNA, 64 nt, Human; identical to SEQ ID NO: 358209

SEQ ID NO: 405525 - RNA, 64 nt, Human; identical to SEQ ID NO: 358210

SEQ ID NO: 405526 - RNA, 64 nt, Human; identical to SEQ ID NO: 358211

SEQ ID NO: 405527 - RNA, 64 nt, Human; identical to SEQ ID NO: 358212

SEQ ID NO: 405528 - RNA, 64 nt, Human; identical to SEQ ID NO: 358213

SEQ ID NO: 405529 - RNA, 64 nt, Human; identical to SEQ ID NO: 358214

SEQ ID NO: 405530 - RNA, 64 nt, Human; identical to SEQ ID NO: 358215

SEQ ID NO: 405531 - RNA, 64 nt, Human; identical to SEQ ID NO: 358216

SEQ ID NO: 405532 - RNA, 64 nt, Human; identical to SEQ ID NO: 358217

SEQ ID NO: 405533 - RNA, 64 nt, Human; identical to SEQ ID NO: 358218

SEQ ID NO: 405534 - RNA, 64 nt, Human; identical to SEQ ID NO: 358219

SEQ ID NO: 405535 - RNA, 64 nt, Human; identical to SEQ ID NO: 358220

SEQ ID NO: 405536 - RNA, 64 nt, Human; identical to SEQ ID NO: 358221

SEQ ID NO: 405537 - RNA, 64 nt, Human; identical to SEQ ID NO: 358222

SEQ ID NO: 405538 - RNA, 64 nt, Human; identical to SEQ ID NO: 358223

SEQ ID NO: 405539 - RNA, 64 nt, Human; identical to SEQ ID NO: 358224

SEQ ID NO: 405540 - RNA, 64 nt, Human; identical to SEQ ID NO: 358225

SEQ ID NO: 405541 - RNA, 64 nt, Human; identical to SEQ ID NO: 358226

SEQ ID NO: 405542 - RNA, 64 nt, Human
auaggagaguggaugauagaugcaaaauaauaccuguccacaacaaacucuuaaugcuguguuu

SEQ ID NO: 405543 - RNA, 62 nt, Human
cucgugaccuggucgugauguggcauucagugcauguccacagcuaauggaaaaacacgagg

SEQ ID NO: 405544 - RNA, 64 nt, Human; identical to SEQ ID NO: 358227

SEQ ID NO: 405545 - RNA, 64 nt, Human; identical to SEQ ID NO: 358228

SEQ ID NO: 405546 - RNA, 64 nt, Human; identical to SEQ ID NO: 358229

SEQ ID NO: 405547 - RNA, 64 nt, Human; identical to SEQ ID NO: 358230

SEQ ID NO: 405548 - RNA, 64 nt, Human; identical to SEQ ID NO: 358231

SEQ ID NO: 405549 - RNA, 64 nt, Human; identical to SEQ ID NO: 358232

SEQ ID NO: 405550 - RNA, 64 nt, Human; identical to SEQ ID NO: 358233

SEQ ID NO: 405551 - RNA, 64 nt, Human; identical to SEQ ID NO: 358234

SEQ ID NO: 405552 - RNA, 51 nt, Human; identical to SEQ ID NO: 358235

SEQ ID NO: 405553 - RNA, 64 nt, Human; identical to SEQ ID NO: 358236

SEQ ID NO: 405554 - RNA, 64 nt, Human; identical to SEQ ID NO: 358237

SEQ ID NO: 405555 - RNA, 64 nt, Human; identical to SEQ ID NO: 358238

SEQ ID NO: 405556 - RNA, 64 nt, Human; identical to SEQ ID NO: 358239

SEQ ID NO: 405557 - RNA, 64 nt, Human; identical to SEQ ID NO: 358240

SEQ ID NO: 405558 - RNA, 64 nt, Human; identical to SEQ ID NO: 358241

SEQ ID NO: 405559 - RNA, 64 nt, Human; identical to SEQ ID NO: 358242

SEQ ID NO: 405560 - RNA, 64 nt, Human; identical to SEQ ID NO: 358243

SEQ ID NO: 405561 - RNA, 64 nt, Human; identical to SEQ ID NO: 358244

SEQ ID NO: 405562 - RNA, 64 nt, Human; identical to SEQ ID NO: 358245

SEQ ID NO: 405563 - RNA, 64 nt, Human; identical to SEQ ID NO: 358246

SEQ ID NO: 405564 - RNA, 64 nt, Human; identical to SEQ ID NO: 358253

SEQ ID NO: 405565 - RNA, 64 nt, Human; identical to SEQ ID NO: 358254

SEQ ID NO: 405566 - RNA, 64 nt, Human; identical to SEQ ID NO: 358255

SEQ ID NO: 405567 - RNA, 64 nt, Human; identical to SEQ ID NO: 358256

SEQ ID NO: 405568 - RNA, 64 nt, Human; identical to SEQ ID NO: 358257

SEQ ID NO: 405569 - RNA, 64 nt, Human; identical to SEQ ID NO: 358258

SEQ ID NO: 405570 - RNA, 64 nt, Human; identical to SEQ ID NO: 358259

SEQ ID NO: 405571 - RNA, 64 nt, Human; identical to SEQ ID NO: 358260

SEQ ID NO: 405572 - RNA, 64 nt, Human; identical to SEQ ID NO: 358261

SEQ ID NO: 405573 - RNA, 64 nt, Human; identical to SEQ ID NO: 358262

SEQ ID NO: 405574 - RNA, 64 nt, Human; identical to SEQ ID NO: 358263

SEQ ID NO: 405575 - RNA, 64 nt, Human; identical to SEQ ID NO: 358264

SEQ ID NO: 405576 - RNA, 64 nt, Human; identical to SEQ ID NO: 358265

SEQ ID NO: 405577 - RNA, 64 nt, Human; identical to SEQ ID NO: 358266

SEQ ID NO: 405578 - RNA, 64 nt, Human; identical to SEQ ID NO: 358267

SEQ ID NO: 405579 - RNA, 64 nt, Human; identical to SEQ ID NO: 358268

SEQ ID NO: 405580 - RNA, 64 nt, Human; identical to SEQ ID NO: 358269

SEQ ID NO: 405581 - RNA, 64 nt, Human
uuuguaccccaggccccuauacucuuccuuccuauguccacagcugaccccaagcagccguucc

SEQ ID NO: 405582 - RNA, 64 nt, Human
auuaauauauaauacuuuaaauuuuaaaaauucuuguccacaaggaaauuugucuggguuauug

SEQ ID NO: 405583 - RNA, 64 nt, Human
cucagcuuguccaguauuucccuucguuccucaguguccacauugaggccuauacagaaaauca

SEQ ID NO: 405584 - RNA, 64 nt, Human; identical to SEQ ID NO: 358270

SEQ ID NO: 405585 - RNA, 64 nt, Human; identical to SEQ ID NO: 358271

SEQ ID NO: 405586 - RNA, 64 nt, Human; identical to SEQ ID NO: 358272

SEQ ID NO: 405587 - RNA, 64 nt, Human; identical to SEQ ID NO: 358273

SEQ ID NO: 405588 - RNA, 64 nt, Human; identical to SEQ ID NO: 358274

SEQ ID NO: 405589 - RNA, 64 nt, Human; identical to SEQ ID NO: 358275

SEQ ID NO: 405590 - RNA, 64 nt, Human; identical to SEQ ID NO: 358276

SEQ ID NO: 405591 - RNA, 64 nt, Human; identical to SEQ ID NO: 358277

SEQ ID NO: 405592 - RNA, 64 nt, Human; identical to SEQ ID NO: 358278

SEQ ID NO: 405593 - RNA, 64 nt, Human; identical to SEQ ID NO: 358279

SEQ ID NO: 405594 - RNA, 64 nt, Human; identical to SEQ ID NO: 358280

SEQ ID NO: 405595 - RNA, 64 nt, Human; identical to SEQ ID NO: 358281

SEQ ID NO: 405596 - RNA, 64 nt, Human; identical to SEQ ID NO: 358282

SEQ ID NO: 405597 - RNA, 64 nt, Human; identical to SEQ ID NO: 358283

SEQ ID NO: 405598 - RNA, 64 nt, Human; identical to SEQ ID NO: 358284

SEQ ID NO: 405599 - RNA, 64 nt, Human; identical to SEQ ID NO: 358285

SEQ ID NO: 405600 - RNA, 64 nt, Human; identical to SEQ ID NO: 358286

SEQ ID NO: 405601 - RNA, 64 nt, Human; identical to SEQ ID NO: 358287

SEQ ID NO: 405602 - RNA, 64 nt, Human; identical to SEQ ID NO: 358288

SEQ ID NO: 405603 - RNA, 64 nt, Human
ucugccuguuuaaaaagucauuuuaaagguagaguguccacaucaggcaccauuugugauauga

SEQ ID NO: 405604 - RNA, 64 nt, Human; identical to SEQ ID NO: 358289

SEQ ID NO: 405605 - RNA, 64 nt, Human; identical to SEQ ID NO: 358290

SEQ ID NO: 405606 - RNA, 64 nt, Human; identical to SEQ ID NO: 358291

SEQ ID NO: 405607 - RNA, 62 nt, Human; identical to SEQ ID NO: 358292

SEQ ID NO: 405608 - RNA, 64 nt, Human; identical to SEQ ID NO: 358293

SEQ ID NO: 405609 - RNA, 64 nt, Human; identical to SEQ ID NO: 358294

SEQ ID NO: 405610 - RNA, 64 nt, Human; identical to SEQ ID NO: 358295

SEQ ID NO: 405611 - RNA, 64 nt, Human; identical to SEQ ID NO: 358296

SEQ ID NO: 405612 - RNA, 64 nt, Human; identical to SEQ ID NO: 358297

SEQ ID NO: 405613 - RNA, 64 nt, Human; identical to SEQ ID NO: 358298

SEQ ID NO: 405614 - RNA, 64 nt, Human; identical to SEQ ID NO: 358299

SEQ ID NO: 405615 - RNA, 64 nt, Human; identical to SEQ ID NO: 358300

SEQ ID NO: 405616 - RNA, 64 nt, Human; identical to SEQ ID NO: 358301

SEQ ID NO: 405617 - RNA, 64 nt, Human; identical to SEQ ID NO: 358302

SEQ ID NO: 405618 - RNA, 64 nt, Human; identical to SEQ ID NO: 358303

SEQ ID NO: 405619 - RNA, 64 nt, Human; identical to SEQ ID NO: 358304

SEQ ID NO: 405620 - RNA, 64 nt, Human; identical to SEQ ID NO: 358305

SEQ ID NO: 405621 - RNA, 55 nt, Human; identical to SEQ ID NO: 358306

SEQ ID NO: 405622 - RNA, 64 nt, Human; identical to SEQ ID NO: 358307

SEQ ID NO: 405623 - RNA, 64 nt, Human; identical to SEQ ID NO: 358308

SEQ ID NO: 405624 - RNA, 64 nt, Human; identical to SEQ ID NO: 358309

SEQ ID NO: 405625 - RNA, 64 nt, Human; identical to SEQ ID NO: 358310

SEQ ID NO: 405626 - RNA, 64 nt, Human; identical to SEQ ID NO: 358311

SEQ ID NO: 405627 - RNA, 64 nt, Human; identical to SEQ ID NO: 358312

SEQ ID NO: 405628 - RNA, 64 nt, Human; identical to SEQ ID NO: 358313

SEQ ID NO: 405629 - RNA, 64 nt, Human; identical to SEQ ID NO: 358314

SEQ ID NO: 405630 - RNA, 64 nt, Human; identical to SEQ ID NO: 358315

SEQ ID NO: 405631 - RNA, 64 nt, Human; identical to SEQ ID NO: 358316

SEQ ID NO: 405632 - RNA, 64 nt, Human; identical to SEQ ID NO: 358317

SEQ ID NO: 405633 - RNA, 64 nt, Human; identical to SEQ ID NO: 358318

SEQ ID NO: 405634 - RNA, 64 nt, Human; identical to SEQ ID NO: 358319

SEQ ID NO: 405635 - RNA, 64 nt, Human; identical to SEQ ID NO: 358320

SEQ ID NO: 405636 - RNA, 64 nt, Human; identical to SEQ ID NO: 358321

SEQ ID NO: 405637 - RNA, 64 nt, Human; identical to SEQ ID NO: 358322

SEQ ID NO: 405638 - RNA, 64 nt, Human; identical to SEQ ID NO: 358323

SEQ ID NO: 405639 - RNA, 64 nt, Human; identical to SEQ ID NO: 358324

SEQ ID NO: 405640 - RNA, 64 nt, Human; identical to SEQ ID NO: 358325

SEQ ID NO: 405641 - RNA, 64 nt, Human; identical to SEQ ID NO: 358326

SEQ ID NO: 405642 - RNA, 64 nt, Human; identical to SEQ ID NO: 358327

SEQ ID NO: 405643 - RNA, 64 nt, Human; identical to SEQ ID NO: 358328

SEQ ID NO: 405644 - RNA, 64 nt, Human; identical to SEQ ID NO: 358331

SEQ ID NO: 405645 - RNA, 64 nt, Human; identical to SEQ ID NO: 358332

SEQ ID NO: 405646 - RNA, 64 nt, Human; identical to SEQ ID NO: 358333

SEQ ID NO: 405647 - RNA, 64 nt, Human; identical to SEQ ID NO: 358334

SEQ ID NO: 405648 - RNA, 64 nt, Human; identical to SEQ ID NO: 358335

SEQ ID NO: 405649 - RNA, 64 nt, Human; identical to SEQ ID NO: 358336

SEQ ID NO: 405650 - RNA, 64 nt, Human; identical to SEQ ID NO: 358337

SEQ ID NO: 405651 - RNA, 64 nt, Human; identical to SEQ ID NO: 358338

SEQ ID NO: 405652 - RNA, 64 nt, Human; identical to SEQ ID NO: 358339

SEQ ID NO: 405653 - RNA, 64 nt, Human; identical to SEQ ID NO: 358340

SEQ ID NO: 405654 - RNA, 64 nt, Human; identical to SEQ ID NO: 358341

SEQ ID NO: 405655 - RNA, 53 nt, Human; identical to SEQ ID NO: 358342

SEQ ID NO: 405656 - RNA, 64 nt, Human; identical to SEQ ID NO: 358343

SEQ ID NO: 405657 - RNA, 64 nt, Human; identical to SEQ ID NO: 358344

SEQ ID NO: 405658 - RNA, 64 nt, Human; identical to SEQ ID NO: 358345

SEQ ID NO: 405659 - RNA, 64 nt, Human; identical to SEQ ID NO: 358346

SEQ ID NO: 405660 - RNA, 64 nt, Human; identical to SEQ ID NO: 358346

SEQ ID NO: 405661 - RNA, 61 nt, Human
caguguuuacuuuaccuagauggcuuauauaauccaguaagagaugcaaagauaaaauugc

SEQ ID NO: 405662 - RNA, 61 nt, Human
uucaaaugaccacuccauaauauaacauuucauccaguaaacuggccucuacuaucuuuaa

SEQ ID NO: 405663 - RNA, 61 nt, Human
cagaaauucuauaacugaucauagaagaagaauccaguaauugaacaaauccuauuuaaug

SEQ ID NO: 405664 - RNA, 64 nt, Human; identical to SEQ ID NO: 358040

SEQ ID NO: 405665 - RNA, 64 nt, Human; identical to SEQ ID NO: 358041

SEQ ID NO: 405666 - RNA, 64 nt, Human; identical to SEQ ID NO: 358042

SEQ ID NO: 405667 - RNA, 64 nt, Human; identical to SEQ ID NO: 358043

SEQ ID NO: 405668 - RNA, 64 nt, Human; identical to SEQ ID NO: 358044

SEQ ID NO: 405669 - RNA, 64 nt, Human; identical to SEQ ID NO: 358045

SEQ ID NO: 405670 - RNA, 64 nt, Human; identical to SEQ ID NO: 358046

SEQ ID NO: 405671 - RNA, 64 nt, Human; identical to SEQ ID NO: 358047

SEQ ID NO: 405672 - RNA, 64 nt, Human; identical to SEQ ID NO: 358048

SEQ ID NO: 405673 - RNA, 64 nt, Human; identical to SEQ ID NO: 358049

SEQ ID NO: 405674 - RNA, 64 nt, Human; identical to SEQ ID NO: 358050

SEQ ID NO: 405675 - RNA, 64 nt, Human; identical to SEQ ID NO: 358051

SEQ ID NO: 405676 - RNA, 64 nt, Human; identical to SEQ ID NO: 358052

SEQ ID NO: 405677 - RNA, 64 nt, Human; identical to SEQ ID NO: 358053

SEQ ID NO: 405678 - RNA, 64 nt, Human; identical to SEQ ID NO: 358054

SEQ ID NO: 405679 - RNA, 61 nt, Human
ucuucacuugcugagaaagucagaggaggggauccaguagcccuuuccacauacuguggcu

SEQ ID NO: 405680 - RNA, 61 nt, Human
ugcucccagcacccuggagccacuguccacgauccaguacaacgugguggauggccugagg

SEQ ID NO: 405681 - RNA, 61 nt, Human
uuggccuuucaggagccggaccuacaacaugauccaguacuaucagaaugacauccccuac

SEQ ID NO: 405682 - RNA, 64 nt, Human; identical to SEQ ID NO: 358055

SEQ ID NO: 405683 - RNA, 64 nt, Human; identical to SEQ ID NO: 358056

SEQ ID NO: 405684 - RNA, 64 nt, Human; identical to SEQ ID NO: 358057

SEQ ID NO: 405685 - RNA, 64 nt, Human; identical to SEQ ID NO: 358058

SEQ ID NO: 405686 - RNA, 64 nt, Human; identical to SEQ ID NO: 358059

SEQ ID NO: 405687 - RNA, 64 nt, Human; identical to SEQ ID NO: 358060

SEQ ID NO: 405688 - RNA, 64 nt, Human; identical to SEQ ID NO: 358061

SEQ ID NO: 405689 - RNA, 64 nt, Human; identical to SEQ ID NO: 358062

SEQ ID NO: 405690 - RNA, 64 nt, Human; identical to SEQ ID NO: 358063

SEQ ID NO: 405691 - RNA, 64 nt, Human; identical to SEQ ID NO: 358064

SEQ ID NO: 405692 - RNA, 64 nt, Human; identical to SEQ ID NO: 358065

SEQ ID NO: 405693 - RNA, 64 nt, Human; identical to SEQ ID NO: 358066

SEQ ID NO: 405694 - RNA, 64 nt, Human; identical to SEQ ID NO: 358067

SEQ ID NO: 405695 - RNA, 64 nt, Human; identical to SEQ ID NO: 358068

SEQ ID NO: 405696 - RNA, 64 nt, Human; identical to SEQ ID NO: 358069

SEQ ID NO: 405697 - RNA, 64 nt, Human; identical to SEQ ID NO: 358070

SEQ ID NO: 405698 - RNA, 61 nt, Human
aguccucuuuccuugucccaggauggagcugauccaguaaccucggagacgggacccugcc

SEQ ID NO: 405699 - RNA, 61 nt, Human
gccuuuugugggucguaaauuauuucuacuuauccaguaaauaacaaugacaaaauaaaca

SEQ ID NO: 405700 - RNA, 61 nt, Human
aguugaauagaaugggagggauguuuaguauauccaguaugauugguaaaugggaaauaua

SEQ ID NO: 405701 - RNA, 64 nt, Human; identical to SEQ ID NO: 358071

SEQ ID NO: 405702 - RNA, 64 nt, Human; identical to SEQ ID NO: 358072

SEQ ID NO: 405703 - RNA, 64 nt, Human; identical to SEQ ID NO: 358073

SEQ ID NO: 405704 - RNA, 64 nt, Human; identical to SEQ ID NO: 358074

SEQ ID NO: 405705 - RNA, 64 nt, Human; identical to SEQ ID NO: 358075

SEQ ID NO: 405706 - RNA, 64 nt, Human; identical to SEQ ID NO: 358076

SEQ ID NO: 405707 - RNA, 64 nt, Human; identical to SEQ ID NO: 358077

SEQ ID NO: 405708 - RNA, 64 nt, Human; identical to SEQ ID NO: 358078

SEQ ID NO: 405709 - RNA, 64 nt, Human; identical to SEQ ID NO: 358079

SEQ ID NO: 405710 - RNA, 64 nt, Human; identical to SEQ ID NO: 358080

SEQ ID NO: 405711 - RNA, 64 nt, Human; identical to SEQ ID NO: 358081

SEQ ID NO: 405712 - RNA, 64 nt, Human; identical to SEQ ID NO: 358082

SEQ ID NO: 405713 - RNA, 64 nt, Human; identical to SEQ ID NO: 358083

SEQ ID NO: 405714 - RNA, 52 nt, Human; identical to SEQ ID NO: 358084

SEQ ID NO: 405715 - RNA, 64 nt, Human; identical to SEQ ID NO: 358085

SEQ ID NO: 405716 - RNA, 64 nt, Human; identical to SEQ ID NO: 358086

SEQ ID NO: 405717 - RNA, 64 nt, Human
ggcaaaucacaacauggggaauuuuauucauaaauguccacagaaacaguaaauguucucgcuu

SEQ ID NO: 405718 - RNA, 64 nt, Human
guggaccccucaacuuccugcugcucagcuacuuuguccacauuggauuugguccaaacaugua

SEQ ID NO: 405719 - RNA, 64 nt, Human
ugaaugccagcuuucagacagagcccacuuagcuuguccacauggaucucaaugccaauccucc

SEQ ID NO: 405720 - RNA, 64 nt, Human; identical to SEQ ID NO: 358087

SEQ ID NO: 405721 - RNA, 64 nt, Human; identical to SEQ ID NO: 358088

SEQ ID NO: 405722 - RNA, 64 nt, Human; identical to SEQ ID NO: 358089

SEQ ID NO: 405723 - RNA, 64 nt, Human; identical to SEQ ID NO: 358090

SEQ ID NO: 405724 - RNA, 64 nt, Human; identical to SEQ ID NO: 358091

SEQ ID NO: 405725 - RNA, 64 nt, Human; identical to SEQ ID NO: 358092

SEQ ID NO: 405726 - RNA, 64 nt, Human; identical to SEQ ID NO: 358093

SEQ ID NO: 405727 - RNA, 64 nt, Human; identical to SEQ ID NO: 358094

SEQ ID NO: 405728 - RNA, 64 nt, Human; identical to SEQ ID NO: 358095

SEQ ID NO: 405729 - RNA, 64 nt, Human; identical to SEQ ID NO: 358096

SEQ ID NO: 405730 - RNA, 64 nt, Human; identical to SEQ ID NO: 358097

SEQ ID NO: 405731 - RNA, 64 nt, Human; identical to SEQ ID NO: 358098

SEQ ID NO: 405732 - RNA, 64 nt, Human; identical to SEQ ID NO: 358099

SEQ ID NO: 405733 - RNA, 64 nt, Human; identical to SEQ ID NO: 358100

SEQ ID NO: 405734 - RNA, 64 nt, Human; identical to SEQ ID NO: 358101

SEQ ID NO: 405735 - RNA, 64 nt, Human; identical to SEQ ID NO: 358102

SEQ ID NO: 405736 - RNA, 61 nt, Human
ugaauauuauuagacaguaauuuugcuuuccauccaguaugcuaguucuuauucgagaacu

SEQ ID NO: 405737 - RNA, 61 nt, Human
agguuucagugaacccuuaccuauauucagcauccaguagugggaaaacuggggugggggu

SEQ ID NO: 405738 - RNA, 61 nt, Human
cuuagaucagugucugcucuuuucacuugauauccaguacuauguaagauagaaggugcau

SEQ ID NO: 405739 - RNA, 64 nt, Human; identical to SEQ ID NO: 358103

SEQ ID NO: 405740 - RNA, 64 nt, Human; identical to SEQ ID NO: 358104

SEQ ID NO: 405741 - RNA, 64 nt, Human; identical to SEQ ID NO: 358105

SEQ ID NO: 405742 - RNA, 64 nt, Human; identical to SEQ ID NO: 358106

SEQ ID NO: 405743 - RNA, 64 nt, Human; identical to SEQ ID NO: 358107

SEQ ID NO: 405744 - RNA, 64 nt, Human; identical to SEQ ID NO: 358108

SEQ ID NO: 405745 - RNA, 64 nt, Human; identical to SEQ ID NO: 358109

SEQ ID NO: 405746 - RNA, 64 nt, Human; identical to SEQ ID NO: 358110

SEQ ID NO: 405747 - RNA, 64 nt, Human; identical to SEQ ID NO: 358111

SEQ ID NO: 405748 - RNA, 64 nt, Human; identical to SEQ ID NO: 358112

SEQ ID NO: 405749 - RNA, 64 nt, Human; identical to SEQ ID NO: 358113

SEQ ID NO: 405750 - RNA, 64 nt, Human; identical to SEQ ID NO: 358114

SEQ ID NO: 405751 - RNA, 64 nt, Human; identical to SEQ ID NO: 358115

SEQ ID NO: 405752 - RNA, 64 nt, Human; identical to SEQ ID NO: 358116

SEQ ID NO: 405753 - RNA, 64 nt, Human; identical to SEQ ID NO: 358117

SEQ ID NO: 405754 - RNA, 64 nt, Human; identical to SEQ ID NO: 358118

SEQ ID NO: 405755 - RNA, 61 nt, Human
guacaucuagauguguuuacagaaagcaaguauccaguaugacuggcauguguucaugcua

SEQ ID NO: 405756 - RNA, 64 nt, Human
cagaugaacugacuuuaguuuucaucuuauuuuuuguccacaugcuggugaugcugagaaacaa

SEQ ID NO: 405757 - RNA, 64 nt, Human
ugucaauauaaaaauugguaaacuagaaguaacuuguccacaacccucaguuaugauacuuaug

SEQ ID NO: 405758 - RNA, 64 nt, Human; identical to SEQ ID NO: 358119

SEQ ID NO: 405759 - RNA, 64 nt, Human; identical to SEQ ID NO: 358120

SEQ ID NO: 405760 - RNA, 64 nt, Human; identical to SEQ ID NO: 358121

SEQ ID NO: 405761 - RNA, 64 nt, Human; identical to SEQ ID NO: 358122

SEQ ID NO: 405762 - RNA, 64 nt, Human; identical to SEQ ID NO: 358123

SEQ ID NO: 405763 - RNA, 64 nt, Human; identical to SEQ ID NO: 358124

SEQ ID NO: 405764 - RNA, 64 nt, Human; identical to SEQ ID NO: 358125

SEQ ID NO: 405765 - RNA, 64 nt, Human; identical to SEQ ID NO: 358126

SEQ ID NO: 405766 - RNA, 64 nt, Human; identical to SEQ ID NO: 358127

SEQ ID NO: 405767 - RNA, 64 nt, Human; identical to SEQ ID NO: 358128

SEQ ID NO: 405768 - RNA, 64 nt, Human; identical to SEQ ID NO: 358129

SEQ ID NO: 405769 - RNA, 64 nt, Human; identical to SEQ ID NO: 358130

SEQ ID NO: 405770 - RNA, 64 nt, Human; identical to SEQ ID NO: 358131

SEQ ID NO: 405771 - RNA, 64 nt, Human; identical to SEQ ID NO: 358132

SEQ ID NO: 405772 - RNA, 64 nt, Human; identical to SEQ ID NO: 358133

SEQ ID NO: 405773 - RNA, 64 nt, Human; identical to SEQ ID NO: 358134

SEQ ID NO: 405774 - RNA, 64 nt, Human
uuaucuuuugaaugucuuuugaggcugugaaagcuguccacauuuuugcuguguauuaaauagc

SEQ ID NO: 405775 - RNA, 64 nt, Human
guacacugcuuagaaauuauagacuauuaugaucuguccacagugcccauugucacuucuuugu

SEQ ID NO: 405776 - RNA, 64 nt, Human
uccagggcugcaggucauuagccagaauaaaggauguccacauucacaaucugugggccugcca

SEQ ID NO: 405777 - RNA, 64 nt, Human; identical to SEQ ID NO: 358135

SEQ ID NO: 405778 - RNA, 64 nt, Human; identical to SEQ ID NO: 358136

SEQ ID NO: 405779 - RNA, 64 nt, Human; identical to SEQ ID NO: 358137

SEQ ID NO: 405780 - RNA, 57 nt, Human; identical to SEQ ID NO: 358138

SEQ ID NO: 405781 - RNA, 64 nt, Human; identical to SEQ ID NO: 358139

SEQ ID NO: 405782 - RNA, 64 nt, Human; identical to SEQ ID NO: 358140

SEQ ID NO: 405783 - RNA, 64 nt, Human; identical to SEQ ID NO: 358141

SEQ ID NO: 405784 - RNA, 64 nt, Human; identical to SEQ ID NO: 358142

SEQ ID NO: 405785 - RNA, 64 nt, Human; identical to SEQ ID NO: 358143

SEQ ID NO: 405786 - RNA, 64 nt, Human; identical to SEQ ID NO: 358144

SEQ ID NO: 405787 - RNA, 64 nt, Human; identical to SEQ ID NO: 358145

SEQ ID NO: 405788 - RNA, 64 nt, Human; identical to SEQ ID NO: 358146

SEQ ID NO: 405789 - RNA, 64 nt, Human; identical to SEQ ID NO: 358147

SEQ ID NO: 405790 - RNA, 64 nt, Human; identical to SEQ ID NO: 358148

SEQ ID NO: 405791 - RNA, 64 nt, Human; identical to SEQ ID NO: 358149

SEQ ID NO: 405792 - RNA, 64 nt, Human; identical to SEQ ID NO: 358150

SEQ ID NO: 405793 - RNA, 64 nt, Human
caaaucacaaggauuucucuaacccuauccuaauuguccacauacguggaaacaauccuguuac

SEQ ID NO: 405794 - RNA, 64 nt, Human
cugggugaaaggaaaggggccggggacaggaggguguccacauauguuaacaucaguuggaucu

SEQ ID NO: 405795 - RNA, 64 nt, Human
acuuuuguauguguauauuuuuauagcugcagauuguccacacaguauacuuuuggaaguuugg

SEQ ID NO: 405796 - RNA, 64 nt, Human; identical to SEQ ID NO: 358151

SEQ ID NO: 405797 - RNA, 64 nt, Human; identical to SEQ ID NO: 358152

SEQ ID NO: 405798 - RNA, 64 nt, Human; identical to SEQ ID NO: 358153

SEQ ID NO: 405799 - RNA, 64 nt, Human; identical to SEQ ID NO: 358154

SEQ ID NO: 405800 - RNA, 64 nt, Human; identical to SEQ ID NO: 358155

SEQ ID NO: 405801 - RNA, 64 nt, Human; identical to SEQ ID NO: 358156

SEQ ID NO: 405802 - RNA, 64 nt, Human; identical to SEQ ID NO: 358157

SEQ ID NO: 405803 - RNA, 64 nt, Human; identical to SEQ ID NO: 358158

SEQ ID NO: 405804 - RNA, 64 nt, Human; identical to SEQ ID NO: 358159

SEQ ID NO: 405805 - RNA, 64 nt, Human; identical to SEQ ID NO: 358160

SEQ ID NO: 405806 - RNA, 64 nt, Human; identical to SEQ ID NO: 358161

SEQ ID NO: 405807 - RNA, 64 nt, Human; identical to SEQ ID NO: 358162

SEQ ID NO: 405808 - RNA, 64 nt, Human; identical to SEQ ID NO: 358163

SEQ ID NO: 405809 - RNA, 64 nt, Human; identical to SEQ ID NO: 358164

SEQ ID NO: 405810 - RNA, 64 nt, Human; identical to SEQ ID NO: 358165

SEQ ID NO: 405811 - RNA, 64 nt, Human; identical to SEQ ID NO: 358166

SEQ ID NO: 405812 - RNA, 61 nt, Human
ugcucgggccagguaaaugcuauuggauguaauccaguaguguguaauauaaauucaaacc

SEQ ID NO: 405813 - RNA, 61 nt, Human
cuagcugugccuucauuaguuugcuauagaaauccaguacuuauaguaaauaaaacagugu

SEQ ID NO: 405814 - RNA, 64 nt, Human
acaggaauauauuuuuuaaacgaagagacagaacuguccacaucugccuccucuccuccucagc

SEQ ID NO: 405815 - RNA, 64 nt, Human; identical to SEQ ID NO: 358167

SEQ ID NO: 405816 - RNA, 64 nt, Human; identical to SEQ ID NO: 358168

SEQ ID NO: 405817 - RNA, 64 nt, Human; identical to SEQ ID NO: 358169

SEQ ID NO: 405818 - RNA, 64 nt, Human; identical to SEQ ID NO: 358170

SEQ ID NO: 405819 - RNA, 64 nt, Human; identical to SEQ ID NO: 358171

SEQ ID NO: 405820 - RNA, 64 nt, Human; identical to SEQ ID NO: 358172

SEQ ID NO: 405821 - RNA, 64 nt, Human; identical to SEQ ID NO: 358173

SEQ ID NO: 405822 - RNA, 64 nt, Human; identical to SEQ ID NO: 358174

SEQ ID NO: 405823 - RNA, 64 nt, Human; identical to SEQ ID NO: 358175

SEQ ID NO: 405824 - RNA, 63 nt, Human; identical to SEQ ID NO: 358176

SEQ ID NO: 405825 - RNA, 64 nt, Human; identical to SEQ ID NO: 358177

SEQ ID NO: 405826 - RNA, 64 nt, Human; identical to SEQ ID NO: 358178

SEQ ID NO: 405827 - RNA, 64 nt, Human; identical to SEQ ID NO: 358179

SEQ ID NO: 405828 - RNA, 64 nt, Human; identical to SEQ ID NO: 358180

SEQ ID NO: 405829 - RNA, 64 nt, Human; identical to SEQ ID NO: 358181

SEQ ID NO: 405830 - RNA, 64 nt, Human; identical to SEQ ID NO: 358182

SEQ ID NO: 405831 - RNA, 64 nt, Human
aaucuaaaggcauugucauguggccugccuuuccuguccacauccccaccucugaugcucaaga

SEQ ID NO: 405832 - RNA, 64 nt, Human
gccaccuugccuuugccaaccaccucugcuugccuguccacauuuaaaaauaaaaucauuuuag

SEQ ID NO: 405833 - RNA, 64 nt, Human
gguuuaaaaccaacaaugaugccuagugaguauguguccacaggccauaacaggguagaagaga

SEQ ID NO: 405834 - RNA, 64 nt, Human; identical to SEQ ID NO: 358183

SEQ ID NO: 405835 - RNA, 64 nt, Human; identical to SEQ ID NO: 358184

SEQ ID NO: 405836 - RNA, 64 nt, Human; identical to SEQ ID NO: 358185

SEQ ID NO: 405837 - RNA, 64 nt, Human; identical to SEQ ID NO: 358186

SEQ ID NO: 405838 - RNA, 64 nt, Human; identical to SEQ ID NO: 358187

SEQ ID NO: 405839 - RNA, 64 nt, Human; identical to SEQ ID NO: 358188

SEQ ID NO: 405840 - RNA, 64 nt, Human; identical to SEQ ID NO: 358189

SEQ ID NO: 405841 - RNA, 64 nt, Human; identical to SEQ ID NO: 358190

SEQ ID NO: 405842 - RNA, 64 nt, Human; identical to SEQ ID NO: 358191

SEQ ID NO: 405843 - RNA, 64 nt, Human; identical to SEQ ID NO: 358192

SEQ ID NO: 405844 - RNA, 64 nt, Human; identical to SEQ ID NO: 358193

SEQ ID NO: 405845 - RNA, 64 nt, Human; identical to SEQ ID NO: 358194

SEQ ID NO: 405846 - RNA, 64 nt, Human; identical to SEQ ID NO: 358195

SEQ ID NO: 405847 - RNA, 64 nt, Human; identical to SEQ ID NO: 358196

SEQ ID NO: 405848 - RNA, 64 nt, Human; identical to SEQ ID NO: 358197

SEQ ID NO: 405849 - RNA, 64 nt, Human; identical to SEQ ID NO: 358198

SEQ ID NO: 405850 - RNA, 61 nt, Human
ucggcacugacaaaguacaaauaauccaccuauccaguagaggcagcacugaucuggcuga

SEQ ID NO: 405851 - RNA, 61 nt, Human
ggugaugcgcucaccuucugcugggaaguuaauccaguacauuguagaagauggaggucau

SEQ ID NO: 405852 - RNA, 64 nt, Human
cuacuguagcuacggaaccagauucuggugaauuuguccacaaucagccauuggccugucuggg

SEQ ID NO: 405853 - RNA, 64 nt, Human; identical to SEQ ID NO: 358199

SEQ ID NO: 405854 - RNA, 64 nt, Human; identical to SEQ ID NO: 358200

SEQ ID NO: 405855 - RNA, 64 nt, Human; identical to SEQ ID NO: 358201

SEQ ID NO: 405856 - RNA, 64 nt, Human; identical to SEQ ID NO: 358202

SEQ ID NO: 405857 - RNA, 64 nt, Human; identical to SEQ ID NO: 358203

SEQ ID NO: 405858 - RNA, 64 nt, Human; identical to SEQ ID NO: 358204

SEQ ID NO: 405859 - RNA, 64 nt, Human; identical to SEQ ID NO: 358205

SEQ ID NO: 405860 - RNA, 64 nt, Human; identical to SEQ ID NO: 358206

SEQ ID NO: 405861 - RNA, 64 nt, Human; identical to SEQ ID NO: 358207

SEQ ID NO: 405862 - RNA, 64 nt, Human; identical to SEQ ID NO: 358208

SEQ ID NO: 405863 - RNA, 64 nt, Human; identical to SEQ ID NO: 358209

SEQ ID NO: 405864 - RNA, 64 nt, Human; identical to SEQ ID NO: 358210

SEQ ID NO: 405865 - RNA, 64 nt, Human; identical to SEQ ID NO: 358211

SEQ ID NO: 405866 - RNA, 64 nt, Human; identical to SEQ ID NO: 358212

SEQ ID NO: 405867 - RNA, 64 nt, Human; identical to SEQ ID NO: 358213

SEQ ID NO: 405868 - RNA, 64 nt, Human; identical to SEQ ID NO: 358214

SEQ ID NO: 405869 - RNA, 64 nt, Human
aagccucucgucccgucccucccuuuccuccgccuguccacagccccuuaagggaaagguagga

SEQ ID NO: 405870 - RNA, 64 nt, Human
gacgcguauguaauaaaggacgcccucccuccaguguccacauccaguucaccccagagggucg

SEQ ID NO: 405871 - RNA, 64 nt, Human
cuuggggugggggagaggggagacagggcaaucuuguccacagucucccauucucauauguagc

SEQ ID NO: 405872 - RNA, 64 nt, Human; identical to SEQ ID NO: 358215

SEQ ID NO: 405873 - RNA, 64 nt, Human; identical to SEQ ID NO: 358216

SEQ ID NO: 405874 - RNA, 64 nt, Human; identical to SEQ ID NO: 358217

SEQ ID NO: 405875 - RNA, 64 nt, Human; identical to SEQ ID NO: 358218

SEQ ID NO: 405876 - RNA, 64 nt, Human; identical to SEQ ID NO: 358219

SEQ ID NO: 405877 - RNA, 64 nt, Human; identical to SEQ ID NO: 358220

SEQ ID NO: 405878 - RNA, 64 nt, Human; identical to SEQ ID NO: 358221

SEQ ID NO: 405879 - RNA, 64 nt, Human; identical to SEQ ID NO: 358222

SEQ ID NO: 405880 - RNA, 64 nt, Human; identical to SEQ ID NO: 358223

SEQ ID NO: 405881 - RNA, 64 nt, Human; identical to SEQ ID NO: 358224

SEQ ID NO: 405882 - RNA, 64 nt, Human; identical to SEQ ID NO: 358225

SEQ ID NO: 405883 - RNA, 64 nt, Human; identical to SEQ ID NO: 358226

SEQ ID NO: 405884 - RNA, 64 nt, Human; identical to SEQ ID NO: 358227

SEQ ID NO: 405885 - RNA, 64 nt, Human; identical to SEQ ID NO: 358228

SEQ ID NO: 405886 - RNA, 64 nt, Human; identical to SEQ ID NO: 358229

SEQ ID NO: 405887 - RNA, 64 nt, Human; identical to SEQ ID NO: 358230

SEQ ID NO: 405888 - RNA, 61 nt, Human
ccauaccagcuuuuaaugguggaccuauagaauccaguacuuuuaauggugggaauuuaca

SEQ ID NO: 405889 - RNA, 61 nt, Human
caguauguggccuuuuuugauguuauguuuuauccaguagcuuuacuaagguauaauugau

SEQ ID NO: 405890 - RNA, 61 nt, Human
auuuuuagucuaaugcauguuuucauccacuauccaguacugauuauuaaaaugacaugua

SEQ ID NO: 405891 - RNA, 64 nt, Human; identical to SEQ ID NO: 358231

SEQ ID NO: 405892 - RNA, 64 nt, Human; identical to SEQ ID NO: 358232

SEQ ID NO: 405893 - RNA, 64 nt, Human; identical to SEQ ID NO: 358233

SEQ ID NO: 405894 - RNA, 64 nt, Human; identical to SEQ ID NO: 358234

SEQ ID NO: 405895 - RNA, 51 nt, Human; identical to SEQ ID NO: 358235

SEQ ID NO: 405896 - RNA, 64 nt, Human; identical to SEQ ID NO: 358236

SEQ ID NO: 405897 - RNA, 64 nt, Human; identical to SEQ ID NO: 358237

SEQ ID NO: 405898 - RNA, 64 nt, Human; identical to SEQ ID NO: 358238

SEQ ID NO: 405899 - RNA, 64 nt, Human; identical to SEQ ID NO: 358239

SEQ ID NO: 405900 - RNA, 64 nt, Human; identical to SEQ ID NO: 358240

SEQ ID NO: 405901 - RNA, 64 nt, Human; identical to SEQ ID NO: 358241

SEQ ID NO: 405902 - RNA, 64 nt, Human; identical to SEQ ID NO: 358242

SEQ ID NO: 405903 - RNA, 64 nt, Human; identical to SEQ ID NO: 358243

SEQ ID NO: 405904 - RNA, 64 nt, Human; identical to SEQ ID NO: 358244

SEQ ID NO: 405905 - RNA, 64 nt, Human; identical to SEQ ID NO: 358245

SEQ ID NO: 405906 - RNA, 64 nt, Human; identical to SEQ ID NO: 358246

SEQ ID NO: 405907 - RNA, 61 nt, Human
gacaucacuuuaaacuuggugaugaguuuaaauccaguagcuaaucccuuccugagacuca

SEQ ID NO: 405908 - RNA, 61 nt, Human
ccuucaaaauuauaaaagcacuaacucuuugauccaguaguuuccacuucuaggaacuuaa

SEQ ID NO: 405909 - RNA, 61 nt, Human
uugaaccaugaaauuucaucuuuuaaauaacauccaguacagauuucuguguaagcuuuuu

SEQ ID NO: 405910 - RNA, 64 nt, Human; identical to SEQ ID NO: 358247

SEQ ID NO: 405911 - RNA, 64 nt, Human; identical to SEQ ID NO: 358248

SEQ ID NO: 405912 - RNA, 64 nt, Human; identical to SEQ ID NO: 358249

SEQ ID NO: 405913 - RNA, 64 nt, Human; identical to SEQ ID NO: 358250

SEQ ID NO: 405914 - RNA, 64 nt, Human; identical to SEQ ID NO: 358251

SEQ ID NO: 405915 - RNA, 64 nt, Human; identical to SEQ ID NO: 358252

SEQ ID NO: 405916 - RNA, 64 nt, Human; identical to SEQ ID NO: 358253

SEQ ID NO: 405917 - RNA, 64 nt, Human; identical to SEQ ID NO: 358254

SEQ ID NO: 405918 - RNA, 64 nt, Human; identical to SEQ ID NO: 358255

SEQ ID NO: 405919 - RNA, 64 nt, Human; identical to SEQ ID NO: 358256

SEQ ID NO: 405920 - RNA, 64 nt, Human; identical to SEQ ID NO: 358257

SEQ ID NO: 405921 - RNA, 64 nt, Human; identical to SEQ ID NO: 358258

SEQ ID NO: 405922 - RNA, 64 nt, Human; identical to SEQ ID NO: 358259

SEQ ID NO: 405923 - RNA, 64 nt, Human; identical to SEQ ID NO: 358260

SEQ ID NO: 405924 - RNA, 64 nt, Human; identical to SEQ ID NO: 358261

SEQ ID NO: 405925 - RNA, 64 nt, Human; identical to SEQ ID NO: 358262

SEQ ID NO: 405926 - RNA, 61 nt, Human
uucaaaacauugaucacccucucacaaagucauccaguaagagagaucaccggcguucugu

SEQ ID NO: 405927 - RNA, 61 nt, Human
guguucucaagcuuuacugugaaucagaaacauccaguaagcuugugacaaaugcagacuc

SEQ ID NO: 405928 - RNA, 61 nt, Human
cauaaauccaguaucucugcuuaugacauaaauccaguaccucugcuuuucuuuugcugug

SEQ ID NO: 405929 - RNA, 64 nt, Human; identical to SEQ ID NO: 358263

SEQ ID NO: 405930 - RNA, 64 nt, Human; identical to SEQ ID NO: 358264

SEQ ID NO: 405931 - RNA, 64 nt, Human; identical to SEQ ID NO: 358265

SEQ ID NO: 405932 - RNA, 64 nt, Human; identical to SEQ ID NO: 358266

SEQ ID NO: 405933 - RNA, 64 nt, Human; identical to SEQ ID NO: 358267

SEQ ID NO: 405934 - RNA, 64 nt, Human; identical to SEQ ID NO: 358268

SEQ ID NO: 405935 - RNA, 64 nt, Human; identical to SEQ ID NO: 358269

SEQ ID NO: 405936 - RNA, 64 nt, Human; identical to SEQ ID NO: 358270

SEQ ID NO: 405937 - RNA, 64 nt, Human; identical to SEQ ID NO: 358271

SEQ ID NO: 405938 - RNA, 64 nt, Human; identical to SEQ ID NO: 358272

SEQ ID NO: 405939 - RNA, 64 nt, Human; identical to SEQ ID NO: 358273

SEQ ID NO: 405940 - RNA, 64 nt, Human; identical to SEQ ID NO: 358274

SEQ ID NO: 405941 - RNA, 64 nt, Human; identical to SEQ ID NO: 358275

SEQ ID NO: 405942 - RNA, 64 nt, Human; identical to SEQ ID NO: 358276

SEQ ID NO: 405943 - RNA, 64 nt, Human; identical to SEQ ID NO: 358277

SEQ ID NO: 405944 - RNA, 64 nt, Human; identical to SEQ ID NO: 358278

SEQ ID NO: 405945 - RNA, 61 nt, Human
aguuaauuaggcagccuggagaaaaccagagauccaguacagaaaggaaaggauauuuauu

SEQ ID NO: 405946 - RNA, 61 nt, Human
aacaucacauguguuuuucaguaucucugcaauccaguaugcauuccaaaugaaaugugua

SEQ ID NO: 405947 - RNA, 61 nt, Human
gcuuuguuuugugguaguccuuuugggaagaauccaguauuauccacaauuauuggcaaag

SEQ ID NO: 405948 - RNA, 64 nt, Human; identical to SEQ ID NO: 358279

SEQ ID NO: 405949 - RNA, 64 nt, Human; identical to SEQ ID NO: 358280

SEQ ID NO: 405950 - RNA, 64 nt, Human; identical to SEQ ID NO: 358281

SEQ ID NO: 405951 - RNA, 64 nt, Human; identical to SEQ ID NO: 358282

SEQ ID NO: 405952 - RNA, 64 nt, Human; identical to SEQ ID NO: 358283

SEQ ID NO: 405953 - RNA, 64 nt, Human; identical to SEQ ID NO: 358284

SEQ ID NO: 405954 - RNA, 64 nt, Human; identical to SEQ ID NO: 358285

SEQ ID NO: 405955 - RNA, 64 nt, Human; identical to SEQ ID NO: 358286

SEQ ID NO: 405956 - RNA, 64 nt, Human; identical to SEQ ID NO: 358287

SEQ ID NO: 405957 - RNA, 64 nt, Human; identical to SEQ ID NO: 358288

SEQ ID NO: 405958 - RNA, 64 nt, Human; identical to SEQ ID NO: 358289

SEQ ID NO: 405959 - RNA, 64 nt, Human; identical to SEQ ID NO: 358290

SEQ ID NO: 405960 - RNA, 64 nt, Human; identical to SEQ ID NO: 358291

SEQ ID NO: 405961 - RNA, 62 nt, Human; identical to SEQ ID NO: 358292

SEQ ID NO: 405962 - RNA, 64 nt, Human; identical to SEQ ID NO: 358293

SEQ ID NO: 405963 - RNA, 64 nt, Human; identical to SEQ ID NO: 358294

SEQ ID NO: 405964 - RNA, 64 nt, Human
ugccuacuucaccaucucuuaaggacucggcauuuguccacagucagacugcaagagaggguag

SEQ ID NO: 405965 - RNA, 64 nt, Human
cuugaggggucugggcagucccuccucuccccaguguccacagucacugagccagacggucggu

SEQ ID NO: 405966 - RNA, 64 nt, Human
agcccugugccacacuccuucuauguguguacaguguccacaggcaucacaccuucuucauuaa

SEQ ID NO: 405967 - RNA, 64 nt, Human; identical to SEQ ID NO: 358295

SEQ ID NO: 405968 - RNA, 64 nt, Human; identical to SEQ ID NO: 358296

SEQ ID NO: 405969 - RNA, 64 nt, Human; identical to SEQ ID NO: 358297

SEQ ID NO: 405970 - RNA, 64 nt, Human; identical to SEQ ID NO: 358298

SEQ ID NO: 405971 - RNA, 64 nt, Human; identical to SEQ ID NO: 358299

SEQ ID NO: 405972 - RNA, 64 nt, Human; identical to SEQ ID NO: 358300

SEQ ID NO: 405973 - RNA, 64 nt, Human; identical to SEQ ID NO: 358301

SEQ ID NO: 405974 - RNA, 64 nt, Human; identical to SEQ ID NO: 358302

SEQ ID NO: 405975 - RNA, 64 nt, Human; identical to SEQ ID NO: 358303

SEQ ID NO: 405976 - RNA, 64 nt, Human; identical to SEQ ID NO: 358304

SEQ ID NO: 405977 - RNA, 64 nt, Human; identical to SEQ ID NO: 358305

SEQ ID NO: 405978 - RNA, 55 nt, Human; identical to SEQ ID NO: 358306

SEQ ID NO: 405979 - RNA, 64 nt, Human; identical to SEQ ID NO: 358307

SEQ ID NO: 405980 - RNA, 64 nt, Human; identical to SEQ ID NO: 358308

SEQ ID NO: 405981 - RNA, 64 nt, Human; identical to SEQ ID NO: 358309

SEQ ID NO: 405982 - RNA, 64 nt, Human; identical to SEQ ID NO: 358310

SEQ ID NO: 405983 - RNA, 61 nt, Human
uuuuauuuguauucgaucuguguuaccugggauccaguaucaaauauauccacauucuuua

SEQ ID NO: 405984 - RNA, 56 nt, Human
acaauucuggacugucauaaguagucauccaguagaagcauaguuagcaucagaaa

SEQ ID NO: 405985 - RNA, 61 nt, Human
gauacuacuaccucauaggguuguccuggggauccaguaugaugaagugcgccaggggcuu

SEQ ID NO: 405986 - RNA, 64 nt, Human; identical to SEQ ID NO: 358311

SEQ ID NO: 405987 - RNA, 64 nt, Human; identical to SEQ ID NO: 358312

SEQ ID NO: 405988 - RNA, 64 nt, Human; identical to SEQ ID NO: 358313

SEQ ID NO: 405989 - RNA, 64 nt, Human; identical to SEQ ID NO: 358314

SEQ ID NO: 405990 - RNA, 64 nt, Human; identical to SEQ ID NO: 358315

SEQ ID NO: 405991 - RNA, 64 nt, Human; identical to SEQ ID NO: 358316

SEQ ID NO: 405992 - RNA, 64 nt, Human; identical to SEQ ID NO: 358317

SEQ ID NO: 405993 - RNA, 64 nt, Human; identical to SEQ ID NO: 358318

SEQ ID NO: 405994 - RNA, 64 nt, Human; identical to SEQ ID NO: 358319

SEQ ID NO: 405995 - RNA, 64 nt, Human; identical to SEQ ID NO: 358320

SEQ ID NO: 405996 - RNA, 64 nt, Human; identical to SEQ ID NO: 358321

SEQ ID NO: 405997 - RNA, 64 nt, Human; identical to SEQ ID NO: 358322

SEQ ID NO: 405998 - RNA, 64 nt, Human; identical to SEQ ID NO: 358323

SEQ ID NO: 405999 - RNA, 64 nt, Human; identical to SEQ ID NO: 358324

SEQ ID NO: 406000 - RNA, 64 nt, Human; identical to SEQ ID NO: 358325

SEQ ID NO: 406001 - RNA, 64 nt, Human; identical to SEQ ID NO: 358326

SEQ ID NO: 406002 - RNA, 64 nt, Human
gcagucauccucuccuugccaaaagauuuaaaccuguccacauugguggugaugaugggugagu

SEQ ID NO: 406003 - RNA, 64 nt, Human
uagcccugggguagccuguaguagacucggguccuguccacagcccuagcugccagcaaugcug

SEQ ID NO: 406004 - RNA, 64 nt, Human
uuuaugucacuggcuggcuggauccaaagucauguguccacacauucauaaauaaaaauuuuac

SEQ ID NO: 406005 - RNA, 64 nt, Human; identical to SEQ ID NO: 358327

SEQ ID NO: 406006 - RNA, 64 nt, Human; identical to SEQ ID NO: 358328

SEQ ID NO: 406007 - RNA, 64 nt, Human; identical to SEQ ID NO: 358329

SEQ ID NO: 406008 - RNA, 64 nt, Human; identical to SEQ ID NO: 358330

SEQ ID NO: 406009 - RNA, 64 nt, Human; identical to SEQ ID NO: 358331

SEQ ID NO: 406010 - RNA, 64 nt, Human; identical to SEQ ID NO: 358332

SEQ ID NO: 406011 - RNA, 64 nt, Human; identical to SEQ ID NO: 358333

SEQ ID NO: 406012 - RNA, 64 nt, Human; identical to SEQ ID NO: 358334

SEQ ID NO: 406013 - RNA, 64 nt, Human; identical to SEQ ID NO: 358335

SEQ ID NO: 406014 - RNA, 64 nt, Human; identical to SEQ ID NO: 358336

SEQ ID NO: 406015 - RNA, 64 nt, Human; identical to SEQ ID NO: 358337

SEQ ID NO: 406016 - RNA, 64 nt, Human; identical to SEQ ID NO: 358338

SEQ ID NO: 406017 - RNA, 64 nt, Human; identical to SEQ ID NO: 358339

SEQ ID NO: 406018 - RNA, 64 nt, Human; identical to SEQ ID NO: 358340

SEQ ID NO: 406019 - RNA, 64 nt, Human; identical to SEQ ID NO: 358341

SEQ ID NO: 406020 - RNA, 53 nt, Human; identical to SEQ ID NO: 358342

SEQ ID NO: 406021 - RNA, 61 nt, Human
aacuauuuucuuuugaccuuucuuccccuccauccaguauuucgguugauuucauuuucuc

SEQ ID NO: 406022 - RNA, 61 nt, Human
uuuuaagguaagaagaucuaaugcauccuauauccaguaaguagaauuaucucuucaucug

SEQ ID NO: 406023 - RNA, 61 nt, Human
uuuaugagaaaaugaacacaugcauuuauggauccaguaucaugcagugcugcccucaucc

SEQ ID NO: 406024 - RNA, 64 nt, Human; identical to SEQ ID NO: 358343

SEQ ID NO: 406025 - RNA, 64 nt, Human; identical to SEQ ID NO: 358344

SEQ ID NO: 406026 - RNA, 64 nt, Human; identical to SEQ ID NO: 358345

SEQ ID NO: 406027 - RNA, 64 nt, Human; identical to SEQ ID NO: 358346

SEQ ID NO: 406028 - RNA, 64 nt, Human; identical to SEQ ID NO: 358346

SEQ ID NO: 406029 - RNA, 64 nt, Human; identical to SEQ ID NO: 358040

SEQ ID NO: 406030 - RNA, 64 nt, Human; identical to SEQ ID NO: 358041

SEQ ID NO: 406031 - RNA, 64 nt, Human; identical to SEQ ID NO: 358042

SEQ ID NO: 406032 - RNA, 64 nt, Human; identical to SEQ ID NO: 358043

SEQ ID NO: 406033 - RNA, 64 nt, Human; identical to SEQ ID NO: 358044

SEQ ID NO: 406034 - RNA, 64 nt, Human; identical to SEQ ID NO: 358045

SEQ ID NO: 406035 - RNA, 64 nt, Human; identical to SEQ ID NO: 358046

SEQ ID NO: 406036 - RNA, 64 nt, Human; identical to SEQ ID NO: 358047

SEQ ID NO: 406037 - RNA, 64 nt, Human; identical to SEQ ID NO: 358048

SEQ ID NO: 406038 - RNA, 61 nt, Human
gggaaugcugagcagauagcccccauuguuaauccaguauccuuaugggaauggagggaaa

SEQ ID NO: 406039 - RNA, 61 nt, Human
aucaaauuacuguauuuauuaauuugcuagaauccaguaaaucauuuugguagcucuggcu

SEQ ID NO: 406040 - RNA, 61 nt, Human
ggagcugauuaggcugggauuugaggugauaauccaguaagucuuuccucguuccuacuug

SEQ ID NO: 406041 - RNA, 61 nt, Human
agccccuccuagccaccagugauccccaagcauccaguacagaaccaggcaucgagcuagc

SEQ ID NO: 406042 - RNA, 64 nt, Human; identical to SEQ ID NO: 358049

SEQ ID NO: 406043 - RNA, 64 nt, Human; identical to SEQ ID NO: 358050

SEQ ID NO: 406044 - RNA, 64 nt, Human; identical to SEQ ID NO: 358051

SEQ ID NO: 406045 - RNA, 64 nt, Human; identical to SEQ ID NO: 358052

SEQ ID NO: 406046 - RNA, 64 nt, Human; identical to SEQ ID NO: 358053

SEQ ID NO: 406047 - RNA, 64 nt, Human; identical to SEQ ID NO: 358054

SEQ ID NO: 406048 - RNA, 64 nt, Human; identical to SEQ ID NO: 358055

SEQ ID NO: 406049 - RNA, 64 nt, Human; identical to SEQ ID NO: 358056

SEQ ID NO: 406050 - RNA, 64 nt, Human; identical to SEQ ID NO: 358057

SEQ ID NO: 406051 - RNA, 64 nt, Human; identical to SEQ ID NO: 358058

SEQ ID NO: 406052 - RNA, 64 nt, Human; identical to SEQ ID NO: 358059

SEQ ID NO: 406053 - RNA, 64 nt, Human; identical to SEQ ID NO: 358060

SEQ ID NO: 406054 - RNA, 64 nt, Human; identical to SEQ ID NO: 358061

SEQ ID NO: 406055 - RNA, 64 nt, Human; identical to SEQ ID NO: 358062

SEQ ID NO: 406056 - RNA, 64 nt, Human; identical to SEQ ID NO: 358063

SEQ ID NO: 406057 - RNA, 64 nt, Human; identical to SEQ ID NO: 358064

SEQ ID NO: 406058 - RNA, 61 nt, Human
uauuuaacgaauaguguggaugugauuugucauccaguauuaaguucuuagucauugauuu

SEQ ID NO: 406059 - RNA, 61 nt, Human
gguuaacauggcauuucuaagaaggcauuuaauccaguaucucuaguguacaaaggaaacu

SEQ ID NO: 406060 - RNA, 61 nt, Human
agaaaagcauuuuagcaauuuauacaauaucauccaguaccuuaagcccugauuguguaua

SEQ ID NO: 406061 - RNA, 64 nt, Human; identical to SEQ ID NO: 358065

SEQ ID NO: 406062 - RNA, 64 nt, Human; identical to SEQ ID NO: 358066

SEQ ID NO: 406063 - RNA, 64 nt, Human; identical to SEQ ID NO: 358067

SEQ ID NO: 406064 - RNA, 64 nt, Human; identical to SEQ ID NO: 358068

SEQ ID NO: 406065 - RNA, 64 nt, Human; identical to SEQ ID NO: 358069

SEQ ID NO: 406066 - RNA, 64 nt, Human; identical to SEQ ID NO: 358070

SEQ ID NO: 406067 - RNA, 64 nt, Human; identical to SEQ ID NO: 358071

SEQ ID NO: 406068 - RNA, 64 nt, Human; identical to SEQ ID NO: 358072

SEQ ID NO: 406069 - RNA, 64 nt, Human; identical to SEQ ID NO: 358073

SEQ ID NO: 406070 - RNA, 64 nt, Human; identical to SEQ ID NO: 358074

SEQ ID NO: 406071 - RNA, 64 nt, Human; identical to SEQ ID NO: 358075

SEQ ID NO: 406072 - RNA, 64 nt, Human; identical to SEQ ID NO: 358076

SEQ ID NO: 406073 - RNA, 64 nt, Human; identical to SEQ ID NO: 358077

SEQ ID NO: 406074 - RNA, 64 nt, Human; identical to SEQ ID NO: 358078

SEQ ID NO: 406075 - RNA, 64 nt, Human; identical to SEQ ID NO: 358079

SEQ ID NO: 406076 - RNA, 64 nt, Human; identical to SEQ ID NO: 358080

SEQ ID NO: 406077 - RNA, 61 nt, Human
uucuuugcuuuacuuuucaccuugcaaagagauccaguaccuaguauuggaagauccaccu

SEQ ID NO: 406078 - RNA, 61 nt, Human
uaguacguguggcagaaguuuauuuauuuuuauccaguauagaauucaauuauaugauuau

SEQ ID NO: 406079 - RNA, 64 nt, Human
uccuggguggugcuggcccaguuggugggaccccuguccacacccacccuauuuauuuccguug

SEQ ID NO: 406080 - RNA, 64 nt, Human; identical to SEQ ID NO: 358081

SEQ ID NO: 406081 - RNA, 64 nt, Human; identical to SEQ ID NO: 358082

SEQ ID NO: 406082 - RNA, 64 nt, Human; identical to SEQ ID NO: 358083

SEQ ID NO: 406083 - RNA, 52 nt, Human; identical to SEQ ID NO: 358084

SEQ ID NO: 406084 - RNA, 64 nt, Human; identical to SEQ ID NO: 358085

SEQ ID NO: 406085 - RNA, 64 nt, Human; identical to SEQ ID NO: 358086

SEQ ID NO: 406086 - RNA, 64 nt, Human; identical to SEQ ID NO: 358087

SEQ ID NO: 406087 - RNA, 64 nt, Human; identical to SEQ ID NO: 358088

SEQ ID NO: 406088 - RNA, 64 nt, Human; identical to SEQ ID NO: 358089

SEQ ID NO: 406089 - RNA, 64 nt, Human; identical to SEQ ID NO: 358090

SEQ ID NO: 406090 - RNA, 64 nt, Human; identical to SEQ ID NO: 358091

SEQ ID NO: 406091 - RNA, 64 nt, Human; identical to SEQ ID NO: 358092

SEQ ID NO: 406092 - RNA, 64 nt, Human; identical to SEQ ID NO: 358093

SEQ ID NO: 406093 - RNA, 64 nt, Human; identical to SEQ ID NO: 358094

SEQ ID NO: 406094 - RNA, 64 nt, Human; identical to SEQ ID NO: 358095

SEQ ID NO: 406095 - RNA, 64 nt, Human; identical to SEQ ID NO: 358096

SEQ ID NO: 406096 - RNA, 61 nt, Human
ggcugcccacuccucaggggaggaaagagagauccaguaugcaccccucagcuuucauaag

SEQ ID NO: 406097 - RNA, 61 nt, Human
uucacaggccacuguugguaagaucuaaagcauccaguagggaaacaaaauugauaaauau

SEQ ID NO: 406098 - RNA, 61 nt, Human
caagcgagaggucaugggccaacuaaguguuauccaguagaaaagacaguacacugcuuuu

SEQ ID NO: 406099 - RNA, 64 nt, Human; identical to SEQ ID NO: 358097

SEQ ID NO: 406100 - RNA, 64 nt, Human; identical to SEQ ID NO: 358098

SEQ ID NO: 406101 - RNA, 64 nt, Human; identical to SEQ ID NO: 358099

SEQ ID NO: 406102 - RNA, 64 nt, Human; identical to SEQ ID NO: 358100

SEQ ID NO: 406103 - RNA, 64 nt, Human; identical to SEQ ID NO: 358101

SEQ ID NO: 406104 - RNA, 64 nt, Human; identical to SEQ ID NO: 358102

SEQ ID NO: 406105 - RNA, 64 nt, Human; identical to SEQ ID NO: 358103

SEQ ID NO: 406106 - RNA, 64 nt, Human; identical to SEQ ID NO: 358104

SEQ ID NO: 406107 - RNA, 64 nt, Human; identical to SEQ ID NO: 358105

SEQ ID NO: 406108 - RNA, 64 nt, Human; identical to SEQ ID NO: 358106

SEQ ID NO: 406109 - RNA, 64 nt, Human; identical to SEQ ID NO: 358107

SEQ ID NO: 406110 - RNA, 64 nt, Human; identical to SEQ ID NO: 358108

SEQ ID NO: 406111 - RNA, 64 nt, Human; identical to SEQ ID NO: 358109

SEQ ID NO: 406112 - RNA, 64 nt, Human; identical to SEQ ID NO: 358110

SEQ ID NO: 406113 - RNA, 64 nt, Human; identical to SEQ ID NO: 358111

SEQ ID NO: 406114 - RNA, 64 nt, Human; identical to SEQ ID NO: 358112

SEQ ID NO: 406115 - RNA, 61 nt, Human
ccaagacugugccccucaucugcaucuucagauccaguacucuguguaccugcuccagccc

SEQ ID NO: 406116 - RNA, 61 nt, Human
auuuuacaguggugcuuuauuuauaucaauaauccaguauaguuaggcuguucauuccuca

SEQ ID NO: 406117 - RNA, 61 nt, Human
gcucacuuaucuaaaggugagagcugcauagauccaguaauguacauaaagccugaaugau

SEQ ID NO: 406118 - RNA, 64 nt, Human; identical to SEQ ID NO: 358113

SEQ ID NO: 406119 - RNA, 64 nt, Human; identical to SEQ ID NO: 358114

SEQ ID NO: 406120 - RNA, 64 nt, Human; identical to SEQ ID NO: 358115

SEQ ID NO: 406121 - RNA, 64 nt, Human; identical to SEQ ID NO: 358116

SEQ ID NO: 406122 - RNA, 64 nt, Human; identical to SEQ ID NO: 358117

SEQ ID NO: 406123 - RNA, 64 nt, Human; identical to SEQ ID NO: 358118

SEQ ID NO: 406124 - RNA, 64 nt, Human; identical to SEQ ID NO: 358119

SEQ ID NO: 406125 - RNA, 64 nt, Human; identical to SEQ ID NO: 358120

SEQ ID NO: 406126 - RNA, 64 nt, Human; identical to SEQ ID NO: 358121

SEQ ID NO: 406127 - RNA, 64 nt, Human; identical to SEQ ID NO: 358122

SEQ ID NO: 406128 - RNA, 64 nt, Human; identical to SEQ ID NO: 358123

SEQ ID NO: 406129 - RNA, 64 nt, Human; identical to SEQ ID NO: 358124

SEQ ID NO: 406130 - RNA, 64 nt, Human; identical to SEQ ID NO: 358125

SEQ ID NO: 406131 - RNA, 64 nt, Human; identical to SEQ ID NO: 358126

SEQ ID NO: 406132 - RNA, 64 nt, Human; identical to SEQ ID NO: 358127

SEQ ID NO: 406133 - RNA, 64 nt, Human; identical to SEQ ID NO: 358128

SEQ ID NO: 406134 - RNA, 61 nt, Human
auacugucacagugccuagaaugggcucuuuauccaguagacaccacuguacuuuuugaua

SEQ ID NO: 406135 - RNA, 61 nt, Human
aaagugagaacaaucucauuuaccaucauguauccaguaguggauaauucauuuugauggc

SEQ ID NO: 406136 - RNA, 64 nt, Human
acaccagucuugagagguggccagccagacugccuguccacaugcgugucagcacauacagccg

SEQ ID NO: 406137 - RNA, 64 nt, Human; identical to SEQ ID NO: 358129

SEQ ID NO: 406138 - RNA, 64 nt, Human; identical to SEQ ID NO: 358130

SEQ ID NO: 406139 - RNA, 64 nt, Human; identical to SEQ ID NO: 358131

SEQ ID NO: 406140 - RNA, 64 nt, Human; identical to SEQ ID NO: 358132

SEQ ID NO: 406141 - RNA, 64 nt, Human; identical to SEQ ID NO: 358133

SEQ ID NO: 406142 - RNA, 64 nt, Human; identical to SEQ ID NO: 358134

SEQ ID NO: 406143 - RNA, 64 nt, Human; identical to SEQ ID NO: 358135

SEQ ID NO: 406144 - RNA, 64 nt, Human; identical to SEQ ID NO: 358136

SEQ ID NO: 406145 - RNA, 64 nt, Human; identical to SEQ ID NO: 358137

SEQ ID NO: 406146 - RNA, 57 nt, Human; identical to SEQ ID NO: 358138

SEQ ID NO: 406147 - RNA, 64 nt, Human; identical to SEQ ID NO: 358139

SEQ ID NO: 406148 - RNA, 64 nt, Human; identical to SEQ ID NO: 358140

SEQ ID NO: 406149 - RNA, 64 nt, Human; identical to SEQ ID NO: 358141

SEQ ID NO: 406150 - RNA, 64 nt, Human; identical to SEQ ID NO: 358142

SEQ ID NO: 406151 - RNA, 64 nt, Human; identical to SEQ ID NO: 358143

SEQ ID NO: 406152 - RNA, 64 nt, Human; identical to SEQ ID NO: 358144

SEQ ID NO: 406153 - RNA, 61 nt, Human
gcccaagaagguaaaauguacaaugucuagcauccaguagagaggcaugaaaagcaggaaa

SEQ ID NO: 406154 - RNA, 61 nt, Human
uugaaaagauaaauuauaucaauuuccucauauccaguauuguuccuuuugugggcaauca

SEQ ID NO: 406155 - RNA, 61 nt, Human
aacaucgauauguauaucauucuacagaauaauccaguauugcugauuuuaaaggcagaga

SEQ ID NO: 406156 - RNA, 64 nt, Human; identical to SEQ ID NO: 358145

SEQ ID NO: 406157 - RNA, 64 nt, Human; identical to SEQ ID NO: 358146

SEQ ID NO: 406158 - RNA, 64 nt, Human; identical to SEQ ID NO: 358147

SEQ ID NO: 406159 - RNA, 64 nt, Human; identical to SEQ ID NO: 358148

SEQ ID NO: 406160 - RNA, 64 nt, Human; identical to SEQ ID NO: 358149

SEQ ID NO: 406161 - RNA, 64 nt, Human; identical to SEQ ID NO: 358150

SEQ ID NO: 406162 - RNA, 64 nt, Human; identical to SEQ ID NO: 358151

SEQ ID NO: 406163 - RNA, 64 nt, Human; identical to SEQ ID NO: 358152

SEQ ID NO: 406164 - RNA, 64 nt, Human; identical to SEQ ID NO: 358153

SEQ ID NO: 406165 - RNA, 64 nt, Human; identical to SEQ ID NO: 358154

SEQ ID NO: 406166 - RNA, 64 nt, Human; identical to SEQ ID NO: 358155

SEQ ID NO: 406167 - RNA, 64 nt, Human; identical to SEQ ID NO: 358156

SEQ ID NO: 406168 - RNA, 64 nt, Human; identical to SEQ ID NO: 358157

SEQ ID NO: 406169 - RNA, 64 nt, Human; identical to SEQ ID NO: 358158

SEQ ID NO: 406170 - RNA, 64 nt, Human; identical to SEQ ID NO: 358159

SEQ ID NO: 406171 - RNA, 64 nt, Human; identical to SEQ ID NO: 358160

SEQ ID NO: 406172 - RNA, 61 nt, Human
caaacauugucugcaaagggccagauacugaauccaguacuuucaguuuggcgagccguga

SEQ ID NO: 406173 - RNA, 61 nt, Human
gccaaaaagaaaagcaacauagaguuuaaguauccaguagugauuuguaaacuuguuuuuc

SEQ ID NO: 406174 - RNA, 61 nt, Human
aacuuuaaauuugaauguauucuuguaaaacauccaguauuuuuuuuucugugacuauguu

SEQ ID NO: 406175 - RNA, 64 nt, Human; identical to SEQ ID NO: 358161

SEQ ID NO: 406176 - RNA, 64 nt, Human; identical to SEQ ID NO: 358162

SEQ ID NO: 406177 - RNA, 64 nt, Human; identical to SEQ ID NO: 358163

SEQ ID NO: 406178 - RNA, 64 nt, Human; identical to SEQ ID NO: 358164

SEQ ID NO: 406179 - RNA, 64 nt, Human; identical to SEQ ID NO: 358165

SEQ ID NO: 406180 - RNA, 64 nt, Human; identical to SEQ ID NO: 358166

SEQ ID NO: 406181 - RNA, 64 nt, Human; identical to SEQ ID NO: 358167

SEQ ID NO: 406182 - RNA, 64 nt, Human; identical to SEQ ID NO: 358168

SEQ ID NO: 406183 - RNA, 64 nt, Human; identical to SEQ ID NO: 358169

SEQ ID NO: 406184 - RNA, 64 nt, Human; identical to SEQ ID NO: 358170

SEQ ID NO: 406185 - RNA, 64 nt, Human; identical to SEQ ID NO: 358171

SEQ ID NO: 406186 - RNA, 64 nt, Human; identical to SEQ ID NO: 358172

SEQ ID NO: 406187 - RNA, 64 nt, Human; identical to SEQ ID NO: 358173

SEQ ID NO: 406188 - RNA, 64 nt, Human; identical to SEQ ID NO: 358174

SEQ ID NO: 406189 - RNA, 64 nt, Human; identical to SEQ ID NO: 358175

SEQ ID NO: 406190 - RNA, 63 nt, Human; identical to SEQ ID NO: 358176

SEQ ID NO: 406191 - RNA, 61 nt, Human
gagaagcagcagucuuuacuuuuccagccaaauccaguagcagaaucaucuuccacaacaa

SEQ ID NO: 406192 - RNA, 61 nt, Human
acaaacccccauuauguacagaauaggaccuauccaguagccaggccaguaggcaguuggg

SEQ ID NO: 406193 - RNA, 61 nt, Human
uauaccaugcauuuagcugccuagugagaauauccaguagguuauccuauaguuacuauga

SEQ ID NO: 406194 - RNA, 64 nt, Human; identical to SEQ ID NO: 358177

SEQ ID NO: 406195 - RNA, 64 nt, Human; identical to SEQ ID NO: 358178

SEQ ID NO: 406196 - RNA, 64 nt, Human; identical to SEQ ID NO: 358179

SEQ ID NO: 406197 - RNA, 64 nt, Human; identical to SEQ ID NO: 358180

SEQ ID NO: 406198 - RNA, 64 nt, Human; identical to SEQ ID NO: 358181

SEQ ID NO: 406199 - RNA, 64 nt, Human; identical to SEQ ID NO: 358182

SEQ ID NO: 406200 - RNA, 64 nt, Human; identical to SEQ ID NO: 358183

SEQ ID NO: 406201 - RNA, 64 nt, Human; identical to SEQ ID NO: 358184

SEQ ID NO: 406202 - RNA, 64 nt, Human; identical to SEQ ID NO: 358185

SEQ ID NO: 406203 - RNA, 64 nt, Human; identical to SEQ ID NO: 358186

SEQ ID NO: 406204 - RNA, 64 nt, Human; identical to SEQ ID NO: 358187

SEQ ID NO: 406205 - RNA, 64 nt, Human; identical to SEQ ID NO: 358188

SEQ ID NO: 406206 - RNA, 64 nt, Human; identical to SEQ ID NO: 358189

SEQ ID NO: 406207 - RNA, 64 nt, Human; identical to SEQ ID NO: 358190

SEQ ID NO: 406208 - RNA, 64 nt, Human; identical to SEQ ID NO: 358191

SEQ ID NO: 406209 - RNA, 64 nt, Human; identical to SEQ ID NO: 358192

SEQ ID NO: 406210 - RNA, 61 nt, Human
uucauuugccacauaguuguuguaauauuuaauccaguagcauaacuuauaucuguauuua

SEQ ID NO: 406211 - RNA, 61 nt, Human
gaauuuuaaagugauaauaguacuuaauguuauccaguauuguucauuaaaugguguuauc

SEQ ID NO: 406212 - RNA, 61 nt, Human
aggauacaugaaaaguaugagaucugguuccauccaguaagacauuuuaauagagaagauc

SEQ ID NO: 406213 - RNA, 64 nt, Human; identical to SEQ ID NO: 358193

SEQ ID NO: 406214 - RNA, 64 nt, Human; identical to SEQ ID NO: 358194

SEQ ID NO: 406215 - RNA, 64 nt, Human; identical to SEQ ID NO: 358195

SEQ ID NO: 406216 - RNA, 64 nt, Human; identical to SEQ ID NO: 358196

SEQ ID NO: 406217 - RNA, 64 nt, Human; identical to SEQ ID NO: 358197

SEQ ID NO: 406218 - RNA, 64 nt, Human; identical to SEQ ID NO: 358198

SEQ ID NO: 406219 - RNA, 64 nt, Human; identical to SEQ ID NO: 358199

SEQ ID NO: 406220 - RNA, 64 nt, Human; identical to SEQ ID NO: 358200

SEQ ID NO: 406221 - RNA, 64 nt, Human; identical to SEQ ID NO: 358201

SEQ ID NO: 406222 - RNA, 64 nt, Human; identical to SEQ ID NO: 358202

SEQ ID NO: 406223 - RNA, 64 nt, Human; identical to SEQ ID NO: 358203

SEQ ID NO: 406224 - RNA, 64 nt, Human; identical to SEQ ID NO: 358204

SEQ ID NO: 406225 - RNA, 64 nt, Human; identical to SEQ ID NO: 358205

SEQ ID NO: 406226 - RNA, 64 nt, Human; identical to SEQ ID NO: 358206

SEQ ID NO: 406227 - RNA, 64 nt, Human; identical to SEQ ID NO: 358207

SEQ ID NO: 406228 - RNA, 64 nt, Human; identical to SEQ ID NO: 358208

SEQ ID NO: 406229 - RNA, 61 nt, Human
uauuagcauuauaaauaugcaugauaguauaauccaguaaugguugaagaauguauuuuac

SEQ ID NO: 406230 - RNA, 61 nt, Human
gaagggagaggagaaaggcgcugcacuuuaaauccaguauuuguuuacucauguuaaaaaa

SEQ ID NO: 406231 - RNA, 61 nt, Human
ucucaauuagucuuucuccccuggacuagaaauccaguauaguuugccauuaauuuauuga

SEQ ID NO: 406232 - RNA, 64 nt, Human; identical to SEQ ID NO: 358209

SEQ ID NO: 406233 - RNA, 64 nt, Human; identical to SEQ ID NO: 358210

SEQ ID NO: 406234 - RNA, 64 nt, Human; identical to SEQ ID NO: 358211

SEQ ID NO: 406235 - RNA, 64 nt, Human; identical to SEQ ID NO: 358212

SEQ ID NO: 406236 - RNA, 64 nt, Human; identical to SEQ ID NO: 358213

SEQ ID NO: 406237 - RNA, 64 nt, Human; identical to SEQ ID NO: 358214

SEQ ID NO: 406238 - RNA, 64 nt, Human; identical to SEQ ID NO: 358215

SEQ ID NO: 406239 - RNA, 64 nt, Human; identical to SEQ ID NO: 358216

SEQ ID NO: 406240 - RNA, 64 nt, Human; identical to SEQ ID NO: 358217

SEQ ID NO: 406241 - RNA, 64 nt, Human; identical to SEQ ID NO: 358218

SEQ ID NO: 406242 - RNA, 64 nt, Human; identical to SEQ ID NO: 358219

SEQ ID NO: 406243 - RNA, 64 nt, Human; identical to SEQ ID NO: 358220

SEQ ID NO: 406244 - RNA, 64 nt, Human; identical to SEQ ID NO: 358221

SEQ ID NO: 406245 - RNA, 64 nt, Human; identical to SEQ ID NO: 358222

SEQ ID NO: 406246 - RNA, 64 nt, Human; identical to SEQ ID NO: 358223

SEQ ID NO: 406247 - RNA, 64 nt, Human; identical to SEQ ID NO: 358224

SEQ ID NO: 406248 - RNA, 61 nt, Human
gguaauguggaaaucugaagaagaaaugaauauccaguauagcagugacuuugacugcugu

SEQ ID NO: 406249 - RNA, 61 nt, Human
agcucccuucucaucucuuauguucugaagaauccaguaccugaucaauuuuuuuucuccc

SEQ ID NO: 406250 - RNA, 61 nt, Human
gaaccaggaaagcugcuuucacgucauugccauccaguacugacagggaagaaagauguag

SEQ ID NO: 406251 - RNA, 64 nt, Human; identical to SEQ ID NO: 358225

SEQ ID NO: 406252 - RNA, 64 nt, Human; identical to SEQ ID NO: 358226

SEQ ID NO: 406253 - RNA, 64 nt, Human; identical to SEQ ID NO: 358227

SEQ ID NO: 406254 - RNA, 64 nt, Human; identical to SEQ ID NO: 358228

SEQ ID NO: 406255 - RNA, 64 nt, Human; identical to SEQ ID NO: 358229

SEQ ID NO: 406256 - RNA, 64 nt, Human; identical to SEQ ID NO: 358230

SEQ ID NO: 406257 - RNA, 64 nt, Human; identical to SEQ ID NO: 358231

SEQ ID NO: 406258 - RNA, 64 nt, Human; identical to SEQ ID NO: 358232

SEQ ID NO: 406259 - RNA, 64 nt, Human; identical to SEQ ID NO: 358233

SEQ ID NO: 406260 - RNA, 64 nt, Human; identical to SEQ ID NO: 358234

SEQ ID NO: 406261 - RNA, 51 nt, Human; identical to SEQ ID NO: 358235

SEQ ID NO: 406262 - RNA, 64 nt, Human; identical to SEQ ID NO: 358236

SEQ ID NO: 406263 - RNA, 64 nt, Human; identical to SEQ ID NO: 358237

SEQ ID NO: 406264 - RNA, 64 nt, Human; identical to SEQ ID NO: 358238

SEQ ID NO: 406265 - RNA, 64 nt, Human; identical to SEQ ID NO: 358239

SEQ ID NO: 406266 - RNA, 64 nt, Human; identical to SEQ ID NO: 358240

SEQ ID NO: 406267 - RNA, 61 nt, Human
gaacauauuccagcuuuuugaaugagugcauauccaguaguaccuuuaaaguaacacuuug

SEQ ID NO: 406268 - RNA, 61 nt, Human
uccucaagaacacagcccugcuucugacauaauccaguaaaauaauaauuuuuaagaaaua

SEQ ID NO: 406269 - RNA, 61 nt, Human
gagagagacuugcuaggaggccuuagcaauaauccaguaaucuaaaggaaagaugauggug

SEQ ID NO: 406270 - RNA, 64 nt, Human; identical to SEQ ID NO: 358241

SEQ ID NO: 406271 - RNA, 64 nt, Human; identical to SEQ ID NO: 358242

SEQ ID NO: 406272 - RNA, 64 nt, Human; identical to SEQ ID NO: 358243

SEQ ID NO: 406273 - RNA, 64 nt, Human; identical to SEQ ID NO: 358244

SEQ ID NO: 406274 - RNA, 64 nt, Human; identical to SEQ ID NO: 358245

SEQ ID NO: 406275 - RNA, 64 nt, Human; identical to SEQ ID NO: 358246

SEQ ID NO: 406276 - RNA, 64 nt, Human; identical to SEQ ID NO: 358247

SEQ ID NO: 406277 - RNA, 64 nt, Human; identical to SEQ ID NO: 358248

SEQ ID NO: 406278 - RNA, 64 nt, Human; identical to SEQ ID NO: 358249

SEQ ID NO: 406279 - RNA, 64 nt, Human; identical to SEQ ID NO: 358250

SEQ ID NO: 406280 - RNA, 64 nt, Human; identical to SEQ ID NO: 358251

SEQ ID NO: 406281 - RNA, 64 nt, Human; identical to SEQ ID NO: 358252

SEQ ID NO: 406282 - RNA, 64 nt, Human; identical to SEQ ID NO: 358253

SEQ ID NO: 406283 - RNA, 64 nt, Human; identical to SEQ ID NO: 358254

SEQ ID NO: 406284 - RNA, 64 nt, Human; identical to SEQ ID NO: 358255

SEQ ID NO: 406285 - RNA, 64 nt, Human; identical to SEQ ID NO: 358256

SEQ ID NO: 406286 - RNA, 61 nt, Human
uuacaggcuugagccacugcuccuggccaacauccaguauuuuaucuugacuguccuaacc

SEQ ID NO: 406287 - RNA, 61 nt, Human
auauaggcuugugaauauagcacuuauuuuaauccaguagagacuugcauaaagauccuaa

SEQ ID NO: 406288 - RNA, 61 nt, Human
gauuuguuuacaaugugauauuuucuauuaaauccaguauuuucaaauaacaugucauuug

SEQ ID NO: 406289 - RNA, 64 nt, Human; identical to SEQ ID NO: 358257

SEQ ID NO: 406290 - RNA, 64 nt, Human; identical to SEQ ID NO: 358258

SEQ ID NO: 406291 - RNA, 64 nt, Human; identical to SEQ ID NO: 358259

SEQ ID NO: 406292 - RNA, 64 nt, Human; identical to SEQ ID NO: 358260

SEQ ID NO: 406293 - RNA, 64 nt, Human; identical to SEQ ID NO: 358261

SEQ ID NO: 406294 - RNA, 64 nt, Human; identical to SEQ ID NO: 358262

SEQ ID NO: 406295 - RNA, 64 nt, Human; identical to SEQ ID NO: 358263

SEQ ID NO: 406296 - RNA, 64 nt, Human; identical to SEQ ID NO: 358264

SEQ ID NO: 406297 - RNA, 64 nt, Human; identical to SEQ ID NO: 358265

SEQ ID NO: 406298 - RNA, 64 nt, Human; identical to SEQ ID NO: 358266

SEQ ID NO: 406299 - RNA, 64 nt, Human; identical to SEQ ID NO: 358267

SEQ ID NO: 406300 - RNA, 64 nt, Human; identical to SEQ ID NO: 358268

SEQ ID NO: 406301 - RNA, 64 nt, Human; identical to SEQ ID NO: 358269

SEQ ID NO: 406302 - RNA, 64 nt, Human; identical to SEQ ID NO: 358270

SEQ ID NO: 406303 - RNA, 64 nt, Human; identical to SEQ ID NO: 358271

SEQ ID NO: 406304 - RNA, 64 nt, Human; identical to SEQ ID NO: 358272

SEQ ID NO: 406305 - RNA, 61 nt, Human
gaguuaguggauuacugccauucacuucauaauccaguaggauccagugauccuuacaagu

SEQ ID NO: 406306 - RNA, 61 nt, Human
auaaaaacuguuacaucacuauuuuaaacauauccaguacaauuuaaauaucacaacaauu

SEQ ID NO: 406307 - RNA, 61 nt, Human
ggaaauauuuguuacauaguaggcaauuuuuauccaguacuuuauagauucaacucuaagu

SEQ ID NO: 406308 - RNA, 64 nt, Human; identical to SEQ ID NO: 358273

SEQ ID NO: 406309 - RNA, 64 nt, Human; identical to SEQ ID NO: 358274

SEQ ID NO: 406310 - RNA, 64 nt, Human; identical to SEQ ID NO: 358275

SEQ ID NO: 406311 - RNA, 64 nt, Human; identical to SEQ ID NO: 358276

SEQ ID NO: 406312 - RNA, 64 nt, Human; identical to SEQ ID NO: 358277

SEQ ID NO: 406313 - RNA, 64 nt, Human; identical to SEQ ID NO: 358278

SEQ ID NO: 406314 - RNA, 64 nt, Human; identical to SEQ ID NO: 358279

SEQ ID NO: 406315 - RNA, 64 nt, Human; identical to SEQ ID NO: 358280

SEQ ID NO: 406316 - RNA, 64 nt, Human; identical to SEQ ID NO: 358281

SEQ ID NO: 406317 - RNA, 64 nt, Human; identical to SEQ ID NO: 358282

SEQ ID NO: 406318 - RNA, 64 nt, Human; identical to SEQ ID NO: 358283

SEQ ID NO: 406319 - RNA, 64 nt, Human; identical to SEQ ID NO: 358284

SEQ ID NO: 406320 - RNA, 64 nt, Human; identical to SEQ ID NO: 358285

SEQ ID NO: 406321 - RNA, 64 nt, Human; identical to SEQ ID NO: 358286

SEQ ID NO: 406322 - RNA, 64 nt, Human; identical to SEQ ID NO: 358287

SEQ ID NO: 406323 - RNA, 64 nt, Human; identical to SEQ ID NO: 358288

SEQ ID NO: 406324 - RNA, 61 nt, Human
uuuuaaaagcaucuuaucuaaaagaaaggcuauccaguagagcccagugcucccuuguccc

SEQ ID NO: 406325 - RNA, 61 nt, Human
cagagggacagucaguuuuaggguugccuguauccaguaacucggggccuguuuccccgug

SEQ ID NO: 406326 - RNA, 61 nt, Human
accuuauucuucugaaaaagacuuucuucucauccaguaauuugggcuaaaaaauggaaag

SEQ ID NO: 406327 - RNA, 64 nt, Human; identical to SEQ ID NO: 358289

SEQ ID NO: 406328 - RNA, 64 nt, Human; identical to SEQ ID NO: 358290

SEQ ID NO: 406329 - RNA, 64 nt, Human; identical to SEQ ID NO: 358291

SEQ ID NO: 406330 - RNA, 62 nt, Human; identical to SEQ ID NO: 358292

SEQ ID NO: 406331 - RNA, 64 nt, Human; identical to SEQ ID NO: 358293

SEQ ID NO: 406332 - RNA, 64 nt, Human; identical to SEQ ID NO: 358294

SEQ ID NO: 406333 - RNA, 64 nt, Human; identical to SEQ ID NO: 358295

SEQ ID NO: 406334 - RNA, 64 nt, Human; identical to SEQ ID NO: 358296

SEQ ID NO: 406335 - RNA, 64 nt, Human; identical to SEQ ID NO: 358297

SEQ ID NO: 406336 - RNA, 64 nt, Human; identical to SEQ ID NO: 358298

SEQ ID NO: 406337 - RNA, 64 nt, Human; identical to SEQ ID NO: 358299

SEQ ID NO: 406338 - RNA, 64 nt, Human; identical to SEQ ID NO: 358300

SEQ ID NO: 406339 - RNA, 64 nt, Human; identical to SEQ ID NO: 358301

SEQ ID NO: 406340 - RNA, 64 nt, Human; identical to SEQ ID NO: 358302

SEQ ID NO: 406341 - RNA, 64 nt, Human; identical to SEQ ID NO: 358303

SEQ ID NO: 406342 - RNA, 64 nt, Human; identical to SEQ ID NO: 358304

SEQ ID NO: 406343 - RNA, 61 nt, Human
ucccaaaacuucauauuuuggauuaugaaucauccaguaauaaaauggaagauggagucag

SEQ ID NO: 406344 - RNA, 61 nt, Human
uucuuuuucaguucucauccucuccaucccaauccaguauaucaaucaacucuaacucgga

SEQ ID NO: 406345 - RNA, 61 nt, Human
gguccauaaacaacccccaaagucccugcugauccaguagcccuggagguuccccagguag

SEQ ID NO: 406346 - RNA, 64 nt, Human; identical to SEQ ID NO: 358305

SEQ ID NO: 406347 - RNA, 55 nt, Human; identical to SEQ ID NO: 358306

SEQ ID NO: 406348 - RNA, 64 nt, Human; identical to SEQ ID NO: 358307

SEQ ID NO: 406349 - RNA, 64 nt, Human; identical to SEQ ID NO: 358308

SEQ ID NO: 406350 - RNA, 64 nt, Human; identical to SEQ ID NO: 358309

SEQ ID NO: 406351 - RNA, 64 nt, Human; identical to SEQ ID NO: 358310

SEQ ID NO: 406352 - RNA, 64 nt, Human; identical to SEQ ID NO: 358311

SEQ ID NO: 406353 - RNA, 64 nt, Human; identical to SEQ ID NO: 358312

SEQ ID NO: 406354 - RNA, 64 nt, Human; identical to SEQ ID NO: 358313

SEQ ID NO: 406355 - RNA, 64 nt, Human; identical to SEQ ID NO: 358314

SEQ ID NO: 406356 - RNA, 64 nt, Human; identical to SEQ ID NO: 358315

SEQ ID NO: 406357 - RNA, 64 nt, Human; identical to SEQ ID NO: 358316

SEQ ID NO: 406358 - RNA, 64 nt, Human; identical to SEQ ID NO: 358317

SEQ ID NO: 406359 - RNA, 64 nt, Human; identical to SEQ ID NO: 358318

SEQ ID NO: 406360 - RNA, 64 nt, Human; identical to SEQ ID NO: 358319

SEQ ID NO: 406361 - RNA, 64 nt, Human; identical to SEQ ID NO: 358320

SEQ ID NO: 406362 - RNA, 61 nt, Human
ggaaaaaugaaauuaacaucacugauguguaauccaguaaaaucucccuuuuucgggugug

SEQ ID NO: 406363 - RNA, 61 nt, Human
aaccccuucuuuuuuuuuuuuuuuuuuuuaaauccaguauuuaggauaauauuuaugcuua

SEQ ID NO: 406364 - RNA, 61 nt, Human
auaaugguuucaauuucuacacaauauaaauauccaguauaaaggaaagcguuaagucggu

SEQ ID NO: 406365 - RNA, 64 nt, Human; identical to SEQ ID NO: 358321

SEQ ID NO: 406366 - RNA, 64 nt, Human; identical to SEQ ID NO: 358322

SEQ ID NO: 406367 - RNA, 64 nt, Human; identical to SEQ ID NO: 358323

SEQ ID NO: 406368 - RNA, 64 nt, Human; identical to SEQ ID NO: 358324

SEQ ID NO: 406369 - RNA, 64 nt, Human; identical to SEQ ID NO: 358325

SEQ ID NO: 406370 - RNA, 64 nt, Human; identical to SEQ ID NO: 358326

SEQ ID NO: 406371 - RNA, 64 nt, Human; identical to SEQ ID NO: 358327

SEQ ID NO: 406372 - RNA, 64 nt, Human; identical to SEQ ID NO: 358328

SEQ ID NO: 406373 - RNA, 64 nt, Human; identical to SEQ ID NO: 358329

SEQ ID NO: 406374 - RNA, 64 nt, Human; identical to SEQ ID NO: 358330

SEQ ID NO: 406375 - RNA, 64 nt, Human; identical to SEQ ID NO: 358331

SEQ ID NO: 406376 - RNA, 64 nt, Human; identical to SEQ ID NO: 358332

SEQ ID NO: 406377 - RNA, 64 nt, Human; identical to SEQ ID NO: 358333

SEQ ID NO: 406378 - RNA, 64 nt, Human; identical to SEQ ID NO: 358334

SEQ ID NO: 406379 - RNA, 64 nt, Human; identical to SEQ ID NO: 358335

SEQ ID NO: 406380 - RNA, 64 nt, Human; identical to SEQ ID NO: 358336

SEQ ID NO: 406381 - RNA, 61 nt, Human
cauaucaaggagcucuucuagcuaaaugaccauccaguagagauuucccacauucccauga

SEQ ID NO: 406382 - RNA, 61 nt, Human
cagauaaaagucucuuaugaagcagauauaaauccaguaagcuauuuuuuucuaccuaugg

SEQ ID NO: 406383 - RNA, 61 nt, Human
acuugggugaaauaaaacaacaaaaaagguaauccaguaauccacgucaggauucaccuua

SEQ ID NO: 406384 - RNA, 64 nt, Human; identical to SEQ ID NO: 358337

SEQ ID NO: 406385 - RNA, 64 nt, Human; identical to SEQ ID NO: 358338

SEQ ID NO: 406386 - RNA, 64 nt, Human; identical to SEQ ID NO: 358339

SEQ ID NO: 406387 - RNA, 64 nt, Human; identical to SEQ ID NO: 358340

SEQ ID NO: 406388 - RNA, 64 nt, Human; identical to SEQ ID NO: 358341

SEQ ID NO: 406389 - RNA, 53 nt, Human; identical to SEQ ID NO: 358342

SEQ ID NO: 406390 - RNA, 64 nt, Human; identical to SEQ ID NO: 358343

SEQ ID NO: 406391 - RNA, 64 nt, Human; identical to SEQ ID NO: 358344

SEQ ID NO: 406392 - RNA, 64 nt, Human; identical to SEQ ID NO: 358345

SEQ ID NO: 406393 - RNA, 64 nt, Human; identical to SEQ ID NO: 358346

SEQ ID NO: 406394 - RNA, 64 nt, Human; identical to SEQ ID NO: 358346

SEQ ID NO: 406395 - RNA, 64 nt, Human; identical to SEQ ID NO: 220801

SEQ ID NO: 406396 - RNA, 64 nt, Human; identical to SEQ ID NO: 220802

SEQ ID NO: 406397 - RNA, 64 nt, Human; identical to SEQ ID NO: 220803

SEQ ID NO: 406398 - RNA, 64 nt, Human; identical to SEQ ID NO: 220804

SEQ ID NO: 406399 - RNA, 64 nt, Human; identical to SEQ ID NO: 220805

SEQ ID NO: 406400 - RNA, 64 nt, Human
acauuauacacaaaaguguaugauauguacaacugagugguacagauaugacauggaagaucug

SEQ ID NO: 406401 - RNA, 64 nt, Human
ggcccucgguacucuggauaacgaagcuugugcagagugguaaccaugcuuacacacuaaacua

SEQ ID NO: 406402 - RNA, 64 nt, Human
acgggccguucuuucuaaggugucgguauguggggagugguacaaaauggucugaugcuccuuc

SEQ ID NO: 406403 - RNA, 64 nt, Human; identical to SEQ ID NO: 220806

SEQ ID NO: 406404 - RNA, 64 nt, Human; identical to SEQ ID NO: 220807

SEQ ID NO: 406405 - RNA, 64 nt, Human; identical to SEQ ID NO: 220808

SEQ ID NO: 406406 - RNA, 64 nt, Human; identical to SEQ ID NO: 220809

SEQ ID NO: 406407 - RNA, 64 nt, Human; identical to SEQ ID NO: 220810

SEQ ID NO: 406408 - RNA, 64 nt, Human; identical to SEQ ID NO: 220811

SEQ ID NO: 406409 - RNA, 64 nt, Human; identical to SEQ ID NO: 220812

SEQ ID NO: 406410 - RNA, 64 nt, Human; identical to SEQ ID NO: 220813

SEQ ID NO: 406411 - RNA, 64 nt, Human; identical to SEQ ID NO: 220814

SEQ ID NO: 406412 - RNA, 64 nt, Human; identical to SEQ ID NO: 220815

SEQ ID NO: 406413 - RNA, 64 nt, Human; identical to SEQ ID NO: 220819

SEQ ID NO: 406414 - RNA, 64 nt, Human; identical to SEQ ID NO: 220820

SEQ ID NO: 406415 - RNA, 64 nt, Human; identical to SEQ ID NO: 220821

SEQ ID NO: 406416 - RNA, 64 nt, Human; identical to SEQ ID NO: 220822

SEQ ID NO: 406417 - RNA, 64 nt, Human; identical to SEQ ID NO: 220823

SEQ ID NO: 406418 - RNA, 64 nt, Human; identical to SEQ ID NO: 220824

SEQ ID NO: 406419 - RNA, 61 nt, Human
aaaguugccuuuucucuccacccuugaguagauccaguauuugaugaaacucaugaaagug

SEQ ID NO: 406420 - RNA, 61 nt, Human
uaaacaacagacugcauauaugaugguggucauccaguaagcuaagguuaauuuauuauua

SEQ ID NO: 406421 - RNA, 61 nt, Human
aucuggaaucuaaggagcagcuuuuacccugauccaguauccugaggaauuuuaagccucc

SEQ ID NO: 406422 - RNA, 64 nt, Human; identical to SEQ ID NO: 220825

SEQ ID NO: 406423 - RNA, 64 nt, Human; identical to SEQ ID NO: 220826

SEQ ID NO: 406424 - RNA, 56 nt, Human; identical to SEQ ID NO: 220827

SEQ ID NO: 406425 - RNA, 64 nt, Human; identical to SEQ ID NO: 220828

SEQ ID NO: 406426 - RNA, 64 nt, Human; identical to SEQ ID NO: 220829

SEQ ID NO: 406427 - RNA, 64 nt, Human; identical to SEQ ID NO: 220830

SEQ ID NO: 406428 - RNA, 64 nt, Human; identical to SEQ ID NO: 220831

SEQ ID NO: 406429 - RNA, 64 nt, Human; identical to SEQ ID NO: 220832

SEQ ID NO: 406430 - RNA, 64 nt, Human; identical to SEQ ID NO: 220833

SEQ ID NO: 406431 - RNA, 64 nt, Human; identical to SEQ ID NO: 220837

SEQ ID NO: 406432 - RNA, 64 nt, Human; identical to SEQ ID NO: 220838

SEQ ID NO: 406433 - RNA, 64 nt, Human; identical to SEQ ID NO: 220839

SEQ ID NO: 406434 - RNA, 64 nt, Human; identical to SEQ ID NO: 220840

SEQ ID NO: 406435 - RNA, 64 nt, Human; identical to SEQ ID NO: 220841

SEQ ID NO: 406436 - RNA, 64 nt, Human; identical to SEQ ID NO: 220842

SEQ ID NO: 406437 - RNA, 64 nt, Human; identical to SEQ ID NO: 220843

SEQ ID NO: 406438 - RNA, 61 nt, Human
uauuuauuaacguauuauaaaauaauguuugauccaguaugugcuugucuuauuuaaaauu

SEQ ID NO: 406439 - RNA, 61 nt, Human
ugggggauggugggaugugugugcuacuggcauccaguaaauagaagccaggggugccgcu

SEQ ID NO: 406440 - RNA, 61 nt, Human
ggacuucuaaagcuuggggcuccaggaaaucauccaguagaguuggagauucagagauuuc

SEQ ID NO: 406441 - RNA, 64 nt, Human; identical to SEQ ID NO: 220844

SEQ ID NO: 406442 - RNA, 64 nt, Human; identical to SEQ ID NO: 220845

SEQ ID NO: 406443 - RNA, 64 nt, Human; identical to SEQ ID NO: 220846

SEQ ID NO: 406444 - RNA, 64 nt, Human; identical to SEQ ID NO: 220847

SEQ ID NO: 406445 - RNA, 64 nt, Human; identical to SEQ ID NO: 220848

SEQ ID NO: 406446 - RNA, 52 nt, Human; identical to SEQ ID NO: 220849

SEQ ID NO: 406447 - RNA, 64 nt, Human; identical to SEQ ID NO: 220850

SEQ ID NO: 406448 - RNA, 64 nt, Human; identical to SEQ ID NO: 220851

SEQ ID NO: 406449 - RNA, 64 nt, Human; identical to SEQ ID NO: 220855

SEQ ID NO: 406450 - RNA, 64 nt, Human; identical to SEQ ID NO: 220856

SEQ ID NO: 406451 - RNA, 64 nt, Human; identical to SEQ ID NO: 220857

SEQ ID NO: 406452 - RNA, 64 nt, Human; identical to SEQ ID NO: 220858

SEQ ID NO: 406453 - RNA, 64 nt, Human; identical to SEQ ID NO: 220859

SEQ ID NO: 406454 - RNA, 64 nt, Human; identical to SEQ ID NO: 220860

SEQ ID NO: 406455 - RNA, 64 nt, Human; identical to SEQ ID NO: 220861

SEQ ID NO: 406456 - RNA, 64 nt, Human; identical to SEQ ID NO: 220862

SEQ ID NO: 406457 - RNA, 61 nt, Human
cccuguucucuucacaccaaggaagcuccagauccaguaucuuguuuggccucaaaacaga

SEQ ID NO: 406458 - RNA, 61 nt, Human
agaguuugcagcugguaaaaccagaggcuacauccaguauuacugcuaagagacauucuuc

SEQ ID NO: 406459 - RNA, 61 nt, Human
uaaguaauauagaauuuuucuugcuagguaaauccaguaagccaauaauuuuaaagauucu

SEQ ID NO: 406460 - RNA, 64 nt, Human; identical to SEQ ID NO: 220863

SEQ ID NO: 406461 - RNA, 64 nt, Human; identical to SEQ ID NO: 220864

SEQ ID NO: 406462 - RNA, 64 nt, Human; identical to SEQ ID NO: 220865

SEQ ID NO: 406463 - RNA, 64 nt, Human; identical to SEQ ID NO: 220866

SEQ ID NO: 406464 - RNA, 54 nt, Human; identical to SEQ ID NO: 220867

SEQ ID NO: 406465 - RNA, 64 nt, Human; identical to SEQ ID NO: 220868

SEQ ID NO: 406466 - RNA, 64 nt, Human; identical to SEQ ID NO: 220869

SEQ ID NO: 406467 - RNA, 64 nt, Human; identical to SEQ ID NO: 220873

SEQ ID NO: 406468 - RNA, 64 nt, Human; identical to SEQ ID NO: 220874

SEQ ID NO: 406469 - RNA, 64 nt, Human; identical to SEQ ID NO: 220875

SEQ ID NO: 406470 - RNA, 64 nt, Human; identical to SEQ ID NO: 220876

SEQ ID NO: 406471 - RNA, 64 nt, Human; identical to SEQ ID NO: 220877

SEQ ID NO: 406472 - RNA, 64 nt, Human; identical to SEQ ID NO: 220878

SEQ ID NO: 406473 - RNA, 64 nt, Human; identical to SEQ ID NO: 220879

SEQ ID NO: 406474 - RNA, 64 nt, Human; identical to SEQ ID NO: 220880

SEQ ID NO: 406475 - RNA, 64 nt, Human; identical to SEQ ID NO: 220881

SEQ ID NO: 406476 - RNA, 61 nt, Human
ucccucuuuucuaaacaaguucuucugguucauccaguaaucucuuucuuuuuuaaaaaug

SEQ ID NO: 406477 - RNA, 61 nt, Human
auaccaaauacuuuuuguuuuuaacacagcuauccaguaaggcuaucaugaugugugcuaa

SEQ ID NO: 406478 - RNA, 61 nt, Human
cagaaggagggcaccacaccuaggaagguaaauccaguaucagaagguugcuaaaagauua

SEQ ID NO: 406479 - RNA, 64 nt, Human; identical to SEQ ID NO: 220882

SEQ ID NO: 406480 - RNA, 64 nt, Human; identical to SEQ ID NO: 220883

SEQ ID NO: 406481 - RNA, 64 nt, Human; identical to SEQ ID NO: 220884

SEQ ID NO: 406482 - RNA, 64 nt, Human; identical to SEQ ID NO: 220885

SEQ ID NO: 406483 - RNA, 64 nt, Human; identical to SEQ ID NO: 220886

SEQ ID NO: 406484 - RNA, 64 nt, Human; identical to SEQ ID NO: 220887

SEQ ID NO: 406485 - RNA, 64 nt, Human; identical to SEQ ID NO: 220891

SEQ ID NO: 406486 - RNA, 64 nt, Human; identical to SEQ ID NO: 220892

SEQ ID NO: 406487 - RNA, 64 nt, Human; identical to SEQ ID NO: 220893

SEQ ID NO: 406488 - RNA, 64 nt, Human; identical to SEQ ID NO: 220894

SEQ ID NO: 406489 - RNA, 64 nt, Human; identical to SEQ ID NO: 220895

SEQ ID NO: 406490 - RNA, 64 nt, Human; identical to SEQ ID NO: 220896

SEQ ID NO: 406491 - RNA, 64 nt, Human; identical to SEQ ID NO: 220897

SEQ ID NO: 406492 - RNA, 64 nt, Human; identical to SEQ ID NO: 220898

SEQ ID NO: 406493 - RNA, 64 nt, Human; identical to SEQ ID NO: 220899

SEQ ID NO: 406494 - RNA, 64 nt, Human; identical to SEQ ID NO: 220900

SEQ ID NO: 406495 - RNA, 61 nt, Human
aucagaaacuuaaaauauuucauaccguuugauccaguagcuucuucuaaaucauaaaugc

SEQ ID NO: 406496 - RNA, 61 nt, Human
aauggugaaugccuaugguggauccaaacugauccaguauaagacuacugaaucugcuacc

SEQ ID NO: 406497 - RNA, 61 nt, Human
uuaguccaugaacucauggcauuuugaauacauccaguacuuuaaaaaugacauauauauu

SEQ ID NO: 406498 - RNA, 64 nt, Human; identical to SEQ ID NO: 220901

SEQ ID NO: 406499 - RNA, 64 nt, Human; identical to SEQ ID NO: 220902

SEQ ID NO: 406500 - RNA, 64 nt, Human; identical to SEQ ID NO: 220903

SEQ ID NO: 406501 - RNA, 64 nt, Human; identical to SEQ ID NO: 220904

SEQ ID NO: 406502 - RNA, 64 nt, Human; identical to SEQ ID NO: 220905

SEQ ID NO: 406503 - RNA, 64 nt, Human; identical to SEQ ID NO: 220909

SEQ ID NO: 406504 - RNA, 64 nt, Human; identical to SEQ ID NO: 220910

SEQ ID NO: 406505 - RNA, 64 nt, Human; identical to SEQ ID NO: 220911

SEQ ID NO: 406506 - RNA, 64 nt, Human; identical to SEQ ID NO: 220912

SEQ ID NO: 406507 - RNA, 64 nt, Human; identical to SEQ ID NO: 220913

SEQ ID NO: 406508 - RNA, 64 nt, Human; identical to SEQ ID NO: 220914

SEQ ID NO: 406509 - RNA, 64 nt, Human; identical to SEQ ID NO: 220915

SEQ ID NO: 406510 - RNA, 64 nt, Human; identical to SEQ ID NO: 220916

SEQ ID NO: 406511 - RNA, 64 nt, Human; identical to SEQ ID NO: 220917

SEQ ID NO: 406512 - RNA, 64 nt, Human; identical to SEQ ID NO: 220918

SEQ ID NO: 406513 - RNA, 64 nt, Human; identical to SEQ ID NO: 220919

SEQ ID NO: 406514 - RNA, 61 nt, Human
uguagaacuggucauagaggaagagcuagaaauccaguagcaugauuuuuaaauaaccugu

SEQ ID NO: 406515 - RNA, 61 nt, Human
auccagucaauaguugaaaaguuuucacauaauccaguauuggcaucagagccagaaaugc

SEQ ID NO: 406516 - RNA, 61 nt, Human
aacugccacuguacuggacuguaauuuauaaauccaguagcuacgcaggguggaggcuggg

SEQ ID NO: 406517 - RNA, 64 nt, Human; identical to SEQ ID NO: 220920

SEQ ID NO: 406518 - RNA, 64 nt, Human; identical to SEQ ID NO: 220921

SEQ ID NO: 406519 - RNA, 64 nt, Human; identical to SEQ ID NO: 220922

SEQ ID NO: 406520 - RNA, 64 nt, Human; identical to SEQ ID NO: 220923

SEQ ID NO: 406521 - RNA, 64 nt, Human; identical to SEQ ID NO: 220927

SEQ ID NO: 406522 - RNA, 64 nt, Human; identical to SEQ ID NO: 220928

SEQ ID NO: 406523 - RNA, 64 nt, Human; identical to SEQ ID NO: 220929

SEQ ID NO: 406524 - RNA, 64 nt, Human; identical to SEQ ID NO: 220930

SEQ ID NO: 406525 - RNA, 64 nt, Human; identical to SEQ ID NO: 220931

SEQ ID NO: 406526 - RNA, 64 nt, Human; identical to SEQ ID NO: 220932

SEQ ID NO: 406527 - RNA, 64 nt, Human; identical to SEQ ID NO: 220933

SEQ ID NO: 406528 - RNA, 64 nt, Human; identical to SEQ ID NO: 220934

SEQ ID NO: 406529 - RNA, 64 nt, Human; identical to SEQ ID NO: 220935

SEQ ID NO: 406530 - RNA, 64 nt, Human; identical to SEQ ID NO: 220936

SEQ ID NO: 406531 - RNA, 64 nt, Human; identical to SEQ ID NO: 220937

SEQ ID NO: 406532 - RNA, 64 nt, Human; identical to SEQ ID NO: 220938

SEQ ID NO: 406533 - RNA, 61 nt, Human
aauuuuugucagacacaguauuuuagggugcauccaguauaccauugagcauuguaaccuc

SEQ ID NO: 406534 - RNA, 61 nt, Human
uuucuacccucaagauacucccagauccuaaauccaguagccucccaggcaaaauauagca

SEQ ID NO: 406535 - RNA, 61 nt, Human
gcaacugaauacuugaaguaggaaguaggaaauccaguagggaaaauaggguccuugaaac

SEQ ID NO: 406536 - RNA, 64 nt, Human; identical to SEQ ID NO: 220939

SEQ ID NO: 406537 - RNA, 64 nt, Human; identical to SEQ ID NO: 220940

SEQ ID NO: 406538 - RNA, 64 nt, Human; identical to SEQ ID NO: 220941

SEQ ID NO: 406539 - RNA, 64 nt, Human; identical to SEQ ID NO: 220945

SEQ ID NO: 406540 - RNA, 64 nt, Human; identical to SEQ ID NO: 220946

SEQ ID NO: 406541 - RNA, 64 nt, Human; identical to SEQ ID NO: 220947

SEQ ID NO: 406542 - RNA, 64 nt, Human; identical to SEQ ID NO: 220948

SEQ ID NO: 406543 - RNA, 64 nt, Human; identical to SEQ ID NO: 220949

SEQ ID NO: 406544 - RNA, 64 nt, Human; identical to SEQ ID NO: 220950

SEQ ID NO: 406545 - RNA, 64 nt, Human; identical to SEQ ID NO: 220951

SEQ ID NO: 406546 - RNA, 64 nt, Human; identical to SEQ ID NO: 220952

SEQ ID NO: 406547 - RNA, 64 nt, Human; identical to SEQ ID NO: 220953

SEQ ID NO: 406548 - RNA, 64 nt, Human; identical to SEQ ID NO: 220954

SEQ ID NO: 406549 - RNA, 64 nt, Human; identical to SEQ ID NO: 220955

SEQ ID NO: 406550 - RNA, 64 nt, Human; identical to SEQ ID NO: 220956

SEQ ID NO: 406551 - RNA, 64 nt, Human; identical to SEQ ID NO: 220957

SEQ ID NO: 406552 - RNA, 61 nt, Human
ugcaguauuuauagacuucuaagguuuuaaaauccaguaucaagaagaaaaucagaaauac

SEQ ID NO: 406553 - RNA, 61 nt, Human
uuuuuaaaaaaaaaaaaucuuagucccuguuauccaguagggguggguauuuggguccgac

SEQ ID NO: 406554 - RNA, 61 nt, Human
guguauccgauaccccacucuggaaggaaccauccaguaaaggucuuucagaaccacuaag

SEQ ID NO: 406555 - RNA, 64 nt, Human; identical to SEQ ID NO: 220958

SEQ ID NO: 406556 - RNA, 64 nt, Human; identical to SEQ ID NO: 220959

SEQ ID NO: 406557 - RNA, 64 nt, Human; identical to SEQ ID NO: 220963

SEQ ID NO: 406558 - RNA, 64 nt, Human; identical to SEQ ID NO: 220964

SEQ ID NO: 406559 - RNA, 64 nt, Human; identical to SEQ ID NO: 220965

SEQ ID NO: 406560 - RNA, 64 nt, Human; identical to SEQ ID NO: 220966

SEQ ID NO: 406561 - RNA, 64 nt, Human; identical to SEQ ID NO: 220967

SEQ ID NO: 406562 - RNA, 64 nt, Human; identical to SEQ ID NO: 220968

SEQ ID NO: 406563 - RNA, 64 nt, Human; identical to SEQ ID NO: 220969

SEQ ID NO: 406564 - RNA, 64 nt, Human; identical to SEQ ID NO: 220970

SEQ ID NO: 406565 - RNA, 64 nt, Human; identical to SEQ ID NO: 220971

SEQ ID NO: 406566 - RNA, 64 nt, Human; identical to SEQ ID NO: 220972

SEQ ID NO: 406567 - RNA, 64 nt, Human; identical to SEQ ID NO: 220973

SEQ ID NO: 406568 - RNA, 64 nt, Human; identical to SEQ ID NO: 220974

SEQ ID NO: 406569 - RNA, 64 nt, Human; identical to SEQ ID NO: 220975

SEQ ID NO: 406570 - RNA, 64 nt, Human; identical to SEQ ID NO: 220976

SEQ ID NO: 406571 - RNA, 61 nt, Human
uuuccuucuuucuuuucaccuuuagguuaauauccaguauuauguguuaucccuuuggaua

SEQ ID NO: 406572 - RNA, 61 nt, Human
uucugagaacuuauuccugaugaucaauugaauccaguaguuuuucuaugcuauuuguugu

SEQ ID NO: 406573 - RNA, 61 nt, Human
aggauuaacuguucuuuauuuauaagugcuuauccaguagaauuaauaaguaccugaugcg

SEQ ID NO: 406574 - RNA, 64 nt, Human; identical to SEQ ID NO: 220977

SEQ ID NO: 406575 - RNA, 59 nt, Human; identical to SEQ ID NO: 220981

SEQ ID NO: 406576 - RNA, 64 nt, Human; identical to SEQ ID NO: 220982

SEQ ID NO: 406577 - RNA, 64 nt, Human; identical to SEQ ID NO: 220983

SEQ ID NO: 406578 - RNA, 64 nt, Human; identical to SEQ ID NO: 220984

SEQ ID NO: 406579 - RNA, 64 nt, Human; identical to SEQ ID NO: 220985

SEQ ID NO: 406580 - RNA, 64 nt, Human; identical to SEQ ID NO: 220986

SEQ ID NO: 406581 - RNA, 64 nt, Human; identical to SEQ ID NO: 220987

SEQ ID NO: 406582 - RNA, 64 nt, Human; identical to SEQ ID NO: 220988

SEQ ID NO: 406583 - RNA, 64 nt, Human; identical to SEQ ID NO: 220989

SEQ ID NO: 406584 - RNA, 64 nt, Human; identical to SEQ ID NO: 220990

SEQ ID NO: 406585 - RNA, 64 nt, Human; identical to SEQ ID NO: 220991

SEQ ID NO: 406586 - RNA, 51 nt, Human; identical to SEQ ID NO: 220992

SEQ ID NO: 406587 - RNA, 64 nt, Human; identical to SEQ ID NO: 220993

SEQ ID NO: 406588 - RNA, 64 nt, Human; identical to SEQ ID NO: 220994

SEQ ID NO: 406589 - RNA, 64 nt, Human; identical to SEQ ID NO: 220995

SEQ ID NO: 406590 - RNA, 64 nt, Human
caaaaauguucugugugucaggaaagaggugugagagugguaggcagccugccgcaaacacacg

SEQ ID NO: 406591 - RNA, 64 nt, Human
ugaaaauuuugucugcuaaaaaguuucugcuacagagugguagaugaaguuauaucaugggguc

SEQ ID NO: 406592 - RNA, 61 nt, Human
gcuaauuuacgugaaacugauuaguugcaaaauccaguagguuaaaauacucacauauuuu

SEQ ID NO: 406593 - RNA, 64 nt, Human; identical to SEQ ID NO: 220999

SEQ ID NO: 406594 - RNA, 64 nt, Human; identical to SEQ ID NO: 221000

SEQ ID NO: 406595 - RNA, 64 nt, Human; identical to SEQ ID NO: 221001

SEQ ID NO: 406596 - RNA, 64 nt, Human; identical to SEQ ID NO: 221002

SEQ ID NO: 406597 - RNA, 64 nt, Human; identical to SEQ ID NO: 221003

SEQ ID NO: 406598 - RNA, 64 nt, Human; identical to SEQ ID NO: 221004

SEQ ID NO: 406599 - RNA, 64 nt, Human; identical to SEQ ID NO: 221005

SEQ ID NO: 406600 - RNA, 64 nt, Human; identical to SEQ ID NO: 221006

SEQ ID NO: 406601 - RNA, 64 nt, Human; identical to SEQ ID NO: 221007

SEQ ID NO: 406602 - RNA, 64 nt, Human; identical to SEQ ID NO: 221008

SEQ ID NO: 406603 - RNA, 64 nt, Human; identical to SEQ ID NO: 221009

SEQ ID NO: 406604 - RNA, 64 nt, Human; identical to SEQ ID NO: 221010

SEQ ID NO: 406605 - RNA, 64 nt, Human; identical to SEQ ID NO: 221011

SEQ ID NO: 406606 - RNA, 64 nt, Human; identical to SEQ ID NO: 221012

SEQ ID NO: 406607 - RNA, 54 nt, Human; identical to SEQ ID NO: 221013

SEQ ID NO: 406608 - RNA, 64 nt, Human; identical to SEQ ID NO: 221017

SEQ ID NO: 406609 - RNA, 61 nt, Human
ucaguuuggauaauuggucaaacaauuuuuuauccaguaguaaaauauguaaccauugucc

SEQ ID NO: 406610 - RNA, 61 nt, Human
uuguguguuuauugucaaaguggugagaggcauccaguaucuugaagacuuuucuuucagc

SEQ ID NO: 406611 - RNA, 61 nt, Human
ccugggccaagugcugggacuaugguacuaaauccaguagaugggcuguguagcaacucuc

SEQ ID NO: 406612 - RNA, 64 nt, Human; identical to SEQ ID NO: 221018

SEQ ID NO: 406613 - RNA, 64 nt, Human; identical to SEQ ID NO: 221019

SEQ ID NO: 406614 - RNA, 64 nt, Human; identical to SEQ ID NO: 221020

SEQ ID NO: 406615 - RNA, 64 nt, Human; identical to SEQ ID NO: 221021

SEQ ID NO: 406616 - RNA, 64 nt, Human; identical to SEQ ID NO: 221022

SEQ ID NO: 406617 - RNA, 64 nt, Human; identical to SEQ ID NO: 221023

SEQ ID NO: 406618 - RNA, 64 nt, Human; identical to SEQ ID NO: 221024

SEQ ID NO: 406619 - RNA, 64 nt, Human; identical to SEQ ID NO: 221025

SEQ ID NO: 406620 - RNA, 64 nt, Human; identical to SEQ ID NO: 221026

SEQ ID NO: 406621 - RNA, 64 nt, Human; identical to SEQ ID NO: 221027

SEQ ID NO: 406622 - RNA, 64 nt, Human; identical to SEQ ID NO: 221028

SEQ ID NO: 406623 - RNA, 64 nt, Human; identical to SEQ ID NO: 221029

SEQ ID NO: 406624 - RNA, 64 nt, Human; identical to SEQ ID NO: 221030

SEQ ID NO: 406625 - RNA, 57 nt, Human; identical to SEQ ID NO: 221031

SEQ ID NO: 406626 - RNA, 64 nt, Human; identical to SEQ ID NO: 221035

SEQ ID NO: 406627 - RNA, 64 nt, Human; identical to SEQ ID NO: 221036

SEQ ID NO: 406628 - RNA, 64 nt, Human
ccuaggcucucuguagagagucuucaagaucccggagugguagcgcugucuccuggugaaggag

SEQ ID NO: 406629 - RNA, 64 nt, Human
gggagugucccccucccagaagcauaucccagaugagugguacauuauauaaggauuuuuuuua

SEQ ID NO: 406630 - RNA, 64 nt, Human
uccuaaaagugucugauguuuuuacucaagaggggagugguaaaauuaaauacucuauuguuca

SEQ ID NO: 406631 - RNA, 64 nt, Human; identical to SEQ ID NO: 221037

SEQ ID NO: 406632 - RNA, 64 nt, Human; identical to SEQ ID NO: 221038

SEQ ID NO: 406633 - RNA, 64 nt, Human; identical to SEQ ID NO: 221039

SEQ ID NO: 406634 - RNA, 64 nt, Human; identical to SEQ ID NO: 221040

SEQ ID NO: 406635 - RNA, 64 nt, Human; identical to SEQ ID NO: 221041

SEQ ID NO: 406636 - RNA, 64 nt, Human; identical to SEQ ID NO: 221042

SEQ ID NO: 406637 - RNA, 64 nt, Human; identical to SEQ ID NO: 221043

SEQ ID NO: 406638 - RNA, 64 nt, Human; identical to SEQ ID NO: 221044

SEQ ID NO: 406639 - RNA, 64 nt, Human; identical to SEQ ID NO: 221045

SEQ ID NO: 406640 - RNA, 64 nt, Human; identical to SEQ ID NO: 221046

SEQ ID NO: 406641 - RNA, 64 nt, Human; identical to SEQ ID NO: 221047

SEQ ID NO: 406642 - RNA, 64 nt, Human; identical to SEQ ID NO: 221048

SEQ ID NO: 406643 - RNA, 64 nt, Human; identical to SEQ ID NO: 221049

SEQ ID NO: 406644 - RNA, 64 nt, Human; identical to SEQ ID NO: 221053

SEQ ID NO: 406645 - RNA, 64 nt, Human; identical to SEQ ID NO: 221054

SEQ ID NO: 406646 - RNA, 64 nt, Human; identical to SEQ ID NO: 221055

SEQ ID NO: 406647 - RNA, 64 nt, Human
ucucgguagcuuugaaucuuaagcuucuacgggagagugguagaacuggaucauuuccuaaucc

SEQ ID NO: 406648 - RNA, 64 nt, Human
augugggguuuauaccccuccccugaugaauacagagugguagcuagggguugguuaucaucag

SEQ ID NO: 406649 - RNA, 64 nt, Human
uguguugugucuugcauuaaaaaaaaaaauuugagagugguagaauuacuucuguuaucugaaa

SEQ ID NO: 406650 - RNA, 64 nt, Human; identical to SEQ ID NO: 221056

SEQ ID NO: 406651 - RNA, 64 nt, Human; identical to SEQ ID NO: 221057

SEQ ID NO: 406652 - RNA, 64 nt, Human; identical to SEQ ID NO: 221058

SEQ ID NO: 406653 - RNA, 64 nt, Human; identical to SEQ ID NO: 221059

SEQ ID NO: 406654 - RNA, 64 nt, Human; identical to SEQ ID NO: 221060

SEQ ID NO: 406655 - RNA, 64 nt, Human; identical to SEQ ID NO: 221061

SEQ ID NO: 406656 - RNA, 64 nt, Human; identical to SEQ ID NO: 221062

SEQ ID NO: 406657 - RNA, 60 nt, Human; identical to SEQ ID NO: 221063

SEQ ID NO: 406658 - RNA, 64 nt, Human; identical to SEQ ID NO: 221064

SEQ ID NO: 406659 - RNA, 64 nt, Human; identical to SEQ ID NO: 221065

SEQ ID NO: 406660 - RNA, 64 nt, Human; identical to SEQ ID NO: 221066

SEQ ID NO: 406661 - RNA, 64 nt, Human; identical to SEQ ID NO: 221067

SEQ ID NO: 406662 - RNA, 64 nt, Human; identical to SEQ ID NO: 221071

SEQ ID NO: 406663 - RNA, 64 nt, Human; identical to SEQ ID NO: 221072

SEQ ID NO: 406664 - RNA, 64 nt, Human; identical to SEQ ID NO: 221073

SEQ ID NO: 406665 - RNA, 64 nt, Human; identical to SEQ ID NO: 221074

SEQ ID NO: 406666 - RNA, 64 nt, Human
aguuuucuuuuguuagaaauuguuagagaauagagagugguaauucagauuuggucaacgauuc

SEQ ID NO: 406667 - RNA, 64 nt, Human
aaagaaacgguuguuuuaacccaaaucauuaccagagugguaaagcagacaugugagaaguaag

SEQ ID NO: 406668 - RNA, 61 nt, Human
ccuuggacaaaaaggcuaccuaccacgugcuauccaguaauauacuuaaauaagccaauac

SEQ ID NO: 406669 - RNA, 64 nt, Human; identical to SEQ ID NO: 221075

SEQ ID NO: 406670 - RNA, 64 nt, Human; identical to SEQ ID NO: 221076

SEQ ID NO: 406671 - RNA, 64 nt, Human; identical to SEQ ID NO: 221077

SEQ ID NO: 406672 - RNA, 64 nt, Human; identical to SEQ ID NO: 221078

SEQ ID NO: 406673 - RNA, 64 nt, Human; identical to SEQ ID NO: 221079

SEQ ID NO: 406674 - RNA, 64 nt, Human; identical to SEQ ID NO: 221080

SEQ ID NO: 406675 - RNA, 64 nt, Human; identical to SEQ ID NO: 221081

SEQ ID NO: 406676 - RNA, 64 nt, Human; identical to SEQ ID NO: 221082

SEQ ID NO: 406677 - RNA, 64 nt, Human; identical to SEQ ID NO: 221083

SEQ ID NO: 406678 - RNA, 64 nt, Human; identical to SEQ ID NO: 221084

SEQ ID NO: 406679 - RNA, 64 nt, Human; identical to SEQ ID NO: 221085

SEQ ID NO: 406680 - RNA, 64 nt, Human; identical to SEQ ID NO: 221089

SEQ ID NO: 406681 - RNA, 64 nt, Human; identical to SEQ ID NO: 221090

SEQ ID NO: 406682 - RNA, 64 nt, Human; identical to SEQ ID NO: 221091

SEQ ID NO: 406683 - RNA, 64 nt, Human; identical to SEQ ID NO: 221092

SEQ ID NO: 406684 - RNA, 64 nt, Human; identical to SEQ ID NO: 221093

SEQ ID NO: 406685 - RNA, 64 nt, Human
aucuuuagcccaaaguaacuaguaaaaauaaauggagugguauccuaucuucuuuuuuuaagga

SEQ ID NO: 406686 - RNA, 64 nt, Human
cauuucauuaguggaucaggaaaugaugacuuacgagugguauuuacccaagauggcaaagcac

SEQ ID NO: 406687 - RNA, 64 nt, Human
cccaccggggacuggacacaaacaggaaugucuggagugguaacagcucucuucuuacucauua

SEQ ID NO: 406688 - RNA, 64 nt, Human; identical to SEQ ID NO: 221094

SEQ ID NO: 406689 - RNA, 64 nt, Human; identical to SEQ ID NO: 221095

SEQ ID NO: 406690 - RNA, 64 nt, Human; identical to SEQ ID NO: 221096

SEQ ID NO: 406691 - RNA, 64 nt, Human; identical to SEQ ID NO: 221097

SEQ ID NO: 406692 - RNA, 64 nt, Human; identical to SEQ ID NO: 221098

SEQ ID NO: 406693 - RNA, 64 nt, Human; identical to SEQ ID NO: 221099

SEQ ID NO: 406694 - RNA, 64 nt, Human; identical to SEQ ID NO: 221100

SEQ ID NO: 406695 - RNA, 64 nt, Human; identical to SEQ ID NO: 221101

SEQ ID NO: 406696 - RNA, 64 nt, Human; identical to SEQ ID NO: 221102

SEQ ID NO: 406697 - RNA, 64 nt, Human; identical to SEQ ID NO: 221103

SEQ ID NO: 406698 - RNA, 64 nt, Human; identical to SEQ ID NO: 221107

SEQ ID NO: 406699 - RNA, 64 nt, Human; identical to SEQ ID NO: 221108

SEQ ID NO: 406700 - RNA, 62 nt, Human; identical to SEQ ID NO: 221109

SEQ ID NO: 406701 - RNA, 64 nt, Human; identical to SEQ ID NO: 221110

SEQ ID NO: 406702 - RNA, 64 nt, Human; identical to SEQ ID NO: 221111

SEQ ID NO: 406703 - RNA, 64 nt, Human; identical to SEQ ID NO: 221112

SEQ ID NO: 406704 - RNA, 64 nt, Human
gacugagucucauucuaucacccaggcuggaguggagugguaugaucuugacucacugcaacau

SEQ ID NO: 406705 - RNA, 64 nt, Human
gagacagugagauacucagggcguuguuaacagggagugguauuugaaguguccagcaguugcu

SEQ ID NO: 406706 - RNA, 64 nt, Human
uugggcaguugugggaacuucugagaguauuacagagugguagaaucgguaagaacucugauuu

SEQ ID NO: 406707 - RNA, 64 nt, Human; identical to SEQ ID NO: 221113

SEQ ID NO: 406708 - RNA, 64 nt, Human; identical to SEQ ID NO: 221114

SEQ ID NO: 406709 - RNA, 50 nt, Human; identical to SEQ ID NO: 221115

SEQ ID NO: 406710 - RNA, 64 nt, Human; identical to SEQ ID NO: 221116

SEQ ID NO: 406711 - RNA, 64 nt, Human; identical to SEQ ID NO: 221117

SEQ ID NO: 406712 - RNA, 64 nt, Human; identical to SEQ ID NO: 221118

SEQ ID NO: 406713 - RNA, 64 nt, Human; identical to SEQ ID NO: 221119

SEQ ID NO: 406714 - RNA, 64 nt, Human; identical to SEQ ID NO: 221120

SEQ ID NO: 406715 - RNA, 64 nt, Human; identical to SEQ ID NO: 221121

SEQ ID NO: 406716 - RNA, 64 nt, Human; identical to SEQ ID NO: 221125

SEQ ID NO: 406717 - RNA, 64 nt, Human; identical to SEQ ID NO: 221126

SEQ ID NO: 406718 - RNA, 64 nt, Human; identical to SEQ ID NO: 221127

SEQ ID NO: 406719 - RNA, 64 nt, Human; identical to SEQ ID NO: 221128

SEQ ID NO: 406720 - RNA, 64 nt, Human; identical to SEQ ID NO: 221129

SEQ ID NO: 406721 - RNA, 64 nt, Human; identical to SEQ ID NO: 221130

SEQ ID NO: 406722 - RNA, 64 nt, Human; identical to SEQ ID NO: 221131

SEQ ID NO: 406723 - RNA, 64 nt, Human
gacccccaucacuugaugggccacacaaguuugagagugguacaagggagaaguuugggaaaag

SEQ ID NO: 406724 - RNA, 64 nt, Human
uaccaccagcacccugcgggcccggggucuggcagagugguaugggcaccccaccccugggcug

SEQ ID NO: 406725 - RNA, 64 nt, Human
caaggcacaggcacgugcucugggaaauagacaggagugguauuuccgcccucucggagggcug

SEQ ID NO: 406726 - RNA, 64 nt, Human; identical to SEQ ID NO: 221132

SEQ ID NO: 406727 - RNA, 64 nt, Human; identical to SEQ ID NO: 221133

SEQ ID NO: 406728 - RNA, 64 nt, Human; identical to SEQ ID NO: 221134

SEQ ID NO: 406729 - RNA, 64 nt, Human; identical to SEQ ID NO: 221135

SEQ ID NO: 406730 - RNA, 64 nt, Human; identical to SEQ ID NO: 221136

SEQ ID NO: 406731 - RNA, 64 nt, Human; identical to SEQ ID NO: 221137

SEQ ID NO: 406732 - RNA, 64 nt, Human; identical to SEQ ID NO: 221138

SEQ ID NO: 406733 - RNA, 64 nt, Human; identical to SEQ ID NO: 221139

SEQ ID NO: 406734 - RNA, 64 nt, Human; identical to SEQ ID NO: 221143

SEQ ID NO: 406735 - RNA, 64 nt, Human; identical to SEQ ID NO: 221144

SEQ ID NO: 406736 - RNA, 64 nt, Human; identical to SEQ ID NO: 221145

SEQ ID NO: 406737 - RNA, 64 nt, Human; identical to SEQ ID NO: 221146

SEQ ID NO: 406738 - RNA, 64 nt, Human; identical to SEQ ID NO: 221147

SEQ ID NO: 406739 - RNA, 64 nt, Human; identical to SEQ ID NO: 221148

SEQ ID NO: 406740 - RNA, 64 nt, Human; identical to SEQ ID NO: 221149

SEQ ID NO: 406741 - RNA, 64 nt, Human; identical to SEQ ID NO: 221150

SEQ ID NO: 406742 - RNA, 64 nt, Human
guaaucugaggguuaauuucuaggcagguggagagagugguaaaaaagaaaugaaauugacaag

SEQ ID NO: 406743 - RNA, 64 nt, Human
ucugaucccuacucaugacacggaggugacucgugagugguaccaacaaacucaugagcagcag

SEQ ID NO: 406744 - RNA, 61 nt, Human
cuaagguauucuagaccuaucuuagagcagcauccaguauuugcuuucuagauaauaugcc

SEQ ID NO: 406745 - RNA, 64 nt, Human; identical to SEQ ID NO: 221151

SEQ ID NO: 406746 - RNA, 64 nt, Human; identical to SEQ ID NO: 221152

SEQ ID NO: 406747 - RNA, 64 nt, Human; identical to SEQ ID NO: 221153

SEQ ID NO: 406748 - RNA, 64 nt, Human; identical to SEQ ID NO: 221154

SEQ ID NO: 406749 - RNA, 64 nt, Human; identical to SEQ ID NO: 221155

SEQ ID NO: 406750 - RNA, 64 nt, Human; identical to SEQ ID NO: 221156

SEQ ID NO: 406751 - RNA, 64 nt, Human; identical to SEQ ID NO: 221157

SEQ ID NO: 406752 - RNA, 64 nt, Human; identical to SEQ ID NO: 221161

SEQ ID NO: 406753 - RNA, 59 nt, Human; identical to SEQ ID NO: 221162

SEQ ID NO: 406754 - RNA, 64 nt, Human; identical to SEQ ID NO: 221163

SEQ ID NO: 406755 - RNA, 64 nt, Human; identical to SEQ ID NO: 221164

SEQ ID NO: 406756 - RNA, 64 nt, Human; identical to SEQ ID NO: 221165

SEQ ID NO: 406757 - RNA, 64 nt, Human; identical to SEQ ID NO: 221166

SEQ ID NO: 406758 - RNA, 64 nt, Human; identical to SEQ ID NO: 221167

SEQ ID NO: 406759 - RNA, 64 nt, Human; identical to SEQ ID NO: 221168

SEQ ID NO: 406760 - RNA, 64 nt, Human; identical to SEQ ID NO: 221169

SEQ ID NO: 406761 - RNA, 64 nt, Human
ugcucuaguucuuucuuuuugaagagagugacuggagugguaaagauggaaaugcuggaaauga

SEQ ID NO: 406762 - RNA, 64 nt, Human
ucgugagcaggaaaaucagaggagccacugaucugagugguauuuagguugaaggaaagauuuc

SEQ ID NO: 406763 - RNA, 64 nt, Human
cccuauugcuucuaaguuguaacaaccaaccauugagugguacuuauaucugaaaauucagauu

SEQ ID NO: 406764 - RNA, 64 nt, Human; identical to SEQ ID NO: 221170

SEQ ID NO: 406765 - RNA, 64 nt, Human; identical to SEQ ID NO: 221171

SEQ ID NO: 406766 - RNA, 64 nt, Human; identical to SEQ ID NO: 221172

SEQ ID NO: 406767 - RNA, 64 nt, Human; identical to SEQ ID NO: 221173

SEQ ID NO: 406768 - RNA, 64 nt, Human; identical to SEQ ID NO: 221174

SEQ ID NO: 406769 - RNA, 64 nt, Human; identical to SEQ ID NO: 221175

SEQ ID NO: 406770 - RNA, 64 nt, Human; identical to SEQ ID NO: 221179

SEQ ID NO: 406771 - RNA, 64 nt, Human; identical to SEQ ID NO: 221180

SEQ ID NO: 406772 - RNA, 64 nt, Human; identical to SEQ ID NO: 221181

SEQ ID NO: 406773 - RNA, 64 nt, Human; identical to SEQ ID NO: 221182

SEQ ID NO: 406774 - RNA, 64 nt, Human; identical to SEQ ID NO: 221183

SEQ ID NO: 406775 - RNA, 64 nt, Human; identical to SEQ ID NO: 221184

SEQ ID NO: 406776 - RNA, 64 nt, Human; identical to SEQ ID NO: 221185

SEQ ID NO: 406777 - RNA, 64 nt, Human; identical to SEQ ID NO: 221186

SEQ ID NO: 406778 - RNA, 64 nt, Human; identical to SEQ ID NO: 221187

SEQ ID NO: 406779 - RNA, 64 nt, Human; identical to SEQ ID NO: 221188

SEQ ID NO: 406780 - RNA, 64 nt, Human
gggggaggaagucccuaguuuaaaauguauaacugagugguagaucaguacuuucagcacacug

SEQ ID NO: 406781 - RNA, 64 nt, Human
gaaauaguaauuugauuauuucauucaugaagcggagugguaguuauccuucuauugagaggga

SEQ ID NO: 406782 - RNA, 64 nt, Human
gugggagggcgagcugagaacacauggacuagcugagugguagcgguaguugggacgagaagcg

SEQ ID NO: 406783 - RNA, 64 nt, Human; identical to SEQ ID NO: 221189

SEQ ID NO: 406784 - RNA, 64 nt, Human; identical to SEQ ID NO: 221190

SEQ ID NO: 406785 - RNA, 64 nt, Human; identical to SEQ ID NO: 221191

SEQ ID NO: 406786 - RNA, 64 nt, Human; identical to SEQ ID NO: 221192

SEQ ID NO: 406787 - RNA, 64 nt, Human; identical to SEQ ID NO: 221193

SEQ ID NO: 406788 - RNA, 64 nt, Human; identical to SEQ ID NO: 221197

SEQ ID NO: 406789 - RNA, 64 nt, Human; identical to SEQ ID NO: 221198

SEQ ID NO: 406790 - RNA, 64 nt, Human; identical to SEQ ID NO: 221199

SEQ ID NO: 406791 - RNA, 63 nt, Human; identical to SEQ ID NO: 221200

SEQ ID NO: 406792 - RNA, 64 nt, Human; identical to SEQ ID NO: 221201

SEQ ID NO: 406793 - RNA, 64 nt, Human; identical to SEQ ID NO: 221202

SEQ ID NO: 406794 - RNA, 64 nt, Human; identical to SEQ ID NO: 221203

SEQ ID NO: 406795 - RNA, 64 nt, Human; identical to SEQ ID NO: 221204

SEQ ID NO: 406796 - RNA, 64 nt, Human; identical to SEQ ID NO: 221205

SEQ ID NO: 406797 - RNA, 64 nt, Human; identical to SEQ ID NO: 221206

SEQ ID NO: 406798 - RNA, 64 nt, Human; identical to SEQ ID NO: 221207

SEQ ID NO: 406799 - RNA, 64 nt, Human
aaagcaauuccaaauagauguauacaucuagagagagugguauuagagauucaguguauguauu

SEQ ID NO: 406800 - RNA, 64 nt, Human
gagaucuaaucccuucaaggaagugauaacacuggagugguaacaagaggagcaggaagcaagg

SEQ ID NO: 406801 - RNA, 64 nt, Human
ugaccacucccuuugggaggccugagguagaggggagugguauguguuuucucaguggaagcag

SEQ ID NO: 406802 - RNA, 64 nt, Human; identical to SEQ ID NO: 221208

SEQ ID NO: 406803 - RNA, 64 nt, Human; identical to SEQ ID NO: 221209

SEQ ID NO: 406804 - RNA, 64 nt, Human; identical to SEQ ID NO: 221210

SEQ ID NO: 406805 - RNA, 64 nt, Human; identical to SEQ ID NO: 221211

SEQ ID NO: 406806 - RNA, 64 nt, Human; identical to SEQ ID NO: 221215

SEQ ID NO: 406807 - RNA, 64 nt, Human; identical to SEQ ID NO: 221216

SEQ ID NO: 406808 - RNA, 64 nt, Human; identical to SEQ ID NO: 221217

SEQ ID NO: 406809 - RNA, 64 nt, Human; identical to SEQ ID NO: 221218

SEQ ID NO: 406810 - RNA, 64 nt, Human; identical to SEQ ID NO: 221219

SEQ ID NO: 406811 - RNA, 64 nt, Human; identical to SEQ ID NO: 221220

SEQ ID NO: 406812 - RNA, 64 nt, Human; identical to SEQ ID NO: 221221

SEQ ID NO: 406813 - RNA, 64 nt, Human; identical to SEQ ID NO: 221222

SEQ ID NO: 406814 - RNA, 64 nt, Human; identical to SEQ ID NO: 221223

SEQ ID NO: 406815 - RNA, 64 nt, Human; identical to SEQ ID NO: 221224

SEQ ID NO: 406816 - RNA, 64 nt, Human; identical to SEQ ID NO: 221225

SEQ ID NO: 406817 - RNA, 64 nt, Human; identical to SEQ ID NO: 221226

SEQ ID NO: 406818 - RNA, 64 nt, Human
aucuucugccggcugccccagaggacaguggguggagugguaccuacuuauuaaaugucucaga

SEQ ID NO: 406819 - RNA, 64 nt, Human
gacuagaggacuucuccagacaugauucuucauagagugguaauacaauuuauaguacaaucac

SEQ ID NO: 406820 - RNA, 64 nt, Human
augccauauuuaaauguccaccaauaugauuucugagugguaaaccucaaauaugaauuuuaaa

SEQ ID NO: 406821 - RNA, 64 nt, Human; identical to SEQ ID NO: 221227

SEQ ID NO: 406822 - RNA, 64 nt, Human; identical to SEQ ID NO: 221228

SEQ ID NO: 406823 - RNA, 64 nt, Human; identical to SEQ ID NO: 221229

SEQ ID NO: 406824 - RNA, 64 nt, Human; identical to SEQ ID NO: 221233

SEQ ID NO: 406825 - RNA, 64 nt, Human; identical to SEQ ID NO: 221234

SEQ ID NO: 406826 - RNA, 64 nt, Human; identical to SEQ ID NO: 221235

SEQ ID NO: 406827 - RNA, 64 nt, Human; identical to SEQ ID NO: 221236

SEQ ID NO: 406828 - RNA, 64 nt, Human; identical to SEQ ID NO: 221237

SEQ ID NO: 406829 - RNA, 64 nt, Human; identical to SEQ ID NO: 221238

SEQ ID NO: 406830 - RNA, 64 nt, Human; identical to SEQ ID NO: 221239

SEQ ID NO: 406831 - RNA, 64 nt, Human; identical to SEQ ID NO: 221240

SEQ ID NO: 406832 - RNA, 64 nt, Human; identical to SEQ ID NO: 221241

SEQ ID NO: 406833 - RNA, 64 nt, Human; identical to SEQ ID NO: 221242

SEQ ID NO: 406834 - RNA, 64 nt, Human; identical to SEQ ID NO: 221243

SEQ ID NO: 406835 - RNA, 64 nt, Human; identical to SEQ ID NO: 221244

SEQ ID NO: 406836 - RNA, 64 nt, Human; identical to SEQ ID NO: 221245

SEQ ID NO: 406837 - RNA, 64 nt, Human
auggaaaaaugugaagaucuuuggagauucucuugagugguauaucuaauugaaaugggaucuu

SEQ ID NO: 406838 - RNA, 64 nt, Human
uauaccuuauuguaaugaauguuccaaaaugguagagugguagaaaacgccagaguaguuuaga

SEQ ID NO: 406839 - RNA, 64 nt, Human
agguuucuguagcauuaaauugugaagacaacuggagugguacuuacugaagaaacucucugua

SEQ ID NO: 406840 - RNA, 64 nt, Human; identical to SEQ ID NO: 221246

SEQ ID NO: 406841 - RNA, 64 nt, Human; identical to SEQ ID NO: 221247

SEQ ID NO: 406842 - RNA, 64 nt, Human; identical to SEQ ID NO: 221251

SEQ ID NO: 406843 - RNA, 64 nt, Human; identical to SEQ ID NO: 221252

SEQ ID NO: 406844 - RNA, 64 nt, Human; identical to SEQ ID NO: 221253

SEQ ID NO: 406845 - RNA, 64 nt, Human; identical to SEQ ID NO: 221254

SEQ ID NO: 406846 - RNA, 64 nt, Human; identical to SEQ ID NO: 221255

SEQ ID NO: 406847 - RNA, 64 nt, Human; identical to SEQ ID NO: 221256

SEQ ID NO: 406848 - RNA, 64 nt, Human; identical to SEQ ID NO: 221257

SEQ ID NO: 406849 - RNA, 64 nt, Human; identical to SEQ ID NO: 221258

SEQ ID NO: 406850 - RNA, 64 nt, Human; identical to SEQ ID NO: 221259

SEQ ID NO: 406851 - RNA, 64 nt, Human; identical to SEQ ID NO: 221260

SEQ ID NO: 406852 - RNA, 64 nt, Human; identical to SEQ ID NO: 221261

SEQ ID NO: 406853 - RNA, 64 nt, Human; identical to SEQ ID NO: 221262

SEQ ID NO: 406854 - RNA, 64 nt, Human; identical to SEQ ID NO: 221263

SEQ ID NO: 406855 - RNA, 64 nt, Human; identical to SEQ ID NO: 221264

SEQ ID NO: 406856 - RNA, 64 nt, Human
cacuuuuuucuccaaaaugaugccuugggguggggagugguagggggaagagcucccacccuaa

SEQ ID NO: 406857 - RNA, 64 nt, Human
cauagccucccaccacuaucaguaucccacaccagagugguacauuuguuacaaucaauaaacc

SEQ ID NO: 406858 - RNA, 64 nt, Human
gcuuuuuuuuucuuuuucauuuuuuuaaaagauugagugguacacuaauaaaugagaguuugaa

SEQ ID NO: 406859 - RNA, 64 nt, Human; identical to SEQ ID NO: 221265

SEQ ID NO: 406860 - RNA, 64 nt, Human; identical to SEQ ID NO: 221269

SEQ ID NO: 406861 - RNA, 64 nt, Human; identical to SEQ ID NO: 221270

SEQ ID NO: 406862 - RNA, 64 nt, Human; identical to SEQ ID NO: 221271

SEQ ID NO: 406863 - RNA, 64 nt, Human; identical to SEQ ID NO: 221272

SEQ ID NO: 406864 - RNA, 64 nt, Human; identical to SEQ ID NO: 221273

SEQ ID NO: 406865 - RNA, 64 nt, Human; identical to SEQ ID NO: 221274

SEQ ID NO: 406866 - RNA, 64 nt, Human; identical to SEQ ID NO: 221275

SEQ ID NO: 406867 - RNA, 64 nt, Human; identical to SEQ ID NO: 221276

SEQ ID NO: 406868 - RNA, 64 nt, Human; identical to SEQ ID NO: 221277

SEQ ID NO: 406869 - RNA, 64 nt, Human; identical to SEQ ID NO: 221278

SEQ ID NO: 406870 - RNA, 64 nt, Human; identical to SEQ ID NO: 221279

SEQ ID NO: 406871 - RNA, 64 nt, Human; identical to SEQ ID NO: 221280

SEQ ID NO: 406872 - RNA, 64 nt, Human; identical to SEQ ID NO: 221281

SEQ ID NO: 406873 - RNA, 64 nt, Human; identical to SEQ ID NO: 221282

SEQ ID NO: 406874 - RNA, 64 nt, Human; identical to SEQ ID NO: 221283

SEQ ID NO: 406875 - RNA, 64 nt, Human
gugauuggcuagugauucuuguuuucagaagggagagugguauagauagaaaaugacaaagaug

SEQ ID NO: 406876 - RNA, 64 nt, Human
aauuaacuauuauguuugcacuaagauuugcugggagugguagguggacauaucuauauaucaa

SEQ ID NO: 406877 - RNA, 64 nt, Human
uuuaagacuuggaaaacuaagugcagaguuuacagagugguaaauaucuauguuacauguagau

SEQ ID NO: 406878 - RNA, 64 nt, Human; identical to SEQ ID NO: 221287

SEQ ID NO: 406879 - RNA, 64 nt, Human; identical to SEQ ID NO: 221288

SEQ ID NO: 406880 - RNA, 64 nt, Human; identical to SEQ ID NO: 221289

SEQ ID NO: 406881 - RNA, 64 nt, Human; identical to SEQ ID NO: 221290

SEQ ID NO: 406882 - RNA, 64 nt, Human; identical to SEQ ID NO: 221291

SEQ ID NO: 406883 - RNA, 64 nt, Human; identical to SEQ ID NO: 221292

SEQ ID NO: 406884 - RNA, 64 nt, Human; identical to SEQ ID NO: 221293

SEQ ID NO: 406885 - RNA, 64 nt, Human; identical to SEQ ID NO: 221294

SEQ ID NO: 406886 - RNA, 64 nt, Human; identical to SEQ ID NO: 221295

SEQ ID NO: 406887 - RNA, 64 nt, Human; identical to SEQ ID NO: 221296

SEQ ID NO: 406888 - RNA, 64 nt, Human; identical to SEQ ID NO: 221297

SEQ ID NO: 406889 - RNA, 64 nt, Human; identical to SEQ ID NO: 221298

SEQ ID NO: 406890 - RNA, 64 nt, Human; identical to SEQ ID NO: 221299

SEQ ID NO: 406891 - RNA, 64 nt, Human; identical to SEQ ID NO: 221300

SEQ ID NO: 406892 - RNA, 64 nt, Human; identical to SEQ ID NO: 221301

SEQ ID NO: 406893 - RNA, 64 nt, Human; identical to SEQ ID NO: 221305

SEQ ID NO: 406894 - RNA, 64 nt, Human
uagacagaacuuuggcacuuuagaacaaaugcaugagugguauuucaguuccuaaguuacauaa

SEQ ID NO: 406895 - RNA, 64 nt, Human
ugcuuauagcuuuuuuuguaaacagggaaauguugagugguacuuguauucccuuaucaaauua

SEQ ID NO: 406896 - RNA, 64 nt, Human
cccuugcuccacucaugccugggggccuggggcugagugguaucccuaccuggccucccccugg

SEQ ID NO: 406897 - RNA, 64 nt, Human; identical to SEQ ID NO: 221306

SEQ ID NO: 406898 - RNA, 64 nt, Human; identical to SEQ ID NO: 221307

SEQ ID NO: 406899 - RNA, 64 nt, Human; identical to SEQ ID NO: 221308

SEQ ID NO: 406900 - RNA, 64 nt, Human; identical to SEQ ID NO: 221309

SEQ ID NO: 406901 - RNA, 64 nt, Human; identical to SEQ ID NO: 221310

SEQ ID NO: 406902 - RNA, 64 nt, Human; identical to SEQ ID NO: 221311

SEQ ID NO: 406903 - RNA, 64 nt, Human; identical to SEQ ID NO: 221312

SEQ ID NO: 406904 - RNA, 64 nt, Human; identical to SEQ ID NO: 221313

SEQ ID NO: 406905 - RNA, 64 nt, Human; identical to SEQ ID NO: 221314

SEQ ID NO: 406906 - RNA, 64 nt, Human; identical to SEQ ID NO: 221315

SEQ ID NO: 406907 - RNA, 64 nt, Human; identical to SEQ ID NO: 221316

SEQ ID NO: 406908 - RNA, 64 nt, Human; identical to SEQ ID NO: 221317

SEQ ID NO: 406909 - RNA, 64 nt, Human; identical to SEQ ID NO: 221318

SEQ ID NO: 406910 - RNA, 64 nt, Human; identical to SEQ ID NO: 221319

SEQ ID NO: 406911 - RNA, 64 nt, Human; identical to SEQ ID NO: 221323

SEQ ID NO: 406912 - RNA, 64 nt, Human; identical to SEQ ID NO: 221324

SEQ ID NO: 406913 - RNA, 64 nt, Human
ugagaugacaggcacgagccaccaggcccagccugagugguauuuucuuuagggaccagguaga

SEQ ID NO: 406914 - RNA, 64 nt, Human
cccgacuuccacagagugcuucaggacacauuuugagugguauuuucuuuucuuuuuuucuucu

SEQ ID NO: 406915 - RNA, 64 nt, Human
aauauuuuucaugccuuuucucauaaacccagacgagugguaaaaauuugccuucaguuguaau

SEQ ID NO: 406916 - RNA, 64 nt, Human; identical to SEQ ID NO: 221325

SEQ ID NO: 406917 - RNA, 64 nt, Human; identical to SEQ ID NO: 221326

SEQ ID NO: 406918 - RNA, 64 nt, Human; identical to SEQ ID NO: 221327

SEQ ID NO: 406919 - RNA, 57 nt, Human; identical to SEQ ID NO: 221328

SEQ ID NO: 406920 - RNA, 64 nt, Human; identical to SEQ ID NO: 221329

SEQ ID NO: 406921 - RNA, 64 nt, Human; identical to SEQ ID NO: 221330

SEQ ID NO: 406922 - RNA, 64 nt, Human; identical to SEQ ID NO: 221331

SEQ ID NO: 406923 - RNA, 64 nt, Human; identical to SEQ ID NO: 221332

SEQ ID NO: 406924 - RNA, 64 nt, Human; identical to SEQ ID NO: 221333

SEQ ID NO: 406925 - RNA, 64 nt, Human; identical to SEQ ID NO: 221334

SEQ ID NO: 406926 - RNA, 64 nt, Human; identical to SEQ ID NO: 221335

SEQ ID NO: 406927 - RNA, 64 nt, Human; identical to SEQ ID NO: 221336

SEQ ID NO: 406928 - RNA, 64 nt, Human; identical to SEQ ID NO: 221337

SEQ ID NO: 406929 - RNA, 64 nt, Human; identical to SEQ ID NO: 221341

SEQ ID NO: 406930 - RNA, 64 nt, Human; identical to SEQ ID NO: 221342

SEQ ID NO: 406931 - RNA, 64 nt, Human; identical to SEQ ID NO: 221343

SEQ ID NO: 406932 - RNA, 64 nt, Human
ugggguuguagggaaggcuaaggacaggaguggggagugguaccuugaaaauccaaaagccauc

SEQ ID NO: 406933 - RNA, 64 nt, Human
ugaaccggcagaugugugucccuccguggcuacagagugguaaacaaaucucaccuuuggggcu

SEQ ID NO: 406934 - RNA, 64 nt, Human
cagcagguuccagugccugacuugggauaggacugagugguaggaggagggggaguggaggggc

SEQ ID NO: 406935 - RNA, 64 nt, Human; identical to SEQ ID NO: 221344

SEQ ID NO: 406936 - RNA, 64 nt, Human; identical to SEQ ID NO: 221345

SEQ ID NO: 406937 - RNA, 64 nt, Human; identical to SEQ ID NO: 221346

SEQ ID NO: 406938 - RNA, 64 nt, Human; identical to SEQ ID NO: 221347

SEQ ID NO: 406939 - RNA, 64 nt, Human; identical to SEQ ID NO: 221348

SEQ ID NO: 406940 - RNA, 64 nt, Human; identical to SEQ ID NO: 221349

SEQ ID NO: 406941 - RNA, 64 nt, Human; identical to SEQ ID NO: 221350

SEQ ID NO: 406942 - RNA, 64 nt, Human; identical to SEQ ID NO: 221351

SEQ ID NO: 406943 - RNA, 64 nt, Human; identical to SEQ ID NO: 221352

SEQ ID NO: 406944 - RNA, 64 nt, Human; identical to SEQ ID NO: 221353

SEQ ID NO: 406945 - RNA, 64 nt, Human; identical to SEQ ID NO: 221354

SEQ ID NO: 406946 - RNA, 64 nt, Human; identical to SEQ ID NO: 221355

SEQ ID NO: 406947 - RNA, 64 nt, Human; identical to SEQ ID NO: 221359

SEQ ID NO: 406948 - RNA, 64 nt, Human; identical to SEQ ID NO: 221360

SEQ ID NO: 406949 - RNA, 64 nt, Human; identical to SEQ ID NO: 221361

SEQ ID NO: 406950 - RNA, 64 nt, Human; identical to SEQ ID NO: 221362

SEQ ID NO: 406951 - RNA, 64 nt, Human
ccaggacuacagcuuuccuauaucuucuauucuagagugguaaacucucuauaaguguucagug

SEQ ID NO: 406952 - RNA, 64 nt, Human
cuaagccaaguuuuaaauauuaucuaacagacaagagugguauauacaaguagauccugagaag

SEQ ID NO: 406953 - RNA, 64 nt, Human
ucuaugaaguuauuacuauaaguagccuucagaagagugguaucacaaaguuguguuucuuuug

SEQ ID NO: 406954 - RNA, 64 nt, Human; identical to SEQ ID NO: 221363

SEQ ID NO: 406955 - RNA, 64 nt, Human; identical to SEQ ID NO: 221364

SEQ ID NO: 406956 - RNA, 64 nt, Human; identical to SEQ ID NO: 221365

SEQ ID NO: 406957 - RNA, 64 nt, Human; identical to SEQ ID NO: 221366

SEQ ID NO: 406958 - RNA, 64 nt, Human; identical to SEQ ID NO: 221367

SEQ ID NO: 406959 - RNA, 58 nt, Human; identical to SEQ ID NO: 221368

SEQ ID NO: 406960 - RNA, 64 nt, Human; identical to SEQ ID NO: 221369

SEQ ID NO: 406961 - RNA, 64 nt, Human; identical to SEQ ID NO: 221370

SEQ ID NO: 406962 - RNA, 64 nt, Human; identical to SEQ ID NO: 221371

SEQ ID NO: 406963 - RNA, 64 nt, Human; identical to SEQ ID NO: 221372

SEQ ID NO: 406964 - RNA, 64 nt, Human; identical to SEQ ID NO: 221373

SEQ ID NO: 406965 - RNA, 64 nt, Human; identical to SEQ ID NO: 221377

SEQ ID NO: 406966 - RNA, 64 nt, Human; identical to SEQ ID NO: 221378

SEQ ID NO: 406967 - RNA, 64 nt, Human; identical to SEQ ID NO: 221379

SEQ ID NO: 406968 - RNA, 64 nt, Human; identical to SEQ ID NO: 221380

SEQ ID NO: 406969 - RNA, 64 nt, Human; identical to SEQ ID NO: 221381

SEQ ID NO: 406970 - RNA, 64 nt, Human
cucagcaauacauagaacugaaaaaacagggcgggagugguauguggcccugaauaaaagagga

SEQ ID NO: 406971 - RNA, 64 nt, Human
gaaaaaaguuuauaugacugacaacaaugucucugagugguaggauuacaguuaauuuuuauuu

SEQ ID NO: 406972 - RNA, 64 nt, Human
guggacaaaccccgcaaaucagaguggggaaggugagugguagagagggggucucugaaggccc

SEQ ID NO: 406973 - RNA, 64 nt, Human; identical to SEQ ID NO: 221382

SEQ ID NO: 406974 - RNA, 64 nt, Human; identical to SEQ ID NO: 221383

SEQ ID NO: 406975 - RNA, 64 nt, Human; identical to SEQ ID NO: 221384

SEQ ID NO: 406976 - RNA, 64 nt, Human; identical to SEQ ID NO: 221385

SEQ ID NO: 406977 - RNA, 64 nt, Human; identical to SEQ ID NO: 221386

SEQ ID NO: 406978 - RNA, 64 nt, Human; identical to SEQ ID NO: 221387

SEQ ID NO: 406979 - RNA, 64 nt, Human; identical to SEQ ID NO: 221388

SEQ ID NO: 406980 - RNA, 64 nt, Human; identical to SEQ ID NO: 221389

SEQ ID NO: 406981 - RNA, 64 nt, Human; identical to SEQ ID NO: 221390

SEQ ID NO: 406982 - RNA, 64 nt, Human; identical to SEQ ID NO: 221391

SEQ ID NO: 406983 - RNA, 64 nt, Human; identical to SEQ ID NO: 221395

SEQ ID NO: 406984 - RNA, 64 nt, Human; identical to SEQ ID NO: 221396

SEQ ID NO: 406985 - RNA, 64 nt, Human; identical to SEQ ID NO: 221397

SEQ ID NO: 406986 - RNA, 64 nt, Human; identical to SEQ ID NO: 221398

SEQ ID NO: 406987 - RNA, 64 nt, Human; identical to SEQ ID NO: 221399

SEQ ID NO: 406988 - RNA, 64 nt, Human; identical to SEQ ID NO: 221400

SEQ ID NO: 406989 - RNA, 64 nt, Human
ugugaugacuguaaauguucacuggguggguagggagugguauccaguguucaagugcagaaau

SEQ ID NO: 406990 - RNA, 64 nt, Human
uuaguuaaccaauuauguuaauaauuuauuuaaugagugguauggaaaccaauugauuuuuuua

SEQ ID NO: 406991 - RNA, 64 nt, Human
ggucuacagaauuguuucauauaaaauacggguagagugguagaguuucaaaacuuucgucaua

SEQ ID NO: 406992 - RNA, 64 nt, Human; identical to SEQ ID NO: 221401

SEQ ID NO: 406993 - RNA, 55 nt, Human; identical to SEQ ID NO: 221402

SEQ ID NO: 406994 - RNA, 62 nt, Human; identical to SEQ ID NO: 221403

SEQ ID NO: 406995 - RNA, 64 nt, Human; identical to SEQ ID NO: 221404

SEQ ID NO: 406996 - RNA, 64 nt, Human; identical to SEQ ID NO: 221405

SEQ ID NO: 406997 - RNA, 64 nt, Human; identical to SEQ ID NO: 221406

SEQ ID NO: 406998 - RNA, 64 nt, Human; identical to SEQ ID NO: 221407

SEQ ID NO: 406999 - RNA, 64 nt, Human; identical to SEQ ID NO: 221408

SEQ ID NO: 407000 - RNA, 64 nt, Human; identical to SEQ ID NO: 221409

SEQ ID NO: 407001 - RNA, 64 nt, Human; identical to SEQ ID NO: 221413

SEQ ID NO: 407002 - RNA, 64 nt, Human; identical to SEQ ID NO: 221414

SEQ ID NO: 407003 - RNA, 64 nt, Human; identical to SEQ ID NO: 221415

SEQ ID NO: 407004 - RNA, 64 nt, Human; identical to SEQ ID NO: 221416

SEQ ID NO: 407005 - RNA, 53 nt, Human; identical to SEQ ID NO: 221417

SEQ ID NO: 407006 - RNA, 64 nt, Human; identical to SEQ ID NO: 221418

SEQ ID NO: 407007 - RNA, 64 nt, Human; identical to SEQ ID NO: 221419

SEQ ID NO: 407008 - RNA, 64 nt, Human
guuggcuuuguuuauuugguuuuggcggggagaggagugguauuugaugcuuucuguggacaau

SEQ ID NO: 407009 - RNA, 64 nt, Human
agggugcucuaugagauuguacuaggccuaugaagagugguaagccaaauaggucuccauggga

SEQ ID NO: 407010 - RNA, 64 nt, Human
ugcuucugcaaugcauauaaaaacuauaaaugccgagugguagaaacuccucuuucuucauagu

SEQ ID NO: 407011 - RNA, 64 nt, Human; identical to SEQ ID NO: 221420

SEQ ID NO: 407012 - RNA, 64 nt, Human; identical to SEQ ID NO: 221421

SEQ ID NO: 407013 - RNA, 64 nt, Human; identical to SEQ ID NO: 221422

SEQ ID NO: 407014 - RNA, 64 nt, Human; identical to SEQ ID NO: 221423

SEQ ID NO: 407015 - RNA, 64 nt, Human; identical to SEQ ID NO: 221424

SEQ ID NO: 407016 - RNA, 64 nt, Human; identical to SEQ ID NO: 221425

SEQ ID NO: 407017 - RNA, 64 nt, Human; identical to SEQ ID NO: 221426

SEQ ID NO: 407018 - RNA, 64 nt, Human; identical to SEQ ID NO: 221427

SEQ ID NO: 407019 - RNA, 64 nt, Human; identical to SEQ ID NO: 221431

SEQ ID NO: 407020 - RNA, 64 nt, Human; identical to SEQ ID NO: 221432

SEQ ID NO: 407021 - RNA, 64 nt, Human; identical to SEQ ID NO: 221433

SEQ ID NO: 407022 - RNA, 64 nt, Human; identical to SEQ ID NO: 221434

SEQ ID NO: 407023 - RNA, 64 nt, Human; identical to SEQ ID NO: 221435

SEQ ID NO: 407024 - RNA, 64 nt, Human; identical to SEQ ID NO: 221436

SEQ ID NO: 407025 - RNA, 64 nt, Human; identical to SEQ ID NO: 221437

SEQ ID NO: 407026 - RNA, 64 nt, Human; identical to SEQ ID NO: 221438

SEQ ID NO: 407027 - RNA, 64 nt, Human
guugugauguaaaaaguuuaagaaauaugaaugugagugguaaguauaucucaguuuaaauggu

SEQ ID NO: 407028 - RNA, 64 nt, Human
ggcacaacuaggaacaaugccaccauucccacaggagugguacuuaaaccagacagcaggguuc

SEQ ID NO: 407029 - RNA, 64 nt, Human
aacaucccaucuaagcauuccacacugcagggaggagugguacuuaagcuccccugccuuaacc

SEQ ID NO: 407030 - RNA, 64 nt, Human; identical to SEQ ID NO: 221439

SEQ ID NO: 407031 - RNA, 64 nt, Human; identical to SEQ ID NO: 221440

SEQ ID NO: 407032 - RNA, 64 nt, Human; identical to SEQ ID NO: 221441

SEQ ID NO: 407033 - RNA, 63 nt, Human; identical to SEQ ID NO: 221442

SEQ ID NO: 407034 - RNA, 64 nt, Human; identical to SEQ ID NO: 221443

SEQ ID NO: 407035 - RNA, 64 nt, Human; identical to SEQ ID NO: 221444

SEQ ID NO: 407036 - RNA, 64 nt, Human; identical to SEQ ID NO: 221445

SEQ ID NO: 407037 - RNA, 64 nt, Human; identical to SEQ ID NO: 221449

SEQ ID NO: 407038 - RNA, 64 nt, Human; identical to SEQ ID NO: 221450

SEQ ID NO: 407039 - RNA, 64 nt, Human; identical to SEQ ID NO: 221451

SEQ ID NO: 407040 - RNA, 64 nt, Human; identical to SEQ ID NO: 221452

SEQ ID NO: 407041 - RNA, 64 nt, Human; identical to SEQ ID NO: 221453

SEQ ID NO: 407042 - RNA, 64 nt, Human; identical to SEQ ID NO: 221454

SEQ ID NO: 407043 - RNA, 64 nt, Human; identical to SEQ ID NO: 221455

SEQ ID NO: 407044 - RNA, 64 nt, Human; identical to SEQ ID NO: 221456

SEQ ID NO: 407045 - RNA, 64 nt, Human; identical to SEQ ID NO: 221457

SEQ ID NO: 407046 - RNA, 64 nt, Human
cugaugauaacccaguagcaaaaacauuuguacugagugguacaagccuuggggacugaaaaaa

SEQ ID NO: 407047 - RNA, 64 nt, Human
ucguaauuacuguuuuaaugauucaguuucuucagagugguaauuguauaaaauugcuauugca

SEQ ID NO: 407048 - RNA, 64 nt, Human
cuagguuuuuuguuuuguuuuguucugaagagaagagugguaccauauguugcaggaagucaaa

SEQ ID NO: 407049 - RNA, 64 nt, Human; identical to SEQ ID NO: 221458

SEQ ID NO: 407050 - RNA, 64 nt, Human; identical to SEQ ID NO: 221459

SEQ ID NO: 407051 - RNA, 64 nt, Human; identical to SEQ ID NO: 221460

SEQ ID NO: 407052 - RNA, 64 nt, Human; identical to SEQ ID NO: 221461

SEQ ID NO: 407053 - RNA, 64 nt, Human; identical to SEQ ID NO: 221462

SEQ ID NO: 407054 - RNA, 64 nt, Human; identical to SEQ ID NO: 221463

SEQ ID NO: 407055 - RNA, 64 nt, Human; identical to SEQ ID NO: 221467

SEQ ID NO: 407056 - RNA, 64 nt, Human; identical to SEQ ID NO: 221468

SEQ ID NO: 407057 - RNA, 64 nt, Human; identical to SEQ ID NO: 221469

SEQ ID NO: 407058 - RNA, 64 nt, Human; identical to SEQ ID NO: 221470

SEQ ID NO: 407059 - RNA, 64 nt, Human; identical to SEQ ID NO: 221471

SEQ ID NO: 407060 - RNA, 64 nt, Human; identical to SEQ ID NO: 221472

SEQ ID NO: 407061 - RNA, 64 nt, Human; identical to SEQ ID NO: 221473

SEQ ID NO: 407062 - RNA, 64 nt, Human; identical to SEQ ID NO: 221474

SEQ ID NO: 407063 - RNA, 64 nt, Human; identical to SEQ ID NO: 221475

SEQ ID NO: 407064 - RNA, 64 nt, Human; identical to SEQ ID NO: 221476

SEQ ID NO: 407065 - RNA, 61 nt, Human
uugagcuucagcaaaauacaggaaaagaacuauccaguauaaaugucagaagacagauuuc

SEQ ID NO: 407066 - RNA, 61 nt, Human
caagcuguuuacagcucuuucuuguccugccauccaguagcaguuagucuucauccccacg

SEQ ID NO: 407067 - RNA, 61 nt, Human
gguagaaagauuuauauuucucugaguauguauccaguaauagcccauucauuuauugcau

SEQ ID NO: 407068 - RNA, 64 nt, Human; identical to SEQ ID NO: 221477

SEQ ID NO: 407069 - RNA, 64 nt, Human; identical to SEQ ID NO: 221478

SEQ ID NO: 407070 - RNA, 64 nt, Human; identical to SEQ ID NO: 221479

SEQ ID NO: 407071 - RNA, 64 nt, Human; identical to SEQ ID NO: 221480

SEQ ID NO: 407072 - RNA, 64 nt, Human; identical to SEQ ID NO: 221481

SEQ ID NO: 407073 - RNA, 64 nt, Human; identical to SEQ ID NO: 221485

SEQ ID NO: 407074 - RNA, 64 nt, Human; identical to SEQ ID NO: 221486

SEQ ID NO: 407075 - RNA, 64 nt, Human; identical to SEQ ID NO: 221487

SEQ ID NO: 407076 - RNA, 64 nt, Human; identical to SEQ ID NO: 221488

SEQ ID NO: 407077 - RNA, 64 nt, Human; identical to SEQ ID NO: 221489

SEQ ID NO: 407078 - RNA, 64 nt, Human; identical to SEQ ID NO: 221490

SEQ ID NO: 407079 - RNA, 64 nt, Human; identical to SEQ ID NO: 221491

SEQ ID NO: 407080 - RNA, 64 nt, Human; identical to SEQ ID NO: 221492

SEQ ID NO: 407081 - RNA, 64 nt, Human; identical to SEQ ID NO: 221493

SEQ ID NO: 407082 - RNA, 64 nt, Human; identical to SEQ ID NO: 221494

SEQ ID NO: 407083 - RNA, 64 nt, Human; identical to SEQ ID NO: 221495

SEQ ID NO: 407084 - RNA, 57 nt, Human
ccacccuggccauccacuagcccggaggguacgcagacuccacacucaguagaagga

SEQ ID NO: 407085 - RNA, 64 nt, Human
cuaauuaagguuuauuuuaaaaagugucuaccuugguacgcagccaccuccugcaugcugugca

SEQ ID NO: 407086 - RNA, 64 nt, Human
aagcucuuuaaaucaccaucuucccuauuucugugagugguauugccauccuugacauuugaca

SEQ ID NO: 407087 - RNA, 64 nt, Human; identical to SEQ ID NO: 221496

SEQ ID NO: 407088 - RNA, 64 nt, Human; identical to SEQ ID NO: 221497

SEQ ID NO: 407089 - RNA, 64 nt, Human; identical to SEQ ID NO: 221498

SEQ ID NO: 407090 - RNA, 64 nt, Human; identical to SEQ ID NO: 221499

SEQ ID NO: 407091 - RNA, 64 nt, Human; identical to SEQ ID NO: 221503

SEQ ID NO: 407092 - RNA, 64 nt, Human; identical to SEQ ID NO: 221504

SEQ ID NO: 407093 - RNA, 64 nt, Human; identical to SEQ ID NO: 221505

SEQ ID NO: 407094 - RNA, 53 nt, Human; identical to SEQ ID NO: 221506

SEQ ID NO: 407095 - RNA, 64 nt, Human; identical to SEQ ID NO: 221507

SEQ ID NO: 407096 - RNA, 64 nt, Human; identical to SEQ ID NO: 221508

SEQ ID NO: 407097 - RNA, 64 nt, Human; identical to SEQ ID NO: 221489

SEQ ID NO: 407098 - RNA, 64 nt, Human; identical to SEQ ID NO: 221510

SEQ ID NO: 407099 - RNA, 64 nt, Human; identical to SEQ ID NO: 221511

SEQ ID NO: 407100 - RNA, 64 nt, Human; identical to SEQ ID NO: 221512

SEQ ID NO: 407101 - RNA, 64 nt, Human; identical to SEQ ID NO: 221513

SEQ ID NO: 407102 - RNA, 64 nt, Human; identical to SEQ ID NO: 221514

SEQ ID NO: 407103 - RNA, 64 nt, Human
uaaucaucccaguuccuaggcaacuuguucaccagguacgcaagggccgaauaguugagaaaug

SEQ ID NO: 407104 - RNA, 64 nt, Human
gaggauggugugagcuuuucagcaggcccggaaagguacgcaggugacgccuuagcagccccgc

SEQ ID NO: 407105 - RNA, 64 nt, Human
gccaggcccccaccacacaucccagcccaauccagguacgcacagacagguuuucacauaaaug

SEQ ID NO: 407106 - RNA, 64 nt, Human; identical to SEQ ID NO: 221515

SEQ ID NO: 407107 - RNA, 64 nt, Human; identical to SEQ ID NO: 221516

SEQ ID NO: 407108 - RNA, 64 nt, Human; identical to SEQ ID NO: 221517

SEQ ID NO: 407109 - RNA, 64 nt, Human; identical to SEQ ID NO: 221521

SEQ ID NO: 407110 - RNA, 64 nt, Human; identical to SEQ ID NO: 221522

SEQ ID NO: 407111 - RNA, 64 nt, Human; identical to SEQ ID NO: 221523

SEQ ID NO: 407112 - RNA, 64 nt, Human; identical to SEQ ID NO: 221524

SEQ ID NO: 407113 - RNA, 64 nt, Human; identical to SEQ ID NO: 221525

SEQ ID NO: 407114 - RNA, 64 nt, Human; identical to SEQ ID NO: 221526

SEQ ID NO: 407115 - RNA, 64 nt, Human; identical to SEQ ID NO: 221527

SEQ ID NO: 407116 - RNA, 64 nt, Human; identical to SEQ ID NO: 221528

SEQ ID NO: 407117 - RNA, 64 nt, Human; identical to SEQ ID NO: 221529

SEQ ID NO: 407118 - RNA, 64 nt, Human; identical to SEQ ID NO: 221530

SEQ ID NO: 407119 - RNA, 64 nt, Human; identical to SEQ ID NO: 221531

SEQ ID NO: 407120 - RNA, 64 nt, Human; identical to SEQ ID NO: 221532

SEQ ID NO: 407121 - RNA, 64 nt, Human; identical to SEQ ID NO: 221533

SEQ ID NO: 407122 - RNA, 64 nt, Human
cugccaaugacagaugcaagcccaacacccuuuugguacgcaaaaccugcucucaauaaauucc

SEQ ID NO: 407123 - RNA, 64 nt, Human
agauaugaccugacagcccccuccagugccacaggguacgcacacgcagagccccgccugugca

SEQ ID NO: 407124 - RNA, 57 nt, Human
ccacucuggccauccacuagcccgggggguacgcagaccccacacucagcagaagga

SEQ ID NO: 407125 - RNA, 64 nt, Human; identical to SEQ ID NO: 221534

SEQ ID NO: 407126 - RNA, 64 nt, Human; identical to SEQ ID NO: 221535

SEQ ID NO: 407127 - RNA, 53 nt, Human; identical to SEQ ID NO: 221539

SEQ ID NO: 407128 - RNA, 64 nt, Human; identical to SEQ ID NO: 221540

SEQ ID NO: 407129 - RNA, 64 nt, Human; identical to SEQ ID NO: 221541

SEQ ID NO: 407130 - RNA, 64 nt, Human; identical to SEQ ID NO: 221542

SEQ ID NO: 407131 - RNA, 64 nt, Human; identical to SEQ ID NO: 221543

SEQ ID NO: 407132 - RNA, 64 nt, Human; identical to SEQ ID NO: 221544

SEQ ID NO: 407133 - RNA, 64 nt, Human; identical to SEQ ID NO: 221545

SEQ ID NO: 407134 - RNA, 64 nt, Human; identical to SEQ ID NO: 221546

SEQ ID NO: 407135 - RNA, 64 nt, Human; identical to SEQ ID NO: 221547

SEQ ID NO: 407136 - RNA, 64 nt, Human
acuccggaaaugugggaggagagaauuacugcuugguacgcagagcaccgaggccgagccaggu

SEQ ID NO: 407137 - RNA, 64 nt, Human
auuccccuucccacuccagcaccccagccagccugguacgcagaucccagaauaaagcaccuuc

SEQ ID NO: 407138 - RNA, 64 nt, Human
uaacuuuuaaguggaaaccaaguuuagauuuggggagugguaaaggaaucagcuuuuucuauug

SEQ ID NO: 407139 - RNA, 64 nt, Human; identical to SEQ ID NO: 90358

SEQ ID NO: 407140 - RNA, 64 nt, Human; identical to SEQ ID NO: 90359

SEQ ID NO: 407141 - RNA, 64 nt, Human; identical to SEQ ID NO: 90360

SEQ ID NO: 407142 - RNA, 64 nt, Human; identical to SEQ ID NO: 90361

SEQ ID NO: 407143 - RNA, 64 nt, Human; identical to SEQ ID NO: 90362

SEQ ID NO: 407144 - RNA, 64 nt, Human; identical to SEQ ID NO: 90363

SEQ ID NO: 407145 - RNA, 64 nt, Human; identical to SEQ ID NO: 90364

SEQ ID NO: 407146 - RNA, 64 nt, Human; identical to SEQ ID NO: 90365

SEQ ID NO: 407147 - RNA, 64 nt, Human; identical to SEQ ID NO: 90366

SEQ ID NO: 407148 - RNA, 64 nt, Human; identical to SEQ ID NO: 90367

SEQ ID NO: 407149 - RNA, 64 nt, Human; identical to SEQ ID NO: 90368

SEQ ID NO: 407150 - RNA, 64 nt, Human
uguuggauuuguguuucuugaagaauagcuggcagagugguauaaaagacacgaauaucuccug

SEQ ID NO: 407151 - RNA, 64 nt, Human
uuuaucaucuaugauaugagugagauaauuaugggagugguaagaauuaugacuugaauucuuc

SEQ ID NO: 407152 - RNA, 64 nt, Human
cucaugaauaucccccuuccucugcaauucuccagagugguaacagauggguagaggcagcuca

SEQ ID NO: 407153 - RNA, 64 nt, Human
gcaacugagugacacccagcgacaaccgacuggggagugguagaagcaacugaacggaugcgug

SEQ ID NO: 407154 - RNA, 64 nt, Human; identical to SEQ ID NO: 90369

SEQ ID NO: 407155 - RNA, 54 nt, Human; identical to SEQ ID NO: 23168

SEQ ID NO: 407156 - RNA, 64 nt, Human; identical to SEQ ID NO: 90371

SEQ ID NO: 407157 - RNA, 64 nt, Human; identical to SEQ ID NO: 90372

SEQ ID NO: 407158 - RNA, 64 nt, Human; identical to SEQ ID NO: 90373

SEQ ID NO: 407159 - RNA, 64 nt, Human; identical to SEQ ID NO: 90374

SEQ ID NO: 407160 - RNA, 64 nt, Human; identical to SEQ ID NO: 90375

SEQ ID NO: 407161 - RNA, 64 nt, Human; identical to SEQ ID NO: 90376

SEQ ID NO: 407162 - RNA, 64 nt, Human; identical to SEQ ID NO: 90377

SEQ ID NO: 407163 - RNA, 64 nt, Human; identical to SEQ ID NO: 90378

SEQ ID NO: 407164 - RNA, 64 nt, Human; identical to SEQ ID NO: 90379

SEQ ID NO: 407165 - RNA, 64 nt, Human; identical to SEQ ID NO: 90380

SEQ ID NO: 407166 - RNA, 64 nt, Human; identical to SEQ ID NO: 90381

SEQ ID NO: 407167 - RNA, 64 nt, Human; identical to SEQ ID NO: 90382

SEQ ID NO: 407168 - RNA, 64 nt, Human; identical to SEQ ID NO: 90383

SEQ ID NO: 407169 - RNA, 64 nt, Human; identical to SEQ ID NO: 90384

SEQ ID NO: 407170 - RNA, 64 nt, Human
agaagcaaagaggacuaaagggcaaaauucuagagagugguaaaucucagaaagcacaagcaua

SEQ ID NO: 407171 - RNA, 64 nt, Human
agcccugucugaaggacacuuccugccuaagggagagugguauuugcagacuagaauucuagug

SEQ ID NO: 407172 - RNA, 64 nt, Human
cgaaaagagagacaaagucucagcacauuccaaggagugguagaaacagagcugaagguguccc

SEQ ID NO: 407173 - RNA, 64 nt, Human; identical to SEQ ID NO: 90385

SEQ ID NO: 407174 - RNA, 64 nt, Human; identical to SEQ ID NO: 90386

SEQ ID NO: 407175 - RNA, 64 nt, Human; identical to SEQ ID NO: 90387

SEQ ID NO: 407176 - RNA, 57 nt, Human; identical to SEQ ID NO: 23186

SEQ ID NO: 407177 - RNA, 64 nt, Human; identical to SEQ ID NO: 90389

SEQ ID NO: 407178 - RNA, 51 nt, Human; identical to SEQ ID NO: 23188

SEQ ID NO: 407179 - RNA, 64 nt, Human; identical to SEQ ID NO: 90391

SEQ ID NO: 407180 - RNA, 64 nt, Human; identical to SEQ ID NO: 90393

SEQ ID NO: 407181 - RNA, 64 nt, Human; identical to SEQ ID NO: 90394

SEQ ID NO: 407182 - RNA, 64 nt, Human; identical to SEQ ID NO: 90395

SEQ ID NO: 407183 - RNA, 64 nt, Human; identical to SEQ ID NO: 90396

SEQ ID NO: 407184 - RNA, 64 nt, Human; identical to SEQ ID NO: 90397

SEQ ID NO: 407185 - RNA, 64 nt, Human; identical to SEQ ID NO: 90398

SEQ ID NO: 407186 - RNA, 64 nt, Human; identical to SEQ ID NO: 90399

SEQ ID NO: 407187 - RNA, 64 nt, Human; identical to SEQ ID NO: 90400

SEQ ID NO: 407188 - RNA, 64 nt, Human; identical to SEQ ID NO: 90401

SEQ ID NO: 407189 - RNA, 64 nt, Human
ccuguaugcagcccucguguaauacggugaauuagagugguauuucacuuuguauuauuuugua

SEQ ID NO: 407190 - RNA, 64 nt, Human
aguuugcuauaauauaaaaugacaauagucucuugagugguaaguugguuauuuuuuuagaggu

SEQ ID NO: 407191 - RNA, 64 nt, Human
aagaguagcacucacugaauaguuuuaaaugacugagugguaugcuuacaauugucaugucuag

SEQ ID NO: 407192 - RNA, 64 nt, Human; identical to SEQ ID NO: 90402

SEQ ID NO: 407193 - RNA, 64 nt, Human; identical to SEQ ID NO: 90403

SEQ ID NO: 407194 - RNA, 64 nt, Human; identical to SEQ ID NO: 90404

SEQ ID NO: 407195 - RNA, 64 nt, Human; identical to SEQ ID NO: 90405

SEQ ID NO: 407196 - RNA, 64 nt, Human; identical to SEQ ID NO: 90406

SEQ ID NO: 407197 - RNA, 64 nt, Human; identical to SEQ ID NO: 90407

SEQ ID NO: 407198 - RNA, 64 nt, Human; identical to SEQ ID NO: 90408

SEQ ID NO: 407199 - RNA, 64 nt, Human; identical to SEQ ID NO: 90409

SEQ ID NO: 407200 - RNA, 64 nt, Human; identical to SEQ ID NO: 90410

SEQ ID NO: 407201 - RNA, 64 nt, Human; identical to SEQ ID NO: 90411

SEQ ID NO: 407202 - RNA, 64 nt, Human; identical to SEQ ID NO: 90412

SEQ ID NO: 407203 - RNA, 64 nt, Human; identical to SEQ ID NO: 90413

SEQ ID NO: 407204 - RNA, 63 nt, Human; identical to SEQ ID NO: 90414

SEQ ID NO: 407205 - RNA, 64 nt, Human; identical to SEQ ID NO: 90415

SEQ ID NO: 407206 - RNA, 64 nt, Human; identical to SEQ ID NO: 90416

SEQ ID NO: 407207 - RNA, 64 nt, Human; identical to SEQ ID NO: 90417

SEQ ID NO: 407208 - RNA, 64 nt, Human
uuuaaagcccggaaugacuguaacuuucacacaagguacgcaucuauguuuuugggggagguga

SEQ ID NO: 407209 - RNA, 64 nt, Human
cucaacaaccagcucuaugacaucauuaccaugcgguacgcagacaaacacaugaacaucgacu

SEQ ID NO: 407210 - RNA, 64 nt, Human
uuaaugaaggggaaauauacaauuuauuucuauugagugguagaacuauaugucuggucccuug

SEQ ID NO: 407211 - RNA, 64 nt, Human; identical to SEQ ID NO: 90418

SEQ ID NO: 407212 - RNA, 64 nt, Human; identical to SEQ ID NO: 90419

SEQ ID NO: 407213 - RNA, 64 nt, Human; identical to SEQ ID NO: 90420

SEQ ID NO: 407214 - RNA, 64 nt, Human; identical to SEQ ID NO: 90421

SEQ ID NO: 407215 - RNA, 64 nt, Human; identical to SEQ ID NO: 90422

SEQ ID NO: 407216 - RNA, 64 nt, Human; identical to SEQ ID NO: 90423

SEQ ID NO: 407217 - RNA, 64 nt, Human; identical to SEQ ID NO: 90424

SEQ ID NO: 407218 - RNA, 64 nt, Human; identical to SEQ ID NO: 90425

SEQ ID NO: 407219 - RNA, 64 nt, Human; identical to SEQ ID NO: 90426

SEQ ID NO: 407220 - RNA, 64 nt, Human; identical to SEQ ID NO: 90427

SEQ ID NO: 407221 - RNA, 64 nt, Human; identical to SEQ ID NO: 90428

SEQ ID NO: 407222 - RNA, 64 nt, Human; identical to SEQ ID NO: 90429

SEQ ID NO: 407223 - RNA, 64 nt, Human; identical to SEQ ID NO: 90430

SEQ ID NO: 407224 - RNA, 64 nt, Human; identical to SEQ ID NO: 90431

SEQ ID NO: 407225 - RNA, 64 nt, Human
gguugagccuuucaugaggaaaaacaaaagacaugguacgcauuccagggcugaauacuauugc

SEQ ID NO: 407226 - RNA, 58 nt, Human
uacuccaccaucgacuuugauuuccucagguacgcagugauccgauucaaccaguacu

SEQ ID NO: 407227 - RNA, 64 nt, Human
cccugagugggccuugaaugcuaaaaagaagcaggguacgcagggcuacauguagauaccacac

SEQ ID NO: 407228 - RNA, 64 nt, Human
auacauugauuuuucauaauuuaucaaagccugugguacgcacugaauuuucuuugucacauag

SEQ ID NO: 407229 - RNA, 64 nt, Human
aggcccuuugaagccucagcuacccacuauccuucgugaacauccccucccaucauuacccuuc

SEQ ID NO: 407230 - RNA, 64 nt, Human; identical to SEQ ID NO: 407229

SEQ ID NO: 407231 - RNA, 64 nt, Human
aaguucagcaaagucauacacucccuguggccagcgugaacagagccaugccccacccucccag

SEQ ID NO: 407232 - RNA, 64 nt, Human
uuauacuugagauuuuccuccauuuuuauuucuucgugaacauagaguuuggggccgaaaaugu

SEQ ID NO: 407233 - RNA, 64 nt, Human
cuuuuuguguggggucaugggcuccaaaagccaacgugaacaauuaaaaauguauugagcaucu

SEQ ID NO: 407234 - RNA, 64 nt, Human
auaaauugccuuuagcagcaguuuaaaauccuaucgugaacaaccuauauuuucgccauuuuac

SEQ ID NO: 407235 - RNA, 64 nt, Human
gaggaagucugacacuacagcguuggcacagugccgugaacaguggaacugugcccaagggacu

SEQ ID NO: 407236 - RNA, 64 nt, Human
ggucauaaacccugagccagaugaaaugagccaccgugaacagacaucugccaugcccccaggu

SEQ ID NO: 407237 - RNA, 64 nt, Human
ugcugaggcaggucgggcucaggaacugcagggacgugaacaugcgcuugcgguuugagguagc

SEQ ID NO: 407238 - RNA, 64 nt, Human
caccaucugacugcugucaauaaaauguaucuggcgugaacagcaggauaacccauguucucca

SEQ ID NO: 407239 - RNA, 64 nt, Human
ccaagacuaucuugaaggugggcuguuugccuuucgugaacacauucuugguaaagaacaucaa

SEQ ID NO: 407240 - RNA, 64 nt, Human
agcucuggaacgugaagagcuguuugguuugaaccgugaacaaaacuguguuuugaguuuagcu

SEQ ID NO: 407241 - RNA, 64 nt, Human
acauaaauuugcacugcaagaaaauugaaguuuacgugaacaaauucaugagcauauuuucucu

SEQ ID NO: 407242 - RNA, 64 nt, Human
aaagugccagaugccccagugccagagcugcgaacgugaacacaguggaaggcagaggguuuac

SEQ ID NO: 407243 - RNA, 64 nt, Human
aaaguuaaaugacuugaguacccaaaagaaaugucgugaacaugaaaguacuucucaugugucc

SEQ ID NO: 407244 - RNA, 64 nt, Human
guucuaccuguauugucugacuucucaggaagaucgugaacauaacugagggcaugagucucac

SEQ ID NO: 407245 - RNA, 64 nt, Human
uuacagcacaauauuuauuuuaaagugaauaaaauguccacaagcaguguugucauguagucaa

SEQ ID NO: 407246 - RNA, 64 nt, Human
cuggcucccagauuuacuuagguaccccacgaguuguccacauaagcagcuucaucuuuaccuu

SEQ ID NO: 407247 - RNA, 64 nt, Human
ccuggagcagcucucgagaacuaccuguugguauuguccacaagcucucccgagcgccccaucu

SEQ ID NO: 407248 - RNA, 56 nt, Human; identical to SEQ ID NO: 12514

SEQ ID NO: 407249 - RNA, 64 nt, Human
aacugaugaccaacaguuccaagccagauagucucgugaacagugacaauacagaaauaaggug

SEQ ID NO: 407250 - RNA, 64 nt, Human
agagaggugaugacgugcccaaggugacgcaacucgugaacagccgugccugccuugggcgcag

SEQ ID NO: 407251 - RNA, 64 nt, Human
ucucccucacucagggcaccugcccccuccucuucgugaacaccagcagauaccuccuugugcc

SEQ ID NO: 407252 - RNA, 64 nt, Human
ccugccauccaguagcaguuagucuucauccccacgugaacaaaaugggaaggagccgugagga

SEQ ID NO: 407253 - RNA, 64 nt, Human
ucuaguuuccugguuccguuuuagaaaaggaaaacgugaacaaacuuagaaagggaaggaaauc

SEQ ID NO: 407254 - RNA, 64 nt, Human
gcaugggccugucgcccgacaacagguaccuguacgugaacagccgcgccuggcccaacggugc

SEQ ID NO: 407255 - RNA, 64 nt, Human
gcagaauccuugcugggguuucuacaguccccaacgugaacaguauuaagcaagagguggacuc

SEQ ID NO: 407256 - RNA, 64 nt, Human
agcuggggccuaaacaacuagaaggagagagccacgugaacauccggcgaaggggacccaggca

SEQ ID NO: 407257 - RNA, 64 nt, Human
cgcagaaggugaaggugcucacgggcacggguaacgugaacauuauucagccuaacuauccugc

SEQ ID NO: 407258 - RNA, 64 nt, Human
cugucugaugcccucuccauagcccagcuggagccgugaacacugggguccccuggcagagucc

SEQ ID NO: 407259 - RNA, 64 nt, Human
uacccagaguaguggaaauuuuaggacuugaggacgugaacaacuugaaagagaaaauugauuc

SEQ ID NO: 407260 - RNA, 64 nt, Human
ucuuuucuauuuauauguguggcuuaggacccuccgugaacagaugauagagggcaucucuccc

SEQ ID NO: 407261 - RNA, 64 nt, Human
caccguuaggaaacagugagcuccggccccaccucgugaacacaaagccucggaucagccuuga

SEQ ID NO: 407262 - RNA, 64 nt, Human
ccuaagaguugccucugaguuagcucuuuggaaucgugaacacaggugugcuauauuguccuug

SEQ ID NO: 407263 - RNA, 64 nt, Human
acggaaauccuguuguacuuaaagcuagcggacccgugaacaacuuugucagguucacguccua

SEQ ID NO: 407264 - RNA, 64 nt, Human
cuucccgggcucagcugggcuuuaucacacaucccgugaacacucauugaagucagccuguuug

SEQ ID NO: 407265 - RNA, 64 nt, Human
auacauagacacaagacacacacgcucaaaccccuguccacauauacaaccauacauacuugca

SEQ ID NO: 407266 - RNA, 64 nt, Human
uuuuccaggcuggagucgguuccacccacucgccuguccacaggcuuccuuguaagcaagucag

SEQ ID NO: 407267 - RNA, 64 nt, Human
gucuaugguaggcagaauaaugucccccgaaauauguccacauccuaaucccaagaucugugca

SEQ ID NO: 407268 - RNA, 64 nt, Human
ucugauuagaaugucaguugaucagcuagauuuguguccacacuaccaguuucacacccccuuu

SEQ ID NO: 407269 - RNA, 64 nt, Human
gacuccggcucccuaccccaaacugaagcgcuuccgugaacacccccguccuccguagggggag

SEQ ID NO: 407270 - RNA, 64 nt, Human
acuccuugacggaguuugccuccuuuguacgcugcgugaacaugccucaccuuuaagagagucu

SEQ ID NO: 407271 - RNA, 64 nt, Human
uauagcaauauuuaaagaugcuuuggaaaccaaccgugaacacaucaacaccacgacgucuacg

SEQ ID NO: 407272 - RNA, 64 nt, Human
ccaugagugcuucgcagagcaacaaaggaguagacgugaacaacgcaguggugugagucugcag

SEQ ID NO: 407273 - RNA, 64 nt, Human
gugcagaugagcucaagaagguccuuaacacagucgugaacaaacgugaguugcucaaaccaaa

SEQ ID NO: 407274 - RNA, 64 nt, Human
ccguugcacacaaaccuuuaaaaguuccccggcccgugaacaaauguacaauucucuauucuga

SEQ ID NO: 407275 - RNA, 64 nt, Human
aaccauccuuugcaguuauuuuggauauuuccuucgugaacaaaaauaaaauaggcacauuuag

SEQ ID NO: 407276 - RNA, 64 nt, Human
uugagacccuuugcuccaguccuauggcagaaaacgugaacauuccugcaaaguauuauuguaa

SEQ ID NO: 407277 - RNA, 64 nt, Human
ccuuccaggacauccagcgcggggugacaagugccgugaacaucaugcacagcagccuccagca

SEQ ID NO: 407278 - RNA, 64 nt, Human
uagagcucuggccuuguguguauauguauacauacgugaacacaugccugugugugugugugug

SEQ ID NO: 407279 - RNA, 64 nt, Human
uacaccaucccacuuucaggaagucaacuugcuucgugaacagcuuggcgaccgccucagugug

SEQ ID NO: 407280 - RNA, 64 nt, Human
augcccucauaguagugggaagugugaaggugaccgugaacauccuuccucaucgggucugucc

SEQ ID NO: 407281 - RNA, 64 nt, Human
cccaaauuugauuuuguuauuagaaaaaugauuccgugaacacagauguguuuugaagaaguag

SEQ ID NO: 407282 - RNA, 64 nt, Human
caccugcuggucaguggcagaacuguccugacuucgugaacauggaacugcuaagagggaaaac

SEQ ID NO: 407283 - RNA, 64 nt, Human
uguucuugauuuucccagagaagcaaauaaacagcgugaacagccccaguuccuggaguucuug

SEQ ID NO: 407284 - RNA, 64 nt, Human
ggcugagacaggcccguggggcgggguuuuggggcgugaacaaggcuggcaguaaguggacaag

SEQ ID NO: 407285 - RNA, 64 nt, Human
cucagaagccugacuguccuaugggcuucuccaguguccacaggggcuugggaugguugugggg

SEQ ID NO: 407286 - RNA, 64 nt, Human
gugcucgaauugugggugguuuuuugucuucuguuguccacagccagagcuuaguggaugggug

SEQ ID NO: 407287 - RNA, 64 nt, Human
cuugccagcugcaucccugcagacagaggauguguguccacaugaguguuucugugugggaaau

SEQ ID NO: 407288 - RNA, 64 nt, Human
acaagaacacccugaacaguccugguugggaugguguccacauucauguucugcgguucuugaa

SEQ ID NO: 407289 - RNA, 64 nt, Human
uucuggagaugacaacugaguggggaaaacagaccgugaacacaaaacaucaaguuccacacac

SEQ ID NO: 407290 - RNA, 64 nt, Human
gccagugguccagggauggcugcuuccugauacacgugaacaagagucacaccauguguaauug

SEQ ID NO: 407291 - RNA, 64 nt, Human
caaaauugucacaauugcugaaaacagaaugaaucgugaacauuaucucaauauuuuguauaau

SEQ ID NO: 407292 - RNA, 64 nt, Human
cuaggaagcaaggaugcaacaagaugaugcugagcgugaacacaucugagaacuaaaugugcuu

SEQ ID NO: 407293 - RNA, 64 nt, Human
ucauagacuucauacugcauagaaaucuuacaaacgugaacaaugugacaaaguuuucauucac

SEQ ID NO: 407294 - RNA, 64 nt, Human
gucaagccagguguggacauuccaaguucauaugcgugaacaaaagaaaagaggaacccagugg

SEQ ID NO: 407295 - RNA, 64 nt, Human
uguguuuaaggagacccuauauucagggaaguugcgugaacacugcaguggggagaauugagaa

SEQ ID NO: 407296 - RNA, 64 nt, Human
ccuaccuaaaugaagaaaccaugccuggaggggccgugaacacagaacccucaagacaaggaug

SEQ ID NO: 407297 - RNA, 64 nt, Human
uuaaaccccugcuuucuguccuuugcaccuuuugcgugaacagaauaugcauuauuaaagcaaa

SEQ ID NO: 407298 - RNA, 64 nt, Human
uauucaugguuuauauuucuuauucuauggaguucgugaacacaucuagguggaaugcaucuga

SEQ ID NO: 407299 - RNA, 64 nt, Human
gaagauguuuucacuuugugucuagguuuauguacgugaacaaauaauaaaccguuguuguuau

SEQ ID NO: 407300 - RNA, 64 nt, Human
ucaccuccauccugguggacaugugguaccagaccgugaacaccugcuuccucccucgggcagg

SEQ ID NO: 407301 - RNA, 64 nt, Human
ugauguacccaugcuccgugugucugugucugcauguccacacgucugaugcaccuguguacgu

SEQ ID NO: 407302 - RNA, 64 nt, Human
ucguucauuuaaacguauauuuagaacugcacuuuguccacaaccuucccuucucuuucuauuc

SEQ ID NO: 407303 - RNA, 64 nt, Human
gcucaucccagccgacuacaccugcuucugguccuguccacauuuugauacgcagaucacuuga

SEQ ID NO: 407304 - RNA, 64 nt, Human
aaaaaaagggggcauggauuuacauugcaaaagguguccacaguguauuagugacauucuuuca

SEQ ID NO: 407305 - RNA, 61 nt, Human
accccaagaggcucaugugacuaagaggaucuguccacauuuggggccuauccuuacuugu

SEQ ID NO: 407306 - RNA, 64 nt, Human
aguuugccuugucaaauucaaucucaauggccauuguccacauaacugaucacccauggcugcc

SEQ ID NO: 407307 - RNA, 64 nt, Human
agcugccaccccccaccuuacccuuauuccucucuguccacauuuucugccccaccuuacuucu

SEQ ID NO: 407308 - RNA, 64 nt, Human
uguguguguguguguccguguguguguguguguguguccacacuggccagccucccuacuuacc

SEQ ID NO: 407309 - RNA, 64 nt, Human
gcugcugcugguccucaguaccagcgcccggggguguccacaaccacuugggacagaagaaggu

SEQ ID NO: 407310 - RNA, 64 nt, Human
cuggagaaggaacuuuauguucccucuccugcuguguccacaaccuuagaaaucuguagcuaga

SEQ ID NO: 407311 - RNA, 64 nt, Human
accagagaaaccuggccuggguugucucaaauccuguccacaaggcaacuccagaagaaagaag

SEQ ID NO: 407312 - RNA, 64 nt, Human
gccccaccucucccagcugauggugagcugacaguguccacagguuccaggaccauuugagauu

SEQ ID NO: 407313 - RNA, 64 nt, Human
cguagaaauuucuauguuccgaaacacagaguaguguccacaugugagcuuuucacauuaccuu

SEQ ID NO: 407314 - RNA, 64 nt, Human
ccaggaacacacagaggugcacaucacauucccuuguccacacugcccgccucucccacaugcc

SEQ ID NO: 407315 - RNA, 64 nt, Human
cagcaggacacugauccagucacagccauacagcuguccacacugaagaacauguccuacaaca

SEQ ID NO: 407316 - RNA, 64 nt, Human
uucccaaauguauucuacuuguucuaaaacaaucuguccacaaauauaaaacuauaaguaauaa

SEQ ID NO: 407317 - RNA, 64 nt, Human
uucaauuaacaaaguaggaaguugagcacaaccuuguccacagccauuuuaaauauccacuuag

SEQ ID NO: 407318 - RNA, 64 nt, Human
ugcugcugcuggcucuccuuggccucgccguccuuguccacaagcacuauggcccccggcucaa

SEQ ID NO: 407319 - RNA, 64 nt, Human
cacacagaugcauaggccugccuuccggagacccuguccacauugccgggaccacccugguggg

SEQ ID NO: 407320 - RNA, 64 nt, Human
gauuaaaaauaaaucagaauuucaaauuuaaaauuguccacacacuaggaaauagaacuguguu

SEQ ID NO: 407321 - RNA, 64 nt, Human
cugcccccugguggcgcuuccuggcgcugcgcccuguccacagucaccuuaggucccuuuggaa

SEQ ID NO: 407322 - RNA, 64 nt, Human
gguuuugaauuccuaccuuguuauucuaaacagauguccacauuguuaauuaaaucuaaauuau

SEQ ID NO: 407323 - RNA, 64 nt, Human
cgcccaccugggcccuaggcauacucuccaggauuguccacaaauguccucagagggucccuag

SEQ ID NO: 407324 - RNA, 64 nt, Human
gggcgcgggcagcagggaagagggagcaaggcauuguccacagacugcuggggucacuucuuug

SEQ ID NO: 407325 - RNA, 64 nt, Human
gcccgaggccaggaaggccgggccguggagguccuguccacagcuggacaggagagacaccgcc

SEQ ID NO: 407326 - RNA, 64 nt, Human
uuugucuccugguacccaaagaaauacugaguuguguccacaacauggcugggucuucagaccc

SEQ ID NO: 407327 - RNA, 64 nt, Human
aauaaaaaaccuucaagucuacuuacccuucuccuguccacaauaaaguugagaaaacaccaag

SEQ ID NO: 407328 - RNA, 64 nt, Human
accccauggagauuuugaaaaguguuauuucucuuguccacaggcacuuucaagaacuuuggga

SEQ ID NO: 407329 - RNA, 64 nt, Human
uuuuuuuuuuuuuuuuuuuugcugaggcaguuauuguccacaggccuuuggguacagaugaggc

SEQ ID NO: 407330 - RNA, 64 nt, Human
uaaccaaagacauuuaagcauaguaagaaucugauguccacaagaacaggaacuggguuaauaa

SEQ ID NO: 407331 - RNA, 64 nt, Human
caggccuggagaguuaucuacagauguuaggauauguccacauaagaaagcaucuaaacugaac

SEQ ID NO: 407332 - RNA, 64 nt, Human
ugccugaccuggacuaagaaccccacggccccacuguccacacacugccuccccaccgcccacc

SEQ ID NO: 407333 - RNA, 64 nt, Human
uuuucuugauaccacucauccacguguuccugauuguccacauuucaugauaaaaugagagcuc

SEQ ID NO: 407334 - RNA, 64 nt, Human
cuuauaucagucacuugccacucccccacccuccuguccacaacuccuuuccacuuuaggccaa

SEQ ID NO: 407335 - RNA, 64 nt, Human
cucuguaggcuucugggaggucccuuuucagggguguccacaaagucaaagcuauuuucauaau

SEQ ID NO: 407336 - RNA, 64 nt, Human
ccaucuaccgucaguccacauggcaggucugcuguguccacaccacagaugaccacaucuaauc

SEQ ID NO: 407337 - RNA, 64 nt, Human
ggggcuuuugggcaaccucuccguguacugcgucuguccacacucgauugggccccaggugugu

SEQ ID NO: 407338 - RNA, 64 nt, Human
caggaggcucuccugaccucaaguccaacaacaguguccacacuagucaagguucagcccagaa

SEQ ID NO: 407339 - RNA, 64 nt, Human
aggaugcagaaguaccuaccacaugggaaccguuuguccacacucauuccagagaaaaccgagu

SEQ ID NO: 407340 - RNA, 64 nt, Human
guuugaaacuucuguccucuuuggaugagaucaguguccacaaguggccgacauggaacaugcu

SEQ ID NO: 407341 - RNA, 64 nt, Human
uagcugggauugggcuaaggacuguggucuuaucuguccacauacagccaaaaugccuauccag

SEQ ID NO: 407342 - RNA, 64 nt, Human
ucucaggcguguucagcacccugucccuccucccuguccacagcugggucccucuucaacacug

SEQ ID NO: 407343 - RNA, 64 nt, Human
ggcuugucucugcuucuugccaggugggagggccuguccacacccuggauccccguaccacagu

SEQ ID NO: 407344 - RNA, 64 nt, Human
cuccaugcaaguguggccagggcccuggguaucauguccacaugcccagcaagagccuugccuc

SEQ ID NO: 407345 - RNA, 64 nt, Human
cauuuaucucugauggcacuuugagggaaaagaauguccacauacaguuuuugaaagaucuucu

SEQ ID NO: 407346 - RNA, 64 nt, Human
aucaaccuguaucaagaacaaaaaugggaggagguguccacauuuaugguguguauagguaaca

SEQ ID NO: 407347 - RNA, 64 nt, Human
cuccaggggaccauaggucccgucauguacucaguguccacagcagucagucguguaugacccu

SEQ ID NO: 407348 - RNA, 64 nt, Human
caucuuauccuacauuauuggaaaauaaaugagauguccacacaaauggauuauccacauaauc

SEQ ID NO: 407349 - RNA, 64 nt, Human
auuuaguuuacaguauauggauucuaugaaaaaauguccacaacacaguaauuggucacuuguu

SEQ ID NO: 407350 - RNA, 64 nt, Human
gcucaggcgcucccuccaggauucugccccugccuguccacagacuccuuugugcuggaaccug

SEQ ID NO: 407351 - RNA, 64 nt, Human
auguuuucagagccgcuguaggucucuucuugcauguccacaguaauguauuugugguuuuuau

SEQ ID NO: 407352 - RNA, 64 nt, Human
ccgcagcaggugaacaugaccguguuuucaacuguguccacaguucagaucccuuuccagauug

SEQ ID NO: 407353 - RNA, 64 nt, Human
gguggcaaaaggacuccacgccucuguggaaucauguccacagggggaccugccucccgugaug

SEQ ID NO: 407354 - RNA, 64 nt, Human
uggggcugaccacgguguucccuggcaucgucuguguccacacagaugcuaacugguagugcaa

SEQ ID NO: 407355 - RNA, 64 nt, Human
accuggcuuuuggcuccacgcucacucauagccauguccacaugggggcuugcacacaggauca

SEQ ID NO: 407356 - RNA, 64 nt, Human
aauccucccaaccaaccagcaggguagcuauuacuguccacauuuuacaggcaaggaaacaggc

SEQ ID NO: 407357 - RNA, 64 nt, Human
ccucauaauaaagacugugaacugccuggugcaguguccacaugacaaaggggcagguagcacc

SEQ ID NO: 407358 - RNA, 64 nt, Human
gccaaugcaccuccccccaccccccacccucccauguccacagugggucguguguuccuggaca

SEQ ID NO: 407359 - RNA, 64 nt, Human
gaggauguccuuggugcuugggggauacggguucuguccacagagucccuuggagggaaaggug

SEQ ID NO: 407360 - RNA, 64 nt, Human
auggaaagucgcggugaaugcgugcaugucucaauguccacaaaggauucuggcuacccuuugg

SEQ ID NO: 407361 - RNA, 64 nt, Human
augauggucaccagcaggagaaagcuuugaugcauguccacauaucauugacuguauccuguaa

SEQ ID NO: 407362 - RNA, 64 nt, Human
acaaaaucuggggaggacaaaggugauuuuccuguguccacaucuaacaaagucaagauucccg

SEQ ID NO: 407363 - RNA, 64 nt, Human
aaaauuucuagucaucuguggauguuaccuugcuuguccacagcagccagucacccuggccagu

SEQ ID NO: 407364 - RNA, 64 nt, Human
uguugaaacugucugucaugcaccacggugucuguguccacacaguaauaaacgguuuacuguc

SEQ ID NO: 407365 - RNA, 53 nt, Human; identical to SEQ ID NO: 12681

SEQ ID NO: 407366 - RNA, 64 nt, Human
uuuucccuaggugccaucuccucaagcuacaaaauguccacaucuuauauccccuuugcuucua

SEQ ID NO: 407367 - RNA, 64 nt, Human
aggcuugugauuaacuguggcggcagacacagcuuguccacagcuugggccaggcuuccccugu

SEQ ID NO: 407368 - RNA, 64 nt, Human
gaaaauauuuuuauuuugguuuauuuguaaaacuuguccacagucagccuggcacagucgcuca

SEQ ID NO: 407369 - RNA, 64 nt, Human
guuuuggcuggcuccagaguggacagguacgcucuguccacagcagcugcucaggcacaguaug

SEQ ID NO: 407370 - RNA, 64 nt, Human
auacacuguaugaccccaccccaaaucuuuguauuguccacauucuccaacaauaaagcacaga

SEQ ID NO: 407371 - RNA, 64 nt, Human
guacacuaagugaacccagauucuggauucuugguguccacagccuagcugauacgagauagcc

SEQ ID NO: 407372 - RNA, 64 nt, Human
aaauauaaacauucagguuaauuaucuagauuuuuguccacaguauaugauccauccagacauu

SEQ ID NO: 407373 - RNA, 64 nt, Human
auuucugaagagguggaucccagaguggcucugauguccacauuagaaaaacuuacuuguaaug

SEQ ID NO: 407374 - RNA, 64 nt, Human
ucauguuccuccagaauucauaugcugaagccucuguccacacaugcacaccagaugagggcca

SEQ ID NO: 407375 - RNA, 64 nt, Human
aaccuuagaggccagaacuugauccagaaguugcuguccacagaagugcuuucuauuucaucau

SEQ ID NO: 407376 - RNA, 64 nt, Human
cuguaagucaacccaaugauacacaucauguuccuguccacauacugguuuuccccaaaucagc

SEQ ID NO: 407377 - RNA, 64 nt, Human
gcacacguguacagcggaguacgaaaaggaacguuguccacaggggauuuauggauacaacagc

SEQ ID NO: 407378 - RNA, 64 nt, Human
gauuuauuuuacauuucauaugaaagcauaauuuuguccacaugugacucaaauugcauuggua

SEQ ID NO: 407379 - RNA, 64 nt, Human
cucauagggcuaguaagggagauuguauaccuguuguccacagucuucaggcagcuccccaggu

SEQ ID NO: 407380 - RNA, 64 nt, Human
cuuuagcccaggagguugaggcugcagugagccauguccacaccauugcacugcagccugagua

SEQ ID NO: 407381 - RNA, 64 nt, Human
ggaaauuucuaaaccuagugcacuguuuggccaguguccacagccucuuuucuggcuguguuuu

SEQ ID NO: 407382 - RNA, 64 nt, Human
ggaucacauaggaugcgauaccuguggccguguauguccacaugugugccuguagauacaucau

SEQ ID NO: 407383 - RNA, 64 nt, Human
ccuccccaacaccguggaauccucacuggugugcuguccacagauuugugaacuccugguagua

SEQ ID NO: 407384 - RNA, 64 nt, Human
cuggacgccaggccagugccgccuacguggagacuguccacacagcugccucagaagcgccggg

SEQ ID NO: 407385 - RNA, 64 nt, Human
uccauguugccuaccugugccccuggcagccgcguguccacacaguuagcggagcgcgggacuu

SEQ ID NO: 407386 - RNA, 64 nt, Human
gccuggcacaugccugccagcguugugucaugccuguccacaggggauucguggggcucacuuc

SEQ ID NO: 407387 - RNA, 64 nt, Human
ggcuuucaagcgcuuggcagaaucuuguacuucguguccacaaugguacugaauuugcaucugc

SEQ ID NO: 407388 - RNA, 64 nt, Human
ccuggaccugggugggaggaaacuguagccugaguguccacagggacacacgugagccacaggg

SEQ ID NO: 407389 - RNA, 64 nt, Human
uagggauguucuggcccucaccccugcccugggauguccacagaugccuccaccccccagaacc

SEQ ID NO: 407390 - RNA, 64 nt, Human
uuuuacugccaguaacuccaggcuuugacaucccuguccacagcucugagugugugggauaagu

SEQ ID NO: 407391 - RNA, 64 nt, Human
cuggcuacucugguggggacuuggagaaccuuuguguccacacucuguaucuagcuaaucuagu

SEQ ID NO: 407392 - RNA, 64 nt, Human
acaugucuguggguaucacacugagugugaguuguguccacacgugcucaagcagaaggacuuu

SEQ ID NO: 407393 - RNA, 64 nt, Human
cacaguaucaguggaauugauccauaaaccucccuguccacaucuugcccaauggggaauggau

SEQ ID NO: 407394 - RNA, 64 nt, Human
ccagccacgaagagcuggaccagcuucaaguacauguccacagcaacaugcaggaaggccucuu

SEQ ID NO: 407395 - RNA, 64 nt, Human
ccuauuccucccucgccaaacgcguuccagaauuuguccacaggugcgccggcaccugcuuucc

SEQ ID NO: 407396 - RNA, 64 nt, Human
agcugccuucuggucugcaugacacuaagacgcuuguccacagcggcgacccaggccuccaagc

SEQ ID NO: 407397 - RNA, 64 nt, Human
gaaagaacagaaguuguuuggaccuuagagccauuguccacaaucacggaugguucucaagagu

SEQ ID NO: 407398 - RNA, 64 nt, Human
ccaucuauuuuaggggcugucugcuuuucuagucuguccacacagggauuaccugucaucuugc

SEQ ID NO: 407399 - RNA, 64 nt, Human
ucaugcaaaugcauagucagguagauucagaccuuguccacaccuuccugggcaacccccacca

SEQ ID NO: 407400 - RNA, 64 nt, Human
gcccuuggcuacaucauugccuuccugguacuccuguccacagugaagcuuuggcaucugcuca

SEQ ID NO: 407401 - RNA, 64 nt, Human
aaagaagccaugagaggcagcgcccgccacccuguguccacagcccccaccuucccgcuucccu

SEQ ID NO: 407402 - RNA, 64 nt, Human
cccagagggaugacuuccaguuccgucuguccuuuguccacaaggaauuucccuggacgcuaau

SEQ ID NO: 407403 - RNA, 64 nt, Human
guggacgagaaggugcuuccgcugcuugaagguuuguccacauucgucacagauauaguuccgc

SEQ ID NO: 407404 - RNA, 64 nt, Human
gugggcauggaaugcgugaggcuggcuucuggguuguccacaccacucucugcuguguugacuu

SEQ ID NO: 407405 - RNA, 64 nt, Human
uucucagagucauugccgucgagucucugcuuuuuguccacauuuugggaucagcuuacugcau

SEQ ID NO: 407406 - RNA, 64 nt, Human
agaaagaaaccuccagcaagggaagagagguguguguccacaggaaggggcuccguggggaucc

SEQ ID NO: 407407 - RNA, 64 nt, Human
cugaaagguuuguacagaugcaugccacaguagauguccacauaauaaaauucauaguuaccaa

SEQ ID NO: 407408 - RNA, 64 nt, Human
gguguugauuucuggaucacgggauaccacuuccuguccacaccccgaccaggggcuagaaaau

SEQ ID NO: 407409 - RNA, 57 nt, Human; identical to SEQ ID NO: 12725

SEQ ID NO: 407410 - RNA, 64 nt, Human
uuuguucacauagcugaugcgugcccugggaagguguccacagugagcccugugugcaggacug

SEQ ID NO: 407411 - RNA, 64 nt, Human
ggaagguguccacagugagcccugugugcaggacuguccacacgguucacaccuugucaccauc

SEQ ID NO: 407412 - RNA, 64 nt, Human
uccagguccagcccugacuucauccucccuucucuguccacaccacgaguggcacaucccaccu

SEQ ID NO: 407413 - RNA, 64 nt, Human
cuaagcaaggcuauaaaagggaauacuacaguuuuguccacacuuuaauuugagaccauuuuuc

SEQ ID NO: 407414 - RNA, 64 nt, Human
agcacccucuuucgggcugcauccacagaguuuguguccacacuuucucuccgagcaugugggu

SEQ ID NO: 407415 - RNA, 64 nt, Human
aggacccuuccuccuucccuagggcugcagggccuguccacagcuccuguggggguggaggaga

SEQ ID NO: 407416 - RNA, 64 nt, Human
uaagugcaaccgccuagacuuucuuucagauacauguccacauguccauuuuucagguucucua

SEQ ID NO: 407417 - RNA, 64 nt, Human
cccuccaucccugucccccgucccccugucccccuguccacauaccaaucccccuguccccgac

SEQ ID NO: 407418 - RNA, 64 nt, Human
cccgagcagccuggacuuuacaguuaugugaaacuguccacaaaaagucauggcaauaauggug

SEQ ID NO: 407419 - RNA, 64 nt, Human
accagaaaaacgucucccaaucacccaggaaagcuguccacaguaguccccccuuauccacggu

SEQ ID NO: 407420 - RNA, 64 nt, Human
gguucggcucugccccugccccccagcccucguguguccacaccgcagugccucugccccucgg

SEQ ID NO: 407421 - RNA, 64 nt, Human
guuuugggguucacaccccaaaaugacccaacgauguccacacaccaccaaaacccagccaaug

SEQ ID NO: 407422 - RNA, 64 nt, Human
ccgucacacacaccugccuaaagacagggauggcuguccacaggauccuccagccccgugagag

SEQ ID NO: 407423 - RNA, 64 nt, Human
ccuccgccuugcugcaacagagaggaaaugcccauguccacagcuuguacacacugcccccuca

SEQ ID NO: 407424 - RNA, 64 nt, Human
gcuguguaauguauuaauacauccguucaugugcuguccacaugaauguguugacugugcucuc

SEQ ID NO: 407425 - RNA, 64 nt, Human
ucuuguacaugacacuccuccacgcgguuuccaguguccacacugcugcccgugcagugggacc

SEQ ID NO: 407426 - RNA, 64 nt, Human
gugggcaugugagaugagugacugccggugaauguguccacaguugagagguuggagcaggaug

SEQ ID NO: 407427 - RNA, 64 nt, Human
uauggugggcaccaucucucugaugacaguucuguguccacaacccagaccccuccacacaaac

SEQ ID NO: 407428 - RNA, 64 nt, Human
ggucguuuuuuuggcaauucuuccacgugggacuuguccacaagaaugaaaguagugguuuuua

SEQ ID NO: 407429 - RNA, 64 nt, Human
uucccacaucuugccaagacagccuuuguccagcuguccacauugagucagacugcucccgggg

SEQ ID NO: 407430 - RNA, 64 nt, Human
ccaggagauggggugaagggacacagucuugagcuguccacaugcaugugacuccucaaaccuc

SEQ ID NO: 407431 - RNA, 64 nt, Human
cagccuagucauagcucauccccaucucuaaauguguccacacaaccacaucugccuuuuccac

SEQ ID NO: 407432 - RNA, 64 nt, Human
cuucacccaccgcgaccccacacuauuucugugcuguccacacucucuugccucccgacccccg

SEQ ID NO: 407433 - RNA, 64 nt, Human
gagccugucacgguaggagcucucccgguaccaguguccacagaccgcccaacacagaggcuuu

SEQ ID NO: 407434 - RNA, 64 nt, Human
ggcuuugcagggauuuuuaggguuuuuuccacauuguccacauuaaugguuggcaugauugugc

SEQ ID NO: 407435 - RNA, 64 nt, Human
cuuaguaacugugaguauaugaauguguugcacauguccacaguauuggcgagauaauuacaua

SEQ ID NO: 407436 - RNA, 64 nt, Human
cugccucucuugaauagcucuaacuccaaaccucuguccacaccuccagagcaccaaguccaga

SEQ ID NO: 407437 - RNA, 64 nt, Human
gaaauagccacagaugcuccaugaggaaaaucccuguccacauuggaauaaaaaagacauuuuu

SEQ ID NO: 407438 - RNA, 64 nt, Human
ucgaguaaaccugacccaccaauaaggauucagcuguccacacgggcuggcgacacacuuaccg

SEQ ID NO: 407439 - RNA, 64 nt, Human
aaauguaauaaaauugaggcuccacggaggcccguguccacaucagcugcagcucccacucaga

SEQ ID NO: 407440 - RNA, 64 nt, Human
ugagaauguuaacauuuguugaucaauguggagcuguccacauucgguaucuuuucauuuuuau

SEQ ID NO: 407441 - RNA, 64 nt, Human
cugccccuccucucccucaucaaggacacgggccuguccacaggcuucugagcagcgagccugc

SEQ ID NO: 407442 - RNA, 64 nt, Human
cuaaucuuaacuaauuacauuugcaaggaucuuauguccacaaaagucacagucugaggugcug

SEQ ID NO: 407443 - RNA, 64 nt, Human
acacacaaaagagaaagcucuugaauauaagcaauguccacacguuuuuagccagcccacaugc

SEQ ID NO: 407444 - RNA, 64 nt, Human
auugagaaggaaagaagccuggagcagccucuccuguccacagccagggguuaggucugcaggc

SEQ ID NO: 407445 - RNA, 64 nt, Human
ccgucugcaguuccaggccagccagaaacuccuguguccacauagagcugacgugagaaauauc

SEQ ID NO: 407446 - RNA, 64 nt, Human
ggguugaaguaccuuuacuuguaucagaucuuauuguccacauuuuguacuacagaaaaacucu

SEQ ID NO: 407447 - RNA, 64 nt, Human
cuuguaagauaguuuucuauuuccuucaguaauguguccacaguacccuguauuucgaguucca

SEQ ID NO: 407448 - RNA, 64 nt, Human
gugcugcccuuaaccaugacaccauuguaagagcuguccacauuuguauguugugcccuggaau

SEQ ID NO: 407449 - RNA, 64 nt, Human
uggcuacaccacucucccagccugugaccaccgauguccacacacccccaaccacuuguccaca

SEQ ID NO: 407450 - RNA, 64 nt, Human
ugugaccaccgauguccacacacccccaaccacuuguccacacagcuacccacguacgacaucg

SEQ ID NO: 407451 - RNA, 64 nt, Human
uuccuuccuucuuuuuuguuuuugcccccaguucuguccacaccccuucccuuuccuguccugu

SEQ ID NO: 407452 - RNA, 64 nt, Human
uggucuccuuguacucaccauugucucugucagauguccacauugcaaccaaauuuguauuuuu

SEQ ID NO: 407453 - RNA, 64 nt, Human
cccagugcuucugugaacgugaauuuuguucaguuguccacaggagauccacauaauuccuagc

SEQ ID NO: 407454 - RNA, 64 nt, Human
ggggaggggaaggacaggcuggccucuccuucacuguccacagggccuuggguucccugagcug

SEQ ID NO: 407455 - RNA, 64 nt, Human
gaagauguguugcuacucugacaucccgaguuucuguccacacauugcaugcacagcgccccac

SEQ ID NO: 407456 - RNA, 64 nt, Human
gugcccacggggcucccucucccgguggugaaaguguccacacgugugguagucuagugugccg

SEQ ID NO: 407457 - RNA, 64 nt, Human
uccucauuaggacaucaugucuuugucagugccauguccacaguaucugccauacucccuggca

SEQ ID NO: 407458 - RNA, 64 nt, Human
uugaccucaccccugccccuacccgaaggcccucuguccacacaacaugaaccuaggcugugac

SEQ ID NO: 407459 - RNA, 64 nt, Human
uaacuuucggauuaguuaagauaaaagcauacauuguccacaggugagaagauuaaaucagaau

SEQ ID NO: 407460 - RNA, 64 nt, Human
ucaggcaauggcggugacuuacaaugaaccauaauguccacauuucccaacuguauuuuggagc

SEQ ID NO: 407461 - RNA, 64 nt, Human
gccgucaguggaaugcagcugucaggccugaagguguccacagccgggcagguggucacugagg

SEQ ID NO: 407462 - RNA, 64 nt, Human
accucccaugcucucacucucauccccguucucuuguccacacagcucuuccaauaaagguguu

SEQ ID NO: 407463 - RNA, 64 nt, Human
cuggggucccggauucuugggucuccaagaagucuguccacagacuucugcccuggcucuuccc

SEQ ID NO: 407464 - RNA, 64 nt, Human
ucacugcaucaguaucacaucuagcucccuuacuuguccacagauaauguaaacaaaggaggga

SEQ ID NO: 407465 - RNA, 64 nt, Human
uaccaaauguguaauggagauugccucaaaauuguguccacauaauccacgcucaucuugcaaa

SEQ ID NO: 407466 - RNA, 64 nt, Human
gggcuguugccacuuaaaaguucaugaccacaaauguccacagugucuuccucugaggaaacuc

SEQ ID NO: 407467 - RNA, 64 nt, Human
ccgugcaccauccuugacguuuugcugccaccucuguccacauucuucuuggauuuguauaaaa

SEQ ID NO: 407468 - RNA, 64 nt, Human
uccaaguuagaucugcugcucuuagguguggggcuguccacauuagggaacuugccucaaaaac

SEQ ID NO: 407469 - RNA, 64 nt, Human
ggccgggccuccggcggcccggcugcuguucccauguccacaucucugaggccugcacccccuc

SEQ ID NO: 407470 - RNA, 64 nt, Human
ccaagccugcauuuuuuugaguuccuacaucauuuguccacaaagauggcuucagagagguggu

SEQ ID NO: 407471 - RNA, 64 nt, Human
cuccagcggcagggcaugguucuuggcagccugguguccacacggugcauuccugucccccucg

SEQ ID NO: 407472 - RNA, 64 nt, Human
acccaaggucagaggaguggcccucagugucaucuguccacagugauaccugccaagaugacca

SEQ ID NO: 407473 - RNA, 64 nt, Human
guuuuuccaacugaguccaaacuuuucuaaugucuguccacaucaugcauuaggaaauguaauu

SEQ ID NO: 407474 - RNA, 64 nt, Human
ccaggaggagcuguggacacagucgugguucaaguguccacaugcaccuguuagucccugagag

SEQ ID NO: 407475 - RNA, 64 nt, Human
accucugugugugcacugcagacacgccccaguguguccacaugugugugcaugaguccaugug

SEQ ID NO: 407476 - RNA, 64 nt, Human
gcaggcuagacagaaacaugucuugacuguuaguuguccacaaaucuucaguauuuucuccacu

SEQ ID NO: 407477 - RNA, 64 nt, Human
cuugaccguccagcauucacuggccggccagcuguguccacagcaguuuuugauaaagguguuc

SEQ ID NO: 407478 - RNA, 64 nt, Human
aaaauuuuccagauacuugcuuuaaagcuacuuuuguccacaaaugaaauacugucacaguaga

SEQ ID NO: 407479 - RNA, 64 nt, Human
gaaggagcagccagcugggaugggaacccaaggcuguccacaucuggcuuuugugggacucaga

SEQ ID NO: 407480 - RNA, 64 nt, Human
ccaucuuaauagcaugcugcuccuuuuugcucaguguccacagcaagaugacgugauucuuauu

SEQ ID NO: 407481 - RNA, 64 nt, Human
uauaaagaguuguauauguccaccuaaauuccuauguccacacuuaaccuuuaaagauguacau

SEQ ID NO: 407482 - RNA, 64 nt, Human
ccacaaagucuaauuuaauaacuagggacaccuguguccacagcuguggcacagacucccacua

SEQ ID NO: 407483 - RNA, 64 nt, Human
ggaggggcacaguaggacacagugacugcccagguguccacacaccuguaggccucugagccag

SEQ ID NO: 407484 - RNA, 64 nt, Human
uccucauggcauccucccuguacccaggucaggcuguccacaccacaugggagcccagaggagg

SEQ ID NO: 407485 - RNA, 64 nt, Human
ucgucugccuucucacagcuuuccugaguccgcuuguccacagcuccuuggugguuucaucucc

SEQ ID NO: 407486 - RNA, 64 nt, Human
cugggaagcccagucucagucccucccccaacacuguccacacugccccuccccacuguuuauu

SEQ ID NO: 407487 - RNA, 64 nt, Human
gcugacuucauuuuccaauccggagaaggggcucuguccacagucccccgccgccagguggccc

SEQ ID NO: 407488 - RNA, 64 nt, Human
ugagucaggagccugguggggacaagauggaggauguccacagaggcugaccugugggggaaaa

SEQ ID NO: 407489 - RNA, 64 nt, Human
gguuccaguuuguggaagucccaggcaaucacuguguccacaugagcgaaccccagcacguggc

SEQ ID NO: 407490 - RNA, 64 nt, Human
ucgcucccacgcuccuccugccccagcccucugguguccacaccugcccacagagaauguaaac

SEQ ID NO: 407491 - RNA, 64 nt, Human
ccagugcucccugggucauaccaggaucugccucuguccacaaagaugagggaaaaugaugacu

SEQ ID NO: 407492 - RNA, 64 nt, Human
augugccccgugaaagcauguguggcugcagacguguccacaugggccuugcgaaccuggguua

SEQ ID NO: 407493 - RNA, 64 nt, Human
ggagacugugguaggggcagggaggcaacacugcuguccacaugaccuccauuucccaaagucc

SEQ ID NO: 407494 - RNA, 64 nt, Human
ccuggcugcaaaggagguucauauuccccagauguguccacaaaccuguccaggaguugugucu

SEQ ID NO: 407495 - RNA, 64 nt, Human
ucccuguccacacacucccuguccacacacucccuguccacaacugcagccgggcccucugccu

SEQ ID NO: 407496 - RNA, 64 nt, Human
ucccuguccacacacucccuguccacacacucccuguccacacacucccuguccacaacugcag

SEQ ID NO: 407497 - RNA, 64 nt, Human
aaaggccggccacgcucccuguccacacacucccuguccacacacucccuguccacacacuccc

SEQ ID NO: 407498 - RNA, 64 nt, Human
cuacagcugccuaggaaaggccggccacgcucccuguccacacacucccuguccacacacuccc

SEQ ID NO: 407499 - RNA, 64 nt, Human
gaaccacccagccagggcacucagugcauuggacuguccacauguucuugaggaaagccggugg

SEQ ID NO: 407500 - RNA, 64 nt, Human
uaaaauaggaugaaaaucaaguaaaaugcaaagauguccacacuguuuuaaacuugacccugau

SEQ ID NO: 407501 - RNA, 64 nt, Human
aggcacucggcccugaugcccucguguccacuuguguccacacaggcccugggaggagcgggga

SEQ ID NO: 407502 - RNA, 64 nt, Human
acagaugucuggcccauugucuccagucuguuccuguccacagcuucccuuuaugcugagcccc

SEQ ID NO: 407503 - RNA, 64 nt, Human
uucccauggagccaaaguacauccuuggaaucuuuguccacacagcagucaaggcaguuauggc

SEQ ID NO: 407504 - RNA, 64 nt, Human
cuauuucucuucguaaugaauuuucuuuacauccuguccacacugcuggagauacuaaguccca

SEQ ID NO: 407505 - RNA, 64 nt, Human
uuagagcugaaaacacauuuguugauauuugucuuguccacauugugauguucaguauuugagc

SEQ ID NO: 407506 - RNA, 64 nt, Human
ucauaugaaaauaaccauaguacaggaugauuucuguccacacaaagguuaaauuagauugcac

SEQ ID NO: 407507 - RNA, 64 nt, Human
aggaauaaccccauugaguugauuguggccagaauguccacaggccuggccugggggcuguggg

SEQ ID NO: 407508 - RNA, 64 nt, Human
ggccaagcugcagacacacacagucauucauuucuguccacaccccuguggguggcgggugugc

SEQ ID NO: 407509 - RNA, 64 nt, Human
uauaccacaacagcagcaggggccugaaaugugauguccacaagagcuaauacccuacagaugg

SEQ ID NO: 407510 - RNA, 64 nt, Human
ccccaagagacucagagugccuucuccaucccaguguccacacucuccuccagcucugagcccu

SEQ ID NO: 407511 - RNA, 64 nt, Human
ccuuccacagcucauagcucgucaucucggcccuuguccacacucuccaagcacauuacagggg

SEQ ID NO: 407512 - RNA, 64 nt, Human
uauuaaugaaacacuucugaacacugauaggaaguguccacauccacaaaguuucucuugaguu

SEQ ID NO: 407513 - RNA, 64 nt, Human; identical to SEQ ID NO: 349533

SEQ ID NO: 407514 - RNA, 64 nt, Human; identical to SEQ ID NO: 349534

SEQ ID NO: 407515 - RNA, 64 nt, Human; identical to SEQ ID NO: 349307

SEQ ID NO: 407516 - RNA, 64 nt, Human; identical to SEQ ID NO: 349308

SEQ ID NO: 407517 - RNA, 64 nt, Human; identical to SEQ ID NO: 334922

SEQ ID NO: 407518 - RNA, 64 nt, Human; identical to SEQ ID NO: 334923

SEQ ID NO: 407519 - RNA, 64 nt, Human; identical to SEQ ID NO: 334924

SEQ ID NO: 407520 - RNA, 64 nt, Human; identical to SEQ ID NO: 349309

SEQ ID NO: 407521 - RNA, 64 nt, Human; identical to SEQ ID NO: 334943

SEQ ID NO: 407522 - RNA, 64 nt, Human; identical to SEQ ID NO: 349479

SEQ ID NO: 407523 - RNA, 64 nt, Human; identical to SEQ ID NO: 349480

SEQ ID NO: 407524 - RNA, 64 nt, Human; identical to SEQ ID NO: 349481

SEQ ID NO: 407525 - RNA, 64 nt, Human; identical to SEQ ID NO: 349496

SEQ ID NO: 407526 - RNA, 64 nt, Human; identical to SEQ ID NO: 349497

SEQ ID NO: 407527 - RNA, 64 nt, Human; identical to SEQ ID NO: 334960

SEQ ID NO: 407528 - RNA, 64 nt, Human; identical to SEQ ID NO: 349498

SEQ ID NO: 407529 - RNA, 64 nt, Human; identical to SEQ ID NO: 349445

SEQ ID NO: 407530 - RNA, 64 nt, Human; identical to SEQ ID NO: 349446

SEQ ID NO: 407531 - RNA, 64 nt, Human; identical to SEQ ID NO: 334961

SEQ ID NO: 407532 - RNA, 64 nt, Human; identical to SEQ ID NO: 349513

SEQ ID NO: 407533 - RNA, 64 nt, Human; identical to SEQ ID NO: 349514

SEQ ID NO: 407534 - RNA, 64 nt, Human; identical to SEQ ID NO: 349515

SEQ ID NO: 407535 - RNA, 64 nt, Human; identical to SEQ ID NO: 349409

SEQ ID NO: 407536 - RNA, 64 nt, Human; identical to SEQ ID NO: 349410

SEQ ID NO: 407537 - RNA, 64 nt, Human; identical to SEQ ID NO: 334962

SEQ ID NO: 407538 - RNA, 64 nt, Human; identical to SEQ ID NO: 349411

SEQ ID NO: 407539 - RNA, 64 nt, Human; identical to SEQ ID NO: 349462

SEQ ID NO: 407540 - RNA, 64 nt, Human; identical to SEQ ID NO: 349463

SEQ ID NO: 407541 - RNA, 64 nt, Human; identical to SEQ ID NO: 349464

SEQ ID NO: 407542 - RNA, 64 nt, Human; identical to SEQ ID NO: 334979

SEQ ID NO: 407543 - RNA, 64 nt, Human; identical to SEQ ID NO: 334980

SEQ ID NO: 407544 - RNA, 64 nt, Human; identical to SEQ ID NO: 334981

SEQ ID NO: 407545 - RNA, 60 nt, Human; identical to SEQ ID NO: 334998

SEQ ID NO: 407546 - RNA, 64 nt, Human; identical to SEQ ID NO: 334999

SEQ ID NO: 407547 - RNA, 64 nt, Human; identical to SEQ ID NO: 335000

SEQ ID NO: 407548 - RNA, 64 nt, Human; identical to SEQ ID NO: 335019

SEQ ID NO: 407549 - RNA, 51 nt, Human; identical to SEQ ID NO: 335037

SEQ ID NO: 407550 - RNA, 64 nt, Human; identical to SEQ ID NO: 335038

SEQ ID NO: 407551 - RNA, 64 nt, Human; identical to SEQ ID NO: 335077

SEQ ID NO: 407552 - RNA, 64 nt, Human; identical to SEQ ID NO: 335078

SEQ ID NO: 407553 - RNA, 64 nt, Human; identical to SEQ ID NO: 349535

SEQ ID NO: 407554 - RNA, 64 nt, Human; identical to SEQ ID NO: 349536

SEQ ID NO: 407555 - RNA, 64 nt, Human; identical to SEQ ID NO: 349537

SEQ ID NO: 407556 - RNA, 64 nt, Human; identical to SEQ ID NO: 349538

SEQ ID NO: 407557 - RNA, 64 nt, Human; identical to SEQ ID NO: 349539

SEQ ID NO: 407558 - RNA, 64 nt, Human; identical to SEQ ID NO: 349540

SEQ ID NO: 407559 - RNA, 64 nt, Human; identical to SEQ ID NO: 349541

SEQ ID NO: 407560 - RNA, 64 nt, Human; identical to SEQ ID NO: 349542

SEQ ID NO: 407561 - RNA, 64 nt, Human; identical to SEQ ID NO: 349543

SEQ ID NO: 407562 - RNA, 64 nt, Human; identical to SEQ ID NO: 349544

SEQ ID NO: 407563 - RNA, 64 nt, Human; identical to SEQ ID NO: 349545

SEQ ID NO: 407564 - RNA, 64 nt, Human; identical to SEQ ID NO: 349546

SEQ ID NO: 407565 - RNA, 64 nt, Human; identical to SEQ ID NO: 349547

SEQ ID NO: 407566 - RNA, 64 nt, Human; identical to SEQ ID NO: 349548

SEQ ID NO: 407567 - RNA, 64 nt, Human; identical to SEQ ID NO: 349549

SEQ ID NO: 407568 - RNA, 64 nt, Human; identical to SEQ ID NO: 349550

SEQ ID NO: 407569 - RNA, 64 nt, Human; identical to SEQ ID NO: 349551

SEQ ID NO: 407570 - RNA, 64 nt, Human; identical to SEQ ID NO: 349552

SEQ ID NO: 407571 - RNA, 64 nt, Human; identical to SEQ ID NO: 349553

SEQ ID NO: 407572 - RNA, 64 nt, Human; identical to SEQ ID NO: 349554

SEQ ID NO: 407573 - RNA, 64 nt, Human; identical to SEQ ID NO: 349555

SEQ ID NO: 407574 - RNA, 64 nt, Human; identical to SEQ ID NO: 349556

SEQ ID NO: 407575 - RNA, 64 nt, Human; identical to SEQ ID NO: 349557

SEQ ID NO: 407576 - RNA, 64 nt, Human; identical to SEQ ID NO: 349558

SEQ ID NO: 407577 - RNA, 64 nt, Human; identical to SEQ ID NO: 349559

SEQ ID NO: 407578 - RNA, 64 nt, Human; identical to SEQ ID NO: 349560

SEQ ID NO: 407579 - RNA, 64 nt, Human; identical to SEQ ID NO: 349561

SEQ ID NO: 407580 - RNA, 64 nt, Human; identical to SEQ ID NO: 349562

SEQ ID NO: 407581 - RNA, 64 nt, Human; identical to SEQ ID NO: 349563

SEQ ID NO: 407582 - RNA, 64 nt, Human; identical to SEQ ID NO: 349564

SEQ ID NO: 407583 - RNA, 64 nt, Human; identical to SEQ ID NO: 349565

SEQ ID NO: 407584 - RNA, 64 nt, Human; identical to SEQ ID NO: 349566

SEQ ID NO: 407585 - RNA, 64 nt, Human; identical to SEQ ID NO: 349567

SEQ ID NO: 407586 - RNA, 64 nt, Human; identical to SEQ ID NO: 349568

SEQ ID NO: 407587 - RNA, 64 nt, Human; identical to SEQ ID NO: 349569

SEQ ID NO: 407588 - RNA, 64 nt, Human; identical to SEQ ID NO: 349570

SEQ ID NO: 407589 - RNA, 64 nt, Human; identical to SEQ ID NO: 349571

SEQ ID NO: 407590 - RNA, 64 nt, Human; identical to SEQ ID NO: 349572

SEQ ID NO: 407591 - RNA, 64 nt, Human; identical to SEQ ID NO: 349573

SEQ ID NO: 407592 - RNA, 64 nt, Human; identical to SEQ ID NO: 349574

SEQ ID NO: 407593 - RNA, 64 nt, Human; identical to SEQ ID NO: 349575

SEQ ID NO: 407594 - RNA, 64 nt, Human; identical to SEQ ID NO: 349576

SEQ ID NO: 407595 - RNA, 53 nt, Human; identical to SEQ ID NO: 349577

SEQ ID NO: 407596 - RNA, 64 nt, Human; identical to SEQ ID NO: 349578

SEQ ID NO: 407597 - RNA, 64 nt, Human; identical to SEQ ID NO: 349579

SEQ ID NO: 407598 - RNA, 64 nt, Human; identical to SEQ ID NO: 349580

SEQ ID NO: 407599 - RNA, 64 nt, Human
aaaagcauacuuucuuuuuucuuuuccuuuuuucccuccacagacaauguccucuguucaauuc

SEQ ID NO: 407600 - RNA, 64 nt, Human
cugaggcucuuucugggccaaguuccucuagugcccuccacagccgcagccucccucugaccug

SEQ ID NO: 407601 - RNA, 64 nt, Human
aggucccucccagccccaugugccugccgccugcccuccacacaucccuguccccccaacccgg

SEQ ID NO: 407602 - RNA, 64 nt, Human
cucagaggauccaugauccccagcacugucccauccuccacaaaggcccacaggcaugccugua

SEQ ID NO: 407603 - RNA, 64 nt, Human
ccgccacacaguuccagcagagccaggccagccuccuccacaugcagaacccacccuuugagcc

SEQ ID NO: 407604 - RNA, 64 nt, Human
gugacgcccagcuccgccugcugggaagagcuccccuccacagcugcagcugauccauaggacu

SEQ ID NO: 407605 - RNA, 64 nt, Human
gguuucaaacauugcacaagcaacuaacuuuauuccuccacaggaacccagcauuccugaucug

SEQ ID NO: 407606 - RNA, 64 nt, Human
uagcacccgaggcugaccugccuccucuccuaucccuccacaccucccuacccugugccagaag

SEQ ID NO: 407607 - RNA, 64 nt, Human
aauuuuaucuccagauggaaugggguccuagcaaccuccacauguucaacuauuaauggaucau

SEQ ID NO: 407608 - RNA, 64 nt, Human
agcagcucuggaugagaugggaccugcagcucucccuccacaaggugacucuuagcaaccucau

SEQ ID NO: 407609 - RNA, 64 nt, Human
ucagccugaagacacaggguggauuauuuccuggccuccacaccaaacguucccuugcagaugg

SEQ ID NO: 407610 - RNA, 64 nt, Human
caucuccauucucuaaaauuaauauaauugcuuuccuccacacccagccacuguaaagagguaa

SEQ ID NO: 407611 - RNA, 64 nt, Human
auuuuuuuuuuggcgagucaccagugacccgagcccuccacaccagccuccuguaucucaucag

SEQ ID NO: 407612 - RNA, 64 nt, Human
agcaaaaacacuuuccuuucuacugacaaccaguccuccacaucacagcauuuagacauauggg

SEQ ID NO: 407613 - RNA, 64 nt, Human
uccuggaauuuggccugggcguaugcagaggccgccuccacaccccucucccaggggcuuggug

SEQ ID NO: 407614 - RNA, 64 nt, Human
aagagccugcccuccuauauggauucuucagggcccuccacaucugagguggcucauucccauc

SEQ ID NO: 407615 - RNA, 64 nt, Human
agcaguguccagugcaguaccuggaccggagcccccuccacagacacccgcggggcucagugcc

SEQ ID NO: 407616 - RNA, 64 nt, Human
cccugcguuggagccacuccugucccgccuuccuccuccacagugcugcuucucuugggaacuc

SEQ ID NO: 407617 - RNA, 64 nt, Human
cuaaacuacauuguucuuauucuggcaucuuagaccuccacacccgugagaaauccuggagagg

SEQ ID NO: 407618 - RNA, 64 nt, Human
gggcucaggacacaggcccagccacccccaggggccuccacaggccgcugcaugacagcgauac

SEQ ID NO: 407619 - RNA, 64 nt, Human
aaugauaguuucuacagauccuucuccccaccacccuccacaguccuugauccagaacuuaccc

SEQ ID NO: 407620 - RNA, 64 nt, Human
uuguugugcuuagaauugcuggaugcauuuuuacccuccacacaaaccuaaaaauuuugugacc

SEQ ID NO: 407621 - RNA, 64 nt, Human
agaccccgucguuaguccagccccugcuucacccccuccacacacaaaacaggaaacauaauca

SEQ ID NO: 407622 - RNA, 64 nt, Human
cuggcuccccaucccaccuggcuccagagccugcccuccacagcuugcugccaagcuacucccu

SEQ ID NO: 407623 - RNA, 64 nt, Human
uggauuuuuaauauuuuuuaauggaacaugaaaaccuccacagcaacaucgaaaccagggagaa

SEQ ID NO: 407624 - RNA, 64 nt, Human
uugauugggcacaucauuucaagaaguccccucuccuccacauuuguuuugccaauuugcacau

SEQ ID NO: 407625 - RNA, 64 nt, Human
ccucuucugaaauccacuucacccacuccacuuuccuccacagaugccucuucugugccuuaag

SEQ ID NO: 407626 - RNA, 64 nt, Human
uuuccucucucucucuuucucccaagccuuucucccuccacaggaaacagauuuuucagggccu

SEQ ID NO: 407627 - RNA, 64 nt, Human
cagaugaugucccaccacagucccucaccuccggccuccacaugacagaaccaauuuacacuca

SEQ ID NO: 407628 - RNA, 64 nt, Human
acucuguaucuguuggcuucaagagaauauuuugccuccacauauguaccccuucuccuuuuuu

SEQ ID NO: 407629 - RNA, 64 nt, Human
gggguaugugaagcaaaaggggcaggugcacacaccuccacagugaccucugugcacacgguua

SEQ ID NO: 407630 - RNA, 64 nt, Human
uuuacguauauuucauugaauacuuuaugggaagccuccacaacaccuccugauaguaguaaaa

SEQ ID NO: 407631 - RNA, 64 nt, Human
uuucagcucagugacacccauuucagacuucugaccuccacaacuauaaaauaauaaacuugug

SEQ ID NO: 407632 - RNA, 64 nt, Human
cuucccaugcuuguaaccagcucuggggcuugcaccuccacaaaguaagguuggcccuuggagg

SEQ ID NO: 407633 - RNA, 64 nt, Human
caggcagcagcgauuccgacccgccaagucucggccuccacauuaaccauaggauguugacucu

SEQ ID NO: 407634 - RNA, 64 nt, Human
aaucagaucaccuuugaucaaaaugguuggugaaccuccacauguccaguucuguugccaaacu

SEQ ID NO: 407635 - RNA, 64 nt, Human
aucuccuuuuugccuuguacugaaugacacauuaccuccacacucucccggacuagguggucaa

SEQ ID NO: 407636 - RNA, 64 nt, Human
ugaguuguaggaacugcuuuccaacuccaagcucccuccacaaguuucccucccaggcccccca

SEQ ID NO: 407637 - RNA, 64 nt, Human
ugcggccagcccaggucugcaugcugagccccauccuccacagcuugccgcugacgcucucucc

SEQ ID NO: 407638 - RNA, 64 nt, Human
gucgaggccuagccucuguccucucagccuguggccuccacauccccgccgccgaggccuagcc

SEQ ID NO: 407639 - RNA, 64 nt, Human
agucaccgucccaaugagaaacaagaaggagcacccuccacauggacucccaccugcaagugga

SEQ ID NO: 407640 - RNA, 64 nt, Human
uggucagggcaguggccaagccugcuguguccuuccuccacaagguccccccaccgcucagugu

SEQ ID NO: 407641 - RNA, 64 nt, Human
ggugauucaaggauuuggucucggaccagaccccccuccacagcugcccggccccagacccauc

SEQ ID NO: 407642 - RNA, 64 nt, Human
aaaaucuucauguuaggauuaauuuucuuaaucaccuccacacuguacagaggaaacucaagcc

SEQ ID NO: 407643 - RNA, 64 nt, Human
uguguaugugugugcguguuugugugcguguuuaccuccacaggggacacucuacacucagugu

SEQ ID NO: 407644 - RNA, 64 nt, Human
uggcuucacuccgcccauuccaaagagggcucucccuccacacugcagccgggagccucugcug

SEQ ID NO: 407645 - RNA, 64 nt, Human
uaaucuccagucuguguucucucggcucauugaaccuccacacaccgauucucuucgugccuca

SEQ ID NO: 407646 - RNA, 64 nt, Human
cuuccaugcuuucagucagauucaacuauuuuauccuccacaguugcuuaacuugguguuggag

SEQ ID NO: 407647 - RNA, 64 nt, Human
augaucuaaggucuggggaggguggcuggcccggccuccacagcaccccaccccauaucuucuu

SEQ ID NO: 407648 - RNA, 64 nt, Human
uggagggaccuugucucccagcucagggcucuuuccuccacaccauucaggucuuucuuuccga

SEQ ID NO: 407649 - RNA, 64 nt, Human
ggaaccccuucauccucugagugugaccaggcauccuccacaauagcagacaguguuuucuggg

SEQ ID NO: 407650 - RNA, 64 nt, Human
ccacacuguugacuaccucauuccugguuuuuggccuccacaucaucuuuuuucuuaauauuuc

SEQ ID NO: 407651 - RNA, 64 nt, Human
cucucuauuaaaaagaaaaaaaaaaguugcccuuccuccacaggugauuuaguaaauuuagaca

SEQ ID NO: 407652 - RNA, 64 nt, Human
agaguuuuuggccagugcuucugccauuuuuuucccuccacaauuuggccuucuucaaucaagc

SEQ ID NO: 407653 - RNA, 64 nt, Human
gcuuguccgacaacaggccauuucccuuuacauuccuccacagacagaaauggcuauuaaaaau

SEQ ID NO: 407654 - RNA, 64 nt, Human
gucccuuucuccuccccuaguguccuuaaguccuccuccacagggaacaucuauuugggcuuug

SEQ ID NO: 407655 - RNA, 64 nt, Human
ccuuagagcuucugaguuuccaagcucugagucaccuccacauuugggcauggcaucuucaaaa

SEQ ID NO: 407656 - RNA, 64 nt, Human
uuuuuggagggaggaggaaacuguuuacuuuuuuccuccacacguuugauuuuugacacauaca

SEQ ID NO: 407657 - RNA, 64 nt, Human
aaguuuguauauaacugaaauucacucuugacacccuccacagucuuuccaaguuggacucuuc

SEQ ID NO: 407658 - RNA, 64 nt, Human
gcccgcccaccccgccaggcugcacucggucgggccuccacaggcauggaguccccgcaaaaac

SEQ ID NO: 407659 - RNA, 64 nt, Human
gacuuguucuauuuauaaguauuuauuucuaaugccuccacauagcccuguaauauucagaugg

SEQ ID NO: 407660 - RNA, 64 nt, Human
caagggaagagcuggucucccucagaagccccuuccuccacagacuucugaucaucucccucuu

SEQ ID NO: 407661 - RNA, 64 nt, Human
uucagcggacaucaagguaguaauaauaauuuuuccuccacaggucccuccacucauauggccu

SEQ ID NO: 407662 - RNA, 64 nt, Human
aaaaucuggguuagccugaagaaaauugccucagccuccacaguaccauuuuaaauucacauaa

SEQ ID NO: 407663 - RNA, 64 nt, Human
auccuaucucuuucuccaacccugacugcccacuccuccacaaaccgugacccauagccgcccc

SEQ ID NO: 407664 - RNA, 64 nt, Human
acaaguuuacaguuguaagugcaaugacccgaguccuccacaugaccuugugaauugugugcug

SEQ ID NO: 407665 - RNA, 64 nt, Human
ggccgcccccgugcgagcggcaccccugcccugcccuccacagaauuggguuccaagggcuguu

SEQ ID NO: 407666 - RNA, 64 nt, Human
uugcccccaguuccucuucugcuggccuguaugaccuccacagccaggcccugggcccaagccc

SEQ ID NO: 407667 - RNA, 64 nt, Human
cagccuccugaguagcugggauuacaggugugugccuccacacccggcuaauuuuuuguauuuu

SEQ ID NO: 407668 - RNA, 64 nt, Human
aucuaggguuggcgaggcuggagggcagggugagccuccacaugggugcugaagcaagaaaccg

SEQ ID NO: 407669 - RNA, 64 nt, Human
ccaaggcccugggguuccaacucacugugcgucuccuccacacagaccaguagguucuccuaug

SEQ ID NO: 407670 - RNA, 64 nt, Human
cacuaggcagcuagcccaccuccccagccacccuccuccacagguccaggugccgcucccuccc

SEQ ID NO: 407671 - RNA, 64 nt, Human
cuuccucaucuggcacuaugcaugucucacucacccuccacagcacucagucccaucgacguuc

SEQ ID NO: 407672 - RNA, 64 nt, Human
gcucugcuccagaaacauguguguggcuucccuaccuccacaccaaggagcugccuugcugggu

SEQ ID NO: 407673 - RNA, 64 nt, Human
gcuaucagcauuuuggcuggguggaaaaagcucuccuccacagagagcccucccaugucugcug

SEQ ID NO: 407674 - RNA, 64 nt, Human
gacuucugggaacuauuuauugagcaggccugugccuccacaucaucuuguugucucuggggug

SEQ ID NO: 407675 - RNA, 64 nt, Human
cugagggaacucagaggccagcgccggugcggguccuccacaugcugagcgccgguccugggcc

SEQ ID NO: 407676 - RNA, 64 nt, Human
cagugauuuuauucccuagugaggccucugagggccuccacacugccuggcagaacauaccacu

SEQ ID NO: 407677 - RNA, 64 nt, Human
ccacuucugaggugagcuuuugccccaugcccuuccuccacagguguugccuuuuuauaaagac

SEQ ID NO: 407678 - RNA, 64 nt, Human
gaauagccgugagccggaauccugcacggugccaccuccacacucaccucaccucugccugccu

SEQ ID NO: 407679 - RNA, 64 nt, Human
ucuggaguuggggcacagcgagguacugcagcuuccuccacagccggcuguggagcagcaggac

SEQ ID NO: 407680 - RNA, 64 nt, Human
guuacaggucaguacaaccucaguccuuagaaccccuccacacuucagcucugcacccacuuuc

SEQ ID NO: 407681 - RNA, 64 nt, Human
gcuuccgaacuguuuuauugagggcuacuaucugccuccacaauuuuauuaaaaccacuccacc

SEQ ID NO: 407682 - RNA, 64 nt, Human
uaaaauagaaccuccagguaguuuucuuccucuaccuccacauccccccaagacugaaaagagu

SEQ ID NO: 407683 - RNA, 64 nt, Human
ugagguggcacuuuuucauuugccuauucccacaccuccacaguucaguggcagggcucaggau

SEQ ID NO: 407684 - RNA, 64 nt, Human
gggcccaugagguuguggcuggcuuaggcagcaaccuccacauucccacaggccuugagcagaa

SEQ ID NO: 407685 - RNA, 64 nt, Human
agacaauaaacuuacacuggaagcuuugauucacccuccacaguacuccagaaaggacuguccu

SEQ ID NO: 407686 - RNA, 64 nt, Human
cugcugagagcuuccccugcacaauaaaacuuggccuccacaauccuuuaucuuaaccugaaca

SEQ ID NO: 407687 - RNA, 64 nt, Human
acuggcgugugggagacccuguggccggcacccaccuccacacgaggacuaagcucugauuuuu

SEQ ID NO: 407688 - RNA, 64 nt, Human
gauuuguuuaaaaaccaaauaagcaucuguguaaccuccacaguagcauuucuuauuuguuugg

SEQ ID NO: 407689 - RNA, 64 nt, Human
accugcuggugcagagcugaagauuuuggaggguccuccacaauaaggucaaugccagagacgg

SEQ ID NO: 407690 - RNA, 64 nt, Human
uacagcaagugaacaggggcuaccugccacauccccuccacagaugcacuuuaaaaagccacuc

SEQ ID NO: 407691 - RNA, 64 nt, Human
aggauggucucaaucuccuaaccuugagauccacccuccacagccucccaaacugcugggauua

SEQ ID NO: 407692 - RNA, 64 nt, Human
ccuccuccgaggcucugggcugcacccacagguaccuccacacuugggaguuaccaucaucaca

SEQ ID NO: 407693 - RNA, 64 nt, Human
gagaggguguugaguucacugugccagcaugcuuccuccacaguaacacgcugaaggggcuugg

SEQ ID NO: 407694 - RNA, 64 nt, Human
gaggaccccugcccucggccauugaacacugcacccuccacaggagccgcagaggcccgaggca

SEQ ID NO: 407695 - RNA, 64 nt, Human
cacggagauucagucugucuggaaucccggaaccccuccacagaaucgugucuggauccacacu

SEQ ID NO: 407696 - RNA, 64 nt, Human
aggggaagccuugcacuagguugcagagaagcauccuccacauccugugucagaaacccugguc

SEQ ID NO: 407697 - RNA, 64 nt, Human
agaauuaauuuuuccauuugcauauuaauauguuccuccacacauguaaaggcacaguggcucc

SEQ ID NO: 407698 - RNA, 64 nt, Human
gccgaugcaauuuucugccaccacuccaaauacuccuccacaaccagcgucccugucacuaauu

SEQ ID NO: 407699 - RNA, 64 nt, Human
gauaauucagucaugaaccuguuuucuggaugcuccuccacauaaauaauugcuaguuuauuaa

SEQ ID NO: 407700 - RNA, 64 nt, Human
auccccaacagcugccuaauuuuaggagucugacccuccacaucucacuggugugggugcaugg

SEQ ID NO: 407701 - RNA, 64 nt, Human
ccuuugucuccagcccugccuuuauuccuccuugccuccacaccagccuccccuugcuucuccu

SEQ ID NO: 407702 - RNA, 64 nt, Human
cagaacaacuguuaagauggaaaacagugccaaaccuccacagcucauuucuuuguaauauaau

SEQ ID NO: 407703 - RNA, 64 nt, Human
uguucucacccucuaggcccugugccuggaggugccuccacagccgaccagcagccaccccgcc

SEQ ID NO: 407704 - RNA, 64 nt, Human
cucaaguagccuccgccggccugcccugcucgccccuccacagccucggucccugccuuuagaa

SEQ ID NO: 407705 - RNA, 64 nt, Human
ucgucucuguacacaaauacuuucugcauuccccccuccacaccauccuagcgaggcaccagca

SEQ ID NO: 407706 - RNA, 64 nt, Human
cuugcauugcauuuaaugaucccuuuucuccccaccuccacacacuacauuuuuuuuagauuua

SEQ ID NO: 407707 - RNA, 64 nt, Human
uaaagaaaauguauugugauugaaauuauuuuguccuccacaagauggcucuaugaguauucuu

SEQ ID NO: 407708 - RNA, 64 nt, Human
agguggagguagaucuuucucucaaccacaucugccuccacacacagcuccuccgcagggaagg

SEQ ID NO: 407709 - RNA, 64 nt, Human
gaugggaggguggcccccucaagaggacucccagccuccacaucugguuccuaccuucacaucu

SEQ ID NO: 407710 - RNA, 64 nt, Human
uccucuuaagacaacuccuguggcaccguuucucccuccacagggccaaagccauaguguccgg

SEQ ID NO: 407711 - RNA, 64 nt, Human
auuacaccuuuaucucaagauaggaagaaaauuuccuccacauucauguacaaugauguaaaua

SEQ ID NO: 407712 - RNA, 64 nt, Human
caaucuuggcggagcauugcuacccccgcugcccccuccacaguuccugaauggugcuaaggau

SEQ ID NO: 407713 - RNA, 64 nt, Human
auccuggagggagaggccccacgcccccacucucccuccacacuuccaggguuggugcccacga

SEQ ID NO: 407714 - RNA, 64 nt, Human
gguugucaccucucucugaggacagagcuugaagccuccacaccagcugcugcuggagauucaa

SEQ ID NO: 407715 - RNA, 64 nt, Human
aaucacugcucugaaccaguguucuccaccuuguccuccacagaucucauaggaaauguucaac

SEQ ID NO: 407716 - RNA, 64 nt, Human
aagccagagaggccccaaacaggauuguuucuuuccuccacagcccuucugcccaucugagauu

SEQ ID NO: 407717 - RNA, 64 nt, Human
ccuuuccucuguacauauacccuuaagaacgcccccuccacacacugccccccaguauaugccg

SEQ ID NO: 407718 - RNA, 64 nt, Human
aaggaccaaagguuuuaaaagucaauugguaucaccuccacacugacuaggguaguggggugca

SEQ ID NO: 407719 - RNA, 64 nt, Human
ccgccucugagcuccucccacccuccuccaggaaccuccacaucuccaaaaaucucccuguuga

SEQ ID NO: 407720 - RNA, 64 nt, Human
ccuggcuguguucuggaaguucaagacacuuaguccuccacaguggguggaagagugcaagguc

SEQ ID NO: 407721 - RNA, 64 nt, Human
augaacugugugucccaguaggaggucaagaaaaccuccacagccuucuggaugaagaaccugu

SEQ ID NO: 407722 - RNA, 64 nt, Human
uucucccugcccagcucagagcugagggccucccccuccacagcaaccaaucacaaccauaaag

SEQ ID NO: 407723 - RNA, 64 nt, Human
aacuuuaggaaaaggucugauaaaaaccaagaugccuccacauuuugucauaauuguaaccaau

SEQ ID NO: 407724 - RNA, 64 nt, Human
gcuucucugaccauucuuuuugacuguaaugaauccuccacaguuggucagauucauaaagucu

SEQ ID NO: 407725 - RNA, 64 nt, Human
uacgcuuccccugcugagauagccccuacccccaccuccacaggcugggacagccccgucccca

SEQ ID NO: 407726 - RNA, 64 nt, Human
gcagguccagaacuaagugggaguggaggcaggcccuccacagaagcucugcagcaggggcugg

SEQ ID NO: 407727 - RNA, 64 nt, Human
uauucuagacuuguuuuaguaauggaaacucuuaccuccacauauuauccuacagauguuucca

SEQ ID NO: 407728 - RNA, 64 nt, Human
agauuuguuucuguuuuauagauuuaauucaauaccuccacauagauguuuuuauauuacauga

SEQ ID NO: 407729 - RNA, 64 nt, Human
guuucaacuugacccucccacccccugcuacucuccuccacacaccccuccguuccgcuagccu

SEQ ID NO: 407730 - RNA, 64 nt, Human
cccggccugcugcuugcugucgccacucaugucuccuccacaugcgguccacacaucaguaagg

SEQ ID NO: 407731 - RNA, 64 nt, Human
gauggcagaggcaaauccacagaaggggggcugcccuccacacacacacgcccgucacccacac

SEQ ID NO: 407732 - RNA, 64 nt, Human
uuguauagacagagaucagaccucaacaagggagccuccacaguauugaaaaguuaauauaauu

SEQ ID NO: 407733 - RNA, 64 nt, Human
ucuuggagaccacauuuagauggaaaugagaggaccuccacagccccgccucccugccaggaug

SEQ ID NO: 407734 - RNA, 64 nt, Human
aggaaaccuguugugcagagcucuuccccggagaccuccacacacccuggcuuugaaguggagu

SEQ ID NO: 407735 - RNA, 64 nt, Human
guucuuagaauucgcauuuugccagcucagcgcaccuccacaacgaaugaaaugcuccguauga

SEQ ID NO: 407736 - RNA, 64 nt, Human
gcacccaaccuguguuguugccgcccggcccuucccuccacagcucuccuuccucccgcccggc

SEQ ID NO: 407737 - RNA, 64 nt, Human
uucuuuccuaggaccaucuaugugucuccccuccccuccacaaaaaggagaaagagugcauuaa

SEQ ID NO: 407738 - RNA, 64 nt, Human
gaccugguacugaggagcaagacuguccaguucuccuccacaucucccaucccagaaucaggau

SEQ ID NO: 407739 - RNA, 64 nt, Human
cccggaggacgugaugugagacccgcuugugaguccuccacacucguuccccauuggcaagaua

SEQ ID NO: 407740 - RNA, 64 nt, Human
uccugguugcaagagggaugugccuccauuauuuccuccacaguuuugguauuugucagacauu

SEQ ID NO: 407741 - RNA, 64 nt, Human
uccugcccuggugaccuuuuccuaugucuaggcuccuccacaggugcugcuauuuugugagcuc

SEQ ID NO: 407742 - RNA, 64 nt, Human
ccaggcaaugguguggcccugcacuggcccuuggccuccacacucaguggugccccugcaguug

SEQ ID NO: 407743 - RNA, 64 nt, Human
aggcgugucuuccaggcccucccacagcuugugcccuccacaguguggacucaggucccauaga

SEQ ID NO: 407744 - RNA, 64 nt, Human
ugacaccuucucaaccaggaggcaaguaaccccgccuccacaaucuuaguauuuuuuuuaaacu

SEQ ID NO: 407745 - RNA, 64 nt, Human
gggguaggagggacagagagacagggagagucagccuccacauucagaggcaucacaaguaaug

SEQ ID NO: 407746 - RNA, 64 nt, Human
acugaauauggguccccaaauguucccagaggguccuccacacccucugccgacuaccacggug

SEQ ID NO: 407747 - RNA, 64 nt, Human
accgcgcaugugcaugccgugcgggcagacucuuccuccacacagcagacacggaccuauggac

SEQ ID NO: 407748 - RNA, 64 nt, Human
ggugcugcccaggccucucggugcuccaucuccgccuccacacugaccaagugcuggcccaccc

SEQ ID NO: 407749 - RNA, 64 nt, Human
cuucagcccagagccagagggcugggucccggguccuccacaggugaccccgguggacacacgc

SEQ ID NO: 407750 - RNA, 64 nt, Human
cucugauaagagaaucaacauuucucaauaauuuccuccacaaauuauuaaugaaaauaagaau

SEQ ID NO: 407751 - RNA, 64 nt, Human
ccaggaaagccaagcuggcggccaccgcaggggcccuccacauucuggccgguaacugggggaa

SEQ ID NO: 407752 - RNA, 64 nt, Human
ugcuggcuuuccacaccugccuggcccccuccucccuccacacuuccacuuuguccuccucguc

SEQ ID NO: 407753 - RNA, 64 nt, Human
cacagcugcccucuggccucuccaugaugaggugccuccacaacuuccugacaggucagugccc

SEQ ID NO: 407754 - RNA, 64 nt, Human
caccucgcuggccaggcucucccgagucguggcaccuccacaaugugaauuuucugaaucccua

SEQ ID NO: 407755 - RNA, 64 nt, Human
uucccaugugcagucccuguccccccccgccaguccuccacacccaaacuguuucugauuggcu

SEQ ID NO: 407756 - RNA, 64 nt, Human
cucgggcuacaaacaaagacuuugcuaccucccuccuccacaacccccaaguaauuagccuucu

SEQ ID NO: 407757 - RNA, 64 nt, Human
guuuuugaaggcuuuaguucugcuuucugccucuccuccacagccccaaccucccaccccugau

SEQ ID NO: 407758 - RNA, 64 nt, Human
cccuagagcuggggagacgcugggaaagguucaaccuccacacacuaaaaucauuuuggcuccu

SEQ ID NO: 407759 - RNA, 64 nt, Human
cucccuccgucugucuuuccggccuggaccccacccuccacacucucaggccaucacagaacac

SEQ ID NO: 407760 - RNA, 64 nt, Human
ccugcuugcugaccccccgguuucagauuuccggccuccacagcugugagacaauaaauuucug

SEQ ID NO: 407761 - RNA, 64 nt, Human
cugguaaacuguaaaguuacucauguaucccaacccuccacagauuucugaagacaaaguuuug

SEQ ID NO: 407762 - RNA, 64 nt, Human
ccuuuuuauggaccuuuaauggagagagaguaacccuccacagaaugucugaauucuugcauuc

SEQ ID NO: 407763 - RNA, 64 nt, Human
ucugaucccucuguacaggcuggauggaaggggcccuccacacuuccugggaggucagagacaa

SEQ ID NO: 407764 - RNA, 64 nt, Human
uguucuacuuugaauaacagcuuccuugcagucuccuccacaugggugguacuguguuuagaag

SEQ ID NO: 407765 - RNA, 64 nt, Human
caacuugucacccaaagccugucccaggacucacccuccacaaagcaaaggcagucccgggaga

SEQ ID NO: 407766 - RNA, 64 nt, Human
ccucacaugugcacuugaacccaggacccagcauccuccacacaccgugacaaugggcaaaauc

SEQ ID NO: 407767 - RNA, 64 nt, Human
gagauauuuguaguccuaugugaaugagcuuaucccuccacaaccaggugcauaugaaagugua

SEQ ID NO: 407768 - RNA, 64 nt, Human
uuugucuuucuuuccuuuuugacuuuaguagcauccuccacacauuugugugccugauuugaaa

SEQ ID NO: 407769 - RNA, 64 nt, Human
cuggggugucugcacgaagucaggccagcguccuccuccacagccugucacugcccccucccca

SEQ ID NO: 407770 - RNA, 64 nt, Human
agcgccccuccuggggcugcugcagcuucuggggccuccacagaccccccuccugcggggcacg

SEQ ID NO: 407771 - RNA, 64 nt, Human
cacgcaugagcaaacguguacagacuggcacaugccuccacaugcgaacacccacuuacacaca

SEQ ID NO: 407772 - RNA, 64 nt, Human
aaagccauaucuugcaccagcagcaugaauggucccuccacacucugggcucugggcuccuuga

SEQ ID NO: 407773 - RNA, 64 nt, Human
ugggaggucccuuucucccucggugaaacacaguccuccacaucaauuuccaaacaaugaauua

SEQ ID NO: 407774 - RNA, 64 nt, Human
gacucuccagucagaaaugugucgcauaguuccaccuccacaccucucugcugccagcacauuc

SEQ ID NO: 407775 - RNA, 64 nt, Human
gaaggccuccccuccgagcccagcucuccugucuccuccacagccaggcccugcacgcccaccu

SEQ ID NO: 407776 - RNA, 64 nt, Human
agggaugggaccccucucugcugcccccuccuccccuccacacugcccaucucugaugucuggc

SEQ ID NO: 407777 - RNA, 64 nt, Human
cccagcccagagccaccuggaucuaucccugcggccuccacaccugaacuugccuaacuaacug

SEQ ID NO: 407778 - RNA, 64 nt, Human
ccugcaaagaagcaccacucuagacuggcaagggccuccacaguguggaggucccauuuuauua

SEQ ID NO: 407779 - RNA, 64 nt, Human
uucuggggagcaucuucccgcuccggccccacgaccuccacaggguuacauuguaauauauaug

SEQ ID NO: 407780 - RNA, 64 nt, Human
uacucauuaacucagcagacaugaggcagcauuuccuccacacuaggguggcugagaggggucc

SEQ ID NO: 407781 - RNA, 63 nt, Human
ugaaggugcggcccgccuagacgggccaggaccccuccacaugcaccugcuaguggggaggcc

SEQ ID NO: 407782 - RNA, 64 nt, Human
cccccaacacccccgugcucugcaccagccucucccuccacacccgaagcaggcguccaucugu

SEQ ID NO: 407783 - RNA, 64 nt, Human
ggugaagcugugacaagggagugaccauccauccccuccacaggagggugaggaauugggacag

SEQ ID NO: 407784 - RNA, 64 nt, Human
ccaucuuucuguuugucgucuuguugauuugcugccuccacacugucagcuccuugggaacaga

SEQ ID NO: 407785 - RNA, 64 nt, Human
aaaacaugucuccuauccugguuuuuguagccuuccuccacauccuuucuaaacaagauuuuaa

SEQ ID NO: 407786 - RNA, 64 nt, Human
gagaacaacugagggccacccggucggggccaucccuccacacucugcauccuaccccaccuac

SEQ ID NO: 407787 - RNA, 64 nt, Human
aggaaggcugugugggucuggagcccacgucccaccuccacacccuuggcuugggcccaugccc

SEQ ID NO: 407788 - RNA, 64 nt, Human
ucuuaagaaccagcccacaacagccucucuuucuccuccacauacugcagccucccuccaugca

SEQ ID NO: 407789 - RNA, 64 nt, Human
guuucaggagaggacugugcuggaucaugcuugcccuccacagggaauacagcauccuuacagc

SEQ ID NO: 407790 - RNA, 64 nt, Human
cccaggcagugggaggucugcagccuggucauggccuccacagcaggucccuguggacagacau

SEQ ID NO: 407791 - RNA, 64 nt, Human
uaacagggagcccggcugccucaccuggccacagccuccacaccagaucuccacauugucuuga

SEQ ID NO: 407792 - RNA, 64 nt, Human
gggaccacaucaagcuucaggccgacagcuucggccuccacaucguccccgucugaccccaccc

SEQ ID NO: 407793 - RNA, 64 nt, Human
gcccggaggcuuagggugcagccucccuggucuuccuccacacaguuguucaccaacagaccag

SEQ ID NO: 407794 - RNA, 64 nt, Human
ucuccagguacaguucgggguguggaugccucuuccuccacaagggcacaguguuguggagggc

SEQ ID NO: 407795 - RNA, 64 nt, Human
cuccagcagccaugcaugugcgcccgcagcccugccuccacagcucgccacacacucacgcuuc

SEQ ID NO: 407796 - RNA, 64 nt, Human
cgacaaacuugaguguuucccugccacuucugugccuccacagccugcuccaguuccgcagcua

SEQ ID NO: 407797 - RNA, 64 nt, Human
agggcagagugagacccagcccucaucccgagcaccuccacauccuccacguucugcucaucau

SEQ ID NO: 407798 - RNA, 64 nt, Human
ucugucuuuauuuccaggcuucuccacccauauuccuccacagaucucucuuccuugacauuug

SEQ ID NO: 407799 - RNA, 64 nt, Human
ugaguguuuuuauuucugcaguuauuaguuggauccuccacaucuugcauauauacaugggcuc

SEQ ID NO: 407800 - RNA, 64 nt, Human
gucucuucucaucuuaacugucccuuccaaccacccuccacacugcugccagagcaaucuuaaa

SEQ ID NO: 407801 - RNA, 64 nt, Human
gauuuugcuuuuguuuuuguuucacauucuucccccuccacaagccaaagucguuucauuuggu

SEQ ID NO: 407802 - RNA, 64 nt, Human
uaccuccagggugucauuggguuccagcugcucuccuccacauugaaugauaucuuguuaauuu

SEQ ID NO: 407803 - RNA, 64 nt, Human
ugaaccccuuccuucugccuccagggccugucugccuccacaucacucugaggacagggacagg

SEQ ID NO: 407804 - RNA, 64 nt, Human
cuggguucuaaccucuaaauaggggagaucccagccuccacaaagaggcccuuuuauuuuuuau

SEQ ID NO: 407805 - RNA, 51 nt, Human
ggauccggggcagcuccugacccuccacagccaccuggucagccaccagcu

SEQ ID NO: 407806 - RNA, 64 nt, Human
ggagggugggugaauuccaguguggucagccaguccuccacagcaccucguggcccguacucuu

SEQ ID NO: 407807 - RNA, 64 nt, Human
cguggcauucccagacagcacaccacugugguccccuccacacucaccccaaccaaagcuaaug

SEQ ID NO: 407808 - RNA, 64 nt, Human
ccagaacacacuccaucagcuuaggggcugcugaccuccacagcuuccccucucuccuccugcc

SEQ ID NO: 407809 - RNA, 64 nt, Human
guuccuggcggggcuauccucuccucccuuggcuccuccacaggcuggcugucggacugcgcuc

SEQ ID NO: 407810 - RNA, 64 nt, Human
gucauugagauacaaguuuccgaacaggagccccccuccacagauguccccccauccccagagg

SEQ ID NO: 407811 - RNA, 64 nt, Human
ugaugugcuggugcuguguccccaaaaccggggcccuccacagaggccccuucccagcgacacu

SEQ ID NO: 407812 - RNA, 64 nt, Human
uggagugcaguggcgcgaucucggcucacugcaaccuccacaucccauguugaaguaauucuuc

SEQ ID NO: 407813 - RNA, 64 nt, Human
ccuggcuuuuuaacuccccuguuucaaucacuguccuccacacaagggaaggacagaaaggaga

SEQ ID NO: 407814 - RNA, 64 nt, Human
cucucuauuauacaccagugugugccugcagcagccuccacagccacgauggguuuguuucugu

SEQ ID NO: 407815 - RNA, 64 nt, Human
cgccucacccgcccccuccccccacuccaggcccccuccacaucccgcuucgccucccuccagg

SEQ ID NO: 407816 - RNA, 64 nt, Human
uacccucucacuuaacuggagcuuugggacgcacccuccacagugggagguggugguggguggc

SEQ ID NO: 407817 - RNA, 64 nt, Human
gcuuugagaagccuucagcuccagggaauccaagccuccacagcgagggcagcugcuauuuauu

SEQ ID NO: 407818 - RNA, 64 nt, Human
aacagaauuuugaauuguuuuucuuugcaaaaccccuccacaaaagcaaauccuuucaagaaug

SEQ ID NO: 407819 - RNA, 64 nt, Human
ucugcucugaaaugucccacaucuccuuuuuuuuccuccacacccuauauagacacuuccugaa

SEQ ID NO: 407820 - RNA, 64 nt, Human
cauggagcaauuccaaggccccaguuacccaucaccuccacaccaggucaaguuuugucucagc

SEQ ID NO: 407821 - RNA, 64 nt, Human
cugagagcaggugggcacuggcuggguacggugcccuccacaggacucucccuacugccugagc

SEQ ID NO: 407822 - RNA, 64 nt, Human
cucuccugauaacagaauccaauuuccuuccuucccuccacagguuuggaacaaacucucccuu

SEQ ID NO: 407823 - RNA, 64 nt, Human
acucccuucauguaauccucuuuuccuccccacuccuccacagagggcagagcucaggacauuu

SEQ ID NO: 407824 - RNA, 64 nt, Human
aagaucacugaagaaagaggaacccccacaacccccuccacaaagagaccaggggcgggugaug

SEQ ID NO: 407825 - RNA, 64 nt, Human
gggagaaauggcccguggugggcugaccccccacccuccacacacacaguuccaugacccagcg

SEQ ID NO: 407826 - RNA, 64 nt, Human
augugauagaucuggucccucuccuugaacuaccccuccacacgcucuagucccuucaaccuac

SEQ ID NO: 407827 - RNA, 64 nt, Human
cacgccaacuucaggcaguguuuucuacugcaaaccuccacauccuggaaucaaucacacugac

SEQ ID NO: 407828 - RNA, 64 nt, Human
cccccaaccacagcagagacuagcagcggggccaccuccacaaccaccaccacaagguaggugc

SEQ ID NO: 407829 - RNA, 64 nt, Human
ggggcgcuuccccccgcuccuccaucacccucagccuccacacuucaaaguucaaguucaaagc

SEQ ID NO: 407830 - RNA, 64 nt, Human
agugugagaucuuuggacacccauggaauccuuuccuccacaccacccgugcacuugccaaaga

SEQ ID NO: 407831 - RNA, 64 nt, Human
gaaggccagcagaucacugagagugcaaccccacccuccacaggaaauugccucaugggcaggg

SEQ ID NO: 407832 - RNA, 64 nt, Human
cgccccugagugcuuugucauauagcacagaaguccuccacacugccugggacaguguccugca

SEQ ID NO: 407833 - RNA, 64 nt, Human
gaguuccuguuuugcucaucccgcaccaccccacccuccacacacuaacaucccuuucuucccc

SEQ ID NO: 407834 - RNA, 64 nt, Human
gcuccccucuggcuaugaagagguuaacgcggccccuccacaccuggaggucagaaccuggccu

SEQ ID NO: 407835 - RNA, 64 nt, Human
cucacuuuuggcucacugcagcccuuguccuucaccuccacacaggaccagcuggaagcagaaa

SEQ ID NO: 407836 - RNA, 64 nt, Human
cuuuuucccuccucagaugaccuuacuuccacugccuccacaaagaccuucuuaccaugaccug

SEQ ID NO: 407837 - RNA, 64 nt, Human
ugaaaauagugaagcccacagaaaauaaguagcuccuccacagguuguaagcuaggucuagcug

SEQ ID NO: 407838 - RNA, 64 nt, Human
cccagagccauacugccuugggucaguccagcccccuccacaucacugagccaucaaugagcug

SEQ ID NO: 407839 - RNA, 64 nt, Human
agauuuuaaaaaaucauuucuagauuauuuuuuuccuccacaguccuuuuuuuucaccuaacgc

SEQ ID NO: 407840 - RNA, 64 nt, Human
uuuuuacuuuuauugggaauaaggaauguuugcaccuccacauuuuauugcuucuggaugugaa

SEQ ID NO: 407841 - RNA, 64 nt, Human
gaacagacggagaagaugugcuagggagaaucugccuccacagucacccauuucauugcucgcu

SEQ ID NO: 407842 - RNA, 64 nt, Human
agaggugcagugugaucugagccuccaucauuguccuccacaaacauauuuucauauucuuuau

SEQ ID NO: 407843 - RNA, 64 nt, Human
aagaccagcgugggcaauauagcaagacuccaccccuccacaccccaaaaaaguaaguuuagga

SEQ ID NO: 407844 - RNA, 64 nt, Human
agcugacuguguaugagccugggagaaugugucuccuccacaguggcucccagagguuccacac

SEQ ID NO: 407845 - RNA, 64 nt, Human
accgccgggggcggcccggggccgcucggcggcaccuccacacccgccccaacgcguucucugg

SEQ ID NO: 407846 - RNA, 64 nt, Human
auaguccuuaaagugaaaacugaguuguugcugaccuccacaaaagaauauggaaaaaagccuu

SEQ ID NO: 407847 - RNA, 64 nt, Human
gcucagggauccccggacaccucuguccagagccccuccacagucggccucaugacuguccucc

SEQ ID NO: 407848 - RNA, 64 nt, Human
cuuccugugagugacaccagugaugaaauggaccccuccacacaggcauccucagggcacaggg

SEQ ID NO: 407849 - RNA, 64 nt, Human
cgugggccaaauuaaaacaaacaaaaccgcaacuccuccacagaaacacaaacacaguuauucc

SEQ ID NO: 407850 - RNA, 64 nt, Human
guaggggaggaaggggugcaugcaugucccccacccuccacagucuuccuugccuuuagaguga

SEQ ID NO: 407851 - RNA, 64 nt, Human
ugacuaccuagauccccagcuuaccgguuaguuuccuccacaggcuuccaugagcucagugucc

SEQ ID NO: 407852 - RNA, 64 nt, Human
ggcgcagcaccugggcaguguccccaccccaggcccuccacauccuccucccugucuggugucu

SEQ ID NO: 407853 - RNA, 64 nt, Human
ccaccguacaacccccuccaccccccacucagugccuccacaugcugccuggcacagaccaggc

SEQ ID NO: 407854 - RNA, 64 nt, Human
ggcauccaugugugcaaaccaucugccccagcugccuccacagacugcugucuccuuguccucc

SEQ ID NO: 407855 - RNA, 64 nt, Human
cccugacuguugccucacuuccuuggaacuccugccuccacagccccuccaguggcagggacag

SEQ ID NO: 407856 - RNA, 64 nt, Human
ggggaaggcugauaacggcguaagaugaaguggcccuccacaaaggcugguuaggggacaguuc

SEQ ID NO: 407857 - RNA, 64 nt, Human
gcugcagcucugcucaacugcgucuucucucagcccuccacacacacucacccccacucccaca

SEQ ID NO: 407858 - RNA, 64 nt, Human
accccuaaaagaaacccugcacccauuagcagucccuccacauuucccccuagccugccucccc

SEQ ID NO: 407859 - RNA, 64 nt, Human
gucacaaucauucuguccaauccagccaagguucccuccacauaugaagauggaccauggcagg

SEQ ID NO: 407860 - RNA, 64 nt, Human
auucucagggucacuucugccuccucccguuuccccuccacauccaaacagcacccugguccuc

SEQ ID NO: 407861 - RNA, 64 nt, Human
ggcuuccccccagccuggcagcagcgucccagcgccuccacauugccccucucaccucccagcu

SEQ ID NO: 407862 - RNA, 64 nt, Human
ccaagcuccauucuuccuucccucaacucucugcccuccacagagcuauggagaaggcuggaga

SEQ ID NO: 407863 - RNA, 64 nt, Human
cauauuuucugcauaacacuauuaauaauaucaaccuccacagccccuuauuuuauuauuucca

SEQ ID NO: 407864 - RNA, 64 nt, Human
ccugcagcugacccacgcuugggcaucaauggcaccuccacacagccgaagcacccggcaucuu

SEQ ID NO: 407865 - RNA, 64 nt, Human
acagccagcacauacaccuaggcuguuuuuccuuccuccacaccugagggacgcagcaacagcu

SEQ ID NO: 407866 - RNA, 64 nt, Human
gauguuuuccuuucuuccuucuuuacuggaaggaccuccacauucuucccuccuuggaagagga

SEQ ID NO: 407867 - RNA, 64 nt, Human
gcaccucgacuugugaacgaguuguuggcugcucccuccacagcuucugcagcagacugucccu

SEQ ID NO: 407868 - RNA, 64 nt, Human
ucuggggccagaauggcuguccuugucguagagcccuccacauuuucuuuuucuuuuuugagac

SEQ ID NO: 407869 - RNA, 64 nt, Human
acuacaagugugagccaccgcgccuggcccaagcccuccacauuuucaauccaggagccuugag

SEQ ID NO: 407870 - RNA, 64 nt, Human
cuccaugagaagccguggguggaaccaggaaccuccuccacaccagcgcugaugcccaauaaag

SEQ ID NO: 407871 - RNA, 64 nt, Human
agaucaggagugacagaucacagggugagggccaccuccacacccacccccucuggagaaggcc

SEQ ID NO: 407872 - RNA, 64 nt, Human
acccuuugggacaguuacuucugggacccccuuuccuccacagagcccuucucccugguuucac

SEQ ID NO: 407873 - RNA, 64 nt, Human
ccuaccacaaaccaggcuggaacccaagccccuuccuccacagcugccuucaguggguagaaug

SEQ ID NO: 407874 - RNA, 64 nt, Human
gacacuuuggugcagaagcuucuuuucaauccauccuccacaagaagguguuucccuguuguua

SEQ ID NO: 407875 - RNA, 64 nt, Human
ggggggacaucucaccucccccauggcacagagcccuccacaccccuggaccagggcauccggg

SEQ ID NO: 407876 - RNA, 64 nt, Human
agccucagcccccuccagcccacuggggcucucaccuccacauguggguagaagcuuuccugcc

SEQ ID NO: 407877 - RNA, 64 nt, Human
ccgagggcugcccugcccuggaagggccccucugccuccacaccaguggagucuucgagacuug

SEQ ID NO: 407878 - RNA, 64 nt, Human
ccgccagccgcgcccugcgccaccuacccgggguccuccacagcggaggccugcaggaaugucc

SEQ ID NO: 407879 - RNA, 64 nt, Human
cccaccgcaagcaacgcugccugccucugccgcuccuccacaucuugccgcugcccagcagagc

SEQ ID NO: 407880 - RNA, 64 nt, Human
cccagccagggcuugacacgcccacagucaggggccuccacaugccuggccuggcucuggaagu

SEQ ID NO: 407881 - RNA, 64 nt, Human
cucuggagaaugacuauggacagaaggccaccauccuccacagagcacccuguccugaguaggg

SEQ ID NO: 407882 - RNA, 64 nt, Human
uuccugcauuaguaacuacagcugcaacagacauccuccacauugugcacacugguuuugccuu

SEQ ID NO: 407883 - RNA, 64 nt, Human
gugacaaagucugagggucuuccuuuaugcuugcccuccacacuaagagaaguuggcgucuccc

SEQ ID NO: 407884 - RNA, 64 nt, Human
gggucagacccugugacccacaugccacccccacccuccacagagcccccuugcugggacagcc

SEQ ID NO: 407885 - RNA, 64 nt, Human
cucuaaccuccuuuuucuuuuuuuaaugcugcagccuccacacuccacccacagguggacccuu

SEQ ID NO: 407886 - RNA, 64 nt, Human
guccauccugauaucuccugaauucagaaauuagccuccacaugugcaauggcuuuaagagcca

SEQ ID NO: 407887 - RNA, 64 nt, Human
cagugguuaguggcuucaaaggcccagcugacacccuccacagccuaagggguguccuaaagug

SEQ ID NO: 407888 - RNA, 64 nt, Human
cuaccuccuggaguuauacaacuuggcuuguuuaccuccacaugcugaugaugacuauuuuuuu

SEQ ID NO: 407889 - RNA, 64 nt, Human
gauagggccauggcuggucccccaccauaccuccccuccacaucacugacacagcugagcuugu

SEQ ID NO: 407890 - RNA, 64 nt, Human
agggccgugugccccaugcuacccuccccgccucccuccacagugaucagcugugccucucugc

SEQ ID NO: 407891 - RNA, 64 nt, Human
caccaccaggguggaccaggccuggagggcacuuccuccacagucccccacccaccuccugcgg

SEQ ID NO: 407892 - RNA, 64 nt, Human
guccauuccaauacauugaacacauuuccuuuacccuccacacacuucuuccaaaaggaagcac

SEQ ID NO: 407893 - RNA, 64 nt, Human
uaugcuuccggccuccugucccucauccauagcaccuccacauaccuggcccugugccuuggug

SEQ ID NO: 407894 - RNA, 64 nt, Human
agccugggcucacugugcuggggcacggcgggauccuccacagagaggaggggaccaauucugg

SEQ ID NO: 407895 - RNA, 64 nt, Human
uuuucugccagggguacugggucccccucagcacccuccacagcacaggccuuccaaguggaug

SEQ ID NO: 407896 - RNA, 64 nt, Human
ccagcauguccucacaugcucaugcccacccgcuccuccacaagccuaguccauccugccugag

SEQ ID NO: 407897 - RNA, 64 nt, Human
agggugagcuccagcugcugcgcacggcggccuaccuccacaccacaaccaccuucaccuggau

SEQ ID NO: 407898 - RNA, 64 nt, Human
ugcuccagcuugcuggauguuaccuguccucuucccuccacaagucuuggcccuuaaccuuuau

SEQ ID NO: 407899 - RNA, 64 nt, Human
cccaccuucaccuuagggaagaugccacaccuggccuccacacuugcucuucugaucagucugu

SEQ ID NO: 407900 - RNA, 64 nt, Human
auggacagcaggguguucucagcucccagcgaagccuccacaacagaauggggccacagggcag

SEQ ID NO: 407901 - RNA, 64 nt, Human
ccggggccaggacagacaaaccagagccucugcgccuccacagggaaaaggcaaggcuuccagg

SEQ ID NO: 407902 - RNA, 64 nt, Human
cggccucccaaagugcugggauuacaggugugagccuccacaccuggcuguuuucuuugauuuu

SEQ ID NO: 407903 - RNA, 64 nt, Human
ccuggaagguagacgagauagcgccacccacgccccuccacaccccagacuccgaguaaagcgg

SEQ ID NO: 407904 - RNA, 64 nt, Human
cuccuaccagagugaagcccacagagucccuccaccuccacaccaggcccucucuccaguuuua

SEQ ID NO: 407905 - RNA, 64 nt, Human
cuuugaaggccgaaggcagugcaagagacucuggccuccacaguucgaccugcggcugcugugu

SEQ ID NO: 407906 - RNA, 64 nt, Human
gucaugcaggcuuccaggaacauagacuguuuuaccuccacaacccuauuuguuauuagugaua

SEQ ID NO: 407907 - RNA, 64 nt, Human
agcaggagccugagccuugggaacaugcgugugaccuccacagcuaccucuucuauggacuggu

SEQ ID NO: 407908 - RNA, 64 nt, Human
cucugaugacaguucuguguccacaacccagaccccuccacacaaacccagauggggcugugcc

SEQ ID NO: 407909 - RNA, 64 nt, Human
uggggguggggggucccaaagaguuugaugaggcccuccacaccugcggcccaauccaaggugg

SEQ ID NO: 407910 - RNA, 64 nt, Human
aggggaggagggcggggggcaccuacuacaucgcccuccacaucccugauuccuguuguuaugg

SEQ ID NO: 407911 - RNA, 64 nt, Human
ugacuguuauaucuuuagugguugucucccucucccuccacagucuccuuggcauuccaugaca

SEQ ID NO: 407912 - RNA, 64 nt, Human
cuaagaagacaucccacuaggaagagagagacuaccuccacaucaagaauauuuaaguuauuau

SEQ ID NO: 407913 - RNA, 64 nt, Human
ccucugcucuccgaccucucuccucugaaacccuccuccacagcugcagcccauccucccggcu

SEQ ID NO: 407914 - RNA, 64 nt, Human
cagucauaauucacaauucagacagcccaggcuuccuccacagugguccaaggagcaguccuca

SEQ ID NO: 407915 - RNA, 64 nt, Human
agacagccucccccuguccccucuaugaccucgcccuccacaaaugggaaaaccagacuacuug

SEQ ID NO: 407916 - RNA, 64 nt, Human
augaacaguuguagggagacccagcagcaccuuuccuccacacaccuucauuuugauguucggg

SEQ ID NO: 407917 - RNA, 64 nt, Human
agccgaaccagcacucucccggaagccuggggucccuccacaccuuggcuuuuaugacccugau

SEQ ID NO: 407918 - RNA, 64 nt, Human
cagguggcuggcugucuggccgucucgccccgccccuccacaggacccuggaccagggcggugc

SEQ ID NO: 407919 - RNA, 54 nt, Human
ggggcuucugggccugcugagcucccuccacacaccucaagccccaugccgugc

SEQ ID NO: 407920 - RNA, 64 nt, Human
cgcccgcccgcccacgcuguccuccacuuaggcuccuccacaaacgcuggcgggugugccgccc

SEQ ID NO: 407921 - RNA, 64 nt, Human
cugucuauuuaguauaucaaaguuuuaguaguuuccuccacauucacgaaauuaccacagugag

SEQ ID NO: 407922 - RNA, 64 nt, Human
uguuaauaagcacuggucuaacacagccaacccuccuccacagcgccauauuaauggaggaggg

SEQ ID NO: 407923 - RNA, 64 nt, Human
gagcacagggucuguccuuagacauaauggugacccuccacaagcucuguggcuuuuaaaguuc

SEQ ID NO: 407924 - RNA, 64 nt, Human
uggagugcaguggcgugaucucggcucacugcaaccuccacaucccggguucaagugauucucc

SEQ ID NO: 407925 - RNA, 64 nt, Human
aagucuuacauuuaaccccccuuucuaccaccccccuccacacuucacgucagcuacauaguuu

SEQ ID NO: 407926 - RNA, 64 nt, Human
uacucaaaaaccugaaucccaccccucgaccaauccuccacaaacuucaguuguugguuaacgu

SEQ ID NO: 407927 - RNA, 64 nt, Human
cgggugucccaguggcaccacuaggugccugcugccuccacagugggguucacacccagggcuc

SEQ ID NO: 407928 - RNA, 64 nt, Human
gcucuuggugacuguggcagcgggaguucccggcccuccacacccggggccagacccucggggc

SEQ ID NO: 407929 - RNA, 64 nt, Human
ggggccugugaccucccauggagcccagccccgcccuccacaccuccggcgcuccgcacccacc

SEQ ID NO: 407930 - RNA, 64 nt, Human
gcuggugaggagggggccgcgccaggcucccaggccuccacagagucuucagcgcaucccccaa

SEQ ID NO: 407931 - RNA, 64 nt, Human
ggccucuugaugucugggauggcacguggcccgaccuccacaagcucccucaugcuuccugucc

SEQ ID NO: 407932 - RNA, 64 nt, Human
ccuccacccucaccccuuccuaggggaaccccacccuccacacagccggagcugcccuagggag

SEQ ID NO: 407933 - RNA, 64 nt, Human
uccaugccagcuuuuuuuuuugcuggaaaugcccccuccacaccccugguagcucuguguccug

SEQ ID NO: 407934 - RNA, 64 nt, Human
uaacugaccauuuuuuggaaacccucuccucccuccuccacaccuugagugaugaccacaccaa

SEQ ID NO: 407935 - RNA, 64 nt, Human
ucgaguucaguggugccaucucuguccacugcaaccuccacauccuggguucaagugauucucc

SEQ ID NO: 407936 - RNA, 64 nt, Human
uuauguaaccacguggaaagcggccccugcugccccuccacacacacauacacacucacugauc

SEQ ID NO: 407937 - RNA, 64 nt, Human
ccagacccuccuuagaaugccacagucccccaacccuccacagagcccccagacccaccagaac

SEQ ID NO: 407938 - RNA, 64 nt, Human
agcucgguguucagcuuacagagaccaccccuuuccuccacagggagaggcuccucccucuccu

SEQ ID NO: 407939 - RNA, 64 nt, Human
uuguggaaccagugaugccucaaagacaguguccccuccacagcugggugccaggggcagggga

SEQ ID NO: 407940 - RNA, 64 nt, Human
caaacaaggaauccuugccuuuaaggugacaggcccuccacaggcuuccagacuugaaggaaaa

SEQ ID NO: 407941 - RNA, 64 nt, Human
cucuggccauccacuagcccagggaggacccagaccuccacacuccauggagacucaguucucc

SEQ ID NO: 407942 - RNA, 64 nt, Human
gugaggccucuccccuggcaccugcuucaguuguccuccacagcacugauuugcagcccacaag

SEQ ID NO: 407943 - RNA, 64 nt, Human
acaaagccauggggaaguuccagcugagcagagcccuccacagcucagcaaagccucuguagcc

SEQ ID NO: 407944 - RNA, 64 nt, Human
guaacuguccuagagcugggacaggucacgccugccuccacaucucuguuucuucagcgggaaa

SEQ ID NO: 407945 - RNA, 64 nt, Human
aaauuccugggcucaagcgauccucccaccucagccuccacagcagcuggaacuccagguguga

SEQ ID NO: 407946 - RNA, 64 nt, Human
gacuccucggaggagaagucagcauuuuugaagcccuccacaccguuccggaagagcuggcaaa

SEQ ID NO: 407947 - RNA, 64 nt, Human
gcagcugaccccaggggcucgccgcugccccuccccuccacaccaaggccugagacagcaggag

SEQ ID NO: 407948 - RNA, 64 nt, Human
gcacucauggcucucugggucuaaugaauaaaguccuccacagccuagaucuugggugaugugu

SEQ ID NO: 407949 - RNA, 64 nt, Human
ucuuccaccagccaccacccuccgacccccuagcccuccacaagaagcagcauugagagagcug

SEQ ID NO: 407950 - RNA, 64 nt, Human
uucuuugcuugugauaucuauacuuacuuauuuuccuccacagaguuagcacuccuagucagau

SEQ ID NO: 407951 - RNA, 64 nt, Human
ucucugagguccugugcccucguccagcugcugcccuccacagcgguucuucacaggaucccag

SEQ ID NO: 407952 - RNA, 64 nt, Human
gguacgucccacccuguccccagauccccuauucccuccacaauaacagaaacacucccaggga

SEQ ID NO: 407953 - RNA, 64 nt, Human
ccaguucuccgagggcugagccccgcccagcuccccuccacaauaaacgcuguuucuccuugag

SEQ ID NO: 407954 - RNA, 64 nt, Human
caggaugguaccagcucccgccccucgccccccaccuccacaggugccuuaaagggcccucguc

SEQ ID NO: 407955 - RNA, 64 nt, Human
cuccccuugucugcacuguucaaaccucugccgcccuccacaccucuaaacaucuccccucuca

SEQ ID NO: 407956 - RNA, 64 nt, Human
ugcuaccgccagagagguggacccacuccggauuccuccacaccacccacacaccagucggcag

SEQ ID NO: 407957 - RNA, 64 nt, Human
agauggggcggggccucccccugagagagcucacccuccacagugacccuuuuccuuccugccu

SEQ ID NO: 407958 - RNA, 64 nt, Human
uucccuacggccuccucgcccugcacauuccccaccuccacauuccccuccuccaagaucucag

SEQ ID NO: 407959 - RNA, 64 nt, Human
uucccaugcccaggcuccaugugucauguggaaaccuccacaggucugcuagugaagaaugcau

SEQ ID NO: 407960 - RNA, 64 nt, Human
ccccucaaacccauucccucuccaggagaccuacccuccacaggcacagguccccagaugagaa

SEQ ID NO: 407961 - RNA, 64 nt, Human
ugcucacgacucuuccugcaaagggaacugaagaccuccacauuaaguggcuuuuuaacaugaa

SEQ ID NO: 407962 - RNA, 64 nt, Human
ccaccaccaaguucaccagguucaccagacacggccuccacaauagccacacccacaccugagc

SEQ ID NO: 407963 - RNA, 64 nt, Human
cagggagacccggagcacagccuccugcagguguccuccacaggcagggcccuggagagacgcu

SEQ ID NO: 407964 - RNA, 64 nt, Human
aaggagacugaggcuuagagagaggaggcagcccccuccacaccaguggccucgugguuauuag

SEQ ID NO: 407965 - RNA, 64 nt, Human
gagcuggguggggacagugauaggcccaagguccccuccacaucccagcagcccaagcuuaaua

SEQ ID NO: 407966 - RNA, 64 nt, Human
ggguauucuuuaaaguucuggucaauguauaucaccuccacagagcugcuuacccugcacuggg

SEQ ID NO: 407967 - RNA, 64 nt, Human
ucaucugagccgcgcggggaccggccaccuggagccuccacaccuaagcugcgccuccugucau

SEQ ID NO: 407968 - RNA, 64 nt, Human
aauuguuagugaccccucuuucucuugcaagcccccuccacacuggguuggaugauaccuuaau

SEQ ID NO: 407969 - RNA, 64 nt, Human
aggccacccugcccaggacccaggcccgccucccccuccacacucaggauguccugcuccaucu

SEQ ID NO: 407970 - RNA, 64 nt, Human
acgucuguaaaaccccuuccuggacagcguaaggccuccacaucuaaguuccugucauuaaaau

SEQ ID NO: 407971 - RNA, 64 nt, Human
ggcccccgcagccuagaccucccaggccugugacccuccacaccagcccucagaacccuccugg

SEQ ID NO: 407972 - RNA, 64 nt, Human
ccuuugucgcucucauggcugucagauccuggucccuccacacugggugcuggggagggaggac

SEQ ID NO: 407973 - RNA, 64 nt, Human
cagaauauauucacuuucauuuuugacaggauucccuccacaacucaguuucauauauuauucc

SEQ ID NO: 407974 - RNA, 64 nt, Human
ugguguggacccaucggcgggagagagugccacgccuccacagcuugccccaagcgcucugccu

SEQ ID NO: 407975 - RNA, 64 nt, Human
gccuauaaacaguggugucucaaagcaaaggaaaccuccacaagugcugcaacagugcauuagu

SEQ ID NO: 407976 - RNA, 64 nt, Human
uuucacuuacuuacuuccccagaccccgggcucgccuccacaaaggagaaaagacugcccuggc

SEQ ID NO: 407977 - RNA, 64 nt, Human
cuccucugagucuuagcaauggacaauuccaauaccuccacacaggacacuagaguaagaaacc

SEQ ID NO: 407978 - RNA, 64 nt, Human
uugucucauggaaagacucaacuugcaacugugcccuccacacuauccuuacuucugucuccac

SEQ ID NO: 407979 - RNA, 64 nt, Human
caggauucaccuuccuagugguguuuagaaaaugccuccacagcccccuuccaccaugggcaug

SEQ ID NO: 407980 - RNA, 64 nt, Human
ggccgggguugcuggguggccccuuccccaugggccuccacaagcacucaggccacuggcacgu

SEQ ID NO: 407981 - RNA, 64 nt, Human
ggaaaggaaggaaaucuuuguacugucuuggaagccuccacauccggcuauggcccugcaagcu

SEQ ID NO: 407982 - RNA, 64 nt, Human
ugaccucccaaagugccgggauuacaggcaugagccuccacaccuggcccaugcuggguuuuug

SEQ ID NO: 407983 - RNA, 64 nt, Human
cgacugagucuccagggaauucccagugaccuccccuccacaccugcugugauccugccaacau

SEQ ID NO: 407984 - RNA, 64 nt, Human
ggcccagcuggggaaaugggagaguuccugucccccuccacauaucccuacaugaaauauggga

SEQ ID NO: 407985 - RNA, 64 nt, Human
cagaggccaaggaugaggccugacucggcuccucccuccacaucagccagggcaucagaaguug

SEQ ID NO: 407986 - RNA, 64 nt, Human
acuguucaguucccacucuaauacucacacagcuccuccacaggagacuucuggagcaagcagg

SEQ ID NO: 407987 - RNA, 64 nt, Human
ggccuccacgccagcgccgggaaggcugcuggggccuccacaccugccucaucacggcggcgag

SEQ ID NO: 407988 - RNA, 64 nt, Human
gccucugacagacaccagaccagguccagggccuccuccacagccucagcuggggcucucagca

SEQ ID NO: 407989 - RNA, 64 nt, Human
ccaccugcuugugaggccgccacuuggcaugaagccuccacagcuccccgccugcaggggcaaa

SEQ ID NO: 407990 - RNA, 64 nt, Human
cagccauggaaggagcuggcccucacaccauccaccuccacacugccuccuggccagcugccca

SEQ ID NO: 407991 - RNA, 64 nt, Human
uaaaaauguuuuauauauuacucuaaccuguuguccuccacauucuauuguccuaauuguacug

SEQ ID NO: 407992 - RNA, 64 nt, Human
aagggaaggaagccagccuuucagcaccccuuacccuccacaguucugugauuucuguccuugc

SEQ ID NO: 407993 - RNA, 64 nt, Human
uuguuaggauguccugugcugcuugugaugagagccuccacacuguacuguucaagucaauguu

SEQ ID NO: 407994 - RNA, 64 nt, Human
gggaccgauaucacuguugauagugcagagaaacccuccacauuuuucagugcauaauugaguu

SEQ ID NO: 407995 - RNA, 64 nt, Human
gaucgaguguauugauuuuaguauugcuucguguccuccacacaggaggaggauguauucagcc

SEQ ID NO: 407996 - RNA, 57 nt, Human
cgggcaaggaggugugcuaaaggcugcccuccacacccgcgccccgcgcgcgccccg

SEQ ID NO: 407997 - RNA, 64 nt, Human
cauuaguauaaaugguaauaaguuguucccuaacccuccacauacauuugccuaucacacguaa

SEQ ID NO: 407998 - RNA, 64 nt, Human
gaagaauuacucccaagaguaacucucauuaucuccuccacagaaaacacacagcuuccacaac

SEQ ID NO: 407999 - RNA, 64 nt, Human
caccccucuucccccuuccccugcgcccucccucccuccacaccuccacccguccugggguggu

SEQ ID NO: 408000 - RNA, 64 nt, Human
caggcuuccuauggauguuggaguaccuguuuuuccuccacacauagcccuuuucauggauaga

SEQ ID NO: 408001 - RNA, 64 nt, Human
cauccacuuaccuggagcugcucuccuguauuauccuccacaauaaaauucuccagaaaauaag

SEQ ID NO: 408002 - RNA, 64 nt, Human
agggacaaaaucaaacccuucuccccuuuuagcuccuccacacugucucccuccucaacacaca

SEQ ID NO: 408003 - RNA, 62 nt, Human
agcucaagaaggugaucuaagggccgcggccuccuccacacacacacacacaccaggggaac

SEQ ID NO: 408004 - RNA, 63 nt, Human
gaccguucgcauggcagccaucaaagaguccuggacgcacaauauccagcgagagaaagaguu

SEQ ID NO: 408005 - RNA, 63 nt, Human
uggaacugccaguguagagggaauucuaagcuggacgcacagaacagucucuccgugggagga

SEQ ID NO: 408006 - RNA, 63 nt, Human
uuuuagaaaacagaaaucugcaucucagccugagacgcacagagaggucucuuccugacccag

SEQ ID NO: 408007 - RNA, 63 nt, Human
cuuacuuucauuuuuugauuacaaauuucucuugacgcacacaauuaugucugcuaauccucu

SEQ ID NO: 408008 - RNA, 63 nt, Human
agggaugcugggcugggcccucuuucccugcgagacgcacacagcugagcacuuagcaggcac

SEQ ID NO: 408009 - RNA, 63 nt, Human
agccuuucugccgcccaggcccacaggucucgagacgcacaugcacgccugggcguggcagcc

SEQ ID NO: 408010 - RNA, 63 nt, Human
aggccggggcacaauuugcacuccccucagcuagacgcacagacucagcaauaaaccuuugca

SEQ ID NO: 408011 - RNA, 63 nt, Human
cugagcccacaagggcagagcagcauucugagagacgcacaggagaccaagccagaccaauaa

SEQ ID NO: 408012 - RNA, 63 nt, Human
uggacacacacacacacacggauaugcugucuggacgcacacacgugcagauaugguauccgg

SEQ ID NO: 408013 - RNA, 63 nt, Human
agcugggcagcgucugcucugguaggacugucagacgcacacgcgcacgcaccuagacacacc

SEQ ID NO: 408014 - RNA, 63 nt, Human
uuccaaaguccuguacaguuguucucugcaauugacgcacaucugcccuaagcgaaaucuguc

SEQ ID NO: 408015 - RNA, 63 nt, Human
aacacaagcacaacuaaguauguauauacacaugacgcacacgaugccagggccuagaccucc

SEQ ID NO: 408016 - RNA, 63 nt, Human
uucauaauaaucuucaaguucaggagccgcagagacgcacaacuuuacacuuaucauuucuaa

SEQ ID NO: 408017 - RNA, 63 nt, Human
auuuuauaguuuuauuuuaaugaaacccugauugacgcacagcaguggggagaacagcgucuu

SEQ ID NO: 408018 - RNA, 63 nt, Human
gccucuguucaguucauucccagaaguccacaggacgcacagcccaggccacagccagggcuc

SEQ ID NO: 408019 - RNA, 63 nt, Human
uagaggaguagaagcugguguuaaaguucccacgacgcacauggcuuugccagaaacucuguu

SEQ ID NO: 408020 - RNA, 63 nt, Human
cugugaaagucagaaucgccucagcauuuccaugacgcacauuaugcaaaucucuuuagcacu

SEQ ID NO: 408021 - RNA, 63 nt, Human
ccccagcuuugcugccugagaggaaccagagcagacgcacaggccggaaaaggcgcaucuaac

SEQ ID NO: 408022 - RNA, 63 nt, Human
agcccggcgggggcacgcgccacguggccgggagacgcacagggcgccagcgucgccgcgagg

SEQ ID NO: 408023 - RNA, 50 nt, Human
ggcaucagaaagcacugugagacgcacagacggcgucuucugccaccaag

SEQ ID NO: 408024 - RNA, 63 nt, Human
uccacguguaucucugcugugacacacugagcugacgcacauuuccagugcagcugcagaaga

SEQ ID NO: 408025 - RNA, 63 nt, Human
gguagaagacuucucauuggggagcaacuuuuugacgcacaacuuuuggugcguuuuucuagu

SEQ ID NO: 408026 - RNA, 63 nt, Human
ggcccaggagcagaugggaggaccccgaggccagacgcacacuguccgagcccucugcucagc

SEQ ID NO: 408027 - RNA, 63 nt, Human
aauccuccccugccccgcgggucucuggauugggacgcacagugcaguugaggucugcgucgg

SEQ ID NO: 408028 - RNA, 63 nt, Human
agcguccggucuugcccacagggccugugcugcgacgcacauacauacguguugugucuguca

SEQ ID NO: 408029 - RNA, 63 nt, Human
gaaucaccacauaguaugucccuuuaaagcauugacgcacagacaaauguuuaaagcacagua

SEQ ID NO: 408030 - RNA, 63 nt, Human
gugaaccguagcagcgccuccggccccuccugugacgcacagcacuccuguaacugucucaga

SEQ ID NO: 408031 - RNA, 63 nt, Human
caguggcugcagguagcuggacuuccugccugugacgcacagagagcagcggacuccggagcg

SEQ ID NO: 408032 - RNA, 63 nt, Human
ccccauccaguguccucugcagcagggccaggggacgcacaccugccugacucuuuccucaca

SEQ ID NO: 408033 - RNA, 63 nt, Human
cccuucucugucccauugcuuucuccuuuccccgacgcacagaauaaacaugaagcucagcag

SEQ ID NO: 408034 - RNA, 63 nt, Human
uugagugaagcucuuggggccagcgugcguccugacgcacaggagagagcugaaggugggugg

SEQ ID NO: 408035 - RNA, 63 nt, Human
gcccugucuaggucaguacccaccugagcuuuggacgcacacagcuuuuaguacccaccugag

SEQ ID NO: 408036 - RNA, 63 nt, Human
cccccuuuuuuuuuugagacggagucucgcucugacgcacaggcuggagugcaguggcuccga

SEQ ID NO: 408037 - RNA, 63 nt, Human
cuccugggcaggguucugggacccucugugggugacgcacacccugggauggggcuaguagag

SEQ ID NO: 408038 - RNA, 63 nt, Human
acucccagcccggccaaaaagacaaaacacauagacgcacacacucaggaggaaaagaaaaaa

SEQ ID NO: 408039 - RNA, 63 nt, Human
acguagucugaaacagaccugaacagacagacagacgcacacacacaacagaugcgcagcaac

SEQ ID NO: 408040 - RNA, 63 nt, Human
uccagauuccggcuucuacaugggacagacggggacgcacaggccaccuuccuucuggcaggg

SEQ ID NO: 408041 - RNA, 63 nt, Human
uggaggggacaagguugacugcuuaggaggcgcgacgcacagggcugccaggccuggccccuc

SEQ ID NO: 408042 - RNA, 63 nt, Human
ugcacaguguggcugcuuuuccauaauuuuugggacgcacaaaugucugcaugauuuugagaa

SEQ ID NO: 408043 - RNA, 63 nt, Human
aaccauuuccuugauuguguaaggaacuugcuggacgcacauuagagaauaaagcuccuguuu

SEQ ID NO: 408044 - RNA, 63 nt, Human
agaaaacaauuuuuuaaaaauucucauuacauagacgcacaagaauaugucacauaaagaaaa

SEQ ID NO: 408045 - RNA, 63 nt, Human
cgggcugcucucuucccugagcccggaaccggcgacgcacaugugucuuuuguugguguguuu

SEQ ID NO: 408046 - RNA, 63 nt, Human
aacaaaacccagaaagugcggcaggaccagccugacgcacacgcuccuguugucauggcagac

SEQ ID NO: 408047 - RNA, 63 nt, Human
gagccccaaagaucccacgggagaggggagagggacgcacagcacugccugccaagcgagaau

SEQ ID NO: 408048 - RNA, 63 nt, Human
aaugcuuuuuaaagcacaugucucauuuuaaaugacgcacaaacugaagauguuaauaaaauu

SEQ ID NO: 408049 - RNA, 64 nt, Human
ccuaaacuaaagcuuaaaaguuuaguaaaaaucgucugggcacaguggcucacgccuguaaucc

SEQ ID NO: 408050 - RNA, 64 nt, Human
gggcaacggaagucuuuuagugauggcuaaugggucugggcagcaucccuucaugaauuuuuuu

SEQ ID NO: 408051 - RNA, 52 nt, Human
gcaaauccaucaaaaguuaacuucugggcagaugaaaagcuaccaucacuuc

SEQ ID NO: 408052 - RNA, 51 nt, Human
guaguuguggaggauugugagucugggcaguaaauccacagccaacaaaca

SEQ ID NO: 408053 - RNA, 51 nt, Human
aggagaaugggaagcugugacucugggcauuaucgacacguucacccaucu

SEQ ID NO: 408054 - RNA, 64 nt, Human
cagccacaggcugggguugggguguguggacaucucugggcagcucuugaguccaccuugugcc

SEQ ID NO: 408055 - RNA, 64 nt, Human
cccgcccccucugacuaggcacccaaagugagcaucugggcauugggcauucaugcuuaucuuc

SEQ ID NO: 408056 - RNA, 64 nt, Human
gcugagcacccccaggccuuccacuccucuacccucugggcaccagaaggcuccuggaccauga

SEQ ID NO: 408057 - RNA, 64 nt, Human
ggucagucucaacaggagccagucuucuggagccucugggcagaacccuccaucagaguggaaa

SEQ ID NO: 408058 - RNA, 64 nt, Human
cagccaacggccuggaaucgcaaagagacaccacucugggcagagcagagcaggguauggggug

SEQ ID NO: 408059 - RNA, 64 nt, Human
uagagcucucacucacugauaaugcuuauuaccuucugggcauuuauuccaaagugggaucaac

SEQ ID NO: 408060 - RNA, 64 nt, Human
cagcuugcugaggggcagggagagcgccucuuccucugggcagcgcuaucuagauagguaagug

SEQ ID NO: 408061 - RNA, 64 nt, Human
auugcauuccgcuguagugaaaggacgagccauuucugggcacguggcagcagucgcugaucuc

SEQ ID NO: 408062 - RNA, 64 nt, Human
aauguguggacuuaauucaccccagucuucaucaucugggcaucagaauauuuccuuaugguuu

SEQ ID NO: 408063 - RNA, 64 nt, Human
uucuaagucuucuaugcauuguccaccaagaagaucugggcagcuucuguuccugcacaacagu

SEQ ID NO: 408064 - RNA, 64 nt, Human
uauucuuugaaauauaauuuugguaauuuugauuucugggcacuuuuuaacauugcugauguag

SEQ ID NO: 408065 - RNA, 64 nt, Human
agaaauuaaagaagaaaaccagcaaacuaaaacuucugggcagcaaaaauauauaaaugcuuca

SEQ ID NO: 408066 - RNA, 64 nt, Human
agugagggcacaugaaacucacuucaggaugaaaucugggcagagacuuauuaauuaauuuugc

SEQ ID NO: 408067 - RNA, 64 nt, Human
caguccaggguugaaauuaucacagaauaaggauucugggcaagguuacugcauuccggaucuc

SEQ ID NO: 408068 - RNA, 64 nt, Human
uucccucucccaucuucucauauccuggcucuucucugggcaagaugagccaagcagaacauuc

SEQ ID NO: 408069 - RNA, 64 nt, Human
gcaguaagccgagaccaugcuuauugcccuccagucugggcaacaaaaaugaaacuccgucuca

SEQ ID NO: 408070 - RNA, 64 nt, Human
ccuaagcccuauaugccucacucauaaugaggcugucucugaaccccggagggcgggaccuaca

SEQ ID NO: 408071 - RNA, 64 nt, Human
caaucugcaaagugugaagggauuagaugggauggucucugaggcucuuuguggcaucagccuu

SEQ ID NO: 408072 - RNA, 64 nt, Human
uccagauacagagaugacuaaggucauugauagcgucucugaacaaucagacggaucaccuuau

SEQ ID NO: 408073 - RNA, 64 nt, Human
gcgggcgcugagcgcguugggcagacugguugccucugggcaucgcaaacugcccccgggcgca

SEQ ID NO: 408074 - RNA, 64 nt, Human
aaagcacauccaggagccccaguugucacugcagucugggcaaccccagcaaugaaaaggggug

SEQ ID NO: 408075 - RNA, 64 nt, Human
uuuagggcagccccaagggccagccagccuguacucugggcaagagcccaaaauggcuaggaau

SEQ ID NO: 408076 - RNA, 64 nt, Human
agcugguccugggacaugcagccaggacugugagucugggcagguccaaggccugcaccuucaa

SEQ ID NO: 408077 - RNA, 64 nt, Human
gacacagaaauccugauuagugauaggccugucuucugggcaauauuucuaaaauauuugagug

SEQ ID NO: 408078 - RNA, 64 nt, Human
ccauuugccccaguguggucaagcagccaugcuuucugggcauuuucguccucccauaauuuca

SEQ ID NO: 408079 - RNA, 64 nt, Human
guggacuugagcguccaaaaacccugagugugauucugggcagccggccuggcuugaaguccgc

SEQ ID NO: 408080 - RNA, 64 nt, Human
uucuccgaggcaugugucucccugcucacccucgucugggcaccucagcaucuguggacuugag

SEQ ID NO: 408081 - RNA, 64 nt, Human
cccgggcuucccgugcgccucugccgcaggugcuucugggcacccauccucugcguuucauuug

SEQ ID NO: 408082 - RNA, 64 nt, Human
ccagggugucaacugcugcucucaacuccccaccucugggcacugaggaguauuuccccucauu

SEQ ID NO: 408083 - RNA, 64 nt, Human
cugcugugugacucugggcaagucacucucccucucugggcaugucugcuacaaauggacaaga

SEQ ID NO: 408084 - RNA, 64 nt, Human
guccugguuuccaauuuggguucugcugugugacucugggcaagucacucucccucucugggca

SEQ ID NO: 408085 - RNA, 64 nt, Human
acugagcugggggaagaagggauaucuacuguggucugggcaccaccucugugggcacuggugg

SEQ ID NO: 408086 - RNA, 64 nt, Human
ggggcucucccuaggggcauagcuggugaggaggucugggcaccuccuccauggcucucagggg

SEQ ID NO: 408087 - RNA, 64 nt, Human
caguucaggagggagggguauguuugucucccagucugggcaaaggagugcuaugcggaauucu

SEQ ID NO: 408088 - RNA, 64 nt, Human
uguaguaagcuacgaucaugccacugcacuccacucugggcaacagaaugagauccugucucuu

SEQ ID NO: 408089 - RNA, 54 nt, Human
cagaguugccgcaagucugaauggcgccaucaaacuuaugggcagggauaacag

SEQ ID NO: 408090 - RNA, 64 nt, Human
ucaggguugacaucuuauuugaacaagggucccccgccaucaugcagccuccaaggugccaaga

SEQ ID NO: 408091 - RNA, 64 nt, Human
cacaguaaaacaaggaaaguucuacccuaagagccgccaucacuucaggccgcugguuugucag

SEQ ID NO: 408092 - RNA, 64 nt, Human
gcuguguccccaggucuuguguggguggcacagaucugggcaguuagauagugcucugugccua

SEQ ID NO: 408093 - RNA, 64 nt, Human
ugaugcauuacauuuaagaauucucuuuaauacaucugggcaauaaauauugaaagguauucca

SEQ ID NO: 408094 - RNA, 64 nt, Human
uucacaccgcucguuccugcagccagaaaggaacucugggcagcuggaggcgcaggagccugug

SEQ ID NO: 408095 - RNA, 64 nt, Human
guauuaauguguuaagugcaggagacauugguauucugggcaccuuccuaauaugcuuuacaau

SEQ ID NO: 408096 - RNA, 64 nt, Human
guaguaccccaagaagaaaauguuacuucucucaucugggcaaaacccacagaagacuucccag

SEQ ID NO: 408097 - RNA, 64 nt, Human
ggcggauugccugagcucaggaguucaagaucagucugggcaacacgaugaaacuccgucucua

SEQ ID NO: 408098 - RNA, 64 nt, Human
cuugcauccugacuggauguucucagccccuuguucugggcaagaacccagagcuccccagugu

SEQ ID NO: 408099 - RNA, 64 nt, Human
gcugacaaccuuugaggcugggaggagagcagccucugggcaucguucccagugucccucacac

SEQ ID NO: 408100 - RNA, 64 nt, Human
ccuguggugacaggcccaguggaacagucacccuucugggcaagggggaacaaaucacaccucu

SEQ ID NO: 408101 - RNA, 64 nt, Human
agucucccauucucauauguagcccucaugauaaucugggcaucucgugccagggcaggcuacc

SEQ ID NO: 408102 - RNA, 64 nt, Human
cucucuggguauagacaggggugggaaggguccaucugggcaaggggaauggggccauguuguu

SEQ ID NO: 408103 - RNA, 64 nt, Human
caggaugccuucgggggacagauucugcccagucucugggcauccauaauugcugcuaaccuag

SEQ ID NO: 408104 - RNA, 64 nt, Human
ggcaggaaauaaccucacuaucccggcugcccuuucugggcaccggggccucggacuuagcugg

SEQ ID NO: 408105 - RNA, 64 nt, Human
auucauucaguauuuauugagcaucuaguauaagucugggcacuggaugcaugaauuccacucc

SEQ ID NO: 408106 - RNA, 64 nt, Human
ugauugcauccuguuuuccuaauucccagacuguucugggcacggaagggacccuggaugugga

SEQ ID NO: 408107 - RNA, 64 nt, Human
cagaaagaaagaaaaacuaugguguaauuuaaacucugggcagccucugaaugaaaugcuacuu

SEQ ID NO: 408108 - RNA, 64 nt, Human
caauauggauucagugagccugcuuucgccugcugucucugauggcucuggcaaggacuccagg

SEQ ID NO: 408109 - RNA, 64 nt, Human
guuucccagucuucagcagagaaguuuucuggaggucucugaacccagggaagacaagaaggaa

SEQ ID NO: 408110 - RNA, 64 nt, Human
uacuucuugauaccugggauacugugcccagagccucgaggagguaaugaauuaaagaagagaa

SEQ ID NO: 408111 - RNA, 64 nt, Human
uucaauuguuaugaauaagaaaggcaaacauaggucugggcauuaaauuauacaaacugaaaau

SEQ ID NO: 408112 - RNA, 64 nt, Human
ucugcugccgguccccucaccugcacuugaggggucugggcagucccuccucuccccagugucc

SEQ ID NO: 408113 - RNA, 64 nt, Human
caccugcccuuugggcaagguugggacaaagccaucugggcagucaggggcaaggacuguugga

SEQ ID NO: 408114 - RNA, 64 nt, Human
uaaacaucugauucuggaaugcagaaggagggggucugggcaucuguggauuuuuggcuacuag

SEQ ID NO: 408115 - RNA, 64 nt, Human
acuggcagcgaggcucgugugucccccaggcagaucugggcacuuucccaacccagguuuaugc

SEQ ID NO: 408116 - RNA, 64 nt, Human
acaguucugcucagcaaaauuguugaguaccuguucugggcaggucccacgcuauaugcacaaa

SEQ ID NO: 408117 - RNA, 64 nt, Human
uuuuuuuucuugguaaagccaugcaccacagacuucugggcagagcugagagacaaugguccug

SEQ ID NO: 408118 - RNA, 64 nt, Human
ccacuggcccagcaagcagaggcgggcaggaggaucugggcauccugagccccuucccugaggc

SEQ ID NO: 408119 - RNA, 64 nt, Human
gcauuugccauuccuggaaucaaggaauccugagucugggcaaugaaaccaaagccaggaguug

SEQ ID NO: 408120 - RNA, 64 nt, Human
caucccacuuccaccagcaccauagaagaauaauucugggcagaagucuguuuuuuuucauuuu

SEQ ID NO: 408121 - RNA, 64 nt, Human
cuggacacacacauacaccaaagauguauuuggaucugggcacccccucccaggaucccuguac

SEQ ID NO: 408122 - RNA, 64 nt, Human
agcagauugcuugaacccaggaauucaaguccaaucugggcaacauggggaaaccccagcucua

SEQ ID NO: 408123 - RNA, 64 nt, Human
gucgcuaagguccugcccacugaggggacagccuucugggcagggaccucggggggcuucaagg

SEQ ID NO: 408124 - RNA, 64 nt, Human
aggccaccuuuugcuccacggaggugggagaaaaucugggcacauggggcccccugggcagugc

SEQ ID NO: 408125 - RNA, 64 nt, Human
ucuucucuggaaaccuaauccuccuuucauuuccucugggcaggacucucuggccuucuguggc

SEQ ID NO: 408126 - RNA, 64 nt, Human
aguuuguuaaccugacaucucugccagucuaguuucugggcagguuuccugugucaguauuccc

SEQ ID NO: 408127 - RNA, 64 nt, Human
aaaggaauggauuucuuccaugauaacuacgugucucgaggaugaucugcucagagcucuucca

SEQ ID NO: 408128 - RNA, 64 nt, Human
caggacugaggauccucuccuccagaaaagcccccucgaggaaauaaauuagugcgguucucuu

SEQ ID NO: 408129 - RNA, 64 nt, Human
ccaggacccaugagggggcugagagguuucuacacucgaggagcagggguccagagaggcaggc

SEQ ID NO: 408130 - RNA, 64 nt, Human
ugacugcaguggugucugguauccauguuuuauuucugggcacaagcuaguuuuuauguugaua

SEQ ID NO: 408131 - RNA, 64 nt, Human
uugggcagcugugccugugcgagaggugcuguggucugggcagccccuggaaaagcaccuuugc

SEQ ID NO: 408132 - RNA, 64 nt, Human
aaagcauuaacuaaaaaaguuuauuuuccuuuugucugggcaguagugaaaauaacuacucaca

SEQ ID NO: 408133 - RNA, 64 nt, Human
cugugugaaccgcuggcugcuguugugccucaucucugggcacauugccugcuuccccccagcg

SEQ ID NO: 408134 - RNA, 64 nt, Human
gaaaggccagcccaguccauggccuucuugggccucugggcacagagccaauguucgucauugc

SEQ ID NO: 408135 - RNA, 64 nt, Human
ggcagagacugaaaauugcagacagaggggcacgucugggcagaaaaccuguuuuguuuggcuc

SEQ ID NO: 408136 - RNA, 64 nt, Human
cuguaaaguuccccuggccuaaaugauuacuugcucugggcaaguggauauuuauuaggcuauu

SEQ ID NO: 408137 - RNA, 64 nt, Human
uaaauccagcagaccccuuuccugucuuacuagaucugggcagcauuugacauggcugaucacc

SEQ ID NO: 408138 - RNA, 64 nt, Human
ucugugaagcuuaagagcagauggugacaaguucucugggcagguggccauggggaggggccau

SEQ ID NO: 408139 - RNA, 64 nt, Human
aagcacuuucgauguugggcgcuggcguuuguguucugggcaccaccgugacccugcccagaug

SEQ ID NO: 408140 - RNA, 64 nt, Human
uuccuccaagcugcugccuccccugcagccagggucugggcagggugcagccgguccucggggc

SEQ ID NO: 408141 - RNA, 64 nt, Human
cuccccagaugaaguagguguauuccccuggcagucugggcaacggagaccaagaaacauuuuu

SEQ ID NO: 408142 - RNA, 64 nt, Human
ggacuggaggaacacagagaaauccuaaaagagaucugggcauuaagucaguggcuuugcauag

SEQ ID NO: 408143 - RNA, 64 nt, Human
aagaaacaaugcuucaaauguuaagaaauaacagucugggcaaagaacgcauauucuauaggaa

SEQ ID NO: 408144 - RNA, 64 nt, Human
accggggcaggcaugcacccggugccagccccgcucugggcaccaccugccuuccagccccucc

SEQ ID NO: 408145 - RNA, 64 nt, Human
ugcaugcacacacgagcauacuuguaccuuugucucugggcaaacaggugggacuguuagugac

SEQ ID NO: 408146 - RNA, 64 nt, Human
acggugaugaaacugagguucaguacucucgggacucgaggaaauuauuccugagacauggagu

SEQ ID NO: 408147 - RNA, 64 nt, Human
ccucuucccacaccugucagcuucggaagcaucucucgaggacucuggucccaggaugucuccc

SEQ ID NO: 408148 - RNA, 64 nt, Human
cuuuguaaaaugaggguggaggugggaauaggaucucgaggagacuauuggcauaugauuccaa

SEQ ID NO: 408149 - RNA, 64 nt, Human
agaaaccuugucucuacuaaaaacacaaaaauuaucugggcaugguggggcaugccuguagucc

SEQ ID NO: 408150 - RNA, 64 nt, Human
aagguuaaauuacaaauucauucccagccuaggcucugggcacauuuccuguucuugaauucug

SEQ ID NO: 408151 - RNA, 64 nt, Human
cacucauccuuugguuucuuuuuaaucaccugugucugggcacagacaaucacaauaaaugcag

SEQ ID NO: 408152 - RNA, 64 nt, Human
ucgaaguagaucaaaguccagaucuaguuccaagucugggcaccgaaagagagcaucaaaauca

SEQ ID NO: 408153 - RNA, 64 nt, Human
gucugagaugcugguaauggccaugguacccccuucugggcaucuguucugguuuuuaaccauu

SEQ ID NO: 408154 - RNA, 64 nt, Human
uguaucccagaacugcucuagugcccggguguggucugggcaucccuccagugugaccaagagc

SEQ ID NO: 408155 - RNA, 64 nt, Human
agggacguugccugagcccaaauguguaguguggucugggcaggcagaccuuuagguuuugcug

SEQ ID NO: 408156 - RNA, 64 nt, Human
ggagaaacuuucuauauauccuucuaaauauuuuucugggcaugcuuauguauguacaucaguu

SEQ ID NO: 408157 - RNA, 64 nt, Human
aaacuucacccccaggacccaggaucuucuccuuucugggcaucccuuugugggugggcagagc

SEQ ID NO: 408158 - RNA, 64 nt, Human
uuacaguaucuccugacgggaccugccacucgcaucugggcaauguugacauuugagguggcag

SEQ ID NO: 408159 - RNA, 64 nt, Human
uaguaaguguaagccauguaaaaaguaaauaaugucugggcacaguggcucacgccuguaaucc

SEQ ID NO: 408160 - RNA, 64 nt, Human
cagcacagcucaucaguccccaaagcccccuggcucugggcauuugacagacuagcucauacag

SEQ ID NO: 408161 - RNA, 64 nt, Human
cugaucccccaucagagcuaucugagccugccugucugggcaccugcugcaaccaugcagcuac

SEQ ID NO: 408162 - RNA, 64 nt, Human
cuggguuggggggccuuccuggagugucagggucucugggcaacguccauucagggugcggcau

SEQ ID NO: 408163 - RNA, 64 nt, Human
caccucuuccuugcaagugagcaacuucaggcucucugggcagaggcuggcccacuguaguuug

SEQ ID NO: 408164 - RNA, 64 nt, Human
aaauugaugcuccccuacugacuagcugugccacucugggcaaaugcucuuccuugagccuguu

SEQ ID NO: 408165 - RNA, 64 nt, Human
augcuuaguauaaaugugucacuucuaaaguuuugucucugacuuuuagaaauaaauuucagaa

SEQ ID NO: 408166 - RNA, 64 nt, Human
acuuuggucuggccaggaggcuggagaaugcggggucucugaagguccucuuuggcaccccaga

SEQ ID NO: 408167 - RNA, 64 nt, Human
cuuccuccagaaagaggagcgugucucugaacugcgccaucaacuccagucucggcagcagcuc

SEQ ID NO: 408168 - RNA, 64 nt, Human
caggcuaugacuaagaauuuagguggaauugaugucugggcaauuaaaauaaauggcauaagag

SEQ ID NO: 408169 - RNA, 64 nt, Human
gcgaaccaugccccagacuauuaucucagggcuuucugggcacugcacuucagcguggcccacc

SEQ ID NO: 408170 - RNA, 64 nt, Human
guaaagagaaacauaaaucuagccuacgugcacaucugggcacaguaccuuuccuugaacuuau

SEQ ID NO: 408171 - RNA, 64 nt, Human
acaucugggcauacagugucuggacgcugccacaucugggcauacagugucuggacacugccac

SEQ ID NO: 408172 - RNA, 64 nt, Human
agggcagccacacagcuggacggaugcugccacaucugggcauacagugucuggacgcugccac

SEQ ID NO: 408173 - RNA, 64 nt, Human
uguauuuauggagugccugcuguggacccugucuucugggcacaguggacucagcagugaccac

SEQ ID NO: 408174 - RNA, 64 nt, Human
gcagaccaacauauagaguguuuaaaauagcauuucugggcaaauucaaacucuugugguucua

SEQ ID NO: 408175 - RNA, 64 nt, Human
auuuuagagagaaaguaaccaaaccaaauauuuaucugggcaaagucauaaauucuccacuuga

SEQ ID NO: 408176 - RNA, 64 nt, Human
gugggguagggggaugugggaagcagcauuguccucugggcauguggcucagagguaucacagu

SEQ ID NO: 408177 - RNA, 64 nt, Human
guugguucguucuguacuguuacugggcccugagucugggcagcugucccuugcuugccugcag

SEQ ID NO: 408178 - RNA, 64 nt, Human
cccucugacuggacaucauugccauuaacuuucuucugggcaucacggcaaugucacgaugccc

SEQ ID NO: 408179 - RNA, 64 nt, Human
gccagugucugucaggaugguccccccgaggcgcucugggcaggcauccugguguccugagagg

SEQ ID NO: 408180 - RNA, 64 nt, Human
acaguuaucaagaaugggucaggagaccgcugcuucugggcauaaguccugcaaggaaagcaac

SEQ ID NO: 408181 - RNA, 64 nt, Human
accacaaaccacccuaaaaugacagccgcugaugucugggcaucagccuuuguacucuguuuuu

SEQ ID NO: 408182 - RNA, 64 nt, Human
ccauauccgucaggaagagccuuuccagaaugauucugggcauauacuaagaagagcagguaug

SEQ ID NO: 408183 - RNA, 64 nt, Human
auuuugaagaguuuuguguccguaguucuguaauucugggcagucaucauguugguuuuuuugg

SEQ ID NO: 408184 - RNA, 64 nt, Human
uuuuuuuuugucauuuucuuucaaaacuugaguggucucugagcuccugucauuaaaccuaucu

SEQ ID NO: 408185 - RNA, 64 nt, Human
aagaggggucaagaguuaaacuuagagacccuuugucucugagaagcauccuucuaagacauuc

SEQ ID NO: 408186 - RNA, 64 nt, Human
uaaggggagaguaacccugucuaaugaaaccugugucucugagaguagagucacuggaacacua

SEQ ID NO: 408187 - RNA, 64 nt, Human
ucuggagcauugggugaacacacaggcuggcugcucugggcagcgccuucacucugacccugga

SEQ ID NO: 408188 - RNA, 64 nt, Human
ggcaggggaauugcuugaguucagaaguuugagaucugggcaacauauugagacucugucucua

SEQ ID NO: 408189 - RNA, 64 nt, Human
agagcuuccuccuucuacaagcuaacucccugcaucugggcaucaggacugcuccauacauuug

SEQ ID NO: 408190 - RNA, 64 nt, Human
aauugagagugugugcaaagcuuauuuucuuuuaucugggcaaaaauuaaaacacauuccuugg

SEQ ID NO: 408191 - RNA, 64 nt, Human
aagagcauuauuccuggucaaagcuccuuaaaguucugggcagcuaaaagcaucccugugagca

SEQ ID NO: 408192 - RNA, 64 nt, Human
gagccucaaauauuagacaauugcagugcggcuuucugggcacaggugucacugcucugccacc

SEQ ID NO: 408193 - RNA, 64 nt, Human
cuguacuccucaagcacuggaacacgauccucuuucugggcauuccuaggggagaaaauaaaau

SEQ ID NO: 408194 - RNA, 64 nt, Human
uaugggcaugacugcacguucacucucagugggaucugggcaacauggaguucauuguccuguu

SEQ ID NO: 408195 - RNA, 64 nt, Human
aucccuuccaagguugguccaugccaacauaaccucugggcaucagacaucagcaggucugugu

SEQ ID NO: 408196 - RNA, 64 nt, Human
uguuguuuucuuuugaaacaauagauuauuaaaaucugggcauuuauaugcaauuuagagccau

SEQ ID NO: 408197 - RNA, 64 nt, Human
gcagauuucagaucauauuucacaauccuguggaucugggcaaaugaaaauguuucaggaaguu

SEQ ID NO: 408198 - RNA, 64 nt, Human
uaagcgguguugaacuuucugcuuguguauucucucugggcagagaugccacuugccuccccca

SEQ ID NO: 408199 - RNA, 64 nt, Human
aagucacaagcaaauaucuuaaagguaaaauccaucugggcacucauuuaaaguauaucuuaaa

SEQ ID NO: 408200 - RNA, 64 nt, Human
ucucggcggcagccucgggggcuccgacuccagcucugggcaagauccauaaacuuuuaaagaa

SEQ ID NO: 408201 - RNA, 64 nt, Human
gucccaccaacuaccagaccagaacacgagccccucugggcagcaggauuccuaagucaaagac

SEQ ID NO: 408202 - RNA, 64 nt, Human
ccugcacugcccuguccccggauccugccgaacaucugggcaucaggagcuggagccugugggc

SEQ ID NO: 408203 - RNA, 64 nt, Human
agacuuucuauggaacccagcaucauguggcucagucucugauugccaacucuuccucuuucuu

SEQ ID NO: 408204 - RNA, 64 nt, Human
aucuguaaacacucugaucuuccuauuccacugagucucugaagggaauagggcugguaguggg

SEQ ID NO: 408205 - RNA, 64 nt, Human
uucugaaguuaguuucuuaagugaguuuucaggugucucugaaaaauuuauaacaaucauguau

SEQ ID NO: 408206 - RNA, 64 nt, Human
auuuugucucuuguuaaaccagacccugggcuugucugggcagagacagaagcugauuuaacag

SEQ ID NO: 408207 - RNA, 64 nt, Human
ucuuagcucauaaaaauauaauaugacuugauaaagcaacuaaacucuuuccacaguguucaga

SEQ ID NO: 408208 - RNA, 64 nt, Human
cacuacccaacuuuaaaccauacuacaaggcuacagcaacuaaaacagcaugguacugguauaa

SEQ ID NO: 408209 - RNA, 64 nt, Human
cuuaaaaugauugaaaauaaugcuguucuuuaguagcaacuaaaaugugucuugcugucauuua

SEQ ID NO: 408210 - RNA, 64 nt, Human
uucuggcaagccugucuucagagaacccacuagaagcaacuaggaaaaucacuugccaaaaucc

SEQ ID NO: 408211 - RNA, 64 nt, Human
gcuuguuaguggguucagaaaucaguuucuggcuagcaacuagaaguuuuguauguuaacagua

SEQ ID NO: 408212 - RNA, 64 nt, Human
aagaggaccaaacaauucuuuauacaaauggaguagcaacuaguuuuguagcacuacauuuaau

SEQ ID NO: 408213 - RNA, 64 nt, Human
guccucugguaggaggcaaagguucuaucugcuuagcaacuaguuaauaagugguaucugacac

SEQ ID NO: 408214 - RNA, 64 nt, Human
agagucccccagcacacacuccccaacccccuccagcaacuacaugugacugauagcuuuuccc

SEQ ID NO: 408215 - RNA, 64 nt, Human
aauuuaguauuuguguaaaaccaccuuuugaagcagcaacuaucaagucugaaaagcaauugau

SEQ ID NO: 408216 - RNA, 64 nt, Human
ggcuguuccuggacacugugcuguccccguccugagcaacuaugcccccgccccaguagguuca

SEQ ID NO: 408217 - RNA, 64 nt, Human
cuaccuucgaggcaggagcccucucauggugaacagcaacuauuaugucaugguaugaacuaga

SEQ ID NO: 408218 - RNA, 64 nt, Human
cugcuuucuaagugggaagaggaagggagaggcaagcaacuagguacaaugucuaucaggaaag

SEQ ID NO: 408219 - RNA, 64 nt, Human
ucgagacacagaagugcaauaacugcccuaauuaagcaacuauuuguuaaaaagggccucuuuu

SEQ ID NO: 408220 - RNA, 64 nt, Human
agcaugagaaauaugauauuuggauagggauuucagcaacuaaacauucucuguucugagaucu

SEQ ID NO: 408221 - RNA, 64 nt, Human
uccaauggauuugccuucucaaaauguacaacuaagcaacuaaagaaaauuaaagugaaaguug

SEQ ID NO: 408222 - RNA, 64 nt, Human
ugcuucccuguauguggaagcagcaccucauucccgccaucagcuaccucucaucaccccaccu

SEQ ID NO: 408223 - RNA, 64 nt, Human
guuuaggcagcguguggugucugagaggccauagcgccaucaugggcugauuuuuauuaccagg

SEQ ID NO: 408224 - RNA, 64 nt, Human
gcuaguucuuuucagccuuguggagccugucagucgccaucauaccucgagugaggcccagcua

SEQ ID NO: 408225 - RNA, 64 nt, Human
acaauuucaguguuguguucagccaaggggacggucugggcaggcagcuuaagugugaguuuag

SEQ ID NO: 408226 - RNA, 64 nt, Human
ugguguaaagaacuuaauuucaguauaaacugacucugggcagcauuggugaugcuguauccug

SEQ ID NO: 408227 - RNA, 64 nt, Human
aggguugggaagggggugcaggaagcucaaccccucugggcaccaacccugcauugcagguugg

SEQ ID NO: 408228 - RNA, 64 nt, Human
ugaaauacacuaacaggauggcuggguagagcaaucugggcacuuuggccaauuuuagucuugc

SEQ ID NO: 408229 - RNA, 64 nt, Human
uggguuuguggggaguuccuuaauauucucaaguucugggcacacaggguuaaugagucucuug

SEQ ID NO: 408230 - RNA, 64 nt, Human
uaagaucuuguuaaagauuucaaauaaagguacuucugggcagccaggcugcacagcauuugcu

SEQ ID NO: 408231 - RNA, 64 nt, Human
agcgugacugugaguugcucauaccgugcugcuaucugggcagcgcugcccauuuauuuauaug

SEQ ID NO: 408232 - RNA, 64 nt, Human
uccucuuagaaucuucaccaaguggcaggccaccucugggcaggaccaccugcgucuggcaccc

SEQ ID NO: 408233 - RNA, 64 nt, Human
gauugagagcaagguagaggaaggagucccagccucugggcagaccagaggcccagagggagag

SEQ ID NO: 408234 - RNA, 64 nt, Human
ugcugaaagagaugcugggacauagaaccucuuaucugggcagucaugugcugaguuaaaacuc

SEQ ID NO: 408235 - RNA, 64 nt, Human
uggagcccagcugccuguuuucuuuugcaggggaucugggcaccugugccuugaggagaugcug

SEQ ID NO: 408236 - RNA, 64 nt, Human
cauucugugcacagccaaggacuucaguagaccaucugggcagcuuucccauggugcugcucca

SEQ ID NO: 408237 - RNA, 64 nt, Human
ucuaggugaugcugagaccuuggugucucuaaacucugggcauguggacaggaggggcuugcgg

SEQ ID NO: 408238 - RNA, 64 nt, Human
ggaguggugagguaccgucuacauuucacauuauucugggcaccacaaaauauacaaaacuuua

SEQ ID NO: 408239 - RNA, 64 nt, Human
uucuuuuccagccuccuggccuucggacucugaaucugggcaggaagaguccucagucccaaga

SEQ ID NO: 408240 - RNA, 64 nt, Human
guucucucuguuguuggagccuggagccuugcucucugggcacagagggguccacucuccugcc

SEQ ID NO: 408241 - RNA, 64 nt, Human
guaucaggcuucaauuccauuauguuuuaauguugucucugaagaugacuugugauuuuuuuuu

SEQ ID NO: 408242 - RNA, 64 nt, Human
auuugcaauuauacauagcuagcuaaaaaguugggucucugagauuucaacuuguagauuuaaa

SEQ ID NO: 408243 - RNA, 64 nt, Human
cuuuuuguugcacagggcucuauugagguccuaugucucugauuuuuuuuuuuccccaguauug

SEQ ID NO: 408244 - RNA, 64 nt, Human
aaagaagauuauuaguuguaacuaauuuagggguucugggcacagacaucuaaccugguauugu

SEQ ID NO: 408245 - RNA, 64 nt, Human
augggugaugucagaauucuucccagcacaguguucugggcagccaguaccaaucaauuuggca

SEQ ID NO: 408246 - RNA, 64 nt, Human
guuuuugcccuggagccucagcagcaaaugccacucugggcagucuuuugugucagugucuuaa

SEQ ID NO: 408247 - RNA, 64 nt, Human
cugcuuucccugggcacgggcuccagggaucaucucugggcacucccuuccugccccaggcccu

SEQ ID NO: 408248 - RNA, 64 nt, Human
gagauacuuggaaaccacaguuuauuauuauuuaucugggcaauuauugugugugugaggaugg

SEQ ID NO: 408249 - RNA, 64 nt, Human
uggaugugccgaugauggggcugacaguaugggcucugggcaucccuguuccccccucuuucuu

SEQ ID NO: 408250 - RNA, 64 nt, Human
ggacagcagcauuguuuaugggaauggagagaggucugggcaggauaggaaccuucuuggagac

SEQ ID NO: 408251 - RNA, 64 nt, Human
uaccugugagauaaccacaaccaggaagaacaaaucugggcauugagcaagcuaugaggguccc

SEQ ID NO: 408252 - RNA, 64 nt, Human
auggcggggcccauucacggggcaacacugggcuucugggcacagcgggaauacagaaagauac

SEQ ID NO: 408253 - RNA, 64 nt, Human
gcagcuaccucgggaggaaggucucacaucugucucugggcacccaugcuggccagcaguuucc

SEQ ID NO: 408254 - RNA, 64 nt, Human
uuuaguggauagguuauuguacuuccauucauacucugggcacuuguguuguauuguucuguua

SEQ ID NO: 408255 - RNA, 64 nt, Human
aguccagaaaaaaaaauaagcuguuugaauuacaucugggcaaucaggagauaauucauuaugg

SEQ ID NO: 408256 - RNA, 64 nt, Human
ucaugacaugaacaguuuaauugaacccauccacucugggcagguaagagaaaagaaaaagaua

SEQ ID NO: 408257 - RNA, 64 nt, Human
gcugaagccucccaauccccagggcacugcagagucugggcagaggugggcgcauagguacaag

SEQ ID NO: 408258 - RNA, 64 nt, Human
ccgccauagccccaguaggacaaacgggcucgggucugggcagcaccucuggucaggaggguca

SEQ ID NO: 408259 - RNA, 64 nt, Human
aggccccagacagggugggcuuccugcccuucccucugggcacgccugcuggccgacccacuga

SEQ ID NO: 408260 - RNA, 64 nt, Human
uuuuucuuuuuagauagaagugacugugugguuggucucugagguauuugggggacucuguauu

SEQ ID NO: 408261 - RNA, 64 nt, Human
guauaugaggaugguaguuuuuucaccuucaguugucucugauguagcuuauacaaaacauuug

SEQ ID NO: 408262 - RNA, 64 nt, Human
uugucagccccagaauuucuucuuaaguucgccugucucugaaaucccaaagucacggaaccgc

SEQ ID NO: 408263 - RNA, 64 nt, Human
aagagcccauaucacuaagauggcauauaugugaucugggcauuuuccuccucugccuacagcc

SEQ ID NO: 408264 - RNA, 64 nt, Human
cuuggggauuucuggucaaccccacaagcaccacucugggcacaagcagggcacucuguucccc

SEQ ID NO: 408265 - RNA, 64 nt, Human
uuccacugauagcucucgucguaacugcagcugaucugggcacagugguuuucacagccacugc

SEQ ID NO: 408266 - RNA, 64 nt, Human
agaaaagcuuuguuccuaacauaucuuuugccugucugggcaaguauuugacucaacuaaauuu

SEQ ID NO: 408267 - RNA, 64 nt, Human
agcacccacaaccagccccaugcaugcugcugccucugggcagucguagaaucucccacuucag

SEQ ID NO: 408268 - RNA, 64 nt, Human
ccccaccuggcccuuucuccagcaagcacuguccucugggcaguuugcccccaucccucccagu

SEQ ID NO: 408269 - RNA, 64 nt, Human
ccaggcagcuggacaucuccaggaaaccaggccaucugggcaggaggccuggggaugagggugg

SEQ ID NO: 408270 - RNA, 64 nt, Human
cuaaccagugagcacugguuaguacugguccccuucugggcaacauggcccuaccagacacugc

SEQ ID NO: 408271 - RNA, 64 nt, Human
cggagugagggggcugcuggcuuaacagcaggcaucugggcaggccaguccucaaagcagcucc

SEQ ID NO: 408272 - RNA, 64 nt, Human
gauauacuaguugaaaagaauaacccacuccucuucugggcauuuaagcugguauguuagugcu

SEQ ID NO: 408273 - RNA, 64 nt, Human
guugucaugugaccacuucuuucuucuccuuucuucugggcagccuguacucuccaccacucac

SEQ ID NO: 408274 - RNA, 64 nt, Human
gugcugcacagacuugucaagguuugcuacguccucugggcaucugcaaaaggcccugcucucu

SEQ ID NO: 408275 - RNA, 64 nt, Human
augcacaaaaauaaacuaugguaauuaaugcaaaucugggcacagaugaugcgugcuacuugcu

SEQ ID NO: 408276 - RNA, 64 nt, Human
cagcacaggggcucagccugggauccggugauggucugggcagaggcugggucaggagucccaa

SEQ ID NO: 408277 - RNA, 64 nt, Human
ccccaggccggagcccagauacgggggcugugacucugggcagggacccggggucuccuggacc

SEQ ID NO: 408278 - RNA, 64 nt, Human
ggagaaucacuugagcucaggaguucuagaccaaucugggcaacagagagaccccaucucuuuu

SEQ ID NO: 408279 - RNA, 64 nt, Human
gaccugcaccaaagcuggcaccagggcucggaaggucucugaacucagaaggauggcauuuuuu

SEQ ID NO: 408280 - RNA, 64 nt, Human
agaugucucccugugggaaaggagaagagaaguugucucugaguccccugucaccaguuggauu

SEQ ID NO: 408281 - RNA, 64 nt, Human
agugaggguuuucauagcuuuuggaaauacuuuggucucugaacuguaauuagcaagaaguaaa

SEQ ID NO: 408282 - RNA, 64 nt, Human
ugaggccugggguuccucagaccaucuccuucauucugggcagugcccagccaccggcugaccc

SEQ ID NO: 408283 - RNA, 64 nt, Human
cuucacccacccuccaggaccccagcaaguggauucugggcaagccuguuccggugauguagac

SEQ ID NO: 408284 - RNA, 64 nt, Human
ggcuggcauguucagcagugccuggggcccuguuucugggcagccuuugaggauuuucuaugau

SEQ ID NO: 408285 - RNA, 64 nt, Human
gucaacuugguguagccgguuccccggccacgacucugggcacuuccccugaagcuccucuccg

SEQ ID NO: 408286 - RNA, 64 nt, Human
aauauuuaauuaaauauugcuuugaagauggcgcucugggcaugagcauggggcuccaugacuu

SEQ ID NO: 408287 - RNA, 64 nt, Human
gggugcgguggaggcggccuugccgguggugcuuucugggcagccagggguuccugggugggag

SEQ ID NO: 408288 - RNA, 64 nt, Human
cugcccugagaccuuggacaaacccuucccccucucugggcacccuucugcccacaccaguuuc

SEQ ID NO: 408289 - RNA, 64 nt, Human
aaagccucagccuuccucuggaagcaucccccguucugggcaagggggaagggcuccuuuaagg

SEQ ID NO: 408290 - RNA, 64 nt, Human
cugguuuccuggcagccugcugcgcgugugggucucugggcacagugggccugugugugugccc

SEQ ID NO: 408291 - RNA, 64 nt, Human
ucgucaaaaccauucucgcugcugagcuugacaaucugggcaaggcuuguggggcgcuugacaa

SEQ ID NO: 408292 - RNA, 64 nt, Human
uggcugagagggguccugggguguuucagacccuucugggcaucuccuuccacagcuguucagu

SEQ ID NO: 408293 - RNA, 64 nt, Human
agaccucagccggcgccggacccgguaggggcagucugggcagcaggaaggaagggcgcagcgu

SEQ ID NO: 408294 - RNA, 64 nt, Human
acuuuugucuuguauauguauguauauuggguccucugggcaguagaggcaaagcucaccuccc

SEQ ID NO: 408295 - RNA, 64 nt, Human
caaagcuguuggccucugcaaaggaaauaccaguucugggcaaucaguguuaccguucaccagu

SEQ ID NO: 408296 - RNA, 64 nt, Human
ccacagcaaagguuucauucaggagauucuuccaucugggcaaccugguuuuccaaauaucauu

SEQ ID NO: 408297 - RNA, 64 nt, Human
uauaauaccccucaguaagauuccaguauuaauuucugggcaguuuguucucuguauacaauug

SEQ ID NO: 408298 - RNA, 64 nt, Human
uugaccauccaaauggaaauuccccuuucuuggugucucugacaaaugguccuuugccuuaucu

SEQ ID NO: 408299 - RNA, 64 nt, Human
gagaggggcuguccaguucccagaaggcauaucagucucugagggcuuccuuuggggccgggaa

SEQ ID NO: 408300 - RNA, 64 nt, Human
gcuuggcaauguuaaauguauuuauuaacuuugugucucugaaucucuguucuaaugugccaug

SEQ ID NO: 408301 - RNA, 64 nt, Human
cccuaggaaaccuucugcucagccccagccugcuucugggcacuccuccucaccccuccuugcu

SEQ ID NO: 408302 - RNA, 64 nt, Human
cuuccuaauacccacccuuccucacgaccucauuucugggcaucuuuguggacaugaugucacc

SEQ ID NO: 408303 - RNA, 64 nt, Human
ugccaggaugcauuuggaaagauagagcauucugucugggcagagacuguggacccugguaugc

SEQ ID NO: 408304 - RNA, 64 nt, Human
uuggauacuggaggcaguugcauaggucucccucucugggcaccaggacucaguccagcccaag

SEQ ID NO: 408305 - RNA, 64 nt, Human
cugggcaccaggacucaguccagcccaagacuacucugggcagcucccaucccagucuggggcc

SEQ ID NO: 408306 - RNA, 64 nt, Human
cacugaaggaaaaggccaacuaggguguuagcccucugggcaccaaggaaacuaacagcuuucu

SEQ ID NO: 408307 - RNA, 64 nt, Human
caccuuugugagaauuagaaaacauguaccuuccucugggcagcugcagcccugagccaggaca

SEQ ID NO: 408308 - RNA, 64 nt, Human
gaaucauuuuguuugcuuugacccuguuucaccaucugggcaaucauuuauuuuccuugagcau

SEQ ID NO: 408309 - RNA, 64 nt, Human
uucugcucguaucccaaggccugguuggucaaacucugggcaaaggguuuucaggaugaggagg

SEQ ID NO: 408310 - RNA, 64 nt, Human
gaguuuauacccuccccuuguuuucuugcuuuauucugggcaaguuugaaggggaaaauuugug

SEQ ID NO: 408311 - RNA, 64 nt, Human
uggcuguugauuuugucugguuccuuugccaacaucugggcacacccuuugcccagacacgagu

SEQ ID NO: 408312 - RNA, 64 nt, Human
acugcguaauucuuaguuuauuuaggaacucaucucugggcacuauaaagucucugccuccuaa

SEQ ID NO: 408313 - RNA, 64 nt, Human
agggcuggggugugcuggcaucgacagcccccacucugggcacuaggugggcccuugaagggga

SEQ ID NO: 408314 - RNA, 64 nt, Human
ucuaagauucugcugaggagcccccgcuggucccucugggcaugcugugcucggacggaaagcg

SEQ ID NO: 408315 - RNA, 64 nt, Human
ccuccccggguuccuucaggucaccuugucaggaucugggcagcggcuucccccucuagccccu

SEQ ID NO: 408316 - RNA, 64 nt, Human
gccugcagguggcaccgguggcccuggcugcaguucugggcagcauccucccaagcagagaccu

SEQ ID NO: 408317 - RNA, 64 nt, Human
uaacggccaacacuuuguucgcucauuuuacgcugucucugacauaaggagugccugaauagcu

SEQ ID NO: 408318 - RNA, 64 nt, Human
agugagcagagcauuggacuuggcuggccagagggucucugagggcaagagacauggccaacca

SEQ ID NO: 408319 - RNA, 64 nt, Human
uucuguaauguuugaccuaauaauagcccguuucgucucugacccaacagaggaagcacagauc

SEQ ID NO: 408320 - RNA, 64 nt, Human
gaagugacgguuccuacacaggacagggguuccuucugggcauuacaucgcauagaaaucaaua

SEQ ID NO: 408321 - RNA, 64 nt, Human
caagaguggggcaugggaagggcugguccaggggucugggcacuguacauaccugcccccucau

SEQ ID NO: 408322 - RNA, 64 nt, Human
aauauacccaguuuuuacucaguuugauuuauauucugggcaaggaagcuuugccuacuuuauu

SEQ ID NO: 408323 - RNA, 64 nt, Human
aaacagggaggagcugcagaauggggcucuggucucugggcauucauuucccucauagaggcug

SEQ ID NO: 408324 - RNA, 64 nt, Human
guguccgcuauccaccaaaagggcucccugagggucugggcaagggaccugcuucuauuagccc

SEQ ID NO: 408325 - RNA, 64 nt, Human
cuauauaauaauugcuuuggcuuucaccuaaaauucugggcaucacaauuuccuugggauagag

SEQ ID NO: 408326 - RNA, 64 nt, Human
ggggucagccccaagggcuggggcggagcuggggucugggcagugccacagccugcuggcaggg

SEQ ID NO: 408327 - RNA, 64 nt, Human
gggggugucagaagcugggaacguguguccaggcucugggcacagugcugccccuugcaagcca

SEQ ID NO: 408328 - RNA, 64 nt, Human
gguuuggggggcccucucccaggacacugccucuucugggcagaaggccccuccagggggacug

SEQ ID NO: 408329 - RNA, 64 nt, Human
ucagugguuucugugucccuguggugccagugcuucugggcagugcaggcggcugccaggccca

SEQ ID NO: 408330 - RNA, 64 nt, Human
caucugggagagcccacugucccacucccacaugucugggcaccugcccugggcugaggccagg

SEQ ID NO: 408331 - RNA, 64 nt, Human
gaggcggauugagaaggagcucccaggaggggcuucugggcagacucuggucaagaagcaucgu

SEQ ID NO: 408332 - RNA, 64 nt, Human
cuguggauagugccuaggggagugcuccacgcccucugggcauacgguagauauuaucugauga

SEQ ID NO: 408333 - RNA, 64 nt, Human
ugaaaccuuggaguuuacaaagaauugccccagcucugggcacccuggccacccugguccuugg

SEQ ID NO: 408334 - RNA, 64 nt, Human
agggccccuggggcagaaguuaggcacgaggcagucugggcacuuuucugcaaguccacugggg

SEQ ID NO: 408335 - RNA, 64 nt, Human
uugaacaccucaccuugaaacuguagcaguguguucugggcaguaucuguaauguaugaaauag

SEQ ID NO: 408336 - RNA, 64 nt, Human
gguggguuuuucuccguaugcacauugguauacagucucugagaacuggcuuggugacuuugcu

SEQ ID NO: 408337 - RNA, 64 nt, Human
agcagauggugacaacgugcaucugguucugaaugucucugaggagcagcacuucggccucucc

SEQ ID NO: 408338 - RNA, 64 nt, Human
uuaaagccaugcagcuggaggggccacugagauugucucugaguauuacugagaagcaacagaa

SEQ ID NO: 408339 - RNA, 64 nt, Human
caguggaaagugcuuagcucucucccuccugaccucugggcagccagucaucaaagcagagaga

SEQ ID NO: 408340 - RNA, 64 nt, Human
accugcugccugacgccacagucauuggcagaggucugggcauuauuaauuuauaaaaauccau

SEQ ID NO: 408341 - RNA, 64 nt, Human
uccccagaaugacugcgcuucuccuacaagguucucugggcacugcccagccugagucucggcc

SEQ ID NO: 408342 - RNA, 64 nt, Human
gccucccugucggccugguguucugugggaucccucugggcacugguaaucccaagaucugugc

SEQ ID NO: 408343 - RNA, 64 nt, Human
cuucacugagcauguauuuugugccacacccugcucugggcacugggaaugcugggaaaugaga

SEQ ID NO: 408344 - RNA, 64 nt, Human
aauuagguggccuuauaaauauaagcagaugguuucugggcaaaaucaaaugauuucugucucu

SEQ ID NO: 408345 - RNA, 64 nt, Human
cuaaauaauaacaauaaaagagcacuugggugaaucugggcaccugauuucugaguuuugaguu

SEQ ID NO: 408346 - RNA, 64 nt, Human
uugaaagacgucaucacugaaagacagaaugccaucugggcauacaaauaagaaguuugucaca

SEQ ID NO: 408347 - RNA, 64 nt, Human
caugugcaugugcauggaaggauaaaagaucuagucugggcagugucugcucugaaauguccca

SEQ ID NO: 408348 - RNA, 64 nt, Human
gcuuuuuugauuuugcugacuuuaaaaggauuaaucugggcagacauuauguaaaagaaagguu

SEQ ID NO: 408349 - RNA, 64 nt, Human
agccccuccccuggcauggcaggaccaucgccacucugggcacuccugagcccagcucuccccu

SEQ ID NO: 408350 - RNA, 64 nt, Human
uuuuuacccugccaguuauagcauugugauucuuucugggcacuggcauuuugugaaacucuca

SEQ ID NO: 408351 - RNA, 64 nt, Human
auggggcaccuggcggggcgggggucugccggccucugggcaaggccccuggagcaucucgccc

SEQ ID NO: 408352 - RNA, 64 nt, Human
aaccugaggcccaggaucugcucugugccgguccucugggcaguguggggugcagaauggggug

SEQ ID NO: 408353 - RNA, 64 nt, Human
ccuuaccucaauuccaucuccacccaucucuacaucugggcacagcaacccagagauggccaaa

SEQ ID NO: 408354 - RNA, 64 nt, Human
gccacgaugugugccuucaggacaccggggacacucugggcagcguccuccggggcuucuucac

SEQ ID NO: 408355 - RNA, 51 nt, Human
guucuguaugcuuucuguaaagucucugaauuaguuccgaauucaggcugu

SEQ ID NO: 408356 - RNA, 64 nt, Human
gaugaaaacuuuuacauuuuucugauggguucaugucucugauugggucagcuggcuuccuagc

SEQ ID NO: 408357 - RNA, 64 nt, Human
gaugauguuucuugcuuuuggaaaaaaaaaaaaagucucugaaauuugauucuuacuacagauu

SEQ ID NO: 408358 - RNA, 64 nt, Human
ggcauagauuuccucuuccacaagcugccgcuuuucugggcaccuugaagcaucagggcgugaa

SEQ ID NO: 408359 - RNA, 64 nt, Human
ccagcggaggcagagccgggaggcugcgugggcuucugggcaggcucacgcagacgccggccac

SEQ ID NO: 408360 - RNA, 64 nt, Human
auggcagcuugccaugccuacccuucccugucugucugggcagcagguucagggcugagcccuu

SEQ ID NO: 408361 - RNA, 64 nt, Human
ggaaaacaaagguguuaaguaccucuguucuggaucugggcagucagcacucuuuuuagaucuu

SEQ ID NO: 408362 - RNA, 64 nt, Human
uauuuuaacaugauguccaugaagagguuugccgucugggcagcccugucggcaaggagcgugc

SEQ ID NO: 408363 - RNA, 64 nt, Human
ggacucugacgucucuuuggucuuguugauuuccucugggcauaucccuuccccagaucugcuc

SEQ ID NO: 408364 - RNA, 64 nt, Human
uuuccucucagggaacuaaugcucugaaaagggaucugggcacaacaguuucagugagugcuuu

SEQ ID NO: 408365 - RNA, 64 nt, Human
caggcucaccuuaaaaucagcccuugaucccauuucugggcaauuuagacagugaaacugacuu

SEQ ID NO: 408366 - RNA, 64 nt, Human
ugcagugagccaagaucgcgccacugcacuccagucugggcaacagagugagacccugucucaa

SEQ ID NO: 408367 - RNA, 64 nt, Human
ccuaacucuuggcuucaucugcugccaugccgucucugggcaaccaggccccaacugugcuuaa

SEQ ID NO: 408368 - RNA, 64 nt, Human
cuguucuugagcagcuugaccaccccaacagggaucugggcagagagucuguggaugcagagga

SEQ ID NO: 408369 - RNA, 64 nt, Human
ggcuccagcucugugcucucagaacucccuucccucugggcagaggcccaucugcucuguuuac

SEQ ID NO: 408370 - RNA, 64 nt, Human
ccagcacugugguuguugagccacaccaguggccucugggcauucggcucaacgcaggagggac

SEQ ID NO: 408371 - RNA, 64 nt, Human
gaauuucuuacuccauacaagcaguuuauggaugucugggcaaucauagcacuugccauuuaaa

SEQ ID NO: 408372 - RNA, 64 nt, Human
gcaaaaccccaucucuacaaaaauaaaaaauaugucugggcaugguggcccaagucugaguccc

SEQ ID NO: 408373 - RNA, 64 nt, Human
gaugucccuacccuaggcaugagguauauuuuauucugggcaccacacauuugccccauagaua

SEQ ID NO: 408374 - RNA, 64 nt, Human
gaccccugcuguuuuuaaacagcuuuuccuuuuggucucugacagucaauccagguuuuauguu

SEQ ID NO: 408375 - RNA, 64 nt, Human
uuggacuuucaaaauuaaaucugucccugagagugucucugauaaaagggcaaaucugcaccua

SEQ ID NO: 408376 - RNA, 64 nt, Human
cagcauguuaguuuugggaggcaaugucaacugugucucugaauuccugucuuccaaauugaag

SEQ ID NO: 408377 - RNA, 64 nt, Human
uccuuauuuucuccaagcccagcaaacguugacuucugggcaaaccugaaaaccugaaaaugcc

SEQ ID NO: 408378 - RNA, 64 nt, Human
uaagcgguaauagcagaggaaagggugaagggagucugggcaagcaaagcauagagaugguggg

SEQ ID NO: 408379 - RNA, 64 nt, Human
aagccacauucacucucucuguggccuuucuuccucugggcaaagaagggcuuccaguggccuu

SEQ ID NO: 408380 - RNA, 64 nt, Human
ugucagcuuuuucccagggagccguuucagggguucugggcaguaggcugggccuggccucaga

SEQ ID NO: 408381 - RNA, 64 nt, Human
auaccuuaaccucugaacucugaccucaggaggcucugggcacuccagcccugaaagccccagg

SEQ ID NO: 408382 - RNA, 64 nt, Human
augaaggcucggcggcccagggcagcacccaaggucugggcaaacucagcauuaguggcggagg

SEQ ID NO: 408383 - RNA, 64 nt, Human
agaaauccucugaguagcgggaagugcgguacagucugggcauucugauguuugugauuguuuu

SEQ ID NO: 408384 - RNA, 64 nt, Human
cugggggaguggugccucgcaugcugauaacaauucugggcacggugaagcccaaugcaaacag

SEQ ID NO: 408385 - RNA, 64 nt, Human
agguuaagaauaucagugacaguacucugaggcaucugggcaugucagaugaagauuuauuauu

SEQ ID NO: 408386 - RNA, 64 nt, Human
gaugaggucauuucuaagguguguugcccguggaucugggcacaaucauuggaauuccuuggag

SEQ ID NO: 408387 - RNA, 64 nt, Human
cgugccaauaccuggcugcugucuuaacucguagucugggcacaggauacauauguccccgucc

SEQ ID NO: 408388 - RNA, 64 nt, Human
aaggaacuuggaaugcaagcuggaugccugggucucugggcacagccuggccccugugcaccga

SEQ ID NO: 408389 - RNA, 64 nt, Human
gggugucacaacuaauguggccacugcuucauucucugggcaaaauaauauuaaauggauuaaa

SEQ ID NO: 408390 - RNA, 64 nt, Human
ccgugggcccugccacccagaagucuggcugaggucugggcaggggcagggcaagcuugaccuc

SEQ ID NO: 408391 - RNA, 64 nt, Human
cccagacaccacuguccauccugugaggcucccgucugggcauguccuggguggauuccuccuu

SEQ ID NO: 408392 - RNA, 64 nt, Human
gacauggcucuggacucuaaagaccaaacuucacucugggcacacucugccagcaaagaggacu

SEQ ID NO: 408393 - RNA, 64 nt, Human
aguuuagaaagauaucaucaacguucugucaccagucucugaugccacuauguucuuugcaggc

SEQ ID NO: 408394 - RNA, 64 nt, Human
ucgguaucucuauuggucaaagaauauuaaaucugucucugaauuacuucaaauucucagguga

SEQ ID NO: 408395 - RNA, 64 nt, Human
aucaagcuggcccagauacaaguaccaaacaguagucucugaaguucccccauuuccuucagua

SEQ ID NO: 408396 - RNA, 64 nt, Human
uuaagcaaugggagggagagggaggaggggaagaucugggcaauuuuggccuugacucuuuccu

SEQ ID NO: 408397 - RNA, 64 nt, Human
cagaaaacagaauugaaguugggaaacucuagagucugggcaaaauguuugguuuuuucucuua

SEQ ID NO: 408398 - RNA, 64 nt, Human
cgugacaggcucgucagccaccugggaacacaguucugggcaaagaggauccgagguugagagg

SEQ ID NO: 408399 - RNA, 64 nt, Human
acuaaugaccacaccugccucucccgucgucucuucugggcacccucccacccggcugcauacc

SEQ ID NO: 408400 - RNA, 64 nt, Human
ucaucaggacacuucccucucuuuugggagcuucucugggcagaauugggcugggaccucucuc

SEQ ID NO: 408401 - RNA, 64 nt, Human
ggaggacugcuugggcccaagaauucaggaccagucugggcaacagagccagacacugucucua

SEQ ID NO: 408402 - RNA, 64 nt, Human
ccccacccuggcuugcucuuggucacagggcgguucugggcacuugaacucagggcccaagcag

SEQ ID NO: 408403 - RNA, 64 nt, Human
ggaguaggauauugggucaguguccaaagcagggucugggcaggacucagcuccccagaguccu

SEQ ID NO: 408404 - RNA, 64 nt, Human
agugauugggacagagguuaucugucccagguuaucugggcauagaugcaggugagcccauggc

SEQ ID NO: 408405 - RNA, 64 nt, Human
uuuccugagaucuacccggggcuuggcugucuguucugggcacuggcuccgaguuccccuccug

SEQ ID NO: 408406 - RNA, 64 nt, Human
cauuuuguucauccccaggguagcugcccuggggucugggcacucugccucugggagagaggaa

SEQ ID NO: 408407 - RNA, 64 nt, Human
cacuggauugcucucccauuaugagcauccuucaucugggcagaccccccacccugcagaugcu

SEQ ID NO: 408408 - RNA, 64 nt, Human
agugguuacuagccaggcauaccccuagcauaagucugggcagcucuaugggaugauaaauuac

SEQ ID NO: 408409 - RNA, 64 nt, Human
aaguuugaaguuucgccgcuuuugucaacuauccucugggcaaagguauucagcaagaggugga

SEQ ID NO: 408410 - RNA, 64 nt, Human
uccgagccucuuccugagccccaggucucuucagucugggcacaggcauuucugccaagucugu

SEQ ID NO: 408411 - RNA, 64 nt, Human
ugagggggugugccacuuguccccagggcacuccucugggcaucccgggugggggauuuugggg

SEQ ID NO: 408412 - RNA, 64 nt, Human
ugucuuaugggcgcauaugugcguguguggcugagucucugacagcugugagugugugugagca

SEQ ID NO: 408413 - RNA, 64 nt, Human
ugccaagaaaucgccuuaugagaacauggugugugucucugacaaugcguggcacaucuaaauu

SEQ ID NO: 408414 - RNA, 64 nt, Human
gacucaguggggacuugcaugcacauccaccauugucucugaguaguauugaaauguggcccgg

SEQ ID NO: 408415 - RNA, 64 nt, Human
ucucauugagccagagaagacaaggagaucucccucugggcaucuggcuuugcugcgucucuag

SEQ ID NO: 408416 - RNA, 64 nt, Human
cgguuggccuccuugcuuugccgcaccuccagguucugggcaugagaggccguggccucauuuc

SEQ ID NO: 408417 - RNA, 64 nt, Human
accgugcaugaugacagggugaagagaaggcaggucugggcacuggggcaaagagaacuuaagu

SEQ ID NO: 408418 - RNA, 64 nt, Human
uuuggguggggagggggagcauggugggccaugcucugggcagcuguuccaagacagagcugac

SEQ ID NO: 408419 - RNA, 64 nt, Human
aucccauggcauccccauggaggaaccaggcccaucugggcagcagcaucugguugaccagaug

SEQ ID NO: 408420 - RNA, 62 nt, Human
acugcgcuaacuccugauuaauacaauggaaguuucugggcauuuacaauuucaacacuuuu

SEQ ID NO: 408421 - RNA, 64 nt, Human
uuuaaauagcaaagcagccuaccuggaggcuaagucugggcagugggcuggccccuggugugag

SEQ ID NO: 408422 - RNA, 64 nt, Human
aagcucacccuucgucauggaccgagguucccacucugggcaaagccccucacacugcaaggga

SEQ ID NO: 408423 - RNA, 64 nt, Human
cagcacaaggagacaaagcagagccuugucuguaucugggcagcagguguuccaugcugcuagg

SEQ ID NO: 408424 - RNA, 64 nt, Human
cauuuccaaggguuugccuugugucucagcucauucugggcagcacguuugucuucugucccua

SEQ ID NO: 408425 - RNA, 64 nt, Human
aaucugcucccaaaggaagcugaccagagcaagaucugggcaagcagagagugccugggacagg

SEQ ID NO: 408426 - RNA, 64 nt, Human
ggguauugcucuucuucuuuucuugaucuuccugucugggcagacuucagagacuuuguggccu

SEQ ID NO: 408427 - RNA, 64 nt, Human
uauuuauaugccucccccaacacuacccuuggggucugggcauuccccgugucuggaggacagc

SEQ ID NO: 408428 - RNA, 64 nt, Human
caagagagcagcgcccaggccugcuggcaucaggucugggcaaguagcaggacuaggcauguca

SEQ ID NO: 408429 - RNA, 64 nt, Human
cacaggcugggcuccagcaggugggcaggggaggucugggcaaggcgcugccgucggcugucaa

SEQ ID NO: 408430 - RNA, 64 nt, Human
ggacaagguuccucccucuccugcagaguaggcaucugggcaccaagaccuucccucaacagag

SEQ ID NO: 408431 - RNA, 64 nt, Human
cgugugcuccaguucuaaaauuaaccugugccuggucucugaagcccuuucuugcucugugccu

SEQ ID NO: 408432 - RNA, 64 nt, Human
caaacuacugcuuuaaugucaaguuugcagaauugucucugaaaauaaaaacccugacuuuagu

SEQ ID NO: 408433 - RNA, 64 nt, Human
uuuauagaaaaaaguuuauaugacugacaacaaugucucugagugguaggauuacaguuaauuu

SEQ ID NO: 408434 - RNA, 64 nt, Human
gccagcccccuccuuagggggugggcgaggagccucugggcagacccaagaaccauggggacug

SEQ ID NO: 408435 - RNA, 64 nt, Human
ucuggcacccugggccuccuccgggagccucccaucugggcaguggagccauaaacggggaucc

SEQ ID NO: 408436 - RNA, 64 nt, Human
acucuucauggaaagcaacucuugccccuccuccucugggcacagggugugcguucagaugacu

SEQ ID NO: 408437 - RNA, 64 nt, Human
ucugcauugucacgcugacgcuagagaccagcgcucugggcaccuuuuuuacgcacgcggcccu

SEQ ID NO: 408438 - RNA, 64 nt, Human
ugccggcaucuccccuagcucaccaggccuggccucugggcaguguggccucuuggcuauuucu

SEQ ID NO: 408439 - RNA, 64 nt, Human
cagccguaggguggcacugggagggggugggggaucugggcaaggugggugauuccucccagga

SEQ ID NO: 408440 - RNA, 64 nt, Human
gucgucccaggcugccggcuccccucgacagcucucugggcacccgguccccucugccccaccc

SEQ ID NO: 408441 - RNA, 64 nt, Human
auacggcauguuaaugacucugaugguguccuccucugggcagcuguauaggaucaucaugugg

SEQ ID NO: 408442 - RNA, 64 nt, Human
uuacccagggaggggacauucccccaauccugugucugggcagcuugccugguggauguuucug

SEQ ID NO: 408443 - RNA, 64 nt, Human
cuggaaacccggauuucgccuccggacagcggcgucugggcaggguucggguacugcagucccg

SEQ ID NO: 408444 - RNA, 64 nt, Human
gaggcaugacaggcccugcucagaggucagagggucugggcagaggagggaccacauuccccug

SEQ ID NO: 408445 - RNA, 64 nt, Human
gcuggugcacaggagccuccuguuugggccugggucugggcauggggaggccgugccucaaagc

SEQ ID NO: 408446 - RNA, 64 nt, Human
cagcuccucacccagggcccccaaagagcaagcgucugggcaagaggaaaaugcccugucccua

SEQ ID NO: 408447 - RNA, 64 nt, Human
ucucccugggguuuuuuucaucccugccaagaacucugggcacuuuugaacucacgagccuugc

SEQ ID NO: 408448 - RNA, 64 nt, Human
gacagcugcaggugcccauuagcaacgccugccuucugggcaaggugagggaugccauaccuug

SEQ ID NO: 408449 - RNA, 64 nt, Human
uccugggcuuaaggccuaaggaagccagucaccuucugggcaagggcuccuaucuuuccucccu

SEQ ID NO: 408450 - RNA, 64 nt, Human
agucacugccaacaacaacgagguuccuauaauugucucugaguaacccuuuggaauggagagg

SEQ ID NO: 408451 - RNA, 64 nt, Human
cagucugugauaucugaauguucauuguauauuugucucugaugcaaaaagguagaguaacaca

SEQ ID NO: 408452 - RNA, 64 nt, Human
uaugcaguuauucuaugagucgcacaauucuugagucucugauaccuaccuauugggguuagga

SEQ ID NO: 408453 - RNA, 64 nt, Human
gcccacuuugugacccagcaagaccuuuccccucucugggcaucaguuucucaucuguaagaug

SEQ ID NO: 408454 - RNA, 64 nt, Human
gacaggaugucuuccuggggguugggauggacucucugggcacuguacucucucuccuaccugc

SEQ ID NO: 408455 - RNA, 64 nt, Human
uccuguggcacccuucaagcugcccagccggcccucugggcagacugucaucacaugcaugcau

SEQ ID NO: 408456 - RNA, 63 nt, Human
auguggagcccagcugcugacagcccagggcucucugggcagcugaugucugcacugaguggg

SEQ ID NO: 408457 - RNA, 64 nt, Human
uuuggggggggcccgccuggcagaacugagcuccucugggcaggaccucagaguccaggcccca

SEQ ID NO: 408458 - RNA, 64 nt, Human
ggugggugcgaugacucugaugccucacucagucucugggcaaucaucaucuuugccucuagcc

SEQ ID NO: 408459 - RNA, 64 nt, Human
cacgccgacccgagagcagcugagcugcgcuggcucugggcagggagugugccuuaaugggaag

SEQ ID NO: 408460 - RNA, 64 nt, Human
acccaagaagucaccguuguuauccguguaugccucugggcauggacaggcgggaguccccgag

SEQ ID NO: 408461 - RNA, 64 nt, Human
agggcaucgaugcugccccgggcuaccuggcugcucugggcagggugugcgggccgggcccggc

SEQ ID NO: 408462 - RNA, 64 nt, Human
gugugcgggccgggcccggcugggggagggcagcucugggcacgccgcacccacgccccccacc

SEQ ID NO: 408463 - RNA, 64 nt, Human
gaaggaggccucagagguuucuccacaguccucuucugggcaaauucuuguuucuucacaugcu

SEQ ID NO: 408464 - RNA, 64 nt, Human
augaggcucacccacgaggcuggguggccagcagucugggcacacacgagcagguggcaucuug

SEQ ID NO: 408465 - RNA, 64 nt, Human
aggggcucuguguuaggaugcggcuuucucugccucugggcagccugcuuuggccuuuccuugu

SEQ ID NO: 408466 - RNA, 64 nt, Human
acauugccaucgcccccaccaguccccucaugccucugggcaguccaaccacuucccuguuucc

SEQ ID NO: 408467 - RNA, 64 nt, Human
agaacuccagauggucaccugcccuggccccuccucugggcagccccuuuccuccauguacacu

SEQ ID NO: 408468 - RNA, 64 nt, Human
ugaucaaggaaaauagcuuccagaauguggugguucugggcaacaaaugagauuguggcgacgu

SEQ ID NO: 408469 - RNA, 64 nt, Human
ucagacaccuuuuaauugcuuaggagaaaccauugucucugacugcagguuugaauaaguugaa

SEQ ID NO: 408470 - RNA, 64 nt, Human
ccagauucucugcuuuugccgcguggucucuggugucucugacauguucccgucacucacugug

SEQ ID NO: 408471 - RNA, 64 nt, Human
aaucagaguggggaaggugagugguagagagggggucucugaaggcccuuggggcugacagggc

SEQ ID NO: 408472 - RNA, 64 nt, Human
gagguggcugcagucccuuaauggggggccuugcucugggcauguggggcucuuccuccaucca

SEQ ID NO: 408473 - RNA, 64 nt, Human
agcccacagccucaccugcugcugccccucuaggucugggcagccaugaccugcagggcccaga

SEQ ID NO: 408474 - RNA, 64 nt, Human
cccaggcacucuuacuucuagccgaacucuuagcucugggcagaucuccaagcgccuggagugc

SEQ ID NO: 408475 - RNA, 64 nt, Human
aaugucuaaccuguugucuuucuguuacuuucuuucugggcaaucaaugacagcaucuccccau

SEQ ID NO: 408476 - RNA, 64 nt, Human
uccuaacuacuuugcaucuguaauccacaaagauucugggcagcugccaccucagucucuucuc

SEQ ID NO: 408477 - RNA, 64 nt, Human
uuuuuaaucuccuacuucugcuaucuuugagcaaucugggcacuuuuaaaaauagagaaaugag

SEQ ID NO: 408478 - RNA, 64 nt, Human
aagugauugugaugcuauuuaucuucagggucacucugggcaaagagaagguccucagccaugc

SEQ ID NO: 408479 - RNA, 64 nt, Human
ccagaaacccggauucugccucccgacggcggcgucugggcaggguucgggugcggcccuccgc

SEQ ID NO: 408480 - RNA, 64 nt, Human
uuuauugucugcuccucugugccaggugcugugcucugggcaggggcacugcaugggcugccug

SEQ ID NO: 408481 - RNA, 64 nt, Human
guggccugaagaagcacuucugcugcaucgcuguucugggcauggcagggccaggccucugcug

SEQ ID NO: 408482 - RNA, 64 nt, Human
uggagcguuugcugugccaggaggcggcagcucuucugggcagagccuguccccgccuucccuc

SEQ ID NO: 408483 - RNA, 64 nt, Human
cccccagguggucucccggugcauagcugguggcucugggcaagccaucccuugcuucucgggg

SEQ ID NO: 408484 - RNA, 64 nt, Human
gcucccugagugaugagcuugaaccugugguguuucugggcagaagcuuaucuuuuuugagagu

SEQ ID NO: 408485 - RNA, 64 nt, Human
ugcagugagcuaugauuccaccauugcacuccagucugggcaacagagcaagacccugucuauu

SEQ ID NO: 408486 - RNA, 64 nt, Human
acccgguuuauuaguucaaaagugugacaccuuuucugggcaaggaacagccccuuuaaggagc

SEQ ID NO: 408487 - RNA, 64 nt, Human
gaggcauuucagauagauacccaccaugagguguucugggcaucugaagguauuaagaguucag

SEQ ID NO: 408488 - RNA, 64 nt, Human
uuuaaauugcuuaaguacucacucagacauuccagucucugauagcuuuuccucaaguguuucu

SEQ ID NO: 408489 - RNA, 64 nt, Human
ccagacuucaguggacccagauagaaaauauaaagucucugaucuauaggccacaucaggaugu

SEQ ID NO: 408490 - RNA, 64 nt, Human
uuucaagccuacuuaccuuuauaaagguucucuagucucugauuagccaugacuguauuggacu

SEQ ID NO: 408491 - RNA, 64 nt, Human
gcccugccucauacugagauccaacccuuuauuuucugggcaaagccaaacccaccuguguaga

SEQ ID NO: 408492 - RNA, 64 nt, Human
augggaauuguuguauuccuucugcagcccuccuucugggcacuaagaaggucuaugaauuaaa

SEQ ID NO: 408493 - RNA, 64 nt, Human
cagagacuugcccaagggcccaucaccacuggccucugggcacuugugcugagacucugggacc

SEQ ID NO: 408494 - RNA, 64 nt, Human
uugcugugugaccuuggggaaaggcagugcccucucugggcagucagauccacccagugcuuaa

SEQ ID NO: 408495 - RNA, 64 nt, Human
agccccuuccuucugcccacccacccuucuucccucugggcaacuggacagaucugggagccag

SEQ ID NO: 408496 - RNA, 64 nt, Human
cuuguaaucccaguacuuugggaggccaaggcagucugggcaauauagugaggcucccaucugu

SEQ ID NO: 408497 - RNA, 64 nt, Human
acuuccuggccccaccugcuaaauaccuccaaacucugggcaggcgccugcauucucaacacag

SEQ ID NO: 408498 - RNA, 64 nt, Human
gaauuuaguagagcuaguaggcccuggucgucacucugggcagggaugccgucagccuugaggg

SEQ ID NO: 408499 - RNA, 64 nt, Human
ccacaaaucuuuccaacucuacggauuugccuguucugggcauuucaugucaauggaaucaugu

SEQ ID NO: 408500 - RNA, 64 nt, Human
cuccgguugguggaagauugcugaccgugccguuucugggcaggagaagacaucauggugucca

SEQ ID NO: 408501 - RNA, 64 nt, Human
gccucuaaacagaacccucuuacuauuuaguuuaucugggcagaaccagauuguuauguccuuu

SEQ ID NO: 408502 - RNA, 64 nt, Human
aaaaaauaaaaaacugaccaucuaguccuugucaucugggcacccucacacaucuccuuaacca

SEQ ID NO: 408503 - RNA, 64 nt, Human
gcugggugagggcacauucaggacuagaagccccucugggcaugggguggacauggcaggucag

SEQ ID NO: 408504 - RNA, 64 nt, Human
ugcagugagcuguguucacaccacugcacuccagucugggcaacagugcaagacccugucacuu

SEQ ID NO: 408505 - RNA, 64 nt, Human
gucuuggcccccacccugaaucuuacugagucccucugggcagcagcucccuucuccaccccac

SEQ ID NO: 408506 - RNA, 64 nt, Human
aucccacauuuccauggugugagauccucuuuacucugggcagaagugagccccccccuuaaag

SEQ ID NO: 408507 - RNA, 64 nt, Human
cugggcacuccgcgccgaugccaccggccugugggucucugaagggacccccccccaaucggac

SEQ ID NO: 408508 - RNA, 64 nt, Human
agcaaacaccuuuccuccagcuccagaauuccuugucucugaaugacucugucuuguggguguc

SEQ ID NO: 408509 - RNA, 64 nt, Human
aaaggauuaaucauuuugacugcauacaaacuaugucucugacaugcacauacacugcuuuaua

SEQ ID NO: 408510 - RNA, 64 nt, Human
gugggggcgguggccaggacaacgggcuggagggucugggcaacgacagccgagacauguacau

SEQ ID NO: 408511 - RNA, 64 nt, Human
ucuguagccagacugccucucuagauuccuccucucugggcagcgcaucuuugaaaaaagugca

SEQ ID NO: 408512 - RNA, 64 nt, Human
cguuuaucaucucacaguuucugugagucaggggucugggcacugcuucaggagcucacaaggc

SEQ ID NO: 408513 - RNA, 64 nt, Human
acagguucugaauacaacaucaugguugccugagucugggcaucugugaagaagggucauggau

SEQ ID NO: 408514 - RNA, 64 nt, Human
acagguucugaauacaacaucaugguuaccugagucugggcaucugugaagaagggucauggau

SEQ ID NO: 408515 - RNA, 64 nt, Human
aagugucgcacaaaggagucgcccacuggaagguucugggcaggcgagaugcccagaggugauc

SEQ ID NO: 408516 - RNA, 64 nt, Human
uugcacugcccuacacuaccuaccaucuccauccucugggcaccuuuuuauaagaaccaaaaca

SEQ ID NO: 408517 - RNA, 64 nt, Human
ggaugcguugccugcagugcagacggccgugagcucugggcaaaccuaaacagagaccaguguc

SEQ ID NO: 408518 - RNA, 64 nt, Human
uuuauagcaacaguguuuuaugcaccugcuaugcucugggcauaagcugugccuauguauagug

SEQ ID NO: 408519 - RNA, 64 nt, Human
gaucgaccucagugccugagaccaccaacgggacucugggcauggcuggggccccuggacggcc

SEQ ID NO: 408520 - RNA, 64 nt, Human
aggggcuauucccugucucuguggguuucuaagcucugggcaaaguggugguagggggagggag

SEQ ID NO: 408521 - RNA, 64 nt, Human
ccccaugccagccauuguaagaguuccacagagcucugggcacuucuuugcaaagccauguuug

SEQ ID NO: 408522 - RNA, 64 nt, Human
gaaaccccaucucuaccaaaaauacaggaaauuaucugggcauaguagugugugccuguaaucc

SEQ ID NO: 408523 - RNA, 64 nt, Human
cuguucauucgagacuggccccgucugaaccuucucugggcacuggggacuaagguugcaggcc

SEQ ID NO: 408524 - RNA, 64 nt, Human
guguguucacuuccaguugaaguauccauguguuucugggcagcuuuucugcucagugugaucc

SEQ ID NO: 408525 - RNA, 64 nt, Human
cauucuaggguugggggcagggccauccacgguuucugggcagagccaugguggcaggagagag

SEQ ID NO: 408526 - RNA, 64 nt, Human
gugugugugugguugcacgggugugccucugugugucucugacccuggcugggugugugugcaa

SEQ ID NO: 408527 - RNA, 64 nt, Human
ggauugacaaacaacagagccuugaccacguggagucucugaaucagccuugucuggaaccaga

SEQ ID NO: 408528 - RNA, 64 nt, Human
auucugucucuccuucuucccccuggccuguucugucucugagcucuguguccuccguucauuc

SEQ ID NO: 408529 - RNA, 64 nt, Human
aggcagggcaggaaaucagaauagcauuugcuucucugggcaaaugggaaguucagcggggcag

SEQ ID NO: 408530 - RNA, 64 nt, Human
gaggaggggggauagggggagcagaccccugagaucugggcauaggcaccgcauucugaucugg

SEQ ID NO: 408531 - RNA, 64 nt, Human
uaucucccuggguagcagacggcugcugcccuucucugggcauguucugaauguuuacacuggu

SEQ ID NO: 408532 - RNA, 64 nt, Human
agggaaccaugccauugagacuaguaacgggcguucugggcacagucccacugugcacagguuu

SEQ ID NO: 408533 - RNA, 64 nt, Human
cccucugagaggaggccuagcagggcaggcucccucugggcaucccuggaugcagccucuggac

SEQ ID NO: 408534 - RNA, 64 nt, Human
aaaacaaacaaacaaacaaacaaaaacagaacauucugggcacgguggcucaugccuguagucc

SEQ ID NO: 408535 - RNA, 64 nt, Human
agacuuguuccuaguggaucaaugaaccaucucuucugggcaguuuuguugaaaauaaagguuu

SEQ ID NO: 408536 - RNA, 64 nt, Human
gucgggacaguugaugggcacauggccuuguagcucugggcacagauguguuuggauucauugc

SEQ ID NO: 408537 - RNA, 64 nt, Human
agggaccgggggaccauggccuguuccgggacacucugggcagggcccucgggacaucuccacc

SEQ ID NO: 408538 - RNA, 64 nt, Human
uucacgguccugagcaggggccaugggauugggcucugggcacugacucauggcaccucccuag

SEQ ID NO: 408539 - RNA, 64 nt, Human
uucaugguccugagcaggugccaugggauugggcucugggcacugacuuaacggcaccucccua

SEQ ID NO: 408540 - RNA, 64 nt, Human
ugcgccuucucauggcugacucaggccuggggcaucugggcauuguaggggugcagugguaugu

SEQ ID NO: 408541 - RNA, 64 nt, Human
uagauuggcagcaccaccccagggcagaggacucucugggcacccgcugugcauggagccagag

SEQ ID NO: 408542 - RNA, 64 nt, Human
cccagcaacaaucugagccaugagaacgaggggaucugggcaccccaggaaccgccauugccca

SEQ ID NO: 408543 - RNA, 64 nt, Human
gacauaacuaauuuuuccuugugcauuuaauaccucugggcagaauccaaauacuggguucucc

SEQ ID NO: 408544 - RNA, 64 nt, Human
gcgcaggagggugagcguuauuggucggcagccuucugggcagaccuugaccucgugggcuagg

SEQ ID NO: 408545 - RNA, 64 nt, Human
agggcugugaaggcucaugugaccuggaucugaggucucugauagaaaucuggacgccaccggg

SEQ ID NO: 408546 - RNA, 64 nt, Human
auuuauaauucuuuuuccuuguuugaguauuucugucucugaaauaaccuuuuacuuggcuuuu

SEQ ID NO: 408547 - RNA, 64 nt, Human
ccccuuccaaauaauaaagucuauggacagggcugucucugaaguacuaacacaaggacacucg

SEQ ID NO: 408548 - RNA, 64 nt, Human
accuugagugcuggugauuaccauucucaagcucucugggcacagagaccugcugucaaccccc

SEQ ID NO: 408549 - RNA, 64 nt, Human
uacuguuaacucuuaacagaugcagucagcaguuucugggcacuucucucaguaggugccucau

SEQ ID NO: 408550 - RNA, 64 nt, Human
cagugcuaacugcuaaggauacuguuuaucuuguucugggcauuggaguuucaguuuuuaaaaa

SEQ ID NO: 408551 - RNA, 64 nt, Human
gggcaagaggccuccuuggucaguguccaugcuuucugggcagggacuugguuuuuuguuccaa

SEQ ID NO: 408552 - RNA, 64 nt, Human
guguaagaaggcccugcauguguaugaguccuauucugggcaaauagauucuuaaaguggcuuu

SEQ ID NO: 408553 - RNA, 64 nt, Human
agugagccuuggucaugccacuacuguguucuagucugggcaacagagugagaccuucucucaa

SEQ ID NO: 408554 - RNA, 64 nt, Human
cccccacuccccgagagccaggggaaggaguggcucugggcagagagggacacauagcacuggg

SEQ ID NO: 408555 - RNA, 64 nt, Human
caauggaggcagggguuccagcacaaaguuuacuucugggcaauuuuuguauccaaggaaauaa

SEQ ID NO: 408556 - RNA, 64 nt, Human
cagcuguuuccacuggacauucucccuuugccucucugggcagcaacuccuaggccagccgacc

SEQ ID NO: 408557 - RNA, 64 nt, Human
ugccucuucacacaucugcuauuuccugugguguucugggcaugguguguaagacccacagagg

SEQ ID NO: 408558 - RNA, 64 nt, Human
accuccuuaucugcucuuccccucccugccgccuucugggcagguagcagucccuggccucucc

SEQ ID NO: 408559 - RNA, 64 nt, Human
ugaccccugaggaggcacagcgccuucugccaccucugggcacggccucaagguagugaggcua

SEQ ID NO: 408560 - RNA, 64 nt, Human
agcccugucccaccauagccacaggcagcagaagucugggcagaguucaucuucuugaccuuug

SEQ ID NO: 408561 - RNA, 64 nt, Human
caugcagggagcgccucccuauguugccugccacucugggcaccggccagcacccucuggugag

SEQ ID NO: 408562 - RNA, 64 nt, Human
auucacuucaguccaagucauaccuaggaagcugucugggcagcugcucgagggaggcccuggc

SEQ ID NO: 408563 - RNA, 64 nt, Human
ggaccucuuaaggcccaaggugggccccaggaccucugggcagaguggacugcucauggcagau

SEQ ID NO: 408564 - RNA, 64 nt, Human
uccugccagaaaggaccagugccgucacaucgcugucucugauuguccccggcaccagcaggcc

SEQ ID NO: 408565 - RNA, 64 nt, Human
ggcuagggguggauugggaggugaguggaggagagucucugaccagcugcagagccaaccccua

SEQ ID NO: 408566 - RNA, 64 nt, Human
cuuaagaggaaaaugaaaguguuccuggggugcugucucugaagaagcagaguuucauuaccug

SEQ ID NO: 408567 - RNA, 64 nt, Human
uccuccaucauggaggagaugggaucauggauuuucugggcauaaguggcuguucugggaguca

SEQ ID NO: 408568 - RNA, 64 nt, Human
caaaacccugucucuacuaaaaauacaaaaauuaucugggcaugguggugcaugccuguaaucc

SEQ ID NO: 408569 - RNA, 64 nt, Human; identical to SEQ ID NO: 408560

SEQ ID NO: 408570 - RNA, 64 nt, Human
gccacguaguggugccugggcccgacagcggggcucugggcaucccgggugaccuuggcccauc

SEQ ID NO: 408571 - RNA, 64 nt, Human
cccccaccaugggcugugggagaguugaccguauucugggcaagacuccaugaccccucugauu

SEQ ID NO: 408572 - RNA, 64 nt, Human
uuuguguacucaggauaaagacugauguuuacucucugggcacuguuguaagauagguuuuguc

SEQ ID NO: 408573 - RNA, 64 nt, Human
aauuguagagcauguguguuugaacaauaugaaaucugggcaccuugaaaaaagaacaggauaa

SEQ ID NO: 408574 - RNA, 64 nt, Human
cagcucuugaaagcaucuguuugagggaaaggucucugggcaagcaagugguuauuuggauugc

SEQ ID NO: 408575 - RNA, 64 nt, Human
gggcugaguucccacucaccuguguagagugccaucugggcaccauugcuccagacguguuccg

SEQ ID NO: 408576 - RNA, 64 nt, Human
caguuugccguugaugcguuuuucucauggaguuucugggcagaguggagcugcaacccuguug

SEQ ID NO: 408577 - RNA, 64 nt, Human
acauguguguacaugugcuugccauguguaggagucugggcacaagugucccugggccuaccuu

SEQ ID NO: 408578 - RNA, 64 nt, Human
uuagccaagcuccucaaccuucucccaggcccaaucugggcacuuccuuguaaaaucuaguuuu

SEQ ID NO: 408579 - RNA, 64 nt, Human
cgaggggagcuauccagagggucagugcugaaggucugggcagaagaccugcgagacccagaug

SEQ ID NO: 408580 - RNA, 64 nt, Human
aaauuacuuaauaauauuauuaaauaauaauaggucugggcaguauuguuuuuaaccugacuca

SEQ ID NO: 408581 - RNA, 64 nt, Human
uggccccacauuccucaacuaguauuauuugggcucugggcagcagcagggaucuggugguaug

SEQ ID NO: 408582 - RNA, 64 nt, Human
aggucuuucauuagaccgagacaucacuagaaauucugggcacugcuguuugugguauuugucu

SEQ ID NO: 408583 - RNA, 64 nt, Human
gagucagacagaugugguugcauccuaacuccaugucucugagcauuagauuucucauuugcca

SEQ ID NO: 408584 - RNA, 64 nt, Human
uacuuggcuauuuugauuagggaagagggauguggucucugaucucuguugucuucuugggucu

SEQ ID NO: 408585 - RNA, 64 nt, Human
ucaggaaugcccacgccuuucuuccaaagccuuugucucugagaccucuuaaguucuaagauua

SEQ ID NO: 408586 - RNA, 64 nt, Human
cuuauucuuucguucaguuaaguuuuucccuucaucugggcacugaagggauaugugaaacaau

SEQ ID NO: 408587 - RNA, 64 nt, Human
gcaaagagcagaaggugugaaaucacacucuuccucugggcauccuggaucccugaauuauccc

SEQ ID NO: 408588 - RNA, 64 nt, Human
uuagcaaaggugaaugccagauguaaauggcgccucugggcaaaggaggcuuguauuuugcaca

SEQ ID NO: 408589 - RNA, 64 nt, Human
uugagagcuuugggugcugaagggccaaacguuuucugggcauuuuuuggccaguuuuuaaugu

SEQ ID NO: 408590 - RNA, 64 nt, Human
augucucccuuucuuagaauauauuaaagucagagucucugaggaaggaaugugauuuggcagu

SEQ ID NO: 408591 - RNA, 64 nt, Human
uacugcuuuucuuucugcuucaaacacacaguucgucucugaggaaaguaaaauaaauggaaua

SEQ ID NO: 408592 - RNA, 64 nt, Human
cccugaguccacagccacccagcugagguccugggucucugagcaaaggagcaugcuugggcgu

SEQ ID NO: 408593 - RNA, 64 nt, Human
acaaaguuccucagggguuucauuuugcaggcaugucucugagcuucuauaccugcucaagguc

SEQ ID NO: 408594 - RNA, 64 nt, Human
ugaucaacggcgccaccuguguuugcugagacuggucucugagagaguuuuaugucgaucgagg

SEQ ID NO: 408595 - RNA, 64 nt, Human
caguuuggugucaacaugaaacaccaagaugucugucucugaagcgugauuuuaaaauccccau

SEQ ID NO: 408596 - RNA, 64 nt, Human
ggguuccacagcacagcagacauggaacgcugaagucucugaaagugaaguuguaaaaagaaaa

SEQ ID NO: 408597 - RNA, 64 nt, Human
auguucagaccucacaucuucuaagccgcccugugucucugaccccuucucauuugccuaguau

SEQ ID NO: 408598 - RNA, 64 nt, Human
ugugcuaugaagcuuucuuuccuacacacucugagucucugaaugaagcugaaggucuuaguac

SEQ ID NO: 408599 - RNA, 64 nt, Human
uuuuguaauaaauguggcuggagcugauccagcugucucugaccuacaguaucugucauuaucu

SEQ ID NO: 408600 - RNA, 64 nt, Human
auucuaauuuuugccacgugucacaacuuuuccagucucugagaaggucccagccuuucucaaa

SEQ ID NO: 408601 - RNA, 64 nt, Human
ugaauguauagacauuucucggguuccuaccuuugucucugauggaccauuuuccauuuaagac

SEQ ID NO: 408602 - RNA, 64 nt, Human
gugcuggucuccaggcugacaaggauucaaaguugucucugaaacuccucuuugucauacugca

SEQ ID NO: 408603 - RNA, 64 nt, Human
caugugguuggccagaaaucagaaguggggcugugucucugacuggcuagaggccaggccuugu

SEQ ID NO: 408604 - RNA, 63 nt, Human
gauguccccauauguacagaacugaauaaagugggucucugagaagucugaugugccuugaug

SEQ ID NO: 408605 - RNA, 64 nt, Human
gccugaaaagccugauucaaggagaucaggcugugucucugacuggagcagcuacacuccccau

SEQ ID NO: 408606 - RNA, 64 nt, Human
aauaggaaaucugaagaaccugcuguguuuagaugucucugaaaacagguuggaaagacuuccu

SEQ ID NO: 408607 - RNA, 64 nt, Human
ucgcuguggugcacuggagaacuugguaaaugaugucucugaugaagccuggaacgagcgugcu

SEQ ID NO: 408608 - RNA, 64 nt, Human
gcccuuccuggguuuuuuucuuguguucccuguggucucugacccauuaggcuaaagagagaca

SEQ ID NO: 408609 - RNA, 64 nt, Human
cucaugggcugugugaucucuucagggugggguggucucugauagguagcauuuuccagcacuu

SEQ ID NO: 408610 - RNA, 64 nt, Human
gaaggucaguaauuccgacuuucucagcaguggugucucugaauuacugcaaaggguaaaaaaa

SEQ ID NO: 408611 - RNA, 64 nt, Human
aaugccagaauauaaugugcaggcaaucguggaugucucugacaaagugugucucaaaaauaau

SEQ ID NO: 408612 - RNA, 64 nt, Human
agcugccagcuggauuccaaacagguaccacauugucucugagcuaauguuuauauuuuuccau

SEQ ID NO: 408613 - RNA, 64 nt, Human
acuggaaaagaucauugcugagaaagaggagcgugucucugaacugcgccaucaacuccagucu

SEQ ID NO: 408614 - RNA, 64 nt, Human
gugaggacugguugucucucuucgguggccuugagucucugaauuugucggguucucccaugau

SEQ ID NO: 408615 - RNA, 64 nt, Human
aggaguacaucugcccugccacaugacuccagaagucucugaccccauuuguuuuuaauggcau

SEQ ID NO: 408616 - RNA, 64 nt, Human
uggugguguuucuacggugucugguucugugcccgucucugagacagucucuguguggaauuug

SEQ ID NO: 408617 - RNA, 59 nt, Human
gcaucaucuuccucaucugaggaggccucgucucugaacuuggguugugccgagagagu

SEQ ID NO: 408618 - RNA, 64 nt, Human
uacuuaguuacugcguuuacaguucuuuggcccagucucugacccuucccaaguauuugugcaa

SEQ ID NO: 408619 - RNA, 64 nt, Human
auuuagaaacagguuccaacauuccucuucuuuugucucugaugcuagaacuaguuugguaacu

SEQ ID NO: 408620 - RNA, 64 nt, Human
aggcacuucaucugaagaauguuggugaaggcaagucucugaaagcagaacuauccaguguuau

SEQ ID NO: 408621 - RNA, 64 nt, Human
caucuguauuuguugguucugucauuugagcgaugucucugacuuguuuguuuugaauuacauu

SEQ ID NO: 408622 - RNA, 64 nt, Human
acggugcugcucuuguuccacccccacccagauggucucugagugcgccguccugggcagggca

SEQ ID NO: 408623 - RNA, 64 nt, Human
cauucuguaaaggugacauaaauacuucaaaaaugucucugacacagaaagaaaaaaaacaaaa

SEQ ID NO: 408624 - RNA, 64 nt, Human
ucugggcauguggacaggaggggcuugcggccgugucucugaccugugugaugugcaggagggu

SEQ ID NO: 408625 - RNA, 64 nt, Human
ucuuuccguugcugaaaaauauuugaaacuuguggucucugaagcucgguggcaccuggaauuu

SEQ ID NO: 408626 - RNA, 64 nt, Human
cauucgugugugguuuucuugaucggugagaucugucucugaagucacugccagccucccuggg

SEQ ID NO: 408627 - RNA, 64 nt, Human
cuagagaggggugaggaauggauacugucuaacagucucugauuucaacacuaacauuccaucu

SEQ ID NO: 408628 - RNA, 64 nt, Human
ugucuuccccuauuuucugucccagcucauccgugucucugaagaacaaauaugcuuuuggacc

SEQ ID NO: 408629 - RNA, 64 nt, Human
acauuucuccucugugcggccuccagcugagccugucucugaauuguucccucccccgcaaugu

SEQ ID NO: 408630 - RNA, 64 nt, Human
gaaauucaccauaauuauggugcaaggucagugugucucugagaucuaugucuguugguggcaa

SEQ ID NO: 408631 - RNA, 64 nt, Human
ugaauuuccuaccuaaauauuaaccauaugccuagucucugaaacuaaaaacuuggaccucauc

SEQ ID NO: 408632 - RNA, 64 nt, Human
gaucacuguugaagguguucauggcauaguuggagucucugacuguuuaaagaaaucacagaac

SEQ ID NO: 408633 - RNA, 64 nt, Human
gacggggcggaaaggcgcagagaagcugagggcggucucugaucuguguguggguugacauuuu

SEQ ID NO: 408634 - RNA, 64 nt, Human
auccuuaugguuuaggccuugccaguuuuccgaagucucugauuaguugacaguauuaacacua

SEQ ID NO: 408635 - RNA, 64 nt, Human
ucccuagaggcgacuucauugcuauggaucuggagucucugaacucuuaauaggaugcagccuc

SEQ ID NO: 408636 - RNA, 64 nt, Human
guagagacaggguuucaccauguuggccaggcuggucucugacuccugacuaaaagugaucugc

SEQ ID NO: 408637 - RNA, 64 nt, Human
uagaccuuaccucucaacucccucaagaguaccagucucugaaguuauaaugcuuuggucucua

SEQ ID NO: 408638 - RNA, 64 nt, Human
caagagcacguccagccgccucuggcucaaguucgucucugacggguccauuaacaaagcgggc

SEQ ID NO: 408639 - RNA, 64 nt, Human
ccgcuuccauaaaucaaagcaugacuaauagggggucucugaaauguaagggcacaaacuucac

SEQ ID NO: 408640 - RNA, 64 nt, Human
ucuuugaccuuguauacuagcuugacauagugcugucucugauuucuaggcuaguuacuugaga

SEQ ID NO: 408641 - RNA, 64 nt, Human
gaucacguguguugauggaaaccaucugugcuuagucucugacauaggaagcuugcuucaggca

SEQ ID NO: 408642 - RNA, 64 nt, Human
uuuuucauuauaauugguagccaucucaugaacugucucugacuguugucucuuuguggucaug

SEQ ID NO: 408643 - RNA, 64 nt, Human
gacauguuacuaugaaagacuuguauuuuuuauugucucugaacuuuaauccugugaaaaugcu

SEQ ID NO: 408644 - RNA, 64 nt, Human
acauacaucggccccaggauucuaacaucuccuggucucugagguuauaauuuucacuuaacau

SEQ ID NO: 408645 - RNA, 64 nt, Human
aguuccccagcuguaguuauguaucugccuucaagucucugacaaaugugcuguguuaguagag

SEQ ID NO: 408646 - RNA, 53 nt, Human
aucaaauuaacaucucuuaaacagucucugagaaguacuuuaccugaaagaca

SEQ ID NO: 408647 - RNA, 64 nt, Human
aaaaauuccaccaggauuaaucucuaaaauucuagucucugauuugcaaaugcacauuugucac

SEQ ID NO: 408648 - RNA, 64 nt, Human
gggaagggagggaugaaaggggacacaagucccugucucugaaguuucuuuaaaaucugaguuc

SEQ ID NO: 408649 - RNA, 64 nt, Human
agagcugggaaauuuguaucuccaaggcggcucugucucugaaauaaauggcaucaagugcaug

SEQ ID NO: 408650 - RNA, 64 nt, Human
cgagaccuagaaccgaaccucaucuccgaguugggucucugaagacgggggugaggugagguag

SEQ ID NO: 408651 - RNA, 64 nt, Human
gccgugaguuuugcuggcauaggugacagggugugucucugacagugguaaaucggguuuccag

SEQ ID NO: 408652 - RNA, 64 nt, Human
uuaaagaguuuguaaagucaauguguuuguuugugucucugagauugacuucaagauaauaagc

SEQ ID NO: 408653 - RNA, 64 nt, Human
agagagcaaguucuucugccagggucacacuguggucucugaacugaccaguauaucccuaacu

SEQ ID NO: 408654 - RNA, 64 nt, Human
gacugggcggcuugucccaggcuacugggcuguggucucugacccccuggaggccuccccacgc

SEQ ID NO: 408655 - RNA, 64 nt, Human
ucucugcucugguugaccugggcugguuuucccugucucugagaacuugagaccuagcuccgag

SEQ ID NO: 408656 - RNA, 64 nt, Human
uguaacaaggaacacuaaaacaguguugauucuugucucugaagacaaauaauuaaaccuuuuu

SEQ ID NO: 408657 - RNA, 64 nt, Human
cacacaccccugcucaacagagguuuaguuuacagucucugaacuaaaguaguaaccucccaaa

SEQ ID NO: 408658 - RNA, 64 nt, Human
ucgggcagaugaacacggaggcucucuguugucugucucugagaucuuugugucugggaaugcc

SEQ ID NO: 408659 - RNA, 64 nt, Human
gugacugacugugaaguggcuucuccguacgauugucucugaaacaucguggccucaggugcca

SEQ ID NO: 408660 - RNA, 64 nt, Human
cugagacgcugugugcccuuuuucaacuuccuuagucucugagcaucaggucuucaucucuaag

SEQ ID NO: 408661 - RNA, 64 nt, Human
ccgcagggcgcuccggcagaggcagggcccuggggucucugagcaguggggagcgggggcuaac

SEQ ID NO: 408662 - RNA, 64 nt, Human
cucgguccccuugaagaggcaacucucugaacccgucucugacuguuggagggaaggcaaaugc

SEQ ID NO: 408663 - RNA, 64 nt, Human
caggaaugaggaaagaagaaaacuggaguuuccagucucugaguucuaccugauguaacucuug

SEQ ID NO: 408664 - RNA, 64 nt, Human
gcgacuucacaaaaugcaaggugaacaccacuuugucucugagaacagacguuaccaauuaugg

SEQ ID NO: 408665 - RNA, 64 nt, Human
gcgaggaggaugacuggguccggucgccaggacugucucugaggcagaaacgccggcugggcgc

SEQ ID NO: 408666 - RNA, 64 nt, Human
ggcaggcuaguguagauaaguggucugaaaaggugucucugagccgagggcaugugagcugggg

SEQ ID NO: 408667 - RNA, 64 nt, Human
aaacuuuaaaauuuauauuaauuugcaaauguaugucucugaguaggacuuggaccuuuccuga

SEQ ID NO: 408668 - RNA, 64 nt, Human
ccgcggccugaucaugcccucugugcccacacaggucucugagcggccccugauguuccuguug

SEQ ID NO: 408669 - RNA, 64 nt, Human
gaacuugagcuuuaaacuugauuugaguuucagugucucugaauugaacaucccacguuggaag

SEQ ID NO: 408670 - RNA, 64 nt, Human
cuaacuucuuguuugcugaguaauuguuucuaaugucucugaacucaaagugaggugcuccaag

SEQ ID NO: 408671 - RNA, 64 nt, Human
agcuauguaaacugacaaggaugcuaaaauaaaagucucugaaguauuccaugccuuuuggacc

SEQ ID NO: 408672 - RNA, 64 nt, Human
gagcccugccugcucggacgccuuuccagccagugucucugacgucgggguuagugccuuagag

SEQ ID NO: 408673 - RNA, 64 nt, Human
aaauuuguuauuuugcaaccucgcuggacucucagucucugagcagugaaugauucaguguuaa

SEQ ID NO: 408674 - RNA, 64 nt, Human
ucgucuccuccaugguggucacugccccuggcaggucucugaaagggaaaugcuuuucugcaga

SEQ ID NO: 408675 - RNA, 64 nt, Human
guuuuuuuuuuuuuguuguuguuguuguuuuacggucucugagggaauauaguaaaaaugcaua

SEQ ID NO: 408676 - RNA, 64 nt, Human
uugagccaucuuccccaaagcagggaaaccacuggucucugacugccuuucccacagacacagc

SEQ ID NO: 408677 - RNA, 64 nt, Human
ggccgcuggcugccuuugucaaaacuaaggucuggucucugauccagcuggcgcgcagauaccu

SEQ ID NO: 408678 - RNA, 64 nt, Human
cugagagccauaaaugaccuaacguuucccguuagucucugaacuaggugaucucaguucucuu

SEQ ID NO: 408679 - RNA, 64 nt, Human
ccauuuuuaagggaagaguuauuuaauauaaauagucucugauuuuaaguucuguuuaauguuc

SEQ ID NO: 408680 - RNA, 64 nt, Human
cccaggcgcccucgcugcagccccgcccccgugggucucugacucugucgcuuuucucuaagua

SEQ ID NO: 408681 - RNA, 64 nt, Human
aaaugagcucugcucuaaaauuguugacauucaugucucugaguuacaaaagugcuaauucacu

SEQ ID NO: 408682 - RNA, 64 nt, Human
cugcugugcccgccaguccuugcccucccaccaggucucugagcucaguguuaccaaauucgcc

SEQ ID NO: 408683 - RNA, 64 nt, Human
aaagggggauugggggauccgggagggugggguugucucugacuugacauuaaaaaguguucca

SEQ ID NO: 408684 - RNA, 64 nt, Human
augauugcagcuguguccugaauuccugaagcacgucucugaaucuguccuccucuggacuaag

SEQ ID NO: 408685 - RNA, 64 nt, Human
cccagcucaccccacucccuucugccccuuuuuugucucugaaauuugcacuacgucuuggacg

SEQ ID NO: 408686 - RNA, 64 nt, Human
guggcuugagugaauguuaggccuugggggcugagucucugaaaagucuaagaagcucugccua

SEQ ID NO: 408687 - RNA, 64 nt, Human
gugaaauucuggucucagacaccaggagaccagagucucugaggaugaaguuuccuaccccuau

SEQ ID NO: 408688 - RNA, 64 nt, Human
uagaccuuccauucauuccgucucaucgugcguggucucugaucguccaucaccugaccuucuc

SEQ ID NO: 408689 - RNA, 64 nt, Human
agcaaguggggggcgugcagaugugccugugucugucucugagcaccugguguccguguacaag

SEQ ID NO: 408690 - RNA, 64 nt, Human
uuuuaauuuuuacacuggggcaauagacuaggaggucucugauuucuucuuggucuaaaguguu

SEQ ID NO: 408691 - RNA, 64 nt, Human
cccagcccugucugucuccaccccauccccucuugucucugagaaccauucucccaccccaagu

SEQ ID NO: 408692 - RNA, 64 nt, Human
aaguuccaccuucuauguuucuacucccucccuggucucugaaugccuucgccuguauaaagag

SEQ ID NO: 408693 - RNA, 64 nt, Human
cugauaauuaagguuuucauaauaccuagggccugucucugaguaauuuuaauuuugccaaaua

SEQ ID NO: 408694 - RNA, 64 nt, Human
cucucuucauauccuucaucagguguuuuaagaugucucugagaagccaucaaggcaaaagaga

SEQ ID NO: 408695 - RNA, 64 nt, Human
uucucaggggccaaggcuaggucugcaacccucugucucugacagauugggagccacaggugcc

SEQ ID NO: 408696 - RNA, 64 nt, Human
acaaggacccccggggcugcagccuccucuuucugucucugaucagagccgacaccagacguga

SEQ ID NO: 408697 - RNA, 64 nt, Human
cugaggccucuucucagcaugcugcaaaccuguggucucugauacuaacucccuccccaacccc

SEQ ID NO: 408698 - RNA, 64 nt, Human
gacuuccucgcccuccuccacccgagaugccagagucucugaagaagaagcuuggguuaacuca

SEQ ID NO: 408699 - RNA, 64 nt, Human
uauuuuuaauuuguuuuuuucuccaaguccaccagucucugaaauuagaacaguaggcgguaug

SEQ ID NO: 408700 - RNA, 64 nt, Human
cuccucuccauagcugggaaguuuauuuuguuuugucucugaagacagcaguuuuauugcauca

SEQ ID NO: 408701 - RNA, 64 nt, Human
aucacaacuucaggagacaucugaaaagaaugaugucucugaaagcuguccuuucagaugaggg

SEQ ID NO: 408702 - RNA, 64 nt, Human
aguuuguuucuuucuguucccccaaagcuuaucugucucugagccuugggcccuguagugacau

SEQ ID NO: 408703 - RNA, 64 nt, Human
uauaaaaugaugguauucuaagguccauccuuccgucucugacauuuugagaucuuuggaaagg

SEQ ID NO: 408704 - RNA, 64 nt, Human
ccuuauuuguuuuuuauguccccugccagggccugucucugacuaggugucaccauacacauuc

SEQ ID NO: 408705 - RNA, 64 nt, Human
acaggaaggagagcuaccuccuaaggguuuuaacgucucugacauacaggcacacugaccugau

SEQ ID NO: 408706 - RNA, 64 nt, Human
uuuuuaauuuuucuuuuguuauuuguauuugcuagucucugauuuccucaaaacgaaguggaau

SEQ ID NO: 408707 - RNA, 64 nt, Human
ggauaaauuuuguagcugguacacucuggccugggucucugaauucagccugucaccgauggcu

SEQ ID NO: 408708 - RNA, 64 nt, Human
uagguccuugaucuuuucuuuagauugaaagucugucucugaacacaauuauuuguaaaaguua

SEQ ID NO: 408709 - RNA, 64 nt, Human
ggggugcucucucugagggggugggggugccgcugucucugaggggugggggugccgcugucuc

SEQ ID NO: 408710 - RNA, 64 nt, Human
ggugccgcugucucugaggggugggggugccgcugucucugaggggugggggugccgcucucuc

SEQ ID NO: 408711 - RNA, 64 nt, Human
gggugcugcucucuccgagggguggaaugccgcugucucugaggggugggggugccgcucuaaa

SEQ ID NO: 408712 - RNA, 64 nt, Human
auauaauuuuaaaguagagauaauuuacugaagcgucucugacaaucuaacuuauuagacagca

SEQ ID NO: 408713 - RNA, 64 nt, Human
auauauggggaugguaguuuuuucaucuucaguugucucugaugcagcuuauacgaaauaauug

SEQ ID NO: 408714 - RNA, 64 nt, Human
accuucacugguuuugaacucagugccuaagaaagucucugaaauguucguuuuuaggcaauau

SEQ ID NO: 408715 - RNA, 64 nt, Human
agagccagcuuguggcaagcaguugggguggggggucucugacuugcucaggacaaacuaggcc

SEQ ID NO: 408716 - RNA, 64 nt, Human
guagaagaaauugucuacaggagccaaggugaaagucucugaugacggcggaacuggcuccauu

SEQ ID NO: 408717 - RNA, 64 nt, Human
ccauuaagaagauaaauccaguuaucagcuuccugucucugaaguuuggaucauuuuauagauc

SEQ ID NO: 408718 - RNA, 64 nt, Human
aauaauauauugaaugccuuuugauuuagccagagucucugaugauuagcuuucacugauagag

SEQ ID NO: 408719 - RNA, 64 nt, Human
uguagggagugugauuuuguuggaggugcacauggucucugaauuugacagagaacaccuuccc

SEQ ID NO: 408720 - RNA, 64 nt, Human
ucucuuggggucgcuggaggugauccuaggaucugucucugagaccaaugugcuguuucagccc

SEQ ID NO: 408721 - RNA, 64 nt, Human
ucagcgccucaaggguagggucugcgugugauuugucucugagcccccugugcccacccagggc

SEQ ID NO: 408722 - RNA, 64 nt, Human
aauaaauuuauguagugaguaaaguugcucucuagucucugaaaagcaaaaaaagugagaaaau

SEQ ID NO: 408723 - RNA, 64 nt, Human
uacuuuucuugucccuguggggucuuacagaugugucucugaguaguaaaggcuuagccuuguu

SEQ ID NO: 408724 - RNA, 64 nt, Human
uccauggcucuuagccagaaaugucuugccucuggucucugaaaagcuggggugagugguuacc

SEQ ID NO: 408725 - RNA, 64 nt, Human
auugugcuccugcccugcaggcuggcucccgggggucucugauggccaaccaaggggccaccca

SEQ ID NO: 408726 - RNA, 64 nt, Human
uccauuccugguuucuguagcuugcauucuuguugucucugaugcaugcccugccaguuaguac

SEQ ID NO: 408727 - RNA, 64 nt, Human
caggcacacagcagccccccagcacuaaggccgugucucugaggacgucaucggaggcugggcc

SEQ ID NO: 408728 - RNA, 64 nt, Human
uuuuuuccuaaauggaaaaugggaaggagauacugucucugaacaaaaauagcuggaaaaacac

SEQ ID NO: 408729 - RNA, 64 nt, Human
ugagaacugcuuuuuacacauuuaauaaaaaaaggucucugaauuaucugaugucauuuaucaa

SEQ ID NO: 408730 - RNA, 64 nt, Human
aacauuuaccuguauuguaaguacccacaucugugucucugaaguccuuugaaacaucucauua

SEQ ID NO: 408731 - RNA, 64 nt, Human
ugaagaucauaagaaauccuuuaagaguuuaaaugucucugaaacaggcauacaggcucuaguc

SEQ ID NO: 408732 - RNA, 64 nt, Human
accuguuguccacagucuucaggcagcuccccaggucucugaaccccagagugucaucauugga

SEQ ID NO: 408733 - RNA, 64 nt, Human
aaucauaccucagcucaugucagagugcgaauaugucucugagaagcuagagguacguggguug

SEQ ID NO: 408734 - RNA, 64 nt, Human
cuccuuugauugugaaguagccccaaaugaugucgucucugaagugggaauauuuuacagaaua

SEQ ID NO: 408735 - RNA, 64 nt, Human
aaacuucacuguguguuuucuaucucggaucccagucucugaagacaacuugcuuugauucaac

SEQ ID NO: 408736 - RNA, 64 nt, Human
cagggcucugggugacucaguaaaacuaacguuugucucugacaagaucagcuguaggcucacc

SEQ ID NO: 408737 - RNA, 64 nt, Human
aaaggaguucugucugcaugagaaaggauggcaagucucugaggugaccucaggguggaauucu

SEQ ID NO: 408738 - RNA, 64 nt, Human
ugggggcugcagggguuucccuggcgcagcgaaagucucugagcacuuaccgggcgugaccguu

SEQ ID NO: 408739 - RNA, 64 nt, Human
gagccuauggucucaacugugcuugaaaaacacugucucugaaaacaacuuugugauucucccu

SEQ ID NO: 408740 - RNA, 64 nt, Human
gcccagcacagccuugggggaaguguacagagaugucucugagguugcauggcaugguccuugu

SEQ ID NO: 408741 - RNA, 64 nt, Human
uuguggggacucaggcagcagaggcaucugggaagucucugaguaggcaggguccuccugggag

SEQ ID NO: 408742 - RNA, 64 nt, Human
ggugccuccaggaggugagcccugggugcagcuggucucugaaugacguuacacccucaccuuc

SEQ ID NO: 408743 - RNA, 64 nt, Human
ccccccaccccuaggacuuauucccgcugacugagucucugaggggcuaccaggaaagcgccuc

SEQ ID NO: 408744 - RNA, 64 nt, Human
ucgcaccuccuuguccucacccaguuccugcagugucucugacccacgccucccgccuccuggc

SEQ ID NO: 408745 - RNA, 64 nt, Human
uuauuuuguguaaacuauauucugcuuauagagagucucugagacuaaaauugacaacuugaaa

SEQ ID NO: 408746 - RNA, 64 nt, Human
uggucacuguuuuucucucuugccaaaugaggcagucucugagugacggugacuguggccuuga

SEQ ID NO: 408747 - RNA, 64 nt, Human
ccaggccagggugugaacuuucucccaugguuuagucucugacgcggcacugggccggaaguuc

SEQ ID NO: 408748 - RNA, 64 nt, Human
agugaggaacaggguugccucuuggcuggguggagucucugaaauguuagaagaagcgcugaag

SEQ ID NO: 408749 - RNA, 64 nt, Human
ggugcuggcugggauggcgguucugcccaguggugucucugagcgcgggaugacaggagcaacc

SEQ ID NO: 408750 - RNA, 64 nt, Human
cgaccauacugaugacuguuuugaauguuccuuugucucugacaugauccauagugaaauugcc

SEQ ID NO: 408751 - RNA, 64 nt, Human
cccaguuaaucagcaaccugacucaggccagugugucucugaaacggauccagcaauuccugag

SEQ ID NO: 408752 - RNA, 64 nt, Human
ucuccauacuguaguccuauugagaagacauuucgucucugagaaaaaaggauggaacuauggg

SEQ ID NO: 408753 - RNA, 64 nt, Human
aaaauuuguguaaauuuguauccacacaaauucagucucugaauacacaguauucagagucucu

SEQ ID NO: 408754 - RNA, 64 nt, Human
cacaaauucagucucugaauacacaguauucagagucucugauacacaguaauugugacaauag

SEQ ID NO: 408755 - RNA, 64 nt, Human
cccuccccgaaaaaggguguuuugaugccucagggucucugaaaucucccgggaagccccagag

SEQ ID NO: 408756 - RNA, 64 nt, Human
uauguaugugcuaggcagucuggggacccccugugucucugaccaccccccugacccccgccau

SEQ ID NO: 408757 - RNA, 64 nt, Human
ccacugccuccucccugcucuccugugcaggaaugucucugagcuguucacguugaugcuucuu

SEQ ID NO: 408758 - RNA, 64 nt, Human
uauaaaaucauguaccaagaaguuccugccuuuugucucugagccugauguguguaggggugau

SEQ ID NO: 408759 - RNA, 64 nt, Human
cccuccugacuugccuuauuuauuuguucgacgcgucucugaauguauccgccucgguucccac

SEQ ID NO: 408760 - RNA, 64 nt, Human
caggcccagaagacagacccacagcccugcccuugucucugaggcugaagacccccugacuccc

SEQ ID NO: 408761 - RNA, 64 nt, Human
ccccuccucugaauaggggagauguuuuguuggugucucugaggggacccccaugaggcugcuu

SEQ ID NO: 408762 - RNA, 64 nt, Human
ugcugaugguagcuggcuuuugaaauccuauggggucucugaaugaaaacauucuccagcugcu

SEQ ID NO: 408763 - RNA, 64 nt, Human
agcuucccccagugaaggcuccacaggcugcacagucucugauaaugaagggcugccuucccga

SEQ ID NO: 408764 - RNA, 64 nt, Human
uuuguuagaugggggcccacucuuccuuagcucugucucugaguuacuggguggaaauaagcuu

SEQ ID NO: 408765 - RNA, 64 nt, Human
cggaccuacuuaaguuguucacuuuacuugccuggucucugaaggcauuugaguuugccucuuc

SEQ ID NO: 408766 - RNA, 64 nt, Human
caguuugcuuauuuucaauugccuaggucacagugucucugaacuguucaucccuugaccaccu

SEQ ID NO: 408767 - RNA, 64 nt, Human
ugggaccucuccggauggggaguccuuggccagggucucugacucugugucaccugacauuugc

SEQ ID NO: 408768 - RNA, 64 nt, Human
cuguggaauucuguuuguuaaaucaaauuagcuggucucugaauuaagggggagacgaccuucu

SEQ ID NO: 408769 - RNA, 64 nt, Human
gguguggcguaaggccucacucccggcugggaaggucucugaucacacagaagcagcccugccc

SEQ ID NO: 408770 - RNA, 64 nt, Human
aucuuuaauauauggacuauuccuauaaaccaaagucucugacaagugcaccuaauuuauauug

SEQ ID NO: 408771 - RNA, 64 nt, Human
uggagcugcucagggugcccucuccugcggaccagucucugaauguucaaagaugagggccugg

SEQ ID NO: 408772 - RNA, 64 nt, Human
agaguuguugaaaguugacaagcagacugcgcaugucucugaugcuuuguaucauucuugagca

SEQ ID NO: 408773 - RNA, 64 nt, Human
acagagaauuuuuauuuuguaauagaagugaacugucucugaagggugaaggcaggccguccug

SEQ ID NO: 408774 - RNA, 64 nt, Human
caagagcguucgugcagugcccugagccacggccgucucugauucucccuuuaugaagcugcag

SEQ ID NO: 408775 - RNA, 64 nt, Human
gaacuacugcuuuagaaugaagucguauaauaaagucucugaaaaggccuuauucagaauaagc

SEQ ID NO: 408776 - RNA, 64 nt, Human
ucauauaucucuccagagaacucaccugacaaaugucucugagcacaggcugacaccaaagugg

SEQ ID NO: 408777 - RNA, 64 nt, Human
ccuugugcuucugugagagaauuauugauggugggucucugacaucuuugugaaguuugggaag

SEQ ID NO: 408778 - RNA, 64 nt, Human
aagcaugcaugaagagaugaguguguucuaauaagucucugaaagccaguggcuuuaugacuuu

SEQ ID NO: 408779 - RNA, 64 nt, Human
gaacuaacacaguuauuccuauacuggauuuuaggucucugaagaacugcugguguuuaggaau

SEQ ID NO: 408780 - RNA, 64 nt, Human
gggaugaagacuucauugggcaugaaugagucaagucucugaagcgguggccacuucuuggaca

SEQ ID NO: 408781 - RNA, 64 nt, Human
ugucaaggccacccccaccccagaacagaaccgugucucugauaaagguuuugaagugaauaaa

SEQ ID NO: 408782 - RNA, 64 nt, Human
uugucagucgugugauuugcaagucuucuuccuagucucugaaguuucuuucuuucauagagca

SEQ ID NO: 408783 - RNA, 64 nt, Human
acaaacaaaaaaagaggcagggguugcaauccuagucucugauaaaacagaauuuaaaccaaca

SEQ ID NO: 408784 - RNA, 64 nt, Human
gauuggucgcuacacccuggacaagugacugcccgucucugagccuugauuuccucagcugcca

SEQ ID NO: 408785 - RNA, 64 nt, Human
guauaauuucguccucuccuucggaacacuggcugucucugaagacuucucgcucaguuucagu

SEQ ID NO: 408786 - RNA, 64 nt, Human
auagaaaauaaggaacaaagagaaacuuguaauggucucugaaaaggaauugagaaguaauucc

SEQ ID NO: 408787 - RNA, 64 nt, Human
aauucugguuucgcgugauccugccugcguccgugucucugauuccgccggcggcaaaaaaaaa

SEQ ID NO: 408788 - RNA, 64 nt, Human
uggagaaaggccuuagggugacagguuauguacugucucugaaucaauaugaccucacuuaaaa

SEQ ID NO: 408789 - RNA, 64 nt, Human
guagugccugacccaaagccuggcccugcacacugucucugacucacagcaaucaucagcaccu

SEQ ID NO: 408790 - RNA, 64 nt, Human
cguccugaggauggaguggggucccauggugcaggucucugagcaaggcggagguguggaggag

SEQ ID NO: 408791 - RNA, 64 nt, Human
guucaguacuaaccugggcaacaaagaggccccugucucugauaaaaagaaaaaaaaugaaaaa

SEQ ID NO: 408792 - RNA, 64 nt, Human
aaggcggcgccucuuucucagguccugcaggcuggucucugagccugcccccacgaacuuucug

SEQ ID NO: 408793 - RNA, 64 nt, Human
agaaagggaggugaguggguggaggcagggugacgucucugaacccaaaacccugacggccucu

SEQ ID NO: 408794 - RNA, 64 nt, Human
agugcagguuaugagauccuugggguccacccuagucucugacaccugggacaggggugcuuuu

SEQ ID NO: 408795 - RNA, 64 nt, Human
gagguacagguuggguucucugccuaccauugcugucucugacuuccagagcucaacccccucc

SEQ ID NO: 408796 - RNA, 64 nt, Human
aagccaaaacccauugugacugccugucucuccugucucugacuucucaggcagccuccugagu

SEQ ID NO: 408797 - RNA, 64 nt, Human
uguucccacagugaccccagagcccugggcuauagucucugaccccuccaaggaaagaccaccu

SEQ ID NO: 408798 - RNA, 64 nt, Human
uaaaucccaguucugucaauuugagcuguuuacugucucugagccuacaucuucuugucuguaa

SEQ ID NO: 408799 - RNA, 64 nt, Human
aagaauuucacacauuuagccaaucuuucuagaugucucugaagguaagaucauuuaauaucuu

SEQ ID NO: 408800 - RNA, 64 nt, Human
cauauggguuuagguugguuuuuugaugucauaugucucugauggggcugcaagugcuaccucg

SEQ ID NO: 408801 - RNA, 64 nt, Human
aggauguggacauuuugguugcagcuaaaaaucagucucugaagucucucucccuucuagaggu

SEQ ID NO: 408802 - RNA, 64 nt, Human
gugcuggcugggccaugcuugugaagugaugugugucucugauuuaacggauucacuguuuucu

SEQ ID NO: 408803 - RNA, 64 nt, Human
gaaggggaaugugggacaggggcgauggugccuggucucugaguaagaugccaggucccaggaa

SEQ ID NO: 408804 - RNA, 64 nt, Human
ccucugcacagcccuucugggugguccucaccaggucucugagcugggugggaggccauccugg

SEQ ID NO: 408805 - RNA, 64 nt, Human
aggguguuucugguuuugccuuagcaaugcaucggucucugaggugacacucuggagugguuga

SEQ ID NO: 408806 - RNA, 64 nt, Human
cagaauauuagaaguuacaagacugauuuaaaccgucucugauuuaaugcaagauauauugugu

SEQ ID NO: 408807 - RNA, 64 nt, Human
uuuggguucaauuccuucaauuuuuaaaaaacuggucucugagaguuuuuuaaaucauugagag

SEQ ID NO: 408808 - RNA, 64 nt, Human
caccccugagcgcccagcucccuaccuccuggacgucucugagaguccaggcagagcagagggc

SEQ ID NO: 408809 - RNA, 64 nt, Human
ggauguguccagaagcuuuaccauccacaccccagucucugaugcuuuugacauguuuucaccu

SEQ ID NO: 408810 - RNA, 64 nt, Human
cguccuacagaauuucucuaacuuaacauguugagucucugagagugcaaaacuugaaacaaga

SEQ ID NO: 408811 - RNA, 64 nt, Human
cguaagccucugcaauuuuaacuucucaaaggaugucucugaaaagaaucacuuuaaaccaaug

SEQ ID NO: 408812 - RNA, 64 nt, Human
aacccuugccagucuguuuaucccuccagauacagucucugauaguaaacuuuucuuucucuua

SEQ ID NO: 408813 - RNA, 64 nt, Human
gcugguucuguuuucuaaaggagcagaaggacaggucucugagacaggaucguugucccuacag

SEQ ID NO: 408814 - RNA, 64 nt, Human
cucaguccaggcaaagcccagagcaucugagcacgucucugacuuccaguggcaacacaguuug

SEQ ID NO: 408815 - RNA, 64 nt, Human
gaggucauccgcugagcaucccuucugcacagaugucucugauucuuguccuugcagguggagg

SEQ ID NO: 408816 - RNA, 64 nt, Human
cuuuucuccuccauggcugucugccugcguaucugucucugagaauccucggggcggucagggg

SEQ ID NO: 408817 - RNA, 64 nt, Human
cugagcccacgguccccucagcagggaugcgauggucucugaaucagugugcagcugggguccc

SEQ ID NO: 408818 - RNA, 64 nt, Human
ucaguuuuuaucaggcuuucucugggggacagcagucucugagcaccagggagcaguugcccuc

SEQ ID NO: 408819 - RNA, 64 nt, Human
cccucauacauugcuuucucucccucuccugcgugucucugacaucucucacuuccuuuuagau

SEQ ID NO: 408820 - RNA, 64 nt, Human
cgucucaauuuaaaacaagagagaaccagacugagucucugaagaccacagggacagggucucu

SEQ ID NO: 408821 - RNA, 64 nt, Human
agccauuuccauggugcccagcugaggaccaggugucucugagaauccaaacauccuggagagu

SEQ ID NO: 408822 - RNA, 64 nt, Human
cuuccaguguaauucagaaucauuggccuagaaagucucugauauuuggaggggaacaaaaauc

SEQ ID NO: 408823 - RNA, 64 nt, Human
caugcagucuuggucaaggcaacuuuggcuggcagucucugagaugacccugaaugauccccac

SEQ ID NO: 408824 - RNA, 64 nt, Human
gacagggagcucucauagauacuaguugaaaaaagucucugaacaauucucucuaauacauauu

SEQ ID NO: 408825 - RNA, 64 nt, Human
cugcauuccagccugggugacagagugagauccugucucugaagaaaaaaaaaaccugccuggc

SEQ ID NO: 408826 - RNA, 64 nt, Human
uuauucaaauuuuacacaaggacuaauccugggugucucugagacccaucuccugccuagacau

SEQ ID NO: 408827 - RNA, 64 nt, Human
aagaaauuuguacuaccuaaaagucccagugcaugucucugaauguguaagcuauauaaaugcu

SEQ ID NO: 408828 - RNA, 64 nt, Human
cuaaauaagugguagaagagugucacugaauuuugucucugaauucaguauaacugaguuuugu

SEQ ID NO: 408829 - RNA, 64 nt, Human
ucgcuuuuauagauuuacucagucuuuaaaauucgucucugauuugccagagaaaaacgguggu

SEQ ID NO: 408830 - RNA, 64 nt, Human
gacugauuacucagagcagaugaggaaaacuguagucucugaguccuuugcuaaucgcaacucu

SEQ ID NO: 408831 - RNA, 64 nt, Human
aucagcuucuuacacuacuauauuugcuuauuuugucucugaauaagcuuuaggcaccacaagg

SEQ ID NO: 408832 - RNA, 64 nt, Human
uguagugagaagcuguugucacgacuaaccuucugucucugaaauuguuuguuucaaauaaaga

SEQ ID NO: 408833 - RNA, 64 nt, Human
aaucauucauacugcuuucauagguguuaugauagucucugauuaaucaaucuaguaugaauua

SEQ ID NO: 408834 - RNA, 64 nt, Human
ugcacuccaaccuagguaacagagagacaccucugucucugaaaaaacaaaacuugaaguuuga

SEQ ID NO: 408835 - RNA, 64 nt, Human
guaugccacgcccuuugaggacucgaagaucauggucucugacuuuggacucuccaaaauccag

SEQ ID NO: 408836 - RNA, 64 nt, Human
aagaggcgcggggccacacccgugaaccaugcagacggccgaagaagucuuaggcagggcgccc

SEQ ID NO: 408837 - RNA, 64 nt, Human
aggccagcacaccuaacccauggauguggaaccuacggccgagaaggaauguugcaugagucgg

SEQ ID NO: 408838 - RNA, 64 nt, Human
gaaaacauuaguggccgcugccccagcuacagagacggccgaaaugcuuucacuccuuagcuuu

SEQ ID NO: 408839 - RNA, 64 nt, Human
ggaagcuccacauguccauggaaguuugugauguacggccgacccuacaggcaguuaacaugca

SEQ ID NO: 408840 - RNA, 61 nt, Human; identical to SEQ ID NO: 149671

SEQ ID NO: 408841 - RNA, 64 nt, Human
agagaccccgggugggugagcgcuggcuucucaaacggccgaaguugccucuuuuaggaaucuc

SEQ ID NO: 408842 - RNA, 64 nt, Human
augcacugccccucccacccggccccgcccaggcacggccgaccccgccccgggcaccgcccac

SEQ ID NO: 408843 - RNA, 64 nt, Human
uggagccgccuccacgcugugcucccucccaacaacggccgagccugcaccgacaacccccugg

SEQ ID NO: 408844 - RNA, 64 nt, Human
cuaccauuucacaaaguuggagaucugcaaccucacggccgaugcucugcagucugacaagcuu

SEQ ID NO: 408845 - RNA, 64 nt, Human
uggggggagccauccagaccgaacagcgcccuccacggccgagucccccgccgcuggaccuggu

SEQ ID NO: 408846 - RNA, 64 nt, Human
cagcccggggacggccgugcuccgucccucgccaacggccgagcuugugauucugagcuugcaa

SEQ ID NO: 408847 - RNA, 64 nt, Human
ggccaccagcggcccucggagguacccaggccccacggccgagccucuggccggagaucggccg

SEQ ID NO: 408848 - RNA, 64 nt, Human
gcugaacuuugccgucuuguaagggugggggcugacggccgacccugggaggaggugacaucgc

SEQ ID NO: 408849 - RNA, 64 nt, Human
gccgcccccagcagcacagaccccgccgccuccuacggccgacucuggguucccuucagguguu

SEQ ID NO: 408850 - RNA, 64 nt, Human
auccgggauuguuuccccaaguuguuacgccuggacggccgagaguuauccgcaccagugauug

SEQ ID NO: 408851 - RNA, 64 nt, Human
uugugcccuuaaaagcauuacuuuaacugguagggaacgccagaaacuuuucaguccagcuauu

SEQ ID NO: 408852 - RNA, 64 nt, Human
ugcagcacggugguuuuacaauguuccagagcaggaacgccagguugacaagcuaugguaggau

SEQ ID NO: 408853 - RNA, 64 nt, Human
ugggccuggacacagaugaccucuacgggagucugaacgccaagauuuagucucaggauuaacc

SEQ ID NO: 408854 - RNA, 64 nt, Human
aauuuccaggggaccucaggucuaccucaggacugaacgccacaccucaggauuccuccuccuu

SEQ ID NO: 408855 - RNA, 64 nt, Human
cuguucuuuccgagucuuaaucuucagaaacagugaacgccaaaaagaacucaagauauucugg

SEQ ID NO: 408856 - RNA, 64 nt, Human
aaaggaucccccgugacggcucugccccacuugugaacgccaacccucagugcuuagccugcuu

SEQ ID NO: 408857 - RNA, 64 nt, Human
cauuuauauucuuuccauuugcuaucaugucagugaacgccaggagugcuuucuuugcaacuug

SEQ ID NO: 408858 - RNA, 64 nt, Human
gccccccacccccagcucaggggaccuuuugucugaacgccagagcuacugaccaggucggggg

SEQ ID NO: 408859 - RNA, 64 nt, Human
ggcacugucacugcccaccuccuugggccuccuggaacgccagggccucggcggcugcugaagg

SEQ ID NO: 408860 - RNA, 64 nt, Human
ccccggguucuagcugcccuucucuccuguaggagaacgccaagaacgaagagauucugaauuc

SEQ ID NO: 408861 - RNA, 64 nt, Human
aggaaagccagcuccccuucuccucuaacuauuggaacgccagaaagucagagaaagccuucca

SEQ ID NO: 408862 - RNA, 64 nt, Human
acacgagggaagucaguaaaaacuacgagcaggcgaacgccacccucaguaaguggcccgaggc

SEQ ID NO: 408863 - RNA, 64 nt, Human
cucagaugaccguggccucccucucagagggggagaacgccagagcccuggcuggugaugugcu

SEQ ID NO: 408864 - RNA, 64 nt, Human
gugaaucccaaugagggucccucucagagcgggagaacgccagagcccuggauggugaugcgcu

SEQ ID NO: 408865 - RNA, 64 nt, Human
gugaaucccaaugagggucccucucagaaagggagaacgccagagcccuggcuggugacaugcu

SEQ ID NO: 408866 - RNA, 64 nt, Human
uuuccucuccucucuggaagguuuugcuucuuacgaacgccacggccguguucacuucuaaacu

SEQ ID NO: 408867 - RNA, 64 nt, Human
uucuguagguuaaaugcagguauuuuaacugugugaacgccaaacuaaaguuuacagucuuucu

SEQ ID NO: 408868 - RNA, 64 nt, Human
uaauccaguccauuuucugacacaauauuaaacagaacgccaguugcauuuacuuuggugauuu

SEQ ID NO: 408869 - RNA, 64 nt, Human
uccugaagccccgggaggagaggaaggcagcggcgaacgccaggcucugggcuccggcgacugg

SEQ ID NO: 408870 - RNA, 64 nt, Human
uaacagcucugcuggacacccaagaaagccaugggaacgccaacuggaaagguccccuucccca

SEQ ID NO: 408871 - RNA, 64 nt, Human
auacgcuccucuauucuucccuucauccucauuugaacgccagguaucuccccuccucucucuc

SEQ ID NO: 408872 - RNA, 64 nt, Human
gaaccaggccucugcucuggcccucuugcaucuggaacgccagguggguuuuucuggcauagga

SEQ ID NO: 408873 - RNA, 64 nt, Human
agccacuuucugaguguuguccuggggcucuuuggaacgccaucuuccucccacuuaccugccu

SEQ ID NO: 408874 - RNA, 64 nt, Human
cuguccucacuccuguccugugcuggcuuuucuggaacgccaggcgcccauggcuggcaccuuu

SEQ ID NO: 408875 - RNA, 64 nt, Human
uagagauuugagaauuguuaaauguucagcaggagaacgccaccgccuagugugaaugcuaggu

SEQ ID NO: 408876 - RNA, 64 nt, Human
ccugcuggccuuagcagggagacaggggagcaaagaacgccaagccggaggcccgaggccagcc

SEQ ID NO: 408877 - RNA, 64 nt, Human
cucccaggccccaggggagaaagaggaguagcaugaacgccaaggaauguacguugagaaucac

SEQ ID NO: 408878 - RNA, 64 nt, Human
uaacguucugcuguccaagagaaugucaugcugggaacgccaucaucggugguguuagcuucac

SEQ ID NO: 408879 - RNA, 64 nt, Human
aucagaggagagacgguguugggagcccuuuggagaacgccagucucccaggcccccugcaucu

SEQ ID NO: 408880 - RNA, 64 nt, Human
augcccuggaggaacucuguagcugugcaucauggaacgccacaggauuuuuacauuaaaaagu

SEQ ID NO: 408881 - RNA, 64 nt, Human
ccccuccuggcagucaggcugcguccccuuuaaagaacgccaccgcugagaacugacccucaca

SEQ ID NO: 408882 - RNA, 64 nt, Human
auggaccuucugggacaagcugagcaagcuguaugaacgccacguuugugaagagcugagggua

SEQ ID NO: 408883 - RNA, 64 nt, Human
guaucgagcauccugacccacugccccugccugagaacgccaucucggcucccgggcacagcug

SEQ ID NO: 408884 - RNA, 64 nt, Human
gggagcacguccaggcguggugcauccuggggcagaacgccauggcuccuccccgcucucuugg

SEQ ID NO: 408885 - RNA, 64 nt, Human
cauucacauugaguguggcucauuuucuuuccccgaacgccaugacuguucagaagcacaauac

SEQ ID NO: 408886 - RNA, 64 nt, Human
cuuuuagcacuauccugaggagcgacaugugguugaacgccauggacgggacacaagcggacca

SEQ ID NO: 408887 - RNA, 64 nt, Human
gcagaucuccuggcguguccaccauggccccgcagaacgccagggaccgccugcugccaagggc

SEQ ID NO: 408888 - RNA, 64 nt, Human
ugagaucagagcugggguggaagggagccauucugaacgccacgccuggcccggucagugcugc

SEQ ID NO: 408889 - RNA, 64 nt, Human
guggcacugagcuaugagucccggggauggugaggaacgccacagacagagccacccuaggagu

SEQ ID NO: 408890 - RNA, 64 nt, Human
ccugauuuccuccaaucucuguagccccagaagugaacgccagacaggaacacgcaugugugua

SEQ ID NO: 408891 - RNA, 64 nt, Human
auuggacagcaucuacccaacccaguguccacgugaacgccauucaaccgaacauucuucccaa

SEQ ID NO: 408892 - RNA, 64 nt, Human
ugcauguauccccgcaccccagaacugggcuccugaacgccaggaaccuggggucuggggggga

SEQ ID NO: 408893 - RNA, 64 nt, Human
guccucagaacagaugagcucaggguaggguagagaacgccacuuucucagaccuguccccuuu

SEQ ID NO: 408894 - RNA, 64 nt, Human
gagggaaaagugaggugggacuuggaaaggcuuugaacgccaggcugaugguugagggauggug

SEQ ID NO: 408895 - RNA, 64 nt, Human
aggcaggccaacauucagauucaggaaauacagagaacgccacaaagauacuccuugagaagag

SEQ ID NO: 408896 - RNA, 64 nt, Human
agaagcugugaguuucagaacagcugucugcagggaacgccaccauguugacccucuggaggag

SEQ ID NO: 408897 - RNA, 64 nt, Human
gugaggguuaagcaacauggugcaucuguggauagaacgccacccagccgcccggagcagggac

SEQ ID NO: 408898 - RNA, 64 nt, Human
ggaauuacuuuuuguuguuuuugccaccguggagagcaacuauuuggagugcacagccuauuga

SEQ ID NO: 408899 - RNA, 64 nt, Human
uauuauaaagacuguauuucccauagacguuuacagcaacuauguuuaaaaaacaaaaacaaaa

SEQ ID NO: 408900 - RNA, 54 nt, Human
caguuccaggauauaauugaagucagcaacuaagucuuccuucaaaguugugau

SEQ ID NO: 408901 - RNA, 64 nt, Human
aucagagcauucugugcccagggacaggacagaucucgaggacaccacaguccaccuguucccg

SEQ ID NO: 408902 - RNA, 64 nt, Human
cacaccucugggaaaagauuacacuguauuaacucucgaggaguuuccucaccaauaaacagac

SEQ ID NO: 408903 - RNA, 64 nt, Human
acgggaugguguccacggcaagugugcacacccuccgccagaccucacuggccuggcuggacca

SEQ ID NO: 408904 - RNA, 64 nt, Human
ccaaugucaccucagagguuucaaacauugcacaagcaacuaacuuuauuccuccacaggaacc

SEQ ID NO: 408905 - RNA, 64 nt, Human
aguccaggagaacccguacccccacagagccuuaagcaacuacuucugugaaguauuuuuugac

SEQ ID NO: 408906 - RNA, 64 nt, Human
uugcacggcaaccacuccucccauggcauugcucagcaacuacuucucccuucccggccacccu

SEQ ID NO: 408907 - RNA, 64 nt, Human
auugcccaguacugccugccagcugggucucccaagcaacuaccccaagacauaccaacaguga

SEQ ID NO: 408908 - RNA, 64 nt, Human
cccugcuguuaguaacagucaccaaaauguucuaagcaacuacuuuccuagaguaucauuugcc

SEQ ID NO: 408909 - RNA, 64 nt, Human
agauguggcuucugaugacaauggccaagacuugagcaacuacaguuucucaacagaugguuuc

SEQ ID NO: 408910 - RNA, 64 nt, Human
acgauuggccauucuaaaguuggugaguuugucaagcaacuaucgacuugaucaguucagccaa

SEQ ID NO: 408911 - RNA, 64 nt, Human
aagcuuugaaauuauuguuuggggguuuuauaaaagcaacuacugucaccuccauccagauucu

SEQ ID NO: 408912 - RNA, 64 nt, Human
ucugacugguuuuaauagucaccuucaugauuauagcaacuaauguuugaacaaagcucaaagu

SEQ ID NO: 408913 - RNA, 64 nt, Human
uuauuugguuauuuccuaagaauauugaaagugaagcaacuaugugacuguauucuucagguaa

SEQ ID NO: 408914 - RNA, 64 nt, Human
gucacugcuaagagacagagcacauuuucaggccagcaacuauccuugccagaguuuuuucauu

SEQ ID NO: 408915 - RNA, 64 nt, Human
acaugauauuucggaauugguuuuacuguucuucagcaacuauuguacaaaauguucacauuua

SEQ ID NO: 408916 - RNA, 64 nt, Human
uauaauauaaauguauagacauggugguaggaauagcaacuaauacaaaugccaauaugauaau

SEQ ID NO: 408917 - RNA, 64 nt, Human
cuuucuuaguuauuugcuccuugcaaauuaaaaaagcaacuaagagaaagaaaaacauuguaga

SEQ ID NO: 408918 - RNA, 64 nt, Human
gaauaaaaagauugguggaagggcucaugugguuagcaacuaugaaacagaaauaggacacuca

SEQ ID NO: 408919 - RNA, 64 nt, Human
cugcucccccaaagcuguuucugauccugcugggagcaacuaacuaguuauuaugcacaucugc

SEQ ID NO: 408920 - RNA, 64 nt, Human
acaacauuagguucaggcuugaagucccugauuucgccaucaaagucagauccaggggggacga

SEQ ID NO: 408921 - RNA, 64 nt, Human
uccgagucuucucuaccgggcgagucucccuuagcgccaucagggcaguggccaagaacaccac

SEQ ID NO: 408922 - RNA, 60 nt, Human
aguaugaguaccccuccuagaggacccagccgccaucagcccaacgggaagcaaccuccc

SEQ ID NO: 408923 - RNA, 64 nt, Human
uaggaaaccaugaaugggaaggauggcaauaaguagcaacuauacuuuccaaugacuaaagaaa

SEQ ID NO: 408924 - RNA, 64 nt, Human
cauuucuuuuuuucuaugcgcaaaacugccugaaagcaacuacagaauuucauucauuugugcu

SEQ ID NO: 408925 - RNA, 64 nt, Human
aucugugcuguuucaaaguucucuguggcaaagcagcaacuauucacaaaauaucaccaaaaac

SEQ ID NO: 408926 - RNA, 64 nt, Human
cauuguauagagcagacagaaagauguugggucaagcaacuauugaagagaaauacaaagaaaa

SEQ ID NO: 408927 - RNA, 64 nt, Human
augaagccuuuauuucugaaguaacaagacaccuagcaacuauaggaaucauuuuuaaaaaucu

SEQ ID NO: 408928 - RNA, 62 nt, Human
uggaacuggagcaagcuugauuuauauuugcaagcaacuaaauuaauugaccugaaaaagcc

SEQ ID NO: 408929 - RNA, 64 nt, Human
uucugaaguuauaaacuuauaaucaauacaaaccagcaacuaauaaaaccucuaauucugcaac

SEQ ID NO: 408930 - RNA, 64 nt, Human
cuaaaccaauuaagaaaauaauuaauuucuuucaagcaacuaaaaaauauaugguaauuuaaag

SEQ ID NO: 408931 - RNA, 64 nt, Human
cuaaggcacaaagacaugucaugcaucacagaaaagcaacuacuuauauuucagagcaaauuag

SEQ ID NO: 408932 - RNA, 64 nt, Human
augcagcccuauggccgcucagaccaaggcgcagagcaacuaucagggcagcucugccuccucc

SEQ ID NO: 408933 - RNA, 64 nt, Human
uccgaauagaauguuuucuuuaagaggcaugaaaagcaacuauuguuguguuacaguguuaaaa

SEQ ID NO: 408934 - RNA, 64 nt, Human
ggaucacugacaaaaaacacugcaccaguaaggaagcaacuaaauuuuguuuuguucuuugaaa

SEQ ID NO: 408935 - RNA, 64 nt, Human
uggugaauaugcuguuuccucaguucagagagguagcaacuagguaaacuccuuauaaaaagca

SEQ ID NO: 408936 - RNA, 64 nt, Human
gcuuuuuauauugacauugccauugaauagcucuagcaacuauuauuauucccccaaacccuaa

SEQ ID NO: 408937 - RNA, 64 nt, Human
uuugccacuuuuaaauaaugugcugaauaagcucagcaacuaaaaaccauuacccaagaacguu

SEQ ID NO: 408938 - RNA, 64 nt, Human
uguuucauauuuaaaucauguuuuccuaaaauguagcaacuacaugugauaaaagcaaauuaga

SEQ ID NO: 408939 - RNA, 64 nt, Human
cugccuaguccacagauuaggcaaucaaggaagacgccaucagggaagccacauccuuagucaa

SEQ ID NO: 408940 - RNA, 64 nt, Human
cggauuugacaaaauaacauuugaguauccgauucgccaucacccccuaccccagaaauaggac

SEQ ID NO: 408941 - RNA, 64 nt, Human
auguuuauucaguauacuuacauaaaaauuauuucgccaucagccaaaacucaguaaucaugac

SEQ ID NO: 408942 - RNA, 64 nt, Human
caaagcgcuaaguaaaaauauuaacugacgaagaagcaacuaaguuaauaauaaugacucuaaa

SEQ ID NO: 408943 - RNA, 64 nt, Human
ggagcugcauuaauucuggaagacgacuccaugcagcaacuacugaagaaaggaccagacuuca

SEQ ID NO: 408944 - RNA, 64 nt, Human
auuauuuuuggagcugaaaucuuuguaauauuaaagcaacuaguuucuaauucccaguuucugu

SEQ ID NO: 408945 - RNA, 64 nt, Human
uauugacaggcauugguauuauuagucauugcuaagcaacuaaaacuucaucaguucaaauaag

SEQ ID NO: 408946 - RNA, 64 nt, Human
aucuuuucugcuuuugaauugggcagaagauuuuagcaacuauauucuacaaauguuacuuaua

SEQ ID NO: 408947 - RNA, 64 nt, Human
uuagcucuguuagauauguuucuuucuaaggacaagcaacuauguauagacuuguuguuugaau

SEQ ID NO: 408948 - RNA, 64 nt, Human
ucaaguuauaggaaaggaagcagauaccuugcaaagcaacuagugggugcuugagagacacugg

SEQ ID NO: 408949 - RNA, 64 nt, Human
uaguacuucaaaguauuauucaacuucaaguuucagcaacuaccuacaaaagauucuaaggccu

SEQ ID NO: 408950 - RNA, 64 nt, Human
uauugacauaaaauaugaauauggcuuagcaaagagcaacuaauauguuuucugaaaccaggau

SEQ ID NO: 408951 - RNA, 64 nt, Human
guacugcaguugguaugaccccucuaaggaguguagcaacuacagucuaaagcugguuuaaugu

SEQ ID NO: 408952 - RNA, 64 nt, Human
aaaacuguucucuuuaaaauauuugucuuuaaacagcaacuacagaaguggaagugcuugauau

SEQ ID NO: 408953 - RNA, 64 nt, Human
gaaccaagcacugucagcaaaucucagguauuagagcaacuaugguugauugaaaagugucuca

SEQ ID NO: 408954 - RNA, 64 nt, Human
guuauuuuaucuugucauuuacaacauccauauaagcaacuagccauauaagcaaaauucauag

SEQ ID NO: 408955 - RNA, 64 nt, Human
augagcgauuaaauaguaauggauacaauuaaggagcaacuauuuuauaugacuguucuguaca

SEQ ID NO: 408956 - RNA, 64 nt, Human
cauuuucucuuuggauaauuuucaucgcauauccagcaacuauagaccaaaguuugcuuaaggu

SEQ ID NO: 408957 - RNA, 64 nt, Human
cauccuauauuuuuauucucagauucaaagaaagagcaacuacuuuggaccaaaagcccauggc

SEQ ID NO: 408958 - RNA, 64 nt, Human
acgccacauggguguggucugcaucucaguuggccgccaucaguguaaauagagcuuaaaguca

SEQ ID NO: 408959 - RNA, 64 nt, Human
cguucugcuguccaagagaaugucaugcugggaacgccaucaucggugguguuagcuucacaug

SEQ ID NO: 408960 - RNA, 64 nt, Human
acauuuucaagaacucugcugaggucacuuagagcgccaucacaacuuauuugugugacuaauu

SEQ ID NO: 408961 - RNA, 64 nt, Human
gacaguuccuuauuggugugugugagauuacucuagcaacuauuacaguauaacacagaugauc

SEQ ID NO: 408962 - RNA, 64 nt, Human
caucaguuacagagaauuucuaaaguaaaauugaagcaacuacaacuucuccuuagacacuuug

SEQ ID NO: 408963 - RNA, 64 nt, Human
aucaggaacaucccugagaaacgguuuuaaguguagcaacuacucuuccuuaauggacagccac

SEQ ID NO: 408964 - RNA, 64 nt, Human
uuuuuuguugacuuuagaucuauaauuauuucuaagcaacuaguuuuuauuccccacuacucuu

SEQ ID NO: 408965 - RNA, 64 nt, Human
auauauaauugauuuauguugaauauauggacuuagcaacuaaaaauaccacagaugguuaacc

SEQ ID NO: 408966 - RNA, 64 nt, Human
ccuuaaaaagacaaaaaaaauaaggcaaaaggaaagcaacuaagacacuggacuauccuuuaaa

SEQ ID NO: 408967 - RNA, 64 nt, Human
acaaauccaucuuugaaucuaaugguguacucauagcaacuauuacugguuuaaaugacaaaua

SEQ ID NO: 408968 - RNA, 64 nt, Human
cacuagggaaagguaaauacaagugaacaaaauaagcaacuaaaugagaccuaauaauuggccu

SEQ ID NO: 408969 - RNA, 64 nt, Human
cucuggcuucagaagugaacuaugggcugcugggagcaacuagugacuuugauucccauggagg

SEQ ID NO: 408970 - RNA, 64 nt, Human
guugcggguugucgaaggguggauuuucuccuucagcaacuacaggagauaugaugccucauaa

SEQ ID NO: 408971 - RNA, 64 nt, Human
ucggccuucacaaucugucaguucuaaccuccuaagcaacuaggccuucaguaaaugugauuca

SEQ ID NO: 408972 - RNA, 64 nt, Human
ccauguauuaauagucacagaaagacuguaagugagcaacuauuuuuaugaaacguaccacuau

SEQ ID NO: 408973 - RNA, 64 nt, Human
ugauaauuugcugaagaagcaaauagauuaacauagcaacuaaguagaugauuaguugcauuau

SEQ ID NO: 408974 - RNA, 64 nt, Human
uggcauagacuccuucacacaucacuguggcaccagcaacuacuucuuuauauuguucuucaua

SEQ ID NO: 408975 - RNA, 64 nt, Human
aaacggauuuuguaacuagcuuuaaacuaggccaagcaacuaguuuuccugcaaaucaaauuuu

SEQ ID NO: 408976 - RNA, 64 nt, Human
aagguagcuaccacaucauuuugaaaggaccaugagcaacuauaagcaaagccauaagaagugg

SEQ ID NO: 408977 - RNA, 64 nt, Human
uggccuguccuuagccccaggccucuuccaaaaccgccaucagucccgagagcucacccugccc

SEQ ID NO: 408978 - RNA, 64 nt, Human
cucagccuccugaguagcugggacuacaggcgcccgccaucacgccuggcuaauuuuuuuuuuu

SEQ ID NO: 408979 - RNA, 64 nt, Human
gccccgcagcuggugcucugccccgcgguacuggcgccaucagggccucccuugcccgccugag

SEQ ID NO: 408980 - RNA, 64 nt, Human
aagaagaaauuauuguucaugguaaaagauauuuagcaacuaugguauucuuauucugaagauu

SEQ ID NO: 408981 - RNA, 64 nt, Human
ucaaaaagauauuguuguuuuccaugauuuagcaagcaacuaauuuucucccaagcugauuuua

SEQ ID NO: 408982 - RNA, 64 nt, Human
cacuaucacuuuaaauacuauuauuugcuaccacagcaacuauauauuuccauagcuuuuggcu

SEQ ID NO: 408983 - RNA, 64 nt, Human
uuuacauuugcaaauguagcaaacaagguaaugaagcaacuauuucuauugcaguagauauccu

SEQ ID NO: 408984 - RNA, 64 nt, Human
guauguaacugucccagacuccucugucaguuucagcaacuacaagggauacccugcgaaagua

SEQ ID NO: 408985 - RNA, 63 nt, Human
aauaaaauaagaaaauagcaauaaacuucuuuucagcaacuacagaaaacuaccucagcaucu

SEQ ID NO: 408986 - RNA, 64 nt, Human
ugaauuccaaguguauuuuaaaauagaggcuuugagcaacuaacuaaccacauuuuaggaucuc

SEQ ID NO: 408987 - RNA, 64 nt, Human
ggcuuccagcugcccaguggcucuuaaacaguuuagcaacuaauaaccggagaacuaacaugua

SEQ ID NO: 408988 - RNA, 64 nt, Human
gcuaaacuaugcaguuuuucuugaaggaacuaaaagcaacuagcucccuaauggucuauaauuu

SEQ ID NO: 408989 - RNA, 64 nt, Human
cuaucucauugcaauuuguauuuuagcagauuucagcaacuauccuaaacaauguuauuguguu

SEQ ID NO: 408990 - RNA, 64 nt, Human
guguacccuggggcaauaggguuaaaugguaguuagcaacuagggcuagucuucccuuaccuca

SEQ ID NO: 408991 - RNA, 64 nt, Human
uuacagaauugaugugcuaacugaauaucauugcagcaacuagacuaagauauucaagaucucu

SEQ ID NO: 408992 - RNA, 64 nt, Human
ucguucuauguaccagguauuuuauuacugaacuagcaacuagccuuuuccaccuuuaaaaguu

SEQ ID NO: 408993 - RNA, 64 nt, Human
cuguacuguauaggcaacauguuguacucccaguagcaacuagaucucuuuuaccucuucuuua

SEQ ID NO: 408994 - RNA, 64 nt, Human
cauuggaaucauuuccauaggagguaauuuccauagcaacuaaucauagugacccaaacaggau

SEQ ID NO: 408995 - RNA, 64 nt, Human
ugaagagaaacaccugagcuauauauuuuuuuaaagcaacuaacuuauugcuuuauguuuaucu

SEQ ID NO: 408996 - RNA, 64 nt, Human
gggaggcugggagagcagcaagggggaccaggugcgccaucaggaggagagaagcuaaaccuag

SEQ ID NO: 408997 - RNA, 64 nt, Human
agaggaagauggcagugaauaucaaacaguagaccgccaucaacuucuaacagccaguacacac

SEQ ID NO: 408998 - RNA, 64 nt, Human
ugcaucccuagucuccuaaacuccagcucugauucgccaucaacccauggagcaauuccaaggc

SEQ ID NO: 408999 - RNA, 64 nt, Human
caugcuccccccccuccuuauuuguagcaaucguagcaacuaauuccacuaaguacaagggagu

SEQ ID NO: 409000 - RNA, 64 nt, Human
uuugggucuuuuugagagagcuggggaaaguagcagcaacuagauuaagacugggaggauuuug

SEQ ID NO: 409001 - RNA, 64 nt, Human
uucaggaccugacuggacagauggaccuggcucaagcaacuacucuggaugcacuuugcugugu

SEQ ID NO: 409002 - RNA, 64 nt, Human
guccuguaaacacagaauuaaauuaggggacucaagcaacuauuauuauauuucuccuuuuugc

SEQ ID NO: 409003 - RNA, 64 nt, Human
ucuggccuucucugugggaccucugcuuuugugaagcaacuauuuauuugaagaccaggguaug

SEQ ID NO: 409004 - RNA, 64 nt, Human
aucauuuaauauuucccugucuuaccccuauucaagcaacuagaggccagaaaaugggcaaauu

SEQ ID NO: 409005 - RNA, 64 nt, Human
uccauuguuaacugaauguuacuguuuccacuccagcaacuacauguccucccuucaacugccu

SEQ ID NO: 409006 - RNA, 64 nt, Human
ggccaaaacacuacucagacacuuuccugggaagagcaacuaaaaauguaaaauugguuaaaaa

SEQ ID NO: 409007 - RNA, 64 nt, Human
uguuaagucaaaucuaaauaguuaugaguuaguuagcaacuauuccuaaagaauauguauuaag

SEQ ID NO: 409008 - RNA, 64 nt, Human
gcaauaguauuaguauuuaccauuuuuccaaauuagcaacuaccagaccucacguguugcagug

SEQ ID NO: 409009 - RNA, 64 nt, Human
aaagcuaugauggcauugucgcugaguugacagaagcaacuauuguacaaauuaaaaauaacca

SEQ ID NO: 409010 - RNA, 64 nt, Human
ugaauauuuuagcuauauuuaguggcuuucugcaagcaacuagaacagagaaguaaugggucaa

SEQ ID NO: 409011 - RNA, 64 nt, Human
ccagugcuuuugauaaugugguuggcaacaaaccagcaacuauuuagaagugucauaagaguuc

SEQ ID NO: 409012 - RNA, 64 nt, Human
uagagaagaaacacugguccuucuuucaaaauuaagcaacuauuaaaagcgccauuuuauuuau

SEQ ID NO: 409013 - RNA, 64 nt, Human
aaccccuucagugcauuuucauuuuuuuauuaacagcaacuaaaauuuuauauauuguaaccag

SEQ ID NO: 409014 - RNA, 64 nt, Human
uuuuaccaaaacugaagcugguaauuuuaaguaaagcaacuaaauuuacccuuuacuuauuagu

SEQ ID NO: 409015 - RNA, 64 nt, Human
gcaagaagagcguccuccgcgagaagcugcgcuacgccaucagcaugaacacgggcuuugaacu

SEQ ID NO: 409016 - RNA, 64 nt, Human
guguuuucccguagccaccaaccgcuaaaaugcacgccaucaucgagcgcacggccagcuucgu

SEQ ID NO: 409017 - RNA, 64 nt, Human
gacucuucuccugcagugcacuugcccccguggccgccaucauccccccgccccccgacgucca

SEQ ID NO: 409018 - RNA, 64 nt, Human
accccaauaauguucuauauagccuuugcuaaagagcaacuaauaaauuaaaccuauucuuucu

SEQ ID NO: 409019 - RNA, 64 nt, Human
uguuaacaauuaugacaucugcaauguuuuauaaagcaacuaauuuaauaaaaucacuguugug

SEQ ID NO: 409020 - RNA, 64 nt, Human
ccgcagggacuagaggcuuucggcuuuuugggacagcaacuaccuugcuuuuggaaaauacauu

SEQ ID NO: 409021 - RNA, 64 nt, Human
gcacugaagucaccauuaggucacuuaagaaguaagcaacuagcugggcacaguggcucaugcc

SEQ ID NO: 409022 - RNA, 64 nt, Human
cuggguggcauccaagucuuggaaaaccgugugaagcaacuacuauaaacuugagucaucccga

SEQ ID NO: 409023 - RNA, 64 nt, Human
cucugggcucacgggguguuuuccaccccccugcagcaacuaagauggugggggagaggggguu

SEQ ID NO: 409024 - RNA, 64 nt, Human
uagcuaacaguaaacagacaucuuuacaccagcaagcaacuaaggagauucaggaugcagcugg

SEQ ID NO: 409025 - RNA, 64 nt, Human
ugaguccggcucuucagcaggcugcacaaguggaagcaacuaauucuggugcucaggcugggcu

SEQ ID NO: 409026 - RNA, 62 nt, Human
gcgccgccgcccagcccugaaccagaagccugagcaacuacggacgcaagccgaggaccgug

SEQ ID NO: 409027 - RNA, 64 nt, Human
aaaugcaaagacacauuuuucuauaaaaagaaaaagcaacuaagguuaaaagcuauauuguggc

SEQ ID NO: 409028 - RNA, 64 nt, Human
ggguuuuucugggagcgaauaucaagugccugagagcaacuacaggacuaacuguguuuggguu

SEQ ID NO: 409029 - RNA, 64 nt, Human
guaaauccuuucuuaaugguuaaauaggauuguuagcaacuauggguuugcaguuuucugagua

SEQ ID NO: 409030 - RNA, 64 nt, Human
aguguggucguuauaaaccaauauugugaaaaauagcaacuauucauuuguucacaacaugcgu

SEQ ID NO: 409031 - RNA, 64 nt, Human
accuaagaauucaaaagcuggauagaauuuuagaagcaacuacguacaucauuauuaauauaaa

SEQ ID NO: 409032 - RNA, 64 nt, Human
agacaucagcccuuggggguccuccuccagggacagcaacuaucagacuaagccagcaccggac

SEQ ID NO: 409033 - RNA, 64 nt, Human
uaauguaccauaugugaaacauucuggccauagcagcaacuaaaaacugcaagcaacuugguaa

SEQ ID NO: 409034 - RNA, 64 nt, Human
gaguucgcuccaggagaaggcugcgcacccacacccgccagagcccuacacgguggcgccggug

SEQ ID NO: 409035 - RNA, 64 nt, Human
ggauguggcacugcuugaggaggggcaccugccaccgccagaggacaaggaagugggggccgcu

SEQ ID NO: 409036 - RNA, 64 nt, Human
agaaagggcaguuacccggccagggucacaucaaccgccagaaguggaguugggcaggucagcg

SEQ ID NO: 409037 - RNA, 64 nt, Human
uuuuuuccaggggugagaauaaguauaaacauaaagcaacuaaaaugaaacauaaaaccuuuua

SEQ ID NO: 409038 - RNA, 64 nt, Human
gggugugucugaggggguguguuugggagccuggccuccaaaagccagugucuggguuggagac

SEQ ID NO: 409039 - RNA, 64 nt, Human
cacccccuugguacccauucccauuucacaaacuccuccaaaccccaaaccccaaacggaaauc

SEQ ID NO: 409040 - RNA, 64 nt, Human
ccaggaacauguugcuucucagguccuaguauauccuccaaagaauauaccacaaguuuuucca

SEQ ID NO: 409041 - RNA, 64 nt, Human
gguacuugaacuugguaguguuuccuuagaaccuccuccaaaaauaugcauuuaccaggcuugu

SEQ ID NO: 409042 - RNA, 64 nt, Human
gucauuuuuaauuuauaucagauuuauaucagacccuccaaaaaguauuugaaauauauuacag

SEQ ID NO: 409043 - RNA, 64 nt, Human
agugcauuuauuuuuauacagaguuacuuaauuaccuccaaaacacauauguuggaaaucgcuu

SEQ ID NO: 409044 - RNA, 64 nt, Human
gguuuuguguuugcuuuuccggaccccacucugcccuccaaaaagacaaaaaaaaaaaaaaaaa

SEQ ID NO: 409045 - RNA, 64 nt, Human
guagaauguuugcuuucuucuucuuggaaauaguccuccaaaaaguccacuuguaccagugaca

SEQ ID NO: 409046 - RNA, 64 nt, Human
aaaucccaccuuuaccccaccuuccugggaaaggccuccaaagcaaaggaucuggaccaguuuc

SEQ ID NO: 409047 - RNA, 64 nt, Human
ccagagccuacccucaccagacaaacucugugcuccuccaaaacauccuuuagaugcaaaauaa

SEQ ID NO: 409048 - RNA, 64 nt, Human
gaacagcggcugcuguugcuccuggccucaucagccuccaaacucaaccacaaccagcugccuc

SEQ ID NO: 409049 - RNA, 64 nt, Human
aaacucuuggaaaugaacacuuucugcuuuccuuccuccaaagaauuaauaggcaacaguggga

SEQ ID NO: 409050 - RNA, 64 nt, Human
guucuuucuguccugguguggugcugcucccucaccuccaaaagagcaaaaguacuuucaccac

SEQ ID NO: 409051 - RNA, 64 nt, Human
uauucucuggcccgauuuaucauaucccuuuucuccuccaaauauuucuccucucaccuuuucu

SEQ ID NO: 409052 - RNA, 64 nt, Human
gggcaggaggggggcugugaccccugcccuuuccccgccagagaccucaggcucucagcacauu

SEQ ID NO: 409053 - RNA, 64 nt, Human
aggagcccuaccucccugccauuauagcugcuccccgccagaagccugugccaacucucugcau

SEQ ID NO: 409054 - RNA, 64 nt, Human
ccagaaucaacagcuccagcccucugcgcuacaaccgccagaucggggaguuuauagucacccg

SEQ ID NO: 409055 - RNA, 64 nt, Human
cagguuccuccuuugggcccagcggccggcgaggccgccagacauacacacguuaccagacgcu

SEQ ID NO: 409056 - RNA, 64 nt, Human
ucgagacacagaagugcaauaacugcccuaauuaagcaacuauuuguuaaaaagggccccuuuu

SEQ ID NO: 409057 - RNA, 52 nt, Human
cuacuccccuaucucccugagcagcaacuaaguuuaggcccagcugccagac

SEQ ID NO: 409058 - RNA, 64 nt, Human
ccuuucagacccugcucccagggacuuggguggaugcgcugauagaacauccucaagacaguuu

SEQ ID NO: 409059 - RNA, 64 nt, Human
guucuaauccuuaacuccaggauuagcucccaagugcgcugagacccagccagcacacuucugg

SEQ ID NO: 409060 - RNA, 64 nt, Human
cucgucaagugcccgagcucgccgccgugugugcugcgcugagugaguuaugaggugccuuucc

SEQ ID NO: 409061 - RNA, 64 nt, Human
ccccaaaugccccugcacacacacgugccacaccugcgcugauucuugugugugcugcaccccc

SEQ ID NO: 409062 - RNA, 64 nt, Human
ccgggagauuucuggaugguggugcauccgugaaugcgcugaucguuucuuccaguuagagucu

SEQ ID NO: 409063 - RNA, 64 nt, Human
acacuucacuacagacacucuauuaagauacauuugcgcugaccuuugcuuucacgccauuuaa

SEQ ID NO: 409064 - RNA, 64 nt, Human
ugguugccugccuuccccagcucccacgcgggugugcgcugacacugccgggggcgcuggacug

SEQ ID NO: 409065 - RNA, 64 nt, Human
ggguaccaggacuuccuccaaccuggcaagggugugcgcugaggcggggcuugcaggugagggg

SEQ ID NO: 409066 - RNA, 64 nt, Human
acaucauuuaggugaaagucaguguugcugugcaugcgcugauggaguagacgagugagcuuuu

SEQ ID NO: 409067 - RNA, 64 nt, Human
aggaagccaucuguucccagcagaggagagcugcugcgcugaccugcagagguuggugguccca

SEQ ID NO: 409068 - RNA, 64 nt, Human
ucacucuucaguucaagaagagaugucuucuuguugcgcugagaacaccauauguucaugacga

SEQ ID NO: 409069 - RNA, 64 nt, Human
cuuuguauagaaccucuuugucuacaccauuaugugcgcugauaagcguucauggaacgcguug

SEQ ID NO: 409070 - RNA, 64 nt, Human
uggaugcccaccugucaagaguucagaucaaaguugcgcugagagcaucacaauuuugguucag

SEQ ID NO: 409071 - RNA, 64 nt, Human
aguuaagguauaauuugaagguuggcagaccaguugcgcugauuacucuuagagaagaagaaau

SEQ ID NO: 409072 - RNA, 64 nt, Human
guucuggacucaccccucauccgggcccccagccccgccagagccuccguggcugcggguguug

SEQ ID NO: 409073 - RNA, 64 nt, Human
guaagcaguccccaccgggaguuccccccugcuaccgccagagagguggacccacuccggauuc

SEQ ID NO: 409074 - RNA, 64 nt, Human
cacugucauuguguuucccagccucuccacucccccgccagaaaggagccugagugauucucuu

SEQ ID NO: 409075 - RNA, 64 nt, Human
gaggcccagcaucccgcgcagaugacaccaucaaccgccagagucccagacaccgguuuuccua

SEQ ID NO: 409076 - RNA, 64 nt, Human
cugcucagccucauccugagagaccugcccucucugcgcugaggcccagccccuccagcaccac

SEQ ID NO: 409077 - RNA, 64 nt, Human
agagcugaccuuaggaccgagcaccagggcagguugcgcugacucugcggcccuccaggacgga

SEQ ID NO: 409078 - RNA, 64 nt, Human
gcaugcauguguguauguguguguguguguggcaugcgcugacaaauguguccuugauccacac

SEQ ID NO: 409079 - RNA, 64 nt, Human
cucgguacccuuucugcacuccgugggcccugggugcgcugaggccuggaggcgucuacacugg

SEQ ID NO: 409080 - RNA, 64 nt, Human
auggggggcaucaccaugccugccgucggguuccugcgcugacaccuggucugugcaccugugu

SEQ ID NO: 409081 - RNA, 64 nt, Human
ucugccugucuguggaaugggagguuggauuagcugcgcugaggucccauccacagcuggugcu

SEQ ID NO: 409082 - RNA, 64 nt, Human
auggccacacccaccgccccacacgagaaauuugugcgcugaacuucaaaggacuucauaagua

SEQ ID NO: 409083 - RNA, 64 nt, Human
gugggaucagcaccacguaaggggccggccucgcugcgcugauucgucgagcccauccggcgac

SEQ ID NO: 409084 - RNA, 64 nt, Human
aguuugaauaugaaauuuggaccaaaugauaaacugcgcugagucuaaacuggcaacauguauu

SEQ ID NO: 409085 - RNA, 64 nt, Human
ugaguaugugugcacacacgugugcauguuccugugcgcugauguuuacgcccaagcauuucug

SEQ ID NO: 409086 - RNA, 64 nt, Human
aaaaugucuuauaugaacauauaucaaauauccaugcgcugaaacccacauaccaucacuuggc

SEQ ID NO: 409087 - RNA, 64 nt, Human
guccugaugguuacagaguaagugaaagggugccugcgcugacgugagagaaaggaaucuguaa

SEQ ID NO: 409088 - RNA, 64 nt, Human
accccgaggggcuugcagggacaaggcgaccgacugcgcugagcugcuuauuuauugaaaauaa

SEQ ID NO: 409089 - RNA, 64 nt, Human
accuccucuacuuuaacugugcucucaggugguuugcgcugagaauggauguccucaugaacau

SEQ ID NO: 409090 - RNA, 64 nt, Human
aguauuguuugggucucggaaugggcgcauaaccugcgcugaccaguuuaggggcuuagcagau

SEQ ID NO: 409091 - RNA, 64 nt, Human
ccucuauuuagcaugacaagccccaggcaggcugugcgcugacaaccaccgcuccccagcccag

SEQ ID NO: 409092 - RNA, 64 nt, Human
uccgggagagaugccuggccaggcuccacggaucccgccagaaacaccaacagagggucucccu

SEQ ID NO: 409093 - RNA, 64 nt, Human
ugccaugucucagaugaggagggagagaaggaggccgccagacucgagaggugggaggaacucc

SEQ ID NO: 409094 - RNA, 64 nt, Human
uccuggaccacccacugcuucuccccaacccugaugcgcugacauucccuuagcaccagcuguc

SEQ ID NO: 409095 - RNA, 64 nt, Human
gcguuuaagccugugccccucugcuggguguaacugcgcugaaauaaaugaucugacaauguga

SEQ ID NO: 409096 - RNA, 64 nt, Human
ggaauccguccgagcuccuguggaaguugcuccuugcgcugauguggucacucggcuagcaggc

SEQ ID NO: 409097 - RNA, 64 nt, Human
ucugcuuuugugcagcgguccagacaguggcgacugcgcugacagaacgugauucucgugccuu

SEQ ID NO: 409098 - RNA, 64 nt, Human
auuucagcuguggcuuucagaagaaugggaaugcugcgcugauuuuagccagccacuggcccag

SEQ ID NO: 409099 - RNA, 64 nt, Human
uagaauuaucuuaaaauacaugaucaguauucagugcgcugauauuauaaugucuucuauaugu

SEQ ID NO: 409100 - RNA, 64 nt, Human
uuagugcccugaagacugcugccgcugucaccguugcgcugaaaccccaugggcccguucugau

SEQ ID NO: 409101 - RNA, 64 nt, Human
cccugaguccaccugacaccccacaccuuauuuaugcgcugagcccuacuccuuccuuaauuua

SEQ ID NO: 409102 - RNA, 64 nt, Human
uuuccaucuguuugucccgcugcaagccucuuucugcgcugacugugacauuggaacguggccu

SEQ ID NO: 409103 - RNA, 64 nt, Human
cgcugggucagugcuggaaagcgccccucacuccugcgcugacaagggcccuucucuacugucu

SEQ ID NO: 409104 - RNA, 64 nt, Human
agauggaccuggacagacagucagcuccacaccuugcgcugagcagcugugauugugccacggg

SEQ ID NO: 409105 - RNA, 64 nt, Human
ucgcauuuagagagcagacaaggcacccuucugcugcgcugauacguuucuuacacugggccau

SEQ ID NO: 409106 - RNA, 64 nt, Human
ggaucauguuaaauuaacaagaaagaugaauaacugcgcugaauugccuuuaccuauaaauaau

SEQ ID NO: 409107 - RNA, 64 nt, Human
agcaguuggcauaagcaacauuuagaaguuccuuugcgcugacaaggauuccacuguuagagcc

SEQ ID NO: 409108 - RNA, 54 nt, Human
ccuaccuccucuaccagugacguucgccaucauaccgccagcgcgacagccacc

SEQ ID NO: 409109 - RNA, 64 nt, Human
auaaaauguugccuuccccacuucucaccaccaccgccaucaugacgcucauacuggcuuuugc

SEQ ID NO: 409110 - RNA, 64 nt, Human
aggagagggacuccuggggggccugccccucauacgccaucaccaaaaggaaaggacaaagcca

SEQ ID NO: 409111 - RNA, 64 nt, Human
uccugggccuuucugccuccugauguacacccaucgccaucauagcaagagugcuucuggaccu

SEQ ID NO: 409112 - RNA, 64 nt, Human
uucugugggugcugagagcugccccccaucaccacgccaucacaccccucugagcagaagcaaa

SEQ ID NO: 409113 - RNA, 64 nt, Human
uggguagugagugacaugugcacacguccagcugcgccaucaccagcccugcgcaacaggacgu

SEQ ID NO: 409114 - RNA, 64 nt, Human
gcccugcauuuuuuauuuaaauauuuagcuguagcgccaucagauauggaugccuucuaacaau

SEQ ID NO: 409115 - RNA, 64 nt, Human
ccgggggcuggaggggcguguacccaaauccccgcgccaucagccuggaugggcauaaguagau

SEQ ID NO: 409116 - RNA, 64 nt, Human
cgagcgucuuaccgaauucccuucacaucuucaacgccaucagugggacuccaacaagcacaau

SEQ ID NO: 409117 - RNA, 64 nt, Human
ggccugcaccacacgcccuccccuuuuggcuucacgccaucaggccucaagugggcaugggggc

SEQ ID NO: 409118 - RNA, 64 nt, Human
ucgccgucuccauccucaucauuggcaugcucaccgccaucauuggggaccuggccucgcacuu

SEQ ID NO: 409119 - RNA, 64 nt, Human
cugccaagcaaucgugauuguaggucaaguaucgcgccaucacggaagguguaaguauauguag

SEQ ID NO: 409120 - RNA, 64 nt, Human
gggacccuacucuagaacuguguaccauccaauucgccaucauaaaggaaucuuccugcaucuc

SEQ ID NO: 409121 - RNA, 64 nt, Human
ugucccuucccagcgcugcuggucagucguggagcgccaucaugucuuaccagugacgcugcug

SEQ ID NO: 409122 - RNA, 64 nt, Human
caccuccugccaccugucagauacccagccugcccgccaucagccacccgagugguuccgaccu

SEQ ID NO: 409123 - RNA, 64 nt, Human
aaaaacucaguucccaaauccccaguuuaugcagcgccaucagguauuuuaagcuaaacuucuu

SEQ ID NO: 409124 - RNA, 64 nt, Human
caaggaggaacuguagcugcccccgugucacccccgccaucacugcuggacaggagccaccccc

SEQ ID NO: 409125 - RNA, 64 nt, Human
ccccuuuuuugcccccagguuccccagagggcaacgccaucaguagcagugugguguuucaggc

SEQ ID NO: 409126 - RNA, 64 nt, Human
acgccgcccuccgccacgccacagccacagccgccgccaucacucgcucgcccucccgcuuggg

SEQ ID NO: 409127 - RNA, 64 nt, Human
gcagaggaggggcgaugagggguggcggcugucucgccaucaggcagggacaggacgggcaagc

SEQ ID NO: 409128 - RNA, 64 nt, Human
cucagccucccgaguagcugggacuacaggcgcccgccaucacgcccggcuaauguuuuguauu

SEQ ID NO: 409129 - RNA, 64 nt, Human
cauggugggaacugcaccaggguacuccucacagcgccaucaccaauggccaaaacuccucuca

SEQ ID NO: 409130 - RNA, 64 nt, Human
uuuucuuuccucaaucuaugcaagcggcucuggccgccaucaucuccugggaugccagagggcu

SEQ ID NO: 409131 - RNA, 64 nt, Human
uucacuuuuuauccucccuggagcuacagcuguucgccaucacaucacucccauccuauccuuu

SEQ ID NO: 409132 - RNA, 64 nt, Human
gcaucgcacgaucuagucugugguguagacuggucgccaucacguguaauaaagcacccgggaa

SEQ ID NO: 409133 - RNA, 64 nt, Human
agaacgguuucuuucucccccaaagaaaccccaucgccaucagcacucacuccccacuccccca

SEQ ID NO: 409134 - RNA, 64 nt, Human
cccacgaggugaagccagccuaugccaccagguacgccaucacugucugguauuuugaugccaa

SEQ ID NO: 409135 - RNA, 64 nt, Human
uggaaaaucauuucgccacaguucuucguuccgucgccaucagagaguucauacuggaaugagg

SEQ ID NO: 409136 - RNA, 64 nt, Human
acuuugaccugaugaccucaucccagcccuugaucgccaucacuaaaacaauuuuagaaucaca

SEQ ID NO: 409137 - RNA, 64 nt, Human
cuugccagaggcccucggucagcgacuggaugcucgccaucaagguccaguggaaguucuucaa

SEQ ID NO: 409138 - RNA, 64 nt, Human
aguccagggcccccccacccuccccaccacccuccgccaucagccugccugggccagccugccu

SEQ ID NO: 409139 - RNA, 64 nt, Human
gcccuaacaacuucccauccgcugaccccuccaacgccaucaaucuccagcugugguuguugaa

SEQ ID NO: 409140 - RNA, 64 nt, Human
ccugccuggagaggccuggcccugggcaaacagccgccaucaggguucaccucggugggggacc

SEQ ID NO: 409141 - RNA, 64 nt, Human
gcgggcucugaaggaaggcaagacaagcaugcauccgccguacucuuuggggcagcuggucccg

SEQ ID NO: 409142 - RNA, 64 nt, Human
accacuguggccucuccaagcguccugcacguguccgccguagcuuuaccauuuuagugaggga

SEQ ID NO: 409143 - RNA, 64 nt, Human
cccagccccucuccuuuuccuggacucuggccgugcgcggcagcccagguguuugcucaguugc

SEQ ID NO: 409144 - RNA, 64 nt, Human
aggagcuuauauuucuucgcaaccgcaauccggagcgcggcaguauccagaacaauaagcaggu

SEQ ID NO: 409145 - RNA, 64 nt, Human
gagagugggggggugucuuuggugccugaagucugcgcggcauggaggguggugugaguuccuc

SEQ ID NO: 409146 - RNA, 64 nt, Human
gcaaagggcauccaaauggguaggcaggugacagccgccguauuuauuuugcauaauauuuuaa

SEQ ID NO: 409147 - RNA, 64 nt, Human
ugauggaaagcgaccucuccaaccaccacacuccccgccguacaguucuccagaaucccaggcg

SEQ ID NO: 409148 - RNA, 64 nt, Human
gggucacucggauaccaucaucccugcggaugcaccgccguacccugcucaucugggagugguu

SEQ ID NO: 409149 - RNA, 64 nt, Human
gaucuggaucugcggcggccucgggcgguuucccccgccguaaauaggcucaucuaccucuacc

SEQ ID NO: 409150 - RNA, 64 nt, Human
cacuaacaaggacuccagaccugcagccccagacccgccguaguauaagccuaacaagcaacac

SEQ ID NO: 409151 - RNA, 64 nt, Human
uuucgcagaggccaccagcuggggccgccuuggggcgcggcagcgcaggcagagccgccuagag

SEQ ID NO: 409152 - RNA, 64 nt, Human
acgacuacucgcugcacgggggcugccuggucacgcgcggcaccaaguggauugccaacaacug

SEQ ID NO: 409153 - RNA, 64 nt, Human
ugccaacaacuggauuaauguggaccccagccgagcgcggcaagcgcuguuccaacaggagaug

SEQ ID NO: 409154 - RNA, 64 nt, Human
acauaaagauguuccuuaagucguacagaagguggcgcggcaaagggccucgugcaguguguuc

SEQ ID NO: 409155 - RNA, 64 nt, Human
cgugugggguccagagugguguugcaucacuggugcgcggcauacgcgcuuucuucugauccag

SEQ ID NO: 409156 - RNA, 60 nt, Human
uggagcagaugcagauuuagguggcagggagcgcggcagcccuggcggagggaugcaggu

SEQ ID NO: 409157 - RNA, 64 nt, Human
gaggggccagggcugagccggcggguccuccugagcgcggcagagggugagccucacagccccu

SEQ ID NO: 409158 - RNA, 64 nt, Human
gagccgggugcgaggaggagcaugcacggaccaagcgcggcaggcgggaggagggggcgcggcu

SEQ ID NO: 409159 - RNA, 64 nt, Human
cucuggacacugcgggccagguguacauagagcagcgcggcacaguggccucaccucccgucgg

SEQ ID NO: 409160 - RNA, 64 nt, Human
ccccuccucgccccauccccguccggguacgggggcgcggcagggguccccggccccucccccg

SEQ ID NO: 409161 - RNA, 64 nt, Human
cuggcccgggaggggacaacgggcuguugcgggugcgcggcagcuggagacacucccccgcagg

SEQ ID NO: 409162 - RNA, 55 nt, Human
aaaccugccauggccacuagggggcgcgcggcacccggagccacagcuggcgggg

SEQ ID NO: 409163 - RNA, 64 nt, Human
ccugcccgucggcgcggccgggagccugccuggugcgcggcacccgggucucgcugaccauccg

SEQ ID NO: 409164 - RNA, 64 nt, Human
ugggcggggacaauaagggaauaaaagcuggcgagcgcggcaccccaccagagucugcuuccac

SEQ ID NO: 409165 - RNA, 64 nt, Human
ucauaguucauuuuaugugggaggauguucagcagcgcggcagagucauggggguaagugagug

SEQ ID NO: 409166 - RNA, 64 nt, Human
gugagggccacggacggcccagacccgggcuggggcgcggcaccacggacggugccccuugcgc

SEQ ID NO: 409167 - RNA, 64 nt, Human
ucuacaaccaccugcgacgccacgaacugcgccugcgcggcaagaaugucuagccugcccgccc

SEQ ID NO: 409168 - RNA, 64 nt, Human
ucgugguuuuuuggggcgcugaccgcuccaagcagcgcggcagcuaaagccaauguuaauuuau

SEQ ID NO: 409169 - RNA, 64 nt, Human
cugagcuucaaggugaucaagguuaacaaagaaugcguccgaggacuuugggccgggcagcagc

SEQ ID NO: 409170 - RNA, 64 nt, Human
aggucaggagggcuggcagcugaacgcacuugcagcguccgagggccaccgggcuggcauuuug

SEQ ID NO: 409171 - RNA, 64 nt, Human
gcgcaaggggaagccuccugucuccccuuuccccgcguccgagaaggcggaaacccacaguguu

SEQ ID NO: 409172 - RNA, 64 nt, Human; identical to SEQ ID NO: 90358

SEQ ID NO: 409173 - RNA, 64 nt, Human; identical to SEQ ID NO: 90359

SEQ ID NO: 409174 - RNA, 64 nt, Human; identical to SEQ ID NO: 90360

SEQ ID NO: 409175 - RNA, 64 nt, Human; identical to SEQ ID NO: 90361

SEQ ID NO: 409176 - RNA, 64 nt, Human
aggccgggggucccggggucccggggcggggccggcguccgaggccgggcggugagaagggugc

SEQ ID NO: 409177 - RNA, 64 nt, Human
ggcaccucugagucaccccucuccuguggagcgggcguccgaggggcccuggcaucugacucag

SEQ ID NO: 409178 - RNA, 64 nt, Human
cuccucugccaagcccccaggggagcccucccuggcguccgagggugggagucgggguguggca

SEQ ID NO: 409179 - RNA, 64 nt, Human
ucuccacgcggggcagacucuggcgggucuccuagcguccgagagauggcuuauuuucuacagu

SEQ ID NO: 409180 - RNA, 64 nt, Human
ugcuggucugagccccacgaaggccuugggcugugcguccgacccugcugcagaaccagcaggg

SEQ ID NO: 409181 - RNA, 64 nt, Human
aacacgcacguccgcgugggaagcuugcagcagggcguccgagcaauaagggcuggguuugucc

SEQ ID NO: 409182 - RNA, 64 nt, Human
gccguggguucagguguggcagaagcuugcagaugcguccgaagggaaauaaaguguguuggcg

SEQ ID NO: 409183 - RNA, 64 nt, Human
gcgucgggcgaggccgggaccccagcgcugcgccgcguccgaacgucgagaccccaccgagggc

SEQ ID NO: 409184 - RNA, 64 nt, Human; identical to SEQ ID NO: 90362

SEQ ID NO: 409185 - RNA, 64 nt, Human; identical to SEQ ID NO: 90363

SEQ ID NO: 409186 - RNA, 64 nt, Human; identical to SEQ ID NO: 90364

SEQ ID NO: 409187 - RNA, 64 nt, Human
ugccucaggcaggcccacacaacuggccaccucuucccguuaaugaccacagcagacagaauuu

SEQ ID NO: 409188 - RNA, 64 nt, Human
uuugagcuugugaaagauuucugaacagugauugucccguuaauagccccucagaagauguucc

SEQ ID NO: 409189 - RNA, 64 nt, Human
acacagauuaugcaaaguuaagaguuguaucuuaucccguuaguacaguauguaauaguggguc

SEQ ID NO: 409190 - RNA, 64 nt, Human
gauccuaauaaggggaaaaugguaaaugcaaacgucccguuacaauuuuaccgccagugugcug

SEQ ID NO: 409191 - RNA, 64 nt, Human
ucaugggggaaucugcccccaugacccagaccccucccguuaggcuucaccuccaacacugagg

SEQ ID NO: 409192 - RNA, 64 nt, Human
cugggccaggggccccgggucgcagagagcacguucccguuauuuauuccccuccgcguccuac

SEQ ID NO: 409193 - RNA, 64 nt, Human
ucuuuuuuuuccccccugcuccacacuucaaaacucccguuagaucagcauucuacuacaagag

SEQ ID NO: 409194 - RNA, 64 nt, Human
gugaaacacuaauaaauguguuuuuacuuuuuauucccguuaaaacugauguaaaacaggauaa

SEQ ID NO: 409195 - RNA, 64 nt, Human
aguuggggcugaaguaccuaagugugaaugucucucccguuaaacugaguguagaaaucugaau

SEQ ID NO: 409196 - RNA, 64 nt, Human
uuccaguaacuucuuccauauuuucucacuaaucucccguuagccaaaauaugccagaaauggg

SEQ ID NO: 409197 - RNA, 64 nt, Human
aaggaggcaccuggaggugaaacccagcuccagcucccguuagccaggacuuguccccuggcag

SEQ ID NO: 409198 - RNA, 64 nt, Human
uagucaauguauuuucagugaaaugcaaaaauauucccguuaucuuugaccaguauuaauuuuu

SEQ ID NO: 409199 - RNA, 64 nt, Human
ccaccgggugaccggcuuacagggauauuuuuaaucccguuauggacucugucuccaggagagg

SEQ ID NO: 409200 - RNA, 64 nt, Human
augaauuuaauaauaaacuaaacuuuuuuuugucucccguuauugaaaaguaccaaagcuucuu

SEQ ID NO: 409201 - RNA, 64 nt, Human
guggagaugagugauugagugagguagauugcugucccguuaacauagugcugaaaccaaaggc

SEQ ID NO: 409202 - RNA, 64 nt, Human; identical to SEQ ID NO: 90365

SEQ ID NO: 409203 - RNA, 64 nt, Human; identical to SEQ ID NO: 90366

SEQ ID NO: 409204 - RNA, 64 nt, Human; identical to SEQ ID NO: 90367

SEQ ID NO: 409205 - RNA, 64 nt, Human
cuaauuugaaagccaaguguuaagucggauguuuucccguuacacuacuacucagcccucuccu

SEQ ID NO: 409206 - RNA, 64 nt, Human
gggaagcaauauagcuuccauucuaaggcuguauucccguuaugaauuacuagcugauuacagu

SEQ ID NO: 409207 - RNA, 64 nt, Human
gaagcaugagacccgcccacacuagccucuguguucccguuagggacaucacacccugucucac

SEQ ID NO: 409208 - RNA, 64 nt, Human
acuuucuaauguuuaaaucccauaaagcuaaguuucccguuaaagggaagugcuuugaagaugu

SEQ ID NO: 409209 - RNA, 64 nt, Human
ucauuugaaaggacuuggcccuguucuugggucuucccguuaccugcccccugggugguaaguu

SEQ ID NO: 409210 - RNA, 64 nt, Human
uucuagggaagguaggucgguuuccauguuucccucccguuauuuuuauuuuuuacuuuuugcc

SEQ ID NO: 409211 - RNA, 64 nt, Human
ggggaaaaaaguuuguaauuauuucauccaaaucucccguuauauaucugugaauaauaagaga

SEQ ID NO: 409212 - RNA, 64 nt, Human
uaacgugucugagagccauaaaugaccuaacguuucccguuagucucugaacuaggugaucuca

SEQ ID NO: 409213 - RNA, 64 nt, Human
uccuuaagaaguauuuccuuuccuuuuuauauagucccguuaggguuuaaaaccauauugauca

SEQ ID NO: 409214 - RNA, 64 nt, Human
uuuaccacuaacuagcuguguggccuugaguaaaucccguuaccucucugagccucgguuaccc

SEQ ID NO: 409215 - RNA, 64 nt, Human
uuuuuuucuauuaaaauacucaugcauuuaaccuucccguuauucaaccagucucuugguugca

SEQ ID NO: 409216 - RNA, 64 nt, Human
ccacuagcccagguugcugugagucagcggaagcucccguuaugcccuuugcuccuggugggag

SEQ ID NO: 409217 - RNA, 64 nt, Human
caacuucccagugaucuguucaguuaaguucuucucccguuaaccaggaagugcuuauucucuc

SEQ ID NO: 409218 - RNA, 64 nt, Human
ucaggcuccagggacuuguggggugggaggggcuucccguuauccacgaggauuuguggguguc

SEQ ID NO: 409219 - RNA, 64 nt, Human
ccgucaauucucaggaaaguuuugcaggaaucucucccguuacuugaaaccugggcggacagau

SEQ ID NO: 409220 - RNA, 64 nt, Human; identical to SEQ ID NO: 90368

SEQ ID NO: 409221 - RNA, 64 nt, Human; identical to SEQ ID NO: 90369

SEQ ID NO: 409222 - RNA, 54 nt, Human; identical to SEQ ID NO: 23168

SEQ ID NO: 409223 - RNA, 64 nt, Human
aguuuuuguuaaacccuuuguaaaauaccaagguucccguuaacaaauuacggccucugcuugc

SEQ ID NO: 409224 - RNA, 64 nt, Human
agcuacuugggauauauauuuaauuuucuuaaauucccguuaaacucuauuuuaugguuuugau

SEQ ID NO: 409225 - RNA, 64 nt, Human
auugauuuuucccucacgaugaugaacaauuaucucccguuacucaccuagcaguaucuaacug

SEQ ID NO: 409226 - RNA, 64 nt, Human
cucugcucaggccuggaagugaaagccgccuccuucccguuaugccccccauacaggagccucg

SEQ ID NO: 409227 - RNA, 64 nt, Human
auugaaguuuacauuuccaugugcuguugaucaacggcgccaccuguguuugcugagacugguc

SEQ ID NO: 409228 - RNA, 64 nt, Human
ugauccugcugucaccccgaccucuggcaggagccggcgccaguaggaaagaccuccuuccuaa

SEQ ID NO: 409229 - RNA, 64 nt, Human
aagauccagaaaggaaaauaaagaagaagggcuucggcgccaugcugagguaugggccugcuuu

SEQ ID NO: 409230 - RNA, 64 nt, Human
ccaggccgccugcagccugccccugugaucccuucggcgccagcagcuccaaaacuggaccacc

SEQ ID NO: 409231 - RNA, 64 nt, Human
cgcgcaggggcccguggcuugguuucacgcgcagcggcgccagacccugcaggagggcggcgug

SEQ ID NO: 409232 - RNA, 64 nt, Human
ccaucaacuccagucucggcagcagcuccgcucccggcgccacccaccgacacccccagaaccc

SEQ ID NO: 409233 - RNA, 64 nt, Human
cgugaacagccgugccugccuugggcgcagccuccggcgccagagcugggcucuucaacacggc

SEQ ID NO: 409234 - RNA, 64 nt, Human; identical to SEQ ID NO: 90371

SEQ ID NO: 409235 - RNA, 64 nt, Human; identical to SEQ ID NO: 90372

SEQ ID NO: 409236 - RNA, 64 nt, Human; identical to SEQ ID NO: 90373

SEQ ID NO: 409237 - RNA, 64 nt, Human
cccgaaucugucuugaccugcaggaauacacgggcggcgccaggcauuaccucacagcgggacu

SEQ ID NO: 409238 - RNA, 64 nt, Human
gccgccgaccugugacucgcuugagaugggaaagcggcgccacagaccccgggucuccuuggcu

SEQ ID NO: 409239 - RNA, 64 nt, Human
uagugauguccucucaaagugcuguacgcgagcucggcgccaccuccgccucccuuucagagcc

SEQ ID NO: 409240 - RNA, 64 nt, Human
gcuggagcucuugcccgaagccugaagcuuccuucggcgccaugcagggguugggguugggacu

SEQ ID NO: 409241 - RNA, 64 nt, Human
cggaagugagcaaaacugccgcaagucugcagcccggcgccaccauccugcagccuccuccuga

SEQ ID NO: 409242 - RNA, 64 nt, Human
gcaucucgggcugggggcccaccccucucugugccggcgccaccaaccccacccacacugcugc

SEQ ID NO: 409243 - RNA, 64 nt, Human
guggcaacagcaggaguuaauagcagaguugaggcggcgccaggccaaggaacaccggccuguu

SEQ ID NO: 409244 - RNA, 64 nt, Human
acuccugcuucucucagccagcuguuuaagccugcggcgccagccucacggagggccgugugac

SEQ ID NO: 409245 - RNA, 64 nt, Human
ccacccuccgcaccguccccuccugagcagcacucggcgccagcagccucugccagaguggaag

SEQ ID NO: 409246 - RNA, 64 nt, Human
ugcucauuaagugccugccugcccgcccaccccucggcgccaugcucccgcgugggcagcgggc

SEQ ID NO: 409247 - RNA, 64 nt, Human
ugacaaaggcggcuucugcgucgucacugcuucccggcgccauuccgaggccgggccuucuucu

SEQ ID NO: 409248 - RNA, 64 nt, Human
gggaagaggcgagagggcuguggaggagcucgcacggcgccaggugaugggcugcacaggcacu

SEQ ID NO: 409249 - RNA, 64 nt, Human
gcugcagcccguggggccucagagcugaaagcugcggcgccacuggugccagagucagauguca

SEQ ID NO: 409250 - RNA, 55 nt, Human
ucaaccugaggcauuacugaagccccggcgccaccagcugcgcggucuuacuccc

SEQ ID NO: 409251 - RNA, 64 nt, Human
aaacccccuuuuccccaagcugcccauggggcuucggcgccaaaggugacccgcgccaaccucc

SEQ ID NO: 409252 - RNA, 64 nt, Human
gcgccacacggcacccacagacugggugccccggcggcgccacgcuuggcuggucagcgcugca

SEQ ID NO: 409253 - RNA, 64 nt, Human; identical to SEQ ID NO: 90374

SEQ ID NO: 409254 - RNA, 64 nt, Human; identical to SEQ ID NO: 90375

SEQ ID NO: 409255 - RNA, 64 nt, Human; identical to SEQ ID NO: 90376

SEQ ID NO: 409256 - RNA, 64 nt, Human
cgggacucuggucugcuguggggggcaugcaggacggcgccacucucugcccugccaugcggcu

SEQ ID NO: 409257 - RNA, 64 nt, Human
agacuggagagcagccagcaggugcccggcagcucggcgccacggcuugcugacagcugggagg

SEQ ID NO: 409258 - RNA, 64 nt, Human
gagccccugcugccagggcggugucugagccugccggcgccaccugggccccggcccuugaggu

SEQ ID NO: 409259 - RNA, 64 nt, Human
gcgccaggagccuggacccggccucccggggcugcggcgccaccgagcccggcaaaugcgcacg

SEQ ID NO: 409260 - RNA, 64 nt, Human
gcucgaagaccccaagacagcccucugcucucagcggcgccacagagagccugggcucagccuu

SEQ ID NO: 409261 - RNA, 64 nt, Human; identical to SEQ ID NO: 90377

SEQ ID NO: 409262 - RNA, 64 nt, Human; identical to SEQ ID NO: 90378

SEQ ID NO: 409263 - RNA, 64 nt, Human; identical to SEQ ID NO: 90379

SEQ ID NO: 409264 - RNA, 64 nt, Human; identical to SEQ ID NO: 90380

SEQ ID NO: 409265 - RNA, 64 nt, Human; identical to SEQ ID NO: 90381

SEQ ID NO: 409266 - RNA, 64 nt, Human; identical to SEQ ID NO: 90382

SEQ ID NO: 409267 - RNA, 64 nt, Human; identical to SEQ ID NO: 90383

SEQ ID NO: 409268 - RNA, 64 nt, Human; identical to SEQ ID NO: 90384

SEQ ID NO: 409269 - RNA, 64 nt, Human; identical to SEQ ID NO: 90385

SEQ ID NO: 409270 - RNA, 64 nt, Human; identical to SEQ ID NO: 90386

SEQ ID NO: 409271 - RNA, 64 nt, Human; identical to SEQ ID NO: 90387

SEQ ID NO: 409272 - RNA, 57 nt, Human; identical to SEQ ID NO: 23186

SEQ ID NO: 409273 - RNA, 64 nt, Human; identical to SEQ ID NO: 90389

SEQ ID NO: 409274 - RNA, 51 nt, Human; identical to SEQ ID NO: 23188

SEQ ID NO: 409275 - RNA, 64 nt, Human; identical to SEQ ID NO: 90391

SEQ ID NO: 409276 - RNA, 64 nt, Human; identical to SEQ ID NO: 90393

SEQ ID NO: 409277 - RNA, 64 nt, Human; identical to SEQ ID NO: 90394

SEQ ID NO: 409278 - RNA, 64 nt, Human; identical to SEQ ID NO: 90395

SEQ ID NO: 409279 - RNA, 64 nt, Human; identical to SEQ ID NO: 90396

SEQ ID NO: 409280 - RNA, 64 nt, Human; identical to SEQ ID NO: 90397

SEQ ID NO: 409281 - RNA, 64 nt, Human; identical to SEQ ID NO: 90398

SEQ ID NO: 409282 - RNA, 64 nt, Human; identical to SEQ ID NO: 90399

SEQ ID NO: 409283 - RNA, 64 nt, Human; identical to SEQ ID NO: 90400

SEQ ID NO: 409284 - RNA, 64 nt, Human; identical to SEQ ID NO: 90401

SEQ ID NO: 409285 - RNA, 64 nt, Human; identical to SEQ ID NO: 90402

SEQ ID NO: 409286 - RNA, 64 nt, Human; identical to SEQ ID NO: 90403

SEQ ID NO: 409287 - RNA, 64 nt, Human; identical to SEQ ID NO: 90404

SEQ ID NO: 409288 - RNA, 64 nt, Human; identical to SEQ ID NO: 90405

SEQ ID NO: 409289 - RNA, 64 nt, Human; identical to SEQ ID NO: 90406

SEQ ID NO: 409290 - RNA, 64 nt, Human; identical to SEQ ID NO: 90407

SEQ ID NO: 409291 - RNA, 64 nt, Human; identical to SEQ ID NO: 90408

SEQ ID NO: 409292 - RNA, 64 nt, Human; identical to SEQ ID NO: 90409

SEQ ID NO: 409293 - RNA, 64 nt, Human; identical to SEQ ID NO: 90410

SEQ ID NO: 409294 - RNA, 64 nt, Human; identical to SEQ ID NO: 90411

SEQ ID NO: 409295 - RNA, 64 nt, Human; identical to SEQ ID NO: 90412

SEQ ID NO: 409296 - RNA, 64 nt, Human; identical to SEQ ID NO: 90413

SEQ ID NO: 409297 - RNA, 63 nt, Human; identical to SEQ ID NO: 90414

SEQ ID NO: 409298 - RNA, 64 nt, Human; identical to SEQ ID NO: 90415

SEQ ID NO: 409299 - RNA, 64 nt, Human; identical to SEQ ID NO: 90416

SEQ ID NO: 409300 - RNA, 64 nt, Human; identical to SEQ ID NO: 90417

SEQ ID NO: 409301 - RNA, 64 nt, Human; identical to SEQ ID NO: 90418

SEQ ID NO: 409302 - RNA, 64 nt, Human; identical to SEQ ID NO: 90419

SEQ ID NO: 409303 - RNA, 64 nt, Human; identical to SEQ ID NO: 90420

SEQ ID NO: 409304 - RNA, 64 nt, Human; identical to SEQ ID NO: 90421

SEQ ID NO: 409305 - RNA, 64 nt, Human; identical to SEQ ID NO: 90422

SEQ ID NO: 409306 - RNA, 64 nt, Human; identical to SEQ ID NO: 90423

SEQ ID NO: 409307 - RNA, 64 nt, Human; identical to SEQ ID NO: 90424

SEQ ID NO: 409308 - RNA, 64 nt, Human; identical to SEQ ID NO: 90425

SEQ ID NO: 409309 - RNA, 64 nt, Human; identical to SEQ ID NO: 90426

SEQ ID NO: 409310 - RNA, 64 nt, Human; identical to SEQ ID NO: 90427

SEQ ID NO: 409311 - RNA, 64 nt, Human; identical to SEQ ID NO: 90428

SEQ ID NO: 409312 - RNA, 64 nt, Human; identical to SEQ ID NO: 90429

SEQ ID NO: 409313 - RNA, 64 nt, Human; identical to SEQ ID NO: 90430

SEQ ID NO: 409314 - RNA, 64 nt, Human; identical to SEQ ID NO: 90431

SEQ ID NO: 409315 - RNA, 63 nt, Human; identical to SEQ ID NO: 393194

SEQ ID NO: 409316 - RNA, 63 nt, Human; identical to SEQ ID NO: 393195

SEQ ID NO: 409317 - RNA, 63 nt, Human; identical to SEQ ID NO: 393196

SEQ ID NO: 409318 - RNA, 63 nt, Human; identical to SEQ ID NO: 393197

SEQ ID NO: 409319 - RNA, 63 nt, Human; identical to SEQ ID NO: 393198

SEQ ID NO: 409320 - RNA, 63 nt, Human; identical to SEQ ID NO: 393199

SEQ ID NO: 409321 - RNA, 63 nt, Human; identical to SEQ ID NO: 393200

SEQ ID NO: 409322 - RNA, 63 nt, Human; identical to SEQ ID NO: 393201

SEQ ID NO: 409323 - RNA, 63 nt, Human; identical to SEQ ID NO: 393202

SEQ ID NO: 409324 - RNA, 63 nt, Human; identical to SEQ ID NO: 393203

SEQ ID NO: 409325 - RNA, 63 nt, Human; identical to SEQ ID NO: 393204

SEQ ID NO: 409326 - RNA, 63 nt, Human; identical to SEQ ID NO: 393205

SEQ ID NO: 409327 - RNA, 63 nt, Human; identical to SEQ ID NO: 393206

SEQ ID NO: 409328 - RNA, 63 nt, Human; identical to SEQ ID NO: 393207

SEQ ID NO: 409329 - RNA, 63 nt, Human; identical to SEQ ID NO: 393208

SEQ ID NO: 409330 - RNA, 63 nt, Human; identical to SEQ ID NO: 393209

SEQ ID NO: 409331 - RNA, 63 nt, Human; identical to SEQ ID NO: 393210

SEQ ID NO: 409332 - RNA, 63 nt, Human; identical to SEQ ID NO: 393211

SEQ ID NO: 409333 - RNA, 63 nt, Human; identical to SEQ ID NO: 393212

SEQ ID NO: 409334 - RNA, 63 nt, Human; identical to SEQ ID NO: 393213

SEQ ID NO: 409335 - RNA, 63 nt, Human; identical to SEQ ID NO: 393214

SEQ ID NO: 409336 - RNA, 63 nt, Human; identical to SEQ ID NO: 393215

SEQ ID NO: 409337 - RNA, 63 nt, Human; identical to SEQ ID NO: 393216

SEQ ID NO: 409338 - RNA, 63 nt, Human; identical to SEQ ID NO: 393217

SEQ ID NO: 409339 - RNA, 63 nt, Human; identical to SEQ ID NO: 393218

SEQ ID NO: 409340 - RNA, 63 nt, Human; identical to SEQ ID NO: 393219

SEQ ID NO: 409341 - RNA, 63 nt, Human; identical to SEQ ID NO: 393220

SEQ ID NO: 409342 - RNA, 63 nt, Human; identical to SEQ ID NO: 393221

SEQ ID NO: 409343 - RNA, 63 nt, Human; identical to SEQ ID NO: 393222

SEQ ID NO: 409344 - RNA, 63 nt, Human; identical to SEQ ID NO: 393223

SEQ ID NO: 409345 - RNA, 63 nt, Human; identical to SEQ ID NO: 393224

SEQ ID NO: 409346 - RNA, 63 nt, Human; identical to SEQ ID NO: 393225

SEQ ID NO: 409347 - RNA, 63 nt, Human; identical to SEQ ID NO: 393226

SEQ ID NO: 409348 - RNA, 63 nt, Human; identical to SEQ ID NO: 393227

SEQ ID NO: 409349 - RNA, 63 nt, Human; identical to SEQ ID NO: 393228

SEQ ID NO: 409350 - RNA, 63 nt, Human; identical to SEQ ID NO: 393229

SEQ ID NO: 409351 - RNA, 63 nt, Human; identical to SEQ ID NO: 393230

SEQ ID NO: 409352 - RNA, 63 nt, Human; identical to SEQ ID NO: 393231

SEQ ID NO: 409353 - RNA, 63 nt, Human; identical to SEQ ID NO: 393232

SEQ ID NO: 409354 - RNA, 63 nt, Human; identical to SEQ ID NO: 393233

SEQ ID NO: 409355 - RNA, 63 nt, Human; identical to SEQ ID NO: 393234

SEQ ID NO: 409356 - RNA, 63 nt, Human; identical to SEQ ID NO: 393235

SEQ ID NO: 409357 - RNA, 63 nt, Human; identical to SEQ ID NO: 393236

SEQ ID NO: 409358 - RNA, 63 nt, Human; identical to SEQ ID NO: 393237

SEQ ID NO: 409359 - RNA, 63 nt, Human; identical to SEQ ID NO: 393238

SEQ ID NO: 409360 - RNA, 63 nt, Human; identical to SEQ ID NO: 393239

SEQ ID NO: 409361 - RNA, 63 nt, Human; identical to SEQ ID NO: 393240

SEQ ID NO: 409362 - RNA, 63 nt, Human; identical to SEQ ID NO: 393241

SEQ ID NO: 409363 - RNA, 63 nt, Human; identical to SEQ ID NO: 393242

SEQ ID NO: 409364 - RNA, 63 nt, Human; identical to SEQ ID NO: 393243

SEQ ID NO: 409365 - RNA, 63 nt, Human; identical to SEQ ID NO: 393244

SEQ ID NO: 409366 - RNA, 63 nt, Human; identical to SEQ ID NO: 393245

SEQ ID NO: 409367 - RNA, 63 nt, Human; identical to SEQ ID NO: 393246

SEQ ID NO: 409368 - RNA, 63 nt, Human; identical to SEQ ID NO: 393247

SEQ ID NO: 409369 - RNA, 63 nt, Human; identical to SEQ ID NO: 393248

SEQ ID NO: 409370 - RNA, 63 nt, Human; identical to SEQ ID NO: 393249

SEQ ID NO: 409371 - RNA, 63 nt, Human; identical to SEQ ID NO: 393250

SEQ ID NO: 409372 - RNA, 63 nt, Human; identical to SEQ ID NO: 393251

SEQ ID NO: 409373 - RNA, 63 nt, Human; identical to SEQ ID NO: 393252

SEQ ID NO: 409374 - RNA, 63 nt, Human; identical to SEQ ID NO: 393253

SEQ ID NO: 409375 - RNA, 63 nt, Human; identical to SEQ ID NO: 393254

SEQ ID NO: 409376 - RNA, 63 nt, Human; identical to SEQ ID NO: 393255

SEQ ID NO: 409377 - RNA, 63 nt, Human; identical to SEQ ID NO: 393256

SEQ ID NO: 409378 - RNA, 63 nt, Human; identical to SEQ ID NO: 393257

SEQ ID NO: 409379 - RNA, 63 nt, Human; identical to SEQ ID NO: 393258

SEQ ID NO: 409380 - RNA, 63 nt, Human; identical to SEQ ID NO: 393259

SEQ ID NO: 409381 - RNA, 63 nt, Human; identical to SEQ ID NO: 393260

SEQ ID NO: 409382 - RNA, 63 nt, Human; identical to SEQ ID NO: 393261

SEQ ID NO: 409383 - RNA, 63 nt, Human; identical to SEQ ID NO: 393262

SEQ ID NO: 409384 - RNA, 63 nt, Human; identical to SEQ ID NO: 393263

SEQ ID NO: 409385 - RNA, 63 nt, Human; identical to SEQ ID NO: 393264

SEQ ID NO: 409386 - RNA, 63 nt, Human; identical to SEQ ID NO: 393265

SEQ ID NO: 409387 - RNA, 63 nt, Human; identical to SEQ ID NO: 393266

SEQ ID NO: 409388 - RNA, 63 nt, Human; identical to SEQ ID NO: 393267

SEQ ID NO: 409389 - RNA, 63 nt, Human; identical to SEQ ID NO: 393268

SEQ ID NO: 409390 - RNA, 63 nt, Human; identical to SEQ ID NO: 393269

SEQ ID NO: 409391 - RNA, 63 nt, Human; identical to SEQ ID NO: 393270

SEQ ID NO: 409392 - RNA, 63 nt, Human; identical to SEQ ID NO: 393271

SEQ ID NO: 409393 - RNA, 63 nt, Human; identical to SEQ ID NO: 393272

SEQ ID NO: 409394 - RNA, 63 nt, Human; identical to SEQ ID NO: 393273

SEQ ID NO: 409395 - RNA, 63 nt, Human; identical to SEQ ID NO: 393274

SEQ ID NO: 409396 - RNA, 63 nt, Human; identical to SEQ ID NO: 393275

SEQ ID NO: 409397 - RNA, 63 nt, Human; identical to SEQ ID NO: 393276

SEQ ID NO: 409398 - RNA, 63 nt, Human; identical to SEQ ID NO: 393277

SEQ ID NO: 409399 - RNA, 63 nt, Human; identical to SEQ ID NO: 393278

SEQ ID NO: 409400 - RNA, 63 nt, Human; identical to SEQ ID NO: 393279

SEQ ID NO: 409401 - RNA, 63 nt, Human; identical to SEQ ID NO: 393280

SEQ ID NO: 409402 - RNA, 63 nt, Human; identical to SEQ ID NO: 393281

SEQ ID NO: 409403 - RNA, 63 nt, Human; identical to SEQ ID NO: 393282

SEQ ID NO: 409404 - RNA, 63 nt, Human; identical to SEQ ID NO: 393283

SEQ ID NO: 409405 - RNA, 63 nt, Human; identical to SEQ ID NO: 393284

SEQ ID NO: 409406 - RNA, 63 nt, Human; identical to SEQ ID NO: 393285

SEQ ID NO: 409407 - RNA, 63 nt, Human; identical to SEQ ID NO: 393286

SEQ ID NO: 409408 - RNA, 63 nt, Human; identical to SEQ ID NO: 393287

SEQ ID NO: 409409 - RNA, 63 nt, Human; identical to SEQ ID NO: 393288

SEQ ID NO: 409410 - RNA, 63 nt, Human; identical to SEQ ID NO: 393289

SEQ ID NO: 409411 - RNA, 63 nt, Human; identical to SEQ ID NO: 393290

SEQ ID NO: 409412 - RNA, 63 nt, Human; identical to SEQ ID NO: 393291

SEQ ID NO: 409413 - RNA, 63 nt, Human; identical to SEQ ID NO: 393292

SEQ ID NO: 409414 - RNA, 63 nt, Human; identical to SEQ ID NO: 393293

SEQ ID NO: 409415 - RNA, 63 nt, Human; identical to SEQ ID NO: 393294

SEQ ID NO: 409416 - RNA, 63 nt, Human; identical to SEQ ID NO: 393295

SEQ ID NO: 409417 - RNA, 63 nt, Human; identical to SEQ ID NO: 393296

SEQ ID NO: 409418 - RNA, 63 nt, Human; identical to SEQ ID NO: 393297

SEQ ID NO: 409419 - RNA, 63 nt, Human; identical to SEQ ID NO: 393298

SEQ ID NO: 409420 - RNA, 63 nt, Human; identical to SEQ ID NO: 393299

SEQ ID NO: 409421 - RNA, 63 nt, Human; identical to SEQ ID NO: 82280

SEQ ID NO: 409422 - RNA, 63 nt, Human; identical to SEQ ID NO: 393301

SEQ ID NO: 409423 - RNA, 63 nt, Human; identical to SEQ ID NO: 393302

SEQ ID NO: 409424 - RNA, 63 nt, Human; identical to SEQ ID NO: 393303

SEQ ID NO: 409425 - RNA, 63 nt, Human; identical to SEQ ID NO: 393304

SEQ ID NO: 409426 - RNA, 63 nt, Human; identical to SEQ ID NO: 393305

SEQ ID NO: 409427 - RNA, 63 nt, Human; identical to SEQ ID NO: 393306

SEQ ID NO: 409428 - RNA, 63 nt, Human; identical to SEQ ID NO: 393307

SEQ ID NO: 409429 - RNA, 63 nt, Human; identical to SEQ ID NO: 393308

SEQ ID NO: 409430 - RNA, 63 nt, Human; identical to SEQ ID NO: 393309

SEQ ID NO: 409431 - RNA, 63 nt, Human; identical to SEQ ID NO: 393310

SEQ ID NO: 409432 - RNA, 63 nt, Human; identical to SEQ ID NO: 393311

SEQ ID NO: 409433 - RNA, 63 nt, Human; identical to SEQ ID NO: 393312

SEQ ID NO: 409434 - RNA, 63 nt, Human; identical to SEQ ID NO: 393313

SEQ ID NO: 409435 - RNA, 63 nt, Human; identical to SEQ ID NO: 393314

SEQ ID NO: 409436 - RNA, 63 nt, Human; identical to SEQ ID NO: 393315

SEQ ID NO: 409437 - RNA, 63 nt, Human; identical to SEQ ID NO: 393316

SEQ ID NO: 409438 - RNA, 63 nt, Human; identical to SEQ ID NO: 393317

SEQ ID NO: 409439 - RNA, 63 nt, Human; identical to SEQ ID NO: 393318

SEQ ID NO: 409440 - RNA, 63 nt, Human; identical to SEQ ID NO: 393319

SEQ ID NO: 409441 - RNA, 63 nt, Human; identical to SEQ ID NO: 393320

SEQ ID NO: 409442 - RNA, 63 nt, Human; identical to SEQ ID NO: 393321

SEQ ID NO: 409443 - RNA, 63 nt, Human; identical to SEQ ID NO: 393322

SEQ ID NO: 409444 - RNA, 63 nt, Human; identical to SEQ ID NO: 393323

SEQ ID NO: 409445 - RNA, 63 nt, Human; identical to SEQ ID NO: 393324

SEQ ID NO: 409446 - RNA, 63 nt, Human; identical to SEQ ID NO: 393325

SEQ ID NO: 409447 - RNA, 63 nt, Human; identical to SEQ ID NO: 393326

SEQ ID NO: 409448 - RNA, 63 nt, Human; identical to SEQ ID NO: 393327

SEQ ID NO: 409449 - RNA, 63 nt, Human; identical to SEQ ID NO: 393328

SEQ ID NO: 409450 - RNA, 63 nt, Human; identical to SEQ ID NO: 393329

SEQ ID NO: 409451 - RNA, 63 nt, Human; identical to SEQ ID NO: 393330

SEQ ID NO: 409452 - RNA, 63 nt, Human; identical to SEQ ID NO: 393331

SEQ ID NO: 409453 - RNA, 63 nt, Human; identical to SEQ ID NO: 393332

SEQ ID NO: 409454 - RNA, 63 nt, Human; identical to SEQ ID NO: 393333

SEQ ID NO: 409455 - RNA, 63 nt, Human; identical to SEQ ID NO: 393334

SEQ ID NO: 409456 - RNA, 63 nt, Human; identical to SEQ ID NO: 393335

SEQ ID NO: 409457 - RNA, 63 nt, Human; identical to SEQ ID NO: 393336

SEQ ID NO: 409458 - RNA, 63 nt, Human; identical to SEQ ID NO: 393337

SEQ ID NO: 409459 - RNA, 63 nt, Human; identical to SEQ ID NO: 393338

SEQ ID NO: 409460 - RNA, 63 nt, Human; identical to SEQ ID NO: 393339

SEQ ID NO: 409461 - RNA, 63 nt, Human; identical to SEQ ID NO: 393340

SEQ ID NO: 409462 - RNA, 63 nt, Human; identical to SEQ ID NO: 393341

SEQ ID NO: 409463 - RNA, 63 nt, Human; identical to SEQ ID NO: 393342

SEQ ID NO: 409464 - RNA, 63 nt, Human; identical to SEQ ID NO: 393343

SEQ ID NO: 409465 - RNA, 63 nt, Human; identical to SEQ ID NO: 393344

SEQ ID NO: 409466 - RNA, 63 nt, Human; identical to SEQ ID NO: 393345

SEQ ID NO: 409467 - RNA, 63 nt, Human; identical to SEQ ID NO: 393346

SEQ ID NO: 409468 - RNA, 63 nt, Human; identical to SEQ ID NO: 393347

SEQ ID NO: 409469 - RNA, 63 nt, Human; identical to SEQ ID NO: 393348

SEQ ID NO: 409470 - RNA, 63 nt, Human; identical to SEQ ID NO: 393349

SEQ ID NO: 409471 - RNA, 63 nt, Human; identical to SEQ ID NO: 393350

SEQ ID NO: 409472 - RNA, 63 nt, Human; identical to SEQ ID NO: 393351

SEQ ID NO: 409473 - RNA, 63 nt, Human; identical to SEQ ID NO: 393352

SEQ ID NO: 409474 - RNA, 63 nt, Human; identical to SEQ ID NO: 393353

SEQ ID NO: 409475 - RNA, 63 nt, Human; identical to SEQ ID NO: 393354

SEQ ID NO: 409476 - RNA, 63 nt, Human; identical to SEQ ID NO: 393355

SEQ ID NO: 409477 - RNA, 63 nt, Human; identical to SEQ ID NO: 393356

SEQ ID NO: 409478 - RNA, 63 nt, Human; identical to SEQ ID NO: 393357

SEQ ID NO: 409479 - RNA, 63 nt, Human; identical to SEQ ID NO: 393358

SEQ ID NO: 409480 - RNA, 63 nt, Human; identical to SEQ ID NO: 393359

SEQ ID NO: 409481 - RNA, 63 nt, Human; identical to SEQ ID NO: 393360

SEQ ID NO: 409482 - RNA, 56 nt, Human; identical to SEQ ID NO: 78858

SEQ ID NO: 409483 - RNA, 63 nt, Human; identical to SEQ ID NO: 393362

SEQ ID NO: 409484 - RNA, 63 nt, Human; identical to SEQ ID NO: 393363

SEQ ID NO: 409485 - RNA, 63 nt, Human; identical to SEQ ID NO: 393364

SEQ ID NO: 409486 - RNA, 63 nt, Human; identical to SEQ ID NO: 393365

SEQ ID NO: 409487 - RNA, 63 nt, Human; identical to SEQ ID NO: 393366

SEQ ID NO: 409488 - RNA, 63 nt, Human; identical to SEQ ID NO: 393367

SEQ ID NO: 409489 - RNA, 63 nt, Human; identical to SEQ ID NO: 393368

SEQ ID NO: 409490 - RNA, 55 nt, Human; identical to SEQ ID NO: 78866

SEQ ID NO: 409491 - RNA, 63 nt, Human; identical to SEQ ID NO: 393370

SEQ ID NO: 409492 - RNA, 63 nt, Human; identical to SEQ ID NO: 393371

SEQ ID NO: 409493 - RNA, 63 nt, Human; identical to SEQ ID NO: 393372

SEQ ID NO: 409494 - RNA, 63 nt, Human; identical to SEQ ID NO: 393373

SEQ ID NO: 409495 - RNA, 63 nt, Human; identical to SEQ ID NO: 393374

SEQ ID NO: 409496 - RNA, 63 nt, Human; identical to SEQ ID NO: 393375

SEQ ID NO: 409497 - RNA, 62 nt, Human; identical to SEQ ID NO: 82356

SEQ ID NO: 409498 - RNA, 63 nt, Human; identical to SEQ ID NO: 393377

SEQ ID NO: 409499 - RNA, 63 nt, Human; identical to SEQ ID NO: 393378

SEQ ID NO: 409500 - RNA, 63 nt, Human; identical to SEQ ID NO: 393379

SEQ ID NO: 409501 - RNA, 63 nt, Human; identical to SEQ ID NO: 393380

SEQ ID NO: 409502 - RNA, 63 nt, Human; identical to SEQ ID NO: 393381

SEQ ID NO: 409503 - RNA, 63 nt, Human; identical to SEQ ID NO: 393382

SEQ ID NO: 409504 - RNA, 63 nt, Human; identical to SEQ ID NO: 393383

SEQ ID NO: 409505 - RNA, 63 nt, Human; identical to SEQ ID NO: 393384

SEQ ID NO: 409506 - RNA, 63 nt, Human; identical to SEQ ID NO: 393385

SEQ ID NO: 409507 - RNA, 63 nt, Human; identical to SEQ ID NO: 393386

SEQ ID NO: 409508 - RNA, 63 nt, Human; identical to SEQ ID NO: 393387

SEQ ID NO: 409509 - RNA, 63 nt, Human; identical to SEQ ID NO: 393388

SEQ ID NO: 409510 - RNA, 63 nt, Human; identical to SEQ ID NO: 393389

SEQ ID NO: 409511 - RNA, 63 nt, Human; identical to SEQ ID NO: 393390

SEQ ID NO: 409512 - RNA, 63 nt, Human; identical to SEQ ID NO: 393391

SEQ ID NO: 409513 - RNA, 63 nt, Human; identical to SEQ ID NO: 393392

SEQ ID NO: 409514 - RNA, 63 nt, Human; identical to SEQ ID NO: 393393

SEQ ID NO: 409515 - RNA, 63 nt, Human; identical to SEQ ID NO: 393394

SEQ ID NO: 409516 - RNA, 63 nt, Human; identical to SEQ ID NO: 393395

SEQ ID NO: 409517 - RNA, 63 nt, Human; identical to SEQ ID NO: 393396

SEQ ID NO: 409518 - RNA, 63 nt, Human; identical to SEQ ID NO: 393397

SEQ ID NO: 409519 - RNA, 63 nt, Human; identical to SEQ ID NO: 393398

SEQ ID NO: 409520 - RNA, 63 nt, Human; identical to SEQ ID NO: 393399

SEQ ID NO: 409521 - RNA, 63 nt, Human; identical to SEQ ID NO: 393400

SEQ ID NO: 409522 - RNA, 63 nt, Human; identical to SEQ ID NO: 393401

SEQ ID NO: 409523 - RNA, 63 nt, Human; identical to SEQ ID NO: 393402

SEQ ID NO: 409524 - RNA, 63 nt, Human; identical to SEQ ID NO: 393403

SEQ ID NO: 409525 - RNA, 63 nt, Human; identical to SEQ ID NO: 393404

SEQ ID NO: 409526 - RNA, 63 nt, Human; identical to SEQ ID NO: 393405

SEQ ID NO: 409527 - RNA, 63 nt, Human; identical to SEQ ID NO: 393406

SEQ ID NO: 409528 - RNA, 63 nt, Human; identical to SEQ ID NO: 393407

SEQ ID NO: 409529 - RNA, 63 nt, Human; identical to SEQ ID NO: 393408

SEQ ID NO: 409530 - RNA, 63 nt, Human; identical to SEQ ID NO: 393409

SEQ ID NO: 409531 - RNA, 62 nt, Human; identical to SEQ ID NO: 82390

SEQ ID NO: 409532 - RNA, 63 nt, Human; identical to SEQ ID NO: 393411

SEQ ID NO: 409533 - RNA, 63 nt, Human; identical to SEQ ID NO: 393412

SEQ ID NO: 409534 - RNA, 63 nt, Human; identical to SEQ ID NO: 393413

SEQ ID NO: 409535 - RNA, 63 nt, Human; identical to SEQ ID NO: 393414

SEQ ID NO: 409536 - RNA, 63 nt, Human; identical to SEQ ID NO: 393415

SEQ ID NO: 409537 - RNA, 63 nt, Human; identical to SEQ ID NO: 393416

SEQ ID NO: 409538 - RNA, 63 nt, Human; identical to SEQ ID NO: 393417

SEQ ID NO: 409539 - RNA, 63 nt, Human; identical to SEQ ID NO: 393418

SEQ ID NO: 409540 - RNA, 63 nt, Human; identical to SEQ ID NO: 393419

SEQ ID NO: 409541 - RNA, 63 nt, Human; identical to SEQ ID NO: 393420

SEQ ID NO: 409542 - RNA, 63 nt, Human; identical to SEQ ID NO: 393421

SEQ ID NO: 409543 - RNA, 63 nt, Human; identical to SEQ ID NO: 393422

SEQ ID NO: 409544 - RNA, 63 nt, Human; identical to SEQ ID NO: 393423

SEQ ID NO: 409545 - RNA, 63 nt, Human; identical to SEQ ID NO: 393424

SEQ ID NO: 409546 - RNA, 52 nt, Human; identical to SEQ ID NO: 78922

SEQ ID NO: 409547 - RNA, 63 nt, Human; identical to SEQ ID NO: 393426

SEQ ID NO: 409548 - RNA, 63 nt, Human; identical to SEQ ID NO: 393427

SEQ ID NO: 409549 - RNA, 63 nt, Human; identical to SEQ ID NO: 393428

SEQ ID NO: 409550 - RNA, 63 nt, Human; identical to SEQ ID NO: 393429

SEQ ID NO: 409551 - RNA, 63 nt, Human; identical to SEQ ID NO: 393430

SEQ ID NO: 409552 - RNA, 63 nt, Human; identical to SEQ ID NO: 393431

SEQ ID NO: 409553 - RNA, 63 nt, Human; identical to SEQ ID NO: 393432

SEQ ID NO: 409554 - RNA, 63 nt, Human; identical to SEQ ID NO: 393433

SEQ ID NO: 409555 - RNA, 63 nt, Human; identical to SEQ ID NO: 393434

SEQ ID NO: 409556 - RNA, 63 nt, Human; identical to SEQ ID NO: 393435

SEQ ID NO: 409557 - RNA, 63 nt, Human; identical to SEQ ID NO: 393436

SEQ ID NO: 409558 - RNA, 63 nt, Human; identical to SEQ ID NO: 393437

SEQ ID NO: 409559 - RNA, 59 nt, Human; identical to SEQ ID NO: 78935

SEQ ID NO: 409560 - RNA, 63 nt, Human; identical to SEQ ID NO: 393439

SEQ ID NO: 409561 - RNA, 63 nt, Human; identical to SEQ ID NO: 393440

SEQ ID NO: 409562 - RNA, 63 nt, Human; identical to SEQ ID NO: 393441

SEQ ID NO: 409563 - RNA, 63 nt, Human; identical to SEQ ID NO: 393442

SEQ ID NO: 409564 - RNA, 63 nt, Human; identical to SEQ ID NO: 393443

SEQ ID NO: 409565 - RNA, 63 nt, Human; identical to SEQ ID NO: 393444

SEQ ID NO: 409566 - RNA, 63 nt, Human; identical to SEQ ID NO: 393445

SEQ ID NO: 409567 - RNA, 63 nt, Human; identical to SEQ ID NO: 393446

SEQ ID NO: 409568 - RNA, 63 nt, Human; identical to SEQ ID NO: 393447

SEQ ID NO: 409569 - RNA, 63 nt, Human; identical to SEQ ID NO: 393448

SEQ ID NO: 409570 - RNA, 63 nt, Human; identical to SEQ ID NO: 393449

SEQ ID NO: 409571 - RNA, 63 nt, Human; identical to SEQ ID NO: 393450

SEQ ID NO: 409572 - RNA, 63 nt, Human; identical to SEQ ID NO: 393451

SEQ ID NO: 409573 - RNA, 63 nt, Human; identical to SEQ ID NO: 393452

SEQ ID NO: 409574 - RNA, 63 nt, Human; identical to SEQ ID NO: 393453

SEQ ID NO: 409575 - RNA, 63 nt, Human; identical to SEQ ID NO: 393454

SEQ ID NO: 409576 - RNA, 63 nt, Human; identical to SEQ ID NO: 393455

SEQ ID NO: 409577 - RNA, 63 nt, Human; identical to SEQ ID NO: 393456

SEQ ID NO: 409578 - RNA, 63 nt, Human; identical to SEQ ID NO: 393457

SEQ ID NO: 409579 - RNA, 63 nt, Human; identical to SEQ ID NO: 393458

SEQ ID NO: 409580 - RNA, 63 nt, Human; identical to SEQ ID NO: 393459

SEQ ID NO: 409581 - RNA, 63 nt, Human; identical to SEQ ID NO: 393460

SEQ ID NO: 409582 - RNA, 63 nt, Human; identical to SEQ ID NO: 393461

SEQ ID NO: 409583 - RNA, 63 nt, Human; identical to SEQ ID NO: 393462

SEQ ID NO: 409584 - RNA, 63 nt, Human; identical to SEQ ID NO: 393463

SEQ ID NO: 409585 - RNA, 63 nt, Human; identical to SEQ ID NO: 393464

SEQ ID NO: 409586 - RNA, 63 nt, Human; identical to SEQ ID NO: 393465

SEQ ID NO: 409587 - RNA, 63 nt, Human; identical to SEQ ID NO: 393466

SEQ ID NO: 409588 - RNA, 63 nt, Human; identical to SEQ ID NO: 393467

SEQ ID NO: 409589 - RNA, 63 nt, Human; identical to SEQ ID NO: 393468

SEQ ID NO: 409590 - RNA, 63 nt, Human; identical to SEQ ID NO: 393469

SEQ ID NO: 409591 - RNA, 63 nt, Human; identical to SEQ ID NO: 393470

SEQ ID NO: 409592 - RNA, 63 nt, Human; identical to SEQ ID NO: 393471

SEQ ID NO: 409593 - RNA, 63 nt, Human; identical to SEQ ID NO: 393472

SEQ ID NO: 409594 - RNA, 63 nt, Human; identical to SEQ ID NO: 393473

SEQ ID NO: 409595 - RNA, 63 nt, Human; identical to SEQ ID NO: 393474

SEQ ID NO: 409596 - RNA, 63 nt, Human; identical to SEQ ID NO: 393475

SEQ ID NO: 409597 - RNA, 63 nt, Human; identical to SEQ ID NO: 393476

SEQ ID NO: 409598 - RNA, 63 nt, Human; identical to SEQ ID NO: 393477

SEQ ID NO: 409599 - RNA, 63 nt, Human; identical to SEQ ID NO: 393478

SEQ ID NO: 409600 - RNA, 63 nt, Human; identical to SEQ ID NO: 393479

SEQ ID NO: 409601 - RNA, 63 nt, Human; identical to SEQ ID NO: 393480

SEQ ID NO: 409602 - RNA, 63 nt, Human; identical to SEQ ID NO: 393481

SEQ ID NO: 409603 - RNA, 63 nt, Human; identical to SEQ ID NO: 393482

SEQ ID NO: 409604 - RNA, 57 nt, Human; identical to SEQ ID NO: 78980

SEQ ID NO: 409605 - RNA, 63 nt, Human; identical to SEQ ID NO: 393484

SEQ ID NO: 409606 - RNA, 63 nt, Human; identical to SEQ ID NO: 393485

SEQ ID NO: 409607 - RNA, 63 nt, Human; identical to SEQ ID NO: 393486

SEQ ID NO: 409608 - RNA, 63 nt, Human; identical to SEQ ID NO: 393487

SEQ ID NO: 409609 - RNA, 63 nt, Human; identical to SEQ ID NO: 393488

SEQ ID NO: 409610 - RNA, 63 nt, Human; identical to SEQ ID NO: 393489

SEQ ID NO: 409611 - RNA, 63 nt, Human; identical to SEQ ID NO: 393490

SEQ ID NO: 409612 - RNA, 63 nt, Human; identical to SEQ ID NO: 393491

SEQ ID NO: 409613 - RNA, 63 nt, Human; identical to SEQ ID NO: 393492

SEQ ID NO: 409614 - RNA, 63 nt, Human; identical to SEQ ID NO: 393493

SEQ ID NO: 409615 - RNA, 63 nt, Human; identical to SEQ ID NO: 393494

SEQ ID NO: 409616 - RNA, 63 nt, Human; identical to SEQ ID NO: 393495

SEQ ID NO: 409617 - RNA, 63 nt, Human; identical to SEQ ID NO: 393496

SEQ ID NO: 409618 - RNA, 63 nt, Human; identical to SEQ ID NO: 393497

SEQ ID NO: 409619 - RNA, 63 nt, Human; identical to SEQ ID NO: 393498

SEQ ID NO: 409620 - RNA, 63 nt, Human; identical to SEQ ID NO: 393499

SEQ ID NO: 409621 - RNA, 63 nt, Human; identical to SEQ ID NO: 393500

SEQ ID NO: 409622 - RNA, 54 nt, Human; identical to SEQ ID NO: 78998

SEQ ID NO: 409623 - RNA, 63 nt, Human; identical to SEQ ID NO: 393502

SEQ ID NO: 409624 - RNA, 63 nt, Human; identical to SEQ ID NO: 393503

SEQ ID NO: 409625 - RNA, 63 nt, Human; identical to SEQ ID NO: 393504

SEQ ID NO: 409626 - RNA, 63 nt, Human; identical to SEQ ID NO: 393505

SEQ ID NO: 409627 - RNA, 63 nt, Human; identical to SEQ ID NO: 393506

SEQ ID NO: 409628 - RNA, 63 nt, Human; identical to SEQ ID NO: 393507

SEQ ID NO: 409629 - RNA, 63 nt, Human; identical to SEQ ID NO: 393508

SEQ ID NO: 409630 - RNA, 63 nt, Human; identical to SEQ ID NO: 393509

SEQ ID NO: 409631 - RNA, 63 nt, Human; identical to SEQ ID NO: 393510

SEQ ID NO: 409632 - RNA, 63 nt, Human; identical to SEQ ID NO: 393511

SEQ ID NO: 409633 - RNA, 63 nt, Human; identical to SEQ ID NO: 393512

SEQ ID NO: 409634 - RNA, 63 nt, Human; identical to SEQ ID NO: 393513

SEQ ID NO: 409635 - RNA, 63 nt, Human; identical to SEQ ID NO: 393514

SEQ ID NO: 409636 - RNA, 63 nt, Human; identical to SEQ ID NO: 393515

SEQ ID NO: 409637 - RNA, 63 nt, Human; identical to SEQ ID NO: 393516

SEQ ID NO: 409638 - RNA, 63 nt, Human; identical to SEQ ID NO: 393517

SEQ ID NO: 409639 - RNA, 63 nt, Human; identical to SEQ ID NO: 393518

SEQ ID NO: 409640 - RNA, 63 nt, Human; identical to SEQ ID NO: 393519

SEQ ID NO: 409641 - RNA, 63 nt, Human; identical to SEQ ID NO: 393520

SEQ ID NO: 409642 - RNA, 63 nt, Human; identical to SEQ ID NO: 393521

SEQ ID NO: 409643 - RNA, 63 nt, Human; identical to SEQ ID NO: 393522

SEQ ID NO: 409644 - RNA, 63 nt, Human; identical to SEQ ID NO: 393523

SEQ ID NO: 409645 - RNA, 63 nt, Human; identical to SEQ ID NO: 393524

SEQ ID NO: 409646 - RNA, 63 nt, Human; identical to SEQ ID NO: 393525

SEQ ID NO: 409647 - RNA, 63 nt, Human; identical to SEQ ID NO: 393526

SEQ ID NO: 409648 - RNA, 63 nt, Human; identical to SEQ ID NO: 393527

SEQ ID NO: 409649 - RNA, 63 nt, Human; identical to SEQ ID NO: 393528

SEQ ID NO: 409650 - RNA, 63 nt, Human; identical to SEQ ID NO: 393529

SEQ ID NO: 409651 - RNA, 63 nt, Human; identical to SEQ ID NO: 393530

SEQ ID NO: 409652 - RNA, 63 nt, Human; identical to SEQ ID NO: 393531

SEQ ID NO: 409653 - RNA, 63 nt, Human; identical to SEQ ID NO: 393532

SEQ ID NO: 409654 - RNA, 63 nt, Human; identical to SEQ ID NO: 393533

SEQ ID NO: 409655 - RNA, 63 nt, Human; identical to SEQ ID NO: 393534

SEQ ID NO: 409656 - RNA, 63 nt, Human; identical to SEQ ID NO: 82515

SEQ ID NO: 409657 - RNA, 63 nt, Human; identical to SEQ ID NO: 393536

SEQ ID NO: 409658 - RNA, 63 nt, Human; identical to SEQ ID NO: 393537

SEQ ID NO: 409659 - RNA, 51 nt, Human; identical to SEQ ID NO: 79035

SEQ ID NO: 409660 - RNA, 63 nt, Human; identical to SEQ ID NO: 393539

SEQ ID NO: 409661 - RNA, 63 nt, Human; identical to SEQ ID NO: 393540

SEQ ID NO: 409662 - RNA, 63 nt, Human; identical to SEQ ID NO: 393541

SEQ ID NO: 409663 - RNA, 63 nt, Human; identical to SEQ ID NO: 393542

SEQ ID NO: 409664 - RNA, 63 nt, Human; identical to SEQ ID NO: 393543

SEQ ID NO: 409665 - RNA, 63 nt, Human; identical to SEQ ID NO: 393544

SEQ ID NO: 409666 - RNA, 63 nt, Human; identical to SEQ ID NO: 393545

SEQ ID NO: 409667 - RNA, 63 nt, Human; identical to SEQ ID NO: 393546

SEQ ID NO: 409668 - RNA, 63 nt, Human; identical to SEQ ID NO: 393547

SEQ ID NO: 409669 - RNA, 63 nt, Human; identical to SEQ ID NO: 393548

SEQ ID NO: 409670 - RNA, 63 nt, Human; identical to SEQ ID NO: 393549

SEQ ID NO: 409671 - RNA, 63 nt, Human; identical to SEQ ID NO: 393550

SEQ ID NO: 409672 - RNA, 63 nt, Human; identical to SEQ ID NO: 393551

SEQ ID NO: 409673 - RNA, 63 nt, Human; identical to SEQ ID NO: 393552

SEQ ID NO: 409674 - RNA, 59 nt, Human; identical to SEQ ID NO: 79050

SEQ ID NO: 409675 - RNA, 63 nt, Human; identical to SEQ ID NO: 393554

SEQ ID NO: 409676 - RNA, 63 nt, Human; identical to SEQ ID NO: 393555

SEQ ID NO: 409677 - RNA, 63 nt, Human; identical to SEQ ID NO: 393556

SEQ ID NO: 409678 - RNA, 63 nt, Human; identical to SEQ ID NO: 393557

SEQ ID NO: 409679 - RNA, 53 nt, Human; identical to SEQ ID NO: 79055

SEQ ID NO: 409680 - RNA, 63 nt, Human; identical to SEQ ID NO: 393559

SEQ ID NO: 409681 - RNA, 63 nt, Human; identical to SEQ ID NO: 393560

SEQ ID NO: 409682 - RNA, 63 nt, Human; identical to SEQ ID NO: 393561

SEQ ID NO: 409683 - RNA, 63 nt, Human; identical to SEQ ID NO: 393562

SEQ ID NO: 409684 - RNA, 63 nt, Human; identical to SEQ ID NO: 393563

SEQ ID NO: 409685 - RNA, 63 nt, Human; identical to SEQ ID NO: 393564

SEQ ID NO: 409686 - RNA, 63 nt, Human; identical to SEQ ID NO: 393565

SEQ ID NO: 409687 - RNA, 63 nt, Human; identical to SEQ ID NO: 393566

SEQ ID NO: 409688 - RNA, 63 nt, Human; identical to SEQ ID NO: 393567

SEQ ID NO: 409689 - RNA, 63 nt, Human; identical to SEQ ID NO: 393568

SEQ ID NO: 409690 - RNA, 63 nt, Human; identical to SEQ ID NO: 393569

SEQ ID NO: 409691 - RNA, 63 nt, Human; identical to SEQ ID NO: 393570

SEQ ID NO: 409692 - RNA, 63 nt, Human; identical to SEQ ID NO: 393571

SEQ ID NO: 409693 - RNA, 63 nt, Human; identical to SEQ ID NO: 393572

SEQ ID NO: 409694 - RNA, 63 nt, Human; identical to SEQ ID NO: 393573

SEQ ID NO: 409695 - RNA, 63 nt, Human; identical to SEQ ID NO: 393574

SEQ ID NO: 409696 - RNA, 63 nt, Human; identical to SEQ ID NO: 393575

SEQ ID NO: 409697 - RNA, 63 nt, Human; identical to SEQ ID NO: 393576

SEQ ID NO: 409698 - RNA, 63 nt, Human; identical to SEQ ID NO: 393577

SEQ ID NO: 409699 - RNA, 63 nt, Human; identical to SEQ ID NO: 393578

SEQ ID NO: 409700 - RNA, 63 nt, Human; identical to SEQ ID NO: 393579

SEQ ID NO: 409701 - RNA, 63 nt, Human; identical to SEQ ID NO: 393580

SEQ ID NO: 409702 - RNA, 63 nt, Human; identical to SEQ ID NO: 393581

SEQ ID NO: 409703 - RNA, 63 nt, Human; identical to SEQ ID NO: 393582

SEQ ID NO: 409704 - RNA, 63 nt, Human; identical to SEQ ID NO: 393583

SEQ ID NO: 409705 - RNA, 63 nt, Human; identical to SEQ ID NO: 393584

SEQ ID NO: 409706 - RNA, 63 nt, Human; identical to SEQ ID NO: 393585

SEQ ID NO: 409707 - RNA, 63 nt, Human; identical to SEQ ID NO: 393586

SEQ ID NO: 409708 - RNA, 63 nt, Human; identical to SEQ ID NO: 393587

SEQ ID NO: 409709 - RNA, 63 nt, Human; identical to SEQ ID NO: 393588

SEQ ID NO: 409710 - RNA, 63 nt, Human; identical to SEQ ID NO: 393589

SEQ ID NO: 409711 - RNA, 63 nt, Human; identical to SEQ ID NO: 393590

SEQ ID NO: 409712 - RNA, 63 nt, Human; identical to SEQ ID NO: 393591

SEQ ID NO: 409713 - RNA, 63 nt, Human; identical to SEQ ID NO: 393592

SEQ ID NO: 409714 - RNA, 63 nt, Human; identical to SEQ ID NO: 393593

SEQ ID NO: 409715 - RNA, 63 nt, Human; identical to SEQ ID NO: 393594

SEQ ID NO: 409716 - RNA, 63 nt, Human; identical to SEQ ID NO: 393595

SEQ ID NO: 409717 - RNA, 63 nt, Human; identical to SEQ ID NO: 393596

SEQ ID NO: 409718 - RNA, 63 nt, Human; identical to SEQ ID NO: 393597

SEQ ID NO: 409719 - RNA, 63 nt, Human; identical to SEQ ID NO: 393598

SEQ ID NO: 409720 - RNA, 63 nt, Human; identical to SEQ ID NO: 393599

SEQ ID NO: 409721 - RNA, 63 nt, Human; identical to SEQ ID NO: 393600

SEQ ID NO: 409722 - RNA, 51 nt, Human; identical to SEQ ID NO: 79098

SEQ ID NO: 409723 - RNA, 63 nt, Human; identical to SEQ ID NO: 393602

SEQ ID NO: 409724 - RNA, 63 nt, Human; identical to SEQ ID NO: 393603

SEQ ID NO: 409725 - RNA, 63 nt, Human; identical to SEQ ID NO: 393604

SEQ ID NO: 409726 - RNA, 63 nt, Human; identical to SEQ ID NO: 393605

SEQ ID NO: 409727 - RNA, 63 nt, Human; identical to SEQ ID NO: 393606

SEQ ID NO: 409728 - RNA, 63 nt, Human; identical to SEQ ID NO: 393607

SEQ ID NO: 409729 - RNA, 63 nt, Human; identical to SEQ ID NO: 393608

SEQ ID NO: 409730 - RNA, 63 nt, Human; identical to SEQ ID NO: 393609

SEQ ID NO: 409731 - RNA, 63 nt, Human; identical to SEQ ID NO: 393610

SEQ ID NO: 409732 - RNA, 63 nt, Human; identical to SEQ ID NO: 393611

SEQ ID NO: 409733 - RNA, 63 nt, Human; identical to SEQ ID NO: 393612

SEQ ID NO: 409734 - RNA, 63 nt, Human; identical to SEQ ID NO: 393613

SEQ ID NO: 409735 - RNA, 63 nt, Human; identical to SEQ ID NO: 393614

SEQ ID NO: 409736 - RNA, 63 nt, Human; identical to SEQ ID NO: 393615

SEQ ID NO: 409737 - RNA, 63 nt, Human; identical to SEQ ID NO: 393616

SEQ ID NO: 409738 - RNA, 63 nt, Human; identical to SEQ ID NO: 393617

SEQ ID NO: 409739 - RNA, 63 nt, Human; identical to SEQ ID NO: 393618

SEQ ID NO: 409740 - RNA, 63 nt, Human; identical to SEQ ID NO: 393619

SEQ ID NO: 409741 - RNA, 63 nt, Human; identical to SEQ ID NO: 393620

SEQ ID NO: 409742 - RNA, 63 nt, Human; identical to SEQ ID NO: 393621

SEQ ID NO: 409743 - RNA, 63 nt, Human; identical to SEQ ID NO: 393622

SEQ ID NO: 409744 - RNA, 63 nt, Human; identical to SEQ ID NO: 393623

SEQ ID NO: 409745 - RNA, 63 nt, Human; identical to SEQ ID NO: 393624

SEQ ID NO: 409746 - RNA, 63 nt, Human; identical to SEQ ID NO: 393625

SEQ ID NO: 409747 - RNA, 63 nt, Human; identical to SEQ ID NO: 393626

SEQ ID NO: 409748 - RNA, 63 nt, Human; identical to SEQ ID NO: 393627

SEQ ID NO: 409749 - RNA, 63 nt, Human; identical to SEQ ID NO: 393628

SEQ ID NO: 409750 - RNA, 63 nt, Human; identical to SEQ ID NO: 393629

SEQ ID NO: 409751 - RNA, 63 nt, Human; identical to SEQ ID NO: 393630

SEQ ID NO: 409752 - RNA, 63 nt, Human; identical to SEQ ID NO: 393631

SEQ ID NO: 409753 - RNA, 63 nt, Human; identical to SEQ ID NO: 393632

SEQ ID NO: 409754 - RNA, 63 nt, Human; identical to SEQ ID NO: 393633

SEQ ID NO: 409755 - RNA, 63 nt, Human; identical to SEQ ID NO: 393634

SEQ ID NO: 409756 - RNA, 63 nt, Human; identical to SEQ ID NO: 393635

SEQ ID NO: 409757 - RNA, 63 nt, Human; identical to SEQ ID NO: 393636

SEQ ID NO: 409758 - RNA, 63 nt, Human; identical to SEQ ID NO: 393637

SEQ ID NO: 409759 - RNA, 63 nt, Human; identical to SEQ ID NO: 393638

SEQ ID NO: 409760 - RNA, 63 nt, Human; identical to SEQ ID NO: 393639

SEQ ID NO: 409761 - RNA, 63 nt, Human; identical to SEQ ID NO: 393640

SEQ ID NO: 409762 - RNA, 63 nt, Human; identical to SEQ ID NO: 393641

SEQ ID NO: 409763 - RNA, 63 nt, Human; identical to SEQ ID NO: 393642

SEQ ID NO: 409764 - RNA, 63 nt, Human; identical to SEQ ID NO: 393643

SEQ ID NO: 409765 - RNA, 63 nt, Human; identical to SEQ ID NO: 393644

SEQ ID NO: 409766 - RNA, 63 nt, Human; identical to SEQ ID NO: 393645

SEQ ID NO: 409767 - RNA, 63 nt, Human; identical to SEQ ID NO: 393646

SEQ ID NO: 409768 - RNA, 63 nt, Human; identical to SEQ ID NO: 393647

SEQ ID NO: 409769 - RNA, 63 nt, Human; identical to SEQ ID NO: 393648

SEQ ID NO: 409770 - RNA, 63 nt, Human; identical to SEQ ID NO: 393649

SEQ ID NO: 409771 - RNA, 63 nt, Human; identical to SEQ ID NO: 393650

SEQ ID NO: 409772 - RNA, 63 nt, Human; identical to SEQ ID NO: 393651

SEQ ID NO: 409773 - RNA, 63 nt, Human; identical to SEQ ID NO: 393652

SEQ ID NO: 409774 - RNA, 63 nt, Human; identical to SEQ ID NO: 393653

SEQ ID NO: 409775 - RNA, 63 nt, Human; identical to SEQ ID NO: 393654

SEQ ID NO: 409776 - RNA, 63 nt, Human; identical to SEQ ID NO: 393655

SEQ ID NO: 409777 - RNA, 63 nt, Human; identical to SEQ ID NO: 393656

SEQ ID NO: 409778 - RNA, 63 nt, Human; identical to SEQ ID NO: 393657

SEQ ID NO: 409779 - RNA, 63 nt, Human; identical to SEQ ID NO: 393658

SEQ ID NO: 409780 - RNA, 63 nt, Human; identical to SEQ ID NO: 393659

SEQ ID NO: 409781 - RNA, 63 nt, Human; identical to SEQ ID NO: 393660

SEQ ID NO: 409782 - RNA, 63 nt, Human; identical to SEQ ID NO: 393661

SEQ ID NO: 409783 - RNA, 63 nt, Human; identical to SEQ ID NO: 393662

SEQ ID NO: 409784 - RNA, 63 nt, Human; identical to SEQ ID NO: 393663

SEQ ID NO: 409785 - RNA, 63 nt, Human; identical to SEQ ID NO: 393664

SEQ ID NO: 409786 - RNA, 63 nt, Human; identical to SEQ ID NO: 393665

SEQ ID NO: 409787 - RNA, 63 nt, Human; identical to SEQ ID NO: 393666

SEQ ID NO: 409788 - RNA, 63 nt, Human; identical to SEQ ID NO: 393667

SEQ ID NO: 409789 - RNA, 63 nt, Human; identical to SEQ ID NO: 393668

SEQ ID NO: 409790 - RNA, 63 nt, Human; identical to SEQ ID NO: 393669

SEQ ID NO: 409791 - RNA, 63 nt, Human; identical to SEQ ID NO: 393670

SEQ ID NO: 409792 - RNA, 63 nt, Human; identical to SEQ ID NO: 393671

SEQ ID NO: 409793 - RNA, 63 nt, Human; identical to SEQ ID NO: 393672

SEQ ID NO: 409794 - RNA, 63 nt, Human; identical to SEQ ID NO: 393673

SEQ ID NO: 409795 - RNA, 63 nt, Human; identical to SEQ ID NO: 393674

SEQ ID NO: 409796 - RNA, 63 nt, Human; identical to SEQ ID NO: 393675

SEQ ID NO: 409797 - RNA, 63 nt, Human; identical to SEQ ID NO: 393676

SEQ ID NO: 409798 - RNA, 63 nt, Human; identical to SEQ ID NO: 393677

SEQ ID NO: 409799 - RNA, 63 nt, Human; identical to SEQ ID NO: 393678

SEQ ID NO: 409800 - RNA, 63 nt, Human; identical to SEQ ID NO: 393679

SEQ ID NO: 409801 - RNA, 63 nt, Human; identical to SEQ ID NO: 393680

SEQ ID NO: 409802 - RNA, 63 nt, Human; identical to SEQ ID NO: 393681

SEQ ID NO: 409803 - RNA, 63 nt, Human; identical to SEQ ID NO: 393682

SEQ ID NO: 409804 - RNA, 63 nt, Human; identical to SEQ ID NO: 393683

SEQ ID NO: 409805 - RNA, 63 nt, Human; identical to SEQ ID NO: 393684

SEQ ID NO: 409806 - RNA, 63 nt, Human; identical to SEQ ID NO: 393685

SEQ ID NO: 409807 - RNA, 63 nt, Human; identical to SEQ ID NO: 393686

SEQ ID NO: 409808 - RNA, 63 nt, Human; identical to SEQ ID NO: 393687

SEQ ID NO: 409809 - RNA, 63 nt, Human; identical to SEQ ID NO: 393688

SEQ ID NO: 409810 - RNA, 63 nt, Human; identical to SEQ ID NO: 393689

SEQ ID NO: 409811 - RNA, 63 nt, Human; identical to SEQ ID NO: 393690

SEQ ID NO: 409812 - RNA, 63 nt, Human; identical to SEQ ID NO: 393691

SEQ ID NO: 409813 - RNA, 63 nt, Human; identical to SEQ ID NO: 393692

SEQ ID NO: 409814 - RNA, 63 nt, Human; identical to SEQ ID NO: 393693

SEQ ID NO: 409815 - RNA, 63 nt, Human; identical to SEQ ID NO: 393694

SEQ ID NO: 409816 - RNA, 63 nt, Human; identical to SEQ ID NO: 393695

SEQ ID NO: 409817 - RNA, 63 nt, Human; identical to SEQ ID NO: 393696

SEQ ID NO: 409818 - RNA, 63 nt, Human; identical to SEQ ID NO: 393697

SEQ ID NO: 409819 - RNA, 63 nt, Human; identical to SEQ ID NO: 393698

SEQ ID NO: 409820 - RNA, 63 nt, Human; identical to SEQ ID NO: 393699

SEQ ID NO: 409821 - RNA, 63 nt, Human; identical to SEQ ID NO: 393700

SEQ ID NO: 409822 - RNA, 63 nt, Human; identical to SEQ ID NO: 393701

SEQ ID NO: 409823 - RNA, 63 nt, Human; identical to SEQ ID NO: 393702

SEQ ID NO: 409824 - RNA, 63 nt, Human; identical to SEQ ID NO: 393703

SEQ ID NO: 409825 - RNA, 63 nt, Human; identical to SEQ ID NO: 393704

SEQ ID NO: 409826 - RNA, 63 nt, Human; identical to SEQ ID NO: 393705

SEQ ID NO: 409827 - RNA, 63 nt, Human; identical to SEQ ID NO: 393706

SEQ ID NO: 409828 - RNA, 63 nt, Human; identical to SEQ ID NO: 393707

SEQ ID NO: 409829 - RNA, 63 nt, Human; identical to SEQ ID NO: 393708

SEQ ID NO: 409830 - RNA, 63 nt, Human; identical to SEQ ID NO: 393709

SEQ ID NO: 409831 - RNA, 63 nt, Human; identical to SEQ ID NO: 393710

SEQ ID NO: 409832 - RNA, 63 nt, Human; identical to SEQ ID NO: 393711

SEQ ID NO: 409833 - RNA, 63 nt, Human; identical to SEQ ID NO: 393712

SEQ ID NO: 409834 - RNA, 63 nt, Human; identical to SEQ ID NO: 393713

SEQ ID NO: 409835 - RNA, 63 nt, Human; identical to SEQ ID NO: 393714

SEQ ID NO: 409836 - RNA, 63 nt, Human; identical to SEQ ID NO: 393715

SEQ ID NO: 409837 - RNA, 63 nt, Human; identical to SEQ ID NO: 393716

SEQ ID NO: 409838 - RNA, 63 nt, Human; identical to SEQ ID NO: 393717

SEQ ID NO: 409839 - RNA, 63 nt, Human; identical to SEQ ID NO: 393718

SEQ ID NO: 409840 - RNA, 63 nt, Human; identical to SEQ ID NO: 393719

SEQ ID NO: 409841 - RNA, 56 nt, Human; identical to SEQ ID NO: 79217

SEQ ID NO: 409842 - RNA, 63 nt, Human; identical to SEQ ID NO: 393721

SEQ ID NO: 409843 - RNA, 61 nt, Human; identical to SEQ ID NO: 82702

SEQ ID NO: 409844 - RNA, 63 nt, Human; identical to SEQ ID NO: 393723

SEQ ID NO: 409845 - RNA, 63 nt, Human; identical to SEQ ID NO: 393724

SEQ ID NO: 409846 - RNA, 63 nt, Human; identical to SEQ ID NO: 393725

SEQ ID NO: 409847 - RNA, 63 nt, Human; identical to SEQ ID NO: 393726

SEQ ID NO: 409848 - RNA, 63 nt, Human; identical to SEQ ID NO: 393727

SEQ ID NO: 409849 - RNA, 63 nt, Human; identical to SEQ ID NO: 393728

SEQ ID NO: 409850 - RNA, 63 nt, Human; identical to SEQ ID NO: 393729

SEQ ID NO: 409851 - RNA, 63 nt, Human; identical to SEQ ID NO: 393730

SEQ ID NO: 409852 - RNA, 63 nt, Human; identical to SEQ ID NO: 393731

SEQ ID NO: 409853 - RNA, 63 nt, Human; identical to SEQ ID NO: 393732

SEQ ID NO: 409854 - RNA, 63 nt, Human; identical to SEQ ID NO: 393733

SEQ ID NO: 409855 - RNA, 63 nt, Human; identical to SEQ ID NO: 393734

SEQ ID NO: 409856 - RNA, 63 nt, Human; identical to SEQ ID NO: 393735

SEQ ID NO: 409857 - RNA, 63 nt, Human; identical to SEQ ID NO: 393736

SEQ ID NO: 409858 - RNA, 63 nt, Human; identical to SEQ ID NO: 393737

SEQ ID NO: 409859 - RNA, 50 nt, Human; identical to SEQ ID NO: 79235

SEQ ID NO: 409860 - RNA, 63 nt, Human; identical to SEQ ID NO: 393739

SEQ ID NO: 409861 - RNA, 63 nt, Human; identical to SEQ ID NO: 393740

SEQ ID NO: 409862 - RNA, 63 nt, Human; identical to SEQ ID NO: 393741

SEQ ID NO: 409863 - RNA, 63 nt, Human; identical to SEQ ID NO: 393742

SEQ ID NO: 409864 - RNA, 63 nt, Human; identical to SEQ ID NO: 393743

SEQ ID NO: 409865 - RNA, 63 nt, Human; identical to SEQ ID NO: 393744

SEQ ID NO: 409866 - RNA, 63 nt, Human; identical to SEQ ID NO: 393745

SEQ ID NO: 409867 - RNA, 63 nt, Human; identical to SEQ ID NO: 393746

SEQ ID NO: 409868 - RNA, 63 nt, Human; identical to SEQ ID NO: 393747

SEQ ID NO: 409869 - RNA, 63 nt, Human; identical to SEQ ID NO: 393748

SEQ ID NO: 409870 - RNA, 63 nt, Human; identical to SEQ ID NO: 393749

SEQ ID NO: 409871 - RNA, 63 nt, Human; identical to SEQ ID NO: 393750

SEQ ID NO: 409872 - RNA, 63 nt, Human; identical to SEQ ID NO: 393751

SEQ ID NO: 409873 - RNA, 63 nt, Human; identical to SEQ ID NO: 393752

SEQ ID NO: 409874 - RNA, 63 nt, Human; identical to SEQ ID NO: 393753

SEQ ID NO: 409875 - RNA, 63 nt, Human; identical to SEQ ID NO: 393754

SEQ ID NO: 409876 - RNA, 63 nt, Human; identical to SEQ ID NO: 393755

SEQ ID NO: 409877 - RNA, 63 nt, Human; identical to SEQ ID NO: 393756

SEQ ID NO: 409878 - RNA, 63 nt, Human; identical to SEQ ID NO: 393757

SEQ ID NO: 409879 - RNA, 63 nt, Human; identical to SEQ ID NO: 393758

SEQ ID NO: 409880 - RNA, 63 nt, Human; identical to SEQ ID NO: 393759

SEQ ID NO: 409881 - RNA, 63 nt, Human; identical to SEQ ID NO: 393760

SEQ ID NO: 409882 - RNA, 63 nt, Human; identical to SEQ ID NO: 393761

SEQ ID NO: 409883 - RNA, 63 nt, Human; identical to SEQ ID NO: 393762

SEQ ID NO: 409884 - RNA, 63 nt, Human; identical to SEQ ID NO: 393763

SEQ ID NO: 409885 - RNA, 63 nt, Human; identical to SEQ ID NO: 393764

SEQ ID NO: 409886 - RNA, 63 nt, Human; identical to SEQ ID NO: 393765

SEQ ID NO: 409887 - RNA, 63 nt, Human; identical to SEQ ID NO: 393766

SEQ ID NO: 409888 - RNA, 63 nt, Human; identical to SEQ ID NO: 393767

SEQ ID NO: 409889 - RNA, 63 nt, Human; identical to SEQ ID NO: 393768

SEQ ID NO: 409890 - RNA, 63 nt, Human; identical to SEQ ID NO: 393769

SEQ ID NO: 409891 - RNA, 63 nt, Human; identical to SEQ ID NO: 393770

SEQ ID NO: 409892 - RNA, 63 nt, Human; identical to SEQ ID NO: 393771

SEQ ID NO: 409893 - RNA, 63 nt, Human; identical to SEQ ID NO: 393772

SEQ ID NO: 409894 - RNA, 63 nt, Human; identical to SEQ ID NO: 393773

SEQ ID NO: 409895 - RNA, 63 nt, Human; identical to SEQ ID NO: 393774

SEQ ID NO: 409896 - RNA, 63 nt, Human; identical to SEQ ID NO: 393775

SEQ ID NO: 409897 - RNA, 63 nt, Human; identical to SEQ ID NO: 393776

SEQ ID NO: 409898 - RNA, 63 nt, Human; identical to SEQ ID NO: 393777

SEQ ID NO: 409899 - RNA, 63 nt, Human; identical to SEQ ID NO: 393778

SEQ ID NO: 409900 - RNA, 63 nt, Human; identical to SEQ ID NO: 393779

SEQ ID NO: 409901 - RNA, 63 nt, Human; identical to SEQ ID NO: 393780

SEQ ID NO: 409902 - RNA, 63 nt, Human; identical to SEQ ID NO: 393781

SEQ ID NO: 409903 - RNA, 63 nt, Human; identical to SEQ ID NO: 393782

SEQ ID NO: 409904 - RNA, 63 nt, Human; identical to SEQ ID NO: 393783

SEQ ID NO: 409905 - RNA, 63 nt, Human; identical to SEQ ID NO: 393784

SEQ ID NO: 409906 - RNA, 63 nt, Human; identical to SEQ ID NO: 393785

SEQ ID NO: 409907 - RNA, 63 nt, Human; identical to SEQ ID NO: 393786

SEQ ID NO: 409908 - RNA, 63 nt, Human; identical to SEQ ID NO: 393787

SEQ ID NO: 409909 - RNA, 63 nt, Human; identical to SEQ ID NO: 393788

SEQ ID NO: 409910 - RNA, 63 nt, Human; identical to SEQ ID NO: 393789

SEQ ID NO: 409911 - RNA, 63 nt, Human; identical to SEQ ID NO: 393790

SEQ ID NO: 409912 - RNA, 63 nt, Human; identical to SEQ ID NO: 393791

SEQ ID NO: 409913 - RNA, 63 nt, Human; identical to SEQ ID NO: 393792

SEQ ID NO: 409914 - RNA, 63 nt, Human; identical to SEQ ID NO: 393793

SEQ ID NO: 409915 - RNA, 63 nt, Human; identical to SEQ ID NO: 393794

SEQ ID NO: 409916 - RNA, 63 nt, Human; identical to SEQ ID NO: 393795

SEQ ID NO: 409917 - RNA, 63 nt, Human; identical to SEQ ID NO: 393796

SEQ ID NO: 409918 - RNA, 63 nt, Human; identical to SEQ ID NO: 393797

SEQ ID NO: 409919 - RNA, 63 nt, Human; identical to SEQ ID NO: 393798

SEQ ID NO: 409920 - RNA, 63 nt, Human; identical to SEQ ID NO: 393799

SEQ ID NO: 409921 - RNA, 63 nt, Human; identical to SEQ ID NO: 393800

SEQ ID NO: 409922 - RNA, 63 nt, Human; identical to SEQ ID NO: 393801

SEQ ID NO: 409923 - RNA, 63 nt, Human; identical to SEQ ID NO: 393802

SEQ ID NO: 409924 - RNA, 63 nt, Human; identical to SEQ ID NO: 393803

SEQ ID NO: 409925 - RNA, 63 nt, Human; identical to SEQ ID NO: 393804

SEQ ID NO: 409926 - RNA, 63 nt, Human; identical to SEQ ID NO: 393805

SEQ ID NO: 409927 - RNA, 63 nt, Human; identical to SEQ ID NO: 393806

SEQ ID NO: 409928 - RNA, 63 nt, Human; identical to SEQ ID NO: 393807

SEQ ID NO: 409929 - RNA, 63 nt, Human; identical to SEQ ID NO: 393808

SEQ ID NO: 409930 - RNA, 63 nt, Human; identical to SEQ ID NO: 393809

SEQ ID NO: 409931 - RNA, 63 nt, Human; identical to SEQ ID NO: 393810

SEQ ID NO: 409932 - RNA, 63 nt, Human; identical to SEQ ID NO: 393811

SEQ ID NO: 409933 - RNA, 63 nt, Human; identical to SEQ ID NO: 393812

SEQ ID NO: 409934 - RNA, 63 nt, Human; identical to SEQ ID NO: 393813

SEQ ID NO: 409935 - RNA, 63 nt, Human; identical to SEQ ID NO: 393814

SEQ ID NO: 409936 - RNA, 63 nt, Human; identical to SEQ ID NO: 393815

SEQ ID NO: 409937 - RNA, 63 nt, Human; identical to SEQ ID NO: 393816

SEQ ID NO: 409938 - RNA, 63 nt, Human; identical to SEQ ID NO: 393817

SEQ ID NO: 409939 - RNA, 63 nt, Human; identical to SEQ ID NO: 393818

SEQ ID NO: 409940 - RNA, 63 nt, Human; identical to SEQ ID NO: 393819

SEQ ID NO: 409941 - RNA, 63 nt, Human; identical to SEQ ID NO: 393820

SEQ ID NO: 409942 - RNA, 63 nt, Human; identical to SEQ ID NO: 393821

SEQ ID NO: 409943 - RNA, 63 nt, Human; identical to SEQ ID NO: 393822

SEQ ID NO: 409944 - RNA, 63 nt, Human; identical to SEQ ID NO: 393823

SEQ ID NO: 409945 - RNA, 63 nt, Human; identical to SEQ ID NO: 393824

SEQ ID NO: 409946 - RNA, 63 nt, Human; identical to SEQ ID NO: 393825

SEQ ID NO: 409947 - RNA, 63 nt, Human; identical to SEQ ID NO: 393826

SEQ ID NO: 409948 - RNA, 63 nt, Human; identical to SEQ ID NO: 393827

SEQ ID NO: 409949 - RNA, 63 nt, Human; identical to SEQ ID NO: 393828

SEQ ID NO: 409950 - RNA, 63 nt, Human; identical to SEQ ID NO: 393829

SEQ ID NO: 409951 - RNA, 63 nt, Human; identical to SEQ ID NO: 393830

SEQ ID NO: 409952 - RNA, 63 nt, Human; identical to SEQ ID NO: 393831

SEQ ID NO: 409953 - RNA, 63 nt, Human; identical to SEQ ID NO: 393832

SEQ ID NO: 409954 - RNA, 63 nt, Human; identical to SEQ ID NO: 393833

SEQ ID NO: 409955 - RNA, 63 nt, Human; identical to SEQ ID NO: 393834

SEQ ID NO: 409956 - RNA, 63 nt, Human; identical to SEQ ID NO: 393835

SEQ ID NO: 409957 - RNA, 63 nt, Human; identical to SEQ ID NO: 393836

SEQ ID NO: 409958 - RNA, 63 nt, Human; identical to SEQ ID NO: 393837

SEQ ID NO: 409959 - RNA, 63 nt, Human; identical to SEQ ID NO: 393838

SEQ ID NO: 409960 - RNA, 63 nt, Human; identical to SEQ ID NO: 393839

SEQ ID NO: 409961 - RNA, 63 nt, Human; identical to SEQ ID NO: 393840

SEQ ID NO: 409962 - RNA, 63 nt, Human; identical to SEQ ID NO: 393841

SEQ ID NO: 409963 - RNA, 63 nt, Human; identical to SEQ ID NO: 393842

SEQ ID NO: 409964 - RNA, 63 nt, Human; identical to SEQ ID NO: 393843

SEQ ID NO: 409965 - RNA, 63 nt, Human; identical to SEQ ID NO: 393844

SEQ ID NO: 409966 - RNA, 63 nt, Human; identical to SEQ ID NO: 393845

SEQ ID NO: 409967 - RNA, 63 nt, Human; identical to SEQ ID NO: 393846

SEQ ID NO: 409968 - RNA, 63 nt, Human; identical to SEQ ID NO: 393847

SEQ ID NO: 409969 - RNA, 63 nt, Human; identical to SEQ ID NO: 393848

SEQ ID NO: 409970 - RNA, 63 nt, Human; identical to SEQ ID NO: 393849

SEQ ID NO: 409971 - RNA, 63 nt, Human; identical to SEQ ID NO: 393850

SEQ ID NO: 409972 - RNA, 63 nt, Human; identical to SEQ ID NO: 393851

SEQ ID NO: 409973 - RNA, 63 nt, Human; identical to SEQ ID NO: 393852

SEQ ID NO: 409974 - RNA, 63 nt, Human; identical to SEQ ID NO: 393853

SEQ ID NO: 409975 - RNA, 63 nt, Human; identical to SEQ ID NO: 393854

SEQ ID NO: 409976 - RNA, 63 nt, Human; identical to SEQ ID NO: 393855

SEQ ID NO: 409977 - RNA, 63 nt, Human; identical to SEQ ID NO: 393856

SEQ ID NO: 409978 - RNA, 63 nt, Human; identical to SEQ ID NO: 393857

SEQ ID NO: 409979 - RNA, 63 nt, Human; identical to SEQ ID NO: 393858

SEQ ID NO: 409980 - RNA, 63 nt, Human; identical to SEQ ID NO: 393859

SEQ ID NO: 409981 - RNA, 63 nt, Human; identical to SEQ ID NO: 393860

SEQ ID NO: 409982 - RNA, 63 nt, Human; identical to SEQ ID NO: 393861

SEQ ID NO: 409983 - RNA, 63 nt, Human; identical to SEQ ID NO: 393862

SEQ ID NO: 409984 - RNA, 63 nt, Human; identical to SEQ ID NO: 393863

SEQ ID NO: 409985 - RNA, 63 nt, Human; identical to SEQ ID NO: 393864

SEQ ID NO: 409986 - RNA, 63 nt, Human; identical to SEQ ID NO: 393865

SEQ ID NO: 409987 - RNA, 63 nt, Human; identical to SEQ ID NO: 393866

SEQ ID NO: 409988 - RNA, 63 nt, Human; identical to SEQ ID NO: 393867

SEQ ID NO: 409989 - RNA, 63 nt, Human; identical to SEQ ID NO: 393868

SEQ ID NO: 409990 - RNA, 63 nt, Human; identical to SEQ ID NO: 393869

SEQ ID NO: 409991 - RNA, 63 nt, Human; identical to SEQ ID NO: 393870

SEQ ID NO: 409992 - RNA, 63 nt, Human; identical to SEQ ID NO: 393871

SEQ ID NO: 409993 - RNA, 63 nt, Human; identical to SEQ ID NO: 393872

SEQ ID NO: 409994 - RNA, 63 nt, Human; identical to SEQ ID NO: 393873

SEQ ID NO: 409995 - RNA, 63 nt, Human; identical to SEQ ID NO: 393874

SEQ ID NO: 409996 - RNA, 63 nt, Human; identical to SEQ ID NO: 393875

SEQ ID NO: 409997 - RNA, 63 nt, Human; identical to SEQ ID NO: 393876

SEQ ID NO: 409998 - RNA, 63 nt, Human; identical to SEQ ID NO: 393877

SEQ ID NO: 409999 - RNA, 63 nt, Human; identical to SEQ ID NO: 393878

SEQ ID NO: 410000 - RNA, 63 nt, Human; identical to SEQ ID NO: 393879

SEQ ID NO: 410001 - RNA, 63 nt, Human; identical to SEQ ID NO: 393880

SEQ ID NO: 410002 - RNA, 63 nt, Human; identical to SEQ ID NO: 393881

SEQ ID NO: 410003 - RNA, 63 nt, Human; identical to SEQ ID NO: 393882

SEQ ID NO: 410004 - RNA, 63 nt, Human; identical to SEQ ID NO: 393883

SEQ ID NO: 410005 - RNA, 63 nt, Human; identical to SEQ ID NO: 393884

SEQ ID NO: 410006 - RNA, 63 nt, Human; identical to SEQ ID NO: 393885

SEQ ID NO: 410007 - RNA, 63 nt, Human; identical to SEQ ID NO: 393886

SEQ ID NO: 410008 - RNA, 63 nt, Human; identical to SEQ ID NO: 393887

SEQ ID NO: 410009 - RNA, 63 nt, Human; identical to SEQ ID NO: 393888

SEQ ID NO: 410010 - RNA, 63 nt, Human; identical to SEQ ID NO: 393889

SEQ ID NO: 410011 - RNA, 63 nt, Human; identical to SEQ ID NO: 393890

SEQ ID NO: 410012 - RNA, 63 nt, Human; identical to SEQ ID NO: 393891

SEQ ID NO: 410013 - RNA, 63 nt, Human; identical to SEQ ID NO: 393892

SEQ ID NO: 410014 - RNA, 63 nt, Human; identical to SEQ ID NO: 393893

SEQ ID NO: 410015 - RNA, 63 nt, Human; identical to SEQ ID NO: 393894

SEQ ID NO: 410016 - RNA, 63 nt, Human; identical to SEQ ID NO: 393895

SEQ ID NO: 410017 - RNA, 63 nt, Human; identical to SEQ ID NO: 393896

SEQ ID NO: 410018 - RNA, 63 nt, Human; identical to SEQ ID NO: 393897

SEQ ID NO: 410019 - RNA, 63 nt, Human; identical to SEQ ID NO: 393898

SEQ ID NO: 410020 - RNA, 63 nt, Human; identical to SEQ ID NO: 393899

SEQ ID NO: 410021 - RNA, 63 nt, Human; identical to SEQ ID NO: 393900

SEQ ID NO: 410022 - RNA, 63 nt, Human; identical to SEQ ID NO: 393901

SEQ ID NO: 410023 - RNA, 63 nt, Human; identical to SEQ ID NO: 393902

SEQ ID NO: 410024 - RNA, 63 nt, Human; identical to SEQ ID NO: 393903

SEQ ID NO: 410025 - RNA, 63 nt, Human; identical to SEQ ID NO: 393904

SEQ ID NO: 410026 - RNA, 63 nt, Human; identical to SEQ ID NO: 393905

SEQ ID NO: 410027 - RNA, 63 nt, Human; identical to SEQ ID NO: 393906

SEQ ID NO: 410028 - RNA, 63 nt, Human; identical to SEQ ID NO: 393907

SEQ ID NO: 410029 - RNA, 63 nt, Human; identical to SEQ ID NO: 393908

SEQ ID NO: 410030 - RNA, 63 nt, Human; identical to SEQ ID NO: 393909

SEQ ID NO: 410031 - RNA, 63 nt, Human; identical to SEQ ID NO: 393910

SEQ ID NO: 410032 - RNA, 63 nt, Human; identical to SEQ ID NO: 393911

SEQ ID NO: 410033 - RNA, 63 nt, Human; identical to SEQ ID NO: 393912

SEQ ID NO: 410034 - RNA, 63 nt, Human; identical to SEQ ID NO: 393913

SEQ ID NO: 410035 - RNA, 63 nt, Human; identical to SEQ ID NO: 393914

SEQ ID NO: 410036 - RNA, 63 nt, Human; identical to SEQ ID NO: 393915

SEQ ID NO: 410037 - RNA, 63 nt, Human; identical to SEQ ID NO: 393916

SEQ ID NO: 410038 - RNA, 63 nt, Human; identical to SEQ ID NO: 393917

SEQ ID NO: 410039 - RNA, 63 nt, Human; identical to SEQ ID NO: 393918

SEQ ID NO: 410040 - RNA, 63 nt, Human; identical to SEQ ID NO: 393919

SEQ ID NO: 410041 - RNA, 63 nt, Human; identical to SEQ ID NO: 393920

SEQ ID NO: 410042 - RNA, 63 nt, Human; identical to SEQ ID NO: 393921

SEQ ID NO: 410043 - RNA, 63 nt, Human; identical to SEQ ID NO: 393922

SEQ ID NO: 410044 - RNA, 63 nt, Human; identical to SEQ ID NO: 393923

SEQ ID NO: 410045 - RNA, 59 nt, Human; identical to SEQ ID NO: 79421

SEQ ID NO: 410046 - RNA, 63 nt, Human; identical to SEQ ID NO: 393925

SEQ ID NO: 410047 - RNA, 63 nt, Human; identical to SEQ ID NO: 393926

SEQ ID NO: 410048 - RNA, 63 nt, Human; identical to SEQ ID NO: 393927

SEQ ID NO: 410049 - RNA, 63 nt, Human; identical to SEQ ID NO: 393928

SEQ ID NO: 410050 - RNA, 63 nt, Human; identical to SEQ ID NO: 393929

SEQ ID NO: 410051 - RNA, 63 nt, Human; identical to SEQ ID NO: 393930

SEQ ID NO: 410052 - RNA, 63 nt, Human; identical to SEQ ID NO: 393931

SEQ ID NO: 410053 - RNA, 63 nt, Human; identical to SEQ ID NO: 393932

SEQ ID NO: 410054 - RNA, 63 nt, Human; identical to SEQ ID NO: 393933

SEQ ID NO: 410055 - RNA, 63 nt, Human; identical to SEQ ID NO: 393934

SEQ ID NO: 410056 - RNA, 63 nt, Human; identical to SEQ ID NO: 393935

SEQ ID NO: 410057 - RNA, 63 nt, Human; identical to SEQ ID NO: 393936

SEQ ID NO: 410058 - RNA, 63 nt, Human; identical to SEQ ID NO: 393937

SEQ ID NO: 410059 - RNA, 63 nt, Human; identical to SEQ ID NO: 393938

SEQ ID NO: 410060 - RNA, 63 nt, Human; identical to SEQ ID NO: 393939

SEQ ID NO: 410061 - RNA, 63 nt, Human; identical to SEQ ID NO: 393940

SEQ ID NO: 410062 - RNA, 63 nt, Human; identical to SEQ ID NO: 393941

SEQ ID NO: 410063 - RNA, 63 nt, Human; identical to SEQ ID NO: 393942

SEQ ID NO: 410064 - RNA, 63 nt, Human; identical to SEQ ID NO: 393943

SEQ ID NO: 410065 - RNA, 63 nt, Human; identical to SEQ ID NO: 393944

SEQ ID NO: 410066 - RNA, 63 nt, Human; identical to SEQ ID NO: 393945

SEQ ID NO: 410067 - RNA, 63 nt, Human; identical to SEQ ID NO: 393946

SEQ ID NO: 410068 - RNA, 63 nt, Human; identical to SEQ ID NO: 393947

SEQ ID NO: 410069 - RNA, 63 nt, Human; identical to SEQ ID NO: 393948

SEQ ID NO: 410070 - RNA, 63 nt, Human; identical to SEQ ID NO: 393949

SEQ ID NO: 410071 - RNA, 63 nt, Human; identical to SEQ ID NO: 393950

SEQ ID NO: 410072 - RNA, 63 nt, Human; identical to SEQ ID NO: 393951

SEQ ID NO: 410073 - RNA, 63 nt, Human; identical to SEQ ID NO: 393952

SEQ ID NO: 410074 - RNA, 63 nt, Human; identical to SEQ ID NO: 393953

SEQ ID NO: 410075 - RNA, 63 nt, Human; identical to SEQ ID NO: 393954

SEQ ID NO: 410076 - RNA, 63 nt, Human; identical to SEQ ID NO: 393955

SEQ ID NO: 410077 - RNA, 63 nt, Human; identical to SEQ ID NO: 393956

SEQ ID NO: 410078 - RNA, 63 nt, Human; identical to SEQ ID NO: 393957

SEQ ID NO: 410079 - RNA, 63 nt, Human; identical to SEQ ID NO: 393958

SEQ ID NO: 410080 - RNA, 63 nt, Human; identical to SEQ ID NO: 393959

SEQ ID NO: 410081 - RNA, 63 nt, Human; identical to SEQ ID NO: 393960

SEQ ID NO: 410082 - RNA, 63 nt, Human; identical to SEQ ID NO: 393961

SEQ ID NO: 410083 - RNA, 63 nt, Human; identical to SEQ ID NO: 393962

SEQ ID NO: 410084 - RNA, 63 nt, Human; identical to SEQ ID NO: 393963

SEQ ID NO: 410085 - RNA, 63 nt, Human; identical to SEQ ID NO: 393964

SEQ ID NO: 410086 - RNA, 63 nt, Human; identical to SEQ ID NO: 393965

SEQ ID NO: 410087 - RNA, 63 nt, Human; identical to SEQ ID NO: 393966

SEQ ID NO: 410088 - RNA, 63 nt, Human; identical to SEQ ID NO: 393967

SEQ ID NO: 410089 - RNA, 63 nt, Human; identical to SEQ ID NO: 393968

SEQ ID NO: 410090 - RNA, 63 nt, Human; identical to SEQ ID NO: 393969

SEQ ID NO: 410091 - RNA, 51 nt, Human; identical to SEQ ID NO: 79467

SEQ ID NO: 410092 - RNA, 63 nt, Human; identical to SEQ ID NO: 393971

SEQ ID NO: 410093 - RNA, 63 nt, Human; identical to SEQ ID NO: 393972

SEQ ID NO: 410094 - RNA, 52 nt, Human; identical to SEQ ID NO: 79470

SEQ ID NO: 410095 - RNA, 63 nt, Human; identical to SEQ ID NO: 393974

SEQ ID NO: 410096 - RNA, 63 nt, Human; identical to SEQ ID NO: 393975

SEQ ID NO: 410097 - RNA, 63 nt, Human; identical to SEQ ID NO: 393976

SEQ ID NO: 410098 - RNA, 63 nt, Human; identical to SEQ ID NO: 393977

SEQ ID NO: 410099 - RNA, 63 nt, Human; identical to SEQ ID NO: 393978

SEQ ID NO: 410100 - RNA, 63 nt, Human; identical to SEQ ID NO: 393979

SEQ ID NO: 410101 - RNA, 63 nt, Human; identical to SEQ ID NO: 393980

SEQ ID NO: 410102 - RNA, 63 nt, Human; identical to SEQ ID NO: 393981

SEQ ID NO: 410103 - RNA, 63 nt, Human; identical to SEQ ID NO: 393982

SEQ ID NO: 410104 - RNA, 63 nt, Human; identical to SEQ ID NO: 393983

SEQ ID NO: 410105 - RNA, 63 nt, Human; identical to SEQ ID NO: 393984

SEQ ID NO: 410106 - RNA, 63 nt, Human; identical to SEQ ID NO: 393985

SEQ ID NO: 410107 - RNA, 63 nt, Human; identical to SEQ ID NO: 393986

SEQ ID NO: 410108 - RNA, 63 nt, Human; identical to SEQ ID NO: 393987

SEQ ID NO: 410109 - RNA, 63 nt, Human; identical to SEQ ID NO: 393988

SEQ ID NO: 410110 - RNA, 63 nt, Human; identical to SEQ ID NO: 393989

SEQ ID NO: 410111 - RNA, 63 nt, Human; identical to SEQ ID NO: 393990

SEQ ID NO: 410112 - RNA, 63 nt, Human; identical to SEQ ID NO: 393991

SEQ ID NO: 410113 - RNA, 63 nt, Human; identical to SEQ ID NO: 393992

SEQ ID NO: 410114 - RNA, 63 nt, Human; identical to SEQ ID NO: 393993

SEQ ID NO: 410115 - RNA, 63 nt, Human; identical to SEQ ID NO: 393994

SEQ ID NO: 410116 - RNA, 63 nt, Human; identical to SEQ ID NO: 393995

SEQ ID NO: 410117 - RNA, 63 nt, Human; identical to SEQ ID NO: 393996

SEQ ID NO: 410118 - RNA, 63 nt, Human; identical to SEQ ID NO: 393997

SEQ ID NO: 410119 - RNA, 63 nt, Human; identical to SEQ ID NO: 393998

SEQ ID NO: 410120 - RNA, 63 nt, Human; identical to SEQ ID NO: 393999

SEQ ID NO: 410121 - RNA, 63 nt, Human; identical to SEQ ID NO: 394000

SEQ ID NO: 410122 - RNA, 63 nt, Human; identical to SEQ ID NO: 394001

SEQ ID NO: 410123 - RNA, 63 nt, Human; identical to SEQ ID NO: 394002

SEQ ID NO: 410124 - RNA, 63 nt, Human; identical to SEQ ID NO: 394003

SEQ ID NO: 410125 - RNA, 63 nt, Human; identical to SEQ ID NO: 394004

SEQ ID NO: 410126 - RNA, 63 nt, Human; identical to SEQ ID NO: 394005

SEQ ID NO: 410127 - RNA, 63 nt, Human; identical to SEQ ID NO: 394006

SEQ ID NO: 410128 - RNA, 63 nt, Human; identical to SEQ ID NO: 394007

SEQ ID NO: 410129 - RNA, 63 nt, Human; identical to SEQ ID NO: 394008

SEQ ID NO: 410130 - RNA, 63 nt, Human; identical to SEQ ID NO: 394009

SEQ ID NO: 410131 - RNA, 63 nt, Human; identical to SEQ ID NO: 394010

SEQ ID NO: 410132 - RNA, 63 nt, Human; identical to SEQ ID NO: 394011

SEQ ID NO: 410133 - RNA, 63 nt, Human; identical to SEQ ID NO: 394012

SEQ ID NO: 410134 - RNA, 63 nt, Human; identical to SEQ ID NO: 394013

SEQ ID NO: 410135 - RNA, 63 nt, Human; identical to SEQ ID NO: 394014

SEQ ID NO: 410136 - RNA, 63 nt, Human; identical to SEQ ID NO: 394015

SEQ ID NO: 410137 - RNA, 63 nt, Human; identical to SEQ ID NO: 394016

SEQ ID NO: 410138 - RNA, 63 nt, Human; identical to SEQ ID NO: 394017

SEQ ID NO: 410139 - RNA, 63 nt, Human; identical to SEQ ID NO: 394018

SEQ ID NO: 410140 - RNA, 63 nt, Human; identical to SEQ ID NO: 394019

SEQ ID NO: 410141 - RNA, 63 nt, Human; identical to SEQ ID NO: 394020

SEQ ID NO: 410142 - RNA, 63 nt, Human; identical to SEQ ID NO: 394021

SEQ ID NO: 410143 - RNA, 63 nt, Human; identical to SEQ ID NO: 394022

SEQ ID NO: 410144 - RNA, 63 nt, Human; identical to SEQ ID NO: 394023

SEQ ID NO: 410145 - RNA, 63 nt, Human; identical to SEQ ID NO: 394024

SEQ ID NO: 410146 - RNA, 63 nt, Human; identical to SEQ ID NO: 394025

SEQ ID NO: 410147 - RNA, 63 nt, Human; identical to SEQ ID NO: 394026

SEQ ID NO: 410148 - RNA, 63 nt, Human; identical to SEQ ID NO: 394027

SEQ ID NO: 410149 - RNA, 63 nt, Human; identical to SEQ ID NO: 394028

SEQ ID NO: 410150 - RNA, 63 nt, Human; identical to SEQ ID NO: 394029

SEQ ID NO: 410151 - RNA, 63 nt, Human; identical to SEQ ID NO: 394030

SEQ ID NO: 410152 - RNA, 50 nt, Human; identical to SEQ ID NO: 79528

SEQ ID NO: 410153 - RNA, 63 nt, Human; identical to SEQ ID NO: 394032

SEQ ID NO: 410154 - RNA, 63 nt, Human; identical to SEQ ID NO: 394033

SEQ ID NO: 410155 - RNA, 63 nt, Human; identical to SEQ ID NO: 394034

SEQ ID NO: 410156 - RNA, 63 nt, Human; identical to SEQ ID NO: 394035

SEQ ID NO: 410157 - RNA, 63 nt, Human; identical to SEQ ID NO: 394036

SEQ ID NO: 410158 - RNA, 63 nt, Human; identical to SEQ ID NO: 394037

SEQ ID NO: 410159 - RNA, 63 nt, Human; identical to SEQ ID NO: 394038

SEQ ID NO: 410160 - RNA, 63 nt, Human; identical to SEQ ID NO: 394039

SEQ ID NO: 410161 - RNA, 63 nt, Human; identical to SEQ ID NO: 394040

SEQ ID NO: 410162 - RNA, 63 nt, Human; identical to SEQ ID NO: 394041

SEQ ID NO: 410163 - RNA, 63 nt, Human; identical to SEQ ID NO: 394042

SEQ ID NO: 410164 - RNA, 63 nt, Human; identical to SEQ ID NO: 394043

SEQ ID NO: 410165 - RNA, 63 nt, Human; identical to SEQ ID NO: 394044

SEQ ID NO: 410166 - RNA, 63 nt, Human; identical to SEQ ID NO: 394045

SEQ ID NO: 410167 - RNA, 63 nt, Human; identical to SEQ ID NO: 394046

SEQ ID NO: 410168 - RNA, 63 nt, Human; identical to SEQ ID NO: 394047

SEQ ID NO: 410169 - RNA, 63 nt, Human; identical to SEQ ID NO: 394048

SEQ ID NO: 410170 - RNA, 63 nt, Human; identical to SEQ ID NO: 394049

SEQ ID NO: 410171 - RNA, 60 nt, Human; identical to SEQ ID NO: 83030

SEQ ID NO: 410172 - RNA, 56 nt, Human; identical to SEQ ID NO: 79548

SEQ ID NO: 410173 - RNA, 63 nt, Human; identical to SEQ ID NO: 394052

SEQ ID NO: 410174 - RNA, 63 nt, Human; identical to SEQ ID NO: 394053

SEQ ID NO: 410175 - RNA, 63 nt, Human; identical to SEQ ID NO: 394054

SEQ ID NO: 410176 - RNA, 63 nt, Human; identical to SEQ ID NO: 394055

SEQ ID NO: 410177 - RNA, 63 nt, Human; identical to SEQ ID NO: 394056

SEQ ID NO: 410178 - RNA, 63 nt, Human; identical to SEQ ID NO: 394057

SEQ ID NO: 410179 - RNA, 63 nt, Human; identical to SEQ ID NO: 394058

SEQ ID NO: 410180 - RNA, 63 nt, Human; identical to SEQ ID NO: 394059

SEQ ID NO: 410181 - RNA, 63 nt, Human; identical to SEQ ID NO: 394060

SEQ ID NO: 410182 - RNA, 63 nt, Human; identical to SEQ ID NO: 394061

SEQ ID NO: 410183 - RNA, 63 nt, Human; identical to SEQ ID NO: 394062

SEQ ID NO: 410184 - RNA, 63 nt, Human; identical to SEQ ID NO: 394063

SEQ ID NO: 410185 - RNA, 63 nt, Human; identical to SEQ ID NO: 394064

SEQ ID NO: 410186 - RNA, 63 nt, Human; identical to SEQ ID NO: 394065

SEQ ID NO: 410187 - RNA, 63 nt, Human; identical to SEQ ID NO: 394066

SEQ ID NO: 410188 - RNA, 63 nt, Human; identical to SEQ ID NO: 394067

SEQ ID NO: 410189 - RNA, 63 nt, Human; identical to SEQ ID NO: 394068

SEQ ID NO: 410190 - RNA, 63 nt, Human; identical to SEQ ID NO: 394069

SEQ ID NO: 410191 - RNA, 63 nt, Human; identical to SEQ ID NO: 394070

SEQ ID NO: 410192 - RNA, 63 nt, Human; identical to SEQ ID NO: 394071

SEQ ID NO: 410193 - RNA, 63 nt, Human; identical to SEQ ID NO: 394072

SEQ ID NO: 410194 - RNA, 63 nt, Human; identical to SEQ ID NO: 394073

SEQ ID NO: 410195 - RNA, 63 nt, Human; identical to SEQ ID NO: 394074

SEQ ID NO: 410196 - RNA, 63 nt, Human; identical to SEQ ID NO: 394075

SEQ ID NO: 410197 - RNA, 63 nt, Human; identical to SEQ ID NO: 394076

SEQ ID NO: 410198 - RNA, 63 nt, Human; identical to SEQ ID NO: 394077

SEQ ID NO: 410199 - RNA, 63 nt, Human; identical to SEQ ID NO: 394078

SEQ ID NO: 410200 - RNA, 63 nt, Human; identical to SEQ ID NO: 394079

SEQ ID NO: 410201 - RNA, 63 nt, Human; identical to SEQ ID NO: 394080

SEQ ID NO: 410202 - RNA, 63 nt, Human; identical to SEQ ID NO: 394081

SEQ ID NO: 410203 - RNA, 63 nt, Human; identical to SEQ ID NO: 394082

SEQ ID NO: 410204 - RNA, 63 nt, Human; identical to SEQ ID NO: 394083

SEQ ID NO: 410205 - RNA, 63 nt, Human; identical to SEQ ID NO: 394084

SEQ ID NO: 410206 - RNA, 63 nt, Human; identical to SEQ ID NO: 394085

SEQ ID NO: 410207 - RNA, 63 nt, Human; identical to SEQ ID NO: 394086

SEQ ID NO: 410208 - RNA, 63 nt, Human; identical to SEQ ID NO: 394087

SEQ ID NO: 410209 - RNA, 63 nt, Human; identical to SEQ ID NO: 394088

SEQ ID NO: 410210 - RNA, 63 nt, Human; identical to SEQ ID NO: 394089

SEQ ID NO: 410211 - RNA, 63 nt, Human; identical to SEQ ID NO: 394090

SEQ ID NO: 410212 - RNA, 63 nt, Human; identical to SEQ ID NO: 394091

SEQ ID NO: 410213 - RNA, 63 nt, Human; identical to SEQ ID NO: 394092

SEQ ID NO: 410214 - RNA, 63 nt, Human; identical to SEQ ID NO: 394093

SEQ ID NO: 410215 - RNA, 63 nt, Human; identical to SEQ ID NO: 394094

SEQ ID NO: 410216 - RNA, 63 nt, Human; identical to SEQ ID NO: 394095

SEQ ID NO: 410217 - RNA, 63 nt, Human; identical to SEQ ID NO: 394096

SEQ ID NO: 410218 - RNA, 63 nt, Human; identical to SEQ ID NO: 394097

SEQ ID NO: 410219 - RNA, 63 nt, Human; identical to SEQ ID NO: 394098

SEQ ID NO: 410220 - RNA, 63 nt, Human; identical to SEQ ID NO: 394099

SEQ ID NO: 410221 - RNA, 63 nt, Human; identical to SEQ ID NO: 394100

SEQ ID NO: 410222 - RNA, 63 nt, Human; identical to SEQ ID NO: 394101

SEQ ID NO: 410223 - RNA, 63 nt, Human; identical to SEQ ID NO: 394102

SEQ ID NO: 410224 - RNA, 63 nt, Human; identical to SEQ ID NO: 394103

SEQ ID NO: 410225 - RNA, 63 nt, Human; identical to SEQ ID NO: 394104

SEQ ID NO: 410226 - RNA, 63 nt, Human; identical to SEQ ID NO: 394105

SEQ ID NO: 410227 - RNA, 63 nt, Human; identical to SEQ ID NO: 394106

SEQ ID NO: 410228 - RNA, 63 nt, Human; identical to SEQ ID NO: 394107

SEQ ID NO: 410229 - RNA, 63 nt, Human; identical to SEQ ID NO: 394108

SEQ ID NO: 410230 - RNA, 63 nt, Human; identical to SEQ ID NO: 394109

SEQ ID NO: 410231 - RNA, 63 nt, Human; identical to SEQ ID NO: 394110

SEQ ID NO: 410232 - RNA, 63 nt, Human; identical to SEQ ID NO: 394111

SEQ ID NO: 410233 - RNA, 63 nt, Human; identical to SEQ ID NO: 394112

SEQ ID NO: 410234 - RNA, 63 nt, Human; identical to SEQ ID NO: 394113

SEQ ID NO: 410235 - RNA, 63 nt, Human; identical to SEQ ID NO: 394114

SEQ ID NO: 410236 - RNA, 63 nt, Human; identical to SEQ ID NO: 394115

SEQ ID NO: 410237 - RNA, 63 nt, Human; identical to SEQ ID NO: 394116

SEQ ID NO: 410238 - RNA, 63 nt, Human; identical to SEQ ID NO: 394117

SEQ ID NO: 410239 - RNA, 63 nt, Human; identical to SEQ ID NO: 394118

SEQ ID NO: 410240 - RNA, 63 nt, Human; identical to SEQ ID NO: 394119

SEQ ID NO: 410241 - RNA, 63 nt, Human; identical to SEQ ID NO: 394120

SEQ ID NO: 410242 - RNA, 63 nt, Human; identical to SEQ ID NO: 394121

SEQ ID NO: 410243 - RNA, 63 nt, Human; identical to SEQ ID NO: 394122

SEQ ID NO: 410244 - RNA, 63 nt, Human; identical to SEQ ID NO: 394123

SEQ ID NO: 410245 - RNA, 63 nt, Human; identical to SEQ ID NO: 394124

SEQ ID NO: 410246 - RNA, 63 nt, Human; identical to SEQ ID NO: 394125

SEQ ID NO: 410247 - RNA, 63 nt, Human; identical to SEQ ID NO: 394126

SEQ ID NO: 410248 - RNA, 63 nt, Human; identical to SEQ ID NO: 394127

SEQ ID NO: 410249 - RNA, 63 nt, Human; identical to SEQ ID NO: 394128

SEQ ID NO: 410250 - RNA, 63 nt, Human; identical to SEQ ID NO: 394129

SEQ ID NO: 410251 - RNA, 63 nt, Human; identical to SEQ ID NO: 394130

SEQ ID NO: 410252 - RNA, 63 nt, Human; identical to SEQ ID NO: 394131

SEQ ID NO: 410253 - RNA, 63 nt, Human; identical to SEQ ID NO: 394132

SEQ ID NO: 410254 - RNA, 63 nt, Human; identical to SEQ ID NO: 394133

SEQ ID NO: 410255 - RNA, 63 nt, Human; identical to SEQ ID NO: 394134

SEQ ID NO: 410256 - RNA, 63 nt, Human; identical to SEQ ID NO: 394135

SEQ ID NO: 410257 - RNA, 63 nt, Human; identical to SEQ ID NO: 394136

SEQ ID NO: 410258 - RNA, 63 nt, Human; identical to SEQ ID NO: 394137

SEQ ID NO: 410259 - RNA, 63 nt, Human; identical to SEQ ID NO: 394138

SEQ ID NO: 410260 - RNA, 63 nt, Human; identical to SEQ ID NO: 394139

SEQ ID NO: 410261 - RNA, 63 nt, Human; identical to SEQ ID NO: 394140

SEQ ID NO: 410262 - RNA, 63 nt, Human; identical to SEQ ID NO: 394141

SEQ ID NO: 410263 - RNA, 63 nt, Human; identical to SEQ ID NO: 394142

SEQ ID NO: 410264 - RNA, 63 nt, Human; identical to SEQ ID NO: 394143

SEQ ID NO: 410265 - RNA, 63 nt, Human; identical to SEQ ID NO: 394144

SEQ ID NO: 410266 - RNA, 63 nt, Human; identical to SEQ ID NO: 394145

SEQ ID NO: 410267 - RNA, 54 nt, Human; identical to SEQ ID NO: 79643

SEQ ID NO: 410268 - RNA, 63 nt, Human; identical to SEQ ID NO: 394147

SEQ ID NO: 410269 - RNA, 63 nt, Human; identical to SEQ ID NO: 394148

SEQ ID NO: 410270 - RNA, 63 nt, Human; identical to SEQ ID NO: 394149

SEQ ID NO: 410271 - RNA, 63 nt, Human; identical to SEQ ID NO: 394150

SEQ ID NO: 410272 - RNA, 63 nt, Human; identical to SEQ ID NO: 394151

SEQ ID NO: 410273 - RNA, 63 nt, Human; identical to SEQ ID NO: 394152

SEQ ID NO: 410274 - RNA, 63 nt, Human; identical to SEQ ID NO: 394153

SEQ ID NO: 410275 - RNA, 63 nt, Human; identical to SEQ ID NO: 394154

SEQ ID NO: 410276 - RNA, 63 nt, Human; identical to SEQ ID NO: 394155

SEQ ID NO: 410277 - RNA, 63 nt, Human; identical to SEQ ID NO: 394156

SEQ ID NO: 410278 - RNA, 63 nt, Human; identical to SEQ ID NO: 394157

SEQ ID NO: 410279 - RNA, 63 nt, Human; identical to SEQ ID NO: 394158

SEQ ID NO: 410280 - RNA, 63 nt, Human; identical to SEQ ID NO: 394159

SEQ ID NO: 410281 - RNA, 63 nt, Human; identical to SEQ ID NO: 394160

SEQ ID NO: 410282 - RNA, 63 nt, Human; identical to SEQ ID NO: 394161

SEQ ID NO: 410283 - RNA, 63 nt, Human; identical to SEQ ID NO: 394162

SEQ ID NO: 410284 - RNA, 63 nt, Human; identical to SEQ ID NO: 394163

SEQ ID NO: 410285 - RNA, 63 nt, Human; identical to SEQ ID NO: 394164

SEQ ID NO: 410286 - RNA, 63 nt, Human; identical to SEQ ID NO: 394165

SEQ ID NO: 410287 - RNA, 63 nt, Human; identical to SEQ ID NO: 394166

SEQ ID NO: 410288 - RNA, 63 nt, Human; identical to SEQ ID NO: 394167

SEQ ID NO: 410289 - RNA, 63 nt, Human; identical to SEQ ID NO: 394168

SEQ ID NO: 410290 - RNA, 63 nt, Human; identical to SEQ ID NO: 394169

SEQ ID NO: 410291 - RNA, 63 nt, Human; identical to SEQ ID NO: 394170

SEQ ID NO: 410292 - RNA, 63 nt, Human; identical to SEQ ID NO: 394171

SEQ ID NO: 410293 - RNA, 63 nt, Human; identical to SEQ ID NO: 394172

SEQ ID NO: 410294 - RNA, 63 nt, Human; identical to SEQ ID NO: 394173

SEQ ID NO: 410295 - RNA, 63 nt, Human; identical to SEQ ID NO: 394174

SEQ ID NO: 410296 - RNA, 63 nt, Human; identical to SEQ ID NO: 394175

SEQ ID NO: 410297 - RNA, 63 nt, Human; identical to SEQ ID NO: 394176

SEQ ID NO: 410298 - RNA, 63 nt, Human; identical to SEQ ID NO: 394177

SEQ ID NO: 410299 - RNA, 63 nt, Human; identical to SEQ ID NO: 394178

SEQ ID NO: 410300 - RNA, 63 nt, Human; identical to SEQ ID NO: 394179

SEQ ID NO: 410301 - RNA, 63 nt, Human; identical to SEQ ID NO: 394180

SEQ ID NO: 410302 - RNA, 63 nt, Human; identical to SEQ ID NO: 394181

SEQ ID NO: 410303 - RNA, 63 nt, Human; identical to SEQ ID NO: 394182

SEQ ID NO: 410304 - RNA, 63 nt, Human; identical to SEQ ID NO: 394183

SEQ ID NO: 410305 - RNA, 63 nt, Human; identical to SEQ ID NO: 394184

SEQ ID NO: 410306 - RNA, 63 nt, Human; identical to SEQ ID NO: 394185

SEQ ID NO: 410307 - RNA, 63 nt, Human; identical to SEQ ID NO: 394186

SEQ ID NO: 410308 - RNA, 63 nt, Human; identical to SEQ ID NO: 394187

SEQ ID NO: 410309 - RNA, 63 nt, Human; identical to SEQ ID NO: 394188

SEQ ID NO: 410310 - RNA, 63 nt, Human; identical to SEQ ID NO: 394189

SEQ ID NO: 410311 - RNA, 63 nt, Human; identical to SEQ ID NO: 394190

SEQ ID NO: 410312 - RNA, 63 nt, Human; identical to SEQ ID NO: 394191

SEQ ID NO: 410313 - RNA, 63 nt, Human; identical to SEQ ID NO: 394192

SEQ ID NO: 410314 - RNA, 63 nt, Human; identical to SEQ ID NO: 394193

SEQ ID NO: 410315 - RNA, 63 nt, Human; identical to SEQ ID NO: 394194

SEQ ID NO: 410316 - RNA, 63 nt, Human; identical to SEQ ID NO: 394195

SEQ ID NO: 410317 - RNA, 63 nt, Human; identical to SEQ ID NO: 394196

SEQ ID NO: 410318 - RNA, 63 nt, Human; identical to SEQ ID NO: 394197

SEQ ID NO: 410319 - RNA, 63 nt, Human; identical to SEQ ID NO: 394198

SEQ ID NO: 410320 - RNA, 63 nt, Human; identical to SEQ ID NO: 394199

SEQ ID NO: 410321 - RNA, 63 nt, Human; identical to SEQ ID NO: 394200

SEQ ID NO: 410322 - RNA, 63 nt, Human; identical to SEQ ID NO: 394201

SEQ ID NO: 410323 - RNA, 63 nt, Human; identical to SEQ ID NO: 394202

SEQ ID NO: 410324 - RNA, 63 nt, Human; identical to SEQ ID NO: 394203

SEQ ID NO: 410325 - RNA, 63 nt, Human; identical to SEQ ID NO: 394204

SEQ ID NO: 410326 - RNA, 63 nt, Human; identical to SEQ ID NO: 394205

SEQ ID NO: 410327 - RNA, 63 nt, Human; identical to SEQ ID NO: 394206

SEQ ID NO: 410328 - RNA, 63 nt, Human; identical to SEQ ID NO: 394207

SEQ ID NO: 410329 - RNA, 63 nt, Human; identical to SEQ ID NO: 394208

SEQ ID NO: 410330 - RNA, 63 nt, Human; identical to SEQ ID NO: 394209

SEQ ID NO: 410331 - RNA, 63 nt, Human; identical to SEQ ID NO: 394210

SEQ ID NO: 410332 - RNA, 63 nt, Human; identical to SEQ ID NO: 394211

SEQ ID NO: 410333 - RNA, 63 nt, Human; identical to SEQ ID NO: 83192

SEQ ID NO: 410334 - RNA, 63 nt, Human; identical to SEQ ID NO: 394213

SEQ ID NO: 410335 - RNA, 63 nt, Human; identical to SEQ ID NO: 394214

SEQ ID NO: 410336 - RNA, 63 nt, Human; identical to SEQ ID NO: 394215

SEQ ID NO: 410337 - RNA, 63 nt, Human; identical to SEQ ID NO: 394216

SEQ ID NO: 410338 - RNA, 63 nt, Human; identical to SEQ ID NO: 394217

SEQ ID NO: 410339 - RNA, 63 nt, Human; identical to SEQ ID NO: 394218

SEQ ID NO: 410340 - RNA, 63 nt, Human; identical to SEQ ID NO: 394219

SEQ ID NO: 410341 - RNA, 63 nt, Human; identical to SEQ ID NO: 394220

SEQ ID NO: 410342 - RNA, 63 nt, Human; identical to SEQ ID NO: 394221

SEQ ID NO: 410343 - RNA, 63 nt, Human; identical to SEQ ID NO: 394222

SEQ ID NO: 410344 - RNA, 63 nt, Human; identical to SEQ ID NO: 394223

SEQ ID NO: 410345 - RNA, 63 nt, Human; identical to SEQ ID NO: 394224

SEQ ID NO: 410346 - RNA, 63 nt, Human; identical to SEQ ID NO: 394225

SEQ ID NO: 410347 - RNA, 63 nt, Human; identical to SEQ ID NO: 394226

SEQ ID NO: 410348 - RNA, 63 nt, Human; identical to SEQ ID NO: 394227

SEQ ID NO: 410349 - RNA, 63 nt, Human; identical to SEQ ID NO: 394228

SEQ ID NO: 410350 - RNA, 63 nt, Human; identical to SEQ ID NO: 394229

SEQ ID NO: 410351 - RNA, 63 nt, Human; identical to SEQ ID NO: 394230

SEQ ID NO: 410352 - RNA, 63 nt, Human; identical to SEQ ID NO: 394231

SEQ ID NO: 410353 - RNA, 63 nt, Human; identical to SEQ ID NO: 394232

SEQ ID NO: 410354 - RNA, 63 nt, Human; identical to SEQ ID NO: 394233

SEQ ID NO: 410355 - RNA, 63 nt, Human; identical to SEQ ID NO: 394234

SEQ ID NO: 410356 - RNA, 63 nt, Human; identical to SEQ ID NO: 394235

SEQ ID NO: 410357 - RNA, 63 nt, Human; identical to SEQ ID NO: 394236

SEQ ID NO: 410358 - RNA, 63 nt, Human; identical to SEQ ID NO: 394237

SEQ ID NO: 410359 - RNA, 63 nt, Human; identical to SEQ ID NO: 394238

SEQ ID NO: 410360 - RNA, 63 nt, Human; identical to SEQ ID NO: 394239

SEQ ID NO: 410361 - RNA, 63 nt, Human; identical to SEQ ID NO: 394240

SEQ ID NO: 410362 - RNA, 63 nt, Human; identical to SEQ ID NO: 394241

SEQ ID NO: 410363 - RNA, 63 nt, Human; identical to SEQ ID NO: 394242

SEQ ID NO: 410364 - RNA, 63 nt, Human; identical to SEQ ID NO: 394243

SEQ ID NO: 410365 - RNA, 63 nt, Human; identical to SEQ ID NO: 394244

SEQ ID NO: 410366 - RNA, 63 nt, Human; identical to SEQ ID NO: 394245

SEQ ID NO: 410367 - RNA, 63 nt, Human; identical to SEQ ID NO: 394246

SEQ ID NO: 410368 - RNA, 63 nt, Human; identical to SEQ ID NO: 394247

SEQ ID NO: 410369 - RNA, 63 nt, Human; identical to SEQ ID NO: 394248

SEQ ID NO: 410370 - RNA, 63 nt, Human; identical to SEQ ID NO: 394249

SEQ ID NO: 410371 - RNA, 63 nt, Human; identical to SEQ ID NO: 394250

SEQ ID NO: 410372 - RNA, 63 nt, Human; identical to SEQ ID NO: 394251

SEQ ID NO: 410373 - RNA, 63 nt, Human; identical to SEQ ID NO: 394252

SEQ ID NO: 410374 - RNA, 63 nt, Human; identical to SEQ ID NO: 394253

SEQ ID NO: 410375 - RNA, 63 nt, Human; identical to SEQ ID NO: 394254

SEQ ID NO: 410376 - RNA, 63 nt, Human; identical to SEQ ID NO: 394255

SEQ ID NO: 410377 - RNA, 63 nt, Human; identical to SEQ ID NO: 394256

SEQ ID NO: 410378 - RNA, 63 nt, Human; identical to SEQ ID NO: 394257

SEQ ID NO: 410379 - RNA, 63 nt, Human; identical to SEQ ID NO: 394258

SEQ ID NO: 410380 - RNA, 63 nt, Human; identical to SEQ ID NO: 394259

SEQ ID NO: 410381 - RNA, 63 nt, Human; identical to SEQ ID NO: 394260

SEQ ID NO: 410382 - RNA, 63 nt, Human; identical to SEQ ID NO: 394261

SEQ ID NO: 410383 - RNA, 63 nt, Human; identical to SEQ ID NO: 394262

SEQ ID NO: 410384 - RNA, 63 nt, Human; identical to SEQ ID NO: 394263

SEQ ID NO: 410385 - RNA, 56 nt, Human; identical to SEQ ID NO: 79761

SEQ ID NO: 410386 - RNA, 63 nt, Human; identical to SEQ ID NO: 394265

SEQ ID NO: 410387 - RNA, 63 nt, Human; identical to SEQ ID NO: 394266

SEQ ID NO: 410388 - RNA, 58 nt, Human; identical to SEQ ID NO: 79764

SEQ ID NO: 410389 - RNA, 56 nt, Human; identical to SEQ ID NO: 79765

SEQ ID NO: 410390 - RNA, 52 nt, Human; identical to SEQ ID NO: 79766

SEQ ID NO: 410391 - RNA, 63 nt, Human; identical to SEQ ID NO: 394270

SEQ ID NO: 410392 - RNA, 64 nt, Human
ucccggucugcguuugggagaccccuggggguugccggggcagcgcgccguguccagguggagg

SEQ ID NO: 410393 - RNA, 64 nt, Human
caggccacugugagggugggugcuggcugagcccccggggcagcaggagccaggcaggugaugu

SEQ ID NO: 410394 - RNA, 64 nt, Human
ccugugcgugcgcuggggccaugggguggccccgccggggcagcgggggagcugccugcagaag

SEQ ID NO: 410395 - RNA, 64 nt, Human
cucacuccggcgggcacagcuggcuggggcuguuccggggcauggaagauucccagucacccac

SEQ ID NO: 410396 - RNA, 64 nt, Human
gggcaggcaugggacuggcccaggcacacaggucccggggcaucaggagaaaggcugggucuug

SEQ ID NO: 410397 - RNA, 64 nt, Human
uacaugccucaugucaaaugcagcaucagucuuuccggggcauuucaguuaagcugcucagcag

SEQ ID NO: 410398 - RNA, 64 nt, Human
aacagaacaucaugauccccccacagaugaggccccggggcauggcugcugacgugggcauggg

SEQ ID NO: 410399 - RNA, 57 nt, Human
cuccccaggaucccuccugaaagggguccggggcaccuucacgguuuucugugccac

SEQ ID NO: 410400 - RNA, 64 nt, Human
gcuucaccccugcacuucagacaccguuugucccccggggcaaggucuccuuacucugagccca

SEQ ID NO: 410401 - RNA, 64 nt, Human
uccuuccaggauaugugucauuucccaugaggggccggggcagguggcugggugggggcacagg

SEQ ID NO: 410402 - RNA, 64 nt, Human
agcccagggugggagcaggaaaugauugcugagcccggggcaggggaauugcaucugcaggaaa

SEQ ID NO: 410403 - RNA, 64 nt, Human
agcaggaaacccucaaacccagccagaccccaggccggggcauugccagggaggacccucacaa

SEQ ID NO: 410404 - RNA, 64 nt, Human
cucggcgccuggccuggccggugcugcacauccaccggggcacaacagggacuuguccagccuc

SEQ ID NO: 410405 - RNA, 64 nt, Human
guggaaggcuacccugacgcaccauaaucuaagcccggggcauaaaaccccucguggcuuggau

SEQ ID NO: 410406 - RNA, 64 nt, Human
uucuucuaagugacauguuggaagccuucucaucccggggcaaagcaggcaucaaaaccagaau

SEQ ID NO: 410407 - RNA, 64 nt, Human
cguccccacuccuccuucagggacuggccugagaccggggcacaggguaggggggaucccaaca

SEQ ID NO: 410408 - RNA, 64 nt, Human
uccaagggcugugcuaagcagcuguguuguccccccggggcacugccucuggcucacgucaaug

SEQ ID NO: 410409 - RNA, 64 nt, Human
uuaauaccucaaggucauuguggcucuggggaugccggggcaggaggacgagggugcgcugugg

SEQ ID NO: 410410 - RNA, 64 nt, Human
aggaacgugguucagagacuggcagccagggagcccggggcagagcucagaggagucugggaag

SEQ ID NO: 410411 - RNA, 64 nt, Human
ucuaguucccagggcccagccuuccccuucucccccggggcagggacagugcggcauauucaga

SEQ ID NO: 410412 - RNA, 64 nt, Human
uagccccggaugccagcaccugccaggugccgccccggggcaagggccccagcagcccuauggu

SEQ ID NO: 410413 - RNA, 64 nt, Human
agcgccaucagggcaguggccaagaacaccacccccggggcagcccugccugcgggggaguggg

SEQ ID NO: 410414 - RNA, 64 nt, Human
ugaguccugaggagagguugcagaggcugcagggccggggcauggagaagaccagggaagaagc

SEQ ID NO: 410415 - RNA, 64 nt, Human
accugcaggcagaaccugaaagggcauuuuggcuccggggcauccuggauuuagaacauggacu

SEQ ID NO: 410416 - RNA, 64 nt, Human
cacugcccccgcacgaaucaccuccugcuggcuaccggggcaggcaugcacccggugccagccc

SEQ ID NO: 410417 - RNA, 64 nt, Human
gcagucggggacaaggagcuuccgucuggcaaggccggggcacaauuugcacuccccucagcua

SEQ ID NO: 410418 - RNA, 64 nt, Human
ugugcugcucugcuaagagauguccaaggcggagccggggcaagauccuuccagacucaucugu

SEQ ID NO: 410419 - RNA, 64 nt, Human
ggccuccuuacccuuagagacugugacucaguauccggggcagggcccaggcaucuucauuuug

SEQ ID NO: 410420 - RNA, 64 nt, Human
acuaggcggggcggggguugggacccagcgggagccggggcagccuggcuccacggccuguacu

SEQ ID NO: 410421 - RNA, 64 nt, Human
guccucagcagggcggcagccuccuccuggcuguccggggcagagcggaggcugggcuuggcca

SEQ ID NO: 410422 - RNA, 64 nt, Human
uuguuuacaacacaguaguguucuguucacuuuuccggggcacaaguuuuuuuguucauacuuu

SEQ ID NO: 410423 - RNA, 64 nt, Human
agccgacccggccgcugggggaagugccaggggcccggggcacccugcguuuaggcugggucca

SEQ ID NO: 410424 - RNA, 64 nt, Human
cucuuggccuuauguacacagccuugcccggccgccggggcacauagggguuuuaucgggcgug

SEQ ID NO: 410425 - RNA, 64 nt, Human
uaaaaugaaguuggaggaacagcugcuucuggagccggggcaaaaauuucaaggugagccugga

SEQ ID NO: 410426 - RNA, 64 nt, Human
ggcgaauugcuugagcccaggaguucgagaccagccggggcaacauggcaaaacccugucucua

SEQ ID NO: 410427 - RNA, 64 nt, Human
ugccccagcacugagaacaaaaugcaggcaucccccggggcagcaucagagugccuuucuagag

SEQ ID NO: 410428 - RNA, 64 nt, Human
accuugggcaccauuuauccuccuuucaucguccccggggcaguugcgugacccugcugggagg

SEQ ID NO: 410429 - RNA, 64 nt, Human
caggagggcucccugaucugccggcucucaguccccggggcagagccugauugacugugcuggc

SEQ ID NO: 410430 - RNA, 64 nt, Human
uccaucugucuguccuacccgcccgcguccaaccccggggcauggacagggccaggguugcggu

SEQ ID NO: 410431 - RNA, 64 nt, Human
ugccgugugccagaugagcuugugaucugggaagccggggcacccccguuuuguuucucugggc

SEQ ID NO: 410432 - RNA, 64 nt, Human
cccacccagaacccagaugggguggagggggccaccggggcagggagggggcggcaagggggga

SEQ ID NO: 410433 - RNA, 64 nt, Human
ccccaaccucagugaggagagccccgagccggccccggggcaaagaggggugcagagggaguuc

SEQ ID NO: 410434 - RNA, 64 nt, Human
auuacuuaucuuccucuucuaucucuguuauacgccggggcauagaaugcucguauacaucucu

SEQ ID NO: 410435 - RNA, 64 nt, Human
gggggccacauccccaccccagcuguuacccagcccggggcaggugcagcccuuccucccuguc

SEQ ID NO: 410436 - RNA, 64 nt, Human
gugggccccagccguggcgugaacugaggaugacccggggcagcuggcaggagagagccuuggc

SEQ ID NO: 410437 - RNA, 64 nt, Human
guguagccaggaagccccgcucagguagccaccaccggggcacuggcugcucugucuugguccu

SEQ ID NO: 410438 - RNA, 64 nt, Human
acuucaucacugaguacaucaagggcggcacgcuccggggcaucaucaagagcauggugagucc

SEQ ID NO: 410439 - RNA, 64 nt, Human
ggaggaucgcuugaggccaggaauuuuagaccagccggggcaacauagugaaaccccaucucua

SEQ ID NO: 410440 - RNA, 64 nt, Human
acuccccaccccagggacaccgccuccccauuuuccggggcagaguggggacucacagaggccc

SEQ ID NO: 410441 - RNA, 64 nt, Human
uagggaccaccagccgcugcuacugugggccgccccggggcagggugggcagggcuuuuguggg

SEQ ID NO: 410442 - RNA, 64 nt, Human
cugcaagcaaccccgcgcuugggaaggcucuucuccggggcacagugcuaguggggccucccca

SEQ ID NO: 410443 - RNA, 64 nt, Human
caaccuggguacccugguggggaugcagggaaggccggggcagagaaagugaaggucgacccag

SEQ ID NO: 410444 - RNA, 64 nt, Human
ucccagaaacacgcauaauacauuuccguccagcccggggcagucugacugucggugcccuccc

SEQ ID NO: 410445 - RNA, 64 nt, Human
uggugugcaccuguaaucccagcuacucaggaggccggggcaggagaaucgcuugaaccuggga

SEQ ID NO: 410446 - RNA, 64 nt, Human
cugaccuguucucggcaccuuaaauuauuagaccccggggcagucaggugcuccggacacccga

SEQ ID NO: 410447 - RNA, 64 nt, Human
agccuuggaggaggcggugagcgggggagggugcccggggcacacaaggccugcccagccagcc

SEQ ID NO: 410448 - RNA, 64 nt, Human
ucucagaugccccaaaguuucgguuccuaugagcccggggcaugaucugauccccaagacaugu

SEQ ID NO: 410449 - RNA, 64 nt, Human
acaacgccuucaaccgcuuccugcaugccugagcccggggcacuagcccuugcacagaagggca

SEQ ID NO: 410450 - RNA, 64 nt, Human
augugcgacaagcccaaauguuccggggaggcggccggggcagggggcuuagaagugcuaauau

SEQ ID NO: 410451 - RNA, 64 nt, Human
uggggcagaugcuccgcggccuggaguggcucugccggggcauuggugggaccccugcucaggc

SEQ ID NO: 410452 - RNA, 64 nt, Human
gguugggcucaggccacaacggccugagauugccccggggcaacccgucggcucggccuggagg

SEQ ID NO: 410453 - RNA, 64 nt, Human
ccacacccacgucacaagcaccugaggaguccggccggggcacugugguccaaaagguccugcc

SEQ ID NO: 410454 - RNA, 64 nt, Human
uuuuuacugcucucugcucugucaguggagcuauccggggcaauuguagcguuuggguccuuuu

SEQ ID NO: 410455 - RNA, 64 nt, Human
ggcuagggguacaccugacccagcuggccucggcccggggcaccuucggcugguccuguggggc

SEQ ID NO: 410456 - RNA, 64 nt, Human
cagcccuguggugcucaggcagagcucucaggagccggggcaccuugcuguucgcugcuguguc

SEQ ID NO: 410457 - RNA, 64 nt, Human
uuggacgcuuagcuccuaccccuguccuaccucaccggggcacuuucaggggccaggggccucu

SEQ ID NO: 410458 - RNA, 64 nt, Human
agaggcuuuucuucccagcugggccugguggagcccggggcagggggagaguagagacacuccc

SEQ ID NO: 410459 - RNA, 64 nt, Human
ggaggaauggaaacgagagaugugaaguuggcagccggggcauggcguucaagauuuuggagau

SEQ ID NO: 410460 - RNA, 64 nt, Human
cugcagcccguguuccuggccuuccgaaucaugcccggggcagguaaaccucaugcccaugugc

SEQ ID NO: 410461 - RNA, 64 nt, Human
gugcaaaucaacauuccagcggucaggacugaccccggggcagcacugggcucaggcuucagcg

SEQ ID NO: 410462 - RNA, 64 nt, Human
ggggacugagggcauuguugcugauucucacucaccggggcagccugccgcagaugcacaggcc

SEQ ID NO: 410463 - RNA, 64 nt, Human
ccggccuagggcccgaccgcgccggacgcgguguccggggcagggcagggcuggggccugggcc

SEQ ID NO: 410464 - RNA, 64 nt, Human
ugaccagggccugcacagguuaaccgucagacuuccggggcauucagguggggaugcugguggu

SEQ ID NO: 410465 - RNA, 64 nt, Human
agguccugggcagccuucauauuugccauuguguccggggcaccaggagccccaccaaccccaa

SEQ ID NO: 410466 - RNA, 64 nt, Human
caguuuagagcccaaagagccccgagggaaccugccggggcagcggacguuggaagggcgcugg

SEQ ID NO: 410467 - RNA, 64 nt, Human
cggcucccggacgccagcugggcgucagaccccaccggggcaaccuugcagaggacgacccggg

SEQ ID NO: 410468 - RNA, 64 nt, Human
ccugcccuucuagaagucgcugccagggcuggagccggggcaauguugcaaauacgauaaccuu

SEQ ID NO: 410469 - RNA, 64 nt, Human
ccuccucacaucugcccuggggacuccccacacuccggggcagaucuuuccucuugucuguggu

SEQ ID NO: 410470 - RNA, 64 nt, Human
ugucccugucagcggcagagggcguuggggcuggccggggcaccuugucccugcuaugguccac

SEQ ID NO: 410471 - RNA, 64 nt, Human
ucaagcuuucuucuguggucugauuagugugauaccggggcaccuccucugguacuuuuaagug

SEQ ID NO: 410472 - RNA, 64 nt, Human
ggagcaguacaucugaugacuucaggcaggcgggccggggcagggacuugccuccacucaccac

SEQ ID NO: 410473 - RNA, 64 nt, Human
ccuccucccuguccuugugucccuccuugcuuccccggggcacccucgcucucaccucccuccu

SEQ ID NO: 410474 - RNA, 64 nt, Human
aguuggacuaaaugcucuuccuucagaggauuauccggggcaucuacucaaugaaaaaccauga

SEQ ID NO: 410475 - RNA, 64 nt, Human
agcugggauugguaggcuggguccagaacacugaccggggcacagugcaaggacaauugcaagg

SEQ ID NO: 410476 - RNA, 64 nt, Human
cggagcgaacuggcgccuccgagggacgcggcucccggggcagggcagccgucaccccugccuc

SEQ ID NO: 410477 - RNA, 64 nt, Human
aaaaaagaaaaaggguuacaaaagguucccagcuccggggcaucagccugagugcgcuugagcu

SEQ ID NO: 410478 - RNA, 64 nt, Human
agguaaggguggaacaggagggguggggaggaagccggggcagucaccgagugaccaccaagag

SEQ ID NO: 410479 - RNA, 64 nt, Human
cugcuuccugccagccugugcuugcggcagggagccggggcagggcagaggugaacuugaaguu

SEQ ID NO: 410480 - RNA, 64 nt, Human
aaggcauugcucuaccucucccugacauuuugcuccggggcagauccaaccuuaccuggggcag

SEQ ID NO: 410481 - RNA, 64 nt, Human
gcgggagcggggcugcagaguauccgaggugcugccggggcagcgggagguggcuggacccauc

SEQ ID NO: 410482 - RNA, 64 nt, Human
acacgucccgucuuggguguggauggagggcagcccggggcagagccucagccccgcggccccu

SEQ ID NO: 410483 - RNA, 64 nt, Human
uggaaagcagggguuaccguuacgaggcugugguccggggcaagccaaguacgaagcagcagcc

SEQ ID NO: 410484 - RNA, 64 nt, Human
cagcccuccucucccuucugggggcuggagggagccggggcagccacagggagagacaugggcg

SEQ ID NO: 410485 - RNA, 64 nt, Human
cuuggugggcuugggguugguucuggguggugaaccggggcagacccagcuaauggauuaaaaa

SEQ ID NO: 410486 - RNA, 64 nt, Human
acuuucuugagagccaucagcaccccccuuauuuccggggcacuggagccaggcuggaagucaa

SEQ ID NO: 410487 - RNA, 64 nt, Human
ccccaacauagcuuccccacccaggcacccccucccggggcagcaggcgugggagucagggcug

SEQ ID NO: 410488 - RNA, 64 nt, Human
cacgguuuauccucuuggugucugguuucuguccccggggcauuggguucaaggaauccauccu

SEQ ID NO: 410489 - RNA, 64 nt, Human
gaguuuuuucucuugggcugagacuggauacugcccggggcagcugccagagaagcaucggagg

SEQ ID NO: 410490 - RNA, 51 nt, Human
ccuacuacccaucugggugacccggggcaggccacagaggccaggccaggg

SEQ ID NO: 410491 - RNA, 64 nt, Human
acacuugguuccauccauuuaggggccuugccauccggggcauccucccacccugacgccaucu

SEQ ID NO: 410492 - RNA, 64 nt, Human
agaaaugccugcugggccuuaagcuuuccaggggccggggcaguggggagcccccaucccuuca

SEQ ID NO: 410493 - RNA, 64 nt, Human
ccugggugguccccaaggucgcugccacccuugcccggggcagaggcagaagcccacauaugcu

SEQ ID NO: 410494 - RNA, 64 nt, Human
ggccgccugcuguacauagugaagcugucacucgccggggcacggggcgucggcugcugcggcc

SEQ ID NO: 410495 - RNA, 64 nt, Human
uggugcucucagggcaaaaucauguuccccacccccggggcagaaccccucuuagaagccucug

SEQ ID NO: 410496 - RNA, 64 nt, Human
ugaaagacuaccucguucuugucuugaugugucaccggggcaacugccugggggcggggauggg

SEQ ID NO: 410497 - RNA, 64 nt, Human
cuugcccagggugcagugugagugugaugggccaccggggcaagagggaaggugaccgcccagc

SEQ ID NO: 410498 - RNA, 64 nt, Human
aguuccaugauauuaaauccaggucugcauuggcccggggcaagaguuuaacaucuucggcccu

SEQ ID NO: 410499 - RNA, 64 nt, Human
agcagcuggaaguuuggguuuggugguuugggggccggggcagccaagcuguauggggcaggac

SEQ ID NO: 410500 - RNA, 64 nt, Human
ccuggaggcuucuccuggcagagccucccuggggccggggcaggcuguggauggggcggagcag

SEQ ID NO: 410501 - RNA, 64 nt, Human
cuuggauccugggguagggaggcaggguuaggaaccggggcagagucagcucugugcugagccu

SEQ ID NO: 410502 - RNA, 64 nt, Human
cuggaucucccugagaugggcuucccaagggcugccggggcagcccccucacaguauugcucac

SEQ ID NO: 410503 - RNA, 64 nt, Human
uuuuaaaacucugauggggagggugucggggacaccggggcaaaacaagaaaguccuauuuuuc

SEQ ID NO: 410504 - RNA, 64 nt, Human
gaugcaggcagacgcugcgccuccuagugggcucccggggcaccgugggaggcagcggcuccug

SEQ ID NO: 410505 - RNA, 64 nt, Human
ggugcagggcuggugggcggggccagggaaacggccggggcaggggcggggcuugugggagggg

SEQ ID NO: 410506 - RNA, 64 nt, Human
gccucaggucagggcccagcgugugauguaggggccggggcaggccaggguuuguuuguggagg

SEQ ID NO: 410507 - RNA, 64 nt, Human
acagaaauaugggccugcugccauuuccugaagaccggggcaucgggguggggugauaaaggau

SEQ ID NO: 410508 - RNA, 64 nt, Human
ccaggagcgagagacggugccagaacgccggggcccggggcaacuccgagugggugcucaaguc

SEQ ID NO: 410509 - RNA, 64 nt, Human
ccugcugagcucuucuggacucaggaucgcagauccggggcacaaagaggguggggaacauggg

SEQ ID NO: 410510 - RNA, 64 nt, Human
gaguacaaaagagagaaauuuuaaagcuggguguccggggcagacaucacaugucgguagguuc

SEQ ID NO: 410511 - RNA, 64 nt, Human
ucguggagcagaacuucccggccaucgccauccaccggggcauggcccaggaggagcggugagu

SEQ ID NO: 410512 - RNA, 64 nt, Human
augccucagggccuggcccuccugcaugcuaugcccggggcaggccugacgggcagcugaggau

SEQ ID NO: 410513 - RNA, 64 nt, Human
gagcagaaugggccgagcagcugacaaagaugggccggggcaagcacuucaucggagacuuccu

SEQ ID NO: 410514 - RNA, 64 nt, Human
gcaagcugugccuuuugcgccucuugcgcgugcgccggggcacagggagggacagcgggaggug

SEQ ID NO: 410515 - RNA, 64 nt, Human
uucgacuccggggccccguuggaagacugagugcccggggcacggcacagaagccgcgcccacc

SEQ ID NO: 410516 - RNA, 64 nt, Human
cuggacucccagcccugccugucccgggggcgggccggggcagccacuccagccccagcccagc

SEQ ID NO: 410517 - RNA, 64 nt, Human
aauuuuuauaaaguguuuuugaguguccuaugggccggggcaggguccaagaucuuuucccuuc

SEQ ID NO: 410518 - RNA, 64 nt, Human
ggugucccugcgaauggggcgaucaaguccagagccggggcacuuucagaguuugaagguaacu

SEQ ID NO: 410519 - RNA, 64 nt, Human
cggggggccccagagcgaaugagggcagagaugcccggggcaggggcaaacgcccuccgcuccc

SEQ ID NO: 410520 - RNA, 64 nt, Human
gugacaccuccuucagucccacucagcugggcggccggggcaggcuuagggcacaguuaggggc

SEQ ID NO: 410521 - RNA, 64 nt, Human
uaacccggagggaacccugacuacagaaauuaccccggggcacccuuaaaacuuccacuaccuu

SEQ ID NO: 410522 - RNA, 64 nt, Human
ucagagaaaggggagaucugggccugggaagauuccggggcaggggugagcggacguucacaug

SEQ ID NO: 410523 - RNA, 64 nt, Human
ccuucuccacagcccggcccgaccuggagggcccccggggcacugggcggugagccaccuccug

SEQ ID NO: 410524 - RNA, 64 nt, Human
ggguaugaaucgugcacacagccaugcuucaaggccggggcaggggagccugugcugaugccau

SEQ ID NO: 410525 - RNA, 64 nt, Human
guaggcuggugggugggggugguucguucucuagccggggcagacacccagcuggcuggguccu

SEQ ID NO: 410526 - RNA, 64 nt, Human
gcugcuguggaugccgcgagggacggacacacguccggggcacccacgaggagggcccccagcc

SEQ ID NO: 410527 - RNA, 64 nt, Human
ccuugccaaaugacugccucgugcugccccuaguccggggcagccuaggaggccgacccucuuu

SEQ ID NO: 410528 - RNA, 64 nt, Human
ccaccgcucauagagcuugcccugggucagaggaccggggcagccccugccaccaaaggacuug

SEQ ID NO: 410529 - RNA, 64 nt, Human
ugcccagacauucccgcuagauaggcucugauuuccggggcagccuuucagaugcggcagacau

SEQ ID NO: 410530 - RNA, 64 nt, Human
ggauucuucccggaaggcauuccugccgcgcuccccggggcaccccucaauuguguacuacguc

SEQ ID NO: 410531 - RNA, 64 nt, Human
aagaagcaccagaauauguaccgccuggccaugaccggggcagggaucgacaggcaccucuucu

SEQ ID NO: 410532 - RNA, 64 nt, Human
ccgucaccccgccagccuacacugccagccgccaccggggcacacgggccucugcuugccagcc

SEQ ID NO: 410533 - RNA, 64 nt, Human
accccuggacccauaaaccaguccacuguuauacccggggcacucuaaccaucacaaucaauca

SEQ ID NO: 410534 - RNA, 64 nt, Human
cagugggucagugaccugcacggugauucucccaccuccaaaagguaggggugggacuggaggc

SEQ ID NO: 410535 - RNA, 64 nt, Human
caguagcuccuggaaaaaaccuuaaaaaauguuuccuccaaaucugauuucauuacauuucuga

SEQ ID NO: 410536 - RNA, 64 nt, Human
aagguuaggcaaucacugggacccgcaugguguuccuccaaagaauaggguaaaggagagcugg

SEQ ID NO: 410537 - RNA, 64 nt, Human
acuuaguuugaaauggugcaggcuuagucuuaagccuccaaaggccuggauuugagcagcuuua

SEQ ID NO: 410538 - RNA, 64 nt, Human
gaagcaaaaacaaaaguaaacuccuuucccuggcccuccaaacauauauucugugagauaacug

SEQ ID NO: 410539 - RNA, 64 nt, Human
agcaggacacgccaccauuccaggguagcugguaccgccagaaacaggagugggucuuguccug

SEQ ID NO: 410540 - RNA, 64 nt, Human
gggcagcaguuucucugguaacggaagagaccguccgccagaucugcaggcuguuucugcucca

SEQ ID NO: 410541 - RNA, 64 nt, Human
cacgcaccguguccccacccaggacagcagacacccgccagagugugcgcgcccagugacugca

SEQ ID NO: 410542 - RNA, 64 nt, Human
guaacaugguaacacuuaaaaugguacucggggaccuccaaagacuaaacugacaagccuucaa

SEQ ID NO: 410543 - RNA, 64 nt, Human
gagagucugucucaaaagaaaaaaaaaagcaccgccuccaaaugccaacuuguccuuuuguacc

SEQ ID NO: 410544 - RNA, 64 nt, Human
uaccuccuggguucaagcaaaucuccugccucagccuccaaaguagcugggauuacaggcaccc

SEQ ID NO: 410545 - RNA, 64 nt, Human
cucugcaaccuccaccuccuggguucaagacaauccuccaaacacagacuguuugacuuagaau

SEQ ID NO: 410546 - RNA, 64 nt, Human
cccucaaacacccagcucagccacacacaacuacccuccaaaccaccacagucucugucacacc

SEQ ID NO: 410547 - RNA, 64 nt, Human
acacacacacaugcacaagucaugugcgaacagcccuccaaagccuaugccacagacagcucuu

SEQ ID NO: 410548 - RNA, 64 nt, Human
uccuggacuuuuggucuuuucuuuugugcucuuuccuccaaaucuuuuugacuucugagguuuu

SEQ ID NO: 410549 - RNA, 64 nt, Human
acauuucuaauaccaccaccccugugcuucaggcccuccaaaccccuguguuccccaaauguuc

SEQ ID NO: 410550 - RNA, 64 nt, Human
cucuugaucaagaugccgaacccuguguucagaaccuccaaauacugccaugagaaacuagagg

SEQ ID NO: 410551 - RNA, 64 nt, Human
ugcaauaaacucaaaucacaugucugcaagaaggccuccaaauauagaaacaaucccauuaguc

SEQ ID NO: 410552 - RNA, 64 nt, Human
caauguggugcuagcaggcaggaucccuucuccaccuccaaaggcccuaaaggguggggagaga

SEQ ID NO: 410553 - RNA, 64 nt, Human
cuucuaugauccugcccuucagagaugaacuuucccuccaaagcuagaacuuucuucccaggau

SEQ ID NO: 410554 - RNA, 64 nt, Human
gcuuacauuuuaaacauacacaauaaacacuaauccuccaaacuuucacuguuuuuauuaguau

SEQ ID NO: 410555 - RNA, 64 nt, Human
uuaagugugcacguucguuuauuucugcaucuucccuccaaacuugccuuugcaucuuaaauau

SEQ ID NO: 410556 - RNA, 64 nt, Human
ggauucaagguaaauaggcuuuacaggcuccccuccuccaaacacacacagaaugggcugguuu

SEQ ID NO: 410557 - RNA, 64 nt, Human
uugguuuccaccuauuuaaagucagauuuauagacucgaggagacagaaacugaaucccacacc

SEQ ID NO: 410558 - RNA, 64 nt, Human
auuaaaaacccaagcauugaucuguguacguguccucgaggaucccggaucaucagcacaauug

SEQ ID NO: 410559 - RNA, 64 nt, Human
ccacaggccacgacagacgcuggaugcccuccuaccgccagacaccuccccagaggccuuggac

SEQ ID NO: 410560 - RNA, 64 nt, Human
uucucccugccucaaucuaaaagcagugccacacccuccaaaguggaauagaaagaaguucaug

SEQ ID NO: 410561 - RNA, 64 nt, Human
cacuguucaaccuccugaguggucgcuuuaacaaccuccaaauuguguacagugguuauuuucc

SEQ ID NO: 410562 - RNA, 64 nt, Human
gaaauucugacccucagcuuugggaauguuaucuccuccaaaauggugauuuuuauucacucaa

SEQ ID NO: 410563 - RNA, 64 nt, Human
uagugaugaaauucaauuuaaaaaaucacguuagccuccaaaccauuuaauucaaaugaaccca

SEQ ID NO: 410564 - RNA, 64 nt, Human
agacgggcaagugguugcuccaggauuacucccuccuccaaaaaaggaaucaaauccacgagug

SEQ ID NO: 410565 - RNA, 64 nt, Human
gcuuuaugcuuguaaauauugauagcacuggcuuccuccaaagucccaauacucuagccccgcu

SEQ ID NO: 410566 - RNA, 64 nt, Human
guccucuccccaaaucagggcucuagacccgagcccuccaaaccuggacucugggacuuaggcc

SEQ ID NO: 410567 - RNA, 64 nt, Human
acagcccgaacccguggagcaaugcccugucuggccuccaaaaccaaaauaaaacugggucacu

SEQ ID NO: 410568 - RNA, 64 nt, Human
ugaguucugagcaagucagacuccuuccuuuuggccuccaaagccacagauguuggccggccca

SEQ ID NO: 410569 - RNA, 64 nt, Human
gcggaaaucgggguggagauggggagcagugacuccuccaaauauucauugcuaacaggccauu

SEQ ID NO: 410570 - RNA, 64 nt, Human
aaugcguuuuauuuugauaagauacuucaaauagccuccaaaaguguagauccaaucauuuaaa

SEQ ID NO: 410571 - RNA, 64 nt, Human
aaaccuuacuuagugacuggaaugguauaugcucccuccaaaaguuuaucuuuguuuauugauu

SEQ ID NO: 410572 - RNA, 64 nt, Human
uccaucuccugaccucgugauccgcccgccuuguccuccaaagugcugggauuacaggcaugag

SEQ ID NO: 410573 - RNA, 64 nt, Human
caauaauaauaaaaaccuauauaguauguucucuccuccaaaguuuuaacucuaaaaauugguu

SEQ ID NO: 410574 - RNA, 64 nt, Human
cuaagugcugacuggcuacguaguucgggcaaauccuccaaaagggaaagggaggauuugcuua

SEQ ID NO: 410575 - RNA, 64 nt, Human; identical to SEQ ID NO: 409035

SEQ ID NO: 410576 - RNA, 64 nt, Human
gaggccagugcgcacuagcugggccugguggccaccgccagagcuccuggcgacaucuuggcgu

SEQ ID NO: 410577 - RNA, 64 nt, Human
gagaagccgcgucugugggacgaagaccgggcacccgccagagaggggaagguaccagguugcg

SEQ ID NO: 410578 - RNA, 64 nt, Human
cucuccuggcacccagagaaaaggagcauccuuaccuccaaaagcacagggacacaaagaggaa

SEQ ID NO: 410579 - RNA, 64 nt, Human
gaaugaauagauuugucuuuuccucaccaccuucccuccaaaacaugacauaaacaauauuuuu

SEQ ID NO: 410580 - RNA, 64 nt, Human
gaucaugcccucuccugccaacauccuccaagggccuccaaaccucauagcuggacauucacag

SEQ ID NO: 410581 - RNA, 64 nt, Human
gccaaauuccugccugauucuggguccguccugaccuccaaaggucagcuuggugcuugagguc

SEQ ID NO: 410582 - RNA, 64 nt, Human
ggaacgugcugagccagcacccucagaugauuucccuccaaacugcugacuaggucauccucug

SEQ ID NO: 410583 - RNA, 64 nt, Human
cuuccuccccagucuacguucuccagcccacaccccuccaaagccccaccuuuaaguccucucu

SEQ ID NO: 410584 - RNA, 64 nt, Human
ggauuuuucuacauucuguauauuucuucucaaaccuccaaauguccuuaaauguuuaauaaac

SEQ ID NO: 410585 - RNA, 64 nt, Human
cgugcuuuuuuucuuuaccauuuugcuuucccagccuccaaacauaguuaauagaaauuucccu

SEQ ID NO: 410586 - RNA, 64 nt, Human
ucccuuuucccccaguuuugggacacugugcuuaccuccaaaaaucucaucucuucccuggcau

SEQ ID NO: 410587 - RNA, 64 nt, Human
cugaggcuugugccacugggccuuucugauuuugccuccaaaggagagcgcugugauaccuaca

SEQ ID NO: 410588 - RNA, 64 nt, Human
ucuguuucuucaaugguucucuucccuuuuccauccuccaaaccuggccugagccuccugaagu

SEQ ID NO: 410589 - RNA, 64 nt, Human
gggcuagagcaaauauaaaauuaaaugucuuuuuccuccaaauaauugguuauuaaugguaaaa

SEQ ID NO: 410590 - RNA, 64 nt, Human
gaacuccuggccucaggugaucugcccaccucauccuccaaaagugcugggauuacaggcauga

SEQ ID NO: 410591 - RNA, 64 nt, Human
auauguguaauaucauuucauaaaaaucccucuuccuccaaagccugggcagaaaugugcugca

SEQ ID NO: 410592 - RNA, 64 nt, Human
cugaaaggcuauuaccacuuuaacucuuugugcuccuccaaauagcuuuaaaaugugggcuuuu

SEQ ID NO: 410593 - RNA, 64 nt, Human
gugugccugcagacggcccgggagcugugugucuccgccagagucacagcagugccgagguguc

SEQ ID NO: 410594 - RNA, 64 nt, Human
cccacgacaaggagacagaggagcugguagccagccgccagaugagcuuccuaaagcugacccu

SEQ ID NO: 410595 - RNA, 64 nt, Human; identical to SEQ ID NO: 409055

SEQ ID NO: 410596 - RNA, 64 nt, Human
auggacuuugugaaguagaaacauaauuuuuuuuccuccaaaggugaaaaaacaaugcauucuu

SEQ ID NO: 410597 - RNA, 64 nt, Human
ucucucucuucuuucucucugagggagagggagcccuccaaacuucagauccuguggguuuagu

SEQ ID NO: 410598 - RNA, 64 nt, Human
guuagcuugguacuuuuaaguuugugguacagauccuccaaacccauacucugagcaauuaacu

SEQ ID NO: 410599 - RNA, 64 nt, Human
agucacuucuaaauggguucuaaugugacaauggccuccaaaacuacagccuucccugaaguuu

SEQ ID NO: 410600 - RNA, 64 nt, Human
gguugcauggugaguucacagucggauuguccucccuccaaacugaaacuaauuugauuuugau

SEQ ID NO: 410601 - RNA, 64 nt, Human
ucauuuuauguauguuccuaaugcuuauggaacuccuccaaaauaaaguuacucaaagagagca

SEQ ID NO: 410602 - RNA, 64 nt, Human
uuuugaauaauucccaggaguccugggucccuggccuccaaagcuggaaugugaacgcaugcca

SEQ ID NO: 410603 - RNA, 64 nt, Human
aaacuuucccacauuuuccuguuuucuucugagcccuccaaacuguuccagccucugccuguua

SEQ ID NO: 410604 - RNA, 64 nt, Human
gacauagccaaaccauaucauucuaccccuggccccuccaaaucucauguccucacuauucaaa

SEQ ID NO: 410605 - RNA, 64 nt, Human
gaaauaugcaaaagguaugaggaauguuuuaauaccuccaaauuuuuaagaaaagcaucaaagg

SEQ ID NO: 410606 - RNA, 64 nt, Human
aaguuucucuuuucuucaggugcauuuuccuacaccuccaaaugaggaauggauuuucuuuaau

SEQ ID NO: 410607 - RNA, 64 nt, Human
aaaguucauuuuuuaaauuuguauuuuuauacaaccuccaaaaaaaaaaacaacuggguagagg

SEQ ID NO: 410608 - RNA, 64 nt, Human
ccccuggguagauggaaacugcaaaaacccaaagccuccaaaacuaaccagguccaccuaacac

SEQ ID NO: 410609 - RNA, 64 nt, Human
auuauuugccuuuuaaauucuuuucccccaucccccuccaaagucuugauagcaagcguuauuu

SEQ ID NO: 410610 - RNA, 64 nt, Human
caaaccugaugauucuuggauauuuagcuauuguccuccaaagagucaucguuucacguuuuca

SEQ ID NO: 410611 - RNA, 64 nt, Human
aaccuaugggcuugaggaggucacgaugccgacuccgccagagcuuuuccacugauuguacuca

SEQ ID NO: 410612 - RNA, 64 nt, Human
acgugcauccccaguccccgccggggcgggcgggccgccagagcagcuuuuuacaauccagaga

SEQ ID NO: 410613 - RNA, 64 nt, Human
agcuuuuuguauuaauugccuuugagguuauuuuccgccagaccucaaccugggucaaaguggu

SEQ ID NO: 410614 - RNA, 64 nt, Human
cugagauauaaguuguacugcguaugcaguuuuuccuccaaaaauuaaauugcuuuugacaauc

SEQ ID NO: 410615 - RNA, 64 nt, Human
cggccaacucaggucagccagccugaggcuguggccuccaaagggucugggcgcaccccccagg

SEQ ID NO: 410616 - RNA, 64 nt, Human
ccccuucugaagccauccguagaaaguacuuuguccuccaaaaagcuaacauacgguuuugaag

SEQ ID NO: 410617 - RNA, 64 nt, Human
cauuagaugugagggcuauguugacauggcaucaccuccaaagaccugaccugccuaaagacug

SEQ ID NO: 410618 - RNA, 64 nt, Human
aggauugcagguggaacucagucauuagacuccuccuccaaaggcccccuacgccaaucaaggg

SEQ ID NO: 410619 - RNA, 64 nt, Human
guggguugaauauagccugccucaguggcagcauccuccaaaacuuagacccaugcuggucaga

SEQ ID NO: 410620 - RNA, 64 nt, Human
ucuacccagagccagugacugucccucccagcagccuccaaaggguccaaaguccaagcuagcu

SEQ ID NO: 410621 - RNA, 64 nt, Human
aaaugcuuucacuccuuagcuuugccaacuccauccuccaaaacuucccagaauaccucccuuu

SEQ ID NO: 410622 - RNA, 64 nt, Human
cagacuuguauauucuauuuuacaacuacaaaugccuccaaaguauuguacaaauaagugugca

SEQ ID NO: 410623 - RNA, 64 nt, Human
uuuaaauuuguaaguaauuuuauaaaauccaccuccuccaaaaaagcaauaaaaaaaaaacaaa

SEQ ID NO: 410624 - RNA, 61 nt, Human
gcuaucugaaugcuuccuaaaaagcgaggucccuccaaaccguugucauuuuuauaaaacu

SEQ ID NO: 410625 - RNA, 64 nt, Human
agcauuauuucuauagugugauuaccugagggugccuccaaauguauaucauuucacuccccuc

SEQ ID NO: 410626 - RNA, 64 nt, Human
uaguuucagaccagaccugaauagucuccuaugcccuccaaaagucggguccuugcuccugcau

SEQ ID NO: 410627 - RNA, 64 nt, Human
uuuuuccgcagacuucuuucugcaaauuauucagccuccaaaugcaaaugaaugauauaaaaau

SEQ ID NO: 410628 - RNA, 64 nt, Human
cagccuuccaaguagcugggacuacagaugcacaccuccaaaccuggguaguuuuugaaguuuu

SEQ ID NO: 410629 - RNA, 64 nt, Human
agaaaggccuccagcugagcagacggccccgaucccgccagaacggccuuuugcuuccagccaa

SEQ ID NO: 410630 - RNA, 64 nt, Human
cuagggcuugggcuguuugugugauaccggccccccgccagacaauagccuuugcugacacccc

SEQ ID NO: 410631 - RNA, 64 nt, Human
auuugacauccucucuggauucccaaggagcauaccuccaaaauccgagaagagcaaaucagag

SEQ ID NO: 410632 - RNA, 64 nt, Human
cgaacuguggcacgccaaagcaaaggauaaccauccuccaaaacgccuccauaacaccaguaaa

SEQ ID NO: 410633 - RNA, 64 nt, Human
auaucuaaagcaguuuacucaucaauugaaaaguccuccaaaaagagaacuauugggaaaccau

SEQ ID NO: 410634 - RNA, 64 nt, Human
aauguaaaugauauuaaaucugugauuccuuuucccuccaaaggcuuuuguguacauggcgcug

SEQ ID NO: 410635 - RNA, 64 nt, Human
uucaaauuuuucuaacauauggaaagccuuuuguccuccaaagaugaguacuagggaucaugug

SEQ ID NO: 410636 - RNA, 64 nt, Human
gacuaaggagaaacguauaucccuacaaaccuccccuccaaacaccuucucacauucuuuucca

SEQ ID NO: 410637 - RNA, 64 nt, Human
auuaauuucuauuugaccucuaaauuguaaaaugccuccaaaaguuuauuuauagaacaaaaau

SEQ ID NO: 410638 - RNA, 64 nt, Human
uucauaccccugggcuuccuucgagagggcucuuccuccaaauccuccccaccuguccuccaag

SEQ ID NO: 410639 - RNA, 64 nt, Human
ccacugcguuccugggaagggcugcgaggccugcccuccaaaccugacuggggaugggcggcac

SEQ ID NO: 410640 - RNA, 64 nt, Human
guggcggaauaagaaaggauuaaacaguuacaagccuccaaauucaaauaaaauuaaaucacag

SEQ ID NO: 410641 - RNA, 64 nt, Human
gcuaggucgcggcagcagugauggauuuauaguuccuccaaacaaagaugggaccccucccgag

SEQ ID NO: 410642 - RNA, 64 nt, Human
uuuagaaaugucaguauuuuuguaauuauuucuaccuccaaauauauauauauugucuuucacu

SEQ ID NO: 410643 - RNA, 64 nt, Human
uggggcccucagugaggggcugccuggcauuacuccuccaaagacugcugcccccagaacaggc

SEQ ID NO: 410644 - RNA, 64 nt, Human
accuugagaaugcgaaacauuccagaggcaguagccuccaaagcacacagagccccuggccccg

SEQ ID NO: 410645 - RNA, 64 nt, Human
uuggaggguuaucuguauauaaaagguuuucuccccuccaaagaaagacuccaguacaagauac

SEQ ID NO: 410646 - RNA, 64 nt, Human
auacuguugguccaaaagcauuuaaaaucaauagaucugggauuauguggccuuagguagcugg

SEQ ID NO: 410647 - RNA, 64 nt, Human
cuucacugggcuccaccugcucacccgccugcagaucugggauccagccugcucucaccgcugu

SEQ ID NO: 410648 - RNA, 64 nt, Human
accauauacgauagggcucuucgcuuuuaaugauaucugggauuucuguggaacuuggcaaauu

SEQ ID NO: 410649 - RNA, 64 nt, Human
cgaaagugacccucaaagaaugagaaccucaagcaucugggauccaguggagcuaaucaguccu

SEQ ID NO: 410650 - RNA, 64 nt, Human
caguagcgugguugaugcuauuguuuagccuuccccuccaaauuguauacauuggcuuggaaug

SEQ ID NO: 410651 - RNA, 64 nt, Human
cagauaauguuugacugcaguugccuuggaaauuccuccaaaguuugccuucaucucuccucua

SEQ ID NO: 410652 - RNA, 64 nt, Human
ccacccaugaaagucacuguuuaaguuacaucauccuccaaauaaagacugauucuuuaccugg

SEQ ID NO: 410653 - RNA, 64 nt, Human
ugacccccuuugaggcaucugcuccccgucucccccuccaaaaaaaaaguggauauuugaagaa

SEQ ID NO: 410654 - RNA, 64 nt, Human
uugucucagaaaaaaacaccaucagcaaagugggccuccaaagccagaugauuuucauuuuaug

SEQ ID NO: 410655 - RNA, 64 nt, Human
aguggguuauaagacauugcuuuagaaucuugccccuccaaaucuucccucaaagaucuuaaug

SEQ ID NO: 410656 - RNA, 64 nt, Human
ccuuuccucccuucugauaagacuggaaaauaguccuccaaaacacaagggaggauuuugggug

SEQ ID NO: 410657 - RNA, 64 nt, Human
cuggugcccuguauauauguaacaauauaggaccccuccaaauagguuuugcuucuggugaauc

SEQ ID NO: 410658 - RNA, 64 nt, Human
cuaaguccuaacuauuacaaugauggacucagcaccuccaaagcaguuaauuuuucacuagaac

SEQ ID NO: 410659 - RNA, 64 nt, Human
gauaccucaaccuuggggccagcaucucccacugccuccaaauauuaguaacuaugacugacgu

SEQ ID NO: 410660 - RNA, 64 nt, Human
agguagcuuucucagagccccuuggugguucuguccuccaaaugcugcuguugggagcgggcuu

SEQ ID NO: 410661 - RNA, 64 nt, Human
gauggcccugagcccacggaaaaggccagguagaccuccaaacuagaaaugcuggcugauuugc

SEQ ID NO: 410662 - RNA, 64 nt, Human
uugaacugcucacccaacuucugcuaucuugcucccuccaaacucacagauucuccuacaguca

SEQ ID NO: 410663 - RNA, 64 nt, Human
cacgagaagagaaugccuucuagaugcaaaaucaccuccaaaccagaccacuuuucuugacuug

SEQ ID NO: 410664 - RNA, 64 nt, Human
gacaggucaggaucuccaaacauggacguccuccccuccaaauccagaagcucccagaaggugu

SEQ ID NO: 410665 - RNA, 64 nt, Human
cucccuaauaggggaguggguucccagaagggagaucugggaggggucaggagccacuaaguug

SEQ ID NO: 410666 - RNA, 64 nt, Human
uucauaccaacaguccuaaacugucauuuucuaaaucugggauuuaaaaucuuuagacaauauu

SEQ ID NO: 410667 - RNA, 64 nt, Human
caaauauagccacagaaauaaaggagggaccaauaucugggacagguaauuuugcaaaacacau

SEQ ID NO: 410668 - RNA, 64 nt, Human
uggucaggcccacugcagagaugguggugagcacaucugggaggcuggucucccuccagcugga

SEQ ID NO: 410669 - RNA, 64 nt, Human
uauucucuggccugauuuaucauaucccuuuucuccuccaaauguuucuucucucaccucuucu

SEQ ID NO: 410670 - RNA, 64 nt, Human
aauuaaugcuuaauagggugguacccuggaaaggaucugggaagugguagaauuucuggucugu

SEQ ID NO: 410671 - RNA, 64 nt, Human
acagagagguuucaccagcacauuuaccagaagaaucugggaauggauuccacuacagugauau

SEQ ID NO: 410672 - RNA, 64 nt, Human
acagagcaggggugaacuguagcuugaugcaguaaucugggacaagacugguugcuagcacaua

SEQ ID NO: 410673 - RNA, 64 nt, Human
ccacuuuuaguuccaacagaaugccguucacaagaucugggaggcacucucucagcccucuccu

SEQ ID NO: 410674 - RNA, 64 nt, Human
ucucuuggcagauuugcauauuucauacccagguaucugggaucuagacaucugaauuugaucu

SEQ ID NO: 410675 - RNA, 64 nt, Human
ggugcuggcggccgggucccuggugcacugaccuaucugggauaggcaguacccuggagggggg

SEQ ID NO: 410676 - RNA, 64 nt, Human
acaaaauuaguuuguaucuugguuauuaaacaguaucugggacugguuugggcagaauauuaaa

SEQ ID NO: 410677 - RNA, 64 nt, Human
aucugugcccgauuuuaguaugugcaggggggcgaucugggaaucaguccccuguggauaccaa

SEQ ID NO: 410678 - RNA, 64 nt, Human
cggacgggagggaggcacccggccggcuggacuaaucugggaucgcggugauuugcagcgugga

SEQ ID NO: 410679 - RNA, 64 nt, Human
uguacaauauauuuaugcuggcugaaaagacagaaucugggaauaauaaaauugcaaccaguuu

SEQ ID NO: 410680 - RNA, 64 nt, Human
gugcaggcacauuaauauugugaccaaucacagaaucugggaauaugaagcuauaauuuuuuaa

SEQ ID NO: 410681 - RNA, 64 nt, Human
cugaaacccucucugcuccauaugcccuaaacuuaucugggaaggcuggggaaguaggcucugg

SEQ ID NO: 410682 - RNA, 64 nt, Human
agagugguagaguuucaaaacuuucgucauagauaucugggaccuuucucaggaucuguguuca

SEQ ID NO: 410683 - RNA, 64 nt, Human
ggguguguuuauagugauccuguuauauauacagaucugggaucuuucgucuuuauugucuuac

SEQ ID NO: 410684 - RNA, 64 nt, Human
uucaguagugaaaucuuacuguaccgccuguuguaucugggagccucguacagaggcucgcaca

SEQ ID NO: 410685 - RNA, 64 nt, Human
uuuguuggcacacccaccuuuucuguucccuagcaucugggauaugcaaugcuucuauggcuaa

SEQ ID NO: 410686 - RNA, 64 nt, Human
ugcuaguggugagcauguaaguguuaaguuuuuaaucugggagcagggcauaggaagaaaaugu

SEQ ID NO: 410687 - RNA, 64 nt, Human
gaaucugcaaauggaaacauugugaguaucagcaaucugggaagugacaggguuaauaacuccu

SEQ ID NO: 410688 - RNA, 51 nt, Human
ccugguugcagcaugcuugaaaucugggauguggaagacccuuccaaugca

SEQ ID NO: 410689 - RNA, 64 nt, Human
auuccauggggcucccugcugacugcauuuccugaucugggaugauguuuaccagcccaaaacc

SEQ ID NO: 410690 - RNA, 64 nt, Human
uuaaaaaaaaaugcauaguauaaacccauuaaggaucugggaaaagagaagaaguuuaauauag

SEQ ID NO: 410691 - RNA, 64 nt, Human
gacagacccucacccccacccuggggguguggcaccuccaaacuuucaacuucagggugauuuu

SEQ ID NO: 410692 - RNA, 64 nt, Human
uuaggaagagguauacauuuuuuaagucgcucugccuccaaaucugaacagucacuguaaauca

SEQ ID NO: 410693 - RNA, 64 nt, Human
agggugacaggaaggcuuuaccaaccugucucucccuccaaaagagcagaauccucccaccgcc

SEQ ID NO: 410694 - RNA, 64 nt, Human
uccagguuguugaaaagacuuuguacucccacuuccuccaaauccauacagugaggaaucagag

SEQ ID NO: 410695 - RNA, 64 nt, Human
ucuguacagagcgcugucucaggucaugcauuguccuccaaacccaaagguuuuuuucaggguu

SEQ ID NO: 410696 - RNA, 64 nt, Human
auaucugcauguaccaagagucccuaagccacccccuccaaagauggaguguagaaaugaugac

SEQ ID NO: 410697 - RNA, 64 nt, Human
acaaccagucaaagaagcaggggaaaaguaagcuccuccaaaguugcuugcagugcuggaaaua

SEQ ID NO: 410698 - RNA, 64 nt, Human
gcgagcaagcucggaauccaguuccucaggaaccccuccaaaacccacacccccagggacgccg

SEQ ID NO: 410699 - RNA, 64 nt, Human
gaagguccucacuguuugcauaucgcucaggccaccuccaaaccccaccuagguuuuauaaugu

SEQ ID NO: 410700 - RNA, 64 nt, Human
ugguuccugagcucuuucuccuguuucauuugagccuccaaacuacauauuuggucauauugcc

SEQ ID NO: 410701 - RNA, 64 nt, Human
cuguggaucgugaaggcgaucucaagaguguuucccuccaaaccugauagcugccuauuccugu

SEQ ID NO: 410702 - RNA, 64 nt, Human
agcugcggaaggauugaagucaaagaauugaaacccuccaaaccacgucaucugauuguaagca

SEQ ID NO: 410703 - RNA, 64 nt, Human
caacccugccaacaccuugaucuuggacuuccagccuccaaaacuaugagaaauaaauuucuau

SEQ ID NO: 410704 - RNA, 64 nt, Human
aggugccuacagagacuauagagcuagacaaagcccuccaaacuggccccuccugcucacugcc

SEQ ID NO: 410705 - RNA, 64 nt, Human
uauauauuuaauugauuucugacucuaucauuggccuccaaacacagauuguguuuuucuuugg

SEQ ID NO: 410706 - RNA, 64 nt, Human
cauacacacaauuaagagcucaugucuuagcaagaucugggaaaccaacauugcgagaguagcu

SEQ ID NO: 410707 - RNA, 64 nt, Human
auggcauuuaaaacuuugaaugaauuauaccuaaaucugggacagggaggugacaguggaacag

SEQ ID NO: 410708 - RNA, 64 nt, Human
guucugcagcggggcggaggaccggcacggcuacaucugggaccgccacuacaacaucugucug

SEQ ID NO: 410709 - RNA, 64 nt, Human
ucugcuuucagaguuauuauuuuaauaaaggaagaucugggaugggcuggugggccauuccagc

SEQ ID NO: 410710 - RNA, 64 nt, Human
ucugaaccuuagcacuaaggagauugaguaaggaccuccaaaguuccccggacucaugaauucu

SEQ ID NO: 410711 - RNA, 64 nt, Human
uaauuuaaagauuuuuagugcaauggcacgguaaccuccaaaccugaauuagacagagacucac

SEQ ID NO: 410712 - RNA, 64 nt, Human
aaauaauguuuaaagaaaaaaaaaaaaaagcaaaccuccaaaacguggaccuaaccauugcuuc

SEQ ID NO: 410713 - RNA, 64 nt, Human
aaaggucauucuuucugcagacuuuuggggagcuccuccaaaacauuuguucucuuuaccaugc

SEQ ID NO: 410714 - RNA, 64 nt, Human
ugagccaccucgccugggcccccuucuccauaugccuccaaaaacaugucccuggagaguagcc

SEQ ID NO: 410715 - RNA, 64 nt, Human
ucgaucuccugaccucgugauccgcccgccuuggccuccaaagugcugggauuacaggugugag

SEQ ID NO: 410716 - RNA, 64 nt, Human
acauuaaauuugguacauuucaaaacuucuagguccuccaaagauugaaagcuuaauaaucucc

SEQ ID NO: 410717 - RNA, 64 nt, Human
agccggugggugaggagauucccaccuuccauagccuccaaacauguucccaaggccccacuuu

SEQ ID NO: 410718 - RNA, 64 nt, Human
aguaaacguuuuaauggcccguuuaugucucaugccuccaaacaacacugaauuugaaaccccc

SEQ ID NO: 410719 - RNA, 64 nt, Human
augucucuagguagagacagauacaugagaagagccuccaaaacuggaagcccaucauaaggca

SEQ ID NO: 410720 - RNA, 64 nt, Human
acagugucuggccuugggaagaagugauucugucccuccaaagaaauagggcauggcuugcccc

SEQ ID NO: 410721 - RNA, 64 nt, Human
ucauauguaaaucuuuagauaucaauuugaaaauccuccaaaaaaaggagcaaagaaugcauaa

SEQ ID NO: 410722 - RNA, 64 nt, Human
auuugucucuauagcuaauuagcuuaucaacuccccuccaaacaaacaauuaaaaaaaaaacau

SEQ ID NO: 410723 - RNA, 64 nt, Human
aauuuguaugcuaaaugaggagguacauugaaacccuccaaaucuccagucucaucuaugucau

SEQ ID NO: 410724 - RNA, 64 nt, Human
ugcuuccugaauguuugugugugaacccuuguuuccuccaaaacaaacgacagcaacgaaaacu

SEQ ID NO: 410725 - RNA, 64 nt, Human
agccccuuaaaugccagccugaguaccugaaggaaucugggaauuagcccuggccugaaagugg

SEQ ID NO: 410726 - RNA, 64 nt, Human
uucugaguaacaagauggugacuucuccuuggggaucugggagcugagcacuugucuauacuug

SEQ ID NO: 410727 - RNA, 64 nt, Human
uuaaaaauaucgauaucaccaugauuuaauccagaucugggauuauguagcuaaacauugugau

SEQ ID NO: 410728 - RNA, 64 nt, Human
aguguuuauagagugaacccuauucucaucuuucaucugggaagcacuucuguaaucacugccu

SEQ ID NO: 410729 - RNA, 64 nt, Human
uugcugaauccuuucauauccuaauaggaauuaaccuccaaauaaaacaugacugguacgugug

SEQ ID NO: 410730 - RNA, 64 nt, Human
ucguauucauaaacaauaucuaucaaauggguuaccuccaaauaugaaaaucuauaacaaccua

SEQ ID NO: 410731 - RNA, 64 nt, Human
aggccaguuacuggaaaggaauggaaaaaagaagccuccaaaagggaaaaacuucugacaauau

SEQ ID NO: 410732 - RNA, 64 nt, Human
cuuacuacgcuugcuugacgucacucucucucgaccuccaaacagcaggacucuuucucuggga

SEQ ID NO: 410733 - RNA, 64 nt, Human
uaaacgacaaauagaaauacaucuucuuuauuauccuccaaauccaauucagagguaauaugcu

SEQ ID NO: 410734 - RNA, 64 nt, Human
aaacgaaaaaucaacaaacacucuguccucuaucccuccaaagaaugaaaaucagaaaaagccc

SEQ ID NO: 410735 - RNA, 64 nt, Human
uuaauaaagauacuaauucucaugacugaaucacccuccaaaggccccaccuccuaauaccauc

SEQ ID NO: 410736 - RNA, 64 nt, Human
cuucccaggcucaagugauccucccagcucucagccuccaaaguagcuggcacuacaaguguac

SEQ ID NO: 410737 - RNA, 64 nt, Human
uaucuaagcuaugcuauucccuuuagaaaauuagccuccaaaaucuuuuguuucaaaauauuau

SEQ ID NO: 410738 - RNA, 64 nt, Human
uaugucuugaaacauguucaucuggaaguauuuuccuccaaaguaauguagcaugauuuuucaa

SEQ ID NO: 410739 - RNA, 64 nt, Human
cuggaggaagacuuuugccuccguccaaaagauuccuccaaaaaaagauuuaaaaaaagauuuc

SEQ ID NO: 410740 - RNA, 64 nt, Human
gguauccagggcucauguucacuugaugaaaacuccuccaaaagguacaguccucauugugguu

SEQ ID NO: 410741 - RNA, 64 nt, Human
ugguaaugccgcugucaucaaauaugaggagaaaccuccaaaaccagcauuucagaaugguucc

SEQ ID NO: 410742 - RNA, 64 nt, Human
cuuagccuugcaugcguugugggcaucaaaucuaccuccaaaagacccauccuggggagcccuc

SEQ ID NO: 410743 - RNA, 64 nt, Human
ccugugguuuuguuuuuucuuucccuuuuuuguuccuccaaacaaaaacaaaaugcaggccgag

SEQ ID NO: 410744 - RNA, 55 nt, Human
uggaccccagaauuuuauaacccacaucugggaaugaauuugcagcaccugguag

SEQ ID NO: 410745 - RNA, 64 nt, Human
guccccuuguuugucccuucuacaggcaugaggaaucugggaggcccugagacagggauugugc

SEQ ID NO: 410746 - RNA, 64 nt, Human
uugacgcugugggcacugccucagccgcccaaguaucugggaccacaggcgugcaccaccaugc

SEQ ID NO: 410747 - RNA, 64 nt, Human
acucuguucccuguucaggguccccugcccuucuaucugggagcuagggaagguaugggggagg

SEQ ID NO: 410748 - RNA, 64 nt, Human
guuauauacaucucaaggguuaaccagacccuuuccuccaaacccaaccuuucauuuccuacuu

SEQ ID NO: 410749 - RNA, 64 nt, Human
gaagcauguuuauucuguuccccagcaacucuggccuccaaaaugggagaaaacgccagugugu

SEQ ID NO: 410750 - RNA, 64 nt, Human
caauuuauauuauuugguaagguuuuuuuuuuucccuccaaagaugucaucuucucaucugaau

SEQ ID NO: 410751 - RNA, 64 nt, Human
ucucuuggaagcagaaaugcuuuguaccagagcaccuccaaacugcauugaggagaaguuccag

SEQ ID NO: 410752 - RNA, 64 nt, Human
auuuuuaaaauaaaucuagaugacuguccaagugccuccaaaguguacaaagcaucagauucag

SEQ ID NO: 410753 - RNA, 64 nt, Human
gacauuccaggagcuagcaauuuuaagaggugucccuccaaagugaccugauggaaguccugaa

SEQ ID NO: 410754 - RNA, 64 nt, Human
gacugggcagugcuuuucucucucccaugucuagccuccaaaaguuaagugaaaauuagucaac

SEQ ID NO: 410755 - RNA, 64 nt, Human
cagaauaguuaaguaaaacauuagcuguuuuauaccuccaaaauaucuucugcauuauauaucu

SEQ ID NO: 410756 - RNA, 64 nt, Human
cggcuccuaacgugucugugugaugaccaguuguccuccaaaaaccucacucaccacggaguca

SEQ ID NO: 410757 - RNA, 64 nt, Human
augaagaaauaagcaguuaaaaaaauaagucgccccuccaaaacacgcccccaucccacagcgc

SEQ ID NO: 410758 - RNA, 64 nt, Human
gaaauugccccaauagaaaacauggcaucccugaccuccaaauggucuguuuuggccuccauuc

SEQ ID NO: 410759 - RNA, 64 nt, Human
uugucuugcuuuucuucccauugcaccagcuuguccuccaaaaucaugaaugauacacaugaag

SEQ ID NO: 410760 - RNA, 64 nt, Human
gggaaaacucuuagauaguacagugaguugugacccuccaaaggaucacaaguacauaaacaga

SEQ ID NO: 410761 - RNA, 64 nt, Human
agccagcccagcucccugcagcccaagucucaagccuccaaaccugccuacggcaacucuccau

SEQ ID NO: 410762 - RNA, 64 nt, Human
ugguaaucaugagauuaauguuucaugauuucuaccuccaaagugugaagacaaguaaaacaau

SEQ ID NO: 410763 - RNA, 64 nt, Human
ugguguauggccuguggguuaccugaacuccauaaucugggacuuuuuaaaaauaagaaccagc

SEQ ID NO: 410764 - RNA, 64 nt, Human
gcagguaaaagaccaucagguuguuuuuuuccacaucugggacacaguuguuuguguaggaaca

SEQ ID NO: 410765 - RNA, 64 nt, Human
aggcccuagucuagcaagaggacauagcacccucaucugggaauagggaaggcaccuugcagaa

SEQ ID NO: 410766 - RNA, 64 nt, Human
gucaucagggacccauuguucucuucagaacccuaucugggagagaaggcgaaccaccuccggg

SEQ ID NO: 410767 - RNA, 64 nt, Human
aagaaagcgccucucuaccauacaguauuucaucccuccaaacacuugggcaaaaagaaaacuu

SEQ ID NO: 410768 - RNA, 64 nt, Human
ggaagcucagccuucuccucccaagguuugagucccuccaaagggcaguggguggaggaccggg

SEQ ID NO: 410769 - RNA, 64 nt, Human
gcagccucuccucgggcaggaggggagguggcuuccuccaaaggacacccgauggcaggugccu

SEQ ID NO: 410770 - RNA, 64 nt, Human
ugcagguccacacaccuuccaggccuguggccugccuccaaagaugugcaagggcaggcuggcu

SEQ ID NO: 410771 - RNA, 64 nt, Human
gucauccucucacugcaagcacagcauaccuguaccuccaaaagugacguuuuagugaacaggc

SEQ ID NO: 410772 - RNA, 64 nt, Human
aaauuguuuauauugcuauccauaaugggauucaccuccaaauuaucaaagaaauaacucagag

SEQ ID NO: 410773 - RNA, 64 nt, Human
auggaaaaucacaccaccugacaggccuucugggccuccaaagcccauccuugggguucccccu

SEQ ID NO: 410774 - RNA, 64 nt, Human
gccggcgcagggagcccucugcccuucacacucuccuccaaaagagccuccaucuguaaggaag

SEQ ID NO: 410775 - RNA, 64 nt, Human
aacuccuggccucaagagauccccccaaccuuggccuccaaagugcugggauuacaggcaugag

SEQ ID NO: 410776 - RNA, 64 nt, Human
gauuuugugguguuuucuuuaacccaugugauguccuccaaaauguguaggguaaaaauucaca

SEQ ID NO: 410777 - RNA, 64 nt, Human
uucuuuuccaagaagcuuuugaauaagcauauuuccuccaaaggucucucucuuucucucucuu

SEQ ID NO: 410778 - RNA, 64 nt, Human
uuguaagugcaggaaaccgaguagaaaaugugacccuccaaauggagaagcugcaggcuuugcc

SEQ ID NO: 410779 - RNA, 64 nt, Human
uccccguaguauaccauccagcuucccuccccuuccuccaaaacccucccucccaccuccccac

SEQ ID NO: 410780 - RNA, 64 nt, Human
gacacagccaaaccauaucauucuaccccuggcaccuccaaaucucauguccucacauuucaaa

SEQ ID NO: 410781 - RNA, 64 nt, Human
aguccaaaauucagcagggcagucaaauuuuaaaccuccaaaaugaucaccuuugacuccacgu

SEQ ID NO: 410782 - RNA, 64 nt, Human
cugcuccgaggacucuuaguuuuucaaaaccagaaucugggacuuaccaggguuagcucugccc

SEQ ID NO: 410783 - RNA, 64 nt, Human
cuccccuccgagcaacucugcauuuaauuuuguaaucugggaagugccugguuuugaaaauccg

SEQ ID NO: 410784 - RNA, 64 nt, Human
gcuggccaccgugucccaggaccguaccguccgcaucugggaccuggccacccugcagcaggug

SEQ ID NO: 410785 - RNA, 64 nt, Human
ucuacuccgcaugggugcaugcagaggcuccuggaucugggaagcccgcccccucacaaaugcu

SEQ ID NO: 410786 - RNA, 64 nt, Human
ccuuucugagggaggggauuuuacagccgagggaccuccaaagggaacguccauuugcaugugu

SEQ ID NO: 410787 - RNA, 64 nt, Human
aaaauaaauaaauaagggaaauuccuaacuuugcccuccaaagucuaacuuugguuuucuuguu

SEQ ID NO: 410788 - RNA, 64 nt, Human
uaaugagauacugauaugguuugggcauuugucuccuccaaaccucauguugagauuugauccc

SEQ ID NO: 410789 - RNA, 64 nt, Human
auagugggcucuucacuccugcucguaauaaccaccuccaaauuuguuagagugauuuggucuc

SEQ ID NO: 410790 - RNA, 64 nt, Human
agauggcagcagugaggccuugggguagaaggauccuccaaagucacacagagugccugccucc

SEQ ID NO: 410791 - RNA, 64 nt, Human
uuuuguaugaauuauuuugucguccuacccuuuuccuccaaaacaaaaauuagaggauuauuuu

SEQ ID NO: 410792 - RNA, 64 nt, Human
cagcucuucuuccucuguagauagcagaggacacccuccaaacacugguuccccacugcccugu

SEQ ID NO: 410793 - RNA, 64 nt, Human
ucucagguggugauaugguuuggauguuuuguccccuccaaaucucauguucaaagugugacau

SEQ ID NO: 410794 - RNA, 64 nt, Human
aacagugacagacaacaggccuucugcagccaggccuccaaacacaccacaaaggaagccucug

SEQ ID NO: 410795 - RNA, 64 nt, Human
ugaccaugaucuguugauaucuuugaaucucuucccuccaaaccccaaguaaguuguccuucaa

SEQ ID NO: 410796 - RNA, 64 nt, Human
ccaagaauaaaauugcugcaccagaaggagggucccuccaaaguugaacacuuggugaaaggaa

SEQ ID NO: 410797 - RNA, 64 nt, Human
auaaagugaagucauccuuauuauuaaaaugcagccuccaaacaaauuucucaagauuccuuuu

SEQ ID NO: 410798 - RNA, 64 nt, Human
cauuuugaugaucaugaaacgcugaugaaaaaugccuccaaacauuuuucuguacucauacuua

SEQ ID NO: 410799 - RNA, 64 nt, Human
ggggucauggcacggaauaugaaagccuccuccaccuccaaacacccccaccuuggaaggagau

SEQ ID NO: 410800 - RNA, 64 nt, Human
cccaggaagucagugauugucuuuuugggcuuccccuccaaaggaccuucugcaguggaagugc

SEQ ID NO: 410801 - RNA, 64 nt, Human
gcucucccuuuguggggacucaggcagcagaggcaucugggaagucucugaguaggcagggucc

SEQ ID NO: 410802 - RNA, 64 nt, Human
aggagaggggaggggaccugcccccuccucaggcaucugggagggcccugcccccaugggcuuu

SEQ ID NO: 410803 - RNA, 64 nt, Human
ggcaggcuccaacccuaagaaggucgaccucaucaucugggagaucgaggugccaaagguaggg

SEQ ID NO: 410804 - RNA, 64 nt, Human
uucuuugucccuagcggaugaccaccaggcucucaucugggacauccagcaaaugccccgagcc

SEQ ID NO: 410805 - RNA, 64 nt, Human
augugccuguuuuuuaacacaacaaaaaagccuaccuccaaaauccccuuuuuguucuuccugg

SEQ ID NO: 410806 - RNA, 64 nt, Human
acauaguggucaccugggccuuaugcccagggagccuccaaagcauucagcuccugcuuggcca

SEQ ID NO: 410807 - RNA, 64 nt, Human
aauauucuguucccuaccuuuuuucacuuuuccuccuccaaagagcaaaaugaaaauuuugccu

SEQ ID NO: 410808 - RNA, 64 nt, Human
caacuccucgccucaagcaauucgccccccucggccuccaaagugcuggaauuauaggcaugag

SEQ ID NO: 410809 - RNA, 64 nt, Human
aauguguaauuuugaguacagaauucaacaguuaccuccaaaaaagaaacauuguuaauauaau

SEQ ID NO: 410810 - RNA, 64 nt, Human
ccaaaucugccuagaaaaccucucgcuuccucagccuccaaaguggagcugggagguagaaggg

SEQ ID NO: 410811 - RNA, 64 nt, Human
cuuauuguaacccugucuggauccuauccuccuaccuccaaagcuucccacggccuuucuagcc

SEQ ID NO: 410812 - RNA, 64 nt, Human
uaaaggacggaggccgccccacccccuucccuuuccuccaaaccccuaacucccuccagacacc

SEQ ID NO: 410813 - RNA, 64 nt, Human
cccagccacauugccaggcaacaggacuaaacuaccuccaaagcaagcagucuuuucaguuuug

SEQ ID NO: 410814 - RNA, 64 nt, Human
agacuaacuccaggaguaggaaaugauucaucauccuccaaagcaagaggcuuaagagagaaac

SEQ ID NO: 410815 - RNA, 64 nt, Human
acaagccucugagaccugcuacagaucaaagacuccuccaaaaagcacaagcccagaacauggg

SEQ ID NO: 410816 - RNA, 64 nt, Human
gacuuucaguauaaggaaaagggguaguuuauucccuccaaauuugacuacagcucgaaauugu

SEQ ID NO: 410817 - RNA, 64 nt, Human
cccagcucccugcucacucuucucucagccaaagccuccaaagggacuagagagaagccuccug

SEQ ID NO: 410818 - RNA, 64 nt, Human
uuccuuuauguaaagaucugugacucugaaauauccuccaaaaggagagugcaucugagacuga

SEQ ID NO: 410819 - RNA, 64 nt, Human
gccaggagugggauucagcugcagcagggcgcccccuccaaacugcagcuggucuggcuuacug

SEQ ID NO: 410820 - RNA, 64 nt, Human
aaacuguugccagagauggagguucucucggaguaucugggaacugugccuuugaguuuccuca

SEQ ID NO: 410821 - RNA, 64 nt, Human
uuuaagucccugauuuauucuuuccauucauuccaucugggaggaacccccccaacuccugcca

SEQ ID NO: 410822 - RNA, 64 nt, Human
cccaaauguuaagguauaugguaaaaaaagaaauaucugggaucccgauguucuuaauaaaucc

SEQ ID NO: 410823 - RNA, 64 nt, Human
gguaugaauaccaggaaacagauaacucagaagcaucugggaaauuugccauggaauuaaugaa

SEQ ID NO: 410824 - RNA, 64 nt, Human
cccggccucucccaauaggucuuuauuccucaauccuccaaaugcucuggagaggcccccaccc

SEQ ID NO: 410825 - RNA, 64 nt, Human
gugaaucuguuucagguuuccauucugcagaacuccuccaaagcaugugcuaguggcaagacag

SEQ ID NO: 410826 - RNA, 64 nt, Human
caccauucugccugccauaugccuguccccuuuuccuccaaacccuauuaggguaccggaagca

SEQ ID NO: 410827 - RNA, 64 nt, Human
agaggagucagagccauaacucaaucacucagccccuccaaagauaguugaugugugauaaucu

SEQ ID NO: 410828 - RNA, 64 nt, Human
uuaaagacuuucugguuacacuacuccacgaacuccuccaaagauccguuauucaauaacugcc

SEQ ID NO: 410829 - RNA, 64 nt, Human
uuaguggauaaaugggaauggaaacguguguguuccuccaaauuuucuaguaugaucggugagc

SEQ ID NO: 410830 - RNA, 64 nt, Human
auuuuuagccuugugaauagaucgcuuugccuauccuccaaaauauuaaaauaacccagaaaug

SEQ ID NO: 410831 - RNA, 64 nt, Human
uagagagccccuaaguccuucaucauaccacugcccuccaaaucuacucuucuuuuaagcaaua

SEQ ID NO: 410832 - RNA, 64 nt, Human
gcugaguaugacaaauagugucuacuaucucaacccuccaaaauuugcagaguguugggacugu

SEQ ID NO: 410833 - RNA, 64 nt, Human
gcucuccuucugcagacuccucuugcaaggcguaccuccaaacauaauugauucguaucugcga

SEQ ID NO: 410834 - RNA, 64 nt, Human
ucacuuccuaaagcaaaaggagaaacauucuuuaccuccaaauguuuuaguuuuaaaaaaaaaa

SEQ ID NO: 410835 - RNA, 64 nt, Human
ucaauguggaagcccaugagguugcccagggaagccuccaaaagcugggaugcuugaggguauc

SEQ ID NO: 410836 - RNA, 64 nt, Human
ccaaguucaucgcagcauguucaccauaucccagccuccaaaucuauccuccuaccuuccaacg

SEQ ID NO: 410837 - RNA, 64 nt, Human
accagaaaccacaagcaaaaucuggaucuugggaccuccaaacuuauagcgcugaccaacgcac

SEQ ID NO: 410838 - RNA, 64 nt, Human
cauguuauagaaacugcagcagaguugaaaauugccuccaaauuaccggaagaguguaugaaga

SEQ ID NO: 410839 - RNA, 62 nt, Human
ccucccaccaguaccaguagcacucuguccccaucugggaggguggcauucugggacaugag

SEQ ID NO: 410840 - RNA, 64 nt, Human
agcgcgaggacguggucuggagguaccgccggagaucugggaccacucagggcaucagggggcg

SEQ ID NO: 410841 - RNA, 64 nt, Human
uauuuugcauccuuaagcaccuuucguggugccuaucugggaaagaaccacaguauggaaaggc

SEQ ID NO: 410842 - RNA, 64 nt, Human
cgcaucugaggggcagaaugcugcuagcacuugaaucugggaucucgccuuauucucaaguagc

SEQ ID NO: 410843 - RNA, 52 nt, Human
aaccaccuuccacaccauaaugccuccaaaaugagaccaugauauuaagcau

SEQ ID NO: 410844 - RNA, 64 nt, Human
uuacucagcccugggccccaccaccuaggccacuccuccaaaggaagucuaggagcugggagga

SEQ ID NO: 410845 - RNA, 64 nt, Human
aguugucuccuuccauucagauguuaauggggacccuccaaaggaagggguuuucccaugacuc

SEQ ID NO: 410846 - RNA, 64 nt, Human
aagguucuauuaaccacuucuaaggguacaccucccuccaaacuacugcauuuucuauggauua

SEQ ID NO: 410847 - RNA, 64 nt, Human
aguucaucacuacguaaggaaagcuccuuccgccccuccaaagcccucaccaugccuaacagag

SEQ ID NO: 410848 - RNA, 64 nt, Human
caggacagaggaaggaaucucuaaucgucccucuccuccaaaaccagggaaucagagcagucag

SEQ ID NO: 410849 - RNA, 64 nt, Human
gauuaagauacacuccugcugugcccccaucuuuccuccaaacuccugccuguguuugugugga

SEQ ID NO: 410850 - RNA, 64 nt, Human
agaggacccuugucccaaacccuucuuguucucuccuccaaaaguagcuuccuccaacccgcag

SEQ ID NO: 410851 - RNA, 64 nt, Human
uuaagcuuuguguuuaccuacuaaacagaaaaugccuccaaauaaacagugucacaaguacaga

SEQ ID NO: 410852 - RNA, 64 nt, Human
cuuuuuccuuugcuugaauaaacauuuuggaucaccuccaaagaaugaaaaccaguaguacguu

SEQ ID NO: 410853 - RNA, 64 nt, Human
auucagacagucauggggugaaauaauucacuuaccuccaaaauagcauccuauaugccaauaa

SEQ ID NO: 410854 - RNA, 64 nt, Human
uaaaggugaaaucagagcagcacuaccccucccaccuccaaagcaucuguaaaaucauucuauc

SEQ ID NO: 410855 - RNA, 64 nt, Human
auuucagcaaaccaccaccucccacucaguguccccuccaaacuucacacuucccugccugcag

SEQ ID NO: 410856 - RNA, 64 nt, Human
ggucccuccuuuuugggggaaggucagcccagccccuccaaaggucugaugucuccacuuucac

SEQ ID NO: 410857 - RNA, 64 nt, Human
uccauuuuuguuuccaccuuaaccuauagcagcuccuccaaaugaggaaugcuguaaguaagac

SEQ ID NO: 410858 - RNA, 64 nt, Human
agaccagguggaccccagcugccugucacccuucaucugggacuugcugucaaacccuaggaua

SEQ ID NO: 410859 - RNA, 64 nt, Human; identical to SEQ ID NO: 410858

SEQ ID NO: 410860 - RNA, 64 nt, Human
cacuagcccugcuuacuggugccugcugccagccaucugggagugggugaacagcaccccgccg

SEQ ID NO: 410861 - RNA, 64 nt, Human
accuugagaagauucuucccauucuccauuuguuaucugggaacuuauuaaauggaaacugaaa

SEQ ID NO: 410862 - RNA, 64 nt, Human
ucagauuuggucaacgauucuagucacauauuuuccuccaaaaguauuccuuccaaaaauaauc

SEQ ID NO: 410863 - RNA, 64 nt, Human
caaaacccuuugcuguaucacuguguggaaaauaccuccaaagcugaaagagccagguauuuac

SEQ ID NO: 410864 - RNA, 64 nt, Human
ugaaaagugucuuuuuggacaaacuauuuuuccaccuccaaaagaaauuaacacauggacauuu

SEQ ID NO: 410865 - RNA, 64 nt, Human
aaaaacauuuuuaauuuaacaaacuaaaaauauuccuccaaaucucuugcuugucauugacucu

SEQ ID NO: 410866 - RNA, 64 nt, Human
auaguggagguauuguggguucauuugaguaagcccuccaaagauaccauucaaauaaccuggg

SEQ ID NO: 410867 - RNA, 64 nt, Human
acaaauaauagcaauguaaaaaugguuuuuugaaccuccaaauggaauuacagacucaguagcc

SEQ ID NO: 410868 - RNA, 64 nt, Human
cgugcccuauaauggcugcaucccuuuugagcaaccuccaaaaucuacauuuacacaguaggua

SEQ ID NO: 410869 - RNA, 64 nt, Human
uauguaaaaacuaucaucuuugcagauuacucugccuccaaaugcagggccuuucagagaugca

SEQ ID NO: 410870 - RNA, 64 nt, Human
gagaagaucugcgagguugucugcuaaaccugcuccuccaaagccagagcccaagccuaaaaag

SEQ ID NO: 410871 - RNA, 64 nt, Human
cauaugugaaggauaagaaccucacuuccuuacuccuccaaaaagaaguggggaaagaaccauc

SEQ ID NO: 410872 - RNA, 64 nt, Human
uauuuuuacuauuauaauauaauauggaaccuucccuccaaauucuucaauaaaaguugcuuuu

SEQ ID NO: 410873 - RNA, 55 nt, Human
cuggaucggauaaacuuuaauaccuccuccaaaucaucauucaccaaccauacca

SEQ ID NO: 410874 - RNA, 64 nt, Human
gaagacauauugacucugacuggacacccugauuccuccaaauauauauaccacuguguauuaa

SEQ ID NO: 410875 - RNA, 64 nt, Human
aggguggacacuggaaacuagaugacuucuuucaccuccaaaauucccuuaguuucuaugaaaa

SEQ ID NO: 410876 - RNA, 64 nt, Human
uacuauaguaaccaagcacucauuauauaugcauccuccaaauguuucaugcuuauuuauagga

SEQ ID NO: 410877 - RNA, 64 nt, Human
ucuuacacuaaaaauuauuucuuaggcauucugaaucugggaugagaaacaggauuguuucaca

SEQ ID NO: 410878 - RNA, 64 nt, Human
aggcccgcaaaggcaaauaaauccuuguuuugucuucacccauguaauaaagguguuuauuguu

SEQ ID NO: 410879 - RNA, 64 nt, Human
uuauugugucacagggaccccugcuaccacagcuuucacccaugggcauggucagguagccucu

SEQ ID NO: 410880 - RNA, 64 nt, Human
accuccugggcgucacugacaagcuccaucuuaaccuccaaagccacagaacuaggggcucaga

SEQ ID NO: 410881 - RNA, 64 nt, Human
cagaccagaggcccugcaaggacucccccucagaccuccaaagggcaacagaagaguauuaaua

SEQ ID NO: 410882 - RNA, 64 nt, Human
agccaggugcuuucaucacagcuaaaccugguucccuccaaaccucccagccacucgggcuugu

SEQ ID NO: 410883 - RNA, 64 nt, Human
auucacuacagccuggaugacaagcaagacccucccuccaaagaaaauaaagcucaaaauaaaa

SEQ ID NO: 410884 - RNA, 64 nt, Human
gcagcccaggccagucagacgccaggcaccacagccuccaaaaauggcagugacuccccagccc

SEQ ID NO: 410885 - RNA, 64 nt, Human
gacuaagccuuugacuuaaggguugcuugcuugcccuccaaauguccuuucucagaggggccag

SEQ ID NO: 410886 - RNA, 64 nt, Human
uccucugcucuuccaaacacguagcauuugcaccccuccaaagccaucuuuguaaaggaaaacg

SEQ ID NO: 410887 - RNA, 64 nt, Human
uggaugaugcucuagccucugucagggacuguccccuccaaacuugcuuccguggucugccucc

SEQ ID NO: 410888 - RNA, 64 nt, Human
guugguuuagcacaaauacuucccuccuccggcaccuccaaaccuaccccacagucaguguacu

SEQ ID NO: 410889 - RNA, 64 nt, Human
aaacacgaggcacucuuggaucuacccugaguauccuccaaacuguggauacaguuuagugaga

SEQ ID NO: 410890 - RNA, 64 nt, Human
ucccccaucucccuuccugcacccugcugugcucccuccaaacccaccuugcucuguguucuca

SEQ ID NO: 410891 - RNA, 64 nt, Human
ccuguggacucucucaguuguauguugcuauaauccuccaaaucaaagcucuuucugcuugugc

SEQ ID NO: 410892 - RNA, 64 nt, Human
guccuuuucaugugauguggaaaccuacuucuguccuccaaaccaugaaaugugucaucuagac

SEQ ID NO: 410893 - RNA, 64 nt, Human
aguggguggguuugggcaucugugccccugguggccuccaaauccuuccugggauucccccaaa

SEQ ID NO: 410894 - RNA, 64 nt, Human
cugccuggucuagcuccucuccaaacagccaugcccuccaaaugcuagagaccugggcccugaa

SEQ ID NO: 410895 - RNA, 64 nt, Human
guggagacuaagcccugucgagacacuugccuucuucacccagcuaaucuguagggcuggaccu

SEQ ID NO: 410896 - RNA, 64 nt, Human
gccuacucucuguuaugugaauuagcgucuguguuucacccauugucuguguuuaguccuuguu

SEQ ID NO: 410897 - RNA, 64 nt, Human
auagaaaccaucccuucccuuucucccuuggcuguucacccagccauucccugaaggccuuacc

SEQ ID NO: 410898 - RNA, 64 nt, Human
ccaaugaacauuuucucccauuuggugguuuaguuucacccagugugcuuuuggauaagcagaa

SEQ ID NO: 410899 - RNA, 64 nt, Human
gcaggccccucagccuggccugcucucaccaccuccuccaaagcacugagguccuggcagggcu

SEQ ID NO: 410900 - RNA, 64 nt, Human
uucuccugagacagaggacucagaaguggccuuuccuccaaagccugcucagacacaggucugu

SEQ ID NO: 410901 - RNA, 64 nt, Human
ucagccacugcccacagcugcuagacucccuccuccuccaaaucugggcugggucuaggucccu

SEQ ID NO: 410902 - RNA, 64 nt, Human
uuuggauuuucaguuugcuuuuuucuuuuuuuccccuccaaacuccuuuuccuuggccaagccu

SEQ ID NO: 410903 - RNA, 64 nt, Human
acaagcccagcagguccugagugaagccgugggcccuccaaaugcucguuuuauagcaaccucu

SEQ ID NO: 410904 - RNA, 64 nt, Human
ccaaaugcugcuugcagcacccacccuaaagcccccuccaaauagccauacuuagccucagcag

SEQ ID NO: 410905 - RNA, 64 nt, Human
gcgugguacuagugcuugccaccuggucaccagaccuccaaauauggcugccaccaccaggacc

SEQ ID NO: 410906 - RNA, 64 nt, Human
ugacugacuaaagaugcuaggcgugacaccguucccuccaaaagcagaccucggaaucacugcc

SEQ ID NO: 410907 - RNA, 64 nt, Human
agccugggcgcugguccuuucuuccggccccuccccuccaaaaugugccuauugcuagagcucc

SEQ ID NO: 410908 - RNA, 64 nt, Human
uuguaaggaaacacuuucagaaauucagcugguuccuccaaacccuucagccuccguguguucc

SEQ ID NO: 410909 - RNA, 64 nt, Human
gcuucuuuuaaguacccccuuuccuccucacccaccuccaaacugacuagcacucagagggacu

SEQ ID NO: 410910 - RNA, 64 nt, Human
ugccugcugacaccccucgagucacccagcacucccuccaaacagaccuugaggcccaagaccc

SEQ ID NO: 410911 - RNA, 64 nt, Human
cauuuugaaugaauagauugguuuccuguggcucccuccaaaccuggccaagcccagcuuccga

SEQ ID NO: 410912 - RNA, 64 nt, Human
cacugcccuguucugaugucagugccuguacauaccuccaaaggcaggacuugccugauaaaua

SEQ ID NO: 410913 - RNA, 64 nt, Human
ccuuuucuccuugccuucgcauggcuggccuuccccuccaaaaccuccauuccccugcugccag

SEQ ID NO: 410914 - RNA, 64 nt, Human
auugccaccugcacuuugaagaagugagcaaagacguggccacauuucuaauaaguugaaaugg

SEQ ID NO: 410915 - RNA, 64 nt, Human
uggccccacuacagccugaguaggccugaguggccguggccaggcugagaccugucaggccaua

SEQ ID NO: 410916 - RNA, 64 nt, Human
gcuuauuuuuacuuauauauuucagcagaagguccguggccauucacuucaauuuugaccucug

SEQ ID NO: 410917 - RNA, 64 nt, Human
cuucaguuccaaccaauucuuagauugaaucuggccuccaaauauaugcuccccccacauuuua

SEQ ID NO: 410918 - RNA, 64 nt, Human
ccucaguuccaaccaauucuuggauugaguuuggccuccaaauaugcucaccaaacacuauguu

SEQ ID NO: 410919 - RNA, 64 nt, Human
ucaaguacccauucuguuuucccccagcaacgccccuccaaaccuccagccucccugucuccag

SEQ ID NO: 410920 - RNA, 64 nt, Human
cagauuccugggaacagacaccagugcuccagcuccuccaaaguucuggcuuagcagcugcagg

SEQ ID NO: 410921 - RNA, 64 nt, Human
ucagcucuauccucaugggccuauauauuuaauaccuccaaagauauuuucaggauaggcuuug

SEQ ID NO: 410922 - RNA, 64 nt, Human
uaagagcaaagcugaacaacuugccuccucuacuccuccaaagcuuuucuucaggcagccggug

SEQ ID NO: 410923 - RNA, 64 nt, Human
agaaagggaaaggaauggauuccccugccuggagccuccaaaagaaaccagcccugcccacgcc

SEQ ID NO: 410924 - RNA, 64 nt, Human
uggauucuccuucaauuccucagcuuccccucugccuccaaacaggggacacuucgggaaugcu

SEQ ID NO: 410925 - RNA, 64 nt, Human
gauuuaacucaaguggaacuuuuaacucguuugaccuccaaaccauuuggaauucuuuccccag

SEQ ID NO: 410926 - RNA, 64 nt, Human
uccacgccauggguaacuugggggagagaagaauccuccaaacgauggaguagccagugguaau

SEQ ID NO: 410927 - RNA, 64 nt, Human
uguaaaugccacaaaugcauagaauuguuaccaaccuccaaagggcucuuuaaaaucauauuuu

SEQ ID NO: 410928 - RNA, 64 nt, Human
caugauggaaggacucucacuugggcacaagucaccuccaaaugaggacaacagauaccaaaag

SEQ ID NO: 410929 - RNA, 64 nt, Human
auacuuuacaaaccauuaccuguaccuggccuggccuccaaaauauuaacauucuuuuucuguu

SEQ ID NO: 410930 - RNA, 64 nt, Human
ccugguccaggguauccuggggccacccucccugccuccaaaacagggaucccuggcaggcugu

SEQ ID NO: 410931 - RNA, 64 nt, Human
caccccgggccaugccagugugucccucugggucccuccaaaacucuggucaguucaaggaugc

SEQ ID NO: 410932 - RNA, 64 nt, Human
ggugccagaauccucucagagucauugaaggguguucacccaucccacccaaggcuuggcacac

SEQ ID NO: 410933 - RNA, 64 nt, Human
ccugaaaucagaugccuauguaaggaaagugcuauucacccaguaaacccaaaaaaagcaaaug

SEQ ID NO: 410934 - RNA, 64 nt, Human
guggggacaggggucugaaugccgagucccugaauucacccaggaccauccaaggggccaccgc

SEQ ID NO: 410935 - RNA, 64 nt, Human
cucuccugucccuccggccucugcucuccccacguucacccacccuccucccaauuguuucccc

SEQ ID NO: 410936 - RNA, 64 nt, Human
gagagggacacuuccuggccccaccugcuaaauaccuccaaacucugggcaggcgccugcauuc

SEQ ID NO: 410937 - RNA, 64 nt, Human
cccugcccgggaagggaccuugcagggaccucucccuccaaaaaaagaaaaaaagaaaaagaaa

SEQ ID NO: 410938 - RNA, 64 nt, Human
uuuccugauucucuggcuugucaaucaagaguauccuccaaaucucuugacuuuccuuuuuuca

SEQ ID NO: 410939 - RNA, 64 nt, Human
uaauuuccauaaguaacguaugagaauucuagguccuccaaauaauuagcaguccuucguagug

SEQ ID NO: 410940 - RNA, 64 nt, Human
ccgggcgggacccgccccacagacuccaacuuccccuccaaaccccgaagugaaacccgccacc

SEQ ID NO: 410941 - RNA, 64 nt, Human
cagagccagucuuuuuggugaggguaaccccaaaccuccaaaacuccugccccuguucucuucc

SEQ ID NO: 410942 - RNA, 64 nt, Human
uucugaggagccaggacaaguuggcgaccuuacuccuccaaaacugaacacaaggggagggaaa

SEQ ID NO: 410943 - RNA, 64 nt, Human
caagcaugcuggcaccuugaccuuggacuuucagccuccaaaacugugagaaauaaaccucagu

SEQ ID NO: 410944 - RNA, 64 nt, Human
cucuccugagggggaauccuggugcucaaauuacccuccaaaagcaaguagccaaagccguugc

SEQ ID NO: 410945 - RNA, 64 nt, Human
cagaguuggacccgaccccaauggaugaagacccccuccaaagagaccagccucccucccugug

SEQ ID NO: 410946 - RNA, 64 nt, Human
acaaccucagggaggaguguccuggcguccccauccuccaaagggccugggcccgccccgaggg

SEQ ID NO: 410947 - RNA, 64 nt, Human
cccccgccccuucccggccccccucgccgcgcguccuccaaaaaauaaaaccuuaaccgcgggc

SEQ ID NO: 410948 - RNA, 64 nt, Human
cccugagacuucuuucucuccuugccuccacccaccuccaaaggugcugagcucacauccacac

SEQ ID NO: 410949 - RNA, 64 nt, Human
gagggguggcuggggcccccacccauucccccucccuccaaacucccaacccccagucaguguu

SEQ ID NO: 410950 - RNA, 64 nt, Human
gccugaaaauuccaaaaaccagaaugccucuucuccuccaaaggaucacaacuccuugccggca

SEQ ID NO: 410951 - RNA, 64 nt, Human
caggaaaccagagcagugagggcgggcggggcauuucacccaggaauauugagaaugagggccu

SEQ ID NO: 410952 - RNA, 64 nt, Human
uaaacuuagcaagaauggccauggaggcaaagccuucacccagacccaucccacucuccuguga

SEQ ID NO: 410953 - RNA, 64 nt, Human
ggaaagaauauuucccucuccugcaucaagucugcguggccauccuccccccaccauccaagac

SEQ ID NO: 410954 - RNA, 64 nt, Human
gcaaucugggugguaacugccagccuuggaggaucguggccaacguggaccugccuacggaggg

SEQ ID NO: 410955 - RNA, 64 nt, Human
aaacuccugacuucaggugauccgccuaccuuggccuccaaaagugcugggauuacaggcauga

SEQ ID NO: 410956 - RNA, 64 nt, Human
cugcucucucuccacccuccuguucugucuguacccuccaaaaccaagagccggagguggcccc

SEQ ID NO: 410957 - RNA, 64 nt, Human
uucccuucccacccccccuuaagccugucagcccccuccaaaugucucaggauccccccucucc

SEQ ID NO: 410958 - RNA, 64 nt, Human
ugccuccuggguucaagcgauucuccugccucagccuccaaaguagcugggauuacaggcaugc

SEQ ID NO: 410959 - RNA, 64 nt, Human
gcccuaugcugacccaggaaaggccagaccugccccuccaaacuccacaguaugggacccugga

SEQ ID NO: 410960 - RNA, 64 nt, Human
accucuuucacagccucuccuuccuacaaagacuccuccaaaucuuaaaaugaagcaggaaaac

SEQ ID NO: 410961 - RNA, 64 nt, Human
gaaggggagucauuacuccccauuaccuagggccccuccaaaagaguccuuuuaaauaaaugag

SEQ ID NO: 410962 - RNA, 64 nt, Human
gaacuucugggcucaagugauccucccuccuuggccuccaaaggugcugggguuacagguauga

SEQ ID NO: 410963 - RNA, 64 nt, Human
gggcacaagcaaaucccaaauucuccuccugaacccuccaaauuugucuaagaacuucgaaaac

SEQ ID NO: 410964 - RNA, 64 nt, Human
gguucccgccugguccuccagcuucaggaccccaccuccaaaggccccucugcucaaugccuac

SEQ ID NO: 410965 - RNA, 64 nt, Human
cuacucuagaagagggguuacuucuccccuggguccuccaaagacugaaggagcauaugauugc

SEQ ID NO: 410966 - RNA, 64 nt, Human
ugaccuaauuuaaauaaauuaacuauuuaaagacccuccaaauacaguaaccuucugagauauu

SEQ ID NO: 410967 - RNA, 64 nt, Human
aaucuccuggguucaagggauccucccaccucagccuccaaaguugcuaggaccauagccaggu

SEQ ID NO: 410968 - RNA, 64 nt, Human
guggagggagcaugucccugaauuuuccuagaucccuccaaaugccacccaccagagucacugg

SEQ ID NO: 410969 - RNA, 64 nt, Human
caggggaccucgggacugcgcgugaggccccggcccuccaaauccaaauccagacgcaggcccu

SEQ ID NO: 410970 - RNA, 64 nt, Human
ggaagaagagggcuguggucauacacacuguguacguggccaccgcaaaggacggcgucgugca

SEQ ID NO: 410971 - RNA, 64 nt, Human
uccugcuuuguacauagggugugguccccuggcacguggccaccaucaugucuaggccuaugcu

SEQ ID NO: 410972 - RNA, 64 nt, Human
gcagagggcgcaggagcccaggagauggccucagcguggccagccugccaaacugaccagggga

SEQ ID NO: 410973 - RNA, 64 nt, Human
ugccucccagguucaagcaguucuccugccucagccuccaaaguagcuaggauuacaggugccu

SEQ ID NO: 410974 - RNA, 64 nt, Human
cagauucguccacaggggaucugucaguuuggguccuccaaaugaaaaaugucaagacagaauu

SEQ ID NO: 410975 - RNA, 64 nt, Human
cggggcaggagcccccucugccacacgcuuugugccuccaaagcuccccccgccuuggucaggg

SEQ ID NO: 410976 - RNA, 64 nt, Human
cugggaagugguuaagugugcccacccguguucuccuccaaaugcugucgggcaagauagcucc

SEQ ID NO: 410977 - RNA, 64 nt, Human
auaauggaguuggggcaggaagccuauggcccauccuccaaagacagacagaaucaccugaggc

SEQ ID NO: 410978 - RNA, 64 nt, Human
gaggccggguccccuggccacacuuggcagcccuccuccaaagcccucuuccucacguggcuga

SEQ ID NO: 410979 - RNA, 64 nt, Human
agcuaaugaaauugagaagggaaaucuuagcaugccuccaaaaauucacauccaaugcauaguu

SEQ ID NO: 410980 - RNA, 64 nt, Human
gaugacugcccuuuacaacucauauucaguucugccuccaaaaugcauguguccacuuacauga

SEQ ID NO: 410981 - RNA, 64 nt, Human
gggcaguugaggaaaggacagccccugguuggugccuccaaaggaagguggacuuuuuuggugg

SEQ ID NO: 410982 - RNA, 64 nt, Human
cuccuagcccuccugagggguauccuccuaaagaccuccaaaguuuuuauggaaggguaaauac

SEQ ID NO: 410983 - RNA, 64 nt, Human
uccugagaaaugagauucaaaagcugcauuccuuccuccaaaggcccaggacaggacagugcua

SEQ ID NO: 410984 - RNA, 64 nt, Human
agacccucauugaccaguauuuaagggacccuaaccuccaaaagagguacccauuggcgcucaa

SEQ ID NO: 410985 - RNA, 64 nt, Human
aaggcugggaagguuaagaaacaacagagguggaccuccaaaaacauagaggcaucaccugacu

SEQ ID NO: 410986 - RNA, 64 nt, Human
aggcugaugcauucccggugcagaacaggggcacccuccaaacacugggcucugaggaguggag

SEQ ID NO: 410987 - RNA, 64 nt, Human
aacuccugaccuuagggugauccacccaucuuggccuccaaaagugcugggauuacaggcauga

SEQ ID NO: 410988 - RNA, 64 nt, Human
guaacacaaugguaaguaucuaaacauagaaaagggacaguaaaaauaugguuuuauaaucuuc

SEQ ID NO: 410989 - RNA, 64 nt, Human
aauguuuaaauaaugucuauccauguaucaugaaggacaguaugcuucaaauugucuuuugagg

SEQ ID NO: 410990 - RNA, 64 nt, Human
ugaguguuuccuuuguccuugggcugcucgagcuggacaguagguaaccacuguuuucaaggac

SEQ ID NO: 410991 - RNA, 64 nt, Human
accuaaaacagugguauccaaagaagaaucaaggccuccaaaauuugucauugaaucugucacu

SEQ ID NO: 410992 - RNA, 64 nt, Human
ggguugcugugggagguacgccugggccucuguuccuccaaagaccugccugcccaucugcaua

SEQ ID NO: 410993 - RNA, 64 nt, Human
gcaccugccaggccaagggucagggugcccagagccuccaaagagagcugaggggauguggggc

SEQ ID NO: 410994 - RNA, 64 nt, Human
agauguggcuccugccacacccacagggcagccuccuccaaaucccuccuggaggggccuaccc

SEQ ID NO: 410995 - RNA, 64 nt, Human
gauccuccugaagcccuuuucgcagcacugcuauccuccaaagccauuguaaauguguguacag

SEQ ID NO: 410996 - RNA, 64 nt, Human
uugaacuccuggacucgagggauccacccauuggccuccaaaagugcugagauuacaggcauga

SEQ ID NO: 410997 - RNA, 64 nt, Human
cuggaagacacccuaauguggcagcugucucaaaccuccaaaagcccugaguuucaaguauccu

SEQ ID NO: 410998 - RNA, 64 nt, Human
caucuuggaaacugcucuuauugugccaauaugcccuccaaacccucccaggauucaaagcuag

SEQ ID NO: 410999 - RNA, 59 nt, Human
cccauggagccccgaauugacccucacugccuccaaagcccagagccugccugucagcc

SEQ ID NO: 411000 - RNA, 64 nt, Human
acccccaucacccagggcguggagaugaccacgcccuccaaacagagcaacaacaaguacgcgg

SEQ ID NO: 411001 - RNA, 64 nt, Human
gguuuauuucuggaugcucaguggcacggggccuccuccaaagacagguugucauuuucauggu

SEQ ID NO: 411002 - RNA, 64 nt, Human
ucauauucguauugcccuuuuaaaacauugggauccuccaaaggccugccccauguauuuaaca

SEQ ID NO: 411003 - RNA, 64 nt, Human
ccuuucuucuaaaucccaaccgaacuucuuccaaccuccaaacuggcuguaaccccaaauccaa

SEQ ID NO: 411004 - RNA, 64 nt, Human
agagccaggaccaggugggggugcggcccugugcccuccaaauucacaggggguaccuaggagc

SEQ ID NO: 411005 - RNA, 64 nt, Human
agaggaugaggcauaugcguugucaguuggaaucccuccaaauggauugcaagagaaauacuaa

SEQ ID NO: 411006 - RNA, 64 nt, Human
guauguuuauuugccaccaaaaaguaaaugcauuuucacccauucugugguucauuguaguuua

SEQ ID NO: 411007 - RNA, 64 nt, Human
cugauaagcaagaaagcgucacagccagcgucuguucacccaagguugacaagugaaguuucuc

SEQ ID NO: 411008 - RNA, 64 nt, Human
caauaauucacccaguuuagugggugguaggguacguggccagacacagucacccaguuuuugu

SEQ ID NO: 411009 - RNA, 64 nt, Human
ucuucaacagccccaguuauccuggccccaugaccguggccacagcccugcuccagcagcacuu

SEQ ID NO: 411010 - RNA, 64 nt, Human
aaaucuaagacaccccucauaaauaucaaaaacaccuccaaagcuaacgucaggguaaaacuac

SEQ ID NO: 411011 - RNA, 64 nt, Human
acaggaacccuugcauccauuguugugucugugcccuccaaagagccuucagaaugcuccugag

SEQ ID NO: 411012 - RNA, 64 nt, Human
ucucaggugaccaaaauccccuucucaucacuccccuccaaagaggugacugggcccugccucu

SEQ ID NO: 411013 - RNA, 64 nt, Human
aggaucuccacuggacccuugauucauucugaacccuccaaaggaacucuagagggcgagggau

SEQ ID NO: 411014 - RNA, 64 nt, Human
ucauguccaugccagguguuacaauucuuaacuuccuccaaauucguguguccauuagacauuu

SEQ ID NO: 411015 - RNA, 64 nt, Human
ugugggcauugcucuaaccuacuucucaagcuucccuccaaagaaacugauuggcccuggaacc

SEQ ID NO: 411016 - RNA, 64 nt, Human
cugccccuuucccuccucuccgcccaugaaaaugccuccaaacugagaugcuuucagcugagaa

SEQ ID NO: 411017 - RNA, 64 nt, Human
cggggucacgguaccagcagcacuuggggugaggccuccaaagcuuccucagaauuguggcugu

SEQ ID NO: 411018 - RNA, 64 nt, Human
agcuucugaucccagcuauuagggacagaagaagccuccaaaucuggaaggugcugaaugcccu

SEQ ID NO: 411019 - RNA, 64 nt, Human
caucagguuucagcacacaacuuacauuucuuugccuccaaauugaggcauuuauuaugauguu

SEQ ID NO: 411020 - RNA, 64 nt, Human
uuguguggaguggugugucagcccuugaacaucuccuccaaagagacuagaagagucuuaaauu

SEQ ID NO: 411021 - RNA, 64 nt, Human
aagagaaaugaggaacuuucgaacugcaaauaugccuccaaacuagcuuuugauaagugugguu

SEQ ID NO: 411022 - RNA, 64 nt, Human
ccuccucugugggccuggcagacccuucaugagugggacccaagauaucacugacuucaaccca

SEQ ID NO: 411023 - RNA, 64 nt, Human
cgugguuuuucccaccccagcugccccagcacgcgggacccauagcacaccccuuagcgcuugc

SEQ ID NO: 411024 - RNA, 64 nt, Human
ccgggcuucgaugugccuggaggauuuccccacagggacccacgcaccucccuguaucugcgca

SEQ ID NO: 411025 - RNA, 64 nt, Human
uaccucuugcccagcugccucuucugaaauccacuucacccacuccacuuuccuccacagaugc

SEQ ID NO: 411026 - RNA, 64 nt, Human
gggacaaaauacugacucaguccuuagauguaguuucacccaagagcaucuuggcccugggaag

SEQ ID NO: 411027 - RNA, 64 nt, Human
aggccugggcuaagaggagcugauucguuaucucuucacccacugcccucucaguaucaccagu

SEQ ID NO: 411028 - RNA, 64 nt, Human
guauggucuuucaagagaguuccagacuggcacuuucacccagaaccaaugcgguguuucuuaa

SEQ ID NO: 411029 - RNA, 64 nt, Human
agaagagauagaaucagggcugcccccacagagugggacccaaggggcuaauuggaggcacgag

SEQ ID NO: 411030 - RNA, 64 nt, Human
aaagggaaaggguggggguuaggggaagguuggggggacccagcaaggacucagagagucagac

SEQ ID NO: 411031 - RNA, 64 nt, Human
auccucuccccgcucuagguuucuucucccaaaggggacccaaggcugugacacuuaccuccac

SEQ ID NO: 411032 - RNA, 64 nt, Human
gggggccuccucagccucugcaacugcaagaaaggggacccaagaaaccaaagucugccgccca

SEQ ID NO: 411033 - RNA, 64 nt, Human
acaagccacacccccuccucugagcucugaauaugggacccagugccaggagcuggaagacaag

SEQ ID NO: 411034 - RNA, 64 nt, Human
uacagagcuaagagugacaucaaaugaggacugugggacccagauuugaagacccaauaaaaau

SEQ ID NO: 411035 - RNA, 64 nt, Human
uggggaaaccuccuuccaccugagcuugcuugaagggacccagagucuuugggcccagaucuuu

SEQ ID NO: 411036 - RNA, 64 nt, Human
guggguggauucauugccacacucuuuucucccagggacccaggaaacuaggacuuuguguguu

SEQ ID NO: 411037 - RNA, 64 nt, Human
ucuccuccgccacccccgccguggggcuccggaggggacccagcuccucugagccauaccgacc

SEQ ID NO: 411038 - RNA, 64 nt, Human
cacacagauguuccugucuccucgcaugggcauagggacccaucauugaugacugaugaaacca

SEQ ID NO: 411039 - RNA, 64 nt, Human
ccucucacucccuuccaugccggaacccaggccagggacccaccggccugugguuugugggaaa

SEQ ID NO: 411040 - RNA, 64 nt, Human
gggcaaaggcauuggucaccaagagucuugcagggggacccacagauaugccauguccuucaca

SEQ ID NO: 411041 - RNA, 64 nt, Human
caguggcuuugagucaaggccgguucuaauugaggggacccagugugcuucaguguuaagagug

SEQ ID NO: 411042 - RNA, 64 nt, Human
uuguuuggagaaagagggcaaucaggacucuucugggacccagaugaguucuucacuagcccuu

SEQ ID NO: 411043 - RNA, 64 nt, Human
acugugagagauugugucugccccugcccugccugggacccacagggagacuauaaucuccuua

SEQ ID NO: 411044 - RNA, 64 nt, Human
gacaauaccucgagccacaaccgaccagaugccagggacccacggagcccuuaugacaucagca

SEQ ID NO: 411045 - RNA, 64 nt, Human
aucagaaaacaaagucuucaucucucucuccaguuucacccaccccacccuuugcuuucauuuc

SEQ ID NO: 411046 - RNA, 64 nt, Human
cagccaagacucugaacucugcagaaacauuuguuucacccagacuucaaacucuagcccugac

SEQ ID NO: 411047 - RNA, 64 nt, Human
caaauccucuggguuuugacuuuuuggcuuccacuucacccaaaauguuaaaauuuuuacuuaa

SEQ ID NO: 411048 - RNA, 64 nt, Human
cccacacccaugccaaugugccaagucucccuuggggacccagcugagucuggguguucccauu

SEQ ID NO: 411049 - RNA, 64 nt, Human
gagauguggccugcagacaacaugcagccaugcagggacccaggacuguaaccuggggaggacg

SEQ ID NO: 411050 - RNA, 64 nt, Human
gggaggcccacuccuggcucaccucucccucucagggacccacgugggagccuggaucccugga

SEQ ID NO: 411051 - RNA, 64 nt, Human
ccacacuagcagcccugacuccacacuccuccuggggacccaagaggcaguguugcugucugca

SEQ ID NO: 411052 - RNA, 64 nt, Human
caaauaauuugggggugauuugcaaugaaauuuugggacccaaagaguauccacuggggauguu

SEQ ID NO: 411053 - RNA, 64 nt, Human
gauuucaacuuaagcuugacuugggguuuguagcgggacccagucaaaccccauucaggucaug

SEQ ID NO: 411054 - RNA, 64 nt, Human
cacagcugagacugggcaccaggccaccucuguugggacccacaggaaagaguguggcagcaac

SEQ ID NO: 411055 - RNA, 64 nt, Human
aggcaggcacuaucagaaaguguacgccaacuaagggacccacaaagcaggcagagguaaugca

SEQ ID NO: 411056 - RNA, 64 nt, Human
uggucccuggucccucguccacaggggcaggccugggacccagcuacucuguccaggccacugu

SEQ ID NO: 411057 - RNA, 64 nt, Human
gugccaagugcuaccacuucccaauaaaggaauggggacccagaggcugggucccuggcuaccu

SEQ ID NO: 411058 - RNA, 64 nt, Human
uucccaggggaggaaccaacugcuccaccuucuagggacccaguuuguuggaguaggacaguaa

SEQ ID NO: 411059 - RNA, 64 nt, Human
accucacugucuccagcuaugcccagugcugcaugggacccaugucuccugggacagaggccau

SEQ ID NO: 411060 - RNA, 64 nt, Human
cggccuugcgaagccuccucagcucggggggccggggacccagugagccgagaggcccucuggg

SEQ ID NO: 411061 - RNA, 64 nt, Human
uggagcuggccugagagggcucaauggacccucggggacccaaguggggcuuucaacccucucc

SEQ ID NO: 411062 - RNA, 64 nt, Human
ccuuucacaggguuccaccucccagacucacucugggacccagaauccuauauguggccuuggg

SEQ ID NO: 411063 - RNA, 64 nt, Human
gcuccaacuucaggaaauaaauuucccauugcgagggacccagcucuguuucugcugcuuccau

SEQ ID NO: 411064 - RNA, 64 nt, Human
uuauagagaggucacacucuaaguggggucgcggcguggccacgcuucacggucacgcucgucc

SEQ ID NO: 411065 - RNA, 64 nt, Human
gaaagugcugagauuacaguugcgagccacugugcguggccagaacuuuauaauaagagacuug

SEQ ID NO: 411066 - RNA, 64 nt, Human
uagagugcagggauuacaggcgugagccacugcucguggccaaaaguuuucuuuuuuuuuuuuu

SEQ ID NO: 411067 - RNA, 64 nt, Human
acacuucuggcucacaggaaagugucugcaguaggggacccagagucccaggccccuggaguug

SEQ ID NO: 411068 - RNA, 64 nt, Human
cuugccauuuaggacugaacuuuccuuagcccaagggacccagugacaguugucuuccguuugu

SEQ ID NO: 411069 - RNA, 64 nt, Human
uguuuaaggacuuggaguuauggauggaauuuaugggacccacgugagcagaccugaggaaggc

SEQ ID NO: 411070 - RNA, 64 nt, Human
acuuucucacccugcggcaggcacaacagaugcugggacccagucucugcccaggucacagcac

SEQ ID NO: 411071 - RNA, 64 nt, Human
uccguauugggguucugccaaggacccguauucagggacccaugcucuuuuggggggacuuuuc

SEQ ID NO: 411072 - RNA, 64 nt, Human
cucauuuaaucaccccaauccagcuccuggaggagggacccagcuccaucgcgcuggaggagag

SEQ ID NO: 411073 - RNA, 64 nt, Human
ugcucagaaucugguauguggaagagccaacauggggacccagccuuuugugauucuaaaaccu

SEQ ID NO: 411074 - RNA, 64 nt, Human
acggugcggggccgcagggggcgcggggcgcggcgggacccaggcuacgagcgggagggaggcg

SEQ ID NO: 411075 - RNA, 64 nt, Human
ugggcuggguggcacaccacccgaggggggccccgggacccacggagcccucccuaugucugca

SEQ ID NO: 411076 - RNA, 64 nt, Human
ggggaccugccaccagggagcuuccuggcucugggggacccaggugggacuuagcagugaguau

SEQ ID NO: 411077 - RNA, 64 nt, Human
aaugucaggacccucagcgguggagccugcuggggggacccagcugcucuuggacaaguggcug

SEQ ID NO: 411078 - RNA, 64 nt, Human
uguguucccaucugucugccauccucugaaggccgggacccagucauacauccuuagaaaccaa

SEQ ID NO: 411079 - RNA, 64 nt, Human
ugucaaccagauugaguugcuauagcuugaugcagggacccagugaaguuucuccguuaaagau

SEQ ID NO: 411080 - RNA, 64 nt, Human
ggaggaggacucgcgcuacaagaggccacucccagggacccagggaggcgauggccaccccaga

SEQ ID NO: 411081 - RNA, 64 nt, Human
gccaggcuuccaacuuccgcugccuucggacauagggacccaguucccaggagcggggagguag

SEQ ID NO: 411082 - RNA, 64 nt, Human
ggccuugggcucuccccagggucuaacgguuaaggggacccacauaccagugccaagggggaug

SEQ ID NO: 411083 - RNA, 64 nt, Human
gucauuuccagauuucauuaccuccuacuugccauucacccaucaaugugaaagucagggucac

SEQ ID NO: 411084 - RNA, 64 nt, Human
ccuuugcaagugaacccugcagcucacccauucauucacccaacuuccuucauucagcaggagg

SEQ ID NO: 411085 - RNA, 64 nt, Human
ugggcuugccugccagcagugaugucccacccuguucacccagccgccagucauggacacaggg

SEQ ID NO: 411086 - RNA, 64 nt, Human
ucuagauggggaaggagcagguucaucggguacugggacccagcagugugauccagagagcagu

SEQ ID NO: 411087 - RNA, 64 nt, Human
gcuugagcugaggaugggacgaugugcccagggagggacccaccagagcacaagagaagguggc

SEQ ID NO: 411088 - RNA, 64 nt, Human
gccaucugaugccucuacuaucauuaccucuauugggacccagaaaccaauaccccaaaauaug

SEQ ID NO: 411089 - RNA, 56 nt, Human
aggugcuuguuggguccuaagacccagggacccagcgacuaugcccacccagaccc

SEQ ID NO: 411090 - RNA, 64 nt, Human
ugcuuccugcagcucacgcccaccagcuacugaagggacccaaggcacccccugaagccagcga

SEQ ID NO: 411091 - RNA, 64 nt, Human
acacacacacacacacacagagacacaucuuaaggggacccacaaguauugcccuuuaacaaga

SEQ ID NO: 411092 - RNA, 64 nt, Human
aaacgccaugaggcagggggcuggacuucaggcggggacccauugccucgcagaagaaaguucu

SEQ ID NO: 411093 - RNA, 64 nt, Human
gggccagugccauggggaaggggcuuguggggaggggacccaugaauccugaccacucuugaac

SEQ ID NO: 411094 - RNA, 64 nt, Human
ugggggcagaaguucagacacaccgugcucaggagggacccagagccgaguuucggaguuuggu

SEQ ID NO: 411095 - RNA, 64 nt, Human
ccuccauaacagcuucugugcuuauauaauuuuugggacccagaagaaacaacgacacaaucuu

SEQ ID NO: 411096 - RNA, 64 nt, Human
gggugggggcagaaggcagagccugugucccagggggacccacacgaagucaccagcccauagg

SEQ ID NO: 411097 - RNA, 64 nt, Human
aagagggugaugagacaggacuagaaaguagugggggacccagcgaguggacgcccugcuccgg

SEQ ID NO: 411098 - RNA, 64 nt, Human
cagcugugugagaaaaugaaagccgacguccacagggacccaggcaggguuggguguugugacu

SEQ ID NO: 411099 - RNA, 64 nt, Human
ccgcuggggccuggagucagggcccacuccaggagggacccacugccuucccggggagcacagu

SEQ ID NO: 411100 - RNA, 64 nt, Human
cagugcuuagcaacauuggugauagcauguggcugggacccagggcccuuccccacucuucagc

SEQ ID NO: 411101 - RNA, 64 nt, Human
gcacagccuugaagugggagugaugagauucugagggacccaugaauuggauugaggcuugagg

SEQ ID NO: 411102 - RNA, 64 nt, Human
agaccauuaggaacguaucuuugcaaacugcccauucacccaugaagaggaagccucaagaucc

SEQ ID NO: 411103 - RNA, 64 nt, Human
auccucgaaaugauaauaucuccagaauauuguuuucacccaaauuugaguagauauuuuaaac

SEQ ID NO: 411104 - RNA, 64 nt, Human
augggaagcugugacucugggcauuaucgacacguucacccaucuuaucaaggacucugguuuc

SEQ ID NO: 411105 - RNA, 64 nt, Human
gaugucagagacuugccagggcugccaaggagccgggacccaggagagggugagcuggaagggu

SEQ ID NO: 411106 - RNA, 64 nt, Human
auaagcuagucccaaaauucauaaagaaaugcaagggacccagaauauccaaauaagccuugaa

SEQ ID NO: 411107 - RNA, 64 nt, Human
ccccaggccccccaccugcaggacaacuuauaaugggacccaaaggggaaagaggauuucccgg

SEQ ID NO: 411108 - RNA, 64 nt, Human
cacucuuagaaccuuccuucacauuguuuuuuaugggacccaugaaugguuagccuuucuuuuc

SEQ ID NO: 411109 - RNA, 64 nt, Human
caguccucacacacggaggccagacacaggccgugggacccaggcucccagccuaagggagaca

SEQ ID NO: 411110 - RNA, 64 nt, Human
aggucagcaccccagagcagacugauagguccgugggacccauguuagagcagaaaauuugggc

SEQ ID NO: 411111 - RNA, 64 nt, Human
ucucuucauuccucuuaggagagugccaaacucagggacccagcacugggcuggguugggagua

SEQ ID NO: 411112 - RNA, 64 nt, Human
ggauagagggcaggagacccuuaggauagauugugggacccaggcaggaacagguguccacaag

SEQ ID NO: 411113 - RNA, 64 nt, Human
uuuuucauuuucuguuggauuacagaaaaagaaugggacccauucaggucucgauuuccaaagg

SEQ ID NO: 411114 - RNA, 64 nt, Human
ucgagaaggugagaggaaggcaaaggccagggaggggacccagagaggccuggcacacaaggcc

SEQ ID NO: 411115 - RNA, 64 nt, Human
cuugccgcggggcccacuaggcggggcggggguugggacccagcgggagccggggcagccuggc

SEQ ID NO: 411116 - RNA, 64 nt, Human
ccugcuguuuauucuguaaggggaagguggcaaugggacccagcuccaucagacacuugucaag

SEQ ID NO: 411117 - RNA, 64 nt, Human
aaguuugcagagagcagacagcuagagauaacucgggacccagaguuggucgacagauguuaga

SEQ ID NO: 411118 - RNA, 64 nt, Human
gacgaaguauagagaacagguggcccagauccaggggacccaacuucuggccccuuggucuguc

SEQ ID NO: 411119 - RNA, 64 nt, Human
ggaggauggaggacggagcugcagacgaaggcaggggacccauggcgaggaggaauggccagca

SEQ ID NO: 411120 - RNA, 64 nt, Human
uggugcugcagcaccgaggggccuuuguucuggggggacccagugcagaauguaagugggccca

SEQ ID NO: 411121 - RNA, 64 nt, Human
cuuuucaacaacagacguaguaaucgauguguuauucacccacuucauucaucuuuauccagug

SEQ ID NO: 411122 - RNA, 64 nt, Human
augugcaauaacgguaacuugacucuuccaucuuuucacccacagcaggcaccuaagucugccu

SEQ ID NO: 411123 - RNA, 64 nt, Human
ggucuggcuuuggaaagaccugugaggggaaaccuucacccagcacccaugccccacucugcug

SEQ ID NO: 411124 - RNA, 64 nt, Human
ucuuucaaaaacaaaucagaagcagaugcugauugggacccauauaccacguugcugacucacg

SEQ ID NO: 411125 - RNA, 64 nt, Human
gccaggccugcccagcagccucugcucccuccuggggacccacagcagacgucugcaagccacu

SEQ ID NO: 411126 - RNA, 64 nt, Human
cccuggcccaauuccucagaccccagaguggccugggacccaagcugccgcagcugaguggccc

SEQ ID NO: 411127 - RNA, 64 nt, Human
agaagagaagagccaaccagaagagcucugcacagggacccaucccaugguuucuccccgaaag

SEQ ID NO: 411128 - RNA, 64 nt, Human
auuucacuugcaaaacagaaguaaauaagaguucgggacccaggguaaaaugguagcuucaucc

SEQ ID NO: 411129 - RNA, 64 nt, Human
uacuggcagcccuagaguucauagauggacuuuugggacccagcaguuuugaaauguguuuaug

SEQ ID NO: 411130 - RNA, 64 nt, Human
uagaugcuguucuuccuuuagauuuugucacguggggacccagcuguacauauguggauaagcu

SEQ ID NO: 411131 - RNA, 64 nt, Human
gucucauugccagugguguccaagggcccccguugggacccacggcucucgucccucugcuccg

SEQ ID NO: 411132 - RNA, 64 nt, Human
ugcuggaggaaauguagcagacagcauggaggcugggacccagcagcuacuuugggucaugucu

SEQ ID NO: 411133 - RNA, 64 nt, Human
ugggugccccccuugccagacauguggugggacagggacccacuucacacacaggcaacugagg

SEQ ID NO: 411134 - RNA, 64 nt, Human
ugcccaggucuccugccucacaucacaauaaucugggacccaggcuugugcccuuucaguguaa

SEQ ID NO: 411135 - RNA, 64 nt, Human
agggcagagccagaagaaggcucauuagaccugggggacccaaagggucuggccucuuugggca

SEQ ID NO: 411136 - RNA, 64 nt, Human
aaggagguaaauaaacuaagauauuccgagggaagggacccaggccaccucccuuccgcagguc

SEQ ID NO: 411137 - RNA, 64 nt, Human
aaccagcccacaauuacacaaagacaaaaaaagggggacccaggucuucuguaaccaccucaua

SEQ ID NO: 411138 - RNA, 64 nt, Human
gaaugcagaaaacaaagucguggacaaccaggcugggacccagggccagcugaaggugcuggug

SEQ ID NO: 411139 - RNA, 64 nt, Human
cuccccggcucuggggccagucgagagccacugagggacccagcacucagagacacaacacaca

SEQ ID NO: 411140 - RNA, 64 nt, Human
ccaaauugggaaaugucccagucagaagaagauuaucugggacacugauacugacagggagaug

SEQ ID NO: 411141 - RNA, 64 nt, Human
uucauacuggagaaaggccuuaugagugcugucaaucugggaaacaucagaaugucugcucucc

SEQ ID NO: 411142 - RNA, 64 nt, Human
auguggacagcuuuggccagagcucccguguggcaucugggagccacagugacccagccaccug

SEQ ID NO: 411143 - RNA, 64 nt, Human
ccacccccagaguuugauacaguagaccucaggugggacccaaaaauuugcauuucuaacacau

SEQ ID NO: 411144 - RNA, 64 nt, Human
gacccgcgcucccaucccccaccuucccgggccggggacccacucugcccagccggagggacgc

SEQ ID NO: 411145 - RNA, 64 nt, Human
ggugccugaagagggccugacacuucacagaguggggacccaccagagccuauagaaucaauuc

SEQ ID NO: 411146 - RNA, 64 nt, Human
uuucuucugauccagccuguagagacucgccuuugggacccaucuuugcuuccuuucaguugcc

SEQ ID NO: 411147 - RNA, 64 nt, Human
gaauguauuuauuugggagaccgggguauccugggggacccaauguaggagcugccuuggcuca

SEQ ID NO: 411148 - RNA, 64 nt, Human
ccuuucaggccaaggcuaugaagggacagcugcugggacccaccucccccuccccggccacaug

SEQ ID NO: 411149 - RNA, 64 nt, Human
aaaucacuaccgccgauaggugcugucuccuccggggacccagacugccuucaucucugauggc

SEQ ID NO: 411150 - RNA, 64 nt, Human
ccagggacggccucuggacugccaggcuggguuggggacccagggaacaucggucuacucaggu

SEQ ID NO: 411151 - RNA, 64 nt, Human
ccagccaauaagcauagauacuauaugguaucaugggacccaucuauuuuuuaccaguggacua

SEQ ID NO: 411152 - RNA, 64 nt, Human
ucucgcaguagaggaacuccugguggugggaagagggacccaauggacaaaaccguuuuuguuu

SEQ ID NO: 411153 - RNA, 64 nt, Human
uucccuggggagccuuuauaagacacugauacuugggacccacuccagagauucugaaugaauu

SEQ ID NO: 411154 - RNA, 64 nt, Human
cuggggagguaggcugggagcaaaaggagagggugggacccaguuuugcgugguugguuuuuau

SEQ ID NO: 411155 - RNA, 64 nt, Human
uuucagaugaagugcccaggcuccaggaaguugagggacccacaggagaggugggcagagcugg

SEQ ID NO: 411156 - RNA, 64 nt, Human
aguuagggggguacgggugaaagagggguacacagggacccagcccuucucuucuuccccaaua

SEQ ID NO: 411157 - RNA, 64 nt, Human
accauauuucccuccucagugugcacccuuugaagggacccagcacagggucuugggccugggc

SEQ ID NO: 411158 - RNA, 64 nt, Human
acagggaaaauggagcccaaguagccucuggccagggacccaaugucccgaggaaucugccucc

SEQ ID NO: 411159 - RNA, 64 nt, Human
agggggucaggcacugcaugcucguuccagcaccaucugggacuggguacaguaccuccagccc

SEQ ID NO: 411160 - RNA, 64 nt, Human
aacugugaagauaguuuauuuuuauuccuugccaaucugggaauaugccuuuuuuguguguuug

SEQ ID NO: 411161 - RNA, 64 nt, Human
accacuuguacucaauucuaauugcccccuggcaaucugggaaggguucagaaggugggcaccc

SEQ ID NO: 411162 - RNA, 64 nt, Human
ucuacaccugggcuccaagucugaguucccacaggggacccagcagccuccaggaaguccauac

SEQ ID NO: 411163 - RNA, 64 nt, Human
auccuggaggagaggaaacagugacuaaaagcuggggacccacagagggguuggcagcuucucu

SEQ ID NO: 411164 - RNA, 64 nt, Human
augcccucagccagcucugacccagguccgcccagggacccacauggacuaaaggcaaugccag

SEQ ID NO: 411165 - RNA, 64 nt, Human
uggcucaucacaacaaggaaggcugugcaccacugggacccagcagcagcucagcagcagcagu

SEQ ID NO: 411166 - RNA, 64 nt, Human
ucaggguggcgcggcugcugcucacugugcugcugggacccaagaguggggcgucgccccugcu

SEQ ID NO: 411167 - RNA, 64 nt, Human
cacucccuugaaguuguggaggaggugaaagaaagggacccaccugcuagucgccccucagagc

SEQ ID NO: 411168 - RNA, 64 nt, Human
agcgaugaugacaccaaauccauguguccacccugggacccaggagggcacagccaaggaauga

SEQ ID NO: 411169 - RNA, 64 nt, Human
ccuccgcgggagguggcccucagcugggacaguggggacccaggcuucuccucagagccaggcc

SEQ ID NO: 411170 - RNA, 64 nt, Human
ccaacaggcccgugggaccaugacuuagggaggugggacccacccacccccauccaggaaccgu

SEQ ID NO: 411171 - RNA, 64 nt, Human
caacgucugcucaggaaguggggccagcuccacugggacccauaguuuuacuuccuugucauuu

SEQ ID NO: 411172 - RNA, 64 nt, Human
cguuggugaagaacacacaucgauucugcaccuggggacccagagcgagauggguuuguucggu

SEQ ID NO: 411173 - RNA, 64 nt, Human
aggcucaggugcuuccaucuguggugacuggaaugggacccacguggaguaggugacauaugcu

SEQ ID NO: 411174 - RNA, 64 nt, Human
uucccugagaaacagggccggccccccaacuucagggacccaccgcccauuccccgagagcugu

SEQ ID NO: 411175 - RNA, 64 nt, Human
ccugaucacagcugcaugccgaccuugucccaccgggacccacaauggcccgagcccucuuugc

SEQ ID NO: 411176 - RNA, 64 nt, Human
agcauuccagagcaguacaucugcuauaucugccgggacccaccagguaaggcuuucugugccg

SEQ ID NO: 411177 - RNA, 64 nt, Human
ggccuagguaggggaggauggugccuggagcagagggacccacaagugccucccgagccuagau

SEQ ID NO: 411178 - RNA, 64 nt, Human
cggggugugugcuacagucuaagggcucccacucaucugggaguucacgggagccggagcuggg

SEQ ID NO: 411179 - RNA, 64 nt, Human
cuacuugggaggcugaggcaggagaauugcuugaaucugggaggcagagguugcagugagccga

SEQ ID NO: 411180 - RNA, 64 nt, Human
ugccccugagguucuccuggcuagucaggguggcuucacccaucacugguggguugcaggaaca

SEQ ID NO: 411181 - RNA, 64 nt, Human
gcccucagcgugggcaggcacauccacuugguuggggacccagauggaacacaaagggagaaga

SEQ ID NO: 411182 - RNA, 64 nt, Human
cuuccaccacagagggcgugugcucggugcugacgggacccacaugcuccagauuagagccugu

SEQ ID NO: 411183 - RNA, 64 nt, Human
cguugagaaccaggagacacguguggcgggcagugggacccauagaucuucugaaaugaaacaa

SEQ ID NO: 411184 - RNA, 64 nt, Human
auuguaguucccauaauccccacauguugugggagggacccagugggagguaauuaaaucaugg

SEQ ID NO: 411185 - RNA, 64 nt, Human
ugagaacgaacaggaauggagagaggacucaacugggacccacguggaaaagaccgagcaggcc

SEQ ID NO: 411186 - RNA, 64 nt, Human
cuuccgguccagucacaaucaucaugucacuguggggacccagaucugugucuugaagcagcug

SEQ ID NO: 411187 - RNA, 64 nt, Human
ucuccaaccccuucauaagcuugggccacugccugggacccagcagacacugcccaggacucuu

SEQ ID NO: 411188 - RNA, 64 nt, Human
uuccugguuccccccagacccuugagcgcucuuugggacccagaaggaguccuugcacagggaa

SEQ ID NO: 411189 - RNA, 64 nt, Human
agggagacagggaugccaagaguagaccagagcugggacccacagacagaaccuccaccugccu

SEQ ID NO: 411190 - RNA, 64 nt, Human
cgcagggcccccacuucccaguggcugcuuccuggggacccagggcaccccggcaccuucaggc

SEQ ID NO: 411191 - RNA, 64 nt, Human
gcugagggaagguacgagcucccugcuggagccugggacccauggcacaggccaggcagcccgg

SEQ ID NO: 411192 - RNA, 64 nt, Human
gcaugcccuucacugcagugucaggccuuuagaugggacccagcgaaaauguggcccuucugag

SEQ ID NO: 411193 - RNA, 64 nt, Human
acuccgccaacccauuccuaccuccucuagugcagggacccaaguuagaugaugagaaaaugcc

SEQ ID NO: 411194 - RNA, 64 nt, Human
gagccuccaggcacacacccgcuucuggacgucggggacccagcgguugggcucaggccacaac

SEQ ID NO: 411195 - RNA, 64 nt, Human
agaauaaccaggacagccaagugaagcagccacagggacccaagcagucgaggucuuuaaugug

SEQ ID NO: 411196 - RNA, 64 nt, Human
gaaauauagugcucuugcuuuggauaacuguaaagggacccaugcugauagacuggaaauagaa

SEQ ID NO: 411197 - RNA, 64 nt, Human
cugugacaaucagcaaagccccacccaggcccccaucugggaugaugggagagcucuggcagau

SEQ ID NO: 411198 - RNA, 64 nt, Human
acuuggguagguuggggauggggcagaggucuggaucugggaucgcccuuggcugaaaguuuag

SEQ ID NO: 411199 - RNA, 64 nt, Human
cccugcccuugugaccucccaggaaacagaacugaucugggacacuaugucaccucuccucuca

SEQ ID NO: 411200 - RNA, 64 nt, Human
gcccugaggucaggauggggagcugcugccuuuggggacccacgcuccaaggcugagaccaguu

SEQ ID NO: 411201 - RNA, 64 nt, Human
gagcugaccacggagcuggggguugccauggauggggacccaaagaccugcagccaccagugcu

SEQ ID NO: 411202 - RNA, 64 nt, Human
uguuaggggacauaacaagcucugcugggcuugagggacccagaccaggugucugcagucagcu

SEQ ID NO: 411203 - RNA, 64 nt, Human
cugccgaccgcacagcucccucucugggggcugagggacccaccuggccccuccucugacacag

SEQ ID NO: 411204 - RNA, 64 nt, Human
aggggccaccgcguggcugcugcuguccuccuccgggacccacggggaccaaggucacacguuc

SEQ ID NO: 411205 - RNA, 64 nt, Human
acgcacacuguccgagcccucugcucagccgccugggacccaccagggugcagcugggcuccag

SEQ ID NO: 411206 - RNA, 64 nt, Human
uugguuagcacaguuuauaguaagugaaaagcaagggacccaccuacauuaccuucaggagacu

SEQ ID NO: 411207 - RNA, 64 nt, Human
ccauaugaaaaauaagggaagauuuuuuagcaaggggacccacaaacaagagugcucuuguaug

SEQ ID NO: 411208 - RNA, 64 nt, Human
aacugcauagauugaucaaaguguaaacaccauagggacccauucuacacagagcaggacugca

SEQ ID NO: 411209 - RNA, 64 nt, Human
ggucauccacaucugugggugggccguggguagagggacccacaggcguggacagggcaucucu

SEQ ID NO: 411210 - RNA, 64 nt, Human
agaacacuugccccuugacuguaggagccagaaggggacccaggugugcauagcucucuguaga

SEQ ID NO: 411211 - RNA, 64 nt, Human
auguuaaggugaaccccaccccuucuuacagauggggacccagagccugcucuugggaacagcc

SEQ ID NO: 411212 - RNA, 64 nt, Human
cuuucuuccccagggaauucucuagcagagggaggggacccaccccagugaggaaguagauugc

SEQ ID NO: 411213 - RNA, 64 nt, Human
accuaggacucuucccuggagucaugggcugccugggacccaggacccaugagggggcugagag

SEQ ID NO: 411214 - RNA, 64 nt, Human
agcagggguccagagaggcaggcuggggaggcaagggacccauccuaggcccgcuuucuugccg

SEQ ID NO: 411215 - RNA, 64 nt, Human
acgggcuuugggggcgucaggucuuuccaagguugggacccaaggaucggggggcccagcagcc

SEQ ID NO: 411216 - RNA, 64 nt, Human
ggcuuggcccuagccgcccuccccgauggcggggaucugggagggucgggggagcaaaaggcgg

SEQ ID NO: 411217 - RNA, 64 nt, Human
ucaagaaagcuuccgagguaagaauuuuauggucaucugggacaacuuaaaucucccuucugcu

SEQ ID NO: 411218 - RNA, 64 nt, Human
aaaauuucuucaaaauuuuuugguguuccaaugaaucugggauguaaacucugaauguauuuau

SEQ ID NO: 411219 - RNA, 64 nt, Human
uagaaggagagagccacgugaacauccggcgaaggggacccaggcagagagaaaaggaaaucca

SEQ ID NO: 411220 - RNA, 64 nt, Human
gagcccuccugcucacacagcugcugagacuucagggacccaucagaacuuggugcagcacagc

SEQ ID NO: 411221 - RNA, 64 nt, Human
uugggugcggggucucugugcacuugagagcugggggacccacccaccgucucccacuccaagu

SEQ ID NO: 411222 - RNA, 64 nt, Human
aaauggcauuagcagcugucaucagaagcugugagggacccacagauuuuggaaacgaccugga

SEQ ID NO: 411223 - RNA, 64 nt, Human
guagggguauaagucuguuccaugcagucacucagggacccagucuccuuuugucuggugacuc

SEQ ID NO: 411224 - RNA, 64 nt, Human
caggucagcaggaacccuuuucugcagucacucagggacccagacuuacagaguggguaggaug

SEQ ID NO: 411225 - RNA, 64 nt, Human
agcaauuaagagcaguuauaauagaggaagcugggggacccauuuugcaccaugaguuugugaa

SEQ ID NO: 411226 - RNA, 64 nt, Human
ggacugaugucuccuaagcaccuguaaugugcgagggacccagcuaauaacugaucucguuuuu

SEQ ID NO: 411227 - RNA, 64 nt, Human
agacuggaugcuucuguugagcucuccauuaugugggacccauuccucaccaaaaugaggagag

SEQ ID NO: 411228 - RNA, 64 nt, Human
ggagaugguaaguucaagaagacugauugcaccugggacccaggcccuuucuuugggauccagu

SEQ ID NO: 411229 - RNA, 64 nt, Human
ccucacccugcuccccacccaggcagggcagcaugggacccagugucucagugccuucaaaacc

SEQ ID NO: 411230 - RNA, 64 nt, Human
ugaggaagggaauggaccagggagucccaggccugggacccagagccaagaaagcugagauauc

SEQ ID NO: 411231 - RNA, 64 nt, Human
gugggugacccuccugggcccuugagacucgucugggacccaugcaaauuaaaccaaccuggua

SEQ ID NO: 411232 - RNA, 64 nt, Human
ccugggcccaccuccgauucacagagguuucagggggacccaaaucacugcugguuuucaauuu

SEQ ID NO: 411233 - RNA, 64 nt, Human
acauggugauguugacaucacuggcauggugguugggacccaguggcagggcacagggccuggc

SEQ ID NO: 411234 - RNA, 64 nt, Human
ucuugggauuuccuuuccaaagcacaaaaauacugggacccaagaagaacagcuagaggacaac

SEQ ID NO: 411235 - RNA, 64 nt, Human
cuagggccccaggcugggaggcucagaggacugaaucugggaccuguguuccccccggcaggca

SEQ ID NO: 411236 - RNA, 64 nt, Human
aucccacccccggccccagggcccaccacauaaaaucugggagcccagagcugcugaggugugg

SEQ ID NO: 411237 - RNA, 64 nt, Human
ugagcuucgagcuuuguucagacuaaaugaauguaucugggaggggucgggggcacgaguugau

SEQ ID NO: 411238 - RNA, 64 nt, Human
gaccacccugggacucuaaccaagccuuccuggagggacccaugcgccccugagccccauucca

SEQ ID NO: 411239 - RNA, 64 nt, Human
ugccagcccuugagcagcccgugugggggcccgagggacccacacagugggggccagccucgcu

SEQ ID NO: 411240 - RNA, 64 nt, Human
guggaccggcccgcgcuccgcccccagcgagccggggacccacccaccaccccccgcaccgccg

SEQ ID NO: 411241 - RNA, 64 nt, Human
aaaagaaaccccaaacucaggccgaaugaucaaggggacccauaggaaaucuuguccagagaca

SEQ ID NO: 411242 - RNA, 64 nt, Human
ggcugcuccucugucccuugagggaggaaguccugggacccagggaggggaggggccuuugucu

SEQ ID NO: 411243 - RNA, 64 nt, Human
uaugggcuuucucugaggcccagucacugcuccugggacccaguccccuggaggggagguggaa

SEQ ID NO: 411244 - RNA, 64 nt, Human
ggacuccugccgcagugaucaaaguccgaggggcgggacccaggcaccugcauuuuaaagcgcc

SEQ ID NO: 411245 - RNA, 64 nt, Human
ccucugaacuacuggggacuucggaccgcuuguggggacccaggcuccgcccuuagucccccaa

SEQ ID NO: 411246 - RNA, 64 nt, Human
auggggcgcuggacacauggccggggcugcaccagggacccaugggggcugcccagcuggacag

SEQ ID NO: 411247 - RNA, 64 nt, Human
guccuggggaaagugacugguccgugguagagccgggacccaauccccucucucuccucccugu

SEQ ID NO: 411248 - RNA, 64 nt, Human
cuucucuucugcuguuuaauuccagacugguggugggacccagguaacccccucucccaccccc

SEQ ID NO: 411249 - RNA, 64 nt, Human
ugugcuccucgguguuacuucccuuucauaugaggggacccagcgccggggggagggaggaggg

SEQ ID NO: 411250 - RNA, 64 nt, Human
ccaaggggcccgaggggcugcgugugggaggcuggggacccagacuuuuggccccagcgcuggc

SEQ ID NO: 411251 - RNA, 64 nt, Human
ggcugagaggaagaaaggccaaccugauccugaggggacccagacauauccuuugcacuguccc

SEQ ID NO: 411252 - RNA, 64 nt, Human
cuccucguucccuacccuaaaauucuaaggggaagggacccauagaggcuugccuguuuccgcu

SEQ ID NO: 411253 - RNA, 64 nt, Human
agcagcuccagguagggggccauguuucccagcggggacccaccaacagaggccaguuucaaag

SEQ ID NO: 411254 - RNA, 64 nt, Human
uucaaauguuaucaauuguuaauaagaaauugcuaucugggaugacagaauuaccucugcuuag

SEQ ID NO: 411255 - RNA, 64 nt, Human
cuuuuaaauuuuccagggccuuucuccucccaggaucugggaaagcuugggaaccaccccuggc

SEQ ID NO: 411256 - RNA, 64 nt, Human
auuacaguauaaauuccuuacagugucaguuuccaucugggaagacucuccuuucuuuaucucu

SEQ ID NO: 411257 - RNA, 64 nt, Human
ucgccgauuucggucuggcgccccuucugcggccgggacccaggccuuucacaucagcucuccc

SEQ ID NO: 411258 - RNA, 64 nt, Human
guccuuagguuuugcugugcugggacaguggcaggggacccacaggggugaggacccacggucc

SEQ ID NO: 411259 - RNA, 64 nt, Human
agcaaaccuugaugaagcaccugcuggacacugagggacccaaagcucaaucagccauaauccc

SEQ ID NO: 411260 - RNA, 64 nt, Human
uugaauaagcccuaagggugguaggaacccaggagggacccaggaaacuaagauuugagauuca

SEQ ID NO: 411261 - RNA, 64 nt, Human
aaccaccuggcaauaugacucacuugaccccuaugggacccaaaugggcacuuucuugucugag

SEQ ID NO: 411262 - RNA, 59 nt, Human
ccucaaggaauccucucugaaugcagccugggacccagguucugggccuggaacuucug

SEQ ID NO: 411263 - RNA, 64 nt, Human
aauauuuguauacacauaaugagaccuuggggaugggacccaagucugaacguggaauucaccu

SEQ ID NO: 411264 - RNA, 64 nt, Human
gcugagguaccuggaucuuggguucuucacugcagggacccagacaaguggaucugcuugccag

SEQ ID NO: 411265 - RNA, 64 nt, Human
ucccagacuugcugaaucggaaucucuggggguugggacccagcaagggcacuuaacaaacccu

SEQ ID NO: 411266 - RNA, 64 nt, Human
uacuguuaagauguagacuuggaacaaagcuguugggacccagagcaaugaauuuuugaacuga

SEQ ID NO: 411267 - RNA, 64 nt, Human
caugugugcagcaugacucucccugucuguggcagggacccaagcgcuugcuuaagccccagug

SEQ ID NO: 411268 - RNA, 64 nt, Human
ggggguggggauggcaaguccaugguguguguuagggacccagggcauugggggaagggaggcg

SEQ ID NO: 411269 - RNA, 64 nt, Human
uucuccugagucccugagggcagacacagcuccagggacccaggccagcugccacacccccgac

SEQ ID NO: 411270 - RNA, 64 nt, Human
ugaaccccucccauucaacuccccaccuccagccgggacccaggcguccgggcucccagcccgc

SEQ ID NO: 411271 - RNA, 64 nt, Human
ccuuuccuaacagacuuguccaagugcuuggcgugggacccaugaccaaagcccaggauggcuu

SEQ ID NO: 411272 - RNA, 64 nt, Human
cuacacaaugcacugauguuuucauaauguuuaagggacccacugcaagaagcuugcugccucc

SEQ ID NO: 411273 - RNA, 64 nt, Human
gcuauagaaauaacuugaaaaaaaaaauuaaaaccguggccagccaccaaauuguggacacugu

SEQ ID NO: 411274 - RNA, 64 nt, Human
ccuggccaccuccccugcuucucccugggcugugcguggccaccucuaagaccacacugacuuc

SEQ ID NO: 411275 - RNA, 64 nt, Human
cugggaauauggaacuaauuucuucuaaugucagcguggccacaacuuauagacaguaucccuu

SEQ ID NO: 411276 - RNA, 64 nt, Human
ugauaauauauuuuuuucuuucaauuuucuuaaugggacccagucccuuauuuggggggagguc

SEQ ID NO: 411277 - RNA, 64 nt, Human
aaaacaccaaacacacuauggaacucugcugauggggacccaagcgcccacgugcucagccacc

SEQ ID NO: 411278 - RNA, 64 nt, Human
uguggcagccacacgcaggcggccagggcggccagggacccaaagcaggaugaccacgcaccuc

SEQ ID NO: 411279 - RNA, 64 nt, Human
cacccuuccuguuguucccacgugggcaauaccagggacccauggggaaacucaagaaugacag

SEQ ID NO: 411280 - RNA, 64 nt, Human
acaagugucuucacuaagcguauggccaauaaaugggacccaaacguucaaucuguucaguuua

SEQ ID NO: 411281 - RNA, 64 nt, Human
acaucuucacuggacucugacggacucugugucugggacccagcugauaacacgugguaauaug

SEQ ID NO: 411282 - RNA, 64 nt, Human
gccuuugcugucacugggagagaagagccguccagggacccaugguggcccacauguggaugcc

SEQ ID NO: 411283 - RNA, 64 nt, Human
ucuauaccaaccaaaccaauucaccaacacaguugggacccaaaacacaggaagucagucacgu

SEQ ID NO: 411284 - RNA, 64 nt, Human
uggacacagaagcacgccuaggcugggcagggaugggacccaugcccccuccuuagaggacggg

SEQ ID NO: 411285 - RNA, 64 nt, Human
aagaggauggaucaacaagggucacggggaauaggggacccacggggugugaccugcuugcuag

SEQ ID NO: 411286 - RNA, 57 nt, Human
ccauucugucccugguguagagccugggggacccaucuuccaccucaccucuuuguu

SEQ ID NO: 411287 - RNA, 64 nt, Human
agaaaaugaugcaagaaaaucaaaugggaaucuggggacccaacacaacauccugaagauuauu

SEQ ID NO: 411288 - RNA, 64 nt, Human
cugcauauuucuuuuaccauugaccauuauuauagggacccaugaaguaaaugucacaaucauc

SEQ ID NO: 411289 - RNA, 64 nt, Human
auauuugcauagcauaaugagauaucuugggaaugggacccaaaucuaaacacaaaauucauuu

SEQ ID NO: 411290 - RNA, 64 nt, Human
gucacacagaccauuucauuuuuaccagggcuuggggacccaaugcaaagaugaugacuauuua

SEQ ID NO: 411291 - RNA, 64 nt, Human
uuaauaguucccauaaucccuacguguugugggagggacccagugggcaguaauuuaaucaugg

SEQ ID NO: 411292 - RNA, 64 nt, Human
uuacauagcauccauacuuagaauuuggcauaucaucugggauuuugccaauauacgucaaagc

SEQ ID NO: 411293 - RNA, 64 nt, Human
ugcucccacucaauacaaaaaggccccucucuacaucugggaaugcaccucuucuuugauuccc

SEQ ID NO: 411294 - RNA, 64 nt, Human
ugcaauggagggcaaaugcgucccugaggagaaaaucugggaggagcugagugugaugaaggug

SEQ ID NO: 411295 - RNA, 64 nt, Human
caucugugggcuggccggcaagauggcaccaguggggacccacacccuggcugggcagaggugc

SEQ ID NO: 411296 - RNA, 64 nt, Human
ccagcuccuggaagagauguccuaauaucucuuagggacccagaccccuaaauucuccuccucc

SEQ ID NO: 411297 - RNA, 64 nt, Human
gucuccuguugaauggcccuuguugcccuagagugggacccagcccucaccucccccagagcua

SEQ ID NO: 411298 - RNA, 64 nt, Human
guaguuggguagagaagccagcagggggcagcgugggacccauaucccagccccaggcggacca

SEQ ID NO: 411299 - RNA, 64 nt, Human
agcuggagagacccaagacccuaucuguucaccagggacccaaaauccaaggggaugcuucccu

SEQ ID NO: 411300 - RNA, 64 nt, Human
acugagccuagccuucagcaaccaagguucuccugggacccaaaguuuaugggagaagggcaaa

SEQ ID NO: 411301 - RNA, 64 nt, Human
acugaucaagaagacaaaccuggccuugguuguggggacccauuccuggagggaccaguucaug

SEQ ID NO: 411302 - RNA, 64 nt, Human
uuugcucuuuugaacacccuccccacugauccuugggacccaacgccgcauugccucuugcaga

SEQ ID NO: 411303 - RNA, 64 nt, Human
uagucuccugagccuguagagcccccaggagacugggacccaaagaacuucacagcacacuuac

SEQ ID NO: 411304 - RNA, 60 nt, Human
ccaaggccuccucccaguagccacggagccgggacccagaggggcagcgcagggcgcaga

SEQ ID NO: 411305 - RNA, 64 nt, Human
ccggcaaggaguaggggcggcugccagcugggccgggacccagggcccucggugggagccaugc

SEQ ID NO: 411306 - RNA, 64 nt, Human
uaagauggacugcacagggucccggcacucccucgggacccauucaggaucucagcugggcagg

SEQ ID NO: 411307 - RNA, 64 nt, Human
accuuucaaguuuaucucaauaaccaggucaucagggacccauuguucucuucagaacccuauc

SEQ ID NO: 411308 - RNA, 64 nt, Human
cagacuuaaaauguaucaccacuaaccugugagggggacccaaucuggacuccuuccccgccuu

SEQ ID NO: 411309 - RNA, 64 nt, Human
gaugcuguuaaaagaggaggaaacuacuugaggagggacccaacuuuccgcuaucuuuuggguu

SEQ ID NO: 411310 - RNA, 64 nt, Human
gcaggaucagagugacucugggaggacagggguggggacccagaguuagcaguggggauggagc

SEQ ID NO: 411311 - RNA, 64 nt, Human
cccaggcuuuugaaaaacaaacagaaacccguguaucugggauauuuccauauggcaauaggug

SEQ ID NO: 411312 - RNA, 64 nt, Human
ccucacuccccucagccccugccgaccuuagcuuaucugggagagaaacaaggccuggugccug

SEQ ID NO: 411313 - RNA, 64 nt, Human
auuccagcuucggaagccccuggucuaacuugggaucugggaauggaaggugcucccaucggag

SEQ ID NO: 411314 - RNA, 64 nt, Human
gcugcccagaacccugcugaugagccugcuccaugggacccagccccccaggagauuggggcug

SEQ ID NO: 411315 - RNA, 64 nt, Human
guggggggucuacagagucagggacagaagggaagggacccacaggaagucacaguggugccca

SEQ ID NO: 411316 - RNA, 64 nt, Human
gacccuucccacagccccgcugugguccagccccgggacccauggccucucuccaggcccuccg

SEQ ID NO: 411317 - RNA, 64 nt, Human
cgcggcggcccuucucagccccucccuccauggagggacccauagggcuagacacuuugaggca

SEQ ID NO: 411318 - RNA, 64 nt, Human
gcucaugcccaacacauuucugcuaauagggagagggacccaccacacacccacacaugccaga

SEQ ID NO: 411319 - RNA, 64 nt, Human
cacgacauggccagcacgcagaaggagcccucccgggacccaggaccccccgugguggacuccg

SEQ ID NO: 411320 - RNA, 64 nt, Human
gagaaggcugagugcagcaagguggggggugacugggacccagccuuugggccuccccagccag

SEQ ID NO: 411321 - RNA, 64 nt, Human
ucgggacugccuggugcaggugguggcagcuggagggacccaugcagcacccaggucagagcag

SEQ ID NO: 411322 - RNA, 64 nt, Human
uccguggaggccuccgugugcccucguugccguggggacccagcuccaugcacgucaacccagu

SEQ ID NO: 411323 - RNA, 64 nt, Human
cccccuacagucacugccacacugguggggaccugggacccagacccggaaccagcccagauau

SEQ ID NO: 411324 - RNA, 64 nt, Human
uuaaacaccaauuacguagcaggccauggcucaugggacccaccccccguggcacucauggagg

SEQ ID NO: 411325 - RNA, 64 nt, Human
ggagggaagaggcagcccggcgaggggcaagcgggggacccagccgggcugggccccugggccc

SEQ ID NO: 411326 - RNA, 64 nt, Human
cccugcuccacacacugcugcaucuugggucucagggacccagacagauggacuuacauggagc

SEQ ID NO: 411327 - RNA, 64 nt, Human
gucccugccuagacuguugacguccccugggaaggggacccaaggaugaauuggcugugaagga

SEQ ID NO: 411328 - RNA, 54 nt, Human
acccaccgcccuccuccuagcucagggacccagccccuccucucugagaaacuc

SEQ ID NO: 411329 - RNA, 64 nt, Human
gcuguauuaggcggccgaggucacucugggccuggggacccaaacccccugcagcccaggccag

SEQ ID NO: 411330 - RNA, 64 nt, Human
auuccuugcuauuggagcuguuuuuccaagcaauaucugggaagagauuucucccucuagcacu

SEQ ID NO: 411331 - RNA, 64 nt, Human
acugaaugauaaccaugagguggaagacgagaucaucugggaggaauucaccccagaggaaggg

SEQ ID NO: 411332 - RNA, 64 nt, Human
auggaguuggggggggacacuagguccuccgggguucacccaccuggagcuggaauuaucacuu

SEQ ID NO: 411333 - RNA, 64 nt, Human
accucugacugacagggacaugcccuguguggcugggacccagacugucugaccuggggguugc

SEQ ID NO: 411334 - RNA, 64 nt, Human
caacucugcagccuucaggucuggggccaggagugggacccaccauuuguggggaaaguagcau

SEQ ID NO: 411335 - RNA, 64 nt, Human
aauggccauuacuauccagucuguauugcuacaagggacccacugguaccccuuuuagauucua

SEQ ID NO: 411336 - RNA, 64 nt, Human
aggagcuggcaccccagguguucugagaccuugagggacccagaccuuuggguccaagaguuuc

SEQ ID NO: 411337 - RNA, 64 nt, Human
ucuuaggaaagcugcaggaaccucgugggcuccagggacccaggcccacauccauccagcguuc

SEQ ID NO: 411338 - RNA, 64 nt, Human
gcaaggcaguccccccacgcccgagaaagccugggggacccagacaccuguccccacagucaaa

SEQ ID NO: 411339 - RNA, 64 nt, Human
ggacccagacaccuguccccacagucaaagccuggggacccagacauccuguccccacagucag

SEQ ID NO: 411340 - RNA, 64 nt, Human
ggagcagaggcacagacaacccuucccaucuggcgggacccagaggugcugagaugggggucug

SEQ ID NO: 411341 - RNA, 64 nt, Human
accucugacccucccccugccuuccucuugccuugggacccagucccucucucuuucccucccc

SEQ ID NO: 411342 - RNA, 64 nt, Human
gcaaucuucaugaugccuaggagguuccugacaugggacccaucugcuccuccagccaacuccu

SEQ ID NO: 411343 - RNA, 64 nt, Human
ccggcccaucuaucgggcaccggggcuccggcccgggacccaggaccagcaacccgcgaccaau

SEQ ID NO: 411344 - RNA, 64 nt, Human
cuuccccacaggugaccgagauccucgauuacuggggacccaauuccggcccauugacguggcg

SEQ ID NO: 411345 - RNA, 64 nt, Human
ucugguacgaaucucaucccucaacugagggccagggacccaggugugccugugcuccugccca

SEQ ID NO: 411346 - RNA, 56 nt, Human
gguaugaccagcugaacuagcacccagggacccaguguacccagccucuggccucg

SEQ ID NO: 411347 - RNA, 61 nt, Human
ccaacccuuuccuucucuagugccugggccugggacccacccagagcaccugugcuggagg

SEQ ID NO: 411348 - RNA, 64 nt, Human
uuugaggccccaacaugacagccacugggccaccgggacccaagaagacagcccccugccccau

SEQ ID NO: 411349 - RNA, 64 nt, Human
auuaucuacaugauguuuauaguuccugugguuuuucacccaagaagcagaaucucauucagua

SEQ ID NO: 411350 - RNA, 64 nt, Human
ggcucccagcaucaucuuccuacacauuauuacauucacccaucuuucuguuugucauucuuau

SEQ ID NO: 411351 - RNA, 64 nt, Human
gccugggcaaugggaaggagccagaaaugccaucuucacccagaaacaaagaauacugaagcca

SEQ ID NO: 411352 - RNA, 64 nt, Human
acuccagcugccaccacccucugggucggacacugggacccacuggcccagucuuggcugcugc

SEQ ID NO: 411353 - RNA, 64 nt, Human
ccccccaucaaguuuggugggcagagcuacagaugggacccaagggaguggccgagccucacug

SEQ ID NO: 411354 - RNA, 64 nt, Human
gcuagggcuaggugucaagagagggugugggauugggacccaggcccuucuuucuaaacucaac

SEQ ID NO: 411355 - RNA, 64 nt, Human
ccccuacugauugcugccuucucuguggcuacaagggacccacagaauuacagggaaguuacag

SEQ ID NO: 411356 - RNA, 64 nt, Human
guccugcaguacagucuuccccugaaugccaccggggacccagggggacuccaccccccuaagc

SEQ ID NO: 411357 - RNA, 64 nt, Human
agcggagaucuguucaccugggggccauggaggggggacccacuaaagaucaagaucaaagauu

SEQ ID NO: 411358 - RNA, 64 nt, Human
cacggcccggccccucacccucuguccccacgaggggacccaugggggcugucuuugcagggca

SEQ ID NO: 411359 - RNA, 64 nt, Human
caaauggaucuuuuuaacagugugccuuuggggagggacccauguccauggcuucguugagggc

SEQ ID NO: 411360 - RNA, 64 nt, Human
cuucccaguuaccaaagacucgaacuuccagacagggacccagggacaccccgaagcccaccug

SEQ ID NO: 411361 - RNA, 64 nt, Human
aaaccaccgaugccgagaggcuaguggugccccagggacccaagacuaguuccgucacuagagu

SEQ ID NO: 411362 - RNA, 63 nt, Human
uagaccccuguggccccugagccugggcagguggggacccaacuccaccccaccugucuucau

SEQ ID NO: 411363 - RNA, 64 nt, Human
gccgcauuccaagaaguagucugucgcgggcgcagggacccaacccggugucgcugcacccgcc

SEQ ID NO: 411364 - RNA, 64 nt, Human
uggaccauggagucccuggugcugccccucaggugggacccaggcguucucagcuguacccucu

SEQ ID NO: 411365 - RNA, 64 nt, Human
gcugcagccugggaaggcuggagaggcagacggugggacccaccagcucucuccccaucccgcu

SEQ ID NO: 411366 - RNA, 64 nt, Human
agccaccucucuugcccaaggugagccagcccuggggacccagcucagggaggcucugcucaga

SEQ ID NO: 411367 - RNA, 64 nt, Human
agucaguugugcccagccuaccuucucucacagggggacccaauucucugaagucuacgaugga

SEQ ID NO: 411368 - RNA, 64 nt, Human
uauuuuuguugucguuuuagggcuuaaggguuaauucacccagaguauauuaauauaauaaaaa

SEQ ID NO: 411369 - RNA, 63 nt, Human
uccccaacaaccuagaugugaaaacagaauaaacuucacccagaaaacacuuuguccugcugu

SEQ ID NO: 411370 - RNA, 64 nt, Human
agaggcuuggaagggaacagggcagaugaggcccuucacccaccaucuacgccauauacccauc

SEQ ID NO: 411371 - RNA, 64 nt, Human
uuuguguccucggcccuccacccuugguggggaggggacccaggaccauaggaagguccugagu

SEQ ID NO: 411372 - RNA, 64 nt, Human
aacucccuuucccccucccuugccccuuccuccagggacccaagcgcuuccagaugacaauugc

SEQ ID NO: 411373 - RNA, 64 nt, Human
caccaggccaugguuccuugccccaugguguccugggacccagagcaacaggaucugucaccca

SEQ ID NO: 411374 - RNA, 64 nt, Human
gcagcaacuuggagggaguucucuggggauggacgggacccagccuucugggggugcuaugagg

SEQ ID NO: 411375 - RNA, 64 nt, Human
agauucgccuuaaaugcucccugucccauggagagggacccagcauaggaaagccacauacuca

SEQ ID NO: 411376 - RNA, 64 nt, Human
uggcaugcugcuaugucucaaaagaggucauccggggacccacuguugcccuggaccucagcgg

SEQ ID NO: 411377 - RNA, 64 nt, Human
uagagcaaauguguuaggagagaagguuucacaugggacccaacauccuucaucaauacuuucc

SEQ ID NO: 411378 - RNA, 64 nt, Human
gcuucccugaaagacugaagaaaguguagugcaugggacccacgaaacugcccuggcuccagug

SEQ ID NO: 411379 - RNA, 64 nt, Human
guuuccaaauaauuugaacagcuugcugcuaaaugggacccaauuuuuggccuauagacacuua

SEQ ID NO: 411380 - RNA, 64 nt, Human
uuccugcagccacacacccacccgggguguccuggggacccaaggggugggggggucacaccag

SEQ ID NO: 411381 - RNA, 64 nt, Human
gcccuagaacuccagaaacagcacagcuggggcggggacccagccuugcccuccacccgaggcu

SEQ ID NO: 411382 - RNA, 64 nt, Human
aggcugucuuuccacgccccugaguucagagucggggacccaggccaggucgggagcacagccg

SEQ ID NO: 411383 - RNA, 64 nt, Human
accacuggccucugggcacuugugcugagacucugggacccaggcagcugccaccuugucacca

SEQ ID NO: 411384 - RNA, 64 nt, Human
uuggcugugccugcagcucagggugcuggggcucgggacccaccccccugcuugcggaaccaac

SEQ ID NO: 411385 - RNA, 64 nt, Human
guccaggacugggaaggaccgggugagugcaccggggacccaggccaggugccccccggagccu

SEQ ID NO: 411386 - RNA, 64 nt, Human
gccacccaaggagccccauccgcccacccacccugggacccacgcggccacuccagggaucauu

SEQ ID NO: 411387 - RNA, 61 nt, Human
caguggaaugaugggccuaagauugcagcugcguggccaggugcucacgccguaaugccaa

SEQ ID NO: 411388 - RNA, 64 nt, Human
aaccaggacccuggggggccugcugccugggggccguggccagagacccucgcugugcugcugc

SEQ ID NO: 411389 - RNA, 62 nt, Human
augacaucaccucccucugagccccacgccagcguggccaccucagcucucuucucuccucu

SEQ ID NO: 411390 - RNA, 64 nt, Human
ccuuuggugggaucauguguuugggggcuuuuaggggacccagcugcacuggggcacugcccgu

SEQ ID NO: 411391 - RNA, 64 nt, Human
ugcagcagcuggggccucuggucaggaacccucagggacccaggaacucagcuuccaaacaucu

SEQ ID NO: 411392 - RNA, 64 nt, Human
agagggcauagguuacacccuacagaauaaagaagggacccaaagccucuuuuugccucccgga

SEQ ID NO: 411393 - RNA, 64 nt, Human
ugaugggcuggagcaguuuggggcaggggguucugggacccacuccgacucccccuccccggca

SEQ ID NO: 411394 - RNA, 64 nt, Human
agcgcgggagccugaggaccggguggaggcgguggggacccagccgcgcgccgggagcgcuccc

SEQ ID NO: 411395 - RNA, 64 nt, Human
gccagcagagggcgccaccaccaccugacggcuggggacccacccagccccucuccccucucug

SEQ ID NO: 411396 - RNA, 64 nt, Human
accuccacccccaccggccugacgcuguggccccgggacccagcagagcugggggagggaucag

SEQ ID NO: 411397 - RNA, 64 nt, Human
aggagcugaggaagcgggguucucccugaccacagggacccagaagacccgcuucuccuuuccg

SEQ ID NO: 411398 - RNA, 64 nt, Human
uguggcuggugggggacccuuggggcugggcccugggacccagugugccccacagcccugucag

SEQ ID NO: 411399 - RNA, 64 nt, Human
uucgccuggagcccuccgccuucacauuccccuggggacccacguggcugcgugccccugcugc

SEQ ID NO: 411400 - RNA, 64 nt, Human
ccugcccuuccuccauuguugcccuggaauguacgggacccaggggcagcagcaguccaggugc

SEQ ID NO: 411401 - RNA, 64 nt, Human
aaugaggaaguaagucagggcgggcuuugagaaggggacccauauccuacaggcaaaaagcagg

SEQ ID NO: 411402 - RNA, 57 nt, Human
ccacucuggccauccacuaauccaggggggacccagaccccacaagccauggagacu

SEQ ID NO: 411403 - RNA, 64 nt, Human
uccuggacacccuguccuucacuccuuugccccagggacccaggcucaugcucugaacucuggc

SEQ ID NO: 411404 - RNA, 64 nt, Human
uccaggcagcguggccuguggcaccgugaggguugggacccaccgaggcgcagaggcggcccga

SEQ ID NO: 411405 - RNA, 64 nt, Human
guggagugcccuugucugguagcaccaugugggagggacccagcugggcgcagcgcccuguggc

SEQ ID NO: 411406 - RNA, 64 nt, Human
ggugugaugaagucaccccuuucugucccacuacaucugggacugacuuuccgagccuccaguc

SEQ ID NO: 411407 - RNA, 64 nt, Human
ugggggacacaccuacucugcuccccucucacacaucugggaguagccccacugccaccugcag

SEQ ID NO: 411408 - RNA, 64 nt, Human
caagcugcauugggaggagaaggcagggugagggaucugggagagcaggacguugagauauccu

SEQ ID NO: 411409 - RNA, 64 nt, Human
uggacugguggauguaacuacuccaccugcccuugggacccaucccaguuuucaucauugagcc

SEQ ID NO: 411410 - RNA, 64 nt, Human
ccacuguggaucugugacccugggcgcugaaaaugggacccaggaaucccccccgucaauaucu

SEQ ID NO: 411411 - RNA, 64 nt, Human
ucuuucuuggccgugagccuaaccaugaucuugagggacccaacauuuguaggggcacuaaucc

SEQ ID NO: 411412 - RNA, 64 nt, Human
augaagggacucaggacaggcucugugacuuacagggacccaaucaauucacaaugagaaauua

SEQ ID NO: 411413 - RNA, 64 nt, Human
ccuugggagucgcccugucagcacgcacaugcuugggacccacuccacacacucccugccagcu

SEQ ID NO: 411414 - RNA, 64 nt, Human
gagggcugggcgccauggggucagggaggccccagggacccaugggcagagcuggggagccagg

SEQ ID NO: 411415 - RNA, 64 nt, Human
cggcugugggaccgcccugggccagccuccggcggggacccagggagugguuuggggucgccgg

SEQ ID NO: 411416 - RNA, 64 nt, Human
uggcccggcugccacaccucuguuuccuaggcuggggacccagcuugucucuccuuguuucuuc

SEQ ID NO: 411417 - RNA, 64 nt, Human
agcucccaaaguggguggugggcccccuucacgugggacccacuucccaugcuggaugggcaga

SEQ ID NO: 411418 - RNA, 64 nt, Human
cccagcaguccuucccucagcugccuaggaggaagggacccagcugggucugggccacaaggga

SEQ ID NO: 411419 - RNA, 57 nt, Human
ccccccuggccauccacuagcccacgggggacccagaucucauacucaacagaagga

SEQ ID NO: 411420 - RNA, 64 nt, Human
ggccuuuacccacuguuauuuuaucauucauaaugggacccacacuguaggaagaaguccuucg

SEQ ID NO: 411421 - RNA, 64 nt, Human
ggcaucccaaagcuucgauggagagcagggaagggggacccaaggcaggagguacaccagcugg

SEQ ID NO: 411422 - RNA, 64 nt, Human
ccaguucccggagggcuggggcggugcaggcucugggacccaggggccaggguggcucuucucu

SEQ ID NO: 411423 - RNA, 64 nt, Human
cauuuugggugauuuuaaacuaggucgauuccucgggacccacagucucaccacgucuccucca

SEQ ID NO: 411424 - RNA, 64 nt, Human
ccagagcugucuggugaucacuuuaugucucacagggacccacauccaaacauguaucucuaau

SEQ ID NO: 411425 - RNA, 64 nt, Human
cacaccauaagcuacugccauccuggcccagggcaucugggaggaaccgagggggcugcuccca

SEQ ID NO: 411426 - RNA, 64 nt, Human
acuggcuacugcaucuuaugauacucgaguauauaucugggauccacauaauggagacauucug

SEQ ID NO: 411427 - RNA, 64 nt, Human
gaagugaggagccccuccgcccggcagccaccccaucugggaagugaggagcgucuacgcccgg

SEQ ID NO: 411428 - RNA, 64 nt, Human
cccguccccaucuggcagcuccugucucgccugagggacccagccgccuucuccgugcucuggg

SEQ ID NO: 411429 - RNA, 64 nt, Human
ucgaguccagggucacaagucucugguaccaaaagggacccauggcugacugacagcaaggccu

SEQ ID NO: 411430 - RNA, 64 nt, Human
caggccaagauacagccagccaggccugucgucugggacccaggaggccucugaugaccaaggg

SEQ ID NO: 411431 - RNA, 64 nt, Human
gagccucuccccagguguauuucagcagaccccggggacccacccccacugggccugcuggccu

SEQ ID NO: 411432 - RNA, 64 nt, Human
agguggaugguucuacccuuucugccuucuguuugggacccagcugguguucuuugguuugcuu

SEQ ID NO: 411433 - RNA, 64 nt, Human
ugaauuguucccguaauccccacgugacaugggagggacccagugggagguaauuuaauccucg

SEQ ID NO: 411434 - RNA, 64 nt, Human
gagcacaggaagccacccugccugcuggggaggagggacccacacaagcccccucggcaguuug

SEQ ID NO: 411435 - RNA, 64 nt, Human
ggugaccagaggagagcaugagggguggggcuuugggacccaccggggccaguggcuggagcuu

SEQ ID NO: 411436 - RNA, 64 nt, Human
ggauccugaccccugcagggcucaggggucagcagggacccacugccccaucucccucucccca

SEQ ID NO: 411437 - RNA, 64 nt, Human
ccugagucugcuggggagugggcauucucugccagggacccaugagcaggcugcauggucuaga

SEQ ID NO: 411438 - RNA, 64 nt, Human
cucagccccagccuuucugaagaagggaaaacuagggacccagaugguuuaaggacaccccaga

SEQ ID NO: 411439 - RNA, 64 nt, Human
uccacccuggccgaguccaagcugggagauucaagggacccaugaguuggggucuggcagccuc

SEQ ID NO: 411440 - RNA, 64 nt, Human
aggggcuccucuucccaccuggaacuugugaguggggacccaugauguaugggucucaccugac

SEQ ID NO: 411441 - RNA, 64 nt, Human
gagacccuccagcuaaaaacagagccugaguucagggacccaaguggugagcggcgucuuuugg

SEQ ID NO: 411442 - RNA, 58 nt, Human
acaacuccaccuucgccuaagagccgcagggacccacgcugucugcgcuggcuccacc

SEQ ID NO: 411443 - RNA, 64 nt, Human
ucaggucauguuugaaaccaugcuuggcuggaccgggacccauggcaagagcaccugggcacca

SEQ ID NO: 411444 - RNA, 64 nt, Human
gaagugaggagccccucugccuggccaccaccccaucugggaggugugcccagcagcucauuga

SEQ ID NO: 411445 - RNA, 64 nt, Human
gcugccuaagaggcaaugaguguguuggcuugugaucugggaacucccaagaacagcaggccca

SEQ ID NO: 411446 - RNA, 64 nt, Human
acacuggacaggugacuguaugguagagacugugaucugggaacuuuuugcuguacaaaucugu

SEQ ID NO: 411447 - RNA, 64 nt, Human
acacacagcgguggggaggcggggaggagcagcugggacccagaacugagccugggagggaucc

SEQ ID NO: 411448 - RNA, 64 nt, Human
agagagggugagagauggagggcgagauuuggaugggacccagggcuccugacucugcccugga

SEQ ID NO: 411449 - RNA, 64 nt, Human
ccuaacccacaugggccuggcuguggggaaaguggggacccaggucccugagcugucugcuggg

SEQ ID NO: 411450 - RNA, 64 nt, Human
cguggccccucagaugcugggacacaacagacccgggacccagcugugcuacccaccccuucca

SEQ ID NO: 411451 - RNA, 64 nt, Human
guccucugcuccuccuagcuccccagggauguuggggacccagcuugucucggcagcuaagaag

SEQ ID NO: 411452 - RNA, 64 nt, Human
ccacuccaggaugggacacggccccucuuucuuggggacccaguauguccucuccucuagaccc

SEQ ID NO: 411453 - RNA, 64 nt, Human
aggcagcacaggcgccccaccaccacccaguuuggggacccagugggaccaggugcgggggcag

SEQ ID NO: 411454 - RNA, 64 nt, Human
gucgcucucccacccagccuggacuuggccccaugggacccauccucagugcucccuccagauc

SEQ ID NO: 411455 - RNA, 64 nt, Human
gggcagguugcuaagucaggugcagagguucugagggacccaggcucuuccucuggguaaaggu

SEQ ID NO: 411456 - RNA, 64 nt, Human
cuucuagcgucagugcuggagggagaagcugucagggacccagggcgccuggagaaagaggccc

SEQ ID NO: 411457 - RNA, 64 nt, Human
cuccacgagucacugcucuccccauuggcagcacgggacccaugcugugcccccggccaggccc

SEQ ID NO: 411458 - RNA, 64 nt, Human
caugagcaugggcaggggcuuucuccuuggaugugggacccacagcagcuuccugaggcugggg

SEQ ID NO: 411459 - RNA, 64 nt, Human
uuccccuguuugccucugaaacgucugguuaguggggacccaaagauucuagugagucaacauc

SEQ ID NO: 411460 - RNA, 51 nt, Human
aagaucucugcucugcuuaaugggacccaaggucucagagcacaggcauau

SEQ ID NO: 411461 - RNA, 64 nt, Human
ggggaguuagauuucagaguccaggcccuagguugggacccacuccaaauaaucuccucggugu

SEQ ID NO: 411462 - RNA, 64 nt, Human
aaucacacagcucagaagcagcagaacugacauugggacccagguccauuggaggcaucuuuua

SEQ ID NO: 411463 - RNA, 64 nt, Human
ccacaguggagcugagcgccacucccuguagccgaucugggacugaaacgcuuacaccucugcc

SEQ ID NO: 411464 - RNA, 64 nt, Human
ucugagcagugugauggagagucucugccgugccaucugggaugcaaaccgucccuguguuccc

SEQ ID NO: 411465 - RNA, 52 nt, Human
agaaggucagagcccagugaagaucugggagacccugaacucagaaggcugu

SEQ ID NO: 411466 - RNA, 64 nt, Human
ucuuccuggcacaauguuggagcagcaggccucugggacccacagaacuuguggccuuuauguu

SEQ ID NO: 411467 - RNA, 64 nt, Human
aaacccccacugagaugccucucaugccucagcugggacccaccguguagacacacgacaugca

SEQ ID NO: 411468 - RNA, 64 nt, Human
ugggccucucggggcuggggccucccaggggauggggacccagagugcaguggccgcccacauc

SEQ ID NO: 411469 - RNA, 64 nt, Human
cccguuccgugggaugccauaaaagccgcccagugggacccacagucacacagagcgccucacc

SEQ ID NO: 411470 - RNA, 64 nt, Human
cagaugccucugcgcaccaaggaauggagaggaggggacccauguaauccuuuuguuuaguuuu

SEQ ID NO: 411471 - RNA, 64 nt, Human
ccacccugagcacugcccggaucccgugcacccugggacccagaagugcccccgccaucccgcc

SEQ ID NO: 411472 - RNA, 64 nt, Human
cuggagaauaccaccccacccccagcccauaauugggacccagagcccuuucccagcacuuaaa

SEQ ID NO: 411473 - RNA, 64 nt, Human
cugggcggaaggaggugugcguggcuucuggggugggacccagaggggaggcucugggacaggg

SEQ ID NO: 411474 - RNA, 64 nt, Human
uccucccagucaggggucguccagugcaggacgggggacccaagggucucaagccugcaagucc

SEQ ID NO: 411475 - RNA, 64 nt, Human
cacgucgcucuuccugcggguucuuggcgagacacagcuugagaacagaagggcgucgggggaa

SEQ ID NO: 411476 - RNA, 64 nt, Human
caccaaaccaaaauagaauguuagcuguucaagaaucugggaccagccaaccuguauguaugca

SEQ ID NO: 411477 - RNA, 64 nt, Human
gccuuggagucuguucuagggaaggccucccagcaucugggacucgagagugggcagccccucu

SEQ ID NO: 411478 - RNA, 64 nt, Human
uuuguugugucccucaggggcuuaaugacucaaaaucugggauccuuccccucucagacacccc

SEQ ID NO: 411479 - RNA, 64 nt, Human
aaaauaaaaauuacuaagccaaagagaaaagucaaucugggaacugcgucagacaaaccugccu

SEQ ID NO: 411480 - RNA, 64 nt, Human
uuggaaaaaaauaaauaaauaaauaaauaaaaggcagcuugaguuuccaaacgugugauucacu

SEQ ID NO: 411481 - RNA, 64 nt, Human
ugcaccugcugcuggcggugagcaggggguucagcagcuugaccgaugccccccgagggggcuc

SEQ ID NO: 411482 - RNA, 64 nt, Human
caaaaaucaauuuguacagucuuaauauuaaaagcagcuugacuaaauaccugauuuaaaaaua

SEQ ID NO: 411483 - RNA, 64 nt, Human
guuucuuccugauuuuuagcagguuuagaggcugcagcuugagcuacaaucaggagggaaauug

SEQ ID NO: 411484 - RNA, 64 nt, Human
ccaugauggcugaauccgaaauccucgauggguccagcuugaugucuuugcagcugcaccuaug

SEQ ID NO: 411485 - RNA, 64 nt, Human
gucuuccgcagucuguccugggcuugggugagcccagcuugaccuccccuugguucccaggguc

SEQ ID NO: 411486 - RNA, 64 nt, Human
augacaugguccccaggcuggccugaggaugucacagcuugaggcuguggugugaaagguggcc

SEQ ID NO: 411487 - RNA, 64 nt, Human
guugcuaaacuuuauauaaugugugguuucaauucagcuugaaaaauaaucucacuacauguag

SEQ ID NO: 411488 - RNA, 64 nt, Human
ggacaguagugaacagagcugggauuccaugcgacagcuugaaugcugaccuucagacaugaga

SEQ ID NO: 411489 - RNA, 64 nt, Human
accugaggaggaacucagucaagcuguugcuuaacagcuugauccagggcgugaaagguuaguu

SEQ ID NO: 411490 - RNA, 64 nt, Human
ccagccuccgagagggagagagagagagagaggacagcuugagccgggccccugggcuuggccu

SEQ ID NO: 411491 - RNA, 64 nt, Human
auggagacugaaucugagggcagcagacuuuuaucagcuugaguuuaugucauuugauggacuu

SEQ ID NO: 411492 - RNA, 64 nt, Human
guauucuggggagcuuugaccuuggagcuuuguacagcuugagaaaacauuagaacaaauuuua

SEQ ID NO: 411493 - RNA, 64 nt, Human
cauguaccagagaaggaaaagucugaucccgaaacagcuugaacgaaaggugguuaacacguga

SEQ ID NO: 411494 - RNA, 64 nt, Human
aaauauuuaucugucaguuuugacagauuggggccagcuugauguuuuaaaucuucagcccggu

SEQ ID NO: 411495 - RNA, 64 nt, Human
cagauuacugucucuugaacaguugcaaucuuggcagcuugaaaauggugcuacacucuguuuu

SEQ ID NO: 411496 - RNA, 64 nt, Human
uuaagcagaggaauuggugugccuuaaagauacaaucugggauaguuugggggaacuuguagcc

SEQ ID NO: 411497 - RNA, 64 nt, Human
ggccucagccugcagggugugggcagagaagggcaucugggacguggugccagugaggagccca

SEQ ID NO: 411498 - RNA, 55 nt, Human
aaacuguuuguguuugcugaaaugcaucugggaaaugagguuuuuccaaacuuag

SEQ ID NO: 411499 - RNA, 64 nt, Human
cuugugccuuucauguaaguuaaauuugcucauacagcuugaacguuguauuugcaaaauuaag

SEQ ID NO: 411500 - RNA, 64 nt, Human
cagugcugcucucccaucucccaucuuccucucgcagcuugaugagccccggugugucccaggu

SEQ ID NO: 411501 - RNA, 64 nt, Human
uugccauuucuuccacaagagcccaggccuccuacagcuugaccgugaggccagagacacaagc

SEQ ID NO: 411502 - RNA, 64 nt, Human
ggcccgggcccugcccagcuacaguuccaccccucagcuugaggaccaaugacugaggucuaug

SEQ ID NO: 411503 - RNA, 64 nt, Human
aaagagcuagcucuugagcauuagucacuaccuucagcuugaugcauggucacuucuuuacuau

SEQ ID NO: 411504 - RNA, 64 nt, Human
uuuuugcaacucuaaugucucacuuuuaaaggaacagcuugauugcaaaggagaaaauagauaa

SEQ ID NO: 411505 - RNA, 64 nt, Human
uaguaauggaaagcugcaauaauuaguuuuaauacagcuugaauauuugcuauauagaaauaua

SEQ ID NO: 411506 - RNA, 64 nt, Human
uuucuuuucugucugagcugccuucucuaucauucagcuugaguccucaagacuacuggucaca

SEQ ID NO: 411507 - RNA, 64 nt, Human
cuacuuaguaccugguugcugccucugaccuuuucagcuugauacccugggcuuuaguguaacc

SEQ ID NO: 411508 - RNA, 64 nt, Human
agguaaacuugguucuuuuuuuucccuaagaugacagcuugauuuuaucaucugcagucaaaua

SEQ ID NO: 411509 - RNA, 64 nt, Human
cagugaccauacuaauuauacccccugcaaagcccagcuugaaaccuucacuuaggaacguaau

SEQ ID NO: 411510 - RNA, 64 nt, Human
guaucuguguauccacauaggauuucucuuaauucagcuugaauugauggggagggagguaaga

SEQ ID NO: 411511 - RNA, 64 nt, Human
caccucuccccucaaauuccgugaccaaguugugcagcuugagcaaaugccgaaagaggguauu

SEQ ID NO: 411512 - RNA, 64 nt, Human
ccccugggugucucaugcugcucuuugacuguuucagcuugaacaugcauuuucuaaagcaaac

SEQ ID NO: 411513 - RNA, 64 nt, Human
auauuuauaagaaaguguccgaaaaauguuucuucagcuugagaaauuuuagaaugauaggaag

SEQ ID NO: 411514 - RNA, 64 nt, Human
acaaaaaaaccccagaucucagugaacuaauacacagcuugagcguuuccaugugcuaauguug

SEQ ID NO: 411515 - RNA, 64 nt, Human
cucccucccauguuucugguggacuaaauuguguaucugggaguucucacuuucuagccaggcc

SEQ ID NO: 411516 - RNA, 64 nt, Human
gccugucaggucgugaguccaguuaccaccaaacaucugggaaacuucugggugcugggugcuc

SEQ ID NO: 411517 - RNA, 64 nt, Human
auccaguuucccaccaccuuggacuccucccacaaucugggacuuucacugaauucuugccacg

SEQ ID NO: 411518 - RNA, 64 nt, Human
acugccacucucuucagacagaaucugauuauuccagcuugagagaagcacucuguuuaugaca

SEQ ID NO: 411519 - RNA, 64 nt, Human
uuucagaaaaugcaucccugauuucauucauuuccagcuugaaagccagccauauuacucuagu

SEQ ID NO: 411520 - RNA, 64 nt, Human
uuuguaauagugaaaccuguacucaaaauauaagcagcuugaaacuggcuuuaccaaucuugaa

SEQ ID NO: 411521 - RNA, 64 nt, Human
auuuuaaaaguuucaucuugaaguaaaaguacaacagcuugaaguguugauagcaggccacagc

SEQ ID NO: 411522 - RNA, 64 nt, Human
ccauagcauaaagcuaggggaugcauggaaauagcagcuugaaacuaggagguaacaagaaagc

SEQ ID NO: 411523 - RNA, 64 nt, Human
gggauccccagccagagagagagagaccagccaacagcuugauagaccagugcagccagagaga

SEQ ID NO: 411524 - RNA, 64 nt, Human
ucacuuuaccacagcuaaaaaugaguuacgauagcagcuugauggugauuguauuguauuccuu

SEQ ID NO: 411525 - RNA, 64 nt, Human
ucuaaauggcaaaggaagguggauggccccagcacagcuugaccugaggcuguggucacagcgg

SEQ ID NO: 411526 - RNA, 64 nt, Human
ugccucacuccaucguuuccaccuugcagugaugcagcuugacccuggaacggucagacaaccu

SEQ ID NO: 411527 - RNA, 64 nt, Human
uggugauguagcccaaugagggcgaaugacauuacagcuugaccucuccagaacacuaauaucc

SEQ ID NO: 411528 - RNA, 64 nt, Human
gaaagacaucacauggcauccagggccaggcaggcagcuugaggugccuuuacgagaaaaccga

SEQ ID NO: 411529 - RNA, 64 nt, Human
ccguuuuacaaagggggaggcuaaagcccagagacagcuugaucaaaggcacacagcaagucag

SEQ ID NO: 411530 - RNA, 64 nt, Human
auuuuaaaaguuucaacuugaaguaaaaguacaacagcuugaaguguugauaccaggccacagc

SEQ ID NO: 411531 - RNA, 64 nt, Human
gauggagcuaguuagcugucuguugucuguagcccagcuugauaauggaacuauacagcgaaga

SEQ ID NO: 411532 - RNA, 64 nt, Human
uaaaaaaaaauacugauguuccuagugaaagaggcagcuugaaacugagaugugaacacaucag

SEQ ID NO: 411533 - RNA, 59 nt, Human
agcgugagaagcuuaacuaggcugcauaacagcuugaaaacuggauuaucuacuacaga

SEQ ID NO: 411534 - RNA, 64 nt, Human
ugccugcacacagagugagggaggagggcuuugaaucugggacugugccuggcucccugauggg

SEQ ID NO: 411535 - RNA, 64 nt, Human
auggugcuggaaaaaguucaucuauuagaaugauaucugggaucacaaagccaacugcuggaga

SEQ ID NO: 411536 - RNA, 64 nt, Human
gcauccuauauccaguaaguagaauuaucucuucaucugggaccuggaaauccugaaauaaaaa

SEQ ID NO: 411537 - RNA, 64 nt, Human
uaugguuuauuagauauucuguauuggauuuuaccagcuugacuuuuacugcucagaugcuuuc

SEQ ID NO: 411538 - RNA, 64 nt, Human
acagcaaagcuaauuugccuuugccugggguguucagcuugaaagaauaaagcucauuugguuu

SEQ ID NO: 411539 - RNA, 64 nt, Human
cgaacucggagcggagcaggguagggaccguguacagcuugauaacccuuaauaaaaagggagu

SEQ ID NO: 411540 - RNA, 64 nt, Human
aaagguugcauugcugccccuuauacacaugcugcagcuugauguuaaagaauuuuuauucuuu

SEQ ID NO: 411541 - RNA, 64 nt, Human
gggaucaggugagggguccagacagcugaccagacagcuugacagcuggucaagacggucacgg

SEQ ID NO: 411542 - RNA, 64 nt, Human
uacacauugccacugucuccccaugugacucuuacagcuugaggaggcauuuguuagcacuucu

SEQ ID NO: 411543 - RNA, 64 nt, Human
uaaagucucuggugggcugccucaugacuuuaaucagcuugaacugccagugcaccagcaguuu

SEQ ID NO: 411544 - RNA, 64 nt, Human
gccucgggcacaacuuucugcccagaaaaaugugcagcuugacucugcugaggaaaagguccaa

SEQ ID NO: 411545 - RNA, 64 nt, Human
cucggcagcacauauacuaaaaauuaauaagacccagcuugaaaauugagccugauaacaagau

SEQ ID NO: 411546 - RNA, 64 nt, Human
gaggcaccuguuuggaaucugguuuucucagcggcagcuugacaugugcacccuuuuguauuaa

SEQ ID NO: 411547 - RNA, 64 nt, Human
uauauauuuacucagucuuugcccugaauggucucagcuugagaccauuucaaacuggagagaa

SEQ ID NO: 411548 - RNA, 64 nt, Human
ggcugcagugagcugugacugugccacugcacuccagcuugagcaacacagugauacugucuca

SEQ ID NO: 411549 - RNA, 64 nt, Human
gccauuucugcucaaccacacauucucuaagaaacagcuugaaagcucugucugggucauucau

SEQ ID NO: 411550 - RNA, 64 nt, Human
gagcuccagucccugcuggauucccugguuaauucagcuugagcugaaaagcuuccuggaagug

SEQ ID NO: 411551 - RNA, 64 nt, Human
uuucaaaugugugugugaugugcuguuuauuuaucagcuugagguccaugggggcagccuugug

SEQ ID NO: 411552 - RNA, 64 nt, Human
uuacuuaugguauuuauuuucaguaguaaagacccagcuugaauguaaauuuuguauaguguaa

SEQ ID NO: 411553 - RNA, 64 nt, Human
accaaaagucggacaggaaacaucuggugcuauuaucugggacuuggccugaccgugggggucc

SEQ ID NO: 411554 - RNA, 64 nt, Human
gaagagugcagcucccagagggaggcagccauccaucugggaugguccuaagcauggaauccua

SEQ ID NO: 411555 - RNA, 64 nt, Human
cacccacccuucuucccucugggcaacuggacagaucugggagccagcagcuggaugcuguggc

SEQ ID NO: 411556 - RNA, 64 nt, Human
ccccguuuaaguagccguuagggcgcaguaucggcagcuugacacccaccaagcaaaaguuuca

SEQ ID NO: 411557 - RNA, 64 nt, Human
cuggcaaguguggcagcugccucugggcugagcacagcuugaccccucuagccccuguaaauac

SEQ ID NO: 411558 - RNA, 64 nt, Human
gaauucaagagagaagugucuccuccucguguagcagcuugagaagaggcuugggagugcagcu

SEQ ID NO: 411559 - RNA, 64 nt, Human
aaauaggguagagaacaggcugucuagucagaugcagcuugaucuguggcaaaaccaagugugg

SEQ ID NO: 411560 - RNA, 64 nt, Human
ccaguuuguucuucauaggaccaauuuuuauuugcagcuugaguuuuuauaugaaguugcauua

SEQ ID NO: 411561 - RNA, 64 nt, Human
accagaccuggacuuucuuaggacaaacuuacugcagcuugaaggagccaaccauggauuugag

SEQ ID NO: 411562 - RNA, 64 nt, Human
uuagccagggccgugccaacuuaugaagacacugcagcuugagaggggcuuugcugaggcuucc

SEQ ID NO: 411563 - RNA, 64 nt, Human
gcagcucuuccccuuuccugggggaugugcacggcagcuugagccugucacguggucaaggccc

SEQ ID NO: 411564 - RNA, 64 nt, Human
gccucacucaaacauagcugacuuccuauugguacagcuugaaaagcacuuuuuacuacauaca

SEQ ID NO: 411565 - RNA, 64 nt, Human
uagaaaaaguuggugugcuggagcuaccucaccucagcuugagagagccaguugugugcaucuc

SEQ ID NO: 411566 - RNA, 64 nt, Human
auacuucaaggaagacucuacaagcuuuuguucacagcuugaaauagaugccucacaauucaga

SEQ ID NO: 411567 - RNA, 64 nt, Human
aaaguuggagcuaccacuuuuagcauagauugcucagcuugacacugaagcauauuaugcaaac

SEQ ID NO: 411568 - RNA, 64 nt, Human
aaagauggaaacugaaggagacuggagcaaaauucagcuugaaugaacagagcacuuuuuacua

SEQ ID NO: 411569 - RNA, 62 nt, Human
gagggagagagaucacaauuuccaacuggguaaacagcuugaaaaaagaaacagaagccugg

SEQ ID NO: 411570 - RNA, 64 nt, Human
gugggccuuggaaaaugcaucaagaaggccaaaccagcuugacccuggcucacagacaugguca

SEQ ID NO: 411571 - RNA, 64 nt, Human
uuaccgaagcaacaaaauucagcagacaccucuucagcuugaguucuucaccaucuuuugcaac

SEQ ID NO: 411572 - RNA, 64 nt, Human
uugccugccagagcuuuguuuuauauauuuauucaucugggaggcagaacaggcuucggacagu

SEQ ID NO: 411573 - RNA, 64 nt, Human
ccacucccccagacaccuggacacguggccacaaaucugggacaaggggcccccgcacagcaug

SEQ ID NO: 411574 - RNA, 64 nt, Human
gugggccuggagaaagaggcugguguuaccugagaucugggaugcugaguggcuguuugggggc

SEQ ID NO: 411575 - RNA, 50 nt, Human
aaggaaaaaccaagaacugacagcuugaggaauucucuccacaccuaggc

SEQ ID NO: 411576 - RNA, 64 nt, Human
ucaauuucauuuuugauauucaaauuaauucuuacagcuugagcauaucagccuuauuaccaga

SEQ ID NO: 411577 - RNA, 64 nt, Human
agugacucauccugucugcuaacuccagaccucccagcuugaagccaaaucuuuccaugugaga

SEQ ID NO: 411578 - RNA, 64 nt, Human
uacaauuaaucuguuuuguacauaaaugugccaacagcuugaugguggcguuuuugaaauguag

SEQ ID NO: 411579 - RNA, 64 nt, Human
caguucaucuauggcaguccagccagcuccugggcagcuugagagggcaaacccaaaaccucau

SEQ ID NO: 411580 - RNA, 64 nt, Human
ccaaauacauaaagcaaauaagcaggauggggaacagcuugaccuucauccaccccuaacucca

SEQ ID NO: 411581 - RNA, 64 nt, Human
uggcucaacuucaguugagagggugcaguccagacagcuugacugcuuuuaaaugaccaaagau

SEQ ID NO: 411582 - RNA, 64 nt, Human
auuuuuuggaaaagaggacagaaaaauugaacuacagcuugagaacguauucuuuuuuuccuac

SEQ ID NO: 411583 - RNA, 64 nt, Human
accuuaguuucaagagucuaaaccccagauucuucagcuugauccuggaggucuuuucuagucu

SEQ ID NO: 411584 - RNA, 64 nt, Human
auauuucaacauguuauguauauuggaacuucuacagcuugaugccuccugcuuuuauagcagu

SEQ ID NO: 411585 - RNA, 64 nt, Human
ccaaaucuggauaaagcugugggauucuuggaagcagcuugaguguuuucaucuugccugggaa

SEQ ID NO: 411586 - RNA, 64 nt, Human
cagccuccucauacgcacagcuuuuggaugaccucagcuugaguuucuccauaugugcauguac

SEQ ID NO: 411587 - RNA, 64 nt, Human
uaauaguccgggucuacagggaagaacaaugacacagcuugagcguuacuuccuccuucguguc

SEQ ID NO: 411588 - RNA, 64 nt, Human
agauuauaguuccccuuaacugcucuauagauaacagcuugaacauuaugaaaugcuaaguuuu

SEQ ID NO: 411589 - RNA, 64 nt, Human
agcuaacuguaggaucuuccacacccuaaggcuucagcuugagaagcacuucgaagccagagca

SEQ ID NO: 411590 - RNA, 64 nt, Human
acaagcuucccaggcuuucuccccuggaaaacuccagcuugagucccagauacacucaugggcu

SEQ ID NO: 411591 - RNA, 64 nt, Human
aucucacuggagagaaacuguaugaauguagagaaucugggaauaccuuucugaaucccacaaa

SEQ ID NO: 411592 - RNA, 64 nt, Human
caugaauguaagcaaugugggaaagcauuugaucaucugggaagcuuccaaagacacaugauaa

SEQ ID NO: 411593 - RNA, 64 nt, Human
auauuuuuuuucuggaauguagccauuugcuguuaucugggaaacaagauucuaacaggaaacc

SEQ ID NO: 411594 - RNA, 64 nt, Human
gccccugcccgccugccugccaccucucggacuccagcuugauggaguugggacagccaugugg

SEQ ID NO: 411595 - RNA, 64 nt, Human
gcauuuuggucccugcuccuugcccauaguaaaacagcuugaaauaucccaugcaagagaguag

SEQ ID NO: 411596 - RNA, 64 nt, Human
ucugagacacagaggugccagugauggacuggaucagcuugaaagaagcacaaagacuccguga

SEQ ID NO: 411597 - RNA, 64 nt, Human
ucaaagacucagguuaaaacuauuuugguaagugcagcuugaauuucaaauaucccguguuacc

SEQ ID NO: 411598 - RNA, 64 nt, Human
uuuuccucacagggaugaauuguaaaagcaacaucagcuugaccaguauaaaauuacaguggau

SEQ ID NO: 411599 - RNA, 64 nt, Human
cagcagacaaagucaagcagcuuuaaguacaaggcagcuugaaaccucucugaugaaagugaaa

SEQ ID NO: 411600 - RNA, 64 nt, Human
ccaugcugcuuuucugaguguugauggggguuaccagcuugauccacuguugcucuuagaaggc

SEQ ID NO: 411601 - RNA, 64 nt, Human
ggcgugcagaauccuuguguuuuuucucgcugggcagcuugaggggcuggggaguauucccagg

SEQ ID NO: 411602 - RNA, 64 nt, Human
auaagucugugugucagguacagcugggcccagccagcuugagucacucuuguacaagcuuguu

SEQ ID NO: 411603 - RNA, 64 nt, Human
gggaacugcuggggucgaccccauacagagaacucagcuugaagcuggaagcacacagugggua

SEQ ID NO: 411604 - RNA, 64 nt, Human
acacggguuaaaauauuaagauguccuaguucaacagcuugaauuccauugauugauacugaua

SEQ ID NO: 411605 - RNA, 64 nt, Human
aagagguaugauuccuaagcccuaaggagcuccucagcuugaaauggggcugcaucccuauaaa

SEQ ID NO: 411606 - RNA, 64 nt, Human
aacguuagcaacacagcagucuccuaauuaaugacagcuugacuuaacaauuuuccaacuuuac

SEQ ID NO: 411607 - RNA, 64 nt, Human
gcgguguggagagggcggaagguggacuccagcgcagcuugaggggcugaggacggaggcugca

SEQ ID NO: 411608 - RNA, 64 nt, Human
cuacgaagccgggcccccacacccuggcugaagucagcuugaccuaggucuugacccucaucca

SEQ ID NO: 411609 - RNA, 64 nt, Human
uuaaugcuuuuuuucuugugacaguuacgcaaaucagcuugaauuccauaugucccugaguuau

SEQ ID NO: 411610 - RNA, 64 nt, Human
aauuuuuucuguagugcuguauuauuuucaauaaaucugggacaacagccuugccugugucauc

SEQ ID NO: 411611 - RNA, 64 nt, Human
guccagaggaaaagacaccugucaaaugucacagaucugggaggggacuuaagaccuaucaugc

SEQ ID NO: 411612 - RNA, 64 nt, Human
uggcuggcucgacuggcagagagagcgcuggcagaucugggagcuccugucgaccgacaacccc

SEQ ID NO: 411613 - RNA, 64 nt, Human
aggcuuuggaaaugggacaggucuuucagacucacagcuugauacccuaacaaagcagaguaua

SEQ ID NO: 411614 - RNA, 64 nt, Human
cgaauugucucugguucagggaaaggggacagcccagcuugaagaugagggauggugaauggcu

SEQ ID NO: 411615 - RNA, 64 nt, Human
ccaaggcuggugucuguaccauugcauccuaagucagcuugaaggguaggcugguuuucuuccc

SEQ ID NO: 411616 - RNA, 64 nt, Human
ugggaacucauccuguguggggaggcagcuccaacagcuugaccagaccuagaccugggccaaa

SEQ ID NO: 411617 - RNA, 64 nt, Human
aaacggagagggaaugggagacuugauauuuaagcagcuugaaugguuuuucuuuucuuuauuu

SEQ ID NO: 411618 - RNA, 64 nt, Human
cgcuuaugaccauccuagagagggcccugagcaccagcuugaucuuagggauuuccaaaguaac

SEQ ID NO: 411619 - RNA, 64 nt, Human
uuuccucaccugccccugcccuaccuuacacccccagcuugacuucuuuccaguccacgugugu

SEQ ID NO: 411620 - RNA, 64 nt, Human
uuuguuuuuguuuucuaauauacuuugauguaaucagcuugagaaagcaacacaauuucaaauc

SEQ ID NO: 411621 - RNA, 64 nt, Human
gccuaagccuucaagugggcggagcugagggcagcagcuugacuuugcagacaucugagcaaua

SEQ ID NO: 411622 - RNA, 64 nt, Human
auucacuaacgagcggggcugugggcaugaauuucagcuugagugcauauccuggaucaacggc

SEQ ID NO: 411623 - RNA, 64 nt, Human
aaaauguucucagcauugucuugcugccaaaugccagcuugaagaguuuuguuuuguuuuuuuu

SEQ ID NO: 411624 - RNA, 64 nt, Human
agcauuaaaucccaaauccuauuuaaagaccugacagcuugagaaggucacuacugcauuuaua

SEQ ID NO: 411625 - RNA, 64 nt, Human
ggauauccacugggagcacuucauccuguucugacagcuugauaacauuccuguuauaaccaag

SEQ ID NO: 411626 - RNA, 64 nt, Human
gaccgcacagcagcgaugcagaaggcaagaacggcagcuugaaaaauuaaaggagguuguucac

SEQ ID NO: 411627 - RNA, 64 nt, Human
cuuugguuaugaaacauguggaguguauuaagugcagcuugacauuauguuuuauuuaaaugcu

SEQ ID NO: 411628 - RNA, 64 nt, Human
auuucuaaauuaagucccuuuuaguuugaucagacagcuugaaucagcaucucuucuucccugu

SEQ ID NO: 411629 - RNA, 64 nt, Human
agcucaagugauccucugccucagccuccagaguaucugggauuacauaugucggcuaccgugu

SEQ ID NO: 411630 - RNA, 64 nt, Human
aguacauaauuuguuggugacuaacaaagcucacaucugggagauuaacuuuuuuuaacgcaaa

SEQ ID NO: 411631 - RNA, 64 nt, Human
uccugagggccccaccaagcacccuuccacuuccaucugggagccccaagaggggcugggaagg

SEQ ID NO: 411632 - RNA, 64 nt, Human
aaaaaaauagagguauauugccaaaacauagagccagcuugaaggggcucccacuggccaaacu

SEQ ID NO: 411633 - RNA, 64 nt, Human
aguuacugccuaggaguuaaugaucguucugggucagcuugaauguccccauucuauaaauuca

SEQ ID NO: 411634 - RNA, 64 nt, Human
aaguguuuuuacaucaucucauuugaucucaaaacagcuugacagagcaacuguuauugaaaua

SEQ ID NO: 411635 - RNA, 64 nt, Human
cuuguguucugaguagagcuuguaauaaauacugcagcuugaguuuuuaguggaagcuucuaaa

SEQ ID NO: 411636 - RNA, 64 nt, Human
cuggccccuucuccagcaagcagugcccucuggacagcuugacucuacucccagcgcuggcucc

SEQ ID NO: 411637 - RNA, 64 nt, Human
auacccccaacacucacuccacucaaugugcacccagcuugauguccacuggacacuggcaacu

SEQ ID NO: 411638 - RNA, 64 nt, Human
acugugaauuguuuaaccucugugguuaaagcuacagcuugaguugacugccuuggggauguca

SEQ ID NO: 411639 - RNA, 64 nt, Human
ccagaaacagcuaaaaugucaguagaagacuugacagcuugagaauagaggaaaaaauaaaagc

SEQ ID NO: 411640 - RNA, 64 nt, Human
ugcccccuucuaccuccaccucagcacccucccccagcuugauguuugggucuccccagcaccc

SEQ ID NO: 411641 - RNA, 64 nt, Human
cuggaaggaugacaugggcccagacugaacaagucagcuugaugaucuuaaaugauggaaguau

SEQ ID NO: 411642 - RNA, 64 nt, Human
auagcuuucccaucaugaaucagaaagauguggacagcuugauguuuuagacaaccacugaacu

SEQ ID NO: 411643 - RNA, 64 nt, Human
caagggagccaguuguguucagacacacacaucacagcuugacucacuaacugaggccuuucca

SEQ ID NO: 411644 - RNA, 64 nt, Human
uuguugacuuccaccagaacaaaaccuguuaauucagcuugacuucucauauguguucuguguu

SEQ ID NO: 411645 - RNA, 64 nt, Human
augcacgauguaauuuaaugcuaaagaguacuuacagcuugagggaaaagcauaaaguuuuagu

SEQ ID NO: 411646 - RNA, 64 nt, Human
uucgguacuccuggugcccgcccggccagaccgucagcuugauaauuacuaaagcaaaggccug

SEQ ID NO: 411647 - RNA, 64 nt, Human
uugccacccucagcucuuuccucugguguggcuucagcuugaaagcaaccuggagucgggggca

SEQ ID NO: 411648 - RNA, 64 nt, Human
uuugucuaaaaacaucuuuuuggcuuggaaagggaucugggaagccagguauuaauugcaggga

SEQ ID NO: 411649 - RNA, 64 nt, Human
caucagauugccaauuuggggagacagcaauaucaucugggagauucagcuuaauuugcuucaa

SEQ ID NO: 411650 - RNA, 64 nt, Human
cuaugguacccuguguuaguaaaggggcccagaaaucugggauguacuguuugcugccacacug

SEQ ID NO: 411651 - RNA, 64 nt, Human
augacggagucuuaucugaacuacacuuacugaacagcuugaaggccuuuugaguucugcugga

SEQ ID NO: 411652 - RNA, 64 nt, Human
ugagcacagauuccagaggucacaguaagccuugcagcuugagcugaaagaugccagagccgga

SEQ ID NO: 411653 - RNA, 64 nt, Human
cuccauagagcacaacucaagauagaccaugagacagcuugagccucaggauucuuguucuucc

SEQ ID NO: 411654 - RNA, 64 nt, Human
uuaaguaaugaauauauaagaacuguacucuucucagcuugagcuuacauagguaaauaucacc

SEQ ID NO: 411655 - RNA, 64 nt, Human
ucuggcaaccauauuucuggaaguugagauguuucagcuugaagaaccaaaacagaaggaauau

SEQ ID NO: 411656 - RNA, 64 nt, Human
gugggcggaucacuugagguugggaguucaugaccagcuugaccaacaugaagaaacccugucu

SEQ ID NO: 411657 - RNA, 64 nt, Human
caucauuacaggaaagacugugaacuccugaguucagcuugauuucugacuacaucccagcaag

SEQ ID NO: 411658 - RNA, 64 nt, Human
uggcuaaccagaucaaccaauauaaauccacaagcagcuugauuccaccaaucagagaaguuga

SEQ ID NO: 411659 - RNA, 64 nt, Human
cuuugcuccuggcaccucgucccuuuuagucccucagcuugauaaagagugaguuuggagcccg

SEQ ID NO: 411660 - RNA, 64 nt, Human
cugucugcaucuuggaccugaacuugaucauuaucagcuugauaagagacuuuuugacucuaua

SEQ ID NO: 411661 - RNA, 64 nt, Human
uaaucauaacacucucggucacauguuuuuccuucagcuugaaagcuuuuuuuuaaaaggaaaa

SEQ ID NO: 411662 - RNA, 64 nt, Human
cucccuugaucucaagggcguaacucuggaagcacagcuugacuacacgucauuuuuaccaaug

SEQ ID NO: 411663 - RNA, 64 nt, Human
caaauaccauagaauucuaaucucuggaggcuggcagcuugacuuggcacuuuagggccccuua

SEQ ID NO: 411664 - RNA, 64 nt, Human
cguuacuuguacuaugaaggaaaauacucagugucagcuugagccugcauuccaagcuuuuuuu

SEQ ID NO: 411665 - RNA, 64 nt, Human
uaagacaauugaguuagcuucauguguauuauugcagcuugaucauuuauauaaauauuugucu

SEQ ID NO: 411666 - RNA, 64 nt, Human
uccuuugcucuugggaagaccagcuuugcagugacagcuugaguggguucucugcagcccucag

SEQ ID NO: 411667 - RNA, 64 nt, Human
gggaucugggggguggggaggaggaagccguugaaucugggagggaaguggagguugcuguaca

SEQ ID NO: 411668 - RNA, 64 nt, Human
aagcccuaucccuggcauuacguuucuagguagaaucugggagugaauuugucccauucccucu

SEQ ID NO: 411669 - RNA, 64 nt, Human
cagcacuuucccauuuucauaacuaugugaaaacaucugggaauuugaaucacuccugaauaca

SEQ ID NO: 411670 - RNA, 64 nt, Human
cagcuugcucaguuagcagcagagggcaguuccccagcuugaugguuucugagcuaagucuggc

SEQ ID NO: 411671 - RNA, 64 nt, Human
ggucuuccccaacuuucaguuauacgaaugccaucagcuugaccagggaagaucugggcuucau

SEQ ID NO: 411672 - RNA, 64 nt, Human
acuaccacaggacccucucaagcuucucaggcaacagcuugaggucccugaggggaguggcaag

SEQ ID NO: 411673 - RNA, 64 nt, Human
uggcaagucuuucccaagccauucuuugucugagcagcuugaugguuucuccuugccccauuuc

SEQ ID NO: 411674 - RNA, 64 nt, Human
uauuucauuugguucagccuguuauggaauuuaccagcuugauaaauuugccuauaaaguuuua

SEQ ID NO: 411675 - RNA, 64 nt, Human
aacuaaauaucauauaguuaauguuuauuuaacucagcuugagacuguacuacaguuagguuug

SEQ ID NO: 411676 - RNA, 64 nt, Human
uguuuuuguuuauuuguuuguuugcuuuuauuuccagcuugaaugagugggguugggggcgggg

SEQ ID NO: 411677 - RNA, 64 nt, Human
gucacggugcaagucucccccugcaccccucccccagcuugagccgugucaccccccucucccu

SEQ ID NO: 411678 - RNA, 64 nt, Human
cuguuuauucagaaucacaguguauccaaaucuucagcuugaauuuggaggcagauucuuagag

SEQ ID NO: 411679 - RNA, 58 nt, Human
augguagagugugucccugagauggaaucagcuugagucuucugcaauuggucacaac

SEQ ID NO: 411680 - RNA, 64 nt, Human
aagaacagcugaagcuaaucuaauuuaaauuuaacagcuugaagagguagcuagguguuuaaag

SEQ ID NO: 411681 - RNA, 64 nt, Human
cuccaguuagcucuaauuacagaccccaccaguacagcuugacagcucccggcaccaucccuuc

SEQ ID NO: 411682 - RNA, 64 nt, Human
acccuaggccccagcugaccgcaugggugugagccagcuugagaacacuaacuacucaauaaaa

SEQ ID NO: 411683 - RNA, 64 nt, Human
ggaaugggauuaagaugacuagcauagcaguguacagcuugaagagauguuccacaucaucacu

SEQ ID NO: 411684 - RNA, 64 nt, Human
cauaaucaacucccugggaguggaagccagauggcagcuugagauugggcaggagcauucgauc

SEQ ID NO: 411685 - RNA, 64 nt, Human
ccugcaguaggaugggagggaagguuaaaguugccagcuugagugaugugcuugggugacuugg

SEQ ID NO: 411686 - RNA, 64 nt, Human
aauuaaguucccucccuccagccagaaguuaaacaucugggauaugacgucuucaugccagggg

SEQ ID NO: 411687 - RNA, 64 nt, Human
aauaaauuuccuccugauuaauuuuuuuuuucucaucugggaauuugaaaucucggugcuuacu

SEQ ID NO: 411688 - RNA, 64 nt, Human
cuugcuaagcaggguccacugggagggaagcucuaucugggaacucacccccagcgcacacaca

SEQ ID NO: 411689 - RNA, 64 nt, Human
agauuaaauugaagaaaagcaagcaaauuaauuucagcuugauuaucaaccuguaucaagaaca

SEQ ID NO: 411690 - RNA, 64 nt, Human
uggacugagucaagggucugcggugcagcaucuucagcuugagaaaaugagguugucaguuucc

SEQ ID NO: 411691 - RNA, 64 nt, Human
gauggcuguaaaucuauuggccaucugggcuucacagcuugaguuaaccuugcuuuuccgggaa

SEQ ID NO: 411692 - RNA, 64 nt, Human
ccgggauuccagugagaugggugcuguucuugagcagcuugaccaccccaacagggaucugggc

SEQ ID NO: 411693 - RNA, 64 nt, Human
uuguagaagugccuagauuuugccagacuucauccagcuugacaagauugagaggcccaugcca

SEQ ID NO: 411694 - RNA, 64 nt, Human
ggcagauaaccuggagauuuucaccuuuucuuuucagcuugauugcauuugacuauauuuuaca

SEQ ID NO: 411695 - RNA, 64 nt, Human
ugaacaugaaauuauuaguacucuagguuuuggacagcuugaguucauuugaauuccuuccuua

SEQ ID NO: 411696 - RNA, 64 nt, Human
cagcuuuuuaaagucacuaaauguucuugauuaucagcuugaagguauuuuuguauuacaaguu

SEQ ID NO: 411697 - RNA, 64 nt, Human
caggcgcuucuccaaugcucuggagugugcauuucagcuugaaccugcuuccuggcucacacau

SEQ ID NO: 411698 - RNA, 64 nt, Human
gaggugaacuaaggcaccccgccacccacuguggcagcuugaauuucuugaggcugagacaaac

SEQ ID NO: 411699 - RNA, 64 nt, Human
uaugauaggcccggaaguugcugugccccaucagcagcuugacgcguggucacaggacgauuuc

SEQ ID NO: 411700 - RNA, 64 nt, Human
uuuuuuccccccaaguagaacuaaugcuagcuuccagcuugaaaguaaaacuccaguguggagu

SEQ ID NO: 411701 - RNA, 64 nt, Human
uuuucauuagaaaguagaacuaauuuuagauuuucagcuugauggauuuucaguuuuuccugaa

SEQ ID NO: 411702 - RNA, 64 nt, Human
auccuuaucuaaccagcuauuuucuuaauugcuacagcuugaccuaccaguauuccggaguaac

SEQ ID NO: 411703 - RNA, 64 nt, Human
cucggaaauuugcuaaugguugugauaaaccauacagcuugagccagugaggcagauugggcug

SEQ ID NO: 411704 - RNA, 64 nt, Human
uuugguuuuacaaaccuguuaacuaccuccuguccagcuugacagagacuaauuuuucaucuuu

SEQ ID NO: 411705 - RNA, 64 nt, Human
gcugcccaggggagggauaugucuuccuuuaugcaucugggaaaccaggaacagacccugcgca

SEQ ID NO: 411706 - RNA, 64 nt, Human
aaauauuuuugcuuguguugucgcaaaggggauaaucugggaaagacaccaaaucaugggcuca

SEQ ID NO: 411707 - RNA, 64 nt, Human
agugucaacuucugaggucuuuauuuacaugauaaucugggagaugcauuuaugccugaaucaa

SEQ ID NO: 411708 - RNA, 64 nt, Human
caaaucuuuauugguauuauuuuauauacuuuuccagcuugauaauuuucacaauagaaagaga

SEQ ID NO: 411709 - RNA, 64 nt, Human
uauuuuuauuucuaucaaagacgguagagagaaacagcuugaugcuguuucuacauuaaaaaaa

SEQ ID NO: 411710 - RNA, 64 nt, Human
uacuuuuuuuaagaaagcauuuauauuuauaugacagcuugaacugacaacauuguguauauag

SEQ ID NO: 411711 - RNA, 64 nt, Human
ggggccuccacccagcagcagaccaaccaggaagcagcuugaacuggauggagacuuuccaaau

SEQ ID NO: 411712 - RNA, 64 nt, Human
aauguugggccugagguuaacugugaccaugguccagcuugaguggcuucuggagcagccacau

SEQ ID NO: 411713 - RNA, 64 nt, Human
gaaaggaaagccuccaagacuccaugugcuugggcagcuugagaaggcguucagcaccacgccu

SEQ ID NO: 411714 - RNA, 64 nt, Human
ggcuggaaucacaggucucacauagagaaauagccagcuugaauuuguuagucguauuccuuca

SEQ ID NO: 411715 - RNA, 64 nt, Human
guugauaaacacucaagaaccucaggagcgcugccagcuugacacuggggaauccagccagucc

SEQ ID NO: 411716 - RNA, 64 nt, Human
uauuuuuauuucuaucaaagacgguagagagaaacagcuugaugcuguuucuacaucaaaaaaa

SEQ ID NO: 411717 - RNA, 64 nt, Human
cggguuccugcuuugcagagaaggagccggggaccagcuugaagacuggcucugggacacacug

SEQ ID NO: 411718 - RNA, 64 nt, Human
aucuaccucuguuuuuaauuuucuuuccaaaaggcagcuugaaauguugguccuaaucuuaauu

SEQ ID NO: 411719 - RNA, 64 nt, Human
ggcaaccuaauuguaaaugccuguguuaaagaggcagcuugacuguucauguuucauuuugcaa

SEQ ID NO: 411720 - RNA, 64 nt, Human
uuuuacucauucuagccuuguagaaugaccauugcagcuugagggaccuaguucuuaccuuuuc

SEQ ID NO: 411721 - RNA, 64 nt, Human
aagaaccccuucccugcuugcacccuggagagaacagcuugacucccaucaacucaacgcuggu

SEQ ID NO: 411722 - RNA, 64 nt, Human
cagcuccuucuguccuacucugugucagguggggcagcuugaggguugggcuggugucaccuga

SEQ ID NO: 411723 - RNA, 64 nt, Human
cuggugccuaucugccuggaggcaaaggccuggacagcuugacuuguggggcaggauucucugc

SEQ ID NO: 411724 - RNA, 64 nt, Human
guucaagcgauucuccugccucagccuccuaaguaucugggauuacaggcaugugccaccacac

SEQ ID NO: 411725 - RNA, 64 nt, Human
gggaagcccuggauuucagaaagagcaagucuggaucugggacccuuuccuuccuucccuggcu

SEQ ID NO: 411726 - RNA, 64 nt, Human
gugggaaugacggaacuggggauugcgaugauugaucugggaacauggcuggauugugauuuaa

SEQ ID NO: 411727 - RNA, 64 nt, Human
uugcuguagcccgugcuguuuaucaagcagugcucagcuugaagaauauuccuguuuuggagac

SEQ ID NO: 411728 - RNA, 64 nt, Human
uugcuguagcccaugcuguuuaucaagcaaugcucagcuugaagaauauuccuguuuuggagac

SEQ ID NO: 411729 - RNA, 64 nt, Human
aaaaacuugcucccaggagggcuuugugucuggccagcuugauuuuccuaauggucucaucucc

SEQ ID NO: 411730 - RNA, 64 nt, Human
ggauuuuucagugaggacccuugggcuuuggaugcagcuugaaccaagaaaacgaggagggaaa

SEQ ID NO: 411731 - RNA, 64 nt, Human
aggccuugccccaaacuaccagcguuucugcaagcagcuugaagggcugaccuugcagccgggu

SEQ ID NO: 411732 - RNA, 64 nt, Human
uauucagcugcuuuuacuguguggauuaugccaacagcuugaauggauucuaacagacucuuuu

SEQ ID NO: 411733 - RNA, 64 nt, Human
cacauccuuucuccccugggcuuguaagaagaugcagcuugaugcagcuccucaaacaccaggc

SEQ ID NO: 411734 - RNA, 64 nt, Human
ugguucugcauucccuucuccugcugauagcagucagcuugaggaggaugaaggaaggcagccu

SEQ ID NO: 411735 - RNA, 64 nt, Human
uuuguuuaccugugggccuugggccaugcaguaucagcuugaccuugcaaggucaagcugagga

SEQ ID NO: 411736 - RNA, 64 nt, Human
cuguccuagucuugaucuguucugggccaggucccagcuugagcugccucugagauuugggcug

SEQ ID NO: 411737 - RNA, 64 nt, Human
agcuggguuucccaggccaucccucuguugccaucagcuugauuggcuuccccgagggccagca

SEQ ID NO: 411738 - RNA, 64 nt, Human
ucauggccugccugguuuuugcucagccugucuucagcuugaggagcugggaagcucuggugga

SEQ ID NO: 411739 - RNA, 64 nt, Human
ggauugcucauggcaugggccucuuacgugcugucagcuugaugugaagaucaaguucagugcu

SEQ ID NO: 411740 - RNA, 64 nt, Human
guggugggaacgugaggugaugccuuugggauuacagcuugaguucugucaccccauccccagg

SEQ ID NO: 411741 - RNA, 64 nt, Human
gcuguuccccagcagccugcagaggccccacagacagcuugaggccccuccuucugcugccugg

SEQ ID NO: 411742 - RNA, 64 nt, Human
ccuuagggggugcccuggccccacggacccgacucagcuugagacacuccagccaaggguccuc

SEQ ID NO: 411743 - RNA, 64 nt, Human
cuacugggaaggcugagguaggagaaucuuuugaaucugggaagcggagguugcagugagcuga

SEQ ID NO: 411744 - RNA, 64 nt, Human
cuauuuguauuuuguguuccuaucaaagugucguaucugggagaugaccugccuuauccuguuc

SEQ ID NO: 411745 - RNA, 64 nt, Human
aucaucccugcggaugcaccgccguacccugcucaucugggagugguuucccugcgguuacguc

SEQ ID NO: 411746 - RNA, 64 nt, Human
uguugaagagcuauugaaaaucauuugugcuuuucagcuugacacagguuuggaguguaagugu

SEQ ID NO: 411747 - RNA, 64 nt, Human
uugcugugacacucccuugccuuuccaccccucucagcuugagguccuaccugguguccuccau

SEQ ID NO: 411748 - RNA, 64 nt, Human
uacaauuagagaaacagaaguccaaggcuggcgacagcuugaaaagucugacagcuuuucuacu

SEQ ID NO: 411749 - RNA, 64 nt, Human
cacagggaacaguuauuagguuugaagcaaccuccagcuugaggccucggcaucuugagaugga

SEQ ID NO: 411750 - RNA, 64 nt, Human
cagcccagaugacuccucacccauccaccaccugcagcuugagauguuaacuauuagagcucca

SEQ ID NO: 411751 - RNA, 64 nt, Human
cacucguccaaguucggaugcgggaaccuggucccagcuugaguuccugccuuucccaccacaa

SEQ ID NO: 411752 - RNA, 64 nt, Human
ucaguacauggguacaauccgagggugugaauuucagcuugaaauuccauugcuguuccuuguu

SEQ ID NO: 411753 - RNA, 64 nt, Human
uuuguauugucaaaauuguauuuccauauugaagcagcuugaguuucuacugaaaaugagcccg

SEQ ID NO: 411754 - RNA, 64 nt, Human
ccugaugccagaucugaucgagucaguaugucuucagcuugaucagauuuuaaaaucaguuuug

SEQ ID NO: 411755 - RNA, 64 nt, Human
agccccuccccugcccucucccugaaauaaagaacagcuugacagaagcccuggcucuccugcu

SEQ ID NO: 411756 - RNA, 64 nt, Human
uuggucuugaacuccuggccucaagcaucccucccagcuugaagugucaauaaaggaaggcaau

SEQ ID NO: 411757 - RNA, 64 nt, Human
acuggccacaaacucugggccuggugggagaggccagcuugagccagacagcgcugcccagggg

SEQ ID NO: 411758 - RNA, 64 nt, Human
guuugaaguuuagaaaugcaggaaauccuucaaccagcuugaaucacugaauaugcauuugaga

SEQ ID NO: 411759 - RNA, 64 nt, Human
agcucucaagccaguugaagaaaccuugccuuuucagcuugacccugcaauauaacaugcacag

SEQ ID NO: 411760 - RNA, 64 nt, Human
guccuuauguauguuuacauggaugucuccccagcagcuugaacccuggagagcaagaauaauc

SEQ ID NO: 411761 - RNA, 64 nt, Human
gggugucuuuaagaugcccaccgugacagugccccagcuugagcuggacguggggcuaagccga

SEQ ID NO: 411762 - RNA, 64 nt, Human
cuuuguuucugcuauucaaaaacugagaguggagaucugggauaaagcaaggaaauaauaauua

SEQ ID NO: 411763 - RNA, 64 nt, Human
uuagauaaauguaaucaccguaaacacccauaugaucugggauuuuguucauauuuugaaaugg

SEQ ID NO: 411764 - RNA, 64 nt, Human
ggcucuaguaaguauuuaguuauaucacuugcauaucugggagaagaaauaagagacuaucauc

SEQ ID NO: 411765 - RNA, 64 nt, Human
aggcaggucgaucacgaggucaggcguuuaagaccagcuugaccaacauggugaaaccccaucu

SEQ ID NO: 411766 - RNA, 64 nt, Human
ugaagacugugacaaaguugucagucacaaaucacagcuugaaagacaggagaauucauacugg

SEQ ID NO: 411767 - RNA, 64 nt, Human
uccuccauuuuccugcuaugaaauauaucaccaccagcuugauucaaccuuaaaaauaagguca

SEQ ID NO: 411768 - RNA, 64 nt, Human
ucuuccuguuuucaccaucuuucuaaucuuuuuccagcuugagggaggcgguauccaccugcag

SEQ ID NO: 411769 - RNA, 64 nt, Human
agagacuuggaaugucugacugacuucuauuuaacagcuugaguauugcauuuccuuggccaaa

SEQ ID NO: 411770 - RNA, 64 nt, Human
uuauauucuaugcuugaaaacucacuuccugaagcagcuugagcuccaaagugcacaucugguu

SEQ ID NO: 411771 - RNA, 64 nt, Human
cuucagccagcaucuuugggggacucuauaauagcagcuugagaucagugucuagaagacuguu

SEQ ID NO: 411772 - RNA, 64 nt, Human
gaaggaaauuuacaagauuuaauaggaaaugaaacagcuugaauuucaaacuaaauuguauuuu

SEQ ID NO: 411773 - RNA, 64 nt, Human
gugugcugcacggugcaggccucaucccugacugcagcuugacucugggcccaacccccauuuc

SEQ ID NO: 411774 - RNA, 64 nt, Human
caucucugcugccuccuuccuuuccugagaggcucagcuugagagaaugagccagugagaagcu

SEQ ID NO: 411775 - RNA, 64 nt, Human
ucauggucucagggaacagccugcuucccaccagcagcuugacacccacagugugcucuggcug

SEQ ID NO: 411776 - RNA, 64 nt, Human
gaaagccauuggugauccaggggcaccuucucuucagcuugacugggcgucuuccgcugcauaa

SEQ ID NO: 411777 - RNA, 64 nt, Human
cuuuugugaaaauggggugugaggagugguucugcagcuugaguccucugguuuuaaguaguuu

SEQ ID NO: 411778 - RNA, 64 nt, Human
auauuuuuggguuacuucaguguguuugacaagacagcuugauauuucuaucaaacaaaugacu

SEQ ID NO: 411779 - RNA, 64 nt, Human
aaugaaaacugcagcauaucagacagcaauuuaacagcuugaaacaucuacagauaguuccuac

SEQ ID NO: 411780 - RNA, 64 nt, Human
cuuccgugagacgccaccgugagaggccagguggcagcuugagcauggacucccagacugcagg

SEQ ID NO: 411781 - RNA, 64 nt, Human
caugaccuguuccuuccugaaguccugggcaugcaucugggacccccguggagcugacaaguuu

SEQ ID NO: 411782 - RNA, 64 nt, Human
aucagguccagccgguccaagcacauggccucccaucugggagagcccacugucccacucccac

SEQ ID NO: 411783 - RNA, 64 nt, Human
aguggucuuccuaaccagucucuugccuaaagauaucugggaccucuacuggcuuuaaugacaa

SEQ ID NO: 411784 - RNA, 64 nt, Human
uucuauuucacagucaaacucggcauucuucagucagcuugaggauuuagcauuguuaaucuug

SEQ ID NO: 411785 - RNA, 64 nt, Human
ccacccagcagcuguuugcccagagcuggagccucagcuugaagaugaugcucaagguacucuu

SEQ ID NO: 411786 - RNA, 64 nt, Human
cucuccacggggcacauuugcucagucacuaauccagcuugaguguccguguguucugcaugug

SEQ ID NO: 411787 - RNA, 64 nt, Human
gcacgugugugcgugugcacagaggguguggugccagcuugagugggagugugugagugugagc

SEQ ID NO: 411788 - RNA, 64 nt, Human
uguagauagcugccuccucaccucuucacgcuuucagcuugaggggagcucccacugccucagc

SEQ ID NO: 411789 - RNA, 64 nt, Human
ccugagguauuucauaucuccugcuguuccaucccagcuugaauuggugccacaagcuuccaag

SEQ ID NO: 411790 - RNA, 64 nt, Human
gguuuuggacacacggucagggucagggccauuucagcuugaccuccuuuuuugaggucagggg

SEQ ID NO: 411791 - RNA, 64 nt, Human
cuucuacccccugucacugauggcgagccuugcccagcuugagaccuguucccaucucuauuca

SEQ ID NO: 411792 - RNA, 64 nt, Human
aagugcuaaaacaaaaucaggugcuuuuuuaaaacagcuugauugagauauaauccacauaccu

SEQ ID NO: 411793 - RNA, 64 nt, Human
ggagaugguguguccugaacaguguagcucaggucagcuugaacuuuccauuucugcucucauu

SEQ ID NO: 411794 - RNA, 64 nt, Human
auucucucauauuugugggcugggaucaagccugcagcuugaggaaagcacaaggaaaggaaag

SEQ ID NO: 411795 - RNA, 64 nt, Human
agcugagcacccuguaaggcaggagcaggcagcucagcuugagcagacauuggguggggggugg

SEQ ID NO: 411796 - RNA, 64 nt, Human
gcaucuugggaccuuuccaguuacuagguuuggacagcuugaugugaacgaaugggauaggauu

SEQ ID NO: 411797 - RNA, 64 nt, Human
ucucccaaaggaucuguacuuucuuuccuuacaacagcuugaaaaucauuauuuuaaaauccuu

SEQ ID NO: 411798 - RNA, 64 nt, Human
uuuaaaaauacuguucagaaugcuuuaauaagcucagcuugagcauuaccauuuccaggacacu

SEQ ID NO: 411799 - RNA, 64 nt, Human
aacugguuucauauggugagagcagccacagcagcagcuugaccugguauucuaccugaguaga

SEQ ID NO: 411800 - RNA, 64 nt, Human
gcucccuaugugaagaaacauuaucuuuaaagucaucugggaggugcagguaaguaaagagaaa

SEQ ID NO: 411801 - RNA, 64 nt, Human
ccacucacuuagaugcuaaaggugauucuaguuaaucugggauuagggucaggaaaaugauagc

SEQ ID NO: 411802 - RNA, 64 nt, Human
ugacuaaaaguaaugccugugaaacaugauaucuaucugggauggccauuugaucucuaaaagg

SEQ ID NO: 411803 - RNA, 64 nt, Human
uaccuggcucuggccaggugcuaggcacuccucacagcuugaccuggguuugcuuccacacccu

SEQ ID NO: 411804 - RNA, 64 nt, Human
gagaugggguccagcccaucccaacacaagggugcagcuugauucgggaguuccccaccuccug

SEQ ID NO: 411805 - RNA, 64 nt, Human; identical to SEQ ID NO: 411022

SEQ ID NO: 411806 - RNA, 64 nt, Human; identical to SEQ ID NO: 411023

SEQ ID NO: 411807 - RNA, 64 nt, Human; identical to SEQ ID NO: 411024

SEQ ID NO: 411808 - RNA, 64 nt, Human; identical to SEQ ID NO: 411029

SEQ ID NO: 411809 - RNA, 64 nt, Human; identical to SEQ ID NO: 411030

SEQ ID NO: 411810 - RNA, 64 nt, Human; identical to SEQ ID NO: 411031

SEQ ID NO: 411811 - RNA, 64 nt, Human; identical to SEQ ID NO: 411032

SEQ ID NO: 411812 - RNA, 64 nt, Human; identical to SEQ ID NO: 411033

SEQ ID NO: 411813 - RNA, 64 nt, Human; identical to SEQ ID NO: 411034

SEQ ID NO: 411814 - RNA, 64 nt, Human; identical to SEQ ID NO: 411035

SEQ ID NO: 411815 - RNA, 64 nt, Human; identical to SEQ ID NO: 411036

SEQ ID NO: 411816 - RNA, 64 nt, Human; identical to SEQ ID NO: 411037

SEQ ID NO: 411817 - RNA, 64 nt, Human; identical to SEQ ID NO: 411038

SEQ ID NO: 411818 - RNA, 64 nt, Human; identical to SEQ ID NO: 411039

SEQ ID NO: 411819 - RNA, 64 nt, Human
cagaaaguuaacugaugauugugggguuugucauaucugggagggaagaugggugcugggagag

SEQ ID NO: 411820 - RNA, 64 nt, Human
ugagagguaggagggcagccugccccaucuaggaaucugggaagggcuggcccucucuuagaag

SEQ ID NO: 411821 - RNA, 64 nt, Human
uggcugccucuccaaacccgcucuuggacagaggaucugggagguggaagccaggccagaggac

SEQ ID NO: 411822 - RNA, 64 nt, Human; identical to SEQ ID NO: 411040

SEQ ID NO: 411823 - RNA, 64 nt, Human; identical to SEQ ID NO: 411041

SEQ ID NO: 411824 - RNA, 64 nt, Human; identical to SEQ ID NO: 411042

SEQ ID NO: 411825 - RNA, 64 nt, Human; identical to SEQ ID NO: 411043

SEQ ID NO: 411826 - RNA, 64 nt, Human; identical to SEQ ID NO: 411044

SEQ ID NO: 411827 - RNA, 64 nt, Human; identical to SEQ ID NO: 411048

SEQ ID NO: 411828 - RNA, 64 nt, Human; identical to SEQ ID NO: 411049

SEQ ID NO: 411829 - RNA, 64 nt, Human; identical to SEQ ID NO: 411050

SEQ ID NO: 411830 - RNA, 64 nt, Human; identical to SEQ ID NO: 411051

SEQ ID NO: 411831 - RNA, 64 nt, Human; identical to SEQ ID NO: 411052

SEQ ID NO: 411832 - RNA, 64 nt, Human; identical to SEQ ID NO: 411053

SEQ ID NO: 411833 - RNA, 64 nt, Human; identical to SEQ ID NO: 411054

SEQ ID NO: 411834 - RNA, 64 nt, Human; identical to SEQ ID NO: 411055

SEQ ID NO: 411835 - RNA, 64 nt, Human; identical to SEQ ID NO: 411056

SEQ ID NO: 411836 - RNA, 64 nt, Human; identical to SEQ ID NO: 411057

SEQ ID NO: 411837 - RNA, 64 nt, Human; identical to SEQ ID NO: 411058

SEQ ID NO: 411838 - RNA, 64 nt, Human
gaacccuuauaaguagauguacauagaggauuccaucugggacucagagcuuucuauccaucug

SEQ ID NO: 411839 - RNA, 64 nt, Human
gagccaggggccccagcacccuccaggacaggagaucugggaugccuggcugcuggaguacaug

SEQ ID NO: 411840 - RNA, 64 nt, Human
acccaaaggaaauagcaguggggaagcaucauguaucugggagcaugcaguggcgagggcucug

SEQ ID NO: 411841 - RNA, 64 nt, Human; identical to SEQ ID NO: 411059

SEQ ID NO: 411842 - RNA, 64 nt, Human; identical to SEQ ID NO: 411060

SEQ ID NO: 411843 - RNA, 64 nt, Human; identical to SEQ ID NO: 411061

SEQ ID NO: 411844 - RNA, 64 nt, Human; identical to SEQ ID NO: 411062

SEQ ID NO: 411845 - RNA, 64 nt, Human; identical to SEQ ID NO: 411063

SEQ ID NO: 411846 - RNA, 64 nt, Human; identical to SEQ ID NO: 411067

SEQ ID NO: 411847 - RNA, 64 nt, Human; identical to SEQ ID NO: 411068

SEQ ID NO: 411848 - RNA, 64 nt, Human; identical to SEQ ID NO: 411069

SEQ ID NO: 411849 - RNA, 64 nt, Human; identical to SEQ ID NO: 411070

SEQ ID NO: 411850 - RNA, 64 nt, Human; identical to SEQ ID NO: 411071

SEQ ID NO: 411851 - RNA, 64 nt, Human; identical to SEQ ID NO: 411072

SEQ ID NO: 411852 - RNA, 64 nt, Human; identical to SEQ ID NO: 411073

SEQ ID NO: 411853 - RNA, 64 nt, Human; identical to SEQ ID NO: 411074

SEQ ID NO: 411854 - RNA, 64 nt, Human; identical to SEQ ID NO: 411075

SEQ ID NO: 411855 - RNA, 64 nt, Human; identical to SEQ ID NO: 411076

SEQ ID NO: 411856 - RNA, 64 nt, Human; identical to SEQ ID NO: 411077

SEQ ID NO: 411857 - RNA, 64 nt, Human
gcaccccucccauuaggacaaucaguccccucccaucugggaguccccuuuucuuuucuacccu

SEQ ID NO: 411858 - RNA, 64 nt, Human
auuuauucaagaucccaaagcuggcaguugauggaucugggauuucaauccagccuaacccaua

SEQ ID NO: 411859 - RNA, 64 nt, Human
auguuuuguuuaacagaguugaaaggccagaacgaucugggagagaaguaucagggcacagugu

SEQ ID NO: 411860 - RNA, 64 nt, Human; identical to SEQ ID NO: 411078

SEQ ID NO: 411861 - RNA, 64 nt, Human; identical to SEQ ID NO: 411079

SEQ ID NO: 411862 - RNA, 64 nt, Human; identical to SEQ ID NO: 411080

SEQ ID NO: 411863 - RNA, 64 nt, Human; identical to SEQ ID NO: 411081

SEQ ID NO: 411864 - RNA, 64 nt, Human; identical to SEQ ID NO: 411082

SEQ ID NO: 411865 - RNA, 64 nt, Human; identical to SEQ ID NO: 411086

SEQ ID NO: 411866 - RNA, 64 nt, Human; identical to SEQ ID NO: 411087

SEQ ID NO: 411867 - RNA, 64 nt, Human; identical to SEQ ID NO: 411088

SEQ ID NO: 411868 - RNA, 56 nt, Human; identical to SEQ ID NO: 411089

SEQ ID NO: 411869 - RNA, 64 nt, Human; identical to SEQ ID NO: 411090

SEQ ID NO: 411870 - RNA, 64 nt, Human; identical to SEQ ID NO: 411091

SEQ ID NO: 411871 - RNA, 64 nt, Human; identical to SEQ ID NO: 411092

SEQ ID NO: 411872 - RNA, 64 nt, Human; identical to SEQ ID NO: 411093

SEQ ID NO: 411873 - RNA, 64 nt, Human; identical to SEQ ID NO: 411094

SEQ ID NO: 411874 - RNA, 64 nt, Human; identical to SEQ ID NO: 411095

SEQ ID NO: 411875 - RNA, 64 nt, Human; identical to SEQ ID NO: 411096

SEQ ID NO: 411876 - RNA, 64 nt, Human
cuagagggacaaagagaaugagaagacauggaugaucugggagagucucacuuuggaaucagaa

SEQ ID NO: 411877 - RNA, 64 nt, Human
gaaagggucauuuacaucaggaaagaggucuuguaucugggaguagagagcuaaccauggagca

SEQ ID NO: 411878 - RNA, 64 nt, Human
acucgagcacaucuaagaucacccauuagguuuuaucugggaccugcaguuuggcuuugggauu

SEQ ID NO: 411879 - RNA, 64 nt, Human; identical to SEQ ID NO: 411097

SEQ ID NO: 411880 - RNA, 64 nt, Human; identical to SEQ ID NO: 411098

SEQ ID NO: 411881 - RNA, 64 nt, Human; identical to SEQ ID NO: 411099

SEQ ID NO: 411882 - RNA, 64 nt, Human; identical to SEQ ID NO: 411100

SEQ ID NO: 411883 - RNA, 64 nt, Human; identical to SEQ ID NO: 411101

SEQ ID NO: 411884 - RNA, 64 nt, Human; identical to SEQ ID NO: 411105

SEQ ID NO: 411885 - RNA, 64 nt, Human; identical to SEQ ID NO: 411106

SEQ ID NO: 411886 - RNA, 64 nt, Human; identical to SEQ ID NO: 411107

SEQ ID NO: 411887 - RNA, 64 nt, Human; identical to SEQ ID NO: 411108

SEQ ID NO: 411888 - RNA, 64 nt, Human; identical to SEQ ID NO: 411109

SEQ ID NO: 411889 - RNA, 64 nt, Human; identical to SEQ ID NO: 411110

SEQ ID NO: 411890 - RNA, 64 nt, Human; identical to SEQ ID NO: 411111

SEQ ID NO: 411891 - RNA, 64 nt, Human; identical to SEQ ID NO: 411112

SEQ ID NO: 411892 - RNA, 64 nt, Human; identical to SEQ ID NO: 411113

SEQ ID NO: 411893 - RNA, 64 nt, Human; identical to SEQ ID NO: 411114

SEQ ID NO: 411894 - RNA, 64 nt, Human; identical to SEQ ID NO: 411115

SEQ ID NO: 411895 - RNA, 64 nt, Human
cugucccugaggacucaguuuugggggagggguuaucugggagaagcuuuagccuguucugagc

SEQ ID NO: 411896 - RNA, 64 nt, Human
cucuuccucccucuuuugccacugucugggccccaucugggauuccugggcccuuuggaaaaga

SEQ ID NO: 411897 - RNA, 64 nt, Human
guuuguuuuccuuuuccauuuucaaaaugccaagaucugggagccucuuucacuccucuagaca

SEQ ID NO: 411898 - RNA, 64 nt, Human; identical to SEQ ID NO: 411116

SEQ ID NO: 411899 - RNA, 64 nt, Human; identical to SEQ ID NO: 411117

SEQ ID NO: 411900 - RNA, 64 nt, Human; identical to SEQ ID NO: 411118

SEQ ID NO: 411901 - RNA, 64 nt, Human; identical to SEQ ID NO: 411119

SEQ ID NO: 411902 - RNA, 64 nt, Human; identical to SEQ ID NO: 411120

SEQ ID NO: 411903 - RNA, 64 nt, Human; identical to SEQ ID NO: 411124

SEQ ID NO: 411904 - RNA, 64 nt, Human; identical to SEQ ID NO: 411125

SEQ ID NO: 411905 - RNA, 64 nt, Human; identical to SEQ ID NO: 411126

SEQ ID NO: 411906 - RNA, 64 nt, Human; identical to SEQ ID NO: 411127

SEQ ID NO: 411907 - RNA, 64 nt, Human; identical to SEQ ID NO: 411128

SEQ ID NO: 411908 - RNA, 64 nt, Human; identical to SEQ ID NO: 411129

SEQ ID NO: 411909 - RNA, 64 nt, Human; identical to SEQ ID NO: 411130

SEQ ID NO: 411910 - RNA, 64 nt, Human; identical to SEQ ID NO: 411131

SEQ ID NO: 411911 - RNA, 64 nt, Human; identical to SEQ ID NO: 411132

SEQ ID NO: 411912 - RNA, 64 nt, Human; identical to SEQ ID NO: 411133

SEQ ID NO: 411913 - RNA, 64 nt, Human; identical to SEQ ID NO: 411134

SEQ ID NO: 411914 - RNA, 64 nt, Human
aagaugggaaacguaacauggaauacaagcuugaaucugggaaacaagcucaaaaaacagugaa

SEQ ID NO: 411915 - RNA, 64 nt, Human
aagaaggaaaagagaaaccagagauggauggcagaucugggaucuaaaauauaagcucccggaa

SEQ ID NO: 411916 - RNA, 52 nt, Human
cucuagccuuagccuccugagcaucugggacuacaggugcgugccaccaugc

SEQ ID NO: 411917 - RNA, 64 nt, Human; identical to SEQ ID NO: 411135

SEQ ID NO: 411918 - RNA, 64 nt, Human; identical to SEQ ID NO: 411136

SEQ ID NO: 411919 - RNA, 64 nt, Human; identical to SEQ ID NO: 411137

SEQ ID NO: 411920 - RNA, 64 nt, Human; identical to SEQ ID NO: 411138

SEQ ID NO: 411921 - RNA, 64 nt, Human; identical to SEQ ID NO: 411139

SEQ ID NO: 411922 - RNA, 64 nt, Human; identical to SEQ ID NO: 411143

SEQ ID NO: 411923 - RNA, 64 nt, Human; identical to SEQ ID NO: 411144

SEQ ID NO: 411924 - RNA, 64 nt, Human; identical to SEQ ID NO: 411145

SEQ ID NO: 411925 - RNA, 64 nt, Human; identical to SEQ ID NO: 411146

SEQ ID NO: 411926 - RNA, 64 nt, Human; identical to SEQ ID NO: 411147

SEQ ID NO: 411927 - RNA, 64 nt, Human; identical to SEQ ID NO: 411148

SEQ ID NO: 411928 - RNA, 64 nt, Human; identical to SEQ ID NO: 411149

SEQ ID NO: 411929 - RNA, 64 nt, Human; identical to SEQ ID NO: 411150

SEQ ID NO: 411930 - RNA, 64 nt, Human; identical to SEQ ID NO: 411151

SEQ ID NO: 411931 - RNA, 64 nt, Human; identical to SEQ ID NO: 411152

SEQ ID NO: 411932 - RNA, 64 nt, Human; identical to SEQ ID NO: 411153

SEQ ID NO: 411933 - RNA, 64 nt, Human
cagagauguuuaugguugaggauaccccauaugaaucugggaaaugggcuaggccugaggcagu

SEQ ID NO: 411934 - RNA, 64 nt, Human
ggguuugggugugggugcacacaaagcaagcaccaucugggauuggcacacuggcagagccagu

SEQ ID NO: 411935 - RNA, 64 nt, Human
cuaccuguacagcggcuccuaccagacaaucaagaucugggacauccgaacccuugacugcauc

SEQ ID NO: 411936 - RNA, 64 nt, Human; identical to SEQ ID NO: 411154

SEQ ID NO: 411937 - RNA, 64 nt, Human; identical to SEQ ID NO: 411155

SEQ ID NO: 411938 - RNA, 64 nt, Human; identical to SEQ ID NO: 411156

SEQ ID NO: 411939 - RNA, 64 nt, Human; identical to SEQ ID NO: 411157

SEQ ID NO: 411940 - RNA, 64 nt, Human; identical to SEQ ID NO: 411158

SEQ ID NO: 411941 - RNA, 64 nt, Human; identical to SEQ ID NO: 411162

SEQ ID NO: 411942 - RNA, 64 nt, Human; identical to SEQ ID NO: 411163

SEQ ID NO: 411943 - RNA, 64 nt, Human; identical to SEQ ID NO: 411164

SEQ ID NO: 411944 - RNA, 64 nt, Human; identical to SEQ ID NO: 411165

SEQ ID NO: 411945 - RNA, 64 nt, Human; identical to SEQ ID NO: 411166

SEQ ID NO: 411946 - RNA, 64 nt, Human; identical to SEQ ID NO: 411167

SEQ ID NO: 411947 - RNA, 64 nt, Human; identical to SEQ ID NO: 411168

SEQ ID NO: 411948 - RNA, 64 nt, Human; identical to SEQ ID NO: 411169

SEQ ID NO: 411949 - RNA, 64 nt, Human; identical to SEQ ID NO: 411170

SEQ ID NO: 411950 - RNA, 64 nt, Human; identical to SEQ ID NO: 411171

SEQ ID NO: 411951 - RNA, 64 nt, Human; identical to SEQ ID NO: 411172

SEQ ID NO: 411952 - RNA, 64 nt, Human
acuaaggcucaggugacacuauggcuagauuaacaucugggauuaggacuggaaacacauguca

SEQ ID NO: 411953 - RNA, 64 nt, Human
gucaucugucauggucuccuuccaccaaaucuucaucugggaauagcagcgguaucccuccacc

SEQ ID NO: 411954 - RNA, 64 nt, Human
uugcacuuuaauguuuuuuguuacuugaaaacauaucugggaucccuuuuuuugguccucugcu

SEQ ID NO: 411955 - RNA, 64 nt, Human; identical to SEQ ID NO: 411173

SEQ ID NO: 411956 - RNA, 64 nt, Human; identical to SEQ ID NO: 411174

SEQ ID NO: 411957 - RNA, 64 nt, Human; identical to SEQ ID NO: 411175

SEQ ID NO: 411958 - RNA, 64 nt, Human; identical to SEQ ID NO: 411176

SEQ ID NO: 411959 - RNA, 64 nt, Human; identical to SEQ ID NO: 411177

SEQ ID NO: 411960 - RNA, 64 nt, Human; identical to SEQ ID NO: 411181

SEQ ID NO: 411961 - RNA, 64 nt, Human; identical to SEQ ID NO: 411182

SEQ ID NO: 411962 - RNA, 64 nt, Human; identical to SEQ ID NO: 411183

SEQ ID NO: 411963 - RNA, 64 nt, Human; identical to SEQ ID NO: 411184

SEQ ID NO: 411964 - RNA, 64 nt, Human; identical to SEQ ID NO: 411185

SEQ ID NO: 411965 - RNA, 64 nt, Human; identical to SEQ ID NO: 411186

SEQ ID NO: 411966 - RNA, 64 nt, Human; identical to SEQ ID NO: 411187

SEQ ID NO: 411967 - RNA, 64 nt, Human; identical to SEQ ID NO: 411188

SEQ ID NO: 411968 - RNA, 64 nt, Human; identical to SEQ ID NO: 411189

SEQ ID NO: 411969 - RNA, 64 nt, Human; identical to SEQ ID NO: 411190

SEQ ID NO: 411970 - RNA, 64 nt, Human; identical to SEQ ID NO: 411191

SEQ ID NO: 411971 - RNA, 64 nt, Human
uuagcucuuuuuagacucuuuuuaggagucagggaucugggauaaagccacacugucuugcugu

SEQ ID NO: 411972 - RNA, 64 nt, Human
ccaaggaacaagaaucucacuaucagagccacaaaucugggaccugucuuuccaacuaaauugg

SEQ ID NO: 411973 - RNA, 64 nt, Human
gcucaggugauccucccgccugagccuccugaguaucugggacuacagaugcgugccaccaagc

SEQ ID NO: 411974 - RNA, 64 nt, Human; identical to SEQ ID NO: 411192

SEQ ID NO: 411975 - RNA, 64 nt, Human; identical to SEQ ID NO: 411193

SEQ ID NO: 411976 - RNA, 64 nt, Human; identical to SEQ ID NO: 411194

SEQ ID NO: 411977 - RNA, 64 nt, Human; identical to SEQ ID NO: 411195

SEQ ID NO: 411978 - RNA, 64 nt, Human; identical to SEQ ID NO: 411196

SEQ ID NO: 411979 - RNA, 64 nt, Human; identical to SEQ ID NO: 411200

SEQ ID NO: 411980 - RNA, 64 nt, Human; identical to SEQ ID NO: 411201

SEQ ID NO: 411981 - RNA, 64 nt, Human; identical to SEQ ID NO: 411202

SEQ ID NO: 411982 - RNA, 64 nt, Human; identical to SEQ ID NO: 411203

SEQ ID NO: 411983 - RNA, 64 nt, Human; identical to SEQ ID NO: 411204

SEQ ID NO: 411984 - RNA, 64 nt, Human; identical to SEQ ID NO: 411205

SEQ ID NO: 411985 - RNA, 64 nt, Human; identical to SEQ ID NO: 411206

SEQ ID NO: 411986 - RNA, 64 nt, Human; identical to SEQ ID NO: 411207

SEQ ID NO: 411987 - RNA, 64 nt, Human; identical to SEQ ID NO: 411208

SEQ ID NO: 411988 - RNA, 64 nt, Human; identical to SEQ ID NO: 411209

SEQ ID NO: 411989 - RNA, 64 nt, Human; identical to SEQ ID NO: 411210

SEQ ID NO: 411990 - RNA, 64 nt, Human
cuuccugggaggcugaggcaagagaaucgcuugaaucugggaggcggagguugcagugagccag

SEQ ID NO: 411991 - RNA, 64 nt, Human
uucuuguguugcuauaaagaaguaccugaucaggaucugggagaauuugaaaaaaaaagaaaaa

SEQ ID NO: 411992 - RNA, 64 nt, Human
ccauggacuaggaagaaaacaugguuuccaaauaaucugggagcuuuuggccauggugccgccu

SEQ ID NO: 411993 - RNA, 64 nt, Human; identical to SEQ ID NO: 411211

SEQ ID NO: 411994 - RNA, 64 nt, Human; identical to SEQ ID NO: 411212

SEQ ID NO: 411995 - RNA, 64 nt, Human; identical to SEQ ID NO: 411213

SEQ ID NO: 411996 - RNA, 64 nt, Human; identical to SEQ ID NO: 411214

SEQ ID NO: 411997 - RNA, 64 nt, Human; identical to SEQ ID NO: 411215

SEQ ID NO: 411998 - RNA, 64 nt, Human; identical to SEQ ID NO: 411219

SEQ ID NO: 411999 - RNA, 64 nt, Human; identical to SEQ ID NO: 411220

SEQ ID NO: 412000 - RNA, 64 nt, Human; identical to SEQ ID NO: 411221

SEQ ID NO: 412001 - RNA, 64 nt, Human; identical to SEQ ID NO: 411222

SEQ ID NO: 412002 - RNA, 64 nt, Human; identical to SEQ ID NO: 411223

SEQ ID NO: 412003 - RNA, 64 nt, Human; identical to SEQ ID NO: 411224

SEQ ID NO: 412004 - RNA, 64 nt, Human; identical to SEQ ID NO: 411225

SEQ ID NO: 412005 - RNA, 64 nt, Human; identical to SEQ ID NO: 411226

SEQ ID NO: 412006 - RNA, 64 nt, Human; identical to SEQ ID NO: 411227

SEQ ID NO: 412007 - RNA, 64 nt, Human; identical to SEQ ID NO: 411228

SEQ ID NO: 412008 - RNA, 64 nt, Human; identical to SEQ ID NO: 411229

SEQ ID NO: 412009 - RNA, 64 nt, Human
uggccuggcaaguggccacgcccugugucagaccaucugggaauuaagcuccagacagacuuac

SEQ ID NO: 412010 - RNA, 64 nt, Human
agaagagaugggaagugaaugcccgauguggugaaucugggaugaaugggagucauaggcuggu

SEQ ID NO: 412011 - RNA, 64 nt, Human
uuuacguauuuuucuuggaauauacagaacucaaaucugggaguuagcaucuuucaucaguuuu

SEQ ID NO: 412012 - RNA, 64 nt, Human; identical to SEQ ID NO: 411230

SEQ ID NO: 412013 - RNA, 64 nt, Human; identical to SEQ ID NO: 411231

SEQ ID NO: 412014 - RNA, 64 nt, Human; identical to SEQ ID NO: 411232

SEQ ID NO: 412015 - RNA, 64 nt, Human; identical to SEQ ID NO: 411233

SEQ ID NO: 412016 - RNA, 64 nt, Human; identical to SEQ ID NO: 411234

SEQ ID NO: 412017 - RNA, 64 nt, Human; identical to SEQ ID NO: 411238

SEQ ID NO: 412018 - RNA, 64 nt, Human; identical to SEQ ID NO: 411239

SEQ ID NO: 412019 - RNA, 64 nt, Human; identical to SEQ ID NO: 411240

SEQ ID NO: 412020 - RNA, 64 nt, Human; identical to SEQ ID NO: 411241

SEQ ID NO: 412021 - RNA, 64 nt, Human; identical to SEQ ID NO: 411242

SEQ ID NO: 412022 - RNA, 64 nt, Human; identical to SEQ ID NO: 411243

SEQ ID NO: 412023 - RNA, 64 nt, Human; identical to SEQ ID NO: 411244

SEQ ID NO: 412024 - RNA, 64 nt, Human; identical to SEQ ID NO: 411245

SEQ ID NO: 412025 - RNA, 64 nt, Human; identical to SEQ ID NO: 411246

SEQ ID NO: 412026 - RNA, 64 nt, Human; identical to SEQ ID NO: 411247

SEQ ID NO: 412027 - RNA, 64 nt, Human; identical to SEQ ID NO: 411248

SEQ ID NO: 412028 - RNA, 64 nt, Human
uaaaaguguaauauaacaauguaaaaaauuauauaucugggaggauuuuuugguugccuaaagu

SEQ ID NO: 412029 - RNA, 64 nt, Human
ucaaacgguguguauuuggcaaagagcucuucaaaucugggagagggacuuccucaagguuuuc

SEQ ID NO: 412030 - RNA, 64 nt, Human
cuacuugggaggcugaggcaggagaaucgcuugaaucugggaggcggagauugcagugagccga

SEQ ID NO: 412031 - RNA, 64 nt, Human; identical to SEQ ID NO: 411249

SEQ ID NO: 412032 - RNA, 64 nt, Human; identical to SEQ ID NO: 411250

SEQ ID NO: 412033 - RNA, 64 nt, Human; identical to SEQ ID NO: 411251

SEQ ID NO: 412034 - RNA, 64 nt, Human; identical to SEQ ID NO: 411252

SEQ ID NO: 412035 - RNA, 64 nt, Human; identical to SEQ ID NO: 411253

SEQ ID NO: 412036 - RNA, 64 nt, Human; identical to SEQ ID NO: 411257

SEQ ID NO: 412037 - RNA, 64 nt, Human; identical to SEQ ID NO: 411258

SEQ ID NO: 412038 - RNA, 64 nt, Human; identical to SEQ ID NO: 411259

SEQ ID NO: 412039 - RNA, 64 nt, Human; identical to SEQ ID NO: 411260

SEQ ID NO: 412040 - RNA, 64 nt, Human; identical to SEQ ID NO: 411261

SEQ ID NO: 412041 - RNA, 59 nt, Human; identical to SEQ ID NO: 411262

SEQ ID NO: 412042 - RNA, 64 nt, Human; identical to SEQ ID NO: 411263

SEQ ID NO: 412043 - RNA, 64 nt, Human; identical to SEQ ID NO: 411264

SEQ ID NO: 412044 - RNA, 64 nt, Human; identical to SEQ ID NO: 411265

SEQ ID NO: 412045 - RNA, 64 nt, Human; identical to SEQ ID NO: 411266

SEQ ID NO: 412046 - RNA, 64 nt, Human; identical to SEQ ID NO: 411267

SEQ ID NO: 412047 - RNA, 64 nt, Human
ugauggaacccugacccuggggaaagacgccuucaucugggacaaaacuggagaugcaucggga

SEQ ID NO: 412048 - RNA, 64 nt, Human
aggaaggggguccacccagcaaagagugggcugcaucugggauucccaccaaggucuucagcca

SEQ ID NO: 412049 - RNA, 64 nt, Human
gaugcugggacagcauuagaagagggucuuuuugaucugggagaugagacgggauccuucauga

SEQ ID NO: 412050 - RNA, 64 nt, Human; identical to SEQ ID NO: 411268

SEQ ID NO: 412051 - RNA, 64 nt, Human; identical to SEQ ID NO: 411269

SEQ ID NO: 412052 - RNA, 64 nt, Human; identical to SEQ ID NO: 411270

SEQ ID NO: 412053 - RNA, 64 nt, Human; identical to SEQ ID NO: 411271

SEQ ID NO: 412054 - RNA, 64 nt, Human; identical to SEQ ID NO: 411272

SEQ ID NO: 412055 - RNA, 64 nt, Human; identical to SEQ ID NO: 411276

SEQ ID NO: 412056 - RNA, 64 nt, Human; identical to SEQ ID NO: 411277

SEQ ID NO: 412057 - RNA, 64 nt, Human; identical to SEQ ID NO: 411278

SEQ ID NO: 412058 - RNA, 64 nt, Human; identical to SEQ ID NO: 411279

SEQ ID NO: 412059 - RNA, 64 nt, Human; identical to SEQ ID NO: 411280

SEQ ID NO: 412060 - RNA, 64 nt, Human; identical to SEQ ID NO: 411281

SEQ ID NO: 412061 - RNA, 64 nt, Human; identical to SEQ ID NO: 411282

SEQ ID NO: 412062 - RNA, 64 nt, Human; identical to SEQ ID NO: 411283

SEQ ID NO: 412063 - RNA, 64 nt, Human; identical to SEQ ID NO: 411284

SEQ ID NO: 412064 - RNA, 64 nt, Human; identical to SEQ ID NO: 411285

SEQ ID NO: 412065 - RNA, 57 nt, Human; identical to SEQ ID NO: 411286

SEQ ID NO: 412066 - RNA, 64 nt, Human
ugagaauaggacacaaacaccagcuauugccugcaucugggaaauugcugaaucgcacagcagu

SEQ ID NO: 412067 - RNA, 64 nt, Human
cucagaucagaucaagcauucuuucuauuuuauuaucugggacauauuuaaauacaaacauauu

SEQ ID NO: 412068 - RNA, 64 nt, Human
gcaccauagggacuucaccaauggauuacaugccaucugggacaggccaugugggagaccccag

SEQ ID NO: 412069 - RNA, 64 nt, Human; identical to SEQ ID NO: 411287

SEQ ID NO: 412070 - RNA, 64 nt, Human; identical to SEQ ID NO: 411288

SEQ ID NO: 412071 - RNA, 64 nt, Human; identical to SEQ ID NO: 411289

SEQ ID NO: 412072 - RNA, 64 nt, Human; identical to SEQ ID NO: 411290

SEQ ID NO: 412073 - RNA, 64 nt, Human; identical to SEQ ID NO: 411291

SEQ ID NO: 412074 - RNA, 64 nt, Human; identical to SEQ ID NO: 411295

SEQ ID NO: 412075 - RNA, 64 nt, Human; identical to SEQ ID NO: 411296

SEQ ID NO: 412076 - RNA, 64 nt, Human; identical to SEQ ID NO: 411297

SEQ ID NO: 412077 - RNA, 64 nt, Human; identical to SEQ ID NO: 411298

SEQ ID NO: 412078 - RNA, 64 nt, Human; identical to SEQ ID NO: 411299

SEQ ID NO: 412079 - RNA, 64 nt, Human; identical to SEQ ID NO: 411300

SEQ ID NO: 412080 - RNA, 64 nt, Human; identical to SEQ ID NO: 411301

SEQ ID NO: 412081 - RNA, 64 nt, Human; identical to SEQ ID NO: 411302

SEQ ID NO: 412082 - RNA, 64 nt, Human; identical to SEQ ID NO: 411303

SEQ ID NO: 412083 - RNA, 60 nt, Human; identical to SEQ ID NO: 411304

SEQ ID NO: 412084 - RNA, 64 nt, Human; identical to SEQ ID NO: 411305

SEQ ID NO: 412085 - RNA, 64 nt, Human
cccacuuacuguccuaacucuccucgcugacccuaucugggagcccggaaccguuagguacugc

SEQ ID NO: 412086 - RNA, 64 nt, Human
uggggguccuggagacuuaccauugagccaugcaaucugggaagcacaggaauaaguagacacu

SEQ ID NO: 412087 - RNA, 64 nt, Human
aguuauuuggaaacuaugaucugcauccuuaggaaucugggauuugccaguugcuggcaaugua

SEQ ID NO: 412088 - RNA, 64 nt, Human; identical to SEQ ID NO: 411306

SEQ ID NO: 412089 - RNA, 64 nt, Human; identical to SEQ ID NO: 411307

SEQ ID NO: 412090 - RNA, 64 nt, Human; identical to SEQ ID NO: 411308

SEQ ID NO: 412091 - RNA, 64 nt, Human; identical to SEQ ID NO: 411309

SEQ ID NO: 412092 - RNA, 64 nt, Human; identical to SEQ ID NO: 411310

SEQ ID NO: 412093 - RNA, 64 nt, Human; identical to SEQ ID NO: 411314

SEQ ID NO: 412094 - RNA, 64 nt, Human; identical to SEQ ID NO: 411315

SEQ ID NO: 412095 - RNA, 64 nt, Human; identical to SEQ ID NO: 411316

SEQ ID NO: 412096 - RNA, 64 nt, Human; identical to SEQ ID NO: 411317

SEQ ID NO: 412097 - RNA, 64 nt, Human; identical to SEQ ID NO: 411318

SEQ ID NO: 412098 - RNA, 64 nt, Human; identical to SEQ ID NO: 411319

SEQ ID NO: 412099 - RNA, 64 nt, Human; identical to SEQ ID NO: 411320

SEQ ID NO: 412100 - RNA, 64 nt, Human; identical to SEQ ID NO: 411321

SEQ ID NO: 412101 - RNA, 64 nt, Human; identical to SEQ ID NO: 411322

SEQ ID NO: 412102 - RNA, 64 nt, Human; identical to SEQ ID NO: 411323

SEQ ID NO: 412103 - RNA, 64 nt, Human; identical to SEQ ID NO: 411324

SEQ ID NO: 412104 - RNA, 64 nt, Human
aaacuaggugaaaugaaauuaacuaaagguuuuaaucugggauugaaagccugaaagcauuucc

SEQ ID NO: 412105 - RNA, 64 nt, Human
cuccauagaccuucagagaaggugaaaccagguuaucugggaaucuuuccagcccgcaggucgc

SEQ ID NO: 412106 - RNA, 64 nt, Human
caaauuggacucgauuuccuuauaucuaauauauaucugggagaaaaggcugcuugaaaauauc

SEQ ID NO: 412107 - RNA, 64 nt, Human; identical to SEQ ID NO: 411325

SEQ ID NO: 412108 - RNA, 64 nt, Human; identical to SEQ ID NO: 411326

SEQ ID NO: 412109 - RNA, 64 nt, Human; identical to SEQ ID NO: 411327

SEQ ID NO: 412110 - RNA, 54 nt, Human; identical to SEQ ID NO: 411328

SEQ ID NO: 412111 - RNA, 64 nt, Human; identical to SEQ ID NO: 411329

SEQ ID NO: 412112 - RNA, 64 nt, Human; identical to SEQ ID NO: 411333

SEQ ID NO: 412113 - RNA, 64 nt, Human; identical to SEQ ID NO: 411334

SEQ ID NO: 412114 - RNA, 64 nt, Human; identical to SEQ ID NO: 411335

SEQ ID NO: 412115 - RNA, 64 nt, Human; identical to SEQ ID NO: 411336

SEQ ID NO: 412116 - RNA, 64 nt, Human; identical to SEQ ID NO: 411337

SEQ ID NO: 412117 - RNA, 64 nt, Human; identical to SEQ ID NO: 411338

SEQ ID NO: 412118 - RNA, 64 nt, Human; identical to SEQ ID NO: 411339

SEQ ID NO: 412119 - RNA, 64 nt, Human; identical to SEQ ID NO: 411340

SEQ ID NO: 412120 - RNA, 64 nt, Human; identical to SEQ ID NO: 411341

SEQ ID NO: 412121 - RNA, 64 nt, Human; identical to SEQ ID NO: 411342

SEQ ID NO: 412122 - RNA, 64 nt, Human; identical to SEQ ID NO: 411343

SEQ ID NO: 412123 - RNA, 64 nt, Human
accuauuagggaugagauacagacaaggauagcuaucugggacauuauuggcagugggcccugg

SEQ ID NO: 412124 - RNA, 64 nt, Human
uaguuucagauauauaucauauugguauucacuaaucugggaagggaagggcuacugcagcuuu

SEQ ID NO: 412125 - RNA, 64 nt, Human
uuagauaaauguaaucacuguaaacaucuauaugaucugggauuuuguuuuuauuuugaaaugg

SEQ ID NO: 412126 - RNA, 64 nt, Human; identical to SEQ ID NO: 411344

SEQ ID NO: 412127 - RNA, 64 nt, Human; identical to SEQ ID NO: 411345

SEQ ID NO: 412128 - RNA, 56 nt, Human; identical to SEQ ID NO: 411346

SEQ ID NO: 412129 - RNA, 61 nt, Human; identical to SEQ ID NO: 411347

SEQ ID NO: 412130 - RNA, 64 nt, Human; identical to SEQ ID NO: 411348

SEQ ID NO: 412131 - RNA, 64 nt, Human; identical to SEQ ID NO: 411352

SEQ ID NO: 412132 - RNA, 64 nt, Human; identical to SEQ ID NO: 411353

SEQ ID NO: 412133 - RNA, 64 nt, Human; identical to SEQ ID NO: 411354

SEQ ID NO: 412134 - RNA, 64 nt, Human; identical to SEQ ID NO: 411355

SEQ ID NO: 412135 - RNA, 64 nt, Human; identical to SEQ ID NO: 411356

SEQ ID NO: 412136 - RNA, 64 nt, Human; identical to SEQ ID NO: 411357

SEQ ID NO: 412137 - RNA, 64 nt, Human; identical to SEQ ID NO: 411358

SEQ ID NO: 412138 - RNA, 64 nt, Human; identical to SEQ ID NO: 411359

SEQ ID NO: 412139 - RNA, 64 nt, Human; identical to SEQ ID NO: 411360

SEQ ID NO: 412140 - RNA, 64 nt, Human; identical to SEQ ID NO: 411361

SEQ ID NO: 412141 - RNA, 63 nt, Human; identical to SEQ ID NO: 411362

SEQ ID NO: 412142 - RNA, 64 nt, Human
aagucgaugaacuauuccccagcagggucuuuucaucugggaaagacauccauaaagaagcaau

SEQ ID NO: 412143 - RNA, 64 nt, Human
ugucgucuucugccgugugccagaugagcuugugaucugggaagccggggcacccccguuuugu

SEQ ID NO: 412144 - RNA, 64 nt, Human
gaacuugauucccuuacaguucuggaggcuggaaaucugggauggagguguuggcagggcugug

SEQ ID NO: 412145 - RNA, 64 nt, Human; identical to SEQ ID NO: 411363

SEQ ID NO: 412146 - RNA, 64 nt, Human; identical to SEQ ID NO: 411364

SEQ ID NO: 412147 - RNA, 64 nt, Human; identical to SEQ ID NO: 411365

SEQ ID NO: 412148 - RNA, 64 nt, Human; identical to SEQ ID NO: 411366

SEQ ID NO: 412149 - RNA, 64 nt, Human; identical to SEQ ID NO: 411367

SEQ ID NO: 412150 - RNA, 64 nt, Human; identical to SEQ ID NO: 411371

SEQ ID NO: 412151 - RNA, 64 nt, Human; identical to SEQ ID NO: 411372

SEQ ID NO: 412152 - RNA, 64 nt, Human; identical to SEQ ID NO: 411373

SEQ ID NO: 412153 - RNA, 64 nt, Human; identical to SEQ ID NO: 411374

SEQ ID NO: 412154 - RNA, 64 nt, Human; identical to SEQ ID NO: 411375

SEQ ID NO: 412155 - RNA, 64 nt, Human; identical to SEQ ID NO: 411376

SEQ ID NO: 412156 - RNA, 64 nt, Human; identical to SEQ ID NO: 411377

SEQ ID NO: 412157 - RNA, 64 nt, Human; identical to SEQ ID NO: 411378

SEQ ID NO: 412158 - RNA, 64 nt, Human; identical to SEQ ID NO: 411379

SEQ ID NO: 412159 - RNA, 64 nt, Human; identical to SEQ ID NO: 411380

SEQ ID NO: 412160 - RNA, 64 nt, Human; identical to SEQ ID NO: 411381

SEQ ID NO: 412161 - RNA, 64 nt, Human
gauucagccaucugcgcccaggccacgugucccgaucugggauuagaaaauauggguccauucc

SEQ ID NO: 412162 - RNA, 64 nt, Human
cugccaccaagagacagcaaugacauguacagccaucugggacaugccugucuuccuaauacca

SEQ ID NO: 412163 - RNA, 64 nt, Human
uacuuaaagagaaaagcauaagagcaugaagcauaucugggaauaucuuuugccuuuaagacga

SEQ ID NO: 412164 - RNA, 64 nt, Human; identical to SEQ ID NO: 411382

SEQ ID NO: 412165 - RNA, 64 nt, Human; identical to SEQ ID NO: 411383

SEQ ID NO: 412166 - RNA, 64 nt, Human; identical to SEQ ID NO: 411384

SEQ ID NO: 412167 - RNA, 64 nt, Human; identical to SEQ ID NO: 411385

SEQ ID NO: 412168 - RNA, 64 nt, Human; identical to SEQ ID NO: 411386

SEQ ID NO: 412169 - RNA, 64 nt, Human; identical to SEQ ID NO: 411390

SEQ ID NO: 412170 - RNA, 64 nt, Human; identical to SEQ ID NO: 411391

SEQ ID NO: 412171 - RNA, 64 nt, Human; identical to SEQ ID NO: 411392

SEQ ID NO: 412172 - RNA, 64 nt, Human; identical to SEQ ID NO: 411393

SEQ ID NO: 412173 - RNA, 64 nt, Human; identical to SEQ ID NO: 411394

SEQ ID NO: 412174 - RNA, 64 nt, Human; identical to SEQ ID NO: 411395

SEQ ID NO: 412175 - RNA, 64 nt, Human; identical to SEQ ID NO: 411396

SEQ ID NO: 412176 - RNA, 64 nt, Human; identical to SEQ ID NO: 411397

SEQ ID NO: 412177 - RNA, 64 nt, Human; identical to SEQ ID NO: 411398

SEQ ID NO: 412178 - RNA, 64 nt, Human; identical to SEQ ID NO: 411399

SEQ ID NO: 412179 - RNA, 64 nt, Human; identical to SEQ ID NO: 411400

SEQ ID NO: 412180 - RNA, 64 nt, Human
accauucauucugaagauugcauggaggaugaacaucugggaauccuguuaaugagaaggcuga

SEQ ID NO: 412181 - RNA, 64 nt, Human
guccuugugaugauucugagccuggcacucccaaaucugggaagcauaguuuauuugcaagugu

SEQ ID NO: 412182 - RNA, 64 nt, Human
ggcaccacagugagcauuguguucuuggcaugugaucugggaaacugauugaauaauacacuuu

SEQ ID NO: 412183 - RNA, 64 nt, Human; identical to SEQ ID NO: 411401

SEQ ID NO: 412184 - RNA, 57 nt, Human; identical to SEQ ID NO: 411402

SEQ ID NO: 412185 - RNA, 64 nt, Human; identical to SEQ ID NO: 411403

SEQ ID NO: 412186 - RNA, 64 nt, Human; identical to SEQ ID NO: 411404

SEQ ID NO: 412187 - RNA, 64 nt, Human; identical to SEQ ID NO: 411405

SEQ ID NO: 412188 - RNA, 64 nt, Human; identical to SEQ ID NO: 411409

SEQ ID NO: 412189 - RNA, 64 nt, Human; identical to SEQ ID NO: 411410

SEQ ID NO: 412190 - RNA, 64 nt, Human; identical to SEQ ID NO: 411411

SEQ ID NO: 412191 - RNA, 64 nt, Human; identical to SEQ ID NO: 411412

SEQ ID NO: 412192 - RNA, 64 nt, Human; identical to SEQ ID NO: 411413

SEQ ID NO: 412193 - RNA, 64 nt, Human; identical to SEQ ID NO: 411414

SEQ ID NO: 412194 - RNA, 64 nt, Human; identical to SEQ ID NO: 411415

SEQ ID NO: 412195 - RNA, 64 nt, Human; identical to SEQ ID NO: 411416

SEQ ID NO: 412196 - RNA, 64 nt, Human; identical to SEQ ID NO: 411417

SEQ ID NO: 412197 - RNA, 64 nt, Human; identical to SEQ ID NO: 411418

SEQ ID NO: 412198 - RNA, 57 nt, Human; identical to SEQ ID NO: 411419

SEQ ID NO: 412199 - RNA, 64 nt, Human
ugcaugcugugcuuuuucacauuugcucuggguuaucugggaaguaucagguucugggaggcaa

SEQ ID NO: 412200 - RNA, 64 nt, Human
auuguccaguuaagugaucaccaaaggacugagaaucugggagggcaaaaaaaaaaaaaaaguu

SEQ ID NO: 412201 - RNA, 64 nt, Human
uaagggaacuauggaaagguuuggauuucuccaaaucugggagaauuuucaaaauaagaaaaua

SEQ ID NO: 412202 - RNA, 64 nt, Human; identical to SEQ ID NO: 411420

SEQ ID NO: 412203 - RNA, 64 nt, Human; identical to SEQ ID NO: 411421

SEQ ID NO: 412204 - RNA, 64 nt, Human; identical to SEQ ID NO: 411422

SEQ ID NO: 412205 - RNA, 64 nt, Human; identical to SEQ ID NO: 411423

SEQ ID NO: 412206 - RNA, 64 nt, Human; identical to SEQ ID NO: 411424

SEQ ID NO: 412207 - RNA, 64 nt, Human; identical to SEQ ID NO: 411428

SEQ ID NO: 412208 - RNA, 64 nt, Human; identical to SEQ ID NO: 411429

SEQ ID NO: 412209 - RNA, 64 nt, Human; identical to SEQ ID NO: 411430

SEQ ID NO: 412210 - RNA, 64 nt, Human; identical to SEQ ID NO: 411431

SEQ ID NO: 412211 - RNA, 64 nt, Human; identical to SEQ ID NO: 411432

SEQ ID NO: 412212 - RNA, 64 nt, Human; identical to SEQ ID NO: 411433

SEQ ID NO: 412213 - RNA, 64 nt, Human; identical to SEQ ID NO: 411434

SEQ ID NO: 412214 - RNA, 64 nt, Human; identical to SEQ ID NO: 411435

SEQ ID NO: 412215 - RNA, 64 nt, Human; identical to SEQ ID NO: 411436

SEQ ID NO: 412216 - RNA, 64 nt, Human; identical to SEQ ID NO: 411437

SEQ ID NO: 412217 - RNA, 64 nt, Human; identical to SEQ ID NO: 411438

SEQ ID NO: 412218 - RNA, 64 nt, Human
ugccaagcugcggggaaggguccugagcaggggcaucugggaggcucuggcugccuucugcauu

SEQ ID NO: 412219 - RNA, 64 nt, Human
aguucuccuccacaucucccaucccagaaucaggaucugggacuggcaggguccccuccugugu

SEQ ID NO: 412220 - RNA, 64 nt, Human
ugcagcaacacagaauguaauauaaggcaaaugcaucugggacuugaccaaaguuguucuguuu

SEQ ID NO: 412221 - RNA, 64 nt, Human; identical to SEQ ID NO: 411439

SEQ ID NO: 412222 - RNA, 64 nt, Human; identical to SEQ ID NO: 411440

SEQ ID NO: 412223 - RNA, 64 nt, Human; identical to SEQ ID NO: 411441

SEQ ID NO: 412224 - RNA, 58 nt, Human; identical to SEQ ID NO: 411442

SEQ ID NO: 412225 - RNA, 64 nt, Human; identical to SEQ ID NO: 411443

SEQ ID NO: 412226 - RNA, 64 nt, Human; identical to SEQ ID NO: 411447

SEQ ID NO: 412227 - RNA, 64 nt, Human; identical to SEQ ID NO: 411448

SEQ ID NO: 412228 - RNA, 64 nt, Human; identical to SEQ ID NO: 411449

SEQ ID NO: 412229 - RNA, 64 nt, Human; identical to SEQ ID NO: 411450

SEQ ID NO: 412230 - RNA, 64 nt, Human; identical to SEQ ID NO: 411451

SEQ ID NO: 412231 - RNA, 64 nt, Human; identical to SEQ ID NO: 411452

SEQ ID NO: 412232 - RNA, 64 nt, Human; identical to SEQ ID NO: 411453

SEQ ID NO: 412233 - RNA, 64 nt, Human; identical to SEQ ID NO: 411454

SEQ ID NO: 412234 - RNA, 64 nt, Human; identical to SEQ ID NO: 411455

SEQ ID NO: 412235 - RNA, 64 nt, Human; identical to SEQ ID NO: 411456

SEQ ID NO: 412236 - RNA, 64 nt, Human; identical to SEQ ID NO: 411457

SEQ ID NO: 412237 - RNA, 64 nt, Human
agaagaaggaagaaucagcccagcagguaugggcaucugggaaaccuccagccucaaguguguu

SEQ ID NO: 412238 - RNA, 64 nt, Human
ccuuuuucucccaaaaaaucuuuaaguaaagaugaucugggaaaaugugccauguuuauccugu

SEQ ID NO: 412239 - RNA, 64 nt, Human
gagcuggaguuggggagaggucuggaagaggaccaucugggauuucuacagccuggguacccau

SEQ ID NO: 412240 - RNA, 64 nt, Human; identical to SEQ ID NO: 411458

SEQ ID NO: 412241 - RNA, 64 nt, Human; identical to SEQ ID NO: 411459

SEQ ID NO: 412242 - RNA, 51 nt, Human; identical to SEQ ID NO: 411460

SEQ ID NO: 412243 - RNA, 64 nt, Human; identical to SEQ ID NO: 411461

SEQ ID NO: 412244 - RNA, 64 nt, Human; identical to SEQ ID NO: 411462

SEQ ID NO: 412245 - RNA, 64 nt, Human; identical to SEQ ID NO: 411466

SEQ ID NO: 412246 - RNA, 64 nt, Human; identical to SEQ ID NO: 411467

SEQ ID NO: 412247 - RNA, 64 nt, Human; identical to SEQ ID NO: 411468

SEQ ID NO: 412248 - RNA, 64 nt, Human; identical to SEQ ID NO: 411469

SEQ ID NO: 412249 - RNA, 64 nt, Human; identical to SEQ ID NO: 411470

SEQ ID NO: 412250 - RNA, 64 nt, Human; identical to SEQ ID NO: 411471

SEQ ID NO: 412251 - RNA, 64 nt, Human; identical to SEQ ID NO: 411472

SEQ ID NO: 412252 - RNA, 64 nt, Human; identical to SEQ ID NO: 411473

SEQ ID NO: 412253 - RNA, 64 nt, Human; identical to SEQ ID NO: 411474

SEQ ID NO: 412254 - RNA, 64 nt, Human
cauggcugcagguaccuugauagcccacagagagaucugggaaggaagggcuccuccucaggcu

SEQ ID NO: 412255 - RNA, 64 nt, Human
gaugaauacuucgacugugacauacaaguccauuaucugggaugcaaccacucaacaacuaucc

SEQ ID NO: 412256 - RNA, 64 nt, Human
caaacaugaauguacauuuucuaacaaacucaaaaucugggaccaaaacaucaacuuuuuucuu

SEQ ID NO: 412257 - RNA, 64 nt, Human; identical to SEQ ID NO: 411475

SEQ ID NO: 412258 - RNA, 64 nt, Human; identical to SEQ ID NO: 411480

SEQ ID NO: 412259 - RNA, 64 nt, Human; identical to SEQ ID NO: 411481

SEQ ID NO: 412260 - RNA, 64 nt, Human; identical to SEQ ID NO: 411482

SEQ ID NO: 412261 - RNA, 64 nt, Human; identical to SEQ ID NO: 411483

SEQ ID NO: 412262 - RNA, 64 nt, Human; identical to SEQ ID NO: 411484

SEQ ID NO: 412263 - RNA, 64 nt, Human; identical to SEQ ID NO: 411485

SEQ ID NO: 412264 - RNA, 64 nt, Human; identical to SEQ ID NO: 411486

SEQ ID NO: 412265 - RNA, 64 nt, Human; identical to SEQ ID NO: 411487

SEQ ID NO: 412266 - RNA, 64 nt, Human; identical to SEQ ID NO: 411488

SEQ ID NO: 412267 - RNA, 64 nt, Human; identical to SEQ ID NO: 411489

SEQ ID NO: 412268 - RNA, 64 nt, Human; identical to SEQ ID NO: 411490

SEQ ID NO: 412269 - RNA, 64 nt, Human
ugauuuguccauuucuuucccugcacuuuguuacaucugggauacagucuaacucaucugauuu

SEQ ID NO: 412270 - RNA, 64 nt, Human
gaguacuaauaugcaauuaugaaaauuauauuaaaucugggauuaugacgguaucacuguauca

SEQ ID NO: 412271 - RNA, 64 nt, Human
acacccucauggaaggagaaaagcauacuauuauaucugggaccucucuuuuagaccuaaaauu

SEQ ID NO: 412272 - RNA, 64 nt, Human
cugaucguagaaaauuugcuuuaauuaauuaaguaucugggauuauucuuugaaaacagaugac

SEQ ID NO: 412273 - RNA, 64 nt, Human; identical to SEQ ID NO: 411491

SEQ ID NO: 412274 - RNA, 64 nt, Human; identical to SEQ ID NO: 411492

SEQ ID NO: 412275 - RNA, 64 nt, Human; identical to SEQ ID NO: 411493

SEQ ID NO: 412276 - RNA, 64 nt, Human; identical to SEQ ID NO: 411494

SEQ ID NO: 412277 - RNA, 64 nt, Human; identical to SEQ ID NO: 411495

SEQ ID NO: 412278 - RNA, 64 nt, Human; identical to SEQ ID NO: 411499

SEQ ID NO: 412279 - RNA, 64 nt, Human; identical to SEQ ID NO: 411500

SEQ ID NO: 412280 - RNA, 64 nt, Human; identical to SEQ ID NO: 411501

SEQ ID NO: 412281 - RNA, 64 nt, Human; identical to SEQ ID NO: 411502

SEQ ID NO: 412282 - RNA, 64 nt, Human; identical to SEQ ID NO: 411503

SEQ ID NO: 412283 - RNA, 64 nt, Human; identical to SEQ ID NO: 411504

SEQ ID NO: 412284 - RNA, 64 nt, Human; identical to SEQ ID NO: 411505

SEQ ID NO: 412285 - RNA, 64 nt, Human; identical to SEQ ID NO: 411506

SEQ ID NO: 412286 - RNA, 64 nt, Human; identical to SEQ ID NO: 411507

SEQ ID NO: 412287 - RNA, 64 nt, Human; identical to SEQ ID NO: 411508

SEQ ID NO: 412288 - RNA, 64 nt, Human; identical to SEQ ID NO: 411509

SEQ ID NO: 412289 - RNA, 64 nt, Human
agcccaggugggcacagagaaggguggagagagaaucugggaagagaaauggagaauaagcagc

SEQ ID NO: 412290 - RNA, 64 nt, Human
ugaauggaccugcaggguaaacuugggugccuccaucugggaaagcugaugauguguucaugca

SEQ ID NO: 412291 - RNA, 64 nt, Human
uuauuccucaaaaaauugcacauaguagaacgcuaucugggaagcuauuuuuuucaguuuugau

SEQ ID NO: 412292 - RNA, 64 nt, Human; identical to SEQ ID NO: 411510

SEQ ID NO: 412293 - RNA, 64 nt, Human; identical to SEQ ID NO: 411511

SEQ ID NO: 412294 - RNA, 64 nt, Human; identical to SEQ ID NO: 411512

SEQ ID NO: 412295 - RNA, 64 nt, Human; identical to SEQ ID NO: 411513

SEQ ID NO: 412296 - RNA, 64 nt, Human; identical to SEQ ID NO: 411514

SEQ ID NO: 412297 - RNA, 64 nt, Human; identical to SEQ ID NO: 411518

SEQ ID NO: 412298 - RNA, 64 nt, Human; identical to SEQ ID NO: 411519

SEQ ID NO: 412299 - RNA, 64 nt, Human; identical to SEQ ID NO: 411520

SEQ ID NO: 412300 - RNA, 64 nt, Human; identical to SEQ ID NO: 411521

SEQ ID NO: 412301 - RNA, 64 nt, Human; identical to SEQ ID NO: 411522

SEQ ID NO: 412302 - RNA, 64 nt, Human; identical to SEQ ID NO: 411523

SEQ ID NO: 412303 - RNA, 64 nt, Human; identical to SEQ ID NO: 411524

SEQ ID NO: 412304 - RNA, 64 nt, Human; identical to SEQ ID NO: 411525

SEQ ID NO: 412305 - RNA, 64 nt, Human; identical to SEQ ID NO: 411526

SEQ ID NO: 412306 - RNA, 64 nt, Human; identical to SEQ ID NO: 411527

SEQ ID NO: 412307 - RNA, 64 nt, Human; identical to SEQ ID NO: 411528

SEQ ID NO: 412308 - RNA, 64 nt, Human
gucuagugaaucagaaaggcuuagccaaggccacaucugggaagaguggagaaauuugccacuu

SEQ ID NO: 412309 - RNA, 64 nt, Human
guucaagcgauucuccugccucagccuccagaguaucugggacuacaguugcaugucaccacgu

SEQ ID NO: 412310 - RNA, 64 nt, Human
guacccaauagcugcccauuucgugagccccaucuucacccaggccuauguugauccauccagc

SEQ ID NO: 412311 - RNA, 64 nt, Human; identical to SEQ ID NO: 411529

SEQ ID NO: 412312 - RNA, 64 nt, Human; identical to SEQ ID NO: 411530

SEQ ID NO: 412313 - RNA, 64 nt, Human; identical to SEQ ID NO: 411531

SEQ ID NO: 412314 - RNA, 64 nt, Human; identical to SEQ ID NO: 411532

SEQ ID NO: 412315 - RNA, 59 nt, Human; identical to SEQ ID NO: 411533

SEQ ID NO: 412316 - RNA, 64 nt, Human; identical to SEQ ID NO: 411537

SEQ ID NO: 412317 - RNA, 64 nt, Human; identical to SEQ ID NO: 411538

SEQ ID NO: 412318 - RNA, 64 nt, Human; identical to SEQ ID NO: 411539

SEQ ID NO: 412319 - RNA, 64 nt, Human; identical to SEQ ID NO: 411540

SEQ ID NO: 412320 - RNA, 64 nt, Human; identical to SEQ ID NO: 411541

SEQ ID NO: 412321 - RNA, 64 nt, Human; identical to SEQ ID NO: 411542

SEQ ID NO: 412322 - RNA, 64 nt, Human; identical to SEQ ID NO: 411543

SEQ ID NO: 412323 - RNA, 64 nt, Human; identical to SEQ ID NO: 411544

SEQ ID NO: 412324 - RNA, 64 nt, Human; identical to SEQ ID NO: 411545

SEQ ID NO: 412325 - RNA, 64 nt, Human; identical to SEQ ID NO: 411546

SEQ ID NO: 412326 - RNA, 64 nt, Human; identical to SEQ ID NO: 411547

SEQ ID NO: 412327 - RNA, 64 nt, Human
cccacucccuguccauccccaguuggggcugcgaccgccagauucucccuuaaggaauugacuu

SEQ ID NO: 412328 - RNA, 64 nt, Human; identical to SEQ ID NO: 409072

SEQ ID NO: 412329 - RNA, 64 nt, Human
uccaccagcgccugccucggccccuccucugcccccgccagaucccguggugcuggggaugggg

SEQ ID NO: 412330 - RNA, 64 nt, Human; identical to SEQ ID NO: 411548

SEQ ID NO: 412331 - RNA, 64 nt, Human; identical to SEQ ID NO: 411549

SEQ ID NO: 412332 - RNA, 64 nt, Human; identical to SEQ ID NO: 411550

SEQ ID NO: 412333 - RNA, 64 nt, Human; identical to SEQ ID NO: 411551

SEQ ID NO: 412334 - RNA, 64 nt, Human; identical to SEQ ID NO: 411552

SEQ ID NO: 412335 - RNA, 64 nt, Human; identical to SEQ ID NO: 411556

SEQ ID NO: 412336 - RNA, 64 nt, Human; identical to SEQ ID NO: 411557

SEQ ID NO: 412337 - RNA, 64 nt, Human; identical to SEQ ID NO: 411558

SEQ ID NO: 412338 - RNA, 64 nt, Human; identical to SEQ ID NO: 411559

SEQ ID NO: 412339 - RNA, 64 nt, Human; identical to SEQ ID NO: 411560

SEQ ID NO: 412340 - RNA, 64 nt, Human; identical to SEQ ID NO: 411561

SEQ ID NO: 412341 - RNA, 64 nt, Human; identical to SEQ ID NO: 411562

SEQ ID NO: 412342 - RNA, 64 nt, Human; identical to SEQ ID NO: 411563

SEQ ID NO: 412343 - RNA, 64 nt, Human; identical to SEQ ID NO: 411564

SEQ ID NO: 412344 - RNA, 64 nt, Human; identical to SEQ ID NO: 411565

SEQ ID NO: 412345 - RNA, 64 nt, Human; identical to SEQ ID NO: 411566

SEQ ID NO: 412346 - RNA, 64 nt, Human
cagcuguaaggaccgggggucucccuccucacuaccgccagacaccccgguggaagcauuuaga

SEQ ID NO: 412347 - RNA, 64 nt, Human
agcaggauguuggcgaacugacaaacucugucugccgccagaaggaaugcugggggcagucaug

SEQ ID NO: 412348 - RNA, 64 nt, Human; identical to SEQ ID NO: 409073

SEQ ID NO: 412349 - RNA, 64 nt, Human; identical to SEQ ID NO: 411567

SEQ ID NO: 412350 - RNA, 64 nt, Human; identical to SEQ ID NO: 411568

SEQ ID NO: 412351 - RNA, 62 nt, Human; identical to SEQ ID NO: 411569

SEQ ID NO: 412352 - RNA, 64 nt, Human; identical to SEQ ID NO: 411570

SEQ ID NO: 412353 - RNA, 64 nt, Human; identical to SEQ ID NO: 411571

SEQ ID NO: 412354 - RNA, 50 nt, Human; identical to SEQ ID NO: 411575

SEQ ID NO: 412355 - RNA, 64 nt, Human; identical to SEQ ID NO: 411576

SEQ ID NO: 412356 - RNA, 64 nt, Human; identical to SEQ ID NO: 411577

SEQ ID NO: 412357 - RNA, 64 nt, Human; identical to SEQ ID NO: 411578

SEQ ID NO: 412358 - RNA, 64 nt, Human; identical to SEQ ID NO: 411579

SEQ ID NO: 412359 - RNA, 64 nt, Human; identical to SEQ ID NO: 411580

SEQ ID NO: 412360 - RNA, 64 nt, Human; identical to SEQ ID NO: 411581

SEQ ID NO: 412361 - RNA, 64 nt, Human; identical to SEQ ID NO: 411582

SEQ ID NO: 412362 - RNA, 64 nt, Human; identical to SEQ ID NO: 411583

SEQ ID NO: 412363 - RNA, 64 nt, Human; identical to SEQ ID NO: 411584

SEQ ID NO: 412364 - RNA, 64 nt, Human; identical to SEQ ID NO: 411585

SEQ ID NO: 412365 - RNA, 64 nt, Human; identical to SEQ ID NO: 409074

SEQ ID NO: 412366 - RNA, 64 nt, Human
cacagccuccuucgaggcugugcugggugcagaaccgccagagccacccaaaagguguuucucu

SEQ ID NO: 412367 - RNA, 64 nt, Human
gccuagagaggccgcaaggggaccgccccaggcaccgccagaguguccugcuaccuuugucuca

SEQ ID NO: 412368 - RNA, 64 nt, Human; identical to SEQ ID NO: 411586

SEQ ID NO: 412369 - RNA, 64 nt, Human; identical to SEQ ID NO: 411587

SEQ ID NO: 412370 - RNA, 64 nt, Human; identical to SEQ ID NO: 411588

SEQ ID NO: 412371 - RNA, 64 nt, Human; identical to SEQ ID NO: 411589

SEQ ID NO: 412372 - RNA, 64 nt, Human; identical to SEQ ID NO: 411590

SEQ ID NO: 412373 - RNA, 64 nt, Human; identical to SEQ ID NO: 411594

SEQ ID NO: 412374 - RNA, 64 nt, Human; identical to SEQ ID NO: 411595

SEQ ID NO: 412375 - RNA, 64 nt, Human; identical to SEQ ID NO: 411596

SEQ ID NO: 412376 - RNA, 64 nt, Human; identical to SEQ ID NO: 411597

SEQ ID NO: 412377 - RNA, 64 nt, Human; identical to SEQ ID NO: 411598

SEQ ID NO: 412378 - RNA, 64 nt, Human; identical to SEQ ID NO: 411599

SEQ ID NO: 412379 - RNA, 64 nt, Human; identical to SEQ ID NO: 411600

SEQ ID NO: 412380 - RNA, 64 nt, Human; identical to SEQ ID NO: 411601

SEQ ID NO: 412381 - RNA, 64 nt, Human; identical to SEQ ID NO: 411602

SEQ ID NO: 412382 - RNA, 64 nt, Human; identical to SEQ ID NO: 411603

SEQ ID NO: 412383 - RNA, 64 nt, Human; identical to SEQ ID NO: 411604

SEQ ID NO: 412384 - RNA, 64 nt, Human
uuacuaaaagucuucauacagaguacaagugcagccgccagaggagaaaauugagauucuugac

SEQ ID NO: 412385 - RNA, 64 nt, Human
gcgggggcggaggggugguucuuuuccuucuccuccgccagaggccacgggcgcccuuguuccc

SEQ ID NO: 412386 - RNA, 64 nt, Human
caccaucuccauccgcucucacgccuccugcaggaucugggagugaggguggagagucuuuccu

SEQ ID NO: 412387 - RNA, 64 nt, Human; identical to SEQ ID NO: 411605

SEQ ID NO: 412388 - RNA, 64 nt, Human; identical to SEQ ID NO: 411606

SEQ ID NO: 412389 - RNA, 64 nt, Human; identical to SEQ ID NO: 411607

SEQ ID NO: 412390 - RNA, 64 nt, Human; identical to SEQ ID NO: 411608

SEQ ID NO: 412391 - RNA, 64 nt, Human; identical to SEQ ID NO: 411609

SEQ ID NO: 412392 - RNA, 64 nt, Human; identical to SEQ ID NO: 411613

SEQ ID NO: 412393 - RNA, 64 nt, Human; identical to SEQ ID NO: 411614

SEQ ID NO: 412394 - RNA, 64 nt, Human; identical to SEQ ID NO: 411615

SEQ ID NO: 412395 - RNA, 64 nt, Human; identical to SEQ ID NO: 411616

SEQ ID NO: 412396 - RNA, 64 nt, Human; identical to SEQ ID NO: 411617

SEQ ID NO: 412397 - RNA, 64 nt, Human; identical to SEQ ID NO: 411618

SEQ ID NO: 412398 - RNA, 64 nt, Human; identical to SEQ ID NO: 411619

SEQ ID NO: 412399 - RNA, 64 nt, Human; identical to SEQ ID NO: 411620

SEQ ID NO: 412400 - RNA, 64 nt, Human; identical to SEQ ID NO: 411621

SEQ ID NO: 412401 - RNA, 64 nt, Human; identical to SEQ ID NO: 411622

SEQ ID NO: 412402 - RNA, 64 nt, Human; identical to SEQ ID NO: 411623

SEQ ID NO: 412403 - RNA, 64 nt, Human
uaucuccgagagcagcgacuaaguucaggcccagccgccagaccucagagaucucaccagcggg

SEQ ID NO: 412404 - RNA, 64 nt, Human; identical to SEQ ID NO: 409075

SEQ ID NO: 412405 - RNA, 64 nt, Human; identical to SEQ ID NO: 412403

SEQ ID NO: 412406 - RNA, 64 nt, Human; identical to SEQ ID NO: 411624

SEQ ID NO: 412407 - RNA, 64 nt, Human; identical to SEQ ID NO: 411625

SEQ ID NO: 412408 - RNA, 64 nt, Human; identical to SEQ ID NO: 411626

SEQ ID NO: 412409 - RNA, 64 nt, Human; identical to SEQ ID NO: 411627

SEQ ID NO: 412410 - RNA, 64 nt, Human; identical to SEQ ID NO: 411628

SEQ ID NO: 412411 - RNA, 64 nt, Human; identical to SEQ ID NO: 411632

SEQ ID NO: 412412 - RNA, 64 nt, Human; identical to SEQ ID NO: 411633

SEQ ID NO: 412413 - RNA, 64 nt, Human; identical to SEQ ID NO: 411634

SEQ ID NO: 412414 - RNA, 64 nt, Human; identical to SEQ ID NO: 411635

SEQ ID NO: 412415 - RNA, 64 nt, Human; identical to SEQ ID NO: 411636

SEQ ID NO: 412416 - RNA, 64 nt, Human; identical to SEQ ID NO: 411637

SEQ ID NO: 412417 - RNA, 64 nt, Human; identical to SEQ ID NO: 411638

SEQ ID NO: 412418 - RNA, 64 nt, Human; identical to SEQ ID NO: 411639

SEQ ID NO: 412419 - RNA, 64 nt, Human; identical to SEQ ID NO: 411640

SEQ ID NO: 412420 - RNA, 64 nt, Human; identical to SEQ ID NO: 411641

SEQ ID NO: 412421 - RNA, 64 nt, Human; identical to SEQ ID NO: 411642

SEQ ID NO: 412422 - RNA, 62 nt, Human; identical to SEQ ID NO: 174733

SEQ ID NO: 412423 - RNA, 64 nt, Human
ucaccagaggaugccaccuccgcccccacccccgccgccagaggaguacaagagccagaggccc

SEQ ID NO: 412424 - RNA, 64 nt, Human; identical to SEQ ID NO: 411643

SEQ ID NO: 412425 - RNA, 64 nt, Human; identical to SEQ ID NO: 411644

SEQ ID NO: 412426 - RNA, 64 nt, Human; identical to SEQ ID NO: 411645

SEQ ID NO: 412427 - RNA, 64 nt, Human; identical to SEQ ID NO: 411646

SEQ ID NO: 412428 - RNA, 64 nt, Human; identical to SEQ ID NO: 411647

SEQ ID NO: 412429 - RNA, 64 nt, Human; identical to SEQ ID NO: 411651

SEQ ID NO: 412430 - RNA, 64 nt, Human; identical to SEQ ID NO: 411652

SEQ ID NO: 412431 - RNA, 64 nt, Human; identical to SEQ ID NO: 411653

SEQ ID NO: 412432 - RNA, 64 nt, Human; identical to SEQ ID NO: 411654

SEQ ID NO: 412433 - RNA, 64 nt, Human; identical to SEQ ID NO: 411655

SEQ ID NO: 412434 - RNA, 64 nt, Human; identical to SEQ ID NO: 411656

SEQ ID NO: 412435 - RNA, 64 nt, Human; identical to SEQ ID NO: 411657

SEQ ID NO: 412436 - RNA, 64 nt, Human; identical to SEQ ID NO: 411658

SEQ ID NO: 412437 - RNA, 64 nt, Human; identical to SEQ ID NO: 411659

SEQ ID NO: 412438 - RNA, 64 nt, Human; identical to SEQ ID NO: 411660

SEQ ID NO: 412439 - RNA, 64 nt, Human; identical to SEQ ID NO: 411661

SEQ ID NO: 412440 - RNA, 64 nt, Human
ucugcuucgagugcgugcggggccgcuaugaggcccgccagaggaagugccccaagugcaacgc

SEQ ID NO: 412441 - RNA, 64 nt, Human; identical to SEQ ID NO: 409053

SEQ ID NO: 412442 - RNA, 64 nt, Human
ugagcaucugggcgccgggacgcugcagugauccccgccagagccugugcccuuccugcuccgu

SEQ ID NO: 412443 - RNA, 64 nt, Human; identical to SEQ ID NO: 411662

SEQ ID NO: 412444 - RNA, 64 nt, Human; identical to SEQ ID NO: 411663

SEQ ID NO: 412445 - RNA, 64 nt, Human; identical to SEQ ID NO: 411664

SEQ ID NO: 412446 - RNA, 64 nt, Human; identical to SEQ ID NO: 411665

SEQ ID NO: 412447 - RNA, 64 nt, Human; identical to SEQ ID NO: 411666

SEQ ID NO: 412448 - RNA, 64 nt, Human; identical to SEQ ID NO: 411670

SEQ ID NO: 412449 - RNA, 64 nt, Human; identical to SEQ ID NO: 411671

SEQ ID NO: 412450 - RNA, 64 nt, Human; identical to SEQ ID NO: 411672

SEQ ID NO: 412451 - RNA, 64 nt, Human; identical to SEQ ID NO: 411673

SEQ ID NO: 412452 - RNA, 64 nt, Human; identical to SEQ ID NO: 411674

SEQ ID NO: 412453 - RNA, 64 nt, Human; identical to SEQ ID NO: 411675

SEQ ID NO: 412454 - RNA, 64 nt, Human; identical to SEQ ID NO: 411676

SEQ ID NO: 412455 - RNA, 64 nt, Human; identical to SEQ ID NO: 411677

SEQ ID NO: 412456 - RNA, 64 nt, Human; identical to SEQ ID NO: 411678

SEQ ID NO: 412457 - RNA, 58 nt, Human; identical to SEQ ID NO: 411679

SEQ ID NO: 412458 - RNA, 64 nt, Human; identical to SEQ ID NO: 411680

SEQ ID NO: 412459 - RNA, 64 nt, Human
cagugguccccaaauuuugcuacauauuagaaucaucugggagguuuuaaacaaauucugaugc

SEQ ID NO: 412460 - RNA, 64 nt, Human
ugagcccucuaccuggguucgggucaggagcuccaucugggaacuaacagcugcuaaccugacc

SEQ ID NO: 412461 - RNA, 64 nt, Human
guaggucaucagguucacuuauuauccgaccuuaaucugggauaaagguuuugguauuugccca

SEQ ID NO: 412462 - RNA, 64 nt, Human; identical to SEQ ID NO: 411681

SEQ ID NO: 412463 - RNA, 64 nt, Human; identical to SEQ ID NO: 411682

SEQ ID NO: 412464 - RNA, 64 nt, Human; identical to SEQ ID NO: 411683

SEQ ID NO: 412465 - RNA, 64 nt, Human; identical to SEQ ID NO: 411684

SEQ ID NO: 412466 - RNA, 64 nt, Human; identical to SEQ ID NO: 411685

SEQ ID NO: 412467 - RNA, 64 nt, Human; identical to SEQ ID NO: 411689

SEQ ID NO: 412468 - RNA, 64 nt, Human; identical to SEQ ID NO: 411690

SEQ ID NO: 412469 - RNA, 64 nt, Human; identical to SEQ ID NO: 411691

SEQ ID NO: 412470 - RNA, 64 nt, Human; identical to SEQ ID NO: 411692

SEQ ID NO: 412471 - RNA, 64 nt, Human; identical to SEQ ID NO: 411693

SEQ ID NO: 412472 - RNA, 64 nt, Human; identical to SEQ ID NO: 411694

SEQ ID NO: 412473 - RNA, 64 nt, Human; identical to SEQ ID NO: 411695

SEQ ID NO: 412474 - RNA, 64 nt, Human; identical to SEQ ID NO: 411696

SEQ ID NO: 412475 - RNA, 64 nt, Human; identical to SEQ ID NO: 411697

SEQ ID NO: 412476 - RNA, 64 nt, Human; identical to SEQ ID NO: 411698

SEQ ID NO: 412477 - RNA, 64 nt, Human; identical to SEQ ID NO: 411699

SEQ ID NO: 412478 - RNA, 64 nt, Human
ccucggcucacuuacagaaguucugacucaauacaucugggauuucuacuuucaaagcaguaca

SEQ ID NO: 412479 - RNA, 64 nt, Human
uguuggccccugaggcagccugucacccauccuaaucugggagagaaggugacacagcugggcc

SEQ ID NO: 412480 - RNA, 64 nt, Human
ugaaauggaagugggggugucccuacucuguagaaucugggacugggcaaauguuuguguggcc

SEQ ID NO: 412481 - RNA, 64 nt, Human; identical to SEQ ID NO: 411700

SEQ ID NO: 412482 - RNA, 64 nt, Human; identical to SEQ ID NO: 411701

SEQ ID NO: 412483 - RNA, 64 nt, Human; identical to SEQ ID NO: 411702

SEQ ID NO: 412484 - RNA, 64 nt, Human; identical to SEQ ID NO: 411703

SEQ ID NO: 412485 - RNA, 64 nt, Human; identical to SEQ ID NO: 411704

SEQ ID NO: 412486 - RNA, 64 nt, Human; identical to SEQ ID NO: 411708

SEQ ID NO: 412487 - RNA, 64 nt, Human; identical to SEQ ID NO: 411709

SEQ ID NO: 412488 - RNA, 64 nt, Human; identical to SEQ ID NO: 411710

SEQ ID NO: 412489 - RNA, 64 nt, Human; identical to SEQ ID NO: 411711

SEQ ID NO: 412490 - RNA, 64 nt, Human; identical to SEQ ID NO: 411712

SEQ ID NO: 412491 - RNA, 64 nt, Human; identical to SEQ ID NO: 411713

SEQ ID NO: 412492 - RNA, 64 nt, Human; identical to SEQ ID NO: 411714

SEQ ID NO: 412493 - RNA, 64 nt, Human; identical to SEQ ID NO: 411715

SEQ ID NO: 412494 - RNA, 64 nt, Human; identical to SEQ ID NO: 411716

SEQ ID NO: 412495 - RNA, 64 nt, Human; identical to SEQ ID NO: 411717

SEQ ID NO: 412496 - RNA, 64 nt, Human; identical to SEQ ID NO: 411718

SEQ ID NO: 412497 - RNA, 64 nt, Human
aagaucucaauugucuuagucacagaguagguuuaucugggauggauauuaauuuuaauacagg

SEQ ID NO: 412498 - RNA, 64 nt, Human
ugaaauuauauauauacacauauauauauuuuacaucugggaucaugauagacuuguuagggcu

SEQ ID NO: 412499 - RNA, 64 nt, Human
cgcagaaggccuuucccaccuuaagcuuccggggaucugggaauuuuacccccauucucuucug

SEQ ID NO: 412500 - RNA, 64 nt, Human; identical to SEQ ID NO: 411719

SEQ ID NO: 412501 - RNA, 64 nt, Human; identical to SEQ ID NO: 411720

SEQ ID NO: 412502 - RNA, 64 nt, Human; identical to SEQ ID NO: 411721

SEQ ID NO: 412503 - RNA, 64 nt, Human; identical to SEQ ID NO: 411722

SEQ ID NO: 412504 - RNA, 64 nt, Human; identical to SEQ ID NO: 411723

SEQ ID NO: 412505 - RNA, 64 nt, Human; identical to SEQ ID NO: 411727

SEQ ID NO: 412506 - RNA, 64 nt, Human; identical to SEQ ID NO: 411728

SEQ ID NO: 412507 - RNA, 64 nt, Human; identical to SEQ ID NO: 411729

SEQ ID NO: 412508 - RNA, 64 nt, Human; identical to SEQ ID NO: 411730

SEQ ID NO: 412509 - RNA, 64 nt, Human; identical to SEQ ID NO: 411731

SEQ ID NO: 412510 - RNA, 64 nt, Human; identical to SEQ ID NO: 411732

SEQ ID NO: 412511 - RNA, 64 nt, Human; identical to SEQ ID NO: 411733

SEQ ID NO: 412512 - RNA, 64 nt, Human; identical to SEQ ID NO: 411734

SEQ ID NO: 412513 - RNA, 64 nt, Human; identical to SEQ ID NO: 411735

SEQ ID NO: 412514 - RNA, 64 nt, Human; identical to SEQ ID NO: 411736

SEQ ID NO: 412515 - RNA, 64 nt, Human; identical to SEQ ID NO: 411737

SEQ ID NO: 412516 - RNA, 64 nt, Human
ccccucccagucaccuuguggcaagccccugcccaucugggaaaauaccccaucauucaugcua

SEQ ID NO: 412517 - RNA, 64 nt, Human
gcagggagccuguggaaaagggcaugucagugaaaucugggaauggcuggauucggaaacaucu

SEQ ID NO: 412518 - RNA, 64 nt, Human
uguugccugggugcucauucagagaggggcuaucaucugggagccugugccccuggguccucga

SEQ ID NO: 412519 - RNA, 64 nt, Human; identical to SEQ ID NO: 411738

SEQ ID NO: 412520 - RNA, 64 nt, Human; identical to SEQ ID NO: 411739

SEQ ID NO: 412521 - RNA, 64 nt, Human; identical to SEQ ID NO: 411740

SEQ ID NO: 412522 - RNA, 64 nt, Human; identical to SEQ ID NO: 411741

SEQ ID NO: 412523 - RNA, 64 nt, Human; identical to SEQ ID NO: 411742

SEQ ID NO: 412524 - RNA, 64 nt, Human; identical to SEQ ID NO: 411746

SEQ ID NO: 412525 - RNA, 64 nt, Human; identical to SEQ ID NO: 411747

SEQ ID NO: 412526 - RNA, 64 nt, Human; identical to SEQ ID NO: 411748

SEQ ID NO: 412527 - RNA, 64 nt, Human; identical to SEQ ID NO: 411749

SEQ ID NO: 412528 - RNA, 64 nt, Human; identical to SEQ ID NO: 411750

SEQ ID NO: 412529 - RNA, 64 nt, Human; identical to SEQ ID NO: 411751

SEQ ID NO: 412530 - RNA, 64 nt, Human; identical to SEQ ID NO: 411752

SEQ ID NO: 412531 - RNA, 64 nt, Human; identical to SEQ ID NO: 411753

SEQ ID NO: 412532 - RNA, 64 nt, Human; identical to SEQ ID NO: 411754

SEQ ID NO: 412533 - RNA, 64 nt, Human; identical to SEQ ID NO: 411755

SEQ ID NO: 412534 - RNA, 64 nt, Human; identical to SEQ ID NO: 411756

SEQ ID NO: 412535 - RNA, 64 nt, Human
agggccaccugaagcgggccuccaacgagagcacccgccagaggcugcagcagcagcugaccca

SEQ ID NO: 412536 - RNA, 64 nt, Human; identical to SEQ ID NO: 408903

SEQ ID NO: 412537 - RNA, 64 nt, Human
guggcagaggggccuucaccgccaccagggugucccgccagacagggagagacuccagccuucu

SEQ ID NO: 412538 - RNA, 64 nt, Human; identical to SEQ ID NO: 411757

SEQ ID NO: 412539 - RNA, 64 nt, Human; identical to SEQ ID NO: 411758

SEQ ID NO: 412540 - RNA, 64 nt, Human; identical to SEQ ID NO: 411759

SEQ ID NO: 412541 - RNA, 64 nt, Human; identical to SEQ ID NO: 411760

SEQ ID NO: 412542 - RNA, 64 nt, Human; identical to SEQ ID NO: 411761

SEQ ID NO: 412543 - RNA, 64 nt, Human; identical to SEQ ID NO: 411765

SEQ ID NO: 412544 - RNA, 64 nt, Human; identical to SEQ ID NO: 411766

SEQ ID NO: 412545 - RNA, 64 nt, Human; identical to SEQ ID NO: 411767

SEQ ID NO: 412546 - RNA, 64 nt, Human; identical to SEQ ID NO: 411768

SEQ ID NO: 412547 - RNA, 64 nt, Human; identical to SEQ ID NO: 411769

SEQ ID NO: 412548 - RNA, 64 nt, Human; identical to SEQ ID NO: 411770

SEQ ID NO: 412549 - RNA, 64 nt, Human; identical to SEQ ID NO: 411771

SEQ ID NO: 412550 - RNA, 64 nt, Human; identical to SEQ ID NO: 411772

SEQ ID NO: 412551 - RNA, 64 nt, Human; identical to SEQ ID NO: 411773

SEQ ID NO: 412552 - RNA, 64 nt, Human; identical to SEQ ID NO: 411774

SEQ ID NO: 412553 - RNA, 64 nt, Human; identical to SEQ ID NO: 411775

SEQ ID NO: 412554 - RNA, 64 nt, Human
aggcacaaaauuaccucauucuuccuaacaagcaaucugggaccugauuuuccaccuuuuuucu

SEQ ID NO: 412555 - RNA, 64 nt, Human
ggacuguugagcucacauaguguucugacuccaaaucugggagcaggagaauguguaaacaaga

SEQ ID NO: 412556 - RNA, 64 nt, Human
aaaguguggucucuggaagagcaguaucagcaucaucugggaacuugucacagaugcagauucu

SEQ ID NO: 412557 - RNA, 64 nt, Human; identical to SEQ ID NO: 411776

SEQ ID NO: 412558 - RNA, 64 nt, Human; identical to SEQ ID NO: 411777

SEQ ID NO: 412559 - RNA, 64 nt, Human; identical to SEQ ID NO: 411778

SEQ ID NO: 412560 - RNA, 64 nt, Human; identical to SEQ ID NO: 411779

SEQ ID NO: 412561 - RNA, 64 nt, Human; identical to SEQ ID NO: 411780

SEQ ID NO: 412562 - RNA, 64 nt, Human; identical to SEQ ID NO: 411784

SEQ ID NO: 412563 - RNA, 64 nt, Human; identical to SEQ ID NO: 411785

SEQ ID NO: 412564 - RNA, 64 nt, Human; identical to SEQ ID NO: 411786

SEQ ID NO: 412565 - RNA, 64 nt, Human; identical to SEQ ID NO: 411787

SEQ ID NO: 412566 - RNA, 64 nt, Human; identical to SEQ ID NO: 411788

SEQ ID NO: 412567 - RNA, 64 nt, Human; identical to SEQ ID NO: 411789

SEQ ID NO: 412568 - RNA, 64 nt, Human; identical to SEQ ID NO: 411790

SEQ ID NO: 412569 - RNA, 64 nt, Human; identical to SEQ ID NO: 411791

SEQ ID NO: 412570 - RNA, 64 nt, Human; identical to SEQ ID NO: 411792

SEQ ID NO: 412571 - RNA, 64 nt, Human; identical to SEQ ID NO: 411793

SEQ ID NO: 412572 - RNA, 64 nt, Human; identical to SEQ ID NO: 411794

SEQ ID NO: 412573 - RNA, 64 nt, Human; identical to SEQ ID NO: 409034

SEQ ID NO: 412574 - RNA, 64 nt, Human
ggagcugcagggcgagcccggacggcugccgucuccgccagaggccaccccggcccggccucca

SEQ ID NO: 412575 - RNA, 64 nt, Human
ugcugugggacuggcccugcuccuguacugcuauccgccagaccccaagggccugccagggacc

SEQ ID NO: 412576 - RNA, 64 nt, Human; identical to SEQ ID NO: 411795

SEQ ID NO: 412577 - RNA, 64 nt, Human; identical to SEQ ID NO: 411796

SEQ ID NO: 412578 - RNA, 64 nt, Human; identical to SEQ ID NO: 411797

SEQ ID NO: 412579 - RNA, 64 nt, Human; identical to SEQ ID NO: 411798

SEQ ID NO: 412580 - RNA, 64 nt, Human; identical to SEQ ID NO: 411799

SEQ ID NO: 412581 - RNA, 64 nt, Human; identical to SEQ ID NO: 411803

SEQ ID NO: 412582 - RNA, 64 nt, Human; identical to SEQ ID NO: 411804

SEQ ID NO: 412583 - RNA, 64 nt, Human; identical to SEQ ID NO: 411022

SEQ ID NO: 412584 - RNA, 64 nt, Human; identical to SEQ ID NO: 411023

SEQ ID NO: 412585 - RNA, 64 nt, Human; identical to SEQ ID NO: 411024

SEQ ID NO: 412586 - RNA, 64 nt, Human; identical to SEQ ID NO: 411029

SEQ ID NO: 412587 - RNA, 64 nt, Human; identical to SEQ ID NO: 411030

SEQ ID NO: 412588 - RNA, 64 nt, Human; identical to SEQ ID NO: 411031

SEQ ID NO: 412589 - RNA, 64 nt, Human; identical to SEQ ID NO: 411032

SEQ ID NO: 412590 - RNA, 64 nt, Human; identical to SEQ ID NO: 411033

SEQ ID NO: 412591 - RNA, 64 nt, Human; identical to SEQ ID NO: 411034

SEQ ID NO: 412592 - RNA, 64 nt, Human
caaagugaaaagaugcuguggcaguuccugaagcccgccagagacagcucaggugcaaggagau

SEQ ID NO: 412593 - RNA, 64 nt, Human
agacagcccugccuauccucuguauauaggccuuccgccagaugaagcuuuggcccucaguggg

SEQ ID NO: 412594 - RNA, 64 nt, Human
agaucugccagguacaaaggaaugaaacccagacaucugggaaccaaauucuacccaaugggcc

SEQ ID NO: 412595 - RNA, 64 nt, Human; identical to SEQ ID NO: 411035

SEQ ID NO: 412596 - RNA, 64 nt, Human; identical to SEQ ID NO: 411036

SEQ ID NO: 412597 - RNA, 64 nt, Human; identical to SEQ ID NO: 411037

SEQ ID NO: 412598 - RNA, 64 nt, Human; identical to SEQ ID NO: 411038

SEQ ID NO: 412599 - RNA, 64 nt, Human; identical to SEQ ID NO: 411039

SEQ ID NO: 412600 - RNA, 64 nt, Human; identical to SEQ ID NO: 411040

SEQ ID NO: 412601 - RNA, 64 nt, Human; identical to SEQ ID NO: 411041

SEQ ID NO: 412602 - RNA, 64 nt, Human; identical to SEQ ID NO: 411042

SEQ ID NO: 412603 - RNA, 64 nt, Human; identical to SEQ ID NO: 411043

SEQ ID NO: 412604 - RNA, 64 nt, Human; identical to SEQ ID NO: 411044

SEQ ID NO: 412605 - RNA, 64 nt, Human; identical to SEQ ID NO: 411048

SEQ ID NO: 412606 - RNA, 64 nt, Human; identical to SEQ ID NO: 411049

SEQ ID NO: 412607 - RNA, 64 nt, Human; identical to SEQ ID NO: 411050

SEQ ID NO: 412608 - RNA, 64 nt, Human; identical to SEQ ID NO: 411051

SEQ ID NO: 412609 - RNA, 64 nt, Human; identical to SEQ ID NO: 411052

SEQ ID NO: 412610 - RNA, 64 nt, Human; identical to SEQ ID NO: 411053

SEQ ID NO: 412611 - RNA, 64 nt, Human
agagggcgaguggcugcgagagagaaugagccucccgccagacaggagggaggugcguguggau

SEQ ID NO: 412612 - RNA, 64 nt, Human
gagagaaaagguaguguuuuuguacaaggucauaccgccagaagccccaaauccuauuuuggcu

SEQ ID NO: 412613 - RNA, 64 nt, Human
uguguccacuccugaggaugguuccagggaaauaccgccagaaaacaagaaggucagcccacuc

SEQ ID NO: 412614 - RNA, 64 nt, Human; identical to SEQ ID NO: 411054

SEQ ID NO: 412615 - RNA, 64 nt, Human; identical to SEQ ID NO: 411055

SEQ ID NO: 412616 - RNA, 64 nt, Human; identical to SEQ ID NO: 411056

SEQ ID NO: 412617 - RNA, 64 nt, Human; identical to SEQ ID NO: 411057

SEQ ID NO: 412618 - RNA, 64 nt, Human; identical to SEQ ID NO: 411058

SEQ ID NO: 412619 - RNA, 64 nt, Human; identical to SEQ ID NO: 411059

SEQ ID NO: 412620 - RNA, 64 nt, Human; identical to SEQ ID NO: 411060

SEQ ID NO: 412621 - RNA, 64 nt, Human; identical to SEQ ID NO: 411061

SEQ ID NO: 412622 - RNA, 64 nt, Human; identical to SEQ ID NO: 411062

SEQ ID NO: 412623 - RNA, 64 nt, Human; identical to SEQ ID NO: 411063

SEQ ID NO: 412624 - RNA, 64 nt, Human; identical to SEQ ID NO: 411067

SEQ ID NO: 412625 - RNA, 64 nt, Human; identical to SEQ ID NO: 411068

SEQ ID NO: 412626 - RNA, 64 nt, Human; identical to SEQ ID NO: 411069

SEQ ID NO: 412627 - RNA, 64 nt, Human; identical to SEQ ID NO: 411070

SEQ ID NO: 412628 - RNA, 64 nt, Human; identical to SEQ ID NO: 411071

SEQ ID NO: 412629 - RNA, 64 nt, Human; identical to SEQ ID NO: 411072

SEQ ID NO: 412630 - RNA, 64 nt, Human; identical to SEQ ID NO: 409036

SEQ ID NO: 412631 - RNA, 64 nt, Human
uuucauucaaaccugacaagucuaucucuaagagccgccagauuuccaugugugcaguauuaua

SEQ ID NO: 412632 - RNA, 64 nt, Human
ggggaaaaucaagaugguaccucucugcauuaucccgccagacacuguauuuuaugcauucaug

SEQ ID NO: 412633 - RNA, 64 nt, Human; identical to SEQ ID NO: 411073

SEQ ID NO: 412634 - RNA, 64 nt, Human; identical to SEQ ID NO: 411074

SEQ ID NO: 412635 - RNA, 64 nt, Human; identical to SEQ ID NO: 411075

SEQ ID NO: 412636 - RNA, 64 nt, Human; identical to SEQ ID NO: 411076

SEQ ID NO: 412637 - RNA, 64 nt, Human; identical to SEQ ID NO: 411077

SEQ ID NO: 412638 - RNA, 64 nt, Human; identical to SEQ ID NO: 411078

SEQ ID NO: 412639 - RNA, 64 nt, Human; identical to SEQ ID NO: 411079

SEQ ID NO: 412640 - RNA, 64 nt, Human; identical to SEQ ID NO: 411080

SEQ ID NO: 412641 - RNA, 64 nt, Human; identical to SEQ ID NO: 411081

SEQ ID NO: 412642 - RNA, 64 nt, Human; identical to SEQ ID NO: 411082

SEQ ID NO: 412643 - RNA, 64 nt, Human; identical to SEQ ID NO: 411086

SEQ ID NO: 412644 - RNA, 64 nt, Human; identical to SEQ ID NO: 411087

SEQ ID NO: 412645 - RNA, 64 nt, Human; identical to SEQ ID NO: 411088

SEQ ID NO: 412646 - RNA, 56 nt, Human; identical to SEQ ID NO: 411089

SEQ ID NO: 412647 - RNA, 64 nt, Human; identical to SEQ ID NO: 411090

SEQ ID NO: 412648 - RNA, 64 nt, Human; identical to SEQ ID NO: 411091

SEQ ID NO: 412649 - RNA, 64 nt, Human
guggugcugggggaggcaccccacagacucagcgccgccagagauaggguuuuuggagggcucc

SEQ ID NO: 412650 - RNA, 64 nt, Human; identical to SEQ ID NO: 409052

SEQ ID NO: 412651 - RNA, 64 nt, Human
acccuccccugcccccuccacuccggggccugugccgccagaaccgggcucugcccccauacgc

SEQ ID NO: 412652 - RNA, 64 nt, Human; identical to SEQ ID NO: 411092

SEQ ID NO: 412653 - RNA, 64 nt, Human; identical to SEQ ID NO: 411093

SEQ ID NO: 412654 - RNA, 64 nt, Human; identical to SEQ ID NO: 411094

SEQ ID NO: 412655 - RNA, 64 nt, Human; identical to SEQ ID NO: 411095

SEQ ID NO: 412656 - RNA, 64 nt, Human; identical to SEQ ID NO: 411096

SEQ ID NO: 412657 - RNA, 64 nt, Human; identical to SEQ ID NO: 411097

SEQ ID NO: 412658 - RNA, 64 nt, Human; identical to SEQ ID NO: 411098

SEQ ID NO: 412659 - RNA, 64 nt, Human; identical to SEQ ID NO: 411099

SEQ ID NO: 412660 - RNA, 64 nt, Human; identical to SEQ ID NO: 411100

SEQ ID NO: 412661 - RNA, 64 nt, Human; identical to SEQ ID NO: 411101

SEQ ID NO: 412662 - RNA, 64 nt, Human; identical to SEQ ID NO: 411105

SEQ ID NO: 412663 - RNA, 64 nt, Human; identical to SEQ ID NO: 411106

SEQ ID NO: 412664 - RNA, 64 nt, Human; identical to SEQ ID NO: 411107

SEQ ID NO: 412665 - RNA, 64 nt, Human; identical to SEQ ID NO: 411108

SEQ ID NO: 412666 - RNA, 64 nt, Human; identical to SEQ ID NO: 411109

SEQ ID NO: 412667 - RNA, 64 nt, Human; identical to SEQ ID NO: 411110

SEQ ID NO: 412668 - RNA, 64 nt, Human
auuuauaauaaauaguagcaauuucugagcaaaaaucugggaaacucaagcaaaggaauuucug

SEQ ID NO: 412669 - RNA, 64 nt, Human; identical to SEQ ID NO: 411111

SEQ ID NO: 412670 - RNA, 64 nt, Human; identical to SEQ ID NO: 411112

SEQ ID NO: 412671 - RNA, 64 nt, Human; identical to SEQ ID NO: 411113

SEQ ID NO: 412672 - RNA, 64 nt, Human; identical to SEQ ID NO: 411114

SEQ ID NO: 412673 - RNA, 64 nt, Human; identical to SEQ ID NO: 411115

SEQ ID NO: 412674 - RNA, 64 nt, Human; identical to SEQ ID NO: 411116

SEQ ID NO: 412675 - RNA, 64 nt, Human; identical to SEQ ID NO: 411117

SEQ ID NO: 412676 - RNA, 64 nt, Human; identical to SEQ ID NO: 411118

SEQ ID NO: 412677 - RNA, 64 nt, Human; identical to SEQ ID NO: 411119

SEQ ID NO: 412678 - RNA, 64 nt, Human; identical to SEQ ID NO: 411120

SEQ ID NO: 412679 - RNA, 64 nt, Human; identical to SEQ ID NO: 411124

SEQ ID NO: 412680 - RNA, 64 nt, Human; identical to SEQ ID NO: 411125

SEQ ID NO: 412681 - RNA, 64 nt, Human; identical to SEQ ID NO: 411126

SEQ ID NO: 412682 - RNA, 64 nt, Human; identical to SEQ ID NO: 411127

SEQ ID NO: 412683 - RNA, 64 nt, Human; identical to SEQ ID NO: 411128

SEQ ID NO: 412684 - RNA, 64 nt, Human; identical to SEQ ID NO: 411129

SEQ ID NO: 412685 - RNA, 64 nt, Human; identical to SEQ ID NO: 410630

SEQ ID NO: 412686 - RNA, 64 nt, Human
acgagugcguguaccuggugcgggacucacccggccgccagacugccugggccugcccagaugg

SEQ ID NO: 412687 - RNA, 64 nt, Human; identical to SEQ ID NO: 411130

SEQ ID NO: 412688 - RNA, 64 nt, Human; identical to SEQ ID NO: 411131

SEQ ID NO: 412689 - RNA, 64 nt, Human; identical to SEQ ID NO: 411132

SEQ ID NO: 412690 - RNA, 64 nt, Human; identical to SEQ ID NO: 411133

SEQ ID NO: 412691 - RNA, 64 nt, Human; identical to SEQ ID NO: 411134

SEQ ID NO: 412692 - RNA, 64 nt, Human; identical to SEQ ID NO: 411135

SEQ ID NO: 412693 - RNA, 64 nt, Human; identical to SEQ ID NO: 411136

SEQ ID NO: 412694 - RNA, 64 nt, Human; identical to SEQ ID NO: 411137

SEQ ID NO: 412695 - RNA, 64 nt, Human; identical to SEQ ID NO: 411138

SEQ ID NO: 412696 - RNA, 64 nt, Human; identical to SEQ ID NO: 411139

SEQ ID NO: 412697 - RNA, 64 nt, Human; identical to SEQ ID NO: 411143

SEQ ID NO: 412698 - RNA, 64 nt, Human; identical to SEQ ID NO: 411144

SEQ ID NO: 412699 - RNA, 64 nt, Human; identical to SEQ ID NO: 411145

SEQ ID NO: 412700 - RNA, 64 nt, Human; identical to SEQ ID NO: 411146

SEQ ID NO: 412701 - RNA, 64 nt, Human; identical to SEQ ID NO: 411147

SEQ ID NO: 412702 - RNA, 64 nt, Human; identical to SEQ ID NO: 411148

SEQ ID NO: 412703 - RNA, 64 nt, Human
ucucuuuaggaccugccuccugccugccccucucccgccagacuguuagaaaauggacacugug

SEQ ID NO: 412704 - RNA, 64 nt, Human
gccuccgggccugaauacgggccagccgccgaggccgccagagcagggccgccuggucccaccg

SEQ ID NO: 412705 - RNA, 64 nt, Human
gagugacccagcuacugaaccagccacgaacagcccgccagaggccugaagcugagcguguacg

SEQ ID NO: 412706 - RNA, 64 nt, Human; identical to SEQ ID NO: 411149

SEQ ID NO: 412707 - RNA, 64 nt, Human; identical to SEQ ID NO: 411150

SEQ ID NO: 412708 - RNA, 64 nt, Human; identical to SEQ ID NO: 411151

SEQ ID NO: 412709 - RNA, 64 nt, Human; identical to SEQ ID NO: 411152

SEQ ID NO: 412710 - RNA, 64 nt, Human; identical to SEQ ID NO: 411153

SEQ ID NO: 412711 - RNA, 64 nt, Human; identical to SEQ ID NO: 411154

SEQ ID NO: 412712 - RNA, 64 nt, Human; identical to SEQ ID NO: 411155

SEQ ID NO: 412713 - RNA, 64 nt, Human; identical to SEQ ID NO: 411156

SEQ ID NO: 412714 - RNA, 64 nt, Human; identical to SEQ ID NO: 411157

SEQ ID NO: 412715 - RNA, 64 nt, Human; identical to SEQ ID NO: 411158

SEQ ID NO: 412716 - RNA, 64 nt, Human; identical to SEQ ID NO: 411162

SEQ ID NO: 412717 - RNA, 64 nt, Human; identical to SEQ ID NO: 411163

SEQ ID NO: 412718 - RNA, 64 nt, Human; identical to SEQ ID NO: 411164

SEQ ID NO: 412719 - RNA, 64 nt, Human; identical to SEQ ID NO: 411165

SEQ ID NO: 412720 - RNA, 64 nt, Human; identical to SEQ ID NO: 411166

SEQ ID NO: 412721 - RNA, 64 nt, Human; identical to SEQ ID NO: 411167

SEQ ID NO: 412722 - RNA, 64 nt, Human
aaacagucagugagaguggaggcuccagucagacccgccagauccuugggcaccuggcacucaa

SEQ ID NO: 412723 - RNA, 64 nt, Human
ugugggccuggcagggcuggcaggaugccgugggccgccagaucugcaccaccuucgagcacua

SEQ ID NO: 412724 - RNA, 64 nt, Human
gcugagcccuguacccaccccagcacagccaccuccgccagaccccguggcucugggagagcca

SEQ ID NO: 412725 - RNA, 64 nt, Human; identical to SEQ ID NO: 411168

SEQ ID NO: 412726 - RNA, 64 nt, Human; identical to SEQ ID NO: 411169

SEQ ID NO: 412727 - RNA, 64 nt, Human; identical to SEQ ID NO: 411170

SEQ ID NO: 412728 - RNA, 64 nt, Human; identical to SEQ ID NO: 411171

SEQ ID NO: 412729 - RNA, 64 nt, Human; identical to SEQ ID NO: 411172

SEQ ID NO: 412730 - RNA, 64 nt, Human; identical to SEQ ID NO: 411173

SEQ ID NO: 412731 - RNA, 64 nt, Human; identical to SEQ ID NO: 411174

SEQ ID NO: 412732 - RNA, 64 nt, Human; identical to SEQ ID NO: 411175

SEQ ID NO: 412733 - RNA, 64 nt, Human; identical to SEQ ID NO: 411176

SEQ ID NO: 412734 - RNA, 64 nt, Human; identical to SEQ ID NO: 411177

SEQ ID NO: 412735 - RNA, 64 nt, Human; identical to SEQ ID NO: 411181

SEQ ID NO: 412736 - RNA, 64 nt, Human; identical to SEQ ID NO: 411182

SEQ ID NO: 412737 - RNA, 64 nt, Human; identical to SEQ ID NO: 411183

SEQ ID NO: 412738 - RNA, 64 nt, Human; identical to SEQ ID NO: 411184

SEQ ID NO: 412739 - RNA, 64 nt, Human; identical to SEQ ID NO: 411185

SEQ ID NO: 412740 - RNA, 64 nt, Human; identical to SEQ ID NO: 411186

SEQ ID NO: 412741 - RNA, 64 nt, Human
uggagaaucgccugcagguggggcccuuuccuucccgccagaguggggcugagugggcgcugag

SEQ ID NO: 412742 - RNA, 64 nt, Human
accccacuuccacauggcccucgucccuuccugcccgccagaugcugccugcacuuccgcagcc

SEQ ID NO: 412743 - RNA, 64 nt, Human
accuguguaaccaccaccaccuguguaaccaccaccgccagaaccaaaaacguuucugucaccc

SEQ ID NO: 412744 - RNA, 64 nt, Human; identical to SEQ ID NO: 411187

SEQ ID NO: 412745 - RNA, 64 nt, Human; identical to SEQ ID NO: 411188

SEQ ID NO: 412746 - RNA, 64 nt, Human; identical to SEQ ID NO: 411189

SEQ ID NO: 412747 - RNA, 64 nt, Human; identical to SEQ ID NO: 411190

SEQ ID NO: 412748 - RNA, 64 nt, Human; identical to SEQ ID NO: 411191

SEQ ID NO: 412749 - RNA, 64 nt, Human; identical to SEQ ID NO: 411192

SEQ ID NO: 412750 - RNA, 64 nt, Human; identical to SEQ ID NO: 411193

SEQ ID NO: 412751 - RNA, 64 nt, Human; identical to SEQ ID NO: 411194

SEQ ID NO: 412752 - RNA, 64 nt, Human; identical to SEQ ID NO: 411195

SEQ ID NO: 412753 - RNA, 64 nt, Human; identical to SEQ ID NO: 411196

SEQ ID NO: 412754 - RNA, 64 nt, Human; identical to SEQ ID NO: 411200

SEQ ID NO: 412755 - RNA, 64 nt, Human; identical to SEQ ID NO: 411201

SEQ ID NO: 412756 - RNA, 64 nt, Human; identical to SEQ ID NO: 411202

SEQ ID NO: 412757 - RNA, 64 nt, Human; identical to SEQ ID NO: 411203

SEQ ID NO: 412758 - RNA, 64 nt, Human; identical to SEQ ID NO: 411204

SEQ ID NO: 412759 - RNA, 64 nt, Human; identical to SEQ ID NO: 411205

SEQ ID NO: 412760 - RNA, 64 nt, Human
accuccgccagauccugcagaaguacuccuauugccgccagaagauccaagaggcccugcacgc

SEQ ID NO: 412761 - RNA, 64 nt, Human
uacguauccugcagcgggaggaggaggagcaccuccgccagauccugcagaaguacuccuauug

SEQ ID NO: 412762 - RNA, 64 nt, Human; identical to SEQ ID NO: 409054

SEQ ID NO: 412763 - RNA, 64 nt, Human; identical to SEQ ID NO: 411206

SEQ ID NO: 412764 - RNA, 64 nt, Human; identical to SEQ ID NO: 411207

SEQ ID NO: 412765 - RNA, 64 nt, Human; identical to SEQ ID NO: 411208

SEQ ID NO: 412766 - RNA, 64 nt, Human; identical to SEQ ID NO: 411209

SEQ ID NO: 412767 - RNA, 64 nt, Human; identical to SEQ ID NO: 411210

SEQ ID NO: 412768 - RNA, 64 nt, Human; identical to SEQ ID NO: 411211

SEQ ID NO: 412769 - RNA, 64 nt, Human; identical to SEQ ID NO: 411212

SEQ ID NO: 412770 - RNA, 64 nt, Human; identical to SEQ ID NO: 411213

SEQ ID NO: 412771 - RNA, 64 nt, Human; identical to SEQ ID NO: 411214

SEQ ID NO: 412772 - RNA, 64 nt, Human; identical to SEQ ID NO: 411215

SEQ ID NO: 412773 - RNA, 64 nt, Human; identical to SEQ ID NO: 411219

SEQ ID NO: 412774 - RNA, 64 nt, Human; identical to SEQ ID NO: 411220

SEQ ID NO: 412775 - RNA, 64 nt, Human; identical to SEQ ID NO: 411221

SEQ ID NO: 412776 - RNA, 64 nt, Human; identical to SEQ ID NO: 411222

SEQ ID NO: 412777 - RNA, 64 nt, Human; identical to SEQ ID NO: 411223

SEQ ID NO: 412778 - RNA, 64 nt, Human; identical to SEQ ID NO: 411224

SEQ ID NO: 412779 - RNA, 64 nt, Human; identical to SEQ ID NO: 410611

SEQ ID NO: 412780 - RNA, 64 nt, Human; identical to SEQ ID NO: 412329

SEQ ID NO: 412781 - RNA, 64 nt, Human; identical to SEQ ID NO: 412346

SEQ ID NO: 412782 - RNA, 64 nt, Human; identical to SEQ ID NO: 411225

SEQ ID NO: 412783 - RNA, 64 nt, Human; identical to SEQ ID NO: 411226

SEQ ID NO: 412784 - RNA, 64 nt, Human; identical to SEQ ID NO: 411227

SEQ ID NO: 412785 - RNA, 64 nt, Human; identical to SEQ ID NO: 411228

SEQ ID NO: 412786 - RNA, 64 nt, Human; identical to SEQ ID NO: 411229

SEQ ID NO: 412787 - RNA, 64 nt, Human; identical to SEQ ID NO: 411230

SEQ ID NO: 412788 - RNA, 64 nt, Human; identical to SEQ ID NO: 411231

SEQ ID NO: 412789 - RNA, 64 nt, Human; identical to SEQ ID NO: 411232

SEQ ID NO: 412790 - RNA, 64 nt, Human; identical to SEQ ID NO: 411233

SEQ ID NO: 412791 - RNA, 64 nt, Human; identical to SEQ ID NO: 411234

SEQ ID NO: 412792 - RNA, 64 nt, Human; identical to SEQ ID NO: 411238

SEQ ID NO: 412793 - RNA, 64 nt, Human; identical to SEQ ID NO: 411239

SEQ ID NO: 412794 - RNA, 64 nt, Human; identical to SEQ ID NO: 411240

SEQ ID NO: 412795 - RNA, 64 nt, Human; identical to SEQ ID NO: 411241

SEQ ID NO: 412796 - RNA, 64 nt, Human; identical to SEQ ID NO: 411242

SEQ ID NO: 412797 - RNA, 64 nt, Human; identical to SEQ ID NO: 411243

SEQ ID NO: 412798 - RNA, 64 nt, Human; identical to SEQ ID NO: 412347

SEQ ID NO: 412799 - RNA, 64 nt, Human; identical to SEQ ID NO: 410612

SEQ ID NO: 412800 - RNA, 64 nt, Human; identical to SEQ ID NO: 412384

SEQ ID NO: 412801 - RNA, 64 nt, Human; identical to SEQ ID NO: 411244

SEQ ID NO: 412802 - RNA, 64 nt, Human; identical to SEQ ID NO: 411245

SEQ ID NO: 412803 - RNA, 64 nt, Human; identical to SEQ ID NO: 411246

SEQ ID NO: 412804 - RNA, 64 nt, Human; identical to SEQ ID NO: 411247

SEQ ID NO: 412805 - RNA, 64 nt, Human; identical to SEQ ID NO: 411248

SEQ ID NO: 412806 - RNA, 64 nt, Human; identical to SEQ ID NO: 411249

SEQ ID NO: 412807 - RNA, 64 nt, Human; identical to SEQ ID NO: 411250

SEQ ID NO: 412808 - RNA, 64 nt, Human; identical to SEQ ID NO: 411251

SEQ ID NO: 412809 - RNA, 64 nt, Human; identical to SEQ ID NO: 411252

SEQ ID NO: 412810 - RNA, 64 nt, Human; identical to SEQ ID NO: 411253

SEQ ID NO: 412811 - RNA, 64 nt, Human; identical to SEQ ID NO: 411257

SEQ ID NO: 412812 - RNA, 64 nt, Human; identical to SEQ ID NO: 411258

SEQ ID NO: 412813 - RNA, 64 nt, Human; identical to SEQ ID NO: 411259

SEQ ID NO: 412814 - RNA, 64 nt, Human; identical to SEQ ID NO: 411260

SEQ ID NO: 412815 - RNA, 64 nt, Human; identical to SEQ ID NO: 411261

SEQ ID NO: 412816 - RNA, 59 nt, Human; identical to SEQ ID NO: 411262

SEQ ID NO: 412817 - RNA, 64 nt, Human; identical to SEQ ID NO: 412366

SEQ ID NO: 412818 - RNA, 64 nt, Human; identical to SEQ ID NO: 412367

SEQ ID NO: 412819 - RNA, 64 nt, Human; identical to SEQ ID NO: 412442

SEQ ID NO: 412820 - RNA, 64 nt, Human; identical to SEQ ID NO: 411263

SEQ ID NO: 412821 - RNA, 64 nt, Human; identical to SEQ ID NO: 411264

SEQ ID NO: 412822 - RNA, 64 nt, Human; identical to SEQ ID NO: 411265

SEQ ID NO: 412823 - RNA, 64 nt, Human; identical to SEQ ID NO: 411266

SEQ ID NO: 412824 - RNA, 64 nt, Human; identical to SEQ ID NO: 411267

SEQ ID NO: 412825 - RNA, 64 nt, Human; identical to SEQ ID NO: 411268

SEQ ID NO: 412826 - RNA, 64 nt, Human; identical to SEQ ID NO: 411269

SEQ ID NO: 412827 - RNA, 64 nt, Human; identical to SEQ ID NO: 411270

SEQ ID NO: 412828 - RNA, 64 nt, Human; identical to SEQ ID NO: 411271

SEQ ID NO: 412829 - RNA, 64 nt, Human; identical to SEQ ID NO: 411272

SEQ ID NO: 412830 - RNA, 64 nt, Human; identical to SEQ ID NO: 411276

SEQ ID NO: 412831 - RNA, 64 nt, Human; identical to SEQ ID NO: 411277

SEQ ID NO: 412832 - RNA, 64 nt, Human; identical to SEQ ID NO: 411278

SEQ ID NO: 412833 - RNA, 64 nt, Human; identical to SEQ ID NO: 411279

SEQ ID NO: 412834 - RNA, 64 nt, Human; identical to SEQ ID NO: 411280

SEQ ID NO: 412835 - RNA, 64 nt, Human; identical to SEQ ID NO: 411281

SEQ ID NO: 412836 - RNA, 64 nt, Human; identical to SEQ ID NO: 412403

SEQ ID NO: 412837 - RNA, 62 nt, Human; identical to SEQ ID NO: 174733

SEQ ID NO: 412838 - RNA, 64 nt, Human; identical to SEQ ID NO: 412423

SEQ ID NO: 412839 - RNA, 64 nt, Human; identical to SEQ ID NO: 411282

SEQ ID NO: 412840 - RNA, 64 nt, Human; identical to SEQ ID NO: 411283

SEQ ID NO: 412841 - RNA, 64 nt, Human; identical to SEQ ID NO: 411284

SEQ ID NO: 412842 - RNA, 64 nt, Human; identical to SEQ ID NO: 411285

SEQ ID NO: 412843 - RNA, 57 nt, Human; identical to SEQ ID NO: 411286

SEQ ID NO: 412844 - RNA, 64 nt, Human; identical to SEQ ID NO: 411287

SEQ ID NO: 412845 - RNA, 64 nt, Human; identical to SEQ ID NO: 411288

SEQ ID NO: 412846 - RNA, 64 nt, Human; identical to SEQ ID NO: 411289

SEQ ID NO: 412847 - RNA, 64 nt, Human; identical to SEQ ID NO: 411290

SEQ ID NO: 412848 - RNA, 64 nt, Human; identical to SEQ ID NO: 411291

SEQ ID NO: 412849 - RNA, 64 nt, Human; identical to SEQ ID NO: 411295

SEQ ID NO: 412850 - RNA, 64 nt, Human; identical to SEQ ID NO: 411296

SEQ ID NO: 412851 - RNA, 64 nt, Human; identical to SEQ ID NO: 411297

SEQ ID NO: 412852 - RNA, 64 nt, Human; identical to SEQ ID NO: 411298

SEQ ID NO: 412853 - RNA, 64 nt, Human; identical to SEQ ID NO: 411299

SEQ ID NO: 412854 - RNA, 64 nt, Human; identical to SEQ ID NO: 411300

SEQ ID NO: 412855 - RNA, 64 nt, Human; identical to SEQ ID NO: 412385

SEQ ID NO: 412856 - RNA, 64 nt, Human; identical to SEQ ID NO: 410613

SEQ ID NO: 412857 - RNA, 64 nt, Human
ugagaaccgccagaaacugagccgccccaggaugccgccagaaucacuggucccugggagcuug

SEQ ID NO: 412858 - RNA, 64 nt, Human; identical to SEQ ID NO: 411301

SEQ ID NO: 412859 - RNA, 64 nt, Human; identical to SEQ ID NO: 411302

SEQ ID NO: 412860 - RNA, 64 nt, Human; identical to SEQ ID NO: 411303

SEQ ID NO: 412861 - RNA, 60 nt, Human; identical to SEQ ID NO: 411304

SEQ ID NO: 412862 - RNA, 64 nt, Human; identical to SEQ ID NO: 411305

SEQ ID NO: 412863 - RNA, 64 nt, Human; identical to SEQ ID NO: 411306

SEQ ID NO: 412864 - RNA, 64 nt, Human; identical to SEQ ID NO: 411307

SEQ ID NO: 412865 - RNA, 64 nt, Human; identical to SEQ ID NO: 411308

SEQ ID NO: 412866 - RNA, 64 nt, Human; identical to SEQ ID NO: 411309

SEQ ID NO: 412867 - RNA, 64 nt, Human; identical to SEQ ID NO: 411310

SEQ ID NO: 412868 - RNA, 64 nt, Human; identical to SEQ ID NO: 411314

SEQ ID NO: 412869 - RNA, 64 nt, Human; identical to SEQ ID NO: 411315

SEQ ID NO: 412870 - RNA, 64 nt, Human; identical to SEQ ID NO: 411316

SEQ ID NO: 412871 - RNA, 64 nt, Human; identical to SEQ ID NO: 411317

SEQ ID NO: 412872 - RNA, 64 nt, Human; identical to SEQ ID NO: 411318

SEQ ID NO: 412873 - RNA, 64 nt, Human; identical to SEQ ID NO: 411319

SEQ ID NO: 412874 - RNA, 64 nt, Human
uucuccucccgagggaaccuucuucccaggccucccgccagacugccuggguccuggcgccugg

SEQ ID NO: 412875 - RNA, 64 nt, Human; identical to SEQ ID NO: 411320

SEQ ID NO: 412876 - RNA, 64 nt, Human; identical to SEQ ID NO: 411321

SEQ ID NO: 412877 - RNA, 64 nt, Human; identical to SEQ ID NO: 411322

SEQ ID NO: 412878 - RNA, 64 nt, Human; identical to SEQ ID NO: 411323

SEQ ID NO: 412879 - RNA, 64 nt, Human; identical to SEQ ID NO: 411324

SEQ ID NO: 412880 - RNA, 64 nt, Human; identical to SEQ ID NO: 411325

SEQ ID NO: 412881 - RNA, 64 nt, Human; identical to SEQ ID NO: 411326

SEQ ID NO: 412882 - RNA, 64 nt, Human; identical to SEQ ID NO: 411327

SEQ ID NO: 412883 - RNA, 54 nt, Human; identical to SEQ ID NO: 411328

SEQ ID NO: 412884 - RNA, 64 nt, Human; identical to SEQ ID NO: 411329

SEQ ID NO: 412885 - RNA, 64 nt, Human; identical to SEQ ID NO: 411333

SEQ ID NO: 412886 - RNA, 64 nt, Human; identical to SEQ ID NO: 411334

SEQ ID NO: 412887 - RNA, 64 nt, Human; identical to SEQ ID NO: 411335

SEQ ID NO: 412888 - RNA, 64 nt, Human; identical to SEQ ID NO: 411336

SEQ ID NO: 412889 - RNA, 64 nt, Human; identical to SEQ ID NO: 411337

SEQ ID NO: 412890 - RNA, 64 nt, Human; identical to SEQ ID NO: 411338

SEQ ID NO: 412891 - RNA, 64 nt, Human; identical to SEQ ID NO: 412632

SEQ ID NO: 412892 - RNA, 64 nt, Human; identical to SEQ ID NO: 412649

SEQ ID NO: 412893 - RNA, 64 nt, Human
uggaguggggcaguagaaggucggaggcuugggaccgccagauggggccucuguuucggagacg

SEQ ID NO: 412894 - RNA, 64 nt, Human; identical to SEQ ID NO: 411339

SEQ ID NO: 412895 - RNA, 64 nt, Human; identical to SEQ ID NO: 411340

SEQ ID NO: 412896 - RNA, 64 nt, Human; identical to SEQ ID NO: 411341

SEQ ID NO: 412897 - RNA, 64 nt, Human; identical to SEQ ID NO: 411342

SEQ ID NO: 412898 - RNA, 64 nt, Human; identical to SEQ ID NO: 411343

SEQ ID NO: 412899 - RNA, 64 nt, Human; identical to SEQ ID NO: 411344

SEQ ID NO: 412900 - RNA, 64 nt, Human; identical to SEQ ID NO: 411345

SEQ ID NO: 412901 - RNA, 56 nt, Human; identical to SEQ ID NO: 411346

SEQ ID NO: 412902 - RNA, 61 nt, Human; identical to SEQ ID NO: 411347

SEQ ID NO: 412903 - RNA, 64 nt, Human; identical to SEQ ID NO: 411348

SEQ ID NO: 412904 - RNA, 64 nt, Human; identical to SEQ ID NO: 411352

SEQ ID NO: 412905 - RNA, 64 nt, Human; identical to SEQ ID NO: 411353

SEQ ID NO: 412906 - RNA, 64 nt, Human; identical to SEQ ID NO: 411354

SEQ ID NO: 412907 - RNA, 64 nt, Human; identical to SEQ ID NO: 411355

SEQ ID NO: 412908 - RNA, 64 nt, Human; identical to SEQ ID NO: 411356

SEQ ID NO: 412909 - RNA, 64 nt, Human; identical to SEQ ID NO: 411357

SEQ ID NO: 412910 - RNA, 64 nt, Human
cacauggguguccagggagaaggcucugucccugccgccagaccccagugguugccacugaaga

SEQ ID NO: 412911 - RNA, 64 nt, Human
cgcugaguccagccucguggucuucuccaagaugccgccagaugcccagccuacagccucucag

SEQ ID NO: 412912 - RNA, 64 nt, Human
ucaggaccuaucuaggcagaccccagccagacccccgccagacagacucccaaccagacugacc

SEQ ID NO: 412913 - RNA, 64 nt, Human; identical to SEQ ID NO: 411358

SEQ ID NO: 412914 - RNA, 64 nt, Human; identical to SEQ ID NO: 411359

SEQ ID NO: 412915 - RNA, 64 nt, Human; identical to SEQ ID NO: 411360

SEQ ID NO: 412916 - RNA, 64 nt, Human; identical to SEQ ID NO: 411361

SEQ ID NO: 412917 - RNA, 63 nt, Human; identical to SEQ ID NO: 411362

SEQ ID NO: 412918 - RNA, 64 nt, Human; identical to SEQ ID NO: 411363

SEQ ID NO: 412919 - RNA, 64 nt, Human; identical to SEQ ID NO: 411364

SEQ ID NO: 412920 - RNA, 64 nt, Human; identical to SEQ ID NO: 411365

SEQ ID NO: 412921 - RNA, 64 nt, Human; identical to SEQ ID NO: 411366

SEQ ID NO: 412922 - RNA, 64 nt, Human; identical to SEQ ID NO: 411367

SEQ ID NO: 412923 - RNA, 64 nt, Human; identical to SEQ ID NO: 411371

SEQ ID NO: 412924 - RNA, 64 nt, Human; identical to SEQ ID NO: 411372

SEQ ID NO: 412925 - RNA, 64 nt, Human; identical to SEQ ID NO: 411373

SEQ ID NO: 412926 - RNA, 64 nt, Human; identical to SEQ ID NO: 411374

SEQ ID NO: 412927 - RNA, 64 nt, Human; identical to SEQ ID NO: 411375

SEQ ID NO: 412928 - RNA, 64 nt, Human; identical to SEQ ID NO: 411376

SEQ ID NO: 412929 - RNA, 64 nt, Human; identical to SEQ ID NO: 410629

SEQ ID NO: 412930 - RNA, 64 nt, Human; identical to SEQ ID NO: 412403

SEQ ID NO: 412931 - RNA, 64 nt, Human
gguuuuuggaggaagggauuagauagugacuaagccgccagaauugagguggccauuccuuuuu

SEQ ID NO: 412932 - RNA, 64 nt, Human; identical to SEQ ID NO: 411377

SEQ ID NO: 412933 - RNA, 64 nt, Human; identical to SEQ ID NO: 411378

SEQ ID NO: 412934 - RNA, 64 nt, Human; identical to SEQ ID NO: 411379

SEQ ID NO: 412935 - RNA, 64 nt, Human; identical to SEQ ID NO: 411380

SEQ ID NO: 412936 - RNA, 64 nt, Human; identical to SEQ ID NO: 411381

SEQ ID NO: 412937 - RNA, 64 nt, Human; identical to SEQ ID NO: 411382

SEQ ID NO: 412938 - RNA, 64 nt, Human; identical to SEQ ID NO: 411383

SEQ ID NO: 412939 - RNA, 64 nt, Human; identical to SEQ ID NO: 411384

SEQ ID NO: 412940 - RNA, 64 nt, Human; identical to SEQ ID NO: 411385

SEQ ID NO: 412941 - RNA, 64 nt, Human; identical to SEQ ID NO: 411386

SEQ ID NO: 412942 - RNA, 64 nt, Human; identical to SEQ ID NO: 411390

SEQ ID NO: 412943 - RNA, 64 nt, Human; identical to SEQ ID NO: 411391

SEQ ID NO: 412944 - RNA, 64 nt, Human; identical to SEQ ID NO: 411392

SEQ ID NO: 412945 - RNA, 64 nt, Human; identical to SEQ ID NO: 411393

SEQ ID NO: 412946 - RNA, 64 nt, Human; identical to SEQ ID NO: 411394

SEQ ID NO: 412947 - RNA, 64 nt, Human; identical to SEQ ID NO: 411395

SEQ ID NO: 412948 - RNA, 64 nt, Human; identical to SEQ ID NO: 412743

SEQ ID NO: 412949 - RNA, 64 nt, Human; identical to SEQ ID NO: 410559

SEQ ID NO: 412950 - RNA, 64 nt, Human
ggugccugcaccugcacucuagugacccugggugccgccagacccuucucuucuacaaagaccc

SEQ ID NO: 412951 - RNA, 64 nt, Human; identical to SEQ ID NO: 411396

SEQ ID NO: 412952 - RNA, 64 nt, Human; identical to SEQ ID NO: 411397

SEQ ID NO: 412953 - RNA, 64 nt, Human; identical to SEQ ID NO: 411398

SEQ ID NO: 412954 - RNA, 64 nt, Human; identical to SEQ ID NO: 411399

SEQ ID NO: 412955 - RNA, 64 nt, Human; identical to SEQ ID NO: 411400

SEQ ID NO: 412956 - RNA, 64 nt, Human; identical to SEQ ID NO: 411401

SEQ ID NO: 412957 - RNA, 57 nt, Human; identical to SEQ ID NO: 411402

SEQ ID NO: 412958 - RNA, 64 nt, Human; identical to SEQ ID NO: 411403

SEQ ID NO: 412959 - RNA, 64 nt, Human; identical to SEQ ID NO: 411404

SEQ ID NO: 412960 - RNA, 64 nt, Human; identical to SEQ ID NO: 411405

SEQ ID NO: 412961 - RNA, 64 nt, Human; identical to SEQ ID NO: 411409

SEQ ID NO: 412962 - RNA, 64 nt, Human; identical to SEQ ID NO: 411410

SEQ ID NO: 412963 - RNA, 64 nt, Human; identical to SEQ ID NO: 411411

SEQ ID NO: 412964 - RNA, 64 nt, Human; identical to SEQ ID NO: 411412

SEQ ID NO: 412965 - RNA, 64 nt, Human; identical to SEQ ID NO: 411413

SEQ ID NO: 412966 - RNA, 64 nt, Human; identical to SEQ ID NO: 411414

SEQ ID NO: 412967 - RNA, 64 nt, Human
cuuagcuucucaaaggccuaaccaagccuuggcaccgccagauccuuucuguaggcuaauuccu

SEQ ID NO: 412968 - RNA, 64 nt, Human
cuuauguggguugccuggugaauggccuuccuucccgccagagggcuugugaacagaccggaga

SEQ ID NO: 412969 - RNA, 64 nt, Human
gccuccuaccugugccuuucucugaggggacaccccgccagagagggccccgggagccgggggu

SEQ ID NO: 412970 - RNA, 64 nt, Human; identical to SEQ ID NO: 411415

SEQ ID NO: 412971 - RNA, 64 nt, Human; identical to SEQ ID NO: 411416

SEQ ID NO: 412972 - RNA, 64 nt, Human; identical to SEQ ID NO: 411417

SEQ ID NO: 412973 - RNA, 64 nt, Human; identical to SEQ ID NO: 411418

SEQ ID NO: 412974 - RNA, 57 nt, Human; identical to SEQ ID NO: 411419

SEQ ID NO: 412975 - RNA, 64 nt, Human; identical to SEQ ID NO: 411420

SEQ ID NO: 412976 - RNA, 64 nt, Human; identical to SEQ ID NO: 411421

SEQ ID NO: 412977 - RNA, 64 nt, Human; identical to SEQ ID NO: 411422

SEQ ID NO: 412978 - RNA, 64 nt, Human; identical to SEQ ID NO: 411423

SEQ ID NO: 412979 - RNA, 64 nt, Human; identical to SEQ ID NO: 411424

SEQ ID NO: 412980 - RNA, 64 nt, Human; identical to SEQ ID NO: 411428

SEQ ID NO: 412981 - RNA, 64 nt, Human; identical to SEQ ID NO: 411429

SEQ ID NO: 412982 - RNA, 64 nt, Human; identical to SEQ ID NO: 411430

SEQ ID NO: 412983 - RNA, 64 nt, Human; identical to SEQ ID NO: 411431

SEQ ID NO: 412984 - RNA, 64 nt, Human; identical to SEQ ID NO: 411432

SEQ ID NO: 412985 - RNA, 64 nt, Human; identical to SEQ ID NO: 411433

SEQ ID NO: 412986 - RNA, 64 nt, Human
caaggaagacgucguuaucuccccuccccacuuacucgaggagagaggugagggggggaugacu

SEQ ID NO: 412987 - RNA, 64 nt, Human
cagauugaaguaagagcaguucucuccguugccucucgaggaggaggugcgaaguccuggagua

SEQ ID NO: 412988 - RNA, 64 nt, Human
agggacagagcccucugugguggaacgaccccaccucgaggagcuuccugagcagguggcagaa

SEQ ID NO: 412989 - RNA, 64 nt, Human; identical to SEQ ID NO: 411434

SEQ ID NO: 412990 - RNA, 64 nt, Human; identical to SEQ ID NO: 411435

SEQ ID NO: 412991 - RNA, 64 nt, Human; identical to SEQ ID NO: 411436

SEQ ID NO: 412992 - RNA, 64 nt, Human; identical to SEQ ID NO: 411437

SEQ ID NO: 412993 - RNA, 64 nt, Human; identical to SEQ ID NO: 411438

SEQ ID NO: 412994 - RNA, 64 nt, Human; identical to SEQ ID NO: 411439

SEQ ID NO: 412995 - RNA, 64 nt, Human; identical to SEQ ID NO: 411440

SEQ ID NO: 412996 - RNA, 64 nt, Human; identical to SEQ ID NO: 411441

SEQ ID NO: 412997 - RNA, 58 nt, Human; identical to SEQ ID NO: 411442

SEQ ID NO: 412998 - RNA, 64 nt, Human; identical to SEQ ID NO: 411443

SEQ ID NO: 412999 - RNA, 64 nt, Human; identical to SEQ ID NO: 411447

SEQ ID NO: 413000 - RNA, 64 nt, Human; identical to SEQ ID NO: 411448

SEQ ID NO: 413001 - RNA, 64 nt, Human; identical to SEQ ID NO: 411449

SEQ ID NO: 413002 - RNA, 64 nt, Human; identical to SEQ ID NO: 411450

SEQ ID NO: 413003 - RNA, 64 nt, Human; identical to SEQ ID NO: 411451

SEQ ID NO: 413004 - RNA, 64 nt, Human; identical to SEQ ID NO: 411452

SEQ ID NO: 413005 - RNA, 64 nt, Human
guacuauccuguacugcaguggugccuucagggacucgaggaauguaagguugccuuuccccuu

SEQ ID NO: 413006 - RNA, 64 nt, Human
gcgcugcaugacuugcugaacggcacagggaccccucgaggaacaagguugcacaccagcuuuc

SEQ ID NO: 413007 - RNA, 64 nt, Human
caacuaagaaaaaaagcacaaaguucucagagcucucgaggaaagugguuguccccguaccacc

SEQ ID NO: 413008 - RNA, 64 nt, Human; identical to SEQ ID NO: 411453

SEQ ID NO: 413009 - RNA, 64 nt, Human; identical to SEQ ID NO: 411454

SEQ ID NO: 413010 - RNA, 64 nt, Human; identical to SEQ ID NO: 411455

SEQ ID NO: 413011 - RNA, 64 nt, Human; identical to SEQ ID NO: 411456

SEQ ID NO: 413012 - RNA, 64 nt, Human; identical to SEQ ID NO: 411457

SEQ ID NO: 413013 - RNA, 64 nt, Human; identical to SEQ ID NO: 411458

SEQ ID NO: 413014 - RNA, 64 nt, Human; identical to SEQ ID NO: 411459

SEQ ID NO: 413015 - RNA, 51 nt, Human; identical to SEQ ID NO: 411460

SEQ ID NO: 413016 - RNA, 64 nt, Human; identical to SEQ ID NO: 411461

SEQ ID NO: 413017 - RNA, 64 nt, Human; identical to SEQ ID NO: 411462

SEQ ID NO: 413018 - RNA, 64 nt, Human; identical to SEQ ID NO: 411466

SEQ ID NO: 413019 - RNA, 64 nt, Human; identical to SEQ ID NO: 411467

SEQ ID NO: 413020 - RNA, 64 nt, Human; identical to SEQ ID NO: 411468

SEQ ID NO: 413021 - RNA, 64 nt, Human; identical to SEQ ID NO: 411469

SEQ ID NO: 413022 - RNA, 64 nt, Human; identical to SEQ ID NO: 411470

SEQ ID NO: 413023 - RNA, 64 nt, Human; identical to SEQ ID NO: 411471

SEQ ID NO: 413024 - RNA, 64 nt, Human
cacugacugagccacccucuccguaggguucuuucucgaggacucuacccuccucccccacguc

SEQ ID NO: 413025 - RNA, 64 nt, Human
ccugcgccccgccagcugcccgcagaggugcagccucgaggaaucugagggcgucggggcagcg

SEQ ID NO: 413026 - RNA, 64 nt, Human; identical to SEQ ID NO: 412705

SEQ ID NO: 413027 - RNA, 64 nt, Human; identical to SEQ ID NO: 411472

SEQ ID NO: 413028 - RNA, 64 nt, Human; identical to SEQ ID NO: 411473

SEQ ID NO: 413029 - RNA, 64 nt, Human; identical to SEQ ID NO: 411474

SEQ ID NO: 413030 - RNA, 64 nt, Human; identical to SEQ ID NO: 411475

SEQ ID NO: 413031 - RNA, 64 nt, Human; identical to SEQ ID NO: 411480

SEQ ID NO: 413032 - RNA, 64 nt, Human; identical to SEQ ID NO: 411481

SEQ ID NO: 413033 - RNA, 64 nt, Human; identical to SEQ ID NO: 411482

SEQ ID NO: 413034 - RNA, 64 nt, Human; identical to SEQ ID NO: 411483

SEQ ID NO: 413035 - RNA, 64 nt, Human; identical to SEQ ID NO: 411484

SEQ ID NO: 413036 - RNA, 64 nt, Human; identical to SEQ ID NO: 411485

SEQ ID NO: 413037 - RNA, 64 nt, Human
ucccugagagguggugggaauggcugcuucauuccucgaggaugcccgggccccaccugggcuu

SEQ ID NO: 413038 - RNA, 64 nt, Human
auuauagcaauuuaagggcccaccagaagcaggccucgaggagucaauuugccucugugugccu

SEQ ID NO: 413039 - RNA, 64 nt, Human
gugaccaugccgaccacaaaggugucugcggaaacucgaggacauucaccacgaugauuuuccu

SEQ ID NO: 413040 - RNA, 64 nt, Human; identical to SEQ ID NO: 411486

SEQ ID NO: 413041 - RNA, 64 nt, Human; identical to SEQ ID NO: 411487

SEQ ID NO: 413042 - RNA, 64 nt, Human; identical to SEQ ID NO: 411488

SEQ ID NO: 413043 - RNA, 64 nt, Human; identical to SEQ ID NO: 411489

SEQ ID NO: 413044 - RNA, 64 nt, Human; identical to SEQ ID NO: 411490

SEQ ID NO: 413045 - RNA, 64 nt, Human; identical to SEQ ID NO: 411491

SEQ ID NO: 413046 - RNA, 64 nt, Human; identical to SEQ ID NO: 411492

SEQ ID NO: 413047 - RNA, 64 nt, Human; identical to SEQ ID NO: 411493

SEQ ID NO: 413048 - RNA, 64 nt, Human; identical to SEQ ID NO: 411494

SEQ ID NO: 413049 - RNA, 64 nt, Human; identical to SEQ ID NO: 411495

SEQ ID NO: 413050 - RNA, 64 nt, Human; identical to SEQ ID NO: 411499

SEQ ID NO: 413051 - RNA, 64 nt, Human; identical to SEQ ID NO: 411500

SEQ ID NO: 413052 - RNA, 64 nt, Human; identical to SEQ ID NO: 411501

SEQ ID NO: 413053 - RNA, 64 nt, Human; identical to SEQ ID NO: 411502

SEQ ID NO: 413054 - RNA, 64 nt, Human; identical to SEQ ID NO: 411503

SEQ ID NO: 413055 - RNA, 64 nt, Human; identical to SEQ ID NO: 411504

SEQ ID NO: 413056 - RNA, 64 nt, Human
ggcagcagcaaggcgcccaugccacacaccgucucucgaggaaacgcgguucagcgauucuuug

SEQ ID NO: 413057 - RNA, 64 nt, Human
guuuagguucuagguaguggagggccagguggggcucgaggaacguaguguucuuugcauuucu

SEQ ID NO: 413058 - RNA, 64 nt, Human; identical to SEQ ID NO: 411505

SEQ ID NO: 413059 - RNA, 64 nt, Human; identical to SEQ ID NO: 411506

SEQ ID NO: 413060 - RNA, 64 nt, Human; identical to SEQ ID NO: 411507

SEQ ID NO: 413061 - RNA, 64 nt, Human; identical to SEQ ID NO: 411508

SEQ ID NO: 413062 - RNA, 64 nt, Human; identical to SEQ ID NO: 411509

SEQ ID NO: 413063 - RNA, 64 nt, Human; identical to SEQ ID NO: 411510

SEQ ID NO: 413064 - RNA, 64 nt, Human; identical to SEQ ID NO: 411511

SEQ ID NO: 413065 - RNA, 64 nt, Human; identical to SEQ ID NO: 411512

SEQ ID NO: 413066 - RNA, 64 nt, Human; identical to SEQ ID NO: 411513

SEQ ID NO: 413067 - RNA, 64 nt, Human; identical to SEQ ID NO: 411514

SEQ ID NO: 413068 - RNA, 64 nt, Human; identical to SEQ ID NO: 411518

SEQ ID NO: 413069 - RNA, 64 nt, Human; identical to SEQ ID NO: 411519

SEQ ID NO: 413070 - RNA, 64 nt, Human; identical to SEQ ID NO: 411520

SEQ ID NO: 413071 - RNA, 64 nt, Human; identical to SEQ ID NO: 411521

SEQ ID NO: 413072 - RNA, 64 nt, Human; identical to SEQ ID NO: 411522

SEQ ID NO: 413073 - RNA, 64 nt, Human; identical to SEQ ID NO: 411523

SEQ ID NO: 413074 - RNA, 64 nt, Human
ugauuaugagaugugcauauugcuuugggaagagcucgaggaaggaaauaauucucuccuuugu

SEQ ID NO: 413075 - RNA, 64 nt, Human
cccagcuacuuggaaggcugaggugagaggaucacucgaggagauuggggcugccaugagccau

SEQ ID NO: 413076 - RNA, 64 nt, Human
ccucucccacacacauuccagaagucagggcccccucgaggagcacccgcugcagggaugcagg

SEQ ID NO: 413077 - RNA, 64 nt, Human; identical to SEQ ID NO: 411524

SEQ ID NO: 413078 - RNA, 64 nt, Human; identical to SEQ ID NO: 411525

SEQ ID NO: 413079 - RNA, 64 nt, Human; identical to SEQ ID NO: 411526

SEQ ID NO: 413080 - RNA, 64 nt, Human; identical to SEQ ID NO: 411527

SEQ ID NO: 413081 - RNA, 64 nt, Human; identical to SEQ ID NO: 411528

SEQ ID NO: 413082 - RNA, 64 nt, Human; identical to SEQ ID NO: 411529

SEQ ID NO: 413083 - RNA, 64 nt, Human; identical to SEQ ID NO: 411530

SEQ ID NO: 413084 - RNA, 64 nt, Human; identical to SEQ ID NO: 411531

SEQ ID NO: 413085 - RNA, 64 nt, Human; identical to SEQ ID NO: 411532

SEQ ID NO: 413086 - RNA, 59 nt, Human; identical to SEQ ID NO: 411533

SEQ ID NO: 413087 - RNA, 64 nt, Human; identical to SEQ ID NO: 411537

SEQ ID NO: 413088 - RNA, 64 nt, Human; identical to SEQ ID NO: 411538

SEQ ID NO: 413089 - RNA, 64 nt, Human; identical to SEQ ID NO: 411539

SEQ ID NO: 413090 - RNA, 64 nt, Human; identical to SEQ ID NO: 411540

SEQ ID NO: 413091 - RNA, 64 nt, Human; identical to SEQ ID NO: 411541

SEQ ID NO: 413092 - RNA, 64 nt, Human; identical to SEQ ID NO: 411542

SEQ ID NO: 413093 - RNA, 64 nt, Human
gcacuccagccugggcaacacagcgagacuccgucucgaggaaaaaaaaagaaaagauacgugc

SEQ ID NO: 413094 - RNA, 64 nt, Human
uuuuagacaaauacucauguguaugggcaaaaaacucgaggacuguauuugugacuaauuguau

SEQ ID NO: 413095 - RNA, 64 nt, Human; identical to SEQ ID NO: 412537

SEQ ID NO: 413096 - RNA, 64 nt, Human; identical to SEQ ID NO: 411543

SEQ ID NO: 413097 - RNA, 64 nt, Human; identical to SEQ ID NO: 411544

SEQ ID NO: 413098 - RNA, 64 nt, Human; identical to SEQ ID NO: 411545

SEQ ID NO: 413099 - RNA, 64 nt, Human; identical to SEQ ID NO: 411546

SEQ ID NO: 413100 - RNA, 64 nt, Human; identical to SEQ ID NO: 411547

SEQ ID NO: 413101 - RNA, 64 nt, Human; identical to SEQ ID NO: 411548

SEQ ID NO: 413102 - RNA, 64 nt, Human; identical to SEQ ID NO: 411549

SEQ ID NO: 413103 - RNA, 64 nt, Human; identical to SEQ ID NO: 411550

SEQ ID NO: 413104 - RNA, 64 nt, Human; identical to SEQ ID NO: 411551

SEQ ID NO: 413105 - RNA, 64 nt, Human; identical to SEQ ID NO: 411552

SEQ ID NO: 413106 - RNA, 64 nt, Human; identical to SEQ ID NO: 411556

SEQ ID NO: 413107 - RNA, 64 nt, Human; identical to SEQ ID NO: 411557

SEQ ID NO: 413108 - RNA, 64 nt, Human; identical to SEQ ID NO: 411558

SEQ ID NO: 413109 - RNA, 64 nt, Human; identical to SEQ ID NO: 411559

SEQ ID NO: 413110 - RNA, 64 nt, Human; identical to SEQ ID NO: 411560

SEQ ID NO: 413111 - RNA, 64 nt, Human; identical to SEQ ID NO: 411561

SEQ ID NO: 413112 - RNA, 64 nt, Human
caacggccucuagcacccagaaacagggaggguccucgaggaggacacaccagggucucagccu

SEQ ID NO: 413113 - RNA, 64 nt, Human
augcaccugggagcccccuggcuugcacugaacccucgaggaccugggcacggggucggaugga

SEQ ID NO: 413114 - RNA, 64 nt, Human
ucuaucuaauucaaacauaucuccccaugauacaccgccagagugacauugcagacagucugug

SEQ ID NO: 413115 - RNA, 64 nt, Human; identical to SEQ ID NO: 411562

SEQ ID NO: 413116 - RNA, 64 nt, Human; identical to SEQ ID NO: 411563

SEQ ID NO: 413117 - RNA, 64 nt, Human; identical to SEQ ID NO: 411564

SEQ ID NO: 413118 - RNA, 64 nt, Human; identical to SEQ ID NO: 411565

SEQ ID NO: 413119 - RNA, 64 nt, Human; identical to SEQ ID NO: 411566

SEQ ID NO: 413120 - RNA, 64 nt, Human; identical to SEQ ID NO: 411567

SEQ ID NO: 413121 - RNA, 64 nt, Human; identical to SEQ ID NO: 411568

SEQ ID NO: 413122 - RNA, 62 nt, Human; identical to SEQ ID NO: 411569

SEQ ID NO: 413123 - RNA, 64 nt, Human; identical to SEQ ID NO: 411570

SEQ ID NO: 413124 - RNA, 64 nt, Human; identical to SEQ ID NO: 411571

SEQ ID NO: 413125 - RNA, 50 nt, Human; identical to SEQ ID NO: 411575

SEQ ID NO: 413126 - RNA, 64 nt, Human; identical to SEQ ID NO: 411576

SEQ ID NO: 413127 - RNA, 64 nt, Human; identical to SEQ ID NO: 411577

SEQ ID NO: 413128 - RNA, 64 nt, Human; identical to SEQ ID NO: 411578

SEQ ID NO: 413129 - RNA, 64 nt, Human; identical to SEQ ID NO: 411579

SEQ ID NO: 413130 - RNA, 64 nt, Human; identical to SEQ ID NO: 411580

SEQ ID NO: 413131 - RNA, 64 nt, Human; identical to SEQ ID NO: 412574

SEQ ID NO: 413132 - RNA, 64 nt, Human; identical to SEQ ID NO: 412575

SEQ ID NO: 413133 - RNA, 64 nt, Human; identical to SEQ ID NO: 412592

SEQ ID NO: 413134 - RNA, 64 nt, Human; identical to SEQ ID NO: 411581

SEQ ID NO: 413135 - RNA, 64 nt, Human; identical to SEQ ID NO: 411582

SEQ ID NO: 413136 - RNA, 64 nt, Human; identical to SEQ ID NO: 411583

SEQ ID NO: 413137 - RNA, 64 nt, Human; identical to SEQ ID NO: 411584

SEQ ID NO: 413138 - RNA, 64 nt, Human; identical to SEQ ID NO: 411585

SEQ ID NO: 413139 - RNA, 64 nt, Human; identical to SEQ ID NO: 411586

SEQ ID NO: 413140 - RNA, 64 nt, Human; identical to SEQ ID NO: 411587

SEQ ID NO: 413141 - RNA, 64 nt, Human; identical to SEQ ID NO: 411588

SEQ ID NO: 413142 - RNA, 64 nt, Human; identical to SEQ ID NO: 411589

SEQ ID NO: 413143 - RNA, 64 nt, Human; identical to SEQ ID NO: 411590

SEQ ID NO: 413144 - RNA, 64 nt, Human; identical to SEQ ID NO: 411594

SEQ ID NO: 413145 - RNA, 64 nt, Human; identical to SEQ ID NO: 411595

SEQ ID NO: 413146 - RNA, 64 nt, Human; identical to SEQ ID NO: 411596

SEQ ID NO: 413147 - RNA, 64 nt, Human; identical to SEQ ID NO: 411597

SEQ ID NO: 413148 - RNA, 64 nt, Human; identical to SEQ ID NO: 411598

SEQ ID NO: 413149 - RNA, 64 nt, Human; identical to SEQ ID NO: 411599

SEQ ID NO: 413150 - RNA, 64 nt, Human
uugaaauugucacucgcuuacuggauccaagcgucucgaggauaaauaaagaucaugaaaaaga

SEQ ID NO: 413151 - RNA, 64 nt, Human
ugacacccuggggugaggugcucagcaccuuccucucgaggagccacauuuuccuccuuugugu

SEQ ID NO: 413152 - RNA, 64 nt, Human; identical to SEQ ID NO: 412593

SEQ ID NO: 413153 - RNA, 64 nt, Human; identical to SEQ ID NO: 411600

SEQ ID NO: 413154 - RNA, 64 nt, Human; identical to SEQ ID NO: 411601

SEQ ID NO: 413155 - RNA, 64 nt, Human; identical to SEQ ID NO: 411602

SEQ ID NO: 413156 - RNA, 64 nt, Human; identical to SEQ ID NO: 411603

SEQ ID NO: 413157 - RNA, 64 nt, Human; identical to SEQ ID NO: 411604

SEQ ID NO: 413158 - RNA, 64 nt, Human; identical to SEQ ID NO: 411605

SEQ ID NO: 413159 - RNA, 64 nt, Human; identical to SEQ ID NO: 411606

SEQ ID NO: 413160 - RNA, 64 nt, Human; identical to SEQ ID NO: 411607

SEQ ID NO: 413161 - RNA, 64 nt, Human; identical to SEQ ID NO: 411608

SEQ ID NO: 413162 - RNA, 64 nt, Human; identical to SEQ ID NO: 411609

SEQ ID NO: 413163 - RNA, 64 nt, Human; identical to SEQ ID NO: 411613

SEQ ID NO: 413164 - RNA, 64 nt, Human; identical to SEQ ID NO: 411614

SEQ ID NO: 413165 - RNA, 64 nt, Human; identical to SEQ ID NO: 411615

SEQ ID NO: 413166 - RNA, 64 nt, Human; identical to SEQ ID NO: 411616

SEQ ID NO: 413167 - RNA, 64 nt, Human; identical to SEQ ID NO: 411617

SEQ ID NO: 413168 - RNA, 64 nt, Human; identical to SEQ ID NO: 411618

SEQ ID NO: 413169 - RNA, 64 nt, Human; identical to SEQ ID NO: 412611

SEQ ID NO: 413170 - RNA, 64 nt, Human; identical to SEQ ID NO: 412612

SEQ ID NO: 413171 - RNA, 64 nt, Human; identical to SEQ ID NO: 412613

SEQ ID NO: 413172 - RNA, 64 nt, Human; identical to SEQ ID NO: 411619

SEQ ID NO: 413173 - RNA, 64 nt, Human; identical to SEQ ID NO: 411620

SEQ ID NO: 413174 - RNA, 64 nt, Human; identical to SEQ ID NO: 411621

SEQ ID NO: 413175 - RNA, 64 nt, Human; identical to SEQ ID NO: 411622

SEQ ID NO: 413176 - RNA, 64 nt, Human; identical to SEQ ID NO: 411623

SEQ ID NO: 413177 - RNA, 64 nt, Human; identical to SEQ ID NO: 411624

SEQ ID NO: 413178 - RNA, 64 nt, Human; identical to SEQ ID NO: 411625

SEQ ID NO: 413179 - RNA, 64 nt, Human; identical to SEQ ID NO: 411626

SEQ ID NO: 413180 - RNA, 64 nt, Human; identical to SEQ ID NO: 411627

SEQ ID NO: 413181 - RNA, 64 nt, Human; identical to SEQ ID NO: 411628

SEQ ID NO: 413182 - RNA, 64 nt, Human; identical to SEQ ID NO: 411632

SEQ ID NO: 413183 - RNA, 64 nt, Human; identical to SEQ ID NO: 411633

SEQ ID NO: 413184 - RNA, 64 nt, Human; identical to SEQ ID NO: 411634

SEQ ID NO: 413185 - RNA, 64 nt, Human; identical to SEQ ID NO: 411635

SEQ ID NO: 413186 - RNA, 64 nt, Human; identical to SEQ ID NO: 411636

SEQ ID NO: 413187 - RNA, 64 nt, Human; identical to SEQ ID NO: 411637

SEQ ID NO: 413188 - RNA, 64 nt, Human; identical to SEQ ID NO: 412686

SEQ ID NO: 413189 - RNA, 64 nt, Human; identical to SEQ ID NO: 410576

SEQ ID NO: 413190 - RNA, 64 nt, Human; identical to SEQ ID NO: 412631

SEQ ID NO: 413191 - RNA, 64 nt, Human; identical to SEQ ID NO: 411638

SEQ ID NO: 413192 - RNA, 64 nt, Human; identical to SEQ ID NO: 411639

SEQ ID NO: 413193 - RNA, 64 nt, Human; identical to SEQ ID NO: 411640

SEQ ID NO: 413194 - RNA, 64 nt, Human; identical to SEQ ID NO: 411641

SEQ ID NO: 413195 - RNA, 64 nt, Human; identical to SEQ ID NO: 411642

SEQ ID NO: 413196 - RNA, 64 nt, Human; identical to SEQ ID NO: 411643

SEQ ID NO: 413197 - RNA, 64 nt, Human; identical to SEQ ID NO: 411644

SEQ ID NO: 413198 - RNA, 64 nt, Human; identical to SEQ ID NO: 411645

SEQ ID NO: 413199 - RNA, 64 nt, Human; identical to SEQ ID NO: 411646

SEQ ID NO: 413200 - RNA, 64 nt, Human; identical to SEQ ID NO: 411647

SEQ ID NO: 413201 - RNA, 64 nt, Human; identical to SEQ ID NO: 411651

SEQ ID NO: 413202 - RNA, 64 nt, Human; identical to SEQ ID NO: 411652

SEQ ID NO: 413203 - RNA, 64 nt, Human; identical to SEQ ID NO: 411653

SEQ ID NO: 413204 - RNA, 64 nt, Human; identical to SEQ ID NO: 411654

SEQ ID NO: 413205 - RNA, 64 nt, Human; identical to SEQ ID NO: 411655

SEQ ID NO: 413206 - RNA, 64 nt, Human; identical to SEQ ID NO: 411656

SEQ ID NO: 413207 - RNA, 64 nt, Human
cccagaagaagccgugaacuucaucuuguccugucucgaggaugaaaagauccagacccgggaa

SEQ ID NO: 413208 - RNA, 64 nt, Human
gaaugagccuucgacccugaaauccuuggggugccucgaggacgacuggccgaaaagccgcauu

SEQ ID NO: 413209 - RNA, 64 nt, Human
ucaccugccccucccccaucccagguuguggaggcucgaggaagcugacuucuuaggcuaaagg

SEQ ID NO: 413210 - RNA, 64 nt, Human; identical to SEQ ID NO: 411657

SEQ ID NO: 413211 - RNA, 64 nt, Human; identical to SEQ ID NO: 411658

SEQ ID NO: 413212 - RNA, 64 nt, Human; identical to SEQ ID NO: 411659

SEQ ID NO: 413213 - RNA, 64 nt, Human; identical to SEQ ID NO: 411660

SEQ ID NO: 413214 - RNA, 64 nt, Human; identical to SEQ ID NO: 411661

SEQ ID NO: 413215 - RNA, 64 nt, Human; identical to SEQ ID NO: 411662

SEQ ID NO: 413216 - RNA, 64 nt, Human; identical to SEQ ID NO: 411663

SEQ ID NO: 413217 - RNA, 64 nt, Human; identical to SEQ ID NO: 411664

SEQ ID NO: 413218 - RNA, 64 nt, Human; identical to SEQ ID NO: 411665

SEQ ID NO: 413219 - RNA, 64 nt, Human; identical to SEQ ID NO: 411666

SEQ ID NO: 413220 - RNA, 64 nt, Human; identical to SEQ ID NO: 411670

SEQ ID NO: 413221 - RNA, 64 nt, Human; identical to SEQ ID NO: 411671

SEQ ID NO: 413222 - RNA, 64 nt, Human; identical to SEQ ID NO: 411672

SEQ ID NO: 413223 - RNA, 64 nt, Human; identical to SEQ ID NO: 411673

SEQ ID NO: 413224 - RNA, 64 nt, Human; identical to SEQ ID NO: 411674

SEQ ID NO: 413225 - RNA, 64 nt, Human; identical to SEQ ID NO: 411675

SEQ ID NO: 413226 - RNA, 64 nt, Human; identical to SEQ ID NO: 410541

SEQ ID NO: 413227 - RNA, 64 nt, Human; identical to SEQ ID NO: 412535

SEQ ID NO: 413228 - RNA, 64 nt, Human
gagcauauuagcacaucacuccaagcaacaaccuccgccagaagaaagcaaaugcuguuuuacu

SEQ ID NO: 413229 - RNA, 64 nt, Human; identical to SEQ ID NO: 411676

SEQ ID NO: 413230 - RNA, 64 nt, Human; identical to SEQ ID NO: 411677

SEQ ID NO: 413231 - RNA, 64 nt, Human; identical to SEQ ID NO: 411678

SEQ ID NO: 413232 - RNA, 58 nt, Human; identical to SEQ ID NO: 411679

SEQ ID NO: 413233 - RNA, 64 nt, Human; identical to SEQ ID NO: 411680

SEQ ID NO: 413234 - RNA, 64 nt, Human; identical to SEQ ID NO: 411681

SEQ ID NO: 413235 - RNA, 64 nt, Human; identical to SEQ ID NO: 411682

SEQ ID NO: 413236 - RNA, 64 nt, Human; identical to SEQ ID NO: 411683

SEQ ID NO: 413237 - RNA, 64 nt, Human; identical to SEQ ID NO: 411684

SEQ ID NO: 413238 - RNA, 64 nt, Human; identical to SEQ ID NO: 411685

SEQ ID NO: 413239 - RNA, 64 nt, Human; identical to SEQ ID NO: 411689

SEQ ID NO: 413240 - RNA, 64 nt, Human; identical to SEQ ID NO: 411690

SEQ ID NO: 413241 - RNA, 64 nt, Human; identical to SEQ ID NO: 411691

SEQ ID NO: 413242 - RNA, 64 nt, Human; identical to SEQ ID NO: 411692

SEQ ID NO: 413243 - RNA, 64 nt, Human; identical to SEQ ID NO: 411693

SEQ ID NO: 413244 - RNA, 64 nt, Human; identical to SEQ ID NO: 411694

SEQ ID NO: 413245 - RNA, 64 nt, Human
gauuuccaauuguuaauaacgcuauguuagcgcgcucgaggaagaagguaggaaucccggcucc

SEQ ID NO: 413246 - RNA, 64 nt, Human
ucuccagccauggucagacaggucacccaggagccucgaggaaagcccuggagggaaucacaug

SEQ ID NO: 413247 - RNA, 64 nt, Human; identical to SEQ ID NO: 410577

SEQ ID NO: 413248 - RNA, 64 nt, Human; identical to SEQ ID NO: 411695

SEQ ID NO: 413249 - RNA, 64 nt, Human; identical to SEQ ID NO: 411696

SEQ ID NO: 413250 - RNA, 64 nt, Human; identical to SEQ ID NO: 411697

SEQ ID NO: 413251 - RNA, 64 nt, Human; identical to SEQ ID NO: 411698

SEQ ID NO: 413252 - RNA, 64 nt, Human; identical to SEQ ID NO: 411699

SEQ ID NO: 413253 - RNA, 64 nt, Human; identical to SEQ ID NO: 411700

SEQ ID NO: 413254 - RNA, 64 nt, Human; identical to SEQ ID NO: 411701

SEQ ID NO: 413255 - RNA, 64 nt, Human; identical to SEQ ID NO: 411702

SEQ ID NO: 413256 - RNA, 64 nt, Human; identical to SEQ ID NO: 411703

SEQ ID NO: 413257 - RNA, 64 nt, Human; identical to SEQ ID NO: 411704

SEQ ID NO: 413258 - RNA, 64 nt, Human; identical to SEQ ID NO: 411708

SEQ ID NO: 413259 - RNA, 64 nt, Human; identical to SEQ ID NO: 411709

SEQ ID NO: 413260 - RNA, 64 nt, Human; identical to SEQ ID NO: 411710

SEQ ID NO: 413261 - RNA, 64 nt, Human; identical to SEQ ID NO: 411711

SEQ ID NO: 413262 - RNA, 64 nt, Human; identical to SEQ ID NO: 411712

SEQ ID NO: 413263 - RNA, 64 nt, Human; identical to SEQ ID NO: 411713

SEQ ID NO: 413264 - RNA, 64 nt, Human
cccagcagagccugcauugauaacagccuuaacccucgaggaauaccucaauaccucagacaag

SEQ ID NO: 413265 - RNA, 64 nt, Human
gcugacugugcgcuagacacugccaggcccgggccucgaggaggaaaagacaguagggaagaca

SEQ ID NO: 413266 - RNA, 64 nt, Human
agauacugagucuuccuuuccuuuucugacccuucucgaggacauuugcuuuccucacacuuuu

SEQ ID NO: 413267 - RNA, 64 nt, Human; identical to SEQ ID NO: 411714

SEQ ID NO: 413268 - RNA, 64 nt, Human; identical to SEQ ID NO: 411715

SEQ ID NO: 413269 - RNA, 64 nt, Human; identical to SEQ ID NO: 411716

SEQ ID NO: 413270 - RNA, 64 nt, Human; identical to SEQ ID NO: 411717

SEQ ID NO: 413271 - RNA, 64 nt, Human; identical to SEQ ID NO: 411718

SEQ ID NO: 413272 - RNA, 64 nt, Human; identical to SEQ ID NO: 411719

SEQ ID NO: 413273 - RNA, 64 nt, Human; identical to SEQ ID NO: 411720

SEQ ID NO: 413274 - RNA, 64 nt, Human; identical to SEQ ID NO: 411721

SEQ ID NO: 413275 - RNA, 64 nt, Human; identical to SEQ ID NO: 411722

SEQ ID NO: 413276 - RNA, 64 nt, Human; identical to SEQ ID NO: 411723

SEQ ID NO: 413277 - RNA, 64 nt, Human; identical to SEQ ID NO: 411727

SEQ ID NO: 413278 - RNA, 64 nt, Human; identical to SEQ ID NO: 411728

SEQ ID NO: 413279 - RNA, 64 nt, Human; identical to SEQ ID NO: 411729

SEQ ID NO: 413280 - RNA, 64 nt, Human; identical to SEQ ID NO: 411730

SEQ ID NO: 413281 - RNA, 64 nt, Human; identical to SEQ ID NO: 411731

SEQ ID NO: 413282 - RNA, 64 nt, Human; identical to SEQ ID NO: 411732

SEQ ID NO: 413283 - RNA, 64 nt, Human
guuaaaugccugucuccccgcggaucaugggcuccucgaggacagggacuggccugucugucca

SEQ ID NO: 413284 - RNA, 64 nt, Human
cccguuccccccagguggccugggagguggcccccucgaggaugacuccacuagcgcccuggga

SEQ ID NO: 413285 - RNA, 64 nt, Human
guuaaacacuaccuugaucauucucuccucuuuccucgaggaacuccuggaggguuugagcguc

SEQ ID NO: 413286 - RNA, 64 nt, Human; identical to SEQ ID NO: 411733

SEQ ID NO: 413287 - RNA, 64 nt, Human; identical to SEQ ID NO: 411734

SEQ ID NO: 413288 - RNA, 64 nt, Human; identical to SEQ ID NO: 411735

SEQ ID NO: 413289 - RNA, 64 nt, Human; identical to SEQ ID NO: 411736

SEQ ID NO: 413290 - RNA, 64 nt, Human; identical to SEQ ID NO: 411737

SEQ ID NO: 413291 - RNA, 64 nt, Human; identical to SEQ ID NO: 411738

SEQ ID NO: 413292 - RNA, 64 nt, Human; identical to SEQ ID NO: 411739

SEQ ID NO: 413293 - RNA, 64 nt, Human; identical to SEQ ID NO: 411740

SEQ ID NO: 413294 - RNA, 64 nt, Human; identical to SEQ ID NO: 411741

SEQ ID NO: 413295 - RNA, 64 nt, Human; identical to SEQ ID NO: 411742

SEQ ID NO: 413296 - RNA, 64 nt, Human; identical to SEQ ID NO: 411746

SEQ ID NO: 413297 - RNA, 64 nt, Human; identical to SEQ ID NO: 411747

SEQ ID NO: 413298 - RNA, 64 nt, Human; identical to SEQ ID NO: 411748

SEQ ID NO: 413299 - RNA, 64 nt, Human; identical to SEQ ID NO: 411749

SEQ ID NO: 413300 - RNA, 64 nt, Human; identical to SEQ ID NO: 411750

SEQ ID NO: 413301 - RNA, 64 nt, Human; identical to SEQ ID NO: 411751

SEQ ID NO: 413302 - RNA, 64 nt, Human
gccuccggcggcccaggauucuaaggaugcaauccucgaggaaaauuagucgauucucagauua

SEQ ID NO: 413303 - RNA, 62 nt, Human
ucggggcccuggggcugugagaccccgacccucucgaggaacccugccugagacgccuccau

SEQ ID NO: 413304 - RNA, 64 nt, Human
gccagguccaugggggcuggcaucccagcuccaacucgaggagccucaguuuccucaucuguaa

SEQ ID NO: 413305 - RNA, 64 nt, Human; identical to SEQ ID NO: 411752

SEQ ID NO: 413306 - RNA, 64 nt, Human; identical to SEQ ID NO: 411753

SEQ ID NO: 413307 - RNA, 64 nt, Human; identical to SEQ ID NO: 411754

SEQ ID NO: 413308 - RNA, 64 nt, Human; identical to SEQ ID NO: 411755

SEQ ID NO: 413309 - RNA, 64 nt, Human; identical to SEQ ID NO: 411756

SEQ ID NO: 413310 - RNA, 64 nt, Human; identical to SEQ ID NO: 411757

SEQ ID NO: 413311 - RNA, 64 nt, Human; identical to SEQ ID NO: 411758

SEQ ID NO: 413312 - RNA, 64 nt, Human; identical to SEQ ID NO: 411759

SEQ ID NO: 413313 - RNA, 64 nt, Human; identical to SEQ ID NO: 411760

SEQ ID NO: 413314 - RNA, 64 nt, Human; identical to SEQ ID NO: 411761

SEQ ID NO: 413315 - RNA, 64 nt, Human; identical to SEQ ID NO: 411765

SEQ ID NO: 413316 - RNA, 64 nt, Human; identical to SEQ ID NO: 411766

SEQ ID NO: 413317 - RNA, 64 nt, Human; identical to SEQ ID NO: 411767

SEQ ID NO: 413318 - RNA, 64 nt, Human; identical to SEQ ID NO: 411768

SEQ ID NO: 413319 - RNA, 64 nt, Human; identical to SEQ ID NO: 411769

SEQ ID NO: 413320 - RNA, 64 nt, Human; identical to SEQ ID NO: 411770

SEQ ID NO: 413321 - RNA, 64 nt, Human; identical to SEQ ID NO: 410593

SEQ ID NO: 413322 - RNA, 64 nt, Human; identical to SEQ ID NO: 412703

SEQ ID NO: 413323 - RNA, 64 nt, Human; identical to SEQ ID NO: 412704

SEQ ID NO: 413324 - RNA, 64 nt, Human; identical to SEQ ID NO: 411771

SEQ ID NO: 413325 - RNA, 64 nt, Human; identical to SEQ ID NO: 411772

SEQ ID NO: 413326 - RNA, 64 nt, Human; identical to SEQ ID NO: 411773

SEQ ID NO: 413327 - RNA, 64 nt, Human; identical to SEQ ID NO: 411774

SEQ ID NO: 413328 - RNA, 64 nt, Human; identical to SEQ ID NO: 411775

SEQ ID NO: 413329 - RNA, 64 nt, Human; identical to SEQ ID NO: 411776

SEQ ID NO: 413330 - RNA, 64 nt, Human; identical to SEQ ID NO: 411777

SEQ ID NO: 413331 - RNA, 64 nt, Human; identical to SEQ ID NO: 411778

SEQ ID NO: 413332 - RNA, 64 nt, Human; identical to SEQ ID NO: 411779

SEQ ID NO: 413333 - RNA, 64 nt, Human; identical to SEQ ID NO: 411780

SEQ ID NO: 413334 - RNA, 64 nt, Human; identical to SEQ ID NO: 411784

SEQ ID NO: 413335 - RNA, 64 nt, Human; identical to SEQ ID NO: 411785

SEQ ID NO: 413336 - RNA, 64 nt, Human; identical to SEQ ID NO: 411786

SEQ ID NO: 413337 - RNA, 64 nt, Human; identical to SEQ ID NO: 411787

SEQ ID NO: 413338 - RNA, 64 nt, Human; identical to SEQ ID NO: 411788

SEQ ID NO: 413339 - RNA, 64 nt, Human; identical to SEQ ID NO: 411789

SEQ ID NO: 413340 - RNA, 64 nt, Human
cacacauugaccaagccagacccgguucacccagcucgaggaucccagguugaagaguggcccc

SEQ ID NO: 413341 - RNA, 64 nt, Human
ucuccucccucccacuucugcacccuuucaccaccucgaggagauuugcuccccauuagcgaau

SEQ ID NO: 413342 - RNA, 64 nt, Human; identical to SEQ ID NO: 413094

SEQ ID NO: 413343 - RNA, 64 nt, Human; identical to SEQ ID NO: 411790

SEQ ID NO: 413344 - RNA, 64 nt, Human; identical to SEQ ID NO: 411791

SEQ ID NO: 413345 - RNA, 64 nt, Human; identical to SEQ ID NO: 411792

SEQ ID NO: 413346 - RNA, 64 nt, Human; identical to SEQ ID NO: 411793

SEQ ID NO: 413347 - RNA, 64 nt, Human; identical to SEQ ID NO: 411794

SEQ ID NO: 413348 - RNA, 64 nt, Human; identical to SEQ ID NO: 411795

SEQ ID NO: 413349 - RNA, 64 nt, Human; identical to SEQ ID NO: 411796

SEQ ID NO: 413350 - RNA, 64 nt, Human; identical to SEQ ID NO: 411797

SEQ ID NO: 413351 - RNA, 64 nt, Human; identical to SEQ ID NO: 411798

SEQ ID NO: 413352 - RNA, 64 nt, Human; identical to SEQ ID NO: 411799

SEQ ID NO: 413353 - RNA, 64 nt, Human; identical to SEQ ID NO: 411803

SEQ ID NO: 413354 - RNA, 64 nt, Human; identical to SEQ ID NO: 411804

SEQ ID NO: 413355 - RNA, 64 nt, Human
uccagaggcccuaggcgggaugggcucgcugaaccucgaggaacuccaggacgaggaggacaug

SEQ ID NO: 413356 - RNA, 64 nt, Human
ggcccuccuggugcccacucccgccagccccugccucgaggacugauacugcagugacugccgu

SEQ ID NO: 413357 - RNA, 64 nt, Human
ccccuccuagcccugugguuaucccuagguggcucucgaggaguuaacuccaugagcccaggga

SEQ ID NO: 413358 - RNA, 64 nt, Human
accuguccacguggccagggcccaugcugccacccucgaggagauggaacccugugaugcaaaa

SEQ ID NO: 413359 - RNA, 64 nt, Human
uccccugcgucuccuuguaaaguuccaugagaugcucgaggagcaccugcugguggggcaccca

SEQ ID NO: 413360 - RNA, 62 nt, Human
uuccagcuggagaggaauaaccaucccuacaacucgaggauagccaucaggagcacuguugg

SEQ ID NO: 413361 - RNA, 64 nt, Human
ucuccacagacuaacauugaagucuuccagaaaccucgaggagcugggcuagauacuucgagag

SEQ ID NO: 413362 - RNA, 64 nt, Human
acgggugcaggcccggccuuuccccacgcggacuccgcgcgaccccggcccucucccugcggcc

SEQ ID NO: 413363 - RNA, 64 nt, Human
cugcgggcugccccgcuuugcggacgggcuguccccgcgcgaacggaacguuggacuuuucguu

SEQ ID NO: 413364 - RNA, 64 nt, Human
cuggccccgcccugcacuccagcucgccccuuucccgcgcgaagugaaggaugcgucacuuuuc

SEQ ID NO: 413365 - RNA, 64 nt, Human
augguaaaagcuucccgacuguucuacuuuggguccgcgcgaagcccacucacgugugaucugu

SEQ ID NO: 413366 - RNA, 64 nt, Human
gagccgcgccaacgcacgcaacccuugcugcugcccgcgcgaagugggcauugcaaagugcgcu

SEQ ID NO: 413367 - RNA, 64 nt, Human
gugcaugccaggccgggccggaggcucgaaagucccgcgcgagcgccacggccuccgggcgcgc

SEQ ID NO: 413368 - RNA, 64 nt, Human
aggagcugccggccggggccacgcuccacagccgccgcgcgacaguggagccaaggguuagggc

SEQ ID NO: 413369 - RNA, 64 nt, Human; identical to SEQ ID NO: 412651

SEQ ID NO: 413370 - RNA, 64 nt, Human; identical to SEQ ID NO: 412440

SEQ ID NO: 413371 - RNA, 64 nt, Human; identical to SEQ ID NO: 412327

SEQ ID NO: 413372 - RNA, 64 nt, Human; identical to SEQ ID NO: 270185

SEQ ID NO: 413373 - RNA, 64 nt, Human; identical to SEQ ID NO: 270186

SEQ ID NO: 413374 - RNA, 64 nt, Human; identical to SEQ ID NO: 270187

SEQ ID NO: 413375 - RNA, 64 nt, Human; identical to SEQ ID NO: 270188

SEQ ID NO: 413376 - RNA, 64 nt, Human; identical to SEQ ID NO: 270189

SEQ ID NO: 413377 - RNA, 64 nt, Human; identical to SEQ ID NO: 270190

SEQ ID NO: 413378 - RNA, 64 nt, Human; identical to SEQ ID NO: 270191

SEQ ID NO: 413379 - RNA, 64 nt, Human; identical to SEQ ID NO: 270192

SEQ ID NO: 413380 - RNA, 64 nt, Human; identical to SEQ ID NO: 270193

SEQ ID NO: 413381 - RNA, 64 nt, Human; identical to SEQ ID NO: 410594

SEQ ID NO: 413382 - RNA, 64 nt, Human; identical to SEQ ID NO: 412722

SEQ ID NO: 413383 - RNA, 64 nt, Human; identical to SEQ ID NO: 412723

SEQ ID NO: 413384 - RNA, 64 nt, Human; identical to SEQ ID NO: 270194

SEQ ID NO: 413385 - RNA, 64 nt, Human; identical to SEQ ID NO: 270195

SEQ ID NO: 413386 - RNA, 64 nt, Human; identical to SEQ ID NO: 270196

SEQ ID NO: 413387 - RNA, 64 nt, Human; identical to SEQ ID NO: 270197

SEQ ID NO: 413388 - RNA, 64 nt, Human; identical to SEQ ID NO: 270198

SEQ ID NO: 413389 - RNA, 64 nt, Human; identical to SEQ ID NO: 412724

SEQ ID NO: 413390 - RNA, 64 nt, Human; identical to SEQ ID NO: 412857

SEQ ID NO: 413391 - RNA, 64 nt, Human; identical to SEQ ID NO: 412969

SEQ ID NO: 413392 - RNA, 64 nt, Human; identical to SEQ ID NO: 412874

SEQ ID NO: 413393 - RNA, 64 nt, Human; identical to SEQ ID NO: 412893

SEQ ID NO: 413394 - RNA, 64 nt, Human; identical to SEQ ID NO: 409092

SEQ ID NO: 413395 - RNA, 64 nt, Human; identical to SEQ ID NO: 412910

SEQ ID NO: 413396 - RNA, 64 nt, Human; identical to SEQ ID NO: 412911

SEQ ID NO: 413397 - RNA, 64 nt, Human; identical to SEQ ID NO: 412912

SEQ ID NO: 413398 - RNA, 64 nt, Human; identical to SEQ ID NO: 412931

SEQ ID NO: 413399 - RNA, 64 nt, Human; identical to SEQ ID NO: 409093

SEQ ID NO: 413400 - RNA, 64 nt, Human; identical to SEQ ID NO: 412950

SEQ ID NO: 413401 - RNA, 64 nt, Human; identical to SEQ ID NO: 412967

SEQ ID NO: 413402 - RNA, 64 nt, Human; identical to SEQ ID NO: 412968

SEQ ID NO: 413403 - RNA, 64 nt, Human; identical to SEQ ID NO: 410539

SEQ ID NO: 413404 - RNA, 64 nt, Human; identical to SEQ ID NO: 413114

SEQ ID NO: 413405 - RNA, 64 nt, Human; identical to SEQ ID NO: 412760

SEQ ID NO: 413406 - RNA, 64 nt, Human; identical to SEQ ID NO: 412761

SEQ ID NO: 413407 - RNA, 64 nt, Human; identical to SEQ ID NO: 410540

SEQ ID NO: 413408 - RNA, 64 nt, Human; identical to SEQ ID NO: 413228

SEQ ID NO: 413409 - RNA, 64 nt, Human; identical to SEQ ID NO: 412741

SEQ ID NO: 413410 - RNA, 64 nt, Human; identical to SEQ ID NO: 412742

SEQ ID NO: 413411 - RNA, 64 nt, Human
ccugacuuuuaaugucauuuguuaaaauacaguucugucauauguuaagcagcuaaauuuucug

SEQ ID NO: 413412 - RNA, 64 nt, Human
auacaaaaacaaaaaccuacuagucuugaacaaacugucauacguaugggaccuacacuuaauc

SEQ ID NO: 413413 - RNA, 64 nt, Human
agagagaccgcagaaggaggaagauacugugguacugucauaaaaaacaguggagcucuguauu

SEQ ID NO: 413414 - RNA, 64 nt, Human
uuuuuuguuuuuuaagaugcugugcuguaaaauacugucauacuugcuauuuccugguacagug

SEQ ID NO: 413415 - RNA, 64 nt, Human
ggcuguuagccagcugugcuguggugcugugggucugucauacccucccuugcuucuguucaca

SEQ ID NO: 413416 - RNA, 64 nt, Human
aggcuugugguuuguuagaggguauuuguggaaacugucauagggauugucccuguguuguccc

SEQ ID NO: 413417 - RNA, 64 nt, Human
cuuacagaagacacaacuccuuccccagugaucacugucauaaccagugcucuaccguauccca

SEQ ID NO: 413418 - RNA, 64 nt, Human
aaaaggaauucuggaaagaaaaccauucuggacacugucauaacacacauagauagauuuucuu

SEQ ID NO: 413419 - RNA, 64 nt, Human
ggugggugcuacuucugauucauuguccuugucccugucauaaguaccucccuauuguagauag

SEQ ID NO: 413420 - RNA, 64 nt, Human
uucuccauaaggcaucucagucaaauccccaucacugucauaaauucaaauaaaaugucugaac

SEQ ID NO: 413421 - RNA, 64 nt, Human
cauauuacugaaagacacauuuuaauaaagauuucugucauaauucaacuuaccucauuuuccu

SEQ ID NO: 413422 - RNA, 64 nt, Human
augugcauccugugaauaaaccacgucuuggucacugucauauuuugaaccaucucaucagaga

SEQ ID NO: 413423 - RNA, 64 nt, Human
ggccucuugaugcucauaucuguucuucagcagccugucauaggaacuggauccuaccuauguu

SEQ ID NO: 413424 - RNA, 64 nt, Human
gcaguuuguacacuaaaacuaaguuuuuggcugacugucauauugugguccuuaaucuugagau

SEQ ID NO: 413425 - RNA, 64 nt, Human
uggaggggugacuguguccgugguguguauuaugcugucauaucagagucaagugaacuguggu

SEQ ID NO: 413426 - RNA, 64 nt, Human
cuucacaguguuucgacagcugauuacacaguugcugucauaagaaugaauaauaauuauccag

SEQ ID NO: 413427 - RNA, 62 nt, Human
caacaucaacaaauaaauaagaaagcaaaaagaucugggauauguguuggaaaacugcuuuc

SEQ ID NO: 413428 - RNA, 64 nt, Human
agcaguccuaaaaguuuaaaauccgauaaggaauaucugggacaggguuuagaucaugacucua

SEQ ID NO: 413429 - RNA, 64 nt, Human
cuggcaccagcagugugggugggccucauguaacaucugggaggggcuucauccccccacccag

SEQ ID NO: 413430 - RNA, 64 nt, Human
auaaaaccaaaacucauucguuuaaugaacuugacugucauaccucuauuuaguaauugcgagg

SEQ ID NO: 413431 - RNA, 64 nt, Human
guaaaauagagaagguuugaagguuugaguuacucugucauauaacauguagaucagucuucau

SEQ ID NO: 413432 - RNA, 64 nt, Human
uagaugcagccacuuguuuuuuaaauagaaguggcugucauacgugaaauaaggugaaagugac

SEQ ID NO: 413433 - RNA, 64 nt, Human
acaacuuuggacauagcgaauacaaaauuggaagcugucauaaaaagacaacucagaggccagg

SEQ ID NO: 413434 - RNA, 64 nt, Human
uccaccaugugcaucaggaaacaccucacucauacugucauauaaugcaacagggaggcauagu

SEQ ID NO: 413435 - RNA, 64 nt, Human
gcccagccccaccuccuucccuuuaauccugccacugucauaugcuaccuuuccuaucucuucc

SEQ ID NO: 413436 - RNA, 64 nt, Human
ccugagaagaacuacggagaaaucaaauaaaauccugucauauuuuuuucacccugccuuucca

SEQ ID NO: 413437 - RNA, 64 nt, Human
ccgacagauuaaaugcguguuggggauugguuuccugucauagcugcugcugcugccaugcgca

SEQ ID NO: 413438 - RNA, 64 nt, Human
cagucaggacauggacuuggaacucaggauggggcugucauagacagacccaccaguaggaacu

SEQ ID NO: 413439 - RNA, 64 nt, Human
gcuacuuuuuuaaauacuguaucauaaguucagccugucauacuuuuugcauugaucguuauga

SEQ ID NO: 413440 - RNA, 64 nt, Human
agguuauuuaaacuuugggaaauguacuuuuagucugucauaucaaggcaugagucacugucuu

SEQ ID NO: 413441 - RNA, 64 nt, Human
auuucuuucuuuuuuuuuuuaauguauagguguucugucauacguuauugugagcuuugguucu

SEQ ID NO: 413442 - RNA, 64 nt, Human
uguuuaagaagauuaguuaccauugaaauugguucugucauaaaacagcaugagucugguuuua

SEQ ID NO: 413443 - RNA, 64 nt, Human
caggauuuucuaggaguuacacauacauuuuauccugucauaccucgagauaaaguggcauguu

SEQ ID NO: 413444 - RNA, 64 nt, Human
acauguagauaccacaccaaggcuggaggcuggucugucauaagacagaaagaaagacgcuggg

SEQ ID NO: 413445 - RNA, 64 nt, Human
uuacuggggaaauagaucagccacuuuuaaggugcugucauauaucuuggaaugaaugaccuaa

SEQ ID NO: 413446 - RNA, 64 nt, Human
uuucaugaagaaccauuggaaagaggaaucugcaaucugggagcuuaagagcaaaugaugacca

SEQ ID NO: 413447 - RNA, 64 nt, Human
agguguggucaugcaucauaaccaacauucacucaucugggacauucuuaagauacauuuauaa

SEQ ID NO: 413448 - RNA, 64 nt, Human
auguuuaaguugaggaaaacucaguucuuaaauuaucugggaagggucuggauucucuauuuuu

SEQ ID NO: 413449 - RNA, 64 nt, Human
uuugggggagccugcuagaaugucacauggauggcugucauagggguuguacauauccuuuuuu

SEQ ID NO: 413450 - RNA, 64 nt, Human
cucuuaaagacacucacuguacaacugaaagcagcugucauauuucuggcaaaauguguuuacg

SEQ ID NO: 413451 - RNA, 64 nt, Human
ugcugccuuaaaagagccauuuauuuuuagagaucugucauauuaugaaaguucugggcuaucu

SEQ ID NO: 413452 - RNA, 64 nt, Human
uuuuguuccucugauagacaugacugacuuuuagcugucauaauguauuaaccuaacagaugaa

SEQ ID NO: 413453 - RNA, 64 nt, Human
gucagacaguuuuuaauuuuucuugcuuugaacccugucauaaugacugugcaauacaugugca

SEQ ID NO: 413454 - RNA, 64 nt, Human
aagagcaucguuccaaugcuuguucacuguuccucugucauacuguaucuggaaugcuuuguaa

SEQ ID NO: 413455 - RNA, 64 nt, Human
aauuacaaugcauauaugucuauuuauucaauaucugucauauaauaucuauuuggaagaagaa

SEQ ID NO: 413456 - RNA, 64 nt, Human
caggaugucuuaaaugauucuuuguguaccuuuucugucauauucagaaaccguuuugugccug

SEQ ID NO: 413457 - RNA, 64 nt, Human
aaagguagaagugggaguuguuuacuuaauuuuacugucauaccaugcuauuaccuacacuccu

SEQ ID NO: 413458 - RNA, 64 nt, Human
gaagcagucuggacuuagaaaggaaauagguggucugucauaggggcuuucauuagaguuaaac

SEQ ID NO: 413459 - RNA, 64 nt, Human
uacuuccuucagggcagcagccacagccaggcuucugucauacagguagaucccgaagcacaga

SEQ ID NO: 413460 - RNA, 64 nt, Human
ggaggaauuagucacaaaugacuuguagaaaauacugucauauaguucauuucaucauuuucug

SEQ ID NO: 413461 - RNA, 64 nt, Human
cagacuguguggaccaaaaggccacauacagucucugucauaacuacucaacucuguuucugaa

SEQ ID NO: 413462 - RNA, 64 nt, Human
gccgugcuauguaaauauuuuauggauauaacaacugucauauuuugaugucaacagaguuuua

SEQ ID NO: 413463 - RNA, 64 nt, Human
uagcagcuggucuugagaaguagaagcaucuuaacugucauaagagcauagauuuuuuguuuuu

SEQ ID NO: 413464 - RNA, 64 nt, Human
augauuuguuaauauuauuaauuaaaaguuacagcugucauaagaucauaauuuuaugaacaga

SEQ ID NO: 413465 - RNA, 64 nt, Human
cgaauauagccacagaaauaaaggauggagaaaaaucugggacagguaauuuugcaaaacacau

SEQ ID NO: 413466 - RNA, 64 nt, Human
cgaacauagccacagaaauaaaggauggagaaaaaucugggacagguaauuuugcaaaagacau

SEQ ID NO: 413467 - RNA, 64 nt, Human
cuacucaggaggcugaggcaggagaaucgcuugaaucugggaggcagagguugcugugagccga

SEQ ID NO: 413468 - RNA, 64 nt, Human
gcugagggcccuguccccacccccgcccuuggugcugucauaaaagggcaggcaggggcaggcu

SEQ ID NO: 413469 - RNA, 64 nt, Human
uuagucaggauugacagauacauucucagcuggccugucauauaaaacauacugucauugagcu

SEQ ID NO: 413470 - RNA, 64 nt, Human
ccuccauaucccggcccacauccagcuggacccccugucauacagcagccaacaacacccaugu

SEQ ID NO: 413471 - RNA, 64 nt, Human
ugcaguuaagauacauucuugagagccacuucuucugucauaaauauguaugcauacuucugac

SEQ ID NO: 413472 - RNA, 64 nt, Human
uggcauugaggaugguauucagggcgcuuuccuucugucauauaguugugggaucucuaccaag

SEQ ID NO: 413473 - RNA, 64 nt, Human
ccacauacucuuuuuuuuuuuuuuguagaaguagcugucauagagugaagaaaaggauaagacu

SEQ ID NO: 413474 - RNA, 64 nt, Human
gcucaguuucuuuuucacuugggucucuggauuccugucauagggaagguauaucaggagggga

SEQ ID NO: 413475 - RNA, 64 nt, Human
auccagaaaaccuauggaguuaguaaauucugggcugucauauguaggauagccacuuuuuagg

SEQ ID NO: 413476 - RNA, 64 nt, Human
auuguuugauuucucuuugucaaguguauagaaccugucauacauucaugauaaguagcacuga

SEQ ID NO: 413477 - RNA, 64 nt, Human
ccacaaugcagugccuuucuucucuccagugcaccugucauaugcucugauuuaucugagucaa

SEQ ID NO: 413478 - RNA, 64 nt, Human
gaagaauauauuuucuuggugaauuuuuguaugucugucauaugacacuuggguuuuuuaauua

SEQ ID NO: 413479 - RNA, 64 nt, Human
ucuacuagauaggaggaugguagaaguuuggcugcugucauaacauccagagcuuugucguauu

SEQ ID NO: 413480 - RNA, 64 nt, Human
gagaaugucaguucauguauguucagaagaaauucugucauagaaagugccagaaaguguuuaa

SEQ ID NO: 413481 - RNA, 64 nt, Human
aguugguaggcuagcaaagaggaugagacaugaacugucauaaaggacucagcaaccagccagg

SEQ ID NO: 413482 - RNA, 64 nt, Human
aaaggaaacaaaagugaauaccauauuguuuuuacugucauaguguugcuuucuugccuguccu

SEQ ID NO: 413483 - RNA, 64 nt, Human
aacugaucucaaguauaugucauuuacucaaaaucugucauaagcauuacuuuauagcuaguga

SEQ ID NO: 413484 - RNA, 64 nt, Human
guuuucuggagggacagucaucauguuuugauuuaucugggagaaaacuguggugcacagcuug

SEQ ID NO: 413485 - RNA, 64 nt, Human
cgucaaggcucagagguaacaagacagaaaauucaucugggauuuuccugcuguggcuggcaca

SEQ ID NO: 413486 - RNA, 64 nt, Human
agcuuagggaaugcagagccuacuugaggugggcaucugggaauacaggguagaaagaaauucc

SEQ ID NO: 413487 - RNA, 64 nt, Human
ugguucuaugguguguggaugugugugcaugaaucugucauauagaggggguccgagcuggaau

SEQ ID NO: 413488 - RNA, 64 nt, Human
cccuuuguuaauuauuuuuauggaaauuauuacucugucauaauuaaaucauagcuaguauaac

SEQ ID NO: 413489 - RNA, 64 nt, Human
aacuuaggguuuugagcagguugggguauggugccugucauacccaccugccacccugggaacc

SEQ ID NO: 413490 - RNA, 64 nt, Human
gucuggccucauucuguaucaguccaguguguuccugucauaguuugugucucccaggcaggcc

SEQ ID NO: 413491 - RNA, 64 nt, Human
caggaacaguuacccaagggcuguuucuuaguaacugucauaaacugaucugaauccaugggca

SEQ ID NO: 413492 - RNA, 64 nt, Human
gaagauugugaugguguaagagcuaaauccucaucugucauauccagaaaucacuauauaauau

SEQ ID NO: 413493 - RNA, 64 nt, Human
cagacauagcccagguagccuguuucuaacacaacugucauaauccugaaauccaaaauugcac

SEQ ID NO: 413494 - RNA, 64 nt, Human
uacccaaaagugaugaguucugaacaagacaagacugucauauuguagagacuuugguauguga

SEQ ID NO: 413495 - RNA, 64 nt, Human
guuuggguuucuucucuucugauucugcugcucacugucauagccuuuuguguauagugaugug

SEQ ID NO: 413496 - RNA, 64 nt, Human
auuucuucagcucuucuuaggaauauuuaaauuacugucauaauucaguuuaagcuaugaacug

SEQ ID NO: 413497 - RNA, 64 nt, Human
ccuuaaauauccaaccccagcaauuuauacaacgcugucauauuuuuaaaaaaacaaaaguaag

SEQ ID NO: 413498 - RNA, 64 nt, Human
ccuguaugugccuggcugagucaccuaauucauacugucauacuagcauaauuaugacuauugc

SEQ ID NO: 413499 - RNA, 64 nt, Human
cagagucacggggcugagggggcgggagcugccccugucauagggagggggauucccagcgucu

SEQ ID NO: 413500 - RNA, 64 nt, Human
ucaauuucaaauuuuagccaucuguuugugauuucugucauaagcauuuuguuguuuguuuuuu

SEQ ID NO: 413501 - RNA, 64 nt, Human
aaaaccaagcaaaugggggaaaaguuagucaauccugucauauaauaaaaaaauuagugaguau

SEQ ID NO: 413502 - RNA, 64 nt, Human
aaauuucaaauaauaaccaaagcugaaaaauggucugucauaaauuauuuccccgguaauuuuu

SEQ ID NO: 413503 - RNA, 64 nt, Human
agcagugccccucgagcagccaggaagccugcggaucugggaaauggcucugccuuaggcacuu

SEQ ID NO: 413504 - RNA, 64 nt, Human
ggcucaagugaucucccacuucagccucccgaguaucugggauuauaagcaagagccacugcuc

SEQ ID NO: 413505 - RNA, 64 nt, Human
gagaccugcuuuacaagguuggcccuugauuggcaucugggaacuuggaguucagggggcuucc

SEQ ID NO: 413506 - RNA, 64 nt, Human
cuggcuuacaguuucucugugugcuuugugguugcugucauauuugcucuagaagaaaaaaaaa

SEQ ID NO: 413507 - RNA, 64 nt, Human
uuuauguucauggacuuuuauuccugugucuuggcugucauaacuuuuuauuucugcuauuugc

SEQ ID NO: 413508 - RNA, 64 nt, Human
uuauuguggcuuaaugggaagguauagaagcuaccugucauagccuccuuggcuguuggaagga

SEQ ID NO: 413509 - RNA, 64 nt, Human
uguaucauuaagaaaaaauacugccaauuaaacucugucauaucaacaguuguaagacacccca

SEQ ID NO: 413510 - RNA, 64 nt, Human
cuuuccaccccaaaggggccucuccuuuucuccacugucauaaucucuuuccaucuuacuugcc

SEQ ID NO: 413511 - RNA, 64 nt, Human
uggacauuuuaaacacuuacaaauaaauccaagacugucauauuuagcuggauaguuuugggca

SEQ ID NO: 413512 - RNA, 64 nt, Human
aaauacugacagauucguucuaaauauauuguuucugucauaaaauuauugugauuuccugaug

SEQ ID NO: 413513 - RNA, 64 nt, Human
ugccaaauuugauauguugcacugaagacagacccugucauauauuuaauggcuucaagcaggu

SEQ ID NO: 413514 - RNA, 64 nt, Human
uggauauagggcauaggauuacuugucucagaagcugucauagaauuucuugcugccaauuaaa

SEQ ID NO: 413515 - RNA, 64 nt, Human
agacuuaacaagcugcagauaaccauguggacuucugucauaauucuugcugagucaagagugu

SEQ ID NO: 413516 - RNA, 64 nt, Human
cagaugguuagagguguuggcaguuuaggaccugcugucauaaaugugugaacaaccuuuugua

SEQ ID NO: 413517 - RNA, 64 nt, Human
ucagacuuuaaagccaccagggcuucuggaacaccugucauagaagcaauaacucuaacucuau

SEQ ID NO: 413518 - RNA, 64 nt, Human
gacuaugcauuguuauucauuauaauauuuuuugcugucauaaucgccucauaaagacagguuu

SEQ ID NO: 413519 - RNA, 64 nt, Human
aaugccgguacuuaggaccuaaauuuaucuaugucugucauacgcuaaaaugauauuggucuuu

SEQ ID NO: 413520 - RNA, 64 nt, Human
cacggaccaauggccugcagccgugacaacacuccugucauauuggaguccaaaacuugaauuc

SEQ ID NO: 413521 - RNA, 64 nt, Human
aaagaaauauauuuuauucauucacauuaggucacugucauacugucauaggaugagagaguuc

SEQ ID NO: 413522 - RNA, 64 nt, Human
ccuucuccagauguguguaacuuaugucuugaguaucugggaguaguugaagaacagauaauuc

SEQ ID NO: 413523 - RNA, 64 nt, Human
uagggcagugguucccaacucuccgaucagaaucaucugggaagcauuuucaaacagcaaagua

SEQ ID NO: 413524 - RNA, 64 nt, Human
ucaguauagauuauuaagugguuuauauuacagaaucugggauucagcagacuuucaguguaaa

SEQ ID NO: 413525 - RNA, 64 nt, Human
auauuuuauucauucacauuaggucacugucauacugucauaggaugagagaguucuucaaaaa

SEQ ID NO: 413526 - RNA, 64 nt, Human
agggaccaugggagacacaagaaaugugugucugcugucauaacuuacagugaaaaagcccaau

SEQ ID NO: 413527 - RNA, 64 nt, Human
aauuuauuuuuaauuaauauuuuuagacucugugcugucauacugaacucacugcuagcuaaga

SEQ ID NO: 413528 - RNA, 64 nt, Human
ucucguauuuuacugucacuggaggcucugugggcugucauaguuaauugaccauaauuagcaa

SEQ ID NO: 413529 - RNA, 64 nt, Human
caacuugaaacaauaaaauguaugcuuccuugaacugucauaucguugaccugcaaaauucacc

SEQ ID NO: 413530 - RNA, 64 nt, Human
auaggugcugcauuuauaucugcugguuuaaauucugucauauuucacuucuagccuuuuagua

SEQ ID NO: 413531 - RNA, 64 nt, Human
acagucccaggucccagcuccccucuuaugguuucugucauaaugugcuuuaucugauugacuc

SEQ ID NO: 413532 - RNA, 64 nt, Human
uguaaguuugugaauagauuuuagcaugaugaaacugucauaauggugaauguucaaucugugu

SEQ ID NO: 413533 - RNA, 64 nt, Human
ggguuuuuuaaaaaucaggucuguugaaagucuucugucauaaucuauaaagcagcagcacuca

SEQ ID NO: 413534 - RNA, 64 nt, Human
uuuuaaaacauucacaccauucgucaucacuccucugucauaugcagaauuguuuuuugcucuu

SEQ ID NO: 413535 - RNA, 64 nt, Human
cuggauuuuuuaaggugguaccaaaaaugaaugucugucauauauuuauauuacaaauacauua

SEQ ID NO: 413536 - RNA, 64 nt, Human
cauuuuuguuaucuaauuuggggaaacuauucaucugucauauacuauugauccuuuggcacuu

SEQ ID NO: 413537 - RNA, 64 nt, Human
aaacaaaaaagcaguggcuaagaugguauagggacugucauaccagugaagaauaaaaggguga

SEQ ID NO: 413538 - RNA, 64 nt, Human
gaauugagaauuugacuaucuuggggguaaaaugcugucauaggggcagcagucucagggggug

SEQ ID NO: 413539 - RNA, 64 nt, Human
auuuugcauuuuacauuuaaauaugcuaacaucacugucauagaauucccaaauuucauuugua

SEQ ID NO: 413540 - RNA, 64 nt, Human
uccauuugucuauaaaaguuuauggaaguuaaugcugucauaccccccuggugguaccuuaaag

SEQ ID NO: 413541 - RNA, 64 nt, Human
ggggaucuuguuaauacagcuucuaacucaauagaucugggagauccugcauuucuaacaagcu

SEQ ID NO: 413542 - RNA, 64 nt, Human
acugugaagugaauacaacauugaacaguuacagaucugggacagucccuucuaugaaagugcu

SEQ ID NO: 413543 - RNA, 64 nt, Human
uuuguuuuuccugaagggcauuugaaggaacaauaucugggaagguacuagagaaauuacaaag

SEQ ID NO: 413544 - RNA, 64 nt, Human
uccucagccuacuaucauaggcuuccucagcccucugucauauggcuguuuugcaaaccugugg

SEQ ID NO: 413545 - RNA, 64 nt, Human
guagcuugugccuuuuuuauugccuaguaguauucugucauaugccuaucuuacaauuugauua

SEQ ID NO: 413546 - RNA, 64 nt, Human
agauucuaagaaggauaguccccccuacaacauacugucauacugcuggguuuucauggguagg

SEQ ID NO: 413547 - RNA, 64 nt, Human
aguucuguuuacuuucugcaugguauuucagugucugucauacauuaaaaauacuugucacugu

SEQ ID NO: 413548 - RNA, 64 nt, Human
guacauacauaaguaggagcagugggacguguuucugucauaaugcaggcaugaaggguggagu

SEQ ID NO: 413549 - RNA, 64 nt, Human
gucucuguuggaccugucucuccucagucuauuccugucauagaugugggugucccugguaggg

SEQ ID NO: 413550 - RNA, 64 nt, Human
ucaaggcaacucuucuagaauuuauuguucaauucugucauauuuacuucuaauucuacucuca

SEQ ID NO: 413551 - RNA, 64 nt, Human
aguucuccgucacuauuauuuugccuuuucuggacugucauauaaacagaaucuuauaguacgu

SEQ ID NO: 413552 - RNA, 64 nt, Human
aguccauuuuguuucuuaaaauuugaagucgugucugucauagcauuuuuacuaccagcaguau

SEQ ID NO: 413553 - RNA, 64 nt, Human
ccaaggcaaaguuuggcaaacuguggcccccccacugucauauuuuguuaauaaaauuuuauug

SEQ ID NO: 413554 - RNA, 64 nt, Human; identical to SEQ ID NO: 413553

SEQ ID NO: 413555 - RNA, 64 nt, Human
guccuucacuggcaugccaguugacuauuauuagcugucauaaguaacucagccauuuggaagc

SEQ ID NO: 413556 - RNA, 64 nt, Human
guucccucauucuacccucuuuuuccugcuaauccugucauaaugaauguagcuucucaguuca

SEQ ID NO: 413557 - RNA, 64 nt, Human
aagaggaaacaaagcccccuuuuagaaacuacgucugucauacugggagcuuuaucacugcaaa

SEQ ID NO: 413558 - RNA, 64 nt, Human
auauugcccaauagccauaauuuuaccagccuuucugucauaugcugcuauuacaaaguggaag

SEQ ID NO: 413559 - RNA, 64 nt, Human
uuucuucugaacaaaguaggguucaaaaugcagacugucauauccagcgagucccugacccuuu

SEQ ID NO: 413560 - RNA, 64 nt, Human
gcacuuucagggacuucccuccagcugccucuucaucugggaaugagcuaagcaaggcugagcc

SEQ ID NO: 413561 - RNA, 64 nt, Human
gagccugccucucuccuuuagaugacagaccuucaucugggaacgugcugagccagcacccuca

SEQ ID NO: 413562 - RNA, 64 nt, Human
guagugacauuuuuuucucacucaggcuauugccaucugggauucucucccuacuacagcuggc

SEQ ID NO: 413563 - RNA, 64 nt, Human
ccucuuccuuggucuacauaaagaagacaugggucugucauagaauggggacauuagacugaaa

SEQ ID NO: 413564 - RNA, 64 nt, Human
ggcuucaaaaaauauaaguaggaugucaucuauacugucauacacuuuguuuuuuaucacuuaa

SEQ ID NO: 413565 - RNA, 64 nt, Human
aguacuuuucacacuuguuaagauggaguuauaacugucauacauuuggaauauuaugauccca

SEQ ID NO: 413566 - RNA, 64 nt, Human
gagcuuugauagacacucaccagaauauggcagacugucauaggcauucuguuauugucuugga

SEQ ID NO: 413567 - RNA, 64 nt, Human
gggaagauacuuauuuuucugagguccuuauguccugucauauaauuaaagacucaagagaauu

SEQ ID NO: 413568 - RNA, 64 nt, Human
cucuggccagaacccacacccggccccuucccaccugucauacugguaacuguaacaagaaaaa

SEQ ID NO: 413569 - RNA, 64 nt, Human
uaaaguucuguguugucaaaauaaaagaagcuuucugucauaaaaaaaugucauuaugguuuac

SEQ ID NO: 413570 - RNA, 64 nt, Human
aacuugcacauuaugauauuguccuuuuaugaaacugucauaugaccagaauucuucuguaauu

SEQ ID NO: 413571 - RNA, 64 nt, Human
guaguuuacuaauguuugggggauuguacuuggacugucauagccucugcguuugaccuuaaaa

SEQ ID NO: 413572 - RNA, 64 nt, Human
cccugugcccuccacucaucuggauuuacaggaacugucauaguguucaguauuggguggugau

SEQ ID NO: 413573 - RNA, 64 nt, Human
cucgaauucugcaggcccugggcuccccugacaccugucauauuuauggaccagacacuggggc

SEQ ID NO: 413574 - RNA, 64 nt, Human
gagccauggguuuggacaugacuggcacaaacagcugucauauguucauggucagaugucauac

SEQ ID NO: 413575 - RNA, 64 nt, Human
gugaagaagguuagguguuuuagguacauuccagcugucauaggaagaucacagaaaugaggag

SEQ ID NO: 413576 - RNA, 64 nt, Human
gugguuggcauggggugccagcaucgugcaagcucugucauaaucugcaucuucccagcagccu

SEQ ID NO: 413577 - RNA, 64 nt, Human
ucguguugccagcggagcagugcccugguacuugcugucauagcucuauauaugucccuuuaca

SEQ ID NO: 413578 - RNA, 64 nt, Human
aauuccagcggugccacccaaucaugcccagcuucugucauaugaaugagauauacauuuaugu

SEQ ID NO: 413579 - RNA, 64 nt, Human
ucauaugaagaaggguaagguaaugaaucucuccaucugggaaugauuaacacaaauguuggag

SEQ ID NO: 413580 - RNA, 64 nt, Human
ugauugacacuguugauucacaguucagccuccuaucugggaaagacauuucuuuccucugcuc

SEQ ID NO: 413581 - RNA, 64 nt, Human
acacggaugacuuaacugcauuuuuagaccauuuaucugggauuaugguuuugugauguuuguc

SEQ ID NO: 413582 - RNA, 64 nt, Human
gacucaugauuaugcagagaauuggauugggucucugucauagauugaguaaucucuucccuua

SEQ ID NO: 413583 - RNA, 64 nt, Human
cacugggaaauuauuguauuucuuuauaaauuuacugucauaucaauugcuggaaaaugcuaug

SEQ ID NO: 413584 - RNA, 64 nt, Human
guuuuuguauauaagacugcuuccaccugaaaugcugucauaaguacugggggggugggggagu

SEQ ID NO: 413585 - RNA, 64 nt, Human
cuaaauggggagcuaucuggaaacucuagauuuucugucauacccacaucugucacaguaccug

SEQ ID NO: 413586 - RNA, 64 nt, Human
uuaaguaucagcuaaagaugugcuuccuccgugucugucauacacugagaccaacaggcuacag

SEQ ID NO: 413587 - RNA, 64 nt, Human
gucaacuaaaugagauuauauguggacuaaauaucugucauauaguaaacacucaauaaauugc

SEQ ID NO: 413588 - RNA, 64 nt, Human
aguccaagucuguggaacuuaaaaccuugaaggucugucauaggacucuggacaaucucacacc

SEQ ID NO: 413589 - RNA, 64 nt, Human
ggccccagcuuccuaagcugccaccucuguguuccugucauagcaaauaugggaccaucaccag

SEQ ID NO: 413590 - RNA, 64 nt, Human
gcacauuagcaaaucuaugucuuguccugauucacugucauaaagcaugagcagaggcuagaag

SEQ ID NO: 413591 - RNA, 64 nt, Human
uuauaggcagucuucugcagacuuaacguguuuucugucauaguuagaugugauaauucuaaga

SEQ ID NO: 413592 - RNA, 64 nt, Human
ugccucccgugaugucccaccuuuccuucaaggucugucauaugaguccuccccuuuuacaaca

SEQ ID NO: 413593 - RNA, 64 nt, Human
uuacaacaauagugacaccaguaauuaugagaggcugucauauaucaaagcagcucagguggga

SEQ ID NO: 413594 - RNA, 64 nt, Human
acugaagagauacgugaaugaaaccaggccauagcugucauaaaucuuugacuuuugaauauuu

SEQ ID NO: 413595 - RNA, 64 nt, Human
gcaucagcuucugcuguuaaguguuagccacaaucugucauauauaugucuuuuagauucugaa

SEQ ID NO: 413596 - RNA, 64 nt, Human
ucagcaaagccaguaacaacagcguguacugccacugucauaaccaauaccaugaaugaauaua

SEQ ID NO: 413597 - RNA, 64 nt, Human
uaaaccuuuagaauuuaugacuuacuguuagagucugucauaugguuagaauuuuuacuuccgc

SEQ ID NO: 413598 - RNA, 64 nt, Human
ugugccuggaauuagcaguguacaugaagugcacaucugggaacuuguaaguggaaagauuauu

SEQ ID NO: 413599 - RNA, 64 nt, Human
aagagagaugccugcuuccuaaagaucuacagcaaucugggacgugguucaaguucaagacuug

SEQ ID NO: 413600 - RNA, 64 nt, Human
accaugcccaggucuccugccucacaucacaauaaucugggacccaggcuugugcccuuucagu

SEQ ID NO: 413601 - RNA, 64 nt, Human
aggaaacacugauuaacugcaagucuucaugauucugucauauuaagaaacaccuguagguuug

SEQ ID NO: 413602 - RNA, 64 nt, Human
auauuuuuuucuuucuuuguuuuauuuuaauagccugucauagguuuuaaaucugcuuuaguuu

SEQ ID NO: 413603 - RNA, 64 nt, Human
aaccuauuuuaaguacagcaaaauuuauuuaaaacugucauagcaguaaaaaguauuacgauga

SEQ ID NO: 413604 - RNA, 64 nt, Human
aaccuaaugacauuaauaccucuagaaagggcugcugucauagugaacaauuuauaaguguccc

SEQ ID NO: 413605 - RNA, 64 nt, Human
uguuacuuuuauauagaacccaaggaaugccuuccugucauauuuuagccaaaacaacugguua

SEQ ID NO: 413606 - RNA, 64 nt, Human
aacaugaaauggacaaaccaaucugcuuaagauccugucauaguuuuagaucauugguuauccu

SEQ ID NO: 413607 - RNA, 64 nt, Human
cucccucuccucagccaguugggugugcgcagagcugucauagggucccuuugucagccccgag

SEQ ID NO: 413608 - RNA, 64 nt, Human
uaaguaagccuuguuauaccauugucauggaccccugucauaaagccauuucuugguuuguuug

SEQ ID NO: 413609 - RNA, 64 nt, Human
aguuguaacuuauuacaggaucauacuaaaauuucugucauauguauacugaagacauuuuaaa

SEQ ID NO: 413610 - RNA, 64 nt, Human
cagagaccagguggaaaccuuuuccuguggaaaccugucauagaauuuugugcaauauguaugu

SEQ ID NO: 413611 - RNA, 64 nt, Human
aacccagaauaguugguaugucagcuagucauuccugucauauucccaguagaaugauuuucaa

SEQ ID NO: 413612 - RNA, 64 nt, Human
gaguaccuguucaauagcucauauaucgaguacccugucauacaggaacaaguuaaaggacaca

SEQ ID NO: 413613 - RNA, 51 nt, Human
cagaugcugcaaacagcuaaacugucauauugcugucuuguauauacagcu

SEQ ID NO: 413614 - RNA, 64 nt, Human
gugcccaucacucucagagaccacguuucccugacugucauagagaaucaucaucgccacugaa

SEQ ID NO: 413615 - RNA, 64 nt, Human
agggauaaauucuauauauauaguuaugcauuugcugucauaccagacaauuuuuuaucaugag

SEQ ID NO: 413616 - RNA, 64 nt, Human
ucuaagucaaguuuaggaaaacaaggauaagauucugucauaggcauagagaguugcacauaaa

SEQ ID NO: 413617 - RNA, 64 nt, Human
uuugauuagauguacaauacauugggggcagaagaucugggaucaauuaagauggagccugaag

SEQ ID NO: 413618 - RNA, 64 nt, Human
cccucucaucguccggccuucucccuucaucuugaucugggaagaaugaaaugaacucagcuac

SEQ ID NO: 413619 - RNA, 64 nt, Human
ugggggggagucauaggaaaagcccccaucucccaucugggauagggaccuuccaucagccuua

SEQ ID NO: 413620 - RNA, 64 nt, Human
acaagaccaucagucugaauccaggucgugggggcugucauagccgaacuccuucugcacaucc

SEQ ID NO: 413621 - RNA, 64 nt, Human
acagaguugggugcuuuuuucucucugcaauuaccugucauagcauuuugugcucaccacgaag

SEQ ID NO: 413622 - RNA, 64 nt, Human
aagucugcacacgucucaugaaugcaucacauuucugucauauggauauuagccauuccgaaau

SEQ ID NO: 413623 - RNA, 64 nt, Human
cccucguacugccgggcauuuauuauacuacuuccugucauaaccuucuaacuuguuucuugac

SEQ ID NO: 413624 - RNA, 64 nt, Human
ucaucacuggauuugccaacuagaauucgauuuccugucauaggaagcuccuuggaagaaggga

SEQ ID NO: 413625 - RNA, 64 nt, Human
uggucuuaaugcuuuguaaacaggucaaaaaauacugucauacucuaagcuucuauuuuccaca

SEQ ID NO: 413626 - RNA, 64 nt, Human
uauugguuauauacccaaaggaaucuaaaucauucugucauaaagacauauauacacaaauguu

SEQ ID NO: 413627 - RNA, 64 nt, Human
cucucucguuuggcuuggguauuuuauauuauuucugucauaacuuuuaucuuuagaauuguuc

SEQ ID NO: 413628 - RNA, 64 nt, Human
aauuauauuuaaguuguugauguuuuaacucuaucugucauacauccuagugaauguaaaaugc

SEQ ID NO: 413629 - RNA, 64 nt, Human
ggcguaagaugauggauuugauucgcccuccucccugucauagagcugcaggguggauuguuac

SEQ ID NO: 413630 - RNA, 64 nt, Human
cauaauuuuauuucugcuugauagucaugguagucugucauacccaccucugggacucugcgug

SEQ ID NO: 413631 - RNA, 64 nt, Human
gccguggucgucacucagucgcucugcaugcucucugucauacagacagguaaccuaguucugu

SEQ ID NO: 413632 - RNA, 64 nt, Human
gcuacuguuguggagauccuuaacgcagcagcgccugucauaaacaagccucuuguagcuucuu

SEQ ID NO: 413633 - RNA, 64 nt, Human
aguauccuuguauuggauacguaauaccuuagugcugucauaauguuguacaagaucaugauca

SEQ ID NO: 413634 - RNA, 64 nt, Human
cguucuguuggccaccagacuugcauuucagccucugucauaaugcucugcccucccucccccg

SEQ ID NO: 413635 - RNA, 64 nt, Human
uaugaucccaggacugaagacaguugugggauaucugucauauuuauccugugagucauuguga

SEQ ID NO: 413636 - RNA, 64 nt, Human
auaugcacugagugaaggaugaauguauggacacaucugggaguauuuuaaagaauguaucuug

SEQ ID NO: 413637 - RNA, 64 nt, Human
uggggauaaggucagcuauaaaggaggacuuuccaucugggagaggcagaaucuauauacugaa

SEQ ID NO: 413638 - RNA, 64 nt, Human
aucccucaaguacacaaagguccccuggcccuucaucugggaaucauauacuccacucuagcuc

SEQ ID NO: 413639 - RNA, 64 nt, Human
uuugcuugcacaucaguaguuucugcugaacgugcugucauaaugaagagauuuccaagauuuu

SEQ ID NO: 413640 - RNA, 64 nt, Human
aagucccaugaaaagacuuaauguaacaacucuucugucauagcauuguguguggucccuaugg

SEQ ID NO: 413641 - RNA, 64 nt, Human
gcagcuauuuaucgaguaccuacucugucaggcacugucauaggcguggggcaaagcaggaacc

SEQ ID NO: 413642 - RNA, 64 nt, Human
cugucccugucacacccccaaccccagggaggggcugucauagucccagaggauaagcaauacc

SEQ ID NO: 413643 - RNA, 64 nt, Human
agagacacaccuccaguaagaccuuaagacaguucugucauaaaaaaaauacgagguuuggccg

SEQ ID NO: 413644 - RNA, 64 nt, Human
uaauucagucuagcaauaugauagauaauucagucugucauacugaaaaugacagcacuuuuaa

SEQ ID NO: 413645 - RNA, 64 nt, Human
auggucaucugggacaacuuaaaucucccuucugcugucauaguucuuccaacucaguugccuu

SEQ ID NO: 413646 - RNA, 64 nt, Human
ccugacuuggcccccacagagagagguccuacagcugucauaaauuaaauuuauucucuggaga

SEQ ID NO: 413647 - RNA, 64 nt, Human
auacguuguaauuuuucaguaguauuugaaauuacugucauauuugaaauucaguaauauuuga

SEQ ID NO: 413648 - RNA, 64 nt, Human
ucuaaccugaugcucuuggagagagauaaccugucugucauaacuuaaaggaugagaaaaugug

SEQ ID NO: 413649 - RNA, 64 nt, Human
uccuaguuauguuuacagcacaaauaaauaaugacugucauacauccagaggagaccgaaccug

SEQ ID NO: 413650 - RNA, 64 nt, Human
aacgggaauucagacaagcugcauuucagaaaugcugucauaaugguuuuuaacaccuuuuacu

SEQ ID NO: 413651 - RNA, 64 nt, Human
caggaaguguuuuuucugggucaguaaauaacaacugucauagggagggaaauucucaguagug

SEQ ID NO: 413652 - RNA, 64 nt, Human
ugaugccagcaguuccuuuucauuauucuaucuucugucauaugaauguugagcaaagcuuagg

SEQ ID NO: 413653 - RNA, 64 nt, Human
gagauguaaaagguauuaaauugauguugcuggacugucauagaaauuacacccaaagagguau

SEQ ID NO: 413654 - RNA, 64 nt, Human
auaggugagaugauaugaaaaacaaauuuucucacugucauaaaaggcucuaauuaugguuacu

SEQ ID NO: 413655 - RNA, 64 nt, Human
aaagaagugauaccucuagacuggguuuauauuaaucugggauauaaaugaagaagacauacua

SEQ ID NO: 413656 - RNA, 64 nt, Human
ugcccuuuaccuccagggcugcugcugccuggguaucugggaccccagaucaggcucuggagac

SEQ ID NO: 413657 - RNA, 64 nt, Human
gcuccauuuccucaugcugucauccuuaaaguccaucugggaaggggaaaaugcugaacaccau

SEQ ID NO: 413658 - RNA, 64 nt, Human
ggacauuuucaucccgaagccauagagacauuugcugucauauugcugcugggcacaucugugc

SEQ ID NO: 413659 - RNA, 64 nt, Human
caccuuuuucaaggaaaccuugacuuauaccuagcugucauaugaaggaaaugcaaagaaacau

SEQ ID NO: 413660 - RNA, 64 nt, Human
agggaccaagaaagaaaauauaacaguuugauuucugucauacccauuguauuugaagauauau

SEQ ID NO: 413661 - RNA, 64 nt, Human
acacagacauucuguacauauccugugaaacgugcugucauaugaaauaaauauaucugucuuu

SEQ ID NO: 413662 - RNA, 64 nt, Human
caacuccguucucaacaccuuccuuaagucuuugcugucauaauuuaagcauuugaguauauuu

SEQ ID NO: 413663 - RNA, 64 nt, Human
uggagcaguugacauccaggguuuuuuuuccugccugucauacuugcuaaacaagagcacagcg

SEQ ID NO: 413664 - RNA, 64 nt, Human
uuuagcacuuggaacauuuaaagaaaggucuaugcugucauaugggguuuauugggaacuaucc

SEQ ID NO: 413665 - RNA, 64 nt, Human
ccagaaaacagagucucaagacccccgcucuggacugucauaagcuagcacccgugguaagcgg

SEQ ID NO: 413666 - RNA, 64 nt, Human
auuuuuagccuuuaauccauuccauuuucuaaaacugucauaaacuauuuuuaaucauuuuaaa

SEQ ID NO: 413667 - RNA, 64 nt, Human
cauuucagugaaucuggugaccuccaucugcuugcugucauaacccgacacggacuuauuuuug

SEQ ID NO: 413668 - RNA, 64 nt, Human
acuacuuuuuuucaaacaaacuauuauauuaaaacugucauauuuuggcuaaguuuggaccuau

SEQ ID NO: 413669 - RNA, 64 nt, Human
aaacaaaauuuaucuaaagaaauaacuucuauuacugucauagaccaaaggaaucugauucucc

SEQ ID NO: 413670 - RNA, 64 nt, Human
ugcuguuccugcuuuauuguuugcuuucugugugcugucauauuuugguaucagaguuacauua

SEQ ID NO: 413671 - RNA, 64 nt, Human
cuggcaagaagacccuuugacuaaagauaaugugcugucauaucuuggcugagaaacuguugag

SEQ ID NO: 413672 - RNA, 64 nt, Human
cuccauacucuuuccccucuauuucuuuguaugacugucauagacacaugggugcuugaagaaa

SEQ ID NO: 413673 - RNA, 64 nt, Human
aguguccauugaaaccgugauuuuuuuuuuuuuccugucauacuuuguuaggaagggugagaau

SEQ ID NO: 413674 - RNA, 64 nt, Human
ugaaggggcuggcuuuuggaguguugaggugaauaucugggagcagagaucaugaauagcucag

SEQ ID NO: 413675 - RNA, 64 nt, Human
cuuccagcccaggaagcccacuguaccuggagccaucugggauaagacuuugacccaugacucc

SEQ ID NO: 413676 - RNA, 64 nt, Human
cuacgucaaacaugaaguguguuuccuucagugcaucugggaagauuucuaccugaccaacagu

SEQ ID NO: 413677 - RNA, 64 nt, Human
uuuuuuucuguuaauuaguuguguacucuggccucugucauaucuucacaauggugcucauuuc

SEQ ID NO: 413678 - RNA, 64 nt, Human
gcaaagcuaaugguauuuuaaucauuauuuuugccugucauaagaaaacucuuagcugaaaugg

SEQ ID NO: 413679 - RNA, 64 nt, Human
agaaugaaagcaagguuuuuuugauguuaccugacugucauaaagaugaaaaugauuuguauug

SEQ ID NO: 413680 - RNA, 64 nt, Human
uuuuucuuuuagacacauuagcucuggagugagucugucauaauauuugaacaaaaauugagag

SEQ ID NO: 413681 - RNA, 64 nt, Human
uuggauguuuuccccaauuauccuccuucacucccugucauaguuaccgauggugucccguugu

SEQ ID NO: 413682 - RNA, 64 nt, Human
cacccaagauauuaaaguuucuuccucuuggguucugucauauuuucccucauuugaguuuacu

SEQ ID NO: 413683 - RNA, 64 nt, Human
uacucaaaucaauuucuccccugcuucgcuaagacugucauaaaauggccuugacauuuaauca

SEQ ID NO: 413684 - RNA, 64 nt, Human
cuucaauuuuuguuuguuuuuuguuuuuuugucccugucauaaaauauuuuggugcuucaaaac

SEQ ID NO: 413685 - RNA, 64 nt, Human
aacuuguaucgguucuuaauuaaauuauccaaaacggaggcauuuaaacacuuggauuuacacc

SEQ ID NO: 413686 - RNA, 64 nt, Human
gcgcagcggcucacgccuguaaucccagcacuuucggaggcagaggcaggcggaucacaagguc

SEQ ID NO: 413687 - RNA, 64 nt, Human
ggcugaggugggagaauugcuugaacccaggaggcggaggcagaggcugcagugacccaagauu

SEQ ID NO: 413688 - RNA, 64 nt, Human
uaggucuuuagcaggccucuggcaccucagcagucggaggcacagaagcugcaaaagggaucuu

SEQ ID NO: 413689 - RNA, 64 nt, Human
ugccgcgcugugcggcccacgcccacccgcugcucggaggcaucugugcgaaggugcagcuagc

SEQ ID NO: 413690 - RNA, 64 nt, Human
guccuccagggagcugacccagagguggaggccacggaggcagggucucuggggacugucgggg

SEQ ID NO: 413691 - RNA, 64 nt, Human
uggcugaccugcuuaaaaagauucuagaguuggccggaggcagaacaugucaacucuuugcugg

SEQ ID NO: 413692 - RNA, 64 nt, Human
ugaagugucuagaaguaucuagugcagaugguggcggaggcagaaucgaccaucagcaaacaug

SEQ ID NO: 413693 - RNA, 64 nt, Human
agugccaagacagagagcuaugaacacgauaucuaucugggaacacugagaagggugaccaaug

SEQ ID NO: 413694 - RNA, 64 nt, Human
gguuuaauagacuauuccuaggggaaguaaaaagaucugggauaaaaccagacugaaaggaaua

SEQ ID NO: 413695 - RNA, 64 nt, Human
ugaaguuucacaugagcuauuuccauuccagaauaucugggauucuacuuuaagcacuacauaa

SEQ ID NO: 413696 - RNA, 64 nt, Human
aggcaguguucuacccaaaugcaaacgccucucccggaggcauguccuggcugguucuuugggg

SEQ ID NO: 413697 - RNA, 64 nt, Human
ugcuccacgucauuuugucaggcugguuauaagccggaggcagcuuuaaccagcccccagggau

SEQ ID NO: 413698 - RNA, 64 nt, Human
uccagugcugucgagagaccaccuucccccgacccggaggcacuuccuuggggucuuucucuag

SEQ ID NO: 413699 - RNA, 64 nt, Human
ucuuaggaauccaaaauggucugcagagagugagcggaggcaccagaucaauguugguucuuug

SEQ ID NO: 413700 - RNA, 64 nt, Human
ucugauucaggaugacguggaccuccgugacacacggaggcacugugacaagggaaaccugcgu

SEQ ID NO: 413701 - RNA, 64 nt, Human
auccugccacccccaaccauuugcacuacaagggcggaggcaccccgaagaaugaaaaguacac

SEQ ID NO: 413702 - RNA, 64 nt, Human
cauugguuauagucaugggaaaggaagguguccacggaggcacacuuaacaagaaagcauauga

SEQ ID NO: 413703 - RNA, 64 nt, Human
guaauucacauccacaacccuaagccuuuuaaagcggaggcaaacguuaacaaaccccaucgug

SEQ ID NO: 413704 - RNA, 64 nt, Human
gaacagaccauugaaaagacuauuaucugaccagcggaggcagaaaagagaggaacccaguuga

SEQ ID NO: 413705 - RNA, 64 nt, Human
ggccacacgacauagcugaaauuuguucuguaggcggaggcaccaagcccuguuuucuuggugu

SEQ ID NO: 413706 - RNA, 64 nt, Human
acugagcagcaaggcugcagccagcaaagaggugcggaggcaagcaagcuccauguggugggga

SEQ ID NO: 413707 - RNA, 64 nt, Human
agcaguugguguggcacgugcgggguguuggcaccggaggcauggaaaagcacaggcuguacug

SEQ ID NO: 413708 - RNA, 64 nt, Human
gcucugaaagccagcugccgaccagagccccacacggaggcaucugcacccucgaugaagccca

SEQ ID NO: 413709 - RNA, 64 nt, Human
ucagauccaggugggugagggcaggaggccccugcggaggcagcguggaucugcccacacauag

SEQ ID NO: 413710 - RNA, 64 nt, Human
acauuuccagcuucaucuuugaucuuaacccucccggaggcauacuugguuuccugacagccgc

SEQ ID NO: 413711 - RNA, 64 nt, Human
aucucugaaacgagcguuagagugccgccuuagacggaggcaggaguuucguuagaaagcggac

SEQ ID NO: 413712 - RNA, 64 nt, Human
aaucaaccauuugaugcugcaggggccuuucaggaucugggagggggcagucuggagagaagga

SEQ ID NO: 413713 - RNA, 64 nt, Human
agaguacgccuugaggaggggggaugaggccuuaaucugggaggccuaucccccuaucccaggc

SEQ ID NO: 413714 - RNA, 64 nt, Human
ggaacucaaaacuuggaaggcgaaggacaauguuaucugggauucaccgugcccagcacccgaa

SEQ ID NO: 413715 - RNA, 64 nt, Human
gugagcaaagcgccgcgccucccucagggcggaacggaggcaacuuuccggagucuauuuuugu

SEQ ID NO: 413716 - RNA, 64 nt, Human
cuucaugagacccaacucugccacagcucauccucggaggcaaucccggaaaccucuuuuauaa

SEQ ID NO: 413717 - RNA, 64 nt, Human
gcccugggguuggggccucaccccucuggagggccggaggcaggagguggaaaccccaggggcu

SEQ ID NO: 413718 - RNA, 64 nt, Human
cgggccagcugggcugcccgguucccagcugcugcggaggcaggcugagggcgcaggggcugcc

SEQ ID NO: 413719 - RNA, 64 nt, Human
ccaaaccaaaaacccaaacacccuauguaacuaucggaggcauauacgugguauaaaugacugu

SEQ ID NO: 413720 - RNA, 64 nt, Human
acagagaagcugccugcguaaaaagugccacccacggaggcaggacacaggcagcguguggccc

SEQ ID NO: 413721 - RNA, 64 nt, Human
ugacucaagccuauaaucccagcacuucggaaggcggaggcaggaggaucgcuugaggccagga

SEQ ID NO: 413722 - RNA, 64 nt, Human
cacugugagacguccugccacaccccacaggagacggaggcagugggcauuuggaaccaauucu

SEQ ID NO: 413723 - RNA, 64 nt, Human
ccaggccgggcgccugcccagcaggagcugaugccggaggcagugggugcccugguuagggcug

SEQ ID NO: 413724 - RNA, 64 nt, Human
cccuacugucccuuacuggggcagcagagggcuucggaggcagaagugaggccugggguuuugg

SEQ ID NO: 413725 - RNA, 64 nt, Human
ggcucguguuucacagugggcggcuucccugcgacggaggcaggaccaggcauuuagcuaguua

SEQ ID NO: 413726 - RNA, 64 nt, Human
gaggggucuuguucaaagcauccaacucugacuucggaggcauucccagccggcagcagugugu

SEQ ID NO: 413727 - RNA, 64 nt, Human
auguguggacuguggcacuugccugggucacacacggaggcauccuacccuuuucuggggaaag

SEQ ID NO: 413728 - RNA, 64 nt, Human
cugccuguuaggagaagcugcauccagaggcaaacggaggcaaagcuggcucaccuuccgcacg

SEQ ID NO: 413729 - RNA, 64 nt, Human
gggccacaugcugccugcaaacagggcaagaccacggaggcacagggguccugcuccugauggg

SEQ ID NO: 413730 - RNA, 64 nt, Human
uggcucgugcuuguaaucccagcacuuugggaggcggaggcaggcggguugcuugagcuccgga

SEQ ID NO: 413731 - RNA, 64 nt, Human
ggauucuggcauuuugcaugccauucuccaucagaucugggaugauggcucagaacauguacac

SEQ ID NO: 413732 - RNA, 64 nt, Human
acccggcaccccaccugcaugacgauuuauuuguaucugggaaaauauucucucuaguuaaaaa

SEQ ID NO: 413733 - RNA, 64 nt, Human
agcacugauguuguuacugauucuccugucagagaucugggaggucuccacugaggaugugagc

SEQ ID NO: 413734 - RNA, 64 nt, Human
gacuuugcccugaacuuguccggguagggagggccggaggcauguggccucccagaccuccuga

SEQ ID NO: 413735 - RNA, 64 nt, Human
gaaccagcucaccucugguugcuguagcuccugccggaggcaugucuacuugugaucccggaca

SEQ ID NO: 413736 - RNA, 64 nt, Human
ccaagcggcugggcccaggcuguggcaugauggccggaggcaagaagcaccuggacuucuaggg

SEQ ID NO: 413737 - RNA, 64 nt, Human
ggagcucccugucccuuugccccagguuuccucccggaggcagacagucucccagagcugaggg

SEQ ID NO: 413738 - RNA, 53 nt, Human
cccugcagcucagcaagugauagcggaggcaccacgaagcugugaacucagag

SEQ ID NO: 413739 - RNA, 64 nt, Human
uacaaggcugucugguuuggcgaggacaucgggacggaggcagacguggucguucucaacgcgc

SEQ ID NO: 413740 - RNA, 64 nt, Human
cccguccccagccccacgcacgaccccaagcccgcggaggcaccgaugcccgcagagcccgcac

SEQ ID NO: 413741 - RNA, 64 nt, Human
agucacugcuugaggcucagcugcugugucagagcggaggcacauuggugaguccccgccccgc

SEQ ID NO: 413742 - RNA, 64 nt, Human
caaaggaaccgcuccuugucccuccuggccuccccggaggcacagcagugucauggggcugucu

SEQ ID NO: 413743 - RNA, 64 nt, Human
gccugccagcuuggccuccucccacagccucccucggaggcaugccaugccaagcacucuuucu

SEQ ID NO: 413744 - RNA, 64 nt, Human
guagcuaugggccauaaccaaaacucacaugaaacggaggcagauggagaccaagggugggauc

SEQ ID NO: 413745 - RNA, 64 nt, Human
uuuaauguuaaggaaagagaagaaccgcgccgcccggaggcagagaggcuccauggccgugcug

SEQ ID NO: 413746 - RNA, 64 nt, Human
accugcaaaccagcgcuuccugagacggggccagcggaggcagagccgggaggcugcgugggcu

SEQ ID NO: 413747 - RNA, 64 nt, Human
guagcuguuuuaucaucuguagcuucauccuauccggaggcacagcacaugagcccuggacagg

SEQ ID NO: 413748 - RNA, 64 nt, Human
cguguggggcugcaaaaggagaggacgacgcugucggaggcagggagagcaaauuaccacagcu

SEQ ID NO: 413749 - RNA, 64 nt, Human
ccccucgggcuccaggcccccacugagacccucucggaggcagaagcacuucaccccucagagu

SEQ ID NO: 413750 - RNA, 64 nt, Human
gcuuaucacauucccaauucagugagaaaaauucaucugggacacaacaggguacucuucucug

SEQ ID NO: 413751 - RNA, 63 nt, Human
ucuuuguauggcaugcuggcugcaaauaaaggagaucugggacacuuaacuaggcuuuuaaag

SEQ ID NO: 413752 - RNA, 64 nt, Human
caaauauagccacagaaauaaagaagggacaacaaucugggacagguaauuuugcaaaacacau

SEQ ID NO: 413753 - RNA, 64 nt, Human
cugagaauguauggaggucaucggggccucagcucggaggcagugacuuggggccaagggaccu

SEQ ID NO: 413754 - RNA, 64 nt, Human
gcuaggccgcccugccacacaucccgcccccucccggaggcagcuucaggacaggacaccaggc

SEQ ID NO: 413755 - RNA, 64 nt, Human
ggaagauaacugagcagcaccgucgucucgacuucggaggcaacaccaagcccgaccgggccag

SEQ ID NO: 413756 - RNA, 64 nt, Human
cccuaagcugagcuaggaggcaccacgcacaggccggaggcaccacgcacaggccagagucucc

SEQ ID NO: 413757 - RNA, 64 nt, Human
cucccucaucggcccggcgcugauuccucguguccggaggcaugggugagcauggcagcugguu

SEQ ID NO: 413758 - RNA, 64 nt, Human
ccaugccugagcaggauagauuugaagugcaagccggaggcagcagaucaggaguagggacagg

SEQ ID NO: 413759 - RNA, 64 nt, Human
gugucucagcccggugcugggccuggccgaggggcggaggcacagcugcuuccagcagccagca

SEQ ID NO: 413760 - RNA, 64 nt, Human
gucacaaaaugguaaauguuccauacugacaugccggaggcagccugacccguuauuuggaaag

SEQ ID NO: 413761 - RNA, 64 nt, Human
agcucaugccuguaaucuccagcacuuugggaggcggaggcaggaggaucucuugaagucaaga

SEQ ID NO: 413762 - RNA, 64 nt, Human
agcagggaccacuaaaucuccaagaccuggugugcggaggcaggagcauguaugucugcaggug

SEQ ID NO: 413763 - RNA, 64 nt, Human
ggagacaccucagagccccgcaaaacccacugaccggaggcaaaaggcaguggggcugggggua

SEQ ID NO: 413764 - RNA, 64 nt, Human
uggcugucgccuguaaugccagcgcuuugggaggcggaggcaggaggaucgcucaagccccgga

SEQ ID NO: 413765 - RNA, 64 nt, Human
cucagauggggagggacagggucggccuguaccccggaggcaccuggguccaucagagaaggug

SEQ ID NO: 413766 - RNA, 64 nt, Human
ggcagagacauaugcuuuaaaaacuuaaauauuucggaggcacauguuggacuacuuuguuuua

SEQ ID NO: 413767 - RNA, 64 nt, Human
ugauccggaagcacgcagcauguucccugcugagcggaggcagcccaccuguccugccucccag

SEQ ID NO: 413768 - RNA, 64 nt, Human
ccccacacaacagugcccuccagaagcagccccucggaggcagaggaaggaaaauggggauggc

SEQ ID NO: 413769 - RNA, 64 nt, Human
cuugauuugaugacagagaucuucauuaaacaagaucugggacaguaauaaaagauugcugcau

SEQ ID NO: 413770 - RNA, 64 nt, Human
aguagagagcaagggaagugguucuuagauggugaucugggauuaggcccucaagacccuuuug

SEQ ID NO: 413771 - RNA, 64 nt, Human
aaauaaacgaaacauuuagacaauggcuauauuaaucugggaaggcaacaccuguggauaaaac

SEQ ID NO: 413772 - RNA, 64 nt, Human
uugggccugugaggauucuccccgaaggugcccucggaggcagcagguuugaggcccugggggg

SEQ ID NO: 413773 - RNA, 64 nt, Human
uacauacuguaagguugguuuguaaauuauucuacggaggcaaaaagggaaaauaaaaacuugc

SEQ ID NO: 413774 - RNA, 64 nt, Human
uugccaagucaauccuaagccaaaugaauaaagccggaggcaucacgcuaccugacuucaaacu

SEQ ID NO: 413775 - RNA, 64 nt, Human
acaccaguauucccagcuacucuggaggcugaggcggaggcaggauugcuugauaugagggaga

SEQ ID NO: 413776 - RNA, 64 nt, Human
gaugccguuucuuucaauauuuauuuccagaguccggaggcagcagacacgcccucuuaguagg

SEQ ID NO: 413777 - RNA, 64 nt, Human
ugaaaggucccugugacauuuucugccacccaaacggaggcagcugacacaucucccgcuccuc

SEQ ID NO: 413778 - RNA, 64 nt, Human
ucgcggggagccuggugcccuucuagaugggcgacggaggcaaggacaagacgaguccgagcuc

SEQ ID NO: 413779 - RNA, 64 nt, Human
gccguuucaccgccuucucuacucaccuucucuucggaggcaggagaguugguaagaggauugg

SEQ ID NO: 413780 - RNA, 64 nt, Human
ccacccuugcugugucaccaucacuacucaagaccggaggcacagagggcaggagcacagaccc

SEQ ID NO: 413781 - RNA, 64 nt, Human
auugugguccguccuuaacccauccacucuucuucggaggcaacugagaacacauaaagcaagc

SEQ ID NO: 413782 - RNA, 64 nt, Human
aggccgacccggggagggggacgggguggggaaacggaggcaggggacagaagaggggagauug

SEQ ID NO: 413783 - RNA, 64 nt, Human
auacugacagggagaugggacauucugagggacccggaggcagggagccaccuccucagcuucc

SEQ ID NO: 413784 - RNA, 64 nt, Human
acucccuacuuaagggaauaggccaggcuccauccggaggcagggaccaugccaggaggagccc

SEQ ID NO: 413785 - RNA, 64 nt, Human
cucccucugucauccucaggaaccaacaauucgucggaggcaucauggaaagacugggacagcc

SEQ ID NO: 413786 - RNA, 64 nt, Human
ggggcugccccuuuccuaccugugcuugaggggccggaggcaggugcugccuggcagagcugug

SEQ ID NO: 413787 - RNA, 64 nt, Human
gccgauucucuugugcugauuuaaaugcuggacacggaggcaggcuguuuaaacgcugcuuaaa

SEQ ID NO: 413788 - RNA, 64 nt, Human
gaacaagagaacccaucuauuaaaauugccuuagaucugggaaaguaaccauccuucuggcaaa

SEQ ID NO: 413789 - RNA, 64 nt, Human
cagaaaacccacugaaguauuuaaaguuaggaagaucugggagauagggguugcuggcaugaaa

SEQ ID NO: 413790 - RNA, 64 nt, Human
uugugcccgagaaacuuaacagaugaguucuugaaucugggaugagaugacggauguaaauauu

SEQ ID NO: 413791 - RNA, 64 nt, Human
cuuuaaaucacaagcaaaauaggaaaguuaaccacggaggcaccgaguuccagguagugguuuu

SEQ ID NO: 413792 - RNA, 64 nt, Human
ugugcuguggugcaccgccuggcuuugggggucccggaggcaggcugccuagacucacagccuc

SEQ ID NO: 413793 - RNA, 64 nt, Human
cagcagcauaccaaagagaugugcugcaggacuccggaggcagccugggugggugagccauggg

SEQ ID NO: 413794 - RNA, 64 nt, Human
gcugcccagagcagcccaggccguggugaggaggcggaggcaucggcggcggaggcucagggug

SEQ ID NO: 413795 - RNA, 64 nt, Human
ucacaacacauuagcacauacuguccauuagcauaucugggauaaccagguuuuggggguugag

SEQ ID NO: 413796 - RNA, 64 nt, Human
auauuucagacuucccauuuggggaucugaaacaaucugggaguuaauaacuggggaaagaagu

SEQ ID NO: 413797 - RNA, 64 nt, Human
caggugcagggaggugaccauguaacucugaccaaucugggaaguggagggugggcucaugggc

SEQ ID NO: 413798 - RNA, 64 nt, Human
uugaagcugcucccugguuccacucuggagaguaaucugggacaucuuaguguuuuguuuuguu

SEQ ID NO: 413799 - RNA, 64 nt, Human
gaaaugcuuguggguauauuggauagcucagaaaaucugggaaaucaaaguggcucaauagcug

SEQ ID NO: 413800 - RNA, 64 nt, Human
cccccggagaaucccagcggggccucagagaugcaucugggagagguggggaagauggcaggca

SEQ ID NO: 413801 - RNA, 64 nt, Human
ugugggcagggggauggggagggagugggccuggaucugggaccucccuccagaauuuccucca

SEQ ID NO: 413802 - RNA, 64 nt, Human
aucaucugaaagaaaugacguauacuuuaaaacaaucugggauggaacagaggaaauaugucaa

SEQ ID NO: 413803 - RNA, 64 nt, Human
guccucauucccaagauugaggaggcaguaguuaaucugggaaggcaguagaauggccagcauu

SEQ ID NO: 413804 - RNA, 64 nt, Human
cuacuugggaggcugaguugggaggauugcugcaaucugggagguggaaguugcagugagccga

SEQ ID NO: 413805 - RNA, 64 nt, Human
uaucuccuggcauuuuuguaucuaacuuuguucaaucugggaauuucaguuuucaauauccuug

SEQ ID NO: 413806 - RNA, 64 nt, Human
aacagggaauaacugcaaacuggacaggacacccaucugggaccaccuguccauccuacuuccc

SEQ ID NO: 413807 - RNA, 64 nt, Human
ugacuguguggguggaaugucccaagaaaagugcaucugggaauugccaguccagcuggguagu

SEQ ID NO: 413808 - RNA, 64 nt, Human
gcucagaauagcaccauugcugguuuguauuaggaucugggaauaacaaccuaaccaugagccu

SEQ ID NO: 413809 - RNA, 64 nt, Human
cugggccccugggaggugagguguggugugcggcuucacccagggcagaacaaggcagaaucgc

SEQ ID NO: 413810 - RNA, 64 nt, Human
cagcauugcucaacuuaccugacugccggaccccuucacccaugauucuaugcacuguauuguu

SEQ ID NO: 413811 - RNA, 64 nt, Human
ugaaaugggcuuucugaaguuuaaauaguccgacuucacccaugguguucugugcuugcagugc

SEQ ID NO: 413812 - RNA, 64 nt, Human
gcaauuuaagcaguuuguguugcaguaccccccauucacccacaaaaugcagcccaccacccag

SEQ ID NO: 413813 - RNA, 64 nt, Human
cuugagggggaaaaaauguacccgcuaaccuuuuuucacccaugauuugagcccuaaaacaaca

SEQ ID NO: 413814 - RNA, 64 nt, Human
aagaauuuuguagagcugccagcgcucucccagguucacccacccaggcuucaccagcccugug

SEQ ID NO: 413815 - RNA, 64 nt, Human
uauuauuaguguggguauggcuaaugaguucugauucacccacgaagguuacauuuaugcugaa

SEQ ID NO: 413816 - RNA, 64 nt, Human
gaucuuacguggcuuccugcugggggagauggccuucacccacgggaugccggguucuccuuuc

SEQ ID NO: 413817 - RNA, 64 nt, Human
cuggcuuauuucacucagcauaaugugcaccggguucacccauguuuucauaaaugacaagauu

SEQ ID NO: 413818 - RNA, 64 nt, Human
caccuuaaucuuguuuucauaugccucuucuuacuucacccauguuuguuguuaugcaaauaaa

SEQ ID NO: 413819 - RNA, 64 nt, Human
guaacuaggcugcugguuuuaauuacccucagauuucacccauaaaaacgcacaauuguauuau

SEQ ID NO: 413820 - RNA, 64 nt, Human
caaagcauugagaucuccacggucagauuugcuguucacccacaucuaaugucucuuccucugu

SEQ ID NO: 413821 - RNA, 64 nt, Human
aacauuuugagauugggcauucagaugaugggguuucacccaaccuuggggcagguuuuuaaaa

SEQ ID NO: 413822 - RNA, 64 nt, Human
ccaggagguagaaaaugaguggcaggcuagagauuucacccauuuugugggcuggaguuaccag

SEQ ID NO: 413823 - RNA, 64 nt, Human
uaaugagucacuaggcuucuggggagggcccaacuucacccaugcaugagagacucuccuccuu

SEQ ID NO: 413824 - RNA, 64 nt, Human
uaauacaagugacauagcuucccuucccucccccuucacccacucccuccagaacauuuagugu

SEQ ID NO: 413825 - RNA, 64 nt, Human
cugcaggucccgucuggcuccagcccuugucagauucacccagggugaagccuucaaagcuuuu

SEQ ID NO: 413826 - RNA, 59 nt, Human
ucaugaaggguguggaguagaugcugaccuucacccagagcugccuaugcccagccucc

SEQ ID NO: 413827 - RNA, 64 nt, Human
gauggagcugcauauuuuuauggccccaucuucauucacccagaagaaacagagcaugagccca

SEQ ID NO: 413828 - RNA, 64 nt, Human
auggacgagggcucuccaagggaaugccuggggauucacccagugguccccagaggugcuccau

SEQ ID NO: 413829 - RNA, 64 nt, Human
agacccaaccccuagcugggccaacuccagugaauucacccauuuuucuucuucagaaggccuu

SEQ ID NO: 413830 - RNA, 64 nt, Human
gauuuuuuuuuuuuuuuuuugccccaagaaaacguucacccagugaucuugggcugggguuguc

SEQ ID NO: 413831 - RNA, 64 nt, Human
uuguucauuuuauauugugcccagcaaagaaacuuucacccaguucagguuuccccaaaacucc

SEQ ID NO: 413832 - RNA, 64 nt, Human
augccccugcucaucugguccugaaguaguaacauucacccaaaugaggauauagucauuauuc

SEQ ID NO: 413833 - RNA, 64 nt, Human
uguagagaggagcuuugaggccacccgcacaaaauucacccagagggaaaucucgucggaagga

SEQ ID NO: 413834 - RNA, 64 nt, Human
cuggucccauggggacccuauggcucccucaaucuucacccacuaggauuuggguucugccugu

SEQ ID NO: 413835 - RNA, 64 nt, Human
ucugccugccacacauugaccaagccagacccgguucacccagcucgaggaucccagguugaag

SEQ ID NO: 413836 - RNA, 64 nt, Human
cggagaugaauaugagcucauuaguaaaaaugacuucacccacgcauauacauaaaguauccau

SEQ ID NO: 413837 - RNA, 64 nt, Human
ccuggugagcugaugccaccccagcaucugucuuuucacccacggagggcacagaaccaccagc

SEQ ID NO: 413838 - RNA, 64 nt, Human
gauguggcaccaacuaauuagcaagcaugaauuuuucacccaagagugaaaaaaggaaaaucua

SEQ ID NO: 413839 - RNA, 64 nt, Human
gaagggugcuccaagucacggccacuagguugucuucacccauguauuuugcgaugucacccug

SEQ ID NO: 413840 - RNA, 64 nt, Human
caugauuuuagcaauacccaugucuacacagauguucacccaaccacaucccacucacaacagc

SEQ ID NO: 413841 - RNA, 64 nt, Human
ugcauuagaccuuuacagguaauggaacaugagcuucacccauauuaaauauuuuggccccuuu

SEQ ID NO: 413842 - RNA, 64 nt, Human
acuauuaauaaaaauggaaucauuaaauacucucuucacccaaauaugcuugauuauucugcaa

SEQ ID NO: 413843 - RNA, 64 nt, Human
ggaacggcagggcucuuugcuggagcagaggcccuucacccagagccaguguggucaguauucc

SEQ ID NO: 413844 - RNA, 64 nt, Human
cacauuuuuuucaugccccuaucuuuagcugaacuucacccacuauuaugcuuaugguaaaauu

SEQ ID NO: 413845 - RNA, 64 nt, Human
gaugccaucugacugguuuccccauguccucccauucacccaucucugcucccacccuugccug

SEQ ID NO: 413846 - RNA, 64 nt, Human
aggaggccccagcacuucagacaaagaccaccccuucacccacuggaccccaagccgcaaaagc

SEQ ID NO: 413847 - RNA, 64 nt, Human
uguugacuuguucuuccuuaggagaaggacgauuuucacccacccuuucuguucuaugguggac

SEQ ID NO: 413848 - RNA, 64 nt, Human
cugccagccucucuugacuacagaauaacugauauucacccaccaaacagaaaaagugaaggcu

SEQ ID NO: 413849 - RNA, 64 nt, Human
uucuagaaaguuauuuucaacugauaaaucuauauucacccaaauaaucaagggugaagguaaa

SEQ ID NO: 413850 - RNA, 64 nt, Human
gucaggcuagucucgaacucgugaccgcaagcgauucacccaccucagccucccaaagugcugg

SEQ ID NO: 413851 - RNA, 64 nt, Human
aaagaaccaaaaguuuuccugagaauaagaaaguuucacccaauaaaauauuuuugaaaggcau

SEQ ID NO: 413852 - RNA, 64 nt, Human
gacuuuuaaaguuauuuccuggcauucugguaccuucacccagccugagugcccuggagaggga

SEQ ID NO: 413853 - RNA, 64 nt, Human
ucugauuauaaggccauguuuauauaaagggaauuucacccacaguucagcuggcuguugauuu

SEQ ID NO: 413854 - RNA, 64 nt, Human
aacucaucacuucucccaagcacucgaucccagcuucacccacugguguugcuuugcuugaacu

SEQ ID NO: 413855 - RNA, 64 nt, Human
auauaugcuucuuuauuucuugcaaggggcaaguuucacccaaaugccugagacugcuugaaag

SEQ ID NO: 413856 - RNA, 64 nt, Human
caagugcauuuaguugaaugaagucuucuuggauuucacccaacuaaaaggauuuuuaaaaaua

SEQ ID NO: 413857 - RNA, 64 nt, Human
aucugucuuuuauggauucugugacauguuuauauucacccauguacauuuucuguaaauacca

SEQ ID NO: 413858 - RNA, 64 nt, Human
cacaguugccagguugggaaugcuagauguagucuucacccaucaccuucugucguccucccag

SEQ ID NO: 413859 - RNA, 64 nt, Human
gugaagaauuuaucucuuuaguuagugauuauauuucacccaucucucaggaaucaucuccuuu

SEQ ID NO: 413860 - RNA, 64 nt, Human
acuucccauaauaaccacuuugcauccaacacucuucacccaccucccauacgcaaggggaugu

SEQ ID NO: 413861 - RNA, 64 nt, Human
uuauacaaacucguauaaagaauguaggaagaccuucacccagaagccaggacugacugugcac

SEQ ID NO: 413862 - RNA, 64 nt, Human
cuguuaggggagcuugggucccugaacacugucauucacccaauaaauuacuauuugaccccag

SEQ ID NO: 413863 - RNA, 64 nt, Human
caaauuauaugcuaauuaaauaauacaacuccuauucacccacuuaguuaaaauugauuucuuc

SEQ ID NO: 413864 - RNA, 64 nt, Human
aggcauuggcuccuagaaaucaaguuagaaaguuuucacccagggaguaagucccauucauuuc

SEQ ID NO: 413865 - RNA, 64 nt, Human
uuguaaaaccaacuaaauaaaaaauucaaaccaauucacccagaaaaaagaccaauaggugcaa

SEQ ID NO: 413866 - RNA, 64 nt, Human
uuccuguuuuuguuucguuuuuguagccuugacauucacccaccucccuuauguaguugaaaua

SEQ ID NO: 413867 - RNA, 64 nt, Human
aaugcauauguaaauuuuuuuuuguuuuuaagcauucacccaaacaaaaaaaucacagguaaac

SEQ ID NO: 413868 - RNA, 64 nt, Human
caaaacguggaccuaaccauugcuucacuuacacuucacccacagcuggaguucauucaacucu

SEQ ID NO: 413869 - RNA, 64 nt, Human
gccucagagcuuccuggggaccaagauuuaccaauucacccacucccuugaaguuguggaggag

SEQ ID NO: 413870 - RNA, 64 nt, Human
uuguuagggaucaagggcaacauaguacuucuccuucacccauaguaauccuccuggggcagaa

SEQ ID NO: 413871 - RNA, 64 nt, Human
ggagcucuuccuggaccaagggaggagccgcucauucacccaacaaaacugugucuuaucugcc

SEQ ID NO: 413872 - RNA, 64 nt, Human
uggucaauaacauuuuucauuacugauggugucauucacccauuagguaaacauucccuuuuaa

SEQ ID NO: 413873 - RNA, 64 nt, Human
uguaugaaaucaaggugcgcuguggaaacaauaauucacccaguuuagugggugguaggguacg

SEQ ID NO: 413874 - RNA, 64 nt, Human
ggugaccgaguaaagugagaggcaggugagacgguucacccaaucacacgggaaggggcgcgcg

SEQ ID NO: 413875 - RNA, 64 nt, Human
acuagaucccuuacccucucuccaguuccuaucauucacccauuucacugugcaagacaccuca

SEQ ID NO: 413876 - RNA, 64 nt, Human
ggagcccauccaggacacugggagcacauagagauucacccauguuuguugaacuuagagucau

SEQ ID NO: 413877 - RNA, 64 nt, Human
gcggauucggaaggagaagccucaacaacacaacuucacccaccgccuccuggcugcagcucug

SEQ ID NO: 413878 - RNA, 64 nt, Human
ggguuaaaggguuucuuugacacauucggaaccguucacccaugacauguuuccauggcucacc

SEQ ID NO: 413879 - RNA, 64 nt, Human
guguauuggcuugaaugugauuuucauuccuugauucacccaacaaauaccgacuggcugagca

SEQ ID NO: 413880 - RNA, 64 nt, Human
agucuccccugccagccuaggauuuugggcgucauucacccacuaccccuagugcuagucccag

SEQ ID NO: 413881 - RNA, 64 nt, Human
aagaacucuaacugucccaggaaucuugugaauuuucacccauaauggucuuucacuugucauu

SEQ ID NO: 413882 - RNA, 64 nt, Human
agauggagcucucgcuuccucagcagcugugacuuucacccaggacccaggacgcagcccuccg

SEQ ID NO: 413883 - RNA, 64 nt, Human
gaaccccagaguuuaaauaucucuggcucaaguguucacccaguaaaagaaagauccagaaagc

SEQ ID NO: 413884 - RNA, 64 nt, Human
cuuugcuaguuuaguacuugucucuaaauugauguucacccauuucaauauugcacuuauuaau

SEQ ID NO: 413885 - RNA, 64 nt, Human
agaagauaacuaauuguguugaagaaacuuagacuucacccaccagcuggcacaggugcacaga

SEQ ID NO: 413886 - RNA, 64 nt, Human
caaggaauucgggcuccuucccuagccccagcauuucacccagaugacaccuccccaaagucca

SEQ ID NO: 413887 - RNA, 64 nt, Human
ucugacaggugaauuggaugguucucagaaccauuucacccagacagccuguuucuauccuguu

SEQ ID NO: 413888 - RNA, 64 nt, Human
ugagcuuucuccugucgguuuggucuguuuugccuucacccauaagccccucgcacucuggugg

SEQ ID NO: 413889 - RNA, 64 nt, Human
cugccucccuuccaggaggcuccaucccacacuguucacccaggcugcggagacucaccuuccc

SEQ ID NO: 413890 - RNA, 64 nt, Human
cugucuucccaguacguaaguuaaaaaauaccaguucacccaaguugcuucuagccuacugaga

SEQ ID NO: 413891 - RNA, 64 nt, Human
aaaaagauaaaaaaacagcuuuauugagguauaauucacccaccagacuuuuuuaaacaucaaa

SEQ ID NO: 413892 - RNA, 64 nt, Human
gauuuguguuuaaagucuuguaaaguucaugucuuucacccagauauaucaaauguuagaagac

SEQ ID NO: 413893 - RNA, 64 nt, Human
uggcucuugucccaagugggcuacauuugaagaauucacccaggcuccagcuagaucaucaguu

SEQ ID NO: 413894 - RNA, 64 nt, Human
aguauuaagggcccuugguaucaagugagguaaauucacccaucacagggucucgcccuaccau

SEQ ID NO: 413895 - RNA, 64 nt, Human
ucaaaaaaucuuccuucuuauaacugagaaauguuucacccaaauuuccuuuguuauuauauau

SEQ ID NO: 413896 - RNA, 64 nt, Human
ccacccagccugguauuguccacggacagcguuguucacccagagccuuacuugggagccucac

SEQ ID NO: 413897 - RNA, 64 nt, Human
gguucaggucacuucggacaccugccauggacacuucacccacccuccaggaccccagcaagug

SEQ ID NO: 413898 - RNA, 64 nt, Human
uagaguccgaaaguauuuuuauaaguuacugguuuucacccacgcuuuugugggagagaaaauc

SEQ ID NO: 413899 - RNA, 64 nt, Human
cggggugauauaggggggccagacgugugccccguucacccacccccaggcaagcaucugaccu

SEQ ID NO: 413900 - RNA, 64 nt, Human
cgaaguacauucucugucuuacugauacuguagguucacccauuuuuuuuuaauuuccucgcaa

SEQ ID NO: 413901 - RNA, 64 nt, Human
gaguguggccaucuguauaagccucuuugacauuuucacccagcucuuucuuaaugucuguguu

SEQ ID NO: 413902 - RNA, 64 nt, Human
gaaucuuauaguacguucccucuugaaaugcuuuuucacccagcauaaugacuuugagguucau

SEQ ID NO: 413903 - RNA, 64 nt, Human
ucuuguauugaucccaucagugcccggcacucccuucacccaggugcugacgugccgggguuga

SEQ ID NO: 413904 - RNA, 64 nt, Human
ggugaacuguuacgacccaggacaauuagaaaaauucacccaccaugccgcacauuacugggua

SEQ ID NO: 413905 - RNA, 64 nt, Human
ggcuucccaugcccucccccaacagucccucagcuucacccagcggggcuuccaggccagccug

SEQ ID NO: 413906 - RNA, 64 nt, Human
gggagacuucuaaagcccccccugucgucugcucuucacccagcaccacagaggcaccugcugc

SEQ ID NO: 413907 - RNA, 64 nt, Human
cuaaaugugcaguuguguccuuaaauaugcagucuucacccagaguaaaguguugaucgcaaga

SEQ ID NO: 413908 - RNA, 64 nt, Human
agcgaggggggcuucugcucccugagacucuggguucacccacagcacuuucugaggaagagga

SEQ ID NO: 413909 - RNA, 64 nt, Human
acaaaaagcaaauacuagaacagcuagcucaucguucacccaauguacuugguauuuuucugca

SEQ ID NO: 413910 - RNA, 64 nt, Human
guguucuggauagaucuauuaugugaaaggcagcuucacccaguuuucuggacucucaugcccc

SEQ ID NO: 413911 - RNA, 64 nt, Human
agaugaccagcucugaagccaacuucuguauaccuucacccauuucaugaaaauaaaaucaaaa

SEQ ID NO: 413912 - RNA, 64 nt, Human
ugagaacguggaaucccacggguuuuuacugcccuucacccaaccucucccaccuccaccccac

SEQ ID NO: 413913 - RNA, 64 nt, Human
guuuauuuguguuugugaccaagcagccucucccuucacccagguuuauggccucguuuucacu

SEQ ID NO: 413914 - RNA, 64 nt, Human
auuuaaaccuaggcuuaauauaggcguuuccccuuucacccaagugaugucacaguucgaugca

SEQ ID NO: 413915 - RNA, 64 nt, Human
uuuucaucuguuucuaugguugucaaaugaauucuucacccacccuacaguuugcuaacuccuu

SEQ ID NO: 413916 - RNA, 64 nt, Human
gccaaaagguagaagcagcccaagugucaucccauucacccaugaauggaugcaggaauugugu

SEQ ID NO: 413917 - RNA, 64 nt, Human
gcucaauuuuauuuuacuaaguauauauuuacauuucacccaggcaggccauuuucuuuuguga

SEQ ID NO: 413918 - RNA, 64 nt, Human
aacuauuugagguucaggaaauguuaugaucacuuucacccaugauauaaaguaaaguuuauuu

SEQ ID NO: 413919 - RNA, 64 nt, Human
ggaaaguagcacauuagcauugauggcuguucauuucacccaguauaagcaagugcaguguaca

SEQ ID NO: 413920 - RNA, 64 nt, Human
gccaccggcuccacuuuccccuuuuauuaauacauucacccagauaaucauuaaaauuaacaug

SEQ ID NO: 413921 - RNA, 64 nt, Human
ccgugguugcccaugagaaguguccuuguucauuuucacccaaaugaagugugaacgugauguu

SEQ ID NO: 413922 - RNA, 64 nt, Human
caucccccaggucaccugucuggauuccuccccauucacccaccuugccaggugcaggugagga

SEQ ID NO: 413923 - RNA, 64 nt, Human
gaauagauguuuaucuaaccugacaguugcaguuuucacccauggaaagcauuagucugacagu

SEQ ID NO: 413924 - RNA, 64 nt, Human
gcccacccgcaaaggugucuaaaaacuucagcuuuucacccaccugccccuuucuuucaauccc

SEQ ID NO: 413925 - RNA, 64 nt, Human
aauauuugaccuuaaaucuccagugacucagagcuucacccacaaacucaggagaacauaagcc

SEQ ID NO: 413926 - RNA, 64 nt, Human
cgccuaguaaaccuuaaccaacuugguuuuuugcuucacccagcaauuaaaagucccaagcuga

SEQ ID NO: 413927 - RNA, 64 nt, Human
aaaugaucacuguaaacuggcucugucucaggaauucacccaggcagccuggagucagccaugg

SEQ ID NO: 413928 - RNA, 64 nt, Human
gagaaggaaagggucugcgccagcccuguccgucuucacccauccccaagccuacuagagcaag

SEQ ID NO: 413929 - RNA, 64 nt, Human
uaucacacagggaugccaguuguauuugugggauuucacccauuauuaauaaaaccuauauuua

SEQ ID NO: 413930 - RNA, 64 nt, Human
caacuggaacauugauuguaaggccagugaaguuuucacccaacuggaauuugauggaaagaag

SEQ ID NO: 413931 - RNA, 64 nt, Human
guggguguuuuuaggguucuuuaguguuguuucuuucacccaggggugguggucccagccaguu

SEQ ID NO: 413932 - RNA, 64 nt, Human
cucugaggcgggugggggagagaaacccuggcucuucacccagguuucacacacauguaaauga

SEQ ID NO: 413933 - RNA, 64 nt, Human
aaauaguucaucaucagagaauggucaguuuccauucacccaucugaaagauuuuaagaugagg

SEQ ID NO: 413934 - RNA, 64 nt, Human
aggcccccugccuggggcucuccaaggagccuucuucacccacuuccagcuccacuucugcaag

SEQ ID NO: 413935 - RNA, 64 nt, Human
uuuuuuuuuuuucauguuagcagguaaaaaaucauucacccaauuugaagcauagaagaaaaua

SEQ ID NO: 413936 - RNA, 64 nt, Human
uguugcuaggauuagagccucucagucuggccucuucacccaagugcaagaacucagucucuua

SEQ ID NO: 413937 - RNA, 62 nt, Human
ugaaagcugggaaguuaugaaugaagauaacauucacccauaaccaagagaacucagguagc

SEQ ID NO: 413938 - RNA, 64 nt, Human
caacuucaggaguccgcuuucccaccaggcuucauucacccaguggaccugaacuguuugguag

SEQ ID NO: 413939 - RNA, 64 nt, Human
ggcucagaucacucagcucccugugaccuuuguauucacccaggcuuccuucucaguagcucua

SEQ ID NO: 413940 - RNA, 64 nt, Human
uguaaagcucucagcucaugcaccccaucuccucuucacccauauuaugccuucuuucucuugu

SEQ ID NO: 413941 - RNA, 64 nt, Human
caaaguacuacagcaaagccuagccugcauaucauucacccaaaacaaaguaauagcgccucuu

SEQ ID NO: 413942 - RNA, 64 nt, Human
uuagugcaucacaaugacaaaggggugguuuucuuucacccaagaaugugcuuuccuggaaauu

SEQ ID NO: 413943 - RNA, 64 nt, Human
aauuuuauaaaaaaauuuacgucagaaagagauuuucacccauccaugagcugcuccaucaccu

SEQ ID NO: 413944 - RNA, 64 nt, Human
gcaauguccagcuuuuaccccuacucucuacuuuuucacccaaacugauaacauuuaucucauu

SEQ ID NO: 413945 - RNA, 64 nt, Human
cacugcucucuuuuccucuacagcuccaucuuguuucacccaccccacaucucacacauccaga

SEQ ID NO: 413946 - RNA, 64 nt, Human
guggucccuagaacaagaggcuuaaaaccgggcuuucacccaaccugcucccucugauccucca

SEQ ID NO: 413947 - RNA, 64 nt, Human
gccaggcuggucucgaacuccugaccucaagugauucacccaccuuggccucauaaaccuguuu

SEQ ID NO: 413948 - RNA, 64 nt, Human
cugauaacacagagagaggaauguccaggucaucuucacccagaggagaagccucaucauugaa

SEQ ID NO: 413949 - RNA, 64 nt, Human
ucccugccgccucaaugugguugcaaggccgcuguucacccacagggcuaagagcuagcgcugc

SEQ ID NO: 413950 - RNA, 64 nt, Human
uggaaagaugacauauuugugccaugcuuguuuuuucacccagguuuuucccucuuugugagau

SEQ ID NO: 413951 - RNA, 64 nt, Human
uaauggcuugccccacucaaaaccaucccagcucuucacccaggucuccucuuccucucccuga

SEQ ID NO: 413952 - RNA, 64 nt, Human
uagccaagagaaccccacggacaagauuuuucauuucacccaauguucacaucugcacucaagg

SEQ ID NO: 413953 - RNA, 64 nt, Human
cccuggaccacccaucugaccaucuccuuaagguuucacccaaagcccccagugucagagacuu

SEQ ID NO: 413954 - RNA, 64 nt, Human
ugucaugcagaggccauucccccaggccugugucuucacccaccugccaucauuggccuuugcu

SEQ ID NO: 413955 - RNA, 64 nt, Human
uuuuaagucuuucacacuucaggaaaauacuacauucacccacguugugauucauaucggacag

SEQ ID NO: 413956 - RNA, 64 nt, Human
gaguugggcucuagcuccuggugcuguucccgcauucacccacuggccuuucccaccucugcuc

SEQ ID NO: 413957 - RNA, 64 nt, Human
gaguugggcucuagcuccuggugcuguuccugcauucacccacuggccuuucccaccucugcuc

SEQ ID NO: 413958 - RNA, 64 nt, Human
gucguuuccucaaguuugacuguuuuaaugggguuucacccaaauuguuuaaugcuucugcugu

SEQ ID NO: 413959 - RNA, 64 nt, Human
uauuggcuuuacguaacaauauuguuccuguccauucacccagccaaauuguguuaaagaggaa

SEQ ID NO: 413960 - RNA, 64 nt, Human
gauaacucuguccuuccauuugcucacuucucucuucacccaucuuuuuuaaaaacaaauaaau

SEQ ID NO: 413961 - RNA, 64 nt, Human
cauucauguguccagagaucuuggaaaauauuuuuucacccacgauuuauuuuguuauugauga

SEQ ID NO: 413962 - RNA, 64 nt, Human
ggagaggcagcaucaggaccuaagccccaggaacuucacccaacuuaggcccuggcaauuaacu

SEQ ID NO: 413963 - RNA, 64 nt, Human
ccaugguauggauguaccacaguuugcuuaaccauucacccacuaaaggacauaagaguuguuu

SEQ ID NO: 413964 - RNA, 64 nt, Human
aggcugccucaauggaggagucgcugggggcauuuucacccacaauucuggccauacuuaagca

SEQ ID NO: 413965 - RNA, 64 nt, Human
ccacucggcaccccagucuaacaccacaacuaauuucacccaagguuuuaagcacguucuuuca

SEQ ID NO: 413966 - RNA, 64 nt, Human
ccuggacggacccggagcccccgcauaucagcaguucacccaguacuccucagagacugguuuc

SEQ ID NO: 413967 - RNA, 64 nt, Human
cagcagagcacuuguuaacguuuggaggcacaguuucacccagggcgacccuggguucuuuugg

SEQ ID NO: 413968 - RNA, 64 nt, Human
ggucaccuuccucagcucagcugggccacuccucuucacccaccccauggagacaauaaacagc

SEQ ID NO: 413969 - RNA, 64 nt, Human
auuuuauagguucagacaaaucuucuagaucugcuucacccagcauauuuucuauucagugaua

SEQ ID NO: 413970 - RNA, 64 nt, Human
uaaaagcaucaggaaaucggauggagaaccaccauucacccaagggucagaggagguuucaaag

SEQ ID NO: 413971 - RNA, 64 nt, Human
aggagcugcucuccuaucugcacucacccaggccuucacccagacuuuaccacggaggcggcug

SEQ ID NO: 413972 - RNA, 64 nt, Human
ggaaggacucuuccaaagccccaaagccgaggguuucacccacacugccagccuggguuggggc

SEQ ID NO: 413973 - RNA, 64 nt, Human
ucucccaggccaggcuccuuccugucuuccugcauucacccagacagcucccucugccugaacc

SEQ ID NO: 413974 - RNA, 64 nt, Human
ugagacugggcugcaggccccaggaagacuuuccuucacccaccaucccccuaaccucggcagg

SEQ ID NO: 413975 - RNA, 54 nt, Human
uggccagcacagcauucuaaacuauucacccauggguuccuggugccccuuucc

SEQ ID NO: 413976 - RNA, 64 nt, Human
aauauuccagaagaacaacuuuagcaucagaagguucacccagcaccuugcagauuuucuuaag

SEQ ID NO: 413977 - RNA, 64 nt, Human
gguauaggagaagaaugacagcuuccugagagguuucacccaaguuccaagugagaagcaggug

SEQ ID NO: 413978 - RNA, 64 nt, Human
augagaccgcacuccuuggcuuguuccugcguguuucacccaaaggagaaaaugcuaggaugaa

SEQ ID NO: 413979 - RNA, 64 nt, Human
gcuaguuacugugccaauuaagacccaguuguauuucacccaucuguuucuucuuggcuaaucu

SEQ ID NO: 413980 - RNA, 64 nt, Human
ucuaggcuuugcgugcugcuagcuggguucaggcuucacccacuggaaagaaccaccaucugcu

SEQ ID NO: 413981 - RNA, 64 nt, Human
cacagcggggaggccaagaggggcccuguggacuuucacccagcacugugggggccuucagacu

SEQ ID NO: 413982 - RNA, 64 nt, Human
guaaugggggcagaggccagggaaaaagaugcuguucacccacccucagcuucccuuuuccuaa

SEQ ID NO: 413983 - RNA, 64 nt, Human
gagccagcuacuggagucauuccguuuccacucauucacccaaccucaggguucuccccaucug

SEQ ID NO: 413984 - RNA, 64 nt, Human
uguauagacgacugacuggaucccaggccugcccuucacccaggccccguccccgaggccgacc

SEQ ID NO: 413985 - RNA, 64 nt, Human
ugccugaugcccaccccugccagucauuccuccauucacccagcgggaggugggaugugagaca

SEQ ID NO: 413986 - RNA, 64 nt, Human
ggacucuggguucuuaagauuucugggagcguuguucacccacccccuuuaggaaccaggcugg

SEQ ID NO: 413987 - RNA, 64 nt, Human
aacagacugauaagaagcuggccuuucagccugcuucacccaaguuauggaggagguuaagucu

SEQ ID NO: 413988 - RNA, 64 nt, Human
ccccaucugccaggaagguugaggacucccagguuucacccacuggaggcucaaccuaaggaac

SEQ ID NO: 413989 - RNA, 64 nt, Human
cggcacagcagccagcgggugggggacgccuguguucacccauggugcccaugucguucuucuc

SEQ ID NO: 413990 - RNA, 64 nt, Human
ccagaaaggagagcuuagcaggaguccuagcccuuucacccauacacauuuggcucaggguuac

SEQ ID NO: 413991 - RNA, 64 nt, Human
accaccucagccucuuuugccccucuucuugccuuucacccaggcucucagcccuaauuaacac

SEQ ID NO: 413992 - RNA, 64 nt, Human
cuccaccuauggccccaggccuuugcgaucuugcuucacccaccgcgaccccacacuauuucug

SEQ ID NO: 413993 - RNA, 64 nt, Human
gccugucagauucuaacaacaaaagcugaauuucuucacccaacuuaaauguucuugagaugaa

SEQ ID NO: 413994 - RNA, 64 nt, Human
ugccagcccacccccuuugacucuggggugcagcuucacccaccaggccagcucaggaauuccc

SEQ ID NO: 413995 - RNA, 64 nt, Human
caccuuccucuagagcucgggagcccggagggucuucacccacuccuacuccaguaucagcugg

SEQ ID NO: 413996 - RNA, 64 nt, Human
auuuccuucuguggucauuuuucuugcugccuuuuucacccaagauucagcagucagauguuua

SEQ ID NO: 413997 - RNA, 64 nt, Human
gaacagcgauugaccaguaacugugagaucagaauucacccaaaggaagacauuuucaucucug

SEQ ID NO: 413998 - RNA, 64 nt, Human
caaauucuguuuacggugaaaaaggauuuuguuuuucacccaauuugggaggcgggaggggggg

SEQ ID NO: 413999 - RNA, 64 nt, Human
agcugggaacauguguacugggugacucaaauuuuucacccauuuacacauauccacaaaugac

SEQ ID NO: 414000 - RNA, 64 nt, Human
cuccgaccuuucuugccucgguucucauuacacuuucacccauagcagaaaacacuuugugcgg

SEQ ID NO: 414001 - RNA, 64 nt, Human
aggccgggacggccucucccucucagugugaggcuucacccaugcuaggcaagcccagggcaca

SEQ ID NO: 414002 - RNA, 64 nt, Human
aaaaaaugaaaaaacacucaugagauaacugcauuucacccaacaaaagcaggguauaaggcga

SEQ ID NO: 414003 - RNA, 64 nt, Human
ucuuuucugcagaaaagcuccagcaggcgcugccuucacccacggaucugcccaggcugaaggc

SEQ ID NO: 414004 - RNA, 64 nt, Human
gcuagccucagccuccauugugguauagcagaacuucacccacuuguaagccagcgcuucuucu

SEQ ID NO: 414005 - RNA, 64 nt, Human
cggguuacccccacaagggggccgcugcgagaaguucacccacccccgaaaaaauaauuaaacu

SEQ ID NO: 414006 - RNA, 64 nt, Human
gccaggcuggucucgaacuccugaacucaagugauucacccaccuuagccucccaaagugcugg

SEQ ID NO: 414007 - RNA, 64 nt, Human
uuuuuuuuuuuuuuuugagacagagucucacucuuucacccaggccugacugcaguggcgcuau

SEQ ID NO: 414008 - RNA, 64 nt, Human
cccaacccuaguccuccaccgucccgaagccaacuucacccauguccccauccccaaucuuguc

SEQ ID NO: 414009 - RNA, 64 nt, Human
uguaaguaaugauacagagggaucuuguguacccuucacccagccucccccaauggcaacaucu

SEQ ID NO: 414010 - RNA, 64 nt, Human
gacacagccaagagucuuauucuacaucugauaauucacccaugaaagagacccagugguuacu

SEQ ID NO: 414011 - RNA, 64 nt, Human
gaaccagccuggagucuuauucuccaccugagaauucacccaugagagagacccagugguugcu

SEQ ID NO: 414012 - RNA, 64 nt, Human
cuggcuuauuucacuuaggauaaggucuucacgguucacccauguuguauaaugugucagaaua

SEQ ID NO: 414013 - RNA, 64 nt, Human
uacaccuugccuuccagauaugugguuuuugugauucacccagaucuguugugccaguuaggaa

SEQ ID NO: 414014 - RNA, 64 nt, Human
acuggaucuccauccccuugaugcucugagcaucuucacccauuuggucguugagacauaucug

SEQ ID NO: 414015 - RNA, 64 nt, Human
gauuucauuugcacguggggacaggauuugccaguucacccacagaucacaccuccauccccaa

SEQ ID NO: 414016 - RNA, 64 nt, Human
agggaggucaccugggggcagcuggugccgggucuucacccagaccacgcuggguccccucugu

SEQ ID NO: 414017 - RNA, 64 nt, Human
ggaacugugcguucugcauagaauucaaacgagauucacccagcgcgaggaggaagaaacagca

SEQ ID NO: 414018 - RNA, 64 nt, Human
aaaugcucugguauucaguauugccuuaauaaacuucacccacaacugcauacaggccaugugu

SEQ ID NO: 414019 - RNA, 64 nt, Human
cacccccaggcacuggaucccagauucccaagccuucacccaccagauucuggcuccuaaaaca

SEQ ID NO: 414020 - RNA, 64 nt, Human
ggacucagugaccuuugaagauguggcugugaacuucacccaggaggaauggacuuugcuggau

SEQ ID NO: 414021 - RNA, 64 nt, Human
gugacacaaaauaucauucuucuuuuuauuuguuuucacccauuugaaaaauguaaaaacuauu

SEQ ID NO: 414022 - RNA, 64 nt, Human
uaaucacuugucauccaaagaauuauauuaaagauucacccaguuuagagccuuacacuguacc

SEQ ID NO: 414023 - RNA, 64 nt, Human
cucucgggcaauuuucccuucgccugccaugggcuucacccacccccacgccagggguaagugg

SEQ ID NO: 414024 - RNA, 64 nt, Human
acaccccugggauagaaagacccuuagaugucuuuucacccaaccccaaacucccuguacagaa

SEQ ID NO: 414025 - RNA, 64 nt, Human
aagagaaaccccgagacacuguacacuguuccuuuucacccaccaccccgaucccuaggugagg

SEQ ID NO: 414026 - RNA, 64 nt, Human
uaaucuaugauacgaauauaccacuauuuguuuauucacccacugaaggacauuaguuuuguuc

SEQ ID NO: 414027 - RNA, 64 nt, Human
uagccuggauggucucgauuuucugaucuuaugauucacccaccucuaccucccgaagugcuga

SEQ ID NO: 414028 - RNA, 64 nt, Human
ucaaagggggcuuauuaauacccucagcauguuuuucacccaaaugaugcaaaacaugcagauu

SEQ ID NO: 414029 - RNA, 64 nt, Human
guguuugccucuuccuuggguaugaaugugugaguucacccagaggccugcucuccucacacau

SEQ ID NO: 414030 - RNA, 64 nt, Human
ggacccuucgagaucaucacuuccuugcccccauuucacccauggggagacaguugagagcggg

SEQ ID NO: 414031 - RNA, 64 nt, Human
auguuauaaaagcaaaucccaagcaucauaucauuucacccaaguauuuuaaaguaugugucuc

SEQ ID NO: 414032 - RNA, 64 nt, Human
auuguuaacacacuugugaugugucagccacagauucacccaggaggucacagaaugacagcaa

SEQ ID NO: 414033 - RNA, 63 nt, Human
ucuucauaaaacauuugaaaauaaaagaucauucuucacccauauguucuuuggauucuggca

SEQ ID NO: 414034 - RNA, 64 nt, Human
guaagcaaauuuauuauuaaaugugcacaucuuauucacccaagggaauaaaagcuacuucgua

SEQ ID NO: 414035 - RNA, 64 nt, Human
caggacacccagcaucggcuuugacugcagacuguucacccacacgagcccugugcuuuuggug

SEQ ID NO: 414036 - RNA, 64 nt, Human
cugauagaaugucuuuaaugguaucauaaucauuuucacccauaauacacaguagcuucuucuu

SEQ ID NO: 414037 - RNA, 64 nt, Human
caguagauccuuucacgaccuuggccucuaaggcuucacccacacuggacuuuacagaaagaua

SEQ ID NO: 414038 - RNA, 64 nt, Human
caagccugauuuaggcacugcuuuauccaggggcuucacccaugaaauuaauaaaacuuaucug

SEQ ID NO: 414039 - RNA, 64 nt, Human
aggcuagggaccuggggggaggagacccauggacuucacccauacucagugagggggcuccugc

SEQ ID NO: 414040 - RNA, 64 nt, Human
cuuuaggaccccacagcauggcagugcugaccauuucacccacuuggccuccuugaggaauagg

SEQ ID NO: 414041 - RNA, 64 nt, Human
caacugaagauccuucagguccccuggcccuuccuucacccaccacccccaucaucaccgauuc

SEQ ID NO: 414042 - RNA, 64 nt, Human
cccgguggguuagacaggaaguaacugauaucacuucacccaaauauauaaccgugaugguuau

SEQ ID NO: 414043 - RNA, 64 nt, Human
acugaggauggguccugcuugcagaagcugcccuuucacccaucuugacaagauccagccaccc

SEQ ID NO: 414044 - RNA, 64 nt, Human
gauaugagcuauuuauuuugugaaaugaaaauuguucacccaaaugauucucuuauaaacuauu

SEQ ID NO: 414045 - RNA, 64 nt, Human
aguguacuggcagcuugccacccccuccucucccuucacccagacacgugguagggauggaaaa

SEQ ID NO: 414046 - RNA, 64 nt, Human
acagaucaggucagagcccaggaauucucacagguucacccagcgcccucuaccuccuagcaag

SEQ ID NO: 414047 - RNA, 64 nt, Human
guaaccugaaguuuuaugaucccugaacauaguuuucacccaagagcuguccuggugaccaaaa

SEQ ID NO: 414048 - RNA, 64 nt, Human
agaauaugugcccuuuucagugugacuuugccacuucacccaucaagagguagaaucuauuucu

SEQ ID NO: 414049 - RNA, 64 nt, Human
cugggacccacagaacuuguggccuuuauguucuuucacccauccuaggaaccagccaaccauc

SEQ ID NO: 414050 - RNA, 64 nt, Human
cucuccugguuccggucaaagccuuuccucagccuucacccaaccuuuccaguuuccacuggcc

SEQ ID NO: 414051 - RNA, 64 nt, Human
uuugcacucaguguaaguuucugucagcaguaguuucacccauuugcauggaaaaauuuaaagc

SEQ ID NO: 414052 - RNA, 64 nt, Human
ccaacuacggcgcucuauauuuuaguagaggauuuucacccaugugcauggaaaagauguucau

SEQ ID NO: 414053 - RNA, 64 nt, Human
ugcagcugggagaagggggucaaagcaaggaucuuucacccacagaaagagagcacugaccccg

SEQ ID NO: 414054 - RNA, 64 nt, Human
auuaagccuacaguuaaagaccaguuuuguucuuuucacccauuuuuaagcugguuuucuccug

SEQ ID NO: 414055 - RNA, 64 nt, Human
cuuccccuguugaaaagcuuucucaugaucauauuucacccacaucucaccuugaagaaacuua

SEQ ID NO: 414056 - RNA, 64 nt, Human
ccuuaccucucacuuggcugauuugaccuucucuuucacccacaugccuaagaccugcccugac

SEQ ID NO: 414057 - RNA, 64 nt, Human
auaacuucacugagaagacauugaauggaaauuauucacccauuuuaaauuggugaccuaggga

SEQ ID NO: 414058 - RNA, 64 nt, Human
ugauugauagagaaggacaguuauuugcauuuaauucacccauaugcuuucaaaucuaguauau

SEQ ID NO: 414059 - RNA, 64 nt, Human
aauggaaugaauuaguucuguagaugacaauuucuucacccauuuaugagaccuaaaucuuuuc

SEQ ID NO: 414060 - RNA, 64 nt, Human
ccaacuacagcgcucuauauuuuaguagaggauuuucacccaugugcauggaaaagauguucau

SEQ ID NO: 414061 - RNA, 64 nt, Human
ccaacuacagugcucugucuuuuaguagaggauuuucacccaugugcauggaauaaauguucau

SEQ ID NO: 414062 - RNA, 64 nt, Human
uccugacugaacacuauagacuucccagcagcauuucacccagcagccagagccggcuuuaagu

SEQ ID NO: 414063 - RNA, 64 nt, Human
caucugucaaaaguucacaaugccauacaggcucuucacccagaggaucuggaaagaagaaaga

SEQ ID NO: 414064 - RNA, 64 nt, Human
ccugaaaucacaugccuauguaaggaaagugcuauucacccaguaaacccaaaaaagcaaaugg

SEQ ID NO: 414065 - RNA, 64 nt, Human
accuccaggugcuguugaauucuucuagcaguccuucacccaaaaguucaaauuugucagugac

SEQ ID NO: 414066 - RNA, 64 nt, Human
ccagugguauuggcauuggcagcaggugagcaauuucacccagugucuucugccucccucugcg

SEQ ID NO: 414067 - RNA, 59 nt, Human
ccucaggacagggagucugauccaucccauucacccagugacuucuuuuugcccaggcc

SEQ ID NO: 414068 - RNA, 64 nt, Human
auaucuucacugacaagacacugaauggaauuuauucacccauuuuaaauugguuacuugggga

SEQ ID NO: 414069 - RNA, 64 nt, Human
auaaaaacaguauccguagcuaucaggaucauugcgcacucauauaugcuaagccuucuguucu

SEQ ID NO: 414070 - RNA, 64 nt, Human
cagcgugagcucucugaaucccgggaccccuucacguggccacagccccagcccugcccccguc

SEQ ID NO: 414071 - RNA, 64 nt, Human
ccuuccacuaagccagcucccccuccugaccucucguggccauugccaggagcccacccugguc

SEQ ID NO: 414072 - RNA, 64 nt, Human
uccgcgagggcaaguucggagccguggagggugccguggccaaguacaugggugcagcggccau

SEQ ID NO: 414073 - RNA, 64 nt, Human
caguacuugccaccugcuggccugucugacccuccgcacucaccugccgggacccucccuauuc

SEQ ID NO: 414074 - RNA, 64 nt, Human
ugaccucaguagggaacauguccgucuacccucucgcacucaugacaccucccccuaccagccc

SEQ ID NO: 414075 - RNA, 64 nt, Human
guaugggaaggugguccagaagcuucgggcaccacgcacucaggccauggaggagcagcugguc

SEQ ID NO: 414076 - RNA, 64 nt, Human
uuccuacgcccgaggcucccuucccuuccccagccgcacucaugcccugcuccugucuugugcu

SEQ ID NO: 414077 - RNA, 64 nt, Human
ugagacgcacagagaggucucuuccugacccagacgcacucacgagccagguccuggggguaug

SEQ ID NO: 414078 - RNA, 64 nt, Human
cuuuugcacauaacaugcuuuagauuauauauuccgcacucaaggaguaaccaggucguccaag

SEQ ID NO: 414079 - RNA, 64 nt, Human
aacacaugcucauccuccugccuaugcugagauacgcacucagcuccaugucuuguacacacag

SEQ ID NO: 414080 - RNA, 64 nt, Human
cucaggagcuuaccaagaaacccaugucagcaaccgcacucaucagaccaugcacuauggaugu

SEQ ID NO: 414081 - RNA, 64 nt, Human
cuguucaaaaaaaauauguggccuguuguauaaccgcacucauguaucccauauguggugccac

SEQ ID NO: 414082 - RNA, 64 nt, Human
cacgcgguucccacccggggccaaccucuccacgcgcacucaggaaagugaccagugaccacug

SEQ ID NO: 414083 - RNA, 64 nt, Human
uguucugaagucuacuuugucuaaaaauaacauacgcacucaacuuccuuuucuuucuuccuuc

SEQ ID NO: 414084 - RNA, 64 nt, Human
uggaacccacugagcccuucccgggguuucccgccgcacucaguguguuccuucaggcuaguga

SEQ ID NO: 414085 - RNA, 64 nt, Human
gcgcgcguucgcggcggugggcgccugucgggcccgcacucaggagcacagccauagcagacgg

SEQ ID NO: 414086 - RNA, 64 nt, Human
uaccaacuugauagcagaggggguuuuaugcaaacgcacucaccuccgccuuggggaaugaaag

SEQ ID NO: 414087 - RNA, 64 nt, Human
gucauuacgagggagugauggcgggaaucucagucgcacucaagcucugagaccuuuguaucaa

SEQ ID NO: 414088 - RNA, 64 nt, Human
uauucuaaugugcuuauucuaguucagggucgugcguggccagaguccaccccagcaacucagu

SEQ ID NO: 414089 - RNA, 64 nt, Human
cucuuuacccacuuggguuuuuccacugcagccacguggccagcccuggauuuuggagccugug

SEQ ID NO: 414090 - RNA, 64 nt, Human
augaagcaguucccacaugggcguguggcuggggcguggccaccacagagcacauggcuguguc

SEQ ID NO: 414091 - RNA, 64 nt, Human
ggccccugugacaggggaaagggcucucuuacaccgcacucagggagaccacuucucaggaugg

SEQ ID NO: 414092 - RNA, 64 nt, Human
aaaaaacaaaaaaaaaaaacaacgguggagccuucgcacucaaugccaacuuuuuguuacagau

SEQ ID NO: 414093 - RNA, 64 nt, Human
gcccucagggaucuugcauucccaguggucaaaccgcacucacccaugugccaaggugggguau

SEQ ID NO: 414094 - RNA, 64 nt, Human
uaagaagacaaauggcgcccacuaguggggaauccgcacucacaaaagcacaggaugcuggaaa

SEQ ID NO: 414095 - RNA, 64 nt, Human
ugggaaacgugugggaaggcuuguugaacuuuggcgcacucagguaaacaauacucucucaauu

SEQ ID NO: 414096 - RNA, 64 nt, Human
auggggaaaaucacagggagggcgcugugaccagcgcacucaggcaccaagugucggcauggcu

SEQ ID NO: 414097 - RNA, 64 nt, Human
agcugcgagcaggugggcagaugagggcccuaugcgcacucaggggugaagggcguccgcuggc

SEQ ID NO: 414098 - RNA, 64 nt, Human
uauuuucuaauuucagacaaacacacacucagcgcgcacucacugauuccuacacauugccaag

SEQ ID NO: 414099 - RNA, 64 nt, Human
uggcuggugugugugucaagcccucacucacccacgcacucacacacagcauucuguucuccau

SEQ ID NO: 414100 - RNA, 64 nt, Human
gcgccccggcccgcggcccccgcggcccacucggcgcacucagccagcgucuccccuguggaga

SEQ ID NO: 414101 - RNA, 64 nt, Human
acgugggugucccucggggguucucucucggguccgcacucaacuggcagcugcuccucggcug

SEQ ID NO: 414102 - RNA, 64 nt, Human
aaauagugagauggacuuggggccucugacgccgcgcacucagccgugggcccgggcgcgggga

SEQ ID NO: 414103 - RNA, 64 nt, Human
agggggugaggaauuagugcuggauuugaagcuacgcacucagccucaagaacucccuggaaua

SEQ ID NO: 414104 - RNA, 64 nt, Human
ccagcuuuggaacugggaaaccuuucuucggauccgcacucauuccacugaugccagcugcccc

SEQ ID NO: 414105 - RNA, 64 nt, Human
cgaccacagucggcggcaccuucucagagugccccgcacucaccuggggguuggggcagugccg

SEQ ID NO: 414106 - RNA, 64 nt, Human
ugucuccaugaggaggccaacccuugccauugaccguggccaccuggacccaggccaggcccgg

SEQ ID NO: 414107 - RNA, 64 nt, Human
aaaaaaaaaaaaaaagccagggcaaaggaccuggcguggccacuuccuccugccccagcccaac

SEQ ID NO: 414108 - RNA, 64 nt, Human
gcuucuucaucuuccuggacgucagcagggacuucguggccagcggggcggaggaccggcacgg

SEQ ID NO: 414109 - RNA, 64 nt, Human
cuguauacuguauuuuuuuaaaaaaauggugcagcguggccaaaccuaccaauuguaugcauua

SEQ ID NO: 414110 - RNA, 64 nt, Human
ccaucccucuguccaccccagggggagguaaccccgcacucacacucccuugaugcugucugua

SEQ ID NO: 414111 - RNA, 64 nt, Human
cacugaacacacccgcccucaaccccgcacccuccgcacucaccucccccucgccgcucgaccc

SEQ ID NO: 414112 - RNA, 64 nt, Human
uggcaggccgcgguggggggcggcaguggcuccgcgcacucacccgggccccgggcaggggcgc

SEQ ID NO: 414113 - RNA, 64 nt, Human
ccgggacuggcugcggacccagccuccugugccgcgcacucacggagcugcguagucuccucag

SEQ ID NO: 414114 - RNA, 64 nt, Human
ccccacccccgcccccagcuucaugcuucucuuccgcacucagccgcccugcccuguccucgug

SEQ ID NO: 414115 - RNA, 64 nt, Human
gcacucacuaauguacuacuaauugagcaaccuacgcacucaguugacuacguaaaucugucag

SEQ ID NO: 414116 - RNA, 64 nt, Human
cuggaugguaggaagggaugugcccgccucuccacgcacucagcuauaccucauucacagcucc

SEQ ID NO: 414117 - RNA, 64 nt, Human
gcccgugucacugccucugucacccagcuauccucgcacucaaagccauccaaccucagcaggc

SEQ ID NO: 414118 - RNA, 64 nt, Human
aucccacugcuugccugcuugcccccugccaucucgcacucagcccugggugccugugaagccu

SEQ ID NO: 414119 - RNA, 64 nt, Human
acuacccuuaggucuacagcucucaugagucucccgcacucagccuuuagcaauucauuaaaaa

SEQ ID NO: 414120 - RNA, 64 nt, Human
uauccaccccuccccccacccuccccucacaccccgcacucaccccuuccacccaccucccccc

SEQ ID NO: 414121 - RNA, 64 nt, Human; identical to SEQ ID NO: 414069

SEQ ID NO: 414122 - RNA, 64 nt, Human; identical to SEQ ID NO: 414073

SEQ ID NO: 414123 - RNA, 64 nt, Human
cucccaggguguuucaaacuuagagaagaccaagggacaguauuuuuuaucaaaggaauacuau

SEQ ID NO: 414124 - RNA, 64 nt, Human
uuguaauuuauugaucuggaugcuuaagugucauggacaguaaaugaauuugaacuuuauguug

SEQ ID NO: 414125 - RNA, 64 nt, Human
uuguuuauauaucacuauaaaauccaguugaccuggacaguauuauauguacauaucuauucua

SEQ ID NO: 414126 - RNA, 64 nt, Human; identical to SEQ ID NO: 414074

SEQ ID NO: 414127 - RNA, 64 nt, Human; identical to SEQ ID NO: 414075

SEQ ID NO: 414128 - RNA, 64 nt, Human; identical to SEQ ID NO: 414076

SEQ ID NO: 414129 - RNA, 64 nt, Human; identical to SEQ ID NO: 414077

SEQ ID NO: 414130 - RNA, 64 nt, Human; identical to SEQ ID NO: 414078

SEQ ID NO: 414131 - RNA, 64 nt, Human; identical to SEQ ID NO: 414079

SEQ ID NO: 414132 - RNA, 64 nt, Human; identical to SEQ ID NO: 414080

SEQ ID NO: 414133 - RNA, 64 nt, Human; identical to SEQ ID NO: 414081

SEQ ID NO: 414134 - RNA, 64 nt, Human; identical to SEQ ID NO: 414082

SEQ ID NO: 414135 - RNA, 64 nt, Human; identical to SEQ ID NO: 414083

SEQ ID NO: 414136 - RNA, 64 nt, Human; identical to SEQ ID NO: 414084

SEQ ID NO: 414137 - RNA, 64 nt, Human; identical to SEQ ID NO: 414085

SEQ ID NO: 414138 - RNA, 64 nt, Human; identical to SEQ ID NO: 414086

SEQ ID NO: 414139 - RNA, 64 nt, Human; identical to SEQ ID NO: 414087

SEQ ID NO: 414140 - RNA, 64 nt, Human; identical to SEQ ID NO: 414091

SEQ ID NO: 414141 - RNA, 64 nt, Human
ucagguuuccaaucaacagcagugaguugggauuggacaguagaauuucaauguccagugagug

SEQ ID NO: 414142 - RNA, 64 nt, Human
gcaucauuccugggccagagucguguccaccaagggacaguagccagagcuccucuuccuuuac

SEQ ID NO: 414143 - RNA, 64 nt, Human
uugcuuuuaccaaaauaucaguaguaauauuuuuggacaguagcuaaugggucaguggguucuu

SEQ ID NO: 414144 - RNA, 64 nt, Human; identical to SEQ ID NO: 414092

SEQ ID NO: 414145 - RNA, 64 nt, Human; identical to SEQ ID NO: 414093

SEQ ID NO: 414146 - RNA, 64 nt, Human; identical to SEQ ID NO: 414094

SEQ ID NO: 414147 - RNA, 64 nt, Human; identical to SEQ ID NO: 414095

SEQ ID NO: 414148 - RNA, 64 nt, Human; identical to SEQ ID NO: 414096

SEQ ID NO: 414149 - RNA, 64 nt, Human; identical to SEQ ID NO: 414097

SEQ ID NO: 414150 - RNA, 64 nt, Human; identical to SEQ ID NO: 414098

SEQ ID NO: 414151 - RNA, 64 nt, Human; identical to SEQ ID NO: 414099

SEQ ID NO: 414152 - RNA, 64 nt, Human; identical to SEQ ID NO: 414100

SEQ ID NO: 414153 - RNA, 64 nt, Human; identical to SEQ ID NO: 414101

SEQ ID NO: 414154 - RNA, 64 nt, Human; identical to SEQ ID NO: 414102

SEQ ID NO: 414155 - RNA, 64 nt, Human; identical to SEQ ID NO: 414103

SEQ ID NO: 414156 - RNA, 64 nt, Human; identical to SEQ ID NO: 414104

SEQ ID NO: 414157 - RNA, 64 nt, Human; identical to SEQ ID NO: 414105

SEQ ID NO: 414158 - RNA, 64 nt, Human; identical to SEQ ID NO: 414110

SEQ ID NO: 414159 - RNA, 64 nt, Human
augaaguuuuuaaauugucaggaguugaucaugaggacaguagcauuaaauaaguauauggccg

SEQ ID NO: 414160 - RNA, 64 nt, Human
agcugcccuggggguucacuggaguugaggcaggggacaguagucuccccugccagccuaggau

SEQ ID NO: 414161 - RNA, 64 nt, Human
auucugucuugcugguguggauagaaaccaggcaggacaguagaucccuaugguuggaucucag

SEQ ID NO: 414162 - RNA, 64 nt, Human; identical to SEQ ID NO: 414111

SEQ ID NO: 414163 - RNA, 64 nt, Human; identical to SEQ ID NO: 414112

SEQ ID NO: 414164 - RNA, 64 nt, Human; identical to SEQ ID NO: 414113

SEQ ID NO: 414165 - RNA, 64 nt, Human; identical to SEQ ID NO: 414114

SEQ ID NO: 414166 - RNA, 64 nt, Human; identical to SEQ ID NO: 414115

SEQ ID NO: 414167 - RNA, 64 nt, Human; identical to SEQ ID NO: 414116

SEQ ID NO: 414168 - RNA, 64 nt, Human; identical to SEQ ID NO: 414117

SEQ ID NO: 414169 - RNA, 64 nt, Human; identical to SEQ ID NO: 414118

SEQ ID NO: 414170 - RNA, 64 nt, Human; identical to SEQ ID NO: 414119

SEQ ID NO: 414171 - RNA, 64 nt, Human; identical to SEQ ID NO: 414120

SEQ ID NO: 414172 - RNA, 64 nt, Human
ccaagggcaucaugcagcuggugggccaggcagagccggagagcgugcugcuggugcauggcga

SEQ ID NO: 414173 - RNA, 64 nt, Human
gagcugcugagggcggccggcgcccgcccggcgugccggagaggagaaagggcccgacugcccg

SEQ ID NO: 414174 - RNA, 64 nt, Human
cucuccugcaccucccgccugcguugugccuccugccggagagucugcuuccugagcuuuuccg

SEQ ID NO: 414175 - RNA, 64 nt, Human
ccuggggccgcuugugagucaggccagagcgagaggacaguaucuguggggcuggccccuuuuc

SEQ ID NO: 414176 - RNA, 64 nt, Human
uuccagaaagcaccccaggaugucagagaaauugggacaguaacauaucuuauguaagcugacc

SEQ ID NO: 414177 - RNA, 64 nt, Human
auggagccaaguguauggaaacccacaacaguauggacaguauauggcaaauggguggcaagua

SEQ ID NO: 414178 - RNA, 64 nt, Human
gggagcagcagaagccacggcagggaggaaaggagccggagaagccggagcagaaguccuggua

SEQ ID NO: 414179 - RNA, 64 nt, Human
ucgcacguguaggaggcugccgccgagggacucggccggagagcugaggggaggggggcguuuu

SEQ ID NO: 414180 - RNA, 64 nt, Human
cucucuaacaggaccaucacagcuucugaacugagccggagagagagaauggaauugcugaccc

SEQ ID NO: 414181 - RNA, 64 nt, Human
ccguccuguguccgcgcgcgcgggugccuuucccgccggagacucggccggugugcuucgugcu

SEQ ID NO: 414182 - RNA, 64 nt, Human
ucuuugaagacacaaacacucaccugggacguuggccggagaugucuuuuuauuuuugugcugu

SEQ ID NO: 414183 - RNA, 64 nt, Human
ugccgggugacgugcacggucucccucugcccuagccggagaugcaugaugacaggcaguguga

SEQ ID NO: 414184 - RNA, 64 nt, Human
uccacaagcagggcaucgugcaccuggaccucaagccggagaacaucaugugugucaacaagac

SEQ ID NO: 414185 - RNA, 64 nt, Human
cauggaagagacagucuacagagagcuuuaagaggccggagaaaggaaaagacauuaucagggc

SEQ ID NO: 414186 - RNA, 64 nt, Human
cagacguggaccucaacuucugauuccagaacacgccggagauugcugcugcuuucugagcccg

SEQ ID NO: 414187 - RNA, 64 nt, Human
gcccucccgcucagccucagaagcagacucugaagccggagagcugcggaagcccacucaggag

SEQ ID NO: 414188 - RNA, 64 nt, Human
ggcucagccuaaccucuccuggccaaucccccccgccggagagcaggacacuagggaggacccc

SEQ ID NO: 414189 - RNA, 62 nt, Human
uggaauuagaguauuuguaacuguguucuuuagccggagauccauuuuuuauauuucaagua

SEQ ID NO: 414190 - RNA, 64 nt, Human
ccccuugaggcccagacucagccugcccacuggugccggagacggaguggagugggccuggauc

SEQ ID NO: 414191 - RNA, 64 nt, Human
auggggcucuuuuagcccacugaugcuuacuuaggccggagagcaggggacacggugcuagguu

SEQ ID NO: 414192 - RNA, 64 nt, Human
cccacacaccagucuuuuuggggguuucagaguggccggagaaaccgacugaagggacugacca

SEQ ID NO: 414193 - RNA, 64 nt, Human
acuagcaggcggagccccccacccccucagcagggccggagaccuagguaaggaccgcgccgcu

SEQ ID NO: 414194 - RNA, 64 nt, Human
aagacgccaagggcauugcagaaucccucucaguggacaguaugcacucagcugaccacucucu

SEQ ID NO: 414195 - RNA, 64 nt, Human
uuucauugaccuugucucucauacuucaagaaaaggacaguacauugcuacauuacccuagaaa

SEQ ID NO: 414196 - RNA, 64 nt, Human
acuucuaccgagagccauggcucaacaccaaacuggacaguagacaucaugaucccuccaguua

SEQ ID NO: 414197 - RNA, 62 nt, Human
guguuccacuuacuucuugagguacaaaaacugccggagauucuggguaagccuagauuggu

SEQ ID NO: 414198 - RNA, 64 nt, Human
ugcugaguccaggaggugaugagcaaguguacaaaagaaaaaagggaagggggagaggggcugg

SEQ ID NO: 414199 - RNA, 64 nt, Human
cuaugcaauauuacucagcuuuuuuuauuguaaaaagaaaaaucaacucacuguucagugcuga

SEQ ID NO: 414200 - RNA, 64 nt, Human
aacagagcaagacuccaucucaaaaaaagaaagaaagaaaaaagaaaguacaaguuuauaaagu

SEQ ID NO: 414201 - RNA, 64 nt, Human
ugggggaggguaagaaaagcaguuugcacuuaaaaagaaaaaaaaaaaacggguggugugucuc

SEQ ID NO: 414202 - RNA, 64 nt, Human
caccgcugccagcccagaguuacccucuaaagauaagaaaaaggcuauuaauaucauacuaagu

SEQ ID NO: 414203 - RNA, 64 nt, Human
ugaguucuaauaauccauguucaguuuguagggaaagaaaaaauaauuuuuccuucuacccacu

SEQ ID NO: 414204 - RNA, 64 nt, Human
aagaacaguaaauuuuuagagaaacaacaaaacaaagaaaaagagcuuugagucuguaggggca

SEQ ID NO: 414205 - RNA, 64 nt, Human
agaaaaagaaucauucucaaccugauaaucuguuaagaaaaaucccauaugaacaaucugguca

SEQ ID NO: 414206 - RNA, 64 nt, Human
auuuaaauuuuuuguaacaguuuuguuuucuaauaagaaaaauccaugcuuuuuguagcugguu

SEQ ID NO: 414207 - RNA, 64 nt, Human
aaaaacccugggcugaaguuggcauuucaguuaaaagaaaaaaagaaacuagucccagauuuga

SEQ ID NO: 414208 - RNA, 64 nt, Human
uuaguaugaacuaaaugaagguuaaaacaugcuuaagaaaaaugcacugauuucugcauuaugu

SEQ ID NO: 414209 - RNA, 64 nt, Human
aaaugaagagauucuggaaaugcaucaauaaccuaagaaaaagcgacauaaaaauauacuuaug

SEQ ID NO: 414210 - RNA, 64 nt, Human
aaaaaucucauuaaucuaaaucaaaauagcuuuaaagaaaaaugcauacacuuccucagaucau

SEQ ID NO: 414211 - RNA, 64 nt, Human
cccaggcaacacagcaagaccccaucucuauaaaaagaaaaaauaaagaaacugcagcgccuua

SEQ ID NO: 414212 - RNA, 64 nt, Human
aaaaaaaaaauuuuaagugacagugccauaguuuggacaguaccuuucaaugauuaauuuuaau

SEQ ID NO: 414213 - RNA, 64 nt, Human
ucuaaauaagcuuuucauuaacuuuuuauuuuaaggacaguaucuuuucaugaaagaguauuug

SEQ ID NO: 414214 - RNA, 64 nt, Human
uuacuuuuguaacagucagugguuuguucuaacaggacaguagaacacuugcaagguaaguaaa

SEQ ID NO: 414215 - RNA, 64 nt, Human
acucugccuugcccucgucccucguccuucggcagccggagaggcugugggugggccgagggug

SEQ ID NO: 414216 - RNA, 64 nt, Human
ugucugaauagaaagagcacaguaaguaugcauugccggagaaaacguccuugaagcugcuugu

SEQ ID NO: 414217 - RNA, 64 nt, Human
ucacucuggggcaagcaucacugggaagggcauagccggagaccuuucuccuagugacugguag

SEQ ID NO: 414218 - RNA, 64 nt, Human
cuccccgcccccugaaacaugugccccugccaaggccggagacccacagcccugaaacgagaag

SEQ ID NO: 414219 - RNA, 62 nt, Human
gcgccugucgggucaacuagccucaccgaggugccggagagggagcgcuggacaacuagaau

SEQ ID NO: 414220 - RNA, 64 nt, Human
guaagccuugcagcuugagcugaaagaugccagagccggagaugucugcuggcagcaggcaggg

SEQ ID NO: 414221 - RNA, 64 nt, Human
acaagcgucuuacaaaacacuucucuaucaugcagccggagagcuggcugggagcccuuuuguu

SEQ ID NO: 414222 - RNA, 64 nt, Human
acuuaccccauggcugcacaguuggugggguccugccggagaggaagagacacucagaccagag

SEQ ID NO: 414223 - RNA, 64 nt, Human
acugcaguggauacaaggaagggccuuucucggggccggagaagagaccaagagaccaggcccg

SEQ ID NO: 414224 - RNA, 64 nt, Human
caguuuucuaauuuugacuuuaaauuuuucauccgccggagacacugcucccauuugugggggg

SEQ ID NO: 414225 - RNA, 64 nt, Human
aagcgaaagagggggcucacagaauugaagggaugccggagaacaagaagcugaagguaggaag

SEQ ID NO: 414226 - RNA, 64 nt, Human
uaucugaccaacuggcagugucuucuggcugcuggccggagacagcucuugcccuuuccaaagu

SEQ ID NO: 414227 - RNA, 64 nt, Human
gacucugagggguuccgccuccuccgcuuggggggccggagagauggugggggcagcuccucuu

SEQ ID NO: 414228 - RNA, 64 nt, Human
gccuccgggggacaggcccagggcgggaaauggagccggagaagcuugagccucucucuuggac

SEQ ID NO: 414229 - RNA, 64 nt, Human
acauaccuguaauccaagcugcccaggagcugaggccggagaaucgcuugaaccugggaggugg

SEQ ID NO: 414230 - RNA, 64 nt, Human
gacugcugggguugcugggugagcagagugggaggccggagacugcccuugaccggcaaaugcc

SEQ ID NO: 414231 - RNA, 64 nt, Human
gaaacugaaacauuuuguccacaacuucacgggacguggccagacuggguuugcguuccaaccu

SEQ ID NO: 414232 - RNA, 64 nt, Human
caaauacagaagaaccccuucuaccaagcucccucguggccacgaggccacgaacccggccagc

SEQ ID NO: 414233 - RNA, 64 nt, Human
caagcgcacugggcugccgucuguccccagcucccguggccacacagcuaucuggaggcuuugc

SEQ ID NO: 414234 - RNA, 64 nt, Human
cuggcagaagaguccucuggggaggaccccaagggccggagacccaaagaucaugauauuccaa

SEQ ID NO: 414235 - RNA, 64 nt, Human
ggggugcugugaggcuugcccaggagcaagugaggccggagaggaguucaggaacccuucucca

SEQ ID NO: 414236 - RNA, 64 nt, Human
ccgggcccugcaggggcaggcccaggcagcgucagccggagagcuucuccccgaccagcccagc

SEQ ID NO: 414237 - RNA, 64 nt, Human
ggaagguguugcauccccaggggcugccgcagaggccggagaccuccuggacuaguucggcgag

SEQ ID NO: 414238 - RNA, 64 nt, Human
agaaggucuccucugugcuccauccacacaggaugccggagagacagccccuugugcugugagc

SEQ ID NO: 414239 - RNA, 64 nt, Human
cuaucaacugaaagagcagccgccgccgcccccagccggagaccccuuucguuugaguccugcu

SEQ ID NO: 414240 - RNA, 64 nt, Human
aucgcucaacaggacaccucuccgcagaaggcuugccggagacgccguggggagggccauuuga

SEQ ID NO: 414241 - RNA, 64 nt, Human
cgugcccugcuggggaaggccucacccagcgaaggccggagaagcgguugggcccuggcacaca

SEQ ID NO: 414242 - RNA, 64 nt, Human
uuuuauguuucuuugcaacggccucagaaguuuggccggagagggggcagccagagcggcagcc

SEQ ID NO: 414243 - RNA, 64 nt, Human
ggcauucccagagguggggaagagagccugcccggccggagaacaucugccuugcugcaccuga

SEQ ID NO: 414244 - RNA, 64 nt, Human
caugccuguaaucccagcuacucaggaggcugaggccggagaaucgcuugagcccgagaggugg

SEQ ID NO: 414245 - RNA, 64 nt, Human
gggggacgccccacggggcccugcggagccugaagccggagagcaggcggcucuucuggaacgc

SEQ ID NO: 414246 - RNA, 64 nt, Human
cuuccugccucucugcuccgacacccggcaagcagccggagacaaaacgccuuaaagcccccgg

SEQ ID NO: 414247 - RNA, 64 nt, Human
gcccugcugcccuggccugucacuccccaccccugccggagaccucccuucccugggccccuuc

SEQ ID NO: 414248 - RNA, 64 nt, Human
cgucucgggcagagccaccugggccccgggugcagccggagaccccgccgagccccuccuccca

SEQ ID NO: 414249 - RNA, 64 nt, Human
uuuguccugccucuuguuucugugccccggcgaggccggagagcuggugacuuuggggacaggg

SEQ ID NO: 414250 - RNA, 64 nt, Human
aagguguuuccagggguccgagggccguggccugcguggccauccccuggagagaggagccgcu

SEQ ID NO: 414251 - RNA, 51 nt, Human
accuccagaacaccagguagccguggccaccacagccagacugaacguuug

SEQ ID NO: 414252 - RNA, 64 nt, Human
cugagggcagacgcugcuaccggagugaccuggacguggccagaucuucucgcaggucacaaga

SEQ ID NO: 414253 - RNA, 62 nt, Human
ccucuguccccagguuguagcugccaucagaugccggagacucgcccuucaauaaaaaaucu

SEQ ID NO: 414254 - RNA, 64 nt, Human
ccugauccuggggucuucugagacuccaccaggagccggagagggcagggagccaaauccagcu

SEQ ID NO: 414255 - RNA, 64 nt, Human
cguccugcgcccccugguucuggaggaaccgcaagccggagaggauuuggucccucaacuauca

SEQ ID NO: 414256 - RNA, 64 nt, Human
ccuguccuggcaguagcuucuggguucugaaggugccggagagagugaggcugggcaggggucu

SEQ ID NO: 414257 - RNA, 64 nt, Human
ccaccuuggcccuaaaacagccaccaggaaagcagccggagagccggacagcaggcagccuguc

SEQ ID NO: 414258 - RNA, 64 nt, Human
agaccuggcagagccugguguggggucugagacggccggagaaccucccaggcagggcucugug

SEQ ID NO: 414259 - RNA, 64 nt, Human
ucggagguacccaggccccacggccgagccucuggccggagaucggccgcccacggggggccac

SEQ ID NO: 414260 - RNA, 64 nt, Human
ggggcaacacgguuagcggggagagcacgggguagccggagaagggccucuggagcaggucugg

SEQ ID NO: 414261 - RNA, 64 nt, Human
caaucggagcgcgaggacguggucuggagguaccgccggagaucugggaccacucagggcauca

SEQ ID NO: 414262 - RNA, 64 nt, Human
gguauucccugacaaacauugcuuaggaaagagggccggagaauaagaagccagcaccucauca

SEQ ID NO: 414263 - RNA, 64 nt, Human
agcagcagccagggaugggcccuggagguucccggccggagagugccucuccccucugccaucc

SEQ ID NO: 414264 - RNA, 64 nt, Human
cgcacgccagcgccgccuccuagacucgagcagagccggagagagagacgagagggugggaggu

SEQ ID NO: 414265 - RNA, 64 nt, Human
uuguuuuuguuuguuucuugaaaaugagagaagagccggagagaugauuuuuauuaauuuuuuu

SEQ ID NO: 414266 - RNA, 64 nt, Human
agucuccaccucggccccagcaaagcgcuaagcagccggagagacagccagggcggcuuccuga

SEQ ID NO: 414267 - RNA, 64 nt, Human
uagauuccagacccugcugccagagagaccugcugccggagagaaggggaggaggacuccagcu

SEQ ID NO: 414268 - RNA, 64 nt, Human
agacccaggaaucucaucugagaacccacucucugccggagaaccccauggugacacauuuuca

SEQ ID NO: 414269 - RNA, 64 nt, Human
aucaccgacaucacuguugccugcaaggacaccacguggccauuuuccuucaacugagggcuca

SEQ ID NO: 414270 - RNA, 64 nt, Human
acuuucccauaggcuuaauauuacauuuggacaucguggccaacucuaucaagaccacaaauac

SEQ ID NO: 414271 - RNA, 64 nt, Human
acgguccccccacagucagccugugcaaaggccccguggccagggguggaggagaauauguggg

SEQ ID NO: 414272 - RNA, 64 nt, Human
gcaucuccacgcgcgcccgugggagguggguccggccggagaggccucccgcggacgccgucuc

SEQ ID NO: 414273 - RNA, 64 nt, Human
cugccuccaaguagccaccgccuggaugcggauggccggagaggaccggcggcucggaggaagc

SEQ ID NO: 414274 - RNA, 64 nt, Human
cuacaacaugugagcgcagcacaccggcccaggugccggagaugaaugagccccagcaguccaa

SEQ ID NO: 414275 - RNA, 64 nt, Human
ggccagugaaccugccagccuuccaggacaggcggccggagagcugccccugaaggacaguccu

SEQ ID NO: 414276 - RNA, 64 nt, Human
aaauaaaucacauuuuaucuuauauuuagggaaagccggagagcaacaacaaaaaauguuuaag

SEQ ID NO: 414277 - RNA, 54 nt, Human
gcguggugacagcaccguagggcagccggagaaugcagcccaagcagggccugg

SEQ ID NO: 414278 - RNA, 64 nt, Human
gcucucuaccucugcccaccguuguggcccugcagccggagaucugaggugcucuggucugugg

SEQ ID NO: 414279 - RNA, 64 nt, Human
gagggggccacgugugagagagaagaaaaugguggccggagaugggagggcccaaggaaccucc

SEQ ID NO: 414280 - RNA, 64 nt, Human
gcaugcaucccccaauaagaagagaugagacucggccggagagaagaaaaggcccuuaacuuuc

SEQ ID NO: 414281 - RNA, 64 nt, Human
uaauuuguacgggacagggugcgggcaauggccacguggccaaggcccugcaggaacgcgccga

SEQ ID NO: 414282 - RNA, 64 nt, Human
guccucccaccaccgcggccucggaggccugggccguggccagauaggaguuugcaucauccac

SEQ ID NO: 414283 - RNA, 64 nt, Human
ugcgcgugcgcacacacacaaacacacacacacuggacaguagaugggccgacacacacuuggc

SEQ ID NO: 414284 - RNA, 64 nt, Human
uccagcccugaggauggcaucuagugugcccgugcguggccauacccugccucccucucuggcc

SEQ ID NO: 414285 - RNA, 64 nt, Human
gugugagagagaccucauucucugcaggcuccagcguggccacagcuaaggcccauccauuucc

SEQ ID NO: 414286 - RNA, 64 nt, Human
acccacccuguccagaguagagggcaccuguccacguggccagggcccaugcugccacccucga

SEQ ID NO: 414287 - RNA, 64 nt, Human
uaucacuuccaugacauaagugcuauugcagagccguggccacccaggaacuccugacugcuuu

SEQ ID NO: 414288 - RNA, 64 nt, Human
ugauucagacuuucacaccauuaauggggaaaagcguggccacaaaaacagaugcuaggaagcu

SEQ ID NO: 414289 - RNA, 64 nt, Human
cugcacugccugguccagaagggguggugcuguccguggccagcaccccggggcccgggagggg

SEQ ID NO: 414290 - RNA, 64 nt, Human
ugugcagucacuccucucauuucuaaaauagggacguggccaggcacgguggcucaugccugua

SEQ ID NO: 414291 - RNA, 64 nt, Human
gcccaggagauagaagaccuggacuccagcccaccguggccacuggagaccucaggccaguugu

SEQ ID NO: 414292 - RNA, 64 nt, Human
caccccccgcccuaaggggccuggccuggggugacguggccaggcagacugucugccccacucc

SEQ ID NO: 414293 - RNA, 64 nt, Human
gcucugcuuugugcuguggcuuagccggaggggacguggccaagggugagguggccaaaaccag

SEQ ID NO: 414294 - RNA, 64 nt, Human
cucuuuaccuaauggucucuaccuaauggaccuccguggccaaaaaguaccauuaaaaccagaa

SEQ ID NO: 414295 - RNA, 64 nt, Human
gucucugcugucaagauagauucgagagaaagcacguggccauguaugcuuuaaccuuaaacug

SEQ ID NO: 414296 - RNA, 64 nt, Human
caggacacacuucuugccuucacuuucccacuuccguggccaccuccaugcagaagcccuaagc

SEQ ID NO: 414297 - RNA, 64 nt, Human
aaaacuaccuuguucgguugauacuuaguaacuccguggccaguugaagcgcuggauguuuccu

SEQ ID NO: 414298 - RNA, 64 nt, Human
cugacacacggcugcaugaccagucccacccccccguggccaccaauggcuaugacaucauugg

SEQ ID NO: 414299 - RNA, 64 nt, Human
ugccuugcuuauccuaagcugugguugcagaaaccguggccauuuauauaagcuauaacaucaa

SEQ ID NO: 414300 - RNA, 64 nt, Human
gaaguauagcuagagaaugcgaaauucaccaacacguggccaagagaaacuuccuagggggcua

SEQ ID NO: 414301 - RNA, 64 nt, Human
caauuuggggcaguuauucugcuuuuuguaaagccguggccaauugucuccuguaaugacuguu

SEQ ID NO: 414302 - RNA, 64 nt, Human
gucuuguguugucuucgucugugccguuugucuucguggccauccugcagaugagcaccguguc

SEQ ID NO: 414303 - RNA, 64 nt, Human
ugcauuaaugccacaguggggauggaggccaggccguggccagagcagauacguaggcccauga

SEQ ID NO: 414304 - RNA, 64 nt, Human
caagugaccaacgcaggugagcuggucauugucucguggccagagggcccagcagccacugugg

SEQ ID NO: 414305 - RNA, 64 nt, Human
acccuccaaccaggccuugccuucugagagcccccguggccaagcccaggucacagaucuuccc

SEQ ID NO: 414306 - RNA, 61 nt, Human
uggucaucucagcacgcuagcaccccaguugcguggccagccgggcccaggcaggagcagg

SEQ ID NO: 414307 - RNA, 64 nt, Human
agacagacucucagaugaaagaucugacaagcaccguggccagucacagggagagacuugaugu

SEQ ID NO: 414308 - RNA, 64 nt, Human
ccgggcugccccgccucagccccagcugcccuggcguggccauguggcuuugcccagccugcug

SEQ ID NO: 414309 - RNA, 64 nt, Human
uuggaacucaaauauuucaagggcuccauagccacguggccagcagcuaccacacuggucagcg

SEQ ID NO: 414310 - RNA, 64 nt, Human
ccaggucugagcagagcagcuggugaaucccagacguggccaccuguggcuugcagcccuucuc

SEQ ID NO: 414311 - RNA, 64 nt, Human
cauucaucauccacccagacucgggcaaccucaccguggccaggaguguccccagccccaugac

SEQ ID NO: 414312 - RNA, 64 nt, Human
ggauggggcugcuggggacugccccccuucccgccguggccaggcgcucugugugcugugugug

SEQ ID NO: 414313 - RNA, 64 nt, Human
ugccgcuuauuuugaagcuggugcccucccucgccguggccacaugcuggaagccugaggccuc

SEQ ID NO: 414314 - RNA, 64 nt, Human
cccuuccuccugauggagugugcagacagccaugcguggccacgggggcagugugaggaccucc

SEQ ID NO: 414315 - RNA, 64 nt, Human
gugggaagucccgcgaaacccggugcaucuggcacguggccaggagccaugacaggggcgcuug

SEQ ID NO: 414316 - RNA, 64 nt, Human
cuccaccccgaugcuccuuagugaugcucugaggcguggccacgaucucccucccaggugguau

SEQ ID NO: 414317 - RNA, 64 nt, Human
guaggcaugcccacugcuggacacguccccgacucguggccacauggagaaacaggcaaaccag

SEQ ID NO: 414318 - RNA, 64 nt, Human
gccaaaacuccaaacaaguuccccgguggaaugacguggccauuggagggcugcaggucguccu

SEQ ID NO: 414319 - RNA, 64 nt, Human
gguggaucaccugaggucaggaguucgagacaagcguggccaauauggcaaagcccagucucua

SEQ ID NO: 414320 - RNA, 64 nt, Human
uagguagcaagagagaggcugggaaaaguguggacguggccagagcgagagaguagcggaggaa

SEQ ID NO: 414321 - RNA, 64 nt, Human
ggacagacgagacaacagcacacaggcagccagccguggccagaggcucgaggggcucagggcc

SEQ ID NO: 414322 - RNA, 64 nt, Human
aggcagggagagggcucacagagucuccucuguacguggccauggccagacaccccagucccuu

SEQ ID NO: 414323 - RNA, 64 nt, Human
cucuuuauuuauccuauuucugggggaggauguacguggccauguaugaagccaaauauuaggc

SEQ ID NO: 414324 - RNA, 64 nt, Human
gugccccgggagucgaccccuucuacaccuaucccguggccauccgcugugacugcggagccug

SEQ ID NO: 414325 - RNA, 64 nt, Human
acuucuccugcucuugagccagcugugcuuugcccguggccagaagcucagcagcggcuccugg

SEQ ID NO: 414326 - RNA, 64 nt, Human
aggggugcccccuccucucccaucccccugcccucguggccagcccggcugguuuuguaagaug

SEQ ID NO: 414327 - RNA, 64 nt, Human
aggucuagaaaaccagcuugcgaauaacaguccccguggccaucccugugagggugacguuagc

SEQ ID NO: 414328 - RNA, 64 nt, Human
cucagugcuguggcccgguggggacacaguugcucguggccacucaguggagcugggccugcag

SEQ ID NO: 414329 - RNA, 64 nt, Human
ugccaacuggucagcuguccuucacgcacauauccguggccaccugagaccugcuccacgaccc

SEQ ID NO: 414330 - RNA, 60 nt, Human
ucgccaggaucaucacguagcucccgccagcguggccagagcugucgcaccgugagcguc

SEQ ID NO: 414331 - RNA, 64 nt, Human
cagccgcaaggggaaaugaagaaaacugagcccucguggccaccugugucacccuugugccuua

SEQ ID NO: 414332 - RNA, 64 nt, Human
ugccuagagcucagcccacaggacugcuucaggccguggccacagguagcagccgcaaggggaa

SEQ ID NO: 414333 - RNA, 64 nt, Human
cgcccgagagggaaggagccggccugcugggcagcguggccacaaggggcggcacuccucaggc

SEQ ID NO: 414334 - RNA, 64 nt, Human
ccgcugcauucccagagaucaagcagcccggugccguggccagugaacucagaggugcuggugg

SEQ ID NO: 414335 - RNA, 64 nt, Human
acucucuuggauuauuuauguguugugguuuggccguggccaucagggugggccacucuccccu

SEQ ID NO: 414336 - RNA, 64 nt, Human
acgcauccugaugcugccuggaagcuuauuuucccguggccaggacgcauuucucugaguggaa

SEQ ID NO: 414337 - RNA, 64 nt, Human
ggagaacagccaacaagaggcccuugaaucucuacguggccacugaacugcugggcccgggaga

SEQ ID NO: 414338 - RNA, 64 nt, Human
ggcggaucagcugaggucaggaguuggagaccagcguggccaacauggugaaaccccgucucua

SEQ ID NO: 414339 - RNA, 64 nt, Human
gcuccgguucucuccuggggacucacagaagcaucguggccaagcaggugucggacugcucaga

SEQ ID NO: 414340 - RNA, 64 nt, Human
gcccggcucuccugcgguguggcugguggccugccguggccaagagcaucuucuggguggaugg

SEQ ID NO: 414341 - RNA, 64 nt, Human
cagcaccugcuccuggggccacgaccucccuggccguggccacccguccuccgcagcaggcccc

SEQ ID NO: 414342 - RNA, 64 nt, Human
aacuggauggugccuuuaguuggugcggaugccccguggccaggucaagucagagcaccuggac

SEQ ID NO: 414343 - RNA, 64 nt, Human
ggaagcuggcaggcauacagcacccucuacccuccguggccauggcaacguccagggcccagaa

SEQ ID NO: 414344 - RNA, 64 nt, Human
ccuggcccuccccccaccccucugcugcaggaggcguggccaccaccagaugcucccugucugg

SEQ ID NO: 414345 - RNA, 64 nt, Human
ggguccugcuugugugcucugcguuccucuguggcguggccaggccggggccuggcucuuaccc

SEQ ID NO: 414346 - RNA, 64 nt, Human
ucugcagauacaggcuuggcgcucgggguggucucguggccaacucuucaugccccugccguug

SEQ ID NO: 414347 - RNA, 64 nt, Human
aggugccuaaaucccaggccccuuucucagggggcguggccacaccacacacugcgccagugac

SEQ ID NO: 414348 - RNA, 64 nt, Human
gcuucccgcaggcaucugagcucugugccggggccguggccaugggaagauguuccacgcugcc

SEQ ID NO: 414349 - RNA, 64 nt, Human
gccccccgacuuucccccgccuccccgccccccacguggccacuuuucucuggauuuuagcugu

SEQ ID NO: 414350 - RNA, 64 nt, Human
ucaggcuuggcccacucccccagacaccuggacacguggccacaaaucugggacaaggggcccc

SEQ ID NO: 414351 - RNA, 64 nt, Human
aauucauacuggagaaaacuaccagugugaacaacguggccaagcuucgacaaugcucacaccc

SEQ ID NO: 414352 - RNA, 64 nt, Human
gcugacgucacauaucaccguggugauggcgucacguggccauguagacgucacgaagagauau

SEQ ID NO: 414353 - RNA, 64 nt, Human
ccgccucggccuccugaagugcugggauuacaggcguggccacugcgcccaggcacauuccucc

SEQ ID NO: 414354 - RNA, 64 nt, Human
cuggacucgccugcucgcuuccccuucccaggcccguggccaacccagcaguccuucccucagc

SEQ ID NO: 414355 - RNA, 64 nt, Human
uuaacuguguagagguguguggcuggacauuuuucguggccacagcgaguugaguuguguugaa

SEQ ID NO: 414356 - RNA, 64 nt, Human
uucucccucccaauuggcuccagcuuccugggggcguggccaagcccuccucuucccagaauug

SEQ ID NO: 414357 - RNA, 64 nt, Human
uguaaaggaagccagaguugacaguacaaagggucguggccagcccugcagcuucagcaccugc

SEQ ID NO: 414358 - RNA, 64 nt, Human
caggggccuggucuccagcaccugcccgaguggccguggccaggauggggugcgcauuccgugu

SEQ ID NO: 414359 - RNA, 64 nt, Human
ccucggcccugaugcaggagggugcgauagcggacguggccaggcaggaggggccggguucagg

SEQ ID NO: 414360 - RNA, 64 nt, Human
gggcgcugcuggugcggcugcugcaggcgcugcgcguggccaggaugcccgggcuggagcggag

SEQ ID NO: 414361 - RNA, 64 nt, Human
ugauuccaagaguaggugcugccuagcagcccuucguggccacucuuuacucaggagggccuug

SEQ ID NO: 414362 - RNA, 64 nt, Human
gugcggcgcugccucgggugucugcgugaaugagcguggccaaggaccagugccaccuuauggc

SEQ ID NO: 414363 - RNA, 64 nt, Human
guggggagugcugugucuccugggucugcccacccguggccaagcaggaacuccaggugcaggg

SEQ ID NO: 414364 - RNA, 61 nt, Human
ccucucaauugcagagcugaugucaguaaaucguggccauagcugagugaacuggugaaau

SEQ ID NO: 414365 - RNA, 64 nt, Human
ccaaggugcacugagaagcaaucaacgggucggucguggccaguccuggggaggucugaguggu

SEQ ID NO: 414366 - RNA, 64 nt, Human
ggguucuuuccccaaaggaacuuaaaaagacaagcguggccaggcacaguggcucacaccugua

SEQ ID NO: 414367 - RNA, 64 nt, Human
acagacaaacacgcuugggcucggcaggagcugccguggccacccccgcugcccagugucugcc

SEQ ID NO: 414368 - RNA, 64 nt, Human
ccacgagagaaggacagucguggcagccgggggccguggccacauuaccucagcgggagggagc

SEQ ID NO: 414369 - RNA, 64 nt, Human
gcacgcuccgcagcccagcccagccgggagaccacguggccauugcggucuccugaccuuggcc

SEQ ID NO: 414370 - RNA, 64 nt, Human
cccugcgcaccacagccucucugcuccucacguccguggccacagaagcagagcgacagagcga

SEQ ID NO: 414371 - RNA, 64 nt, Human
acauugagccaguggacucugugucugaagggggcguggccacaccuccuagaccacgcccacc

SEQ ID NO: 414372 - RNA, 64 nt, Human
ccuuuuggggccaagaugugugugcacccggggucguggccauucacucccaggcaggggugag

SEQ ID NO: 414373 - RNA, 64 nt, Human
gcaaucacuguguccacaugagcgaaccccagcacguggccaguaucaucagcuccuucuuaca

SEQ ID NO: 414374 - RNA, 64 nt, Human
aggggcaagagugcgagcuggcugacaauaagaacguggccaccugcccagcuucacaccuccc

SEQ ID NO: 414375 - RNA, 64 nt, Human
ucacccucauuuccuccucgcaguagcccugcaccguggccagaaacccauccacaggcaggca

SEQ ID NO: 414376 - RNA, 64 nt, Human
ugucacagaguuucauugaguccagcugcagccacguggccaucuggagcuggugcuauaggug

SEQ ID NO: 414377 - RNA, 64 nt, Human
agaagcuuguguuuuuguuuguaauggggagaagcguggccaggcagguggcacguggcaucgc

SEQ ID NO: 414378 - RNA, 64 nt, Human
gccugugucagcuggauguguuuacguggagaggcguggccacuuuuuaggucaccugaagcag

SEQ ID NO: 414379 - RNA, 64 nt, Human
caaaaaguguccauaaagaggcugcuggagagugcguggccauagggagccgacaugcccggga

SEQ ID NO: 414380 - RNA, 64 nt, Human
auuauuuuuuaagccucaagcccuguuaaauggucguggccaauuaugucauagaaacuguaug

SEQ ID NO: 414381 - RNA, 64 nt, Human
cuaauuuauuggauucccuauucguagccaucuccguggccaaugugacuaccgugccagcagc

SEQ ID NO: 414382 - RNA, 64 nt, Human
uguucaguaaacaaacugaagccaaaaaugaagccguggccaagcgugacccagagauggggug

SEQ ID NO: 414383 - RNA, 64 nt, Human
gacaaguguucuauuuauuucuuguauuguuuggaagaaaaaaugaugauagagucccaaaaag

SEQ ID NO: 414384 - RNA, 64 nt, Human
guauauauuaaaacagagauaugugcaugaaaucaagaaaaaagaaaugaacaaaagcaaagca

SEQ ID NO: 414385 - RNA, 64 nt, Human
ccagccugggcgacagagcgagagucugucucaaaagaaaaaaaaaagcaccgccuccaaaugc

SEQ ID NO: 414386 - RNA, 64 nt, Human
uuuagaguauuauuuuuuuguaagggggugggugggacaguaaauuuguauugucucgauguac

SEQ ID NO: 414387 - RNA, 64 nt, Human
agccucuggguguggagcugggaucuucaacuggggacaguacaguaaagaacaucacagcauc

SEQ ID NO: 414388 - RNA, 64 nt, Human
cuggggaagccgagggacagccauaacacccccgggacaguaggucugggcggcaccacuggga

SEQ ID NO: 414389 - RNA, 64 nt, Human
cagccugagcaacagagugagacccugucucuuaaagaaaaaaaaagucagacugcugggacug

SEQ ID NO: 414390 - RNA, 64 nt, Human
uauuuuuguuuguuuauacaaauaucugauuugcaagaaaaagugcaugggagggguuuuagug

SEQ ID NO: 414391 - RNA, 64 nt, Human
uaauugcugagggcuuauagggaagugauuuaaaaagaaaaaacaaacaacaacaaaaaaaacu

SEQ ID NO: 414392 - RNA, 64 nt, Human
ucauuuggcuguuggauuuuaagcaaaagcauccaagaaaaacaaggccuguucaaaaacaaga

SEQ ID NO: 414393 - RNA, 64 nt, Human
cagauauguccaaggaaguugagcuauagggaguaagaaaaagcaucaugauaacgucuaguca

SEQ ID NO: 414394 - RNA, 64 nt, Human
cggacuuggauacaucauuuguaacauuguaggaaagaaaaaagucuugguugugaaaaacgau

SEQ ID NO: 414395 - RNA, 64 nt, Human
caugggacaaaaaagaacgauccuccacuugaccaagaaaaaagugauucucccagaagcacaa

SEQ ID NO: 414396 - RNA, 64 nt, Human
aagacauaggacuuaacuggaaaaugaaaaaaaaaagaaaaagaaaaaacuaaacaaaaaaucc

SEQ ID NO: 414397 - RNA, 64 nt, Human
uaggacuuaacuggaaaaugaaaaaaaaaagaaaaagaaaaaacuaaacaaaaaaucccucuag

SEQ ID NO: 414398 - RNA, 64 nt, Human
ucuuucugcaguuguguguauguguguuugugugaagaaaaacagacucuguccagguagaaau

SEQ ID NO: 414399 - RNA, 64 nt, Human
acuuuuauuaaaucuuccuuagacauuagugagaaagaaaaagaucgcuauuucagucucucag

SEQ ID NO: 414400 - RNA, 64 nt, Human
cuguucucuagugguuaacaugguauucuuuaagaagaaaaaacaaagccaaagaaaacucauu

SEQ ID NO: 414401 - RNA, 64 nt, Human
gccaccauauuuagaacuaguuaccuuauuaaaaaagaaaaaacagucuguuggcuucucaguc

SEQ ID NO: 414402 - RNA, 64 nt, Human
guuuuaaaguugaaaaaccuucucuucagaaaagaagaaaaauucagaaaucaguagaucuugg

SEQ ID NO: 414403 - RNA, 64 nt, Human
agccuuaaucagaaaaggacuagauuuguuuaagaagaaaaaugaaaccagacccagaucaaua

SEQ ID NO: 414404 - RNA, 64 nt, Human
accuuugggaugauaggguuguuagugacccacaggacaguauagauguuuguggauguagcac

SEQ ID NO: 414405 - RNA, 64 nt, Human
gauugucuuaauuucuaucuuguuccaaggccagggacaguaauaagaauggaaaagagauaug

SEQ ID NO: 414406 - RNA, 64 nt, Human
aauuuuuggcugaaugucacagauguuguauguaggacaguagaaacugagguaaauaguaauu

SEQ ID NO: 414407 - RNA, 64 nt, Human
cuuggcagcacaacuaucuuugcaaaaaaaaguaaagaaaaaguaaaugaugguuuaaaaaaua

SEQ ID NO: 414408 - RNA, 64 nt, Human
uuccagcucuugauguuuuuaaacuuuuuuuuagaagaaaaauuaaguacagaaaagcccagau

SEQ ID NO: 414409 - RNA, 64 nt, Human
cacaaaaauaaaaaacaaaaaaaacaaaaaacccaagaaaaaaaaaaagagucagcccuuggcu

SEQ ID NO: 414410 - RNA, 64 nt, Human
uucacuguuguacacagucuguuuucuauuuguuaagaaaaacuacagcaucauugcauaauuc

SEQ ID NO: 414411 - RNA, 64 nt, Human
gcacucauguuaggaaggucaaaaaaaaggaaaaaagaaaaauaauaaaaaauaauaaaaaucc

SEQ ID NO: 414412 - RNA, 64 nt, Human
gggcugcaugauguuugcccaaaauuuauuuuauaagaaaaacuuuuuugguuaaaaaaaagaa

SEQ ID NO: 414413 - RNA, 64 nt, Human
cuuuguguguguguguuuagaauauaacagacauaagaaaaaauuaccuaaaugaagacuguac

SEQ ID NO: 414414 - RNA, 64 nt, Human
auuuaaagacaucuauuaucugcuuugugcuuaaaagaaaaauucaaccuuuuuuuuuuuuuuu

SEQ ID NO: 414415 - RNA, 64 nt, Human
ucugugaaaucgucugauggucuguguggaagaaaagaaaaaucugucugccgccuauuuccca

SEQ ID NO: 414416 - RNA, 64 nt, Human
ggcgacagagcgagacugucucaaaaaaacaaaaaagaaaaaaaaacuggggccuguguagcca

SEQ ID NO: 414417 - RNA, 64 nt, Human
gacucuaaauuauugggguaaaaaacagccuugcaagaaaaaggggagcuauuuuugcuuuuua

SEQ ID NO: 414418 - RNA, 64 nt, Human
uaaacauaauucuucacgauaguaguuuucuauuaagaaaaauguccugcugggcacaguggca

SEQ ID NO: 414419 - RNA, 64 nt, Human
uaagacaguucagugcauauauaguagaagccuuaagaaaaaagaaaaugagcaagcaaauauu

SEQ ID NO: 414420 - RNA, 64 nt, Human
aucuaccuauccugagucuaucuuaaaggaaaaaaagaaaaaaaccuuaucucuugcccuuauu

SEQ ID NO: 414421 - RNA, 64 nt, Human
uuuugagcuaaugauagauagaaaugcccacucaaagaaaaauaaacagagacaaauguuaaaa

SEQ ID NO: 414422 - RNA, 64 nt, Human
guuccccuaggagcuuugagcauuucucugcaggggacaguaguaauauaauucucucuucucc

SEQ ID NO: 414423 - RNA, 63 nt, Human
cuguggucccagcuacucaggaggcugaggcaggaggaucacuugagcacaggaguuugaggc

SEQ ID NO: 414424 - RNA, 63 nt, Human
ggcuggcgcccguaaucccagcuacuaaggcuggaggaucacuucagcccaggaguuuaaggc

SEQ ID NO: 414425 - RNA, 64 nt, Human
ugauuucacugguccaucuauauuuaaaacgugcaagaaaaaaauaaaauacucugcucuagca

SEQ ID NO: 414426 - RNA, 64 nt, Human
uuuuuuuuuuuuuuuuauagccuacaaugguuggaagaaaaaauacuuggaaacaaagaaaguc

SEQ ID NO: 414427 - RNA, 59 nt, Human
uuuuaaguaccaccauuugaaccuuaacgaagaaaaaaaucuucaaguagaccuagaag

SEQ ID NO: 414428 - RNA, 64 nt, Human
auacaaaagccagcaauaauucuucaagauccaaaagaaaaaaauauacuaccucagauuuuca

SEQ ID NO: 414429 - RNA, 64 nt, Human
augguagauacaguuuaaaagugcuuacccaggcaagaaaaaacacagcuaggcuaagucaaca

SEQ ID NO: 414430 - RNA, 64 nt, Human
aacauuuauaaacaaaagaaacauuuauaaacuaaagaaaaacuaaaagaaugacagaacaauc

SEQ ID NO: 414431 - RNA, 64 nt, Human
guguuuuuguccuaauguugcuacucccauggcaaagaaaaaaaaaagaaugaaaaaaagaaaa

SEQ ID NO: 414432 - RNA, 64 nt, Human
cucccauggcaaagaaaaaaaaaagaaugaaaaaaagaaaaaaauuuggaaaaaaaaaucaggc

SEQ ID NO: 414433 - RNA, 64 nt, Human
uagaaaauucccccuacuucuaauuugcugaaugaagaaaaaaaaaaaucuuuuauuugugaua

SEQ ID NO: 414434 - RNA, 64 nt, Human
ucuaguaugguguauuuaaauaauaaaaacuuaaaagaaaaaauauuuaaugguguuuggguuu

SEQ ID NO: 414435 - RNA, 64 nt, Human
uucugcuuccaguguaccacuaugguuuauaguaaagaaaaauuaagaaagugaacaguugcaa

SEQ ID NO: 414436 - RNA, 64 nt, Human
auuauucaaaugccuagaaauccauaguuuggaaaagaaaaaucaugucaucuucuauuuguac

SEQ ID NO: 414437 - RNA, 64 nt, Human
aauggaaauugucggucauauuucuagaacuuuaaagaaaaaagaauguuauauuaguuuucua

SEQ ID NO: 414438 - RNA, 64 nt, Human
ucuuuccuugccauuucuauggauuuuauaaugaaagaaaaaggcauuggagacugaaggcaga

SEQ ID NO: 414439 - RNA, 64 nt, Human
ugccgcuuuuuauaacuuuauauuauuuuuuuuuaagaaaaaaagcucuuuaaaauaccucaag

SEQ ID NO: 414440 - RNA, 63 nt, Human
cuauagucccagcuacucaggaagcugagacaagaggaucaauugagcccaggaguucaaagc

SEQ ID NO: 414441 - RNA, 63 nt, Human; identical to SEQ ID NO: 169963

SEQ ID NO: 414442 - RNA, 63 nt, Human
gcuuucuagcagaggucaccugaagugugugaggaggaucaucauuuuccucauccccccucu

SEQ ID NO: 414443 - RNA, 64 nt, Human
uuugugcuguguacacaagauuucuggaaaaguaaagaaaaacccuuuuuauggcucacacagc

SEQ ID NO: 414444 - RNA, 64 nt, Human
acaugcucauauguuuauaaacuguguuuuguagaagaaaaagaaucauaacaauacaaacaca

SEQ ID NO: 414445 - RNA, 64 nt, Human
uaagcaaaugaauuaaacagcuauguaaaucauaaagaaaaacuaaaaaugaaccaaagugaaa

SEQ ID NO: 414446 - RNA, 64 nt, Human
gcugauagaaggaguugaaaucugaugacaaaaaaagaaaaauuacuuuuuguuuguuuauaaa

SEQ ID NO: 414447 - RNA, 64 nt, Human
aaaaguucuauauuuguggcuuuauuaaaaaaaaaagaaaaauauauagagagauauauaucua

SEQ ID NO: 414448 - RNA, 64 nt, Human
uuaucuugccaccuuagccuuaagaaugaauaugaagaaaaauacacagccaccucuguccagg

SEQ ID NO: 414449 - RNA, 64 nt, Human
guagauuugacuuguuuauaauucugcacuuuagaagaaaaacaguguuaaucuguaguugaaa

SEQ ID NO: 414450 - RNA, 64 nt, Human
ucaguguuuccccuuugugcacuuguagaaaaaaaagaaaaaccuucuagagcugauuugaugg

SEQ ID NO: 414451 - RNA, 64 nt, Human
uggauuguggauguggacuuuuuuguacauaaauaagaaaaaccaaaauacuccaaagaugacu

SEQ ID NO: 414452 - RNA, 64 nt, Human
ggaaugaguugugaccuguuuacugucucuuuagaagaaaaacuccacuggaaaccauucacca

SEQ ID NO: 414453 - RNA, 64 nt, Human
gccccacucggggaccagaaguggaaccaaaaacaagaaaaaacugugagagauugugucugcc

SEQ ID NO: 414454 - RNA, 64 nt, Human
cuagggaagauaauauuaaggaagacaaugugaaaagaaaaaugagccuggcaagaauguguuu

SEQ ID NO: 414455 - RNA, 64 nt, Human
gggugacagagcaagugagacccugucucaaaaaaagaaaaagaaaaagaaaaaauauuuuccc

SEQ ID NO: 414456 - RNA, 64 nt, Human
cagagcaagugagacccugucucaaaaaaagaaaaagaaaaagaaaaaauauuuucccuauuag

SEQ ID NO: 414457 - RNA, 64 nt, Human
aagugagacccugucucaaaaaaagaaaaagaaaaagaaaaaauauuuucccuauuagagaaga

SEQ ID NO: 414458 - RNA, 63 nt, Human
cuguggucccagcugcucgggaggcugaggugggaggaucacuugagccuuggaggucaaggc

SEQ ID NO: 414459 - RNA, 63 nt, Human
uugaaauccucuguuggcuuuggguuguauaaggaggaucaaaacaacagaggaaaugcugac

SEQ ID NO: 414460 - RNA, 63 nt, Human
cuuguguccucaaagggccacgaggccugaaaggaggaucagaaugcuuugggauuaauuggg

SEQ ID NO: 414461 - RNA, 64 nt, Human
ggaacaagagaugacuuugaggauaaaaggaccaaagaaaaagcuuuacuuagaugauugauug

SEQ ID NO: 414462 - RNA, 64 nt, Human
ugcccugcacgucaugggagggggcuugaagccaaagaaaaauaacccuuugguuuuuuucuuc

SEQ ID NO: 414463 - RNA, 64 nt, Human
ugggucaaaagaauuagauguacagugaagggaaaagaaaaaaaaugggcgaagagagggugga

SEQ ID NO: 414464 - RNA, 64 nt, Human
aagguguagauauaaugagguagaaguagaaaggaagaaaaacucaaagaauucuuaaaaggau

SEQ ID NO: 414465 - RNA, 64 nt, Human
uuuuaggcucugagacuaaaugagaggaaaagaaaagaaaaaaaaaaugauugucuaaccaauu

SEQ ID NO: 414466 - RNA, 64 nt, Human
agcaacaaaauauuuauucuacuguaaaugacaaaagaaaaagaaaaauugagccuugggacgu

SEQ ID NO: 414467 - RNA, 64 nt, Human
aaaauauuuauucuacuguaaaugacaaaagaaaaagaaaaauugagccuugggacgugcccau

SEQ ID NO: 414468 - RNA, 64 nt, Human
auuuaugcaguuguacaauuuuauuuuuuucugcaagaaaaaguguaauguaugaaauaaacca

SEQ ID NO: 414469 - RNA, 64 nt, Human
cuuuuuacugaaaguaagugacuuaaaaggauggaagaaaaacuacaugguuggaguguuuuua

SEQ ID NO: 414470 - RNA, 64 nt, Human
aauuacagugugaacaagagaaaaacaggaauagaagaaaaaaguugcagguugaauuaucuau

SEQ ID NO: 414471 - RNA, 64 nt, Human
ugggcuuuauuaucuugucagucacuaccuccuaaagaaaaaaaaaaaggcuagaagaaaaaac

SEQ ID NO: 414472 - RNA, 64 nt, Human
gucacuaccuccuaaagaaaaaaaaaaaggcuagaagaaaaaacauuacauucauguucuaauu

SEQ ID NO: 414473 - RNA, 64 nt, Human
ugaacuuauccuuccucccacaaaaaaagaaaagaagaaaaaauuccaagcagcaaaacuuacu

SEQ ID NO: 414474 - RNA, 64 nt, Human
uauucauagacaaauuuuuuucaauauauuuugcaagaaaaaucuuugaauaagacuaacugca

SEQ ID NO: 414475 - RNA, 64 nt, Human
aucaauuuuaacuacauaaaaauguuuauaggacaagaaaaaccccaccauaacccaaggcaaa

SEQ ID NO: 414476 - RNA, 63 nt, Human
cuauaaucccaacacuuugggaggccgaggugggaggaucacuugagcacaggaguuugagac

SEQ ID NO: 414477 - RNA, 63 nt, Human
auguaucauuuugucaucaauggcagcauuccagaggaucaugaagacugggcuuccaauggg

SEQ ID NO: 414478 - RNA, 63 nt, Human
agaccccucccguuaggcuucaccuccaacacugaggaucaaauuucaacaugagauuuggag

SEQ ID NO: 414479 - RNA, 64 nt, Human
augcaauugaaagaaaggagccaaggaagagauuaagaaaaagaaccagcugaaccaugaaaca

SEQ ID NO: 414480 - RNA, 64 nt, Human
uuggaauguaugcuaauugaacaugcaauuggggaagaaaaaauguagaaugauuuuugcuauu

SEQ ID NO: 414481 - RNA, 64 nt, Human
guaggaaggaaaaaauaagagauagcagaggaaaaagaaaaacauuuccucuuauaacuucuga

SEQ ID NO: 414482 - RNA, 62 nt, Human
aaaggggcaucugcuuauaagaagugagagagaagaaaaaucaugucccaaguucugagaau

SEQ ID NO: 414483 - RNA, 64 nt, Human
gauuuguuuuuuacaucuccuuuuuccuuccuugaagaaaaauucuuggcugucccaaggauuc

SEQ ID NO: 414484 - RNA, 64 nt, Human
agaacaguuaaucccuaaggucuugacaaaacagaagaaaaacaagccuccucguccuagucuu

SEQ ID NO: 414485 - RNA, 64 nt, Human
uaauaaaaugcaacacuuggcauuuuuauguuuuaagaaaaacaguauuuuauuuauaauaaaa

SEQ ID NO: 414486 - RNA, 64 nt, Human
cugagugugcacgaaauguucgcagugcaacaaaaagaaaaauccaucaggaacucuccguccc

SEQ ID NO: 414487 - RNA, 64 nt, Human
gguaucuaaaguucucuccuuccugccuccccuaaagaaaaaggauauuagauugcacacuaua

SEQ ID NO: 414488 - RNA, 64 nt, Human
gagaacuugguucauugacauauucugcugaagaaagaaaaauuaaauugguaguaaaauauag

SEQ ID NO: 414489 - RNA, 64 nt, Human
auuauaauaggacuugccuauuuucauuuuuaagaagaaaaacaccacucauuuuauaaaauau

SEQ ID NO: 414490 - RNA, 64 nt, Human
ccucucccucccauugcauggcucacaccuguaaaagaaaaaagaaucaaauugaauauaucuu

SEQ ID NO: 414491 - RNA, 64 nt, Human
agagcuccuaaaaaugagaaauauuuauugaaauaagaaaaaagcccucagacauguugaauau

SEQ ID NO: 414492 - RNA, 64 nt, Human
aagaaaugccuugauucauuuuagaucucuggggaagaaaaaggaaauaaaaaccaucucaaua

SEQ ID NO: 414493 - RNA, 64 nt, Human
uuaaaauuguauguuacuuauuuccagaaucucgaagaaaaaagaaaaaagagugguauuauua

SEQ ID NO: 414494 - RNA, 63 nt, Human
cuguagucccagcauuccgggaggcugaggugggaggaucacuugagcccagggagguugggg

SEQ ID NO: 414495 - RNA, 63 nt, Human
cuguggucccaguuacucaggaggcugaggcaggaggaucacuugagcccaggagguugaggc

SEQ ID NO: 414496 - RNA, 63 nt, Human
uagaaggaagagaggcaaaggaaacuggguggggaggaucaauuagagaggaggcaccuggga

SEQ ID NO: 414497 - RNA, 64 nt, Human
uguauguuacuuauuuccagaaucucgaagaaaaaagaaaaaagagugguauuauuaugggcaa

SEQ ID NO: 414498 - RNA, 64 nt, Human
aucuaaaagcuuuugcuuuuccuuuguuuuuaugaagaaaaaauacauuuuauauuagaagugu

SEQ ID NO: 414499 - RNA, 64 nt, Human
gauugggggaguggggagggggaagaagaacaggaagaaaaaaaguacucugaacugcuccaag

SEQ ID NO: 414500 - RNA, 64 nt, Human
gauugaacucacagauggauaccaacacggucagaagaaaaacggacagaacgguucuuguaua

SEQ ID NO: 414501 - RNA, 64 nt, Human
agguuuuggccaggaggacgugaaguccuuggggaagaaaaacaagggaggagggcauuccacc

SEQ ID NO: 414502 - RNA, 64 nt, Human
aagaaaggaggaaaagaaaccaaaaguuuuuuuuaagaaaaaaaauccuucaagggagcugcuu

SEQ ID NO: 414503 - RNA, 64 nt, Human
agcuugggcgacagagugagacuccgucucaaaaaagaaaaaaaaaagaugcuccucugagguc

SEQ ID NO: 414504 - RNA, 64 nt, Human
uucuuucugcaaacagccaucuuuauacuuagggaagaaaaauuguuggguucuagacuuuuuu

SEQ ID NO: 414505 - RNA, 64 nt, Human
aauguucuuaggcaucaaaauccaagguagcuguaagaaaaauacuggagcuaacaaugaagaa

SEQ ID NO: 414506 - RNA, 64 nt, Human
ugcagcagucagguacauaguuaggugaacccaaaagaaaaacucuugaaaacaagagauuucu

SEQ ID NO: 414507 - RNA, 64 nt, Human
uggucuugggggcacugugcucacuucuagagagaagaaaaaggcuggguuuggacuucaugcc

SEQ ID NO: 414508 - RNA, 64 nt, Human
cauguaaaacaagaaaaguugaagaagauaugugaagaaaaauguauuuuuccuaaauagaaau

SEQ ID NO: 414509 - RNA, 64 nt, Human
ugacugaaguuuacuuggaaagaaagggcuugcuaagaaaaaagggaguaaaaaugaugauagg

SEQ ID NO: 414510 - RNA, 64 nt, Human
gcaauguuuuaaaaaaaauaagucaucagauuuuaagaaaaaagugaugauuucuuauugauau

SEQ ID NO: 414511 - RNA, 64 nt, Human
cugacccacugcuaacuguagcaacaaaauuuaaaagaaaaaaaacauacuuuaucuggcuauu

SEQ ID NO: 414512 - RNA, 63 nt, Human
cugcaggcccagcuacacgggaggccaaggcaggaggaucacuugaaaucaagaguucaaguc

SEQ ID NO: 414513 - RNA, 63 nt, Human
cuauaaucccagcacuuugggaggcagaggagggaggaucacuugaacccaggaauucaaggc

SEQ ID NO: 414514 - RNA, 63 nt, Human
uguuuuagggacaugauuuuccugaaauugggugaggaucagugaaauaauuacucuauuacu

SEQ ID NO: 414515 - RNA, 64 nt, Human
cccuaaacuguuuaaauaaagagcucuauuuuuaaagaaaaaagguacaauugaauggaaaagc

SEQ ID NO: 414516 - RNA, 63 nt, Human
cccagcgugccucucacuuuccagaaagggugagaggaucauuagagaguucauuagagagua

SEQ ID NO: 414517 - RNA, 63 nt, Human
cucagguccccaugguuguccauugaauggagugaggaucaaggugggaaugacuggguggug

SEQ ID NO: 414518 - RNA, 63 nt, Human
gucauuagucucacaaacacacuuuggacugaagaggaucauuucuuuuuguucgugagguca

SEQ ID NO: 414519 - RNA, 63 nt, Human
cugugaagggagaaagggagagaaaacucuucugaggaucauuugucuugguaguauaguaaa

SEQ ID NO: 414520 - RNA, 63 nt, Human
cuguagucacagguacuugggaggcugaggugggaggaucacuugagcccaggagauagaggc

SEQ ID NO: 414521 - RNA, 63 nt, Human
uuauauuugcacaaguauguaaaauaucguguugaggaucauucuuuguuggaaacacugcuc

SEQ ID NO: 414522 - RNA, 63 nt, Human
uuaagggaguuacaucuuuauucugcuaaagaagaggaucauugauuucuguacagucagaac

SEQ ID NO: 414523 - RNA, 63 nt, Human
agaauuacucauuaaccagcauaaauacugccugaggaucaaaacucagaggcaaagagggag

SEQ ID NO: 414524 - RNA, 63 nt, Human
aguauuugcagaagggcaaagcugcuuaagagagaggaucagggugaaguuuggcacacaggg

SEQ ID NO: 414525 - RNA, 63 nt, Human
cuguaaucccagcuacuugggaggcugaggugggaggaucacuugaacucaggaguuugagag

SEQ ID NO: 414526 - RNA, 63 nt, Human
guaguucuucacuaucuguuccagggcuagucggaggaucauaagcaagcucagaccugcccc

SEQ ID NO: 414527 - RNA, 63 nt, Human
aucccaugagggaagcacgacagggcugauggugaggaucagagcaguucuaaggugacucgu

SEQ ID NO: 414528 - RNA, 63 nt, Human
uguaaucccaacacuuuugggagguccaggcaggaggaucacuugggcccaggaggucaagcc

SEQ ID NO: 414529 - RNA, 63 nt, Human
uuugaugcauggcuauaaucccagccgaggugggaggaucacuugaguccagguucaagacua

SEQ ID NO: 414530 - RNA, 63 nt, Human
agagcagaagguagauccuaaaaagcauggugagaggaucaaauguuuuuauaucaacauccu

SEQ ID NO: 414531 - RNA, 63 nt, Human
gauggacagcuguucuuuggccauaugguauaagaggaucauucuugucacuacuuaaguuag

SEQ ID NO: 414532 - RNA, 63 nt, Human
cuauagucccaacuacuagggaggcugaggugggaggaucacuugagccugggggacugaggc

SEQ ID NO: 414533 - RNA, 63 nt, Human
gcagaggaagauauuucuaaucggucuugcccagaggaucacagugcugagaccccccaccac

SEQ ID NO: 414534 - RNA, 63 nt, Human
cugucaucccagcacuuugggaggccgagacgggaggaucaguugaggucaggaguuugagac

SEQ ID NO: 414535 - RNA, 63 nt, Human
uaaaauauuuaaauagaagugaaaagguccucugaggaucagaucaugcaugcgccauuuuuu

SEQ ID NO: 414536 - RNA, 64 nt, Human
cacgugagguuuuguuuagagggauccacuacucaagaaaaaguuagcaaaccacuccuuuugu

SEQ ID NO: 414537 - RNA, 64 nt, Human; identical to SEQ ID NO: 414392

SEQ ID NO: 414538 - RNA, 64 nt, Human
aaauguucuuuauacagccuaguuaauguuuaaaaagaaaaaaauagcuugguuuuauuuguca

SEQ ID NO: 414539 - RNA, 64 nt, Human
uugguuuaacaaaaaaaaaaagcuuuaaaaaaaaaagaaaaaaaggaaaagguuuuuagcucau

SEQ ID NO: 414540 - RNA, 64 nt, Human
auuuuuauuauacaaaguuuguacaguaccaaaaaagaaaaaaaaaaagguguaaauuuuuuuu

SEQ ID NO: 414541 - RNA, 64 nt, Human
aauacauaaaauaugcucauaaaaggccuuuaugaagaaaaacacuuaagcugagaccuggaua

SEQ ID NO: 414542 - RNA, 64 nt, Human
cccaaugggagcccacggaacuaaguagggucccaagaaaaaaaacgggagcuauuucacagag

SEQ ID NO: 414543 - RNA, 64 nt, Human
uauuugauguacccaagucuuacguuucccaauaaagaaaaaaaaucuccauaaaacugccucu

SEQ ID NO: 414544 - RNA, 64 nt, Human
caggauuauuuaacuuaccuguauaucaaaagugaagaaaaaguuaguucauaaguaaaggcac

SEQ ID NO: 414545 - RNA, 64 nt, Human
uuggaaguuuaggagccacgugagugaaaguuuuaagaaaaaugaaauuuaugucauacuuauu

SEQ ID NO: 414546 - RNA, 64 nt, Human
ccacuggucacagguagacauguggagucaacucaagaaaaagcugagugaacagcaugauuua

SEQ ID NO: 414547 - RNA, 64 nt, Human
guuacaaaucuauauuuuuauugaaguuuaaauaaagaaaaaauuuacaagagccucuuugauc

SEQ ID NO: 414548 - RNA, 64 nt, Human
gugucauguuguaaacauuucuuucaauaaacuaaagaaaaauuauuaaaggaacacauaccuu

SEQ ID NO: 414549 - RNA, 64 nt, Human
acacacuaaauagcaucuuugaauacaaagaaccaagaaaaaggaaugaagacucgcaauuuca

SEQ ID NO: 414550 - RNA, 64 nt, Human
cacucugggcaacagaaugagauccugucucuuaaagaaaaaaaauaaacucaagaaugauuuu

SEQ ID NO: 414551 - RNA, 63 nt, Human
ccuuggguccagcuacucaggaggccaaggugggaggaucacuugagcccaggaguuuuagac

SEQ ID NO: 414552 - RNA, 63 nt, Human
cuguaauuccagcacuuugggaggccgaggagggaggaucaccugaggucaggaguuugagac

SEQ ID NO: 414553 - RNA, 63 nt, Human
ucuguaaucccagcaauuuggaggcugaggugggaggaucauuugagcccaggaguucgagac

SEQ ID NO: 414554 - RNA, 64 nt, Human
cuuacagcuaggaaagcucuaguucugggggugaaagaaaaauauuaguuuaccugagcacuua

SEQ ID NO: 414555 - RNA, 64 nt, Human
uacugacuuagaugauguauuaaauaccaagauaaagaaaaaugcaccuaaaaucuaauuagaa

SEQ ID NO: 414556 - RNA, 64 nt, Human
gucuacccacccaagagaaaagacuguuaacuggaagaaaaaauauauauauaaaauuuuaugu

SEQ ID NO: 414557 - RNA, 64 nt, Human
cguuccccugccaguuuuauauuuuugguuuuacaagaaaaaacauuaaaaacuggaaaggaga

SEQ ID NO: 414558 - RNA, 64 nt, Human
uugaagagagaccgucgggggcugaggggcaacgaagaaaaaaaauaacacagagagacagacu

SEQ ID NO: 414559 - RNA, 64 nt, Human
guuuugaaaagaacaaaacaucaaaaugaauagaaagaaaaauuggaaggcguccuuuugguaa

SEQ ID NO: 414560 - RNA, 64 nt, Human
cuaaauuugaaucaacuauuaauuuuauaacuuaaagaaaaauaauuguuaaugcaacugcuua

SEQ ID NO: 414561 - RNA, 64 nt, Human
auccauucugaauuuucaaagcauaaaaaugucaaagaaaaauugagauaaacauuuuguucac

SEQ ID NO: 414562 - RNA, 64 nt, Human
uuucacauucuuggcuuaaucauuuucauuccuaaagaaaaauaucuuggccuaaaccucaguu

SEQ ID NO: 414563 - RNA, 64 nt, Human
gagaacgaauguuagccacaugcccaaguuaacaaagaaaaaauguucucaagguuguccuuuu

SEQ ID NO: 414564 - RNA, 64 nt, Human
ccuuguuaucagagaaauauuaguucaauacugaaagaaaaauauuauaccucuugguaucuag

SEQ ID NO: 414565 - RNA, 64 nt, Human
uguuuuauauuguuugauacucaguaccuguuuuaagaaaaaacaacaaggaaguaaaaccaaa

SEQ ID NO: 414566 - RNA, 64 nt, Human
cuuccuaaaacacuauuaagcuuauuguacuuuuaagaaaaauugccuuacguacauuccuuuu

SEQ ID NO: 414567 - RNA, 64 nt, Human
uaaacaugaaggguauggcuuuauuuuuauagauaagaaaaaugaagccaagacaggguaaaua

SEQ ID NO: 414568 - RNA, 64 nt, Human
auuugaauuucuuuggugcuguagaaaacaaaaaaagaaaaauauauauucauaaaaaauaugg

SEQ ID NO: 414569 - RNA, 63 nt, Human
cuauaaucccagugcuuugggaagccgaagcaggaggaucacuggaggccaagaguuggagag

SEQ ID NO: 414570 - RNA, 63 nt, Human
ucuaccuuaguagauacaaguagagaauauggagaggaucauuacauugaaaaguaaauguuu

SEQ ID NO: 414571 - RNA, 63 nt, Human
cuguagucccagcuacuagggaggcugagccaggaggaucacuugagcccgggagguugaggc

SEQ ID NO: 414572 - RNA, 64 nt, Human
cacgggguaggagaaguuucuuuaaagacguaaaaagaaaaaaaccauaggcugcucugccugu

SEQ ID NO: 414573 - RNA, 64 nt, Human
agaacugccuauaguaaccaaaauuggauucaugaagaaaaaaauauauuuuaggaaaacaugu

SEQ ID NO: 414574 - RNA, 64 nt, Human
auuauacauggcuacuuuacugugucuguagcuaaagaaaaauuauuuuacaaaaauuacuuca

SEQ ID NO: 414575 - RNA, 64 nt, Human
aauuuagcaaauuaaguuauuuuccuaaaaaaaaaagaaaaaaagaauucagaacuacuuuccu

SEQ ID NO: 414576 - RNA, 64 nt, Human
cuccaugcauucugauaacggcagcuuuccuaaaaagaaaaaguuauaguuuugggacauuuaa

SEQ ID NO: 414577 - RNA, 64 nt, Human
ccuggguaacacagcaagacucuaucucaaaaaaaagaaaaaaaagaaauacauagaguucagu

SEQ ID NO: 414578 - RNA, 64 nt, Human
gaugagagcuuuaugaguucacggaauuuauuuuaagaaaaaaaaauauacauaugagaagaag

SEQ ID NO: 414579 - RNA, 64 nt, Human
guuuccauuauggcagguuuagagaauccuuaaaaagaaaaauugacuugcuugccuaaaacua

SEQ ID NO: 414580 - RNA, 64 nt, Human
cuguguuugguauuuuucugacaaaauuaagaaaaagaaaaaaaauuauuugugggcaaauguu

SEQ ID NO: 414581 - RNA, 64 nt, Human
aaaucacuguguuugguauuuuucugacaaaauuaagaaaaagaaaaaaaauuauuugugggca

SEQ ID NO: 414582 - RNA, 64 nt, Human
uacuuuuaaagaguuggucuuuucugucuaaauaaagaaaaaaguuuaaaagcaucaaauaaga

SEQ ID NO: 414583 - RNA, 64 nt, Human
gugaaauguuaagugucuggaaauuuuuuuuucuaagaaaaacuauuaaaguacuuccuaguag

SEQ ID NO: 414584 - RNA, 64 nt, Human
cuacuuuucuagucacagauguuuucaaauuucuaagaaaaagaaaaugaggcucaagaggcug

SEQ ID NO: 414585 - RNA, 64 nt, Human
ucacuauauuuguuguaaagagguuuacuauuaaaagaaaaagaauacacguuucugauacuuc

SEQ ID NO: 414586 - RNA, 64 nt, Human
ugaagugcucugauuucuaaauauugugaagguuaagaaaaacauaaauuuaggucuaugggcu

SEQ ID NO: 414587 - RNA, 63 nt, Human
ccuauaaucgagcacuuugggaggccaagacaggaggaucacuugaggccaggagucugagac

SEQ ID NO: 414588 - RNA, 63 nt, Human
ggcuagggggcuggugccgccucauaggcagacgaggaucaucgcugggggaccuuucccgug

SEQ ID NO: 414589 - RNA, 63 nt, Human
gcccggcuccucccagaaccagucccagccugggaggaucaaggccuggaucccgggccguua

SEQ ID NO: 414590 - RNA, 64 nt, Human
cagagagcaaaccaaucagucccucaggaaagggaagaaaaagaagagguggcaccaugaagag

SEQ ID NO: 414591 - RNA, 64 nt, Human
ucaacugcagucagagagcaagccccccaaaaaaaagaaaaagaaaaggaggcagaaagaggag

SEQ ID NO: 414592 - RNA, 64 nt, Human
aagaaggacagcagcaagcauaggcucaggauuaaagaaaaaaaucugcucacagucuguucug

SEQ ID NO: 414593 - RNA, 64 nt, Human
aauuaagaaaaaauaaaacuaccuacgaaauacuaagaaaaauuuguauacuaauauuaagaaa

SEQ ID NO: 414594 - RNA, 64 nt, Human
augugugggucuuguuuggauccugacucaaauuaagaaaaaauaaaacuaccuacgaaauacu

SEQ ID NO: 414595 - RNA, 64 nt, Human
uuugucacauguaucacccccaaaaaaagagaaaaagaaaaauagaagacauauaaauuaaaug

SEQ ID NO: 414596 - RNA, 64 nt, Human
agaagagagggaggaagaaagggagagagaagaaaagaaaaaugaagaaaaguaauuagaauau

SEQ ID NO: 414597 - RNA, 64 nt, Human
agaggaaugucaaaaauacauuuuacuuuauucaaagaaaaauauauugguuacugggaaaagg

SEQ ID NO: 414598 - RNA, 64 nt, Human
cuaacagaauugaguuuucuauuaaggauccaaaaagaaaaacaaaaugcuaaugaagccauca

SEQ ID NO: 414599 - RNA, 64 nt, Human
caaucacaccccugccuuuuuuuuuuuuuuuuuaaagaaaaagacaaaagaaaguggaaguggu

SEQ ID NO: 414600 - RNA, 64 nt, Human
ucuccauucccacugcuucacuugccuagucuugaagaaaaaaaacaaaaaacaaaaaaaaacc

SEQ ID NO: 414601 - RNA, 64 nt, Human
caaguuggcugucuaugagcauuuagagauuuagaagaaaaauuuaguuuguuuaacccuugua

SEQ ID NO: 414602 - RNA, 64 nt, Human
aacuuaacugagauccagcaaacagguucuguuuaagaaaaauaauuuauacuaaauuuaguaa

SEQ ID NO: 414603 - RNA, 57 nt, Human
ccguggacaaucauuucuaacaugucaaagaaaaaagauuuuaauaagcacuauguc

SEQ ID NO: 414604 - RNA, 64 nt, Human
gauugccuugagccuacuaggcaccuuugugagaaagaaaaaauagaugccucuucuucaagau

SEQ ID NO: 414605 - RNA, 63 nt, Human
auguaaucccagcacuuugggaagccaaggagggaggaucacuugaacucaggaauucgagac

SEQ ID NO: 414606 - RNA, 63 nt, Human
gaacauugaccauuagcugauacaugcagacaagaggaucaggaaggaugagucugaucugga

SEQ ID NO: 414607 - RNA, 63 nt, Human
uacaaaccccugaaggaaagugacccuuuaagagaggaucaucuuuuuuuauauuuauuuuca

SEQ ID NO: 414608 - RNA, 64 nt, Human
auauucaaauguucuauuaaaaaaacugaguaugaagaaaaacacuuuacuacugcagaaggaa

SEQ ID NO: 414609 - RNA, 64 nt, Human
acuuuuuuucuaauuuacugaucuuacuacuacaaagaaaaaaaaacccaaccaaucugcaauu

SEQ ID NO: 414610 - RNA, 64 nt, Human
aacugcaaaucagaaagaaugauuugcagaaagaaagaaaaacuaugguguaauuuaaacucug

SEQ ID NO: 414611 - RNA, 64 nt, Human
cucagcuuugccuucuugcuuuuucauaucuguaaagaaaaaaauuacauaucaguuguccuuu

SEQ ID NO: 414612 - RNA, 64 nt, Human
guuugaggguuugccuucuaaagucugcaacuucaagaaaaaaaaucgacacuguggauugacu

SEQ ID NO: 414613 - RNA, 64 nt, Human
uauauuaauuucacauauaaagguagauuuuucaaagaaaaauuugguaggcgguaguuuagaa

SEQ ID NO: 414614 - RNA, 64 nt, Human
auaauuauaacugaaagguuuaaauauacuaccuaagaaaaaaguacuucugugacauauacaa

SEQ ID NO: 414615 - RNA, 64 nt, Human
cguaaagaagcagcaguccugccccaguucuccuaagaaaaauccgcugugggcagagaacgau

SEQ ID NO: 414616 - RNA, 64 nt, Human
gggcauuaaauuauacaaacugaaaauguguuacaagaaaaauaugagaguuuuaacuagaugu

SEQ ID NO: 414617 - RNA, 64 nt, Human
cagagccaccaacuaaauguacaucacaguuuucaagaaaaaaaaaggugugugagugccaccu

SEQ ID NO: 414618 - RNA, 64 nt, Human
uuaugggaucauuuuuccaggacucuuugaagaaaagaaaaaacaacuaaaaaaauuuuugaca

SEQ ID NO: 414619 - RNA, 64 nt, Human
uuuaggcacccucuaccuggcagcucuuaaaacuaagaaaaaauaugauauacacacacauuau

SEQ ID NO: 414620 - RNA, 64 nt, Human
uucccaaguggugaggugagauuguggcuggaggaagaaaaaggauggcaugaaagaaugaccc

SEQ ID NO: 414621 - RNA, 64 nt, Human
guuccuucuuuuuaccuuuuuaaaaaucuguuagaagaaaaaaagcagcagacgaaagagaaaa

SEQ ID NO: 414622 - RNA, 64 nt, Human
cucaaguuagaaaacaguagguccugagaaccauaagaaaaaugacuggugugauguugaguaa

SEQ ID NO: 414623 - RNA, 63 nt, Human
cuauaaucccagcacuuugggaagccgggguaggaggaucaccagaggccagcagguccacac

SEQ ID NO: 414624 - RNA, 63 nt, Human
aaaauuagccaggcaugcgaaacgcugaggugggaggaucagaugagcuugggagguugaggc

SEQ ID NO: 414625 - RNA, 63 nt, Human
cuguagucccagcuacuugggaggcugaggcaggaggaucacuuaagcccagaaggcagaggu

SEQ ID NO: 414626 - RNA, 64 nt, Human
ugauggucuggggagagauuuuauuaaaaaaaaaaagaaaaaagagggaggaaaaaaaagaacc

SEQ ID NO: 414627 - RNA, 64 nt, Human
gccaacauacugaaaccccgucucuacuaaaaauaagaaaaauuagcugggcgugguggcgggc

SEQ ID NO: 414628 - RNA, 64 nt, Human
ugggugacagagaaggacuccgucucaaaaaaaaaagaaaaaagaauagucauuuuuaaacuac

SEQ ID NO: 414629 - RNA, 64 nt, Human
aaauugcagagaaaccuguaaguaauggaagguaaagaaaaauuacagaauggaaaauaauauu

SEQ ID NO: 414630 - RNA, 64 nt, Human
ugauaguauaauuaucccuuuuuaauauuggggaaagaaaaaugaaaauucauuaguuaauuac

SEQ ID NO: 414631 - RNA, 64 nt, Human
uggauuacaaagucauuggugaaaguccuauggcaagaaaaauuuucuugcaaaucauccacau

SEQ ID NO: 414632 - RNA, 64 nt, Human
ccauaaaccuuguuacauauguauaucagaauguaagaaaaaaaaauuuauuuaaaaauauuuu

SEQ ID NO: 414633 - RNA, 64 nt, Human
gccagccuugugugaaaaugccuucuuccucuuuaagaaaaaggacaauuuuuaaacugcugaa

SEQ ID NO: 414634 - RNA, 64 nt, Human
gggagaaagggaaaagucagggaaggggagaagaaagaaaaacacauuuggccuuaaaauagca

SEQ ID NO: 414635 - RNA, 64 nt, Human
agaauggggauacccccaaaauaagauucuggugaagaaaaagucuuguacuaaguuccccuuu

SEQ ID NO: 414636 - RNA, 64 nt, Human
gggcgugggcuucuucacauaagccuggggaaggaagaaaaaacggcuuucauuaccaaauaau

SEQ ID NO: 414637 - RNA, 64 nt, Human
uuuuguaucagugcuguuaauuugcuguugccucaagaaaaagugcuuuuucuccauggaugag

SEQ ID NO: 414638 - RNA, 64 nt, Human
gagaacacuuugggcuccugcagugauggugggaaagaaaaauucuuuccaaagcugcacuucu

SEQ ID NO: 414639 - RNA, 64 nt, Human
auuuguuaacuugugaauacgaauaaaugggauaaagaaaaauagacaaccaguucgcauuuua

SEQ ID NO: 414640 - RNA, 64 nt, Human
gguaccacuuuuuaaagcuagcugugucgaguuaaagaaaaaaucagcaguuuuuucucccaga

SEQ ID NO: 414641 - RNA, 63 nt, Human
acacagugguucaugccugugagacuggggcaggaggaucacuugaggccaggaguucaagau

SEQ ID NO: 414642 - RNA, 63 nt, Human
cagagacacacacacauacuacuuuaagggggugaggaucauuaauucagauaauuuuuaagu

SEQ ID NO: 414643 - RNA, 63 nt, Human
cauuaaaguccaguauuacuaagguaagggauugaggaucagggguuagaagacauaaaccaa

SEQ ID NO: 414644 - RNA, 64 nt, Human
aggacuguaaagauuuguugacagcaaaauguugaagaaaaaagcuuauagaauaaaagcuaua

SEQ ID NO: 414645 - RNA, 64 nt, Human
aagcugacuuggcacuuaagugcacuuuuuuaugaagaaaaaguacaaugaacugcuuuuccuc

SEQ ID NO: 414646 - RNA, 64 nt, Human
aagauuaucagaaaaauaccaaguuauuuuauaaaagaaaaaauauuucuaaauccugaugcau

SEQ ID NO: 414647 - RNA, 64 nt, Human
uccucccaccacacacacaugcuccaaaagaggaaagaaaaaaagauaauuuuuaggacuugau

SEQ ID NO: 414648 - RNA, 64 nt, Human
aaauucagucagucaaaaacuggaagaacuguaaaagaaaaaaguauauaucaauaaguauaca

SEQ ID NO: 414649 - RNA, 64 nt, Human
guugauaaagacacaccugagaugguaauuuguaaagaaaaagguuuaauggacucacaguucc

SEQ ID NO: 414650 - RNA, 64 nt, Human
uuaguuuuugugcuccguguucuuguguccuucuaagaaaaaugugggcugcucuugaaaguua

SEQ ID NO: 414651 - RNA, 64 nt, Human
uaaacgaaauguuaaaacagggucaauccauuugaagaaaaaguuggacaaaauaaucagcauu

SEQ ID NO: 414652 - RNA, 64 nt, Human
agguuugaaacuggauucucgauuuuuagcaaaaaagaaaaaaaaaaggcacauaguuuaaaaa

SEQ ID NO: 414653 - RNA, 64 nt, Human
cacaaggaggacaaguugaauggaccuuuuuaaaaagaaaaaaaaaauggaaggaaaacuaaga

SEQ ID NO: 414654 - RNA, 64 nt, Human
uugcuccuugcaaauuaaaaaagcaacuaagagaaagaaaaacauuguagauaucuauuuauau

SEQ ID NO: 414655 - RNA, 64 nt, Human
uuuggauuucugcacuguuuaacaaaugaaguaaaagaaaaacacuacugcaaucacgucuuuu

SEQ ID NO: 414656 - RNA, 64 nt, Human
cccuuacuuggcugauuuuuuuuuuccaucucauaagaaaaaucagcugaaguguuaccaacua

SEQ ID NO: 414657 - RNA, 64 nt, Human
ccaaaggaacauuuuaacuguaaaggcuggagacaagaaaaaauaaguagaucguuuuaauaac

SEQ ID NO: 414658 - RNA, 64 nt, Human
gaugccgaagaguugaugucaaucuuuuuuuccuaagaaaaaaaguccgcgaguauuaaauauu

SEQ ID NO: 414659 - RNA, 64 nt, Human
gagcaggacaacugaccugucuccuucacacaguccacgucaccacgaaucacacaacaaaaag

SEQ ID NO: 414660 - RNA, 64 nt, Human
aagggcuugucucccucccaguuuuucuuuugcuccacgucauuuugucaggcugguuauaagc

SEQ ID NO: 414661 - RNA, 64 nt, Human
ggcagaggaucugccucggcgucugcaggcgggaccacgucagggaggguuccuucauguguuc

SEQ ID NO: 414662 - RNA, 64 nt, Human
ugacaccagauguagauauuuaucuggagcuggaaagaaaaauucuuuuucuguaccucaugcc

SEQ ID NO: 414663 - RNA, 64 nt, Human
gaccuguacaagugaugcagaaaggaggguuucaaagaaaaaggauuuuguuuaaaauacuuua

SEQ ID NO: 414664 - RNA, 64 nt, Human
uuccucaacuugacaagaaaagcuaauuuaagagaagaaaaacauaaagucauuauauuaauua

SEQ ID NO: 414665 - RNA, 64 nt, Human
gagaagaaaaacauaaagucauuauauuaauuaaaagaaaaaacaccauuuaauauguucugaa

SEQ ID NO: 414666 - RNA, 64 nt, Human
agcuuuagguuccaagaagauucugggacucaggaagaaaaagugccaucaggugaccagcugu

SEQ ID NO: 414667 - RNA, 64 nt, Human
gaacauuugggguaagaaaacaaacaugaggcaaaagaaaaaauacauguuuuuaagaaaacau

SEQ ID NO: 414668 - RNA, 64 nt, Human
uucugggcaggucccacgcuauaugcacaaaguuaagaaaaacuuggucuuagcccuugggagc

SEQ ID NO: 414669 - RNA, 64 nt, Human
uggauggggaaaugggugggagggugguguugggaagaaaaauuggucagcuuggcucggggag

SEQ ID NO: 414670 - RNA, 64 nt, Human
aagauuaaccauuuuuuugucuuagaauaucaaaaagaaaaagaaaaagguguucuagcuguuu

SEQ ID NO: 414671 - RNA, 64 nt, Human
aaccauuuuuuugucuuagaauaucaaaaagaaaaagaaaaagguguucuagcuguuugcauca

SEQ ID NO: 414672 - RNA, 64 nt, Human
cucuuuuacuuugguuccuguugugcucuuguaaaagaaaaauauaauuuccugaagaauaaaa

SEQ ID NO: 414673 - RNA, 64 nt, Human
cucaccccaaauguguaauggaaaauuuuuaauuaagaaaaacuucaguuuugccaagugcaau

SEQ ID NO: 414674 - RNA, 64 nt, Human
acgaggacaagagggcaaaagcaaaacagacaaaaagaaaaaaaaucgccgucuccguuccgaa

SEQ ID NO: 414675 - RNA, 64 nt, Human
gccccacccccuuucucuuucucucucucucucaaagaaaaaaaaaaugggagugcaaaaaaaa

SEQ ID NO: 414676 - RNA, 64 nt, Human
uugucuuaaaauauuaguggcuuacauuuuaaaaaagaaaaaucaccagcaugaacuugcaccu

SEQ ID NO: 414677 - RNA, 64 nt, Human
ccauuaucuucuuuugccuaaaauuacuaaugcaccacgucagucugcuuccuucaggcaucau

SEQ ID NO: 414678 - RNA, 64 nt, Human
aaggauugaagucaaagaauugaaacccuccaaaccacgucaucugauuguaagcacaauauga

SEQ ID NO: 414679 - RNA, 64 nt, Human
cacuuaaaccuuccaaguagcacagaagcccccuccacgucagaggcccccuggccgcggggcc

SEQ ID NO: 414680 - RNA, 64 nt, Human
uagcauaaugacagugggagggguacaaggggauaagaaaaaugucaugauuuuuuuccggucc

SEQ ID NO: 414681 - RNA, 64 nt, Human
cagccuuagguaaacaacuuagauucugaggucaaagaaaaaaggagagggaaugcagccuugu

SEQ ID NO: 414682 - RNA, 64 nt, Human
aguguugcuagagaaaauuagggaaaaggugaaaaagaaaaaaugguaguaauugagcagaaaa

SEQ ID NO: 414683 - RNA, 64 nt, Human
auuuaucuaaguagaacugaauuggcuaggaaaaaagaaaaacugcauguuaaucauuuuccua

SEQ ID NO: 414684 - RNA, 64 nt, Human
cugucacaugacucauugaguaguaaugauucagaagaaaaagaaaaaggagacuuuauugguc

SEQ ID NO: 414685 - RNA, 64 nt, Human
caugacucauugaguaguaaugauucagaagaaaaagaaaaaggagacuuuauuggucaauauu

SEQ ID NO: 414686 - RNA, 64 nt, Human
uuccagccugguugacagagugacccuugucuccaagaaaaaaaaaaagcaaaugggauuaagg

SEQ ID NO: 414687 - RNA, 64 nt, Human
agcccaggcaacaagagugaaacccugucucaaaaagaaaaaaaaaguugaccuugagaauuua

SEQ ID NO: 414688 - RNA, 64 nt, Human
agccugggcaacauggcuaaacucugucucuauuaagaaaaaaaauguuaacauuaugauuuaa

SEQ ID NO: 414689 - RNA, 64 nt, Human
uccagaacugugaaaaauaaauuuguuauuuaaaaagaaaaaaaaaaaaacaaaaaccugaguu

SEQ ID NO: 414690 - RNA, 64 nt, Human
guauuuggacacugauggacuuaaguauggaaggaagaaaaauagguguauaaaauguuuucca

SEQ ID NO: 414691 - RNA, 64 nt, Human
aaaaaaaaaaaaaaaaaaaaaaaggaaaaaaaaaaagaaaaagaaaacgugugcauuuuguaua

SEQ ID NO: 414692 - RNA, 64 nt, Human
caaaaguuuuaccacagucugcacuugcagaagaaagaaaaaaauucaaaccacauguuuauuu

SEQ ID NO: 414693 - RNA, 64 nt, Human
guuaugauaaaaggaaguagaugugaaaaagccuaagaaaaaggaaauuggacaguuuugauac

SEQ ID NO: 414694 - RNA, 64 nt, Human
auugaaaaaagagaaaggggcaagaaauucauuaaagaaaaaccacagauacugaaacauuuga

SEQ ID NO: 414695 - RNA, 64 nt, Human
agcccccacauccugugccuccaucagcuaaacaccacgucacuucaugcaggugaaacccagu

SEQ ID NO: 414696 - RNA, 64 nt, Human
uagcucacugaagagcuguuagauccugggguggccacgucacuuguguuuauuuguucuguaa

SEQ ID NO: 414697 - RNA, 64 nt, Human
aggcagacacuccagccccuuucugggauccuggccacgucauugugcuccugcccugcaggcu

SEQ ID NO: 414698 - RNA, 64 nt, Human
aaaaaaaaaaggaaaaaaagaaaagaaaagugaaaagaaaaacucuuauuggccuaaguucuaa

SEQ ID NO: 414699 - RNA, 55 nt, Human
cuuuccacuuccaguucuaguaaggaagaaaaacugaaaauguuuuaguuuauua

SEQ ID NO: 414700 - RNA, 64 nt, Human
uaugaaugguuuuaugucauuuuuuuaauuaaaaaagaaaaauucauauaaucguguuuaaaac

SEQ ID NO: 414701 - RNA, 64 nt, Human
aaaauuccaacugcuguuggggaaggacacagaaaagaaaaauaaccacccaagaaaaacaaaa

SEQ ID NO: 414702 - RNA, 64 nt, Human
ggcauauauaagagggaaguaagacuuuuaagaaaagaaaaaguuaugccucauuccucaugug

SEQ ID NO: 414703 - RNA, 64 nt, Human
guuuauugacuguuauugcuaagaagaaguaagaaagaaaaagccuguuggcaaucuugguuau

SEQ ID NO: 414704 - RNA, 64 nt, Human
ugaacgugagugggguauuuuguucuggcauuagaagaaaaacaagcaagcaaacaaaaacaca

SEQ ID NO: 414705 - RNA, 64 nt, Human
uucauacuuuuuauacuuugaggaaaaaaagucaaagaaaaauuguauuugagggaaaaaacca

SEQ ID NO: 414706 - RNA, 64 nt, Human
aauuuucuuugcauuuuaaaauaucuggauuaugaagaaaaagugaugaaaauaaauuaaaacu

SEQ ID NO: 414707 - RNA, 64 nt, Human
ugugcuuacuuccuuaacauuuauacauuguuuuaagaaaaaacuuuuaaaaauauuucuuaua

SEQ ID NO: 414708 - RNA, 64 nt, Human
cuuuuaagugaaaaucugaauuguucuaaauggaaagaaaaaaaguugcaaucugugcccuuca

SEQ ID NO: 414709 - RNA, 64 nt, Human
ucgaaguaacuguggucuuagguucggcugaguaaagaaaaaggauuuuucuucgaguuagcug

SEQ ID NO: 414710 - RNA, 64 nt, Human
ucuuuguuuacuuagcuuucucuuaguuguaagaaagaaaaagacgucuugcaugaaaauagua

SEQ ID NO: 414711 - RNA, 64 nt, Human
uuuuuccugcauaugucaacuuuggacagcuuucaagaaaaaugagaaaaguuucaacuucugg

SEQ ID NO: 414712 - RNA, 64 nt, Human
cagaacaacuuguaaaacaaauuguguuugcuuuaagaaaaauguuuauugcacucaugucaua

SEQ ID NO: 414713 - RNA, 64 nt, Human
cgguggacucucauguggccaagcacaucuuugaccacgucaucgggccagaaggcgugcuggc

SEQ ID NO: 414714 - RNA, 64 nt, Human
uauucacuuaagaagcuugucugcaauaauaaagccacgucaugucuucuuuugggagggagag

SEQ ID NO: 414715 - RNA, 64 nt, Human
aaauguaagacaugugggaaaggcuuuuauucucccacgucauuucaaagacaugaaaaaacuc

SEQ ID NO: 414716 - RNA, 64 nt, Human
uaggacacuucacugccauuuucuauucacauaaaagaaaaauaaauguggaaauuucauccuu

SEQ ID NO: 414717 - RNA, 64 nt, Human
auucuguucuuucaaggagaaauaagccuaaaagaagaaaaacaaaaaaaauucuguauaaaac

SEQ ID NO: 414718 - RNA, 64 nt, Human
aaugaugacuuuuuaauguaaaaguaauuauuguaagaaaaagauuuaauuguuccauguguau

SEQ ID NO: 414719 - RNA, 64 nt, Human
ugcagugcagagcacuuuaaugcaaccagcuuucaagaaaaagcccuaucuaguacuugauguu

SEQ ID NO: 414720 - RNA, 64 nt, Human
aauaauagcccugagauguuucuaacauuuaaauaagaaaaaaaucaaaucgaagucagccugc

SEQ ID NO: 414721 - RNA, 64 nt, Human
uagacaugggagacuuuucauuuuguucuguacuaagaaaaauucuuacccuaaaacuuaaagu

SEQ ID NO: 414722 - RNA, 64 nt, Human
uuugugcuuuaggcaaacauuaaccagcucuaacaagaaaaaugucuagauuuacacauuguca

SEQ ID NO: 414723 - RNA, 64 nt, Human
accaaguaagacucaaaauugcaaauauaaacaaaagaaaaauccaacugaaaauaacacuaag

SEQ ID NO: 414724 - RNA, 64 nt, Human
cagaauauaaaauccaaagucugaccaguuuguaaagaaaaacaaaugguaacuggugcuuaaa

SEQ ID NO: 414725 - RNA, 64 nt, Human
guuguaguaaagaaauuuaaaagacacuguuuacaagaaaaaaugaauuuuguuuggacuucuu

SEQ ID NO: 414726 - RNA, 64 nt, Human
cccuccacugcuguuaauuaaugucacuuccaagaagaaaaacuguucuguuguaaaaaauaua

SEQ ID NO: 414727 - RNA, 64 nt, Human
uauuauaggaugaacuuugauaauguugaagaugaagaaaaaguuuaaaagaaauucugacaga

SEQ ID NO: 414728 - RNA, 64 nt, Human
auaacaaaguguuaguaaucauugcuuucuguagaagaaaaagguuuaaauuuaaaauguguau

SEQ ID NO: 414729 - RNA, 64 nt, Human
gccuauuuuucuguuccagcaacuguuuuuaugaaagaaaaacuugaaaugcuacuuaacuuac

SEQ ID NO: 414730 - RNA, 64 nt, Human
aaccagaaucuacaaugaacucaaacaaauuuacaagaaaaaaacaaacaaccccaucaaaaag

SEQ ID NO: 414731 - RNA, 64 nt, Human
gcucuccuaaguuuaauuacaacagcacgugcagccacgucagccaaaugacuucauuucugau

SEQ ID NO: 414732 - RNA, 64 nt, Human
gggcccccagccugggagacuggcccugcggccuccacgucaaacucucuucccaaagcccuaa

SEQ ID NO: 414733 - RNA, 64 nt, Human
aguauuuuuauuaccaauaaauuuaaaauuuuuuaagaaaaauauuuuuauccuagggccaagu

SEQ ID NO: 414734 - RNA, 64 nt, Human
agcuuguauauguaguaguuugaugaauaauuuaaagaaaaacaccuaaaauuugaaaaaugau

SEQ ID NO: 414735 - RNA, 64 nt, Human
uuuccaaaauguuuggaaacaguauaauuugacaaagaaaaaugauacuucucuuuuuuugcug

SEQ ID NO: 414736 - RNA, 64 nt, Human
uagucuuucaagcuuagugauaagguggaagcacaagaaaaauuucaguagaauacaguuuuua

SEQ ID NO: 414737 - RNA, 64 nt, Human
guguaauucuuggugggcucuguaguuuaauaauaagaaaaaggccauuucauuuuaaauugug

SEQ ID NO: 414738 - RNA, 64 nt, Human
gaaugaauauagacacuguaucuaagugggaccaaagaaaaaauagcgaacuuucaccaaaguu

SEQ ID NO: 414739 - RNA, 64 nt, Human
ugaagugaacuaugaaguaagcaacaaggaugacaagaaaaacauggggaaacagaugccucag

SEQ ID NO: 414740 - RNA, 64 nt, Human
uggggaaacagaugccucagccuacuuucacacuaagaaaaaaacuugucuucccuucugauug

SEQ ID NO: 414741 - RNA, 64 nt, Human
guguguaucaaaaguggucucaaaauauuuuuuuaagaaaaaaagcaaaaacaauguauugcug

SEQ ID NO: 414742 - RNA, 64 nt, Human
gcagugcaucagccaguaaaacaaacacauuuacaagaaaaauguuuuaaagaugccaggggua

SEQ ID NO: 414743 - RNA, 64 nt, Human
agccaggaaagucaaaaaaacgaaagagaaggagaagaaaaaggaaaagggcaaauugaaaguc

SEQ ID NO: 414744 - RNA, 64 nt, Human
aauuuauguuuuuauuaagugccuugaaaaaaugaagaaaaauguauuuucccuuuauguaaaa

SEQ ID NO: 414745 - RNA, 64 nt, Human
aaaaauaggauuuacuuuuuucuaauucugaccuaagaaaaauaaugagaacaagcuguugcaa

SEQ ID NO: 414746 - RNA, 64 nt, Human
cuguaagggcaaggacaccauuccuucuacauauaagaaaaaagucucuccccaagggcagccu

SEQ ID NO: 414747 - RNA, 60 nt, Human
gcuuuacgucuccccuguaaaaggggcaaaaagaaaaaaauaaaaagcauuuuaaaauca

SEQ ID NO: 414748 - RNA, 63 nt, Human
ugcuaucaguguggaauuugauagagucuagacucgggccacuuggaguuguguacuccaaag

SEQ ID NO: 414749 - RNA, 63 nt, Human
guugugugugagugcccgucagccagugaugccucgggccacgcuguggggccaccucagucc

SEQ ID NO: 414750 - RNA, 64 nt, Human
ugucuccuaaauuguuguaauugcauuauaaaauaagaaaaauauuaauaagacaaauauugaa

SEQ ID NO: 414751 - RNA, 64 nt, Human
auuuaagcugccuguacacaacucacuccuuuuaaagaaaaaaacuucaacguaagacugugua

SEQ ID NO: 414752 - RNA, 64 nt, Human
augcugauuuaacauuuaaguaucacagcauuaaaagaaaaagaaaguaaaccaguccuuugua

SEQ ID NO: 414753 - RNA, 64 nt, Human
gccugugagacuuagcaccaagugcugaggcuggaagaaaaacgcacaccagacgggcaacaaa

SEQ ID NO: 414754 - RNA, 64 nt, Human
gacauuuaauaacuuugcuggaaaaucuguaaaaaagaaaaacaaguuugcuagugacuaagcc

SEQ ID NO: 414755 - RNA, 64 nt, Human
gugcccaacuuuucuaagugagcuuagcaaugagaagaaaaaaaaacaugaauucuuuuucugg

SEQ ID NO: 414756 - RNA, 64 nt, Human
gucagaaguauuuuaaagggcuuaaugugccaaaaagaaaaaaagcuagagacccuuuuugcaa

SEQ ID NO: 414757 - RNA, 64 nt, Human
ucaggaaugguguggauugagaacuuguuacuugaagaaaaagaauuuugauauuggaauagcc

SEQ ID NO: 414758 - RNA, 64 nt, Human
ggguauaagaucugaacuuuucaucugcagaggcaagaaaaauauuugacauugugacuugacu

SEQ ID NO: 414759 - RNA, 64 nt, Human
auuuuauuauuuuagaagaaaauugaagagccuaaagaaaaaauauuuuaugguugaaaaaaca

SEQ ID NO: 414760 - RNA, 64 nt, Human
uucaccuggcaggggaggggggauuuauuucugaaagaaaaauauauaaacagaucuucuacau

SEQ ID NO: 414761 - RNA, 64 nt, Human
gccacugcaagcucugaaucaguuuuuuaaaaaaaagaaaaaaaaaaaaaaggagcugugcccc

SEQ ID NO: 414762 - RNA, 64 nt, Human
ccaccugggcaacauaguaagaucuugucucuuaaagaaaaaaaaaaaagguacuuagaggucg

SEQ ID NO: 414763 - RNA, 64 nt, Human
gcaucaggaauucaccuggagguugaaaagagaaaagaaaaagcaccaagcucuuguguguuug

SEQ ID NO: 414764 - RNA, 64 nt, Human
uccugucccuuugccaacuacuccuuccccaucaaagaaaaacacuugcacacaguaacuacca

SEQ ID NO: 414765 - RNA, 63 nt, Human
ucacacugucugaaaggccacccaggauccaaaucgggccaucuucauugccaugaguguucg

SEQ ID NO: 414766 - RNA, 63 nt, Human
gcuaagucuuucccaaucucuaccccuuucuucucgggccacccucuguuuaaaauuugugcu

SEQ ID NO: 414767 - RNA, 63 nt, Human
agaaagucugguuaaaacaccaugagucaaaugucgggccagccaacaguaacacuugccaag

SEQ ID NO: 414768 - RNA, 64 nt, Human
ugcuugccaaaguacagaauuugaauuaucagcaaagaaaaaaaaaaaagccagccaagcuuua

SEQ ID NO: 414769 - RNA, 64 nt, Human
uuuuuuuuuuacuuggauggcuuaacauuuuugcaagaaaaauaggaagauaugaagaugaugu

SEQ ID NO: 414770 - RNA, 64 nt, Human
ggugggaggcaaaagacacuucuuacauuguggcaagaaaaaaugaggaagaagcaaaagcaga

SEQ ID NO: 414771 - RNA, 64 nt, Human
ucacgcugcugauaaagacauacccgagacugggaagaaaaagugguuuaauuggacuuaaagu

SEQ ID NO: 414772 - RNA, 64 nt, Human
uaaugcugcugauaaagacguacccgagacugggaagaaaaagagguuuacuuggacuuacagu

SEQ ID NO: 414773 - RNA, 62 nt, Human
auacauugcagcacaacugaauuccuucccuaaagaaaaaguccugccauuguaacaucaua

SEQ ID NO: 414774 - RNA, 64 nt, Human
aaaaacaaguaucucaugcucuuguuucucaaaaaagaaaaacaaaaaacaaaaaacaggggcc

SEQ ID NO: 414775 - RNA, 64 nt, Human
cagcaucuuaccuucauaugcaguaaaagaaagaaagaaaaaaaaaggaaaaaaaaaaaaaaac

SEQ ID NO: 414776 - RNA, 64 nt, Human
uuuuuuguacaaaacuuuuuuaaauauaaauguuaagaaaaauuuuuuuuaaaaaacacuucau

SEQ ID NO: 414777 - RNA, 64 nt, Human
gucucuaaaggguuaaauguaucaauuggaaaggaagaaaaaaggccuugaauugacaaauuaa

SEQ ID NO: 414778 - RNA, 64 nt, Human
cuguucacuguuucuagaaaaaaaucauugccauaagaaaaaguauaaauuagcaagaaaggag

SEQ ID NO: 414779 - RNA, 64 nt, Human
cccuucccauuucugcaaagguacuguuagcuggaagaaaaacauuuugguuagcuuuguauga

SEQ ID NO: 414780 - RNA, 64 nt, Human
cccagagggcucaccuuccaagucucccucaaagaagaaaaagaaauuccgaacccccuccuuc

SEQ ID NO: 414781 - RNA, 64 nt, Human
gcuaugcuggauaugaacuuuuggggccucaggaaagaaaaaccaggaacuaguuucaauaaug

SEQ ID NO: 414782 - RNA, 50 nt, Human
aaaagaggaagaugcuaugaaagaaaaaaaaaauuccuaaaacuguggaa

SEQ ID NO: 414783 - RNA, 63 nt, Human
uuggcccugaaccagggccagauaaggaacagcucgggccacucuucugaaggccaacgugga

SEQ ID NO: 414784 - RNA, 63 nt, Human
ucacaguaucaguauuuucacacguaagcacauucgggccauuuccgugguuucucaugagcu

SEQ ID NO: 414785 - RNA, 63 nt, Human
cucauguggccaagcacaucuuugaccacgucaucgggccagaaggcgugcuggcaggcaagg

SEQ ID NO: 414786 - RNA, 64 nt, Human
ucccugcugauuuguuucuaaaucaaaagaaaugaagaaaaaaguacugugaccugagagacac

SEQ ID NO: 414787 - RNA, 64 nt, Human
gcuguucuggaaguucuagacauggcaauaaggcaagaaaaagagauuaaaugcauacagaucg

SEQ ID NO: 414788 - RNA, 64 nt, Human
gguacuuaauaaaugagucguuauacuaugcauaaagaaaaauccuagcaguauugucaggugg

SEQ ID NO: 414789 - RNA, 64 nt, Human
uuuuuuguuaauaaugugcuaggauuugcuaaaaaagaaaaaaaaaaaacccuuuugaguuugc

SEQ ID NO: 414790 - RNA, 64 nt, Human
aagcccauauaaggagcggaguuguuaaggacugaagaaaaacuucucuggagaaaaauaaaau

SEQ ID NO: 414791 - RNA, 64 nt, Human
ugggcagacacgagcaggagggagagacagagaaaagaaaaacacagcaugagaacacaguaaa

SEQ ID NO: 414792 - RNA, 64 nt, Human
gacuaaccagcuuagucagaagaugguuccauggaagaaaaaggccaaggaguuugaagauuuu

SEQ ID NO: 414793 - RNA, 64 nt, Human
gaggaagaugaggggggaugcgaguaccuccaagaagaaaaaucacacucugaauggugcuugc

SEQ ID NO: 414794 - RNA, 64 nt, Human
uuuauaauaaacugauuuaaacuuuuucuauaagaagaaaaauuaagaccacuuauuugaaaac

SEQ ID NO: 414795 - RNA, 64 nt, Human
gaucaaaguuuucagugcauuuauuguacauuuuaagaaaaaggugaaaaucauuuggggagua

SEQ ID NO: 414796 - RNA, 64 nt, Human
uucaaugacaugaaaacugugcaagcaaaaaccgaagaaaaacacuuaaguacaacuguaguga

SEQ ID NO: 414797 - RNA, 64 nt, Human
auuuuuaucaaauguuaugaugcaaaaaaagaaaaagaaaaaaaaaaagaaaagaaaacuucaa

SEQ ID NO: 414798 - RNA, 64 nt, Human
caaaagauuuuuaucaaauguuaugaugcaaaaaaagaaaaagaaaaaaaaaaagaaaagaaaa

SEQ ID NO: 414799 - RNA, 64 nt, Human
cuuuggacacaguguuuuaucaccuguucauuugaagaaaaauaauaaagucagaaguucaagu

SEQ ID NO: 414800 - RNA, 64 nt, Human
agugacuuauuaaacuauugaaggaaaaggacucaagaaaaauaauaaaagaccauaaauaagg

SEQ ID NO: 414801 - RNA, 63 nt, Human
gggauuucagggccuucccucccugccugggugucgggccaccagaaggcucugccggacgcc

SEQ ID NO: 414802 - RNA, 63 nt, Human
augggugagguuccaauggcagguuagagccccucgggccaacugccauccuggaaaguagag

SEQ ID NO: 414803 - RNA, 63 nt, Human
guacacuucccacacgagcugcggcugccagccucgggccaucagccuaggagagcagaugca

SEQ ID NO: 414804 - RNA, 64 nt, Human
uguuaaagacauaccugagacuggguaauuuauaaagaaaaauagguucgauggacucacaggu

SEQ ID NO: 414805 - RNA, 64 nt, Human
uuucauauauuuaugcauuacacaccuuagcuauaagaaaaaaaggguuuugauuauaugcuuc

SEQ ID NO: 414806 - RNA, 64 nt, Human
acacaugacgcaccaguuacagggguuguuuuuaaagaaaaaaacaaucccagcaggagggauu

SEQ ID NO: 414807 - RNA, 64 nt, Human
caauaaagaaaaaaaaauacaaaggaagaaaagaaagaaaaacaaguguucagggcauaacaac

SEQ ID NO: 414808 - RNA, 64 nt, Human
ucagaaagcaguagugagagugagaguaacaauaaagaaaaaaaaauacaaaggaagaaaagaa

SEQ ID NO: 414809 - RNA, 64 nt, Human
acuggagaagaaaaaaaagaaaaaagauagaaaaaagaaaaaguuucagaagagcagaaguaaa

SEQ ID NO: 414810 - RNA, 64 nt, Human
uuacaggaaauuagaucgacuggagaagaaaaaaaagaaaaaagauagaaaaaagaaaaaguuu

SEQ ID NO: 414811 - RNA, 64 nt, Human
auuucccaauuacaggaaauuagaucgacuggagaagaaaaaaaagaaaaaagauagaaaaaag

SEQ ID NO: 414812 - RNA, 64 nt, Human
gucuguacuaaaaaaaaaaaaaaagaaaaagaaaaagaaaaaagaauacccaggugugguagug

SEQ ID NO: 414813 - RNA, 64 nt, Human
aacccggucuguacuaaaaaaaaaaaaaaagaaaaagaaaaagaaaaaagaauacccaggugug

SEQ ID NO: 414814 - RNA, 64 nt, Human
uggugaaacccggucuguacuaaaaaaaaaaaaaaagaaaaagaaaaagaaaaaagaauaccca

SEQ ID NO: 414815 - RNA, 64 nt, Human
uguuguuauacuguauuguuuagggaauaacaauaagaaaaacagucuguacauguucacuaca

SEQ ID NO: 414816 - RNA, 64 nt, Human
auuuuucccuccuuauagucaaggaccguagaggaagaaaaacuuuuuuuucauaccaugcacu

SEQ ID NO: 414817 - RNA, 64 nt, Human
acacggacuaaucuuucugaacuguaaauauuuaaagaaaaaaaaguaguuuuguaucaaccua

SEQ ID NO: 414818 - RNA, 64 nt, Human
ggugcuaauaagaguaggaauucucucuauuaaaaagaaaaaaaaaaguugcccuuccuccaca

SEQ ID NO: 414819 - RNA, 64 nt, Human; identical to SEQ ID NO: 58315

SEQ ID NO: 414820 - RNA, 64 nt, Human; identical to SEQ ID NO: 58316

SEQ ID NO: 414821 - RNA, 64 nt, Human; identical to SEQ ID NO: 58317

SEQ ID NO: 414822 - RNA, 64 nt, Human
agauauuugauuucuugagcauguauuggucagaaagaaaaagaaagaaaaccauucucuauuu

SEQ ID NO: 414823 - RNA, 64 nt, Human
cuaaaauaaaaaccagaaucauaauuuucaagagaagaaaaaauuaagagauacauucccuauc

SEQ ID NO: 414824 - RNA, 64 nt, Human
cauguacaaucucaucauccugaagccuauaaugaagaaaaagaucuagaaacugaguugugga

SEQ ID NO: 414825 - RNA, 64 nt, Human
aaguaucccuuucaaaugccuuugagaagaauagaagaaaaaaaguuuguauauauuuuaaaaa

SEQ ID NO: 414826 - RNA, 64 nt, Human
ucccuuauguugaggcauggaaaaaaaauuggaaaagaaaaacucaguuuaaauacggagacua

SEQ ID NO: 414827 - RNA, 64 nt, Human
gagcucucuguauucuauaauuggaagagaaaaaaagaaaaacuuuuaacuggaaauguuaguu

SEQ ID NO: 414828 - RNA, 64 nt, Human
ccaauaacuucagagaagucaguuggagaaaaugaagaaaaaggcuggcugaaaaucacuauaa

SEQ ID NO: 414829 - RNA, 64 nt, Human
uccugaauauuugcgcgagacuuuuuucuuaggaaagaaaaaaggcucaccuuggcuacuguug

SEQ ID NO: 414830 - RNA, 64 nt, Human
ucuucccuauacuucacacugaacucaggaugggaagaaaaaggaaacaagcuuuggcuuuuuc

SEQ ID NO: 414831 - RNA, 64 nt, Human
cauacuaaugcuuauuuuauuuuaauuguauagaaagaaaaaaaugccuaaaauaagguuuucu

SEQ ID NO: 414832 - RNA, 64 nt, Human
uugauuucaggacauaaagaucuggucccugaugaagaaaaaaaucuagcuaugucagauggua

SEQ ID NO: 414833 - RNA, 64 nt, Human
uuuugcuuguaguuuuacuguacauuuauuuuuaaagaaaaagaaaacaaaagccagacaaacc

SEQ ID NO: 414834 - RNA, 64 nt, Human
agguaacucuuugcacauaaauugguauaauaaaaagaaaaacacaaacauucaaagcuuaggg

SEQ ID NO: 414835 - RNA, 64 nt, Human
augaagucaaauuuguauaaauucucuuaauucaaagaaaaaguuuuaugugauuuauuuuugg

SEQ ID NO: 414836 - RNA, 64 nt, Human
aacaauuauagcuucugaggucaguuuaaagugaaagaaaaaucuguaauacaaggauucaaaa

SEQ ID NO: 414837 - RNA, 64 nt, Human; identical to SEQ ID NO: 58320

SEQ ID NO: 414838 - RNA, 64 nt, Human; identical to SEQ ID NO: 58321

SEQ ID NO: 414839 - RNA, 64 nt, Human; identical to SEQ ID NO: 58322

SEQ ID NO: 414840 - RNA, 64 nt, Human
ucuuugcaaaauguauauuacuaacauaguuuggaagaaaaauugaguagugguaaguuuuguu

SEQ ID NO: 414841 - RNA, 64 nt, Human
cuauuuuuucucaguuuuuaaugcuuuaauuugaaagaaaaaugcauccuaaccauuccauccu

SEQ ID NO: 414842 - RNA, 64 nt, Human
guggcaauuuauuuuaagaguauuuucugguaaaaagaaaaauguguauuuuaagaugaaauau

SEQ ID NO: 414843 - RNA, 64 nt, Human
gugcuuuguuuccgugcacuuaaaaauaauugagaagaaaaacucaauuaaaauuuuguuuaua

SEQ ID NO: 414844 - RNA, 64 nt, Human
aaaaauuuuuaggaaacucaccuuccucaucuaaaagaaaaaggcauuuuagagaaaacuaaag

SEQ ID NO: 414845 - RNA, 64 nt, Human
aaaccaugacgcaaagagagauuuuuuuuuaaagaagaaaaaaaaaaauucacacugccagcgu

SEQ ID NO: 414846 - RNA, 64 nt, Human
caauuuuuauaaaaagaggauuaaaucuaaaggaaagaaaaaauuaaaaccacccauaacuuua

SEQ ID NO: 414847 - RNA, 64 nt, Human
gaaaaggaaauaaaagaaagagaaaaaggcaaaaaagaaaaaguaaugccuuucugaagaacca

SEQ ID NO: 414848 - RNA, 64 nt, Human
aaauaaaaaggacuacuuaaacauuugucauauuaagaaaaaaaguuuaucuagcacuugugac

SEQ ID NO: 414849 - RNA, 64 nt, Human
gaacuuauucuuaagaaauuguacuuuuuauuguaagaaaaauaaaaaggacuacuuaaacauu

SEQ ID NO: 414850 - RNA, 64 nt, Human
auuuugcacgccaaacucggcagcuuuggggaagaagaaaaaugccuuucuguuccccucucau

SEQ ID NO: 414851 - RNA, 64 nt, Human
gcccggcggucccuguuuugcuuuauugcuguuuaagaaaaauggagguaguuccaaaaaagug

SEQ ID NO: 414852 - RNA, 64 nt, Human
gcuggguuuucugaagucugaggaacaaugccuuaagaaaaaacaaacagcaggaaucgguggg

SEQ ID NO: 414853 - RNA, 64 nt, Human
uucuccagcagccucgucuuacagcgugacugcaaagaaaaagacuuuuguuuugcaaaagaaa

SEQ ID NO: 414854 - RNA, 64 nt, Human
uauuguugaauguacaucuaccccagccccucaaaagaaaaacuguuuacauagaaauuccuac

SEQ ID NO: 414855 - RNA, 64 nt, Human; identical to SEQ ID NO: 37080

SEQ ID NO: 414856 - RNA, 64 nt, Human; identical to SEQ ID NO: 37086

SEQ ID NO: 414857 - RNA, 64 nt, Human; identical to SEQ ID NO: 37093

SEQ ID NO: 414858 - RNA, 64 nt, Human
accuuaucuuugucacaggguguucuuuuuuaugaagaaaaauuugaaaaugauaaaagcuaag

SEQ ID NO: 414859 - RNA, 64 nt, Human
aaguguuuuccacuaauuuugcaugcguauuuauaagaaaaaugugaauuuggugguuuuauuc

SEQ ID NO: 414860 - RNA, 64 nt, Human
cacaagaugcguucuuaauacagacuuguuugcaaagaaaaaaaaaaguauauuauuaaaaucc

SEQ ID NO: 414861 - RNA, 64 nt, Human
aguacuaagaucuuaaaaagugguaacugucuugaagaaaaaacguuuauuguuuguuugcaau

SEQ ID NO: 414862 - RNA, 64 nt, Human
gcacgugacacuuaaauaauuuucuauguauuuaaagaaaaaugcaccaggauggugucugugc

SEQ ID NO: 414863 - RNA, 64 nt, Human
aaaucucuacugcuuuggauccugggucaaaaaaaagaaaaaaaaaagaaaugcaaaacuuuag

SEQ ID NO: 414864 - RNA, 64 nt, Human
agaaacauuuggaaaagacagaaaacuaaaaaggaagaaaaaagaucccuauuagauacacuuc

SEQ ID NO: 414865 - RNA, 64 nt, Human
ccuuguccucaguuggaaagaugagcaucagaucaagaaaaaggucugaggcagaauccaagau

SEQ ID NO: 414866 - RNA, 64 nt, Human
aaagucagaccuguuucuuguaacuggguucaaaaagaaaaaaauaauaaaaauaaaagagaga

SEQ ID NO: 414867 - RNA, 64 nt, Human
cuucaaaaguguucuuaaaacgaaagauaauguuaagaaaaauuugaaagcuuuggaaaaccaa

SEQ ID NO: 414868 - RNA, 64 nt, Human
gacaaauuuaacaaguuuucuguuacuuuuuaaaaagaaaaaauccagaacauaagaacuauau

SEQ ID NO: 414869 - RNA, 64 nt, Human
ccugggcaacauggcgagacccuguuucuacaaaaagaaaaagggaaaaaaaaagcagggacug

SEQ ID NO: 414870 - RNA, 64 nt, Human
uccccaguaccuucaguuccaggauuuaaaaugcaagaaaaaacauuuuuacugcugcuuaguu

SEQ ID NO: 414871 - RNA, 64 nt, Human
ugacaauuuauuuuugccaucauuuuuuuaauuaaagaaaaaauuuccagaagaggaaaaaaaa

SEQ ID NO: 414872 - RNA, 64 nt, Human
gcacagaaguuuaagacuaugaguuuuuagggugaagaaaaaacuguacaguuuaaaugaaaau

SEQ ID NO: 414873 - RNA, 63 nt, Human
uuuacauucagccagggaagaggaggccagaggucgggccagcugccccauucuuuuaacguu

SEQ ID NO: 414874 - RNA, 63 nt, Human
aaaggaagaaagaaaauaauuuuccuuguaaaaucgggccaaaccccaagacagcuacauuuu

SEQ ID NO: 414875 - RNA, 64 nt, Human; identical to SEQ ID NO: 37099

SEQ ID NO: 414876 - RNA, 64 nt, Human
guuuuucccagaaaaucaguauuauuuuuuaaauaagaaaaacauuccuagaagaugauaauug

SEQ ID NO: 414877 - RNA, 64 nt, Human
cucucccugugccccuuggucuuuauucucaauuaagaaaaacagucacaugucacgacaaacc

SEQ ID NO: 414878 - RNA, 64 nt, Human
ugucauucagggccccucauguagccaaaagaccaagaaaaaucuggcccacagauaaguugca

SEQ ID NO: 414879 - RNA, 64 nt, Human
ugucauccuuggucuuuguaucuuccauauuuggaagaaaaaaaucuucuccagauuuuucgga

SEQ ID NO: 414880 - RNA, 64 nt, Human
uuacuggguuugcuuuucuuaaaacauaccaaaaaagaaaaaaauagaaaaaaaaaaaaaaaaa

SEQ ID NO: 414881 - RNA, 64 nt, Human
auuggagaaguauuuauuuucaaauaucaaauugaagaaaaacucaauccucccaugaaaauca

SEQ ID NO: 414882 - RNA, 64 nt, Human
gcaagacacucuggccaccauaaaaaacgcagaaaagaaaaaaagguuaagcauaaaaagaaag

SEQ ID NO: 414883 - RNA, 64 nt, Human
agucugggcaccgaaagagagcaucaaaaucaccaagaaaaacagcuucucaguuaagugaaaa

SEQ ID NO: 414884 - RNA, 64 nt, Human
aagcagggccaaauggaaagaacacauaauaaacaagaaaaaaacagaggugaagaaaaaucca

SEQ ID NO: 414885 - RNA, 64 nt, Human
agaacacauaauaaacaagaaaaaaacagaggugaagaaaaauccaagucugaacgggaaugcc

SEQ ID NO: 414886 - RNA, 64 nt, Human
auuaucuacaugagaauauacuaauuuuauaugcaagaaaaaaagcacaguauuuuuuaaaugc

SEQ ID NO: 414887 - RNA, 64 nt, Human
cagggcuggggccaagaggaaaaacagggaaaaaaagaaaaaaaaaagaaaaaggaaaaggaag

SEQ ID NO: 414888 - RNA, 64 nt, Human
ccaagaggaaaaacagggaaaaaaagaaaaaaaaaagaaaaaggaaaaggaagcgguguguggc

SEQ ID NO: 414889 - RNA, 64 nt, Human
aauuuaaacaaagaaacacuugaaagaaacuggaaagaaaaauaauuuuuuuaugugaacaaau

SEQ ID NO: 414890 - RNA, 64 nt, Human
aaaauaauuuuuuuaugugaacaaauuuugcaagaagaaaaaagcauaaaagacacuaacggca

SEQ ID NO: 414891 - RNA, 62 nt, Human; identical to SEQ ID NO: 37105

SEQ ID NO: 414892 - RNA, 64 nt, Human; identical to SEQ ID NO: 37110

SEQ ID NO: 414893 - RNA, 64 nt, Human; identical to SEQ ID NO: 37114

SEQ ID NO: 414894 - RNA, 64 nt, Human
auuguucaccugguuugaaauaauaaaauguagaaagaaaaaaaauaccgagaacugaugggua

SEQ ID NO: 414895 - RNA, 64 nt, Human
acuucuaaccauuucuuuuguguauucauguuuaaagaaaaaaagugauuuaaaaaugaucuua

SEQ ID NO: 414896 - RNA, 64 nt, Human
aggacuucaaagugugucugggauuuuuuuauuaaagaaaaaaaauuucuagcuguccuugcag

SEQ ID NO: 414897 - RNA, 64 nt, Human
agauuuaaauguguucuauuauuagaguagaucgaagaaaaaauuagucucagaaagagcuuuu

SEQ ID NO: 414898 - RNA, 64 nt, Human
uaaaguuuaauugaaagaauguaaagcaaccaaaaagaaaaaaaaaaagaaagaaagaggaaaa

SEQ ID NO: 414899 - RNA, 64 nt, Human
cugcaaacuauuuaaagaaauauguauucuguaaaagaaaaaaaaaaugcggccuuuucaugag

SEQ ID NO: 414900 - RNA, 64 nt, Human
gugauaagcacaaaucucuacuccucaugacaugaagaaaaagacugaaugugaagggaguuuc

SEQ ID NO: 414901 - RNA, 64 nt, Human
auacguuugacccauuuugaauaaggaaauugaaaagaaaaauuuaaaaggagaaaaaaaugca

SEQ ID NO: 414902 - RNA, 64 nt, Human
uuguugaagcauuuaucuuguugauuucuuacaaaagaaaaaggacgaugucagucaagcagca

SEQ ID NO: 414903 - RNA, 64 nt, Human
cuuaaugggucuugucuaucuucauuagucuucaaagaaaaaccauuugcuaccaaaguaaauc

SEQ ID NO: 414904 - RNA, 64 nt, Human
cacuauuauauaguggguuauauuaaaagaaaagaagaaaaauaucuaauuucucuuggcagau

SEQ ID NO: 414905 - RNA, 64 nt, Human
aguuucaaagcagguaaauuguaaauguuucuuuaagaaaaagcaugugaaaggaaaaagguaa

SEQ ID NO: 414906 - RNA, 64 nt, Human
aauuuaagcaugaauguguucuggaacacguuagaagaaaaauaaaagccaaugaguuuuuuuu

SEQ ID NO: 414907 - RNA, 64 nt, Human
uacaauucaagaaacugaguauuuaugggcauugaagaaaaaauguugagauaaaauugcugug

SEQ ID NO: 414908 - RNA, 64 nt, Human
gacuauauauuguuuuuuuuuuaaaaaaaaaaagaagaaaaaagagacagagaaaauugguauu

SEQ ID NO: 414909 - RNA, 64 nt, Human; identical to SEQ ID NO: 37119

SEQ ID NO: 414910 - RNA, 64 nt, Human; identical to SEQ ID NO: 37125

SEQ ID NO: 414911 - RNA, 64 nt, Human; identical to SEQ ID NO: 37129

SEQ ID NO: 414912 - RNA, 64 nt, Human
ccuuugaaagaaagaaguaauguucuuugaaagaaagaaaaaucucuugcugugucaaaccuca

SEQ ID NO: 414913 - RNA, 64 nt, Human
ucucagggugcucuuucuaacauaguaaaaaaugaagaaaaauguuuagauuaaaacucuguag

SEQ ID NO: 414914 - RNA, 64 nt, Human
cuauaaaagaacaccugagacuggguaauugauaaagaaaaagguuuguuuggcucacaauuuu

SEQ ID NO: 414915 - RNA, 64 nt, Human
cuguagauuucugaagugcauauucauugaugccaagaaaaaaaaaaaguugccuuuuugaagu

SEQ ID NO: 414916 - RNA, 64 nt, Human
ggaaaaagaaaccacaaauuggggaaaaaaaaagaagaaaaaccuguuuccgugugcaaaagca

SEQ ID NO: 414917 - RNA, 64 nt, Human
aguuuggguaaaggaugagcagacaagucaacuaaagaaaaaagaaaagcaaggaggaggguug

SEQ ID NO: 414918 - RNA, 64 nt, Human
acuccugaucguuucuguagaaagaugacaaauaaagaaaaaguuauaauuauuaauuauaguu

SEQ ID NO: 414919 - RNA, 64 nt, Human
uuucuuuuguauuuuguuauaaucuuaagcaacaaagaaaaaacccuaauauuugaaucuauuu

SEQ ID NO: 414920 - RNA, 64 nt, Human
cuucugagguacauuuugaaugacagcauauuguaagaaaaaaaaaggugaauaaaauuugaca

SEQ ID NO: 414921 - RNA, 64 nt, Human
gucuccucagcauaaagcuuucuuaagccucauuaagaaaaaaacugaaagcaaucuauccuug

SEQ ID NO: 414922 - RNA, 64 nt, Human
agauuugaaugaggaaugcuucccacauccuugaaagaaaaacuguggcuuacguuuugaagua

SEQ ID NO: 414923 - RNA, 64 nt, Human
cggacagucagaaugguuggaauuuuggcuuucuaagaaaaacuuuauuuugcauaagcaugug

SEQ ID NO: 414924 - RNA, 64 nt, Human
gaaaagguuaaacuggauuuuuuuuuuuaaaaaaaagaaaaaaaaagaagaaaaguauaccaga

SEQ ID NO: 414925 - RNA, 64 nt, Human
uuuauugcuguuuugucuuucuuuuuucuaaaaaaagaaaaaaaagaaaaaaaggaaaagaaga

SEQ ID NO: 414926 - RNA, 64 nt, Human
guuuugucuuucuuuuuucuaaaaaaagaaaaaaaagaaaaaaaggaaaagaagaacaaagaaa

SEQ ID NO: 414927 - RNA, 63 nt, Human
gccauucgccaucccgcgcaccuccagccuagcucgggccaagcggccaucggucuccuucgc

SEQ ID NO: 414928 - RNA, 63 nt, Human
aaccugggaggcggagauugcagugaaccaagaucgggccacugcacuccagcuugggugaca

SEQ ID NO: 414929 - RNA, 63 nt, Human
uggaauccacucuaaccaaucgcacuuaacgacucgggccaccacugggggggcagggggagg

SEQ ID NO: 414930 - RNA, 64 nt, Human
ccggacagcgaacuggaggggggagaaauuuucaaagaaaaacgagggaaaugggaggggugca

SEQ ID NO: 414931 - RNA, 64 nt, Human
agaaacagcauggagaaaacccgguacgcucaaaaagaaaaaggaaaaaaaaaaaucccaucac

SEQ ID NO: 414932 - RNA, 64 nt, Human
cagagugagauucugucucaaaagcaaacuaacaaagaaaaacaauacuuccugggguuuuggu

SEQ ID NO: 414933 - RNA, 64 nt, Human
gaaaacccaaaauauuaugcaaacuacuguaagcaagaaaaauaaaggaaaaauggaaacauuu

SEQ ID NO: 414934 - RNA, 64 nt, Human
caccuguucagccggcacugagaagaacgaacacaagaaaaagauaagaaauacuagaguaaag

SEQ ID NO: 414935 - RNA, 64 nt, Human
gaccaugauaauucaguuuauauucaccacaugaaagaaaaauggguaacagaagaacccuuaa

SEQ ID NO: 414936 - RNA, 64 nt, Human
aaguaauguugaccaucccccucucagcugaauaaagaaaaauuuaguucaauuuauugcaauu

SEQ ID NO: 414937 - RNA, 64 nt, Human
ccuuuggggaaguuuauuugagaaaauauaauaaaagaaaaaaguaaaggcuuuuaugucuucg

SEQ ID NO: 414938 - RNA, 64 nt, Human
auuuauuaauuuuaaaacauucagaacuuguugaaagaaaaauuauaucugaaucaagauucau

SEQ ID NO: 414939 - RNA, 64 nt, Human
ugguaaaaucaguuuuuugauaguguguguauauaagaaaaaauagauacacacauucuuuuuu

SEQ ID NO: 414940 - RNA, 64 nt, Human
guuuaagaagcuaauguuuaagaagcauuugggaaagaaaaagaaauaaauguauccagauagg

SEQ ID NO: 414941 - RNA, 64 nt, Human
ggcaacaagagugaaacugcaucucaaaaaaaaaaagaaaaaaaauuuacgcuucuuaaccauu

SEQ ID NO: 414942 - RNA, 64 nt, Human
uauaccauucucuguggccuguuuuuccuggaagaagaaaaaaaaagguuuggcaggccaucuu

SEQ ID NO: 414943 - RNA, 64 nt, Human
cauuguuugggggccaggcauuacuacuaucaugaagaaaaaugaagagcaggaugcauguuag

SEQ ID NO: 414944 - RNA, 64 nt, Human
cacuccagccugggccacagagcaagacugucucaagaaaaaaaauuuuuuaaauaaguuuaau

SEQ ID NO: 414945 - RNA, 63 nt, Human
ucccggacgcgaguggguguggaauugcuuuccucgggccaccgugggggcaccucuggccuc

SEQ ID NO: 414946 - RNA, 63 nt, Human
uuauuccuuccagcagggcccucuucccuagguucgggccagcaggaggugccggcuggaguc

SEQ ID NO: 414947 - RNA, 63 nt, Human
gucagcgagauguugggucuggaggugaugagaucgggccacacuugagcugagucaccagac

SEQ ID NO: 414948 - RNA, 64 nt, Human
uuuuugucuuguuaagaaaauuuagcauuucuaaaagaaaaaagcaacccucuuucaaacuguu

SEQ ID NO: 414949 - RNA, 64 nt, Human
aacuaguggauuccagggcugggggaaaaaaaaaaagaaaaaaccucauuacugaccucucaaa

SEQ ID NO: 414950 - RNA, 64 nt, Human
ucuuuggaaacuugccccuuauuuaaaaaaaaaaaagaaaaaaaagaguuuguuacucuauugu

SEQ ID NO: 414951 - RNA, 64 nt, Human
uucuuucacaaaggcagguucaaaauucuguugaaagaaaaaugcuuucugaaacugagguaua

SEQ ID NO: 414952 - RNA, 64 nt, Human
cuuuauucaagauaccugaacuggggugcuuuuuaagaaaaauuugggaaauauauauguuucu

SEQ ID NO: 414953 - RNA, 64 nt, Human
cugaugcacaguaaaauccgagaaacacugguuuaagaaaaaccuuguaaugaucgaauaccca

SEQ ID NO: 414954 - RNA, 64 nt, Human
aggagaaaagaaagcacacugccuaaauguguaaaagaaaaaugcagagguuauuaaaauguaa

SEQ ID NO: 414955 - RNA, 64 nt, Human
ugugguuacccauuuuuuagaaggagccguacagaagaaaaauuauucuacauuauguaggauu

SEQ ID NO: 414956 - RNA, 64 nt, Human
gucuuguuuguaaaaaaaaaaaaaaaaaaagaaaaagaaaaaaguguauuuuacuguuuucugu

SEQ ID NO: 414957 - RNA, 64 nt, Human
aagcuagucuuguuuguaaaaaaaaaaaaaaaaaaagaaaaagaaaaaaguguauuuuacuguu

SEQ ID NO: 414958 - RNA, 64 nt, Human
aguuuaaagcucgaaaacaauuguaauaaugcuaaagaaaaagucauccaaucuaaccacauca

SEQ ID NO: 414959 - RNA, 64 nt, Human
ggaagacauaagaaacuccauuuugaucuguacuaagaaaaauuguuucugcuuugagauguug

SEQ ID NO: 414960 - RNA, 63 nt, Human
ugauaauuugcuuaugucuuauaaaacucagcauaagaaaaauacugcccuaccuugacugug

SEQ ID NO: 414961 - RNA, 64 nt, Human
cuugaaauuuggggaggcaucucugauuuaaaaaaagaaaaaggcugcuugauguauguuaugc

SEQ ID NO: 414962 - RNA, 64 nt, Human
acaaaacuuauuucuaaaacagcuuaaaaauucaaagaaaaaccccaaacacugacauuaccua

SEQ ID NO: 414963 - RNA, 63 nt, Human
uaacuauuaugagggaggcauggcuuuccaccgucgggccaggaagagcaccuguugcugcaa

SEQ ID NO: 414964 - RNA, 63 nt, Human
caguucccagcgcuccucacggaucccucucucucgggccaggguggagcaggcucgccgcaa

SEQ ID NO: 414965 - RNA, 63 nt, Human
ggcggaccgggugggcaggggccugaggguggcucgggccagcccaccagccaauggaccccu

SEQ ID NO: 414966 - RNA, 64 nt, Human
agccagacucugucucaaaaaaaaaaaaaaagaaaagaaaaagauaaagggauugugaaaagag

SEQ ID NO: 414967 - RNA, 64 nt, Human
gcauuuuuuucucccucuuuaaaaaacccuuuaaaagaaaaaaaaaaguagauagugcuaaaua

SEQ ID NO: 414968 - RNA, 64 nt, Human
uucaugaucagacauaaacuuagcaucuuaauggaagaaaaaugaggggaacuucaauuaugau

SEQ ID NO: 414969 - RNA, 64 nt, Human
ggacagaacagaauaauaugaagcaggaucacaaaagaaaaaaaacuuuggcuuucauauucuc

SEQ ID NO: 414970 - RNA, 64 nt, Human
uaauuauuauuuggcaauaaugggggugggaaccaagaaaaauauuuauuuuguggaucuuuga

SEQ ID NO: 414971 - RNA, 64 nt, Human
uuaugaaugacuuucuacagaguuucuauuucuaaagaaaaaacaauuguucacaucccaucug

SEQ ID NO: 414972 - RNA, 64 nt, Human
gagccuguugugggagguagggaggaaauauguaaagaaaaacaggaagauaccugcacuaauc

SEQ ID NO: 414973 - RNA, 64 nt, Human
cagaucacacauauaaacuuauuucuaaaauuaaaagaaaaaaaaacuauagcagagaggcuaa

SEQ ID NO: 414974 - RNA, 64 nt, Human
aauuuuggugggcaucuaauccuacauaaugaaaaagaaaaacagaccauuuaaaaacucagac

SEQ ID NO: 414975 - RNA, 64 nt, Human
augaagagaauuuuucccugugaaaaguaagaccaagaaaaaacaaacuaaagacaugugacuu

SEQ ID NO: 414976 - RNA, 64 nt, Human
uccuggcuaucuuaaacaaguucauacauuugaaaagaaaaaaaaauguuguuuaaaaaauguu

SEQ ID NO: 414977 - RNA, 64 nt, Human
cuuagucuaaagacuguagcaaaaaaaaaaaaaaaagaaaaauuagauuuuacauaucuuugca

SEQ ID NO: 414978 - RNA, 64 nt, Human
uguggauucaaccaacugcagaucaaaaauauugaagaaaaaaucgcaucuguaccaaacaugu

SEQ ID NO: 414979 - RNA, 64 nt, Human
ugaauaucauugauuuuauaauuggugcuauuugaagaaaaaaauguacauuuauucauagaua

SEQ ID NO: 414980 - RNA, 64 nt, Human
augaaccaaaugguucuuacuuuuccuggacuuaaagaaaaaaagagguuuaaguuuguugugg

SEQ ID NO: 414981 - RNA, 63 nt, Human
cuuucccgcaggggauggacgaucucccaccuuucgggccauguugcccccgugagccaaucc

SEQ ID NO: 414982 - RNA, 63 nt, Human
cuucuugguugccgagacagagagaugguggucucgggccagccccuccucuccccgccuucu

SEQ ID NO: 414983 - RNA, 63 nt, Human
aggguuuuaagguggggagagauaagggcucucucgggccaugcuacccgguaugacugggua

SEQ ID NO: 414984 - RNA, 64 nt, Human
aucuuugacuuuuaccacaaaucuucauuuauaaaagaaaaagccaaagugaaaaaaaguuaga

SEQ ID NO: 414985 - RNA, 64 nt, Human
cuuuggcucuagaaaaauuucaaacaauuaaaauaagaaaaaauuuuaaacugguuuuuuauaa

SEQ ID NO: 414986 - RNA, 64 nt, Human
uugaaaacuacguaaacucuggaaaguauucuauaagaaaaagcuggaccuaggauuuagggcu

SEQ ID NO: 414987 - RNA, 64 nt, Human
gagggagauaugauuauauuguauuuucucagauaagaaaaauguuuuuuaacaauauuauuuu

SEQ ID NO: 414988 - RNA, 64 nt, Human
cuuccaggcgcuuaaauuccuagcgaagugccguaagaaaaagaaacuauuugcuccuuggcga

SEQ ID NO: 414989 - RNA, 64 nt, Human
aaaacaauaauuuuuucaacaaauuguaaauuauaagaaaaagaguugguuuguguacaacaau

SEQ ID NO: 414990 - RNA, 64 nt, Human
uccuucauaaaaauauauuuacuuugccaauaaaaagaaaaagaacucacagcuuuuggcauuc

SEQ ID NO: 414991 - RNA, 64 nt, Human
uggaucugagcuguguagcacuuguugcauuacaaagaaaaagacuucugcaggaaauagggua

SEQ ID NO: 414992 - RNA, 64 nt, Human
ccagaaguaacuuauuuuguacuaguguccgcauaagaaaaagaaucggcaguauuuucuguuu

SEQ ID NO: 414993 - RNA, 64 nt, Human
cccuucaacccccucgccuccuacucugagacaaaagaaaaaauauuaaaaaaaugcauaggcu

SEQ ID NO: 414994 - RNA, 64 nt, Human
aaaaaagaggaaaaaaaggcaaaaaauauugugaaagaaaaaaaacaacuuaauauauuuugga

SEQ ID NO: 414995 - RNA, 64 nt, Human
acauuugguucaugugcauuguuuacaaagcaaaaagaaaaaagaggaaaaaaaggcaaaaaau

SEQ ID NO: 414996 - RNA, 64 nt, Human
acacaggugauugaacguaugagagggaaaggcaaagaaaaaggaagccagacacuaggagaau

SEQ ID NO: 414997 - RNA, 64 nt, Human
uuuugguggggugggggugggcuaaagccauaggaagaaaaaugugauguauguguccaguaug

SEQ ID NO: 414998 - RNA, 64 nt, Human
aaagaagagcugcagcuuugacagugcuuauuuaaagaaaaauacugcuggaaaauuuccaauu

SEQ ID NO: 414999 - RNA, 64 nt, Human; identical to SEQ ID NO: 37133

SEQ ID NO: 415000 - RNA, 64 nt, Human; identical to SEQ ID NO: 37137

SEQ ID NO: 415001 - RNA, 64 nt, Human; identical to SEQ ID NO: 37141

SEQ ID NO: 415002 - RNA, 64 nt, Human
ugaugcaacugauuuauacaaaaugaacuuuggcaagaaaaauaacauuaaccucauuguuuau

SEQ ID NO: 415003 - RNA, 64 nt, Human
uugcccuuucaaagcaggaggaagaaaaggaagaaagaaaaacuguuucaucauuucuguuagg

SEQ ID NO: 415004 - RNA, 64 nt, Human
accaauuggggaaguuucacccucucccuaucugaagaaaaaaaucaaaaacaaauguccccgg

SEQ ID NO: 415005 - RNA, 64 nt, Human
aguuucacagacaucauagauccuuuucuuaaagaagaaaaacauguauaaaauaguuuuagua

SEQ ID NO: 415006 - RNA, 64 nt, Human
ugagaggaggcagagagagggaggcagauggaagaagaaaaacaguuaaauaagacauacccag

SEQ ID NO: 415007 - RNA, 64 nt, Human
ccuggagagcagagcaagacucugucucaaaaaaaagaaaaaaguuuuauuauccuuacuuuuu

SEQ ID NO: 415008 - RNA, 64 nt, Human
cugagccuuaaaacacagauugaagaagaaaagaaagaaaaaacuuaaauauuuauuucuaugc

SEQ ID NO: 415009 - RNA, 64 nt, Human
uggucaaaaucugcaaacucuaaaagaagaaaagaagaaaaaaccaagcuuaggguauuuuucc

SEQ ID NO: 415010 - RNA, 64 nt, Human
gcuuuugugccccuuaaauguagauaugugcugaaagaaaaaaaaaacgcccaacucuugaagu

SEQ ID NO: 415011 - RNA, 64 nt, Human
acuuccguagauaauguggaaaucaaauuuaaccaagaaaaaaagauuggaacaaaugcucucu

SEQ ID NO: 415012 - RNA, 64 nt, Human
uaucggauguguugggcuccaugcaagaacuuggaagaaaaacaggcaggaaugcauuugcaua

SEQ ID NO: 415013 - RNA, 64 nt, Human
acaccacaggcauuguauuaucauugccaaugucaagaaaaagagcuaaauuuaccaagccaug

SEQ ID NO: 415014 - RNA, 51 nt, Human
cagagcuuaguaauuucuaaaaagaaaaaaugaucuuuuuccgacuucuaa

SEQ ID NO: 415015 - RNA, 64 nt, Human
ugauuaaccaaggguaagcauguuuugguugcuaaagaaaaaagcauaaucuuuaaccgaguau

SEQ ID NO: 415016 - RNA, 64 nt, Human
uuuuuagauuuuguugaguccuguaaagaagaagaagaaaaaaguuucaguugugguagaauac

SEQ ID NO: 415017 - RNA, 63 nt, Human
cggccagacguggcuucuccugaguucuagggcucgggccagaguggcacuacugcccggcca

SEQ ID NO: 415018 - RNA, 63 nt, Human
gagccacagucccagaaccaagcucucggugucucgggccaccauccgcccaccucgggcuga

SEQ ID NO: 415019 - RNA, 63 nt, Human
cagcauuugggauccaggcuaccuagaggggcaucgggccagggaaaaccucggauuagcaag

SEQ ID NO: 415020 - RNA, 64 nt, Human
agcuucuuuuauauucaagcuaaacaugaaaaagaagaaaaacaauaaaguaaaccugagcccc

SEQ ID NO: 415021 - RNA, 64 nt, Human
uaacauucagacaaguaacaggcaacaaagauuuaagaaaaauuuaugguggaaaaccuuaaaa

SEQ ID NO: 415022 - RNA, 64 nt, Human
augucaacacacuuaaacuacaugcuaaauagucaagaaaaaaauggaaacaguagcauccaua

SEQ ID NO: 415023 - RNA, 60 nt, Human
gggccuuuuuaguuggcuaacugaccuggaaagaaaaagcaauaaccucaaagugacuau

SEQ ID NO: 415024 - RNA, 64 nt, Human
aauuucuauucaggcuacuggaauugguuauuaaaagaaaaaggaaaaagaagaaucuugcugc

SEQ ID NO: 415025 - RNA, 64 nt, Human
ucauaacuuuaauucaagaaugcaguuuuaccaaaagaaaaauuugaaaauuucuauucaggcu

SEQ ID NO: 415026 - RNA, 64 nt, Human
ugugacaaaaaaaaaaaaaaaaaaaagaaaaaaaaagaaaaaacagaaauauauccagcuaaca

SEQ ID NO: 415027 - RNA, 64 nt, Human
aacaguguucugugacaaaaaaaaaaaaaaaaaaaagaaaaaaaaagaaaaaacagaaauauau

SEQ ID NO: 415028 - RNA, 64 nt, Human
ugaaaauguuuauuuaaaaaaaaaaaagaugacaaagaaaaacagagagagagaauauuggaga

SEQ ID NO: 415029 - RNA, 64 nt, Human
caggaacccaccaaaccaaccaaucaaccaaacaaagaaaaaauuccacaaugaaagaauguau

SEQ ID NO: 415030 - RNA, 64 nt, Human
uccacugaugaaaagagguguuuuguacuuacauaagaaaaauaaauuucugauugauuuuaac

SEQ ID NO: 415031 - RNA, 64 nt, Human
caaaucaggagugguguagagacauccaaauuuaaagaaaaaaaaacacaaaacagaauguuaa

SEQ ID NO: 415032 - RNA, 64 nt, Human
uagauggcaucuuuuuaaaaaguuauauuuucuaaagaaaaaaauaaaaaaaguuguauuuucu

SEQ ID NO: 415033 - RNA, 64 nt, Human
augaacuuugguucuucaugagugcauuuugaaaaagaaaaaaaguacacauucagaaucuggc

SEQ ID NO: 415034 - RNA, 64 nt, Human
aagaagcucaaagaaaagaaguacguuaaagaaaaagaaaaaaccucacuuuuccuuuauagug

SEQ ID NO: 415035 - RNA, 63 nt, Human
ccucucagugugggcagcccucgcaugcuggggucgggccagcucuccccgaaaggucuugac

SEQ ID NO: 415036 - RNA, 63 nt, Human
gagucccugcaacagcaauaaacuuccuucuccucgggccaccuggauccuugauuugugcag

SEQ ID NO: 415037 - RNA, 63 nt, Human
ugccauccaccacccugugaggcaccagggcauucgggccacagggcggugcuagcuugacac

SEQ ID NO: 415038 - RNA, 64 nt, Human
uugaccaagaagcucaaagaaaagaaguacguuaaagaaaaagaaaaaaccucacuuuuccuuu

SEQ ID NO: 415039 - RNA, 64 nt, Human
cuuuuaaagauaguuuugcuguugcuccuagugaaagaaaaaucucuguacaaaggagaaaaag

SEQ ID NO: 415040 - RNA, 64 nt, Human
aaccuuuaaacagcccucaccggugaauaaacauaagaaaaaucaugcuggagggaagcccuac

SEQ ID NO: 415041 - RNA, 64 nt, Human
aaaucuucaaaaaauauauuuuagucuguuauuuaagaaaaacauaacaucccaaaaucuuuga

SEQ ID NO: 415042 - RNA, 64 nt, Human
aucagcauaccuuuauugugaucuaucaauagucaagaaaaauuauuguauaagauuagaauga

SEQ ID NO: 415043 - RNA, 64 nt, Human
agccacaguaaaaaaaaaaaaaaaaaaaaaaaaaaagaaaaaaaaaucaaaauguauaaauauu

SEQ ID NO: 415044 - RNA, 64 nt, Human
uaggugaauuuuuccugaaaaaucuaguggcuaaaagaaaaacaaaagaccucuaaaacuucaa

SEQ ID NO: 415045 - RNA, 64 nt, Human
uuaaaagaggaaaaaggacauaguagugguaguaaagaaaaaaaggagaucuaacaaaaacacu

SEQ ID NO: 415046 - RNA, 64 nt, Human
cuuuaaauggucaggcuccagucggaauuuuuuuaagaaaaaaguaguuuuuaauacauugguu

SEQ ID NO: 415047 - RNA, 64 nt, Human
gacagaguaacacucugucucagaaaaaaaaaaaaagaaaaauauaugggguaaauacaguaaa

SEQ ID NO: 415048 - RNA, 64 nt, Human
auacacugauguucuucacuaaauggauggccacaagaaaaauaaaguaaaugucuuaaauaau

SEQ ID NO: 415049 - RNA, 64 nt, Human
aaggugcagaacaaggagugaaagaaaauauaagaagaaaaaaauccccuacauuuuauuggca

SEQ ID NO: 415050 - RNA, 64 nt, Human
caagauuucuuucuuccugagacaaaaaaaaaaaaagaaaaaaaaaucuuuucaaaauuuacuu

SEQ ID NO: 415051 - RNA, 64 nt, Human
cacuuccuugaagaaucaaaauuccuguuaauaaaagaaaaacaaauguaauugaaauagcaca

SEQ ID NO: 415052 - RNA, 64 nt, Human
uuuuuugccuuggugacuuuugaaaaaaaaagaaaagaaaaagcagcauccuuauauuucuuua

SEQ ID NO: 415053 - RNA, 63 nt, Human
cgccugccgcgccagacguggagcaucagugaaucgggccacaucugcagccagauguucgaa

SEQ ID NO: 415054 - RNA, 63 nt, Human
cagaaauacuuccugcgagcauaucgacaacucucgggccaggcgcuguggcucacaccuaua

SEQ ID NO: 415055 - RNA, 63 nt, Human
aaucaucaagagaauuuggggcuuccaaguuguucgggccaaggaccugagaccugaaggguu

SEQ ID NO: 415056 - RNA, 64 nt, Human
caugauuuaauauaugugguuugggggaaaggacaagaaaaaacuauaauuccacauauaagaa

SEQ ID NO: 415057 - RNA, 64 nt, Human
ugcuuguaaauccuaaucuuagaguuaucaaaagaagaaaaaacugaagguacuuuacucccua

SEQ ID NO: 415058 - RNA, 64 nt, Human
auuggcaacugaagccagcugcuggagauauguaaagaaaaaagcaccaaagguaauacccucu

SEQ ID NO: 415059 - RNA, 64 nt, Human
uaugucauauauuaaaaaagagcuugcuuacuacaagaaaaauauugaaauauugaaaauauug

SEQ ID NO: 415060 - RNA, 64 nt, Human
cuaaccauuuauauaaaacuuaaaaacaagagaaaagaaaaaucaauuagaucuaaacaguuau

SEQ ID NO: 415061 - RNA, 64 nt, Human
cagcccacaagugaucagcagaguugcauuuccaaagaaaaaggcuaugagaugagcugaguua

SEQ ID NO: 415062 - RNA, 64 nt, Human
gccagaacuuucuuucacgguuacuguuccugaaaagaaaaagccaccuagcccuaucaagcca

SEQ ID NO: 415063 - RNA, 64 nt, Human
cucaggaguuucuauaggugucuucagaguucugaagaaaaauuacuggacacagcuucagcua

SEQ ID NO: 415064 - RNA, 64 nt, Human
cacaguuuuaacuuguucaaucugcuucaaaaacaagaaaaacaacaacuaugaguuaucaaaa

SEQ ID NO: 415065 - RNA, 64 nt, Human
gccuagacaacauagugagacuuggucucuaaaaaagaaaaaaaaaaauaaaacugauguaaug

SEQ ID NO: 415066 - RNA, 64 nt, Human
agugcguaucgccaaugcaggaugcuccuuagaaaagaaaaaaugguaaagaauggcauuuaac

SEQ ID NO: 415067 - RNA, 55 nt, Human
acucaaccagugaugauuagaacaaaagaaaaacccguaagauuccuuuugugaa

SEQ ID NO: 415068 - RNA, 64 nt, Human
aaaaaauacaauuucucacuuugcauuuagucaaaagaaaaaaugcuuuauagcaaaaugaaag

SEQ ID NO: 415069 - RNA, 64 nt, Human
uuggaaggcuuuccacaaacuaaccuuggaugaaaagaaaaaauuccucuguaaguacuguggu

SEQ ID NO: 415070 - RNA, 64 nt, Human
gcuauuucagaccucuguuuggucagaaauggaaaagaaaaagcccccuuucuucccuuuucug

SEQ ID NO: 415071 - RNA, 57 nt, Human
cugucaccgucuccucuuagagcucacucgggccaggcccugaucugcgcuguggcu

SEQ ID NO: 415072 - RNA, 63 nt, Human
ucuacccauuaacacuuguuagagacaccucagucgggccacaacugucucuguuucaacuuu

SEQ ID NO: 415073 - RNA, 63 nt, Human
ccacaucaaaaaugcaucaagucuccacguguuucgggccagggcguggcuuggcauugaccu

SEQ ID NO: 415074 - RNA, 64 nt, Human
agaauuaguuguauaggguuggcccaagagauguaagaaaaaucucgcauugcucccuaagcac

SEQ ID NO: 415075 - RNA, 64 nt, Human
gcagauuuguaagugaaguagaauaaaauugaauaagaaaaagaucuauaaccuagguaaagca

SEQ ID NO: 415076 - RNA, 64 nt, Human
cuguauuaagcuaucugaauuuauucgagacauuaagaaaaagacaguacauggugggaaagcu

SEQ ID NO: 415077 - RNA, 64 nt, Human
uccaguaguaaaauauguaaccauugucccaguaaagaaaaauaacaaaaguuguaaaauguau

SEQ ID NO: 415078 - RNA, 64 nt, Human
gguuaaacaugguuagaaacaacugaaagcauaaaagaaaaaucuaggccgggugcaguggcuc

SEQ ID NO: 415079 - RNA, 64 nt, Human
guugugacaaccacaagcacuuuuuuuuuuuuuaaagaaaaaaagguagugaauuuuuaaucau

SEQ ID NO: 415080 - RNA, 64 nt, Human
aaagguaauucagggucccaaagacaaacuuacuaagaaaaaaucauuaauaguuuucucccaa

SEQ ID NO: 415081 - RNA, 64 nt, Human
guuuuuauagaacugauaaucaggcuuauggcauaagaaaaaugaguuucaaauuuaagauguu

SEQ ID NO: 415082 - RNA, 64 nt, Human
agcauagcaaacagaggaagaauuuguuaucaguaagaaaaagaagaacuauaugugaauccuc

SEQ ID NO: 415083 - RNA, 64 nt, Human
aauguauguacucacuucaguacuucagcucuucaagaaaaaaaaaaaaaaccuuaaaaagcua

SEQ ID NO: 415084 - RNA, 64 nt, Human
agguacgguguuccauauuaaauacagcaauaugaagaaaaauaaauuaagucccuuauaccua

SEQ ID NO: 415085 - RNA, 64 nt, Human
gaagauuuuuguccaugcuugauuuuuuuuuuuaaagaaaaacuuucauggguuagcauuaccu

SEQ ID NO: 415086 - RNA, 64 nt, Human
ugcaggaaaauaauauuuuuauguauaaaagaugaagaaaaaauuuugcaagucuuuaagcaca

SEQ ID NO: 415087 - RNA, 64 nt, Human
cuugaucccacugaucuugacaucaagucuaacaaagaaaaaguuuugaguuuuguauuuucuu

SEQ ID NO: 415088 - RNA, 64 nt, Human
ccacagugccuacaacccaggcccuaaguugaugaagaaaaagucaaggaaggaggugauacaa

SEQ ID NO: 415089 - RNA, 63 nt, Human
aggcggacagauggccuggaaaccucuggcuaaucgggccauccguagagcgggaaccuuccu

SEQ ID NO: 415090 - RNA, 63 nt, Human
aucaaggaagcuccaugcucaggcucucagcucucgggccagugcucugcucuguccagggua

SEQ ID NO: 415091 - RNA, 63 nt, Human
agacacaguacccugggaggcauaggagaagggucgggccagcccagcccagggccugaguua

SEQ ID NO: 415092 - RNA, 64 nt, Human
ccauuaccuuuccucugccugaaagacgugucucaagaaaaauaaauucuauuuuagaugcagg

SEQ ID NO: 415093 - RNA, 64 nt, Human
uucuguuuuaaacuuuggguaccaaaccaaaaagaagaaaaaagaaaggaaaagaucuucuuug

SEQ ID NO: 415094 - RNA, 64 nt, Human
ggauuacugaagcggaaagcggucucccauguauaagaaaaaguuuuacaacacgaauuggaag

SEQ ID NO: 415095 - RNA, 64 nt, Human
gccuucaagggacaacuuuuuuaacuuuggagaaaagaaaaacacucuauaacagagaguggaa

SEQ ID NO: 415096 - RNA, 64 nt, Human
gaaguaaaucuccuucaacguuauauauguacagaagaaaaaaaguugaucauagcuuuuuguc

SEQ ID NO: 415097 - RNA, 64 nt, Human
agaaauguagcauuagcucucacaaaagaggaccaagaaaaaucaacaaacaaaucaaagccag

SEQ ID NO: 415098 - RNA, 64 nt, Human
ucuuccuuuaaagcaagaaaucauguuauuuagaaagaaaaacuaaucuuaaacauacuauuuc

SEQ ID NO: 415099 - RNA, 64 nt, Human
augaccagaacuugucaaugagaaaccacuuguuaagaaaaaguccaguguuuauuucucaaga

SEQ ID NO: 415100 - RNA, 64 nt, Human
aauagcuuuuccuucugaaccacguucuauguaaaagaaaaaaaauagcuuugauuuucucacu

SEQ ID NO: 415101 - RNA, 64 nt, Human
ucccugcuaauguaauuggaagcuugguacacauaagaaaaacuagagauuugaaaucagcuau

SEQ ID NO: 415102 - RNA, 64 nt, Human
cugauucucauaguaaauacaagcauacucuuguaagaaaaacacugaauacuuugaaccacaa

SEQ ID NO: 415103 - RNA, 64 nt, Human
uuuaaaauuaagagagcagcaaaugaaaggaguaaagaaaaaaauagcugucggguaggaugcc

SEQ ID NO: 415104 - RNA, 64 nt, Human
auaaaagaagcagaagccaaagcugcucuugaagaagaaaaacgaagacaacagguaaccaaac

SEQ ID NO: 415105 - RNA, 64 nt, Human
aauauuugcucaauaugaucuugauauuccuacaaagaaaaaagaagggguagggauuuggcua

SEQ ID NO: 415106 - RNA, 64 nt, Human
acagaaacuccaacuggcaaaaaagcaagcaucuaagaaaaaaaaccaccaaaguucuugaauu

SEQ ID NO: 415107 - RNA, 63 nt, Human
ucccggcauuucaugucuucccacgggguugagucgggccauaggggugagcagcugccugga

SEQ ID NO: 415108 - RNA, 64 nt, Human
uggaagacagccauguguagugauggauaauuuaaagaaaaaaagaauccuuguuucuuggcuu

SEQ ID NO: 415109 - RNA, 64 nt, Human
gcccauaauaucaacuuucccuccuauaguuaaaaagaaaaaaaaugaaucuauuuuucucuuu

SEQ ID NO: 415110 - RNA, 64 nt, Human
ugaaaaaucaaagaacauuauguuccuccguagcaagaaaaauuuuaugcccucgcauugcuac

SEQ ID NO: 415111 - RNA, 53 nt, Human
agaagaaaaaaagagaauaggucaagaaaaagaggaaauauauauauuuuuaa

SEQ ID NO: 415112 - RNA, 64 nt, Human
auucauuggaagaaaucaccaaagauuauuacaaaagaaaaauauguugcuaagauuguguugg

SEQ ID NO: 415113 - RNA, 64 nt, Human
caagucuuacauagaaaaaaaagguagauaugaaaagaaaaaucacagaagagagaaugcaaau

SEQ ID NO: 415114 - RNA, 64 nt, Human
aaacauaauuuugugcaauuaacaaagcuacugcaagaaaaauaaaacauuucuugguaaaaac

SEQ ID NO: 415115 - RNA, 64 nt, Human
acacaucugaaauacaaaauguuuuugucuaccaaagaaaaauguugaaaaauaagcaaaugua

SEQ ID NO: 415116 - RNA, 64 nt, Human
uuuguuuaaaacuggauuucaauguaagcaaaugaagaaaaaaauauagauuucauuuccauag

SEQ ID NO: 415117 - RNA, 64 nt, Human
gcagaaacaccgugggggaggaaggcagcagcugaagaaaaaagcucaaaugaucuagucacuu

SEQ ID NO: 415118 - RNA, 64 nt, Human
aaagccagugccuauugaguauaucaaaccaaaaaagaaaaaaaaaaguuuuaagaggggucag

SEQ ID NO: 415119 - RNA, 64 nt, Human
agaaauaccuuuagaggugacuuuaaggaaaaugaagaaaaagaaccaaaaugacuuuauuaaa

SEQ ID NO: 415120 - RNA, 64 nt, Human
caugacauuucgcagugcagagaaggcagaacccaagaaaaacgucaucuuugagacuuugcuu

SEQ ID NO: 415121 - RNA, 64 nt, Human
aggggggcagagauggaugaagagaaagcccacgaagaaaaaagccugguuuuguuuuucccag

SEQ ID NO: 415122 - RNA, 64 nt, Human
augcccacuuuacucggacaucaucacgggaguuaagaaaaauuguguaaauuuguaccuugaa

SEQ ID NO: 415123 - RNA, 63 nt, Human
cucccccuagcccagccccagucacugucagggucgggccagccccugcacugccucgcagag

SEQ ID NO: 415124 - RNA, 64 nt, Human
uuggcaaucaaagcaugcacuuguaacaaugaaaaagaaaaagcauuuuauauuacuacucaau

SEQ ID NO: 415125 - RNA, 64 nt, Human
aaaaaaaaaaaaaaucugccuaugcauguuuuuuaagaaaaaaaaaauggcuguaucggccugu

SEQ ID NO: 415126 - RNA, 64 nt, Human
auuaggcagucuuaaaaaaaaaaaaaaacagaaaaagaaaaaaaagaacguugcaaauuuguua

SEQ ID NO: 415127 - RNA, 64 nt, Human
cuaauauaaauuauuccaagucuuuaaggagccaaagaaaaaaaagauuucucacagcuuuuug

SEQ ID NO: 415128 - RNA, 64 nt, Human
uacuucugcuguucaaucaagagucuugguagauaagaaaaaaaucagucaauauuuccaaaua

SEQ ID NO: 415129 - RNA, 64 nt, Human
ucacauuaaaucuugcuuuuuuuccccuuaaaaaaagaaaaaaauuaccaaacaauaaacuugg

SEQ ID NO: 415130 - RNA, 64 nt, Human
guacugccagauauaagggcacugccuggcauagaagaaaaaauuauuaucaccagauauucua

SEQ ID NO: 415131 - RNA, 64 nt, Human
ggaacugaggaggaagccauagcucagggucaucaagaaaaauaauagacaaaagaaaauggca

SEQ ID NO: 415132 - RNA, 64 nt, Human
ugugaagcagcuauacguggcauacauguauuuaaagaaaaaaaaauagauguagaguguuuuu

SEQ ID NO: 415133 - RNA, 64 nt, Human
uccucagaagccuauuuuuaaagcagaagcaaaaaagaaaaacaaaauaacaaaaacaacccuu

SEQ ID NO: 415134 - RNA, 64 nt, Human
aggggucuggggaccaugguauaaagaggaaaccaagaaaaagaagccaagcaaaaaucaggcu

SEQ ID NO: 415135 - RNA, 64 nt, Human
guauauacauaugacauauauauuaaaauguaggaagaaaaauguuugaguaccugaugaaaau

SEQ ID NO: 415136 - RNA, 64 nt, Human
uccauguugcuuuauauguagccuugccuuuuaaaagaaaaaguaugugaauaugaauugacag

SEQ ID NO: 415137 - RNA, 64 nt, Human
uuagaaauggaauggccuuggaugucuaucagugaagaaaaauguucuguuagaagaucucucu

SEQ ID NO: 415138 - RNA, 64 nt, Human
uucccaaacuuuucuuuuuggcuuugucagggaaaagaaaaauaucuuuauaaagaaaucuuug

SEQ ID NO: 415139 - RNA, 64 nt, Human
cccacuuuuaaagaugggucucaaccccuccccaccacgucaugauggauggggcaagguggug

SEQ ID NO: 415140 - RNA, 64 nt, Human
cccugaggccuccugggagaucugccaaccacgcccacgucauuugcauacgcacucccgaccc

SEQ ID NO: 415141 - RNA, 63 nt, Human
ucgauuucaccaagaaguggagacuuuucggcaucgggccaucucagauacuuggcugacggu

SEQ ID NO: 415142 - RNA, 64 nt, Human
acucuccagaaaauuuuucugucagugaaaauaaaagaaaaauuaaaguaaagcuaaggaacug

SEQ ID NO: 415143 - RNA, 64 nt, Human
cuaauggcuuguuuguguaaagcuuuuuuauuaaaagaaaaauuuuaaaaaucuuguaccuagc

SEQ ID NO: 415144 - RNA, 64 nt, Human
ccucuuacaguaggaaacaacugaacccaucaauaagaaaaaggaucgaaagggaccaagcagc

SEQ ID NO: 415145 - RNA, 64 nt, Human
guggccaaacuuauuuaugcugcuaaaugaaagaaagaaaaaagcaaauuauuuuuuuuuauuu

SEQ ID NO: 415146 - RNA, 64 nt, Human
ccuucccccugcaaaaagaaaaaaagaaaagaaaaagaaaaaaaucccuuguucucaguggugc

SEQ ID NO: 415147 - RNA, 64 nt, Human
cccugcccuucccccugcaaaaagaaaaaaagaaaagaaaaagaaaaaaaucccuuguucucag

SEQ ID NO: 415148 - RNA, 64 nt, Human
uagacgauauacucccugcccuucccccugcaaaaagaaaaaaagaaaagaaaaagaaaaaaau

SEQ ID NO: 415149 - RNA, 64 nt, Human
aauauauggacuuuauuuugaucuuaauguaaacaagaaaaauaaagaguauuuaugggauggu

SEQ ID NO: 415150 - RNA, 64 nt, Human
guugagucaggauaacagagagauaccacauggcaagaaaaacaaagugacaauuguagagucc

SEQ ID NO: 415151 - RNA, 64 nt, Human
uugggaaauuaguguauuuuauaaaaauuuuaaaaagaaaaaagacuacuacagguuaagauaa

SEQ ID NO: 415152 - RNA, 64 nt, Human
guacuccaaaaauauuauauuuaagaugcucaacaagaaaaaaaugcaaauguaauauuuuuuu

SEQ ID NO: 415153 - RNA, 64 nt, Human
gacccccagaucacuaagcuugcauuuuggcagaaagaaaaaaaaucaguugugauuuaaaacg

SEQ ID NO: 415154 - RNA, 64 nt, Human
gcuuaaaauagaguauacaaguuuuuuagacccaaagaaaaaaacagcagagucucagcaugau

SEQ ID NO: 415155 - RNA, 64 nt, Human
aagaccccauccuccaccccccccaaaaaauagaaagaaaaaaaaaguuugcacuaauugaggu

SEQ ID NO: 415156 - RNA, 64 nt, Human
aaggaaaauaguaauguuuuauacuguuuacugaaagaaaaagaccuaugagcacauaggacuc

SEQ ID NO: 415157 - RNA, 64 nt, Human
uucccggccggagagugccucuccccucugccauccacgucaggucuuugguggggggacccca

SEQ ID NO: 415158 - RNA, 64 nt, Human
cugaaagugucauccuaaguaccuugaaaugagaccacgucagagacauguacugccccucaca

SEQ ID NO: 415159 - RNA, 63 nt, Human
aggaggaggagccgugacccuguggaaggugcgucgggccagggccacacccaagggcccagc

SEQ ID NO: 415160 - RNA, 64 nt, Human
ucuaagcuuugacacgucaaaaugugggaucagaaagaaaaaaaucaugauauuuaaaaauggu

SEQ ID NO: 415161 - RNA, 64 nt, Human
ucucaucagcccaggucccagugccauuggcuucaagaaaaaaaaaaaaucucuccccaaugcu

SEQ ID NO: 415162 - RNA, 64 nt, Human
cuuuaaaaauaacuuagauucaaauuuauaguagaagaaaaaaaaucuuucagauaagaggugu

SEQ ID NO: 415163 - RNA, 64 nt, Human
uaucuuacgucuaauuaguguagcauuuacaagaaagaaaaauuaagaucuuaaaaucagugau

SEQ ID NO: 415164 - RNA, 64 nt, Human
gccuucuguuacaccucaaaauguguuacaugggaagaaaaagauuaagaaaaagcaagauaau

SEQ ID NO: 415165 - RNA, 64 nt, Human
accucaaaauguguuacaugggaagaaaaagauuaagaaaaagcaagauaauuuugaagaagga

SEQ ID NO: 415166 - RNA, 64 nt, Human
ugggaagcauuacuuuguagauguauuuucaauaaagaaaaaaauaguuuuacauuaacaucuu

SEQ ID NO: 415167 - RNA, 64 nt, Human
uuaagagaaagaauuuaguauuaucaaagggauaaagaaaaaaauacuauuuaagaugugaaaa

SEQ ID NO: 415168 - RNA, 64 nt, Human
uaagauaucuguaaguguuauaucccuaaccaagaagaaaaauaugaaaauaauuaagacuaga

SEQ ID NO: 415169 - RNA, 64 nt, Human
uaaagcugguuuaauguuuuggccaaugcaccuaaagaaaaacaaacucguuuuuuacaaagcc

SEQ ID NO: 415170 - RNA, 64 nt, Human
cucugaguggacuggccucaaagcaagcauucagaagaaaaagaagcaaccucaguaauuuaga

SEQ ID NO: 415171 - RNA, 64 nt, Human
aaacaugaaaugcuuccaagcaugacaacuuuuaaagaaaaauaugauacucucagauuuuaag

SEQ ID NO: 415172 - RNA, 64 nt, Human
ucagggagcuauuuucauuuagugcuaaacaaguaagaaaaauaagcucgagugaauuucuaaa

SEQ ID NO: 415173 - RNA, 64 nt, Human
accccgcaaacaagaauuaagaugaucccaauaaaagaaaaauugcucaggaaacugaaccuuu

SEQ ID NO: 415174 - RNA, 64 nt, Human
acaguuggagccaaugccucauaguguaaacugaaagaaaaauaguugcuuuuuaaaaugucag

SEQ ID NO: 415175 - RNA, 63 nt, Human
ucuuggcuuucccacagaggcaggaguccuaccucgggccaacacucuuucuccuugguggaa

SEQ ID NO: 415176 - RNA, 63 nt, Human
cacugagcgggacucaggccaagaggcgugaccucgggccagccugucuguugugcagacgcc

SEQ ID NO: 415177 - RNA, 63 nt, Human
aggucucuugucucuugggaaggaacugauaggucgggccauuguugggccaucacugagcgc

SEQ ID NO: 415178 - RNA, 64 nt, Human
aaggcuacugacccuaaauuucugaagcacagccaagaaaaauuacauuccuugucauuguaaa

SEQ ID NO: 415179 - RNA, 64 nt, Human
acauguuugggaaguccuacugauguuccuuuggaagaaaaaaucugcugguuuuaacaacugu

SEQ ID NO: 415180 - RNA, 64 nt, Human
gugggaaacugagaaaucauaaaauuguacucugaagaaaaagauuucaaaaucuaccagcaga

SEQ ID NO: 415181 - RNA, 64 nt, Human
uggccucauuucuucaaaauaucaaguguugggaaagaaaaaaggaaguggaauggguaacucu

SEQ ID NO: 415182 - RNA, 64 nt, Human; identical to SEQ ID NO: 415181

SEQ ID NO: 415183 - RNA, 64 nt, Human; identical to SEQ ID NO: 415162

SEQ ID NO: 415184 - RNA, 64 nt, Human
auuauuacgccaacucaaguaguuaaaaaucaguaagaaaaaugucuugagcuagaagaaccca

SEQ ID NO: 415185 - RNA, 64 nt, Human
gaccuuagaaaucauuguagaaacacaguuuugaaagaaaaauaccaugucucuaagccaacuu

SEQ ID NO: 415186 - RNA, 64 nt, Human
uuaacccucugaguuuuuguauguauuauuauuaaagaaaaaugcaaucaggauuuuaaacaug

SEQ ID NO: 415187 - RNA, 64 nt, Human
aauaaaaauuauacaguaguaaagauaauucagaaagaaaaagcuaccuguuagaauuuccagu

SEQ ID NO: 415188 - RNA, 64 nt, Human
cccaaauuucauucuuagaaaguuauguuccaugaagaaaaauauauguucuuuugaauacuua

SEQ ID NO: 415189 - RNA, 64 nt, Human
gauucauaaggagcuuaucugaacagauuuaucuaagaaaaaaaaaaaacgacauaaaauaagu

SEQ ID NO: 415190 - RNA, 64 nt, Human
cuuguauuaguugguagcuuuuaaaaaauauaauaagaaaaaaguagagauucuccaaacucua

SEQ ID NO: 415191 - RNA, 64 nt, Human
cacagacugggagaacuaacaagugacauaacagaagaaaaauaucauucaagauugguucuga

SEQ ID NO: 415192 - RNA, 64 nt, Human
auauguuuuuguaucaaaaacacucauauauuucaagaaaaagaaauuauguuaaauagcccug

SEQ ID NO: 415193 - RNA, 63 nt, Human
cccaggcugcugacacccgcgcguggggaggacucgggccacgaaaggaaagaaauguauacc

SEQ ID NO: 415194 - RNA, 63 nt, Human
gaugacauggcccugccugagcccgggccggccucgggccacccacgagggccucccggccua

SEQ ID NO: 415195 - RNA, 63 nt, Human
uguucccucagccccagucgagaggaaagagaaucgggccacugccagaaagagagucaagca

SEQ ID NO: 415196 - RNA, 64 nt, Human
aagaaaaagaaauuauguuaaauagcccuguuuuaagaaaaauauuuaugaagcaucucaacuu

SEQ ID NO: 415197 - RNA, 64 nt, Human
agcuugggcaacagagcaagacuccaucucaaaaaagaaaaaagaaaagaaauagaauuaucaa

SEQ ID NO: 415198 - RNA, 62 nt, Human
gagacucugucucaaaaaaaaaaaaaaaaaaaaaaagaaaaagaaaaagaaaagaaaagaaa

SEQ ID NO: 415199 - RNA, 64 nt, Human
guggguuuuuucuuuuuucuuuuaccaguacaguaagaaaaaaaaaaaaaaaaaaaaagccaug

SEQ ID NO: 415200 - RNA, 64 nt, Human
auaugugguuggguaaugcaaauguaguuauacaaagaaaaauacagaugucuccagaccugag

SEQ ID NO: 415201 - RNA, 64 nt, Human
ggcaauguagugagacccugucucuaauuuaaaaaagaaaaagaaaaaaacauucccaguggca

SEQ ID NO: 415202 - RNA, 64 nt, Human
guagugagacccugucucuaauuuaaaaaagaaaaagaaaaaaacauucccaguggcagccugc

SEQ ID NO: 415203 - RNA, 64 nt, Human
uugauaugacugaauugcaaucuauauuuuuaaaaagaaaaaucaaaauacauuaggguuuacu

SEQ ID NO: 415204 - RNA, 64 nt, Human
uuuaauccauucuuaauauuuuaaaacuuuuguuaagaaaaacugccaguuugugcuuuugaaa

SEQ ID NO: 415205 - RNA, 64 nt, Human
cuuuaauuuaauuuuuguuuuuugccuaaauccaaagaaaaagggcugccgggccaggcgcggu

SEQ ID NO: 415206 - RNA, 64 nt, Human
agugccacagguuuuaaggauucugcagaaaaaaaagaaaaaaguccuucaguuuagaaccuac

SEQ ID NO: 415207 - RNA, 64 nt, Human
ccaaccacagaucaaaaauagaaaaaaaaaaaaaaagaaaaaaagaauguaaaauuuuaaaaau

SEQ ID NO: 415208 - RNA, 64 nt, Human
uugaauuguucuuaaggcaucauaucuagaagcaaagaaaaaagaaaaauaacaauuuaaguug

SEQ ID NO: 415209 - RNA, 64 nt, Human
guucuuaaggcaucauaucuagaagcaaagaaaaaagaaaaauaacaauuuaaguuguguaaau

SEQ ID NO: 415210 - RNA, 64 nt, Human
cucugucucagaaaaaaaaaaaaagaaaaggaaaaagaaaaauauauauucuauauuuuuuuaa

SEQ ID NO: 415211 - RNA, 64 nt, Human
ggccgaggaggaaggggcuccgugcacuugcaggccacgucaggagagccagcggugccugucg

SEQ ID NO: 415212 - RNA, 64 nt, Human
augaugucaaugaguucaccugcccuguguguuuccacgucaacugccugcucugcaagguggg

SEQ ID NO: 415213 - RNA, 64 nt, Human; identical to SEQ ID NO: 37148

SEQ ID NO: 415214 - RNA, 64 nt, Human
uuugacuuuccacuuuguccuuucugcucuugugaagaaaaaaaaaagcauuuucgaggaaaga

SEQ ID NO: 415215 - RNA, 64 nt, Human
gaaaaaaauuuucguaaacuuuguuuuauauuaaaagaaaaauccauaagucuguguguguuaa

SEQ ID NO: 415216 - RNA, 64 nt, Human
acuuccuaagcuacuuaagacaacuugcaccacuaagaaaaaaauguagaaccauuuggaaaaa

SEQ ID NO: 415217 - RNA, 64 nt, Human
ugucguuuuaacaucuccacgucccuagcauaaaaagaaaaagaaaaaaauuuaaacugcuuuu

SEQ ID NO: 415218 - RNA, 64 nt, Human
uuuaacaucuccacgucccuagcauaaaaagaaaaagaaaaaaauuuaaacugcuuuuucggaa

SEQ ID NO: 415219 - RNA, 64 nt, Human
agucacaggacccugcccaccugaguucccaauaaagaaaaaccuccccuucugaggcugcuuu

SEQ ID NO: 415220 - RNA, 64 nt, Human
cucuaaccaacuauauaucaagacccaaaaauugaagaaaaauauuguuuucucauacagugag

SEQ ID NO: 415221 - RNA, 64 nt, Human
uuaauuauagugcacuauugaaucaggaaaauuuaagaaaaagaauaguuaguuuuaaaugcau

SEQ ID NO: 415222 - RNA, 64 nt, Human
gugauaugauaaauaaaccccuaauuagccuuagaagaaaaaccacugcaagauauuaagcgug

SEQ ID NO: 415223 - RNA, 64 nt, Human
uauuuaacccuguaaguuacuuuaaagcuaauacaagaaaaacaaagacaagugaaaguaagga

SEQ ID NO: 415224 - RNA, 64 nt, Human
uuugauuuuuuucauuuucuauuuaagaaauaugaagaaaaaauacaccaagauggucaaauua

SEQ ID NO: 415225 - RNA, 64 nt, Human
cuggaauuccuuguuagggaacuuuaaagaagaaaagaaaaacuugaauuguguugaauuacug

SEQ ID NO: 415226 - RNA, 64 nt, Human
aguaucaucuauaagggagggcugggggcgggaaaagaaaaaaaaaagucauuuugaaauuaac

SEQ ID NO: 415227 - RNA, 64 nt, Human
aaguuuauaguuuuauauuuggaccuugaaagguaagaaaaaaccagguucuccaaaguuagga

SEQ ID NO: 415228 - RNA, 64 nt, Human
acuagcagggaaguuuccuugagccuaaaauaaaaagaaaaaauuaaaaagaaucaguuuuuuu

SEQ ID NO: 415229 - RNA, 63 nt, Human
uucgucgucuuaccccacugaaaccaacagggaucgggccaggcucccagauucuugaggaca

SEQ ID NO: 415230 - RNA, 63 nt, Human
cuccucauugugccuucaucagagcuggugccuucgggccagaaagacucucguucuuucuag

SEQ ID NO: 415231 - RNA, 63 nt, Human
acauccaagacuggagcagcaggcuggccacgcucgggccagagagagcucacagcugaagcu

SEQ ID NO: 415232 - RNA, 64 nt, Human
uucugagaaugugacuuuuucugguguuguaaaaaagaaaaaaaaaagaaugcucauuguaaaa

SEQ ID NO: 415233 - RNA, 64 nt, Human
guaacucuauuguaaaacaugucaauggugugugaagaaaaaucaaccaaucuguagguguuga

SEQ ID NO: 415234 - RNA, 64 nt, Human
aaauacacacacaacugaucuagacaucaagaggaagaaaaaugauggaugaugccaccugcuu

SEQ ID NO: 415235 - RNA, 64 nt, Human
cagcgucguuaaaauaaaaacugugccuuuuaaaaagaaaaaugcaaauauagagcaaaucccu

SEQ ID NO: 415236 - RNA, 64 nt, Human
gaccuuuccauccuugaaaaaauggggaaaaaagaagaaaaaagacaaaaucgaccauaaaaga

SEQ ID NO: 415237 - RNA, 64 nt, Human
gagagaaaagagggggaagaugguucaaagauacaagaaaaaguagaaaaaaaaauaacacuua

SEQ ID NO: 415238 - RNA, 64 nt, Human
gguguuucaaaggguaaauuauaaauguuucaugaagaaaaaauuuuaaaaaucuacgucuuua

SEQ ID NO: 415239 - RNA, 64 nt, Human
uaaauuugaucccaauagaauaccucccucauuuaagaaaaaucauaacucacuuuaaauauga

SEQ ID NO: 415240 - RNA, 64 nt, Human
ggaauuacauuuaaauuugagggcauuuuauauaaagaaaaauacagaccuauaaaguuuggca

SEQ ID NO: 415241 - RNA, 64 nt, Human
auaaguccuaucauugaaaauucaaauauaagugaagaaaaaauuaguagaucaacaaucuaaa

SEQ ID NO: 415242 - RNA, 64 nt, Human
ugcuaaauauucuugaacaauuaguagauccagaaagaaaaaaaaauaugcuuucucugugugu

SEQ ID NO: 415243 - RNA, 64 nt, Human
uucugacaaugugaccagacugaauuuccucauaaagaaaaaauggcgugccuugugucugugu

SEQ ID NO: 415244 - RNA, 64 nt, Human
aaugcugaaauguacaaaaucaaccaugacaacaaagaaaaagaccuuguacagcagcucucug

SEQ ID NO: 415245 - RNA, 64 nt, Human
ggugggggcuuaggcauccauauuggauucagaaaagaaaaagaaugaugcuucuugcaacaaa

SEQ ID NO: 415246 - RNA, 64 nt, Human
uaauauguaauauuagaacauauuacaaaguagcaagaaaaauacgacauugguguaaaaauaa

SEQ ID NO: 415247 - RNA, 64 nt, Human
cuuauaacacaucccaagugcaggccgcagugguccacgucauccagccccaccaagugacuuu

SEQ ID NO: 415248 - RNA, 64 nt, Human
uuagucuguauuuccaauauuucuaauuccugagccacgucaaagaugccuugccaaauuucuc

SEQ ID NO: 415249 - RNA, 64 nt, Human
uaucugugggaaugugguaguacccagggccagcccacgucauuaagguuaugcacugccugcc

SEQ ID NO: 415250 - RNA, 64 nt, Human
aguugcguuuaaguuguauuaaaaauagauauauaagaaaaaauucuuucacuugauguuuguu

SEQ ID NO: 415251 - RNA, 64 nt, Human
gcuaaauaacgacuaggaaaaauuuuuuuaaaaaaagaaaaaucaguuuaaugugggaaguacu

SEQ ID NO: 415252 - RNA, 64 nt, Human
gaagaacuugcauuuuuauggaacucaguauuaaaagaaaaauauaaugugaauuagccacuuu

SEQ ID NO: 415253 - RNA, 64 nt, Human
ucagauauuucaacucaucucaucaguuucuuguaagaaaaaaacauuuucacuuuguagcaca

SEQ ID NO: 415254 - RNA, 64 nt, Human
uuuggauagacuccaugccuucucucucccugcaaagaaaaaucuugaacauuuaugaugucaa

SEQ ID NO: 415255 - RNA, 64 nt, Human
agaagugcauagguccauaauauuucauaaaaugaagaaaaagaauguggccaaacaauuauuc

SEQ ID NO: 415256 - RNA, 64 nt, Human
aauagaagugcaagcuggaaaggcaaaaaugagaaagaaaaaggcaggcccuuugugucuaccg

SEQ ID NO: 415257 - RNA, 64 nt, Human
aggcaccuguaaauaaaucagcauuuaugaccagaagaaaaauaaucuggucuuggacuuuuua

SEQ ID NO: 415258 - RNA, 64 nt, Human
gcuaaaauacaaccgagaggggagauuuuuaaaaaagaaaaagaaacacaaauauuaauagaaa

SEQ ID NO: 415259 - RNA, 64 nt, Human
uccugcccuugcaaaugaagcuuuuaaaaaggugaagaaaaauuuuacaguauauccuguucug

SEQ ID NO: 415260 - RNA, 64 nt, Human
gaauaugugauguauuuuuguccagugaaucuugaagaaaaaucuuuugguggaggugccuuca

SEQ ID NO: 415261 - RNA, 64 nt, Human
auauaagaaaggaaauuuaaaaacauuccacaagaagaaaaauuauuguuuauacuucuacuua

SEQ ID NO: 415262 - RNA, 64 nt, Human
caguaaauaauccuccuucaaaaaauaaaaauaaaagaaaaaggaaaaucauucaggaagaaau

SEQ ID NO: 415263 - RNA, 64 nt, Human
uucagcuuccuugauuuagaaauaugauauaauaaagaaaaacuccauuuaucaucuguuacaa

SEQ ID NO: 415264 - RNA, 64 nt, Human
cucaagcacuucuagaaucaugcacugaauucaaaagaaaaaucuugcugcuuuuuguccaggg

SEQ ID NO: 415265 - RNA, 63 nt, Human
gggugugaggccuggccugggcccagaugcugaucgggccagggacaggcuugcccauguccc

SEQ ID NO: 415266 - RNA, 63 nt, Human
ggcuggugcguuccccagcucucccuacgcugcucgggccauugcccagccagauguggucac

SEQ ID NO: 415267 - RNA, 63 nt, Human
cccgauggccuccgugugcugucugccaccuccucgggccaccugggcuuccuggacacgcug

SEQ ID NO: 415268 - RNA, 64 nt, Human
acuuuucauaaaccucucucauguuagagcagcaaagaaaaaccaguuugccaagaggucacga

SEQ ID NO: 415269 - RNA, 64 nt, Human
cucuugaugaaagaaaaagacagaaggaaggaagaagaaaaagacugcaagcuuuccugccaau

SEQ ID NO: 415270 - RNA, 64 nt, Human
cuuuaaaaagcccucuuaaugaugcucuugaugaaagaaaaagacagaaggaaggaaggaagga

SEQ ID NO: 415271 - RNA, 64 nt, Human
ccuuugcuaaugauaguuauucuacaaucuccacaagaaaaauauaccuuuuauccggaaauau

SEQ ID NO: 415272 - RNA, 64 nt, Human
caauaauguagauagaacaaauuacagacaaggaaagaaaaaacuugaaugaaauggauuuuac

SEQ ID NO: 415273 - RNA, 64 nt, Human
uccucuguaaagaucagaugguaaucuuucaaauaagaaaaaaauaaagacguauguuugacca

SEQ ID NO: 415274 - RNA, 64 nt, Human
gcucauuuuuauuguuuuuacagccaguuauaguaagaaaaagguuuuuccccuugugcugcuu

SEQ ID NO: 415275 - RNA, 64 nt, Human
cuugugagaacuugaacuguuuacuaguuaauugaagaaaaaguguaacacuaaggugaacuug

SEQ ID NO: 415276 - RNA, 64 nt, Human
gccuugaaaaguuacucuagaggaaaaaugucuaaagaaaaaaaaaauucaaaaaguuuacauu

SEQ ID NO: 415277 - RNA, 64 nt, Human
agaaaguagcacuugaugcaagggauguuuugaaaagaaaaaauugguaaugcgaauguauaga

SEQ ID NO: 415278 - RNA, 64 nt, Human
caaccauacuuuuauccucauuuuuauucucacuaagaaaaaagucaacuccccuccccuugcc

SEQ ID NO: 415279 - RNA, 64 nt, Human
ucaugaaaaggaaaaaugguuaacauguuuacacaagaaaaaaagucaaaauuaucauuuauuu

SEQ ID NO: 415280 - RNA, 64 nt, Human
aagugagugagauguaaauccugugauuuuggugaagaaaaaaacggguaucuucauagcagcc

SEQ ID NO: 415281 - RNA, 64 nt, Human
augauaucuaaagaucuauuuugccuuaccagaaaagaaaaaaaaaacccuaaaaccaaaaacu

SEQ ID NO: 415282 - RNA, 64 nt, Human
gauagaaguuaaauagaauuuuuauuucauucuuaagaaaaacucauguuuguaacaaaugaua

SEQ ID NO: 415283 - RNA, 64 nt, Human
caggagguggccgacugcugcuagcggccugccgccacgucagcagcccagggcacagcgcucg

SEQ ID NO: 415284 - RNA, 64 nt, Human
aggcugaggccugcacugcagaugauccugcggaccacgucaaggucccggcacacgcugcugu

SEQ ID NO: 415285 - RNA, 64 nt, Human
gccggggcuccgaugccuucuucgacgcgcuggaccacgucauagacauacacggacacaucau

SEQ ID NO: 415286 - RNA, 64 nt, Human
uuucuuuucaacaaaacugcuaaugucuauuaggaagaaaaauguguuuaaaguuuuacaggaa

SEQ ID NO: 415287 - RNA, 64 nt, Human
auggauaaaaacuaagcgcuugccuucuuuuaaaaagaaaaacugaugauuagauuagguuagc

SEQ ID NO: 415288 - RNA, 64 nt, Human
ccuuugagaaaugaaugaaguagagagaaaauaaaagaaaaaccagccaggcacaguggcucac

SEQ ID NO: 415289 - RNA, 64 nt, Human
auuuacuuggugaauaaguuauaaauucccacagaagaaaaaugugaaagacugggugcuagac

SEQ ID NO: 415290 - RNA, 64 nt, Human
gguuaaauaauggguaguaaauuauagaauguauaagaaaaaauauaaaggagaaaaucaauua

SEQ ID NO: 415291 - RNA, 64 nt, Human
ucaggaaggaaugaaagagaguucuuucuuaauaaagaaaaacacucaaggacuuuguucauuu

SEQ ID NO: 415292 - RNA, 64 nt, Human
cagagcaagaucaaugaaggcuaauggcaagaauaagaaaaagaguugagauuuaaccaauagc

SEQ ID NO: 415293 - RNA, 64 nt, Human
aaauauauuagucuagggccacuuaauuuagaggaagaaaaaaaaucaacccauccauagaaau

SEQ ID NO: 415294 - RNA, 64 nt, Human
uugcauauauuucagaggaaaguaccagucaguaaagaaaaaugccaacuaaacaugaaacuau

SEQ ID NO: 415295 - RNA, 64 nt, Human
ccauugucuagguaugaaauccucaagcaauaacaagaaaaaaggcccacaauuagaaaaauuu

SEQ ID NO: 415296 - RNA, 64 nt, Human
uucuaauuuaauuugaagggaauaaaauuuguguaagaaaaaagcuguuuaacauuaauaaacu

SEQ ID NO: 415297 - RNA, 64 nt, Human
aaaaguugaauaagaguuggcuuaaauuuuaaaaaagaaaaagaaaauugagguuuuaggauuu

SEQ ID NO: 415298 - RNA, 64 nt, Human
uagagaagaaaugggucuaaagauagccugauggaagaaaaaccucagacaucuacaaacaacc

SEQ ID NO: 415299 - RNA, 64 nt, Human
uuucaauaggaaaacaaaguucuagauagguuaaaagaaaaacaccauaaaagugguaguauau

SEQ ID NO: 415300 - RNA, 64 nt, Human
cugcugagcaacagagugagaccccaucucaaaaaagaaaaaaaaaggcauucuaguaaaucga

SEQ ID NO: 415301 - RNA, 64 nt, Human
uuggacgucagccuguggauuugauacgacuuaaccacgucagaggaaggacuuuggcaaguga

SEQ ID NO: 415302 - RNA, 64 nt, Human
acugaacacaauauuuguguuuuuauuauuuaugccacgucaguggggcaagaaaucuggagug

SEQ ID NO: 415303 - RNA, 64 nt, Human
gcccagggugcccugccucaggacauguccacacccacgucacaagcaccugaggaguccggcc

SEQ ID NO: 415304 - RNA, 64 nt, Human
gacuuaauguauguuguaagaaaagaaaaaagaaaagaaaaaaagggaaaaaagaaaagcaagg

SEQ ID NO: 415305 - RNA, 64 nt, Human
caucugauucacgacuuaauguauguuguaagaaaagaaaaaagaaaagaaaaaaagggaaaaa

SEQ ID NO: 415306 - RNA, 64 nt, Human
cuguguauguauucaagagacuuccaacuagacaaagaaaaaauuguuguuuuaauggaaugua

SEQ ID NO: 415307 - RNA, 64 nt, Human
aagagucuccauuuuccagaaaauacagcuaagcaagaaaaauaucuuuuaaauacuuugccuu

SEQ ID NO: 415308 - RNA, 64 nt, Human
accagcugcaccauguaccccaccuucaguuuaaaagaaaaaaaaaauccccuucacuccuacu

SEQ ID NO: 415309 - RNA, 64 nt, Human
aaaagucaauuuuacaauuuguagaacucuaaugaagaaaaacgagcaugaaaauucgguuuga

SEQ ID NO: 415310 - RNA, 64 nt, Human
agugcuucucuuguguccuguagauguugugaaaaagaaaaaaacaaaaaauacaccacacugu

SEQ ID NO: 415311 - RNA, 64 nt, Human
uuuuggguuuuaaaggaaugguuuuacugcauuaaagaaaaaaaaugcuuuggaaaccagaggc

SEQ ID NO: 415312 - RNA, 64 nt, Human
aaagucuacuauuguaagaguucuucuguuugugaagaaaaaaacaaguuaaaaacugaaugua

SEQ ID NO: 415313 - RNA, 64 nt, Human
gaacaaaacuguguuuugaguuuagcugacauuaaagaaaaaaguucaucacgugacuguuaau

SEQ ID NO: 415314 - RNA, 64 nt, Human
ucagaagagaagaacuauaaacauauauuguguaaagaaaaaguucagcaauggaacuaguuuc

SEQ ID NO: 415315 - RNA, 64 nt, Human
agauugaccaaaccauccaaaugccaaaaagaaaaagaaaaaaaaaagccucucuguccuauga

SEQ ID NO: 415316 - RNA, 64 nt, Human
aagagaagauugaccaaaccauccaaaugccaaaaagaaaaagaaaaaaaaaagccucucuguc

SEQ ID NO: 415317 - RNA, 64 nt, Human
gugcuagaaauaacagcaucuaaagugaagacuuaagaaaaacuuagugacuacuagauuaucc

SEQ ID NO: 415318 - RNA, 64 nt, Human
gugacagagcaagacuccgucucaaaaaaaagaaaagaaaaaagaaagcauuguuuuaauugag

SEQ ID NO: 415319 - RNA, 64 nt, Human
ucuauugauaaauccagagccucaaggggcccagccacgucaaacuucucucccucagggacuc

SEQ ID NO: 415320 - RNA, 64 nt, Human
cgagcacucacugugucuuugucaagugucugcuccacgucaggcacugugcuuugcaccgggg

SEQ ID NO: 415321 - RNA, 64 nt, Human
ccccuguuuucugcuguuuacaacaucaccagugccacgucaugagcgucaaagaaaaugccua

SEQ ID NO: 415322 - RNA, 64 nt, Human
caagucaaugucaccgacagugaugaggaggaagaagaaaaagugcucagggauuuauaauuuu

SEQ ID NO: 415323 - RNA, 64 nt, Human
auuuuuuucaggacugcucuaugguuuccuuuaaaagaaaaaaacuucuguuuguuuuuagcag

SEQ ID NO: 415324 - RNA, 64 nt, Human
gaucaguuuuuuauaaaaauauauauuuuuguccaagaaaaaaaaaagcauacauaugugauua

SEQ ID NO: 415325 - RNA, 64 nt, Human
uggugauauuuacaaaaaaguaaaaaaaaaaaaaaagaaaaaaaggaaaaaaaaaaaagcuugu

SEQ ID NO: 415326 - RNA, 64 nt, Human
gccaacuuaaucagauaaacagauuauguaauggaagaaaaaugcggaugccuacaguuaacag

SEQ ID NO: 415327 - RNA, 64 nt, Human
ccugggcuggcagucuguuggacuucucuucaggaagaaaaagcaucagggggaaauggaaugc

SEQ ID NO: 415328 - RNA, 64 nt, Human
aauuguaccuuuuuagagaaaaggaccaaaauaaaagaaaaaugaauuaugaacuaccucucag

SEQ ID NO: 415329 - RNA, 52 nt, Human
auaggguagaaugguuuugaagaagaaaaaaccugcuuucugacugauuuug

SEQ ID NO: 415330 - RNA, 64 nt, Human
ugcuuagaugauaaaaugaggcagaauaugucugaagaaaaaaauugcaagccacacuucuaga

SEQ ID NO: 415331 - RNA, 64 nt, Human
cuuauggcauuuccuagaguuuuguugaagcaagaagaaaaacucagagaauauaaaaucaacu

SEQ ID NO: 415332 - RNA, 64 nt, Human
uguaaaucuucugaacugccuuuuuuuuaaaaagaagaaaaaucaaggaaacacaaucaggauu

SEQ ID NO: 415333 - RNA, 64 nt, Human
auuuuuucucuucauguuguaacaaaaaggaaaaaagaaaaaaaaaucccaucccuuuuguaca

SEQ ID NO: 415334 - RNA, 64 nt, Human
caucugccaugcgauguuaaaaaaaaaaaaaaggaagaaaaauaacacagcuacuccucacugc

SEQ ID NO: 415335 - RNA, 64 nt, Human
uugauuauacuugaaugccaaagaacuuguccagaagaaaaaccuguuaaauucaaguauuaaa

SEQ ID NO: 415336 - RNA, 64 nt, Human
ggaagauuguguuacugcccuucacagugaaaaaaagaaaaaucuuucauuuuuaaaauuagga

SEQ ID NO: 415337 - RNA, 64 nt, Human
cugcaggccagcaagccugcagcagcaggugcccccacgucaggugcugacugucugcuguccg

SEQ ID NO: 415338 - RNA, 64 nt, Human
guacauacgccauggggacccugaggaacugaggccacgucaaucccugugccgccccauucgc

SEQ ID NO: 415339 - RNA, 64 nt, Human
uuaugccaaaaauccuucauugugauuuucagaaccacgucagauauaccaagugacugugugu

SEQ ID NO: 415340 - RNA, 64 nt, Human
cguuuucauucgucauuccaagagagagagaggaaagaaaaauacaacuuucauucuuucuuug

SEQ ID NO: 415341 - RNA, 64 nt, Human
ucuuuguguggguaugcguggguguauguuugggaagaaaaacaaaggugcagacuaucuuccu

SEQ ID NO: 415342 - RNA, 64 nt, Human
agacgaagaguuuaaagagaaaagggaaaaaagaaagaaaaaguaagcagggcuggcuucgccc

SEQ ID NO: 415343 - RNA, 64 nt, Human
gucaguggagggcgagugguuucggaaaaaaaaaaagaaaaaaagaaaaaaaaagaaaaaaaaa

SEQ ID NO: 415344 - RNA, 64 nt, Human
agggcgagugguuucggaaaaaaaaaaagaaaaaaagaaaaaaaaagaaaaaaaaaagauuuuu

SEQ ID NO: 415345 - RNA, 64 nt, Human
guuucggaaaaaaaaaaagaaaaaaagaaaaaaaaagaaaaaaaaaagauuuuuuucuucucuu

SEQ ID NO: 415346 - RNA, 64 nt, Human
ggggaggagaauuagccaaacacuguaagcuuuuaagaaaaacaaaguuuuaaacgaaauacug

SEQ ID NO: 415347 - RNA, 64 nt, Human
ucaaggccacaaaaacaauguuugggggaaaaaaaagaaaaaaucaugccagcuaaucauguca

SEQ ID NO: 415348 - RNA, 64 nt, Human
gcaaagccuaaaagauuuacuacuugucuccuuaaagaaaaaguuugccagcuccugaucuaga

SEQ ID NO: 415349 - RNA, 64 nt, Human
uuugaaaacaguguagcgaacaccgcagauuuaaaagaaaaacuagagggaaggugguccagau

SEQ ID NO: 415350 - RNA, 64 nt, Human
caaccuaggagccagcgggcuuucggggaaaaaaaagaaaaagacaucuaaaauaaaauguuua

SEQ ID NO: 415351 - RNA, 64 nt, Human
agccuucgcucuguagaacuuggaaaaauccagaaagaaaaaauaauugauuucaagaccuucu

SEQ ID NO: 415352 - RNA, 64 nt, Human
cgccagcccaaaagauggucaucgggaagagaaaaagaaaaaaaugcugcaguuguucucucaa

SEQ ID NO: 415353 - RNA, 64 nt, Human
gguuuuaaagcauugccaaaaaaaagaaaacagaaagaaaaaauguaucaucuaaaggacuaga

SEQ ID NO: 415354 - RNA, 64 nt, Human
gcauuuuauguuaaguuggguauuuuuuuaaaaaaagaaaaacagcaacauuaauaaaagaagu

SEQ ID NO: 415355 - RNA, 64 nt, Human
gaagggaaagauaauaaugauggucaacaauaagccacgucaaugcauaaguuguauaggcuaa

SEQ ID NO: 415356 - RNA, 64 nt, Human
auaguauucaggugagcaauuagauuaguauuuuccacgucacuguuuauuuuuuuaaaacaca

SEQ ID NO: 415357 - RNA, 64 nt, Human
aaaauaccaguguuucucaucccauugacucacaccacgucaucuggauuuuggauuucccucc

SEQ ID NO: 415358 - RNA, 64 nt, Human
ccagaugguagguugauauuucuggacucuagccaagaaaaagcuaauucuggggauagaauga

SEQ ID NO: 415359 - RNA, 64 nt, Human
agcagacuggaagcugaggaagaucuagaaguaaaagaaaaaauuagaugcguuaaaaugacau

SEQ ID NO: 415360 - RNA, 64 nt, Human
ugaauuuauauauauauuuuguuuugccaauaugaagaaaaagaggccuuauuucuuaacugug

SEQ ID NO: 415361 - RNA, 64 nt, Human
ucauguagaauuuucuguucuggguuauugggauaagaaaaaauauauauugcucuucaacuag

SEQ ID NO: 415362 - RNA, 64 nt, Human
augggcaacauaacaagaccccaucccuuauuaaaagaaaaaaaaauaauuccucauuucauca

SEQ ID NO: 415363 - RNA, 64 nt, Human
gacuucaauucauauuuauggccuuuggaauccaaagaaaaacagaagaauaauucauggauuu

SEQ ID NO: 415364 - RNA, 64 nt, Human
uacuuuuuagacaggacagauacucucaacagacaagaaaaaagauuuagcuuaucacaagaag

SEQ ID NO: 415365 - RNA, 64 nt, Human
caagucuaccaauuauaagggcaaauuggagaaaaagaaaaaauauauacucaagagugguauc

SEQ ID NO: 415366 - RNA, 64 nt, Human
uuuaaauuuagauuauguauuccuuuugaaacauaagaaaaacauuuaaaccuaugcugaaaau

SEQ ID NO: 415367 - RNA, 64 nt, Human
aaaaacauuuaaaccuaugcugaaaauacgauaaaagaaaaacaacuccaauaugcuaaaaguu

SEQ ID NO: 415368 - RNA, 64 nt, Human
uuuaguuuaguuuuuuugaagaauuacaaaucagaagaaaaagcaagcauuauaaacaaaacua

SEQ ID NO: 415369 - RNA, 64 nt, Human
auucaagaugugugaaauaauauaagucaaaagcaagaaaaacguaaucccgucugaacucaag

SEQ ID NO: 415370 - RNA, 64 nt, Human
aauaggauuguguguauauuugggauaucuauugaagaaaaaaagaaaaccccuuaaagauaau

SEQ ID NO: 415371 - RNA, 64 nt, Human
ugucuuuaaaucagauaccaaauauuuuuuaggaaagaaaaauguuauuacugucauuagguug

SEQ ID NO: 415372 - RNA, 64 nt, Human
gucauaauaaaacaaauaauuuccucaaauaacaaagaaaaaugauaccuauaaauauauuuau

SEQ ID NO: 415373 - RNA, 64 nt, Human
gcugcagucucuugggccccugcuggcagcucugccacgucaccgccugccuggcucccacaca

SEQ ID NO: 415374 - RNA, 64 nt, Human
ggggaaggggcugccaacgaaccagacucagugaccacgucaugacagaacagcacauccuggc

SEQ ID NO: 415375 - RNA, 64 nt, Human
cagcaaugugaguauuauuuggaguaaauuuguuccacgucaaguucuggccuucugaugcaaa

SEQ ID NO: 415376 - RNA, 64 nt, Human
cugaagaaugagguuuuucauaccugaagaguaaaagaaaaacuaagagaucaaacugagaggu

SEQ ID NO: 415377 - RNA, 64 nt, Human
uucaggcaguguuucugggggagguuauggagggaagaaaaaagaaaaaucgauagugagugac

SEQ ID NO: 415378 - RNA, 64 nt, Human
aguguuucugggggagguuauggagggaagaaaaaagaaaaaucgauagugagugacugauugc

SEQ ID NO: 415379 - RNA, 64 nt, Human
aaauaccauuaaacugugaucaguuaaaauuuaaaagaaaaaucagcacaaaagggcgcuaaaa

SEQ ID NO: 415380 - RNA, 64 nt, Human
uauuuugguuuugguuccagauugugcaaucuuuaagaaaaauaaagauacaaacgagaguuuu

SEQ ID NO: 415381 - RNA, 64 nt, Human
uuuugcauccauuguauuaucagaaaaugugaagaagaaaaaaaugccauguuuuaaaaccacu

SEQ ID NO: 415382 - RNA, 64 nt, Human
uggaguaucccauucugaugaguacagaaaaaaaaagaaaaagaaaagaagagaaaaaauuaag

SEQ ID NO: 415383 - RNA, 64 nt, Human
aaaaaaaaagaaaaagaaaagaagagaaaaaauuaagaaaaaaaucaaaaaaggaagaaaacua

SEQ ID NO: 415384 - RNA, 64 nt, Human
ggugucagauucaucaaacaaaaaauaaaucucgaagaaaaaaaaugcacuuacaugugcuuau

SEQ ID NO: 415385 - RNA, 64 nt, Human
ucugagaucccaauggugugagucugacuuuggaaagaaaaagggacuaaagagaaauguaaca

SEQ ID NO: 415386 - RNA, 64 nt, Human
ucaggauguggagcuuccuauucugugaaaaaccaagaaaaagauaugguuguauacucaaauu

SEQ ID NO: 415387 - RNA, 52 nt, Human
agcaacaacagcagaguugauuaagaaaaaugaagaaaaaacgcaaaaagag

SEQ ID NO: 415388 - RNA, 62 nt, Human
agcaacaacagcagaguugauuaagaaaaaugaagaaaaaacgcaaaaagagaacacaugua

SEQ ID NO: 415389 - RNA, 64 nt, Human
cuacaagucuugaguuaagaaggaaagaggaaaaaagaaaaaacaccaauacccagauuuaaaa

SEQ ID NO: 415390 - RNA, 64 nt, Human
gugcagaauuuggcauaucgaugcaugcaauggaaagaaaaaaaauuuguuaaaauuuguaaau

SEQ ID NO: 415391 - RNA, 64 nt, Human
ucucagugccccuuaaauuucugcccugagcccuccacgucagugccaucggucuagaaccacu

SEQ ID NO: 415392 - RNA, 64 nt, Human
uucuaguucugccaggagacagguuagcugcuccccacgucagcugggacaccccgacuuuugu

SEQ ID NO: 415393 - RNA, 63 nt, Human
caguuccaguuccacgaaacacugugcaaagccucgggccacauggguccacugcaccagugu

SEQ ID NO: 415394 - RNA, 64 nt, Human
cucagaggguuaugauuuuccuuucuuuuuuucuaagaaaaaauuauuuucaggagaauauucu

SEQ ID NO: 415395 - RNA, 64 nt, Human
auaaagaaaaucucauuugucuaauugcaauuaaaagaaaaauguuaaaauauuaaaaugaaaa

SEQ ID NO: 415396 - RNA, 64 nt, Human
cuugaaagcaucaagauuccacucaauuguggagaagaaaaaaggugcuguagaaagugcacca

SEQ ID NO: 415397 - RNA, 64 nt, Human
uaaauacuuccugaacaucuuaggucuuuucaacaagaaaaagacagaggauuguccuuaaguc

SEQ ID NO: 415398 - RNA, 64 nt, Human
uauuuuagugggguaacaaaaagaauugccaaggaagaaaaauccacccaggaaugaaaauuaa

SEQ ID NO: 415399 - RNA, 64 nt, Human
ugaucgauguguucgcauugcugaaacacaacagaagaaaaauggagugcugggacuggcagag

SEQ ID NO: 415400 - RNA, 64 nt, Human
uggggaguucuugaguuccucauuuguugguaaaaagaaaaagaaugugaaaaugucucuuuuu

SEQ ID NO: 415401 - RNA, 64 nt, Human
gugugcuuugugguugcugucauauuugcucuagaagaaaaaaaaaaaaggaggggaaaugcau

SEQ ID NO: 415402 - RNA, 57 nt, Human
gccacagcacaaaguuuuaaugucuuuaagaaaaagaaaucaaucugcagaaaugug

SEQ ID NO: 415403 - RNA, 60 nt, Human
cucagcaacuggagaaaugauuuuuccuucaagaaaaacuacagugggauucauuuacuu

SEQ ID NO: 415404 - RNA, 64 nt, Human
guuaccagaaagccaaauuuuauaaugcgggugaaagaaaaauauagauuaaaauugcugggca

SEQ ID NO: 415405 - RNA, 64 nt, Human
agugcuuguaaaucuuuuuuuuuuuuuaagaagaaagaaaaaaaugguguuugacguugaugga

SEQ ID NO: 415406 - RNA, 64 nt, Human
aauggaacgacuucaaagagaacuugagauucaaaagaaaaagcuggauaaauuaaaaucugag

SEQ ID NO: 415407 - RNA, 64 nt, Human
auucagaugaucaggaauguauauaacugaaaucaagaaaaagaacaguaugcauuuaaaaaga

SEQ ID NO: 415408 - RNA, 64 nt, Human
cguguccugaaagagaauuuuuaaauuauuuaauaagaaaaaauuuauauuaaugauuguuucc

SEQ ID NO: 415409 - RNA, 64 nt, Human
caggccucuaccaccagagagcuggagaauggguccacgucauucaaggaccugaauuuuuuau

SEQ ID NO: 415410 - RNA, 64 nt, Human
aggccaccagguggcagcacagccacacccguucccacgucagaggagggcaaggcuggguacu

SEQ ID NO: 415411 - RNA, 64 nt, Human
gauuauguaggaauaauguuuggacuugauuuccccacgucauaaugaagaauggaaguuugga

SEQ ID NO: 415412 - RNA, 64 nt, Human
aucuacaaggaacuuaaacaauucaacaagcaagaagaaaaaacccaauuaaaauugggcaaag

SEQ ID NO: 415413 - RNA, 64 nt, Human
uggcacuucaauuuugcacugucuuuugagauucaagaaaaauuucuauucuuuuuuuugcauc

SEQ ID NO: 415414 - RNA, 64 nt, Human
guauugcauuuuugggggaagcaaauugacuuuaaagaaaaaaguuguggcaaaagaugcuaag

SEQ ID NO: 415415 - RNA, 64 nt, Human
auuuuuucauuagggccauaucuccaaaaaaagaaagaaaaaauacaaaaaacaaaaacaaaaa

SEQ ID NO: 415416 - RNA, 64 nt, Human
guauuucaagauaauguaguuuaaaaaaaaaaaaaagaaaaaaacuugauguaaauuccuccuu

SEQ ID NO: 415417 - RNA, 64 nt, Human
aaucuuugaaaugaaagcuacaaauacaugugagaagaaaaaaauggauuuuuuuagcaaauaa

SEQ ID NO: 415418 - RNA, 64 nt, Human
cucaugauaccaccuuuacugugcuuauuuuuuuaagaaaaaaguguugaucaaccauucgacc

SEQ ID NO: 415419 - RNA, 64 nt, Human
gguuuguaaugcaaaaggcugauuacugaaauuuaagaaaaagguucuuuuuucaauaaauggu

SEQ ID NO: 415420 - RNA, 64 nt, Human
augaagguaucaguucauuuaauuuuagaugcaaaagaaaaaggucuaacguacaaucagccaa

SEQ ID NO: 415421 - RNA, 64 nt, Human
uaagcaacauuccuaagugguaaaaaaucaaaucaagaaaaagugacauggauuuuuaaaaacc

SEQ ID NO: 415422 - RNA, 64 nt, Human
ggcaggccacugugcaugcagacagcccgccccaaagaaaaaucagaggaggagaaauggaaac

SEQ ID NO: 415423 - RNA, 51 nt, Human
uggagauggcaacguucugagaagaaaaaaaagaggaaggggacugcguua

SEQ ID NO: 415424 - RNA, 64 nt, Human
ggaacacaaucaccaagaaauuagucagggcgaaaagaaaaaaauaauacuauuaauaagaaac

SEQ ID NO: 415425 - RNA, 64 nt, Human
gauuauuauaugaaccauuauuuuauguaucauuaagaaaaaauacugccaauuaaacucuguc

SEQ ID NO: 415426 - RNA, 64 nt, Human
gaugaaguuacuguugauccugaguuacgugaauaagaaaaacaauugaacugcuuauuaaaaa

SEQ ID NO: 415427 - RNA, 64 nt, Human
ucuguaugucuuaggccaguaucccaaaccucuuccacgucacuguucuuuccacccauucucc

SEQ ID NO: 415428 - RNA, 64 nt, Human
agcggaagggugagagggaggagaugcaggaugcccacgucauccugaacgacaucaccgagga

SEQ ID NO: 415429 - RNA, 64 nt, Human
cugacuaaccagccaccuuuucucucucuuagcuccacgucagcacugagaccagacucgagca

SEQ ID NO: 415430 - RNA, 64 nt, Human
guaaagccauuuacuuuuucuaaaaaaguuuuagaagaaaaagauguaacuaaacuuuuaaagu

SEQ ID NO: 415431 - RNA, 64 nt, Human
uagaacauuuuuaaaaagagaguauauggaucgcaagaaaaaugaaggguuaucauacuugaaa

SEQ ID NO: 415432 - RNA, 64 nt, Human
gaaguaaaugcaaauuacuuuuaagugugcuuuaaagaaaaauauuuuccccacaagagaaauu

SEQ ID NO: 415433 - RNA, 64 nt, Human
gggcuuugggguugaacuuuuuuuuuuuuaaagaaagaaaaagaaacccugggauccaucuguu

SEQ ID NO: 415434 - RNA, 64 nt, Human
agggaaguuucugggugccccacuaaguagaauaaagaaaaacgguuauaaauaccucugucuu

SEQ ID NO: 415435 - RNA, 64 nt, Human
ccccuucggccagucuuaaacgggugucagcaagaagaaaaauuaacaaaagacagaaggccug

SEQ ID NO: 415436 - RNA, 64 nt, Human
gaacggagaucuggguuucagagcuuucccauuuaagaaaaauagaucuugagauucugauucu

SEQ ID NO: 415437 - RNA, 64 nt, Human
agugaaacuacuuuggauuuuaaccucuuagaggaagaaaaaagguuagggaagugucaacucu

SEQ ID NO: 415438 - RNA, 64 nt, Human
cuuucugacuaggaaaccaugugguuugaacuugaagaaaaauguagacccaucuggguuaauu

SEQ ID NO: 415439 - RNA, 64 nt, Human
aagaagggagggaaacagggagaaagggaaaaagaagaaaaagagaaagaugaaaauaggaaca

SEQ ID NO: 415440 - RNA, 64 nt, Human
gaaaaauuuccugguccaaauaaaguugaaguuuaagaaaaauugauuugaguguucuguuuuu

SEQ ID NO: 415441 - RNA, 62 nt, Human
aaacugacucauccaacuagacauucuacagaaagaaaaaugcauuauugacgaacuggcua

SEQ ID NO: 415442 - RNA, 64 nt, Human
auuuguucaguguuuuaaccuguauuuguuaaaaaagaaaaaaaaacacacauaaaguuccaug

SEQ ID NO: 415443 - RNA, 64 nt, Human
caauuuuggguggcaauaaauauauucgcacauuaagaaaaaaaagacuuaagcauuagaaagc

SEQ ID NO: 415444 - RNA, 64 nt, Human
cacagaggaauauuggcuggcaugcaaccugcaaaagaaaaaugcgaagcggccgggcacggug

SEQ ID NO: 415445 - RNA, 64 nt, Human
ggacagugaccuugggaggaaggggcuacuccgcccacgucagggagagaugugagcaucccgg

SEQ ID NO: 415446 - RNA, 64 nt, Human
ugugccgggccuccguugcaccucugaccugcagccacgucaucguugcgcagccccuggggag

SEQ ID NO: 415447 - RNA, 64 nt, Human
gggacccgggacccgcggcucaguggcccgcuagccacgucagccaagccacuuuagguccauu

SEQ ID NO: 415448 - RNA, 64 nt, Human
uaaaacuacuaaccagaggagucuaugccauuuuaagaaaaacaauuaaccugguuaaagagaa

SEQ ID NO: 415449 - RNA, 64 nt, Human
gaagagucauguacuuggcaaccaguaaauucugaagaaaaagacacuuacuuauuauuaaaac

SEQ ID NO: 415450 - RNA, 64 nt, Human
aacaguuuagucccaagagaauagcguuuuaaaaaagaaaaacaagauuuggagucauuguggg

SEQ ID NO: 415451 - RNA, 64 nt, Human
uuauaucauuuuaacaaguuuuuuggaaauguaaaagaaaaaaguaaagcuccauuuuugugaa

SEQ ID NO: 415452 - RNA, 64 nt, Human
cucuuuuaauauuuuaugauugccaucaaagaagaagaaaaagaaggaacagacaaagguuuga

SEQ ID NO: 415453 - RNA, 64 nt, Human
uuaaugguaagaauuaagacauuuguagauuuuaaagaaaaauaugaaauuguccauuaaauca

SEQ ID NO: 415454 - RNA, 64 nt, Human
gcuuucuuuuuggaacugcuacaaacaaaauuagaagaaaaaaaggucaagcaguuuucacuug

SEQ ID NO: 415455 - RNA, 64 nt, Human
gagccagaccuugucucaaaaaaaaaaaaaaaaaaagaaaaaagaaaguacugucugucuuaaa

SEQ ID NO: 415456 - RNA, 64 nt, Human
gaugcauauaggauguuugggagcaucauccgugaagaaaaaaucaauuaaaucauuguguuca

SEQ ID NO: 415457 - RNA, 64 nt, Human
aaugaugcuguuuucucugcuaaagguaaaagaaaagaaaaaaauaguuggaaaauaagacaug

SEQ ID NO: 415458 - RNA, 64 nt, Human
acuucccaguggaaggagcacugaaaaccucuuaaagaaaaagcauuuguguguuuuccuugaa

SEQ ID NO: 415459 - RNA, 64 nt, Human
gauugcuguggccuagacuucugaguaauuaauaaagaaaaagaaguacccuuuggccuacaga

SEQ ID NO: 415460 - RNA, 64 nt, Human
aauuauagcuaugucuugugaaaauaaccucaaaaagaaaaauacgacucuguugucuuacuug

SEQ ID NO: 415461 - RNA, 64 nt, Human
gaaaauuaucuaguuaaucauaauauuugauggaaagaaaaagacaauaaaauuguaauauaau

SEQ ID NO: 415462 - RNA, 64 nt, Human
gguaagcucuacuaaauguaucuguacaaggaugaagaaaaacaaaauaacuacuacuuuugga

SEQ ID NO: 415463 - RNA, 64 nt, Human
gaggagcuuuguuucaaccaagucaugugcauuuccacgucaacagaauuguuuauugugacag

SEQ ID NO: 415464 - RNA, 64 nt, Human
ccacagaaccacccagcgucuccccugcugcuguccacgucaguucaugaggcaacgucgcgug

SEQ ID NO: 415465 - RNA, 63 nt, Human
gcugaaugggaaugauuaaaaacaagguauuuuucgggccaggcgguggcucacgcuuguaau

SEQ ID NO: 415466 - RNA, 64 nt, Human
ugacagaaaucuaacuucaagugacugaagcagaaagaaaaauuuuugaaugacauaacugaga

SEQ ID NO: 415467 - RNA, 64 nt, Human
ccccauuucuacugaacauccuaguuuuaaacagaagaaaaacuguaauccugggguugguaug

SEQ ID NO: 415468 - RNA, 64 nt, Human
agagugagaaagaauaaauuguuauuaagagcaaaagaaaaauaaagugauugaugauaguucu

SEQ ID NO: 415469 - RNA, 64 nt, Human
guaaaucuaaaaggcacuuuuuuuuagagguauaaagaaaaacuagauguaauaaauaagauca

SEQ ID NO: 415470 - RNA, 64 nt, Human
auucucaauacaaaucaaacaauuuaaauauuuuaagaaaaaaggaaaaguagauagugauacu

SEQ ID NO: 415471 - RNA, 64 nt, Human
ucacaaacaaugucacagagaugaaacagauucaaagaaaaaauauuuuuaagucuuuugaaaa

SEQ ID NO: 415472 - RNA, 64 nt, Human
agaccaucgaggaagccgaaaauaugcaaagaccaagaaaaaauaaagaaaagaugauuuaccu

SEQ ID NO: 415473 - RNA, 64 nt, Human
agugcuuuaggugagaugacuaaauuaugccuccaagaaaaaaaaauuaaagugcuuuucuggg

SEQ ID NO: 415474 - RNA, 64 nt, Human
ucgauucucguacccaacuaaaaaaaaaaaaauaaagaaaaaaugugcugcguucugaaaaaua

SEQ ID NO: 415475 - RNA, 64 nt, Human
cauaauauaguauuuguuugauaauuagaguuggaagaaaaaagagagaauuucuuuugggcag

SEQ ID NO: 415476 - RNA, 64 nt, Human
gacauaaauacuucaaaaaugucucugacacagaaagaaaaaaaacaaaaagggagcuauucca

SEQ ID NO: 415477 - RNA, 64 nt, Human
aacuccaauaacugagcugaaguuuuuguuuaaaaagaaaaaaaucugauaagugaugauuuua

SEQ ID NO: 415478 - RNA, 64 nt, Human
uaacuuguacuugucucucugcuuguuauugguuaagaaaaaaggauaugaggaauucauuuua

SEQ ID NO: 415479 - RNA, 64 nt, Human
acccuaccaacuuuacuguccuaacaugguuuaaaagaaaaaaugacaccaucuuuuauucuuu

SEQ ID NO: 415480 - RNA, 64 nt, Human
uuauggaaauguugucuuuuauacuuaguuauauaagaaaaaagggaguuaugcaauuaauauc

SEQ ID NO: 415481 - RNA, 63 nt, Human
cuguaaucccagcacuuuaagaggcugaggcaggaggaucacuugagcucaggaauucgagac

SEQ ID NO: 415482 - RNA, 63 nt, Human
cuuaugaguccuagcacugauuuugaggaaaaggaggaucagaaguucaagggaccgugaaag

SEQ ID NO: 415483 - RNA, 63 nt, Human
cuguggucccagcuacucaggaggcugaggugggaggaucauuugagccuaggaggucaaggc

SEQ ID NO: 415484 - RNA, 64 nt, Human
uuagcauugcaugugaauaagaaaauaauguuuaaagaaaaaaaaaaaaaagcaaaccuccaaa

SEQ ID NO: 415485 - RNA, 64 nt, Human
caaaaaaaaaaagcaaaaaaagaaaagagaaaaaaagaaaaaaugcaaauggaauaauuuucua

SEQ ID NO: 415486 - RNA, 64 nt, Human
caaccauuuggcacagcuuccugggaggaauaauaagaaaaacaugcuuuggaggaaaacucaa

SEQ ID NO: 415487 - RNA, 64 nt, Human
auucuaaaccaaucaaaugucugggaagcccuccaagaaaaaaaauagaaaagcacuugaagaa

SEQ ID NO: 415488 - RNA, 64 nt, Human
uugggagaaguaugaaugcgugugucuaaauuaaaagaaaaaaauauuuaaacguuuuuuaaca

SEQ ID NO: 415489 - RNA, 64 nt, Human
cuucuccuacuggaacaucucagcuucugcagugaagaaaaauuccugugauaguucaguucuu

SEQ ID NO: 415490 - RNA, 64 nt, Human
aaaacaaaaaaaaaaaacaaaaaaaaaaaaacaaaagaaaaaaauaaaaauacgguggcaauau

SEQ ID NO: 415491 - RNA, 64 nt, Human
gcuuuuuaaugaauaugaccccuauagaaaagucaagaaaaaaaaacccuuguauaaauuauuu

SEQ ID NO: 415492 - RNA, 64 nt, Human
agccugggcaagagcgugagacccugucucaaagaagaaaaaaagagaaaaauaacucuuuuga

SEQ ID NO: 415493 - RNA, 64 nt, Human
auuugcaauuuucuacagaauugaauaccuguuaaagaaaaauuacagaauaaacuugugacug

SEQ ID NO: 415494 - RNA, 64 nt, Human
ccuccuuccaggauuaaguugucaucauucugggaagaaaaaaaaaacauuaaugaagaggcca

SEQ ID NO: 415495 - RNA, 64 nt, Human
aaugcugugacagcuuuuuggcugcuuuaaccauaagaaaaaugauugguggaugauuuuauua

SEQ ID NO: 415496 - RNA, 64 nt, Human
ccagccugggugauagagcaagacugucucaaaaaagaaaaaaaagaaaaaauuuuaauuuaau

SEQ ID NO: 415497 - RNA, 64 nt, Human
gugauagagcaagacugucucaaaaaagaaaaaaaagaaaaaauuuuaauuuaauccuucugua

SEQ ID NO: 415498 - RNA, 60 nt, Human
gaggcugugugauuucauaauacaaacaaaaagaaaaaaaauuaaacaaauucuuggaaa

SEQ ID NO: 415499 - RNA, 63 nt, Human
auggaaucccagcacuuugggaggccgaggugggaggaucacuugagcccaggaguucgagac

SEQ ID NO: 415500 - RNA, 63 nt, Human
cuguaaucccagcuacucaggaggcugaggcaggaggaucacuugaaccugggaggcggaggu

SEQ ID NO: 415501 - RNA, 63 nt, Human
cugugguccuggcuacuugggaggcugaggauggaggaucauuugagcccaggaggucgaggc

SEQ ID NO: 415502 - RNA, 64 nt, Human
gaaauuguaaaaccugucaaugauacagucccuaaagaaaaaaaaucauugcuuugaagcaguu

SEQ ID NO: 415503 - RNA, 64 nt, Human
uaugauguguugugauagcuaacauuuuaaauaaaagaaaaaauaucuugaagauuuuugucac

SEQ ID NO: 415504 - RNA, 64 nt, Human
gaugucuucuagacauuuacuaucacugcaccugaagaaaaaaucacuuuuaccuuccuaauuu

SEQ ID NO: 415505 - RNA, 64 nt, Human
gaaugucagaaaugacuuuaucaucgucaucuugaagaaaaauaugaacacugaugaaggucau

SEQ ID NO: 415506 - RNA, 64 nt, Human
accagucacuaggauauuucuacccaugcaacggaagaaaaacccauuacuccagaagaguaua

SEQ ID NO: 415507 - RNA, 64 nt, Human
ccuguauaaauguuuuuacugcuuuuagaaaauaaagaaaaaaaacuugguucauguuuacaug

SEQ ID NO: 415508 - RNA, 64 nt, Human
auuuugguuaucuuuguguuccucaagcucuuuaaagaaaaagauguaaucguuguaaccuuug

SEQ ID NO: 415509 - RNA, 64 nt, Human
ucagauuuuauuuuaaaagccaugucuguuaaacaagaaaaaacacaaaagaacuccagauucc

SEQ ID NO: 415510 - RNA, 64 nt, Human
ucagauauauugcaaagucuguauuccagcucuuaagaaaaauauaagcauguuaaauaccaua

SEQ ID NO: 415511 - RNA, 64 nt, Human
cuguggucaagcgagucacgaaugauuaaucauaaagaaaaaucaguuuuugacugaccuggau

SEQ ID NO: 415512 - RNA, 64 nt, Human
guuucuaguuauaucauuacuuaaagggcuuaaaaagaaaaaacuuagcaaacuuuugaaucuu

SEQ ID NO: 415513 - RNA, 64 nt, Human
uggcaacagagcaagagucugucucaaaaaaaaaaagaaaaaaagaaaaaaagaaaaaagaaaa

SEQ ID NO: 415514 - RNA, 64 nt, Human
gagcaagagucugucucaaaaaaaaaaagaaaaaaagaaaaaaagaaaaaagaaaaaucucauu

SEQ ID NO: 415515 - RNA, 64 nt, Human
gucugucucaaaaaaaaaaagaaaaaaagaaaaaaagaaaaaagaaaaaucucauuauuucaaa

SEQ ID NO: 415516 - RNA, 64 nt, Human
ucaaaaaaaaaaagaaaaaaagaaaaaaagaaaaaagaaaaaucucauuauuucaaaaugauag

SEQ ID NO: 415517 - RNA, 63 nt, Human
cuguauucccagagcuuugggaggcugaggcgagaggaucacuugagcacaggaguucgagac

SEQ ID NO: 415518 - RNA, 63 nt, Human
uaacuagaacuacccagcgagucguccagaggagaggaucagguuugagucaggaggcucccu

SEQ ID NO: 415519 - RNA, 64 nt, Human
aggccacagggagcuccgucagcuucucccaagcccacgucaggccuggccucaucucagaccc

SEQ ID NO: 415520 - RNA, 64 nt, Human
acccaaaauuauuaauuuuauuaggcuuuuggaaaagaaaaaaaacuuuuugauguuuuaggug

SEQ ID NO: 415521 - RNA, 64 nt, Human
aauuuucuuccagaagauauuuauauaagauuauaagaaaaauuauguacacagcuuauuuuau

SEQ ID NO: 415522 - RNA, 64 nt, Human
cacagugcaagacuccaucucaaaaaaaaaagaaaagaaaaagccuguuuaaugcacaggugug

SEQ ID NO: 415523 - RNA, 64 nt, Human
ccugagaucaauaagaaauguucaggagagaggaaagaaaaaaaauauaugcuccacaauuuau

SEQ ID NO: 415524 - RNA, 64 nt, Human
ggagauauucaguuuucuuuuuuucauuuaaacaaagaaaaaaaauguaucuacucuaccuucc

SEQ ID NO: 415525 - RNA, 64 nt, Human
ucuuacuuuaucuuuuaagaauuaaugaguauaaaagaaaaauuaggcaguuuacccuuuucag

SEQ ID NO: 415526 - RNA, 64 nt, Human
uaauaguacaucauguaagauggcaacuguauuaaagaaaaauccggaaaacaaauguuugauu

SEQ ID NO: 415527 - RNA, 64 nt, Human
guacauuuuaaaugguaaauaaucuguuuaugugaagaaaaagaauuaagucuuucuuccaacu

SEQ ID NO: 415528 - RNA, 64 nt, Human
uccuuuacuaacaagagcaggaauucagaggcacaagaaaaagcauuggcaugagccaaagagu

SEQ ID NO: 415529 - RNA, 64 nt, Human
uaugacauuggacacuuuuuuauuauuccaaaagaagaaaaaauuaaaacaacuugcugaaguc

SEQ ID NO: 415530 - RNA, 64 nt, Human
gucuacaaaaaugaaaaaccaaaaagcaaaccaaaagaaaaaucugaaauuuccaucuggggau

SEQ ID NO: 415531 - RNA, 64 nt, Human
aauucuuauuguaauuuuccuacuucuuugauaaaagaaaaauaagucagauuguuaacuccaa

SEQ ID NO: 415532 - RNA, 64 nt, Human
uguaugcacacaguaugcuuaugugucauuucacaagaaaaaaggaauaauauucucuaaacca

SEQ ID NO: 415533 - RNA, 64 nt, Human
cagcaauuguuucaaaggaaaauagauccccuuaaagaaaaaauacaggcuuuagggaacaaag

SEQ ID NO: 415534 - RNA, 64 nt, Human
agguuaugguuuaauguuacaacaacuauuuuuuaagaaaaacaaguuuuagaaauuugguuuc

SEQ ID NO: 415535 - RNA, 63 nt, Human
uaacaauccauuaacauguguagggguuacggugaggaucacuguguuguauucagaaaaacg

SEQ ID NO: 415536 - RNA, 63 nt, Human
cccaucccaaacugcauuuauaauuuugugacugaggaucauuuguuuguuaauguacugugc

SEQ ID NO: 415537 - RNA, 63 nt, Human
ggcaugagugugcaggguggucacuuucugugggaggaucacaguggggaguuggggguggga

SEQ ID NO: 415538 - RNA, 64 nt, Human
uguuguuggaagagcagcauuuugacccuuggagaagaaaaacuagcuguggcauuccaggugg

SEQ ID NO: 415539 - RNA, 64 nt, Human
uuguuuauguuuguguucuuaaauuuaaaacacgaagaaaaagaaaugucuuucuuguuaguga

SEQ ID NO: 415540 - RNA, 64 nt, Human
gauuuccccaagcuguggauucuuccuacuccuuaagaaaaaaacuuugguuuauuuagcaucu

SEQ ID NO: 415541 - RNA, 64 nt, Human
acacauuuaauuccuauuaaguacagccgcaagaaagaaaaaaugaugaaguugcaaauggcag

SEQ ID NO: 415542 - RNA, 64 nt, Human
caaacucucuaaacugguacaauuuuauaggugaaagaaaaaauucccucauuuaaacccaauc

SEQ ID NO: 415543 - RNA, 64 nt, Human
auggaggagguauuguaagcuuuccauuuucuauaagaaaaaggaaaaguugaggggggggcau

SEQ ID NO: 415544 - RNA, 64 nt, Human
augcauaaaagggucaaaccuguagaugcagaaaaagaaaaaaacuauaaauacaaaucuguau

SEQ ID NO: 415545 - RNA, 64 nt, Human
uuuuccuuccucuguaagauaucccagcuuuaaaaagaaaaaaaaagaauuaccaagagaaggg

SEQ ID NO: 415546 - RNA, 64 nt, Human
ccuuuuuucaggggaagcauucagcaacccuuuaaagaaaaagaauuaaaugcaugcuuuaaau

SEQ ID NO: 415547 - RNA, 64 nt, Human
cuaaguacccauuucuuucugauaaguuauugggaagaaaaagcuaauuggucuuugaauagaa

SEQ ID NO: 415548 - RNA, 64 nt, Human
augucauaauucggggacaauuaucucaaucaucaagaaaaaaauuucagcacuuguuuuguau

SEQ ID NO: 415549 - RNA, 64 nt, Human
uuagcuagaaacucuaaaaacaaaaauaauaauaaagaaaaauaaauaaaaaggagaggcagac

SEQ ID NO: 415550 - RNA, 64 nt, Human
gcaguuuuacauuggggguugcugagguaggcacaagaaaaagucaggcauaaagcacaaggca

SEQ ID NO: 415551 - RNA, 64 nt, Human
ugauaugcuccaugaugcuguguguuuugguaguaagaaaaaaaaauugggaggcuuuucaaag

SEQ ID NO: 415552 - RNA, 64 nt, Human
cagacggaaguuauaaucaucuuggaggaaccauaagaaaaaguguccaggguaucuauauaaa

SEQ ID NO: 415553 - RNA, 63 nt, Human
cauauguauauacacauaucauuuuaagaagcugaggaucacuaauucagauaauguauaagu

SEQ ID NO: 415554 - RNA, 63 nt, Human
uaugcccaugaugucauuucaggcucaaccaaagaggaucaaacaggaauuccaucuuggcuu

SEQ ID NO: 415555 - RNA, 63 nt, Human
acacaccaguagucccagcuacuagggaggcaggaggaucacuugagcccaggaguuugaggc

SEQ ID NO: 415556 - RNA, 64 nt, Human
aucacagagagacagugcaguguagcuuuaguuuaagaaaaaaaaauauuccuccccacugcau

SEQ ID NO: 415557 - RNA, 64 nt, Human
auuagacuucuaaauaaggugugaaaucaucaaaaagaaaaaucaaaguagaaacuacuaauuu

SEQ ID NO: 415558 - RNA, 64 nt, Human
uucauuguaaaaugaacaaauacauaaauauuuuaagaaaaauuuaaguuuauucagauaaguc

SEQ ID NO: 415559 - RNA, 64 nt, Human
uuuacuuuuggaagacaagauuauuagaauauugaagaaaaauuggagacuuauaaucauggua

SEQ ID NO: 415560 - RNA, 64 nt, Human
agauauuuacugagaggaacuauuuuuauaacacaagaaaaauuuacaauugauuaaaaguauc

SEQ ID NO: 415561 - RNA, 64 nt, Human
ucugcuuuugacucauuucuaggcagugcuuaugaagaaaaauuaaagcacaaacauucuggca

SEQ ID NO: 415562 - RNA, 64 nt, Human
uugcuguuguaaaaguguuuucauaaguucacucaagaaaaaugcagcuguucugaacuggaau

SEQ ID NO: 415563 - RNA, 64 nt, Human
gcggcuuucuaauagagagauuaguaaauaugugaagaaaaagaccugcauuuggcaggaagau

SEQ ID NO: 415564 - RNA, 64 nt, Human
augcaaaugucacaguaaugcaagcaaaguaucaaagaaaaacaaugaaauugaccuaguucag

SEQ ID NO: 415565 - RNA, 64 nt, Human
auuauugcuuuaauccaguguauuuguuuauggaaagaaaaacacaaaggcagacuguugagua

SEQ ID NO: 415566 - RNA, 64 nt, Human
uuuaauauuuaaacuucuuguuguggaggcugaaaagaaaaaaaauaauagaaagguaaacaaa

SEQ ID NO: 415567 - RNA, 64 nt, Human
uauguucugcaaauccaacacacguuugccaaucaagaaaaagaaaucggugugaaugagucuc

SEQ ID NO: 415568 - RNA, 64 nt, Human
ccaagggaauucagauucugaccagccaggcccuaagaaaaaauuuaaagcuccccagagcaag

SEQ ID NO: 415569 - RNA, 64 nt, Human
gagguuuuuguuuuuugguuuuuuuuuuuuuuuuaagaaaaaaagaugaaaaaugaaaaaaaaa

SEQ ID NO: 415570 - RNA, 64 nt, Human
accucccgucucucucggaaaaaaaaaaagaaaaaagaaaaagccgggugaggugguguguacc

SEQ ID NO: 415571 - RNA, 63 nt, Human
ucagcuaagaaaauggacuuuagacaaaagcaagaggaucagaugaagaaaaggagagguaga

SEQ ID NO: 415572 - RNA, 63 nt, Human
cuguggucccagcuacucaggaggcugaggugggaggaucauuugagcccaggaggucaaggc

SEQ ID NO: 415573 - RNA, 63 nt, Human
cuguggucccagcugcuggggaggcugaaguaggaggaucauuuaugcuugggaggucgaggc

SEQ ID NO: 415574 - RNA, 64 nt, Human
cauggugaccucccgucucucucggaaaaaaaaaaagaaaaaagaaaaagccgggugagguggu

SEQ ID NO: 415575 - RNA, 64 nt, Human
aaaauguauguugguuuagcguuguuuuguggauaagaaaaaugcuugacccugaaauauuuuc

SEQ ID NO: 415576 - RNA, 64 nt, Human
ucagaaaacaguuauauugucauaccauaguaggaagaaaaaccuuuauuuggaauauacacua

SEQ ID NO: 415577 - RNA, 64 nt, Human
aaaaacugauagaagcaacagaagaauucgcaggaagaaaaaucauaguguuaaugaauuauug

SEQ ID NO: 415578 - RNA, 64 nt, Human
uggauggaauaucagaaguauaucuguacagaucaagaaaaaaagggagaauaaaauuccuauc

SEQ ID NO: 415579 - RNA, 64 nt, Human
uauuaaugggccaaugcaaaaaaucauuuuuucaaagaaaaauuuguccauguaaagcuuaaau

SEQ ID NO: 415580 - RNA, 64 nt, Human
aacagaaaaauaaaugauuuaaaaucaaaucaaaaagaaaaaacuaaacauuuaaacaaaaaug

SEQ ID NO: 415581 - RNA, 64 nt, Human
acagagaggccaugggaagauuugaaaauuauuaaagaaaaauuccuacagauuuucaaugcag

SEQ ID NO: 415582 - RNA, 64 nt, Human
caaagguaauuaauuuauucuuuuuuucuuaaagaagaaaaagacauugguuguuguuacaaaa

SEQ ID NO: 415583 - RNA, 64 nt, Human
gaugcggguguaagcccugauuuuuuuuucucccaagaaaaaucuuaaaggaccacuuuagaua

SEQ ID NO: 415584 - RNA, 64 nt, Human
acuaaacaucuucaaaugguacuaugaggaaaaaaagaaaaacauuuuucuaaauauucaacua

SEQ ID NO: 415585 - RNA, 64 nt, Human
uucuaaaaggaaaaauaauuuuaaguaaagaaaaaagaaaaaaaaggaagacuaaacagaaacc

SEQ ID NO: 415586 - RNA, 64 nt, Human
gugaacuuucuaaaaggaaaaauaauuuuaaguaaagaaaaaagaaaaaaaaggaagacuaaac

SEQ ID NO: 415587 - RNA, 64 nt, Human
cugagcucagugcugcuggaugaugagggagaucaagaaaaagccacguaagggacuuuauaga

SEQ ID NO: 415588 - RNA, 64 nt, Human
uggcuuuagauuuaaaguaaauugaaauguuuuaaagaaaaaaguauucacagauuuaauaccu

SEQ ID NO: 415589 - RNA, 63 nt, Human
uggaggcucuaauugaauuuucaagcaucuccugaggaucagaaaguaauuucuucucaaagg

SEQ ID NO: 415590 - RNA, 63 nt, Human
cuguagucccaccuauucaggagauuaaggcaggaggaucacuugagcccaggaggucaaggc

SEQ ID NO: 415591 - RNA, 63 nt, Human
cuguagucucagcuacucaggaggcugagaugagaggaucacuugagccugaggagguccagg

SEQ ID NO: 415592 - RNA, 64 nt, Human
uaaaguuucaauacaagccauaggcucacagaaaaagaaaaagaaaauaaaaauuaaauuaaaa

SEQ ID NO: 415593 - RNA, 64 nt, Human
ccauacaauucuacuguaacuacccaucaacuuaaagaaaaauauuaucucuucucuuuacauu

SEQ ID NO: 415594 - RNA, 64 nt, Human
uugauuccuuggaucccacccauucuuucacuuuaagaaaaaacaaauaauuguugcagagguc

SEQ ID NO: 415595 - RNA, 64 nt, Human
agccugggugacagagcaagaucuugucucaaaaaagaaaaaaaaucacaaaauacuggcuaca

SEQ ID NO: 415596 - RNA, 64 nt, Human
auccagcaucuauacguaauuuaaacaaauuuagaagaaaaaaccaccccauuaaaaagugggc

SEQ ID NO: 415597 - RNA, 64 nt, Human
cucuggagccgccauucugcagaguauuuggaaaaagaaaaaaggguuuaugcuuacgucucug

SEQ ID NO: 415598 - RNA, 64 nt, Human
uuugaacaaacuacaucuuaggucauuuaagaauaagaaaaauaaaaguuuuuauuuaccuuca

SEQ ID NO: 415599 - RNA, 64 nt, Human
agaagauaagccauguuucuguauuguacauguaaagaaaaauaaaacuguuuaugauacuugu

SEQ ID NO: 415600 - RNA, 64 nt, Human
aaauauaauuaccuguaagguuaucugguuuuaaaagaaaaaaaaaaagccuacaaacucagug

SEQ ID NO: 415601 - RNA, 64 nt, Human
uguauuucaguguuucacuuacuggacggauaacaagaaaaaaauccuaacacaggcaggcacc

SEQ ID NO: 415602 - RNA, 64 nt, Human
ccugagcaacagagcgagacccugugucuaaguaaagaaaaagccagaagugacucccacugcu

SEQ ID NO: 415603 - RNA, 64 nt, Human
guagaguuguuguuugggguacaagaugagaagaaagaaaaaccuacagccuuucuacauucug

SEQ ID NO: 415604 - RNA, 64 nt, Human
aaacauaaaaacaucacacuaaucuuggaggaauaagaaaaauuguacauccauuaaauguaca

SEQ ID NO: 415605 - RNA, 64 nt, Human
ugcuugcuaaugguacuaguaguacuccuuucagaagaaaaaauggagcgauuuaggugaccaa

SEQ ID NO: 415606 - RNA, 64 nt, Human
aaaacuuauuaggcaugaaaucaaucagaagagaaagaaaaaugcuggaacaugcuugauguau

SEQ ID NO: 415607 - RNA, 64 nt, Human
uggugcuggagguggcugcagagagccacuugucccacgucaccauuucaucucauuguaggcu

SEQ ID NO: 415608 - RNA, 64 nt, Human
acacucccacccagucucugcuccaccuuucagcccacgucacguguaguguccauuuugugaa

SEQ ID NO: 415609 - RNA, 64 nt, Human
gucucuggaucuuuccucauugacugacucugugccacgucauccauaguuuauuguuaguaug

SEQ ID NO: 415610 - RNA, 64 nt, Human
ugucacagccucuaucacacaucuguuuuucucgaagaaaaaaauauaauuaauaaaaauguuu

SEQ ID NO: 415611 - RNA, 64 nt, Human
ucuaaaugguucugaauagcuuuaaaagaugaauaagaaaaaagaucaagcucuuuugaggcua

SEQ ID NO: 415612 - RNA, 64 nt, Human
ccuguuauuuaugcuugcugcacagacauauuagaagaaaaaaaaaagcuuuguauuauucuuc

SEQ ID NO: 415613 - RNA, 64 nt, Human
auguuuggugagguuauuuugggauaaauuacaaaagaaaaaaaauuagacacugcauuaauuu

SEQ ID NO: 415614 - RNA, 64 nt, Human
uucuucuaaagcaaagucauuggaugggaggaggaagaaaaagucccauaaaggaacuuuugua

SEQ ID NO: 415615 - RNA, 64 nt, Human
ccuuuguuuacucagauuucucuuagccauaaggaagaaaaagaacucuugcaugaaaauagca

SEQ ID NO: 415616 - RNA, 64 nt, Human
aaaacuaugaaaaaauguauuuucuucuaugugcaagaaaaauagggcauuucaaagagcuguu

SEQ ID NO: 415617 - RNA, 64 nt, Human
gcaacaagagugaaacuccaucuccaaaaaaaaaaagaaaaaguaacaaaaggaaauuauuugu

SEQ ID NO: 415618 - RNA, 64 nt, Human
caugacauacuuuugcuuucaguaguuucauguaaagaaaaaaacuugaaaauaguaauaccug

SEQ ID NO: 415619 - RNA, 64 nt, Human
aucuaaaauaaaaaucgaaauaauuuuuuuaaaaaagaaaaagacaauaguauuacccauggga

SEQ ID NO: 415620 - RNA, 64 nt, Human
augaucaaggaaagcaagagagcagauaauacaaaagaaaaagaagaagguucacauaaauagc

SEQ ID NO: 415621 - RNA, 64 nt, Human
uugaaauuaacucuuccaugaguuuucauugcugaagaaaaaccaaacauucuuguaaaaacau

SEQ ID NO: 415622 - RNA, 64 nt, Human
cuauaccucaguccuauuugaaagaccuaauugaaagaaaaaucauagaaauaaguaaaaugau

SEQ ID NO: 415623 - RNA, 64 nt, Human
aaauaaauguucaugauuucaagauguuauauuaaagaaaaacuuuaaaaauuauuauauauuu

SEQ ID NO: 415624 - RNA, 64 nt, Human
uuuggaggagcucuugcauuuaaauaccccagccaagaaaaauugcacagauaguguauauaag

SEQ ID NO: 415625 - RNA, 64 nt, Human
gcaggcaccuucucuuuuccagagccuggggccuccacgucacagaguccaacagggacaucac

SEQ ID NO: 415626 - RNA, 64 nt, Human
ggccaaauugaggcacccaagugauccacuggccccacgucacacaguuacagugaagcccaag

SEQ ID NO: 415627 - RNA, 64 nt, Human
gaaucucuguggggcgaugcugcagcggcugaaaccacgucaagucccccagagcccggcauuc

SEQ ID NO: 415628 - RNA, 64 nt, Human
uagguauaaaaccuacugcaacuuagaaaaaggaaagaaaaaagaaaacuuuuccaacugcugc

SEQ ID NO: 415629 - RNA, 64 nt, Human
cauuuaagugcuguuuguucuuaaaaugcauuuaaagaaaaauuacccauauugacuuucacac

SEQ ID NO: 415630 - RNA, 64 nt, Human
aaaugauauuucaaagguaaaacaauacaauauaaagaaaaaaauaaauauauuaauaccggcu

SEQ ID NO: 415631 - RNA, 64 nt, Human
ggaauaauauugugaaaaugaaucuguuaugauaaagaaaaaauaaaguggaaacuuuuagagu

SEQ ID NO: 415632 - RNA, 64 nt, Human
aguagaaaaggaaacuaguagggccaaaaaaaaaaagaaaaagaaaaagaaaaaagaaaaaaaa

SEQ ID NO: 415633 - RNA, 64 nt, Human
aaaggaaacuaguagggccaaaaaaaaaaagaaaaagaaaaagaaaaaagaaaaaaaaagaaaa

SEQ ID NO: 415634 - RNA, 64 nt, Human
aacuaguagggccaaaaaaaaaaagaaaaagaaaaagaaaaaagaaaaaaaaagaaaaaacugg

SEQ ID NO: 415635 - RNA, 64 nt, Human
agggccaaaaaaaaaaagaaaaagaaaaagaaaaaagaaaaaaaaagaaaaaacugggaccuaa

SEQ ID NO: 415636 - RNA, 64 nt, Human
aaaaaaagaaaaagaaaaagaaaaaagaaaaaaaaagaaaaaacugggaccuaaguauaaauau

SEQ ID NO: 415637 - RNA, 64 nt, Human
uacuuaaaacuuugguuguuuuccuguaauauaaaagaaaaaguuaauuuaucaauugauugaa

SEQ ID NO: 415638 - RNA, 64 nt, Human
acagcauuuuaaccgcucuaaaaauuaccagaguaagaaaaagcuagguacuuuaaagugaguu

SEQ ID NO: 415639 - RNA, 64 nt, Human
uuaguuuuaucuacucuucuauugaaguuaaagaaagaaaaaaagauuuuuuuauuuguauuaa

SEQ ID NO: 415640 - RNA, 64 nt, Human
uuucuugcaauuugaagguacgaguagagguuuaaagaaaaaucaguuuuuguucuuaaaaaug

SEQ ID NO: 415641 - RNA, 64 nt, Human
gaauaacaacugcugggaauauccgugccaggaaaagaaaaauuucuggcaaauauuuugucac

SEQ ID NO: 415642 - RNA, 64 nt, Human
gaccauaauuaacaucacuuagugaauugugauaaagaaaaaaaagccaugauuuauucgaugu

SEQ ID NO: 415643 - RNA, 64 nt, Human
aguaauugcuguuugcacuuacugcauggucagaccacgucacuacauuucuaugcaaggggac

SEQ ID NO: 415644 - RNA, 64 nt, Human
cugaaccagccugguccacugggaacucaaaagcccacgucaggaccacagaccccccaggccc

SEQ ID NO: 415645 - RNA, 64 nt, Human
uaagcuaagugaguuggguuuucgaaccuguuguccacgucacaguuuuucugcucuggucauu

SEQ ID NO: 415646 - RNA, 64 nt, Human
ugggggggcauguuuugacauuaaauugacuuuuaagaaaaacaugucacuaaccugaagcuca

SEQ ID NO: 415647 - RNA, 64 nt, Human
guucuaaaaaauguuuuuaacaauaauaagauaaaagaaaaaccugugauucauauguccccac

SEQ ID NO: 415648 - RNA, 64 nt, Human
aaucucaggccccuauauagucacacuuugauuuaagaaaaauggagcucuugaaaucaaaaga

SEQ ID NO: 415649 - RNA, 64 nt, Human
uacuccuacuugcuguaggaauaaccuugcugauaagaaaaaaagggacaauauuggagaaacu

SEQ ID NO: 415650 - RNA, 64 nt, Human
aggauaaaggacaugagagaguauuuuaaaacuaaagaaaaaauuagcugccagaagcaacuga

SEQ ID NO: 415651 - RNA, 64 nt, Human
aauugaacccauccacucugggcagguaagagaaaagaaaaagauaaggaaagaagagagaaga

SEQ ID NO: 415652 - RNA, 64 nt, Human
agacaaagaucacuacagaccaaaacagaagaagaagaaaaaaaagaaaaagaaaucuaagcaa

SEQ ID NO: 415653 - RNA, 64 nt, Human
ucacuacagaccaaaacagaagaagaagaaaaaaaagaaaaagaaaucuaagcaacaugguaag

SEQ ID NO: 415654 - RNA, 64 nt, Human
cugauuugugaugucaauaggauggcaccuuggaaagaaaaaugaagaacaacuuuaucaagga

SEQ ID NO: 415655 - RNA, 64 nt, Human
guuuucuccuugauaucauucagcaucuacucuaaagaaaaaugccugucucuagcuguucugg

SEQ ID NO: 415656 - RNA, 61 nt, Human
ucugggcauucugcugcugagcuugcagaaaaagaaaaaugagcucaaaauuugcuuugag

SEQ ID NO: 415657 - RNA, 61 nt, Human; identical to SEQ ID NO: 415656

SEQ ID NO: 415658 - RNA, 64 nt, Human
aagcagugcaagauucaguucaagguccugaaaaaagaaaaacauuuuacucuguguaccuugu

SEQ ID NO: 415659 - RNA, 64 nt, Human
gacauguuacccgacuaaggaucacucuguucauaagaaaaaggccugaagugacucuguuuaa

SEQ ID NO: 415660 - RNA, 64 nt, Human
uccagccugugcaacaagagugaaacuccauuucaagaaaaaaaaaaaaaaaagaauaugcaca

SEQ ID NO: 415661 - RNA, 64 nt, Human
aacuccacaggguuuggagaauagaaaugaaaagccacgucauauaacucaagaauaaauggug

SEQ ID NO: 415662 - RNA, 64 nt, Human
gcuggucuugaacuccugaccucaggugauccacccacgucaggcucccaaagugcugagauua

SEQ ID NO: 415663 - RNA, 64 nt, Human
uaguagcaucuagguacagaugcugguuguauuaccacgucaauguccuaugcaguauuguuag

SEQ ID NO: 415664 - RNA, 64 nt, Human
uaggguggagaaggaggaguuaucuccacuccaaaagaaaaaaaaaaaguuuuuuaccuuacac

SEQ ID NO: 415665 - RNA, 64 nt, Human
aaguaugaccguuccuaucucagaucuuaauaaaaagaaaaaaaaaaacgcauucagguuaaau

SEQ ID NO: 415666 - RNA, 64 nt, Human
aaaaaaacaaacuaacuaacuaacuguguaaagaaagaaaaagggaaguaccaauggguuuuuc

SEQ ID NO: 415667 - RNA, 64 nt, Human
ucaaucagcauauacauuucagccaaagccauagaagaaaaagcaauaguugcuugaauuauga

SEQ ID NO: 415668 - RNA, 64 nt, Human
ccuagaccaugucaucuacaagcuucaguaacuaaagaaaaaggaacuucccugaguggcuuga

SEQ ID NO: 415669 - RNA, 64 nt, Human
gucacuuuaugcguuuuccacuuuuuucuuuuuuaagaaaaagaaguaccauuuuuguuuuguu

SEQ ID NO: 415670 - RNA, 64 nt, Human
ucaucaacacagugaaacuccaucucaauuuaaaaagaaaaaaagugguuuuaggaugucauuc

SEQ ID NO: 415671 - RNA, 64 nt, Human
aagggacugagugagccuuuugcaggaaaaggcuaagaaaaaggaaaaccauucuaaaacacaa

SEQ ID NO: 415672 - RNA, 64 nt, Human
accaucucuguaggaucguaaaaaaauagaaaaaaagaaaaaaaaaagaaagaaagagggaaaa

SEQ ID NO: 415673 - RNA, 64 nt, Human
augaaaaccaccuuccuauguuuguaaaauauuuaagaaaaaauuggcaaacaauuaaugcuua

SEQ ID NO: 415674 - RNA, 64 nt, Human
gaaccgccaugccuggcccuugauuuuucuuuuuaagaaaaaaauaucuaggaguuucuuagac

SEQ ID NO: 415675 - RNA, 64 nt, Human
auuagguuugaauugcuuuuuaaaaaaaaaagaaaagaaaaagacagcaucucacuauguugcc

SEQ ID NO: 415676 - RNA, 64 nt, Human
uggcauggauuaauagaguuggaguuuuauuuuuaagaaaaauucacaagcuaacuuccacuaa

SEQ ID NO: 415677 - RNA, 64 nt, Human
auuuuauaguuucuacuuguaaaauauuuuuaauaagaaaaauugguuugcauaaucucagugu

SEQ ID NO: 415678 - RNA, 64 nt, Human
gagugggugagggugggagaaaguuacauauuuaaagaaaaauaaauuuaauaacaaguuucuc

SEQ ID NO: 415679 - RNA, 63 nt, Human
uauaaucucagcacuuuugggaggccaagacaggaggaucacuucaggccaggaguucaagau

SEQ ID NO: 415680 - RNA, 63 nt, Human
uaagaauugagcgcuauggguguuaacgugcaugaggaucaguuugcagcagcaaguacaaaa

SEQ ID NO: 415681 - RNA, 63 nt, Human
cuguaaucccagcacuuugggaggccaaggugggaggaucaauugaggccagaguuugaaacc

SEQ ID NO: 415682 - RNA, 64 nt, Human
auuuuuuuaagacucugucuuaaaaaaaacuaaaaagaaaaaaagaagccccuucacucuacag

SEQ ID NO: 415683 - RNA, 64 nt, Human
gggaggcaucaguugcuauauauuaaaaacaaaaaagaaaaaaaaggaaaauguuuuuaaaaag

SEQ ID NO: 415684 - RNA, 64 nt, Human
cucaucugucagaaauccaugugggcuuccuggaaagaaaaaaaaaaaaaagaaaacuaggcau

SEQ ID NO: 415685 - RNA, 64 nt, Human
caguuaucaaagauaaauuggcaagucaguacuuaagaaaaaagauuugauuaucaucacagca

SEQ ID NO: 415686 - RNA, 64 nt, Human
acuccuguugaugcagcuaagguacauuuguaaaaagaaaaaaaaccagacuuuucagacaaac

SEQ ID NO: 415687 - RNA, 64 nt, Human
cuaauuuuauuuuccccagcugauauaaaaaggaaagaaaaacuaugauagacuucuuggauua

SEQ ID NO: 415688 - RNA, 64 nt, Human
cugauauuauuucuauuuaauacucuuuucucucaagaaaaaaaaaaaaguuuguuuuuucuuu

SEQ ID NO: 415689 - RNA, 64 nt, Human
auuccuaauaauagggauaaugcuguuuauugucaagaaaaaguaaaaucguucucuucaauua

SEQ ID NO: 415690 - RNA, 64 nt, Human
uagaagaguauauaucucuuuaaaaaaaaacagaaagaaaaauauuucugagcacucauuagcc

SEQ ID NO: 415691 - RNA, 64 nt, Human
ucaugcuuuggagauuaacuauaaaagcaagauuaagaaaaauauguuaauuaccauaucccug

SEQ ID NO: 415692 - RNA, 64 nt, Human
ugccugagggcuugcauagcuuucacauuaaaaaaagaaaaagcuagcagauuuacuccuuuuu

SEQ ID NO: 415693 - RNA, 64 nt, Human
uuauucucuuguaaaagaaaaggaaaaauuaguaaagaaaaaaguuuuaguugauguuaccugc

SEQ ID NO: 415694 - RNA, 64 nt, Human
acaguaaaaaacagggcauagccuaguuuguuauaagaaaaagcauccauuuucuauccuuuua

SEQ ID NO: 415695 - RNA, 64 nt, Human
augaaugguuuaaucaaggcuuuauuuuggaaguaagaaaaauggcagugaugauuaaauugcu

SEQ ID NO: 415696 - RNA, 64 nt, Human
gggcuauggaaagacagcuuuuccuacacugauaaagaaaaaaaaugaggaaauuauuucaucc

SEQ ID NO: 415697 - RNA, 63 nt, Human
aaaguggaggggacacuccagaggcugucgugggaggaucaugugagccugggaggucaaggc

SEQ ID NO: 415698 - RNA, 63 nt, Human
cuguaggccuagcugcucaggaggcugaagcaggaggaucacuugagccugaguucaacacug

SEQ ID NO: 415699 - RNA, 63 nt, Human
guguagucucagcuacucaggaggcugagaugagaggaucacuugagccuggggagguccagg

SEQ ID NO: 415700 - RNA, 64 nt, Human
uuuggaagauuguauuuaaaguucuucaaggaugaagaaaaaaaucuguuaauuagguaaacca

SEQ ID NO: 415701 - RNA, 64 nt, Human
gaugauuugcaaugggauguaugaauacagcagcaagaaaaaaaaaugccauaauacaaaaggc

SEQ ID NO: 415702 - RNA, 64 nt, Human
ugguauuucacugaauuucaaacauuugucagagaagaaaaacgugaggacucaggaaaaauaa

SEQ ID NO: 415703 - RNA, 64 nt, Human
uugauaaagcauauuuaugaacauauuucuuaauaagaaaaauauccauuuuauuaccauuuuc

SEQ ID NO: 415704 - RNA, 64 nt, Human
uaaauauuucaguguuguuugguguaagccuucaaagaaaaaacauaaaaagugggaaggugau

SEQ ID NO: 415705 - RNA, 64 nt, Human
ugaaauacauuauauauuaucuuuauguacucuuaagaaaaacgagcaaggaagaguaucuuca

SEQ ID NO: 415706 - RNA, 64 nt, Human
auuauggugcuacugagcguuuucuuuugguaaaaagaaaaaugccaugggcugcagucuucuu

SEQ ID NO: 415707 - RNA, 64 nt, Human
ucagggaccaugaaaagaaacuugugcuucaccgaagaaaaauaucuaaacaucgaaaaacuua

SEQ ID NO: 415708 - RNA, 64 nt, Human
uguguaaucuuuuaaaaauauuaucuugcagauaaagaaaaaaauuaagaguguguuuacaacu

SEQ ID NO: 415709 - RNA, 64 nt, Human
aaaacugauaauaucuguaaugacaucagaaugaaagaaaaaaaauuguacaguguauauuccu

SEQ ID NO: 415710 - RNA, 64 nt, Human
gaaaccaggagguuaucaugguaguugaccuuauaagaaaaaugauucuucuucagaaauuaaa

SEQ ID NO: 415711 - RNA, 64 nt, Human
uguaacuuuacaguuaaacuaguuuuaguuuaaaaagaaaaaaugcagggugauuucuuauuau

SEQ ID NO: 415712 - RNA, 64 nt, Human
cuccauuugagaaaauaaagcuauucacauuguuaagaaaaauacuuuuuaaaguuuaccauca

SEQ ID NO: 415713 - RNA, 64 nt, Human
uuuuccccaaagauaauauccucuuagggaacauaagaaaaauguauaauaaaaauguggugcu

SEQ ID NO: 415714 - RNA, 64 nt, Human
cagaggaggagaaauugaagguccagggcaaugaaagaaaaauggcgcccucucaauuuagucu

SEQ ID NO: 415715 - RNA, 63 nt, Human
aauccaguaagucuuuccucguuccuacuuguggaggaucaguagcuguuaugaugccagacc

SEQ ID NO: 415716 - RNA, 63 nt, Human
cuguaaucccaguacuuugagacgcugaggugggaggaucacuugagcccaggaguucaaaac

SEQ ID NO: 415717 - RNA, 63 nt, Human
ccuccagcuggcucccuugucuccagggcuuuggaggaucaggguagggagggcucugucucu

SEQ ID NO: 415718 - RNA, 64 nt, Human
gaaauccuauauccaguuuccuguaauuuaauugaagaaaaauacauccaaauaaagacuuuau

SEQ ID NO: 415719 - RNA, 64 nt, Human
aguuuaauuuaaaacuaugguguaagucuuugacaagaaaaaaaaacaaacaaacacuucuuuc

SEQ ID NO: 415720 - RNA, 64 nt, Human
aggacucaaguugcuuuauaaaguugcuggauagaagaaaaauaacuuguacuuuuauuucuga

SEQ ID NO: 415721 - RNA, 64 nt, Human
uaauucuugcugaguugacuuucccuuguaggaaaagaaaaauauuucaaauagaaacccaccu

SEQ ID NO: 415722 - RNA, 64 nt, Human
ucuuucaguacgagacaaaguuucuuaaaucccgaagaaaaauauaaguguuccacaaguuuca

SEQ ID NO: 415723 - RNA, 64 nt, Human
accagacacuuggcaaauuuaccucuuucuucaaaagaaaaacuuuaagaaaaugagccaaugg

SEQ ID NO: 415724 - RNA, 64 nt, Human
caagugccauuuuaauaaaaaauguauuuaaaaaaagaaaaaagacaauauacugacagucuaa

SEQ ID NO: 415725 - RNA, 64 nt, Human
aacauugucaguuaacaucacucuugucuggcaaaagaaaaaaaauagacuuuuucaacucagc

SEQ ID NO: 415726 - RNA, 64 nt, Human
gaaugccaguagaaaauucauaacguguaucuuuaagaaaaaugagcauacaucuuaaaucuuu

SEQ ID NO: 415727 - RNA, 64 nt, Human
gcuuuuguuuucagagcaaugggucagggauuacaagaaaaacuuugcuaaauuuuacaauaaa

SEQ ID NO: 415728 - RNA, 64 nt, Human
ucaaaacuguuucuucuauuccugguucauaggaaagaaaaaaguuauucaaaguauuuuuaaa

SEQ ID NO: 415729 - RNA, 64 nt, Human
aaauuaaauccuugcaggaagagaaauuaacacuaagaaaaagucaucaauauuuuucaacuuu

SEQ ID NO: 415730 - RNA, 64 nt, Human
aucuuuuguacuucucauaaccuaaugucagacuaagaaaaauaaaauaucugagaguaaauac

SEQ ID NO: 415731 - RNA, 64 nt, Human
ugaacgugagugggguauuuuguucuggcauuaaaagaaaaacaagcaagcaaacaaaaacaca

SEQ ID NO: 415732 - RNA, 64 nt, Human
ucuuuucaaauuaaguauauaaaaguaaacuuuuaagaaaaacauuuuuaaugagauuuuaaua

SEQ ID NO: 415733 - RNA, 63 nt, Human
aaucauuuuaggauugucaaaaggaggauugaggaggaucagaucaauaauggaggcaauggu

SEQ ID NO: 415734 - RNA, 63 nt, Human
guaccgggaccggaaacuucuuggugcugaagagaggaucaugcaaacuguggagaucacuaa

SEQ ID NO: 415735 - RNA, 63 nt, Human
agcaugaccgcucucugacuucacauguuaauagaggaucagagcagaguugggaguauauug

SEQ ID NO: 415736 - RNA, 64 nt, Human
cauuaagacaaaagcaauguguucaugaagacuuaagaaaaaugucacuacugcaacauuagga

SEQ ID NO: 415737 - RNA, 63 nt, Human
ccuguagacuuauagauuauuccauauuauuaaaaagaaaaaagccaaaaagaaaaaaaaaaa

SEQ ID NO: 415738 - RNA, 64 nt, Human
aacaaacaaaugaaaaacguuuaaaaagaagaagaagaaaaaaaacaagaacaagcagcaacag

SEQ ID NO: 415739 - RNA, 64 nt, Human
uucaucccuuccuauaaccucuagguaaaaagaaaagaaaaaaagaaauuucgagauauuuuca

SEQ ID NO: 415740 - RNA, 64 nt, Human
gcuuuuuuuguacauauuuuuuuuuucuaaagagaagaaaaaguuaucacaaaauguauucugg

SEQ ID NO: 415741 - RNA, 64 nt, Human
gcagagauuuauaaaaauauauaagaaagauguuaagaaaaauuaaggggggauccauugaaag

SEQ ID NO: 415742 - RNA, 64 nt, Human
uacuuucaaguaaauauagcauuccuuuggcaaaaagaaaaaaaaaguaaaagaaaagaaaaaa

SEQ ID NO: 415743 - RNA, 64 nt, Human
uuccuuuggcaaaaagaaaaaaaaaguaaaagaaaagaaaaaaaauguauuaccacccgaugag

SEQ ID NO: 415744 - RNA, 64 nt, Human
ccauuguucugcuuguuguaauggugaaugcuuuaagaaaaaaaaguguaauuugcuaagaaua

SEQ ID NO: 415745 - RNA, 64 nt, Human
uacaugucuauuugucaaacauaagugggaaccaaagaaaaaaugugacaaguuugaagacaca

SEQ ID NO: 415746 - RNA, 64 nt, Human
aacuucaguuacugaccagucaagagaauuucucaagaaaaaucccagcaacguucccucuuuc

SEQ ID NO: 415747 - RNA, 64 nt, Human
aaauauacaaucaagauaucucauggcauauuaaaagaaaaaucuuaauagcaguguuggcuuu

SEQ ID NO: 415748 - RNA, 64 nt, Human
uugcugagcaaccaguguguuucaggaugauacaaagaaaaauauagaauagaaauaagugcag

SEQ ID NO: 415749 - RNA, 64 nt, Human
cuggaugagaaaauuuucaauucuggccaugagaaagaaaaaaaaauaaacagccuucuuuuuu

SEQ ID NO: 415750 - RNA, 64 nt, Human
cccuaaaauuaucagacuuccuuuuuccaauauaaagaaaaaaaguaaguuuucagaauucucu

SEQ ID NO: 415751 - RNA, 63 nt, Human
guguccuuaaaacucuggagugagaggaugccagaggaucaagaaaaggaucacaguuucuug

SEQ ID NO: 415752 - RNA, 63 nt, Human
ugguaaauucacaaauacauaaccuugaauaaugaggaucaacuguaccauauuuaauaaagc

SEQ ID NO: 415753 - RNA, 64 nt, Human
aauuuguuguuauaggucuuaccugugugaaagaaagaaaaagaaagaaagaaagaaagagaaa

SEQ ID NO: 415754 - RNA, 64 nt, Human
uucauaaaauguaauguacauuguaaucuuuuaaaagaaaaaucaggguugcacuugcaacuuu

SEQ ID NO: 415755 - RNA, 64 nt, Human
uauggaaucaacaccaccgagcucugugggaaaaaagaaaaaccugcucccuucgcucugcugg

SEQ ID NO: 415756 - RNA, 64 nt, Human
aacauguaucugucuacuuucucuuguuuaaaaaaagaaaaaaaaacuuaaaaaaaugggguua

SEQ ID NO: 415757 - RNA, 64 nt, Human
aaaagcuuugaaaauggaugguuuggguauuaaaaagaaaaaaaaaacuuaaaaaaaaaaagac

SEQ ID NO: 415758 - RNA, 64 nt, Human
ccugagacaagccgaguaugaggugguuugauuuaagaaaaaucaaugaaauuguuuacuacug

SEQ ID NO: 415759 - RNA, 64 nt, Human
ugcuuuuguuuuuuauuuugaacagacguuuuaaaagaaaaaaaaacaacuaccuucuguccua

SEQ ID NO: 415760 - RNA, 64 nt, Human
uccagccugggugacagagcgagacuguguuucaaagaaaaaaaaaaacaagcagccuuuugcu

SEQ ID NO: 415761 - RNA, 64 nt, Human
ccauguacucagauaaacaugaagaaaauaagcaaagaaaaauggagacugggaaagcaaagcu

SEQ ID NO: 415762 - RNA, 64 nt, Human
uuggauuaauaaguggaugguuuuuguuucuaaaaagaaaaaaaaaaucaguguucacccuuau

SEQ ID NO: 415763 - RNA, 64 nt, Human; identical to SEQ ID NO: 415731

SEQ ID NO: 415764 - RNA, 64 nt, Human
aaugugucucuauauuauacagguaccuauguaaaagaaaaacuugagaaccacuggaauauga

SEQ ID NO: 415765 - RNA, 64 nt, Human
uuauaguaccaucucccccgccaauaaaaaagagaagaaaaaagagaaacccguggcacuaugu

SEQ ID NO: 415766 - RNA, 64 nt, Human
uuaaaaaaagaaaaaaugaaaaaaaaaggaaaaaaagaaaaaaggaaaaaaacaguuugaacac

SEQ ID NO: 415767 - RNA, 64 nt, Human
uuccaguguguaacccaguuugaaaucuuaaaaaaagaaaaaaugaaaaaaaaaggaaaaaaag

SEQ ID NO: 415768 - RNA, 63 nt, Human
accuacuauaugcagaaggggaggccgaggugggaggaucauuggaucucaggaguucgagau

SEQ ID NO: 415769 - RNA, 63 nt, Human
cuucucgcucauaaugacacccagcuccuuugagaggaucagagcccauugcacaagaagagc

SEQ ID NO: 415770 - RNA, 63 nt, Human
cuguaaucccagcacuuugggaggcugaggcaggaggaucacuugaggucaggaguuugagac

SEQ ID NO: 415771 - RNA, 64 nt, Human
aaaugucuuuaggaagucacuaaaacuuaauuggaagaaaaaaucaugaugcuuauacaauaaa

SEQ ID NO: 415772 - RNA, 64 nt, Human
cauuuauguuagcauuaaugcacauuuuuaaaaaaagaaaaaaacauggucuuguuuuuacuac

SEQ ID NO: 415773 - RNA, 64 nt, Human
augacuguugccugcaaaaauaaaagggaaaaaaaagaaaaaagaaacaaaaaggaacuucuua

SEQ ID NO: 415774 - RNA, 64 nt, Human
cuguggcaugcaaaagaaagcaaauuauuuuuaaaagaaaaaaaccaaaguacuuuugguguca

SEQ ID NO: 415775 - RNA, 64 nt, Human
gaagagguacuuuccuggaauaauugucuaccugaagaaaaaaaauuuauauauacauugugug

SEQ ID NO: 415776 - RNA, 64 nt, Human
ccuuuuuggucaguaaaacuuaaugaaaaaagcaaagaaaaaaauauucugaacaaagcuauag

SEQ ID NO: 415777 - RNA, 64 nt, Human
aucauuuuuuauauauucuuauaaaaauguaaaaaagaaaaacaccgcuucugccuuuucacug

SEQ ID NO: 415778 - RNA, 64 nt, Human
aaaguauauuuguuuaauggccuauuuuuagaugaagaaaaagccaguugguaagcuguguuag

SEQ ID NO: 415779 - RNA, 64 nt, Human
uggacugccaguaaaacaaauguguauucaacaaaagaaaaaaaauaaaacaguaacacuuuaa

SEQ ID NO: 415780 - RNA, 64 nt, Human
gcagcuuauuuaaaacuugggguccuuuuuaaauaagaaaaauuauauaaauuuuagaaguuau

SEQ ID NO: 415781 - RNA, 64 nt, Human
cuggggcugggcaguguagaccugccaccgugugaagaaaaaugaaagcacagauagccuaaga

SEQ ID NO: 415782 - RNA, 64 nt, Human
aaauauuuuuguuacuguucugagccaaauucuaaagaaaaaauaaauacauuuccuuguugaa

SEQ ID NO: 415783 - RNA, 64 nt, Human
cuucucuuuauuggugguccuaagugggucacuuaagaaaaaaaaguguaacaaauucucgcuc

SEQ ID NO: 415784 - RNA, 64 nt, Human
auauuacauuuacccuuggcccuuaaaaaaaaaaaagaaaaacccucacagucuuccugguuca

SEQ ID NO: 415785 - RNA, 64 nt, Human
uuuuuuagccuucccuggagaaaaacaaguccccaagaaaaaauucacucuauguagagaaaaa

SEQ ID NO: 415786 - RNA, 63 nt, Human
guugguagaaaaguuauuuguauagaacuuuaagaggaucagaagguuuuuugcagaguuaua

SEQ ID NO: 415787 - RNA, 63 nt, Human
cuguagcaccagcuacuugggagguuaaggugggaggaucacuugagccugggagauagaggc

SEQ ID NO: 415788 - RNA, 63 nt, Human
uugcaaucccagugcuuugggagacugaggcaggaggaucacuuaaggccaggaguucgagac

SEQ ID NO: 415789 - RNA, 64 nt, Human
gaugcugaaggagaaggaggguaguguuuugcaaaagaaaaagaaaagaaccaacagaauuuua

SEQ ID NO: 415790 - RNA, 64 nt, Human
ucucaugccaacacuucuguaauugaucauuauaaagaaaaaacaagguaacagucauaguuca

SEQ ID NO: 415791 - RNA, 64 nt, Human
auauauacuuguuuuuccauuguaugcaaauugaaagaaaaagauguaccauuucucuguugua

SEQ ID NO: 415792 - RNA, 64 nt, Human
gaaagacaugauguauguauuuaagccacguuaaaagaaaaaauauaacuauggaccgguauuc

SEQ ID NO: 415793 - RNA, 64 nt, Human
uuagugggaguggucaaauugguacucuuggaggaagaaaaacuguccuuccuucuccaaaaaa

SEQ ID NO: 415794 - RNA, 64 nt, Human
ggaguggggccucaaagggcagguuuaggcagaaaagaaaaagggcauuccagcuggggcaugu

SEQ ID NO: 415795 - RNA, 64 nt, Human
acagaacauuuggcaggaauuguccuuaugaaacaagaaaaagaaaaugaaaaguauuauuaag

SEQ ID NO: 415796 - RNA, 64 nt, Human
guuugaaguuguuuauucacaucuaucuuauuugaagaaaaagacugauguaauagaucuuugu

SEQ ID NO: 415797 - RNA, 64 nt, Human
caacauugcuugaaaugccucuauguucugaauaaagaaaaaccauaauugcuuguggugaaac

SEQ ID NO: 415798 - RNA, 64 nt, Human
uuucuaaguuaaaucauuuucauuaaaaggaaaaaagaaaaaaaauuuuguaugucaauaacuu

SEQ ID NO: 415799 - RNA, 64 nt, Human
aauuuacagaauauuauauaacccacugcugaaaaagaaaaaaaugauuguuuuagaaguuaaa

SEQ ID NO: 415800 - RNA, 64 nt, Human
ucacuaauacuuacuguuaacugucuugagagaaaagaaaaauaugagagaacuauuguuuggg

SEQ ID NO: 415801 - RNA, 64 nt, Human
agucucaaauuuuucaucucuucaaucacuagucaagaaaaauauaaaaacaacaaauacuucc

SEQ ID NO: 415802 - RNA, 64 nt, Human
uauuugucaaguaauaugaucuuggaaaauuuuaaagaaaaauaauccuacuuauaaacuacuu

SEQ ID NO: 415803 - RNA, 64 nt, Human
gccucuggaacugacccuuugcaagucuuuacaaaagaaaaaaggcaguggggagagagagugu

SEQ ID NO: 415804 - RNA, 63 nt, Human
ggacugcccucucuuguucuuggaaacuuuguugaggaucaauucaccauaaauauguguguu

SEQ ID NO: 415805 - RNA, 63 nt, Human
cuauaaucccagcacuuuaggagccccagacaggaggaucacuuaagcgcagaagaucaagac

SEQ ID NO: 415806 - RNA, 63 nt, Human
ccuguaaucccagcugcuggggggcugaggcaggaggaucaguugaacgugggaggcagaggu

SEQ ID NO: 415807 - RNA, 64 nt, Human
uuuguguaccaucuccagcaaccugauuuuugaaaagaaaaaaggaacuuccucgaacuaaagc

SEQ ID NO: 415808 - RNA, 64 nt, Human
uuacaggcugcauucuugccuuacuguauagaaaaagaaaaaaggcuggguuuacuauugcaca

SEQ ID NO: 415809 - RNA, 64 nt, Human
cuucuguacaucuuacuggguuuaauuaaaaaaaaagaaaaaacucuguuguaaaaacaguuua

SEQ ID NO: 415810 - RNA, 64 nt, Human
ccugaauuggaaaggaaaagaggcccaagugcaaaagaaaaaacauuuuagaaacggacagcuu

SEQ ID NO: 415811 - RNA, 64 nt, Human
gguggggugauugaauauuuguauaaaaagcaaaaagaaaaaaaaaauguuuguuuacugauug

SEQ ID NO: 415812 - RNA, 64 nt, Human
cuuggaagacauugucauaaaagccagugauuuuaagaaaaagagugguucuggaaucaauguu

SEQ ID NO: 415813 - RNA, 64 nt, Human
gaaugacccugaaaugacugacagccccgggcccaagaaaaacccauaaccaccucagauggau

SEQ ID NO: 415814 - RNA, 64 nt, Human
aaugcaagagggaaggugauugguagugaguuaaaagaaaaagagaggaaaagagaguaguuuu

SEQ ID NO: 415815 - RNA, 64 nt, Human
gagaccacgggcaaagcucuucauuuugagagagaagaaaaacuguuuggaaccacaccaauga

SEQ ID NO: 415816 - RNA, 64 nt, Human
acaguuguuugaugcauuaaaagaaaauaaaaaaaagaaaaaagagaaaagaaaaaaaaagaaa

SEQ ID NO: 415817 - RNA, 64 nt, Human
cauuaaaagaaaauaaaaaaaagaaaaaagagaaaagaaaaaaaaagaaaaaaguuguaggcga

SEQ ID NO: 415818 - RNA, 64 nt, Human
aaauaaaaaaaagaaaaaagagaaaagaaaaaaaaagaaaaaaguuguaggcgaaucauuuguu

SEQ ID NO: 415819 - RNA, 64 nt, Human
uauauauauagaaccacuuuuuguagauuaguauaagaaaaauauuuacccuguuuuggggcaa

SEQ ID NO: 415820 - RNA, 64 nt, Human
uguguucagcaaaaugugauguuuuuuucuuuuaaagaaaaaaagugaaaauauauagugccaa

SEQ ID NO: 415821 - RNA, 64 nt, Human
ugaaggugugaugguagaaauaggaaaacaacaaaagaaaaacaauaacaaaaaaagaaagugu

SEQ ID NO: 415822 - RNA, 63 nt, Human
cuauagucccagccacucaagaggcacaggcgggaggaucacuugagccugggagguuguggu

SEQ ID NO: 415823 - RNA, 63 nt, Human
cuguagucccagcuaacugggaggcugaggcaggaggaucacuugagcccaggagauugaggc

SEQ ID NO: 415824 - RNA, 63 nt, Human
cuguaguccuagcuacucaggaggcugaggugggaggaucacuugagcuugggaggcgguggu

SEQ ID NO: 415825 - RNA, 64 nt, Human
ugaaaacgauuuaccaauguuguuuuuuuuuaacaagaaaaaaaauaaaagcacauugucauuu

SEQ ID NO: 415826 - RNA, 64 nt, Human
ggugacagagggagacucugucucgaaagaaagaaagaaaaaaaggaaggaaggagaaggaagg

SEQ ID NO: 415827 - RNA, 64 nt, Human
ccuguaauucuuaaaagacuucuuaaucuucuagaagaaaaaucuccgaagagcucucucuaga

SEQ ID NO: 415828 - RNA, 64 nt, Human
uacuguacugucagcuucacuccaccugagaaaaaagaaaaaaaaauugauagcucaaaugcau

SEQ ID NO: 415829 - RNA, 64 nt, Human
guaauacauguuuacuuuaaagauuguugcagugaagaaaaaccuuuaacugagaaauauggaa

SEQ ID NO: 415830 - RNA, 64 nt, Human
uaccugaucaggaucugggagaauuugaaaaaaaaagaaaaacuagaaaaauaaacaaaauuaa

SEQ ID NO: 415831 - RNA, 64 nt, Human
aaaaagaaaaacuagaaaaauaaacaaaauuaaaaagaaaaaaaaauaccugagacugaguaac

SEQ ID NO: 415832 - RNA, 64 nt, Human
uuuguacaucccaaaggaugagaaugugaccuuuaagaaaaaugaaaacuuuuguaaauuauug

SEQ ID NO: 415833 - RNA, 64 nt, Human
ccaauagucugugucaacagaauacuuauuuuagaagaaaaauucaugauuucuuccugaagcc

SEQ ID NO: 415834 - RNA, 64 nt, Human
agaaauaauaccaggcuuuuauaaacuuuucuagaagaaaaaagauggaacuuuuccaauucag

SEQ ID NO: 415835 - RNA, 64 nt, Human
cuggaagacagagugagaccccaucucaggaaaaaagaaaaaaaaaaagaugucauucagcagg

SEQ ID NO: 415836 - RNA, 64 nt, Human
cugacauuacuuuagcaauucaacuugaugugagaagaaaaaacaaauguuucaacacaaaauc

SEQ ID NO: 415837 - RNA, 64 nt, Human
gagaccuauguugaaaaccccugaaaauucacugaagaaaaaucauuacucuuuuucucaguaa

SEQ ID NO: 415838 - RNA, 64 nt, Human
uauagggcuuuuugacagcuuuuugagaccucuuaagaaaaaauaaaaaguaaaaaaugaaagg

SEQ ID NO: 415839 - RNA, 64 nt, Human
gccaaugacuacucaguuuuaggacuuucuguggaagaaaaaagggagaagaaaucaauuccac

SEQ ID NO: 415840 - RNA, 64 nt, Human
acuuucucccucagaggcacaaacacuuuguguuccacgucaguuugaggggacggugggggga

SEQ ID NO: 415841 - RNA, 64 nt, Human
gugaugugucccaaacggacuggcucauggguggccacgucacaaccucugaucucagaccgug

SEQ ID NO: 415842 - RNA, 64 nt, Human
uggcaucauggggcauuuaauucugacuuuauccccacgucagccuuaauaaagucuucuuuac

SEQ ID NO: 415843 - RNA, 64 nt, Human
uuuagaucuacaugaauaaacaaacuauuuuaccaagaaaaaucucagcuugcuuacugcuuaa

SEQ ID NO: 415844 - RNA, 64 nt, Human
aaagugagucaucagauuaugaguuacuguuuaaaagaaaaaugcuguuuauucaugcugaggu

SEQ ID NO: 415845 - RNA, 64 nt, Human
uuuugacuuuacaaaguauagauguuggaacauuaagaaaaauguauauucccaaugaaaaaau

SEQ ID NO: 415846 - RNA, 64 nt, Human
uaacggauaaaauaauguguuauuuuuauagagaaagaaaaaaauagcaacacaaucuaguuua

SEQ ID NO: 415847 - RNA, 64 nt, Human
gaaguuuuaaaguuuucaauuacgagcaauuuggaagaaaaaaccuaaggugcuuuucaaaaga

SEQ ID NO: 415848 - RNA, 64 nt, Human
ggugcaaaagcaaacaguuccagcaggcucucuaaagaaaaacucauuguaacuuauuaaaaua

SEQ ID NO: 415849 - RNA, 64 nt, Human
aaguaugaugcaucuuacagauuauuaaaaaagaaagaaaaaccugcauauuuuguacagaaaa

SEQ ID NO: 415850 - RNA, 64 nt, Human
gauuuauagcauugacuuuuacacacauucacacaagaaaaaaauccuuucaaaauucuuaaau

SEQ ID NO: 415851 - RNA, 64 nt, Human
uucaggcuuuuuuuugguuucauuuuguuuuuuuaagaaaaagaaaaugaaaggaaaaaaauaa

SEQ ID NO: 415852 - RNA, 64 nt, Human
gaaagcuucagaccgcuaguaaggcucaaagaagaagaaaaacaccaaaaccacaagggaaaag

SEQ ID NO: 415853 - RNA, 64 nt, Human
aaagaagaagaaaaacaccaaaaccacaagggaaaagaaaaacccaguuucuuaggaaacgcaa

SEQ ID NO: 415854 - RNA, 64 nt, Human
uuuauuauccagauuauuuggauaaguccuuuuuaagaaaaaaaaagaaaaugaaaaacaacac

SEQ ID NO: 415855 - RNA, 64 nt, Human
ucauuacugaguuacuuguuacccuuacagaauuaagaaaaauagcacaguaugacauuuuaaa

SEQ ID NO: 415856 - RNA, 64 nt, Human
uuguuuuacuaaagaaagauuacuuagaggaaauaagaaaaaucauguuugcucucccgguucu

SEQ ID NO: 415857 - RNA, 64 nt, Human
auaaaaaaguuugucaucucuagugacuucaauaaagaaaaaacuagaagaggagaaaaaggau

SEQ ID NO: 415858 - RNA, 63 nt, Human
guggcacacaccuguagucccaggcugaggugggaggaucacuugaacccaagaggcagaguu

SEQ ID NO: 415859 - RNA, 63 nt, Human
guggaaucccagcacuucaggaggccgaggugggaggaucacuggagcucgggaguucaagac

SEQ ID NO: 415860 - RNA, 63 nt, Human
cuguaguccaagcuacuugggaggcugaagugggaggaucauuugugcccagguugaggcuau

SEQ ID NO: 415861 - RNA, 64 nt, Human
gggucaaguuggugagaggagagcucauuguuugaagaaaaaccaaaacauuuuauggcuagua

SEQ ID NO: 415862 - RNA, 64 nt, Human
ugcugaguugucaguauguuaucacuagaaaacaaagaaaaaugauuaauaaaugacaauucag

SEQ ID NO: 415863 - RNA, 64 nt, Human
caucuacgauucaacuaaucgaaggauuaaacuaaagaaaaaacuaagaagaacaaugaaccuu

SEQ ID NO: 415864 - RNA, 64 nt, Human
guggucccuuuugaauuucaugagccucucaaaaaagaaaaacuuaaaaaaaaaaaaaaaaaaa

SEQ ID NO: 415865 - RNA, 64 nt, Human
uaaguuucacauggccauggagaaugugcccaagaagaaaaagaauuugaaacagagauacagu

SEQ ID NO: 415866 - RNA, 64 nt, Human
auuuuucacacuguaaauuucuuguacaaacccaaagaaaaaauuaaaaaaaauuuuuuuguuu

SEQ ID NO: 415867 - RNA, 64 nt, Human
ggagacagaguucccucuguauagccucugggacaagaaaaagaaaacacaagaauguauacac

SEQ ID NO: 415868 - RNA, 64 nt, Human
aaaacuguuggagaaauaauguuuaaaguuauuuaagaaaaacuguuacaucacuaaguauuaa

SEQ ID NO: 415869 - RNA, 64 nt, Human
acuggacuuuaagaacuggaaagagguuuuacaaaagaaaaacuuucagauucaucucucauuu

SEQ ID NO: 415870 - RNA, 64 nt, Human
uccccuuccauucccaacucucucucucuuuuuaaagaaaaaugcuaagggcagcccugccugc

SEQ ID NO: 415871 - RNA, 64 nt, Human
gagacaauuuaaggccugcacucuuauuucacuaaagaaaaacuaaugucagcacauguugcua

SEQ ID NO: 415872 - RNA, 64 nt, Human
ccucccuuuccuuuuccccucuucuacccuccccaagaaaaagggccuucaaggcaggaaugag

SEQ ID NO: 415873 - RNA, 64 nt, Human
aagacaaacaauaugucuuuuuuuuuuuugcaugaagaaaaaugucuaucauuuacaguuucaa

SEQ ID NO: 415874 - RNA, 64 nt, Human
gucuugugaaaaaguugaacaaauuuccuaaucaaagaaaaaaguaugagcuccauguuucuuu

SEQ ID NO: 415875 - RNA, 64 nt, Human
uccaugguuauggucgauugccaacagccuuauaaagaaaaagaagcuuuucuagggguuugua

SEQ ID NO: 415876 - RNA, 63 nt, Human
uuuaaguacaaguuuguuuaagugccagacuuugaggaucaguuuuaauuucuccauuuguaa

SEQ ID NO: 415877 - RNA, 63 nt, Human
ucugggaggaccaggaaacagccucaguggccagaggaucaccagugcauccuucaucacagc

SEQ ID NO: 415878 - RNA, 63 nt, Human
cuguaaucccugcacuuugggaggccaaggugggaggaucaguugagccccagaguucaagac

SEQ ID NO: 415879 - RNA, 64 nt, Human
cagccugagcaacagagcgacucugucuccaaaaaagaaaaaaaguaccccauguucagccccu

SEQ ID NO: 415880 - RNA, 64 nt, Human
guggccaaacuaaauauaauuucuuuaaaaaagaaagaaaaaggaaaaauccaaaauaucucag

SEQ ID NO: 415881 - RNA, 64 nt, Human
aauucagaaauuggguuuugguucagugauucucaagaaaaagaucucuugcccauuaagaagu

SEQ ID NO: 415882 - RNA, 64 nt, Human
ucacgcugcugauaaagacauaccugagaccaggaagaaaaagagguuuaauuggacuuacagu

SEQ ID NO: 415883 - RNA, 64 nt, Human
cacacugcugauaaagacauuccucaagauugugaagaaaaagagguuuaauuggacuuacagu

SEQ ID NO: 415884 - RNA, 64 nt, Human
uucaguugaccagccgcuggugauuaaaguuaaaaagaaaaaaauuauagugagaaugagauuc

SEQ ID NO: 415885 - RNA, 64 nt, Human
cagauuuauuauucuuaaaugcuguaugauaaugaagaaaaauaaaaauuuauuucuugcaaag

SEQ ID NO: 415886 - RNA, 64 nt, Human
ucauaacguucucuuuaauuuauauuaaaaucagaagaaaaaugaauacaauaauaaugcauau

SEQ ID NO: 415887 - RNA, 64 nt, Human
agagucagugcuauaaaauugccuauuaagguaaaagaaaaauguggagacuauuuuacuauac

SEQ ID NO: 415888 - RNA, 64 nt, Human
aagcagaacugaaguuagcuuaagcauaaaaacaaagaaaaaucuucgcuuuucauguaugugg

SEQ ID NO: 415889 - RNA, 64 nt, Human
acauuugugugcagauaccaaaagaggaggaaagaagaaaaaaauuaaugugugggagcugcac

SEQ ID NO: 415890 - RNA, 64 nt, Human
uagucugggugacagagcaagacccuguuuaaaaaagaaaaaggccaggcacgguggcucaugc

SEQ ID NO: 415891 - RNA, 64 nt, Human
gaagaccaaagaccucaaacacugguccuguucaaagaaaaagaaagaacaugaggguuaaaaa

SEQ ID NO: 415892 - RNA, 51 nt, Human
acaagaccccugaggcaugacaagaaaaaaaaagaagaccaaagaccucaa

SEQ ID NO: 415893 - RNA, 64 nt, Human
uccagccugggcgacagagcaagauuccguucccaagaaaaaaaaauuguucaacaauaagggc

SEQ ID NO: 415894 - RNA, 63 nt, Human
cuguagucccagcuacuggugaggcugaggcuggaggaucacuggaguucgaggcugcaguga

SEQ ID NO: 415895 - RNA, 63 nt, Human
aucccagcacuuugggaggucgggggggugggggaggaucacggggucaggagaucgagacca

SEQ ID NO: 415896 - RNA, 63 nt, Human
cuauaaucccaguacuuuaggacauggaagggggaggaucacuugagaccaggaguugugagg

SEQ ID NO: 415897 - RNA, 64 nt, Human
uguuuaggaauuguccuuauagcauugcauacacaagaaaaacagagaaaagccugaucccugu

SEQ ID NO: 415898 - RNA, 64 nt, Human
aacucuugauagugacaaaucaguaaauacaaccaagaaaaagaaaaugaggggucagaguugc

SEQ ID NO: 415899 - RNA, 64 nt, Human
guccccccaggcaucuucacucagcaggauauaaaagaaaaaaauguucaaaugagagagcuuu

SEQ ID NO: 415900 - RNA, 64 nt, Human
uuuauguuaguagagcuguuuucaacccaaaaauaagaaaaaauagcucuaaauaucuaaaagg

SEQ ID NO: 415901 - RNA, 64 nt, Human
acacuguauaugaugaaaggcuucuauuuggaggaagaaaaauuaagaagacaacuuacaaaau

SEQ ID NO: 415902 - RNA, 64 nt, Human
aaaugacuucuuguuugaauauguaaaagcuuucaagaaaaauuaaaacuuuucauuagaaaau

SEQ ID NO: 415903 - RNA, 64 nt, Human
agguggguaaaauugauaaaccucuagcuagauuaagaaaaaacagaagacaaauacugcuaau

SEQ ID NO: 415904 - RNA, 64 nt, Human
gggcugugacugaaagacacacugagcugugaugaagaaaaauacauggccgacuccagggugg

SEQ ID NO: 415905 - RNA, 64 nt, Human
uuucucuccaaaggaccugcguuggacaacaauaaagaaaaauuuaaccuaucaugcacuguac

SEQ ID NO: 415906 - RNA, 64 nt, Human
aaauuaucaaauaucaggugaucuuacuauggagaagaaaaaccaauaucuaguuacagaugaa

SEQ ID NO: 415907 - RNA, 64 nt, Human
uuaguuuuugaucguaguuuuauaugaauguuccaagaaaaaagcagacuguuacaaauaaguu

SEQ ID NO: 415908 - RNA, 64 nt, Human
aaauuaauacccuuaugcaguugcauuuaaccuuaagaaaaauguccuugggauaaacuccaau

SEQ ID NO: 415909 - RNA, 64 nt, Human
caaagccuugcuuuuagagaaugcccaauaaggcaagaaaaagcauaguaacuugugcuuugag

SEQ ID NO: 415910 - RNA, 64 nt, Human
cagagcuucauucuccuggcuuuuagguuuguaaaagaaaaagggauaucuuuuuuauauuuuu

SEQ ID NO: 415911 - RNA, 64 nt, Human
aacuuuagucuguuauuuuguuucuuuuuauacaaagaaaaaaaauucagcuuucauguuucug

SEQ ID NO: 415912 - RNA, 63 nt, Human
cuguagucccagcuacuccggacacugaugugagaggaucacuugagccagggaggucauggc

SEQ ID NO: 415913 - RNA, 63 nt, Human
ugcuuuaaaacucucauguauguuaucuacagagaggaucauuacagagacagacucucccga

SEQ ID NO: 415914 - RNA, 63 nt, Human
cccaaagucucccaggaagcuguggggagaccagaggaucaagcugaagugaagccagugaag

SEQ ID NO: 415915 - RNA, 64 nt, Human
gacgcaaaugaaacaccaaacagucuugaauuacaagaaaaaaaggggauuuuuuuuuuuucua

SEQ ID NO: 415916 - RNA, 64 nt, Human
uacugcauugcaccaugagcaagaacugcucugcaagaaaaauaucugucccuguggucugaau

SEQ ID NO: 415917 - RNA, 64 nt, Human
augcagauaacagcaggaaggacuuaagguguauaagaaaaagaaaguauucauacagaaauua

SEQ ID NO: 415918 - RNA, 64 nt, Human
auccuugaaucaguucucauaaugcuuuuuaaauaagaaaaauucagaagaugaauuucuucca

SEQ ID NO: 415919 - RNA, 64 nt, Human
ccuuuucugggcuacuuugagggaaaacaaucuuaagaaaaauaggauuaagcuauucuguucc

SEQ ID NO: 415920 - RNA, 64 nt, Human
ggguaaagcuguaugccaucauggggcaccugaaaagaaaaacacgucucaccacugugguuga

SEQ ID NO: 415921 - RNA, 64 nt, Human
uguuccacuacaguccagccugggugacagagaaaagaaaaagaaaacauuacauaauuuggcu

SEQ ID NO: 415922 - RNA, 64 nt, Human
accgagguguuuuuuacauuuaagaaaaaaaaaaaagaaaaaaagauuguuuaaaaaaaaaagg

SEQ ID NO: 415923 - RNA, 64 nt, Human
cugucucugcuguaccgagguguuuuuuacauuuaagaaaaaaaaaaaagaaaaaaagauuguu

SEQ ID NO: 415924 - RNA, 64 nt, Human
agcauuugugcuuuuaagcaaauuaaaguaguaaaagaaaaacuuaagugaaaccuuugccauc

SEQ ID NO: 415925 - RNA, 64 nt, Human
gcauaaugguuauugucacuaucaacagucuaaaaagaaaaacugaggucuuuuuaaucuugau

SEQ ID NO: 415926 - RNA, 64 nt, Human
auaucauaccauaaugugucauagcuauaggcacaagaaaaacaacaguuugagagaauauuau

SEQ ID NO: 415927 - RNA, 64 nt, Human
uuugugugugcauaaauucauucuguaggaucuuaagaaaaagagucccagaauguugcuucua

SEQ ID NO: 415928 - RNA, 64 nt, Human
auuuucauuguuauuuuuagaaagauuuuuugcuaagaaaaaaauuaaacauauuuacauauuu

SEQ ID NO: 415929 - RNA, 64 nt, Human
uacuguuuguauaaaaaauagaaaaaaaaaagaaaagaaaaaaggcauaaaucuuuauugcaga

SEQ ID NO: 415930 - RNA, 63 nt, Human
uuguaaucgcagcacuuugggaggcugaggcaggaggaucacuugagcccaggaguucaagac

SEQ ID NO: 415931 - RNA, 63 nt, Human
auuucucauuaaacuucuaaaauucuuauaggugaggaucauuuuuccccccaccuuaggaug

SEQ ID NO: 415932 - RNA, 63 nt, Human
cuguaauccgagugcuuugggaggcugaggcaggaggaucacucgagcucaagaauucaagac

SEQ ID NO: 415933 - RNA, 64 nt, Human
agaauagguuacuacaaaaaagguuauauucugaaagaaaaauaacugacauuauauauaacca

SEQ ID NO: 415934 - RNA, 64 nt, Human
uccuuaucuuuugcagucucucugggaucaguaaaagaaaaaaaaaauaaugugcuuaagaagu

SEQ ID NO: 415935 - RNA, 64 nt, Human
uccuuggauaucuaggggaaagcuguuuggcagaaagaaaaaucaagaggacccaaggggaugg

SEQ ID NO: 415936 - RNA, 64 nt, Human
gguuccugagaggguuuccuaacagcuuuguaauaagaaaaauauggccuugaugguguagugc

SEQ ID NO: 415937 - RNA, 64 nt, Human
caagacccugucucuaaagaaaaaaaaaaaguaaaagaaaaauaaagcacgucuuggcucagcu

SEQ ID NO: 415938 - RNA, 64 nt, Human
ccagccugggcaacauagcaagacccugucucuaaagaaaaaaaaaaaguaaaagaaaaauaaa

SEQ ID NO: 415939 - RNA, 64 nt, Human
ggcuuuuuuuuccucucaaaaaaaaaaaaagaaaaagaaaaagaggaagaagcagcuuugcuga

SEQ ID NO: 415940 - RNA, 64 nt, Human
ccagugggcuuuuuuuuccucucaaaaaaaaaaaaagaaaaagaaaaagaggaagaagcagcuu

SEQ ID NO: 415941 - RNA, 64 nt, Human
cuggaggaaaaccagaucggacuaaaaaaggaaaaagaaaaacaaaaucuccgcaguguccaaa

SEQ ID NO: 415942 - RNA, 64 nt, Human
ugcuucugggccaggccauugucacuguuaguugaagaaaaagcaguucccaggugccagcaaa

SEQ ID NO: 415943 - RNA, 64 nt, Human
agcaaaaacuaugcgaaagggugagucuguuuagaagaaaaagcaaagacugagguacugugaa

SEQ ID NO: 415944 - RNA, 64 nt, Human
uaucuuuuaaacucaguucugcauccaacuugagaagaaaaaaagcuucuuuccauaucaagua

SEQ ID NO: 415945 - RNA, 64 nt, Human
aucacccagacaugugcagaugaaaugucaauauaagaaaaaucaagguauuugggaaacaugg

SEQ ID NO: 415946 - RNA, 64 nt, Human
uauguacuguaaacaguucugcacucuuguacaaaagaaaaaacaccugucacauccaaauaua

SEQ ID NO: 415947 - RNA, 64 nt, Human
cacaaagcaaccgccaaauuguuucagagcagaaaagaaaaagggagaaaaccucuuagcaaag

SEQ ID NO: 415948 - RNA, 63 nt, Human
cuguaaucccagcuugucaggaggcugaagugggaggaucaccugagcccagggaggucaagg

SEQ ID NO: 415949 - RNA, 63 nt, Human
acuucucccacaggcccagcaggacgcaguccugaggaucagggauucuacagcugcauuaaa

SEQ ID NO: 415950 - RNA, 63 nt, Human
ccgggccaaguacuucauucgagaugaguuucugaggaucagcacugccaguggagaugggcg

SEQ ID NO: 415951 - RNA, 64 nt, Human
guugcauuauuucaucaaucauuuguugacaaaaaagaaaaacuaaaaaauaaauuuaaaaugu

SEQ ID NO: 415952 - RNA, 64 nt, Human
caucaguuugggaagaauuauugaauuaucuugcaagaaaaaaguaugucucacuuuuuguuaa

SEQ ID NO: 415953 - RNA, 51 nt, Human
ucuccacacugaacauguaauaagaaaaaguaggaaauggagggucauagg

SEQ ID NO: 415954 - RNA, 64 nt, Human
uugggauuuucaccaaaauaaugcuuuugaaaaaaagaaaaaaaaaacggauauauugagaauc

SEQ ID NO: 415955 - RNA, 53 nt, Human
auacucgagauaaguccugaaaaaagaaaaaaugaaagauuaccuucagucag

SEQ ID NO: 415956 - RNA, 64 nt, Human
auucuaaauuuaacaagugacaggguugguuucaaagaaaaagguccaugcuuugcuuacaaug

SEQ ID NO: 415957 - RNA, 64 nt, Human
uuauuuaucuuccugcaaacaaggguuaccugaaaagaaaaaaaaagucaacauugucaagcug

SEQ ID NO: 415958 - RNA, 64 nt, Human
aaauaaaacaaacuuaaucuucaucuuuaaaaaaaagaaaaaagaaaccaaaaugagaaucaac

SEQ ID NO: 415959 - RNA, 64 nt, Human
uuguacuaaugugaugauggauuauuuaaugaaaaagaaaaaauggcucuuuuugcaauaagua

SEQ ID NO: 415960 - RNA, 64 nt, Human
auacuaauuuugaccuugaaagaugaauuccuucaagaaaaauaaaauaaugcuuaagauaaug

SEQ ID NO: 415961 - RNA, 64 nt, Human
ugcgcaaaaauuguuaaauccuuugucuuuauuaaagaaaaauuugaguaacauuaaguuugau

SEQ ID NO: 415962 - RNA, 64 nt, Human
uuuaguuaauaugaacacagcacagauuuguuagaagaaaaaaaauuugcuguaauaccaaaac

SEQ ID NO: 415963 - RNA, 64 nt, Human
agacucauuuguguggaugcgugaccaugggaaaaagaaaaaaaaaaagauccauuuuuuaggu

SEQ ID NO: 415964 - RNA, 64 nt, Human
uuuguuuaaaaaaaugcaaaucauucuuuaccuuaagaaaaaaaaaauacccuuugcuuugugc

SEQ ID NO: 415965 - RNA, 64 nt, Human
ugcaugaauauaaaucuauauuauuugcuaaaaaaagaaaaaacauuuguguuuuaguuucuuu

SEQ ID NO: 415966 - RNA, 63 nt, Human
cugcaaucccagcuacuuuggaggcagggaugggaggaucacuugaggccaggaucucaggac

SEQ ID NO: 415967 - RNA, 63 nt, Human
ccccugggauauaagaugaucuagcucccgguagaggaucaccggugacaacuauagcaguug

SEQ ID NO: 415968 - RNA, 63 nt, Human
cuguaaucccagcauuuuaggaggccaagguuggaggaucauuugagcccaggaauuggaaag

SEQ ID NO: 415969 - RNA, 64 nt, Human
ccguuaggguuuaaaaccauauugaucaacuagaaagaaaaauaugaaaagagaaaaauauuuu

SEQ ID NO: 415970 - RNA, 64 nt, Human
cugauacuuuugaaacagaugugaaaaacagaaaaagaaaaaauugucugaaauguuuauuuug

SEQ ID NO: 415971 - RNA, 64 nt, Human
aacuuugcaaacaacaggggaaaaaaauggggaaaagaaaaaccacgagagagggaaaaaaaau

SEQ ID NO: 415972 - RNA, 64 nt, Human
caggauuuguagccuugugcuucuugcuaagagaaagaaaaacaaaaucagagggcauuaaaug

SEQ ID NO: 415973 - RNA, 64 nt, Human
gcuagucaauaugaggauggugguuuauucucagaagaaaaagauauguaaggucuuuuagcuc

SEQ ID NO: 415974 - RNA, 64 nt, Human
gcacuuuauuuuguuuugauuuucauuuuuuauuaagaaaaaauuuuauuuuacagaauuuacc

SEQ ID NO: 415975 - RNA, 64 nt, Human
cucugaguuuucagcaccaguagauuuguauuaaaagaaaaaaaaauggggccuuagcuucugg

SEQ ID NO: 415976 - RNA, 64 nt, Human
cuagguaaggcauauuaaaaauaaauauguaaagaagaaaaauaaaaguugucuucauggaagc

SEQ ID NO: 415977 - RNA, 64 nt, Human
uuuucuaaaauccaacuucugaccgcccaguaggaagaaaaaugagacauuuuuuccauuacag

SEQ ID NO: 415978 - RNA, 64 nt, Human
auuaugaauagaagguagugaagaaaagcaagcuaagaaaaaauucuguuuauaaaagaaggaa

SEQ ID NO: 415979 - RNA, 64 nt, Human
uguuaaauguucuuaaauguucucacuacaaaaaaagaaaaaagauaacuacgugaggugaugg

SEQ ID NO: 415980 - RNA, 53 nt, Human
cagcuaaugccccuaaauaguaaaagaaaaagggguaucagucuaaucucaug

SEQ ID NO: 415981 - RNA, 64 nt, Human
gguuuucaugcgcuguuuuuguuuuaaaguuaugaagaaaaaagucaauaaaauucuaaaagua

SEQ ID NO: 415982 - RNA, 64 nt, Human
cuucaccuucaauaugagaauucagcgaacuugaaagaaaaaucaucugugaguuccuucaggu

SEQ ID NO: 415983 - RNA, 64 nt, Human
aucuuugugccacacaggauuuuuuuuuuuuuuuaagaaaaaccuauagaugaaaaauuacuaa

SEQ ID NO: 415984 - RNA, 63 nt, Human
cuuagguugguuaaguugacaagauuuacuccagaggaucaucucuuuguauuugccaaauaa

SEQ ID NO: 415985 - RNA, 63 nt, Human
aauauuuggggcauguuugugcacugcuguugugaggaucagcauaugaaauugacaucaugg

SEQ ID NO: 415986 - RNA, 63 nt, Human
ugugaucccagcuacuuaggagguugaggcugggaggaucacuugagcccaggagucugaggc

SEQ ID NO: 415987 - RNA, 64 nt, Human
gccccuucccaccugucauacugguaacuguaacaagaaaaacgacaucacuuaucauuguguc

SEQ ID NO: 415988 - RNA, 64 nt, Human
acuggacgcugcuauugauucauuaaaaaaagaaaagaaaaauacaccaaggcuccauguuccc

SEQ ID NO: 415989 - RNA, 64 nt, Human
ucugugccccuguaaauaguuuuaaauaugaacaaagaaaaaaauauauuuuaugauuuaaaaa

SEQ ID NO: 415990 - RNA, 64 nt, Human
ugcucuuucccccuuccaucucugacuuaagcaaaagaaaaagauuacccaaaaacugucuuua

SEQ ID NO: 415991 - RNA, 64 nt, Human
ggugggguguuugggaggcugcgugccagucaagaagaaaaagguuugcauucucacauugcca

SEQ ID NO: 415992 - RNA, 64 nt, Human
agauccuuuuauaggugagaaaaaaacaaucuggaagaaaaaaaccacacaaagacauugauuc

SEQ ID NO: 415993 - RNA, 64 nt, Human
aaaucugguugugauggagaagugacuuugcuuuaagaaaaaaggaggcaagguagggagagcg

SEQ ID NO: 415994 - RNA, 64 nt, Human
acaggggaauguacuuuuuuaaaaaaaaaugaaaaagaaaaaaaaagcugcacauuuacaguga

SEQ ID NO: 415995 - RNA, 64 nt, Human
cugauucuuccaccuauuuuuaugaaccuccaggaagaaaaacacuugccaaaacauuaagaga

SEQ ID NO: 415996 - RNA, 64 nt, Human
caugguauuaaacuaucauagaaguagacagaaaaagaaaaaaggacucauggcauuauuaaua

SEQ ID NO: 415997 - RNA, 64 nt, Human
auuaaauugaguagguucagcucuaacauaccuuaagaaaaaugcauaucggugcacuguaugu

SEQ ID NO: 415998 - RNA, 64 nt, Human
cuauagaaaauauuugagaauuucuuauacuaucaagaaaaaauucugugaauuaagauguaau

SEQ ID NO: 415999 - RNA, 64 nt, Human
cuuuuuaaaaaguaacuuuuuuaauaauauaagaaagaaaaaugcccuuucacacugaaucuuc

SEQ ID NO: 416000 - RNA, 64 nt, Human
ccaaccugagugacagagcaacacucugucuuaaaagaaaaaaaaaaaagagagagauaguaau

SEQ ID NO: 416001 - RNA, 64 nt, Human
cugaccucuuucacaguuggcucuaaagaaucaaaagaaaaaaacuuuuuauuucuuuugcuau

SEQ ID NO: 416002 - RNA, 63 nt, Human
uuggguggcuguuuuuaaaaaguaaaguucuuagaggaucauaggucuggacacuccauccuu

SEQ ID NO: 416003 - RNA, 63 nt, Human
cuguaguccuagcuacucaggaggcugaggugggaggaucaccuaaggccaggaggucaaggc

SEQ ID NO: 416004 - RNA, 63 nt, Human
uguagucuuugggucuuugggaggccagggugggaggaucacuugagcucaggaguuugagac

SEQ ID NO: 416005 - RNA, 64 nt, Human
caaauuguauaaaauuagguacuucgauuaguaaaagaaaaaaauuugaauguuuuuuuuuuuu

SEQ ID NO: 416006 - RNA, 64 nt, Human
agcaaaagaaagaaugcauuucgaaagcaaacagaagaaaaaaguauauucucacaguuuuucc

SEQ ID NO: 416007 - RNA, 64 nt, Human
gcacauguaccccagaaucuaaaauaaaaauaaaaagaaaaacaaagaauguacucuauacaaa

SEQ ID NO: 416008 - RNA, 64 nt, Human
uuuuuuguaaauccuuguauuccuauuuuuuuuaaagaaaaaaaaaaaaccuuaagcugcauuu

SEQ ID NO: 416009 - RNA, 64 nt, Human
uuuggguguaggauaugaaauuguacuuagauuuaagaaaaagagaaaaucagauguauuuauu

SEQ ID NO: 416010 - RNA, 64 nt, Human
ggcgcccuaagcgucacccaagcacacucacuuaaagaaaaaacgaguucuuucguucugugcg

SEQ ID NO: 416011 - RNA, 64 nt, Human
cuucagccucauucacuguccuggcuuuuauuuaaagaaaaaaaaggcaguauucccuuuuuaa

SEQ ID NO: 416012 - RNA, 64 nt, Human
guguguugugaaacgugaaauaaaaagagcaagaaagaaaaaggaaacaaaauaagaccgucug

SEQ ID NO: 416013 - RNA, 64 nt, Human
agacuacaauaaaaccaaacaugcuuauaacauuaagaaaaacaauaaagauacaugauugaaa

SEQ ID NO: 416014 - RNA, 64 nt, Human
auucacuaaccaccuugaauuaaauuuauuucuuaagaaaaagcaucccucauuuacugugaac

SEQ ID NO: 416015 - RNA, 64 nt, Human
acauuauaaaagagcacuucuguggcucauuuaaaagaaaaaaaagguuaagucuuuuaaauuu

SEQ ID NO: 416016 - RNA, 64 nt, Human
ugauuuuuaucuaaaaaaauucauuuuuauaucgaagaaaaaauauuuuauucaaacauuagau

SEQ ID NO: 416017 - RNA, 64 nt, Human
uuuguaagaauguugaaaauauguguaccguuuaaagaaaaagcagcuuuaaagugacaaacaa

SEQ ID NO: 416018 - RNA, 64 nt, Human
uuucuguuacaacuuacaggaacauuuguacuuuaagaaaaauuuaagugacaaauguuagaag

SEQ ID NO: 416019 - RNA, 64 nt, Human
uaugguuccagagaugcauacacuuuuuucugacaagaaaaaguaaaaggugaugagggcaauu

SEQ ID NO: 416020 - RNA, 64 nt, Human
gagcugcacacaccuggguggacacaaggcacggccacgucaugucucuaaacugcggucagau

SEQ ID NO: 416021 - RNA, 64 nt, Human
uggguaaacucauuccacaacccuaugggggcugccacgucacaggcccaaaggacucuucuuc

SEQ ID NO: 416022 - RNA, 64 nt, Human
ugaaauaaaacaacaaaaaagguaauccaguaauccacgucaggauucaccuuagaaguuuagc

SEQ ID NO: 416023 - RNA, 64 nt, Human
cccccucuggucuccucuuuguuuuguuuuaaggaagaaaaaucaguugcgcguucugaaauau

SEQ ID NO: 416024 - RNA, 64 nt, Human
uguauauauacauaacaggguaaauuauucaguuaagaaaaaaauaauuuuaugaacugcaugu

SEQ ID NO: 416025 - RNA, 64 nt, Human
gcaacuuuuaaagcucaugcauuucaagcagcugaagaaaaaaucagaacuaaccaguaccucu

SEQ ID NO: 416026 - RNA, 64 nt, Human
uuguuuaacccaaaagauuauuuuuugguuccuaaagaaaaagauauuuuuaaucugucaauua

SEQ ID NO: 416027 - RNA, 64 nt, Human
ucgggguccaucugugauauuucuuugugccaaaaagaaaaaaaaagaguggaucaguuugcua

SEQ ID NO: 416028 - RNA, 64 nt, Human
gauucuggggaagagaccuagaaacaagcuuucaaagaaaaaccagaaguugucauaaaugguc

SEQ ID NO: 416029 - RNA, 64 nt, Human
aaaaaauaaauaagauaaagggucagcaacaacaaagaaaaagacaauuacagaaaauaagcaa

SEQ ID NO: 416030 - RNA, 64 nt, Human
auuuaaggcuuuguaaaaugaagaguagaauuccaagaaaaaugagaaauaauuuuguaaaacu

SEQ ID NO: 416031 - RNA, 64 nt, Human
ugguucugagcuaaaguugaguaaauucuuagcuaagaaaaaauuggaaauccaucaucuauau

SEQ ID NO: 416032 - RNA, 64 nt, Human
ggauccugaacggaaaaggaagaagaaagagaagaagaaaaagaagguagaguagaggccuauu

SEQ ID NO: 416033 - RNA, 64 nt, Human
aacaccaucugauucagaucacaagaagaagaaaaagaaaaaagaagaggauccugaacggaaa

SEQ ID NO: 416034 - RNA, 64 nt, Human
uacagaaacaccaucugauucagaucacaagaagaagaaaaagaaaaaagaagaggauccugaa

SEQ ID NO: 416035 - RNA, 64 nt, Human
caugacuguggauaugaagaacuauugacuucuuaagaaaaaagggagaaauauuaaucagaaa

SEQ ID NO: 416036 - RNA, 64 nt, Human
aaauuuugcagcgaagagaaaugaagaaaaacugaagaaaaaaaaaaaacaggaaaaaaagaac

SEQ ID NO: 416037 - RNA, 64 nt, Human
cacaaaaaaaaaaauuuugcagcgaagagaaaugaagaaaaacugaagaaaaaaaaaaaacagg

SEQ ID NO: 416038 - RNA, 63 nt, Human
uuucagaaagcacaaagagauucaauuucccuggaggaucaggacagaggaaggaaucucuaa

SEQ ID NO: 416039 - RNA, 63 nt, Human
gggcuuugcaguuccuaaggagugaugagguuagaggaucacuucugcauuugauuuucaagg

SEQ ID NO: 416040 - RNA, 63 nt, Human
agucccagcuacucgggaggcugagugaggcaggaggaucacuugagaccaggagguuguggc

SEQ ID NO: 416041 - RNA, 64 nt, Human
ugggugacagagcaagacucccucucaaaagaaaaagaaaaaagauguaaaaaccauucuuagu

SEQ ID NO: 416042 - RNA, 64 nt, Human
ccagccugggugacagagcaagacucccucucaaaagaaaaagaaaaaagauguaaaaaccauu

SEQ ID NO: 416043 - RNA, 64 nt, Human
gcagccuuugugccacuucagugcuagaaaguuaaagaaaaaaaaacuuuugugauuuaauaau

SEQ ID NO: 416044 - RNA, 64 nt, Human
uaguuguacagauaguuuauaagcacaauauuuuaagaaaaaaaaguggcuggucuacuaggca

SEQ ID NO: 416045 - RNA, 64 nt, Human
guucuguaucucguaauuguguauagcaugguaaaagaaaaaaaaaaagacagguaaauguuau

SEQ ID NO: 416046 - RNA, 64 nt, Human
gccugaaggucauacaauucuggggacucucuuuaagaaaaagaauucuaaaauaucuuacuuu

SEQ ID NO: 416047 - RNA, 64 nt, Human
uuuaaaaauaggcuuucuuauauuugauauuuggaagaaaaagccguaagguguauguagacca

SEQ ID NO: 416048 - RNA, 64 nt, Human
uuccuagaaaacuccacuacagaaugacuuuuagaagaaaaauuucaacaaauccugaagucuu

SEQ ID NO: 416049 - RNA, 64 nt, Human
acguaccaugaguacucugacucuuuauuguuguaagaaaaauaguucaucaucagagaauggu

SEQ ID NO: 416050 - RNA, 64 nt, Human
gaucucagcuaacugaaaccuccgccucccagaaaagaaaaaccucuuuuuaauuggauggaaa

SEQ ID NO: 416051 - RNA, 64 nt, Human
aagcuaggaaaauugaauuucugcugcugcuucaaagaaaaagcugccccagagcauuaaacau

SEQ ID NO: 416052 - RNA, 64 nt, Human
caggccaggauguuuuauuucucacaucauguccaagaaaaagaauaaauuauguucagcuuaa

SEQ ID NO: 416053 - RNA, 64 nt, Human
gguuuguuuggaguaaccaaacaguaugcaaauuaagaaaaagccagagaaccuagaaaacauc

SEQ ID NO: 416054 - RNA, 64 nt, Human
cuuacauuuauaacaucauaguguguaaauuuaaaagaaaaauugugagguucuaauuauuuuc

SEQ ID NO: 416055 - RNA, 64 nt, Human
aaauuuuuaauugaguguaaacacaccuaacuuuaagaaaaagaaccgcuuguaugauuuucaa

SEQ ID NO: 416056 - RNA, 63 nt, Human
cuguagucccagcuacuugggaagcagaggcuggaggaucauuucagcccaggagguugugga

SEQ ID NO: 416057 - RNA, 63 nt, Human
ucauuuucaguuguaccuuagaugucugguguugaggaucaagugccauagccuuuauucagg

SEQ ID NO: 416058 - RNA, 63 nt, Human
ggaaaaauuacccaguauaguucagguuaugaggaggaucagccacacaauccagugcuucag

SEQ ID NO: 416059 - RNA, 64 nt, Human
aacuguaguaguuggucuagaaacaaaauacuccaagaaaaagaaaauuuucaaauaaaaccca

SEQ ID NO: 416060 - RNA, 64 nt, Human
auuauacaaucaaacuagaucugaagcauaauuuaagaaaaacaucaacauuuuuugugcuuua

SEQ ID NO: 416061 - RNA, 64 nt, Human
agagcuucuuccaagggagaagauauucucgugaaagaaaaaaacaaaacaaaacaacagugcu

SEQ ID NO: 416062 - RNA, 64 nt, Human
aagaaacuaagucuuagugcacaguaucacaacaaagaaaaagcuuuguuuuuauaacugguaa

SEQ ID NO: 416063 - RNA, 64 nt, Human
uuuuuacuguaaguauggaucaaauugcaaaauaaagaaaaaugccaaccuuagaaaagacaau

SEQ ID NO: 416064 - RNA, 64 nt, Human
ucuacauuccauggaauguuuuuaauaaguaggcaagaaaaaugccacuaaucaaagcauuaag

SEQ ID NO: 416065 - RNA, 64 nt, Human
ccauggggagcaagcauuugauaauucauccuuuaagaaaaacaccaccguacacugcuugaag

SEQ ID NO: 416066 - RNA, 64 nt, Human
aaaggagagugcaucugagacugauauuuaaacuaagaaaaauguuuagucugagauggaucau

SEQ ID NO: 416067 - RNA, 64 nt, Human
acuggagaacgacuaagaccaaauuauggaaaauaagaaaaagcuguugcuggcaagaccauca

SEQ ID NO: 416068 - RNA, 64 nt, Human
gcaaguacuaggaauucagaugaucagcucuuaaaagaaaaaaaaaagcaaaaagacuaaagcc

SEQ ID NO: 416069 - RNA, 64 nt, Human
guugugguggugguaagaaggagauauugguaccaagaaaaauuuccaaaacuauugagagaga

SEQ ID NO: 416070 - RNA, 64 nt, Human
guuccaagaggugguuuuugaaagagcaagaggaaagaaaaaagaaaagaaggaaagaagaaua

SEQ ID NO: 416071 - RNA, 64 nt, Human
uuuccucaauuccauacugacuuugaucuugagaaagaaaaacuggcuaugcauuaccuaaaac

SEQ ID NO: 416072 - RNA, 64 nt, Human
cuauuuguuaaaauauuugccuuuuuaaguaaaaaagaaaaaucagaacagggcuauuugaaga

SEQ ID NO: 416073 - RNA, 64 nt, Human
ggucggguuuucaaucacacugaauuggcaggauaagaaaaauaggucagauaaguaugggaug

SEQ ID NO: 416074 - RNA, 63 nt, Human
acauguuuuuggcaagacaacagauugagguuagaggaucaguaggacauuuuuauuccaucu

SEQ ID NO: 416075 - RNA, 63 nt, Human
ucagucgcucccuggaggcaggugggcacugcagaggaucacuggaauccagaucgagcgcag

SEQ ID NO: 416076 - RNA, 63 nt, Human
cugugaucccagcuacuuggaaggcugaggugagaggaucacucgaggagauuggggcugcca

SEQ ID NO: 416077 - RNA, 64 nt, Human
uuuuuucuucccucauuuucugggauucucaagaaagaaaaaguaacccauuaucacucugagu

SEQ ID NO: 416078 - RNA, 64 nt, Human
aacucagaaagugguccuugugauggaaagagaaaagaaaaaccaauuagaauaaggcagaaug

SEQ ID NO: 416079 - RNA, 64 nt, Human
accaaauuaucuuagguacuaaggccucaaaaauaagaaaaacuuuauuauuucuccucaguag

SEQ ID NO: 416080 - RNA, 64 nt, Human
gaagaugaugaugaugaugaugacgaggaagcugaagaaaaagcgccagugaagaaaucuauac

SEQ ID NO: 416081 - RNA, 64 nt, Human
gaaacugaagauaaaagauuugggaaaacacaccaagaaaaaggggcaguuuucuuugcccaag

SEQ ID NO: 416082 - RNA, 64 nt, Human
uauggccguauagccucaggccuucauuucugaaaagaaaaaagcucaaaaagcugcugaauuu

SEQ ID NO: 416083 - RNA, 64 nt, Human
cuucccuuuagugauuucaguaguuuauauuggaaagaaaaacaauuacaacaugugcccuuac

SEQ ID NO: 416084 - RNA, 64 nt, Human
aucauuugguuuuugaguuguuuuuucuuaauguaagaaaaauuguauuuuuuuuacaaguauc

SEQ ID NO: 416085 - RNA, 64 nt, Human
aauuaaagugagagacaugguuacuguguaauaaaagaaaaaauacuuguucagguaauucuaa

SEQ ID NO: 416086 - RNA, 64 nt, Human
uaaauuuaaaugggaagggaagaaaacaccaaauaagaaaaaaauuugccuuuaagaguuacuu

SEQ ID NO: 416087 - RNA, 64 nt, Human
cgacagugcaagacucugucuccaaaaaaaaaaaaagaaaaaagaaaaucccccuucauccccc

SEQ ID NO: 416088 - RNA, 64 nt, Human
aucaaauggcuacaguucauuuaaauuuaaaaaaaagaaaaaagaaacagaaaacgugucucag

SEQ ID NO: 416089 - RNA, 64 nt, Human
gaaucccuuuguucucuguuuaaaaaaaucuaaaaagaaaaaggaaaaaaaaaaaagaacugcu

SEQ ID NO: 416090 - RNA, 64 nt, Human
aguauggaauaauauaucucaugucauuuuuuagaagaaaaacuauuugaagguauuuuuuggu

SEQ ID NO: 416091 - RNA, 64 nt, Human
uuucuccagcuggaccaauuuucaaacuuggauaaagaaaaagacaaacagaaauagacacaca

SEQ ID NO: 416092 - RNA, 63 nt, Human
cuauaaucccagcacuuugggaggcugaggcaggaggaucacuugagcccaggaguucaagac

SEQ ID NO: 416093 - RNA, 63 nt, Human
cacugacaaauaguggauauagguuucauuucugaggaucaauaaacagcuuguaauguugua

SEQ ID NO: 416094 - RNA, 63 nt, Human
cuguauucccagcuacucaggagguugaggugggaggaucacuugagcccagaaguucaaggc

SEQ ID NO: 416095 - RNA, 64 nt, Human
aggaaucaauuuugaggguucagauuuagcuuggaagaaaaaaaagaaacauacauccuucagu

SEQ ID NO: 416096 - RNA, 64 nt, Human
gaagauugaaaggguuuuucuuucuuuuuuaaaaaagaaaaacaaacuauugauuguagauaau

SEQ ID NO: 416097 - RNA, 64 nt, Human
aagagcaagauagacaaaagccaaucagcuuaaaaagaaaaacaaggaaggggaaaagaaaacu

SEQ ID NO: 416098 - RNA, 64 nt, Human
uacuaccuaaagggaaccugcaauaaucuugaaaaagaaaaagagaaaaauuuuaaaauccugc

SEQ ID NO: 416099 - RNA, 64 nt, Human
ugucuugaauucucuguuuaugcaaugugcucgaaagaaaaaaauguuaaaaauauaucuauaa

SEQ ID NO: 416100 - RNA, 64 nt, Human
uuaaaaggccauuuugggggguuauuuauuuuuuaagaaaaaaagcugcaaaaauuauauauug

SEQ ID NO: 416101 - RNA, 64 nt, Human
gagauucaaaccaaaggcuguuuuucuauguuuaaagaaaaaaaaaaguaaaaaccaaacacaa

SEQ ID NO: 416102 - RNA, 64 nt, Human
aauuccugugcaugugcucuuauuguaaggugccaagaaaaacugauuuaaguuacagcccuug

SEQ ID NO: 416103 - RNA, 64 nt, Human
gacauuuuuauauuacagagcuuccaucaucaugaagaaaaaaaaauuugguucucaagugaac

SEQ ID NO: 416104 - RNA, 64 nt, Human
guacuuauuacaugcugcuauacacaagcaaugcaagaaaaaaacuuacuggguaggugauucu

SEQ ID NO: 416105 - RNA, 64 nt, Human
caguacaaaaaagaauaaauucuaccagaagauaaagaaaaaagcaaguauugcauaggcaccu

SEQ ID NO: 416106 - RNA, 64 nt, Human
gggaggagaacggucagaaucaaagugacauucuaagaaaaacuguaccuuagagauuuuccuc

SEQ ID NO: 416107 - RNA, 64 nt, Human
ggugaugaucuagaacugacuuacuucaggacagaagaaaaaacaaucacacccuuaaccuuua

SEQ ID NO: 416108 - RNA, 64 nt, Human
caaagauuauauaugacaaucaguauugcaaugaaagaaaaacuaaaaacagaaaugauauucu

SEQ ID NO: 416109 - RNA, 64 nt, Human
uguggucuaucaccacugaauucauguaauagauaagaaaaaaauuagagguggaugucuuguu

SEQ ID NO: 416110 - RNA, 63 nt, Human
uugugaugagucucgacugucaaaucuucuucagaggaucacccgggaaaacgaccgagaccg

SEQ ID NO: 416111 - RNA, 63 nt, Human
ccuguaaucccagcauuuugggaggcugagugagaggaucacuugagcucaggaguucgagac

SEQ ID NO: 416112 - RNA, 63 nt, Human
uugugaugagucucgacugucaaaucuucuucggaggaucacccgggaagacgacagagacug

SEQ ID NO: 416113 - RNA, 62 nt, Human
auuuaguucuuuuggacuaauacaauucaggaaagaaaaaacccaaaaaccaaccucauuca

SEQ ID NO: 416114 - RNA, 64 nt, Human
uauuauuuugcuacuuaccguguuauucuguggaaagaaaaaccuguaaaguguuuaauaaauu

SEQ ID NO: 416115 - RNA, 64 nt, Human
ucaacauuuaugaaauauugccugacuauuuaaaaagaaaaaaguagcucuccauuaucaccuu

SEQ ID NO: 416116 - RNA, 64 nt, Human
aaacagacaguauuguaaucccaucaaaagaugaaagaaaaacaaaaacaaaaaccaacaacaa

SEQ ID NO: 416117 - RNA, 64 nt, Human
uuuauuuagcuuuuauuuauuuauuguucuuuuuaagaaaaaaacugagaguuugaauuaaaag

SEQ ID NO: 416118 - RNA, 64 nt, Human
cacccugcugauucugugguaucuguguugaauaaagaaaaagguagcagugcuucucuggucc

SEQ ID NO: 416119 - RNA, 64 nt, Human
ccagccugggugacauagcaagacccugucuuaaaagaaaaaugggaagaaagacaagguaaca

SEQ ID NO: 416120 - RNA, 64 nt, Human
aaagagguuaaggaacuguguuaccuuuuguccuaagaaaaaggcuugaauuuauguaaauacu

SEQ ID NO: 416121 - RNA, 64 nt, Human
aaagagcuaaacuuauucagaaaggaaugacuagaagaaaaaggagacaauaccauguuguuca

SEQ ID NO: 416122 - RNA, 64 nt, Human
ucauugauuuuaaacauuuuauuccuacuuucagaagaaaaauauaauacggaaaaaauuauag

SEQ ID NO: 416123 - RNA, 64 nt, Human
cuugucaguggcguugggagggggagaaaaggaaaagaaaaaaaaaagaagaagaagaagaaaa

SEQ ID NO: 416124 - RNA, 64 nt, Human
gaaaaaaaaaagaagaagaagaagaaaagagaagaagaaaaaaacgaaaacagucaaccaaccc

SEQ ID NO: 416125 - RNA, 64 nt, Human
gguagugugaaccguaugaaccuaaguaguuuggaagaaaaaguaggguuuuuguauacuagcu

SEQ ID NO: 416126 - RNA, 64 nt, Human
ucuuaaucuggcaucuucuccaggccuaaaucuuaagaaaaagaaaugggugcugggguuuggg

SEQ ID NO: 416127 - RNA, 64 nt, Human
ccuaugcauucacauuggcauccugguuugggggaagaaaaacaacggcccuuagcagcagccc

SEQ ID NO: 416128 - RNA, 63 nt, Human
ucuccuuuuuugccucuacuggugaggaaacaugaggaucagaggccacauuuuuaauuauug

SEQ ID NO: 416129 - RNA, 63 nt, Human
ggguuccaucaccugugguuccagcugaggugggaggaucacuugagccuaugaggucgaggc

SEQ ID NO: 416130 - RNA, 63 nt, Human
cuguagucccagcuacuucggggacugaggugggaggaucacuugaaccuaggaggucgaggc

SEQ ID NO: 416131 - RNA, 64 nt, Human
ugauggaaaguucagcaagaucagcaacaaaaccaagaaaaaugauccuugcgugcugaauauc

SEQ ID NO: 416132 - RNA, 64 nt, Human
cugaaacgcuuccuauaacucgaguuuauaggggaagaaaaagcuauuguuuacaauuauauca

SEQ ID NO: 416133 - RNA, 64 nt, Human
gaagugucacugcugucuucuagucaaacuuguaaagaaaaagauuccaguucaguauuugcag

SEQ ID NO: 416134 - RNA, 64 nt, Human
uauuaaucugaaaauagcaacccagaauguaaaaaagaaaaaacuggggggaaaaagaccaggu

SEQ ID NO: 416135 - RNA, 64 nt, Human
aagcaaagauccaccgagagaagaagagaaagaaaagaaaaagaaaaagcacaaaaaaagaucu

SEQ ID NO: 416136 - RNA, 64 nt, Human
agauccaccgagagaagaagagaaagaaaagaaaaagaaaaagcacaaaaaaagaucucgaaca

SEQ ID NO: 416137 - RNA, 64 nt, Human
ggccuggaagcagaugaggggaauacuucaugcaaagaaaaaaguaacaugugcaaaagcuccc

SEQ ID NO: 416138 - RNA, 62 nt, Human
uccuuacugaacaccagugaauuuacacugcaaagaaaaacuaugaauguauggaauuuuuu

SEQ ID NO: 416139 - RNA, 64 nt, Human
ugugucugguagaaaccauauuuugguuaacagcaagaaaaaugcuuauaauguaguacaauua

SEQ ID NO: 416140 - RNA, 64 nt, Human
cccaauggucugugaucauugaaaaagaggaaagaagaaaaaauguaugggugagaggaaggag

SEQ ID NO: 416141 - RNA, 64 nt, Human
gcaucccucccccacacccugguguuuuaaaaugaagaaaaaaaaccaucaccuuuuguacaaa

SEQ ID NO: 416142 - RNA, 64 nt, Human
uaagagcacagugaauuugaaggcucuggaagaaaagaaaaaagucuuugaguuuuauucugga

SEQ ID NO: 416143 - RNA, 64 nt, Human
uuaguuaauucuucaaaagauaaagaugaacaggaagaaaaagaaaauuauuuuggacuaugac

SEQ ID NO: 416144 - RNA, 59 nt, Human
agcgccgagggaccaaaugagacugagggaagaaaaaaaaucucuuuuuuucuggaggc

SEQ ID NO: 416145 - RNA, 64 nt, Human
cauugggaagucuagacuuugagccagguacaguaagaaaaauuagccucugauucauuaaguu

SEQ ID NO: 416146 - RNA, 63 nt, Human
ggccuaccugaggucggagcauggaaggagggugaggaucaaaaaacuaccuaucugguacua

SEQ ID NO: 416147 - RNA, 63 nt, Human
caucauaugcagaggaagcuucuacgcgcuagagaggaucaaggggccacacuggaccaugug

SEQ ID NO: 416148 - RNA, 63 nt, Human
aggggcucuggggaaacugcuggaacucgaggugaggaucagccuuuuccagcauccugugag

SEQ ID NO: 416149 - RNA, 64 nt, Human
auugccccaguucagaguugaauguuuauuauuaaagaaaaaaguaauguacauauggcuggau

SEQ ID NO: 416150 - RNA, 64 nt, Human
uuuuuuuucuuuguaaugcaccugacagaaaaaaaagaaaaaugaauuucucuuuacuucucuc

SEQ ID NO: 416151 - RNA, 64 nt, Human
auguguuuuguuguuuugugcuacaauuuuuaaaaagaaaaaaguuuuguuuuguuuuuugggg

SEQ ID NO: 416152 - RNA, 64 nt, Human
cugacuaauagaccucagccucaaaaggcuuggaaagaaaaaacaaauacaacaagcaaacaac

SEQ ID NO: 416153 - RNA, 64 nt, Human
aacauucucuauucuuuucucaaaagauugcuguaagaaaaaauguaagacaaaaaaaaaaaaa

SEQ ID NO: 416154 - RNA, 64 nt, Human
cacucuccccaaaauauuauauuuuuucuauaaaaagaaaaaaauggaaaaaaauuacaaggca

SEQ ID NO: 416155 - RNA, 64 nt, Human
acauaaagaaaagaugagcaaagaugguaaaaagaagaaaaagaagucaaagacaaagugugua

SEQ ID NO: 416156 - RNA, 64 nt, Human
gcucguucccaauguaucuuaaugaaaagugcaaaagaaaaaccuaccaauuaacuuguguggu

SEQ ID NO: 416157 - RNA, 64 nt, Human
acacaaauaagcagaaaacauacuuauuuuaaaaaagaaaaaaaaggauaaaaaaacccaaacu

SEQ ID NO: 416158 - RNA, 64 nt, Human
uauauuuuaaacagcuacuguaaguaugaaaugaaagaaaaacaaucauuggacggaaaaggac

SEQ ID NO: 416159 - RNA, 64 nt, Human
uaagaaauuuagauuacagaguaugcaugacuguaagaaaaagaaauugagaggaagugaucau

SEQ ID NO: 416160 - RNA, 64 nt, Human
gugacuuuuauaagcaugaaacuauuuuacuggaaagaaaaauauauacauccacauaucuaac

SEQ ID NO: 416161 - RNA, 64 nt, Human
ucaauauaaaaauuguuuuaauggcauuuguugaaagaaaaaagcauggcuaaaauguauaaaa

SEQ ID NO: 416162 - RNA, 64 nt, Human
caaaauaucacauaagacaucaugauaacauuugaagaaaaaauaaaacuguagacccuaacag

SEQ ID NO: 416163 - RNA, 64 nt, Human
cagucaaagaaagagaaaaaagauaaaguagaaaaagaaaaaagugaaaaggaaacaacuagca

SEQ ID NO: 416164 - RNA, 63 nt, Human
gcauuuaaucuguauuuuacaaguuaggaagcagaggaucagagaugggaaaggacuagccca

SEQ ID NO: 416165 - RNA, 63 nt, Human
uccccuccucucuccagggagccggggcugugagaggaucaucuggggcaggcccuccacuuc

SEQ ID NO: 416166 - RNA, 63 nt, Human
uauucuuuggaagcaggaagaaaugcucauaaagaggaucagaccuucuuucccgugaaacca

SEQ ID NO: 416167 - RNA, 64 nt, Human
aauacuaucauaguaauauuauuauugucaucccaagaaaaaauauauuaaaaagauauuugaa

SEQ ID NO: 416168 - RNA, 64 nt, Human
aauacuaucauguuaauacuauuauugucaucccaagaaaaaagauauuuuaaaaauuuauuug

SEQ ID NO: 416169 - RNA, 64 nt, Human
guaacaaucuugaagagcuaauuuuaauaaaaauaagaaaaauuaauacuaucauguuaauacu

SEQ ID NO: 416170 - RNA, 64 nt, Human
acuuugcuaacuuacuaguaccagaguuauuuuaaagaaaaacacuaguguccaauuucauuuu

SEQ ID NO: 416171 - RNA, 64 nt, Human
augacucccauugucccuuuauuuaggauauugaaagaaaaaauaaacuuuauguauuaguguc

SEQ ID NO: 416172 - RNA, 64 nt, Human
gcaccacuuuuacuguugccuacuucugaccaagaagaaaaaggaccuuaguauuuagcauaaa

SEQ ID NO: 416173 - RNA, 53 nt, Human
uuccaccccuuccuaaguaaaaaaagaaaaagaagaggagaaaaaaacuucuu

SEQ ID NO: 416174 - RNA, 64 nt, Human
uuuacuuccuuuuuuuuuuuuuaagaaaggaaaaaagaaaaaaaaaucaaacuugaaacuuuuc

SEQ ID NO: 416175 - RNA, 64 nt, Human
ugguaugagcacaggucauggacagccccugcucaagaaaaagcaugagcuggccacacaugua

SEQ ID NO: 416176 - RNA, 64 nt, Human
uuuuaggaccaaucucauuuuuaauaagguuaaaaagaaaaaaaaagucuagcgaaaaaacucc

SEQ ID NO: 416177 - RNA, 64 nt, Human
augagguccuucuggacuaaaagccaaaaaaagaaagaaaaaaauaauuuuucuuuucuguuuu

SEQ ID NO: 416178 - RNA, 64 nt, Human
aguaaggaauauugucaucaccuggauuuugagaaagaaaaauaacuucucugcaagauuucau

SEQ ID NO: 416179 - RNA, 64 nt, Human
ucugucucaaaaaaaaaaaaagaaaaaagaaagaaagaaaaaaggcagaagcccuggauucaaa

SEQ ID NO: 416180 - RNA, 64 nt, Human
gugacagagcgaaccucugucucaaaaaaaaaaaaagaaaaaagaaagaaagaaaaaaggcaga

SEQ ID NO: 416181 - RNA, 64 nt, Human
cuauaagaauuaagggguaaagcacuaaacagaaaagaaaaaaaaaauagcaacucuggugagc

SEQ ID NO: 416182 - RNA, 63 nt, Human
agcccuuccuguucucuccagcccagcauacaggaggaucaaaggaggugacggagcaucgug

SEQ ID NO: 416183 - RNA, 63 nt, Human
agaauuuaaagguauuuuuuaaaauucuaauaagaggaucagccgggugcaaugacucaugcc

SEQ ID NO: 416184 - RNA, 63 nt, Human
cugugaucccagcacuuugggaggcugagguaggaggaucacgugaggucgggaguucaagac

SEQ ID NO: 416185 - RNA, 64 nt, Human
ucgcugucgguuaacuguaaaguuagggggaagaaagaaaaaaaauuaaaaggguagacacagu

SEQ ID NO: 416186 - RNA, 64 nt, Human
aaaacuguuuuacaguaucaaaauuuuucacuuaaagaaaaaaaaugccaugaaacauuugaac

SEQ ID NO: 416187 - RNA, 64 nt, Human
caaagcacucagcucaauuaucuucuuagaaagaaagaaaaaguaugaauggucaaaaugaaua

SEQ ID NO: 416188 - RNA, 64 nt, Human
gcaaucuugagucuauuauuguauaauuuaguaaaagaaaaaaauaaucguuggugguccuacu

SEQ ID NO: 416189 - RNA, 64 nt, Human
ucaguuuugaaccaagaauuggugauuuguuuauaagaaaaaaacuggcuucauuucugugaaa

SEQ ID NO: 416190 - RNA, 64 nt, Human
auuuuacagugaaugauugugcggacucguguguaagaaaaacuaggacugugugguguaaaua

SEQ ID NO: 416191 - RNA, 64 nt, Human
uuaagaaaguacuugacuaaaaaaaaaagaaaaaaagaaaaaaaagaaagcauagacauauuuu

SEQ ID NO: 416192 - RNA, 64 nt, Human
uuguuucuuuaagaaaguacuugacuaaaaaaaaaagaaaaaaagaaaaaaaagaaagcauaga

SEQ ID NO: 416193 - RNA, 64 nt, Human
ugaauacaaagauaagugaaaagagagaaaggaaaagaaaaaggagaaaaacaaagagauuucu

SEQ ID NO: 416194 - RNA, 64 nt, Human
gcuguugaucuuuuaucaauaauguucuauagaaaagaaaaaaaaaauauauauauauauauau

SEQ ID NO: 416195 - RNA, 64 nt, Human
ucugacuugagaaucuuuuucaugaaugauuuuaaagaaaaauuuggauuuuaaagguauuaaa

SEQ ID NO: 416196 - RNA, 64 nt, Human
cuguagggauuuacuggcaugguaucauuccuagaagaaaaaaagagagaaacuugacugcaca

SEQ ID NO: 416197 - RNA, 64 nt, Human
aaagcaaccccaaaagaguugauguguguuuuaaaagaaaaaacccaaugaggaacaauuggag

SEQ ID NO: 416198 - RNA, 64 nt, Human
acaaaagcgaaacucugucucaaaaaagaaaaaaaagaaaaaaaagcacgugaccuuaugaggc

SEQ ID NO: 416199 - RNA, 64 nt, Human
gccugggcaacaaaagcgaaacucugucucaaaaaagaaaaaaaagaaaaaaaagcacgugacc

SEQ ID NO: 416200 - RNA, 63 nt, Human
cgguaguccuggcuacuagagagguugaggugggaggaucacuugaaccugggaggugggggu

SEQ ID NO: 416201 - RNA, 63 nt, Human
caugcaaacuuuauuuuguguuuaggaacuacugaggaucagaguaauccaagcaaaugugaa

SEQ ID NO: 416202 - RNA, 63 nt, Human
cuguaaucccagcacuuugggaggccgaggcgggaggaucaugaggucaggagaucgagacca

SEQ ID NO: 416203 - RNA, 64 nt, Human
cauaaaacauuuucuugagagaguucaguuaaaaaagaaaaaaucagcgucauuuguucccugc

SEQ ID NO: 416204 - RNA, 64 nt, Human
aaaauguccacaacacaguaauuggucacuuguuaagaaaaauuuauccuuguaaguaucuuca

SEQ ID NO: 416205 - RNA, 64 nt, Human
uuuucuucccuagaaacccaauucuaagcagaaaaagaaaaaaaacacaaaaaauaaaaaaccc

SEQ ID NO: 416206 - RNA, 64 nt, Human
aagcuuuuggcucucuguuucauuuuuuuccauuaagaaaaaaaaaaguccccuuuuaaaacaa

SEQ ID NO: 416207 - RNA, 64 nt, Human
ugucuuuucaaaaugagaggcuuucauugaagaaaagaaaaaaacaacaguuaaaagcuuuugg

SEQ ID NO: 416208 - RNA, 64 nt, Human
guugaggaauuuccucuaccaccuuuguugcuugaagaaaaacaugucuuuucaaaaugagagg

SEQ ID NO: 416209 - RNA, 64 nt, Human
cuuaggaaauuuuuuuaauuuuuuuuuuuuaaagaagaaaaaaaacuacauaauuucuaccagg

SEQ ID NO: 416210 - RNA, 64 nt, Human
gugugcuguauauuuuccaugcccucacuccuuuaagaaaaaaaaaaaggaaaaaagcaacaca

SEQ ID NO: 416211 - RNA, 64 nt, Human
auccuguauauaaguuuaauauaucacuuuuuaaaagaaaaaauucuaccauuuuaaauucaug

SEQ ID NO: 416212 - RNA, 64 nt, Human
uaguccugggagaggcagggaaauguccucgaaaaagaaaaaggggcugcuuuccaaaggcaag

SEQ ID NO: 416213 - RNA, 64 nt, Human
aaaucccgaguggagagauuagauacagaaaaagaagaaaaaaucaaugaacuugaagaguaag

SEQ ID NO: 416214 - RNA, 64 nt, Human
gcugcacuccagccugggagacugcaucucaaaaaagaaaaauaaacgaaguaaaagauauuua

SEQ ID NO: 416215 - RNA, 64 nt, Human
auuaccuagguuaagcacuauugucugugcuaguaagaaaaagaaaggaaaaccaucauugcuu

SEQ ID NO: 416216 - RNA, 64 nt, Human
ucagagaccacgaaaagaaauuugugcuucaccgaagaaaaauaucuaaacaucgagaaacuau

SEQ ID NO: 416217 - RNA, 64 nt, Human
uaauuuggaauagagaaaccaguauauuuuaaaaaagaaaaauauucuuuguagcaacuguaaa

SEQ ID NO: 416218 - RNA, 63 nt, Human
auggaaucauaagcaaagguuguguucuggggugaggaucaugagagagauauuuaucacaug

SEQ ID NO: 416219 - RNA, 63 nt, Human
cuuauucaaccuguccuuucagggaguuuauuggaggaucaaagaacugaaagcacuagagca

SEQ ID NO: 416220 - RNA, 63 nt, Human
cuguagucccagcuacuugggaugcugaggugggaggaucacuugaaccugggagacacaggc

SEQ ID NO: 416221 - RNA, 64 nt, Human
gggccccgcggguagaugccggcaggccuuccggaagaaaaagagccauugguuuuuguaguau

SEQ ID NO: 416222 - RNA, 64 nt, Human
uuaaaaugauuuucucugccuugagauuugcaucaagaaaaagcaccucucuucaccugaaagc

SEQ ID NO: 416223 - RNA, 64 nt, Human
uaucuuaaaacuaaauguaauuuauuaacuaaucaagaaaaacaucuuuggcugagcucggugg

SEQ ID NO: 416224 - RNA, 64 nt, Human
gccugggcaacauagggagacccccaucuuuacaaagaaaaaaaaaaggggaaaagaaaaucuu

SEQ ID NO: 416225 - RNA, 64 nt, Human
uccaguucuccguaacaguguaaaguuaaucagaaagaaaaaauuuuauugaugcagugugucu

SEQ ID NO: 416226 - RNA, 64 nt, Human
uguaaaaauuuuuaaaacacagaaacuauaugcaaagaaaaaauaaaaauuaucuauaaucuca

SEQ ID NO: 416227 - RNA, 64 nt, Human
auaugccagaugugugugaguuggaaaucaaaaaaagaaaaauaaaauaugcaaagaauucacc

SEQ ID NO: 416228 - RNA, 64 nt, Human
cuucagcuuuccaaaagcuaguaaacauguuucaaagaaaaauaaggucaggagaaaaagaaua

SEQ ID NO: 416229 - RNA, 64 nt, Human
uuaauauuugucuuuuuaagaugacuguacauguaagaaaaaagcuuauuaaaaacuugaucaa

SEQ ID NO: 416230 - RNA, 64 nt, Human
auguuuuauagugaaagauucaaauuugcuuuucaagaaaaaugccaaaagcuauuuaaauaau

SEQ ID NO: 416231 - RNA, 64 nt, Human
ugagguaauacagauccaaggagaauuguauagcaagaaaaaaacagucaacuacagaaacucu

SEQ ID NO: 416232 - RNA, 56 nt, Human
aaacuuuaauuuguucuugaacagucaagaaaaacauuauugaggaaaauuaauau

SEQ ID NO: 416233 - RNA, 64 nt, Human
ucaauaauaauaauaauaauaaugaugauacucuaagaaaaaaaucucaacauacuucauuuaa

SEQ ID NO: 416234 - RNA, 64 nt, Human
agccugggugaaaaagacaggcugugucuccaaaaagaaaaaaaaaagucaaauucaaauauca

SEQ ID NO: 416235 - RNA, 64 nt, Human
uuugaauuucaauaaucagggguuugggucaaggaagaaaaaucaugggacuugccauuuagga

SEQ ID NO: 416236 - RNA, 62 nt, Human; identical to SEQ ID NO: 170078

SEQ ID NO: 416237 - RNA, 63 nt, Human
cuguaaucccagcacuuugggaggucgaggugggaggaucacuugaggccacgaguucaagac

SEQ ID NO: 416238 - RNA, 63 nt, Human
accuguagucccggccacucggggcugaggcaggaggaucacuggaaccugggagguugccac

SEQ ID NO: 416239 - RNA, 64 nt, Human
uggaagagagaugagaaaauugagagcuauuauuaagaaaaacaguugagagaggaagaauuug

SEQ ID NO: 416240 - RNA, 64 nt, Human
agccacuaaauuucuaaggagaucauaagaaauuaagaaaaacguuuaagucuagccucugcgu

SEQ ID NO: 416241 - RNA, 64 nt, Human
cucaauugccuuauuccugaggauguagugaaggaagaaaaaguuuucuggaauuccguaaauu

SEQ ID NO: 416242 - RNA, 64 nt, Human
gggaaacgacccuguggcugugagaaagugaaaaaagaaaaaaaaaaaggcauuggcauuuucu

SEQ ID NO: 416243 - RNA, 64 nt, Human
guauuaggacagaauuaaugaugcuuaaagagaaaagaaaaaaagagagaagaaaaaggagaga

SEQ ID NO: 416244 - RNA, 64 nt, Human
uaaugaugcuuaaagagaaaagaaaaaaagagagaagaaaaaggagagaugaaaaaggaggaug

SEQ ID NO: 416245 - RNA, 64 nt, Human
auaaguagcugugguggauauuauuauuugaagaaagaaaaaacagauuuuaggguggaaaaaa

SEQ ID NO: 416246 - RNA, 64 nt, Human
uuaagaaaaugugggaauaccaaauguccuuuauaagaaaaauaaauuuuauuuuaagggacau

SEQ ID NO: 416247 - RNA, 64 nt, Human
uucagcugagaugcaaaaaagaaauuaagcaaaaaagaaaaagaugaagacuuuucaugaauuu

SEQ ID NO: 416248 - RNA, 64 nt, Human
uauaucagugucaaaagcccaagaaaagacaaaaaagaaaaaaacaauccccagggguucuaug

SEQ ID NO: 416249 - RNA, 64 nt, Human
gggaguauuugaacacaguugaauuuuuucuaaaaagaaaaagagauaaaugagcuuuccagau

SEQ ID NO: 416250 - RNA, 64 nt, Human
auuuaaccccccuguacacaacucacuccuuuuaaagaaaaaaauugaaauguaaggcugugua

SEQ ID NO: 416251 - RNA, 64 nt, Human
aggauauuuagaaauuuuguguauuauauggaaaaagaaaaaaagcuuaagucuguagucuuua

SEQ ID NO: 416252 - RNA, 64 nt, Human
caguuuaaaugaugucacuuuuagugcuguuggcaagaaaaaaaaaacaacaaacuuguacaau

SEQ ID NO: 416253 - RNA, 64 nt, Human
auuggcaggaaaaagcucuagaggcuauacagagaagaaaaaaagagcaaaaaugagaccugua

SEQ ID NO: 416254 - RNA, 63 nt, Human
caggcaugguggugggcuacucuggaggcccuugaggaucacuugagcccaggagauugaggc

SEQ ID NO: 416255 - RNA, 63 nt, Human
auguggucccagcuacucuggaagcugaggugagaggaucacuugagcccuggaauuccaugc

SEQ ID NO: 416256 - RNA, 63 nt, Human
cuauaaucccaggacuuugggaggccaaggcaggaggaucacuugaguccagaaauucaagac

SEQ ID NO: 416257 - RNA, 64 nt, Human
uuuucaacuguaaauaauguacauuuaaugucacaagaaaaaaaugucuucugcaaauuuucua

SEQ ID NO: 416258 - RNA, 64 nt, Human
aaaaaaaaaaaaaaaaaaaaaaggaaaaaaaaaaaagaaaaaaaaccauauguguauuagggug

SEQ ID NO: 416259 - RNA, 64 nt, Human
aauuugggaaguuuuacuuuuguuuucuucuaugaagaaaaaaaugcaggcugggcgcgguggc

SEQ ID NO: 416260 - RNA, 64 nt, Human
uagaccccaugucuacaaaaaaacucaaaacauaaagaaaaaccauaauacuguuaaucauguu

SEQ ID NO: 416261 - RNA, 64 nt, Human
aucccuacuuucuuuaugguacaaauauguacaaaagaaaaaggucuuauauucuuuuacacaa

SEQ ID NO: 416262 - RNA, 64 nt, Human
acugugauuuauuuggaguggaggcauuguuuuuaagaaaaacaugucauguagguugucuaaa

SEQ ID NO: 416263 - RNA, 64 nt, Human
agaaggcguacauagauuguuacaaaucaaagcaaagaaaaaucccaaaguucccucaaaacug

SEQ ID NO: 416264 - RNA, 64 nt, Human
uucauuacaggaaauguaacuagauauugugcccaagaaaaacagccagaagcaaagaaaugcu

SEQ ID NO: 416265 - RNA, 64 nt, Human
caagcagaugauugauaaaaccugggaguaagguaagaaaaauggaacaaauuuuuaucuaaaa

SEQ ID NO: 416266 - RNA, 64 nt, Human
uguaaaacuaauguaucaaaauuagcauauauggaagaaaaaucacuauucaaaaauaguuuca

SEQ ID NO: 416267 - RNA, 64 nt, Human
uaugaugccggaauucuguaaacaauaaagaugaaagaaaaaaugaaaacuuuauacaaaaaag

SEQ ID NO: 416268 - RNA, 64 nt, Human
agaauuuuguucuuaaacaaacuuagaauuucaaaagaaaaacauaugauccauuaaguuggag

SEQ ID NO: 416269 - RNA, 64 nt, Human
gauuugaaauaaaaggaaauuuuagcaaggauuaaagaaaaaagcuaucagcuguauguuaaga

SEQ ID NO: 416270 - RNA, 64 nt, Human
aauauaguucugauuggguauuaauuacuugauuaagaaaaaauuaacauuauagauacucugg

SEQ ID NO: 416271 - RNA, 64 nt, Human
acagaacaagacugucucaaaaaaaaaaaaagagaagaaaaacugccuacaggccauaguuaac

SEQ ID NO: 416272 - RNA, 63 nt, Human
gagcuauucauacacagugacuugauguucuuggaggaucaacaaaacugcccugggaaagca

SEQ ID NO: 416273 - RNA, 63 nt, Human
uggucagagggugaccugaaccagagcuggagugaggaucaaacaggcccaggagccugagga

SEQ ID NO: 416274 - RNA, 63 nt, Human
cuguaaucccaacccuuuggaagguaaagacgggaggaucacuugaggccaggaguucaagac

SEQ ID NO: 416275 - RNA, 64 nt, Human
uuuugcguaaguacuuugauuauuuaauauuuguaagaaaaaacuuucauuuuccuacagagga

SEQ ID NO: 416276 - RNA, 64 nt, Human
aacaaaaaucuucaaagacugguuucuuuuuuaaaagaaaaaacuugaaagaacacuucuaagc

SEQ ID NO: 416277 - RNA, 64 nt, Human
cacaugcaaaaugcuaaauuacaaugcagacauuaagaaaaaguauugacuggagggguugaau

SEQ ID NO: 416278 - RNA, 64 nt, Human
agugaugauaugcucuccuacagcaacauaugagaagaaaaaaggcuuaucuagauucgaaaau

SEQ ID NO: 416279 - RNA, 64 nt, Human
ggaugaauguucucaaauguuacaaagcuguuuaaagaaaaagguauauauaaguaaucagaac

SEQ ID NO: 416280 - RNA, 64 nt, Human
auggacuaagaacgaugcuggcuuucaagcaaaaaagaaaaauaaucauuguuuauuguauacu

SEQ ID NO: 416281 - RNA, 64 nt, Human
cacugaaaacauuuuugucauauucuuguauucaaagaaaaaggaaaaaagauuauuguaaaua

SEQ ID NO: 416282 - RNA, 64 nt, Human
auaacuaaaacauugaaaacagaacaaaugagaaaagaaaaaaaaccugccgauuaacaagacu

SEQ ID NO: 416283 - RNA, 64 nt, Human
aacuggaacuugacaauuauaaauaguaauagugaagaaaaaauagaaagguugcaauuauaua

SEQ ID NO: 416284 - RNA, 64 nt, Human
gcacagcaguaaacuauggggaaaaaaaaagaagaagaaaaagaaacucagggaucacugggag

SEQ ID NO: 416285 - RNA, 64 nt, Human
cugguaauuauauauuuauuauuuagcaaaacugaagaaaaaaagcacagaauuguuucaacag

SEQ ID NO: 416286 - RNA, 64 nt, Human
aaauaguacaguuacaaccaauaggaacaacaaaaagaaaaaguuugugacauuguaguaggga

SEQ ID NO: 416287 - RNA, 64 nt, Human
ugacuugagucuuuuucccuaauuugcuagugggaagaaaaauagcugagcuuucuaaaaugau

SEQ ID NO: 416288 - RNA, 64 nt, Human
ugcugccucugaaacagaaaguuggaaaggaaaaaagaaaaaagcaauuagguagcacagcacu

SEQ ID NO: 416289 - RNA, 64 nt, Human
uuaagguugaaaagacaauagcccaaagccaagaaagaaaaauuaucuugaauguaguauucaa

SEQ ID NO: 416290 - RNA, 63 nt, Human
gacucaguugucauucuucacaaaagaauaguagaggaucauguaaaccugagccuaacucuu

SEQ ID NO: 416291 - RNA, 63 nt, Human
cauuauggcucucauaaucugcauagguauaaagaggaucauuucuaccuagggauagccaaa

SEQ ID NO: 416292 - RNA, 63 nt, Human
gagaaauauccccugugcaacccacccuugguugaggaucacaaauugaggugccuuccuugu

SEQ ID NO: 416293 - RNA, 64 nt, Human
agaggcauuccagccccuauguuauugauggaaaaagaaaaagaagaaaagcaaucucgcagua

SEQ ID NO: 416294 - RNA, 64 nt, Human
aaccagugaggcugcccugaacaaaaaaaacaaaaagaaaaaaaaaaaaggaaagaaagaaacu

SEQ ID NO: 416295 - RNA, 64 nt, Human
ccuuuguuuacuuagcuuucucuuaguuauaagaaagaaaaagaccucuugcaugaaaauagua

SEQ ID NO: 416296 - RNA, 64 nt, Human
cagcucugacguggcagugaggugaccugaaggaaagaaaaauauaaauaaauaccacuucaua

SEQ ID NO: 416297 - RNA, 64 nt, Human
cauaggucuaucauuauuucuuagacauaaucuaaagaaaaacagacuagagaagccaccuggu

SEQ ID NO: 416298 - RNA, 64 nt, Human
ggccggugagcggggcggguucugcugggucgggaagaaaaauaauucugcaagguauuuuguu

SEQ ID NO: 416299 - RNA, 64 nt, Human
aagaaggaaaaaaaaaagaauuaaaaaaaaaaaaaagaaaaacagaagaugaccuugauggaaa

SEQ ID NO: 416300 - RNA, 64 nt, Human
auuugggggcuuacucaugcuaggcuugaggaagaagaaaaacgcuucggcauucuccuuagga

SEQ ID NO: 416301 - RNA, 64 nt, Human
aucccagcaauaaugguaacauuuugacaacugaaagaaaaaguacaaggggauccagugugua

SEQ ID NO: 416302 - RNA, 64 nt, Human
cgcaaugagagaagcagcaguggguacaaggaggaagaaaaagggcuugcagagaguggaaagu

SEQ ID NO: 416303 - RNA, 64 nt, Human
gaauauucaugaaacuucauugcagggguaauagaagaaaaaguaaauugggaggacuuaaugg

SEQ ID NO: 416304 - RNA, 64 nt, Human
agguuuguugaacaaugccuuuucagguuggaagaagaaaaauagccucaaucucccaccccau

SEQ ID NO: 416305 - RNA, 64 nt, Human
cuccaugcaacuaugagucucuaaaucucucuguaagaaaaaaauuucaaaguaaagauuuuac

SEQ ID NO: 416306 - RNA, 64 nt, Human
uuucuucuggccuacaaguauuuuuuuuuuaaaaaagaaaaaaagccuacauuggcaucaaguu

SEQ ID NO: 416307 - RNA, 64 nt, Human
uuugcaacagaauuuuguagccuuaagggguaggaagaaaaaccugacugcaaaucaugucagu

SEQ ID NO: 416308 - RNA, 63 nt, Human
aaauaaaaauaaaagccuuuggguucuugaauggaggaucauggaacacauuugcugccauau

SEQ ID NO: 416309 - RNA, 63 nt, Human
aaaaaaaaaaaagguggcaggagaggcuuuggggaggaucagccagcagacaugagcacugcu

SEQ ID NO: 416310 - RNA, 63 nt, Human
uuuuugaggaaguuuugucuaauuaucaauauugaggaucagggcuccuaggcucagugguag

SEQ ID NO: 416311 - RNA, 64 nt, Human
ugguuauuuaccuccuuuuuuuuuuuuuuuuuuaaagaaaaaaggacuuuuaaccuuugcugac

SEQ ID NO: 416312 - RNA, 64 nt, Human
accaugcaaguuaucucugaaauuuaaaauguuaaagaaaaacauuucuauauugaaauauaua

SEQ ID NO: 416313 - RNA, 60 nt, Human
ccaaagucggaaucuacugaacaaucagaaaagaaaaaaauguaaugcaaauuuuaagaa

SEQ ID NO: 416314 - RNA, 64 nt, Human
gcuuacaaauauucuguuaagggguaguuuuauaaagaaaaaugauauauaguuauguugucuu

SEQ ID NO: 416315 - RNA, 64 nt, Human
cuccuaucgguauacaaauuccauuucuuuuuauaagaaaaacacauaaaccauuaucauuuau

SEQ ID NO: 416316 - RNA, 64 nt, Human
uguauagcuuacucuaccugcagacagaaaaugaaagaaaaaaauggacuugccuagaauaaua

SEQ ID NO: 416317 - RNA, 64 nt, Human
gucuugcauccagaaaggccagauuuuaccuaccaagaaaaaaagauauuuuuccagagaguua

SEQ ID NO: 416318 - RNA, 64 nt, Human
ggaccuuugauccuauguggaagggcuguuuuuuaagaaaaaauuuuugguaaacaguauugug

SEQ ID NO: 416319 - RNA, 62 nt, Human
gaucauuuaacaaaaaauaaguagcuuuauuaaagaaaaaucuucaacacaaucaaacuuua

SEQ ID NO: 416320 - RNA, 64 nt, Human
ugaaaaugcuggugagcugagguagaaaaaaaacaagaaaaaaauuuuaaaaauagcguuaaaa

SEQ ID NO: 416321 - RNA, 64 nt, Human
guugguauaaagauauuuugagcagacuguaaacaagaaaaaaaaaaucaugcauucuuagcaa

SEQ ID NO: 416322 - RNA, 64 nt, Human
acagaacugcagaccucuaaacauaaguaggaaaaagaaaaauaaaagaauauuaccaauaauu

SEQ ID NO: 416323 - RNA, 64 nt, Human
augugguauccuacauggaauuauauaccacgaaaagaaaaaaaggucauuugguagaaacuag

SEQ ID NO: 416324 - RNA, 64 nt, Human
gaacuauauuucaaaugaauuuaaauaucuuuuaaagaaaaaaacaccuaaaaauaaaucuuaa

SEQ ID NO: 416325 - RNA, 64 nt, Human
uaacuggacaccuuuuauuugaagaaacaaacugaagaaaaaaugcuuccuuaagugcugacag

SEQ ID NO: 416326 - RNA, 63 nt, Human
aaagaucacagcagccagcuccugguggcugaugaggaucagagcauuuguucccccaugaaa

SEQ ID NO: 416327 - RNA, 63 nt, Human
aaagaucucagcagccagcuccugguagcugaugaggaucagagcguuuguucccccaugaaa

SEQ ID NO: 416328 - RNA, 63 nt, Human
cagucacaauggucuccauugcauuucaaaggagaggaucagacuaucugaauauaaacacaa

SEQ ID NO: 416329 - RNA, 64 nt, Human
auaaagcaauaugcauacaauguaguaguucuguaagaaaaaaguauuaugugcauuuuaacug

SEQ ID NO: 416330 - RNA, 64 nt, Human
cuacucuguauaacgcaugagaggggaggcaaagaagaaaaagacacacagaagggccuuuaaa

SEQ ID NO: 416331 - RNA, 64 nt, Human
gcagaucaacaaucaucaccugccuuuuguagaaaagaaaaacaaaaaaaguaaauaaaaauuu

SEQ ID NO: 416332 - RNA, 64 nt, Human
gcugcuguuuucaagaagagcaaucuguuuggauaagaaaaaccuuuacuuuacagcuucccuu

SEQ ID NO: 416333 - RNA, 64 nt, Human
aauuauguaaaaaacaaaacuacaacaacaaaaaaagaaaaaaguuaaaaaagaaaaaaacacc

SEQ ID NO: 416334 - RNA, 64 nt, Human
aaacuacaacaacaaaaaaagaaaaaaguuaaaaaagaaaaaaacaccaaaaaacaaaaacaaa

SEQ ID NO: 416335 - RNA, 64 nt, Human
acaugaugucaagaaguaucugcuugaccuuucuaagaaaaagggauucuuaucuuacucugag

SEQ ID NO: 416336 - RNA, 64 nt, Human
auugguguaaaucuuuuuauaaauacauaaauaaaagaaaaauaugcauuuuucuuuucuaaaa

SEQ ID NO: 416337 - RNA, 64 nt, Human
cugacuguaacauauucuguaugaacuuuaucuaaagaaaaauaaaucuguucugggcucuuuc

SEQ ID NO: 416338 - RNA, 64 nt, Human
aaucauuuuucuuuaacuaacuucuauuuuuuuuaagaaaaaaaaauagacugguggguacuca

SEQ ID NO: 416339 - RNA, 64 nt, Human
ugauuucaauacacucaagugccauucauccuuuaagaaaaacaucuggauaucaagguggaaa

SEQ ID NO: 416340 - RNA, 64 nt, Human
uuacacagucaccuugcccuuccuuccaccaccgaagaaaaaagauggucauacuaacagguga

SEQ ID NO: 416341 - RNA, 64 nt, Human
uucugcucuuuauugaagacaaacacucaccaaaaagaaaaauaaaaguuuucagagaaacuaa

SEQ ID NO: 416342 - RNA, 64 nt, Human
ucuuuucaaguaauuuucauauuaaacaaaaacaaagaaaaaaaaucuuauaaaaaggaaaaaa

SEQ ID NO: 416343 - RNA, 64 nt, Human; identical to SEQ ID NO: 416295

SEQ ID NO: 416344 - RNA, 63 nt, Human
auaaaauuccagcacuuugggaggccaaggcaggaggaucacuugagccuaugaguucaagac

SEQ ID NO: 416345 - RNA, 63 nt, Human
cacuccaaccagcagcuggauuccugggaacuggaggaucagagugcuguggacuggacccag

SEQ ID NO: 416346 - RNA, 63 nt, Human
uguguaucucuuucacauuguuugcugcuauuggaggaucaguuuuuuguuuuacaaugucau

SEQ ID NO: 416347 - RNA, 64 nt, Human
auacauagaauuugccaguuacuuucugacuacaaagaaaaacagauacuaaaagucucuucug

SEQ ID NO: 416348 - RNA, 64 nt, Human
ugagcaaaaacagcaaguggugaaauucuuaaucaagaaaaaagcaaauuuaaaugcacuggau

SEQ ID NO: 416349 - RNA, 64 nt, Human
aaaagagagaaacggacaccagaggaaugaacuaaagaaaaacguaaacuuggaaaauacagaa

SEQ ID NO: 416350 - RNA, 64 nt, Human
aacagugggguuuaguacuccaaaugaacucuuaaagaaaaaaacuaaucuuggcauccuauca

SEQ ID NO: 416351 - RNA, 64 nt, Human
cuuuuaaacuuauuuugcuuuaaaaaaaaaaaaaaagaaaaagaaaauuuaacuuaaaauauuu

SEQ ID NO: 416352 - RNA, 64 nt, Human
uaaguuaacuguaauuacuguauuuugugggacaaagaaaaaaggacuccaguauuuguggccu

SEQ ID NO: 416353 - RNA, 64 nt, Human
guauacuuccugauuugaaaggaggagguuugaaaagaaaaaaauggaggugguagaugccaca

SEQ ID NO: 416354 - RNA, 64 nt, Human
gaaucugacuuuguccuucuaaaggauauauuugaagaaaaacaaauuguucaugaaaauggaa

SEQ ID NO: 416355 - RNA, 64 nt, Human
aaaaaaguuuuauuuuucuaaaaaaagaaaaaagaagaaaaaauuuaaaggguguacuuauauc

SEQ ID NO: 416356 - RNA, 64 nt, Human
uuuguacaaaaaaaaaguuuuauuuuucuaaaaaaagaaaaaagaagaaaaaauuuaaagggug

SEQ ID NO: 416357 - RNA, 64 nt, Human
aauauguuguucaaauuaugaguauuauuuaaaaaagaaaaaggaacauaacccaggagucuaa

SEQ ID NO: 416358 - RNA, 64 nt, Human
cuaguuuuuaguaaucuguacauuuuguuguaaaaagaaaaaccacucccaguccccagcccuu

SEQ ID NO: 416359 - RNA, 64 nt, Human
uuaaauuauuccauaaauaauauuuaaagagcacaagaaaaauuuuuuaaagugcacuaaaaug

SEQ ID NO: 416360 - RNA, 64 nt, Human
auuauaguuuuggcuguauaaauaaaacugugagaagaaaaaaauaauaugaaacaaugaggua

SEQ ID NO: 416361 - RNA, 64 nt, Human
ugaacacaaucauaugaugguaaagcagaaacuuaagaaaaaauuguuuauguguuauauucaa

SEQ ID NO: 416362 - RNA, 62 nt, Human; identical to SEQ ID NO: 170091

SEQ ID NO: 416363 - RNA, 63 nt, Human
cuguagucucagcuacucggaaggcugaggcaggaggaucacuugagccugggaauucgaagc

SEQ ID NO: 416364 - RNA, 63 nt, Human
cugcagucccagcuacuugggaggcugaguugggaggaucacuugagccugggagguugaggc

SEQ ID NO: 416365 - RNA, 64 nt, Human
gaacucugaaaaaacaaaacaaaaaaaaaaaaaaaagaaaaaaaaaacaugcaccuguuucacu

SEQ ID NO: 416366 - RNA, 64 nt, Human
guugaacucuggaaaaaaaaaaaaaaaugaaaaaaagaaaaaaaaaagagcuauagaaauccuu

SEQ ID NO: 416367 - RNA, 64 nt, Human
acauauguagguauucauuuugaguagguugaagaagaaaaaaaauauuuaaaugaauugaauu

SEQ ID NO: 416368 - RNA, 64 nt, Human
accaaaauggugaaacccugucucuacuaaaaaaaagaaaaauuagccagacgugguggcaugc

SEQ ID NO: 416369 - RNA, 64 nt, Human
auuuugacaaaauauauuuauaacuacguauuaaaagaaaaaaauaaaaugagucauuauuuua

SEQ ID NO: 416370 - RNA, 64 nt, Human
augcacuguuacuuacaguuuguuuccugcaguaaagaaaaauucuucauuugugcaaaauuug

SEQ ID NO: 416371 - RNA, 64 nt, Human
aaagggcgacucuguguaaguaaccuaagaaacgaagaaaaauucuuauucaaaaugacuccuu

SEQ ID NO: 416372 - RNA, 64 nt, Human
auuuaagcucuuuguacagugucaauuuguaaaaaagaaaaaacgaaaaaaaaucucaaauaaa

SEQ ID NO: 416373 - RNA, 64 nt, Human
gugauucagagaacagugugaccaaaaacccacuaagaaaaacagauucuugugacaguggaau

SEQ ID NO: 416374 - RNA, 64 nt, Human
uuuauaucaaaggugcaucgugaccaaauuguuuaagaaaaaaaaacaaaaaaaacaaaaucua

SEQ ID NO: 416375 - RNA, 64 nt, Human
ucugcuaagcuguuaaauguauuuauaguaaaggaagaaaaaaagacugucauuuccuuauaag

SEQ ID NO: 416376 - RNA, 64 nt, Human
uucuauuucucuuucuuugugugaauuuauuuaaaagaaaaaaaaacuuuuuguaacgacuauu

SEQ ID NO: 416377 - RNA, 64 nt, Human
gaagugacaguuuacaaaauuauuuucugcaaaaaagaaaaaaaaguuacguuaaaaaccaaaa

SEQ ID NO: 416378 - RNA, 64 nt, Human
uaaaaaacaccuguuaauuuuaaacacauuuuuuaagaaaaaaauaauuaaaaaagaaacagug

SEQ ID NO: 416379 - RNA, 64 nt, Human
uuaaaagucuauauaaauauuucaacagaucguaaagaaaaaauuuaucucuuugguccuugca

SEQ ID NO: 416380 - RNA, 63 nt, Human
cacucaggcuuucuucccuuagggucacagggugaggaucaaagacacaaaugucugagauac

SEQ ID NO: 416381 - RNA, 63 nt, Human
ucauuucuuggggucguauuccugauuucagaagaggaucauaacugaaacaacauaagacaa

SEQ ID NO: 416382 - RNA, 63 nt, Human
cuauaauccuagcacuuugggaggcugaagcaggaggaucacuugagcccaggaguucaagac

SEQ ID NO: 416383 - RNA, 64 nt, Human
gagugagagcccagggacaggucccuggaaaccaaagaaaaaucgcauuucaacccuuugagug

SEQ ID NO: 416384 - RNA, 63 nt, Human
uuaacauagauggaaaguaacuaaaaauaaauacaagaaaaaccaucgguguuauuaacuuac

SEQ ID NO: 416385 - RNA, 64 nt, Human
guuaugcacucucugaaaggaaaaacacacacaaaagaaaaagacuuuuuuuuuuuuuuuuuuu

SEQ ID NO: 416386 - RNA, 64 nt, Human
aguuuucacccuuuaaucuuaaguuuagccuuuuaagaaaaacaguaagcgaugacugcugaaa

SEQ ID NO: 416387 - RNA, 64 nt, Human
cauaugcuccuagagaggagaaaggggugauugaaagaaaaaaaaauacuuaaauauuuguaau

SEQ ID NO: 416388 - RNA, 64 nt, Human
gguaaggcuuauuuuugauuagcagucaauggcaaagaaaaaguaaaucaaagaugacuucuuu

SEQ ID NO: 416389 - RNA, 64 nt, Human
uacagaaauuaacuuugagaccagaauuacagagaagaaaaaccaaaacccaacccugcauggu

SEQ ID NO: 416390 - RNA, 64 nt, Human
gauccacaaugcauggauuccuuugaagaaaaaaaagaaaaagagaaaaaaaucacaaaaacaa

SEQ ID NO: 416391 - RNA, 64 nt, Human
gaaauuucugauccacaaugcauggauuccuuugaagaaaaaaaagaaaaagagaaaaaaauca

SEQ ID NO: 416392 - RNA, 64 nt, Human
aauguaccuuuuuguuagugaauuuggaaauaaaaagaaaaaaaaaacaaaaacaaacaggcug

SEQ ID NO: 416393 - RNA, 64 nt, Human
uaauaaucgagaaugccugggcauuuuacaaaacaagaaaaaaaauacccuuuucuuuuccuug

SEQ ID NO: 416394 - RNA, 64 nt, Human
caaagcuacacuuuugaguaaaaacccuuauuaaaagaaaaacaugauuaauauuuuugucuau

SEQ ID NO: 416395 - RNA, 64 nt, Human
caauguauuagauaaacccaguuucagaaugauaaagaaaaaauguuagaccaaauaaugcggc

SEQ ID NO: 416396 - RNA, 64 nt, Human
uaccacucuuuguguagauauuugucauauauuuaagaaaaagcuaaaaagaauggaaaucgca

SEQ ID NO: 416397 - RNA, 64 nt, Human
aauuuuaugauguacacuuugugcuuggcauuaaaagaaaaaaacacacauccuggaagucugu

SEQ ID NO: 416398 - RNA, 63 nt, Human
gugcaugccuguaaucucggaaggcugaggcaggaggaucauuugagcucaugagggcccagg

SEQ ID NO: 416399 - RNA, 63 nt, Human
cuguaaucccaccacuuugggagggugaugcaggaggaucacuugaggccaggaguuggagac

SEQ ID NO: 416400 - RNA, 63 nt, Human
cacacagccuucggaaacccccaaggugucgaggaggaucagauccagauaagagaagaugau

SEQ ID NO: 416401 - RNA, 64 nt, Human
ccucccuuuugacagagauuagaaguacuucuuuaagaaaaaaauaaauuugagaaauuguauu

SEQ ID NO: 416402 - RNA, 64 nt, Human
ggugacaaagcuacacgccaucucaaaaaaaaaaaagaaaaaggguuacaaaagguucccagcu

SEQ ID NO: 416403 - RNA, 64 nt, Human
gccuauuaacaucauacauugucauuagucuuugaagaaaaaauauguaaauauauauguguaa

SEQ ID NO: 416404 - RNA, 64 nt, Human
cuuggugacagagcaagacuccgucuccaaaaaaaagaaaaaaaaauuucuugaaguggaauga

SEQ ID NO: 416405 - RNA, 64 nt, Human
acugcacaguugugaaaaaggaagagaaucauuaaagaaaaagaaaaaagauuuuaagaccguu

SEQ ID NO: 416406 - RNA, 64 nt, Human
caguugugaaaaaggaagagaaucauuaaagaaaaagaaaaaagauuuuaagaccguugaaauc

SEQ ID NO: 416407 - RNA, 64 nt, Human
aauuuguauuuuggaggugcuugaucuaucuacaaagaaaaauuaauuaggaauuacuuuauua

SEQ ID NO: 416408 - RNA, 64 nt, Human
ugaauacugucuguaucuuugguuauccuguuugaagaaaaaggacaaauaaaacauggccagc

SEQ ID NO: 416409 - RNA, 64 nt, Human
gauuaucugaagacacaaaccugacaggagggagaagaaaaaacaaaacacuugaaccaagaaa

SEQ ID NO: 416410 - RNA, 64 nt, Human
caguaugcccagaagcuuuccuucauaaaauagaaagaaaaaaacauuuggcuuauuuuucacu

SEQ ID NO: 416411 - RNA, 64 nt, Human
caaaugaaguccuucuccaaaugcauugagccccaagaaaaaucgcugauucugaggaaccuuc

SEQ ID NO: 416412 - RNA, 64 nt, Human
gagaaaacuagucuaaauuauuucaacuggaaaaaagaaaaaagaguccucuucuuuucccagc

SEQ ID NO: 416413 - RNA, 64 nt, Human
gauuaauaauccaacuuuaauaguauacauuuaaaagaaaaaaaacaaaagcccuggaaguuga

SEQ ID NO: 416414 - RNA, 64 nt, Human
ccagggcuugucuggaucagcaccaacgauuuuaaagaaaaaaggaagaguuucuuagaugagu

SEQ ID NO: 416415 - RNA, 64 nt, Human
uggacccugaagaggaggcaacacaccauuguagaagaaaaacaacagaaggauccuggucccu

SEQ ID NO: 416416 - RNA, 63 nt, Human
aggaagagaaagccuuugucuagcauuuauuaggaggaucagagugagugggaaguuucacaa

SEQ ID NO: 416417 - RNA, 63 nt, Human
augguggcccaagucugagucccaguuacuugggaggaucacuugaauguaggaucacuugag

SEQ ID NO: 416418 - RNA, 63 nt, Human
auguaauccuagcacuuugggaggcugagaugggaggaucacuugaggccaagaguuugagac

SEQ ID NO: 416419 - RNA, 64 nt, Human
uacagaauuaacaagagaaaaugucuaacuuuuuaagaaaaaccuuauuuucuucgguuuuuga

SEQ ID NO: 416420 - RNA, 64 nt, Human
aguuuguguguuuaaacuuuuuuuugagcgagggaagaaaaagcuguaugcauuucauugcugu

SEQ ID NO: 416421 - RNA, 64 nt, Human
auuuguuaauuugugaauacgaauaaaugggauaaagaaaaauagacaaccaguucgcauuuua

SEQ ID NO: 416422 - RNA, 64 nt, Human
ucggaagcauggggcuuuugagcacacuuaaaaaaagaaaaaucuguaacuuggugcuuauuga

SEQ ID NO: 416423 - RNA, 64 nt, Human
auuaguaauccaagggucauuuuuuucuuaaaaaaagaaaaaaagguuccaaaaaaaaccaaaa

SEQ ID NO: 416424 - RNA, 64 nt, Human
aaaauugaauaguacccaauuaaaguuccucaguaagaaaaaaaauguguuuuuguaggcaaaa

SEQ ID NO: 416425 - RNA, 64 nt, Human
aacaaaauaaaacaaaaaaaaggaaggaaaaaaaaagaaaaaauuuaaaaaauuuuaaaaauau

SEQ ID NO: 416426 - RNA, 64 nt, Human
uccacuucauccagaugaaggaaaggaagaccucaagaaaaauucacaguugagugcaucccag

SEQ ID NO: 416427 - RNA, 64 nt, Human
uuauuuuuuaaaauucuaaguagaguauauugaaaagaaaaagaagagccuuaacauauauaaa

SEQ ID NO: 416428 - RNA, 64 nt, Human
uaccacucuuuguguagauauuugucguauauugaagaaaaagcuaaaaagaauggaaaucgca

SEQ ID NO: 416429 - RNA, 64 nt, Human; identical to SEQ ID NO: 416395

SEQ ID NO: 416430 - RNA, 64 nt, Human
gcguuucuaugacacaugcaaggucauuuuuuuuaagaaaaaggaugcacagaguuguuacauu

SEQ ID NO: 416431 - RNA, 64 nt, Human
ugaauugguaaaagggaugcuagaaauucaacugaagaaaaaaagcaagucaaguacguauuca

SEQ ID NO: 416432 - RNA, 64 nt, Human
aauuucugucucaaaauguauaauauagaaaugcaagaaaaaaacaaauguacagauuguaaag

SEQ ID NO: 416433 - RNA, 64 nt, Human
ggcuucaaguauaaaauuuuggugaauguguaccaagaaaaaauuagucaccugaguaacuugg

SEQ ID NO: 416434 - RNA, 63 nt, Human
ccuaccaaaguaaccugggcuuaaguuuuacuugaggaucauaugaauuagccaaaagaaugg

SEQ ID NO: 416435 - RNA, 63 nt, Human
ugugcuuucuugaugcguagaaacacgugcauggaggaucaaacacugucagaauugcugaaa

SEQ ID NO: 416436 - RNA, 63 nt, Human
cuguaaccccagcacuuugggaggccaaggagggaggaucacaaggucaggagaucgagacca

SEQ ID NO: 416437 - RNA, 64 nt, Human
cuaguuuccagccauugaagugaacugcuaaaaaaagaaaaauaauugaaauguugagagagau

SEQ ID NO: 416438 - RNA, 64 nt, Human
ucauuaauucaccauccagagaccaaauaauuaaaagaaaaacaaauauagauagguagaacua

SEQ ID NO: 416439 - RNA, 64 nt, Human
cagaaaacuacuuauguccuuuucuugccuuuccaagaaaaauguuuuuuguuuuuuuuuuuaa

SEQ ID NO: 416440 - RNA, 64 nt, Human
caacugguuuguguuuugcugcugcauuuaucccaagaaaaacagcuuuaaucuccagaagaaa

SEQ ID NO: 416441 - RNA, 64 nt, Human
aaauaguguuuaauauugauuggggguggggagaaagaaaaaguguauuacuuaaagauacuau

SEQ ID NO: 416442 - RNA, 64 nt, Human
cucaagauagcagguuuauacuuagaaauauuugaagaaaaaaaagcguuauuuauaguccaaa

SEQ ID NO: 416443 - RNA, 64 nt, Human
uugaagcagucacauuuguacuguaguucaauaaaagaaaaaugaaguauucuguagccuauau

SEQ ID NO: 416444 - RNA, 64 nt, Human
ggaaagcgguguagguguugugagcuuuugcuguaagaaaaaguugagacuuuuguuuugcuuu

SEQ ID NO: 416445 - RNA, 64 nt, Human
caucuccaaacuaaacccucacaaguaacaguugaagaaaaaauggcaagagaucauauccuca

SEQ ID NO: 416446 - RNA, 64 nt, Human
cucagaaggcaacaacagcagcuucguuaugaacaagaaaaaaggaauuccuugaaacgcccac

SEQ ID NO: 416447 - RNA, 64 nt, Human
uuuuaacauuaucauggcagggaaauauauaaagaagaaaaauauuuuuacauuaaaccuuuuc

SEQ ID NO: 416448 - RNA, 64 nt, Human
uuuauuuugcugguuugauuuuuuuuuuuuaaagaagaaaaaaaaacugcccugaauuaaaugg

SEQ ID NO: 416449 - RNA, 64 nt, Human
aaaaaauuaauauguguacaauuaaaaugaaugaaagaaaaaccauuauuguacagagguauua

SEQ ID NO: 416450 - RNA, 64 nt, Human
cuuagaaggaaggagggggagcccagguaugagaaagaaaaaaccacuaagaaaauaccucccu

SEQ ID NO: 416451 - RNA, 64 nt, Human
guugacuuuucauguuaaggaaauacgaaucugaaagaaaaauguuaacuccagcucuugaagu

SEQ ID NO: 416452 - RNA, 51 nt, Human; identical to SEQ ID NO: 170013

SEQ ID NO: 416453 - RNA, 63 nt, Human
uuuauaagagaauagaggcaaaaguauagaacugaggaucauuuguauuuuugaguuggaaau

SEQ ID NO: 416454 - RNA, 63 nt, Human
cuauaaucccaauauuuugggaggccgaggagagaggaucacuuaagcccaggagucugagac

SEQ ID NO: 416455 - RNA, 64 nt, Human
ccaggaacuacaagaugccaucugccguuugcaaaagaaaaaucuuuucccauauaauccaacu

SEQ ID NO: 416456 - RNA, 64 nt, Human
agagagagagagagaggagaagacagagagauuaaagaaaaauauguucacucccacuuaugug

SEQ ID NO: 416457 - RNA, 64 nt, Human
auuucuaaauuuccuucuuccaagaugaaaacaaaagaaaaacuuaaaacagaagguauuaaaa

SEQ ID NO: 416458 - RNA, 64 nt, Human
ggaaaccuugcagcauuuuuauuuaaaagaaaagaagaaaaaaaacacccaaccacacaaagaa

SEQ ID NO: 416459 - RNA, 64 nt, Human
caccaaauggagcuuggcacuaaaauuuauguaaaagaaaaaucacaaaccuugaaaaauuuua

SEQ ID NO: 416460 - RNA, 64 nt, Human
uaccuaaguguuucuguaggggaaggagccaauuaagaaaaaguguugguacagauucauguuu

SEQ ID NO: 416461 - RNA, 64 nt, Human
ggggcuuaggggauuggaacugggguuuggcugaaagaaaaaaaaaaaaauguaacugaugaau

SEQ ID NO: 416462 - RNA, 64 nt, Human
aaggcccaggacacuugucagaaggaugcaaaaaaagaaaaaaguacauccacccucuuaaucc

SEQ ID NO: 416463 - RNA, 64 nt, Human
cggaaauuuccccaucauucuaggaugauacagaaagaaaaacugugccuggacccucccucuu

SEQ ID NO: 416464 - RNA, 64 nt, Human
cuugggugaucucugcuucauuagucauggguggaagaaaaaccacaccccccgcaccccuccg

SEQ ID NO: 416465 - RNA, 64 nt, Human
agcucagaaauucuaucuucgggagucaccacaaaagaaaaaaaucaaaaugcagaaaaugugu

SEQ ID NO: 416466 - RNA, 64 nt, Human
gguuuuguuucuguuguuguucaaaugcaaaaaaaagaaaaaaaaagaaaaaaaaaggugacuc

SEQ ID NO: 416467 - RNA, 64 nt, Human
cuguuguuguucaaaugcaaaaaaaagaaaaaaaaagaaaaaaaaaggugacucacauuguuac

SEQ ID NO: 416468 - RNA, 64 nt, Human
aaaaaaaauuccuuguaguuucuuagaggaaaaaaagaaaaaccccaacuuuuagcacugauac

SEQ ID NO: 416469 - RNA, 64 nt, Human
ucuguuucucuucagugcuccauuuuuuuaaugaaagaaaaaauaauaaagcuuuuguuuacca

SEQ ID NO: 416470 - RNA, 63 nt, Human
cuguagucccagcacuuugggaggcaaaggcgggaggaucacuugaggccaggacuuugagac

SEQ ID NO: 416471 - RNA, 63 nt, Human
cugucaucccagcacuuugggaggccgaggcaggaggaucaccugaggucaggaguuugagac

SEQ ID NO: 416472 - RNA, 63 nt, Human
cuuguuuauggggagucugguuggaugucauuugaggaucauugugccccuagaggugccauu

SEQ ID NO: 416473 - RNA, 64 nt, Human
uuugagaaaaaaaaugaaaaaauucuaauaaaagaagaaaaaugguuuuuggguuugugccaga

SEQ ID NO: 416474 - RNA, 64 nt, Human
cagccguuuguuccccaagacauucuagguuugcaagaaaaauaugaccacacuccagcuggga

SEQ ID NO: 416475 - RNA, 64 nt, Human
ccacacaaaaaaaaaaaugucuuaaccaaccgaaaagaaaaauuaaaaaaggauuuguauuaaa

SEQ ID NO: 416476 - RNA, 64 nt, Human
cuuaucagaaaacauauaugucaucucuagaacgaagaaaaagcauaguaguucaauucccagu

SEQ ID NO: 416477 - RNA, 64 nt, Human
guagagaauuuggaaacuguagaagagaaucaagaagaaaaauaaaaaucagcuguuguaauca

SEQ ID NO: 416478 - RNA, 64 nt, Human
caugacaaguacuguauuuuuuuauaccuaaauaaagaaaaaucuuuagccugggcaacauagg

SEQ ID NO: 416479 - RNA, 64 nt, Human
uuucucaucuuaccccuuuaugccaccuacugaaaagaaaaacaaauagcuagguuugguuucc

SEQ ID NO: 416480 - RNA, 64 nt, Human
uuuaaaaauauuaauccuuuugaaaagaacugagaagaaaaauguauaauuuuaucccauuuuu

SEQ ID NO: 416481 - RNA, 64 nt, Human
uucuagaagcaaaaaaaaaaaaaaaaaaaaaaaaaagaaaaaaaaagaaaagaaaaaaagaaaa

SEQ ID NO: 416482 - RNA, 64 nt, Human
uauuuuucuauacaguaauuggugugugguauagaagaaaaacggguucaaaccccacuucugc

SEQ ID NO: 416483 - RNA, 64 nt, Human
gacaaaaauaggugcaaaugauggggggcaauagaagaaaaaauuugcauuuuggaaaauuggg

SEQ ID NO: 416484 - RNA, 64 nt, Human
auuucgaaagaaauaauuggcaagauaaugagaaaagaaaaaagucaugguaggugaggugguu

SEQ ID NO: 416485 - RNA, 64 nt, Human
aggcuaugcuugggacuggccugaggguauuuuaaagaaaaaaacuacauaaaaggccuaaaag

SEQ ID NO: 416486 - RNA, 64 nt, Human
cugcagccgggggcuggccuucuccuacuuagggaagaaaaagcaaguguucacugcuccuugc

SEQ ID NO: 416487 - RNA, 64 nt, Human
gcuggaucugaguuuugucacucuaaaauuaaacaagaaaaaaagugggaaaagggcauccccc

SEQ ID NO: 416488 - RNA, 63 nt, Human
agcagauuuuaugaacuauaagaugcagucucagaggaucagcaaguggaggccaucaguauu

SEQ ID NO: 416489 - RNA, 63 nt, Human
cucuguuugaaccagcaggauugcagaucauuugaggaucagagugugaaaacgaguuucucu

SEQ ID NO: 416490 - RNA, 63 nt, Human
ccuguaacccuggcacuuaaggggccaaggcaggaggaucacuugaggccagugagcugugau

SEQ ID NO: 416491 - RNA, 64 nt, Human
cuuccauucaccauucuuuaucuuuucuuugaauaagaaaaaguaucuagcaaggauauuacuu

SEQ ID NO: 416492 - RNA, 64 nt, Human
uguuuguaaaucuagccaauagagucauuuacagaagaaaaaugagcauguaauaauacaagaa

SEQ ID NO: 416493 - RNA, 64 nt, Human
auuuuuuuaaaggaaacaaacagacaacaaaaagaagaaaaaaaaaaagaaccuccuuggaaaa

SEQ ID NO: 416494 - RNA, 64 nt, Human
agaauacaaaccaguaaggcaacacgaauaaacuaagaaaaagguaagaacugucucaaaaacg

SEQ ID NO: 416495 - RNA, 64 nt, Human
aaauauuuagauuaaagcccccuuuaaugaguacaagaaaaacucuuggcuuguuagaagaaag

SEQ ID NO: 416496 - RNA, 64 nt, Human
aucaguaagauuccuguaagaaauacugcuuuuuaagaaaaaaaauaacaugcugaggggugac

SEQ ID NO: 416497 - RNA, 61 nt, Human
cagcuguggcuacaacauaggguuuuuauacaagaaaaauaaagugaauuaagcguguuac

SEQ ID NO: 416498 - RNA, 64 nt, Human
uucaagacuuuaaacauuuauguuuaaaaguaagaagaaaaauaauauucagaacugauuccug

SEQ ID NO: 416499 - RNA, 64 nt, Human
aaacaugauuuugugcaauuaacaaagcuacugcaagaaaaauaaaacacuucuugguaacaca

SEQ ID NO: 416500 - RNA, 64 nt, Human
caaaaaaaaaaaaaaaaaaaaaaaaaaaagaaaaaagaaaaaaaaaauccaaaagagagaagag

SEQ ID NO: 416501 - RNA, 64 nt, Human
uaaaagccaaaaaaaaaaaaaaaaaaaaaaaaaaaagaaaaaagaaaaaaaaaauccaaaagag

SEQ ID NO: 416502 - RNA, 64 nt, Human
cuuagaugcagcgacuguuucaggggugacucagaagaaaaagaagcugaggaagcuguugggg

SEQ ID NO: 416503 - RNA, 64 nt, Human
agcuuccugggccccucacccccagcuggaaauuaagaaaaagucgcccgaaacaccaagugag

SEQ ID NO: 416504 - RNA, 64 nt, Human
uucuauaaaacuacccauaagccuuuaaccuuuaaagaaaaaugaaaaagguuaguguuugggg

SEQ ID NO: 416505 - RNA, 64 nt, Human
ccaucaucuaaacuacuauucuugcguuaucauaaagaaaaagagguaaguaauacacugauaa

SEQ ID NO: 416506 - RNA, 63 nt, Human
ccaccaaguaaagcauccugggcuagccuaccggaggaucagagaccauguggaacauaaaug

SEQ ID NO: 416507 - RNA, 63 nt, Human
cuguggucccaggugcucaggaagcugaggugggaggaucacuugagcccaauucaaagcugc

SEQ ID NO: 416508 - RNA, 63 nt, Human
ugcuuuuguuaaagccccuauaugggcagcauggaggaucauaagauagcaaaaccauuucaa

SEQ ID NO: 416509 - RNA, 64 nt, Human
aaaaugcaacugaaaaauaccuuccaaauuugccaagaaaaaaaauucuauuuuaaacuuguau

SEQ ID NO: 416510 - RNA, 64 nt, Human
aaccgguuaaucaagaauuuggucaaggaggaacaagaaaaaucggagaagguguccaagaggg

SEQ ID NO: 416511 - RNA, 64 nt, Human; identical to SEQ ID NO: 416505

SEQ ID NO: 416512 - RNA, 64 nt, Human
ugcagguguugcacauaaaacacucccucuuuauaagaaaaaucauaaaugcauauaaaauaga

SEQ ID NO: 416513 - RNA, 64 nt, Human
uaaauaccuaaaagcaaaacuaaacaaagaaaguaagaaaaagaaauaaaaccaguccuccuca

SEQ ID NO: 416514 - RNA, 64 nt, Human
agcaagggaaauaaugcaguuuccugucuuauuuaagaaaaagagaaggcucucuuuucucccu

SEQ ID NO: 416515 - RNA, 64 nt, Human
cauuuucucuuuacacuucguauguauuuuaaagaagaaaaaaaacaaaaaaaauucccuggcu

SEQ ID NO: 416516 - RNA, 64 nt, Human
ucaccaggccucacugggcccacagcugggcaacaagaaaaauguuugaauuggaccaacugcu

SEQ ID NO: 416517 - RNA, 64 nt, Human
uuaucaaauauauauccagacgguucuucccuagaagaaaaacaagucuuuacaccugauaaaa

SEQ ID NO: 416518 - RNA, 64 nt, Human
agggucucgcauucaagggcaauuacauuuuaaaaagaaaaacagaaaaagguuaaucacaaaa

SEQ ID NO: 416519 - RNA, 64 nt, Human
ugagacaagaaaauaagagcucaggaugagggaaaagaaaaagauugagagaauuugugccccc

SEQ ID NO: 416520 - RNA, 64 nt, Human
aaguauucaggcgccaugucuuauauacugaagaaagaaaaagugaggcccaccuugcucuuac

SEQ ID NO: 416521 - RNA, 64 nt, Human
ggcccaagaaaaugucuucagaucuuaaaauaagaagaaaaaaaugaauauuauccaacauggg

SEQ ID NO: 416522 - RNA, 64 nt, Human
aauccuggguccugagcugcuguuuccaaucaugaagaaaaacagugaauccagugaacaggga

SEQ ID NO: 416523 - RNA, 64 nt, Human
acaacaggagugaaacuccgucucaaaaaaaaaaaagaaaaaaaagaaguacaagaguauaaua

SEQ ID NO: 416524 - RNA, 63 nt, Human
gacaauuucucauuccucucagugacuauccuagaggaucaguguauuugagaaauauuuaga

SEQ ID NO: 416525 - RNA, 63 nt, Human
uugcccucaaugcacgaaagguggcccaggagagaggaucaaugccauaggaggcagaagucu

SEQ ID NO: 416526 - RNA, 63 nt, Human
ugaaggcagcacucagggccaggggagagagaagaggaucagcagugcagccccaggaugccu

SEQ ID NO: 416527 - RNA, 64 nt, Human
gguauauuuauguaagaaaaugacuguaaaucucaagaaaaaucucagcagcuaauagcaacuc

SEQ ID NO: 416528 - RNA, 64 nt, Human
cacucguuaaauagguuuucuuuaaacuuaauuaaagaaaaacuauuuaaagguaaaggauauu

SEQ ID NO: 416529 - RNA, 64 nt, Human
uucccuuuuccuaaauuaagaggaaaaguggucaaagaaaaacucuucauuucucccugauucu

SEQ ID NO: 416530 - RNA, 64 nt, Human
cuucuguccuguucacagguucuccuucuucaucaagaaaaaguggaaccagcugucccuccag

SEQ ID NO: 416531 - RNA, 64 nt, Human
uaugugccuuccaaccagagggagacccaguagaaagaaaaacauccugggaaauccagcuacc

SEQ ID NO: 416532 - RNA, 64 nt, Human
acuuauuuuguauugaaacuuuuaaacaauacugaagaaaaaaaaacuuuuccgacaucuguuc

SEQ ID NO: 416533 - RNA, 64 nt, Human
acacaugugccccugaaccuaaaaaaaaaguuaaaagaaaaacguuuggauuauuuucccucuu

SEQ ID NO: 416534 - RNA, 64 nt, Human
cacacauuauuucucacuggucaugauuuacaagaagaaaaauaaaacugcuuuuggaaccaca

SEQ ID NO: 416535 - RNA, 64 nt, Human
uaucgugguuuaaaauuacuaacaaguugugggaaagaaaaauaauauuugauuuugaaucuua

SEQ ID NO: 416536 - RNA, 64 nt, Human
ggguguuugugaguuuggggagcaauuuuuauaaaagaaaaacuuuauucuccucuuuugaaaa

SEQ ID NO: 416537 - RNA, 64 nt, Human
uuuucuuacgaauauaccaacauccugaaaguuaaagaaaaaaaucuaauguaugaaugugacu

SEQ ID NO: 416538 - RNA, 64 nt, Human
gaccuaaaaauaauucucuuguauuuuggagaugaagaaaaaagucauucaccugggagggauu

SEQ ID NO: 416539 - RNA, 64 nt, Human
gggcuggaaaugcaaagacacauuuuucuauaaaaagaaaaagcaacuaagguuaaaagcuaua

SEQ ID NO: 416540 - RNA, 64 nt, Human
gacuuuuaaucuuguaaagugguugugcuuuuagaagaaaaauauuuuacccagaguugcacau

SEQ ID NO: 416541 - RNA, 64 nt, Human
acauacacauaguuauuuuaguaauauuuccugaaagaaaaaccaaauucugcuauaagucuug

SEQ ID NO: 416542 - RNA, 63 nt, Human
ggcaaauucacaaauacggaauccaugaauaacgaggaucaacuguacuuaacuauauuuuaa

SEQ ID NO: 416543 - RNA, 63 nt, Human
aauggcagcaucugagcuguuggcauauuggaugaggaucaguauggcuugcugcuuuuauuu

SEQ ID NO: 416544 - RNA, 63 nt, Human
cuguagucccagcuacaugggaggcugaggugggaggaucacuugagcccaggaaguccagaa

SEQ ID NO: 416545 - RNA, 64 nt, Human
uagacaugggagacuuuucauuuuguucuguacuaagaaaaauucuucugccuugggauccugu

SEQ ID NO: 416546 - RNA, 64 nt, Human
cagccugggugacagagcgagacuccguaucagaaagaaaaagaggaacugaaugaaaucucag

SEQ ID NO: 416547 - RNA, 64 nt, Human
agccugggcaacauagugagaccccaucucuacaaagaaaaaaaaauuagcuggacaugguaau

SEQ ID NO: 416548 - RNA, 64 nt, Human
cccaacuugggaguggggaaauugcuuaaaaaaaaagaaaaagaaaaaaaaaaagauuauucua

SEQ ID NO: 416549 - RNA, 64 nt, Human
uugggaguggggaaauugcuuaaaaaaaaagaaaaagaaaaaaaaaaagauuauucuaaauaaa

SEQ ID NO: 416550 - RNA, 64 nt, Human
auugugcaugcaaaccaggagcauuuugugucuuaagaaaaauaaucuuagaacagauggcugu

SEQ ID NO: 416551 - RNA, 64 nt, Human
auauaacuauggaauuuugaaaaaaaauuucaaaaagaaaaaaauauauauaauuuaaaacuac

SEQ ID NO: 416552 - RNA, 64 nt, Human
ccuggcccaguggauuucauggugaucauuaaaaaagaaaaaucgcaaccaaucugccuuggcu

SEQ ID NO: 416553 - RNA, 64 nt, Human
gaguucgugguuguacagaaaugaaccuuuauuuaagaaaaauagaaaaaaaaaaaaacauaaa

SEQ ID NO: 416554 - RNA, 64 nt, Human
acuuuggaaaccaagcaaggggagaagacaaaugaagaaaaacuagacagagagaaaaauacaa

SEQ ID NO: 416555 - RNA, 64 nt, Human
uccagccuggucaacagagcaagacuccaucucgaagaaaaaaaaaaaaaauuccccaccccua

SEQ ID NO: 416556 - RNA, 64 nt, Human
guguuaaauuauaaaaaugauuuuuaaauauucaaagaaaaauaucacaaauccuacuacucag

SEQ ID NO: 416557 - RNA, 64 nt, Human
ucaaaacaaccauccugcucauaacaucuuugaaaagaaaaauauauaugugcaguauuuuauu

SEQ ID NO: 416558 - RNA, 64 nt, Human
ccuggcacccaccuucccugcugccaggaugcccaagaaaaaggucagcuccaccgaaggggcu

SEQ ID NO: 416559 - RNA, 64 nt, Human
aaaacuuggaaagauggaggagaaaaagaaaaggaagaaaaaaaugucacccauagucucacca

SEQ ID NO: 416560 - RNA, 63 nt, Human
auggcuugagccuauaauccgaggcugaggugggaggaucacuugagcccaggaguuugaggu

SEQ ID NO: 416561 - RNA, 63 nt, Human
cuguaauuccagugcuuugggaggccaagaugggaggaucauuugagcccaggaguuugagac

SEQ ID NO: 416562 - RNA, 63 nt, Human
ugcaccaaugcacugagugaaggaagagagacagaggaucaagggcuuuagacagcacuccuu

SEQ ID NO: 416563 - RNA, 64 nt, Human
uacauccaacauuaaaagccacccccaaaugcccaagaaaaaaagaaagacuuaucaacauuug

SEQ ID NO: 416564 - RNA, 64 nt, Human
gaaacuguguguauguauacauacauuuuccaaaaagaaaaauuaaaugauuauagagauuaug

SEQ ID NO: 416565 - RNA, 64 nt, Human
gccccaccaagaggguggaucacaccucagugggaagaaaaauaaaauuuccuucagguuuuaa

SEQ ID NO: 416566 - RNA, 64 nt, Human
cugauagucuugaauauuuuauuuuuuuaaugaaaagaaaaaacaagaaaguuauguuucauaa

SEQ ID NO: 416567 - RNA, 64 nt, Human
caugcuuugauaucugguucagacuaucaucaggaagaaaaaaaaaucccacaguaccugaaau

SEQ ID NO: 416568 - RNA, 64 nt, Human
guuuggaacaaauacucacuuaaaacuucagcagaagaaaaauuacuuaguccuuaggccaacc

SEQ ID NO: 416569 - RNA, 64 nt, Human
augaaauaggaacuguaauuauccccaauucuaaaagaaaaaacuuaguuuuagagaguuagua

SEQ ID NO: 416570 - RNA, 64 nt, Human
uacuuagaaguauugaaggaaaaaaugaagaccuaagaaaaaaauauuucaugaucauuucccu

SEQ ID NO: 416571 - RNA, 64 nt, Human
ccuuccuuauauuuuuuuccucaacaguuuuaaaaagaaaaaaaggucuauuuuuuuuucuccu

SEQ ID NO: 416572 - RNA, 64 nt, Human
guguguggcugcucugagugaggaaaaaauuaaaaagaaaaacugguuccauguacugugaacu

SEQ ID NO: 416573 - RNA, 64 nt, Human
uccagcugggagacacagcaagacuccgucucaaaagaaaaaaaaaaaaaagaacaacugccaa

SEQ ID NO: 416574 - RNA, 64 nt, Human
aucuuaggcuggccagacuucagcuguuccuuugaagaaaaagacacagacaaagugacauucc

SEQ ID NO: 416575 - RNA, 64 nt, Human
acacggugaaaccccaccucuacuaaaauuaaaaaagaaaaaaaauagccgggcgugguggcag

SEQ ID NO: 416576 - RNA, 64 nt, Human
agcucuuugcuuuaccauacagggaccugucccaaagaaaaaggcucuuuuuuuagccagcaua

SEQ ID NO: 416577 - RNA, 64 nt, Human
uuaacccucuuuuguauaaaacaugugcuuucuaaagaaaaauuguuucuuauuuuuugagacu

SEQ ID NO: 416578 - RNA, 63 nt, Human
ccuauagucccacuacuuguggggcuaaggcaggaggaucacuugagccccggaggucgaggc

SEQ ID NO: 416579 - RNA, 63 nt, Human
cuguaauccuugcauuuuggaaggcugaggcaggaggaucacuuuaggccugguguguucaag

SEQ ID NO: 416580 - RNA, 63 nt, Human
cuguaguaccagcuacucuggaggcugaggcaggaggaucacuugagcccaggagauuaagac

SEQ ID NO: 416581 - RNA, 64 nt, Human
caauuauauucuuggccaauuuuguccaacggacaagaaaaaagcaaagucaacgacaccauua

SEQ ID NO: 416582 - RNA, 64 nt, Human
gcagaagcgagaaaacuuuguuuauugaaaaaaaaagaaaaagaaagcaagaaaaaaagauacu

SEQ ID NO: 416583 - RNA, 64 nt, Human
acuuuguuuauugaaaaaaaaagaaaaagaaagcaagaaaaaaagauacuauggggucaagugu

SEQ ID NO: 416584 - RNA, 64 nt, Human
acaaggaaggacagaggguuuugauuuuaaaaagaagaaaaaaaaaccuuauuuuuucuuucuu

SEQ ID NO: 416585 - RNA, 64 nt, Human
cauauuuaaagccaaauguaaauagaggucuguaaagaaaaauaauugccauagaaaguauaau

SEQ ID NO: 416586 - RNA, 64 nt, Human
uuggacuuuguaauuauuuuuuuagcaguaauuaaagaaaaaaguccucugugaggaauauucu

SEQ ID NO: 416587 - RNA, 64 nt, Human
aguauuuuuguacagauuugcuuucucuuacaaaaagaaaaaaaaaauccuguuguauuaacau

SEQ ID NO: 416588 - RNA, 64 nt, Human
acuaccagacuguuuuuugucuucucacaaagacaagaaaaaucagggcauuuugugagugccu

SEQ ID NO: 416589 - RNA, 64 nt, Human
ucuaaggcucgccgugagccaggucuaaaguuugaagaaaaagaaaaaucuuaaaaaaaaaaaa

SEQ ID NO: 416590 - RNA, 64 nt, Human
gcucgccgugagccaggucuaaaguuugaagaaaaagaaaaaucuuaaaaaaaaaaaaaaaaaa

SEQ ID NO: 416591 - RNA, 64 nt, Human
aaagaaaaaucuuaaaaaaaaaaaaaaaaaaaaaaagaaaaaaagaaaaacaggaaaaaggacu

SEQ ID NO: 416592 - RNA, 64 nt, Human
aucuuaaaaaaaaaaaaaaaaaaaaaaagaaaaaaagaaaaacaggaaaaaggacuuuuuuuuu

SEQ ID NO: 416593 - RNA, 64 nt, Human
gcaaaaggaagcuuguagagguuuuuugggugagaagaaaaauguagcuaagguaaugguucau

SEQ ID NO: 416594 - RNA, 64 nt, Human
acauuaaaagucauguaaaagaacaucugacugaaagaaaaaugcuccuugaauauuaaaaggu

SEQ ID NO: 416595 - RNA, 64 nt, Human
uccagccugggugacagagccagacuccaucucaaagaaaaaaaaaaaauauuaagagguucug

SEQ ID NO: 416596 - RNA, 63 nt, Human
cugucaaggucaggcaagugagcaccggggacugaggaucagggcgggaccccgugaggcuca

SEQ ID NO: 416597 - RNA, 63 nt, Human
cuguaaucccagcaccuugggaggcugaggugggaggaucauuugaggccaggaguuugagac

SEQ ID NO: 416598 - RNA, 63 nt, Human
cuguaaucccagcgcucugggaggcugaggcaggaggaucacuugaggucaggaguucaaugu

SEQ ID NO: 416599 - RNA, 64 nt, Human
ccccagucugacauauuucauacagaauguuuaaaagaaaaacucugcuagucuuggcaaacau

SEQ ID NO: 416600 - RNA, 64 nt, Human
ucuaugugaauauaagcuugugcacaauguuuaaaagaaaaacaaugaauuagaagagaucccc

SEQ ID NO: 416601 - RNA, 64 nt, Human
auggagaauuuaaaagaaaaguugcccgcuguguaagaaaaagccaagagacugcuuuugagug

SEQ ID NO: 416602 - RNA, 64 nt, Human
caguaggggauuagaauguuuaguccuacuuaguaagaaaaauauuguauuuuuaaucauucau

SEQ ID NO: 416603 - RNA, 64 nt, Human
uuuacuuaaauuuaagaauuaaaaaaauacaaaaaagaaaaaaugaaaauaaaggaauaagaag

SEQ ID NO: 416604 - RNA, 64 nt, Human
cauuauagauauuugcgccugcucuguuuacuugaagaaaaaagcacccguggagaauaaagag

SEQ ID NO: 416605 - RNA, 64 nt, Human
ugcacaagaucuguuugugaaagccugauuuaaaaagaaaaaaaaaauuccuuaagccaaaugg

SEQ ID NO: 416606 - RNA, 64 nt, Human
acuuuggcugggauggauaaccauauaauuuaaaaagaaaaaaaaaaucaaaauauaauauauu

SEQ ID NO: 416607 - RNA, 64 nt, Human
agggaagggaggaagggaaaacagaaagcagacaaagaaaaaagagcuagcccaaaaucccaaa

SEQ ID NO: 416608 - RNA, 64 nt, Human
aauguuucugggaggaguugccacugccugggugaagaaaaagcacugcuaggguuagcaaccu

SEQ ID NO: 416609 - RNA, 64 nt, Human
uaugugccuuccacccagagggagacccaguagaaagaaaaacauccugggaaauccagcuacc

SEQ ID NO: 416610 - RNA, 64 nt, Human
uaucuuuuaauuucucagcaaaaucuaaaaggggaagaaaaaaguccaugaaaacuaaaacuuu

SEQ ID NO: 416611 - RNA, 52 nt, Human
cuaacaaacagauagguuagugaagaaaaaugcaaaguagcaaugagaaggc

SEQ ID NO: 416612 - RNA, 64 nt, Human
cauguucuucaucuucucaaaucaucagaggccgaagaaaaacacuuuggcugugucuauaacu

SEQ ID NO: 416613 - RNA, 64 nt, Human
uuuucccuugaggaaacaacagcuuuaaaagaaaaagaaaaaaaaagucuuugguaaauggcaa

SEQ ID NO: 416614 - RNA, 63 nt, Human
cuguagucccugcuacuugggaggcucaggugggaggaucacuugagccccaaagaugguggc

SEQ ID NO: 416615 - RNA, 63 nt, Human
cuguaaucccagcacuuugggaggcugagaugggaggaucacuugaagccaggaguuuaaaac

SEQ ID NO: 416616 - RNA, 63 nt, Human
cauucucucacugauugcuacauacacuucucugaggaucaccugcugucaaauugccaucua

SEQ ID NO: 416617 - RNA, 64 nt, Human
auaaaguuuucccuugaggaaacaacagcuuuaaaagaaaaagaaaaaaaaagucuuugguaaa

SEQ ID NO: 416618 - RNA, 64 nt, Human
gacuagauaauucaaacugauuagcccauuccagaagaaaaacagcugggaauuaaguuaaucc

SEQ ID NO: 416619 - RNA, 64 nt, Human
uaaggaacuuccagaucaacaaaagugucuuucaaagaaaaaaaaaucaagaaggacacaagcg

SEQ ID NO: 416620 - RNA, 64 nt, Human
cauuauguaucuguccagaaaaaugugcaugucuaagaaaaaugucuaaccuguugucuuucug

SEQ ID NO: 416621 - RNA, 64 nt, Human
cuuuucacuuuaccagaaaguguucuuuaauggaaagaaaaacaacuuucuguucucauuuacu

SEQ ID NO: 416622 - RNA, 64 nt, Human
ccuaaacaucuaucugguguuuuuaaaaaguuaaaagaaaaauagauuuuuuuucacaagguga

SEQ ID NO: 416623 - RNA, 64 nt, Human
acugcaguaaacugaagacaagaucucuucccccaagaaaaaguguacagacagcuggcagugg

SEQ ID NO: 416624 - RNA, 64 nt, Human
uaauauuaaacaguacauguuuacaauaccaaaaaagaaaaaauccacaaaagccacuuuauuu

SEQ ID NO: 416625 - RNA, 64 nt, Human
uuuucccaucaagucauuuguuaaaacuaaauguaagaaaaaucugcuagaggaaaacuuugag

SEQ ID NO: 416626 - RNA, 64 nt, Human
cuuaaagaauuugucaauccuagccuuccaagagaagaaaaagaagagaaacuagaaacaguua

SEQ ID NO: 416627 - RNA, 64 nt, Human
gcaaauugauaguuguucuagcagugaagagauaaagaaaaaaaaguacaaccaaaugccaguc

SEQ ID NO: 416628 - RNA, 64 nt, Human
aggcuuuggggccccuuaguugucccgaaaccccaagaaaaaucagaaugaggagagucaagga

SEQ ID NO: 416629 - RNA, 64 nt, Human
cguguggcuagaauugguugguuggucacuugacaagaaaaaccauacuuaccugggccaaggc

SEQ ID NO: 416630 - RNA, 64 nt, Human
aaaaaagaaaaagaaaaagcaagaagaaggaagaaagaaaaagacagaaagagaaauaggagga

SEQ ID NO: 416631 - RNA, 64 nt, Human
caaaucucuugcuuucuuucuuaaaaaaaagaaaaagaaaaagcaagaagaaggaagaaagaaa

SEQ ID NO: 416632 - RNA, 63 nt, Human
gugcagucccagcuacucaggaggcugaggcaggaggaucacagugaccuauaaugagccguu

SEQ ID NO: 416633 - RNA, 63 nt, Human; identical to SEQ ID NO: 170040

SEQ ID NO: 416634 - RNA, 63 nt, Human
gggaccgagcccuguuacauggaugugaacagugaggaucagagguuuuaucagaacacauuc

SEQ ID NO: 416635 - RNA, 64 nt, Human
aagauucaaaucucuugcuuucuuucuuaaaaaaaagaaaaagaaaaagcaagaagaaggaaga

SEQ ID NO: 416636 - RNA, 64 nt, Human
cucagcgcgucucagcucagugccgaggaggaggaagaaaaacaggccgagugaaggugcugga

SEQ ID NO: 416637 - RNA, 64 nt, Human
ccuagagcucuaauuguuuguuuuggaagaaaaaaagaaaaagaacaaaaaauauauaucacuc

SEQ ID NO: 416638 - RNA, 64 nt, Human
gcgaggggccuagagcucuaauuguuuguuuuggaagaaaaaaagaaaaagaacaaaaaauaua

SEQ ID NO: 416639 - RNA, 64 nt, Human
uucgagcacuuuucuaacuaaugagcucugugguaagaaaaaaugaacucuuucaauugagauu

SEQ ID NO: 416640 - RNA, 64 nt, Human
uaaaauuugccacacacccagccugaaguucuaaaagaaaaagcuaaaaaauaugguuaaaaac

SEQ ID NO: 416641 - RNA, 64 nt, Human
uuaaaaguuuaaagauuuuugcuauauauuauggaagaaaaauguaaucguaaauauuaauuuu

SEQ ID NO: 416642 - RNA, 64 nt, Human
ugaaaguuaauccuuuuuaaaaacuuuauuuaaaaagaaaaauuagcagccaggugcaguggcu

SEQ ID NO: 416643 - RNA, 64 nt, Human
aucaagagaaaaccaaucagcuucaucaaaacagaagaaaaaggcuaagucccagcaauacaaa

SEQ ID NO: 416644 - RNA, 64 nt, Human
gauuaugauucuucuguuuacucaacaauuuacaaagaaaaaaaggacagacauugaagagcua

SEQ ID NO: 416645 - RNA, 64 nt, Human
gggaguggggugagagcuaaacauugcacagggaaagaaaaaaaauaacugcacugacuuuaua

SEQ ID NO: 416646 - RNA, 64 nt, Human
uucaaugaaaacauucacuugguauuucauuuguaagaaaaaaaaauggugcuuuuauaaagaa

SEQ ID NO: 416647 - RNA, 64 nt, Human
uguuuuuaaaaaauucauuuugcagaaagccugaaagaaaaaaaauaccccuaaauaaaacuau

SEQ ID NO: 416648 - RNA, 64 nt, Human
aggucuacuuuaaaaaaauucaaaugaagagaaaaagaaaaacagcauucuagaaauggcauuu

SEQ ID NO: 416649 - RNA, 64 nt, Human
uccuuauaucaccaugggcagcaucagugauuacaagaaaaaugcuaagucccagcuauggauu

SEQ ID NO: 416650 - RNA, 63 nt, Human
cuguggucccugcuaugcagaugucuaagacaggaggaucacaagagcccaggagguugagaa

SEQ ID NO: 416651 - RNA, 63 nt, Human
aggaaaaugagugcaggggccaggggaacccgugaggaucacucucaaaugagauuaaaaaca

SEQ ID NO: 416652 - RNA, 63 nt, Human
aaaguaguuauauuuuuaaaugcuauuauugcagaggaucaucaaaaaagagguaaucuacgu

SEQ ID NO: 416653 - RNA, 64 nt, Human
ucuccaccaagcauuugguuuauuuagaaaaaggaagaaaaacaaaaaacaaaaaacuaaaggg

SEQ ID NO: 416654 - RNA, 64 nt, Human
ggacuggaggccgccaggcaggcguggccgagggaagaaaaagcuucuggauguccagccagcu

SEQ ID NO: 416655 - RNA, 64 nt, Human
auguuucuuuauugcauaacuggcguguagcacaaagaaaaagccccuucuccaccagauauuu

SEQ ID NO: 416656 - RNA, 64 nt, Human
cauuugcauacaccugggccaucuugguuuuugcaagaaaaaagcgaggaaaucagagaaacuc

SEQ ID NO: 416657 - RNA, 64 nt, Human
guuauauuuucuauuagauguaaauauguuauuuaagaaaaauaucuaaauauauauauuucaa

SEQ ID NO: 416658 - RNA, 64 nt, Human
uuuugauaacacaguauuauuucucuuacuguagaagaaaaaguuuauuaccaaacaagaguau

SEQ ID NO: 416659 - RNA, 64 nt, Human
agaaacuuugcuaguuaaaaaaaaaagaaaaaaaaagaaaaaaaaucccuuucuuguaaacuua

SEQ ID NO: 416660 - RNA, 64 nt, Human
aaaguauaauagaaacuuugcuaguuaaaaaaaaaagaaaaaaaaagaaaaaaaaucccuuucu

SEQ ID NO: 416661 - RNA, 64 nt, Human
aaaguuauuaaauuaauuauauguuuaaaaguuaaagaaaaaagagcugcagaguauuuauaaa

SEQ ID NO: 416662 - RNA, 64 nt, Human
aggagaaaggaauuccuuuucccgcccgaacaugaagaaaaaugaccugacccuguagagagaa

SEQ ID NO: 416663 - RNA, 64 nt, Human
cuggaugccgagguaaaaguucuuuuugcucuaaaagaaaaaggaacuaggucaaaaaucuguc

SEQ ID NO: 416664 - RNA, 64 nt, Human
uggaguauaugccugaaaagguuuuggauucagaaagaaaaaggaugguuaguuuaaucaguga

SEQ ID NO: 416665 - RNA, 64 nt, Human
aauuaaagauguuugaauccaaaggaagucaaggaagaaaaagcauggaaaggaagagaacuga

SEQ ID NO: 416666 - RNA, 64 nt, Human
gugguauguucccuuaaaaaaaaaugacacuuggaagaaaaauguaugaaauucagaaauuccg

SEQ ID NO: 416667 - RNA, 64 nt, Human
cugggauuacaggugugagcugccgcacccagccaagaaaaauaauacucuuaaauacuuagau

SEQ ID NO: 416668 - RNA, 63 nt, Human
gcauagucccagcuacccaggaggcugaggugggaggaucacuugagcccaggaauuugaagc

SEQ ID NO: 416669 - RNA, 63 nt, Human
cuguaauaacaacaccuucagaggcugaggugagaggaucaguugaggccaggaguuuaagac

SEQ ID NO: 416670 - RNA, 63 nt, Human
cuguaaccucagcacuuugggaggcagaggugggaggaucacuuagguccaggaguucgagac

SEQ ID NO: 416671 - RNA, 64 nt, Human
ccacaaaauguaauauucuuuuguauaacuacuaaagaaaaauccuuguagaucuuugugccuu

SEQ ID NO: 416672 - RNA, 64 nt, Human
ugguauuaggaaauuacuuucacaguaaauaucaaagaaaaaagauuaagggucucuuugccau

SEQ ID NO: 416673 - RNA, 64 nt, Human
acauuuuaacuuaaugguacuuaaaauaauuuaaaagaaaaauguuaacuuagacauucuuaug

SEQ ID NO: 416674 - RNA, 64 nt, Human
acaacuacaucccauuuuauauuuccaauuguuaaagaaaaauauuucaagaacaaaucuucuc

SEQ ID NO: 416675 - RNA, 64 nt, Human
gccagccuggcaacagaacaagacucugucuaaaaagaaaaaaaaauuuuuuuguuuaagacag

SEQ ID NO: 416676 - RNA, 64 nt, Human
aacugaaauagaaaaggaaaaggaagaagcagagaagaaaaaaucaaagaaaucugucuaauuc

SEQ ID NO: 416677 - RNA, 64 nt, Human
augauugguauuauggaaggcuuauugggggaacaagaaaaauauaaaaagugaucucugccca

SEQ ID NO: 416678 - RNA, 64 nt, Human
gcccuaaagaccuccuuugggaauucuggggaaaaagaaaaaguaaucuucuacuugcuucaag

SEQ ID NO: 416679 - RNA, 64 nt, Human
uucugcuagaaaaugcugacucacuuuuauauacaagaaaaaccuuuccacugaaaaaucccuc

SEQ ID NO: 416680 - RNA, 64 nt, Human
auuucuguggauggcagccggagcauguuagcuuaagaaaaauguuguguguggugcucuaguc

SEQ ID NO: 416681 - RNA, 64 nt, Human
uuaugagagaaaaggaaaaaggaaucaaagguggaagaaaaaaaaagccaaauucuguuuacgg

SEQ ID NO: 416682 - RNA, 64 nt, Human
acgccuaaugaacaagcacaguuuuucaauggugaagaaaaaagcaccagacuuuuuuucuuuu

SEQ ID NO: 416683 - RNA, 64 nt, Human
uaaauaggaaguguuuggguuuuguuuuuucuuuaagaaaaagaaauguacaccacuccucaug

SEQ ID NO: 416684 - RNA, 64 nt, Human
aguuccauuuugaggaauggggaaggcuauucuaaagaaaaaaaugggauuuguuuucucggca

SEQ ID NO: 416685 - RNA, 64 nt, Human
aacauggggauuuuguauaaccagggauaauaaaaagaaaaaagaaguuaauuuuuaauugaug

SEQ ID NO: 416686 - RNA, 63 nt, Human
cuauagucccugcuauuugagaggcugaggugggaggaucauuugagugcaggaguucaagga

SEQ ID NO: 416687 - RNA, 63 nt, Human
ugaacccuucuuacaucauucaaguucugcucugaggaucaagcuugggucugauuuaacuca

SEQ ID NO: 416688 - RNA, 63 nt, Human
agaggauuuagaaguuccaauugcccugcuaaggaggaucaagacccguaauccggcauaaca

SEQ ID NO: 416689 - RNA, 64 nt, Human
gaaaaauguucuauauucucauuuuucuaaaagaaagaaaaaaggaaacccgauuuauuucucc

SEQ ID NO: 416690 - RNA, 64 nt, Human
gccuaacagauugcuagacaagagaaaaaacuugaagaaaaaagaagcuuaauuucaugcuuca

SEQ ID NO: 416691 - RNA, 64 nt, Human
ucauagccuuggaaccuuaauucgaaauguacugaagaaaaaguaacagcaaaaaauaaaauaa

SEQ ID NO: 416692 - RNA, 64 nt, Human
cauuucugugccuuucacuugaaaaaaaaaaaagaagaaaaaaaggcuuaaaggcauuucauuc

SEQ ID NO: 416693 - RNA, 64 nt, Human
uuuccaaacugcuuuguguauuguauauuuuuuuaagaaaaagaaaagccuuauuugacuuaug

SEQ ID NO: 416694 - RNA, 64 nt, Human
caggugaaucuagagccuacuuuuauuuugguuaaagaaaaagaaaauaucaauaauucaauuu

SEQ ID NO: 416695 - RNA, 64 nt, Human
uucauuuuaaauuguucuguauuuuuaaauugccaagaaaaacaacuuuguaaauuuggagaua

SEQ ID NO: 416696 - RNA, 64 nt, Human
cuuugacaagcuugccaauuuacugauuuugucaaagaaaaauauguuauuuuugaaguuuguu

SEQ ID NO: 416697 - RNA, 64 nt, Human
gucuaaaaacaucugcauaguuuucaacuggaaaaagaaaaaacuuaaaaaugggauguccuaa

SEQ ID NO: 416698 - RNA, 64 nt, Human
gcuggggccuccuuccauugcaucauuuuaaaggaagaaaaaagcagcuaaaaaagaguggacc

SEQ ID NO: 416699 - RNA, 64 nt, Human
caaacuaaaauuuauuuuuauaaaugaauuuuaaaagaaaaaauaucuacuucuuuuaaaguua

SEQ ID NO: 416700 - RNA, 64 nt, Human
aauccucccaauguuaccccuuccaucuuccaagaagaaaaaaaaugccugaauauucagaaua

SEQ ID NO: 416701 - RNA, 64 nt, Human
uauauauauaugucaaaagguaggaaaugcaaaaaagaaaaaaaaaaaaggugacagccgcagu

SEQ ID NO: 416702 - RNA, 64 nt, Human
aauaauagaagaaauagaaauuuugaauguauaaaagaaaaagaucaaguugucauuuuagaac

SEQ ID NO: 416703 - RNA, 64 nt, Human
ccauauuguuuaugcauauugcaugaguauuaccaagaaaaaucuuaaaaguugugaugugaca

SEQ ID NO: 416704 - RNA, 63 nt, Human
cuguagucccagcuacuugggaagcugaagugggaggaucaccugagcucuggagguggaggc

SEQ ID NO: 416705 - RNA, 63 nt, Human
caacuguuacuugauucugcuuuuaguucuuaagaggaucaggcuuuuaaauacucauuuaca

SEQ ID NO: 416706 - RNA, 63 nt, Human
uucuaaucccagcacuuugguaggcaaaggugggaggaucauuugagcucaggaguuccagac

SEQ ID NO: 416707 - RNA, 64 nt, Human
gguggucccuaugacuuauacauaacuuuguaaaaagaaaaaaaaauuuuuucugaugcuuuga

SEQ ID NO: 416708 - RNA, 64 nt, Human
gugcuucuguaagauggaugaucaucuuaauauaaagaaaaaagggagaugaacaaaauuguca

SEQ ID NO: 416709 - RNA, 64 nt, Human
ucuguguaccucugucccuagguguaggaaauggaagaaaaagauucagccaaguggggaggug

SEQ ID NO: 416710 - RNA, 64 nt, Human
aucauuauuuauguauugugcaauguguauaaacaagaaaaauaaagaaaagaugcacuuugcu

SEQ ID NO: 416711 - RNA, 64 nt, Human
aaaggacuccugaaaaaaaaccugagauuuauuaaagaaaaaaauguauuuuauguuauauaua

SEQ ID NO: 416712 - RNA, 64 nt, Human
uugaacaaaaauguuuccacuggcuuuugccuguaagaaaaaaaauguacccgagcacauagag

SEQ ID NO: 416713 - RNA, 64 nt, Human
ccaauuaucaaaaaacagaaaaacaaaaaaaagaaagaaaaaagugcaacuugagggacgacuu

SEQ ID NO: 416714 - RNA, 64 nt, Human
ccugaacaucaagugauauuaagguugucaucuuaagaaaaaauauccauuuuuuucuuaaguu

SEQ ID NO: 416715 - RNA, 64 nt, Human
agaaggugagauaagcccugagucucagcuaccuaagaaaaaccuggaugucacuggccacuga

SEQ ID NO: 416716 - RNA, 64 nt, Human
ccaaagggaaauaucauuuauuuuuuacauuauuaagaaaaaaagauuuauuuauuuaagacag

SEQ ID NO: 416717 - RNA, 64 nt, Human
gugauguaccaugaaacaaagcugcaggcuguuuaagaaaaaauaacacacauauaaacaucac

SEQ ID NO: 416718 - RNA, 64 nt, Human
ggaaaggcugaugaugguauaaaguuugcucauuaagaaaaaaagacaaggcugauuuugaaga

SEQ ID NO: 416719 - RNA, 64 nt, Human
acagagcgagacuccgccucaaaaaaaaaaaaaaaagaaaaaaagaaauguaccuguuggcagg

SEQ ID NO: 416720 - RNA, 64 nt, Human
uugaaaaggucuucugacacacuuaucuugcacaaagaaaaagaaaauuucuuuuacuguguuu

SEQ ID NO: 416721 - RNA, 64 nt, Human
uugacauguguucugugugugucuguauagccuuaagaaaaagaauggcuucacuuucauucug

SEQ ID NO: 416722 - RNA, 63 nt, Human
cuguaagcucaucaccuugggaggccacuguaggaggaucaauugagccuagaaguucaagac

SEQ ID NO: 416723 - RNA, 63 nt, Human
cuguaaucccaacacuguggaaggccgaggcaggaggaucacuugaguccaggaguuugaaac

SEQ ID NO: 416724 - RNA, 63 nt, Human
aauuucuuguucuuuuggaauaucuuaguaacugaggaucauuuucuaacaaugugguugaca

SEQ ID NO: 416725 - RNA, 64 nt, Human
uccagaaaggagccacagcugacgccaaaaagaaaagaaaaaagauauauauauauauauauau

SEQ ID NO: 416726 - RNA, 64 nt, Human
uguguuccuucagggaaacuggucuugaaaaagcaagaaaaaaaagcaaaaaaaaaaaaaaaaa

SEQ ID NO: 416727 - RNA, 64 nt, Human
uucuaugcccgcaaguuucaggaaguauucacaaaagaaaaauacauuuuuucccccaggggug

SEQ ID NO: 416728 - RNA, 64 nt, Human
guugguuccauuuucuuuuuuucuuuuuuuuuuuaagaaaaaauaaaagguggauuugagcugu

SEQ ID NO: 416729 - RNA, 64 nt, Human
aggagugugcggucaauauuuauaucauccagaaaagaaaaacacgagaaacgccaucgcggga

SEQ ID NO: 416730 - RNA, 64 nt, Human
ggguuuuguuuuguuuucauuuuuccaaaaaaaaaagaaaaaaaaauagaaaaaaaaggaguaa

SEQ ID NO: 416731 - RNA, 64 nt, Human
uuuguuuuacgguauauuguaaacuuuuauguuaaagaaaaaauauacauuuacaaauugugag

SEQ ID NO: 416732 - RNA, 64 nt, Human
gccauagaauuuaggggcuuuuuuaaaaaaauaaaagaaaaaugaaaccaaacccaaguguaga

SEQ ID NO: 416733 - RNA, 64 nt, Human
gacaaaacacauagacgcacacacucaggaggaaaagaaaaaacaaaggcagaagaagaagaag

SEQ ID NO: 416734 - RNA, 64 nt, Human
ucuuucuauaaauacauauuguuuaaaaaaaagcaagaaaaaaaggaaaacaaaggaaaauauc

SEQ ID NO: 416735 - RNA, 64 nt, Human
uauccccaaaguuguuuucuagauuuguggcuuuaagaaaaacaaaacaaaacaaacacauugu

SEQ ID NO: 416736 - RNA, 64 nt, Human
cuuuuuguggguguugcaugcaaaucaaguggacaagaaaaaauaacaaaacaaaaaacaagaa

SEQ ID NO: 416737 - RNA, 64 nt, Human
caaguggacaagaaaaaauaacaaaacaaaaaacaagaaaaaaaaaacacaaaaccccguaaaa

SEQ ID NO: 416738 - RNA, 64 nt, Human
uuuaauuguaacauuuuuagaaaaagaacaaaaaaagaaaaaaaaaagaaagaaacacagcaac

SEQ ID NO: 416739 - RNA, 64 nt, Human
aguacaucugaauuaagcugaauguagacaaauaaagaaaaacaaaacugcgcccgucuuaggc

SEQ ID NO: 416740 - RNA, 63 nt, Human
ggaacccuggacuucacugggagggccaacuuggaggaucagugcuggcugacaagcccuccg

SEQ ID NO: 416741 - RNA, 63 nt, Human
cuguaauuccagcacuuugggaggcagaguugggaggaucaccugaugucagggguuugagac

SEQ ID NO: 416742 - RNA, 63 nt, Human
gcugugaauuaugaaaacaccaaguuugaauaagaggaucauggagaaaaaaugagacccuaa

SEQ ID NO: 416743 - RNA, 64 nt, Human
gaagggaccuugcagggaccucucccuccaaaaaaagaaaaaaagaaaaagaaagaaaaaauaa

SEQ ID NO: 416744 - RNA, 64 nt, Human
cuugcagggaccucucccuccaaaaaaagaaaaaaagaaaaagaaagaaaaaauaaaugaggaa

SEQ ID NO: 416745 - RNA, 64 nt, Human
ccucucccuccaaaaaaagaaaaaaagaaaaagaaagaaaaaauaaaugaggaaacguguugca

SEQ ID NO: 416746 - RNA, 64 nt, Human
cccacccuacccuuauuccaugaaaguuuuauaaaagaaaaaauauauauauauucauguuuau

SEQ ID NO: 416747 - RNA, 64 nt, Human
acacagugaugaccucagccuagggacaccaaaaaagaaaaaaaaaaaaacccaaaccaaaaac

SEQ ID NO: 416748 - RNA, 64 nt, Human
agagaguuuuccuaucuuuguauguuaagagauuaagaaaaaaaaauucuauuuuuguuguaau

SEQ ID NO: 416749 - RNA, 64 nt, Human
aaacuaauaaaaagcaaaaaaaaaaaaaaaagaaaagaaaaaacacugcauuugggcaccaucu

SEQ ID NO: 416750 - RNA, 64 nt, Human
ugaaucccugaaugacugcauggauagaaccacuaagaaaaauaaacuuuuauauuuuuauagc

SEQ ID NO: 416751 - RNA, 64 nt, Human
cuccagccuggucgacagagugagacuccaucucaagaaaaaauaaaaauaaaguuguucucug

SEQ ID NO: 416752 - RNA, 64 nt, Human
aaaaaagcaccguggagaauggcccucuucaggaaagaaaaauaagcaaaugaaugguccaccu

SEQ ID NO: 416753 - RNA, 64 nt, Human
guuugguucuaugugguuggucuguuucccggacaagaaaaauugcaaucaaaugucagcagcu

SEQ ID NO: 416754 - RNA, 64 nt, Human
uuuaagaagcuuuuaaaagguaauaauacucugaaagaaaaaugacguaaccacagcguguacu

SEQ ID NO: 416755 - RNA, 64 nt, Human
cagccugggugacagagugagauuccgucucaacaagaaaaaaaaaaaagaauauauauauaug

SEQ ID NO: 416756 - RNA, 64 nt, Human
guggaucaucagagacauuuaugaacaaugacagaagaaaaauuacccaaauaaauguggaagc

SEQ ID NO: 416757 - RNA, 64 nt, Human
uaccaccauagaucuggagaucuucgccaguaacaagaaaaauuaaguuguaaauauuggaaag

SEQ ID NO: 416758 - RNA, 63 nt, Human
auuucccaccaacgaauguaguacauacugugagaggaucauaaugagguccugaauauuuaa

SEQ ID NO: 416759 - RNA, 63 nt, Human
gcugagguagaaaaacgucuccgagaaggggaggaggaucauguacgcccggaaguaggaccu

SEQ ID NO: 416760 - RNA, 63 nt, Human
gcauguccuaaagcacuggcugaaggaagccaagaggaucacugcugcuccuuuuuucuagag

SEQ ID NO: 416761 - RNA, 64 nt, Human
caaaacagcuuucccucaucauaauguagauaaaaagaaaaaaaggauaugguuaccuguaauc

SEQ ID NO: 416762 - RNA, 64 nt, Human
gaaggaaaaagaaagagaaagagagagagagagaaagaaaaagaaagaaaaguaagaaagaaaa

SEQ ID NO: 416763 - RNA, 64 nt, Human
agagagagagaaagaaaaagaaagaaaaguaagaaagaaaaaagaaaaagaaagaaaaguaaga

SEQ ID NO: 416764 - RNA, 64 nt, Human
gagaaagaaaaagaaagaaaaguaagaaagaaaaaagaaaaagaaagaaaaguaagaaagaaaa

SEQ ID NO: 416765 - RNA, 64 nt, Human
aauaaauaaauaaauagauuaccagaaaaaugaaaagaaaaaaacagacauacaaaauaaaagc

SEQ ID NO: 416766 - RNA, 64 nt, Human
gcaacacagcgagaucucuuggggguaaaacaaaaagaaaaaaaaaaguucauacuucuccaau

SEQ ID NO: 416767 - RNA, 64 nt, Human
uaacgcuuaaugccuucaaaguuuugguuuuuuuaagaaaaaaaaauauauauauauuuggguu

SEQ ID NO: 416768 - RNA, 64 nt, Human
aaaccgggcaauauuguguucaguucaagcugugaagaaaaauauauaucaauguuuuccaaua

SEQ ID NO: 416769 - RNA, 64 nt, Human
gcaacaugccaagaccccgucucuauuuuuaaaaaagaaaaagaaccgacuucugaaucgcagc

SEQ ID NO: 416770 - RNA, 64 nt, Human
gugacacagcaagacuccaucucaaaaaaaaaaaaagaaaaagaaaugaauggguucaaagacc

SEQ ID NO: 416771 - RNA, 64 nt, Human
cuguaguuggugacuggguguucauuuuagcucuaagaaaaaaaaucaguguuucgugaaggug

SEQ ID NO: 416772 - RNA, 64 nt, Human
gggggaccucacgucccagccaggaucccccuggaagaaaaagggcguccccacacucuaggug

SEQ ID NO: 416773 - RNA, 64 nt, Human
caaaucugcauccuuuucaaaaccuaaaaacaaaaagaaaaacaaauaaaacaaaaccaacuca

SEQ ID NO: 416774 - RNA, 64 nt, Human
augaaaaggugaaaguucucaacuuaaaaaagaaaagaaaaaaaucauauacugagguugcuaa

SEQ ID NO: 416775 - RNA, 64 nt, Human
ggaaaacuacaagccacgaaugaaugaauuaggaaagaaaaaaaguaggaaaugaaugaucuug

SEQ ID NO: 416776 - RNA, 63 nt, Human
ugguggcccacgcacuucgggaggucgaggcaggaggaucacuugaguccagaaguuugagau

SEQ ID NO: 416777 - RNA, 63 nt, Human
cuguggucccagcuauucaggaggcugaggugggaggaucauuugagcccagagguagaggcu

SEQ ID NO: 416778 - RNA, 63 nt, Human
aauaaaagcaucugauccuucaaggauaaaguugaggaucacaugguacguggcauuuguugu

SEQ ID NO: 416779 - RNA, 64 nt, Human
cagccugggcgacagagcaagacucugucucaagaagaaaaaaaaaauacauauacacauaaau

SEQ ID NO: 416780 - RNA, 64 nt, Human
aaaacacagcaugagaacuucgugaagcauacagaagaaaaaccuucagccagauugaaugcuu

SEQ ID NO: 416781 - RNA, 64 nt, Human
ccaaccuuuugucuucccugggccacauuggaagaagaaaaauugucuugugccacacauacaa

SEQ ID NO: 416782 - RNA, 64 nt, Human
acaauacacuaacauuaacaauagcugaugagcuaagaaaaaaaaaaagucugugcauaguuuu

SEQ ID NO: 416783 - RNA, 64 nt, Human
ccugggcaacauagccagaccuccucucuacaaaaagaaaaaagaaugacaugcuucuuguuuu

SEQ ID NO: 416784 - RNA, 64 nt, Human
ccugggcaacaaagaggccccugucucugauaaaaagaaaaaaaaugaaaaaauaaaaaugaac

SEQ ID NO: 416785 - RNA, 64 nt, Human
gaaagcaagcaacaaaacauacacuuugucagagaagaaaaaaaugccuuaacuauaaaaagcg

SEQ ID NO: 416786 - RNA, 64 nt, Human
ugccaggggcgggcaaaaaaaaaaguaaaaagaaaagaaaaaaaaaaaaaagaaacaaaccacc

SEQ ID NO: 416787 - RNA, 64 nt, Human
acaagagugagacuuagucucaaaaaaaaaaaaaaagaaaaaaaaaucagggauauaguucaua

SEQ ID NO: 416788 - RNA, 64 nt, Human
gacaaaacuuccuguuuguggaacaaaaguucgaaagaaaaaacaaaacaaaaacacccagccc

SEQ ID NO: 416789 - RNA, 64 nt, Human
uguauuuuccaagacguauauuauuuuacuauuaaagaaaaaaaucauuuuuuuuucccgagaa

SEQ ID NO: 416790 - RNA, 64 nt, Human
gggcgacacagcgagacccugucucaagaaagaaaagaaaaagagacaaauuacccagaaaccc

SEQ ID NO: 416791 - RNA, 64 nt, Human
aacgucuguggagcuucugcugcaaggaacaaaaaagaaaaaaaucaaaaaagcgacaaaaaaa

SEQ ID NO: 416792 - RNA, 64 nt, Human
aaacaaaaugaaaaaaaaaggggggugggaggggaagaaaaacucuauuuuuguaaaaagggaa

SEQ ID NO: 416793 - RNA, 64 nt, Human
agagugagacuccaucucaaaaaaaauaaaaaaaaagaaaaagaaauaaacucuaugaauguaa

SEQ ID NO: 416794 - RNA, 63 nt, Human
auuguuuuaaauguugugcaucuguaacuucaggaggaucacuugagcuuuaaaaccugugcc

SEQ ID NO: 416795 - RNA, 63 nt, Human
aaaacuaggauugggacaccuuuuuuucccccugaggaucacugacaaaaaacacugcaccag

SEQ ID NO: 416796 - RNA, 63 nt, Human
auuauuuuauuugcaaacuaggaauugcagucugaggaucauuuagaagggcaaguucaagag

SEQ ID NO: 416797 - RNA, 64 nt, Human
aguguuuucagccugugagauagauguuuauggcaagaaaaaggaaaaaaaaauggaaaucuga

SEQ ID NO: 416798 - RNA, 64 nt, Human
aagaaaaaaaaaagacaaaaaaaaaaaaaaagaaaagaaaaaaaaucucaucacuugaagccac

SEQ ID NO: 416799 - RNA, 64 nt, Human
uccccauugcuguaaauauuucaacgaaauggaaaagaaaaaaaaaagacaaaaaaaaaaaaaa

SEQ ID NO: 416800 - RNA, 64 nt, Human
ccucgcguuauuuauucuacacugccacuucuguaagaaaaacaguuucucaauaaaaaaaaaa

SEQ ID NO: 416801 - RNA, 64 nt, Human
uuuucuuguguugguuuuuuaaagaaaugggaagaagaaaaaaaaauucuccgccccuuuccuc

SEQ ID NO: 416802 - RNA, 64 nt, Human
uuccagccugugcgacagaaugagacacugucucaagaaaaaauaaaagugggaaaaucuucca

SEQ ID NO: 416803 - RNA, 64 nt, Human
gaguuuguguguaugaauuuguaccuguuuuccgaagaaaaaagcaauacugaacaaaacaaau

SEQ ID NO: 416804 - RNA, 64 nt, Human
aaaaaaguuuuguuuuguuuuuuucuggaaaaaaaagaaaaaagauacgacucucagaagccug

SEQ ID NO: 416805 - RNA, 64 nt, Human
uaaugagagauggaggaaacaaucuagaagauaaaagaaaaagaugugcauaacuuguuuucag

SEQ ID NO: 416806 - RNA, 64 nt, Human
gaauguguugagggaaugaauaaguauuuccgucaagaaaaaggaaacaacaaaauaaaaccaa

SEQ ID NO: 416807 - RNA, 64 nt, Human
auauuaacagaaauauuuuuaaaaaauuagagugaagaaaaaugaugaacauauuguaaugaug

SEQ ID NO: 416808 - RNA, 64 nt, Human
auuucuaucaagaaagagaugcuacaaaaaaaaaaagaaaaaaccuuuauguauacagacguaa

SEQ ID NO: 416809 - RNA, 64 nt, Human
ccagccugggcaacaagagcaaaacucuaucucaaagaaaaaaagaaaauuucuacauauuaaa

SEQ ID NO: 416810 - RNA, 64 nt, Human
augauauaucuggaauguccuuuuguucauacaaaagaaaaaugaggaugaauaacaaguuugg

SEQ ID NO: 416811 - RNA, 64 nt, Human
ugccagccaggggcauggacagagccuuuuucuaaagaaaaagacaaaaaguuaaaaaaaaaaa

SEQ ID NO: 416812 - RNA, 63 nt, Human
caucucuagggauugggggauuggcuagccugggaggaucagucuguccaggucagcgaggcc

SEQ ID NO: 416813 - RNA, 63 nt, Human
ccccgagccgcucuccuuggaguagccucucgggaggaucacaccucgacacccaaccccuga

SEQ ID NO: 416814 - RNA, 63 nt, Human
cuguaaucugaacacuuugggaggccgaggcgggaggaucacuugagcccaggaguucaagac

SEQ ID NO: 416815 - RNA, 64 nt, Human
auccuguccccagagggugguuuauccagaaaccaagaaaaaaaaucaaucagaauaaacucaa

SEQ ID NO: 416816 - RNA, 64 nt, Human
cagccugggcaacacagcgagacuccgucucaaaaagaaaaaguuuggaucaggcaggguggcu

SEQ ID NO: 416817 - RNA, 64 nt, Human
augaacaggcugauacuucaugaaauucaagacaaagaaaaaaacccaauuuuauuggacuaaa

SEQ ID NO: 416818 - RNA, 64 nt, Human
acaggcugauaccuucaugaaauucaagacaaagaagaaaaauacucaauguuauuggacuaaa

SEQ ID NO: 416819 - RNA, 64 nt, Human
acaggcugauaccuucaugaaauucuagacaaagaagaaaaaaacuccauguuauuggacuaaa

SEQ ID NO: 416820 - RNA, 64 nt, Human
acaggcugauaccuucaugaaauucaagacaaagaagaaaaaaacucaauguuauuggacuaaa

SEQ ID NO: 416821 - RNA, 64 nt, Human
acuugggcuguuuguaguuuuuugccuuuuagacaagaaaaaaaaaucuuuccacucuuuaguu

SEQ ID NO: 416822 - RNA, 64 nt, Human
gcaacacucugucucaaaaaaaaaaagaaaagaaaagaaaaagccagaaaaaguuggugccccu

SEQ ID NO: 416823 - RNA, 64 nt, Human
acauuuuucguaaaauaugggagaauuuguagaaaagaaaaacucuugaaaguaagaaaugaug

SEQ ID NO: 416824 - RNA, 64 nt, Human
ggcaacaagaacaaaacuccaucuaaagaagaaaaagaaaaacugaagagagaguaguugucag

SEQ ID NO: 416825 - RNA, 64 nt, Human
agccugggcaacaagaacaaaacuccaucuaaagaagaaaaagaaaaacugaagagagaguagu

SEQ ID NO: 416826 - RNA, 64 nt, Human
cauuaggugaggauuauuucucuccaagcuccugaagaaaaaagacucugccuuuuaaaauuaa

SEQ ID NO: 416827 - RNA, 64 nt, Human
agccuggacaacauggcaaaaccccaucuauuaaaagaaaaaauaccugaugcccuuauuugaa

SEQ ID NO: 416828 - RNA, 64 nt, Human
caggaguagaauaugaagugcuaaaucugaauguaagaaaaauaauaguauugaaugggguauu

SEQ ID NO: 416829 - RNA, 64 nt, Human
uuucuugcgcucuauuuuuuuuuuuuuuuuuuuuaagaaaaacaacaacaacaaaaaaagacaa

SEQ ID NO: 416830 - RNA, 64 nt, Human
cuugcuuucaaauaugcuauggagccacaguugaggacaguaguuuccugcaggagccuacccu

SEQ ID NO: 416831 - RNA, 64 nt, Human
auaauuggcuuuaaauuacgagagacuugugauaggacaguaaaaccuagaguuggaguuggau

SEQ ID NO: 416832 - RNA, 64 nt, Human
cucugcauggaccccagggcuguggggacuugggggacaguaaucaaguaauccccuuuuccag

SEQ ID NO: 416833 - RNA, 64 nt, Human
cacaaaauccauuccagguagcucggcaccaacuaagaaaaaaagcacaaaguucucagagcuc

SEQ ID NO: 416834 - RNA, 64 nt, Human
ugcuguucccaucccugaaacauugcauguauuuaagaaaaacaaaauguuaguggcauauuug

SEQ ID NO: 416835 - RNA, 64 nt, Human
cuuccacgguccuguuaauucuagaucagagagcaagaaaaaaguacagaacauauccucuacg

SEQ ID NO: 416836 - RNA, 64 nt, Human
aacugaucaaaagcauaauugaaaguucugaaaaaagaaaaauaauaauauguagaaaaaugua

SEQ ID NO: 416837 - RNA, 64 nt, Human
gauggauuggacguugugacucuugccuuuuaagaagaaaaaaaagauaggacaaaguauuuga

SEQ ID NO: 416838 - RNA, 64 nt, Human
guugcaaaggucuuuuuaaaccaguuuagauuucaagaaaaaauaaauggaaaucaucgaaaau

SEQ ID NO: 416839 - RNA, 64 nt, Human
ugugugguagcugaacucaagaugauguggggcuaagaaaaauaauuguccaugugcaaagaug

SEQ ID NO: 416840 - RNA, 64 nt, Human
aaaaaaaaaaaaaaaaaaaaaaaaaacagaaagaaagaaaaagaaaacugcagauaacccuaua

SEQ ID NO: 416841 - RNA, 64 nt, Human
gaauaagcagcagaacccuguuccauauggaaaaaagaaaaacaauuuuuugucccuaauguuc

SEQ ID NO: 416842 - RNA, 64 nt, Human
ugcuauuccucuaugggagaaaaaaauuaauauaaagaaaaacaaauaaaaauauauuuaaagc

SEQ ID NO: 416843 - RNA, 64 nt, Human
gcagacaaauugaagaacuggugggauuuuuuucaagaaaaaaaauuauauaauaacuauaauc

SEQ ID NO: 416844 - RNA, 64 nt, Human
aagaaaaggagucaagaacaauucacaguaugagaagaaaaauggaaaaaaaaaacuuuauuua

SEQ ID NO: 416845 - RNA, 64 nt, Human
gaagaaaaauggaaaaaaaaaacuuuauuuaaaaaagaaaaaaguccagauuguaguuauacuu

SEQ ID NO: 416846 - RNA, 64 nt, Human
aacgagaagcagguuuauuuuuuccagcacauaaaagaaaaauaauguuucggaguccaggacu

SEQ ID NO: 416847 - RNA, 64 nt, Human
aguggaaucuacuuucauuguuaacacugagcuaaagaaaaaaagccguguguuuuaugaauga

SEQ ID NO: 416848 - RNA, 64 nt, Human
uucagcaccuggucuguucgcugcagggcaugguggacaguaaugcugaguucugucucacacu

SEQ ID NO: 416849 - RNA, 64 nt, Human
ccuaagaguugagcucucggaacugcaugcugcuggacaguaucacugucuuuccuagauggca

SEQ ID NO: 416850 - RNA, 64 nt, Human
agaugccaggacuuauaguacccccucaggacauggacaguaugugggggcaggaagguuaucu

SEQ ID NO: 416851 - RNA, 64 nt, Human
aguccaucuguuuguccaucugcugaaaugagaaaagaaaaauuuaugcacugauuuaaaacaa

SEQ ID NO: 416852 - RNA, 64 nt, Human
aauuuaugcacugauuuaaaacaaaccaaaaaaaaagaaaaaaacaaaaaaaaaaaucccuccu

SEQ ID NO: 416853 - RNA, 64 nt, Human
gcacacccgugguugugaaaauaguauagcaaaaaagaaaaauccccgguuauugauguacuag

SEQ ID NO: 416854 - RNA, 64 nt, Human
aacccaguucuguuugacuauguagcaucuugaaaagaaaaauuauaauaaagccccaaaauua

SEQ ID NO: 416855 - RNA, 64 nt, Human
cacaguccucuccacaaaaauaccugguccaaacaagaaaaacaaaaagacaagcaaaacuaaa

SEQ ID NO: 416856 - RNA, 64 nt, Human
accaaaagaauguaucucgaaagaaugaaggaagaagaaaaaaggauccuugauguuugugaca

SEQ ID NO: 416857 - RNA, 64 nt, Human
auuuuuccccuuugcucuucuuuucccuccuuaaaagaaaaauuaccuucuaguccuaggauga

SEQ ID NO: 416858 - RNA, 64 nt, Human
uuacccagccacuugggaacagcagguaauacugaagaaaaauaaaaauagauuuugaaaacgu

SEQ ID NO: 416859 - RNA, 64 nt, Human
agugcuggaacuugaccauccuggaacacccuggaagaaaaaggagcgcagggugggcccucgg

SEQ ID NO: 416860 - RNA, 64 nt, Human
cuccugaauacacaugaaccccuauaccaauuuuaagaaaaaaaugauucucuuuccucuuugu

SEQ ID NO: 416861 - RNA, 64 nt, Human
gccugggcgacggagugagacucccucucaaaaaaagaaaaaagccccagcauguagcaaaagc

SEQ ID NO: 416862 - RNA, 64 nt, Human
ggccacaggggcagggagaagagaaggcauuaguaagaaaaaaauagaaaaaaauaugaacaga

SEQ ID NO: 416863 - RNA, 64 nt, Human
caagaggauuucuggauauuagucacccaucugcaagaaaaaugcugaggccucgggucaagau

SEQ ID NO: 416864 - RNA, 64 nt, Human
aacagccacauaaccuugcggcaagucugauggaaagaaaaagauaaaccauccgugggguaga

SEQ ID NO: 416865 - RNA, 64 nt, Human
gaaaauaugcuacagaaugaaaguuuguaauugaaagaaaaagaauguauucaucugcuucuug

SEQ ID NO: 416866 - RNA, 64 nt, Human
cggcgccggacccugcgacaaccggggucccccaggacaguaggcccggcucugcccguagccc

SEQ ID NO: 416867 - RNA, 64 nt, Human
gauugggccacccuacccaggaucuccacccuggggacaguagaaggggaaagccuucaucuug

SEQ ID NO: 416868 - RNA, 64 nt, Human
ccagcuuugcagccagaagccagaggauacccagggacaguagggcucccagguggcugguucu

SEQ ID NO: 416869 - RNA, 64 nt, Human
uaauuuaaccaggacuauguagaaguagaaagaaaagaaaaagaaaaucuuuuuuaaaccagaa

SEQ ID NO: 416870 - RNA, 64 nt, Human
gaugucagcaguugcugguaaaaugaagaauuuaaagaaaaaaaugucaaaaguagaacuuugu

SEQ ID NO: 416871 - RNA, 64 nt, Human
agagaaaguaguucuuuaaauaagagauaauuuaaagaaaaauaaauacuagacaucaaauuua

SEQ ID NO: 416872 - RNA, 64 nt, Human
ccuagaauuaucuguuuauguugcaugaaugcauaagaaaaaaauucugucauguucccaaggu

SEQ ID NO: 416873 - RNA, 64 nt, Human
aauaagaauuuuaauaaaaauccuguguuuaaaaaagaaaaaaagaaaaaaucccugcccuccc

SEQ ID NO: 416874 - RNA, 64 nt, Human
auaauguaagggucuguuguaaaugaccaagaaaaagaaaaaaaaagcauucccaaucuugaca

SEQ ID NO: 416875 - RNA, 64 nt, Human
aaaaaaauaauguaagggucuguuguaaaugaccaagaaaaagaaaaaaaaagcauucccaauc

SEQ ID NO: 416876 - RNA, 64 nt, Human
accucccuuccuaaaaucuggggggucggggggaaagaaaaaaaaagccuuaguggccugguug

SEQ ID NO: 416877 - RNA, 64 nt, Human
ccagccugggcgacagugagacccugucucaccaaagaaaaaaaaaaggugagauuaaucuuca

SEQ ID NO: 416878 - RNA, 64 nt, Human
uuagcccuauagaugauaaauaucacuggguuauaagaaaaaauugcacaaaaauuaugugcuu

SEQ ID NO: 416879 - RNA, 64 nt, Human
guauuuuuguuuguaaguuaaaaagaaaaaaaaaaagaaaaaguuccgggcauuuugcaucaga

SEQ ID NO: 416880 - RNA, 64 nt, Human
uuuauuauuacgguauuuuuguuuguaaguuaaaaagaaaaaaaaaaagaaaaaguuccgggca

SEQ ID NO: 416881 - RNA, 64 nt, Human
ucacauccauucucaagguaguuauaugcuggagaagaaaaauccucuagacacaugaaggccc

SEQ ID NO: 416882 - RNA, 64 nt, Human
agaguugagaguugggugagguuagucucuccugaagaaaaagccuauaaaaaguggcuaaucu

SEQ ID NO: 416883 - RNA, 64 nt, Human
uuaaauccuaaaaaucaauauaauuuauuuauguaagaaaaauaacucaaucaauauauuuuug

SEQ ID NO: 416884 - RNA, 64 nt, Human
uguaucagcggcuacccaccuuccaaaccacucaggacaguacccguggcacugggcccgcaga

SEQ ID NO: 416885 - RNA, 64 nt, Human
ggucugugaaauuuugugagacuuuuccugcacuggacaguaaaaaaauaauaaaagacaaaaa

SEQ ID NO: 416886 - RNA, 64 nt, Human
agcugucuccucucuaccuggcuaguaagaggugggacaguaaugguccuccugcuggccccag

SEQ ID NO: 416887 - RNA, 64 nt, Human
gaguucuuacauacacuucaaggcgagcagaucaaagaaaaaucccccuuauuuagaaauguuc

SEQ ID NO: 416888 - RNA, 64 nt, Human
auuaacuuuaacuuauuaaaaaaaaaaaaagaaaaagaaaaacgauuuaaaaaaaaaaaaaaaa

SEQ ID NO: 416889 - RNA, 64 nt, Human
auuuguauuaacuuuaacuuauuaaaaaaaaaaaaagaaaaagaaaaacgauuuaaaaaaaaaa

SEQ ID NO: 416890 - RNA, 64 nt, Human
uguuccugcuucuacuaaaaaaaaaagagcacaaaagaaaaacuaaauuauugaaaaauuaaaa

SEQ ID NO: 416891 - RNA, 55 nt, Human
gacaguguuacagcaauuaaucaaaaagaaaaaccacaggcccuuccccuucccc

SEQ ID NO: 416892 - RNA, 64 nt, Human
ggcaaaaccuagcaggaaaaaaaaacaacgcauaaagaaaaauggccgggccaggucauuggcu

SEQ ID NO: 416893 - RNA, 64 nt, Human
gagugccaagucagaaaguguguauuaccuuguaaagaaaaaaauuacaaagcagggguuuaga

SEQ ID NO: 416894 - RNA, 64 nt, Human
cacguuucuuuguugagcugugucuugaaggcaaaagaaaaaaaauuucuacaguagucuuucu

SEQ ID NO: 416895 - RNA, 64 nt, Human
caagcuaagagagcuugcaaaaaaaaaaagaaaaaagaaaaaaaaaaaccacguuucuuuguug

SEQ ID NO: 416896 - RNA, 64 nt, Human
gaaugcacaagcuaagagagcuugcaaaaaaaaaaagaaaaaagaaaaaaaaaaaccacguuuc

SEQ ID NO: 416897 - RNA, 64 nt, Human
gaagaaauugagaaguauguugcugaaauugaaaaagaaaaagaagaaaacgaaaagaagaaac

SEQ ID NO: 416898 - RNA, 64 nt, Human
aucaaguuuccuauuuuugguuuauuuauuuuagaagaaaaauaaaauuauuugggcauuuuug

SEQ ID NO: 416899 - RNA, 64 nt, Human
agagggcggggacaaauaucaaauuaagcaaguaaagaaaaagaacagguaagagugugugugu

SEQ ID NO: 416900 - RNA, 64 nt, Human
aagcauccuuguacuuauaaucccaaugacuaugaagaaaaauaauuuagccaaauaguuccua

SEQ ID NO: 416901 - RNA, 64 nt, Human
aaguuaagcucuaguauaacaaugauaugggucaaagaaaaaugaaaacaaauuuuaaaaacgu

SEQ ID NO: 416902 - RNA, 64 nt, Human
agaguaucagguuauuuauauauuugcaagcaaaggacaguaagaaguugacuggcaaaagagc

SEQ ID NO: 416903 - RNA, 64 nt, Human
caccccuccucccaccaucaccucccucaccucgggacaguagcccuccacuucuccagccucu

SEQ ID NO: 416904 - RNA, 64 nt, Human
uagacugccuuucacauaaaaucacaaaacuacaggacaguacaaacagauugccagagaaauc

SEQ ID NO: 416905 - RNA, 64 nt, Human
uuuuauaaacauaugaaggcauaaagauauacagaagaaaaauuauuaaacaacucauuuuaag

SEQ ID NO: 416906 - RNA, 64 nt, Human
ccagguuuacuuucuaucagcugagcaaccucucaagaaaaaauaaauaaauaaauaaaccucu

SEQ ID NO: 416907 - RNA, 64 nt, Human
guaacuacagagaggacguuucccuguuuagggaaagaaaaaacaucuucagaucauagguccu

SEQ ID NO: 416908 - RNA, 64 nt, Human
aaucauugaacugagggggaaaaauguaacuaggaagaaaaacccaauuuaagaaauuacauaa

SEQ ID NO: 416909 - RNA, 64 nt, Human
aagggcauuuacaaugucauaaauauccuuauauaagaaaaaaaaugaucucuuaucaauuagc

SEQ ID NO: 416910 - RNA, 64 nt, Human
uagauguaguugcuuaguagcauuuuggaaaaaaaagaaaaaaagguuugguuugguuuuguga

SEQ ID NO: 416911 - RNA, 64 nt, Human
ucucagucaugcuugcugauuacaguuagcacaaaagaaaaauucagcugccugacaauacagg

SEQ ID NO: 416912 - RNA, 64 nt, Human
uugauuuucaagcuuucaaauccucccuacuuccaagaaaaauaauuaaaaaaaaaacuucauu

SEQ ID NO: 416913 - RNA, 64 nt, Human
gcagaguuguuuguuuuuguuguuuguuuccuuuaagaaaaaccacagggaccaagaaagaaaa

SEQ ID NO: 416914 - RNA, 64 nt, Human
aaaauauaugcuuacauuuuucacuuuugcuaaaaagaaaaaaaaaagguguuuauuuuuaacu

SEQ ID NO: 416915 - RNA, 64 nt, Human
auaauuguaaagcuuguuaacuguuuauauacuaaagaaaaagcuuuacaagauaagacugaaa

SEQ ID NO: 416916 - RNA, 64 nt, Human
agacuguggcgugauccaaggaaacgccuguaggaagaaaaaggaugcauucccuacagauuuu

SEQ ID NO: 416917 - RNA, 64 nt, Human
ggcuauacucagaagaaagauaaaagugugaucuaagaaaaagugaugguuuuaggaaagugaa

SEQ ID NO: 416918 - RNA, 64 nt, Human
uuuaacacuugggacaacauuuauuauaaaugauaagaaaaaucuuagagguuugucuacccac

SEQ ID NO: 416919 - RNA, 64 nt, Human
caacauagugagacgucgucucuacaaaaaaaaaaagaaaaaaaaaauuagccaggcaugcgaa

SEQ ID NO: 416920 - RNA, 64 nt, Human
gagagagaaguugcuugacggaugccacuugucaggacaguaugugagugucuggagacagcau

SEQ ID NO: 416921 - RNA, 64 nt, Human
ugauauagaucacccuguuauugcuguuuuucagggacaguagaaaguguuuuguuuuuugagu

SEQ ID NO: 416922 - RNA, 63 nt, Human
gguguuuccccccucuuucugguuuuacaucaugaggaucaguuagcugcugacaagaaaagu

SEQ ID NO: 416923 - RNA, 64 nt, Human
ucuuugcuguuuuaugguugugaagaacgagagcaagaaaaagaugauguagauguugcccuac

SEQ ID NO: 416924 - RNA, 64 nt, Human
aaguuuccauggaagcuguucagaaaaaucaaggaagaaaaaagcaaguuguucaauuuuaauu

SEQ ID NO: 416925 - RNA, 64 nt, Human
uuuuuuuguucuaggggaaaugaaugugcaaaaaaagaaaaagaacuguugguuauuuguguua

SEQ ID NO: 416926 - RNA, 64 nt, Human
gauaauuuuuuaauuauuuaaauguacuuauauuaagaaaaauaucaaguacuacauuuucuuu

SEQ ID NO: 416927 - RNA, 64 nt, Human
uuauaagaaaauggaggcaaagaacuuaaguuuuaagaaaaagcacuucaaaacagaagggcaa

SEQ ID NO: 416928 - RNA, 64 nt, Human
agccgccacacccagccaaugugccgaagaaagaaagaaaaacaugcucauccuuugagucagg

SEQ ID NO: 416929 - RNA, 64 nt, Human
ucaaguuuuccauugaauauaugcuuaugguuaaaagaaaaacgaaugguuuuauaauucugug

SEQ ID NO: 416930 - RNA, 64 nt, Human
cacuuccucuuuauaaaugagucacuauacugugaagaaaaagacuuuuccuagaacaaaggca

SEQ ID NO: 416931 - RNA, 64 nt, Human
uuaaaaacucgacaccccaauucacucaaccaagaagaaaaaagcugaaagcugaguccugcag

SEQ ID NO: 416932 - RNA, 64 nt, Human
cagccugggcaacagagcgagacucagucucaaaaagaaaaaagaaauuuauugcugaucacaa

SEQ ID NO: 416933 - RNA, 64 nt, Human
acauuuuggacugugaccauguaccuuccuuuuuaagaaaaauaaacugcuuuauggaaguugg

SEQ ID NO: 416934 - RNA, 64 nt, Human
ucacauacacuacacacacugugccacguuuaaaaagaaaaaaaacaauucucggcugggcgcg

SEQ ID NO: 416935 - RNA, 64 nt, Human
uagcagauaucauguaggaaagagaggauaaacaaagaaaaaagaaaaaaaaauaagcucauac

SEQ ID NO: 416936 - RNA, 64 nt, Human
uaucauguaggaaagagaggauaaacaaagaaaaaagaaaaaaaaauaagcucauacccaaauu

SEQ ID NO: 416937 - RNA, 64 nt, Human
acugacaugaagcggcuuuccauggagauagagaaagaaaaaguggaauacauggaaaagagca

SEQ ID NO: 416938 - RNA, 64 nt, Human
acugugaauucaaacauuacucuuuggacaguuuggacaguaucuguauucagauuuuacaaca

SEQ ID NO: 416939 - RNA, 64 nt, Human
ugaaagcaaccuucuugccuaguguucugauauuggacaguaaaauccacagaccaaccuggag

SEQ ID NO: 416940 - RNA, 64 nt, Human
ugggugaaaaauaaggaacuuagucuuugagaagggacaguaugugguucguauugaucaagga

SEQ ID NO: 416941 - RNA, 64 nt, Human
cuguaaauccaauacuugccugaaagcugugaagaagaaaaaaaccccuggccuuugggccagg

SEQ ID NO: 416942 - RNA, 64 nt, Human
cuuuaggaaacagagcugccaauugaaacagaagaagaaaaaaaaaaaaagcagcagacaacac

SEQ ID NO: 416943 - RNA, 64 nt, Human
accagggagcugugggaagccacagcagaaauggaagaaaaacaggucucagcccaggguccuc

SEQ ID NO: 416944 - RNA, 64 nt, Human
ucuuaaugaugacuucaaaaauuaauaaaaagaaaagaaaaaaaugauuucuggccgggcgugg

SEQ ID NO: 416945 - RNA, 64 nt, Human
ggccacaccgcugaaggccaaagaggccacaaagaagaaaaagaaacaguuugggaagaaaagu

SEQ ID NO: 416946 - RNA, 64 nt, Human
aagaaacauguuuuaguagaaguuuuauuugaaaaagaaaaauaagcauaaauauauucccagu

SEQ ID NO: 416947 - RNA, 64 nt, Human
auuuuguguugauucagcuaaauuaugaaaaauaaagaaaaacuccuuugauaagcauggcuuu

SEQ ID NO: 416948 - RNA, 64 nt, Human
cuuucagugccugcuguucgugacucagaaacagaagaaaaacacugagaaaaagcauuaaaaa

SEQ ID NO: 416949 - RNA, 64 nt, Human
agucagauuucauuuucuacccuggauguacuugaagaaaaagaauuauuuuugcauaugaaag

SEQ ID NO: 416950 - RNA, 64 nt, Human
agacagaaaccacacucacaguccaaagcaguagaagaaaaaugaauucaaaaguagauguguc

SEQ ID NO: 416951 - RNA, 64 nt, Human
uuauuuuuuauaccaaaugaauacuuuuuuuuuuaagaaaaaaaagagaaaugaauaaagaauc

SEQ ID NO: 416952 - RNA, 64 nt, Human
cccaaacauccuggagaguaugcgagaaccuaccaagaaaaacagucucauuacucauauacag

SEQ ID NO: 416953 - RNA, 64 nt, Human
uuucucuuuccagcugcuguuuuguaaaaagaaaaagaaaaaagaagcccaaacuagugagagu

SEQ ID NO: 416954 - RNA, 64 nt, Human
ccuacauuucucuuuccagcugcuguuuuguaaaaagaaaaagaaaaaagaagcccaaacuagu

SEQ ID NO: 416955 - RNA, 64 nt, Human
agucaguucauuuucguugaaauacauuuauuuaaagaaaaaucuuuguuacucuguaaaugaa

SEQ ID NO: 416956 - RNA, 64 nt, Human
gaaaaaacaaaauaaggacuucaauccaaaguuuggacaguagauggacuucucagaacuuugc

SEQ ID NO: 416957 - RNA, 64 nt, Human
ccagaacuugagccagcugugggauguugcugcaggacaguaagcccucaccugggcaaacaug

SEQ ID NO: 416958 - RNA, 63 nt, Human
acugaaguuccucauagugucauuuguaugagagaggaucauggacaaugaauaaaugcacac

SEQ ID NO: 416959 - RNA, 64 nt, Human
cagcggccuccggcgucuugcccagcagcucaagaagaaaaagaaggacugaacuccaucgcca

SEQ ID NO: 416960 - RNA, 64 nt, Human
uugcacuccagcugagagugugacccugucucuaaagaaaaacuauagaaaauuuaaaaaauua

SEQ ID NO: 416961 - RNA, 64 nt, Human
gggagaccaaccccuuugugucuuuugaaauacgaagaaaaauguguguucaggagcaugacuc

SEQ ID NO: 416962 - RNA, 64 nt, Human
gaaaagagaaaggaaaggccaaaaaaaagaggaaaagaaaaauguacaaaaagauuuucgaucu

SEQ ID NO: 416963 - RNA, 64 nt, Human
auuguauaauuuuuaaauaucugaguuuuaaaaaaagaaaaaaguacaaaaaaaucuuguuaug

SEQ ID NO: 416964 - RNA, 64 nt, Human
uuuucagaaauuaccgaauguguauaaacaaauaaagaaaaauaauuuagcuguguuuuagaca

SEQ ID NO: 416965 - RNA, 63 nt, Human
auaaacuauuuuuaaucauuuuaaauaaauguaaaagaaaaauaacuggauuugauuauugaa

SEQ ID NO: 416966 - RNA, 64 nt, Human
cuguuuuuuaaccuuuuguuccgccauuuaaaaaaagaaaaaaaaaaagcuuauguuucuuguc

SEQ ID NO: 416967 - RNA, 64 nt, Human
cccccgccaccuguacucacccucacgcucuuugaagaaaaaaaaaaaaaucaccuuguguguu

SEQ ID NO: 416968 - RNA, 64 nt, Human
cauacuaaagacauuugcgcuuacuuuguugaaaaagaaaaagaaauuaaauuugaacacagug

SEQ ID NO: 416969 - RNA, 64 nt, Human
cagccugggcaauauagugaaaccccaucucuuaaagaaaaaguuagccaggugugaugaugug

SEQ ID NO: 416970 - RNA, 64 nt, Human
uacgugguuugaauucuggcuacauguuuuaaguaagaaaaaaaaagacguauuuuugcuuacu

SEQ ID NO: 416971 - RNA, 64 nt, Human
uauguugguucacauguacaucuacuuuauaugaaagaaaaaacaguugucugccuguaaaaug

SEQ ID NO: 416972 - RNA, 64 nt, Human
gauaaucugauugcuguuguuuuguuuguuuggaaagaaaaaaaaugucuggcuucuucuacua

SEQ ID NO: 416973 - RNA, 64 nt, Human
uugaacauuuacaaaaugucacacuuuuucuuaaaagaaaaauauuuugggguuugaauaaaau

SEQ ID NO: 416974 - RNA, 63 nt, Human
cugaugccaguuuaaaauucccagguuacgucugaggaucaguugguguaaagcugagauguu

SEQ ID NO: 416975 - RNA, 63 nt, Human
agugacgugcaccuguacucaggaggcugaggggaggaucacuggagcccaggaguuugaggc

SEQ ID NO: 416976 - RNA, 63 nt, Human
uuguaaucccaacacuuuggaaggcugaggcgggaggaucaguauaucgguacgucugagccc

SEQ ID NO: 416977 - RNA, 64 nt, Human
cacuguggaaaagaguauugaguuacaaacugagaagaaaaagcaggaaguucccuaauaaucu

SEQ ID NO: 416978 - RNA, 64 nt, Human
uuuuuaaaaaacauugaccuguguguuuuuauaaaagaaaaaguauguugugccuucuucuuaa

SEQ ID NO: 416979 - RNA, 64 nt, Human
uuuguuaacuugauaauucuucaucuaccuuaaaaagaaaaaaauuacacauagucauucuuga

SEQ ID NO: 416980 - RNA, 64 nt, Human
uuacaaaaauagcacccaaacacauggcacuuggaagaaaaagacccacugaaucugagaaagu

SEQ ID NO: 416981 - RNA, 64 nt, Human
guaaagaaaaccggauggugccuuguuaaagggcaagaaaaaagggaggggguuggaguuuuga

SEQ ID NO: 416982 - RNA, 64 nt, Human
agaauucugggccugaaauuucaaucuaguuagaaagaaaaaugaggcaaugauuuuauuaaca

SEQ ID NO: 416983 - RNA, 64 nt, Human
auguuugcaaaugucuuuuuuuuuuuaauacuggaagaaaaaauauucuguugugucucauaca

SEQ ID NO: 416984 - RNA, 64 nt, Human
aaaauucucaguucucuucacucaaggauuuuuaaagaaaaauaaaagaauugucuuucugucu

SEQ ID NO: 416985 - RNA, 64 nt, Human
auguuauaaauauuuauguugcuuguuuuuaugaaagaaaaaauauugucauauuugacuacaa

SEQ ID NO: 416986 - RNA, 64 nt, Human
ccaaaauauuuucuuaaauagucauagaacuaacaagaaaaaauagauagcaaaaaaauguguu

SEQ ID NO: 416987 - RNA, 64 nt, Human
uuuuagcugucaacucauuuucaucuguuuuuugaagaaaaauggaaaaauguaaaaggcagcc

SEQ ID NO: 416988 - RNA, 64 nt, Human
uucuaccugggccaggccaggaaagagacuauuuaagaaaaaaaaaaucaauuccuagccugga

SEQ ID NO: 416989 - RNA, 64 nt, Human
gaaaacaaauugcguuggcauguacgugggugggaagaaaaagaaaauuaacaggauuuacaca

SEQ ID NO: 416990 - RNA, 64 nt, Human
acaagacuccuaccuugagaucuuagucuagguaaagaaaaaaaaaaaaaggucaugaaacaca

SEQ ID NO: 416991 - RNA, 64 nt, Human
uacuagcaagcuaauggaaacaugauuuucggggaagaaaaacuacagaaaauguagaaauuua

SEQ ID NO: 416992 - RNA, 63 nt, Human
agaaccaccuggcuagacccuaggaagccaggagaggaucagguuccaaaggggaaugcuaug

SEQ ID NO: 416993 - RNA, 63 nt, Human
cuguaaucccaacacuuugggaggcugaggcgggaggaucacuugagcccaggaguucaagac

SEQ ID NO: 416994 - RNA, 63 nt, Human
ggccaauaaccagacugcugagguugcccacaggaggaucacaaacucacagcacagugugug

SEQ ID NO: 416995 - RNA, 64 nt, Human
uauuauuuaauuguguuggagcuucuuuuuccaaaagaaaaacuaguugcagucagggagccag

SEQ ID NO: 416996 - RNA, 64 nt, Human
aauguguaagucacccccaccaaaaacaaaagagaagaaaaagaauagaaagaauuauccagug

SEQ ID NO: 416997 - RNA, 64 nt, Human
ccaaucccuaguacauauauaauagaaaagggccaagaaaaauaugcaucuugauuuggagaga

SEQ ID NO: 416998 - RNA, 64 nt, Human
acucucuuuccaauuucacuuugguggucugaagaagaaaaagaaauuuuauguauguaugugu

SEQ ID NO: 416999 - RNA, 64 nt, Human
uguaucaucaauaaaauuguauguuaaugcuggaaagaaaaaaagaagaaagaaagaaaccauc

SEQ ID NO: 417000 - RNA, 64 nt, Human
guaaaaaaaauguauauuuauauauuaauaugcaaagaaaaagcuaaaaguauagacuucaaag

SEQ ID NO: 417001 - RNA, 64 nt, Human
uucauucuggucucucuauuaccacugaagauagaagaaaaaagaaugucagaaaaacaauaag

SEQ ID NO: 417002 - RNA, 64 nt, Human
uacaccuaauaacguuguguuaaaaaaguguuugaagaaaaagguacaaaaauggcuuuuauac

SEQ ID NO: 417003 - RNA, 64 nt, Human
aaagaauuggcacugggauaagauuuuucagaaaaagaaaaacaucggcaaacugugugugauu

SEQ ID NO: 417004 - RNA, 64 nt, Human
gcaaaucaauaacucuaaauucugggcugauauaaagaaaaaaacaauauuggauuuggauuua

SEQ ID NO: 417005 - RNA, 64 nt, Human
guagugaauccccucauuuugugcauucacuuugaagaaaaagguuucucaaagaugcacacuc

SEQ ID NO: 417006 - RNA, 64 nt, Human
agcuuaucaugagagcccucaggggaaaggguuuaagaaaaacaacuccucuuucccauaguca

SEQ ID NO: 417007 - RNA, 64 nt, Human
gucuucaaguaaguaaaacauacaucguagcuagaagaaaaauguaccuuaaauuugcaucuuc

SEQ ID NO: 417008 - RNA, 64 nt, Human
uugaccccggguacaguuuaaagaagcuggccauaagaaaaauauauauugauguguuugucac

SEQ ID NO: 417009 - RNA, 64 nt, Human
ugaggguaucaggcaucaguucaugcaauaauacaagaaaaaaaauccuuugcuugccaagagg

SEQ ID NO: 417010 - RNA, 63 nt, Human
ggcugcggugauugcaauuaccauccgguguucgaggaucauuggugaagucagcagauauuu

SEQ ID NO: 417011 - RNA, 63 nt, Human
cuccaaucagugauaccagaccacauugacagggaggaucaaauuccugacuuacauuugcac

SEQ ID NO: 417012 - RNA, 63 nt, Human
uugggaguggggagggaaaaaagcucagucagugaggaucauuuuaucacauuagacuggggc

SEQ ID NO: 417013 - RNA, 64 nt, Human
ccagccugggugacagagugagauccugucucugaagaaaaaaaaaaccugccuggcaaggucc

SEQ ID NO: 417014 - RNA, 64 nt, Human
aacaaaugugugaaucucaaauaucucaaagcaaaagaaaaaguguucuagaguguuguugcuu

SEQ ID NO: 417015 - RNA, 64 nt, Human
ucuccaugauuuuauuauaauuuugacacuagacaagaaaaaaaaauauuauuugucuuuccug

SEQ ID NO: 417016 - RNA, 64 nt, Human
uuuugauguugauuuugaccuguucaugauucagaagaaaaacaaacuuuuuuggauuuuuuuu

SEQ ID NO: 417017 - RNA, 64 nt, Human
cuccucuaaucuguguacacaucuccaagcaaggaagaaaaaacaaacucugcucagacgccua

SEQ ID NO: 417018 - RNA, 64 nt, Human
aagagucugcucaaaguuuucaacauaaagaauaaagaaaaaaaaaugccaaagugcuuuucaa

SEQ ID NO: 417019 - RNA, 64 nt, Human
aacuguucccugauguccuuguuuaaacgauaauaagaaaaagggcaacuccauuuguugaggg

SEQ ID NO: 417020 - RNA, 64 nt, Human
guguaaaguuacuuaagcuaaaucaauuucaaagaagaaaaacuuggaggacucauuuuaccug

SEQ ID NO: 417021 - RNA, 64 nt, Human
cagcgaggcuaugacuuacuuaucucaauggcuaaagaaaaaauagugaaaauaccaaauacug

SEQ ID NO: 417022 - RNA, 64 nt, Human
guuacauacauacagcuaccauuuuauaugaaaaaagaaaaacauuucuuccuggaacucacuu

SEQ ID NO: 417023 - RNA, 64 nt, Human
ccauacuuaaagaccaaaucauuuguuugcuuugaagaaaaagcaaaaacaagaacaaaaacac

SEQ ID NO: 417024 - RNA, 64 nt, Human
aaaagagaaaaaagaaaaaaaaugagaaaaaaguaagaaaaaaaaaaauccuguccuaggcuuu

SEQ ID NO: 417025 - RNA, 64 nt, Human
aaaaauauacuugcuaucuauaaaaaagagaaaaaagaaaaaaaaugagaaaaaaguaagaaaa

SEQ ID NO: 417026 - RNA, 64 nt, Human
ugugaguuuaaacaaaaaccacaaacagacaaacaagaaaaaaagcuuuuauugguguuuucac

SEQ ID NO: 417027 - RNA, 64 nt, Human
ccagccugaacuauauuuaagagacuuuguaaaaaagaaaaauguauauagcugugaguuuaaa

SEQ ID NO: 417028 - RNA, 64 nt, Human
uaccaagguucuccacugcuuaccuuuuccagugggacaguacagugugagcccccgggaagua

SEQ ID NO: 417029 - RNA, 64 nt, Human
aacuaacacagugaaaaaaaucaguaccacauuuggacaguauaggugagaaaacauaauuaua

SEQ ID NO: 417030 - RNA, 64 nt, Human
uucccaggacauggaacuuucaaugcuaaaacugggacaguacccagcaaguggggaugguugg

SEQ ID NO: 417031 - RNA, 64 nt, Human
aaauaaauaauuuaaauuuuauugguguuauuggaagaaaaaugcuauuaaugggcuaauaaaa

SEQ ID NO: 417032 - RNA, 64 nt, Human
agaacuuguuuagaaaggauucaguuaaccaaacaagaaaaaggcagugccucacaaagaaauu

SEQ ID NO: 417033 - RNA, 64 nt, Human
gaagccauauuuuuacauaggagucagauacaaaaagaaaaaucacugaaugcuuuuagauauu

SEQ ID NO: 417034 - RNA, 64 nt, Human
gauacaauuugagggaggcagaagucugcaguugaagaaaaaaaauaagucuguuugucauauu

SEQ ID NO: 417035 - RNA, 64 nt, Human
auacaucaguauguaauguaaaagacauaugagcaagaaaaaagugauuuaacuuaccucauca

SEQ ID NO: 417036 - RNA, 54 nt, Human
uccccaaagcugaacaguaguaggaagaaaaaaggugagugaaaaacuaucuuc

SEQ ID NO: 417037 - RNA, 64 nt, Human
cuuguuuuuuauuauuguuguuuaagcauaauuuaagaaaaaaaauuuuuaccuggugaacuug

SEQ ID NO: 417038 - RNA, 64 nt, Human
uuuuuuguguuuuuuuguguguuuuuuuuuuuuuaagaaaaauacaguuuauuucaggcuuaca

SEQ ID NO: 417039 - RNA, 64 nt, Human
auguuaccgauuggauguaaaaugcuaucgagggaagaaaaagcucuuccaaagagaggagcca

SEQ ID NO: 417040 - RNA, 64 nt, Human
cagaagaucagcaaguuuggcagaguuuugguuuaagaaaaacaaaccacuacuaccuagcaca

SEQ ID NO: 417041 - RNA, 64 nt, Human
aaguaagaaagaaaaggacucccuuagaaugggaaagaaaaaucauaaaauauugagcugaugc

SEQ ID NO: 417042 - RNA, 64 nt, Human
uuuccucaaguuacuuuccuucauuuucuuaaaaaagaaaaaaaauuauuaaauguuucucaca

SEQ ID NO: 417043 - RNA, 64 nt, Human
caaggucaguucaggaaagcuuaagcaucgaaaaaagaaaaaaagccaugauguacccuccgag

SEQ ID NO: 417044 - RNA, 64 nt, Human
aguugaagagaaaugcucacugcacaaggagaccaagaaaaaccccccacgaaaucagccacaa

SEQ ID NO: 417045 - RNA, 64 nt, Human
uuaaaaauuagccuaagauauacuuguuuuuguaaagaaaaauauuuaauguugaacaaaauaa

SEQ ID NO: 417046 - RNA, 64 nt, Human
uucuaauguucagugcaauggaagacauuuauuuggacaguaauacuagcaaaguugguagaua

SEQ ID NO: 417047 - RNA, 64 nt, Human
uuuuagauugauuucccuguuucagggaaaucacggacaguaguuucaguucugaugguauaag

SEQ ID NO: 417048 - RNA, 64 nt, Human
ccuaccacuaagaaauacaugaaccgugccaugaggacaguaaguguucauaaagcaacaugaa

SEQ ID NO: 417049 - RNA, 64 nt, Human
aauugaguaaaaucaucagaaacugaauccauguaagaaaaaauaauuguugaagaaagaaguu

SEQ ID NO: 417050 - RNA, 64 nt, Human
cucacuucaauuauagaucauaauaggaagcaaaaagaaaaaaaugaaaagcaaacauaugcac

SEQ ID NO: 417051 - RNA, 64 nt, Human
uguaacacuaaucaauacgugaucucuguuacaaaagaaaaaagcaaguacaaguuccaacaug

SEQ ID NO: 417052 - RNA, 64 nt, Human
aauauuuuuuuccuaaaggaauaaagggugaggaaagaaaaauauuaaaaaagcuaauauuuga

SEQ ID NO: 417053 - RNA, 64 nt, Human
cuaauugccaguuccaguguauucaugguacucuaagaaaaaucucuuugguuuugauuucuug

SEQ ID NO: 417054 - RNA, 64 nt, Human
gaagcagguuuuauuuaucauguuaucuuauuaaaagaaaaagcccaaaaagcaguaaaauuuc

SEQ ID NO: 417055 - RNA, 64 nt, Human
uagugguagcauauagauuguccuuuugcaaagaaagaaaaaaaaccaucaaguugugccaaau

SEQ ID NO: 417056 - RNA, 64 nt, Human
gaccuuuugugauuucauuaucaugccuaugcagaagaaaaaucauugaggaaaauugucauua

SEQ ID NO: 417057 - RNA, 64 nt, Human
ccuuuguaggcugggaaucgcuguguuauuugcaaagaaaaaacagcccccacuccuccuccug

SEQ ID NO: 417058 - RNA, 64 nt, Human
cuucuuucccauuuuaaaaaagaaaagaaggaaaaagaaaaaaggggcaaggagccccgcggcg

SEQ ID NO: 417059 - RNA, 64 nt, Human
cagccugggugacagagcaagacccuguuucaaaaagaaaaacccugggaaaagugaaguaugg

SEQ ID NO: 417060 - RNA, 64 nt, Human
aggaaccauaguugacaguuccaaucaguagcuuaagaaaaaaccguguuugucucuucuggaa

SEQ ID NO: 417061 - RNA, 64 nt, Human
ucuugcucuccuagguagcccccucuucccugguaagaaaaagcaaaaggcauuucccacccug

SEQ ID NO: 417062 - RNA, 64 nt, Human
cagggcaaauggaaaacaggagauccuaauaugaaagaaaaauggaucccaaucugagaaaagg

SEQ ID NO: 417063 - RNA, 64 nt, Human
acaucuuaguuuccaaaagucugcuuaauuucaaaagaaaaaugccuaauugaauguaacucau

SEQ ID NO: 417064 - RNA, 64 nt, Human
uguuggccugggagcugagagaaggcacugagagggacaguaggcggaggaccaggugagguca

SEQ ID NO: 417065 - RNA, 64 nt, Human
aucuccagggcugccccuguagguugcuuaaaagggacaguauucucagugcucuccuacccca

SEQ ID NO: 417066 - RNA, 64 nt, Human
uccuuuuguauccuccauuguaucuucauacaaaggacaguacacacuuggguaauuaaaaaua

SEQ ID NO: 417067 - RNA, 64 nt, Human
cugauuuagauacuucucccugagguggggauaaaagaaaaaaaaaaacaacuucuuuuuuucu

SEQ ID NO: 417068 - RNA, 58 nt, Human
ccagaagcucaccggaauagcccagccaaagaaaaaggucaagauuucuaucacuucc

SEQ ID NO: 417069 - RNA, 64 nt, Human
cuccugauaauucaagggagcucaaagucacaagaagaaaaaugaaaggaaaaaacagcagccc

SEQ ID NO: 417070 - RNA, 64 nt, Human
aggggguggggagguaaauuccucugacuugccaaagaaaaagaagggaaccacaguggauaug

SEQ ID NO: 417071 - RNA, 64 nt, Human
cauuccugaauaauuuccaaauguuuuuaauccaaagaaaaagguuuaaagcuuauuucccuuu

SEQ ID NO: 417072 - RNA, 64 nt, Human
ccagccugggcgacaagagcgagacucucucaaaaagaaaaaagaagacacaagagagguggcu

SEQ ID NO: 417073 - RNA, 64 nt, Human
ggcgguucucgaggugugugccagcuacacguguguucuguauggguccagcugcguuuccauc

SEQ ID NO: 417074 - RNA, 64 nt, Human
gauuaauggggcuggcaucucucuuuggccugagguucuguauucugggaaagguacacagggu

SEQ ID NO: 417075 - RNA, 64 nt, Human
uauauuuuacuucuaaaggagagaaugucaaaaaguucuguauuuuuuuauauucuauauauua

SEQ ID NO: 417076 - RNA, 64 nt, Human
caggccauguacacuaacguccuugaaauuugcaguucuguaugcuucuauuccaaaucauuca

SEQ ID NO: 417077 - RNA, 64 nt, Human
ugugaaaaauaauaauaauuuuucuuggauuuauguucuguaucugugaaaaaauaaauuucuu

SEQ ID NO: 417078 - RNA, 64 nt, Human
aguagacauuggauuggguuggugaaagaguucaguucuguaguaucugaauuugucuuuuaaa

SEQ ID NO: 417079 - RNA, 64 nt, Human
ugggaagcccguuagcccagggugggucccaccaggacaguagggaaacaguuguuucccuagc

SEQ ID NO: 417080 - RNA, 64 nt, Human
cauccaaggcucuuccuaggggcccugcuaauguggacaguagacuuuaucccuccuucuuacu

SEQ ID NO: 417081 - RNA, 64 nt, Human
uguuuaaaauugaaauuaguuauuuucuucugcuggacaguauuaaauagagcaggauguugag

SEQ ID NO: 417082 - RNA, 64 nt, Human
agugggugcugaggugacaggggaggaaccaguuguucuguagccuaggaacugccucaguguc

SEQ ID NO: 417083 - RNA, 64 nt, Human
uacaucagcacucugcugguucuguuugaaauauguucuguauuuaaaacucaaaucuuguugg

SEQ ID NO: 417084 - RNA, 64 nt, Human
gggaggagagcaugccuaaacccugguggccauuguucuguacuaaggaacaacauucccuuug

SEQ ID NO: 417085 - RNA, 64 nt, Human
ugcauccacgugguaagcucccauggaugacaggguucuguaugauggagacuauuauugcuau

SEQ ID NO: 417086 - RNA, 64 nt, Human
gauggaaggagagagguugaggaugcacuggccuguucuguaggagagacuggccagaggcagc

SEQ ID NO: 417087 - RNA, 64 nt, Human
aaaggggcugcaaagggaauaggcugauggagcuguucuguaugguacugugugguggauacau

SEQ ID NO: 417088 - RNA, 64 nt, Human
uccauaauggcuuccagacuagggugaauuuuauguucuguacuguacugugauguagcuuucu

SEQ ID NO: 417089 - RNA, 64 nt, Human
cacaagaggaaauagggcuuuuaaauaaauagauguucuguagcauuggucagggaaauaugaa

SEQ ID NO: 417090 - RNA, 64 nt, Human
aaucaaagcaagggcuccagcauccagccuguguguucuguaauggaacugacccccuccccug

SEQ ID NO: 417091 - RNA, 64 nt, Human
ccagaagccaccuugacacuuuugaacauuuccaguucuguagaguuuauugucaauugcuucu

SEQ ID NO: 417092 - RNA, 64 nt, Human
agugccugccugaguuaggaaaauuacauuccugguucuguauugaggagaaggauguauaaag

SEQ ID NO: 417093 - RNA, 64 nt, Human
uucccuacuuccuaaacucucuuccagcaucgauguucuguagcucugaccuugauagggauac

SEQ ID NO: 417094 - RNA, 64 nt, Human
aacacagguacagucauucuuugaaggugacacuguucuguauauucccuauaggcagcuggag

SEQ ID NO: 417095 - RNA, 64 nt, Human
aauauagagaaauaguuucacccugcacuacccuguucuguaguuauucugaugauagccagug

SEQ ID NO: 417096 - RNA, 64 nt, Human
cuggcagggggugucuaagccacguccaaaugguggacaguagcuccaacagugacaugacaga

SEQ ID NO: 417097 - RNA, 64 nt, Human
cucccaaugguacggugcacccugugguggucuuggacaguauguggaaacagaagcuccauga

SEQ ID NO: 417098 - RNA, 64 nt, Human
accaaaaagaaacucuaagguucccuccaguguuggacaguacaaaaacaaagcugcucuuguu

SEQ ID NO: 417099 - RNA, 64 nt, Human
gauuucucuuuuucauucauauaccauuuuaugaguucuguauaauuuuuugugguuuuuguuu

SEQ ID NO: 417100 - RNA, 64 nt, Human
uaaguugauuuggccaauguguaauauuuaaacuguucuguaaaauaagugucuggccauuugg

SEQ ID NO: 417101 - RNA, 64 nt, Human
guguaaaugaucacaaaaauguauuuuauaaaauguucuguacaauaaaguuacaccucaaagu

SEQ ID NO: 417102 - RNA, 64 nt, Human
ccaacaaaugaaauuuaaaagcaaauguaaaaguguucuguacauaagcaaaugagagauucga

SEQ ID NO: 417103 - RNA, 64 nt, Human
aguuucuuucccuucauucuacccugcaagccaaguucuguaagagaaaugccugaguucuagc

SEQ ID NO: 417104 - RNA, 64 nt, Human
cugcauuuuucugucagaaucacauaugauguguguucuguagagguuauuucugcauggaaac

SEQ ID NO: 417105 - RNA, 64 nt, Human
ucagaaauaucgaaggagccaaaaauauaaaacaguucuguauaccaaaguggcuauaucaaca

SEQ ID NO: 417106 - RNA, 64 nt, Human
agcccagggagacuccgcugugggaaaccucauuguucuguacaaaguacuagcuaaaccagaa

SEQ ID NO: 417107 - RNA, 64 nt, Human
gggacaacugccugggaacuaggaugcuagagcaguucuguaaugcuuugagacacagcaauuu

SEQ ID NO: 417108 - RNA, 64 nt, Human
uggguccaucccaggcacugguacuugcccccuuguucuguaucccccuuugcccuugccuugc

SEQ ID NO: 417109 - RNA, 64 nt, Human
cggcaaguuugacagcacccaaacuggccagacuguucuguagguuaaguccauugaucaugua

SEQ ID NO: 417110 - RNA, 64 nt, Human
cuuaugcaucagucauuucaacagcaugaaugugguucuguacagugauguauguggagauuuc

SEQ ID NO: 417111 - RNA, 64 nt, Human
auucuaucacuggcaauauuuguucugguuuaguguucuguauuuuaagguguacguaucauuu

SEQ ID NO: 417112 - RNA, 64 nt, Human
agaaagcuaaaauuuaauuucuuuuuuccucugaguucuguacuucaaccagccuacaagcugg

SEQ ID NO: 417113 - RNA, 64 nt, Human
gaaggcugaagcuagaguguggaccugaccuguuggacaguacuuuucuuucuuuuuuuuucgg

SEQ ID NO: 417114 - RNA, 64 nt, Human
ucuccuccccuucccccaccgguccagcuggccuggacaguaucccacauccaacuccagcaac

SEQ ID NO: 417115 - RNA, 64 nt, Human
acacuuuaaggaaagauugaaucuaagcugugaaggacaguauagaagacugcaccaaguggac

SEQ ID NO: 417116 - RNA, 64 nt, Human
aaguauauguuauauauacuugcaaugugacaugguucuguagaucauuuuauaauaauaaaua

SEQ ID NO: 417117 - RNA, 64 nt, Human
uucaucuccuuuccuggagaaagcagcugcagagguucuguauuuccugcauuuccaucauccu

SEQ ID NO: 417118 - RNA, 64 nt, Human
uuuguuguuagaaacaaaugaugaaaacauagggguucuguaaacuuuuguaaugcuaugaauu

SEQ ID NO: 417119 - RNA, 64 nt, Human
gauuccaagcaacccaucuuucuucaguauguauguucuguacauacuuaucggagcgcgccag

SEQ ID NO: 417120 - RNA, 64 nt, Human
aacuaaguggcaaauuccaugaaaauauuucucaguucuguaugcacuuuuauuuaacauuauu

SEQ ID NO: 417121 - RNA, 64 nt, Human
auguaagaguggaauguuaauaaauuucaguuuaguucuguaaugucaagaauuuaagaauuaa

SEQ ID NO: 417122 - RNA, 64 nt, Human
gacuuuauuggucaauauuugaccacucuggacuguucuguaaaguggcugguaacaacagcac

SEQ ID NO: 417123 - RNA, 64 nt, Human
ugauuauuacacggauaauguuuuaaaugucuagguucuguauuuuuuucuuaaauagcaagaa

SEQ ID NO: 417124 - RNA, 64 nt, Human
agaguaaagacaagaguguuggaccaguauugcaguucuguagugucauuucuuauaaaaaaca

SEQ ID NO: 417125 - RNA, 64 nt, Human
guagugcauguuuucuucuguuaucccccuguuuguucuguaacuaguugcucucauuuuaauu

SEQ ID NO: 417126 - RNA, 64 nt, Human
uuuugucuugucauugagaggagucagcagucuuguucuguaaaggaccagagaugguaaauac

SEQ ID NO: 417127 - RNA, 64 nt, Human
ggaagagacacaugugugcacuccugcauguucaguucuguacuuccaguuucuaaaaugcacu

SEQ ID NO: 417128 - RNA, 64 nt, Human
gggauggcugcuuccaaguuguuugcaauuaaagguucuguauaaaaccaagcccucugugugu

SEQ ID NO: 417129 - RNA, 64 nt, Human
uagaaagaaguagacaugggagacuuuucauuuuguucuguacuaagaaaaauucuuacccuaa

SEQ ID NO: 417130 - RNA, 64 nt, Human
cuggacagggccccccccaccaucuguaaaacggggacaguaugauguaccuugaagggcuguu

SEQ ID NO: 417131 - RNA, 64 nt, Human
accuuggcucauagaaagucacuuuaauagauagggacaguaauaaauaaauguacaaucucua

SEQ ID NO: 417132 - RNA, 64 nt, Human
gggcacuuuccacagcccaggagagcuucugaaaggacaguauagcugcccuugcucccuaccc

SEQ ID NO: 417133 - RNA, 64 nt, Human
uauuauuguuauuauuauuauuguuauuauuguuguucuguaaacauguugcacaagcuuagcc

SEQ ID NO: 417134 - RNA, 64 nt, Human
gcaauccagcccaugccgacggggacugcuucguguucuguauucugacccaugggagauuugg

SEQ ID NO: 417135 - RNA, 64 nt, Human
cucuuccauagggcaguuguugcuucuuaauucaguucuguauguguucaacauuuuugaauac

SEQ ID NO: 417136 - RNA, 64 nt, Human
uuuaaaaccucaaguuuuuaaacaugauuuauauguucuguauaauguucaguuuguaacuuuu

SEQ ID NO: 417137 - RNA, 64 nt, Human
cuacagggagaggcugaguaaaccgagauccagcguucuguauggcagggguauugcuuaucac

SEQ ID NO: 417138 - RNA, 64 nt, Human
uuuugcugugaacucuuacuaaaaugaguuuuagguucuguaaguggaaaaaugugcuuuuauu

SEQ ID NO: 417139 - RNA, 64 nt, Human
ugaucucauguugccuugcuuacuuuaagauccuguucuguaauaaacauauuuugccuugagu

SEQ ID NO: 417140 - RNA, 64 nt, Human
cuuauuuaucuguugcacuugguuagcuuuaauuguucuguauuauuuaaagauaaguuuacuc

SEQ ID NO: 417141 - RNA, 64 nt, Human
cagauuguaauuugguuuauuggaugugauggacguucuguaauagaaaaccugaaacgaugau

SEQ ID NO: 417142 - RNA, 64 nt, Human
ucuuggcucucuuugucauguccagaggcaggcuguucuguaaaauagacugccagaccucuua

SEQ ID NO: 417143 - RNA, 64 nt, Human
aucuuuuuucacaaauuugucuugccuuauuaaaguucuguaaaauauacuuaaauggaaaaaa

SEQ ID NO: 417144 - RNA, 64 nt, Human
gacaggugguguuucuaaauaauuggcugcuaugguucuguaaaaaccaguuaauucuauuuuu

SEQ ID NO: 417145 - RNA, 64 nt, Human
gauuaagucccacaaugaaauuucagaaguuuuuguucuguaaguaaaaaauuacuaaccacug

SEQ ID NO: 417146 - RNA, 64 nt, Human
uuuauuccuuuucucuccuaaucugaaaauggguguucuguauuuuggguggaagaggcauaga

SEQ ID NO: 417147 - RNA, 64 nt, Human
auuuguggaauauagugauauauuguguuaauuuggacaguagcgguuuuuaaaaaccauauac

SEQ ID NO: 417148 - RNA, 64 nt, Human
uuucugcaugacugagagucucaguguuggaacgggacaguauuuauguaugaguuuuuccuau

SEQ ID NO: 417149 - RNA, 64 nt, Human
auuauuaauuuauaaaaauccaugcuuuacaccuggacaguagacagggacuucagagauugca

SEQ ID NO: 417150 - RNA, 64 nt, Human
ggucucaagagauauaauuuagauucucauugauguucuguauucauuauccuaacaccaucug

SEQ ID NO: 417151 - RNA, 64 nt, Human
uaaugggaaaggcugggaucauauguauuucuauguucuguaaaguauuugacuuacuaguucu

SEQ ID NO: 417152 - RNA, 64 nt, Human
aagcauguugcauacuacccuggugggauggaugguucuguaaaugaagggauauuuaaacuug

SEQ ID NO: 417153 - RNA, 64 nt, Human
ugaaauacaaagaacaagcuauuuccaggaauguguucuguauuuuacaucccaguguacccuu

SEQ ID NO: 417154 - RNA, 64 nt, Human
uccauuuuuuaaagacuaaaccaucucacagauuguucuguaucaguaaauaaagaucuuuccc

SEQ ID NO: 417155 - RNA, 64 nt, Human
augaagagauguucaccuacccgguauuuuaaauguucuguaaauuauuagccaaauagaacug

SEQ ID NO: 417156 - RNA, 64 nt, Human
acccugggcauugucugggcugcagggcugccagguucuguacuuguguccagcuguggcccug

SEQ ID NO: 417157 - RNA, 64 nt, Human
uugauuucuaguguacaagauacugucugcugugguucuguauuuuuuuauuuuuugaccaacu

SEQ ID NO: 417158 - RNA, 64 nt, Human
cugaagcgguucauugcuauuauugcagugucauguucuguaauagaaaguaaaaagacuguua

SEQ ID NO: 417159 - RNA, 64 nt, Human
uaguaacugcaagugaugaacugcauuucguauuguucuguauauuucaaaaugguauuuugau

SEQ ID NO: 417160 - RNA, 64 nt, Human
uaaaauuacaaugaucuuuuaaaaagaugaugcaguucuguauuuauugugcugugucuggucc

SEQ ID NO: 417161 - RNA, 64 nt, Human
ggagcagcaaacaaggggcuaauccaugagcaguguucuguaggcucugugacaucuuugguuu

SEQ ID NO: 417162 - RNA, 64 nt, Human
acaucacuguaguugcuugacuguuucuccuacuguucuguaaacuuauuaaugggugagaauc

SEQ ID NO: 417163 - RNA, 64 nt, Human
aaaccugaguauaucucuucuacuuucaucauguguucuguaccuucuuuuuguuucauugggc

SEQ ID NO: 417164 - RNA, 64 nt, Human
gcauccacauguucccguuugcagaaaccucacaggacaguacgaauaucuggcauuuuuaagu

SEQ ID NO: 417165 - RNA, 64 nt, Human
uguuguuuagccaaaacagaaaaugauuuccacuggacaguagaaaaauauguguaaaauaggg

SEQ ID NO: 417166 - RNA, 63 nt, Human
aagcaaacugcauuaucaggaguaccuuggugagaggaucaguguaaauccuaauagguacaa

SEQ ID NO: 417167 - RNA, 64 nt, Human
cuuuauagcugcaagaaaugugguauguggagaaguucuguaugugaggaaggaaaaaaagaaa

SEQ ID NO: 417168 - RNA, 64 nt, Human
acaguaaggcagcaugcuaaaaugcuuuuguucaguucuguauauuugaaaauagcaguguguu

SEQ ID NO: 417169 - RNA, 64 nt, Human
gaacuuuacuuacuaauuuucaguguccuuaaggguucuguaguguuaucaaagcaaaaagaaa

SEQ ID NO: 417170 - RNA, 64 nt, Human
agacaucaugaauuuuacaugguacucuuguugaguucuguagagccuucugaugucucuaaag

SEQ ID NO: 417171 - RNA, 64 nt, Human
ugugugccuauauugacguagugaguacuagagaguucuguauuuuauuauugacuauaauaau

SEQ ID NO: 417172 - RNA, 64 nt, Human
guaaaaucuuucuuucuuagaaauuuauuuccuaguucuguagaaaugguuguauuagauguuc

SEQ ID NO: 417173 - RNA, 64 nt, Human
cuggcuucacagagacaaccauuuaugauuugcuguucuguaagaguguggauucuuucuauca

SEQ ID NO: 417174 - RNA, 64 nt, Human
uuuaagguauuuuaaaauucgaaggguauccaagguucuguauuuauuuauuggggagacacua

SEQ ID NO: 417175 - RNA, 64 nt, Human
aaaaccucaaagacagauguuacagaaucagccaguucuguaaaacugauauugucuauugguu

SEQ ID NO: 417176 - RNA, 64 nt, Human
accauccaguggagcuuucugcagugacggaaauguucuguauuugcguuguccaacgugguaa

SEQ ID NO: 417177 - RNA, 64 nt, Human
gaggcuugucauacugucuagagguugacucuuaguucuguaaauaaagacauccauuucaaac

SEQ ID NO: 417178 - RNA, 64 nt, Human
aguaaauagaccaaaguggggggacaauuuucuaguucuguagagggaaaaacaucugagucaa

SEQ ID NO: 417179 - RNA, 64 nt, Human
auaaaauaaacuauaccucuucaagagguauccuguucuguaagaucagauguuuuuauugcag

SEQ ID NO: 417180 - RNA, 64 nt, Human
aauaggauugaaucaacuagaaaugaaucuauauguucuguauauaugaaugacuaucuuguuu

SEQ ID NO: 417181 - RNA, 64 nt, Human
gcuugaaguuuuaucuacauacacagguaacagaggacaguagucuguaaacauauaaaucggu

SEQ ID NO: 417182 - RNA, 64 nt, Human
ggcaucccugccuagcuaucuccuucaugugcaaggacaguauaaguaguauuuugcaugugag

SEQ ID NO: 417183 - RNA, 64 nt, Human
augaaccccccugaccuuuccuggugggaaacggggacaguacgauguuaccaagugaauucug

SEQ ID NO: 417184 - RNA, 64 nt, Human
cuagaauuuguauuuugcuuaaaauuuuacuuuuguucuguauuuucauguggaauggauuaua

SEQ ID NO: 417185 - RNA, 64 nt, Human
ugauugcaagagaccaaguuucacagcuuguaaaguucuguauuugggauucuugcuuauuuuu

SEQ ID NO: 417186 - RNA, 64 nt, Human
uagggaacagauacaccugguuagaaggucuaggguucuguauaugaagcugccagucuguagc

SEQ ID NO: 417187 - RNA, 64 nt, Human
aagcuuggagggaagccgugaauucaguugguucguucuguacuguuacugggcccugagucug

SEQ ID NO: 417188 - RNA, 64 nt, Human
auauuggcugauauuuauauacuuaauagauugaguucuguaagggcaaaaacggauugaaaug

SEQ ID NO: 417189 - RNA, 64 nt, Human
cagauuggccaauuaaaaacgaaaaccugacuagguucuguagagccaauuagacuugaaauac

SEQ ID NO: 417190 - RNA, 64 nt, Human
uggacauuuuguuuaaaaagucuuugaauugccaguucuguaagugccaucaauuaaaauaguu

SEQ ID NO: 417191 - RNA, 64 nt, Human
aauauuuguaaaaauaaugaauggacucaucuuaguucuguauauaaauauauuuucuuucuag

SEQ ID NO: 417192 - RNA, 64 nt, Human
uauauuuccuuauucagaauuucuaaaaauuuaaguucuguaagggcuaauauauucucuuccu

SEQ ID NO: 417193 - RNA, 64 nt, Human
uauauauauggaaauauauauguauacauuuuaaguucuguauacauaauuaccaaacacuaug

SEQ ID NO: 417194 - RNA, 64 nt, Human
gggaguauaucuucugugguuuugaaggaggugaguucuguaugugccuugcaguacuguaauu

SEQ ID NO: 417195 - RNA, 64 nt, Human
acucugaacuuuuuuuguuuuugcauuccaugagguucuguauucagucauucucuagguaaug

SEQ ID NO: 417196 - RNA, 64 nt, Human
uugcuguucucuuugaggcucuccaaagucuugaguucuguauauggccugguuucuuguuuuu

SEQ ID NO: 417197 - RNA, 64 nt, Human
caguaacacaucuuuaauccgccuaauucuuguuguucuguagguuaaaugcagguauuuuaac

SEQ ID NO: 417198 - RNA, 64 nt, Human
uugaacuagacugcuuugagauaucauuucagaaggacaguauucagccacagcugcaaagguu

SEQ ID NO: 417199 - RNA, 64 nt, Human
acauuauuugaaagacugggaauuuaaugguuagggacaguaaaucuacuucuuuuuccaggga

SEQ ID NO: 417200 - RNA, 64 nt, Human
aaguuacacguaaaguagaagaaucuagugcgugggacaguaaaggauccuuucucguacagaa

SEQ ID NO: 417201 - RNA, 64 nt, Human
gaaaugcuaaauuuugaagaguuuuguguccguaguucuguaauucugggcagucaucauguug

SEQ ID NO: 417202 - RNA, 64 nt, Human
aacucagagauauuacucuuugaugaaugcauaaguucuguacuugcauuuauacgaacauaua

SEQ ID NO: 417203 - RNA, 64 nt, Human
cacacauauguguauuuacagugcaguguaaauaguucuguaguagagguuaacuccauauuuc

SEQ ID NO: 417204 - RNA, 64 nt, Human
uuaaauaaaucuuucagccugcuucuuccccaggguucuguauugcagcuaagcucaaauguau

SEQ ID NO: 417205 - RNA, 64 nt, Human
aaagcccagcacuugaauuguuauuacuuuaaauguucuguauuuguaucuguuuuuauuagcc

SEQ ID NO: 417206 - RNA, 64 nt, Human
aagauaaacacucaaccaaacaaugugaaaacggguucuguaguauuuguaaaaaggcccggcc

SEQ ID NO: 417207 - RNA, 64 nt, Human
gcuagaacaguuuuuuucuuaccucuguaaguggguucuguaaaaaauggaggcuuuagagaaa

SEQ ID NO: 417208 - RNA, 64 nt, Human
ggggggauuagcaaagcagaaaacuggcugcuggguucuguaguuuuaaaaaaucuauauuuuu

SEQ ID NO: 417209 - RNA, 64 nt, Human
uucagaguuaccauguacguauuccacuagcuggguucuguauuucaguucuuucgauacggcu

SEQ ID NO: 417210 - RNA, 64 nt, Human
ccuuuuuuuugaaauuucucaaacucauuuacuaguucuguaaaaucaaagauacuaacauugu

SEQ ID NO: 417211 - RNA, 64 nt, Human
gcauauaagacaaaaauuuauguuuggagccuguguucuguaaagagaagguugauuugucuuu

SEQ ID NO: 417212 - RNA, 64 nt, Human
uuucaugacuagagaugaggaagaacaagggauaguucuguaaguguucgggggacaucagcau

SEQ ID NO: 417213 - RNA, 64 nt, Human
acauauaagacaaaaauuuauguuuggagccuguguucuguaaagagaagguugauuugucuuu

SEQ ID NO: 417214 - RNA, 64 nt, Human
acgguuauccuuucugacccacaaaguaugaaaaguucuguaaucuguaaacucaguucuguaa

SEQ ID NO: 417215 - RNA, 51 nt, Human
cugucggaacucauugcugaaggacaguacuugguugggucagauuuauuu

SEQ ID NO: 417216 - RNA, 64 nt, Human
aaccugccuuagcugcacucucuuaccuacagcuggacaguaccugucuguuuccuguccuccu

SEQ ID NO: 417217 - RNA, 64 nt, Human
cugugagggagcaggcccugugagaaucaauucaggacaguauuuuuuuuuguccuuucuccau

SEQ ID NO: 417218 - RNA, 64 nt, Human
caaaguaugaaaaguucuguaaucuguaaacucaguucuguaaucuguauuauugagaugauua

SEQ ID NO: 417219 - RNA, 64 nt, Human
uaucugggauggauauuaauuuuaauacaggaguguucuguaucaacauuuggguugguauuca

SEQ ID NO: 417220 - RNA, 64 nt, Human
gauuuuguaaugcgaaucuccucucauaauuuuaguucuguaaauucaggguuuuuuuuuguuu

SEQ ID NO: 417221 - RNA, 64 nt, Human
cagaaaauuuuacaauauuuuuucuuuacaauauguucuguaguauguuuacccucuuuaugaa

SEQ ID NO: 417222 - RNA, 64 nt, Human
agguuguaaauuuuaaaugcaagaugacgcuuacguucuguaaaccauuaguaauacaugcugu

SEQ ID NO: 417223 - RNA, 64 nt, Human
ggauacaauuaaggagcaacuauuuuauaugacuguucuguacaaacaaaaaguauguaauacc

SEQ ID NO: 417224 - RNA, 64 nt, Human
cuaaauacauuccuaaaaauguauuugaacauugguucuguaaaagauaauggacuaaaaaagu

SEQ ID NO: 417225 - RNA, 64 nt, Human
gccuaugugguuuuuuuucagucuuauagcugguguucuguaaaagauuuguccaauaaacgac

SEQ ID NO: 417226 - RNA, 64 nt, Human
uacagcucucucuccucacugcucacagcaagggguucuguaucaguggauuucauuuuguagc

SEQ ID NO: 417227 - RNA, 64 nt, Human
aauggugagaaacauuauugucaacuugaaauguguucuguaauggggacacuacaaaaagcua

SEQ ID NO: 417228 - RNA, 64 nt, Human
aggcugacagggccacacgacauagcugaaauuuguucuguaggcggaggcaccaagcccuguu

SEQ ID NO: 417229 - RNA, 64 nt, Human
agaugccagugcgcucugacaaguauuccaaaguguucuguagcuagacuggugcaggcucguu

SEQ ID NO: 417230 - RNA, 64 nt, Human
ucacuugauguuuguuagaccagaaaguguguguguucuguagcucaguucccagacagcuuuu

SEQ ID NO: 417231 - RNA, 64 nt, Human
guauuuuuuaauguucaauaauguauauguaucaguucuguaauaaaggggaaaacacuuuuuu

SEQ ID NO: 417232 - RNA, 64 nt, Human
guagcauuugcauuuuaaaagaggaaugcggagaggacaguacuuaguccaaaggugcuaacgg

SEQ ID NO: 417233 - RNA, 64 nt, Human
uaacuguuaguaaguugaaggauauuggacaggaggacaguauuucagaaaaggagagguugac

SEQ ID NO: 417234 - RNA, 64 nt, Human
ugaaaguuaccuuaauaguccucuuguguuauuaggacaguauuauuauaguacuuauuuauuu

SEQ ID NO: 417235 - RNA, 64 nt, Human
uaaaaaggugaagaaaaauuuuacaguauauccuguucuguacauuaaauuaaaaaaacaaaaa

SEQ ID NO: 417236 - RNA, 63 nt, Human
agggccucuugauauuugagguaauaaauucauuguucuguauaaggcuuuuuuauuuuucac

SEQ ID NO: 417237 - RNA, 64 nt, Human
agcagacuaccuguuuccacauguaacugguuauguucuguaaaguuacaaaaauagaaagguu

SEQ ID NO: 417238 - RNA, 64 nt, Human
aguaucuugaaauccuggaaaauucuauggaauaguucuguauauagggcacaaguaaaggcau

SEQ ID NO: 417239 - RNA, 64 nt, Human
gcucagcuguguuugacccacauccucccaauuuguucuguauuuagguaguuauuuauacaag

SEQ ID NO: 417240 - RNA, 64 nt, Human
acuuagauguuggauauguacauagcuguuucuuguucuguauacauuucucaaauguacacuu

SEQ ID NO: 417241 - RNA, 64 nt, Human
gcaugaggcagagcguccguagcauuuccaguuuguucuguauaggaacagaggugccuccggg

SEQ ID NO: 417242 - RNA, 64 nt, Human
gguccccuuccccaggggagccugcgaaggagagguucuguagaauccaagcccacauuuccaa

SEQ ID NO: 417243 - RNA, 64 nt, Human
augccccugccccaggaacauggcagaagcacagguucuguaccucagauggacuccugcuggg

SEQ ID NO: 417244 - RNA, 64 nt, Human
auuucaaaaggaaggguggcuuugcauuucuuguguucuguagacugccaucauugaugaucac

SEQ ID NO: 417245 - RNA, 64 nt, Human
uaguauuuaagucauaaugucauuucagaauucaguucuguaggauuuucuuuucuuuaaaaaa

SEQ ID NO: 417246 - RNA, 64 nt, Human
caacacuagcauuuuuggcuuacucauggacaaaguucuguauauaguauaaagucauuaacaa

SEQ ID NO: 417247 - RNA, 64 nt, Human
agauguccaaugucugacuccugcauaccaagguguucuguaucaagggcuuuaaaacaaugcc

SEQ ID NO: 417248 - RNA, 64 nt, Human
ggcuuaagcuaaaguauugccucuauucuguaaaguucuguacauaguucccaagcuucugcag

SEQ ID NO: 417249 - RNA, 64 nt, Human
auacaugcccaugaccaaauauucaaauugugcaggacaguaaauaaugaaaaccaaauuuccu

SEQ ID NO: 417250 - RNA, 60 nt, Human
aaggagguggcucuaaguaaaacugggauuggacaguaguggugcaucugguccuugccg

SEQ ID NO: 417251 - RNA, 64 nt, Human
caacccucacuucaccuggggaggggcuucuuccggacaguagacacccugcccgugcagagag

SEQ ID NO: 417252 - RNA, 64 nt, Human
ccauauuauagcaaaugcuaaaaauuuuugaaauguucuguaauucccagagucuuccauaaau

SEQ ID NO: 417253 - RNA, 64 nt, Human
gcccauauuuuacuuggaaauauuaaaagaaaggguucuguaaaauggaaaacuuaguuuguga

SEQ ID NO: 417254 - RNA, 64 nt, Human
uuauauuaaugauuguuuccuuuaguaauuuauuguucuguacugauauuuaaauaaagaguuc

SEQ ID NO: 417255 - RNA, 64 nt, Human
uagggugcuggcugaauagacucuguccagcccuguucuguagucucaagcugccugcgauggc

SEQ ID NO: 417256 - RNA, 64 nt, Human
gcacaucagacuucucagagacccacuuuauucaguucuguacauauggggacaucgguccaag

SEQ ID NO: 417257 - RNA, 60 nt, Human
aaaagagcuuuacucagugacuuaauauauguucuguauuaaaauuaaugugcuuuguug

SEQ ID NO: 417258 - RNA, 64 nt, Human
uaaacccacuuggguaguuacuauccccaaaucuguucuguaaauaauauuauggaaggguuuc

SEQ ID NO: 417259 - RNA, 64 nt, Human
uaucugugaccaugcucuucucccaauuuaagugguucuguaccacaaagaaucuugauacauu

SEQ ID NO: 417260 - RNA, 64 nt, Human
ugcguuuuaaauccguaugacccaguguucuagaguucuguauaaaaugauaccaacaacaaau

SEQ ID NO: 417261 - RNA, 64 nt, Human
uguucaugcuuuguaccaaauuuaaugaacgcguguucuguaaucaaacugcaaauauugucau

SEQ ID NO: 417262 - RNA, 64 nt, Human
uuuuguguugcuaugguguugaaauauccaagauguucuguaucuauguaaacaugauuccuuu

SEQ ID NO: 417263 - RNA, 64 nt, Human
auuuguaacauuaguuuuaaaaagggaaaguuuuguucuguauauuuuguuaccuuuuacagaa

SEQ ID NO: 417264 - RNA, 64 nt, Human
gaaacguggcaggacuuccaucugugccauacuuguucuguauucgaaaugagcucaaauugau

SEQ ID NO: 417265 - RNA, 64 nt, Human
gcuuugccuauugauguuccuuugggucugugagguucuguaaacugugcuagugcugacgaug

SEQ ID NO: 417266 - RNA, 64 nt, Human
cucugaacccugagcaggcacccacuucccugcaggacaguauuccugccgaggcugacuuccu

SEQ ID NO: 417267 - RNA, 64 nt, Human
cugccuugcaaagguaaucucucauuuuaaaauuggacaguauuaaugaaggggaaauauacaa

SEQ ID NO: 417268 - RNA, 64 nt, Human
aauuucucuguaucagguggggaaaugugcugaaggacaguauguaucccuugcuucauuuuua

SEQ ID NO: 417269 - RNA, 64 nt, Human
gugagguucuguaaacugugcuagugcugacgauguucuguacaacuuaacucacuggcgagaa

SEQ ID NO: 417270 - RNA, 64 nt, Human
gauggagauuaagaugccuugaauugucuaggguguucuguacuuagaaaguaagagcucuaag

SEQ ID NO: 417271 - RNA, 64 nt, Human
aagaaggacauauuaccuugguuugaaucccugaguucuguacuguucuguuuuguuuagucua

SEQ ID NO: 417272 - RNA, 64 nt, Human
ucccucagugcuucucuucugaccugcauguugaguucuguauugcuggggcuuccaacaaaaa

SEQ ID NO: 417273 - RNA, 64 nt, Human
cauuaaaauggacuccaaaaacauuuuuuuaaauguucuguaagauaaacuguauauuucauau

SEQ ID NO: 417274 - RNA, 64 nt, Human
gaacccccagggcauaacauaguaagaaaguaugguucuguauggcaauagguuuuuaaaauua

SEQ ID NO: 417275 - RNA, 64 nt, Human
aaacagucaacaccauuguauuuuuuaacuucguguucuguaucuccucagccauguaucuuaa

SEQ ID NO: 417276 - RNA, 64 nt, Human
uuggcaaguuuuaaacccaaaauauauacacauaguucuguaauaaaacuguuugacuucucaa

SEQ ID NO: 417277 - RNA, 64 nt, Human
uaguaagauugccaaaaucagagaaucuugcaaaguucuguaauucuaaguguuguucuagauu

SEQ ID NO: 417278 - RNA, 64 nt, Human
aacaaguguccuucagaacccagagaaggccgccguucuguaaauagcgacgucgguguugcug

SEQ ID NO: 417279 - RNA, 64 nt, Human
agauuaaacugacuuuguuuuggcuguuuuuuuaguucuguauguauuuuagcaaucucaucuc

SEQ ID NO: 417280 - RNA, 64 nt, Human
auguguuaauuguauuuuuaagaauauauucuaaguucuguacuucaaauaauagcacagauuu

SEQ ID NO: 417281 - RNA, 64 nt, Human
auuggaauagcagccucacacuggcgucuggacuguucuguagauucaugcaaguggagcuguc

SEQ ID NO: 417282 - RNA, 64 nt, Human
cuacauaugaauguugaagcugauacauugcacaguucuguagacaucacuacaccgauguagu

SEQ ID NO: 417283 - RNA, 64 nt, Human
uugcugcucuuccuuguugugaacaguggaugugggacaguauuuucuuuuauguuuuaguugu

SEQ ID NO: 417284 - RNA, 64 nt, Human
uuaagggaguauauacuugaguacuuauugaaauggacaguaauaagcaaauguucuuauaaug

SEQ ID NO: 417285 - RNA, 64 nt, Human
gcacaagcgagucccugcaaacuaccacugcugaggacaguaguaaaccccuugaccugagacu

SEQ ID NO: 417286 - RNA, 64 nt, Human
aguaauacuuaacaucucagaaaaaauuuugcauguucuguaguuuuguauuaaaucagucauu

SEQ ID NO: 417287 - RNA, 64 nt, Human
gccuuucuaagggagggaccgcgcaggcuccuuuguucuguauucuggcggagauggguccugg

SEQ ID NO: 417288 - RNA, 64 nt, Human
ucuccuuccagccagugaccuacccaaaccuuuuguucuguaaaacugcucuggaaauaccggg

SEQ ID NO: 417289 - RNA, 64 nt, Human
ucacaguuaauguucauaccuaguuuuauaagcuguucuguaacauaguguagcaaaaaaaaaa

SEQ ID NO: 417290 - RNA, 64 nt, Human
uguaacuuaugguuucugcuucaguauuguguugguucuguauuauaaauugcaccuuaauaga

SEQ ID NO: 417291 - RNA, 64 nt, Human
uugucgugcuccuguuucugagguugucgugugaguucuguacaaaaagcccccacaagucguc

SEQ ID NO: 417292 - RNA, 64 nt, Human
caauucugacuaugaaaaaugucucuuucaguuuguucuguaaauauuuagaaaagugacagcu

SEQ ID NO: 417293 - RNA, 64 nt, Human
gaagccagaaugggucaguuguagcugcugcaaaguucuguagcugauggucauuuaauugcau

SEQ ID NO: 417294 - RNA, 64 nt, Human
augugguauucuuuuguaacucaagucuugaaauguucuguaguguuaagcaaagucuccucuu

SEQ ID NO: 417295 - RNA, 64 nt, Human
guaaauuuguguuuauuuuuauaugauugaaugaguucuguaugaaacugagauguugucuaua

SEQ ID NO: 417296 - RNA, 64 nt, Human
ugcuagggguaaggugcuguuuuaugugaagauaguucuguaaaguuguuucaguuaaacuggg

SEQ ID NO: 417297 - RNA, 64 nt, Human
caugaaguuaagggcaagaaacaguaugccauguguucuguaccaucaugugucucuucuugcu

SEQ ID NO: 417298 - RNA, 64 nt, Human
cuagucuuccuccaggggucaguuccucacagugguucuguaccaaaacuugccaaauuccucc

SEQ ID NO: 417299 - RNA, 64 nt, Human
uuauuaggcacagagucauauuuuaagguagauaguucuguauugcugaaauaguaauuuuaau

SEQ ID NO: 417300 - RNA, 64 nt, Human
gcucaggaaauccaaacauuuguguuucaacaagggacaguaaacuguguguuuacagccaaaa

SEQ ID NO: 417301 - RNA, 64 nt, Human
uguuaacaacuugaauuacaaccgguuaucaguuggacaguaagauuuuaucccuuucucuucu

SEQ ID NO: 417302 - RNA, 63 nt, Human
cuguaaucccaguuauaggggaggcugaagcaggaggaucacuugaggccaggaguuugagac

SEQ ID NO: 417303 - RNA, 64 nt, Human
gagggaacccucccccacccuuugaagaguucaaguucuguacagguuuuuaaaacgugaagua

SEQ ID NO: 417304 - RNA, 64 nt, Human
cacagcuggggccgguuuuccucagcucuaggcuguucuguagcuuaucugccccucccccacu

SEQ ID NO: 417305 - RNA, 64 nt, Human
ugcgaacucauacaaaccaauagaauuucaacauguucuguagcuuagagugcucacuuacuac

SEQ ID NO: 417306 - RNA, 64 nt, Human
guuuucgagcagguccuggcugagcgggcucugaguucuguacuggaauugaguguaaagaugg

SEQ ID NO: 417307 - RNA, 64 nt, Human
gagagaaggaagggguggggggccuggaaacuucguucuguagagaacuauuuuuguuuguauu

SEQ ID NO: 417308 - RNA, 64 nt, Human
ucaauuuaacaugcguuguguuuuuucaguaaacguucuguaucuuuuugauauuccaugaccc

SEQ ID NO: 417309 - RNA, 64 nt, Human
gccaccgcgccgggccgguugcuggcaucuuaauguucuguagguggaauauuuccaauaaaca

SEQ ID NO: 417310 - RNA, 64 nt, Human; identical to SEQ ID NO: 417299

SEQ ID NO: 417311 - RNA, 64 nt, Human
accaaggccuccaucucacuguaaauaagucucuguucuguaaauagauguacagaagccaugu

SEQ ID NO: 417312 - RNA, 64 nt, Human
ugcauuguggauuuuaaaauguauacucuguacgguucuguaaaccgaaaaacuuuuguaaaua

SEQ ID NO: 417313 - RNA, 64 nt, Human
uccuuuccagcuggagaggccccaacacuggaugguucuguagggagccuagggagccugguca

SEQ ID NO: 417314 - RNA, 64 nt, Human
cauugcauagaagccauuggggaguucaguggaaguucuguaagaugugcauguacuauuugau

SEQ ID NO: 417315 - RNA, 64 nt, Human
aaaauguauaugcacuuauaauuuuccuaauaaaguucuguacucaaauguagccaccaacagu

SEQ ID NO: 417316 - RNA, 64 nt, Human
gccuaaccacacugcuuuauuuuacacuuaagaaguucuguaauuucacuaaguuuugguguuu

SEQ ID NO: 417317 - RNA, 64 nt, Human
ggccacuccucugcuuccucuguuggccccagauggacaguaaggggaaccuccaaugucucuc

SEQ ID NO: 417318 - RNA, 64 nt, Human
uugagcaucucucuucauuccuggaaugagccauggacaguaaaguugugugggaaaagaaggc

SEQ ID NO: 417319 - RNA, 64 nt, Human
aauagacuuccacuuuguaauuagaaaauuuuauggacaguaaguccaguaaagccuuaagugg

SEQ ID NO: 417320 - RNA, 64 nt, Human
cuagaauaauuugcaucucauuuugccuaaauugguucuguauucauaaacacuuuccacauag

SEQ ID NO: 417321 - RNA, 64 nt, Human
cccuugggccgauuguugaucauccagagccucaguucuguacuuguaaaguggagacagcagu

SEQ ID NO: 417322 - RNA, 64 nt, Human
agcaauggaugaaaguugcaggaaguuaguuuuaguucuguagaaggcaagaguaggguagacc

SEQ ID NO: 417323 - RNA, 64 nt, Human
caggcuggggcagguucuuaguuugccuggaauuguucuguaccucuuuguagcacguaguguu

SEQ ID NO: 417324 - RNA, 64 nt, Human
gauccugggguggccacgucacuuguguuuauuuguucuguaaaugcugcguuccuaauuuagu

SEQ ID NO: 417325 - RNA, 64 nt, Human
gaaauguauauuuuacuaauaaauuauugaccgaguucuguagauucuuguuagaucagcgggg

SEQ ID NO: 417326 - RNA, 64 nt, Human
ggcuucuucuaguuucugccuuacaagcaaugcuguucuguaaauuuauugaaaccucuggaac

SEQ ID NO: 417327 - RNA, 64 nt, Human
aacaaaaauauccacacccuuuuaauaaugcucaguucuguaggcucucuauccuagaggaauu

SEQ ID NO: 417328 - RNA, 64 nt, Human
caugcguccugaaaacaggacaucagauucacugguucuguaacccaguagcugugacguucca

SEQ ID NO: 417329 - RNA, 64 nt, Human
ugccugcagaguuucaggugcuuguugugugaaaguucuguagaugugugcaaauuuaacgaaa

SEQ ID NO: 417330 - RNA, 64 nt, Human
aaauuaucauugaauuuuuuguuuauuuuguaguguucuguauuuaucugcacuuuguguauau

SEQ ID NO: 417331 - RNA, 64 nt, Human
gagaaccaugucuauuuuuauaacuggagugugaguucuguaucuucucacauucuguauacug

SEQ ID NO: 417332 - RNA, 64 nt, Human
guugggagaggaagcuagaaggguuaugguuggaguucuguacaguguugaguuuccgacaggg

SEQ ID NO: 417333 - RNA, 64 nt, Human
ccauaaaauuccaguauuuaaaaagcaguuuacuguucuguacuuucuguuguaucacaaucag

SEQ ID NO: 417334 - RNA, 64 nt, Human
cugcuuucuuggcagaguugaauaguugggacagggacaguauagccugcaaagccuaaaagau

SEQ ID NO: 417335 - RNA, 64 nt, Human
gaaucuccaccuugccuaucuuuggguagaagcuggacaguacuguugcccucuuccaauccuc

SEQ ID NO: 417336 - RNA, 64 nt, Human
aucuaagcucacaagauacccacuuuucaggaugggacaguaucagaugaacuucaacccaugg

SEQ ID NO: 417337 - RNA, 64 nt, Human
aaugucuuccagaaaaauacauaagcuaguuucuguucuguaaagugauaucuuucauacuuga

SEQ ID NO: 417338 - RNA, 64 nt, Human
agugaguuuucuuauuauagugugauuaagccuaguucuguaucucguaauuguguauagcaug

SEQ ID NO: 417339 - RNA, 64 nt, Human
acacuaagacaguguagccugcugacuugagaauguucuguaaggacuggaaacacuagaaucu

SEQ ID NO: 417340 - RNA, 64 nt, Human
auaagcaguauguuuguuucauugugagauugcaguucuguauuucgaaugagucuaagaacca

SEQ ID NO: 417341 - RNA, 64 nt, Human
cguuaaucacuuuuaugaaggcucgaguucugcuguucuguaaaagagaauuggagaaugaaac

SEQ ID NO: 417342 - RNA, 64 nt, Human
uugcugauuuacaguauuguuauuuuugucuaaaguucuguaaauacaugcuuuaauguuaucu

SEQ ID NO: 417343 - RNA, 64 nt, Human
uuacacuccuuugucuuggaacugucuuauuuuuguucuguaaaugucuauugccguaaauugu

SEQ ID NO: 417344 - RNA, 64 nt, Human
gguuuagcuuuugugugugcaucagugacuuagaguucuguaauaacuuauuguaaaugcauga

SEQ ID NO: 417345 - RNA, 64 nt, Human
uuuaucuuauaauuucaguucaucuaaauuguguguucuguacaugugauguuugacuguacca

SEQ ID NO: 417346 - RNA, 64 nt, Human
aacaaaagaaguugccugcaugccgguccaaauuguucuguauaaagaugcucuuaaaagacac

SEQ ID NO: 417347 - RNA, 64 nt, Human
ggcccacuuuugaaauuucagugaauaccuuaauguucuguaauuugggaaguuucuggcaaca

SEQ ID NO: 417348 - RNA, 64 nt, Human
auguaagcacugucuugagggaaggaagaggucuguucuguauugccuuaaguugauugagguu

SEQ ID NO: 417349 - RNA, 64 nt, Human
aaauggaaauaugacaucggauguuucagcaacuguucuguaaauaaaaucuuugaucacacca

SEQ ID NO: 417350 - RNA, 64 nt, Human
ugaacuuuguuuaaaauuuuaaaaaaaggaacacguucuguaaacgagucgcuaaauacagaau

SEQ ID NO: 417351 - RNA, 64 nt, Human
uugucucccuuguuccccucaggauccauagaguggacaguaaaggugcucaguacauguuggc

SEQ ID NO: 417352 - RNA, 64 nt, Human
uucauauacaugugagguuuucuuuugcuugaguggacaguagcaccuguaucauugaacucau

SEQ ID NO: 417353 - RNA, 64 nt, Human
uaaucaugugucaggacauaaauuuugucacuugggacaguagcuuuccagcuaagauaauugc

SEQ ID NO: 417354 - RNA, 64 nt, Human
ggauaaaugacgcuguuaucaaaaguugccugggguucuguauuucuucucugcccuccaaucc

SEQ ID NO: 417355 - RNA, 64 nt, Human
acuguagacuguccucguccuuggcauuuucacuguucuguacaaggcugcuuguuuuuuuauu

SEQ ID NO: 417356 - RNA, 64 nt, Human
cuacagcuguuguaaaaggaugcucgcaccaaguguucuguaggcuuggggagggaucguuucu

SEQ ID NO: 417357 - RNA, 64 nt, Human
uguuauacuguguucauuucuaguugugcaggugguucuguauaaacuuaaaaggagauuuuga

SEQ ID NO: 417358 - RNA, 64 nt, Human
gguaacugucaagucaugauggagacuucagguuguucuguauaaaaugcaaaauaaauguuuu

SEQ ID NO: 417359 - RNA, 64 nt, Human
ugaucgacugacugcuuguugccaaacuggaaauguucuguagggauuuacuggcaugguauca

SEQ ID NO: 417360 - RNA, 64 nt, Human
uggggcccucggcguggggccaugccuucuguguguucuguagugucugggauuugccggugcu

SEQ ID NO: 417361 - RNA, 64 nt, Human
auguaaagcaguauuaaaauuuggccaaacaaguguucuguaucuacuuuaauaaaugguuauu

SEQ ID NO: 417362 - RNA, 64 nt, Human
uaaagaauuugacaagcaugaugcuauugaaauaguucuguaaggaagugguguucuuuauaca

SEQ ID NO: 417363 - RNA, 64 nt, Human
gaugcgaaaaauuccuucuuccaccgcccuucucguucuguaaagaaagaaaagaaacauagcc

SEQ ID NO: 417364 - RNA, 64 nt, Human
guuuuucuuguauaaauaggagucaugggcguuaguucuguaguaauaacuucccagcaccugg

SEQ ID NO: 417365 - RNA, 64 nt, Human
aggaccaacucuaggcucaauaugaagggauuuaguucuguaagcagcaaaaaagcuucuuuau

SEQ ID NO: 417366 - RNA, 64 nt, Human
guaaauauugggacaaucaugguaagcaaacuuaguucuguaacugcauuuuucaccuuaaaag

SEQ ID NO: 417367 - RNA, 63 nt, Human
agcguggcugcuuucaaguucuuugcaauuaaagguucuguauaaaaccaagaccucugugua

SEQ ID NO: 417368 - RNA, 51 nt, Human
ccuugagacagcugcugugagggacaguacugaagacucugcagcccucgg

SEQ ID NO: 417369 - RNA, 64 nt, Human
cgauugcaggagucccugccaucauguuuacagaggacaguauuuguggggagggauuuggggc

SEQ ID NO: 417370 - RNA, 64 nt, Human
acuccagucugggugucccagcgagccccugcagggacaguauggcugagggucaggugugcug

SEQ ID NO: 417371 - RNA, 64 nt, Human
uuuuaauugcauuuccagcaaggaaugacauucaguucuguaagaaaugagugguauuugaugu

SEQ ID NO: 417372 - RNA, 64 nt, Human
ggucuuuguuuucaguaacugaaucauagaacgaguucuguaucccucaggccugaugucagca

SEQ ID NO: 417373 - RNA, 64 nt, Human
cagccauuuuguuuuuaaugcagaaaaggaagauguucuguagcaagggggaauauuuuaaaaa

SEQ ID NO: 417374 - RNA, 64 nt, Human
uggucucugcccuggcauggacuggcacagagguguucuguaguugaauaggaagagccugucu

SEQ ID NO: 417375 - RNA, 64 nt, Human
cuuaacuuugagauuauaaaacuggguuuagccaguucuguauauuacuucaagccaguaagau

SEQ ID NO: 417376 - RNA, 64 nt, Human
gacaaaaagaaauaagauuauuuucugcuuuguaguucuguacuuuucgagagaagggaauagg

SEQ ID NO: 417377 - RNA, 64 nt, Human
uuuaaaaaagaaaaaaagccuacauuggcaucaaguucuguaucaauccaucuuacauugccau

SEQ ID NO: 417378 - RNA, 64 nt, Human
gucuguuuguaaagugcuuauggcuaacaguucaguucuguauuuguugacagguaaauaagug

SEQ ID NO: 417379 - RNA, 64 nt, Human
uguuugagaugagaaaccuuaaguuugcacaccuguucuguagaagcuuggaaacaguaaaaua

SEQ ID NO: 417380 - RNA, 64 nt, Human
ccaggagacucaggcaguggccuggagaggcuuuguucuguaacggugccuuuucuuagggucc

SEQ ID NO: 417381 - RNA, 64 nt, Human
acagauuauaaagcaauaugcauacaauguaguaguucuguaagaaaaaaguauuaugugcauu

SEQ ID NO: 417382 - RNA, 64 nt, Human
acucacaaugaaauagugauuaugaaaauacaguguucuguaauuaagcuaugucucuuucuuc

SEQ ID NO: 417383 - RNA, 64 nt, Human
gugugagcaggcguuggagggguucgagccccugguucuguaucuucagccagcaaacgaaacc

SEQ ID NO: 417384 - RNA, 64 nt, Human
gcgugaaguucccgggcauggucaugaaagcgugguucuguaagaaaucagagggagaaaggga

SEQ ID NO: 417385 - RNA, 64 nt, Human
aauguuugaauucugcuccucucucaucaauccaggacaguauuugaagugugagggcuuugug

SEQ ID NO: 417386 - RNA, 64 nt, Human
gucaaaggaaaucgccuagcuccaggcuguguuaggacaguauuagcaugaaggcugugcgacc

SEQ ID NO: 417387 - RNA, 64 nt, Human
gugccuccucuccucugcccaggggagggaguguggacaguaucuggaaguucugggauucagg

SEQ ID NO: 417388 - RNA, 64 nt, Human
ucaguguggcuuuaauuuuccccucuugcaguuuguucuguaaugccuuuuacauuuggacaca

SEQ ID NO: 417389 - RNA, 50 nt, Human
uuaaccucaagauggacugaguucuguauggcagaacuauugcuguucuc

SEQ ID NO: 417390 - RNA, 64 nt, Human
uuuuagaaaaauuaguuuuuggauuuuuuuuuaaguucuguauacuguuuugaaugaacuuuau

SEQ ID NO: 417391 - RNA, 64 nt, Human
cuacaaaagacgagucugucaaccuagugccuguguucuguacagggcuuauuuauuuacuguu

SEQ ID NO: 417392 - RNA, 59 nt, Human
uguccaaagacuuugcguaaccacgccugguucuguacauguggaaaacucacagaugg

SEQ ID NO: 417393 - RNA, 64 nt, Human
cuguuaagcacuaaucaguauagugcaacuccugguucuguacuguauuuuauaugcaacauau

SEQ ID NO: 417394 - RNA, 64 nt, Human
gcguguguguguguguguguguguguguguguguguucuguacccacuaggauuuguuuaggug

SEQ ID NO: 417395 - RNA, 64 nt, Human
agguggagugcaggggauguuagggcagugaaagguucuguaugacacugugaugguggguaca

SEQ ID NO: 417396 - RNA, 64 nt, Human
gugggaaucuuugaugccagaaauuuauaaagagguucuguaucuucacaccuugaauaagcau

SEQ ID NO: 417397 - RNA, 64 nt, Human
uuaugugguguugauuucaaucggcuacuguucuguucuguauuuuggcaucuguguuuuuaag

SEQ ID NO: 417398 - RNA, 59 nt, Human; identical to SEQ ID NO: 417392

SEQ ID NO: 417399 - RNA, 64 nt, Human
cauuacuaccacucccacucaacuagaagccuguguucuguacacaucauacugaacucuugau

SEQ ID NO: 417400 - RNA, 64 nt, Human
agugcuuaacagcugccguugaagcuaauauucaguucuguagaguuagaauaccuuuuguugu

SEQ ID NO: 417401 - RNA, 64 nt, Human
ggggcuaccucaacuaugugccuuaugguaacuuguucuguaccuccuaugccucauguccagc

SEQ ID NO: 417402 - RNA, 64 nt, Human
aacuccccuccccuugcccaaguaugaaauauagggacaguauguaugguguggucucauuugu

SEQ ID NO: 417403 - RNA, 64 nt, Human
ccuuaaaagguuccacuggagggcagaucccaaaggacaguaucaccguaaaccugcguuaaaa

SEQ ID NO: 417404 - RNA, 64 nt, Human
ggguguugaauccagcacgucugugugaguaacgggacaguaaacacuccacauucuucaguuu

SEQ ID NO: 417405 - RNA, 64 nt, Human
ggguuggccucuaacauguuccuuguuaauucuuguucuguaacaugcauucaagaagcuaggg

SEQ ID NO: 417406 - RNA, 64 nt, Human
cagcauccccacuucauuuuacccccagcauauuguucuguagucuuuucuugaaacaucuuga

SEQ ID NO: 417407 - RNA, 64 nt, Human
ucaaagaccccgugaucaccacgugugggcacacguucuguaggagaugcgccuugaagucagg

SEQ ID NO: 417408 - RNA, 64 nt, Human
ugaauggaauguuagaaauguugugugaauugaaguucuguauucauuauagauguagcccuua

SEQ ID NO: 417409 - RNA, 64 nt, Human
acucuguacucugcccuagauuguuuuagcuucuguucuguaaucaugaguuugguuggagaua

SEQ ID NO: 417410 - RNA, 64 nt, Human
gggcccuccaauuacugaggcauacguaacagauguucuguacagaguaaugagaugugugacg

SEQ ID NO: 417411 - RNA, 64 nt, Human
ggguccuccaauuacugaggcauacguaacaguuguucuguacagaguaaugagaugugugacg

SEQ ID NO: 417412 - RNA, 64 nt, Human
ggcccuucuuaccccacgcgugucugucccccucguucuguagcguuuguacauaauaaaacaa

SEQ ID NO: 417413 - RNA, 64 nt, Human
ccuggcuagaagcuacuugaccuuugauguuugaguucuguaagucuucguguucugacuuacu

SEQ ID NO: 417414 - RNA, 64 nt, Human
acgcuuucugggaacagcuuccaauggcaugggaguucuguauuuaaaagcaugaacuguguau

SEQ ID NO: 417415 - RNA, 64 nt, Human
uuucaugacuagaguugaggaagaacaggggauaguucuguaaguguucgggggacgucaacau

SEQ ID NO: 417416 - RNA, 64 nt, Human
uuccuuaguucuuaagugguugaauucgcugcuuguucuguaacguuauaaauaauuuauaucu

SEQ ID NO: 417417 - RNA, 64 nt, Human
uagaaagaaguagacaugggagacuuuucauuuuguucuguacuaagaaaaauucuucugccuu

SEQ ID NO: 417418 - RNA, 64 nt, Human
gaauuacaugaacauaccacccuaguaaaggcaaguucuguaagcuuacauugcuauuuguaaa

SEQ ID NO: 417419 - RNA, 64 nt, Human
auaccagggguuccccaggagagaccuucucuuaggacaguaaacucacuagaauauuccuuau

SEQ ID NO: 417420 - RNA, 64 nt, Human
cacuaagaacucuuccaggugacuucaaaacauaggacaguacaucucuaguagaauaugcccu

SEQ ID NO: 417421 - RNA, 64 nt, Human
augaaauagcaugagaaaacacagggcauuucuaggacaguaaaacguuaaaguacuggauuaa

SEQ ID NO: 417422 - RNA, 64 nt, Human
ggauugcugggaauggaagccaggcauggcacaaguucuguaaucuucaaaauaaaacuuuuuu

SEQ ID NO: 417423 - RNA, 64 nt, Human
agaggagucuugauuuuuuagacuucacugcggaguucuguacacccuuugcccugaugaauuu

SEQ ID NO: 417424 - RNA, 64 nt, Human
uuuugcuuuauugccuugcauucuaaugcaguuuguucuguaacucgagagccaguagcauugg

SEQ ID NO: 417425 - RNA, 64 nt, Human
acacaaauuuauauguuaacccaguuuucuugccguucuguaaguguuuuauucuuagugugau

SEQ ID NO: 417426 - RNA, 64 nt, Human
uuauuuuuauuauuuuuuuaaacaaaauuucacaguucuguaauguaggcacuuuuauuuucau

SEQ ID NO: 417427 - RNA, 64 nt, Human
cccucagccugccuugcagaccaaugggcuccauguucuguagcccccuccccuacgccucacc

SEQ ID NO: 417428 - RNA, 64 nt, Human
uuuuuguacaauaugaaaaggauauuaucuaccuguucuguagcuuucuggaauuuaccucccc

SEQ ID NO: 417429 - RNA, 64 nt, Human
uucugcuucaguugcugucagggcagcaguuccaguucuguaagucucacuuuguucagcugcc

SEQ ID NO: 417430 - RNA, 64 nt, Human
ccucuguaucucugcaggccauacugguuccauuguucuguauaauacugaauaaauaaauuua

SEQ ID NO: 417431 - RNA, 64 nt, Human
aguagcauguauacauugauuuugauuacaaaugguucuguauuauauaccaccguucugacug

SEQ ID NO: 417432 - RNA, 64 nt, Human
gaaguuacacacaguagcugacuucaaagugccuguucuguaaauuuuauuuuaaacuguuacc

SEQ ID NO: 417433 - RNA, 64 nt, Human
ugaaaauauuuacaagggaacuguuuuacgugaaguucuguauguugucuuuucaccuguggau

SEQ ID NO: 417434 - RNA, 64 nt, Human
aaguaaaauuuaaaauguaaauacaucaguucauguucuguauugaaauaggucugguugaucg

SEQ ID NO: 417435 - RNA, 64 nt, Human
aaaacacuaacuuaauguguauucauuuuaaauuguucuguauuuuuaaauugccaagaaaaac

SEQ ID NO: 417436 - RNA, 64 nt, Human
cauuuuccucccucucuuuaaaugaccaccuaaaggacaguauauuaacaagcaaagucgauuc

SEQ ID NO: 417437 - RNA, 64 nt, Human
auuuagguagccacgugucuagcggcuaccguuuggacaguauagcucuagagcauggcuuggu

SEQ ID NO: 417438 - RNA, 63 nt, Human
uuauuacggaaauggacaccaagaauaucuccugaggaucacuccaagaaaagagauccacau

SEQ ID NO: 417439 - RNA, 64 nt, Human
aauauauugaaaugccaacaauaguuugaauuguguucuguaaaaaaguauuagucaauuauuu

SEQ ID NO: 417440 - RNA, 64 nt, Human
auguggauauuuacuguaugacaacacauuuacaguucuguaaugcaaggaugcaguuuaaaaa

SEQ ID NO: 417441 - RNA, 64 nt, Human
guuuauuauguaaacaagagauuuggcaugacauguucuguauguuucagggaaaaaugucuuu

SEQ ID NO: 417442 - RNA, 64 nt, Human
uaaaauucuguaagcgcagagcagcagggaaaugguucuguaugagugcauugcugagccauca

SEQ ID NO: 417443 - RNA, 64 nt, Human
aaaguuugcuggagaaagcguccacucacagauuguucuguaaggaauguuauguaugggugag

SEQ ID NO: 417444 - RNA, 64 nt, Human
cuucugucccucuggugguggaacccagcacgugguucuguagggaccuuugucagugagcaag

SEQ ID NO: 417445 - RNA, 64 nt, Human
ggacuugcccgcguuccugaagcgcucucgagcuguucuguaaauaccuggugcuaacauccca

SEQ ID NO: 417446 - RNA, 64 nt, Human
ugagaaucucaaugauucuagaugacuucuugugguucuguaaugccaaaaggaaugaaggcuc

SEQ ID NO: 417447 - RNA, 64 nt, Human
uguccuccgacucuuucgcccgccugguggagcuguucuguagccgggaugacagcucucgccc

SEQ ID NO: 417448 - RNA, 64 nt, Human
uguuuucuuuuagacuucagagauguaucucucuguucuguacauuauuguuuaauauaagaaa

SEQ ID NO: 417449 - RNA, 64 nt, Human
guuuugauguacuguugacucuuucugucuguggguucuguauucauggaucgaagcaaccaug

SEQ ID NO: 417450 - RNA, 64 nt, Human
gaagggacaaugugauggcagaagacagcucuuuguucuguauugcucuaauuggccugcugcc

SEQ ID NO: 417451 - RNA, 64 nt, Human
uuccucgcuggcuguuggcuggaagcugcccuuuguucuguaccaugugggucucuccacagcg

SEQ ID NO: 417452 - RNA, 64 nt, Human
ggugauuagauuccuaagaucauagcauuaacaaguucuguacgagauaaaucaugcagauuga

SEQ ID NO: 417453 - RNA, 64 nt, Human
cagcguuccaucuuuguguuguagcagaugaaauggacaguaaugugaguucagacuuugggca

SEQ ID NO: 417454 - RNA, 64 nt, Human
uuugaugacagagaucuucauuaaacaagaucugggacaguaauaaaagauugcugcauaauuu

SEQ ID NO: 417455 - RNA, 64 nt, Human
gugcccagccccacaaaggcugcccgacucccugggacaguaguguggagucccagcccaggcu

SEQ ID NO: 417456 - RNA, 64 nt, Human
aaaaaugugaaaauuaauucuccccuaacauccaguucuguagccacucacuuuccacagaugc

SEQ ID NO: 417457 - RNA, 64 nt, Human
gcccagcuugcuuguguauaaguuguauuuaaugguucuguaacaauaacacuguguggcuguu

SEQ ID NO: 417458 - RNA, 64 nt, Human
caaacgucauauuucacagaugcgagaaaacuuuguucuguaaauaugaucaguguuuauauca

SEQ ID NO: 417459 - RNA, 64 nt, Human
gguggaucuagccaggagaaagacaguaacauguguucuguacuuucugggaagaucccugaag

SEQ ID NO: 417460 - RNA, 64 nt, Human
aaaaaagaaaacaaaaaacaaaaaaaggaaugauguucuguagagauggccuuucacuugagga

SEQ ID NO: 417461 - RNA, 64 nt, Human
uguugcugcuugucacccccaaguccccguggagguucuguauuuuaagaaacagugcguugag

SEQ ID NO: 417462 - RNA, 64 nt, Human
uuuuguauauugguuuuaugaugacguacaaguaguucuguauuugaaagugccuuugcagcuc

SEQ ID NO: 417463 - RNA, 64 nt, Human
uuuaaaacaaaugguagcaaaccaaccacacacuguucuguaucuugcucuguuugcuugauac

SEQ ID NO: 417464 - RNA, 64 nt, Human
uagcucucuuuuaaaaauaaaugucuccuucuguguucuguaauaugaggauaaauaaucuacu

SEQ ID NO: 417465 - RNA, 64 nt, Human
uccuucuggaaggcauagaacacgguuacagcugguucuguagaaagagggaaaagaugauugu

SEQ ID NO: 417466 - RNA, 64 nt, Human
acgaagcugacacugcaggguccugaguaaauguguucuguauaaacaaaugcagcuggaaucg

SEQ ID NO: 417467 - RNA, 64 nt, Human
cucgcuugcaccgcgggacgaggcugaccgggcuguucuguagacucaggaccguggcuccaga

SEQ ID NO: 417468 - RNA, 64 nt, Human
cugccucaggacugcgacgaaaccgguggggcugguucuguaauugugugugaugugaagccaa

SEQ ID NO: 417469 - RNA, 64 nt, Human
caguugccuucugcaacgcaaaguaauguuuugaguucuguaaguugcaugccaacaaugccuc

SEQ ID NO: 417470 - RNA, 64 nt, Human
ugaaacaucguggccucaggugccaggguuugauggacaguagcauuagaauuguggaaaagga

SEQ ID NO: 417471 - RNA, 64 nt, Human
uuugggaaagaucagagagggcagagguggcacaggacaguaaaggagaugcugugcuggccuu

SEQ ID NO: 417472 - RNA, 64 nt, Human
uuuuucaagagaucuuucuuuccaaaacauuucuggacaguaccugauuguauuuuuuuuuuaa

SEQ ID NO: 417473 - RNA, 64 nt, Human
ggacuacaggcaugcaccaccacacuuggccaauguucuguauuuuuaauagggacgggguuuu

SEQ ID NO: 417474 - RNA, 64 nt, Human
gucuuaugguucacaucuuguuuccuauagaaauguucuguauucucggaucaauuuccaaaug

SEQ ID NO: 417475 - RNA, 64 nt, Human
uggaaggacccaggagaggccccgaggugggaggguucuguaaauacagacuacugcgaguguc

SEQ ID NO: 417476 - RNA, 64 nt, Human
cccaaagaggagagcgcagcagagccaggggucuguucuguagcagccaccccccugcccccac

SEQ ID NO: 417477 - RNA, 64 nt, Human
aaaugcugugaaugcggagggaagugauguuuggguucuguagcugagagauuuuuauucauuu

SEQ ID NO: 417478 - RNA, 64 nt, Human
gacaaucauccacagcuauucccuccagcaucugguucuguacaaaaauuaaaugcuuauuugu

SEQ ID NO: 417479 - RNA, 64 nt, Human
gucaacaauuuuguguacauauuuggcauuuucaguucuguacgcaucugcggguugcagccca

SEQ ID NO: 417480 - RNA, 64 nt, Human
uuuccagauuuaccugccauugaaauuuuaaggaguucuguaauuucaaacacuacuccuauua

SEQ ID NO: 417481 - RNA, 64 nt, Human
uuugcugcacuucuuuuaguggcuuaaggauuuuguucuguaggggaguaggguuucauuggag

SEQ ID NO: 417482 - RNA, 64 nt, Human
ccccaccucacucucaccaagucaccagagggugguucuguaggaccucuuuuguugcuuaaga

SEQ ID NO: 417483 - RNA, 64 nt, Human
aacauuuugaccaaaaauccacacuauauguacuguucuguauuuuuaauuuuaaacugaacaa

SEQ ID NO: 417484 - RNA, 64 nt, Human
ucuucguucaugaauuagucuacagaaaaaaaauguucuguaaaauuagucuguugaaaauguu

SEQ ID NO: 417485 - RNA, 64 nt, Human
caccaagagcaaaggaucaacuuuuagucaugauguucuguaaagacaacaaaucccuuuuuuu

SEQ ID NO: 417486 - RNA, 64 nt, Human
aagagguagagugaugugcauuuaucuguuuucuguucuguaagucuagaccuucaaaccauuu

SEQ ID NO: 417487 - RNA, 64 nt, Human
gaaaggaauguuuuugauggugguuucaaagcucggacaguaacuaucuugagcccauuagaga

SEQ ID NO: 417488 - RNA, 64 nt, Human
uggaaccugaggcgccgagagggcgggaccugcaggacaguagccaaugaggugcggggagggg

SEQ ID NO: 417489 - RNA, 64 nt, Human
ugagugucacacaccuguuaauccaucuugagcaggacaguacuauacaaauagaaugcaagcu

SEQ ID NO: 417490 - RNA, 64 nt, Human
uuugcuucuccaaccaaaacaucaauguuuauuaguucuguauacaguacaggaucuuuggucu

SEQ ID NO: 417491 - RNA, 64 nt, Human
agaaucaguagggagaaacaaaaauacaagucccguucuguagcucuggcccuuugaauauguu

SEQ ID NO: 417492 - RNA, 64 nt, Human
caugggacuccucccaucccccaggcugguaccaguucuguaccauaugagaaaguugccuuca

SEQ ID NO: 417493 - RNA, 64 nt, Human
cuccccugugaugguggugguggauacuaauacaguucuguacgaugugaaggaugugucuuug

SEQ ID NO: 417494 - RNA, 64 nt, Human
uagauauaguuacucaagguauaagaagccuuguguucuguauuuuucuuguaguguuaguuaa

SEQ ID NO: 417495 - RNA, 64 nt, Human
agacuugccuuuguuucuguuagacugcuuuucaguucuguauugaguaucuuaaguacuguag

SEQ ID NO: 417496 - RNA, 64 nt, Human
ugcugcuacccaagaaaucuaauggaaugaauuaguucuguagaugacaauuucuucacccauu

SEQ ID NO: 417497 - RNA, 64 nt, Human
aguuuuuguuuugaaaagagcaaaaguaaaaaguguucuguagugagguuacauaucaggaaca

SEQ ID NO: 417498 - RNA, 64 nt, Human
aaagaaucagcagagaaaacaaaauacaaguccuguucuguaguucuugcccuuugaauauauu

SEQ ID NO: 417499 - RNA, 64 nt, Human
ucuucuuuauuccucucuccucuuucauuauucuguucuguauuccuuuccccuucauucucac

SEQ ID NO: 417500 - RNA, 64 nt, Human
uuuuccagacguaacugccauuaaauacuaaggaguucuguaguuuuaaacacuacuccuauua

SEQ ID NO: 417501 - RNA, 64 nt, Human
caggugccagcucuguucugauucaccagggguccgucaguagucauugccacccgcggggcac

SEQ ID NO: 417502 - RNA, 64 nt, Human
auuuauauccacggaguccuuggauccagugcuacgucaguaaauagcaccagcauuuugcaau

SEQ ID NO: 417503 - RNA, 64 nt, Human
cugccacggcaaccgccaagccccccucaaggugggacaguaccccggacccauccacucacuc

SEQ ID NO: 417504 - RNA, 64 nt, Human
cucucacgcagcuccacagcgcugucucgugaauggacaguagccacuuacaaacaaaucaaca

SEQ ID NO: 417505 - RNA, 64 nt, Human
acaucaguucuucaaauaaggacgcaaaucuucaggacaguaagcagaacaaucagaauggaau

SEQ ID NO: 417506 - RNA, 64 nt, Human
uggaaauaugucuuuaaguauuuuagacauuccucgucaguauuaggaauuuccaugggaaaag

SEQ ID NO: 417507 - RNA, 64 nt, Human
uuugacauuugaccuuugcagugucaugugagggcgucaguauagaggccuuugcaucugggcc

SEQ ID NO: 417508 - RNA, 64 nt, Human
uuuaaaugcuguugacugugcuauuaacugcugccgucaguaaacuccaaagaucuuuuuguuu

SEQ ID NO: 417509 - RNA, 64 nt, Human
cacuuuggcaggccgaggcagguggaucaccugacgucaguaguuugagaccagccuggccaac

SEQ ID NO: 417510 - RNA, 64 nt, Human
cgcuuuaaacauccugcagugcacaccucggucucgucaguaaggacuucacuuucuucugaac

SEQ ID NO: 417511 - RNA, 64 nt, Human
gcgaauaaaucuaguuguauaaauuuuuaaaugccgucaguagaaagcacacaagguuaugauu

SEQ ID NO: 417512 - RNA, 64 nt, Human
cugggcuggacuguugccaacaucaccuuaaagucgucaguaaaaguaaaaaggaaaaagguac

SEQ ID NO: 417513 - RNA, 64 nt, Human
guacccauuaaccauccccaccucccccugcaaccgucaguacccuuaccagccacugguaacc

SEQ ID NO: 417514 - RNA, 64 nt, Human
guuaacagacagcaagcagcugaacaagcaguaccgucaguacccacuugcuuuagcccauuau

SEQ ID NO: 417515 - RNA, 64 nt, Human
uugauugauggaaagugucugcacugacacuuuucgucaguagucuguaguuucguggccucuu

SEQ ID NO: 417516 - RNA, 64 nt, Human
cccccacuccagcccgcagcacauuuccgcuguccgucaguaauuguguccucucuuuaugcuu

SEQ ID NO: 417517 - RNA, 64 nt, Human
ugagcaugcuucauuggauucauuuuauuuuacacgucaguauuguuuuaaaguuucugucugu

SEQ ID NO: 417518 - RNA, 64 nt, Human
cucugucccuaggucagcuugcugcccuaggcuccgucaguaucaggccugccagacggcaccc

SEQ ID NO: 417519 - RNA, 64 nt, Human
uuucuuuaaauguuuuuggccaucaaguagcagucgucaguaggaguuuauaauaccaagaaug

SEQ ID NO: 417520 - RNA, 64 nt, Human
acugccagaaaauguaccuccaggcccugcaugccgucaguaacccgcccggcauuggugcucu

SEQ ID NO: 417521 - RNA, 64 nt, Human
ugugcacauggacugaaucacauagauucuccuccgucaguaaccgugcgauuauacaaauuau

SEQ ID NO: 417522 - RNA, 64 nt, Human
uguaacuacaggaaaaaaauaaaaaauauauaguggacaguaaccuuucaaucaaaacucagua

SEQ ID NO: 417523 - RNA, 64 nt, Human
auagaauguugcagaauguggagggauguaaaauggacaguacuaggguagaggggaagucaga

SEQ ID NO: 417524 - RNA, 64 nt, Human
uugcuccuccucuugaaaaugauuaggcacuuaaggacaguaaagcuguauuuucuggaaggaa

SEQ ID NO: 417525 - RNA, 64 nt, Human
aguguagaauugcugugagguauggggcuaggggcgucaguagggccuugaagguuauggacag

SEQ ID NO: 417526 - RNA, 64 nt, Human
cgacugccgugacaucauucagcgcaugcaccuucgucaguacgagcugcucuaagaagggaac

SEQ ID NO: 417527 - RNA, 64 nt, Human
gggggcaccgggccgcccacccacucccaaaauccgucaguauucacuggaccucaggcccugu

SEQ ID NO: 417528 - RNA, 64 nt, Human
cucuugugaaaagagaggauauguucacaccuagcgucaguauuuucccugcuagggguuuuag

SEQ ID NO: 417529 - RNA, 64 nt, Human
aagcuuuaacaaauauuuaaagacaaaaaaaucacgucaguaaaauacuaaaaggcucauuuuu

SEQ ID NO: 417530 - RNA, 64 nt, Human
uuucccucgugcugugucccgcucggguuccaauggacaguaucagggcuuguuugacuuaggu

SEQ ID NO: 417531 - RNA, 64 nt, Human
guuggacaugucuaucuucuggaaacuauggcauggacaguaaggauucagaagugcaugaagg

SEQ ID NO: 417532 - RNA, 57 nt, Human
agaaaucagcaagcaccuagcuuaauaggacaguaaaucuguguggggcuagaacaa

SEQ ID NO: 417533 - RNA, 64 nt, Human
cucaguuugcuaacuccccaugcaucuuugugaaggacaguaucuaguuuaucuguaggucagu

SEQ ID NO: 417534 - RNA, 64 nt, Human
ggcccacaguggccagugccauaggcagugcuguggacaguagaggcugccaaaggcaagggcu

SEQ ID NO: 417535 - RNA, 64 nt, Human
aucgacuuuuuaacaacuguugagauguuucaugggacaguagaacucugacucaccaacuggg

SEQ ID NO: 417536 - RNA, 64 nt, Human
gaucccuccccaacccacuccauauuugggucauggacaguaaaggcaguuggauucucauaga

SEQ ID NO: 417537 - RNA, 64 nt, Human
ccucaugggcauugucucuguuucccagugggguggacaguauaucagauggucagaacaaaua

SEQ ID NO: 417538 - RNA, 64 nt, Human
aaaaauagcaauuugccccuacucgcucagagugggacaguagugaacagagcugggauuccau

SEQ ID NO: 417539 - RNA, 64 nt, Human
cuuuuuaauuguauccucuaguauuauagauauaggacaguacuguaucauaccucugugaaug

SEQ ID NO: 417540 - RNA, 64 nt, Human
uauuaaaaauggggaauugcacauuuuaccuuuuggacaguaauuucuaucacaguuagaagga

SEQ ID NO: 417541 - RNA, 64 nt, Human
ugucaccaagugaacauacuucucaugguggguuggacaguaauacauguuagagggucagaag

SEQ ID NO: 417542 - RNA, 64 nt, Human
uuuggaagggucucucuccaggucagccuggaagggacaguaucguuuguuuaugaaaugccac

SEQ ID NO: 417543 - RNA, 64 nt, Human
gcuccaccuucuagggacccaguuuguuggaguaggacaguaacauggcaggaaucggacuucu

SEQ ID NO: 417544 - RNA, 64 nt, Human
aguaguuuggucagcuaaaacucagcugcagccuggacaguagagcgagaccccaucuuaaaaa

SEQ ID NO: 417545 - RNA, 63 nt, Human
ggggauggagucccaaggcaagcgccccaaaccucgggccacaagacaccacuuccccuuuac

SEQ ID NO: 417546 - RNA, 63 nt, Human
gauauaacuuuguuuuguuuacagaguaccugcucgggccagguaaaugcuauuggauguaau

SEQ ID NO: 417547 - RNA, 63 nt, Human
aggcccuggaaggagaagcaccaccuuacccauucgggccaguuucucccucuucaccccugc

SEQ ID NO: 417548 - RNA, 63 nt, Human
gaaaccaagccccaugagcagcaguggaagaccucgggccaugcggccuggggaggacuuggu

SEQ ID NO: 417549 - RNA, 63 nt, Human
cuccagaaagucgagcagcacccaccuccaaccucgggccagugucuucaggcuuuacugggg

SEQ ID NO: 417550 - RNA, 64 nt, Human
agagaccaugugcccgagcaucugguugaccggcaugaaguacaucagccugucuuagccugag

SEQ ID NO: 417551 - RNA, 64 nt, Human
gagaucugucccuuuuagagacaccuuacuuaugaugaaguauuugggagagugguuuuucaaa

SEQ ID NO: 417552 - RNA, 64 nt, Human
gaugccuaagcuguauuucuccaaauaaaucaagaugaaguacugcccaaguuaaauauugaua

SEQ ID NO: 417553 - RNA, 64 nt, Human
auuuuuuggugcuaagggauacuuugucauuaugaugaaguaaguguuaagugucagauaaaua

SEQ ID NO: 417554 - RNA, 64 nt, Human
uguacuuaauccugugcugucgagggauggauauaugaaguaaggugagauccuuaaccuuuca

SEQ ID NO: 417555 - RNA, 64 nt, Human
gucccucuucccaccccucucuucuagcuugguaaugaaguauauuuauuggugaaggaaacag

SEQ ID NO: 417556 - RNA, 64 nt, Human
aggaauagagccaaaugagguaggugucugagccaugaaguauaaauacugaaagaugucacuu

SEQ ID NO: 417557 - RNA, 64 nt, Human
ugcacugagaaauuagcauucaggccuuacccccaugaaguauuacuguuaacauauguucgga

SEQ ID NO: 417558 - RNA, 64 nt, Human
ugacuaagucuuagguggguugggaagacagauaaugaaguaggcaaagagaaaaggacccaag

SEQ ID NO: 417559 - RNA, 64 nt, Human
guaacuuauuaaaggcuaugacuuaaauuugaagaugaaguacaguguucuagguuugcugaga

SEQ ID NO: 417560 - RNA, 64 nt, Human
gaaaugggguauuuuugcuaucagcucuucugcuaugaaguaguaaaaggcagucuauaauuaa

SEQ ID NO: 417561 - RNA, 64 nt, Human
guacccagggaugggcaggcuuuggccuagggacaugaaguaugggaguggguggcuguggcac

SEQ ID NO: 417562 - RNA, 64 nt, Human
uaggggaaauggcacuuaauagagguuuaauggaaugaaguacuuucaacccauugaugagagu

SEQ ID NO: 417563 - RNA, 64 nt, Human
uuucccaugagccaacugggaaacaugguauaucaugaaguaaucuugucaaggcaucuggaga

SEQ ID NO: 417564 - RNA, 64 nt, Human
cauuagguccugcuggguguucucaguccuugccaugaaguaugguggugucuagcacugaaug

SEQ ID NO: 417565 - RNA, 64 nt, Human
ucaaagaagggauccucuuucaaaggcuaccuuuaugaaguagacacuauugcccucagaauga

SEQ ID NO: 417566 - RNA, 64 nt, Human
agcuuucgauuaucaguguaguaccugacuaaaaaugaaguaauacccuuaaaccauuuauaau

SEQ ID NO: 417567 - RNA, 64 nt, Human
uuuuccuuaaagcaauuuuuuucuuuucgauuuaaugaaguauugcuagcugaagccaguuuga

SEQ ID NO: 417568 - RNA, 64 nt, Human
aguuaaauccuacagcauaaucaauaacucgcauaugaaguaaaaaggaauacugugaaagggg

SEQ ID NO: 417569 - RNA, 64 nt, Human
auuuuucauuuggaaguccaauagggcaaauugaaugaaguauuauuaucugucucuuguagua

SEQ ID NO: 417570 - RNA, 64 nt, Human
gagaucugucccuuuuagagacaccuuacuuauaaugaaguacuugggaaagugguuuucaaga

SEQ ID NO: 417571 - RNA, 64 nt, Human
caagcuacauucuguauuugccaguuuccacagcaugaaguacauagcuuccuuagcaaggagu

SEQ ID NO: 417572 - RNA, 64 nt, Human
gugauaugaaaauaucuggguuuuucuuuugaugaugaaguauugcuaauauuaccgugguuua

SEQ ID NO: 417573 - RNA, 64 nt, Human
guauuccuacacauauuagaaacucuucuaauaaaugaaguaaaaaaauuaaaaagaauacaaa

SEQ ID NO: 417574 - RNA, 64 nt, Human
aauucuguuuuaaaucaaugaccuaagaucaacaaugaaguauuuuauaaauguauuuaugcug

SEQ ID NO: 417575 - RNA, 64 nt, Human
ucuagcaccauaaggccagggagcugcugccagaaugaaguaggaaagaggagggauccaucug

SEQ ID NO: 417576 - RNA, 64 nt, Human
gcaggccugguacucagauuuugcuaugagguuaaugaaguaccaagcugugcuugaauaauga

SEQ ID NO: 417577 - RNA, 64 nt, Human
augcuugguuuggggaguguguggggugggcuguaugaaguagcauuuugggggugggugggug

SEQ ID NO: 417578 - RNA, 64 nt, Human
auccauaaaauugcucuuuacuuuagcuuaucaaaugaaguauuauuuuguggacuggaggcca

SEQ ID NO: 417579 - RNA, 64 nt, Human
uggcuguggguuacauuaaauaugugaacauaguaugaaguagcaucauuuuaggguuauucug

SEQ ID NO: 417580 - RNA, 64 nt, Human
uuaauagauuauuaucaacuagagauauuuauaaaugaaguauauacuuuuaaaacauguaagu

SEQ ID NO: 417581 - RNA, 64 nt, Human
auguuguuauuuggauuucugcacuguuuaacaaaugaaguaaaagaaaaacacuacugcaauc

SEQ ID NO: 417582 - RNA, 64 nt, Human
ccuacuggaaauagucuaaaauuaugauuauaacaugaaguagugcaugguuauuuuacauagu

SEQ ID NO: 417583 - RNA, 64 nt, Human
acugguaguuacagucuuagguuaaaguauucuaaugaaguaugggaacuaaauugcugguuuu

SEQ ID NO: 417584 - RNA, 64 nt, Human
uaaaucugcacuuucuaaauaucaaaaaagggaaaugaaguauaaaucaauuuuuguauaaucu

SEQ ID NO: 417585 - RNA, 64 nt, Human
uuauuauguaaauuauaguauauguaaguagcuaaugaaguaaagaucaugaagaaagaaauug

SEQ ID NO: 417586 - RNA, 64 nt, Human
gggaagagugggagggggaguuaaauccagucuuaugaaguauuguuauuaaaugucuuuuuaa

SEQ ID NO: 417587 - RNA, 64 nt, Human
uauauuuuuacuauuaaaauauucaguuuuuuaaaugaaguagaacuugaguucauguuuuaua

SEQ ID NO: 417588 - RNA, 64 nt, Human
aggaaguagauuaauugauccugucaccaaccauaugaaguaggcacuguuaccaucugcaucu

SEQ ID NO: 417589 - RNA, 64 nt, Human
agcuuuguugguaaaagugacauguuaaggggcuaugaaguaaauaugcugcaguuaauuaugc

SEQ ID NO: 417590 - RNA, 64 nt, Human
uaacuugaaaaggagcauuucacuauaaaagauaaugaaguagguaaugaaaucaguccuugaa

SEQ ID NO: 417591 - RNA, 64 nt, Human
cacccacugaaaggaaagugcuuuccagaauaauaugaaguaucuaaaagugucaccuuuucuu

SEQ ID NO: 417592 - RNA, 64 nt, Human
ucuuuuugugguugcuggcuggguacuguauuuaaugaaguagagaauagcacuugcaaaaaua

SEQ ID NO: 417593 - RNA, 64 nt, Human
uuuucuucccauuuguaauguaucuuauuuauauaugaaguaaguucugaaaacuguuuauggu

SEQ ID NO: 417594 - RNA, 64 nt, Human
acauauuagcucauucaguccccagacagacgggaugaaguagguauuguuacuguucccauuu

SEQ ID NO: 417595 - RNA, 64 nt, Human
gagaacaaaaaugaauagggauuucacuugggaaaugaaguacuuuaguuggcuuccgaguucc

SEQ ID NO: 417596 - RNA, 64 nt, Human
gaugauauucucaccauccugacugaagugaacuaugaaguaagcaacaaggaugacaagaaaa

SEQ ID NO: 417597 - RNA, 64 nt, Human
aagaaaauguuuauaaucuaucucauuaagaaagaugaaguauuagauuuuacaucauaacaca

SEQ ID NO: 417598 - RNA, 64 nt, Human
agaccaaauaucaagaucauuuugagacucugaaaugaaguaaaagagauuuccugugacaggc

SEQ ID NO: 417599 - RNA, 64 nt, Human
uaccuaacgaaguauccuucagccugaaagaggaaugaaguacucauacauguuacaacacgga

SEQ ID NO: 417600 - RNA, 64 nt, Human
auuuaauuuuuaaaagacuuugauguguuuuuguaugaaguacuuuuaacguauguauuucauu

SEQ ID NO: 417601 - RNA, 64 nt, Human
aauuauuuuuaacaugugcuuuuccaaauuaaaaaugaaguagaguauaccaaaugcauaaacu

SEQ ID NO: 417602 - RNA, 64 nt, Human
augcugcuugccuccaccagauguccacaacaauaugaaguacagcagaagccccaagcaacuu

SEQ ID NO: 417603 - RNA, 64 nt, Human
acugugcauauuauagaguuguagccaccucacaaugaaguacuacagccugugcugucuuaau

SEQ ID NO: 417604 - RNA, 62 nt, Human
cuuuugaguucucauauuaacauuuagauaacauaugaaguauggcccccuuggauccuugu

SEQ ID NO: 417605 - RNA, 64 nt, Human
aacauuuguacuauuuuaaaugaauaaugaccuuaugaaguaugcuaucuguaggcugaaauua

SEQ ID NO: 417606 - RNA, 64 nt, Human
gggcuugccuggcuuggcugcagugcacuuugaaaugaaguaucuguccuuuggcccagccccu

SEQ ID NO: 417607 - RNA, 64 nt, Human
agcuuuguugguaaaagugacauguuaaggggcuaugaaguaaauaugcugcaguuaauugugc

SEQ ID NO: 417608 - RNA, 64 nt, Human
guugaacccacacacaccccugcagccuccccagaugaaguagguguauuccccuggcagucug

SEQ ID NO: 417609 - RNA, 64 nt, Human
agugcuagauucuguuauuuucuucuuauuuuggaugaaguaccccaaccuguuuacauuuagc

SEQ ID NO: 417610 - RNA, 64 nt, Human
gaaggaaaaaugaagagauuauaaaagucagcuaaugaaguaagauacguaguaaagucaggac

SEQ ID NO: 417611 - RNA, 64 nt, Human
ccauauuuauaacacagcaagaguauuuacaggaaugaaguagcugacacauauuuuuagacuc

SEQ ID NO: 417612 - RNA, 64 nt, Human
aauuccauggaauuucuaguaugagacuauuuauaugaaguagaagguaacucuuugcacauaa

SEQ ID NO: 417613 - RNA, 64 nt, Human
uccacuaggccuuuucauuccaaaggggaccccuaugaaguaaagaacugcacaugaagaaaua

SEQ ID NO: 417614 - RNA, 64 nt, Human
acgaucggaaugcuuuuuauuaaaagcaaguagcaugaaguauugcuuaaauuuuagguauaaa

SEQ ID NO: 417615 - RNA, 64 nt, Human
aaaaucuugugccuaaaaguuuuuuugcuuaauuaugaaguagacaugcauguuuacauuuaug

SEQ ID NO: 417616 - RNA, 64 nt, Human
uggaaacaauacauuguaaauaguuuuucauuguaugaaguaguguucacauuaaaaagauguu

SEQ ID NO: 417617 - RNA, 64 nt, Human
ugugguccauuguucauuuuaauucacauuucuuaugaaguaugguaacagggagggagacacc

SEQ ID NO: 417618 - RNA, 64 nt, Human
agcaaaaauaaaguucggccugggucucucuuugaugaaguaagaaagacagcacgcuuaaacc

SEQ ID NO: 417619 - RNA, 64 nt, Human
aacuucaguuaaugucaugcaucaguuuuaacauaugaaguaaaguguucuauccaggauuaaa

SEQ ID NO: 417620 - RNA, 64 nt, Human
gcuaccucaccuggccaaaacaguuuuuuuagaaaugaaguauauuagacaacaacaaaaggaa

SEQ ID NO: 417621 - RNA, 64 nt, Human
agcuaguuguggguggaguguguucucagaagguaugaaguagauguuuuccuagguguuggaa

SEQ ID NO: 417622 - RNA, 64 nt, Human
accuaugaaauaacauccucucaaauguuugcugaugaaguacaaguugaaauguaguuauugg

SEQ ID NO: 417623 - RNA, 64 nt, Human
auauaaaaucucaagauaaaaaaacacuucuuaaaugaaguauagaauuugacucauacuugga

SEQ ID NO: 417624 - RNA, 64 nt, Human
uuaagaaaacucaugcucuguuucucugaaucaaaugaaguagaaguuuacaaagcuaacuuuc

SEQ ID NO: 417625 - RNA, 64 nt, Human
uugaaaaauaucccacuauaguugcuucaugaguaugaaguaagauggccucugauuuacacug

SEQ ID NO: 417626 - RNA, 64 nt, Human
aaaacuguggcuuacguuuugaaguauucugagaaugaaguauuaagauccaauuucuauaagc

SEQ ID NO: 417627 - RNA, 64 nt, Human
gguaugggaagaaauuuggcugaucgaugcaccgaugaaguaaacgccuuagugcuucagaccc

SEQ ID NO: 417628 - RNA, 64 nt, Human
cacgcaauggaacauuauuagacucuaaaaagaaaugaaguacucacacaugccacaacaugga

SEQ ID NO: 417629 - RNA, 64 nt, Human
uguaaaauggggaaaagguuaccuuuucugccacaugaaguagcuggcuggugaaaugauguca

SEQ ID NO: 417630 - RNA, 64 nt, Human
gacacuaguugucaaagguguucugagauaagccaugaaguauuuuugagguuuuucuuuucuu

SEQ ID NO: 417631 - RNA, 64 nt, Human
cauuuaaauuguagaacugauauuuuucauuuauaugaaguauaagccucuacugggucuauau

SEQ ID NO: 417632 - RNA, 64 nt, Human
augucacuuuuuugguuuuuauuauacaaaaaccaugaaguacuuuuuuuauuugcuaaaucag

SEQ ID NO: 417633 - RNA, 64 nt, Human
gaaagugcugaaauuuaauuaaaaucagucuuauaugaaguauguuccaauccaugugggaacu

SEQ ID NO: 417634 - RNA, 64 nt, Human
guuagcugagaauauucucuauuuuauaaauaauaugaaguagguuggucucucugcuucucua

SEQ ID NO: 417635 - RNA, 64 nt, Human
uuaaaauuucguuuuugguuuagauuauggaugcaugaaguaagggagugaaucaguuucuugu

SEQ ID NO: 417636 - RNA, 64 nt, Human
aagcuaaagauuuacuagaaggucaagcuaaaaaaugaaguaaauguaugaugaauuuuaaguu

SEQ ID NO: 417637 - RNA, 64 nt, Human
agcuuacuaucuuguguuuguuuauuugcuuuuaaugaaguauuuuguguagaagguuaaauua

SEQ ID NO: 417638 - RNA, 64 nt, Human
aguuuuuuuaaaaagaugcuguugugccuauaucaugaaguacauuaauuucucauguaaaaaa

SEQ ID NO: 417639 - RNA, 64 nt, Human
uggauuuugaccauugauuaccuuucucaauguaaugaaguauuuuacagucaauuuguggugu

SEQ ID NO: 417640 - RNA, 64 nt, Human
aacuucaucaguucaaauaaguuuuaauugucaaaugaaguauaaacacaugaacuuucuagaa

SEQ ID NO: 417641 - RNA, 64 nt, Human
auuggauguaugaugaguguugugauuggaacugaugaaguaaaauaaguaucuagauuugaca

SEQ ID NO: 417642 - RNA, 64 nt, Human
ccuacgcuucucccugaaguuuacagcucagcuaaugaaguacuaauauaguauuuccacuauu

SEQ ID NO: 417643 - RNA, 64 nt, Human
ugcauuaaaccaaguccauuuugaaugaccuaaaaugaaguaacacaaucagaaaucccaugug

SEQ ID NO: 417644 - RNA, 64 nt, Human
aguugccaccaugacugagucuucucaguugacaaugaaguagccuuuuaaagcuagaaaacug

SEQ ID NO: 417645 - RNA, 64 nt, Human
ccuaguaacuagagaaaagacuuauuuauauaaaaugaaguauuuaugaacugugauaaagcau

SEQ ID NO: 417646 - RNA, 64 nt, Human
aggggcuaagugcuggugucagggaaauuccauaaugaaguagaaugcugcuccugcauuaaga

SEQ ID NO: 417647 - RNA, 64 nt, Human
ugugaaaccaauauuggcaaauaguacuuuaaugaugaaguaaaugaccagaaauuauagaaau

SEQ ID NO: 417648 - RNA, 64 nt, Human
ccuugaaugacuacagauuauuuugugaaggaggaugaaguaauguguguucuuguaaaauuaa

SEQ ID NO: 417649 - RNA, 64 nt, Human
gaaacucuauuuugaugucaauauagauuacuguaugaaguagcuuugugucuguuaccugucc

SEQ ID NO: 417650 - RNA, 64 nt, Human
ggccuugaaucaggucagaguguuaacugucaacaugaaguauuuucacuucgcagcaucaacu

SEQ ID NO: 417651 - RNA, 64 nt, Human
cuugaccaccuuggaagucaaugacuauuuugagaugaaguauuuaacuaugaauaucaugaag

SEQ ID NO: 417652 - RNA, 64 nt, Human
gagaagguacuaaauacacuuuagaaguaaaaauaugaaguaccgagaggcuaaacccacuggc

SEQ ID NO: 417653 - RNA, 64 nt, Human
uauucuauuuacaggaugauuuuuaaacugucaaaugaaguaguguuaaccucaaauaggcuaa

SEQ ID NO: 417654 - RNA, 64 nt, Human
gagaaaaacaaacagaccaaaugcccaggagcccaugaaguaauagcguaaaguaaaguaugau

SEQ ID NO: 417655 - RNA, 64 nt, Human
augcaaaguucaacucaauagguuauugaucaccaugaaguauugaucauuuucuaucucaaaa

SEQ ID NO: 417656 - RNA, 64 nt, Human
uuuaauuucuaacuaaauuaguauggcacuaguuaugaaguaucugcuuaaaacccuucaucau

SEQ ID NO: 417657 - RNA, 64 nt, Human
uccauuuaucauacaggaucauuaugaaaguaaaaugaaguaguauauaugaaaaugcuuuuua

SEQ ID NO: 417658 - RNA, 64 nt, Human
uauauguuaaagccugcuaaaucauucacuuagaaugaaguaaccucaagguaccaaauacccc

SEQ ID NO: 417659 - RNA, 64 nt, Human
uuuggagauccuugucaguuuuauuuucuauuugaugaaguaagacuguggacucaauccagag

SEQ ID NO: 417660 - RNA, 64 nt, Human
gauuuuuaauaauaucccucagacuguuucccuuaugaaguaauuuggggauuuuagugaucuc

SEQ ID NO: 417661 - RNA, 64 nt, Human
aauaguauaguaaccacaagugauuggcuuauaaaugaaguagaaaugcuuuuuaauauuccaa

SEQ ID NO: 417662 - RNA, 64 nt, Human
agaucugauaacuugaauucagaauauuaagaaaaugaaguaacugauuuucuaaaaaaaaaaa

SEQ ID NO: 417663 - RNA, 64 nt, Human
auuugaaagacuuuuguuuuucuugacuuaauucaugaaguaucauuuuuugacugagucucca

SEQ ID NO: 417664 - RNA, 64 nt, Human
agaagaaaauacgguuucaggcuuucuugcagauaugaaguauucuuggaaugcaauaaguaug

SEQ ID NO: 417665 - RNA, 64 nt, Human
ugccauuuggaaaguaguggcccugcaagccuaaaugaaguaguauuuguaggccuggguggca

SEQ ID NO: 417666 - RNA, 64 nt, Human
aauuaagauccuaaacucucuagcuuaaguguaaaugaaguacaguaguuucccuacugaaccc

SEQ ID NO: 417667 - RNA, 64 nt, Human
ucaagcccaagauacaaaugguuuauggcuaugaaugaaguauuuguuguagauaguacccccu

SEQ ID NO: 417668 - RNA, 64 nt, Human
ggcccagggaguuucagaugccuuugagaaaugaaugaaguagagagaaaauaaaagaaaaacc

SEQ ID NO: 417669 - RNA, 64 nt, Human
uuagggaaaacagucugagaaaugaauaaaaagcaugaaguacguguguguguguguguguuac

SEQ ID NO: 417670 - RNA, 64 nt, Human
uagaaaacaggugcuuaauugcaauaaaauuacuaugaaguauauuaaaaaucacgacauugua

SEQ ID NO: 417671 - RNA, 64 nt, Human
ccucagacuucuggcacuauuacauaguaagcacaugaaguaguuugauaauaaauagcaguuc

SEQ ID NO: 417672 - RNA, 64 nt, Human
ugugagauuguuggacugauuugagaucaugccuaugaaguaccuagcacacugccuaguacau

SEQ ID NO: 417673 - RNA, 64 nt, Human
gaucuccuugagauccugauagccuguuacaggaaugaaguaaaggucaguuuuuuuuuguauu

SEQ ID NO: 417674 - RNA, 50 nt, Human
gaagaaagcaaaaaauauaaaugaaguacuuguaccuauauuaauuaugc

SEQ ID NO: 417675 - RNA, 64 nt, Human
gugaggcccuuauauaauuacucccauuuugcagaugaaguaacugaggcuuagaaagguuaau

SEQ ID NO: 417676 - RNA, 64 nt, Human
gucccuuccuaccuucuuccuccaagagaguaucaugaaguaaacuacaaacuucagaagaaag

SEQ ID NO: 417677 - RNA, 64 nt, Human
uauuuugcaaguauggaagcugaggcagggcaacaugaaguaacuuacauaacucauacaguaa

SEQ ID NO: 417678 - RNA, 64 nt, Human
cauggagagaugccccauggugggcaggcagaugaugaaguacuggcagguaggcagccuugcu

SEQ ID NO: 417679 - RNA, 64 nt, Human
aaguuauuucaaaguuaaguuuuaaacaaaauacaugaaguagugucugccauacauguuaaua

SEQ ID NO: 417680 - RNA, 64 nt, Human
cuucagggaaugugacauacaaaguuuguaagacaugaaguaauaacgauaaugauaacaauaa

SEQ ID NO: 417681 - RNA, 64 nt, Human
ugagucacugugccuggccaaguuucaguucuauaugaaguauuugauguuuuguuugaaacaa

SEQ ID NO: 417682 - RNA, 64 nt, Human
uuuuguuucccccuuccacauucuuuuauuauacaugaaguaacugguauguguacacaagcau

SEQ ID NO: 417683 - RNA, 64 nt, Human
uaacugacauuaaguguuccugcugggaugaauuaugaaguauuccuuccaaagaugucaaugg

SEQ ID NO: 417684 - RNA, 64 nt, Human
guuacaaaguauugaauaaacuauuugccaaaguaugaaguauuugaucuacaauuuaauaaau

SEQ ID NO: 417685 - RNA, 64 nt, Human
augaguagaguaagauuugggugggauggguaggaugaaguauauugcccaacucuauguuucu

SEQ ID NO: 417686 - RNA, 64 nt, Human
ccagcagccaccuguggguauuuaugaguuucauaugaaguacugugccccuucccuuccucau

SEQ ID NO: 417687 - RNA, 64 nt, Human
ugauggcugggagcucuggcagccauacggcaccaugaaguagcggcaauguuugagcggcaca

SEQ ID NO: 417688 - RNA, 64 nt, Human
guacuguuggaguugaugggcaccaugcuuucucaugaaguagcauuucccuaccaucaagcca

SEQ ID NO: 417689 - RNA, 64 nt, Human
ugacuuuuuuuuuuguccauggaauauuugacagaugaaguaggacugcugagaagauucugau

SEQ ID NO: 417690 - RNA, 64 nt, Human
uuagguucacauaccugccugcuagucgggcaacaugaaguaggacaguucuguugauuuuuua

SEQ ID NO: 417691 - RNA, 64 nt, Human
gucagaacuauaacauucaauuugcuauuuacaaaugaaguauuucauguaauauaagugaaca

SEQ ID NO: 417692 - RNA, 64 nt, Human
gacuaaguugcaagaucuuauuuauuaacuagguaugaaguauaaacccauuuuggugcaauau

SEQ ID NO: 417693 - RNA, 64 nt, Human
gggcugauacuaugaggcugaaacaauccuugugaugaaguagaucaugcagugacauacaaag

SEQ ID NO: 417694 - RNA, 64 nt, Human
caacaaagugaacuguuuugguuguuuuaaacucaugaaguauggguucaguggaaauguuugg

SEQ ID NO: 417695 - RNA, 64 nt, Human
gacaagagaugagccucuguacuguaaauaagaaaugaaguagagaaauguuaaauauuuuaug

SEQ ID NO: 417696 - RNA, 64 nt, Human
aauguagguguaaaauacaaugcaaaacaaaauaaugaaguaagugaauuaaauuauugcacca

SEQ ID NO: 417697 - RNA, 64 nt, Human
guaaugguuguaugugugaugcuaugcccagaauaugaaguaucuguuuuugaaauucacuuua

SEQ ID NO: 417698 - RNA, 55 nt, Human
ucucucucuuuuaggaauaauaaauaugaaguaagauuacaacagagcagaacuu

SEQ ID NO: 417699 - RNA, 64 nt, Human
auuuuugaagucuuacauuuucacucuuuuuuuaaugaaguauuucauacuacaaaaauacaua

SEQ ID NO: 417700 - RNA, 64 nt, Human
aggauaaaguagcuaauccauuauugaucacaguaugaaguaaaacuauucuaagccauuauau

SEQ ID NO: 417701 - RNA, 64 nt, Human
ucuguuuccuucaacuucauacauagauucauauaugaaguacugcauuguaaaacaacuauag

SEQ ID NO: 417702 - RNA, 64 nt, Human
uuuggaaccuugauucuugugucacacaaaaugaaugaaguagcuugauguggagccuucauau

SEQ ID NO: 417703 - RNA, 64 nt, Human
uucucugugguguuuaugaaauagcuaaaagcaaaugaaguaaagggcauacuaugguuuuuca

SEQ ID NO: 417704 - RNA, 64 nt, Human
cuguuuguguuuaacuuauaauauugagugauccaugaaguagguuuucagagcaauauucuuc

SEQ ID NO: 417705 - RNA, 64 nt, Human
cauggcauuuuauauguuaauuuuuuaguuuaaaaugaaguauauugaauguuugccuuuagca

SEQ ID NO: 417706 - RNA, 64 nt, Human
uagaaaaaugcacuuacuaagaacaugaaaaaaaaugaaguaggaaaauaagaugaagacuuug

SEQ ID NO: 417707 - RNA, 64 nt, Human
cccaaaggagguagguugauggugcuuaacaaacaugaaguaugguguaauaggaauaauauuu

SEQ ID NO: 417708 - RNA, 64 nt, Human
uuuuuuuuuaacuuuauuuuugggaaaguaacacaugaaguaguucagucaugucagguuuguc

SEQ ID NO: 417709 - RNA, 64 nt, Human
gggccacugaucuuccuggacaggaggggugaccaugaaguagagcagugggcuuugccuucug

SEQ ID NO: 417710 - RNA, 64 nt, Human
uaccggaauauaauuaaagggagaaauacacuguaugaaguauauguugauacuaugacauguu

SEQ ID NO: 417711 - RNA, 64 nt, Human
cagaaguuuucagggcauuaaauauauguuguguaugaaguaucucaaacuggaacauaaauuu

SEQ ID NO: 417712 - RNA, 64 nt, Human
accuaacuugggcacagcuguaacugaagaccuaaugaaguagucagaugcuuacaacuauuua

SEQ ID NO: 417713 - RNA, 64 nt, Human
agcuuguacagaucaagagaauauacugggcagaaugaaguauguuuguuuauuuuucuuuaaa

SEQ ID NO: 417714 - RNA, 64 nt, Human
cuauuucuggguguuugcgagccugauugcuaucaugaaguaaaaauuuauuacucuagguauu

SEQ ID NO: 417715 - RNA, 64 nt, Human
guaauuuaaugacuuuugaauuacagagauauaaaugaaguauuaucuguaaaaauuguuauaa

SEQ ID NO: 417716 - RNA, 64 nt, Human
uauuuguuacuugucuaagaugcaauuugauuuuaugaaguauauacccuuuacccaccagaga

SEQ ID NO: 417717 - RNA, 64 nt, Human
caggcagaguccuggauauaggaaaaaguaauuuaugaaguaaacuucaguugcuuaaucaaac

SEQ ID NO: 417718 - RNA, 64 nt, Human
cugcaaaugagaauguguuauaugccaaggaacaaugaaguagaauauaauguauacuaaggga

SEQ ID NO: 417719 - RNA, 64 nt, Human
ucuugucauguacugacaacuguuuaauugaaucaugaaguaaauugaaagcaggacauaugag

SEQ ID NO: 417720 - RNA, 64 nt, Human
auuuuucaauaaauaaaguaaggcauugucaucaaugaaguaauuaaaacugggaccugaucua

SEQ ID NO: 417721 - RNA, 64 nt, Human
caaaccuguuuaaauauuucaagacauuaaaucuaugaaguauauaaugguuucaaagauucaa

SEQ ID NO: 417722 - RNA, 64 nt, Human
ccaaaguagaguucuguuuaagcuugaaagagguaugaaguaaucuguaguguuuuuuugguuu

SEQ ID NO: 417723 - RNA, 64 nt, Human
uucuuguguguaugcacaugaacuuagauuuuacaugaaguauuuuuucaguauuauauguacc

SEQ ID NO: 417724 - RNA, 64 nt, Human
ucugguguuugacuuaggaauugcuucaauuuagaugaaguauuuucuuuuuagaagaucuuau

SEQ ID NO: 417725 - RNA, 64 nt, Human
gaauauuccuuggauuacucagccauaaaaaggaaugaaguacugacacaugcugugacaucag

SEQ ID NO: 417726 - RNA, 64 nt, Human
agaaaaugaagagcauuugacucccgcacuuaaaaugaaguacacauaaaguuuaaacugguua

SEQ ID NO: 417727 - RNA, 64 nt, Human
ugguaauuuuaaagacugcaaggcaguuuagagaaugaaguaaaccaauagauacucuuuugau

SEQ ID NO: 417728 - RNA, 64 nt, Human
uccacucugcaaacuguccugguuuuucacaccaaugaaguauuauagaugccaauccaaaacc

SEQ ID NO: 417729 - RNA, 64 nt, Human
cucagaggaggguuugucgggcaaauucagguggaugaaguaugugugugcgugugcaugggag

SEQ ID NO: 417730 - RNA, 64 nt, Human
auacuugaaagaaaccucaauuaucaguggcuuuaugaaguaaaguuaaaaacaaacauaggaa

SEQ ID NO: 417731 - RNA, 64 nt, Human
aguaaauugacauauaacuacuaugcuuauaaaaaugaaguaaggaaaacaaguaguccuguuu

SEQ ID NO: 417732 - RNA, 64 nt, Human
aaagaaaaaaaauuuuguaugucaauaacuuuauaugaaguauuaaaaugcauauuucuauguu

SEQ ID NO: 417733 - RNA, 64 nt, Human
auaucuccaaagagggauuacaaggucaaagagcaugaaguauuuuauagcucuuguuuuauau

SEQ ID NO: 417734 - RNA, 64 nt, Human
uaaaaguuccucucuauuuuauuuuuuauuuaacaugaaguaaaauugaaauuucuucuuggug

SEQ ID NO: 417735 - RNA, 64 nt, Human
gcucucuccuguugcucugggauugcacuucugaaugaaguagcagcucauaagcuuuugccac

SEQ ID NO: 417736 - RNA, 64 nt, Human
auugcuucucaaugaugcauuuuaaucuuuuauaaugaaguaaaaguugugucuauaauuaaaa

SEQ ID NO: 417737 - RNA, 64 nt, Human
aacuuuaaaauauuaaguuuuuaaaaaaucaaauaugaaguauguucagcaaaggcauaauuuu

SEQ ID NO: 417738 - RNA, 64 nt, Human
uauuagaaaagaaaucagaccuaaauaaucauugaugaaguaugucaguuacaagcacaaaaga

SEQ ID NO: 417739 - RNA, 64 nt, Human
auuuuauuuacauaauguugacaucucauacuucaugaaguaauuuugacucaugcagucgugu

SEQ ID NO: 417740 - RNA, 64 nt, Human
guaaugcaguucaugggcuuuagguacuucaguuaugaaguaggcuuuucauggggagagauug

SEQ ID NO: 417741 - RNA, 64 nt, Human
uaagcaauuacuaguuuuaauuagcucugcccucaugaaguauuauuauaauucaccauaaaca

SEQ ID NO: 417742 - RNA, 64 nt, Human
uaccuucugaugucaaagugauugugcaagcuaaaugaaguaggcucagcgauagugguccucu

SEQ ID NO: 417743 - RNA, 64 nt, Human
uauguugcaaaggcucuugggcauuuuaaacaaaaugaaguauauccauuuugaaaccugugua

SEQ ID NO: 417744 - RNA, 63 nt, Human
cagagacuguauagcuuauaccaauuauagaaucaugaaguaagaacguuauucugaaaugaa

SEQ ID NO: 417745 - RNA, 64 nt, Human
uuuaugaaaguuaagaucaagaaauuauauuuauaugaaguaaaucacuugacaacuuuuaagg

SEQ ID NO: 417746 - RNA, 64 nt, Human
aaagaaauggugagagccuugaagauacacgaggaugaaguagaggauauggaagaaaauuaag

SEQ ID NO: 417747 - RNA, 64 nt, Human
ugcguuuuugcuuuagugcauugugugugcaagcaugaaguagaaacacuuuuuuuuucugggu

SEQ ID NO: 417748 - RNA, 64 nt, Human
ccaacggcaggaaaaaauaguuuguaccaguuucaugaaguaugucuuuggguuuuuguaaaua

SEQ ID NO: 417749 - RNA, 64 nt, Human
uaggauauucuucaagcaaauuuguggaugguagaugaaguacuuugcggugcucuguuauaua

SEQ ID NO: 417750 - RNA, 64 nt, Human
acuuccuugggacucuuaagugcauaaugauggcaugaaguaaaaggggccucaaugaugauag

SEQ ID NO: 417751 - RNA, 64 nt, Human
uuuuugauuuugaaauaucugauaauaauuuggaaugaaguaagguucuguuaaaauauauuug

SEQ ID NO: 417752 - RNA, 64 nt, Human
auugcuucauuuucuugagcaauacugaagcaggaugaaguaagaggaaugcauucauuuaaac

SEQ ID NO: 417753 - RNA, 64 nt, Human
aaggccuggcaggaccuggccuguuuguuuaaaaaugaaguauggguugggggauuacgcuagu

SEQ ID NO: 417754 - RNA, 64 nt, Human
aaguuaauaauuauauuagcaaaguguuaaucuaaugaaguaaaaaacuccuguguggcagaaa

SEQ ID NO: 417755 - RNA, 64 nt, Human
uacacaauagacuacuuacuacucagcaauaaaaaugaaguaacuuucaauaaaugcaauauua

SEQ ID NO: 417756 - RNA, 64 nt, Human
guguggguugcaagagggggagauuauucuggaaaugaaguaaauaugggaaguuauugccaaa

SEQ ID NO: 417757 - RNA, 64 nt, Human
uuuauuaaaccucuaacuuacugauaagauguuuaugaaguauggcauauuuugauuuuuuuaa

SEQ ID NO: 417758 - RNA, 64 nt, Human
aaaacgagcaugaauuaacucuucaauauaagcuaugaaguaauaguugguugugaauuaaagu

SEQ ID NO: 417759 - RNA, 64 nt, Human
uucagcauuucuuugugauuuauaaguacugagcaugaaguacuugucugccccucauuucaag

SEQ ID NO: 417760 - RNA, 64 nt, Human
gucuguguugguauaguacccuucauaaggaaaaaugaaguaaugccuauaaguagcaggccuu

SEQ ID NO: 417761 - RNA, 64 nt, Human
cccguccggugucacaguucagucagugaggaugaugaaguagauacagucuucaggacaccau

SEQ ID NO: 417762 - RNA, 64 nt, Human
ccuaaaggacuauuauguggaauaauacauacuaaugaaguauuacaugauuuaaagacuacaa

SEQ ID NO: 417763 - RNA, 64 nt, Human
uuuuguauucuguacagcuuugucuuuuuuaaauaugaaguacuuaaauguacuuacuaugaua

SEQ ID NO: 417764 - RNA, 64 nt, Human
aaaacaaaaauguaaugaucauaagucuaaauaaaugaaguauuucucacucauugcaaguaua

SEQ ID NO: 417765 - RNA, 64 nt, Human
uacauuuuuguaaguagauuuauucuuuuauuuuaugaaguaauguuaauuuuacuaagaauaa

SEQ ID NO: 417766 - RNA, 64 nt, Human
aauuaagugggaauuuucuggaagauggucagcuaugaaguaauagaguuugcuuaaucauuug

SEQ ID NO: 417767 - RNA, 64 nt, Human
acugagugaaauaauagaugacagacaugucugaaugaaguaaaaaucaauggaagacagucgg

SEQ ID NO: 417768 - RNA, 64 nt, Human
gggaaaaaucauuuaacacaaagccuaucuucuaaugaaguauggaauaucucauguaauuuau

SEQ ID NO: 417769 - RNA, 64 nt, Human
agagagaguaaaaaugaauuacacuguaucuuauaugaaguaaaaaauaaaucagaggugagaa

SEQ ID NO: 417770 - RNA, 64 nt, Human
ggacagaggugucuuauguagggagggggcaaguaugaaguaagguaauuauauacuacucuca

SEQ ID NO: 417771 - RNA, 64 nt, Human
gaaauucaaauggcugugacaauuuaccgaaaugaugaaguaaccaccauucccaccuuucacu

SEQ ID NO: 417772 - RNA, 64 nt, Human
gauaauauuuaugcuuaguguaaacauucugugaaugaaguagacucuucgguggaauauauua

SEQ ID NO: 417773 - RNA, 64 nt, Human
uaaguauuuaacaaaaaagcauucuugaccaugaaugaaguaguuuguuucauagcuugucuca

SEQ ID NO: 417774 - RNA, 64 nt, Human
gcuuuuuuucauccuuaauuugcuugucaucacaaugaaguauguuuuuugaaucaucaauucu

SEQ ID NO: 417775 - RNA, 64 nt, Human
uaaaaaagauuuagcuuuaaaauaguuggaaagaaugaaguauauaaguuaaggaaaaaauaca

SEQ ID NO: 417776 - RNA, 64 nt, Human
augacuagaccuacaauuaauuuuccugcaguauaugaaguauuguaccagaguauuaaaagau

SEQ ID NO: 417777 - RNA, 64 nt, Human
auuagcugcucaaugauugauuguugaaugauagaugaaguauugcugaagccaaccagagauc

SEQ ID NO: 417778 - RNA, 64 nt, Human
uuucugccuuuuuuaaaaaaaaaguauguguaauaugaaguaaaauguuucagacuuuuuuuua

SEQ ID NO: 417779 - RNA, 64 nt, Human
gaaacugggaguccacaaagacauaaauggaaagaugaaguaccuccugacagagcaagaaugg

SEQ ID NO: 417780 - RNA, 64 nt, Human
uagauaaaggcucaaagacauucuguuauacugcaugaaguauguuaagcuaagcacagagaaa

SEQ ID NO: 417781 - RNA, 64 nt, Human
uuaaaugaagcuacacauuuggguaaucuagcaaaugaaguauuuuuucccucuuggcaacuug

SEQ ID NO: 417782 - RNA, 64 nt, Human
cacuuguguauuuuauauuuuaguaaagccaauuaugaaguacaaguaucauacacguacuuuu

SEQ ID NO: 417783 - RNA, 64 nt, Human
ucacuuacggagaauguaagguuaccuuugauguaugaaguagcaguauuuuccaguuuuucca

SEQ ID NO: 417784 - RNA, 64 nt, Human
ugaaaagaaaauuaugaaaaaauaugcauaccuaaugaaguauugguuuuaguaagaauuaaau

SEQ ID NO: 417785 - RNA, 64 nt, Human
caacucuaauccauaaacgggucuuaugacaucuaugaaguaguagcaagacaugcuuagugug

SEQ ID NO: 417786 - RNA, 64 nt, Human
caauuggaauacauuucaagaugguaacagccccaugaaguaccgcuuuaauuccuugcuggua

SEQ ID NO: 417787 - RNA, 61 nt, Human
cggagucugaggaccuuuaaugggcuuugucaugaaguagcagaugagagggcagucaguu

SEQ ID NO: 417788 - RNA, 64 nt, Human
uucaguaguguuuuaagguucugauaucgaauuaaugaaguaaaguuguugaugguggugaaac

SEQ ID NO: 417789 - RNA, 64 nt, Human
uugaauacaauuacuguaucuaaaaggagcugcuaugaaguaccuuucuuauguugcuaggcua

SEQ ID NO: 417790 - RNA, 64 nt, Human
aauuuuguauuauuguucucacuuauuauuaauaaugaaguagaaguuacuuaauugccagcaa

SEQ ID NO: 417791 - RNA, 64 nt, Human
auuuuaagcauauuuucauuuagauauaaaauauaugaaguaugcuuuguugauuauagugaga

SEQ ID NO: 417792 - RNA, 64 nt, Human
auggacacggagcugugacgauccucaugugaucaugaaguaacaguaacugacuuuuuauguu

SEQ ID NO: 417793 - RNA, 64 nt, Human
gcuuuaaaauugaaaauuuaaauaacaugguggcaugaaguacaauucgaguauuaggcaauuu

SEQ ID NO: 417794 - RNA, 64 nt, Human
uguugcugguuuuuauuuaauuagaugguaauaaaugaaguaaaauaaaaguuguugugucuca

SEQ ID NO: 417795 - RNA, 64 nt, Human
uauauucaaagaugugauucccaaccaacucaggaugaaguaacuaguguuacaacugaguuga

SEQ ID NO: 417796 - RNA, 64 nt, Human
aaacacuccucagaauauucuucuaaguauuuugaugaaguaacuuuguaauuauuugaacauu

SEQ ID NO: 417797 - RNA, 64 nt, Human
ucauucauuaauuucucacaugggauuauggaguaugaaguauuaucuuugaaugaaauuccug

SEQ ID NO: 417798 - RNA, 64 nt, Human
uccugcauuaggaacaagugaacacgcaaaugacaugaaguauuuguugcagagcugaggaaca

SEQ ID NO: 417799 - RNA, 64 nt, Human
ccuaauaaucaaaagauuguacacauuuuuuucaaugaaguacaauaaugugaacugcaugugu

SEQ ID NO: 417800 - RNA, 64 nt, Human
uuuugguccuugggcacagagacauucacuauuaaugaaguaacccuugggcaugacuccaauc

SEQ ID NO: 417801 - RNA, 64 nt, Human
gcacuagaaauaguugauaaugaaaugagauuuuaugaaguauaccgcuccaccuaugagcguc

SEQ ID NO: 417802 - RNA, 64 nt, Human
aagaugagccuagaguaucuugugccacagaaaaaugaaguacugaaauuaaaaaaaaaaaauc

SEQ ID NO: 417803 - RNA, 64 nt, Human
gugaugguuuuagcgaugaauaacguaauuggcuaugaaguacuguggcagagcugcuguuuuc

SEQ ID NO: 417804 - RNA, 64 nt, Human
uuucuuuuaccauugaccauuauuauagggacccaugaaguaaaugucacaaucaucuuacuag

SEQ ID NO: 417805 - RNA, 64 nt, Human
aaaaaguacgugaccagucugguaagaaguauuaaugaaguagcuaauauuacagcuucauuuu

SEQ ID NO: 417806 - RNA, 64 nt, Human
gcugagggcguggcuuuggucccuggcuguccggaugaaguaccagagugacgccacagcccau

SEQ ID NO: 417807 - RNA, 64 nt, Human
gguaugagcugcuaugauacaugaagaacauuccaugaaguauguuuuaaaaccuuguuauauc

SEQ ID NO: 417808 - RNA, 64 nt, Human
caacucuuugcauuacaauaugaaguaaaguucuaugaaguaugcauuuuguguaacuaaugua

SEQ ID NO: 417809 - RNA, 64 nt, Human
ucugccuaaaauaugcaacucuuugcauuacaauaugaaguaaaguucuaugaaguaugcauuu

SEQ ID NO: 417810 - RNA, 64 nt, Human
uguuuaguccaguguuaccaagguaagcuggggaaugaaguauaccaacuucuuucagagcauu

SEQ ID NO: 417811 - RNA, 64 nt, Human
ggaaaaauacaguaaaguugcaaugaagagguucaugaaguauguccuuguucuuuuuggaaac

SEQ ID NO: 417812 - RNA, 64 nt, Human
gaccaaggccauuugaugccaggggaguuugccaaugaaguaaagggauaggcucauggcccuu

SEQ ID NO: 417813 - RNA, 64 nt, Human
cuaucccaggaaaguauuuaauccaacauuguaaaugaaguaucuuguacauauaaauuuauuu

SEQ ID NO: 417814 - RNA, 64 nt, Human
cucuguguguuuucuuugguuuuggaggagggguaugaaguaucuuugacauggugccuuagga

SEQ ID NO: 417815 - RNA, 64 nt, Human
gauggcucaaauauaaaugaaugaggaauucuuuaugaaguaucagucagauuuuaugauuaag

SEQ ID NO: 417816 - RNA, 64 nt, Human
acugacuccacuccugacuucugcuucugaaaaaaugaaguagguguuuucccuauuccuccca

SEQ ID NO: 417817 - RNA, 64 nt, Human
cugcuguuuuucuggucugaccaucgcaacccucaugaaguacaaccagcauaugcuacaaagu

SEQ ID NO: 417818 - RNA, 64 nt, Human
ucuuuucuugagaucauggucauaugagguccuaaugaaguacuacaguuuucauucuuucaag

SEQ ID NO: 417819 - RNA, 64 nt, Human
gccuagcauacguacacauuuuauuuuauuaugcaugaaguaauaugcacacauuuuuuaaaug

SEQ ID NO: 417820 - RNA, 64 nt, Human
agaguuagaauaccuuuuguuguugaagaugugaaugaaguaugcaugugcauuaacuguugaa

SEQ ID NO: 417821 - RNA, 64 nt, Human
agucacauuuguacuguaguucaauaaaagaaaaaugaaguauucuguagccuauauuuuucau

SEQ ID NO: 417822 - RNA, 64 nt, Human
caacugaguauuacccaguuauacccaaucccugaugaaguauuaaaauguuauuaguuuuauu

SEQ ID NO: 417823 - RNA, 64 nt, Human
guaaauucauuucauuuaguucuuaaacauccccaugaaguaaacacuauuauuauccucauuu

SEQ ID NO: 417824 - RNA, 64 nt, Human
ucagcccccagccacggggacgcgggauucaagaaugaaguaaauacagucacagccccaagug

SEQ ID NO: 417825 - RNA, 64 nt, Human
ucaccaggaaaaauuucuauggcaauuuuguaccaugaaguaaacuguuacaauaguuucugag

SEQ ID NO: 417826 - RNA, 64 nt, Human
cuuccugcucccaggauauuucucuuuucuguuuaugaaguacaacccaugcugcuaagaugcg

SEQ ID NO: 417827 - RNA, 64 nt, Human
aggccuuuugagcaagcgccaaugaguuucaggaaugaaguagaagguaguuauuuaaaaauaa

SEQ ID NO: 417828 - RNA, 64 nt, Human
gcuucaugagcccagaccaaaagcccacagugaaaugaaguacccuuuuguaaauagcauuuuu

SEQ ID NO: 417829 - RNA, 64 nt, Human
auauguuaucaaacuuugaaauugaguugcuggaaugaaguagaggugacucucucugugguac

SEQ ID NO: 417830 - RNA, 64 nt, Human
uuaugucguaagucacugacccuaacugcagaccaugaaguaaauuauguaacuagguuuuugc

SEQ ID NO: 417831 - RNA, 64 nt, Human
uggcuaccgggcugggggcgaccuuuaccauaggaugaaguaaccuugcauucggcugcaaggu

SEQ ID NO: 417832 - RNA, 64 nt, Human
uauuaauaaguuauguuuggaaguuuuaacuucaaugaaguaauuauuugcugugaaagaaaca

SEQ ID NO: 417833 - RNA, 64 nt, Human
aggagugagcuucguguacauuaucuauuagaaaaugaaguaccuucugguucagcuagucccu

SEQ ID NO: 417834 - RNA, 64 nt, Human
uuuuuaaucauauguuccaaacaggcacuguuagaugaaguaaaugauuucaacaaggauauuu

SEQ ID NO: 417835 - RNA, 64 nt, Human
uauuaauauaagcaggaagggaucuacuauaggaaugaaguauuuauaaaccacugaaagggau

SEQ ID NO: 417836 - RNA, 64 nt, Human
auagauuugaaaaacuuuuagguuguuaccaaguaugaaguauaaaucuggggaagagguuuua

SEQ ID NO: 417837 - RNA, 64 nt, Human
uucucucuccaugaaaauuaaaacacacaagugaaugaaguaauuacauaguccaagauuagaa

SEQ ID NO: 417838 - RNA, 64 nt, Human
guguucuuuguggaaauguccuuuagaagcacccaugaaguaguguguucagacugugcacaca

SEQ ID NO: 417839 - RNA, 64 nt, Human
auuugcauuuucuguaacaauuccuuauaauaaaaugaaguaaaauugugcauuuaaaguggaa

SEQ ID NO: 417840 - RNA, 64 nt, Human
aaagccagucuuaacauuucuaacucugauguaaaugaaguaacuugucuuaaauaaaagaaau

SEQ ID NO: 417841 - RNA, 64 nt, Human
aauguuuuuaaagaagccagcucaagcaauauuaaugaaguagguuccaguacuaaugaagugg

SEQ ID NO: 417842 - RNA, 64 nt, Human
agaugauaaugagaaaaauguuaucauuauuaucaugaaguaccauuaucguaauacaaugaac

SEQ ID NO: 417843 - RNA, 64 nt, Human
acacaguugcaggaaaguauguuagcuauauacuaugaaguacucuuaguuuacuuauguugaa

SEQ ID NO: 417844 - RNA, 64 nt, Human
gcucguguguucuauccaaacauguauuuauguaaugaaguaaagccauuaaaugaauauuuug

SEQ ID NO: 417845 - RNA, 64 nt, Human
uaggcccaggucuguguacacauuuuauagaagaaugaaguacucugaaguauuuugguugccu

SEQ ID NO: 417846 - RNA, 64 nt, Human
gauauggugacugagucaacaacauacugccacuaugaaguaauaagaaaauaaaaaguuaaaa

SEQ ID NO: 417847 - RNA, 64 nt, Human
aauuacguuuguuauuccuaguggaugacuguugaugaaguauacuuuuccccuguuaaacagu

SEQ ID NO: 417848 - RNA, 64 nt, Human
agauuuugugaauugguugaauaguucuauacaaaugaaguauggagguguguauguuuauaug

SEQ ID NO: 417849 - RNA, 64 nt, Human
gggaccaaagacuagacagaauucaguaagucacaugaaguaauggucaugccuguacauaaag

SEQ ID NO: 417850 - RNA, 64 nt, Human
acuuugcucuuuuaauaauuauguucagccuaugaugaaguauuugauuauuagacagcaaugu

SEQ ID NO: 417851 - RNA, 64 nt, Human
aauucuuuccuaaagaacauuuuuagcagcaaaaaugaaguaugacacuugcuguuuuucuucu

SEQ ID NO: 417852 - RNA, 64 nt, Human
uugacuuuggaggcaaaauguguugaagugcccuaugaaguagcaauuuucuauaggaauauag

SEQ ID NO: 417853 - RNA, 64 nt, Human
uuggcaaaguguacuuucuuaauuucuauuuaugaugaaguauagucauaauuuauuuguaaua

SEQ ID NO: 417854 - RNA, 64 nt, Human
auguauagucagagaaauuuucaugaauuauuccaugaaguauuguuuccuuuauuuaaaaaaa

SEQ ID NO: 417855 - RNA, 64 nt, Human
ucuuucuuucauagagcaaacguuuuaaauuuuuaugaaguaagacuucucaguuuuauuuuug

SEQ ID NO: 417856 - RNA, 64 nt, Human
caaauuuggaaaaaccacucaucacuuacauuucaugaaguacuucuuugauaaaaucuguuau

SEQ ID NO: 417857 - RNA, 64 nt, Human
acaaccaugugauccucaacaaaacugacaagcaaugaaguaagaacuucauucaauaaguggu

SEQ ID NO: 417858 - RNA, 64 nt, Human
uuuugaaauaaagcaacagacuucucaauaaucaaugaaguagcugagaaaacuaagucagaaa

SEQ ID NO: 417859 - RNA, 64 nt, Human
cacgguacguccauaaagccaguauuacacuuaaaugaaguauucuuuuuuguaaucguuuuuu

SEQ ID NO: 417860 - RNA, 64 nt, Human
uuguaucuuuuuucauauaaauauuuuacagauuaugaaguauucauuaugugagcuggucugu

SEQ ID NO: 417861 - RNA, 64 nt, Human
guccuuucugcuuuaacucuuagaaaaaaguaauaugaaguauucugaaauuaaccaaucaguu

SEQ ID NO: 417862 - RNA, 64 nt, Human
ucaggcacacagauaaugacaaugcagguugcucaugaaguauuuagugaaccaggagaguuuu

SEQ ID NO: 417863 - RNA, 64 nt, Human
cuuuccauuugcagugugcaacagaaaaaaaaaaaugaaguaaugugacucaaggccugcuguu

SEQ ID NO: 417864 - RNA, 64 nt, Human
guaaaggaagcccaaguacuuuuaaguggaggaaaugaaguacugugaauuuuuaaaacagaug

SEQ ID NO: 417865 - RNA, 64 nt, Human
uccuacacugucucaagaguauuaaaaggauuauaugaaguaauaaaggauaaaaugcauugga

SEQ ID NO: 417866 - RNA, 64 nt, Human
acagcauuauuuaugaaggaaaaaauacauaaauaugaaguaccucauguugaauguuauugua

SEQ ID NO: 417867 - RNA, 64 nt, Human
gggccagagcuuuuugguucugauuuacaaauuaaugaaguaguuucaaacaacgcggucaugu

SEQ ID NO: 417868 - RNA, 64 nt, Human
cugcugaccgaaccucagccucucagacuugaugaugaaguaggugguccugaaaguuaacagg

SEQ ID NO: 417869 - RNA, 64 nt, Human
gguaauaauugcacaugguucaaagcuaaaagguaugaaguauuauguagggauacgucccucc

SEQ ID NO: 417870 - RNA, 64 nt, Human
aaaauagccaguaguaucugaaaaugaaaaauaaaugaaguaucucuaggaaacagucuggcuu

SEQ ID NO: 417871 - RNA, 64 nt, Human
auauaucaucuaacaguagcacaaaauuuguaauaugaaguaaaguaugaagauaaugaagaag

SEQ ID NO: 417872 - RNA, 64 nt, Human
uccuugauugucaucuucaggcguaaagagaaacaugaaguacaaauggaucacagaccugaau

SEQ ID NO: 417873 - RNA, 64 nt, Human
uccuuugagucgcgaacgcugugcguuugucagaaugaaguauacaagucaauguuuuuccccc

SEQ ID NO: 417874 - RNA, 64 nt, Human
acugauuuguaaaaauagcuuaagcauguugagaaugaaguaaaaguuuucccaugugcugucu

SEQ ID NO: 417875 - RNA, 64 nt, Human
gacauauucccuaccugucuuauuucauagguacaugaaguauuguguauaaaaaaagagauaa

SEQ ID NO: 417876 - RNA, 64 nt, Human
gacauauucccuaccuguuuuauuucauagguacaugaaguauuguguauaaaaaaagagauaa

SEQ ID NO: 417877 - RNA, 64 nt, Human
auuuaaccuguaaaaugucaauagcaaaugaaggaugaaguauaucucuagaugcaaauacauu

SEQ ID NO: 417878 - RNA, 64 nt, Human
cagccgacgacgucugauggagugcauugugcacaugaaguauuuauccaccuguuuuauuuuc

SEQ ID NO: 417879 - RNA, 64 nt, Human
uaagugcauuucugcaaagaucaagauaagcuggaugaaguagugugcauuuguaauacuauug

SEQ ID NO: 417880 - RNA, 64 nt, Human
cuugccuuauuuucuaguuugugaacaagaacgaaugaaguacuauuauugauaacuuauauau

SEQ ID NO: 417881 - RNA, 64 nt, Human
cucagacgccuaugaaacaccugaaugaacuuugaugaaguacagucugaguuaccaucaugca

SEQ ID NO: 417882 - RNA, 64 nt, Human
uccguaguggagacuugcuuuucagaacauagggaugaaguaaggugccugaaaaguuuggggg

SEQ ID NO: 417883 - RNA, 64 nt, Human
gggcauccuggaucccugaauuauccccccccccaugaaguacuucaagggccaagcugccccu

SEQ ID NO: 417884 - RNA, 64 nt, Human
uguguucccuagcagcugcgggaggguuuggccgaugaaguaccugcucagcuuagcuaaucag

SEQ ID NO: 417885 - RNA, 64 nt, Human
aaaacacacaugaauuuucuauaaaaucacgaauaugaaguaccagguuuagucuuacuuuagc

SEQ ID NO: 417886 - RNA, 64 nt, Human
uauuguaauguauacuugaaaaauguuauaacuuaugaaguaaaguuucugauaguagucuuua

SEQ ID NO: 417887 - RNA, 64 nt, Human
acugaaacaaauauuugcuugaaaaaaaaaguucaugaaguaccaaugcaaguguuuuauuuuu

SEQ ID NO: 417888 - RNA, 64 nt, Human
ccucugaaacacuggaagagcuaguaaauuguaaaugaaguaauacuguguuccucuugacugu

SEQ ID NO: 417889 - RNA, 64 nt, Human
uuuuuuuuuguuauccuguauaccuccuccagccaugaaguagaggacuaaccauguguuaugu

SEQ ID NO: 417890 - RNA, 64 nt, Human
caugaacuuugugaauggauuuaaauacaauaguaugaaguagaaguuaugcaaugagaaugaa

SEQ ID NO: 417891 - RNA, 64 nt, Human
uguguucccuagcagcugccggaggauuuggcugaugaaguaccugcucagcuuagcuaaucag

SEQ ID NO: 417892 - RNA, 64 nt, Human
agcgucgccccaguggcacugaaguggcccucccucagcggagggguuugggagucaggccugg

SEQ ID NO: 417893 - RNA, 64 nt, Human
gcaaccucaacccagcgcaguuacaacuucacuaucagcggaaggggagaaaaaccgauucaaa

SEQ ID NO: 417894 - RNA, 64 nt, Human
uucaagggacuaaauugcuuauguuuauucccugucagcggaguggagaaugucauucaucaau

SEQ ID NO: 417895 - RNA, 64 nt, Human
augaucuauuucagugugccucauugcuuggaauucagcggaauauugauuagaaagaaacugc

SEQ ID NO: 417896 - RNA, 64 nt, Human
cuauacuguccucaaauauaagccaaggguaauuucagcggaugcacacacaacccugccuccc

SEQ ID NO: 417897 - RNA, 64 nt, Human
uugacuggacacccuaugaaaguggguagaccucucagcggaaaauaagaagggcuuuuaccua

SEQ ID NO: 417898 - RNA, 64 nt, Human
cauucuugaacugcugaggaugggggguguccccucagcggaggccaagggaggggagcagccu

SEQ ID NO: 417899 - RNA, 51 nt, Human
caaaccugagcccagagugagccgucugaacugugggagggaagugcuaac

SEQ ID NO: 417900 - RNA, 55 nt, Human
gagaaaaggaucaaacauagcaccaccgucugacccaaccucauaggauaaugug

SEQ ID NO: 417901 - RNA, 64 nt, Human; identical to SEQ ID NO: 37151

SEQ ID NO: 417902 - RNA, 64 nt, Human
gguucaccuugccugucgcuagcaagcaucugguucagcggaaaugggaugugagaaugaugaa

SEQ ID NO: 417903 - RNA, 64 nt, Human
gcuugggguuauucagugugaccuagagaagaaaucagcggaccacgauuucaagacuuguuaa

SEQ ID NO: 417904 - RNA, 64 nt, Human
uaugccaagaagugugcugggugcaccaaccccaucagcggacuugguggcacaaaauacaucu

SEQ ID NO: 417905 - RNA, 64 nt, Human
gaauauguccugagaaauuuccauccacuuugguucagcggacaucaagguaguaauaauaauu

SEQ ID NO: 417906 - RNA, 64 nt, Human
uggccagaagcaggagugugaggaggagacagccucagcggacaagcagcuggugcuccaagca

SEQ ID NO: 417907 - RNA, 64 nt, Human
ggcugagggccugucccagacaauaaaggugcccucagcggaugugggccaugucaccaaggaa

SEQ ID NO: 417908 - RNA, 64 nt, Human
gugaggugguggccaugacacuggagaccaagccucagcggagggaucagcgcacuguccugug

SEQ ID NO: 417909 - RNA, 64 nt, Human
aaaaaagaccaugcaucauaaaauugcccagucuucagcggagcaguuuucuggagaucccugg

SEQ ID NO: 417910 - RNA, 64 nt, Human
ccacacacuugcacaccccagcugugagguggcuucagcggaagucugcugaccccuuauauuc

SEQ ID NO: 417911 - RNA, 64 nt, Human
gcuggguacuccagaggugccacugguggaagggucagcggagccccagcaggaagggugggcc

SEQ ID NO: 417912 - RNA, 64 nt, Human
cauauguacuucaauugcuuugcacuuuuccguuucagcggaagaccugaagaguggucagaac

SEQ ID NO: 417913 - RNA, 64 nt, Human
aagcuaauguggguccugugaccgcggcagcuccucagcggagccgcagacuguccugcccugc

SEQ ID NO: 417914 - RNA, 64 nt, Human
auacuuguaagacucuagggguucauuucccauuucagcggaaaguacuucacucaacaacaau

SEQ ID NO: 417915 - RNA, 64 nt, Human
agcgagcucuguccuuacauguauuugaugugcaucagcggaggagaacacuggcuuggcccug

SEQ ID NO: 417916 - RNA, 64 nt, Human
ccccagacaccgaccccacaggccgucccggaucucagcggacacaggcaggagcgccccauca

SEQ ID NO: 417917 - RNA, 64 nt, Human
aaaggauuauuuggucuucuggauuuggaggcaaucagcggacagcauggaagaugugugcucu

SEQ ID NO: 417918 - RNA, 64 nt, Human; identical to SEQ ID NO: 58313

SEQ ID NO: 417919 - RNA, 64 nt, Human; identical to SEQ ID NO: 58314

SEQ ID NO: 417920 - RNA, 64 nt, Human; identical to SEQ ID NO: 58318

SEQ ID NO: 417921 - RNA, 64 nt, Human; identical to SEQ ID NO: 58319

SEQ ID NO: 417922 - RNA, 64 nt, Human
acaaaucuucgggauccaagaagcagaaacaauaucagcggauucggaaggagaagccucaaca

SEQ ID NO: 417923 - RNA, 64 nt, Human
gacaaucuccccucaaccgcacaugugccacuguucagcggagcugacugguuucuccugguag

SEQ ID NO: 417924 - RNA, 64 nt, Human
cccagcccgcgccagacagcccacggauccguucucagcggagccagauucaucgcacacgugc

SEQ ID NO: 417925 - RNA, 64 nt, Human
cucuugauaaaggagagguuaaagcaaaccagccucagcggaccacucuucucuccaaggaaau

SEQ ID NO: 417926 - RNA, 64 nt, Human
uugaaagaagaacaugaaagaaauaaacaggaguucagcggagcuagcagaagacaaggcaugu

SEQ ID NO: 417927 - RNA, 64 nt, Human
agaggggacuuccagagucaaugaacgucacccuucagcggacggauaccgggagcgcuugggc

SEQ ID NO: 417928 - RNA, 64 nt, Human
ggcuugggagugcagccuucucggcacuggagugucagcggaggccccaggcagcccaagagcu

SEQ ID NO: 417929 - RNA, 64 nt, Human
gaaggaaugagugcaauuucuaagacuuugaaacucagcggaaucaaucagcuguguuaugcca

SEQ ID NO: 417930 - RNA, 64 nt, Human
cacagauguacccacuagcccagguugcugugagucagcggaagcucccguuaugcccuuugcu

SEQ ID NO: 417931 - RNA, 64 nt, Human
agccgggaaccuaggucagggccacccuccauucucagcggacagccucugccucugucuccug

SEQ ID NO: 417932 - RNA, 64 nt, Human
ugaaguuuaaauucuaguguccauaaauaaaguuucagcggaacacagccgugcuuaugugcgu

SEQ ID NO: 417933 - RNA, 64 nt, Human
uguccugcccuuccgcccacgagugcgccauguuucagcggagcggcgugugggagaagccacg

SEQ ID NO: 417934 - RNA, 64 nt, Human
gcugcuugguguucuucuggaggagcgugaguucucagcggagcgcuucucggcacuucugaug

SEQ ID NO: 417935 - RNA, 64 nt, Human
caagaugccccgggacugaggccgcccugcaccuucagcggauuuggggauuaggcucuuuuag

SEQ ID NO: 417936 - RNA, 64 nt, Human
aucuuggacagacaaggaccaaaaugccaaaaucucagcggacucgauaaucugccugcugaug

SEQ ID NO: 417937 - RNA, 64 nt, Human
uugguguuugguuuuucccagccccauuuuaucuucagcggagccgcgguguuuguuuugugaa

SEQ ID NO: 417938 - RNA, 64 nt, Human; identical to SEQ ID NO: 58323

SEQ ID NO: 417939 - RNA, 64 nt, Human; identical to SEQ ID NO: 58324

SEQ ID NO: 417940 - RNA, 64 nt, Human; identical to SEQ ID NO: 58325

SEQ ID NO: 417941 - RNA, 64 nt, Human; identical to SEQ ID NO: 58326

SEQ ID NO: 417942 - RNA, 64 nt, Human
ggcagcuuugaguggcagcguggugcuagcagcuucagcggaacagggugagaguuaauuaugc

SEQ ID NO: 417943 - RNA, 64 nt, Human
gcugcuucaccuacacuaccuacaagaucccgcgucagcggauuauggauuacuaugagaccaa

SEQ ID NO: 417944 - RNA, 64 nt, Human
auguacuguuggacaacucauucacuccaccuugucagcggaugggcggaauggucucuuuucg

SEQ ID NO: 417945 - RNA, 64 nt, Human
cucucuccuaccauaauccccaccgcuuccugucucagcggaccuacuuaaguuguucacuuua

SEQ ID NO: 417946 - RNA, 64 nt, Human
guaagcucugaccccacccccaccccuugagaggucagcggaccaccuccuuagggacagaccc

SEQ ID NO: 417947 - RNA, 64 nt, Human
ggggugcucuucccccuccuuauaaauguucaggucagcggaaauguuccuuccucugagagcu

SEQ ID NO: 417948 - RNA, 64 nt, Human
cccugauccucaagcgguucccucccgucucagcucagcggaucccccagaguggaggaggccu

SEQ ID NO: 417949 - RNA, 64 nt, Human
gagcugauggggucuuauccuggccucugaggguucagcggaggugaggaaggcagcagagcuc

SEQ ID NO: 417950 - RNA, 64 nt, Human
agccgacacagccacgaaccagacaagcagacaaucagcggacaaucgguucuggacucacccc

SEQ ID NO: 417951 - RNA, 64 nt, Human
cagggagcaacucaggcccccacccaagccugcgucagcggaacuugagugaggggcguugugc

SEQ ID NO: 417952 - RNA, 64 nt, Human
ucaaaagaaguccaaagcgggaaucaugugccccucagcggagccccgggaguguccaagacag

SEQ ID NO: 417953 - RNA, 64 nt, Human
gacuucgggggcggcucugggaagcggaaagcagucagcggagaggaccccauucugggacugc

SEQ ID NO: 417954 - RNA, 64 nt, Human
ccucagaugaauuagaagaaagagguuuggggacucagcggauacuaguucuuuuaccuucugc

SEQ ID NO: 417955 - RNA, 64 nt, Human
uacuaagauaauuucagaaguucagucuauuuuuucagcggauacugccgccaccaagaaucca

SEQ ID NO: 417956 - RNA, 64 nt, Human
caacccagccucagcaucacagccgcagcucuguucagcggagcagccagccagggcggaugag

SEQ ID NO: 417957 - RNA, 64 nt, Human
cuccaugugacacaugggcucagggcugccagaaucagcggaugcuggaugggccugcagaaac

SEQ ID NO: 417958 - RNA, 64 nt, Human; identical to SEQ ID NO: 58327

SEQ ID NO: 417959 - RNA, 64 nt, Human; identical to SEQ ID NO: 58328

SEQ ID NO: 417960 - RNA, 64 nt, Human; identical to SEQ ID NO: 58329

SEQ ID NO: 417961 - RNA, 64 nt, Human; identical to SEQ ID NO: 58330

SEQ ID NO: 417962 - RNA, 64 nt, Human
ugaucccaaaaccccuuuaagaccuuagguuuccucagcggaaaacuguacuuuaaucccaaac

SEQ ID NO: 417963 - RNA, 64 nt, Human
cgcaucugcggguugcagcccacgccgcuuacucucagcggaugcagcugcucacuugggggca

SEQ ID NO: 417964 - RNA, 62 nt, Human
ggaucgauauuauaugcuguaaccaugugucuccgucugaccauucuuguuauuguuaaaau

SEQ ID NO: 417965 - RNA, 62 nt, Human
uaagugugaaacuuaauuauguagggcuccccccgucugaauagaauuaauuccuuaaaguc

SEQ ID NO: 417966 - RNA, 62 nt, Human
aguuacuugucugaggccucaucccucggaagccgucugacuccagagucugagcccccggc

SEQ ID NO: 417967 - RNA, 62 nt, Human
ugggaggugaggagcaacucugcccagccgccccgucugagaagugaggagacccuccgccu

SEQ ID NO: 417968 - RNA, 62 nt, Human
gaagugaggagacccuccgccuggcaaccgccccgucugauaaguaaggagccccucugccc

SEQ ID NO: 417969 - RNA, 62 nt, Human
uaaguaaggagccccucugcccagcagccgccccgucugagaagugaggagccccucugccc

SEQ ID NO: 417970 - RNA, 62 nt, Human
acaaacaaacaaagaagagaaggauucuuauaccgucugacauagaauccucaaaaucuucc

SEQ ID NO: 417971 - RNA, 62 nt, Human
aaggcccuggccagguguggccccuccaucuuccgucugagacuggaagacuucccagccuu

SEQ ID NO: 417972 - RNA, 62 nt, Human
gagccccccaaagacacuaccacuccccauccccgucugaccaagggcugacuucuccagga

SEQ ID NO: 417973 - RNA, 62 nt, Human
uuucauccuuuagagggaugaaacaguuauuuccgucugaugagcauucgguagaauuuuug

SEQ ID NO: 417974 - RNA, 62 nt, Human
ugcgguggggaugggggggagagcacggguccccgucugacaguggccgcugccauauucag

SEQ ID NO: 417975 - RNA, 62 nt, Human
uggaucccaggccagcgcuuugcucuccugcuccgucugaagggagcaggugcaccagccaa

SEQ ID NO: 417976 - RNA, 62 nt, Human
uuccaguggccacuuccuaaggaggaacaaccccgucugaucucagaauuggcaccacguga

SEQ ID NO: 417977 - RNA, 64 nt, Human; identical to SEQ ID NO: 58331

SEQ ID NO: 417978 - RNA, 64 nt, Human; identical to SEQ ID NO: 58332

SEQ ID NO: 417979 - RNA, 64 nt, Human; identical to SEQ ID NO: 58333

SEQ ID NO: 417980 - RNA, 64 nt, Human; identical to SEQ ID NO: 58334

SEQ ID NO: 417981 - RNA, 62 nt, Human
uaauauaagucaaaagcaagaaaaacguaaucccgucugaacucaaguagucauucauauaa

SEQ ID NO: 417982 - RNA, 62 nt, Human
ucuuacccuggcaaagcagcaacacacaugcuccgucugacaagguggucaacaacauuccu

SEQ ID NO: 417983 - RNA, 62 nt, Human
aucuacagaugcccagagguuuugaaaacuuaccgucugagcucaaauuugaucacucacaa

SEQ ID NO: 417984 - RNA, 62 nt, Human
gcccaggaaagcacagaacucaagugugguggccgucugagcuguccuuucgcuggccccgc

SEQ ID NO: 417985 - RNA, 62 nt, Human
cucccuuuguguucuauacauugugaaucuucccgucugaagaacgcccagccugcccagac

SEQ ID NO: 417986 - RNA, 62 nt, Human
auuuugcuucuuagaaagcuaaguccuggguuccgucugauuuuagguuccaggaacuuccu

SEQ ID NO: 417987 - RNA, 62 nt, Human
ucccgcaggcuucguuugccuccagaaccuucccgucugauuguuccuccccagcccccugg

SEQ ID NO: 417988 - RNA, 62 nt, Human
cagcagcgccaggaaggcuuugacaauuaccuccgucugaucuacggcucuggccugcuggu

SEQ ID NO: 417989 - RNA, 62 nt, Human
uacauuuuuuggugucuucucuucuccccuuuccgucugaauaauggguuuuagcggguccu

SEQ ID NO: 417990 - RNA, 62 nt, Human; identical to SEQ ID NO: 417983

SEQ ID NO: 417991 - RNA, 62 nt, Human
ucaggccgacagcuucggccuccacaucguccccgucugaccccaccccggagggagggagg

SEQ ID NO: 417992 - RNA, 62 nt, Human
aggcuggcuggagaagacagugggagggugccccgucugacaccccugggguugcugaggga

SEQ ID NO: 417993 - RNA, 62 nt, Human
ggcagcaagaacgaagcaggauguugucacucccgucugaauaaagcuccaugagcuggguu

SEQ ID NO: 417994 - RNA, 62 nt, Human
agagcaagaaagaaaaaggaaacaaaauaagaccgucugacagcaacaacggucccacaaac

SEQ ID NO: 417995 - RNA, 62 nt, Human
cguacagagccuuaaaccacaucguggcggugccgucugagcuguagcggguggcuuuguuu

SEQ ID NO: 417996 - RNA, 62 nt, Human
cccuuagccaaccugcugggcucaccaguuccccgucugaucugccugugcgccucccauuc

SEQ ID NO: 417997 - RNA, 64 nt, Human; identical to SEQ ID NO: 58335

SEQ ID NO: 417998 - RNA, 64 nt, Human; identical to SEQ ID NO: 58336

SEQ ID NO: 417999 - RNA, 64 nt, Human; identical to SEQ ID NO: 58337

SEQ ID NO: 418000 - RNA, 64 nt, Human; identical to SEQ ID NO: 58338

SEQ ID NO: 418001 - RNA, 62 nt, Human
agagcuuugcuaauaauuaguguggucaagagccgucugagccuaaugagucccagcugcau

SEQ ID NO: 418002 - RNA, 62 nt, Human
cagaucgacacacuguugucacuucauucuccccgucugagaaggaucuuguguucaguuag

SEQ ID NO: 418003 - RNA, 62 nt, Human
guuugaucuuuugggagucugucuuuccuuagccgucugagugagcuguguaugaacaaguc

SEQ ID NO: 418004 - RNA, 62 nt, Human
agcccuucguugcccccuuaggauugagcgucccgucugacguggaguugguauguguccug

SEQ ID NO: 418005 - RNA, 62 nt, Human
ugcagagcauuuguuuaaaacuuagccauuaaccgucugaaucguuuccuuuucuuccguag

SEQ ID NO: 418006 - RNA, 62 nt, Human
uccaccacccuuagacacaaucccagugcuacccgucugaccugcacugcucaucugcuuug

SEQ ID NO: 418007 - RNA, 62 nt, Human
cccaucaccuuggcagcaaagcacuggcucugccgucugaccccugauccaggcagcccccu

SEQ ID NO: 418008 - RNA, 62 nt, Human
uuaauuuuuccuuuaaaugacccagggcuguuccgucugauagauggaaggguaacauugcc

SEQ ID NO: 418009 - RNA, 62 nt, Human
cucugguggccacugagcuggcugacuaagccccgucugaccccagcccagacagcaaggug

SEQ ID NO: 418010 - RNA, 62 nt, Human
ggugcagauacuuucuggaccaacccucaguaccgucugaagcuccuggaggaggacgauga

SEQ ID NO: 418011 - RNA, 62 nt, Human
ggacagggacuggcuucucaccaccagccuuuccgucugauggacagcagaccccgccucca

SEQ ID NO: 418012 - RNA, 62 nt, Human
gcagaguggcccgcugggacucccaugugcugccgucugaugugcucagaugggcucaucgu

SEQ ID NO: 418013 - RNA, 62 nt, Human
acucuuggacccuccucgucugcaugguaacuccgucugagucuaccauuuucuugcucucc

SEQ ID NO: 418014 - RNA, 62 nt, Human
gggguucccuugaacaugcguaggcuggaaccccgucugagaggucucccugaauuucagug

SEQ ID NO: 418015 - RNA, 62 nt, Human
agugccgagguguccgcggcagaccacacagaccgucugaaaugcgcccgccuggcggacag

SEQ ID NO: 418016 - RNA, 62 nt, Human
ggugaagaaaauuuucaauaaauauguauuacccgucugaagcuuaaagauacuguguaacg

SEQ ID NO: 418017 - RNA, 64 nt, Human; identical to SEQ ID NO: 58339

SEQ ID NO: 418018 - RNA, 64 nt, Human; identical to SEQ ID NO: 58340

SEQ ID NO: 418019 - RNA, 64 nt, Human; identical to SEQ ID NO: 58341

SEQ ID NO: 418020 - RNA, 64 nt, Human; identical to SEQ ID NO: 58342

SEQ ID NO: 418021 - RNA, 62 nt, Human
aacacagagucucuagaagaggugcagacaucccgucugacugucccuguggacucucucag

SEQ ID NO: 418022 - RNA, 62 nt, Human
ccauggacuugccucccagagcagcacaaugcccgucugagccccacguggcaggagccucu

SEQ ID NO: 418023 - RNA, 62 nt, Human
uuuuguuguuacggguauucagccuucagucaccgucugaguucuccaguugcugccuccuu

SEQ ID NO: 418024 - RNA, 62 nt, Human
ugggaggugaggagcgucucugucuggccaccccgucugagaagugaggagaccuccgcccg

SEQ ID NO: 418025 - RNA, 62 nt, Human
gggggggaaagggagggcgagcccuugggaugccgucugaugcccuguccaaugugaggacu

SEQ ID NO: 418026 - RNA, 62 nt, Human
uggcacagcuccauguccggaggcccagcacuccgucugaugggaggagucgugggagccca

SEQ ID NO: 418027 - RNA, 62 nt, Human
cagcacccucagagcccccgcccggcugugccccgucugaccaaaguuauaauaaaaacauu

SEQ ID NO: 418028 - RNA, 62 nt, Human
agggaugaguguugggaggggaagggcuggguccgucugagugggacuuugcaccucugcug

SEQ ID NO: 418029 - RNA, 62 nt, Human
ccuggacugggccugagcuugccacagaggcuccgucugacugugggcugggaggagggagg

SEQ ID NO: 418030 - RNA, 62 nt, Human
caaguguuuuccccauuuccucuuaugaaacaccgucugagcccaagguacacauugggcgg

SEQ ID NO: 418031 - RNA, 62 nt, Human
gacaaaguggguguguggccucccuggcuccuccgucugacccucugcggccacugcgccac

SEQ ID NO: 418032 - RNA, 62 nt, Human
gcccagcucuccagggagcuucuggcccaaggccgucugagggaucugcuccuuaacccccc

SEQ ID NO: 418033 - RNA, 62 nt, Human
aacggcccugugcuuaagacacuccugcugccccgucugaggguggcaauuaaaguugcuuc

SEQ ID NO: 418034 - RNA, 62 nt, Human
ggaugccucagucuguucauucgagacuggccccgucugaaccuucucugggcacuggggac

SEQ ID NO: 418035 - RNA, 62 nt, Human
caugucucuagucauaccuagaauguucugagccgucugagggccuucaugccggcagcagc

SEQ ID NO: 418036 - RNA, 62 nt, Human
uuccuguuuauauaaauuggcaacaacuuauaccgucugacaguucaaaaucucuuucagcu

SEQ ID NO: 418037 - RNA, 64 nt, Human; identical to SEQ ID NO: 58343

SEQ ID NO: 418038 - RNA, 64 nt, Human; identical to SEQ ID NO: 58344

SEQ ID NO: 418039 - RNA, 64 nt, Human; identical to SEQ ID NO: 58345

SEQ ID NO: 418040 - RNA, 64 nt, Human; identical to SEQ ID NO: 58346

SEQ ID NO: 418041 - RNA, 62 nt, Human
ggcgcaggcagcugugagcuuuucuccaucagccgucugagaagagcagugaggccagcugc

SEQ ID NO: 418042 - RNA, 64 nt, Human
agggagacccugucuuuuuuuugggcagcguggugggggauaaauaaauaaaaggaaaaaaaac

SEQ ID NO: 418043 - RNA, 64 nt, Human
ccggucccacuaaggggcagggucgagagaggaggggggauagggggagcagaccccugagauc

SEQ ID NO: 418044 - RNA, 64 nt, Human
gaacaaccugagcuccugggccgggguggaaggagggggauaaaccuaaggcccugauccaaag

SEQ ID NO: 418045 - RNA, 64 nt, Human
ccucgcccggaccauuaggcggacugcggcgucagggggauagcggguggugagggaaggggca

SEQ ID NO: 418046 - RNA, 64 nt, Human
gggagcagccugcacucuuuuguagauuacuuuugggggauauauuuugagaaugaugaaacgg

SEQ ID NO: 418047 - RNA, 64 nt, Human
gauacuauuuccagaauaguguuuagcucaccuagggggauauguuuguauacacauuugcaua

SEQ ID NO: 418048 - RNA, 64 nt, Human
caucgcuuuugacccaaaugcaaacauuuuauuagggggauaaagagggugagguaaaguuuau

SEQ ID NO: 418049 - RNA, 64 nt, Human
acacaggccacgacaaaaugcaggcauuuuauuagggggauaaagagggcaagguaaaguuuau

SEQ ID NO: 418050 - RNA, 64 nt, Human
caccgcgccuggccaaaaugcagacauuuuauuagggggauaaggagggcaagguaaagcuuau

SEQ ID NO: 418051 - RNA, 64 nt, Human
cagcuccuucuggacccagucuggaaggucuagagggggauagaauuuuuauuucauauccuua

SEQ ID NO: 418052 - RNA, 64 nt, Human
ccagagcucaacagcuacucaacuggaggggugagggggauaaggucuguaguauacagacagg

SEQ ID NO: 418053 - RNA, 57 nt, Human
cugaggaagaugacgaguaacuccccugggggauacgacacaugcccuugaugagaa

SEQ ID NO: 418054 - RNA, 64 nt, Human
agagacccugaggaagaugaugaguaacuccccugggggauaugacacaugcccaugaugagaa

SEQ ID NO: 418055 - RNA, 64 nt, Human
ucccguuuagaguuauuuaggcuuuguaacgauugggggauaaaaagauguucagucauuuuug

SEQ ID NO: 418056 - RNA, 64 nt, Human; identical to SEQ ID NO: 37156

SEQ ID NO: 418057 - RNA, 64 nt, Human; identical to SEQ ID NO: 37163

SEQ ID NO: 418058 - RNA, 64 nt, Human; identical to SEQ ID NO: 37168

SEQ ID NO: 418059 - RNA, 62 nt, Human
cagccacuuugccuucucuggacucaguuuccccgucugagaaaugagagucgaaugcuaca

SEQ ID NO: 418060 - RNA, 62 nt, Human
uguuuagcuuucaucauuauacuccaacagacccgucugaagggguauuuuuuuuuaacaau

SEQ ID NO: 418061 - RNA, 62 nt, Human
gggagggcuccucccaugccuccugcacacagccgucugagcagggcaggugcccaacaccc

SEQ ID NO: 418062 - RNA, 62 nt, Human
cgcuccugcugauucugucggcaguugaaggcccgucugaggccccgcaaugcgaggguccu

SEQ ID NO: 418063 - RNA, 62 nt, Human
gcagccagcuuuuccagaaauagaaaauucugccgucugagguuuuauacuucagguuaguu

SEQ ID NO: 418064 - RNA, 62 nt, Human
aaguacaucaaacaaaggcauuggauuuggauccgucugaaaguguggauguggggaagcca

SEQ ID NO: 418065 - RNA, 62 nt, Human
agucggcuggaauucuaucuucugggggccuuccgucugagauggaagcugucuugggcuug

SEQ ID NO: 418066 - RNA, 64 nt, Human; identical to SEQ ID NO: 58300

SEQ ID NO: 418067 - RNA, 64 nt, Human; identical to SEQ ID NO: 58301

SEQ ID NO: 418068 - RNA, 64 nt, Human; identical to SEQ ID NO: 58302

SEQ ID NO: 418069 - RNA, 64 nt, Human; identical to SEQ ID NO: 58303

SEQ ID NO: 418070 - RNA, 64 nt, Human; identical to SEQ ID NO: 58304

SEQ ID NO: 418071 - RNA, 64 nt, Human; identical to SEQ ID NO: 58305

SEQ ID NO: 418072 - RNA, 64 nt, Human; identical to SEQ ID NO: 58306

SEQ ID NO: 418073 - RNA, 64 nt, Human; identical to SEQ ID NO: 58307

SEQ ID NO: 418074 - RNA, 64 nt, Human; identical to SEQ ID NO: 58308

SEQ ID NO: 418075 - RNA, 64 nt, Human; identical to SEQ ID NO: 58309

SEQ ID NO: 418076 - RNA, 64 nt, Human; identical to SEQ ID NO: 58310

SEQ ID NO: 418077 - RNA, 64 nt, Human; identical to SEQ ID NO: 58311

SEQ ID NO: 418078 - RNA, 64 nt, Human; identical to SEQ ID NO: 58312

SEQ ID NO: 418079 - RNA, 64 nt, Human; identical to SEQ ID NO: 58347

SEQ ID NO: 418080 - RNA, 64 nt, Human; identical to SEQ ID NO: 58348

SEQ ID NO: 418081 - RNA, 64 nt, Human; identical to SEQ ID NO: 58349

SEQ ID NO: 418082 - RNA, 64 nt, Human; identical to SEQ ID NO: 58350

SEQ ID NO: 418083 - RNA, 64 nt, Human; identical to SEQ ID NO: 58351

SEQ ID NO: 418084 - RNA, 64 nt, Human; identical to SEQ ID NO: 58352

SEQ ID NO: 418085 - RNA, 54 nt, Human; identical to SEQ ID NO: 58353

SEQ ID NO: 418086 - RNA, 64 nt, Human
aaggaaacacgcggaucugaacagcaguaauccugggggauacggggguugggcuagauuacag

SEQ ID NO: 418087 - RNA, 64 nt, Human
ggauucucauaaggaaagcaaugacuguucuugcgggggauaaaaaagggcuugggagauucau

SEQ ID NO: 418088 - RNA, 64 nt, Human
cuccaucaagaguuacuuaccaagggcaggggaagggggauauagaggucacaaggaaauaaaa

SEQ ID NO: 418089 - RNA, 64 nt, Human
gaagaauacuccuguaaucucuguaaagguuuuugggggauaaggguguuuaaccaccucccag

SEQ ID NO: 418090 - RNA, 64 nt, Human
auccacucucuguucucuuggcagggcgggggaggggggauaggagguccccuuuccccuaggu

SEQ ID NO: 418091 - RNA, 64 nt, Human
cagcucaagaacugagcuuuguauguguccuuuugggggauaacagggcuggaccaugcuuccc

SEQ ID NO: 418092 - RNA, 64 nt, Human
auaauugcuuuuucuguguauuuuguauugggcugggggauagcaucaaagguugaacuuuuug

SEQ ID NO: 418093 - RNA, 64 nt, Human
accuaauguauucccuagggucugcuuuagagaagggggauaaagagagagaaggacuguuaug

SEQ ID NO: 418094 - RNA, 64 nt, Human; identical to SEQ ID NO: 37174

SEQ ID NO: 418095 - RNA, 64 nt, Human; identical to SEQ ID NO: 37181

SEQ ID NO: 418096 - RNA, 64 nt, Human; identical to SEQ ID NO: 37187

SEQ ID NO: 418097 - RNA, 64 nt, Human; identical to SEQ ID NO: 37193

SEQ ID NO: 418098 - RNA, 64 nt, Human
cccuggcugagaguggagggauagggugcuacuugggggauaucuauuacuaaucagcacacaa

SEQ ID NO: 418099 - RNA, 64 nt, Human
uuugauuucuggauuuuucccaugauaaaaauuagggggauaaauaaaauuguuacuggaauuu

SEQ ID NO: 418100 - RNA, 64 nt, Human
uauaucccuacaaauuggcccauuuuauuggguggggggauaaaaaagggauucccuaacuuua

SEQ ID NO: 418101 - RNA, 64 nt, Human
caaguuuugcggggucuaaagcuguguguguugagggggauacucuguuuaugaaaaagaauaa

SEQ ID NO: 418102 - RNA, 64 nt, Human
ugaugagagguuugagaaaugggugaaaugaaaugggggauauguaggucaaaucaaauuaaag

SEQ ID NO: 418103 - RNA, 64 nt, Human
gaaaacccaaaguguuuuuuauucaggcuugucagggggauaacuaccagaaagguauaccugu

SEQ ID NO: 418104 - RNA, 64 nt, Human
cccagccuccccuccccaccccaugcagcccccagggggauagcccaugggccccuguggaccc

SEQ ID NO: 418105 - RNA, 64 nt, Human
uccuuuauucacuaguuacgcaaauugguuccuagggggauacuccuuaccuuccuuugugaug

SEQ ID NO: 418106 - RNA, 64 nt, Human
aggauggucagcuccaguaucuccccuaaguuuagggggauacagcuuuaccucuagccuuuug

SEQ ID NO: 418107 - RNA, 64 nt, Human
caagaggguuuuuaguggcuugggucuccccagugggggauaagucuuuugucaucaaggaggc

SEQ ID NO: 418108 - RNA, 64 nt, Human
ggugguggccacggggaggccucuuggggggugugggggauaaaacaggacagacgacaggucc

SEQ ID NO: 418109 - RNA, 64 nt, Human
acucacaauuuaaaauauuuccccuaguuuuuuggggggauaggaagaaagauuuguuacugua

SEQ ID NO: 418110 - RNA, 64 nt, Human
cccuuguugguacauuccagaggcgcaggggccugggggauaugaagcuagggaagccccugcu

SEQ ID NO: 418111 - RNA, 64 nt, Human
guguguaucguguguguguguuuuguuuugauuugggggauauuuuguacaaaaagaaaaccca

SEQ ID NO: 418112 - RNA, 64 nt, Human
ugcucuguguuggugaaauugcuguggggguaucgggggauauggccaguaaaguauugagaga

SEQ ID NO: 418113 - RNA, 64 nt, Human; identical to SEQ ID NO: 37078

SEQ ID NO: 418114 - RNA, 64 nt, Human; identical to SEQ ID NO: 37079

SEQ ID NO: 418115 - RNA, 64 nt, Human; identical to SEQ ID NO: 37198

SEQ ID NO: 418116 - RNA, 64 nt, Human
cagggcacugauuuuccucucaguuuauuauuuggggggauagggucagguggguauaguagua

SEQ ID NO: 418117 - RNA, 64 nt, Human
caggcccguguccagucauaccuagagauuuguggggggauacugaaccucuagacugaaguac

SEQ ID NO: 418118 - RNA, 64 nt, Human
gacaccauccuucagaucuauugccuuggcuucagggggauaaggagggaacauaucauaacug

SEQ ID NO: 418119 - RNA, 64 nt, Human
ugacuaccacauccuuguguuuguguguagagacgggggauagugagaaccuaagccccaucgu

SEQ ID NO: 418120 - RNA, 64 nt, Human
cuaagaaggccacucccucccaccccacugaagugggggauagucgguguccuagcaggccuca

SEQ ID NO: 418121 - RNA, 64 nt, Human
gccaauauuucuguuguauuucuauaauggguuugggggauaauaauggugaagcucaagaaca

SEQ ID NO: 418122 - RNA, 64 nt, Human
ggacuuaaaacauucacaaccuuaagccgagguggggggauauggggauucaggcaauuguuua

SEQ ID NO: 418123 - RNA, 64 nt, Human
cuucagccauuuuaguaaugcaggucugugauuugggggauagaaaacaaaguaccuaugaaac

SEQ ID NO: 418124 - RNA, 64 nt, Human
gcuaucuuccuagcauaggccccuuaaguagcaugggggauauauuuuuugcuauaacguaaaa

SEQ ID NO: 418125 - RNA, 64 nt, Human
gauuuuccuuuuucgcauauaugguuuaauaaaugggggauaauuuuuuuuuuguaaauccgug

SEQ ID NO: 418126 - RNA, 64 nt, Human
uaaagaccuuccagcuccuguguucuagaccucugggggauaagggaguccaggguggaugauc

SEQ ID NO: 418127 - RNA, 64 nt, Human
gaaaaacaccauugaaagaggcagaaacagguaagggggauaguaucuuagaaaaccuguuggu

SEQ ID NO: 418128 - RNA, 64 nt, Human
ucagcugguguugcugacacuuuccuuauggugggggggauacaaaaguauuuauuaugauucu

SEQ ID NO: 418129 - RNA, 64 nt, Human
ggguguugguuaaaguuguaccucccaaguauuugggggauauauuuauucuguauugacaaaa

SEQ ID NO: 418130 - RNA, 64 nt, Human
acagaccagcccuuccccauccugggguugcccugggggauaccagcugagucugaauucugcu

SEQ ID NO: 418131 - RNA, 64 nt, Human; identical to SEQ ID NO: 37203

SEQ ID NO: 418132 - RNA, 64 nt, Human; identical to SEQ ID NO: 37206

SEQ ID NO: 418133 - RNA, 64 nt, Human; identical to SEQ ID NO: 37212

SEQ ID NO: 418134 - RNA, 64 nt, Human
gcccaaggucagggaggggcaaccaacugccccagggggauauggguccucuggggccuucggg

SEQ ID NO: 418135 - RNA, 64 nt, Human
ugauuacaauuuuuuccuuugcagaugccuuccugggggauacuccuccccacccuaaaggguc

SEQ ID NO: 418136 - RNA, 64 nt, Human
aucugcaguauuauaaaagucauuuagaaggucagggggauaaucuagaggcaggauuuuggac

SEQ ID NO: 418137 - RNA, 64 nt, Human
ucaagacucagcaacuggaauguuaaacuaaagagggggauauuucacuuuaccaaguagauag

SEQ ID NO: 418138 - RNA, 64 nt, Human
agugagccaugaucauuccacugcauuucagccugggggauacagugagaccuugucuuuaaaa

SEQ ID NO: 418139 - RNA, 64 nt, Human
cucagccuaggcuguggccacuaagacguggguggggggauagacaggagugagagggagagug

SEQ ID NO: 418140 - RNA, 64 nt, Human
ugaguagggaaaggcauacuuuuccagggacuuagggggauaggcuuuggaaaugggacagguc

SEQ ID NO: 418141 - RNA, 64 nt, Human
cagcgggagcgcacaggugccccgcggcccagccgggggauaacgcagggcggucuucugcucc

SEQ ID NO: 418142 - RNA, 64 nt, Human
aucuuuggggguugguuugaggucuuagaacucugggggauauuccccugagcaaaacaaacaa

SEQ ID NO: 418143 - RNA, 64 nt, Human
ucugcaagaacacuggaccuuuggguucuuucuggggggauauuuccuaaggcauguggccuuu

SEQ ID NO: 418144 - RNA, 64 nt, Human
cgccaugcugggccagcagugucauaggaguggagggggauaaguggggacuggggacauguga

SEQ ID NO: 418145 - RNA, 64 nt, Human
ggauaaauaauacuaaaaggacucuaguggaaaggggggauaucgaagagcaggggguugugaa

SEQ ID NO: 418146 - RNA, 64 nt, Human
agaguaagaaacucauggaagggccaccucaggagggggauauaauguguguuguaaauauccu

SEQ ID NO: 418147 - RNA, 64 nt, Human
auuuugaaaaaauauacccucccuuuaguuuguugggggauauaaauuauucucaggaagaaua

SEQ ID NO: 418148 - RNA, 64 nt, Human
cagcucuuuguuuuccuuguaugaugaggggauugggggauacaguuauuuuacuagcaccuug

SEQ ID NO: 418149 - RNA, 64 nt, Human; identical to SEQ ID NO: 37218

SEQ ID NO: 418150 - RNA, 64 nt, Human; identical to SEQ ID NO: 37224

SEQ ID NO: 418151 - RNA, 64 nt, Human; identical to SEQ ID NO: 37228

SEQ ID NO: 418152 - RNA, 64 nt, Human
gucaguggcaggugccugaacagaggguggaugggggggauaccggagggggucuugucuuccc

SEQ ID NO: 418153 - RNA, 64 nt, Human
gagcagaauccugcacauuaaaggaugggguugggggggauacauuuauuuuauuuucucacua

SEQ ID NO: 418154 - RNA, 64 nt, Human
acaguucacuguagcaacagauuugguggugauggggggauagagguagaagcagauagaaggu

SEQ ID NO: 418155 - RNA, 64 nt, Human
uuggcugccauccaggaccccaauuugugcuucagggggauaaucuccuucucucggaucauug

SEQ ID NO: 418156 - RNA, 64 nt, Human
uucccuuugagucccaguuucccuuuugguuacagggggauaguagcccccagggaucauguga

SEQ ID NO: 418157 - RNA, 64 nt, Human
ccuuuaaaaaggugcacuacaguuuuagcggggagggggauaggaagacgcagagcaaaugagc

SEQ ID NO: 418158 - RNA, 64 nt, Human
gugccugggaccgcuccagcugcacugcagccaggggggauaccagcuucauuccucagaguaa

SEQ ID NO: 418159 - RNA, 64 nt, Human
cgguuacauuauuaaaugauucuagggauucacugggggauauuuuuguugcuuuuacuuucau

SEQ ID NO: 418160 - RNA, 64 nt, Human
caaaaagcaauauuuuucaucacaugccaaaaacgggggauagagagaaggaguggcaggccua

SEQ ID NO: 418161 - RNA, 64 nt, Human
ccccgggacuguuggggggauucugagggccagagggggauauauaugauuccccaggcccugc

SEQ ID NO: 418162 - RNA, 64 nt, Human
cuauuuagguuaauguucacuuuacaaaggugaugggggauauuuuguuaggugauagcagaag

SEQ ID NO: 418163 - RNA, 64 nt, Human
gguuccuuuguucccuaaguccaacuacuaaacugggggauauuaugaagggccuugagcaucu

SEQ ID NO: 418164 - RNA, 64 nt, Human
gaccacuacuauacugauggugggauugggaccugggggauacaggggccccaggaagaagcug

SEQ ID NO: 418165 - RNA, 64 nt, Human
uuacaggcgugagucaccacaccuggcccauggugggggauauguuuuaagacccccaguuaau

SEQ ID NO: 418166 - RNA, 54 nt, Human
ccacugggaguagcggcuaaagcugggggauagaggggcugcagggccacugga

SEQ ID NO: 418167 - RNA, 64 nt, Human; identical to SEQ ID NO: 37234

SEQ ID NO: 418168 - RNA, 64 nt, Human; identical to SEQ ID NO: 37239

SEQ ID NO: 418169 - RNA, 64 nt, Human; identical to SEQ ID NO: 37245

SEQ ID NO: 418170 - RNA, 53 nt, Human
aucgcuguggcugcucuuaaggugggggauagaggaugccucccccacagacc

SEQ ID NO: 418171 - RNA, 64 nt, Human
ggaauuuuuuuuuuaguuuuuauuuuuugguuuugggggauauuuuuuauuuguuucauucauu

SEQ ID NO: 418172 - RNA, 64 nt, Human
uagaauacuuugacuuaauuuucuuccagauacagggggauaccugccuguuuuucaaaguguu

SEQ ID NO: 418173 - RNA, 64 nt, Human
acaacuggcuaauuuuuacauuuuuaguagagacgggggauauugcuauguuggccaggcuggu

SEQ ID NO: 418174 - RNA, 64 nt, Human
uccuuccuucaccucugaaaacggcccucuugaagggggauaugaauggagauuugaaggucug

SEQ ID NO: 418175 - RNA, 64 nt, Human
gguuaucaucagaagguggucuccccucaggccugggggauaaggacgugggcccagccacaug

SEQ ID NO: 418176 - RNA, 64 nt, Human
agcugaaaacauucaaaaguucacaucccuguuugggggauaccauucaccgccuucagcccag

SEQ ID NO: 418177 - RNA, 64 nt, Human
uuguguguguguguguguuguaucaugaguguuugggggauaaguuuuuguuaaaacaaagucu

SEQ ID NO: 418178 - RNA, 64 nt, Human
cagaagucccagucugaggauguccuuggugcuugggggauacggguucuguccacagaguccc

SEQ ID NO: 418179 - RNA, 64 nt, Human
auuguaauuuuaaacauuuaauuaaauguaauuugggggauauuuugaacuuuaauauuaguga

SEQ ID NO: 418180 - RNA, 64 nt, Human
cgaugaccucucgguaguuucaaagggggcuggagggggauauuugacuuguuuuuucgaaaug

SEQ ID NO: 418181 - RNA, 64 nt, Human
cuaaaaagcuuuguguucuucaggguggguggcagggggauauagugaggguggaccagggaga

SEQ ID NO: 418182 - RNA, 64 nt, Human
aacucugggaguuguggugggaggaggcacuucugggggauaggaccagacaagauaacaggag

SEQ ID NO: 418183 - RNA, 64 nt, Human
aucccagcacuacuuuuuauuacuggagaaaugggggggauagaaaauucuacuuugaauuauu

SEQ ID NO: 418184 - RNA, 64 nt, Human
ucucaaauaaauacaguaguccccacuuaucugagggggauacauucaaagacccccagcagau

SEQ ID NO: 418185 - RNA, 64 nt, Human; identical to SEQ ID NO: 37249

SEQ ID NO: 418186 - RNA, 64 nt, Human; identical to SEQ ID NO: 37255

SEQ ID NO: 418187 - RNA, 64 nt, Human; identical to SEQ ID NO: 37259

SEQ ID NO: 418188 - RNA, 64 nt, Human
gaaucugcaggcugcuuguaggacuguucaccaagggggauaccagcagcaagagagugcaccc

SEQ ID NO: 418189 - RNA, 64 nt, Human
ccauaacuaggacuuuaucagaaacucaaagcuugggggauaaaaaggagcaagagaauacugu

SEQ ID NO: 418190 - RNA, 64 nt, Human
caguaaaauauucccuuuguuaauguuauagaaggggggauacaaaaaggaacuaacaauuugu

SEQ ID NO: 418191 - RNA, 64 nt, Human
ucuuuucccuucccaaagguggguguugaacuaggggggauauugcuguccugagggacccucu

SEQ ID NO: 418192 - RNA, 64 nt, Human
guaucagcccccaacauauuauuuuucauuauuugggggauauuucaguuccagagcagcagua

SEQ ID NO: 418193 - RNA, 64 nt, Human
cguucuuucuucauugcaggcuaguauauaccgagggggauacaaccguuuugcuccauacuaa

SEQ ID NO: 418194 - RNA, 64 nt, Human
guccuagauuuuuguagccaagcagaguuguagagggggauaaaaagaaaagaaauuggaugua

SEQ ID NO: 418195 - RNA, 64 nt, Human
cacaugaggguuucuuguugcuuuuggagggugugggggauauuuuguuuugguuuuucugcag

SEQ ID NO: 418196 - RNA, 64 nt, Human
gcauuccgaggccagaguaacauuuugaacuuuggggggauauuuguucaucacuuggguagaa

SEQ ID NO: 418197 - RNA, 64 nt, Human
gccaggaccugcuugaacuaccagggccacaggagggggauaaucagagcuugaggcuggcacu

SEQ ID NO: 418198 - RNA, 64 nt, Human
uggugaggcugcaguuucugcucuuuuucaucaggggggauagucucuaggauuuuucagugag

SEQ ID NO: 418199 - RNA, 64 nt, Human
auugcuucucccuugcuucaaagaaucuagcagcgggggauaggauuuugcaacaaaaagcuga

SEQ ID NO: 418200 - RNA, 64 nt, Human
gguucaggcaguuccugucaucucugaaaagacugggggauaugaaaucuucccccuaccccac

SEQ ID NO: 418201 - RNA, 64 nt, Human
gguggagccaggggcaaaucuuaaugggaccagugggggauaccccagagcccauggccugacu

SEQ ID NO: 418202 - RNA, 64 nt, Human
ccacaauuauauaaaucauuucaagacuagaauagggggauauaauacauauuacuccacaccu

SEQ ID NO: 418203 - RNA, 63 nt, Human
uacuccgaaaauuucaucaucuaagaaaaugauuccauacaaauaacucagcacacaagugac

SEQ ID NO: 418204 - RNA, 63 nt, Human
uauucuuggagaacuuuccaucugcuuguauuuuccauacacauccccagccagaaguuagug

SEQ ID NO: 418205 - RNA, 63 nt, Human
cugugcucccuaaaaguuguacuucauuucuuuuccauacacugugugcuauuuguguuaaca

SEQ ID NO: 418206 - RNA, 64 nt, Human
ggacccuauucccuuggggucaagugaaaggguagggggauaguccugaucaagugugauaaau

SEQ ID NO: 418207 - RNA, 64 nt, Human
gcugucgguuuuuaccugccuguuguggauggaugggggauacccaccuuucugaagugucccc

SEQ ID NO: 418208 - RNA, 64 nt, Human
cugaugccagcucugugccaggcacauuggacaugggggauacacuagugggcagaaauagccc

SEQ ID NO: 418209 - RNA, 64 nt, Human
guugcagccuuuuugaaggggacacagucuaggagggggauaaaugggaugcccuugccccaga

SEQ ID NO: 418210 - RNA, 64 nt, Human
uacagugaccauuugaacauuggugaguggagaggggggauauauggucagcagcuguuuugaa

SEQ ID NO: 418211 - RNA, 64 nt, Human
gcuuuugcuuuguccauuuucaucauuuuaaaaugggggauaauaacagaacuuguuuccuagg

SEQ ID NO: 418212 - RNA, 64 nt, Human
ugauaguuauuaauaguaucuaaauaaaauauuggggggauagaaaaauaaugcuguuagcuca

SEQ ID NO: 418213 - RNA, 64 nt, Human
gggccugaaaccuuagcccccagccggccugagugggggauauugacacccccagcuaaagcac

SEQ ID NO: 418214 - RNA, 64 nt, Human
cccuuuccugggucucagacaacucagaagguuggggggauaccagagaggugguggaauagga

SEQ ID NO: 418215 - RNA, 64 nt, Human
guggggugcagcuggguggggcagcacaccucuggggggauaauguccccacucccgaaagccu

SEQ ID NO: 418216 - RNA, 64 nt, Human
ccaguuuuggcugcugguucccagcaggggacucgggggauauacaguggcugcaccaaauugg

SEQ ID NO: 418217 - RNA, 64 nt, Human
cagccuccccaacuugauguuuguguuuuguuuggggggauauuuuucauaauuauuuaaaaga

SEQ ID NO: 418218 - RNA, 64 nt, Human
ugaugggauugguaaccccucgcuacucaagauggggggauacaaacaccuucagggaagggga

SEQ ID NO: 418219 - RNA, 54 nt, Human
acuccaguacaucuaauuaaguuugggggauaagcaggaaagagcgcugcguga

SEQ ID NO: 418220 - RNA, 64 nt, Human
auauacaugcgugucucaguaaaaauuauaaaaugggggauaauuauaauaccuaccucauaau

SEQ ID NO: 418221 - RNA, 63 nt, Human
ucaguaucugaacuauaagcccauuuauacuguuccauacaaaagcuauuuuucaaaaauuaa

SEQ ID NO: 418222 - RNA, 63 nt, Human
uagaucuuggcuuccuuuagaagccacuuaacuuccauacacuauaauaaacugugaacauau

SEQ ID NO: 418223 - RNA, 63 nt, Human
guuuuuuugccuccuguucuaauaaauuuugucuccauacaaaucugaaccccaaguguguac

SEQ ID NO: 418224 - RNA, 64 nt, Human
aauuauuucaguggcucuuuuggccucuuacuaggggggauagucuuguuucuagcuuaaacaa

SEQ ID NO: 418225 - RNA, 64 nt, Human
aacaaacccaauuucuacaaauguuguuuacaucaaauuggacagggaugcagacacuguccau

SEQ ID NO: 418226 - RNA, 64 nt, Human
auuaggagaaagugaggugcuauauagaauauugaaauuggaagaacauuuuauuuucucuuau

SEQ ID NO: 418227 - RNA, 64 nt, Human
ugugaaggugaagaauauguugguuuagagaaagaaauuggauguaauuuuaugcaauuuacuu

SEQ ID NO: 418228 - RNA, 64 nt, Human
aaggaaugaccuguucuuguucuacagagaauggaaauuggaagucaaacacccuuuguauucc

SEQ ID NO: 418229 - RNA, 64 nt, Human
uuacaaggacaagguuuccauuuuuccaguuguaaaauuggaaccaucagcugauaaccucgua

SEQ ID NO: 418230 - RNA, 64 nt, Human
uugagcauuauucuuggcgcacaguccaaaauacaaauuggacagaagaucuauauuguaccag

SEQ ID NO: 418231 - RNA, 64 nt, Human
cugggguuugaucucagcuucugaaaauguuuaaaaauuggaaggaaauacuacucauaucuuc

SEQ ID NO: 418232 - RNA, 64 nt, Human
gauucccauuugucuaaggauuugaagggggucuaaauuggauguaucuuacuuagucuaaaga

SEQ ID NO: 418233 - RNA, 64 nt, Human
agaaucccuaagagauacucaaaugauuaaauuaaaauuggaucaucaaacucaagagaggcau

SEQ ID NO: 418234 - RNA, 64 nt, Human
uuuaaugaaauugguuuacagaaguaaaaaacaaaaauuggaaagcaaaguaauaaaacuuagu

SEQ ID NO: 418235 - RNA, 64 nt, Human
ucuccucucucucucuccuauacuaacuuguuucaaauuggaaguaaugauauguauugcccaa

SEQ ID NO: 418236 - RNA, 64 nt, Human
cauauuccauguuuggaagacccuuggaagaggaaaauuggauucccuuaaacaaaaguguuua

SEQ ID NO: 418237 - RNA, 64 nt, Human
cauguauaauaaauacaucucuuaaucuccuaauaaauuggaccuuuaaacuacagauacauuu

SEQ ID NO: 418238 - RNA, 64 nt, Human
ggcccugcugcgagucacuccauuuaucuuaaagaaauuggacagcauaugaagauuggacauc

SEQ ID NO: 418239 - RNA, 64 nt, Human
agagguucuaaaaucaugaaacuuguuucacugaaaauuggacagauugccuguuucugauuug

SEQ ID NO: 418240 - RNA, 63 nt, Human
uuugacacugaaaguuuuguaaaagaaaucauguccauacacuuuguugcaagaugugaauua

SEQ ID NO: 418241 - RNA, 63 nt, Human
cugaacuuaucuaccugguuaugauacuguggguccauacacaaguaaaauaagauuagacag

SEQ ID NO: 418242 - RNA, 63 nt, Human
gugacaagaacuauacuugcaacucuuuuugaauccauacaggucgucuggccaaugauucuu

SEQ ID NO: 418243 - RNA, 64 nt, Human
auuuuagccccaggucucaguaccuggcuggggagggggauauuuuuccuuccuuaaguaguuu

SEQ ID NO: 418244 - RNA, 64 nt, Human
augauguuuacuaacgaugaauuuuacauccaaagggggauaggcacuuggacccccauucucc

SEQ ID NO: 418245 - RNA, 64 nt, Human
agggcugugcgaucucuuggccugguccuugcagcuguggcagcagcaggcuccccagcggccc

SEQ ID NO: 418246 - RNA, 64 nt, Human
cuuugacaucguggcuguccaguugggcugugagcuguggcacccaggacuggcgcuggcccuu

SEQ ID NO: 418247 - RNA, 64 nt, Human
ggugugugcccacaacacucuaggugcagagccccuguggcaaaguauuacagggugugggugg

SEQ ID NO: 418248 - RNA, 64 nt, Human
caaagggaagugaggcccaaggagcuuacccaagcuguggcagccgucccaggccacccccaug

SEQ ID NO: 418249 - RNA, 64 nt, Human
cuaggugcuuugcuuccuuucaucagguaucuuucuguggcauuugagaacagaaaccaagaaa

SEQ ID NO: 418250 - RNA, 64 nt, Human
ggagagguggggguggagugggcaagggcacacccuguggcaggggguccuauaauuuugugua

SEQ ID NO: 418251 - RNA, 64 nt, Human
ugaacaauuaaggggaaaagcuucccuuuucccucuguggcaguuacgauuuugacuucagucc

SEQ ID NO: 418252 - RNA, 64 nt, Human
uuuuuugauccucugaguaagggaaggaagauuccuguggcauguugauuucuauggccaacuu

SEQ ID NO: 418253 - RNA, 64 nt, Human
cagcaggaaacauggggacugccuaggcucgaaucuguggcacccugagcaauuacuuaaauug

SEQ ID NO: 418254 - RNA, 64 nt, Human
auccaaaaauuuuuugucccuacauagcaauuuucuguggcacugagaaaccauguaugaccac

SEQ ID NO: 418255 - RNA, 64 nt, Human
auauccauguuucuucccuuucugauauuguugucuguggcauauucuuuguauggcgaauuua

SEQ ID NO: 418256 - RNA, 64 nt, Human
uuggccuagggacaugaaguaugggaguggguggcuguggcacagacagguggaaaacgggaua

SEQ ID NO: 418257 - RNA, 64 nt, Human
ugaguccaaggugugaccagcuuccuccagaccccuguggcagaccgggggccagacacagaua

SEQ ID NO: 418258 - RNA, 63 nt, Human
caaucggggaugcagacaaguggcuacaaacuuuccauacaacaggugaagauaacgagacuu

SEQ ID NO: 418259 - RNA, 63 nt, Human
gcuuucccaaauccuguuugguuaauuguagccuccauacaguggggucuucucuguggcugg

SEQ ID NO: 418260 - RNA, 63 nt, Human
gggcagggcuuggacccccgucuccauggcagguccauacagcauggguggcaggguuuggac

SEQ ID NO: 418261 - RNA, 64 nt, Human
ggcaggugcauuugugccugcccagcaguuccagcuguggcaaaagucucuuccauggacaagu

SEQ ID NO: 418262 - RNA, 64 nt, Human
aaucauuucuagauacugaggcugcgaacuaguucuguggcaguggacuagcauaaguggaugu

SEQ ID NO: 418263 - RNA, 64 nt, Human
uauacugaagaacuagagugucacugcuggugaacuguggcacgguugcucaacacaucaccuc

SEQ ID NO: 418264 - RNA, 64 nt, Human
gcagcuucaguauuagcagagccacaggccgccucuguggcaucaccaggguuucucugaagaa

SEQ ID NO: 418265 - RNA, 64 nt, Human
cuuuauuuuucacaguuuuauucuucuucacuaucuguggcaugaccagcuguaucugaaagag

SEQ ID NO: 418266 - RNA, 64 nt, Human
ucuauuuuuaaacaagcaguugacuuaaaacuuucuguggcaacuucugguuuucugacaguuc

SEQ ID NO: 418267 - RNA, 64 nt, Human
accauugcggcucuguccacuucucguugcugcucuguggcacauaucggaagcaguacagcgc

SEQ ID NO: 418268 - RNA, 64 nt, Human
uaaauugacucagaaaccugcgguuucagcuuuucuguggcaaacagggccgagggcuggugaa

SEQ ID NO: 418269 - RNA, 64 nt, Human
gggcucuccaaaggggcugcuggggcaugugugccuguggcagaaaagaggagacccuggaauu

SEQ ID NO: 418270 - RNA, 64 nt, Human
ggcuggcaagcagggaaagcuccacggugcguggcuguggcacagacuucuggaaggcuggcug

SEQ ID NO: 418271 - RNA, 64 nt, Human
ggcugaggcaccugcagucacccacacucugggccuguggcaccaucugugccucagcugacug

SEQ ID NO: 418272 - RNA, 64 nt, Human
ccugcuggcuccugggugagcugaagaaccuugccuguggcacuuuucgagggugagcuggaac

SEQ ID NO: 418273 - RNA, 64 nt, Human
acacccugccaggacugcagcccccauggugaugcuguggcaucagacauguccguggugggca

SEQ ID NO: 418274 - RNA, 64 nt, Human
uugaauacacugacuaauguuuguuaaacuuuuucuguggcaccuuggccacaugccugcaggc

SEQ ID NO: 418275 - RNA, 64 nt, Human
ccuucuggagaagcugcugggaucggaccagccacuguggcagaugggagccaagcuugaggac

SEQ ID NO: 418276 - RNA, 63 nt, Human
aaacuuggauagagccaguucaaccucccccaauccauacacauacauaccuaggucauccua

SEQ ID NO: 418277 - RNA, 63 nt, Human
auuaucuugaaccugugcuauuaaauggaaauuuccauacaucuuccccauacuauuuuuuau

SEQ ID NO: 418278 - RNA, 63 nt, Human
auggcaugccgugaucagaagucaugcaugagauccauacaccacaggacacuacuaaucuag

SEQ ID NO: 418279 - RNA, 64 nt, Human
acuguauauaaucaaauacaguguggguuaggaccuguggcagaccauuauaauaaagcauggc

SEQ ID NO: 418280 - RNA, 64 nt, Human
gauggaggaaaaggccaacucuguccuggucuugcuguggcaccccaucgccccacagcucgua

SEQ ID NO: 418281 - RNA, 64 nt, Human
ccagagugcugugacuugcaugauggauucuaggcuguggcaagggcugauuucugggauaggg

SEQ ID NO: 418282 - RNA, 64 nt, Human
uuaauuaccaacagugaagcacuacaggaggcaacuguggcauugcuuccuuaaccagcucaug

SEQ ID NO: 418283 - RNA, 64 nt, Human
aaaacauucaaagagacauauacuaagauguucacuguggcauugucuguaaugacaaauaagu

SEQ ID NO: 418284 - RNA, 64 nt, Human
cagacaccugaccuagaaugccugcccgcuaucccuguggcaggaaauauccccucauguccca

SEQ ID NO: 418285 - RNA, 64 nt, Human
ccuuggcagcauguaccacacagccaagcugagacuguggcaauguguugagucauauacauuu

SEQ ID NO: 418286 - RNA, 64 nt, Human
uguggcugcaggaacuuaauuuauagggaggagccuguggcagcugcugccccagccacagcug

SEQ ID NO: 418287 - RNA, 64 nt, Human
aagcaaagaucagcagaaaaauuggcugucccaccuguggcaaaugcuggagccucaguuaaag

SEQ ID NO: 418288 - RNA, 64 nt, Human
aaccugcccagagagcuuuaccuuucccaagcaucuguggcauggacauguccucugugcagug

SEQ ID NO: 418289 - RNA, 64 nt, Human
cauuucaucuaccauuuucugguucuuguguuggcuguggcaggccagcugugguuuucuuuug

SEQ ID NO: 418290 - RNA, 64 nt, Human
cccuucccucgguuccagucuucccuuuaaaagccuguggcauuuuuccuccuucucccuaacu

SEQ ID NO: 418291 - RNA, 64 nt, Human
ggcucuuugcaugaucacaguucuguguucuggccuguggcagggccgggaagggccgcuggcu

SEQ ID NO: 418292 - RNA, 64 nt, Human
ggaauugugugucugguaacuggaaggccuuccacuguggcaaauggaggcuuuucacugccug

SEQ ID NO: 418293 - RNA, 64 nt, Human
cuugacuguaaaaguaccccauaccguugacgcgcuguggcagaccugugggugcggucucccc

SEQ ID NO: 418294 - RNA, 63 nt, Human
ggaggguguuuauguaagagcaccuuccucacuuccauacagcucuacguggcaaauuaacuu

SEQ ID NO: 418295 - RNA, 63 nt, Human
guuguucauauaguauccuuuaaccucuaguuuuccauacauccuuuguuuguuucucauuuu

SEQ ID NO: 418296 - RNA, 63 nt, Human
caguguauuuguguaaaguuugucauuucauacuccauacacuacaguugcugucacugaucc

SEQ ID NO: 418297 - RNA, 64 nt, Human
uucugcaacaccaugagaccugagcaagaaugugcuguggcagagggggucuugguuucauaaa

SEQ ID NO: 418298 - RNA, 64 nt, Human
auccuuucaauauuuuuauaaacuuuugugugugcuguggcagggaacaguuaacaaggaguuu

SEQ ID NO: 418299 - RNA, 64 nt, Human
gagccuucauauuuucuucuuugcugccuucucccuguggcaauguacuguucucacauuaagc

SEQ ID NO: 418300 - RNA, 64 nt, Human
uagcaaaagcuggacuaaagcccaaauggauugucuguggcaaugcagaagcugauagcauuaa

SEQ ID NO: 418301 - RNA, 64 nt, Human
uacugcacugaggccaaguuaggauggcaucacucuguggcagcucucccuggacuugcccugc

SEQ ID NO: 418302 - RNA, 64 nt, Human
uuucagggaggaucugugaggucaacuguuggcacuguggcaugaaucaaggugguggcagcaa

SEQ ID NO: 418303 - RNA, 64 nt, Human
uuuuggaaaaggcacucaguucuuggcugccguccuguggcagcuuaauggaacaaaaauuaca

SEQ ID NO: 418304 - RNA, 64 nt, Human
aaauauuuacguaccuuuauaaauucaguugcaucuguggcaaaauuucagacuauuuuugcgu

SEQ ID NO: 418305 - RNA, 64 nt, Human
gcuacaauggcuccuagacacucaacgacuucaucuguggcagggagagaggaggccggaagaa

SEQ ID NO: 418306 - RNA, 64 nt, Human
acuguauuuuguuuuuuccuuucuagccacaugacuguggcauugcacaaauacagucucugua

SEQ ID NO: 418307 - RNA, 64 nt, Human
uauuaaagggaugcuuuuuaccuuuugcuguuugcuguggcagauuccccagauaaccaaggaa

SEQ ID NO: 418308 - RNA, 64 nt, Human
uugugaugcccucuugguuuugauacuuuaaaaucuguggcacccguucuacaugaauuaucaa

SEQ ID NO: 418309 - RNA, 64 nt, Human
gcuguuggugaggugggacgaaugcacuugcuuccuguggcaauaaagauuuucugugccucac

SEQ ID NO: 418310 - RNA, 64 nt, Human
gaaauuuugcagaugugccuaugagcacaaacuucuguggcaaaugccaguuuuguuuaauaau

SEQ ID NO: 418311 - RNA, 64 nt, Human
gaucugauuggcuguaaguaucucuacuguguaccuguggcauuccuucacaguggguuacaag

SEQ ID NO: 418312 - RNA, 63 nt, Human
uuguuuacaacauuuuugcaaaucuaaaguugcuccauacaaugacuagucaccugggggggu

SEQ ID NO: 418313 - RNA, 63 nt, Human
uguguuuugccuccuguucuaauuaauuuugucuccauacauaucugaaccccaaguguguac

SEQ ID NO: 418314 - RNA, 63 nt, Human
gggacaggauacuugucacauauuugaagaaauuccauacagugaaggaaauuugagucugua

SEQ ID NO: 418315 - RNA, 64 nt, Human
ucugggucucuaaucugugcuguuucaaaguucucuguggcaaagcagcaacuauucacaaaau

SEQ ID NO: 418316 - RNA, 64 nt, Human
cuggagccugcccucagagugucccuuuccagugcuguggcauucuguggcagcuuccccaggu

SEQ ID NO: 418317 - RNA, 64 nt, Human
cccucagagugucccuuuccagugcuguggcauucuguggcagcuuccccagguguggugacgg

SEQ ID NO: 418318 - RNA, 64 nt, Human
gauugagggugugugggcuggaaccagugggucacuguggcagcuucaucugagccgaaggugu

SEQ ID NO: 418319 - RNA, 64 nt, Human
uggcuccuguaucacauacggaggucuuguguaucuguggcaacagggaguuuccuuauucacu

SEQ ID NO: 418320 - RNA, 64 nt, Human
guccugccucuuugcuagcaaaugcuuuuagacacuguggcagugagucauccucuaauuucua

SEQ ID NO: 418321 - RNA, 64 nt, Human
ucuucccccccccccccccccccgcaaaauaauucuguggcagggcaagguuuaaauguguuuc

SEQ ID NO: 418322 - RNA, 64 nt, Human
ugaagagcccagaggaggaguuuggccagguggacuguggcagaucaauaaagaaaggcuucuu

SEQ ID NO: 418323 - RNA, 64 nt, Human
ggaacuaguuucaauaaugaggugucaugguucccuguggcaaauuuagaacacuuaucguuug

SEQ ID NO: 418324 - RNA, 64 nt, Human
ggggcccgggcucuguaggaaaguugguccuugacuguggcauugcacucugcacuguuucucu

SEQ ID NO: 418325 - RNA, 64 nt, Human
gagauagugaaaguaacugaccagagcugaggaacuguggcacagcaccucguggccuggagcc

SEQ ID NO: 418326 - RNA, 64 nt, Human
uauaauaagauagguuguguuuauaaaauacaaacuguggcauacauucucuauacaaacuuga

SEQ ID NO: 418327 - RNA, 64 nt, Human
aagcagaggcugagggcaggcaaagccugugugacuguggcagugccggaggccaagggggcca

SEQ ID NO: 418328 - RNA, 64 nt, Human
uaucuaugacuguguuuaauaguauaucuaauggcuguggcauuguugaugcucacauaugaua

SEQ ID NO: 418329 - RNA, 64 nt, Human
gggucccgcaagggacgccguggaagaaaggagccuguggcaacaggcggccgagcugccgaau

SEQ ID NO: 418330 - RNA, 64 nt, Human; identical to SEQ ID NO: 37257

SEQ ID NO: 418331 - RNA, 64 nt, Human; identical to SEQ ID NO: 37258

SEQ ID NO: 418332 - RNA, 64 nt, Human; identical to SEQ ID NO: 37260

SEQ ID NO: 418333 - RNA, 64 nt, Human
accaucuuucugccuuaagggcaggagcccacuucuguggcaccagauuccacccugggaacug

SEQ ID NO: 418334 - RNA, 64 nt, Human
cuuguuuaacuuguugcuacugggacuugauuuacuguggcacuaguuaaguaaguuaaaaaaa

SEQ ID NO: 418335 - RNA, 64 nt, Human
ucacucccugcgagaaauuaggaugaauaacuaccuguggcauuguugguucugaacuuuuaca

SEQ ID NO: 418336 - RNA, 64 nt, Human
aguacuggcugauggaguaaaucgcuaccuuuugcuguggcaaaugggcccucuaauuaauuuc

SEQ ID NO: 418337 - RNA, 64 nt, Human
ccugucccccaacaggugugacugcucugacaaccuguggcaugcugcagggucaggcuccuga

SEQ ID NO: 418338 - RNA, 64 nt, Human
acauuuuucuugcuuguucucucuguacucaaaccuguggcaaauucauccuagcaacguuauu

SEQ ID NO: 418339 - RNA, 64 nt, Human
gaaaagacaaaugucuugacuguugaccucgguccuguggcagacugcagucaacagugugccu

SEQ ID NO: 418340 - RNA, 64 nt, Human
gccaugaggaggcagagagggucacugggggacacuguggcagcaggagggacucugucuggcc

SEQ ID NO: 418341 - RNA, 64 nt, Human
ggccuuggggccuagcccagcucugagcagaggacuguggcauucacuguccuugaguguuuca

SEQ ID NO: 418342 - RNA, 64 nt, Human
ugcuugcgcuacuggcagagcugcugcgaggacccuguggcagcuuugaugugcgcaagacagc

SEQ ID NO: 418343 - RNA, 64 nt, Human
cguuuccuucacauuccagcuggcccggaucccucuguggcacagggcccugcccgucacaugc

SEQ ID NO: 418344 - RNA, 64 nt, Human
ccccugcucccauugugugugugaaauucucagucuguggcauguuugaccuguggcaggacuc

SEQ ID NO: 418345 - RNA, 64 nt, Human
gugugugaaauucucagucuguggcauguuugaccuguggcaggacucgcugcugccaggugag

SEQ ID NO: 418346 - RNA, 64 nt, Human
guccaccuuuucugauguguguugucagccugugcuguggcauagacauggaugcgaggaccac

SEQ ID NO: 418347 - RNA, 64 nt, Human
ggccagucgggggaggagaaagacgcgauuaacacuguggcauucagccaggccccauguccuc

SEQ ID NO: 418348 - RNA, 64 nt, Human; identical to SEQ ID NO: 37253

SEQ ID NO: 418349 - RNA, 64 nt, Human; identical to SEQ ID NO: 37254

SEQ ID NO: 418350 - RNA, 64 nt, Human; identical to SEQ ID NO: 37261

SEQ ID NO: 418351 - RNA, 64 nt, Human
uuuccaaugacgucaacagugugugcgaugguaccuguggcaagagcgagggcagucccaguga

SEQ ID NO: 418352 - RNA, 64 nt, Human
cgggagggaaugucagugaauuggcuugaauguucuguggcaauccacaggucuagccaaauau

SEQ ID NO: 418353 - RNA, 64 nt, Human
aaaauucugcugcacucugcuugggccuugaggucuguggcagggcuccucuggcccgcagugg

SEQ ID NO: 418354 - RNA, 64 nt, Human
aaagcuguaagaaaaugcugucacagacccaucccuguggcaucgucagcagaauacugcuugc

SEQ ID NO: 418355 - RNA, 64 nt, Human
auuugaaaaauauaaaauuaugagauugguuuuccuguggcauaaauugcaucacuguaucauu

SEQ ID NO: 418356 - RNA, 64 nt, Human
cauccugcaagcuccacagccucgggcugccagccuguggcacuguccucgguguguccuggag

SEQ ID NO: 418357 - RNA, 64 nt, Human
ugaucuuauaucuguuaaaaguuguuuuaaaaagcuguggcaucccauuguucauauuugccaa

SEQ ID NO: 418358 - RNA, 64 nt, Human
cccaagaccccacuggccaccccucccucugguccuguggcacccccuaccucuguucugccug

SEQ ID NO: 418359 - RNA, 64 nt, Human
agagaccacugcccuuugugguuggacagaauaucuguggcaucaugggcuauggcugcuggaa

SEQ ID NO: 418360 - RNA, 64 nt, Human
ucccauuggccagaauccacagacacaccuaagccuguggcacugggacagaauagauuuucca

SEQ ID NO: 418361 - RNA, 64 nt, Human
uuugccuuuguugacuggugguagaacuccaguucuguggcaaggggcagccacaccauuucuc

SEQ ID NO: 418362 - RNA, 64 nt, Human
aaauggaacaaguagcuuccagaccagauacuaccuguggcaagaaugcugccuaccaguuaac

SEQ ID NO: 418363 - RNA, 64 nt, Human
augggcucaaccagaaaagcccaaguucaugcagcuguggcagaguuacaguucugugguuuca

SEQ ID NO: 418364 - RNA, 64 nt, Human
cuguaacugccaaucugucuguguaagcuggaaucuguggcaacuauuacccuguguuguauuu

SEQ ID NO: 418365 - RNA, 64 nt, Human
aguugggugguuauuaaaaugcuuuuaaagucaacuguggcaccaauucuaauguaauccaacu

SEQ ID NO: 418366 - RNA, 63 nt, Human; identical to SEQ ID NO: 37262

SEQ ID NO: 418367 - RNA, 64 nt, Human; identical to SEQ ID NO: 37263

SEQ ID NO: 418368 - RNA, 64 nt, Human; identical to SEQ ID NO: 37264

SEQ ID NO: 418369 - RNA, 64 nt, Human
cucacucuuacacgaguacugcagugauaccgaacuguggcacgccaaagcaaaggauaaccau

SEQ ID NO: 418370 - RNA, 64 nt, Human
aaagaaccugagcucuuccuaaguagauccaggccuguggcagccaaggccaagcaggcccauc

SEQ ID NO: 418371 - RNA, 64 nt, Human
cacaauuugcuacagcaacaaaaaagacauugggcuguggcauuauuaauuaaagaugauaucc

SEQ ID NO: 418372 - RNA, 64 nt, Human
agagaacaggcugucuagucagaugcagcuugaucuguggcaaaaccaaguguggucuuucagc

SEQ ID NO: 418373 - RNA, 64 nt, Human
cauccuccagggggcccagggugccugcacuuugcuguggcaggcagauugggugguaguggga

SEQ ID NO: 418374 - RNA, 64 nt, Human
cuguccucugggcuucuccucugcccaggucacccuguggcaggccugggcccucaggauguuu

SEQ ID NO: 418375 - RNA, 64 nt, Human
gcucugaccguuuccucucauggguuugcuuuaccuguggcagcagguugcugcuuuccaggga

SEQ ID NO: 418376 - RNA, 64 nt, Human
guguucaaagccaagcaaaaugcacacccuuuuucuguggcaaaucgucucuguacaugugugu

SEQ ID NO: 418377 - RNA, 64 nt, Human
gaagggaggaagacuuuaucauguuccuaaaaaucuguggcaagcacccaucguauuauccaaa

SEQ ID NO: 418378 - RNA, 64 nt, Human
auggggaaucaaacugaaugaacuuuucucugcacuguggcaaaacuguuauuuuuauggauuu

SEQ ID NO: 418379 - RNA, 64 nt, Human
aaguucgagaggaggagcuauuugcgaggaagcccuguggcaauagagauaggcuuaaaagcgg

SEQ ID NO: 418380 - RNA, 64 nt, Human
uagaugguuaguuuucaccugaaauuauuuucuucuguggcaacuaaguggauaauuacaucca

SEQ ID NO: 418381 - RNA, 64 nt, Human
gagauuuaccacccagguaaugguuagaaauauucuguggcaaugaagaaaacacuagggaaaa

SEQ ID NO: 418382 - RNA, 64 nt, Human
gauaaugcuuccagugaaugugaacuucuuuucccuguggcacugauugacagacuugugcuga

SEQ ID NO: 418383 - RNA, 64 nt, Human
cucgcagugauagguuugcagagugugugcuuggcuguggcagccuagcuuggagaagcugcug

SEQ ID NO: 418384 - RNA, 64 nt, Human; identical to SEQ ID NO: 37247

SEQ ID NO: 418385 - RNA, 64 nt, Human; identical to SEQ ID NO: 37248

SEQ ID NO: 418386 - RNA, 64 nt, Human; identical to SEQ ID NO: 37265

SEQ ID NO: 418387 - RNA, 64 nt, Human
auugcauuuuggaugccauuugauuguaauaaaacuguggcaccuuaauuuugaauggcagcau

SEQ ID NO: 418388 - RNA, 64 nt, Human
ggccaggcuggccagggcgugggcaggugguguccuguggcaccuccauccuccugcccagccg

SEQ ID NO: 418389 - RNA, 64 nt, Human
caaaacaugccccaggaacaagcaccccuugccucuguggcagcugcgagugugucugauuuca

SEQ ID NO: 418390 - RNA, 64 nt, Human
auucgaaguuuuauccauguuauauauuguacuccuguggcaugaaaaauagcucccaagauau

SEQ ID NO: 418391 - RNA, 64 nt, Human
uuuaagcccacaugcagcagugggucagauaacccuguggcagugacacgggcaaauuggcauu

SEQ ID NO: 418392 - RNA, 64 nt, Human
ucuuguaguagguaggggguacuacuagggauaucuguggcaugauuaugcauuccguaguauu

SEQ ID NO: 418393 - RNA, 64 nt, Human
uuuugguaaacauacaaauucugauauagagccucuguggcaaagggaauuucucaguuccugc

SEQ ID NO: 418394 - RNA, 64 nt, Human
uucuuuggugccuuuccuguucagcauucuuagccuguggcaguaaagagaaacuuugugcuac

SEQ ID NO: 418395 - RNA, 64 nt, Human
gcugcauguccugacccucuuugaauuaaguggacuguggcaugacauucugcaauacuuugcu

SEQ ID NO: 418396 - RNA, 64 nt, Human
acuuugggagagggcacagauugcagagguaaugcuguggcauauugcuucugccucaguguau

SEQ ID NO: 418397 - RNA, 64 nt, Human
ccaugagcucugcccaggacccucucucaagcaccuguggcauaccuucaugugcuccacugca

SEQ ID NO: 418398 - RNA, 64 nt, Human
agaccgugcaugccuuguccucuuaagacaacuccuguggcaccguuucucccuccacagggcc

SEQ ID NO: 418399 - RNA, 64 nt, Human
ggggcuggggggaauccugccaguuggugaagcccuguggcaggaagguauauguggacauaga

SEQ ID NO: 418400 - RNA, 64 nt, Human
ccaccagcccaggacccuccagaggcagccuggccuguggcaucagucccugagucaccaugga

SEQ ID NO: 418401 - RNA, 64 nt, Human
uugugugguggcuucuuguccuucucuuugacuucuguggcauggugcuagugcauguacccug

SEQ ID NO: 418402 - RNA, 64 nt, Human; identical to SEQ ID NO: 37266

SEQ ID NO: 418403 - RNA, 64 nt, Human; identical to SEQ ID NO: 37268

SEQ ID NO: 418404 - RNA, 64 nt, Human; identical to SEQ ID NO: 37269

SEQ ID NO: 418405 - RNA, 64 nt, Human
acgccuguggguuucgugaaugagaucgaggcugcuguggcacccugcccguccuggccuggag

SEQ ID NO: 418406 - RNA, 64 nt, Human
ugcccuggugaaauaaauaaaagaugggcaguuucuguggcauuuuaggcauagguuugcaauc

SEQ ID NO: 418407 - RNA, 64 nt, Human
gacacuaagagggcugggugggagaugcuuggcucuguggcaucuguucagcgaggcuuuuccu

SEQ ID NO: 418408 - RNA, 64 nt, Human
agcacaucaaagaaugcaauuaacugauaacaugcuguggcaagcuauguccgcaguucccagg

SEQ ID NO: 418409 - RNA, 64 nt, Human
cuucuuccaggccacuaagguagcauguuauccacuguggcacugccuaacuccguguauccuc

SEQ ID NO: 418410 - RNA, 64 nt, Human
uguguaaauagagcaagaaaacaguauucugcaucuguggcauuuauguagaguugcaguugug

SEQ ID NO: 418411 - RNA, 64 nt, Human
guggcucccacugacgggcacugagccugguacccuguggcauggagaagccucagggaaaggc

SEQ ID NO: 418412 - RNA, 64 nt, Human
ugaugacguacguuauuuccauggaagauagccgcuguggcagcugucacaucaccacagcucc

SEQ ID NO: 418413 - RNA, 52 nt, Human
acuggcacuucgggcaauaacucuguggcacgugggcaucacguaagcagca

SEQ ID NO: 418414 - RNA, 64 nt, Human
auaacugaucuuguuuuauuuuuuggcauugcaacuguggcauaguuacaauuucuguuuguuc

SEQ ID NO: 418415 - RNA, 64 nt, Human
acuuuuaauuuuuuuagcugccauuuaagcauuccuguggcacccaucaccauuucaauuuaau

SEQ ID NO: 418416 - RNA, 64 nt, Human
caaacagcacuuuaggaaaagucaccguagcccacuguggcaucagaaaauucuugggggcuga

SEQ ID NO: 418417 - RNA, 64 nt, Human
caggaugcaggcucuggagagagaacaggaugcccuguggcagggucuggagcugcuacagcau

SEQ ID NO: 418418 - RNA, 64 nt, Human
ugcucuuuuagaacgggaaacggcucagauccugcuguggcacggggccuaugugucucugucg

SEQ ID NO: 418419 - RNA, 64 nt, Human
gaacaguuuacuaaugcacuacugaaguuuaaaucuguggcacaaucaauguaagcaugggguu

SEQ ID NO: 418420 - RNA, 64 nt, Human; identical to SEQ ID NO: 37213

SEQ ID NO: 418421 - RNA, 64 nt, Human; identical to SEQ ID NO: 37215

SEQ ID NO: 418422 - RNA, 64 nt, Human; identical to SEQ ID NO: 37216

SEQ ID NO: 418423 - RNA, 64 nt, Human
gggccaauaugguguuuacauuauauaauuccugcuguggcaaguaaagcacacuuuuuuuuuc

SEQ ID NO: 418424 - RNA, 64 nt, Human
guggccacacuaugucaagaagccucuccacacucuguggcacuuccagucccauaaauccugu

SEQ ID NO: 418425 - RNA, 64 nt, Human
gaagaaaauagagggagaaacagaagucuuaagucuguggcacacugugucuucagacaguuug

SEQ ID NO: 418426 - RNA, 64 nt, Human
ugucagugggcugcucuggcccuggugugcacggcuguggcagcuguugaugccaguguccucu

SEQ ID NO: 418427 - RNA, 64 nt, Human
uuucagagaggugagagugaacacauugucucugcuguggcaaagauggccacgcugguguuug

SEQ ID NO: 418428 - RNA, 64 nt, Human
cauuuugugauuuuggguuauuuauuuugugcaucuguggcaauaaaugagaucucaguggugg

SEQ ID NO: 418429 - RNA, 64 nt, Human
ucccuggcacguuuauuucacagcagagccaagucuguggcagguugacacagacuguguugcc

SEQ ID NO: 418430 - RNA, 64 nt, Human
cacaccucucccauccaggcguucuucagucagccuguggcacuguucaucugcugucccgaag

SEQ ID NO: 418431 - RNA, 64 nt, Human
augcguaacuggucagugugucuggccagcguggcuguggcacuuggccaggacgcuccguuga

SEQ ID NO: 418432 - RNA, 64 nt, Human
agcuaucaaauaaaguagguguaaaaacaacugucuguggcauuuguauacaucgagaacauuu

SEQ ID NO: 418433 - RNA, 64 nt, Human
guuucaguggagcucagaggacggggagauagaacuguggcacuuaggggagaugacauuugcu

SEQ ID NO: 418434 - RNA, 64 nt, Human
uaauggggauuccucugguuguucacugccaaaacuguggcauuuucauuacaggagaguuuac

SEQ ID NO: 418435 - RNA, 64 nt, Human
aguggagaaucucucagcacacguagauccaaaucuguggcaccugcuaaagauuaggauuugg

SEQ ID NO: 418436 - RNA, 64 nt, Human
cagcagguacacaucuugccacaaaaccaguaaccuguggcacugagaucgcacaccggucguc

SEQ ID NO: 418437 - RNA, 64 nt, Human
cagagaaaacgaagggugucauuucuucuuuucccuguggcaucguggauccuuuacauuuagc

SEQ ID NO: 418438 - RNA, 64 nt, Human; identical to SEQ ID NO: 37210

SEQ ID NO: 418439 - RNA, 64 nt, Human; identical to SEQ ID NO: 37211

SEQ ID NO: 418440 - RNA, 64 nt, Human; identical to SEQ ID NO: 37217

SEQ ID NO: 418441 - RNA, 64 nt, Human
gucuauccuagugauaauacauugucagccuuuucuguggcaccuuccagaugagaaugaggga

SEQ ID NO: 418442 - RNA, 64 nt, Human
ggaaagaacuuccccuucccugucucccaucccucuguggcaggcgccucucaccagggcagga

SEQ ID NO: 418443 - RNA, 64 nt, Human
uucauacuggaaagaaacccuacaaaugugaagucuguggcaaagcuuuuaacugauucucaac

SEQ ID NO: 418444 - RNA, 64 nt, Human
ugcccaucaggcgucuacacugucacucagacaccuguggcauguggaggagacugcccugucc

SEQ ID NO: 418445 - RNA, 64 nt, Human
cugaugaaggucauuuuuuuuuuuugacaucuuucuguggcaaagcucuuagaauucuuugcag

SEQ ID NO: 418446 - RNA, 64 nt, Human
uggcucaugccuauaaucccggcacuuugggagucuguggcaggaggauugcuugaggccagga

SEQ ID NO: 418447 - RNA, 64 nt, Human
caguggaagaaacacccuuucaucucagaguccacuguggcacuggccaccccuccccaguaca

SEQ ID NO: 418448 - RNA, 64 nt, Human
ggauuauuugcagguuugguuuuuucucauuugucuguggcauuggagaauauucucgguuuaa

SEQ ID NO: 418449 - RNA, 64 nt, Human
cuucagcauuuuaaguaacuggcuucaagggguacuguggcaaccaaauaaaauaacuccauuu

SEQ ID NO: 418450 - RNA, 64 nt, Human
gcuugcaccguagguucuuuaaccagcucccucacuguggcaucaagguugcuuuuggcuuuug

SEQ ID NO: 418451 - RNA, 64 nt, Human
ccggcuuuugaccauauucaucgcuauuuaaaaccuguggcaaaaugaacgcuuauuuuacaga

SEQ ID NO: 418452 - RNA, 64 nt, Human
uguuaaugaauuaagaacacauucuaacaagggucuguggcagacauugccgagugacuuucuu

SEQ ID NO: 418453 - RNA, 64 nt, Human
uguuaaugaauuaagaacacauucuaacaagggucuguggcagacauugccgagugacuuucua

SEQ ID NO: 418454 - RNA, 64 nt, Human
ucagagguuacuaggguuuaggaaacgugaaaggcuguggcaucaggguaggggagcauucugc

SEQ ID NO: 418455 - RNA, 64 nt, Human
agcagcauuuugacccuuggagaagaaaaacuagcuguggcauuccagguggagaaccugacag

SEQ ID NO: 418456 - RNA, 64 nt, Human; identical to SEQ ID NO: 37270

SEQ ID NO: 418457 - RNA, 64 nt, Human; identical to SEQ ID NO: 37271

SEQ ID NO: 418458 - RNA, 64 nt, Human; identical to SEQ ID NO: 37272

SEQ ID NO: 418459 - RNA, 64 nt, Human
accagaugaacaacacacacgcugcuguaucucccuguggcagauuuguagccucguguggcuu

SEQ ID NO: 418460 - RNA, 64 nt, Human
uggcgggcaccuguaaucccagcuacucgggaggcuguggcaggagaaucgcuugaacccagga

SEQ ID NO: 418461 - RNA, 64 nt, Human
aaaucagcaucaaaacauuccuaguguucaaauacuguggcauuuuccauugaaaauugcugaa

SEQ ID NO: 418462 - RNA, 64 nt, Human
ucacuaaaauauguuuguaacccccaaaucaauacuguggcacuuucucaguuauucgcagaca

SEQ ID NO: 418463 - RNA, 64 nt, Human
aaugauuacuauaugcaaaacucugugcucuguucuguggcauagaacuuccuuugauaugcug

SEQ ID NO: 418464 - RNA, 64 nt, Human
agagauucuuuguuuuauuucacugauuaauauacuguggcaaauuacacagauuauuaaauuu

SEQ ID NO: 418465 - RNA, 64 nt, Human
cuggaggcagcagugcuggauggaauugucuaggcuguggcauguugguuuugucuuucuuuuc

SEQ ID NO: 418466 - RNA, 51 nt, Human
auguaauccaaaauaacugagcuguggcaguuguggaccauaugacacagc

SEQ ID NO: 418467 - RNA, 64 nt, Human
gauuguggcauuuaaggagcaguggcccaugugacuguggcauuuucggcacuuuucauuacuu

SEQ ID NO: 418468 - RNA, 64 nt, Human
agauacugcggggugguagaaaagguagaguaggcuguggcaauggaauaaaacacgauuaaaa

SEQ ID NO: 418469 - RNA, 64 nt, Human
acuccuuccucuuucucagcagagcuguagcugacuguggcauuacuacgccuccccacacgcc

SEQ ID NO: 418470 - RNA, 64 nt, Human
uccucccugggcagaauguagcuuuucugcuucacuguggcagccuccucccuggauccuuaga

SEQ ID NO: 418471 - RNA, 64 nt, Human
gaaagaaagcaguaauugacauuuccugcagagucuguggcaagagggaaaguaaccaucuaug

SEQ ID NO: 418472 - RNA, 56 nt, Human
gaagccagagcuucuacugaggagggcuguggcagagccacugucacacagaaugc

SEQ ID NO: 418473 - RNA, 64 nt, Human
uuccuaaguuaaaagcaucgcuuaaccuuggcuccuguggcauuuuacaaagguuuaaaggaau

SEQ ID NO: 418474 - RNA, 64 nt, Human; identical to SEQ ID NO: 37219

SEQ ID NO: 418475 - RNA, 64 nt, Human; identical to SEQ ID NO: 37220

SEQ ID NO: 418476 - RNA, 64 nt, Human; identical to SEQ ID NO: 37221

SEQ ID NO: 418477 - RNA, 64 nt, Human
uccagcaaaagcugucuacuuucucuuuuauucacuguggcaccaaucugguaaauuguagaac

SEQ ID NO: 418478 - RNA, 64 nt, Human
uaaaacagacagaagugagcuuaucuguuugaugcuguggcagggucccagucacugggcauau

SEQ ID NO: 418479 - RNA, 64 nt, Human
uauuaaauuguauuccaaaccuguucuucuguuucuguggcaccuagguuuaaaauauguauua

SEQ ID NO: 418480 - RNA, 64 nt, Human
caggugugaaggagcacaggugagggggugccugcuguggcacagagcugggaaggccuuacag

SEQ ID NO: 418481 - RNA, 64 nt, Human
ucaaaggagcagugguggcuggcgcgcuuucgcacuguggcagccacgagagucugugcacguc

SEQ ID NO: 418482 - RNA, 64 nt, Human
gccaaccacauuuuccuuugggauaauuuauuuccuguggcaucuagccagaagaaauugagga

SEQ ID NO: 418483 - RNA, 64 nt, Human
ucugacucaucucagaaaugucaauucuuaaacacuguggcaacaggaccuagaauggcugacg

SEQ ID NO: 418484 - RNA, 64 nt, Human
guaagagcucagcaucccaggggcaucuucuugacuguggcauuuccuguccaccgccgguuua

SEQ ID NO: 418485 - RNA, 64 nt, Human
gcucucccuguccuuagccgauuuugagggaacccuguggcaccugucccuggaugaagagcug

SEQ ID NO: 418486 - RNA, 64 nt, Human
uuggcagugcaaucucuuuccaggauuucguuugcuguggcauugguuauaucagagcacuuua

SEQ ID NO: 418487 - RNA, 64 nt, Human
aaagaaacaguggcauagacuccuucacacaucacuguggcaccagcaacuacuucuuuauauu

SEQ ID NO: 418488 - RNA, 64 nt, Human
ccuggcccugguucccaggguggcguccacucggcuguggcaggaggagcugccucuucucuug

SEQ ID NO: 418489 - RNA, 64 nt, Human
guaaggugaaaauuagccauccauuauuuaucuucuguggcaaugcauuuauaugguugauugg

SEQ ID NO: 418490 - RNA, 64 nt, Human
aaguaucuauuguggaagcagccaaaaagggcugcuguggcaggaauugguuaauuucuccuuc

SEQ ID NO: 418491 - RNA, 64 nt, Human
accaaaggaaccccucccuggugucugaucagggcuguggcaucacgaaacauuggaucaugac

SEQ ID NO: 418492 - RNA, 64 nt, Human; identical to SEQ ID NO: 37222

SEQ ID NO: 418493 - RNA, 64 nt, Human; identical to SEQ ID NO: 37223

SEQ ID NO: 418494 - RNA, 64 nt, Human; identical to SEQ ID NO: 37225

SEQ ID NO: 418495 - RNA, 64 nt, Human
uccaccugugaucaccucccccugcuuccugcugcuguggcacagcucacucauggggucugag

SEQ ID NO: 418496 - RNA, 64 nt, Human
gccucacaaucccacaggcccacccccagugggccuguggcauucauauuucauauucauauuu

SEQ ID NO: 418497 - RNA, 64 nt, Human
cagccaggagcuguucaccuuccagaagcagggccuguggcagccuaacagggagaggccacgg

SEQ ID NO: 418498 - RNA, 64 nt, Human
aaggcuuggugucugcggggggugucuucccugccuguggcauuuguguguuggcuuugcagcu

SEQ ID NO: 418499 - RNA, 64 nt, Human
auaagccagugugguucuggggaccugaggagcccuguggcacccacagggggcaccuaugucu

SEQ ID NO: 418500 - RNA, 64 nt, Human
gcccuucacuccgcccccaugacugggaagaggccuguggcagcgccgcuggacccuaggaggc

SEQ ID NO: 418501 - RNA, 64 nt, Human
gggccccaccucagaaccaaacucacuguccccacuguggcaugagggcaguggagcaccaugu

SEQ ID NO: 418502 - RNA, 64 nt, Human
aagaaggcugugaugucgcugucaggaucaugcccuguggcacagcacagguggugggaggugg

SEQ ID NO: 418503 - RNA, 64 nt, Human
uccugauggacuugcguugggaugugggggacaccuguggcaugguaaggcucccugagucccu

SEQ ID NO: 418504 - RNA, 64 nt, Human
gggacuucgggugggcagaggcaccuugcugggucuguggcauuuuccaagggcccacguagca

SEQ ID NO: 418505 - RNA, 64 nt, Human
ugggcuccaggucagcucugcaaggggcuugucucuguggcacccacacuccugcccugccagg

SEQ ID NO: 418506 - RNA, 64 nt, Human
uguuguacccuuguuuugaaacuagaaaucuguccuguggcaugcaaaagaaagcaaauuauuu

SEQ ID NO: 418507 - RNA, 64 nt, Human
uuccuuugccucuugccuguccccuaaaacuugacuguggcacucagggucaaacagacuaucc

SEQ ID NO: 418508 - RNA, 64 nt, Human
uuguuucaguuggcagaacauuuacuggccccaacuguggcaucauccucucagcagucuuccu

SEQ ID NO: 418509 - RNA, 63 nt, Human
aggaagaaguagacaacugaaaagggcgggagacuguggcaccuuggaagguaccacuugaaa

SEQ ID NO: 418510 - RNA, 64 nt, Human; identical to SEQ ID NO: 37229

SEQ ID NO: 418511 - RNA, 64 nt, Human; identical to SEQ ID NO: 37230

SEQ ID NO: 418512 - RNA, 64 nt, Human; identical to SEQ ID NO: 37231

SEQ ID NO: 418513 - RNA, 64 nt, Human
aagucagaggauggccagugucugucccgggguccuguggcaggcagcgccaagcaaccugggu

SEQ ID NO: 418514 - RNA, 64 nt, Human
gcuaguggccauaugcagggaauggugcuucuggcuguggcacgcacuggaucacccagguccc

SEQ ID NO: 418515 - RNA, 64 nt, Human
caggcaggcuuucugggugugacugauucccagccuguggcagggcguggucccaacuacucag

SEQ ID NO: 418516 - RNA, 64 nt, Human
acaccagcgcccccuggggggccucacacagccccuguggcagaagcaguugcccuccucugua

SEQ ID NO: 418517 - RNA, 64 nt, Human
cacgccgaggcuuuggagugaacagcccgcuuggcuguggcaucucaguccuauuuuugaguuu

SEQ ID NO: 418518 - RNA, 64 nt, Human
caggaaggaagccaacccugagcgagccuguccucuguggcagguccacacggugugggugggc

SEQ ID NO: 418519 - RNA, 64 nt, Human
aggcaucaugcaugucaaacaugagauguguggacuguggcacuugccugggucacacacggag

SEQ ID NO: 418520 - RNA, 64 nt, Human
auuuauuauuagacaaauucauuauagaaaaaaccuguggcaaaaacguuucuuucuuauuuuu

SEQ ID NO: 418521 - RNA, 64 nt, Human
cuuucauuaauuuucccccuccuuuuugaaaguccuguggcaguacuaauauuuucauuuuaug

SEQ ID NO: 418522 - RNA, 64 nt, Human
cacaauuauuuuuaaacacuggcauuuuccaaaacuguggcagcuaacuuuuuaaaaucucaaa

SEQ ID NO: 418523 - RNA, 64 nt, Human
aaccgaaguugaguaaguucccacacugcuggaccuguggcaaagagugcuuugaauaagucag

SEQ ID NO: 418524 - RNA, 64 nt, Human
ccuuugcugaaaaaaaaucaucuugcccacaggccuguggcaaaaggauaaaaaugugaacgaa

SEQ ID NO: 418525 - RNA, 64 nt, Human
gauauugguucuuccccucauaguaauaagauggcuguggcauuuccaaacauccaaaaaaagg

SEQ ID NO: 418526 - RNA, 64 nt, Human
agauuucagccccaggccuuugcugcaagugacccuguggcaacaguggauucucagacaugau

SEQ ID NO: 418527 - RNA, 53 nt, Human
uggauguuaagauggugugagagcuguggcaaggucaccccacugaggaugcu

SEQ ID NO: 418528 - RNA, 64 nt, Human; identical to SEQ ID NO: 37273

SEQ ID NO: 418529 - RNA, 64 nt, Human; identical to SEQ ID NO: 37274

SEQ ID NO: 418530 - RNA, 64 nt, Human; identical to SEQ ID NO: 37275

SEQ ID NO: 418531 - RNA, 64 nt, Human
aguccagaugugucccugaugcugcuggaggcugcuguggcacaaagaaaagcugcuaaaucua

SEQ ID NO: 418532 - RNA, 64 nt, Human
ugugcuguccagggccuaggcugauagucagagccuguggcacaccugggaugggccagggccc

SEQ ID NO: 418533 - RNA, 64 nt, Human
auacauuuucaucaauaucacuuugggagaauaacuguggcacaugcucuuucugcuuucucug

SEQ ID NO: 418534 - RNA, 64 nt, Human
augcaagggaugauggaaagcagcacaugcguuucuguggcagcuguggggacuugacagcaau

SEQ ID NO: 418535 - RNA, 55 nt, Human
uacgcuugacaucuuccuagaguagcuguggcaaaaucuugaagacuacucagcu

SEQ ID NO: 418536 - RNA, 64 nt, Human
aacacuuuccacauagaaaauagauuaguauuaccuguggcaccuuuuaagaaagggucaaaug

SEQ ID NO: 418537 - RNA, 64 nt, Human
ggaaggacgucacaacuccaggugcucagacugccuguggcagcagaaccagugccuuuggcau

SEQ ID NO: 418538 - RNA, 64 nt, Human
gacacaguggagauucucuggcacucugaggucucuguggcaggccuggucaggcucuccaggu

SEQ ID NO: 418539 - RNA, 64 nt, Human
cccccuagugccccacaccauguacugccugccccuguggcagggcaucaaccuggugcuccug

SEQ ID NO: 418540 - RNA, 64 nt, Human
aauuuaauuuuccaugagaaacaacagaguuaaccuguggcauuaggagaccuacuucaugugg

SEQ ID NO: 418541 - RNA, 64 nt, Human
gagccagcaagcuuuacugcaaagugaaaagaugcuguggcaguuccugaaggugggaagccug

SEQ ID NO: 418542 - RNA, 64 nt, Human
cguguguggcucaggaggaaaagcucagccuggacuguggcagccacggcagaagguggaucuu

SEQ ID NO: 418543 - RNA, 64 nt, Human
ggguggccagcagggacgcgccccaggugggcagcuguggcagagcagcgacccgcggcggggc

SEQ ID NO: 418544 - RNA, 64 nt, Human
gggcggccagcagggacgcgccccaggugggcagcuguggcagagcagucccgacaccuaaaua

SEQ ID NO: 418545 - RNA, 64 nt, Human
augcuaaaucauuccuacaaagguuugacugaaacuguggcagaugucucaucuucuuuauaug

SEQ ID NO: 418546 - RNA, 64 nt, Human; identical to SEQ ID NO: 37235

SEQ ID NO: 418547 - RNA, 64 nt, Human; identical to SEQ ID NO: 37236

SEQ ID NO: 418548 - RNA, 64 nt, Human; identical to SEQ ID NO: 37237

SEQ ID NO: 418549 - RNA, 64 nt, Human
aucuggcagaauccgccaagcggcugggcccaggcuguggcaugauggccggaggcaagaagca

SEQ ID NO: 418550 - RNA, 64 nt, Human
uauccuccuuuaacuccgaccagaacccuucuuccuguggcacuccccacccauagaccuucag

SEQ ID NO: 418551 - RNA, 64 nt, Human
uggcuccugccacugaccucaccggcaugcuggccuguggcaggccuaggaccucaggcgggga

SEQ ID NO: 418552 - RNA, 64 nt, Human
gaaucuuaccauguaaauccaaaucucugcaauccuguggcaccaaccaguggugcucauucua

SEQ ID NO: 418553 - RNA, 64 nt, Human
aguuucauucucaacucuagcccugcacacucaccuguggcacggaaugaaaacagagcuuccc

SEQ ID NO: 418554 - RNA, 64 nt, Human
gcuuccuccugguucugccccaccacaaaguuuucuguggcaagugcuggaacauaguuguagg

SEQ ID NO: 418555 - RNA, 64 nt, Human
gaugcaucugcaccugacuuuggggccacgugcccuguggcaccccagcucacugggagucuca

SEQ ID NO: 418556 - RNA, 64 nt, Human
ugccuucuaguuccaaauauuuuagccagcuucacuguggcaauagucuuucagagaaaagacu

SEQ ID NO: 418557 - RNA, 64 nt, Human
gccauccaaaggggaugggcgggauuggaagaagcuguggcagcucuuuucccuguucaccucc

SEQ ID NO: 418558 - RNA, 64 nt, Human
ucccuuccucuuuccucugcugcuuuccuuccuucuguggcaggguauuuuaauauauuuuuca

SEQ ID NO: 418559 - RNA, 64 nt, Human
ccgugggagcccggccagggcagggggcucguugcuguggcacccccucucugccagcaccaag

SEQ ID NO: 418560 - RNA, 64 nt, Human
uccacaagcacuauggcccccggcucaagugcugcuguggcaaagcuccggugaggcccaggau

SEQ ID NO: 418561 - RNA, 64 nt, Human
augucaggagccaggucuaggcccagcuuucacacuguggcagcccagugaagcagacugggcc

SEQ ID NO: 418562 - RNA, 64 nt, Human
uuggauuggcacuguuugccauucucuggguuggcuguggcaucuacccucccucccugcugcc

SEQ ID NO: 418563 - RNA, 64 nt, Human
caugcuggaagccugaggccucccuggacugagccuguggcacugcgugcgggacaguuauguu

SEQ ID NO: 418564 - RNA, 64 nt, Human; identical to SEQ ID NO: 37226

SEQ ID NO: 418565 - RNA, 64 nt, Human; identical to SEQ ID NO: 37227

SEQ ID NO: 418566 - RNA, 64 nt, Human; identical to SEQ ID NO: 37238

SEQ ID NO: 418567 - RNA, 64 nt, Human
accugugacaagggcuguguugaccacagucacacuguggcaugacuggauacccaaacuacac

SEQ ID NO: 418568 - RNA, 64 nt, Human
cccagguacuccaggcccuccuggcuggagagggcuguggcaauagaaaauuagugccaacugc

SEQ ID NO: 418569 - RNA, 64 nt, Human
cucccaucccaaagguucaaaaguuuucaaauaacuguggcagcucaccaaaggugggggaaag

SEQ ID NO: 418570 - RNA, 64 nt, Human
ccaugcuuuuucagaaauguuaggccugaagugccuguggcauguugcagcagcuauuuugcca

SEQ ID NO: 418571 - RNA, 64 nt, Human
uguccaguccauucaaggcuagccugcccaugcacuguggcagggguuggauuggagggagaga

SEQ ID NO: 418572 - RNA, 64 nt, Human
acagacaaauacucuagauuccacgagcagcagccuguggcacccgcugggcgcgggcagcagg

SEQ ID NO: 418573 - RNA, 64 nt, Human
agccucuuguggugguggcugugcccccuaugcccuguggcauuucugcgucuuacuggcaacc

SEQ ID NO: 418574 - RNA, 64 nt, Human
gagcgggguccccucugugcuucgacuacugcuccuguggcaggaggcuuuggguggcucacua

SEQ ID NO: 418575 - RNA, 64 nt, Human
uaugugcccucaccauccaauaaaggccccuuggcuguggcauggcaacugacuuaccuucccc

SEQ ID NO: 418576 - RNA, 64 nt, Human
aagcuuugaugggucaugggccaugccauacccccuguggcaauggaguguguggaugcucacc

SEQ ID NO: 418577 - RNA, 64 nt, Human
gaggaacaucaguuuucaaaccaacacugaaauucuguggcaucacauauauugggccuugaug

SEQ ID NO: 418578 - RNA, 64 nt, Human
uguguagacaugucagagcuuggcccucuuuccucuguggcaaagcgugucccauagaaaauug

SEQ ID NO: 418579 - RNA, 64 nt, Human
aaaacauuugaaggaccuaaauucguagcaaauucuguggcaguuuuaaaaaguuaagcugcua

SEQ ID NO: 418580 - RNA, 64 nt, Human
gcagguccccaggaccuggaugacacccgccucacuguggcaguguauugccuguuaauugcug

SEQ ID NO: 418581 - RNA, 64 nt, Human
gcuggaaaugccagggcaggggggccccacggugcuguggcagagcuagagggguccuuagacu

SEQ ID NO: 418582 - RNA, 64 nt, Human; identical to SEQ ID NO: 37240

SEQ ID NO: 418583 - RNA, 64 nt, Human; identical to SEQ ID NO: 37241

SEQ ID NO: 418584 - RNA, 64 nt, Human; identical to SEQ ID NO: 37242

SEQ ID NO: 418585 - RNA, 64 nt, Human
cuccccaugccacguuccacaguugccaccaccucuguggcauugaaaugagcaccuccauuaa

SEQ ID NO: 418586 - RNA, 64 nt, Human
uugaguugaaaguaaacacaagcuggcugcuucccuguggcaacuguggcuauugugagccucc

SEQ ID NO: 418587 - RNA, 64 nt, Human
agagccaggcuuccuuccuggucuccgcaggaggcuguggcagcuguggcauccacuguggcau

SEQ ID NO: 418588 - RNA, 64 nt, Human
cuuccuuccuggucuccgcaggaggcuguggcagcuguggcauccacuguggcaucuccguccu

SEQ ID NO: 418589 - RNA, 64 nt, Human
ucuccgcaggaggcuguggcagcuguggcauccacuguggcaucuccguccugcccaccuucuu

SEQ ID NO: 418590 - RNA, 64 nt, Human
acaucaggcuccccggccaccaugauugggaucucuguggcacugggccaccucauugggguaa

SEQ ID NO: 418591 - RNA, 64 nt, Human
gaugcugauaccugcccccggcccuaccuuagcucuguggcauuauaucuccucucugggacuc

SEQ ID NO: 418592 - RNA, 64 nt, Human
gccuuagggugcccccauccccuuccccagucaacuguggcaccuguaaccucccggaacauga

SEQ ID NO: 418593 - RNA, 60 nt, Human
cuaaugcccagagaacguaacuccugcucccuguggcacucagggagcauuuaauggcag

SEQ ID NO: 418594 - RNA, 64 nt, Human
ugccacaccucauuggaguauagccaguguuggucuguggcacuugggcugaaaggugauaaug

SEQ ID NO: 418595 - RNA, 64 nt, Human
caaauggaauugugcaaccaccagaaaaacacuacuguggcaaacuggagaagugccaauuuaa

SEQ ID NO: 418596 - RNA, 64 nt, Human
ucuuuauccuuuguggacuuggaggaauuauuagcuguggcacaacacauacagcauugguucc

SEQ ID NO: 418597 - RNA, 64 nt, Human
cuggccaugcaaagcaagggcacagggauuagaccuguggcacacuuccccaauucccucaucu

SEQ ID NO: 418598 - RNA, 64 nt, Human
cugacuaacaggcugcaaagugcaaguucagauucuguggcagagauuuggaaggcacccaccu

SEQ ID NO: 418599 - RNA, 64 nt, Human
accuguguugguggcuguccccugccgccccucccuguggcagcagcaggacaggugugugccc

SEQ ID NO: 418600 - RNA, 64 nt, Human; identical to SEQ ID NO: 37191

SEQ ID NO: 418601 - RNA, 64 nt, Human; identical to SEQ ID NO: 37192

SEQ ID NO: 418602 - RNA, 64 nt, Human; identical to SEQ ID NO: 37202

SEQ ID NO: 418603 - RNA, 64 nt, Human
gacuuuuuuuuuuuuuuuuguaugggagaagauacuguggcaaccaggaaggaauggaaaaaaa

SEQ ID NO: 418604 - RNA, 64 nt, Human
guugcuggggaccuucacauucucuuuuagaaagcuguggcaugcagucucauugcaggacucc

SEQ ID NO: 418605 - RNA, 64 nt, Human
ucgggggccaugugugcagcaugacucucccugucuguggcagggacccaagcgcuugcuuaag

SEQ ID NO: 418606 - RNA, 64 nt, Human
ggcauugaguggacucugugcucacuggguggagcuguggcagggggcacugagccuccagacc

SEQ ID NO: 418607 - RNA, 64 nt, Human
gaaacauggguuagguuacuuacuaaaaguccaccuguggcaaccugcaaauaaugcuuauuua

SEQ ID NO: 418608 - RNA, 64 nt, Human
uuuauuauccuccucucuucuuaguaacuucuuucuguggcaaaaccacaauucuuuaagauuc

SEQ ID NO: 418609 - RNA, 64 nt, Human
aaguuggugacucaguaaaacuugacauuuuaaccuguggcauuuagauacuuuuuacuguuug

SEQ ID NO: 418610 - RNA, 64 nt, Human
agaagcacaccaauucuaacccacaagauuccaucuguggcauuuguaccaaauauaaguugga

SEQ ID NO: 418611 - RNA, 64 nt, Human
guguucucuuuugucaggaaacucagccaguggacuguggcagagaaaguccuccacucagagg

SEQ ID NO: 418612 - RNA, 64 nt, Human
aacuuccagauucagagaaucugauuuagggaaacuguggcagaugagugggagacugguugca

SEQ ID NO: 418613 - RNA, 64 nt, Human
agccgauuaucuucauugcuuuuaauguucuauucuguggcauaugguuuucuguuacuuucgu

SEQ ID NO: 418614 - RNA, 64 nt, Human
gcuuguccgugucaacaucaccccagugguggcccuguggcagccuauggccccgaaccaagga

SEQ ID NO: 418615 - RNA, 64 nt, Human
agguuccuuaagcuuuuugcuguccaugaauccucuguggcaacuguaaucacagagccagaag

SEQ ID NO: 418616 - RNA, 64 nt, Human
guauuagugccacaagccugaaaagacaguucuccuguggcaguggcgauguggcauccagagg

SEQ ID NO: 418617 - RNA, 64 nt, Human
gggaaaagauuagauucuaaaauaaaaguuuacccuguggcaucuucauuuuuauauucuuuga

SEQ ID NO: 418618 - RNA, 64 nt, Human; identical to SEQ ID NO: 37243

SEQ ID NO: 418619 - RNA, 64 nt, Human; identical to SEQ ID NO: 37244

SEQ ID NO: 418620 - RNA, 64 nt, Human; identical to SEQ ID NO: 37246

SEQ ID NO: 418621 - RNA, 64 nt, Human
caaaugcuaacuuacacuuuauagcguuuaucagcuguggcauauuaccuguaacauguuuaaa

SEQ ID NO: 418622 - RNA, 64 nt, Human
gauacauuuuacauucuguuuacugccacaagcacuguggcaauaacuuuugaauuuuaauuuu

SEQ ID NO: 418623 - RNA, 64 nt, Human
gaaccccugggcuuaauuuucccccuacuuaguucuguggcagcaaagaaaagugacuucuuuu

SEQ ID NO: 418624 - RNA, 64 nt, Human
acugccuugguucaaaggccuaguuucgacauuacuguggcaaauuauuuaagcucucuguuuu

SEQ ID NO: 418625 - RNA, 64 nt, Human
ugagcuggaaaaucuugaaaauauuuuuuuuuuccuguggcacauucagguugaauacaagaac

SEQ ID NO: 418626 - RNA, 64 nt, Human
cauccacuuggcugaggugaaagaaacauccauucuguggcauguuggacuugaucuggcaaaa

SEQ ID NO: 418627 - RNA, 64 nt, Human
aaacaggaggugaacuaaggcaccccgccacccacuguggcagcuugaauuucuugaggcugag

SEQ ID NO: 418628 - RNA, 64 nt, Human
cggggagagcagagccucgggaggggcacacagacuguggcagagcugcgcccaucccgcagag

SEQ ID NO: 418629 - RNA, 64 nt, Human
uuuagcgaugaauaacguaauuggcuaugaaguacuguggcagagcugcuguuuucugaaggug

SEQ ID NO: 418630 - RNA, 64 nt, Human
acuguggcccuugucucagggcccacaagcugaacuguggcauagcucucucuucuucuccaag

SEQ ID NO: 418631 - RNA, 64 nt, Human
aacagggccuuucccuacaggacacgccccagagcuguggcagauugcaggagccaucgugugg

SEQ ID NO: 418632 - RNA, 64 nt, Human
cccuccuuaccugacccccuacgaguuuacaggucuguggcaauacucuuaaccauaagaauug

SEQ ID NO: 418633 - RNA, 64 nt, Human
ccaucuuuguacucuucagaugaauauauagacacuguggcauacauuuuuuuucauuaaaaac

SEQ ID NO: 418634 - RNA, 64 nt, Human
aaugaucagacacugccuuuuguguguuugcugccuguggcauccuuuuuuaaaaagacuguua

SEQ ID NO: 418635 - RNA, 64 nt, Human
uuuucccccuuuugacuccuugugucuuccucuccuguggcauaaaaguaguucugucguuaac

SEQ ID NO: 418636 - RNA, 64 nt, Human; identical to SEQ ID NO: 37164

SEQ ID NO: 418637 - RNA, 64 nt, Human; identical to SEQ ID NO: 37165

SEQ ID NO: 418638 - RNA, 64 nt, Human; identical to SEQ ID NO: 37166

SEQ ID NO: 418639 - RNA, 64 nt, Human
cgcacuggcgaagccagagggaucugucuuucuacuguggcagggaggcuucccccuuuagcca

SEQ ID NO: 418640 - RNA, 64 nt, Human
auauacucgcacaacuuaaauaggucauuuuugucuguggcauuuuuacuguuugugaaaguau

SEQ ID NO: 418641 - RNA, 64 nt, Human
cgguggaggucuggacaguucaagugugaugcagcuguggcaaggagaaauccuuccgccucug

SEQ ID NO: 418642 - RNA, 64 nt, Human
ugucagugagcaccaugcuggaggucacccagcacuguggcagcgcccaggagggcauagggca

SEQ ID NO: 418643 - RNA, 57 nt, Human
auuucaauuugauucuguagcaucgugcuguggcauguggucuagucugcugagguu

SEQ ID NO: 418644 - RNA, 64 nt, Human
gugcuguaaagaguugcuuuuuguuuauuuaaugcuguggcaugggugaagaggaggggaagag

SEQ ID NO: 418645 - RNA, 64 nt, Human
ugauccaccugcugcacgauccuaugagggcuuccuguggcacacagcccucugggugcuuggg

SEQ ID NO: 418646 - RNA, 64 nt, Human
agaggaggaugugugggauuguaggcaaacccaccuguggcaucacugaaaauaaauuugauca

SEQ ID NO: 418647 - RNA, 64 nt, Human
ccuggggacccuuggagaaauuaggugucaccugcuguggcaaaauggguuuagaaaucuuugc

SEQ ID NO: 418648 - RNA, 64 nt, Human
auguucagcagaacaccaccacugugacauggggcuguggcagugggagacaccgcgcguggcg

SEQ ID NO: 418649 - RNA, 64 nt, Human
ugagaaagaaaucucuaugguguaagccacuagucuguggcauuguuauagcagcucgagaaga

SEQ ID NO: 418650 - RNA, 62 nt, Human
agcaggagaggcuucggcaacaggaugagaggcuguggcagcaggagacucugcaggagcug

SEQ ID NO: 418651 - RNA, 64 nt, Human
aggcuaaguggguaacagcccagcaucagggucacuguggcaacagcaggcucuaggggaaucc

SEQ ID NO: 418652 - RNA, 64 nt, Human
uaauccuacuaguaaaggaugcuaagcaguuccacuguggcaggugucauuugcuaguagaauu

SEQ ID NO: 418653 - RNA, 64 nt, Human
ccugcugagauaaaugcgucuuuaaaaauagucucuguggcaggucacugggggacaauguaca

SEQ ID NO: 418654 - RNA, 64 nt, Human; identical to SEQ ID NO: 37161

SEQ ID NO: 418655 - RNA, 64 nt, Human; identical to SEQ ID NO: 37162

SEQ ID NO: 418656 - RNA, 64 nt, Human; identical to SEQ ID NO: 37167

SEQ ID NO: 418657 - RNA, 64 nt, Human
aacuguuuguuauguaccauaaugcuaaauaaaacuguggcacuuuucaccauaauuuaauuua

SEQ ID NO: 418658 - RNA, 64 nt, Human
uucaucuguuccggugccaagaaugagcaguguacuguggcaguucccuuuggauuuguaugug

SEQ ID NO: 418659 - RNA, 64 nt, Human
ucgugcacaccuguaguaucagcuacuuguaaggcuguggcagaagugcuuuagcccaggaggu

SEQ ID NO: 418660 - RNA, 64 nt, Human
ccaauuaauuccuguuugucuacauaugaucugucuguggcaaaaguuuaaucagaggaaauuc

SEQ ID NO: 418661 - RNA, 64 nt, Human
cagagccugcuacuacuugggaguuggugcugcccuguggcauggaggggugggaggggcugag

SEQ ID NO: 418662 - RNA, 64 nt, Human
ucuacuccauugcugugacaaaucaccacauugucuguggcaccuacgagaaccucauccacgu

SEQ ID NO: 418663 - RNA, 64 nt, Human
uucucucugauuugguuuguucugucucaggcuucuguggcaggacuggcccagggaggaggaa

SEQ ID NO: 418664 - RNA, 64 nt, Human
gugcugcugggcccgcaccccaugucccuugucacuguggcauccugcacccauccucaccccu

SEQ ID NO: 418665 - RNA, 64 nt, Human
gacacagagcaagaggaacugaccaucucaugaccuguggcauugcacggugcaguggacagaa

SEQ ID NO: 418666 - RNA, 64 nt, Human
ccccaccccgauagugacacaucuucaggcagagcuguggcacagacccccguccuguccccca

SEQ ID NO: 418667 - RNA, 64 nt, Human
gcagaaagcaaaugugaccugugucacuacgugacuguggcacacgccuuguucuuggccaaag

SEQ ID NO: 418668 - RNA, 64 nt, Human
cuuccggcuccccucccaggcugcagacucugaccuguggcaucaggcuucucccaguacagga

SEQ ID NO: 418669 - RNA, 64 nt, Human
aacguccagggagugggagcagcacaugcgcgugcuguggcaggaggacgcaucccaaucggga

SEQ ID NO: 418670 - RNA, 64 nt, Human
cuggcugugguagcguagcgcucucucucucugucuguggcaggaggcaaagaguaggguguaa

SEQ ID NO: 418671 - RNA, 64 nt, Human
uccauuuuggagaugaauuucaucucaugaguugcuguggcauuuaaacaacaggaaauguguc

SEQ ID NO: 418672 - RNA, 64 nt, Human; identical to SEQ ID NO: 37169

SEQ ID NO: 418673 - RNA, 64 nt, Human; identical to SEQ ID NO: 37170

SEQ ID NO: 418674 - RNA, 64 nt, Human; identical to SEQ ID NO: 37171

SEQ ID NO: 418675 - RNA, 64 nt, Human
cugccauggggaagugcuguuuguuauccuuucucuguggcagugaagaaggaagaaaugagag

SEQ ID NO: 418676 - RNA, 64 nt, Human
uuucugucugccccagggugcuccauggaucucccuguggcagcaggcauggagagucagggcu

SEQ ID NO: 418677 - RNA, 64 nt, Human
ucuucugucccuuucagucauuugcuguacuucccuguggcacguuaccauggaagccgcucca

SEQ ID NO: 418678 - RNA, 64 nt, Human
ccuggcccagacccuguggggcagcggagcuucccuguggcaugaaccccacaggguauuaaau

SEQ ID NO: 418679 - RNA, 64 nt, Human
cacacacacacacacacacacgacaugcuccuuucuguggcacaugccuguauuacugaaagcu

SEQ ID NO: 418680 - RNA, 64 nt, Human
gccaucgggaguguggcugggggugaagggggcucuguggcaauaugggguuggguaguguggg

SEQ ID NO: 418681 - RNA, 64 nt, Human
guaaacggaaucacguaugguucuuucugugggucuguggcacagcaggaagagcccggugccg

SEQ ID NO: 418682 - RNA, 64 nt, Human
ucuugccacacagguagucggggaugucucgcuucuguggcacaggggcacacggucagaggcu

SEQ ID NO: 418683 - RNA, 64 nt, Human
gauggcauugaacuagagcgagugccugccucggcuguggcacuuccagguucgacugaaucaa

SEQ ID NO: 418684 - RNA, 64 nt, Human; identical to SEQ ID NO: 418664

SEQ ID NO: 418685 - RNA, 64 nt, Human
uggcagacaccccaugucuuuguuaccccaggggcuguggcaugucccaggagggugugcaugu

SEQ ID NO: 418686 - RNA, 64 nt, Human
aaaccaguccuccucagcccuccccaagucgcuucuguggcaccccgcauucgcugugagguuu

SEQ ID NO: 418687 - RNA, 64 nt, Human
gcucugcugacacagucgguccccgcagaggucacuguggcaaagccucacaaagcccccucuc

SEQ ID NO: 418688 - RNA, 64 nt, Human
uuuuuuaaagugaaccauugcuggaucucagauucuguggcaucuaaggccuagcagggguggg

SEQ ID NO: 418689 - RNA, 64 nt, Human
gacugaaggugagauguuauuuguggcaugugaacuguggcaggugggaauaauccugcccuug

SEQ ID NO: 418690 - RNA, 64 nt, Human; identical to SEQ ID NO: 37172

SEQ ID NO: 418691 - RNA, 64 nt, Human; identical to SEQ ID NO: 37173

SEQ ID NO: 418692 - RNA, 63 nt, Human
acgccccucccaagcguuccuggccuucugaacuccauacagccucuacagccgucccgcguu

SEQ ID NO: 418693 - RNA, 64 nt, Human
cagaagcuaguagauugguuaaaagucuggacuucuguggcauuuuuuucgugacgugauaauc

SEQ ID NO: 418694 - RNA, 64 nt, Human
ucauuuuccugaaaguguggucuguuucagaaugcuguggcaaccagguagguguggcacuggc

SEQ ID NO: 418695 - RNA, 64 nt, Human
acuccagugcucagcuguggcuggaggagcuggccuguggcacagcccugagugucccaagccg

SEQ ID NO: 418696 - RNA, 64 nt, Human
gggggaggaggagagggaagauggucccugggcacuguggcagcuaaccacaggaagacugucg

SEQ ID NO: 418697 - RNA, 60 nt, Human
aguuuggcagccccaagugaggggccguggcuguggcauccagagucccugccuggacca

SEQ ID NO: 418698 - RNA, 64 nt, Human
aaaugcuacugaaacuuaccugagaaccauaggacuguggcaaacaaaaccaauucaugaagug

SEQ ID NO: 418699 - RNA, 64 nt, Human
aucaucacaauuagggaaugguuaguggucucuacuguggcaaaugccaacuguuggaauucac

SEQ ID NO: 418700 - RNA, 64 nt, Human
cugauuuuaggacagcuaagaugacugccaugugcuguggcaggccuaauuugucuuguucuuu

SEQ ID NO: 418701 - RNA, 64 nt, Human
gcccugagcuuugggucucuuggaggcuaggguucuguggcaguugcagggcaauguuauggag

SEQ ID NO: 418702 - RNA, 64 nt, Human
uaguaauguggaagaauagcuaucauuccugucucuguggcacccgaucaauggcuuaaaucug

SEQ ID NO: 418703 - RNA, 64 nt, Human
gaguuuuucuuuugaauaauguagugcagucacccuguggcaaaugccaggacagcugcaggug

SEQ ID NO: 418704 - RNA, 64 nt, Human
ccaggggacccguuccucuugaaccagucauugccuguggcaaauguguguaugagaauguggg

SEQ ID NO: 418705 - RNA, 64 nt, Human
gucacccccccaggccuccagaaccuuacuggcacuguggcacugccaccagcaaugcccugcc

SEQ ID NO: 418706 - RNA, 64 nt, Human
gcccagcaagccagucuggcacugccaggaccuccuguggcacccuucaagcugcccagccggc

SEQ ID NO: 418707 - RNA, 64 nt, Human
ugcucuguagucauguugguccuuucaggcaccucuguggcauagcuccccuuugguaaguuuu

SEQ ID NO: 418708 - RNA, 64 nt, Human; identical to SEQ ID NO: 37175

SEQ ID NO: 418709 - RNA, 64 nt, Human; identical to SEQ ID NO: 37176

SEQ ID NO: 418710 - RNA, 64 nt, Human; identical to SEQ ID NO: 37177

SEQ ID NO: 418711 - RNA, 64 nt, Human
cacagggguuaaagcugugugucccucccaguggcuguggcagugacagugacacccacaccca

SEQ ID NO: 418712 - RNA, 64 nt, Human
uugcauuuuacuggaaacugaggcgucaagauggcuguggcagcuagcaaaagcaaagaugcuu

SEQ ID NO: 418713 - RNA, 64 nt, Human
ugggccaggacuucagccugccuccgaggguccccuguggcaccuagcauggugcacagcacau

SEQ ID NO: 418714 - RNA, 64 nt, Human
ucuaggaguuccuggccagucaccccaucgcccucuguggcagacucagugcuguguggcgccu

SEQ ID NO: 418715 - RNA, 64 nt, Human
aaccaaaggcaucuggagcccgagaggccuccugcuguggcagaggagcagcugggauucccga

SEQ ID NO: 418716 - RNA, 64 nt, Human
cucucaguggacagggcaucuguuacccugagaccuguggcagacacgucuuguuuucauuuga

SEQ ID NO: 418717 - RNA, 64 nt, Human
ucagcuaaagcccucggguuccauccguuuaaaucuguggcauuuucagagccucaucugucag

SEQ ID NO: 418718 - RNA, 64 nt, Human
cucaggagcuggguggcaggagaggcaauagccccuguggcaauugcaggaccagcuggagcag

SEQ ID NO: 418719 - RNA, 64 nt, Human
cgugcggggcacccucggccucacccugcagugucuguggcacucacugcuuuucuaaggcucg

SEQ ID NO: 418720 - RNA, 64 nt, Human
ugcugcuggcaaacaguaaagaaacucacuuucccuguggcacguuaugcuucagaauuaaaac

SEQ ID NO: 418721 - RNA, 64 nt, Human
gcggagcuaauggucacauugauaguugauuacacuguggcacgaauuaaugcagaacacuguu

SEQ ID NO: 418722 - RNA, 64 nt, Human
uaucuuguuugauaaggcugcugccugucucccucuguggcaaggacuguuuguucuuuugccc

SEQ ID NO: 418723 - RNA, 64 nt, Human
uggaaucuacuagaaccuucuaauccaugugcugcuguggcaucaggaaaggaagauguaagaa

SEQ ID NO: 418724 - RNA, 64 nt, Human
uagaccggaaugggguuuucccacagauccccgccuguggcacaccccagagccagaaaucgaa

SEQ ID NO: 418725 - RNA, 64 nt, Human
uucuagcuuugacaaaggaccaggcuugccuuuucuguggcaacacagccucuuacauauggcu

SEQ ID NO: 418726 - RNA, 64 nt, Human; identical to SEQ ID NO: 37182

SEQ ID NO: 418727 - RNA, 64 nt, Human; identical to SEQ ID NO: 37183

SEQ ID NO: 418728 - RNA, 64 nt, Human; identical to SEQ ID NO: 37184

SEQ ID NO: 418729 - RNA, 64 nt, Human
cugggcccagagcccccguucuucugcguuaacacuguggcauucagagggaaucaaagagccu

SEQ ID NO: 418730 - RNA, 64 nt, Human
ggggaugcagucaacaacacagagugcuggaagccuguggcagaauacauugaucagcaguuug

SEQ ID NO: 418731 - RNA, 64 nt, Human
uguccuaauccucagaaccugugacuguuaccuucuguggcagaaagggacagugcagauguau

SEQ ID NO: 418732 - RNA, 64 nt, Human
aagauacucaggucaguuaacuaaugaggcggggcuguggcagccagcgguuuuccucucuucu

SEQ ID NO: 418733 - RNA, 64 nt, Human
uuucuucuccaaacugcugucucuaauuuggccucuguggcaagaccacgcccagcaaaagugg

SEQ ID NO: 418734 - RNA, 64 nt, Human
ucacaguaguaggaaguauagggaaaccucucagcuguggcacuguuguagcuuuggagugcag

SEQ ID NO: 418735 - RNA, 64 nt, Human
cuauuuugaagcgagcuuucaacaggcggguccccuguggcaaagaaaaucggaacccuguugc

SEQ ID NO: 418736 - RNA, 64 nt, Human
uguguguugggugugggguguguacaccuggcaucuguggcauguguucuggucacuuggagaa

SEQ ID NO: 418737 - RNA, 64 nt, Human
uauuucaaaauaaaauuaguguguccuugccugucuguggcauauuugugcaugggacagggcc

SEQ ID NO: 418738 - RNA, 64 nt, Human
auacuuuugccuaaaaaggaaauuggaugggauacuguggcaaaucauaaaaaaccagauaauu

SEQ ID NO: 418739 - RNA, 64 nt, Human
acugaauaugcauuuuauugcuuuacucuucauucuguggcaccuacccacaggggaaguaaga

SEQ ID NO: 418740 - RNA, 64 nt, Human
ucacugaggaauuagaacuaugauagaaguuaggcuguggcaaaugggacauucguagaguggg

SEQ ID NO: 418741 - RNA, 64 nt, Human
cuccauauaauaauuuucuacaaucagaucuaugcuguggcauauuuugcuuuauuuaaaaauu

SEQ ID NO: 418742 - RNA, 64 nt, Human
cccccuucggcacccaguugcccuuggccaccaccuguggcaggacucaagcuccucuucugca

SEQ ID NO: 418743 - RNA, 64 nt, Human
uauuuaaacauaugcacacauauaaaaguugauacuguggcaguaaacuauuaaaaguuuucac

SEQ ID NO: 418744 - RNA, 64 nt, Human; identical to SEQ ID NO: 37188

SEQ ID NO: 418745 - RNA, 64 nt, Human; identical to SEQ ID NO: 37189

SEQ ID NO: 418746 - RNA, 64 nt, Human; identical to SEQ ID NO: 37190

SEQ ID NO: 418747 - RNA, 64 nt, Human
gaaagguugagcccagaguggccgaggcuggacccuguggcaccaaguggggucggcugaccgu

SEQ ID NO: 418748 - RNA, 64 nt, Human
gugucacuuuuuagcguuaauggcaguugugugucuguggcagugagauaauggaccacuauua

SEQ ID NO: 418749 - RNA, 64 nt, Human
auugucuaaaaugcaugaauauauuuuuagcagucuguggcauauuaaucaaacuguugaauug

SEQ ID NO: 418750 - RNA, 64 nt, Human
uuagaaucagccuugaaacauugauggaauaacucuguggcauuauugcauuauauaccauuua

SEQ ID NO: 418751 - RNA, 64 nt, Human
cugcggugacagggacagcucaggcucuuggugacuguggcagcgggaguucccggcccuccac

SEQ ID NO: 418752 - RNA, 64 nt, Human
gggggacaugguggagggaagcgggaaggcucuucuguggcaucgcacgaucuagucuguggug

SEQ ID NO: 418753 - RNA, 64 nt, Human
auuugaacauaauugcuggacacugacugauguacuguggcagacagaacuaguugcugucuca

SEQ ID NO: 418754 - RNA, 64 nt, Human
ucugccuuuuccucgggugucccuccucgagccccuguggcauuggcuuggguggcagagccca

SEQ ID NO: 418755 - RNA, 64 nt, Human
gucaguuuuuguuucagccuuccuuauggguaugcuguggcauaucccugagauuuuaauucgc

SEQ ID NO: 418756 - RNA, 64 nt, Human
uuguuucuagacacucaacucugauacuccagcccuguggcaccccagacccucuucagcuaca

SEQ ID NO: 418757 - RNA, 64 nt, Human
cagcgccuugucagccaaggugggcaggcagggacuguggcagcuuauguccaaagggagcccc

SEQ ID NO: 418758 - RNA, 64 nt, Human
cucauacuggagagaaaccuuacaaaugucaugacuguggcaaggucuucagucaagcuucauc

SEQ ID NO: 418759 - RNA, 64 nt, Human
cccagccccguggccccugccccucuccuacucucuguggcaguuucauauuugcuaagacgaa

SEQ ID NO: 418760 - RNA, 64 nt, Human
cuacagaagcacugagauaauggaguggggaugacuguggcaaacaaaaggagauucgaacauu

SEQ ID NO: 418761 - RNA, 64 nt, Human
cccgucucgccuggggccagcgggagucccgggccuguggcagcggcgcccagcucccuggugg

SEQ ID NO: 418762 - RNA, 64 nt, Human; identical to SEQ ID NO: 37179

SEQ ID NO: 418763 - RNA, 64 nt, Human; identical to SEQ ID NO: 37180

SEQ ID NO: 418764 - RNA, 64 nt, Human; identical to SEQ ID NO: 37194

SEQ ID NO: 418765 - RNA, 64 nt, Human
ccauccaguuccacacgaacuagggcaguggucacuguggcacccaggugugggccuggcuagc

SEQ ID NO: 418766 - RNA, 64 nt, Human
ccugugacugcaucccgccucccuggggaccugccuguggcaggaaggaauggggggccccagc

SEQ ID NO: 418767 - RNA, 64 nt, Human
gucggugacccugggacccuccaggcagcguggccuguggcaccgugaggguugggacccaccg

SEQ ID NO: 418768 - RNA, 64 nt, Human
ggacacuuguuuaaacauucacaucugaauuucucuguggcaaccgcagguggcucugagguga

SEQ ID NO: 418769 - RNA, 64 nt, Human
cauuugucucauacagggaagaguuguaugucuccuguggcauagacuacacuuggcaauuggg

SEQ ID NO: 418770 - RNA, 64 nt, Human
cgagaaaucguguucaguauuucaagcucuauuucuguggcacaugucuuuugagaggcaucuu

SEQ ID NO: 418771 - RNA, 64 nt, Human
cccuuacccagccaugucuggacaugccagacagcuguggcaugucauaaacuguccuggagug

SEQ ID NO: 418772 - RNA, 64 nt, Human
agaagucuucagcaccaaguuccugaaagcuuuucuguggcaggaaagaaugcaacaaaaaagu

SEQ ID NO: 418773 - RNA, 64 nt, Human
uggauucuucuagcuccuucaaucccauuuucuccuguggcaucacuaaguauaagaccugcuc

SEQ ID NO: 418774 - RNA, 64 nt, Human
ccuggugugggccuggucucagcagcggcugcggcuguggcagccuccaucuccagcaagucuc

SEQ ID NO: 418775 - RNA, 64 nt, Human
ggguuauuauugccuuugcuuuuuagcaaaucugcuguggcaggcuguggauuuugagagucag

SEQ ID NO: 418776 - RNA, 64 nt, Human
ucuaugagcccagaucaccaccugaacguucugucuguggcacauucuuaaauauuuccaucag

SEQ ID NO: 418777 - RNA, 64 nt, Human
ucacacuggagaaauacuuuccucuggcaaaccccuguggcaggguuuucaguaaaauguuuug

SEQ ID NO: 418778 - RNA, 64 nt, Human; identical to SEQ ID NO: 418758

SEQ ID NO: 418779 - RNA, 64 nt, Human
cuccaucuuaaaggaaaaaaaaaaaaugcaaugacuguggcaaacuccucaugaguucaaguau

SEQ ID NO: 418780 - RNA, 64 nt, Human; identical to SEQ ID NO: 37250

SEQ ID NO: 418781 - RNA, 64 nt, Human; identical to SEQ ID NO: 37251

SEQ ID NO: 418782 - RNA, 64 nt, Human; identical to SEQ ID NO: 37252

SEQ ID NO: 418783 - RNA, 64 nt, Human
uucauucuugagacaauucuuacaaauacagugacuguggcaaacuccugaugaguuuaagcau

SEQ ID NO: 418784 - RNA, 64 nt, Human
gacucccugcuccgcugcccucuuugucuaagagcuguggcaacagcaccugaauuucagaaac

SEQ ID NO: 418785 - RNA, 64 nt, Human
aacuucaaacggcagucauuuguucuccucggcucuguggcaaggauagcccuuuggaggggga

SEQ ID NO: 418786 - RNA, 64 nt, Human
ucccagagcagaccacauauacagcaggaugugccuguggcaugaagauuuucuuucucuuuuu

SEQ ID NO: 418787 - RNA, 64 nt, Human
guuguguagucauuuuauuugcaaaaugaggugacuguggcaaauuauagaacacagaguauua

SEQ ID NO: 418788 - RNA, 64 nt, Human
uggccucugcaacugcucagcucugguccaggcccuguggcaggacacacauggugagccuagc

SEQ ID NO: 418789 - RNA, 64 nt, Human
uggccuucugaugucuuuguucaacuguggccagcuguggcaucagcuuccuggagcaguaaau

SEQ ID NO: 418790 - RNA, 64 nt, Human
acacagccucuccagccuauaaacagccggggggcuguggcacagguuggggcaauguucccuu

SEQ ID NO: 418791 - RNA, 64 nt, Human
ugauuaaugacuugacuggcugcucuucccagagcuguggcagcucucccguagaagauggggu

SEQ ID NO: 418792 - RNA, 64 nt, Human
caggaugcagugaggggcguuccugccccgaggacuguggcauugucaccuucacagcagacag

SEQ ID NO: 418793 - RNA, 64 nt, Human
ugaugaacagagucagaagcccaaaggaauugcacuguggcagcaucagacguacucgucauaa

SEQ ID NO: 418794 - RNA, 64 nt, Human
uguucuggggaggcucaugcugucuccaugacgucuguggcaggagucccugaggacgggagcu

SEQ ID NO: 418795 - RNA, 64 nt, Human
ugcuuccuucucacugcgcagcaaaguucguccccuguggcaagauagaugugguugggccauc

SEQ ID NO: 418796 - RNA, 64 nt, Human
uggccucagcugccucacuuccuacaagagcagccuguggcaucuuugccuugggcugcuccuc

SEQ ID NO: 418797 - RNA, 64 nt, Human
ccugcacuccuggaaucacagaggggucaggaagcuguggcaggagcaucuacacagcuugggu

SEQ ID NO: 418798 - RNA, 64 nt, Human; identical to SEQ ID NO: 37199

SEQ ID NO: 418799 - RNA, 64 nt, Human; identical to SEQ ID NO: 37200

SEQ ID NO: 418800 - RNA, 51 nt, Human; identical to SEQ ID NO: 37201

SEQ ID NO: 418801 - RNA, 63 nt, Human
cacaggccccccaggccuagguucccuuggaggcuguggcaaguccucaauccugugucccag

SEQ ID NO: 418802 - RNA, 64 nt, Human
ugcagggccugagcauggcuggcaggggcagcugcuguggcaaacuggccuugaucaguguccg

SEQ ID NO: 418803 - RNA, 64 nt, Human
gcacaugggcaugguugaaucugaaacccuccuucuguggcaacuuguacugaaaaucuggugc

SEQ ID NO: 418804 - RNA, 64 nt, Human
uguggaaaacugacucugugugggucccguaucccuguggcauccagaccuggccucucuucau

SEQ ID NO: 418805 - RNA, 64 nt, Human
cuaauuuaauaacuagggacaccuguguccacagcuguggcacagacucccacuaaagaaguag

SEQ ID NO: 418806 - RNA, 64 nt, Human
ggcuggccagucagagaaagggggccauggacugcuguggcaaauagggagacaaggagacaga

SEQ ID NO: 418807 - RNA, 64 nt, Human
cugugucuuuccaucugggcucugcagcccagcucuguggcaggaggccugaccccaccccauc

SEQ ID NO: 418808 - RNA, 51 nt, Human
ugaucgacauggccaagugaacuguggcagguccagaaccagucagagacu

SEQ ID NO: 418809 - RNA, 64 nt, Human
uaacagugaguuucguuuguaaacugcuugaagucuguggcauucaggcacacgucuggcuggc

SEQ ID NO: 418810 - RNA, 64 nt, Human
ugcccuuucguccccacacuguggaggaagggaccuguggcagcucacaggcaugagggguggc

SEQ ID NO: 418811 - RNA, 64 nt, Human
aucaaauggcaagagaccguuuaguuccuaucaucuguggcaugugaagggcaaucacaguguu

SEQ ID NO: 418812 - RNA, 64 nt, Human
cuccucaggaaagccaguucuccaaguucuuaaccuguggcacugaaaggaauguugaguuacc

SEQ ID NO: 418813 - RNA, 64 nt, Human
augguaauacccguccucucggcugccaggggcucuguggcaaaaagagucagacauuucuuug

SEQ ID NO: 418814 - RNA, 64 nt, Human
uggguucugguggcgcaggcgcaggagcagccagcuguggcagcgcauuaguuuuggcgcaagc

SEQ ID NO: 418815 - RNA, 64 nt, Human
aaguuugagaggcaacacuuaaacacuagggcuacuguggcaucuauguagacaggaaagacaa

SEQ ID NO: 418816 - RNA, 52 nt, Human; identical to SEQ ID NO: 37146

SEQ ID NO: 418817 - RNA, 64 nt, Human; identical to SEQ ID NO: 37147

SEQ ID NO: 418818 - RNA, 64 nt, Human; identical to SEQ ID NO: 37233

SEQ ID NO: 418819 - RNA, 64 nt, Human
uaaacuauuuuaggaagucaacccccauugcacucuguggcaguuauucugguaaaaauaggca

SEQ ID NO: 418820 - RNA, 64 nt, Human
uuuuaaugaauucaaggaagggagcauagcauaucuguggcaaacuauuuuccacucaaauccu

SEQ ID NO: 418821 - RNA, 64 nt, Human
aggagcuuggguugcuucccuguccccgcccccucuguggcauugucccucccacucuuauuuu

SEQ ID NO: 418822 - RNA, 64 nt, Human
ugcugagugucaucucaaccccaucauccugccccuguggcaugucggugagccuggggacggg

SEQ ID NO: 418823 - RNA, 64 nt, Human
uugguccuuccaccacccccaccaaguaaaccaccuguggcagcggcuguucccucaaccugcu

SEQ ID NO: 418824 - RNA, 64 nt, Human
cuucuaaguguauaacugucuccuaagcccaucacuguggcacacuguagagugagcuuauagu

SEQ ID NO: 418825 - RNA, 64 nt, Human
gugcugaaaacuggcuucccccugaagcacccugcuguggcaccagcaggaagcucagguuaau

SEQ ID NO: 418826 - RNA, 64 nt, Human
caucuucuggcccuuagcuggugccacuucccuccuguggcaaucccaguccugcacgucacag

SEQ ID NO: 418827 - RNA, 64 nt, Human
ucaaaucugcuguguaugaggucacagggcccagcuguggcaggggugagugcauugaagaagu

SEQ ID NO: 418828 - RNA, 64 nt, Human
acauuuaugugcuccuaaucgugggaacccuugucuguggcaucguccucggcuuccucuuuaa

SEQ ID NO: 418829 - RNA, 64 nt, Human
ugucgcaguugggcgagaccuaccuaguccugacgggucguauuuccaagacauuuucauauuc

SEQ ID NO: 418830 - RNA, 64 nt, Human
cuccuggugagucauuggagcuaugaaggggaaggggucguaucacuuugucucuccuaccccc

SEQ ID NO: 418831 - RNA, 64 nt, Human; identical to SEQ ID NO: 37120

SEQ ID NO: 418832 - RNA, 64 nt, Human; identical to SEQ ID NO: 37121

SEQ ID NO: 418833 - RNA, 64 nt, Human; identical to SEQ ID NO: 37122

SEQ ID NO: 418834 - RNA, 64 nt, Human
guucucugaaguggaauguggcuuuccuaggaaugggucguacaaagcuaagugguaaugaugc

SEQ ID NO: 418835 - RNA, 64 nt, Human
ggaggacgucccggcugggaugaagucugguggugggucguaaguuuaggaggugacugcaucc

SEQ ID NO: 418836 - RNA, 64 nt, Human
gauauaaaagcaaauaugacucacucauuucuuggggucguauuccugauuucagaagaggauc

SEQ ID NO: 418837 - RNA, 64 nt, Human
uugaggugguaguaaaacacagagggccaguaacgggucguaaugacuuauuguggauaacaaa

SEQ ID NO: 418838 - RNA, 64 nt, Human
guucucccgugucagcguguggugucgccugcaugggucguaccuggaugguguguccaccauc

SEQ ID NO: 418839 - RNA, 64 nt, Human
agauagagaucugaaauuggugggaagcaagcaggggucguaccuugcuuuagaguagauguuu

SEQ ID NO: 418840 - RNA, 64 nt, Human
aagcccaccaaccccuucacaccccccuucacaggggucguaugaguaaggggauuuggaaacu

SEQ ID NO: 418841 - RNA, 64 nt, Human
gcuguggcguuuuauguguugcuuggagucuguggggucguacucccuccccucccguccccag

SEQ ID NO: 418842 - RNA, 64 nt, Human
aacuuuucugauugaggcuaacuggaaaaagcuggggucguauucuaagugcuaaagaaggcug

SEQ ID NO: 418843 - RNA, 64 nt, Human
acuguagugcuuuaaacaaucaucuccuuaacaggggucguaagccugguuugcuucuauuacu

SEQ ID NO: 418844 - RNA, 64 nt, Human
cagccagucucccagcucucugccuuccccaaaagggucguaguaggucacccuucuacagcag

SEQ ID NO: 418845 - RNA, 64 nt, Human
gauuaucguuuuuggagaccugaagcccacacucgggucguauggacuucuggaaaaguucuug

SEQ ID NO: 418846 - RNA, 64 nt, Human
cccaugaagcccaugcggccugcuacaugggguggggucguagggaggcuguuugccuccacgu

SEQ ID NO: 418847 - RNA, 64 nt, Human
ucccucuccuuccaacaaaagaaggucaaacugugggucguagagccuugacaauguuguccuc

SEQ ID NO: 418848 - RNA, 64 nt, Human
gagcuccugggugcguguccagaugggaaaggcagggucguaucuguggggaccugacaagggc

SEQ ID NO: 418849 - RNA, 64 nt, Human; identical to SEQ ID NO: 37123

SEQ ID NO: 418850 - RNA, 64 nt, Human; identical to SEQ ID NO: 37124

SEQ ID NO: 418851 - RNA, 64 nt, Human; identical to SEQ ID NO: 37126

SEQ ID NO: 418852 - RNA, 64 nt, Human
ggggacugucagggccucgacuugccauugguuggggucguacggggcugggagcccugcguuu

SEQ ID NO: 418853 - RNA, 64 nt, Human
cccagcucuuugauuugccauauauaaaauaggugggucguaugucuucccuuuagacaugaug

SEQ ID NO: 418854 - RNA, 64 nt, Human
cagugcucaccagggccagcagggcccuaggcuggggucguacagcugaaguggugggugcauu

SEQ ID NO: 418855 - RNA, 64 nt, Human
uguaauuaguguuucacuugagaaagccuuuugugggucguaaauuauuucuacuuauccagua

SEQ ID NO: 418856 - RNA, 64 nt, Human
aaggagaaaggggcuagcacuggauggagcuggagggucguaggggagagaucuccaacucucu

SEQ ID NO: 418857 - RNA, 64 nt, Human
gcaagaaaagguagagaggaaccagauuggaagagggucguaaaugcauggcuacagaauucag

SEQ ID NO: 418858 - RNA, 64 nt, Human
cacuugagugaagaugagaauagauccuauguggagauuguagaagaugggucuggugaucugg

SEQ ID NO: 418859 - RNA, 64 nt, Human
ugaaaauccuacccccaccccccaccagccgcacagauuguacuaccgcgagaggcaucccugg

SEQ ID NO: 418860 - RNA, 64 nt, Human
cuuuuggaggauucuuuuuguauaacuucaauaaagauuguaagcaaagguugaggcuuugaug

SEQ ID NO: 418861 - RNA, 64 nt, Human
uuaaagccaugaauacuauaccuuugacuagucgagauuguauuuauauuuuccuguuacuacu

SEQ ID NO: 418862 - RNA, 64 nt, Human
cucauuuauuauaauauugaugcucaauuagguaagauuguaaaagcauugauuuuuuuuaaug

SEQ ID NO: 418863 - RNA, 64 nt, Human
uauaguuuuugggaaagaaugauuuuaaauaaagagauuguaaaaguaaaaaacuguaaaugua

SEQ ID NO: 418864 - RNA, 64 nt, Human
aaagaugcuggaugcuaacuugguacuaaccaucagauuguacaguuugguuguugcuguaaau

SEQ ID NO: 418865 - RNA, 64 nt, Human
uagaauaguuuuguauauucucucuugaucuuaaagauuguaucuuauugaauaucccacugua

SEQ ID NO: 418866 - RNA, 64 nt, Human
uuaugagaggaauuccuucuccaggcccuugcugagauuguagagauugagugcucuggaccgc

SEQ ID NO: 418867 - RNA, 56 nt, Human; identical to SEQ ID NO: 37127

SEQ ID NO: 418868 - RNA, 64 nt, Human; identical to SEQ ID NO: 37128

SEQ ID NO: 418869 - RNA, 64 nt, Human; identical to SEQ ID NO: 37130

SEQ ID NO: 418870 - RNA, 64 nt, Human
uuggucuugcccuauuauaauugucaugacuuucagauuguaucugaacucacagacugcuguc

SEQ ID NO: 418871 - RNA, 64 nt, Human
auugguuuggaaugauugugugcaugaauuugggagauuguauaaaacaaaacuagcagaaugu

SEQ ID NO: 418872 - RNA, 64 nt, Human
aacauauaugagguauacaaaauuuucuaacuccagauuguagucauuuugagagguacaaagc

SEQ ID NO: 418873 - RNA, 64 nt, Human
aaaauuuagagaacaaacccggaauaugaagugcagauuguaacauggagcuauuuuuuuuucu

SEQ ID NO: 418874 - RNA, 64 nt, Human
aaaggcaguacaaaaaaaguaauaauguuuuauaagauuguagaguuaaguaaaaguuaagcuu

SEQ ID NO: 418875 - RNA, 64 nt, Human
auagaaaguguccuauuuuauauauacgcauauaagauuguaauuuuaagauguuuugugucuc

SEQ ID NO: 418876 - RNA, 64 nt, Human
cggugugccugacugcccagcauuuggguaauuuagauuguaaaccgcuuuggccugaguuauu

SEQ ID NO: 418877 - RNA, 64 nt, Human
aucguuauuguacaaaaaguaaagaguauccuaaagauuguauucauuguaaucaaguaaugca

SEQ ID NO: 418878 - RNA, 64 nt, Human
uucccucuuuuguagucugcacaagauccauaaaagauuguauuuuuauuacuauuuaaacaag

SEQ ID NO: 418879 - RNA, 64 nt, Human
guucaaugaucaaaaucauguuuuuuccuuaaaaagauuguaaauugugcaacaaagaugcauu

SEQ ID NO: 418880 - RNA, 64 nt, Human
aagucaccucuacuauuuacacaucauaggcucaagauuguacagugagugaugcugucaugaa

SEQ ID NO: 418881 - RNA, 64 nt, Human
uuacauuaaagaguauaugugucuuaaugcagucagauuguaaaaaacaaaaacaaagaaacua

SEQ ID NO: 418882 - RNA, 64 nt, Human
agaaaauauuaggcuauaaauguccuaaggacucagauuguaucuuuguacagaagaggauuca

SEQ ID NO: 418883 - RNA, 64 nt, Human
uaauugaagaauaugugauacagccucuucaaucagauuguaaguuaccugaaagcugcaguuc

SEQ ID NO: 418884 - RNA, 64 nt, Human
ggcguguguuggagggcuucuuagcucuuuggugagauuguauuucuauguguuuguaucagcu

SEQ ID NO: 418885 - RNA, 64 nt, Human; identical to SEQ ID NO: 37195

SEQ ID NO: 418886 - RNA, 64 nt, Human; identical to SEQ ID NO: 37197

SEQ ID NO: 418887 - RNA, 64 nt, Human; identical to SEQ ID NO: 37256

SEQ ID NO: 418888 - RNA, 64 nt, Human
uuagcuaaaauugggagcaugccuuaaaacuuaaagauuguaugcauauauguguauauguuau

SEQ ID NO: 418889 - RNA, 64 nt, Human
guguuguaguugcuuagaguugauucugcuggcuagauuguacugauuaauagauuuuuauuuu

SEQ ID NO: 418890 - RNA, 64 nt, Human
uaauaaacuguauuaaaucuuaaacaauguauaaagauuguacuuagccaguucaaaguguaua

SEQ ID NO: 418891 - RNA, 64 nt, Human
ugauauagaccucagagcuguuaucuuaguuuaaagauuguauauguacuguacuauaguagga

SEQ ID NO: 418892 - RNA, 64 nt, Human
uaaaaauaggggcaugaaauaugugaucuggaaaagauuguacuuucuggacucuuuucccacu

SEQ ID NO: 418893 - RNA, 64 nt, Human
uuuauaaucucuguaaaaaugaagauaaaaagccagauuguacaaaagucaccugacaaagacu

SEQ ID NO: 418894 - RNA, 64 nt, Human
ucauagacaaugaccuuguuuucauuauucugauagauuguauacauauguacacauacauaua

SEQ ID NO: 418895 - RNA, 64 nt, Human
uauaccaagcacuaggcuuagaggaaaagaugucagauuguacugucacuggcuauguacccau

SEQ ID NO: 418896 - RNA, 64 nt, Human
uuauaauuuauguauauguauuauccucucaacuagauuguaagcacuuggaggugugacuuac

SEQ ID NO: 418897 - RNA, 64 nt, Human
ugucucuccuauuuuuaaauaagugaaauuugggagauuguaaaaucuguaaaguuuguuuugu

SEQ ID NO: 418898 - RNA, 64 nt, Human
gaugcccauguuuuauugcuauuacuaaaugucaagauuguaugcuauuaugucuuguaaauuu

SEQ ID NO: 418899 - RNA, 64 nt, Human
uaauguaaauuuagaggaauguacuuuacaagauagauuguauaagaagccaaauaaugaaagc

SEQ ID NO: 418900 - RNA, 64 nt, Human
auuuaagcauuuuacugucuguaagagaauucuaagauuguacauaaagucauauauauggaaa

SEQ ID NO: 418901 - RNA, 64 nt, Human
uuaucuaucuuuaguugaauauuuucuuuuggagagauuguauauuuuaaaauacuguuuagag

SEQ ID NO: 418902 - RNA, 64 nt, Human
aucuuaauuuucaguaauuguuuugcacuuucaaagauuguaaauaguucauucaaucaauggu

SEQ ID NO: 418903 - RNA, 64 nt, Human; identical to SEQ ID NO: 37131

SEQ ID NO: 418904 - RNA, 64 nt, Human; identical to SEQ ID NO: 37132

SEQ ID NO: 418905 - RNA, 64 nt, Human; identical to SEQ ID NO: 37134

SEQ ID NO: 418906 - RNA, 64 nt, Human
cccuauuuuaacuaccucaacuggucagaaacacagauuguauucuaugagucccagaagauga

SEQ ID NO: 418907 - RNA, 64 nt, Human
uagaguagaaaauauaucuuaaacuaguugaccuagauuguauuaauagcuacuuaagauguuu

SEQ ID NO: 418908 - RNA, 64 nt, Human
cuugggcacacagaguucuucaauccaaguuaucagauuguauuugaaaaugacagagcuggag

SEQ ID NO: 418909 - RNA, 64 nt, Human
ucauugagggaaaauauauuugaauuucuguuuuagauuguaucgggucccaguugauucaugu

SEQ ID NO: 418910 - RNA, 64 nt, Human
auuugaugccaggcaguggaguggccucagccccagauuguaccuccugcccuguaggagggga

SEQ ID NO: 418911 - RNA, 64 nt, Human
auuuuguuggaguauuauugaagaugugaucaauagauuguaauacacauaucuaaaaauaguu

SEQ ID NO: 418912 - RNA, 64 nt, Human
ugauuguagcuuuuuaaacuaugaaaccccugagagauuguaccuucuaguugaaauaaaguau

SEQ ID NO: 418913 - RNA, 64 nt, Human
aucuuuauaguauuugaaaaugagaagaagcagcagauuguaauuugguuuauuggaugugaug

SEQ ID NO: 418914 - RNA, 64 nt, Human
uacaacagauucuuaccgucuccacaaaggucagagauuguaaauggucaauacugacuuuuuu

SEQ ID NO: 418915 - RNA, 64 nt, Human
uuuuuaguacaaacaaaucauuuggaauaccuaaagauuguagagucauucccucuaucacuga

SEQ ID NO: 418916 - RNA, 64 nt, Human
uacuacaguaaacguuaagaguuuuaaacaguuaagauuguacaauuuuucuucuuuucuauau

SEQ ID NO: 418917 - RNA, 64 nt, Human
aaggaacccaagagaguggaagaacugcaaaacaagauuguaaauugucucaaagaccacguga

SEQ ID NO: 418918 - RNA, 64 nt, Human
aacuugagaaggcuugugcccaaagcuugaagaaagauuguaauagcauuuaguuguguuuuau

SEQ ID NO: 418919 - RNA, 64 nt, Human
auuuugcaacguauuuccuucguggaaaggauuuagauuguaacccgcacacaaaagcacggug

SEQ ID NO: 418920 - RNA, 64 nt, Human
uaaagggagagugagugauauguacaguguuuugagauuguauacauauauuccagaacuugga

SEQ ID NO: 418921 - RNA, 64 nt, Human; identical to SEQ ID NO: 37103

SEQ ID NO: 418922 - RNA, 64 nt, Human; identical to SEQ ID NO: 37104

SEQ ID NO: 418923 - RNA, 64 nt, Human; identical to SEQ ID NO: 37138

SEQ ID NO: 418924 - RNA, 64 nt, Human
uguaacauuuaagcauauuucagauguaaauaaaagauuguaaaauauacgguuuuuaccaaau

SEQ ID NO: 418925 - RNA, 64 nt, Human
uaaaagaguagaauaggguaugauccuuguuuuaagauuguaauucagaaaacauaauauaaga

SEQ ID NO: 418926 - RNA, 64 nt, Human
uuagggcagauuuugguugguuuuuacauaguugagauuguacuguucauacaguuuuauaccc

SEQ ID NO: 418927 - RNA, 64 nt, Human
auguggagauagaaaagaccuuuaagacaauaaaagauuguaggcuaucucuguaaucaugcaa

SEQ ID NO: 418928 - RNA, 64 nt, Human
cuucggaaacugugcauaguucuaauuguaagucagauuguauauucaaauuguaauuaagaga

SEQ ID NO: 418929 - RNA, 64 nt, Human
gaaaugggaggccagagaugagaacccuuugaaaagauuguaaaauacugauuuucauucuuuc

SEQ ID NO: 418930 - RNA, 64 nt, Human
uuaauguugguucugaaacagccucuuagcauucagauuguauuuuaaauacuuaaacacacca

SEQ ID NO: 418931 - RNA, 64 nt, Human
uuuccuaugguuggggaugcaaauauuagaaaacagauuguauuuugcugaggggaguggcugu

SEQ ID NO: 418932 - RNA, 64 nt, Human
aauaaagguuggcaaacuuuuucuguaaagggccagauuguaaauauuucagacuguguggacc

SEQ ID NO: 418933 - RNA, 64 nt, Human
cauuuuuguuuaagaguaauauuuuuaauguaauagauuguaagacguggugagggagggaucu

SEQ ID NO: 418934 - RNA, 64 nt, Human
uauacauccuuguaugguucucccaguauuagcaagauuguauaucuguaaagaauguccaguu

SEQ ID NO: 418935 - RNA, 64 nt, Human
accaauggucagcacuuuugguuugaguuaucugagauuguauuuucaaaaugaauuuuaagua

SEQ ID NO: 418936 - RNA, 64 nt, Human
aaggcacagggaacaagcauucuccuguuuuuacagauuguauccugaggcugagagaguuaag

SEQ ID NO: 418937 - RNA, 64 nt, Human
aggacaaagcagagaguccaauuuauugagggauagauuguaucucuuaaaguggucauauuau

SEQ ID NO: 418938 - RNA, 64 nt, Human
guugcaugaaauuuugccugcaacagagagaaaaagauuguauuacuuuaaugauuauaaucau

SEQ ID NO: 418939 - RNA, 64 nt, Human; identical to SEQ ID NO: 37143

SEQ ID NO: 418940 - RNA, 64 nt, Human; identical to SEQ ID NO: 37144

SEQ ID NO: 418941 - RNA, 64 nt, Human; identical to SEQ ID NO: 37145

SEQ ID NO: 418942 - RNA, 64 nt, Human
aggaaauguuaguaaaauagaugaguguuaaacuagauuguauucauuacuagauaaaauguau

SEQ ID NO: 418943 - RNA, 64 nt, Human
uguaaaauuuugccucucagaagaauggaauuggagauuguagacgugguuuuacaaaauguga

SEQ ID NO: 418944 - RNA, 64 nt, Human
gcacugcugagaacuaauuaaaauuauauauuccagauuguaaaacauguuuauuucuucuggg

SEQ ID NO: 418945 - RNA, 64 nt, Human
guugauuugaagcuguuauaagaauuaggauuccagauuguaaaaagauccccaaaugauucug

SEQ ID NO: 418946 - RNA, 64 nt, Human
guguuuauaauaagauguggauauuuccuucaguagauuguaaccauaauuuaaauuauuuugu

SEQ ID NO: 418947 - RNA, 64 nt, Human
aggacaggugacaaccaccucgaagagcucccagagauuguagaaagaguccaguguaaccagc

SEQ ID NO: 418948 - RNA, 64 nt, Human
aaguaucagccaauaaguauguuagugauaucacagauuguaccaacuauuaacuauguuaaau

SEQ ID NO: 418949 - RNA, 64 nt, Human
acauaauaguauuucuagaaaaagagauauuuuuagauuguaugccacuuuuguuuaagaacug

SEQ ID NO: 418950 - RNA, 64 nt, Human
agucacucaguauuuguauauguugcuagaauuuagauuguaaaauagugaaauuuuaaugugu

SEQ ID NO: 418951 - RNA, 64 nt, Human
uguuuguggcauggugagaaaacccaugcugaaaagauuguacuuugugaucccaaucagaggg

SEQ ID NO: 418952 - RNA, 64 nt, Human
gccuguuaaacagugucuuucauguucucuccccagauuguaaacucuguaagaagcugcuugu

SEQ ID NO: 418953 - RNA, 64 nt, Human
ucacuaaugaucacugcaaaaaugauuagaaaugagauuguacacauggaugaggauauauuuu

SEQ ID NO: 418954 - RNA, 64 nt, Human
agaagugauaacucuuaauuuccuaauagauacuagauuguauugaauucuguuuuaauuauuc

SEQ ID NO: 418955 - RNA, 64 nt, Human
auggacaugagcuggaaaaaugauguauuuuuguagauuguauguccagaaugacuuuagaacc

SEQ ID NO: 418956 - RNA, 64 nt, Human
agaggugaaaacuugucagaauauauaaaagcuuagauuguagcuguucuaaaaacguaaguac

SEQ ID NO: 418957 - RNA, 64 nt, Human; identical to SEQ ID NO: 37091

SEQ ID NO: 418958 - RNA, 64 nt, Human; identical to SEQ ID NO: 37092

SEQ ID NO: 418959 - RNA, 64 nt, Human; identical to SEQ ID NO: 37118

SEQ ID NO: 418960 - RNA, 64 nt, Human
uugaaaaugcucucacauacaggaauuagggccuagauuguaagcucuugcagcagucacauuu

SEQ ID NO: 418961 - RNA, 64 nt, Human
gugaagauuuuuaaacugacuaacuuaaaaaaauagauuguaauugaugugccuuaauuugcau

SEQ ID NO: 418962 - RNA, 64 nt, Human
aauuauguaaauaacucuaaccaaggcuguguuuagauuguauuaacuaucuucuuuggacuuc

SEQ ID NO: 418963 - RNA, 64 nt, Human
gauugcacagaauuuguauguauuuucaguuacaagauuguaaguaaauugccugauuuguuuu

SEQ ID NO: 418964 - RNA, 64 nt, Human
uuuauuucagucugacauagaguuaacugcaaucagauuguagucugauuuauaugaauaacgg

SEQ ID NO: 418965 - RNA, 64 nt, Human
auuugaucuacaauuuuuuucuguguuuuucaccagauuguacuccuaaaacuuaacaggccau

SEQ ID NO: 418966 - RNA, 64 nt, Human
cauccacugauagauuuuaggacugagagacuugagauuguacauuucuuacuacucuucuacu

SEQ ID NO: 418967 - RNA, 64 nt, Human
agccuuuuggugagcucagcugagauguagagggagauuguaaaagguuaaauauacccacacc

SEQ ID NO: 418968 - RNA, 64 nt, Human
ggugacaguaaaaacaguaagauccauaugcauaagauuguacaaggcuauucauuugugaaac

SEQ ID NO: 418969 - RNA, 64 nt, Human
aacauuagaauguaaucgugaauuugcauauuuuagauuguagaaaaguaaauauaaaauuaug

SEQ ID NO: 418970 - RNA, 64 nt, Human
ucuuuccccccuuuucuguauauagagugguuucagauuguaaauagcgcgucagcgaacuugu

SEQ ID NO: 418971 - RNA, 64 nt, Human
aggaaaauuggauucccuuaaacaaaaguguuuaagauuguaauuaaaaugauaguugauuuuc

SEQ ID NO: 418972 - RNA, 64 nt, Human
aggcuacaaaaacaaaccuguguuguuuuuguauagauuguagguuuauuuuuggauuucauau

SEQ ID NO: 418973 - RNA, 64 nt, Human
agguauuaaaggcuagccuaacuguugucuaaaaagauuguacaguauuuaagggauuuuccuu

SEQ ID NO: 418974 - RNA, 64 nt, Human
uauaugacaggauguuuguccugggacacccaccagauuguacauacuguguuuggcuguuuuc

SEQ ID NO: 418975 - RNA, 64 nt, Human; identical to SEQ ID NO: 37185

SEQ ID NO: 418976 - RNA, 64 nt, Human; identical to SEQ ID NO: 37186

SEQ ID NO: 418977 - RNA, 64 nt, Human; identical to SEQ ID NO: 37204

SEQ ID NO: 418978 - RNA, 64 nt, Human
caaaugaagaaauauuuaaagacagccucucaacagauuguaucucagguuaaaugcuaacuaa

SEQ ID NO: 418979 - RNA, 64 nt, Human
uguucgaguauaccuacccuaguuucagaagcauagauuguaguguaccuuuuuaaacuuuauu

SEQ ID NO: 418980 - RNA, 64 nt, Human
aauauauaaacgauauauguaaauauacagcaugagauuguacauuuuuuacuuuuuuaaaauu

SEQ ID NO: 418981 - RNA, 64 nt, Human
aacagaaacaaaaaaaaccagcauuaaaauaauaagauuguauaguuuguauauuuaggagugu

SEQ ID NO: 418982 - RNA, 64 nt, Human
uaacucaaacauaauuaacauguaauuaguuuacagauuguagggcaucacuucaauucaccaa

SEQ ID NO: 418983 - RNA, 64 nt, Human
ugacauuucaugaaguguagaucauuguauucagagauuguaaaugaaaaaaauauagaaacua

SEQ ID NO: 418984 - RNA, 64 nt, Human
ucuuuuuggugcugaacuaugacaugagccuuauagauuguaaaauagggauaguuggaacuaa

SEQ ID NO: 418985 - RNA, 64 nt, Human
uuaaauguaguuuuugugguuuaaucuuaugaguagauuguaaugaaaucauuaccuuugaaac

SEQ ID NO: 418986 - RNA, 64 nt, Human
gagauaagaggaggaagcuaauaagagacugucaagauuguauaccuucuugguuucuuuuaag

SEQ ID NO: 418987 - RNA, 64 nt, Human
uuuaaagaucuuuaauacuuuccaugaguacuaaagauuguaaugaguuaccuuauccuuagaa

SEQ ID NO: 418988 - RNA, 51 nt, Human
ucgccaauuuuagcaaauaagagauuguaaaagaagcagauugaaugaaga

SEQ ID NO: 418989 - RNA, 64 nt, Human
aacaggugcuaacacuguucccagcaaaguuuucagauuguaaagguaggugcaugccuucaua

SEQ ID NO: 418990 - RNA, 64 nt, Human
gcuguugcaaauuccaccccuccuucccugguccagauuguagcucuuaguccucccugcucag

SEQ ID NO: 418991 - RNA, 64 nt, Human
uacuuuuaaaauuguaucuuuccaggagccccucagauuguaccuugcuuucucaccaauagac

SEQ ID NO: 418992 - RNA, 64 nt, Human
aauguguguacaguuggcaugguaguauacaaaaagauuguaguggaucuaauuuuuaagaaau

SEQ ID NO: 418993 - RNA, 64 nt, Human; identical to SEQ ID NO: 37135

SEQ ID NO: 418994 - RNA, 64 nt, Human; identical to SEQ ID NO: 37136

SEQ ID NO: 418995 - RNA, 64 nt, Human; identical to SEQ ID NO: 37149

SEQ ID NO: 418996 - RNA, 64 nt, Human
ggccccuggaggcagaaaggcccuucuaacuuccagauuguaugcuugagugauggguccccag

SEQ ID NO: 418997 - RNA, 64 nt, Human
uuuuuccuuuuuuguauguaacagaacacauuucagauuguauuuaauuuaaauauuuguauau

SEQ ID NO: 418998 - RNA, 64 nt, Human
ugcauauauggauuagcuauaaaaaaugucaauaagauuguacaaggaaaauuagagaaaguca

SEQ ID NO: 418999 - RNA, 64 nt, Human
cuucacuugaguuguuuaacuuccuucuguuuuaagauuguaauuaaaaauuacuauuuuguua

SEQ ID NO: 419000 - RNA, 64 nt, Human
aaguguagacuuaauaccaugugacauuuaauccagauuguaaaugcucauuuaugguuaauga

SEQ ID NO: 419001 - RNA, 64 nt, Human
uguuugaagcauuauaaacauucauuucacaacuagauuguauaaggauauuagcugugaugag

SEQ ID NO: 419002 - RNA, 64 nt, Human
ucauaaaauccucuuauagaguuacucuugcccuagauuguaaauuaaguuuggcauuauuguc

SEQ ID NO: 419003 - RNA, 64 nt, Human
caaaaacuauuaucaccaggauuuauacauacagagauuguaguauuuaguauaugaaauauuu

SEQ ID NO: 419004 - RNA, 64 nt, Human
ggcuuucuaugcaccuaucaagaaucaagagaauagauuguaucaaacaacggcagggaaaucc

SEQ ID NO: 419005 - RNA, 64 nt, Human
cacacuguguauguuuucagcauuuuaaggcuagagauuguaaugggcuccuacuuguaauuuc

SEQ ID NO: 419006 - RNA, 64 nt, Human
cuugaaccuagaaggcggagguugcagugagcggagauuguaccauggcacuccagccuggaca

SEQ ID NO: 419007 - RNA, 64 nt, Human
agagacuguccuuuuucauaauuaauuuuauccaagauuguauuaaggcaaaaucugauucuac

SEQ ID NO: 419008 - RNA, 64 nt, Human
uaaaguauguguguguaucagugucucaaugugaagauuguaaccucaagauuaggaaucuuaa

SEQ ID NO: 419009 - RNA, 64 nt, Human
cuugagcccgggagguggagguugcaaugagccaagauuguaccacugcauuccaaccugggcg

SEQ ID NO: 419010 - RNA, 64 nt, Human
agaggauggcagagacuuuauuaaaaaaaaaaaaagauuguagugguagucuaacuccauaacg

SEQ ID NO: 419011 - RNA, 64 nt, Human; identical to SEQ ID NO: 37112

SEQ ID NO: 419012 - RNA, 64 nt, Human; identical to SEQ ID NO: 37113

SEQ ID NO: 419013 - RNA, 64 nt, Human; identical to SEQ ID NO: 37205

SEQ ID NO: 419014 - RNA, 64 nt, Human
ggcacagaauucuuuugugaaauaucagugccacagauuguaacagauagcuucaugcacacuc

SEQ ID NO: 419015 - RNA, 64 nt, Human
gugacuaagggccacgguuauugggugaaauuugagauuguaggccaacuguauuuucaagcuu

SEQ ID NO: 419016 - RNA, 64 nt, Human
ccuuauugcacaggaaagcauuuauacuucagaaagauuguacaaauacaaggaauguggaaaa

SEQ ID NO: 419017 - RNA, 64 nt, Human
caugcagccagcuuugcagguuaucagagaucaaagauuguaauaauaauuuuguaaauuguaa

SEQ ID NO: 419018 - RNA, 64 nt, Human
aguccaauauaaguaugaaggauucucucuccugagauuguagcaggcagccaaacauuuucaa

SEQ ID NO: 419019 - RNA, 64 nt, Human
guguguuucuacagaaguucuaguuuucaaauauagauuguaaggagccuucaauuuucuuuag

SEQ ID NO: 419020 - RNA, 64 nt, Human
cuuggacccuggagguagaggcugcagugagccaagauuguaccacuguacuccagccugggcu

SEQ ID NO: 419021 - RNA, 64 nt, Human
cacaguugaggauauucaucuccucaccaauuccagauuguaaauguaccaucuuaaacaacuc

SEQ ID NO: 419022 - RNA, 64 nt, Human
gggaggaggggcuggcacugagauuuuuuuuucaagauuguaaugugauugaaguuuucaacac

SEQ ID NO: 419023 - RNA, 64 nt, Human
gguauugaucagugaaauccuagggugcucuaugagauuguacuaggccuaugaagagugguaa

SEQ ID NO: 419024 - RNA, 64 nt, Human
ugugcauuaaacagaacaagcugugugucaucacagauuguacugugggcucagaaaccgugag

SEQ ID NO: 419025 - RNA, 64 nt, Human
ugagucacuggacguuggcagggaguuggcugugagauuguaggugcucaaguguuucuguucg

SEQ ID NO: 419026 - RNA, 64 nt, Human
gaaacaccaagauggcgagccagugugguuguagagauuguagagaggguggaauuggcacugu

SEQ ID NO: 419027 - RNA, 64 nt, Human
uaugguuccaaugaaauauguugggguuuuuuuaagauuguaaaaauaaucaguuacugguauc

SEQ ID NO: 419028 - RNA, 64 nt, Human
uuaaugguacuauauguaggccuuauuaaaauuaagauuguaugguuaaguaaaguuaacaaga

SEQ ID NO: 419029 - RNA, 64 nt, Human; identical to SEQ ID NO: 37081

SEQ ID NO: 419030 - RNA, 64 nt, Human; identical to SEQ ID NO: 37082

SEQ ID NO: 419031 - RNA, 64 nt, Human; identical to SEQ ID NO: 37083

SEQ ID NO: 419032 - RNA, 64 nt, Human
gcugagcuuuuuguuuucuucucuuuuugucucaagauuguauaugaaggaggcuuuucuucuc

SEQ ID NO: 419033 - RNA, 64 nt, Human
uucaucaguggcuaaauucacagauauccuauauagauuguauacagaacugagacugauuuug

SEQ ID NO: 419034 - RNA, 64 nt, Human
auuugguugccucaaagugcuuacauuuguuaacagauuguaaaccacauuuauuuacauugau

SEQ ID NO: 419035 - RNA, 64 nt, Human
aaugguuaauguucacuuaaaagacagauuuuggagauuguauucauaucuauuugcauuugau

SEQ ID NO: 419036 - RNA, 64 nt, Human
ggaaagaauuaacaaaugccaagauuucuggagcagauuguacagcugugacuuuggaaaacag

SEQ ID NO: 419037 - RNA, 64 nt, Human
guagugucauuuuuccuuccuuccuuccauuggcagauuguauauuuauucacaaaacauuaaa

SEQ ID NO: 419038 - RNA, 64 nt, Human
cgccaucacaacuuauuugugugacuaauugccuagauuguaagcucuuugagggcagggcuug

SEQ ID NO: 419039 - RNA, 64 nt, Human
uggauauucaauuuugauggcuuccagauuuguaagauuguauguuguauauaccauucuauua

SEQ ID NO: 419040 - RNA, 64 nt, Human
ugauugugguucaguuuaacugaagaauauccugagauuguaagaaaagcauuuuuuaaaaggu

SEQ ID NO: 419041 - RNA, 64 nt, Human
cgaaccagccacuuuuucaaucuggcuuuuuggaagauuguauuuaaaguucuucaaggaugaa

SEQ ID NO: 419042 - RNA, 64 nt, Human
caauagcccagggcucccccaaaagaauugguucagauuguaauuaucaguuaggcaauguuuu

SEQ ID NO: 419043 - RNA, 64 nt, Human
uuuguuacuuuguuagguacgaaucacauaagggagauuguauacaaguuggagcaauauccau

SEQ ID NO: 419044 - RNA, 64 nt, Human
cuauacaugaauguauuauacacacacacuuuagagauuguaagaaccccauuuagcuucuuga

SEQ ID NO: 419045 - RNA, 64 nt, Human
cuucuagaaaugaacuguacuaaucccuuuccccagauuguaucaugaguagaaucagguucac

SEQ ID NO: 419046 - RNA, 64 nt, Human
aacuuaacagggaagggcuggggugugaaaaagaagauuguaugaaaaccauugguaauuuuua

SEQ ID NO: 419047 - RNA, 64 nt, Human; identical to SEQ ID NO: 37152

SEQ ID NO: 419048 - RNA, 64 nt, Human; identical to SEQ ID NO: 37153

SEQ ID NO: 419049 - RNA, 64 nt, Human; identical to SEQ ID NO: 37154

SEQ ID NO: 419050 - RNA, 64 nt, Human
gugagucaaccgucuguggcuaccaguuacacugagauuguaacagcauuuuuacuuucuguac

SEQ ID NO: 419051 - RNA, 64 nt, Human
guuuuacaaaauuuuccucuuuuguuuauugacuagauuguauauaauuuucuuuuuuccaaaa

SEQ ID NO: 419052 - RNA, 64 nt, Human
ugauacucucugauaaaugcagguaguuaagaauagauuguacucauuccuuuuugaguuugug

SEQ ID NO: 419053 - RNA, 64 nt, Human
aauuacugggucuacaauuaauguugacuguuuuagauuguaagcuccuggagagcaguauugc

SEQ ID NO: 419054 - RNA, 64 nt, Human
aaaagaaauuaccacugggaaaaucuuuuuaguuagauuguaggcuuccuggggccucccaugc

SEQ ID NO: 419055 - RNA, 64 nt, Human
uggacccccuacuacuauuugucaccucacccacagauuguauuuaugucuauauauauguuca

SEQ ID NO: 419056 - RNA, 64 nt, Human
acagugaaaaguuugugagugaagaaugcugagaagauuguaaugcuuuguacaaauaaaaguc

SEQ ID NO: 419057 - RNA, 64 nt, Human
auucauuauaauuugggugacuagaacaacuugaagauuguagcaauaagcuggacuagugucc

SEQ ID NO: 419058 - RNA, 64 nt, Human
gauuuuuauauuaguugcuuuguuaaaaaaaaaaagauuguauugcuguccuugaaugccauag

SEQ ID NO: 419059 - RNA, 64 nt, Human
ucaagcugguguggggcuuuuauugauagugugaagauuguacacuauauuacaugaucagauc

SEQ ID NO: 419060 - RNA, 64 nt, Human
ccccucuagaauacauuggugauuucauuuaaagagauuguaugcauuuguggcuuuccugauu

SEQ ID NO: 419061 - RNA, 64 nt, Human
agagaaagagaaaggaaugcugguuuaucuuuguagauuguaaucgaauggagaaauuugcagu

SEQ ID NO: 419062 - RNA, 64 nt, Human
agaaugaauuuaugguauaguugaacccaguggcagauuguacacugcuagcacugcuagcaca

SEQ ID NO: 419063 - RNA, 64 nt, Human
ugaacuagaagucacagguuaauuaaauguaaguagauuguagauacuguuuuauaucaaacaa

SEQ ID NO: 419064 - RNA, 64 nt, Human
cugcaguuuaagagaacuuguauugugucauuucagauuguaggcugagaguuguaaauaguga

SEQ ID NO: 419065 - RNA, 64 nt, Human; identical to SEQ ID NO: 37087

SEQ ID NO: 419066 - RNA, 64 nt, Human; identical to SEQ ID NO: 37088

SEQ ID NO: 419067 - RNA, 58 nt, Human; identical to SEQ ID NO: 37090

SEQ ID NO: 419068 - RNA, 64 nt, Human
uaaacuuucucagauuaaaaguccugagaccugaagauuguaauauucaugucugugaagcuuu

SEQ ID NO: 419069 - RNA, 64 nt, Human
cccuucccuggguuuguuuuccuuggggugguguagauuguaugaguaagaaguauuaauuuuu

SEQ ID NO: 419070 - RNA, 64 nt, Human
gaagugggguauaauauuuaacgaaucaugauucagauuguaccauuacauguuucagugcagc

SEQ ID NO: 419071 - RNA, 64 nt, Human
ucaagcuggcauggggcuuuuauugacagugugaagauuguacacuacauuacaugaucagauc

SEQ ID NO: 419072 - RNA, 64 nt, Human
guguguuugcacuuucugagguucuagcuaguacagauuguauauugauaguacauauugcuuu

SEQ ID NO: 419073 - RNA, 64 nt, Human
aagaaauacuaccgaaguaaaauauaauguaccuagauuguaggagaugacagacauaagguau

SEQ ID NO: 419074 - RNA, 64 nt, Human
acuuuaguucuugacuuagucugcaccgucaucuagauuguauuguacaucucggucugaacuu

SEQ ID NO: 419075 - RNA, 64 nt, Human
uauuugaauaaauuaaagcucuuagauacagaguagauuguauuauaugcuuuuuccuauuaau

SEQ ID NO: 419076 - RNA, 64 nt, Human
ugauuucauuuuauucuuuguaauucuagacacuagauuguaguuuagccauaacugauguuuu

SEQ ID NO: 419077 - RNA, 64 nt, Human
aacauaguacgccaguguaacgugggaaccauugagauuguauuugcccugaguauuaaagcua

SEQ ID NO: 419078 - RNA, 64 nt, Human
uuaaaauaacacugagauuuuuuuaaaagcuggaagauuguacagcauaaagcuaaagugaagg

SEQ ID NO: 419079 - RNA, 64 nt, Human
agugauucucuuaccacagccugccagagugcugagauuguaggcaugaaccaccgugccuaac

SEQ ID NO: 419080 - RNA, 64 nt, Human
acuugcucaaagccacauagcugcucagaacccaagauuguaagcucccccuagggccagaggc

SEQ ID NO: 419081 - RNA, 64 nt, Human
caucagugcuauaguaaauuacaaagaaauagguagauuguaugaacauacccacaaaugccua

SEQ ID NO: 419082 - RNA, 64 nt, Human
cuaaccuucuauagauugcagcuggcuuuaaaauagauuguaaaguguaaggcauuagguucug

SEQ ID NO: 419083 - RNA, 64 nt, Human; identical to SEQ ID NO: 37094

SEQ ID NO: 419084 - RNA, 64 nt, Human; identical to SEQ ID NO: 37095

SEQ ID NO: 419085 - RNA, 64 nt, Human; identical to SEQ ID NO: 37096

SEQ ID NO: 419086 - RNA, 59 nt, Human
cuaucaccgaccuucccuaagccgcuggaagauuguauuccagaugcuagcuuagaggu

SEQ ID NO: 419087 - RNA, 64 nt, Human
ggagaggacaguucuuaguccaguaaaaauaugcagauuguauguaaugaauuuuuguaaacaa

SEQ ID NO: 419088 - RNA, 64 nt, Human
aggacuccuuaggcuuuguugaaugaagcagagaagauuguauaguuggggcuggucuugguga

SEQ ID NO: 419089 - RNA, 64 nt, Human
gugcccagacuguguacaaagacacauguaauggagauuguacagguuguuuuuuuguuugaac

SEQ ID NO: 419090 - RNA, 64 nt, Human
agucuuugucuguauucuucuguauuuaaccuucagauuguaagccuuuucuggcaagcuuuuc

SEQ ID NO: 419091 - RNA, 64 nt, Human
aacauaaagggaaaggcugcuaauuuucuuuggcagauuguauuggccagcaggaaagcaagcu

SEQ ID NO: 419092 - RNA, 64 nt, Human
uaauuuuccgaauaauucagguggaaaacaagaaagauuguauuucucugcuuucauuucaauu

SEQ ID NO: 419093 - RNA, 62 nt, Human
uagcuauaaugaaaauucaagcgaaaagggaaaaagauuguaaaugcagaugaaauaacuuc

SEQ ID NO: 419094 - RNA, 64 nt, Human
ccagccuccugcuaacuccuagcugacucagcauagauuguauaaaauaccuuuguaacggcuc

SEQ ID NO: 419095 - RNA, 64 nt, Human
auuguuuuuugugcauauauuucugcuaccacagagauuguacuauacaaauaaaaaaauaaaa

SEQ ID NO: 419096 - RNA, 64 nt, Human
aaacaucuuuuguuuuauaugcuuuuaagaauguagauuguaauuuaggaaauggcauauauuc

SEQ ID NO: 419097 - RNA, 64 nt, Human
ccggcccuuuuuuuucauuuauacuuuuucauuuagauuguaaugauuaacagaaacaggggua

SEQ ID NO: 419098 - RNA, 64 nt, Human
uuaagaccccugcuuuacaucucagguaauguguagauuguacuucucuggaaccaaauguagu

SEQ ID NO: 419099 - RNA, 64 nt, Human
gcuuuuguuugaugguuuucaauagaggugacugagauuguagggggggcauuuuugguugccc

SEQ ID NO: 419100 - RNA, 64 nt, Human
uuuugugaguuugguggggaagggaaggguauauagauuguauuaaaaaaaaaaagguauauau

SEQ ID NO: 419101 - RNA, 64 nt, Human; identical to SEQ ID NO: 37097

SEQ ID NO: 419102 - RNA, 64 nt, Human; identical to SEQ ID NO: 37098

SEQ ID NO: 419103 - RNA, 64 nt, Human; identical to SEQ ID NO: 37155

SEQ ID NO: 419104 - RNA, 64 nt, Human
ugcuugaaaacacaggaguagagaaaaucgaugaagauuguauuuuugcaccuuaacuccacau

SEQ ID NO: 419105 - RNA, 64 nt, Human
ccuucagaauuuaaggguuuuaaauauagcauucagauuguaauugguauguuuuugccaucug

SEQ ID NO: 419106 - RNA, 64 nt, Human
uaguagaaucaggcacugcucgcagaaggaacacagauuguagagauuaacauaaauuguucuu

SEQ ID NO: 419107 - RNA, 64 nt, Human
uuuucugcuggagauuauauuaggaaguuucaucagauuguauaaaauuaugauuuuguaucaa

SEQ ID NO: 419108 - RNA, 64 nt, Human
agguuuuauuauuuaaguuaguuaaacuuuggauagauuguauaauauauaguuuaauguaauc

SEQ ID NO: 419109 - RNA, 64 nt, Human
acaugauggguaacugugaucuuucuucccuguuagauuguaagccuccgucuuuguaucccag

SEQ ID NO: 419110 - RNA, 64 nt, Human
acaguuggaggacuucaccguaccaacccugaagagauuguauuacacauuaaggaccuuggua

SEQ ID NO: 419111 - RNA, 64 nt, Human
guugacuguauuuuuuaaccuaauucuggagagaagauuguauuuuuuacaguuuuuuggguuu

SEQ ID NO: 419112 - RNA, 64 nt, Human
caaguaguccaucagaaauuggcagucacuucccagauuguaccagcaaauacacaaggaauuc

SEQ ID NO: 419113 - RNA, 64 nt, Human
cuucuaccuuccugcaacaccuuguuucccucucagauuguaccauugaggaauaaaaaaagau

SEQ ID NO: 419114 - RNA, 64 nt, Human
ggaacaacaacacugucuguguucaucaccguuuagauuguacacaguaauggugacucuuaaa

SEQ ID NO: 419115 - RNA, 64 nt, Human
aucaucuguggugggaaaagcuauguaaauagguagauuguauagagagacuaucuuguguugu

SEQ ID NO: 419116 - RNA, 64 nt, Human
guagacaaaaggaaaggucucagcuuguauauagagauuguacauuuauuuauuacugucccua

SEQ ID NO: 419117 - RNA, 64 nt, Human
caagaaagucaaagagccuuaagagccucagugaagauuguauuuuauuuuaucaaaagccacc

SEQ ID NO: 419118 - RNA, 64 nt, Human
uucucaaggccuuuugaagagcauaagaagaugaagauuguaaacuuguauaaaauuaucuugg

SEQ ID NO: 419119 - RNA, 64 nt, Human; identical to SEQ ID NO: 37100

SEQ ID NO: 419120 - RNA, 64 nt, Human; identical to SEQ ID NO: 37101

SEQ ID NO: 419121 - RNA, 64 nt, Human; identical to SEQ ID NO: 37102

SEQ ID NO: 419122 - RNA, 64 nt, Human
ucaucgccuucaucaucuacgaguuuguccugggagauuguauggaggugagaggccagugugu

SEQ ID NO: 419123 - RNA, 64 nt, Human
auaauuugauaguuacaguuuucuuuguaucauaagauuguaagucccgauaauuuuuuuuuuu

SEQ ID NO: 419124 - RNA, 64 nt, Human
auucauucuuugccaugaaaugaaugaauuaggaagauuguauuuacuuaacuguuuuuuaaau

SEQ ID NO: 419125 - RNA, 64 nt, Human
uaggauugcccaucuuaagagaucuugcaggaagagauuguauuagauauuauauuuauuucau

SEQ ID NO: 419126 - RNA, 64 nt, Human
auaccauuauauguucccccuguuucagaggcucagauuguaauauguaaaugguaugucauuc

SEQ ID NO: 419127 - RNA, 64 nt, Human
gugcuuucaaguuuuguauauaagcaguagauacagauuguauuuguguguguuuuugguuuuu

SEQ ID NO: 419128 - RNA, 64 nt, Human
ucuaacuaaaacagagcuauagugaaacaaaaugagauuguaagaagacauuaaagcuauugau

SEQ ID NO: 419129 - RNA, 64 nt, Human
cuguguuauuguucuuuuucuuuuuaguguguggagauuguaauugccaucuaggcacacaaac

SEQ ID NO: 419130 - RNA, 64 nt, Human
acaacuuuucaauuaauauuaucacacuauuaucagauuguaauuagaugcaaaugagagagca

SEQ ID NO: 419131 - RNA, 64 nt, Human
auucggaagaaugugaaucaaucaguauguuuuuagauuguauuuugccuuacagaaagccuuu

SEQ ID NO: 419132 - RNA, 64 nt, Human
gcuccuauuuucccuuauggcugaguucaccuuaagauuguaaauguguauaugucagugaaaa

SEQ ID NO: 419133 - RNA, 64 nt, Human
ucacauacuacauacaaauucccuaauaaucaaaagauuguacacauuuuuuucaaugaaguac

SEQ ID NO: 419134 - RNA, 64 nt, Human
ccaugggggucuugugacaaauuaguuccuuuggagauuguauucaacccugaggaauggauua

SEQ ID NO: 419135 - RNA, 64 nt, Human
ucucucuggaaacugacuuugucaaauaaauagcagauuguagugucugguuugguuuggacag

SEQ ID NO: 419136 - RNA, 64 nt, Human
agaauuuauuuuauaaauacuuuguuuacauuuuagauuguacuugucuuuauuuaaaaugaug

SEQ ID NO: 419137 - RNA, 64 nt, Human; identical to SEQ ID NO: 37207

SEQ ID NO: 419138 - RNA, 64 nt, Human; identical to SEQ ID NO: 37208

SEQ ID NO: 419139 - RNA, 64 nt, Human; identical to SEQ ID NO: 37209

SEQ ID NO: 419140 - RNA, 64 nt, Human
uuuguuuuacaaacuaugaaucagcaaauuuuuaagauuguaccacauagcaaacauacagcug

SEQ ID NO: 419141 - RNA, 64 nt, Human
uuuuuauauauuuagccugucacaacagugcucaagauuguauugaaguuuuucugcauuauac

SEQ ID NO: 419142 - RNA, 64 nt, Human
ggggccggcccacucuggccagccagauacugcuagauuguaauauuuaaggucgaauuucgac

SEQ ID NO: 419143 - RNA, 64 nt, Human
ucuguccgguuugcaguacuugcacacauuuuggagauuguauuuucuagacaauucucuauuu

SEQ ID NO: 419144 - RNA, 64 nt, Human
caugucaucuuuguugagagucuucgugacuguaagauuguaaauacagauuauuuauuaacuc

SEQ ID NO: 419145 - RNA, 64 nt, Human
uaaaugcuuuauccauuugugcaaagguaaacgcagauuguaucuuuuuuaaugguacggcaua

SEQ ID NO: 419146 - RNA, 64 nt, Human
ucugaugaacacuaaauauuaauuucaauuagcuagauuguacauacuugcagauuuaacaaaa

SEQ ID NO: 419147 - RNA, 64 nt, Human
ugaaucauuugucacaagagagugugugcugaugagauuguaaguuuguguguuuaaacuuuuu

SEQ ID NO: 419148 - RNA, 64 nt, Human
auaauauagaaaugcaagaaaaaaacaaauguacagauuguaaaguuuuuugauaccuaaugua

SEQ ID NO: 419149 - RNA, 64 nt, Human
uuaagagugugauuucucauagggcuaguaagggagauuguauaccuguuguccacagucuuca

SEQ ID NO: 419150 - RNA, 64 nt, Human
gacaugaaagaauugccuuaguugaacaguucucagauuguaguuugcaauccccugggguucc

SEQ ID NO: 419151 - RNA, 64 nt, Human
caauaagauagcagcuguacaaaaugacuaaaauagauuguaggaucauauggcguauaucuug

SEQ ID NO: 419152 - RNA, 64 nt, Human
gaauuucaaggaaaagaauucucagcagagcucaagauuguagaaacucagcagaagcugguaa

SEQ ID NO: 419153 - RNA, 64 nt, Human
uggcuuucacuaaaaguggggaccucaguaucccagauuguaauuuugccaaguguuagauuug

SEQ ID NO: 419154 - RNA, 64 nt, Human
gugaguuggggauaugauagucagcucaggcuucagauuguaugagaaaaaugaagagaaguca

SEQ ID NO: 419155 - RNA, 64 nt, Human; identical to SEQ ID NO: 37084

SEQ ID NO: 419156 - RNA, 64 nt, Human; identical to SEQ ID NO: 37085

SEQ ID NO: 419157 - RNA, 64 nt, Human; identical to SEQ ID NO: 37106

SEQ ID NO: 419158 - RNA, 64 nt, Human
uuccuuuaacaaaaagaccuugaccaugaaucagagauuguauucaaugacauuaucaucauuu

SEQ ID NO: 419159 - RNA, 64 nt, Human
cuaugugacaaugagaagcaaacuuuuuugugacagauuguauuggcauaggcaugauagaugg

SEQ ID NO: 419160 - RNA, 64 nt, Human
uucugcauuugcgauguuacuagcagcagaagucagauuguagagguccuggcggcugauucua

SEQ ID NO: 419161 - RNA, 64 nt, Human
cuugcuuugauaccauucuugggcacauacuccaagauuguauuagauuuuugugaugaagagc

SEQ ID NO: 419162 - RNA, 64 nt, Human
acuagcaggaugggucuugggaguuggcauggggagauuguaagggcuguaucuccgcgauuac

SEQ ID NO: 419163 - RNA, 64 nt, Human
gacgaccuggauauuugacuggccagauuugauuagauuguaauuggagggggcgcgggaagac

SEQ ID NO: 419164 - RNA, 64 nt, Human
cuuaaccuuuaucuuucuuccuguccucucaccuagauuguaagcucccugggccaggacuuca

SEQ ID NO: 419165 - RNA, 64 nt, Human
ggccggggcccuggagggcugcucuguguuaauaagauuguaagguuugcccuccucaccuguu

SEQ ID NO: 419166 - RNA, 64 nt, Human
aaaggcacuaaaugguuuuuuccucuggaagaugagauuguaggugauauuuauuuucuucuga

SEQ ID NO: 419167 - RNA, 64 nt, Human
ccaaaaccauggacauuuuuuuuugggagaauugagauuguagacauuuuuuuuuucuuaaaua

SEQ ID NO: 419168 - RNA, 64 nt, Human
auuuagauggugguguagggcaaagcuguuagaaagauuguagcguuuuacucucccugggcuu

SEQ ID NO: 419169 - RNA, 64 nt, Human
aaaaauaaaaauaaaccuuacuuacaagcauaacagauuguauuuaacuuuaucacauaugaua

SEQ ID NO: 419170 - RNA, 64 nt, Human
ccuguaguuacccagcccgcuccagcagugcgggagauuguaaggaagcgguggcggcugguga

SEQ ID NO: 419171 - RNA, 64 nt, Human
auaaaaugcauuaugccaugguugcuuuugagauagauuguagucuggguagcaucuuuaaaau

SEQ ID NO: 419172 - RNA, 64 nt, Human
auuuauauauauuuuuuaacauuuuaaguuuaacagauuguauuccuuucaaguuucuauacuu

SEQ ID NO: 419173 - RNA, 64 nt, Human; identical to SEQ ID NO: 37108

SEQ ID NO: 419174 - RNA, 64 nt, Human; identical to SEQ ID NO: 37109

SEQ ID NO: 419175 - RNA, 64 nt, Human; identical to SEQ ID NO: 37111

SEQ ID NO: 419176 - RNA, 64 nt, Human
uauauugaucugcugauaccagugauaggcuuaaagauuguauuuucacagaguggaaaccaau

SEQ ID NO: 419177 - RNA, 64 nt, Human
guuuaccuaaaacagaacuaugguuauuuaucucagauuguaaguuuuauuuugaagugucauu

SEQ ID NO: 419178 - RNA, 64 nt, Human
cuugaaccugggagguggaaguugcagugagccaagauuguaccacugcacuccaguuuggcaa

SEQ ID NO: 419179 - RNA, 64 nt, Human
aaaaaagaaaggaaagaucucuaaauucaaagcuagauuguaaauaggcauucaagaaguauug

SEQ ID NO: 419180 - RNA, 64 nt, Human
auucuuucuaacuccauauaagcuuuuccagcaaagauuguaauaacacauuuauguucucguu

SEQ ID NO: 419181 - RNA, 64 nt, Human
augugggggcaccuucuccaguaggauucggaaaagauuguacauaugggaggagggggcagau

SEQ ID NO: 419182 - RNA, 64 nt, Human
cuaaggaugacuacuuuagauuccgaauauagugagauuguaacguguuugucucucugugccu

SEQ ID NO: 419183 - RNA, 64 nt, Human
aauaaaguagaaagugguaaagauucaacaugcaagauuguacuuauugggcuucagaauaucc

SEQ ID NO: 419184 - RNA, 64 nt, Human
uugacaguaagccugugauaaacauuauuccuauagauuguagaucagcuauaaguauuccuua

SEQ ID NO: 419185 - RNA, 64 nt, Human
cuccccuuuccaggcgccacuguugagaagcuagagauuguaugagaauaaacuuguuauuaug

SEQ ID NO: 419186 - RNA, 64 nt, Human
cuuuagaaacuaaacuucuccaaaaggacagggcagauuguaaacgucgucucaaaaaugaaau

SEQ ID NO: 419187 - RNA, 64 nt, Human
aauuauuaaacauaauuuauucuagguaaaauuuagauuguagugaauguaggaaguucuucag

SEQ ID NO: 419188 - RNA, 64 nt, Human
caauucacacuggugacaaacccuaugaauguaaagauuguaaaaaagcuuuucuuuguuauuc

SEQ ID NO: 419189 - RNA, 64 nt, Human
aggagaauugcuugaacuugggagguggaggccaagauuguaccacuguauuccagcccgggug

SEQ ID NO: 419190 - RNA, 64 nt, Human
uucugacacagaagugaugcuagaaugugucuauagauuguauugcuagcauccagacuuucua

SEQ ID NO: 419191 - RNA, 64 nt, Human; identical to SEQ ID NO: 37115

SEQ ID NO: 419192 - RNA, 64 nt, Human; identical to SEQ ID NO: 37116

SEQ ID NO: 419193 - RNA, 64 nt, Human; identical to SEQ ID NO: 37117

SEQ ID NO: 419194 - RNA, 64 nt, Human
ucugaaguuuguuagucauuuguaaaacuaaaucagauuguaaucccaguacuuugggaggcca

SEQ ID NO: 419195 - RNA, 64 nt, Human
cucaaaauggauccgauaaauauuugaauagagcagauuguagaaugucgugcugucaccagaa

SEQ ID NO: 419196 - RNA, 64 nt, Human
aaaaaaaaacuuuauuuaaaaaagaaaaaaguccagauuguaguuauacuuuugcuuguuuuuc

SEQ ID NO: 419197 - RNA, 64 nt, Human
uguuuaagugugcauuaguugugucuccccagcuagauuguaagcuccuggaggacagggacca

SEQ ID NO: 419198 - RNA, 64 nt, Human
cuuuccccuaccaaguucaaaauauaucuaagaaagauuguaaauccgaaaacuuccauuguag

SEQ ID NO: 419199 - RNA, 64 nt, Human
cugaugguggaagagcgggaacgagagauucgccagauuguacaguccauuucugaccugaaug

SEQ ID NO: 419200 - RNA, 64 nt, Human
accacgcguuuuccaaagcuccugaucuuucccaagauuguaacugaaaacugcugucucuugu

SEQ ID NO: 419201 - RNA, 64 nt, Human
uccagaaaauggcaguccuaaauguucaugagacagauuguauuaauuuaaccaggacuaugua

SEQ ID NO: 419202 - RNA, 64 nt, Human
ggaaaccccccagggccugcuguggccuaggagcagauuguaaugcugccgaguccggucggug

SEQ ID NO: 419203 - RNA, 64 nt, Human
guuuguauuaguugauaaauuaacaguaauaacaagauuguaugaaccgcauggugcuugcagu

SEQ ID NO: 419204 - RNA, 64 nt, Human
uauuguuauuguuaucuuccucuguuucuacaaaagauuguaaaacccuuuuuaggcaagggcc

SEQ ID NO: 419205 - RNA, 64 nt, Human
guaaaaaguauguaacacuuccaguugugagccaagauuguaaccagagagcagccaggagcuu

SEQ ID NO: 419206 - RNA, 64 nt, Human
cacgcuccuccacucccgcccuuggccgaagcauagauuguaaccccuccacuccccucugaga

SEQ ID NO: 419207 - RNA, 64 nt, Human
cugcuccuuuucuugcaguguauuuucuacaaccagauuguauuaauauuuuuuacuuugcccu

SEQ ID NO: 419208 - RNA, 64 nt, Human
uaauuuaagauuuuguuuuuaaacuggaaauaaaagauuguauagugcauguuuuuuaaagucu

SEQ ID NO: 419209 - RNA, 64 nt, Human; identical to SEQ ID NO: 37139

SEQ ID NO: 419210 - RNA, 64 nt, Human; identical to SEQ ID NO: 37140

SEQ ID NO: 419211 - RNA, 64 nt, Human; identical to SEQ ID NO: 37150

SEQ ID NO: 419212 - RNA, 64 nt, Human
uaaacagcauggaaaagguuaaauaccuguguucagauuguaagaucuaguccggacuugcugu

SEQ ID NO: 419213 - RNA, 64 nt, Human
augaccuucuuauuuauguaacuggcuuucauuuagauuguaaguuauggacaugauuugagau

SEQ ID NO: 419214 - RNA, 64 nt, Human
ucauuaggcaauugcauuguagugugauuaucacagauuguacuuauacaaaacuuagauggca

SEQ ID NO: 419215 - RNA, 64 nt, Human
gaaauauuacuauaauugagaacuacagcuuuuaagauuguacuuuuaucuuaaaaggguggua

SEQ ID NO: 419216 - RNA, 64 nt, Human
accuucacuauaaguggcccaguucugguuuucuagauuguacuuaugcauaagauaguuuuua

SEQ ID NO: 419217 - RNA, 64 nt, Human
aucgucuggccccuccuuuuccaaagugaccagaagauuguacuuccuagagaugccagacuug

SEQ ID NO: 419218 - RNA, 64 nt, Human
ugacagaaauucuacucguggacguugggaagaaagauuguagguggcuuggggaaugugggug

SEQ ID NO: 419219 - RNA, 64 nt, Human
cccaucauuuccugugucagcgccuggccuacccagauuguaucaugugcuagauuggaguggg

SEQ ID NO: 419220 - RNA, 64 nt, Human
cuuguccuaaggaaguaauugaauaauugcccaaagauuguauguaugaggcuguucaucccag

SEQ ID NO: 419221 - RNA, 64 nt, Human
ucuacaaugaugucccaaaguaaccaaguaagagagauuguaaaugauaaaccgagcuuuaaag

SEQ ID NO: 419222 - RNA, 64 nt, Human
agcuggcuggccuaaaaaccuaaauauaugaugaagauuguaggacugucuucccaagccccau

SEQ ID NO: 419223 - RNA, 64 nt, Human
aucuaaagcacuacuuuguaaagaugacuacccaagauuguaaauacaaaauuuaaaaagguac

SEQ ID NO: 419224 - RNA, 64 nt, Human
aaugagauaucugaaaccagguagaaggaagccuagauuguaagauuuuaaacauuuguaauag

SEQ ID NO: 419225 - RNA, 64 nt, Human
ggguuguuuaaaaauuuauaacaguuauaaagaaagauuguaaacuaaagugugcuuuauaaaa

SEQ ID NO: 419226 - RNA, 64 nt, Human
gaacucuuguucuuaaauuuugaauuuuauggugagauuguaaagauagaggcaauugaaacau

SEQ ID NO: 419227 - RNA, 64 nt, Human; identical to SEQ ID NO: 37157

SEQ ID NO: 419228 - RNA, 64 nt, Human; identical to SEQ ID NO: 37158

SEQ ID NO: 419229 - RNA, 64 nt, Human; identical to SEQ ID NO: 37159

SEQ ID NO: 419230 - RNA, 64 nt, Human
gugagggcacaagcaggcuucugagccacuugucagauuguauucaaagcaucaauccaagaag

SEQ ID NO: 419231 - RNA, 64 nt, Human; identical to SEQ ID NO: 37059

SEQ ID NO: 419232 - RNA, 64 nt, Human; identical to SEQ ID NO: 37060

SEQ ID NO: 419233 - RNA, 64 nt, Human; identical to SEQ ID NO: 37061

SEQ ID NO: 419234 - RNA, 64 nt, Human; identical to SEQ ID NO: 37062

SEQ ID NO: 419235 - RNA, 64 nt, Human; identical to SEQ ID NO: 37063

SEQ ID NO: 419236 - RNA, 64 nt, Human; identical to SEQ ID NO: 37064

SEQ ID NO: 419237 - RNA, 64 nt, Human; identical to SEQ ID NO: 37065

SEQ ID NO: 419238 - RNA, 64 nt, Human; identical to SEQ ID NO: 37066

SEQ ID NO: 419239 - RNA, 64 nt, Human; identical to SEQ ID NO: 37067

SEQ ID NO: 419240 - RNA, 64 nt, Human; identical to SEQ ID NO: 37068

SEQ ID NO: 419241 - RNA, 64 nt, Human; identical to SEQ ID NO: 37069

SEQ ID NO: 419242 - RNA, 64 nt, Human; identical to SEQ ID NO: 37070

SEQ ID NO: 419243 - RNA, 64 nt, Human; identical to SEQ ID NO: 37071

SEQ ID NO: 419244 - RNA, 64 nt, Human; identical to SEQ ID NO: 37072

SEQ ID NO: 419245 - RNA, 64 nt, Human; identical to SEQ ID NO: 37073

SEQ ID NO: 419246 - RNA, 64 nt, Human; identical to SEQ ID NO: 37074

SEQ ID NO: 419247 - RNA, 64 nt, Human; identical to SEQ ID NO: 37075

SEQ ID NO: 419248 - RNA, 64 nt, Human; identical to SEQ ID NO: 37076

SEQ ID NO: 419249 - RNA, 64 nt, Human; identical to SEQ ID NO: 37077

SEQ ID NO: 419250 - RNA, 64 nt, Human; identical to SEQ ID NO: 37276

SEQ ID NO: 419251 - RNA, 64 nt, Human; identical to SEQ ID NO: 37277

SEQ ID NO: 419252 - RNA, 64 nt, Human; identical to SEQ ID NO: 37278

SEQ ID NO: 419253 - RNA, 64 nt, Human; identical to SEQ ID NO: 37279

SEQ ID NO: 419254 - RNA, 64 nt, Human; identical to SEQ ID NO: 37280

SEQ ID NO: 419255 - RNA, 64 nt, Human; identical to SEQ ID NO: 37281

SEQ ID NO: 419256 - RNA, 64 nt, Human; identical to SEQ ID NO: 37282

SEQ ID NO: 419257 - RNA, 64 nt, Human; identical to SEQ ID NO: 37283

SEQ ID NO: 419258 - RNA, 64 nt, Human; identical to SEQ ID NO: 37284

SEQ ID NO: 419259 - RNA, 64 nt, Human; identical to SEQ ID NO: 37286

SEQ ID NO: 419260 - RNA, 64 nt, Human; identical to SEQ ID NO: 37287

SEQ ID NO: 419261 - RNA, 64 nt, Human; identical to SEQ ID NO: 37288

SEQ ID NO: 419262 - RNA, 64 nt, Human; identical to SEQ ID NO: 37289

SEQ ID NO: 419263 - RNA, 64 nt, Human; identical to SEQ ID NO: 37290

SEQ ID NO: 419264 - RNA, 64 nt, Human; identical to SEQ ID NO: 37291

SEQ ID NO: 419265 - RNA, 63 nt, Human; identical to SEQ ID NO: 37292

SEQ ID NO: 419266 - RNA, 64 nt, Human; identical to SEQ ID NO: 37293

SEQ ID NO: 419267 - RNA, 64 nt, Human; identical to SEQ ID NO: 37294

SEQ ID NO: 419268 - RNA, 64 nt, Human; identical to SEQ ID NO: 37295

SEQ ID NO: 419269 - RNA, 64 nt, Human; identical to SEQ ID NO: 37296

SEQ ID NO: 419270 - RNA, 64 nt, Human; identical to SEQ ID NO: 37297

SEQ ID NO: 419271 - RNA, 64 nt, Human; identical to SEQ ID NO: 37298

SEQ ID NO: 419272 - RNA, 64 nt, Human; identical to SEQ ID NO: 37299

SEQ ID NO: 419273 - RNA, 64 nt, Human; identical to SEQ ID NO: 37300

SEQ ID NO: 419274 - RNA, 64 nt, Human; identical to SEQ ID NO: 37301

SEQ ID NO: 419275 - RNA, 64 nt, Human; identical to SEQ ID NO: 37302

SEQ ID NO: 419276 - RNA, 64 nt, Human; identical to SEQ ID NO: 37304

SEQ ID NO: 419277 - RNA, 64 nt, Human; identical to SEQ ID NO: 37305

SEQ ID NO: 419278 - RNA, 64 nt, Human; identical to SEQ ID NO: 37306

SEQ ID NO: 419279 - RNA, 64 nt, Human; identical to SEQ ID NO: 37307

SEQ ID NO: 419280 - RNA, 64 nt, Human; identical to SEQ ID NO: 37308

SEQ ID NO: 419281 - RNA, 64 nt, Human; identical to SEQ ID NO: 37309

SEQ ID NO: 419282 - RNA, 64 nt, Human; identical to SEQ ID NO: 37310

SEQ ID NO: 419283 - RNA, 64 nt, Human; identical to SEQ ID NO: 37311

SEQ ID NO: 419284 - RNA, 64 nt, Human; identical to SEQ ID NO: 37312

SEQ ID NO: 419285 - RNA, 64 nt, Human; identical to SEQ ID NO: 37313

SEQ ID NO: 419286 - RNA, 64 nt, Human; identical to SEQ ID NO: 37314

SEQ ID NO: 419287 - RNA, 64 nt, Human; identical to SEQ ID NO: 37315

SEQ ID NO: 419288 - RNA, 64 nt, Human; identical to SEQ ID NO: 37316

SEQ ID NO: 419289 - RNA, 64 nt, Human; identical to SEQ ID NO: 37317

SEQ ID NO: 419290 - RNA, 64 nt, Human; identical to SEQ ID NO: 37318

SEQ ID NO: 419291 - RNA, 64 nt, Human; identical to SEQ ID NO: 37319

SEQ ID NO: 419292 - RNA, 64 nt, Human; identical to SEQ ID NO: 37320

SEQ ID NO: 419293 - RNA, 64 nt, Human; identical to SEQ ID NO: 37321

SEQ ID NO: 419294 - RNA, 64 nt, Human; identical to SEQ ID NO: 37322

SEQ ID NO: 419295 - RNA, 64 nt, Human; identical to SEQ ID NO: 37323

SEQ ID NO: 419296 - RNA, 64 nt, Human; identical to SEQ ID NO: 37324

SEQ ID NO: 419297 - RNA, 64 nt, Human; identical to SEQ ID NO: 37325

SEQ ID NO: 419298 - RNA, 64 nt, Human; identical to SEQ ID NO: 37326

SEQ ID NO: 419299 - RNA, 64 nt, Human; identical to SEQ ID NO: 37327

SEQ ID NO: 419300 - RNA, 64 nt, Human; identical to SEQ ID NO: 37328

SEQ ID NO: 419301 - RNA, 64 nt, Human; identical to SEQ ID NO: 37329

SEQ ID NO: 419302 - RNA, 64 nt, Human; identical to SEQ ID NO: 37330

SEQ ID NO: 419303 - RNA, 64 nt, Human; identical to SEQ ID NO: 37331

SEQ ID NO: 419304 - RNA, 64 nt, Human; identical to SEQ ID NO: 37332

SEQ ID NO: 419305 - RNA, 64 nt, Human; identical to SEQ ID NO: 37333

SEQ ID NO: 419306 - RNA, 64 nt, Human; identical to SEQ ID NO: 37334

SEQ ID NO: 419307 - RNA, 64 nt, Human; identical to SEQ ID NO: 37335

SEQ ID NO: 419308 - RNA, 64 nt, Human; identical to SEQ ID NO: 37336

SEQ ID NO: 419309 - RNA, 64 nt, Human; identical to SEQ ID NO: 37337

SEQ ID NO: 419310 - RNA, 64 nt, Human; identical to SEQ ID NO: 37339

SEQ ID NO: 419311 - RNA, 64 nt, Human; identical to SEQ ID NO: 37340

SEQ ID NO: 419312 - RNA, 64 nt, Human; identical to SEQ ID NO: 37341

SEQ ID NO: 419313 - RNA, 64 nt, Human; identical to SEQ ID NO: 37342

SEQ ID NO: 419314 - RNA, 64 nt, Human; identical to SEQ ID NO: 37343

SEQ ID NO: 419315 - RNA, 64 nt, Human; identical to SEQ ID NO: 37344

SEQ ID NO: 419316 - RNA, 64 nt, Human; identical to SEQ ID NO: 37345

SEQ ID NO: 419317 - RNA, 64 nt, Human; identical to SEQ ID NO: 37346

SEQ ID NO: 419318 - RNA, 64 nt, Human; identical to SEQ ID NO: 37347

SEQ ID NO: 419319 - RNA, 64 nt, Human; identical to SEQ ID NO: 37348

SEQ ID NO: 419320 - RNA, 64 nt, Human; identical to SEQ ID NO: 37349

SEQ ID NO: 419321 - RNA, 64 nt, Human; identical to SEQ ID NO: 37350

SEQ ID NO: 419322 - RNA, 64 nt, Human; identical to SEQ ID NO: 37351

SEQ ID NO: 419323 - RNA, 64 nt, Human; identical to SEQ ID NO: 37352

SEQ ID NO: 419324 - RNA, 64 nt, Human; identical to SEQ ID NO: 37353

SEQ ID NO: 419325 - RNA, 64 nt, Human; identical to SEQ ID NO: 37354

SEQ ID NO: 419326 - RNA, 64 nt, Human; identical to SEQ ID NO: 37355

SEQ ID NO: 419327 - RNA, 64 nt, Human; identical to SEQ ID NO: 37357

SEQ ID NO: 419328 - RNA, 64 nt, Human; identical to SEQ ID NO: 37358

SEQ ID NO: 419329 - RNA, 64 nt, Human; identical to SEQ ID NO: 37359

SEQ ID NO: 419330 - RNA, 64 nt, Human; identical to SEQ ID NO: 37360

SEQ ID NO: 419331 - RNA, 64 nt, Human; identical to SEQ ID NO: 37361

SEQ ID NO: 419332 - RNA, 64 nt, Human; identical to SEQ ID NO: 37362

SEQ ID NO: 419333 - RNA, 64 nt, Human; identical to SEQ ID NO: 37363

SEQ ID NO: 419334 - RNA, 64 nt, Human; identical to SEQ ID NO: 37364

SEQ ID NO: 419335 - RNA, 64 nt, Human; identical to SEQ ID NO: 37365

SEQ ID NO: 419336 - RNA, 64 nt, Human; identical to SEQ ID NO: 37366

SEQ ID NO: 419337 - RNA, 64 nt, Human; identical to SEQ ID NO: 37367

SEQ ID NO: 419338 - RNA, 64 nt, Human; identical to SEQ ID NO: 37368

SEQ ID NO: 419339 - RNA, 64 nt, Human; identical to SEQ ID NO: 37369

SEQ ID NO: 419340 - RNA, 64 nt, Human; identical to SEQ ID NO: 37370

SEQ ID NO: 419341 - RNA, 64 nt, Human; identical to SEQ ID NO: 37371

SEQ ID NO: 419342 - RNA, 64 nt, Human; identical to SEQ ID NO: 37372

SEQ ID NO: 419343 - RNA, 64 nt, Human; identical to SEQ ID NO: 37373

SEQ ID NO: 419344 - RNA, 64 nt, Human; identical to SEQ ID NO: 37375

SEQ ID NO: 419345 - RNA, 64 nt, Human; identical to SEQ ID NO: 37376

SEQ ID NO: 419346 - RNA, 64 nt, Human; identical to SEQ ID NO: 37377

SEQ ID NO: 419347 - RNA, 64 nt, Human; identical to SEQ ID NO: 37378

SEQ ID NO: 419348 - RNA, 64 nt, Human; identical to SEQ ID NO: 37379

SEQ ID NO: 419349 - RNA, 64 nt, Human; identical to SEQ ID NO: 37380

SEQ ID NO: 419350 - RNA, 64 nt, Human; identical to SEQ ID NO: 37381

SEQ ID NO: 419351 - RNA, 64 nt, Human; identical to SEQ ID NO: 37382

SEQ ID NO: 419352 - RNA, 64 nt, Human; identical to SEQ ID NO: 37383

SEQ ID NO: 419353 - RNA, 64 nt, Human; identical to SEQ ID NO: 37384

SEQ ID NO: 419354 - RNA, 64 nt, Human; identical to SEQ ID NO: 37385

SEQ ID NO: 419355 - RNA, 64 nt, Human; identical to SEQ ID NO: 37386

SEQ ID NO: 419356 - RNA, 64 nt, Human; identical to SEQ ID NO: 37387

SEQ ID NO: 419357 - RNA, 64 nt, Human; identical to SEQ ID NO: 37388

SEQ ID NO: 419358 - RNA, 64 nt, Human; identical to SEQ ID NO: 37389

SEQ ID NO: 419359 - RNA, 64 nt, Human; identical to SEQ ID NO: 37390

SEQ ID NO: 419360 - RNA, 64 nt, Human; identical to SEQ ID NO: 37391

SEQ ID NO: 419361 - RNA, 64 nt, Human; identical to SEQ ID NO: 37393

SEQ ID NO: 419362 - RNA, 64 nt, Human; identical to SEQ ID NO: 37394

SEQ ID NO: 419363 - RNA, 64 nt, Human; identical to SEQ ID NO: 37395

SEQ ID NO: 419364 - RNA, 64 nt, Human; identical to SEQ ID NO: 37396

SEQ ID NO: 419365 - RNA, 64 nt, Human; identical to SEQ ID NO: 37397

SEQ ID NO: 419366 - RNA, 64 nt, Human; identical to SEQ ID NO: 37398

SEQ ID NO: 419367 - RNA, 64 nt, Human; identical to SEQ ID NO: 37399

SEQ ID NO: 419368 - RNA, 64 nt, Human; identical to SEQ ID NO: 37400

SEQ ID NO: 419369 - RNA, 64 nt, Human; identical to SEQ ID NO: 37401

SEQ ID NO: 419370 - RNA, 64 nt, Human; identical to SEQ ID NO: 37402

SEQ ID NO: 419371 - RNA, 64 nt, Human; identical to SEQ ID NO: 37403

SEQ ID NO: 419372 - RNA, 64 nt, Human; identical to SEQ ID NO: 37404

SEQ ID NO: 419373 - RNA, 64 nt, Human; identical to SEQ ID NO: 37405

SEQ ID NO: 419374 - RNA, 64 nt, Human; identical to SEQ ID NO: 37406

SEQ ID NO: 419375 - RNA, 64 nt, Human; identical to SEQ ID NO: 37407

SEQ ID NO: 419376 - RNA, 64 nt, Human; identical to SEQ ID NO: 37408

SEQ ID NO: 419377 - RNA, 64 nt, Human; identical to SEQ ID NO: 37409

SEQ ID NO: 419378 - RNA, 64 nt, Human; identical to SEQ ID NO: 37410

SEQ ID NO: 419379 - RNA, 56 nt, Human; identical to SEQ ID NO: 37411

SEQ ID NO: 419380 - RNA, 64 nt, Human; identical to SEQ ID NO: 37412

SEQ ID NO: 419381 - RNA, 64 nt, Human; identical to SEQ ID NO: 37413

SEQ ID NO: 419382 - RNA, 64 nt, Human; identical to SEQ ID NO: 37414

SEQ ID NO: 419383 - RNA, 64 nt, Human; identical to SEQ ID NO: 37415

SEQ ID NO: 419384 - RNA, 64 nt, Human; identical to SEQ ID NO: 37416

SEQ ID NO: 419385 - RNA, 57 nt, Human; identical to SEQ ID NO: 37417

SEQ ID NO: 419386 - RNA, 64 nt, Human; identical to SEQ ID NO: 37418

SEQ ID NO: 419387 - RNA, 64 nt, Human; identical to SEQ ID NO: 37419

SEQ ID NO: 419388 - RNA, 64 nt, Human; identical to SEQ ID NO: 37420

SEQ ID NO: 419389 - RNA, 64 nt, Human; identical to SEQ ID NO: 37421

SEQ ID NO: 419390 - RNA, 64 nt, Human; identical to SEQ ID NO: 37422

SEQ ID NO: 419391 - RNA, 64 nt, Human; identical to SEQ ID NO: 37423

SEQ ID NO: 419392 - RNA, 64 nt, Human; identical to SEQ ID NO: 37424

SEQ ID NO: 419393 - RNA, 64 nt, Human; identical to SEQ ID NO: 37425

SEQ ID NO: 419394 - RNA, 64 nt, Human; identical to SEQ ID NO: 37426

SEQ ID NO: 419395 - RNA, 64 nt, Human; identical to SEQ ID NO: 37428

SEQ ID NO: 419396 - RNA, 64 nt, Human; identical to SEQ ID NO: 37429

SEQ ID NO: 419397 - RNA, 64 nt, Human; identical to SEQ ID NO: 37430

SEQ ID NO: 419398 - RNA, 64 nt, Human
uuagaggcugcagcuugagcuacaaucaggagggaaauuggaaggauuagcagcuuuuaaaaau

SEQ ID NO: 419399 - RNA, 64 nt, Human
ucaccaacucacuucucucggcuucguugucuguaaauuggaugaaaagagcucuaaugccuuu

SEQ ID NO: 419400 - RNA, 64 nt, Human
uaauguuugauccaguaugugcuugucuuauuuaaaauuggaaugugagacauguugcugugac

SEQ ID NO: 419401 - RNA, 64 nt, Human
ucugaauuccugaugauuggauuuaagcuauugaaaauuggauaauuuaaacuuaaugauuuuu

SEQ ID NO: 419402 - RNA, 64 nt, Human
aaaaccaguauuacuuuuuuuuaaaaaaagaaagaaauuggaaaucugugcuauacguaauguc

SEQ ID NO: 419403 - RNA, 64 nt, Human
uguguucuuagaucagcacaaaccaugucaaaaaaaauuggagauuuuuuuccaauuuuccuuc

SEQ ID NO: 419404 - RNA, 64 nt, Human
agagaggguugauaggcuggccguguccggggugaaauuggaaauccagcugccuaguggccag

SEQ ID NO: 419405 - RNA, 64 nt, Human
auuauuuaauaaaacuuuggaacauuaaaaaaauaaauuggaggcuuaaggauuagaaaacuug

SEQ ID NO: 419406 - RNA, 64 nt, Human
aucuuugugauauuacuucgcuauuaaauaaagaaaauuggaugcaagacaauggagaaacuuu

SEQ ID NO: 419407 - RNA, 64 nt, Human
ggaaggaagaugauacuucuuucucaagaaaagaaaauuggauuauuaggaauacaucuugacc

SEQ ID NO: 419408 - RNA, 64 nt, Human
aguuaggaugaaaaaaguuccagagguuuuuaagaaauuggauuaagcugggucccuaacuuca

SEQ ID NO: 419409 - RNA, 64 nt, Human
aggugguuuuaaugccucauucuaagugcuauuuaaauuggaucuugaaagaugaauaaggccu

SEQ ID NO: 419410 - RNA, 55 nt, Human
cacaguccucacugcacuaaaaauuaaauuggacacagcugcaguaacuuuucac

SEQ ID NO: 419411 - RNA, 64 nt, Human
uacauuaguuuuuacacuaaaacuuuacaagauaaaauuggacuucauuuaguaucuuuuuaac

SEQ ID NO: 419412 - RNA, 63 nt, Human
gacacccuagguuuuucuuagcuuccagcucuuuccauacagucuucacugaaguguuuggua

SEQ ID NO: 419413 - RNA, 63 nt, Human
caaauuuguaggaguuacuagguuagcaauuaguccauacauccauaagccugaugaguugaa

SEQ ID NO: 419414 - RNA, 63 nt, Human
ucugugccugcauaaugcugacaccugcuuguuuccauacaaauugauaucaaaauaaaauuu

SEQ ID NO: 419415 - RNA, 64 nt, Human
uaaauuuucaauucaauaauuaagguaaucuuuaaaauuggaugauccaaaaauaagugauaau

SEQ ID NO: 419416 - RNA, 64 nt, Human
uguuuaguggauaccacaucggaagugauuuucuaaauuggauuugaauucggcuccuguuuuc

SEQ ID NO: 419417 - RNA, 64 nt, Human
uauccuuguaucucugcaguguggauugaacagaaaauuggaaaucauagucaaagggcuuccc

SEQ ID NO: 419418 - RNA, 64 nt, Human
cuucuuuuuacauaaauguuuauuuaaauauucuaaauuggauuuucuuucacagauacugauu

SEQ ID NO: 419419 - RNA, 64 nt, Human
aaccgggaaggguggccuguucccuagagagaauaaauuggauuauuuucuaaugcugccuaua

SEQ ID NO: 419420 - RNA, 64 nt, Human
gaaaagaacaaaacaucaaaaugaauagaaagaaaaauuggaaggcguccuuuugguaacccga

SEQ ID NO: 419421 - RNA, 64 nt, Human
acugucccagugguggucauugauggccuuuaguaaauuggagcugcuuaaucauauugauauc

SEQ ID NO: 419422 - RNA, 64 nt, Human
ugcguguuuccauuuuaaagugaguugaguucucaaauuggaaagaaagauuccuugagacgua

SEQ ID NO: 419423 - RNA, 64 nt, Human
agaaguguaauuuuccuuuucccagcaugacgaaaaauuggaguucugccauuugagcagcuua

SEQ ID NO: 419424 - RNA, 64 nt, Human
ucucucaacuuaucagaacugccuauaguaaccaaaauuggauucaugaagaaaaaaauauauu

SEQ ID NO: 419425 - RNA, 64 nt, Human
aagcuggacaaggaccauuuagagaagguuuuacaaauuggaucagcaaaagccaaagaauuag

SEQ ID NO: 419426 - RNA, 64 nt, Human
ccugacuggccauucaguguucaggcugucauucaaauuggauaggagaaaguuggugaggaag

SEQ ID NO: 419427 - RNA, 64 nt, Human
aggucucaauuuuggaauuucaaacaccagcaaaaaauuggaaaucgagauagguugcugacuu

SEQ ID NO: 419428 - RNA, 64 nt, Human
uaaauuguuugguuuugcuuuucucucuuccacaaaauuggaagcuuuuuuuaaaaauguuuuc

SEQ ID NO: 419429 - RNA, 64 nt, Human
cuccacaagauggccagaguaauguuuuuaauauaaauuggauccuucaguuuccugcuuaaaa

SEQ ID NO: 419430 - RNA, 64 nt, Human
uauuccuauagaauguauuuuaagaaaucuauacaaauuggauauaugcuugguaauucuccag

SEQ ID NO: 419431 - RNA, 63 nt, Human
ugaggaugguguccuggagucuuguccacccucuccauacaagucucaaaagucauccuccua

SEQ ID NO: 419432 - RNA, 63 nt, Human
cuggccucucccucgugcuccucaagagcccaguccauacacuguggaugucauugcugucgg

SEQ ID NO: 419433 - RNA, 63 nt, Human
gacucuuuugcaauaacaacuuugauuacugaauccauacacucaaacuauagugauauauca

SEQ ID NO: 419434 - RNA, 64 nt, Human
ccuuguacugcaagaugaauuuguaaacaaaacaaaauuggacugucuggaaagcuaaaguucu

SEQ ID NO: 419435 - RNA, 64 nt, Human
ugucacuuuuaaaaccugucaggaucccacuguaaaauuggaaaugggcaguucugaauuuuca

SEQ ID NO: 419436 - RNA, 64 nt, Human
uacagugaguuuuauuaauagaaugcuucaccuuaaauuggaaaacaauaauagucuuggacua

SEQ ID NO: 419437 - RNA, 64 nt, Human
ucagaugaccucaaugccuuuguucaccugauugaaauuggaaauggucuugucaccuuucaac

SEQ ID NO: 419438 - RNA, 64 nt, Human
uaaaaggucuugcaguggcuuuucauggcccuucaaauuggaauggaacuacuguacuuugcca

SEQ ID NO: 419439 - RNA, 64 nt, Human
aggaaugaagaauggcaacgaaagauggggccuuaaauuggaugccacuuuuggacuuucauca

SEQ ID NO: 419440 - RNA, 64 nt, Human
gcugaugauauugauaagaugucgugacgcaaagaaauuggaaaacaugaugaaaauuuuggug

SEQ ID NO: 419441 - RNA, 64 nt, Human
uuugugucauucuccccacuuuauuaguuaauuuaaauuggaaaaaacccucaaacuaauauuc

SEQ ID NO: 419442 - RNA, 64 nt, Human
uuuugcauaaggaacuagaaaaaaaaaguaaggaaaauuggagaugcuaacauccucccccauc

SEQ ID NO: 419443 - RNA, 64 nt, Human
gaaugcagauaaaaguaccuuguaagauaaauauaaauuggaguuaggaauuucaugaaccuca

SEQ ID NO: 419444 - RNA, 64 nt, Human
uaagugaaacuuaguguaacaauuuugaucuguuaaauuggauuuuacauguacauuugaaugc

SEQ ID NO: 419445 - RNA, 64 nt, Human
gaagaagcauacaacuuuggacauagcgaauacaaaauuggaagcugucauaaaaagacaacuc

SEQ ID NO: 419446 - RNA, 64 nt, Human
ugauaguguugccagugauaaagcuuucaagcaaaaauuggaauuuccgaaaaucuguacucca

SEQ ID NO: 419447 - RNA, 64 nt, Human
cugaauugaauccauuguugggcuuaaguuacugaaauuggaacacccuuuguccuucucggcg

SEQ ID NO: 419448 - RNA, 64 nt, Human
ggagccccugcacaaaaugaaauaaaggaaguggaaauuggaaaaaacgcaaaccuaacuugcu

SEQ ID NO: 419449 - RNA, 64 nt, Human
aaggaaguagaugugaaaaagccuaagaaaaaggaaauuggacaguuuugauacaaacuuuguu

SEQ ID NO: 419450 - RNA, 64 nt, Human
acuccgcacgcuucugucuuucacggugggcgcucggggggagccugaggaaaacccccuuagg

SEQ ID NO: 419451 - RNA, 64 nt, Human
gcugaagaugccccuauauucugucaaagguuggcggggggagguguugggguccuuucaucug

SEQ ID NO: 419452 - RNA, 64 nt, Human
aucaauucuacuuuuauuuuugcuuacagaaaaacggggggagaauuaagccaaagaaguauau

SEQ ID NO: 419453 - RNA, 64 nt, Human
ugacuagauccaaacuguguuguucuuaaaucaaaaauuggauaauuuguaauauuuauguguu

SEQ ID NO: 419454 - RNA, 64 nt, Human
uaaucuuaaacacugaauaaaaaaacuuuccccuaaauuggaaugaucuuaguuuugcuuugag

SEQ ID NO: 419455 - RNA, 64 nt, Human
uuucuaaaugugaaagcaauacauaauuuagggaaaauuggaaaauauaggaaacuuuaaacga

SEQ ID NO: 419456 - RNA, 64 nt, Human
uuacacaauuaauugucccuguuucaaacugaguaaauuggaaacauuuucuuucuuuuucugg

SEQ ID NO: 419457 - RNA, 64 nt, Human
gacaguuuuauucuuugcagaugucuaauacaggaaauuggaugcauauucguuaucaaucuaa

SEQ ID NO: 419458 - RNA, 64 nt, Human
aaaaaaaaaaaaaaaagacuaagguggauuuuaaaaauuggaaacugacauaauguuagguuau

SEQ ID NO: 419459 - RNA, 64 nt, Human
aguugcugccuugcaaagguaaucucucauuuuaaaauuggacaguauuaaugaaggggaaaua

SEQ ID NO: 419460 - RNA, 64 nt, Human
uuuuaaccauugcuacuggaaaguaacagagucaaaauuggaagguuuuauucauucuugaauu

SEQ ID NO: 419461 - RNA, 64 nt, Human
gacacacuugucuagggaugccuggaaguguauaaaauuggacugcauuucuuagaguguuuua

SEQ ID NO: 419462 - RNA, 64 nt, Human
uaauuaaaguauuuuaauaugguuuucagugcuaaaauuggagucagauacuucuugguuuuaa

SEQ ID NO: 419463 - RNA, 64 nt, Human
uggcucucuaggauaauuagauagguauuucagaaaauuggaccuuaaaacuuugcuucuuugg

SEQ ID NO: 419464 - RNA, 64 nt, Human
gacgccaaucacugucacagcagagucaccuuagaaauuggacagcugcauguucugugcucuc

SEQ ID NO: 419465 - RNA, 64 nt, Human
acgaauugucuuaauuugaaaaccuugcuguuacaaauuggaccuuuauacauuuucugaaaac

SEQ ID NO: 419466 - RNA, 64 nt, Human
guuguaauguuuuauauguguauggugcaagagaaaauuggaucaaaucaaucugcaguugaug

SEQ ID NO: 419467 - RNA, 64 nt, Human
ggugaaugugaauccagagucuauuuuucuaaauaaauuggaaaaaacauuuugaacucuauug

SEQ ID NO: 419468 - RNA, 64 nt, Human
ugacuagauccaaacuguguuguucuuaaaucaaaaauuggauaauuuuuaauauuuauguauu

SEQ ID NO: 419469 - RNA, 64 nt, Human
cugcauagagcuggucucacuguggcgcaggccccggggggagugccugugcugucaggaagag

SEQ ID NO: 419470 - RNA, 64 nt, Human
cuuuuuaaaugcuucccuggacugcggggaggggcggggggagggagggauuucuuaucccguu

SEQ ID NO: 419471 - RNA, 64 nt, Human
gagugucugccuaguguuuugugcuuacaucuuucggggggaagccuuugcaagaaaauugcau

SEQ ID NO: 419472 - RNA, 64 nt, Human
uaaagugaggggaaacauuuugagccaaagaaacaaauuggagauuucaagcgucaaguggggg

SEQ ID NO: 419473 - RNA, 64 nt, Human
aacaaaaagccaucguagguaucaagucaacaugaaauuggaaugcaaaauuaauacugcugag

SEQ ID NO: 419474 - RNA, 64 nt, Human
uugcacacaggggcuacagcgcauuuucuaccugaaauuggaagacuuggugccaccgccagca

SEQ ID NO: 419475 - RNA, 64 nt, Human
uaggagaauagaagaacugguagccacaguggugaaauuggaaagagaacuuucuuccugaaac

SEQ ID NO: 419476 - RNA, 64 nt, Human
uauauuauggaacuaguaaaccuuaggauuuugaaaauuggagucuaaucuuucaaggaggugg

SEQ ID NO: 419477 - RNA, 64 nt, Human
acuugaaauuuugcagaauacccagguggagugaaaauuggaaggguuuugugcaaugacuaaa

SEQ ID NO: 419478 - RNA, 64 nt, Human
uaaggguugagcgaauuagggagauugcuaguggaaauuggagggaauuuguuuugcaucauuu

SEQ ID NO: 419479 - RNA, 64 nt, Human
ugauuaauuucccuuauguugaggcauggaaaaaaaauuggaaaagaaaaacucaguuuaaaua

SEQ ID NO: 419480 - RNA, 64 nt, Human
uuagauucugauucuaaauccgauuuuuacuauaaaauuggaaaauagaugggaggggugucau

SEQ ID NO: 419481 - RNA, 64 nt, Human
agucuuccuguaguggcaaaaaagaacaguguugaaauuggaaaggacuuuguguuauuuaggu

SEQ ID NO: 419482 - RNA, 64 nt, Human
ucuuaagguuuuuacagauacccaccuuaguuguaaauuggauaguuuauauuucugggacuuu

SEQ ID NO: 419483 - RNA, 64 nt, Human
augagagaaauaaguacucucaucaacuuaugauaaauuggacuauuaggaauaaaacaaucuc

SEQ ID NO: 419484 - RNA, 64 nt, Human
auuugaaggcaaaaccguggaauccuaacagaucaaauuggaugaaauauauaauuacuugaua

SEQ ID NO: 419485 - RNA, 64 nt, Human
gcaacaaacagcucagggccaaaccaaaagacaaaaauuggaguaacguagaaugcuccaugcu

SEQ ID NO: 419486 - RNA, 64 nt, Human
uuguuacacauuucuuuacaaaggaggccuguagaaauuggacacgaucaugcuugagcaugug

SEQ ID NO: 419487 - RNA, 64 nt, Human
aauucaaaguuaucacugaagaacaguugacuuaaaauuggaccaagacuaugaggcuuaaaag

SEQ ID NO: 419488 - RNA, 64 nt, Human
agcagacgcuccgccccacccggugauggagccccggggggacagucgugccuggggaggagca

SEQ ID NO: 419489 - RNA, 64 nt, Human
aagaaaaaaggguuuaugcuuacgucucuggggucggggggauuaugucacgagcguucaaacu

SEQ ID NO: 419490 - RNA, 64 nt, Human
gugcccuagaguccacccgguguccugaaguccucggggggaggccagccccuggcucacuggc

SEQ ID NO: 419491 - RNA, 64 nt, Human
cuccacacugguacaguagucaccugugaaaaaaaaauuggaacuuacuaauuugggcuuuuca

SEQ ID NO: 419492 - RNA, 64 nt, Human
ucccucuaagacuacauacuuuuuguuuaaaacaaaauuggaauuuguuuucccuucuuggaag

SEQ ID NO: 419493 - RNA, 64 nt, Human
gaaccaacaacagcaucuuagaagaaauguagccaaauuggaguccauucuucuuuagggcagu

SEQ ID NO: 419494 - RNA, 64 nt, Human
gagccaggguagaucauaugacugccuuucuguaaaauuggaugccuaguacaaaugcucuuug

SEQ ID NO: 419495 - RNA, 64 nt, Human
uucaggguugcucaguuaguaaguuauagaguugaaauuggagccaggccuaucugacugcaga

SEQ ID NO: 419496 - RNA, 64 nt, Human
gaagcuuccaugagaaagaaaacacuauuuugauaaauuggaucacuuauaggaacauuucuaa

SEQ ID NO: 419497 - RNA, 64 nt, Human
ccuaggaauuaaaguguaaguuguuuucgcuguuaaauuggauauuuauauauauauauagcaa

SEQ ID NO: 419498 - RNA, 64 nt, Human
caucucagaauuuuaauuuuuagaaauucaugggaaauuggauuuuuguaauaaucuuuugaug

SEQ ID NO: 419499 - RNA, 64 nt, Human
aaugaaugaacuuuuaagauacugucuagcucuaaaauuggaagaacaaaaaguuuuagauuag

SEQ ID NO: 419500 - RNA, 64 nt, Human
ucaauaaauaaauaaauagaagaaaucaugaguaaaauuggaaaacacuuuuaacugaaaaaaa

SEQ ID NO: 419501 - RNA, 64 nt, Human
ggcaucugaauucaucauugacaauaaauguaagaaauuggaauaaaaaagagagaccugcugu

SEQ ID NO: 419502 - RNA, 64 nt, Human
gaggcauuaguauagaccaaauaaaaagcugcagaaauuggaaaguuuauguuuuaaauaaaug

SEQ ID NO: 419503 - RNA, 64 nt, Human
ugaaaugugcagucuaagguuuaaucugaccaagaaauuggaauugaaaacaggaggugacuag

SEQ ID NO: 419504 - RNA, 64 nt, Human
ggcuuuuauaacaauagauuugaacauuuuuaaaaaauuggacuguguaacuuaaauacacaau

SEQ ID NO: 419505 - RNA, 64 nt, Human
auguauauacugacagaagauauuugaaaguggaaaauuggaaaugaaauauguugcugggugc

SEQ ID NO: 419506 - RNA, 64 nt, Human
caguugucuagagauauauauacuugugguuuucaaauuggacuuucaaaauuaaaucuguccc

SEQ ID NO: 419507 - RNA, 64 nt, Human
cccaccucacugccacauuccagugggacggccacggggggaccuaggccccagggaaagagcc

SEQ ID NO: 419508 - RNA, 64 nt, Human
auuugccuauagcccggcagcaaggaagucggggcggggggacuuuuuuacccugccaguuaua

SEQ ID NO: 419509 - RNA, 64 nt, Human
ccacagguggaaaggggaacugccucagugagaacggggggacggggauguuaggaaaaauaca

SEQ ID NO: 419510 - RNA, 59 nt, Human
auggacugcaaggauauugagagugaauaaaauuggacuuuguuuaaaauaagugaaua

SEQ ID NO: 419511 - RNA, 64 nt, Human
accaaagacacaagcaaccaauggaaaaauagguaaauuggacuuaaucaagauuugaagcuuu

SEQ ID NO: 419512 - RNA, 64 nt, Human
acuuaacaaaacaagugcaagacugaaaacuacaaaauuggaaagaaauuaaagaaggcuuaaa

SEQ ID NO: 419513 - RNA, 64 nt, Human
acaugacauaucuggauuuugugcuuagaaccuuaaauuggaagcauucuuaauuaugcaucua

SEQ ID NO: 419514 - RNA, 64 nt, Human
aaugucuaggauuauaaaacauuuuuuugugucuaaauuggacccaaaacauugaacaguuugg

SEQ ID NO: 419515 - RNA, 64 nt, Human
uuuuauaucucuuuggcguuucccuacagaaaagaaauuggacagaacagaauaauaugaagca

SEQ ID NO: 419516 - RNA, 53 nt, Human
augagcuuucaaaacguuaaaugaaauuggauaucuaaccaaggacauguuug

SEQ ID NO: 419517 - RNA, 64 nt, Human
agaugguauuaccuuuuaaaaaaugcuaauaagaaaauuggaagauucuuuuaaaaauuuuucu

SEQ ID NO: 419518 - RNA, 64 nt, Human
aggcuuugugguccugaucaagguccucauuaaaaaauuggaguucacccuaggugcuuuuccc

SEQ ID NO: 419519 - RNA, 64 nt, Human
aaaaauccaggaguaagagccuuaggucaguuugaaauuggagacaaacugucuggcaaagggu

SEQ ID NO: 419520 - RNA, 64 nt, Human
uggcuugccaaaaaaaaaaaaaaaaaaaaaucagaaauuggagaaauccuuagcacaauuuucu

SEQ ID NO: 419521 - RNA, 64 nt, Human
aucuuugcugaauccagauggguuagcagagggcaaauuggaggauuccuuugaggaaauguuc

SEQ ID NO: 419522 - RNA, 64 nt, Human
acaggggagaggcuggaaaacauauuaagagcauaaauuggagagaaucaaagccuugucacau

SEQ ID NO: 419523 - RNA, 64 nt, Human
gaauuguuuuaaugcauuuuaaacaguguuucugaaauuggauggcuggcuaauagacacugaa

SEQ ID NO: 419524 - RNA, 64 nt, Human
aacuuauuucuuaacugcuauuuggcagaagcugaaauuggagaaccaaggagcaaaaacaaau

SEQ ID NO: 419525 - RNA, 64 nt, Human
aaacuugcauaaaaguuaugcaagugguuuuuauaaauuggaauaauaccucaguuuugagguu

SEQ ID NO: 419526 - RNA, 64 nt, Human
ccagugaguccaggccccugaugcuccaaccucccggggggacgacgaugacaaugugaaacca

SEQ ID NO: 419527 - RNA, 64 nt, Human
gugagugggucucccaagacuaggccucaggacgcggggggagccauccccgccgcccucacag

SEQ ID NO: 419528 - RNA, 64 nt, Human
caggaggcugaggcaggagaauuacuuuaaccugcggggggagccuagauugcgcuacugcacu

SEQ ID NO: 419529 - RNA, 64 nt, Human
uguacacuaucuaucugccuuuaccuacauaggcaaauuggaaauacacagaugauuaaacaga

SEQ ID NO: 419530 - RNA, 64 nt, Human
gaugcaacaaauauuuauauauuugaauaucauuaaauuggaauuuucuuacccauauaucuua

SEQ ID NO: 419531 - RNA, 64 nt, Human
uaaucucuaauuccagugucuuuacacagcaaauaaauuggagaauauugcucccauauaaacu

SEQ ID NO: 419532 - RNA, 64 nt, Human
guucagauacucaaaaaugucuucacucugucuuaaauuggacaguugaacuuaaaagguuuuu

SEQ ID NO: 419533 - RNA, 64 nt, Human
aaaaaguuucuaaaguuacuacuggugucuaugcaaauuggauuccauagaaguuuuagcuaug

SEQ ID NO: 419534 - RNA, 64 nt, Human
auaauacuguagccucauucauauguaguuauucaaauuggauuaaugucugugugaguuuauu

SEQ ID NO: 419535 - RNA, 64 nt, Human
ucauuuggucacuagucuauagaagaugacacagaaauuggaaccaacaaaacugcuaacaccu

SEQ ID NO: 419536 - RNA, 64 nt, Human
cugaaccaucuaauccuauaaacauaaagggguaaaauuggaacucuccagaugaacaaagaca

SEQ ID NO: 419537 - RNA, 64 nt, Human
uugcugguagagguuuuggagguuaauuuaccuuaaauuggaagacuuuuaauugcagucucuu

SEQ ID NO: 419538 - RNA, 64 nt, Human
uauccucauucagagcugccacccuugugacuuuaaauuggagcuccuguuuuacaccacugug

SEQ ID NO: 419539 - RNA, 64 nt, Human
aaauaacuauagauauguaucguuuuccccuguaaaauuggaauaguaugauuggauuauucua

SEQ ID NO: 419540 - RNA, 64 nt, Human
aacauugugccuuaaaaugagucauacaucuuuuaaauuggaaugcaguaauagauaugugauu

SEQ ID NO: 419541 - RNA, 64 nt, Human
aacagaauagccacccaauuucugucugaaaucuaaauuggauggauuugaccaucauucuauu

SEQ ID NO: 419542 - RNA, 64 nt, Human
uguuaggggaagcauuuuuccaucaguuucuuuaaaauuggauugucuggugaguuuugauauu

SEQ ID NO: 419543 - RNA, 64 nt, Human
gcauauacauaguacuuugaauaauguauauuuuaaauuggaccucacaaaucuuguauuaaag

SEQ ID NO: 419544 - RNA, 64 nt, Human
accuuagagauuaugaagucauuaauuuauacugaaauuggauugacuuacuaccuaacacuga

SEQ ID NO: 419545 - RNA, 64 nt, Human
ccgcucagcacagaagaaggaugagggggcucagcggggggagcuggcaccuuccuggagccuc

SEQ ID NO: 419546 - RNA, 64 nt, Human
caggguuuaccgcaaagugcugcaggccgugcaccggggggauggagccaacccuuuccaguga

SEQ ID NO: 419547 - RNA, 64 nt, Human
gaaucugacagccucucccccauucugugugugucggggggacagagggaaccauuuaagaaaa

SEQ ID NO: 419548 - RNA, 64 nt, Human
uugaaugccuuauuuuugaauucuuuagauuuuuaaauuggagaaaagcacuuaaaguuuuuua

SEQ ID NO: 419549 - RNA, 64 nt, Human
aaucaguguucaggcuucaguuauauaauguaagcacaacuaaaaugaaacuuguugacugcac

SEQ ID NO: 419550 - RNA, 64 nt, Human
agcacgauuucucuuuugauaaugcccuuuagggcacaacuaguuaucaguaacugaauguauc

SEQ ID NO: 419551 - RNA, 64 nt, Human
uauuagcaccaaugacauaaauacauacaagacacacaacuaaaaugucauguuauuaacaguu

SEQ ID NO: 419552 - RNA, 64 nt, Human
ccauuaauuuuuuagauggauuuguuuccucuuacacaacuagaauuaauguauuuuucaccag

SEQ ID NO: 419553 - RNA, 64 nt, Human
uuaaggccauauugcauugauaacaagcuaaaagcacaacuaaaauuucacaugcuaacgacaa

SEQ ID NO: 419554 - RNA, 64 nt, Human
accacaaguuagaagaaaggucacauauuucaaacacaacuagauggggcucugaaagauuugu

SEQ ID NO: 419555 - RNA, 64 nt, Human
ugaaaagauaacauguaggccaggcaggucacugcacaacuaaagcaaaccagcuggguacagu

SEQ ID NO: 419556 - RNA, 64 nt, Human
gaaaucaggaagaggacaaguggccuggccagcccacaacuaguauucagccauugggagguaa

SEQ ID NO: 419557 - RNA, 64 nt, Human
ccuggauuuccugcugccauccucacccagcacccacaacuagcgccugggcagggcagggcug

SEQ ID NO: 419558 - RNA, 64 nt, Human
uaauguagggaauagaugaauagcuacagaaucacacaacuagaaagugucaccuaugacaaga

SEQ ID NO: 419559 - RNA, 64 nt, Human
aaucugaagauugcgguuuacagcuaucgaacuucacaacuaggccucaauuguuccgguuuuu

SEQ ID NO: 419560 - RNA, 64 nt, Human
auacuguuuccagcagccaacccuuuucucccaucacaacuacgaagaccuugauuuaccguua

SEQ ID NO: 419561 - RNA, 64 nt, Human
aaagucagcgggucaagcuagccuguggcccagccacaacuagcugacaaagcuuccuggccuu

SEQ ID NO: 419562 - RNA, 64 nt, Human
gagucuaccuucuuuucuuggccaccuccccauucacaacuacuuucucgcucccagaagguug

SEQ ID NO: 419563 - RNA, 64 nt, Human; identical to SEQ ID NO: 376864

SEQ ID NO: 419564 - RNA, 64 nt, Human; identical to SEQ ID NO: 376869

SEQ ID NO: 419565 - RNA, 61 nt, Human
gggccuggccaggccaggguuugggccuaauggcuuugacuaaauuacccccauccuccuu

SEQ ID NO: 419566 - RNA, 64 nt, Human
uuaguaaccccaagaguuucuucucauauccauaaaauuggauuacaguauggcaauaucuaca

SEQ ID NO: 419567 - RNA, 64 nt, Human
aaguauuuaaucaaagaaaagauucauacaugugaaauuggaagguauuuauaaaauuuuuauu

SEQ ID NO: 419568 - RNA, 64 nt, Human
cccaagauucuacagcauauuccuggcggggcugaaauuggaaccugggccuccugacuuuggc

SEQ ID NO: 419569 - RNA, 64 nt, Human
acacuuagaacauuuuuugaaauucaguuuacagaaauuggagaaaaugcuuuuuaaacaagug

SEQ ID NO: 419570 - RNA, 64 nt, Human
gaugccugugcccaaauaauaauucauauagcauaaauuggaguuguguguuaauguguaaaaa

SEQ ID NO: 419571 - RNA, 64 nt, Human
agacuuguguagaugcuucucagaacaugaaaucaaauuggaaaucuguaacgcagcuuccgua

SEQ ID NO: 419572 - RNA, 64 nt, Human
ugggguucccauuaggugucuacagggagaggugaaauuggaaguuggagguguggagaguuca

SEQ ID NO: 419573 - RNA, 64 nt, Human
gauuauuagcacuuucaaacuuagggacauuauuaaauuggauggaaugcacuucuaaauguuu

SEQ ID NO: 419574 - RNA, 64 nt, Human
cggccugggugauggagcaagaccucgucucagaaaauuggaaacuauugacuaagagaaguuu

SEQ ID NO: 419575 - RNA, 64 nt, Human
caaugaauaaauaacuuaagcacaaaauacauagaaauuggaaugugauuuauaguacaaucuc

SEQ ID NO: 419576 - RNA, 64 nt, Human
uucauauauacugucuuauuucuagauuuguuuaaaauuggaauaugaaaaacuaauggauaaa

SEQ ID NO: 419577 - RNA, 64 nt, Human
uugaauaucacuccuccaggaggaggaucuuuugaaauuggaauuguauauuucacuguaaauu

SEQ ID NO: 419578 - RNA, 64 nt, Human
uggaaagaacuguaugcaguugacuuuacuauguaaauuggagggaaacaaaguuuuagaucca

SEQ ID NO: 419579 - RNA, 64 nt, Human
uuuaaaaaaaaauuauuuuuaauauagagucaaaaaauuggauguauuauuuugagcuucuaau

SEQ ID NO: 419580 - RNA, 64 nt, Human
ugggaauaugaaaaugacaccuuuuccaaauauuaaauuggaaaacaaggucuacaaaaucaug

SEQ ID NO: 419581 - RNA, 64 nt, Human
gguuguaaauuugauuucaccauuaagaaaagguaaauuggauauaaaugaacgaucuccaacu

SEQ ID NO: 419582 - RNA, 64 nt, Human
uggcaauagggcaacaaagccauaggccagagggcggggggaugucccugccucccugccaccc

SEQ ID NO: 419583 - RNA, 64 nt, Human
cccaagucugagccggaggcccuuguuuugggggcggggggagaguuggaugugauugcccuug

SEQ ID NO: 419584 - RNA, 64 nt, Human
aauguuugcgcagcuucgcuucuuugccucuccccggggggaccaaaccgucccagcguuaaug

SEQ ID NO: 419585 - RNA, 64 nt, Human
agggagggaagugugagcgccuugguaugacuuaaaauuggaaaugucaucuaaccauuaaguc

SEQ ID NO: 419586 - RNA, 64 nt, Human
gauuguaaucacauggugacaacacucagaaucuaaauuggacuucuguuguauucucaccacu

SEQ ID NO: 419587 - RNA, 64 nt, Human
uuauuaccaacuuuuuguuucucauuacugaagaaaauuggaggaaaaucuucauacugaauuc

SEQ ID NO: 419588 - RNA, 64 nt, Human
caaaacaguuuugggggggucuucuaaagcuuucaaauuggaaguaacuuuauucaacuagagu

SEQ ID NO: 419589 - RNA, 64 nt, Human
uaaaugggucugaugugauaugacaagaccagagaaauuggauguaaauuuacauuuuugaaua

SEQ ID NO: 419590 - RNA, 64 nt, Human
uaacuggcaaaauccuuaguguacggacaaaagcaaauuggaaaagccagccauuuacuaauuc

SEQ ID NO: 419591 - RNA, 64 nt, Human
uaaacaaacaaaaucaccgaccuugcaaauacugaaauuggaagagggaucugcaagugcaggg

SEQ ID NO: 419592 - RNA, 64 nt, Human
cauaguuacaauuucuguuuguucaucacauuuaaaauuggaagagaacgcgcuugauggauag

SEQ ID NO: 419593 - RNA, 64 nt, Human
ggaugcugagauuccacauaacacaugguugucaaaauuggauguuaaggauucuuagaaaaac

SEQ ID NO: 419594 - RNA, 64 nt, Human
ggcuucagguaugggaaacagcucucagauuuauaaauuggaaaucaccagguuacuugccaau

SEQ ID NO: 419595 - RNA, 64 nt, Human
ugucuuugguguuuagaggagggaaugagaacacaaauuggauaauccacugucucccauccca

SEQ ID NO: 419596 - RNA, 64 nt, Human
gaaaugcuucagaugaggcuccaccuuguuaaauaaauuggauguauggaaaaauagacugcag

SEQ ID NO: 419597 - RNA, 64 nt, Human
gcauagacacuauucaguaaaugucugaugaaagaaauuggacuuuuucccuuuaauacugaug

SEQ ID NO: 419598 - RNA, 64 nt, Human
uagcaucuggcuccaggacagaccuucaacuuccaaauuggauacugcugccaagaaguugcuc

SEQ ID NO: 419599 - RNA, 64 nt, Human
uaccuucaccccagccacaugccccagccaauacaaauuggaaaaucuggcccauuuuaggguu

SEQ ID NO: 419600 - RNA, 64 nt, Human
ucugccaugagacuagagguugcuugagaacaggaaauuggaucucucccuucaggcugggauu

SEQ ID NO: 419601 - RNA, 64 nt, Human
ggguggugcuuucucuugcacaccacucccaccacggggggagagccagcaacccaaccagaca

SEQ ID NO: 419602 - RNA, 64 nt, Human
uuucuuaaaccucccuuccuaaaaucuggggggucggggggaaagaaaaaaaaagccuuagugg

SEQ ID NO: 419603 - RNA, 64 nt, Human
uucucuauugggcacagccuagggucuugggggucggggggagaaguucuugauucagccaaau

SEQ ID NO: 419604 - RNA, 64 nt, Human
ucuugagguaggaaaugcucugugaugguaaauaaaauuggagcagacagaaaagauauagcaa

SEQ ID NO: 419605 - RNA, 64 nt, Human
ccaggggcaauuccuaaaagcugaauggauaauaaaauuggacuggaaaguaaguagguggcug

SEQ ID NO: 419606 - RNA, 64 nt, Human
uaccaaccuguucaagucuaccaauuauaagggcaaauuggagaaaaagaaaaaauauauacuc

SEQ ID NO: 419607 - RNA, 64 nt, Human
agauauuuugacacaagaaagcaggaacguggagaaauuggagcaggaaaagaaauuaucaaag

SEQ ID NO: 419608 - RNA, 64 nt, Human
uggauucaaauggccauuuuucuccaauuuugguaaauuggauaucuuuuuuuuacaaauacga

SEQ ID NO: 419609 - RNA, 64 nt, Human
uauuuaaagugcucauuaauagaaugauggauguaaauuggauguaaauauucaguuuauauaa

SEQ ID NO: 419610 - RNA, 64 nt, Human
auuucugcauuuuuuaaaucaaaugaaaaacgucaaauuggaccaauugucuugguuucuugau

SEQ ID NO: 419611 - RNA, 64 nt, Human
gaaaaaaacaauacaaagaaaugcauucauaucaaaauuggaauagaaaggaaaaccuauuuuu

SEQ ID NO: 419612 - RNA, 64 nt, Human
aauagaguauuaguccuuaugucaucauuguucaaaauuggagauguacacauacauacccuau

SEQ ID NO: 419613 - RNA, 64 nt, Human
ccuuuucucuguccugaacccccagguaugggugaaauuggaaauuacuaaucuauuggaaauc

SEQ ID NO: 419614 - RNA, 64 nt, Human
caaagucucucuagaauuuuuucugccuucacuaaaauuggacuguagccaagauauaaagcaa

SEQ ID NO: 419615 - RNA, 64 nt, Human
uuuaaacguuuuuuaauccccuguuuuaguuaaaaaauuggaaaagaaaccgacccauuuuuuu

SEQ ID NO: 419616 - RNA, 64 nt, Human
ucuauuguccauauguauauuuucccaguaauugaaauuggaaaggaacuuaugggcauauuac

SEQ ID NO: 419617 - RNA, 64 nt, Human
uuuugauuccuugaagagccuauuuaguuccauaaaauuggagaacugcugaaggucaguaauu

SEQ ID NO: 419618 - RNA, 64 nt, Human
caugucuuuaauuuuuuaaaaaacuacuauuugaaaauuggagggggaagaaugggaagggagu

SEQ ID NO: 419619 - RNA, 64 nt, Human
ucagaugacugaagacuuccuguaagagaaauggaaauuggaaacuagacugaagugcaaaucu

SEQ ID NO: 419620 - RNA, 64 nt, Human
ugccuucagggaaaggucacagcuggggaggaagcggggggacgccugucaccccuggcaggug

SEQ ID NO: 419621 - RNA, 64 nt, Human
agccauggccggccgggugcuucugggggcucgucggggggacagcuccacucugacuggcaca

SEQ ID NO: 419622 - RNA, 64 nt, Human
gaggcgauccagugaugagucggggacaggccagcggggggacggaggcggcgggcccaggagc

SEQ ID NO: 419623 - RNA, 64 nt, Human
gaaaauuaaaucacuauuaauuacauuaaaaaucaaauuggauaaaacaauguuuucuuucugg

SEQ ID NO: 419624 - RNA, 64 nt, Human
aacaaauguuaaauuugugcuucaguaccuagauaaauuggaaagguuaauguucuaguuucug

SEQ ID NO: 419625 - RNA, 64 nt, Human
caacaguggaaguagaaacaguagggccucuguaaaauuggagacugauagguugaucagaaac

SEQ ID NO: 419626 - RNA, 64 nt, Human
aggcuaucaaaauuuuaauuaaguuuaaaauacaaaauuggaucaagacauucacccuaaauuc

SEQ ID NO: 419627 - RNA, 64 nt, Human
gacaaaacugauaucuuaacccggccaucaacccaaauuggacauuccagacuaccaccaacug

SEQ ID NO: 419628 - RNA, 64 nt, Human
aaguaauuucagaagaaauucugcaagcuuuucaaaauuggacuuaaaaucuaauucaaacuaa

SEQ ID NO: 419629 - RNA, 64 nt, Human
cccuccguuuuauuuuguuaauuaaauucuuuccaaauuggaucgcucugggauuucuuccaug

SEQ ID NO: 419630 - RNA, 64 nt, Human
caagugaaauaaguaauucuagauaggacaauuuaaauuggauaauuuuaaagugucuauaauu

SEQ ID NO: 419631 - RNA, 64 nt, Human
aacugaacccugaaggcuuucaagugaaaacuuuaaauuggaauccuaaccuuauauagacuug

SEQ ID NO: 419632 - RNA, 64 nt, Human
aucaauaaaagccuuugaaaauacuuuggauaauaaauuggaguuuuaaaaaugcaaauuugcu

SEQ ID NO: 419633 - RNA, 64 nt, Human
gugugggcagcgugacauuuuaugucccacccaaaaauuggauuccuuuuggagacugaucugu

SEQ ID NO: 419634 - RNA, 64 nt, Human
cugccagaaaucuuugccaagguccugguuaaaaaaauuggaaacgguuuucuuagccccagcu

SEQ ID NO: 419635 - RNA, 64 nt, Human
aaaccugugcauguaccccuugaaccugaaauaaaaauuggaaaguaaaaaaaaguguguaaau

SEQ ID NO: 419636 - RNA, 64 nt, Human
uuucccugaagagguuucuucacuauuaaucuuaaaauuggauaccauugugcagcgguguacu

SEQ ID NO: 419637 - RNA, 64 nt, Human
ucaucaaauagauugcuccuaaauccaauuguuaaaauuggaucagaauaauuaucacaggaac

SEQ ID NO: 419638 - RNA, 64 nt, Human
aagauuucaagaagccaucuaagaauacagaaccaaauuggauccauuuuuuuaaaaaaauggu

SEQ ID NO: 419639 - RNA, 64 nt, Human
cacagagacacaugucuuacuuucagaauuuccacggggggacuaggagggcagcauugcuggg

SEQ ID NO: 419640 - RNA, 64 nt, Human
gccgaagaggagcucccaccuuccccacugccgucggggggagucuucuuguaaauauaucuaa

SEQ ID NO: 419641 - RNA, 64 nt, Human
gguggagaaguggggagaaguguauaguaguacacggggggaagaggggaccuccaugucccuu

SEQ ID NO: 419642 - RNA, 64 nt, Human
gaggaagggccccauuaaagggugaacuuguaauaaauuggaauuucaaauaaaccucauguac

SEQ ID NO: 419643 - RNA, 64 nt, Human
uuuuggaagacaagauuauuagaauauugaagaaaaauuggagacuuauaaucaugguaaauau

SEQ ID NO: 419644 - RNA, 64 nt, Human
ggagacuaaacauugaaaacuuucacugauuuuuaaauuggaguaauagccuaaauaaguguaa

SEQ ID NO: 419645 - RNA, 64 nt, Human
cucugggcgcuguaaguuaagcucuacauagauuaaauuggagaaacguguuaauuguguggaa

SEQ ID NO: 419646 - RNA, 64 nt, Human
ugacuuuccuuucaaauuuuuacugagaauaucgaaauuggauuaugcaauaggaucuuauuua

SEQ ID NO: 419647 - RNA, 64 nt, Human
uuaccagaaguaauuuguguuugagaugggguggaaauuggaauuauauuaguagccgguggag

SEQ ID NO: 419648 - RNA, 64 nt, Human
uaaauauauuaaggaaaguauagcuuuguaauuuaaauuggagcuuuuagcuuguuucauggaa

SEQ ID NO: 419649 - RNA, 64 nt, Human
ucuuugcccccaaagguauuuugugucuagugucaaauuggagcuauucuucacugguccuuaa

SEQ ID NO: 419650 - RNA, 64 nt, Human
cugauggcucacugauuuuugaaaagccugaauaaaauuggaaagacuggaaaguuaggagaac

SEQ ID NO: 419651 - RNA, 64 nt, Human
gggagagucuuuuuuuuuuuuuuuuuuaaauacuaaauuggaacauuuaauuccauauuaauac

SEQ ID NO: 419652 - RNA, 64 nt, Human
aaaagcuauguucauacucuaaaucuggauauuaaaauuggaagagacuucaaagacugucaag

SEQ ID NO: 419653 - RNA, 64 nt, Human
gauguauauguacaguaccuugccagggaagcaaaaauuggaauuauuguagcuuuucauguau

SEQ ID NO: 419654 - RNA, 64 nt, Human
gaugcaguggcuccucucugguugaggagagggaaaauuggaaaaacuggucgaguaauuauca

SEQ ID NO: 419655 - RNA, 64 nt, Human
uuuuaugauuguuaagcauuucauauuuuaauuuaaauuggauucaaccacaauaaagaaaaug

SEQ ID NO: 419656 - RNA, 64 nt, Human
ugguauuuuucuuauucuuguuugaucauguuaaaaauuggaccuaauaaaaguauuuuauucu

SEQ ID NO: 419657 - RNA, 64 nt, Human
uauacuagauccaauacuauuuaguuuauuaucgaaauuggaaggauucauugagcagcauaga

SEQ ID NO: 419658 - RNA, 64 nt, Human
aaacuacuucuauaaugcuuauuaugguaaaauaaaauuggaaaaaauuaaaacugaccuauaa

SEQ ID NO: 419659 - RNA, 64 nt, Human
uuugggcagauuugcaacagcaaauuaauguguaaaauuggauuauuacuacaaaaccguuuag

SEQ ID NO: 419660 - RNA, 64 nt, Human
aaugauacauaaucauucucuuuaagacaauuauaaauuggauggagcuauuauucacuacuuc

SEQ ID NO: 419661 - RNA, 64 nt, Human
gacugaaagauuuagccauaauguaaacugccucaaauuggacuuugggcauaaaagaacuuuu

SEQ ID NO: 419662 - RNA, 64 nt, Human
caguuggugacugggaaaguuaggauucagaucgaaauuggacugucuuuauaacccauauuuu

SEQ ID NO: 419663 - RNA, 64 nt, Human
guaggaagcaacagcuucagaaagagcucaaaauaaauuggaaaugugaaucgcagcugugggu

SEQ ID NO: 419664 - RNA, 64 nt, Human
cacagauuuuacugugacuucugaagcuguggauaaauuggaauuuuuuauguugucucucucu

SEQ ID NO: 419665 - RNA, 64 nt, Human
gcugcuauuuuacuauuuggagaauaugaugugaaaauuggaccucaaaggguuuccuuguguu

SEQ ID NO: 419666 - RNA, 64 nt, Human
aucuuaagauuuuuauaaacacaaagccuuugcaaaauuggauuaaauuccaccuaucuuaaug

SEQ ID NO: 419667 - RNA, 64 nt, Human
acaaacuuuaucucccuauucuuacauuuagugcaaauuggaaugcguaugugaauguuagaag

SEQ ID NO: 419668 - RNA, 64 nt, Human
acuauguauuggggauaucuuugcagauauguucaaauuggacuggacuuugaugagauauaau

SEQ ID NO: 419669 - RNA, 64 nt, Human
aagugcuccaaaggacaauguuaggucaacuggcaaauuggaauauagacagucaaucagauaa

SEQ ID NO: 419670 - RNA, 64 nt, Human
uggacucagugcagagcaggacaugaugccaucgaaauuggaagguucccuggugcugccucac

SEQ ID NO: 419671 - RNA, 64 nt, Human
uuggcccuaaacugugaugcuccauuggaugauaaaauuggagcagagucucggaauuggagag

SEQ ID NO: 419672 - RNA, 64 nt, Human
uucacaucuuguggaaggaccaaauuuucugaaaaaauuggaacaaucuuuuaugugcguuugc

SEQ ID NO: 419673 - RNA, 64 nt, Human
gggggaagaggaaaugaaaauagcacaaaaauuaaaauuggaacgaaguaagauaauuaaaaca

SEQ ID NO: 419674 - RNA, 64 nt, Human
ggcccucccgcugcaucucagaccugacacccaacggggggaugugguggccugugcccaccuu

SEQ ID NO: 419675 - RNA, 64 nt, Human
ccugagucggcuguggggagcggugggggugggccggggggaagcauggggaugaggcugggug

SEQ ID NO: 419676 - RNA, 64 nt, Human
ggguggguggggggccucaggcgggaucucggggcggggggaggaggauggugaccuugggagu

SEQ ID NO: 419677 - RNA, 64 nt, Human
uugcuuuaaguuguauguauuucugaacuuggcaaaauuggaaauuaaaauuuuuaaaaauuac

SEQ ID NO: 419678 - RNA, 64 nt, Human
aauuugcaaaagaaauaggcuuuucuucuuuuuuaaauuggagaaaucucugcucugguugacc

SEQ ID NO: 419679 - RNA, 64 nt, Human
gaggcccauuuucacuaaacaauaaaaucuaaauaaauuggaaggaauaacaaccacaaaggaa

SEQ ID NO: 419680 - RNA, 64 nt, Human
aaggugacguuuaaaauuuuuaguacauauccucaaauuggagcuaaguuauacuucuuuuaua

SEQ ID NO: 419681 - RNA, 64 nt, Human
gaacucuauuggugucgucugagcagccauuuaaaaauuggaaucuaaaggaugguugcugaug

SEQ ID NO: 419682 - RNA, 64 nt, Human
uuucuuauucgugaaaauucggagagugcugcuaaaauuggauuggugugaucuuuuugguagu

SEQ ID NO: 419683 - RNA, 64 nt, Human
caguugucccccucuucucuggguguaagaagggaaauuggaaaaaaaauuauauauauauucu

SEQ ID NO: 419684 - RNA, 64 nt, Human
cagcccuacaaauguauaugcccuccccugaaaaaaauuggaugaaaaucugcacagcaaagug

SEQ ID NO: 419685 - RNA, 64 nt, Human
acagaauuuuauacaacuguaccaauaaaauuccaaauuggaauuguuuuguuacucugguugu

SEQ ID NO: 419686 - RNA, 64 nt, Human
cagagccacaaaucugggaccugucuuuccaacuaaauuggaggcuuuggaagggcagcuuugu

SEQ ID NO: 419687 - RNA, 64 nt, Human
gaggagaaaggggaaucucccaaaauuuaaaaacaaauuggaagaauaaccaggacagccaagu

SEQ ID NO: 419688 - RNA, 64 nt, Human
uacuccuccaagguuauuggacaccggaaacaauaaauuggaacaccuccucaaaccuaccacu

SEQ ID NO: 419689 - RNA, 64 nt, Human
uuuauuuccugguuuggcacaguaugguuucaugaaauuggagcucuguauaaacugaaaaaga

SEQ ID NO: 419690 - RNA, 64 nt, Human
uugcauuacuucauucacugaaguuuuugcccaaaaauuggaagguaaacagagagcuauguuu

SEQ ID NO: 419691 - RNA, 64 nt, Human
uuaauauaguugguacacaacuaguuuuguuuauaaauuggagaugcaaauagcaaaacuaaau

SEQ ID NO: 419692 - RNA, 64 nt, Human
auguguggguccaacacuuacuaccugguguaugaaauuggaccugaacuguuggauuuuucua

SEQ ID NO: 419693 - RNA, 64 nt, Human
uaguuagauaaugagaaguuguuaauuaucucuaaaauuggaauuaggaagcauaucaccaaua

SEQ ID NO: 419694 - RNA, 64 nt, Human
gccugauaauucaucucauuauugccucuaaagcaaauuggagacugggcacaguggcucccac

SEQ ID NO: 419695 - RNA, 64 nt, Human
aaaauuaaaaauaccuagacugcaauaaaccuuuaaauuggauuuucagugagaauuuagaagc

SEQ ID NO: 419696 - RNA, 64 nt, Human
uugguauuugaacuuauuacagaauuuuuucucuaaauuggauguuucuuuauaugaccuugga

SEQ ID NO: 419697 - RNA, 64 nt, Human
ucuggaaagcuugagccuccuuggguucgucuacaaauuggaaggaaauaugaaugaagcccug

SEQ ID NO: 419698 - RNA, 64 nt, Human
acuacgucugucauacugggagcuuuaucacugcaaauuggaaagccaucuuauacaaaauuau

SEQ ID NO: 419699 - RNA, 64 nt, Human
aacauuauuggaguuucaguguaaaauaaaauuaaaauuggaggguugguuagauugauuucag

SEQ ID NO: 419700 - RNA, 64 nt, Human
ggacaggggccgcgcagauccgggggaggcucccaaauuggaaccaggcuucuggcugcccccu

SEQ ID NO: 419701 - RNA, 64 nt, Human
cagucaguggaucuuaaaaugacaaucuguuuuuaaauuggauucuaugaaaaugcauaaugcu

SEQ ID NO: 419702 - RNA, 64 nt, Human
augguuugcugcauuaaagguauuugggcaaacaaaauuggagggcaagugacugcaguuuuga

SEQ ID NO: 419703 - RNA, 64 nt, Human
uauacaguuguuaaaucuuaaauaugcuuuuuaaaaauuggaauaauguauuaaggucaaauaa

SEQ ID NO: 419704 - RNA, 64 nt, Human
uuucuucuuaaaaaucagcuauuuagagguggauaaauuggaaguuugugcauugcuuguggga

SEQ ID NO: 419705 - RNA, 64 nt, Human
uaauuugguaagaaaacuguauuuuuuuucccugaaauuggauaauguacuuucuucucaagau

SEQ ID NO: 419706 - RNA, 64 nt, Human
gcaucauagacgagacaguccauucaucuuaguuaaauuggauugagaaugccuuuuguuucca

SEQ ID NO: 419707 - RNA, 64 nt, Human
aguaacauguguuaaguauuuucauaaguauuucaaauuggagcuucauggcagaaggcaaacc

SEQ ID NO: 419708 - RNA, 64 nt, Human
uuauucucucucuucuaccuacaauuaguuugaaaaauuggagauuuugauuugcugugaugaa

SEQ ID NO: 419709 - RNA, 64 nt, Human
uguuuccugggaagugcuaauuuuaccuguuuccaaauuggaaacacauuucucaaucauuccg

SEQ ID NO: 419710 - RNA, 64 nt, Human
aaaggaaggaggggacugaaaucucccaaagugcaaauuggagaguguuuaaucuuuguucugu

SEQ ID NO: 419711 - RNA, 64 nt, Human
uuuauagcauuccauuuuccuagugccacaugugaaauuggauuuugaugaucuuaaucuauau

SEQ ID NO: 419712 - RNA, 64 nt, Human
cagcagaauuucugaauguguagagacuacuacaaaauuggaaaaagauuggcaauucuuugua

SEQ ID NO: 419713 - RNA, 64 nt, Human
ucaaggauuauuauacuugugcuucaaccaaucuaaauuggauucuuuaauguuguuucaccau

SEQ ID NO: 419714 - RNA, 64 nt, Human
augaaugcagauuacacugaucuuauguguuacaaaauuggagaaaguauuuaauaaaaccugu

SEQ ID NO: 419715 - RNA, 64 nt, Human
ggugguucucgagccugccauucaaaaccaaagcaaauuggagcauuucucacaacaugguauu

SEQ ID NO: 419716 - RNA, 64 nt, Human
gcacguggcuucugaugaaucuugcguuuuuuacaaauuggagcagggacagaucauagauuuc

SEQ ID NO: 419717 - RNA, 64 nt, Human
aggucagagcuuagugauucacacugaaauuggcaaauuggauuuaacccaauuaauagugugu

SEQ ID NO: 419718 - RNA, 64 nt, Human
aaguauuuucauuugaucuuuaaaaaauaaaaacaaauuggagaccugugacauaacucuaguc

SEQ ID NO: 419719 - RNA, 64 nt, Human
gagaauacaucuaaggucaucuuucaaaagagaaaaauuggacacuugagugacuuuguuuuua

SEQ ID NO: 419720 - RNA, 64 nt, Human
ggcagaacaacugcauuucacagcuuuuccaguuaaauuggagcacugaacguucagaugcaua

SEQ ID NO: 419721 - RNA, 64 nt, Human
uaaaacuaagaauaaaggcugcauuuucaaagauaaauuggaauugcuguuggugaaauaacaa

SEQ ID NO: 419722 - RNA, 64 nt, Human
cuuauguauucucaauuaccuguauuugugcaauaaauuggaauaauguaacuugauuucuuau

SEQ ID NO: 419723 - RNA, 64 nt, Human
auagauaaacaauuagguauaauagcaaaaaugaaaauuggaagaaugcaaaauggaucagaau

SEQ ID NO: 419724 - RNA, 64 nt, Human
ugaaugauguggacuuuuagaggaucaaaucaauaaauuggauuuuuuauuuuuugagggcagc

SEQ ID NO: 419725 - RNA, 64 nt, Human
uuccuuuccucgugaaggauaagagaaacaggcccggggggaccaggaugacaccuccauuucu

SEQ ID NO: 419726 - RNA, 64 nt, Human
gcagccucccucacccaguauguuuuacagauuacggggggaccgggugagccagugacccccu

SEQ ID NO: 419727 - RNA, 64 nt, Human; identical to SEQ ID NO: 376865

SEQ ID NO: 419728 - RNA, 64 nt, Human
aguauagccaaaugccuguucugaaacuuauaggaaauuggaauuuuguuuaaaauuuuacacu

SEQ ID NO: 419729 - RNA, 64 nt, Human
ugugugauggcuuggaauuuaauuuauuaaagucaaauuggaguuuauaaacuggacaacuggu

SEQ ID NO: 419730 - RNA, 64 nt, Human
acuaucaccuauuacauuuuacugauuaacaaauaaauuggaauuuaaaaauaucgauaucacc

SEQ ID NO: 419731 - RNA, 64 nt, Human
uagcagaagcuuuucauuuuuaaacauagaauuaaaauuggauuugcuucucuuuaauacuuca

SEQ ID NO: 419732 - RNA, 64 nt, Human
cucaguugacacuuguuauaucaugggaccccggaaauuggagugaagcuagaaacagaaaacc

SEQ ID NO: 419733 - RNA, 64 nt, Human
uggggacuccccaagaaggccaugaggaagccagaaauuggaggugguaggaagugguacugau

SEQ ID NO: 419734 - RNA, 64 nt, Human
caacuuaagguagaaguuccaagcuacuaguguuaaauuggaaaauaucaauaauuaagaguau

SEQ ID NO: 419735 - RNA, 64 nt, Human
ugugauguuugugugcuguuuuaaaauucauuucaaauuggacucgauuuccuuauaucuaaua

SEQ ID NO: 419736 - RNA, 64 nt, Human
ugcccaccaucccaccucuggauaauuuugcauaaaauuggauuagccuggagcagguugggag

SEQ ID NO: 419737 - RNA, 64 nt, Human
ugagcuaaaguugaguaaauucuuagcuaagaaaaaauuggaaauccaucaucuauauuagcaa

SEQ ID NO: 419738 - RNA, 64 nt, Human
ccggggcuuuggauagagugagaauuccccaacuaaauuggacuucucugcuuuauccccuucu

SEQ ID NO: 419739 - RNA, 64 nt, Human
uccccagacugagaaagugaaaccuuauugggaaaaauuggacugcccugaauuuagcaccaau

SEQ ID NO: 419740 - RNA, 64 nt, Human
cacuugagcaugaauggguaguagccaaacucacaaauuggagugaugaaccugcuuauaccua

SEQ ID NO: 419741 - RNA, 64 nt, Human
agggucuguauuggacuaauucugaacuacagacaaauuggaccucaaugucauuuacuucccu

SEQ ID NO: 419742 - RNA, 64 nt, Human
ucucagggcuggcccuuuuugggauuuggaugagaaauuggaaguacuaacuacuuucuagcau

SEQ ID NO: 419743 - RNA, 64 nt, Human
ugaauguucacacacuuuucuugcguacucaacuaaauuggagaauguuucugaagaaaauugg

SEQ ID NO: 419744 - RNA, 64 nt, Human; identical to SEQ ID NO: 376870

SEQ ID NO: 419745 - RNA, 64 nt, Human; identical to SEQ ID NO: 376871

SEQ ID NO: 419746 - RNA, 64 nt, Human; identical to SEQ ID NO: 376872

SEQ ID NO: 419747 - RNA, 64 nt, Human
cguacucaacuaaauuggagaauguuucugaagaaaauuggaugaaauuagcugcugagauuga

SEQ ID NO: 419748 - RNA, 64 nt, Human
cagggauccuuaauguuuugauuuuuguuuucugaaauuggauuuuauuuuauuuuaucuuaua

SEQ ID NO: 419749 - RNA, 64 nt, Human
cagcuuaaauauuuaugcuggucaaaugugauuuaaauuggacauuuucaucaaugcagucuaa

SEQ ID NO: 419750 - RNA, 64 nt, Human
ggcucuacuuucaaagguuaagaaugagauuuuaaaauuggauuuuugccuggacuugagggua

SEQ ID NO: 419751 - RNA, 64 nt, Human
auuugaugaauuuaaacuuuaagucaggugcugcaaauuggaaagaagacuugugguguuuuaa

SEQ ID NO: 419752 - RNA, 64 nt, Human
cucccaccccccgcuagccuggucaguggucagcaaauuggaagaggauccgaugggaguguaa

SEQ ID NO: 419753 - RNA, 64 nt, Human
cuuaaggaucugauacaucuaguuauuggucuggaaauuggagaaauggaggugagcaaauuaa

SEQ ID NO: 419754 - RNA, 64 nt, Human
ugcccccuuuuaggccauguuccauuaucucuuaaaauuggaaccuaauucgagaggaaguaag

SEQ ID NO: 419755 - RNA, 64 nt, Human
agacucagugcuuauuuuuuaaacugcauuuuaaaaauuggauaguauaauaacaauaaggagu

SEQ ID NO: 419756 - RNA, 55 nt, Human
aaagcuguuccauuaugugaaguggaaauuggaggggggagacaacccccuacuu

SEQ ID NO: 419757 - RNA, 64 nt, Human
ugcaugauucuuaaccaggcuauauguuaaaaaaaaauuggaaaaugcaauacauuuuuuauua

SEQ ID NO: 419758 - RNA, 64 nt, Human
guuuauuggaccccuccaucuugaugauauauaaaaauuggaagccaaaccaguucuuaaaugc

SEQ ID NO: 419759 - RNA, 64 nt, Human
augcacaaaaucauacauguuaauaaauauaaacaaauuggaggcuuauuuaaaccaauuauga

SEQ ID NO: 419760 - RNA, 64 nt, Human
aauaaaucaggaugguagaaagugauuauauggaaaauuggaaccuggaugagaccuuuucguu

SEQ ID NO: 419761 - RNA, 64 nt, Human
auuuauaaagggguaauucauuaauuacacuuuaaaauuggaaagugggauaagaaaucuaaag

SEQ ID NO: 419762 - RNA, 64 nt, Human
ucuugcuacccaugacuuuauauggaugauucagaaauuggaacagaauguuuuacugugaaac

SEQ ID NO: 419763 - RNA, 61 nt, Human
caaauauuuccugaagauccacccugggugaggcuuugagcugacuuuagagaucacugug

SEQ ID NO: 419764 - RNA, 61 nt, Human
aaagcaaaccccuuuuaaaaucuaaugucugggcuuugaguauuagcucauuuagggugga

SEQ ID NO: 419765 - RNA, 61 nt, Human
acucuggugcccccaacccugggcauccucaggcuuugaggagaauacacaggauuugaag

SEQ ID NO: 419766 - RNA, 64 nt, Human
aagaggaacuucagacacaaaaguccacugaugcaaauuggacuggcgaguccagagaggaaac

SEQ ID NO: 419767 - RNA, 64 nt, Human
augugaaaaaugcucucccagcaaagcugagacaaaauuggagaagcugcagccucacgcacca

SEQ ID NO: 419768 - RNA, 64 nt, Human
auuucauugcaauguaauaacuacaguuuuuuacaaauuggaacagcuuuggugugucguaauc

SEQ ID NO: 419769 - RNA, 64 nt, Human
acuccuaaaaacauuuuccgggauuuuacuacuaaaauuggacauuuaagcgaaguaaaagagg

SEQ ID NO: 419770 - RNA, 64 nt, Human
auuucauuaccucugcacaugccugucaaauaugaaauuggaagggcccuuuucaggcuggguu

SEQ ID NO: 419771 - RNA, 64 nt, Human
uuuugguaauauucauuuuaaaguggacuuauuaaaauuggaugcuagagaaucaaguuuauuu

SEQ ID NO: 419772 - RNA, 64 nt, Human
cuacaaugcauauucuaaugaagcuacuuuauauaaauuggagagcuuauaaaaugcagaacau

SEQ ID NO: 419773 - RNA, 64 nt, Human
uuagagaugaucccauuuagaaaaagacugguagaaauuggagugaaaggaacccuacagauua

SEQ ID NO: 419774 - RNA, 64 nt, Human
ggaguguuuuuguuucuguugggucuaauuaaaaaaauuggagcuuguauuuuaugugucuuug

SEQ ID NO: 419775 - RNA, 64 nt, Human
auacuauauauauauauacacacauaguuuuagcaaauuggaaauaauauauucauuuguaugg

SEQ ID NO: 419776 - RNA, 64 nt, Human
gggaccuaucuauguauguugacuuuuaacaucaaaauuggauuugugucaaacauucauuguu

SEQ ID NO: 419777 - RNA, 64 nt, Human
ugcuuaaaauggaaaucauucuccaacgauauacaaauuggacuuguucaacugcuggauauau

SEQ ID NO: 419778 - RNA, 64 nt, Human
aauauagaacuaugaauauguagaauaacaugaaaaauuggaggugcuggugguauggcugacc

SEQ ID NO: 419779 - RNA, 64 nt, Human
guaaaauuauuuugguuuucuucuacaaaggaaaaaauuggauuuauauauauaagguuacugc

SEQ ID NO: 419780 - RNA, 64 nt, Human
uaguagaggaaaaccaaaacccuuuuuuccgucaaaauuggauuuguaauuaaauuguaagccu

SEQ ID NO: 419781 - RNA, 64 nt, Human
aucuuauuuaccauuuccucuuuuugagucacuuaaauuggacaccuuugguacccuggucuca

SEQ ID NO: 419782 - RNA, 64 nt, Human
ccuagaugagcuaggaugcuuccagcuagagcuucggggggauguggaaaugaaggugauggca

SEQ ID NO: 419783 - RNA, 50 nt, Human
ugggcgugcagucgcggugacggggggagggccgcccggcaguggacucg

SEQ ID NO: 419784 - RNA, 64 nt, Human
uguaauuuuaucccucauguauacuuggauauggcggggggagggcugggacuguuucguuucu

SEQ ID NO: 419785 - RNA, 64 nt, Human
cuuaccuuuuuccagcuucauauuugcaagugguaaauuggauuugcgguggaagagacagggg

SEQ ID NO: 419786 - RNA, 64 nt, Human
cuuuuucaucgaugguacuauuucuuaguguuuuaaauuggaacauaucuugccucaugaagcu

SEQ ID NO: 419787 - RNA, 64 nt, Human
ugguaggacaguuggcagaaaagaguuaaagugaaaauuggaauuucauuggaauucauguauu

SEQ ID NO: 419788 - RNA, 64 nt, Human
uuaaguggucccaaugcucagcgcuuaaaaaaacaaauuggacagcuacuucugggaaaaacaa

SEQ ID NO: 419789 - RNA, 64 nt, Human
uuaacaaaauuagcugaagaaguuauucucaagaaaauuggauguuuucauuggccuucuuaaa

SEQ ID NO: 419790 - RNA, 64 nt, Human
aaguuggaaaaccacugacuagaccaucggcuccaaauuggagucugugcuuccuuccccaggu

SEQ ID NO: 419791 - RNA, 64 nt, Human
cuuuuagaaucauguuuuguuaauccgcuucacuaaauuggaccuucacauaucuaaaaagcuc

SEQ ID NO: 419792 - RNA, 64 nt, Human
ucaguuuggggugcauguaugauuuugcagcgucaaauuggaguaagggaagauuucuguauac

SEQ ID NO: 419793 - RNA, 64 nt, Human
ucuuacuuacuauggguuacauuuuuuauuuuucaaauuggaugauaauuucuuggaaacauuu

SEQ ID NO: 419794 - RNA, 64 nt, Human
gcauuacucuggacuuuauuguccuguuucuaucaaauuggacuaacaaaaauugauauaauac

SEQ ID NO: 419795 - RNA, 64 nt, Human
uuucuguucaaauuaggaauuagggacauggaugaaauuggaaaucuucauucucaguaaacua

SEQ ID NO: 419796 - RNA, 64 nt, Human
gaaauggcaagcccuugugaaggcauggaguuuaaaauuggaaugcaaaaauuagcagacaauc

SEQ ID NO: 419797 - RNA, 64 nt, Human
cauccauguucacuuauggcugguuuugcuauagaaauuggaaaauaaaggccacuuuuuugaa

SEQ ID NO: 419798 - RNA, 64 nt, Human
uacaguugucuugaggguaugauaaguccacaaaaaauuggaaagcaucuuacccauuuucuuc

SEQ ID NO: 419799 - RNA, 64 nt, Human
uuuuccugaagaauuuucuuuaccauuagucuucaaauuggauacuguugugcagugguguacu

SEQ ID NO: 419800 - RNA, 64 nt, Human
aucuuaaaagagcuugcucugucuaccuugacagaaauuggaguuuuaaaauuauguguuaaua

SEQ ID NO: 419801 - RNA, 64 nt, Human
ugcugagacugccucacggugccaccaugcggaccggggggaggcagggagugaggguguggcu

SEQ ID NO: 419802 - RNA, 64 nt, Human
guguagaggcaggcauuauguaggauaagagcuccggggggauucuucaugcaccaguguuuag

SEQ ID NO: 419803 - RNA, 64 nt, Human
agggacagggaccaccucaccgggcaaauggggucggggggacuggggcaccagaccaggcacc

SEQ ID NO: 419804 - RNA, 64 nt, Human
aagcugaauggaaucugacgguugggagugguggaaauuggaaggauaccaggagguauuuggg

SEQ ID NO: 419805 - RNA, 64 nt, Human
aauuaggauaggccagaacccuggccacuguauaaaauuggaaagucucuaagacacaggcaaa

SEQ ID NO: 419806 - RNA, 64 nt, Human
uuugccaagaaggaugagacaaaaggccagacagaaauuggacuuugguuuucagacaugggac

SEQ ID NO: 419807 - RNA, 64 nt, Human
cuucccuggguuuuaaacuucauauaacuuucagaaauuggagagcaaaaauuuugcuugucac

SEQ ID NO: 419808 - RNA, 64 nt, Human
aagucauuuuacauuugcuuuuccaaaauguauuaaauuggaauuuuuuaauccuuuauauaca

SEQ ID NO: 419809 - RNA, 64 nt, Human
uguacaucugcauuaaggugccgaugcagaaggcaaauuggaaacacgcgccagcggcaguggg

SEQ ID NO: 419810 - RNA, 64 nt, Human
uccaggugaagugaccugcuguugagaccgguacaaauuggauuucaggaaggagacuccauca

SEQ ID NO: 419811 - RNA, 64 nt, Human
cagcuauucuggaggcugaggcaggaaucgcuugaaauuggaaagcagagguugcagugagcug

SEQ ID NO: 419812 - RNA, 64 nt, Human
guuguugcuaucugauuucauagcagcagucacuaaauuggaaacaaaagguugcaacgugaca

SEQ ID NO: 419813 - RNA, 64 nt, Human
ggcuuggggaaaauggccaugcaggagguggagaaaauuggaacucuacucaacccauuguugu

SEQ ID NO: 419814 - RNA, 64 nt, Human
gaaagcgcccuucuuauguuaggaggccuuggcaaaauuggauuucuucaaaaauacauguaaa

SEQ ID NO: 419815 - RNA, 64 nt, Human
gcaaauuuuggaaaugcuguucaacagcgcccuuaaauuggaaacaucuuugcagcucguuuua

SEQ ID NO: 419816 - RNA, 64 nt, Human
ugcauuucuaguuaagauggaucuuguaaauuuaaaauuggauuaacauuggagugcuggggug

SEQ ID NO: 419817 - RNA, 64 nt, Human
ugcagcuggaccggcaagcuggcuguguacaggaaaauuggaagcacacaguggacugugccuc

SEQ ID NO: 419818 - RNA, 64 nt, Human
agaucgcaucccacaaugcgagaaugauaaaauaaaauuggauauuugagaaacauugugcuuu

SEQ ID NO: 419819 - RNA, 64 nt, Human
aaucaaucaauaaagaaagauggaaggaagggagaaauuggaauguuuuaacugcagcccucag

SEQ ID NO: 419820 - RNA, 64 nt, Human
ugcuccgaggagggucccagcugcagugugcaugcggggggaacccagguggagccugccagcc

SEQ ID NO: 419821 - RNA, 64 nt, Human
aaguuuaauuauauacaaggagaagggauuuaaacggggggaagaauacaacagguagccauau

SEQ ID NO: 419822 - RNA, 61 nt, Human
aagagaaauaagaauacugcaauuuugugcuggcuuugaacaauuacgaacaauaaugaag

SEQ ID NO: 419823 - RNA, 64 nt, Human
aauaugagggauguguuuuauuaauuggcaguggaaauuggaaugugauuuaaggaagaaaaca

SEQ ID NO: 419824 - RNA, 64 nt, Human
cagauggagaacuuagaaaaccugaagaguacccaaauuggauuguauuuuaauggacaauggc

SEQ ID NO: 419825 - RNA, 64 nt, Human
gauugacguaguaugaaaccuaaaaguauacaggaaauuggacaaauguggauacagcaaguuu

SEQ ID NO: 419826 - RNA, 64 nt, Human
uuuucuuaaaagauaaucuauuuacuguaaaaauaaauuggacuuugcaaaagcuuuuagaagg

SEQ ID NO: 419827 - RNA, 64 nt, Human
gaaaugaauuacaauguaaaguguuccaggaaccaaauuggauuuucuuucuuuugucauugga

SEQ ID NO: 419828 - RNA, 64 nt, Human
agaucaugguucucccuuccucccugaggacaccaaauuggaugagagcaaguuugagagaaga

SEQ ID NO: 419829 - RNA, 64 nt, Human
caagcagaguuguagagggggauaaaaagaaaagaaauuggauguauuuacagcuguccuugaa

SEQ ID NO: 419830 - RNA, 64 nt, Human
aagguauaaauguguaaaaaucucauuauugccaaaauuggauaaaugcccaucuuagcuaaaa

SEQ ID NO: 419831 - RNA, 64 nt, Human
guggaggaggcaccaagugucucaggcagcgaggaaauuggaggccauuuuucagucaauuucc

SEQ ID NO: 419832 - RNA, 64 nt, Human
uaaccaagguuagaugccaguuaaaauuccuuagaaauuggaugagccuugagauugcuucuua

SEQ ID NO: 419833 - RNA, 64 nt, Human
ugguaaaaauagggaucugugaaggaaauuucuaaaauuggauguauuagguuuugaacucuga

SEQ ID NO: 419834 - RNA, 64 nt, Human
gugaagaaaaggugaagagcgaguucccgcaggcaaauuggaugggcgucuggccgccguggag

SEQ ID NO: 419835 - RNA, 64 nt, Human
auauaacaugcuucccauuuuuuuuaugucguagaaauuggaaguuagggaguacugcuuucaa

SEQ ID NO: 419836 - RNA, 64 nt, Human
uuucccagaagcugcugccucuuccugaggcagaaaauuggauuacuaaggcucaaaacuaaaa

SEQ ID NO: 419837 - RNA, 64 nt, Human
ggauucccucagcagccuguguguugugugaaauaaauuggacuugaaacaagaccaccgcgga

SEQ ID NO: 419838 - RNA, 64 nt, Human
auagaaaaggcggaaagguggggaaaagauugagaaauuggaugguugccgugucuguguagaa

SEQ ID NO: 419839 - RNA, 64 nt, Human
ccugccauuugcacgcccggccgggaggcagagacggggggaggggaagccucaccauuucuca

SEQ ID NO: 419840 - RNA, 64 nt, Human
uguuacuucccuuucauaugaggggacccagcgccggggggagggaggagggcgugggcauggg

SEQ ID NO: 419841 - RNA, 64 nt, Human
cuccucgccggccucaguuuaccacgucugaggucggggggacccccuccgagucccgcgcugu

SEQ ID NO: 419842 - RNA, 64 nt, Human
cuuuguaauugugagacauuuucuuggggagggaaaauuggaaugguucccuuuuuuagaaauu

SEQ ID NO: 419843 - RNA, 64 nt, Human
accugcugcccccccaccccaccaccccagggauaaauuggauauaaacacuaaauacuaauca

SEQ ID NO: 419844 - RNA, 64 nt, Human
auaaagcuaaaguccaucaucuggcaaauucaguaaauuggagaguacuugcuucuguuuguau

SEQ ID NO: 419845 - RNA, 64 nt, Human
uuucgaagcagacaacacuauuucaucguguuucaaauuggaaccuugaggcuaguuaguauca

SEQ ID NO: 419846 - RNA, 64 nt, Human
aaacuaaauaaguagagaaaguuuuaaacugcagaaauuggaguggauggguucugccuuaaau

SEQ ID NO: 419847 - RNA, 64 nt, Human
cuguucauugagagaugacaaugaagauuagaugaaauuggaaauaaaccaacauuguuuacau

SEQ ID NO: 419848 - RNA, 64 nt, Human
uguggcccuuccucccccucauugaggacuuaauaaauuggauugaugacaccagccccaaauc

SEQ ID NO: 419849 - RNA, 64 nt, Human
cauccuuccuuuggacccaucggggaaaaagucuaaauuggagauccaguuuuagaagugcuuu

SEQ ID NO: 419850 - RNA, 64 nt, Human
ucucaguaccuacaacuaauguacucugcuuuagaaauuggaacaaggaugguacuaccacaau

SEQ ID NO: 419851 - RNA, 64 nt, Human
ggaguacuuuggaacaguacaaauauauugcuuuaaauuggaagacgcuggaggcacugggaug

SEQ ID NO: 419852 - RNA, 64 nt, Human
aaucaguaagucacuucuaaauuuaaagaaaacaaaauuggaguugaagaauaaguagguuucc

SEQ ID NO: 419853 - RNA, 64 nt, Human
auacccuccuuccaccaaguuggaacauccuuggaaauuggaagagcacaagaggagauccagg

SEQ ID NO: 419854 - RNA, 64 nt, Human
acaauaagggucuuagugcuuuagaaaaaaguuaaaauuggaagucauuaaaaaaagacuguua

SEQ ID NO: 419855 - RNA, 64 nt, Human
cugcaaaguuuguuuauacuuuugccuaaaaaggaaauuggaugggauacuguggcaaaucaua

SEQ ID NO: 419856 - RNA, 64 nt, Human
ucuuuuuuuaaaagaugcgcucuaccugaaaaggaaauuggauuuuagaacuggauguggugca

SEQ ID NO: 419857 - RNA, 64 nt, Human
agaaacuauggaaaacuggaaaauaacuuugaaaaaauuggauaaaguauaggaggguuacuug

SEQ ID NO: 419858 - RNA, 64 nt, Human
cugcuguaaccugcagaccgggcccuuuugggggcggggggaggggaaaauuauuuuauuuuau

SEQ ID NO: 419859 - RNA, 64 nt, Human
ugcaguucuucuccaccuaggaccgccagcagagcggggggaucucccugcccccaccccaguu

SEQ ID NO: 419860 - RNA, 64 nt, Human
gcccaggucuggaccucagcgggagaacuggcuccggggggaguggggcccugcgcuagaggca

SEQ ID NO: 419861 - RNA, 64 nt, Human
ggaaguggcuggaugggacaucuccagacuacaaaaauuggaaagcuggacagccggauaacug

SEQ ID NO: 419862 - RNA, 64 nt, Human
aagauuuccuagauuaaaaucuuaauugauuuugaaauuggauuuuuauuuagaaucaaaauua

SEQ ID NO: 419863 - RNA, 64 nt, Human
ccucaguuccccugugcagaugggcugugaaauuaaauuggagucuugauaagaacauuuuaau

SEQ ID NO: 419864 - RNA, 64 nt, Human
cuggcaacaaccauaugguuguuccauuuucauaaaauuggaaacaaugcaguaauagcuuauu

SEQ ID NO: 419865 - RNA, 64 nt, Human
cuuuuaaagaaacuuggcugcuuaaaauaagcaaaaauuggaugcguaaaguaauauuuacaga

SEQ ID NO: 419866 - RNA, 64 nt, Human
accagggugaugccacuuuugccuccugcccugaaaauuggacuuaagaugccaugucuuggcc

SEQ ID NO: 419867 - RNA, 64 nt, Human
cucccagccccguuuaucagaaacacaggcaaggaaauuggaacugccacccagcccagcaugg

SEQ ID NO: 419868 - RNA, 64 nt, Human
ggcuaaaugcuccaauuaaaagacacagacaggcaaauuggauaaauagucaagacccaucagg

SEQ ID NO: 419869 - RNA, 64 nt, Human
acaaauuaguuuuuacuauuauaaaccuuucuauaaauuggauuauauaucauguauucuuuca

SEQ ID NO: 419870 - RNA, 64 nt, Human
auacaaaugaaacauuguguaauaauauuuauguaaauuggaaugaaaucauuuauaaagaaca

SEQ ID NO: 419871 - RNA, 64 nt, Human
aaacaucauuacuggaaaccuauuaaacauuagcaaauuggagaauaguuuuaauauaguaaau

SEQ ID NO: 419872 - RNA, 64 nt, Human
aagugccuucaaggagcuuacguucuaguuagggaaauuggaugccuucacaaggcucagugac

SEQ ID NO: 419873 - RNA, 64 nt, Human
uuccucuucccauccccaccaccuuguaaguucuaaauuggauuuauucucucgugaggggggu

SEQ ID NO: 419874 - RNA, 64 nt, Human
ggcuggguggggacugcucauuuggccacucugcaaauuggacuugcccgcguuccugaagcgc

SEQ ID NO: 419875 - RNA, 64 nt, Human
gcaggggacucgggggauauacaguggcugcaccaaauuggagguguggguuccuccaacacaa

SEQ ID NO: 419876 - RNA, 64 nt, Human
gcuuuauucacacaaaucaugucuguuggccuggaaauuggaaaaccaguuaaaccaaaaacau

SEQ ID NO: 419877 - RNA, 64 nt, Human
aaaagcaaguaaaagcgcauuccuaaacagaguccggggggaaauguacuguagggaucccucc

SEQ ID NO: 419878 - RNA, 64 nt, Human
ggggaccuccguggcgcggaagacccgagccugccggggggaggccggcggcgccgcaccugcc

SEQ ID NO: 419879 - RNA, 64 nt, Human
ugggaacgagaggggaagaguguacuggggguugcggggggagggauggcggguggggguggaa

SEQ ID NO: 419880 - RNA, 64 nt, Human
aaucccaccccacuccucaucucaccauuuggucaaauuggaagcccagggccaggacccggag

SEQ ID NO: 419881 - RNA, 64 nt, Human
cacuguguuccugaaucaugguuuguauugcccaaaauuggauauaacaaauuuuuaucaauug

SEQ ID NO: 419882 - RNA, 64 nt, Human
ugauagcauuuuacccauaauagaacuucuuucaaaauuggagccaauccucucaaacccugcc

SEQ ID NO: 419883 - RNA, 64 nt, Human
ccuucuccucuuagggccuugugccaagccuaugaaauuggagguggcuuuccugcucuaaagc

SEQ ID NO: 419884 - RNA, 64 nt, Human
aguuagguauuaaacacuucagaauaucaauguaaaauuggaaaauaaggaacugggggcauuu

SEQ ID NO: 419885 - RNA, 64 nt, Human
uguuuguccuucucugccuguugcacaucuuguaaaauuggacaauggcucuuuagagaguuau

SEQ ID NO: 419886 - RNA, 64 nt, Human
aaaacaggggcacacagaaauuugauuuguggccaaauuggaugaaaaagaugaggcucuaagg

SEQ ID NO: 419887 - RNA, 64 nt, Human
gauugccuuguagagguagcaugcacaggaugguaaauuggauugguggauccaccauaucaug

SEQ ID NO: 419888 - RNA, 64 nt, Human
agggaaaagcaaauuucuaauucaccagcaauaaaaauuggaggaggcuuggcccucagcccuu

SEQ ID NO: 419889 - RNA, 64 nt, Human
ccccuggcaggcuaaagugcuguauccuuuaguaaaauuggagguagcaaacacuaaggugaaa

SEQ ID NO: 419890 - RNA, 64 nt, Human
gauccaaucaugacuguagucuuccaugcuugacaaauuggauguagacaacauuacuuaaaac

SEQ ID NO: 419891 - RNA, 64 nt, Human
cuaauuaaauaaauuaaaagagcgguuuguguagaaauuggagagaacuauguuuuauaugaau

SEQ ID NO: 419892 - RNA, 64 nt, Human
uuuuguuuuuaauguagaaaugagacaaggguacaaauuggaacuagaaauugacauugucauu

SEQ ID NO: 419893 - RNA, 64 nt, Human
auugggacugguggugccaagauaaggguuucucaaauuggagaaccccuccuuguugcaugag

SEQ ID NO: 419894 - RNA, 64 nt, Human
ucaaaaaccuugaauaagucucccacaguuguauaaauuggacaauuuaggaauuuuaaacuuu

SEQ ID NO: 419895 - RNA, 64 nt, Human
cucuuuaccuucuuguucuauccaggcccucaacaaauuggaugaggcacuaugcccugggauc

SEQ ID NO: 419896 - RNA, 64 nt, Human
auguacauuauucauauuccucucuguuguguuucggggggaaaagacauuuuagccuuuuuua

SEQ ID NO: 419897 - RNA, 64 nt, Human
gggggcuucagaggguggggggaagauuggggaacggggggaauggucauuuaguuuuacuccu

SEQ ID NO: 419898 - RNA, 61 nt, Human
aaauggauuuaaacauauuucccuguggaggggcuuugaccacgaccuuugaagagcuuca

SEQ ID NO: 419899 - RNA, 64 nt, Human
uaauacaaucuuuuaauucugcucuaaugcuagcaaauuggaaaauguuuaagucuuugacacu

SEQ ID NO: 419900 - RNA, 64 nt, Human
acaagaacaagaugguuugauuucauuaauguugaaauuggauuagucuugauugugugcaugg

SEQ ID NO: 419901 - RNA, 64 nt, Human
gcagagauuccuaaguauuuuauagcagccaucaaaauuggacuuuguauuguuuauucauaaa

SEQ ID NO: 419902 - RNA, 64 nt, Human
uuugguagauuuggccaggagcuuucuuuuauguaaauuggauaaauacacacaccauacacua

SEQ ID NO: 419903 - RNA, 64 nt, Human
uuuugcugucuuuguaauuuuaaaacuuuaaaauaaauuggaaaagggagaaacugagcggugu

SEQ ID NO: 419904 - RNA, 64 nt, Human
ggugacagagugagacccuauuucaaaaaaauaaaaauuggaagaagagcuuaaaaaagauaag

SEQ ID NO: 419905 - RNA, 64 nt, Human
cauuuaaugacuuucccugcuguuaccuaauuacaaauuggauggaacuguguuuuuuucugcu

SEQ ID NO: 419906 - RNA, 64 nt, Human
uuauuuccacugugcagguucccacuuaaaaauuaaauuggaaagcagguuucaaggaaguaga

SEQ ID NO: 419907 - RNA, 64 nt, Human
cccauccaaguuuguucugccaccacuggauggaaaauuggaaauggacugggcgugguggcuc

SEQ ID NO: 419908 - RNA, 64 nt, Human
uagcccacuagucucauauuauuuuccuuuugagaaauuggaaacucuuucuguugcuauuaua

SEQ ID NO: 419909 - RNA, 64 nt, Human
ucuuucccuuuucuugaaaugugguguuugcuguaaauuggauugaauuauuuuucucagagcc

SEQ ID NO: 419910 - RNA, 64 nt, Human
ccaucugaaaguuuugauuugaauguaaaacaggaaauuggaauuccuuuguccaggagaaacc

SEQ ID NO: 419911 - RNA, 64 nt, Human
aaacuaguaucagaacaaaccccgaaacaguaagaaauuggagugagaagggcaugguauuggg

SEQ ID NO: 419912 - RNA, 64 nt, Human
ucaaauaauuuuaagauuacauuaauuuuucuauaaauuggaagauuuauaaauguuugaaauu

SEQ ID NO: 419913 - RNA, 64 nt, Human
aaaaugaaugccaguccagaugugccuagacacgaaauuggagcugaggacucucacgauaugc

SEQ ID NO: 419914 - RNA, 64 nt, Human
auauugccguuacauuuauuagccuguaauuucuaaauuggagauucucuacauuucacuugca

SEQ ID NO: 419915 - RNA, 64 nt, Human
agccaaagcagaagggguaaugacauggacuuggcggggggacaagacaaagcucccgaugcug

SEQ ID NO: 419916 - RNA, 64 nt, Human
gaaagugcuagguguuuuuuaggaacuaggguggcggggggacgaacuucucuuccucacauga

SEQ ID NO: 419917 - RNA, 64 nt, Human
uggcuaaaaauuuuuaauuggauguguuugggggcggggggauggaagugacuuggagaaugug

SEQ ID NO: 419918 - RNA, 64 nt, Human
uacagacauuucugucucaaaaaggagagaauggaaauuggaauggagucuccugucccaauca

SEQ ID NO: 419919 - RNA, 64 nt, Human
aggcuguucaucccagcacugucuaagcuaguaaaaauuggaaacaauuuaaguaucuagcaca

SEQ ID NO: 419920 - RNA, 64 nt, Human
aauucuuugauuaugacuguuuuuuaaacuaggaaaauuggacauuaagcaucacaaaugauau

SEQ ID NO: 419921 - RNA, 64 nt, Human
cagaacugccaaucagggccuaguuucuauuaauaaauuggauaaauuuaauaaaauaagagug

SEQ ID NO: 419922 - RNA, 64 nt, Human
auacuagcaucaguggggaagaaaccuccccaggaaauuggaauuaaagugaaaaaucauucug

SEQ ID NO: 419923 - RNA, 64 nt, Human
uguucuucaaugagaaaucaaauuugagacguugaaauuggagcugcgugcugcugcacucacc

SEQ ID NO: 419924 - RNA, 64 nt, Human
ucuaaucccucccuccucauucucucccuaauaaaaauuggagcucauuuuccacauggcaagg

SEQ ID NO: 419925 - RNA, 64 nt, Human
uucauguaauuuuacgaguuggcaauauuuucuuaaauuggaauacucuaagagaauaggacau

SEQ ID NO: 419926 - RNA, 64 nt, Human
gaaacuggugcugacuucggcagcagguauacuaaaauuggaaugacacagaggagauuagcau

SEQ ID NO: 419927 - RNA, 64 nt, Human
ccaggaauguuuugcagcuuuguacaaguaacauaaauuggacaccucagaaugaaaguucaug

SEQ ID NO: 419928 - RNA, 64 nt, Human
aguuuuguaggaguuauuuagaacaggaaaagguaaauuggaaauuuuaccuagaaauauacau

SEQ ID NO: 419929 - RNA, 64 nt, Human
uuuuuuaaaggacuacagauuauuuuuaaugacuaaauuggagugauacuucuuacacuaaaaa

SEQ ID NO: 419930 - RNA, 64 nt, Human
uuuaaauguaauaaaggccaaaggccucuguaugaaauuggauuuaaacuuucuuauuuuaggg

SEQ ID NO: 419931 - RNA, 64 nt, Human
agggugaggaagacuaauuaaacauggagaaaccaaauuggacaaauccucaccaccaacggug

SEQ ID NO: 419932 - RNA, 64 nt, Human
gagggugaaucaguacacugugaccaagguccucaaauuggaauuugaacaacaauguaaaacc

SEQ ID NO: 419933 - RNA, 64 nt, Human
cccauaacuaaggaaacaucaccuguccaaguucaaauuggaaaccauguugaagagcuccagu

SEQ ID NO: 419934 - RNA, 64 nt, Human
agaaucggaucgcaccacguguggcagccugcggcggggggaggggggccucuuuagcucucuu

SEQ ID NO: 419935 - RNA, 64 nt, Human
uuuggggugggaaaggugaaugccaguggggaugcggggggaugaggguaggagggacuuauag

SEQ ID NO: 419936 - RNA, 64 nt, Human
gucuugugaugagggucuggggagaaagugggcccggggggaccccggaggcugucgguggaug

SEQ ID NO: 419937 - RNA, 64 nt, Human
aaauauuuuuaaaaaauacaauuuagaucucugaaaauuggaaccacucaagaguaucaucuug

SEQ ID NO: 419938 - RNA, 64 nt, Human
uuuguaaagaaaaauauuuaauguugaacaaaauaaauuggaguuggaguagaauguaguuuga

SEQ ID NO: 419939 - RNA, 64 nt, Human
aauacagauguguucauuacauuccccaagggucaaauuggagcuuuuaaagaauuaaagcuuc

SEQ ID NO: 419940 - RNA, 64 nt, Human
acaguggggaggauuagucacacauggagaaaccaaauuggacaaaucaucaccacugauggcg

SEQ ID NO: 419941 - RNA, 64 nt, Human
aggguggggaggacuagucaaacauggagaaaccaaauuggacaaauccucacuaccaauggcg

SEQ ID NO: 419942 - RNA, 64 nt, Human
cuuacauaguugaaauaucaaggaggucagaagaaaauuggacuggugaaaacagaaaaaacac

SEQ ID NO: 419943 - RNA, 64 nt, Human
auucucaggugaacaaacagcuaacugcaucagcaaauuggaauggcuggcuugaaguuuccau

SEQ ID NO: 419944 - RNA, 64 nt, Human
gaaacuguugcugacuucggcagcagguauacuaaaauuggaaugacacagaggagauuagcau

SEQ ID NO: 419945 - RNA, 64 nt, Human
aacaguuuaacaaccauuuaacugcaguguaagaaaauuggacuguaaucauaucgcuacuggc

SEQ ID NO: 419946 - RNA, 60 nt, Human
gagggugaggcuuuguaccccagccccugcccaggccacugugagggugggugcuggcug

SEQ ID NO: 419947 - RNA, 60 nt, Human
gagggugaggcuuugcaccccagccccugcccaggccacugugagggugggugcuggcug

SEQ ID NO: 419948 - RNA, 60 nt, Human
caaagauuuccaagguucccaaagucaaggccaggccaaggccugguuggguccuugggg

SEQ ID NO: 419949 - RNA, 60 nt, Human
ggggcuuccccuucauguggcaccuuugugccaggccaccaggcagacucuucccaccuu

SEQ ID NO: 419950 - RNA, 60 nt, Human
cccaaaaguaggcccucccauuggcuuuggccaggccagacacuucacaucguuuacaug

SEQ ID NO: 419951 - RNA, 64 nt, Human
gggcuggggcaggggccugggccggcgagggggccggggggaggggacagagcugaggauuucc

SEQ ID NO: 419952 - RNA, 64 nt, Human
gcaucucauccuucauuauucucugcauuccuuccggggggagccuguccucagaggggacaac

SEQ ID NO: 419953 - RNA, 64 nt, Human
gcuaccguggaucuccuucccuucucuugggggccggggggaaagaaaaggauuuaagcaaagg

SEQ ID NO: 419954 - RNA, 60 nt, Human
uaagguacagagggguuggcauuucaggaaccaggccaucacagaaacagguucaugggc

SEQ ID NO: 419955 - RNA, 60 nt, Human
gcugcuucucugugcucacugaagggugagccaggccagugcuuccccagccccugggcc

SEQ ID NO: 419956 - RNA, 60 nt, Human
ugcccugcaccagacaggccguggucaggcccaggccaccggccggguucugccacagcu

SEQ ID NO: 419957 - RNA, 60 nt, Human
gagggguaggccugcauccacagagaggauccaggccaaggcacuggcugucaguggcag

SEQ ID NO: 419958 - RNA, 60 nt, Human
cuuguauauccuuaaaccuguacucuauuaccaggccacugugccuguggagcacuguaa

SEQ ID NO: 419959 - RNA, 60 nt, Human
gguguucccuuugcuuggcuggggagccccccaggccagguuugcuggccauagauaccu

SEQ ID NO: 419960 - RNA, 60 nt, Human
cagccuugccgccacacaguuccagcagagccaggccagccuccuccacaugcagaaccc

SEQ ID NO: 419961 - RNA, 60 nt, Human
ggaaggaugggagcccuggagugggcaagaccaggccaccugcugaggucgcuguggagc

SEQ ID NO: 419962 - RNA, 60 nt, Human
ggggcaaaaaagaggcccacaccuugauauccaggccauaccaggguaucccuugucccu

SEQ ID NO: 419963 - RNA, 50 nt, Human; identical to SEQ ID NO: 75628

SEQ ID NO: 419964 - RNA, 50 nt, Human; identical to SEQ ID NO: 75629

SEQ ID NO: 419965 - RNA, 60 nt, Human
agggaugagugaggcccugcagagagcaucccaggccaagguucccacucagccugcccc

SEQ ID NO: 419966 - RNA, 60 nt, Human
cgcuuccccugcccuuugguagugccaggaccaggccaaugaugcuucucaguagccuua

SEQ ID NO: 419967 - RNA, 60 nt, Human
aaaaaaaaaaagaagaagguggaucuccaaccaggccagagaagauucucacagaagguu

SEQ ID NO: 419968 - RNA, 60 nt, Human
gcuuccggaaaagggaacccugcgguacccccaggccaaagcaaguaagcgguuagcacc

SEQ ID NO: 419969 - RNA, 60 nt, Human
gaagcccugccugguccaguccgggggcggccaggccaacugcaagauucuggacuguuu

SEQ ID NO: 419970 - RNA, 64 nt, Human
agcccagccugggggccagagcaccccaggaccccggggggauggcccaggccugcgaggagua

SEQ ID NO: 419971 - RNA, 64 nt, Human
ccugguauuugaccaugcucccuucuccuccauucggggggaaaagugugaaaugaagcuacau

SEQ ID NO: 419972 - RNA, 64 nt, Human
auauacauguauagagagauauauuugugggggccggggggagcggggaggggguggagugaag

SEQ ID NO: 419973 - RNA, 64 nt, Human
ccuacaccuacccauggguggaagcuaaagaguccggggggaaccaagagccugggucccuccc

SEQ ID NO: 419974 - RNA, 60 nt, Human
uaacaccccuuugcuuuuucuaugggaccuccaggccaccauauuuagaacuaguuaccu

SEQ ID NO: 419975 - RNA, 60 nt, Human
gcacccaacuuucuccuuguauuucaaaggccaggccauguacacuaacguccuugaaau

SEQ ID NO: 419976 - RNA, 60 nt, Human
gaucccgaaggagcaagcagucggcagcacccaggccacaggagacuccgcuuuuacuuc

SEQ ID NO: 419977 - RNA, 60 nt, Human
ccaagcgggggcguggcuggccuuucagguccaggccagugggccugguagcacaugucu

SEQ ID NO: 419978 - RNA, 60 nt, Human
aaggagcuuacccaagcuguggcagccgucccaggccacccccauggaagcaauaaagcu

SEQ ID NO: 419979 - RNA, 60 nt, Human
auccaacaugaauuuccagccgaugauaauccaggccaaagguuuaguuguuguuauuuc

SEQ ID NO: 419980 - RNA, 60 nt, Human
gcuugggggcuugacgcccuuccccuugccccaggccaucaucuccccaccucuccuccc

SEQ ID NO: 419981 - RNA, 60 nt, Human
cccuccucucacucccuuccaugccggaacccaggccagggacccaccggccugugguuu

SEQ ID NO: 419982 - RNA, 60 nt, Human
cuggccucuuucuugagguggccaccaggcccaggccaggcccuuugcccaagaagagag

SEQ ID NO: 419983 - RNA, 60 nt, Human
auauuguguaaaaugggugcugccaaaauuccaggccauuuugcagggacucugaaguga

SEQ ID NO: 419984 - RNA, 60 nt, Human
cauucgaaaugcuaugggcucccuggccucccaggccaccaaggacggcaagaaggacaa

SEQ ID NO: 419985 - RNA, 60 nt, Human
uggccacggccacagccacuaaucaggaggccaggccacccugccucuacccaaccaggg

SEQ ID NO: 419986 - RNA, 60 nt, Human
aauggaguaguuuguuauugguagucuacuccaggccaggcaguguguuaugggcugagg

SEQ ID NO: 419987 - RNA, 60 nt, Human
uaguagaggaggauaagggcaaaaccaggcccaggccagugccuggcuuggucuggaugg

SEQ ID NO: 419988 - RNA, 60 nt, Human
gccagccuccucuggacggcaggcucacugccaggccagccuccgagagggagagagaga

SEQ ID NO: 419989 - RNA, 60 nt, Human
augagcaaaugagcuacuuuucccuagacaccaggccagcucucucuuaucugacuucug

SEQ ID NO: 419990 - RNA, 64 nt, Human
acuuuuaaaacagcacuaaauaacuugggggaaacggggggagggaaaaugaaaugaaaacccu

SEQ ID NO: 419991 - RNA, 64 nt, Human
uaaggaagaaucggccagugggccuucgggagggcggggggagguugauuuucaugauucauga

SEQ ID NO: 419992 - RNA, 64 nt, Human
cggcaaaguggcgacucaaccuugggggggggggcggggggagggcgcgaggcuuuuggagcgg

SEQ ID NO: 419993 - RNA, 64 nt, Human
cucccgaacccaggguccugggaacugcagaucccggggggauucagcccuucucccacugugc

SEQ ID NO: 419994 - RNA, 60 nt, Human
uaaaggacaauucucuucauuggugagagcccaggccauuaacaccuacacaguguuauu

SEQ ID NO: 419995 - RNA, 60 nt, Human
gaauccagccgcuuaggcuuugaugaacucccaggccaaaaugaggaguuauugaagcaa

SEQ ID NO: 419996 - RNA, 60 nt, Human
cuccguucccaccucugaggacucuggaccccaggccauaccaggugcuagggugccugc

SEQ ID NO: 419997 - RNA, 60 nt, Human
ccugggaagcagcacagcugagacugggcaccaggccaccucuguugggacccacaggaa

SEQ ID NO: 419998 - RNA, 60 nt, Human
ucugaagccucacuuaugagaugccugaagccaggccauggcuauaaacaauuacauggc

SEQ ID NO: 419999 - RNA, 60 nt, Human
gaccuacgccacggacuaaugcuguugggcccaggccaguccuuguugcuggccuccaag

SEQ ID NO: 420000 - RNA, 60 nt, Human
gacugagucccuucaggcgugcaagcuggcccaggccaaugguuggugugucauggugcc

SEQ ID NO: 420001 - RNA, 60 nt, Human
uucaguagagaccgggucuugccaugcugcccaggccagucucaaacuccuggccucaug

SEQ ID NO: 420002 - RNA, 60 nt, Human
ggcccucagguggagagagcugcgauccauccaggccaagaccacagcucugugauccuu

SEQ ID NO: 420003 - RNA, 60 nt, Human
uuggcugaguggcuuugugugaccguggccccaggccaaggggaucauggcccuggcugg

SEQ ID NO: 420004 - RNA, 60 nt, Human
cuuugccggacuggauggaguggaggaggcccaggccacaguaccaccccaccugcccag

SEQ ID NO: 420005 - RNA, 60 nt, Human
guuucacagugcuguaggggccuacacguuccaggccaguggccaggccuugugccgugg

SEQ ID NO: 420006 - RNA, 60 nt, Human
aggggcaggccugggacccagcuacucuguccaggccacuguggccagagcuggaaggca

SEQ ID NO: 420007 - RNA, 60 nt, Human
cuuaaccccugccaucccaugcugggcccuccaggccaagagucucagcuggccgagagu

SEQ ID NO: 420008 - RNA, 60 nt, Human
ggguccucuggcuauuuggcugagaaggggccaggccaagggccggguggggaugggcac

SEQ ID NO: 420009 - RNA, 60 nt, Human
guucucccaaauaggagaccuggggccuggccaggccaggguuugggccuaauggcuuug

SEQ ID NO: 420010 - RNA, 63 nt, Human
ccagauguuucuauguggauucuguaauguuccuccauacaguuaaaacauccuaacuuguuu

SEQ ID NO: 420011 - RNA, 63 nt, Human
gcccagcccaccccauggccggcuuucaggagcuccauacacacgcugccuucgguacccacc

SEQ ID NO: 420012 - RNA, 64 nt, Human
cccagcuggguugugcuccacugugacgguggcccggggggaggaugccagcagccugccuaug

SEQ ID NO: 420013 - RNA, 64 nt, Human
guucgcgaacccuagcagaggacucagccaccgccggggggagggugaggcggccgggggcauu

SEQ ID NO: 420014 - RNA, 60 nt, Human
ucauuuuagugaugagcugccaguccauucccaggccaggcugucgcuggccauccauuc

SEQ ID NO: 420015 - RNA, 60 nt, Human
ccuguuaccguuaguaccuguguucccucaccaggccauccugucaaacgagcccauuuu

SEQ ID NO: 420016 - RNA, 60 nt, Human
ccagaaacuugucuucuaaaagggaggacuccaggccaucaauaaagauguccaggcagu

SEQ ID NO: 420017 - RNA, 60 nt, Human
uaggacccugcaagcaacucugcucugugaccaggccaggauuccuggagcuggccugag

SEQ ID NO: 420018 - RNA, 60 nt, Human
gcagcugcagggccucgcgcucggcccucgccaggccagccccacuccuuguaccaagug

SEQ ID NO: 420019 - RNA, 60 nt, Human
cccugucugguacccgagaagaaagcagggccaggccagaagcugguguccaacagacac

SEQ ID NO: 420020 - RNA, 60 nt, Human
cagacagcccagcagugugaacacacaaugccaggccaggaacugggaccaccaucuugc

SEQ ID NO: 420021 - RNA, 60 nt, Human
uacuagagcugaaaggcccccuugacacauccaggccaaccucccauggaauagguaggc

SEQ ID NO: 420022 - RNA, 60 nt, Human
gcagcccagggccaagccccgcugccuuccccaggccacagugcguccagucuccugucc

SEQ ID NO: 420023 - RNA, 60 nt, Human
agcaggagugccaggccacagccggaacagccaggccaugacccaggggagccagcgcug

SEQ ID NO: 420024 - RNA, 60 nt, Human
cucccacccuccgugcaccuagcaggagugccaggccacagccggaacagccaggccaug

SEQ ID NO: 420025 - RNA, 60 nt, Human
uaccuuguaaguggauaacuuuucuuuuucccaggccagagaauucaaauuguuaaaaca

SEQ ID NO: 420026 - RNA, 60 nt, Human
guucauaaaacauggacugaugggucugcuccaggccacauuuguuuuuuaacaguaacg

SEQ ID NO: 420027 - RNA, 60 nt, Human
acccggacugcugcccguccucucccugcuccaggccacuaggccucccuugcagccaac

SEQ ID NO: 420028 - RNA, 60 nt, Human
gcuggccuggcauuagucauuauuuaguuuccaggccaaccauccagauagagauucccu

SEQ ID NO: 420029 - RNA, 60 nt, Human
gcgagcccgggggcucgcaggggggauuuuccaggccaggagaaccucguggagacaccc

SEQ ID NO: 420030 - RNA, 63 nt, Human
ccacagccagcgggcuggccucccaccccagcauccauacacguaggccuguugcugagggaa

SEQ ID NO: 420031 - RNA, 63 nt, Human
uuuagaggacaagaaacaaucuguagauugguuuccauacagggaaguucuccguccuaugca

SEQ ID NO: 420032 - RNA, 64 nt, Human
uuuguacucgguuuggaauggggagggaggagggcggggggaggggaggguugcccucagcccu

SEQ ID NO: 420033 - RNA, 64 nt, Human
uugagggaguguuuggggucccaggagacuuggacggggggaguuuggguagacuaggaaagga

SEQ ID NO: 420034 - RNA, 60 nt, Human
agcagacugcaggggaggccaugggauuccccaggccagugucugugcugauccuucaag

SEQ ID NO: 420035 - RNA, 60 nt, Human
cacuuuuugaauggugugccauuuaaaaauccaggccagauccuauuauaaccaacucuc

SEQ ID NO: 420036 - RNA, 60 nt, Human
agaaggucuccuuuuuagcccagcacaggcccaggccacuuugucguguuuguuuuaacu

SEQ ID NO: 420037 - RNA, 60 nt, Human
uucuugggguauaugacuguccuguuucccccaggccacuuuuuuuuuuuuuuucuuuug

SEQ ID NO: 420038 - RNA, 60 nt, Human
cugcccugagcugaguccuuucccugggagccaggccaccuuagaaugggguuuggaagu

SEQ ID NO: 420039 - RNA, 60 nt, Human
cugaccccauugggaacacggaagucuauuccaggccaaccagcccaaaauuauuucauc

SEQ ID NO: 420040 - RNA, 60 nt, Human
gguuuuggagucugagccucaggcucaaauccaggccaagugaucuugggcaaguuaauc

SEQ ID NO: 420041 - RNA, 60 nt, Human
ccuggccuuucaguucuuaacuauuucccuccaggccagaaaguuuucuuugaggaagga

SEQ ID NO: 420042 - RNA, 60 nt, Human
gagagucggccuggacuucccuggggugcuccaggccagagcucuuucauuggggcgagu

SEQ ID NO: 420043 - RNA, 60 nt, Human
ucuuucuucauccccgcauucccaauauacccaggccacaagaguggacgugaaccacag

SEQ ID NO: 420044 - RNA, 60 nt, Human
ucugaguucuuguguccugguaauuccucuccaggccagaauaauuggcaugucuccuca

SEQ ID NO: 420045 - RNA, 60 nt, Human
gucacaucagcaaauauguagucaaggcagccaggccaacuagaccacacuuauuggucu

SEQ ID NO: 420046 - RNA, 60 nt, Human
cacgaaguuggagaaccugacagggcugguccaggccacagaggaugggguuaggcuuca

SEQ ID NO: 420047 - RNA, 60 nt, Human
ccuggcuccugaggcugcggccagcagagcccaggccagggcucuguucuugccacaccu

SEQ ID NO: 420048 - RNA, 60 nt, Human
uccagaacucaggaaugggccugguaggccccaggccagacuaacugggcucaaggggug

SEQ ID NO: 420049 - RNA, 60 nt, Human
aguaccagcucuggcugggguccgugaagcccaggccaggcagccaaaucuugccugugc

SEQ ID NO: 420050 - RNA, 61 nt, Human
caugggauauauccagaggcaaacuuuaugaggcuuugaaaucuugccuuccugaagauag

SEQ ID NO: 420051 - RNA, 61 nt, Human
uaaguccuccuccacagggaacaucuauuugggcuuugauguuuaauaaaguagaaagcac

SEQ ID NO: 420052 - RNA, 61 nt, Human
agucacucuucaguuugggagcugggucuguggcuuugaucagaagguacuuucaaaagag

SEQ ID NO: 420053 - RNA, 60 nt, Human
gaaccgaggggcucaggaaaacgggaccggccaggccaccuccagaaacggccauucagc

SEQ ID NO: 420054 - RNA, 60 nt, Human
ccacccaucugguauggaaaccugccggcuccaggccagacccaggagccaagagaaggc

SEQ ID NO: 420055 - RNA, 60 nt, Human
uggaggaguccuguugccucuccugccccuccaggccacugaguguuuuggccacuugga

SEQ ID NO: 420056 - RNA, 60 nt, Human
cgugaugggccccucagccagggcugccagccaggccacucggguaaggggcugggcagg

SEQ ID NO: 420057 - RNA, 60 nt, Human
gaggaggacagaggcugcugcugcugcaaaccaggccacuugccucaccugcuguccugc

SEQ ID NO: 420058 - RNA, 60 nt, Human
cacagguuggguuugccaaacgccuaauuaccaggccaggaagcaugccaacaaagccac

SEQ ID NO: 420059 - RNA, 60 nt, Human
gguauugauuuccuuuuccagugacuggcuccaggccaugucuaaugaccagcucgauuc

SEQ ID NO: 420060 - RNA, 60 nt, Human
uccacugucuauuuauugcauucccuugccccaggccaccuccucccccucccaccuggu

SEQ ID NO: 420061 - RNA, 60 nt, Human
uacugugucuucugugucacaaacagcacuccaggccagcucaagaagcaaagcaggcca

SEQ ID NO: 420062 - RNA, 60 nt, Human
ccugcccacucucuccccuucauuggcugcccaggccacuggccccaguucucagugucc

SEQ ID NO: 420063 - RNA, 60 nt, Human
cccaggaaauagccuauuaaaaaaugcuguccaggccaggcacaguggcucacaccugua

SEQ ID NO: 420064 - RNA, 60 nt, Human
gccgaguccaggagccccagccagcccuucccaggccagcgaggcgaggcugccucuggg

SEQ ID NO: 420065 - RNA, 60 nt, Human
gcuacuccacugaccuggaagagcuggguaccaggccacccacuguggggcaagccugag

SEQ ID NO: 420066 - RNA, 60 nt, Human
aaguuuugugcccgccugcccccauccccuccaggccacguuuuagauggcccuuguagu

SEQ ID NO: 420067 - RNA, 60 nt, Human
cuaaacccuaaugggaugaggcuuuucaccccaggccaugcugguggugauuuuuuagcc

SEQ ID NO: 420068 - RNA, 60 nt, Human
cccucuucaggcugcugcaggaggccaggcccaggccagagaccccaggcagccugagcu

SEQ ID NO: 420069 - RNA, 63 nt, Human
cuugacuauuguuuuuccuuucuggcgcaugaauccauacaucauuccuggaagugaggcaag

SEQ ID NO: 420070 - RNA, 63 nt, Human
acuccaacucccccugaguguagcagcacacuuuccauacaccagguucuuucuacaauccug

SEQ ID NO: 420071 - RNA, 64 nt, Human
aaugugaaaauacaaaauacccaagauuuaagaccggggggaaaaaaccacaaauugguaaaua

SEQ ID NO: 420072 - RNA, 64 nt, Human
ucuaaccugaaccagccuggcuuuucaaacacuccggggggagguagucccagccucccccgga

SEQ ID NO: 420073 - RNA, 60 nt, Human
ggacucucuggccuucuguggccugcaaugccaggccaugugccccucugcccucuaguu

SEQ ID NO: 420074 - RNA, 60 nt, Human
auaugugcaguaucucauccucccccuguaccaggccauagcuuugaaguguauuuugua

SEQ ID NO: 420075 - RNA, 60 nt, Human
auaucuguuuuuaauguuuuguuucucccuccaggccaguauaaagggacuugaaguauu

SEQ ID NO: 420076 - RNA, 60 nt, Human
uguugugaaugagccugaucauaaaacggaccaggccauucauuauuccucaaguguuaa

SEQ ID NO: 420077 - RNA, 60 nt, Human
cccaggcuggugccccgggagggcuggagaccaggccaugggcccucacggagaggaagg

SEQ ID NO: 420078 - RNA, 60 nt, Human
acccagugccuuccaaaugagcugcaguccccaggccaugagccucccgggaauguuuaa

SEQ ID NO: 420079 - RNA, 60 nt, Human
uugugcgguggggaccggggccggcgggcuccaggccagcacaccuaacccauggaugug

SEQ ID NO: 420080 - RNA, 60 nt, Human
aagaacugcaggcccuggccuccccugccaccaggccaccuccccagcauuccagccccu

SEQ ID NO: 420081 - RNA, 60 nt, Human
ggauccauccagaacagcgguaucugaagcccaggccauacucccugccuccuuucuucu

SEQ ID NO: 420082 - RNA, 60 nt, Human
acucaggaccccgccucuguccucacugugccaggccauagccagaggccacccuguagu

SEQ ID NO: 420083 - RNA, 60 nt, Human
aaacuacugaaugaagcaguauuuugguaaccaggccauuuuuggugggaauccaagauu

SEQ ID NO: 420084 - RNA, 60 nt, Human
acuggacaagggauggcggcagaccaggggccaggccaaagcacuggcaggacucaggug

SEQ ID NO: 420085 - RNA, 60 nt, Human; identical to SEQ ID NO: 75727

SEQ ID NO: 420086 - RNA, 60 nt, Human
cucagaaauuaacaugguaugaagguguuuccaggccaggcgcgguggcucacgccugua

SEQ ID NO: 420087 - RNA, 60 nt, Human
guaaaaguacaacagcuugaaguguugauaccaggccacagcccucuaacucaugugauc

SEQ ID NO: 420088 - RNA, 60 nt, Human
gugcggcauccccuuggcagcugccgucagccaggccagccccagggagcuuaaaacaga

SEQ ID NO: 420089 - RNA, 64 nt, Human
gauugcuucuguaguacuccuuaagaacacaaagcggggggaggguuggggaggggcggcagga

SEQ ID NO: 420090 - RNA, 64 nt, Human
gggagagaaugacuucugccuucaucugcaguaacggggggaccuauacugaccucuuccccag

SEQ ID NO: 420091 - RNA, 64 nt, Human
aggcaguuagggaaacuaggauccagccaaggcccggggggagacccgcauguugcuuggucug

SEQ ID NO: 420092 - RNA, 64 nt, Human
ucugaaccauaaugaaaaucaugaaagaggcuuucggggggaaaaagcuacuugacuuggaggg

SEQ ID NO: 420093 - RNA, 60 nt, Human
ugagaccagcuucuggcaacugccccagcuccaggccaucccauagccccuccucuucug

SEQ ID NO: 420094 - RNA, 60 nt, Human
cuccuaugguucccauaggcacaccuauucccaggccaaggagaguccuuccucuccccu

SEQ ID NO: 420095 - RNA, 60 nt, Human
agcagcugugauguugguaccuggugcagaccaggccaaaguucuggaaagcuccuuuug

SEQ ID NO: 420096 - RNA, 60 nt, Human
ccaggcccauagggcucccacagcugguucccaggccagugagugcugugagaauacagu

SEQ ID NO: 420097 - RNA, 60 nt, Human
ggucuaaguuacucaaaggccauaucuucaccaggccagagauucaguuuuaaaccucag

SEQ ID NO: 420098 - RNA, 60 nt, Human
ugggagcugaaagugaggauacuccgugcuccaggccacagggugaauguggccaugccu

SEQ ID NO: 420099 - RNA, 60 nt, Human
acagcugggcccaccgaggugcuauccugcccaggccagcacuuggcugaguuggguugg

SEQ ID NO: 420100 - RNA, 60 nt, Human
caggacaguguuuucagcacagagcaguggccaggccacccaaaggagcuccgccuggac

SEQ ID NO: 420101 - RNA, 60 nt, Human
ggacuacggcggcaguauggaauuccagugccaggccagugaccucauucccgagcagcc

SEQ ID NO: 420102 - RNA, 60 nt, Human
auugaguggccaaguauggggucauggauuccaggccacaaauuccaggccuaguucagu

SEQ ID NO: 420103 - RNA, 60 nt, Human
uucagucugggggcagggucaguccuucucccaggccagcccuugacauuaaaaaaaaug

SEQ ID NO: 420104 - RNA, 60 nt, Human
uguggcucaguggagggagacccagcauagccaggccaguauggagcaccucacgcacag

SEQ ID NO: 420105 - RNA, 60 nt, Human
gucacuggcccaucucuuugcucuugugccccaggccagaauaaagaauagaguguagag

SEQ ID NO: 420106 - RNA, 60 nt, Human
ugccuaaccaggcccagccaguugguggggccaggccaggaccacacaguccccagacuc

SEQ ID NO: 420107 - RNA, 60 nt, Human
gggugggggcuccugguggccuucugcugcccaggccacagccgccuuuggguuccaucu

SEQ ID NO: 420108 - RNA, 60 nt, Human
cuccucacuauggccccagugccuugaggcccaggccagggcagccaguggcucuagcuc

SEQ ID NO: 420109 - RNA, 64 nt, Human
cccccuguaaucccagcgcuuugggaggccgaggcggggggaucacgaggucaagagaucgaga

SEQ ID NO: 420110 - RNA, 64 nt, Human
ugugaauauguguaacuuuuuuuuaguauuugcccggggggaaaaagauauuguauuaucauau

SEQ ID NO: 420111 - RNA, 64 nt, Human
ucugcuuugcaucccccaaacuucuuguucaaaacggggggaguuuaggagacuuuaaucccgg

SEQ ID NO: 420112 - RNA, 64 nt, Human
uuugcauugggggaggggggagggaccggaugggcggggggagggggagggggaggggugggcg

SEQ ID NO: 420113 - RNA, 60 nt, Human
cucccaaguggccacauacagcaacccacuccaggccauggggaccaccacucaggguuc

SEQ ID NO: 420114 - RNA, 60 nt, Human
uaggugguuugugaaacucacaggugguccccaggccaagaugggcaggugucacaaaga

SEQ ID NO: 420115 - RNA, 60 nt, Human
ugagcaugaccucaauuauuucacuuaaccccaggccauuaucauauccagauggucuuc

SEQ ID NO: 420116 - RNA, 51 nt, Human; identical to SEQ ID NO: 75750

SEQ ID NO: 420117 - RNA, 60 nt, Human
caagaagucacuuaucaccaaggggauggcccaggccauucaugagggauccaccuuugu

SEQ ID NO: 420118 - RNA, 60 nt, Human
gauugagccaggcccccagaaccccuggcuccaggccagggggccagucccugaggcagg

SEQ ID NO: 420119 - RNA, 60 nt, Human
ucuuguagagaugagaucucgcuauguugcccaggccagucucaaacuccuggacucaag

SEQ ID NO: 420120 - RNA, 60 nt, Human
caacugaucaccacuaacucagagccuccuccaggccaaacagccccaaagucaauuaaa

SEQ ID NO: 420121 - RNA, 60 nt, Human
uuagacuuuggagucuuuucucugaagucaccaggccaggggucaggagagagauggauu

SEQ ID NO: 420122 - RNA, 60 nt, Human
aacaagccccuccagaugagugccccggccccaggccagcuucacugccgucucuucaca

SEQ ID NO: 420123 - RNA, 60 nt, Human
agaaccagagcugggaagauggcugggaagccaggccaaagugggggcaacagcuugcuu

SEQ ID NO: 420124 - RNA, 60 nt, Human
gcugugcaagauaaaagcagccugggucacccaggccacaaggccaugguuaauucuuaa

SEQ ID NO: 420125 - RNA, 60 nt, Human
cauggagccccuccaccgggcgcaugccucccaggccaccucagucucaccugccggcuc

SEQ ID NO: 420126 - RNA, 60 nt, Human
ccauaugaccucaugcaucuccaccugcucccaggccaguaagggaaauagaaaaacccu

SEQ ID NO: 420127 - RNA, 60 nt, Human
uuuugagggcuugagaaugggucagggacuccaggccaaguccaacagagaccccaaacc

SEQ ID NO: 420128 - RNA, 60 nt, Human
agcugcugugagcuggccuaccugccugccccaggccaugccugccuuuguuguggggaa

SEQ ID NO: 420129 - RNA, 63 nt, Human
uaccagaugaaaggauaaacaaaaugugguccauccauacaauggaguauuacacagccauaa

SEQ ID NO: 420130 - RNA, 63 nt, Human
cauucuaugaauguaguaauuaaucuauuuugcuccauacaugcaacugcguuggcauuagag

SEQ ID NO: 420131 - RNA, 64 nt, Human
ggaucgugaccgugaccgugaccgcgagcacaaacggggggagcggggcagugagcggggcagg

SEQ ID NO: 420132 - RNA, 64 nt, Human
cagcggcaaguggaaaucgaagaugucauggggucggggggaggcuucugaaagaugacugcgu

SEQ ID NO: 420133 - RNA, 60 nt, Human
gggcugugguccgcucagggucucauuuccccaggccaaguucaaggcagcagcccuuug

SEQ ID NO: 420134 - RNA, 60 nt, Human
gagcuaaccccaagcugccucugggccaugccaggccagagggcaguggcccuccaccuu

SEQ ID NO: 420135 - RNA, 60 nt, Human
ggagaguccaggcccugggaaugggaggaaccaggccacauuccuuccaucgugcccuga

SEQ ID NO: 420136 - RNA, 60 nt, Human
gggggcaucucacagccugacuucccuuccccaggccaggguugcugggaugccugcccc

SEQ ID NO: 420137 - RNA, 60 nt, Human
cacauuuugacacaauguugcacugaaaacccaggccacaaaugugucccagugaacagu

SEQ ID NO: 420138 - RNA, 60 nt, Human
ucuaaaccagggaucagcaaacuauaacccccaggccaaaucuagcccacucccuguuuu

SEQ ID NO: 420139 - RNA, 60 nt, Human
gcagggacuggaggcacccccagcccugccccaggccacagcaggacaggccgggacagg

SEQ ID NO: 420140 - RNA, 60 nt, Human
agacaaucacgggcgguccugcacagauucccaggccagggcugggucacaggaaggaaa

SEQ ID NO: 420141 - RNA, 60 nt, Human
uggccaaagguuggcagauagaggcaacucccaggccagugagcuuuacuugccguguaa

SEQ ID NO: 420142 - RNA, 60 nt, Human
ucagggccgcaccgcccagacuggcucagcccaggccaccaacuucaucgccuuugcggc

SEQ ID NO: 420143 - RNA, 60 nt, Human
cuuucagccaugcugaugaccacaccccguccaggccagacaccaccccccaccccacug

SEQ ID NO: 420144 - RNA, 60 nt, Human
ugaugcuauggcgcuggacccagggcccucccaggccaucucuguuccucuggggugguc

SEQ ID NO: 420145 - RNA, 60 nt, Human
gggccuaggugauggcaguccauguggcugccaggccaaggcagucacaggggcccugac

SEQ ID NO: 420146 - RNA, 60 nt, Human
caggccaaggcagucacaggggcccugaccccaggccacacagacggacaugggcccaca

SEQ ID NO: 420147 - RNA, 60 nt, Human
acggcccugucagagccgccacuccuauccccaggccaggucccuggaccagccuccugu

SEQ ID NO: 420148 - RNA, 60 nt, Human
cccucuuggaaaggaggggcucguguggccccaggccagugucugucaggaugguccccc

SEQ ID NO: 420149 - RNA, 64 nt, Human
cccucuucccagacuaaauucauagccgagagcucggggggaugguagaguuaaaauuuaaaau

SEQ ID NO: 420150 - RNA, 64 nt, Human
cagagugcaggggagggggcaaugguggagguggcggggggaagcagagggaggugggcugagg

SEQ ID NO: 420151 - RNA, 64 nt, Human
ugagaugucaaaaccugggggcccgggggcggggcggggggaggugggugugaagaacgugcuu

SEQ ID NO: 420152 - RNA, 58 nt, Human
cuggauaccagagaaucuaauuguugcccggggggaaugaaaauaauggaauuuagag

SEQ ID NO: 420153 - RNA, 60 nt, Human
cccgcgggaagccagcccgugcaacggaagccaggccaacugccccgcgucuucagcugu

SEQ ID NO: 420154 - RNA, 60 nt, Human
cuaacuacacucuacaagugaacuccuugcccaggccaguuagaaaaucccuuggggaac

SEQ ID NO: 420155 - RNA, 60 nt, Human
gcguuagaagggaucuuagagguagauuauccaggccauccccuacugcuuacauucccc

SEQ ID NO: 420156 - RNA, 60 nt, Human
ugcagcugaagugggccagccuugcaccagccaggccagaccaccauggugaaggcuucu

SEQ ID NO: 420157 - RNA, 60 nt, Human
aucucagugugccccuaccuguucuccccuccaggccaccugucucuguaaaggaugucu

SEQ ID NO: 420158 - RNA, 60 nt, Human
accugaauuuggaaauccgaaauuacuaauccaggccaggugugguggcucaugccugua

SEQ ID NO: 420159 - RNA, 60 nt, Human
ggugcgaaacccuggcagucccaggcagcaccaggccagggguugauuugaaacgugaag

SEQ ID NO: 420160 - RNA, 60 nt, Human
caacacgaucuuguaagauggauuucacccccaggccaaugcagcuaauuuugauagcug

SEQ ID NO: 420161 - RNA, 60 nt, Human
agcccacuggagagaaguuugcuggcuugcccaggccagagcaggaccacagauacugga

SEQ ID NO: 420162 - RNA, 60 nt, Human
auguuuccugacucccaggccccuacuauuccaggccaucacacuggccuguuccggaga

SEQ ID NO: 420163 - RNA, 60 nt, Human
cuccagagaucuauaaagcauauccuuuacccaggccauuccuaucauauaguaagcaga

SEQ ID NO: 420164 - RNA, 60 nt, Human
gaucacuugaggucagaaguuugagaccagccaggccaacauggugaaacuucaucucua

SEQ ID NO: 420165 - RNA, 60 nt, Human
uggccuuucauuuggggugcccuuucacucccaggccaagcccuggagcaaucuucuuca

SEQ ID NO: 420166 - RNA, 60 nt, Human
auagauguugaauuguuuguggggggugugccaggccacgucucguguguccguaugcag

SEQ ID NO: 420167 - RNA, 60 nt, Human
uuuuuuuaagacagaguguugcucugucgcccaggccagagugcagugguaugaucucgg

SEQ ID NO: 420168 - RNA, 60 nt, Human
gauuggccugugcuucagcgaccaggauggccaggccagagcugcagcugggggcucuuu

SEQ ID NO: 420169 - RNA, 64 nt, Human
caauucucuagcauacuggguaugcucacacugacggggggaccuagugaauggucuuuacugu

SEQ ID NO: 420170 - RNA, 64 nt, Human
cugaccgaucccaccucaacagcucccugacucucggggggagaaggggcucccaacaugaccc

SEQ ID NO: 420171 - RNA, 64 nt, Human
gauacguggugcccccggggcugguguuggcagccggggggaggugccugaggguccccacggu

SEQ ID NO: 420172 - RNA, 64 nt, Human
aucccugaccucugccauucacacugacuuagaacggggggaggggguaccagguggccaggug

SEQ ID NO: 420173 - RNA, 60 nt, Human
agcagggagcucacagaaggggagggagcaccaggccagcugagcugcacccacaguccc

SEQ ID NO: 420174 - RNA, 60 nt, Human
cagcugggacuacaggugugcacuaccacaccaggccaauuuuuguuuuuuuuuuuuggu

SEQ ID NO: 420175 - RNA, 58 nt, Human; identical to SEQ ID NO: 75797

SEQ ID NO: 420176 - RNA, 60 nt, Human
agcggagccccagcaggaagggugggccagccaggccauucuuagucccuggguugggga

SEQ ID NO: 420177 - RNA, 60 nt, Human
uuccuuuuuucuuuuuuaagagacagucauccaggccagagugcaguuugaugauagcuu

SEQ ID NO: 420178 - RNA, 60 nt, Human
ggaaaggcuguuauuaccuagaguuuacucccaggccagggggcugccaucuucuucaca

SEQ ID NO: 420179 - RNA, 60 nt, Human
cagaaucaggacuuuaguagagacugaguaccaggccacgggcugcagauccugaaugga

SEQ ID NO: 420180 - RNA, 60 nt, Human
ggguccucagagugggggcuccuuaagccuccaggccagcagcaucagcaucaccuggga

SEQ ID NO: 420181 - RNA, 60 nt, Human
cucaacaagcucacccccaaucccuugcagccaggccacaaugggggaggugaguccagc

SEQ ID NO: 420182 - RNA, 60 nt, Human
cgggacuggccccggggggcccccuggaucccaggccagcgcuuugcucuccugcuccgu

SEQ ID NO: 420183 - RNA, 60 nt, Human
aauaaacuaagauauuccgagggaagggacccaggccaccucccuuccgcaggucugcag

SEQ ID NO: 420184 - RNA, 60 nt, Human
acccccaguuucugcuguuacuugcugccuccaggccaggggagcaggagaugcucagcu

SEQ ID NO: 420185 - RNA, 60 nt, Human
acacuggcucuggaaucuggaauguuaaguccaggccagcagugacaaaaguuauuguaa

SEQ ID NO: 420186 - RNA, 60 nt, Human
aguaaggaagcuaaacuaagacuauacucaccaggccauuuagaaguuuuaaauaaugcc

SEQ ID NO: 420187 - RNA, 60 nt, Human
ugcugggacuacaggcaugagccacuacguccaggccaccucuaccuucuaaccauucuc

SEQ ID NO: 420188 - RNA, 60 nt, Human
uagaucguuuccugacagagaagccuucuuccaggccacuaagguagcauguuauccacu

SEQ ID NO: 420189 - RNA, 64 nt, Human
ugccucacguuagcgggagcgcaccugaagaguacggggggagcccucucucccuuacccucuc

SEQ ID NO: 420190 - RNA, 64 nt, Human
gaagucuagauaucgagccaucccagguguugggcggggggaggguuguggcaagauugucuuu

SEQ ID NO: 420191 - RNA, 64 nt, Human
cuuuuucacugacuuuuuuuguggggggcggggccggggggacucugguaucuaauucuuuaau

SEQ ID NO: 420192 - RNA, 64 nt, Human
ugguggaguacauaugcauagaaacggcuucugucggggggagaguauauaauggaggaaauau

SEQ ID NO: 420193 - RNA, 60 nt, Human
cuauugccacccugcuucuccaagagcagaccaggccaccucauccguaaggacucgguu

SEQ ID NO: 420194 - RNA, 60 nt, Human
ucuggaccaguuucccugcugugcuguggcccaggccagagccugugggcaggcaggcag

SEQ ID NO: 420195 - RNA, 60 nt, Human
uuuauugacaaugaauaaagggcacgaaggccaggccagggccugggccucuugugcuaa

SEQ ID NO: 420196 - RNA, 60 nt, Human
cugcaucuucugaaucaccuggcccagaagccaggccagcagcccgagaccauccuccuu

SEQ ID NO: 420197 - RNA, 60 nt, Human
agugagccgaggcccgcgccgaggaccuggccaggccagccacuccugaagccccgggag

SEQ ID NO: 420198 - RNA, 60 nt, Human
gcgugaggcuggaagauaauacagaaugucccaggccauggcagagcucguuccauucac

SEQ ID NO: 420199 - RNA, 60 nt, Human
ugacaucuaaaacuaaauaaauagaaaacaccaggccagaacuauagucauacucacaca

SEQ ID NO: 420200 - RNA, 60 nt, Human
caaccacugcuuaggccucccaacuucuccccaggccaaguauggggcccuggcuguguu

SEQ ID NO: 420201 - RNA, 60 nt, Human
ugccucauaccucugugcuccacacugcggccaggccagcugagucccuccauccgugga

SEQ ID NO: 420202 - RNA, 60 nt, Human
ucauucccagaaguccacaggacgcacagcccaggccacagccagggcuccacggggcgc

SEQ ID NO: 420203 - RNA, 60 nt, Human
ccuugggaucauaaacaccccagcgucuucccaggccagagaaaguggaagagaccacaa

SEQ ID NO: 420204 - RNA, 60 nt, Human
caugcuggugcccgucuuccuccuaaggggccaggccacauccaagugggccucugucgg

SEQ ID NO: 420205 - RNA, 60 nt, Human
cagucugaauugggucugucuuugagaugcccaggccagcagaaagcagcucagaaguau

SEQ ID NO: 420206 - RNA, 60 nt, Human
ccaguguccuuccaucuucacacugguuugccaggccaauguugcugauggcccccugca

SEQ ID NO: 420207 - RNA, 60 nt, Human
uguugagauuuacaggugugagccaccacaccaggccagagcuauauuuccaaaggcugc

SEQ ID NO: 420208 - RNA, 60 nt, Human
cuuucagagaauugauucagccaucugcgcccaggccacgugucccgaucugggauuaga

SEQ ID NO: 420209 - RNA, 64 nt, Human
ggagaucaagcucauuagcaagacugguggucagcggggggacuuccaucgggcuuagcaccug

SEQ ID NO: 420210 - RNA, 64 nt, Human
gagacaggcacuggcgccagaggcuuccuuggggcggggggagggcaccucagccccugaagac

SEQ ID NO: 420211 - RNA, 64 nt, Human
aggcaggcccccacuucaggcccaaggccuggggcggggggaacagucacugggucucagauuc

SEQ ID NO: 420212 - RNA, 64 nt, Human
gcucugcugacuucugagcaguuuuccaggaggccggggggagcaggaggaggaaagguagccc

SEQ ID NO: 420213 - RNA, 60 nt, Human
auggagagucagcagcuugggcagccacuuccaggccagggugguggcuucucugcagac

SEQ ID NO: 420214 - RNA, 60 nt, Human
caacagcaucugagcaccucucaaguuuuuccaggccagcuccaguuucagugaggagag

SEQ ID NO: 420215 - RNA, 60 nt, Human
uuggacugucuuugaacucugcaccuccuuccaggccaucuugugagacuugguguuaau

SEQ ID NO: 420216 - RNA, 60 nt, Human
gagagggaaggacaccaagcaaaaaauguuccaggccaggauucggauucuugaauuacu

SEQ ID NO: 420217 - RNA, 60 nt, Human
agacagagcaggugcggggaagggaagggcccaggccagacccaucccaaacggaugaug

SEQ ID NO: 420218 - RNA, 60 nt, Human
agugcuaugugucccugcauauaagaaucaccaggccaguguuucuggguuugcuugucu

SEQ ID NO: 420219 - RNA, 60 nt, Human
gguguacgucugcacccaucacccucagcaccaggccacccugcaguccacuuacuguac

SEQ ID NO: 420220 - RNA, 60 nt, Human
auuauguacagaauaggaccuauccaguagccaggccaguaggcaguuggggaagguggg

SEQ ID NO: 420221 - RNA, 60 nt, Human
cugaaaauaaacaaaauccacugaggcuucccaggccauuuaaagccuggaguaccagcg

SEQ ID NO: 420222 - RNA, 60 nt, Human
guccguauccccaacuauuaaggauuugucccaggccaauggugaacaugcugcauuuua

SEQ ID NO: 420223 - RNA, 60 nt, Human
acagugagagcugccuuauauuccuacauuccaggccagaaccagcacaggacugaacac

SEQ ID NO: 420224 - RNA, 60 nt, Human
cacaguggaaggcagaggguuuacuacaggccaggccauggacaccccacccagguacug

SEQ ID NO: 420225 - RNA, 60 nt, Human
aggugugauuugacugguuuuauuuuucucccaggccagaaguauuacuccacuagauca

SEQ ID NO: 420226 - RNA, 60 nt, Human
uuuuuuagagacagggucucacuguaucacccaggccagaguguaguggcacaaucauug

SEQ ID NO: 420227 - RNA, 60 nt, Human
gcccaccgguacugaccagcucccguugggccaggccagcccagcccagagcacaggcuc

SEQ ID NO: 420228 - RNA, 60 nt, Human
gugacaccguucauccccagaucacugaggccaggccauguuuggggccuuguucugaca

SEQ ID NO: 420229 - RNA, 63 nt, Human
ugugguuugagcacuggguucuuuuagccaaauuccauacaaaaagaauuuggauguuuucca

SEQ ID NO: 420230 - RNA, 63 nt, Human
uguacauacacucaggaagguaguacaagauacuccauacaacacaaccaugugcuauuuauc

SEQ ID NO: 420231 - RNA, 63 nt, Human
ucuucaucuuugagaugcuuggccauaacaggguccauacacaucuucugguuuacuauauac

SEQ ID NO: 420232 - RNA, 63 nt, Human
ccccuuucuucuaguggacagaacaugcuguguuccauacagccuuggacuagcaauuuaugc

SEQ ID NO: 420233 - RNA, 60 nt, Human
uacugcuagaaacuucucuaagauaagaggccaggccagucaguuuggcccagcaaacau

SEQ ID NO: 420234 - RNA, 53 nt, Human; identical to SEQ ID NO: 75844

SEQ ID NO: 420235 - RNA, 55 nt, Human; identical to SEQ ID NO: 75845

SEQ ID NO: 420236 - RNA, 60 nt, Human
agagggagaggaggggcugggggugaggggccaggccauggccaaggggccagcugcccc

SEQ ID NO: 420237 - RNA, 60 nt, Human
gcaccuuccccugguuaugacagggagcucccaggccaggccacaugaccccacagguag

SEQ ID NO: 420238 - RNA, 60 nt, Human
uuccccugguuaugacagggagcucccaggccaggccacaugaccccacagguaggcuga

SEQ ID NO: 420239 - RNA, 60 nt, Human
ccaagacacagcagggccaacaaccugugcccaggccagcuucgagcuacaugcaucuag

SEQ ID NO: 420240 - RNA, 60 nt, Human
gucccagcuacuugggcacacgccuguaguccaggccacucgagcacacaccuguaguac

SEQ ID NO: 420241 - RNA, 60 nt, Human
caagugggggccccuuuuccgaagccacuuccaggccaaggcagucgccagggcuucuug

SEQ ID NO: 420242 - RNA, 60 nt, Human
ucugggccuggggugcauccuccucagcccccaggccaggugagguccaccggccccugg

SEQ ID NO: 420243 - RNA, 60 nt, Human
ucguugagcguucggcguggauccacggggccaggccacccugcgggagcgccacacgca

SEQ ID NO: 420244 - RNA, 60 nt, Human
agccuagucccuggaggagggaguccggccccaggccagggacuaaggagcaaugaccau

SEQ ID NO: 420245 - RNA, 60 nt, Human
cuggaacuaauggccccacccccacugggcccaggccaggaggggcccugcccaugccca

SEQ ID NO: 420246 - RNA, 60 nt, Human
auccguuauuauuuccaauggagaccuagcccaggccaagguaaaguuaguuaauagcau

SEQ ID NO: 420247 - RNA, 60 nt, Human
cuggaaaugguuuaccuaaaagcuacagaaccaggccaauauauuuugaaauauugaugc

SEQ ID NO: 420248 - RNA, 60 nt, Human
caagcacugcuaggcgagugccaggacuccccaggccaggccaccaggauggcccuuccc

SEQ ID NO: 420249 - RNA, 63 nt, Human
uuauuugcucagguaucaugcugucuguacaguuccauacaacaaggaggugaaaucagagau

SEQ ID NO: 420250 - RNA, 63 nt, Human
aauuuuuccaguuuccuauuacugaggaaaaccuccauacacugaggcagaaacuugugucag

SEQ ID NO: 420251 - RNA, 63 nt, Human
uaaugacuuguuauagcucagugugcccuugaauccauacaguuucuuaaaagacaauaaaau

SEQ ID NO: 420252 - RNA, 63 nt, Human
uuaaaaaugaaucucguacuguaucuuacuauguccauacagauguuacaaaucgacaguuuu

SEQ ID NO: 420253 - RNA, 60 nt, Human
acugcuaggcgagugccaggacuccccaggccaggccaccaggauggcccuucccacugg

SEQ ID NO: 420254 - RNA, 60 nt, Human
cccaucaucucugccuuugagugugggacuccaggccagcuccuuuucugugaagcccuu

SEQ ID NO: 420255 - RNA, 60 nt, Human
gcuguccugaaaacccuguggaagaagaguccaggccaggucuucauccugcugccaagu

SEQ ID NO: 420256 - RNA, 60 nt, Human
gugguggcguggaagcccugucaccccaccccaggccacccucucccagaggacgccauc

SEQ ID NO: 420257 - RNA, 60 nt, Human
uuuaagagagagacaggcucacucugucacccaggccagagugcaguggcacgaucauag

SEQ ID NO: 420258 - RNA, 60 nt, Human
cucuggaaagucaggcugagaaauccuuucccaggccaggccgcugcgguacacuggaug

SEQ ID NO: 420259 - RNA, 60 nt, Human
cgaugugaacugccccuccccucgcaucccccaggccaccaacggcaguccuucugccuu

SEQ ID NO: 420260 - RNA, 60 nt, Human
aguuucugaagucuucacagcucuuaaaagccaggccaguacugacuguguggugguaaa

SEQ ID NO: 420261 - RNA, 60 nt, Human
uaucuuuggcuucccaaacaguaacucacuccaggccaagugugccuuagcacgagugac

SEQ ID NO: 420262 - RNA, 60 nt, Human
acuaacaaaaugguauaaagaaucucccagccaggccaacauggugaaacccugucucua

SEQ ID NO: 420263 - RNA, 60 nt, Human
aaggcgggcgaguagaugccugggcagggaccaggccagcgcugcaaccuccuucggcuu

SEQ ID NO: 420264 - RNA, 60 nt, Human
gggagauguggaaaagccaagaggcugcagccaggccacuggccccugagaucucugcag

SEQ ID NO: 420265 - RNA, 60 nt, Human
ccagcuagucugggguuuccucucccugccccaggccagaacugccuucuucauuuccac

SEQ ID NO: 420266 - RNA, 60 nt, Human
caccaccaccaccgcgagcuggagcgcgcaccaggccauccagcgugcagccuugccucg

SEQ ID NO: 420267 - RNA, 60 nt, Human
gaggaaaguuuaaucccccauuccaaaaguccaggccaaauggugggcuuagccucuuug

SEQ ID NO: 420268 - RNA, 60 nt, Human
gaucuuaggccucagcaggcagggacccuuccaggccacaguaggcugaagcagcaccag

SEQ ID NO: 420269 - RNA, 63 nt, Human
ucuguuauuaagcccaaugagacaucuagggaguccauacacaucagugagcagauguaguuu

SEQ ID NO: 420270 - RNA, 63 nt, Human
gaagcagugauacucccuggcucgguuauuuucuccauacaaugcacacaugguacaaugaua

SEQ ID NO: 420271 - RNA, 63 nt, Human
auauuugcuauaugcacuggguauaauccguaauccauacacugccagauaaugccauuucaa

SEQ ID NO: 420272 - RNA, 63 nt, Human
aaaaccacuaaguuagaucucuaccucacaguguccauacaaauuaguuccagagggaagaua

SEQ ID NO: 420273 - RNA, 60 nt, Human
ugagaaaagcucaccgcaucagcugguugcccaggccaggaccugaaggguuguguggag

SEQ ID NO: 420274 - RNA, 60 nt, Human
cccugucccucucuucuggcccugugguacccaggccacacguugugcccgcucuugggg

SEQ ID NO: 420275 - RNA, 60 nt, Human
uggagguggcagcuucacagaacuggagaaccaggccaaguccccuccccaaccuaauua

SEQ ID NO: 420276 - RNA, 60 nt, Human
aaaagcguagaggcagaauuagaggccucuccaggccagcuccucugcccacaugucaua

SEQ ID NO: 420277 - RNA, 60 nt, Human
gaacauauuccucagucagcuuuuccauuaccaggccauuuuacuuaaaucuguauuaaa

SEQ ID NO: 420278 - RNA, 60 nt, Human
aucacagacggauacuggggaguaaacggcccaggccaggugcccaggaaaggacggcug

SEQ ID NO: 420279 - RNA, 60 nt, Human
ugugggagccgcagagccugacgcucagccccaggccagcugcggccaggccugcgggcc

SEQ ID NO: 420280 - RNA, 60 nt, Human
cuacacacgauccuggcccuccaccugccuccaggccacgaaaugggaauuccagcacua

SEQ ID NO: 420281 - RNA, 60 nt, Human
gagcugauggcuccgagacuggucaggagcccaggccagugagauggggccuggagccuu

SEQ ID NO: 420282 - RNA, 60 nt, Human
agagaacucuccugggaggcugugggugagccaggccaacauuggugucccuguccccag

SEQ ID NO: 420283 - RNA, 60 nt, Human
aucacugccaugguucaauguucccaggccccaggccauccacuugccggcccccaccag

SEQ ID NO: 420284 - RNA, 60 nt, Human
caggggccaggacuggccccacugcagugcccaggccagucuugagcagcagggagggcu

SEQ ID NO: 420285 - RNA, 50 nt, Human; identical to SEQ ID NO: 75887

SEQ ID NO: 420286 - RNA, 60 nt, Human
cagggucccagacccaggccccagagcagcccaggccaugacccugccgagcacggugug

SEQ ID NO: 420287 - RNA, 60 nt, Human
caagccaggaugcccugugguuguggcgccccaggccaucccaaacccaguggcagagga

SEQ ID NO: 420288 - RNA, 60 nt, Human
gauggaaguuuuugcuacauguuauccaccccaggccagguggaaguaacugaauuauuu

SEQ ID NO: 420289 - RNA, 63 nt, Human
caggcaauuugcuaggcucgggggcggguaguauccauacacuaugcacuacugcucugaagc

SEQ ID NO: 420290 - RNA, 63 nt, Human
cucuuugugacuucgaaaucuuuucaugugccuuccauacaggccauucacuguggucccugg

SEQ ID NO: 420291 - RNA, 61 nt, Human
cuugccgcuggcaugccugaggaauguauuuggcuuugauuacacacuaaguuuuuguaau

SEQ ID NO: 420292 - RNA, 61 nt, Human
agugagcggagugaggugcccuggagaagcaggcuuugaaggcacagcgaagcuguaacug

SEQ ID NO: 420293 - RNA, 60 nt, Human
uguuuaguuacauuaggcuuugcuauauccccaggccaaauagcaugugacacaggacag

SEQ ID NO: 420294 - RNA, 60 nt, Human
agugcugggauuacaggcgugagccaccagccaggccaagcuauucuuuuaaaguaagcu

SEQ ID NO: 420295 - RNA, 60 nt, Human
uccuccccuggggucaggagaggccgagccccaggccacugucacucuuugugggagggg

SEQ ID NO: 420296 - RNA, 60 nt, Human
auuacuuucuuggcagcuuaaguggcgcagccaggccaagcuguguaaguuaagggcagu

SEQ ID NO: 420297 - RNA, 60 nt, Human
ucccucccagcagggaaaccccgcccgcugccaggccauccucucugccagaggcuuuca

SEQ ID NO: 420298 - RNA, 60 nt, Human
cuggccaccagccucccuuucugccugaccccaggccaccccucuucucucccacaugca

SEQ ID NO: 420299 - RNA, 60 nt, Human
gccuggccaccagcuucccucugccugaccccaggccaccugucuucucucccacgugca

SEQ ID NO: 420300 - RNA, 60 nt, Human
agucccaggcagcuggacaucuccaggaaaccaggccaucugggcaggaggccuggggau

SEQ ID NO: 420301 - RNA, 60 nt, Human
gggagugggagggagguggggagagcuagcccaggccaggggucaauguucaugucacua

SEQ ID NO: 420302 - RNA, 60 nt, Human
ucacugggccagucaacggggggcuccugcccaggccacagagaaccugaguucccggga

SEQ ID NO: 420303 - RNA, 60 nt, Human
uuuaguagagacaggauuucaccauguuggccaggccagucucaaacuccugaccucagg

SEQ ID NO: 420304 - RNA, 60 nt, Human
uucccggccgccacugggcccugccggucaccaggccacugugcagugggcgcagagcau

SEQ ID NO: 420305 - RNA, 60 nt, Human
uccccacagugccacccaugcagcugcuccccaggccaccccgcugauggagccccaccu

SEQ ID NO: 420306 - RNA, 60 nt, Human
ugaggggaagccacaggaucggcccgagacccaggccaugcccacuggggacacacugug

SEQ ID NO: 420307 - RNA, 60 nt, Human
gggcuaggaggggccaagccgaagagccacccaggccacaguuccugugccugccuuccc

SEQ ID NO: 420308 - RNA, 60 nt, Human
agcugcuccuugcaggggcgggucaguuucccaggccaugccgggguggccaucuauggu

SEQ ID NO: 420309 - RNA, 63 nt, Human
ucaacaaaacacaaacccugaaggaaaaccuuuuccauacacccaggcuaugcauugaagagu

SEQ ID NO: 420310 - RNA, 63 nt, Human
ggaggguguuuauguaagagcaccuuccucacuuccauacagcucuacgcggcaaauuaacuu

SEQ ID NO: 420311 - RNA, 63 nt, Human
uuaugauauaaaaugauggcuaucaaaugauuuuccauacauuguacugaucaaguuauacac

SEQ ID NO: 420312 - RNA, 63 nt, Human
aaacaaaucuuucuucauuuaugaauuucuuacuccauacaagcaguuuauggaugucugggc

SEQ ID NO: 420313 - RNA, 60 nt, Human
gaugaggacacugagggcggcgucccucacccaggccacgcagcuggugcggcuguucgg

SEQ ID NO: 420314 - RNA, 60 nt, Human
gcucccaccuagugccccagacugagcucuccaggccaggugggaacggcugauguggac

SEQ ID NO: 420315 - RNA, 60 nt, Human
aggcucacugaccuggcucugacgaggaccccaggccacucugagaagaccuuggaguag

SEQ ID NO: 420316 - RNA, 60 nt, Human
ccggagguggagcugggcagcuguggagccccaggccacaggccagucucgcuuggcucu

SEQ ID NO: 420317 - RNA, 60 nt, Human
aggugggggugacacugggaggugggagggccaggccaacuggcugcggccaucacagcu

SEQ ID NO: 420318 - RNA, 60 nt, Human
cagaggcucccagcuggguuggugggacagccaggccagaugaccugauuccagcaaaaa

SEQ ID NO: 420319 - RNA, 60 nt, Human
gacuccaucucccccaccaggcuggucaccccaggccagcgucuguugaaggaugaagca

SEQ ID NO: 420320 - RNA, 60 nt, Human
aaguggcgugaccuuggcucacugcaaccuccaggccagccucagccucccuaguagcug

SEQ ID NO: 420321 - RNA, 60 nt, Human
ugccagcuccuugagagcagugggggugucccaggccagagcagccucuuccucuccugg

SEQ ID NO: 420322 - RNA, 60 nt, Human
cgucugaucguggagcugcggcggcugcacccaggccacgugcugcccgacgaggagcug

SEQ ID NO: 420323 - RNA, 60 nt, Human
auuggccaaauauaaguuggugucguaacuccaggccacagugaguuaugggcaaagcuu

SEQ ID NO: 420324 - RNA, 60 nt, Human
acagggagggcuuaaguuggggauguuugaccaggccaccuccugcaacugcuguuucuc

SEQ ID NO: 420325 - RNA, 60 nt, Human
aggugggaagggccaccaggcccccagcugccaggccagcugaccccagccuuccuggaa

SEQ ID NO: 420326 - RNA, 60 nt, Human
agaugggugggugggugggcagguggccugccaggccaggagugggcuggagcugcugag

SEQ ID NO: 420327 - RNA, 60 nt, Human
gccuggcagaaugcccugccugccugccugccaggccaaggccugcgucucucugcugua

SEQ ID NO: 420328 - RNA, 60 nt, Human
guggcacggcagucucaaugggucagaaacccaggccagcugggcucuaagccuggcauc

SEQ ID NO: 420329 - RNA, 63 nt, Human
ggugugcggucucgauucgcugaauugcccguuuccauacagggucucuuccuucggucuuuu

SEQ ID NO: 420330 - RNA, 63 nt, Human
uuacacaauagcagagaauauaaacugaaaaaauccauacaaauauuaaaaauguggcaaauu

SEQ ID NO: 420331 - RNA, 63 nt, Human
aaagagugaccugcacaaacuuggaauuuuuuuuccauacaacccugacccauuuacuguauu

SEQ ID NO: 420332 - RNA, 63 nt, Human
uuguuucucugugccagaucuucagugccccuuuccauacagggauuuuuuucucauagagua

SEQ ID NO: 420333 - RNA, 60 nt, Human
ccacugacucauucugaacccccuaagcacccaggccagaggcaagaaccugggcuguaa

SEQ ID NO: 420334 - RNA, 60 nt, Human
aagccagucccuccccaccugcccagagcuccaggccagcacagaaauuccugaggccaa

SEQ ID NO: 420335 - RNA, 60 nt, Human
ggcuccagguuucugguugggaagggaaggccaggccaaaagcuccaccggccguauaga

SEQ ID NO: 420336 - RNA, 60 nt, Human
ucugagugguguccucggccccccugauggccaggccaugcaggaaaggccaggggccuc

SEQ ID NO: 420337 - RNA, 60 nt, Human
agaacuugaaacagauucaggccagcccagccaggccaacagcaccuccccgcugggaag

SEQ ID NO: 420338 - RNA, 60 nt, Human
aucugugcuggcgcaggaugaagccacgcuccaggccauggacgagaagcugcggaagug

SEQ ID NO: 420339 - RNA, 60 nt, Human
agccccggccacucccugccaacuccaugaccaggccaccaucuguacccugcuucccaa

SEQ ID NO: 420340 - RNA, 60 nt, Human
aaaaggcucccaugugagucccugugauggccaggccaggggaccccugccaguucucug

SEQ ID NO: 420341 - RNA, 60 nt, Human
acccuugccauugaccguggccaccuggacccaggccaggcccggcccggcgagugguca

SEQ ID NO: 420342 - RNA, 60 nt, Human
cugucaucccgucgccccuuaccccccaccccaggccacugggccccucccacaccaccu

SEQ ID NO: 420343 - RNA, 60 nt, Human
uuucugcaaaguguaugugaccaucauuucccaggccauuaggguugccucacuguagca

SEQ ID NO: 420344 - RNA, 60 nt, Human
gguagccaagcacuuauggaccagaguggcccaggccagcugggcgccuuccucccaccu

SEQ ID NO: 420345 - RNA, 60 nt, Human
acagucccucagcuucacccagcggggcuuccaggccagccuguguccccucccgcaggc

SEQ ID NO: 420346 - RNA, 60 nt, Human
ucuucuagaugugaaaagagggugcagaguccaggccagauagucuuccccacacacuuu

SEQ ID NO: 420347 - RNA, 60 nt, Human
aauccugaauugaggucaugaggaggccccccaggccagacaguccugaaccccucugac

SEQ ID NO: 420348 - RNA, 60 nt, Human
gccccauugcgcagcuccacccauugugccccaggccagcccgcgucaccuacacuuccu

SEQ ID NO: 420349 - RNA, 63 nt, Human
acuucucuuuucuaaacccuuuuccuguucagauccauacaggauuugcaaggguaggaucau

SEQ ID NO: 420350 - RNA, 63 nt, Human
cuacauauuugugguuaagguuagacuauaugauccauacaaauuaaagugagagacaugguu

SEQ ID NO: 420351 - RNA, 63 nt, Human
cacuggaguuaauuagucuuagaaaugugugcauccauacaaaugcacaacauaaagugaaca

SEQ ID NO: 420352 - RNA, 63 nt, Human
caggaucuuccucccuuuucugcuuugaggguuuccauacauugcuguuuucagguucuacaa

SEQ ID NO: 420353 - RNA, 60 nt, Human
caggcaagaucccuaagaggcacccaaugcccaggccaggggggcugcagcccucagccc

SEQ ID NO: 420354 - RNA, 60 nt, Human
cuaagcaaaauucucaucacagaauguagcccaggccaauuuauaacuaaaucucuauuu

SEQ ID NO: 420355 - RNA, 60 nt, Human
ucuaaugugcuucuaguaggcacagggcucccaggccaggccucauucuccucuggccuc

SEQ ID NO: 420356 - RNA, 60 nt, Human
ucucuccuuccuuuccuuccuuuuucucuaccaggccauuuuucaaauuuacaucaaaga

SEQ ID NO: 420357 - RNA, 60 nt, Human
ugaggguggugggaggggaucaccuggguuccaggccauccuugcugagcaucuuugagc

SEQ ID NO: 420358 - RNA, 60 nt, Human
ccugugcuccaagcugcccccggcugcagcccaggccauggacaugugcaccaguaugua

SEQ ID NO: 420359 - RNA, 60 nt, Human
gagacaagcucuuccggagugcucugggagccaggccagggugugagggaggugcagagg

SEQ ID NO: 420360 - RNA, 60 nt, Human
ccaagugagccugccacccuggagugagccccaggccaggaggcuguuccaggaguccug

SEQ ID NO: 420361 - RNA, 60 nt, Human
uuagcuggggcugugcagccaggggcuuacccaggccaguggaggugccacagcccuggg

SEQ ID NO: 420362 - RNA, 60 nt, Human
agagccuccaggcccuaugaugcucccugcccaggccauauccuuuauuccugcugagcu

SEQ ID NO: 420363 - RNA, 60 nt, Human
uuguggaauuaugaguucaugcaaaacucuccaggccaaguaggggucuagccuuuaaug

SEQ ID NO: 420364 - RNA, 60 nt, Human
gggcagugacagagcccagagcaaacagggccaggccagcccaaauccagugaccuccuc

SEQ ID NO: 420365 - RNA, 60 nt, Human
gcguagcugguauuaacaaccguggggacaccaggccacucuuuuucuaccaguuguuuu

SEQ ID NO: 420366 - RNA, 60 nt, Human
ucugggagggguggaggaggcagagggacuccaggccagagggcuguucucacaaccuca

SEQ ID NO: 420367 - RNA, 60 nt, Human
aaauccauugccaagaaacacagucgaagcccaggccaggucgcccugcgcuaccagcug

SEQ ID NO: 420368 - RNA, 60 nt, Human
ccucugcugcaaaggaaucucuugcugaguccaggccaccaaucaggcaaauagcccaua

SEQ ID NO: 420369 - RNA, 63 nt, Human
uacaagugguuuaacaugcauuaucuuacucaauccauacaaaagucuuauggagguguuagc

SEQ ID NO: 420370 - RNA, 63 nt, Human
uucccaauauacaguaaguacgugagccagucauccauacacuaaggccuaguugagaaaaac

SEQ ID NO: 420371 - RNA, 63 nt, Human
gggucaguguccauccaguuuacgcugagucaguccauacagcaagacaccuggcacuuggca

SEQ ID NO: 420372 - RNA, 63 nt, Human
uuacagaauaauagagcagauaauauauagaguuccauacacccacugcaccccauacccuca

SEQ ID NO: 420373 - RNA, 60 nt, Human
cccuaauuggaauuggaaacagaaaauucgccaggccauacugcuggagcccauucagau

SEQ ID NO: 420374 - RNA, 60 nt, Human
aauauagggauaauuacuggcaccugccucccaggccauucugacguguaaccgcauaua

SEQ ID NO: 420375 - RNA, 60 nt, Human
gacacaacuccgggaagccuuugagcagcuccaggccaagguacacccaggggucuugag

SEQ ID NO: 420376 - RNA, 60 nt, Human
uggaccacgggauuuguagccagccagcucccaggccaacgcccaaagcccugaugaccu

SEQ ID NO: 420377 - RNA, 60 nt, Human
cccugagccagggucuccagaaagccccacccaggccaggcauguggcagggguuagagc

SEQ ID NO: 420378 - RNA, 60 nt, Human
gaauauaagugacuacagggcaccugggccccaggccauccagccuuugccuuugagccc

SEQ ID NO: 420379 - RNA, 60 nt, Human
guguugccccucuccuccucacuauucucaccaggccaugggacuuugggggcagugaga

SEQ ID NO: 420380 - RNA, 60 nt, Human
acugagccaguucagucacuagugcgccagccaggccaggagggagugcagagcaugucu

SEQ ID NO: 420381 - RNA, 60 nt, Human
gugucuucugagcucaagccugcuucugggccaggccauugucacuguuaguugaagaaa

SEQ ID NO: 420382 - RNA, 60 nt, Human
uacuagaguucauggauauguuauacugaaccaggccagagcaaacagaaaaagaagguu

SEQ ID NO: 420383 - RNA, 60 nt, Human
uucuaagagccguguucuucauggaauuuuccaggccacuuggcagcuugguuuaccgau

SEQ ID NO: 420384 - RNA, 60 nt, Human
gaggaagggcagagccagaagcaagccgugccaggccaucugccugcucaugggguccua

SEQ ID NO: 420385 - RNA, 60 nt, Human
cucuaaaaacaggacugucccugaugggagccaggccacagggaggaggcuucuuugugg

SEQ ID NO: 420386 - RNA, 60 nt, Human
gaguucuagaaggauggagagugaggggauccaggccauucaccugcauggcuuugcccu

SEQ ID NO: 420387 - RNA, 60 nt, Human
aaacagcagccugccgggcagggagcagccccaggccagagaggccucccgguccagcuc

SEQ ID NO: 420388 - RNA, 60 nt, Human
accuggcagggccagacgcuguaccaucacccaggccagggaugggggugggggucccug

SEQ ID NO: 420389 - RNA, 63 nt, Human
gcuaauaucaacugcauggauuaaaguagucccuccauacauggggaaguguuuggagcaaag

SEQ ID NO: 420390 - RNA, 63 nt, Human
ucaaccaauggcauccagagagggcauggaggcuccauacaaccucuuccacccccacaucuu

SEQ ID NO: 420391 - RNA, 63 nt, Human
uaccagaugaaaggauaaacaaaauaugguccauccauacaauggaguauuacacagccauaa

SEQ ID NO: 420392 - RNA, 63 nt, Human
guguuauaaacauuuaaaaucacauuuuccauuuccauacauaucuuuuuguucaucaguaau

SEQ ID NO: 420393 - RNA, 60 nt, Human
cugccaagccucgccuccuaccacaccacaccaggccaccccagcugcaagugccuuccu

SEQ ID NO: 420394 - RNA, 60 nt, Human
uccagaguuuuccuguccucuagaggcaagccaggccagggagcugggagcgagcaagcu

SEQ ID NO: 420395 - RNA, 60 nt, Human
uuuuguggggagaggggaaggaucagggggccaggccagcagcucgggggccacaaggag

SEQ ID NO: 420396 - RNA, 60 nt, Human
guacaaaccaugugagcccggccggcccagccaggccaucucacguguacauaaucagag

SEQ ID NO: 420397 - RNA, 60 nt, Human
uggcugagugcugggaagggcugagcucacccaggccagcaggugggguaucaucugcuc

SEQ ID NO: 420398 - RNA, 60 nt, Human
cuugguccauaacuggugagcuauggagacccaggccaacaaauuauccccagugauaug

SEQ ID NO: 420399 - RNA, 60 nt, Human
gccauggcuuccaagguggucugcucgggcccaggccaucuuccagguggggugaggcag

SEQ ID NO: 420400 - RNA, 60 nt, Human
uguccucucccaguucauuccuggaaccagccaggccaggcaaccaguggcccccaaagg

SEQ ID NO: 420401 - RNA, 60 nt, Human
uccugugacaccacgccagaucacagggcaccaggccagagauagucuucuuuuuguccu

SEQ ID NO: 420402 - RNA, 60 nt, Human
gacugagaugcaaggucugaccccacaaggccaggccaauguugcucagugaucacuaag

SEQ ID NO: 420403 - RNA, 60 nt, Human
uccgagaaggcgccagugaaggaccagggaccaggccagggugcgggcaggcaucacugu

SEQ ID NO: 420404 - RNA, 60 nt, Human
agcauuccugauggaacacccacuggccagccaggccauggcuucucccgacccucuggc

SEQ ID NO: 420405 - RNA, 60 nt, Human
ggaaggagucacacgguaaaugggcgaaauccaggccaggagccucagagacugaagcag

SEQ ID NO: 420406 - RNA, 60 nt, Human
gugcugccucuuguaggugcuggcuaagggccaggccaggaugaguuuccccauggugaa

SEQ ID NO: 420407 - RNA, 60 nt, Human
gauuuguuuuagcaaacagauggauucucuccaggccaugggauuugggaaccaccaugc

SEQ ID NO: 420408 - RNA, 60 nt, Human
uguguuucagguggaacaggaggaacugguccaggccaggccucauccuccuggacccag

SEQ ID NO: 420409 - RNA, 52 nt, Human; identical to SEQ ID NO: 75987

SEQ ID NO: 420410 - RNA, 63 nt, Human
ucucucuauauauaucuguauaucuuauacauguccauacacagaaacauaauaaacaaucuu

SEQ ID NO: 420411 - RNA, 63 nt, Human
guauuucuuuuuuuuaauaaggaaaaaauaauauccauacagucaagauacauaguaaauggu

SEQ ID NO: 420412 - RNA, 64 nt, Human
ggcaggcacccugggcagagagaugcagugggugcggggggauccuguggcccacagagcugcc

SEQ ID NO: 420413 - RNA, 60 nt, Human
gaguggggggcagggucgggaagggacaugccaggccaggccuggggccccggggccuga

SEQ ID NO: 420414 - RNA, 60 nt, Human
ucuccgcagggcccuguggcucuggcagccccaggccauggcguugccagccucccugug

SEQ ID NO: 420415 - RNA, 60 nt, Human
uaguccagaccacccagguaugggcagcucccaggccagcagcagcagcagccuacgcua

SEQ ID NO: 420416 - RNA, 60 nt, Human
gguaaucccaagaucugugcagccccgccuccaggccacauggggcugggcagcuaccau

SEQ ID NO: 420417 - RNA, 60 nt, Human
gaguuugaggccccuaagcuggcaucaaccccaggccacgcucgcucuuuccuucccucc

SEQ ID NO: 420418 - RNA, 60 nt, Human
uaauaaaacccucugccaggucugggagucccaggccaucugcucaacgcucugugguuu

SEQ ID NO: 420419 - RNA, 55 nt, Human; identical to SEQ ID NO: 75994

SEQ ID NO: 420420 - RNA, 60 nt, Human
ccccacugccagcagcagcaggugauuggaccaggccauucugccgcccccuccugaacc

SEQ ID NO: 420421 - RNA, 60 nt, Human
agaggguucagagugggaggcggggccagcccaggccaggagcgccucaucuucccaggc

SEQ ID NO: 420422 - RNA, 60 nt, Human
uaagaagaacaaguaguugggggcaaggucccaggccaacucccucccuccguucaggaa

SEQ ID NO: 420423 - RNA, 60 nt, Human
uucaacagaagcugugcugccacggcaggcccaggccagccagugcccgaggccaggaag

SEQ ID NO: 420424 - RNA, 60 nt, Human
cagcccuccuugacugugucccagccagcaccaggccagcagccucaucccugccauuca

SEQ ID NO: 420425 - RNA, 60 nt, Human
ccagggaccauuugcccuucccaaaucccuccaggccagaacugacuggagcaggcaugg

SEQ ID NO: 420426 - RNA, 60 nt, Human
cuuuggagacaauuuaccuguauuaggagcccaggccacgcuacacucugcccacacugg

SEQ ID NO: 420427 - RNA, 60 nt, Human
acugucccucucagugccuucucucagcucccaggccaacaguagccaaaccccuagaga

SEQ ID NO: 420428 - RNA, 60 nt, Human
gagugauccccuccagggacacuucccugcccaggccaccucccacagcccuccacuggu

SEQ ID NO: 420429 - RNA, 63 nt, Human
aaaauaaaaaugaaaaaagagcaggcauccauuuccauacaggaacaaaauaggaggcagcac

SEQ ID NO: 420430 - RNA, 63 nt, Human
aaaauggccucaucucauaccauggcuccaccuuccauacaccagccacacggaacuacugug

SEQ ID NO: 420431 - RNA, 63 nt, Human
auuaucugugugugccugggaguccauacaauguccauacaugggugaacucuugaaucgcuc

SEQ ID NO: 420432 - RNA, 63 nt, Human
aacacacacccauuaucugugugugccugggaguccauacaauguccauacaugggugaacuc

SEQ ID NO: 420433 - RNA, 60 nt, Human
ugagaucaagaaaaccuaaucuucugacucccaggccaggauguuuuauuucucacauca

SEQ ID NO: 420434 - RNA, 60 nt, Human
aaaauacugggcagguccaaaaggauaguuccaggccauaggaauggcuuggugcaguua

SEQ ID NO: 420435 - RNA, 60 nt, Human
guuuauaucuucacccuguaaugguugggaccaggccaaucccuucuccacuuacuauaa

SEQ ID NO: 420436 - RNA, 60 nt, Human
gcagaguagcugcuuccuggacgugcgcgcccaggccagugcugugagcaggcggggagg

SEQ ID NO: 420437 - RNA, 60 nt, Human
auccagaacauaugugaguggggccagggcccaggccaggccgcuuuuuuaccccagugg

SEQ ID NO: 420438 - RNA, 60 nt, Human
caggaaacucuuuugaaauaacuuuggugcccaggccaaguagaaugagaugagacugag

SEQ ID NO: 420439 - RNA, 60 nt, Human
ccuggcccuagaacagauccagggcaacguccaggccaaugugccagcuggaggccaggc

SEQ ID NO: 420440 - RNA, 60 nt, Human
cccauucacuucugugauccauuuuaauuuccaggccacaagacaguagugaugcucuga

SEQ ID NO: 420441 - RNA, 60 nt, Human
ucuuuucucuuuccagaaaauagucccuuuccaggccaaggaccugaauucuguuuacuu

SEQ ID NO: 420442 - RNA, 60 nt, Human
ccauguggggccauugguguuaugagccccccaggccacacugcuucucagaaaugagcu

SEQ ID NO: 420443 - RNA, 60 nt, Human
guccuggguuuuggcucuuuaaugauuacuccaggccagcauuuagucguuugagaauug

SEQ ID NO: 420444 - RNA, 60 nt, Human
gggaugcagcuaacugcaguugggucgcccccaggccaacgcuccucucaauccugggcu

SEQ ID NO: 420445 - RNA, 60 nt, Human
ugccugcugcugccugccuuggccugauggccaggccagagugcugccaguccucugcau

SEQ ID NO: 420446 - RNA, 60 nt, Human
cuccccguguuaaucuguaacuugcagcccccaggccaaaguccuuucucacacuccacu

SEQ ID NO: 420447 - RNA, 60 nt, Human
cggcuguggcccuucuguggaugugggagcccaggccaggcagggagcagaugcagggac

SEQ ID NO: 420448 - RNA, 60 nt, Human
auauaucccuagagcaggggaccccaacccccaggccaugggccacacagcaggaagagg

SEQ ID NO: 420449 - RNA, 63 nt, Human
cugagguuauuacuggccguaaggcagaguuaauccauacagaaaccaguguguccaugugcu

SEQ ID NO: 420450 - RNA, 63 nt, Human
acacuaucuuuucaaugaaaaaagcaauaaugauccauacauacuauaaggcacuuuuaacag

SEQ ID NO: 420451 - RNA, 64 nt, Human
acgccuguaaucccagcacuuugggaggccgaggcggggggaucaccugaggucucgaguucga

SEQ ID NO: 420452 - RNA, 64 nt, Human
cucugcauagcauggucugcaccugggagaugggcggggggaggggggcgggcggggugggaag

SEQ ID NO: 420453 - RNA, 60 nt, Human
caacuagcaaaaagaauagccauaagaaaaccaggccaagauugaaaaauguggaucgga

SEQ ID NO: 420454 - RNA, 60 nt, Human
ucaaaugcccccugagugacugcccccagcccaggccagaagaccucccuucaggugccg

SEQ ID NO: 420455 - RNA, 60 nt, Human
gcaggaguuaauagcagaguugaggcggcgccaggccaaggaacaccggccuguuuauga

SEQ ID NO: 420456 - RNA, 60 nt, Human
gucccugagggcagacacagcuccagggacccaggccagcugccacacccccgacacucc

SEQ ID NO: 420457 - RNA, 60 nt, Human
gcgugcagccagcaugugcaguggccaacuccaggccaguggaaaguuacuguguggaua

SEQ ID NO: 420458 - RNA, 60 nt, Human
uucugggggaggaggcaaucgcuguagcugccaggccagccccaucuggaaggagucccu

SEQ ID NO: 420459 - RNA, 60 nt, Human
ccugacucgucugacuguguguggaggaguccaggccauggaggcagaauccuggcccuc

SEQ ID NO: 420460 - RNA, 60 nt, Human
cuggguggaggcgccauccuaaccauccagccaggccacccacaacccgagaaucaggga

SEQ ID NO: 420461 - RNA, 60 nt, Human
cagaaggcugucuggcacccaguguccuagccaggccaaguauaugagaaagguaagucc

SEQ ID NO: 420462 - RNA, 60 nt, Human
gcccgcuccugacccuuaucuucccagagaccaggccaggaaggcccgagauggagagca

SEQ ID NO: 420463 - RNA, 60 nt, Human
guuugggggaaggggauggcuggaugugcuccaggccaugcuggagguacccccgaggca

SEQ ID NO: 420464 - RNA, 60 nt, Human
uacagugggggcaccaagaccccaaagggcccaggccaggagacuguuaaagugaaaagg

SEQ ID NO: 420465 - RNA, 60 nt, Human
ugcuguauuuggaaaccccuucuuuacuucccaggccagcaagcucuucacugaaacugg

SEQ ID NO: 420466 - RNA, 60 nt, Human
aggucuucaccaguuuuacaaugaguuaucccaggccagacgugguagcucacaccugua

SEQ ID NO: 420467 - RNA, 60 nt, Human
ugccccugcccugaauuagggggaaacauuccaggccaacucuagcuccuuucucaagcu

SEQ ID NO: 420468 - RNA, 60 nt, Human
gcccaccugucugccugccccgccuggagcccaggccaguguuguuuccagccucaggcc

SEQ ID NO: 420469 - RNA, 63 nt, Human
ggucccugcgcuuugguauaauauauauacuucuccauacacagaccucugcagaaugcaaaa

SEQ ID NO: 420470 - RNA, 63 nt, Human
caguccucccauauuuuaaaagguguccaaaauuccauacacaagggaaagugaucuagccuu

SEQ ID NO: 420471 - RNA, 63 nt, Human
cagcaccucccaucccauggauacaguggagauuccauacaggccuuacuuagcuccuugcga

SEQ ID NO: 420472 - RNA, 63 nt, Human
uugaaaagacuuuguacucccacuuccuccaaauccauacagugaggaaucagaguguuuaua

SEQ ID NO: 420473 - RNA, 60 nt, Human
uggccacgagcuuuggccuuggucuaccugccaggccaggcaaagcgccuuuacacaggc

SEQ ID NO: 420474 - RNA, 60 nt, Human
ugaccacccugacuguccaaaccugugaccccaggccagggaacggggaggaaaccaaag

SEQ ID NO: 420475 - RNA, 60 nt, Human
aggggacaaagacgugcacucaaccuucuaccaggccacucucaggcucaccuuaaaauc

SEQ ID NO: 420476 - RNA, 60 nt, Human
uucagagggagccagcucuuuauguuggccccaggccaguacuaagcaaauuaaaaagac

SEQ ID NO: 420477 - RNA, 60 nt, Human
ugaaaaaacugaagagauacgugaaugaaaccaggccauagcugucauaaaucuuugacu

SEQ ID NO: 420478 - RNA, 60 nt, Human
aagggaagaccccaguggugggacccuggaccaggccauggaugaaggacaaagaccagg

SEQ ID NO: 420479 - RNA, 56 nt, Human; identical to SEQ ID NO: 76042

SEQ ID NO: 420480 - RNA, 60 nt, Human
acugaaaacuuagccagaguuagguugucuccaggccaugauggccuuacacugaaaaug

SEQ ID NO: 420481 - RNA, 60 nt, Human
agcagcauuggaaggcuggggccgggcaggccaggccaagccaagcagggggccacaggg

SEQ ID NO: 420482 - RNA, 60 nt, Human
uuuauggaaacuaacuuuuuuguuuuuaauccaggccaacauguauguaaauuaaauuuu

SEQ ID NO: 420483 - RNA, 60 nt, Human
gaagcuggggcagaguaugcuacgaagggaccaggccaggccacagggcucuccucccag

SEQ ID NO: 420484 - RNA, 60 nt, Human
uggggcagaguaugcuacgaagggaccaggccaggccacagggcucuccucccagucuuu

SEQ ID NO: 420485 - RNA, 60 nt, Human
uagcccuguugaccugcccgauccagauucccaggccaggcucccgaccccauccaccua

SEQ ID NO: 420486 - RNA, 60 nt, Human
gggaggccaagcaccaguccaucaccccucccaggccagccucuguaaguuggccacacu

SEQ ID NO: 420487 - RNA, 60 nt, Human
cagagggacaugggccauuccaugacgugcccaggccaacgucgcaggacaguugugaaa

SEQ ID NO: 420488 - RNA, 60 nt, Human
guagggaggcagccuccagccugcccaagcccaggccacccuaucgcccccuacgcgccu

SEQ ID NO: 420489 - RNA, 63 nt, Human
uauguauauauauauaguaacuacuuuuuauacuccauacauaacuugauauagaaagcuguu

SEQ ID NO: 420490 - RNA, 63 nt, Human
ugagcaaguggaguagcagaaccaggagccucuuccauacaugaggugaggguugggggacau

SEQ ID NO: 420491 - RNA, 63 nt, Human
acuuuuuaccaagucuguguucuguuuaaucuguccauacaaguuauuacugagaaaguguuu

SEQ ID NO: 420492 - RNA, 63 nt, Human
auuacuguaagaaaauaucacuugucaauaaaauccauacauuugugugaaacuuuguuguuu

SEQ ID NO: 420493 - RNA, 60 nt, Human
ugggccuggggcccagggccaggguggggcccaggccacuggcuccagagcccugcccua

SEQ ID NO: 420494 - RNA, 60 nt, Human
agagguuccugaucuaggccccagaccuggccaggccagccucccugugcgugugcgucu

SEQ ID NO: 420495 - RNA, 60 nt, Human
ucuucuguaccucuccugagugccaacuguccaggccauuugacacaccaucuguuaacc

SEQ ID NO: 420496 - RNA, 60 nt, Human
cacccaccagacaacagccagggcuggaguccaggccacuuucagcugcuccuuucuccg

SEQ ID NO: 420497 - RNA, 60 nt, Human
gucugccggccagagccucucccaucugacccaggccaggcguucccaccucuccuccuu

SEQ ID NO: 420498 - RNA, 60 nt, Human
auucccaaauauuacaacaaguccuugaacccaggccaugugguuagacguugguguuaa

SEQ ID NO: 420499 - RNA, 60 nt, Human
uuuauuccucacucggguuucucuguggcuccaggccaaagugccggugagacccauggc

SEQ ID NO: 420500 - RNA, 60 nt, Human
uccugcuucuccuuguccugccuggaggcuccaggccacacccagcugguggggcugcuc

SEQ ID NO: 420501 - RNA, 60 nt, Human
cuccccgcccagaacugugaauggccugcuccaggccauggcugggggcagggagugagg

SEQ ID NO: 420502 - RNA, 60 nt, Human
cucuuggacagaggaucugggagguggaagccaggccagaggacuuggggaaaaugagau

SEQ ID NO: 420503 - RNA, 60 nt, Human
caggcaagaguguucuuuucuggugauucuccaggccauuuaauacccugcaauguaauu

SEQ ID NO: 420504 - RNA, 60 nt, Human
ggcuggcagggagugguugaggucugggggccaggccacauggcuggagaggaauuucag

SEQ ID NO: 420505 - RNA, 60 nt, Human
ccuggggagccccauguguggcccaccccaccaggccauccccauaccuucugguuugaa

SEQ ID NO: 420506 - RNA, 60 nt, Human
ccccuugacuccagccucgaccgccaggccccaggccagagccacccaaugaacagugca

SEQ ID NO: 420507 - RNA, 60 nt, Human
ucucacaugggcaccaugaaacacuuucuuccaggccaccugagccuucguucuucagcc

SEQ ID NO: 420508 - RNA, 60 nt, Human
gcacaccacugccaggggucagccucgcacccaggccaggcagaagcugugcucugaagc

SEQ ID NO: 420509 - RNA, 63 nt, Human
aacagaaagucugccuguuuaguaaguggcaauuccauacauauuuuagaguuuuuucuaucu

SEQ ID NO: 420510 - RNA, 63 nt, Human
acaagucagguaaaauaaaaucgauucccagauuccauacauuaggagugcaaagacaggauc

SEQ ID NO: 420511 - RNA, 63 nt, Human
auggggguucccacacucgugcauacacacacauccauacacucugacaaucuccacgcuagu

SEQ ID NO: 420512 - RNA, 63 nt, Human
gcaaauuacagaaggaagcuacuuguuuaaaauuccauacacguuugcaguuucuuguacaca

SEQ ID NO: 420513 - RNA, 60 nt, Human
uuacauagaccuuaaaaagagcucacccuuccaggccaaugcugaagacacagcuccgcu

SEQ ID NO: 420514 - RNA, 60 nt, Human
uccgcuugggagccugagaacccaggcuucccaggccagaguguggcuucuuaaacggca

SEQ ID NO: 420515 - RNA, 60 nt, Human
gcaggccauuggagagaaggucuccuuggcccaggccaagauugagaagaucaagggcag

SEQ ID NO: 420516 - RNA, 60 nt, Human
acaaaccuagaugggacaccuaugacccacccaggccagaugguacagccuguugcuccu

SEQ ID NO: 420517 - RNA, 60 nt, Human
cugcacagcuggccaccauggcacccugcaccaggccaucagcaccacgugccaaggagc

SEQ ID NO: 420518 - RNA, 60 nt, Human
gaaggaaaaguagagaaagaaaugccaauuccaggccaaagcguuauuugccaaguuuuc

SEQ ID NO: 420519 - RNA, 60 nt, Human
guuggucaacagaucuggugagggaaguccccaggccagacgcuggacuccugcaaugag

SEQ ID NO: 420520 - RNA, 60 nt, Human
ccuuggacgcugcagcccccuccucaacggccaggccagagucugagacaggacccaggc

SEQ ID NO: 420521 - RNA, 60 nt, Human
uugagacagaaucucaucacacucugucacccaggccaaguucaauggugcaaucuggcu

SEQ ID NO: 420522 - RNA, 60 nt, Human
cuggcuugagaugaguugaaaauaacuucgccaggccaguguguagaacagcugguccaa

SEQ ID NO: 420523 - RNA, 60 nt, Human
ccaucaaacaggagugugcgcuauggaaaaccaggccagagggucacugucugguuugug

SEQ ID NO: 420524 - RNA, 60 nt, Human
gggcagaaacacucaaguugauuagaaagaccaggccaaugucaggguaccuggggccaa

SEQ ID NO: 420525 - RNA, 60 nt, Human
aucgugaugggccacucgguccaaaaucagccaggccaucuuuuccaucaucucacuuca

SEQ ID NO: 420526 - RNA, 60 nt, Human
caggccagcuacggauuuugcacuuuugcuccaggccacuuguguguguaugugugugug

SEQ ID NO: 420527 - RNA, 60 nt, Human
ggaagcuauuccuggcuuuuccacuccaacccaggccacccuuugucucugccccagagu

SEQ ID NO: 420528 - RNA, 60 nt, Human
gaguggcuuagugugacacacaggcaucucccaggccaagcacacacaggcugcgcccag

SEQ ID NO: 420529 - RNA, 63 nt, Human
uuugcaugauacacaagcaccaauaaagacuaauccauacacaguuaaccuaaugccaaauaa

SEQ ID NO: 420530 - RNA, 63 nt, Human
agaaaguagauauuuccaucaaagccaaagcaauccauacaccaagaacuuguuaccaagaau

SEQ ID NO: 420531 - RNA, 63 nt, Human
aauaaaaaucaagaagaacacuuuucucccuuuuccauacaaauuaaaacuuaacagcaucaa

SEQ ID NO: 420532 - RNA, 63 nt, Human
gucaaagaccuaagucuguaagcuggugccauguccauacaccaugucacuuuacucuucauu

SEQ ID NO: 420533 - RNA, 60 nt, Human
acccggugcccucuccuugccagcuucuccccaggccagagcggccaucgcguagaaaga

SEQ ID NO: 420534 - RNA, 60 nt, Human
uguggucaccucaguccagcucuggggccuccaggccauguggcuguucccacggcccag

SEQ ID NO: 420535 - RNA, 60 nt, Human
ccuaaaggccacacccuccccacgcacuucccaggccagaauccaaacaucgggaacccu

SEQ ID NO: 420536 - RNA, 60 nt, Human
gggcucgagcuggacacuccuggcuggacgccaggccagugccgccuacguggagacugu

SEQ ID NO: 420537 - RNA, 60 nt, Human
gcugggcaucccugugccugucccuggcggccaggccauugccuucccacuaugcagcca

SEQ ID NO: 420538 - RNA, 60 nt, Human
ucucugcagguuuggacuugcuaacaggauccaggccaggcugugguuuccccugaacca

SEQ ID NO: 420539 - RNA, 60 nt, Human
ucacaggugacucagcagugacccugugugccaggccagauccaaacugagagggaaggu

SEQ ID NO: 420540 - RNA, 60 nt, Human
uuuguagagauggggaucuccuuauguuguccaggccagucuugaacucuugggcucaag

SEQ ID NO: 420541 - RNA, 60 nt, Human
guugcucccccgccacccaccuccuccuccccaggccacccaacuugggcaccucccugg

SEQ ID NO: 420542 - RNA, 60 nt, Human
gggcuuucuggcccccucccacucccguuuccaggccaugaccacucugcccuguccugg

SEQ ID NO: 420543 - RNA, 60 nt, Human
caugguccucacacccagcucccugcacacccaggccagccaccccucccgcucgugcac

SEQ ID NO: 420544 - RNA, 60 nt, Human
ccagcuuccccugggguucaccccuggcugccaggccacugaggaugggcaggggucucu

SEQ ID NO: 420545 - RNA, 60 nt, Human
uucucugaaggacauugcggacagccacggccaggccagagggagugacagaggcagccc

SEQ ID NO: 420546 - RNA, 60 nt, Human
cccucuccaaagggucgggaggguagcucuccaggccagagcuuguguccuucaacagag

SEQ ID NO: 420547 - RNA, 60 nt, Human
cccauaacagugcagugauagucagcugguccaggccaggcaaggggcugguccaugaug

SEQ ID NO: 420548 - RNA, 60 nt, Human
uaaugaggcugacuggauguccagagcuggccaggccacugggcccugagccagagacaa

SEQ ID NO: 420549 - RNA, 63 nt, Human
gaggcugugcuccgccauggugucccgguaccuuccauacacagaggagugcagccuucucca

SEQ ID NO: 420550 - RNA, 63 nt, Human
ggccaaggaaauauuuugugaugguguucuggguccauacaccagcaaugaaggagauagauu

SEQ ID NO: 420551 - RNA, 63 nt, Human
ggucagcaccauguaccaggaauagcuuuacuuuccauacauagaaauauaaauuuaguggua

SEQ ID NO: 420552 - RNA, 63 nt, Human
guuuaccaaucaacagcaugucuacugcuuggauccauacaaaacuaucgguucaaguugaug

SEQ ID NO: 420553 - RNA, 60 nt, Human
guugaagcucuggugacaccagccuuucucccaggccaggcuccuuccugucuuccugca

SEQ ID NO: 420554 - RNA, 60 nt, Human
uguggggcugcccuggggcccgugcccccaccaggccagccccugcuggguucagaggcc

SEQ ID NO: 420555 - RNA, 60 nt, Human
aggguccuugcaauuccagcgaaucggaggccaggccaggacguccuugcucccugcacc

SEQ ID NO: 420556 - RNA, 60 nt, Human
agaagcucugugccuggucuguaacaguuuccaggccagcuggagaauguucacugguuc

SEQ ID NO: 420557 - RNA, 60 nt, Human
gcagcuuuccccaugucucgacucauccauccaggccauuccccgucucugguuccuccc

SEQ ID NO: 420558 - RNA, 60 nt, Human
uuccuuuguuggagucaacuguugaugcuuccaggccaaacuggcuuccucuccuccucu

SEQ ID NO: 420559 - RNA, 60 nt, Human
ugaugcuucuucagagacuccugcaggcagccaggccacaagacccuuguggucccaccc

SEQ ID NO: 420560 - RNA, 60 nt, Human
gcucagguggugggugcucagggcccugccccaggccacugggccguuuugaugaccucg

SEQ ID NO: 420561 - RNA, 60 nt, Human
cugccuguggcccccgagcccggcccagccccaggccagucagccgcagacuuuggaaag

SEQ ID NO: 420562 - RNA, 60 nt, Human
gaccuggguggccucgcuuacuguuccagcccaggccaagcacagggucuggcucguggc

SEQ ID NO: 420563 - RNA, 60 nt, Human
uuaggaagagccuuccacccaggggcagccccaggccaaaggggaccuggaagggaggug

SEQ ID NO: 420564 - RNA, 60 nt, Human
gggccauagggagggagauucgcuacggauccaggccauuccugggugagcccuugggca

SEQ ID NO: 420565 - RNA, 60 nt, Human
cugggccuggggacccaaacccccugcagcccaggccagucagacgccaggcaccacagc

SEQ ID NO: 420566 - RNA, 60 nt, Human
ugcaggcucugccaugcacgcaccucacugccaggccauuaaaaucagcacccagcaugc

SEQ ID NO: 420567 - RNA, 60 nt, Human
gaucaccugaggccaggaguuggagaccagccaggccaccauggugaaacccugucucua

SEQ ID NO: 420568 - RNA, 60 nt, Human
guaagguuuuuaucuuauaugccagaggcaccaggccagaugugccgcacagucauguaa

SEQ ID NO: 420569 - RNA, 63 nt, Human
uuugaggccaaugcugcuuucugguguauauucuccauacaagauuauuauuaacugcucuuu

SEQ ID NO: 420570 - RNA, 63 nt, Human
caaugcugacauaaugagauguuguagacuguuuccauacaugggcuuaagaaguuggacaga

SEQ ID NO: 420571 - RNA, 63 nt, Human
ugaaaaacuggaaauaauucguuuccauaucuuuccauacauccauuucugaaguauucagga

SEQ ID NO: 420572 - RNA, 63 nt, Human
augggccagaugguaaauauuuaugcuucacgguccauacagucucugucacaacuauucagu

SEQ ID NO: 420573 - RNA, 60 nt, Human
cuucucuucugugggucuguaccagguacuccaggccagcccaugggcccggggccugac

SEQ ID NO: 420574 - RNA, 60 nt, Human
cagcugugcaugcucagcccugccgaggucccaggccaggcuuuguugcuuccguucaug

SEQ ID NO: 420575 - RNA, 60 nt, Human
ccagcugucaaaaguauuucaagauaaaauccaggccaagcaaagccuuuaaguucccgu

SEQ ID NO: 420576 - RNA, 60 nt, Human
cacugcaugauccgcucuggucaaacccuuccaggccagccagaguggggauggucugug

SEQ ID NO: 420577 - RNA, 60 nt, Human
accccagaggccuugucauccucccuugccccaggccagguagcaagagagcagcgccca

SEQ ID NO: 420578 - RNA, 60 nt, Human
cagccacguggaagcagggcauguagcaggccaggccacgggcuugcagcuccucugagg

SEQ ID NO: 420579 - RNA, 60 nt, Human
ccaauacacacaaauuuuuuaaucccaugaccaggccacggucaaggcuguuuuugagua

SEQ ID NO: 420580 - RNA, 60 nt, Human
cuguccugaguagggguugugcucauuaccccaggccagugguagcuuccucaggagccu

SEQ ID NO: 420581 - RNA, 60 nt, Human
gugggaaagccacggcaggcagcgagcagcccaggccagcuuucugcauggauggucagu

SEQ ID NO: 420582 - RNA, 60 nt, Human
cuucagccagggcauuggaggggagcaggcccaggccaaguuugacagcugccuuucuga

SEQ ID NO: 420583 - RNA, 60 nt, Human
ccaugagaaggagaguucaggggucccaaaccaggccauccuagaccagccagcuccagc

SEQ ID NO: 420584 - RNA, 60 nt, Human
ucggaccuccgccucugcccgggagaaagcccaggccagccugcuggacaagcagagacc

SEQ ID NO: 420585 - RNA, 60 nt, Human
acgcacaggagagagcugaagguggguggcccaggccagggugugaacuuucucccaugg

SEQ ID NO: 420586 - RNA, 60 nt, Human
gaucucauggguacaggaggccagcagggaccaggccagucagccaugcucaggaccccu

SEQ ID NO: 420587 - RNA, 60 nt, Human
uucccuaucaggcuugggcauaggggugugccaggccacuuugguaucagaaauugccac

SEQ ID NO: 420588 - RNA, 60 nt, Human
cgggcucuucuggaccuugcaccguggauaccaggccaugugccaugguauuuggguccu

SEQ ID NO: 420589 - RNA, 63 nt, Human
cagguguuugccaugugguaccuacauagaaucuccauacaacacacagguaacagguuauac

SEQ ID NO: 420590 - RNA, 63 nt, Human
aucagaagacagcucaggccaaguuuugaucguuccauacaguaccuuguuuaucugcuucuu

SEQ ID NO: 420591 - RNA, 63 nt, Human
gaaaucuuccucgucaguggucaaggugugucauccauacagcuccaugccuuugucuuuuuu

SEQ ID NO: 420592 - RNA, 63 nt, Human
ucacaggaaggaggagccgaccgggaauaaccuuccauacauuuuuuucuuugucuuaucugg

SEQ ID NO: 420593 - RNA, 60 nt, Human
cucagggcaaagaaguggccuccuggggggccaggccacgagggccagggcuucugccug

SEQ ID NO: 420594 - RNA, 60 nt, Human
cuuugcuuaccaaaagcucagggcccugugccaggccaaagauccccccagacccccauu

SEQ ID NO: 420595 - RNA, 60 nt, Human
gcaaaacccagaagauguauucagagccacccaggccacugaccucccacuuuggggaac

SEQ ID NO: 420596 - RNA, 60 nt, Human
ggggccccauucaccuggaggcaucucaggccaggccaugccaggcucagccacugccca

SEQ ID NO: 420597 - RNA, 60 nt, Human
accagggaagaucuaacauuugagucccuuccaggccaucagaggccuagucagccacau

SEQ ID NO: 420598 - RNA, 60 nt, Human
gucuuucccagucagccagggagcuccccgccaggccacgccccagccacuuugcucccu

SEQ ID NO: 420599 - RNA, 60 nt, Human
gucucagcguagggcaggaggcccuccuggccaggccagcagugaagcaguauggcuggc

SEQ ID NO: 420600 - RNA, 60 nt, Human
cuucacccugaacauuuaguacccugcaggccaggccagcuuccccucacuuaaccaccc

SEQ ID NO: 420601 - RNA, 60 nt, Human
ucucuccaccgccucaguguagggaaggguccaggccagggaaggagcacccucuagugg

SEQ ID NO: 420602 - RNA, 60 nt, Human
agcugggugggugucaucagccccugccucccaggccagaaccugagaacgggcccaggg

SEQ ID NO: 420603 - RNA, 60 nt, Human
gugggggccuugcccauuugaccauguggcccaggccaaagcccaguguuggccuuacgc

SEQ ID NO: 420604 - RNA, 60 nt, Human
aucugggugacccggggcaggccacagaggccaggccagggcuggaaggacaggccugcc

SEQ ID NO: 420605 - RNA, 60 nt, Human
ugucuugacagauugaccaucugucuccagccaggccaccccuuuccaaaauucccucuu

SEQ ID NO: 420606 - RNA, 60 nt, Human
agagucuguuuuuccauccaaauauaagccccaggccauuccacuuagugucuuuucaau

SEQ ID NO: 420607 - RNA, 60 nt, Human
auaucuugaccgagggcuugcagugcaaagccaggccaguguugcgcauuacuuacaaua

SEQ ID NO: 420608 - RNA, 60 nt, Human
ccccgcaggacccauggagcuaugaccacaccaggccauucaaauggcucugcauuaucu

SEQ ID NO: 420609 - RNA, 63 nt, Human
augguaaauauaaaacuccagagguuguucuacuccauacaguucacacugauugugacacau

SEQ ID NO: 420610 - RNA, 63 nt, Human
aaguauauaucgggaccggcagaaauggaaguauccauacauuuuuaaaaagcaacaaguuug

SEQ ID NO: 420611 - RNA, 63 nt, Human
uccuaugauugauuuuuuaaaaucaugcucuuuuccauacaucaacauaaacagucuuuggau

SEQ ID NO: 420612 - RNA, 63 nt, Human
guagcuaugugcugcugcugcucaagagcuggauccauacagguugugugucaucuguccucu

SEQ ID NO: 420613 - RNA, 60 nt, Human
gcgcauuacccacuuguggccaaucaguggccaggccaaccuuggcuaaauggagcagcg

SEQ ID NO: 420614 - RNA, 60 nt, Human
cacccccaccaccuguccccacccagugucccaggccacaggagcuuauuggccaggagg

SEQ ID NO: 420615 - RNA, 60 nt, Human
cagugaccaacagacaggcagcuggguuucccaggccaucccucuguugccaucagcuug

SEQ ID NO: 420616 - RNA, 60 nt, Human
uugaaggaaaugaguggccagcgccagggcccaggccauguggccugcccagccucaaug

SEQ ID NO: 420617 - RNA, 60 nt, Human
ccucgcuuuuggggggggggucucucacccccaggccacauagggccagugguagggguu

SEQ ID NO: 420618 - RNA, 60 nt, Human
cgcggacggacccugccuccccagcuuaucccaggccagaggcugcaugccacugucccc

SEQ ID NO: 420619 - RNA, 60 nt, Human
cgugucagauagcggcgugacccgggcccaccaggccacggccgccugcuguacauagug

SEQ ID NO: 420620 - RNA, 51 nt, Human; identical to SEQ ID NO: 76155

SEQ ID NO: 420621 - RNA, 60 nt, Human
uccugaccagccgugggaauggcugggcugccaggccagacacgcuagguucuuccaaag

SEQ ID NO: 420622 - RNA, 60 nt, Human
cugcgccuccacagggaaaaggcaaggcuuccaggccaguuggcccaggccccuggcagu

SEQ ID NO: 420623 - RNA, 60 nt, Human
aaccugaguaugagaauguuguacccaucuccaggccaccagaacccugaugaccuugaa

SEQ ID NO: 420624 - RNA, 60 nt, Human
acccaccagcuccacacauuccagccaggcccaggccagcccccccacccacccccaggc

SEQ ID NO: 420625 - RNA, 60 nt, Human
uccauagggaaaggcuucucuccaagugugccaggccaggacagcccucccagccaugaa

SEQ ID NO: 420626 - RNA, 60 nt, Human
gccguaugaucuguguggauggcaaacuccccaggccauucugggaccuaaguuuaagaa

SEQ ID NO: 420627 - RNA, 60 nt, Human
ucgauuucacuagaugucucacucaucagaccaggccauugggccuaagugguaaaugug

SEQ ID NO: 420628 - RNA, 60 nt, Human
ugggguuucuuagugagccccccggaggguccaggccacguccuuggucaccuccccagc

SEQ ID NO: 420629 - RNA, 63 nt, Human
ggaggcucuugaugaucccaggucuccucgaccuccauacaccacacaggcauuuguaagcac

SEQ ID NO: 420630 - RNA, 63 nt, Human
cuggaaaaauacucagcaaacaaaguuaccaauuccauacagagaugaucugguaucuucuuu

SEQ ID NO: 420631 - RNA, 63 nt, Human
uccagaagaaucugauaucaucauagugaagacuccauacagacacaugaaugaauuauauug

SEQ ID NO: 420632 - RNA, 63 nt, Human
gggggugaagcugucaaugccaccaguuggaccuccauacauucugagcuaacccagaaucuu

SEQ ID NO: 420633 - RNA, 60 nt, Human
ccucugggcaguccaaccacuucccuguuuccaggccagugaucuacuucuuuuucacua

SEQ ID NO: 420634 - RNA, 60 nt, Human
caucgugggugaggguauccccugugugucccaggccaauaaaaucuaccugccacugcc

SEQ ID NO: 420635 - RNA, 60 nt, Human
cagcacagcgugggguccuggcacugcaggccaggccaggaugcccaccccgcccucuac

SEQ ID NO: 420636 - RNA, 60 nt, Human
cuuccgagaugaccgcuacuggcgccucgaccaggccaaacugcaggcaaccaccucggg

SEQ ID NO: 420637 - RNA, 60 nt, Human
uccucaccgcaggagccucugaagcucccaccaggccagcucuccucccacaacagcuuc

SEQ ID NO: 420638 - RNA, 60 nt, Human
uuuuccuguuucguuuuuagguccuccaagccaggccaugugggcuuuaggggauaagau

SEQ ID NO: 420639 - RNA, 60 nt, Human
aacaggggagagugugguguuuccugcaggccaggccagcugccuccgcgugaucaaagc

SEQ ID NO: 420640 - RNA, 60 nt, Human
gauacaguugaucagaccccugcccaccgcccaggccaggccuguggucaucaaugcccc

SEQ ID NO: 420641 - RNA, 60 nt, Human
aauacgguggggguagggggcuggaggagcccaggccaggacucugcagccucagagaca

SEQ ID NO: 420642 - RNA, 60 nt, Human
gcuaggucaaccccacuguagacaggaaagccaggccaggagaguccgaaugagaauuua

SEQ ID NO: 420643 - RNA, 60 nt, Human
gcugagaggccccuagagacaacacccuucccaggccacuggcugcuggacuguuccuca

SEQ ID NO: 420644 - RNA, 60 nt, Human
cacuggugcuauagaaauugagaugcccccccaggccagcaaauguuccuuuuuguucaa

SEQ ID NO: 420645 - RNA, 60 nt, Human
auggaguuggcuccgacagcccgucugccaccaggccaugguuccuugccccaugguguc

SEQ ID NO: 420646 - RNA, 60 nt, Human
ugccugguccaguggggaacaggucccacgccaggccagcaggcgggcuccuuuguacag

SEQ ID NO: 420647 - RNA, 60 nt, Human
cccuuugacucuggggugcagcuucacccaccaggccagcucaggaauucccuggaaaag

SEQ ID NO: 420648 - RNA, 60 nt, Human
cagcccccgccagcugcccucgaaucccguccaggccaauuccagauucuaaacugauuu

SEQ ID NO: 420649 - RNA, 63 nt, Human
uccgguguuguacuaaaccucgugcuugugaacuccauacagaaaacggugccaucccugaac

SEQ ID NO: 420650 - RNA, 63 nt, Human
cucugcugcuccucccccacccccaccuuccacuccauacaaucugggccugguggagucuuc

SEQ ID NO: 420651 - RNA, 63 nt, Human
ugcucuuuggauuuauaacucuguuuagacuauuccauacauuuuagguauauuuugugccuu

SEQ ID NO: 420652 - RNA, 63 nt, Human
cuuaaguuuauuuuuccuuggauauaccuagauuccauacagugacaauacaaauacaaagga

SEQ ID NO: 420653 - RNA, 60 nt, Human
accugugcaagacacuggcucagcaguuccccaggccacaguaucagcaagauaaaagug

SEQ ID NO: 420654 - RNA, 60 nt, Human
cuggguccucuccccaggggcugccagcauccaggccaggaagccuggagccaagaaccu

SEQ ID NO: 420655 - RNA, 60 nt, Human
uggaagcgcccagcggccuuuccucgcucaccaggccagucucagggccucaccguauuu

SEQ ID NO: 420656 - RNA, 60 nt, Human
uaggaucgaaauguuaacaccgggagcucuccaggccacucacccagcgacgcucguggg

SEQ ID NO: 420657 - RNA, 60 nt, Human
uccguuggggccauuagaaugaggcagacaccaggccacucuagaagccgagccgucaca

SEQ ID NO: 420658 - RNA, 60 nt, Human
cggacccauggcagcugcucccagugcaucccaggccagcaggagcuuugugagcugcag

SEQ ID NO: 420659 - RNA, 60 nt, Human
aauucccgcaggauucuaccaaacccuuccccaggccagcuuuuguacugaaggcaagaa

SEQ ID NO: 420660 - RNA, 60 nt, Human
augcuaauccuccaaguggacaagauguccccaggccaaaaagcccuguuuuccuuucug

SEQ ID NO: 420661 - RNA, 60 nt, Human
gacgagcuugaaaucccagucuccuggcccccaggccagggucuguccaccauagaaugu

SEQ ID NO: 420662 - RNA, 60 nt, Human
gagcuggucccgccauccuccuuugccuucccaggccagcugcucaggcucggcaggucu

SEQ ID NO: 420663 - RNA, 60 nt, Human
cucacugugacccauccuuacucuacuuggccaggccacaguaaaacaagugaccuucag

SEQ ID NO: 420664 - RNA, 60 nt, Human
ggcgggugggacccgcagccuccacgcggcccaggccagccugccacccucugggccucc

SEQ ID NO: 420665 - RNA, 60 nt, Human
ccccccagugcagacuucggggucuccaccccaggccagcagcgcccacugggcuacagc

SEQ ID NO: 420666 - RNA, 60 nt, Human
uuccacgccccugaguucagagucggggacccaggccaggucgggagcacagccgcuccc

SEQ ID NO: 420667 - RNA, 60 nt, Human
cugguguuuccugggcucgguacugggcccccaggccauccaggcuuugccacggccagu

SEQ ID NO: 420668 - RNA, 60 nt, Human
cagaucugaggccaagcuaugugcuagagcccaggccagcucugagaccaagcccagcau

SEQ ID NO: 420669 - RNA, 63 nt, Human
caggaacuggccuuguucuccuuagcccgucacuccauacaguauuaggugaggauggaugcg

SEQ ID NO: 420670 - RNA, 63 nt, Human
gccuugggacaggaaugggcaccugcuucugaguccauacaggagaagaaagaucuguuuccu

SEQ ID NO: 420671 - RNA, 63 nt, Human
cuucaugcauccauuguucuguucauucauucauccauacauccaccugccucugagcuuuca

SEQ ID NO: 420672 - RNA, 63 nt, Human
ucaagaguucggaaaccacaguuuugucucucauccauacacugggguuuauuuugccaaggu

SEQ ID NO: 420673 - RNA, 60 nt, Human
uugucuuccaagauaggaagccaaguggguccaggccaggagauggggggggcgggggca

SEQ ID NO: 420674 - RNA, 60 nt, Human
ugggaaggaccgggugagugcaccggggacccaggccaggugccccccggagccugcugg

SEQ ID NO: 420675 - RNA, 60 nt, Human
guuuucugucguguguguugggaugggaucccaggccagggaaagcccgugucaaugaau

SEQ ID NO: 420676 - RNA, 60 nt, Human; identical to SEQ ID NO: 76199

SEQ ID NO: 420677 - RNA, 60 nt, Human
ccagccucugcccagggaccccugccuuccccaggccaucugcucugccgucgacacucg

SEQ ID NO: 420678 - RNA, 60 nt, Human
gcaucugccacgaaggaagcgccagccucgccaggccagcaggggcgucguuuuguugcc

SEQ ID NO: 420679 - RNA, 60 nt, Human
ucccugcugaauggaggagccgggggucccccaggccaacuggaaaaucucccaggcuag

SEQ ID NO: 420680 - RNA, 60 nt, Human
uuuaauggcagauaagcuccgucugcaguuccaggccagccagaaacuccuguguccaca

SEQ ID NO: 420681 - RNA, 60 nt, Human
uggcugccccagcaggcacccaccucccugccaggccaagccagguguccucuugcagcu

SEQ ID NO: 420682 - RNA, 52 nt, Human; identical to SEQ ID NO: 76205

SEQ ID NO: 420683 - RNA, 60 nt, Human
cucuccuggacgaucgcgggucgcagaagcccaggccagcgagcccuacagagugaggac

SEQ ID NO: 420684 - RNA, 60 nt, Human
gcucugaggucccuucaaggccuccccaauccaggccaaagccccaugugccuuguccag

SEQ ID NO: 420685 - RNA, 60 nt, Human
uggggggugggaggguaaccucacucuucuccaggccaggccuccuuggacuccccuggg

SEQ ID NO: 420686 - RNA, 60 nt, Human
guaaaucaucacuucagcuccugauuggucccaggccaagcugaauagcccuuaggaaua

SEQ ID NO: 420687 - RNA, 60 nt, Human
gcuggugccaacuuccugauggguccugggccaggccagccagggagaagacaaggcccc

SEQ ID NO: 420688 - RNA, 60 nt, Human
cccuccugaggcccugauggcagcucugcgccaggccacagcagccgcccgcugccgcug

SEQ ID NO: 420689 - RNA, 63 nt, Human
guucaaccauguuuuuugaucuagcucucugauuccauacauuccagacuucucaguggauuu

SEQ ID NO: 420690 - RNA, 63 nt, Human
ugcagcaaacguuugccugggcauugaggcauuuccauacaucuucugaaaacuaggcggagg

SEQ ID NO: 420691 - RNA, 63 nt, Human
ggcuagauugauuacggauguaauugcuguccauccauacagagcauacucuacaguguauuc

SEQ ID NO: 420692 - RNA, 63 nt, Human
uaacauaggucuaauuuauuugccgugucauuuuccauacaaaucaguugauuuaaaaaaguu

SEQ ID NO: 420693 - RNA, 60 nt, Human
uugauuuuuuauuuggguagguuuugggguccaggccauuuuuuuuaccccuuggaggaa

SEQ ID NO: 420694 - RNA, 51 nt, Human; identical to SEQ ID NO: 76213

SEQ ID NO: 420695 - RNA, 60 nt, Human
acaggggcaacugguuuggcaaccccacauccaggccaauaaagaugugugagcugggug

SEQ ID NO: 420696 - RNA, 60 nt, Human
cacggacuuugaccgcacgcuggagagugcccaggccaaccuugccgggcuguuucccga

SEQ ID NO: 420697 - RNA, 60 nt, Human
ccagcucaaugccugguaucugcccccaguccaggccaggcggaggggaggggcuguccg

SEQ ID NO: 420698 - RNA, 60 nt, Human
gcugcuggaucagggcagccggggagguggccaggccaguggccaggcccuguggagaca

SEQ ID NO: 420699 - RNA, 60 nt, Human
cgcccucccuccguggggauagccgcagccccaggccaucaucugcugcuggggcccccc

SEQ ID NO: 420700 - RNA, 60 nt, Human
augagugaagauccuggaggacccugggccccaggccagcucccaucgcugggggacggu

SEQ ID NO: 420701 - RNA, 60 nt, Human
cucgugggcuggugacugggucuugggaucccaggccacgcgccagccaggcugugggca

SEQ ID NO: 420702 - RNA, 60 nt, Human
ccaccguguccgaggcgcaacgcuaggccuccaggccacgcauccaucuccaaguuaaca

SEQ ID NO: 420703 - RNA, 60 nt, Human
accccucucccacccuccccagggguaaccccaggccaagcacagauagcucagcugcga

SEQ ID NO: 420704 - RNA, 60 nt, Human
gccugggcaucccuggugcuggggacugugccaggccaugcuugcugugacuccgccccu

SEQ ID NO: 420705 - RNA, 60 nt, Human
cugucguggcugagcggggagcuugaacacccaggccagggacaccccuccccagcuccc

SEQ ID NO: 420706 - RNA, 60 nt, Human
cgggagccucagggcucugagagcugugcuccaggccagggguuacaccugcccuccgug

SEQ ID NO: 420707 - RNA, 60 nt, Human
caaaaucgaugaaauggggaguucucugggccaggccacauucacauuccccucccccug

SEQ ID NO: 420708 - RNA, 60 nt, Human
gaacaccugaggucagguguucgagaccagccaggccaacauggugaaaccccgucucua

SEQ ID NO: 420709 - RNA, 63 nt, Human
agggugagagucacaccacauuacacaugugcuuccauacagugguuucugaagcuuuugcag

SEQ ID NO: 420710 - RNA, 63 nt, Human
uggguauucugagaaucaugcucuaauggcuuuuccauacacuaaagcucugaaaguagugag

SEQ ID NO: 420711 - RNA, 63 nt, Human
agaguucagucccuagaaguaucuucacaaugauccauacagccuugcuaugcuuuagaacuu

SEQ ID NO: 420712 - RNA, 63 nt, Human
gaaaaugcagacagaccucaacauucaacaacauccauacagcacugcuggaggaagaggaag

SEQ ID NO: 420713 - RNA, 60 nt, Human
gggacuacuuguuucccaccccagguuccuccaggccaagucauggggugaugaggaguu

SEQ ID NO: 420714 - RNA, 60 nt, Human
aaggaaagcaguuguugaagcuacagaagcccaggccagggcucccacuggcuguagcug

SEQ ID NO: 420715 - RNA, 60 nt, Human
gcccugcccgccccaggggcaccccgacauccaggccacccccucauggugcuacagacc

SEQ ID NO: 420716 - RNA, 60 nt, Human
agauuccagcccaagccuggccccccaccgccaggccauagggcauaauuugcaucucaa

SEQ ID NO: 420717 - RNA, 60 nt, Human
uggggcuuccacgucccuggggggcaggggccaggccaggggggagggggcucagccccu

SEQ ID NO: 420718 - RNA, 60 nt, Human
ccuucccucaacucuaggggcagcauagccccaggccacccuagcccagccccugcauug

SEQ ID NO: 420719 - RNA, 60 nt, Human
agggcaccucauggaccaggggcugguggcccaggccagggagggaacccugggcagggc

SEQ ID NO: 420720 - RNA, 60 nt, Human
cccuuuuucgacugccccaacucuuggacaccaggccaacuagaacacccaacaccaaac

SEQ ID NO: 420721 - RNA, 60 nt, Human
aauuaugguguagacagcccucccccaaccccaggccagucaggcacaauccccccaccc

SEQ ID NO: 420722 - RNA, 60 nt, Human
gggggagcaaaaccaucaaccaccaggcagccaggccaucagcccaccuccaccucugga

SEQ ID NO: 420723 - RNA, 60 nt, Human
ccacugcuuuccagacacuaaccaaggcuuccaggccagggauugcccaacacuccuagg

SEQ ID NO: 420724 - RNA, 60 nt, Human
auuuauugagacggagucuugcucuguagcccaggccagagugcaguggcgcgaucucag

SEQ ID NO: 420725 - RNA, 60 nt, Human
uuuuuuugagacagggucugacucuguccuccaggccagaguccaguggugcaaucucag

SEQ ID NO: 420726 - RNA, 60 nt, Human
cagcauggcagucccuacccccaauuuuucccaggccaggcacugaguaggaguuaucuc

SEQ ID NO: 420727 - RNA, 60 nt, Human
cgugccuuugcccagacccugcacuuucaaccaggccaguccggcucuggggagcagggg

SEQ ID NO: 420728 - RNA, 60 nt, Human
ggacacugacagacaguacucccagcaggcccaggccagccagggcuucgucaggccugc

SEQ ID NO: 420729 - RNA, 63 nt, Human
acgcuuccauuugaugcauuugaugugagugaauccauacauuugaaugucauuguccuugag

SEQ ID NO: 420730 - RNA, 63 nt, Human
uauugggacucguauguaggaaucaaauaucccuccauacaguguacucuuauucuuggcaag

SEQ ID NO: 420731 - RNA, 63 nt, Human
uugucuauuugccauaucuauuuuuuuuaaauuuccauacacuuguaaaaguaguuaguugcu

SEQ ID NO: 420732 - RNA, 63 nt, Human
uucaggggauaugaaacaaucuguagauugguuuccauacagggaaguucucuguccuaugca

SEQ ID NO: 420733 - RNA, 60 nt, Human
gauggcgcguacugaagccacgauguucauccaggccaaagcaggguguccugggauagg

SEQ ID NO: 420734 - RNA, 60 nt, Human
ggcuuuguuguguuuaagcuauugagagccccaggccacaccaggacuugcagugguggg

SEQ ID NO: 420735 - RNA, 60 nt, Human
gauugaguucaucaugagccguugcuaaugccaggccaguaaaaguauaacagcaaauaa

SEQ ID NO: 420736 - RNA, 60 nt, Human
ugaaugcucuaagaggcuccuacaggcgcuccaggccacucucagagacucccaggaguu

SEQ ID NO: 420737 - RNA, 60 nt, Human
uuccccaugagcccucccugucugcacugcccaggccagaggguagagcacagggguuuc

SEQ ID NO: 420738 - RNA, 60 nt, Human
aaaaugccuggcgugagagccagcagacagccaggccaggguaggcagugccugcuucug

SEQ ID NO: 420739 - RNA, 60 nt, Human
gggagaugccuggggaggggcuccuggaauccaggccagcccaacagcccuggcugggga

SEQ ID NO: 420740 - RNA, 60 nt, Human
cucuucucugagcuccaugucccagauaaaccaggccagacugagaaggcuccccagagg

SEQ ID NO: 420741 - RNA, 59 nt, Human; identical to SEQ ID NO: 76252

SEQ ID NO: 420742 - RNA, 60 nt, Human
agcugagacuagaauucaggguccucacucccaggccaccgaaccaugcagccccuucuu

SEQ ID NO: 420743 - RNA, 60 nt, Human; identical to SEQ ID NO: 76254

SEQ ID NO: 420744 - RNA, 60 nt, Human
cuuggagaguccucagcaggguagccgaggccaggccacuucugcugaggauggggcagg

SEQ ID NO: 420745 - RNA, 60 nt, Human
gcauugucaccuucacagcagacagagcugccaggccaugaugggcuggcgacagcccgg

SEQ ID NO: 420746 - RNA, 60 nt, Human
acucuacugggccguggagguaacgaucacccaggccagucuccucugccugggaugcgc

SEQ ID NO: 420747 - RNA, 60 nt, Human
ccagccuccccuccucccucccauccucacccaggccaaggcccaggggcucugccagga

SEQ ID NO: 420748 - RNA, 60 nt, Human
aggggguuggcugggucugagugccaccccccaggccacagugauaccaucccagugcca

SEQ ID NO: 420749 - RNA, 63 nt, Human
gcagguagaccaaauuccgcuuucaguaauucauccauacagaauuuggaugacuauguauaa

SEQ ID NO: 420750 - RNA, 63 nt, Human
uuuguauguuugacuuaccuuagauuuuuauuuuccauacauacugcaaaugauugacuuguu

SEQ ID NO: 420751 - RNA, 63 nt, Human
gggaagcagggauugcugacauguauuuuugaauccauacauuaaugcuaaaacgaauauagu

SEQ ID NO: 420752 - RNA, 51 nt, Human; identical to SEQ ID NO: 336662

SEQ ID NO: 420753 - RNA, 60 nt, Human
aggaggguugggucccugggaggccggcagccaggccacagaauccacacguggaccauu

SEQ ID NO: 420754 - RNA, 60 nt, Human
gaccauugugggucccugggaggccggcagccaggccacggaauccacacguggaccauu

SEQ ID NO: 420755 - RNA, 60 nt, Human
ggguggugauggggauuguuaggauggagcccaggccacauggaugaugaugauucuccc

SEQ ID NO: 420756 - RNA, 60 nt, Human
ucuucaguaauacggaugccaugggaguggccaggccagauugaaggugaauauggagca

SEQ ID NO: 420757 - RNA, 60 nt, Human
gguggcucucaacuggaauugguaguguuuccaggccaagggucgacugcagguuguuug

SEQ ID NO: 420758 - RNA, 59 nt, Human; identical to SEQ ID NO: 76265

SEQ ID NO: 420759 - RNA, 59 nt, Human; identical to SEQ ID NO: 76266

SEQ ID NO: 420760 - RNA, 60 nt, Human
ugggccugagcugggugccccgucgcccucccaggccacuaggcucugacucuuccagca

SEQ ID NO: 420761 - RNA, 60 nt, Human
agugccugcucccagaaucuggugcucugaccaggccagguggggaggcuuuggcuggcu

SEQ ID NO: 420762 - RNA, 58 nt, Human; identical to SEQ ID NO: 76269

SEQ ID NO: 420763 - RNA, 60 nt, Human
cuggggacaagccugugccugccaaagcucccaggccaaguuugggggcugguguuuggg

SEQ ID NO: 420764 - RNA, 60 nt, Human
caauggucauccugucuacccacccugccuccaggccagggggcuggggaggcaaauaga

SEQ ID NO: 420765 - RNA, 60 nt, Human
uucagagccuggucacacaaggggcgagcaccaggccagccugggacuggccagagcugg

SEQ ID NO: 420766 - RNA, 60 nt, Human
uuuccagagguaauuaugagcgccuaccagccaggccacccagccgugggaggaaggggg

SEQ ID NO: 420767 - RNA, 54 nt, Human; identical to SEQ ID NO: 76274

SEQ ID NO: 420768 - RNA, 60 nt, Human
acucacaaggaagaccaggcugaggccccuccaggccaggguccuggggcaggcaucuca

SEQ ID NO: 420769 - RNA, 63 nt, Human
acucccccugccgcccacacugcagcagccacauccauacacacacgcucgcacaguguucug

SEQ ID NO: 420770 - RNA, 63 nt, Human
guguuuccucucuccucuaccauucaucucucuuccauacagucauuugggcuuuuuacucaa

SEQ ID NO: 420771 - RNA, 63 nt, Human
cacagugcccacucuggaccuaagucuaguguauccauacaauuggugcagagaaauaaggug

SEQ ID NO: 420772 - RNA, 63 nt, Human
guaaacaguaaguccuaagcuuugauggaaggguccauacauuuuuuuuuuuuuuuugcugau

SEQ ID NO: 420773 - RNA, 60 nt, Human
gucuggggcugaucuugccuugaggaagacccaggccauguucccaaaggccagcggggg

SEQ ID NO: 420774 - RNA, 60 nt, Human
gagcugcagcggagcccuccagcccucaccccaggccagccccaccccggccucuuugag

SEQ ID NO: 420775 - RNA, 60 nt, Human
ugaugcucggccuugcgcccguuccaccucccaggccacccuuccugggcuucugggcca

SEQ ID NO: 420776 - RNA, 60 nt, Human
cagggagagaacaauaucacagucauucauccaggccacguuuccucugcggaguguagc

SEQ ID NO: 420777 - RNA, 60 nt, Human
accauggacaacaagccuuggguaaccggaccaggccaagggucuacaauucuccaacga

SEQ ID NO: 420778 - RNA, 60 nt, Human
agccuuuuccuuccacgccgccucucacugccaggccagcggcuuccgcugagacucgcu

SEQ ID NO: 420779 - RNA, 60 nt, Human
cugggcgacguggauccuccuuaccacccaccaggccagauuuacaggagagagaaaucc

SEQ ID NO: 420780 - RNA, 60 nt, Human
gaaaaaacaaaccaaaauaugcucuugcgcccaggccaguggugaguuagagguaugcua

SEQ ID NO: 420781 - RNA, 60 nt, Human
gagcccccucaccucccuggggaugaggggccaggccaugacccugaaagccuagcccug

SEQ ID NO: 420782 - RNA, 60 nt, Human
cacaugugcccccgagggucccacgagcugccaggccaaggcugccugccgugcaccacc

SEQ ID NO: 420783 - RNA, 60 nt, Human
acugccaucacccagcaccccagaucaccgccaggccagcccccaaugguccccuuacgg

SEQ ID NO: 420784 - RNA, 60 nt, Human
ugcgcaugccuauggcagugggugcaccugccaggccaagggucagggugcccagagccu

SEQ ID NO: 420785 - RNA, 60 nt, Human
ucccccauuggugggggcagagaaguaggaccaggccauccuuggcuccagagcucgaag

SEQ ID NO: 420786 - RNA, 60 nt, Human
cuuggaugcccucaggggugcugaccccugccaggccacgaauaucaggcuagagaccca

SEQ ID NO: 420787 - RNA, 60 nt, Human
ugacaauccuggaaaucuguucuccagaauccaggccaaaaaguucacagucaaaugggg

SEQ ID NO: 420788 - RNA, 60 nt, Human
gcccugaugggagcagcuuggcugugagcaccaggccaagacuccugagaacaggcagcc

SEQ ID NO: 420789 - RNA, 63 nt, Human
ccugaagugcuuaugaaggggcguccauucuccuccauacauccccaucccucuacuuucccc

SEQ ID NO: 420790 - RNA, 63 nt, Human
uuucagaagagcaagcacaaaguaauuuagcuuuccauacauuuuuagagucagagauaacuu

SEQ ID NO: 420791 - RNA, 63 nt, Human
agucugccacaugccaaacaauguuagguacuuuccauacaacgaaucuauuauucccaucuu

SEQ ID NO: 420792 - RNA, 63 nt, Human
gaacagagcggcuguguaugcagccugcagguuuccauacacugaagcuuuuaccucaacuuu

SEQ ID NO: 420793 - RNA, 60 nt, Human
gcugagggugguggcggccccugaggcagaccaggccaggcuuccccuccuaccuggacu

SEQ ID NO: 420794 - RNA, 60 nt, Human
ggcuucugugcuccuggcuucuuacgccguccaggccaagguaggcucaaagaagaaaaa

SEQ ID NO: 420795 - RNA, 60 nt, Human
cgauucuuuggaaguucagcagaugaaagcccaggccagggaggagaaggcuagaaagca

SEQ ID NO: 420796 - RNA, 60 nt, Human
augcagcgaagcagcccagcccggcggaucccaggccagcacgccugccggcuucucauc

SEQ ID NO: 420797 - RNA, 60 nt, Human
gccccacacugucagugccaagaggcugcgccaggccacucucucagcccagggccugcc

SEQ ID NO: 420798 - RNA, 60 nt, Human
gagaacaaguaguuccuuggaggcccccauccaggccagaaggaccagguccacccagca

SEQ ID NO: 420799 - RNA, 60 nt, Human
accagauguuccugagucuggagcaagcacccaggccagaauaacagagcuuucuuaguu

SEQ ID NO: 420800 - RNA, 60 nt, Human
uaucuguuggccugaagagugaaaccuguaccaggccaaaggugagggcgugagugaggg

SEQ ID NO: 420801 - RNA, 60 nt, Human
ugcugcucuccacucaacuggccucugcugccaggccacugccugucucugcuuccgacu

SEQ ID NO: 420802 - RNA, 60 nt, Human
gugccaagucacuggccguuaacucagcacccaggccaagcccccgccucccacuugaag

SEQ ID NO: 420803 - RNA, 60 nt, Human
cccuuagccuccagcaccccccgcccccgcccaggccaucaccacagcugcagccaaccc

SEQ ID NO: 420804 - RNA, 60 nt, Human
ggcgccuccgacuggcuggagcugcccccuccaggccaguuugaagacuacaugaacacg

SEQ ID NO: 420805 - RNA, 60 nt, Human
gccagccgggcggccgacccguggggcaggccaggccagguccucccugauggacgccug

SEQ ID NO: 420806 - RNA, 60 nt, Human
ucacagcuggcuuguaaggcaggagcuggcccaggccacagcaccugcuggggugggaaa

SEQ ID NO: 420807 - RNA, 60 nt, Human
cacguugucuuugaccagugguccccaguaccaggccagcgaagacaacuuuauaauguc

SEQ ID NO: 420808 - RNA, 60 nt, Human
uccuccucgcaggagggaccaggcggggcuccaggccacucagugggcucccugguccug

SEQ ID NO: 420809 - RNA, 63 nt, Human
ucaccugcuucccuaccacuccucacugcauuuuccauacaaauguuucuauuuuauuguucc

SEQ ID NO: 420810 - RNA, 63 nt, Human
caaggcccaagcaccaccgucaacacagcccaguccauacagaaauggguuucaugccugaaa

SEQ ID NO: 420811 - RNA, 63 nt, Human
gaacuaaugaauagauaaaccaaaucugguauauccauacaauggacuauauuauucagccau

SEQ ID NO: 420812 - RNA, 63 nt, Human
ccacagaugaauuaagacaugaaguguguucuguccauacaauggaauauuauuuggccauaa

SEQ ID NO: 420813 - RNA, 60 nt, Human
uggcuagagguggggugggaagagaggaggccaggccaggcccucaggaauucccugguu

SEQ ID NO: 420814 - RNA, 60 nt, Human
uccggggguccagggaauggagcucaggucccaggccagccccgaagucgccacguggcc

SEQ ID NO: 420815 - RNA, 60 nt, Human
caggcagugcuccaggaauccuggggggucccaggccaccucugcuuccaccuucacuau

SEQ ID NO: 420816 - RNA, 60 nt, Human
ccccagcugaccucguccauucagccccugccaggccaagcccagccacugcccucccgg

SEQ ID NO: 420817 - RNA, 60 nt, Human
guaggcaacuguuauggcaguggguccagcccaggccagcacugccagccuccucucccu

SEQ ID NO: 420818 - RNA, 60 nt, Human
cagaguguuccccaugcuccaccugguggcccaggccacagcugcugcuuguauuucggu

SEQ ID NO: 420819 - RNA, 60 nt, Human
aacuucagagcccaggcagucccugaaugaccaggccaguguugucacugaguggucccc

SEQ ID NO: 420820 - RNA, 60 nt, Human
aaaacccacuaacaauuuuagcaaaacaguccaggccaaagaggaagcauuucauguuca

SEQ ID NO: 420821 - RNA, 60 nt, Human
aggucuuggccaagaaauguagaccuuuccccaggccagggugauuguucauuugacaug

SEQ ID NO: 420822 - RNA, 60 nt, Human
aaaaagacgagaaaaugaauaaauaaaaaaccaggccaggcgugguggcucacgccugua

SEQ ID NO: 420823 - RNA, 60 nt, Human
guguagccuuuggccacgcacugacacugcccaggccaagcaaaagcagagugugguuaa

SEQ ID NO: 420824 - RNA, 60 nt, Human
gggccaaggucugagcacuggaguggcucgccaggccaaaucacccuuagaaggcugcag

SEQ ID NO: 420825 - RNA, 60 nt, Human
uuucaugacaggucuauauuucuaccugggccaggccaggaaagagacuauuuaagaaaa

SEQ ID NO: 420826 - RNA, 60 nt, Human
cuuauguguagugucccuggcaggcauuuaccaggccaugugcuuuaacguuacgguaau

SEQ ID NO: 420827 - RNA, 60 nt, Human
ugaauacaugacaagacagaacguuccuugccaggccaggcaaaagccaaggcccauuag

SEQ ID NO: 420828 - RNA, 60 nt, Human
ggaugcuuugaaagauauggaagacagagcccaggccauaauugacaccacagaugaugc

SEQ ID NO: 420829 - RNA, 63 nt, Human
agcuaacucccugcaucugggcaucaggacugcuccauacauuugcugaaaacuucuuguauu

SEQ ID NO: 420830 - RNA, 63 nt, Human
aauuaaggcacaguugauuuuguagaguauugguccauacagagaaacugugguccuuuauaa

SEQ ID NO: 420831 - RNA, 63 nt, Human
gaauuuacauuuuauauuaaagaaauugagcuauccauacaaccuguauuuacuuuaauuuca

SEQ ID NO: 420832 - RNA, 63 nt, Human
gugauguugugguuuuauuaucuuaaacucuguuccauacacuuguauaaauacauggauauu

SEQ ID NO: 420833 - RNA, 60 nt, Human
ggacuuugagcugaacaugcccacuggcccccaggccacaugggaccuggaggagccuac

SEQ ID NO: 420834 - RNA, 60 nt, Human
gguauuucaggugugaaagaaucaguaggaccaggccaccgcuagugcuuguggagauca

SEQ ID NO: 420835 - RNA, 60 nt, Human
ccucccuucucuccccaguucugguccuggccaggccaugcuacacuaaccccugccccc

SEQ ID NO: 420836 - RNA, 60 nt, Human
gaaaguaaauaaaaggacugugauuugaauccaggccacucuuagcccaugcuguuuucc

SEQ ID NO: 420837 - RNA, 60 nt, Human
guggcaaaggccauggccauaucuguugucccaggccaaagacuaacaacugccuuggga

SEQ ID NO: 420838 - RNA, 60 nt, Human
uauggcucacagugaugaugccagucagagccaggccagauggaaauuguuuucugaugu

SEQ ID NO: 420839 - RNA, 60 nt, Human
gcgagcuggccuaaugugguggccugcaagccaggccaucccugggcgccacagacgagc

SEQ ID NO: 420840 - RNA, 60 nt, Human
acaauaguucaggucagacaucuaagauccccaggccaaaccaugccacacacgugucug

SEQ ID NO: 420841 - RNA, 60 nt, Human
gccucccucugcguugguaucugcuacaucccaggccaccaccuccgaggaugaaaagau

SEQ ID NO: 420842 - RNA, 60 nt, Human
gugaccaagggacugaauugcugacaugggccaggccaggcacuguuuuguggcccaugc

SEQ ID NO: 420843 - RNA, 60 nt, Human
uguuagaguauauucugaaaccaacuugucccaggccacaggaguguauauguuucauaa

SEQ ID NO: 420844 - RNA, 60 nt, Human
gaugagaggaucacuugagccugaggagguccaggccacagugaucugagaucacaccau

SEQ ID NO: 420845 - RNA, 63 nt, Human
aggggcuggcacaaaucugaucagagacacauauccauacacaggugaaacacauacagacuc

SEQ ID NO: 420846 - RNA, 63 nt, Human
gaguugggcaaaagcuuggguaggacaagaacuuccauacaaauuugagauagaucucgccug

SEQ ID NO: 420847 - RNA, 63 nt, Human
acaaaugaaggacaagcauacuacauaauauaauccauacaauucucuucaguuaguguaaac

SEQ ID NO: 420848 - RNA, 63 nt, Human
cgcuuacaauuuguagaaacacaaaaugcguuuuccauacagcagugccuauauagugacuga

SEQ ID NO: 420849 - RNA, 63 nt, Human
agcuuaaaguugcucuuuugguuuuuaacuuccuccauacauaagcuucaaggacaauaagau

SEQ ID NO: 420850 - RNA, 63 nt, Human
gagaugaaacggaagaugcacgaggauaugaucuccauacagaacuuucucaucuacguggcc

SEQ ID NO: 420851 - RNA, 63 nt, Human
cacccccaagccacuauccacuuugaauccugcuccauacauuggguguauauuuauucugaa

SEQ ID NO: 420852 - RNA, 63 nt, Human
uggaccaaaggcugaggcuuggccaucuagcauuccauacaaaauuguuuccuauaagcauuc

SEQ ID NO: 420853 - RNA, 63 nt, Human
uuugaaaaucaagaugagauauauagauauauauccauacauuuuauugucagaauuuagacu

SEQ ID NO: 420854 - RNA, 63 nt, Human
cuuguccuuucagaaaacaugcaaauaccaagauccauacaaaacaauaauuuauuccacuga

SEQ ID NO: 420855 - RNA, 63 nt, Human
uguccauaagccauccagaucaacacccuuucuuccauacagaaaagggcuaaccauaccaca

SEQ ID NO: 420856 - RNA, 63 nt, Human
uacucucaguaguaaaauaucacacugaauucuuccauacacaggugugcuucuagucagugu

SEQ ID NO: 420857 - RNA, 64 nt, Human
gcagggcugguuagccccucccacugccugacaccugggacaggcugggcagaggggagagagg

SEQ ID NO: 420858 - RNA, 64 nt, Human
gguagagaggagacgagaggcuuuuucagugggccugggacaguggcugcucuugacuuugugu

SEQ ID NO: 420859 - RNA, 64 nt, Human
auguauggggagcuggcagagcagguggcagucacugggacaaggagggacuugccucucuucu

SEQ ID NO: 420860 - RNA, 64 nt, Human
agcuccugcuggcaucuggagaacaccccugugccugggacaggggaggacccuucuuuuggac

SEQ ID NO: 420861 - RNA, 64 nt, Human
gaagcugcucccugguuccacucuggagaguaaucugggacaucuuaguguuuuguuuuguuuu

SEQ ID NO: 420862 - RNA, 64 nt, Human
acgguuuccacagcgagcgccagcuccggccagccugggacagcucaucccagccgacuacacc

SEQ ID NO: 420863 - RNA, 64 nt, Human
ugaacuucuuuaggagucacugcuugugugguuccugggacacuuaaccaaugccuucugguac

SEQ ID NO: 420864 - RNA, 64 nt, Human
ccagguuugcuggccauagauaccuuugggcugccugggacaggcuccugaggaggauugaggg

SEQ ID NO: 420865 - RNA, 64 nt, Human
aggguauuagccaguguuugugccaagcaguuuucugggacaacagaaugacucagaccaagau

SEQ ID NO: 420866 - RNA, 64 nt, Human
cguguucugucacccuuuggggaggggaguucuccugggacagugggcucugcauguucuccac

SEQ ID NO: 420867 - RNA, 64 nt, Human
ggccgugccucacuuuuauuuauugcugguuuuccugggacagcuggagcugugucccuuagcc

SEQ ID NO: 420868 - RNA, 64 nt, Human
uuuggguaccuggugggucuaggcagggucugagcugggacagguucugguaaaugccaaguau

SEQ ID NO: 420869 - RNA, 64 nt, Human
gggaguugccaaaaagagcuuauagccggaagcccugggacaaccaacagcagacaguggccaa

SEQ ID NO: 420870 - RNA, 64 nt, Human
aaaaugaagagggacaucaaguaacauuggagcucugggacaauggcgcagguaauaagaaucu

SEQ ID NO: 420871 - RNA, 64 nt, Human
uucugauaaacuugaaaagacuugagucuuuccacugggacacauccauuuuucagauuguuuu

SEQ ID NO: 420872 - RNA, 64 nt, Human
guuugugugaucucagaacugugccaagcagacacugggacaaagggagaauaucuugcucccc

SEQ ID NO: 420873 - RNA, 64 nt, Human
guagacucuguccugcuggucccaccacacauggcugggacaucuguucccagcuguaggcccu

SEQ ID NO: 420874 - RNA, 64 nt, Human
uaucaguaaccccacugcacaggcacacgaugcucugggacauaacuggugccuggaaaucacc

SEQ ID NO: 420875 - RNA, 64 nt, Human
gcucagcaguucacuuccuagagcaucugucccacugggacacaaccacuaauuugucacugga

SEQ ID NO: 420876 - RNA, 64 nt, Human
auuuuauaaagauguuuuuucacaagauuaauuacugggacaaaaguaauuuggaagcccaguu

SEQ ID NO: 420877 - RNA, 64 nt, Human
ggacuuugcuaggagauuuuuuaaguguuccuuacugggacaacguggagccacguuugcagga

SEQ ID NO: 420878 - RNA, 64 nt, Human
ggcucucccucacucucugaggcuccagcugguccugggacaugcagccaggacugugagucug

SEQ ID NO: 420879 - RNA, 64 nt, Human
cagugagagaaaugcugaaaguacacugggaucacugggacacugucuuaugaagguuugcuug

SEQ ID NO: 420880 - RNA, 64 nt, Human
cccaauaacagacaugagggauggcccugucucucugggacagagccucacagaugauguccau

SEQ ID NO: 420881 - RNA, 64 nt, Human
auccagcccuccccgcuugaggccagcacugagucugggacacucagcgggaagggggcuggca

SEQ ID NO: 420882 - RNA, 64 nt, Human
gcugggggaagccacuccggacacuguguuuucucugggacaugucuucugcccagguaagagu

SEQ ID NO: 420883 - RNA, 64 nt, Human
cccggugaccuuggggccuccgacccugugcagccugggacaaaacuguuuccgguuggccgcu

SEQ ID NO: 420884 - RNA, 64 nt, Human
ggaagggacaguaucguuuguuuaugaaaugccacugggacagcuggcugggccuucaccaagc

SEQ ID NO: 420885 - RNA, 64 nt, Human
acagcuucccuauuuugaaugcagaaaacagggucugggacauuagucguuauauuugacuuga

SEQ ID NO: 420886 - RNA, 64 nt, Human
aggaagaccccaaagcacuggcuguugccuugaacugggacauaaagaagacggagacuguuca

SEQ ID NO: 420887 - RNA, 64 nt, Human
cgaggaguagccagguaggcgagacacaaaaggccugggacagggucaguacaagucaggucag

SEQ ID NO: 420888 - RNA, 64 nt, Human
cagacagaagcugggccagcacuguggacuccuccugggacagggcuggguccucuggcuauuu

SEQ ID NO: 420889 - RNA, 64 nt, Human
agcuaugcccagugcugcaugggacccaugucuccugggacagaggccaucucucuuccagaga

SEQ ID NO: 420890 - RNA, 64 nt, Human
cagggcuccuggaauuucccuugauccagcuaggcugggacacucccuaaaucagcugcguguu

SEQ ID NO: 420891 - RNA, 64 nt, Human
cagaggcaggagccuaccccuggccacaccaccucugggacacggcaccccccugggccuggag

SEQ ID NO: 420892 - RNA, 64 nt, Human
cuggcuguuuagcuugagggcagcacagaggccccugggacaccuacaggccagaaagaucaac

SEQ ID NO: 420893 - RNA, 64 nt, Human
gcauuccaggguugaaucuugucccagccucagccugggacaccuagguggagagaguggucuc

SEQ ID NO: 420894 - RNA, 64 nt, Human
uuaucacauucccaauucagugagaaaaauucaucugggacacaacaggguacucuucucuguu

SEQ ID NO: 420895 - RNA, 64 nt, Human
uuaauaccugcuuugcauauucacacauggucaacugggacauguuaaacuuugauuugucaaa

SEQ ID NO: 420896 - RNA, 64 nt, Human
auccaugcuuuuauuuuuguuaagucuuuugugacugggacaguuaauuuuaguagcugaagaa

SEQ ID NO: 420897 - RNA, 64 nt, Human
ggaaggaaagcacaacuggguccuuuauucauuucugggacagaaagagggucaguggacuuuu

SEQ ID NO: 420898 - RNA, 64 nt, Human
ccauccaccucccccgcacacacacaaagaugaccugggacaugauuuuuuuauucccacauuu

SEQ ID NO: 420899 - RNA, 64 nt, Human
cugugcgggucacaguuucucccaaugauuaugacugggacauucuuugguagauaccauuugc

SEQ ID NO: 420900 - RNA, 64 nt, Human
ggacauuuaaggaauccugauccucagaacuucucugggacaauuucaguucuaauaauguccu

SEQ ID NO: 420901 - RNA, 64 nt, Human
gugucagcaaauuaauugaaguuaugcuucuauacugggacauauuuaaauacugaguauagua

SEQ ID NO: 420902 - RNA, 64 nt, Human
uuaagaagcuaggggaauuaggccacaacacccccugggacauccgaaagcuacaccacagaug

SEQ ID NO: 420903 - RNA, 64 nt, Human
acaggugcugugcuuugugcucuuggcugcugugcugggacagaaugggaugccaggaagagaa

SEQ ID NO: 420904 - RNA, 64 nt, Human
cgcuuggagcuauuuuccaggcuucugcuggggccugggacaacugcucccaccuccugacacc

SEQ ID NO: 420905 - RNA, 64 nt, Human
ucuuccucaaguaagggggaacuccugcuuugggcugggacauaaguuuuucugcuuucagacg

SEQ ID NO: 420906 - RNA, 64 nt, Human
caguuccacaagauccaaccaagaauucuguauccugggacagucagauucuucuaaaucaggc

SEQ ID NO: 420907 - RNA, 64 nt, Human
gcucaacuuguacaauguuuauuagacacaucuccugggacauacugccuaaccuuuuggagcc

SEQ ID NO: 420908 - RNA, 64 nt, Human
uggaaaauguucuuucugcagggucuagagacugcugggacacuuuucuuggagugcuacuuca

SEQ ID NO: 420909 - RNA, 64 nt, Human
uccuacgcccacucccaugcuugggagaauggggcugggacaugcacugaguguugcacuuuua

SEQ ID NO: 420910 - RNA, 64 nt, Human
ugauuugaugacagagaucuucauuaaacaagaucugggacaguaauaaaagauugcugcauaa

SEQ ID NO: 420911 - RNA, 64 nt, Human
uuugaucaggagugagauuuucggguucugaaaccugggacacgagucugugaauagucgguuu

SEQ ID NO: 420912 - RNA, 64 nt, Human
gcagugcccagccccacaaaggcugcccgacucccugggacaguaguguggagucccagcccag

SEQ ID NO: 420913 - RNA, 64 nt, Human
ccugccagucaugguuuccccagaaguguaguuccugggacauucauggauaugagcuauucac

SEQ ID NO: 420914 - RNA, 64 nt, Human
gaacaccuacuaauuccucugcacuccuucauggcugggacaguuacugguucauaugcaagua

SEQ ID NO: 420915 - RNA, 64 nt, Human
auuuuuaaaaaaugaaauagugauguuguccuaacugggacaggaagccuugcgagaagggacg

SEQ ID NO: 420916 - RNA, 64 nt, Human
cuaguuuacugguuuuuauucccauaugccgauucugggacaauaaaguuguuuaaagcuggca

SEQ ID NO: 420917 - RNA, 64 nt, Human
uuuuaauaagcaaucaccggagacuugguacccacugggacauuuuucugaugaucauugcugg

SEQ ID NO: 420918 - RNA, 64 nt, Human
ccaggaugcgcucagcagacauucacucuggcugcugggacaucagaaaacaaagucuucaucu

SEQ ID NO: 420919 - RNA, 64 nt, Human
gcacagcccaaccaggaggggucugccucccacgcugggacacagaccggccgcaugucugcau

SEQ ID NO: 420920 - RNA, 64 nt, Human
aauauagccacagaaauaaaggagggaccaauaucugggacagugucuucucagaaacaaccag

SEQ ID NO: 420921 - RNA, 64 nt, Human
aauauagccacagaaauaaagaagggacaacaaucugggacagugucuccucagaaacaaucgg

SEQ ID NO: 420922 - RNA, 64 nt, Human
aauauagccacagaaauaaaggauggagaaaaaucugggacagugucuucucagaaacaaccag

SEQ ID NO: 420923 - RNA, 64 nt, Human
aacauagccacagaaauaaaggauggagaaaaaucugggacagugucuucucagaaaccaccag

SEQ ID NO: 420924 - RNA, 64 nt, Human
caguccuaaaaguuuaaaauccgauaaggaauaucugggacaggguuuagaucaugacucuaca

SEQ ID NO: 420925 - RNA, 64 nt, Human
gcccggguccugccgggcugaccaucuccggauccugggacacucugccugaccaucuguguag

SEQ ID NO: 420926 - RNA, 64 nt, Human
accucgcugggcucuaagguacugugggguggaccugggacaagcaggccgcccucggacuagg

SEQ ID NO: 420927 - RNA, 64 nt, Human
cuaagucauugcaggaacggggcuguguucucugcugggacaaaacaggagcucaucucuuugg

SEQ ID NO: 420928 - RNA, 64 nt, Human
ggcccugaccacugugagcaggaggguggcagagcugggacaaagcugccuuugccgcugggcu

SEQ ID NO: 420929 - RNA, 64 nt, Human
agacucaggauucagaucagagguucgacuguggcugggacaggaguuguguguagaaauucac

SEQ ID NO: 420930 - RNA, 64 nt, Human
acauaagcccugaagugggcaggggaaauguacgcugggacaaggaccaucucugugcccccug

SEQ ID NO: 420931 - RNA, 64 nt, Human
caaauuaaaaaaaaauuguaucucauuacuuauacugggacaccauuaccaaaauaauaaaaau

SEQ ID NO: 420932 - RNA, 64 nt, Human
guauguuggccccuuucagccauggcuggaguggcugggacacaagacaccaagucccuaggcu

SEQ ID NO: 420933 - RNA, 64 nt, Human
uucccuccagucccuggaggggcuucuaguauuacugggacaaugaccacgcugccuguuuguc

SEQ ID NO: 420934 - RNA, 64 nt, Human
agagcaggggugaacuguagcuugaugcaguaaucugggacaagacugguugcuagcacauacu

SEQ ID NO: 420935 - RNA, 64 nt, Human
aguggaguagugggucccuggucuccuacaaauccugggacauuggauccccaagcugugccaa

SEQ ID NO: 420936 - RNA, 64 nt, Human
guguggucaugcaucauaaccaacauucacucaucugggacauucuuaagauacauuuauaaau

SEQ ID NO: 420937 - RNA, 64 nt, Human
uaccucagggacauggcacgggcaccugcucugucugggacagauacugcccagcacccacccg

SEQ ID NO: 420938 - RNA, 64 nt, Human
uucagauaccguccacagccaggaccgcugagaacugggacaguuuccugggaugagugccagc

SEQ ID NO: 420939 - RNA, 64 nt, Human
cagugggagcgacugagcaacaggaggacucagccugggacaggccccagagagucacacaaag

SEQ ID NO: 420940 - RNA, 64 nt, Human
cuaaaggccucugcuucuuacuggaucuucuuuccugggacauggugucguugggaagcuuacc

SEQ ID NO: 420941 - RNA, 64 nt, Human
gucuuuugggaggcgucuagcguuccugcuggcccugggacaaagacccagaauagaacucgua

SEQ ID NO: 420942 - RNA, 64 nt, Human
uuuuuuuuuuuuuggaacucaaucuguuaacagucugggacauccgguauaguaaccagaguuu

SEQ ID NO: 420943 - RNA, 64 nt, Human
ugcauccucccugggguggaggauggaaggaaagcugggacaagcagggaacgcaugauucagg

SEQ ID NO: 420944 - RNA, 64 nt, Human
acacacccccacacccacccacccacacacaacacugggacaauucagacacgacagcucaccu

SEQ ID NO: 420945 - RNA, 64 nt, Human
uagucuucuggagaaguauuuuugacauugagcucugggacaggacaccuuggguuuguggacu

SEQ ID NO: 420946 - RNA, 64 nt, Human
acaucacaggcugugccaacauguggggcgaguacugggacaaccucaucugcacgguaagggu

SEQ ID NO: 420947 - RNA, 64 nt, Human
gacacugguggggagcuggcaaugaaacccuguccugggacauggguuucauguucuuguacac

SEQ ID NO: 420948 - RNA, 64 nt, Human
augaugucagcuaccucugacccugcccuccagccugggacaauaaaagccuuuuuucuagacu

SEQ ID NO: 420949 - RNA, 64 nt, Human
acucucucagcugagucaggggacaccucaggcacugggacaguugggcauuuggaggcccgug

SEQ ID NO: 420950 - RNA, 64 nt, Human
gagccugaugugaaaggaccacggguguuguaagcugggacacggaagccaaacuggaaucaaa

SEQ ID NO: 420951 - RNA, 64 nt, Human
uauggaggaguucucuuaauaucagcaaggugaacugggacauucuucuuucucagaagaagaa

SEQ ID NO: 420952 - RNA, 64 nt, Human
gcgcaaggaucaagccgacuaccugugcugucuacugggacagcagucuccgagcuacuccgua

SEQ ID NO: 420953 - RNA, 64 nt, Human
uuuuaagaaauaauuaaugaggcuccucacucaccugggacagccugagaagggacauccacca

SEQ ID NO: 420954 - RNA, 64 nt, Human
uugggugugauugagugcccuccuggcuccugggcugggacaagugaggaacuagcugcagagg

SEQ ID NO: 420955 - RNA, 64 nt, Human
cacccacagcugaccggcucgguggaggacacuccugggacaggucucuuugucagugaacaag

SEQ ID NO: 420956 - RNA, 64 nt, Human
agggaaacagcuggcaaugugacaaaagucuuuucugggacaacaaucaaaucauguauuugua

SEQ ID NO: 420957 - RNA, 64 nt, Human
guugagacaucugauggacuuggcuuaggcccugcugggacaucccacgugugaucccuuucac

SEQ ID NO: 420958 - RNA, 64 nt, Human
agguaagagguguagagcuguucccaccagggcucugggacagacuggaaaggaccacagaccu

SEQ ID NO: 420959 - RNA, 64 nt, Human
gauuuaugccagagccuugcaggauggagcaccucugggacaacuaagagccaaggcccaccaa

SEQ ID NO: 420960 - RNA, 64 nt, Human
gccagaauccacagacacaccuaagccuguggcacugggacagaauagauuuuccauuugagag

SEQ ID NO: 420961 - RNA, 64 nt, Human
ccaccauucacugaguagcuaauggguuuggggccugggacauuccaucugagguccuuccuga

SEQ ID NO: 420962 - RNA, 64 nt, Human
ggccauccaguccugaguggucacccuggggguccugggacacaccucaguaaagagcaaaggc

SEQ ID NO: 420963 - RNA, 64 nt, Human
gagguccugggacuccaaguucagcgcuccaggucugggacagggccugcaugcagucaggcug

SEQ ID NO: 420964 - RNA, 64 nt, Human
agaagacgauuagaccauuugguccuagagucugcugggacagaguccuguaaucagugcaugu

SEQ ID NO: 420965 - RNA, 64 nt, Human
ugugaagugaauacaacauugaacaguuacagaucugggacagucccuucuaugaaagugcuga

SEQ ID NO: 420966 - RNA, 64 nt, Human
caucauuguuuaaauuuuggcuggaugccaaacccugggacaugaacaauuuucauguguaagg

SEQ ID NO: 420967 - RNA, 64 nt, Human
ccccaccuucuacuuggguagcugggcugggacgcugggacaggaccccguccuccuucaugac

SEQ ID NO: 420968 - RNA, 64 nt, Human
accuauucagagccuuuuuguccuugucaacagacugggacagugucugauucccccuucaccc

SEQ ID NO: 420969 - RNA, 64 nt, Human
ucauggcauucuccugccucagccuccagagcaacugggacaacaggcgcccgucaccacgccc

SEQ ID NO: 420970 - RNA, 64 nt, Human
agaaaccuacaacagaugcuugauguuguagaaacugggacauauagauaccaagcaaaauuau

SEQ ID NO: 420971 - RNA, 64 nt, Human
ucacaggcagacucgcagacggggcagugagcgucugggacagugccaagagugggguguguga

SEQ ID NO: 420972 - RNA, 64 nt, Human
cggguaaucuacuucuaagccuuaagaauauucccugggacacagacacuauaauuggaagugc

SEQ ID NO: 420973 - RNA, 64 nt, Human
cagaaagucugauuagacuaaagagauauuucuucugggacagccgccuucuugguaauuuuga

SEQ ID NO: 420974 - RNA, 64 nt, Human
ccuugcaaagcaacuagugggugcuugagagacacugggacacugucagugcuagauuuagcac

SEQ ID NO: 420975 - RNA, 64 nt, Human
auguauauaccauguauaugacaggauguuuguccugggacacccaccagauuguacauacugu

SEQ ID NO: 420976 - RNA, 64 nt, Human
cucauuauggugaucauagaauugaccauccaaacugggacacucuugagaguaaauggagggc

SEQ ID NO: 420977 - RNA, 64 nt, Human
cuguguauacuguguaugggcacacugggacuagcugggacaauuccuagagauucaacugccc

SEQ ID NO: 420978 - RNA, 64 nt, Human
acucaggaggcugaggcgagagaaucgcuugagccugggacauugaggcugcagugaacuguga

SEQ ID NO: 420979 - RNA, 64 nt, Human
caggaggucugguccgagucucagcccugaccuucugggacaugguggacagucaccuauccac

SEQ ID NO: 420980 - RNA, 64 nt, Human
uggccaccacagccagacugaacguuugugaaagcugggacaucccaccacacgcugagccaga

SEQ ID NO: 420981 - RNA, 64 nt, Human
ucaugcuccagggucacccuggccagcucuugugcugggacaggggauuacaccaucucuguuc

SEQ ID NO: 420982 - RNA, 64 nt, Human
cuucugagaagcagggugaauaaaguuuagggagcugggacaccugguccugcuagcuggacca

SEQ ID NO: 420983 - RNA, 64 nt, Human
ccuggcuacgccggcucuucgguggcaacacuaccugggacacugccuccccagucaccaaggg

SEQ ID NO: 420984 - RNA, 64 nt, Human
acccagcuuuggccccaugccccuguaggucccucugggacagucaccgcugggguccuggcug

SEQ ID NO: 420985 - RNA, 64 nt, Human
ggccuggcugaguuuggcagggccugggccaucccugggacaaaggugcgucccuucagcucuu

SEQ ID NO: 420986 - RNA, 64 nt, Human
acuccuccaaaccccaaaccccaaacggaaaucucugggacaauggcuccuccagagggccccu

SEQ ID NO: 420987 - RNA, 64 nt, Human
cugguucugacacuuucugcuggaagcugucaggcugggacaggcuuugauuuugaggguuagc

SEQ ID NO: 420988 - RNA, 64 nt, Human
aucagcagaccacguauuuaaaauucugaaucuucugggacaggguuguaacucagccuuccaa

SEQ ID NO: 420989 - RNA, 64 nt, Human
aucuacuccuaaugcccaacagcaucacggcacucugggacaggcacggaggacggcgugggca

SEQ ID NO: 420990 - RNA, 64 nt, Human
ggaccaggguggaggaauagacuucuaguucauucugggacacuugagccagagaguugaaagc

SEQ ID NO: 420991 - RNA, 64 nt, Human
cacacacacaaacacacacacacacacacacacucugggacaagauuccuuugauuaccugguu

SEQ ID NO: 420992 - RNA, 64 nt, Human
uaaaauugauaaauccuaaagaggaagaaaagagcugggacaauaaaacacuggcucuggaauc

SEQ ID NO: 420993 - RNA, 64 nt, Human
ugugacugcuuagccccuaaauaugguaacuacucugggacaauaugggaggaaaagugaagau

SEQ ID NO: 420994 - RNA, 64 nt, Human
cugcggcagagccgaggacgcuggguccuccucucugggacacagggguacucacgaaaacugg

SEQ ID NO: 420995 - RNA, 64 nt, Human
cuugugucuggagaauagucucauaccuugcagucugggacacccucccuacuuugagaaucca

SEQ ID NO: 420996 - RNA, 64 nt, Human
gaggggcaugggcccaggcccaucagccucccugcugggacagggaccuauggcaccugggggc

SEQ ID NO: 420997 - RNA, 64 nt, Human
cuauuagggaugagauacagacaaggauagcuaucugggacauuauuggcagugggcccuggag

SEQ ID NO: 420998 - RNA, 54 nt, Human
cucagcccagugacacuuaggccccugggacaaugacccagaagacagccaugc

SEQ ID NO: 420999 - RNA, 64 nt, Human
guggaugugggaaggagaucaacuucuccucacucugggacagacgauguauggaaacuaaaaa

SEQ ID NO: 421000 - RNA, 64 nt, Human
cuguuucccagccaggcccagccacccaggacuccugggacaucccaugugugaccccucugcg

SEQ ID NO: 421001 - RNA, 64 nt, Human
gcagagugguggccagaggggagaggugcucccccugggacaggagggugggcuggugggcaaa

SEQ ID NO: 421002 - RNA, 64 nt, Human
uguaagaaccugcccccgcaaaacucuggagucccugggacacacccuauccaagaagacccag

SEQ ID NO: 421003 - RNA, 64 nt, Human
gucaggagagaggugcagggaggaaggccuugugcugggacaaccucucucuugccuuaccuca

SEQ ID NO: 421004 - RNA, 64 nt, Human
gccaccaagagacagcaaugacauguacagccaucugggacaugccugucuuccuaauaccauu

SEQ ID NO: 421005 - RNA, 64 nt, Human
cugcugagauagccccuacccccaccuccacaggcugggacagccccguccccaccauccuccu

SEQ ID NO: 421006 - RNA, 64 nt, Human
acguuccuaccacagggccacagcccacacagcccugggacacugcccuggcccuccauacucu

SEQ ID NO: 421007 - RNA, 64 nt, Human
ucggugcgcuacgcaggacgccgccucacgcaagcugggacacugcugggcacggcccuggcgu

SEQ ID NO: 421008 - RNA, 64 nt, Human
agagagcccagugugacuagggauccugaguuuucugggacaauuccagcuuuaaucaauacau

SEQ ID NO: 421009 - RNA, 64 nt, Human
aaaauuuaugacccaaauacaaaucucaauuugacugggacagaaugaggaauggagauuuuug

SEQ ID NO: 421010 - RNA, 64 nt, Human
gcccucaauguuuauauuguguuaucuguugggucugggacauuuaguuuaguuuuuuugaaga

SEQ ID NO: 421011 - RNA, 64 nt, Human
uacuugagacaucaaaaagaagcagcaagagcuucugggacagagacugcuuggccagcuuugu

SEQ ID NO: 421012 - RNA, 64 nt, Human
ucuaaaugaggagcuugauuucuugaucacaaaacugggacaucuccuagagucaaaagaaaac

SEQ ID NO: 421013 - RNA, 64 nt, Human
aauuaaugucucaaagcugugcagucuuuuguuacugggacacuuuuaaacucugaauaggcau

SEQ ID NO: 421014 - RNA, 64 nt, Human
caaaacuuagugugaaacagagcacuugcagagccugggacaaccuccuuauugaagggaagag

SEQ ID NO: 421015 - RNA, 64 nt, Human
ugguggccagucguauaccaucccuggaaggauucugggacaauauuccagggauucauugacu

SEQ ID NO: 421016 - RNA, 64 nt, Human
caucauguaucacuuuuuucuuaaauaaagaagccugggacacaguagauagacacacuuaucu

SEQ ID NO: 421017 - RNA, 64 nt, Human
uccugcccaggaucuccucuuaggguagaagucucugggacaucccugggguguguguguagau

SEQ ID NO: 421018 - RNA, 64 nt, Human
cgacccccucagcuaacaacaguucugaagggugcugggacaggacaggcucauggggacucca

SEQ ID NO: 421019 - RNA, 64 nt, Human
uuuucuuuuuacccucugagaaacaugaaucccacugggacagaugggaagaacacccuucucc

SEQ ID NO: 421020 - RNA, 64 nt, Human
gaccauaggucaccccagauuccuugaccuauuucugggacaccauauuucccuccucagugug

SEQ ID NO: 421021 - RNA, 64 nt, Human
agaucacuguggccacacuuugcugaaagagaugcugggacauagaaccucuuaucugggcagu

SEQ ID NO: 421022 - RNA, 64 nt, Human
uggauaauaagcuggggaagugaggacuguccugcugggacaacuaagaagagagaauguggac

SEQ ID NO: 421023 - RNA, 64 nt, Human
ugcuccccucuggucaccgacaccccuguccucgcugggacaagagggagacaauucuagucac

SEQ ID NO: 421024 - RNA, 64 nt, Human
cacuacucauuauuuuuguacauuuuuguauauacugggacagcgugaaacacuggaauccuuc

SEQ ID NO: 421025 - RNA, 64 nt, Human
gggcugcccaccaggugugcugggcagacuucagcugggacagaaguccgaucucccuagggcc

SEQ ID NO: 421026 - RNA, 64 nt, Human
aucaaacacaggugcacucagcugcccagggccucugggacacuugccuugacuugcaacuugc

SEQ ID NO: 421027 - RNA, 64 nt, Human
ugaugcucccggauggaguggagaaacuaggagacugggacaagcaaaaggcugcaaacaaccc

SEQ ID NO: 421028 - RNA, 64 nt, Human
cagaaggaggugcuugcagggccucucgcugcuacugggacauccacaggaccuaauguuuaug

SEQ ID NO: 421029 - RNA, 64 nt, Human
cccaccagauuccuccgcgggagguggcccucagcugggacaguggggacccaggcuucuccuc

SEQ ID NO: 421030 - RNA, 64 nt, Human
auggaacccugacccuggggaaagacgccuucaucugggacaaaacuggagaugcaucgggaaa

SEQ ID NO: 421031 - RNA, 64 nt, Human
ggcacuaguauuucuaugaaauauuauguuaaaacugggacaggggagaaccuagggugauauu

SEQ ID NO: 421032 - RNA, 64 nt, Human
gagggccgacuggggccaggcucaggggcagaggcugggacacaaggggcuggcgagggcugcg

SEQ ID NO: 421033 - RNA, 64 nt, Human
gcagacucggacuucugagccugcagagcaggaccugggacaggaaagagaggaaccaauaccu

SEQ ID NO: 421034 - RNA, 64 nt, Human
agggcuaggaauagaagucuuuugaucccagucccugggacaguuuuguaugcuguaucuugua

SEQ ID NO: 421035 - RNA, 64 nt, Human
auggggaaagaccaauccaacuguccaucuguggcugggacagcccagggggugugcccacggc

SEQ ID NO: 421036 - RNA, 64 nt, Human
gaagcuggcccauugaaagagccucuuaaggcagcugggacagaggccugguggcccugcuggg

SEQ ID NO: 421037 - RNA, 64 nt, Human
uccgacuuccuuacaggaugaggcugggcauugccugggacagccuauguaaggccaugugccc

SEQ ID NO: 421038 - RNA, 64 nt, Human
accaacccucuuccuccccgucauuguacuguaacugggacagaagaaauaauggggauaugug

SEQ ID NO: 421039 - RNA, 64 nt, Human
cugagcuuuccuccucagagccaugcuggcagcccugggacagagaacgguguggcuuuggcug

SEQ ID NO: 421040 - RNA, 64 nt, Human
ccucagauuuggagaugguaaccaaaggaagcagcugggacagguggagaaggaaguaggaaug

SEQ ID NO: 421041 - RNA, 63 nt, Human
cauuaaguauucacuuuuagaguaaaauccaucccugggacauaaagaaaaaaauauuagaga

SEQ ID NO: 421042 - RNA, 64 nt, Human
ugccuucaccaguagcuggugccaggacagagcucugggacagcaggcagaggccgagccuggg

SEQ ID NO: 421043 - RNA, 64 nt, Human
gugcucuucuggaagugagaucugccuguccgggcugggacagagacuccccaaggaccccauu

SEQ ID NO: 421044 - RNA, 64 nt, Human
aaaagcaaaccuucuaccuccuaccuacuuuucucugggacaaggauaaaggaauaugauuuuc

SEQ ID NO: 421045 - RNA, 64 nt, Human
cagcaauucagaccccuuugagagacgccacucccugggacacagacccaggacccccgagggg

SEQ ID NO: 421046 - RNA, 64 nt, Human
ucaucacugcaaucagcaugaacaccaggcaccccugggacaccuaacgcccaguucccgugac

SEQ ID NO: 421047 - RNA, 64 nt, Human
ucauuugcacccauagcccccaucuauggacaggcugggacagaggcagauggguuagaucaca

SEQ ID NO: 421048 - RNA, 64 nt, Human
aggcauuguguguuuuguuccgggacugguuuggcugggacaaaguuagaacugccugaaguuc

SEQ ID NO: 421049 - RNA, 64 nt, Human
uaucuuugggaagccaugugucugguuugucgugcugggacagucaugggacugcaucuuccga

SEQ ID NO: 421050 - RNA, 54 nt, Human
uccaucaagcuuuucaguaggauucugggacauggauucauuacagaaauguau

SEQ ID NO: 421051 - RNA, 64 nt, Human
gcaaugagaacaaagacacaacauaccagaaucucugggacacauuuaaagcaguguguagagg

SEQ ID NO: 421052 - RNA, 64 nt, Human
aaguuacccucuggggugaggcuauuccagcgagcugggacauuuccccaugggggcccacucc

SEQ ID NO: 421053 - RNA, 64 nt, Human
ccacugaacuccggggaccucuacugacugcuugcugggacagucaccaggguuggggggaagg

SEQ ID NO: 421054 - RNA, 62 nt, Human
ccagccccucacccagcuaggcagccacagaccugggacaccucagccagcuugcccacccu

SEQ ID NO: 421055 - RNA, 64 nt, Human
uggcucugaugccuuugccacacuccucgcaucucugggacaucccuuccgcacucucucccug

SEQ ID NO: 421056 - RNA, 64 nt, Human
ugguggugaauucuguuucuuuccuuuccuaaggcugggacauggugggcaucagggacuuugu

SEQ ID NO: 421057 - RNA, 64 nt, Human
cccagugccuucugggaagggagagggccucugccugggacacugcgggacagaggguggcugg

SEQ ID NO: 421058 - RNA, 64 nt, Human
agauguccucaccccuccucacugccucuccucucugggacaggcugggaccuuugaggaagau

SEQ ID NO: 421059 - RNA, 64 nt, Human
cccggcccugcccucagcgagcccggcaggcguccugggacagcucaguguuggagggccaccu

SEQ ID NO: 421060 - RNA, 64 nt, Human
gcccuguuccgccucacuggguguggccuggcuucugggacaggcaccaugcugggccggggug

SEQ ID NO: 421061 - RNA, 64 nt, Human
ccuagccagggaccggacaccugccccgcccaggcugggacaggcugcaggucucaggauaugc

SEQ ID NO: 421062 - RNA, 64 nt, Human
acgcagccuccauauuuggugcacucaggcauggcugggacaagccagcugccccaggguucuu

SEQ ID NO: 421063 - RNA, 64 nt, Human
uaacuguauucuccaggcagcacaugcgguggcucugggacauuggugggagaaaguccuuuug

SEQ ID NO: 421064 - RNA, 64 nt, Human
aauuuacaggcuggaacagaugagagcccuccugcugggacagagaauuggguucuaguggacu

SEQ ID NO: 421065 - RNA, 64 nt, Human
uuuaauagaauauacugucuugucucacuuuggacugggacaguggaugcccaucuaaaaguua

SEQ ID NO: 421066 - RNA, 64 nt, Human
gaccuggaguggacuagaaucggggcugcuggaacugggacagcugccuguggcucagagccuu

SEQ ID NO: 421067 - RNA, 64 nt, Human
accuugagugugcuuugggaaccaaauggaccuucugggacaagcugagcaagcuguaugaacg

SEQ ID NO: 421068 - RNA, 64 nt, Human
cacugggaccaggccuccuguuguggagggacuccugggacaguccuccacccuguccuguggu

SEQ ID NO: 421069 - RNA, 64 nt, Human
ugucccuuccccucucuggcccucaguuuccccacugggacauugugugcugcaaagccauugg

SEQ ID NO: 421070 - RNA, 64 nt, Human
uguuaaggcuguuuugcuuggagaagacuugggacugggacagucuuuagauauuauuugaaau

SEQ ID NO: 421071 - RNA, 64 nt, Human
ggcauuuaaaacuuugaaugaauuauaccuaaaucugggacagggaggugacaguggaacaggc

SEQ ID NO: 421072 - RNA, 64 nt, Human
accccaccccuaggaacccccagggaaaaccaggcugggacagcccccuguuccugagauggaa

SEQ ID NO: 421073 - RNA, 64 nt, Human
ggccuggcugucgucccuccucagcuucuuguuccugggacaagggucaagccaggaugggccc

SEQ ID NO: 421074 - RNA, 64 nt, Human
ccccugguucccacucuucccaagccucccgggacugggacauguuugcaauaaaggaaagguu

SEQ ID NO: 421075 - RNA, 64 nt, Human
acacgggcagcucaggucagccuguugguagaugcugggacagcauuagaagagggucuuuuug

SEQ ID NO: 421076 - RNA, 64 nt, Human
uggaaacucagaugugucacucagacucaacuugcugggacacugacaggcguuccugagguuu

SEQ ID NO: 421077 - RNA, 64 nt, Human
cuccucugucaucacagcgccagggcagcugugccugggacaggagccacacagucagaggggg

SEQ ID NO: 421078 - RNA, 64 nt, Human
cccuucccccagugagaaggaaaaugggauaagucugggacacuguuucaguucaauaaagagg

SEQ ID NO: 421079 - RNA, 55 nt, Human
ccaccgacggggacugcugagccuccugggacagcgggcuggcagggacuggcag

SEQ ID NO: 421080 - RNA, 64 nt, Human
gaggcagaggcagcuggagcgccguucucuccugcugggacaccgcuugggcuuugguauugac

SEQ ID NO: 421081 - RNA, 64 nt, Human
gccccgcugggccucugagugccagcgcagucugcugggacaugcacauaucagggguuguuug

SEQ ID NO: 421082 - RNA, 64 nt, Human
uagcuacuuucauuggauugacccuacaacugcccugggacauuucacuguaccaguauuaacu

SEQ ID NO: 421083 - RNA, 64 nt, Human
gaacaucucccuuccagcaucugcugguagcaggcugggacagucccuuccuucccugaaaccc

SEQ ID NO: 421084 - RNA, 64 nt, Human
agagggcaacuggaugacucgcaguaccacagcacugggacagacagaagccacaccuuucuuu

SEQ ID NO: 421085 - RNA, 64 nt, Human
cuuaggaggagacagaguucccucuguauagccucugggacaagaaaaagaaaacacaagaaug

SEQ ID NO: 421086 - RNA, 64 nt, Human
gcuguuuccaguugaacaacucaugaaaucugcucugggacauuuugggggaaucucaaagucc

SEQ ID NO: 421087 - RNA, 64 nt, Human
uuggauagcuaauaaugagcuauuaaaacucagccugggacaguuuaucaugaagccuguggau

SEQ ID NO: 421088 - RNA, 64 nt, Human
cagcaggucggucuagagaguugcgaaucuaaaccugggacaggcuggggccaggaggcagaaa

SEQ ID NO: 421089 - RNA, 64 nt, Human
ccccauaggcagagccccagggcagacagaaccucugggacacacaccaagggcacuccugcag

SEQ ID NO: 421090 - RNA, 64 nt, Human
gguuucccaggacauggaacuuucaaugcuaaaacugggacaguacccagcaaguggggauggu

SEQ ID NO: 421091 - RNA, 64 nt, Human
cauugcaagggugccacacaaugucuuguccacccugggacacuucugaguaugaagcgggaug

SEQ ID NO: 421092 - RNA, 64 nt, Human
guguccccuguccucuugaugucacccuccgcuccugggacacgugcucucucugucucugggu

SEQ ID NO: 421093 - RNA, 64 nt, Human
ccuagcccccuuccuggauggaggcuugagggcccugggacaugugcuaucugauaagauuggg

SEQ ID NO: 421094 - RNA, 64 nt, Human
gcugagaagggaaggguauccuuuucccacaguucugggacaaauaaaggggcuuccuuuggua

SEQ ID NO: 421095 - RNA, 64 nt, Human
gacccugaguuuuaaauucgaaaauaaaguggggcugggacacacgaccuccugagccuccgug

SEQ ID NO: 421096 - RNA, 64 nt, Human
cagucaguugcuugcuuauuuuuucuggaugagucugggacacacuguaacuuuaacacauuua

SEQ ID NO: 421097 - RNA, 64 nt, Human
aguguaagugcaaaucaguggaaggagcggcaaacugggacaugcagaauugaauuugcucaaa

SEQ ID NO: 421098 - RNA, 64 nt, Human
uauugcuaaguuuucuuuucuggcuuguguuuuucugggacaguuuagaauugggaggccuauu

SEQ ID NO: 421099 - RNA, 64 nt, Human
guaauuuagagacacuuaauuuuguuaauccugucugggacacuuaaguaacaucuaaagcauu

SEQ ID NO: 421100 - RNA, 64 nt, Human
cagaucagaucaagcauucuuucuauuuuauuaucugggacauauuuaaauacaaacauauuca

SEQ ID NO: 421101 - RNA, 64 nt, Human
ccuguaguauuucagggaccgugggaccccuuugcugggacaguuauuucaagaguaugacucu

SEQ ID NO: 421102 - RNA, 64 nt, Human
accauagggacuucaccaauggauuacaugccaucugggacaggccaugugggagaccccaguu

SEQ ID NO: 421103 - RNA, 64 nt, Human
ggucugucauagaauggggacauuagacugaaaacugggacaacccccuuccuuauuuuauaga

SEQ ID NO: 421104 - RNA, 64 nt, Human
ccaggcguccuaagagaauccacccucucuggcccugggacauugcaagcugcuacaaauaaau

SEQ ID NO: 421105 - RNA, 64 nt, Human
uucugaaacacucuuguugcgaucgcuaaccucacugggacagagaaccgcagucuuucgagaa

SEQ ID NO: 421106 - RNA, 64 nt, Human
augauguuacagacuuacguauacccuuguauaccugggacagggcuguuuuauaccaauaaac

SEQ ID NO: 421107 - RNA, 64 nt, Human
aaacaaccguuggaaacauaaccauuacagggagcugggacacuuaacagaugcaaugugcuac

SEQ ID NO: 421108 - RNA, 64 nt, Human
gaaacgugucauugguggaggucugaaugugaggcugggacagagggagagaacaaggccuccc

SEQ ID NO: 421109 - RNA, 64 nt, Human
gagcaggggugcugggaccuggggcacugugggacugggacacuuuuauguuaaugcucuggac

SEQ ID NO: 421110 - RNA, 64 nt, Human
aucugaaguagagaucagcaggaagccuugcugccugggacauagagaucaucuggccaccccu

SEQ ID NO: 421111 - RNA, 64 nt, Human
agcacucccaggacaguggagucagcaguaagcccugggacagguggcaagggugggucccuug

SEQ ID NO: 421112 - RNA, 64 nt, Human
acugaggccccagguguccucccucccccacugucugggacacaggacagguguugcgucugac

SEQ ID NO: 421113 - RNA, 64 nt, Human
ggcaucacagccccaaggcugggggaacuucaugcugggacaagcagcccaucaacgccauggg

SEQ ID NO: 421114 - RNA, 64 nt, Human
ggcugagggaacucugcuaugugauggggacuuccugggacaagcaaggaaaguacugaggcag

SEQ ID NO: 421115 - RNA, 64 nt, Human
gacugcuucucugagagaacuugcccaucaggggcugggacauggggguguggguaaagacagg

SEQ ID NO: 421116 - RNA, 64 nt, Human
gaaagccugugguuucacuuauuuauauaacucacugggacauugccaaaugaguaagcacuua

SEQ ID NO: 421117 - RNA, 64 nt, Human
ugcagagacuuccugccuggaacucaucugugaacugggacagaagcagaggaggcugccugcu

SEQ ID NO: 421118 - RNA, 64 nt, Human
ggcucuuggacacugccuugggagcauccugcagcugggacagaggccagcuccuguugggcuc

SEQ ID NO: 421119 - RNA, 64 nt, Human
ggaggcagcacugagccagcaccacacguccauccugggacagacgggccuggacuucacggca

SEQ ID NO: 421120 - RNA, 64 nt, Human
gaaauccuaguuuccucuccuucguaucccgagucugggacacaaaacuccgcccccagccuau

SEQ ID NO: 421121 - RNA, 64 nt, Human
aggaguaggggaagccuggagccccacuccagcccugggacaacuugagaauucccccugaggc

SEQ ID NO: 421122 - RNA, 64 nt, Human
gccguuucuccuugguagcgugcacgguguugaacugggacacuggggagaaaggggcuuucau

SEQ ID NO: 421123 - RNA, 64 nt, Human
guggaugggggugaugcagggacugaggggaacccugggacaggcacaggcugggcagaggcac

SEQ ID NO: 421124 - RNA, 64 nt, Human
uaucuaauuccauuaggguucacgucuuuucuuucugggacacuauccuacuauauccauaucu

SEQ ID NO: 421125 - RNA, 64 nt, Human
agcagaggggcugggaaagagggggcaggggcugcugggacacugagcaggagggaggccugag

SEQ ID NO: 421126 - RNA, 64 nt, Human
cuggaaggggaagcaguccuuagguuuugcugugcugggacaguggcaggggacccacaggggu

SEQ ID NO: 421127 - RNA, 64 nt, Human
aauuuaugaaguuauggcaaugaacugcagcaugcugggacaauuauuugacuacuuuuuuuug

SEQ ID NO: 421128 - RNA, 64 nt, Human
ccagagaggacaggcuuucuggaggaaucaggcccugggacagccucugagcuccugggggugu

SEQ ID NO: 421129 - RNA, 64 nt, Human
acccucccuuaggaaugaggagugggcaucaggccugggacacugcucuccuuccccgccccca

SEQ ID NO: 421130 - RNA, 64 nt, Human
aggaggaggggauuugcugagggccaaggggguucugggacagagucuggaaagcuggucuuca

SEQ ID NO: 421131 - RNA, 64 nt, Human
agugaccuugggaagccgaagcugcuuacaguagcugggacaagcugaaagucagacuaagaaa

SEQ ID NO: 421132 - RNA, 64 nt, Human
gugcugucacugcagaaggccagauggcaggugccugggacaggggcaggugccccggggaggg

SEQ ID NO: 421133 - RNA, 64 nt, Human
cuauauuaacauuacuauuuauuuuguuuuggaacugggacaugauucuauuuguuauaaaaua

SEQ ID NO: 421134 - RNA, 64 nt, Human
aauaugucauuguuuucuugacuaugucucucuucugggacauuuaguaguguuugguauguuu

SEQ ID NO: 421135 - RNA, 64 nt, Human
ggcaagauacaacagcugccgaccgaacauggcccugggacacccacagcugcagcaggugacc

SEQ ID NO: 421136 - RNA, 64 nt, Human
cuuugucauauagcacagaaguccuccacacugccugggacaguguccugcauccacacaguag

SEQ ID NO: 421137 - RNA, 64 nt, Human
acaauggaaaauagaggauaccaacuguaugcuacugggacagacuguugcauuugaauuguga

SEQ ID NO: 421138 - RNA, 64 nt, Human
gcugaggaauuuccuggcuuccccagauaguguccugggacaugguaugcuuuggggcuggggu

SEQ ID NO: 421139 - RNA, 64 nt, Human
aggagcuggggcuuguggagggcauccucucagucugggacaacaguucuccagcuucuacgcu

SEQ ID NO: 421140 - RNA, 64 nt, Human
augggcucucucugccccaggaugaucuucugugcugggacagggacucugccucuuggaguuu

SEQ ID NO: 421141 - RNA, 64 nt, Human
ggguggaaagcuugaggggaguaggguuccagcucugggacauugugcucaggaauuugaaaac

SEQ ID NO: 421142 - RNA, 64 nt, Human
acauguauuuugaaacacugaagagcaaaaggggcugggacacucugaacuccugcacucucca

SEQ ID NO: 421143 - RNA, 64 nt, Human
cuccacuugcccaaacugccaaaagcuggugauucugggacaggccuucacuuuggagccacgg

SEQ ID NO: 421144 - RNA, 64 nt, Human
gggcucugaccacaaacuccccuccaggcugccccugggacaugguggugaugugggugcagga

SEQ ID NO: 421145 - RNA, 64 nt, Human
cgugccuucuccacgguaucuccuggccaggcugcugggacagccgccgccucugcauguacca

SEQ ID NO: 421146 - RNA, 64 nt, Human
uuccuuuaauaccaaguaucauuugguuaucuuacugggacauuuucauugauauucuauacac

SEQ ID NO: 421147 - RNA, 64 nt, Human
gugugaugugauauagucuuugucuuucaugcugcugggacagaaaagacccgacauugcuuca

SEQ ID NO: 421148 - RNA, 64 nt, Human
aaucugcugccugaaauaaaaccauuaggacucacugggacagaacuuucaaguuccuucaacu

SEQ ID NO: 421149 - RNA, 64 nt, Human
agguaaaagaccaucagguuguuuuuuuccacaucugggacacaguuguuuguguaggaacaua

SEQ ID NO: 421150 - RNA, 64 nt, Human
uucacguuccccaucugucuucagagaaaaagagcugggacaccaagaacaagcuguuagauca

SEQ ID NO: 421151 - RNA, 64 nt, Human
agcgccaacgccuagagcccuuccgccagcgccucugggacaguggcccugagcccaccccuuc

SEQ ID NO: 421152 - RNA, 64 nt, Human
gucuuugagaggggccugaagagccuccgggcuccugggacauugauguagaguuuuuagugaa

SEQ ID NO: 421153 - RNA, 64 nt, Human
uagaugguugccaaucagccaaugcagacuuucacugggacaacaagaaagcagaucuucuggg

SEQ ID NO: 421154 - RNA, 64 nt, Human
gcucauaaugaggcaucauauauccucucacucucugggacaccauagccacugcccccucccc

SEQ ID NO: 421155 - RNA, 64 nt, Human
caugagacuaaccuuccucugggccugaccaucucugggacagaggcaagaauccccaaggggu

SEQ ID NO: 421156 - RNA, 64 nt, Human
caaaucaaugucuugaauccuuugaaaacaggcacugggacaucacaggcuucaguaccugacc

SEQ ID NO: 421157 - RNA, 64 nt, Human
gccacaauccaccaucauccugacgaucccacaacugggacagaggcuacaucugcccuaggga

SEQ ID NO: 421158 - RNA, 64 nt, Human
gugaucuccccucacacuuugccauuugcuuguacugggacauuguucuuuccggccaaggugc

SEQ ID NO: 421159 - RNA, 64 nt, Human
ugucccuucccuuuacucaugccgaaacuaucaacugggacauuuugugcuuuugguuuaaaag

SEQ ID NO: 421160 - RNA, 64 nt, Human
ccgcccuccuuccccagggcuccuucucagaaaccugggacauaaauuggccccugagucgauu

SEQ ID NO: 421161 - RNA, 64 nt, Human
gcuuuccuccuuugcccugcaguagcaacuggugcugggacaaguugacccaccucucacaguc

SEQ ID NO: 421162 - RNA, 64 nt, Human
gggcaagagcauguacaaacaugcucagaacuugcugggacagugugggugggagaccagggcu

SEQ ID NO: 421163 - RNA, 64 nt, Human
gcuugugcugagacugacccaagugcagcuagcacugggacacagauccuugucuucagcaccu

SEQ ID NO: 421164 - RNA, 64 nt, Human
agguggcaucugccuuacugccuucccugaggagcugggacaugcugggcaguugucagaugua

SEQ ID NO: 421165 - RNA, 64 nt, Human
uuaauagcucuucuacccuugaaggugacugguccugggacaguuagaaucuuucagguuuacc

SEQ ID NO: 421166 - RNA, 64 nt, Human
gagaaggagccggggaccagcuugaagacuggcucugggacacacugaccauugugaaauucag

SEQ ID NO: 421167 - RNA, 63 nt, Human
cccaggagagccgccucugaugcccccaucccacugggacauuuagcaaggagguucagcccc

SEQ ID NO: 421168 - RNA, 64 nt, Human
uagauuuagacaaauguuaaggaaccauacuucucugggacagcauggcauauagugauauaug

SEQ ID NO: 421169 - RNA, 64 nt, Human
uguggcuuaucuaguuagaacuuagcagacuuuacugggacaaguuuacugcucuuguaggagc

SEQ ID NO: 421170 - RNA, 64 nt, Human
gccacagugggggaagaggggaaguuaggcagcccugggacagacgagagggcuccucgcuguc

SEQ ID NO: 421171 - RNA, 64 nt, Human
agcugguuuuaaguggaacugcccuacugggagacugggacaccuuuaacacagaccccuaggg

SEQ ID NO: 421172 - RNA, 64 nt, Human
agccacagcgcgggccuugugcuggaguuugagccugggacagggagagggaggcuuggagaca

SEQ ID NO: 421173 - RNA, 64 nt, Human
aaggaagaugccuuucaagccucacugggccucucugggacauggccaccugaccugugugugg

SEQ ID NO: 421174 - RNA, 64 nt, Human
uuuuuucuguagugcuguauuauuuucaauaaaucugggacaacagccuugccugugucaucuu

SEQ ID NO: 421175 - RNA, 64 nt, Human
aaugugauuuuucccagauuuguuuacauguucccugggacagauccaggucugcagaucgaca

SEQ ID NO: 421176 - RNA, 64 nt, Human
caccagcaagcaacuaaggagauucaggaugcagcugggacaagcagggauaaaaaagaauuua

SEQ ID NO: 421177 - RNA, 64 nt, Human
gcucaggcagcuaagggaggacgccugcccacgccugggacagaaggcuucacugcuaaucaca

SEQ ID NO: 421178 - RNA, 64 nt, Human
ugcucuucagcggcucccugaaggccaucaaggucugggacaucgugggcacugagcugaaguu

SEQ ID NO: 421179 - RNA, 64 nt, Human
accuguacagcggcuccuaccagacaaucaagaucugggacauccgaacccuugacugcaucca

SEQ ID NO: 421180 - RNA, 64 nt, Human
gccggccuaggugucccaggugccccgccuuucucugggacacaguugggggcuggcuucugag

SEQ ID NO: 421181 - RNA, 64 nt, Human
ccccagguuucuauguguagggcgggaggauguucugggacacaguucaauucucauuugucac

SEQ ID NO: 421182 - RNA, 64 nt, Human
acauagugaggggucagcaaaugucagaaguuaccugggacagccgggcacgauggcucacacc

SEQ ID NO: 421183 - RNA, 52 nt, Human
agugcagcugcugcgccugaugcugggacagccccgcucccagauguaaaga

SEQ ID NO: 421184 - RNA, 64 nt, Human
uuguuucugaaagggacgcuacccgggaagggggcugggacaugggaaaggggaaguuguaggc

SEQ ID NO: 421185 - RNA, 64 nt, Human
auaggagcaggauuuccccuggggaaaaguucuccugggacaucuucugcucuucuguacauuu

SEQ ID NO: 421186 - RNA, 64 nt, Human
agggucuggcacauccuuaauccugugccccugccugggacagaaauguggcuccaguugcucu

SEQ ID NO: 421187 - RNA, 64 nt, Human
cagucaggaugaagccccaugccacuccacacugcugggacauggcagggacuucacagugggg

SEQ ID NO: 421188 - RNA, 64 nt, Human
ggcaguuuguugcguucuucgugguucccaggcccugggacaucucacuccacuccuaccuccc

SEQ ID NO: 421189 - RNA, 64 nt, Human
ugaccagagcaagaucugggcaagcagagagugccugggacaggacugugaccugguggacagg

SEQ ID NO: 421190 - RNA, 64 nt, Human
cuggccaggguugcuuggagaaggcucagugugccugggacagggcuuaccaccugccaccaag

SEQ ID NO: 421191 - RNA, 64 nt, Human
gcaguggcaggucccgucagaagagaugaggcuccugggacaggucagcgucaggggcagccug

SEQ ID NO: 421192 - RNA, 64 nt, Human
cucaggcuccuaaagagacauuuuccgcccacuccugggacacuccgucugcuccaaugacuga

SEQ ID NO: 421193 - RNA, 64 nt, Human
cccguccggagggagccaucucuugcucccgaggcugggacaguccuuucugugggggcucuag

SEQ ID NO: 421194 - RNA, 64 nt, Human
cugacugacuucccaguggaacugccuucuugggcugggacagccccuuuccucugucccuucu

SEQ ID NO: 421195 - RNA, 64 nt, Human
aagagacucauuugcugaugguucaugccuucugcugggacaggccugggcugugcagccacac

SEQ ID NO: 421196 - RNA, 64 nt, Human
accuaccugaacugacuggcccuccgaggugggucugggacauccuagaggcccuacauuuguc

SEQ ID NO: 421197 - RNA, 64 nt, Human
acagaaggaaagcugagagcuggcccgacauggucugggacacagaguuggagcuggcacugaa

SEQ ID NO: 421198 - RNA, 64 nt, Human
guccccaucagaggcagugaggugggccccggcccugggacaggcagcugccuucuggucugca

SEQ ID NO: 421199 - RNA, 64 nt, Human
uagaaauuggaugagccuugagauugcuucuuaacugggacaugacauuuuucuagcucuuauc

SEQ ID NO: 421200 - RNA, 64 nt, Human
acaaguuugugauuaguccuuaaaacuuagcucccugggacauucuucaauuccacaucuguuu

SEQ ID NO: 421201 - RNA, 64 nt, Human
gcuagggagcggauguggugggcuggccggacuccugggacaugugggugguggcuugaccccg

SEQ ID NO: 421202 - RNA, 64 nt, Human
guucuuggaaguaaugucgucuugugacauuggccugggacaaucauuguggguagguaguuau

SEQ ID NO: 421203 - RNA, 64 nt, Human
ugccaggagacagguuagcugcuccccacgucagcugggacaccccgacuuuuguuuaccagag

SEQ ID NO: 421204 - RNA, 64 nt, Human
acaugccacccccacccuccacagagcccccuugcugggacagccagcucaccuccaaggacau

SEQ ID NO: 421205 - RNA, 64 nt, Human
cuccucagaaaaaacaggcccccaugugccucuccugggacaaccagacucuguaacucacccc

SEQ ID NO: 421206 - RNA, 64 nt, Human
uuagggguugcgggauccccgagugugggcgggacugggacacccuuuggccucuguuuguccc

SEQ ID NO: 421207 - RNA, 64 nt, Human
ccaccugccucgucucccuggggagguggucccacugggacacacaaacacccaaacagaaaaa

SEQ ID NO: 421208 - RNA, 64 nt, Human
ggcacaggagagaucuuaaauggucucugggcugcugggacaugcaggcucugaguggggacug

SEQ ID NO: 421209 - RNA, 64 nt, Human
ugugccuucucuacugauggcaguguuuuagcugcugggacacaugacggaaguguguauuuuu

SEQ ID NO: 421210 - RNA, 64 nt, Human
aucuuugcuguaaagugcaaggaaauuuuaaauucugggacacugaguuagaugguaaauacug

SEQ ID NO: 421211 - RNA, 64 nt, Human
gugcauucauuaaagcugauugugugagagugaacugggacacaagcuagucuagcucacugca

SEQ ID NO: 421212 - RNA, 64 nt, Human
acugcccagcccugccccuugcccccguggcuuccugggacagccgccuucagugcuguauuua

SEQ ID NO: 421213 - RNA, 64 nt, Human
aagugacauuuggauuuuuauuugggugggagggcugggacaguuuuucuucuagaaaugucug

SEQ ID NO: 421214 - RNA, 64 nt, Human
cgcacugcccaggucccuccucagaccuccagcccugggacagggcaaacaacugaacuugcua

SEQ ID NO: 421215 - RNA, 64 nt, Human
cccagagcgguggccuugcucuuccggcuggagacugggacaucccugauagguucacaucccu

SEQ ID NO: 421216 - RNA, 64 nt, Human
guggcaaggaggggcaggggauauggggacgugacugggacagguuccugccuuaucauuuucu

SEQ ID NO: 421217 - RNA, 64 nt, Human
cuuucucaguggggaaaaaaauggcuggauagaacugggacaaacacagacccaucuuuagggg

SEQ ID NO: 421218 - RNA, 64 nt, Human
agccggaauagagccucgucuggcaagucggggccugggacacuucccugggccucaacaagga

SEQ ID NO: 421219 - RNA, 64 nt, Human
cuuugucccuagcggaugaccaccaggcucucaucugggacauccagcaaaugccccgagccau

SEQ ID NO: 421220 - RNA, 64 nt, Human
ccucauccuaccgggugucccuuugccacccugccugggacaucgcuggaaccugcaccaugcc

SEQ ID NO: 421221 - RNA, 64 nt, Human
ugucugucugcccggcaagaguccauucucacugcugggacacucaugaaaaucuccacguccu

SEQ ID NO: 421222 - RNA, 64 nt, Human
gaccgccuggcccucccucccuagcccuuccagccugggacacacacacacacacacacacaca

SEQ ID NO: 421223 - RNA, 64 nt, Human
cacuuuacuaaacaguuuggauggucagucucuacugggacauguuaggcccuuguuuucuuug

SEQ ID NO: 421224 - RNA, 64 nt, Human
gcuuucccacccucccuccuuagcaggugccgugcugggacaccauacggguugguuucaccuc

SEQ ID NO: 421225 - RNA, 64 nt, Human
uaacuucguguucacacuccauggaaaccccagacugggacacaggcggaagccuaggagagcc

SEQ ID NO: 421226 - RNA, 64 nt, Human
aucaaaauuuguuuaagucucauuguuaguaauucugggacagguuauuaaaggauuuaaauuu

SEQ ID NO: 421227 - RNA, 64 nt, Human
uguuuacuucauuuuuuccucuaaauauucaagacugggacaaaaguauaaauauuauuuauuu

SEQ ID NO: 421228 - RNA, 64 nt, Human
gcucccugcucagggacgguggacagguugccuacugggacacucuagguugcuggguccaugg

SEQ ID NO: 421229 - RNA, 64 nt, Human
ugucugagguccugugacuguacccuccuuugcccugggacaucuguaucucuuggcuuuguaa

SEQ ID NO: 421230 - RNA, 64 nt, Human
ugugccuuuuucagaguuggccaggagcuccuggcugggacacggagaggcagguguggcguaa

SEQ ID NO: 421231 - RNA, 64 nt, Human
aguuaugaacuauaaaauguuaaaacauuuuuugcugggacaaaauguuaaguaauuugcagua

SEQ ID NO: 421232 - RNA, 64 nt, Human
uagagguagcggguggcuggugggcaggccacugcugggacagggucuaugggcccacccagug

SEQ ID NO: 421233 - RNA, 64 nt, Human
aucgauucccaagcucccuuccgggacaaguggucugggacagggaggagcaacggccccagcg

SEQ ID NO: 421234 - RNA, 64 nt, Human
cucuaccuggcuagaguuucuucucaucagagcacugggacauuaaaccaaccuuuuacaacac

SEQ ID NO: 421235 - RNA, 64 nt, Human
aaagguguccgccaaccuccucagucucccaggccugggacaggcagaacaggguguggcuggg

SEQ ID NO: 421236 - RNA, 64 nt, Human
cuugucccagccacucuagcugcuggaugugauccugggacauguacuccaagccuccgucaca

SEQ ID NO: 421237 - RNA, 64 nt, Human
ccccaagcgggguagcagccuugaacccacccagcugggacaccaccagaagguccagggcucu

SEQ ID NO: 421238 - RNA, 64 nt, Human
cugcagaccucacuucugggagacagagcuacagcugggacagcuccaagcuacccuaaccccu

SEQ ID NO: 421239 - RNA, 64 nt, Human
gcacuguuguagcuuuggagugcagaguguaacucugggacaaucagauuucacauauucuguc

SEQ ID NO: 421240 - RNA, 64 nt, Human
agcuugccucugggcugggugagcuugaaguccucugggacagagaccugucuccacgccuccg

SEQ ID NO: 421241 - RNA, 64 nt, Human
agugcuagggccccucccccaucacauggucacacugggacaggcgugcagcucacugaacucc

SEQ ID NO: 421242 - RNA, 64 nt, Human
ccugagaccacacuguugccucccagugacccugcugggacaccaggacaaggaagacaguuuc

SEQ ID NO: 421243 - RNA, 64 nt, Human
ugucuggggcuucgauccuugggugcaggcagggcugggacacgcggcuucccucccagucccu

SEQ ID NO: 421244 - RNA, 64 nt, Human
gggccuggcccuggcucccuccaaccagcugcuccugggacacaggugcuccugcuucggcucu

SEQ ID NO: 421245 - RNA, 64 nt, Human
ggggcagcaccuggggagucccugccucuccucccugggacaauagugugcaugccacccgggg

SEQ ID NO: 421246 - RNA, 64 nt, Human
cuguucaucuguugaucuggaggcaggacagcuucugggacacacaaaaaugugguucccuuug

SEQ ID NO: 421247 - RNA, 64 nt, Human
acgacgcaugauugguguuugaggcguuugccagcugggacaaacugcguuuggagcugugguu

SEQ ID NO: 421248 - RNA, 64 nt, Human
augcaagauuuuaauggugacuuguccuggcuuacugggacagucuguaugaggcaugucacca

SEQ ID NO: 421249 - RNA, 64 nt, Human
gagcacguccgggcaguggagggagggacacagccugggacaggaagccucuuggguuggagca

SEQ ID NO: 421250 - RNA, 64 nt, Human
ggcggggacccagccuugcccuccacccgaggcucugggacaaggcgggagguucgggggccuu

SEQ ID NO: 421251 - RNA, 64 nt, Human
guggaccucacugcucccccaacccagcgucaggcugggacacgccaacgcuguuccggguugg

SEQ ID NO: 421252 - RNA, 64 nt, Human
uggaggaaggagguguugggcagcaucaaaggugcugggacaucccaggguggugagauccauc

SEQ ID NO: 421253 - RNA, 64 nt, Human
cagccuucuggcccaacucuggaugccuguuauacugggacaaaccuuauaaauguuauagcua

SEQ ID NO: 421254 - RNA, 64 nt, Human
gaacacccggucacagcucucuuugcuaugggaacugggacacuuuuuuacacgauguugccgc

SEQ ID NO: 421255 - RNA, 64 nt, Human
aaagucggaaugcucucgacggccucgucccagccugggacaggcccccuuuccccucucucug

SEQ ID NO: 421256 - RNA, 64 nt, Human
acucccccagacaccuggacacguggccacaaaucugggacaaggggcccccgcacagcaugaa

SEQ ID NO: 421257 - RNA, 64 nt, Human
cccaugagaacaaagacacaacauaccagaaucucugggacacauucaaagcaguguguagagg

SEQ ID NO: 421258 - RNA, 64 nt, Human
acauuccaguggacccuggaccauuccaggaaaacugggacauaggaucgucccgcuaugaugg

SEQ ID NO: 421259 - RNA, 64 nt, Human
guguuuagagggguggccugaaggaccuuuucugcugggacaagacacuguacugcccucugcu

SEQ ID NO: 421260 - RNA, 64 nt, Human
ugggagcaagcgaggcucccaggacccccacccucugggacaggcccucccccauguucuucug

SEQ ID NO: 421261 - RNA, 64 nt, Human
ugugcacccagcuccagugucucagcucacuucccugggacauucuccuuucagcccuucuggg

SEQ ID NO: 421262 - RNA, 64 nt, Human
ucucuuuuuguauuuugcaucugaccccggggggcugggacagauuggcaaugggccguccccu

SEQ ID NO: 421263 - RNA, 64 nt, Human
gcaugauccgugcccuugcuucugacuuucgccucugggacaaguaagucaaugugggcaguuc

SEQ ID NO: 421264 - RNA, 64 nt, Human
cccuuuccuccacagggagaggcuccucccucuccugggacagcucacagguccuagugauucu

SEQ ID NO: 421265 - RNA, 64 nt, Human
aggggcagcagcaguccaggugccacaggcagcccugggacauaggaagcugggagcaaggaaa

SEQ ID NO: 421266 - RNA, 64 nt, Human
ccccuggccccagcccucuccugccuggccuggccugggacaccuccucucugccaggaggcaa

SEQ ID NO: 421267 - RNA, 64 nt, Human
ucuccucucccuugauucggccuccuggccagggcugggacauccucccugcuguccucucucc

SEQ ID NO: 421268 - RNA, 64 nt, Human
cuuugaaaaaagugcagauaaaacccucaucucccugggacaaagcacgugggggaaaggggug

SEQ ID NO: 421269 - RNA, 64 nt, Human
ggagagcucuggcuggcaucuggugggugccccucugggacaaagcuuccagaggaaggaacag

SEQ ID NO: 421270 - RNA, 64 nt, Human
uagaaagucuagggaccaugaaugaauaggccagcugggacaaaugaauuuaaaaaaucagaaa

SEQ ID NO: 421271 - RNA, 64 nt, Human
uccagacuagcccucuugaguaacuguccuagagcugggacaggucacgccugccuccacaucu

SEQ ID NO: 421272 - RNA, 64 nt, Human
guggugcugacgcucccaggggugccaggagccacugggacagggugaggcucccagacgcucc

SEQ ID NO: 421273 - RNA, 64 nt, Human
ugccugcccggggcuuaggaggguggcaccggugcugggacacacgggacuguguccucgccac

SEQ ID NO: 421274 - RNA, 64 nt, Human
cccuuuuaucugaauccuaucaauuauucugaugcugggacaggugagaagaaacugugaagua

SEQ ID NO: 421275 - RNA, 64 nt, Human
ugagauccuugggguccacccuagucucugacaccugggacaggggugcuuuugcuacuuuggu

SEQ ID NO: 421276 - RNA, 64 nt, Human
ccaacagcuuguucuagagaagguuucccuuuuucugggacauuguuggucucauguuaugccu

SEQ ID NO: 421277 - RNA, 64 nt, Human
aagaaagcuuccgagguaagaauuuuauggucaucugggacaacuuaaaucucccuucugcugu

SEQ ID NO: 421278 - RNA, 64 nt, Human
guagcacucuguccccaucugggaggguggcauucugggacaugaggagcaaaggaagggggca

SEQ ID NO: 421279 - RNA, 64 nt, Human
cacccccgguuuaccugaucaguguuaaccuuuacugggacacucaucuguuacacuggaacac

SEQ ID NO: 421280 - RNA, 64 nt, Human
cccucugcucaaugccuaccucccuagggcccugcugggacaugggggccugagugcccaucca

SEQ ID NO: 421281 - RNA, 64 nt, Human
cugucugucugcuucacauguccccaucagccugcugggacacacggguccuccugagucccgu

SEQ ID NO: 421282 - RNA, 64 nt, Human
aaauugggaaaugucccagucagaagaagauuaucugggacacugauacugacagggagauggg

SEQ ID NO: 421283 - RNA, 64 nt, Human
aauucucaucugucagauccaguguauuccuaagcugggacaaagccucuguuuucccaguagg

SEQ ID NO: 421284 - RNA, 64 nt, Human
cuugucaguggagggagcagcuccccacucagcccugggacaggcccugggacugugguggccg

SEQ ID NO: 421285 - RNA, 64 nt, Human
gggugauauccugaaaaaaaaaaaaaaaaaaaaacugggacagcuuuccccucauuuuuuuuuu

SEQ ID NO: 421286 - RNA, 64 nt, Human
gugcugcugcuucugcugcuucuccagaaaaucccugggacaccuuuguuccagccugguuucc

SEQ ID NO: 421287 - RNA, 64 nt, Human
gaaccaacaauucgucggaggcaucauggaaagacugggacagcccaggaaacaaggggucuga

SEQ ID NO: 421288 - RNA, 64 nt, Human
gcccuguggcaggacacacauggugagccuagcccugggacaucaggagacugggcucuggcuc

SEQ ID NO: 421289 - RNA, 64 nt, Human
gcaaaccacuucuuuagucaucugucuuaccccccugggacagcuguuaccuuugcaguguugc

SEQ ID NO: 421290 - RNA, 64 nt, Human
agcuggagggcgcccccuccccggaguuuccucccugggacaagugagggaggagggggccgau

SEQ ID NO: 421291 - RNA, 64 nt, Human
gauaucaucuuuucuaaucucuuuuuucaacuggcugggacauuuucggaagggggaagucucu

SEQ ID NO: 421292 - RNA, 64 nt, Human
ccuccgaagaccgcucgggcauuccgccugcgcccugggacagcggagagacggcuucucuuua

SEQ ID NO: 421293 - RNA, 64 nt, Human
agggagcugagcgugcaggcgcuccagggcaggccugggacagagucaaggcucagagaauaaa

SEQ ID NO: 421294 - RNA, 64 nt, Human
gaccuuagggaacaagaggcaucacucaguccuucugggacagcuucccuguaagcaaagccag

SEQ ID NO: 421295 - RNA, 64 nt, Human
guaacuaauugccuaagucugggaacugcuuccacugggacaaaacauucuccugcugcucuug

SEQ ID NO: 421296 - RNA, 64 nt, Human
ugccuuagauuccgugggucaugagccaugaguccugggacaucugaggauugggauucuuugu

SEQ ID NO: 421297 - RNA, 64 nt, Human
ucaaaucacauuugugccuggugacuuccugucccugggacaguugagaagcugacugggcaag

SEQ ID NO: 421298 - RNA, 64 nt, Human
cagguccuguguucucucccucucucuccuggcucugggacaucugucccuggcugccuuucau

SEQ ID NO: 421299 - RNA, 64 nt, Human
uuuuuuccuggcaauguccuuaaaagcucccacccugggacagcaugccacugagcaaggagag

SEQ ID NO: 421300 - RNA, 64 nt, Human
ggcgacaggagaccguugcuccagugcaugucugcugggacaaggauuccuggccucgaagccc

SEQ ID NO: 421301 - RNA, 64 nt, Human
ucacaguccgugagucuuccagcugccaccacggcugggacacgcugggggagggcuccuccca

SEQ ID NO: 421302 - RNA, 64 nt, Human
gcuuccucaagcugccuccccuggcugauguucucugggacauuuucggaaauuugaccuccca

SEQ ID NO: 421303 - RNA, 64 nt, Human
cguggccacauuaccucagcgggagggagcagagcugggacaggcagcuaaaaugagcagcucc

SEQ ID NO: 421304 - RNA, 64 nt, Human
aucccaagucugugcagcagggagccccaugccccugggacaugaacccaccugcguggaaugc

SEQ ID NO: 421305 - RNA, 64 nt, Human
cguccacucaucugcccauggggaagucggcucacugggacaagggccacugggcuggucugug

SEQ ID NO: 421306 - RNA, 64 nt, Human
ccuccuugagccaggguggcacuguucacuggcgcugggacagucagggugaccccaccgccua

SEQ ID NO: 421307 - RNA, 62 nt, Human
acaucaugccgggacugugacagcaaagaauccugggacagaaaccuuauccuacaccauug

SEQ ID NO: 421308 - RNA, 64 nt, Human
gaggggugaggauugcugcgucauauggagccuccugggacaagccucaggaugaaaaggacac

SEQ ID NO: 421309 - RNA, 64 nt, Human
cugcccuugugaccucccaggaaacagaacugaucugggacacuaugucaccucuccucucauc

SEQ ID NO: 421310 - RNA, 64 nt, Human
guggucuagaaggcacugcguggccccucagaugcugggacacaacagacccgggacccagcug

SEQ ID NO: 421311 - RNA, 64 nt, Human
ggaaacucauggaagccucugcucauuugggucacugggacaccccugagauggguguguuuau

SEQ ID NO: 421312 - RNA, 64 nt, Human
gaacucagcaguucaggagccaccccaaaccauucugggacagggacaccccuuucuaccccag

SEQ ID NO: 421313 - RNA, 64 nt, Human
gggcacucaggugugggccgaaccugauaccugccugggacagccacuggaaacuuuugggaac

SEQ ID NO: 421314 - RNA, 64 nt, Human
cagugugcuguccagagagaccugcugacccagucugggacaggcacagugggagcugccacag

SEQ ID NO: 421315 - RNA, 64 nt, Human
acucaggaggcuaaggcaggagaaucacuugaaccugggacacggagguugcagugagcuaaga

SEQ ID NO: 421316 - RNA, 64 nt, Human
uuaauuugcaggacugccuugguggcuuuguuugcugggacaaggcccacaaccugugccucuc

SEQ ID NO: 421317 - RNA, 64 nt, Human
ucggacagugccauccaugggccccaccuugugacugggacaaucagggaccuggauuggacgg

SEQ ID NO: 421318 - RNA, 64 nt, Human
cuccuggggugagagcgcagugcacucccgugcucugggacaccccugcuccuguggcugugau

SEQ ID NO: 421319 - RNA, 64 nt, Human
ugguuauuuggauugcuugcuucccuuuuuccaccugggacauuguaaucauaaaauaacagua

SEQ ID NO: 421320 - RNA, 64 nt, Human
uaggggaguagggguggagucaccaaaaccagugcugggacaaagauggggaaggugugugaac

SEQ ID NO: 421321 - RNA, 54 nt, Human
uggagaugucccagcagugaggagcugggacaugugacaggcugugguggcacc

SEQ ID NO: 421322 - RNA, 64 nt, Human
gccaaagaacaccgccaacacgcacaccuccaaccugggacaucccacgcugggccucgcacgg

SEQ ID NO: 421323 - RNA, 64 nt, Human
cuugaaaguauauacagcuuguaugaaggcuucucugggacagugugcuuucugauugaccugc

SEQ ID NO: 421324 - RNA, 64 nt, Human
gugggguuggggaguaggggggaucccacauugccugggacaucugaaugcugauacgaaugga

SEQ ID NO: 421325 - RNA, 64 nt, Human
cgaauggacaggaaagggagccagagcuguauaccugggacaggccagggagccuuuagugcca

SEQ ID NO: 421326 - RNA, 64 nt, Human
agcaggaugcaggaugggaggacaggaaggcagccugggacauuuaaaaaaauaaaaaugaaaa

SEQ ID NO: 421327 - RNA, 64 nt, Human
agucaguugcuuacuuauuuugcucuggaugagucugggacacgcuguaacuuuaacacauuua

SEQ ID NO: 421328 - RNA, 64 nt, Human
cguggagaauuggccagagccuguggccccgaggcugggacacuguguggcccuggacaagcca

SEQ ID NO: 421329 - RNA, 64 nt, Human
auuuacuuuggaaaguagaaaagcccagcuuuuccugggacaucuucuguuauuguugauguuu

SEQ ID NO: 421330 - RNA, 64 nt, Human
uuuuuaaauucaguacugauugguucagcauauccugggacauaaaaauacucacuacugggaa

SEQ ID NO: 421331 - RNA, 64 nt, Human
gaucauuguuccauccucuacuucuggugcaguccugggacaaggacaagggaaagggaugggu

SEQ ID NO: 421332 - RNA, 64 nt, Human
gucccagaaaugucaugagauugcuguguguugccugggacacagaucaagggccuaucuugga

SEQ ID NO: 421333 - RNA, 64 nt, Human
cguggcuucuggggugggacccagaggggaggcucugggacaggggcugggguucagugccagg

SEQ ID NO: 421334 - RNA, 64 nt, Human
gcaucauuccaggcccgaagcaugaacagugcaccugggacagggagcagccccaaauugucac

SEQ ID NO: 421335 - RNA, 64 nt, Human
acacuuccaacuucgaaacuuacccugagcaugacugggacacagccgcgcccgugccgcagaa

SEQ ID NO: 421336 - RNA, 64 nt, Human
uagcgcaaagaagagcucugacucuccaggggugcugggacaucacguggaauuggaucccagg

SEQ ID NO: 421337 - RNA, 64 nt, Human
caacucuguaaauauguauguagacacuuuuaaaagcacguauuuaugucccugacuguaaaug

SEQ ID NO: 421338 - RNA, 64 nt, Human
guagaggaaaugcacaguacaaauguuuuucuuuagcacguaagggaccuauccuugucuugaa

SEQ ID NO: 421339 - RNA, 64 nt, Human
cauccuugugccuucaccucugauguguuucacaagcacguaguucaacccagauagggaccac

SEQ ID NO: 421340 - RNA, 64 nt, Human
agaaaauagauggacaauauuuuucaacuguaugagcacguagauaaccgagagaauguggcca

SEQ ID NO: 421341 - RNA, 64 nt, Human
ucccacugaccucuuucucguuuguggacaaagcagcacguaucaccucauucaucacuuggac

SEQ ID NO: 421342 - RNA, 64 nt, Human
gaaaauacaugaacagaaacugcccagguggaacagcacguaaccuagugagugacuguacucc

SEQ ID NO: 421343 - RNA, 64 nt, Human
ucugaaacuuuuggagcuuguuuuugcccuugauagcacguauccuuagagaauaagcuugcca

SEQ ID NO: 421344 - RNA, 64 nt, Human
aguguacacuacugaugcuguuuguuguacugagagcacguaccaauaaaaauguuaacaaaau

SEQ ID NO: 421345 - RNA, 64 nt, Human
gcuaauguguggcccagagagccugucuguguggagcacguagugcacagaauacgugagaguu

SEQ ID NO: 421346 - RNA, 64 nt, Human
cuccugggccugucgggccuccgauuucauccucagcacguaaugcucaccaacagcacuugca

SEQ ID NO: 421347 - RNA, 64 nt, Human
uuaaaaagauauuguaccaggaugugcuauuaagagcacguauccauuauucuucucaacccaa

SEQ ID NO: 421348 - RNA, 64 nt, Human
caucaaccagcugccucuuguuucauuucaccucagcacguaccaucuguccuuuuguuguugu

SEQ ID NO: 421349 - RNA, 64 nt, Human
ugagacucagucuuaaaaaaauaugccuuuuugaagcacguacauuuuguaacaaagaacugaa

SEQ ID NO: 421350 - RNA, 64 nt, Human
aaugaaccacguguuuugacaucauguaaaccuaagcacguagagaugauucggauuugacaaa

SEQ ID NO: 421351 - RNA, 64 nt, Human
uuccucucuuaaauucauaucauuuggccgagucagcacguaguuugcauuccagcgucugcug

SEQ ID NO: 421352 - RNA, 64 nt, Human
ggcaaggcuuauccugggcaggagagaacacacgagcacguauuugggagcccagugcccuuuc

SEQ ID NO: 421353 - RNA, 64 nt, Human
aaaagggcauuccagcuggggcaugugcaaaggcagcacguaauguguaaguucuagaucguca

SEQ ID NO: 421354 - RNA, 64 nt, Human
gaacaauggaaagagcugaaggccaccuacagggagcacguagaggccaucaaaauuggccuca

SEQ ID NO: 421355 - RNA, 64 nt, Human
uuaguuugccuggaauuguucuguaccucuuuguagcacguaguguuguggaaacuaagccacu

SEQ ID NO: 421356 - RNA, 64 nt, Human
uauauuuuguccuucccucuucccugaggaacaaagcacguaucuuuagucucuuugauauuua

SEQ ID NO: 421357 - RNA, 64 nt, Human
uggacagaagcccacuuaguuucuugggagcaacagcacguaucagaagccagacuugcucuuc

SEQ ID NO: 421358 - RNA, 64 nt, Human
agauaguagccaguuaaccaagacucauucauauagcacguaguuuauguuccugaggcagcac

SEQ ID NO: 421359 - RNA, 64 nt, Human
gcacagaucgcacugccucaauaacuugguauugagcacguauuuugcaaaagcuacuuuuccu

SEQ ID NO: 421360 - RNA, 64 nt, Human
uucuugcuuugauuggugcccugcuauagcccaaagcacguaguauuugcugaugauucagcau

SEQ ID NO: 421361 - RNA, 64 nt, Human
ccuaucucaaaaaaaaaaaaagucgccagcaacaagcacguaguguaguguuccugcuaaauga

SEQ ID NO: 421362 - RNA, 64 nt, Human
agcacugccagcuugccaguuucugcccagcaaaagcacguaugcuucaggggccuucugagac

SEQ ID NO: 421363 - RNA, 64 nt, Human
ugauuccgugaacacagauguguuuugaagaaguagcacguaauggcuuuuaucuaccaucaac

SEQ ID NO: 421364 - RNA, 64 nt, Human
ugcagggaaccgugauaagccuuucugguuucggagcacguaaaugcgucccuguacagauagu

SEQ ID NO: 421365 - RNA, 64 nt, Human
gagagcugccugcgagccccgcaccaccccgcggagcacguacccagggaccgcagcccugacg

SEQ ID NO: 421366 - RNA, 64 nt, Human
cauuucuccaaagaagauacccagauggccaauaagcacguaacaaugcucgacaucuuuaguc

SEQ ID NO: 421367 - RNA, 64 nt, Human
ucuuuuucuuuuuuuuuuuuuuuuaaacaccaagagcacguauagcaugggggaaagaaccuaa

SEQ ID NO: 421368 - RNA, 64 nt, Human
aaaaacugaacuguguguaaccauaguaacaccaagcacguauuuauuuauaaguuuuugccau

SEQ ID NO: 421369 - RNA, 64 nt, Human
uuuacaaaaugagagauugaauuuaagcuugucaagcacguacuggaagguaugaauuacacua

SEQ ID NO: 421370 - RNA, 64 nt, Human
guguaagcugauagcacaaguucuggcgacagguagcacguaucugagagacaccugcaagcac

SEQ ID NO: 421371 - RNA, 64 nt, Human
cuggcagggauaacaaagaaccuaacauuuauuaagcacguauuuauuaacugcucaguguuuc

SEQ ID NO: 421372 - RNA, 64 nt, Human
cgugcccaggcacaaguaugucucugggucccuugcccugcaguuuccagggggcucugcucca

SEQ ID NO: 421373 - RNA, 64 nt, Human
cuccccgccccuuccuggagcuggcagagcuaacgcccugcaggaggaccccggccucucgagg

SEQ ID NO: 421374 - RNA, 64 nt, Human
aaagccuuucgagaggcccaagguggccucgccagcccugcaguauugaugugcaguauugcac

SEQ ID NO: 421375 - RNA, 64 nt, Human
cauuagagucagccuucccccucccagggccagggcccugcagaggggaaaccaguguagccuu

SEQ ID NO: 421376 - RNA, 64 nt, Human
aacugcgagcugcuccacuucucagcucuccccugcccugcagcccugggccagacaaggccag

SEQ ID NO: 421377 - RNA, 64 nt, Human
cuggaaucagugaagccaaagggacuggcagucugcccugcagggaguaccgaccuaucccagu

SEQ ID NO: 421378 - RNA, 64 nt, Human
cccugaggaagcauggggacccuaacacccuggugcccugcaccagacaggccguggucaggcc

SEQ ID NO: 421379 - RNA, 64 nt, Human
ggcaggaggagguguggacagugaugguacggcggcccugcaucagccugcggguggccucugg

SEQ ID NO: 421380 - RNA, 64 nt, Human
aaaauuaaaauucguuuuugcaauaaugacaaaugcccugcaccuacccacaugcacucgugug

SEQ ID NO: 421381 - RNA, 64 nt, Human
gcagugaacacaucugauuucccacagcacaacagcccugcauggguuuguuuguuuuuuuacu

SEQ ID NO: 421382 - RNA, 64 nt, Human
ccccgcacggcccgcggcucagccucggccgucugcccugcacuaccaaggccgaccacuagag

SEQ ID NO: 421383 - RNA, 64 nt, Human
agcacccucgcuccucuccuggcuacuagcucuggcccugcaccuacucucacuggccaccucu

SEQ ID NO: 421384 - RNA, 64 nt, Human
guccugcuucccacccccugccugcccagccugggcccugcaguguggagagacacauaagccu

SEQ ID NO: 421385 - RNA, 64 nt, Human
ggcaccauccuggcuuuuggcagggaugagugaggcccugcagagagcaucccaggccaagguu

SEQ ID NO: 421386 - RNA, 64 nt, Human
ucaugcuugacagcuugguaaggucaacucuguagcccugcagacaaaagcugguuagguuugg

SEQ ID NO: 421387 - RNA, 64 nt, Human
gcccuacugcagccacccuucucaucuggaucgggcccugcagaggcagaaaacccuuaaaugc

SEQ ID NO: 421388 - RNA, 64 nt, Human
acuguagucccagcaggaacugugaagaccagcugcccugcaggauccaguuuuucuugggagg

SEQ ID NO: 421389 - RNA, 51 nt, Human
ugggcucugacagugacugaggcccugcauuccccaucccacccccggcug

SEQ ID NO: 421390 - RNA, 64 nt, Human
cucuugcauucaagauuaugaaacuuugcuaugggcccugcacuuccuuugcuuccuccuguuc

SEQ ID NO: 421391 - RNA, 64 nt, Human
uuccugcguccuccucaccucaugcccacccccugcccugcacgucaugggagggggcuugaag

SEQ ID NO: 421392 - RNA, 64 nt, Human
gcaagagaacaauguuucuucaguggcaaauguagcccugcauccuccaguguuaccuggugua

SEQ ID NO: 421393 - RNA, 64 nt, Human
uuagccacagcuguuuuaagacuucugaucuccugcccugcaggaauaggugggaagucauuga

SEQ ID NO: 421394 - RNA, 64 nt, Human
gagaugagccucucagggcaggaccucuucccaagcccugcacacccaccccugcagcccuuuu

SEQ ID NO: 421395 - RNA, 64 nt, Human
auggcuacuuauucugccacaugugccaacaauagcccugcacagggcaucaacauggccaaca

SEQ ID NO: 421396 - RNA, 64 nt, Human
aacagauggaaccugccacccaggauccugaucugcccugcacugagcacucaguggauaaaca

SEQ ID NO: 421397 - RNA, 64 nt, Human
ugugugcccaucagagcaggcucagccugcaaaggcccugcauucagaggucuuguaaucuacu

SEQ ID NO: 421398 - RNA, 64 nt, Human
ccuccacuaggaguuaacuacccuacaccucugggcccugcaggaggccugggagggcaagggu

SEQ ID NO: 421399 - RNA, 64 nt, Human
caggucugaaaaucagccagugccaacauugcuugcccugcaaggugcaacugagcccacauag

SEQ ID NO: 421400 - RNA, 64 nt, Human
agcccaggaagucuuggagaucccaccuucuguggcccugcaccuuaugggaagccauuaaggg

SEQ ID NO: 421401 - RNA, 64 nt, Human
gucacacgcuaguauuggcuucauugugaucugagcccugcacgcugggccuucagaauuaaug

SEQ ID NO: 421402 - RNA, 64 nt, Human
gcccuggaccaugcaguucggcggccgcggcugggcccugcaggagggagagagagacacaguc

SEQ ID NO: 421403 - RNA, 64 nt, Human
cggcacccagcuggggccugucugugccccuccugcccugcaggcuguccuccccgccucucug

SEQ ID NO: 421404 - RNA, 64 nt, Human
uaggcacuucagauaccacacgaguaagacaagggcccugcaggggugguccuuugguggaaag

SEQ ID NO: 421405 - RNA, 64 nt, Human
gagcagcuuguguagacaagcgcgugcucgcugagcccugcaaggcagaaaugacagugcaagg

SEQ ID NO: 421406 - RNA, 64 nt, Human
cgggcgcucaaggcgcccucuggcccgggcccgggcccugcaaccgccggcgcgcaccggcgcg

SEQ ID NO: 421407 - RNA, 64 nt, Human
caacucuccuccagagucagaaguuucugccgcagcccugcagagggcacagaaaauggaagac

SEQ ID NO: 421408 - RNA, 64 nt, Human
gagguucacugugcauauggcagagacaggaguggcccugcagugauguuggguugugggcagg

SEQ ID NO: 421409 - RNA, 64 nt, Human
caacauuauuauaugugcuuccccaaguuuaaaggcccugcagaaauaguaaacaugguuuaau

SEQ ID NO: 421410 - RNA, 64 nt, Human
cagggcaaaaccaagagcuguucuucccagaagagcccugcaaacacauugguucgugcuuccc

SEQ ID NO: 421411 - RNA, 64 nt, Human
cccagacauucuugcagcuuggacugcauuuuaagcccugcaggcuucugccauauccaugaga

SEQ ID NO: 421412 - RNA, 64 nt, Human
gcccaagcuccccuugcuggcgggcgcugcgugggcccugcacuugcugagguuccccaucaug

SEQ ID NO: 421413 - RNA, 64 nt, Human
cagauaucuuucacacaguagagcaaaaucaccagcccugcacugaugucacuuuauguagaaa

SEQ ID NO: 421414 - RNA, 63 nt, Human
aguggaaggaaauugguugauacugacccccaggcccugcaguggggcugacuccagaucucu

SEQ ID NO: 421415 - RNA, 64 nt, Human
cccaauaaggccuuugggaaaggacaggugccgagcccugcauguggagcccucccaccccacc

SEQ ID NO: 421416 - RNA, 64 nt, Human
uuucugugggaccgacucucaaggcacuguguaugcccugcaaguuggcugucuaugagcauuu

SEQ ID NO: 421417 - RNA, 64 nt, Human
uugaaugaaugaaagaauaagugaguaugcuugggcccugcauuggccuggccuccagcuccca

SEQ ID NO: 421418 - RNA, 64 nt, Human
cauuagcauuucaugucuuuccccaaaugaagaugcccugcaaagggcaguaaccacacaguuu

SEQ ID NO: 421419 - RNA, 64 nt, Human
ugguucaaguucaagacuugaaggaagcaaagacgcccugcaugguuacaauggcucagguguc

SEQ ID NO: 421420 - RNA, 64 nt, Human
caccuuaaccugaggaauguaugugggcaaccaggcccugcauuuuuuuauauucugaauuuug

SEQ ID NO: 421421 - RNA, 64 nt, Human
caccauguggaaaagcaaggauuucccuggccccgcccugcacuccagcucgccccuuucccgc

SEQ ID NO: 421422 - RNA, 64 nt, Human
accuuggagagccugcaucccaggaugcuggguggcccugcagccuccuccaccucaccuccau

SEQ ID NO: 421423 - RNA, 64 nt, Human
ccgggcucugaggaccccuggggcccccaucggagcccugcaaauuccgagaaaugugaaacuu

SEQ ID NO: 421424 - RNA, 64 nt, Human
ggcugcacagcgggagagcagcugguccagaccagcccugcagcccccacucagccggcagcca

SEQ ID NO: 421425 - RNA, 64 nt, Human
gacucauuggccgaccauccuguguccuggccuggcccugcaguaagaagcgugucugggucug

SEQ ID NO: 421426 - RNA, 64 nt, Human
gaaucuuggaaacacacauaccuguugaucaugggcccugcagaauuggcccuugggggcuuua

SEQ ID NO: 421427 - RNA, 64 nt, Human
ucaucaacaagguggugugauggcuccugcacaggcccugcacauaggaugagggcaucugcuc

SEQ ID NO: 421428 - RNA, 64 nt, Human
ggaaaggcccagugacagguguggacaggugccagcccugcaagccgccucuucucgguagaag

SEQ ID NO: 421429 - RNA, 64 nt, Human
aguugcagccaacgguucuugaaagcucgguaaggcccugcaacgcagagccugcuuaugugga

SEQ ID NO: 421430 - RNA, 64 nt, Human
cagcgagcacggggagaagcucuaccucgucagggcccugcagugacggcgccccggccccaca

SEQ ID NO: 421431 - RNA, 64 nt, Human
ucuccugacuagagcacuuuacucuguuuccucagcccugcagccccugggagcacacacuggg

SEQ ID NO: 421432 - RNA, 64 nt, Human
ucugcaaagacugccuauagcagcuaccugcucagcccugcaccaugcugcuggggaagacagu

SEQ ID NO: 421433 - RNA, 64 nt, Human
uaugagagaaucacacaaguuugugcuaucuauggcccugcaaaaauauaaccauuacauguuu

SEQ ID NO: 421434 - RNA, 64 nt, Human
ucccaaagguaagucugagacccaucagcggcgcgcccugcagagggaccagagcuuggagagu

SEQ ID NO: 421435 - RNA, 64 nt, Human
cauucccauucgggagaucaugucucacuucacagcccugcagugcccuagacuggcugaaaaa

SEQ ID NO: 421436 - RNA, 64 nt, Human
auuuccagacccccucaauauccuccucagauuugcccugcacuucuuguuccaugcuuggggu

SEQ ID NO: 421437 - RNA, 64 nt, Human
caguccuaacgggacaggacagagagacagagcagcccugcacuguuuucccuccaccacagcc

SEQ ID NO: 421438 - RNA, 64 nt, Human
uccuugcagggaucugagccacccuccccgcacagcccugcaccccgccccugggguuggcagc

SEQ ID NO: 421439 - RNA, 64 nt, Human
caucuggugaaccaaguggcagccccaggggccugcccugcaggucacagcuaaacaagucugg

SEQ ID NO: 421440 - RNA, 64 nt, Human
aagaagggccaucucaggacaugaguccucaggggcccugcacauucaaucugaaggugacccu

SEQ ID NO: 421441 - RNA, 64 nt, Human
agaaaagaaggucauggccccuggccuggcccccgcccugcagggacacagaagccacaccauu

SEQ ID NO: 421442 - RNA, 64 nt, Human
cuguggggacaucggugugaagggaagggacugggcccugcagggucagaaccuccccaccccc

SEQ ID NO: 421443 - RNA, 64 nt, Human
ugcguggcacagcuagugggccucccccugcacagcccugcauguacuagcaccuucaucacuc

SEQ ID NO: 421444 - RNA, 64 nt, Human
ugcccaguauggugguugugauaaaucuaaaccagcccugcaugaaacagaguccaagcugucu

SEQ ID NO: 421445 - RNA, 64 nt, Human
cucugagcccaagcuaagccaucauauccccugugcccugcacguauacacccagauggccuga

SEQ ID NO: 421446 - RNA, 64 nt, Human
accucucuggccuugugcagccaguuccugugcugcccugcaccuaggagagacucagccccuc

SEQ ID NO: 421447 - RNA, 64 nt, Human
gggccaggcccucaacagaagccaucucauuuaagcccugcaaccaaugagaugcacgucauca

SEQ ID NO: 421448 - RNA, 64 nt, Human
aacuuucuaucaccacagauaaagauuuuguuuugcccugcaaauaaaaagacaauuccuuauu

SEQ ID NO: 421449 - RNA, 64 nt, Human
cacacugcccucccaacugccagacuuccugggggcccugcagcagccucgcgccccgcguucc

SEQ ID NO: 421450 - RNA, 63 nt, Human
uggaaucaucagaacccuaaagaguagaugguugcccugcaucuugggcuccaucggccgaaa

SEQ ID NO: 421451 - RNA, 64 nt, Human
caggguuggguguugugacucacuccaccucugugcccugcagagguacuguuggguccuuguc

SEQ ID NO: 421452 - RNA, 64 nt, Human
ucugggggagugcaggguggacaucaccuuggaggcccugcacugccagcaucuggagaccguc

SEQ ID NO: 421453 - RNA, 64 nt, Human
cuauauugcuggagucauacccagccuaaguguugcccugcacuauggcuggaggacacauuug

SEQ ID NO: 421454 - RNA, 64 nt, Human
ccuggccaggcuugggggcagcccaucucagguggcccugcacgcgugugccugccucggccug

SEQ ID NO: 421455 - RNA, 64 nt, Human
auagucccgccugcagccuguaaccaucggcugggcccugcaaggcccacacucacgcccugug

SEQ ID NO: 421456 - RNA, 64 nt, Human
ucagaaucaagagcauggcggaguaggagaagaagcccugcacacagggcaguguccacagcca

SEQ ID NO: 421457 - RNA, 64 nt, Human
acuuuuccuguaaagcagacaucguucuuggccugcccugcauuguauacuagauuucauuguu

SEQ ID NO: 421458 - RNA, 64 nt, Human
cuagagcuagagucaugauagcugagggucacucgcccugcaagagucacuaggcacccaccau

SEQ ID NO: 421459 - RNA, 64 nt, Human
aaccuguacauauuccauuuacaaaauaaauucagcccugcacuuucuuuagaugccuugauuu

SEQ ID NO: 421460 - RNA, 64 nt, Human
ccccaggugccuuuggagguuaaggcuagguuaggcccugcacuccaccuggggacggccccuc

SEQ ID NO: 421461 - RNA, 64 nt, Human
ccaaccucccagccccuuccaagcaggacuaggugcccugcauuccacccaaggugggauuggc

SEQ ID NO: 421462 - RNA, 64 nt, Human
ccuguggagagauuuucugcccugccccaccagggcccugcauguuggagacugagcugggugc

SEQ ID NO: 421463 - RNA, 64 nt, Human
ugcucugccccugcacaggacccaaaggccccaggcccugcaaggugugcuaguuccugcuuuc

SEQ ID NO: 421464 - RNA, 64 nt, Human
cugucaccuagcucaauggagccccggaucccaagcccugcauuguaagcccacaguaggcacu

SEQ ID NO: 421465 - RNA, 64 nt, Human
ccuucccuucuugccucaccauuccccuaggcaggcccugcaggucccacacucucccaggccc

SEQ ID NO: 421466 - RNA, 64 nt, Human
agcccuugcacuccuacugaguuugugguaaccagcccugcacgaccccugaaucugcugagag

SEQ ID NO: 421467 - RNA, 64 nt, Human
gaaguacuccuauugccgccagaagauccaagaggcccugcacgccugcccccuugggugaccu

SEQ ID NO: 421468 - RNA, 64 nt, Human
agcccuggaggcugggaauguggaggcucugugagcccugcagcccucagaaucagggccaggg

SEQ ID NO: 421469 - RNA, 64 nt, Human
auaugacccuggucagggcuuugccaccguugaagcccugcagaaggugcaauguagggguucu

SEQ ID NO: 421470 - RNA, 64 nt, Human
uuagcauuugaaaugguucugcuuggaaaaugaugcccugcaacuaacccuggucuuucccaug

SEQ ID NO: 421471 - RNA, 64 nt, Human
uuaacuugcuuaagugucauacuuuacuggcuuugcccugcacaccaauauuccuuuuaaacca

SEQ ID NO: 421472 - RNA, 64 nt, Human
gagacugaagggaaaucccccuuucuuucuaccagcccugcaaguuuccucauggacgcucgcg

SEQ ID NO: 421473 - RNA, 64 nt, Human
ccccaaauauauuucuuugcccuaccuugaacuugcccugcagagucucuugugaggagaaucc

SEQ ID NO: 421474 - RNA, 64 nt, Human
gggacagggugcgggcaauggccacguggccaaggcccugcaggaacgcgccgaggucucccuc

SEQ ID NO: 421475 - RNA, 64 nt, Human
ucaggccagggcagugcugcugcagagcuagaaggcccugcagcuacagcugcuucauucccug

SEQ ID NO: 421476 - RNA, 64 nt, Human
cuugcauacacugagcgggcuacagagcuagaaggcccugcagcuacagcugcuucauucccug

SEQ ID NO: 421477 - RNA, 64 nt, Human
ccccagggggccauagggugcgguggaacugcaggcccugcagaugacggcagccagcugcuuc

SEQ ID NO: 421478 - RNA, 64 nt, Human
cguguuuucauagacucaucccaugcuggcaacagcccugcaaggggcuuggcucugccacagg

SEQ ID NO: 421479 - RNA, 64 nt, Human
ccuugugccagcaguggcuccucucugccuuugagcccugcacagcuggacccauccuaagugc

SEQ ID NO: 421480 - RNA, 64 nt, Human
uaacuggaaacuguguugcucuaacccuccuccagcccugcagccuccccuugcagucaucauu

SEQ ID NO: 421481 - RNA, 64 nt, Human
ccuguaugugagucuguacccagguggggucugugcccugcacaccgggccccucuguauuuau

SEQ ID NO: 421482 - RNA, 64 nt, Human
gggggucccuggaaacaacucuggcacagaaccugcccugcaggcuguagggggcauggugccu

SEQ ID NO: 421483 - RNA, 64 nt, Human
cuuuagcaggacaugaaccaguuauaacaagauggcccugcagcugguuacaagaaugugacau

SEQ ID NO: 421484 - RNA, 64 nt, Human
gacuagagggucacauuguguaaagccuaacauagcccugcaaagagaucuggccccagcagug

SEQ ID NO: 421485 - RNA, 64 nt, Human
aguguaucguggcaugaagcccggcacauagcaggcccugcauauugauggacaaauggauggc

SEQ ID NO: 421486 - RNA, 64 nt, Human
cguauguacaguuagacuugcaggcugcaggagugcccugcauuguuuucuuuuaauuagaaau

SEQ ID NO: 421487 - RNA, 64 nt, Human
guauggucaccuggguguggccagugcccgcugugcccugcaugauucuguguugccgcugcug

SEQ ID NO: 421488 - RNA, 64 nt, Human
uggaaaauguauaucucuccagcuguacuguagugcccugcaggcuguuuauauguucacaguu

SEQ ID NO: 421489 - RNA, 64 nt, Human
uuggcaaaaugggguuugggccccucagagcccugcccugcacccuuguacagugucugugcca

SEQ ID NO: 421490 - RNA, 64 nt, Human
cacuugacgaucacggauuagcuagcaccuuuaagcccugcauuucuccaacugacaagugggu

SEQ ID NO: 421491 - RNA, 64 nt, Human
uuagacaguccuggaugccauuuggaaaguaguggcccugcaagccuaaaugaaguaguauuug

SEQ ID NO: 421492 - RNA, 64 nt, Human
cgauuccaagaguagugguguaaauugccuuggagcccugcauccacgucuuguaacuaacuuu

SEQ ID NO: 421493 - RNA, 64 nt, Human
caguggccuuagugcaggaaacucagcccugguggcccugcagaacaaugcaucugacaugugc

SEQ ID NO: 421494 - RNA, 64 nt, Human
ggguggguggagggguuugcagugugggaauguggcccugcaguugaccugagcugcuucacau

SEQ ID NO: 421495 - RNA, 64 nt, Human
acaggcugaauuagaugagcuccugccgcagggggcccugcacacugaugucagcucaccaguc

SEQ ID NO: 421496 - RNA, 64 nt, Human
uguaaguguugagguuucugcaaagagggcgcaggcccugcagugacgguucagauauugauaa

SEQ ID NO: 421497 - RNA, 64 nt, Human
ugccauuucaugcccuugugacuaccuaucauuggcccugcaauaaaaucauuuauuuuucacu

SEQ ID NO: 421498 - RNA, 64 nt, Human
gcagcuugcaguccguugcugaaaaugauuauaagcccugcauaauguuaagcuuuauugugau

SEQ ID NO: 421499 - RNA, 64 nt, Human
ccccgucucccaccccuguccccggggcucgcuggcccugcacuccgccuuaguccuggggccg

SEQ ID NO: 421500 - RNA, 64 nt, Human
ucuccuuuagggagcugagguucuucugcccugagcccugcagcagcggcagucacagcuucca

SEQ ID NO: 421501 - RNA, 64 nt, Human
uuuaucaccagugaggagcaggacgugagcccccgcccugcaccucugcuguuaaacaccccag

SEQ ID NO: 421502 - RNA, 64 nt, Human
ggcauuuuaauuuggcaaucucuuaaauaauauugcccugcaaguacccaguaaaugguaaggu

SEQ ID NO: 421503 - RNA, 64 nt, Human
uauacaggcugacuugaucuagaacauuaaauccgcccugcaaguuaaccccccauugcaaugg

SEQ ID NO: 421504 - RNA, 64 nt, Human
uguaauucagaauaaaauuuaugauggcauauuugcccugcaaaugucuuaaugaaguuguucu

SEQ ID NO: 421505 - RNA, 64 nt, Human
gcggcagcuccucagcggagccgcagacuguccugcccugcagcaugugccuaaaggcucaagg

SEQ ID NO: 421506 - RNA, 64 nt, Human
aacaucuggcauggcucccuuuuguccuuccugugcccugcaaauauuagcaaagaagcuucau

SEQ ID NO: 421507 - RNA, 64 nt, Human
gcauagcccuucuuuugucucccuuaugaagacugcccugcagggcugagauguggcaggagcu

SEQ ID NO: 421508 - RNA, 64 nt, Human
uaguggucccuaguucauuguugagcaaguuuuagcccugcaguuuucaccaccagcaccuacc

SEQ ID NO: 421509 - RNA, 64 nt, Human
cgguggccccuagccugaggggccuggagucguggcccugcauuucuggguagggcuggcaaug

SEQ ID NO: 421510 - RNA, 64 nt, Human
cccuacuugaauuuaucugaggcagcuacagauugcccugcaagaugaguuuuuggagauaaau

SEQ ID NO: 421511 - RNA, 64 nt, Human
agguuggggugugaggacagccccaucuucaucugcccugcacucacaggagccaaugggguca

SEQ ID NO: 421512 - RNA, 64 nt, Human
gccaaacugccuguccugggaucuaguuaucuuggcccugcacucucaacaugaguagcgaaca

SEQ ID NO: 421513 - RNA, 64 nt, Human
gcaaaacacgcccccaucugcugccuuuucuauugcccugcaacgucccaucuauacgaggugu

SEQ ID NO: 421514 - RNA, 64 nt, Human
ugguggugguuucugugaguggauggaaugagcagcccugcaggggcgcugggcaugugcccuc

SEQ ID NO: 421515 - RNA, 64 nt, Human
cagggccuggccauauagccagcuccaacccaaagcccugcacagugccucacccacucccuuc

SEQ ID NO: 421516 - RNA, 64 nt, Human
cucugcagcaggggcugggagagcagaagggcaggcccugcaacucaggcugggaguaucgaac

SEQ ID NO: 421517 - RNA, 64 nt, Human
gcgcugggaaggacgcaccaaagccgggagcucugcccugcagggaguugccccaacccuuucc

SEQ ID NO: 421518 - RNA, 64 nt, Human
uagacucugguguucuauugcugagaagcaaaccgcccugcagcaucccucagccuguaccggu

SEQ ID NO: 421519 - RNA, 64 nt, Human
cuuucuucauguucagucacaugugcucucgggugcccugcauucacagcuacgugugccccuc

SEQ ID NO: 421520 - RNA, 64 nt, Human
cucgucuccaacuagaaguuuggcccggccacuggcccugcagcugcuuuuuggggguggaauu

SEQ ID NO: 421521 - RNA, 64 nt, Human
cucuuucugcagucauaccgcggacccaaugggcgcccugcacacccguuucuggggccgucag

SEQ ID NO: 421522 - RNA, 64 nt, Human
ccagugaccagcagacagugagcuucuaucccaggcccugcagccaguacaccaaggcuguagg

SEQ ID NO: 421523 - RNA, 64 nt, Human
cccaaggauugggagaucuagugucugcccuccugcccugcaacucaauugggccuuuuucggu

SEQ ID NO: 421524 - RNA, 64 nt, Human
uauuagucuuaacuaaaauuacauauuuuauaaugcccugcaacucuaaaccauccuuuuguuu

SEQ ID NO: 421525 - RNA, 64 nt, Human
ugagcagaauucauucauacuuaaaaauuuauuagcccugcauuuucauaggaagacacauuau

SEQ ID NO: 421526 - RNA, 64 nt, Human
ucacugguugauauauugcaaauagacacucugagcccugcauugcaagggcgucuuuugcuuu

SEQ ID NO: 421527 - RNA, 64 nt, Human
cggagccucagaaagggagcugaggccaugcacggcccugcaguuucuccucaggcuuugguuu

SEQ ID NO: 421528 - RNA, 64 nt, Human
gagacaggcgcagguggguguccucagcgugcgagcccugcaccccccagguccugggacuccu

SEQ ID NO: 421529 - RNA, 64 nt, Human
ucacaccugaacgcugcugccagccgaugccccagcccugcacgccacccacuaucccggcacg

SEQ ID NO: 421530 - RNA, 64 nt, Human
cagcuggauggccacgugcaggggucaaggcugggcccugcaguggggcgggccgccagcccca

SEQ ID NO: 421531 - RNA, 64 nt, Human
cccccugccugguucuaggcugcugcacaccaaggcccugcaucugucugcucugcauauaugu

SEQ ID NO: 421532 - RNA, 64 nt, Human
ccucaguuugucugcuggucucuuggggggccaggcccugcacgucucuccuacccggccucaa

SEQ ID NO: 421533 - RNA, 64 nt, Human
aggcucuuugccuuguccaccagggcucagccaagcccugcaguguguccccgcucggggaggg

SEQ ID NO: 421534 - RNA, 55 nt, Human
agaaacugagcaaggccugagcgcugcccugcaccuccgcagaccugcugugaug

SEQ ID NO: 421535 - RNA, 64 nt, Human
gagcaaagagcucuugaucccgauuucaugcacagcccugcaguaaggagcccagaaggaacau

SEQ ID NO: 421536 - RNA, 64 nt, Human
ccaggccugugcgugguggaaaaagccagccuuggcccugcagccuccaccucgccgcuggggg

SEQ ID NO: 421537 - RNA, 64 nt, Human
cagaagaagaguguacaugcucaacaaauccuaggcccugcauuccugucauccucauccgggg

SEQ ID NO: 421538 - RNA, 64 nt, Human
aauuuagagagccauuccuagaaaauguccuacugcccugcauuugacaaacaagcauccuuua

SEQ ID NO: 421539 - RNA, 64 nt, Human
agagaguuggggcccccugagcccugagccaccagcccugcagccugcccuaucuccgcauuuc

SEQ ID NO: 421540 - RNA, 64 nt, Human
acgccgaugcugcuaaacucagugccugagcccggcccugcagccccagccgcagugucugaag

SEQ ID NO: 421541 - RNA, 64 nt, Human
caggcaacccugaggcagcuggcucccucucucugcccugcagggcuugccgcagggcgugagg

SEQ ID NO: 421542 - RNA, 64 nt, Human
aucuccaggcagcucagaucucuuuccugccuuugcccugcacuguuccccgguacuuccuccu

SEQ ID NO: 421543 - RNA, 64 nt, Human
ccucgugccguggcugggguccugggagguggucgcccugcagugcaagcugcugcuccagagc

SEQ ID NO: 421544 - RNA, 64 nt, Human
gaggguagccuugauuuguucuuacaguuaagaagcccugcagagcacaaacuucagaaacccg

SEQ ID NO: 421545 - RNA, 64 nt, Human
uauuuaucucuuccugcuccucgauaggccacuggcccugcacccuuuaccuucuccacucuuu

SEQ ID NO: 421546 - RNA, 64 nt, Human
cuacucauggagccagcagccaggcaaugguguggcccugcacuggcccuuggccuccacacuc

SEQ ID NO: 421547 - RNA, 64 nt, Human
uuucucugcaucagguguaucguauugaguggcugcccugcagaagaugugaugaauuauccug

SEQ ID NO: 421548 - RNA, 64 nt, Human
ccucaugaagccaugccucgacggcauucaggaagcccugcaaacgugcuuuuugaacucauug

SEQ ID NO: 421549 - RNA, 64 nt, Human
uggggccuccucccauucaguauauacccugagggcccugcaggcaaccugggacucacaugau

SEQ ID NO: 421550 - RNA, 64 nt, Human
cacgacagccacagugugugcacucgaugaugcggcccugcaacggaggaggacagugagacga

SEQ ID NO: 421551 - RNA, 64 nt, Human
gcccagaccccagcacagauauccacacaccccagcccugcaguguagcugacccuaaugugac

SEQ ID NO: 421552 - RNA, 64 nt, Human
agaagggauucagaaauaugauguaguagaacaugcccugcaggaagaaaauguuuucucuccu

SEQ ID NO: 421553 - RNA, 64 nt, Human
uuuauaugucaguugcugcccuucacacuaccaggcccugcagccacaguguucuguuggagaa

SEQ ID NO: 421554 - RNA, 64 nt, Human
augcuucuauccauugcuuucugugauuagggcggcccugcagcauaucucacagcagacacag

SEQ ID NO: 421555 - RNA, 64 nt, Human
cagccgaacaccaaagucaugggagugggcugcagcccugcaagcaaccccgcgcuugggaagg

SEQ ID NO: 421556 - RNA, 64 nt, Human
aagcagccaccguuuccaccccuuucauuagaaggcccugcauccguaaauucgcgcaucucug

SEQ ID NO: 421557 - RNA, 64 nt, Human
ccuugccccauccauccgcuugaggcauggcaccgcccugcaucccuaauaccaaaucugacuc

SEQ ID NO: 421558 - RNA, 64 nt, Human
gagauuugacggaauccauuuuaugccaagugcugcccugcacuguuucugcaauauguggugu

SEQ ID NO: 421559 - RNA, 64 nt, Human
guguuaggucuaggaucccaguucuaguaggacagcccugcaagacaaucaaccagaagccucc

SEQ ID NO: 421560 - RNA, 64 nt, Human
ggguucagagguggcacaccgggacaaagcugaggcccugcaccucaacagcugacugccaggu

SEQ ID NO: 421561 - RNA, 64 nt, Human
uuauugauuugagcagcauaugcugugauuggcugcccugcaaauuuguuucccuuaaggaacc

SEQ ID NO: 421562 - RNA, 64 nt, Human
uuugccaggcuccugggaugggccgcuuucagaagcccugcagugccuccagauggaaaggcgg

SEQ ID NO: 421563 - RNA, 64 nt, Human
cccgcgcccgcugcccccgcggcuccugcagccggcccugcagcgcuacuuucugccagcggac

SEQ ID NO: 421564 - RNA, 64 nt, Human
uugugccugcugaagugaucaccccccgcccccagcccugcaucaggccacaggucuuggcuuu

SEQ ID NO: 421565 - RNA, 64 nt, Human
uuuccuucccucucugaugucccagugcucaccagcccugcagcccaccagacgucaggcccug

SEQ ID NO: 421566 - RNA, 64 nt, Human
agggucugcugcaucugcccccuucuuaccucgugcccugcagggcuccagggcuauuuggagg

SEQ ID NO: 421567 - RNA, 64 nt, Human
cucucucccucaccaaaacaaaagggccaucucugcccugcacuugugcagaaagucagggaua

SEQ ID NO: 421568 - RNA, 64 nt, Human
uauauauacacacacacacacauacuuaaaucuugcccugcaugaaauucaaauacauggaggc

SEQ ID NO: 421569 - RNA, 64 nt, Human
gacugagcaguucagugguacauaaauuuaucucgcccugcauauucccaacauacuuaacaca

SEQ ID NO: 421570 - RNA, 64 nt, Human
gguucaucguucugccuuguccacugggggaccagcccugcagaccacucugacaagucuucag

SEQ ID NO: 421571 - RNA, 64 nt, Human
gcaucauuccagugguggucaguagauccaggacgcccugcaggacucagccuguacagggaga

SEQ ID NO: 421572 - RNA, 64 nt, Human
ccaggccuguccccgacugccauuggcaacaguggcccugcagcccccagcccuccccacccag

SEQ ID NO: 421573 - RNA, 64 nt, Human
ggccugauggggcccccauggggagcuggagccugcccugcagccuggagaagaggguggcugu

SEQ ID NO: 421574 - RNA, 64 nt, Human
cuaagaaaagccaucuucauucguggagacuguggcccugcaacccuggagaaggacuugcugg

SEQ ID NO: 421575 - RNA, 64 nt, Human
acuaaggugaccuccaaccugcccugagccagcugcccugcaggugccacgugagccugcucug

SEQ ID NO: 421576 - RNA, 64 nt, Human
cuaggcccugccgcagaaccaccaucccugggaggcccugcagagcccaccuguggggaaagag

SEQ ID NO: 421577 - RNA, 64 nt, Human
ugcccauggggacacggcccaggacagcccgggggcccugcagcuucaggucccuaugggcgca

SEQ ID NO: 421578 - RNA, 64 nt, Human
gggcgcagcugcuccgugagcugagucucccacugcccugcacaccaccacauuggaccugugc

SEQ ID NO: 421579 - RNA, 64 nt, Human
gacggugggcggggagagcucgaggggaggcccagcccugcaggugggacuggcucucccuccc

SEQ ID NO: 421580 - RNA, 64 nt, Human
caaguugcuaagagugaucugucccagaaaagcggcccugcaaguuugaggaccgcuuauucca

SEQ ID NO: 421581 - RNA, 64 nt, Human
uuucuuuuuuuuuuuuuuacaguauccaaaaauagcccugcaaaaauucagaguccuugcaaaa

SEQ ID NO: 421582 - RNA, 64 nt, Human
ucuacguuuuauaacuuggugagugacgaugagagcccugcaccuggccagagugucacaggca

SEQ ID NO: 421583 - RNA, 64 nt, Human
ccgccucaguuccuuugcgucuguugccuccccagcccugcacgcccuggcuggcacuguugcc

SEQ ID NO: 421584 - RNA, 64 nt, Human
ugcuccuucugccgccacgcccagcuccccaccugcccugcacucugcccucuuugcccaggau

SEQ ID NO: 421585 - RNA, 64 nt, Human
gugcacucuacucugcgacgauccccauggaacagcccugcacgcccaggaugaaggggccaga

SEQ ID NO: 421586 - RNA, 64 nt, Human
ccagcgccccaggcuggacugagccccucacgccgcccugcagcccccaugccccugcccaaca

SEQ ID NO: 421587 - RNA, 64 nt, Human
ggaagaggccgggcauuggugguccccaggcugggcccugcaggugcugggccuucaggcccag

SEQ ID NO: 421588 - RNA, 64 nt, Human
ccccggacgcuggcucgggacugucuucaacccugcccugcaccuugggcacgggagagcgcca

SEQ ID NO: 421589 - RNA, 64 nt, Human
acugcuugaggaaggaugucagcccaaucagcgggcccugcagaguuacugauguucuuucaga

SEQ ID NO: 421590 - RNA, 64 nt, Human
ugagagagcaccggaucaucucagacauaucggugcccugcaagguaagccagugccgcugcuu

SEQ ID NO: 421591 - RNA, 64 nt, Human
aaaaagaguuuggcugauuccuaaaacucugccagcccugcaguaaucuccagggccugguuau

SEQ ID NO: 421592 - RNA, 64 nt, Human
ggagcccuccuggacuguuucuuuaauuucaaaagcccugcagacauaguaccuggucagaacu

SEQ ID NO: 421593 - RNA, 64 nt, Human
cucugucuccuuuccaggacccuggauguugccugcccugcaacucagcugcccgaccccagga

SEQ ID NO: 421594 - RNA, 64 nt, Human
gggaacacuauaagcuucgaccauucaggaaucugcccugcacuuugcauaucuguauagaaaa

SEQ ID NO: 421595 - RNA, 64 nt, Human
ccgagcccagcucuccugucuccuccacagccaggcccugcacgcccaccuccucggacacagg

SEQ ID NO: 421596 - RNA, 64 nt, Human
uccuuuuggguccccgaggugggguccccucccagcccugcauccuccgugcccuagaccugcu

SEQ ID NO: 421597 - RNA, 64 nt, Human
gccacacagccgccuccagaccagcacucggacugcccugcaguggccgcuugggccucccugg

SEQ ID NO: 421598 - RNA, 64 nt, Human
aucccauuucuccugccucuggaagguggguggggcccugcaccguggggcuggacugcgcuaa

SEQ ID NO: 421599 - RNA, 64 nt, Human
gccuuggggcagggagagagggaaccugcucacggcccugcagcagagcagggcgcaaacccag

SEQ ID NO: 421600 - RNA, 64 nt, Human
ucacagaauggcugggcugagaacgcugcccagggcccugcagcuggcgggagaggugucuggu

SEQ ID NO: 421601 - RNA, 64 nt, Human
caucgcccgcccgcccgcccgcccgccaggcgcugcccugcaggugcucucguccucccgugcc

SEQ ID NO: 421602 - RNA, 64 nt, Human
agaagagaguggguccagauuucuggugguuucugcccugcagaugucuaacacauaagccagg

SEQ ID NO: 421603 - RNA, 64 nt, Human
ccuuagagaggucucccagauuccccguaaagcagcccugcagccucugccucucucagccgca

SEQ ID NO: 421604 - RNA, 64 nt, Human
uccucccucuccuggcccacccugcucuucccucgcccugcaaauuagguggguguggcaaggg

SEQ ID NO: 421605 - RNA, 64 nt, Human
uaaggagaaacaaaucuauuuagagaaacagcuggcccugcaaauguuuacagaaaugaaauuc

SEQ ID NO: 421606 - RNA, 64 nt, Human
cagaggauucaaaccgcaaguaugggagauuuaggcccugcagaggcagaccauuccuuaguau

SEQ ID NO: 421607 - RNA, 64 nt, Human
uccccuccugccaguccuucgccugucccuugacgcccugcauccuccucccugacucgcagcc

SEQ ID NO: 421608 - RNA, 64 nt, Human
cgccccguaguugcucuuucgguaguggcgaugcgcccugcaugucuccucacccguggaucgu

SEQ ID NO: 421609 - RNA, 64 nt, Human
cuccucagagguaggugcucccucaggaucaggugcccugcagacccagagccaguuccuaucc

SEQ ID NO: 421610 - RNA, 64 nt, Human
guggcauguacuagaauuggauccuaggugcuuagcccugcaauaucagggccucacugguggg

SEQ ID NO: 421611 - RNA, 64 nt, Human
agcccggcagcucuggggaggcauccgugugccggcccugcagugccugcccacggucaggcau

SEQ ID NO: 421612 - RNA, 60 nt, Human
ucgacaguccgcuacacuagccugggcugggcccugcaguggccagcagggagcccagcu

SEQ ID NO: 421613 - RNA, 64 nt, Human
cucugcagaacuaauggcugugacuucagagaaagcccugcaggaaguuuaaccugcgugucau

SEQ ID NO: 421614 - RNA, 64 nt, Human
cuuucaagagauacuuacagauguugagauggcugcccugcauuuccagcuaaucucuucugcu

SEQ ID NO: 421615 - RNA, 64 nt, Human
accaaggcccugacagcccugccuucugcccucugcccugcaugggcaggcauuuguucccuac

SEQ ID NO: 421616 - RNA, 64 nt, Human
uuugcuguuugucuucugucucaugggucucugcgcccugcacuucguacuuuccgagaguuua

SEQ ID NO: 421617 - RNA, 64 nt, Human
gaacaaaggugaacaugaaggcgaggaugcuggggcccugcagugcgcucuaggcugugcguga

SEQ ID NO: 421618 - RNA, 64 nt, Human
ccuggggcauguucagggcaggguugagggggacgcccugcacauggcuuugcugugcaaugac

SEQ ID NO: 421619 - RNA, 64 nt, Human
cagaaggaggccuccuugggccuggucccccuuugcccugcaguggaaugagggccccucagcc

SEQ ID NO: 421620 - RNA, 64 nt, Human
gaguccauucauaguguggggaagaaugauuuuugcccugcaggagaaggucuaauugaaauaa

SEQ ID NO: 421621 - RNA, 64 nt, Human
uccaucaucauguguguccacgacugucuccauggcccugcaaaaggacucucaggaccaaagc

SEQ ID NO: 421622 - RNA, 64 nt, Human
gaacuucagcauucccaucacggugcuccagccggcccugcagcaguacagccagacccaagac

SEQ ID NO: 421623 - RNA, 64 nt, Human
uguccaaacugccuaagcccuccgccauucucaagcccugcagucacagcuacacagaucacag

SEQ ID NO: 421624 - RNA, 64 nt, Human
gcaugucccagccccugggcccuagcccuuuccugcccugcagucugcagugccagcacgcaaa

SEQ ID NO: 421625 - RNA, 64 nt, Human
aaaaugccaaccccugguccucgcuuuacugugggcccugcaggacuggcucuccauuuccugc

SEQ ID NO: 421626 - RNA, 64 nt, Human
cccaaccgaggcugucaggugcuacgagcugcuggcccugcaccugucugucauccccacugac

SEQ ID NO: 421627 - RNA, 64 nt, Human
ugucaacaccagccccgagcggggaggcgaggaggcccugcaugccuuccugcucgugcacucc

SEQ ID NO: 421628 - RNA, 64 nt, Human
agaaccuucaauguagcuaucuuccagggggagggcccugcagccucgcuccucagaugucugc

SEQ ID NO: 421629 - RNA, 64 nt, Human
ucuagcuccagggcacuaagccacaggaggcagcgcccugcagccucccguccacacugccagc

SEQ ID NO: 421630 - RNA, 64 nt, Human
aggcugucuucaccagcugggcugggccagccuggcccugcagggcagagcacgcuuguuuggg

SEQ ID NO: 421631 - RNA, 64 nt, Human
gccugcaaccuuugcacuccacugugcaaugcuggcccugcacgcuggggcuguugccccugcc

SEQ ID NO: 421632 - RNA, 64 nt, Human
ccugcggccagccagggagguggaccgcaugcuggcccugcagccccgccuucgccugcgccug

SEQ ID NO: 421633 - RNA, 64 nt, Human
gucuccccgcugagcccaggcacuugcccaggccgcccugcaggaccacugcaauaaacgccuu

SEQ ID NO: 421634 - RNA, 64 nt, Human
uaaauuaucucagucugaguuugugaggaagugugcccugcaguggaauggcuccuaaucaggg

SEQ ID NO: 421635 - RNA, 64 nt, Human
ggaacccagcucucagggcugucuugguggaugggcccugcaagacacaggcucagcaugcaga

SEQ ID NO: 421636 - RNA, 57 nt, Human
gggagaaggcaaaucugugaggccggggcccugcaccugugcagcgaagcuuagcgu

SEQ ID NO: 421637 - RNA, 64 nt, Human
ggacaaagagagcaggaccuccagacucuggggagcccugcagaccuugacaauuugccugacu

SEQ ID NO: 421638 - RNA, 64 nt, Human
ccaaucccuggccauuuggccccaggggacgugggcccugcaggcugcaggagggcacuggagc

SEQ ID NO: 421639 - RNA, 64 nt, Human
gccuccucaggggguaggagagcacugccucuaugcccugcagagcaauaacacuauauuuauu

SEQ ID NO: 421640 - RNA, 64 nt, Human
ccucccuaucucaccugcccagcccugugcuggggcccugcaauuggaauguuggccagauuuc

SEQ ID NO: 421641 - RNA, 64 nt, Human
cccauggcaucuucugcucuucccucccggcucugcccugcacauccuguugagccaagcccca

SEQ ID NO: 421642 - RNA, 64 nt, Human
ugagggccagagggggauauauaugauuccccaggcccugcaggauuuuggggggggggaggug

SEQ ID NO: 421643 - RNA, 64 nt, Human
ucccacugcacccccuccugcugcagaggggcaggcccugcacuguccugcuccacaguguugg

SEQ ID NO: 421644 - RNA, 64 nt, Human
agcaggagcaggggcaggggcaggggcagggagagcccugcauuuccucuacgcccagguuccg

SEQ ID NO: 421645 - RNA, 64 nt, Human
gggcaacagcacccuaguuucauucucaacucuagcccugcacacucaccuguggcacggaaug

SEQ ID NO: 421646 - RNA, 64 nt, Human
accuguuuaugagaugcugguuuucuacccaacggcccugcagccagcucacguccagguucaa

SEQ ID NO: 421647 - RNA, 64 nt, Human
uauuaaugccucucccgcaccaggccgggcuugggcccugcacagauauuuccauuucuuccuc

SEQ ID NO: 421648 - RNA, 64 nt, Human
uuucugcaaguccacuggggcuggccccagccaggcccugcagggcuggucagggugucugggg

SEQ ID NO: 421649 - RNA, 64 nt, Human
auguggguggcacugaccuguucuguugacuggggcccugcagacucuggcagagcugagaagg

SEQ ID NO: 421650 - RNA, 64 nt, Human
uuggacguaagccccucaugcugacucagggugggcccugcaugugaugacugggcccuuccag

SEQ ID NO: 421651 - RNA, 64 nt, Human
gcaugggggcgugccugugugggggacagggagggcccugcauggauuuuccuccuuccuaugc

SEQ ID NO: 421652 - RNA, 64 nt, Human
agagagauagaggcuugccccagccuguaccccagcccugcagcaggaagcccccagucccagc

SEQ ID NO: 421653 - RNA, 64 nt, Human
cccccacccacggaaggacuugaguuguuuacaagcccugcacugaggcagauuggugcuguuc

SEQ ID NO: 421654 - RNA, 64 nt, Human
cagcagcuuccuggccuacucccaaucacacugugcccugcaccucccaccaagggggaacccc

SEQ ID NO: 421655 - RNA, 64 nt, Human
uggugcccgccgaccugcggcccccgugguuccugcccugcaccuucucagauggcuacgucug

SEQ ID NO: 421656 - RNA, 64 nt, Human
agcucagaggugggggaggccuguggugugaggugcccugcaccugcuccugcuccugucaccc

SEQ ID NO: 421657 - RNA, 64 nt, Human
cggaccgaggcuaggacguggccggcgcucuccagcccugcagcagaagaacuucccgugcgcg

SEQ ID NO: 421658 - RNA, 64 nt, Human
agcagcccuggguucuccucagugagggaucccugcccugcaccagcacccugagauggagcug

SEQ ID NO: 421659 - RNA, 64 nt, Human
acagaggaagcuuuagauagagacuuuagacccugcccugcagagucaagacuugaggccauug

SEQ ID NO: 421660 - RNA, 64 nt, Human
ccucucucuccucagauuuccuucuuggcccugugcccugcacuuucuucacuguguucaagug

SEQ ID NO: 421661 - RNA, 64 nt, Human
agugagccuggcucccacgcaaguggcacuuuaagcccugcauccucgguugagaguaaaaggc

SEQ ID NO: 421662 - RNA, 64 nt, Human
acggguccccagaucugcuggaaugauuguccgggcccugcagagcaggggccccaacagaguu

SEQ ID NO: 421663 - RNA, 64 nt, Human
ggucuggggccucacagcugucaucacugaguuugcccugcagcugcuggcaccugguaccuac

SEQ ID NO: 421664 - RNA, 64 nt, Human
uccuuggccuagcccacccugcugccuucugacggcccugcaauguaucccuucucacagcaca

SEQ ID NO: 421665 - RNA, 64 nt, Human
ccuggguggaucggccuccucuucaccccggcaggcccugcaguguucgcuuggcuccaugcuc

SEQ ID NO: 421666 - RNA, 60 nt, Human
cggaugauggcgccaaguaguggguggccggcccugcagccucccgugucccgucuccuc

SEQ ID NO: 421667 - RNA, 64 nt, Human
gggccacuggguuaggaccugaggaccucacuuggcccugcaaggcccgcuuuucagggaccag

SEQ ID NO: 421668 - RNA, 64 nt, Human
gcauaaggcugucuuggaucccaacaggcacccagcccugcauggggggagccugggccuaaua

SEQ ID NO: 421669 - RNA, 64 nt, Human
gcugcaggagcaggugcagugggcgcccacacuggcccugcagugaugcagggcgggagggaga

SEQ ID NO: 421670 - RNA, 64 nt, Human
guccagccacucuucaccuggcucccugcucugggcccugcaccagagcugccacccucuucuu

SEQ ID NO: 421671 - RNA, 64 nt, Human
cuuaggggggccuccuugccuuucucauucuuuugcccugcauccugucauuucuguucuuguc

SEQ ID NO: 421672 - RNA, 64 nt, Human
cccuugcacugggucagccuuuggacaggacccagcccugcaccguucacuguauuuggagaaa

SEQ ID NO: 421673 - RNA, 64 nt, Human
accgucuuuaccccugcugaccucccaccuauccgcccugcagcagaaccuuggcgguuuauag

SEQ ID NO: 421674 - RNA, 64 nt, Human
cagggaggcagcccguggugaggcugcccgccgugcccugcaguaccucaagaucauggcaggc

SEQ ID NO: 421675 - RNA, 64 nt, Human
guuuauuucuuaagccauagucaguguaaauacagcccugcagcagguaaaugugaguaaagag

SEQ ID NO: 421676 - RNA, 64 nt, Human
agccagcuucuguguguccgcccucccagcuccagcccugcaggccgucuuuuccgucuccagc

SEQ ID NO: 421677 - RNA, 64 nt, Human
gcugacacaaaacaccucuuggccauucacaggggcccugcaaccucacgagaaaggagauagu

SEQ ID NO: 421678 - RNA, 64 nt, Human
cagguccugguggggcagcuccucugucucgagcgcccugcagacccugcccuuguuuggggca

SEQ ID NO: 421679 - RNA, 64 nt, Human
ccccaccacggccacgccaggcaaagcgccagcagcccugcacuccacgcuggccaagaaggcc

SEQ ID NO: 421680 - RNA, 64 nt, Human
cuuucuggccuggcugggccccccguccugccgagcccugcagagugggcucugugugcuggcu

SEQ ID NO: 421681 - RNA, 64 nt, Human
agagaggccugccuuccggauuccaggcgggcaugcccugcaaaccccgccugggccucccuug

SEQ ID NO: 421682 - RNA, 50 nt, Human
uucccuugguggagagcuaggcccugcauggccccagcaaugcagucacc

SEQ ID NO: 421683 - RNA, 64 nt, Human
gaaggagaggaauacuaauuauccauuccuuuuggcccugcagcaugucaugcucccagaauuu

SEQ ID NO: 421684 - RNA, 64 nt, Human
accaaacuacuucuccaacacccggcagcacuuggcccugcaagcuuaggaugagaaccacuua

SEQ ID NO: 421685 - RNA, 57 nt, Human
cguccagccagagguauuagcugcugagcccugcaagggccccugcaauccuguccc

SEQ ID NO: 421686 - RNA, 64 nt, Human
guccuugugccaggucaaggugggggcaggcugggcccugcauuucuggggcaggaacagaggg

SEQ ID NO: 421687 - RNA, 64 nt, Human
uuauugaggaacgauccgaccaccucacaggccugcccugcagcuggaagacucggcgcucuaa

SEQ ID NO: 421688 - RNA, 64 nt, Human
guucuccugauguagcuugagauauaaaggaaaggcccugcacagguggcuguuucuugucugu

SEQ ID NO: 421689 - RNA, 64 nt, Human
aaaauccuacugugcccaguuuccuucacuacaugcccugcauuuuuuauuuaaauauuuagcu

SEQ ID NO: 421690 - RNA, 64 nt, Human
cgacuugaauguuuauacuuuuauucuauaauuugcccugcacuuauuuuacaaccuaguaaua

SEQ ID NO: 421691 - RNA, 64 nt, Human
aaaaauuguccagauuccacgugcagcaugcuuggcccugcauuuaauuuaagaaggauuaaua

SEQ ID NO: 421692 - RNA, 64 nt, Human
caugauauuuauuggcacuuccucaccucccuuugcccugcagcuguuuuuaugcuucuuuuuc

SEQ ID NO: 421693 - RNA, 64 nt, Human
auucugggagcuggggaaccuggucucaaggcaggcccugcaguuccacagagguggcaggucu

SEQ ID NO: 421694 - RNA, 64 nt, Human
gggcggugucaggucccagcgagccacaggaacggcccugcaggagcagggcggcugccgacuc

SEQ ID NO: 421695 - RNA, 64 nt, Human
ccagucucuccucggaggccuuucucucccaugggcccugcaagccccuuggggccauguuuuc

SEQ ID NO: 421696 - RNA, 64 nt, Human
ugauaaaaagcaccucaugagauucccuugaucagcccugcagcuguaguacagugcugugccc

SEQ ID NO: 421697 - RNA, 64 nt, Human
gaaaaaaaaagaggggacuucgaaaaaaaaaaaagcccugcaaaauauucuaaaacauggucuu

SEQ ID NO: 421698 - RNA, 64 nt, Human
acugaucuggcugccugaugaguguuuccacgcagcccugcauauuuagugaccaaggcaucaa

SEQ ID NO: 421699 - RNA, 64 nt, Human
aauuauuuucuaaucccuuucugaguacucuggggcccugcauuuaugaggcaccuaccuucau

SEQ ID NO: 421700 - RNA, 64 nt, Human
gaucacccaaugcaucacguaccccacugggccagcccugcagcccaaaacccagggcaacaag

SEQ ID NO: 421701 - RNA, 64 nt, Human
acaucccuuccugucucccacaaccccugugacugcccugcauguguucaugaccuccgaaggc

SEQ ID NO: 421702 - RNA, 64 nt, Human
gucaacacucauacuucaucucauucucccuucugcccugcagauuagauuacuuagcacacug

SEQ ID NO: 421703 - RNA, 64 nt, Human
ggacuuccgcucccuggauauguccagucauccugcccugcagcacgcggccuugucugggugc

SEQ ID NO: 421704 - RNA, 64 nt, Human
ugguuuuggauuaaauccaacaguuuauuuguaagcccugcagcagauuucuuugauaauuuag

SEQ ID NO: 421705 - RNA, 64 nt, Human
gugggaggccggagacugcccuugaccggcaaaugcccugcaacgguggcuccugacaccaggg

SEQ ID NO: 421706 - RNA, 63 nt, Human
ucauugcgagguucuacuagcucccugccccucgcccugcagagaagagaaccaugccagggg

SEQ ID NO: 421707 - RNA, 64 nt, Human
gcccaugacugugcccaaugugcuucucaccagagcccugcaaggggaagucucauuagccccu

SEQ ID NO: 421708 - RNA, 64 nt, Human
cacauccagguggccccacggccccuacaggcuggcccugcaauggggcccugagcccucccuc

SEQ ID NO: 421709 - RNA, 64 nt, Human
auccuucuaccuccugagcccaggggucccaggcgcccugcagcugucuccucggccauccugu

SEQ ID NO: 421710 - RNA, 64 nt, Human
gggcuucaaaggaaggcuauggaguuugcugugggcccugcaaccuucccagccacuccugcug

SEQ ID NO: 421711 - RNA, 64 nt, Human
cccagcugcuggaggagaggggagaugccaaggugcccugcaggaccucccuccgggccacacc

SEQ ID NO: 421712 - RNA, 64 nt, Human
gucuucuaagucaguguuaguuuugaaauuuuuggcccugcauaaguucugcauagcaucuaau

SEQ ID NO: 421713 - RNA, 64 nt, Human
gugccugcccaggcuguuccugccuaaaucuccagcccugcaugccgucucaagggugggcccc

SEQ ID NO: 421714 - RNA, 64 nt, Human
gggauggaaacagggccacuucagagggucuccugcccugcagggccuuucuacccguguccac

SEQ ID NO: 421715 - RNA, 64 nt, Human
augacauccaugcaggcagcagugcugaauccaugcccugcaauguccaaccgccaacugcagu

SEQ ID NO: 421716 - RNA, 64 nt, Human
cguccucugggccccccaacacacgucccauuuagcccugcacagcggucuccuuccccuaagc

SEQ ID NO: 421717 - RNA, 64 nt, Human
cuuucugggauccuggccacgucauugugcuccugcccugcaggcuggcucccgggggucucug

SEQ ID NO: 421718 - RNA, 64 nt, Human
gcagcuccuugaagguccucugccuccagcuguggcccugcauccagauaccugccucguccga

SEQ ID NO: 421719 - RNA, 64 nt, Human
ggcgccagcagccucugccagaguggaagccagagcccugcagguguccggcgcagccguggga

SEQ ID NO: 421720 - RNA, 64 nt, Human
agacuugaggccuuuucucuggcuuuccuccuuugcccugcaguagcaacuggugcugggacaa

SEQ ID NO: 421721 - RNA, 55 nt, Human
gggaguacauugaggacugagaauggcccugcauaaaaugaacucugaaaacuuu

SEQ ID NO: 421722 - RNA, 64 nt, Human
cuccuugcuugcacucacccuuucuuauugucuugcccugcaucugggggucugaauuuuuggg

SEQ ID NO: 421723 - RNA, 64 nt, Human
gauccagagcaagcaccgcccccuggacgagcgggcccugcaggacuuuccugugugcgugagc

SEQ ID NO: 421724 - RNA, 64 nt, Human
ugccucggagagcaucauucucugccuaggcaaggcccugcaucccuugccucaggccgggcug

SEQ ID NO: 421725 - RNA, 64 nt, Human
ucuguguaguguuuuacgucuccaugguaacugugcccugcaccccucgguagccgcccuguua

SEQ ID NO: 421726 - RNA, 64 nt, Human
cagaagguuuucaugaacucuuuuuacugaaaaugcccugcauuuaaaaauguuuauuuuagac

SEQ ID NO: 421727 - RNA, 64 nt, Human
acaaacaaaaaaauuaaccgagacacuuuauauggcccugcacagaccuggagcgccacacacu

SEQ ID NO: 421728 - RNA, 64 nt, Human
ugaagccccaucucuacuaaaaauacaaaaauuagcccugcaugguggcaggugccuguagucc

SEQ ID NO: 421729 - RNA, 64 nt, Human
acucuacugcaaggcucuggacuucuuuguaccugcccugcacugugagucccaggccaugccu

SEQ ID NO: 421730 - RNA, 64 nt, Human
cccaggacugaacucuccaggccuccuccccugagcccugcagcuggcuggagucuugcuucca

SEQ ID NO: 421731 - RNA, 64 nt, Human
ccgaggcuguaggggccuagaaguccaccauccugcccugcagucacauggguguggccuccaa

SEQ ID NO: 421732 - RNA, 64 nt, Human
cuguguuuggaguggauaauugucccuccccucagcccugcaccagaggucucauauguuaccc

SEQ ID NO: 421733 - RNA, 64 nt, Human
caggauaccaugcuguccucuuagugaccucgucgcccugcaaccuccaguggggaagagucac

SEQ ID NO: 421734 - RNA, 64 nt, Human
cagacugucggccagagucuguuucaggagcggcgcccugcaccugacagcuuuaucuccccag

SEQ ID NO: 421735 - RNA, 64 nt, Human
gcucccugcacucugguguucaugccgcccccgugcccugcacaaaaaccaccaccagcagcuc

SEQ ID NO: 421736 - RNA, 64 nt, Human
agccgccuggacucagccauggcugugugcuuuggcccugcagcucugggccaccugcuggugu

SEQ ID NO: 421737 - RNA, 64 nt, Human
cugggggaggggugacgauucuccucaggcuuuggcccugcaagcaaacccacauaucugcucu

SEQ ID NO: 421738 - RNA, 64 nt, Human
cucagagaaacagaggccugggcucgguucccgggcccugcaggggcaggcccaggcagcguca

SEQ ID NO: 421739 - RNA, 64 nt, Human
guguggcucuguaugacuguugcugaaauauaaagcccugcaaccugccugugugucuggugug

SEQ ID NO: 421740 - RNA, 64 nt, Human
cgcagggaaacacggggugagacagcaggaaggggcccugcacgccgggacgccaccuccgcca

SEQ ID NO: 421741 - RNA, 64 nt, Human
gccuguggccagucuuccugaucuccaucuuucugcccugcauaccagcccucccagcagccac

SEQ ID NO: 421742 - RNA, 64 nt, Human
agcacugccuuccaugaacagggacagaccagaggcccugcaaggacucccccucagaccucca

SEQ ID NO: 421743 - RNA, 64 nt, Human
caggugucugcugcucaccuggcucuggagggcugcccugcagcugggccuggggacaggucgg

SEQ ID NO: 421744 - RNA, 64 nt, Human
ccgaccugagucuggggccaggggagcccaggcugcccugcacuccugccucccagcccacagc

SEQ ID NO: 421745 - RNA, 64 nt, Human
aggugguggugggguaggcgugaugucagcagaagcccugcaggcugggugggcaggacacgug

SEQ ID NO: 421746 - RNA, 64 nt, Human
gaaccacauuuuaggaauuugcuucccacccagugcccugcauuuaaucagcaccugaugacuu

SEQ ID NO: 421747 - RNA, 64 nt, Human
cugugacuugcagcccaccugccacccaggacgggcccugcacuuugaauaggcuuuccauuuu

SEQ ID NO: 421748 - RNA, 59 nt, Human
acuccgcaucucaagaauaggaaggcacggcccugcaauauggacucagcucuggcucu

SEQ ID NO: 421749 - RNA, 64 nt, Human
ccuggaagagacccccguguucagagugcuggcagcccugcacguguccagggacacugcauuu

SEQ ID NO: 421750 - RNA, 64 nt, Human
ucucgcugcuggcagaaaagccugaucccaggaggcccugcaguucccccgacccgcggauggc

SEQ ID NO: 421751 - RNA, 64 nt, Human
gcgauaagaugugguuugaagcugaugggugccagcccugcauugcugagucaaucaauaaaga

SEQ ID NO: 421752 - RNA, 64 nt, Human; identical to SEQ ID NO: 421751

SEQ ID NO: 421753 - RNA, 64 nt, Human
cagcucagaggucccugugggggcugggggagcugcccugcaggucuuggcacaugcacagcag

SEQ ID NO: 421754 - RNA, 64 nt, Human
cucugggucccuguuuuaccauccugggagcaaggcccugcagcuccacgagaccuuuaccccg

SEQ ID NO: 421755 - RNA, 54 nt, Human
ucaagaugccccgggacugaggccgcccugcaccuucagcggauuuggggauua

SEQ ID NO: 421756 - RNA, 64 nt, Human
gcgcgucugggcgcggcgcgagcggccgggcagggcccugcagaagcacaacuccggccccugg

SEQ ID NO: 421757 - RNA, 64 nt, Human
uggcucggcugccuuccuggggucccgugcaccagcccugcagcuagcaagucuuguguuuagg

SEQ ID NO: 421758 - RNA, 64 nt, Human
ccgcaggccagggcaggccccgcccgaccaggaggcccugcaggucguguaugagaggugugaa

SEQ ID NO: 421759 - RNA, 64 nt, Human
gguuggcuuggccaggcaggaugggcuguguccggcccugcagccuaguggaaggugcugaggg

SEQ ID NO: 421760 - RNA, 64 nt, Human
acuuugcuccccaggcaccuuuuuuacgcacgcggcccugcagagccuccgccuguaccccuuc

SEQ ID NO: 421761 - RNA, 64 nt, Human
cgcagacucaggccaggccuagaaucuccgguuggcccugcaagugccuggaggaaggauggcu

SEQ ID NO: 421762 - RNA, 64 nt, Human
gaacaauaaauauuuguugaacaaauaaauaacugcccugcauuaagucuguagcgggcuuucu

SEQ ID NO: 421763 - RNA, 64 nt, Human
agcuuggccaaauuggggaagugggauggagguugcccugcauccccccuccucugccugagug

SEQ ID NO: 421764 - RNA, 64 nt, Human
ccacccccacacucccugcucagcuccucgugcugcccugcaugcccaggcuugugagccaagc

SEQ ID NO: 421765 - RNA, 64 nt, Human
augccugcccagggacccccagcccccucccguugcccugcagcuuuaacagagugaaccaugu

SEQ ID NO: 421766 - RNA, 64 nt, Human
cugcacucccauccuuuccucucuccccguucaugcccugcacuacauagcacagccgggaugc

SEQ ID NO: 421767 - RNA, 64 nt, Human
gcaccaucccgggggucagggccuccccacaggagcccugcagugugguagcgccauggcuguc

SEQ ID NO: 421768 - RNA, 64 nt, Human
accgagagcuugccauccagccaagcugcucgaggcccugcaguggccuuggcaaugucugugc

SEQ ID NO: 421769 - RNA, 64 nt, Human
gaaggugaagcaucccaacugacuagagacucaggcccugcagggcccuauagaaccuguggcc

SEQ ID NO: 421770 - RNA, 64 nt, Human
gcaugcacaaacuucgugagaccaacacagccgugcccugcaggcaccagcacgugcuuuucag

SEQ ID NO: 421771 - RNA, 64 nt, Human
gacuccaggggguccuggcuccccugucccugcagcccugcaggucagugcaugaucuggguuc

SEQ ID NO: 421772 - RNA, 64 nt, Human
acuccgacucccuggcuuuggcauucagugagacgcccugcacacacagaaagccaaagcgauc

SEQ ID NO: 421773 - RNA, 64 nt, Human
ucgagggccaccgaggucccgcgcaccgcugccugcccugcaguggcuuuaacaguuaguuuug

SEQ ID NO: 421774 - RNA, 64 nt, Human
gggggaggggacagagcugaggauuuccuggagugcccugcaggcacagaggaggucagcaaag

SEQ ID NO: 421775 - RNA, 64 nt, Human
gcauccuuccacacuguguaugugaacagcuugggcccugcaaacacaaccaucuacacacauc

SEQ ID NO: 421776 - RNA, 64 nt, Human
accuuugcuucccgcuccuucuggacauuccagagcccugcaccaaacccuuacuuggugucug

SEQ ID NO: 421777 - RNA, 64 nt, Human
uggcuguccccaguaugcaaacacaccacggucugcccugcaaaaacaccaauggggucuagug

SEQ ID NO: 421778 - RNA, 64 nt, Human
caguuuuaacaucagugcacagcugcugcugguggcccugcaguguacguucucaccucuuaug

SEQ ID NO: 421779 - RNA, 64 nt, Human
caacagaaaauaguggcuguguuuggaagcuucagcccugcacauuugaacuagucacucuccc

SEQ ID NO: 421780 - RNA, 64 nt, Human
guaauuuucaaauguauaauauguuuacagaugugcccugcauuuagucugccuuguuccuauu

SEQ ID NO: 421781 - RNA, 64 nt, Human
ugcaaaugcaggccacucuccccaccacgucugugcccugcacuguccccacagccuuccacac

SEQ ID NO: 421782 - RNA, 64 nt, Human
gauaggcaggaccccagagagggcaggcagccacgcccugcacuguggagaagugaccuggucc

SEQ ID NO: 421783 - RNA, 64 nt, Human
cugcccaucuccagcaucuucuuccccuucccuggcccugcagggccuucuccagcucccuuug

SEQ ID NO: 421784 - RNA, 64 nt, Human
aagauguccuuugaagagccaguauaguuucugugcccugcagcagcccaagugcuuuaaagcc

SEQ ID NO: 421785 - RNA, 64 nt, Human
cuugacagacuguagcuucucuugcucucgaccggcccugcauucuuccgcacccucccuagcu

SEQ ID NO: 421786 - RNA, 64 nt, Human
cgaggacuccggguggggaccugaacuggucaccgcccugcacuucuagcccucauuuaagauu

SEQ ID NO: 421787 - RNA, 64 nt, Human
caggcuccggccauuggauguugaauucaugaaggcccugcaucagcgggucaacaucgugccu

SEQ ID NO: 421788 - RNA, 64 nt, Human
aaggcugguuaacugccagaaaauguaccuccaggcccugcaugccgucaguaacccgcccggc

SEQ ID NO: 421789 - RNA, 64 nt, Human
cuccuccuggaagauagagccaggcugacccgaagcccugcagagccccauccccaggagugcc

SEQ ID NO: 421790 - RNA, 64 nt, Human
cuaugguggggucucgagguccucacaguugccagcccugcagcccccuuccccaggagcaagg

SEQ ID NO: 421791 - RNA, 64 nt, Human
ugcauuggcccggggcaagaguuuaacaucuucggcccugcauuccuacaucuugugucuguac

SEQ ID NO: 421792 - RNA, 64 nt, Human
ugagccccagccucugcacuugggcuccccuccugcccugcauuccauccauccucacucagcu

SEQ ID NO: 421793 - RNA, 64 nt, Human
gcucccuuccugccacugccgccuacuggacgcugcccugcaugcugcccagccacuccaggag

SEQ ID NO: 421794 - RNA, 64 nt, Human
gucagagcagagccaccaggucccacugccccgagcccugcacagcccucccuccugccugggu

SEQ ID NO: 421795 - RNA, 64 nt, Human
uagaucggaaccucuuuggugacauucccgaccagcccugcaagagaaacgacagugugugugu

SEQ ID NO: 421796 - RNA, 64 nt, Human
ucacugggcuuggauuugcauuacauugaccccagcccugcaguggaaccuaauaaaagcgccu

SEQ ID NO: 421797 - RNA, 64 nt, Human
auagugaucugcuucugucacugucacauagacagcccugcaugcccccugucucacacaguuu

SEQ ID NO: 421798 - RNA, 64 nt, Human
uuuuaguuccuuuacacucaccacccuagcaagugcccugcacagaguaauaaguaaauugauu

SEQ ID NO: 421799 - RNA, 64 nt, Human
ccucuggccgccucaacgcacuucgcggaccucagcccugcagcuggagggcaacaggcugccg

SEQ ID NO: 421800 - RNA, 64 nt, Human
uucugugccgaccacgccccaggaccuccggagcgcccugcagggccgggcagggggacagcag

SEQ ID NO: 421801 - RNA, 64 nt, Human
cccccagccugacgggccgcuuaccauccccucugcccugcagagccagccgccaagguugacc

SEQ ID NO: 421802 - RNA, 64 nt, Human
aaaccggcagagagccgguuucccagcagccggagcccugcaggagaggccuuuguguuuuguu

SEQ ID NO: 421803 - RNA, 64 nt, Human
gccggagacaaaacgccuuaaagcccccggcccagcccugcagguauauugcaggggccugggg

SEQ ID NO: 421804 - RNA, 64 nt, Human
gcacgagugaguggacacugccccgccgcgggcggcccugcagggacaggggcccucucccucc

SEQ ID NO: 421805 - RNA, 64 nt, Human
gaugaaagcccaagucaucaggguggcacgucaggcccugcacgaugugccccgucaccucccu

SEQ ID NO: 421806 - RNA, 64 nt, Human
cggaggugauaggcuuccacacaggucuccagaagcccugcauugaauauccauccacacuuug

SEQ ID NO: 421807 - RNA, 64 nt, Human
aggggagucgggccccaggucgcccccgcccccagcccugcaugcaggugcccucgcuccgccc

SEQ ID NO: 421808 - RNA, 64 nt, Human
caggugugguuagacacuuuucuagaacaggcaugcccugcaaacuccacagacacugacuguu

SEQ ID NO: 421809 - RNA, 64 nt, Human
aagcucuguccacgggucuccccauucccaccaggcccugcacacacccacuccguaaccucuc

SEQ ID NO: 421810 - RNA, 64 nt, Human
gagaagggaccuacggacgccuggaagcugcgacgcccugcacugcucccgccuccaccagcgc

SEQ ID NO: 421811 - RNA, 64 nt, Human
ccgacuaccggaugcgcugaggcccggcucucccgcccugcacgagcccaggggcugagcguuc

SEQ ID NO: 421812 - RNA, 64 nt, Human
ugucgggagggggguggacacaaaaaccggccuugcccugcagggauggggcuccacaggccgu

SEQ ID NO: 421813 - RNA, 64 nt, Human
cauauguaaaaggccauuuugagugccuuucacagcccugcauaaggcaggugucucaguguuc

SEQ ID NO: 421814 - RNA, 64 nt, Human
gugauucaggccagcuggagaagcuuccagaagggcccugcacugcuacccucuauuucccacu

SEQ ID NO: 421815 - RNA, 64 nt, Human
gacccaccuuguguagugccugacccaaagccuggcccugcacacugucucugacucacagcaa

SEQ ID NO: 421816 - RNA, 64 nt, Human
ugaugggagcagugagcgggcuccgcugcccccugcccugcacuggaccaggagucuggagaug

SEQ ID NO: 421817 - RNA, 64 nt, Human
guggccuuucaccacagugguccuuccugccugagcccugcacugucccagaccacacagaagu

SEQ ID NO: 421818 - RNA, 64 nt, Human
aucguagguagcaguaggaacgggggccgccgcggcccugcagccgcucauggcggugaggugu

SEQ ID NO: 421819 - RNA, 64 nt, Human
gcccccuacagcccacccuaccccuccuccaugggcccugcaggaggggagacccaccuugaag

SEQ ID NO: 421820 - RNA, 64 nt, Human
ugaagccuccggaccccaggcucugcucugcccugcccugcaccccccucgucagaaguacaug

SEQ ID NO: 421821 - RNA, 64 nt, Human
ccgggcccacggggcggacgcugcauaccaauuugcccugcaccgccugucccggagacggagc

SEQ ID NO: 421822 - RNA, 64 nt, Human
ucccccgcagggccaaccccugcccuguugcucugcccugcaggggucccggcgccuggucacc

SEQ ID NO: 421823 - RNA, 64 nt, Human
cccggagccacagcuggcggggucuccgccgccagcccugcagcgggccggccagagggggccc

SEQ ID NO: 421824 - RNA, 64 nt, Human
ugaccacacagcauccacucuccugcgguuaccagcccugcaccaaccaccacagucagaauaa

SEQ ID NO: 421825 - RNA, 64 nt, Human
uccaagcccugugucuuuccauagucagggucaggcccugcaucuauuccaaggggcacucagu

SEQ ID NO: 421826 - RNA, 64 nt, Human
cauucaauuccugcagaaaccggaaaucuuccaugcccugcaaugugcucaucaaacucucagc

SEQ ID NO: 421827 - RNA, 64 nt, Human
ucuggucaaaaucccuguguagcugaauucccaagcccugcauuguacagccccccacuccccu

SEQ ID NO: 421828 - RNA, 64 nt, Human
cgccuuguuacgagcaagugccggcuggacccaagcccugcauccccacaugcggggcagaggc

SEQ ID NO: 421829 - RNA, 64 nt, Human
caauuagcauccaguuccugcagccuggugcucugcccugcacgucaggguuggcauccaccca

SEQ ID NO: 421830 - RNA, 64 nt, Human
aucuacuucgugccagcuuucugccucuguaguagcccugcacaaaggguggggagucaggaga

SEQ ID NO: 421831 - RNA, 64 nt, Human
agucagcuggaccuugcugugucgcccgcaggcagcccugcagacaccggugaggugggaugau

SEQ ID NO: 421832 - RNA, 64 nt, Human
aggaccaugaagccaggacagaggccaggagccagcccugcagcccuccccacccggcauccac

SEQ ID NO: 421833 - RNA, 64 nt, Human
ugagugugguguugaacuucgggaggagcagggagcccugcaccuuguguccuggcccaccuga

SEQ ID NO: 421834 - RNA, 64 nt, Human
ggggaagccgggcuugaguugcccauaggccccugcccugcaccauccuguccagugcccugcg

SEQ ID NO: 421835 - RNA, 64 nt, Human
uuuccuaggcaggggcguggcagagcagguaggcgcccugcagccucccugcucccagcccaag

SEQ ID NO: 421836 - RNA, 64 nt, Human
uaggaccacuccccgccuucccuacggccuccucgcccugcacauuccccaccuccacauuccc

SEQ ID NO: 421837 - RNA, 64 nt, Human
ucaggaagcagaggcgucccugccgcugcccuuggcccugcaagcacaucaugacccuuucugg

SEQ ID NO: 421838 - RNA, 64 nt, Human
ccaaguaggugggauuacaggugcccaccaccaagcccugcaaauuuuuuuguauuuuuaguag

SEQ ID NO: 421839 - RNA, 64 nt, Human
cuauuucaggcacaucauuggaauacaggaaguagcccugcaccugccagugagcucgccauuc

SEQ ID NO: 421840 - RNA, 64 nt, Human
ugugccuucgcuuggagacccacaaagagagugcgcccugcacuccccgaacccgaguccgcgc

SEQ ID NO: 421841 - RNA, 64 nt, Human
aagccagaguugacaguacaaagggucguggccagcccugcagcuucagcaccugccccaccca

SEQ ID NO: 421842 - RNA, 64 nt, Human
cacuucgggaggugggggcacuccacacuggggggcccugcagcuccagggcuggugcucuagc

SEQ ID NO: 421843 - RNA, 64 nt, Human
uggucgcccuccugugccccucuccugccggaaagcccugcaacauucuaggguugggggcagg

SEQ ID NO: 421844 - RNA, 64 nt, Human
uuuaguguuuuucccuuuguucuugaacacuuuugcccugcagccucaguuuugaauucuuuua

SEQ ID NO: 421845 - RNA, 64 nt, Human
cccagcccuucuccagcaucacagaugaccuccagcccugcagggagccgcucaagucugggag

SEQ ID NO: 421846 - RNA, 64 nt, Human
ugagcaggcauagcagaggcccuccagagagacugcccugcacgccaugccuugggccacguug

SEQ ID NO: 421847 - RNA, 64 nt, Human
gagccaugguagggcuagaguugggucuugcccagcccugcaguuucauagucccagccuuccu

SEQ ID NO: 421848 - RNA, 64 nt, Human
uugcaucuuucuuuucuugggccucugggaaagagcccugcaucuuucauuaauucgguucuca

SEQ ID NO: 421849 - RNA, 64 nt, Human
aggcugagcagugaggagagaaaguuucugccuggcccugcaucugguuccagcccaccugccc

SEQ ID NO: 421850 - RNA, 64 nt, Human
guucuuuugucuaaucggaggccacugugcugaggcccugcagugucugcucacugcugccauc

SEQ ID NO: 421851 - RNA, 64 nt, Human
gccggagaauaagaagccagcaccucaucagucagcccugcaaugugagacuuccguagcuguu

SEQ ID NO: 421852 - RNA, 64 nt, Human
ugagcugucuagcaugagcacccacccccacagcgcccugcacccggccgcugcccagcaccgc

SEQ ID NO: 421853 - RNA, 64 nt, Human
gccuucgccccucagugggauggcagcugagggggcccugcauuugaccgucgagacugcagca

SEQ ID NO: 421854 - RNA, 64 nt, Human
gucggcugugaccuccuguccccagagcuguacggcccugcagugggugggaggaacuugcaua

SEQ ID NO: 421855 - RNA, 64 nt, Human
gggucuagggaagcuccagccccaggauggggcugcccugcacaccggugcccgccacaugcca

SEQ ID NO: 421856 - RNA, 64 nt, Human
agucgcaccccagcagccucucucgcacaccggggcccugcaugucagauggcguggucugcag

SEQ ID NO: 421857 - RNA, 64 nt, Human
cagucucuugcguguccuagaccuuguggguggcgcccugcauaggggagcagggggaacgggu

SEQ ID NO: 421858 - RNA, 64 nt, Human
cggaaugccagugcuccgagcucagacagaggaagcccugcagaaaguuccaucaggcuguuuc

SEQ ID NO: 421859 - RNA, 64 nt, Human
cucaccuccagauccugcuggcaucaccuccagagcccugcaugcacuggcugaagaguugguc

SEQ ID NO: 421860 - RNA, 64 nt, Human
acaccuaagcgucguggagcauuguucugccacagcccugcauacugaccccgggaggcugggc

SEQ ID NO: 421861 - RNA, 64 nt, Human
cucugcaugcuccucugccugugcccgcugcgcugcccugcaaaccgugaggucacaauaaagu

SEQ ID NO: 421862 - RNA, 64 nt, Human
uuuggaggggagucuggcagcccggcuggcccaggcccugcagcggcagccuuuccacagggcg

SEQ ID NO: 421863 - RNA, 64 nt, Human
aaggaaaaaaaacgugagcuacauguguaagaaggcccugcauguguaugaguccuauucuggg

SEQ ID NO: 421864 - RNA, 64 nt, Human
gaggagagccaggugagcaguggagagaaggggggcccugcacaaggaaacagggaagagccau

SEQ ID NO: 421865 - RNA, 64 nt, Human
acauuuugccccgggccaaauucaggggucuagugcccugcauuccuuugaggcaaaaaauaaa

SEQ ID NO: 421866 - RNA, 64 nt, Human
cagaucgaagugugaccccugugugguccagacagcccugcagagagaaaaccuuuauuccauu

SEQ ID NO: 421867 - RNA, 64 nt, Human
gggagcacagggcagguggcugggugaggaugccgcccugcagcauguacaccgagugucugca

SEQ ID NO: 421868 - RNA, 64 nt, Human
cacaacugccuuucaaggacaguucagacaaagggcccugcauggaaagagugaccucccuuug

SEQ ID NO: 421869 - RNA, 64 nt, Human
ugagacccaaauugagcauguugcuguuauuccugcccugcaccuguggagcaggaguggcagg

SEQ ID NO: 421870 - RNA, 64 nt, Human
ccuggccugccuugauuucagccacaccccugcagcccugcaucccagcucuggggugugcaga

SEQ ID NO: 421871 - RNA, 64 nt, Human
aaaauaagguuuuuuauuguaaaaauugacgauugcccugcauuucuaccaaguccugugaaua

SEQ ID NO: 421872 - RNA, 64 nt, Human
gggccaugccuuccagguggcccagacagcccaagcccugcacuggaucgugaggacgcugcgg

SEQ ID NO: 421873 - RNA, 64 nt, Human
uccugagccuggccaggacucaggcuguuccugggcccugcacaugaugggguuugguggaccc

SEQ ID NO: 421874 - RNA, 64 nt, Human
ccuccuuccaccaugccagccucucccacacggggcccugcaggcuguggauaugcacucagag

SEQ ID NO: 421875 - RNA, 64 nt, Human
guauuccucaguagcacuuuaaacgccgaagacagcccugcagcaagccugcacacgggcuugg

SEQ ID NO: 421876 - RNA, 55 nt, Human
cguuuguccuggugcagugagggcagcccugcauccuggcacggacacugacucu

SEQ ID NO: 421877 - RNA, 64 nt, Human
cugacucuccuugggacucgccugccugcucagagcccugcagggcuuggucagcugccuguuc

SEQ ID NO: 421878 - RNA, 64 nt, Human
ccugcagaacuggaugcucaaggcccugcccccagcccugcaggacccgccacaugugcccccg

SEQ ID NO: 421879 - RNA, 64 nt, Human
cuucccuccaggaaaugaggaccggccggacgaugcccugcagacugcucugaagagaaggagg

SEQ ID NO: 421880 - RNA, 64 nt, Human
cauccaugcagauaacagcugguuggccgguguggcccugcaagggcgugguggcuucggccug

SEQ ID NO: 421881 - RNA, 64 nt, Human
cuuauuagaguuuuugucugagcacaguagccuggcccugcauaucuugggcguuugauuacca

SEQ ID NO: 421882 - RNA, 64 nt, Human
gguggacuuggggacccuaccccugaagacugaggcccugcagcuaccaggugggcuagaaggu

SEQ ID NO: 421883 - RNA, 64 nt, Human
ggcaggagcaccccccagacuccccgugcccgcagcccugcagcaccccggcuuucccgggucu

SEQ ID NO: 421884 - RNA, 64 nt, Human
ccccuccggacccgcagagcuggggacauggcaugcccugcacucagucaccccgagggcugag

SEQ ID NO: 421885 - RNA, 64 nt, Human
ggcagaagcucguggaggaugggcaucugagguggcccugcagccccccaccuucuggcccucc

SEQ ID NO: 421886 - RNA, 64 nt, Human
ugggaagucuuucuggccaagucuggccagccuggcccugcaggucucccaugaaggccacccc

SEQ ID NO: 421887 - RNA, 64 nt, Human
gguuuggguggcagcugggagaacuucucucccagcccugcaacucuuacgcucugguucagcu

SEQ ID NO: 421888 - RNA, 64 nt, Human
uaggguacccgccuggucucggcuggcuccagcugcccugcaggugccccugggcucagguagu

SEQ ID NO: 421889 - RNA, 64 nt, Human
ugcaccucagguucaaaaugggugucuucuggcagcccugcacgugugcuuucugagugucucu

SEQ ID NO: 421890 - RNA, 64 nt, Human
gcaggggggcagcagcucuccuccccacucacaggcccugcagugcucauuuggaauuccuccc

SEQ ID NO: 421891 - RNA, 64 nt, Human
ggcagcagcauccuccucucuggccuugccccaggcccugcagcggugguugucacacccugac

SEQ ID NO: 421892 - RNA, 64 nt, Human
cccgcaauggaccauguaacaaauaccucagcaggcccugcaaaaggccaugcuagagcugagg

SEQ ID NO: 421893 - RNA, 64 nt, Human
ccgucuggccuaaaggugauguauuugguguuuggcccugcaguccccacucuugaggcuuaag

SEQ ID NO: 421894 - RNA, 64 nt, Human
gggggucaggcuacaggugccccaccuccccagagcccugcagucacgugaggccccugugcag

SEQ ID NO: 421895 - RNA, 64 nt, Human
uguacugucuuggaagccuccacauccggcuauggcccugcaagcugcuuuaucccugcgcuag

SEQ ID NO: 421896 - RNA, 64 nt, Human
cucuccuuuucugggccuccucgcaaaugcccaggcccugcauuuucacgcugugcuaagcagc

SEQ ID NO: 421897 - RNA, 64 nt, Human
cgcgagcugcugcgcugcgcucuggugcgcgcgcgcccugcacacccggcccugcgccugcagg

SEQ ID NO: 421898 - RNA, 64 nt, Human
gccugcaccacccacuugcaaccaccaggcuggugcccugcagcugugccaguugggccacagc

SEQ ID NO: 421899 - RNA, 64 nt, Human
aaauugucuuuauuaagugaaaacuuuccccuuugcccugcaauguagcugggcauucaaacgg

SEQ ID NO: 421900 - RNA, 64 nt, Human
acgaauuuaggcucagaagcaucgcuccucuccagcccugcagcuauucaccaauaucaguccu

SEQ ID NO: 421901 - RNA, 64 nt, Human
uucucauuacuggguuagaaaacaaagagggauugcccugcacauuuucuuuugugcuuuuaaa

SEQ ID NO: 421902 - RNA, 64 nt, Human
aauugcugcuucuccaacucuugcuuggggccaagcccugcaccaguugcuucccagcuguuau

SEQ ID NO: 421903 - RNA, 64 nt, Human
gaaaaaagauccagcccaggcacggaaugggagggcccugcaaagcacccaaguguguuucacu

SEQ ID NO: 421904 - RNA, 64 nt, Human
gugcccacaucacccucauuuccuccucgcaguagcccugcaccguggccagaaacccauccac

SEQ ID NO: 421905 - RNA, 64 nt, Human
aucucuauucaggugccauguggccuucacugcagcccugcagccacccacgcaccaucugugg

SEQ ID NO: 421906 - RNA, 64 nt, Human
caacccgcuggugcugaacucugugcugagcaaggcccugcagugcagccugcauggggacacc

SEQ ID NO: 421907 - RNA, 64 nt, Human
ccuggcccgcucucuaccucugcccaccguuguggcccugcagccggagaucugaggugcucug

SEQ ID NO: 421908 - RNA, 64 nt, Human
acaccuggauguggacuuggacucggacacuucugcccugcacccuggcccgcucucuaccucu

SEQ ID NO: 421909 - RNA, 64 nt, Human
cgucuuuguuuagaaggcucuaucuuccacuguggcccugcagagauccccugagccaagccga

SEQ ID NO: 421910 - RNA, 64 nt, Human
cccugcagcuaguccuagugaaccucaccccgaggcccugcaugggccagccccuccaucugua

SEQ ID NO: 421911 - RNA, 64 nt, Human
ugacugguuaucacaccaucgcuggccccuuugggcccugcauguagugugggaggcuccuguu

SEQ ID NO: 421912 - RNA, 64 nt, Human
cauucuauguuggugggaaugggacugggcugacgcccugcauucagccugugccuuuccuggg

SEQ ID NO: 421913 - RNA, 64 nt, Human
gguggagggaggugaggugcccagguggcuauuugcccugcagagcugggaguuucacccccac

SEQ ID NO: 421914 - RNA, 64 nt, Human
gaccccagggaaggaggcugcucacccagccuuggcccugcagggaauguuggggggcacagag

SEQ ID NO: 421915 - RNA, 64 nt, Human
agcuccaucugagcaaguacaccaaaugaucucagcccugcaacuugacccagguagggccacc

SEQ ID NO: 421916 - RNA, 64 nt, Human
ggcuggugaggaagagcuggggggcagagguaaagcccugcaggggaggccacaggguccaucc

SEQ ID NO: 421917 - RNA, 64 nt, Human
gaagggugccaccugagggagccgccugcaagcggcccugcagccacaaagcaacccgcccucu

SEQ ID NO: 421918 - RNA, 64 nt, Human
cacccaggcccccuucauuagugccuugcuuugggcccugcagggggaggggugacagggcgag

SEQ ID NO: 421919 - RNA, 64 nt, Human
auuggacuuuguccucucuuauuccccccuccuagcccugcaaguugcuagguacuugugaggc

SEQ ID NO: 421920 - RNA, 64 nt, Human
acaucaugggagguggggcuguccaguuagcugugcccugcaccuucagcccaggaaagauuug

SEQ ID NO: 421921 - RNA, 64 nt, Human
ccuguaaucaggcaaggaggaggagucagaugaggcccugcaccuuccccaaaggaaccgccca

SEQ ID NO: 421922 - RNA, 64 nt, Human
ccccaccuccgccccagacacaccccccagucgagcccugcagccaaacagagccuucacaacc

SEQ ID NO: 421923 - RNA, 64 nt, Human
agcccagaccucuucggcuucaggaacuugccucgcccugcaacguucuuauccugaucaaagu

SEQ ID NO: 421924 - RNA, 64 nt, Human
gggggugcugccugaugggcaguccaagcuccaggcccugcaugcccaguauugccaaggaccg

SEQ ID NO: 421925 - RNA, 64 nt, Human
cuccuucagccaaucauuaucaaauguuccuucagcccugcaguugccccaaauaaccuuuuuu

SEQ ID NO: 421926 - RNA, 64 nt, Human
cuuaaggcaagaaagaucucaaaaagcaacuucugcccugcaacgccccccacuccauagucug

SEQ ID NO: 421927 - RNA, 64 nt, Human
guuucugauuuuacuuuccucagccaguuucuaggcccugcaaggccccaugagcuacagucgu

SEQ ID NO: 421928 - RNA, 64 nt, Human
uuaggcccucgacccucgggccucgggggggagggcccugcacgccgccacccccuccccgcag

SEQ ID NO: 421929 - RNA, 64 nt, Human
cagccuuggcgguuuaucgcccuggcaggcaggggcccugcagcucucaugcugccccugccuu

SEQ ID NO: 421930 - RNA, 64 nt, Human
gggcuugugccuagauuaggagaggaagccaggggcccugcacucaugccaccugccagguagu

SEQ ID NO: 421931 - RNA, 63 nt, Human
uuaagucauuuuguaauauuugaauuuuuacauuuguuguacaaucaggaaaagcaauaaaga

SEQ ID NO: 421932 - RNA, 63 nt, Human
ugugguaacuuacugucacauagcucugacguuuuguuguaauaaauguuuucaggccgggca

SEQ ID NO: 421933 - RNA, 63 nt, Human
gcuaaaauguguuugagcuuuagacuauaacauuuguuguaauaauugcuagguugaaguuca

SEQ ID NO: 421934 - RNA, 63 nt, Human
uuugguaguccauugaagaagggaguuugaaaguuguuguauacuguuaacgauugucugccc

SEQ ID NO: 421935 - RNA, 63 nt, Human
aaaaaaggugacugcugaacugugugugguuuauuguuguacauucacaaucuugcaggagcc

SEQ ID NO: 421936 - RNA, 63 nt, Human
ugaacucaguuaaugaaaacuguauuaacauaauuguuguagcauaauauuaauagugcaaaa

SEQ ID NO: 421937 - RNA, 63 nt, Human
uucuauauguaaacuacaaauucuaugguagcuuuguuguauauuauuguaaaauuauuuuaa

SEQ ID NO: 421938 - RNA, 63 nt, Human
gaaaaaaaaaaucuuucccacuguuuuuucugcuuguuguaagaaucaaaugaaauaauguau

SEQ ID NO: 421939 - RNA, 63 nt, Human
ccugggcaauuucagccaggacauuaggaccacuuguuguacaucugaauaauuauggaaguu

SEQ ID NO: 421940 - RNA, 63 nt, Human
aagcuauacacagcucuguuuugucaaugaccuuuguuguaagucucccaacguccuauuagg

SEQ ID NO: 421941 - RNA, 63 nt, Human
ucucugggggaaccugucucaguguugacugcauuguuguagucuucccaaaguuugcccuau

SEQ ID NO: 421942 - RNA, 63 nt, Human
auguguauuuuuaauguggugagaugcacucuuuuguuguaccaaauagggcuccccacccca

SEQ ID NO: 421943 - RNA, 63 nt, Human
cuugugcagcuauucaugucucuacucugccccuuguuguaaauaguuugaguaaaacaaaac

SEQ ID NO: 421944 - RNA, 63 nt, Human
ccuuuucaaagacaauagggggucuugacauguuuguuguauguaaagaugauaagauuaaaa

SEQ ID NO: 421945 - RNA, 63 nt, Human
cuuaugguuuuguagauauggugacuccagucuuuguuguauaaagguugggggagcugauaa

SEQ ID NO: 421946 - RNA, 63 nt, Human
uggucucaaagcuugcaaagauagcuucugauauuguuguaauuucuacuuuauuucaaagaa

SEQ ID NO: 421947 - RNA, 63 nt, Human; identical to SEQ ID NO: 421946

SEQ ID NO: 421948 - RNA, 63 nt, Human
uuucucacuucuccuaucauguggucaaaguuauuguuguauaccagcgaugggauguauacu

SEQ ID NO: 421949 - RNA, 63 nt, Human
gugagcccaggugaggacauagucggcucccguuuguuguaggcccuucccaggugccuucuc

SEQ ID NO: 421950 - RNA, 63 nt, Human
ucccuugucucagaugguguguccagcacucgauuguuguaaacuguuguuuuguaugagcga

SEQ ID NO: 421951 - RNA, 63 nt, Human
gcaagucagcacacaagugauuuuauuguuauuuuguuguauuuacuugcauuuguuguauuu

SEQ ID NO: 421952 - RNA, 63 nt, Human
auuuuauuguuauuuuguuguauuuacuugcauuuguuguauuuacuuucaucugcagcauuu

SEQ ID NO: 421953 - RNA, 63 nt, Human
uaagauggggaguguucauaaaauuauagauguuuguuguaaaauuuuggaaaacccuggaaa

SEQ ID NO: 421954 - RNA, 63 nt, Human
gcuuuugcugggaugaauguuuuuauaggguuuuuguuguaacauaagcuauuuucuaauaug

SEQ ID NO: 421955 - RNA, 63 nt, Human
accugcuagggugcaggaggcuuccagaagcaguuguuguaauuaggacccaagcacugggag

SEQ ID NO: 421956 - RNA, 63 nt, Human
ccagacuuggagauugaaguucuuaaaaggccuuuguuguagccaaaggcaugcaugcgucac

SEQ ID NO: 421957 - RNA, 63 nt, Human
cuacaaagcaucugauuuuggaaguacauggaauuguuguaacaaaguauauugaauggaaau

SEQ ID NO: 421958 - RNA, 63 nt, Human
ugaacaagugggccauuagccagauuugucuuuuuguuguaaaacaaaauuugacuaauuuua

SEQ ID NO: 421959 - RNA, 63 nt, Human
uuagauuucuuuguuuuuguuuuauuuuuuaaauuguuguaaaaauuauuauaggccagcuac

SEQ ID NO: 421960 - RNA, 63 nt, Human
gauuagaggaacuaacucaacuucuaauuuuuuuuguuguaauuauggcacugucauguuuua

SEQ ID NO: 421961 - RNA, 63 nt, Human
auaggacugccaaaucauggguuuugccuuuuguuguuguauuuauccucuguugguaauacu

SEQ ID NO: 421962 - RNA, 63 nt, Human
aggagcuuuauuguaaauacuauggaaggggcuuuguuguaaauacuauguaauauauauaaa

SEQ ID NO: 421963 - RNA, 63 nt, Human
caaaaauauuuuccauuuccguuauuaugcuaauuguuguaugaaauaagugcaauuauacuu

SEQ ID NO: 421964 - RNA, 63 nt, Human
uacauuguaaguuaguaaguuagaaagcuagcuuuguuguaucugaacacaugaaucuuuuuu

SEQ ID NO: 421965 - RNA, 63 nt, Human
uaugaguuuuguuugaaaacucuuucacuauauuuguuguaaagagguuuacuauuaaaagaa

SEQ ID NO: 421966 - RNA, 63 nt, Human
uguaacaguccaggaaacuguuuuuuuuuguuguuguuguauugauaugaaaugagauucuau

SEQ ID NO: 421967 - RNA, 63 nt, Human
auagggugggcuaaaaaccaugcacucuggaauuuguuguauuuucucccaguaaagcuuuuc

SEQ ID NO: 421968 - RNA, 63 nt, Human
ugcuuagaaauuuucuuuauuuaaacauuauguuuguuguagccuuguuaaaggcuauuuuau

SEQ ID NO: 421969 - RNA, 63 nt, Human
cuguaugcaguuuuguaaauaagugaaaauaauuuguuguacuuuuuauucaauucuguauag

SEQ ID NO: 421970 - RNA, 63 nt, Human
uucaagaaggcauacaaauaucugagagugacuuuguuguauggcuacccuugugaucuacag

SEQ ID NO: 421971 - RNA, 63 nt, Human
uuguaguuacacuuguguuucaaucagaucagauuguuguauuuauuccacuauuuugcauuu

SEQ ID NO: 421972 - RNA, 63 nt, Human
ucuuauaagauucuauauuuccuaucuaaaauguuguuguaauucaauuuaaauguguucaug

SEQ ID NO: 421973 - RNA, 63 nt, Human
ccaucuuaaguuuuacaaggugauguaaucagcuuguuguagugaugcuggccaaauggugcu

SEQ ID NO: 421974 - RNA, 63 nt, Human
ccuggcaauacgacgugggaauuucaaugcguuuuguuguagaugcuaacgugucagaauccu

SEQ ID NO: 421975 - RNA, 63 nt, Human
uguauucuaccuuuuuaugggaaaacuacuuuuuuguuguaaagauuuucuucuguuuucuuu

SEQ ID NO: 421976 - RNA, 63 nt, Human
cuacuggaauauuguccacaauaagcuggaaguuuguuguaguaugccucaaauauaacugac

SEQ ID NO: 421977 - RNA, 63 nt, Human
auguguucuguuuuguaaaggaacuuucaaguauuguuguaaauacuuggacagagguugcug

SEQ ID NO: 421978 - RNA, 63 nt, Human
gauuauugaauuggugcuugaaauuuauugguuuuguuguaauuuuauacagauuauaugagg

SEQ ID NO: 421979 - RNA, 63 nt, Human
cauguucuaaacagcaacaguguaacuagucuuuuguuguaaaugguuauuuuccuuauaaga

SEQ ID NO: 421980 - RNA, 63 nt, Human
caaguuagaguccagccuaaucaaaugucauaauuguuguaccuauugaaaguuuuuaaauaa

SEQ ID NO: 421981 - RNA, 63 nt, Human
guuuauaacuauucaguuguguuuguugcuggcuuguuguaaagcaauaaaauuuuuuugguc

SEQ ID NO: 421982 - RNA, 63 nt, Human
ggggaauaaacucaauacacauucauuaaacuuuuguuguaauuaaacugcuauauauuguuu

SEQ ID NO: 421983 - RNA, 63 nt, Human
auacuaaagguaagacugguuguuacuuuuguuuuguuguacaauuaguacuuuauagucaca

SEQ ID NO: 421984 - RNA, 63 nt, Human
aaguuauauauuugcagaauguuuuaaagugaauuguuguaaugaaguuccugugaacaucau

SEQ ID NO: 421985 - RNA, 63 nt, Human
aaacaaaaccuucaccgcucuuuguuuguuguuuuguuguauuuuguuuuccugcuagaaugu

SEQ ID NO: 421986 - RNA, 63 nt, Human
uguugcaauuaggauuuugaugugacaauaauauuguuguauaauuucgagauuuguaggaag

SEQ ID NO: 421987 - RNA, 63 nt, Human
uuucaaaacaggaaugcauuuuuccccuugucuuuguuguaagagacaaaagaggaaacaaaa

SEQ ID NO: 421988 - RNA, 63 nt, Human
cauucuuuuguuuauauuguuuugucuccuaaauuguuguaauugcauuauaaaauaagaaaa

SEQ ID NO: 421989 - RNA, 63 nt, Human
guucuugggguugcucacaaauacuagggguuuuuguuguauuuuuaacaaauauauccuaau

SEQ ID NO: 421990 - RNA, 63 nt, Human
cugugugacagcccucugaauauuugaaguuguuuguuguaacuuaagguuauaacagcccuu

SEQ ID NO: 421991 - RNA, 63 nt, Human
gcaucucaagaaaacauugaaaaauucuaugaauuguuguagccggugaauugagucguauuc

SEQ ID NO: 421992 - RNA, 63 nt, Human
acuuucauuagcuaaggaacucaugucugaauuuuguuguaguuuugaauguugugcucuuuc

SEQ ID NO: 421993 - RNA, 63 nt, Human
guacagaaauauuguauauacuuacauauguaauuguuguaagaguuaaauacaaaaucaugg

SEQ ID NO: 421994 - RNA, 63 nt, Human
ccagaugugguugcauaagguuuuuaugcauguuuguuguauacuuccuuaugcuucuuucaa

SEQ ID NO: 421995 - RNA, 63 nt, Human
ggcuugcugccuucaggaaauggacaggucaguuuguuguaggaaaugcauauuuuccucucc

SEQ ID NO: 421996 - RNA, 63 nt, Human
uaaaccaaagagcaauuuucccaaggguugauuuuguuguaaauuuuuaguuuuaaugaaagc

SEQ ID NO: 421997 - RNA, 63 nt, Human
acaguguaacuuauuguguccccgcguauuuauuuguuguaaauauuugaguauuuuuauauu

SEQ ID NO: 421998 - RNA, 63 nt, Human
aucauaaucagucauauuggguaauuguguucauuguuguaucaggguauaggaggcaaugcu

SEQ ID NO: 421999 - RNA, 63 nt, Human
auuaaaaaaacugcuguuuuauaagaagacuuuuuguuguacuaugugcaugcauacuaccua

SEQ ID NO: 422000 - RNA, 63 nt, Human
uaaugauaaauucccuucuagcucuauuguaaauuguuguacagaugucauauuucaauuacu

SEQ ID NO: 422001 - RNA, 63 nt, Human
uacuaaacuggcacaauuuuauauguaugcuauuuguuguauuuaugcuuaagagcaaaaaag

SEQ ID NO: 422002 - RNA, 63 nt, Human
aucaccugagucaaggaaacauguuacgccuucuuguuguaggaaaaacggcuugcagauuau

SEQ ID NO: 422003 - RNA, 63 nt, Human
augaauuuucuuuuucuuuccuuuuuuuuuuuuuuguuguaauaguuaaagaggcuuagaaca

SEQ ID NO: 422004 - RNA, 63 nt, Human
acuauuuauugagggcuagguaaaaaguucuuuuuguuguaaucguccauuaauucauaaguu

SEQ ID NO: 422005 - RNA, 63 nt, Human
aacagauauuauucagucuuauuuccuaagauuuuguuguaacuuaagguaucuugcuacagu

SEQ ID NO: 422006 - RNA, 63 nt, Human
uauuuguuuuuccaaaguuuuauaugcagguuuuuguuguaccuguauccagaucuucuuuuc

SEQ ID NO: 422007 - RNA, 63 nt, Human
guuuauuacguuucacuugauuaaauuuuuuuguuguuguauuaaaccauguacguugcagcu

SEQ ID NO: 422008 - RNA, 63 nt, Human
cguccagcacccuccaccuuugccaccuauuucuuguuguaaaacagauguuuguuucuaaaa

SEQ ID NO: 422009 - RNA, 63 nt, Human
uggacaguuuaccaguugccuuuuaucccaaaguuguuguaaccugcugugauacgaugcuuc

SEQ ID NO: 422010 - RNA, 63 nt, Human
ucaaggaggagauuaagcuuuauauuugcuuauuuguuguagcuacauuuuaaaaaaaagauu

SEQ ID NO: 422011 - RNA, 63 nt, Human
uuucaaaugugucuguguuucucuuuacauuccuuguuguaccucauuguucaauucacuuuu

SEQ ID NO: 422012 - RNA, 63 nt, Human
caaacauucuucacauguuugcuguuaucaagauuguuguauaugugaaugaaaugauacgau

SEQ ID NO: 422013 - RNA, 63 nt, Human
guguuaaaggaagugagucagggagggcggaguuuguuguaaggcaaucaccugucaaaacag

SEQ ID NO: 422014 - RNA, 63 nt, Human
uuaaagcaaaaaaugaaugucuaaaauuguuuuuuguuguaccugcuuugacugaugcugaga

SEQ ID NO: 422015 - RNA, 63 nt, Human
uguuaaagagaaugaguccuugauuucaaaguuuuguuguacuuaaaugguaauaagcacugu

SEQ ID NO: 422016 - RNA, 63 nt, Human
ggaagaacagugguaauggauuaacauccuauuuuguuguacuaaagugacaaaucggaauaa

SEQ ID NO: 422017 - RNA, 63 nt, Human
caugugugagauuugcauuuuacuuugcugacuuuguuguaauagaucccauucauugucccc

SEQ ID NO: 422018 - RNA, 63 nt, Human
uccaagcaauucauacuauaagcuucacucuuauuguuguaugcaauuuuuacuaucaugcaa

SEQ ID NO: 422019 - RNA, 63 nt, Human
auuuugaaucuacaugaaugaacacuuuggauuuuguuguaguuugauucuaggguagaacca

SEQ ID NO: 422020 - RNA, 63 nt, Human
acgucaaaaguuagcagugaaauuguucuccauuuguuguacagucuggaggauuuucacuac

SEQ ID NO: 422021 - RNA, 63 nt, Human
ccauacuucccccgcccccauuuuaaaggcuuauuguuguauuuuguagcagcuucaagugac

SEQ ID NO: 422022 - RNA, 63 nt, Human
uaaaauagacaugacuucagcagcagcuuuuuuuuguuguauuuugagacagugucucacugu

SEQ ID NO: 422023 - RNA, 63 nt, Human
uguaucaaauugugcacuuuaaguaugugcaguuuguuguaugucaauuauaccucaauaaau

SEQ ID NO: 422024 - RNA, 63 nt, Human
uuaaaaugaaacuucuaucggaaguaaauuaauuuguuguaauaaaguccaguauuuaauaaa

SEQ ID NO: 422025 - RNA, 63 nt, Human
cccauguaccuauuaugaucuuucucccuugaguuguuguaaacuguaucaguaugaaauaug

SEQ ID NO: 422026 - RNA, 63 nt, Human
uguacaaagugacauacaauuggaaauccauuuuuguuguaaagacauuguuuuucagacuuu

SEQ ID NO: 422027 - RNA, 63 nt, Human
gacaucagaaauguuaaaguugauucccaauauuuguuguacuuuuuuguagcaaauguuaaa

SEQ ID NO: 422028 - RNA, 63 nt, Human
caauugaauccaguaguuuuucuaugcuauuuguuguuguauaagcuacuguaagaaacuuau

SEQ ID NO: 422029 - RNA, 63 nt, Human
aagugugaaaucuaaccaaucgcuagcacauauuuguuguaauacggugguuuauuucauguu

SEQ ID NO: 422030 - RNA, 63 nt, Human
cuaaaauuguugcaaaacauauuuuguaugauuuuguuguaagaguucuucucuuuuuacuuu

SEQ ID NO: 422031 - RNA, 63 nt, Human
gcauauuuuacccccagcuggcuagagauuuauuuguuguaaaugcuguauagauuugguuuu

SEQ ID NO: 422032 - RNA, 63 nt, Human
auauauaauuuauugaguuuuuacaagauguauuuguuguagacuuaacacuucuuacgcaau

SEQ ID NO: 422033 - RNA, 63 nt, Human
uuuuaucuuuaaugaacguuucugacuaauauuuuguuguaaaccauuaaguaauguaacgca

SEQ ID NO: 422034 - RNA, 63 nt, Human
uuuuguacuugagaauauuuuuggugaauuacuuuguuguagugaggaaaaaaccuaagaaau

SEQ ID NO: 422035 - RNA, 63 nt, Human
auuguuucucagaaaagguuaccuuuguauuaauuguuguaugacauuuaguaauguccuaaa

SEQ ID NO: 422036 - RNA, 63 nt, Human
ggucucaaaguuggaugaccucauuacuaauauuuguuguaaaagugaaacuuguuugccaac

SEQ ID NO: 422037 - RNA, 63 nt, Human
auucuuugauauuugaugucauuguauccacauuuguuguaagacauauugcauaccaauuau

SEQ ID NO: 422038 - RNA, 63 nt, Human
ugccaaugaacaguggcuugauaauaccaaguauuguuguaauuuauaaaauugaaggcaacc

SEQ ID NO: 422039 - RNA, 63 nt, Human
agcaauaucaaguuauggcaauggcaaaaguccuuguuguagaugagaagcauauaagaaaug

SEQ ID NO: 422040 - RNA, 63 nt, Human
ugcuauugucuuuccuuuguugucgaucuguuauuguuguauuauuauuguugauguugucau

SEQ ID NO: 422041 - RNA, 63 nt, Human
guguguuguuaaaugaaaguacagacagcuucauuguuguauuguuaauaauuguuacuuacu

SEQ ID NO: 422042 - RNA, 63 nt, Human
uuuuaaucauuaguauuaaugguguauuaaaaguuguuguacuuugucugugaccuuaauuuu

SEQ ID NO: 422043 - RNA, 63 nt, Human
gcugauuggugcucgacucccagcaugcauauuuuguuguaaaaacccagguuuguaauucac

SEQ ID NO: 422044 - RNA, 63 nt, Human
gccugguuggacuuggguuccuggauggugggauuguuguacagccucucaggagacccugcu

SEQ ID NO: 422045 - RNA, 63 nt, Human
ccuuuuuaucaaaguguacacuacugaugcuguuuguuguacugagagcacguaccaauaaaa

SEQ ID NO: 422046 - RNA, 63 nt, Human
aagaaagaaguguacagaauuaacauauaaacuuuguuguaaaacugaaucaugucagaacug

SEQ ID NO: 422047 - RNA, 63 nt, Human
auuauccacaauuugauguuuaucauuccuguguuguuguacuuucacuguguauaaccuaaa

SEQ ID NO: 422048 - RNA, 63 nt, Human
cagugaauuuucauuucuuuccuuaucacccccuuguuguaaaaagcccagcacuugaauugu

SEQ ID NO: 422049 - RNA, 63 nt, Human
aggucuccacagaguuuaugccauauuggaauuuuguuguauaauucucaaauaaauauuuug

SEQ ID NO: 422050 - RNA, 63 nt, Human
uuuguauauucaacauuugaaguauauucuauuuuguuguacucuuguuucaaaguguauuca

SEQ ID NO: 422051 - RNA, 63 nt, Human
acuaagauuuucuugucuugcuuuuuacugcuuuuguuguaguugucauaauuacauuuggaa

SEQ ID NO: 422052 - RNA, 63 nt, Human
auuaugguuuugugauguuuguccugaacacuuuuguuguaaaaaaauaauaauaauguuuaa

SEQ ID NO: 422053 - RNA, 63 nt, Human
ucuuuuucagugucucauaaacgcuacucuggauuguuguaaauauuagugagaugggaggau

SEQ ID NO: 422054 - RNA, 63 nt, Human
gugucucacuaaagcaugaaaugugaauuuuuauuguuguacauacgauuuaagguauuuaaa

SEQ ID NO: 422055 - RNA, 63 nt, Human
caguacuauaacuugugguuucugaacucauuauuguuguauuuccaaaaaaguaauaccuuu

SEQ ID NO: 422056 - RNA, 63 nt, Human
aguaaauaguuugaauucaguaaauauuauugguuguuguauugaucaaugcauguuacccau

SEQ ID NO: 422057 - RNA, 63 nt, Human
gccuaacuuauccaucuuugaacuucugacuacuuguuguaucugcuggauauuuaguucaac

SEQ ID NO: 422058 - RNA, 63 nt, Human
gugaauuguacuggaugauuaauacaaacgugauuguuguauuuggaguauaaauuacugauu

SEQ ID NO: 422059 - RNA, 63 nt, Human
cgaauagccaggugcuacagauuuuuaaaauuuuuguuguauugaaaagcuaaacaaggccaa

SEQ ID NO: 422060 - RNA, 63 nt, Human
ugaaaguagguagaauuuuugcuaugcuguaauuuguuguauauucugguauuugaggugaga

SEQ ID NO: 422061 - RNA, 63 nt, Human
auuuucuagccugggggaugggguucauauguguuguuguaacuuuagauuacuaaacaaaac

SEQ ID NO: 422062 - RNA, 63 nt, Human
aauguggguuuuguuuuauuguuuauuuguuuguuguuguauccuuuucuccuuguuauuugc

SEQ ID NO: 422063 - RNA, 63 nt, Human
cucaccuucccaaaagacacuguguaaguccauuuguuguauuuucuuaaagagggagacaaa

SEQ ID NO: 422064 - RNA, 63 nt, Human
acagcaagauguuucuugccuuuuguuaaugcauuguuguaaaguauuugauguacauuacag

SEQ ID NO: 422065 - RNA, 63 nt, Human
gaugaaguuaaaucuuaaaucuuauuaguugaauuguuguaaggacagugaugucugguaaca

SEQ ID NO: 422066 - RNA, 63 nt, Human
gauacaaaugguuuauggcuaugaaugaaguauuuguuguagauaguacccccucccuccuuc

SEQ ID NO: 422067 - RNA, 63 nt, Human
uugugcaaaaacuuagugaugaaagccugucuuuuguuguaaucugaauaauuucucaggaua

SEQ ID NO: 422068 - RNA, 63 nt, Human
guaccaaguguacuuauuuuguuguuguuguuguuguuguauuuuagaaggaauucagcucug

SEQ ID NO: 422069 - RNA, 63 nt, Human
aagaagacaaacuguacaagcccauuucauuccuuguuguauaccuuuccaucugcccuccca

SEQ ID NO: 422070 - RNA, 63 nt, Human
acacugguagaugcaacaaacucagauuuauauuuguuguaaaguuguaaaaauauugugaug

SEQ ID NO: 422071 - RNA, 63 nt, Human
acauuaaaauuguacaacuggugauuguucaaauuguuguacuacuacucuucaauuguacug

SEQ ID NO: 422072 - RNA, 63 nt, Human
cuggguggggguuggggugggggguaguuuacuuuguuguaaggacuugauaaccuggcuaca

SEQ ID NO: 422073 - RNA, 63 nt, Human
gauuacaggcaugcaccaccaugcccagcuaauuuguuguauuuuuaguagagacaggguuuc

SEQ ID NO: 422074 - RNA, 63 nt, Human
aauauuuuuuuuccauuuggcauacaucguucuuuguuguaauuaaauaaacauagauaaaau

SEQ ID NO: 422075 - RNA, 63 nt, Human
cuuuugaccguccaagucauuaugaauucugacuuguuguauuaggaacauguuggacagugg

SEQ ID NO: 422076 - RNA, 63 nt, Human
uguguuuacauuuacugaaaugcgcucuuuaauuuguuguagauuaggucuugcuggaagaca

SEQ ID NO: 422077 - RNA, 63 nt, Human
cuuauguauacuuuuacaguuugccaaaauauuuuguuguaaaauuuuuuuucaauaaaaugu

SEQ ID NO: 422078 - RNA, 63 nt, Human
uucuguucuuuguuguggcucuuguuuucauuuuuguuguacguguagaucuguaaauaaaau

SEQ ID NO: 422079 - RNA, 63 nt, Human
uucauuaacuuuuaucauuuaacucucucauguuuguuguaaccugagguauccaaaugcuac

SEQ ID NO: 422080 - RNA, 63 nt, Human
aucggcacuguacaaaaaaaucuuccaauuuaguuguuguagagaaaacaugcagaacaaaug

SEQ ID NO: 422081 - RNA, 63 nt, Human
caaggaguuaugcugacauaauucuaaggaguuuuguuguauuuuagaauaaaauuauaaagu

SEQ ID NO: 422082 - RNA, 63 nt, Human
gcuuuuaaaguuaucuuuguuuuauagacuuuuuuguuguauguauuacagucuuuauaaucu

SEQ ID NO: 422083 - RNA, 63 nt, Human
uuaauuuccuuucuaauuuaaaggagaguuacuuuguuguaugugugccacuaaaauaggggc

SEQ ID NO: 422084 - RNA, 63 nt, Human
ggaauuggaauauaucaaaaaagguuaguauuuuuguuguaguuaggauacuaaaaggauauu

SEQ ID NO: 422085 - RNA, 63 nt, Human
gugaauauguuuuauauguuaugaagaaaagaauuguuguaaguuuuugauucuacucuuaua

SEQ ID NO: 422086 - RNA, 63 nt, Human
uccagaaaauguuuagaguguuuuaguuuucauuuguuguaugugcccaaaugguuuaguagu

SEQ ID NO: 422087 - RNA, 63 nt, Human
uuucucuuuguagauaaaaagcauuaucuaugauuguuguauaauaaauugauuuuuacauua

SEQ ID NO: 422088 - RNA, 63 nt, Human
gcaaguauacacaauaguauuaucgucuacuguuuguuguaaauauauauauauuauuuucuu

SEQ ID NO: 422089 - RNA, 63 nt, Human
aaaauaaaccuagaaauauuguuuuuuauauuauuguuguaugacauuuaaaaauuucuuucu

SEQ ID NO: 422090 - RNA, 63 nt, Human
aaucaucauuuuuaaaaaaaaauuaacauguuuuuguuguaguuaucuucugggguuucaauu

SEQ ID NO: 422091 - RNA, 63 nt, Human
gacuauuuuauacuuguugauuaaucggaauguuuguuguaugccuucauuuuccauuucacu

SEQ ID NO: 422092 - RNA, 63 nt, Human
ucuuccauccuucaacugagcucaaaguagguuuuguuguaacauugugauuaggauuuaaac

SEQ ID NO: 422093 - RNA, 63 nt, Human
aauuucuucuugcuuuuuugguggaaauaggcuuuguuguaaacauuaagaauauaaaaucuc

SEQ ID NO: 422094 - RNA, 63 nt, Human
uuucacugccauaugcucuugucaaaacugcauuuguuguauaaagaugggaucgguguaguu

SEQ ID NO: 422095 - RNA, 63 nt, Human
ugugcaaaguaaaaugcuucauuugccacauaguuguuguaauauuuaauccaguagcauaac

SEQ ID NO: 422096 - RNA, 63 nt, Human
uggugaauguggaaaauauauugucuuggaaauuuguuguaaaagccauauuucuaauggaaa

SEQ ID NO: 422097 - RNA, 63 nt, Human
uaauugacugaaauuacuuuaacauuuuggaaauuguuguauaucacuaaaagcaugaauugg

SEQ ID NO: 422098 - RNA, 63 nt, Human
uuauucauagauuuauuucaaauaguuuggaaauuguuguacuuuugaaaacaugcuguuccu

SEQ ID NO: 422099 - RNA, 63 nt, Human
uguuuugaagacagaauuauguuacaaauguuuuuguuguaaauaaauaaaacacuuccuugu

SEQ ID NO: 422100 - RNA, 63 nt, Human
aaccuuuuuuccuaugaaguuuuuuguagguccuuguuguaacuaauuuaggaugaguuucua

SEQ ID NO: 422101 - RNA, 63 nt, Human
uugcacuguggauaaauguuccgagagucuccauuguuguacaggaucuucaguuauucgagg

SEQ ID NO: 422102 - RNA, 63 nt, Human
uuugauagcuugaagaucuuuuuaauuauaauuuuguuguauuuguuuccuaggagcaagugu

SEQ ID NO: 422103 - RNA, 63 nt, Human
uuugcaccuagauacuguuacaacugcaauaauuuguuguacaacuguuguaucaggaaucag

SEQ ID NO: 422104 - RNA, 63 nt, Human
acaacuguuguaucaggaaucaggauuuuuuuguuguuguacuuuccagauccuuauagauac

SEQ ID NO: 422105 - RNA, 63 nt, Human
uugaauuaaggccuaugguaagguaacauugcuuuguuguacuuuugaacaagagcuccuccu

SEQ ID NO: 422106 - RNA, 63 nt, Human
agggagggaaagagaagagcucugcacuucccuuuguuguagucucacaguauaacagauauu

SEQ ID NO: 422107 - RNA, 63 nt, Human
cugcucagguaaaucuuagugaaauuccuaccguuguuguacguucugcaaaacauuuuaugu

SEQ ID NO: 422108 - RNA, 63 nt, Human
aggguccuacuaacuacucaguaaaagaacguauuguuguauuccuccaguguuaagcuauag

SEQ ID NO: 422109 - RNA, 63 nt, Human
cauucuauuuagucuucagaaugcugaauuuacuuguuguaagucuauuuuaaccuucuguau

SEQ ID NO: 422110 - RNA, 63 nt, Human
gccaacugucagauuaaauagcauuauaauauuuuguuguaaucauaaaugcagguuuauguc

SEQ ID NO: 422111 - RNA, 63 nt, Human
cuuugagguguguugcccuaauacuagccagcguuguuguagccauauucccugcugcugcac

SEQ ID NO: 422112 - RNA, 63 nt, Human
acaagcuuauucacauuuugcuuccuaaucuuuuuguuguacagggauucagguuucuuauuc

SEQ ID NO: 422113 - RNA, 63 nt, Human
gucuaggcacuguacaguuauuauauaucuugguuguuguauuguaccagugaaaugccaaau

SEQ ID NO: 422114 - RNA, 63 nt, Human
uuauauaauuuucaccuuuacuuucaaaguguuuuguuguaguuggcuauugcagagagugca

SEQ ID NO: 422115 - RNA, 63 nt, Human
agaaaacaaucacaaaguagugguuuaaauacuuuguuguauuuggcuaauuuugcugucuua

SEQ ID NO: 422116 - RNA, 63 nt, Human
acuccaaguaauccuugacccaagaacaaaggcuuguuguaugaguuccacugccagauuuau

SEQ ID NO: 422117 - RNA, 63 nt, Human
cuguacaugucauuguauguauaccaaacaagauuguuguaaaucauauuuuuuauuacaaca

SEQ ID NO: 422118 - RNA, 63 nt, Human
aaauccccucagcaggcauaggauagaaacguauuguuguauauuuccauuuuugaauagggu

SEQ ID NO: 422119 - RNA, 63 nt, Human
aaagucauguguugauaguagaagcagugguaguuguuguaacaguaaucauugucauuguca

SEQ ID NO: 422120 - RNA, 63 nt, Human
agaaucagauuugaaaaaguuaaaacaauuucauuguuguaauuguucccuuucuguuuucau

SEQ ID NO: 422121 - RNA, 63 nt, Human
uuacaaaauggcaaaacauuuucucuguauucauuguuguauuuuucuacagugagaugugau

SEQ ID NO: 422122 - RNA, 63 nt, Human
uccaaaguggugauugauuugaguauuugaaaauuguuguagcuaaaugaagcaugauuaguc

SEQ ID NO: 422123 - RNA, 63 nt, Human
ugauguaagagucacacugcuucaacuuuuucuuuguuguaguuuuuaaauugucgauuuuua

SEQ ID NO: 422124 - RNA, 63 nt, Human
auauauauuuaccgauaagcagugaguguaaaauuguuguagcuugaauaagaaaccacuuuu

SEQ ID NO: 422125 - RNA, 63 nt, Human
gacuuuugacauacaaacucuucuugagaauguuuguuguaaaugguuucaaaaauacaaauu

SEQ ID NO: 422126 - RNA, 63 nt, Human
uuauacuuggauuugcucucuucccauuucugauuguuguauagcuuucgauuuugcuuacag

SEQ ID NO: 422127 - RNA, 63 nt, Human
gaauaaaaccaauuuuucuaacuuguugcucauuuguuguaacucaauaaagcaaagacuaaa

SEQ ID NO: 422128 - RNA, 63 nt, Human
auccacugcuccucuagguggcccauuuaugguuuguuguaagagaaaaauuaaaaaaauauu

SEQ ID NO: 422129 - RNA, 63 nt, Human
gccugguucuguguacuugucccuuuguugucguuguuguaguuaaaggaauuucauuuuuua

SEQ ID NO: 422130 - RNA, 63 nt, Human
accauagcuugcuggguugaucuagaugucuguuuguuguauggaaauuuugggggaaaaaau

SEQ ID NO: 422131 - RNA, 63 nt, Human
cucccuuuuuccaauuucuuauugcauaucauuuuguuguaauacagaaagcagcauuuuuaa

SEQ ID NO: 422132 - RNA, 63 nt, Human
auaguauguaucuagaauacugguaaugagaaauuguuguaaauugaagaaaacaagaugcug

SEQ ID NO: 422133 - RNA, 63 nt, Human
aguauguuaucccuauggugaaaauaaauuaauuuguuguauauaguuccucaaucucugaag

SEQ ID NO: 422134 - RNA, 63 nt, Human
uauuuauuaugagaccaguggucuggaaacagcuuguuguaccgaaucaacuggagucuaugc

SEQ ID NO: 422135 - RNA, 63 nt, Human
uccuugugacuuacaauuugcacaauauuucuuuuguuguacuuuauaucuuguuuacaauaa

SEQ ID NO: 422136 - RNA, 63 nt, Human
aacauccacgagugcuguugcacuaccaucuauuuguuguaaauaaaaguguuguuuucaaag

SEQ ID NO: 422137 - RNA, 63 nt, Human
uuucauauuuauuuguuguauuuaaaaaauacauuguuguaagagugauuuuuucaauauauu

SEQ ID NO: 422138 - RNA, 63 nt, Human
aacuugaaauugcuuugcugguuucauauuuauuuguuguauuuaaaaaauacauuguuguaa

SEQ ID NO: 422139 - RNA, 63 nt, Human
ccaaaacagugauauuuccagaacuuuuuaguauuguuguaaaacuucaugaaacaaaagacc

SEQ ID NO: 422140 - RNA, 63 nt, Human
uaguuacgaugaccagugauauaaguggaguuuuuguuguauuuuuguuuugcuuuucaccgg

SEQ ID NO: 422141 - RNA, 63 nt, Human
guacauuuuccauuuuggaauuuugaguuccaauuguuguaaaacuuaauuucuccccaguuu

SEQ ID NO: 422142 - RNA, 63 nt, Human
ucugcaaggacucaccuccuugagccuugguuuuuguuguagggauuaaaugagauaauauga

SEQ ID NO: 422143 - RNA, 63 nt, Human
uuuuucuacagugaauuuaaucaaauaguaaaguuguuguaaaaauaaaaguggauuuagaaa

SEQ ID NO: 422144 - RNA, 63 nt, Human
ugaaauucuucucaggcuccuuaaacccucgcuuuguuguaaaagcuaaaauaaacagcaugc

SEQ ID NO: 422145 - RNA, 63 nt, Human
gugucuuuguaauauguuuuuaguucccuuuuuuuguuguauuauaggcagaugaacaaauua

SEQ ID NO: 422146 - RNA, 63 nt, Human
ugaagaguugacacugaaaucuaaaauguuuaauuguuguaaauauuacaguuuuuuuuuuuu

SEQ ID NO: 422147 - RNA, 63 nt, Human
cuguauucugacaacucuuugcuuuauagcauuuuguuguauucaaaugauaaugguagcauu

SEQ ID NO: 422148 - RNA, 63 nt, Human
cagauaugaauggcuaauacuccauuguucugcuuguuguaauggugaaugcuuuaagaaaaa

SEQ ID NO: 422149 - RNA, 63 nt, Human
ugcagugucaacugauguuuaagcuacagagcauuguuguaguggugagggcccucuguugca

SEQ ID NO: 422150 - RNA, 63 nt, Human
gugguaacuucguauguucaguuuaugcgaugauuguuguaaaugcaaugccguaguuuggau

SEQ ID NO: 422151 - RNA, 63 nt, Human
aaaaguuguuuccaauuuaagccccaaaaccauuuguuguauuaguggaugguggguaaaaua

SEQ ID NO: 422152 - RNA, 63 nt, Human
agaauaauucuuggucuuccccaaagagacaauuuguuguacccaugacuguugccugcaaaa

SEQ ID NO: 422153 - RNA, 63 nt, Human
aagacgguuggggauggggggauuuuuuuguucuuguuguacccuuguuuugaaacuagaaau

SEQ ID NO: 422154 - RNA, 63 nt, Human
auggccugaaauugcaagagcauuucuggcauguuguuguaauuauuccauuauuaguccuua

SEQ ID NO: 422155 - RNA, 63 nt, Human
cuacaaaaaaagguaaugccucauuuacuaguauuguuguaaaaugaggaauguaugugaaua

SEQ ID NO: 422156 - RNA, 63 nt, Human
aguguuagaaagccuuuagcaagaugucacaccuuguuguacaugagaaacuuugaaaaugga

SEQ ID NO: 422157 - RNA, 63 nt, Human
uaacccgggacuccuugccauggacuuuuccuguuguuguacacacacaacagaacaaaauga

SEQ ID NO: 422158 - RNA, 63 nt, Human
acuauguuuaaguuuuaugugugccuuguaagauuguuguaaaauuuuuugugagcacuuuga

SEQ ID NO: 422159 - RNA, 63 nt, Human
agagucucaaacacugaucacaaauaaacugcuuuguuguaacacagaguacugccugguucc

SEQ ID NO: 422160 - RNA, 63 nt, Human
cacugaggaccugcauuagaaacauuuuuuaaauuguuguacaggaagagaugugucuaaaac

SEQ ID NO: 422161 - RNA, 63 nt, Human
uuuguuuacugauuggggaggggcaauauuuauuuguuguaaauagcaaaugcuagacuugaa

SEQ ID NO: 422162 - RNA, 63 nt, Human
auucgcuuuuguaagaaucagauggcauuaugcuuguuguacaaugccauauugguauaugac

SEQ ID NO: 422163 - RNA, 63 nt, Human
uaauaaauauaauagaaaaauauuuuauuuguauuguuguauaaaauauuuacaaucauauag

SEQ ID NO: 422164 - RNA, 63 nt, Human
gauacauuaaauggacacauaucuugcaaaauuuuguuguauagaacaguuuuuaggcagccu

SEQ ID NO: 422165 - RNA, 63 nt, Human
aauggcaauauaaauccagucuuuauucucccuuuguuguauuuaugcugaaucuucccuuug

SEQ ID NO: 422166 - RNA, 63 nt, Human
cacauuucucagcucugggggucauuuaccaguuuguuguagaagaaauaaucagguaaguua

SEQ ID NO: 422167 - RNA, 63 nt, Human
gcgaguuucacuuuccccuugcucguuucucccuuguuguaaguguuuacaacuggcaugugc

SEQ ID NO: 422168 - RNA, 63 nt, Human
uugagcaaaguauagcaacagaauauauugcuuuuguuguaagcuuuuguaguacauguuuuu

SEQ ID NO: 422169 - RNA, 63 nt, Human
gaagauauuuucuugaaccauauuaccuuccuuuuguuguaaacugcacaggaugguuuguac

SEQ ID NO: 422170 - RNA, 63 nt, Human
aaaggaaucaggauuuagccucaaguaguucccuuguuguauuaauaaccacacccuuucugc

SEQ ID NO: 422171 - RNA, 63 nt, Human
uaauaauauauuuuaaauauuuuuucuuuucuauuguuguacacagaaauacaguuaaguuuu

SEQ ID NO: 422172 - RNA, 63 nt, Human
uggaaugacaaacaggcuucccuuuuucuccuauuguuguacucuuaugugucugauauacac

SEQ ID NO: 422173 - RNA, 63 nt, Human
auggccguaauccuucuaagggaaacacuaaaguuguuguagucuccacuucagucagaaacu

SEQ ID NO: 422174 - RNA, 63 nt, Human
uaugcaggaaucauucaugagacagaauguauuuuguuguaugacagaaggcuuuuccaagca

SEQ ID NO: 422175 - RNA, 63 nt, Human
cuugagagaaggugaguacaaagcaauuugcaguuguuguaaugacaagauuacugcgcaagu

SEQ ID NO: 422176 - RNA, 63 nt, Human
aguuaucugaacaaauacuuuugaaaaaaaaguuuguuguauagucaaaacaaaucggugcca

SEQ ID NO: 422177 - RNA, 63 nt, Human
aauaaaccucucugauggcagcaagccucucacuuguuguaggacugcaagacacuggaccga

SEQ ID NO: 422178 - RNA, 63 nt, Human
uuaccacaacuugcugaaauacaccauuauuauuuguuguaugcaauacuggauuuauuuuga

SEQ ID NO: 422179 - RNA, 63 nt, Human
agcuagguuuauccaugaaggacugagugaccuuuguuguauuuaacaaaauccaggugcauc

SEQ ID NO: 422180 - RNA, 63 nt, Human
uuaaacuuguaauuuuugcuaaguuauuugucuuuguuguaucuauaaauauguaaaaaauau

SEQ ID NO: 422181 - RNA, 63 nt, Human
ggagugggacaggaacaagacuugccuagaucuuuguuguaucuuggggacuuuuacuuuguu

SEQ ID NO: 422182 - RNA, 63 nt, Human
guuuuauaguaauucuugccugcuucuuagucuuuguuguaggaugcauaauaaaauacauga

SEQ ID NO: 422183 - RNA, 63 nt, Human
cauccugaaauaagcauaccuaauuucaagcaauuguuguauuuucaugacugaccuuaacug

SEQ ID NO: 422184 - RNA, 63 nt, Human
ugauuuggaguuucagaucuuccaaagcacuauuuguuguaauaacuuuucuaaauguagugc

SEQ ID NO: 422185 - RNA, 63 nt, Human
auccccuuggaauauuaagaggucaacacgugauuguuguacguacacauugugcucuggagu

SEQ ID NO: 422186 - RNA, 63 nt, Human
uggacauguuugcaaaccauaccaagggucagguuguuguacacuuacaguacgugucaacca

SEQ ID NO: 422187 - RNA, 63 nt, Human
ugguuuauauacuuuuugcauuguaaauagucuuuguuguacauugucaguguaauaaaaaca

SEQ ID NO: 422188 - RNA, 63 nt, Human
gacuuaauuuaauuguaaaauuauuagagguauuuguuguagagcuuuauauauuaaagagag

SEQ ID NO: 422189 - RNA, 63 nt, Human
ugcagcagcuauuuugccaguuaguauaccucuuuguuguacuuucuugggcuuuugcucugg

SEQ ID NO: 422190 - RNA, 63 nt, Human
cuucacuuuccaaaauagcugaggguuguuggcuuguuguagcugaccaccaaaagcagucac

SEQ ID NO: 422191 - RNA, 63 nt, Human
agcucuauuauccaauuaacuucuccauaauuauuguuguaauauuauuauuguuuguaaaac

SEQ ID NO: 422192 - RNA, 63 nt, Human
uuuccacaaccucaaaggguuauuugaaaucuuuuguuguauuuuaaaauauuuuuuggaaga

SEQ ID NO: 422193 - RNA, 63 nt, Human
uaaaauacguaccaugaguacucugacucuuuauuguuguaagaaaaauaguucaucaucaga

SEQ ID NO: 422194 - RNA, 63 nt, Human
auagcauugauucaccuuguuuuuuuaaccugguuguuguaguaagagcuuuguuucaauauc

SEQ ID NO: 422195 - RNA, 63 nt, Human
ucuagcauugcuggacacaaaguguagucauuauuguuguauugggugaugugugcaaaacug

SEQ ID NO: 422196 - RNA, 63 nt, Human
aaauucuguuaugacauaauuuaugucuccauuuuguuguauuggccaguacuuuuacaaauc

SEQ ID NO: 422197 - RNA, 63 nt, Human
aacaggaacaauagaacacucugccuguuauuuuuguuguaaucaagcuuuuccacaguucuu

SEQ ID NO: 422198 - RNA, 63 nt, Human
uugaggaauauaagagcuuucaaugauaaagguuuguuguaguugucuuaugugcugaauuug

SEQ ID NO: 422199 - RNA, 63 nt, Human
aaugaguuuugacgcauguuguuuugauugcuauuguuguacaugagaaauucagcauuaaag

SEQ ID NO: 422200 - RNA, 63 nt, Human
gucaaccaucucuuuaaaguuagccuauaaauauuguuguauaauuuucuuuggucagaaaca

SEQ ID NO: 422201 - RNA, 63 nt, Human
guauaaagcagcagaacugaaggggaaaaaugauuguuguauacacugaauugcuuugcaugg

SEQ ID NO: 422202 - RNA, 63 nt, Human
caauucuuuguuuuuaauugcuugaagauugcauuguuguaauuguucaguuuuuaaaugugu

SEQ ID NO: 422203 - RNA, 63 nt, Human
cuuaggaugcaaaugaaaaugugaauacauaccuuguuguacuguugguaaaauucugucuug

SEQ ID NO: 422204 - RNA, 63 nt, Human
gaaugccuuggucugaauauuugauagaaccaauuguuguacauaaaacagauugcgcauaua

SEQ ID NO: 422205 - RNA, 63 nt, Human
cccauuguguuccucugcccucauucuuuaccuuuguuguaagaacuuuagcuccagggaacu

SEQ ID NO: 422206 - RNA, 63 nt, Human
auguggacagcaauguuaugccguuuacguuuuuuguuguaauccuaguucuaugaagcugug

SEQ ID NO: 422207 - RNA, 63 nt, Human
acaggccuccagccagguugaaugagcucauuuuuguuguagccaaccaguaagauuugcuaa

SEQ ID NO: 422208 - RNA, 63 nt, Human
gggauguggaaagguuugcaauugucaaguguuuuguuguagcuuaguauccauaagggaaac

SEQ ID NO: 422209 - RNA, 63 nt, Human
uaaauauauuauacucacucaucacggccaucuuuguuguaaccauuucuguguuuauaaaug

SEQ ID NO: 422210 - RNA, 63 nt, Human
cuuuuuauauagguaaacucaugucguggagguuuguuguacagauuauuucaucacccaggu

SEQ ID NO: 422211 - RNA, 63 nt, Human
aacuaggggaauuucaggggacagagaugggauuuguuguaugauaaacuguauguaguuuuu

SEQ ID NO: 422212 - RNA, 63 nt, Human
uaagguuuggggacauuauaaacuugaguacauuuguuguacacaguugauauuccaaauugu

SEQ ID NO: 422213 - RNA, 63 nt, Human
ccugucccaaguuuuguuccauuuuuuaaaaauuuguuguaaacugcauguuuuauaaaauaa

SEQ ID NO: 422214 - RNA, 63 nt, Human
cuaccuugcuuacagauucaugguuugauaaauuuguuguauucaaaaacuugaaaugcagga

SEQ ID NO: 422215 - RNA, 63 nt, Human
caaucagucagauucacagaaaaaaguuguuuguuguuguaaaggcucaagaugaaacucuuu

SEQ ID NO: 422216 - RNA, 63 nt, Human
uugagugacuucuuacaacauccacauaagaauuuguuguaaugaguucauguccacccagau

SEQ ID NO: 422217 - RNA, 63 nt, Human
ccuaguuguaaaguucugcauuuauaagugccauuguuguaaggugguguuuccuagaccuuc

SEQ ID NO: 422218 - RNA, 63 nt, Human
auugccuuucagaauaaauauugguauuuuuuguuguuguaaaauugaaaucaggcauuuaac

SEQ ID NO: 422219 - RNA, 63 nt, Human
cuuugaaaaauguuccacuuacccuucagauauuuguuguaaguuaauucaauucuuaauacu

SEQ ID NO: 422220 - RNA, 63 nt, Human
agaguucuaguucuagaaguucuuauuuuguuuuuguuguaauguuugaauacuauuuaauau

SEQ ID NO: 422221 - RNA, 63 nt, Human
gugacucccaaaaguuaacaaucacugaugugguuguuguaucccucauccaaccccagaaca

SEQ ID NO: 422222 - RNA, 63 nt, Human
uaugggaaucacugaaauauuuuuguagauuaauuguuguaacauugucuuucuuuuuuuucu

SEQ ID NO: 422223 - RNA, 63 nt, Human
cuaaugcacuucugagcuuuucuuaacaaaugcuuguuguaucgcagccugcuuuucuuagau

SEQ ID NO: 422224 - RNA, 63 nt, Human
aaaaaaaaaaaaacucacccguuuuccugggauuuguuguaaggaguuuucacuggccucacu

SEQ ID NO: 422225 - RNA, 63 nt, Human
uuauuuucucaucagcuggcucugaucaugaauuuguuguaauuuuauguuguacucagugca

SEQ ID NO: 422226 - RNA, 63 nt, Human
auuaauggguacgaaaauauaguuagaacgaauuuguuguaguauuugauagcccaacagggu

SEQ ID NO: 422227 - RNA, 63 nt, Human
gcgccucagugaaaugcacaggaucaacaggguuuguuguaacuagauugaaacacuaaguug

SEQ ID NO: 422228 - RNA, 63 nt, Human
gcaaaugacacuuugccgucugguuucuguguuuuguuguaacagguuaaaugaaccccuggg

SEQ ID NO: 422229 - RNA, 63 nt, Human
cagagucuguguugauccucauauacaauaauguuguuguaacacaaguguuauuagaccaua

SEQ ID NO: 422230 - RNA, 63 nt, Human
uuuucuaaaaaugauaaaagguuauuacgaauuuuguuguacaaaaucuguacaaaaaucugu

SEQ ID NO: 422231 - RNA, 63 nt, Human
aauuuaguuuuuaaaauaguaaacugaauauuuuuguuguaagccuaucagagucaauccuuc

SEQ ID NO: 422232 - RNA, 63 nt, Human
uuuuuuuuaaugagggauguaaacaguauaagcuuguuguauuugauaaccugucuuccuugu

SEQ ID NO: 422233 - RNA, 63 nt, Human
cacagaguggcaucauuuguauaauuauaugcauuguuguaguuugcaccuguugguuuuaau

SEQ ID NO: 422234 - RNA, 63 nt, Human
gugaacuugacuucuuaugugugcucuaugaguuuguuguaauuuucuucuugaaauugugau

SEQ ID NO: 422235 - RNA, 63 nt, Human
agaaaacucaguaaagaucacuuuggaaucacuuuguuguaacaaaauugauucauggugacu

SEQ ID NO: 422236 - RNA, 63 nt, Human
gaagaaugcauucaaaauauaacaggugcuucuuuguuguacgcagaggaauuuuuucuuuug

SEQ ID NO: 422237 - RNA, 63 nt, Human
cgccacagcggaucagcgguuccguguucacuuuuguuguacaauauaugacacagugcacau

SEQ ID NO: 422238 - RNA, 63 nt, Human
cucagaggacgagucuacuaauuauugccuuuguuguuguauuacaaaucugcauaaaauacc

SEQ ID NO: 422239 - RNA, 63 nt, Human
ugaucuaggugucuauagcugagggguaagagguuguuguaguuguccuggugccuccaucag

SEQ ID NO: 422240 - RNA, 63 nt, Human
augucaccauuaauucucaacgacugcucuauuuuguuguacgguaauaguuaucaccuucua

SEQ ID NO: 422241 - RNA, 63 nt, Human
caguccauuggaauaguauuagguuuugguuuuuuguuguauuucccccuuuccacugggccc

SEQ ID NO: 422242 - RNA, 63 nt, Human
acuaaaugccuaguuuuuaguaaucuguacauuuuguuguaaaaagaaaaaccacucccaguc

SEQ ID NO: 422243 - RNA, 63 nt, Human
ucccagauagcuggccuuagcaugugaucacgguuguuguauuuuuaauuuuugucuuuuaca

SEQ ID NO: 422244 - RNA, 63 nt, Human
aaugaauaaauccaaaacaaacaugcaguacuuuuguuguaugggauuggugggcugauuuac

SEQ ID NO: 422245 - RNA, 63 nt, Human
aaugaaaucauucuacuuuguccuuucugacuuuuguuguaaagacgaauuguaucaguugua

SEQ ID NO: 422246 - RNA, 63 nt, Human; identical to SEQ ID NO: 421934

SEQ ID NO: 422247 - RNA, 63 nt, Human
ggagcaaaugaguauuuguugcauuuguucaauuuguuguauauggugaauauuuaauuaugg

SEQ ID NO: 422248 - RNA, 63 nt, Human
uggaaggauucgccacuacccagaccuuguuuuuuguuguauuuuggaagacagguuuuuuaa

SEQ ID NO: 422249 - RNA, 63 nt, Human
ccucagcacaugacgauuucuauuaacauuuuauuguuguagaaguauuuuacauuuucaucc

SEQ ID NO: 422250 - RNA, 63 nt, Human
ccagguauuuaucugccaaaacaaggacaaaucuuguuguauuaacagcagggucacuucuca

SEQ ID NO: 422251 - RNA, 63 nt, Human
cuuuguucuuugacucaaaugguauugagcuguuuguuguauauggaagcauaggugucuaua

SEQ ID NO: 422252 - RNA, 63 nt, Human
ggauuacaggcacccaccaccaugcccagcuaauuguuguauguuuaguagagacaggguuuc

SEQ ID NO: 422253 - RNA, 63 nt, Human
ccaaagacuugauggaggggcuagaggcgacccuuguuguaaaaggcgaucagaacaccugag

SEQ ID NO: 422254 - RNA, 63 nt, Human
ggauggccgccugucccugacuauugaguccuguuguuguaagccaggcauggagggcuccug

SEQ ID NO: 422255 - RNA, 63 nt, Human
caagacaaaauacuugggguuuuccaauaaagauuguuguaauauugaaaugagccuacaaaa

SEQ ID NO: 422256 - RNA, 63 nt, Human
cuguguccucaccauugcuaugcaaagugauucuuguuguacauaagauuuaaauaaugcacc

SEQ ID NO: 422257 - RNA, 63 nt, Human
ccuucuguaggaaguagaagucauauguugucuuuguuguagugaaauuauacagauagaguu

SEQ ID NO: 422258 - RNA, 63 nt, Human
cccccuccuggugcucccucugggucccccugguuguuguagcagcuuaacuguaucuggagc

SEQ ID NO: 422259 - RNA, 63 nt, Human
uacaugccacagcucagcugucugccugccacuuuguuguaaacauugcaaaaauguggauca

SEQ ID NO: 422260 - RNA, 63 nt, Human
ggaagcauuguaaaauaauucugaguuuuguguuuguuguagauugauuguauuguugaaaaa

SEQ ID NO: 422261 - RNA, 63 nt, Human
accauguggaguuuacuuuuuuuauaugaauguuuguuguacugugucuaagcauaacuuccc

SEQ ID NO: 422262 - RNA, 63 nt, Human
ccaguuuuccccucucuuguuuaugucagagcuuuguuguaagccucucacuuuguaaggaaa

SEQ ID NO: 422263 - RNA, 63 nt, Human
cauagucucaccagagacuaucauuauuucguuuuguuguacuuccuuccacucuuuucuucu

SEQ ID NO: 422264 - RNA, 63 nt, Human
ggaggaggagggacuggguucagcuguggugcuuuguuguaaaaggcagccuggccuuugcua

SEQ ID NO: 422265 - RNA, 63 nt, Human
acucucugauauuuccuauguacauagcuuuuauuguuguaaauccuuucuuaaugguuaaau

SEQ ID NO: 422266 - RNA, 58 nt, Human
aacgccugaagcaauccuaagauccugcuuguuguaagacuccguuuaauuuccagaa

SEQ ID NO: 422267 - RNA, 63 nt, Human
acaaaauguaaaacaugacauucccugcagauauuguuguauaccaguaugguuucuucucuu

SEQ ID NO: 422268 - RNA, 63 nt, Human
ucaguaaagaccaauccuuacuguaggaaaucauuguuguaucaucacaaacaucuaucuuuu

SEQ ID NO: 422269 - RNA, 63 nt, Human
acuauccucuuagagaaacaaucaguucaacuauuguuguacugacugggacuucauauucua

SEQ ID NO: 422270 - RNA, 63 nt, Human
ucauugccaugguaucuuucucucagaccccuuuuguuguagugcuuguagaguguaaaguga

SEQ ID NO: 422271 - RNA, 63 nt, Human
uauugccuguaugucaauuauuauuuuaaaauauuguuguauuuacuuaaugucuuuaaugca

SEQ ID NO: 422272 - RNA, 63 nt, Human
uguaauaauuuuaauucuuuaaaaagugaaagcuuguuguaaagauauuuucuuuuuguuauu

SEQ ID NO: 422273 - RNA, 63 nt, Human
ugcguuugcuaaugguagcuaaauaaccaguuuuuguuguaaaugcaccaauucugaaggcac

SEQ ID NO: 422274 - RNA, 63 nt, Human
gguugugcagaacaaacaaggcauucaugggaauuguuguauuccuucugcagcccuccuucu

SEQ ID NO: 422275 - RNA, 63 nt, Human
auguuaagagauuaagaaaaaaaaauucuauuuuuguuguaauguccucgcggcucuggggac

SEQ ID NO: 422276 - RNA, 63 nt, Human
ggauuacaggcacccaccaccacauccagcuaauuguuguauuuuuaauagaggcgggguuuc

SEQ ID NO: 422277 - RNA, 63 nt, Human
caccuuccuguaccuccuccccacagcuugcuuuuguuguaccgucuuucaauaaaaagaagc

SEQ ID NO: 422278 - RNA, 63 nt, Human
gguuugugugaguaagcaagaaauaaaccuuuguuguuguaagccacugagauuuggagagug

SEQ ID NO: 422279 - RNA, 63 nt, Human
uauuugcuaagacgaauuugcucauuaaacauuuuguuguauuuuacuuuauggagcggcugu

SEQ ID NO: 422280 - RNA, 63 nt, Human
cagggugcgagaugccagcucuggaguucucgguuguuguaggagguuggguguuuucaaaug

SEQ ID NO: 422281 - RNA, 63 nt, Human
agacuacaggcgugugccacuacgcccggcuaauuguuguauuuuuaguagagacgggguuuc

SEQ ID NO: 422282 - RNA, 63 nt, Human
aguggaccugggagaguguucaaccguaaaaccuuguuguaaaugugagaaacguuauuuaug

SEQ ID NO: 422283 - RNA, 63 nt, Human
cugaagaaaguugcaguguuuuccucuuggacauuguuguauuucaaauaaaccacaaaucau

SEQ ID NO: 422284 - RNA, 63 nt, Human
ggggacuggcccucccuugcaggucgguuugguuuguuguaaauaaaaguauuuaauuaguuu

SEQ ID NO: 422285 - RNA, 63 nt, Human
guagcaaauaugugagcaaaaugaaacaaauacuuguuguaaaaaugaugguuuguagagggg

SEQ ID NO: 422286 - RNA, 63 nt, Human
acacuguguccaauucuuuuaaaauuaauguuuuuguuguaaauggacuauauaaauaccuuc

SEQ ID NO: 422287 - RNA, 63 nt, Human
gauuacugauuuuagggcacagcaccagaugaauuguuguauaugcuuguaaaaauugauucu

SEQ ID NO: 422288 - RNA, 63 nt, Human
aacagacaaaaagggugauagaaauauguauuuuuguuguauauguaacucuaagagaccuuc

SEQ ID NO: 422289 - RNA, 63 nt, Human
agaaugugguuuggggaauuaccuuauuuuauauuguuguaaacaaacuucaaauucuacaug

SEQ ID NO: 422290 - RNA, 63 nt, Human
gcuuucuguagccacaccugugaggcgugaugauuguuguauuauuagauuacugauuuuucu

SEQ ID NO: 422291 - RNA, 63 nt, Human
cauuuguaaagcuguggacaccaucagggaagcuuguuguaacggcuuuugaaggccaguaac

SEQ ID NO: 422292 - RNA, 63 nt, Human
aaauguggucucuuuccuacugagcacauauucuuguuguauuugugccaggcugugcuuucu

SEQ ID NO: 422293 - RNA, 63 nt, Human
gaauccaguugggacucgcuguugccauccucuuuguuguaucugguuuucaucacuagacuc

SEQ ID NO: 422294 - RNA, 63 nt, Human
aaauaauuuuauuauauaguguuuuggauguauuuguuguagaaauggaccagugaauaaaga

SEQ ID NO: 422295 - RNA, 63 nt, Human
gcuggaauggcuauggcuaugcaguggcacuucuuguuguagucuuuuugcaaacucugauuc

SEQ ID NO: 422296 - RNA, 63 nt, Human
agaaaauagguaacuaucuaauuagagaaauaauuguuguauuuuaagaucugagagugugua

SEQ ID NO: 422297 - RNA, 63 nt, Human
uccaacagcccauauuugaugaguauuuuggguuuguuguaaaccaaugaacauuugcuaguu

SEQ ID NO: 422298 - RNA, 63 nt, Human
aaaauuauaacucuucugauucuaauguggaaauuguuguauuuaaucugaaaaugacuuuac

SEQ ID NO: 422299 - RNA, 63 nt, Human
cuauuuuuauuggaggauuuggucagaaugcaguuguuguacaacucauaaauacuaacugcu

SEQ ID NO: 422300 - RNA, 63 nt, Human
ucagcuauuuagacuacugugaaauguuuugacuuguuguaaccuguauacuggaaucccucu

SEQ ID NO: 422301 - RNA, 63 nt, Human
cccuguauuuauuaaugcauauauuuccccugcuuguuguacaaguaaguuacucuuuuccuu

SEQ ID NO: 422302 - RNA, 63 nt, Human
ugugaugcaugaauaacucauugauuuaucucuuuguuguauuuuccaugauguuucuuaaaa

SEQ ID NO: 422303 - RNA, 63 nt, Human
guguuguacauagaaugaugaaggguuccacuguuguuguaugucuuaaauuuauuuaaaacu

SEQ ID NO: 422304 - RNA, 63 nt, Human
ggcacauugcaauccucaaacaugugguuaucuuuguuguauuggcauaaucagugacuugua

SEQ ID NO: 422305 - RNA, 63 nt, Human
cuuuuuccugcaauuaauaaucagacuggaaaauuguuguaucauuuuaauuuguaguuacaa

SEQ ID NO: 422306 - RNA, 63 nt, Human
ugaguagugcuuugguguucacagucuguuuuuuuguuguaacuuauauuuuuuaaugcugau

SEQ ID NO: 422307 - RNA, 63 nt, Human
uuaauugaaggaaagauuuguacuacaguucuuuuguuguaaagaguuguguuguucuuuucc

SEQ ID NO: 422308 - RNA, 63 nt, Human
ugauacuuuuuugaaaucaguaaacacuguguauuguuguaaaauguaaaggucacuuuucac

SEQ ID NO: 422309 - RNA, 63 nt, Human
aguuugagaguaaaacuguaaaaaauuauauuuuuguuguacuuucuaagagaaagaguauug

SEQ ID NO: 422310 - RNA, 63 nt, Human
uaagucuguaucacugugacgauuugagacaacuuguuguauugagggacuuucuguaccucc

SEQ ID NO: 422311 - RNA, 63 nt, Human
cuccuuuccucucugcuaauagauuuuuugugguuguuguaaauguuuugguuugguuauuua

SEQ ID NO: 422312 - RNA, 63 nt, Human
cugugcucuggucaucuuugaguuuaaggccuuuuguuguauaaggcuguggaaguuguacuc

SEQ ID NO: 422313 - RNA, 63 nt, Human
gcuacaguaaacuacaugacaguguuuugauaauuguuguauaaaucgguauagcuccucugu

SEQ ID NO: 422314 - RNA, 63 nt, Human; identical to SEQ ID NO: 422313

SEQ ID NO: 422315 - RNA, 63 nt, Human
agaaaaaucuauguuuuuccucuugaggugauuuuguuguauguaaauguuaauuucauggua

SEQ ID NO: 422316 - RNA, 63 nt, Human
gcuaugagaaucaguuauaaaaguauuagccauuuguuguaaaugccaauaaaauauucacca

SEQ ID NO: 422317 - RNA, 63 nt, Human
ucagccuguuggugaguuuaguugugcaugccuuuguuguauauaagcuaaauucuagugacc

SEQ ID NO: 422318 - RNA, 63 nt, Human
cuucccugucuauaccacugacucuugcucugguuguuguacucuuauacgugaauagacucu

SEQ ID NO: 422319 - RNA, 63 nt, Human
cuccuugauccuucccuucuuaguggcuguuguuuguuguacuuccguuuagacuuuguuuua

SEQ ID NO: 422320 - RNA, 63 nt, Human
ccugcuuuaaaaacccuuuugcuagcugugcuauuguuguauuugauauugcaaauugcuaug

SEQ ID NO: 422321 - RNA, 63 nt, Human
uugaaaguuucuaauuauuaaauggugucggaauuguuguauuuuccuuaggaauucagugga

SEQ ID NO: 422322 - RNA, 63 nt, Human
aauccuuuuaggaaugggacagguaccuuccacuuguuguauuuauuaguguagcuucuccuu

SEQ ID NO: 422323 - RNA, 63 nt, Human
cacaaaaaguuuaaaaaaguuguuuaauauuuguuguuguauacccaaauacgcaccgaauaa

SEQ ID NO: 422324 - RNA, 63 nt, Human
acgcagcagccuguguccuccagggccucugguuuguuguauuauaguauauuucgcugugga

SEQ ID NO: 422325 - RNA, 64 nt, Human
aaggucuggccaaugucuugccccaccccgccagccgcgauacggcgcaguuccuauauucaug

SEQ ID NO: 422326 - RNA, 64 nt, Human
ucacuucuuggcugugcagcaggucccccccuccccgcgauaugcuggaggguaggauucugca

SEQ ID NO: 422327 - RNA, 64 nt, Human
uagagccccaacuuagauugccuucugggaaaucccgcgauacuaaaauccagugagcuuuggg

SEQ ID NO: 422328 - RNA, 64 nt, Human
ugaugagcccuguuccugcucaucaugaagauccccgcgauacuucaacgccuucugacuucca

SEQ ID NO: 422329 - RNA, 64 nt, Human
cugaagcccacccugcaccucauuccaacuccuaccgcgauacagacccacagagugccauccc

SEQ ID NO: 422330 - RNA, 64 nt, Human; identical to SEQ ID NO: 376866

SEQ ID NO: 422331 - RNA, 64 nt, Human; identical to SEQ ID NO: 376867

SEQ ID NO: 422332 - RNA, 64 nt, Human
ugcuugugaucagcuuugacaacagugacagccccacaacuaguagccaccuguacauuuguaa

SEQ ID NO: 422333 - RNA, 64 nt, Human
gcuguccuuacuacuuuugcggaaguauggaagucacaacuacacagagauuucucagccuaca

SEQ ID NO: 422334 - RNA, 64 nt, Human
ccuuuuaaugccuuuaccucaaguugcuuggcagcacaacuaucuuugcaaaaaaaaguaaaga

SEQ ID NO: 422335 - RNA, 64 nt, Human
cacaucacacccucaaacacccagcucagccacacacaacuacccuccaaaccaccacagucuc

SEQ ID NO: 422336 - RNA, 64 nt, Human
aauuuaacucugccucucuugcagcauugcuucucacaacuauuaccugcaucugaaaaaaaau

SEQ ID NO: 422337 - RNA, 64 nt, Human
aagcaagagcagauucccuaggcaagagcagcagcacaacuaggaaaccccaaagcccaugcuc

SEQ ID NO: 422338 - RNA, 64 nt, Human
gcggugggugacccagagccaccaaagucacauccacaacuaaugagggaaaucuguaaagcca

SEQ ID NO: 422339 - RNA, 64 nt, Human
aucuucuaaagauuucuuuauauauuuaaaaacccacaacuaaaaauguauccacauaguagug

SEQ ID NO: 422340 - RNA, 64 nt, Human
ccuauuuucucucuggcuuucuucagccaugacucacaacuaaaaacauaaaacacuggagguu

SEQ ID NO: 422341 - RNA, 64 nt, Human
auuuuguggggauaauuuugcuuccuaaacugaucacaacuauuaaacuuagagaauaauaaua

SEQ ID NO: 422342 - RNA, 64 nt, Human
gcccuacucuucauuugcuaggggaaggucacagcacaacuaaauccaggacaggacauuguga

SEQ ID NO: 422343 - RNA, 64 nt, Human
aggggccugcguuaaaaccuaauugcuaaugcuucacaacuaggagagcaugccgucuugaugu

SEQ ID NO: 422344 - RNA, 64 nt, Human
gauucaaguacaaugcugccauuuuuuaaagggccacaacuauagaauuaccacuguuggaauu

SEQ ID NO: 422345 - RNA, 64 nt, Human
agcucagugacacccauuucagacuucugaccuccacaacuauaaaauaauaaacuuguguuau

SEQ ID NO: 422346 - RNA, 64 nt, Human
ugaaagucuuacuccuuuguuaguuuuguuucugcacaacuacuguacuuuuccauauggaaua

SEQ ID NO: 422347 - RNA, 64 nt, Human; identical to SEQ ID NO: 376862

SEQ ID NO: 422348 - RNA, 64 nt, Human; identical to SEQ ID NO: 376863

SEQ ID NO: 422349 - RNA, 64 nt, Human; identical to SEQ ID NO: 376868

SEQ ID NO: 422350 - RNA, 64 nt, Human
gucauuuccuguuaauucugggagacaaugauuucacaacuagcgggaagcaguccuaaaaguu

SEQ ID NO: 422351 - RNA, 64 nt, Human
gcccaucagcuacagucauuacuguuccccaacccacaacuaucuuuuaagaagucuuaguuca

SEQ ID NO: 422352 - RNA, 64 nt, Human
gaaugguaucuguucauuuuagugauaugaagaucacaacuaacaacugacaaaucagaguuug

SEQ ID NO: 422353 - RNA, 64 nt, Human
aggaggaaugacgcucaaccugcccagguuuggacacaacuacaaagaacagcaggacacagag

SEQ ID NO: 422354 - RNA, 64 nt, Human
aaaaaugugcuuuuauuuuaugggccauuuuuaccacaacuaaucuugccuuggauuacuaagc

SEQ ID NO: 422355 - RNA, 64 nt, Human
uaacuuagauuuauauuagcuagcaucuaauuugcacaacuagaacacaucccagaacaauuac

SEQ ID NO: 422356 - RNA, 64 nt, Human
auuacuaugaaauggauggaauaaggagggggaacacaacuagcaagaacaaaacauuggguug

SEQ ID NO: 422357 - RNA, 64 nt, Human
uaauuccuguguuuaauagcauuuauacuuuaagcacaacuagaaaauuguaagaauugcacuc

SEQ ID NO: 422358 - RNA, 64 nt, Human
aaugggguguuguucucccuuuaaucaaucugagcacaacuacauacauccaggaaucugaagu

SEQ ID NO: 422359 - RNA, 64 nt, Human
auguggcuguaucuuguuuuuccacuacugcuaccacaacuauauuaucaugcaaaugcuguau

SEQ ID NO: 422360 - RNA, 64 nt, Human
ucauggguacccagacucuaaauauuucaugauucacaacuaggaccucauaucuuccucauca

SEQ ID NO: 422361 - RNA, 64 nt, Human
ugguaccuuuuuaagaauugcauauuuuuuuagacacaacuauuaguacauuaagagggaagca

SEQ ID NO: 422362 - RNA, 64 nt, Human
cucccaaguagcuggaauuacaggugugcgccaucacaacuagcugguggucaguuuuguuacu

SEQ ID NO: 422363 - RNA, 64 nt, Human
gugaguagcuuugauuuaaaaucaaugcaaaaagcacaacuaauaaauugaauguuuccaugua

SEQ ID NO: 422364 - RNA, 64 nt, Human
uuucuauuuuaugaaaugaaguuucucuucuuaacacaacuagauguaguaauacacugguuau

SEQ ID NO: 422365 - RNA, 64 nt, Human; identical to SEQ ID NO: 376873

SEQ ID NO: 422366 - RNA, 64 nt, Human; identical to SEQ ID NO: 376874

SEQ ID NO: 422367 - RNA, 55 nt, Human; identical to SEQ ID NO: 376875

SEQ ID NO: 422368 - RNA, 64 nt, Human
uuaaaaauauugucauguuuauucuaauauccaacacaacuaucaaaauugccuuuuucucuag

SEQ ID NO: 422369 - RNA, 64 nt, Human
aaaagaugagacuaaaucuuuaucuugaauuuuacacaacuacuuacgacaagggagauguuua

SEQ ID NO: 422370 - RNA, 64 nt, Human
aaaauggagaagagcuugauauucagguacuaaccacaacuagucugacauuguuggcaguuaa

SEQ ID NO: 422371 - RNA, 64 nt, Human
uuuuaaacagauggaguuacugugaagaaguuuucacaacuauuuaugcugguaaaacaaaugc

SEQ ID NO: 422372 - RNA, 64 nt, Human
cccugguggugaguguaaagaagacuuugccucucacaacuacauguauguguggcauuuuugu

SEQ ID NO: 422373 - RNA, 64 nt, Human
acaggugcugaugggcccaagagugacaagcauacacaacuacuuauuaucuguagaaguuuug

SEQ ID NO: 422374 - RNA, 64 nt, Human
aggggauagacuagacugccacagcagcccauggcacaacuaacaccuacugauauucacauua

SEQ ID NO: 422375 - RNA, 64 nt, Human
cucuucuucuuuucuauuuuuuauaaauaucaugcacaacuauaaccuaugggaaugauguagu

SEQ ID NO: 422376 - RNA, 64 nt, Human
cauguaucauguaauaacagccuuugagacuuggcacaacuauggugcugagaaugaaaaucua

SEQ ID NO: 422377 - RNA, 64 nt, Human
ccccaccccacacccacauccucucuuuuccacacacaacuaucuguuuauuuuuuguagcagu

SEQ ID NO: 422378 - RNA, 64 nt, Human
gaguuuuuaauggccauuguguaugauuuugaugcacaacuaguuaaaagccuuucauaccagu

SEQ ID NO: 422379 - RNA, 64 nt, Human
gacuccguaugcaugaguauuugugcaacacaagcacaacuaaguauguauauacacaugacgc

SEQ ID NO: 422380 - RNA, 64 nt, Human
cccaaacuuuuuguucauguggcagggagcaguacacaacuauggaauagauuauuaaaacuga

SEQ ID NO: 422381 - RNA, 64 nt, Human
uaccuguuugaucacugcucuccaucccauguaccacaacuaucuugcugcuuaaaaggagacu

SEQ ID NO: 422382 - RNA, 64 nt, Human
uggguagcaaagcccucccagagaaaagauugggcacaacuaaggcuuuccugagcaggaaggg

SEQ ID NO: 422383 - RNA, 64 nt, Human; identical to SEQ ID NO: 376876

SEQ ID NO: 422384 - RNA, 64 nt, Human; identical to SEQ ID NO: 376877

SEQ ID NO: 422385 - RNA, 64 nt, Human; identical to SEQ ID NO: 376878

SEQ ID NO: 422386 - RNA, 64 nt, Human
ucagacuucucaguguguugggaaaaccaaaaaccacaacuacagaaauucaucuaaaaauaag

SEQ ID NO: 422387 - RNA, 64 nt, Human
gcugucaaauuucucacacuuguauauaucuacacacaacuaaguuaaaauguugaugugaguu

SEQ ID NO: 422388 - RNA, 64 nt, Human
uaugagcuuccuucugugaaaguacauuuggagacacaacuauuuuuccaaaauaauuuuaaga

SEQ ID NO: 422389 - RNA, 64 nt, Human
uugaaacuguuugaagcauuauaaacauucauuucacaacuagauuguauaaggauauuagcug

SEQ ID NO: 422390 - RNA, 64 nt, Human
uggggaguaggaggcccacucacaagcccuuggccacaacuauacuccugucccaccccaccac

SEQ ID NO: 422391 - RNA, 64 nt, Human
cccauauuuucaaccacucugauuaucuucccugcacaacuaacauccaguaauaauucuucac

SEQ ID NO: 422392 - RNA, 64 nt, Human
uguugaguguucuuuggaauugucguuuuuugagcacaacuacagcauuuuagacugcaugaaa

SEQ ID NO: 422393 - RNA, 59 nt, Human
ucuuagaguauuuuauuuagaauagagcucacaacuacuccuuuagacauguaauuguu

SEQ ID NO: 422394 - RNA, 64 nt, Human
ccauuuaugccugcaaaccuuagaccaaaggcaacacaacuaaugucaucuuuucauuaaagac

SEQ ID NO: 422395 - RNA, 64 nt, Human
guugauuuacuuuuuauuaaguucuccagagcugcacaacuaguuauguuuugauuuguuuugu

SEQ ID NO: 422396 - RNA, 64 nt, Human
uuuuagaaggaggaaaaguagauacgcaaauugucacaacuaagagugauaauuugguagcucu

SEQ ID NO: 422397 - RNA, 64 nt, Human
ugauggauauagagaaucagaggcaccuuguuuucacaacuaggauaaaaauaucugcaggguc

SEQ ID NO: 422398 - RNA, 64 nt, Human
uacauuggccuuugguuuuuuuuuuucuuucagccacaacuauaugcugauauaacucagccau

SEQ ID NO: 422399 - RNA, 64 nt, Human
ccuuuuucucuccucuccccaugauguuuagaaacacaacuauauuguuugcuaagcauuccaa

SEQ ID NO: 422400 - RNA, 64 nt, Human
ucccugacaaccccuucguccggacccucccccacacaacuaugucuggucaccagcucccucc

SEQ ID NO: 422401 - RNA, 64 nt, Human; identical to SEQ ID NO: 376879

SEQ ID NO: 422402 - RNA, 64 nt, Human; identical to SEQ ID NO: 376880

SEQ ID NO: 422403 - RNA, 64 nt, Human; identical to SEQ ID NO: 376881

SEQ ID NO: 422404 - RNA, 64 nt, Human
ugauuacuuccuucuggaagacuccccuaauuuucacaacuagaugagcucucccuuauauguu

SEQ ID NO: 422405 - RNA, 64 nt, Human
gacuuaaaauaagccaacagacucucccagaccacacaacuaguggaaugauuccuccuuuuuc

SEQ ID NO: 422406 - RNA, 64 nt, Human
caaccaguccugggggaggggagugggaaccgggcacaacuaggaacaaugccaccauucccac

SEQ ID NO: 422407 - RNA, 64 nt, Human
aauauuuaugcuucacgguccauacagucucugucacaacuauucaguucugcuaguauagcgu

SEQ ID NO: 422408 - RNA, 64 nt, Human
ugugccuaccugcuccaucuaaagcagaaaacuccacaacuaagaucucuucuaacauuuaagg

SEQ ID NO: 422409 - RNA, 64 nt, Human
ucacuugcacuuuauaaugcaucauauuuucauucacaacuaugaaaucgcugcucaaaaauga

SEQ ID NO: 422410 - RNA, 64 nt, Human
ucagaccccuguuaaucucucaguuuucugugaccacaacuauacuguggaggauacaaugcac

SEQ ID NO: 422411 - RNA, 64 nt, Human
augugaagcauugggucgggaacuagcuguagaacacaacuaaaaacucaugucuuuuuucaca

SEQ ID NO: 422412 - RNA, 64 nt, Human
cuuagagaacaguuaugaugugaccauagcauggcacaacuaaaaaucuaagccugaaaccuga

SEQ ID NO: 422413 - RNA, 64 nt, Human
ugacccacagcacccgcgccucagaagcuacggucacaacuaaaggaguccagggacuugcugc

SEQ ID NO: 422414 - RNA, 64 nt, Human
uuuuaaagauauaauaauaggauguaaacuugaccacaacuacuguuuuuuugaaauacaugau

SEQ ID NO: 422415 - RNA, 64 nt, Human
uguuuaucaacucaagaauuuaauauaguugguacacaacuaguuuuguuuauaaauuggagau

SEQ ID NO: 422416 - RNA, 64 nt, Human
gacucuugggcucugugccugagggaaaauguuucacaacuaguggcugcccaauugcugcuga

SEQ ID NO: 422417 - RNA, 64 nt, Human
accuacucuucuuguaaacucugcugcuucccaacacaacuagagugcaauuuuggcaucuuag

SEQ ID NO: 422418 - RNA, 64 nt, Human
uaauugaagucaucuacuucuaacaggacagauacacaacuauuugagguuuacaaauuacauc

SEQ ID NO: 422419 - RNA, 64 nt, Human; identical to SEQ ID NO: 376882

SEQ ID NO: 422420 - RNA, 64 nt, Human; identical to SEQ ID NO: 376883

SEQ ID NO: 422421 - RNA, 64 nt, Human; identical to SEQ ID NO: 376884

SEQ ID NO: 422422 - RNA, 64 nt, Human
uugaauguaaucaccuguguuaccacgaaugaggcacaacuauacuacauggacagaguacugc

SEQ ID NO: 422423 - RNA, 64 nt, Human
ccuguauucagacagaugaggcuuuccaugggaccacaacuauuuucagaugugaaccauuaac

SEQ ID NO: 422424 - RNA, 64 nt, Human
aaacuaugaauggcuauucuuauauaguuuagaacacaacuaauccauacuuuauuguggaagg

SEQ ID NO: 422425 - RNA, 64 nt, Human
guuuauaagguaguaucagaauuuuuuuaggauucacaacuaaucacuauagcacaugaccuug

SEQ ID NO: 422426 - RNA, 64 nt, Human
acugcacuugggcagggaauauagccuuccugggcacaacuagcugacaaugacagguugacug

SEQ ID NO: 422427 - RNA, 64 nt, Human
uaauggcgaaucacgaugaccuuguagacaugcacacaacuauaccuuuguccaacagaucaua

SEQ ID NO: 422428 - RNA, 64 nt, Human
cuuucagguggaauaaagucacaugaaaacaaaacacaacuauauauauuuucaguuuuuuugc

SEQ ID NO: 422429 - RNA, 64 nt, Human
auuuagcaccaauugcauuaacgcacaucucuuccacaacuaacagacuuaaaauaacaguguc

SEQ ID NO: 422430 - RNA, 64 nt, Human
gagauggaaucagcuugagucuucugcaauuggucacaacuauucaugcuuccugugauuucau

SEQ ID NO: 422431 - RNA, 64 nt, Human
ccagcagggcuggaagcacuagaugcagcaugagcacaacuauucggcuuuccuucccuauugu

SEQ ID NO: 422432 - RNA, 64 nt, Human
ugugcucaucaagaacaauaucgacuuccccggccacaacuacaccacguaagugcccaggcug

SEQ ID NO: 422433 - RNA, 64 nt, Human
ucucucaccacaccuucugggccucauuaucucccacaacuagaccgccaugccucaccaaccu

SEQ ID NO: 422434 - RNA, 64 nt, Human
agugauggaagccuugcuuucacaucagcaggggcacaacuaaugagauuuucucucauuccga

SEQ ID NO: 422435 - RNA, 64 nt, Human
acaauucuagaaguuggugucucucuucaauuuccacaacuaugacaaccugaggcacugugcu

SEQ ID NO: 422436 - RNA, 64 nt, Human
gaaaaugagaaaagagcagaagcacuugaagcaacacaacuauaucuaagauugcuguugcuga

SEQ ID NO: 422437 - RNA, 64 nt, Human; identical to SEQ ID NO: 376885

SEQ ID NO: 422438 - RNA, 62 nt, Human; identical to SEQ ID NO: 376886

SEQ ID NO: 422439 - RNA, 64 nt, Human; identical to SEQ ID NO: 376887

SEQ ID NO: 422440 - RNA, 64 nt, Human
cuguagcuuuaaugcauacaaacaugucccuccgcacaacuaaccugcccugccucuccaucuc

SEQ ID NO: 422441 - RNA, 64 nt, Human
ugcauccuucucauucugucggaaaugaaauucacacaacuauaccuuuuggggagguuccagu

SEQ ID NO: 422442 - RNA, 64 nt, Human
uaaaaacaacaaaaacaaacaaaagcaagaaaaccacaacuaaaacuggaaauguauauuuugu

SEQ ID NO: 422443 - RNA, 64 nt, Human
uguuucaugauuuugauuuuuaaaauuauuagcacacaacuauuuucagcccuuuaauaaugga

SEQ ID NO: 422444 - RNA, 64 nt, Human
caucuaucccuuuauuuugacacuaaaacauggacacaacuagaaagagguacaaugcaauaua

SEQ ID NO: 422445 - RNA, 64 nt, Human
uacauuguguuauuuauacuagcaaaaaaauagacacaacuaaauguucgaccauaugguauug

SEQ ID NO: 422446 - RNA, 64 nt, Human
cucccaaagugcugggauuacaggcaugaaucaccacaacuagccuacccuuagauuuuuggaa

SEQ ID NO: 422447 - RNA, 64 nt, Human
uuaaggagcggcgggggcggggcauggggggugucacaacuaauguggccacugcuucauucuc

SEQ ID NO: 422448 - RNA, 64 nt, Human
caacaaugauaaaacuuggccuugaagaaauuuacacaacuaguuagaacuuguuacuauugua

SEQ ID NO: 422449 - RNA, 64 nt, Human
aaaacaaaacaaaaaaaauuagccuacuuaaaggcacaacuaaaugcuuuauuaccuuucuuac

SEQ ID NO: 422450 - RNA, 64 nt, Human
uuuuauaaaauuguacaguuuuuuaaaaacuacucacaacuagcagauggcuuaaauguagcaa

SEQ ID NO: 422451 - RNA, 64 nt, Human
acugcaaauugaguuucuuucucuuuaggccuuucacaacuaggacugagaauguauguaaaag

SEQ ID NO: 422452 - RNA, 64 nt, Human
cuggaaaaucuugucuuuuagaaaagaaauuaaucacaacuaucucucuugccuaaaagauaaa

SEQ ID NO: 422453 - RNA, 64 nt, Human
auuguauuuuccacuagcagugaaaaugauuuuucacaacuaacuuguaaauauauuuuaauca

SEQ ID NO: 422454 - RNA, 64 nt, Human
uuacagaaacccacucggcaccccagucuaacaccacaacuaauuucacccaagguuuuaagca

SEQ ID NO: 422455 - RNA, 64 nt, Human; identical to SEQ ID NO: 376888

SEQ ID NO: 422456 - RNA, 64 nt, Human; identical to SEQ ID NO: 376889

SEQ ID NO: 422457 - RNA, 64 nt, Human; identical to SEQ ID NO: 376890

SEQ ID NO: 422458 - RNA, 64 nt, Human
ccuggagaaggggucggggguggggguaaaguagcacaacuacuauuuuuuuucuuuuuccauu

SEQ ID NO: 422459 - RNA, 61 nt, Human
cacaacuuacccuguuaagucaaaauuuauuuuccaggaauuuaauauguacuuuaguugg

SEQ ID NO: 422460 - RNA, 61 nt, Human
gaacucgugcaagacaaaacugaaacccucuuuccaggaccucaguaggcaccguugaggu

SEQ ID NO: 422461 - RNA, 61 nt, Human
acauuuuaugcugaucuucaguucauaauucuuccaggaaaacucagucuuccaacugcaa

SEQ ID NO: 422462 - RNA, 61 nt, Human
uuuugauuucuugcucauuuucagaauaacuuuccaggaagagauggcauuuagaacuuca

SEQ ID NO: 422463 - RNA, 61 nt, Human
ccuuggcauagagcacccaggcaucgaccucuuccaggagaacugauucuguggauggaug

SEQ ID NO: 422464 - RNA, 61 nt, Human
cagguuaugcaagucgccaggcaggaggccauuccaggagugggauuauucaucaaacucu

SEQ ID NO: 422465 - RNA, 61 nt, Human
gucucuuguagaagauggacucugaaaaacauuccaggaaaccauggcagcauggagagcc

SEQ ID NO: 422466 - RNA, 61 nt, Human
cuucugaaaccucugggucaucucucacacauuccaggaccagaagcauuucaccuuuucc

SEQ ID NO: 422467 - RNA, 61 nt, Human
agagcauuuccaugaaacaacacaugcagcauuccaggaacuugauuguuaaauucaauaa

SEQ ID NO: 422468 - RNA, 61 nt, Human
cuucuguuuguaaggaugauuuuaauauuaauuccaggaacacauguuuuuauuuccucug

SEQ ID NO: 422469 - RNA, 61 nt, Human
uuguccugguggccuucagugucucuuccaguuccaggagcugcugggaagcuggccuuca

SEQ ID NO: 422470 - RNA, 61 nt, Human
uggcuggcugguccugaggccacccaccuuguuccaggacaugggcccgggcccggugugg

SEQ ID NO: 422471 - RNA, 61 nt, Human
uccugucccuuccuccgucacagcauggucauuccaggauauggggacaaaccacuccuuc

SEQ ID NO: 422472 - RNA, 61 nt, Human
agaugacuuugcuucugugcacagccccgucuuccaggagccacaacucagaagaaaaggg

SEQ ID NO: 422473 - RNA, 61 nt, Human
ggucucuguacgggccaguuucucugccuucuuccaggaucagggguuagggugcaagaag

SEQ ID NO: 422474 - RNA, 61 nt, Human
gcucuucaccagaagcuuugaugauggccugggcuuugaauacgugauguucuacaaugac

SEQ ID NO: 422475 - RNA, 61 nt, Human
auaaguuaacaagucuauaucaggugcagcuggcuuugauuaaaggccauuuuuaaaacuu

SEQ ID NO: 422476 - RNA, 61 nt, Human
cgccucaccuuucacagaccagaccggcacaggcuuugagcucauuauaaccacacuccuu

SEQ ID NO: 422477 - RNA, 64 nt, Human
agagccauacucugaugaaacauuaaaacucggucacaacuaagugaucccaagcucaagggug

SEQ ID NO: 422478 - RNA, 64 nt, Human
ccuuuucugaucaaacauaccauuuuuuauauuucacaacuauagacagucacuucugcagucc

SEQ ID NO: 422479 - RNA, 64 nt, Human
cuagagcagcguagacagcugguaaacugaagagcacaacuauauucuuaugaaggaauuugua

SEQ ID NO: 422480 - RNA, 64 nt, Human
auuuuaaagucugccaagacaauaauacaaguaacacaacuaagccuuucuuuaaauaauaaaa

SEQ ID NO: 422481 - RNA, 64 nt, Human
ucaugcugcuaagaugcacaaccgcacacccauacacaacuacaagggccacaaagcaacugcu

SEQ ID NO: 422482 - RNA, 64 nt, Human
uuuuugaacgugggaaucccuuuugcuucaugcucacaacuaagcauaggaaguuuuauuuaaa

SEQ ID NO: 422483 - RNA, 64 nt, Human
cuaagaggugaagugauuuuuuuucugaaacucacacaacuaggaaguggcugagucaggacuu

SEQ ID NO: 422484 - RNA, 64 nt, Human
gaaaagauguacaauccugcauccuugcuuauuucacaacuaaagcuuugucauagacuucaaa

SEQ ID NO: 422485 - RNA, 64 nt, Human
guauaaacuauguauauauaagaaccauauuuuccacaacuaaaaugugcauuauuuuuuccaa

SEQ ID NO: 422486 - RNA, 64 nt, Human
uaaucgucaaccacuuuuaaacauaaagaauucacacaacuacuuucaugaauuuuuuaauccc

SEQ ID NO: 422487 - RNA, 64 nt, Human
aaucguauuucacuguguuuucaauuuauauuuucacaacuacuuucucucuccagagcuuuca

SEQ ID NO: 422488 - RNA, 64 nt, Human
cuaaauuacagaauuggaauuugugaaaagauugcacaacuauauuauugauaaacccauuccg

SEQ ID NO: 422489 - RNA, 64 nt, Human
ucuuccuucaaauccugccacuguuuuguuggcccacaacuaauaggaccucaaaauaagccau

SEQ ID NO: 422490 - RNA, 64 nt, Human
ugugacuaauuccuuaccucucccaaggaggguacacaacuagcaccauucuugauguccaggg

SEQ ID NO: 422491 - RNA, 57 nt, Human
ggcagcccagaaguaucugacuguagacacaacuaggcuccgugggcauaucugggu

SEQ ID NO: 422492 - RNA, 61 nt, Human
ucaagugaucuauuaucuagcugcaaagccuggcuuugauuugaaauuuuguaaaaauuuc

SEQ ID NO: 422493 - RNA, 61 nt, Human
ugugucagauuuggaacuaaacaggcaaggaggcuuugagucacaucguuuucauuuuaaa

SEQ ID NO: 422494 - RNA, 61 nt, Human
uguguuuuccuuguuaacuaaaacagacaugggcuuugauuuuuuucauacuauuagacca

SEQ ID NO: 422495 - RNA, 64 nt, Human
caucuuggcucccagagcucuaggaacucuucaucacaacuagauuugccucuucuaagugucu

SEQ ID NO: 422496 - RNA, 64 nt, Human
ccuacagacagcuuacaggagccagccugcuucccacaacuacuagugugacuccuuaucucuu

SEQ ID NO: 422497 - RNA, 64 nt, Human
aucugucugaaacuuguacagcuaguuccugucccacaacuauuaagugguuuauuaaguacau

SEQ ID NO: 422498 - RNA, 64 nt, Human
aaggagaccaagaaaaaccccccacgaaaucagccacaacuaaaucgcucuggacggugccgcc

SEQ ID NO: 422499 - RNA, 64 nt, Human
uauuaagacaacuuugccaaaaaaguccccuaagcacaacuauuuacauuucuuuauagccucu

SEQ ID NO: 422500 - RNA, 64 nt, Human
auugacaagagggcuuuaaacaagugaauaauugcacaacuaaaaagacauuagaacugugugg

SEQ ID NO: 422501 - RNA, 64 nt, Human; identical to SEQ ID NO: 376851

SEQ ID NO: 422502 - RNA, 64 nt, Human; identical to SEQ ID NO: 376852

SEQ ID NO: 422503 - RNA, 64 nt, Human; identical to SEQ ID NO: 376853

SEQ ID NO: 422504 - RNA, 64 nt, Human; identical to SEQ ID NO: 376854

SEQ ID NO: 422505 - RNA, 64 nt, Human; identical to SEQ ID NO: 376855

SEQ ID NO: 422506 - RNA, 64 nt, Human; identical to SEQ ID NO: 376856

SEQ ID NO: 422507 - RNA, 64 nt, Human; identical to SEQ ID NO: 376857

SEQ ID NO: 422508 - RNA, 64 nt, Human; identical to SEQ ID NO: 376858

SEQ ID NO: 422509 - RNA, 64 nt, Human; identical to SEQ ID NO: 376859

SEQ ID NO: 422510 - RNA, 64 nt, Human; identical to SEQ ID NO: 376860

SEQ ID NO: 422511 - RNA, 64 nt, Human; identical to SEQ ID NO: 376861

SEQ ID NO: 422512 - RNA, 64 nt, Human; identical to SEQ ID NO: 376891

SEQ ID NO: 422513 - RNA, 64 nt, Human; identical to SEQ ID NO: 376892

SEQ ID NO: 422514 - RNA, 64 nt, Human; identical to SEQ ID NO: 376893

SEQ ID NO: 422515 - RNA, 64 nt, Human; identical to SEQ ID NO: 376894

SEQ ID NO: 422516 - RNA, 50 nt, Human; identical to SEQ ID NO: 376895

SEQ ID NO: 422517 - RNA, 64 nt, Human; identical to SEQ ID NO: 376896

SEQ ID NO: 422518 - RNA, 64 nt, Human; identical to SEQ ID NO: 376897

SEQ ID NO: 422519 - RNA, 64 nt, Human; identical to SEQ ID NO: 376898

SEQ ID NO: 422520 - RNA, 64 nt, Human; identical to SEQ ID NO: 376899

SEQ ID NO: 422521 - RNA, 64 nt, Human; identical to SEQ ID NO: 376900

SEQ ID NO: 422522 - RNA, 64 nt, Human; identical to SEQ ID NO: 376901

SEQ ID NO: 422523 - RNA, 64 nt, Human; identical to SEQ ID NO: 376902

SEQ ID NO: 422524 - RNA, 64 nt, Human; identical to SEQ ID NO: 376903

SEQ ID NO: 422525 - RNA, 64 nt, Human; identical to SEQ ID NO: 376904

SEQ ID NO: 422526 - RNA, 64 nt, Human; identical to SEQ ID NO: 376905

SEQ ID NO: 422527 - RNA, 64 nt, Human; identical to SEQ ID NO: 376906

SEQ ID NO: 422528 - RNA, 64 nt, Human; identical to SEQ ID NO: 376907

SEQ ID NO: 422529 - RNA, 64 nt, Human; identical to SEQ ID NO: 376908

SEQ ID NO: 422530 - RNA, 64 nt, Human; identical to SEQ ID NO: 376909

SEQ ID NO: 422531 - RNA, 64 nt, Human; identical to SEQ ID NO: 376910

SEQ ID NO: 422532 - RNA, 64 nt, Human; identical to SEQ ID NO: 376911

SEQ ID NO: 422533 - RNA, 64 nt, Human; identical to SEQ ID NO: 376912

SEQ ID NO: 422534 - RNA, 64 nt, Human; identical to SEQ ID NO: 376913

SEQ ID NO: 422535 - RNA, 104 nt, Human
uuuuuuuugucguguaagaauuuuuuuugucguguaagaaggaugcuggucagagcugcagaaaauaugaggcaauuaaaagucauaugaggcaauuaaaaguc

SEQ ID NO: 422536 - RNA, 104 nt, Human
uuggaaaggaguagaacauguuggaaaggaguagaacaugcagcauaagaaacugcugcagaguggugcgaggaguacauuuucggugcgaggaguacauuuuc

SEQ ID NO: 422537 - RNA, 104 nt, Human
cccgacucacucagaccccacccgacucacucagaccccaaggcccacuguccagcugcagaaauucguugccaaagauuggacuucguugccaaagauuggac

SEQ ID NO: 422538 - RNA, 104 nt, Human
gcuauaccccacugcugcccgcuauaccccacugcugcccgacacugcccuuuagcugcagagcuggauuagcuguugaccauuuggauuagcuguugaccauu

SEQ ID NO: 422539 - RNA, 104 nt, Human
aguucgaacguggucuugacaguucgaacguggucuugaccgucagcacaucccgcugcagagggcauucccuuuaaggcuugagcauucccuuuaaggcuuga

SEQ ID NO: 422540 - RNA, 104 nt, Human
cgagcucggcaccuccccggcgagcucggcaccuccccggccucucucuucccagcugcagaugccacaccugcuccuucuugcccacaccugcuccuucuugc

SEQ ID NO: 422541 - RNA, 104 nt, Human
caggcagaguggagccuccucaggcagaguggagccuccugcucuccuggaccagcugcagacccccaacccugguuucugugccccaacccugguuucugugc

SEQ ID NO: 422542 - RNA, 104 nt, Human
gaugugugaaaaucuuuuccgaugugugaaaaucuuuuccagggaaauggguucgcugcagagguaaggauguguuccuguaucuaaggauguguuccuguauc

SEQ ID NO: 422543 - RNA, 104 nt, Human
gugcugugcugcugcuggucgugcugugcugcugcuggucuccugauggcuguugcugcagaagauguccucguagacugucauauguccucguagacugucau

SEQ ID NO: 422544 - RNA, 104 nt, Human
ugagaugaugcaugaugcccugagaugaugcaugaugcccuccccucagcgcaggcugcagagcccggccccaccucccugcgcccggccccaccucccugcgc

SEQ ID NO: 422545 - RNA, 104 nt, Human
cccgcagacaccuuggacaucccgcagacaccuuggacauccuccucccacccggcugcagaggccagaggcccccagcccaggccagaggcccccagcccagg

SEQ ID NO: 422546 - RNA, 64 nt, Human; identical to SEQ ID NO: 376925

SEQ ID NO: 422547 - RNA, 64 nt, Human; identical to SEQ ID NO: 376926

SEQ ID NO: 422548 - RNA, 64 nt, Human; identical to SEQ ID NO: 376927

SEQ ID NO: 422549 - RNA, 55 nt, Human; identical to SEQ ID NO: 376928

SEQ ID NO: 422550 - RNA, 64 nt, Human; identical to SEQ ID NO: 376929

SEQ ID NO: 422551 - RNA, 64 nt, Human; identical to SEQ ID NO: 376930

SEQ ID NO: 422552 - RNA, 64 nt, Human; identical to SEQ ID NO: 376931

SEQ ID NO: 422553 - RNA, 64 nt, Human; identical to SEQ ID NO: 376932

SEQ ID NO: 422554 - RNA, 64 nt, Human; identical to SEQ ID NO: 376933

SEQ ID NO: 422555 - RNA, 64 nt, Human; identical to SEQ ID NO: 376934

SEQ ID NO: 422556 - RNA, 64 nt, Human; identical to SEQ ID NO: 376935

SEQ ID NO: 422557 - RNA, 64 nt, Human; identical to SEQ ID NO: 376936

SEQ ID NO: 422558 - RNA, 64 nt, Human; identical to SEQ ID NO: 376937

SEQ ID NO: 422559 - RNA, 64 nt, Human; identical to SEQ ID NO: 376938

SEQ ID NO: 422560 - RNA, 64 nt, Human; identical to SEQ ID NO: 376939

SEQ ID NO: 422561 - RNA, 64 nt, Human; identical to SEQ ID NO: 376940

SEQ ID NO: 422562 - RNA, 64 nt, Human; identical to SEQ ID NO: 376941

SEQ ID NO: 422563 - RNA, 64 nt, Human; identical to SEQ ID NO: 376942

SEQ ID NO: 422564 - RNA, 64 nt, Human; identical to SEQ ID NO: 376943

SEQ ID NO: 422565 - RNA, 64 nt, Human; identical to SEQ ID NO: 376944

SEQ ID NO: 422566 - RNA, 64 nt, Human; identical to SEQ ID NO: 376945

SEQ ID NO: 422567 - RNA, 64 nt, Human; identical to SEQ ID NO: 376946

SEQ ID NO: 422568 - RNA, 64 nt, Human; identical to SEQ ID NO: 376947

SEQ ID NO: 422569 - RNA, 64 nt, Human; identical to SEQ ID NO: 376948

SEQ ID NO: 422570 - RNA, 64 nt, Human; identical to SEQ ID NO: 376949

SEQ ID NO: 422571 - RNA, 64 nt, Human; identical to SEQ ID NO: 376950

SEQ ID NO: 422572 - RNA, 64 nt, Human; identical to SEQ ID NO: 376951

SEQ ID NO: 422573 - RNA, 64 nt, Human; identical to SEQ ID NO: 376952

SEQ ID NO: 422574 - RNA, 64 nt, Human; identical to SEQ ID NO: 376953

SEQ ID NO: 422575 - RNA, 64 nt, Human; identical to SEQ ID NO: 376954

SEQ ID NO: 422576 - RNA, 64 nt, Human; identical to SEQ ID NO: 376955

SEQ ID NO: 422577 - RNA, 64 nt, Human; identical to SEQ ID NO: 376956

SEQ ID NO: 422578 - RNA, 64 nt, Human; identical to SEQ ID NO: 376957

SEQ ID NO: 422579 - RNA, 64 nt, Human; identical to SEQ ID NO: 376958

SEQ ID NO: 422580 - RNA, 64 nt, Human; identical to SEQ ID NO: 376959

SEQ ID NO: 422581 - RNA, 64 nt, Human; identical to SEQ ID NO: 376960

SEQ ID NO: 422582 - RNA, 64 nt, Human; identical to SEQ ID NO: 376961

SEQ ID NO: 422583 - RNA, 64 nt, Human; identical to SEQ ID NO: 376962

SEQ ID NO: 422584 - RNA, 64 nt, Human; identical to SEQ ID NO: 376963

SEQ ID NO: 422585 - RNA, 64 nt, Human; identical to SEQ ID NO: 376964

SEQ ID NO: 422586 - RNA, 64 nt, Human; identical to SEQ ID NO: 376965

SEQ ID NO: 422587 - RNA, 64 nt, Human; identical to SEQ ID NO: 376966

SEQ ID NO: 422588 - RNA, 64 nt, Human; identical to SEQ ID NO: 376967

SEQ ID NO: 422589 - RNA, 64 nt, Human; identical to SEQ ID NO: 376968

SEQ ID NO: 422590 - RNA, 64 nt, Human; identical to SEQ ID NO: 376969

SEQ ID NO: 422591 - RNA, 64 nt, Human; identical to SEQ ID NO: 376970

SEQ ID NO: 422592 - RNA, 64 nt, Human; identical to SEQ ID NO: 376971

SEQ ID NO: 422593 - RNA, 64 nt, Human; identical to SEQ ID NO: 376972

SEQ ID NO: 422594 - RNA, 64 nt, Human; identical to SEQ ID NO: 376973

SEQ ID NO: 422595 - RNA, 64 nt, Human; identical to SEQ ID NO: 376974

SEQ ID NO: 422596 - RNA, 64 nt, Human; identical to SEQ ID NO: 376975

SEQ ID NO: 422597 - RNA, 64 nt, Human; identical to SEQ ID NO: 376976

SEQ ID NO: 422598 - RNA, 64 nt, Human; identical to SEQ ID NO: 376977

SEQ ID NO: 422599 - RNA, 64 nt, Human; identical to SEQ ID NO: 376978

SEQ ID NO: 422600 - RNA, 64 nt, Human; identical to SEQ ID NO: 376979

SEQ ID NO: 422601 - RNA, 64 nt, Human; identical to SEQ ID NO: 376980

SEQ ID NO: 422602 - RNA, 64 nt, Human; identical to SEQ ID NO: 376981

SEQ ID NO: 422603 - RNA, 64 nt, Human; identical to SEQ ID NO: 376982

SEQ ID NO: 422604 - RNA, 64 nt, Human; identical to SEQ ID NO: 376983

SEQ ID NO: 422605 - RNA, 64 nt, Human; identical to SEQ ID NO: 376984

SEQ ID NO: 422606 - RNA, 64 nt, Human; identical to SEQ ID NO: 376985

SEQ ID NO: 422607 - RNA, 64 nt, Human; identical to SEQ ID NO: 376986

SEQ ID NO: 422608 - RNA, 64 nt, Human; identical to SEQ ID NO: 376987

SEQ ID NO: 422609 - RNA, 64 nt, Human; identical to SEQ ID NO: 376988

SEQ ID NO: 422610 - RNA, 64 nt, Human; identical to SEQ ID NO: 376989

SEQ ID NO: 422611 - RNA, 64 nt, Human; identical to SEQ ID NO: 376990

SEQ ID NO: 422612 - RNA, 64 nt, Human; identical to SEQ ID NO: 376991

SEQ ID NO: 422613 - RNA, 64 nt, Human; identical to SEQ ID NO: 376992

SEQ ID NO: 422614 - RNA, 64 nt, Human; identical to SEQ ID NO: 376993

SEQ ID NO: 422615 - RNA, 64 nt, Human; identical to SEQ ID NO: 376994

SEQ ID NO: 422616 - RNA, 64 nt, Human; identical to SEQ ID NO: 376995

SEQ ID NO: 422617 - RNA, 64 nt, Human; identical to SEQ ID NO: 376996

SEQ ID NO: 422618 - RNA, 64 nt, Human; identical to SEQ ID NO: 376997

SEQ ID NO: 422619 - RNA, 64 nt, Human; identical to SEQ ID NO: 376998

SEQ ID NO: 422620 - RNA, 64 nt, Human; identical to SEQ ID NO: 376999

SEQ ID NO: 422621 - RNA, 64 nt, Human; identical to SEQ ID NO: 377000

SEQ ID NO: 422622 - RNA, 64 nt, Human; identical to SEQ ID NO: 377001

SEQ ID NO: 422623 - RNA, 64 nt, Human; identical to SEQ ID NO: 377002

SEQ ID NO: 422624 - RNA, 64 nt, Human; identical to SEQ ID NO: 377003

SEQ ID NO: 422625 - RNA, 64 nt, Human; identical to SEQ ID NO: 377004

SEQ ID NO: 422626 - RNA, 64 nt, Human; identical to SEQ ID NO: 377005

SEQ ID NO: 422627 - RNA, 64 nt, Human; identical to SEQ ID NO: 377006

SEQ ID NO: 422628 - RNA, 64 nt, Human; identical to SEQ ID NO: 377007

SEQ ID NO: 422629 - RNA, 64 nt, Human; identical to SEQ ID NO: 377008

SEQ ID NO: 422630 - RNA, 64 nt, Human; identical to SEQ ID NO: 377009

SEQ ID NO: 422631 - RNA, 64 nt, Human; identical to SEQ ID NO: 377010

SEQ ID NO: 422632 - RNA, 64 nt, Human; identical to SEQ ID NO: 377011

SEQ ID NO: 422633 - RNA, 64 nt, Human; identical to SEQ ID NO: 377012

SEQ ID NO: 422634 - RNA, 64 nt, Human; identical to SEQ ID NO: 377013

SEQ ID NO: 422635 - RNA, 64 nt, Human; identical to SEQ ID NO: 377014

SEQ ID NO: 422636 - RNA, 64 nt, Human; identical to SEQ ID NO: 377015

SEQ ID NO: 422637 - RNA, 64 nt, Human; identical to SEQ ID NO: 377016

SEQ ID NO: 422638 - RNA, 64 nt, Human; identical to SEQ ID NO: 377017

SEQ ID NO: 422639 - RNA, 64 nt, Human; identical to SEQ ID NO: 377018

SEQ ID NO: 422640 - RNA, 64 nt, Human; identical to SEQ ID NO: 377019

SEQ ID NO: 422641 - RNA, 64 nt, Human; identical to SEQ ID NO: 377020

SEQ ID NO: 422642 - RNA, 64 nt, Human; identical to SEQ ID NO: 377021

SEQ ID NO: 422643 - RNA, 64 nt, Human; identical to SEQ ID NO: 377022

SEQ ID NO: 422644 - RNA, 64 nt, Human; identical to SEQ ID NO: 377023

SEQ ID NO: 422645 - RNA, 64 nt, Human; identical to SEQ ID NO: 377024

SEQ ID NO: 422646 - RNA, 64 nt, Human; identical to SEQ ID NO: 377025

SEQ ID NO: 422647 - RNA, 64 nt, Human; identical to SEQ ID NO: 377026

SEQ ID NO: 422648 - RNA, 64 nt, Human; identical to SEQ ID NO: 377027

SEQ ID NO: 422649 - RNA, 62 nt, Human; identical to SEQ ID NO: 377028

SEQ ID NO: 422650 - RNA, 64 nt, Human; identical to SEQ ID NO: 377029

SEQ ID NO: 422651 - RNA, 64 nt, Human; identical to SEQ ID NO: 377030

SEQ ID NO: 422652 - RNA, 64 nt, Human; identical to SEQ ID NO: 377031

SEQ ID NO: 422653 - RNA, 64 nt, Human; identical to SEQ ID NO: 377032

SEQ ID NO: 422654 - RNA, 64 nt, Human; identical to SEQ ID NO: 377033

SEQ ID NO: 422655 - RNA, 64 nt, Human; identical to SEQ ID NO: 377034

SEQ ID NO: 422656 - RNA, 64 nt, Human; identical to SEQ ID NO: 377035

SEQ ID NO: 422657 - RNA, 64 nt, Human; identical to SEQ ID NO: 377036

SEQ ID NO: 422658 - RNA, 54 nt, Human; identical to SEQ ID NO: 377037

SEQ ID NO: 422659 - RNA, 64 nt, Human; identical to SEQ ID NO: 377038

SEQ ID NO: 422660 - RNA, 64 nt, Human; identical to SEQ ID NO: 377039

SEQ ID NO: 422661 - RNA, 64 nt, Human; identical to SEQ ID NO: 377040

SEQ ID NO: 422662 - RNA, 64 nt, Human; identical to SEQ ID NO: 377041

SEQ ID NO: 422663 - RNA, 64 nt, Human; identical to SEQ ID NO: 377042

SEQ ID NO: 422664 - RNA, 64 nt, Human; identical to SEQ ID NO: 377043

SEQ ID NO: 422665 - RNA, 64 nt, Human; identical to SEQ ID NO: 377044

SEQ ID NO: 422666 - RNA, 64 nt, Human; identical to SEQ ID NO: 377045

SEQ ID NO: 422667 - RNA, 64 nt, Human; identical to SEQ ID NO: 377046

SEQ ID NO: 422668 - RNA, 64 nt, Human; identical to SEQ ID NO: 377047

SEQ ID NO: 422669 - RNA, 64 nt, Human; identical to SEQ ID NO: 377048

SEQ ID NO: 422670 - RNA, 64 nt, Human; identical to SEQ ID NO: 377049

SEQ ID NO: 422671 - RNA, 64 nt, Human; identical to SEQ ID NO: 377050

SEQ ID NO: 422672 - RNA, 64 nt, Human; identical to SEQ ID NO: 377051

SEQ ID NO: 422673 - RNA, 64 nt, Human; identical to SEQ ID NO: 377052

SEQ ID NO: 422674 - RNA, 64 nt, Human; identical to SEQ ID NO: 377053

SEQ ID NO: 422675 - RNA, 64 nt, Human; identical to SEQ ID NO: 377054

SEQ ID NO: 422676 - RNA, 64 nt, Human; identical to SEQ ID NO: 377055

SEQ ID NO: 422677 - RNA, 64 nt, Human; identical to SEQ ID NO: 377056

SEQ ID NO: 422678 - RNA, 64 nt, Human; identical to SEQ ID NO: 377057

SEQ ID NO: 422679 - RNA, 64 nt, Human; identical to SEQ ID NO: 377058

SEQ ID NO: 422680 - RNA, 64 nt, Human; identical to SEQ ID NO: 377059

SEQ ID NO: 422681 - RNA, 64 nt, Human; identical to SEQ ID NO: 377060

SEQ ID NO: 422682 - RNA, 64 nt, Human; identical to SEQ ID NO: 377061

SEQ ID NO: 422683 - RNA, 64 nt, Human; identical to SEQ ID NO: 377062

SEQ ID NO: 422684 - RNA, 64 nt, Human; identical to SEQ ID NO: 377063

SEQ ID NO: 422685 - RNA, 64 nt, Human; identical to SEQ ID NO: 377064

SEQ ID NO: 422686 - RNA, 64 nt, Human; identical to SEQ ID NO: 377065

SEQ ID NO: 422687 - RNA, 64 nt, Human; identical to SEQ ID NO: 377066

SEQ ID NO: 422688 - RNA, 64 nt, Human; identical to SEQ ID NO: 377067

SEQ ID NO: 422689 - RNA, 64 nt, Human; identical to SEQ ID NO: 377068

SEQ ID NO: 422690 - RNA, 64 nt, Human; identical to SEQ ID NO: 377069

SEQ ID NO: 422691 - RNA, 64 nt, Human; identical to SEQ ID NO: 377070

SEQ ID NO: 422692 - RNA, 64 nt, Human; identical to SEQ ID NO: 377071

SEQ ID NO: 422693 - RNA, 60 nt, Human; identical to SEQ ID NO: 377072

SEQ ID NO: 422694 - RNA, 64 nt, Human; identical to SEQ ID NO: 377073

SEQ ID NO: 422695 - RNA, 64 nt, Human; identical to SEQ ID NO: 377074

SEQ ID NO: 422696 - RNA, 64 nt, Human; identical to SEQ ID NO: 377075

SEQ ID NO: 422697 - RNA, 64 nt, Human; identical to SEQ ID NO: 377076

SEQ ID NO: 422698 - RNA, 64 nt, Human; identical to SEQ ID NO: 377077

SEQ ID NO: 422699 - RNA, 58 nt, Human; identical to SEQ ID NO: 377078

SEQ ID NO: 422700 - RNA, 64 nt, Human; identical to SEQ ID NO: 377079

SEQ ID NO: 422701 - RNA, 64 nt, Human; identical to SEQ ID NO: 377080

SEQ ID NO: 422702 - RNA, 64 nt, Human; identical to SEQ ID NO: 377081

SEQ ID NO: 422703 - RNA, 64 nt, Human; identical to SEQ ID NO: 377082

SEQ ID NO: 422704 - RNA, 64 nt, Human; identical to SEQ ID NO: 377083

SEQ ID NO: 422705 - RNA, 64 nt, Human; identical to SEQ ID NO: 377084

SEQ ID NO: 422706 - RNA, 64 nt, Human; identical to SEQ ID NO: 377085

SEQ ID NO: 422707 - RNA, 64 nt, Human; identical to SEQ ID NO: 377086

SEQ ID NO: 422708 - RNA, 64 nt, Human; identical to SEQ ID NO: 377087

SEQ ID NO: 422709 - RNA, 64 nt, Human; identical to SEQ ID NO: 377088

SEQ ID NO: 422710 - RNA, 64 nt, Human; identical to SEQ ID NO: 377089

SEQ ID NO: 422711 - RNA, 64 nt, Human; identical to SEQ ID NO: 377090

SEQ ID NO: 422712 - RNA, 64 nt, Human; identical to SEQ ID NO: 377091

SEQ ID NO: 422713 - RNA, 64 nt, Human; identical to SEQ ID NO: 377092

SEQ ID NO: 422714 - RNA, 64 nt, Human; identical to SEQ ID NO: 377016

SEQ ID NO: 422715 - RNA, 64 nt, Human; identical to SEQ ID NO: 377094

SEQ ID NO: 422716 - RNA, 64 nt, Human; identical to SEQ ID NO: 377095

SEQ ID NO: 422717 - RNA, 58 nt, Human; identical to SEQ ID NO: 377096

SEQ ID NO: 422718 - RNA, 64 nt, Human; identical to SEQ ID NO: 377097

SEQ ID NO: 422719 - RNA, 64 nt, Human; identical to SEQ ID NO: 377098

SEQ ID NO: 422720 - RNA, 64 nt, Human; identical to SEQ ID NO: 377099

SEQ ID NO: 422721 - RNA, 64 nt, Human; identical to SEQ ID NO: 377100

SEQ ID NO: 422722 - RNA, 64 nt, Human; identical to SEQ ID NO: 377101

SEQ ID NO: 422723 - RNA, 64 nt, Human; identical to SEQ ID NO: 377102

SEQ ID NO: 422724 - RNA, 64 nt, Human; identical to SEQ ID NO: 377103

SEQ ID NO: 422725 - RNA, 64 nt, Human; identical to SEQ ID NO: 377104

SEQ ID NO: 422726 - RNA, 64 nt, Human; identical to SEQ ID NO: 377105

SEQ ID NO: 422727 - RNA, 64 nt, Human; identical to SEQ ID NO: 377106

SEQ ID NO: 422728 - RNA, 64 nt, Human; identical to SEQ ID NO: 377107

SEQ ID NO: 422729 - RNA, 64 nt, Human; identical to SEQ ID NO: 377108

SEQ ID NO: 422730 - RNA, 64 nt, Human; identical to SEQ ID NO: 377109

SEQ ID NO: 422731 - RNA, 64 nt, Human; identical to SEQ ID NO: 377110

SEQ ID NO: 422732 - RNA, 64 nt, Human; identical to SEQ ID NO: 377111

SEQ ID NO: 422733 - RNA, 64 nt, Human; identical to SEQ ID NO: 377112

SEQ ID NO: 422734 - RNA, 64 nt, Human; identical to SEQ ID NO: 377113

SEQ ID NO: 422735 - RNA, 64 nt, Human; identical to SEQ ID NO: 377114

SEQ ID NO: 422736 - RNA, 64 nt, Human; identical to SEQ ID NO: 377115

SEQ ID NO: 422737 - RNA, 64 nt, Human; identical to SEQ ID NO: 377116

SEQ ID NO: 422738 - RNA, 64 nt, Human; identical to SEQ ID NO: 377117

SEQ ID NO: 422739 - RNA, 64 nt, Human; identical to SEQ ID NO: 377118

SEQ ID NO: 422740 - RNA, 64 nt, Human; identical to SEQ ID NO: 377119

SEQ ID NO: 422741 - RNA, 64 nt, Human; identical to SEQ ID NO: 377120

SEQ ID NO: 422742 - RNA, 64 nt, Human; identical to SEQ ID NO: 377121

SEQ ID NO: 422743 - RNA, 64 nt, Human; identical to SEQ ID NO: 377122

SEQ ID NO: 422744 - RNA, 64 nt, Human; identical to SEQ ID NO: 377123

SEQ ID NO: 422745 - RNA, 64 nt, Human; identical to SEQ ID NO: 377124

SEQ ID NO: 422746 - RNA, 64 nt, Human; identical to SEQ ID NO: 377125

SEQ ID NO: 422747 - RNA, 64 nt, Human; identical to SEQ ID NO: 377126

SEQ ID NO: 422748 - RNA, 64 nt, Human; identical to SEQ ID NO: 377127

SEQ ID NO: 422749 - RNA, 64 nt, Human; identical to SEQ ID NO: 377128

SEQ ID NO: 422750 - RNA, 64 nt, Human; identical to SEQ ID NO: 377129

SEQ ID NO: 422751 - RNA, 64 nt, Human; identical to SEQ ID NO: 377130

SEQ ID NO: 422752 - RNA, 64 nt, Human; identical to SEQ ID NO: 377131

SEQ ID NO: 422753 - RNA, 64 nt, Human; identical to SEQ ID NO: 377132

SEQ ID NO: 422754 - RNA, 64 nt, Human; identical to SEQ ID NO: 377133

SEQ ID NO: 422755 - RNA, 64 nt, Human; identical to SEQ ID NO: 377134

SEQ ID NO: 422756 - RNA, 64 nt, Human; identical to SEQ ID NO: 377135

SEQ ID NO: 422757 - RNA, 64 nt, Human; identical to SEQ ID NO: 377136

SEQ ID NO: 422758 - RNA, 64 nt, Human; identical to SEQ ID NO: 377137

SEQ ID NO: 422759 - RNA, 64 nt, Human; identical to SEQ ID NO: 377138

SEQ ID NO: 422760 - RNA, 64 nt, Human; identical to SEQ ID NO: 377139

SEQ ID NO: 422761 - RNA, 64 nt, Human; identical to SEQ ID NO: 377140

SEQ ID NO: 422762 - RNA, 64 nt, Human; identical to SEQ ID NO: 377141

SEQ ID NO: 422763 - RNA, 64 nt, Human; identical to SEQ ID NO: 377142

SEQ ID NO: 422764 - RNA, 64 nt, Human; identical to SEQ ID NO: 377143

SEQ ID NO: 422765 - RNA, 64 nt, Human; identical to SEQ ID NO: 377144

SEQ ID NO: 422766 - RNA, 64 nt, Human; identical to SEQ ID NO: 377145

SEQ ID NO: 422767 - RNA, 64 nt, Human; identical to SEQ ID NO: 377146

SEQ ID NO: 422768 - RNA, 64 nt, Human; identical to SEQ ID NO: 377147

SEQ ID NO: 422769 - RNA, 64 nt, Human; identical to SEQ ID NO: 377148

SEQ ID NO: 422770 - RNA, 64 nt, Human; identical to SEQ ID NO: 377149

SEQ ID NO: 422771 - RNA, 64 nt, Human; identical to SEQ ID NO: 377150

SEQ ID NO: 422772 - RNA, 64 nt, Human; identical to SEQ ID NO: 377151

SEQ ID NO: 422773 - RNA, 64 nt, Human; identical to SEQ ID NO: 377152

SEQ ID NO: 422774 - RNA, 64 nt, Human; identical to SEQ ID NO: 377153

SEQ ID NO: 422775 - RNA, 64 nt, Human; identical to SEQ ID NO: 377154

SEQ ID NO: 422776 - RNA, 64 nt, Human; identical to SEQ ID NO: 377155

SEQ ID NO: 422777 - RNA, 62 nt, Human; identical to SEQ ID NO: 377156

SEQ ID NO: 422778 - RNA, 64 nt, Human; identical to SEQ ID NO: 377157

SEQ ID NO: 422779 - RNA, 64 nt, Human; identical to SEQ ID NO: 377158

SEQ ID NO: 422780 - RNA, 64 nt, Human; identical to SEQ ID NO: 377159

SEQ ID NO: 422781 - RNA, 64 nt, Human; identical to SEQ ID NO: 377160

SEQ ID NO: 422782 - RNA, 52 nt, Human; identical to SEQ ID NO: 377161

SEQ ID NO: 422783 - RNA, 64 nt, Human; identical to SEQ ID NO: 377162

SEQ ID NO: 422784 - RNA, 64 nt, Human; identical to SEQ ID NO: 377163

SEQ ID NO: 422785 - RNA, 64 nt, Human; identical to SEQ ID NO: 377164

SEQ ID NO: 422786 - RNA, 64 nt, Human; identical to SEQ ID NO: 377165

SEQ ID NO: 422787 - RNA, 64 nt, Human; identical to SEQ ID NO: 377166

SEQ ID NO: 422788 - RNA, 64 nt, Human; identical to SEQ ID NO: 377167

SEQ ID NO: 422789 - RNA, 64 nt, Human; identical to SEQ ID NO: 377168

SEQ ID NO: 422790 - RNA, 64 nt, Human; identical to SEQ ID NO: 377169

SEQ ID NO: 422791 - RNA, 64 nt, Human; identical to SEQ ID NO: 377170

SEQ ID NO: 422792 - RNA, 64 nt, Human; identical to SEQ ID NO: 377171

SEQ ID NO: 422793 - RNA, 64 nt, Human; identical to SEQ ID NO: 377172

SEQ ID NO: 422794 - RNA, 64 nt, Human; identical to SEQ ID NO: 377173

SEQ ID NO: 422795 - RNA, 64 nt, Human; identical to SEQ ID NO: 377174

SEQ ID NO: 422796 - RNA, 64 nt, Human; identical to SEQ ID NO: 377175

SEQ ID NO: 422797 - RNA, 64 nt, Human; identical to SEQ ID NO: 377176

SEQ ID NO: 422798 - RNA, 64 nt, Human; identical to SEQ ID NO: 377177

SEQ ID NO: 422799 - RNA, 64 nt, Human; identical to SEQ ID NO: 377178

SEQ ID NO: 422800 - RNA, 64 nt, Human; identical to SEQ ID NO: 377179

SEQ ID NO: 422801 - RNA, 64 nt, Human; identical to SEQ ID NO: 377180

SEQ ID NO: 422802 - RNA, 64 nt, Human; identical to SEQ ID NO: 377181

SEQ ID NO: 422803 - RNA, 64 nt, Human; identical to SEQ ID NO: 377182

SEQ ID NO: 422804 - RNA, 64 nt, Human; identical to SEQ ID NO: 377183

SEQ ID NO: 422805 - RNA, 64 nt, Human; identical to SEQ ID NO: 377184

SEQ ID NO: 422806 - RNA, 64 nt, Human; identical to SEQ ID NO: 377185

SEQ ID NO: 422807 - RNA, 64 nt, Human; identical to SEQ ID NO: 377186

SEQ ID NO: 422808 - RNA, 64 nt, Human; identical to SEQ ID NO: 377187

SEQ ID NO: 422809 - RNA, 64 nt, Human; identical to SEQ ID NO: 377188

SEQ ID NO: 422810 - RNA, 64 nt, Human; identical to SEQ ID NO: 377189

SEQ ID NO: 422811 - RNA, 64 nt, Human; identical to SEQ ID NO: 377190

SEQ ID NO: 422812 - RNA, 64 nt, Human; identical to SEQ ID NO: 377191

SEQ ID NO: 422813 - RNA, 64 nt, Human; identical to SEQ ID NO: 377192

SEQ ID NO: 422814 - RNA, 64 nt, Human; identical to SEQ ID NO: 377193

SEQ ID NO: 422815 - RNA, 64 nt, Human; identical to SEQ ID NO: 377194

SEQ ID NO: 422816 - RNA, 64 nt, Human; identical to SEQ ID NO: 377195

SEQ ID NO: 422817 - RNA, 64 nt, Human; identical to SEQ ID NO: 377196

SEQ ID NO: 422818 - RNA, 64 nt, Human; identical to SEQ ID NO: 377197

SEQ ID NO: 422819 - RNA, 64 nt, Human; identical to SEQ ID NO: 377198

SEQ ID NO: 422820 - RNA, 64 nt, Human; identical to SEQ ID NO: 377199

SEQ ID NO: 422821 - RNA, 64 nt, Human; identical to SEQ ID NO: 377200

SEQ ID NO: 422822 - RNA, 64 nt, Human; identical to SEQ ID NO: 377201

SEQ ID NO: 422823 - RNA, 64 nt, Human; identical to SEQ ID NO: 377202

SEQ ID NO: 422824 - RNA, 64 nt, Human; identical to SEQ ID NO: 377203

SEQ ID NO: 422825 - RNA, 64 nt, Human; identical to SEQ ID NO: 377204

SEQ ID NO: 422826 - RNA, 64 nt, Human; identical to SEQ ID NO: 377205

SEQ ID NO: 422827 - RNA, 64 nt, Human; identical to SEQ ID NO: 377206

SEQ ID NO: 422828 - RNA, 64 nt, Human; identical to SEQ ID NO: 377207

SEQ ID NO: 422829 - RNA, 64 nt, Human; identical to SEQ ID NO: 377208

SEQ ID NO: 422830 - RNA, 64 nt, Human; identical to SEQ ID NO: 377209

SEQ ID NO: 422831 - RNA, 64 nt, Human; identical to SEQ ID NO: 377210

SEQ ID NO: 422832 - RNA, 57 nt, Human; identical to SEQ ID NO: 377211

SEQ ID NO: 422833 - RNA, 64 nt, Human; identical to SEQ ID NO: 377212

SEQ ID NO: 422834 - RNA, 64 nt, Human; identical to SEQ ID NO: 377213

SEQ ID NO: 422835 - RNA, 64 nt, Human; identical to SEQ ID NO: 377214

SEQ ID NO: 422836 - RNA, 64 nt, Human; identical to SEQ ID NO: 377215

SEQ ID NO: 422837 - RNA, 64 nt, Human; identical to SEQ ID NO: 377216

SEQ ID NO: 422838 - RNA, 64 nt, Human; identical to SEQ ID NO: 377217

SEQ ID NO: 422839 - RNA, 64 nt, Human; identical to SEQ ID NO: 377218

SEQ ID NO: 422840 - RNA, 64 nt, Human; identical to SEQ ID NO: 377219

SEQ ID NO: 422841 - RNA, 64 nt, Human; identical to SEQ ID NO: 377220

SEQ ID NO: 422842 - RNA, 64 nt, Human; identical to SEQ ID NO: 377221

SEQ ID NO: 422843 - RNA, 64 nt, Human; identical to SEQ ID NO: 377222

SEQ ID NO: 422844 - RNA, 64 nt, Human; identical to SEQ ID NO: 377223

SEQ ID NO: 422845 - RNA, 64 nt, Human; identical to SEQ ID NO: 377224

SEQ ID NO: 422846 - RNA, 64 nt, Human; identical to SEQ ID NO: 377225

SEQ ID NO: 422847 - RNA, 64 nt, Human; identical to SEQ ID NO: 377226

SEQ ID NO: 422848 - RNA, 64 nt, Human; identical to SEQ ID NO: 377227

SEQ ID NO: 422849 - RNA, 64 nt, Human; identical to SEQ ID NO: 377228

SEQ ID NO: 422850 - RNA, 64 nt, Human; identical to SEQ ID NO: 377229

SEQ ID NO: 422851 - RNA, 64 nt, Human; identical to SEQ ID NO: 377230

SEQ ID NO: 422852 - RNA, 64 nt, Human; identical to SEQ ID NO: 377231

SEQ ID NO: 422853 - RNA, 64 nt, Human; identical to SEQ ID NO: 377232

SEQ ID NO: 422854 - RNA, 64 nt, Human; identical to SEQ ID NO: 377233

SEQ ID NO: 422855 - RNA, 64 nt, Human; identical to SEQ ID NO: 377234

SEQ ID NO: 422856 - RNA, 64 nt, Human; identical to SEQ ID NO: 377235

SEQ ID NO: 422857 - RNA, 64 nt, Human; identical to SEQ ID NO: 377236

SEQ ID NO: 422858 - RNA, 64 nt, Human; identical to SEQ ID NO: 377237

SEQ ID NO: 422859 - RNA, 64 nt, Human; identical to SEQ ID NO: 377238

SEQ ID NO: 422860 - RNA, 64 nt, Human; identical to SEQ ID NO: 377239

SEQ ID NO: 422861 - RNA, 64 nt, Human; identical to SEQ ID NO: 377240

SEQ ID NO: 422862 - RNA, 62 nt, Human; identical to SEQ ID NO: 377241

SEQ ID NO: 422863 - RNA, 64 nt, Human; identical to SEQ ID NO: 377242

SEQ ID NO: 422864 - RNA, 64 nt, Human; identical to SEQ ID NO: 377243

SEQ ID NO: 422865 - RNA, 64 nt, Human; identical to SEQ ID NO: 377244

SEQ ID NO: 422866 - RNA, 64 nt, Human; identical to SEQ ID NO: 377245

SEQ ID NO: 422867 - RNA, 64 nt, Human; identical to SEQ ID NO: 377246

SEQ ID NO: 422868 - RNA, 64 nt, Human; identical to SEQ ID NO: 377247

SEQ ID NO: 422869 - RNA, 64 nt, Human; identical to SEQ ID NO: 377248

SEQ ID NO: 422870 - RNA, 64 nt, Human; identical to SEQ ID NO: 377249

SEQ ID NO: 422871 - RNA, 64 nt, Human; identical to SEQ ID NO: 377250

SEQ ID NO: 422872 - RNA, 64 nt, Human; identical to SEQ ID NO: 377251

SEQ ID NO: 422873 - RNA, 64 nt, Human; identical to SEQ ID NO: 377252

SEQ ID NO: 422874 - RNA, 64 nt, Human; identical to SEQ ID NO: 377253

SEQ ID NO: 422875 - RNA, 64 nt, Human; identical to SEQ ID NO: 377254

SEQ ID NO: 422876 - RNA, 64 nt, Human; identical to SEQ ID NO: 377255

SEQ ID NO: 422877 - RNA, 64 nt, Human; identical to SEQ ID NO: 377256

SEQ ID NO: 422878 - RNA, 64 nt, Human; identical to SEQ ID NO: 377257

SEQ ID NO: 422879 - RNA, 64 nt, Human; identical to SEQ ID NO: 377258

SEQ ID NO: 422880 - RNA, 64 nt, Human; identical to SEQ ID NO: 377259

SEQ ID NO: 422881 - RNA, 64 nt, Human; identical to SEQ ID NO: 377260

SEQ ID NO: 422882 - RNA, 64 nt, Human; identical to SEQ ID NO: 377261

SEQ ID NO: 422883 - RNA, 64 nt, Human; identical to SEQ ID NO: 377262

SEQ ID NO: 422884 - RNA, 64 nt, Human; identical to SEQ ID NO: 377263

SEQ ID NO: 422885 - RNA, 64 nt, Human; identical to SEQ ID NO: 377264

SEQ ID NO: 422886 - RNA, 64 nt, Human; identical to SEQ ID NO: 377265

SEQ ID NO: 422887 - RNA, 64 nt, Human; identical to SEQ ID NO: 377266

SEQ ID NO: 422888 - RNA, 64 nt, Human; identical to SEQ ID NO: 377267

SEQ ID NO: 422889 - RNA, 64 nt, Human; identical to SEQ ID NO: 377268

SEQ ID NO: 422890 - RNA, 64 nt, Human; identical to SEQ ID NO: 377269

SEQ ID NO: 422891 - RNA, 64 nt, Human; identical to SEQ ID NO: 377270

SEQ ID NO: 422892 - RNA, 64 nt, Human; identical to SEQ ID NO: 377271

SEQ ID NO: 422893 - RNA, 64 nt, Human; identical to SEQ ID NO: 377272

SEQ ID NO: 422894 - RNA, 64 nt, Human; identical to SEQ ID NO: 377273

SEQ ID NO: 422895 - RNA, 64 nt, Human; identical to SEQ ID NO: 377274

SEQ ID NO: 422896 - RNA, 64 nt, Human; identical to SEQ ID NO: 377275

SEQ ID NO: 422897 - RNA, 64 nt, Human; identical to SEQ ID NO: 377276

SEQ ID NO: 422898 - RNA, 64 nt, Human; identical to SEQ ID NO: 377277

SEQ ID NO: 422899 - RNA, 64 nt, Human; identical to SEQ ID NO: 377278

SEQ ID NO: 422900 - RNA, 64 nt, Human; identical to SEQ ID NO: 377279

SEQ ID NO: 422901 - RNA, 64 nt, Human; identical to SEQ ID NO: 377280

SEQ ID NO: 422902 - RNA, 64 nt, Human; identical to SEQ ID NO: 377281

SEQ ID NO: 422903 - RNA, 64 nt, Human; identical to SEQ ID NO: 377282

SEQ ID NO: 422904 - RNA, 64 nt, Human; identical to SEQ ID NO: 377283

SEQ ID NO: 422905 - RNA, 64 nt, Human; identical to SEQ ID NO: 377284

SEQ ID NO: 422906 - RNA, 64 nt, Human; identical to SEQ ID NO: 377285

SEQ ID NO: 422907 - RNA, 64 nt, Human; identical to SEQ ID NO: 377286

SEQ ID NO: 422908 - RNA, 64 nt, Human; identical to SEQ ID NO: 377287

SEQ ID NO: 422909 - RNA, 64 nt, Human; identical to SEQ ID NO: 377288

SEQ ID NO: 422910 - RNA, 64 nt, Human; identical to SEQ ID NO: 377289

SEQ ID NO: 422911 - RNA, 64 nt, Human; identical to SEQ ID NO: 377290

SEQ ID NO: 422912 - RNA, 64 nt, Human; identical to SEQ ID NO: 377291

SEQ ID NO: 422913 - RNA, 64 nt, Human; identical to SEQ ID NO: 377292

SEQ ID NO: 422914 - RNA, 64 nt, Human; identical to SEQ ID NO: 377293

SEQ ID NO: 422915 - RNA, 64 nt, Human; identical to SEQ ID NO: 377294

SEQ ID NO: 422916 - RNA, 64 nt, Human; identical to SEQ ID NO: 377295

SEQ ID NO: 422917 - RNA, 64 nt, Human; identical to SEQ ID NO: 377296

SEQ ID NO: 422918 - RNA, 64 nt, Human; identical to SEQ ID NO: 377297

SEQ ID NO: 422919 - RNA, 64 nt, Human; identical to SEQ ID NO: 377298

SEQ ID NO: 422920 - RNA, 64 nt, Human; identical to SEQ ID NO: 377299

SEQ ID NO: 422921 - RNA, 64 nt, Human; identical to SEQ ID NO: 377300

SEQ ID NO: 422922 - RNA, 64 nt, Human; identical to SEQ ID NO: 377301

SEQ ID NO: 422923 - RNA, 64 nt, Human; identical to SEQ ID NO: 377302

SEQ ID NO: 422924 - RNA, 58 nt, Human; identical to SEQ ID NO: 377303

SEQ ID NO: 422925 - RNA, 64 nt, Human; identical to SEQ ID NO: 377304

SEQ ID NO: 422926 - RNA, 64 nt, Human; identical to SEQ ID NO: 377305

SEQ ID NO: 422927 - RNA, 64 nt, Human; identical to SEQ ID NO: 377306

SEQ ID NO: 422928 - RNA, 64 nt, Human; identical to SEQ ID NO: 377307

SEQ ID NO: 422929 - RNA, 64 nt, Human; identical to SEQ ID NO: 377308

SEQ ID NO: 422930 - RNA, 64 nt, Human; identical to SEQ ID NO: 377309

SEQ ID NO: 422931 - RNA, 64 nt, Human; identical to SEQ ID NO: 377310

SEQ ID NO: 422932 - RNA, 50 nt, Human; identical to SEQ ID NO: 377311

SEQ ID NO: 422933 - RNA, 64 nt, Human; identical to SEQ ID NO: 377312

SEQ ID NO: 422934 - RNA, 64 nt, Human; identical to SEQ ID NO: 377313

SEQ ID NO: 422935 - RNA, 64 nt, Human; identical to SEQ ID NO: 377314

SEQ ID NO: 422936 - RNA, 64 nt, Human; identical to SEQ ID NO: 377315

SEQ ID NO: 422937 - RNA, 64 nt, Human; identical to SEQ ID NO: 377316

SEQ ID NO: 422938 - RNA, 64 nt, Human; identical to SEQ ID NO: 377317

SEQ ID NO: 422939 - RNA, 64 nt, Human; identical to SEQ ID NO: 377318

SEQ ID NO: 422940 - RNA, 64 nt, Human; identical to SEQ ID NO: 377319

SEQ ID NO: 422941 - RNA, 64 nt, Human; identical to SEQ ID NO: 377320

SEQ ID NO: 422942 - RNA, 64 nt, Human; identical to SEQ ID NO: 377321

SEQ ID NO: 422943 - RNA, 64 nt, Human; identical to SEQ ID NO: 377322

SEQ ID NO: 422944 - RNA, 64 nt, Human; identical to SEQ ID NO: 377323

SEQ ID NO: 422945 - RNA, 64 nt, Human; identical to SEQ ID NO: 377324

SEQ ID NO: 422946 - RNA, 64 nt, Human; identical to SEQ ID NO: 377325

SEQ ID NO: 422947 - RNA, 64 nt, Human; identical to SEQ ID NO: 377326

SEQ ID NO: 422948 - RNA, 64 nt, Human; identical to SEQ ID NO: 377327

SEQ ID NO: 422949 - RNA, 64 nt, Human; identical to SEQ ID NO: 377328

SEQ ID NO: 422950 - RNA, 64 nt, Human; identical to SEQ ID NO: 377329

SEQ ID NO: 422951 - RNA, 64 nt, Human; identical to SEQ ID NO: 377330

SEQ ID NO: 422952 - RNA, 64 nt, Human; identical to SEQ ID NO: 377331

SEQ ID NO: 422953 - RNA, 64 nt, Human; identical to SEQ ID NO: 377332

SEQ ID NO: 422954 - RNA, 64 nt, Human; identical to SEQ ID NO: 377333

SEQ ID NO: 422955 - RNA, 64 nt, Human; identical to SEQ ID NO: 377334

SEQ ID NO: 422956 - RNA, 64 nt, Human; identical to SEQ ID NO: 377335

SEQ ID NO: 422957 - RNA, 64 nt, Human; identical to SEQ ID NO: 377336

SEQ ID NO: 422958 - RNA, 64 nt, Human; identical to SEQ ID NO: 377337

SEQ ID NO: 422959 - RNA, 64 nt, Human; identical to SEQ ID NO: 377338

SEQ ID NO: 422960 - RNA, 64 nt, Human; identical to SEQ ID NO: 377339

SEQ ID NO: 422961 - RNA, 64 nt, Human; identical to SEQ ID NO: 377340

SEQ ID NO: 422962 - RNA, 64 nt, Human; identical to SEQ ID NO: 377341

SEQ ID NO: 422963 - RNA, 64 nt, Human; identical to SEQ ID NO: 377342

SEQ ID NO: 422964 - RNA, 64 nt, Human; identical to SEQ ID NO: 377343

SEQ ID NO: 422965 - RNA, 64 nt, Human; identical to SEQ ID NO: 377344

SEQ ID NO: 422966 - RNA, 64 nt, Human; identical to SEQ ID NO: 377345

SEQ ID NO: 422967 - RNA, 64 nt, Human; identical to SEQ ID NO: 377346

SEQ ID NO: 422968 - RNA, 64 nt, Human; identical to SEQ ID NO: 377347

SEQ ID NO: 422969 - RNA, 64 nt, Human; identical to SEQ ID NO: 377344

SEQ ID NO: 422970 - RNA, 64 nt, Human; identical to SEQ ID NO: 377349

SEQ ID NO: 422971 - RNA, 64 nt, Human; identical to SEQ ID NO: 377350

SEQ ID NO: 422972 - RNA, 64 nt, Human; identical to SEQ ID NO: 377351

SEQ ID NO: 422973 - RNA, 64 nt, Human; identical to SEQ ID NO: 377352

SEQ ID NO: 422974 - RNA, 64 nt, Human; identical to SEQ ID NO: 377353

SEQ ID NO: 422975 - RNA, 64 nt, Human; identical to SEQ ID NO: 377354

SEQ ID NO: 422976 - RNA, 64 nt, Human; identical to SEQ ID NO: 377355

SEQ ID NO: 422977 - RNA, 62 nt, Human; identical to SEQ ID NO: 377356

SEQ ID NO: 422978 - RNA, 64 nt, Human; identical to SEQ ID NO: 377357

SEQ ID NO: 422979 - RNA, 64 nt, Human; identical to SEQ ID NO: 377358

SEQ ID NO: 422980 - RNA, 64 nt, Human; identical to SEQ ID NO: 377359

SEQ ID NO: 422981 - RNA, 63 nt, Human; identical to SEQ ID NO: 377360

SEQ ID NO: 422982 - RNA, 64 nt, Human; identical to SEQ ID NO: 377361

SEQ ID NO: 422983 - RNA, 64 nt, Human; identical to SEQ ID NO: 377362

SEQ ID NO: 422984 - RNA, 64 nt, Human; identical to SEQ ID NO: 377363

SEQ ID NO: 422985 - RNA, 64 nt, Human; identical to SEQ ID NO: 377364

SEQ ID NO: 422986 - RNA, 64 nt, Human; identical to SEQ ID NO: 377365

SEQ ID NO: 422987 - RNA, 64 nt, Human; identical to SEQ ID NO: 377366

SEQ ID NO: 422988 - RNA, 64 nt, Human; identical to SEQ ID NO: 377367

SEQ ID NO: 422989 - RNA, 64 nt, Human; identical to SEQ ID NO: 377368

SEQ ID NO: 422990 - RNA, 64 nt, Human; identical to SEQ ID NO: 377369

SEQ ID NO: 422991 - RNA, 64 nt, Human; identical to SEQ ID NO: 377370

SEQ ID NO: 422992 - RNA, 64 nt, Human; identical to SEQ ID NO: 377371

SEQ ID NO: 422993 - RNA, 64 nt, Human; identical to SEQ ID NO: 377372

SEQ ID NO: 422994 - RNA, 64 nt, Human; identical to SEQ ID NO: 377373

SEQ ID NO: 422995 - RNA, 64 nt, Human; identical to SEQ ID NO: 377374

SEQ ID NO: 422996 - RNA, 64 nt, Human; identical to SEQ ID NO: 377375

SEQ ID NO: 422997 - RNA, 64 nt, Human; identical to SEQ ID NO: 377376

SEQ ID NO: 422998 - RNA, 64 nt, Human; identical to SEQ ID NO: 377377

SEQ ID NO: 422999 - RNA, 64 nt, Human; identical to SEQ ID NO: 377378

SEQ ID NO: 423000 - RNA, 64 nt, Human; identical to SEQ ID NO: 377379

SEQ ID NO: 423001 - RNA, 64 nt, Human; identical to SEQ ID NO: 377380

SEQ ID NO: 423002 - RNA, 64 nt, Human; identical to SEQ ID NO: 377381

SEQ ID NO: 423003 - RNA, 64 nt, Human; identical to SEQ ID NO: 377382

SEQ ID NO: 423004 - RNA, 64 nt, Human; identical to SEQ ID NO: 377383

SEQ ID NO: 423005 - RNA, 64 nt, Human; identical to SEQ ID NO: 377384

SEQ ID NO: 423006 - RNA, 64 nt, Human; identical to SEQ ID NO: 377385

SEQ ID NO: 423007 - RNA, 64 nt, Human; identical to SEQ ID NO: 377386

SEQ ID NO: 423008 - RNA, 60 nt, Human; identical to SEQ ID NO: 377387

SEQ ID NO: 423009 - RNA, 64 nt, Human
uagcucagaucuccuuucaaaguaguggcuuucuggaugguaauuccaucuuaaggugucagaa

SEQ ID NO: 423010 - RNA, 64 nt, Human
auuuuuauuuauauauggggccuaggccaauccaggaugguagcuggaauaccuuccuucuuaa

SEQ ID NO: 423011 - RNA, 64 nt, Human
uacgugauauuuuagaaacuuagugggaaaaguaggaugguauuuuuauguaaagccuugaccc

SEQ ID NO: 423012 - RNA, 64 nt, Human
aaaucagugcucuuucacuucuucagagaagcagggaugguaccuacccggcagguagguuaga

SEQ ID NO: 423013 - RNA, 64 nt, Human
uggguauguuaaccuaggcagugggaggcaaaugggaugguaugugagcuaggagaagggcuga

SEQ ID NO: 423014 - RNA, 64 nt, Human
ggauggagauaaacagcucccaucccuggguaauggaugguaagaugauggagauuccuaagau

SEQ ID NO: 423015 - RNA, 64 nt, Human
aaagugaaggaaaauacugaacucugucugagugggaugguaugaguuagaggaagaauucucu

SEQ ID NO: 423016 - RNA, 64 nt, Human
aacccauuuugugccacaugcaaguuuugaauaaggaugguauagaaaacaacgcugcauauac

SEQ ID NO: 423017 - RNA, 64 nt, Human
gggagcagccucacacaagcagaaacacuccuguggaugguauuguagcauguauuguuuauuu

SEQ ID NO: 423018 - RNA, 64 nt, Human
uuacagugcaauuuggagauuuuuuuuuuuuccuggaugguaagauuugaaauauuuacauuaa

SEQ ID NO: 423019 - RNA, 64 nt, Human
cuuuggccauuucuauggaaaugcgaugucagauggaugguaauggugcccuccaguggcugug

SEQ ID NO: 423020 - RNA, 64 nt, Human
uggagccuuagucucccagacugaaaaaggaagaggaugguauuacaucagcuccauuguuuga

SEQ ID NO: 423021 - RNA, 64 nt, Human
cguucccucacagcaaagcaacaauacaggcuagggaugguaauccuuuaaacauacaaaaauu

SEQ ID NO: 423022 - RNA, 64 nt, Human
aaauuauaucugucccaggugcucuccacacauaggaugguaaugccagucccaggggagggug

SEQ ID NO: 423023 - RNA, 64 nt, Human
uuacagauaacacuuacuugugccuggcugugcuggaugguauauucugugucauuuuucuuca

SEQ ID NO: 423024 - RNA, 64 nt, Human
uuauagaguucucagccauuggaccucuucuaaaggaugguauaaaaugacucucaaccacuuu

SEQ ID NO: 423025 - RNA, 64 nt, Human
cuuuugugcacacugcauacguuucagaacuccuggaugguaaccaucucuggagugcagcgcu

SEQ ID NO: 423026 - RNA, 64 nt, Human
ccuuucuuauccccgaguggauggauggauggauggaugguagggauguuaauaauuuuagugg

SEQ ID NO: 423027 - RNA, 64 nt, Human
guacaggauaaugguauaaaucaaaagagagaugggaugguaucuaaaaacucaaguauuuucg

SEQ ID NO: 423028 - RNA, 64 nt, Human
ggcaaguaauuuaaaaauaggcaaaagaauugcuggaugguaugguaguucuauuuuuaguuuu

SEQ ID NO: 423029 - RNA, 64 nt, Human
ucauucaacuaaaaauauuaaaauuuauuucacuggaugguaauguaaccuuaaaagcaucaua

SEQ ID NO: 423030 - RNA, 64 nt, Human
ugcauuauagagauggguauuuguagggccggagggaugguagugauggggagaaggugaggaa

SEQ ID NO: 423031 - RNA, 64 nt, Human
uuguuagugcacagcacaaauuaguuguauaugaggaugguaguuuuuucaccuucaguugucu

SEQ ID NO: 423032 - RNA, 64 nt, Human
uugauaguuguguguaugugugugugggguggggggaugguaagagaaaagagagaaacacuga

SEQ ID NO: 423033 - RNA, 64 nt, Human
uuuugguguuggagagacucuacgcuuccccgauggaugguacuucuucugcucucagcauggg

SEQ ID NO: 423034 - RNA, 64 nt, Human
ugcuuccuauaaacagcuccgcucuuucagggaaggaugguaacaaacuagaaggacaaauaug

SEQ ID NO: 423035 - RNA, 64 nt, Human
auuaguucugaggcccuuuguggggagguuagggggaugguaauagaaaaagacuauuuuauuu

SEQ ID NO: 423036 - RNA, 64 nt, Human
uuggagucuaaucuuucaaggaggugggcucccaggaugguaccauugcucuuuccuagcuaac

SEQ ID NO: 423037 - RNA, 64 nt, Human
uagaucaagaagcuacucuagaagucggagcagaggaugguacagcagaggccgaaccagaagc

SEQ ID NO: 423038 - RNA, 64 nt, Human
augggaaugugggucugcaccuuguccccucauaggaugguaccaagcauuuagugcacagugg

SEQ ID NO: 423039 - RNA, 64 nt, Human
ugucuaucuguuuaccucaguguagaugauaugaggaugguauaacuauguaaauuguuuuuga

SEQ ID NO: 423040 - RNA, 64 nt, Human
caguggguagggcuucugucuucccugggagcagggaugguaucuuagucaauuuuuuucccuu

SEQ ID NO: 423041 - RNA, 64 nt, Human
guuuggccaaggaguguccuggccagagaucagaggaugguagggugccuauucucggcucuuc

SEQ ID NO: 423042 - RNA, 64 nt, Human
accauuguuaacaggaauuaaauaagcacauagaggaugguaugggaagaaauuuggcugaucg

SEQ ID NO: 423043 - RNA, 64 nt, Human
cauguugcagauauuuucccgaguuccccagaauggaugguauugaaucucagccacaugcaac

SEQ ID NO: 423044 - RNA, 64 nt, Human
guaaauagggcaugaggaacucaucuguguauugggaugguauuagagagagaaucaggaaaga

SEQ ID NO: 423045 - RNA, 64 nt, Human
gugaaaaggcuucuuggcagccagguggcauugaggaugguauucagggcgcuuuccuucuguc

SEQ ID NO: 423046 - RNA, 64 nt, Human
ugcuuugccucuggugguacaagguuuuuaacauggaugguaaacaauugucuagaaauucugg

SEQ ID NO: 423047 - RNA, 64 nt, Human
uucccagacuaaauucauagccgagagcucggggggaugguagaguuaaaauuuaaaauaauuu

SEQ ID NO: 423048 - RNA, 64 nt, Human
auggacagggccuuccacccuggcuccuucacagggaugguagcugaccggugauggguucauu

SEQ ID NO: 423049 - RNA, 64 nt, Human
agcugcuggacaaggaggucuacuuauuuuguguggaugguaauuauggcaugcacgcugaaug

SEQ ID NO: 423050 - RNA, 64 nt, Human
uucuacagaaccugugauuauucucgcaugauaaggaugguacuugcauauggugaauuacuac

SEQ ID NO: 423051 - RNA, 64 nt, Human
ccuagagaugaauuucguuuucaaauaucuggugggaugguaauggggauuagagaacugacau

SEQ ID NO: 423052 - RNA, 64 nt, Human
aauaaauggaugaaaaucuuuuaacggagacaaaggaugguauuuaaaaauguagaacacaaug

SEQ ID NO: 423053 - RNA, 64 nt, Human
ccaauuagauacauauauacaagauaaaggaauaggaugguaauauauuuguuugaaauuaaau

SEQ ID NO: 423054 - RNA, 64 nt, Human
guauauauuucaagagcuugugaugaaaucuauaggaugguaaugauggacuugucaccuguau

SEQ ID NO: 423055 - RNA, 64 nt, Human
gaagaccuacccuccguuuuucuacuagauaggaggaugguagaaguuuggcugcugucauaac

SEQ ID NO: 423056 - RNA, 64 nt, Human
gagauugggacugugauguugggaccugaggacuggaugguagaauacuggggucccccagcuc

SEQ ID NO: 423057 - RNA, 64 nt, Human
uuaauguauggauucagauuagacugagaaaaauggaugguauuuucuuaaaauugugccaccu

SEQ ID NO: 423058 - RNA, 64 nt, Human
aaggguuggaaacuauugauugccaacuuuuuaaggaugguagggauuuuuucuuuguugaaua

SEQ ID NO: 423059 - RNA, 64 nt, Human
cgugacuuggguggcacccuaucuucuccaucagggaugguagcuauuuuucugccaugagacu

SEQ ID NO: 423060 - RNA, 64 nt, Human
gcuaaagaaagugugaagaucuuaugaaauagguggaugguaaguugaaauuauugaugugggu

SEQ ID NO: 423061 - RNA, 64 nt, Human
uugggaggcuguauuucuccuccacccucuuaauggaugguauggcuuugcucacucacuaggc

SEQ ID NO: 423062 - RNA, 64 nt, Human
accuccccaaauucaaucugagcccagcaggagaggaugguaggguugccagggcucagaagug

SEQ ID NO: 423063 - RNA, 64 nt, Human
uuuuuuuguuguuguuuuuuuuuugcgggggaggggaugguacagacuaaacguggggaaaaga

SEQ ID NO: 423064 - RNA, 64 nt, Human
aaauguuaaggcuuauugaaaccuuucaaguaggggaugguacauuuauuucaucugcaaauga

SEQ ID NO: 423065 - RNA, 64 nt, Human
uaaguggaauuaaaggucuagagugauuuguauuggaugguaacuaaggucuauacaucuacuc

SEQ ID NO: 423066 - RNA, 64 nt, Human
aucucuguuuuggcaaaauucagguucaggggcuggaugguauguguuucugcugccuuauuca

SEQ ID NO: 423067 - RNA, 64 nt, Human
auuuucuguguugcaggauggcuucugucuccaaggaugguacauggaaacugugggacacaga

SEQ ID NO: 423068 - RNA, 64 nt, Human
guauuuuuaacuugaaguuccauuucuuuaucaaggaugguauuuagauuuuuuuccucuuaac

SEQ ID NO: 423069 - RNA, 64 nt, Human
auuguuuuucccauauugauaugcuggcaauauaggaugguauguaauggacagaacugaugca

SEQ ID NO: 423070 - RNA, 64 nt, Human
auucugcuuuguccaauuaaauuauuccaauggcggaugguaauauucaccaucucuaauucau

SEQ ID NO: 423071 - RNA, 64 nt, Human
ggcccccugcggcccuagccugacccggaggaaaggaugguagauucuguuaacucuugaagac

SEQ ID NO: 423072 - RNA, 64 nt, Human
gcagacaauuuuaggaugugguuuacaguaagguggaugguaccuuauggcaaaaaucucucag

SEQ ID NO: 423073 - RNA, 64 nt, Human
gagucagaaugaggggacuacacaagcugacagcggaugguaugacucauugggggccauugau

SEQ ID NO: 423074 - RNA, 64 nt, Human
cacuggcaaucuuccuguuaaccacucuccuuagggaugguaucugaaacaacaauggucaccc

SEQ ID NO: 423075 - RNA, 64 nt, Human
cauugcuaccaaguuucauaccaaauauuugaaaggaugguauugaaucuaaaaccaaauauua

SEQ ID NO: 423076 - RNA, 64 nt, Human
uaaugggauuuggccaauuuugguaaugaaguuaggaugguaaugucugcaucugcuaaaggua

SEQ ID NO: 423077 - RNA, 64 nt, Human
acucugggccaagaccucccacuccgcccucugaggaugguaccaagaaugggccuuugggacu

SEQ ID NO: 423078 - RNA, 64 nt, Human
uuuuaaauauaaucaauaguaaagacuguucuguggaugguaguguuuaauacauuuucuauuu

SEQ ID NO: 423079 - RNA, 64 nt, Human
ggcaggcugcuggagccgcccucugaguugcccgggaugguagugccucugaugccagcccugg

SEQ ID NO: 423080 - RNA, 64 nt, Human
accuagguguaggauauucuucaagcaaauuuguggaugguagaugaaguacuuugcggugcuc

SEQ ID NO: 423081 - RNA, 64 nt, Human
ugguuuguaaaauccacagcuauauccugaugcuggaugguauuaaucuuguguagucuucaac

SEQ ID NO: 423082 - RNA, 64 nt, Human
ccuagaauaauacuggcauuaaagaauccuuguuggaugguagaaaucagaucccuaaccagug

SEQ ID NO: 423083 - RNA, 64 nt, Human
ggggguuugagggugggguaagggauuucuuaggggaugguagaccuuuauuggguaucaagac

SEQ ID NO: 423084 - RNA, 64 nt, Human
uugcuaacuguggucuuuguggcuacuuguuuguggaugguauuguguuuguuagugaacugug

SEQ ID NO: 423085 - RNA, 64 nt, Human
acuuugucauuuuugucuuuagaaaagaucugaaggaugguaaagccccgugcugaaacccagu

SEQ ID NO: 423086 - RNA, 64 nt, Human
agccaccaugcccggcccaaauauuuuuuauucaggaugguauaaccuaacugauaauagguaa

SEQ ID NO: 423087 - RNA, 64 nt, Human
uuuucucacucccuaucagggauauuuuggggggggaugguaaagggugggcuaaggaacagac

SEQ ID NO: 423088 - RNA, 64 nt, Human
cccccgaagccaugucacugaaaaggccugggggggaugguauauggcccuuuccccaccaggc

SEQ ID NO: 423089 - RNA, 64 nt, Human
aaggagguuccuggcuccuguucucagagaaggaggaugguaagguauccaggauuuuuagggg

SEQ ID NO: 423090 - RNA, 53 nt, Human
cugauccuguugugaaaugauacggaugguauucacugcacauaugaugaaau

SEQ ID NO: 423091 - RNA, 64 nt, Human
gcuccuuccuagcuagggagaccuuaugagaaguggaugguaggaggagucacuaauguuucaa

SEQ ID NO: 423092 - RNA, 64 nt, Human
ucuuacugucaucuggacagcuguuuuccuguuuggaugguaaaggaaguugagagucuuuaga

SEQ ID NO: 423093 - RNA, 64 nt, Human
aggccaaggaacaccggccuguuuaugaggggaaggaugguaccaucgaggacaucaucacagg

SEQ ID NO: 423094 - RNA, 64 nt, Human
aaugcuuaggagacagaucacuccuggaggcuggggaugguaggauugcuggggauuuuuuuuu

SEQ ID NO: 423095 - RNA, 64 nt, Human
agaaaaugcagccuuaaacaguguccaggagaugggaugguaccuccuaggaguacaagugccu

SEQ ID NO: 423096 - RNA, 64 nt, Human
gccuucuaacaauugcuguuuguaaaauaaaucaggaugguagaaagugauuauauggaaaauu

SEQ ID NO: 423097 - RNA, 64 nt, Human
gguaaagugaauucaaaauccuaguaugcuaaagggaugguacaagucuaacacaaauuguacg

SEQ ID NO: 423098 - RNA, 64 nt, Human
auuacauaaacgaagcucucaaagcccacauacuggaugguaucaaucuuugcggauacuuugc

SEQ ID NO: 423099 - RNA, 64 nt, Human
uuauuucccuuguuucucauuuugcccugucaguggaugguagaugcuuuguauaucuuaaauc

SEQ ID NO: 423100 - RNA, 64 nt, Human
uuguuggugcacagcacaaauuaguuauauauggggaugguaguuuuuucaucuucaguugucu

SEQ ID NO: 423101 - RNA, 64 nt, Human
aacuaugaacguugaaacaaggacaauuuguguuggaugguauucaaaaggaauuuuuuaaaac

SEQ ID NO: 423102 - RNA, 64 nt, Human
ugcuucuaaaguaauuuuuguaaguaaugagaugggaugguaaucuaguaauuugacuuuauag

SEQ ID NO: 423103 - RNA, 64 nt, Human
guaugcugucucuuuuugcaugcacuacuauccaggaugguaaaccugggcuuacauguuacac

SEQ ID NO: 423104 - RNA, 64 nt, Human
ugacgcagacagaggggauggggauagaggaaagggaugguaaguugagauguuguguggcaau

SEQ ID NO: 423105 - RNA, 64 nt, Human
ccuucuggucugaacaugggggaguugauugcacggaugguaaggaauauggauaacucacugc

SEQ ID NO: 423106 - RNA, 64 nt, Human
uuguaagcuuugguguuuguuuaauuagcaauagggaugguaggauucaaaugugugucauuua

SEQ ID NO: 423107 - RNA, 64 nt, Human
gaauuaaagagagaagccuccuuaaggagccacaggaugguaccuggccccaaaaggaauccug

SEQ ID NO: 423108 - RNA, 64 nt, Human
uuuggacuugacaaaaauguaugcaaaugaugggggaugguagaaaaaaauuauuuacacaacc

SEQ ID NO: 423109 - RNA, 64 nt, Human
aacaguuuuaggcuuccaaaggugguaaacuaugggaugguaaauauccgagaggaagcugaug

SEQ ID NO: 423110 - RNA, 64 nt, Human
augcccgcucuuggggagugaggauucugcacguggaugguacccuuucugugcugggcuccug

SEQ ID NO: 423111 - RNA, 64 nt, Human
acagcaggugucauauauggggggccaacaccagggaugguacuagggggaagugacaaggccc

SEQ ID NO: 423112 - RNA, 64 nt, Human
aucucuucuguauuuagguucgacuagugauaguggaugguauugcuuuuccauuucgucauga

SEQ ID NO: 423113 - RNA, 64 nt, Human
ugacauuaaauaccccuuccacugcucacuuuguggaugguagcaugagcugucuaccaagaag

SEQ ID NO: 423114 - RNA, 64 nt, Human
caacuaauguacucugcuuuagaaauuggaacaaggaugguacuaccacaaucacccccugcaa

SEQ ID NO: 423115 - RNA, 64 nt, Human
uccuagggugggaaggggcuagggaggaccaaagggaugguauugagaagagagaaagaagaua

SEQ ID NO: 423116 - RNA, 64 nt, Human
aacugucucugaagggugaaggcaggccguccugggaugguacccugugcucucccguggagga

SEQ ID NO: 423117 - RNA, 64 nt, Human
auuuggauauuaagaugcagagggggaggggaagggaugguagagauagacagcucuccccuac

SEQ ID NO: 423118 - RNA, 64 nt, Human
uuagggccagcccugcgugaacugcaggggcaauggaugguaaagcccuuuggcucuuggcagg

SEQ ID NO: 423119 - RNA, 64 nt, Human
acagccugccaaucgaagcccgucccugcauccaggaugguaccagcucccgccccucgccccc

SEQ ID NO: 423120 - RNA, 64 nt, Human
uuugaccuugcugaaaaggaacauauaauuguauggaugguaggauuaaguuguugaguaguuu

SEQ ID NO: 423121 - RNA, 64 nt, Human
uugggaagauugccuuguagagguagcaugcacaggaugguaaauuggauugguggauccacca

SEQ ID NO: 423122 - RNA, 64 nt, Human
agguuagucaguuuaaaaauuguucauguuguuuggaugguaucgaaaaccagaaaccacuuuu

SEQ ID NO: 423123 - RNA, 64 nt, Human
aauuuaggaccgugggucaugcagcgaaggggcuggaugguaggaagggaugugcccgccucuc

SEQ ID NO: 423124 - RNA, 64 nt, Human
gggacaggccucacuagucuugaggcccagccuaggaugguagucaggggaaggagcgagauuc

SEQ ID NO: 423125 - RNA, 64 nt, Human; identical to SEQ ID NO: 423124

SEQ ID NO: 423126 - RNA, 64 nt, Human
cgggggcucacugcuugcacugugcuuaggguagggaugguaaauauccucccugcauggcuuu

SEQ ID NO: 423127 - RNA, 64 nt, Human
agggagaacacagggacgugccacucgagggggaggaugguauggauuucugcuuuugucacac

SEQ ID NO: 423128 - RNA, 64 nt, Human
uccuuucauuucuuucucuugugcauuuaauaaaggaugguaucuauaaacaaugcaaaagaug

SEQ ID NO: 423129 - RNA, 64 nt, Human
gggaggggagagaagagaaggagggaaggauuuaggaugguaaaguuagguacagagaccuccc

SEQ ID NO: 423130 - RNA, 64 nt, Human
uuuuuccuaacauaccuaagcaaacccagugucaggaugguaauucuuauucuuucguucaguu

SEQ ID NO: 423131 - RNA, 64 nt, Human
uguaucgacuacauauguauuugacccugugggaggaugguacuuuucuuuuuaacuuuuauuu

SEQ ID NO: 423132 - RNA, 64 nt, Human
aaaugucuccagauauugccagcuaccccuugagggaugguaccucugguugagaaccauugcu

SEQ ID NO: 423133 - RNA, 64 nt, Human
cccgccucaugcacugaccacagcccccaggggaggaugguacuggaucuggccccaucuucug

SEQ ID NO: 423134 - RNA, 64 nt, Human
ccagcggcuggucccgcuuuccuggaauuuggccugggcguaugcagaggccgccuccacaccc

SEQ ID NO: 423135 - RNA, 64 nt, Human
ccuguagaggacuuucuucagggcccguagcugcugggcguaccccuggcaggcgggcugugcc

SEQ ID NO: 423136 - RNA, 64 nt, Human
gucugcaaggccagcccgacccugacacugcacgugggcguaguggggagcacccuggagugga

SEQ ID NO: 423137 - RNA, 64 nt, Human
uguucaugcuggcgagugaaugccagugugcugaugggcguacgcuggugcugaguagaugcgc

SEQ ID NO: 423138 - RNA, 64 nt, Human
aaagcauuccuaggaauauuuuccccgccaaugcugggcguacacccuagccaacgggacaaau

SEQ ID NO: 423139 - RNA, 64 nt, Human
accccccucccuacaaaagauuuuaauaauuaguugggcguaguggugcaugccuguaauccca

SEQ ID NO: 423140 - RNA, 63 nt, Human
uuauccucuccuacacauaagaaaccaaaaggcugggcguaguggcucacaccuguaauccca

SEQ ID NO: 423141 - RNA, 64 nt, Human
gugaauuaccugagguaugcauuucccagaaccgugggcguacccaccuuggggggcauguugg

SEQ ID NO: 423142 - RNA, 64 nt, Human
gccccuggcagaguccacgcugccucagguaucaugggcguaaugaucacccaggcuccgggag

SEQ ID NO: 423143 - RNA, 64 nt, Human
aaagccagaagcuaagcugcagugaggcugugauugggcguagaagugggagcauugggaccuc

SEQ ID NO: 423144 - RNA, 64 nt, Human
cccuaugggggacccccaacucaaggccaaggacugggcguaucggaugcucauaacaccccug

SEQ ID NO: 423145 - RNA, 64 nt, Human
auggcugcaccuuuuugcaugauaucuucaagccugggcguacagagcacauuugucaguauuu

SEQ ID NO: 423146 - RNA, 64 nt, Human
uuuaaaagaaaauauaccucauuuagguuugaauugggcguauuguguaaauuucaaauauuca

SEQ ID NO: 423147 - RNA, 64 nt, Human
aaagaaacacccguuaccggguccagacugaaugugggcguaagaaagcgggaaggguccccca

SEQ ID NO: 423148 - RNA, 64 nt, Human
ugggcuuugccuucugacaccucaguggugcugcugggcguaggccuggcuguggugguguccc

SEQ ID NO: 423149 - RNA, 64 nt, Human
gaauguugaacuuucgccauggucuccaucguucugggcguaaauucccugggaucaaguagga

SEQ ID NO: 423150 - RNA, 64 nt, Human
cuaaaugcaguucuuuggaaucacccuacuguggugggcguaguagggagccaucagcuaggaa

SEQ ID NO: 423151 - RNA, 64 nt, Human
uggagaggccaggcgggagaacuaccgcagcaggugggcguacggacugcuuggcgcauggcac

SEQ ID NO: 423152 - RNA, 64 nt, Human
uaccuucuauguauuagugucaacuuuuaacuuuugggcguaagaccaaauguaguuuuguaua

SEQ ID NO: 423153 - RNA, 64 nt, Human
aauucagaucaucaccccugcacuuuguaccacaugggcguauucuuucuucccagucauugcu

SEQ ID NO: 423154 - RNA, 64 nt, Human
ccaauccugaacauaagacaguguugggcaggucugggcguauaauuugaggaguggauggugg

SEQ ID NO: 423155 - RNA, 64 nt, Human
uuuuuguuguuuccaggaauuuauuugauauuaaugggcguaaaacagcaucauuguacuuaag

SEQ ID NO: 423156 - RNA, 64 nt, Human
gcuaggagaaugaagugugguguugggcagccccugggcguaucucuucuuccucuguacuaau

SEQ ID NO: 423157 - RNA, 64 nt, Human
ccucuacugugucucacaucaccauguagaagaaugggcguacaguauauaccgugacauccug

SEQ ID NO: 423158 - RNA, 64 nt, Human
gccauucccaccuuagagugcuacauaggugcuuugggcguauguaacauuaguguccuuccuu

SEQ ID NO: 423159 - RNA, 64 nt, Human
acaccuguaaucccagcacuuugggaggucgaggugggcguaucaccugagguugggaguucga

SEQ ID NO: 423160 - RNA, 64 nt, Human
ccugucucuacuaaaaauacaaaaaaauauuagcugggcguagguggugcacaccuguaguccc

SEQ ID NO: 423161 - RNA, 64 nt, Human
gcaacaacaguaacaacaagacaaccgcaacaugugggcguagucaggcaaugcugugugcgaa

SEQ ID NO: 423162 - RNA, 64 nt, Human
aggacaagcacuugccaccaccgucacucagcccugggcguagccggacaggaggagagcagug

SEQ ID NO: 423163 - RNA, 64 nt, Human
gccucuccugucucucaucagccacccugacaggugggcguaugccucauuuuucaucugguga

SEQ ID NO: 423164 - RNA, 64 nt, Human
aaaccccaucucuacuaaaaauacaaaaauuagcugggcguaguggcgcgugccuguaauucca

SEQ ID NO: 423165 - RNA, 64 nt, Human
gggugacucagcaaggcagugucagagcugggacugggcguaggccuuuguccucauccccagc

SEQ ID NO: 423166 - RNA, 61 nt, Human
ggugcugcuuuauuucagacucugccccagguuccaggaauccgaaccccggagugcugac

SEQ ID NO: 423167 - RNA, 61 nt, Human
uaagucugucucuuucagcugccaguaaguuuuccaggaugagaggggaaaaagaaagccu

SEQ ID NO: 423168 - RNA, 61 nt, Human
ugaggcaucagcugcuagacagugucugccuuuccaggacauucuucuugguauuccuuac

SEQ ID NO: 423169 - RNA, 61 nt, Human
cgagcucagggcagcugugcugggugagcucuuccaggagccaccuugccacccauucuuc

SEQ ID NO: 423170 - RNA, 61 nt, Human
gauuccuacucgaaaaucuugacaccugacuuuccaggaugcacauuuucauacguagacc

SEQ ID NO: 423171 - RNA, 61 nt, Human
uggucccuaggccaagccaccaagugaaaccuuccaggauacuagcccgccagcugugggc

SEQ ID NO: 423172 - RNA, 61 nt, Human
uagacagcuuugacuggaggguccauuuuucuuccaggaugguguuacugcaguugaaagg

SEQ ID NO: 423173 - RNA, 61 nt, Human
ucaaguaccacuaacacagaugauugaucguuuccaggacaauaaaaguuucggaguugaa

SEQ ID NO: 423174 - RNA, 61 nt, Human
guguucaauguguuuguuucauaugggcccuuuccaggaguuugcaaaccuugucauaccc

SEQ ID NO: 423175 - RNA, 61 nt, Human
caaggaccuaguuccuucuagggauauaaauuuccaggaauguguauuuuuaaugugguga

SEQ ID NO: 423176 - RNA, 61 nt, Human
auuccagguccugagagcugcuuugaggcaguuccaggaguacuuacuauuggucaugcaa

SEQ ID NO: 423177 - RNA, 61 nt, Human
ucuccuagagaggaauggacccaggcugucauuccaggaagaacugcagagccuucagccu

SEQ ID NO: 423178 - RNA, 61 nt, Human
uucaguaggcuccugaagagugaucucaacuuuccaggaagaaaagagggcaaagggaaca

SEQ ID NO: 423179 - RNA, 61 nt, Human
aggacaauuuggucauuggacacggauugcaggcuuugagaagcgcucagaggcccagggc

SEQ ID NO: 423180 - RNA, 61 nt, Human
gacaagaaaccuugaaaagcaccugucaaauggcuuugaagaagugaugccaccaucucua

SEQ ID NO: 423181 - RNA, 61 nt, Human
gagacaaaguuguggguuccuccucccaccuggcuuugaggcugucgucgauaucauagua

SEQ ID NO: 423182 - RNA, 61 nt, Human
caauaagcacguccuccucccccacucccacuuccaggauugugguuuggauugaaaccaa

SEQ ID NO: 423183 - RNA, 61 nt, Human
uccuaauuucuccucccuuccuuuucccugcuuccaggaaacuccacaucugccuuaaaac

SEQ ID NO: 423184 - RNA, 61 nt, Human
caucaaggaagaaugaagaacguugacuuuuuuccaggauaaauuaucucugaugcuucuu

SEQ ID NO: 423185 - RNA, 61 nt, Human
gcauuucauuaucuaacaaaauuaauauaaauuccaggacaugguaaaauguguuuuaaua

SEQ ID NO: 423186 - RNA, 61 nt, Human
ggccaggaaguccuccaauuuccuuuggucuuuccaggagauuggacuacacauuguaaag

SEQ ID NO: 423187 - RNA, 61 nt, Human
cugggccagccuccccacuuacaaggcugcuuuccaggaagggaggucugguguaucucau

SEQ ID NO: 423188 - RNA, 61 nt, Human
cagaaaaaaaccucuggaaugaccuuccucauuccaggaggcccuggaauaaggaagaggc

SEQ ID NO: 423189 - RNA, 61 nt, Human
ugguuguguugcucaguguguaaguguuuguuuccaggauauuuucuuuuuaaaugucuuu

SEQ ID NO: 423190 - RNA, 61 nt, Human
cgagccuggccgguuaacaucuuuuaauuguuuccaggauugagcagguucucagcugggc

SEQ ID NO: 423191 - RNA, 61 nt, Human
uuccgcagggcuguggcucggccagcagcgguuccaggagaguggcggugcgcacgggccu

SEQ ID NO: 423192 - RNA, 61 nt, Human
ggagggcagagccaugggccugggccugcuuuuccaggauccugcaggaacgagcacuggc

SEQ ID NO: 423193 - RNA, 61 nt, Human
cuaaccagccucagcagugugcauagaccauuuccaggagggucuguccccagaugcucug

SEQ ID NO: 423194 - RNA, 61 nt, Human
gccagcugggcuggguguggguucuguguccuuccaggauaugugucauuucccaugaggg

SEQ ID NO: 423195 - RNA, 61 nt, Human
aagcaaagaucuuucugggguccugaguggcuuccaggagagcgggaugaacccuggaccu

SEQ ID NO: 423196 - RNA, 61 nt, Human
uaagcgaucucuaugccugggaugcccuuuauuccaggaggcaucaagccucuaaagaaug

SEQ ID NO: 423197 - RNA, 61 nt, Human
ggaagagcuggagaagcagacucugcugaauuuccaggaacucccagcgccagauucauca

SEQ ID NO: 423198 - RNA, 61 nt, Human
gacagagggucgucccaacagggggagguagggcuuugaaaacaccuucauccaggcuggg

SEQ ID NO: 423199 - RNA, 61 nt, Human
ccggcaugagccacugcgccuggccgacaaaggcuuugauaucagaaugaacugucaaggg

SEQ ID NO: 423200 - RNA, 61 nt, Human
accaacaaaaauaauaaaacacaaagagccaggcuuugagacucauguaauuacaauuucu

SEQ ID NO: 423201 - RNA, 61 nt, Human
gugacuuuaucguuggagaguauuguuacccuuccaggauacauaucaggguuaaccugac

SEQ ID NO: 423202 - RNA, 61 nt, Human
ccccucuggggcucuacagaaacaggcuggguuccaggagcccaucuccccgcugucuccc

SEQ ID NO: 423203 - RNA, 61 nt, Human
gugcuuuccuuguggcccugccaaccagcucuuccaggacgaacucaguccagcaugguuu

SEQ ID NO: 423204 - RNA, 54 nt, Human
cagcaaccuggccagccugaggucuuccaggagaugcuguccaugcugggagau

SEQ ID NO: 423205 - RNA, 61 nt, Human
guacaaaguacuagcuaaaccagaaaggugauuccaggaggaguuagccaaacaacaacaa

SEQ ID NO: 423206 - RNA, 61 nt, Human
uucacuuguaucuccuuaguuaacaacccaguuccaggaucgagccuaaagcgggagccag

SEQ ID NO: 423207 - RNA, 61 nt, Human
cuuccugguucaaucuugggagauuguguguuuccaggaauuuagccguuuccuccagauu

SEQ ID NO: 423208 - RNA, 61 nt, Human
ucacacuuuguuccaaaaacuuuuggaauuauuccaggacuugugguggaguuaugguacu

SEQ ID NO: 423209 - RNA, 61 nt, Human
uucugggaaauuagaaaaaguggggugaucuuuccaggaaaaacauguguaacaucugcuu

SEQ ID NO: 423210 - RNA, 61 nt, Human
guagcugaggagaggucgaauuuacugcuuuuuccaggacaauucuggaaguaaagaaaau

SEQ ID NO: 423211 - RNA, 61 nt, Human
agcccuggguggugaggcucacaguacugguuuccaggaggaagagccuuugugcauuuga

SEQ ID NO: 423212 - RNA, 61 nt, Human
uuccagaugaggcccaaaacauauauagggguuccaggaaucucauucauucauucaguau

SEQ ID NO: 423213 - RNA, 61 nt, Human
gugggacucaugcuggagaggagccgcccacuuccaggaccugugaauaagggcuaaugau

SEQ ID NO: 423214 - RNA, 61 nt, Human
ggugcuauuucuauuccuuaugggaucauuuuuccaggacucuuugaagaaaagaaaaaac

SEQ ID NO: 423215 - RNA, 61 nt, Human
aacuugguaaaauccaagucuuuuuuuuuuuuuccaggaacaacuacauuuucucauauac

SEQ ID NO: 423216 - RNA, 61 nt, Human
ucuuguuccugagaaggguggguaacagauauuccaggaaaaagaaugcacauugaaugga

SEQ ID NO: 423217 - RNA, 61 nt, Human
ucagacacggcaccuucaguuuuguacuauuggcuuugaaucaagcaggcucaaaucuagu

SEQ ID NO: 423218 - RNA, 61 nt, Human
caacaauuuucuagauauuauauacaacacaggcuuugaucuuggggacuuuucccauaua

SEQ ID NO: 423219 - RNA, 61 nt, Human
uuuaaaugccucucacucuuacaagauaguaggcuuugagauaauaaacuuacccguguca

SEQ ID NO: 423220 - RNA, 61 nt, Human
aaauuaaaaugccaaggauaaagcuggcugcuuccaggagggggaagaggaguggggagug

SEQ ID NO: 423221 - RNA, 61 nt, Human
auucaccgugcccagcacccgaagugccaaauuccaggaggacaagagccuuagccaauga

SEQ ID NO: 423222 - RNA, 61 nt, Human
cagcuguuccucaguauccgaagcggguggauuccaggacgcuccguggauaauaaacuuu

SEQ ID NO: 423223 - RNA, 61 nt, Human
acaucacucaugggauuuuuaaaaagccucuuuccaggaauggaacugauggauuccucuc

SEQ ID NO: 423224 - RNA, 61 nt, Human
cugagcucaugccccacggagacuuagcagguuccaggagugagcgagggcagcggaaagg

SEQ ID NO: 423225 - RNA, 61 nt, Human
cuuuaguaaguuagcugccagcauuagaaccuuccaggaagaauuuuaacuaguaugcuac

SEQ ID NO: 423226 - RNA, 61 nt, Human
ccgccucuugcaucaguacgccaaagccaucuuccaggacccagaggggcugccugaccuc

SEQ ID NO: 423227 - RNA, 61 nt, Human
cagggcuuauuucaaaaccuuugucccucaguuccaggaggcagcauuugccaauggaaag

SEQ ID NO: 423228 - RNA, 61 nt, Human
uaauuuguauauuguguugcagaugaaaguauuccaggaacagugaaugguagaagacaca

SEQ ID NO: 423229 - RNA, 61 nt, Human
aaaguguccgucugugucugugagggauugguuccaggaccccuguggcuaccaaaaucca

SEQ ID NO: 423230 - RNA, 61 nt, Human
gcugugguggcugucucugucccucacugccuuccaggagcaauuugcacauguaacauag

SEQ ID NO: 423231 - RNA, 61 nt, Human
auucugggcagaagucuguuuuuuuucauuuuuccaggacaguuggauauugucaggccac

SEQ ID NO: 423232 - RNA, 61 nt, Human
cuuucugcaguagcuagagggacagguuuccuuccaggaaggauucgaguuccugugccug

SEQ ID NO: 423233 - RNA, 61 nt, Human
gagcagcauuacacuacaaugcuucuuugguuuccaggaauuuuuuucaaauggggcuguu

SEQ ID NO: 423234 - RNA, 56 nt, Human
gaaguaaugcaacagaguaaguaccauuccaggagugucuaaagccgagcuuugag

SEQ ID NO: 423235 - RNA, 61 nt, Human
gggaaucacaguggucuaccugcauucauaauuccaggaucugugaagagcacauaugugu

SEQ ID NO: 423236 - RNA, 61 nt, Human
gccaggagacccugaaacaugaaaccaaacaggcuuugauauuuuuuuuuuuuuaauuacu

SEQ ID NO: 423237 - RNA, 61 nt, Human
uacauagaaguacacagcuauuauaugcuguggcuuugagaaguuaacuuuuguggaauau

SEQ ID NO: 423238 - RNA, 61 nt, Human
aaaaaaaaaaaaaaucccaauaguccaugaaggcuuugaucucuugggaaguucuucauag

SEQ ID NO: 423239 - RNA, 61 nt, Human
gaacacagaacugaacugagguucauggauuuuccaggacuguuucaaacaugcccauuac

SEQ ID NO: 423240 - RNA, 61 nt, Human
cccagggcgcccugggagcugagccugggacuuccaggaccuccccucagguuguucucug

SEQ ID NO: 423241 - RNA, 61 nt, Human
gccgccacccucgcguagcuuuccugugguuuuccaggacuguccgguacagcccgggcuc

SEQ ID NO: 423242 - RNA, 61 nt, Human
aguucaaaaacuugggcuuucuaaucagaauuuccaggaggaggaaagugugugcugaaua

SEQ ID NO: 423243 - RNA, 61 nt, Human
ugagccacccacuugccauuugcuccuguccuuccaggaaaucacaauuuucaucagagcc

SEQ ID NO: 423244 - RNA, 61 nt, Human
ggguaucugcaugaaggcuccugucugacuauuccaggauccaauauuacugccuucugaa

SEQ ID NO: 423245 - RNA, 61 nt, Human
guuuggcaggacacagagagguaggugaacauuccaggaaagaagcagcuuagagaaaaug

SEQ ID NO: 423246 - RNA, 61 nt, Human
uauuauccagagucaugggagaguacacccuuuccaggaauaauguuuugggaaacacuga

SEQ ID NO: 423247 - RNA, 61 nt, Human
ucccagcugcuuuucauuuauuacuucuucuuuccaggaccugacagaagucagggaagag

SEQ ID NO: 423248 - RNA, 61 nt, Human
uagaucuacagaguuagaaauucgaaaacuauuccaggacuaauucuuaaucggcauuauu

SEQ ID NO: 423249 - RNA, 61 nt, Human
acugcaaaugucacuugugaugagugugccauuccaggauaacagcuugcacccuccucag

SEQ ID NO: 423250 - RNA, 61 nt, Human
auauuacaagcaauccccaaauuuuauggucuuccaggaaaaguuauuaccguuuaugaua

SEQ ID NO: 423251 - RNA, 61 nt, Human
cuagggacagaaguguuucuggaagugaugcuuccaggauuuguuuucagaaacaagaauu

SEQ ID NO: 423252 - RNA, 61 nt, Human
guguuaagcuguucaugcacgugccugacgcuuccaggaagcuguagagagggacagaagg

SEQ ID NO: 423253 - RNA, 61 nt, Human
auagucauccuuuaguauccaaggggauugguuccaggacuccugaagaucccaaaaucug

SEQ ID NO: 423254 - RNA, 61 nt, Human
uuccuuuaggauaaagcuaugugcuguuguuuuccaggaacaagugcucugucacauuugg

SEQ ID NO: 423255 - RNA, 61 nt, Human
ccuuuucaggcacaugguuucaacaaagccuggcuuugacauuccuuguccugaggagcac

SEQ ID NO: 423256 - RNA, 61 nt, Human
uguucgauuuuguuuuguuuuguuuuguucuggcuuugaggcuuguuuuguugucuguguc

SEQ ID NO: 423257 - RNA, 61 nt, Human
gcccccacccuccuggcagcagcgccaggaaggcuuugacaauuaccuccgucugaucuac

SEQ ID NO: 423258 - RNA, 61 nt, Human
uuacuguuucuguugccuggacaguuacaguuuccaggaaacaucaggaaguaggaaacug

SEQ ID NO: 423259 - RNA, 61 nt, Human
guaggauuuaaaaagcagcccacugcucaguuuccaggaucagcuuccuccuucugucacu

SEQ ID NO: 423260 - RNA, 61 nt, Human
uuugaaaggggacagaaauauaacuaaaugcuuccaggagaaaaauuccaagaguuacaau

SEQ ID NO: 423261 - RNA, 61 nt, Human
cggagcuugaugagcagcccuuggucuccgguuccaggacugagagcccagcugccucugc

SEQ ID NO: 423262 - RNA, 61 nt, Human
gugaugacaugaaauacaaagaacaagcuauuuccaggaauguguucuguauuuuacaucc

SEQ ID NO: 423263 - RNA, 61 nt, Human
accacacaccugccaaggagcaacagaauccuuccaggaccguucacauacaaagaaaagu

SEQ ID NO: 423264 - RNA, 61 nt, Human
acugcucuuaacuugcucaaacuggggcagguuccaggaacuugaacuaaaaauaucuauu

SEQ ID NO: 423265 - RNA, 61 nt, Human
gaggugcuuugagcaguucugaaaaaugcaguuccaggaaagcaacugcuuugguuccuaa

SEQ ID NO: 423266 - RNA, 61 nt, Human
caccacauugcauuucuguuugcaccaugucuuccaggagacuagacuacuguuguccagg

SEQ ID NO: 423267 - RNA, 61 nt, Human
cuagggguuucaaaagacucaguuaauugauuuccaggaaguacucauagcaaguucauaa

SEQ ID NO: 423268 - RNA, 61 nt, Human
agcuacuucaaacauuccccaguaccuucaguuccaggauuuaaaaugcaagaaaaaacau

SEQ ID NO: 423269 - RNA, 61 nt, Human
cccgccuucuuccuccacuuucuucacuugcuuccaggauaccacgcuuucuuuucugaau

SEQ ID NO: 423270 - RNA, 61 nt, Human
gcagggaucugguacagacauaggcgcuuccuuccaggaacagucccucaggagaggcagu

SEQ ID NO: 423271 - RNA, 61 nt, Human
uugugucuuuuuuucagacucacaguggagcuuccaggacccagaauaaagccaaugauuu

SEQ ID NO: 423272 - RNA, 61 nt, Human
gggaauuaggcuuuagauuuugauagcaauguuccaggaaugaaauauagauguuagccca

SEQ ID NO: 423273 - RNA, 61 nt, Human
ucaauugauauauaauaaccguucuaaccucuuccaggaaaauauuuuuagaacuacuagc

SEQ ID NO: 423274 - RNA, 64 nt, Human
aaaauuaauauaucauuaucuuugcuguuauugacagcgauauaauuuuauuacauaugauuag

SEQ ID NO: 423275 - RNA, 64 nt, Human
uagccagaggucccagaugccugggcugagaacccagcgauaagggggcguucccaaagcagac

SEQ ID NO: 423276 - RNA, 64 nt, Human
ucaaagugauugugcaagcuaaaugaaguaggcucagcgauagugguccucuuacagagaaacg

SEQ ID NO: 423277 - RNA, 61 nt, Human
ucugaaugcaagcaguuuauaugggagaugauuccaggaaauaccgauaugagaaugggga

SEQ ID NO: 423278 - RNA, 61 nt, Human
ugcccauccuguguauugacaagcaucaggauuccaggaggauucuuccugauucaaagac

SEQ ID NO: 423279 - RNA, 61 nt, Human
gaucuccuccaccuuucuccaaugacagaaguuccaggacugguuuuccaguacaucuuua

SEQ ID NO: 423280 - RNA, 61 nt, Human
uccaggacaugauacugaugccauguuuagauuccaggaucacaagaaucaccucaaauug

SEQ ID NO: 423281 - RNA, 61 nt, Human
uuuagcuuguccuaaaucuugcuguccacccuuccaggaaagggacauuguaaaugaauaa

SEQ ID NO: 423282 - RNA, 61 nt, Human
ccuggcuggccucguggggccugucucacuuuuccaggagacaugacccacuaacguggca

SEQ ID NO: 423283 - RNA, 61 nt, Human
ugcugugcaaugccuuaggacuuuguuuguguuccaggacaaguguucacucacaucugua

SEQ ID NO: 423284 - RNA, 61 nt, Human
ggaggagaggaagaaacuuuuuuuccuucuuuuccaggaguagcuggaaauuaagaucggg

SEQ ID NO: 423285 - RNA, 61 nt, Human
uuaaguauuaaugaaaaaagagccauaagcauuccaggagaaaaucucaagggagcuacau

SEQ ID NO: 423286 - RNA, 61 nt, Human
uuggaggcuuuuaauuuuauuuguaugaauuuuccaggauuucauuaaaaauuauuauugu

SEQ ID NO: 423287 - RNA, 61 nt, Human
ccacaggccaguugagguugggcaaggagacuuccaggacuuccagacagaguaccagguu

SEQ ID NO: 423288 - RNA, 61 nt, Human
ggagcagucuuccaucaugcugaauuuugucuuccaggagcugccccuauggggcggggcc

SEQ ID NO: 423289 - RNA, 61 nt, Human
aagccggucucaaagauaacugcauccuucauuccaggaaagcccuagaauuagggcacau

SEQ ID NO: 423290 - RNA, 61 nt, Human
aagugaagcuggcucaggguggggcugucccuuccaggaguuuugccccuacaagggguua

SEQ ID NO: 423291 - RNA, 61 nt, Human
aggaaauaucuuccucagcaucugagaauuuuuccaggagggagaccuguugguuauugug

SEQ ID NO: 423292 - RNA, 61 nt, Human
ugaaauacugagaugcugggcugucucucccuuccaggaaugcugggcccccagccuggcc

SEQ ID NO: 423293 - RNA, 61 nt, Human
guguagggguggaaugagccgcggggaagcuggcuuugaaaccucagggcugucccagccc

SEQ ID NO: 423294 - RNA, 61 nt, Human
gggcaaaggggaggguucuuggauguggaagggcuuugaacaauguuuagauuuggagaug

SEQ ID NO: 423295 - RNA, 61 nt, Human
aggauucaagggcucagugucaaagauaauuggcuuugacuuuuuguaaucuaggagcagc

SEQ ID NO: 423296 - RNA, 61 nt, Human
ucugcccugccucucccagcucccacaaggguuccaggaauuccugguguucccaggacac

SEQ ID NO: 423297 - RNA, 61 nt, Human
aauaauggaauuuagagaacucuuucaucccuuccaggauggauguugggaaauucccuca

SEQ ID NO: 423298 - RNA, 61 nt, Human
guuucugcgccgucggugggcacuuguuauuuuccaggaaccuucuccuggugucuacaug

SEQ ID NO: 423299 - RNA, 61 nt, Human
agagucagccaugaacggaauaccugcuagguuccaggaaugagcucaccuaacagauagc

SEQ ID NO: 423300 - RNA, 61 nt, Human
ugcucuguacugcacuuagaaugauguaauauuccaggaugcugcugcagguggcguauca

SEQ ID NO: 423301 - RNA, 61 nt, Human
gcaggcccugcagaugacggcagccagcugcuuccaggaaccagguguccaaggccaccuc

SEQ ID NO: 423302 - RNA, 61 nt, Human
uguggcucucaccugcguuuugagucuguucuuccaggaguaauaaauucuggacaucauc

SEQ ID NO: 423303 - RNA, 61 nt, Human
agugggcuuagagggaggaccugaugacugauuccaggauacuuguacuucuaauaacauu

SEQ ID NO: 423304 - RNA, 61 nt, Human
uggauuuuaguuuugugcuuaguuaaaucuuuuccaggaaaaagaacuuccccauacaaau

SEQ ID NO: 423305 - RNA, 61 nt, Human
agagucugaacacuggccugugauugguccauuccaggaccuucauuugcauaagguauca

SEQ ID NO: 423306 - RNA, 61 nt, Human
cagaccugcacucuggccaaugauugguucauuccaggacauucauuugcauaaggaguca

SEQ ID NO: 423307 - RNA, 61 nt, Human
uaugcccaaaucaaccucugaaaaaagguuuuuccaggaagauuuacauuuagguuuaaua

SEQ ID NO: 423308 - RNA, 61 nt, Human
uguaccaacacuugaaagauggguggauauuuuccaggaaacagauuuugggcaggacauu

SEQ ID NO: 423309 - RNA, 61 nt, Human
auucgcuacuaguuauucagagcguacuuuguuccaggaacuaugcuggaaacugauaguu

SEQ ID NO: 423310 - RNA, 61 nt, Human
uuuacuacauaguuauucagagccuacuguguuccaggaacuaugcuagaaacugucucuc

SEQ ID NO: 423311 - RNA, 61 nt, Human
caccuuugaacagaucccggugacauucuauuuccaggaaaauccggaaccugauuuuagu

SEQ ID NO: 423312 - RNA, 61 nt, Human
uguggcuuuggauuuccuuaugugucuuacaggcuuugauagaaggggaggggaggagaga

SEQ ID NO: 423313 - RNA, 61 nt, Human
uaauauucauaaugucgugugcuuaaaagugggcuuugaagugugugcugcuuacuccuuu

SEQ ID NO: 423314 - RNA, 61 nt, Human
cacugauuuucuguggcuccagugagaacaaggcuuugaaacugaacaagauaacuucuag

SEQ ID NO: 423315 - RNA, 61 nt, Human
ggcugugcugaccuccugagcggcagacaccuuccaggagcccugaggguggcaggagcua

SEQ ID NO: 423316 - RNA, 64 nt, Human; identical to SEQ ID NO: 344184

SEQ ID NO: 423317 - RNA, 64 nt, Human
cccacacuuuucuuugaugggagguuucaauaaacagcgauaagaacucuagccaugauguuca

SEQ ID NO: 423318 - RNA, 64 nt, Human
cgcauuuuucuguugagcuaugcagucgucaaaacagcgauagacagcauaggagguuugaagc

SEQ ID NO: 423319 - RNA, 64 nt, Human
caggaucauacagaugaggugaggggaugguuagcagcgauaaacauucucagacccuuggaga

SEQ ID NO: 423320 - RNA, 61 nt, Human
caccuuauucugacuuuuggauuucauggcauuccaggaagcuccuugccaugcuguuggc

SEQ ID NO: 423321 - RNA, 61 nt, Human
aaaagcaugcaucuuagaaauagccccucaauuccaggagucaacaugccaaagaaugagg

SEQ ID NO: 423322 - RNA, 61 nt, Human
cacgguuaaaggcaaugagaaacaagcagaauuccaggaguccuugaagcagagggcacug

SEQ ID NO: 423323 - RNA, 61 nt, Human
guaauuggaucugaauuuaugaaagacccauuuccaggacugaaccuaggucagagcucua

SEQ ID NO: 423324 - RNA, 61 nt, Human
ugcaacugaagaacugcagccaagaccuuaauuccaggaaagcacagaggacaaaguuaau

SEQ ID NO: 423325 - RNA, 61 nt, Human
aucuucuaucaguagcaguauuguuacuucuuuccaggaugcaaggucuauuaucccaaca

SEQ ID NO: 423326 - RNA, 61 nt, Human
guauacacauauuuucacuuuaacucaagaauuccaggagguaauuuguugauauuacaau

SEQ ID NO: 423327 - RNA, 61 nt, Human
uuuuggcccuugcaccagaguaugaaauagcuuccaggagcuccagcuauaagcuuggaag

SEQ ID NO: 423328 - RNA, 58 nt, Human
cugugugcaccaaggucugaaaaaugacuuccaggaaagguaggaugugucuaugguu

SEQ ID NO: 423329 - RNA, 61 nt, Human
auaggauuugaaagcuguuagagaauuuagcuuccaggacuguucaaucuuuuggcuuccc

SEQ ID NO: 423330 - RNA, 61 nt, Human
uggagaagacagcaggagccucucaguucuuuuccaggaaggaacgagggugggagcgaga

SEQ ID NO: 423331 - RNA, 61 nt, Human
gacaacacacaaacgagagggcuuggcucccuuccaggaagauuuauuuaacaggcuccca

SEQ ID NO: 423332 - RNA, 61 nt, Human
agccaagauugguaaagcugcguccuggcgauuccaggagacccagcuggaaaccuggcuu

SEQ ID NO: 423333 - RNA, 61 nt, Human
ugcugucuccgcggaagucagggcggcuggauuccaggacaggagugaauguaaaaauaaa

SEQ ID NO: 423334 - RNA, 61 nt, Human
agugcccuguguggauagacaugugcacuccuuccaggaguggguacugauuccagacucc

SEQ ID NO: 423335 - RNA, 61 nt, Human
ggcucuccaccagcacaucacuaugcaucuguuccaggaaagaagaaaagcgagcgaggaa

SEQ ID NO: 423336 - RNA, 61 nt, Human
aauuuagaaugugaaauucugaccaccuuuuggcuuugaguauuuuccaaaagauauuuga

SEQ ID NO: 423337 - RNA, 61 nt, Human
cauuacuguuucacaaugaagcuuucuuuaaggcuuugauuuuuaugauuaugaaagaaau

SEQ ID NO: 423338 - RNA, 61 nt, Human
auauuggagagcaaggaauguggacuuguauggcuuugaaccaagagaggguuaugagccu

SEQ ID NO: 423339 - RNA, 61 nt, Human
uauaccuuccauuuccaucguauucuccaguuuccaggauagacguugcucaucgucuuua

SEQ ID NO: 423340 - RNA, 61 nt, Human
cccagcuuucacugccagggucccagucagauuccaggaauuugcgcccuaacuuugcuug

SEQ ID NO: 423341 - RNA, 61 nt, Human
gccuaucccugugaagaugaaccucuggcccuuccaggauggaaggagugcaauguaguca

SEQ ID NO: 423342 - RNA, 61 nt, Human
cacugauugcccacccccaccacugcaccauuuccaggagggagaguggggacccucagcc

SEQ ID NO: 423343 - RNA, 61 nt, Human
aguccuuuuguguacuuuuaaaauuguaucuuuccaggagccccucagauuguaccuugcu

SEQ ID NO: 423344 - RNA, 61 nt, Human
uuuggcauauagucaucuauagggggauugguuccaggauccccugcagaugccaaaauac

SEQ ID NO: 423345 - RNA, 61 nt, Human
guccagacuguggguguagauuaccugccacuuccaggagcccagagggccaagagagaca

SEQ ID NO: 423346 - RNA, 61 nt, Human
auggagcugaucaaggucauguuucucacuguuccaggaaauugaucaacucuuccaaugg

SEQ ID NO: 423347 - RNA, 61 nt, Human
gagauucuggguuugcccaguccuggguuguuuccaggagaaagccgggggaggggcccuc

SEQ ID NO: 423348 - RNA, 61 nt, Human
gguaauauaaaggacuaggaagcagucauacuuccaggaaaugcuuggauucauguggaca

SEQ ID NO: 423349 - RNA, 61 nt, Human
uauuuuguccgucuuuugauguacuuucugauuccaggauuggauauuuauucaaggacua

SEQ ID NO: 423350 - RNA, 61 nt, Human
ggggugggaugggcuggugagaaaguucaaauuccaggaagccacuuuuuauuggauauaa

SEQ ID NO: 423351 - RNA, 61 nt, Human
uuuggacuucggacaccuccacuggggacucuuccaggauggguuggagaggaguaacuuu

SEQ ID NO: 423352 - RNA, 61 nt, Human
cccaacccucagaugcuucacuucuuuggaauuccaggacucucaauggggggacgggaug

SEQ ID NO: 423353 - RNA, 61 nt, Human
gggcaagucucuguacuuuucuggccagcuuuuccaggauuuauaaaauuagagcuucggc

SEQ ID NO: 423354 - RNA, 61 nt, Human
cucuccuuuuucugggucccuucccacuuccuuccaggaccuccauuggcuccuagaaggg

SEQ ID NO: 423355 - RNA, 61 nt, Human
ccuaaucuuccuagcccuucaggcuagaguaggcuuugauccugagaaccuugcuguugcu

SEQ ID NO: 423356 - RNA, 61 nt, Human
uaaggaagggaaagauugucauagaugguagggcuuugaaaaugcaggguaucagcugcca

SEQ ID NO: 423357 - RNA, 61 nt, Human
cuuguauuaaauccuugauuuuuucccauuuggcuuugaugcccuugauccauuguuuccu

SEQ ID NO: 423358 - RNA, 61 nt, Human
caaguucaagacuuaacucaggguucaggucuuccaggaggccuuacuuaugucgucaguc

SEQ ID NO: 423359 - RNA, 61 nt, Human
ggcuccuugugaggaaaccuugaacauuuccuuccaggaaugaaagagaaccucguccuca

SEQ ID NO: 423360 - RNA, 52 nt, Human
cagguuugggaagcaauugaauuuccaggaaauauccauccaugaauuaugc

SEQ ID NO: 423361 - RNA, 61 nt, Human
uauagggaggauaccagcaggcccuuaagccuuccaggacacuaaggucgugggagcggga

SEQ ID NO: 423362 - RNA, 61 nt, Human
uucuccuagggcucaaacuacucucuauugguuccaggauaaugacaaauugaaccauaug

SEQ ID NO: 423363 - RNA, 61 nt, Human
cuagcuuuauaaucaguauaaauuuuaauuauuccaggaauaugcauaauauugaaauauu

SEQ ID NO: 423364 - RNA, 61 nt, Human
ucuuuuaagaugucccacauggaagacgcuauuccaggaucuuuaaauuuccauggaugca

SEQ ID NO: 423365 - RNA, 61 nt, Human
ugcucuggugcacgccugagcguccuccaucuuccaggauggcagcaauggcgcugugcgg

SEQ ID NO: 423366 - RNA, 61 nt, Human
aaaagguaaaaugguaaucaaauagauuguguuccaggaaugcaaagguggcuuaauauuc

SEQ ID NO: 423367 - RNA, 61 nt, Human
gagacucuaaaauauagccaccagugcuuuguuccaggaguuuggugacaaaguuuugguu

SEQ ID NO: 423368 - RNA, 61 nt, Human
cgcuggucuuggggacgggaagggaacccucuuccaggagcucuaaggguacuugggaauc

SEQ ID NO: 423369 - RNA, 61 nt, Human
gaggaggccugggaguugacauucagcacucuuccaggaauaggacccccagugaggauga

SEQ ID NO: 423370 - RNA, 61 nt, Human
cugcccaggcucugcugacuucugagcaguuuuccaggaggccggggggagcaggaggagg

SEQ ID NO: 423371 - RNA, 61 nt, Human
gggagcucccagcgcagccguggcagccaccuuccaggagcaggggcuggaauguccugug

SEQ ID NO: 423372 - RNA, 61 nt, Human
caggcaggcaggagguccuguuagcccugccuuccaggaagguuggggugggaguuuugag

SEQ ID NO: 423373 - RNA, 61 nt, Human
ccaugccccguaagagguggaagacgcuuccuuccaggacagcaggcuuugaguccagcac

SEQ ID NO: 423374 - RNA, 61 nt, Human
aggagcugauggcagcuggggcuaggggaagggcuuugaggguggaaggaugggauggguu

SEQ ID NO: 423375 - RNA, 61 nt, Human
uaguugaauuccaaguguauuuuaaaauagaggcuuugagcaacuaacuaaccacauuuua

SEQ ID NO: 423376 - RNA, 61 nt, Human
ugcucgcugcauugugguguucucuucucaaggcuuugaaaucuccccuugcacugagauu

SEQ ID NO: 423377 - RNA, 61 nt, Human
cuucauaaacacucaccuggcuggcuuugccuuccaggaggaagcuggcugaagcaagggu

SEQ ID NO: 423378 - RNA, 61 nt, Human
uuccauuucucuucuuugaccgugcuaggaauuccaggaaagugcauuccugcccugguga

SEQ ID NO: 423379 - RNA, 61 nt, Human
cggcgcggccagguagggcccgagcuucagcuuccaggaugcuucucuggaaccucaaggc

SEQ ID NO: 423380 - RNA, 61 nt, Human
aaggcaaaugucuuuucuucgcagaauuguuuuccaggaugccaguggauucagauagcaa

SEQ ID NO: 423381 - RNA, 61 nt, Human
uugggaagucugcuuuggaaagaagggggaguuccaggagguggugcgagccuucgaacua

SEQ ID NO: 423382 - RNA, 61 nt, Human
uuuguaauuauagauuugcuuggacaaaauauuccaggaacucauagcgagcucaaagcaa

SEQ ID NO: 423383 - RNA, 61 nt, Human
cagcuucaaagcuuaaaaagagcucaggcuuuuccaggaagauccaggagggcuaauuaga

SEQ ID NO: 423384 - RNA, 61 nt, Human
cauaauggucuucucugcuguuccuugaacauuccaggaacauuccccccauccccucgug

SEQ ID NO: 423385 - RNA, 61 nt, Human
acaaugcaguagccagcacguucgaggcgguuuccaggaagagugugcuugucaucugcca

SEQ ID NO: 423386 - RNA, 61 nt, Human
uaauauguaucgccuuagagcaagagcuguguuccaggaaccagaucacgauuuuuagcca

SEQ ID NO: 423387 - RNA, 61 nt, Human
agcuaaguccuggguuccgucugauuuuagguuccaggaacuuccugagaacacccgaucg

SEQ ID NO: 423388 - RNA, 61 nt, Human
gcauaguauuacugacucaguaaagagcuauuuccaggagugaggugucuuugaguccuuu

SEQ ID NO: 423389 - RNA, 61 nt, Human
aauuguuagauuucuuccaugcauguauguguuccaggaauguuaaugagaugguauugua

SEQ ID NO: 423390 - RNA, 61 nt, Human
aaaugaugucauagcucacuugcuaugcugcuuccaggauuuuguuauaugcugaggugua

SEQ ID NO: 423391 - RNA, 61 nt, Human
gauggaaaguggaagacauauaccaauuauauuccaggaaaaaauacuuuaauaguauugu

SEQ ID NO: 423392 - RNA, 61 nt, Human
uggcugcuuuuccucaaccuuuccuaccagauuccaggaggcagaagauaacuaauugugu

SEQ ID NO: 423393 - RNA, 61 nt, Human
uaucauagaguugaaucacaaugagaccguuggcuuugaauuugagucguugguucccaug

SEQ ID NO: 423394 - RNA, 61 nt, Human
gcuagcagucaucaggggagacacccugcggggcuuugauucuacagaucuuucucaaagg

SEQ ID NO: 423395 - RNA, 61 nt, Human
gucugcuaagauucacauccauagcccccauggcuuugaggagaauccucucugccauucu

SEQ ID NO: 423396 - RNA, 61 nt, Human
cugggguggcccaccgcauggguacaggggguuccaggaauccaaauccagcauggcuugg

SEQ ID NO: 423397 - RNA, 61 nt, Human
gucauggaaggaucauuuaugcagguagucauuccaggaguuuuuggucuuuucugucuca

SEQ ID NO: 423398 - RNA, 61 nt, Human
cugaaagaucucugucacauccaacuggaaauuccaggaaccaaaaagagcaucccuaugg

SEQ ID NO: 423399 - RNA, 61 nt, Human
accuccacaaugugaauuuucugaaucccuauuccaggauuucugggaauaauguuuacuu

SEQ ID NO: 423400 - RNA, 61 nt, Human
aagagacaaaaucauuggcagugcaaucucuuuccaggauuucguuugcuguggcauuggu

SEQ ID NO: 423401 - RNA, 61 nt, Human
cggcucucucaugaccagcucucugccucccuuccaggaggcuccaucccacacuguucac

SEQ ID NO: 423402 - RNA, 61 nt, Human
uuguuguuagggauaguacuaagcauuucaguuccaggagaauaaaagaaauuccuauuug

SEQ ID NO: 423403 - RNA, 61 nt, Human
aagaguuuaaacaaaaaacccacaauugaacuuccaggaaagugugaagacccaaaacagc

SEQ ID NO: 423404 - RNA, 61 nt, Human
ugaaagauuuuuguaaaaagucaguauuuauuuccaggaaaagccugaccuugcuauuuga

SEQ ID NO: 423405 - RNA, 61 nt, Human
ugcaugagacacacaccuacccuccccagcuuuccaggaacccuacuggcugccagacuga

SEQ ID NO: 423406 - RNA, 61 nt, Human
cugcagggagcuaugggguacauuccuugauuuccaggauaguuuuucaaauaggaaagca

SEQ ID NO: 423407 - RNA, 61 nt, Human
gcaguugugauuucuguggaucccagcuugguuccaggaauuuugugugauuggcuuaaau

SEQ ID NO: 423408 - RNA, 61 nt, Human
auaguggaagaggagagcaugaagcaaagaauuccaggaaacccaagaggcugagaauucu

SEQ ID NO: 423409 - RNA, 61 nt, Human
caggagggcaugugcagacacucaagagcccuuccaggagugggucgcccacggguguggc

SEQ ID NO: 423410 - RNA, 61 nt, Human
ccaggccucaucuuucauggaccaggccuuguuccaggaguggguguuggguccucugcuu

SEQ ID NO: 423411 - RNA, 61 nt, Human
cuuagguaaucauuccagguguguucaguaguuccaggacucagggacucaggccagucac

SEQ ID NO: 423412 - RNA, 64 nt, Human
ucucagcugccaucuccagugccccagaaugguacagcgauaauaaaauguauuucagaaagca

SEQ ID NO: 423413 - RNA, 64 nt, Human
acaagccaaaugaacagacaaguaaaagacaugacagcgauacuuucccagagcugaaguuaac

SEQ ID NO: 423414 - RNA, 64 nt, Human
uuuuacauuuuucaagaacggauuuccuggaauacagcgauauaauuuugguugucaaauuccu

SEQ ID NO: 423415 - RNA, 61 nt, Human
uauuguauauuuauucaacaacuguuuauguuuccaggacaacugcaaagaaaacaagcug

SEQ ID NO: 423416 - RNA, 61 nt, Human
uauauuggcccagcaaggcaaagaacugaaguuccaggauggaagaaccuguguucuccuc

SEQ ID NO: 423417 - RNA, 61 nt, Human
uuuaaaaaagcaaaauaauaagaaggaaaaauuccaggagggaaaaugaauugucuucacu

SEQ ID NO: 423418 - RNA, 61 nt, Human
gucuagaagauggguaucaaaacagaagacauuccaggagcuagcaauuuuaagagguguc

SEQ ID NO: 423419 - RNA, 61 nt, Human
uucagauguucuguucccuauagagggccuauuccaggaucuaaaugaaugggaauuuaua

SEQ ID NO: 423420 - RNA, 61 nt, Human
acuuuagcuuuuccuuccauccgguggccuauuccaggaauuccucuuuugcuuaaaucag

SEQ ID NO: 423421 - RNA, 61 nt, Human
agcugagcuuaaaggcccuggguccugccaguuccaggagggccaugucugugccucugug

SEQ ID NO: 423422 - RNA, 61 nt, Human
augcuaagagcucacaaaaauaagauagaauuuccaggacaaacaucuuuggaauugugag

SEQ ID NO: 423423 - RNA, 61 nt, Human
agucuguauuuuccaccuuuuguuuuuccaguuccaggacacagauuaucaacugggggga

SEQ ID NO: 423424 - RNA, 61 nt, Human
cagccagguuucuccgugcucacuaauuuauuuccaggaagguguguggaagacaugagcc

SEQ ID NO: 423425 - RNA, 61 nt, Human
uagccuuugaagucaacacaaaguuuaaaacuuccaggauuuugcaaaguuguauauauuu

SEQ ID NO: 423426 - RNA, 61 nt, Human
uuugaaaucucaggacucuucuggccguagguuccaggaaagcucguggaagcuuuggggc

SEQ ID NO: 423427 - RNA, 61 nt, Human
augcuaauagauccacugaagaucuggaaaauuccaggaacuuuucaccugagccuuucuu

SEQ ID NO: 423428 - RNA, 61 nt, Human
auugguuaagugaaaaccagaacucaaaauauuccaggagagaagauaacauuuacaagua

SEQ ID NO: 423429 - RNA, 61 nt, Human
cagaaaucagggcacuugcauccauugccuuuuccaggaaagggaagaaaacacucaguug

SEQ ID NO: 423430 - RNA, 61 nt, Human
acuucacuuaaccccucagcuaugaaaaggcuuccaggaguuuccaugaaauaacaaaaaa

SEQ ID NO: 423431 - RNA, 64 nt, Human
ccauuuggagacauuccauuucagauuugucaaccagcgauaggccacauuccaguaagaacuc

SEQ ID NO: 423432 - RNA, 64 nt, Human
uucauugaccucuacuugcugaaggagaaaaagacagcgauaagcuuucaauaguggcauacca

SEQ ID NO: 423433 - RNA, 64 nt, Human
aacuuguagacuaaaccaaguauuguaaaauaaacagcgauaacagugauaguuuuuaacucua

SEQ ID NO: 423434 - RNA, 61 nt, Human
aggccuagaagagaaacugagagcucucucauuccaggaagccuuuucccuaguggaacau

SEQ ID NO: 423435 - RNA, 61 nt, Human
agaagggaugcaugggcuuuuuggccaguguuuccaggaggcucugggcuuccugcuucuu

SEQ ID NO: 423436 - RNA, 61 nt, Human
uuuuucaaaguaggauuuccuuuuucaacuguuccaggaaagaaucucuaagacuggguag

SEQ ID NO: 423437 - RNA, 61 nt, Human
aaaacucugucucaaaaaaaaaaaaaauggcuuccaggacagagcaugcucauuugcuggc

SEQ ID NO: 423438 - RNA, 61 nt, Human
ccagcucauugcaaagcgaacauccucuccuuuccaggagccccaggauuagcaucugaaa

SEQ ID NO: 423439 - RNA, 61 nt, Human
guugcauugcagguaagucugguuuugucccuuccaggaggacauagccugcaaagcuggu

SEQ ID NO: 423440 - RNA, 61 nt, Human
cuccugcucggugcuguggcucaacaaugccuuccaggauguggagucagagaacgucaac

SEQ ID NO: 423441 - RNA, 61 nt, Human
auuaguguuugaaauugaauugggaauguuguuccaggauguggaaugcagccgugaucac

SEQ ID NO: 423442 - RNA, 61 nt, Human
acccuggagugagccccaggccaggaggcuguuccaggaguccugcccagcagccucagug

SEQ ID NO: 423443 - RNA, 61 nt, Human
uaaaccuuugauaccuagaucaggaauacucuuccaggaguacaaaauuacauuauugaua

SEQ ID NO: 423444 - RNA, 61 nt, Human
ugccauuccuauuuucuaauauaaaacucuuuuccaggaagcaugcuuaagcaucuuguua

SEQ ID NO: 423445 - RNA, 61 nt, Human
aggagguccccccuccauaaggacgucaaacuuccaggagggccaguguuccuaguguggg

SEQ ID NO: 423446 - RNA, 61 nt, Human
aaagucauaccuucgaggugguagcaguagauuccaggaggagaaggguacuugcuaggua

SEQ ID NO: 423447 - RNA, 61 nt, Human
aaauucuagaagucagucagguuuuaauuuauuccaggaggggcauccucgacaucuuaug

SEQ ID NO: 423448 - RNA, 61 nt, Human
guccugggaagcgcucuccuagcacguccauuuccaggaggagaagcaagcagaugagagg

SEQ ID NO: 423449 - RNA, 61 nt, Human
agggguucugccuguucccaaacuuuuuccauuccaggaacaaaggagaagccacuuuccc

SEQ ID NO: 423450 - RNA, 62 nt, Human; identical to SEQ ID NO: 348569

SEQ ID NO: 423451 - RNA, 62 nt, Human; identical to SEQ ID NO: 348570

SEQ ID NO: 423452 - RNA, 62 nt, Human; identical to SEQ ID NO: 348571

SEQ ID NO: 423453 - RNA, 61 nt, Human
gccugugaagaccauccacuggaacggguccuuccaggaggcagccuuucccggggagacc

SEQ ID NO: 423454 - RNA, 61 nt, Human
uuaguuaaauuggauugagaaugccuuuuguuuccaggaaaauauugaucaccaugaaaga

SEQ ID NO: 423455 - RNA, 61 nt, Human
uuuggaaagguggcuggagagagcugaggauuuccaggacuuuguaaguucuuauucuggg

SEQ ID NO: 423456 - RNA, 61 nt, Human
cggcaaaaauagacccagcuucugcaagguuuuccaggaaaaucugcuuggggcagcauuu

SEQ ID NO: 423457 - RNA, 61 nt, Human
cauugucccucucugugcucaaggaguuccauuccaggaggaagagaucuauacccuaagc

SEQ ID NO: 423458 - RNA, 61 nt, Human
auaccugcagaagggcuacaccacgcugcuguuccaggagggggauuucuacugcuccuac

SEQ ID NO: 423459 - RNA, 61 nt, Human
gucuccagugugagucaugcucccccaggaguuccaggagaacucagccugcaggugacaa

SEQ ID NO: 423460 - RNA, 61 nt, Human
cagcugauggugagcugacaguguccacagguuccaggaccauuugagauuggaagcuaca

SEQ ID NO: 423461 - RNA, 61 nt, Human
gggccuugggagaguuuaaggcaccugcugguuccaggaccucgcuuuccaucuguucuug

SEQ ID NO: 423462 - RNA, 61 nt, Human
gcaguggggugcuuggcagcuguucuguguuuuccaggaauccaacugagcauugaaaucu

SEQ ID NO: 423463 - RNA, 61 nt, Human
gugugucugauaacccaaagcagcgggcagauuccaggaaugaagaauuaggcuugguuuc

SEQ ID NO: 423464 - RNA, 61 nt, Human
cuugacuacacaacauaaaucacuuuuuaaauuccaggaacggguagucugacacggugau

SEQ ID NO: 423465 - RNA, 61 nt, Human
caaguagagauuacacccagaacaccauuccuuccaggagcaguaggugggagguuugacc

SEQ ID NO: 423466 - RNA, 61 nt, Human
gagguuugacccagagaagccaauccuugcauuccaggaguggccugugccucccaccucu

SEQ ID NO: 423467 - RNA, 61 nt, Human
ggagcaggucucuggcagagaaggauguccguuccaggagcacacggcccugccccauccu

SEQ ID NO: 423468 - RNA, 61 nt, Human
gccucgugccccugccuccuggagcuucccauuccaggagaaaaggcuccacuucccagcc

SEQ ID NO: 423469 - RNA, 61 nt, Human
caacuuuugaaaacagauaguuaugacucaaggcuuugagaauguaaagagaccaccuuca

SEQ ID NO: 423470 - RNA, 61 nt, Human
aaugcaacgcuguaauauggcuguaucagagggcuuugaaaacauacacugagcugcuucu

SEQ ID NO: 423471 - RNA, 61 nt, Human
caacuuuugaaaacagauaguuaugacucaaggcuuugagaauguaaagagacgcccuuca

SEQ ID NO: 423472 - RNA, 61 nt, Human
ucuccaugggggcaaggagcauagagauguuuuccaggaaggggcucagaagcugcacuag

SEQ ID NO: 423473 - RNA, 54 nt, Human
uggaagugacgcaguuuuaaggaauuccaggagcugacugccgaucaaugagcc

SEQ ID NO: 423474 - RNA, 61 nt, Human
cagugccgugguggccaaccggacccaggccuuccaggagcaggagcaggggcaggggcag

SEQ ID NO: 423475 - RNA, 61 nt, Human
uaagaaaacagaauauucaaaaacagcacuuuuccaggaaguuagugaggaagauaaggca

SEQ ID NO: 423476 - RNA, 61 nt, Human
aacuugaucaacgcgacuguauuuugaaacauuccaggaagguuacuucuugucaaacuug

SEQ ID NO: 423477 - RNA, 61 nt, Human
uucuacuuaaugggaagggaagaacauuuguuuccaggaugacuuucuggccagaauaccg

SEQ ID NO: 423478 - RNA, 61 nt, Human
aaccucuagacagggaacagcuucaggauacuuccaggagacagagccaccagcagcaaaa

SEQ ID NO: 423479 - RNA, 61 nt, Human
uuccauauaaauuguuuauucaaccaucagguuccaggaaaaagccuguuaguauuuucau

SEQ ID NO: 423480 - RNA, 61 nt, Human
cagucucacuuguggccuauuucucugcuucuuccaggaauuugcuuuuauuagucaagua

SEQ ID NO: 423481 - RNA, 61 nt, Human
uagaggaagaaaugggaaucuuuuuuuucucuuccaggagucaguggaagaauaguucucu

SEQ ID NO: 423482 - RNA, 61 nt, Human
ugggcaaggccugccucggggaacuagaaccuuccaggaucuggagcccgggagagccaca

SEQ ID NO: 423483 - RNA, 61 nt, Human
cugaugauauccuauccucuccaagcuccuauuccaggaaaaaagauccaauguuuuuucu

SEQ ID NO: 423484 - RNA, 61 nt, Human
cauuugacauaagcaauuuaccuccccacauuuccaggaccucuaugacacuucaucagau

SEQ ID NO: 423485 - RNA, 61 nt, Human
gucugcuucaagaggggguuuuacacucugauuccaggacaagcacucugaggcggguggg

SEQ ID NO: 423486 - RNA, 61 nt, Human
cucugagaagcccucuucuucccccaccccuuuccaggagaaggggcugccccuccaagcc

SEQ ID NO: 423487 - RNA, 61 nt, Human
agaggcuucucaucugccuugguccugaguguuccaggagcucuuugguuuggcuucuuuu

SEQ ID NO: 423488 - RNA, 61 nt, Human
ugaugcaagccccucuucuuaaccguuucuuggcuuugagcccagaaacacagcucucccu

SEQ ID NO: 423489 - RNA, 61 nt, Human
auauucuuuaaguuaguugcucacacacuuaggcuuugauugcugaagaaguauguuuaag

SEQ ID NO: 423490 - RNA, 61 nt, Human
uguuauguuacccaagggauaaacuugaacuggcuuugaacauccuuuaggucauuuucuc

SEQ ID NO: 423491 - RNA, 61 nt, Human
cagcucauccgcccucuguugcucccuagcauuccaggagccaucuuggacucuccucccc

SEQ ID NO: 423492 - RNA, 61 nt, Human
ugcagcuuggagcguggagguccugccuagauuccaggaaguccagggcgauacuguuuuc

SEQ ID NO: 423493 - RNA, 61 nt, Human
acugaagcagauugauccguuugauuuuuauuuccaggaggaagacuagugguggauucca

SEQ ID NO: 423494 - RNA, 61 nt, Human
ugucccccguuugccuccacgagccugcuguuuccaggaaauuacauaacguucaguuggg

SEQ ID NO: 423495 - RNA, 61 nt, Human
caccaaacuaauaaaacuuugacgagucaccuuccaggaccccuggguagaaggcagcagu

SEQ ID NO: 423496 - RNA, 61 nt, Human
ggcccuagcuuuggaacgaggaauugggagauuccaggagucaggguagagaauuucugag

SEQ ID NO: 423497 - RNA, 61 nt, Human
cagcugccaucagagggcuggcaguagggaguuccaggagcggggacuucucgggaaaauc

SEQ ID NO: 423498 - RNA, 61 nt, Human
ggagcugugcugauguugggaacuuaucuuuuuccaggauccauaacauuuaggggaauua

SEQ ID NO: 423499 - RNA, 61 nt, Human
ccccauucccugccccagcacuucccagccuuuccaggagcucugccccaccccuacucaa

SEQ ID NO: 423500 - RNA, 61 nt, Human
ugcggauuuggagaagggagcggggcaggacuuccaggaggaccccaacccggcccggaga

SEQ ID NO: 423501 - RNA, 61 nt, Human
agaggcgagcuccuugaagaaggggcuguucuuccaggaggccuuauuuugaacugccuca

SEQ ID NO: 423502 - RNA, 61 nt, Human
ucuccccacucugauccccugacucuccagcuuccaggaagguuccuucucagagccaaau

SEQ ID NO: 423503 - RNA, 61 nt, Human
uccuucuccuccugucuuuaaagccugccucuuccaggaagaccccccuauugcugcuggg

SEQ ID NO: 423504 - RNA, 61 nt, Human
uaaucugagguguugcuacuagacugaggguuuccaggaguaguacuaugacaucauguaa

SEQ ID NO: 423505 - RNA, 61 nt, Human
auauaugaguuaaaugaccaagcagacuugauuccaggaauguuaaggaauguucauuauu

SEQ ID NO: 423506 - RNA, 61 nt, Human
auauauacacacacacacacauacacaaauauuccaggauacaaaaaaaaacauuuaaaaa

SEQ ID NO: 423507 - RNA, 61 nt, Human
acuuucugcuggaagcugucaggcugggacaggcuuugauuuugaggguuagcaagacaaa

SEQ ID NO: 423508 - RNA, 61 nt, Human
uuuuuuuuaauauagaaucugaggcuguuugggcuuugacuuaaauuuccaucaggccucu

SEQ ID NO: 423509 - RNA, 61 nt, Human
uuuuuggcuauuuuauauuuaguguacacagggcuuugaaauauuaauuuacauaaaggcc

SEQ ID NO: 423510 - RNA, 61 nt, Human
gcugaagaaagauaaggcuuugaugggccacuuccaggaugggcuguccuacucuguuuuc

SEQ ID NO: 423511 - RNA, 61 nt, Human
gcugggccgucuggcugccaggaagaagauauuccaggaaccuaagagcgcacaccaggug

SEQ ID NO: 423512 - RNA, 61 nt, Human
gccccuuggaucugagaugguuuuugcaucuuuccaggagagccucacauucuucuuccag

SEQ ID NO: 423513 - RNA, 61 nt, Human
ugaugcagucuaguacgaguauugcaucuaauuccaggagcauuguuuuaaguugauugac

SEQ ID NO: 423514 - RNA, 61 nt, Human
uggaguuuuuuuucauucauauuuuuguuguuuccaggaauuuauuugauauuaaugggcg

SEQ ID NO: 423515 - RNA, 61 nt, Human
uaugaacuaauuuucuggucuauaugacuucuuccaggagggccuaauacacaggaagaag

SEQ ID NO: 423516 - RNA, 61 nt, Human
ggcucagcagugaugggagaacagaggacaguuccaggauaaacugcugccuggggcugug

SEQ ID NO: 423517 - RNA, 61 nt, Human
aucagucaccccgaaucuuggaaaaacccccuuccaggagaggaugggcaggcauuuaaaa

SEQ ID NO: 423518 - RNA, 61 nt, Human
uguuuuguccccaacccuagggcuucucugauuccaggauacauuacuuuagcugaacuca

SEQ ID NO: 423519 - RNA, 61 nt, Human
uggcaaaauaguggagaacgcaggacacaguuuccaggacauggccguggaggugggugcg

SEQ ID NO: 423520 - RNA, 61 nt, Human
uguuugaaugcugccuccauuauauagguccuuccaggaacucaaacacuguaagugaaau

SEQ ID NO: 423521 - RNA, 61 nt, Human
cauccaggacuacgaggcggccaaggcucuguuccaggaaauucuugaagaguauaaugaa

SEQ ID NO: 423522 - RNA, 57 nt, Human
uucguacuuugggacuuugauagcaacuuccaggaaugucacacacgaugaaauauc

SEQ ID NO: 423523 - RNA, 61 nt, Human
ccaaacagaacuauggaaaaaaaggaagaaauuccaggaaaaucugcacugugggcuuuua

SEQ ID NO: 423524 - RNA, 61 nt, Human
uggcugcagaacuccuuugcagaaacugggguuccaggagccuggcaccuuuaugucaaca

SEQ ID NO: 423525 - RNA, 61 nt, Human
aaauccugguugcagaguaguuuuuuguuuuuuccaggaggcuaugucucuaauucacuuu

SEQ ID NO: 423526 - RNA, 61 nt, Human
caauacuauuuauuaugcucaaauauaucuuggcuuugaccuuauuucaacacauucuaag

SEQ ID NO: 423527 - RNA, 61 nt, Human
ggucaccuccucccugcucgcugacaucuggggcuuugacccuuucuuuuuuaaucuacuu

SEQ ID NO: 423528 - RNA, 61 nt, Human
cccugcugcugaguggagagaggccucauccggcuuugacccaccauccguugcagaagcc

SEQ ID NO: 423529 - RNA, 61 nt, Human
caauuguuucaaccaguuugaaccaagaacuuuccaggaaggcuaaagggaaaccgaauuu

SEQ ID NO: 423530 - RNA, 61 nt, Human
ucacuguugggagcuuuuagaugagacaucuuuccaggaguagaaggguuaguauggaauu

SEQ ID NO: 423531 - RNA, 61 nt, Human
uccuuccccccccccaccccgagauacgggguuccaggaaaggggagggguagcgggggag

SEQ ID NO: 423532 - RNA, 61 nt, Human
cucucccccucacccccuguggacaucacgguuccaggaacagcccuucccccaccacugg

SEQ ID NO: 423533 - RNA, 61 nt, Human
cacugacguggucaguuagacauacguugguuuccaggauagaggcccauauauccugggg

SEQ ID NO: 423534 - RNA, 61 nt, Human
ucaauauuuaguaaagcuuuucuuuuuuaauuuccaggaaaaaauaaaaagaguaugaguc

SEQ ID NO: 423535 - RNA, 61 nt, Human
caggcaggaaggcaugugaguguacguuuucuuccaggagacaucaggucccccuggauuc

SEQ ID NO: 423536 - RNA, 61 nt, Human
aggugcagaugaccaggagugugugaaugccuuccaggagguggcuuuguuccgugccucc

SEQ ID NO: 423537 - RNA, 61 nt, Human
agagcacaguaguucagaaacuauuuagagcuuccaggauauauuucacagcuucaggcau

SEQ ID NO: 423538 - RNA, 61 nt, Human
gagcugcugcccugggcagaggggaggagaauuccaggacaagagugucaaggacagggau

SEQ ID NO: 423539 - RNA, 61 nt, Human
gggugcucuccccaccacuacccuuguaaacuuccaggaagauugguugaaagucugaaua

SEQ ID NO: 423540 - RNA, 61 nt, Human
uauuucagauuuuauuugugugacuuagaaauuccaggaacacaauuaggauauuuucaua

SEQ ID NO: 423541 - RNA, 61 nt, Human
uaucuuuuugcuuucuuuggaguuaguguuauuccaggauauuuuacuuaaucuaaaaguu

SEQ ID NO: 423542 - RNA, 61 nt, Human
ggaucucuuguucuuuaauuuuagggucuuguuccaggacucaaaucaguaacuuggugau

SEQ ID NO: 423543 - RNA, 61 nt, Human
caguuagcacuucaacauagcucuuaacaacuuccaggauauucacacaacacuuaggcuu

SEQ ID NO: 423544 - RNA, 61 nt, Human
cuaacacuguuuugauuuuugugggaaaauauuccaggaaacgcuaauucucuuuagacuc

SEQ ID NO: 423545 - RNA, 62 nt, Human; identical to SEQ ID NO: 348572

SEQ ID NO: 423546 - RNA, 62 nt, Human; identical to SEQ ID NO: 348576

SEQ ID NO: 423547 - RNA, 62 nt, Human; identical to SEQ ID NO: 348577

SEQ ID NO: 423548 - RNA, 61 nt, Human
uuuguuuuuaauuuuaaccauagugcacauauuccaggaaagugucuuuaaaaacaaaaac

SEQ ID NO: 423549 - RNA, 61 nt, Human
augcacaguggaaaguccugaacuccuggcuuuccaggagacauauauaggggaacaucac

SEQ ID NO: 423550 - RNA, 61 nt, Human
gucauugacuucaagaugccucuucuaccucuuccaggaagcacaggccaggggaucuggg

SEQ ID NO: 423551 - RNA, 61 nt, Human
gccacgcccgcgcgcccugagcgcagcuggguuccaggagacucucagcucagcugagcua

SEQ ID NO: 423552 - RNA, 61 nt, Human
gccauauuuccaagucugugguacuccaggauuccaggaguaagccuguagaagagauuua

SEQ ID NO: 423553 - RNA, 61 nt, Human
ugcaugagucacgcaauguucugguccuggauuccaggaguagaggaccuagcuuuaaauc

SEQ ID NO: 423554 - RNA, 61 nt, Human
ugcagucugagcuuaggcacacacaggaggguuccaggacuuucugaacaucugauucugu

SEQ ID NO: 423555 - RNA, 61 nt, Human
aauaaaagcuaugagacaaauaguccucuaguuccaggaaacacagucuuuuuuuaaaaaa

SEQ ID NO: 423556 - RNA, 61 nt, Human
auggaucuuuagauggaugaccaccugaccauuccaggacaauuuuuggucccauuuugag

SEQ ID NO: 423557 - RNA, 61 nt, Human
cccaggacagccuguggccuuugugagccaguuccaggaaccacacuucuguggccaucuc

SEQ ID NO: 423558 - RNA, 61 nt, Human
caggagccacuuaagagauuauugugcuguuuuccaggaaagcugcagcuagaaaaugguc

SEQ ID NO: 423559 - RNA, 61 nt, Human
gccucgcgggucuccucagcaucagacgggcuuccaggaccgcagcaggcaggccccagcg

SEQ ID NO: 423560 - RNA, 61 nt, Human
uccagugccaaaaugagcuuaaaaucuuuguuuccaggaauuagcuaacuuggauuugugg

SEQ ID NO: 423561 - RNA, 61 nt, Human
ugccccacuucagggcugcugugagauggaauuccaggaaagaacuucaggugucuggacc

SEQ ID NO: 423562 - RNA, 61 nt, Human
aagauuuuuccucuugccuuacacauggagguuccaggaaaccucuugcagaacuucacac

SEQ ID NO: 423563 - RNA, 61 nt, Human
aaacuacaaagacaguaaaaagaucagugauuuccaggagcugcaagggcagugagaggaa

SEQ ID NO: 423564 - RNA, 61 nt, Human
agcucaggacuugauacccucugagaugaguggcuuugagugacaugcuaacagcaauuuc

SEQ ID NO: 423565 - RNA, 61 nt, Human
uugcugucuccauccgucuuuaaugggucagggcuuugauuuccaagggucuucaggugau

SEQ ID NO: 423566 - RNA, 61 nt, Human
ccacucugccagacacccugacacccacccaggcuuugaagagcauggagggggagccuca

SEQ ID NO: 423567 - RNA, 61 nt, Human
aggugugcaccagacuccuauuagccccuccuuccaggagcuagaaccagggagguccuga

SEQ ID NO: 423568 - RNA, 61 nt, Human
uagcagcucgagaagacuaaggcagaugggcuuccaggacuggcccagaccagccagggcu

SEQ ID NO: 423569 - RNA, 61 nt, Human
cucccaccagcagcccggucagacugaaguguuccaggacaugcugcccaugccaggagau

SEQ ID NO: 423570 - RNA, 61 nt, Human
uugccagagucuuccccuugcucauccucauuuccaggacacugucauuuuaguggucuga

SEQ ID NO: 423571 - RNA, 57 nt, Human
gccccagcacagcccacugagaagagcuuccaggacgcacccaggacgcugagccca

SEQ ID NO: 423572 - RNA, 61 nt, Human
agucauacacuuuaaaaaaaaaaaaaacuuuuuccaggaaaauauauugaaaucaugcugc

SEQ ID NO: 423573 - RNA, 61 nt, Human
augugugagcuuggagcccaagaacaaaguuuuccaggaggccuugcggaacaucgggggc

SEQ ID NO: 423574 - RNA, 61 nt, Human
aaugaagauuuaaagacagagcaggagcuucuuccaggaguucugagccuugguuguggac

SEQ ID NO: 423575 - RNA, 61 nt, Human
auugugugugagacugaguauguguucuuuuuuccaggaaaggcuccagugguucuuacuu

SEQ ID NO: 423576 - RNA, 61 nt, Human
caaagcugcaaguggauucuagugcugagucuuccaggaaaaaaucccguuuggccaccgu

SEQ ID NO: 423577 - RNA, 61 nt, Human
cugaacaaacuaugcaauaccaccugcucccuuccaggagcauuuuaauaaaagauuuuuu

SEQ ID NO: 423578 - RNA, 61 nt, Human
ugcccagcgcugagcugggugcacggugugauuccaggaggagagccaggccugcccugcc

SEQ ID NO: 423579 - RNA, 61 nt, Human
ccuggagcgggaccccagccgucgcaucuccuuccaggacuuuuuugcgcaccccugggug

SEQ ID NO: 423580 - RNA, 61 nt, Human
aauaacacuauaugcaauguaacucacaauguuccaggaccaaagacuugauggaggggcu

SEQ ID NO: 423581 - RNA, 61 nt, Human
agugggaauauuuuacagaauaguaaaaugcuuccaggaacuacaagaugccaucugccgu

SEQ ID NO: 423582 - RNA, 61 nt, Human
uggccacaggcacaagggcugcagcugcuucuuccaggaaacugacacagggagcucagcg

SEQ ID NO: 423583 - RNA, 61 nt, Human
aggcugacuuggacccaaacugggcgacuagggcuuugagcugggcaguuuucccugccac

SEQ ID NO: 423584 - RNA, 61 nt, Human
gagagucccucuggaaccauauaaaguuccuggcuuugaaugaaccagaaguguuugccca

SEQ ID NO: 423585 - RNA, 61 nt, Human
cucaccacauagugugcuuugauuguauuuuggcuuugacucugccauuucugaaaugugg

SEQ ID NO: 423586 - RNA, 61 nt, Human
ggucgcgcgcuggccccgcaggaccuuccuuuuccaggaagagccagcuuuucucggagcg

SEQ ID NO: 423587 - RNA, 61 nt, Human
ucuuguuccugacuccagaggaacgagagcauuccaggaaagagagauucccuggaaaauu

SEQ ID NO: 423588 - RNA, 61 nt, Human
augaggccgaaaugaauuacaauguaaaguguuccaggaaccaaauuggauuuucuuucuu

SEQ ID NO: 423589 - RNA, 61 nt, Human
cuuagccucaacucugccccaccccagccucuuccaggagagcacccuuacuuggcccggc

SEQ ID NO: 423590 - RNA, 61 nt, Human
ccgauuccaaugcuguuuuuuggggagugguuuccaggagcugccuggugucugcuguaaa

SEQ ID NO: 423591 - RNA, 61 nt, Human
cagcagaaaggccaccuggcucacuggcucauuccaggagugggagagacggcagggucuc

SEQ ID NO: 423592 - RNA, 61 nt, Human
caaagccugaucaccaggccugaaacucccuuuccaggacucucaucccugggcacagaau

SEQ ID NO: 423593 - RNA, 61 nt, Human
cauggcucagcgagcacugagcuggcccuacuuccaggauggaugcaucacacucaaggac

SEQ ID NO: 423594 - RNA, 61 nt, Human
gcagcacacacagaauaacccugcauccaaauuccaggaagcucuuaggggucauccagcu

SEQ ID NO: 423595 - RNA, 61 nt, Human
uaacaagcaacacguagcaccuuagucuuuguuccaggagagcugagcaagcuggugaaac

SEQ ID NO: 423596 - RNA, 61 nt, Human
cccuuaugcacauccaguccuaccagccugcuuccaggagccuagagugggaaaggcaccu

SEQ ID NO: 423597 - RNA, 61 nt, Human
uaagcugcggaugggcuuuccugccaccaccuuccaggacauccagcgcggggugacaagu

SEQ ID NO: 423598 - RNA, 61 nt, Human
caauaucagugagugggucccaucgacaggguuccaggaccuggaacacuuuaacagaagg

SEQ ID NO: 423599 - RNA, 61 nt, Human
ccugccagggugagcagggucaagccucuuauuccaggagaagggggcucugccccaggcc

SEQ ID NO: 423600 - RNA, 61 nt, Human
ggugugggccuaugaucuaggcucucgccucuuccaggagaagauacaaauccacaagaaa

SEQ ID NO: 423601 - RNA, 61 nt, Human
ccagcuucucugacacuuggguugggggcccuuccaggaggaaacccccuugggugcccca

SEQ ID NO: 423602 - RNA, 62 nt, Human; identical to SEQ ID NO: 348578

SEQ ID NO: 423603 - RNA, 62 nt, Human; identical to SEQ ID NO: 348579

SEQ ID NO: 423604 - RNA, 62 nt, Human; identical to SEQ ID NO: 348580

SEQ ID NO: 423605 - RNA, 61 nt, Human
agccugugccuugcugccacaguagaccuaguuccaggauccaugggagcauucucaaagg

SEQ ID NO: 423606 - RNA, 61 nt, Human
auaaacaucucaaacaguaagaguuguagucuuccaggacuagaaccuuguguccuuugaa

SEQ ID NO: 423607 - RNA, 61 nt, Human
uuuggggcuggggagcucaggcaaaagagguuuccaggaugcagauuaggucaugcaggcc

SEQ ID NO: 423608 - RNA, 61 nt, Human
cagacaugggagugccaagguggccagaugguuccaggacuacaaugucuuuauuuuuaac

SEQ ID NO: 423609 - RNA, 61 nt, Human
cugcuauaaugaagauuaaauagaauaacaguuccaggauaacacugauuccugacaacag

SEQ ID NO: 423610 - RNA, 61 nt, Human
agcuuugcuucauguucgagcuuaccuacucuuccaggacucucugcuuggauucacuaaa

SEQ ID NO: 423611 - RNA, 61 nt, Human
ggauacccuggagcaagaccuggagcggcuauuccaggagcugcggccacucuaccugaac

SEQ ID NO: 423612 - RNA, 61 nt, Human
gauugaagggaaaaggugauccugguaacuguuccaggauugcuccagguuugagauggua

SEQ ID NO: 423613 - RNA, 61 nt, Human
ucucuggugagcccagcguccccuccuuggcuuccaggagcccugggaagcauuuuuaacu

SEQ ID NO: 423614 - RNA, 61 nt, Human
ccaguauaaucuccucugcucauuaaacugauuccaggagauuggauuugcugugacuaga

SEQ ID NO: 423615 - RNA, 61 nt, Human
guacucagcagccacucugagccggggcuccuuccaggagcugaaauccaccugucuccau

SEQ ID NO: 423616 - RNA, 61 nt, Human
acagcucuccaagcccuuggggugacucggcuuccaggagcuguuggagaaaugaggaugu

SEQ ID NO: 423617 - RNA, 61 nt, Human
ugaaauuggaaauaaaccaacauuguuuacauuccaggagacuuguagcucagccacacac

SEQ ID NO: 423618 - RNA, 61 nt, Human
cacuugcgggguaagagauaaacaguaacccuuccaggagcccacugacguuggagugcua

SEQ ID NO: 423619 - RNA, 52 nt, Human
cuguagggccugcauuguaggguuccaggaggauuuugacccacagaaaagg

SEQ ID NO: 423620 - RNA, 61 nt, Human
uugggagacauggaccagcaucuggucuuguuuccaggagcauagaagccacaucguugag

SEQ ID NO: 423621 - RNA, 61 nt, Human
uacggaaccuuuagggauaguuccguguaagggcuuugaugccagcauccuuggaucagua

SEQ ID NO: 423622 - RNA, 61 nt, Human
gagcucuuccccggagaccuccacacacccuggcuuugaaguggagucugugacugcucug

SEQ ID NO: 423623 - RNA, 61 nt, Human
uuuaaagugacucaagaagcaugugcuaucuggcuuugaaggaaaaaaaaagaauucugca

SEQ ID NO: 423624 - RNA, 61 nt, Human
uugugauugguagggauggcugugggguggcuuccaggagggggccaccauugccgcaucu

SEQ ID NO: 423625 - RNA, 61 nt, Human
ugccgagccagagccgccgcgucccggcgcuuuccaggagccccaggcccggaggaggcga

SEQ ID NO: 423626 - RNA, 61 nt, Human
gaagccuuggaaucagcugaaggugccugacuuccaggagcgugaaagcaucuuugcucaa

SEQ ID NO: 423627 - RNA, 61 nt, Human
cacuuauccuuugguauacucgggggauugguuccaggaccacccauguauacgaaaaucu

SEQ ID NO: 423628 - RNA, 61 nt, Human
ggauuuagaucuuggcuacugucaugcaggcuuccaggaacauagacuguuuuaccuccac

SEQ ID NO: 423629 - RNA, 61 nt, Human
cagcacuauauuucugaucugucacuguuguuuccaggagagaaugggagacaauccuaga

SEQ ID NO: 423630 - RNA, 61 nt, Human
ucuggccaaaucuucccgacagccaacagguuuccaggagaugguagacauugggaccugg

SEQ ID NO: 423631 - RNA, 61 nt, Human
gcucuccuggggcgccuggccagagccgggguuccaggacagggaagggagcaggagccug

SEQ ID NO: 423632 - RNA, 61 nt, Human
gacgagccuucuccuuaucugcugcccaucuuuccaggaagucaggauggagucagaacaa

SEQ ID NO: 423633 - RNA, 61 nt, Human
cuccugggcagauuggguagaaaggacauucuuccaggaaaguugacugcugacugauugg

SEQ ID NO: 423634 - RNA, 61 nt, Human
gguuuguucggaggccucugcugucaauggauuccaggagcaaggccauuugucgcgcuuu

SEQ ID NO: 423635 - RNA, 61 nt, Human
cccaggcuucgugaauugcaagaagggacccuuccaggaugacacuaggaacagggcuagg

SEQ ID NO: 423636 - RNA, 61 nt, Human
acccauccuuugccuuaucuaacaaacauuuuuccaggaagguggaaaaggaaguguugcu

SEQ ID NO: 423637 - RNA, 61 nt, Human
aacauguugcauaauauaugcuuauguagcuuuccaggacuaacagauaaauguguaauga

SEQ ID NO: 423638 - RNA, 61 nt, Human
aucauagaaaagcuuuugcuaacaguccgcuuuccaggaggcaaacuuguguuuauccaaa

SEQ ID NO: 423639 - RNA, 61 nt, Human
aagcagaaauguacaauuucuggucuguguuuuccaggaaauucauagagaagagaauaga

SEQ ID NO: 423640 - RNA, 61 nt, Human
cugacaaaucacaagugguuuaguugggcagggcuuugaucauucaaaaguaacuaaagua

SEQ ID NO: 423641 - RNA, 61 nt, Human
augccagaucauuuuccggcacacacggaguggcuuugacagauugauaacuuuguaagau

SEQ ID NO: 423642 - RNA, 61 nt, Human
aaaggggaaacgucucccagaucgcucccuuggcuuugaggccgaagcugcugugacugug

SEQ ID NO: 423643 - RNA, 61 nt, Human
agaccacccggcauucucugcccacuuugccuuccaggaaaugggcuuuucaggaagugaa

SEQ ID NO: 423644 - RNA, 61 nt, Human
uggaguuuugaacuuccugaaauuaaaaaaguuccaggauuuuuagaaaagaaagagccag

SEQ ID NO: 423645 - RNA, 61 nt, Human
ugcauuguaacuuuucuuuuacauccuauuuuuccaggaacuuuggauuuaaguacucuca

SEQ ID NO: 423646 - RNA, 61 nt, Human
ugcaccuccggaugcaguuuugauguccaucuuccaggagagacggucucggguccaggga

SEQ ID NO: 423647 - RNA, 61 nt, Human
gucccaccagcgggcgccuccucccagaggcuuccaggagcacgagggccuugcggcacag

SEQ ID NO: 423648 - RNA, 61 nt, Human
gcgcacucuaguggacaggagaaggaacgccuuccaggaaccuguggacuaggggugcagg

SEQ ID NO: 423649 - RNA, 61 nt, Human
cuacccuccagaacuuccuacagcugcagacuuccaggaguaaccgcuucuccuggauggg

SEQ ID NO: 423650 - RNA, 61 nt, Human
cggaagcgaggucccagaaggccagcggugguuccaggagcaacagcucccaaacccugag

SEQ ID NO: 423651 - RNA, 61 nt, Human
ccuugccauccugcaacagcuggacucaaguuuccaggaaguggagauguguuucuagaag

SEQ ID NO: 423652 - RNA, 61 nt, Human
acacuggaacauuccaguggacccuggaccauuccaggaaaacugggacauaggaucgucc

SEQ ID NO: 423653 - RNA, 61 nt, Human
gggcgucgcagucucucugugccucaguugcuuccaggaugcgggacccuuggcugcaggg

SEQ ID NO: 423654 - RNA, 61 nt, Human
aacuucauuuaaccuuggucacauugagucauuccaggaugaguggcucaaguauuuccuc

SEQ ID NO: 423655 - RNA, 61 nt, Human
ucugaauacuuauccaggauuaagauacauauuccaggaucaaaaagaccuggguuccaau

SEQ ID NO: 423656 - RNA, 61 nt, Human
aagcccacuguguuuuuaaaccacuuccacuuuccaggaggcuggauggcuuccaggguca

SEQ ID NO: 423657 - RNA, 61 nt, Human
auguaauccauuacagaaucccaugcagugauuccaggauuugaaauuguaugauguguua

SEQ ID NO: 423658 - RNA, 61 nt, Human
ucccuggggugaacgcauguuuuaugggcguuuccaggagcgcgcgugcaccuccagacgg

SEQ ID NO: 423659 - RNA, 61 nt, Human
gcagcauguuggugccauuuucagcaauuacggcuuugacagugccaccucuuugaugcca

SEQ ID NO: 423660 - RNA, 61 nt, Human
uggaccagcuccugggaccuuccaaaacauuggcuuugacaucugccaagguauuggccuu

SEQ ID NO: 423661 - RNA, 61 nt, Human
gagguggaagacgcuuccuuccaggacagcaggcuuugaguccagcacccccagccugccu

SEQ ID NO: 423662 - RNA, 61 nt, Human
augucccuuaccugggauuucacaugcuggcuuccaggagcguccccugcggaagccuggc

SEQ ID NO: 423663 - RNA, 61 nt, Human
ggcugggaaaggggguguggaaagagcaggcuuccaggagagaggcccccaaacccucugg

SEQ ID NO: 423664 - RNA, 61 nt, Human
ccugacucaaaacccagugagggggauguuuuuccaggacaagugaagagaaaauauuaaa

SEQ ID NO: 423665 - RNA, 61 nt, Human
ccauucaccuccgcuccuugagcgugaguguuuccaggacccccucggggcccugagccgg

SEQ ID NO: 423666 - RNA, 61 nt, Human
guaaagcccuuuggcucuuggcaggcagacuuuccaggaagaggcuccauguggcuccugc

SEQ ID NO: 423667 - RNA, 61 nt, Human
uggucaucccuugguauccauggggaauugguuccaggauccuccacugaugguaaaaucu

SEQ ID NO: 423668 - RNA, 61 nt, Human
ggggccagggcuaccccagaacuuuuaacucuuccaggacagggagcuucgggcccccacu

SEQ ID NO: 423669 - RNA, 61 nt, Human
ggaccaccccuugaccugugaugacccccgcuuccaggacuccucuuccucaaaggccccu

SEQ ID NO: 423670 - RNA, 61 nt, Human
acugaccaugugccucccacugaauggcaguuuccaggaccuccauuccacucaucucugg

SEQ ID NO: 423671 - RNA, 61 nt, Human
agagggaugauagcuuggauucccuaggucuuuccaggaugcagaaagaaacaggcugggg

SEQ ID NO: 423672 - RNA, 61 nt, Human
gaccuugcccccucgucccucuccccaguguuuccaggacccccaauaaaccuuguccugu

SEQ ID NO: 423673 - RNA, 61 nt, Human
acacuucucagggccucuuucaucugugcucuuccaggaugcugccucuuacucccugggc

SEQ ID NO: 423674 - RNA, 61 nt, Human
aaagcuguuacuggugauuauagaugaguauuuccaggacaacguucuaaaaguacaauua

SEQ ID NO: 423675 - RNA, 61 nt, Human
cugguggucccugcuuuucugaguaccauguuuccaggaggggccaugggggucagggugg

SEQ ID NO: 423676 - RNA, 53 nt, Human
aguuugucaucaaggucuaagccuuccaggaaggggcuggccucugcugagcu

SEQ ID NO: 423677 - RNA, 61 nt, Human
gcggcuucccagggcugcaggcgggcggagguuccaggagaugggacuucagggagaccug

SEQ ID NO: 423678 - RNA, 61 nt, Human
ucaggagaccccugcccucuaguugguucugggcuuugaucucuuccaaccugcccaguca

SEQ ID NO: 423679 - RNA, 61 nt, Human
uuuugcaaaguauuuuaccaaccuccucgauggcuuugauaaagguuagauuugauguuuu

SEQ ID NO: 423680 - RNA, 61 nt, Human
guuguuuaauuucuuuuuaaaaucacuguugggcuuugaaagcauugagaauauaauauga

SEQ ID NO: 423681 - RNA, 61 nt, Human
aggauaaaugaauauuagacuaagauuuguuuuccaggaggcucaaucugaacacacagaa

SEQ ID NO: 423682 - RNA, 61 nt, Human
agucauugucgcucagcaauagggugcaguuuuccaggaauaggcauuugccuaauuccug

SEQ ID NO: 423683 - RNA, 61 nt, Human
aguuggcaaguuguuuauuuuauauuauuucuuccaggaccuacuugcucagaucuccaag

SEQ ID NO: 423684 - RNA, 61 nt, Human
gugugagcgugccgucaucgacuuuguggcuuuccaggacaucuccaucaagaggcugcag

SEQ ID NO: 423685 - RNA, 61 nt, Human
cucucuguuagggcaaccaccaccaccugucuuccaggacacauuuuuagauacucugaca

SEQ ID NO: 423686 - RNA, 61 nt, Human
aaucaccaugggaaacuguugugggcgcugcuuccaggauaaggagacugaggcuuagaga

SEQ ID NO: 423687 - RNA, 61 nt, Human
aaggacaagcauggcgguggccccuucugccuuccaggagaggucuugcuuuugaaaccaa

SEQ ID NO: 423688 - RNA, 61 nt, Human
ggaccggggguggagaggagccucaaguacauuccaggagaccacugucuccucgcuggcc

SEQ ID NO: 423689 - RNA, 61 nt, Human
ugaagacaaucagaacuuugagaguucagaguuccaggaauauuguuauuguuaucuuccu

SEQ ID NO: 423690 - RNA, 61 nt, Human
ccuccaucucaauccucuucucuucaccaguuuccaggacucaucugcaacauuugcaauc

SEQ ID NO: 423691 - RNA, 61 nt, Human
uaucuuagguggacacagcccugggggcuccuuccaggaggggacccucagcccugugccc

SEQ ID NO: 423692 - RNA, 61 nt, Human
gugccuggaguucccacgugucccggggcuuuuccaggaagcccgagcccaggaccuguug

SEQ ID NO: 423693 - RNA, 61 nt, Human
auuucugccuccaggaugccacugccucugcuuccaggaaaggcaagggggagggugcuua

SEQ ID NO: 423694 - RNA, 61 nt, Human
agcuggggacacaacugcccgggacucuaacuuccaggaauuaaagacucaccacacacga

SEQ ID NO: 423695 - RNA, 61 nt, Human
cccgcgggaccucuuguaacccaucggcaucuuccaggaauccgccgagugacuugaggaa

SEQ ID NO: 423696 - RNA, 61 nt, Human
cuggaucgagacgguggccgucagcguccacuuccaggaccagaaugacguggagcugaac

SEQ ID NO: 423697 - RNA, 61 nt, Human
guacaaccugugggaagggaagcggguucauggcuuugagggccugagaggcaaaugcauc

SEQ ID NO: 423698 - RNA, 61 nt, Human
acccauucuuucugccuuugcccaggauggaggcuuugaagacagguggucaccuggaccu

SEQ ID NO: 423699 - RNA, 61 nt, Human
agacaacuacuuuugaaggaaguuaaaagguggcuuugaaggaggaagacaccuugagcca

SEQ ID NO: 423700 - RNA, 61 nt, Human
aaaaacagggccacuuaccaaacucaggugauuccaggaugguuuggaaacuucuccugaa

SEQ ID NO: 423701 - RNA, 61 nt, Human
gcgaaucaagacuccacgaccugccagcuguuuccaggaucuuccagcaugcugcuugucc

SEQ ID NO: 423702 - RNA, 61 nt, Human
guguugaagagcccccuaggggacacacagcuuccaggaggagggaauguccucuaagcau

SEQ ID NO: 423703 - RNA, 61 nt, Human
uuuaaaaugcgcauuacaaacuucuuagguguuccaggaauuaucaagugacuuuaaaaug

SEQ ID NO: 423704 - RNA, 61 nt, Human
agaaguuucauaaacugcucaaggauuaguuuuccaggacucugcggaggaacggcaggaa

SEQ ID NO: 423705 - RNA, 61 nt, Human
uugguuuaaaaagaagacugggcguccgcucuuccaggacggccucugugcugcugggguc

SEQ ID NO: 423706 - RNA, 61 nt, Human
ccacgcagcccagaccacaccugccacggucuuccaggaacggugcuccugcuucugcaac

SEQ ID NO: 423707 - RNA, 61 nt, Human
auauauuacaaaccaucacacuuagaaauacuuccaggaaaugcuuuuuugaagugugaau

SEQ ID NO: 423708 - RNA, 61 nt, Human
cuccugaccuuggccagugaaccugccagccuuccaggacaggcggccggagagcugcccc

SEQ ID NO: 423709 - RNA, 61 nt, Human
gggagccagcgcucccuuacugggaacaggauuccaggaccccuuucuuguuguggcugcc

SEQ ID NO: 423710 - RNA, 61 nt, Human
gauggggagcccucuggggaugagcaaggccuuccaggacaggcucgguucugguccccug

SEQ ID NO: 423711 - RNA, 61 nt, Human
caacguugcucaucaaauuaugaccauaaauuuccaggaucagacuaacggcuaaagagac

SEQ ID NO: 423712 - RNA, 61 nt, Human
cugcugggcccagaggugacauuugacuuuuuuccaggaaaaauguaagugugaggaaacc

SEQ ID NO: 423713 - RNA, 61 nt, Human
ggacggaaagcuccuuucauucaguuuaucuuuccaggauauaugaaaagggaccagcugg

SEQ ID NO: 423714 - RNA, 61 nt, Human
agccuggaaugaccucuugcacaagccuaaauuccaggaaucuuccccaaaucccagaucc

SEQ ID NO: 423715 - RNA, 61 nt, Human
auaugaguuaaucuucucugaucgauguagauuccaggaagggguguccaggacaauuacc

SEQ ID NO: 423716 - RNA, 61 nt, Human
uguauauuuuuacuuggggugcugcuuuauuggcuuugaaaacacugucagauaagcucag

SEQ ID NO: 423717 - RNA, 61 nt, Human
guaaaaaacagagcuguaaauggaacugcuuggcuuugaccauacacauuucugcccagcc

SEQ ID NO: 423718 - RNA, 61 nt, Human
ccgagcuuaaaaaugccuuuuguuuuaaaugggcuuugagaaaaaaaacagaaacaagcga

SEQ ID NO: 423719 - RNA, 61 nt, Human
cuggggagagaaaagcaguauagacuccaccuuccaggauguccauuucggggagaggagc

SEQ ID NO: 423720 - RNA, 61 nt, Human
acgggcaaauccaucccucucucccucacaguuccaggagcggcuucccucgucuccccuu

SEQ ID NO: 423721 - RNA, 61 nt, Human
cuuguuugaaagaaagaggaguggaaaaugguuccaggagggaagagguucuuugagacac

SEQ ID NO: 423722 - RNA, 61 nt, Human
guacugaguuccuucagaucagccacaccuuuuccaggaguucugaagcugacagcacuac

SEQ ID NO: 423723 - RNA, 61 nt, Human
gccaaaagaacaaaagagaugucaggacagauuccaggagugucggagcacauguguggca

SEQ ID NO: 423724 - RNA, 61 nt, Human
aggauucuagcugaaaauauguucgacugacuuccaggaguuccgaaaggcagaagugagg

SEQ ID NO: 423725 - RNA, 61 nt, Human
aggggaaaguccuguucauauugcuuugcaauuccaggagcggcauugcccccgaaugucc

SEQ ID NO: 423726 - RNA, 61 nt, Human
gaaggggaagcuugggguucagaggggacucuuccaggagaggggugcccagcggagguaa

SEQ ID NO: 423727 - RNA, 61 nt, Human
agagagcaugaacugaugcuggcaugaaggauuccaggaagaucauggagaccuggcuggu

SEQ ID NO: 423728 - RNA, 61 nt, Human
guucccccugggcuuagggccucguggggaguuccaggacuugcuucaugcuugagaaugc

SEQ ID NO: 423729 - RNA, 61 nt, Human
gggaccaggcagcccucagcagccacaggccuuccaggagcuguuaucacuaccaguuucu

SEQ ID NO: 423730 - RNA, 61 nt, Human
auauuaccgcauggaguugcuggccaaagaauuccaggacaagacugcccccaggcugcag

SEQ ID NO: 423731 - RNA, 61 nt, Human
auuugucugaauaaaggugucccacucacuguuccaggaauucuugcaguguagagguauu

SEQ ID NO: 423732 - RNA, 61 nt, Human
ggauccaaguagagccacagaaaaagaagaauuccaggagagggaaagaucguaaggauga

SEQ ID NO: 423733 - RNA, 61 nt, Human
cauuuguuuuacauguuagucaacucugaucuuccaggacaggugguauuagcuccacugu

SEQ ID NO: 423734 - RNA, 61 nt, Human
gcaccagucaucagcuauucaguugguaagcuuccaggaaaaaggacaggcagaaagaguu

SEQ ID NO: 423735 - RNA, 61 nt, Human
agccccacccuacugccucagcuggacccagggcuuugacacaaacccagugcuuugcuua

SEQ ID NO: 423736 - RNA, 61 nt, Human
uuuaucaaauuaaugugcugaugauaauacuggcuuugacuuuguuacuccauguucagcu

SEQ ID NO: 423737 - RNA, 61 nt, Human
uguaugccuuuccaagcuugccagucuuuuuggcuuugaacacugcccaucagcuacaguc

SEQ ID NO: 423738 - RNA, 61 nt, Human
gagaaaaguguuaaaauuuuuaaaauauguuuuccaggacacuucacuuccaagucaggua

SEQ ID NO: 423739 - RNA, 61 nt, Human
acucaccguucccgggacaggcugcccccuguuccaggaagcucauccucaccuguguagg

SEQ ID NO: 423740 - RNA, 61 nt, Human
ccuguguguuaaaauauuuaaaaaguggauauuccaggaauguuuugcagcuuuguacaag

SEQ ID NO: 423741 - RNA, 61 nt, Human
uaaugcuuaaccaugucuuuuacuuaaacaauuccaggaacuggccuuaggagauccaaau

SEQ ID NO: 423742 - RNA, 61 nt, Human
gcuuuaauaagcucagcuugagcauuaccauuuccaggacacuuuccaugaauuguugaga

SEQ ID NO: 423743 - RNA, 61 nt, Human
ccacuuuuugacaccuuauccugauguaugguuccaggauuuggauuuugauuuuccaaau

SEQ ID NO: 423744 - RNA, 61 nt, Human
ucucuucauuucuccguagugcuugucuuuguuccaggaauagcgcuccaguuaccugcug

SEQ ID NO: 423745 - RNA, 61 nt, Human
ugagugcauugaagaaguagguuuuggagccuuccaggaauuccuuguugacaacaggggu

SEQ ID NO: 423746 - RNA, 64 nt, Human; identical to SEQ ID NO: 349519

SEQ ID NO: 423747 - RNA, 64 nt, Human; identical to SEQ ID NO: 349520

SEQ ID NO: 423748 - RNA, 64 nt, Human; identical to SEQ ID NO: 349521

SEQ ID NO: 423749 - RNA, 64 nt, Human; identical to SEQ ID NO: 349522

SEQ ID NO: 423750 - RNA, 64 nt, Human; identical to SEQ ID NO: 349523

SEQ ID NO: 423751 - RNA, 64 nt, Human; identical to SEQ ID NO: 349524

SEQ ID NO: 423752 - RNA, 64 nt, Human; identical to SEQ ID NO: 349525

SEQ ID NO: 423753 - RNA, 64 nt, Human; identical to SEQ ID NO: 349526

SEQ ID NO: 423754 - RNA, 64 nt, Human; identical to SEQ ID NO: 349527

SEQ ID NO: 423755 - RNA, 64 nt, Human; identical to SEQ ID NO: 349528

SEQ ID NO: 423756 - RNA, 64 nt, Human; identical to SEQ ID NO: 349529

SEQ ID NO: 423757 - RNA, 64 nt, Human; identical to SEQ ID NO: 349530

SEQ ID NO: 423758 - RNA, 64 nt, Human; identical to SEQ ID NO: 349531

SEQ ID NO: 423759 - RNA, 64 nt, Human; identical to SEQ ID NO: 349532

SEQ ID NO: 423760 - RNA, 64 nt, Human; identical to SEQ ID NO: 178508

SEQ ID NO: 423761 - RNA, 64 nt, Human; identical to SEQ ID NO: 178509

SEQ ID NO: 423762 - RNA, 64 nt, Human; identical to SEQ ID NO: 178510

SEQ ID NO: 423763 - RNA, 64 nt, Human; identical to SEQ ID NO: 178511

SEQ ID NO: 423764 - RNA, 64 nt, Human; identical to SEQ ID NO: 178512

SEQ ID NO: 423765 - RNA, 64 nt, Human; identical to SEQ ID NO: 178513

SEQ ID NO: 423766 - RNA, 64 nt, Human; identical to SEQ ID NO: 178514

SEQ ID NO: 423767 - RNA, 64 nt, Human; identical to SEQ ID NO: 178515

SEQ ID NO: 423768 - RNA, 61 nt, Human
aggaggcugcugugguggggauccccaggggggcuuugacacaguccucugcugucccucc

SEQ ID NO: 423769 - RNA, 61 nt, Human
aggaggcuacuggaucggggauucccaggggggcuuugacacaguccucugcugucucccc

SEQ ID NO: 423770 - RNA, 61 nt, Human
auuuaucaggcauaaauuauguagaauuagaggcuuugaaaauaauacugguagguugcuc

SEQ ID NO: 423771 - RNA, 61 nt, Human
uacuuauauauuugauacauauaauucuuuuggcuuugaaacuugcaacuuugagaacaaa

SEQ ID NO: 423772 - RNA, 64 nt, Human; identical to SEQ ID NO: 178516

SEQ ID NO: 423773 - RNA, 64 nt, Human; identical to SEQ ID NO: 178517

SEQ ID NO: 423774 - RNA, 64 nt, Human; identical to SEQ ID NO: 178518

SEQ ID NO: 423775 - RNA, 64 nt, Human; identical to SEQ ID NO: 178519

SEQ ID NO: 423776 - RNA, 64 nt, Human; identical to SEQ ID NO: 178520

SEQ ID NO: 423777 - RNA, 64 nt, Human; identical to SEQ ID NO: 178521

SEQ ID NO: 423778 - RNA, 64 nt, Human; identical to SEQ ID NO: 178522

SEQ ID NO: 423779 - RNA, 64 nt, Human; identical to SEQ ID NO: 178523

SEQ ID NO: 423780 - RNA, 64 nt, Human; identical to SEQ ID NO: 178524

SEQ ID NO: 423781 - RNA, 64 nt, Human; identical to SEQ ID NO: 178525

SEQ ID NO: 423782 - RNA, 64 nt, Human; identical to SEQ ID NO: 178526

SEQ ID NO: 423783 - RNA, 64 nt, Human; identical to SEQ ID NO: 178527

SEQ ID NO: 423784 - RNA, 64 nt, Human; identical to SEQ ID NO: 178528

SEQ ID NO: 423785 - RNA, 64 nt, Human; identical to SEQ ID NO: 178529

SEQ ID NO: 423786 - RNA, 64 nt, Human; identical to SEQ ID NO: 178530

SEQ ID NO: 423787 - RNA, 64 nt, Human; identical to SEQ ID NO: 178531

SEQ ID NO: 423788 - RNA, 61 nt, Human
acgaaacugggacccccagaagggaggagugggcuuugaacuuagacaucuaccucagagc

SEQ ID NO: 423789 - RNA, 61 nt, Human
uguaugaauaaaauauugauuugauuacaguggcuuugacuauaaugugggagccaauuuu

SEQ ID NO: 423790 - RNA, 61 nt, Human
ucggggcgucacaccuguugaggagugggguggcuuugaaugcuggaaauggcuucauagu

SEQ ID NO: 423791 - RNA, 64 nt, Human; identical to SEQ ID NO: 178532

SEQ ID NO: 423792 - RNA, 64 nt, Human; identical to SEQ ID NO: 178533

SEQ ID NO: 423793 - RNA, 64 nt, Human; identical to SEQ ID NO: 178534

SEQ ID NO: 423794 - RNA, 64 nt, Human; identical to SEQ ID NO: 178535

SEQ ID NO: 423795 - RNA, 64 nt, Human; identical to SEQ ID NO: 178536

SEQ ID NO: 423796 - RNA, 64 nt, Human; identical to SEQ ID NO: 178537

SEQ ID NO: 423797 - RNA, 64 nt, Human; identical to SEQ ID NO: 178538

SEQ ID NO: 423798 - RNA, 64 nt, Human; identical to SEQ ID NO: 178539

SEQ ID NO: 423799 - RNA, 64 nt, Human; identical to SEQ ID NO: 178540

SEQ ID NO: 423800 - RNA, 64 nt, Human; identical to SEQ ID NO: 178541

SEQ ID NO: 423801 - RNA, 64 nt, Human; identical to SEQ ID NO: 178542

SEQ ID NO: 423802 - RNA, 64 nt, Human; identical to SEQ ID NO: 178543

SEQ ID NO: 423803 - RNA, 64 nt, Human; identical to SEQ ID NO: 178544

SEQ ID NO: 423804 - RNA, 64 nt, Human; identical to SEQ ID NO: 178545

SEQ ID NO: 423805 - RNA, 64 nt, Human; identical to SEQ ID NO: 178546

SEQ ID NO: 423806 - RNA, 64 nt, Human; identical to SEQ ID NO: 178547

SEQ ID NO: 423807 - RNA, 61 nt, Human
guuuuuaauuauuaccauguauuaaauugugggcuuugaaaccuaaugaaaccuguuagcc

SEQ ID NO: 423808 - RNA, 61 nt, Human
cagcagucugcuauuaaguggccuacuucaaggcuuugaaucaacuuaagggaaaaccuuu

SEQ ID NO: 423809 - RNA, 61 nt, Human
aaaauaaacaauucccaauguuccaggugagggcuuugaaaggccuuccaaacagcuccgu

SEQ ID NO: 423810 - RNA, 64 nt, Human; identical to SEQ ID NO: 178548

SEQ ID NO: 423811 - RNA, 64 nt, Human; identical to SEQ ID NO: 178549

SEQ ID NO: 423812 - RNA, 64 nt, Human; identical to SEQ ID NO: 178550

SEQ ID NO: 423813 - RNA, 64 nt, Human; identical to SEQ ID NO: 178551

SEQ ID NO: 423814 - RNA, 64 nt, Human; identical to SEQ ID NO: 178552

SEQ ID NO: 423815 - RNA, 64 nt, Human; identical to SEQ ID NO: 178553

SEQ ID NO: 423816 - RNA, 64 nt, Human; identical to SEQ ID NO: 178554

SEQ ID NO: 423817 - RNA, 58 nt, Human; identical to SEQ ID NO: 178555

SEQ ID NO: 423818 - RNA, 64 nt, Human; identical to SEQ ID NO: 178556

SEQ ID NO: 423819 - RNA, 64 nt, Human; identical to SEQ ID NO: 178557

SEQ ID NO: 423820 - RNA, 64 nt, Human; identical to SEQ ID NO: 178558

SEQ ID NO: 423821 - RNA, 64 nt, Human; identical to SEQ ID NO: 178559

SEQ ID NO: 423822 - RNA, 64 nt, Human; identical to SEQ ID NO: 178560

SEQ ID NO: 423823 - RNA, 64 nt, Human; identical to SEQ ID NO: 178561

SEQ ID NO: 423824 - RNA, 64 nt, Human; identical to SEQ ID NO: 178562

SEQ ID NO: 423825 - RNA, 64 nt, Human; identical to SEQ ID NO: 178563

SEQ ID NO: 423826 - RNA, 61 nt, Human
uugguccugcgacccuuuacuggucuccgcuggcuuugaaucuuccucugggcucuacucu

SEQ ID NO: 423827 - RNA, 61 nt, Human
ccccaacacagccccauggccucugccagauggcuuugaaaaaggugauccaagcaggccc

SEQ ID NO: 423828 - RNA, 61 nt, Human
uguaaagaaaauagugaaucacuguagcaauggcuuugauucagaccuuaaaaucacauaa

SEQ ID NO: 423829 - RNA, 64 nt, Human; identical to SEQ ID NO: 178564

SEQ ID NO: 423830 - RNA, 64 nt, Human; identical to SEQ ID NO: 178565

SEQ ID NO: 423831 - RNA, 64 nt, Human; identical to SEQ ID NO: 178566

SEQ ID NO: 423832 - RNA, 64 nt, Human; identical to SEQ ID NO: 178567

SEQ ID NO: 423833 - RNA, 64 nt, Human; identical to SEQ ID NO: 178568

SEQ ID NO: 423834 - RNA, 64 nt, Human; identical to SEQ ID NO: 178569

SEQ ID NO: 423835 - RNA, 64 nt, Human; identical to SEQ ID NO: 178570

SEQ ID NO: 423836 - RNA, 64 nt, Human; identical to SEQ ID NO: 178571

SEQ ID NO: 423837 - RNA, 64 nt, Human; identical to SEQ ID NO: 178572

SEQ ID NO: 423838 - RNA, 64 nt, Human; identical to SEQ ID NO: 178573

SEQ ID NO: 423839 - RNA, 64 nt, Human; identical to SEQ ID NO: 178574

SEQ ID NO: 423840 - RNA, 64 nt, Human; identical to SEQ ID NO: 178575

SEQ ID NO: 423841 - RNA, 64 nt, Human; identical to SEQ ID NO: 178576

SEQ ID NO: 423842 - RNA, 64 nt, Human; identical to SEQ ID NO: 178577

SEQ ID NO: 423843 - RNA, 64 nt, Human; identical to SEQ ID NO: 178578

SEQ ID NO: 423844 - RNA, 64 nt, Human; identical to SEQ ID NO: 178579

SEQ ID NO: 423845 - RNA, 61 nt, Human
gaucuagcaucucugaaauccuggcugucgaggcuuugaagcauguguuaccugguuaagc

SEQ ID NO: 423846 - RNA, 61 nt, Human
gucaguguauaaguaaguuggguuuauggugggcuuugacuaugucauuagguggguacaa

SEQ ID NO: 423847 - RNA, 61 nt, Human
guuguacuuccagugcgucucuuuuguuccuggcuuugacaugaaaagauagguuugaguu

SEQ ID NO: 423848 - RNA, 64 nt, Human; identical to SEQ ID NO: 178580

SEQ ID NO: 423849 - RNA, 64 nt, Human; identical to SEQ ID NO: 178581

SEQ ID NO: 423850 - RNA, 64 nt, Human; identical to SEQ ID NO: 178582

SEQ ID NO: 423851 - RNA, 64 nt, Human; identical to SEQ ID NO: 178583

SEQ ID NO: 423852 - RNA, 64 nt, Human; identical to SEQ ID NO: 178584

SEQ ID NO: 423853 - RNA, 54 nt, Human; identical to SEQ ID NO: 178585

SEQ ID NO: 423854 - RNA, 56 nt, Human; identical to SEQ ID NO: 178586

SEQ ID NO: 423855 - RNA, 64 nt, Human; identical to SEQ ID NO: 178587

SEQ ID NO: 423856 - RNA, 64 nt, Human; identical to SEQ ID NO: 178588

SEQ ID NO: 423857 - RNA, 64 nt, Human; identical to SEQ ID NO: 178589

SEQ ID NO: 423858 - RNA, 64 nt, Human; identical to SEQ ID NO: 178590

SEQ ID NO: 423859 - RNA, 64 nt, Human; identical to SEQ ID NO: 178591

SEQ ID NO: 423860 - RNA, 64 nt, Human; identical to SEQ ID NO: 178592

SEQ ID NO: 423861 - RNA, 64 nt, Human; identical to SEQ ID NO: 178593

SEQ ID NO: 423862 - RNA, 64 nt, Human; identical to SEQ ID NO: 178594

SEQ ID NO: 423863 - RNA, 64 nt, Human; identical to SEQ ID NO: 178595

SEQ ID NO: 423864 - RNA, 61 nt, Human
ugccagaaguuuuuccacagccuuggagaggggcuuugacugagggcugggggcccugggc

SEQ ID NO: 423865 - RNA, 61 nt, Human
gaguaaaaaaaaaaacaauuacuggcucacuggcuuugaaaagucacuuacuauuguugcu

SEQ ID NO: 423866 - RNA, 61 nt, Human
gcuccccacugcccacacugaguggucuacuggcuuugagaaacagcuguggggaccuucc

SEQ ID NO: 423867 - RNA, 64 nt, Human; identical to SEQ ID NO: 178596

SEQ ID NO: 423868 - RNA, 64 nt, Human; identical to SEQ ID NO: 178597

SEQ ID NO: 423869 - RNA, 64 nt, Human; identical to SEQ ID NO: 178598

SEQ ID NO: 423870 - RNA, 64 nt, Human; identical to SEQ ID NO: 178599

SEQ ID NO: 423871 - RNA, 64 nt, Human; identical to SEQ ID NO: 178600

SEQ ID NO: 423872 - RNA, 64 nt, Human; identical to SEQ ID NO: 178601

SEQ ID NO: 423873 - RNA, 64 nt, Human; identical to SEQ ID NO: 178602

SEQ ID NO: 423874 - RNA, 64 nt, Human; identical to SEQ ID NO: 178603

SEQ ID NO: 423875 - RNA, 64 nt, Human; identical to SEQ ID NO: 178604

SEQ ID NO: 423876 - RNA, 64 nt, Human; identical to SEQ ID NO: 178605

SEQ ID NO: 423877 - RNA, 64 nt, Human; identical to SEQ ID NO: 178606

SEQ ID NO: 423878 - RNA, 64 nt, Human; identical to SEQ ID NO: 178607

SEQ ID NO: 423879 - RNA, 64 nt, Human; identical to SEQ ID NO: 178608

SEQ ID NO: 423880 - RNA, 64 nt, Human; identical to SEQ ID NO: 178609

SEQ ID NO: 423881 - RNA, 64 nt, Human; identical to SEQ ID NO: 178610

SEQ ID NO: 423882 - RNA, 64 nt, Human; identical to SEQ ID NO: 178611

SEQ ID NO: 423883 - RNA, 61 nt, Human
cacugcuacaaagggaucccaacccacuggaggcuuugaaguagggagguuggcaggggug

SEQ ID NO: 423884 - RNA, 61 nt, Human
acaggcuggaaaguaagggaagcagaaggaaggcuuugaaaaguuguuuuaucugguggga

SEQ ID NO: 423885 - RNA, 61 nt, Human
aaaaugguaaagaauggcauuuaacgauucaggcuuugaauuacucugucccucuggaccg

SEQ ID NO: 423886 - RNA, 64 nt, Human; identical to SEQ ID NO: 178612

SEQ ID NO: 423887 - RNA, 64 nt, Human; identical to SEQ ID NO: 178613

SEQ ID NO: 423888 - RNA, 64 nt, Human; identical to SEQ ID NO: 178614

SEQ ID NO: 423889 - RNA, 64 nt, Human; identical to SEQ ID NO: 178615

SEQ ID NO: 423890 - RNA, 64 nt, Human; identical to SEQ ID NO: 178616

SEQ ID NO: 423891 - RNA, 64 nt, Human; identical to SEQ ID NO: 178617

SEQ ID NO: 423892 - RNA, 64 nt, Human; identical to SEQ ID NO: 178618

SEQ ID NO: 423893 - RNA, 64 nt, Human; identical to SEQ ID NO: 178619

SEQ ID NO: 423894 - RNA, 64 nt, Human; identical to SEQ ID NO: 178620

SEQ ID NO: 423895 - RNA, 64 nt, Human; identical to SEQ ID NO: 178621

SEQ ID NO: 423896 - RNA, 64 nt, Human; identical to SEQ ID NO: 178622

SEQ ID NO: 423897 - RNA, 64 nt, Human; identical to SEQ ID NO: 178623

SEQ ID NO: 423898 - RNA, 64 nt, Human; identical to SEQ ID NO: 178624

SEQ ID NO: 423899 - RNA, 64 nt, Human; identical to SEQ ID NO: 178625

SEQ ID NO: 423900 - RNA, 64 nt, Human; identical to SEQ ID NO: 178626

SEQ ID NO: 423901 - RNA, 64 nt, Human; identical to SEQ ID NO: 178627

SEQ ID NO: 423902 - RNA, 61 nt, Human
uggggcuugaugacuuucuuuuuguagcuggggcuuugauguuccuuccagugucauuucu

SEQ ID NO: 423903 - RNA, 61 nt, Human
uuuacccuuaggauauaucuuuaugagucuuggcuuugaaguggagaagggcuuuaucuua

SEQ ID NO: 423904 - RNA, 61 nt, Human
uucucuuuuaggaaaacuguuuguaugugguggcuuugaugguucucaugccaucaguugu

SEQ ID NO: 423905 - RNA, 64 nt, Human; identical to SEQ ID NO: 178628

SEQ ID NO: 423906 - RNA, 64 nt, Human; identical to SEQ ID NO: 178629

SEQ ID NO: 423907 - RNA, 64 nt, Human; identical to SEQ ID NO: 178630

SEQ ID NO: 423908 - RNA, 64 nt, Human; identical to SEQ ID NO: 178631

SEQ ID NO: 423909 - RNA, 64 nt, Human; identical to SEQ ID NO: 178632

SEQ ID NO: 423910 - RNA, 64 nt, Human; identical to SEQ ID NO: 178633

SEQ ID NO: 423911 - RNA, 64 nt, Human; identical to SEQ ID NO: 178634

SEQ ID NO: 423912 - RNA, 64 nt, Human; identical to SEQ ID NO: 178635

SEQ ID NO: 423913 - RNA, 64 nt, Human; identical to SEQ ID NO: 178636

SEQ ID NO: 423914 - RNA, 64 nt, Human; identical to SEQ ID NO: 178637

SEQ ID NO: 423915 - RNA, 64 nt, Human; identical to SEQ ID NO: 178638

SEQ ID NO: 423916 - RNA, 64 nt, Human; identical to SEQ ID NO: 178639

SEQ ID NO: 423917 - RNA, 64 nt, Human; identical to SEQ ID NO: 178640

SEQ ID NO: 423918 - RNA, 64 nt, Human; identical to SEQ ID NO: 178641

SEQ ID NO: 423919 - RNA, 64 nt, Human; identical to SEQ ID NO: 178642

SEQ ID NO: 423920 - RNA, 64 nt, Human; identical to SEQ ID NO: 178643

SEQ ID NO: 423921 - RNA, 62 nt, Human; identical to SEQ ID NO: 348581

SEQ ID NO: 423922 - RNA, 62 nt, Human; identical to SEQ ID NO: 348582

SEQ ID NO: 423923 - RNA, 62 nt, Human; identical to SEQ ID NO: 348583

SEQ ID NO: 423924 - RNA, 62 nt, Human; identical to SEQ ID NO: 348584

SEQ ID NO: 423925 - RNA, 64 nt, Human; identical to SEQ ID NO: 178644

SEQ ID NO: 423926 - RNA, 64 nt, Human; identical to SEQ ID NO: 178645

SEQ ID NO: 423927 - RNA, 64 nt, Human; identical to SEQ ID NO: 178646

SEQ ID NO: 423928 - RNA, 64 nt, Human; identical to SEQ ID NO: 178647

SEQ ID NO: 423929 - RNA, 64 nt, Human; identical to SEQ ID NO: 178648

SEQ ID NO: 423930 - RNA, 64 nt, Human; identical to SEQ ID NO: 178649

SEQ ID NO: 423931 - RNA, 64 nt, Human; identical to SEQ ID NO: 178650

SEQ ID NO: 423932 - RNA, 64 nt, Human; identical to SEQ ID NO: 178651

SEQ ID NO: 423933 - RNA, 64 nt, Human; identical to SEQ ID NO: 178652

SEQ ID NO: 423934 - RNA, 64 nt, Human; identical to SEQ ID NO: 178653

SEQ ID NO: 423935 - RNA, 64 nt, Human; identical to SEQ ID NO: 178654

SEQ ID NO: 423936 - RNA, 64 nt, Human; identical to SEQ ID NO: 178655

SEQ ID NO: 423937 - RNA, 64 nt, Human; identical to SEQ ID NO: 178656

SEQ ID NO: 423938 - RNA, 64 nt, Human; identical to SEQ ID NO: 178657

SEQ ID NO: 423939 - RNA, 64 nt, Human; identical to SEQ ID NO: 178658

SEQ ID NO: 423940 - RNA, 64 nt, Human; identical to SEQ ID NO: 178659

SEQ ID NO: 423941 - RNA, 61 nt, Human
gccuccaauccugcggagcuuuccuggguguggcuuugaccucagaaguggcucugguuug

SEQ ID NO: 423942 - RNA, 61 nt, Human
aacuaaaauuuauggcacaaaagauaaauauggcuuugaaauuaaagauauuccacucaac

SEQ ID NO: 423943 - RNA, 61 nt, Human
gaauugauauuugaguauaguagagcuuuggggcuuugaaggcagguucaagaaagcauau

SEQ ID NO: 423944 - RNA, 64 nt, Human; identical to SEQ ID NO: 178660

SEQ ID NO: 423945 - RNA, 64 nt, Human; identical to SEQ ID NO: 178661

SEQ ID NO: 423946 - RNA, 64 nt, Human; identical to SEQ ID NO: 178662

SEQ ID NO: 423947 - RNA, 61 nt, Human
ugagaugugaaugaugcagcaaccuggauuuggcuuugacuauagcacaaaugugggcaau

SEQ ID NO: 423948 - RNA, 61 nt, Human
ugcacugaacucugggugccgagagauguaaggcuuugagacaugcuacugaauuuggagg

SEQ ID NO: 423949 - RNA, 61 nt, Human
uggucuugaccucccagcaugaagugugcauggcuuugagaagugccucagcacccugaaa

SEQ ID NO: 423950 - RNA, 61 nt, Human
cccagccccagccccaggcccagcugccuuuggcuuugaucucaagucaggcugaaggcag

SEQ ID NO: 423951 - RNA, 61 nt, Human
ucucuguagacugaauucagcaccagugaaaggcuuugagaaggacgugggcagcaaaacg

SEQ ID NO: 423952 - RNA, 61 nt, Human
aacuucaauaaagauuguaagcaaagguugaggcuuugaugguuuuuuucuuaauuauugg

SEQ ID NO: 423953 - RNA, 61 nt, Human
uuugacacgauuagacacuccuccccacaaaggcuuugaaaucauaaggauuuuccucauc

SEQ ID NO: 423954 - RNA, 61 nt, Human
ucagugguuucaggcagauaguugagacuggggcuuugauauucaaggucuuuggcaagaa

SEQ ID NO: 423955 - RNA, 61 nt, Human
ccugugagccuuaguuauauuuuaauucaguggcuuugagucaaggccgguucuaauugag

SEQ ID NO: 423956 - RNA, 61 nt, Human
uuuguccuuugcaugacccuacuuucagcagggcuuugaggcugggaaacugaucugcugg

SEQ ID NO: 423957 - RNA, 61 nt, Human
gccuagaagcaguuauucucucuccauauugggcuuugauuugugcugagggucagcuuuu

SEQ ID NO: 423958 - RNA, 61 nt, Human
aggagggagaaaaacagaauccagccgcuuaggcuuugaugaacucccaggccaaaaugag

SEQ ID NO: 423959 - RNA, 61 nt, Human
gaaagguuuuagagcuguguguucuuucucuggcuuugauucuucuuugaguucucuuacu

SEQ ID NO: 423960 - RNA, 61 nt, Human
uucaccuagucccuccugacccagggauggaggcuuugagucccacaguguggugauacag

SEQ ID NO: 423961 - RNA, 61 nt, Human
ccaacccccaacuccgugugguaagcaacauggcuuugaugauaaacgacuuuacucuaaa

SEQ ID NO: 423962 - RNA, 61 nt, Human
uucuaggcuuauacauaauagcaauaauaaaggcuuugaaccuacuaaugauuuucugauc

SEQ ID NO: 423963 - RNA, 61 nt, Human
uguuuguuuugcaaguuugggagaguaaguuggcuuugagucacacaucgaagcuuuaaga

SEQ ID NO: 423964 - RNA, 61 nt, Human
aggaccuccugcccagaccugaggagugagaggcuuugagggcugaagucucccuuuguua

SEQ ID NO: 423965 - RNA, 61 nt, Human
uuccauaggggguucagucccaaagacauggggcuuugaaaacccuagccugaagucugag

SEQ ID NO: 423966 - RNA, 61 nt, Human
ugcagucaggaauaaacuguuuucuccaccaggcuuugacaaaagggcccacaggaaucuu

SEQ ID NO: 423967 - RNA, 61 nt, Human
ugcaaauauuaaaaaauuuuuuuugcuauaaggcuuugaucauauaguccucauagcaaca

SEQ ID NO: 423968 - RNA, 61 nt, Human
auugccaugggacggaagucugcuuggcaguggcuuugauaagcgaugcuugggggucaga

SEQ ID NO: 423969 - RNA, 61 nt, Human
guuaaucucccugguuuaaaaucacaccaguggcuuugauguuguuucugccccgcauugu

SEQ ID NO: 423970 - RNA, 61 nt, Human
cuugauucuauagagacuuaaucaugccuauggcuuugaauaaucuuaugugauuuaaaua

SEQ ID NO: 423971 - RNA, 61 nt, Human
uuccuaauuuuuaccuaagcucauugcuccaggcuuugauuaccuaaaauaagcuuggaua

SEQ ID NO: 423972 - RNA, 61 nt, Human
aggauuaauugcugcaaggacauucuuguaaggcuuugauuaguuuucuuguugcuuuguu

SEQ ID NO: 423973 - RNA, 61 nt, Human
ugauaaggagaaaugucuguuuugaggaaagggcuuugaauuccccagauacugaacaauu

SEQ ID NO: 423974 - RNA, 61 nt, Human
gauuguuuccugguacugucacugccacuggggcuuugauuuggaggaauggggcagggga

SEQ ID NO: 423975 - RNA, 61 nt, Human
ccugugcuccggagggaagcauuuccugguaggcuuugauuuuucuguguguuaaagaaau

SEQ ID NO: 423976 - RNA, 61 nt, Human
ccucgcagccacaccuaggucugagaacucaggcuuugaguuacugaucuuccuuggauua

SEQ ID NO: 423977 - RNA, 61 nt, Human
gcccaguuucccuggacuagccgaggagcagggcuuugagacuccuguugggacacaguug

SEQ ID NO: 423978 - RNA, 61 nt, Human
gauucaucucucauuuuauauguccagaaauggcuuugaauuuuaagcaauuacuaguuuu

SEQ ID NO: 423979 - RNA, 61 nt, Human
cagugcugugcuugaagccucgugccacacuggcuuugagguagcacgcugcaaguuagug

SEQ ID NO: 423980 - RNA, 61 nt, Human
caaccauggaaugaaugugugaccagaaaguggcuuugacaccaagugcuacugucccuuu

SEQ ID NO: 423981 - RNA, 61 nt, Human
uccaacccgaggcccgcaugcggcccaggauggcuuugaaugcggcccaacgcaaauucgc

SEQ ID NO: 423982 - RNA, 61 nt, Human
gggccuccugcucugccugggcugggccaggggcuuugaggagaggguaaacauaggcccg

SEQ ID NO: 423983 - RNA, 61 nt, Human
gcugacaauuacccauagugagguaauugagggcuuugauacugagcuguucucauaucau

SEQ ID NO: 423984 - RNA, 61 nt, Human
uggggucuguacagaugaugcuacccaauuuggcuuugaaggaucaaguaacagguugaaa

SEQ ID NO: 423985 - RNA, 61 nt, Human
uuggauuuacugagaacucagccguggccuuggcuuugauacuuauaggugucagcccuug

SEQ ID NO: 423986 - RNA, 61 nt, Human
aagcaagcuuguccaacccuuggcccaggacggcuuugaauauggcccgacacaaauucgu

SEQ ID NO: 423987 - RNA, 61 nt, Human
acuucauuucuuucuggggucaccugugaugggcuuugauguggugucaauuuggggccuu

SEQ ID NO: 423988 - RNA, 61 nt, Human
uguucacuuguguuggauagagcaguggcauggcuuugaccuaguaugaacuggugucugc

SEQ ID NO: 423989 - RNA, 61 nt, Human
aaguuuucuuucacagaacuccaccauugugggcuuugagagagcccuaaagcauuguacc

SEQ ID NO: 423990 - RNA, 61 nt, Human
gaaguuuguucaccagagacaggcuucagauggcuuugauuucggcaagcuggaauggccc

SEQ ID NO: 423991 - RNA, 61 nt, Human
cuguauaagacaaagccaagaugcaaaauuaggcuuugauuggcacuuuuugaaaaauaug

SEQ ID NO: 423992 - RNA, 61 nt, Human
uacaaauagaccuaaauuaagcucauuuuuaggcuuugauuuuggggagacaaagggaaau

SEQ ID NO: 423993 - RNA, 61 nt, Human
cggcccaagggccgcauguggcccaggauauggcuuugaauggggccuaacacaaauucau

SEQ ID NO: 423994 - RNA, 61 nt, Human
cccuugccuucugagcagcucccagugccagggcuuugagacuuucccacaugauaaaaga

SEQ ID NO: 423995 - RNA, 61 nt, Human
ugccaauuaauuaccaaacauugagccugcaggcuuugagugggaguguugcccccaggag

SEQ ID NO: 423996 - RNA, 61 nt, Human
cgacucccgccugcaggagccccagccccaaggcuuugacaaccaggcguuccucccugac

SEQ ID NO: 423997 - RNA, 61 nt, Human
ugcggggcuggugugaaaggcgcugggaaccggcuuugaaugaauaaaugaaucgugucau

SEQ ID NO: 423998 - RNA, 61 nt, Human
uuucccagcaucguggauguagacugagaauggcuuugaguggcaucagcuucucacugcu

SEQ ID NO: 423999 - RNA, 61 nt, Human
gcuuucccacagcuggguaacuguucuaaauggcuuugauaaugcucacacaucuuggagu

SEQ ID NO: 424000 - RNA, 61 nt, Human
accaguuggcagacagccguuuguucuacauggcuuugauaauuguuugaggggaggagau

SEQ ID NO: 424001 - RNA, 61 nt, Human
uggacagccucuacuuccaucagauauauguggcuuugagaggcaacuuugccccugucug

SEQ ID NO: 424002 - RNA, 61 nt, Human
cacggccugugggccgcauacggcccaggauggcuuugaaugcagcccaacacaaauucgu

SEQ ID NO: 424003 - RNA, 61 nt, Human
auucaguggaggcuuuuguuuguguguguguggcuuugaaaacaaauuauuugagaaagac

SEQ ID NO: 424004 - RNA, 61 nt, Human
aaauggggaguaaguguucacaucauuaaaaggcuuugaauucauggaaauacaucaacug

SEQ ID NO: 424005 - RNA, 61 nt, Human
ccagaucaucuggcugaagcuuuugcaaguaggcuuugaggggugaaggagauugguggag

SEQ ID NO: 424006 - RNA, 61 nt, Human
ucacagcuuuacugugacagguuuugcccaaggcuuugauaccugucacccaggguaucuu

SEQ ID NO: 424007 - RNA, 61 nt, Human
aaugucuguacagccaacgguuucucuugggggcuuugaaauaacaccaccaguggacuua

SEQ ID NO: 424008 - RNA, 61 nt, Human
agaaagcaugucaggacagagcuguuggauuggcuuugauagaggaauggggaugauguaa

SEQ ID NO: 424009 - RNA, 61 nt, Human
uauucuuuuguacacagcugaagaaagauaaggcuuugaugggccacuuccaggaugggcu

SEQ ID NO: 424010 - RNA, 61 nt, Human
uauuaagguccauucugccugugugugcuguggcuuugaacuguaacaccucuaaucaauu

SEQ ID NO: 424011 - RNA, 61 nt, Human
acuauaaugcauguacuauauaagcugaucuggcuuugaaagaugugaguuggcaaguucc

SEQ ID NO: 424012 - RNA, 61 nt, Human
guaaaaacuggcccuuaccugacagagcccuggcuuugaccugcucagcccuguguguuaa

SEQ ID NO: 424013 - RNA, 61 nt, Human
caauauucuuauaaaaggaauauaugaagauggcuuugauacuagaggugaggcacaagug

SEQ ID NO: 424014 - RNA, 61 nt, Human
gaagcugcgcuacgccaucagcaugaacacgggcuuugaacucuccuagcuccugucccag

SEQ ID NO: 424015 - RNA, 61 nt, Human
cggucugugacaguccuccuagcacccccauggcuuugagccucggggacucaucaagucc

SEQ ID NO: 424016 - RNA, 61 nt, Human
gagcuacugggaucacguuagcgggcauuuaggcuuugaugagagggcacaguuugaguua

SEQ ID NO: 424017 - RNA, 61 nt, Human
ugggcaaaacaggcuagcaauugcaaagucaggcuuugaccaacauauuucuuugcacuga

SEQ ID NO: 424018 - RNA, 61 nt, Human
gaaccuacuacaaggcaaggagccguuuuuuggcuuugaaaagucuugcugucuugggucu

SEQ ID NO: 424019 - RNA, 61 nt, Human
gaacaaacuacaaaaaugugacugggaagggggcuuugagagacugggacugcucuggguu

SEQ ID NO: 424020 - RNA, 61 nt, Human
gcaaacccaguaccucagacaggaaagucggggcuuugaccacuaccauaucugguagccc

SEQ ID NO: 424021 - RNA, 61 nt, Human
ccuugaggcauuuagcaacacauagaaaaugggcuuugauucuuuuccaaaacuuuuagcc

SEQ ID NO: 424022 - RNA, 61 nt, Human
aucuggaaacuuuccccuuuguuuagggguaggcuuugaugaccaggaaaaaaaaaaaggu

SEQ ID NO: 424023 - RNA, 61 nt, Human
ccauuuuaaucaugcauaaaaugaauuagauggcuuugaguggauuuucacaauggcucaa

SEQ ID NO: 424024 - RNA, 61 nt, Human
cuacucccaguccuucccagaaacugccuagggcuuugagucauuuuaugaagcuaggucu

SEQ ID NO: 424025 - RNA, 61 nt, Human
aaggcuguuugaaagaggaauguuuaauaaaggcuuugauuuaaucuugauauaaacagau

SEQ ID NO: 424026 - RNA, 61 nt, Human
acuuagaauuaacucgugcuaaggggucgggggcuuugaaaaugccaccccccuuucuuau

SEQ ID NO: 424027 - RNA, 61 nt, Human
agauaacuguguugaacaaacaggugcuccaggcuuugauuauagauacgacuucaaaaau

SEQ ID NO: 424028 - RNA, 61 nt, Human
uuaggugaacaauguaggaaauccucaaaguggcuuugaauuuaaugcuccacuucaguua

SEQ ID NO: 424029 - RNA, 61 nt, Human
ccuucuguauaauuaacauagguugucucauggcuuugaucuucaaaaggaagagccuuuu

SEQ ID NO: 424030 - RNA, 61 nt, Human
accucucuauccccagggagaccucccaaauggcuuugacccucagacauuucuuuacuca

SEQ ID NO: 424031 - RNA, 61 nt, Human
ugaggugcaaauaaaaugcagaugauugcgcggcuuugaauccaauugaccuguucauuuc

SEQ ID NO: 424032 - RNA, 61 nt, Human
guacauaaaguggagguuuauuuaucauacaggcuuugaaacauuaagaagcaguauuuuu

SEQ ID NO: 424033 - RNA, 61 nt, Human
aucuaggcuaacgagacaaaggaagucugaaggcuuugaauaagaaauuuucuguugcucu

SEQ ID NO: 424034 - RNA, 61 nt, Human
cucuagagaaaaccaauauaugguggugcugggcuuugaagauagcauaucagacgccuug

SEQ ID NO: 424035 - RNA, 61 nt, Human
ucagcuagccugacaccgcaauaacccguuaggcuuugaggcuuuucagugaauucuugac

SEQ ID NO: 424036 - RNA, 61 nt, Human
ucaauuaucaagaacguccuaaaacaccuauggcuuugacuuuguuauugauccagauuau

SEQ ID NO: 424037 - RNA, 61 nt, Human
aaaaacuggaaucuaaauagucagugaggaaggcuuugauaaaaugaaauugccagaaaga

SEQ ID NO: 424038 - RNA, 61 nt, Human
uaggcuuucugggaguccauccagcuggaguggcuuugagugaguuacacagcuagaaggu

SEQ ID NO: 424039 - RNA, 61 nt, Human
ugcggcacgcgcuucgggcagccuagccacaggcuuugagcgccugcauuccugggggcug

SEQ ID NO: 424040 - RNA, 61 nt, Human
uuuggagccaggggauggcauggagugauguggcuuugaaggguccucuggcugcugagcu

SEQ ID NO: 424041 - RNA, 61 nt, Human
ugacuuggcaggacuugccccaccagggucuggcuuugaaggguaguggacaccaggaucc

SEQ ID NO: 424042 - RNA, 55 nt, Human; identical to SEQ ID NO: 240258

SEQ ID NO: 424043 - RNA, 61 nt, Human
aacugaugguguuugugcuguagcuguuggaggcuuugacaggaauggacuggaucaccug

SEQ ID NO: 424044 - RNA, 61 nt, Human
agaucaugagcccuuuuucuccaguaguacaggcuuugaaaacuacuucuauuaaguuauu

SEQ ID NO: 424045 - RNA, 61 nt, Human
cgcuuggggggcggggcucgguccuugggggggcuuugagcucuccagacugugcccuuac

SEQ ID NO: 424046 - RNA, 61 nt, Human
agauuugacaccagggagauccuccauagcuggcuuugaggacacggggaccacagccaug

SEQ ID NO: 424047 - RNA, 61 nt, Human
aaagaucuugccuuacagacuuuacaggcuuggcuuugagauucuguaacugcagacuuca

SEQ ID NO: 424048 - RNA, 61 nt, Human
accugagccuggcugagauggcuaggcggagggcuuugaaguccaagcagcugaacuggcu

SEQ ID NO: 424049 - RNA, 61 nt, Human
cuguguaaauagucucccuaucccacgagggggcuuugauggcccuggagauccuacagua

SEQ ID NO: 424050 - RNA, 61 nt, Human
agguuccucgugagaaacagcacacguuagaggcuuugagagaaggccuaguucugucaug

SEQ ID NO: 424051 - RNA, 61 nt, Human
uugagaguaucuuucuucccagccagucaguggcuuugagcccuaucuuccacuacaaaug

SEQ ID NO: 424052 - RNA, 61 nt, Human
aaggaucaaugugcugacugcauuggccaauggcuuugauacuucugcuauuuuuuuagac

SEQ ID NO: 424053 - RNA, 61 nt, Human
cuccaauauuggagagucgcugggggcacagggcuuugaaucaggguaguauccugccuuc

SEQ ID NO: 424054 - RNA, 61 nt, Human
agugguggcucugagaaggggaggaccucugggcuuugauuccaucuccuugucuuuuuuc

SEQ ID NO: 424055 - RNA, 61 nt, Human
cagcuccccuucugaaucagcugggaugacuggcuuugagaaggaagggaagauggaacag

SEQ ID NO: 424056 - RNA, 61 nt, Human
gcaccagugcuuuccacacuugacagugguuggcuuugaugaacccucaugcugcaccuuc

SEQ ID NO: 424057 - RNA, 61 nt, Human
uccagcaaaagcugaagcagucccagcugcuggcuuugaagaaagagcugauggugcagaa

SEQ ID NO: 424058 - RNA, 61 nt, Human
caaucgaauggagccacugggccccaacacuggcuuugagauuuagagucaaaggguagag

SEQ ID NO: 424059 - RNA, 61 nt, Human
ugcaaugggcuuaccauccaaauaucccaaaggcuuugaccagcaaccaaguaaaaucagu

SEQ ID NO: 424060 - RNA, 61 nt, Human
uuaaggucucuaucacuuuaaucuggaucaaggcuuugaagcaaugccucucugcauuuuu

SEQ ID NO: 424061 - RNA, 61 nt, Human
aaauguugaauuuaugaagaauagauuuuaaggcuuugaaaaugguuaauuucucaaaaac

SEQ ID NO: 424062 - RNA, 61 nt, Human
ugcaggcggagucaccgacucugugcagagaggcuuugagggaugguggaguccggcucug

SEQ ID NO: 424063 - RNA, 61 nt, Human
ggagagggaaaagugaggugggacuuggaaaggcuuugaacgccaggcugaugguugaggg

SEQ ID NO: 424064 - RNA, 61 nt, Human
uuggcuucuguucucccagaaacauggugguggcuuugaaggagcugucuauucgggguga

SEQ ID NO: 424065 - RNA, 61 nt, Human
gucugauuugguuaagaauccuaaauggcauggcuuugacaucaagcugggugaauuagaa

SEQ ID NO: 424066 - RNA, 61 nt, Human
ucuggcuuuccauuggcuuccaacccugcuuggcuuugaugccuucaggguuggggagaca

SEQ ID NO: 424067 - RNA, 61 nt, Human
aguaguuaaacugcuaagcuugggcccaggaggcuuugagaaagccuucucuguguacucu

SEQ ID NO: 424068 - RNA, 61 nt, Human
aaucuucauuauagcagaaaugugccaccauggcuuugacauguugguagguauugucuuc

SEQ ID NO: 424069 - RNA, 61 nt, Human
caaccaaguccaccgaaaguccgugaagaaaggcuuugacuuuacccucaugguggcaggu

SEQ ID NO: 424070 - RNA, 61 nt, Human
cguggugccugcacacagagugagggaggagggcuuugaaucugggacugugccuggcucc

SEQ ID NO: 424071 - RNA, 61 nt, Human
gugacucaucgccaagauuugcuguaaugcaggcuuugaucuguuucaccauggcuucuau

SEQ ID NO: 424072 - RNA, 61 nt, Human
guaccaguguccacagaccgcccaacacagaggcuuugaggcuucucuagaucggaaccuc

SEQ ID NO: 424073 - RNA, 61 nt, Human
uguaacugugccaguucuuuccauaauaaaaggcuuugaguuaacucacugaggguaucug

SEQ ID NO: 424074 - RNA, 61 nt, Human
cggccucgcucucgccucaccccggcuccugggcuuugauggucuggugccagugccugug

SEQ ID NO: 424075 - RNA, 61 nt, Human
caacagagucaacaaggaaacauaauuagagggcuuugaaaugaucuacugaaauaccuaa

SEQ ID NO: 424076 - RNA, 61 nt, Human
ugggagguugagccaggagcaggggaacuugggcuuugaggcgagaccuaauucuuagggu

SEQ ID NO: 424077 - RNA, 59 nt, Human
gcacacuguauguaccuauaauaaacccuuuggcuuugacggucuaugguccuuuguuu

SEQ ID NO: 424078 - RNA, 61 nt, Human
gagacccugagcuuuagaaagacaaguggguggcuuugauggacgguuuggaggaggcaag

SEQ ID NO: 424079 - RNA, 61 nt, Human
gacuaugcaaaugaggaaguaagucagggcgggcuuugagaaggggacccauauccuacag

SEQ ID NO: 424080 - RNA, 61 nt, Human
uggacacaccccgccauaugcugccugccucggcuuugaguuccggaagcaccuggggaau

SEQ ID NO: 424081 - RNA, 61 nt, Human
ucaagggugagcccuuuacuugggauguacaggcuuugagcagugcagggcugcugaguca

SEQ ID NO: 424082 - RNA, 61 nt, Human
uuaagcaugaggcauccgcguggcugggagaggcuuugaccauccuuggcucuuccagguu

SEQ ID NO: 424083 - RNA, 61 nt, Human
aucaaaaaucugguuugggaaauaccaaagaggcuuugauugaauucccuuuugacccgug

SEQ ID NO: 424084 - RNA, 61 nt, Human
gagccccagaauggggugcauuuggugcugaggcuuugaagccaccguauuuuucguuacc

SEQ ID NO: 424085 - RNA, 61 nt, Human
uggaccucauaaauguaagauaugugggaaaggcuuugauuguuccaguacacugcaaagu

SEQ ID NO: 424086 - RNA, 61 nt, Human
uuuuuccccaacagaccugucuucacccuugggcuuugaaagccagacaaagcagcugccc

SEQ ID NO: 424087 - RNA, 61 nt, Human
auuaacaucucuaguaaucucuuuugcuaguggcuuugacugcaaauaaguuaaagaauau

SEQ ID NO: 424088 - RNA, 61 nt, Human
cugaacaauuugaaugaagacaauguggaauggcuuugagauacaguucaguuuuuauuag

SEQ ID NO: 424089 - RNA, 61 nt, Human
auauaguuuaaaacauugguuauauuaccaaggcuuugauugggauguuauauuugagaaa

SEQ ID NO: 424090 - RNA, 61 nt, Human
gacucggccucccuucuccgcccccuccccuggcuuugauugcccuguucuguguccccag

SEQ ID NO: 424091 - RNA, 61 nt, Human
ucucagacagcuuucgugcucaugguggcuuggcuuugacucuccaaagagcaauaaaugc

SEQ ID NO: 424092 - RNA, 61 nt, Human
uuuuuuuuacagcuuuacacacacagaugugggcuuugauuuccaaguaauauaauggaag

SEQ ID NO: 424093 - RNA, 61 nt, Human
ugagaacguggaaugcagaaugagcccaccuggcuuugaaucugggcccuacuuaacuuau

SEQ ID NO: 424094 - RNA, 61 nt, Human
uacucagcagaagugaugacucuuaaaaauuggcuuugaccaaaguucucuuguuuucagg

SEQ ID NO: 424095 - RNA, 61 nt, Human
gcauggugggcauggccuggcuuacaccaaaggcuuugacgguuucuccaaguaaggaucu

SEQ ID NO: 424096 - RNA, 61 nt, Human
cucugggaagugggcccucagagauuacucuggcuuugacccuuguuuagcugauggucau

SEQ ID NO: 424097 - RNA, 61 nt, Human
ucauguuguaugccuuugauaaggccaucuuggcuuugaguagcaguguuccucgucaccc

SEQ ID NO: 424098 - RNA, 61 nt, Human
ucccauucacaucauuggccugcguugcuggggcuuugaaccaccaccccguacuuuguuu

SEQ ID NO: 424099 - RNA, 61 nt, Human
ggggcugcuacacuacaggacacccagcaucggcuuugacugcagacuguucacccacacg

SEQ ID NO: 424100 - RNA, 61 nt, Human
caaguaccccucgugagcugugauuucacugggcuuugaacucuuaggccauuugaggcug

SEQ ID NO: 424101 - RNA, 61 nt, Human
guguaaaaagcaaucuguaaaaacaucuccaggcuuugauuuuuguaccauggaaauugua

SEQ ID NO: 424102 - RNA, 61 nt, Human
agagacucgguuucaccauguuggucaggcuggcuuugaacuccugaccucaggugaucca

SEQ ID NO: 424103 - RNA, 61 nt, Human
cccagcugccccagcaagcucugcccucucuggcuuugacacccucagaagguggggcagg

SEQ ID NO: 424104 - RNA, 61 nt, Human
uccuaugguuuuauucauuuaugguuuuacaggcuuugaaguacucagauuugauuuuugc

SEQ ID NO: 424105 - RNA, 61 nt, Human
agucucuaaaugaugacuaaguagugggguuggcuuugaaaacaauguuuuaugcaacaag

SEQ ID NO: 424106 - RNA, 61 nt, Human
cccagcugccccagcaagcucugcccucucuggcuuugacacccucagaagauggggcagg

SEQ ID NO: 424107 - RNA, 61 nt, Human
guggauucuaguucugauucugucacucauuggcuuugagugacauauuuuuauuuccugg

SEQ ID NO: 424108 - RNA, 61 nt, Human
uucuauuggcagugacugauucaugggaaagggcuuugaaggaacuacuucagugcacaca

SEQ ID NO: 424109 - RNA, 61 nt, Human
cgucugcuaaguugugugauguaucagcacaggcuuugagacgucuggacccuguccuucc

SEQ ID NO: 424110 - RNA, 61 nt, Human
guggcagagcaaccuagcuagguccuccuugggcuuugaaugcaggagcacccagugcccc

SEQ ID NO: 424111 - RNA, 61 nt, Human
ggacuucgaguacagcaguuauaacuauaggggcuuugacauugggaaccauuuuugugag

SEQ ID NO: 424112 - RNA, 61 nt, Human
gcuuucacuucaucuaaucacugaauugucaggcuuugauugauaauuguagaaauaagua

SEQ ID NO: 424113 - RNA, 61 nt, Human
uguuugccuuuugguccuuuugguuugguuuggcuuugacuaauucugguacugaaaaguu

SEQ ID NO: 424114 - RNA, 61 nt, Human
ugggcacccucuucuugguuuuuaccagagaggcuuugaauggaagcaggcugagaguagc

SEQ ID NO: 424115 - RNA, 61 nt, Human
gugaggagcuguugggugucuugccucuagaggcuuugagaagcucagcugccuuccuggg

SEQ ID NO: 424116 - RNA, 61 nt, Human
caagacagaaacauacaguuuccuaaagccuggcuuugaaugcagaagggagcagcuccuc

SEQ ID NO: 424117 - RNA, 61 nt, Human
ccauggaggccagcaauacccaucucagcauggcuuugauauucucuacuuccuggccuuu

SEQ ID NO: 424118 - RNA, 61 nt, Human
aggaguaggacuggggccuugagagccagugggcuuugaguuuaagcuccaccaacuucaa

SEQ ID NO: 424119 - RNA, 61 nt, Human
ccuacuguggaugagggaugaacaaggggauggcuuugauccaauggagccugggaggugu

SEQ ID NO: 424120 - RNA, 61 nt, Human
agaaaacaaguaaacaugcagcugccgacgaggcuuugaaaauucuucaaaaaacacagcc

SEQ ID NO: 424121 - RNA, 61 nt, Human
cacugaugcaucucucaucaaugcuacggaaggcuuugauucaucagucucgggcucuugg

SEQ ID NO: 424122 - RNA, 61 nt, Human
uggaaagauggacagaggcccaaugggugaaggcuuugaagagcacacagaagccccuggc

SEQ ID NO: 424123 - RNA, 61 nt, Human; identical to SEQ ID NO: 424114

SEQ ID NO: 424124 - RNA, 61 nt, Human
ucaaaaagaaaaaagaagacacaagagagguggcuuugaguggguuuccuuuccuccccua

SEQ ID NO: 424125 - RNA, 64 nt, Human; identical to SEQ ID NO: 331588

SEQ ID NO: 424126 - RNA, 64 nt, Human; identical to SEQ ID NO: 345373

SEQ ID NO: 424127 - RNA, 64 nt, Human; identical to SEQ ID NO: 345374

SEQ ID NO: 424128 - RNA, 64 nt, Human; identical to SEQ ID NO: 345375

SEQ ID NO: 424129 - RNA, 64 nt, Human; identical to SEQ ID NO: 345798

SEQ ID NO: 424130 - RNA, 64 nt, Human; identical to SEQ ID NO: 345799

SEQ ID NO: 424131 - RNA, 64 nt, Human; identical to SEQ ID NO: 331605

SEQ ID NO: 424132 - RNA, 64 nt, Human; identical to SEQ ID NO: 345409

SEQ ID NO: 424133 - RNA, 64 nt, Human; identical to SEQ ID NO: 345410

SEQ ID NO: 424134 - RNA, 64 nt, Human; identical to SEQ ID NO: 345411

SEQ ID NO: 424135 - RNA, 64 nt, Human; identical to SEQ ID NO: 345427

SEQ ID NO: 424136 - RNA, 64 nt, Human; identical to SEQ ID NO: 345428

SEQ ID NO: 424137 - RNA, 64 nt, Human; identical to SEQ ID NO: 331606

SEQ ID NO: 424138 - RNA, 64 nt, Human; identical to SEQ ID NO: 345429

SEQ ID NO: 424139 - RNA, 64 nt, Human; identical to SEQ ID NO: 345499

SEQ ID NO: 424140 - RNA, 61 nt, Human
cucagugauguauaugcaacauuuuguugaaagccacgauggacuuacaagcuuuaaugga

SEQ ID NO: 424141 - RNA, 61 nt, Human
ggguggaccccaguuuggaagcugagcccccagccacgaacauggaucugaggaggggccc

SEQ ID NO: 424142 - RNA, 61 nt, Human
aagccagcauguucaccacuggucguucagcagccacgacagcaccaugugagauggcgag

SEQ ID NO: 424143 - RNA, 61 nt, Human
gcugggaucacaggcaugagccacugugcccagccacgagcugcuuuuuauccaccuuccg

SEQ ID NO: 424144 - RNA, 64 nt, Human; identical to SEQ ID NO: 345500

SEQ ID NO: 424145 - RNA, 64 nt, Human; identical to SEQ ID NO: 331607

SEQ ID NO: 424146 - RNA, 64 nt, Human; identical to SEQ ID NO: 345445

SEQ ID NO: 424147 - RNA, 64 nt, Human; identical to SEQ ID NO: 345446

SEQ ID NO: 424148 - RNA, 64 nt, Human; identical to SEQ ID NO: 345447

SEQ ID NO: 424149 - RNA, 64 nt, Human; identical to SEQ ID NO: 345627

SEQ ID NO: 424150 - RNA, 64 nt, Human; identical to SEQ ID NO: 331624

SEQ ID NO: 424151 - RNA, 64 nt, Human; identical to SEQ ID NO: 345481

SEQ ID NO: 424152 - RNA, 64 nt, Human; identical to SEQ ID NO: 345482

SEQ ID NO: 424153 - RNA, 64 nt, Human; identical to SEQ ID NO: 345483

SEQ ID NO: 424154 - RNA, 64 nt, Human; identical to SEQ ID NO: 345501

SEQ ID NO: 424155 - RNA, 64 nt, Human; identical to SEQ ID NO: 331625

SEQ ID NO: 424156 - RNA, 64 nt, Human; identical to SEQ ID NO: 345517

SEQ ID NO: 424157 - RNA, 64 nt, Human; identical to SEQ ID NO: 345518

SEQ ID NO: 424158 - RNA, 64 nt, Human; identical to SEQ ID NO: 345519

SEQ ID NO: 424159 - RNA, 64 nt, Human
gaauuuaaagcuauuuuuuguaaauauuucuaaucagcgauaauuucuaccuauguucucaacc

SEQ ID NO: 424160 - RNA, 64 nt, Human
uuuccuuauaccagauccucagucucacuaaagacagcgauaugggagacacccaggggccugg

SEQ ID NO: 424161 - RNA, 64 nt, Human
uuaacauacaaccuauguuuugaacaaaaacaaccagcgauacguaaucaaaauguaauuuucc

SEQ ID NO: 424162 - RNA, 64 nt, Human
ucugugaaaggguaguguaaguuauauaagcccucagcgauacaugcacaaagauguucuaguu

SEQ ID NO: 424163 - RNA, 64 nt, Human; identical to SEQ ID NO: 345535

SEQ ID NO: 424164 - RNA, 64 nt, Human; identical to SEQ ID NO: 345536

SEQ ID NO: 424165 - RNA, 64 nt, Human; identical to SEQ ID NO: 331626

SEQ ID NO: 424166 - RNA, 64 nt, Human; identical to SEQ ID NO: 345537

SEQ ID NO: 424167 - RNA, 64 nt, Human; identical to SEQ ID NO: 345319

SEQ ID NO: 424168 - RNA, 64 nt, Human; identical to SEQ ID NO: 345320

SEQ ID NO: 424169 - RNA, 64 nt, Human; identical to SEQ ID NO: 331643

SEQ ID NO: 424170 - RNA, 64 nt, Human; identical to SEQ ID NO: 345589

SEQ ID NO: 424171 - RNA, 64 nt, Human; identical to SEQ ID NO: 345590

SEQ ID NO: 424172 - RNA, 64 nt, Human; identical to SEQ ID NO: 345591

SEQ ID NO: 424173 - RNA, 64 nt, Human; identical to SEQ ID NO: 344631

SEQ ID NO: 424174 - RNA, 64 nt, Human; identical to SEQ ID NO: 344632

SEQ ID NO: 424175 - RNA, 64 nt, Human; identical to SEQ ID NO: 331644

SEQ ID NO: 424176 - RNA, 64 nt, Human; identical to SEQ ID NO: 345689

SEQ ID NO: 424177 - RNA, 54 nt, Human; identical to SEQ ID NO: 344493

SEQ ID NO: 424178 - RNA, 64 nt, Human
gaucggcagggaccacuuccugacuaaggagcugcagcgauacaucgaagggcucaagaagcgc

SEQ ID NO: 424179 - RNA, 62 nt, Human; identical to SEQ ID NO: 348585

SEQ ID NO: 424180 - RNA, 62 nt, Human; identical to SEQ ID NO: 348586

SEQ ID NO: 424181 - RNA, 62 nt, Human; identical to SEQ ID NO: 348587

SEQ ID NO: 424182 - RNA, 64 nt, Human; identical to SEQ ID NO: 344494

SEQ ID NO: 424183 - RNA, 64 nt, Human; identical to SEQ ID NO: 331645

SEQ ID NO: 424184 - RNA, 64 nt, Human; identical to SEQ ID NO: 344326

SEQ ID NO: 424185 - RNA, 64 nt, Human; identical to SEQ ID NO: 344327

SEQ ID NO: 424186 - RNA, 64 nt, Human; identical to SEQ ID NO: 344328

SEQ ID NO: 424187 - RNA, 64 nt, Human; identical to SEQ ID NO: 344329

SEQ ID NO: 424188 - RNA, 64 nt, Human; identical to SEQ ID NO: 344343

SEQ ID NO: 424189 - RNA, 64 nt, Human; identical to SEQ ID NO: 344344

SEQ ID NO: 424190 - RNA, 64 nt, Human; identical to SEQ ID NO: 331662

SEQ ID NO: 424191 - RNA, 64 nt, Human; identical to SEQ ID NO: 344360

SEQ ID NO: 424192 - RNA, 64 nt, Human; identical to SEQ ID NO: 344361

SEQ ID NO: 424193 - RNA, 64 nt, Human; identical to SEQ ID NO: 344362

SEQ ID NO: 424194 - RNA, 64 nt, Human; identical to SEQ ID NO: 344363

SEQ ID NO: 424195 - RNA, 64 nt, Human; identical to SEQ ID NO: 344394

SEQ ID NO: 424196 - RNA, 64 nt, Human; identical to SEQ ID NO: 344395

SEQ ID NO: 424197 - RNA, 62 nt, Human; identical to SEQ ID NO: 348588

SEQ ID NO: 424198 - RNA, 62 nt, Human; identical to SEQ ID NO: 348589

SEQ ID NO: 424199 - RNA, 62 nt, Human; identical to SEQ ID NO: 348590

SEQ ID NO: 424200 - RNA, 62 nt, Human; identical to SEQ ID NO: 348591

SEQ ID NO: 424201 - RNA, 55 nt, Human; identical to SEQ ID NO: 331663

SEQ ID NO: 424202 - RNA, 64 nt, Human; identical to SEQ ID NO: 344396

SEQ ID NO: 424203 - RNA, 64 nt, Human; identical to SEQ ID NO: 344397

SEQ ID NO: 424204 - RNA, 64 nt, Human; identical to SEQ ID NO: 344633

SEQ ID NO: 424205 - RNA, 64 nt, Human; identical to SEQ ID NO: 344634

SEQ ID NO: 424206 - RNA, 64 nt, Human; identical to SEQ ID NO: 331664

SEQ ID NO: 424207 - RNA, 64 nt, Human; identical to SEQ ID NO: 344414

SEQ ID NO: 424208 - RNA, 64 nt, Human; identical to SEQ ID NO: 344415

SEQ ID NO: 424209 - RNA, 64 nt, Human; identical to SEQ ID NO: 344416

SEQ ID NO: 424210 - RNA, 64 nt, Human; identical to SEQ ID NO: 344417

SEQ ID NO: 424211 - RNA, 64 nt, Human; identical to SEQ ID NO: 344573

SEQ ID NO: 424212 - RNA, 64 nt, Human; identical to SEQ ID NO: 344574

SEQ ID NO: 424213 - RNA, 64 nt, Human; identical to SEQ ID NO: 331681

SEQ ID NO: 424214 - RNA, 64 nt, Human; identical to SEQ ID NO: 345301

SEQ ID NO: 424215 - RNA, 64 nt, Human; identical to SEQ ID NO: 345302

SEQ ID NO: 424216 - RNA, 62 nt, Human; identical to SEQ ID NO: 348592

SEQ ID NO: 424217 - RNA, 62 nt, Human; identical to SEQ ID NO: 348593

SEQ ID NO: 424218 - RNA, 62 nt, Human; identical to SEQ ID NO: 348594

SEQ ID NO: 424219 - RNA, 62 nt, Human; identical to SEQ ID NO: 348595

SEQ ID NO: 424220 - RNA, 64 nt, Human; identical to SEQ ID NO: 345303

SEQ ID NO: 424221 - RNA, 64 nt, Human; identical to SEQ ID NO: 345321

SEQ ID NO: 424222 - RNA, 64 nt, Human; identical to SEQ ID NO: 331682

SEQ ID NO: 424223 - RNA, 64 nt, Human; identical to SEQ ID NO: 345337

SEQ ID NO: 424224 - RNA, 64 nt, Human; identical to SEQ ID NO: 345338

SEQ ID NO: 424225 - RNA, 64 nt, Human; identical to SEQ ID NO: 345339

SEQ ID NO: 424226 - RNA, 64 nt, Human; identical to SEQ ID NO: 345355

SEQ ID NO: 424227 - RNA, 64 nt, Human; identical to SEQ ID NO: 345356

SEQ ID NO: 424228 - RNA, 64 nt, Human; identical to SEQ ID NO: 331683

SEQ ID NO: 424229 - RNA, 64 nt, Human; identical to SEQ ID NO: 345357

SEQ ID NO: 424230 - RNA, 64 nt, Human; identical to SEQ ID NO: 344279

SEQ ID NO: 424231 - RNA, 64 nt, Human; identical to SEQ ID NO: 344280

SEQ ID NO: 424232 - RNA, 64 nt, Human; identical to SEQ ID NO: 331700

SEQ ID NO: 424233 - RNA, 64 nt, Human; identical to SEQ ID NO: 345463

SEQ ID NO: 424234 - RNA, 64 nt, Human; identical to SEQ ID NO: 345464

SEQ ID NO: 424235 - RNA, 61 nt, Human
ugagcuuccuuuauuucuggcucacagaggcagccacgaggcacuacaccaaguauuauau

SEQ ID NO: 424236 - RNA, 61 nt, Human
uuaaauaacugagaccuaagucugggaacagagccacgaaucugccuuugagaugcuggca

SEQ ID NO: 424237 - RNA, 61 nt, Human
gauuccagcacugagccgugggccggucaugagccacgauaaaaaaugccaguuuggcaaa

SEQ ID NO: 424238 - RNA, 61 nt, Human
ugccaccagggagugccuauacauccuguccagccacgacauugagcagcacgcccccuau

SEQ ID NO: 424239 - RNA, 64 nt, Human; identical to SEQ ID NO: 345465

SEQ ID NO: 424240 - RNA, 64 nt, Human; identical to SEQ ID NO: 344231

SEQ ID NO: 424241 - RNA, 64 nt, Human; identical to SEQ ID NO: 344232

SEQ ID NO: 424242 - RNA, 64 nt, Human; identical to SEQ ID NO: 331701

SEQ ID NO: 424243 - RNA, 64 nt, Human; identical to SEQ ID NO: 345744

SEQ ID NO: 424244 - RNA, 57 nt, Human; identical to SEQ ID NO: 345745

SEQ ID NO: 424245 - RNA, 64 nt, Human; identical to SEQ ID NO: 345746

SEQ ID NO: 424246 - RNA, 64 nt, Human; identical to SEQ ID NO: 344115

SEQ ID NO: 424247 - RNA, 64 nt, Human; identical to SEQ ID NO: 344116

SEQ ID NO: 424248 - RNA, 64 nt, Human; identical to SEQ ID NO: 331702

SEQ ID NO: 424249 - RNA, 64 nt, Human; identical to SEQ ID NO: 344098

SEQ ID NO: 424250 - RNA, 64 nt, Human; identical to SEQ ID NO: 344099

SEQ ID NO: 424251 - RNA, 64 nt, Human; identical to SEQ ID NO: 344100

SEQ ID NO: 424252 - RNA, 64 nt, Human; identical to SEQ ID NO: 344101

SEQ ID NO: 424253 - RNA, 64 nt, Human; identical to SEQ ID NO: 344117

SEQ ID NO: 424254 - RNA, 61 nt, Human
ggguaugggaugagcauggagaagaggcaccagccacgauuccuuccuaagcaucuccugu

SEQ ID NO: 424255 - RNA, 61 nt, Human
acacaucaagcgaugaaacuggaaaacuacaagccacgaaugaaugaauuaggaaagaaaa

SEQ ID NO: 424256 - RNA, 61 nt, Human
ugauuggucauggggaagucucugcgccauaagccacgaucccagcgcaaaacccuuacuc

SEQ ID NO: 424257 - RNA, 61 nt, Human
guccaccccugcaaagccaagacccuucugcagccacgaauguccacggagcccgccggca

SEQ ID NO: 424258 - RNA, 64 nt, Human; identical to SEQ ID NO: 344118

SEQ ID NO: 424259 - RNA, 64 nt, Human; identical to SEQ ID NO: 331719

SEQ ID NO: 424260 - RNA, 64 nt, Human; identical to SEQ ID NO: 344149

SEQ ID NO: 424261 - RNA, 64 nt, Human; identical to SEQ ID NO: 344150

SEQ ID NO: 424262 - RNA, 64 nt, Human; identical to SEQ ID NO: 344151

SEQ ID NO: 424263 - RNA, 64 nt, Human; identical to SEQ ID NO: 344152

SEQ ID NO: 424264 - RNA, 64 nt, Human; identical to SEQ ID NO: 344166

SEQ ID NO: 424265 - RNA, 64 nt, Human; identical to SEQ ID NO: 344167

SEQ ID NO: 424266 - RNA, 64 nt, Human; identical to SEQ ID NO: 331720

SEQ ID NO: 424267 - RNA, 64 nt, Human; identical to SEQ ID NO: 344168

SEQ ID NO: 424268 - RNA, 64 nt, Human; identical to SEQ ID NO: 344169

SEQ ID NO: 424269 - RNA, 64 nt, Human; identical to SEQ ID NO: 344263

SEQ ID NO: 424270 - RNA, 64 nt, Human; identical to SEQ ID NO: 344264

SEQ ID NO: 424271 - RNA, 64 nt, Human; identical to SEQ ID NO: 331721

SEQ ID NO: 424272 - RNA, 64 nt, Human; identical to SEQ ID NO: 344183

SEQ ID NO: 424273 - RNA, 64 nt, Human
aaccaccccaggucagcgcugcgccugcuguggccgccgcgagccacgcccucugggaucucug

SEQ ID NO: 424274 - RNA, 64 nt, Human; identical to SEQ ID NO: 359234

SEQ ID NO: 424275 - RNA, 64 nt, Human; identical to SEQ ID NO: 359235

SEQ ID NO: 424276 - RNA, 64 nt, Human; identical to SEQ ID NO: 359239

SEQ ID NO: 424277 - RNA, 64 nt, Human; identical to SEQ ID NO: 359240

SEQ ID NO: 424278 - RNA, 64 nt, Human; identical to SEQ ID NO: 359241

SEQ ID NO: 424279 - RNA, 64 nt, Human; identical to SEQ ID NO: 359232

SEQ ID NO: 424280 - RNA, 64 nt, Human; identical to SEQ ID NO: 359243

SEQ ID NO: 424281 - RNA, 64 nt, Human; identical to SEQ ID NO: 359244

SEQ ID NO: 424282 - RNA, 64 nt, Human; identical to SEQ ID NO: 359245

SEQ ID NO: 424283 - RNA, 64 nt, Human; identical to SEQ ID NO: 359246

SEQ ID NO: 424284 - RNA, 64 nt, Human; identical to SEQ ID NO: 359247

SEQ ID NO: 424285 - RNA, 64 nt, Human; identical to SEQ ID NO: 359248

SEQ ID NO: 424286 - RNA, 64 nt, Human; identical to SEQ ID NO: 359249

SEQ ID NO: 424287 - RNA, 64 nt, Human; identical to SEQ ID NO: 359250

SEQ ID NO: 424288 - RNA, 62 nt, Human
cuuacaucacccucaccuaggccggcucggcucgccgcgacucugggguggugcucgccuac

SEQ ID NO: 424289 - RNA, 64 nt, Human
gcgcgggacaggacuugugcgccggcgccccggacgccgcgauuuugccuuugguuccccgcga

SEQ ID NO: 424290 - RNA, 64 nt, Human
agcucgguacugucacaguggagccucucaacaacgcugugaggcagcaccauuugacagguua

SEQ ID NO: 424291 - RNA, 64 nt, Human
aaaaaaaugaaaaagaugcagacuggucuuuuagagacggcaugguauauuacuauuuccacau

SEQ ID NO: 424292 - RNA, 64 nt, Human
cuggggcccccugccagccccuucccaggcugggagacggcagaagagauagaaucagggcugc

SEQ ID NO: 424293 - RNA, 64 nt, Human
cgcgugcaccugcaugacacacgcaaggagcaggagacggcauugcgcgucuacagccaccuca

SEQ ID NO: 424294 - RNA, 64 nt, Human
gagagagggaccagcgcccagcguuagggcuggaagacggcaguguucagaauuccagccgcuc

SEQ ID NO: 424295 - RNA, 64 nt, Human
gguguccugcagaccggcugaccacuccuuuuggagacggcaggaggccugagcgauccguacu

SEQ ID NO: 424296 - RNA, 64 nt, Human
aaaaauggagcaaagugguagguacuuuuugugaagacggcacggucuucccucuucccucagu

SEQ ID NO: 424297 - RNA, 64 nt, Human
uguuuugauggauuuucauuucuucgcacuucugagacggcaaagccaaccacuuagaagccuu

SEQ ID NO: 424298 - RNA, 64 nt, Human
ggugggaagcuugcuggcuucuguugcgccacugagacggcagagaccccaggaucccagagcu

SEQ ID NO: 424299 - RNA, 64 nt, Human
gaaggggugguggucaacgggagggaggaggagcagacggcagaggaaauccucagcaaaggcc

SEQ ID NO: 424300 - RNA, 64 nt, Human
guggggagauccugggaagggaggcacuggaggaagacggcaccucuucccccauggcagggug

SEQ ID NO: 424301 - RNA, 64 nt, Human
ggggugacacucggcucuggcucugagaugaggcagacggcacccaggcugugaucuguccugg

SEQ ID NO: 424302 - RNA, 64 nt, Human
agcauccuccaaaacuuagacccaugcuggucagagacggcagaaaacagagccugccuaacca

SEQ ID NO: 424303 - RNA, 64 nt, Human
uguagugaacugaggcaacaguccacuucagggcagacggcaauaaucucuuacaagaaugaag

SEQ ID NO: 424304 - RNA, 64 nt, Human
ccucuggccaggaguaguggcugagcucugugaucgcugugauguggacccagcuccagggagc

SEQ ID NO: 424305 - RNA, 64 nt, Human
cugcuggcuacugggugugcuguccccauguucccgcugugauuuggcagaaacacaauaggcu

SEQ ID NO: 424306 - RNA, 64 nt, Human
uugaucacaguggcgagaggagaggaaaaacgaucgcugugaaaaugaggaggauugcuucuug

SEQ ID NO: 424307 - RNA, 64 nt, Human
ccauaccuagagccaagaaccaugaaggccugagagacggcagacugagcagaauuccuuuuuu

SEQ ID NO: 424308 - RNA, 64 nt, Human
aggagccagaugcccccagaaaggugggugguggagacggcaccagauguaccaguuuucugca

SEQ ID NO: 424309 - RNA, 64 nt, Human
aauuuuggcaugaacccccccuuguuccaaaugaagacggcaucacgaagcagcuccaaaagga

SEQ ID NO: 424310 - RNA, 64 nt, Human
ugaaagaaaaagaccuaugagcacauaggacucuagacggcauccagccggaggccagagcuga

SEQ ID NO: 424311 - RNA, 64 nt, Human
cuuaacacuccccauuggagcaagcuugcccuagagacggcaggaucaugggagcaugcuuacc

SEQ ID NO: 424312 - RNA, 64 nt, Human
gggcagccugggccugggcuuggcccagggaaacagacggcagacacaccugucccccagugau

SEQ ID NO: 424313 - RNA, 64 nt, Human
cugcccuuugcuguccucagagugcauuuccuggagacggcaggcuuaggucucacugacagca

SEQ ID NO: 424314 - RNA, 64 nt, Human
cgggccgguauuuacacacgcgcaaaacacccagagacggcacaaggagguugaacucauguuu

SEQ ID NO: 424315 - RNA, 64 nt, Human
cacaagacugaacaacguguauuuacacgaggguagacggcagaugccugacagagaguggguu

SEQ ID NO: 424316 - RNA, 64 nt, Human
uccaggccccugucucaacuuggagagaggugacagacggcagaucuuccaaaucaaauuccuu

SEQ ID NO: 424317 - RNA, 64 nt, Human
aaggggaaugaaucaacucuugguucuuuccugaagacggcaguguuguggauaagugaguuuu

SEQ ID NO: 424318 - RNA, 64 nt, Human
gcuaacuggccccaggcggaggggcuuggagcagagacggcagccccauccuucccgcagcacc

SEQ ID NO: 424319 - RNA, 64 nt, Human
guggccccagcuguugacuuccagucacugucccagacggcacaagguuuucuguaggaaagcu

SEQ ID NO: 424320 - RNA, 64 nt, Human
gcuaagaucacaccacuacacuccagccugggcgagacggcaagacuccaucucaaaaaaaaaa

SEQ ID NO: 424321 - RNA, 64 nt, Human
gccacagcccagcugagcaugaggcccagcccauagacggcacaggccaccuggcccauucccu

SEQ ID NO: 424322 - RNA, 64 nt, Human
cuggggaucugagguuuggucugggcucagugggagacggcagugcaauccugaugagugaugu

SEQ ID NO: 424323 - RNA, 64 nt, Human
caaggguuccaccccuaccgacgcuagcccgcggcgccgcgacgucugcacggcccagacccag

SEQ ID NO: 424324 - RNA, 64 nt, Human
cgccuguacuuuuuugaaccauccagccuuaauucgcugugaacagugugagaugccaaggcau

SEQ ID NO: 424325 - RNA, 64 nt, Human
aaugucucugaacucaaagugaggugcuccaagacgcugugaacuucugcaaagacaccuccuu

SEQ ID NO: 424326 - RNA, 64 nt, Human
aaacacacugcuauggggaaaaucacagggagggcgcugugaccagcgcacucaggcaccaagu

SEQ ID NO: 424327 - RNA, 64 nt, Human
aaguggugaccagacacugcccacugcagugccaagacggcagcaggacuggggcugauagccc

SEQ ID NO: 424328 - RNA, 64 nt, Human
cucuccuuuccggcgcaacuuccagaguggugggagacggcaaucuuuacauuucccucaucuu

SEQ ID NO: 424329 - RNA, 64 nt, Human
ccuauuccagcccccuugcuucacucuaccggacagacggcagcagucccagcucugguuuccu

SEQ ID NO: 424330 - RNA, 64 nt, Human
gccacugaugagacuaaaacuggcuuccccuuggagacggcagauuucaggcugaucccugcuu

SEQ ID NO: 424331 - RNA, 64 nt, Human
ggucuuugccagacaacuuguccugacucaacagagacggcagccugaccuuugagcuggcuug

SEQ ID NO: 424332 - RNA, 64 nt, Human
ugcagacccucagcuaggcccagaugguggggacagacggcagagaaagagcaugcauugcucu

SEQ ID NO: 424333 - RNA, 64 nt, Human
cuuuccagcgcuugguggaaucugggcuggggaaagacggcaccgggaaacucugcuuccccau

SEQ ID NO: 424334 - RNA, 64 nt, Human
gagugggcaucucaucugccuguggucagcucucagacggcagggagcggagcugacguuggcu

SEQ ID NO: 424335 - RNA, 64 nt, Human
gcgcuccagggacucugcccgcccccgcgacuggagacggcaucucguucacagcacccacccu

SEQ ID NO: 424336 - RNA, 64 nt, Human
gaggccuuucccaaagggcguccucccgggaugcagacggcaggugugugggaagcgccguuua

SEQ ID NO: 424337 - RNA, 64 nt, Human
ccugagggcaaguccuaauagcccugagacaccgagacggcauguucuucauuagacggaaagg

SEQ ID NO: 424338 - RNA, 64 nt, Human
ggcucuccuggauccguaccuaaaaauacaucucagacggcagcuauuacuacaaagguacauu

SEQ ID NO: 424339 - RNA, 64 nt, Human
cauuuuugaacaauuuaccugucaauaaagcagaagacggcaguuuuaaaguucccaguggucc

SEQ ID NO: 424340 - RNA, 51 nt, Human
cguccagccuucuggagugacagacggcaugagugagcgggaggccagggc

SEQ ID NO: 424341 - RNA, 64 nt, Human
gggggccguggcacugaggccgaaagugccugccagacggcacggucugggugcggguguuccc

SEQ ID NO: 424342 - RNA, 64 nt, Human
gccagaguagcugauguaggaguacugggaggccagacggcacgaggucuccaaggccccagca

SEQ ID NO: 424343 - RNA, 64 nt, Human
gcccuggaggcggggcugaggaacagggaaaugccgcugugaagucuuaaagcacuucugcuua

SEQ ID NO: 424344 - RNA, 64 nt, Human
gugccuggcauguaggaagcaccuggaaaauauucgcugugauuaccaucaguccauuuuaccg

SEQ ID NO: 424345 - RNA, 64 nt, Human
ccucuguguucccgcggaaaccaaccaaaccgugcgcugugacccauugcuguucucuguaucg

SEQ ID NO: 424346 - RNA, 64 nt, Human
cauuccaugacgcaggagcuguggaaauggugagcgcugugagauggauguauuuguagccagu

SEQ ID NO: 424347 - RNA, 64 nt, Human
caccuggcucacuggcucauuccaggagugggagagacggcagggucuccucuuuguccuccgg

SEQ ID NO: 424348 - RNA, 64 nt, Human
agggaagagggggccaugagccggccagcaguggagacggcaguccaguuucucuccccucuga

SEQ ID NO: 424349 - RNA, 64 nt, Human
cugcacacccauuucagccaucaagaacccacacagacggcagggaagguggacacaguaugaa

SEQ ID NO: 424350 - RNA, 64 nt, Human
gacgcagugaguguugcucaagggagucaggaagagacggcaacguaaaggauguggcuccaug

SEQ ID NO: 424351 - RNA, 64 nt, Human
ccugacucacagcauauaggucaggaaagaauggagacggcauucuuggacuucacuggggcug

SEQ ID NO: 424352 - RNA, 64 nt, Human
ugcugcccuaggcuccgucaguaucaggccugccagacggcacccacccagcacccagcaacuc

SEQ ID NO: 424353 - RNA, 64 nt, Human
acugcuccuccccucccccaucuagagucuagacagacggcacaggccuaggagacuaggaggg

SEQ ID NO: 424354 - RNA, 64 nt, Human
ucuccuucucuuccuucacuuugcagaggcuggaagacggcagccgccggacugggcagauccu

SEQ ID NO: 424355 - RNA, 64 nt, Human
gaggacgcagagggcagaggcccaguggagccucagacggcacagucagagucgggggccugcc

SEQ ID NO: 424356 - RNA, 64 nt, Human
ccagcacaguggagaggccggaagugagacgggcagacggcaccugcagccugaaacgcaccgc

SEQ ID NO: 424357 - RNA, 64 nt, Human
caggagcugugauugacaguagcuguagguuaccagacggcaacauuagaaagugauuguaaau

SEQ ID NO: 424358 - RNA, 64 nt, Human
uagacuauacaaauuaagugguaagcaguuauaaagacggcaagaccaugcuauugaaaaaguu

SEQ ID NO: 424359 - RNA, 64 nt, Human
cagccugagcaccggggggugccccuccagucccagacggcaauguuccucccuccaacugucc

SEQ ID NO: 424360 - RNA, 64 nt, Human
cuccgcagggccugcgcgucuccggcuuccacccagacggcacucaagccugcccccgaggcgu

SEQ ID NO: 424361 - RNA, 64 nt, Human
ugggcagccugcuggucagcacuccaguagcgagagacggcacccagaaucagaucccagcuuc

SEQ ID NO: 424362 - RNA, 64 nt, Human
agaaucggcuaugucuucauuaugagagcaggagagacggcagagauauguugcuaggugaaua

SEQ ID NO: 424363 - RNA, 64 nt, Human
ggccgugggagaauggcugggcagagcagaggggcagcgauagacucuggggauggagcaggac

SEQ ID NO: 424364 - RNA, 64 nt, Human
gagccagaucgacaacaucaaccuguucaaggugcagcgauacugugagaagagcaugaucagc

SEQ ID NO: 424365 - RNA, 64 nt, Human
ccagaaggauuuugccagcguagugcuccuggaccagcgauaugcccggcccccuguccuggcc

SEQ ID NO: 424366 - RNA, 64 nt, Human
gaggaagguauucugucccacagguuucuguggacagcgauacagcaggagucagugaaaucaa

SEQ ID NO: 424367 - RNA, 64 nt, Human
ucauccucauccuccuccuccuccacuugcagcgagacggcagcacagaccccuggagguccag

SEQ ID NO: 424368 - RNA, 64 nt, Human
uccuguacccauaaaaaccccaggcuccacuggcagacggcagacaaggggagaagagacgaag

SEQ ID NO: 424369 - RNA, 64 nt, Human
uugggguuaaugauggagggagacaccuccucauagacggcaggugcccaccuuucagggaguc

SEQ ID NO: 424370 - RNA, 64 nt, Human
acagugagcaacaagccuggguuucccugcuggcagacggcagaucccucaggaaaccugcucc

SEQ ID NO: 424371 - RNA, 64 nt, Human
agucuccacacagugguggggaggccuucuggacagacggcagucgggccccagagcaagaagg

SEQ ID NO: 424372 - RNA, 64 nt, Human
guguuuuguagauuucuugacagugcuguaauacagacggcaaugcaauagccuauuuaaagac

SEQ ID NO: 424373 - RNA, 64 nt, Human
auggguguguuuaguggggaaagggacggggugcagacggcagggccaguauggggcccccucc

SEQ ID NO: 424374 - RNA, 64 nt, Human
ucaaaacgcuccaucuuuuuacaguggcauaggaagacggcaaaaauuuccuaaagugcaauag

SEQ ID NO: 424375 - RNA, 64 nt, Human
cacaauuuacaaaugaucuuugcaaauaguggucagacggcauuaguuuuucccuuaguuaagc

SEQ ID NO: 424376 - RNA, 64 nt, Human
gaccaaauggaaacagaggaccagcacacucccgagacggcacugagagagcgcagccgccuuc

SEQ ID NO: 424377 - RNA, 64 nt, Human
uuccuggaaggcccuccagcuggaugcuggggaucagcgauaggugaggggacacaguguagga

SEQ ID NO: 424378 - RNA, 64 nt, Human
ccacccccaggggccuccacaggccgcugcaugacagcgauacaguacuuaagugucuguguag

SEQ ID NO: 424379 - RNA, 64 nt, Human
ccaugggcuacuacugggcauuagugcaauauaacagcgauaauaaaauucucuauuagucugu

SEQ ID NO: 424380 - RNA, 64 nt, Human
uaauuuuggugugaucuagcaaaagaguaggaaucagcgauacaaccacuuuggaaguuuauag

SEQ ID NO: 424381 - RNA, 64 nt, Human
agcuacugaagggacccaaggcacccccugaagccagcgauagagggucccucucugcucccca

SEQ ID NO: 424382 - RNA, 64 nt, Human
ugcaugcucugccuuucuugugaaaguuuucaaucagcgauaucagcacuuacaguaagaagua

SEQ ID NO: 424383 - RNA, 64 nt, Human
ucuucuauuguuuuuuaaccuuacagguccccaacagcgauacugcuguuucucgagguaagag

SEQ ID NO: 424384 - RNA, 64 nt, Human
aaauggugugggagaugugagaccauucugaggucagcgauagcccaaaggcucugcaguauuc

SEQ ID NO: 424385 - RNA, 62 nt, Human; identical to SEQ ID NO: 348596

SEQ ID NO: 424386 - RNA, 62 nt, Human; identical to SEQ ID NO: 348597

SEQ ID NO: 424387 - RNA, 62 nt, Human; identical to SEQ ID NO: 348598

SEQ ID NO: 424388 - RNA, 62 nt, Human; identical to SEQ ID NO: 348599

SEQ ID NO: 424389 - RNA, 62 nt, Human; identical to SEQ ID NO: 348600

SEQ ID NO: 424390 - RNA, 62 nt, Human; identical to SEQ ID NO: 348601

SEQ ID NO: 424391 - RNA, 62 nt, Human; identical to SEQ ID NO: 348602

SEQ ID NO: 424392 - RNA, 62 nt, Human; identical to SEQ ID NO: 348603

SEQ ID NO: 424393 - RNA, 62 nt, Human; identical to SEQ ID NO: 348604

SEQ ID NO: 424394 - RNA, 62 nt, Human; identical to SEQ ID NO: 348605

SEQ ID NO: 424395 - RNA, 62 nt, Human; identical to SEQ ID NO: 348606

SEQ ID NO: 424396 - RNA, 62 nt, Human; identical to SEQ ID NO: 348607

SEQ ID NO: 424397 - RNA, 62 nt, Human; identical to SEQ ID NO: 348608

SEQ ID NO: 424398 - RNA, 62 nt, Human; identical to SEQ ID NO: 348609

SEQ ID NO: 424399 - RNA, 62 nt, Human; identical to SEQ ID NO: 348610

SEQ ID NO: 424400 - RNA, 62 nt, Human; identical to SEQ ID NO: 348611

SEQ ID NO: 424401 - RNA, 62 nt, Human; identical to SEQ ID NO: 348612

SEQ ID NO: 424402 - RNA, 62 nt, Human; identical to SEQ ID NO: 348613

SEQ ID NO: 424403 - RNA, 62 nt, Human; identical to SEQ ID NO: 348614

SEQ ID NO: 424404 - RNA, 62 nt, Human; identical to SEQ ID NO: 348615

SEQ ID NO: 424405 - RNA, 62 nt, Human; identical to SEQ ID NO: 348616

SEQ ID NO: 424406 - RNA, 62 nt, Human; identical to SEQ ID NO: 348617

SEQ ID NO: 424407 - RNA, 62 nt, Human; identical to SEQ ID NO: 348618

SEQ ID NO: 424408 - RNA, 62 nt, Human; identical to SEQ ID NO: 348619

SEQ ID NO: 424409 - RNA, 62 nt, Human; identical to SEQ ID NO: 348620

SEQ ID NO: 424410 - RNA, 62 nt, Human; identical to SEQ ID NO: 348621

SEQ ID NO: 424411 - RNA, 62 nt, Human; identical to SEQ ID NO: 348622

SEQ ID NO: 424412 - RNA, 62 nt, Human; identical to SEQ ID NO: 348623

SEQ ID NO: 424413 - RNA, 51 nt, Human; identical to SEQ ID NO: 348624

SEQ ID NO: 424414 - RNA, 62 nt, Human; identical to SEQ ID NO: 348625

SEQ ID NO: 424415 - RNA, 62 nt, Human; identical to SEQ ID NO: 348626

SEQ ID NO: 424416 - RNA, 62 nt, Human; identical to SEQ ID NO: 348627

SEQ ID NO: 424417 - RNA, 62 nt, Human; identical to SEQ ID NO: 348628

SEQ ID NO: 424418 - RNA, 62 nt, Human; identical to SEQ ID NO: 348629

SEQ ID NO: 424419 - RNA, 62 nt, Human; identical to SEQ ID NO: 348630

SEQ ID NO: 424420 - RNA, 62 nt, Human; identical to SEQ ID NO: 348631

SEQ ID NO: 424421 - RNA, 62 nt, Human; identical to SEQ ID NO: 348632

SEQ ID NO: 424422 - RNA, 62 nt, Human; identical to SEQ ID NO: 348633

SEQ ID NO: 424423 - RNA, 62 nt, Human; identical to SEQ ID NO: 348634

SEQ ID NO: 424424 - RNA, 62 nt, Human; identical to SEQ ID NO: 348635

SEQ ID NO: 424425 - RNA, 62 nt, Human; identical to SEQ ID NO: 348636

SEQ ID NO: 424426 - RNA, 62 nt, Human; identical to SEQ ID NO: 348637

SEQ ID NO: 424427 - RNA, 62 nt, Human; identical to SEQ ID NO: 348638

SEQ ID NO: 424428 - RNA, 62 nt, Human; identical to SEQ ID NO: 348639

SEQ ID NO: 424429 - RNA, 62 nt, Human; identical to SEQ ID NO: 348640

SEQ ID NO: 424430 - RNA, 62 nt, Human; identical to SEQ ID NO: 348641

SEQ ID NO: 424431 - RNA, 62 nt, Human; identical to SEQ ID NO: 348642

SEQ ID NO: 424432 - RNA, 57 nt, Human; identical to SEQ ID NO: 348643

SEQ ID NO: 424433 - RNA, 62 nt, Human; identical to SEQ ID NO: 348644

SEQ ID NO: 424434 - RNA, 62 nt, Human; identical to SEQ ID NO: 348645

SEQ ID NO: 424435 - RNA, 62 nt, Human; identical to SEQ ID NO: 348646

SEQ ID NO: 424436 - RNA, 62 nt, Human; identical to SEQ ID NO: 348647

SEQ ID NO: 424437 - RNA, 62 nt, Human; identical to SEQ ID NO: 348648

SEQ ID NO: 424438 - RNA, 63 nt, Human
agggagcccagccuauucccguuggcuggcugggccccucagcugcugggccccaccucccca

SEQ ID NO: 424439 - RNA, 63 nt, Human
uuccagggggcucugcuccaaguucccuagcgggccccucagggagaaauagccucacgugca

SEQ ID NO: 424440 - RNA, 63 nt, Human
cugagaugugggaggugcagcauguuccccugggccccucagaaagucgagcuuggaggccag

SEQ ID NO: 424441 - RNA, 63 nt, Human
ccagaugucugcagcccucagcagcugcagaccgccccucaccaacccagagaaccugcuuua

SEQ ID NO: 424442 - RNA, 63 nt, Human
gcauuggugccaaguccaguggaugagaauccagccccucacaagcugugggauggggcuugg

SEQ ID NO: 424443 - RNA, 63 nt, Human
aggcaccgugggccuggcacuugcaaaaguguggccccucacucuaguguguggucccucuca

SEQ ID NO: 424444 - RNA, 63 nt, Human
ucuaacugggccuaaggugagcugagggcuugagccccucagcccagcgggggucccuuuuca

SEQ ID NO: 424445 - RNA, 63 nt, Human
acugcgggagccagcgcuccugccgccccucuugccccucagaccuugcauccacagaagcac

SEQ ID NO: 424446 - RNA, 63 nt, Human
agugauucucccagaagcacaaagcauacucuugccccucagguguugcuuguguacaucgua

SEQ ID NO: 424447 - RNA, 63 nt, Human
aggcaacaauagagacacaggcuggguuggucugccccucagucaggcccccuuacccaccca

SEQ ID NO: 424448 - RNA, 63 nt, Human
ccauggagugggaauccccagccgaggcccuaggccccucagcagggaagggauccccgggga

SEQ ID NO: 424449 - RNA, 63 nt, Human
cugcaucuuggaggcagggaggugagggcaggugccccucagacacuucaggaagguaguuug

SEQ ID NO: 424450 - RNA, 63 nt, Human
caaucaugugaaggacagaagcuuuugccaugggccccucacaucagggaaaaugaccuucac

SEQ ID NO: 424451 - RNA, 63 nt, Human
ugcccaccccucaaguguaaggaacugcguuccgccccucaggcccccaugggggcagggauc

SEQ ID NO: 424452 - RNA, 63 nt, Human
uugauaaaucagaggugcuacugaggaguuggugccccucauuccagaaucuccuacccccag

SEQ ID NO: 424453 - RNA, 63 nt, Human
uacuuauuucuggccaaaugaaucugcuucucugccccucaaacuuuuaguucacaauucauc

SEQ ID NO: 424454 - RNA, 63 nt, Human
aaagcacucuuauuuuuugaucuggccuauuuugccccucauuguguagccucaauuaacaca

SEQ ID NO: 424455 - RNA, 63 nt, Human
gccucugggaggagagggacuccuggggggccugccccucauacgccaucaccaaaaggaaag

SEQ ID NO: 424456 - RNA, 63 nt, Human
cuuccugcccuguguuaggagauagggauauuggccccucacugcagcugccagcacuugguc

SEQ ID NO: 424457 - RNA, 63 nt, Human
ccccuagccccuucccuccuccuggggccuccagccccucacacugcuguucccagugauauu

SEQ ID NO: 424458 - RNA, 63 nt, Human
augccgggaagccagagaccugcaggggccucggccccucacaucguguaugucucuccuuga

SEQ ID NO: 424459 - RNA, 63 nt, Human
cucugcucccuucuucaguaagcaaggagccccgccccucaggcccagccucuggcaagaggu

SEQ ID NO: 424460 - RNA, 59 nt, Human
gcuucgccaagcuggacugagccuuccaggccccucaugcagaccugggguccuccugg

SEQ ID NO: 424461 - RNA, 63 nt, Human
ggccugaacugccucugcuucccccccugaggggccccucacucuuacccaagacucuggauu

SEQ ID NO: 424462 - RNA, 63 nt, Human
uagcccagcccaucuaaauggaagcugggaauugccccucaccuccccuguguccuguccagc

SEQ ID NO: 424463 - RNA, 63 nt, Human
gcacacacugcaugccuuaacaagugugugcaagccccucagaacucaagacauccaaauuuu

SEQ ID NO: 424464 - RNA, 63 nt, Human
aaagauuucugaacagugauugucccguuaauagccccucagaagauguucccugcugauaac

SEQ ID NO: 424465 - RNA, 63 nt, Human
gucauaaaaaacaguggagcucuguauuagaaagccccucagaacugggaaggccagguaacu

SEQ ID NO: 424466 - RNA, 63 nt, Human
ucgguauauuaaguccaaaagaugguccgggcugccccucacaaaagcuucugcauccacgug

SEQ ID NO: 424467 - RNA, 63 nt, Human
agccugggacccuguuuacaguugcacaucugggccccucacuguggggauugaucauucuca

SEQ ID NO: 424468 - RNA, 63 nt, Human
acuccugggcuucagccucucccacccagcccugccccucaccugccugcccuccccuccccc

SEQ ID NO: 424469 - RNA, 63 nt, Human
gcuggaagaagccuuagagcucaacuucuucaagccccucacuuuacagaugaggaaauggag

SEQ ID NO: 424470 - RNA, 63 nt, Human
ggccagaagcaccagccugcugccagcggggcagccccucauaggaggcccaggagggagccc

SEQ ID NO: 424471 - RNA, 63 nt, Human
ccacagcccugagaugggccggcccccuuccuggccccucauggcgggacuggagaaaugguc

SEQ ID NO: 424472 - RNA, 63 nt, Human
ccggcccauaucccugguugccucauggccagcgccccucagccucugccacugugaaccggc

SEQ ID NO: 424473 - RNA, 63 nt, Human
ucugagcagccguguugggggcgcucccucucugccccucagcgagagccucggaccucccaa

SEQ ID NO: 424474 - RNA, 63 nt, Human
cgaccugcugacccacggucacugcuguguucagccccucagcucggccccagccuauuuccc

SEQ ID NO: 424475 - RNA, 63 nt, Human
gagagggcccagcuguagccauggcucaggcaagccccucagcccuugcccccaucccucgga

SEQ ID NO: 424476 - RNA, 57 nt, Human
uuuucuuuaaaacaucauaaggccagggccccucacccugccuuaucuugcacccca

SEQ ID NO: 424477 - RNA, 63 nt, Human
cuuuucgaacugugcucccacggggaccacugggccccucaggggaagcugcuaggggaagga

SEQ ID NO: 424478 - RNA, 63 nt, Human
ggaggggaggcggaucugaggggcugggugcaggccccucaguuggggcucccaccuucccca

SEQ ID NO: 424479 - RNA, 63 nt, Human
uggggucccagggcccuuccuuguuucucagaggccccucagccacuggaaccccaucuucag

SEQ ID NO: 424480 - RNA, 63 nt, Human
cagccucuuuccgucccucucuuucugauccaggccccucaguccaagcuuuggaaaaccuuc

SEQ ID NO: 424481 - RNA, 63 nt, Human
gaagcacaugccucucucaggccaaacucaccugccccucaacucuccuccagagucagaagu

SEQ ID NO: 424482 - RNA, 63 nt, Human
cccagcugcagccacccuucucaucuggaucgggccccucagaagcaggaaacccucaaaccc

SEQ ID NO: 424483 - RNA, 63 nt, Human
uguccuacaucucccugaaccagagugugcccugccccucaugcucagaccucucccacccca

SEQ ID NO: 424484 - RNA, 63 nt, Human
uuuuuguauuucuggggcugaggcucagcaacagccccucaggcuuccagugaguccccaucu

SEQ ID NO: 424485 - RNA, 63 nt, Human
gugagaaagcuaaaaugguggucuucuccaccagccccucacaggcuuggggguuuucaaugu

SEQ ID NO: 424486 - RNA, 63 nt, Human
aaccagugcauucuacuucucgaguguucacuugccccucaguuugugaccaaguugugggua

SEQ ID NO: 424487 - RNA, 63 nt, Human
caacuauagacuugcucauuguucagacugauugccccucaccugaauccacucucuguauuc

SEQ ID NO: 424488 - RNA, 63 nt, Human
cucuaucuuuagauuucaaaccuuaggcuuacagccccucaauaucucucugcuaacaccagu

SEQ ID NO: 424489 - RNA, 63 nt, Human
gaccccucccuugcucagugccuccuggccggggccccucaccccaaggggucuguauauaca

SEQ ID NO: 424490 - RNA, 63 nt, Human
acauuaaucaccaaaguauuaauguacagaguggccccucaccugggccuuuccugugccaac

SEQ ID NO: 424491 - RNA, 63 nt, Human
guccauccuggagacccugaggucuaagcuacagccccucagccaaccacagacccuucucug

SEQ ID NO: 424492 - RNA, 63 nt, Human
uuccuggcucgucucaaaggccaggacccuggggccccucaacugcagucagagagcaagccc

SEQ ID NO: 424493 - RNA, 63 nt, Human
uaccugaccaacaguuccuucagcuuccauuucgccccucauuuaucccucaacccccagccc

SEQ ID NO: 424494 - RNA, 63 nt, Human
uaugcuacuuucucucagcauccaauaaucauggccccucaauuuauuuguggucacccaggg

SEQ ID NO: 424495 - RNA, 63 nt, Human
aaaaagugcggaggaaguagcuggacaggcccugccccucaccagcaagaggcaugauuggau

SEQ ID NO: 424496 - RNA, 63 nt, Human
ccuuccugcucacauccacagucagggcacggcgccccucaagaacuccagagucaccugucu

SEQ ID NO: 424497 - RNA, 63 nt, Human
caaaacccaaguagaugccucuaggggcacauggccccucacaucacaagccagaaccuaagc

SEQ ID NO: 424498 - RNA, 63 nt, Human
uuagccauccccuccucagcaaggcaucuaccggccccucacagagacaguacuuugaaacuc

SEQ ID NO: 424499 - RNA, 63 nt, Human
agagaaaaacccuccucugguaguucugugugugccccucaccccugugugcuagugucuggg

SEQ ID NO: 424500 - RNA, 63 nt, Human
uugcccuugcaaaggcuuccuaggucuccaguggccccucaggacccagggucccagcugcug

SEQ ID NO: 424501 - RNA, 63 nt, Human
agugacccuggcaguguuugccugcucagaguggccccucagaacaacagggcuggccuugga

SEQ ID NO: 424502 - RNA, 63 nt, Human
cccagucauccagcagcgucaacaucgugaugggccccucagccagggcugccagccaggcca

SEQ ID NO: 424503 - RNA, 63 nt, Human
cgcgaagugaaggaugcgucacuuuucugagcggccccucagaccucuccugcuggucccugg

SEQ ID NO: 424504 - RNA, 57 nt, Human
ggcuccagaguugcaagugacaggagggccccucaggcagagauggaccaggcggug

SEQ ID NO: 424505 - RNA, 63 nt, Human
ucaaaauauauucagcaaaggguucacuuaguugccccucaugcuucacagguugacuaguau

SEQ ID NO: 424506 - RNA, 63 nt, Human
ugugaaugugccucguucaucccuggugcuugagccccucaagcuccagucaaugauccaguc

SEQ ID NO: 424507 - RNA, 63 nt, Human
ccacucucugcccacuaccuaugcuucuagaaagccccucaccucaggaccccagagggacca

SEQ ID NO: 424508 - RNA, 63 nt, Human
guguugcgcccggagcccgcccuucgccucccagccccucaagacaccgcuggcugcuggaca

SEQ ID NO: 424509 - RNA, 63 nt, Human
gcccggccccgccgcggcccggacccccagccagccccucacagcucuuccccagcuccgccu

SEQ ID NO: 424510 - RNA, 63 nt, Human
cacucuggccaaggagcucugaauugugagucugccccucaggggaauucggagcuagaggac

SEQ ID NO: 424511 - RNA, 63 nt, Human
ccuucccccauccaugguugggaaagaagcucagccccucacaguggccucaagugugaugcc

SEQ ID NO: 424512 - RNA, 63 nt, Human
gcgccccggcugggcggaggaggagacgcccaugccccucaggggaaaguggagaccgggaca

SEQ ID NO: 424513 - RNA, 63 nt, Human
gcugcacaugccagugugacccuugaagacagugccccucagagaccccaagaccuuagggau

SEQ ID NO: 424514 - RNA, 63 nt, Human
cuaaugacacccacuccuagcccugaggcucgugccccucagacuggggaagaguccaaggaa

SEQ ID NO: 424515 - RNA, 63 nt, Human
cuggggagggcccucuggccccaggcaaccuuagccccucagaacagggagucccaggaccca

SEQ ID NO: 424516 - RNA, 63 nt, Human
gcuccguaagaacucagaugccugggaagcccagccccucaggugcccccacacacagccuuc

SEQ ID NO: 424517 - RNA, 63 nt, Human
uuuauucacucuucagacacgcuacucaagagugccccucagcugcugaacaagcauuuguag

SEQ ID NO: 424518 - RNA, 63 nt, Human
agaccucuuauugcccauucuccuuucuucucagccccucaccccucuuuagcaauuccuaga

SEQ ID NO: 424519 - RNA, 63 nt, Human
ggcccacugagcugcacugggauucuucacucugccccucacuuccuuuagggcaaauaacac

SEQ ID NO: 424520 - RNA, 63 nt, Human
cuuuuuauacuuuguaaagacaauuguuggagagccccucacacagcccuggccucugcucaa

SEQ ID NO: 424521 - RNA, 63 nt, Human
uuccugugcugcccugcaccuaggagagacucagccccucacagcuugggauguuaccuugcc

SEQ ID NO: 424522 - RNA, 63 nt, Human
acuugccacaggagcgauguguuuucucugagugccccucacuuacauguuuaucuuuguuug

SEQ ID NO: 424523 - RNA, 63 nt, Human
ucccacgccugcccacuuugcuagcccggcugugccccucacuaucagagacugggcgaagca

SEQ ID NO: 424524 - RNA, 63 nt, Human
cuuccagccccuccaggacccggucccccugcugccccucacuucaggaggggccuggagcag

SEQ ID NO: 424525 - RNA, 63 nt, Human
uagguuuuuauuguugaauguacaucuaccccagccccucaaaagaaaaacuguuuacauaga

SEQ ID NO: 424526 - RNA, 63 nt, Human
gcuauuuuuauagcugauauaguuacaccucaagccccucagggguaacaacuaacaaacacc

SEQ ID NO: 424527 - RNA, 63 nt, Human
guuuucuagaagguugggauugucaggguccuggccccucagaacuggcuugaucaagggccu

SEQ ID NO: 424528 - RNA, 63 nt, Human
gaugcagccgucugaugaggccacaaccccuaggccccucaggagcuuugcagagaggaggac

SEQ ID NO: 424529 - RNA, 63 nt, Human
ugcuacucuuugagaaugaaguugucauucagggccccucauguagccaaaagaccaagaaaa

SEQ ID NO: 424530 - RNA, 63 nt, Human
auaugagcuacugaggaggggguuggacauccugccccucaccccccacccacacugcaggua

SEQ ID NO: 424531 - RNA, 63 nt, Human
guuuacauguguagccuauguugugguccaucagccccucacauuccuagggguuugagaugc

SEQ ID NO: 424532 - RNA, 63 nt, Human
caggguagggcugucgccuuagaucccgcccaagccccucauucccuccuugcacagaugcau

SEQ ID NO: 424533 - RNA, 63 nt, Human
ccuaggaaccgccgcugccugcuggggggccacgccccucaugcccuugucccaggcccgggg

SEQ ID NO: 424534 - RNA, 63 nt, Human
gccacaccagccuggauuucaaucccagaaucugccccucacgaggaugugaccuugggcaga

SEQ ID NO: 424535 - RNA, 63 nt, Human
ccgugcuucucccuugggcagccucucucuugagccccucacccuguuucuuucugugaagcg

SEQ ID NO: 424536 - RNA, 63 nt, Human
aauucuuucucauguugggagugagaaugccgggccccucagggcugucggugugcugucagc

SEQ ID NO: 424537 - RNA, 63 nt, Human
uucuagaacacuuggagccugaacucugaccaggccccucacuugagccuuugcuuucugcuc

SEQ ID NO: 424538 - RNA, 63 nt, Human
augacccacuaacguggcaacuuuaacccaaaggccccucagacauguuacagcaaaucugga

SEQ ID NO: 424539 - RNA, 63 nt, Human
gccuccgaggagaccaggaacccugcuucagcagccccucagggcuucccaaggauguccagc

SEQ ID NO: 424540 - RNA, 63 nt, Human
uguggccacagcucuggagugggaggguugguugccccucaccucagagcucccccaaaggcc

SEQ ID NO: 424541 - RNA, 63 nt, Human
ggauuaggagagggggugaugaccccuccccaagccccucagggcccagaccuuccugcucuc

SEQ ID NO: 424542 - RNA, 63 nt, Human
gcucgaccuugcucuuauuagucccucaccccugccccucaugaucucccacuuucucuagcu

SEQ ID NO: 424543 - RNA, 63 nt, Human
gucuccagaagucguggccuuccagaacagucugccccucaaggaaggguggggcaggcagua

SEQ ID NO: 424544 - RNA, 63 nt, Human
ggcuaagaaguucaccagcccugagccauggcggccccucagccugccugaagagaggaaacu

SEQ ID NO: 424545 - RNA, 63 nt, Human
gcuagguuaggcccugcacuccaccuggggacggccccucaucaccugaaguccucugcugug

SEQ ID NO: 424546 - RNA, 63 nt, Human
cugcuccaaaaucaucaacucagccccugggcugccccucagaggcggugucuggggaggacu

SEQ ID NO: 424547 - RNA, 63 nt, Human
gcucgaguuccuggaugugcagaagcacuuguggccccucaaggaccucacgcugacgagcaa

SEQ ID NO: 424548 - RNA, 63 nt, Human
caucagggaccuccaggugcauggauuggugcugccccucaugcugcccagcuucuacucaga

SEQ ID NO: 424549 - RNA, 63 nt, Human
ugcaccucuggaggugcagggcacccuugagaagccccucaccccuaggccgccuccaggugc

SEQ ID NO: 424550 - RNA, 63 nt, Human
cgcuaaggaagauaucuaguguuggggauccuggccccucaaccuccuguggaacccagcagu

SEQ ID NO: 424551 - RNA, 63 nt, Human
ucuaauccuucucauuacccacccgaccuggcugccccucaccuugggcugggggacuggggg

SEQ ID NO: 424552 - RNA, 63 nt, Human
cuggcgcuugaggcucagaagagccucuguccagccccucaguauuaccaugucucccucuca

SEQ ID NO: 424553 - RNA, 63 nt, Human
ucaaaccauucuaauggaaaaggacaacaaacugccccucacuacuggcuugguuuggucuac

SEQ ID NO: 424554 - RNA, 63 nt, Human
uccuccauugaggaugcccacugaggcagccaggccccucaccagcccuggggggaauccuaa

SEQ ID NO: 424555 - RNA, 63 nt, Human
cuuuagagcauugccauucccugccuggggcgggccccucaucgcguccuccuaccgaaaccu

SEQ ID NO: 424556 - RNA, 63 nt, Human
ugcuuauuuguguaauggaugugguccucuaaagccccucauuguuuuugauugccuucuaua

SEQ ID NO: 424557 - RNA, 63 nt, Human
uccccaccuccaggcuuucccacuucccacccugccccucagagacugaaauuacggguaccu

SEQ ID NO: 424558 - RNA, 63 nt, Human
gccuuucccaccuggagagaaacuuccagaccagccccucauaccacagccaagaggggccuu

SEQ ID NO: 424559 - RNA, 63 nt, Human
gccuuucccaccgguagagaaacuuccagaccagccccucacaccacagccaagagaagccuu

SEQ ID NO: 424560 - RNA, 63 nt, Human
gccuuuaccaccuggagagaagcuuccagaccagccccucacaccacagccaggagaggccuu

SEQ ID NO: 424561 - RNA, 63 nt, Human; identical to SEQ ID NO: 424558

SEQ ID NO: 424562 - RNA, 63 nt, Human
gccuuucucaccuggagagaaacuuccagaccagccccucacaccaccgccaggagaggccuu

SEQ ID NO: 424563 - RNA, 63 nt, Human
gccuuucccaccgggagagaaacuuccagaccagccccucacaccacagccaggagaggccuu

SEQ ID NO: 424564 - RNA, 63 nt, Human
gccuuucccaccgggagaggaacuuccagaccagccccucacaccacagccaggagaggccuu

SEQ ID NO: 424565 - RNA, 63 nt, Human
agaaccaccagcaaagccggcggcuggacuggcgccccucagagaccugcggaaagcccccuc

SEQ ID NO: 424566 - RNA, 63 nt, Human
uuuuccagaaauuucucaaaaugucugcugauagccccucacucauauuuuucauguggguuu

SEQ ID NO: 424567 - RNA, 63 nt, Human
ucuguguuuccagaaggccccacacacccaagugccccucacaccucgugccucccccucaca

SEQ ID NO: 424568 - RNA, 63 nt, Human
ugaccagcagaauccacccggugaccagugguggccccucagcccacccucccggcagcucag

SEQ ID NO: 424569 - RNA, 63 nt, Human
acuccagugcucuggcccgggacuccccuauccgccccucacuuacccuuaaacaggugaucc

SEQ ID NO: 424570 - RNA, 63 nt, Human
auccacugaaggcuguguuuauucuuuuccugugccccucauaauggaagaaaguaaacugcu

SEQ ID NO: 424571 - RNA, 63 nt, Human
cgucgagugagcgucccgaggccacgugcggaggccccucacugugcugucaaaggccugugg

SEQ ID NO: 424572 - RNA, 63 nt, Human
gcuagaaaaucgaguuggcaaaaugggguuugggccccucagagcccugcccugcacccuugu

SEQ ID NO: 424573 - RNA, 63 nt, Human
cucgucacccaucacucccugcuuccgcagggcgccccucaguauucgcugccauaugucccu

SEQ ID NO: 424574 - RNA, 63 nt, Human
ggagauacugggggcagagcagacuuugccagugccccucaggucaaaccaagccaagagcac

SEQ ID NO: 424575 - RNA, 63 nt, Human
gcccacacacccugccuaggccaccccgccgcggccccucaggucgcccuggccacacucaca

SEQ ID NO: 424576 - RNA, 63 nt, Human
ccuaagacccaccgacucugugcuagaacaagcgccccucagagauucugaugccacugaagu

SEQ ID NO: 424577 - RNA, 63 nt, Human
gaggacagucuuuccccagcaggggucaggggggccccucaggaagccuaaggucgugcuagu

SEQ ID NO: 424578 - RNA, 63 nt, Human
cacucccuuuggcuacccuggccgugccuggcagccccucaggccccacagguggguccuggu

SEQ ID NO: 424579 - RNA, 63 nt, Human
cggaaaucucugggacaauggcuccuccagagggccccucagagccaggugcuggccagaugc

SEQ ID NO: 424580 - RNA, 63 nt, Human
uguagcccucugagcccucauccugcaggcagagccccucagugcucugagaaaccugcccug

SEQ ID NO: 424581 - RNA, 63 nt, Human
ugaggccuggcccugggcagggucuguggcugcgccccucaggccagcaguugagguccaucg

SEQ ID NO: 424582 - RNA, 63 nt, Human
ugguccgcugagggcuggggggcggucuccgaggccccucaacagagaagccuccaccugagg

SEQ ID NO: 424583 - RNA, 63 nt, Human
agaaaagccgaaaaagcaugcaucuuagaaauagccccucaauuccaggagucaacaugccaa

SEQ ID NO: 424584 - RNA, 63 nt, Human
ggagaguaagaacuaagggaaugaguuugggcggccccucauaaaggaccuuagaggcaggga

SEQ ID NO: 424585 - RNA, 63 nt, Human
cuuguaauuguggauuaaugucaauguuaaucagccccucaaagggagagaaaagcuggaccu

SEQ ID NO: 424586 - RNA, 63 nt, Human
gccaugggcuaaauggguacuagaacaacaacugccccucauguacgccaaggaugagcucua

SEQ ID NO: 424587 - RNA, 63 nt, Human
gaaccuugcauauccuucacauauuucccauaagccccucagaaaggcuaacugugaugauga

SEQ ID NO: 424588 - RNA, 63 nt, Human
uggauauggugcagagaagcuggacuucugugggccccucaacagccaagugugaccccacug

SEQ ID NO: 424589 - RNA, 63 nt, Human
agcaguccccuuggauacuaaagucugagccaggccccucaggcccggcaugggcagugcgag

SEQ ID NO: 424590 - RNA, 63 nt, Human
uuuuuuaagcguuugcacuauuuagaguccuaagccccucauguucagcugugcuguguuucu

SEQ ID NO: 424591 - RNA, 63 nt, Human
gaaggaugugagaggugggcgcuuuggagguuugccccucacccaccagcugccccaucccug

SEQ ID NO: 424592 - RNA, 63 nt, Human
cgaggugcugauggagaugcucaaggccagcaagccccucaggccagcacuucgcuugcagaa

SEQ ID NO: 424593 - RNA, 63 nt, Human
ucacgccucgcucccuccuggcccucugguccagccccucacgccuccucucagucuacucaa

SEQ ID NO: 424594 - RNA, 63 nt, Human
uuuguguacuuuuaaaauuguaucuuuccaggagccccucagauuguaccuugcuuucucacc

SEQ ID NO: 424595 - RNA, 63 nt, Human
gggggaguagaucuuucuaggagggagacacuggccccucaaaucguccagcgaccuuccuca

SEQ ID NO: 424596 - RNA, 63 nt, Human
gggacagugcugcagcucccuggcuucuguggggccccucaccuacuuacccagguggguccc

SEQ ID NO: 424597 - RNA, 63 nt, Human
ccccaaaaccuuuccccagacacauucuccugugccccucagagaggcaugugaugugcaagg

SEQ ID NO: 424598 - RNA, 63 nt, Human
gugaccucaaauguugccuuggaguccccuacagccccucagcagagggcagcacuugaaugc

SEQ ID NO: 424599 - RNA, 63 nt, Human
gggcccuccucccccaccagcucuccccacagggccccucagcaucauggagacccgcaggcg

SEQ ID NO: 424600 - RNA, 63 nt, Human
uuccaagagcaaggaugaaaaauugaagucacagccccucagcaccaagcagaaggugaggac

SEQ ID NO: 424601 - RNA, 63 nt, Human
ugucacaggcugggucaaaagagcccuggcucugccccucagggggccagcuggggagauggg

SEQ ID NO: 424602 - RNA, 63 nt, Human
acuggcugccaacuccugccgcccucugggacugccccucagucccaggagagcuaugaggcc

SEQ ID NO: 424603 - RNA, 63 nt, Human
cccaaagcaguuagacuauggagagccgacccagccccucaggaacccucauccuucaaagac

SEQ ID NO: 424604 - RNA, 63 nt, Human
uccccuagacucaggcuuccuuuggagauuaaggccccucagagaucaacagaccaacauuuu

SEQ ID NO: 424605 - RNA, 63 nt, Human
ugaggcuggcaaguggggcaacguguggaggaagccccucauaauuuggagaaaacuugauac

SEQ ID NO: 424606 - RNA, 63 nt, Human
auugccauacaauuuuaauuuauacaaguauuggccccucaagugguuggaaauuuuuuuuuu

SEQ ID NO: 424607 - RNA, 63 nt, Human
caugaauaggcguacuuucuguauuuaaaaauggccccucaagcaccguuaauuuacauucca

SEQ ID NO: 424608 - RNA, 63 nt, Human
caaagguugggacucugucuuacauaucugggugccccucauagugcaguaauaaguaaguug

SEQ ID NO: 424609 - RNA, 61 nt, Human
aagucuguccaaccccaaaaggcucuuuucagagccccucaauugucaccaaaaggaagcu

SEQ ID NO: 424610 - RNA, 63 nt, Human
cucauugcccacggacccaaccucuguccaggugccccucaucaucacaguuuaacacaagcu

SEQ ID NO: 424611 - RNA, 63 nt, Human
cuccuacuguuuaaauucccauuccaccacagugccccucagccagaucaccaccccuuacaa

SEQ ID NO: 424612 - RNA, 54 nt, Human
acucugauaccuccaacugaucuugccccucagggucacaggggugggggcucu

SEQ ID NO: 424613 - RNA, 58 nt, Human
ggaagcuggccugcgagugaccccagcagccccucagcgcccccagagcccgucagcg

SEQ ID NO: 424614 - RNA, 63 nt, Human
ugccagcaagaaugaagcacagaugaaggcagcgccccucacuugcucuggcuucagaaguga

SEQ ID NO: 424615 - RNA, 63 nt, Human
gccugguggagauucccugucuucugagcccgagccccucauuaccagugaaggacaugcuug

SEQ ID NO: 424616 - RNA, 63 nt, Human
gacuuucaacuugcugacuccuccucuuuuccagccccucaaccaucggucuuguuuacuaga

SEQ ID NO: 424617 - RNA, 63 nt, Human
agaugacccaaaucuuucacuaugugcaccccagccccucaaaaauggggaagggcugaaaga

SEQ ID NO: 424618 - RNA, 63 nt, Human
ccagucauugacagacggacuuguugaccacacgccccucaccaaacaaugcagcagcuacug

SEQ ID NO: 424619 - RNA, 63 nt, Human
aguggcugaguucuuucuuagcugcuuuaaggagccccucacuccccagagucaaaaggaaau

SEQ ID NO: 424620 - RNA, 63 nt, Human
ccaagcagacuagaugggaggaggcgccgcucagccccucacccugcaucacugaagagcggc

SEQ ID NO: 424621 - RNA, 63 nt, Human
cuguccugccacggccucccagccggugcgggagccccucacugcccugaccgacuccgcagu

SEQ ID NO: 424622 - RNA, 63 nt, Human
cuccacgugagaacaagggugaaggugagggaagccccucaccuugggucuuuugcugugccu

SEQ ID NO: 424623 - RNA, 63 nt, Human
aggaggugaaagaaagggacccaccugcuagucgccccucagagcaugaugggaggugugcca

SEQ ID NO: 424624 - RNA, 63 nt, Human
cccaugaugguaccacaccagggccucagccuggccccucaccacauacccuuugccuuuuag

SEQ ID NO: 424625 - RNA, 63 nt, Human
gugaggggccaggccauggccaaggggccagcugccccucauuuaucacucugaccuucacag

SEQ ID NO: 424626 - RNA, 63 nt, Human
caugaccagaggcuggaguggggguguguuagagccccucaccgggacuugcugugcggaugg

SEQ ID NO: 424627 - RNA, 63 nt, Human
ucaauguuucaucuccaacccucugccaguuuggccccucagagcuugguggcucaagacugu

SEQ ID NO: 424628 - RNA, 63 nt, Human
uccuggugccgccucggccccagccuguccccagccccucaaucuggugcagcagcaucuugu

SEQ ID NO: 424629 - RNA, 63 nt, Human
cucccuccuccagaucccugccuccuagugccagccccucacacgccuucauccugaaacagg

SEQ ID NO: 424630 - RNA, 63 nt, Human
gugccacauggguuccugugccacccuuuccccgccccucaaaucguccuuuaagucuuccuu

SEQ ID NO: 424631 - RNA, 63 nt, Human
uccccuguaaaaugggaccuccgaaccaacccugccccucagaaaugcccugccuauuaaaug

SEQ ID NO: 424632 - RNA, 63 nt, Human
ucgcccacccugugcccuggcgccgcugcaacagccccucauggccaggagccccccauggcc

SEQ ID NO: 424633 - RNA, 63 nt, Human
agaaccugggccuaucagcguguaagggggccugccccucaucugcgaaagaagagcccagac

SEQ ID NO: 424634 - RNA, 63 nt, Human
ccuggcccugccucuggcccuucccgggccgcugccccucagccauguggcacuucugagcuc

SEQ ID NO: 424635 - RNA, 63 nt, Human
gcagagaggaggggagguccugaggggacugcugccccucacucggcauccccugcagaguca

SEQ ID NO: 424636 - RNA, 63 nt, Human
ucuguuacuuccccuuuuuccauggguuucauggccccucaugauauuugccuucugcuccua

SEQ ID NO: 424637 - RNA, 63 nt, Human
uugcugcaauacugcucccccagccucuccccugccccucaaccugccuuagcugcacucucu

SEQ ID NO: 424638 - RNA, 63 nt, Human
cccgccuggcuucgaguuggaacccggacacuugccccucacugguguggauggaaaucugcc

SEQ ID NO: 424639 - RNA, 63 nt, Human
augcaacagggguguugcgggggcaacaugagagccccucacccccaacucuccacuuucagg

SEQ ID NO: 424640 - RNA, 63 nt, Human
ggcacacagaguucauguuugcgcccucucccugccccucaccccagagggugaggaggaaug

SEQ ID NO: 424641 - RNA, 63 nt, Human
agcaccagccaucguguggagcacuaccaaggggccccucagggccuuccugggaggaguccc

SEQ ID NO: 424642 - RNA, 63 nt, Human
cucccucuaauuacagaucccacuuccagccgggccccucauguauccacuggccgaccgcag

SEQ ID NO: 424643 - RNA, 63 nt, Human
cgaccuagaugaugauucuuccuguagcaucuggccccucacaaugucagaggauuuaauugu

SEQ ID NO: 424644 - RNA, 63 nt, Human
cgacgcggugcugcugccgccgcuucggguuuggccccucagaaccccuccuuuucugagcgc

SEQ ID NO: 424645 - RNA, 63 nt, Human
uuaaucaaccauauuaaauuuauaauaaaaaaugccccucagaaguuugccucugaagccuuu

SEQ ID NO: 424646 - RNA, 63 nt, Human
agcagagcagaccugaugucccggugcuuccuggccccucagcuccagugauucacgcccgcc

SEQ ID NO: 424647 - RNA, 63 nt, Human
agcccccagccugugaccuuccccccagggaaggccccucaugccuuuccuucccuuucucug

SEQ ID NO: 424648 - RNA, 63 nt, Human
aaagggaggggagcaaguggggaccuggccauggccccucagcaaaaaccuauucacagcggg

SEQ ID NO: 424649 - RNA, 63 nt, Human
cugcuaggcagcccaggccuggucugggagacagccccucacccugccugggcucuuggccaa

SEQ ID NO: 424650 - RNA, 63 nt, Human
uucuuauuuauugcaugcgucgcuuccacaggggccccucaagagcugugacucgggagagcu

SEQ ID NO: 424651 - RNA, 63 nt, Human
ugucccuucagccggcagagcgagcccagcguggccccucaauuugaaaauggacgucuuuuc

SEQ ID NO: 424652 - RNA, 63 nt, Human
uuaaugaacaagguggaccaaagggcugaaccagccccucaaccaggacccuggggggccugc

SEQ ID NO: 424653 - RNA, 63 nt, Human
gguggcaggagagcggacuuagagcccccgagggccccucagcagaggaaggggaguccccuc

SEQ ID NO: 424654 - RNA, 63 nt, Human
cucgugacugcccagcgccccaggcuggacugagccccucacgccgcccugcagcccccaugc

SEQ ID NO: 424655 - RNA, 63 nt, Human
ugaccagaccacgggcagggccugccuccgugugccccucagcucagccccagcaagugugug

SEQ ID NO: 424656 - RNA, 63 nt, Human
cugagguuuggguggugugaucuguccuaauuggccccucaccaaugcaucuaucugucugcc

SEQ ID NO: 424657 - RNA, 63 nt, Human
gggaagccuggcaaagcugcccaaccggguagugccccucacccaucggaucacugccuucuu

SEQ ID NO: 424658 - RNA, 63 nt, Human
gaauugucaucuuugguguuuuuuuaacccccagccccucaaaaaaauaaggccuccagguau

SEQ ID NO: 424659 - RNA, 63 nt, Human
aaggcuguggcugcuagugaccucuuugcuguggccccucauuugaccuuucaccucugucug

SEQ ID NO: 424660 - RNA, 63 nt, Human
acuuccgcaucugcccgugggcgccccacagcugccccucagccgcugagauccaguguccaa

SEQ ID NO: 424661 - RNA, 63 nt, Human
uucugucccuccuacuuuccuucacaccagacagccccucaugucuccaggacaggacaggac

SEQ ID NO: 424662 - RNA, 63 nt, Human
augugcuugugccuaccuggccgcaaguccccagccccucaacccuccguuccuccucagccu

SEQ ID NO: 424663 - RNA, 63 nt, Human
ggaaacgggacaaaaccuuaagcuguuuucuuagccccucagccagcugccauuagcuuggcu

SEQ ID NO: 424664 - RNA, 63 nt, Human
uugcacaugcucacccccagcacagucccacuggccccucaccuccccuucccugagcuccuu

SEQ ID NO: 424665 - RNA, 63 nt, Human
cacuggaugggauguacuucucagccccgcugagccccucauuugugcccagcauuuugugug

SEQ ID NO: 424666 - RNA, 63 nt, Human
cuucuccuugaggcagcuggagagcuaucccccgccccucaagcaccugugccguguggccau

SEQ ID NO: 424667 - RNA, 63 nt, Human
uggcgccccuucucuccaagcucaauucucuaagccccucagggucuccuccucaccccaccc

SEQ ID NO: 424668 - RNA, 63 nt, Human
ccgaagcaggcguccaucuguguccuccuggcagccccucaaacacacaccaccccaugucac

SEQ ID NO: 424669 - RNA, 63 nt, Human
cccgaugucacaggcagucugugugguuacagcgccccucaguguucaucuccagcagagaca

SEQ ID NO: 424670 - RNA, 63 nt, Human
cgccccguggucggaagagcacucccuucccuggccccucauccagccuccggugcuguaaaa

SEQ ID NO: 424671 - RNA, 63 nt, Human
ccuuucuggcauccuggccucucgugguccucagccccucacccccaguacugcagaucucac

SEQ ID NO: 424672 - RNA, 63 nt, Human
cuccuuguggggucccagguccugcugccaagagccccucaagagaagggcugaaccugggga

SEQ ID NO: 424673 - RNA, 62 nt, Human
ugggggcacguuguccgugauaaaaguacaagugccccucaccgcccguggagauugcuuuc

SEQ ID NO: 424674 - RNA, 63 nt, Human
gacucccagcagcagagcccaagcacuggcuucgccccucagugcccuggggcauguucaggg

SEQ ID NO: 424675 - RNA, 63 nt, Human
ccuggucccccuuugcccugcaguggaaugagggccccucagccccgcauugaucuaaauaaa

SEQ ID NO: 424676 - RNA, 63 nt, Human
ugggcucagauacugugacaucccagaagcccagccccucaaccccucuggaugcuacauggg

SEQ ID NO: 424677 - RNA, 63 nt, Human
uguuggacuuuacagaagagccucauccugucugccccucacucugcccuggaaucaacaucu

SEQ ID NO: 424678 - RNA, 63 nt, Human
cucucgauuucucuaucugucccucugaggucggccccucagacccuccuccuuaauuuccca

SEQ ID NO: 424679 - RNA, 63 nt, Human
cacguggaugauggggucagagaucacugagcugccccucaagggggccuggaacccgggugc

SEQ ID NO: 424680 - RNA, 63 nt, Human
agcccugcccgaggcugaggcugggccggcgcugccccucaucuuagcauugggcagacacca

SEQ ID NO: 424681 - RNA, 63 nt, Human
ccuuguuaaugaugcuccugccucugccucccagccccucacccagcacagcucugccuggac

SEQ ID NO: 424682 - RNA, 63 nt, Human
ggcagacccccaccaccauacaugcugucuguggccccucagacauucuguuucaucucccau

SEQ ID NO: 424683 - RNA, 63 nt, Human
cugucaccucccucucaccaacccggggucugagccccucauuccugaccguccguguucuca

SEQ ID NO: 424684 - RNA, 63 nt, Human
gauuuauaaguacugagcaugaaguacuugucugccccucauuucaaggccagaguuauuuuc

SEQ ID NO: 424685 - RNA, 63 nt, Human
cugguuagguggggacagaggauuucugcuuaggccccucaggacccagggaaugccagggac

SEQ ID NO: 424686 - RNA, 63 nt, Human
gguaucuuuggcaaggcuaccaguuggacguaagccccucaugcugacucagggugggcccug

SEQ ID NO: 424687 - RNA, 63 nt, Human
acagaccccagagccaggaaccucucagccgaugccccucagcaagagcaccccaucuucagg

SEQ ID NO: 424688 - RNA, 63 nt, Human
cccgacgccggcggggaggcagggaugucgagggccccucacagcugugcccgcccugccccg

SEQ ID NO: 424689 - RNA, 63 nt, Human
gccaggcagcggggcagggacagggagccgagugccccucagagucccccaaacacaagcaca

SEQ ID NO: 424690 - RNA, 63 nt, Human
ccugcaugcuguguauccuaacucccuacaacagccccucaaauaaaucacaucuagugacug

SEQ ID NO: 424691 - RNA, 63 nt, Human
ucgucuuccuccugcagacaggcggacccacaggccccucagggucugcccagccaggcuccu

SEQ ID NO: 424692 - RNA, 63 nt, Human
cuucuugccuaccacuuggccagugcccacccagccccucagguggcacaucuggagggcagg

SEQ ID NO: 424693 - RNA, 63 nt, Human
gaugaaccugcuuauaccuaagggcaggagcaagccccucacaaugcagcugcauggguuuuu

SEQ ID NO: 424694 - RNA, 63 nt, Human
caucagugccagccccugcuggcuggugccugagccccucagacagcccccugccccgcaggc

SEQ ID NO: 424695 - RNA, 63 nt, Human
caccagaauuuugaaaaucccgaauuuuugacagccccucaggccuggagaguuaucuacaga

SEQ ID NO: 424696 - RNA, 63 nt, Human
ugcccuucccuggaggucucucccucccccagagccccucaugccacagugguacucuguguc

SEQ ID NO: 424697 - RNA, 63 nt, Human
gcccucaauccaccuucaggccccgccccaugggccccucaccgcugguuggaaagaguguug

SEQ ID NO: 424698 - RNA, 63 nt, Human
uggguugcugccugaugacaagggguuguuucagccccucagucaugcugccuucugcugcuc

SEQ ID NO: 424699 - RNA, 63 nt, Human
gagcugggccccagcccagugacuggcucauuugccccucaagcacgaguuugcauguuuagu

SEQ ID NO: 424700 - RNA, 63 nt, Human
gugguggggcugggccauggagcuggcccagaggccccucagcccuuuguaaagucugaugaa

SEQ ID NO: 424701 - RNA, 63 nt, Human
gaaccuaacaauuuaaagacacugggaacacuugccccucaguauaguacugucaagggaagc

SEQ ID NO: 424702 - RNA, 63 nt, Human
aagggccccugaccugccuggcuuccuuagcuugccccucagcuuugcaaagagccacccuag

SEQ ID NO: 424703 - RNA, 63 nt, Human
ccccaucuuuaaaaugcugccagagcgauugcggccccucaccuuguccacguaucaggaaug

SEQ ID NO: 424704 - RNA, 63 nt, Human
aaucucgacucacugcagcuaucucucgccucagccccucaaguagcugggacuacaggugca

SEQ ID NO: 424705 - RNA, 63 nt, Human
cuugaccagcgugcugacuggccuagggccccugccccucaccuucuccuucuugauuccaaa

SEQ ID NO: 424706 - RNA, 63 nt, Human
gguucccacccuccuccaccuccucuccuccgggccccucaguuuccucuccucaucucuggc

SEQ ID NO: 424707 - RNA, 63 nt, Human
cuacuguguuucacugaccauacauuuuucuuagccccucaaguaauauagcacagaguuaug

SEQ ID NO: 424708 - RNA, 63 nt, Human
auggaggaggugugggcugacuaccucccagaagccccucaugccaagccugucccacugggg

SEQ ID NO: 424709 - RNA, 63 nt, Human
guagaggccucguuucugccacacaucacgccugccccucaccgcccucuccucaaacuccuc

SEQ ID NO: 424710 - RNA, 63 nt, Human
auuuggguucugccugccagcugcacugaugcugccccucaucucucugcccaacccuucccu

SEQ ID NO: 424711 - RNA, 51 nt, Human
cugccugcaguccugugugaagccccucaccuaugccaucuccauaagcac

SEQ ID NO: 424712 - RNA, 63 nt, Human
gggaaguuccccaacacauaaucccaagacugugccccucaucugcaucuucagauccaguac

SEQ ID NO: 424713 - RNA, 63 nt, Human
augcuuucugccucugguaacaggagugagugagccccucagaccugcacucugggugucucc

SEQ ID NO: 424714 - RNA, 63 nt, Human
ucagggccugcauuuauggagugcuugcuaugugccccucauggcaggcccacagcacucuga

SEQ ID NO: 424715 - RNA, 63 nt, Human
agggcagccccagcagcuggauucucaggcugggccccucaccuggcagaguccauaguggag

SEQ ID NO: 424716 - RNA, 63 nt, Human
cgcugugcccugguuucccuccucgggcuucucgccccucagugguuuccucggcccuccugg

SEQ ID NO: 424717 - RNA, 63 nt, Human
ccaggaugaccccacagccagagucccuuggcagccccucaccccagaccccccuucuaagga

SEQ ID NO: 424718 - RNA, 63 nt, Human
guuguuccucuguuaucaugccugaauucccccgccccucaguuaccuggggaagaguaaagg

SEQ ID NO: 424719 - RNA, 63 nt, Human
uuucccauugucacggaaaacauuggcugcaaagccccucaaagcccucaagugccuucugug

SEQ ID NO: 424720 - RNA, 63 nt, Human
gcacucggcccaguccugccgccguguccaggcgccccucacccccacaccugcugcauggcu

SEQ ID NO: 424721 - RNA, 63 nt, Human
cgguuuuguuuuuguuucucauucuucuuccucgccccucagccccccaacccccaacccccu

SEQ ID NO: 424722 - RNA, 63 nt, Human
ggcugagugggagggcggcccuuuccagccucugccccucaggggaacccuguagcuuugugu

SEQ ID NO: 424723 - RNA, 63 nt, Human
aucucuccaaaccccauacccuucaaugcuguggccccucagugacuuccuugggugauccug

SEQ ID NO: 424724 - RNA, 63 nt, Human
auggcaggcuacaguugggaagucucagccugggccccucagccacccuuggucucaugcccc

SEQ ID NO: 424725 - RNA, 63 nt, Human
cccugccccauucuggugucuuuccacuccucagccccucaucuugccuccacccagcugcuc

SEQ ID NO: 424726 - RNA, 63 nt, Human
uccuucagccaccuggccauaccccuuaaauaagccccucaccuugcugccucaggaccuuca

SEQ ID NO: 424727 - RNA, 63 nt, Human
cuggcugcaagcuguggguucuuucuccucugugccccucaugcugaucuucuagaugccacu

SEQ ID NO: 424728 - RNA, 63 nt, Human
ccacacggccccuucccagccagcccgccgcccgccccucaguuugguagugccccaccuccc

SEQ ID NO: 424729 - RNA, 63 nt, Human
cgcccauccugcacacggggccgcugggcaggugccccucacacccccaggaugucagugcuc

SEQ ID NO: 424730 - RNA, 63 nt, Human
uacugaaaacugaccaaggccugugcacagguagccccucaugcugggcucuggaccaugagc

SEQ ID NO: 424731 - RNA, 63 nt, Human
cccaguaacuggggccacggggagagaggaguagccccucagacucuucuuacuaagucucag

SEQ ID NO: 424732 - RNA, 63 nt, Human
cugccuccuggugguggccauugucccccaucggccccucagccuugcaccccagcacugaga

SEQ ID NO: 424733 - RNA, 63 nt, Human
aaugcuccagcgauuccaaacugcagccccucugccccucaccaaaaccugcggggcugcuug

SEQ ID NO: 424734 - RNA, 63 nt, Human
ugugugucuguuuugguuugugagaaaguagcugccccucauucuggccaguucuuuccagua

SEQ ID NO: 424735 - RNA, 63 nt, Human
aguagugccgaugugccacacugcccaguugaggccccucacgcucugugccccuagauccuu

SEQ ID NO: 424736 - RNA, 63 nt, Human
cauggcaacucaaagugccuuccaaaccaaacugccccucaugagguuagggucccccacccu

SEQ ID NO: 424737 - RNA, 63 nt, Human
acuucccgagaacaaacaggccugcucacaacugccccucaaguucaaccccgggaccgccca

SEQ ID NO: 424738 - RNA, 63 nt, Human
uucgugacugaggccccucuuggggcacucacugccccucauccccagaaauuauuuuucuac

SEQ ID NO: 424739 - RNA, 63 nt, Human
aguccacuccuagccccggcauccugcucuagggccccucaugccccaggcuggagcagcucu

SEQ ID NO: 424740 - RNA, 63 nt, Human
ggagccaagaagcacagagacacagaggcgccugccccucagcuccgcuggucugucugugca

SEQ ID NO: 424741 - RNA, 63 nt, Human
cuccacugagcuccucugucacaccccauucuugccccucacugggcaggccauggccuacag

SEQ ID NO: 424742 - RNA, 63 nt, Human
ccagcuuucugguuaagguuaacaccagauggugccccucauugguguccuuuuaaaaaauau

SEQ ID NO: 424743 - RNA, 63 nt, Human
gggaguccgggcauggugggcacaguucucccugccccucagccugggggaagaagagggccu

SEQ ID NO: 424744 - RNA, 63 nt, Human
ugacccaggcugccugagcaccucccagccccugccccucaugccaaccccgcccuaggccug

SEQ ID NO: 424745 - RNA, 63 nt, Human
acgucugagcccagcuuucugcgugcccuccuggccccucacucccggcagcgggccggccuc

SEQ ID NO: 424746 - RNA, 63 nt, Human
gaagggcccggugggacguggguagugugugaagccccucagccugggucccgccuagccuaa

SEQ ID NO: 424747 - RNA, 63 nt, Human
gcccggaggucccaaggucccugggaggacugggccccucaugccucgagcuuggcaaccgaa

SEQ ID NO: 424748 - RNA, 63 nt, Human
aggagaaggaugccugggugccaggcaagacaagccccucagcaggagagaggcccagaggcu

SEQ ID NO: 424749 - RNA, 63 nt, Human
uagguucaccugcaaaacaaaaaucuuacuccagccccucaaugccauccugacacacuuuau

SEQ ID NO: 424750 - RNA, 63 nt, Human
gccccuuuuguguuuugguucaaguuucucagagccccucagagcuucuacaucugugcauca

SEQ ID NO: 424751 - RNA, 63 nt, Human
cugggaucuccuucucccuccuguccuguccuugccccucaggacugcuggaaaauaaauccu

SEQ ID NO: 424752 - RNA, 63 nt, Human
gcaugccuggauggggcugcaccggcuggccuggccccucagggucccugguggcagcucacc

SEQ ID NO: 424753 - RNA, 63 nt, Human
ucgucauggaccgagguucccacucugggcaaagccccucacacugcaagggauuguagauaa

SEQ ID NO: 424754 - RNA, 63 nt, Human
ucagguucugccugagcccagccuaccaggcuugccccucagcucagcacuguugaccacgcu

SEQ ID NO: 424755 - RNA, 63 nt, Human
cacuggcccuggguggcucugucagggugcacagccccucaugccuggagcaaugagggucua

SEQ ID NO: 424756 - RNA, 63 nt, Human
cuaccccucaacagagaugacuuugaugacucugccccucagcagggcuuacuaagcacuacc

SEQ ID NO: 424757 - RNA, 63 nt, Human
agcacuaccccuuaacagggaugacuccgcacugccccucaacagggaugacucagcagagau

SEQ ID NO: 424758 - RNA, 63 nt, Human
gcagggaugacacagcaaggaugacucagcacugccccucagcaaggaugacucagcacugcc

SEQ ID NO: 424759 - RNA, 63 nt, Human
ucaacagacaugacucagggauggcuuaguacugccccucagcagggaugacucagcaccgcc

SEQ ID NO: 424760 - RNA, 63 nt, Human
acagggaugacucagcagggaugacucagcaccgccccucaacaggcaugacucugcagagau

SEQ ID NO: 424761 - RNA, 63 nt, Human; identical to SEQ ID NO: 424758

SEQ ID NO: 424762 - RNA, 63 nt, Human
ucaacagggaugacucagggauggcuuaguacugccccucaacagggaugacucagcagggau

SEQ ID NO: 424763 - RNA, 63 nt, Human; identical to SEQ ID NO: 424760

SEQ ID NO: 424764 - RNA, 63 nt, Human
acaggcaugacucugcagagaugacuuaguacugccccucagcagggaugacucaguacugcc

SEQ ID NO: 424765 - RNA, 63 nt, Human
aguacugccccucagcagggaugacucaguacugccccucagcagggaugacucagcacugcc

SEQ ID NO: 424766 - RNA, 63 nt, Human
aguacugccccucagcagggaugacucagcacugccccucaacagggaugacucagcagggau

SEQ ID NO: 424767 - RNA, 63 nt, Human
gcagugaugacacagcaaggaugacucagcacugccccucagcaaggaugacucagcacugcc

SEQ ID NO: 424768 - RNA, 63 nt, Human; identical to SEQ ID NO: 424759

SEQ ID NO: 424769 - RNA, 63 nt, Human
aguacugccccucagcagggaugacucagcaccgccccucaacagggaugacucagcacugcc

SEQ ID NO: 424770 - RNA, 63 nt, Human
agcaccgccccucaacagggaugacucagcacugccccucaacagggaugacucagcagggau

SEQ ID NO: 424771 - RNA, 63 nt, Human
gcagcgaugacacagcaaggaugacucagcacugccccucaccaaggaugacucagcacugcc

SEQ ID NO: 424772 - RNA, 63 nt, Human
ucaacagacaugacucagggauggcuuaguacugccccucagcagggaugacucagcagggau

SEQ ID NO: 424773 - RNA, 63 nt, Human
acagggaugacucagcagggaugacucagcacugccccucaacagggaugacugcagggauga

SEQ ID NO: 424774 - RNA, 63 nt, Human
caacagggaugacugcagggaugacucagcacugccccucagcagggaugacucagcacugcc

SEQ ID NO: 424775 - RNA, 63 nt, Human
agcacugccccucagcagggaugacucagcacugccccucagcagggaugacucagcagggau

SEQ ID NO: 424776 - RNA, 63 nt, Human
gcagggaugacucagcagggaugacucagcaccgccccucaacaggcaugacucugcagagau

SEQ ID NO: 424777 - RNA, 63 nt, Human
acaggcaugacucugcagagaugacucagcacugccccucagcagggauggcucagcagggau

SEQ ID NO: 424778 - RNA, 63 nt, Human
gcagggauggcucagcagggaugacucagcauugccccucaacagggaugacucagcagacuc

SEQ ID NO: 424779 - RNA, 63 nt, Human
acucagcagacucagcagggaugacucagcacugccccucaacagacaugacucagcagggau

SEQ ID NO: 424780 - RNA, 63 nt, Human
acagacaugacucagcagggaugacucagcaccgccccucagcaaggaugacucagcagggau

SEQ ID NO: 424781 - RNA, 63 nt, Human
gccugggagacccaucuggucccugcguccucugccccucacugcucugugcagauccugucg

SEQ ID NO: 424782 - RNA, 63 nt, Human
ggccuggcugggcugggucuggggccgccacaggccccucacggggcggcagaggcaacuuca

SEQ ID NO: 424783 - RNA, 63 nt, Human
ggcagccaaguuccugauagcacuugugccucagccccucaccuggccaccugccagggcacc

SEQ ID NO: 424784 - RNA, 59 nt, Human
gaacaugcagaaggcacuaagcuuccugggccccucacccccagcuggaaauuaagaaa

SEQ ID NO: 424785 - RNA, 63 nt, Human
uuuuacugccuguagcaauggccagagccucuggccccucacccaccauggaccagcccauug

SEQ ID NO: 424786 - RNA, 63 nt, Human
gacacaaggugggcugcccucaagccccagagagccccucauccuuccucugggaccagaugu

SEQ ID NO: 424787 - RNA, 63 nt, Human
gaagggagacuggcccugcccagccggucucuagccccucagcccccgcugggcacucucugu

SEQ ID NO: 424788 - RNA, 63 nt, Human
gugcagacaaauucagcaauaguaugcagaucagccccucaccaccucauuguucucaucugg

SEQ ID NO: 424789 - RNA, 63 nt, Human
ccccaacccucagacccucgccuuccaaggcaggccccucagccuggccugcucucaccaccu

SEQ ID NO: 424790 - RNA, 63 nt, Human
cuccuuccuggucuggcccagcuggcuuccccagccccucagccauccagggcuacccacugc

SEQ ID NO: 424791 - RNA, 63 nt, Human
cagccuuaacucgaugguccgucccugccaggugccccucacucuuccugaccccaaagccag

SEQ ID NO: 424792 - RNA, 63 nt, Human
gugcuccaggauaacaaagaagggcagguugaagccccucauggaaggagcuggcuuuguggg

SEQ ID NO: 424793 - RNA, 63 nt, Human
ggcacucaaugcagccagaccuauuccuccugggccccucaucugcucagcagcuauuugaau

SEQ ID NO: 424794 - RNA, 63 nt, Human
acauccugcaguccccaccaguccugaccgugggccccucaggggucugggagugugacguug

SEQ ID NO: 424795 - RNA, 63 nt, Human
aaccugugaugaggggaggaaacucaccugcuggccccucaccugggcaccuggggaguggga

SEQ ID NO: 424796 - RNA, 63 nt, Human
cggacugccgccucuggguccccccaccguggugccccucaccauccuccugggggagcaggg

SEQ ID NO: 424797 - RNA, 63 nt, Human
gaucuguagccagucagaggaggaggagaaggagccccucagcagaguggugcaguuucgcuc

SEQ ID NO: 424798 - RNA, 63 nt, Human
cugugaaaaggcuuccugugaccuccgauggcggccccucauuggccaagggcacuguggaug

SEQ ID NO: 424799 - RNA, 63 nt, Human
cugaagagcaagguuucguggcagcacggcccggccccucacccucuguccccacgaggggac

SEQ ID NO: 424800 - RNA, 63 nt, Human
cccuccuugcccgccuacccucccuccagaauagccccucacccuucuuccccuucuaguuga

SEQ ID NO: 424801 - RNA, 63 nt, Human
cucacaucccuuuccuagucccccacauccaaagccccucagccugccuugcagaccaauggg

SEQ ID NO: 424802 - RNA, 63 nt, Human
acauaggacuaaccagccacugcccucucuuaggccccucauuuaaaaacgguuauacuauaa

SEQ ID NO: 424803 - RNA, 63 nt, Human
gggagguugguggaccauggagucccuggugcugccccucaggugggacccaggcguucucag

SEQ ID NO: 424804 - RNA, 63 nt, Human
ugcaccugggaccauaggaugggaggauagggagccccucaugacugagggcagaagaaauug

SEQ ID NO: 424805 - RNA, 63 nt, Human
gccacugggugagcagagucacccacagggccagccccucagccaggagccaguggcaggagc

SEQ ID NO: 424806 - RNA, 52 nt, Human
auucuuccaucuccuucuagaagccccucaccccgcugccccgccugucccc

SEQ ID NO: 424807 - RNA, 63 nt, Human
ggcagggaguugugagcgccuucccaacaaugugccccucaccccuugaugcccaugcuaaug

SEQ ID NO: 424808 - RNA, 63 nt, Human
agccugggucagaaggggugggcgagccccucggccccucacccuccaggcugcugugagagu

SEQ ID NO: 424809 - RNA, 63 nt, Human
ccuuuccuuggcccucacugccagugccaaaccgccccucagcagggcagggccaguccuggc

SEQ ID NO: 424810 - RNA, 63 nt, Human
uaguaugcccuguaauuuuucugggaaguccuagccccucacuuccagcuugccuguuucuuc

SEQ ID NO: 424811 - RNA, 63 nt, Human
guuuuugagggggucaugccgggggagccaccagccccucacuggguucggaggagagucagg

SEQ ID NO: 424812 - RNA, 63 nt, Human
uggccugggggaggucagaacauucgaaucucugccccucacuugaggaggagcuggccugcg

SEQ ID NO: 424813 - RNA, 63 nt, Human
acagugaggccaccuugagucaagccgacuaaggccccucaacccugucacuaagcagcacgu

SEQ ID NO: 424814 - RNA, 63 nt, Human
caggugcugcacugaccgcugggccacacggcugccccucagcccugcuggaacagggucugc

SEQ ID NO: 424815 - RNA, 63 nt, Human
gaauggugcacugguuuaauuguguuggugucggccccucacaaaugcagccaagucauguaa

SEQ ID NO: 424816 - RNA, 63 nt, Human
ggugggauccugaaggcacuagcugacagacgggccccucaauccuguccucugaaggauugu

SEQ ID NO: 424817 - RNA, 63 nt, Human
uggcucugaggucacaucagcuagguuugggaggccccucagcuugguuugggagugcccgug

SEQ ID NO: 424818 - RNA, 63 nt, Human
cucaugacaaaggaagggacucaaagcagcaaugccccucauaguguaggcuaaggugaguuu

SEQ ID NO: 424819 - RNA, 63 nt, Human
cgcugagauuacaggugugagccaccgugcccagccccucaguagguuuuaaggagcccccag

SEQ ID NO: 424820 - RNA, 63 nt, Human
ccgggcccccgcgccucugccggacacggaccggccccucagcccccaccgaggacgcagcca

SEQ ID NO: 424821 - RNA, 63 nt, Human
auuugugcguuccagaaaagggcccagcucugagccccucacccuuccacacucacgaacucu

SEQ ID NO: 424822 - RNA, 63 nt, Human
uucuuucaguucucccaugcagccgaggcccgggccccucaggacuccaaggagacggugcag

SEQ ID NO: 424823 - RNA, 63 nt, Human
ccaugaaugaaaugacucagggaaguguuuguugccccucaugccuccuuucucacuuuagaa

SEQ ID NO: 424824 - RNA, 63 nt, Human
cucuggcagugaugaugguacuuccuguugucagccccucaagcccagcugcaaccagucugg

SEQ ID NO: 424825 - RNA, 63 nt, Human
ugcccucgcuccgccccaucaguuccugccccugccccucaugcagacugcccugcuggggcc

SEQ ID NO: 424826 - RNA, 63 nt, Human
cccuaggccaccucgcggaagccuucagccuccgccccucacugcagccccuugggacuugag

SEQ ID NO: 424827 - RNA, 63 nt, Human
gguguugggaaccaugccugccagccaguaugugccccucacccaggccuggcugggcccugg

SEQ ID NO: 424828 - RNA, 63 nt, Human
ccugcucugagcgcucaccccugcugaggcucagccccucaacccgguggcauucugggggag

SEQ ID NO: 424829 - RNA, 63 nt, Human
accgcuguugagcagccuggugguacuggccacgccccucaaggcaaggcuccuccccuuagg

SEQ ID NO: 424830 - RNA, 63 nt, Human
cucagcccagcugacugugccuguucugagugagccccucacucagccggggcccucccaccu

SEQ ID NO: 424831 - RNA, 63 nt, Human
uggggggucuugguuuaugcucccugcccuugagccccucagccguuugcccugcccccaccu

SEQ ID NO: 424832 - RNA, 63 nt, Human
acagcggugggaucucugcugccagcucucccagccccucagcuucgcagccuggcgcagcau

SEQ ID NO: 424833 - RNA, 63 nt, Human
uguccccaccccagggccacuuagcugacaccagccccucagaggaccagugcgccccauccc

SEQ ID NO: 424834 - RNA, 63 nt, Human
uccuugucucauccccgaagauccgucccccuggccccucaguguccaugucuugagcuuaau

SEQ ID NO: 424835 - RNA, 63 nt, Human
uccccuccuguucacucucccaacccugcuccagccccucagcuucccagacccucaugcagu

SEQ ID NO: 424836 - RNA, 63 nt, Human
ccagccuaggacgccaacuucucccaccccuuggccccucacauccucuccaggaagggagug

SEQ ID NO: 424837 - RNA, 63 nt, Human
cucuuucuccuucuucccugagucucucuccaugccccucaucucuuccuuuugcccucgccu

SEQ ID NO: 424838 - RNA, 63 nt, Human
cuucuggaccugcccccacuguggccugcaugcgccccucacgccccuggagcgcaucgccca

SEQ ID NO: 424839 - RNA, 63 nt, Human
ccagagcugaccccacuccaggaccuaggcccagccccucagccucaucuggagccccugaag

SEQ ID NO: 424840 - RNA, 63 nt, Human
cacauguuuucggcaacguguucccguguccuggccccucacgggcccccacacucuccugac

SEQ ID NO: 424841 - RNA, 63 nt, Human
ugcccccucucugagagcccuggccagcucuucgccccucaccucuuugaaacucuggacgua

SEQ ID NO: 424842 - RNA, 63 nt, Human
ugcaaacuucucccggguccagcgccuggggcugccccucaagauggucauguacucagcugu

SEQ ID NO: 424843 - RNA, 63 nt, Human
uuccuuggaccguaucacugguccaccuccugagccccucaauccuaucacagucuacugacu

SEQ ID NO: 424844 - RNA, 63 nt, Human
aaggccaccugacuccuaucacgacgcacccaagccccucaguccagcuucccaaugccuggc

SEQ ID NO: 424845 - RNA, 63 nt, Human
ucuucuuccgacugguacugaacauauauacuugccccucaggugagguuccaaguugcaacu

SEQ ID NO: 424846 - RNA, 63 nt, Human
caucucaaaagaaguccaaagcgggaaucaugugccccucagcggagccccgggaguguccaa

SEQ ID NO: 424847 - RNA, 63 nt, Human
cugaguugggggagcgacccuucccccagccccgccccucaggacacccagaaccccaccccu

SEQ ID NO: 424848 - RNA, 63 nt, Human
acuuuucccuuccucuuuccccacagccccccagccccucagcccucccagcccacuucugcc

SEQ ID NO: 424849 - RNA, 63 nt, Human
gaggcaguggcuggugggccacucucuccaggugccccucagccaugggcccuacaguccccu

SEQ ID NO: 424850 - RNA, 61 nt, Human
cacccuauggaccagucaaauaaaagccuucaggccccucaaccagaguccccucuuacug

SEQ ID NO: 424851 - RNA, 63 nt, Human
gaggcugagguggcugcaggagcucguuucacagccccucagguggagcugguugggccgcgg

SEQ ID NO: 424852 - RNA, 63 nt, Human
aaccucuccccuaacccugcucccuggggcugcgccccucaacacccucucaacaccccccuc

SEQ ID NO: 424853 - RNA, 63 nt, Human
agcagagcgggacucuguccaacaagccccacagccccucaaagacuuuuuuuuguuuguuuu

SEQ ID NO: 424854 - RNA, 63 nt, Human
ugugcccugccuucagcuuuggugaaagggagggccccucaugugugcugugcugugucugca

SEQ ID NO: 424855 - RNA, 63 nt, Human
gccaaacagauggggaggcccaaagcaaggcuugccccucagaggagcucacgcagggcagga

SEQ ID NO: 424856 - RNA, 63 nt, Human
aguuuggcagcuugacuucugcagcuggaggaggccccucaggccggggaucuggggagggcu

SEQ ID NO: 424857 - RNA, 63 nt, Human
aacagccgacuuugagcauuguuucuucuaacugccccucaacuaccauuaucuucaagucaa

SEQ ID NO: 424858 - RNA, 63 nt, Human
gacagcaggccuggcacugggaggugggggugagccccucacagccuugccccuccccaaggc

SEQ ID NO: 424859 - RNA, 63 nt, Human
ggccacuggggccaccacccugaccaccacugugccccucauuguuacugccuugugagauaa

SEQ ID NO: 424860 - RNA, 63 nt, Human
cuuuuuuuuaggccccugccugucugcccaucugccccucacccacccgaggcucugcccacc

SEQ ID NO: 424861 - RNA, 63 nt, Human
ccuuuacuaaaacacuuucucugaaccccccuugccccucacugaucuugcuuuucccugguc

SEQ ID NO: 424862 - RNA, 63 nt, Human
cauguauauagguccugaugccuucccaaccccgccccucacccuguugccaccuuguuucau

SEQ ID NO: 424863 - RNA, 63 nt, Human
uccucucggugggaugggcaccacagacaggaggccccucaggcccgugcgggccacugucug

SEQ ID NO: 424864 - RNA, 63 nt, Human
aguuaccgagccgaagggagaugaugggccuucgccccucagugggauggcagcugagggggc

SEQ ID NO: 424865 - RNA, 63 nt, Human
caggagugggcucagagucuagcaaaugcuaaggccccucaggcugggcucugaacgaggacc

SEQ ID NO: 424866 - RNA, 63 nt, Human
ggguugguguggauagcaaaggaggaagucugagccccucauuggucuuccucccaccugucc

SEQ ID NO: 424867 - RNA, 63 nt, Human
uaaagguccaugaacccugccccacuccugucagccccucaucagccuuuucagcagguucca

SEQ ID NO: 424868 - RNA, 63 nt, Human
ugucuguucucuggggauugcugggucacaggugccccucaccuuccacagucaggcagggaa

SEQ ID NO: 424869 - RNA, 63 nt, Human
aacugugaagguccccgugggguggagcauggugccccucacaagccgcagcggcuggugccc

SEQ ID NO: 424870 - RNA, 63 nt, Human
gccauggaggcgccuuccuggguuggccagagggccccucacuggcuggacuggaggcugggu

SEQ ID NO: 424871 - RNA, 63 nt, Human
aggugcccaacaccccccaccggaggacacgcugccccucagcgaugccccuaccuuuugggg

SEQ ID NO: 424872 - RNA, 63 nt, Human
uucaccuuugucgcugggucagugcuggaaagcgccccucacuccugcgcugacaagggcccu

SEQ ID NO: 424873 - RNA, 63 nt, Human
ggaguguggggauaggagccgggccaagcgcuggccccucagcggugagcccugcccacucuu

SEQ ID NO: 424874 - RNA, 63 nt, Human
agucucugucuccugggcccugcucugggaccugccccucacguucucuuggggacacccgag

SEQ ID NO: 424875 - RNA, 63 nt, Human
acucauccuguucaagaaacaaccuuucauguagccccucaacagaaugcauugcaucaucac

SEQ ID NO: 424876 - RNA, 63 nt, Human
guuuuuaaucaguuaucuugggaacuuaaccuggccccucaccucuucugcaccccccgcccc

SEQ ID NO: 424877 - RNA, 63 nt, Human
ucucuuaauuuucaggaagaaagggaaauugcagccccucagcccccaggauugaccucuggg

SEQ ID NO: 424878 - RNA, 63 nt, Human
gcccugcacaugaugggguuugguggacccagugccccucacggcugccgcaagucugcugca

SEQ ID NO: 424879 - RNA, 63 nt, Human
ggugagcuuccugcagccuguggauguccugcagccccucagcccuacccccaaguuucuccu

SEQ ID NO: 424880 - RNA, 63 nt, Human
ccggugcuccucucuaggcagcgggugggcacagccccucaccacggacacggacagaggacc

SEQ ID NO: 424881 - RNA, 63 nt, Human
ugggguguggauggggcugcagcaccaggcagagccccucagggcgccgaugucgagggcacc

SEQ ID NO: 424882 - RNA, 63 nt, Human
auuagggauauuaucaaaauauguaaccaugaggccccucagguccugaucagucagaaugga

SEQ ID NO: 424883 - RNA, 63 nt, Human
ccugacucugucacucaagccuuucuccaccaggccccucaucugaauaccaagcacagaaau

SEQ ID NO: 424884 - RNA, 63 nt, Human
ggcccccggccacugucucggggcccaccucucgccccucaucuugguaauuagccagccuca

SEQ ID NO: 424885 - RNA, 63 nt, Human
uccuuugcagaacuucagggacugggagcagaggccccucacucaacgacguuugugcgacau

SEQ ID NO: 424886 - RNA, 63 nt, Human
ugcucaucacgggaggauaccugugugccggcagccccucagggacucucagcccuggcacug

SEQ ID NO: 424887 - RNA, 63 nt, Human
auggggggcuggaccaccauggccacugacccagccccucagaaucccacacuccaauccuuu

SEQ ID NO: 424888 - RNA, 63 nt, Human
acggucccagggccccaccuaggugcagagccggccccucaccuaacagcugguuccuaccag

SEQ ID NO: 424889 - RNA, 63 nt, Human
ucccccuucccuggggcuucuagagcucucucugccccucagguccuggcccuuggguccuug

SEQ ID NO: 424890 - RNA, 63 nt, Human
ggguccagggaggggcgccugcugagcacuuccgccccucacccugcccagccccugccauga

SEQ ID NO: 424891 - RNA, 63 nt, Human
ccuugaaaugagaccacgucagagacauguacugccccucacauuuucucaccuaaaccagca

SEQ ID NO: 424892 - RNA, 63 nt, Human
cccuuccuugaguggucuagaaggcacugcguggccccucagaugcugggacacaacagaccc

SEQ ID NO: 424893 - RNA, 63 nt, Human
cagcagagcucaggacauucccccacagagcuugccccucaguuccuaccuccaagggggagg

SEQ ID NO: 424894 - RNA, 63 nt, Human
caccccuucccuucccuggcgccccgggcccaggccccucagcugucagcugguuuugauggc

SEQ ID NO: 424895 - RNA, 63 nt, Human
ggaugcugcugggaguccauggcacaggccacagccccucaccuugccgcgguggcuggcagc

SEQ ID NO: 424896 - RNA, 63 nt, Human
augugguagugaaaaucgaggaagcaccucucagccccucagagaaugaucacccugaauuca

SEQ ID NO: 424897 - RNA, 59 nt, Human
agaaggcaaggccggagugagugccugcggccccucacagggcugaggccagccccuag

SEQ ID NO: 424898 - RNA, 63 nt, Human
aggcaggagagagagcagcuccccugcccaccugccccucaacccuguagcugcagggggagg

SEQ ID NO: 424899 - RNA, 63 nt, Human
gugcagacaagagguggcgagagcccccaucaugccccucaaccuaucccguuccuucugccu

SEQ ID NO: 424900 - RNA, 63 nt, Human
ucagacacugaugucuguccccaggugcucucugccccucaugccccucucaccggcccagug

SEQ ID NO: 424901 - RNA, 63 nt, Human
ggaacgugcaaauuugcaggugcugcaucccaagccccucaugcuccugccuuccugagggcc

SEQ ID NO: 424902 - RNA, 63 nt, Human
ugcccguuggacuuugccccucacacuggcccagccccucacacugccccaccccgagaaccc

SEQ ID NO: 424903 - RNA, 63 nt, Human
caggccgcaggagugggaugcccguuggacuuugccccucacacuggcccagccccucacacu

SEQ ID NO: 424904 - RNA, 63 nt, Human
aggcccuuccucccuuggcccaaccagcaaagcgccccucagucuucaagggcuuuccuggau

SEQ ID NO: 424905 - RNA, 63 nt, Human
cacagccaggaacccggccagguccccccacaugccccucagggcccaggccugagugagugc

SEQ ID NO: 424906 - RNA, 63 nt, Human
ucuuuagucuuugucccuuccuuuucacuaagugccccucauccuuuucaaucucauugucac

SEQ ID NO: 424907 - RNA, 63 nt, Human
ccuuuccuuccucuccucccaccuccucccucagccccucauucuccuugggaaucugcagag

SEQ ID NO: 424908 - RNA, 63 nt, Human
ccgccagagucccagacaccgguuuuccuagaagccccucacccccacuggcccacugguggc

SEQ ID NO: 424909 - RNA, 63 nt, Human
cugccaagcgagaaugcaggccccgcccccucggccccucaccaccucuuucuacagccuaau

SEQ ID NO: 424910 - RNA, 63 nt, Human
augaggagagcuucaggccccaggacugugggggccccucaggucagcucacugagcugggug

SEQ ID NO: 424911 - RNA, 63 nt, Human
uauuggcaaggggaguggaaaugacaccaagaagccccucaugcucaugguuggacagagagc

SEQ ID NO: 424912 - RNA, 63 nt, Human
auuugccucccuccagcucugcuuaggcauuuugccccucaccccaauguuccacaccaucga

SEQ ID NO: 424913 - RNA, 63 nt, Human
cauucuccagucagaguagaugaugaggcccaugccccucacccccacgccccgccccuacaa

SEQ ID NO: 424914 - RNA, 63 nt, Human
uggcaccugccacucugccccuugcccuccccugccccucacaacagucaccucacaaaccug

SEQ ID NO: 424915 - RNA, 63 nt, Human
augacugcagcagaccuccuuggguguaccaaugccccucaucucccacuuucacaccuaacc

SEQ ID NO: 424916 - RNA, 63 nt, Human
aauaaaguauaaaacauuuccaaucacuuaguagccccucaaaguaguuagaaaauaaacaga

SEQ ID NO: 424917 - RNA, 63 nt, Human
cucaccguggcaaacacaggaaccccaugacucgccccucaccuggcguggagcugccugguu

SEQ ID NO: 424918 - RNA, 63 nt, Human
ugcacacagggaugcccgcuccacauccugccugccccucagcccuggcccaggccccuuuug

SEQ ID NO: 424919 - RNA, 63 nt, Human
ccaucuugaguccuggaacggcccugggugccugccccucacugugcaacucugggagcagcc

SEQ ID NO: 424920 - RNA, 63 nt, Human
ccucuaaauaccuacccuagaugauuucauccugccccucacuucuuaacauauuccuguguc

SEQ ID NO: 424921 - RNA, 64 nt, Human; identical to SEQ ID NO: 31718

SEQ ID NO: 424922 - RNA, 64 nt, Human; identical to SEQ ID NO: 31719

SEQ ID NO: 424923 - RNA, 64 nt, Human; identical to SEQ ID NO: 31720

SEQ ID NO: 424924 - RNA, 64 nt, Human; identical to SEQ ID NO: 31721

SEQ ID NO: 424925 - RNA, 64 nt, Human; identical to SEQ ID NO: 31722

SEQ ID NO: 424926 - RNA, 64 nt, Human; identical to SEQ ID NO: 31723

SEQ ID NO: 424927 - RNA, 64 nt, Human; identical to SEQ ID NO: 31724

SEQ ID NO: 424928 - RNA, 64 nt, Human; identical to SEQ ID NO: 31725

SEQ ID NO: 424929 - RNA, 64 nt, Human; identical to SEQ ID NO: 31726

SEQ ID NO: 424930 - RNA, 61 nt, Human; identical to SEQ ID NO: 31727

SEQ ID NO: 424931 - RNA, 64 nt, Human; identical to SEQ ID NO: 31728

SEQ ID NO: 424932 - RNA, 64 nt, Human; identical to SEQ ID NO: 31729

SEQ ID NO: 424933 - RNA, 64 nt, Human; identical to SEQ ID NO: 31730

SEQ ID NO: 424934 - RNA, 64 nt, Human; identical to SEQ ID NO: 31731

SEQ ID NO: 424935 - RNA, 64 nt, Human; identical to SEQ ID NO: 31732

SEQ ID NO: 424936 - RNA, 64 nt, Human; identical to SEQ ID NO: 31733

SEQ ID NO: 424937 - RNA, 64 nt, Human; identical to SEQ ID NO: 31734

SEQ ID NO: 424938 - RNA, 64 nt, Human; identical to SEQ ID NO: 31735

SEQ ID NO: 424939 - RNA, 64 nt, Human; identical to SEQ ID NO: 31736

SEQ ID NO: 424940 - RNA, 64 nt, Human; identical to SEQ ID NO: 31737

SEQ ID NO: 424941 - RNA, 64 nt, Human; identical to SEQ ID NO: 31738

SEQ ID NO: 424942 - RNA, 64 nt, Human; identical to SEQ ID NO: 31739

SEQ ID NO: 424943 - RNA, 64 nt, Human; identical to SEQ ID NO: 31740

SEQ ID NO: 424944 - RNA, 64 nt, Human; identical to SEQ ID NO: 31741

SEQ ID NO: 424945 - RNA, 64 nt, Human; identical to SEQ ID NO: 31742

SEQ ID NO: 424946 - RNA, 64 nt, Human; identical to SEQ ID NO: 31743

SEQ ID NO: 424947 - RNA, 64 nt, Human; identical to SEQ ID NO: 31744

SEQ ID NO: 424948 - RNA, 64 nt, Human; identical to SEQ ID NO: 31745

SEQ ID NO: 424949 - RNA, 64 nt, Human; identical to SEQ ID NO: 31746

SEQ ID NO: 424950 - RNA, 64 nt, Human; identical to SEQ ID NO: 31747

SEQ ID NO: 424951 - RNA, 64 nt, Human; identical to SEQ ID NO: 31748

SEQ ID NO: 424952 - RNA, 64 nt, Human; identical to SEQ ID NO: 31749

SEQ ID NO: 424953 - RNA, 64 nt, Human; identical to SEQ ID NO: 31750

SEQ ID NO: 424954 - RNA, 64 nt, Human; identical to SEQ ID NO: 31751

SEQ ID NO: 424955 - RNA, 64 nt, Human; identical to SEQ ID NO: 31752

SEQ ID NO: 424956 - RNA, 64 nt, Human; identical to SEQ ID NO: 31753

SEQ ID NO: 424957 - RNA, 62 nt, Human; identical to SEQ ID NO: 31754

SEQ ID NO: 424958 - RNA, 64 nt, Human; identical to SEQ ID NO: 31755

SEQ ID NO: 424959 - RNA, 64 nt, Human; identical to SEQ ID NO: 31756

SEQ ID NO: 424960 - RNA, 64 nt, Human; identical to SEQ ID NO: 31757

SEQ ID NO: 424961 - RNA, 54 nt, Human; identical to SEQ ID NO: 31758

SEQ ID NO: 424962 - RNA, 64 nt, Human; identical to SEQ ID NO: 31759

SEQ ID NO: 424963 - RNA, 64 nt, Human; identical to SEQ ID NO: 31760

SEQ ID NO: 424964 - RNA, 64 nt, Human; identical to SEQ ID NO: 31761

SEQ ID NO: 424965 - RNA, 64 nt, Human; identical to SEQ ID NO: 31762

SEQ ID NO: 424966 - RNA, 64 nt, Human; identical to SEQ ID NO: 31763

SEQ ID NO: 424967 - RNA, 64 nt, Human; identical to SEQ ID NO: 31764

SEQ ID NO: 424968 - RNA, 64 nt, Human; identical to SEQ ID NO: 31765

SEQ ID NO: 424969 - RNA, 64 nt, Human; identical to SEQ ID NO: 31766

SEQ ID NO: 424970 - RNA, 64 nt, Human; identical to SEQ ID NO: 31767

SEQ ID NO: 424971 - RNA, 64 nt, Human; identical to SEQ ID NO: 31768

SEQ ID NO: 424972 - RNA, 64 nt, Human; identical to SEQ ID NO: 31769

SEQ ID NO: 424973 - RNA, 64 nt, Human; identical to SEQ ID NO: 31770

SEQ ID NO: 424974 - RNA, 64 nt, Human; identical to SEQ ID NO: 31771

SEQ ID NO: 424975 - RNA, 64 nt, Human; identical to SEQ ID NO: 31772

SEQ ID NO: 424976 - RNA, 64 nt, Human; identical to SEQ ID NO: 31773

SEQ ID NO: 424977 - RNA, 64 nt, Human; identical to SEQ ID NO: 31774

SEQ ID NO: 424978 - RNA, 64 nt, Human; identical to SEQ ID NO: 31775

SEQ ID NO: 424979 - RNA, 64 nt, Human; identical to SEQ ID NO: 31776

SEQ ID NO: 424980 - RNA, 64 nt, Human; identical to SEQ ID NO: 31777

SEQ ID NO: 424981 - RNA, 64 nt, Human; identical to SEQ ID NO: 31778

SEQ ID NO: 424982 - RNA, 64 nt, Human; identical to SEQ ID NO: 31779

SEQ ID NO: 424983 - RNA, 64 nt, Human; identical to SEQ ID NO: 31780

SEQ ID NO: 424984 - RNA, 64 nt, Human; identical to SEQ ID NO: 31781

SEQ ID NO: 424985 - RNA, 64 nt, Human; identical to SEQ ID NO: 31782

SEQ ID NO: 424986 - RNA, 64 nt, Human; identical to SEQ ID NO: 31783

SEQ ID NO: 424987 - RNA, 64 nt, Human; identical to SEQ ID NO: 31784

SEQ ID NO: 424988 - RNA, 64 nt, Human; identical to SEQ ID NO: 31785

SEQ ID NO: 424989 - RNA, 64 nt, Human; identical to SEQ ID NO: 31786

SEQ ID NO: 424990 - RNA, 64 nt, Human; identical to SEQ ID NO: 31787

SEQ ID NO: 424991 - RNA, 64 nt, Human; identical to SEQ ID NO: 31788

SEQ ID NO: 424992 - RNA, 51 nt, Human; identical to SEQ ID NO: 31789

SEQ ID NO: 424993 - RNA, 64 nt, Human; identical to SEQ ID NO: 31790

SEQ ID NO: 424994 - RNA, 64 nt, Human; identical to SEQ ID NO: 31791

SEQ ID NO: 424995 - RNA, 64 nt, Human; identical to SEQ ID NO: 31792

SEQ ID NO: 424996 - RNA, 64 nt, Human; identical to SEQ ID NO: 31793

SEQ ID NO: 424997 - RNA, 64 nt, Human; identical to SEQ ID NO: 31794

SEQ ID NO: 424998 - RNA, 64 nt, Human; identical to SEQ ID NO: 31795

SEQ ID NO: 424999 - RNA, 64 nt, Human; identical to SEQ ID NO: 31796

SEQ ID NO: 425000 - RNA, 64 nt, Human; identical to SEQ ID NO: 31797

SEQ ID NO: 425001 - RNA, 64 nt, Human; identical to SEQ ID NO: 31798

SEQ ID NO: 425002 - RNA, 64 nt, Human; identical to SEQ ID NO: 31799

SEQ ID NO: 425003 - RNA, 64 nt, Human; identical to SEQ ID NO: 31800

SEQ ID NO: 425004 - RNA, 64 nt, Human; identical to SEQ ID NO: 31801

SEQ ID NO: 425005 - RNA, 64 nt, Human; identical to SEQ ID NO: 31802

SEQ ID NO: 425006 - RNA, 64 nt, Human; identical to SEQ ID NO: 31803

SEQ ID NO: 425007 - RNA, 64 nt, Human; identical to SEQ ID NO: 31804

SEQ ID NO: 425008 - RNA, 64 nt, Human; identical to SEQ ID NO: 31805

SEQ ID NO: 425009 - RNA, 64 nt, Human; identical to SEQ ID NO: 31806

SEQ ID NO: 425010 - RNA, 64 nt, Human; identical to SEQ ID NO: 31807

SEQ ID NO: 425011 - RNA, 64 nt, Human; identical to SEQ ID NO: 31808

SEQ ID NO: 425012 - RNA, 64 nt, Human; identical to SEQ ID NO: 31809

SEQ ID NO: 425013 - RNA, 64 nt, Human; identical to SEQ ID NO: 31810

SEQ ID NO: 425014 - RNA, 64 nt, Human; identical to SEQ ID NO: 31811

SEQ ID NO: 425015 - RNA, 64 nt, Human; identical to SEQ ID NO: 31812

SEQ ID NO: 425016 - RNA, 64 nt, Human; identical to SEQ ID NO: 31813

SEQ ID NO: 425017 - RNA, 64 nt, Human; identical to SEQ ID NO: 31814

SEQ ID NO: 425018 - RNA, 64 nt, Human; identical to SEQ ID NO: 31815

SEQ ID NO: 425019 - RNA, 64 nt, Human; identical to SEQ ID NO: 31816

SEQ ID NO: 425020 - RNA, 64 nt, Human; identical to SEQ ID NO: 31817

SEQ ID NO: 425021 - RNA, 64 nt, Human; identical to SEQ ID NO: 31818

SEQ ID NO: 425022 - RNA, 64 nt, Human; identical to SEQ ID NO: 31819

SEQ ID NO: 425023 - RNA, 64 nt, Human; identical to SEQ ID NO: 31820

SEQ ID NO: 425024 - RNA, 64 nt, Human; identical to SEQ ID NO: 31821

SEQ ID NO: 425025 - RNA, 64 nt, Human; identical to SEQ ID NO: 31822

SEQ ID NO: 425026 - RNA, 64 nt, Human; identical to SEQ ID NO: 31823

SEQ ID NO: 425027 - RNA, 64 nt, Human; identical to SEQ ID NO: 31824

SEQ ID NO: 425028 - RNA, 64 nt, Human; identical to SEQ ID NO: 31825

SEQ ID NO: 425029 - RNA, 64 nt, Human; identical to SEQ ID NO: 31826

SEQ ID NO: 425030 - RNA, 64 nt, Human; identical to SEQ ID NO: 31827

SEQ ID NO: 425031 - RNA, 64 nt, Human; identical to SEQ ID NO: 31828

SEQ ID NO: 425032 - RNA, 64 nt, Human; identical to SEQ ID NO: 31829

SEQ ID NO: 425033 - RNA, 64 nt, Human; identical to SEQ ID NO: 31830

SEQ ID NO: 425034 - RNA, 64 nt, Human; identical to SEQ ID NO: 31831

SEQ ID NO: 425035 - RNA, 64 nt, Human; identical to SEQ ID NO: 31832

SEQ ID NO: 425036 - RNA, 64 nt, Human; identical to SEQ ID NO: 31833

SEQ ID NO: 425037 - RNA, 64 nt, Human; identical to SEQ ID NO: 31834

SEQ ID NO: 425038 - RNA, 64 nt, Human; identical to SEQ ID NO: 31835

SEQ ID NO: 425039 - RNA, 64 nt, Human; identical to SEQ ID NO: 31836

SEQ ID NO: 425040 - RNA, 64 nt, Human; identical to SEQ ID NO: 31837

SEQ ID NO: 425041 - RNA, 64 nt, Human; identical to SEQ ID NO: 31838

SEQ ID NO: 425042 - RNA, 64 nt, Human; identical to SEQ ID NO: 31839

SEQ ID NO: 425043 - RNA, 64 nt, Human; identical to SEQ ID NO: 31840

SEQ ID NO: 425044 - RNA, 64 nt, Human; identical to SEQ ID NO: 31841

SEQ ID NO: 425045 - RNA, 64 nt, Human; identical to SEQ ID NO: 31842

SEQ ID NO: 425046 - RNA, 64 nt, Human; identical to SEQ ID NO: 31843

SEQ ID NO: 425047 - RNA, 56 nt, Human; identical to SEQ ID NO: 31844

SEQ ID NO: 425048 - RNA, 64 nt, Human; identical to SEQ ID NO: 31845

SEQ ID NO: 425049 - RNA, 64 nt, Human; identical to SEQ ID NO: 31846

SEQ ID NO: 425050 - RNA, 64 nt, Human; identical to SEQ ID NO: 31847

SEQ ID NO: 425051 - RNA, 64 nt, Human; identical to SEQ ID NO: 31848

SEQ ID NO: 425052 - RNA, 62 nt, Human
caucuccagcuugguguuccauggccccuaggcgaggugaucagggaguggggccaaugggc

SEQ ID NO: 425053 - RNA, 62 nt, Human
uguucccugcuccgcuuccccauaccccagcccgaggugaagcccacaccuacacacccucu

SEQ ID NO: 425054 - RNA, 62 nt, Human
ucuacagaauuuucgucuuuaccuaugugaagcgaggugacgugauacgucacuggcgccgu

SEQ ID NO: 425055 - RNA, 62 nt, Human
cucuccagccgcagcucagcugcacugcguuccgaggugaagucuugccccugaauuuugca

SEQ ID NO: 425056 - RNA, 62 nt, Human
cucacaccuguaaucccagcacuuugagaggccgaggugagacgggaagauggcuugaacuc

SEQ ID NO: 425057 - RNA, 62 nt, Human
ucccaagccuauuggaggaauguggguguggccgaggugauggcaagaaaggugcaagaaag

SEQ ID NO: 425058 - RNA, 62 nt, Human
uuuccuaaaggagacgagcgaauuaacggugucgaggugagccagggccagggggaccccgg

SEQ ID NO: 425059 - RNA, 62 nt, Human
ucugcaaaaugggggugucccccgauccuggccgaggugaggaacagacagggggggucuag

SEQ ID NO: 425060 - RNA, 62 nt, Human
ccaccgccacccagcagucagagaggaccuuucgaggugaugcacuguaaauccggcauuga

SEQ ID NO: 425061 - RNA, 62 nt, Human
acacuaaguaaguggagggaaugaaaguguuucgaggugaauguggauauaauuucccucuu

SEQ ID NO: 425062 - RNA, 62 nt, Human
acccuuugggcucagaggaggguggcuuuuuucgaggugagccauguuguagacacaugaua

SEQ ID NO: 425063 - RNA, 62 nt, Human
auuggcgcauuaccccauaaaacuuuuugagacgaggugagaucugaguauaaagauagguc

SEQ ID NO: 425064 - RNA, 62 nt, Human
aaaugccaugaauuaccuggauguucuuuuuacgaggugacaagaguuggggacagaacucc

SEQ ID NO: 425065 - RNA, 62 nt, Human
uccgucagugccagugccugugccagagguggcgaggugaguccuccagagcuuccuggccg

SEQ ID NO: 425066 - RNA, 62 nt, Human
uacucuguggaugaugugauuguccuggaaaucgaggugaaaggcucaguagaaccuuucca

SEQ ID NO: 425067 - RNA, 62 nt, Human
uucgagcccaacuucaugcucuucgagaagugcgaggugaacggugcgggggcgcacccucu

SEQ ID NO: 425068 - RNA, 62 nt, Human
caccauaugcaugcacuagaauuauuaacuaacgaggugagguauugcaaauguucaaaaaa

SEQ ID NO: 425069 - RNA, 62 nt, Human
auuuagaaaagggacagaucagccccugaagacgaggugaaaagucaauuuuacaauuugua

SEQ ID NO: 425070 - RNA, 62 nt, Human
gacgcagucaggcgcacgcccgcaagaggcggcgaggugacaaguuuggagugcgcccccuu

SEQ ID NO: 425071 - RNA, 62 nt, Human
cugaaggggcugcugacugccccagaaucugccgaggugagaacagcauccugaggcacagc

SEQ ID NO: 425072 - RNA, 62 nt, Human
cucacgccuguaaucccagcacuuugggaggccgaggugagcggaucaccugaggucaggag

SEQ ID NO: 425073 - RNA, 62 nt, Human
auccucuauugagaguuacagcaaguguuaaacgaggugaguucacauaacaggaauucugg

SEQ ID NO: 425074 - RNA, 62 nt, Human
gaaauuuuuaaaaaacuauucucaauuauauacgaggugaugggacuucuuaacacacauuu

SEQ ID NO: 425075 - RNA, 62 nt, Human
uuuaagaaguauucuaaacuguucuagaugaccgaggugaugaguucacauacacuggaagc

SEQ ID NO: 425076 - RNA, 62 nt, Human
ugcuggagcccagucaccccgggaccgugggccgaggugacugcagacccucccagggaggc

SEQ ID NO: 425077 - RNA, 62 nt, Human
caggcagagaggcugggaugauggagaaagcucgaggugaaguuuuaaaaaaaaaguugugg

SEQ ID NO: 425078 - RNA, 62 nt, Human
aacucaggcacaugcuuagcuguaaagggaagcgaggugaagucguccugcagcguauuaga

SEQ ID NO: 425079 - RNA, 52 nt, Human
cugcuggaguuaaggaguagcucgaggugaagcuggaugggggauccagugg

SEQ ID NO: 425080 - RNA, 62 nt, Human
ugugguggagcauacacaggguacucuggggucgaggugagaggugaugugguauucagugc

SEQ ID NO: 425081 - RNA, 62 nt, Human
gaccugcuuacagagcaagccacgccucuuuccgaggugaaggugggaccauuccuugggaa

SEQ ID NO: 425082 - RNA, 62 nt, Human
cuuaugguaaauguaaacauguagacugcauucgaggugaccuaaaguagagaggucaugaa

SEQ ID NO: 425083 - RNA, 62 nt, Human
ccaaagugucccuugggucacacagcuaaagccgaggugaccaguuguaccccgagugccag

SEQ ID NO: 425084 - RNA, 62 nt, Human
agaucaggggcucuggggaaacugcuggaacucgaggugaggaucagccuuuuccagcaucc

SEQ ID NO: 425085 - RNA, 62 nt, Human
gacagagcucaaagaggcccucuuaccgcuagcgaggugauaggacaucuggcuugccacaa

SEQ ID NO: 425086 - RNA, 62 nt, Human
agggcucugcuggucuuucugagucacagcugcgaggugaugggggcuggggccccaggcgu

SEQ ID NO: 425087 - RNA, 62 nt, Human
gaauugcacucuuggaagaucccgcauggguucgaggugaggccgcuucagaaccucaaaug

SEQ ID NO: 425088 - RNA, 62 nt, Human
uucuuggucaggugugcccacagaugcggaggcgaggugagugauuccaucauuucaguucu

SEQ ID NO: 425089 - RNA, 62 nt, Human
cuggcugcaggccugacuacugcccacaccaacgaggugaucuagcagauacauggcaacgu

SEQ ID NO: 425090 - RNA, 62 nt, Human
cgguggcuucucgcugcgcagccuccagggcccgaggugaucccgguggugggauccacgcu

SEQ ID NO: 425091 - RNA, 62 nt, Human
cucauuuucuggucugaccggcggaacccccacgaggugaagccagccuaugccaccaggua

SEQ ID NO: 425092 - RNA, 62 nt, Human
augucucaccacaaagaaggaggauaagggagcgaggugauggauauguuaauuagcuugau

SEQ ID NO: 425093 - RNA, 62 nt, Human
ggcacgccuguaaucccagcacuuugggaggccgaggugaaaggaucacuugagcccaggaa

SEQ ID NO: 425094 - RNA, 62 nt, Human
gcagauaacccuauacauuaauacugguaucucgaggugacucuucugaccaagggugguua

SEQ ID NO: 425095 - RNA, 62 nt, Human
uguguauauauaaaagguuguguacaacuccacgaggugaaaaauauucaguaacuuguuua

SEQ ID NO: 425096 - RNA, 62 nt, Human
cccaguauggccccaccugcucuuuccucccccgaggugaggccccgccugcucuuuccucc

SEQ ID NO: 425097 - RNA, 62 nt, Human
ccuugcuccccgggaacccauggaaggagaagcgaggugaugcagcagcaggggcaagaccc

SEQ ID NO: 425098 - RNA, 64 nt, Human
auuuagucguuugagaauuguagccuguuguuuucgcugugacuugggucucagugcuagggua

SEQ ID NO: 425099 - RNA, 64 nt, Human; identical to SEQ ID NO: 359119

SEQ ID NO: 425100 - RNA, 64 nt, Human; identical to SEQ ID NO: 359120

SEQ ID NO: 425101 - RNA, 64 nt, Human; identical to SEQ ID NO: 359121

SEQ ID NO: 425102 - RNA, 64 nt, Human; identical to SEQ ID NO: 359122

SEQ ID NO: 425103 - RNA, 64 nt, Human; identical to SEQ ID NO: 359123

SEQ ID NO: 425104 - RNA, 64 nt, Human; identical to SEQ ID NO: 359124

SEQ ID NO: 425105 - RNA, 64 nt, Human; identical to SEQ ID NO: 359125

SEQ ID NO: 425106 - RNA, 64 nt, Human; identical to SEQ ID NO: 359126

SEQ ID NO: 425107 - RNA, 64 nt, Human; identical to SEQ ID NO: 359127

SEQ ID NO: 425108 - RNA, 64 nt, Human; identical to SEQ ID NO: 359128

SEQ ID NO: 425109 - RNA, 64 nt, Human; identical to SEQ ID NO: 359129

SEQ ID NO: 425110 - RNA, 64 nt, Human; identical to SEQ ID NO: 359132

SEQ ID NO: 425111 - RNA, 64 nt, Human; identical to SEQ ID NO: 359133

SEQ ID NO: 425112 - RNA, 64 nt, Human; identical to SEQ ID NO: 359134

SEQ ID NO: 425113 - RNA, 64 nt, Human; identical to SEQ ID NO: 359135

SEQ ID NO: 425114 - RNA, 61 nt, Human
aauccuuaacaagacagcacuccagauaggcagccacgaccccaaaggugaggauaauguu

SEQ ID NO: 425115 - RNA, 61 nt, Human
augccagccccugccuggguugggggcacucagccacgaccagccccuuccuggguauuua

SEQ ID NO: 425116 - RNA, 61 nt, Human
uauucuaugagaacacugcaucugcauucauagccacgaguuuguuauugcuacaggcuac

SEQ ID NO: 425117 - RNA, 64 nt, Human
agucgaccccuucuacaccuaucccguggccauccgcugugacugcggagccugcuccacugcc

SEQ ID NO: 425118 - RNA, 64 nt, Human; identical to SEQ ID NO: 359136

SEQ ID NO: 425119 - RNA, 64 nt, Human; identical to SEQ ID NO: 359137

SEQ ID NO: 425120 - RNA, 63 nt, Human; identical to SEQ ID NO: 359138

SEQ ID NO: 425121 - RNA, 64 nt, Human; identical to SEQ ID NO: 359139

SEQ ID NO: 425122 - RNA, 64 nt, Human; identical to SEQ ID NO: 359140

SEQ ID NO: 425123 - RNA, 64 nt, Human; identical to SEQ ID NO: 359141

SEQ ID NO: 425124 - RNA, 64 nt, Human; identical to SEQ ID NO: 359142

SEQ ID NO: 425125 - RNA, 64 nt, Human; identical to SEQ ID NO: 359143

SEQ ID NO: 425126 - RNA, 64 nt, Human; identical to SEQ ID NO: 359144

SEQ ID NO: 425127 - RNA, 64 nt, Human; identical to SEQ ID NO: 359145

SEQ ID NO: 425128 - RNA, 64 nt, Human; identical to SEQ ID NO: 359146

SEQ ID NO: 425129 - RNA, 64 nt, Human; identical to SEQ ID NO: 359147

SEQ ID NO: 425130 - RNA, 64 nt, Human; identical to SEQ ID NO: 359150

SEQ ID NO: 425131 - RNA, 64 nt, Human; identical to SEQ ID NO: 359151

SEQ ID NO: 425132 - RNA, 64 nt, Human; identical to SEQ ID NO: 359152

SEQ ID NO: 425133 - RNA, 64 nt, Human
gccaucacccccuccagcagugaacacuguccgccgcugugaggccugcuccccugcgaccgcc

SEQ ID NO: 425134 - RNA, 64 nt, Human
gaccaaaggaggggguggcaggggccuugcagggcgcugugagguccaggccggucuuggcgcc

SEQ ID NO: 425135 - RNA, 64 nt, Human
guggcccgcacuucaguaaguuaucaacucucaccgcugugaaccugccaauccgcuguaacaa

SEQ ID NO: 425136 - RNA, 64 nt, Human
augggggcauggguggagggucccuaauucucuucgcugugaugcaugagcucccucgcuguau

SEQ ID NO: 425137 - RNA, 64 nt, Human; identical to SEQ ID NO: 359153

SEQ ID NO: 425138 - RNA, 64 nt, Human; identical to SEQ ID NO: 359154

SEQ ID NO: 425139 - RNA, 64 nt, Human; identical to SEQ ID NO: 359155

SEQ ID NO: 425140 - RNA, 64 nt, Human; identical to SEQ ID NO: 359156

SEQ ID NO: 425141 - RNA, 64 nt, Human; identical to SEQ ID NO: 359157

SEQ ID NO: 425142 - RNA, 59 nt, Human; identical to SEQ ID NO: 359158

SEQ ID NO: 425143 - RNA, 64 nt, Human; identical to SEQ ID NO: 359159

SEQ ID NO: 425144 - RNA, 64 nt, Human; identical to SEQ ID NO: 359160

SEQ ID NO: 425145 - RNA, 64 nt, Human; identical to SEQ ID NO: 359161

SEQ ID NO: 425146 - RNA, 64 nt, Human; identical to SEQ ID NO: 359162

SEQ ID NO: 425147 - RNA, 64 nt, Human; identical to SEQ ID NO: 359163

SEQ ID NO: 425148 - RNA, 64 nt, Human; identical to SEQ ID NO: 359164

SEQ ID NO: 425149 - RNA, 64 nt, Human; identical to SEQ ID NO: 359165

SEQ ID NO: 425150 - RNA, 64 nt, Human; identical to SEQ ID NO: 359166

SEQ ID NO: 425151 - RNA, 64 nt, Human; identical to SEQ ID NO: 359167

SEQ ID NO: 425152 - RNA, 64 nt, Human
cugguuccuccugguaggcuuacaaguguuuacuauaugcuauuaauacauuauacuuuauaac

SEQ ID NO: 425153 - RNA, 64 nt, Human
uccucuugccccagaaguaauucucuauaccaagauaugcuaggaguaggaugaugauucaaag

SEQ ID NO: 425154 - RNA, 64 nt, Human
cacuauugaagggaugugacauuaccuccuguagauaugcuaacaguguuauucuuucauuucc

SEQ ID NO: 425155 - RNA, 64 nt, Human; identical to SEQ ID NO: 359168

SEQ ID NO: 425156 - RNA, 64 nt, Human; identical to SEQ ID NO: 359169

SEQ ID NO: 425157 - RNA, 64 nt, Human; identical to SEQ ID NO: 359170

SEQ ID NO: 425158 - RNA, 64 nt, Human; identical to SEQ ID NO: 359171

SEQ ID NO: 425159 - RNA, 64 nt, Human; identical to SEQ ID NO: 359172

SEQ ID NO: 425160 - RNA, 64 nt, Human; identical to SEQ ID NO: 359173

SEQ ID NO: 425161 - RNA, 64 nt, Human; identical to SEQ ID NO: 359174

SEQ ID NO: 425162 - RNA, 64 nt, Human; identical to SEQ ID NO: 359175

SEQ ID NO: 425163 - RNA, 64 nt, Human; identical to SEQ ID NO: 359176

SEQ ID NO: 425164 - RNA, 64 nt, Human; identical to SEQ ID NO: 359177

SEQ ID NO: 425165 - RNA, 64 nt, Human; identical to SEQ ID NO: 359178

SEQ ID NO: 425166 - RNA, 64 nt, Human; identical to SEQ ID NO: 359179

SEQ ID NO: 425167 - RNA, 64 nt, Human; identical to SEQ ID NO: 359180

SEQ ID NO: 425168 - RNA, 64 nt, Human; identical to SEQ ID NO: 359181

SEQ ID NO: 425169 - RNA, 64 nt, Human; identical to SEQ ID NO: 359182

SEQ ID NO: 425170 - RNA, 61 nt, Human
agcaggccccgauaccgggaagagccgacacagccacgaaccagacaagcagacaaucagc

SEQ ID NO: 425171 - RNA, 64 nt, Human
uuuugaaaagcuucuuaauuaauuugauuaacaaauaugcuaauuuggggaaaccuagagaaga

SEQ ID NO: 425172 - RNA, 64 nt, Human
auuacauuuauauuccaagaugaaccuuuuuuauauaugcuaaaaauuuuggggaauauguuuu

SEQ ID NO: 425173 - RNA, 64 nt, Human
guaggcaaaaagaaaaggagaauuuaggaaauaaauaugcuauaaacaagguacaguacaguga

SEQ ID NO: 425174 - RNA, 64 nt, Human; identical to SEQ ID NO: 359183

SEQ ID NO: 425175 - RNA, 64 nt, Human; identical to SEQ ID NO: 359184

SEQ ID NO: 425176 - RNA, 64 nt, Human; identical to SEQ ID NO: 359185

SEQ ID NO: 425177 - RNA, 64 nt, Human; identical to SEQ ID NO: 359186

SEQ ID NO: 425178 - RNA, 64 nt, Human; identical to SEQ ID NO: 359187

SEQ ID NO: 425179 - RNA, 64 nt, Human; identical to SEQ ID NO: 359188

SEQ ID NO: 425180 - RNA, 64 nt, Human; identical to SEQ ID NO: 359189

SEQ ID NO: 425181 - RNA, 64 nt, Human; identical to SEQ ID NO: 359190

SEQ ID NO: 425182 - RNA, 64 nt, Human; identical to SEQ ID NO: 359191

SEQ ID NO: 425183 - RNA, 64 nt, Human; identical to SEQ ID NO: 359192

SEQ ID NO: 425184 - RNA, 64 nt, Human; identical to SEQ ID NO: 359193

SEQ ID NO: 425185 - RNA, 64 nt, Human; identical to SEQ ID NO: 359194

SEQ ID NO: 425186 - RNA, 64 nt, Human; identical to SEQ ID NO: 359195

SEQ ID NO: 425187 - RNA, 64 nt, Human; identical to SEQ ID NO: 359196

SEQ ID NO: 425188 - RNA, 64 nt, Human; identical to SEQ ID NO: 359197

SEQ ID NO: 425189 - RNA, 64 nt, Human
agcacccucuagcuccauauucuaagaaucugaaauaugcuacuauacuaauuaauaaguaaac

SEQ ID NO: 425190 - RNA, 64 nt, Human
aauuccaaaauauuauggauaaacauuaccauuuauaugcuacaaauuagucugauuccaucuu

SEQ ID NO: 425191 - RNA, 64 nt, Human
uuuuauuggcaacguaugcugcuuuuucauuaaaauaugcuauuaaaauuaaauggcuuuuaaa

SEQ ID NO: 425192 - RNA, 64 nt, Human
aauuauguauauuauuucuauugucuuugucuuaauaugcuaaguuaauuuucacuuuaaaaaa

SEQ ID NO: 425193 - RNA, 64 nt, Human; identical to SEQ ID NO: 359201

SEQ ID NO: 425194 - RNA, 64 nt, Human; identical to SEQ ID NO: 359202

SEQ ID NO: 425195 - RNA, 64 nt, Human; identical to SEQ ID NO: 359203

SEQ ID NO: 425196 - RNA, 64 nt, Human; identical to SEQ ID NO: 359204

SEQ ID NO: 425197 - RNA, 64 nt, Human; identical to SEQ ID NO: 359205

SEQ ID NO: 425198 - RNA, 64 nt, Human; identical to SEQ ID NO: 359206

SEQ ID NO: 425199 - RNA, 64 nt, Human; identical to SEQ ID NO: 359207

SEQ ID NO: 425200 - RNA, 64 nt, Human; identical to SEQ ID NO: 359208

SEQ ID NO: 425201 - RNA, 64 nt, Human; identical to SEQ ID NO: 359209

SEQ ID NO: 425202 - RNA, 64 nt, Human; identical to SEQ ID NO: 359210

SEQ ID NO: 425203 - RNA, 64 nt, Human; identical to SEQ ID NO: 359211

SEQ ID NO: 425204 - RNA, 64 nt, Human; identical to SEQ ID NO: 359212

SEQ ID NO: 425205 - RNA, 64 nt, Human; identical to SEQ ID NO: 359213

SEQ ID NO: 425206 - RNA, 64 nt, Human; identical to SEQ ID NO: 359214

SEQ ID NO: 425207 - RNA, 64 nt, Human; identical to SEQ ID NO: 359215

SEQ ID NO: 425208 - RNA, 64 nt, Human
ugcuuaaaaaaugaguaucuuguaaccauuaccuauaugcuaaauauucuugaacaauuaguag

SEQ ID NO: 425209 - RNA, 64 nt, Human
uuauuguauuuuccacuuauuauuacuguauaacauaugcuaguguuuaguuggauuaaucuua

SEQ ID NO: 425210 - RNA, 64 nt, Human
cccuguuuaguucugagagccaacuugagauaccauaugcuagcauucccaguccccagcuggg

SEQ ID NO: 425211 - RNA, 64 nt, Human
aauuaacuauggaaaacauagacauuaugcuuuuauaugcuauucagauuucaaaucuuuccaa

SEQ ID NO: 425212 - RNA, 64 nt, Human; identical to SEQ ID NO: 359216

SEQ ID NO: 425213 - RNA, 64 nt, Human; identical to SEQ ID NO: 359220

SEQ ID NO: 425214 - RNA, 64 nt, Human; identical to SEQ ID NO: 359221

SEQ ID NO: 425215 - RNA, 64 nt, Human; identical to SEQ ID NO: 359222

SEQ ID NO: 425216 - RNA, 64 nt, Human; identical to SEQ ID NO: 359223

SEQ ID NO: 425217 - RNA, 64 nt, Human; identical to SEQ ID NO: 359224

SEQ ID NO: 425218 - RNA, 64 nt, Human; identical to SEQ ID NO: 359225

SEQ ID NO: 425219 - RNA, 64 nt, Human; identical to SEQ ID NO: 359226

SEQ ID NO: 425220 - RNA, 64 nt, Human; identical to SEQ ID NO: 359227

SEQ ID NO: 425221 - RNA, 64 nt, Human; identical to SEQ ID NO: 359228

SEQ ID NO: 425222 - RNA, 64 nt, Human; identical to SEQ ID NO: 359229

SEQ ID NO: 425223 - RNA, 64 nt, Human; identical to SEQ ID NO: 359230

SEQ ID NO: 425224 - RNA, 64 nt, Human; identical to SEQ ID NO: 359231

SEQ ID NO: 425225 - RNA, 64 nt, Human; identical to SEQ ID NO: 359232

SEQ ID NO: 425226 - RNA, 64 nt, Human; identical to SEQ ID NO: 359233

SEQ ID NO: 425227 - RNA, 64 nt, Human
aaaguuuuugcuauuuaccuuugugcaggcuggcauaugcuaauuugggggugguaaccaaccg

SEQ ID NO: 425228 - RNA, 64 nt, Human
gccaaggcacacaaagugcuuguaggcagcaaccauaugcuacaagaauuguaaacugcauaca

SEQ ID NO: 425229 - RNA, 64 nt, Human
aacagaaaauacuuaacuaggaguaggaggcuuuauaugcuaaaaaugauaaaacugacuguaa

SEQ ID NO: 425230 - RNA, 64 nt, Human
aagccacacacuacuacaucccuucacaaagaguauaugcuaguuucuuguagauauucacagc

SEQ ID NO: 425231 - RNA, 64 nt, Human; identical to SEQ ID NO: 359251

SEQ ID NO: 425232 - RNA, 64 nt, Human
ggaagcagcgccuccuucaggguuggcugggagcucggcccauccaccucuugggguaccugcc

SEQ ID NO: 425233 - RNA, 64 nt, Human
ucuuccugucucuguccuggucccugcccccgucucggcccagccucuguauucuccacccuug

SEQ ID NO: 425234 - RNA, 64 nt, Human
acgguuuucugugccaccaucggucacccauugaucggcccacucugaacccccuggcucucca

SEQ ID NO: 425235 - RNA, 64 nt, Human
uccccuaagucucugcucaaaaaaaaaacaauucucggcccaaagaaaacaaucagaagaauuc

SEQ ID NO: 425236 - RNA, 64 nt, Human
ugguagcuuagcaaagagaccagcugacugucucucggcccagcccaccacgccgaguagcuug

SEQ ID NO: 425237 - RNA, 64 nt, Human
agaagcagcauuugauauacaugcucaaccuucaucggcccacguguauuguccgggcucagaa

SEQ ID NO: 425238 - RNA, 64 nt, Human
ugucccuuuuugcaggggacugggccauggguccucggcccaucuguccauccuccucuccaug

SEQ ID NO: 425239 - RNA, 54 nt, Human
ugggcucccagcucuccuaaucccucggcccaugccuccugccucuccccuccc

SEQ ID NO: 425240 - RNA, 64 nt, Human
gcaggcuccggaacccucgcuguggcucccccgcucggcccaggccuugaagccgcggcgaacc

SEQ ID NO: 425241 - RNA, 64 nt, Human
agugauauuucagcuuggacauuuuacccuucagucggcccaagaaaucaaaauaaaggaaaca

SEQ ID NO: 425242 - RNA, 64 nt, Human
gcccaagggcuuagcuuuagggcuccuccugaguucggcccacaguagaagcaagauuuuaacu

SEQ ID NO: 425243 - RNA, 64 nt, Human
ugaccagugaucaaggcuaauuggaaaagaguuaucggcccauagcuaauaaguagugacagac

SEQ ID NO: 425244 - RNA, 64 nt, Human
agaacacugguggcugagaugcuauaaaaacagcucggcccaacagacacuuccccuggguugc

SEQ ID NO: 425245 - RNA, 64 nt, Human
ucccgaaggccgacaccacuccugccagcccggcucggcccagcacccccucuccuggagggcg

SEQ ID NO: 425246 - RNA, 52 nt, Human
ucgugaagacccugaagugagccgcugugacggguggccaguuuccuuaauu

SEQ ID NO: 425247 - RNA, 64 nt, Human
gagagccucuucgcggcgcuguuggcgacagcagcgcugugauucgcguagcaggggaguuguu

SEQ ID NO: 425248 - RNA, 64 nt, Human
gggccucccacgagccccuccagccucuccaagucgcugugaauugaccccuucuuuccuuucu

SEQ ID NO: 425249 - RNA, 64 nt, Human; identical to SEQ ID NO: 359252

SEQ ID NO: 425250 - RNA, 64 nt, Human; identical to SEQ ID NO: 359253

SEQ ID NO: 425251 - RNA, 64 nt, Human; identical to SEQ ID NO: 359254

SEQ ID NO: 425252 - RNA, 64 nt, Human; identical to SEQ ID NO: 357246

SEQ ID NO: 425253 - RNA, 64 nt, Human; identical to SEQ ID NO: 357247

SEQ ID NO: 425254 - RNA, 64 nt, Human; identical to SEQ ID NO: 357248

SEQ ID NO: 425255 - RNA, 64 nt, Human; identical to SEQ ID NO: 357249

SEQ ID NO: 425256 - RNA, 64 nt, Human; identical to SEQ ID NO: 357250

SEQ ID NO: 425257 - RNA, 64 nt, Human; identical to SEQ ID NO: 357251

SEQ ID NO: 425258 - RNA, 64 nt, Human; identical to SEQ ID NO: 357252

SEQ ID NO: 425259 - RNA, 64 nt, Human; identical to SEQ ID NO: 357253

SEQ ID NO: 425260 - RNA, 64 nt, Human; identical to SEQ ID NO: 357254

SEQ ID NO: 425261 - RNA, 64 nt, Human; identical to SEQ ID NO: 357255

SEQ ID NO: 425262 - RNA, 64 nt, Human; identical to SEQ ID NO: 357256

SEQ ID NO: 425263 - RNA, 64 nt, Human; identical to SEQ ID NO: 357257

SEQ ID NO: 425264 - RNA, 61 nt, Human
agugguggcuggcgcgcuuucgcacuguggcagccacgagagucugugcacgucugugcug

SEQ ID NO: 425265 - RNA, 61 nt, Human
gcccugcaggugggacuggcucucccuccccagccacgaguaugccacagggggcuuucaa

SEQ ID NO: 425266 - RNA, 61 nt, Human
ugcuugagcgagggaggucgaggcugcagugagccacgaucacaccacugcacuccagccu

SEQ ID NO: 425267 - RNA, 61 nt, Human
ggccuggagggcccaaugucgcugcaaacacagccacgaagaacaugcagccacugggccc

SEQ ID NO: 425268 - RNA, 64 nt, Human; identical to SEQ ID NO: 357258

SEQ ID NO: 425269 - RNA, 64 nt, Human; identical to SEQ ID NO: 357259

SEQ ID NO: 425270 - RNA, 64 nt, Human; identical to SEQ ID NO: 357260

SEQ ID NO: 425271 - RNA, 64 nt, Human; identical to SEQ ID NO: 359258

SEQ ID NO: 425272 - RNA, 64 nt, Human; identical to SEQ ID NO: 359278

SEQ ID NO: 425273 - RNA, 64 nt, Human; identical to SEQ ID NO: 359279

SEQ ID NO: 425274 - RNA, 64 nt, Human; identical to SEQ ID NO: 359280

SEQ ID NO: 425275 - RNA, 64 nt, Human; identical to SEQ ID NO: 359281

SEQ ID NO: 425276 - RNA, 64 nt, Human; identical to SEQ ID NO: 359282

SEQ ID NO: 425277 - RNA, 64 nt, Human; identical to SEQ ID NO: 359283

SEQ ID NO: 425278 - RNA, 64 nt, Human; identical to SEQ ID NO: 359284

SEQ ID NO: 425279 - RNA, 64 nt, Human; identical to SEQ ID NO: 359285

SEQ ID NO: 425280 - RNA, 64 nt, Human; identical to SEQ ID NO: 359286

SEQ ID NO: 425281 - RNA, 64 nt, Human; identical to SEQ ID NO: 359287

SEQ ID NO: 425282 - RNA, 64 nt, Human; identical to SEQ ID NO: 359288

SEQ ID NO: 425283 - RNA, 61 nt, Human
uacaccagugugugccugcagcagccuccacagccacgauggguuuguuucuguuuucuug

SEQ ID NO: 425284 - RNA, 61 nt, Human
uuugcaccuccuauccccaggguccgccgagagccacgauuuuuuacagaaaaugagcaau

SEQ ID NO: 425285 - RNA, 61 nt, Human
guaaauaauuugcacugaaacguggauacagagccacgaguuuggauguuguaaauaaaac

SEQ ID NO: 425286 - RNA, 61 nt, Human
caaugauccccccucaggacaaaucuacuccagccacgaugagaagugggugagccagggu

SEQ ID NO: 425287 - RNA, 64 nt, Human; identical to SEQ ID NO: 359289

SEQ ID NO: 425288 - RNA, 64 nt, Human; identical to SEQ ID NO: 359290

SEQ ID NO: 425289 - RNA, 64 nt, Human; identical to SEQ ID NO: 359291

SEQ ID NO: 425290 - RNA, 64 nt, Human; identical to SEQ ID NO: 359292

SEQ ID NO: 425291 - RNA, 64 nt, Human; identical to SEQ ID NO: 359293

SEQ ID NO: 425292 - RNA, 64 nt, Human; identical to SEQ ID NO: 359297

SEQ ID NO: 425293 - RNA, 64 nt, Human; identical to SEQ ID NO: 359298

SEQ ID NO: 425294 - RNA, 64 nt, Human; identical to SEQ ID NO: 359299

SEQ ID NO: 425295 - RNA, 64 nt, Human; identical to SEQ ID NO: 359300

SEQ ID NO: 425296 - RNA, 64 nt, Human; identical to SEQ ID NO: 359301

SEQ ID NO: 425297 - RNA, 64 nt, Human; identical to SEQ ID NO: 359302

SEQ ID NO: 425298 - RNA, 64 nt, Human; identical to SEQ ID NO: 359303

SEQ ID NO: 425299 - RNA, 64 nt, Human; identical to SEQ ID NO: 359304

SEQ ID NO: 425300 - RNA, 64 nt, Human; identical to SEQ ID NO: 359305

SEQ ID NO: 425301 - RNA, 64 nt, Human; identical to SEQ ID NO: 359306

SEQ ID NO: 425302 - RNA, 61 nt, Human
agaguucuucgcuccacucacucaaaaucagagccacgaugacccaaaggauaagaaagaa

SEQ ID NO: 425303 - RNA, 61 nt, Human
agaagcagcagaaggagcaggagcaagugagagccacgagccaaggugggcacuugauguc

SEQ ID NO: 425304 - RNA, 61 nt, Human
agggggcugugcacauaccaguuacuuaagcagccacgagugucccccaugccuuggugcg

SEQ ID NO: 425305 - RNA, 61 nt, Human
ugaaagagcggagacgguaguuuaguauuugagccacgaguuuaugugcacaaguguuuug

SEQ ID NO: 425306 - RNA, 64 nt, Human; identical to SEQ ID NO: 359307

SEQ ID NO: 425307 - RNA, 64 nt, Human; identical to SEQ ID NO: 359308

SEQ ID NO: 425308 - RNA, 64 nt, Human; identical to SEQ ID NO: 359309

SEQ ID NO: 425309 - RNA, 64 nt, Human; identical to SEQ ID NO: 359310

SEQ ID NO: 425310 - RNA, 64 nt, Human; identical to SEQ ID NO: 359311

SEQ ID NO: 425311 - RNA, 64 nt, Human; identical to SEQ ID NO: 359312

SEQ ID NO: 425312 - RNA, 64 nt, Human; identical to SEQ ID NO: 359316

SEQ ID NO: 425313 - RNA, 64 nt, Human; identical to SEQ ID NO: 359317

SEQ ID NO: 425314 - RNA, 64 nt, Human; identical to SEQ ID NO: 359318

SEQ ID NO: 425315 - RNA, 64 nt, Human; identical to SEQ ID NO: 359319

SEQ ID NO: 425316 - RNA, 64 nt, Human; identical to SEQ ID NO: 359320

SEQ ID NO: 425317 - RNA, 64 nt, Human; identical to SEQ ID NO: 359321

SEQ ID NO: 425318 - RNA, 64 nt, Human; identical to SEQ ID NO: 359322

SEQ ID NO: 425319 - RNA, 64 nt, Human; identical to SEQ ID NO: 359323

SEQ ID NO: 425320 - RNA, 64 nt, Human; identical to SEQ ID NO: 359324

SEQ ID NO: 425321 - RNA, 64 nt, Human
uuuaaaaauuaaucauuuugcauuuuacauuuaaauaugcuaacaucacugucauagaauuccc

SEQ ID NO: 425322 - RNA, 64 nt, Human
ggaagaaggggaggaaggaaucccuaauucuuuuauaugcuauagauguguacaucuucuauau

SEQ ID NO: 425323 - RNA, 64 nt, Human
cuccauacucuguaucacuuguauugaccaccacauaugcuaauaccuaucuacugcugaguug

SEQ ID NO: 425324 - RNA, 64 nt, Human
uuugcuuuauuaaaagucuuccuucaccaccgagauaugcuaauuuaacuuacaaaugauuuua

SEQ ID NO: 425325 - RNA, 64 nt, Human; identical to SEQ ID NO: 359325

SEQ ID NO: 425326 - RNA, 64 nt, Human; identical to SEQ ID NO: 359326

SEQ ID NO: 425327 - RNA, 64 nt, Human; identical to SEQ ID NO: 359327

SEQ ID NO: 425328 - RNA, 64 nt, Human; identical to SEQ ID NO: 359328

SEQ ID NO: 425329 - RNA, 64 nt, Human; identical to SEQ ID NO: 359329

SEQ ID NO: 425330 - RNA, 64 nt, Human; identical to SEQ ID NO: 359330

SEQ ID NO: 425331 - RNA, 64 nt, Human; identical to SEQ ID NO: 359331

SEQ ID NO: 425332 - RNA, 64 nt, Human; identical to SEQ ID NO: 359335

SEQ ID NO: 425333 - RNA, 64 nt, Human; identical to SEQ ID NO: 359336

SEQ ID NO: 425334 - RNA, 64 nt, Human; identical to SEQ ID NO: 359337

SEQ ID NO: 425335 - RNA, 64 nt, Human; identical to SEQ ID NO: 359338

SEQ ID NO: 425336 - RNA, 64 nt, Human; identical to SEQ ID NO: 359339

SEQ ID NO: 425337 - RNA, 64 nt, Human; identical to SEQ ID NO: 359340

SEQ ID NO: 425338 - RNA, 64 nt, Human; identical to SEQ ID NO: 359341

SEQ ID NO: 425339 - RNA, 64 nt, Human; identical to SEQ ID NO: 359342

SEQ ID NO: 425340 - RNA, 61 nt, Human
ugcaauacgggagugacccagcuacugaaccagccacgaacagcccgccagaggccugaag

SEQ ID NO: 425341 - RNA, 61 nt, Human
agagacgcaguugucucugggcgcuugccagagccacgaaccccagaccuguuuguaucau

SEQ ID NO: 425342 - RNA, 61 nt, Human
aaccacagcauuaucacagcauuauugugacagccacgaacccauugcccacaaccccucc

SEQ ID NO: 425343 - RNA, 61 nt, Human
ccccgcgcgcucuagugcccccgcacgcgggagccacgaaccucggggugggggugggcag

SEQ ID NO: 425344 - RNA, 64 nt, Human; identical to SEQ ID NO: 359343

SEQ ID NO: 425345 - RNA, 64 nt, Human; identical to SEQ ID NO: 359344

SEQ ID NO: 425346 - RNA, 64 nt, Human; identical to SEQ ID NO: 359345

SEQ ID NO: 425347 - RNA, 64 nt, Human; identical to SEQ ID NO: 359346

SEQ ID NO: 425348 - RNA, 64 nt, Human; identical to SEQ ID NO: 359347

SEQ ID NO: 425349 - RNA, 64 nt, Human; identical to SEQ ID NO: 359348

SEQ ID NO: 425350 - RNA, 64 nt, Human; identical to SEQ ID NO: 359349

SEQ ID NO: 425351 - RNA, 64 nt, Human; identical to SEQ ID NO: 359350

SEQ ID NO: 425352 - RNA, 64 nt, Human; identical to SEQ ID NO: 359354

SEQ ID NO: 425353 - RNA, 64 nt, Human; identical to SEQ ID NO: 359355

SEQ ID NO: 425354 - RNA, 64 nt, Human; identical to SEQ ID NO: 359356

SEQ ID NO: 425355 - RNA, 64 nt, Human; identical to SEQ ID NO: 359357

SEQ ID NO: 425356 - RNA, 64 nt, Human; identical to SEQ ID NO: 359358

SEQ ID NO: 425357 - RNA, 64 nt, Human; identical to SEQ ID NO: 359359

SEQ ID NO: 425358 - RNA, 64 nt, Human; identical to SEQ ID NO: 359360

SEQ ID NO: 425359 - RNA, 61 nt, Human
auaccuccuccuguguuguauuacacauauuagccacgaguuuuugcagugaccagauaaa

SEQ ID NO: 425360 - RNA, 61 nt, Human
caggguggagcgcgccagccucagccagagcagccacgacagccacagugugugcacucga

SEQ ID NO: 425361 - RNA, 61 nt, Human
gagacaagagguagaggggagagguagagguagccacgagcugauaauuacagacaagaga

SEQ ID NO: 425362 - RNA, 61 nt, Human
cagguaggcccguuuucacguggagcaugggagccacgacccuucuuaagacauguaucac

SEQ ID NO: 425363 - RNA, 64 nt, Human; identical to SEQ ID NO: 359361

SEQ ID NO: 425364 - RNA, 64 nt, Human; identical to SEQ ID NO: 359362

SEQ ID NO: 425365 - RNA, 59 nt, Human; identical to SEQ ID NO: 359363

SEQ ID NO: 425366 - RNA, 64 nt, Human; identical to SEQ ID NO: 359364

SEQ ID NO: 425367 - RNA, 64 nt, Human; identical to SEQ ID NO: 359365

SEQ ID NO: 425368 - RNA, 64 nt, Human; identical to SEQ ID NO: 359366

SEQ ID NO: 425369 - RNA, 64 nt, Human; identical to SEQ ID NO: 359367

SEQ ID NO: 425370 - RNA, 64 nt, Human; identical to SEQ ID NO: 359368

SEQ ID NO: 425371 - RNA, 64 nt, Human; identical to SEQ ID NO: 359369

SEQ ID NO: 425372 - RNA, 64 nt, Human; identical to SEQ ID NO: 359373

SEQ ID NO: 425373 - RNA, 64 nt, Human; identical to SEQ ID NO: 359374

SEQ ID NO: 425374 - RNA, 64 nt, Human; identical to SEQ ID NO: 359375

SEQ ID NO: 425375 - RNA, 64 nt, Human; identical to SEQ ID NO: 359376

SEQ ID NO: 425376 - RNA, 64 nt, Human; identical to SEQ ID NO: 359377

SEQ ID NO: 425377 - RNA, 64 nt, Human; identical to SEQ ID NO: 359378

SEQ ID NO: 425378 - RNA, 61 nt, Human
acacaagacccuccgcccgaguaaauucuucagccacgaagggauggaugugcaucugccc

SEQ ID NO: 425379 - RNA, 61 nt, Human
ggggaggccagaggagagcugcugggccccgagccacgaacuugcugggugguucucuggg

SEQ ID NO: 425380 - RNA, 61 nt, Human
ucgguuauccaccccuaccucccagugucuaagccacgaauaaugguaugcuguugcugau

SEQ ID NO: 425381 - RNA, 61 nt, Human
gcaggaugaaucgcaggauggcgcguacugaagccacgauguucauccaggccaaagcagg

SEQ ID NO: 425382 - RNA, 64 nt, Human; identical to SEQ ID NO: 359379

SEQ ID NO: 425383 - RNA, 64 nt, Human; identical to SEQ ID NO: 359380

SEQ ID NO: 425384 - RNA, 64 nt, Human; identical to SEQ ID NO: 359381

SEQ ID NO: 425385 - RNA, 64 nt, Human; identical to SEQ ID NO: 359382

SEQ ID NO: 425386 - RNA, 64 nt, Human; identical to SEQ ID NO: 359383

SEQ ID NO: 425387 - RNA, 64 nt, Human; identical to SEQ ID NO: 359384

SEQ ID NO: 425388 - RNA, 64 nt, Human; identical to SEQ ID NO: 359385

SEQ ID NO: 425389 - RNA, 64 nt, Human; identical to SEQ ID NO: 359386

SEQ ID NO: 425390 - RNA, 64 nt, Human; identical to SEQ ID NO: 359387

SEQ ID NO: 425391 - RNA, 64 nt, Human; identical to SEQ ID NO: 359388

SEQ ID NO: 425392 - RNA, 64 nt, Human
gcggggagcaggcugcugcugcugacucugugcagcugcgcaccugugucccccaccuccaccc

SEQ ID NO: 425393 - RNA, 64 nt, Human
guucucuugagcuucgacucuucugugcgcuacugcugcgcacugcuuuuucuacaggcauuac

SEQ ID NO: 425394 - RNA, 64 nt, Human
uuucaaauucuacuaaugcuuugaaauuucaaaugcugcgcaaaauugcaauaaaaaugcuaua

SEQ ID NO: 425395 - RNA, 64 nt, Human
auucuuacuuuuacauuaaaaaaacuggcuacaggcugcgcagcugagguacuucagucaugug

SEQ ID NO: 425396 - RNA, 61 nt, Human
acguuuucauuaaaauuuuuuuuguaacuggagccacgacguaacaaauauggggaaaaaa

SEQ ID NO: 425397 - RNA, 61 nt, Human
uaaaugccugcacccauaauuuucuaguaauagccacgaccaauuuauuaacagucagggc

SEQ ID NO: 425398 - RNA, 61 nt, Human
cagggccuacagcuguguuguccaguacaggagccacgagccaaauguggcauuugaauuu

SEQ ID NO: 425399 - RNA, 64 nt, Human
gcacuaacagaguggccguccuaaccucgggccugcugcgcagacguccaucacguuagcuguc

SEQ ID NO: 425400 - RNA, 64 nt, Human
gagccugacccuguuccgcccacuggcaaucagggcugcgcacuucccuguccacgguccccag

SEQ ID NO: 425401 - RNA, 64 nt, Human
ccuguguggaggugaugguaccugccacaccacagcugcgcacacagcugcuugcucaggggcc

SEQ ID NO: 425402 - RNA, 64 nt, Human
ugcagauggcccuggagugggcaggcaggccagggcugcgcaucaguggacacauugcugccag

SEQ ID NO: 425403 - RNA, 64 nt, Human
cuguguaucuguguauuguacuaaauggacugaugcugcgcacaugagcugaaaaugaagagcc

SEQ ID NO: 425404 - RNA, 64 nt, Human
guuauccaaaaucacagaaaugaaccguuuugcagcugcgcagucuaaagggcaggccaguguc

SEQ ID NO: 425405 - RNA, 64 nt, Human
ucccggccccucuucugaggccgcaguggugguggcugcgcacacagcuccacagguugggagc

SEQ ID NO: 425406 - RNA, 64 nt, Human
ccagaccugcagagugggaagcuggaccagggcagcugcgcacuuaugagcaauacucugugga

SEQ ID NO: 425407 - RNA, 64 nt, Human
uaaguugguauaaauuguaaacgucucuggucaggcugcgcauuucguucuuuugcuuugucug

SEQ ID NO: 425408 - RNA, 64 nt, Human
uuuaaacaggcgcccuauuuucuuucuaguuguggcugcgcaaaaacauuuaucucccaaauaa

SEQ ID NO: 425409 - RNA, 64 nt, Human
caugggcagaacauguuuauugcacagagugggcgcugcgcacaggcguggcuguacacgugcu

SEQ ID NO: 425410 - RNA, 64 nt, Human
cuggcggcggggacccccagggccgcucggucacgcugcgcagcucucuguaccgggcgggggg

SEQ ID NO: 425411 - RNA, 64 nt, Human
uuuguugcagugccaggaaugcugcgcugcugcugcugcgcaccuggcccaugcugucccuggc

SEQ ID NO: 425412 - RNA, 64 nt, Human
agcaccaaaguugugggacauguugcuguagacugcugcgcaguccugggugcauucagucucu

SEQ ID NO: 425413 - RNA, 64 nt, Human
cugaugggcagcacaggaggcccguccucggggggcugcgcacaucacgcuccuugccgggcgu

SEQ ID NO: 425414 - RNA, 61 nt, Human
ucugugauggcagugugagcuggacugugucagccacgacucgagcacucauucugcuccc

SEQ ID NO: 425415 - RNA, 61 nt, Human
gcuaggaggaaauggagcaagaugaacaggcagccacgaggugggugggagcuggcagucu

SEQ ID NO: 425416 - RNA, 61 nt, Human
uccuuggagagacugagcacucagcaccuucagccacgauuucaggaucgcuuccuuguga

SEQ ID NO: 425417 - RNA, 64 nt, Human
cacucauuucugaccaccaggcuaugacguuccugcugcgcauuacagaaagcuuuuaacugug

SEQ ID NO: 425418 - RNA, 64 nt, Human
ucgaggccuccugccguggcuggggucauggucggcugcgcauguccagaagcauuuccuuccu

SEQ ID NO: 425419 - RNA, 64 nt, Human
aacggcuugaaaggaaaggagaagaugcugugucgcugcgcagcucgugugccaaggaaaugug

SEQ ID NO: 425420 - RNA, 64 nt, Human
gcgggcgcagcagcggaguucgcuccaggagaaggcugcgcacccacacccgccagagcccuac

SEQ ID NO: 425421 - RNA, 64 nt, Human
ucaaagacuuaagcccagugcacugaaagucacggcugcgcacuguguccucuuccaccacaga

SEQ ID NO: 425422 - RNA, 64 nt, Human
uuuuguuuguugcuuacaguuugacaacuuaaaugcugcgcaugaaaccucuaaguuggaaauu

SEQ ID NO: 425423 - RNA, 64 nt, Human
uuugauuagugagauguuaccacuuaccccuucugcugcgcagaauaauauuaagaauugcuau

SEQ ID NO: 425424 - RNA, 64 nt, Human
ggccagauuuccucacuaccugccaugcauacaugcugcgcauguuuucuucauucguauguua

SEQ ID NO: 425425 - RNA, 64 nt, Human
accccaaccucagaggcagcuucaagugccuuuugcugcgcaccaaugcccagcaggggaggug

SEQ ID NO: 425426 - RNA, 64 nt, Human
ccgcuguggaccucgggaccuggacgccguccuggcugcgcaggaggggccgcuggcauggacu

SEQ ID NO: 425427 - RNA, 64 nt, Human
uacguccugcccagcucugugcaccugaaccccagcugcgcacugaaaucagcugggguggggg

SEQ ID NO: 425428 - RNA, 64 nt, Human
cauuagaugggcuuucccaauaggccaaaaaaaugcugcgcauacccagagcugguuguugugc

SEQ ID NO: 425429 - RNA, 64 nt, Human
cuccccuggucuuguuaccugugugugugcuggugcugcgcaugaggacugucugccuuugagg

SEQ ID NO: 425430 - RNA, 64 nt, Human
cgcuguuucccugccugcaaaagcagccccaagagcugcgcauuggcuucccucagcaaucugu

SEQ ID NO: 425431 - RNA, 64 nt, Human
ccacaguggguccccuuuucacccuuggcgcuaggcugcgcacucccuuuccccgcagcuuuaa

SEQ ID NO: 425432 - RNA, 61 nt, Human
aacauuaaaacaguaacugacauccaguuaaagccacgaucgucagcaauucuccuuuuuu

SEQ ID NO: 425433 - RNA, 61 nt, Human
cacuguccgucuuuaaacagaaagucaaaggagccacgaagcaagcggccguccgggcguc

SEQ ID NO: 425434 - RNA, 61 nt, Human
cagcuggaggugaaacugugcuuguauccccagccacgaagagcuggaccagcuucaagua

SEQ ID NO: 425435 - RNA, 64 nt, Human
aggcagguaaccccagauucaugcacuguagggugcugcgcagcaucccuagucucuacccagu

SEQ ID NO: 425436 - RNA, 64 nt, Human
gggaagggaugggaagauugcccaguccccgauggcugcgcacacaggaggcggcggagcacaa

SEQ ID NO: 425437 - RNA, 64 nt, Human
cucacccccaggcgcacgucuggccccgccucuggcugcgcacucccgaccgcgacguccacgc

SEQ ID NO: 425438 - RNA, 64 nt, Human
auguccaaccgccaacugcagugacccgcugauagcugcgcaacagccuggguucuugagcaga

SEQ ID NO: 425439 - RNA, 64 nt, Human
aucucuccacugugcuuucagaagugcccuuccugcugcgcaguucucccauccugggacggcg

SEQ ID NO: 425440 - RNA, 64 nt, Human
ccauccgccaagcugggggcaucggcaaggccaagcugcgcagcaugaaggagcgaaagcugga

SEQ ID NO: 425441 - RNA, 64 nt, Human
agggcagccucggggguguggagaaggagcugacgcugcgcagccaagcccuggagcucaacaa

SEQ ID NO: 425442 - RNA, 64 nt, Human
gugaccagcagccgagcccuuggcccuagcccuugcugcgcagaacagcuugcuggcagcuggc

SEQ ID NO: 425443 - RNA, 64 nt, Human
guucuuucuucaggcuugugucuuuaguugcguggcugcgcaggccugccauaugauuuaagcc

SEQ ID NO: 425444 - RNA, 64 nt, Human
agguggagggcaucaggcagggugagcuccagcugcugcgcacggcggccuaccuccacaccac

SEQ ID NO: 425445 - RNA, 64 nt, Human
ucgugcagcagcacacacacccuaccuuccacgcgcugcgcagccucgaccagcagauguaccu

SEQ ID NO: 425446 - RNA, 64 nt, Human
gaauguauccgccucgguucccaccacugccuucgcugcgcacgccccucguguuucagggcug

SEQ ID NO: 425447 - RNA, 64 nt, Human
gcagaacagaggcaacgguggcaggcagguggaggcugcgcacagcuucucccggucauggcac

SEQ ID NO: 425448 - RNA, 64 nt, Human
acuaggcaggaugaauuugacugggucgguaggagcugcgcaaugccccucuguucuccccugc

SEQ ID NO: 425449 - RNA, 64 nt, Human
cggaagcagaaaggacaguuuggcugcugugucugcugcgcacgcccccuccccggacagcacc

SEQ ID NO: 425450 - RNA, 61 nt, Human
aucaauaaacaugacacucugaagugaaaguagccacgagaauugugcuacuuauacuggu

SEQ ID NO: 425451 - RNA, 61 nt, Human
gcccacaggccgcccugcgggugaacaaagcagccacgaggugcaacaagguccucuguca

SEQ ID NO: 425452 - RNA, 61 nt, Human
auuuucacuggagacgggguuucacuguguuagccacgauggucuccaucuccugaccucg

SEQ ID NO: 425453 - RNA, 64 nt, Human
cucccuccagcacuggcaccgagaggcaggccuggcugcgcagggcgcgggggggaggcugggg

SEQ ID NO: 425454 - RNA, 64 nt, Human
ggucaggaggugccguccaggugugcggcgagccgcugcgcacagaugucaggauuuccguuug

SEQ ID NO: 425455 - RNA, 63 nt, Human
gcauggugacccagcucugaccgguggcuucucgcugcgcagccuccagggcccgaggugauc

SEQ ID NO: 425456 - RNA, 64 nt, Human
ggcccagggccgucaaggaaagggcaguggacgugcugcgcauguucgggagcgaacucccccg

SEQ ID NO: 425457 - RNA, 64 nt, Human
aggcuucaggcaggcaggcccaggaugggcguuugcugcgcacagacacucagcaggggccucg

SEQ ID NO: 425458 - RNA, 64 nt, Human
ugaaccucuucaagagcaucuggaacaacagauggcugcgcaccaucucugugauccuguuccu

SEQ ID NO: 425459 - RNA, 64 nt, Human
aagcccaggcaccagugucucggggggccucacugcugcgcaagggguggggccgaggaugcaa

SEQ ID NO: 425460 - RNA, 64 nt, Human
guaagcucaugguucaguacucugggggcgcagggcugcgcaggacccuuggaaauguugcaag

SEQ ID NO: 425461 - RNA, 64 nt, Human
ucugaaaugugaaaagccugcacucuuccugugggcugcgcagugggcucggggguuggggggu

SEQ ID NO: 425462 - RNA, 64 nt, Human
accacggggagacccucaucccugccccuguguggcugcgcaaguauucugcccgccucccacc

SEQ ID NO: 425463 - RNA, 64 nt, Human
ucuuccuccugugagccuaagugcagccgugcuagcugcgcaccguggcuaaggaugacgucug

SEQ ID NO: 425464 - RNA, 64 nt, Human
aaaaugacggcuaccacacucaugggucacuggggcugcgcagggcucuuugagguggguggcu

SEQ ID NO: 425465 - RNA, 64 nt, Human
cgccccgccauccuggguacccgcggguccgcaggcugcgcaccucuuucccucagccagguca

SEQ ID NO: 425466 - RNA, 64 nt, Human
aguucaugaagugccgcuggagagccagagaccagcugcgcaggagccggaggaacgggcaggc

SEQ ID NO: 425467 - RNA, 64 nt, Human
uaccacaacucaggccggcuggcccgggccaugggcugcgcaaaucaccagcccccaacccagg

SEQ ID NO: 425468 - RNA, 61 nt, Human
agcaagggaccugcucaucauauuccaacccagccacgacugccauguaagguugugcagg

SEQ ID NO: 425469 - RNA, 61 nt, Human
cugcgucucggaugucugucuuuugccucgaagccacgauggaucgcugguuuccucugca

SEQ ID NO: 425470 - RNA, 61 nt, Human
ucagaguagaggacauggcugucuucuaaaaagccacgacaugaaaaugacaaucccuuuc

SEQ ID NO: 425471 - RNA, 64 nt, Human
gacagccuuucuugcccucugaccucaaaggcuagcugcgcauagcucuugacacucucggcca

SEQ ID NO: 425472 - RNA, 64 nt, Human
accgcggcuaccagccccaccuggaggacuuucugcugcgcaucaacuucaacaacuacuacca

SEQ ID NO: 425473 - RNA, 64 nt, Human
ugaugaugcgcugugacccugcaguagcgcaaaggcugcgcagcguuaaugcgcauugcgugcg

SEQ ID NO: 425474 - RNA, 64 nt, Human
gcuuucuccacuguacaggugguuaucaaccuuggcugcgcaucagaaucguuuguaaagcuuu

SEQ ID NO: 425475 - RNA, 64 nt, Human
ccggcuucgcugcugagcgcggccucuccccgccgcugcgcacugcaguuauuuguagacaaag

SEQ ID NO: 425476 - RNA, 61 nt, Human
gccgggggccgguggccagagcgagggcaccagccacgaaggacggaggcgggcggggccc

SEQ ID NO: 425477 - RNA, 61 nt, Human
ccacgggccacgggaagaaccaagcggugccagccacgagacgucaccaagaaaacaugca

SEQ ID NO: 425478 - RNA, 61 nt, Human
ugaggugcaauguuuaauuguuaaaaauaguagccacgacuuuaucaggcagccccaaacu

SEQ ID NO: 425479 - RNA, 61 nt, Human
caagggugcuggugcggauggacacuaaugcagccacgauuggagaauacuuugcuucaua

SEQ ID NO: 425480 - RNA, 61 nt, Human
acccacagccuaagcugagugugaccccagaagccacgaugugcucuguauccagaacaca

SEQ ID NO: 425481 - RNA, 61 nt, Human
gagcuuggugcgguaggugcuggccucaaacagccacgaggugguagcucugagcccuccu

SEQ ID NO: 425482 - RNA, 61 nt, Human
uuuuuuggugcuaauaugacauaugacaauaagccacgaggugcaguaaguacccgacuaa

SEQ ID NO: 425483 - RNA, 61 nt, Human
cugcugggcuacaaaccaggagcaaccgugcagccacgaacacgcaugccucagccagccc

SEQ ID NO: 425484 - RNA, 61 nt, Human
cuguggugccaucuccccaugguucauguggagccacgaacauccuuucccugcaguccau

SEQ ID NO: 425485 - RNA, 61 nt, Human
ccucgguaaguauguuuagaaauagaacauuagccacgagccauaggcauuucaggccaaa

SEQ ID NO: 425486 - RNA, 64 nt, Human
ugcugccugaaaccccagaccgagaaguugaugcucggcccacgccguuagcucgugugcgugu

SEQ ID NO: 425487 - RNA, 64 nt, Human
aaauagugaauugauaaucuacuuguuaauauauucggcccauauuuuguguguuuggacaagu

SEQ ID NO: 425488 - RNA, 64 nt, Human
cagggcuugguggugguagcauuugggucugagaucggcccagcucugacugaaggggcuuggc

SEQ ID NO: 425489 - RNA, 64 nt, Human
acaaacucugccuucggucauuucacucaacagcucggcccagcucugaaacuugggaagguga

SEQ ID NO: 425490 - RNA, 64 nt, Human
gugagcccgcccaccgcggaacguucggucagucucggcccacaccccaaaggcucuuuucaga

SEQ ID NO: 425491 - RNA, 64 nt, Human
ugccgggccgggagggaagagggaggcugcacgcucggcccacgggagggcaggcuccggggcc

SEQ ID NO: 425492 - RNA, 64 nt, Human
aagcucaaggacaaaauccagcuaacccagucccucggcccaggccuccuuucgugcuuugugc

SEQ ID NO: 425493 - RNA, 64 nt, Human
cuuuccuucccaccacagagguggacgagugcucucggcccaaccgcgggggcugugagcagcg

SEQ ID NO: 425494 - RNA, 64 nt, Human
gcccugcagcccccagcccuccccacccagguuuucggcccagugaagaggccacuggccaggc

SEQ ID NO: 425495 - RNA, 64 nt, Human
caucaaaggagggauuauguggcugcuaaagccaucggcccacagcccuguucacaucuuggug

SEQ ID NO: 425496 - RNA, 64 nt, Human
ucguugugucccccacaacuguccucuugcuagcucggcccagcuuugucccuggagcccgaug

SEQ ID NO: 425497 - RNA, 64 nt, Human
uggaagacuucuuccuagccuggaagcccugaccucggcccaucugcagaaucucccaguuccu

SEQ ID NO: 425498 - RNA, 64 nt, Human
acagaggcaccugcugcacacacaagcaucucacucggcccacggagggggccaggcuuccuuu

SEQ ID NO: 425499 - RNA, 64 nt, Human
ggguccccucuccagcaagccuccaccagcaagcucggcccagagcuucccuuccggcuggcuc

SEQ ID NO: 425500 - RNA, 64 nt, Human
gccugccuggacugcgcggcgccgugagggggauucggcccagcucgucccggccuccaccaag

SEQ ID NO: 425501 - RNA, 64 nt, Human
uccuaaugcauuagauuaucaaaaaguauaaauucgcugugagugagugguguuggcaguguuu

SEQ ID NO: 425502 - RNA, 64 nt, Human
ucuggcccaggagcaagguggaauguuucccugacgcugugaucugcagcaggcuucaaaugaa

SEQ ID NO: 425503 - RNA, 64 nt, Human
ccucgucaucagagguaaaggcaugagaaaaucgcgcugugaaacguuuuuuaccuuuuauuau

SEQ ID NO: 425504 - RNA, 64 nt, Human
uugagacuccuguugggacacaguuggucugcagucggcccaggacggucuacucagcacaacu

SEQ ID NO: 425505 - RNA, 64 nt, Human
cuuugauuuccuuaauagcccauuucuguuaaccucuuaucacuaagaaagaaaggaaagaagg

SEQ ID NO: 425506 - RNA, 64 nt, Human
uuaauuccauugucauauaaggagucaaauuguuucuuaucauuuguucauugaagaacagaga

SEQ ID NO: 425507 - RNA, 64 nt, Human
cuagaagaaggaagaaaguguguaaauaaucauuucuuaucaucacuuuuugucuuuucuuguu

SEQ ID NO: 425508 - RNA, 64 nt, Human
gaggccccuuuucaauuugagcagcugcuagauaucuuaucagagcucagauuccagauuucac

SEQ ID NO: 425509 - RNA, 64 nt, Human
aagauugaaauccacagauaauucaugacccucaucuuaucacuuuacuccaucuuuuuauccu

SEQ ID NO: 425510 - RNA, 64 nt, Human
auguguaauuauacuagaaguuuuguaaucuguaucuuaucauuggaauaaaaugacauucaau

SEQ ID NO: 425511 - RNA, 64 nt, Human
aggaagaaaaagucccauaaaggaacuuuuguagucuuaucaacauauaaucuaaucccuuagc

SEQ ID NO: 425512 - RNA, 64 nt, Human
cugaaagccacauguguuuauucauugggcuuguucuuaucagcaaauagguuuucugguuuua

SEQ ID NO: 425513 - RNA, 64 nt, Human
ugguauuuuaaacagguacauuuuuacaguguuuucuuaucaauuugcuauauugcacagaauc

SEQ ID NO: 425514 - RNA, 64 nt, Human
ugaagauuugaguuguauauaccugcacugauauucuuaucaaaaauuucuacauuagcuuuaa

SEQ ID NO: 425515 - RNA, 64 nt, Human
gccuaguugaggauguucccaaaguuuuguccaaucuuaucauuaguagauuuuauaagccaca

SEQ ID NO: 425516 - RNA, 64 nt, Human
gccacaggcaggucacagaaaggcagguuucauuucuuaucacauaagagagaugagaaagcuu

SEQ ID NO: 425517 - RNA, 64 nt, Human
gcgagauuuaacuuucugagcaucugcaguacagucuuaucaacugguuguauauuuuuauauu

SEQ ID NO: 425518 - RNA, 64 nt, Human
aaauuuuauauauuccuaauaugcauguacuuuuucuuaucacauauauuuaaacuuacagaug

SEQ ID NO: 425519 - RNA, 64 nt, Human
uuaugugaacuuuuaaagcuaaauauuaaacuuaauaugcuauguaaauauauacauauauaca

SEQ ID NO: 425520 - RNA, 64 nt, Human
auucauacucuguaacacuuguauuaauugcugcauaugcuaauacuuuucuaaugcugacuuu

SEQ ID NO: 425521 - RNA, 64 nt, Human
ccagugucuuuacauuucauuuguacuucaaaaaauaugcuauuguuuagacuuuccauccuuu

SEQ ID NO: 425522 - RNA, 64 nt, Human
acggccacauccugcuaaaacugggauggaggaaucggcccagccccaagagcaacugugauuu

SEQ ID NO: 425523 - RNA, 64 nt, Human
gcagcccccucaaguucuccccuuuugagggguuucggcccagccccagccugccggagcccac

SEQ ID NO: 425524 - RNA, 64 nt, Human
cagaaaaggcuucuuacacagcagccuuacuucaucggcccacagacaccaccgcaguuucuuc

SEQ ID NO: 425525 - RNA, 64 nt, Human
cccagcgccgccgcugacgccgccgacgccgcccucggcccagaccucggugaucacugaggga

SEQ ID NO: 425526 - RNA, 64 nt, Human
uccucccucuggccccuucucccauggggacaucucggcccagcaccccuaucccauuuccaga

SEQ ID NO: 425527 - RNA, 64 nt, Human
cucgccccacuucucccagccuggugcuguccucucggcccaccaucggccagguccagcgcuu

SEQ ID NO: 425528 - RNA, 64 nt, Human
uccugagcagcucuugguuuuggcgucuuuugggucggcccaugugguuugagcacccagccag

SEQ ID NO: 425529 - RNA, 64 nt, Human
uucacaugcucaauugauauuuuuugcugcuuccucggcccagggagaaagcaugucaggacag

SEQ ID NO: 425530 - RNA, 64 nt, Human
acucagcguugccaggugugcugccaucugcuguucggcccaaccucagagugaaggcagggug

SEQ ID NO: 425531 - RNA, 64 nt, Human
uccuguguguugugugcaggaucuguuugcccacucggcccaggaggucagcagucuguucuug

SEQ ID NO: 425532 - RNA, 64 nt, Human
gggucucccucuccugccuacucacgauaaauaaucggcccacagcucccaccccacccccuuc

SEQ ID NO: 425533 - RNA, 64 nt, Human
ucuacuauggagaucaacaguuacugugacugagucggcccauucuguuuagaaauauauuuua

SEQ ID NO: 425534 - RNA, 64 nt, Human
cuggaagagucuuccgcacccucuccaggugcacucggcccaguccugccgccguguccaggcg

SEQ ID NO: 425535 - RNA, 64 nt, Human
uccucggaggggccguggugagucuccaguauguucggcccagcgcucuucgcacccuucugga

SEQ ID NO: 425536 - RNA, 64 nt, Human
aaagugcugggauuacgggcgugagccaccgugcucggcccaaggcaggagaaucucuugaagc

SEQ ID NO: 425537 - RNA, 64 nt, Human
uagcgcagaaagucgugguucaggcaguaugggccgcugugacaaaacaccuaagacuggguag

SEQ ID NO: 425538 - RNA, 64 nt, Human
ugaccccggguacgagcuggccccagacaagcgccgcugugagggugagugcccccagacugcc

SEQ ID NO: 425539 - RNA, 64 nt, Human
cagaaaaggccuugucugaagaggacuugaaaaacgcugugagugugcaccacgcauuggcauc

SEQ ID NO: 425540 - RNA, 64 nt, Human
aagcucagcaccaccggccaugaccagagguugcucggcccagggucugggagcugggcuaaca

SEQ ID NO: 425541 - RNA, 64 nt, Human
cgugaccauggcccacugcagcccugaccccccuucggcccaugcuauuccuccugucccaacc

SEQ ID NO: 425542 - RNA, 64 nt, Human
cauggggcaguuuccuuugguggaccccaggacuucggcccacuccggggccuccccucccugc

SEQ ID NO: 425543 - RNA, 64 nt, Human
aaggucaccauguaccacacaccaaagaagggggucggcccaggggugggcgacacaggcagcu

SEQ ID NO: 425544 - RNA, 64 nt, Human
cccuucugcauuuccucccggagucacugguuucucggcccaaaccaugcuccccagcaguggc

SEQ ID NO: 425545 - RNA, 64 nt, Human
caagaacaacccugacggcugcccucccucuuauucggcccaaggacuugaagcccggcaucuu

SEQ ID NO: 425546 - RNA, 64 nt, Human
ucugucacccaggcuggaguacaauggcgugaucucggcccacugcaaccucugccuccugggu

SEQ ID NO: 425547 - RNA, 64 nt, Human
auuuacccggcaugcacucuucagauaagccaugucggcccaaaucugaguaacuuuauauaaa

SEQ ID NO: 425548 - RNA, 64 nt, Human
cgucagccacgggugggccuugugucgccuuguaucggcccagguagguuguuggccucuuacu

SEQ ID NO: 425549 - RNA, 64 nt, Human
uacuuaauguggaaagacacgcccaugucccccuucggcccacucugggggccuggaaaugcug

SEQ ID NO: 425550 - RNA, 64 nt, Human
ggaccccuagugucccuggucuaucucuccagccucggcccacacgcaagggagucgggggacg

SEQ ID NO: 425551 - RNA, 64 nt, Human
uccccaaaccaacugcagagaagaaagacgagccucggcccaggacgcgauuucuaacgaaaug

SEQ ID NO: 425552 - RNA, 64 nt, Human
cucgcccgcuccugacuuccucuacuugcgcugcucggcccagccuggggggcccgcccagccc

SEQ ID NO: 425553 - RNA, 55 nt, Human
cagaaccggcugcagacugacacccucggcccacgacugucuucccaaguuuuac

SEQ ID NO: 425554 - RNA, 64 nt, Human
cggcagcaccucugagccggagggcaccagggacucggcccagggccgucaaggaaagggcagu

SEQ ID NO: 425555 - RNA, 64 nt, Human
uuuacaggguggcccaaauagaacaagaugcacucgcugugauuuuaagacaagcuguauaaac

SEQ ID NO: 425556 - RNA, 64 nt, Human
acacuccuaccccaaccagacuaaaugccuauaacgcugugaguguccaguccuuguccaggaa

SEQ ID NO: 425557 - RNA, 64 nt, Human
agggguggcugcugcuucccuugugcacuugggucgcugugauugugaauaaaagugauuucgu

SEQ ID NO: 425558 - RNA, 64 nt, Human
agagaagagacuagcaaaaagcugcagagaggauucggcccaaacucagaacuguuccccugag

SEQ ID NO: 425559 - RNA, 64 nt, Human
ccggguccagugggcacugggcggggugguguguucggcccagaggccccuggccugagcaggu

SEQ ID NO: 425560 - RNA, 64 nt, Human
cucucagccuccugcccucagcugcgcgaagcgcucggcccagcucacugaagcugcccugccu

SEQ ID NO: 425561 - RNA, 64 nt, Human
ugucuugguuggaaauaccaucagccuuccuugcucggcccaggucuguuucaggcaucugagu

SEQ ID NO: 425562 - RNA, 64 nt, Human
uaugaaaacuaaguucucuaucuuaggaguaaugucggcccacaagggugcccaccucuuguuu

SEQ ID NO: 425563 - RNA, 64 nt, Human
acugcugcccucucggguaacucacccuaaggccucggcccaccucuggcuaugguaaccacac

SEQ ID NO: 425564 - RNA, 64 nt, Human
uuuccagaagcccacuauugccuuuguagugcuuucggcccaguucuggccucagccucaaagu

SEQ ID NO: 425565 - RNA, 64 nt, Human
cuccuagggcauccccugccugaacgaagacuuccgccgcgaagcccgauagaucgggggaaaa

SEQ ID NO: 425566 - RNA, 64 nt, Human
guucgcacagaagggcgaccuugcagggacucgccgccgcgaccucaguguggcuuuuacagga

SEQ ID NO: 425567 - RNA, 64 nt, Human
cggacccgggcagugaaccagagaucacgcgccgcgccgcgaggcuugggggagguguugaaau

SEQ ID NO: 425568 - RNA, 64 nt, Human
ccacguggccgggagacgcacagggcgccagcgucgccgcgaggccucugggguggguucgcca

SEQ ID NO: 425569 - RNA, 64 nt, Human
ggagcccccuuccuguguucucccuuuguuccagcgccgcgauggugagaucacuguuccaagc

SEQ ID NO: 425570 - RNA, 64 nt, Human
ucucacuccugccagggaccagcuuaaugcccugcgccgcgagaagcagaagcucguggagaag

SEQ ID NO: 425571 - RNA, 64 nt, Human
gaagagccugcgccuccgccuccgccgccugcaccgccgcgaagccgaagccgaagccgaagca

SEQ ID NO: 425572 - RNA, 59 nt, Human
aagucuaccggggcaacugagccgggccucgccgcgacccuuccggcccaucuaucggg

SEQ ID NO: 425573 - RNA, 64 nt, Human
caggacuagaugaucucuguuccuuuuggcucuaauaugcuacaacuguaggccaauuaucacu

SEQ ID NO: 425574 - RNA, 64 nt, Human
aggaggaaggcauacuuggcaaaccacauguauaauaugcuacuuggaaauguaucacagccau

SEQ ID NO: 425575 - RNA, 64 nt, Human
aguugcuggcaauguagagcaggcauggaauuuuauaugcuagugagucauaaugauauguuag

SEQ ID NO: 425576 - RNA, 64 nt, Human
aaguagauguaauuuacuaaagaaugauacacccauaugcuauauacagcuuaacucacagaac

SEQ ID NO: 425577 - RNA, 64 nt, Human
cguguuacuaacucuaguauguuucugugucaaucgcugugaaauaaagucugaaaacuuuaaa

SEQ ID NO: 425578 - RNA, 64 nt, Human
guagcuaaaggagaaaaaggggguuucguuuacacgcugugagaucaccgcaaaccuaccuuac

SEQ ID NO: 425579 - RNA, 64 nt, Human
acauaaccaauacuuucgaguccucccugugucccgcugugauucuauuuccucccacccacuc

SEQ ID NO: 425580 - RNA, 64 nt, Human
uaacauuaauagaaggcauggcuccugcugcaaccgcugugaaugcugcugagaaccucccucu

SEQ ID NO: 425581 - RNA, 64 nt, Human
gugucaccaguuccagccaaaggcuccucacaggcgcugugaauuuuuguacaagucuuguaau

SEQ ID NO: 425582 - RNA, 64 nt, Human
cccaauuaagcccaccauugguuagcacacucagcgcugugagucgugaagacacgggagaaaa

SEQ ID NO: 425583 - RNA, 64 nt, Human
uagggagugaugggcccggcauugccugaggccccgcugugacaguuuccccggugugagcccg

SEQ ID NO: 425584 - RNA, 64 nt, Human
acugggccuuucugauuuugccuccaaaggagagcgcugugauaccuacauguguaaggaaggg

SEQ ID NO: 425585 - RNA, 64 nt, Human
uacuguacuauaguaggacuuuauguaucucauacgcugugauguggauggggccccagaugga

SEQ ID NO: 425586 - RNA, 64 nt, Human
cuuagcaacccucauauaccucccugcaccguuacgcugugauggcaacuggggauagaaaaaa

SEQ ID NO: 425587 - RNA, 64 nt, Human
cguggauguauggggaaucuaagagagcugccaucgcugugaugcugggaguucuaacaaaaca

SEQ ID NO: 425588 - RNA, 64 nt, Human
ugggacauguaguagcccaggucggcuugucacucgcugugagauggggagauuuugucuuuug

SEQ ID NO: 425589 - RNA, 64 nt, Human
auugagcuuacuuacuuggacgcaacauugcaagcgcugugaauggaaacagaauacacuuaac

SEQ ID NO: 425590 - RNA, 64 nt, Human
uggagauguccccagaagcugcugugccucacagcgcugugagccagacccuccuugggcagac

SEQ ID NO: 425591 - RNA, 64 nt, Human
ccaagaccugagggcagcaaaccgcuggugcugucgcugugagcaagagccggcuggcacauuu

SEQ ID NO: 425592 - RNA, 64 nt, Human
cccuccccaagucgcuucuguggcaccccgcauucgcugugagguuuguuuguccgguugauuu

SEQ ID NO: 425593 - RNA, 64 nt, Human
aggagcugagcaccgagaaccaucugugagcugccgcugugaugaaggagccugcucugaggaa

SEQ ID NO: 425594 - RNA, 58 nt, Human
cuguccuacacuugugcuaggcaggcaccgcugugacugggcuccgggccuuuccacu

SEQ ID NO: 425595 - RNA, 64 nt, Human
cagcccuggcucugcaaugggcacugggaugagccgcugugagccccugguccugagggucccc

SEQ ID NO: 425596 - RNA, 64 nt, Human
gauggguguugcuguuuuucuugucguuugugaacgcugugaugcugugugcccaagugggcag

SEQ ID NO: 425597 - RNA, 64 nt, Human
ccagaaaacccgcgccccacauaccugcaucuuccgcugugaccuccggagcccugccugcccc

SEQ ID NO: 425598 - RNA, 64 nt, Human
ggaggaguuaggucuauuugaaaugccaggggcucgcugugaggaauaggugaaaaaaaacuuu

SEQ ID NO: 425599 - RNA, 64 nt, Human
ugcuuggauguuaguucuccacccucgagguguacgcugugaaaaguuugggagcacugcuuua

SEQ ID NO: 425600 - RNA, 60 nt, Human
aacagugggggaaccuaugaccccagaggacgcugugaucuccaccuugaagccaggcag

SEQ ID NO: 425601 - RNA, 64 nt, Human
uuucuggcagaaggagcuguccucaacucagggccgcugugagcaaagcugaccccagccccca

SEQ ID NO: 425602 - RNA, 64 nt, Human
gugcgguugggggagauagcgaagggucuggccucgcugugaucugauuugggauuaaagguuu

SEQ ID NO: 425603 - RNA, 64 nt, Human
ccggguccugguggagcaccaggcaggugguccucgcugugacacugaggugcugagccaguga

SEQ ID NO: 425604 - RNA, 64 nt, Human
aguggaucauguucccagucggcuauggcguucccgcugugacuguggccauuucugcagccuc

SEQ ID NO: 425605 - RNA, 64 nt, Human
cccugccuccuuccgggacaagccuggccacccucgcugugaugacgagcuggcugauuggccc

SEQ ID NO: 425606 - RNA, 64 nt, Human
cagccuccaggcacccccaggauucccagagagacgcugugauuggcaggaggcaggauauccc

SEQ ID NO: 425607 - RNA, 64 nt, Human
ugccccaugccacaguugaaggagggagagaacacgcugugaaaacacagaagcucccagagaa

SEQ ID NO: 425608 - RNA, 64 nt, Human
gugugagcuguaggcagggacggggagggacugucgcugugaucagaguggguuaagcugacca

SEQ ID NO: 425609 - RNA, 64 nt, Human
uuccaaguuuucuaggaacccaucuccgucugggcgcugugaguggggugggcacguccgggca

SEQ ID NO: 425610 - RNA, 64 nt, Human
guuuggauugcagcauucugcucuucugaugaugcgcugugacccugcaguagcgcaaaggcug

SEQ ID NO: 425611 - RNA, 64 nt, Human
gaaaggaaaucagcaacucuucaaucccaaccugcgcugugauuuuagccuccugagauuggag

SEQ ID NO: 425612 - RNA, 64 nt, Human; identical to SEQ ID NO: 28716

SEQ ID NO: 425613 - RNA, 64 nt, Human; identical to SEQ ID NO: 28717

SEQ ID NO: 425614 - RNA, 64 nt, Human; identical to SEQ ID NO: 28718

SEQ ID NO: 425615 - RNA, 64 nt, Human; identical to SEQ ID NO: 28719

SEQ ID NO: 425616 - RNA, 64 nt, Human; identical to SEQ ID NO: 28720

SEQ ID NO: 425617 - RNA, 64 nt, Human; identical to SEQ ID NO: 28721

SEQ ID NO: 425618 - RNA, 64 nt, Human; identical to SEQ ID NO: 28722

SEQ ID NO: 425619 - RNA, 64 nt, Human; identical to SEQ ID NO: 28723

SEQ ID NO: 425620 - RNA, 52 nt, Human; identical to SEQ ID NO: 28724

SEQ ID NO: 425621 - RNA, 58 nt, Human; identical to SEQ ID NO: 28725

SEQ ID NO: 425622 - RNA, 64 nt, Human; identical to SEQ ID NO: 28726

SEQ ID NO: 425623 - RNA, 56 nt, Human; identical to SEQ ID NO: 28727

SEQ ID NO: 425624 - RNA, 64 nt, Human; identical to SEQ ID NO: 28728

SEQ ID NO: 425625 - RNA, 64 nt, Human; identical to SEQ ID NO: 28729

SEQ ID NO: 425626 - RNA, 64 nt, Human; identical to SEQ ID NO: 28730

SEQ ID NO: 425627 - RNA, 64 nt, Human; identical to SEQ ID NO: 28731

SEQ ID NO: 425628 - RNA, 64 nt, Human; identical to SEQ ID NO: 28732

SEQ ID NO: 425629 - RNA, 64 nt, Human; identical to SEQ ID NO: 28733

SEQ ID NO: 425630 - RNA, 64 nt, Human; identical to SEQ ID NO: 28734

SEQ ID NO: 425631 - RNA, 64 nt, Human; identical to SEQ ID NO: 28735

SEQ ID NO: 425632 - RNA, 64 nt, Human; identical to SEQ ID NO: 28736

SEQ ID NO: 425633 - RNA, 64 nt, Human; identical to SEQ ID NO: 28737

SEQ ID NO: 425634 - RNA, 64 nt, Human; identical to SEQ ID NO: 28738

SEQ ID NO: 425635 - RNA, 64 nt, Human; identical to SEQ ID NO: 28739

SEQ ID NO: 425636 - RNA, 64 nt, Human; identical to SEQ ID NO: 28740

SEQ ID NO: 425637 - RNA, 64 nt, Human; identical to SEQ ID NO: 28741

SEQ ID NO: 425638 - RNA, 64 nt, Human; identical to SEQ ID NO: 28742

SEQ ID NO: 425639 - RNA, 64 nt, Human; identical to SEQ ID NO: 28743

SEQ ID NO: 425640 - RNA, 64 nt, Human; identical to SEQ ID NO: 28744

SEQ ID NO: 425641 - RNA, 64 nt, Human; identical to SEQ ID NO: 28745

SEQ ID NO: 425642 - RNA, 64 nt, Human; identical to SEQ ID NO: 28746

SEQ ID NO: 425643 - RNA, 64 nt, Human; identical to SEQ ID NO: 28747

SEQ ID NO: 425644 - RNA, 64 nt, Human; identical to SEQ ID NO: 28748

SEQ ID NO: 425645 - RNA, 64 nt, Human; identical to SEQ ID NO: 28749

SEQ ID NO: 425646 - RNA, 64 nt, Human; identical to SEQ ID NO: 28750

SEQ ID NO: 425647 - RNA, 64 nt, Human; identical to SEQ ID NO: 28751

SEQ ID NO: 425648 - RNA, 64 nt, Human; identical to SEQ ID NO: 28752

SEQ ID NO: 425649 - RNA, 64 nt, Human; identical to SEQ ID NO: 28753

SEQ ID NO: 425650 - RNA, 63 nt, Human; identical to SEQ ID NO: 28754

SEQ ID NO: 425651 - RNA, 64 nt, Human; identical to SEQ ID NO: 28755

SEQ ID NO: 425652 - RNA, 64 nt, Human; identical to SEQ ID NO: 28756

SEQ ID NO: 425653 - RNA, 64 nt, Human; identical to SEQ ID NO: 28757

SEQ ID NO: 425654 - RNA, 64 nt, Human; identical to SEQ ID NO: 28758

SEQ ID NO: 425655 - RNA, 64 nt, Human; identical to SEQ ID NO: 28759

SEQ ID NO: 425656 - RNA, 64 nt, Human; identical to SEQ ID NO: 28760

SEQ ID NO: 425657 - RNA, 64 nt, Human; identical to SEQ ID NO: 28761

SEQ ID NO: 425658 - RNA, 64 nt, Human; identical to SEQ ID NO: 28762

SEQ ID NO: 425659 - RNA, 64 nt, Human; identical to SEQ ID NO: 28763

SEQ ID NO: 425660 - RNA, 64 nt, Human; identical to SEQ ID NO: 28764

SEQ ID NO: 425661 - RNA, 64 nt, Human; identical to SEQ ID NO: 28765

SEQ ID NO: 425662 - RNA, 64 nt, Human; identical to SEQ ID NO: 28766

SEQ ID NO: 425663 - RNA, 64 nt, Human; identical to SEQ ID NO: 28767

SEQ ID NO: 425664 - RNA, 63 nt, Human; identical to SEQ ID NO: 28768

SEQ ID NO: 425665 - RNA, 52 nt, Human; identical to SEQ ID NO: 28769

SEQ ID NO: 425666 - RNA, 64 nt, Human; identical to SEQ ID NO: 28770

SEQ ID NO: 425667 - RNA, 64 nt, Human; identical to SEQ ID NO: 28771

SEQ ID NO: 425668 - RNA, 64 nt, Human; identical to SEQ ID NO: 28772

SEQ ID NO: 425669 - RNA, 64 nt, Human; identical to SEQ ID NO: 28773

SEQ ID NO: 425670 - RNA, 64 nt, Human; identical to SEQ ID NO: 28774

SEQ ID NO: 425671 - RNA, 64 nt, Human; identical to SEQ ID NO: 28775

SEQ ID NO: 425672 - RNA, 64 nt, Human; identical to SEQ ID NO: 28776

SEQ ID NO: 425673 - RNA, 64 nt, Human; identical to SEQ ID NO: 28777

SEQ ID NO: 425674 - RNA, 64 nt, Human; identical to SEQ ID NO: 28778

SEQ ID NO: 425675 - RNA, 64 nt, Human; identical to SEQ ID NO: 28779

SEQ ID NO: 425676 - RNA, 64 nt, Human; identical to SEQ ID NO: 28780

SEQ ID NO: 425677 - RNA, 64 nt, Human; identical to SEQ ID NO: 28781

SEQ ID NO: 425678 - RNA, 64 nt, Human; identical to SEQ ID NO: 28782

SEQ ID NO: 425679 - RNA, 64 nt, Human; identical to SEQ ID NO: 28783

SEQ ID NO: 425680 - RNA, 64 nt, Human; identical to SEQ ID NO: 28784

SEQ ID NO: 425681 - RNA, 64 nt, Human; identical to SEQ ID NO: 28785

SEQ ID NO: 425682 - RNA, 64 nt, Human; identical to SEQ ID NO: 28786

SEQ ID NO: 425683 - RNA, 64 nt, Human; identical to SEQ ID NO: 28787

SEQ ID NO: 425684 - RNA, 64 nt, Human; identical to SEQ ID NO: 28788

SEQ ID NO: 425685 - RNA, 50 nt, Human; identical to SEQ ID NO: 28789

SEQ ID NO: 425686 - RNA, 64 nt, Human; identical to SEQ ID NO: 28790

SEQ ID NO: 425687 - RNA, 64 nt, Human; identical to SEQ ID NO: 28791

SEQ ID NO: 425688 - RNA, 64 nt, Human; identical to SEQ ID NO: 28792

SEQ ID NO: 425689 - RNA, 64 nt, Human; identical to SEQ ID NO: 28793

SEQ ID NO: 425690 - RNA, 64 nt, Human; identical to SEQ ID NO: 28794

SEQ ID NO: 425691 - RNA, 64 nt, Human; identical to SEQ ID NO: 28795

SEQ ID NO: 425692 - RNA, 64 nt, Human; identical to SEQ ID NO: 28796

SEQ ID NO: 425693 - RNA, 64 nt, Human; identical to SEQ ID NO: 28797

SEQ ID NO: 425694 - RNA, 64 nt, Human; identical to SEQ ID NO: 28798

SEQ ID NO: 425695 - RNA, 57 nt, Human; identical to SEQ ID NO: 28799

SEQ ID NO: 425696 - RNA, 64 nt, Human; identical to SEQ ID NO: 28800

SEQ ID NO: 425697 - RNA, 64 nt, Human; identical to SEQ ID NO: 28801

SEQ ID NO: 425698 - RNA, 64 nt, Human; identical to SEQ ID NO: 28802

SEQ ID NO: 425699 - RNA, 64 nt, Human; identical to SEQ ID NO: 28803

SEQ ID NO: 425700 - RNA, 64 nt, Human; identical to SEQ ID NO: 28804

SEQ ID NO: 425701 - RNA, 64 nt, Human; identical to SEQ ID NO: 28805

SEQ ID NO: 425702 - RNA, 64 nt, Human; identical to SEQ ID NO: 28806

SEQ ID NO: 425703 - RNA, 64 nt, Human; identical to SEQ ID NO: 28807

SEQ ID NO: 425704 - RNA, 64 nt, Human; identical to SEQ ID NO: 28808

SEQ ID NO: 425705 - RNA, 64 nt, Human; identical to SEQ ID NO: 28809

SEQ ID NO: 425706 - RNA, 64 nt, Human; identical to SEQ ID NO: 28810

SEQ ID NO: 425707 - RNA, 64 nt, Human; identical to SEQ ID NO: 28811

SEQ ID NO: 425708 - RNA, 64 nt, Human; identical to SEQ ID NO: 28812

SEQ ID NO: 425709 - RNA, 64 nt, Human; identical to SEQ ID NO: 28813

SEQ ID NO: 425710 - RNA, 64 nt, Human; identical to SEQ ID NO: 28814

SEQ ID NO: 425711 - RNA, 64 nt, Human; identical to SEQ ID NO: 28815

SEQ ID NO: 425712 - RNA, 64 nt, Human; identical to SEQ ID NO: 28816

SEQ ID NO: 425713 - RNA, 64 nt, Human; identical to SEQ ID NO: 28817

SEQ ID NO: 425714 - RNA, 64 nt, Human; identical to SEQ ID NO: 28818

SEQ ID NO: 425715 - RNA, 64 nt, Human; identical to SEQ ID NO: 28819

SEQ ID NO: 425716 - RNA, 64 nt, Human; identical to SEQ ID NO: 28820

SEQ ID NO: 425717 - RNA, 64 nt, Human; identical to SEQ ID NO: 28821

SEQ ID NO: 425718 - RNA, 64 nt, Human; identical to SEQ ID NO: 28822

SEQ ID NO: 425719 - RNA, 64 nt, Human; identical to SEQ ID NO: 28823

SEQ ID NO: 425720 - RNA, 64 nt, Human; identical to SEQ ID NO: 28824

SEQ ID NO: 425721 - RNA, 64 nt, Human; identical to SEQ ID NO: 28825

SEQ ID NO: 425722 - RNA, 64 nt, Human; identical to SEQ ID NO: 28826

SEQ ID NO: 425723 - RNA, 64 nt, Human; identical to SEQ ID NO: 28827

SEQ ID NO: 425724 - RNA, 64 nt, Human; identical to SEQ ID NO: 28828

SEQ ID NO: 425725 - RNA, 64 nt, Human; identical to SEQ ID NO: 28829

SEQ ID NO: 425726 - RNA, 64 nt, Human; identical to SEQ ID NO: 28830

SEQ ID NO: 425727 - RNA, 64 nt, Human; identical to SEQ ID NO: 28831

SEQ ID NO: 425728 - RNA, 64 nt, Human; identical to SEQ ID NO: 28832

SEQ ID NO: 425729 - RNA, 64 nt, Human; identical to SEQ ID NO: 28833

SEQ ID NO: 425730 - RNA, 64 nt, Human; identical to SEQ ID NO: 28834

SEQ ID NO: 425731 - RNA, 64 nt, Human; identical to SEQ ID NO: 28835

SEQ ID NO: 425732 - RNA, 64 nt, Human; identical to SEQ ID NO: 28836

SEQ ID NO: 425733 - RNA, 64 nt, Human; identical to SEQ ID NO: 28837

SEQ ID NO: 425734 - RNA, 64 nt, Human; identical to SEQ ID NO: 28838

SEQ ID NO: 425735 - RNA, 64 nt, Human; identical to SEQ ID NO: 28839

SEQ ID NO: 425736 - RNA, 64 nt, Human; identical to SEQ ID NO: 28840

SEQ ID NO: 425737 - RNA, 64 nt, Human; identical to SEQ ID NO: 28841

SEQ ID NO: 425738 - RNA, 64 nt, Human; identical to SEQ ID NO: 28842

SEQ ID NO: 425739 - RNA, 64 nt, Human; identical to SEQ ID NO: 28843

SEQ ID NO: 425740 - RNA, 64 nt, Human; identical to SEQ ID NO: 28844

SEQ ID NO: 425741 - RNA, 64 nt, Human
cggcucacggggcugggcuccgaucuuccgugucucuuaucaguggcguuucucacgucugcgu

SEQ ID NO: 425742 - RNA, 64 nt, Human
aacacaaagaaaugacacauauuugaggugauggauaugcuaauuacccugguucgguuauuac

SEQ ID NO: 425743 - RNA, 64 nt, Human
uccuagggggaagaaauccuaguaugccaaaaauauaugcuaagcauaauuaaacuccaugcgg

SEQ ID NO: 425744 - RNA, 64 nt, Human
acuauaauacuaaggccugaagucuagcuuggauauaugcuacaauaauaucuguuacucacau

SEQ ID NO: 425745 - RNA, 64 nt, Human
agaggauguuucuccucugcugggagcuguaguuucuuaucaaaauagauauuguuccaccauc

SEQ ID NO: 425746 - RNA, 64 nt, Human
uccaaagucuaccugaagugcuagacuuucagacucuuaucacugaaauccuuaagguugagga

SEQ ID NO: 425747 - RNA, 64 nt, Human
cccccaggcagcuauaagaauauuuuaguuuuuuucuuaucaaguuucucaaccuuuauuuuua

SEQ ID NO: 425748 - RNA, 64 nt, Human
aaaacauauuucaauaguauaugaguaugagauuucuuaucaauuaugagugaaauauucuauc

SEQ ID NO: 425749 - RNA, 64 nt, Human
cuaaauuaaagagaaaauugagaguaaaugacugucuuaucacucuuauuugacauuucguagg

SEQ ID NO: 425750 - RNA, 64 nt, Human
gccaaaacucuugguaauuuuugaagauagacugucuuaucaccaaggaaauuuauacaaauua

SEQ ID NO: 425751 - RNA, 64 nt, Human
aagaaacuugcagaugauaugugcugccuuugcuucuuaucauucauggcagauuguuugugcu

SEQ ID NO: 425752 - RNA, 64 nt, Human
cguucugugggugaccuuuuccgggauuucuuguucuuaucaagcaagaauuaagcacaugcua

SEQ ID NO: 425753 - RNA, 64 nt, Human
acuaaaauaauaaaaacuacucuuauauuggacuucuuaucaaugaauuaguaaguauagagac

SEQ ID NO: 425754 - RNA, 64 nt, Human
aguggacauaggcuacauguuugcacauucacauucuuaucacguguagaauacuucacaaaau

SEQ ID NO: 425755 - RNA, 64 nt, Human
cacuccacagcagaaagggguagcagguaccccuucuuaucagcgguaaaaaugcauuuacaac

SEQ ID NO: 425756 - RNA, 64 nt, Human
auuagagaucugaaaacucauuagagauguugagucuuaucaaauaaaaagcaugagacaucau

SEQ ID NO: 425757 - RNA, 64 nt, Human
ugcuuuuggucuccuacccaaauacucacaagggucuuaucagacgcccgucuuaaaguccagc

SEQ ID NO: 425758 - RNA, 64 nt, Human
ggucaaggacuaacuccuaaaaaaaaaaagcaacucuuaucaaggauuaauuuaauuuuuaaaa

SEQ ID NO: 425759 - RNA, 64 nt, Human
uuuacauuuauuauuauuugagacagagucucacucuuaucacccaggcaggagugcaguggug

SEQ ID NO: 425760 - RNA, 64 nt, Human
ggugcucccucugucauccucaggaaccaacaauucgucggaggcaucauggaaagacugggac

SEQ ID NO: 425761 - RNA, 64 nt, Human
gcuggaggacgacccucagggugccaggaagaucucgucggagccuguuccuggcgagaguaag

SEQ ID NO: 425762 - RNA, 64 nt, Human
uuccucucucaguacguugcccucugugcuaucaucuuaucaucaauuauuagacaaaucccac

SEQ ID NO: 425763 - RNA, 64 nt, Human
uaacugcucacuaguugcuuuuuagcaucucuggucuuaucagccaugcuaaaucacuuuaauu

SEQ ID NO: 425764 - RNA, 64 nt, Human
uuacaggugugagccaccgcacccggcuggccaaucuuaucagaagugagcuaccaaaacuucc

SEQ ID NO: 425765 - RNA, 64 nt, Human
auauacuagugaaacauauuuaaugauuuaaauuucuuaucaaauuucuuuuguagcaaucuag

SEQ ID NO: 425766 - RNA, 64 nt, Human
acuuauuuuuaaaaugaaaucuauauauugacuuucuuaucaaucaucuuacugugcaaucaaa

SEQ ID NO: 425767 - RNA, 64 nt, Human
accaagaagcccaagauaucagcccaaaagucaaucuuaucauauuucaaaugauuuucaaauu

SEQ ID NO: 425768 - RNA, 64 nt, Human
ggacugauuacaguggcuggagcuugggcacuugucuuaucacuggucacugagucugaaaguc

SEQ ID NO: 425769 - RNA, 64 nt, Human
ccagcauucagcauguguuccuuucugcagugguucuuaucaccaccucccucccagccccagc

SEQ ID NO: 425770 - RNA, 64 nt, Human
auuagacaacuuaagcaacguugcaucggcugcuucuuaucauugcuuuuccaucuagaucagu

SEQ ID NO: 425771 - RNA, 64 nt, Human
uaguaaagaaaaugacagaucguggucagcagacucuuaucaaauugguauguaaaagauuucu

SEQ ID NO: 425772 - RNA, 64 nt, Human
uacaacuuaguaucuuauugccuaaaaaaaaauuucuuaucauuguuucaaaaaagcaaaauca

SEQ ID NO: 425773 - RNA, 64 nt, Human
gcucaacugcauuucaguuguauuauaguccaguucuuaucaacauuaaaaccuauagcaauca

SEQ ID NO: 425774 - RNA, 64 nt, Human
cagaauaagcuaacucuaaauuuaaugcucuacaucuuaucagucauaauuauauauacugugg

SEQ ID NO: 425775 - RNA, 64 nt, Human
uucuugaaauauuuuuguuuauagaauugaagguucuuaucagaugggauacuggggacuauaa

SEQ ID NO: 425776 - RNA, 64 nt, Human
ggacuaauugauaugcaccaguuuacaaagacagucuuaucauccgagaauacaccaucuuuuu

SEQ ID NO: 425777 - RNA, 64 nt, Human
ugguggccauuaauuuaacuuuaggcuuuugggcauaugcuagucugagcuuccgaaaagauac

SEQ ID NO: 425778 - RNA, 64 nt, Human
uuaaaguauauuuaacucauaauuuuugcagaaaauaugcuauauauuaggcaagaauaaaagc

SEQ ID NO: 425779 - RNA, 64 nt, Human
aaauagaguauuuucauguguuagauguguguaaauaugcuaucuucuuuaagaaauuauauua

SEQ ID NO: 425780 - RNA, 63 nt, Human
aagaucaaguuuguacauaacacuagaggcauuucuuaucaaaaggauuggauaauaaaaaua

SEQ ID NO: 425781 - RNA, 64 nt, Human
agagcuccccuuagugaucucaguucaaauauuaucuuaucaguaagacaaacccuucucccau

SEQ ID NO: 425782 - RNA, 64 nt, Human
uuuuuaggccaaucacauuuacaugaccguaauuucuuaucaauucuacuuuuauuuuugcuua

SEQ ID NO: 425783 - RNA, 64 nt, Human
gucuuguaagccacuuguuugguuaugauuugugucuuaucagggaaaaggugcccagcugcca

SEQ ID NO: 425784 - RNA, 64 nt, Human
cugugacucugggcauuaucgacacguucacccaucuuaucaaggacucugguuucucauucuu

SEQ ID NO: 425785 - RNA, 64 nt, Human
uccugaacaauauuuucucacucauauuccucuaucuuaucacuuagcuaaagacagccuaaau

SEQ ID NO: 425786 - RNA, 64 nt, Human
aaagcauuuucuuucuccuaaggaaaagugaauuucuuaucagaauaucuggcuggcccuguaa

SEQ ID NO: 425787 - RNA, 64 nt, Human
gcaugugggagucacacacgugggucacacugagucuuaucagccacguucuccuacugagguc

SEQ ID NO: 425788 - RNA, 64 nt, Human
gguugugacuauggaaacuccaguuaagacaggaucuuaucagagguggacaacgugaagauuu

SEQ ID NO: 425789 - RNA, 64 nt, Human
agugaccugguuauuuucacauguuacuucauuuucuuaucaaauuaaauguuugugacauagu

SEQ ID NO: 425790 - RNA, 51 nt, Human
agauggugguagaugugugacucuuaucagagaguaccacccaacacuuuu

SEQ ID NO: 425791 - RNA, 64 nt, Human
acugaugucccauuucauucagagcccuuauugcucuuaucaaaacagaagaaggcuacauuug

SEQ ID NO: 425792 - RNA, 64 nt, Human
gagcaaauagaaauaaaagacaaaaggacaucacucuuaucaaaugugugagcaguagaagaga

SEQ ID NO: 425793 - RNA, 64 nt, Human
caaugcuucaaguagaaagugccucaauuaaaugucuuaucaaguucugucaauacuugcccaa

SEQ ID NO: 425794 - RNA, 64 nt, Human
auuuguucaugguuauucuacauuucuagaaaguucuuaucagcaagauggucccauaagcaaa

SEQ ID NO: 425795 - RNA, 64 nt, Human
accaaguaaauacuuuucauuucugagccaaggaauaugcuaugauuacguuuuuuccuagagu

SEQ ID NO: 425796 - RNA, 64 nt, Human
ccccucuucuccaacucuuguuuucuaguccaggauaugcuaaaggacgaagauuuucuauugu

SEQ ID NO: 425797 - RNA, 64 nt, Human
agaagacagcagcaagugugcuggccucucugacauaugcuaacccccaaauacucugaauuug

SEQ ID NO: 425798 - RNA, 64 nt, Human
acuugucucucuuuugcuaagaagggauuuuugaauaugcuaucuaccuggaaucucucucuca

SEQ ID NO: 425799 - RNA, 64 nt, Human
gugucuuuuauuuucucugcuuuguguuauuuuuucuuaucaaacaauuagauguuauguuuca

SEQ ID NO: 425800 - RNA, 64 nt, Human
gacucuaggcuuccagucuguguuugguuuuuauucuuaucauuauuaugauuguuauuauauu

SEQ ID NO: 425801 - RNA, 64 nt, Human
gaaagaagcucuuacaguuuuuacucaugauaaaucuuaucaccuuucaaaaauugauuguggu

SEQ ID NO: 425802 - RNA, 64 nt, Human
guaauggaauucaccuuugcaucuuuugugucuuucuuaucaugauuuggcaaaaugcaucacc

SEQ ID NO: 425803 - RNA, 64 nt, Human
ggcaucguuaacuacauagugcuguagcaacaagucuuaucauggcaucucuuucuauguuugg

SEQ ID NO: 425804 - RNA, 64 nt, Human
uuugcacuguuuuuauauacuuguauucauauccucuuaucaccucagacucagacacaaggcc

SEQ ID NO: 425805 - RNA, 64 nt, Human
gucgaugugaaccuugcaaccagcucuacuggauucuuaucagaaauccugcauaaaaagucag

SEQ ID NO: 425806 - RNA, 64 nt, Human
ccaaauggacagcccagaagcugaugaugagaauucuuaucacucaccuuuauauuaaaaugua

SEQ ID NO: 425807 - RNA, 64 nt, Human
uuuaaagagauuuuuugcauauucucugccuuguucuuaucaacuugaaauguuggcauuuucu

SEQ ID NO: 425808 - RNA, 64 nt, Human
aaacauuuaugagcuuacauuccuucuucccauaucuuaucagcauaucauauccauuucacuc

SEQ ID NO: 425809 - RNA, 64 nt, Human
uguuuaguauuaugucuuauuggugcauuuacucucuuaucauuauguaauguccuucuuuauc

SEQ ID NO: 425810 - RNA, 64 nt, Human
ggauuuaaucuuaucuaccccguggauucaaucuucuuaucagaagguucuuuuaugucaaaaa

SEQ ID NO: 425811 - RNA, 64 nt, Human
uaacuuagugugucauuuugaaacuugaauucauucuuaucaauuuaagggaucuuaaaaggau

SEQ ID NO: 425812 - RNA, 64 nt, Human
ccuuucccuguacuuaccuuucaacaugcuucaaucuuaucaacgcuacauuuuguauuuuuca

SEQ ID NO: 425813 - RNA, 64 nt, Human
aaacaaguugacauuugucauuuguggcuuucuuucuuaucaucauggcacagauucuguacau

SEQ ID NO: 425814 - RNA, 64 nt, Human
uuuuuuuaaaaauuagguuauuaaaauuaaaacaauaugcuagaagacauuuuggcagaaauaa

SEQ ID NO: 425815 - RNA, 64 nt, Human
accugugagugggcuuuguggugaauuacuguaaauaugcuacccucacuuuucuuggcaguua

SEQ ID NO: 425816 - RNA, 64 nt, Human
ucuaaaaugauauauuuagaugcaauaauuaaccauaugcuagaaugcccaccucuaagccaau

SEQ ID NO: 425817 - RNA, 64 nt, Human
uccuuuuaucgguucauuuaaccuggugacuggcucuuaucacuucuaguuuacaggugaggga

SEQ ID NO: 425818 - RNA, 64 nt, Human
uuagaauuaaacauuguaccauacaauuucauuaucuuaucagaaugaaaccaauucacaggga

SEQ ID NO: 425819 - RNA, 64 nt, Human
auguauaauauaucucagacugaguuacugccugucuuaucaggauggauaaaacacuacaguc

SEQ ID NO: 425820 - RNA, 64 nt, Human
ccugucuuaucaggauggauaaaacacuacagucucuuaucaggaaauagagaugauguggaua

SEQ ID NO: 425821 - RNA, 64 nt, Human
aaguuugugucaagauuuaagcugauuuucucauucuuaucaaagucucaccuggggguaggga

SEQ ID NO: 425822 - RNA, 64 nt, Human
gguacugcauggaaauaggucauuaacuugaaacucuuaucaaaauauauuuuaccaguuucca

SEQ ID NO: 425823 - RNA, 64 nt, Human
ugcuagcauuaagccaagaaauagugugaggugaucuuaucacacugauguguucaacuguuua

SEQ ID NO: 425824 - RNA, 64 nt, Human
ucuuuagacaacaguugcuuucauaaagacuaguucuuaucaaccuugaaugacuacagauuau

SEQ ID NO: 425825 - RNA, 64 nt, Human
ccuguaauuucugagaaaagaguacagcauuuacucuuaucaucuagaaauguaauaugcuucc

SEQ ID NO: 425826 - RNA, 64 nt, Human
cacugcuauguacuugucaaaaugguuuccacauucuuaucacaucugagccuuaccagguaga

SEQ ID NO: 425827 - RNA, 64 nt, Human
uaaugauguuaguaacuuuuagugguucugugccucuuaucaaguguuacagaggacauaccac

SEQ ID NO: 425828 - RNA, 64 nt, Human
cuuuucugaccucauauaacacauuauguagguuucuuaucacuuucucuuugcauaauaaugu

SEQ ID NO: 425829 - RNA, 64 nt, Human
ccaucaucauccguuuuaccuuaguuagcauuuuucuuaucauuuuucuuuuuuucuuucccuc

SEQ ID NO: 425830 - RNA, 64 nt, Human
aagguccuacauguaaugcauaugugaugcaucaucuuaucauauauuccuuccuauacauugu

SEQ ID NO: 425831 - RNA, 64 nt, Human
gucuguaccuuguaucuuagcuugaguaugauugucuuaucaaaguaguguucuaacuuuaaug

SEQ ID NO: 425832 - RNA, 64 nt, Human
ugugguucauggcguguugacccagcagagcacucccucccacuaacuuguucugcauguguag

SEQ ID NO: 425833 - RNA, 64 nt, Human
aaccucuuugcucaacagaacauauguugcaagacccucccaugggggcacuugaguuuuggca

SEQ ID NO: 425834 - RNA, 64 nt, Human
gggugggacagggcuucuccugcgggggcgaggccccucccaguaagggcguggcucugggugg

SEQ ID NO: 425835 - RNA, 64 nt, Human
acugccuccuucucaggaguagccccugaugaucucuuaucaaggcgguuauaugcauauuacu

SEQ ID NO: 425836 - RNA, 64 nt, Human
cuaauuuuuaaucauuuaucuuucagaacuuguuucuuaucaagaaguuagcagguaugauaug

SEQ ID NO: 425837 - RNA, 64 nt, Human
ugcucaaucauacuacacuguugccagcauuagaucuuaucacauuuaagucauugcuaauuuu

SEQ ID NO: 425838 - RNA, 64 nt, Human
aggacucugaggcuuuauucccccacuaugcauaucuuaucauuuuauuauuauacacacaucc

SEQ ID NO: 425839 - RNA, 64 nt, Human
uuuuucuuaauuccacuaaagugccuauugaaacucuuaucauuuaaagugguguacaguacac

SEQ ID NO: 425840 - RNA, 64 nt, Human
gaguugguguuuccacucuaaaauuaccaccucuucuuaucaaaauuugcaacuuucuuccugu

SEQ ID NO: 425841 - RNA, 64 nt, Human
aaaaggauguuuucuuuuuucacacaguaaaaauucuuaucauucaaggauauuggaaccacag

SEQ ID NO: 425842 - RNA, 64 nt, Human
uaacucaaguauggaauacuuuuuuuaaagaaauucuuaucauggguguuguaauaaugaagac

SEQ ID NO: 425843 - RNA, 64 nt, Human
ucucuaacaaacaggcuacuugcuaguuagaaauucuuaucaauuuggcaagcuacuuaucaac

SEQ ID NO: 425844 - RNA, 64 nt, Human
augguuguuuugugucccauggucaagcauucuaucuuaucagggccuacaguaacaugccaaa

SEQ ID NO: 425845 - RNA, 64 nt, Human
guuaugacuuguuaaaucuauucccaugccagaaucuuaucaauacauaagaaauuuaggaaga

SEQ ID NO: 425846 - RNA, 64 nt, Human
gggacuuugccuauuaagucuaccaaauuaaaagucuuaucauucagcguguuuugagaguuaa

SEQ ID NO: 425847 - RNA, 64 nt, Human
uuuccauugcuuacaaaaugauuuuccuuuacauucuuaucaugaacacuauuuuaagcaucaa

SEQ ID NO: 425848 - RNA, 64 nt, Human
auuucuucacuuuguucuuuuucugaagucaaacucuuaucaaaugcccuaaaauuauuaccac

SEQ ID NO: 425849 - RNA, 64 nt, Human
cugccaaaauagcuucaggaagaaauuuuuacaaucuuaucaccugagucauuucaugaaauuu

SEQ ID NO: 425850 - RNA, 64 nt, Human
uggagggggacuggacccagugcccucugcagaccccucccagccgcagcaccaagggcuugcu

SEQ ID NO: 425851 - RNA, 64 nt, Human
uccuggccuccccuccugucucaccccccugucacccucccaguggcauccaggguggagaaag

SEQ ID NO: 425852 - RNA, 64 nt, Human
agcagguggaugcucaagauuacgugcaaggaaucccucccaucugguacuaaaauuucagugu

SEQ ID NO: 425853 - RNA, 64 nt, Human
uugagucugagaaaaccuuugguagaagcuccugucuuaucaggccccaaaaaaccuguucugc

SEQ ID NO: 425854 - RNA, 64 nt, Human
uucucuggaauuuccugauaugaccaagaaagcuucuuaucaaaagaagcacaauugccuucgg

SEQ ID NO: 425855 - RNA, 64 nt, Human
agacaaucuccagccacccgccccacgcuugacuucuuaucacuuuggcuguggugccgccuag

SEQ ID NO: 425856 - RNA, 64 nt, Human
ugcuuucuccacuaccccaagguugcagacucucucuuaucaccccuuccuccuuccucuucuc

SEQ ID NO: 425857 - RNA, 64 nt, Human
acauuaaauagaaauaaugucauuugaaugaaaaucuuaucacauuaaauucacugugaaggca

SEQ ID NO: 425858 - RNA, 64 nt, Human
auguauuuguauuaaacuuuuuaaauaauugcuuucuuaucaaaccaauugauuuuauaauaaa

SEQ ID NO: 425859 - RNA, 64 nt, Human
aacaugauuuuggaaagauauaauuucuugaaaaucuuaucagaagaugcauaguuaauuuuuu

SEQ ID NO: 425860 - RNA, 59 nt, Human
uuuccuuaaggaaggacugaucugugugcucuuaucaccaaucaguucagaccugguug

SEQ ID NO: 425861 - RNA, 64 nt, Human
guuaaugauuuauuuuuugacuaaaugugcaauuucuuaucacuagauaacuuucaguaucagu

SEQ ID NO: 425862 - RNA, 64 nt, Human
acugaaccuuuucuguauauagccaugguuucauucuuaucaguccaacccuuugccugaaaca

SEQ ID NO: 425863 - RNA, 64 nt, Human
cuucaugccaaccacagccuguuucugcugaguuucuuaucagcccucaagcuaugcuaggaaa

SEQ ID NO: 425864 - RNA, 64 nt, Human
ugaugcuuucucuccuaaucccugggcacuaggcucuuaucagugugcuugggccagcucuccu

SEQ ID NO: 425865 - RNA, 64 nt, Human
ugccaucgucauagugcacagugacuuuucuguuucuuaucacuaaagacugaggugagguuau

SEQ ID NO: 425866 - RNA, 64 nt, Human
aagaagaaucaacagggacacuuuuuaaaaacacucuuaucagccugggcaacacagugagacu

SEQ ID NO: 425867 - RNA, 64 nt, Human
uaccucugugcugaagcugacagacaguauuaacucuuaucaaggccaucuuuuagaccugauu

SEQ ID NO: 425868 - RNA, 64 nt, Human
cucugcuucuggaaugaaccauguauccuggagacccucccaauggaugagaguggaaagacau

SEQ ID NO: 425869 - RNA, 64 nt, Human
cucacagacccucuuuggcccccugcccuccucucccucccagauggacccuuccaugggagga

SEQ ID NO: 425870 - RNA, 64 nt, Human
gaaugggagacgugccuccccuuccccacuccuucccucccaagccccucccucuggccuucug

SEQ ID NO: 425871 - RNA, 64 nt, Human
auuccaaucacugugcuuaauuuaaauagcauuaucuuaucauuuaucagccuuuuauguauuu

SEQ ID NO: 425872 - RNA, 64 nt, Human
guggccacagugauggguuuaaguaccuugguagggcuggcaccaguggaaacacauacugaag

SEQ ID NO: 425873 - RNA, 64 nt, Human
cuggacaucuuaaaagcugauagacaagccaaauggcuggcagaugauguggauuucaaagagc

SEQ ID NO: 425874 - RNA, 64 nt, Human
ccgaacucccaccucuccauggccugccuagccaggcuggcacugccacucacacucggcccca

SEQ ID NO: 425875 - RNA, 64 nt, Human
uacuuccagggcuacgcgcgcuccgcgcagcucaggcuggcaccgcuguacgcgagcgcgcgcg

SEQ ID NO: 425876 - RNA, 64 nt, Human
ugugcccccagauguuucugaggagccagacuagggcuggcauugcuguagagugacggcugcu

SEQ ID NO: 425877 - RNA, 64 nt, Human
gauuuucaugguaacaagcucugguauaagcuaaggcuggcaaguucagauacuaaaauauuau

SEQ ID NO: 425878 - RNA, 64 nt, Human
cccauguacuuguugggaggaggaggaaagggaaggcuggcagguaggucggcacuuggacaau

SEQ ID NO: 425879 - RNA, 64 nt, Human
acacacacugcagaacccagaacagaaggccacaggcuggcacuacugcauucuccuuaugugu

SEQ ID NO: 425880 - RNA, 64 nt, Human
guguucaggagucccaccuugcauuucagaccugggcuggcagucuguuggacuucucuucagg

SEQ ID NO: 425881 - RNA, 64 nt, Human
cugcggaugcuucuuaacaaccgcccggggcuguggcuggcagcuuggugggccccagggccuu

SEQ ID NO: 425882 - RNA, 64 nt, Human
gggccuggagucguggcccugcauuucuggguagggcuggcaaugguugccuuaacccuggcuc

SEQ ID NO: 425883 - RNA, 64 nt, Human
guagcaccugggcaccugccgcuggaagcuauugggcuggcagcaggacgacuggcuguccucc

SEQ ID NO: 425884 - RNA, 64 nt, Human
ggagaaugguuacuuuggcauuagggccuucaagggcuggcagucuuacagaggcuggagcggu

SEQ ID NO: 425885 - RNA, 64 nt, Human
ugcaucgaugcucccccgcguggccuuuggggcaggcuggcaucccggugcgccucugcuucuu

SEQ ID NO: 425886 - RNA, 64 nt, Human
cugcagauagccagacacauggcuauccuagagaggcuggcaaggaguucguggcugcaaaaga

SEQ ID NO: 425887 - RNA, 64 nt, Human
ccaucacuccccacuucuuucugcugugcugcuucccucccaaacuccauuucugucacccuuu

SEQ ID NO: 425888 - RNA, 64 nt, Human
ccgccucccagguugacaccauucuccugccucacccucccaaguagcugggacuacaggcgcc

SEQ ID NO: 425889 - RNA, 64 nt, Human
uuuugcuucuugauacaggggccaaagccaggcacccucccaguuacguuguguauggccugaa

SEQ ID NO: 425890 - RNA, 63 nt, Human; identical to SEQ ID NO: 425780

SEQ ID NO: 425891 - RNA, 64 nt, Human
uaguguuaaauguuuacaaaagacagugaaggauucuuaucacauaaugugcaggccaugugcc

SEQ ID NO: 425892 - RNA, 64 nt, Human
auaguuauuacaacuaugagagccucccaagucaucuuaucaacucaacucccuuuuuuuuguc

SEQ ID NO: 425893 - RNA, 64 nt, Human
ucuuuuaaacgggaagaaaauuuccgcuuccuggucuuaucauggacaauuugggcuagaggca

SEQ ID NO: 425894 - RNA, 63 nt, Human; identical to SEQ ID NO: 425780

SEQ ID NO: 425895 - RNA, 64 nt, Human
cagcagaauucagugguugucuacuauccauacuucuuaucacuuuaguuuuucaucagucaau

SEQ ID NO: 425896 - RNA, 64 nt, Human; identical to SEQ ID NO: 425853

SEQ ID NO: 425897 - RNA, 64 nt, Human
acuugaauuucuaagaccauuucauucugaaacuucuuaucaauuaccuaaaucucaacgaaaa

SEQ ID NO: 425898 - RNA, 64 nt, Human
cugauuaauuagauaugcaucuggcauuguuuuaucuuaucaguauuaucacucuuauguuggu

SEQ ID NO: 425899 - RNA, 64 nt, Human
gagcagguagggcuuguacucacuuuaauuugaaucuuaucaacuuacucauaaagggacaggc

SEQ ID NO: 425900 - RNA, 64 nt, Human
guaugggguucaagagaguaauggguuucauauuucuuaucaccacaguaaguuccuacuaggc

SEQ ID NO: 425901 - RNA, 64 nt, Human
cuuugccccagaaaggccugggauucauucugguucuuaucaggguguguccacacucugcuca

SEQ ID NO: 425902 - RNA, 64 nt, Human
caugacccggaugaacucaaugcaugaugacucuucuuaucacacuugcaaaugaaugccuuuc

SEQ ID NO: 425903 - RNA, 64 nt, Human
uaguaacuugugcuuugagagcucaauauuuguaucuuaucaguacagaagaaauauuucugug

SEQ ID NO: 425904 - RNA, 64 nt, Human
uuuguacaguucagugaucuaguuugguguguccucuuaucaguuaguggaaauagaacggaaa

SEQ ID NO: 425905 - RNA, 63 nt, Human
aaugcaccacuccuuccccaggguuuaagagauugggggcagacagggacuuuccucugccgg

SEQ ID NO: 425906 - RNA, 63 nt, Human
gcucaacagaacauauguugcaagacccucccaugggggcacuugaguuuuggcaaggcugac

SEQ ID NO: 425907 - RNA, 63 nt, Human
ugaggacuagggcaucaaggucgugugugugggugggggcagccuccaccuccuggauucaag

SEQ ID NO: 425908 - RNA, 64 nt, Human
cugucugacacacaaauggucuuuucagccacagucuuaucaaguauccuauauguauuccuuu

SEQ ID NO: 425909 - RNA, 64 nt, Human
ccucaaaagguuaaagggauucccaucauuggaaucuuaucaccagauaggcaaguuuaugacc

SEQ ID NO: 425910 - RNA, 64 nt, Human
auugaaaaugguuuucuaaacuccaaaauggucaucuuaucaauaauaauaauauugaccauuu

SEQ ID NO: 425911 - RNA, 64 nt, Human
uaaugagcuuggcagguucuuugucucacugaauucuuaucauggaaacagcagcagcagccgc

SEQ ID NO: 425912 - RNA, 64 nt, Human
ccagugggagguacuuuuuggguggcuugugcauucuuaucaguugugugcuaauuuauuguau

SEQ ID NO: 425913 - RNA, 55 nt, Human
aacaaaccaccauugccugacuggcucuuaucaguguuaauagcaucucagcuuc

SEQ ID NO: 425914 - RNA, 64 nt, Human
aaaacaauaguggcaacacuccuauuggcuuuguucuuaucaaauuucucagugccuucucagg

SEQ ID NO: 425915 - RNA, 64 nt, Human
ccuccagcuguuaaaagacaaugcuauuacuacuucuuaucaaaaaucuguaaugcccugugau

SEQ ID NO: 425916 - RNA, 64 nt, Human
uauugcuaaguuuuuaguaugggugauacuggagucuuaucauuugaaguguuugcuuuucuac

SEQ ID NO: 425917 - RNA, 64 nt, Human
gcccugacuuuuccagaggcugcugccaccuacuucuuaucaaagaagggggagaacaguucau

SEQ ID NO: 425918 - RNA, 64 nt, Human
ucuaugugcucuguacuggaggcucuguucugccucuuaucagccaggucaggggcacacaugg

SEQ ID NO: 425919 - RNA, 64 nt, Human
cuccugcguaguaccaagguaggggacuaguggaucuuaucauaguuuuggcugacuaugcagg

SEQ ID NO: 425920 - RNA, 64 nt, Human
ucaaggcucucuucagccuugcucugucccugccucuuaucagagcacagguagacacacgggc

SEQ ID NO: 425921 - RNA, 64 nt, Human
uuuuucagugcaauaauuuuugugugugugugauucuuaucagaaaguugaauuguuuucugcc

SEQ ID NO: 425922 - RNA, 64 nt, Human
uaucauuagcaccuuaagugagagguuuucuuuuucuuaucaguguccuugacaagcauucaua

SEQ ID NO: 425923 - RNA, 63 nt, Human
ucucccugagccugccccagcugggcuguuggcugggggcaugggggaggcucugaagagaua

SEQ ID NO: 425924 - RNA, 63 nt, Human
aguucuaugcaccacuccagguagggauacccaugggggcagcugugccugugugggggaaca

SEQ ID NO: 425925 - RNA, 63 nt, Human
gagaggcagccuagacaaccaaguggcagcaggugggggcauucuucuaggaaugaggggcau

SEQ ID NO: 425926 - RNA, 64 nt, Human
auucuauugaaaccuugaaacuaaaaauuuagacucuuaucaucaucuuaaguucuucaugcua

SEQ ID NO: 425927 - RNA, 64 nt, Human
caggcgugagccacugcgcccggccacauucaguucuuaucaaagaaauaacccagacuuaauc

SEQ ID NO: 425928 - RNA, 64 nt, Human
aaguuguguaugauggugaaccuuugggaauaguucuuaucaacuuaauuggauacuuuuagca

SEQ ID NO: 425929 - RNA, 64 nt, Human
ggccugaauuccacaaguacgauuuacuguagugucuuaucacucuuucaugucacaauagcgu

SEQ ID NO: 425930 - RNA, 64 nt, Human
cuuacuguugggaaggagagaggaacccacucacucuuaucagcuuagaguguucaacugaucc

SEQ ID NO: 425931 - RNA, 64 nt, Human
gucuuagcaucacuuaaagaacuauucauccuuuucuuaucacagaaucuugggguuguucuuc

SEQ ID NO: 425932 - RNA, 64 nt, Human
gcagucagucguguaugacccuguaacguggaaaucuuaucacacaccuguuauccaacaaguc

SEQ ID NO: 425933 - RNA, 64 nt, Human
aaaagaaugaaauuaugcagaaauggccaauaucucuuaucaaucuguucuuuuggaaacccuc

SEQ ID NO: 425934 - RNA, 64 nt, Human
cgaugagaaauucaacguuaauaauucuggauuuucuuaucacaaaaaagaaaaugaaggaccu

SEQ ID NO: 425935 - RNA, 64 nt, Human
ggacucgccuccgugcgccgcugccccagaaggcucuuaucaauguuauuuauuugauugugug

SEQ ID NO: 425936 - RNA, 64 nt, Human
cuaaggcuaguuugaaaaccgugaauuaagauauucuuaucaguauaaaaacacugagauugcu

SEQ ID NO: 425937 - RNA, 64 nt, Human
uuuuuguuuauguguguguuuuuaauuuuuuuguucuuaucagcagucuuguguuagcacuggg

SEQ ID NO: 425938 - RNA, 64 nt, Human
ucuggaguaagccuuacaauuuuaauagacuuuuucuuaucauaucccucauuucuuucccuga

SEQ ID NO: 425939 - RNA, 64 nt, Human
guauauuuccuuauucaaauaaauucagucaucuucuuaucagguugcuuauuuauauaauuug

SEQ ID NO: 425940 - RNA, 64 nt, Human
uuacugcugguguuaauauuugugugggaugaauucuuaucaggacaaccacuucucgaacugu

SEQ ID NO: 425941 - RNA, 63 nt, Human
gccuuccagcugagugaagcuaggcaaauggagugggggcaggcaucuauuccugcccccauc

SEQ ID NO: 425942 - RNA, 63 nt, Human
gaaguggagaggccgagcagcagccggccgggaugggggcauuagaggccugagguucucuag

SEQ ID NO: 425943 - RNA, 63 nt, Human
acugccagugucuuagcagggucuugugagggcugggggcauccaggcacucagaaggcaaag

SEQ ID NO: 425944 - RNA, 64 nt, Human
gaugacaugguauuuaauaauacaauaaaaauauucuuaucacuuccuauccaugaguguugau

SEQ ID NO: 425945 - RNA, 64 nt, Human
uauauaccucaaaaucgugcccucuuuacauaugucuuaucagguauaacauguugaaauguca

SEQ ID NO: 425946 - RNA, 64 nt, Human
ucugugccaaaauuuuguauuuuauuuggagacuucuuaucaaaaguaaugcugccaaaggaag

SEQ ID NO: 425947 - RNA, 64 nt, Human
auucagauaauucaguuuguucauagaauuacuuucuuaucacucuuuuucuacuacuuuuucu

SEQ ID NO: 425948 - RNA, 64 nt, Human
gccgcgugguacaaaauaaacguguauuuguuguucuuaucagucccguuucaguacaacacug

SEQ ID NO: 425949 - RNA, 64 nt, Human
cuuccuuuugugaccauuacgcccccucccuguuucuuaucaccagcccaucagcccacugacu

SEQ ID NO: 425950 - RNA, 64 nt, Human
guggccuucccuaaaaucagggaauuguuuuaagucuuaucaagcagccaagggaugaaagaga

SEQ ID NO: 425951 - RNA, 64 nt, Human
auauaacaaugguuuugauguccuugucugcgaaucuuaucacuugggucaguuucaguugaua

SEQ ID NO: 425952 - RNA, 64 nt, Human
agcaacaacuuaaaggaauccuucacuaggauugucuuaucaccuuuauuagauaaaucaugaa

SEQ ID NO: 425953 - RNA, 64 nt, Human
aaaguuaaaacaugaaucuugggagucuacauuuucuuaucaccaggagcuggacugccaucuc

SEQ ID NO: 425954 - RNA, 64 nt, Human
agugaagcuguguuuacagggcauuccaagugauucuuaucaggaaaugugaaaaacacuccug

SEQ ID NO: 425955 - RNA, 64 nt, Human
uguguagacagguuuuauauuauaaaguaugcauucuuaucaccuaguauauaguuaguuugua

SEQ ID NO: 425956 - RNA, 64 nt, Human
ggucguaaaugcaugcuagaaaaauagggcuggaucuuaucacugcccugucuccccuuguuuc

SEQ ID NO: 425957 - RNA, 64 nt, Human
agacugguguugguuggagguggggggcucccacucuuaucaccucuccccagcaagugcugga

SEQ ID NO: 425958 - RNA, 64 nt, Human
ugccugauuuguucucagcaauccagcuggagugucuuaucaauccagaugaacugagggacau

SEQ ID NO: 425959 - RNA, 64 nt, Human
aaauuaauuugauaauuucauguaugaugugcauauaugcuaaaagaaugcagaaaaucauuuu

SEQ ID NO: 425960 - RNA, 64 nt, Human
agacauaggucuaggaugugugaaguuuggaaaaauaugcuauuuaauuauaauguucccuaga

SEQ ID NO: 425961 - RNA, 64 nt, Human
uugaauuuaaucauuguucuuagauuaaaauaaaauaugcuauugaaacuauauuagucuuuuu

SEQ ID NO: 425962 - RNA, 64 nt, Human
uugcuucuuaacugggacaugacauuuuucuagcucuuaucaagaauaacaacuuccacuuuuu

SEQ ID NO: 425963 - RNA, 64 nt, Human
gaaacugugcauuccagaucuacauacuaaaugcucuuaucauuuugaaaugggcucuugauua

SEQ ID NO: 425964 - RNA, 64 nt, Human
cccuggacgcuaauuaugagggaggcguguagcuucuuaucauuguaacuauguuauuuagaaa

SEQ ID NO: 425965 - RNA, 64 nt, Human
ugcugugaaaguggauuacaccaaauuaagucauucuuaucacacccaaucaaaagucaagaag

SEQ ID NO: 425966 - RNA, 64 nt, Human
aaagaccggaaagauuugcauuuuauuaugucugucuuaucaugcaauggaaaugaugcuuuuu

SEQ ID NO: 425967 - RNA, 64 nt, Human
aaaauccagccccgguuacauauaaucaucuguaucuuaucaugauuccuguagguaaaaguac

SEQ ID NO: 425968 - RNA, 64 nt, Human
aguucagaugagaauacguguccaguuugaauuuucuuaucacuguguacacacgcuucccaaa

SEQ ID NO: 425969 - RNA, 64 nt, Human
agauuuuagcagguuuucuuuccuauucauuguuucuuaucaguuuaaaaggauuccuuuaagc

SEQ ID NO: 425970 - RNA, 64 nt, Human
auuuucuuuggggcagagaagagcauuagcccugucuuaucauuacauugccauccuguugcac

SEQ ID NO: 425971 - RNA, 64 nt, Human
aggcuuagagacaguugggugagaacaaccaaaaucuuaucauggucucagucauaaucauuag

SEQ ID NO: 425972 - RNA, 64 nt, Human
cuauucagaauuauuucauaguaaaauaaucuacucuuaucacagcugugugacgauuucuaaa

SEQ ID NO: 425973 - RNA, 64 nt, Human
gcaguuuccuuucuuauaaaguggaaucaccaaaucuuaucacacagagcacaguccuguaguu

SEQ ID NO: 425974 - RNA, 64 nt, Human
cacaucucuggaggcugagucgguucaugaggucucuuaucaaaaauauuacucaguuugcaag

SEQ ID NO: 425975 - RNA, 64 nt, Human
cuuacagauuuacaugugcacacacacacaaauuucuuaucacauuuucgacuucuucacuuga

SEQ ID NO: 425976 - RNA, 64 nt, Human
cuuugccugucucuccaaauccccugguggcucuucuuaucauuaagaguaugagaauuaccau

SEQ ID NO: 425977 - RNA, 64 nt, Human
agcacacaaaaagcacaguagaacagaaaugaauauaugcuaaaucacaaagacaacucuccuu

SEQ ID NO: 425978 - RNA, 64 nt, Human
ggcauguccuuaaaaagaggauuugaaaucaacuauaugcuaccaagaacuuuaggauccaauu

SEQ ID NO: 425979 - RNA, 64 nt, Human
gauaucacguuuaccauuuacaccaucugcaaccauaugcuauuaauaaaauggaaaaaaacaa

SEQ ID NO: 425980 - RNA, 64 nt, Human
gggucuuccuaagaagagugcugucauuauuuccucuuaucaacaacuugugacaugagauuuu

SEQ ID NO: 425981 - RNA, 64 nt, Human
auuaacacuagggaauuauuugauaaccagcuuaucuuaucaguaguuuuauugcugaucaggc

SEQ ID NO: 425982 - RNA, 64 nt, Human
cuguacuuuuaaggcaguggcuguuuuuagacuuucuuaucacuuauaguuaguaauguacacc

SEQ ID NO: 425983 - RNA, 64 nt, Human
auuuuauauuuucaaaaaaauuguuaaacaucauucuuaucaauguaaaauuuacguuauuaaa

SEQ ID NO: 425984 - RNA, 64 nt, Human
gucaggaaccuuaaaggcgguguuucaaggaaacucuuaucacuacuauugauucuaguuccag

SEQ ID NO: 425985 - RNA, 64 nt, Human
aacugggucggcuaucaagaaggaagguuauauuucuuaucacauuuuaaguuguuaagcaaau

SEQ ID NO: 425986 - RNA, 64 nt, Human
aguugcuggcccuguguccucaaaguucauuacaucuuaucaaggccuguuugcaaaggggaga

SEQ ID NO: 425987 - RNA, 64 nt, Human
aaugaaguuuugggcaccauugucauugauaacaucuuaucaggagacgguuuugagaucaacu

SEQ ID NO: 425988 - RNA, 64 nt, Human
auuuuaugauuacaguaaaaagaugcaaccauucucuuaucauguagccccuuuagaacaacag

SEQ ID NO: 425989 - RNA, 64 nt, Human
guggacucuugacuuccagcugggaugugugacuucuuaucaccuggauucagagagucugggg

SEQ ID NO: 425990 - RNA, 64 nt, Human
gcuuugaggagugacccauuucacuacuuuguuuucuuaucacuaaaggcaaaaaucaaagcac

SEQ ID NO: 425991 - RNA, 64 nt, Human
gacauuuucggaagggggaagucucuuuuuuuacucuuaucauuuuuuuuuuuugagguggagu

SEQ ID NO: 425992 - RNA, 64 nt, Human
ugcgcuuggaaaggccuagucagaagccauuuccucuuaucauuucccucuccuaugcaccagu

SEQ ID NO: 425993 - RNA, 64 nt, Human
ucauaaauauccuuauauaagaaaaaaaaugaucucuuaucaauuagcacucacuaauguacua

SEQ ID NO: 425994 - RNA, 64 nt, Human
agaagccaagucugauuaauaaccauauaccaugucuuaucaguggucccugucucccuucuug

SEQ ID NO: 425995 - RNA, 64 nt, Human
cugcaguccacuuacuguacuguguuguggaaggauaugcuaagugaugaaaguugcgagcagu

SEQ ID NO: 425996 - RNA, 64 nt, Human
uuuugucaaccacuccaggaagagucauuacuacauaugcuagccaaaucaauccaugcagaug

SEQ ID NO: 425997 - RNA, 64 nt, Human
uuguuagaucuaguucacucuccauuuaauaauuauaugcuauuucuauauuuucauucuccua

SEQ ID NO: 425998 - RNA, 64 nt, Human
ggauaaacuuugcccagcaugauuuuuggguucaucuuaucaguuccccuggugggcagauaca

SEQ ID NO: 425999 - RNA, 64 nt, Human
uuaggcaauaggaauuuuucaaguccacuauaaaucuuaucaaaccaugguuguauaugcaguu

SEQ ID NO: 426000 - RNA, 64 nt, Human
cuacccaauguuacuacuuauuuuuccucucaggucuuaucagauacggcuguggagaggauga

SEQ ID NO: 426001 - RNA, 64 nt, Human
ugauaaugucugcuuggcauauuuucaccuuaggucuuaucaagaccaaagagauuauguuaau

SEQ ID NO: 426002 - RNA, 64 nt, Human
aguccugagcccccuccgcuggucccaguccagcucuuaucaacuccccaaaggaaaacccacu

SEQ ID NO: 426003 - RNA, 64 nt, Human
acaaagcaaaaagugaugauagugguggaguuaaucuuaucaagaguugugacaacuuccugag

SEQ ID NO: 426004 - RNA, 64 nt, Human
aaggaacuauuuacuggcaugauauuugcauuccucuuaucaggcauuuucauuuggaaauuuc

SEQ ID NO: 426005 - RNA, 64 nt, Human
ugguacagccacucugggaaagaguuuaugaauuucuuaucaaguuaaacauaauuuuuuaauc

SEQ ID NO: 426006 - RNA, 64 nt, Human
gauugugaccaacauucaggccacgugagcacugucuuaucacaucgccaauuaguuguaauaa

SEQ ID NO: 426007 - RNA, 64 nt, Human
guguacuguuaaaccaauaucaucacaucucgagucuuaucaaguuuucauucucugucaauau

SEQ ID NO: 426008 - RNA, 64 nt, Human
gaaagccuaaauguaaaauauaucuuuucauucaucuuaucagguaaaaggaaauucagaaaau

SEQ ID NO: 426009 - RNA, 64 nt, Human
aaaaagcauagcuguuaaacugacuugauuuuuuucuuaucaauauuuucuauaucacaaaaau

SEQ ID NO: 426010 - RNA, 64 nt, Human
gaagaugaaauuaaauguguggcuuuuuuccuauucuuaucaaaggcaucguugucugcuaaau

SEQ ID NO: 426011 - RNA, 64 nt, Human
ugucucauuugagucuuuuucuuaccuagcccccucuuaucaguaaaacaaaggacuugccaug

SEQ ID NO: 426012 - RNA, 64 nt, Human
ggcagaguucacuauucuaucugccauuagaccuucuuaucauccauacuaaagccccauuauu

SEQ ID NO: 426013 - RNA, 63 nt, Human
aauucccagguguugugguagguaauugaaucaugggggcaguuucccucaugcuauucucau

SEQ ID NO: 426014 - RNA, 63 nt, Human
ugagggaaccugucuccuaccacuucggagccaugggggcaagugugaagcagccagucccug

SEQ ID NO: 426015 - RNA, 63 nt, Human
uuucuugccagcuucguuguucccucuggcuugugggggcacggcugugcuccauguggcaag

SEQ ID NO: 426016 - RNA, 64 nt, Human
aaaaagacauuagaacugugugggcuauaaguguucuuaucacugagacacaguggauuuuuau

SEQ ID NO: 426017 - RNA, 64 nt, Human
uccucuugaugugagagagacucugagacuucuuccaucgcaaugaccuguauuaaacacaagc

SEQ ID NO: 426018 - RNA, 64 nt, Human
uccccugugcagaucgugggaugaaacgcaugggccaucgcaccugccuuuggaaugaucagcu

SEQ ID NO: 426019 - RNA, 64 nt, Human
cagauggacccuuccaugggaggaaauaaaguuuccaucgcaggugcugggagucugguuuuga

SEQ ID NO: 426020 - RNA, 64 nt, Human
aggggaccuucggccgaguuguacaauguguugaccaucgcagggguggggcucgaguugcccu

SEQ ID NO: 426021 - RNA, 64 nt, Human
uaucaucccuaucuauuguaacccaaaagaccuaccaucgcaucagugaaguccgaacacaucu

SEQ ID NO: 426022 - RNA, 64 nt, Human
uaugcucauccuuccugccugaaauugcugcugcccaucgcaugagcccacacaguagcacccc

SEQ ID NO: 426023 - RNA, 64 nt, Human
uaccugccggacacagagggggccuucacagugaccaucgcaaccaggauugacagguggggcu

SEQ ID NO: 426024 - RNA, 64 nt, Human
caaugcagccuauacucccaagacuacaaaguuaccaucgcaaaggaaagguuauuccaguaaa

SEQ ID NO: 426025 - RNA, 64 nt, Human
ggaggaucagaaugcuuugggauuaauugggcagccaucgcagaauuguuugugggcaaagggc

SEQ ID NO: 426026 - RNA, 64 nt, Human
cagggcaggaaccaggccuggacggggugcuauuccaucgcagggugcucacacacccccacac

SEQ ID NO: 426027 - RNA, 64 nt, Human
agcuccuucuccaaacaacucaagcccccaauucccaucgcauuccauuugggugagaugcaac

SEQ ID NO: 426028 - RNA, 64 nt, Human
cagccucccaaagugcuaggaauacaggagugcaccaucgcacccggcuggguuaucuaguuua

SEQ ID NO: 426029 - RNA, 64 nt, Human
gcccggugucaugaaaugaaaccaaaccucggugccaucgcagaguauaaaaagaagguaugaa

SEQ ID NO: 426030 - RNA, 64 nt, Human
ugccuguugugaagcuaaugaacucuuucaaauuauaugcuaauuaaauaauacaacuccuauu

SEQ ID NO: 426031 - RNA, 64 nt, Human; identical to SEQ ID NO: 426030

SEQ ID NO: 426032 - RNA, 64 nt, Human
ugccuguuguaaagcuaaugaacccuuuccaauuauaugcuaauuaaauaauaaaaacuccuau

SEQ ID NO: 426033 - RNA, 64 nt, Human
caggagguggagguugcaaugagccgagguugagccaucgcacuccagcggugaaacaagagug

SEQ ID NO: 426034 - RNA, 64 nt, Human
ugggaggcagagguuguagugagccgagaucgcgccaucgcacuccagccugggugacaagagc

SEQ ID NO: 426035 - RNA, 64 nt, Human
ccaccucccaaaguguucggauuacaaacgugagccaucgcaccuagccucuuugaucauuucu

SEQ ID NO: 426036 - RNA, 64 nt, Human
acuggaggacaugauccaggagcuucaggagaccccaucgcagacgucaguggucucuggggca

SEQ ID NO: 426037 - RNA, 64 nt, Human
gugaggaaaaaaaucguccagggagcauuuuccuccaucgcaguguucaaggccauccuucccu

SEQ ID NO: 426038 - RNA, 64 nt, Human
uacacucccgcagccgcuccucagaggccugugcccaucgcaggccugggaggaaagugggcgc

SEQ ID NO: 426039 - RNA, 64 nt, Human
uagguaccagcuucuggcucaagaguugaaggugccaucgcagggucaggccugcccugucccg

SEQ ID NO: 426040 - RNA, 64 nt, Human
gcccagccugagcaauggcaggaugugaacuuccccaucgcaaaugcaguucucagcccacugc

SEQ ID NO: 426041 - RNA, 64 nt, Human
ugucucuguugggggacagaggaaccuggggaguccaucgcauguccuacaaucugcucuuaga

SEQ ID NO: 426042 - RNA, 64 nt, Human
gcucuaagcaccgucccugcccagccccacuucuccaucgcagccccaccuuggcugcugagcc

SEQ ID NO: 426043 - RNA, 64 nt, Human
uuaacucucuuuugucaaacccucuuguauauaaccaucgcacaacauacagaacccuggggaa

SEQ ID NO: 426044 - RNA, 64 nt, Human
gugagaugcccacugugugcuggucuaaauuaauccaucgcagugauccuccagagacagcgcu

SEQ ID NO: 426045 - RNA, 64 nt, Human
acugcaguucagccuggaugaugagagugagacuccaucgcaaaaaaaaaaaaaaaaaaagaaa

SEQ ID NO: 426046 - RNA, 64 nt, Human
gcuucacuugaucuccggaccuuggcugcagaggccaucgcagcuuuugaaaagugaagggguu

SEQ ID NO: 426047 - RNA, 64 nt, Human
ccaaauuugauagacugcuguuuuucuggucugaccaucgcaacccucaugaaguacaaccagc

SEQ ID NO: 426048 - RNA, 64 nt, Human
gcagaucuuuacaggcauaaauauuuaaacuguaauaugcuaacuugaagagauugcaauaaag

SEQ ID NO: 426049 - RNA, 64 nt, Human
gggacugaacaauuuauugggaagcaaacucuuuauaugcuagaaaguacauuuaaaagaugac

SEQ ID NO: 426050 - RNA, 64 nt, Human
agagaaguguaaccaugcaaauacaaugagcuuaauaugcuaacuuuagcaagauguaaaaugu

SEQ ID NO: 426051 - RNA, 64 nt, Human
cauggcucauucugcaaugagccaugagugugggccaucgcaagucacagaaaaugcaccucau

SEQ ID NO: 426052 - RNA, 64 nt, Human
agccugggagaucaaggcuacagugagccgcgacccaucgcacaccugcacuccaguccuggug

SEQ ID NO: 426053 - RNA, 64 nt, Human
caggaggaaaagcccagggucuggggcagcagagccaucgcaucauguuucccagggcaacuug

SEQ ID NO: 426054 - RNA, 64 nt, Human
aacccaauagcaggggaagcuggggggucaagcaccaucgcaccaacacuccaccgcgaucugc

SEQ ID NO: 426055 - RNA, 64 nt, Human
gaggugcugccggggcagcgggagguggcuggacccaucgcaucuaaaacuggcccaggacacu

SEQ ID NO: 426056 - RNA, 64 nt, Human
ugauacaggugugcugagugagcugugcugccagccaucgcagaggagcccgcgcacgacugug

SEQ ID NO: 426057 - RNA, 64 nt, Human
agaaacuacagcaucauggaugcuguggacauggccaucgcaugggaggagcucaaaccagcac

SEQ ID NO: 426058 - RNA, 64 nt, Human
auccgcacccaguuugauaccugcacuguccugaccaucgcacaccggcuuaacacuaucaugg

SEQ ID NO: 426059 - RNA, 64 nt, Human
agaugcacuuugggggugagggcagguaaugacuccaucgcacccucaguucagcuggacagag

SEQ ID NO: 426060 - RNA, 64 nt, Human
gugacugcuggcaugaaauagaagugcaguuccuccaucgcacuggguaaggccuccaguauug

SEQ ID NO: 426061 - RNA, 64 nt, Human
auucagucaagugaggugacacuccaguugcagaccaucgcacaccaaauuuggcaaaacagcc

SEQ ID NO: 426062 - RNA, 64 nt, Human
gucaaggggcucaggaaagcggacgcgaggcucgccaucgcaagguacagacgggaccugcgau

SEQ ID NO: 426063 - RNA, 64 nt, Human
agagccauuugguccaucaucuccugcaauaaacccaucgcaagaaugaccuucaagaugugug

SEQ ID NO: 426064 - RNA, 64 nt, Human
aagguggugcauuaccggaaguggaucaaggacaccaucgcagccaaccccugagugccccugu

SEQ ID NO: 426065 - RNA, 64 nt, Human
ccccaaaaagcgagaagggggguucaggaggaagccaucgcaggggaccugggagacgccccga

SEQ ID NO: 426066 - RNA, 64 nt, Human
uaacuaugcauuugaguacagacuaauuuuuaaaauaugcuaaacuggaagauuaaacagaugu

SEQ ID NO: 426067 - RNA, 64 nt, Human
caaccaacuguaaugcaggauuggaccaugaaugauaugcuagaauagaagaaagagaaguguu

SEQ ID NO: 426068 - RNA, 64 nt, Human
uguuuaaaaggagaaaccugguaucuauuuguauauaugcuaaauaauuuuaaaauacaagagu

SEQ ID NO: 426069 - RNA, 64 nt, Human
augguaaaaauguguuucccucaaaucaugggaaccaucgcaaaauuauucugaagcuucugca

SEQ ID NO: 426070 - RNA, 64 nt, Human
aggacuugcagguuccuaggagcaggagcaucucccaucgcacgugcuuucugcucuucuggga

SEQ ID NO: 426071 - RNA, 64 nt, Human
cgggaggcagagguuacagugagccaagaucgcgccaucgcacuccagccugggcaacaagagc

SEQ ID NO: 426072 - RNA, 64 nt, Human
guguagacgucuuccaaauaaauuauguguugguccaucgcacaugcucaauaaauauuuuuaa

SEQ ID NO: 426073 - RNA, 64 nt, Human
ugggacacggagguugcagugagcuaagaucaugccaucgcacuccagccugggggacaaaagu

SEQ ID NO: 426074 - RNA, 64 nt, Human
aaggaugcggcaggugcucuguggaugagaggaaccaucgcaggaugacagcucccgggucccc

SEQ ID NO: 426075 - RNA, 64 nt, Human
ucacaaauaagcuuuuaaacuggugucuuuggaaggaagguagauacaaaaagauugugguaaa

SEQ ID NO: 426076 - RNA, 64 nt, Human
ucuauuuugaaagauuuuggcacuauauuuaauuggaagguaaaauauuguacaugugauccag

SEQ ID NO: 426077 - RNA, 64 nt, Human
gggaggugagggcaggugccccucagacacuucaggaagguaguuugcauucuauuuaaaaaag

SEQ ID NO: 426078 - RNA, 64 nt, Human
ccauucaaauuguccuaggucuaucagaaauuagggaagguaguccugcuuuauaauaggaaaa

SEQ ID NO: 426079 - RNA, 64 nt, Human
cuucacuuugagggugugaugucuguagcuauguggaagguaaaaauaguggugugaucaugaa

SEQ ID NO: 426080 - RNA, 64 nt, Human
gaguuacugaagccugugggacuuaauaaauacaauaugcuacucccuguugugauugaacaau

SEQ ID NO: 426081 - RNA, 64 nt, Human
gcuauuauacuugggacucuaccucucacucacuauaugcuaacuuaaagccauucaacaagga

SEQ ID NO: 426082 - RNA, 64 nt, Human
cuuuuccccucauugcauuuauugcaguuuauauauaugcuacuuuuacuuguucauuucuguc

SEQ ID NO: 426083 - RNA, 64 nt, Human
uaaguacccaugucuuuuucaugucuaaccauugggaagguagaggcuggcagggaagacaaau

SEQ ID NO: 426084 - RNA, 64 nt, Human
ggugccuugguggcagcaccacugccugcucccuggaagguagacuauggcauaagugucagcu

SEQ ID NO: 426085 - RNA, 64 nt, Human
aaaaggcagaguacaaaguaagccauguaucucaggaagguaacuucauuuugucuauuugcug

SEQ ID NO: 426086 - RNA, 64 nt, Human
auaaaguaacauccaaguguuucaugguuuguugggaagguaauuuuaaaauaaaacaauuucc

SEQ ID NO: 426087 - RNA, 64 nt, Human
gacccacacauuccucacguagcuucugcucccaggaagguaguuuaaauccuguauauacuuu

SEQ ID NO: 426088 - RNA, 64 nt, Human
accaggcugcuggcuccgguaccauguaaaccuaggaagguaaaggagcaggcaaccuccucgu

SEQ ID NO: 426089 - RNA, 64 nt, Human
ccaucuauaauaguaugggaugauuuuugcuuguggaagguaucauccguguggguucuucccu

SEQ ID NO: 426090 - RNA, 64 nt, Human
ggggcaggaggagguggggaggggcacugccugcggaagguaggauuagaucauuagcucagug

SEQ ID NO: 426091 - RNA, 64 nt, Human
cccuuucugguuuaaaaaaauggugcuugaugagggaagguagacucuucccuaggacugacga

SEQ ID NO: 426092 - RNA, 64 nt, Human
ucuuugacccuuaugacugaaagaucaucaguuuggaagguacugguccaauuuauuuaggaag

SEQ ID NO: 426093 - RNA, 64 nt, Human
acuuuugcagaagaaacuucagcaagcuagaacuggaagguacuuuaauuuuucauauauauuu

SEQ ID NO: 426094 - RNA, 64 nt, Human
auccagaccuuauccacaacccggggcuuggaaaggaagguauuuuggaaucacacccuccggu

SEQ ID NO: 426095 - RNA, 64 nt, Human
agaucuaaauuccagaaggagggcaccacaccuaggaagguaaauccaguaucagaagguugcu

SEQ ID NO: 426096 - RNA, 64 nt, Human
uuauacagagaucuagaaucuuauauuuuccauaggaagguaaagaaaucauuagcaagaguag

SEQ ID NO: 426097 - RNA, 64 nt, Human
aagaccuucaccuuugcaaacuucccucauguaaggaagguacuuuaaauguagcagccacuga

SEQ ID NO: 426098 - RNA, 64 nt, Human
uaauauaaauuuaaacaacauggcuuguuagaaaauaugcuaauugcuauggucucauuauguu

SEQ ID NO: 426099 - RNA, 64 nt, Human
auggaaauauaaauaagaaagaauguuuaacauaauaugcuaaaaauauuuucauauuuaaaua

SEQ ID NO: 426100 - RNA, 64 nt, Human
uaaugaaaaagaaaaguauaguuaaugguuucaaauaugcuaagaaauugacucugcggagggg

SEQ ID NO: 426101 - RNA, 64 nt, Human
aagaacucuugaauugugugguaucuaauaaaagggaagguaagauggauaaucacuuucucau

SEQ ID NO: 426102 - RNA, 64 nt, Human
gugaccuuaccuguauucccugugcuauccugugggaagguaggaaugggcuaaguaugaugaa

SEQ ID NO: 426103 - RNA, 64 nt, Human
gagcccucuuguggccaggccuuccuuugcuggaggaagguacacagggugaagcugaugcugu

SEQ ID NO: 426104 - RNA, 64 nt, Human
uugaaacugaguuuugucaucuuccauauuugcaggaagguauuuucugacuugcaaugcagcu

SEQ ID NO: 426105 - RNA, 64 nt, Human
auauucccaucccucuauuuuaaucuguuaugaaggaagguaaauaaaaaugcuaaauagaaga

SEQ ID NO: 426106 - RNA, 64 nt, Human
caaaacuaucagauuuuauuuuuguauaauuuaaggaagguaaaguuaggggacuagaagacuc

SEQ ID NO: 426107 - RNA, 64 nt, Human
uccaaaugcuguuacccaagguuaggguguugaaggaagguagaggguggggcuucaggucuca

SEQ ID NO: 426108 - RNA, 64 nt, Human
cuguacuuaaauugcagagaaaccuguaaguaauggaagguaaagaaaaauuacagaauggaaa

SEQ ID NO: 426109 - RNA, 64 nt, Human
accuugauguaaagaccauuaaaaaaaaaacagaggaagguauuucuaauuccuugggcuacaa

SEQ ID NO: 426110 - RNA, 64 nt, Human
gcuucagagacagugcugccuccuccugagggagggaagguaccagggagaaccugggaggucc

SEQ ID NO: 426111 - RNA, 64 nt, Human
cggaaaauccaaauguggcuuuuguauuaaauuuggaagguaugguguucagaacuauauuaua

SEQ ID NO: 426112 - RNA, 64 nt, Human
auuauguugaguacuaaaaaggagaaaaaauccuggaagguaacaaggcugaagaccuucaaau

SEQ ID NO: 426113 - RNA, 64 nt, Human
gaggugcuuuuaaugugcugauaaaccaaccucaggaagguauuauguacagaagauucccaag

SEQ ID NO: 426114 - RNA, 64 nt, Human
ggcaagcacuaccaggcugugggucugcaccucuggaagguagagaagcggcgggucaaucugc

SEQ ID NO: 426115 - RNA, 64 nt, Human
ucaggcuugucccccugucagcugccuccagaagggaagguagccagugccugagaagacaguc

SEQ ID NO: 426116 - RNA, 64 nt, Human
uuaccaucuuuauugcuguaauguguuaagcauuauaugcuaguagaaucuaguuuaauuguuu

SEQ ID NO: 426117 - RNA, 64 nt, Human
ucacgaauuuuuuagaaaacagugcuucuuaaugauaugcuauuauacuuauuaguuaugugca

SEQ ID NO: 426118 - RNA, 64 nt, Human
auuauauguauuucuguauaauauguacauauaaauaugcuaauuaauacaagaacauauugaa

SEQ ID NO: 426119 - RNA, 64 nt, Human
aagugugacuucgaauuaguuugcacuuccuguuggaagguagagcccacugcucauuguauaa

SEQ ID NO: 426120 - RNA, 64 nt, Human
agagcccuuuagucucuccuuccaagucuuuagaggaagguacuaagaagacagaaacaagcaa

SEQ ID NO: 426121 - RNA, 64 nt, Human
cuguuggguuguggugaaaucauuuugcauuaaaggaagguaaaauacuaauaaauugcauauu

SEQ ID NO: 426122 - RNA, 64 nt, Human
ccuguauuccuuuggcuuggcaucuuuuagcucaggaagguagaagagaucugugcccaugggu

SEQ ID NO: 426123 - RNA, 64 nt, Human
caccuaucuuugguauaugauagguuacauaaaaggaagguauuggcugaacugaauagagguc

SEQ ID NO: 426124 - RNA, 64 nt, Human
auauacagccaaaguggauguuucuauuuggcaaggaagguaggauuucugaaacucaggccuu

SEQ ID NO: 426125 - RNA, 64 nt, Human
aggaguaacuuauuccaguucuuacccauuauuaggaagguaaggacuacacaugucauugaau

SEQ ID NO: 426126 - RNA, 64 nt, Human
aacugaccuaagccacugauuaauauuuaaugagggaagguaggggagaaucuagccauuuuau

SEQ ID NO: 426127 - RNA, 64 nt, Human
agauuccgucuucuucccugucucaaguaaguaaggaagguacugcggacagugugggccaggg

SEQ ID NO: 426128 - RNA, 64 nt, Human
ugaauugguaucaggagauccugaggcugguaggggaagguaauucuuucuaaguuaccucugu

SEQ ID NO: 426129 - RNA, 64 nt, Human
ccuguuuucauggguccuguagauguuugagucaggaagguaaggcggggagugacugaauaaa

SEQ ID NO: 426130 - RNA, 64 nt, Human
uugguuagcccacuuucccucuccauguggagauggaagguagagaaggauacagugucuaucc

SEQ ID NO: 426131 - RNA, 64 nt, Human
uuuuccugaagggcauuugaaggaacaauaucugggaagguacuagagaaauuacaaagcccga

SEQ ID NO: 426132 - RNA, 64 nt, Human
uccauuucaagaaauaaagacgaacacauuugcaggaagguaacuguuauaacccacaccauca

SEQ ID NO: 426133 - RNA, 64 nt, Human
cacaggggggaggcacuaagucaugguccuggcuggaagguacugaaggcuucugcagcuuugg

SEQ ID NO: 426134 - RNA, 64 nt, Human
cuuuuucacuugggucucuggauuccugucauagggaagguauaucaggaggggaagaggccuu

SEQ ID NO: 426135 - RNA, 64 nt, Human
uggauagauuuuuuuuuucuuuucaaggggggcaggaagguaaugguuugaguagccuuuguuu

SEQ ID NO: 426136 - RNA, 64 nt, Human
auauagaaauauaguagcuaaaaaaauacucuggggaagguaccacaaacauuaucuaccaggg

SEQ ID NO: 426137 - RNA, 64 nt, Human
aguggcuaccuacauacaauuccaaacacauacaggaagguagaaauaucugaaaauguaugug

SEQ ID NO: 426138 - RNA, 64 nt, Human
guuuuguuuucaauauucuuggggauuagacaggggaagguauuuuauuacugcauaauagaug

SEQ ID NO: 426139 - RNA, 64 nt, Human
ucaccuucauuuuggcaagaagacuguauuuucaggaagguaucacacacuuucugacugcaac

SEQ ID NO: 426140 - RNA, 64 nt, Human
uuuaaucaaagaaaagauucauacaugugaaauuggaagguauuuauaaaauuuuuauugcugu

SEQ ID NO: 426141 - RNA, 64 nt, Human
cauaaauggugcugguaggagguuaucagaguaaggaagguagcagauauaggugcagggugcc

SEQ ID NO: 426142 - RNA, 64 nt, Human
ggggaauccugccaguuggugaagcccuguggcaggaagguauauguggacauagaguauaccu

SEQ ID NO: 426143 - RNA, 64 nt, Human
ucaucacaugcagccaaacuuggccucugaagggggaagguagugggaauagguggugagagaa

SEQ ID NO: 426144 - RNA, 64 nt, Human
ccauguccuggcagcaggaccccaggcuacauauggaagguagagauguggggguccuguaucc

SEQ ID NO: 426145 - RNA, 64 nt, Human
uggcucuugcgaaugccccauagcagaagucccgggaagguaaaugccaaacccagagccaugu

SEQ ID NO: 426146 - RNA, 64 nt, Human
uggugauucagcaugaaggaaaugaagcuggagaggaagguaaagaagaagagaauauuaagua

SEQ ID NO: 426147 - RNA, 64 nt, Human
caacucaugaguggauuuuauauaggauggaacaggaagguauguccugucaguaucuuaaccc

SEQ ID NO: 426148 - RNA, 64 nt, Human
aaaccccaccccaaaauuagccaguaauccuguaggaagguacuguaugaucaaauguuuaauc

SEQ ID NO: 426149 - RNA, 64 nt, Human
ugcaauggaauuccuacuuuauuaaauguauuugauaugcuaguuauugugugcgauuuaaacu

SEQ ID NO: 426150 - RNA, 64 nt, Human
ccuaugguaaugaacaccaaacaucuaaacaaucauaugcuaacaugccacuccuggaaacucc

SEQ ID NO: 426151 - RNA, 64 nt, Human
gaacccuagucuuuuaaacaguuuagagugaaauauaugcuauaucaguuuuuacuuucucuag

SEQ ID NO: 426152 - RNA, 64 nt, Human
gcaacuuguguuacaaaaauacaaacacauguuaggaagguacugucaugggcuaggcauggug

SEQ ID NO: 426153 - RNA, 64 nt, Human
cugauccuccuaccugguccaccccagggcuaccggaagguaaaaucuucaccugaaccaauua

SEQ ID NO: 426154 - RNA, 64 nt, Human
aggguuaacaauaguuuauuauuguggcuuaaugggaagguauagaagcuaccugucauagccu

SEQ ID NO: 426155 - RNA, 64 nt, Human
gagguggagggacagugugaauaaauggcaucuaggaagguaaacuccaaucccggugaccgac

SEQ ID NO: 426156 - RNA, 64 nt, Human
cgagcucugugacugucccacguccaggagacaaggaagguagggcaccugcugcacacgauuc

SEQ ID NO: 426157 - RNA, 64 nt, Human
ucuaccuuccgguagcccuagacuuggggucaggggaagguagagcuggagcuuuuacagaaau

SEQ ID NO: 426158 - RNA, 64 nt, Human
uagauaaauuggaaagguuaauguucuaguuucuggaagguaagccugggagacacauaagcaa

SEQ ID NO: 426159 - RNA, 64 nt, Human
uucuggaaugaucagcagauauagucuacaagggggaagguacuaagccccaggaccaauggua

SEQ ID NO: 426160 - RNA, 64 nt, Human
agcuuaaugucuaugauuuguucuuugacauuaaggaagguaaggauuggucagaggauguaac

SEQ ID NO: 426161 - RNA, 64 nt, Human
uggcacugcugaguccucucuggcugggaaggggggaagguaggagggugagggcccugcagga

SEQ ID NO: 426162 - RNA, 64 nt, Human
agcgcugugcuccucauggacgggagcgcaguggggaagguaggggaaagaugaggcacagugu

SEQ ID NO: 426163 - RNA, 64 nt, Human
ccaagaauuucuaggacugaauuaugaaacuuuuggaagguauuuaauagguuuggacaaaaug

SEQ ID NO: 426164 - RNA, 64 nt, Human
ucagcacaacuggagagaggcauuaaagaaccagggaagguaguuugauuuuucauugaauucu

SEQ ID NO: 426165 - RNA, 64 nt, Human
gauccagaccucuacaagcaaauggagaaguucaggaagguacaaacacaagugcgccuugcaa

SEQ ID NO: 426166 - RNA, 64 nt, Human
uuuaccucaucuugguaucaauaaaaacuuauguggaagguaaauauauuguuccccauccacc

SEQ ID NO: 426167 - RNA, 64 nt, Human
uugcuaauagaaaauaaugcacaguguccucaggauaugcuaaacaagguuuuuaagagcauuu

SEQ ID NO: 426168 - RNA, 64 nt, Human
augacuucauuccagaggcuucucagaguucaacauaugcuauaauuuagaauuuucuuaugaa

SEQ ID NO: 426169 - RNA, 64 nt, Human
cacacagcuguuuaaaaaccacuggguaugaggaauaugcuagaaagaaauguuaaaaauagau

SEQ ID NO: 426170 - RNA, 64 nt, Human
uuaauuuucaauguuuucccagccuauaaaaaaaggaagguacacguuguccuuuuaaagguug

SEQ ID NO: 426171 - RNA, 64 nt, Human
agaugaaaccauaucuuaaaaugcagaaaugauuggaagguagaucuuaucuagccuuuggauu

SEQ ID NO: 426172 - RNA, 64 nt, Human
uagaaguuuuuugcaccacuaauuuuuuaaaaauggaagguaaacugcauagcccagagaaaga

SEQ ID NO: 426173 - RNA, 64 nt, Human
guuuuaugugccgaaucacuguggggaaaggucaggaagguauaguccuucaauaggaaauugu

SEQ ID NO: 426174 - RNA, 64 nt, Human
ggaaccacagucuccucauucaaacaguuauuuuggaagguaaagccugucacuuucagcccgg

SEQ ID NO: 426175 - RNA, 64 nt, Human
gaucaaucagaaaggaaacacgaaagaaaagucaggaagguagagagagaaaaagggagggaag

SEQ ID NO: 426176 - RNA, 64 nt, Human
gcuacuugauugguggccaaccucgugcccacauggaagguaucuuuaauagggucuuuucaaa

SEQ ID NO: 426177 - RNA, 64 nt, Human
auuccagaugccaagaccaggggcuuauuucuagggaagguaggucgguuuccauguuucccuc

SEQ ID NO: 426178 - RNA, 64 nt, Human
gggcaagcaagcugcccugugcucugagugagggggaagguagccccuuuuuccaaagauaacu

SEQ ID NO: 426179 - RNA, 64 nt, Human
cggcaucccaaggccaggugggcccucagcugagggaagguacgagcucccugcuggagccugg

SEQ ID NO: 426180 - RNA, 64 nt, Human
ccuucccacauccacgagguggguuuugagcaagggaagguagccuggaugagcugaguggagc

SEQ ID NO: 426181 - RNA, 64 nt, Human
uuuugaucacucugaggacaauauuuaaaugacaggaagguauauuaauguaacaagcauucau

SEQ ID NO: 426182 - RNA, 64 nt, Human
gacaacugaaaagggcgggagacuguggcaccuuggaagguaccacuugaaaugagacgugcua

SEQ ID NO: 426183 - RNA, 64 nt, Human
guccaccuggaggcucaccacuuggagagacacaggaagguaauauuuacagcugucaugugac

SEQ ID NO: 426184 - RNA, 64 nt, Human
uuacuucauucacugaaguuuuugcccaaaaauuggaagguaaacagagagcuauguuucugua

SEQ ID NO: 426185 - RNA, 64 nt, Human
caaucuuuguauacuuuugggauuuuuggugcuuauaugcuaaaucacauucagcauguguauu

SEQ ID NO: 426186 - RNA, 64 nt, Human
aauuaaugaggguuugugcuaccagaguuaaagcauaugcuaucauuguauucuuuaagaaccu

SEQ ID NO: 426187 - RNA, 64 nt, Human
agaacugaugcagaugguugaaugcgcuuguacuauaugcuaaaauauggaaaaggaaaaaaaa

SEQ ID NO: 426188 - RNA, 64 nt, Human
ccgccuaggccucccaaaaccauuagggcucagaggaagguaucccaaugaauaucaauuaagg

SEQ ID NO: 426189 - RNA, 64 nt, Human
uucuuccauguuuuagaaaaugaggccuguuuggggaagguacccuggugauguuuuugcuaga

SEQ ID NO: 426190 - RNA, 64 nt, Human
uccuggaaugcucccaccucaaguggaguuagaaggaagguagaggggcucucccccaggauuu

SEQ ID NO: 426191 - RNA, 64 nt, Human
caaagaugcccccuguccaagccaucccacagcuggaagguaggggaugggggugcccacacug

SEQ ID NO: 426192 - RNA, 64 nt, Human
aaggucagaggaguguguagggagggauguauguggaagguaagauucagggcaagcuaaaaau

SEQ ID NO: 426193 - RNA, 64 nt, Human
uuucuaaacgucuagagcucugaaaugucuugauggaagguauuaaacuauuugccuguuguac

SEQ ID NO: 426194 - RNA, 64 nt, Human
aaacugaacuuaugcuaggaaaccuuaaguauggggaagguagaaaguucauuucaucacuuag

SEQ ID NO: 426195 - RNA, 64 nt, Human
ugcagaagacugacuguggaugugccauuugccaggaagguaucuaacuuggcuuugugccuga

SEQ ID NO: 426196 - RNA, 64 nt, Human
uuugguggaagcaguagcccaaccccaguuuaggggaagguagcacagggcagagccacugggc

SEQ ID NO: 426197 - RNA, 64 nt, Human
ggcaucuacacagccuggacuuugguucucuccaggaagguagcccagcacugugaagacccag

SEQ ID NO: 426198 - RNA, 64 nt, Human
caucacuccaaaucccaccccagugcaagucuggggaagguagggugugagcugcugcugaagg

SEQ ID NO: 426199 - RNA, 64 nt, Human
acuaaccauauuauuuauggaauaauuagcaugaggaagguauaauugcauuuuuuuuuuuuug

SEQ ID NO: 426200 - RNA, 64 nt, Human
uuggaucagcauuuuguaaaaacaaccaaaaucaggaagguaaauugguugcuggaagagggau

SEQ ID NO: 426201 - RNA, 64 nt, Human
aggacucuggggggacguugagaagaggggugugggaagguaaagaaacuugcuggacaaguca

SEQ ID NO: 426202 - RNA, 64 nt, Human
gugcaguggcucaggccuguaaucccaacccuuuggaagguaaagacgggaggaucacuugagg

SEQ ID NO: 426203 - RNA, 64 nt, Human
ugauuuuuucuuauaugcuguugcagauauauguauaugcuaaaauauaacuugcaaagauguu

SEQ ID NO: 426204 - RNA, 64 nt, Human
uuuccauagaauuuaguuauuuuaucuuucagccauaugcuaguuuuuuuuucucuugccaaca

SEQ ID NO: 426205 - RNA, 64 nt, Human
uaaaauguuauaaaugugaaguuauaaaauaaauauaugcuaauaaaauccugaguuuuucugu

SEQ ID NO: 426206 - RNA, 64 nt, Human
gugacucuuggagauuaaaggacagggcauugauggaagguaagggccaggagaagaggccuuu

SEQ ID NO: 426207 - RNA, 64 nt, Human
auaaauaaaaauacaaagagguggguaaggaguaggaagguagagagcaccacugaugaggccc

SEQ ID NO: 426208 - RNA, 64 nt, Human
uucuggguccagacuuuccccagguagggaaagcggaagguagaaggcuuuuuuugcuggcucu

SEQ ID NO: 426209 - RNA, 64 nt, Human
cccuucccccagaaggcuacuuccuuguuuuagaggaagguacugcccauugggagauggggac

SEQ ID NO: 426210 - RNA, 64 nt, Human
aggguuuaaaacugugaggaaggagaaguaugaaggaagguagaaaaugcuggugggucuccgu

SEQ ID NO: 426211 - RNA, 64 nt, Human
gggagauuagaucaguuuucucuuaauaugucaaggaagguagccgggcauggugccaggcacc

SEQ ID NO: 426212 - RNA, 64 nt, Human
cucuuccucccuccucuuucacauauagcacaggggaagguaaaauggaagggcugcuaauuga

SEQ ID NO: 426213 - RNA, 64 nt, Human
gacgaugcuuuaaagccuccgauccauguuccauggaagguacaucagcaauuaauucuagagc

SEQ ID NO: 426214 - RNA, 64 nt, Human
uuccuccccauucucucacuuuaagugacauugaggaagguauucugucccacagguuucugug

SEQ ID NO: 426215 - RNA, 64 nt, Human
acacauccacaugguucaaaaauccaagcagcguggaagguaauucucaccccugcccugguuc

SEQ ID NO: 426216 - RNA, 64 nt, Human
gucaacauauuuugucccauuuucaggcccuguuggaagguaucuauacugaauuaccccaacc

SEQ ID NO: 426217 - RNA, 64 nt, Human
uucaggguccccugcccuucuaucugggagcuagggaagguaugggggaggaaagagaauggau

SEQ ID NO: 426218 - RNA, 64 nt, Human
aggcccaauaaaugaacaaauguacauacacucaggaagguaguacaagauacuccauacaaca

SEQ ID NO: 426219 - RNA, 64 nt, Human
aucagagaagcauggaagaugccaaaggauuuuuggaagguaaagaaggcugaauagugaccac

SEQ ID NO: 426220 - RNA, 64 nt, Human
augaggagaagaauuaccuuuugacaaucuguuaggaagguaugcagugugagaacugaaguau

SEQ ID NO: 426221 - RNA, 64 nt, Human
uucauuauauaaaauuauuauaucuauauaugacauaugcuaaaauuucuuggagaguguuaau

SEQ ID NO: 426222 - RNA, 64 nt, Human
cacuugcaccugguacugcacauuuuguacaaagauaugcuaagcaguagucgucaaguugcag

SEQ ID NO: 426223 - RNA, 64 nt, Human
auucauucauucaucgaguaacuuuaaaaaaaucauaugcuauguucccaguccuggggagcuu

SEQ ID NO: 426224 - RNA, 64 nt, Human
auuugggcuuaaaagugaacauaaauuauagaguggaagguaagggacaaaagccuuuuaccuu

SEQ ID NO: 426225 - RNA, 64 nt, Human
acagacaauuuugauugucacacugggucggguaggaagguaugcugcagacauuuggugggua

SEQ ID NO: 426226 - RNA, 64 nt, Human
uggguugcagcuuaugacaugcaugauagguuuuggaagguaacuuuuaacugcaaaccuauaa

SEQ ID NO: 426227 - RNA, 64 nt, Human
ucauauguacaguauauaaacauaaaacacacaaggaagguauuauguaugcaguaguauacua

SEQ ID NO: 426228 - RNA, 64 nt, Human
aaugauuacuggucaugcuccugugaguuuuuugggaagguagggucauuucucccugccugcu

SEQ ID NO: 426229 - RNA, 64 nt, Human
cacggcccagcacaaccccuagagcaggaaagagggaagguacagggguccucucagccuugaa

SEQ ID NO: 426230 - RNA, 64 nt, Human
uucaucuucacguauggaugcuagugccuuuaauggaagguaaagaauguuuugcuaguuagaa

SEQ ID NO: 426231 - RNA, 64 nt, Human
aauuuuugaaaguagggugauugaguacuaacuaggaagguauuaacaccacuuuguaguuguc

SEQ ID NO: 426232 - RNA, 64 nt, Human
ucuucucccaagcacaagaaguccuggagucuuuggaagguagucugaauagaaggguuuucag

SEQ ID NO: 426233 - RNA, 64 nt, Human
caacagccuucucagccucugcuauuuccuuugaggaagguagaagugaguuuccauguuugca

SEQ ID NO: 426234 - RNA, 64 nt, Human
gguuuuuauuuuuuuuuuccuaucucauuagguuggaagguacuaaauauugaacuguuaagau

SEQ ID NO: 426235 - RNA, 64 nt, Human
agcagaagcaccuucagccacagccuuauaaaagggaagguaaauggcauaaauauggucgcac

SEQ ID NO: 426236 - RNA, 64 nt, Human
cugugggacgaagaccgggcacccgccagagaggggaagguaccagguugcguccuuucaggcc

SEQ ID NO: 426237 - RNA, 64 nt, Human
cagacuuguagguaaaugggaacuuagaagguuaggaagguaaccccuguuuuguuuacuaagc

SEQ ID NO: 426238 - RNA, 64 nt, Human
gaaauaucuuucugagcuggcgaguuagaagaauggaagguaaggggaaggucugucaucuacc

SEQ ID NO: 426239 - RNA, 64 nt, Human
cugaggaugaucgaagaacuggcuuuacuuaaaaauaugcuaauucucagaaaggcaaguagau

SEQ ID NO: 426240 - RNA, 64 nt, Human
aacucuuuaacaggcaauuauauugcuggccaaaauaugcuauauuuguauacaaagacauucu

SEQ ID NO: 426241 - RNA, 64 nt, Human
aaauauuguuagauuaguucucauuaaauuuauuauaugcuaaagaauaaaacuccaguuagau

SEQ ID NO: 426242 - RNA, 64 nt, Human
acuagaaauagagacugagagugagcaaccagcuggaagguacuaugccaguccuagcagaaaa

SEQ ID NO: 426243 - RNA, 64 nt, Human
aacugcuggauuugguucucauugguccagacgaggaagguauccagccucaagucaucauugu

SEQ ID NO: 426244 - RNA, 64 nt, Human
uuuucacuuuccuggaagaucgaugucccgaucaggaagguagagaguuuuccuguucagauua

SEQ ID NO: 426245 - RNA, 64 nt, Human
auggugcacaccuguaguccuccaugaggacaugggaagguaggaguugccgcccugggggagg

SEQ ID NO: 426246 - RNA, 64 nt, Human
uuucuaaaacgcucugacagaugcaaguggugguggaagguagucugagccacugccuuuccca

SEQ ID NO: 426247 - RNA, 64 nt, Human
ggggggucauagccacaggggagggcaguucccaggaagguaaccagaugucucuuuuguguuu

SEQ ID NO: 426248 - RNA, 64 nt, Human
aguuuuguuguuguuguuguuuuguuuuggauggggaagguaguuuuaauuuggcaaguguugc

SEQ ID NO: 426249 - RNA, 64 nt, Human
ugggaggcaagcacaucugggcuucuuguggaggggaagguagagugaaagaaagagggcccac

SEQ ID NO: 426250 - RNA, 64 nt, Human
aaacuugaaucugucccucgugacaauuauaggaggaagguauuuaaaaccccagauuuaugaa

SEQ ID NO: 426251 - RNA, 64 nt, Human
ucuucacaugcacauguugcaacaagagcuucugggaagguaagcggcaucggagcuagaucac

SEQ ID NO: 426252 - RNA, 64 nt, Human
uagggaaacacugggauucuuucuuagcugugggggaagguauuugguuagaugacuuugaaug

SEQ ID NO: 426253 - RNA, 64 nt, Human
agcccaccaaucugcccuuugcagugugcaggguggaagguaagagguugguguggaguugggg

SEQ ID NO: 426254 - RNA, 64 nt, Human
ucuguggguggccugcacucuaccaagaaacacaggaagguauuccagugugugugugugugug

SEQ ID NO: 426255 - RNA, 64 nt, Human
gaggaauuagccugcaagguuaggacuugaagagggaagguauuuaauaacugggcgaggaugg

SEQ ID NO: 426256 - RNA, 64 nt, Human
uagcucgggccaagcggccaucggucuccuucgcggaagguaccaaguuugcaccacagagucg

SEQ ID NO: 426257 - RNA, 64 nt, Human
gcuucaauauuuuucuaaagaaauuacaggugggauaugcuagaaaaggcauuuugggguuaug

SEQ ID NO: 426258 - RNA, 64 nt, Human
caaauuuuuuuaaaaaaaauuaaugguuuuaaauauaugcuauagggacguuccaugcccaggu

SEQ ID NO: 426259 - RNA, 64 nt, Human
augaaauaaaagcaucuuagguuauaccaucuuuauaugcuauugcguuucaauauuuaagauu

SEQ ID NO: 426260 - RNA, 64 nt, Human
ccaggagcauagaagccacaucguugagacaucaggaagguaaaaacccagcggcuuagccaag

SEQ ID NO: 426261 - RNA, 64 nt, Human
ggccccgcugcgugcucagacucacagccaaccuggaagguagacgagauagcgccacccacgc

SEQ ID NO: 426262 - RNA, 64 nt, Human
uuggggguaguuggaagggacugaaauuguggggggaagguaggaggcacaucaauaaagagga

SEQ ID NO: 426263 - RNA, 64 nt, Human
uaaaccaccgucgugaggcauuuaccuguuggauggaagguagacagcaacaagauuuuaauca

SEQ ID NO: 426264 - RNA, 64 nt, Human; identical to SEQ ID NO: 426251

SEQ ID NO: 426265 - RNA, 64 nt, Human
uuuaagguaaucauacaaaaggucuauacauacaggaagguauauauugucucaaugcaaucaa

SEQ ID NO: 426266 - RNA, 64 nt, Human
ugccagucaggcacagcagaaaccuacaacucauggaagguaaagaaccugcaacuggagccaa

SEQ ID NO: 426267 - RNA, 64 nt, Human
ucuucacaugcaccuguugcaacaagagcuucugggaagguaaguggcauuggagcuagaucac

SEQ ID NO: 426268 - RNA, 64 nt, Human
aguuuggguuaguuucaaaugugauauuuuggagggaagguaaaguagguaucuuucaggucgu

SEQ ID NO: 426269 - RNA, 64 nt, Human
acgugccugaaacugaaaccaugugcacuuuaauggaagguaagcugaacuucuuucuuuucaa

SEQ ID NO: 426270 - RNA, 64 nt, Human
aaaagaaagugaaaguuuuacaaguuagagggauggaagguaauguuuaauguugaugucaugg

SEQ ID NO: 426271 - RNA, 64 nt, Human
auaaaaacuugcccuucccuggcugacccagucgggaagguagggaaggaggucucccguuggg

SEQ ID NO: 426272 - RNA, 64 nt, Human
cccuuagcaccugucccccugccugucuccagugggaagguagccuggccaggcggggccuccc

SEQ ID NO: 426273 - RNA, 64 nt, Human
uuuucucaucugcagaaugggagcggugggggugggaagguaaggauggucguggaagaaggca

SEQ ID NO: 426274 - RNA, 64 nt, Human
ucuuaggcuuuaggacugggacuucggcuagggaggaagguagaguaagagguugaagauaaca

SEQ ID NO: 426275 - RNA, 64 nt, Human
uucuacaauuuugaucagugguauuuaagccuguauaugcuaaguguauuuaugccccuuugag

SEQ ID NO: 426276 - RNA, 64 nt, Human
agacaaccagaauaucaagaaaauguauauaggaauaugcuacuugccuccucccugcauuucc

SEQ ID NO: 426277 - RNA, 64 nt, Human
aauagccaaagccuggaaaugaucucacuuuacaauaugcuaaaauugauaaauaauuugugcu

SEQ ID NO: 426278 - RNA, 64 nt, Human
uuaaaggaugauagagaccaucagauagaagcagggaagguagauaacuuuuaggaccuugaug

SEQ ID NO: 426279 - RNA, 64 nt, Human
ccaauuuuaaagaaguauguguauauuuaauaggggaagguaguuuauggaaauauuuuuaaug

SEQ ID NO: 426280 - RNA, 64 nt, Human
aaacuugcugugaaaacacuuugauuuucuaagaggaagguacuuuaaguuccagaaugaacau

SEQ ID NO: 426281 - RNA, 64 nt, Human
ggacacccaaaacacugcuugugagaaggaagauggaagguaaguucugucguucuuuccccaa

SEQ ID NO: 426282 - RNA, 64 nt, Human
aaauuguuuauacacucuuuccuccaugagcucuggaagguauaugcaucuucuguaauacuca

SEQ ID NO: 426283 - RNA, 64 nt, Human
ggccucuacgauguuuuuucuugguccaccuuuaggaagguauugagaagcaagaaacuggagg

SEQ ID NO: 426284 - RNA, 64 nt, Human
auguacagaaaccugugauauuuauacccuuguaggaagguauagacaauggaauugugaguag

SEQ ID NO: 426285 - RNA, 64 nt, Human
ccccugguggccuucaguuucaguuucucauccaggaagguaaccuugggcauuggcagugggu

SEQ ID NO: 426286 - RNA, 64 nt, Human
caccccccaccuaggcuuuuuggguuuuguucaaggaagguaaagugagagguuuaggucagug

SEQ ID NO: 426287 - RNA, 64 nt, Human
ucuaaagugucccgcggaguacagauaauauucuggaagguaacuguuuacuacgacagagacg

SEQ ID NO: 426288 - RNA, 64 nt, Human
uuaggggcaggagacagacacguaacaggaacucggaagguagaacuuagaauucagaacuugg

SEQ ID NO: 426289 - RNA, 64 nt, Human
caucgccagucgucuucugccacaaugacauccaggaagguaggagaaggcaucugagucuccu

SEQ ID NO: 426290 - RNA, 64 nt, Human
cuuuguggcccaugaaagucuuacugggcccuggggaagguauccuacccuggugaagcagcug

SEQ ID NO: 426291 - RNA, 64 nt, Human
cuccucuccaggggccuggaaacacuaggauucaggaagguaggcaggacgugagagaagggag

SEQ ID NO: 426292 - RNA, 64 nt, Human
uucaacagcuacauuauauuuccuucugacacuuggaagguauugaaauuucuagaaauguauc

SEQ ID NO: 426293 - RNA, 64 nt, Human
ugcacaccacaauaaauguaccaccacacacggaauaugcuaagaaaacuaucagauagcguuu

SEQ ID NO: 426294 - RNA, 64 nt, Human
ccauuuuccacuuuuauagaccauccuuuugcuuauaugcuagauuuuucuggugagggaaggg

SEQ ID NO: 426295 - RNA, 64 nt, Human
guaagccuaauauaaacuugauuuuuauuuuaacauaugcuauuucuggauagagaugacuauu

SEQ ID NO: 426296 - RNA, 64 nt, Human
agugauuucuccuguuucuuggugggggugggggggaagguacguauucugcaauauggcuaaa

SEQ ID NO: 426297 - RNA, 64 nt, Human
gagagauugaauuuaagcuugucaagcacguacuggaagguaugaauuacacuaccauguguuu

SEQ ID NO: 426298 - RNA, 64 nt, Human
aacauauaacacaaugugguaguaguagguguaaggaagguaaguuuuuucauagugguaugca

SEQ ID NO: 426299 - RNA, 64 nt, Human
uucugacugaucucagcauuaccucuuuggaaaaggaagguaguucaagaaaugaagagcuguu

SEQ ID NO: 426300 - RNA, 64 nt, Human
uuuauucaaacugaaaagcugagaccaagagcaaggaagguaaaaaguuaacaggcaaacauuu

SEQ ID NO: 426301 - RNA, 64 nt, Human
aaacgugugcauucuuacugaaaauguuuucaaaggaagguaucagcugugggcuaauugccac

SEQ ID NO: 426302 - RNA, 64 nt, Human
gggugaccucucucuuuggucuaagaguucuaaaggaagguaggcaucuguuuaauuaguuggu

SEQ ID NO: 426303 - RNA, 64 nt, Human
ccgaaucgucgugcugacauugagucacggaugaggaagguacaaguccuuuaagaucaaaacu

SEQ ID NO: 426304 - RNA, 64 nt, Human
ucuucucuucaaauaaucuuugauagauaaaaauggaagguaagauguuucuagauagaauguu

SEQ ID NO: 426305 - RNA, 64 nt, Human
ggccacccgcacaaaauucacccagagggaaaucucgucggaaggacacucacggcaguucugg

SEQ ID NO: 426306 - RNA, 64 nt, Human
cugaacuagaagcuuuugaaaacagacugaagggucgucggaagaagaacaggaaaagagauga

SEQ ID NO: 426307 - RNA, 64 nt, Human
aaaguaagcagggcuggcuucgcccgcguucucgucgucggaucaaggagcgcggcggcguuuu

SEQ ID NO: 426308 - RNA, 64 nt, Human
ucccuguuugcagcgaggccuugucucucauccaucgucggagggcaacaucucagcaccuggu

SEQ ID NO: 426309 - RNA, 64 nt, Human
gguggcgccuucccucaacugcagucaaaagaccucgucggaguugggcaaggggccgcuggcu

SEQ ID NO: 426310 - RNA, 64 nt, Human
cccaccccgcuucucagugggcucuaugcuugccucgucggagucaccccucaggcaguccugg

SEQ ID NO: 426311 - RNA, 64 nt, Human
gauauaauguucuuuuuaaacaaguauaaucauaucgucggagguuaagauuaugaaauuuuag

SEQ ID NO: 426312 - RNA, 64 nt, Human
ccuggaagccugaagcaggcagggccgguggacuucgucggaugaagagugauccuccuuccuu

SEQ ID NO: 426313 - RNA, 64 nt, Human
uuccuccucccccugcagguuucugucugcgucgucgucggagggauuacuggggagugcgcug

SEQ ID NO: 426314 - RNA, 64 nt, Human
cacugugaugucaucgggaaaugaucucccaagucgcugccagacaccacccacugcuucgccg

SEQ ID NO: 426315 - RNA, 64 nt, Human
uagaacugguuuuaaccuuuagcugcagcggcuacgcugccacguguguauauauaugacguug

SEQ ID NO: 426316 - RNA, 64 nt, Human
caaaccaccacagucucugucacacccccacuaccgcugccacgcccucugaaucaugcaggga

SEQ ID NO: 426317 - RNA, 64 nt, Human
gcccccuuacugggcuuggauauugaggaccagacgcugccaaaucuaggacaagacagaccau

SEQ ID NO: 426318 - RNA, 64 nt, Human
cucccaaaguacagggauuagaguugugagccaccgcugccagcccagaguuacccucuaaaga

SEQ ID NO: 426319 - RNA, 64 nt, Human
ugugcagccugggacaaaacuguuuccgguuggccgcugccacauggauuuucuuaaucguuuu

SEQ ID NO: 426320 - RNA, 64 nt, Human
cuguaacugcugagccacucgcagucgcaggauccgcugccaccacgucugccaggcccaucuc

SEQ ID NO: 426321 - RNA, 64 nt, Human
uuccuuguaagcaagucagcagcacagcuacucacgcugccaucuggacuuauuuuaugucaau

SEQ ID NO: 426322 - RNA, 64 nt, Human
gacccaggggagccagcgcugccaccccacccagcgcugccagggagccgccauccgagcuuga

SEQ ID NO: 426323 - RNA, 64 nt, Human
ccggaacagccaggccaugacccaggggagccagcgcugccaccccacccagcgcugccaggga

SEQ ID NO: 426324 - RNA, 64 nt, Human
cgugcguuauccagcccgcccggccuggcccggacgcugccaucucucuuucugggaguuuaga

SEQ ID NO: 426325 - RNA, 64 nt, Human
uuuugucaucugccuucccgcuuaucaaggagaccgcugccauucugcuacagauggucccaaa

SEQ ID NO: 426326 - RNA, 64 nt, Human
uuaguguacacguuuguauuuuuguuaauauagccgcugccauaguuuucuaacuugaacagcc

SEQ ID NO: 426327 - RNA, 64 nt, Human
uauaccauggagauguggugcccaaggaugucaacgcugccauugcugccaucaagaccaagug

SEQ ID NO: 426328 - RNA, 64 nt, Human
guccaugcgcucagggccaugcugaggccugggccgcugccacguuggagaagcccgugugaga

SEQ ID NO: 426329 - RNA, 64 nt, Human
auauauaaaaaagccacuggaaugaaaacuuccuauaugcuaugcuguugucuuauuauuauau

SEQ ID NO: 426330 - RNA, 53 nt, Human
aaugcaaaaggaacaauuaauauauaugcuacuggacauucuagcaagguaau

SEQ ID NO: 426331 - RNA, 64 nt, Human
uauauuucccuuggaagagagcauuugugguacaauaugcuaugugccaaaugagugauaagau

SEQ ID NO: 426332 - RNA, 64 nt, Human
aaaauaccuaaauuuuggaugagaaaaugauaaaauaugcuaaguucuaggcuggaaauaaggg

SEQ ID NO: 426333 - RNA, 64 nt, Human
gcgcugcggugucaccucugugcccgacaucagacgcugccagcugacccccaaugacagguaa

SEQ ID NO: 426334 - RNA, 64 nt, Human
caguaaucuuucggucuccuuaaacuaccacccucgcugccacccaccccaagcugcugccgcc

SEQ ID NO: 426335 - RNA, 64 nt, Human
uggagcuguuugggaauuuuccuugcugcuaccgcgcugccaccaaauggaauugaccagcggc

SEQ ID NO: 426336 - RNA, 64 nt, Human
cugacagcaggcaagcuucaguuugggcuguggacgcugccacacaagccugaguagagcccau

SEQ ID NO: 426337 - RNA, 64 nt, Human
cgacucccaccuccagcacccaugcccgcugcaccgcugccauccucagauucaccgcgugcuc

SEQ ID NO: 426338 - RNA, 64 nt, Human
ucgaugggagggaguggcaggcaggagaagguggcgcugccaggugcccgggucuauuggaggc

SEQ ID NO: 426339 - RNA, 64 nt, Human
acccucucgccugcccgcccgcccucauggaccccgcugccacccgcuuuccgggcacccaucc

SEQ ID NO: 426340 - RNA, 64 nt, Human
ggaugcugccacaucugggcauacagugucuggacgcugccacaucugggcauacagugucugg

SEQ ID NO: 426341 - RNA, 64 nt, Human
aggucugauauguuggccccuucuauggaaacaacgcugccaaauccuggagcaaaaccugaag

SEQ ID NO: 426342 - RNA, 64 nt, Human
cuugauuuugucugccacagacaucccacaaagccgcugccauuuuauuaaaguguuuugaucc

SEQ ID NO: 426343 - RNA, 64 nt, Human
ggugccaccucgaggucugcacaggaggacuuggcgcugccauuuccuaccccugccauuuccc

SEQ ID NO: 426344 - RNA, 64 nt, Human
cugucuuuguguuagauccagaguugucggcagccgcugccauuguucucauucgugguaugca

SEQ ID NO: 426345 - RNA, 64 nt, Human
cucagccuccuggguagcugggauuacaggcacgcgcugccacacccagguaauuuauuuauuu

SEQ ID NO: 426346 - RNA, 64 nt, Human
agauguuuguauauuuugucaguaacuaauacugcgcugccaucauggugacugucaugguucu

SEQ ID NO: 426347 - RNA, 64 nt, Human
gccgcuuuugcaaaagccaagguaaagccaggaucgcugccaaguuguuugcacucuuuggagu

SEQ ID NO: 426348 - RNA, 64 nt, Human
cccucuuggugaauuauuacacuguaagaaauguauaugcuacuguguuacauguuguauuagu

SEQ ID NO: 426349 - RNA, 64 nt, Human
ucuccacucacaugcugauauacuuucuacuacaauaugcuauagcuuuauggaacucagggug

SEQ ID NO: 426350 - RNA, 64 nt, Human
agcuaugacagaguaggaauugagaaauuauuucauaugcuacaguauugaaauguggaugcug

SEQ ID NO: 426351 - RNA, 64 nt, Human
aaacugccaucauuuacuuuuaaacuuugauuuuauaugcuauuuauuaaguauuuuauuagga

SEQ ID NO: 426352 - RNA, 64 nt, Human
cacucccugcuuccgcagggcgccccucaguauucgcugccauaugucccuguccuccaggcug

SEQ ID NO: 426353 - RNA, 64 nt, Human
ggggggagagcacggguccccgucugacaguggccgcugccauauucagguguagcuaauugcu

SEQ ID NO: 426354 - RNA, 64 nt, Human
cugucagcccugguuuccauggugacuggcgucacgcugccacccgaguauggcugaccuuccu

SEQ ID NO: 426355 - RNA, 64 nt, Human
gaacuuggacuccugggaacauggacaagcccggcgcugccacgccggggccuccaccgccugg

SEQ ID NO: 426356 - RNA, 64 nt, Human
ggguggcuuuuagagacccagacuugguuggcagcgcugccauggaacaccccagcaagcaccu

SEQ ID NO: 426357 - RNA, 64 nt, Human
ggacacaugccuuaaaaaaggaggggaggaaccacgcugccaccaaagcagccggaagugccuu

SEQ ID NO: 426358 - RNA, 64 nt, Human
ugaccaggaacccuaaagcauccagaguagacugcgcugccacugcgcacaugcuggugcccgu

SEQ ID NO: 426359 - RNA, 64 nt, Human
ugucagcugugguucuuauuugacuaaggcucugcgcugccauuuugucaaugacagaaagauu

SEQ ID NO: 426360 - RNA, 64 nt, Human
gcccucuggaguggccacuaagcagaggaggggccgcugccacccaccucccugccuccaggaa

SEQ ID NO: 426361 - RNA, 64 nt, Human
ccaggaccaagggcagaggggugcucauagcgggcgcugccagccccgccacgcuugugucuuu

SEQ ID NO: 426362 - RNA, 64 nt, Human
gcgaguucagcacugcggggugcgacuagggcugcgcugccagggucacuucccgccuccuccu

SEQ ID NO: 426363 - RNA, 64 nt, Human
caucacaccccauuuccuccucuuucccucuccccgcugccaaaaaaaaaaaaaaaggaaacgu

SEQ ID NO: 426364 - RNA, 64 nt, Human
cacaaguccugagaagggcccccugagguguggucgcugccaagcaucaguguuagggcugggg

SEQ ID NO: 426365 - RNA, 64 nt, Human
ccugcacccacugcccugaccuuccugcuucccacgcugccaucucugccagggugccacaugg

SEQ ID NO: 426366 - RNA, 64 nt, Human
cccaaggugccuggggcaggcgggcaccgucauucgcugccauuggcuucucagauguauuuca

SEQ ID NO: 426367 - RNA, 64 nt, Human
uugggagaaauuuuauaauuuuuuauugguaaacauaugcuaaauccgcuucaguauuuuauua

SEQ ID NO: 426368 - RNA, 64 nt, Human
uauguauuuacuauccuuuuucuaauauauuaauauaugcuacauuuguauuugcauuacuaua

SEQ ID NO: 426369 - RNA, 64 nt, Human
cuaaauuaaaccaaacccuauugaagaauugaauauaugcuacuucaagaaacuaaauugaucu

SEQ ID NO: 426370 - RNA, 64 nt, Human
caucaugagagaucaaaaauccauuuugccuuacauaugcuaagaagcguggcauucuuucugu

SEQ ID NO: 426371 - RNA, 64 nt, Human
gacccgugggaggagaugccggggaccugggccgcgcugccaggaccucugcugugucucgccc

SEQ ID NO: 426372 - RNA, 64 nt, Human
ccuggggccuccccagcugcuggccagacccuggcgcugccacaguccuggcacugcccaaggc

SEQ ID NO: 426373 - RNA, 64 nt, Human
ugugguuacagugcagacaggccaugugagccaccgcugccagcacagagcguccuucccccug

SEQ ID NO: 426374 - RNA, 64 nt, Human
uuagucugaaccauagcugggcugcaguacccuacgcugccagcagguggccaugacuacccgu

SEQ ID NO: 426375 - RNA, 64 nt, Human
ggcccugccucccucccagcagggaaaccccgcccgcugccaggccauccucucugccagaggc

SEQ ID NO: 426376 - RNA, 64 nt, Human
cugagggccuggcuucucacugccaccucacacccgcugccagagcccaccucuccuccuaggc

SEQ ID NO: 426377 - RNA, 64 nt, Human
aaggucaugugcuuccaccccuggucggauguaacgcugccacucaugucggucccugagaucc

SEQ ID NO: 426378 - RNA, 64 nt, Human
agcugugccgccuucuuguccuccuccucauugucgcugccaaacaggucagugucaucaucgu

SEQ ID NO: 426379 - RNA, 53 nt, Human
caagaacauaccuaccuugagcccgcugccaucucuuguuaacugcaaagaau

SEQ ID NO: 426380 - RNA, 64 nt, Human
ugcgugguggcugucucuggaaagcaucccuugccgcugccaugggcagccccagcccccgucc

SEQ ID NO: 426381 - RNA, 64 nt, Human
uuucuggaguccugggaaggugucugccuggccgcgcugccagaucaguacaucuuuuguaaaa

SEQ ID NO: 426382 - RNA, 64 nt, Human
cuauauaacuauaaccacacgccguguagacacccgcugccacacacuacaggagucaauaaac

SEQ ID NO: 426383 - RNA, 64 nt, Human
agaggcucuuguuacuacccacuucauuccccaccgcugccagugccacugccaacccuguuca

SEQ ID NO: 426384 - RNA, 64 nt, Human
uccucuggggaacccuggagcuuggugagagugacgcugccaugggguugggucccugaggccu

SEQ ID NO: 426385 - RNA, 64 nt, Human
cccuugggcucccuguaaccucuucagaggcccucgcugccagcucuguaucaggacccagagg

SEQ ID NO: 426386 - RNA, 64 nt, Human
ugugauuuaagaaguggcuggauuggaacuuuuaauaugcuaauguggaaaauuaauuaccuuu

SEQ ID NO: 426387 - RNA, 64 nt, Human
uauuucuuuugcuuaaggaauaguucauauaaaaauaugcuaaagauaggauaaaagugagugu

SEQ ID NO: 426388 - RNA, 64 nt, Human
agaauuaaacaacaaacaaaacgcaaaacccaguauaugcuauucaaugaucuuagaaguacug

SEQ ID NO: 426389 - RNA, 64 nt, Human
uagaaccagugagaucuggaggaaugugagaagcauaugcuaaauguacauuuuaauuuuagac

SEQ ID NO: 426390 - RNA, 64 nt, Human
cugggacaugugcuaucugauaagauugggucaucgcugccaagguggagagcagugagcaagg

SEQ ID NO: 426391 - RNA, 64 nt, Human
aaaaggugcuccuuugccuggguuugaauuccagcgcugccacuuccucucugcaccuccuggc

SEQ ID NO: 426392 - RNA, 64 nt, Human
cagcaugaccuacccucgccucuuugaugccauccgcugccaccuccuuuugcuccuggacccu

SEQ ID NO: 426393 - RNA, 64 nt, Human
cuuucuggggccuagcgaucucuccuggccuauccgcugccagccuugagcccuggcuguucug

SEQ ID NO: 426394 - RNA, 64 nt, Human
gguucuuugaauucucccucuuugucaucucuuucgcugccacuucuggcuguggucacuagcu

SEQ ID NO: 426395 - RNA, 64 nt, Human
gaagcugaagauccccaacugcuccagccucugccgcugccaugcuuugaguccacgcccacca

SEQ ID NO: 426396 - RNA, 64 nt, Human
aucccacgauuccgaucgacugccaagcagcagccgcugccaggggcugcgucugacauccuga

SEQ ID NO: 426397 - RNA, 64 nt, Human
ggccagccuguuccacaggcaccccugcaggaggcgcugccaggagagccuuccaucucggggc

SEQ ID NO: 426398 - RNA, 64 nt, Human
gaggccuucggccugccugccugccugagguccccgcugccagucccgggcccuggagagcaga

SEQ ID NO: 426399 - RNA, 54 nt, Human
uggccaaccugcccuucuagaagucgcugccagggcuggagccggggcaauguu

SEQ ID NO: 426400 - RNA, 54 nt, Human
ucuacgucagcagccuguagugggcgcugccagaugcgggcuuuuuuuuauuug

SEQ ID NO: 426401 - RNA, 64 nt, Human
uguuuuuugugacuucauguguuccauugcuccccgcugccaugcucucucccuuguuuccuua

SEQ ID NO: 426402 - RNA, 64 nt, Human
cccugugaggaaccuccuuacccuguucuggaaucgcugccagacuguagcuuuuaauuuaaua

SEQ ID NO: 426403 - RNA, 64 nt, Human
gccccugagccagcugcccgugggggccccuucgcgcugccagccucccccaaccaccugcccu

SEQ ID NO: 426404 - RNA, 64 nt, Human
uagggagcguggagggcaucugucugccaucgcccgcugccaaucuaagccagucucacuguga

SEQ ID NO: 426405 - RNA, 64 nt, Human
auuuuuaaauuuucccuuaaaacacacuuuuggaauaugcuacaauauuacauguuuuuugucu

SEQ ID NO: 426406 - RNA, 64 nt, Human
cucccaaccuaccuaauaauuuguuaacuuaggaauaugcuaucauuguugacuuguucuuccu

SEQ ID NO: 426407 - RNA, 64 nt, Human
aaauuuaauuuuauauuuuuugaagaugauagcaauaugcuaaaaaaugcuuguccccuauaug

SEQ ID NO: 426408 - RNA, 64 nt, Human
gaauuuuuguuuguuagaacacccuucaguugcaauaugcuaaucccacuuuacaaagaauaua

SEQ ID NO: 426409 - RNA, 64 nt, Human
gggagcggagcugacguuggcugugcuuggucaccgcugccaugccgcagaggaugcgccuagc

SEQ ID NO: 426410 - RNA, 64 nt, Human
auucauucaaaggccuacacaguacaaaugagcacgcugccauguacugguuugagcaguaggg

SEQ ID NO: 426411 - RNA, 64 nt, Human
gacaaguggcgcugggguuucccucucccagaaccgcugccaccaccgccacgcccuccgcaga

SEQ ID NO: 426412 - RNA, 64 nt, Human
guugauugcuggaaacaaggcaguagugauucuccgcugccacugcuaccuuuuuuuuuuuuuu

SEQ ID NO: 426413 - RNA, 64 nt, Human
cccuuguagagcagcccgaccacaggagcauggccgcugccagcccagacgcugcugacgcugu

SEQ ID NO: 426414 - RNA, 64 nt, Human
gcagacgucugucaggggcuuggauuucgugugccgcugccacccgcccacccgccuugugaga

SEQ ID NO: 426415 - RNA, 64 nt, Human
ucaccaacuggccucuucaccuuccacauuaucccgcugccaccggcugcccugucucacugca

SEQ ID NO: 426416 - RNA, 64 nt, Human
ugcugaguugauaaacacucaagaaccucaggagcgcugccagcuugacacuggggaauccagc

SEQ ID NO: 426417 - RNA, 64 nt, Human
agacccuguguguaagcagaaccuccacucccuccgcugccaugaagcucauuucucccagaga

SEQ ID NO: 426418 - RNA, 64 nt, Human
ggaggaaggggcuugcaguuuucccagcccuucucgcugccaaggcagcaguggugcuguggau

SEQ ID NO: 426419 - RNA, 64 nt, Human
gugcagugacguggccugcggccgggcugcccuucgcugccaggacaccugccccagcgcggcu

SEQ ID NO: 426420 - RNA, 64 nt, Human
cugggcucagucuccucagggucugagaccccggcgcugccaccggaacccgccuucaggggcg

SEQ ID NO: 426421 - RNA, 64 nt, Human
cccacucagugacagacgaacacagcuaaggccucgcugccagccuucugacggcgggcgagca

SEQ ID NO: 426422 - RNA, 64 nt, Human
gcugcagccggcacacccagugguggagggccggcgcugccacucacgguggguggccgugggc

SEQ ID NO: 426423 - RNA, 64 nt, Human
gcagccagcgugcgggaacgggcaggcagccucccgcugccagucuucgcucuaacucccucgg

SEQ ID NO: 426424 - RNA, 64 nt, Human
aauuaauaaugaaauggaggggaauucuagaauuauaugcuaaaugcauauuuuaugauuugcu

SEQ ID NO: 426425 - RNA, 64 nt, Human
ucauggcuucaucucuaucuuuacuuucucuugaauaugcuacacaaaguucuuuauuacuaca

SEQ ID NO: 426426 - RNA, 64 nt, Human
ugaauggggauuaguuggugauuguuuguaacaaauaugcuaaugcuuuagaaaugucaguauu

SEQ ID NO: 426427 - RNA, 64 nt, Human
ccuccacuuccuucucugccccauugccucccaaauaugcuauggagcuauuuuuguuaccacg

SEQ ID NO: 426428 - RNA, 64 nt, Human
cccuggugcaggccaagcauuuuauacauacccucgcugccaggcugcucagagucccgcccac

SEQ ID NO: 426429 - RNA, 64 nt, Human
ugcugugaggaaaagaggaaucccuccuccagcacgcugccaggcggugguguucagaacccuu

SEQ ID NO: 426430 - RNA, 64 nt, Human
accgccuggcaguagccucuuuccagcuacacgucgcugccacaggccccuggaaaugcuaccu

SEQ ID NO: 426431 - RNA, 64 nt, Human
acagcagcagggaugucuaccagccaccucucaccgcugccauugagaagaugaaaaccaccca

SEQ ID NO: 426432 - RNA, 64 nt, Human
aagagaguggacgaugaggaggauacuguggccccgcugccaggacaucuguugggcccaggua

SEQ ID NO: 426433 - RNA, 64 nt, Human
gcuuuggcuuuagauuuaccaagccccgccuccccgcugccagugcccugcucucccguucgcc

SEQ ID NO: 426434 - RNA, 64 nt, Human
ggggacaagacaaagcucccgaugcugcauggggcgcugccagaucucacggugaaccauuuug

SEQ ID NO: 426435 - RNA, 64 nt, Human
gagagcacugggacgcccaccgccccuuucccuccgcugccaggcgagcauguugugguaauuc

SEQ ID NO: 426436 - RNA, 64 nt, Human
agaacugcaggccugcggcugggucuuaggcucccgcugccauuuggguaagccgguggcuggu

SEQ ID NO: 426437 - RNA, 64 nt, Human
uuggaagaggcugagacauucuucaccuccuuggcgcugccaccugccccacccaguuucugga

SEQ ID NO: 426438 - RNA, 64 nt, Human
gcagcggguggggcgccugggugguccccaaggucgcugccacccuugcccggggcagaggcag

SEQ ID NO: 426439 - RNA, 64 nt, Human
aaccaugauuuuaauacgcaagcuguuucuaaggcgcugccacuggggaggguggcuguugccg

SEQ ID NO: 426440 - RNA, 64 nt, Human
aacagcacucccuauccuuucccugaccccagaccgcugccaagccuguucucccccauuacaa

SEQ ID NO: 426441 - RNA, 58 nt, Human
acaagagcgacagcgacugagccgcccccgcugccacccaccccauuccucgcuccuu

SEQ ID NO: 426442 - RNA, 64 nt, Human
ggaggagcaggcugguggcacucuccugaccucacgcugccaaggugcgcccucgacucccgau

SEQ ID NO: 426443 - RNA, 64 nt, Human
aguauacuugaugugaagaugucaugcuaucacaauaugcuaagagcucacaaaaauaagauag

SEQ ID NO: 426444 - RNA, 64 nt, Human
gagcugauggagcugggagcuaaauaaggguauaauaugcuacuucuguguauguuguguaugg

SEQ ID NO: 426445 - RNA, 64 nt, Human
gagaaacugcagagcagcccugugacuuuacaaaauaugcuaccucaaagugcuaccgauaaac

SEQ ID NO: 426446 - RNA, 64 nt, Human
gagacauaauccuccuguuauacucaguaucauuauaugcuagucaaccugauucacuaacaca

SEQ ID NO: 426447 - RNA, 64 nt, Human
cuucccagccuggcccuggcaaggggcgggugggcgcugccaggcgggugcuucucgacgcacu

SEQ ID NO: 426448 - RNA, 64 nt, Human
uugagaggaucagagcccauugcacaagaagagccgcugccaaccauccuuguccuccgauugc

SEQ ID NO: 426449 - RNA, 64 nt, Human
cccuaacccccaccucccggcccugagcgugugucgcugccauauuuuacacaaaaucauguug

SEQ ID NO: 426450 - RNA, 64 nt, Human
cccagugcccaguagcacagcugccagccccaaccgcugccauuucacacucacccuccacccu

SEQ ID NO: 426451 - RNA, 64 nt, Human
ugcuagagaacagguccacccuggcucugggacucgcugccaggggcugccacacuccugaaug

SEQ ID NO: 426452 - RNA, 64 nt, Human
gcccaccacgaccccucacaccuccugcugccgucgcugccaucuugccccuagccugggggcu

SEQ ID NO: 426453 - RNA, 64 nt, Human
cugccgguggugaccuggguuggauggcagagaccgcugccaucaucacagacgccuccuuccu

SEQ ID NO: 426454 - RNA, 64 nt, Human
uccagccgcugccagucgggacuuggucgcccggcgcugccagaaugcuccacugccagccggc

SEQ ID NO: 426455 - RNA, 64 nt, Human
cgccagccuucgcuucugaaaaccaaacuccagccgcugccagucgggacuuggucgcccggcg

SEQ ID NO: 426456 - RNA, 64 nt, Human
ccucccuccuggcgggucuccuccagccucacuucgcugccacuucgccgcugccccggagacu

SEQ ID NO: 426457 - RNA, 64 nt, Human
uuuuccuuaaaagaggccuuaauccccgagcccccgcugccagggcagagggaggagggggcac

SEQ ID NO: 426458 - RNA, 64 nt, Human
ccagccccugguggccaggcuccccuugcugagccgcugccacuucacccugugggaaguggcc

SEQ ID NO: 426459 - RNA, 64 nt, Human
acgacccuaccuugaaggcccccacaaauaaaggcgcugccacucagcccuccuuccaccuggg

SEQ ID NO: 426460 - RNA, 64 nt, Human
agugagcagucugcccacgcagaggacgcacgcucgcugccaucaccgcugggugguuuuuucc

SEQ ID NO: 426461 - RNA, 64 nt, Human
acuccugggagggacugccucaccaccccugucccgcugccagaaauacacccacaauaaaaac

SEQ ID NO: 426462 - RNA, 64 nt, Human
ccuagacagguacgucuguuuuuuauuuuaaaagauaugcuauguagauauaaguugaggaagc

SEQ ID NO: 426463 - RNA, 64 nt, Human
ccccccaguauaugccgcauuguacugcuguguuauaugcuauguacaugucagaaaccauuag

SEQ ID NO: 426464 - RNA, 64 nt, Human
uucaggccugugcauguguguacagcaggagguaauaugcuauaaugucugcuguaauauauuu

SEQ ID NO: 426465 - RNA, 64 nt, Human
agcugagaaacuuuuuuuaaacuuaagcauugucauaugcuauuuuuuaaaauuuggcuuuccu

SEQ ID NO: 426466 - RNA, 64 nt, Human
agcccaggaaagccccccucacugucccugguaccgcugccaacacccauugaccuccucguuu

SEQ ID NO: 426467 - RNA, 64 nt, Human
guugacagaacucacuccucuguccuaugaagaccgcugccauugguguugagaauaauaaagc

SEQ ID NO: 426468 - RNA, 64 nt, Human
aagauggaaaugcuggaaaugauacuggcgcucacgcugccauccgaccacccucggcucccga

SEQ ID NO: 426469 - RNA, 64 nt, Human
gcaugcacucucagguuccccauagugucucccccgcugccacccacaaacagacacacaugcc

SEQ ID NO: 426470 - RNA, 64 nt, Human
cccaccuugaaucccuaauuagauuaaggaauagcgcugccauuuucuaaaccgugaugcgguu

SEQ ID NO: 426471 - RNA, 64 nt, Human
uuucugaagucucaagaacugccauaaaaucucacgcugccauuucccugaacagauacauaca

SEQ ID NO: 426472 - RNA, 64 nt, Human
acccaaggccucugcuucccgccgccacccuccucgcugccauucucugggcuggaaugugaag

SEQ ID NO: 426473 - RNA, 64 nt, Human
cagaagguccacauggcagggcugccuggaacaccgcugccacuguggcuccaggaggcccuug

SEQ ID NO: 426474 - RNA, 64 nt, Human
ugaccuccgcaucccucagagcucagaggguccucgcugccaccggucccccccuagcccguca

SEQ ID NO: 426475 - RNA, 64 nt, Human
uaccaggccucgcgauaaaaacaaaacaaaaaaacgcugccagguuuuagaagcaguucugguc

SEQ ID NO: 426476 - RNA, 64 nt, Human
ccagccaguacuccaggucucccugucucucccccgcugccauuuugauaguauaaucuauuuu

SEQ ID NO: 426477 - RNA, 64 nt, Human
aauggguuugcuuuuucccuuuuccuacagacguauaugcuagaugucacgugaucaucagaaa

SEQ ID NO: 426478 - RNA, 64 nt, Human
ucagcuuuggaccacaauaauuucacuguagaugauaugcuaggaucaaaguuaaacagcauuc

SEQ ID NO: 426479 - RNA, 64 nt, Human
cuuaagcagaacaagggaagauugauauuuuuggauaugcuauagcagcuuucuccuaugaaau

SEQ ID NO: 426480 - RNA, 64 nt, Human; identical to SEQ ID NO: 40787

SEQ ID NO: 426481 - RNA, 64 nt, Human; identical to SEQ ID NO: 40788

SEQ ID NO: 426482 - RNA, 58 nt, Human; identical to SEQ ID NO: 40789

SEQ ID NO: 426483 - RNA, 64 nt, Human; identical to SEQ ID NO: 40790

SEQ ID NO: 426484 - RNA, 64 nt, Human; identical to SEQ ID NO: 40791

SEQ ID NO: 426485 - RNA, 64 nt, Human; identical to SEQ ID NO: 40792

SEQ ID NO: 426486 - RNA, 64 nt, Human; identical to SEQ ID NO: 40793

SEQ ID NO: 426487 - RNA, 64 nt, Human; identical to SEQ ID NO: 40794

SEQ ID NO: 426488 - RNA, 64 nt, Human; identical to SEQ ID NO: 40795

SEQ ID NO: 426489 - RNA, 64 nt, Human; identical to SEQ ID NO: 40796

SEQ ID NO: 426490 - RNA, 64 nt, Human; identical to SEQ ID NO: 40797

SEQ ID NO: 426491 - RNA, 64 nt, Human; identical to SEQ ID NO: 40798

SEQ ID NO: 426492 - RNA, 64 nt, Human; identical to SEQ ID NO: 40799

SEQ ID NO: 426493 - RNA, 64 nt, Human; identical to SEQ ID NO: 40800

SEQ ID NO: 426494 - RNA, 64 nt, Human; identical to SEQ ID NO: 40801

SEQ ID NO: 426495 - RNA, 64 nt, Human; identical to SEQ ID NO: 40802

SEQ ID NO: 426496 - RNA, 64 nt, Human
ugucucguccgaauuagccuugggaaaaucauuuauaugcuaaauaauuuaccuuuuuaucuag

SEQ ID NO: 426497 - RNA, 64 nt, Human
ucuuuuuucacuucucaugauagcuguuauauauauaugcuaaaucuuuauauacagaaauauc

SEQ ID NO: 426498 - RNA, 64 nt, Human
acuacacauuguacaaaauaucgaagacacuaccauaugcuaaaggaagaaaucuagcugggau

SEQ ID NO: 426499 - RNA, 64 nt, Human; identical to SEQ ID NO: 40803

SEQ ID NO: 426500 - RNA, 64 nt, Human; identical to SEQ ID NO: 40804

SEQ ID NO: 426501 - RNA, 64 nt, Human; identical to SEQ ID NO: 40805

SEQ ID NO: 426502 - RNA, 64 nt, Human; identical to SEQ ID NO: 40806

SEQ ID NO: 426503 - RNA, 64 nt, Human; identical to SEQ ID NO: 40807

SEQ ID NO: 426504 - RNA, 64 nt, Human; identical to SEQ ID NO: 40808

SEQ ID NO: 426505 - RNA, 64 nt, Human; identical to SEQ ID NO: 40809

SEQ ID NO: 426506 - RNA, 64 nt, Human; identical to SEQ ID NO: 40810

SEQ ID NO: 426507 - RNA, 64 nt, Human; identical to SEQ ID NO: 40811

SEQ ID NO: 426508 - RNA, 64 nt, Human; identical to SEQ ID NO: 40812

SEQ ID NO: 426509 - RNA, 64 nt, Human; identical to SEQ ID NO: 40813

SEQ ID NO: 426510 - RNA, 64 nt, Human; identical to SEQ ID NO: 40814

SEQ ID NO: 426511 - RNA, 64 nt, Human; identical to SEQ ID NO: 40815

SEQ ID NO: 426512 - RNA, 64 nt, Human; identical to SEQ ID NO: 40816

SEQ ID NO: 426513 - RNA, 64 nt, Human; identical to SEQ ID NO: 40817

SEQ ID NO: 426514 - RNA, 64 nt, Human; identical to SEQ ID NO: 40818

SEQ ID NO: 426515 - RNA, 64 nt, Human
gugagacaacacaggagccuucuauaguauguugauaugcuagaucugugccguuaauaggcau

SEQ ID NO: 426516 - RNA, 64 nt, Human
ugaucccauuuuccagauaaggaaacaagccuagauaugcuacauguccaggaacaacugcagc

SEQ ID NO: 426517 - RNA, 64 nt, Human
ccccuaccucacaggguuguugugaggauuacauauaugcuaaagcauuuugcauaugaaaaag

SEQ ID NO: 426518 - RNA, 64 nt, Human; identical to SEQ ID NO: 40819

SEQ ID NO: 426519 - RNA, 64 nt, Human; identical to SEQ ID NO: 40820

SEQ ID NO: 426520 - RNA, 64 nt, Human; identical to SEQ ID NO: 40821

SEQ ID NO: 426521 - RNA, 64 nt, Human; identical to SEQ ID NO: 40822

SEQ ID NO: 426522 - RNA, 62 nt, Human; identical to SEQ ID NO: 40823

SEQ ID NO: 426523 - RNA, 62 nt, Human; identical to SEQ ID NO: 40824

SEQ ID NO: 426524 - RNA, 64 nt, Human; identical to SEQ ID NO: 40825

SEQ ID NO: 426525 - RNA, 62 nt, Human; identical to SEQ ID NO: 40826

SEQ ID NO: 426526 - RNA, 62 nt, Human; identical to SEQ ID NO: 40827

SEQ ID NO: 426527 - RNA, 64 nt, Human; identical to SEQ ID NO: 40828

SEQ ID NO: 426528 - RNA, 64 nt, Human; identical to SEQ ID NO: 40829

SEQ ID NO: 426529 - RNA, 64 nt, Human; identical to SEQ ID NO: 40830

SEQ ID NO: 426530 - RNA, 64 nt, Human; identical to SEQ ID NO: 40831

SEQ ID NO: 426531 - RNA, 64 nt, Human; identical to SEQ ID NO: 40832

SEQ ID NO: 426532 - RNA, 64 nt, Human; identical to SEQ ID NO: 40833

SEQ ID NO: 426533 - RNA, 64 nt, Human; identical to SEQ ID NO: 40834

SEQ ID NO: 426534 - RNA, 64 nt, Human
ucauuauccauggcucauuaaucucuucuagaauauaugcuaacuguugaagauauuuugggua

SEQ ID NO: 426535 - RNA, 64 nt, Human
uaagugcucuauaugcauaauaucaaauaugaagauaugcuaauguguuaauagcuuuuaaaag

SEQ ID NO: 426536 - RNA, 64 nt, Human
agggaaguuaucuuuuccugucaaucuguuuaaaauaugcuauaguauuucauuaguuuggugg

SEQ ID NO: 426537 - RNA, 64 nt, Human; identical to SEQ ID NO: 40835

SEQ ID NO: 426538 - RNA, 64 nt, Human; identical to SEQ ID NO: 40836

SEQ ID NO: 426539 - RNA, 64 nt, Human; identical to SEQ ID NO: 40837

SEQ ID NO: 426540 - RNA, 56 nt, Human; identical to SEQ ID NO: 40838

SEQ ID NO: 426541 - RNA, 64 nt, Human; identical to SEQ ID NO: 40839

SEQ ID NO: 426542 - RNA, 64 nt, Human; identical to SEQ ID NO: 40840

SEQ ID NO: 426543 - RNA, 64 nt, Human; identical to SEQ ID NO: 40841

SEQ ID NO: 426544 - RNA, 64 nt, Human; identical to SEQ ID NO: 40842

SEQ ID NO: 426545 - RNA, 64 nt, Human; identical to SEQ ID NO: 40843

SEQ ID NO: 426546 - RNA, 64 nt, Human; identical to SEQ ID NO: 40844

SEQ ID NO: 426547 - RNA, 64 nt, Human; identical to SEQ ID NO: 40845

SEQ ID NO: 426548 - RNA, 64 nt, Human; identical to SEQ ID NO: 40846

SEQ ID NO: 426549 - RNA, 64 nt, Human; identical to SEQ ID NO: 40847

SEQ ID NO: 426550 - RNA, 64 nt, Human; identical to SEQ ID NO: 40848

SEQ ID NO: 426551 - RNA, 64 nt, Human; identical to SEQ ID NO: 40849

SEQ ID NO: 426552 - RNA, 64 nt, Human; identical to SEQ ID NO: 40850

SEQ ID NO: 426553 - RNA, 64 nt, Human
uggaguagucucccaccuaaauaucaagauggcuauaugcuaaaaagagaaaauauggucaagu

SEQ ID NO: 426554 - RNA, 64 nt, Human
uaaaucuaaacauuccacagauuuuuggaugguuauaugcuaaugguagagaugauagcuuuua

SEQ ID NO: 426555 - RNA, 64 nt, Human
uuccacaaucuggaagaaaucauguacaggaauaauaugcuaugcacagggacuaugcuccuug

SEQ ID NO: 426556 - RNA, 64 nt, Human; identical to SEQ ID NO: 40851

SEQ ID NO: 426557 - RNA, 64 nt, Human; identical to SEQ ID NO: 40852

SEQ ID NO: 426558 - RNA, 64 nt, Human; identical to SEQ ID NO: 40853

SEQ ID NO: 426559 - RNA, 64 nt, Human; identical to SEQ ID NO: 40854

SEQ ID NO: 426560 - RNA, 64 nt, Human; identical to SEQ ID NO: 40855

SEQ ID NO: 426561 - RNA, 64 nt, Human; identical to SEQ ID NO: 40856

SEQ ID NO: 426562 - RNA, 52 nt, Human; identical to SEQ ID NO: 40857

SEQ ID NO: 426563 - RNA, 50 nt, Human; identical to SEQ ID NO: 40858

SEQ ID NO: 426564 - RNA, 60 nt, Human; identical to SEQ ID NO: 40859

SEQ ID NO: 426565 - RNA, 53 nt, Human; identical to SEQ ID NO: 40860

SEQ ID NO: 426566 - RNA, 64 nt, Human; identical to SEQ ID NO: 40861

SEQ ID NO: 426567 - RNA, 64 nt, Human; identical to SEQ ID NO: 40862

SEQ ID NO: 426568 - RNA, 64 nt, Human; identical to SEQ ID NO: 40863

SEQ ID NO: 426569 - RNA, 64 nt, Human; identical to SEQ ID NO: 40864

SEQ ID NO: 426570 - RNA, 64 nt, Human; identical to SEQ ID NO: 40865

SEQ ID NO: 426571 - RNA, 64 nt, Human; identical to SEQ ID NO: 40866

SEQ ID NO: 426572 - RNA, 64 nt, Human
acuuuuacuacauauuuuauguagcuacagcauaauaugcuauguuuacuuuauauagugaccu

SEQ ID NO: 426573 - RNA, 64 nt, Human
aaugaagacaauuuguaaaguaauacuguuauguauaugcuaaauguugguaaauacuaauuaa

SEQ ID NO: 426574 - RNA, 64 nt, Human
guacacagcugacuuauguagauuuaagcugcuaauaugcuacuuaaccaucuauuaaugcacc

SEQ ID NO: 426575 - RNA, 64 nt, Human
guauacaaaagacuaguuuguuauuaauccacaaauaugcuaaauguuagcaagaugauuuuua

SEQ ID NO: 426576 - RNA, 64 nt, Human; identical to SEQ ID NO: 40867

SEQ ID NO: 426577 - RNA, 64 nt, Human; identical to SEQ ID NO: 40868

SEQ ID NO: 426578 - RNA, 64 nt, Human; identical to SEQ ID NO: 40869

SEQ ID NO: 426579 - RNA, 64 nt, Human; identical to SEQ ID NO: 40870

SEQ ID NO: 426580 - RNA, 64 nt, Human; identical to SEQ ID NO: 40871

SEQ ID NO: 426581 - RNA, 64 nt, Human; identical to SEQ ID NO: 40872

SEQ ID NO: 426582 - RNA, 64 nt, Human; identical to SEQ ID NO: 40873

SEQ ID NO: 426583 - RNA, 64 nt, Human; identical to SEQ ID NO: 40874

SEQ ID NO: 426584 - RNA, 64 nt, Human; identical to SEQ ID NO: 40875

SEQ ID NO: 426585 - RNA, 64 nt, Human; identical to SEQ ID NO: 40876

SEQ ID NO: 426586 - RNA, 64 nt, Human; identical to SEQ ID NO: 40877

SEQ ID NO: 426587 - RNA, 64 nt, Human; identical to SEQ ID NO: 40878

SEQ ID NO: 426588 - RNA, 64 nt, Human; identical to SEQ ID NO: 40879

SEQ ID NO: 426589 - RNA, 64 nt, Human; identical to SEQ ID NO: 40880

SEQ ID NO: 426590 - RNA, 63 nt, Human; identical to SEQ ID NO: 40881

SEQ ID NO: 426591 - RNA, 64 nt, Human; identical to SEQ ID NO: 40882

SEQ ID NO: 426592 - RNA, 64 nt, Human
gccccaccuccuucccuuuaauccugccacugucauaugcuaccuuuccuaucucuucccucau

SEQ ID NO: 426593 - RNA, 64 nt, Human
ucugauuugauauucccuaaaaaacauuuggaauauaugcuaucuauagauucaguaucuacua

SEQ ID NO: 426594 - RNA, 64 nt, Human
cacauuguuguuuuugcuggucucaucuuugguaauaugcuauaccccacugcugcccgacacu

SEQ ID NO: 426595 - RNA, 64 nt, Human; identical to SEQ ID NO: 40883

SEQ ID NO: 426596 - RNA, 64 nt, Human; identical to SEQ ID NO: 40884

SEQ ID NO: 426597 - RNA, 64 nt, Human; identical to SEQ ID NO: 40885

SEQ ID NO: 426598 - RNA, 64 nt, Human; identical to SEQ ID NO: 40886

SEQ ID NO: 426599 - RNA, 64 nt, Human; identical to SEQ ID NO: 40887

SEQ ID NO: 426600 - RNA, 64 nt, Human; identical to SEQ ID NO: 40888

SEQ ID NO: 426601 - RNA, 64 nt, Human; identical to SEQ ID NO: 40889

SEQ ID NO: 426602 - RNA, 64 nt, Human; identical to SEQ ID NO: 40890

SEQ ID NO: 426603 - RNA, 64 nt, Human; identical to SEQ ID NO: 40891

SEQ ID NO: 426604 - RNA, 64 nt, Human; identical to SEQ ID NO: 40892

SEQ ID NO: 426605 - RNA, 64 nt, Human; identical to SEQ ID NO: 40893

SEQ ID NO: 426606 - RNA, 64 nt, Human; identical to SEQ ID NO: 40894

SEQ ID NO: 426607 - RNA, 64 nt, Human; identical to SEQ ID NO: 40895

SEQ ID NO: 426608 - RNA, 64 nt, Human; identical to SEQ ID NO: 40896

SEQ ID NO: 426609 - RNA, 64 nt, Human; identical to SEQ ID NO: 40897

SEQ ID NO: 426610 - RNA, 64 nt, Human; identical to SEQ ID NO: 40898

SEQ ID NO: 426611 - RNA, 64 nt, Human
ggugagacacacagacaaacaucauuauaauaaaauaugcuaagagaaguuaugaauagauuuc

SEQ ID NO: 426612 - RNA, 64 nt, Human
auggaauauagauauguauauacacauauaauauauaugcuaaaguauaaagaguaauaauaau

SEQ ID NO: 426613 - RNA, 64 nt, Human
augcugaaaauacgauaaaagaaaaacaacuccaauaugcuaaaaguuaaauaugguauuuaag

SEQ ID NO: 426614 - RNA, 64 nt, Human; identical to SEQ ID NO: 40899

SEQ ID NO: 426615 - RNA, 64 nt, Human; identical to SEQ ID NO: 40900

SEQ ID NO: 426616 - RNA, 64 nt, Human; identical to SEQ ID NO: 40901

SEQ ID NO: 426617 - RNA, 64 nt, Human; identical to SEQ ID NO: 40902

SEQ ID NO: 426618 - RNA, 64 nt, Human; identical to SEQ ID NO: 40903

SEQ ID NO: 426619 - RNA, 64 nt, Human; identical to SEQ ID NO: 40904

SEQ ID NO: 426620 - RNA, 64 nt, Human; identical to SEQ ID NO: 40905

SEQ ID NO: 426621 - RNA, 64 nt, Human; identical to SEQ ID NO: 40906

SEQ ID NO: 426622 - RNA, 64 nt, Human; identical to SEQ ID NO: 40907

SEQ ID NO: 426623 - RNA, 64 nt, Human; identical to SEQ ID NO: 40908

SEQ ID NO: 426624 - RNA, 64 nt, Human; identical to SEQ ID NO: 40909

SEQ ID NO: 426625 - RNA, 64 nt, Human; identical to SEQ ID NO: 40910

SEQ ID NO: 426626 - RNA, 64 nt, Human; identical to SEQ ID NO: 40911

SEQ ID NO: 426627 - RNA, 64 nt, Human; identical to SEQ ID NO: 40912

SEQ ID NO: 426628 - RNA, 64 nt, Human; identical to SEQ ID NO: 40913

SEQ ID NO: 426629 - RNA, 64 nt, Human; identical to SEQ ID NO: 40914

SEQ ID NO: 426630 - RNA, 64 nt, Human
uacaagaaggcacauacugaaugcugaaguauacauaugcuauuucucuuaaaccucagagcaa

SEQ ID NO: 426631 - RNA, 64 nt, Human
aaaaaacauuucuugagcaccuucugugcccagcauaugcuaggcccaccagcuaagugugugu

SEQ ID NO: 426632 - RNA, 64 nt, Human
caguuugcaggugaaaaaaaauaaauauuauaaaauaugcuauuguuuuuguguucuugcugca

SEQ ID NO: 426633 - RNA, 64 nt, Human; identical to SEQ ID NO: 40915

SEQ ID NO: 426634 - RNA, 64 nt, Human; identical to SEQ ID NO: 40916

SEQ ID NO: 426635 - RNA, 64 nt, Human; identical to SEQ ID NO: 40917

SEQ ID NO: 426636 - RNA, 64 nt, Human; identical to SEQ ID NO: 40918

SEQ ID NO: 426637 - RNA, 64 nt, Human; identical to SEQ ID NO: 40919

SEQ ID NO: 426638 - RNA, 64 nt, Human; identical to SEQ ID NO: 40920

SEQ ID NO: 426639 - RNA, 64 nt, Human; identical to SEQ ID NO: 40921

SEQ ID NO: 426640 - RNA, 64 nt, Human; identical to SEQ ID NO: 40922

SEQ ID NO: 426641 - RNA, 64 nt, Human; identical to SEQ ID NO: 40923

SEQ ID NO: 426642 - RNA, 64 nt, Human; identical to SEQ ID NO: 40924

SEQ ID NO: 426643 - RNA, 64 nt, Human; identical to SEQ ID NO: 40925

SEQ ID NO: 426644 - RNA, 64 nt, Human; identical to SEQ ID NO: 40926

SEQ ID NO: 426645 - RNA, 64 nt, Human; identical to SEQ ID NO: 40927

SEQ ID NO: 426646 - RNA, 64 nt, Human; identical to SEQ ID NO: 40928

SEQ ID NO: 426647 - RNA, 64 nt, Human; identical to SEQ ID NO: 40929

SEQ ID NO: 426648 - RNA, 64 nt, Human; identical to SEQ ID NO: 40930

SEQ ID NO: 426649 - RNA, 64 nt, Human
gacugguuuaguggaugcugaaggccuucaggaaauaugcuacugguugccacugacuucaaac

SEQ ID NO: 426650 - RNA, 64 nt, Human
cuucucacuuuugcauguuuuuacugaucauucgauaugcuaaccguucucagcccugagccuu

SEQ ID NO: 426651 - RNA, 64 nt, Human
caaaguuaacauauucuugguuaaccaugguuaaauaugcuauuuuaauaaauuauugaaacuc

SEQ ID NO: 426652 - RNA, 64 nt, Human; identical to SEQ ID NO: 40931

SEQ ID NO: 426653 - RNA, 64 nt, Human; identical to SEQ ID NO: 40932

SEQ ID NO: 426654 - RNA, 64 nt, Human; identical to SEQ ID NO: 40933

SEQ ID NO: 426655 - RNA, 64 nt, Human; identical to SEQ ID NO: 40934

SEQ ID NO: 426656 - RNA, 64 nt, Human; identical to SEQ ID NO: 40935

SEQ ID NO: 426657 - RNA, 64 nt, Human; identical to SEQ ID NO: 40936

SEQ ID NO: 426658 - RNA, 64 nt, Human; identical to SEQ ID NO: 40937

SEQ ID NO: 426659 - RNA, 64 nt, Human; identical to SEQ ID NO: 40938

SEQ ID NO: 426660 - RNA, 64 nt, Human; identical to SEQ ID NO: 40939

SEQ ID NO: 426661 - RNA, 64 nt, Human; identical to SEQ ID NO: 40940

SEQ ID NO: 426662 - RNA, 64 nt, Human; identical to SEQ ID NO: 40941

SEQ ID NO: 426663 - RNA, 64 nt, Human; identical to SEQ ID NO: 40942

SEQ ID NO: 426664 - RNA, 64 nt, Human; identical to SEQ ID NO: 40943

SEQ ID NO: 426665 - RNA, 64 nt, Human
uguagagaacggaaaacuauuguccauuaacaugauaugcuaaacauucuauaaacauucuugu

SEQ ID NO: 426666 - RNA, 64 nt, Human
acggcaaagcaaguaccucuuaagggacucuaauauaugcuaacgcugguccucuuagcucugu

SEQ ID NO: 426667 - RNA, 64 nt, Human
gagacaaacgugacaggcuagucuugucucucucauaugcuagguagcaaauggggugauauuu

SEQ ID NO: 426668 - RNA, 64 nt, Human
guauccguagcuaucaggaucauugcgcacucauauaugcuaagccuucuguucucuaauagaa

SEQ ID NO: 426669 - RNA, 64 nt, Human
aagguuuaguauauuagaaacacccaaaccaguaauaugcuaaccugaugcacugcugaaagaa

SEQ ID NO: 426670 - RNA, 64 nt, Human
auugcuuuaaaauggcaguguuucucccacuuugauaugcuaacauuuaguaagcacuggcuuu

SEQ ID NO: 426671 - RNA, 64 nt, Human
uacacaaaaaguaucacaaaggauggucuuggccauaugcuagggccccugugaaaauaaguag

SEQ ID NO: 426672 - RNA, 64 nt, Human
gcuccaggcuuugauuauagauacgacuucaaaaauaugcuaagacgcuugacuuauuaaggac

SEQ ID NO: 426673 - RNA, 64 nt, Human
cuuuauuuuuuuuucuauuuuauaaaauaaauauauaugcuaugcuuuaaauuuuggagcuuuc

SEQ ID NO: 426674 - RNA, 64 nt, Human
guuuagaauuuuugucauuaaauaugaaauggauauaugcuaggcaguguuucucaaaaucucc

SEQ ID NO: 426675 - RNA, 64 nt, Human
uuucuuuuauuucauaccaauaauuuaaagauugauaugcuaaaaacaauuugcacagcacuaa

SEQ ID NO: 426676 - RNA, 64 nt, Human
cgauauacaaauuggacuuguucaacugcuggauauaugcuaccaauaaccccagccccaacuu

SEQ ID NO: 426677 - RNA, 64 nt, Human
uuaaauuggacaccuuugguacccuggucucaguauaugcuauucuggcccaaauguuccauua

SEQ ID NO: 426678 - RNA, 64 nt, Human
uuggagaagaugauuugacugaucauugaucugcauaugcuagaacucuaccuguguuucauua

SEQ ID NO: 426679 - RNA, 64 nt, Human
aggcccuaauucaccauuucuuuuuuaagaucugauaugcuaucauugccuuaauaauggaaca

SEQ ID NO: 426680 - RNA, 64 nt, Human
ugcagcuuaaaacaagcaaaauacacagaugauaauaugcuaaauuuuccucuauccuguacau

SEQ ID NO: 426681 - RNA, 64 nt, Human
auuaauuacaguuuucuacacaugguaauacaggauaugcuacugauuuaggaaguuuuuaagu

SEQ ID NO: 426682 - RNA, 64 nt, Human
gucaaguugucagguuauuuauuuuauaauguccauaugcuaauagugaucaagaagacuuuag

SEQ ID NO: 426683 - RNA, 64 nt, Human
aucagugguuacagcuauacuaaaauaaaacuuuauaugcuaauuaucuucaagggucuuucua

SEQ ID NO: 426684 - RNA, 64 nt, Human
auguauuugguuuuuugcaguucacaggguauuaauaugcuacaguacuauguaaauuuaaaga

SEQ ID NO: 426685 - RNA, 64 nt, Human
aucugaauuucuuuuagcauuuugcuuaaaagcaauaugcuauuugcuuauuccgugcccugac

SEQ ID NO: 426686 - RNA, 64 nt, Human
gauuucuauaaucacucgaugugauacaguauaaauaugcuaugguuuguuuguuaugaacaga

SEQ ID NO: 426687 - RNA, 64 nt, Human
uggguucagagggcaauuucucuuuuauguguacauaugcuaaauaaacauaauuuaaaaaaca

SEQ ID NO: 426688 - RNA, 64 nt, Human
uuuuaaagaucuaguuaauuaagguggaaaacauauaugcuaaacaaaagaaacaugauuuuuc

SEQ ID NO: 426689 - RNA, 64 nt, Human
aaccuaaaucuuuucucacucacuuuuagguucuauaugcuauucuccuuacguaacguuaaau

SEQ ID NO: 426690 - RNA, 64 nt, Human
auccaacaagagagauggggagguuuuuaguuauauaugcuauauauauauauauaacuggaaa

SEQ ID NO: 426691 - RNA, 64 nt, Human
cuaauugaauugcguaauuacuagaccagaaugcauaugcuacuauacauugauuuacugccug

SEQ ID NO: 426692 - RNA, 64 nt, Human
uaacuaguuaaggauuaauagcaaaagauauuaaauaugcuaacauagcuauggaggaauugag

SEQ ID NO: 426693 - RNA, 64 nt, Human
auugccauuggaauagauaucucagauuguguagauaugcuauuuaaauaauuuaucaggaaau

SEQ ID NO: 426694 - RNA, 64 nt, Human
uguguucuagaaauuccgacucuuuucauuagauauaugcuauuucuuucauucuugcugguuu

SEQ ID NO: 426695 - RNA, 64 nt, Human
cugaccaucgcaacccucaugaaguacaaccagcauaugcuacaaaguacgcaauaacuguuug

SEQ ID NO: 426696 - RNA, 64 nt, Human
cauacuucucugggacagcauggcauauagugauauaugcuauuugcguucuccagauguuuau

SEQ ID NO: 426697 - RNA, 64 nt, Human
aauguuuuuaauauucucaucucaacauugugauauaugcuacuaaaaaccuuuucauauacau

SEQ ID NO: 426698 - RNA, 64 nt, Human
aaagaagucauggaggccugugcauuugaauuguauaugcuagugaggaaaagauuuagacauu

SEQ ID NO: 426699 - RNA, 64 nt, Human
ccuuuuaguuuuuacucuaauuuuguaaccauguauaugcuagcaguccacuucuacgccacca

SEQ ID NO: 426700 - RNA, 64 nt, Human
uauucugauuuuauuuugcccuuaacugauuguuauaugcuacaagggauuucaguggacugca

SEQ ID NO: 426701 - RNA, 64 nt, Human
guccccgaggugcccagcaucacguaaaacaucgauaugcuaagaagaacaaaaagagcccaau

SEQ ID NO: 426702 - RNA, 64 nt, Human
cagagcccacuccaucugguagaagggaaagcccauaugcuaccaccagcuguguccaaaaccg

SEQ ID NO: 426703 - RNA, 64 nt, Human
auuucagugcaguaauuucugagagcuaguaccuauaugcuaccgguuagcaugguuuuagcaa

SEQ ID NO: 426704 - RNA, 64 nt, Human
acaaaaaauuguaauguugucuagggaugacaugauaugcuaccuccuuuuuccugaaguuuua

SEQ ID NO: 426705 - RNA, 64 nt, Human
cuacgauguguugaaugcuuaccaaguccugggaauaugcuagugauguacgagcugcgcgucc

SEQ ID NO: 426706 - RNA, 64 nt, Human
acaaacaauuauaauguugucuagggacgacaugauaugcuaccuccuuuuuccugaaguuuua

SEQ ID NO: 426707 - RNA, 64 nt, Human
uauuccauuuuuacuaaagcaguguuuucaccucauaugcuauguuagaaguccaggcagagac

SEQ ID NO: 426708 - RNA, 64 nt, Human
acuaaggggguaggaauggaagaugguaucuuuuauaugcuaaacagauuagaaaauuaacaua

SEQ ID NO: 426709 - RNA, 64 nt, Human
aaaugcauagguggcaguauaauuauuuucagggauaugcuagaauuacuuccacauauuuauc

SEQ ID NO: 426710 - RNA, 64 nt, Human
aacuugcauuuuaaaguguauuugcacauuuuacauaugcuaugugguugccuuuggguuuucu

SEQ ID NO: 426711 - RNA, 64 nt, Human
cucucacaggguuaaaguccuuucuugcuuucaaauaugcuauggagccacaguugaggacagu

SEQ ID NO: 426712 - RNA, 64 nt, Human
augccugaagauaauguguggaaggauauuugccauaugcuaacugguuuuuuggccagggaga

SEQ ID NO: 426713 - RNA, 64 nt, Human
cuggagugaggacggugaugcccuguguguauuaauaugcuauguaaggcugggcgugguggcu

SEQ ID NO: 426714 - RNA, 64 nt, Human
auauguguguguguauauauauauauauauauauauaugcuauauaaaguuuaaaugaaaugcu

SEQ ID NO: 426715 - RNA, 64 nt, Human
gauauuauacacuguagaauacucacaaguccaaauaugcuaaaaauuauauauuuuuaacuca

SEQ ID NO: 426716 - RNA, 64 nt, Human
aggcacugcagaagcuguucaguauuauauguguauaugcuauuuuuuuagcagccaugucuga

SEQ ID NO: 426717 - RNA, 64 nt, Human
acaccauuuuaggaagugguucuccuacuggaaaauaugcuacagaaugaaaguuuguaauuga

SEQ ID NO: 426718 - RNA, 64 nt, Human
ugcuacagguaauagggacuuagcaagcucuuuuauaugcuaaaggagcaucuaucagauuaag

SEQ ID NO: 426719 - RNA, 64 nt, Human
gauagaauauuucauguguauuacagugguauucauaugcuaugucucuaaacuuuauuuucaa

SEQ ID NO: 426720 - RNA, 64 nt, Human
gaaugagaagacaaguuuggacauagcccagaaaauaugcuauuauuucauagaagagacuaau

SEQ ID NO: 426721 - RNA, 64 nt, Human
gccaggguaauaaaccaaaauaguccuaaucaguauaugcuaguugagcaucggcauaauuuuc

SEQ ID NO: 426722 - RNA, 64 nt, Human
uuaucugaguucauuggagugggugcuugugcauauaugcuagguaucuuuugccaucuuucuc

SEQ ID NO: 426723 - RNA, 64 nt, Human
cauuugggauuuucuuuugguugauuaaaauugcauaugcuaagugugugaaugaaguaacuga

SEQ ID NO: 426724 - RNA, 64 nt, Human
agguuaaucacuggcaaaagcaucagaucuuuguauaugcuaagauuuauuguuuccccuucua

SEQ ID NO: 426725 - RNA, 64 nt, Human
gguuucucuacugcuggacuuuucagagucuuucauaugcuaacauucauugugaaucucccaa

SEQ ID NO: 426726 - RNA, 64 nt, Human
uuaacauucccaucgccuaccauuuucugcgcagauaugcuaggguaagagagaagagacacau

SEQ ID NO: 426727 - RNA, 64 nt, Human
ucagggauuuuuaaaaaauuguguuacuacugauauaugcuaguuuuauuuuauuuuuuugaac

SEQ ID NO: 426728 - RNA, 64 nt, Human
ucaauauaaagaaagaagcuauuuaggagauaugauaugcuacuugggagaaaacucucacuaa

SEQ ID NO: 426729 - RNA, 64 nt, Human
acuugugaguauguauucaaauacuaaguaucuuauaugcuacgugcauacacauucuuuucuu

SEQ ID NO: 426730 - RNA, 64 nt, Human
gcaaguuaaugacccuauuggcuuguguacaucuauaugcuaaaaugacuuccccacauugaca

SEQ ID NO: 426731 - RNA, 64 nt, Human
uuuuauauuucacaauauaugcaauaucaggggaauaugcuaaauguuaccaccagagggcaca

SEQ ID NO: 426732 - RNA, 64 nt, Human
aaacaccuuguacuuuauuuucuauaauuuaaauauaugcuaagucuuauauauuguagauaau

SEQ ID NO: 426733 - RNA, 64 nt, Human
uucagcuccuuacaaauuaccaaaagugguucuaauaugcuaguuuguuugauuuuuucuuuua

SEQ ID NO: 426734 - RNA, 64 nt, Human
aaacauuccccuuccaaucuggugcuaguagaguauaugcuaucuaggcaccauguguguggcu

SEQ ID NO: 426735 - RNA, 64 nt, Human
uucagcugagaaacugguacuugggagcuuaaaaauaugcuaauuacaaguuauaaaucaaacg

SEQ ID NO: 426736 - RNA, 64 nt, Human
uaaaggugauuuggaugcguuguaacacugcuaaauaugcuaaguacagaauuuuaucuacagu

SEQ ID NO: 426737 - RNA, 64 nt, Human
aguggaaugaauuuggacaugccccaaugcuucuauaugcuaagugaaaucugugucuguaauu

SEQ ID NO: 426738 - RNA, 64 nt, Human
ccuggaguaccggcaggugcccagcagugaucccauaugcuaugaguuacugugggguccaagg

SEQ ID NO: 426739 - RNA, 64 nt, Human; identical to SEQ ID NO: 426729

SEQ ID NO: 426740 - RNA, 64 nt, Human
aauaaauauagugaauacuuacauagugcuuacuauaugcuaagcacuauuuuuagcauguuau

SEQ ID NO: 426741 - RNA, 64 nt, Human
gacuugccaaagaaaaagaagggaaccacaguggauaugcuagcauuuuagcugugcaaaggga

SEQ ID NO: 426742 - RNA, 62 nt, Human
gagcaaggccugcgagggaggaacgggccgcuccccgccagccgccuuccccagcagccgca

SEQ ID NO: 426743 - RNA, 62 nt, Human
gcgcgcggccuagcccgggccucauuucuuauccccgccaaggguuuccucucagucauuug

SEQ ID NO: 426744 - RNA, 62 nt, Human
uuccuucgcccgugucuucccucccuucucggccccgccaccugcccagcgugcccuggcuc

SEQ ID NO: 426745 - RNA, 62 nt, Human
caagucacucaucucagaauguccccaccaauccccgccacagcaggcgccucgggucccag

SEQ ID NO: 426746 - RNA, 62 nt, Human
gugagcggagagacagaacuguccccgccccaccccgccacccauuccuaggguuccuaguc

SEQ ID NO: 426747 - RNA, 62 nt, Human
gaggagcaucaggcuccugcagagccccauccccccgccacacccacacgguggagcugccu

SEQ ID NO: 426748 - RNA, 62 nt, Human
gcagggaucggcuuggaaaucaacgugguuguccccgccaggccggggaagguuggagcagc

SEQ ID NO: 426749 - RNA, 62 nt, Human
cagcucuccgcgucuuuacccugugaucccagccccgccacugaccaucugugacccuuccc

SEQ ID NO: 426750 - RNA, 62 nt, Human
gugggggcgggggaaggaagaggcagccccgcccccgccaucuguucuccaucagugugcgc

SEQ ID NO: 426751 - RNA, 62 nt, Human
cauguuuggacccggggggcugcucuucccucccccgccauagcuaagaugccugaaucaau

SEQ ID NO: 426752 - RNA, 62 nt, Human
gcugggcgagcagggcaggugcaggccgccugccccgccacgcuccugggccaacucugcac

SEQ ID NO: 426753 - RNA, 62 nt, Human
ucugaccugggcccaccaagguggacgcugggccccgccaggcuggagcccggagggucugc

SEQ ID NO: 426754 - RNA, 62 nt, Human
agucauuucggccaguaggugugcagaccccuccccgccacgaucgucgcugugcuuggugu

SEQ ID NO: 426755 - RNA, 62 nt, Human
uuguggagagaauguguguguguggcagggggccccgccagggcuggggacagaggguguca

SEQ ID NO: 426756 - RNA, 62 nt, Human
accgccacgucccagcaucccuggagcaggagccccgccacagccuucggacagacauaugg

SEQ ID NO: 426757 - RNA, 62 nt, Human
agcuaaacacaggggguucuuaaaauggcugcccccgccacccgggccucccuugggcaaaa

SEQ ID NO: 426758 - RNA, 62 nt, Human
cuucacguucaucccugucucucccgggcugcccccgccagcucuggcuguuuagcuugagg

SEQ ID NO: 426759 - RNA, 62 nt, Human
cugaaggagcugagagggagcucaacuccccaccccgccacguggggagacagcccuuccca

SEQ ID NO: 426760 - RNA, 62 nt, Human
ccuuuucuaaaccaccucugggacucagcuccccccgccaaaaaaaaugggucuccuucugg

SEQ ID NO: 426761 - RNA, 62 nt, Human
gcuggaauaaggagggcugaggcugaguuguuccccgccacuguugaggaucccaucugaca

SEQ ID NO: 426762 - RNA, 62 nt, Human
gcccaguaguggcuucuagcucuaaauguuugccccgccaucccuuuccacaguauccuucu

SEQ ID NO: 426763 - RNA, 62 nt, Human
cucuucuccuaaagcauuccuaggaauauuuuccccgccaaugcugggcguacacccuagcc

SEQ ID NO: 426764 - RNA, 62 nt, Human
agccuucaagcaugugaauaaucuuccaucuuccccgccacacauacacacacacacuuuuu

SEQ ID NO: 426765 - RNA, 54 nt, Human; identical to SEQ ID NO: 242453

SEQ ID NO: 426766 - RNA, 62 nt, Human
gaaugucacagaugaggcugccccugccccccccccgccagggagguuucaugagcucaugu

SEQ ID NO: 426767 - RNA, 62 nt, Human
ucaggaccuaucuaggcagaccccagccagacccccgccagacagacucccaaccagacuga

SEQ ID NO: 426768 - RNA, 62 nt, Human
cugccccuacugggaagugaggagccccucugccccgccagccaccccguccgggagggagg

SEQ ID NO: 426769 - RNA, 62 nt, Human
ggcagaucuccgguauccucagcacuacccacccccgccagcuccccagcacaaaggacccu

SEQ ID NO: 426770 - RNA, 62 nt, Human
agcaaacuugugucugucucuucuuucauuuuccccgccaccaacuuacuuuaccaccuaug

SEQ ID NO: 426771 - RNA, 62 nt, Human
agacucagggaggcuaaaucaguguuugauugccccgccaacccuuccugaaacuucagacc

SEQ ID NO: 426772 - RNA, 62 nt, Human
cauacgccccuccuccuucucucuuggcgaggccccgccacaccgcgcucuuccucccggga

SEQ ID NO: 426773 - RNA, 62 nt, Human
aggagaguccuuccucuccccuuuugaggcauccccgccauccccccacuuagagcuaugug

SEQ ID NO: 426774 - RNA, 62 nt, Human
uuggcagggacuaggcugaagaugugucuucuccccgccaccuacuguaugacaccacauuc

SEQ ID NO: 426775 - RNA, 62 nt, Human
gacugaaugguguccagccuggugcccgcccaccccgccaggcugcacucggucgggccucc

SEQ ID NO: 426776 - RNA, 62 nt, Human
agcagauuccauuaccucagcagcucuuguucccccgccacuggcaguucugcaaugccaua

SEQ ID NO: 426777 - RNA, 62 nt, Human
cagacuaaaggucuggccaaugucuugccccaccccgccagccgcgauacggcgcaguuccu

SEQ ID NO: 426778 - RNA, 62 nt, Human
guggggaugcggggagauuugagaggggaaaaccccgccaggagggagagagaggcaccccu

SEQ ID NO: 426779 - RNA, 62 nt, Human
gaggaauuucuguucuuccaucaccuccccccccccgccacccucccacugccaaagaacuu

SEQ ID NO: 426780 - RNA, 62 nt, Human
augagugcagagcuccuacccacacaugacugccccgccauuucauccuaggcauucuguga

SEQ ID NO: 426781 - RNA, 62 nt, Human
cccuucuccucugagaaggcucccggcugccuccccgccaccgagcuuguagccugaaugcc

SEQ ID NO: 426782 - RNA, 62 nt, Human
cccgucucccgucuucugccucccacuccauaccccgccaaggaaaggcauguacaaaaauu

SEQ ID NO: 426783 - RNA, 62 nt, Human
cucaggguugacaucuuauuugaacaagggucccccgccaucaugcagccuccaaggugcca

SEQ ID NO: 426784 - RNA, 62 nt, Human
ccaggauaacccccgcaaaccacauagcagacccccgccauccucgcagagugggagaggcu

SEQ ID NO: 426785 - RNA, 62 nt, Human
auugcggcugcacgucacacuaggguggccacccccgccauugcgagccacaugucugcacu

SEQ ID NO: 426786 - RNA, 62 nt, Human
gucaggccccugcccacugccugacccccaccccccgccaguccagggagacccugugggug

SEQ ID NO: 426787 - RNA, 62 nt, Human
ugacagcuguaggcuguagccugcacggggcgccccgccaaggaggcaccuggaggugaaac

SEQ ID NO: 426788 - RNA, 62 nt, Human
uccuuccucucccaguacuuuaccaaaggaacccccgccaggacccacauggggccacgugu

SEQ ID NO: 426789 - RNA, 62 nt, Human
uucuccuccgccgcaaaggagaggcuucccagccccgccagugagagguuggacucucugcc

SEQ ID NO: 426790 - RNA, 62 nt, Human
ggggcagagucuucccuaccagguuucuacacccccgccaggcugcccaucagggcccaggg

SEQ ID NO: 426791 - RNA, 62 nt, Human
cccaggcagcgccccaggaagccaugcugggcccccgccagggccuaucccaaaagcagggg

SEQ ID NO: 426792 - RNA, 62 nt, Human
cauguuacaaacagaaaagcucgaggcucccaccccgccacaucccaacuucauuucccccu

SEQ ID NO: 426793 - RNA, 62 nt, Human
guugggggaagggaggaaaccccaccuccagcccccgccaccgggcucccugggcacccagc

SEQ ID NO: 426794 - RNA, 62 nt, Human
agucuaccuauacaucccuuccccauugcccaccccgccaucucaaucagucacugacuuuu

SEQ ID NO: 426795 - RNA, 62 nt, Human
acccgcgaggacgcgcgcgagcacacgcggcgccccgccaggccuuagggcccgugggggac

SEQ ID NO: 426796 - RNA, 62 nt, Human
ggaaauuaccuuccugcgaagaaaggugacauccccgccacagacacggaggccccgccugc

SEQ ID NO: 426797 - RNA, 62 nt, Human
aaggaugcgcucuuuauuucuacccugucucuccccgccacccccgacuucccguggaaauu

SEQ ID NO: 426798 - RNA, 62 nt, Human
gucuguguguugauggguggcccaugagugacccccgccaggggagaccaggcuggcuggau

SEQ ID NO: 426799 - RNA, 62 nt, Human
accaaaguguccacauuguaccaaagacugacccccgccagcuggggugcccaggggcaggg

SEQ ID NO: 426800 - RNA, 62 nt, Human
acuuaguuaucagaaaucagcucaguggucuuccccgccaugauucacauuugaugaguuuu

SEQ ID NO: 426801 - RNA, 62 nt, Human
ggcagaggggugcucauagcgggcgcugccagccccgccacgcuugugucuuuagugcucca

SEQ ID NO: 426802 - RNA, 62 nt, Human
gccagcggugaccagccugucacccagcuccuccccgccaacccugccugccgcugcaccug

SEQ ID NO: 426803 - RNA, 62 nt, Human
gccuggcugacauucugagccccccucggaggccccgccacagccaaccugcccagucuuuc

SEQ ID NO: 426804 - RNA, 62 nt, Human
cccaccccugcugccgccacuggcugugccucccccgccaccuguguguucuuuugauacau

SEQ ID NO: 426805 - RNA, 62 nt, Human
agucaucuucucuaguucucauaagacuaucuccccgccaccuauaguuaguacccucaagu

SEQ ID NO: 426806 - RNA, 62 nt, Human
ucccucaccaacauugcuugugccacacccucccccgccacuccugaaccccgucgaggggc

SEQ ID NO: 426807 - RNA, 62 nt, Human
gaaaggcaauucaaacaucugcuugauucccgccccgccaccccuaauuucugagagaauaa

SEQ ID NO: 426808 - RNA, 62 nt, Human
cacucugcuuggccugaccugcagguccccugccccgccagccacaggcugggugcacgucc

SEQ ID NO: 426809 - RNA, 62 nt, Human
gaaggagggucucuugcccaucucuccggccaccccgccaggaaacgacgagaaggccgagg

SEQ ID NO: 426810 - RNA, 62 nt, Human
uaugcugcccccugacccccaccuucaccccuccccgccaaggccuggcucuuccggagguc

SEQ ID NO: 426811 - RNA, 62 nt, Human
acccgccgcaccccgaggccgccaauuguccgccccgccagcgcugcaaauaaaccuucuga

SEQ ID NO: 426812 - RNA, 62 nt, Human
cugacccccaccccccaccccccaccccccccccccgccaacuccuauacccaucuucccua

SEQ ID NO: 426813 - RNA, 62 nt, Human
uggccacagcauggccccuuuaguccucccgcccccgccaaggggcaccaaggccacguuuc

SEQ ID NO: 426814 - RNA, 62 nt, Human
uaucacggcacacagcagggaaucccaggcccccccgccaagugguuacccaagucaccacu

SEQ ID NO: 426815 - RNA, 62 nt, Human
cccauugugugcccagaacaucccuggccccaccccgccacuucccucgggcccuuaugaag

SEQ ID NO: 426816 - RNA, 62 nt, Human
guggcuccuucccaugugcagucccuguccccccccgccaguccuccacacccaaacuguuu

SEQ ID NO: 426817 - RNA, 62 nt, Human
agugcaguggcgcgaucuuggcucacugcaacccccgccaccuagguucaagugauucucau

SEQ ID NO: 426818 - RNA, 62 nt, Human
uccuugucaugcccggccuguggacagccagcccccgccaucccucccacccccuaccaagc

SEQ ID NO: 426819 - RNA, 62 nt, Human
cuccagguggagaacagccccucuccccgcgcccccgccagggagagaaggggagugcggag

SEQ ID NO: 426820 - RNA, 62 nt, Human
gugcacgcuguggccugucaccgccaccguggccccgccagcuggccuccccuuuggcccac

SEQ ID NO: 426821 - RNA, 62 nt, Human
cucuguuccuuccccgagccccugccccggcuccccgccaaagcaacccugcccacucaggc

SEQ ID NO: 426822 - RNA, 62 nt, Human
cccugauaaauaacaaguuauaguaccaucucccccgccaauaaaaaagagaagaaaaaaga

SEQ ID NO: 426823 - RNA, 62 nt, Human
agucaccgaagguccuacagggccacaacugcccccgccacaacccaccccgcuuucguagu

SEQ ID NO: 426824 - RNA, 62 nt, Human
cugcuccacggcgcggagcccaacugcgccgaccccgccacucucacccgacccgugcacga

SEQ ID NO: 426825 - RNA, 62 nt, Human
caagggauuuuuuuuuuuuguauucccccugcccccgccagucaaagguuucuuuucccuuu

SEQ ID NO: 426826 - RNA, 62 nt, Human
aggguccguccacugcugcgguuccgaggcucccccgccacucucucucugcccagguucug

SEQ ID NO: 426827 - RNA, 62 nt, Human
uguggcaguccccacagcuccacaaugggcucccccgccaacggggacgacagggaucuuca

SEQ ID NO: 426828 - RNA, 62 nt, Human
agguccccuaaucuguggccaccaccccccccccccgccacgccuuagagcagagcagcccc

SEQ ID NO: 426829 - RNA, 62 nt, Human
cacacacagacacacaaucacacgcagccccuccccgccacagagacacaccauuacauaca

SEQ ID NO: 426830 - RNA, 62 nt, Human
aagacacagacacaaaaucacacacacacccuccccgccacagagacacaccauuacauaca

SEQ ID NO: 426831 - RNA, 62 nt, Human
cacacacagacacaaaaucacacacacacccuccccgccacagagacaccauuacauacaca

SEQ ID NO: 426832 - RNA, 62 nt, Human
agcaguuacgccuuaggaaggggacaaccaggccccgccacacgcucacacacaaaccugcu

SEQ ID NO: 426833 - RNA, 62 nt, Human
augcccaggccaggggggcugcagcccucagcccccgccaggauucccgcaggcuccuggac

SEQ ID NO: 426834 - RNA, 62 nt, Human
gcaccggcaaguguugucagcacuggaggagaccccgccaguggggugaggccagccaaguc

SEQ ID NO: 426835 - RNA, 62 nt, Human
caguucuccuggaagggagguuuuugcuuuacccccgccagcacuuccgcacacaaucauag

SEQ ID NO: 426836 - RNA, 62 nt, Human
ccuggaguauuugggagagacuggcugcagauccccgccagccaagaugcaagccacucggg

SEQ ID NO: 426837 - RNA, 62 nt, Human
augcugcgucccccgcugcuugccgccccccaccccgccauuuuguauaauaaagcucccug

SEQ ID NO: 426838 - RNA, 62 nt, Human
aggguggaggucccacugagccucucgccugcccccgccacucgucuggugcuuguugaucc

SEQ ID NO: 426839 - RNA, 62 nt, Human
ggcuugggaaaugcacgucccuuccccuuacuccccgccaaaacccacaucccagccucugg

SEQ ID NO: 426840 - RNA, 62 nt, Human
gaagcagagagguggagaacugggauuugaacccccgccauccuucaccagagcccaugcuc

SEQ ID NO: 426841 - RNA, 62 nt, Human
aacugggggcaaagguuugaagacacagccucccccgccagccccaagcugggccgaggcgc

SEQ ID NO: 426842 - RNA, 62 nt, Human
ugcugagcuuguagccuuuuagcuccacagagccccgccauguguuugcaccagcuuaaaau

SEQ ID NO: 426843 - RNA, 62 nt, Human
cccgccccacugagcccgcagcccccgccgggccccgccaggccuccccgcuggccauagca

SEQ ID NO: 426844 - RNA, 62 nt, Human
uguaucccugccucaccccaggucuccgucugccccgccagguaccccacagagaccaauga

SEQ ID NO: 426845 - RNA, 62 nt, Human
cccccauaaaggugugcauuucaguuaggcugccccgccacagagcaggcuucaucugcucu

SEQ ID NO: 426846 - RNA, 62 nt, Human
uagcuuugcccuaacuccuucaucaaaagaccccccgccagcuucccacaccucauacgcag

SEQ ID NO: 426847 - RNA, 62 nt, Human
ggcuaguccucuuccccaguccccucagaggcccccgccagccccaccuugaaagcagcaua

SEQ ID NO: 426848 - RNA, 62 nt, Human
ggggacccacaggggugaggacccacgguccuccccgccagccuugcucagcuguggguugc

SEQ ID NO: 426849 - RNA, 62 nt, Human
cgagcccguguggaggucaaagcuaccuuuggccccgccauugcugcugugcagaaggucag

SEQ ID NO: 426850 - RNA, 62 nt, Human
cugugcgaccuuuccaagccuucccucacccuccccgccagcacccucuuuggggagcagga

SEQ ID NO: 426851 - RNA, 62 nt, Human
agggaguggggggcccagccccuucucuucucccccgccaaaccacagugggagcuggggca

SEQ ID NO: 426852 - RNA, 62 nt, Human
aggaggacaccucccugucggagagugaggggccccgccagcccgauggggaugaggaggag

SEQ ID NO: 426853 - RNA, 62 nt, Human
ucaguuucuuuaucuguaaaauggagaccaccccccgccacgcugaacggugauucugugac

SEQ ID NO: 426854 - RNA, 62 nt, Human
gggucuccauggugcuaggccaggguggccagccccgccaggaggccuggccugggcacacg

SEQ ID NO: 426855 - RNA, 62 nt, Human
cuuccuaaacccaaugacuucccugcuccaacccccgccaccucagggcacgcaggaccagu

SEQ ID NO: 426856 - RNA, 62 nt, Human
ucacaaaacauuacucauuugauuucccccacccccgccaaccauuuaaaaaaguuugccgg

SEQ ID NO: 426857 - RNA, 62 nt, Human
agggacguggaaacaggaggugaacuaaggcaccccgccacccacuguggcagcuugaauuu

SEQ ID NO: 426858 - RNA, 62 nt, Human
ccacccucuuugagaucagcguucggagagguccccgccagcccgguggcugcccucagguc

SEQ ID NO: 426859 - RNA, 62 nt, Human
gccugggccccucagccacccuuggucucaugccccgccauggucacccucaggaacccacc

SEQ ID NO: 426860 - RNA, 62 nt, Human
gcgccugcgugcaggccuggccgugguucgcuccccgccagcccacgugccccagaagggcc

SEQ ID NO: 426861 - RNA, 62 nt, Human
auaucauaauuugauucucccuccccccauccccccgccaacucuguaaaccccaaguauaa

SEQ ID NO: 426862 - RNA, 62 nt, Human
cacgaccgcguguguugccccugcccugggcuccccgccaugacaucuucaccuugcagcuu

SEQ ID NO: 426863 - RNA, 62 nt, Human
caccugcuucacacggaccauucucugaccgcccccgccaaaccucaugcuccccacuugcc

SEQ ID NO: 426864 - RNA, 62 nt, Human
gggcaggaggggggcugugaccccugcccuuuccccgccagagaccucaggcucucagcaca

SEQ ID NO: 426865 - RNA, 62 nt, Human
cgggcgcccaggacccuggccugcagagacgcccccgccacaggauccagagcaagcaccgc

SEQ ID NO: 426866 - RNA, 62 nt, Human
cuuucucccucccgccuccguccccugcugccccccgccagcccucaccaccugcccuccuu

SEQ ID NO: 426867 - RNA, 62 nt, Human
ccauuugcgguuuugugggcuucuggaggguuccccgccauccaggcuggucucccucccuu

SEQ ID NO: 426868 - RNA, 62 nt, Human
ccaaggaggaacuguagcugcccccgugucacccccgccaucacugcuggacaggagccacc

SEQ ID NO: 426869 - RNA, 62 nt, Human
gcucacugcagccuugacccccucccugaccuccccgccagcuggacuccagccauccuccu

SEQ ID NO: 426870 - RNA, 62 nt, Human
gcucuccaggcuguuaaccuuuuccguugcucccccgccacccaccuccuccuccccaggcc

SEQ ID NO: 426871 - RNA, 62 nt, Human
aggagcccuaccucccugccauuauagcugcuccccgccagaagccugugccaacucucugc

SEQ ID NO: 426872 - RNA, 62 nt, Human
uuccugggagucgaaguugaaaggaagcuuucccccgccaaggacgccuaccccgaaaccgg

SEQ ID NO: 426873 - RNA, 62 nt, Human
caggaacaaagacagaaaccaugacagggcugccccgccaggccccgguggguuugucugca

SEQ ID NO: 426874 - RNA, 62 nt, Human
cuccgccaguccgacugcccuccccaccccacccccgccaccccccacaugugaccacugca

SEQ ID NO: 426875 - RNA, 62 nt, Human
uugagcucuccagacugugcccuuaccgccuuccccgccacacccgcucugucuucccacug

SEQ ID NO: 426876 - RNA, 62 nt, Human
aaucaugcugcagcccaggggcgucugcugugccccgccaaucacgagacugggggaccggc

SEQ ID NO: 426877 - RNA, 57 nt, Human; identical to SEQ ID NO: 242325

SEQ ID NO: 426878 - RNA, 62 nt, Human
uccaagcagucauuucagggggcuccugcugaccccgccacucagcagugcacuccccggau

SEQ ID NO: 426879 - RNA, 62 nt, Human
uuugccauucaagcaacauugugaucuuucuuccccgccacgugugugggaaugauugaguc

SEQ ID NO: 426880 - RNA, 62 nt, Human
cuucccccaaacuccagggaauggaggggggaccccgccagccaaaacauuccccccauucc

SEQ ID NO: 426881 - RNA, 62 nt, Human
cgaggcccacggggcccgcgccugccucccuuccccgccaccgggcccucugccauuaaagc

SEQ ID NO: 426882 - RNA, 62 nt, Human
agugcccacugacccacccacccaccuacaccccccgccacacacacacacaaacgugcaca

SEQ ID NO: 426883 - RNA, 62 nt, Human
gcucaguggucccgaggcccuagacccccaccccccgccaguugcuuugucugguagcucaa

SEQ ID NO: 426884 - RNA, 62 nt, Human
acugagcugccaguggggucgugaggcaagauccccgccacccggggacaucuucaaucuag

SEQ ID NO: 426885 - RNA, 62 nt, Human
acaagcugucuuucccagucagccagggagcuccccgccaggccacgccccagccacuuugc

SEQ ID NO: 426886 - RNA, 62 nt, Human
cuaggggccuccccuucucauccuccccacccccccgccaagguucucacacuggccugggc

SEQ ID NO: 426887 - RNA, 62 nt, Human
aacucggggccaccuccacuccaugugcccagccccgccacaaccucuccuccagcacauuc

SEQ ID NO: 426888 - RNA, 62 nt, Human
auugugaucaaaagggcuaugggaagggcagaccccgccaaugauuucucuucaccugucuu

SEQ ID NO: 426889 - RNA, 62 nt, Human
ggacccccugugucucugaccaccccccugacccccgccauuacuuucuuuucuggagugcc

SEQ ID NO: 426890 - RNA, 62 nt, Human
ccugccccaaccggagaggccggugcacagggccccgccaggggcugggggcaucccggcuu

SEQ ID NO: 426891 - RNA, 62 nt, Human
guucuuccaaacuugaccgcacccugccccacccccgccacgucccacuaggcguccucccg

SEQ ID NO: 426892 - RNA, 62 nt, Human
ucugacuugcccaauccccuggauauggugagccccgccaugcuuuuauucuguaucgcuuu

SEQ ID NO: 426893 - RNA, 62 nt, Human
gucucccacagcugugccgggcagggggccugccccgccauccugacgccgcccucuucuuc

SEQ ID NO: 426894 - RNA, 62 nt, Human
agccugguucccgcggcccauuuggucagcuuccccgccacgggcaccucguucuuccacac

SEQ ID NO: 426895 - RNA, 62 nt, Human
auagggagcagaugcaaugacucaggacauccccccgccaaaagcugcucagggaaaagcag

SEQ ID NO: 426896 - RNA, 62 nt, Human
ucaccucugccucaucuuuccucccgucccugccccgccaccuccccaaagaauugaaacgu

SEQ ID NO: 426897 - RNA, 62 nt, Human
uggugggggaggaaccucaggggcuaugcagcccccgccagcugcccucgaaucccguccag

SEQ ID NO: 426898 - RNA, 62 nt, Human
caccagacccuauugcuucaacagugcuuggcccccgccagcuugucccagccacucuagcu

SEQ ID NO: 426899 - RNA, 62 nt, Human
ggggcugcagcccuguugcaauuccaugcuucccccgccaaccagcuccugcugccaucccc

SEQ ID NO: 426900 - RNA, 62 nt, Human
uugcaagggcuuuccuguagggucuggggcuuccccgccacaucgcggcccuccagccuggc

SEQ ID NO: 426901 - RNA, 62 nt, Human
cgcauuccacucagccaggguccagcugcagcccccgccacccuuccuucccuucccugucc

SEQ ID NO: 426902 - RNA, 62 nt, Human
aggaauagagggggacagucugucaccucccuccccgccacuuuguguagauccuaccugga

SEQ ID NO: 426903 - RNA, 62 nt, Human
ggccaggggcggccggacccgucccuccacgaccccgccaccccuccuaggccuggcuuugu

SEQ ID NO: 426904 - RNA, 62 nt, Human
cacuccaccauccccaccccaccccaccccacccccgccaugcaacgggauugaaggguccu

SEQ ID NO: 426905 - RNA, 62 nt, Human
cguggcgcucuguaacuuccugccgucugccaccccgccacguguauuuaacccucgcacuu

SEQ ID NO: 426906 - RNA, 62 nt, Human
aggcagccugccgcaaacacacggauggcuccccccgccacgaagguugagaacaaagccag

SEQ ID NO: 426907 - RNA, 62 nt, Human
gccuccuaccugugccuuucucugaggggacaccccgccagagagggccccgggagccgggg

SEQ ID NO: 426908 - RNA, 62 nt, Human
gcuuauacugcuccaucuuccccggccacaugccccgccaaguacugcacagggacccccca

SEQ ID NO: 426909 - RNA, 62 nt, Human
cuuccuuccacccugcagcccguguccaggagccccgccaggugcccgcgccaggcccucag

SEQ ID NO: 426910 - RNA, 62 nt, Human
ccagcuggcggguguggagaccaggcuccugaccccgccaugcaugcagcgccaccuggaag

SEQ ID NO: 426911 - RNA, 62 nt, Human
gagggcuuggugccuagcugaguccucgcuguccccgccauccccugaucugugcggcucca

SEQ ID NO: 426912 - RNA, 62 nt, Human
ugugauccuggaggccccccggccuggccccgccccgccagccgcccccguuagcgucauaa

SEQ ID NO: 426913 - RNA, 62 nt, Human
ggacgccaaggccgcaggacuggagggccaggccccgccacccccacgggagacccgggaca

SEQ ID NO: 426914 - RNA, 51 nt, Human; identical to SEQ ID NO: 241951

SEQ ID NO: 426915 - RNA, 62 nt, Human
uucugcucggccacgcggugggaaccccgcguccccgccauguggcagaggggucucagucg

SEQ ID NO: 426916 - RNA, 62 nt, Human
agccgggcggggcuggcuguaagggguugcccccccgccagugccuuggauauuucuggggu

SEQ ID NO: 426917 - RNA, 62 nt, Human
cagaccacgcccagaggaggggaggcacuggcccccgccacaggacuggagacgcaagaaca

SEQ ID NO: 426918 - RNA, 62 nt, Human
guucuggacucaccccucauccgggcccccagccccgccagagccuccguggcugcgggugu

SEQ ID NO: 426919 - RNA, 62 nt, Human
gugauucugagcuugcaaugccgccaagcgccccccgccagcccgcccccgguuguccaccu

SEQ ID NO: 426920 - RNA, 62 nt, Human
uccaccagcgccugccucggccccuccucugcccccgccagaucccguggugcuggggaugg

SEQ ID NO: 426921 - RNA, 62 nt, Human
ugggggucgggggggacauuggaaaggagggaccccgccaccccagcagcugaggaggggau

SEQ ID NO: 426922 - RNA, 62 nt, Human
ugcauggcuccucccccacucaagcaauagggccccgccauaggaagacccccagagagagg

SEQ ID NO: 426923 - RNA, 50 nt, Human; identical to SEQ ID NO: 240636

SEQ ID NO: 426924 - RNA, 62 nt, Human
ccagggggcccugggccucuaugauggacacaccccgccauaugcugccugccucggcuuug

SEQ ID NO: 426925 - RNA, 62 nt, Human
aaaccuuuaauuccaaaagaaauccccccucuccccgccaaaaaaggcguucccaccgcccg

SEQ ID NO: 426926 - RNA, 62 nt, Human
cccgagggcagccucucggugccaagagccauccccgccaacagccagccaggacacggggc

SEQ ID NO: 426927 - RNA, 62 nt, Human
ugguuugcaucccagguuccucgcccaccuacccccgccacaccccgucuuuuuagagaucu

SEQ ID NO: 426928 - RNA, 62 nt, Human
gugggucugucucaugcucucccuguuccucuccccgccaccccagggccuccaagccaccu

SEQ ID NO: 426929 - RNA, 62 nt, Human
ccucaggguuauauuucccucuccccuucccuccccgccaagagcucugccaggggcgggca

SEQ ID NO: 426930 - RNA, 62 nt, Human
cugggccuccccggcagcaagaccccggcacuccccgccaggcccagggugggguggauggg

SEQ ID NO: 426931 - RNA, 62 nt, Human
agcuaagcccuuggccuccccgccccacccgcccccgccaccccuccacgccagggucccuc

SEQ ID NO: 426932 - RNA, 62 nt, Human
accccgccugccgcccccuguccagguucccuccccgccacagugaaauaaagcaucccacc

SEQ ID NO: 426933 - RNA, 62 nt, Human
aucccuaccucccaccaccuaguggccaaacaccccgccaggaguucaaugcugggagaggu

SEQ ID NO: 426934 - RNA, 58 nt, Human; identical to SEQ ID NO: 240600

SEQ ID NO: 426935 - RNA, 62 nt, Human
caucuuccagauugguuuaaccaauuacucguccccgccauuccagggauugauucucacca

SEQ ID NO: 426936 - RNA, 62 nt, Human
uuccgccaugauuguaaguuuccugaggccucccccgccauguggaacugugagucaauuac

SEQ ID NO: 426937 - RNA, 62 nt, Human
ucaguacugggggcgaaacagccaggugauccccccgccauuaucucccccuaguuagagac

SEQ ID NO: 426938 - RNA, 62 nt, Human
cccaguucgaagcaaacagcuuacugccuaguccccgccaaucccaagggcgggcuggcuga

SEQ ID NO: 426939 - RNA, 62 nt, Human
cgcugccugaaauaggguuggcgcauacccacccccgccacggccacaagcccuggcauccc

SEQ ID NO: 426940 - RNA, 62 nt, Human
accuucaggcuuccccagccaugacacuucagccccgccacccaugccugucugcugcagcc

SEQ ID NO: 426941 - RNA, 62 nt, Human
agagcaggcuuugugagagaggaccuccaugcccccgccaccuccccacuccagcagauaag

SEQ ID NO: 426942 - RNA, 62 nt, Human
auaauaacuauaaucccuugcucaccccuuucccccgccaaauaagaaacgcaagccagacc

SEQ ID NO: 426943 - RNA, 62 nt, Human
gacagagagauggacaugcguccccucccuccccccgccaagugcucacacacaaccucacg

SEQ ID NO: 426944 - RNA, 62 nt, Human
acacgcagauggaggcgccucacugggaggugccccgccagcccugggcagugucaggcagg

SEQ ID NO: 426945 - RNA, 62 nt, Human
acuaggccaccccagcccccugacaccccagcccccgccagucaccccuccccgcacacacc

SEQ ID NO: 426946 - RNA, 62 nt, Human
ggaucucccgggugugaggggcuuggccugcgccccgccagcugcccgcagaggugcagccu

SEQ ID NO: 426947 - RNA, 62 nt, Human
gugggggggcggggcugacccugaacccucccccccgccaggucggggaggggucccaccac

SEQ ID NO: 426948 - RNA, 62 nt, Human
uugugggaaaacuauaaacucucuuguuacagccccgccaccccuugcuguguguauauaua

SEQ ID NO: 426949 - RNA, 62 nt, Human
uucagucccagcuguaggcuuguaaauacccgccccgccaaaccgcauagagaacguggcag

SEQ ID NO: 426950 - RNA, 62 nt, Human
ccugcaggugugaccccgccugcucuuuccucccccgccagguguggccccgccugcucuuu

SEQ ID NO: 426951 - RNA, 62 nt, Human
cccgccccgcgcgccgguccggcgccccgcacccccgccaggcgcaugucugcaccuccgcu

SEQ ID NO: 426952 - RNA, 62 nt, Human
cuauggacguuaauuugaccgucuacuccaauccccgccaagagacuggcauagcuggacau

SEQ ID NO: 426953 - RNA, 62 nt, Human
cacugucauuguguuucccagccucuccacucccccgccagaaaggagccugagugauucuc

SEQ ID NO: 426954 - RNA, 62 nt, Human
ccgcgagagccuuguuccuggaggcaggagcgccccgccauccuggguacccgcggguccgc

SEQ ID NO: 426955 - RNA, 52 nt, Human; identical to SEQ ID NO: 240334

SEQ ID NO: 426956 - RNA, 62 nt, Human
uggguguggggcagugugagguaguccuggauccccgccaggguggcccagacgccagcccu

SEQ ID NO: 426957 - RNA, 62 nt, Human
gacacagccugugggcucccggaccgagugucccccgccaggcuacuccuaacuaacgcguu

SEQ ID NO: 426958 - RNA, 62 nt, Human
gagggagggcuggcccauaggugcugcuggcuccccgccaccagcugggccucagcccucac

SEQ ID NO: 426959 - RNA, 62 nt, Human
aaagcauauaaaauacaaggugaaagccccccccccgccacauuagcugcgccccugaagug

SEQ ID NO: 426960 - RNA, 62 nt, Human
cgcccagagcucgugacgagcaagugcuggguccccgccaggcaccccgaggcggcgcucug

SEQ ID NO: 426961 - RNA, 62 nt, Human
cgaaaccacagcccuuaccccaaucccacgagccccgccaacgaaccacaggugcugggcuu

SEQ ID NO: 426962 - RNA, 62 nt, Human
ccgguguguggcccgcucucacccaggcacagccccgccaccauggaucuccguguacacua

SEQ ID NO: 426963 - RNA, 62 nt, Human
gugccagugauggugggugggggcugggccuuccccgccaccuccaccccuguugugaccug

SEQ ID NO: 426964 - RNA, 57 nt, Human; identical to SEQ ID NO: 240800

SEQ ID NO: 426965 - RNA, 62 nt, Human
gcuacuuacaucucccucccuuggcugaggucccccgccacagccuggacccuucccucaga

SEQ ID NO: 426966 - RNA, 62 nt, Human
agugugagucuggccugcgugcggugaggaggccccgccaagagacugguggacaucugacu

SEQ ID NO: 426967 - RNA, 62 nt, Human
aaaccacccugccugauccugccccugccugaccccgccacgcccugccguccagcaugauu

SEQ ID NO: 426968 - RNA, 62 nt, Human
ugagcaucugggcgccgggacgcugcagugauccccgccagagccugugcccuuccugcucc

SEQ ID NO: 426969 - RNA, 62 nt, Human
agcgagauugcucugcagccagugagggagguccccgccaugccggcuggaagaagaaccuc

SEQ ID NO: 426970 - RNA, 62 nt, Human
uguucagaugacagcgaccgccuuuucauuccccccgccaccuguacucacccucacgcucu

SEQ ID NO: 426971 - RNA, 62 nt, Human
uccgccccgcuucucuuauucguguuaggugcccccgccaggcauugcaggcuuagucgugg

SEQ ID NO: 426972 - RNA, 62 nt, Human
gugcuuuuccaguucuucuggaauugggggacccccgccaaagacugagcccccugucuccu

SEQ ID NO: 426973 - RNA, 62 nt, Human
auguggauuuuggggggucccuuuugugucucccccgccauucaaggacuccucucuuucuu

SEQ ID NO: 426974 - RNA, 62 nt, Human
aacacaguggagaaccgaaaccccccccccccccccgccacccucucggacaguuauucauu

SEQ ID NO: 426975 - RNA, 62 nt, Human
accggugccaaacccagccccugcggccgucaccccgccagccuacacugccagccgccacc

SEQ ID NO: 426976 - RNA, 62 nt, Human
ccaguucaccuacagagguagagcacucacgcccccgccauugagaauaagguuccauugcg

SEQ ID NO: 426977 - RNA, 62 nt, Human
agugcccccgccaucccgccaccaggacugcuccccgccagcacguccagagcaacuuaccc

SEQ ID NO: 426978 - RNA, 62 nt, Human
cggaucccgugcacccugggacccagaagugcccccgccaucccgccaccaggacugcuccc

SEQ ID NO: 426979 - RNA, 62 nt, Human
gcacugcccucccucacccauauugcaugcccccccgccauucccuuacaccuaccccaccu

SEQ ID NO: 426980 - RNA, 62 nt, Human
gcaugcccaguauugccaaggaccgggcccugccccgccacccuaccucccaccccagcagc

SEQ ID NO: 426981 - RNA, 62 nt, Human
cuagggcuugggcuguuugugugauaccggccccccgccagacaauagccuuugcugacacc

SEQ ID NO: 426982 - RNA, 62 nt, Human
ugcacgccgccacccccuccccgcagcccucaccccgccaggagccacugcucucccccuug

SEQ ID NO: 426983 - RNA, 62 nt, Human
cccuguugccucucccgccccugccccccccgccccgccaaaagccgagggggugcuggcag

SEQ ID NO: 426984 - RNA, 62 nt, Human
acaagcucugagcccugggcacccaccuccacccccgccacggccacccuccuucccgccgc

SEQ ID NO: 426985 - RNA, 54 nt, Human
ugcaucccuaccagcggugaguguggcuggcaaccucgacucccuggugcucuu

SEQ ID NO: 426986 - RNA, 64 nt, Human
ugcggcuccaccugaccagugggucagcaggcacggcuggcagccuucucugcccugagggucg

SEQ ID NO: 426987 - RNA, 64 nt, Human
gcgugcucuucacccucuggggcgccccugcugcggcuggcaggugcagacagccuuugcuggu

SEQ ID NO: 426988 - RNA, 64 nt, Human
accccaggucaugccagcggcagaggacgugaggggcuggcagcaggcagggcggccccaggcc

SEQ ID NO: 426989 - RNA, 64 nt, Human
aauaugauugggguacaguagaggugauuaauggggcuggcaucucucuuuggccugagguucu

SEQ ID NO: 426990 - RNA, 64 nt, Human
gcagcccauugcugaagccaggauguucugaccuggcuggcaucuggcacuugcaauuuuggau

SEQ ID NO: 426991 - RNA, 64 nt, Human
uaaugguguagaacguuccucuuuuuauagugguggcuggcaagaaggaagcaguucuccacgu

SEQ ID NO: 426992 - RNA, 64 nt, Human
uccccugcaggagggaggcuccaggguaagacagggcuggcaggagcagacugccucagcccau

SEQ ID NO: 426993 - RNA, 64 nt, Human
cgaagauugccugccagaggacugaccacagccuggcuggcagcugcucuguggaggaccucca

SEQ ID NO: 426994 - RNA, 64 nt, Human
agguggcacuggcucccacucccaccccugcccaggcuggcaucuagaaggcgucaugaauuac

SEQ ID NO: 426995 - RNA, 64 nt, Human
ggaaacagacaguaacgucaaggaaguagauacuggcuggcauugucaguguucuaaguuucag

SEQ ID NO: 426996 - RNA, 64 nt, Human
agugccucauaggacucauguucucuccaaccagggcuggcaucacugcuuugcaaaguggggc

SEQ ID NO: 426997 - RNA, 64 nt, Human
uccacugggcugcccaagcugcaugucaccugagggcuggcaggaaggggcgagaaaucccagg

SEQ ID NO: 426998 - RNA, 64 nt, Human
ugugguuggugucuuaacucuccugggaaaaggaggcuggcacacacugggaugccgcagccug

SEQ ID NO: 426999 - RNA, 64 nt, Human
gggcagguuggugggggccucgguguggagaagcggcuggcagcccaccccucaacaccucugc

SEQ ID NO: 427000 - RNA, 64 nt, Human
gcagggaacugccuccucuccccaccagcaccauggcuggcaucgcucaggugggcaggguaga

SEQ ID NO: 427001 - RNA, 64 nt, Human
ugacaccuuaugccauuucaagaggagaaaugcaggcuggcagagcaauuuccagaaauggaau

SEQ ID NO: 427002 - RNA, 64 nt, Human
uguuuuaaauuuugugguuccuucccuuuccucccccucccaugcguaagacguucuguguaac

SEQ ID NO: 427003 - RNA, 64 nt, Human
ucuucaguccucucacuuauucuauuucccaacccccucccacuuguuugugugaucucagaac

SEQ ID NO: 427004 - RNA, 64 nt, Human
gggagagaucaccacucuaaccucggccugacaucccucccaucccauauuuguccaaguguuc

SEQ ID NO: 427005 - RNA, 64 nt, Human
cuuuugguuaaacuaauaaacuaguuugggacuuggcuggcaugugcugccagacccaaaggga

SEQ ID NO: 427006 - RNA, 64 nt, Human
ugucugcauguccaccuuggaaucuggcugaacuggcuggcaggaccaagacugcggcuggggu

SEQ ID NO: 427007 - RNA, 64 nt, Human
ugucuuuuucaugucuaaccauugggaagguagaggcuggcagggaagacaaaucugcuacaag

SEQ ID NO: 427008 - RNA, 64 nt, Human
uuucuguccuuuuucuugcugauuuuaugcaaagggcuggcauucugauuguucuuuuuucagg

SEQ ID NO: 427009 - RNA, 64 nt, Human
accugcauaccaaccccuccuuuacccacguuggggcuggcauaagcugcuucccugagaggac

SEQ ID NO: 427010 - RNA, 64 nt, Human
cagcgccgcacacacagaugcucagucucagagaggcuggcacggccuggcagucugagaaaag

SEQ ID NO: 427011 - RNA, 64 nt, Human
ccagcacugagucugggacacucagcgggaagggggcuggcaucgccagcgacccacacauucc

SEQ ID NO: 427012 - RNA, 64 nt, Human
gcggaggcgccauugaaagcauggucuugccaguggcuggcaaggcgguuuuguucugcucagu

SEQ ID NO: 427013 - RNA, 64 nt, Human
agggggccgaccccuuuccccaggcacagccccaggcuggcaaagggagggcccugggcugggu

SEQ ID NO: 427014 - RNA, 64 nt, Human
ugugggcaggggacagggcgugggugggggccgaggcuggcacgccccucugcccucaccgucu

SEQ ID NO: 427015 - RNA, 64 nt, Human
aguccgaggccagccuccuccagcugcuggcaggggcuggcacccaugggacacccucugcccc

SEQ ID NO: 427016 - RNA, 64 nt, Human
cccugccccaccccaccucacagcuacucaguggggcuggcaucaagggagacaccaguggugc

SEQ ID NO: 427017 - RNA, 64 nt, Human
cugacccccuccccugaaaacgaaggggccccggggcuggcaagcagggaaagcuccacggugc

SEQ ID NO: 427018 - RNA, 64 nt, Human
uaaaggcuggaggcuguuucucugggcuucaaauggcuggcaaggcuggcucucaaaucccaaa

SEQ ID NO: 427019 - RNA, 64 nt, Human
cuguuccagcccaggcagagaucaggugggcagaggcuggcagugcugauucagccuggccauc

SEQ ID NO: 427020 - RNA, 64 nt, Human
agauucugccaacuguggaaacuucagucccucaggcuggcagccaugccaguaccugccuggg

SEQ ID NO: 427021 - RNA, 63 nt, Human
uugccccacucaucugccgccuuugcuuuugguugggggcagauuggguuggaaugcuuucca

SEQ ID NO: 427022 - RNA, 63 nt, Human
gggugcuaagaggaaggaugaagggcuucaggcugggggcaguggacagggaauugggauacc

SEQ ID NO: 427023 - RNA, 63 nt, Human
gcguuuguaagaaauaagcucuagugauaucugugggggcaaaauuuaauuuggauuugauuu

SEQ ID NO: 427024 - RNA, 64 nt, Human
cucuaaaguaacuccuuauagggaagccuuucuuggcuggcaacacacacacacacacacacac

SEQ ID NO: 427025 - RNA, 64 nt, Human
cucccagucacggaccaaauacuugcaaguuagaggcuggcaggggggauuuuuaugcuggaga

SEQ ID NO: 427026 - RNA, 64 nt, Human
gcaccagcugagagagacuugccgcaaagcacaaggcuggcagagauuuauguaugacuugcac

SEQ ID NO: 427027 - RNA, 64 nt, Human
auggauaggucaucucagcccaaagggccuccuuggcuggcaugguucuguguuacguugaagc

SEQ ID NO: 427028 - RNA, 64 nt, Human
ucagccagcccuggaggcuggauggcuccccugaggcuggcauccuggcuggcuguguccucuc

SEQ ID NO: 427029 - RNA, 64 nt, Human
cuccccgcugugguuggcagccacccaccccagaggcuggcagagggaaagggguacacugagg

SEQ ID NO: 427030 - RNA, 64 nt, Human
uuuggccaucagauggacgaucugaacauaggguggcuggcagaggggacccccaggagccuga

SEQ ID NO: 427031 - RNA, 64 nt, Human
cgaaacagcuguagagaugaaaacaggcugcagaggcuggcacagccuggccggcuuuucucca

SEQ ID NO: 427032 - RNA, 64 nt, Human
uaaaaguuagcuuuuaucugcagggcuagguuaaggcuggcauucuuacuuuuacauuaaaaaa

SEQ ID NO: 427033 - RNA, 64 nt, Human
aacuuuuaagugugugcacacaggagugcugccaggcuggcaagagcaggucggggcuggaugg

SEQ ID NO: 427034 - RNA, 64 nt, Human
cuuaucuggaagaucugcaaacauuaccuaaauaggcuggcaagauaaacacuuucuggaaccc

SEQ ID NO: 427035 - RNA, 64 nt, Human
accucuuaugugcacuuuaaagauagacuuuaggggcuggcacaaaucugaucagagacacaua

SEQ ID NO: 427036 - RNA, 64 nt, Human
ccggccuggcagugggacaaucgccagaggguggggcuggcagaacaccaucuccagccucagc

SEQ ID NO: 427037 - RNA, 64 nt, Human
ccccaucuggcugugacagccucugcaguccgugggcuggcaguuuguugaucuuuuaaguuuc

SEQ ID NO: 427038 - RNA, 64 nt, Human
uugggaccagcagcccccagcauccucuugcacuggcuggcacaaaaagaaaccugcuguauac

SEQ ID NO: 427039 - RNA, 64 nt, Human
gguauccagagagccauacuucugagggaagacuggcuggcaauaaagucaaauuaagugacca

SEQ ID NO: 427040 - RNA, 63 nt, Human
aaaaccuucaaggagcugacugaccacguagcaugggggcaagaggcgugggauggggauugg

SEQ ID NO: 427041 - RNA, 63 nt, Human
gcugcagcacuggggagccaggcgaggggggcuugggggcauggggccggaaagcaggcagaa

SEQ ID NO: 427042 - RNA, 63 nt, Human
gagggcaccgagacagaggguuaaaugaaccagugggggcaggucccuccaaccaccagcacu

SEQ ID NO: 427043 - RNA, 64 nt, Human
cuuuguuaagguuugggcaggagcagaacucuguggcuggcagccacuauucucaguuacaccu

SEQ ID NO: 427044 - RNA, 64 nt, Human
uccucugaaagccuggacuguccggcugugaacuggcuggcagguucugcacgugggugggggc

SEQ ID NO: 427045 - RNA, 64 nt, Human
ggggucgcaggaaucugcacucaacugcccaccuggcuggcagggaucuuugaauagguaucuu

SEQ ID NO: 427046 - RNA, 64 nt, Human
uggcaccuagaagccugcccacgauuccuaggaaggcuggcagacacccuggaacccuggggag

SEQ ID NO: 427047 - RNA, 64 nt, Human
aucuggcuuguccuggcagugcuugaaugccacaggcuggcaggggccucugggggccccuccc

SEQ ID NO: 427048 - RNA, 64 nt, Human
ggacuuggggcaaguucagaucagaagaggugcaggcuggcaccugcggcagguaccagccugg

SEQ ID NO: 427049 - RNA, 64 nt, Human
agacaacaucugcuccccccacaggggugcagguggcuggcagcaaacaggcucucugaagaca

SEQ ID NO: 427050 - RNA, 64 nt, Human
uccaccucgccugcucggccugaaagccaccaggggcuggcagcaguagcaggacagggauuca

SEQ ID NO: 427051 - RNA, 64 nt, Human
uuuaauuguaguucuguguacuuuuuuuggauggggcuggcauguuuucuuuguuuccuggcaa

SEQ ID NO: 427052 - RNA, 64 nt, Human
cuuuucacggagaccuaucugagguacaggauggggcuggcaccagaugaugucccaccacagu

SEQ ID NO: 427053 - RNA, 64 nt, Human
cagggccgugugggacgaguggaggccgcggccuggcuggcacgagagcccacgcccgcuucug

SEQ ID NO: 427054 - RNA, 64 nt, Human
agaucugugucaaguucaaugugagcccuggcaaggcuggcauauuaacaccugccuucuggcu

SEQ ID NO: 427055 - RNA, 64 nt, Human
aaaguaugcaggcccccugcagccucccaggacaggcuggcaagggaggagggccggccagcau

SEQ ID NO: 427056 - RNA, 64 nt, Human
cacacacacacacacacacacagccauucaucugggcuggcagaggggacagaguucagggagg

SEQ ID NO: 427057 - RNA, 64 nt, Human
cacggaagcagguucuuuauguccucuccucuguggcuggcaaggcucaccuggccuuauccac

SEQ ID NO: 427058 - RNA, 64 nt, Human
auggaucugguugugcauaggaugugggaggaggggcuggcagggccgccuucagaggcugcag

SEQ ID NO: 427059 - RNA, 51 nt, Human
uugagaucaucaacuccuaagggcuggcaagaagggcacugugucuacugu

SEQ ID NO: 427060 - RNA, 50 nt, Human
ugaccaagaaagauuccugaggcuggcaaguggggcaacguguggaggaa

SEQ ID NO: 427061 - RNA, 64 nt, Human
aucuaugggcauuugguggaugauaaugagcagccccucccagauagaaugucaauauuugagc

SEQ ID NO: 427062 - RNA, 64 nt, Human
gcuaucaauaaagaaucucuuuaagaucucacccggcuggcauucuguaacagaggggauuacc

SEQ ID NO: 427063 - RNA, 64 nt, Human
guucaaacgauucuccugccucagccucccgaguggcuggcaucaccacgcccagcuaauuuuu

SEQ ID NO: 427064 - RNA, 64 nt, Human
uuguagagcagcagaguggcugcgugaaacgggaggcuggcagguccucagauagguucugcag

SEQ ID NO: 427065 - RNA, 64 nt, Human
uucuuuaaauggggaaaaauauuugugacucuguggcuggcagaagaaauaagcccaugcaagu

SEQ ID NO: 427066 - RNA, 64 nt, Human
cgcaagccaucuaccuucuggcacagcaucagccggcuggcacccuuccgcaagugaacugguc

SEQ ID NO: 427067 - RNA, 64 nt, Human
ggccagcaccuuucucuuggccggauguccucagggcuggcagaugcaguagacugcaguggac

SEQ ID NO: 427068 - RNA, 64 nt, Human
gcuccugacacggacgccuauccagaagccagccggcuggcagcccccaucugcucaauaucac

SEQ ID NO: 427069 - RNA, 64 nt, Human
caucccgcuaaucuugggaauaagaggaggaagcggcuggcaacugaaggcuggaacacuugcu

SEQ ID NO: 427070 - RNA, 64 nt, Human
caugugauuucccacuggauccaggcccccauccggcuggcaggagggggcucugacgugcagg

SEQ ID NO: 427071 - RNA, 64 nt, Human
ugaggaagggucacccucugucaccugucugccuggcuggcaccucauaucucagcagagaagc

SEQ ID NO: 427072 - RNA, 64 nt, Human
agcaggguguggccccagaaagcugaggagugugggcuggcagagagcuucgagggcaaggcca

SEQ ID NO: 427073 - RNA, 64 nt, Human
ugacaugugccauuuuucagaggacgugcagacaggcuggcauucuagauuacuuuucuuacuc

SEQ ID NO: 427074 - RNA, 64 nt, Human
ucaaucugccuaggguccuguccaugccccccguggcuggcaccgcgugccaugcauacgaccg

SEQ ID NO: 427075 - RNA, 64 nt, Human
ggcuuuaaaaauugccaacaaagugagucaccagggcuggcaguagugugacggggcuguccug

SEQ ID NO: 427076 - RNA, 64 nt, Human
uucauauuugaagucuccggcuuugggccuggcaggcuggcacauccauauuuguauggaaaaa

SEQ ID NO: 427077 - RNA, 64 nt, Human
aaaaaugcuuuauaguuuagggcaguggaaggaaggcuggcaucaaaauauuuugaucaaaaaa

SEQ ID NO: 427078 - RNA, 64 nt, Human
accggagccggccuguuccccagagcccccggagcccucccagcccucaggccugcgccugggg

SEQ ID NO: 427079 - RNA, 64 nt, Human
accugccccuguauauccuuuuuuccccuccccucccucccagugguacuucuacuaaauuguu

SEQ ID NO: 427080 - RNA, 64 nt, Human
uggcauauggagccacgggccaccccggugucaucccucccaaugccacccucaucuuugacgu

SEQ ID NO: 427081 - RNA, 64 nt, Human
uggcugacacggacuuguaucuccuucagagcucggcuggcacccagccucccuucuccuucca

SEQ ID NO: 427082 - RNA, 64 nt, Human
gccauuucuggccauguucuauaccucaaagugaggcuggcagguacagagaugaacuguacac

SEQ ID NO: 427083 - RNA, 64 nt, Human
ggauauuacaauggccagcccagauggcucccugggcuggcauggggaggggagagaagguggu

SEQ ID NO: 427084 - RNA, 64 nt, Human
agacacccuccucuagaauuuaguggcgggucugggcuggcagagguagggggcugcuuugggc

SEQ ID NO: 427085 - RNA, 64 nt, Human
agaguccugugcugaauguggacucaaucccuagggcuggcagaaagggaacagaaagguuuuu

SEQ ID NO: 427086 - RNA, 64 nt, Human
cacccccaugucuguguaaccggagucaaggccaggcuggcagagucaguccuuagaagucacu

SEQ ID NO: 427087 - RNA, 64 nt, Human
gggcaguggcgccaguucccuuccauggucucccggcuggcaauguggugaagcugaguuucug

SEQ ID NO: 427088 - RNA, 64 nt, Human
aaaaaugggcaccaauggaggaaaaugacccuugggcuggcaggggcagugacccuuccagggu

SEQ ID NO: 427089 - RNA, 64 nt, Human
cuggagggcacaggcagagggcagcucccaggcuggcuggcaccccaagggaagagcuggucuc

SEQ ID NO: 427090 - RNA, 64 nt, Human
gggcacaauuccugugcucaaaaaugagagugacggcuggcaugguggcucccgccuguaaucc

SEQ ID NO: 427091 - RNA, 64 nt, Human
cuggccagagagggagcugcuagagauccaagaaggcuggcaggagugaggcucacaacucagc

SEQ ID NO: 427092 - RNA, 64 nt, Human
aagacagaaaauucaucugggauuuuccugcuguggcuggcacauucuucugauuaacagacac

SEQ ID NO: 427093 - RNA, 64 nt, Human
uaaguugaagaaaccucauguaaugaauccaccaggcuggcaguggugcauauaaacugugggu

SEQ ID NO: 427094 - RNA, 64 nt, Human
cccugccugaggccccgacgaggagggguaugcaggcuggcaggccccagagcugguggagggc

SEQ ID NO: 427095 - RNA, 64 nt, Human
ugccccacauucugacuugucacccauuuucguuggcuggcagguugagauguuuuucuuaaac

SEQ ID NO: 427096 - RNA, 64 nt, Human
agaccccaguggccacacugggauaggguggggaggcuggcagcccucuuuuauaaauauuaua

SEQ ID NO: 427097 - RNA, 64 nt, Human
uuauugcauucccuugccccaggccaccuccucccccucccaccuggugaccagaaggcgcucu

SEQ ID NO: 427098 - RNA, 64 nt, Human
cauggacacagggcacugcccuugccaacuuuuacccucccaagcaaugcuuuggcccagucgc

SEQ ID NO: 427099 - RNA, 64 nt, Human
aaaccucagggacaacauuuuugguguauuugagcccucccagcaaguuucaccuuggguuugu

SEQ ID NO: 427100 - RNA, 64 nt, Human
cuccaggccauggggaccaccacucaggguucggggcuggcaggaggguaguuucuccagucuc

SEQ ID NO: 427101 - RNA, 63 nt, Human
cgagagaaauaauucuuuaagcagaauaaaguuaggcuggcauugcucccuuaagaucuugcu

SEQ ID NO: 427102 - RNA, 64 nt, Human
aaugcugggauuacaggagugagccaccaugcccggcuggcaguugcauggaagagaacaccuc

SEQ ID NO: 427103 - RNA, 64 nt, Human
aggaguccagcaaucauuggggaagagagccugaggcuggcaauccuugcccagaacuuugguc

SEQ ID NO: 427104 - RNA, 64 nt, Human
ucucuacacaggugacugaaguugccucuguguuggcuggcaucccugaguccccuccgggcuc

SEQ ID NO: 427105 - RNA, 64 nt, Human
uacuuugaauguuaauuaguuugggacuuugauuggcuggcaaacauuuuaucauugucagaau

SEQ ID NO: 427106 - RNA, 64 nt, Human
ccugggcagucuguuuacagcuggcaaacagacuggcuggcaaguuguggggcugggucagaaa

SEQ ID NO: 427107 - RNA, 64 nt, Human
gcuccaggucugggacagggccugcaugcagucaggcuggcaguggcgcgguacagggagggaa

SEQ ID NO: 427108 - RNA, 64 nt, Human
gauggcuguggaguucaaaugucgaugcuacccuggcuggcaggcaccguggugugagcggaag

SEQ ID NO: 427109 - RNA, 64 nt, Human
agcugaacgcacuugcagcguccgagggccaccgggcuggcauuuugugacccuucccuguugc

SEQ ID NO: 427110 - RNA, 64 nt, Human
gggcuccaggaaaguguuucugggaggucaggagggcuggcagcugaacgcacuugcagcgucc

SEQ ID NO: 427111 - RNA, 64 nt, Human
cuguggggggucccauccggcuucagagagcucuggcuggcauugaccaugggggaaagggcug

SEQ ID NO: 427112 - RNA, 64 nt, Human
gugggagagaggugaaaagcgucccccacuagggggcuggcagugcaugugcuugaguuaaaug

SEQ ID NO: 427113 - RNA, 64 nt, Human
aggacaggccgggacaggccucacccaaggccaaggcuggcaucagccaaucauucagagcuga

SEQ ID NO: 427114 - RNA, 64 nt, Human
agcugcauuaaggauagaguuggaaugaggauguggcuggcauuuuuccccuuucauagauaac

SEQ ID NO: 427115 - RNA, 64 nt, Human
ggaaggaagccauggcugugguucagagagggugggcuggcaagccacuuccggggaaaacucc

SEQ ID NO: 427116 - RNA, 64 nt, Human
gggaaggggcgugucccuccucuuccuguagugccccucccauggcccagcagcuuggcugagc

SEQ ID NO: 427117 - RNA, 64 nt, Human
agggaucuucucccuccccucacccgcugcccagcccucccagcuggugucacucugccucuaa

SEQ ID NO: 427118 - RNA, 64 nt, Human
acauacaccaaagauguauuuggaucugggcacccccucccaggaucccuguacucacgugcca

SEQ ID NO: 427119 - RNA, 64 nt, Human
cugcagcuacgggcccuggggagaguuucgugaaggcuggcacgugcagcguccuuggcaguug

SEQ ID NO: 427120 - RNA, 64 nt, Human
uggauuuuuaaugaaacagacucagggagguaggggcuggcagggacccuagaauccuugugau

SEQ ID NO: 427121 - RNA, 64 nt, Human
ucacccugcguugcccucugggucugugagggugggcuggcaggaggccuaggccuugcccuag

SEQ ID NO: 427122 - RNA, 64 nt, Human
uugcuagcccugggguggcgucugccuaggagcuggcuggcagguguugggaccugcugcucca

SEQ ID NO: 427123 - RNA, 64 nt, Human
agaccacagugcugccaccagugccuaaacagguggcuggcauucgagacuuccuccuguuccc

SEQ ID NO: 427124 - RNA, 64 nt, Human
aacaaaggggcggcucagucccgagccucagcauggcuggcagcgcggcugacacacacguuca

SEQ ID NO: 427125 - RNA, 64 nt, Human
cugugaccugguccccaguguugcccuccccaguggcuggcaggggccugcuugcucacuagag

SEQ ID NO: 427126 - RNA, 64 nt, Human
auuuccguggacagcccgccgucaggguggcuggggcuggcacgggugucgaggcaggaaggau

SEQ ID NO: 427127 - RNA, 64 nt, Human
ccaauccugcugauguggcagucaauggcugcagggcuggcaaaccuccccuuagccagucagc

SEQ ID NO: 427128 - RNA, 64 nt, Human
gggugaagagaagcuguccguggcggcugguguuggcuggcauuggcacugggcugugcugacc

SEQ ID NO: 427129 - RNA, 64 nt, Human
caaaaaagaaaaaaaaaaguuuuaagaggggucaggcuggcagauaaaagucucuuaugaagca

SEQ ID NO: 427130 - RNA, 64 nt, Human
gaaggccgcgccugccuuucccaucugucugucuggcuggcagggaaggaaagaacuugcaugu

SEQ ID NO: 427131 - RNA, 64 nt, Human
uugcugguaauaauauuauccacagauuugcaauggcuggcaucugcuuuauucccauugcugu

SEQ ID NO: 427132 - RNA, 64 nt, Human
cauagacgaugaggggucugaaaggccaacccgaggcuggcagaucugaccccaaggagguccu

SEQ ID NO: 427133 - RNA, 64 nt, Human
aaaugagauagggaauauaaagcaagcagauaguggcuggcacauaguacaugcaauauguuug

SEQ ID NO: 427134 - RNA, 64 nt, Human
ggucuggaccacccagggccuccacugccaccuuggcuggcaagggagaaauguguuguguugu

SEQ ID NO: 427135 - RNA, 64 nt, Human
cccugucuccucguguuuacauucuguguguguccccucccacaauguaccaaaguugucuuug

SEQ ID NO: 427136 - RNA, 64 nt, Human
ggagguuguggaauuucuuucuucuccccuucuucccucccaaaagcuuagcuauguauaaagu

SEQ ID NO: 427137 - RNA, 64 nt, Human
uaguggguuuuggaggagggaguggaguaagaugcccucccacuuuuaucaguuuaguaguagu

SEQ ID NO: 427138 - RNA, 64 nt, Human
cauugaccgugcuggccccagugccuagaugcauggcuggcacauuguuggcacucaacaaugg

SEQ ID NO: 427139 - RNA, 64 nt, Human
cguucccacugccuggaugccggcuugaguucugcgcacgcaggauucaguguggggacggccc

SEQ ID NO: 427140 - RNA, 64 nt, Human
acccacaagccuauacaccauuuauauaccuacacgcacgcaagagacgcggagagauaggcga

SEQ ID NO: 427141 - RNA, 64 nt, Human
guggagcacuuugaaagaccgucgguugugugcacgcacgcacacacucaugcacacgcugaca

SEQ ID NO: 427142 - RNA, 64 nt, Human
uuuaaggaguggggaauugugaagcccacagaugcgcacgcaaugaccagcaggaaccggaagc

SEQ ID NO: 427143 - RNA, 64 nt, Human
uuccuaagcuaggucuaggucuacacuccuaggacgcacgcauaucagcccguguacccuguga

SEQ ID NO: 427144 - RNA, 64 nt, Human
gccaccgugggcgaccuggaggagauccagcgugcgcacgcagaguaccugcacaaggccgucu

SEQ ID NO: 427145 - RNA, 64 nt, Human
cgcagacacacacacacacacacauauauguauacgcacgcacccacacccuacagcagaucca

SEQ ID NO: 427146 - RNA, 64 nt, Human
cucaugugugggcacacacgcacaaacacacacacgcacgcacacaguggcagaagggauuuau

SEQ ID NO: 427147 - RNA, 64 nt, Human
gugugugugugugcgcgcgcgcgugcucgcugugcgcacgcacacaucuccucgucugggugug

SEQ ID NO: 427148 - RNA, 64 nt, Human
gccaggcgccugcacagacuggcugcuggaccugcgcacgcagcccaggaauggacauuccuaa

SEQ ID NO: 427149 - RNA, 64 nt, Human
ccagguccccugaucuuggggccuguuucccaugggauucaagagggacagccccagcuuugug

SEQ ID NO: 427150 - RNA, 63 nt, Human
agccuggccggaaggaagagcccuggaggugguugggggcaaaugugcccugaguccuugggg

SEQ ID NO: 427151 - RNA, 63 nt, Human
auaaacaucuauuugagacaauuaaaauccuucugggggcacuggaagcacaauacggugacc

SEQ ID NO: 427152 - RNA, 63 nt, Human
cugccagucccccugccccagggcucccggcuaugggggcacugaggaccagccauugagggg

SEQ ID NO: 427153 - RNA, 64 nt, Human
aacaggacaggguacccuugggucgcacgggccuggcuggcauguaaacggucaguugcacugc

SEQ ID NO: 427154 - RNA, 64 nt, Human
aaaggaagaaggcugugccuagaacaaagaaucaggcuggcaaagaaaucacaggucuuuccuc

SEQ ID NO: 427155 - RNA, 64 nt, Human
cacacacacacauucuugcucuacccaaagcucuggcuggcagcacuaaaugcuuugguggugu

SEQ ID NO: 427156 - RNA, 64 nt, Human
gagcccgucagcgugggggaaaggauucaguggaggcuggcagggucccuccagcaaagcuccc

SEQ ID NO: 427157 - RNA, 64 nt, Human
guuguuuuguuuuauuuuuuguuuuuguauccauggcuggcacuuuacucauugcacuugaguu

SEQ ID NO: 427158 - RNA, 64 nt, Human
agcaguuaaaguuuuugcuauuuaccuuugugcaggcuggcauaugcuaauuugggggugguaa

SEQ ID NO: 427159 - RNA, 64 nt, Human
ccacuccaacucccacugagcccuuuugcugcugggcuggcaggaaacuuuccccacucccuaa

SEQ ID NO: 427160 - RNA, 64 nt, Human
cuuuucacucauucacccuucuucccaaucaucuggcuggcauccucacaauugaguugaagcu

SEQ ID NO: 427161 - RNA, 64 nt, Human
aaaaaacaaaaaaaaacccugagaccaugaguggggcuggcaucuugccagccugggcuucagg

SEQ ID NO: 427162 - RNA, 64 nt, Human
cugugcuggcuuuucuggaacgccaggcgcccauggcuggcaccuuucugcuugcucugucucu

SEQ ID NO: 427163 - RNA, 64 nt, Human
cucaaacuuucccuucccagcacagaggaauauuggcuggcaugcaaccugcaaaagaaaaaug

SEQ ID NO: 427164 - RNA, 64 nt, Human
aaugccacucuugggccaaggcugugguccccguggcuggcaucuggcuugagucuccccgagg

SEQ ID NO: 427165 - RNA, 64 nt, Human
aucuguagaggagccuggagucggaucuagccauggcuggcagagguuucuagggugggcccca

SEQ ID NO: 427166 - RNA, 64 nt, Human
caucccaggguuacagcaagagccacugagguguggcuggcagagcaacugaggagcucugcga

SEQ ID NO: 427167 - RNA, 64 nt, Human
aaagcuuccuuuuuacuugugugguuauguguggggcuggcacccgaaaugugugacauucagc

SEQ ID NO: 427168 - RNA, 64 nt, Human
uuuuggcucaccucauuucaccccacgcucugcuggcuggcagaggagaaggcagucguuuccu

SEQ ID NO: 427169 - RNA, 64 nt, Human
aaauuaugaucugacuggaaaacaauccuguauccccucccaaagaaucaugggcuuuuuuuuu

SEQ ID NO: 427170 - RNA, 64 nt, Human
cacuuccagucuaagccaguggcuccugccacugcccucccauuaccuagauggcaccuccuuu

SEQ ID NO: 427171 - RNA, 64 nt, Human
aaaaaaaaaacugcuuuauccuccugucagcacccccucccaccccugcaacaaagacuugcuu

SEQ ID NO: 427172 - RNA, 64 nt, Human
cuccugaauuuucccaugguguucugacuucaagggcuggcagccagggagaaugggcccaggg

SEQ ID NO: 427173 - RNA, 64 nt, Human
auuaaaguggaccaauagggcugagcucucugugggcuggcaguccuggaagccagcuuucccu

SEQ ID NO: 427174 - RNA, 64 nt, Human
gagugagcacuuagguaucauaucagaugcucaaggcuggcagcuacccccuucuugagagucc

SEQ ID NO: 427175 - RNA, 64 nt, Human
ugcaguauuccuccagaagagcuaaccagggcagggcuggcaugagaagugacaucugcguuac

SEQ ID NO: 427176 - RNA, 64 nt, Human
ccaugggggugaggggacagacucugcucucacuggcuggcagccccaggagccuguucccuug

SEQ ID NO: 427177 - RNA, 64 nt, Human
uguauugcggugguaucaaccuggggggaggaggggcuggcacugagauuuuuuuuucaagauu

SEQ ID NO: 427178 - RNA, 64 nt, Human
cccaggccuuggcagcugugacauugggggccuaggcuggcaacuccgggggcucaacggugga

SEQ ID NO: 427179 - RNA, 64 nt, Human
cacgcagcccuuaccccaagcccucuagcuguguggcuggcaguguuggccacguaggggcucc

SEQ ID NO: 427180 - RNA, 64 nt, Human
agugcuaggauuacagguaugagccaccaugcccggcuggcaguuguauuuuuuaaagcccuuc

SEQ ID NO: 427181 - RNA, 64 nt, Human
gcucuggggcagaggaagcccagcccaagcacggggcuggcagggcgugaggaacucuccugug

SEQ ID NO: 427182 - RNA, 64 nt, Human
acaccugugcaccccaugaguagugcccacuugaggcuggcacuccccugaccucaccuuugca

SEQ ID NO: 427183 - RNA, 64 nt, Human
acuuuacaauguccccagccccucugcagcccguggcuggcagggcguucgaugugcgguuggc

SEQ ID NO: 427184 - RNA, 64 nt, Human
cagcugggaaggggcaggccggugccccaggggcggcuggcacagugcccccuucccggacggg

SEQ ID NO: 427185 - RNA, 64 nt, Human
uggagggagucugggcucccuccuacccagggagggcuggcagggcucuggcacggccggggug

SEQ ID NO: 427186 - RNA, 64 nt, Human
gccuagauccuaggucccuuuuccucccgaguuuggcuggcacgagagcuagcccagcacauga

SEQ ID NO: 427187 - RNA, 64 nt, Human
guaucugugauacauuauccgacuaaggacucugggcuggcagggccuucugccgggaaagcua

SEQ ID NO: 427188 - RNA, 64 nt, Human
ugacggcaucgcggccggaaccucugggcccggccccucccagggccgccgcuccgugggaaaa

SEQ ID NO: 427189 - RNA, 64 nt, Human
aggggccuaggcuaccauggacugaagggcaguccccucccaccuggugcccagggcuucugcu

SEQ ID NO: 427190 - RNA, 64 nt, Human
caggcaggcuugcucugucccuuccucucugcuucccucccaggccucgccagggcucccuucu

SEQ ID NO: 427191 - RNA, 64 nt, Human
uguugccuagaaaguucuggaauccacaaccaggggcuggcacuggagccagcagcuuggccga

SEQ ID NO: 427192 - RNA, 64 nt, Human
uuccccaggcugcccacucuggggacccgcugggggcuggcagagggcaucggucagcggggca

SEQ ID NO: 427193 - RNA, 64 nt, Human
cacagugccaccaagcucacaccuguccuucucaggcuggcaucucccccacccugugccccuu

SEQ ID NO: 427194 - RNA, 64 nt, Human
ccuccugcgcccugagacuggaccaggguuugauggcuggcagcuucucaaggggcagcuuguc

SEQ ID NO: 427195 - RNA, 64 nt, Human
ccccaguuggcgagggacacgaaggcugcggccgggcuggcagagggcccggccccugggggga

SEQ ID NO: 427196 - RNA, 64 nt, Human
cugcugcuugggccaaaaacauacagaggugcauggcuggcagucuugaaauugucacucgcuu

SEQ ID NO: 427197 - RNA, 64 nt, Human
guaagauaauuccacagcugucaacuuuguuuggggcuggcaacuucucugcuuaaacaggcua

SEQ ID NO: 427198 - RNA, 64 nt, Human
gcagcuccagacuccgcuuuggcaccucugcuccggcuggcauggcugcacgcuccggcugcua

SEQ ID NO: 427199 - RNA, 64 nt, Human
ccauacacugaggcggaagaucgcaagucagaguggcuggcaggcacaaccuccuggcacacca

SEQ ID NO: 427200 - RNA, 64 nt, Human
agcuucaguauguuuccucacccaaaaaccauuuggcuggcagaaauuaucuagaaaaauuauu

SEQ ID NO: 427201 - RNA, 64 nt, Human
uuauuuuugcacauaagccauaaccaauccucaaggcuggcacaggcuuuggggaagcccugga

SEQ ID NO: 427202 - RNA, 64 nt, Human
gcuggaagacaggaucaggugccagcggaccaucggcuggcagagcccagcggccaccacccgu

SEQ ID NO: 427203 - RNA, 64 nt, Human
agucugacuaugggucucacuggacuagaaucaaggcuggcaggcugccuuccuuccuggaggu

SEQ ID NO: 427204 - RNA, 57 nt, Human
ugauucacaccagggaauaggcuguugggcuggcaggagugaaaccgagcauaguuu

SEQ ID NO: 427205 - RNA, 64 nt, Human
caaccucuuugagacguccuuucccuacuccaugggcuggcauggugaggcuuuucaaguaccu

SEQ ID NO: 427206 - RNA, 64 nt, Human
augcucaccagccccagagucagagcuggccacaggcuggcagccuccaggggcuuaaaaaaaa

SEQ ID NO: 427207 - RNA, 64 nt, Human
gcccgccuccgccccgcgcgcagacaugcgccaccccucccaggggugagggggcguuggccuc

SEQ ID NO: 427208 - RNA, 64 nt, Human
gccaagugggguuggggguggggcugguccuucucccucccacaggccuguguucuuggggcug

SEQ ID NO: 427209 - RNA, 64 nt, Human
uugccugccuuauaggcauguagagacugccaggcccucccagggcagccccaaccaggucucc

SEQ ID NO: 427210 - RNA, 64 nt, Human
gaagccgcugucaugacaggacauggcacuggauggcuggcagagagcccuggcugggaguuag

SEQ ID NO: 427211 - RNA, 64 nt, Human
uugcgucuguugccuccccagcccugcacgcccuggcuggcacuguugccgcugcauucucgug

SEQ ID NO: 427212 - RNA, 64 nt, Human
gggcuguuuuuggccuaacccucagaaacacuggggcuggcacaaacucuugguuucuucaaca

SEQ ID NO: 427213 - RNA, 64 nt, Human
ccuuccugggccagggccguuucuggcacugggaggcuggcaggggccccucccugccucggcu

SEQ ID NO: 427214 - RNA, 64 nt, Human
gggugccauagugaggacccucguccuccagacuggcuggcaggagucaggccccagcagcccu

SEQ ID NO: 427215 - RNA, 55 nt, Human
auagcuuugcccugagaugagccggggcuggcaggagaaacugaggaaccacagu

SEQ ID NO: 427216 - RNA, 64 nt, Human
uugugauaauuuguaauugugacuuguucuccccggcuggcagcguaguggggcugccaggccc

SEQ ID NO: 427217 - RNA, 64 nt, Human
gugcgggcuaaugagccaauaaagcucacacuugggcuggcacccacuggagguggguauguuu

SEQ ID NO: 427218 - RNA, 64 nt, Human
caaggaccugcuagaccgagggcacuuccugagcggcuggcacaccaucuaccugcccgacugc

SEQ ID NO: 427219 - RNA, 64 nt, Human
augcucaguugggucggguggcaguugacuugguggcuggcauguucagcagugccuggggccc

SEQ ID NO: 427220 - RNA, 64 nt, Human
uggcaaagggagaacuggggugggcgggggguggggcuggcagggaauuagaauuucucucucu

SEQ ID NO: 427221 - RNA, 64 nt, Human
gccaccuccccuccccacagccuuccucacccuuggcuggcagacccacuggaggucaggcacg

SEQ ID NO: 427222 - RNA, 64 nt, Human
agguggugccaccaguuuugcagguggcaucagaggcuggcaugcuggcaggaacauccccucu

SEQ ID NO: 427223 - RNA, 64 nt, Human
gcacccaagaccucagggcacaaagaugggugaaggcuggcaugauccaagcaagacugagggg

SEQ ID NO: 427224 - RNA, 64 nt, Human
ggcagcucacugaucucuugccucugcugaugggggcuggcaaacuugacgaccccaacuccug

SEQ ID NO: 427225 - RNA, 64 nt, Human
gcagggcguggucccaacuacucagccuagcacaggcuggcaguugguacugaauugucagaug

SEQ ID NO: 427226 - RNA, 64 nt, Human
cauuugcucaaauuccugggcccccaaguuagcccccucccaggaguggucagcgggucacagc

SEQ ID NO: 427227 - RNA, 64 nt, Human
aaugaugccuuucuguaggcugguguuguugccucccucccaggaucccuuuggugaguauggu

SEQ ID NO: 427228 - RNA, 64 nt, Human
ucuuuccuuggcuggaaacaagugcaggaagcuccccucccaauuucuuaugcucccuuccccc

SEQ ID NO: 427229 - RNA, 64 nt, Human
aagggugacccagacucguaaaugaugcccuuguggcuggcauccagagggugccacggggucc

SEQ ID NO: 427230 - RNA, 64 nt, Human
ucugggucuguacuggggagggucacagcccacgggcuggcagccagcccagcaccuacuugua

SEQ ID NO: 427231 - RNA, 64 nt, Human
aagacugcaguuuuguggacuuuugaccaccuugggcuggcacucuuagcacaccugagacaga

SEQ ID NO: 427232 - RNA, 64 nt, Human
cugcggggcagcaggggccaagcaggcacucuggggcuggcaccagcaggcacugaagcugcgg

SEQ ID NO: 427233 - RNA, 64 nt, Human
accccagcauuccuggcuuucugggguccagauaggcuggcaagagcuguuuuugcauccauuu

SEQ ID NO: 427234 - RNA, 64 nt, Human
gacuucaggaaugacaaccuacccagccugguggggcuggcaggaugguggagguuucucaagg

SEQ ID NO: 427235 - RNA, 64 nt, Human
accgacggggacugcugagccuccugggacagcgggcuggcagggacuggcaggaggcaggugc

SEQ ID NO: 427236 - RNA, 64 nt, Human
auggcuaccuccucugacccauccacauccuugcggcuggcaggcaggauguuuugaaauggug

SEQ ID NO: 427237 - RNA, 64 nt, Human
acucccugguaccaguaggcaccuggcugagccuggcuggcacagaaaccucuacuaaaaagaa

SEQ ID NO: 427238 - RNA, 64 nt, Human
ucugcuaggucccaguaggacaggcagagcuccaggcuggcaccaugguaggccuccagggaaa

SEQ ID NO: 427239 - RNA, 64 nt, Human
cuacuaaaaauacaaaaaauuagccaggcgugguggcuggcaccuguagucccagcuacuuggg

SEQ ID NO: 427240 - RNA, 64 nt, Human
gucacaccgaccgcucucagggcccgcugcccugggcuggcaacaccauucuggccuuggccug

SEQ ID NO: 427241 - RNA, 64 nt, Human
cuggauucuggagcuguucuccauccaugagaguggcuggcaauggcugcucucaaucccuuga

SEQ ID NO: 427242 - RNA, 64 nt, Human
uggucuuuucaaauguccaucaauugauggggaaggcuggcacccaccaagaaguggaaguccu

SEQ ID NO: 427243 - RNA, 64 nt, Human
ugugcuccccugccacacugauggcucaagacaaggcuggcaaacccucccagaaacaucucug

SEQ ID NO: 427244 - RNA, 64 nt, Human
cagguuucugauaccuagcuccccaagcugacugggcuggcagaggagaacauguugagacaag

SEQ ID NO: 427245 - RNA, 61 nt, Human
uccccaaacagggcuccuaacaucauguccucccucccacuugccagggaacuuuuuuuug

SEQ ID NO: 427246 - RNA, 64 nt, Human
aucagagcuccucugcaggaaacaggcaggaugccccucccaaccccucagucccuacgucaag

SEQ ID NO: 427247 - RNA, 64 nt, Human
ggagggccuccaugugcaagcgcagaggaagagacccucccauguacgcaaagggcagccccag

SEQ ID NO: 427248 - RNA, 64 nt, Human
uguuccaccuagaauacaaguagagaagagcacuggcuggcaagcaucaacaggagucuucuuc

SEQ ID NO: 427249 - RNA, 64 nt, Human
ucuccaggggacauuucagccaugcugaaagggaggcuggcaguggucauuuggcccggaucua

SEQ ID NO: 427250 - RNA, 64 nt, Human
cucucaggacagacggcguggggagcacagaggaggcuggcagagcuggggacugagggcauug

SEQ ID NO: 427251 - RNA, 64 nt, Human
uuccagcggcucacaaagaauaagccugccuuagggcuggcaacaucuaagccucuaacagcac

SEQ ID NO: 427252 - RNA, 64 nt, Human
cuaggaguccugggagagcuguggugggaauaugggcuggcacugcugcagggcaagaacauuc

SEQ ID NO: 427253 - RNA, 64 nt, Human
ucaucccgaaguggugcuauggucuguuaaacagggcuggcaucagguagagggagcagagugg

SEQ ID NO: 427254 - RNA, 64 nt, Human
ggugagugcauaugaguguggcccugaggaccagggcuggcagauguugucuaccugcugaaga

SEQ ID NO: 427255 - RNA, 64 nt, Human
uguaaucaaauaguuaacaucaggaaguuaauuuggcuggcaaaauucuagggaaacuuggcca

SEQ ID NO: 427256 - RNA, 64 nt, Human
caagcuccuuguucucuacuguucaccgggaccuggcuggcaaaugacuuagcuauuaguauau

SEQ ID NO: 427257 - RNA, 64 nt, Human
ggccucggaacagggccuggguauccgcguggugggcuggcagcugacggccugcucaguggag

SEQ ID NO: 427258 - RNA, 64 nt, Human
uauguuccagcuuccugggucugcagguccagccggcuggcacccuccauguacccaggggaga

SEQ ID NO: 427259 - RNA, 64 nt, Human
gcuuacuaaucaucagaaaaucuguggccauuagggcuggcacguaaaaauccaaaaucacuca

SEQ ID NO: 427260 - RNA, 64 nt, Human
uaucuucaaauaccauagaauucuaaucucuggaggcuggcagcuugacuuggcacuuuagggc

SEQ ID NO: 427261 - RNA, 64 nt, Human
ccugugccccugccccggaccaagaagggcagcuggcuggcagacaaggugaagaggcugaugc

SEQ ID NO: 427262 - RNA, 64 nt, Human
gccccccuggggggcugcgccugggggccgauggggcuggcagcaccgagagccuggggggccc

SEQ ID NO: 427263 - RNA, 64 nt, Human
gcagcggucucugggggaucccccagcugaaggaggcuggcaggaguuggcaagagaacccccu

SEQ ID NO: 427264 - RNA, 64 nt, Human
uccccagaguucuugcacccucauucccucgggacccucccagugagaagggccugcucugcuu

SEQ ID NO: 427265 - RNA, 64 nt, Human
uaauucagagguccuacccucugucuagggaccccccucccaagccuggccuuggccuuggcac

SEQ ID NO: 427266 - RNA, 64 nt, Human
ugcguccuuaccacugaucuggccaagaaugaggcccucccaacacuuucacucccucuccaag

SEQ ID NO: 427267 - RNA, 64 nt, Human
cgaaacugccaaacucuuucuccugucuuggguuggcuggcacuggggcgggcaucuaggguac

SEQ ID NO: 427268 - RNA, 64 nt, Human
ggcaaaggguaccccugcaaacaacuguggugggggcuggcagcagaccccccaccuggcaggg

SEQ ID NO: 427269 - RNA, 64 nt, Human
ggauccucaggccccagccgcgggaggcuggaagggcuggcagaucgcuucccucauccaccuc

SEQ ID NO: 427270 - RNA, 64 nt, Human
cagugaauaaauuacuguagucaaagacaguaugggcuggcaguuuguguaauugcaaguucau

SEQ ID NO: 427271 - RNA, 64 nt, Human
agacccuagcggggagggcaggggagggacggaaggcuggcaccucuuccaccaguucaggggg

SEQ ID NO: 427272 - RNA, 64 nt, Human
auuguugcugaguuuauucccccuucuaacugauggcuggcaucugauaugcagaguuagucaa

SEQ ID NO: 427273 - RNA, 64 nt, Human
auauauuuguugagugaauuaaugaauuaagaguggcuggcagaguaggcagaaaaagacacug

SEQ ID NO: 427274 - RNA, 64 nt, Human
uucccgguggccucccuauuggacuacuaggaggggcuggcagggccuccauagcacagaauug

SEQ ID NO: 427275 - RNA, 64 nt, Human
caggucgugggucuccagccgugcuuggccucagggcuggcagccggauccuggggcaacccau

SEQ ID NO: 427276 - RNA, 64 nt, Human
ggcugucaagagcguguucugccagguccaugggggcuggcaucccagcuccaacucgaggagc

SEQ ID NO: 427277 - RNA, 64 nt, Human
cccggccucgucaagugaacucggcagacccuggggcuggcagagggagcucuccaguuuccag

SEQ ID NO: 427278 - RNA, 64 nt, Human
caccaaaugccucugccuugauggagaaggaaaaggcuggcaagguggguuccagggacuguac

SEQ ID NO: 427279 - RNA, 64 nt, Human
cuaggagauacucagggaagcaaauccuuguuugggcuggcaagcaaauccgacacgacgaggu

SEQ ID NO: 427280 - RNA, 64 nt, Human
uucaucucagugucacagacagcugccaucagagggcuggcaguagggaguuccaggagcgggg

SEQ ID NO: 427281 - RNA, 64 nt, Human
gcccucuuccugcccguccucuuuugccggucagggcuggcacgcaggggaacaaaggaaggag

SEQ ID NO: 427282 - RNA, 64 nt, Human
uuuggaucccaggggaguguucagggccagcccuggcuggcauggagggugaggcugggugucu

SEQ ID NO: 427283 - RNA, 64 nt, Human
cagguggggaaacugaggcaggaacaggguucugcccucccagagccuccacucugggaugcca

SEQ ID NO: 427284 - RNA, 64 nt, Human
ugaggcauccagcagucucugccuugccuuuagccccucccaagcuggcugggguggccugugu

SEQ ID NO: 427285 - RNA, 64 nt, Human
ugguggggagggcaucucccugcuccccucaacccccucccaccccauccacgcccccuaccuu

SEQ ID NO: 427286 - RNA, 64 nt, Human
cucugucuauuugagacuuagaaaaauccuacaaggcuggcagugacagaacuaagaugaucau

SEQ ID NO: 427287 - RNA, 64 nt, Human
ugaaagacauguuuucuagauggcucacucacauggcuggcaacuugguguuggcuauuaaugu

SEQ ID NO: 427288 - RNA, 64 nt, Human
gggaggcucccugaaagugggugcgaaggaguccggcuggcaugaaaaucugacuuugcccagc

SEQ ID NO: 427289 - RNA, 64 nt, Human
ccacuccaggcaggguggcguuagacuggcaucaggcuggcacuaggcucagcccccaaaaccc

SEQ ID NO: 427290 - RNA, 64 nt, Human
uugaacaacacugggguuaagucucugguauuuaggcuggcaauauauauauuaaccauauuuu

SEQ ID NO: 427291 - RNA, 64 nt, Human
cccagggacucauuacagcccuccauuaagcagaggcuggcacggcuacagcugucaccagauu

SEQ ID NO: 427292 - RNA, 64 nt, Human
ucccuagaaaggucugcuugcaaaguuggcccuuggcuggcaucugggggaacuugguucuugg

SEQ ID NO: 427293 - RNA, 64 nt, Human
cucuccuucuucguguagucucuuucaguggccuggcuggcaggguagcuagaccucucacaug

SEQ ID NO: 427294 - RNA, 64 nt, Human
aacccaggggauggggcugggaggggcugugaggggcuggcaccucagcucagaaaagguagca

SEQ ID NO: 427295 - RNA, 64 nt, Human
uuuuauggugaugucacucaccuagacaaccagaggcuggcauugaggcuaaccuccaacacag

SEQ ID NO: 427296 - RNA, 64 nt, Human
uuccccucagguuugccaaguacuacagagaccuggcuggcaacgagcagcgcacgcucaucaa

SEQ ID NO: 427297 - RNA, 64 nt, Human
cugagggaagaaaaaaaaucucuuuuuuucuggaggcuggcaccugauuuuguaucccccugua

SEQ ID NO: 427298 - RNA, 64 nt, Human
uuucuagcuccccagucccuugugaagccuugagggcuggcagaaggguuaggagguugaacuc

SEQ ID NO: 427299 - RNA, 64 nt, Human
ggacuaacgacuucucauuuuccucgcugccuuuggcuggcaggaggcuuuggaggcacaagcc

SEQ ID NO: 427300 - RNA, 64 nt, Human
guagagcagcagcuucgugcucucagcgguggcuggcuggcauuuuucucuagcguuguggugc

SEQ ID NO: 427301 - RNA, 64 nt, Human
uaacagaagcagauuaaccucagaaauccugucuggcuggcagauuucaaguaaaaaaaaaaaa

SEQ ID NO: 427302 - RNA, 64 nt, Human
auuuccuugggaaucugcaagaaccuccccuuuccccucccacaauaagaccauuuaagugugu

SEQ ID NO: 427303 - RNA, 64 nt, Human
uguuuucuagccccgaggugguggcacgggcccucccucccagcgcucugggagccacgccuau

SEQ ID NO: 427304 - RNA, 64 nt, Human
gccaggcaguuacuccugaggggcugaacaccaucccucccacuagccucuccauacuuacucc

SEQ ID NO: 427305 - RNA, 64 nt, Human
auauuauggauuuagccuuaggcuuuaaguuuuaggcuggcaaaagaaauguuauucagugggu

SEQ ID NO: 427306 - RNA, 64 nt, Human
acagaaaggucgggguagguucgugcagagauggggcuggcaggggggcuaugggaggauuauu

SEQ ID NO: 427307 - RNA, 64 nt, Human
acccagcgcuuucgccccucguccacccaccccuggcuggcagccucccuccccacacccgccc

SEQ ID NO: 427308 - RNA, 64 nt, Human
gcugcagggccgaggacugguuuggggacuggagggcuggcagcagccugucaccgugcgaccg

SEQ ID NO: 427309 - RNA, 64 nt, Human
auggacagcgacaaaccugaggccgugucuaggaggcuggcacgacugcuucagcagagaccaa

SEQ ID NO: 427310 - RNA, 64 nt, Human
uuugccauuuucagugcuuauauuguuagguagaggcuggcacuuuauuagaaugcaagccaca

SEQ ID NO: 427311 - RNA, 64 nt, Human
cguccuugggcgucucuaaugucugcagcucaagggcuggcacuuuuuuaaauauaaaaauggg

SEQ ID NO: 427312 - RNA, 64 nt, Human
ugcaugcacgcuguucaaaugugaggucugaaauggcuggcacacgggaaaagcugcuuguguc

SEQ ID NO: 427313 - RNA, 64 nt, Human
uguggagucgggucucugugggcacaacuccaggggcuggcauucacacuguaccuaugaauua

SEQ ID NO: 427314 - RNA, 64 nt, Human
aggguccccagcccaggagguggcuggauugcagggcuggcagcccccacgugguggcauccug

SEQ ID NO: 427315 - RNA, 64 nt, Human
agaaaggaagauggacucuuggcuuccucucucuggcuggcaaagggaguuaucuucuggaaua

SEQ ID NO: 427316 - RNA, 56 nt, Human
aggcacuacggcggggcugagacaccggcuggcagggcuggccccagggcacccug

SEQ ID NO: 427317 - RNA, 64 nt, Human
ggagcaggccaggcagggccugggccauuggaggggcuggcacuggacuugccuuugaccccag

SEQ ID NO: 427318 - RNA, 64 nt, Human
aggcugggggccucggggcggggagcaugagcugggcuggcaccacgacugagggcucccggcu

SEQ ID NO: 427319 - RNA, 64 nt, Human
uggcagaggugagggucaaagaacggggucccugggcuggcagagaagguuugugucccuguug

SEQ ID NO: 427320 - RNA, 64 nt, Human
caccuacauuuggcauugcagccuagccaaaaagggcuggcagcugucucuggagggcccagug

SEQ ID NO: 427321 - RNA, 64 nt, Human
cugcugacgugggcauggguggauuuagccaaggaccuggcaacccaggaaacaugauguuuua

SEQ ID NO: 427322 - RNA, 64 nt, Human
ccuagguacccacaugugugccaaagccuaccccaccuggcaggugucccacagcaacagaagg

SEQ ID NO: 427323 - RNA, 64 nt, Human
accccagacacucuuauuucauuggucuggguggaccuggcaucagaagucauguagcuccuca

SEQ ID NO: 427324 - RNA, 64 nt, Human
acucuggagauccucaaaaaaggcccuccucuguggcuggcagccucugaccuuucccugggcu

SEQ ID NO: 427325 - RNA, 64 nt, Human
ggcagggagcccacaaaacucuaaccaaacuggaggcuggcaugggagaagugcuucugguuca

SEQ ID NO: 427326 - RNA, 64 nt, Human
cuugcugcugguaugagacucccugggaccuagaggcuggcaaauguuuaaaaucaccacgugu

SEQ ID NO: 427327 - RNA, 64 nt, Human
caauuaugucgggaggcauuuuuaagaacaagcaggcuggcacuuuuuauuucucuuuacaaau

SEQ ID NO: 427328 - RNA, 64 nt, Human
ccugauaguaagggacagauuuuuaaugaacauuggcuggcauguuggugaaucacauuuuagu

SEQ ID NO: 427329 - RNA, 64 nt, Human
accacagccggucagaggagcgcaggcagcgcagggcuggcacgugacaggcucgucagccacc

SEQ ID NO: 427330 - RNA, 64 nt, Human
guuaguggggccugaggucaucggcguggcccaaggcuggcaggucaaccucgcgcuugcuggc

SEQ ID NO: 427331 - RNA, 64 nt, Human
cugccugccgucgacucauccaaggacccuccaaggcuggcagugugguguugcuacuauuaag

SEQ ID NO: 427332 - RNA, 64 nt, Human
caaggcagggagagggaguggcccgucccugggaggcuggcaaagugcucuccagggagggguc

SEQ ID NO: 427333 - RNA, 64 nt, Human
ucugagcagguugcuccacagguagcucuaggagggcuggcaacuuagagguggggagcagaga

SEQ ID NO: 427334 - RNA, 64 nt, Human
ccuccuccucuucugggcuccccacugucagacgggcuggcaaaugccuugcaggagguagagg

SEQ ID NO: 427335 - RNA, 64 nt, Human
aacuuccuggaacaaagcgacaucgccagcagcaggcuggcagggagugguugaggucuggggg

SEQ ID NO: 427336 - RNA, 64 nt, Human
auguuugguuuauauauuuucuuuaaaaauccugggcuggcacauugacugggaaaccugagug

SEQ ID NO: 427337 - RNA, 64 nt, Human
caucugggacguggugccagugaggagcccaguuggcuggcacugggcccauuugaaggugucu

SEQ ID NO: 427338 - RNA, 64 nt, Human
ccagcaccacaaagccccccuggagcaucuucccggcuggcaggaccaugccaucucuguggag

SEQ ID NO: 427339 - RNA, 64 nt, Human
gaaaacagcugcaagcccccagggacuuaccuggggcuggcaugugugacugucucggaugaag

SEQ ID NO: 427340 - RNA, 64 nt, Human
acccacuacagcacaggcgggaauagcacagcugcccucccaugcucccuaccuguccccucac

SEQ ID NO: 427341 - RNA, 64 nt, Human
cugcugcccagcucuaccccucccagggaccuaccccucccagggaccgaccccuggcccaagc

SEQ ID NO: 427342 - RNA, 64 nt, Human
guuggccacuggccaugcugcugcccagcucuaccccucccagggaccuaccccucccagggac

SEQ ID NO: 427343 - RNA, 64 nt, Human
ucucugggcuguagugaagccgcauuuucacgcuggcuggcagugugcugagagccucgaaugc

SEQ ID NO: 427344 - RNA, 64 nt, Human
caagcuauaaaagcaggagguuaucugugcagggggcuggcaucauguauuuaggggcaaguaa

SEQ ID NO: 427345 - RNA, 64 nt, Human
aguggguuguucugugccugcagcauagagcgcaggcuggcagagcaaauagggcuggugagga

SEQ ID NO: 427346 - RNA, 51 nt, Human
accaggugcccgccuacuagcggcuggcaggcacagaccagggcuccaagg

SEQ ID NO: 427347 - RNA, 64 nt, Human
cccuccugggcacguccaggugagggagggcuggggcuggcaccacgcacagugccuaacccua

SEQ ID NO: 427348 - RNA, 64 nt, Human
uuccucacagggacuaggaggcucaguccccaacggcuggcaagacucaggguccucaguggac

SEQ ID NO: 427349 - RNA, 64 nt, Human
ugccugggaaaugccaccuccuggaaggcagccaggcuggcagauuuccaaaagacuugaagaa

SEQ ID NO: 427350 - RNA, 64 nt, Human
gacaccccccuucugaaugaagccuucugaccugggcuggcacugcugggggugaggacacauu

SEQ ID NO: 427351 - RNA, 64 nt, Human
cccagcacccacaacuagcgccugggcagggcagggcuggcaccucucaacgucuguggacuga

SEQ ID NO: 427352 - RNA, 64 nt, Human
ggggggcagucgugggagccccucucagcuguggggcuggcacagagccccaggcaagcuuuua

SEQ ID NO: 427353 - RNA, 64 nt, Human
caagauugccugugccccugcucugccccauccuggcuggcagggcugcauguuuccauccugu

SEQ ID NO: 427354 - RNA, 64 nt, Human
ccggcagcucguucuccuguucugcugugcugugggcuggcacucgauaccucuggcaagagga

SEQ ID NO: 427355 - RNA, 64 nt, Human
caaaccgcuggugcugucgcugugagcaagagccggcuggcacauuuggaagccgcacuguauu

SEQ ID NO: 427356 - RNA, 64 nt, Human
aaagcaccuucuuggccugacagaccauugguggggcuggcacgaauccagaucuggauccuac

SEQ ID NO: 427357 - RNA, 64 nt, Human
ucacugagauaaggagauguggagacuucauggaggcuggcagcugagcucagagguucacaca

SEQ ID NO: 427358 - RNA, 64 nt, Human
cauaagcucucacagcgcuaaggaagcaggcccaggcuggcaggcaucucggcuugcaggaggc

SEQ ID NO: 427359 - RNA, 64 nt, Human
ugcuucguggcccccgggggcacaagacaccggccccucccaccccccugccucucugaagggc

SEQ ID NO: 427360 - RNA, 64 nt, Human
agaggccucaggggaaagucccaauccugagggacccucccaaacauuuccauggugcuccagu

SEQ ID NO: 427361 - RNA, 64 nt, Human
cauucacuggccuuggaccucaccuuuguggcuacccucccacgcucugucuaagccccuagcu

SEQ ID NO: 427362 - RNA, 64 nt, Human
ccagggccacaggagggggauaaucagagcuugaggcuggcacucugacugcuggcuuuuccca

SEQ ID NO: 427363 - RNA, 64 nt, Human
auggccucccgccacggggccgugcuguguuuauggcuggcagaggcagccagcggguggggga

SEQ ID NO: 427364 - RNA, 64 nt, Human
cucaggguuugaagggagaccuggccggccugagggcuggcagaugugagggcaggacaccugg

SEQ ID NO: 427365 - RNA, 64 nt, Human
gauccuauagcugcugcuuuuucuugguccuuggggcuggcagacccauagaccauggccuguu

SEQ ID NO: 427366 - RNA, 64 nt, Human
cuugggggagaucugacagcccagaccuuucuacggcuggcagcagagaaacaaagucuggacc

SEQ ID NO: 427367 - RNA, 64 nt, Human
uaaaugaagucucuuuccccaccauuugaaucugggcuggcacugugacuugauuugaucaaua

SEQ ID NO: 427368 - RNA, 64 nt, Human
cccugccagcugccugcgucguugggcccaggguggcuggcaggagucccagcugcuugcuuua

SEQ ID NO: 427369 - RNA, 64 nt, Human
ccugcagagccuccgccuguaccccuucaccgacggcuggcaccccuucgugguagcggcagag

SEQ ID NO: 427370 - RNA, 64 nt, Human
guuuuugccaaaguagaaaaggcagguggugggcggcuggcagggagugcggguccccgccccu

SEQ ID NO: 427371 - RNA, 64 nt, Human
cccuggauuaggagggugacauggggaaggcagaggcuggcaccauggugacugccacauaaua

SEQ ID NO: 427372 - RNA, 64 nt, Human
guugucuagaaguaccauaggguuuaaaaaccugggcuggcauuggucacaccaggccuaagaa

SEQ ID NO: 427373 - RNA, 64 nt, Human
uucuguaucuggauuccguaucacuccaaguggaggcuggcagguuuuucugcaagauggucca

SEQ ID NO: 427374 - RNA, 64 nt, Human
acugugcuggugagaagaagucugggugggagauggcuggcagggucuuccaaguaccuuccuc

SEQ ID NO: 427375 - RNA, 64 nt, Human
ggaggcgagggacagagacagcaaggcagacaguggcuggcaggggggcccaggcccgggacga

SEQ ID NO: 427376 - RNA, 64 nt, Human
gcccagccccgugccccuccgucugccuccgcacggcuggcagagggcaggcugcaugcagugg

SEQ ID NO: 427377 - RNA, 64 nt, Human
aagaccguggagcccgugggcacugcaugguguuggcuggcaugcccaucagcugaggacagca

SEQ ID NO: 427378 - RNA, 64 nt, Human
ccaaggggucuguauauacauuucauaaggccugcccucccauguugcaugccuauguacucua

SEQ ID NO: 427379 - RNA, 64 nt, Human
agcacacucagugcagcaagacugaccccugacccccucccagcccucccuaccuuggacagga

SEQ ID NO: 427380 - RNA, 64 nt, Human
gggaaaggacaggugccgagcccugcauguggagcccucccaccccacccccagauagagggaa

SEQ ID NO: 427381 - RNA, 64 nt, Human
ccaagccccucuuaccucccucccuccuucccaaggcuggcacuaaccagguaccacauucauu

SEQ ID NO: 427382 - RNA, 64 nt, Human
cugucuccuggauugugucaucaugggguaucagggcuggcaaaaccccugcucugcuuuuggc

SEQ ID NO: 427383 - RNA, 64 nt, Human
gcuuggcagguauauuauauuucaucauuuaggaggcuggcaugaccaggacuuauggguggga

SEQ ID NO: 427384 - RNA, 64 nt, Human
cuuuaggucugguuguugcaccaucugcuugguuggcuggcagcugagagcccugcugugggag

SEQ ID NO: 427385 - RNA, 64 nt, Human
caauuucauuccauuaaauuaaaaaauacugacuggcuggcaggcaggugccaugucugggaac

SEQ ID NO: 427386 - RNA, 64 nt, Human
ccaaagccagacagcaacggggaggccaagugcaggcuggcaccgccuucucuaaaugaggggc

SEQ ID NO: 427387 - RNA, 64 nt, Human
gugccucucauuaguggacuuuaaagcaaauccuggcuggcaggaaauucugaggaauauagcu

SEQ ID NO: 427388 - RNA, 64 nt, Human
ucuccgcccagguggggaucgugggccgcacuggggcuggcaagucuuccaugacccuuugccu

SEQ ID NO: 427389 - RNA, 64 nt, Human
cagggacaaagaggagcugcugugggccuggcagggcuggcaggaugccgugggccgccagauc

SEQ ID NO: 427390 - RNA, 64 nt, Human
guggcagggccuuucccugaggcugcaggccgugggcuggcagcccgucucuuggcauuucaau

SEQ ID NO: 427391 - RNA, 64 nt, Human
acacggagaagaucaaacuggagcugcguucauaggcuggcacucucaauccuacaucaggugc

SEQ ID NO: 427392 - RNA, 64 nt, Human
gacacacagcuaaggagccucauagccuggcgggggcuggcagagccacaccccaagugccugu

SEQ ID NO: 427393 - RNA, 64 nt, Human
gagggucaggugugcugccaguaagugagggaggggcuggcaggaagggugggguccucacacu

SEQ ID NO: 427394 - RNA, 64 nt, Human
ugcucugugaccccagcuggagcccacaccuaagggcuggcauccacaucauuucacccugcag

SEQ ID NO: 427395 - RNA, 64 nt, Human
gcuuuugggagauggggugggcaggggugguccuggcuggcauugccugagccggcagugauga

SEQ ID NO: 427396 - RNA, 64 nt, Human
ggguuuccagcccgggcugugcgaggcauccuggggcuggcagcaccuucccggcucaccagug

SEQ ID NO: 427397 - RNA, 64 nt, Human
ccugggaaagccauuacucuugugucugcuacugcccucccacagucaccccaauauuacaagc

SEQ ID NO: 427398 - RNA, 64 nt, Human
cugcaggucuucugcaccccccucaaugaggagucccucccagaaaggaaacugaucucuggga

SEQ ID NO: 427399 - RNA, 64 nt, Human
agauccucugaucccaccccaggccuugccccugcccucccacgaaugguuaauauauauguag

SEQ ID NO: 427400 - RNA, 64 nt, Human
ugacuuuaaugggagggugggugggccgcagacaggcuggcagggcaggugcugcguggggccc

SEQ ID NO: 427401 - RNA, 64 nt, Human
cuccagcuguugaaggguagcgcuggcccuuggaggcuggcacuagcugacagcuuuuccucuc

SEQ ID NO: 427402 - RNA, 64 nt, Human
cagucagaccagaggaagcgguccgggggcugggggcuggcaccgagaguucaaggagagccca

SEQ ID NO: 427403 - RNA, 64 nt, Human
cuguugucugggucaacauuugccgagacgccuuggcuggcacccucuggggucccccuuuucu

SEQ ID NO: 427404 - RNA, 54 nt, Human
ucugcaaggcccuggccuaagacaggcuggcacagccccaggcuuggugaggaa

SEQ ID NO: 427405 - RNA, 64 nt, Human
ugagcaugccugucuucccagggguguaccucuuggcuggcaaagcccaaggccagugggaacu

SEQ ID NO: 427406 - RNA, 64 nt, Human
gcuaucaagacugacugugauauugaggaugacaggcuggcagcuauguucagagaauuuaccc

SEQ ID NO: 427407 - RNA, 64 nt, Human
aauucaaagcaggguucugaggcaaauggcacauggcuggcacugagcaguaccagugugcuug

SEQ ID NO: 427408 - RNA, 64 nt, Human
uucucaaggucacaggccccagucccagccugggggcuggcagaggcccccauauacucugcua

SEQ ID NO: 427409 - RNA, 64 nt, Human
caagguuggugaggggcuaaauugcacgcguuuaggcuggcaccccgugugcagggcacacugg

SEQ ID NO: 427410 - RNA, 64 nt, Human
uccugacaggucagcccugcuccccacagggccaggcuggcaggggccagugggcucagcccag

SEQ ID NO: 427411 - RNA, 64 nt, Human
ucacgccuguaaucccagcacuuuaggaggccgaggcuggcagaucacaaggucaggagaucga

SEQ ID NO: 427412 - RNA, 64 nt, Human
uggcucugccugcugggaucuguuaucucuggugggcuggcagucauaauucacaauucagaca

SEQ ID NO: 427413 - RNA, 64 nt, Human
acauugccccucugccuugcccuccugggcccugggcuggcacagccccuggagccucagaaau

SEQ ID NO: 427414 - RNA, 64 nt, Human
uggccuggcccucgggucuucggaggacguagggggcuggcaugggugccgacuggcugccuga

SEQ ID NO: 427415 - RNA, 64 nt, Human
ucugcuccuccuucccuccaugcaccaucacuguggcuggcaggcaucggacagccucauccag

SEQ ID NO: 427416 - RNA, 64 nt, Human
ugagaaggagcuggcaucucucagugugcuccugcccucccacuccugccccagcuguucucca

SEQ ID NO: 427417 - RNA, 64 nt, Human
agacagccacauugggcagcgcccuuccucuccacccucccagaccugccucuucccccugcuu

SEQ ID NO: 427418 - RNA, 64 nt, Human
gucuccuuccuguguggaaucuuccccacuccaucccucccaaguugccuguauugauaaugua

SEQ ID NO: 427419 - RNA, 64 nt, Human
cccgguaccucccgagaggcugucccuggacccuggcuggcauggaaauacagugggaaaacca

SEQ ID NO: 427420 - RNA, 64 nt, Human
gugggugacacuagugaaccuucuccagucugcaggcuggcauagaaggcucuuagauuauauu

SEQ ID NO: 427421 - RNA, 64 nt, Human
uggcucugagggagcaagagcuggcaggcggcagggcuggcacagacagacggaagcagaaagg

SEQ ID NO: 427422 - RNA, 64 nt, Human
uucuacucacuguuagagagagaccuagcugagcggcuggcaggaagcgggacaggucuaggag

SEQ ID NO: 427423 - RNA, 64 nt, Human
cugucucauugaaaaccgagccagucaaccacaaggcuggcagggugugauccuuguaacgucu

SEQ ID NO: 427424 - RNA, 64 nt, Human
ggggugucuugugggcagugagggggugaggagaggcuggcaugagguucagucauuccaguga

SEQ ID NO: 427425 - RNA, 64 nt, Human
gugucagggcugaguguucugggauuucucuagaggcuggcaagaaccaguuguuuugucuugc

SEQ ID NO: 427426 - RNA, 64 nt, Human
caagaaagguucugugauucacuuuugcuucuggggcuggcaaaaaccuucucugaacccacac

SEQ ID NO: 427427 - RNA, 64 nt, Human
gucuuucauucuuucugcugagacuggccugaaaggcuggcaagugggagggagucagugggga

SEQ ID NO: 427428 - RNA, 64 nt, Human
ccccacagagcaggagacccccagagaaagccggggcuggcaggaggcggccgcccuucccgcc

SEQ ID NO: 427429 - RNA, 64 nt, Human
ucgguguaagaaauugccguuuuuacccugcccuggcuggcaugugagaagccauggaagguug

SEQ ID NO: 427430 - RNA, 64 nt, Human
gcugcauauuauuuaacagcaaaggcaucauaggggcuggcacaggagcccugcugccagaaca

SEQ ID NO: 427431 - RNA, 64 nt, Human
aggaggauguucuuacaaaaauagcuauaucaagggcuggcaccuagacauuaaacuguaauuu

SEQ ID NO: 427432 - RNA, 64 nt, Human
cccuccugaaaggguacggagaguccccucugugggcuggcagugugaaugagaucuguuuagu

SEQ ID NO: 427433 - RNA, 64 nt, Human
aggaaggcauucuccuuuuucauuuuuuuccuuuggcuggcagcucuucccagugauguugaga

SEQ ID NO: 427434 - RNA, 64 nt, Human
gggcaagguagagugccuaggagcccuggacucaggcuggcagaggggcuggugcccuggagaa

SEQ ID NO: 427435 - RNA, 64 nt, Human
ucuuaagacuugacuucugugaguuuagaccugccccucccacccccacccugccacuaugagc

SEQ ID NO: 427436 - RNA, 64 nt, Human
uugguucuuacuuuuguaugcugccuccucugugcccucccagacgcugacugggaaacacaag

SEQ ID NO: 427437 - RNA, 64 nt, Human
cuaggcaccucaagcccccugaccccauucccuccccucccaccccuugcuccuugucuggccu

SEQ ID NO: 427438 - RNA, 64 nt, Human
aggcccguggggcgggguuuuggggcgugaacaaggcuggcaguaaguggacaagcugcucccc

SEQ ID NO: 427439 - RNA, 64 nt, Human
gcucccagggcuggcgucccaccuuccaggugggggcuggcacaucacagacugucgagagcgc

SEQ ID NO: 427440 - RNA, 64 nt, Human
gguggccugcuucuguaauccuagcuaguugggaggcuggcacaggagaaucgcuugaaucugg

SEQ ID NO: 427441 - RNA, 64 nt, Human
gagggucucggaggauagaaugagagguuuccagggcuggcagagugugugcgugugugugugc

SEQ ID NO: 427442 - RNA, 64 nt, Human
cggcagcgcccgcagcgggccauuuacacgucgaggcuggcaccuggcgcgcucgggggccacu

SEQ ID NO: 427443 - RNA, 64 nt, Human
gagaagguuggcgugcccuggaggcugacacagaggcuggcacugagccugcuuguugggaaaa

SEQ ID NO: 427444 - RNA, 64 nt, Human
uucugagcagaagcccaggcgggcccggggccuuggcuggcaaauaaagcguuagcccgcagcg

SEQ ID NO: 427445 - RNA, 64 nt, Human
ccaagaaagaaauucuaaggagagcaugagagaaggcuggcauuggcaggaggagagcaccagg

SEQ ID NO: 427446 - RNA, 64 nt, Human
gccggggaggaggaugcucugagauucaggguggggcuggcaaccccugaagagaacacuuccu

SEQ ID NO: 427447 - RNA, 64 nt, Human
uugggaguagcugagggggcagacuagggaguagggcuggcaggggagggggcagacagccucg

SEQ ID NO: 427448 - RNA, 64 nt, Human
aauguaagaaauguagaaaaaccuucagccaggaggcuggcaagauggccgaauaggaacagcu

SEQ ID NO: 427449 - RNA, 64 nt, Human
agggguccacagacaccucauacaggagagcucuggcuggcaucuggugggugccccucuggga

SEQ ID NO: 427450 - RNA, 64 nt, Human
cgucugcccuccaaggacccgcauggaggcagugggcuggcagcuuccugcugcucccugucag

SEQ ID NO: 427451 - RNA, 64 nt, Human
acaaccugcaaaaacggagcugggcugcagcuggggcuggcauggacuuucauuucagagauuc

SEQ ID NO: 427452 - RNA, 64 nt, Human
cuccaagggguccgaggaaucacucacuccuggaggcuggcaaggagacagucugaggccaggg

SEQ ID NO: 427453 - RNA, 64 nt, Human
acuccuaccugaagcggaagaggauuuucuaaguggcuggcaccagagauaacucaagggccug

SEQ ID NO: 427454 - RNA, 64 nt, Human
ugggcucugguuuucugguggggcuguccugcugcccucccacagccuccuucuguuugucgag

SEQ ID NO: 427455 - RNA, 64 nt, Human
caggcauggaccagcuucagccagggacaaaauccccucccaaaccacucuccacagcuuuuua

SEQ ID NO: 427456 - RNA, 64 nt, Human
gcccucaaucuguaaauuuuugucuccagaaaaacccucccaggcaucccauaccagcaccguu

SEQ ID NO: 427457 - RNA, 64 nt, Human
cgcgcggcggcuguacgugagcuuccgcgaggugggcuggcaccgcugggucaucgcgccgcgc

SEQ ID NO: 427458 - RNA, 64 nt, Human
ucauucacugcugcauccccagugccuagaacagggcuggcaggugguaggcgccugacagaug

SEQ ID NO: 427459 - RNA, 64 nt, Human
caccccugcccaucacugggggcugcgcuagcugggcuggcauucccucccaaccugaacugcu

SEQ ID NO: 427460 - RNA, 64 nt, Human
ccugggcaacuucacauccguccuccugucucagggcuggcagggggagccuggaauuaccccc

SEQ ID NO: 427461 - RNA, 64 nt, Human
ccuggcuaagggaaccauuucacugccggacuuaggcuggcaaugcccccuuccccaaccccag

SEQ ID NO: 427462 - RNA, 64 nt, Human
auauucuagaacuagcaaaacaucuuuuccugauggcuggcaggcaguucuagaagccacagug

SEQ ID NO: 427463 - RNA, 64 nt, Human
caggaaucagguauuggggccccucggaggccgaggcuggcaccccaucucccgcgcagccugc

SEQ ID NO: 427464 - RNA, 61 nt, Human
ucuggcucacggugaaauaagcuugccaggaggcuggcaguacagagugcagcagcgagca

SEQ ID NO: 427465 - RNA, 64 nt, Human
ugcagcaagaccccugaaagugauucaugcuucuggcuggcauucugcauguuuagugauuguc

SEQ ID NO: 427466 - RNA, 64 nt, Human
gaauacacuguagaugcuuuuccccaacguaucuggcuggcagucuuugucguuguucauucug

SEQ ID NO: 427467 - RNA, 64 nt, Human
ggggugagccccucacagccuugccccuccccaaggcuggcaaccugccucccauugcccaaga

SEQ ID NO: 427468 - RNA, 64 nt, Human
cuccagcccccucagaaggggcuggauugauggaggcuggcaagggaaaguuucagcucacugu

SEQ ID NO: 427469 - RNA, 64 nt, Human
uacaggaaacaccgcauccuugcacugcugcuggggcuggcagagcaguuggcugacagcaaca

SEQ ID NO: 427470 - RNA, 64 nt, Human
cacagaaaaagauuuccaucaccacagaaaggucggcuggcagcacuggccaaggugauggggu

SEQ ID NO: 427471 - RNA, 64 nt, Human
cuggugcugcugcugcuguggcgugagggugaggggcuggcacugacugggcauagcuccccgc

SEQ ID NO: 427472 - RNA, 64 nt, Human
accccucuucacagugggugagcugggcugggcuggcuggcaugaggccaagggguaggccuga

SEQ ID NO: 427473 - RNA, 64 nt, Human
auuuaaccagaaauuaaaauaucacccuuuucagcccucccaugaagaauuucuaggucauaaa

SEQ ID NO: 427474 - RNA, 64 nt, Human
guguuccuuucugcagugguucuuaucaccaccucccucccagccccagcgccucagccccagc

SEQ ID NO: 427475 - RNA, 64 nt, Human
cccgcugccuuugucccaucacccagcccugccucccucccagcagcccugggccacagccccc

SEQ ID NO: 427476 - RNA, 64 nt, Human
cgcccugcacccggccgcugcccagcaccgcgcuggcuggcacugaaggacagcaagaggcacu

SEQ ID NO: 427477 - RNA, 64 nt, Human
uggagacccugcagaagcagaccaggguuggcaaggcuggcaccaacaagccccccaggugccg

SEQ ID NO: 427478 - RNA, 64 nt, Human
ccggggccaccccaggagaaaguguccaggugggggcuggcagucccuggcugcagaccccgag

SEQ ID NO: 427479 - RNA, 64 nt, Human
cuccagaagaagguccagccuaggcccccugcaaggcuggcagcccccacccccaccccccagg

SEQ ID NO: 427480 - RNA, 64 nt, Human
gguuuccaucccucuugccuugggacacucuugaggcuggcagcccuccugcaaugaguugcuc

SEQ ID NO: 427481 - RNA, 64 nt, Human
gccuccacgggacuucauuuaagaauacgugcauggcuggcacaguggcuuacgccuguaaucc

SEQ ID NO: 427482 - RNA, 64 nt, Human
auucacaaaauuuccacaaaaucuguccaaaggaggcuggcagguauggaaggguuuguggcug

SEQ ID NO: 427483 - RNA, 54 nt, Human
ccaugcucgugcucaaguaggccuggcuggcacagggcugcauggaccucaggg

SEQ ID NO: 427484 - RNA, 64 nt, Human
cuaucauuacugcaaaaaccugcucuguugugcuggcuggcaggcccuguggcugcuggcugag

SEQ ID NO: 427485 - RNA, 64 nt, Human
agugucuggacagccagcugcagggccugagcauggcuggcaggggcagcugcuguggcaaacu

SEQ ID NO: 427486 - RNA, 64 nt, Human
gacucaggcugcacuguuugaagaggagcagagaggcuggcacuaggggccacuggggggcugg

SEQ ID NO: 427487 - RNA, 64 nt, Human
guucugucuugcaucuuccaugacaugaaagggaggcuggcacuugucagucagguagagguua

SEQ ID NO: 427488 - RNA, 64 nt, Human
ccagaggggauccuaugguuaugugugccaggcuggcuggcaggaacugggguggcuaucaaua

SEQ ID NO: 427489 - RNA, 64 nt, Human
ccaggauggaacacggccacaucaaagaggcugaggcuggcacaggacaugcgguagccagcac

SEQ ID NO: 427490 - RNA, 64 nt, Human
gugaacuuguuucaggaagugugagcacgggccuggcuggcacccgguuuacagggaggugauu

SEQ ID NO: 427491 - RNA, 64 nt, Human
cccucgcccggcuggccgucccugcccucgccccggcuggcaggugcacauggggccuccaggu

SEQ ID NO: 427492 - RNA, 64 nt, Human
uuuaauuaauauuuccucuguuuauuccuccucucccucccauugcauggcucacaccuguaaa

SEQ ID NO: 427493 - RNA, 64 nt, Human
gagggaagguugguugcaaaagugggauucaugacccucccaggcuacaccaucuucuuuagaa

SEQ ID NO: 427494 - RNA, 64 nt, Human
guccuggcuggaccagccacugugggaccaacaccccucccacacucccccagacugcucgucu

SEQ ID NO: 427495 - RNA, 64 nt, Human
agccagcacccagcccaucaccacucccugggcuggcuggcagguauggcacccugggagcccg

SEQ ID NO: 427496 - RNA, 64 nt, Human
ccacugucuucagccagcugaagcuguggggcugggcuggcagccuuuauugucaucuugcuuc

SEQ ID NO: 427497 - RNA, 64 nt, Human
cuugcuguaucccuguugugagguuccuuccaggggcuggcacugaagcaagggugcuggggcc

SEQ ID NO: 427498 - RNA, 64 nt, Human
agagcaugggcccaggucccaggggagagguuggggcuggcaggccacuggcaugugcugagua

SEQ ID NO: 427499 - RNA, 64 nt, Human
uggguccccgccaggcaccccgaggcggcgcucuggcuggcagcugguggggaauaggcagggc

SEQ ID NO: 427500 - RNA, 64 nt, Human
cuugcauuuuccuucuggugcugugaagaccauaggcuggcaggcagcugagaugaacugucuu

SEQ ID NO: 427501 - RNA, 64 nt, Human
gccaggccucagaacugugugugcgggacaggguggcuggcacgagaugugugggacugggacg

SEQ ID NO: 427502 - RNA, 64 nt, Human
uggcacaggccacagccccucaccuugccgcgguggcuggcagcacgccugccuugcucugccc

SEQ ID NO: 427503 - RNA, 64 nt, Human
gcucucgggccuagaucccacugguaggccucguggcuggcagcagugcucugggaauaaacag

SEQ ID NO: 427504 - RNA, 64 nt, Human
uuuguuuuucuuuggggguuuuguuuauuuuuggggcuggcaauccaaaauagaaaaucugauc

SEQ ID NO: 427505 - RNA, 64 nt, Human
cucuguggggcaguuggugggggcugggggaagaggcuggcagaaguuacccuggauagggaag

SEQ ID NO: 427506 - RNA, 64 nt, Human
uaguugaauguuuuggcccaugacuuuggaacauggcuggcagcuuccagcagaagucacgcuc

SEQ ID NO: 427507 - RNA, 64 nt, Human
ugguccccugcugguugggagugaagagaauccaggcuggcagagcuggagccaguuggggagc

SEQ ID NO: 427508 - RNA, 64 nt, Human
gcggagcaugugcugagggaagucugccuggugaggcuggcaggugggagucuaaugcagucag

SEQ ID NO: 427509 - RNA, 64 nt, Human
ggauaucugccaaagggugucugaugugggguggggcuggcauccucccaggaagguucuaggu

SEQ ID NO: 427510 - RNA, 64 nt, Human
cccaggcgggcaucucauggcagugcggacccguggcuggcagcccgggcaguccuuugcaaag

SEQ ID NO: 427511 - RNA, 64 nt, Human
ugaggaccaguagccaccaagccacccacaagcccccucccaaugaccccccuucagccccggg

SEQ ID NO: 427512 - RNA, 64 nt, Human
cccgcguucaguauggguugagggucacagaccucccucccaucugggugccugaguuuugacu

SEQ ID NO: 427513 - RNA, 64 nt, Human
accucugaaaaaaguauaguaucgaguacccguucccucccagaggugggaguaacugcuggua

SEQ ID NO: 427514 - RNA, 64 nt, Human
ccgccccaacuugcuccaucuacggccgcagagcggcuggcaguuucuucgaggaccucagcaa

SEQ ID NO: 427515 - RNA, 64 nt, Human; identical to SEQ ID NO: 427063

SEQ ID NO: 427516 - RNA, 64 nt, Human
gccgcgccugccuuucccaucugucuaucuaucuggcuggcagggaaggaaagaacuugcaugu

SEQ ID NO: 427517 - RNA, 55 nt, Human
cauugagacugagagcuuaaggcagggcuggcacuauuuccuuggccaggguacc

SEQ ID NO: 427518 - RNA, 64 nt, Human
auccuaggcaugcagucuuggucaaggcaacuuuggcuggcagucucugagaugacccugaaug

SEQ ID NO: 427519 - RNA, 64 nt, Human
cucaacugcuucuuaacaccuccaccagggggaaggcuggcacaaggagaaaaaaaaagcaagc

SEQ ID NO: 427520 - RNA, 64 nt, Human
cacacaugcuagcccacugaugcacccagcccagggcuggcagucuuugcagcguggggccguc

SEQ ID NO: 427521 - RNA, 64 nt, Human
caagaggagaaucuuccccaggguuuaguccuggggcuggcacucguugugacuuacacagagc

SEQ ID NO: 427522 - RNA, 64 nt, Human
gcaaagagaaaauuaaauauauaugaagcaauuuggcuggcaucuagaucauucacagcccuuu

SEQ ID NO: 427523 - RNA, 64 nt, Human
ucagcaggcugcagguguucaaagguugccauguggcuggcagugguucaagcccacauuugac

SEQ ID NO: 427524 - RNA, 64 nt, Human
ccacagaaaaacaucugaagauggauugggugagggcuggcaaaacgaaggcaugccgggccag

SEQ ID NO: 427525 - RNA, 64 nt, Human
caauaguuguuuuguuuuguggaccugcccugggggcuggcagcuccuucaggcagccuggcag

SEQ ID NO: 427526 - RNA, 64 nt, Human
cccugccuccaugccagcaucugggggcaaggaaggcuggcaucauccagugaggaggcuggcg

SEQ ID NO: 427527 - RNA, 64 nt, Human
uggaggccacgccugcuucucccaucgccugucuggcuggcagggaaggaaaauagcuugaaug

SEQ ID NO: 427528 - RNA, 64 nt, Human
aggacagggacuucgcagaggcaagcgaccgaggcccucccaaagaggcccgcccugcccgggc

SEQ ID NO: 427529 - RNA, 64 nt, Human
cagccaggcagcgaguccugccccgcccgcagcucccucccacaccccgccuggccaagaugac

SEQ ID NO: 427530 - RNA, 64 nt, Human
guugcguuaguuuuuaaucaucaggacuaucucacccucccacuccuguuuuuaaaacucagaa

SEQ ID NO: 427531 - RNA, 64 nt, Human
ggagauccacagcucacggagccuggccgcggaccccucccaccccugccuugccggccccugc

SEQ ID NO: 427532 - RNA, 64 nt, Human
cacuuaguguggccccaggccccagcgagccucgcccucccaguuuugcucugcccagcagugu

SEQ ID NO: 427533 - RNA, 64 nt, Human
ccucucccuggaaagacgggcagggcugguuagccccucccacugccugacaccugggacaggc

SEQ ID NO: 427534 - RNA, 64 nt, Human
ugaggggagggagggaugucaccccaaaaguaggcccucccauuggcuuuggccaggccagaca

SEQ ID NO: 427535 - RNA, 64 nt, Human
agcugggauuccuccccauuagagucagccuucccccucccagggccagggcccugcagagggg

SEQ ID NO: 427536 - RNA, 64 nt, Human
ggcacugccccaggcccagcuccuggcccuaggucccucccagccccaugugccugccgccugc

SEQ ID NO: 427537 - RNA, 64 nt, Human
cuugugaauauuguggcucccugggggcggccagcccucccagcaguggcuugcuuucuucucc

SEQ ID NO: 427538 - RNA, 64 nt, Human
gcucucucuagcuccccaauucugccugccuccucccucccagcugcacuuuaacccuagaagg

SEQ ID NO: 427539 - RNA, 64 nt, Human
gcccugaagccuccguggaacauucuggaucugacccucccagucucaucuccugacccuccca

SEQ ID NO: 427540 - RNA, 64 nt, Human
uucuggaucugacccucccagucucaucuccugacccucccacucccaucuccuuaccucugga

SEQ ID NO: 427541 - RNA, 64 nt, Human
gagacaaggcccauagguauggccccccccuucccccucccaguacuaguuaauuuugaguaau

SEQ ID NO: 427542 - RNA, 64 nt, Human
cgaacuccugaccucaggugauccgccggccucacccucccaaagugcugggauuacaggcaug

SEQ ID NO: 427543 - RNA, 64 nt, Human
cucacuguaaccuccgacuccuggguucaagugacccucccaccucagccucucaaguagcugg

SEQ ID NO: 427544 - RNA, 64 nt, Human
agucccacaccaguuagguagagcugucuguucacccucccaucccagcugaucccagucacug

SEQ ID NO: 427545 - RNA, 64 nt, Human
gccuuccucaccaauuuggcacaggcagcagucucccucccaggcucuccccaucuccccugcu

SEQ ID NO: 427546 - RNA, 64 nt, Human
agccucagcuacccacuuuccuucaugaacaucccccucccaacacuacccuucccugcacuaa

SEQ ID NO: 427547 - RNA, 64 nt, Human
aagccucagcuacccacuauccuucgugaacauccccucccaucauuacccuucccugcacuaa

SEQ ID NO: 427548 - RNA, 64 nt, Human; identical to SEQ ID NO: 427547

SEQ ID NO: 427549 - RNA, 64 nt, Human
ucccuguggccagcgugaacagagccaugccccacccucccagacugaucagucaguagguauc

SEQ ID NO: 427550 - RNA, 64 nt, Human
uauuagggaauaguagauuguuauuucguuuuuucccucccagugcauuuuaaaaacagcacug

SEQ ID NO: 427551 - RNA, 64 nt, Human
agcuucccuauuauccaggggcucauccuaugcacccucccaaagggagcuauccccgccccac

SEQ ID NO: 427552 - RNA, 64 nt, Human
aagcaagauuuuaacuagccccuuuuccucuucacccucccaugaugcgcaguguucagaaagc

SEQ ID NO: 427553 - RNA, 64 nt, Human
cugcuuuccaacuccaagcucccuccacaaguuucccucccaggccccccacaccccagugugg

SEQ ID NO: 427554 - RNA, 64 nt, Human
ucucuguugcuucucuucugguguugcuucuccucccucccauucucucugcaacucccugcgg

SEQ ID NO: 427555 - RNA, 64 nt, Human
cuggauggagcccaggcgggagcgguggcccugucccucccaccucugugaccucaggcacuag

SEQ ID NO: 427556 - RNA, 64 nt, Human
ugcaguucuuggauacucugggagguguuccccucccucccaugacugagcccaucagccauuc

SEQ ID NO: 427557 - RNA, 64 nt, Human
caggagguucuugucucuguguaagggcuugucucccucccaguuuuucuuuugcuccacguca

SEQ ID NO: 427558 - RNA, 64 nt, Human
ggagaagcguggcuuccugccacccugcaacccacccucccagccaaggaggcugcuguggugg

SEQ ID NO: 427559 - RNA, 64 nt, Human
accggcaggugggcugguggcugcagccucagagcccucccagguugcugcuguuuccagugaa

SEQ ID NO: 427560 - RNA, 64 nt, Human
gcagagaccccaggaucccagagcuucccaggaucccucccagauccucugcugacuccauaug

SEQ ID NO: 427561 - RNA, 64 nt, Human
agccuuccccauguccuugccuugcugagaauugcccucccaugccgcugagguguuagguggu

SEQ ID NO: 427562 - RNA, 64 nt, Human
ccuguacaccagauuggaaauggagugaaacaagcccucccaugccaugucuccgugggccacg

SEQ ID NO: 427563 - RNA, 64 nt, Human
cucuuuauuugcugcuguuuaaguugccaaccuccccucccaauaaaaauucacuuacaccucc

SEQ ID NO: 427564 - RNA, 64 nt, Human
uucagccuccugcccuagggaccgcggggcagcccccucccagcucuugcagcucagcuggcgg

SEQ ID NO: 427565 - RNA, 64 nt, Human
gacggaaagagagagacacucaggcggcagcauucccucccagccacugagcugucgugccagc

SEQ ID NO: 427566 - RNA, 64 nt, Human
gagaccaguaguauggcucuaaucuuacccuuagcccucccaaccauuaugcuguacuaucuac

SEQ ID NO: 427567 - RNA, 64 nt, Human
agccucagaggccccuugcugcuggcucccaucucccucccauuugcagaccaggaaggaagag

SEQ ID NO: 427568 - RNA, 64 nt, Human
ccuggaugucgaccucucccgcuguguggcgucccccucccaccuguugaauacauagggaugg

SEQ ID NO: 427569 - RNA, 64 nt, Human
uaccucuagccuuuuggugggggaaaagauccagcccucccaccucauuuuuuacuauaauaug

SEQ ID NO: 427570 - RNA, 64 nt, Human
gaaaggaauuucucucuucuguccaucagccugucccucccaacugucuaggacagucuucggu

SEQ ID NO: 427571 - RNA, 64 nt, Human
agcgcucccagccugcccuccagcugcugcucuccccucccagucucuacucacugggaugagg

SEQ ID NO: 427572 - RNA, 64 nt, Human
ccucccuggcuucgagugucaggggagccgcguucccucccagggcuggagcagaggaccacaa

SEQ ID NO: 427573 - RNA, 64 nt, Human
ggaggcugacagggucaagccacccugcccaccacccucccacuuccccuccccuuuccucucc

SEQ ID NO: 427574 - RNA, 64 nt, Human
auaauacacaaggaaagcagccucaaagaauuaccccucccaaaaugucagaagugcugaggcu

SEQ ID NO: 427575 - RNA, 64 nt, Human
ccuacgcacacaguauuuuuucauagaaacauuucccucccauuugccuugccucagaaauaaa

SEQ ID NO: 427576 - RNA, 64 nt, Human
gagugaugcguccccccccaaccuuucccucacccccucccacccccagccccgacuccagcca

SEQ ID NO: 427577 - RNA, 64 nt, Human
cuccuuuucuucucuuuagagacccagcccagggcccucccacccuuguccagaccuggugggc

SEQ ID NO: 427578 - RNA, 64 nt, Human
gaaagguagaagugacuucaaggucacgagguuccccucccaccucugucacaggcuucuugac

SEQ ID NO: 427579 - RNA, 64 nt, Human
uuugcugguucagcuaugauucaggcuucuucagcccucccaaauugcccuugcccuaccugug

SEQ ID NO: 427580 - RNA, 64 nt, Human
ccucccuggccucacgcccagccuccucccaccacccucccaccaugcgcugcucaaccucucu

SEQ ID NO: 427581 - RNA, 64 nt, Human
cgguggggaguggaagagccgguccugcuguccgcccucccagccccagguggaaggcucaguu

SEQ ID NO: 427582 - RNA, 64 nt, Human
gaaacgcagcaccccacugguucugaggccccuacccucccaggcugucccacgugaugcugac

SEQ ID NO: 427583 - RNA, 64 nt, Human
ccgggcaaccucuggcuacaggggccauugggugcccucccaguugagaggggccgcuguuucg

SEQ ID NO: 427584 - RNA, 64 nt, Human
uugaggacucuacccacggcuaaggucuucauuucccucccaccgaaccuugauuucaaggugg

SEQ ID NO: 427585 - RNA, 64 nt, Human
cgcccuuuuccgcaccgugcccgucuucacacugcccucccaacugccagacuuccugggggcc

SEQ ID NO: 427586 - RNA, 64 nt, Human
acaaacgaaaggaaagcggggaggggaaaacagacccucccacuggugccguugcugcguucuu

SEQ ID NO: 427587 - RNA, 64 nt, Human
uaaauuugggaggaggaguaugccuuuggugucccccucccaaggggcaauucugaaccccauc

SEQ ID NO: 427588 - RNA, 64 nt, Human
ggaaacucuuccuccagccuuccggggagaacaucccucccauucugggaaaggaaagcagccu

SEQ ID NO: 427589 - RNA, 64 nt, Human
gucaucauccucaucucaccauuguauugcuaugcccucccauaaaaacacauugaucccuagc

SEQ ID NO: 427590 - RNA, 64 nt, Human
uccagggcugggggaagggggacgcaggaucauccccucccaaggagaucugugggggucccac

SEQ ID NO: 427591 - RNA, 64 nt, Human
gaugugaccagcucaggcagacugaacuaagcaccccucccauccugcgacccucacuggccug

SEQ ID NO: 427592 - RNA, 64 nt, Human
ucuuagggugaaccacuucauucugcaggguucucccucccaccuuaaagaaguuccccuuaug

SEQ ID NO: 427593 - RNA, 64 nt, Human
ucaccuggugggccugggcucagcaaacagcccucccucccaguauuucaucaaggacagggaa

SEQ ID NO: 427594 - RNA, 64 nt, Human
ucccucccaguauuucaucaaggacagggaauaucccucccacacacaggccagcugcucaccc

SEQ ID NO: 427595 - RNA, 64 nt, Human
guuugacaccugucuacccagagccagugacugucccucccagcagccuccaaaggguccaaag

SEQ ID NO: 427596 - RNA, 64 nt, Human
auacucuucucccaucucccuucacaggaugacacccucccauaccccauagcuggggccagca

SEQ ID NO: 427597 - RNA, 64 nt, Human
gggggaggacaacugugggaaaagcccugggggccccucccaaggccccaucagugcucugagu

SEQ ID NO: 427598 - RNA, 64 nt, Human
cccuggauuuagacucucaugguccagcccguggcccucccagacuugcugcuugcuuggucca

SEQ ID NO: 427599 - RNA, 64 nt, Human
ccugcccccgugauuaaauuauuucccaccaggccccucccacaacauggaauaaugggagaua

SEQ ID NO: 427600 - RNA, 64 nt, Human
gugagccccuucagggacucaaggguccagaagucccucccaucucuaccccaaagaauuccug

SEQ ID NO: 427601 - RNA, 64 nt, Human
cccacaauuagcuguccuuuaacaccgcagaacccccucccagaagaagagcgaucccucggac

SEQ ID NO: 427602 - RNA, 64 nt, Human
cuaguuagaucccugaccauaagccugagccccucccucccagccccauauucacacacauccc

SEQ ID NO: 427603 - RNA, 64 nt, Human
aagacaucgauugauaugcuucuuuguguuauuucccucccaaguaaauguuuguccuuggguc

SEQ ID NO: 427604 - RNA, 64 nt, Human
cucuugccaacaguaucuacugcccucgaggcagcccucccaagucagacaccuccuucggagc

SEQ ID NO: 427605 - RNA, 64 nt, Human
guccuugcuccugcaugccaucagccccacucagcccucccauaccucccuggcuccucaggau

SEQ ID NO: 427606 - RNA, 64 nt, Human
uuuuucauuaauccucucucaccucacagauacccccucccauggcaaauaauauaauaaccag

SEQ ID NO: 427607 - RNA, 64 nt, Human
gguuaacuggaaaagcacuuucagucuccuauaacccucccaccagcugcugcuucagguauaa

SEQ ID NO: 427608 - RNA, 64 nt, Human
cuggccaggguuuugccgauuucccuccucacaucccucccacccucggucauaucauugagau

SEQ ID NO: 427609 - RNA, 64 nt, Human
uggcuggguggaaaaagcucuccuccacagagagcccucccaugucugcugguuucaguucccc

SEQ ID NO: 427610 - RNA, 64 nt, Human
cuuggcuugaccucuccuugugagcucaccugagcccucccagggccagguuccugacaguguu

SEQ ID NO: 427611 - RNA, 64 nt, Human
aagcucaguauagaggaacagacacuguuuacgucccucccacugcuaaccuuauauaucucua

SEQ ID NO: 427612 - RNA, 64 nt, Human
gugcaugggacagccuggcacaaugaagaauuagcccucccaaaauguagauuauuuuauuuca

SEQ ID NO: 427613 - RNA, 64 nt, Human
caggucuucacugcccaggggucgaauggggucccccucccacuugaccugagaugcugggagg

SEQ ID NO: 427614 - RNA, 64 nt, Human
cguaacccaacucuccuggacugccuugaauauccccucccagucaccuuguggcaagccccug

SEQ ID NO: 427615 - RNA, 64 nt, Human
aagcuuuucucacauggcaucacugugacacuggcccucccacuucccucuuugacuuacaaag

SEQ ID NO: 427616 - RNA, 64 nt, Human
uuucuguucuuccaucaccuccccccccccgccacccucccacugccaaagaacuuggaaauag

SEQ ID NO: 427617 - RNA, 64 nt, Human
cacagugcucuuuucuccucacuguauccagguucccucccagaggagccaccaguucucaugg

SEQ ID NO: 427618 - RNA, 64 nt, Human
cucucaccaaguucccuugccuaagaaggccacucccucccaccccacugaagugggggauagu

SEQ ID NO: 427619 - RNA, 64 nt, Human
ugucccacucuugcucuauucaguuuacagucaacccucccaagcacacaccccgcuucccuug

SEQ ID NO: 427620 - RNA, 64 nt, Human
cuguaacuccagaccaccuugaguguggcaccuccccucccaagccccccuugacauccucuca

SEQ ID NO: 427621 - RNA, 64 nt, Human
acugaugcugcgcacaugagcugaaaaugaagagcccucccauccauuccaugagaaagaaggu

SEQ ID NO: 427622 - RNA, 64 nt, Human
uggaaagcacccuuuugguuguuuucauucuguucccucccauuguagauugaacuuuguucuc

SEQ ID NO: 427623 - RNA, 64 nt, Human
cgcugugucgcgccucuccuccucggaaacagaacccucccacagcacauccuacccggaagac

SEQ ID NO: 427624 - RNA, 64 nt, Human
agucagaagcagcccuuggcugggugaggugugccccucccagggagaauaaagcuucugaaga

SEQ ID NO: 427625 - RNA, 64 nt, Human
ggcgcccccgccuugaccccugggcaccuccauccccucccaccuguccccagaucagucucug

SEQ ID NO: 427626 - RNA, 64 nt, Human
gugaaugcccagugagggcugugccccggucuuacccucccaaagggccaaggccagaccuccc

SEQ ID NO: 427627 - RNA, 64 nt, Human
gucagcgagcuggggcugcacugugcccaugcugcccucccaucacccccuuugcaauauauuu

SEQ ID NO: 427628 - RNA, 64 nt, Human
uugcaccacgggacaucacagggugggccucggccccucccacacccaaagcugagccugcagg

SEQ ID NO: 427629 - RNA, 64 nt, Human
ucuccaguuugaugcuauggcgcuggacccagggcccucccaggccaucucuguuccucugggg

SEQ ID NO: 427630 - RNA, 64 nt, Human
aaaucuccaggguucaaucgauucuccugccucacccucccauguagcugggauuacagcugcc

SEQ ID NO: 427631 - RNA, 64 nt, Human
ugacuucucugggcugaggcuggucguccuggagcccucccaguaccucgggcugcaagagcug

SEQ ID NO: 427632 - RNA, 64 nt, Human
cacccagucccucugugggagcccgggugccaggcccucccaacaccacaccacccuccaggcc

SEQ ID NO: 427633 - RNA, 64 nt, Human
ggggggaugguccuugaguuuugcaugcucuccucccucccacuucugcacccuuucaccaccu

SEQ ID NO: 427634 - RNA, 64 nt, Human
cagaauggaauaaaaaaaugaucucccuuuauuacccucccaaagguuaccagcguuugaauuu

SEQ ID NO: 427635 - RNA, 64 nt, Human
uucaguaugaaccuaacuccccaccccaacaucucccucccacauugucaccauuucaaagggc

SEQ ID NO: 427636 - RNA, 64 nt, Human
guugaugccuucccagagucaaccuccugugacgcccucccagagccaaccucgggugacaccc

SEQ ID NO: 427637 - RNA, 64 nt, Human
ugugacgcccucccagagccaaccucgggugacacccucccagagucaaccucaugugacaccu

SEQ ID NO: 427638 - RNA, 64 nt, Human
gaacaaggggucuuccgagcagcccccagcccuccccucccaucugugccucuguaaggggcuc

SEQ ID NO: 427639 - RNA, 64 nt, Human
aacagagcccggggcuccugagccucugcgugugcccucccagcccacaccagugcucucggcc

SEQ ID NO: 427640 - RNA, 64 nt, Human
cucagggcagggugccuggcggagaaggccugggcccucccacuggucccucggagaucugcug

SEQ ID NO: 427641 - RNA, 64 nt, Human
uuaggcguuaguauaccguuuuuuuguggccucucccucccacgcuguuaauuagagaaagaua

SEQ ID NO: 427642 - RNA, 64 nt, Human
uugccagaauucugacagugaugucauuuuauuccccucccaaaacaugccccaggaacaagca

SEQ ID NO: 427643 - RNA, 64 nt, Human
gaggccaggggccccuggcgagaaccgcacacaccccucccacacaccuugcucuggcuucucu

SEQ ID NO: 427644 - RNA, 64 nt, Human
ucugucagaaggaaucaacaaggcuccuugccuccccucccaaucccccuuuuggaggacuugu

SEQ ID NO: 427645 - RNA, 64 nt, Human
ggaguccucaugaccuaaucgugaccuuaaaggccccucccaacacuguuacaauggcaauuaa

SEQ ID NO: 427646 - RNA, 64 nt, Human
gagaacucauagaacaaggugaaagacaugagugcccucccaaagucugagugcacgaaaauuu

SEQ ID NO: 427647 - RNA, 64 nt, Human
gcugggugguccaccaaguucucauaaacagagucccucccauucccccacggggugcaccgaa

SEQ ID NO: 427648 - RNA, 64 nt, Human
uuagaugcuccuuuguucugguccuuuacucuuccccucccauguugucgcacugaucacacug

SEQ ID NO: 427649 - RNA, 64 nt, Human
uuaaaaauuggcuuuuuuaggauucuuuuucucccccucccaucuuagucuuaccuugagggaa

SEQ ID NO: 427650 - RNA, 64 nt, Human
cggacccuguagauugggcgccaccaccagaucccccucccaggccuuccucccucucccauca

SEQ ID NO: 427651 - RNA, 64 nt, Human
cucaugcacgggaacacacacacccugcguuucucccucccaggcuaggaaccucucugccacc

SEQ ID NO: 427652 - RNA, 64 nt, Human
uaacauguucccauguacagacacgguccccacacccucccagccucaggcccaggcagacaug

SEQ ID NO: 427653 - RNA, 64 nt, Human
ugcuguaauuagcuccacguguacccccuucacucccucccaccagcucugcagccagccuaug

SEQ ID NO: 427654 - RNA, 64 nt, Human
acuccccaaccccccacuccuacuuccugaagggcccucccaaggcuacauccccaccccacag

SEQ ID NO: 427655 - RNA, 64 nt, Human
guuaauuuuuagccugugcccuuccccaccuuugcccucccagugguugguaugugggaagccc

SEQ ID NO: 427656 - RNA, 64 nt, Human
cugcugucuauauucauuaaaguuuuccacuucacccucccauagucuagagggaugcccauuc

SEQ ID NO: 427657 - RNA, 64 nt, Human
ugcgcuucaguucuggugugcuuaaccaugcaagcccucccaccucccagggcuccuugccuua

SEQ ID NO: 427658 - RNA, 64 nt, Human
auauuuucuccagcguugguuacugaccaccccacccucccaccacacacacacacacacacac

SEQ ID NO: 427659 - RNA, 64 nt, Human
accacauccccugcuugagcccagcgcugcaugucccucccaagaaguccagaaugccugcaaa

SEQ ID NO: 427660 - RNA, 64 nt, Human
cacagcuagggucuuccuagcagcuccuccuccucccucccaaggcccccaggaaucccuuccu

SEQ ID NO: 427661 - RNA, 64 nt, Human
ucaaccaaggagcaaagcucaucccaccccacaccccucccaggucugcucacugccaggcucc

SEQ ID NO: 427662 - RNA, 64 nt, Human
cgguacagguaauugagaauguacuacgguacuucccucccacaccauacgauaaagcaagaca

SEQ ID NO: 427663 - RNA, 64 nt, Human
cucugccugaaaagccucccuccagccccuacuucccucccaucuuaguucacaaagucagguu

SEQ ID NO: 427664 - RNA, 64 nt, Human
acagggaggccauuccccuucuacucaccgacaucccucccagcaccacacaccccgccccuga

SEQ ID NO: 427665 - RNA, 64 nt, Human
caggauggugauugcucacaccaaagccuuggaccccucccagccugugaccuuugggaccaac

SEQ ID NO: 427666 - RNA, 64 nt, Human
gaaaauguuuacuauuacagggaccucaacacugcccucccauacaggcuggauaaaacuguuu

SEQ ID NO: 427667 - RNA, 64 nt, Human
ccauuucauuccuuguuguauaccuuuccaucugcccucccauuuuaacuaucuacuguggccu

SEQ ID NO: 427668 - RNA, 64 nt, Human
cccacccccagcccuggcccuuggcuucucucaccccucccaaauuaaauggacuccagaugaa

SEQ ID NO: 427669 - RNA, 64 nt, Human
uuaauaaauuuucaacguaauugucuauuuuuuucccucccaucugcaacagaauacauuuuuu

SEQ ID NO: 427670 - RNA, 64 nt, Human
guagggagccucucugggaagcucuuccuccugccccucccauuccuggugggggcagaggagu

SEQ ID NO: 427671 - RNA, 64 nt, Human
gagcacccugggaacugggucuuggguagcaaagcccucccagagaaaagauugggcacaacua

SEQ ID NO: 427672 - RNA, 64 nt, Human
ugcccuauacgccgccuucacuccacagccucaccccucccacccccauacugguacugcugua

SEQ ID NO: 427673 - RNA, 64 nt, Human
ugcugaggaguugacgacagggaguaccacucuccccucccacaaacuucaacuccuccaugga

SEQ ID NO: 427674 - RNA, 64 nt, Human
gcagaugagugaauuggaauguccagcagaguuacccucccaauuauauguucauuuuguauau

SEQ ID NO: 427675 - RNA, 64 nt, Human
gccucucccaaaccucuuugaacaaagcuucugucccucccacaccucucaccucacaggcaca

SEQ ID NO: 427676 - RNA, 64 nt, Human
agaagccucuguggccuuuggugaccucaccacucccucccacccagucccucccucuggucca

SEQ ID NO: 427677 - RNA, 64 nt, Human
ucuggcuguauggcugcaugugacaagccacguccccucccaccucuccccaaaccccugcauc

SEQ ID NO: 427678 - RNA, 64 nt, Human
cuccccacuugcagcacaaugccuucuccaccugcccucccacucuuccaguccaauccacgcu

SEQ ID NO: 427679 - RNA, 64 nt, Human
cggggagagggagcccuguguucccggugguugucccucccagggaugcagccagacccgugcc

SEQ ID NO: 427680 - RNA, 64 nt, Human
gccucuagggcuguugcguccccgucuuuccagccccucccaucacaaauacagaagaaccccu

SEQ ID NO: 427681 - RNA, 64 nt, Human
aaauauuuccauauucuguauuaggagaaaauuacccucccagcaccagccccccucucaaacc

SEQ ID NO: 427682 - RNA, 64 nt, Human
acauagaaaaauaauaauuauacaugcuguuguacccucccaaaguaaaucugauauauguaau

SEQ ID NO: 427683 - RNA, 64 nt, Human
aagaccugguuuccuuucauucaucccaggagaccccucccagcuuuguuugagauccugaaaa

SEQ ID NO: 427684 - RNA, 64 nt, Human
auuuuuaaaaugcaccauguccugaaagauggcacccucccacccgcagagugcuuccugcaag

SEQ ID NO: 427685 - RNA, 56 nt, Human
cucaggggugccaggugugagggcugcccucccaccuccgcugggaggaaccugaa

SEQ ID NO: 427686 - RNA, 56 nt, Human; identical to SEQ ID NO: 427685

SEQ ID NO: 427687 - RNA, 64 nt, Human
cccaucuauacgagguguuggagaaggugaagaacccucccauucacgcccgccuaccaacaac

SEQ ID NO: 427688 - RNA, 64 nt, Human
gcccucuucucuacccuccuucaugauuccugaccccucccauccuucccauuuccuuugaugu

SEQ ID NO: 427689 - RNA, 64 nt, Human
gguaggacagggcugggcuucccucucauccucccccucccaaucuccuuccaccucccucccu

SEQ ID NO: 427690 - RNA, 64 nt, Human
auacucccgucacuccuccccacugccgccccuccccucccacucucgucuccuuccccucgcc

SEQ ID NO: 427691 - RNA, 64 nt, Human
agggcaugcaggcccucagcccgggcugugccagcccucccagccccaggcccaucugagggac

SEQ ID NO: 427692 - RNA, 64 nt, Human
ucagcccaguagcaguggagcaggcccuguccugcccucccagcaauaaccaccucccuggagg

SEQ ID NO: 427693 - RNA, 64 nt, Human
ucaagcccaggcuuccuggguccugccugguccucccucccaaggagccauucugugugugacu

SEQ ID NO: 427694 - RNA, 64 nt, Human
gagagggcuaaauggguccaucucuaggggccuucccucccaggucugugucugauagcauaca

SEQ ID NO: 427695 - RNA, 64 nt, Human
cccauaguucucuacuucauauaaauugcucaggcccucccaccccuucucuaacacuagcuuc

SEQ ID NO: 427696 - RNA, 64 nt, Human
uuggcuuuuuccuuugucgccuccccagcaccugcccucccagucucccaccccggccccaggc

SEQ ID NO: 427697 - RNA, 64 nt, Human
uaaaaaaguagcacugauguguuuuguaaucugccccucccagcccuccguggaggcugccagg

SEQ ID NO: 427698 - RNA, 64 nt, Human
uucuccggacagagcccuccuugucaacuugaggcccucccaaggcccucuacugcccucuggg

SEQ ID NO: 427699 - RNA, 64 nt, Human
ugagagucugcagacaauguggguucuccgacugcccucccagugaagguggaccucugauuua

SEQ ID NO: 427700 - RNA, 64 nt, Human
ccugcgccuccuccucuguguucucuccaugucccccucccaacuccccaugcccaguucuuac

SEQ ID NO: 427701 - RNA, 64 nt, Human
ugaagaaggaacgaugccuuuuucaauggugucucccucccauugugcagaagagcuuuuguug

SEQ ID NO: 427702 - RNA, 64 nt, Human
agacccuucgcaggcacccacuguuucaacuugacccucccacccccugcuacucuccuccaca

SEQ ID NO: 427703 - RNA, 64 nt, Human
aaugaucucccugagccuuugaccccagauaaaccccucccaauuaaugcauuuucauuuccua

SEQ ID NO: 427704 - RNA, 64 nt, Human
uccucauuccuaaauaacuugccuuacauaucagcccucccacuucugaaguucaaauuagugc

SEQ ID NO: 427705 - RNA, 64 nt, Human
aagcacagaaagugaggcucuccucccgccccgccccucccacgccucaccagccccccgcgcg

SEQ ID NO: 427706 - RNA, 64 nt, Human
aggaccucagaacuggugcagcuucucucucccucccucccacagacugaaccuuucgccagaa

SEQ ID NO: 427707 - RNA, 64 nt, Human
ugcacaacuucaguaaaaacacugcacaugcguccccucccaagugcuggcaggccacugugca

SEQ ID NO: 427708 - RNA, 64 nt, Human
gaugagugcugaguuccucgcccagcgccaucuucccucccaguaucuuugcuuuuggacugac

SEQ ID NO: 427709 - RNA, 64 nt, Human
gaugucauccaccugagaacuccacuacccuuuucccucccagaccacgaauuagaagauaugu

SEQ ID NO: 427710 - RNA, 64 nt, Human
aucccagccaggcccuggaggucugacagccccucccucccagagcugguuccucccugggagg

SEQ ID NO: 427711 - RNA, 64 nt, Human
ucaucaugggagcuuuccucagcaccuucaccuucccucccaguguagccuccugucagugggg

SEQ ID NO: 427712 - RNA, 64 nt, Human
cucaggauuuuacaagacugucagaguggggaaccccucccauuaaagauccgggcaggacugg

SEQ ID NO: 427713 - RNA, 64 nt, Human
guguguagggggguuucagggcugaaccccaccucccucccaccuuccucccaccucaccuguc

SEQ ID NO: 427714 - RNA, 64 nt, Human
accccacgggaggaguggcaucuggggcucuuggcccucccaccuggagccuguuacccguuag

SEQ ID NO: 427715 - RNA, 64 nt, Human
augacugcagccuugaacuccugggcuuaagugacccucccaccucagucuccugaguagcuag

SEQ ID NO: 427716 - RNA, 64 nt, Human
cugauggguuugcaggaaggccugaacaugugcacccucccagggacacuggaugcgcugggag

SEQ ID NO: 427717 - RNA, 64 nt, Human
caugacaggccugggugccacacagagguggccacccucccaccacagugucugcagcugcugc

SEQ ID NO: 427718 - RNA, 64 nt, Human
ugugcccugaacaaggaccucacugcccgccuuccccucccaccagcccccuugggccaggcag

SEQ ID NO: 427719 - RNA, 64 nt, Human
gccggccugggggcugggagggccaggggcaccucccucccacccuucaggcugcacugugugu

SEQ ID NO: 427720 - RNA, 64 nt, Human
aaaagcuagagcagagcagcccuucucccacaagcccucccacccccgugcagccacauaccug

SEQ ID NO: 427721 - RNA, 64 nt, Human
guggaaagggccugaggggugaagugaaauaggacccucccaccauccccuucugcuguaaccu

SEQ ID NO: 427722 - RNA, 64 nt, Human
agguucuauuaccuuuaaaaaagaguaguuuugccccucccagcaaccuaagaccagucugaac

SEQ ID NO: 427723 - RNA, 64 nt, Human
cucacuguaaccucgaauuccugggcucaagcaacccucccaccuuagccucccuaguagcugg

SEQ ID NO: 427724 - RNA, 64 nt, Human
ucucucccuccuccuccccucucccucccccucucccucccaucccuuuucuucccuuucacuc

SEQ ID NO: 427725 - RNA, 64 nt, Human
ucccauggugcugcuccaaccaucagauaaaugacccucccaagcaccaugucagugucguaca

SEQ ID NO: 427726 - RNA, 64 nt, Human
guugcccaggucucaaacucccgaucucaagccacccucccaaaaugcugugauuauaggccag

SEQ ID NO: 427727 - RNA, 64 nt, Human
gcuccgcugagugucugugaaauaccucuacuuucccucccauauccagaacaaaaugauacuu

SEQ ID NO: 427728 - RNA, 64 nt, Human
aaagcgggaagggucccccacagcaagagagagacccucccagucacuuggucaucugagccuu

SEQ ID NO: 427729 - RNA, 64 nt, Human
agcucccccagcccccagguccuccugaccacuccccucccagcccuggguccucccacccucu

SEQ ID NO: 427730 - RNA, 64 nt, Human
guggcuggcuguccagcugggcaaacaguggcaccccucccagcucuucugaguggggagucuu

SEQ ID NO: 427731 - RNA, 64 nt, Human
gccacaggucagggggcugugccugacuagggagcccucccauugccuuccuggcccgggauag

SEQ ID NO: 427732 - RNA, 64 nt, Human
ggugauucccacacauccuuccugcaucccccgacccucccagacagcuuggcucuugccccug

SEQ ID NO: 427733 - RNA, 64 nt, Human
ugcaguucccuuuggguuccauguuuuccuuguucccucccaugccuagcuggauugcagaguu

SEQ ID NO: 427734 - RNA, 64 nt, Human
ucuuguuuuuuuagacggaauuaguccuuggcuucccucccagucccagcccugcuuccggcug

SEQ ID NO: 427735 - RNA, 64 nt, Human
cccaucggggagucacagucaguccccccggccccccucccagucccuguuggcuuucgguagc

SEQ ID NO: 427736 - RNA, 64 nt, Human
cgcuugugggaucugguuguuuaaaagcaugcagcccucccacuucacucucucugucucuccu

SEQ ID NO: 427737 - RNA, 64 nt, Human
cgaugagagagaccaugaggccacugggcuuucccccucccaggccuccugggugucacccccu

SEQ ID NO: 427738 - RNA, 64 nt, Human
ccccuuccccgggccacggggccuugggucccugcccucccacccagguuugguuccucccggg

SEQ ID NO: 427739 - RNA, 64 nt, Human
cucugugccgccaccucuaccuguucccaggacacccucccacaugaugucaccuccccaucau

SEQ ID NO: 427740 - RNA, 52 nt, Human
aggaugaacugauccuuugacccccucccacgaccuccucauaaagaccgug

SEQ ID NO: 427741 - RNA, 64 nt, Human
ugcccccaccucaguuauuguuuugaugucuagccccucccauuuccaaccccucccuagcauc

SEQ ID NO: 427742 - RNA, 64 nt, Human
gaggugaagcgaagccacucuuaccucucccuuccccucccaccugcccccugcguaggcaccc

SEQ ID NO: 427743 - RNA, 64 nt, Human
uuuacuccuuggucugucucgcuuuaucugucgccccucccagcgcugagagccuccccuggcu

SEQ ID NO: 427744 - RNA, 64 nt, Human
gccucgggccuggguccgccuuaaucuggaaggccccucccagcagcgguaccccagggccuac

SEQ ID NO: 427745 - RNA, 64 nt, Human
cccucccuccccuccccaguccugccggcugccucccucccaccagagucugccagagucauug

SEQ ID NO: 427746 - RNA, 64 nt, Human
uggacgaggggacaggcuggugggaugggguucccccucccaugccccucccuccuuuuuauuu

SEQ ID NO: 427747 - RNA, 64 nt, Human
uuccagggcugccuugacuucuucccugcaugcucccucccagugacuuuccuucccuuucaca

SEQ ID NO: 427748 - RNA, 64 nt, Human
cgcagacuuuugacuggaugaaagucaaaagaaacccucccaaaacaggucaguccugcugguu

SEQ ID NO: 427749 - RNA, 64 nt, Human
caggaacucgcaccugugcuggagcccuguuccucccucccacacucgccaucuccugggccgu

SEQ ID NO: 427750 - RNA, 64 nt, Human
aaagugagguucgaggaugacguagguaacucuccccucccaaguccauguuccaaguggcuau

SEQ ID NO: 427751 - RNA, 64 nt, Human
ggacugggagaaucucugaggcgugucuuccaggcccucccacagcuugugcccuccacagugu

SEQ ID NO: 427752 - RNA, 64 nt, Human
uuuguccaagcuguggagacucuuguacuugauccccucccaccaauucuaaaguagcuuucuc

SEQ ID NO: 427753 - RNA, 64 nt, Human
augaaaaauggacagcugcuuuugacaauaaugccccucccaacuucccauucauagaaucaua

SEQ ID NO: 427754 - RNA, 64 nt, Human
cccuaaucgcuuacaccuaauauaagcuuguccucccucccacacucaucccugcuucuuuggg

SEQ ID NO: 427755 - RNA, 64 nt, Human
ccagccagccccauugcacacugugcagcccauccccucccagaaauagagugacaaacucugc

SEQ ID NO: 427756 - RNA, 64 nt, Human
aggaggcccuggcugcugccaccuggcugggcugcccucccaacccccgccucuggcucagagc

SEQ ID NO: 427757 - RNA, 64 nt, Human
ugccccuccaaguggggucuggggccuggagagacccucccacccagcagaccaggagauagcu

SEQ ID NO: 427758 - RNA, 64 nt, Human
cacgcucgccccugcacacucacauauguggcaacccucccacgaaggaccugccaccaugcca

SEQ ID NO: 427759 - RNA, 64 nt, Human
ccucccccgguugccccccacucuaaagccuccucccucccagcguccacuggcuccaggcucc

SEQ ID NO: 427760 - RNA, 64 nt, Human
cuuuggucagucccuguggucccccaccagcucccccucccauagggcugcccaccaagcccug

SEQ ID NO: 427761 - RNA, 64 nt, Human
gacuggggagggagagugaacuccgagggguguccccucccaauccccccagggccuuaauuuu

SEQ ID NO: 427762 - RNA, 64 nt, Human
uucuaggaugugugucacuuugcuucagugacagcccucccacccagccuggcucugcuggccc

SEQ ID NO: 427763 - RNA, 64 nt, Human
uuuuaaaauuguucuccagcauuuuauggcuccucccucccauguccucagacccagcaaaagc

SEQ ID NO: 427764 - RNA, 64 nt, Human
cuggcagcccuguugucuggaggguucuuguugucccucccauuagccagggcggagacugucu

SEQ ID NO: 427765 - RNA, 64 nt, Human
gaaagagcuccaggcucuugugucgcccacccagcccucccauacucacuccugacagcuuucc

SEQ ID NO: 427766 - RNA, 64 nt, Human
gguuuaccuugucaggagugcauggacgggcugccccucccauuccuucaagcaucacucagag

SEQ ID NO: 427767 - RNA, 64 nt, Human
uuccguccagcccggggcagucugacugucggugcccucccaggaacggggaaggccuccgucu

SEQ ID NO: 427768 - RNA, 64 nt, Human
agaacaacaggaaaccaaggucugaccuaggguucccucccagucuucacaucacucuggccuc

SEQ ID NO: 427769 - RNA, 64 nt, Human
ugguuuucauaaugagaaggcuggaauugagcuucccucccauuuuccuuguuccugaacuaau

SEQ ID NO: 427770 - RNA, 64 nt, Human
ucucugauucuagaaaaaggaaucauucuccccucccucccaccacauagaaucaacauauggu

SEQ ID NO: 427771 - RNA, 64 nt, Human
auucucagacuaacuuccagaauuauacuuuaaccccucccagauaugguccgccuuuggcauu

SEQ ID NO: 427772 - RNA, 64 nt, Human
cucucugaggugggucgggcgcccucugcccgcccccucccacaccagccaggcuggucuccuc

SEQ ID NO: 427773 - RNA, 64 nt, Human
ccauguaugucugcgccccugucccccacccugacccucccauggcccucuccaggacucccac

SEQ ID NO: 427774 - RNA, 64 nt, Human
ggauccugagggcuggccccugcucacugaugggcccucccaggcccgucaagcccuggugaag

SEQ ID NO: 427775 - RNA, 64 nt, Human
uugaucuacccuugcagauuuaaccugucuucuucccucccauuauucucauuuuccuuuuacc

SEQ ID NO: 427776 - RNA, 64 nt, Human
uucacauaccucugccugggaaucuucuuuccuccccucccauggacacugucccugauacucu

SEQ ID NO: 427777 - RNA, 64 nt, Human
ucuaagaaaucuauguuccugaguuugcccccugcccucccacuccuuccccuucuccccucua

SEQ ID NO: 427778 - RNA, 64 nt, Human
ccuacagcugugucuaagcucaggaggaaagggacccucccaucauucauggggggcugcuacc

SEQ ID NO: 427779 - RNA, 64 nt, Human
agguagaccauauucuaaguuagacucuuccccucccucccacacuucccacccccaggcaagg

SEQ ID NO: 427780 - RNA, 64 nt, Human
gucagcauccaccccuugguugucaucgaggccgcccucccaguccugggugaagauauuuggg

SEQ ID NO: 427781 - RNA, 64 nt, Human
agaggcaauuuaauguuaaaugacgcaccauccucccucccacccuucucccagucaacuuuuu

SEQ ID NO: 427782 - RNA, 64 nt, Human
aaagaggcagaucuuugcugccagccacuucauccccucccagauguuggaccaacaccccucc

SEQ ID NO: 427783 - RNA, 64 nt, Human
aaaguuccugcgucacucucaguacucucacugccccucccaaacccuauagcuccuuacgcug

SEQ ID NO: 427784 - RNA, 64 nt, Human
ccgcggccccucgggccuguccacaucccucugccccucccagaccucuguccuuccaccaauc

SEQ ID NO: 427785 - RNA, 64 nt, Human
gggucucuggccaugucauagcccaugucuugugcccucccacacagaaaguguuagauaggga

SEQ ID NO: 427786 - RNA, 64 nt, Human
cauaguuucugcaaagggcaaguucauugugcuacccucccaauucccccauuauggaguaacc

SEQ ID NO: 427787 - RNA, 64 nt, Human
ccagagccacugcagcaggagucgggcccugccucccucccagcagggaaaccccgcccgcugc

SEQ ID NO: 427788 - RNA, 64 nt, Human
agcaagcacuguccucugggcaguuugcccccaucccucccagugcuggcuccaggcuccucgu

SEQ ID NO: 427789 - RNA, 64 nt, Human
agccaggcaggguuucugcccugccgaacacuuucccucccaccugccugcuccuggcgccuuc

SEQ ID NO: 427790 - RNA, 64 nt, Human
caacaagaagaaguugcaguauggauaucuuucacccucccaggaaacucuuucaaaccuaauc

SEQ ID NO: 427791 - RNA, 64 nt, Human
augugcagcucuccacuggaaaggaacucuccaccccucccauccugauaaaacaaacaagguu

SEQ ID NO: 427792 - RNA, 64 nt, Human
gaaugaauuagaaacaaauaacucuuacugucuucccucccagcuuuguuuauuuugugcuuuu

SEQ ID NO: 427793 - RNA, 64 nt, Human
cucuagaaaucucagcaugagcugcuauagaauacccucccagcaacaaaaccuaaucaguaag

SEQ ID NO: 427794 - RNA, 64 nt, Human
agaagguacaagcuaagaaauguaacaguaucaacccucccaguugcuuaauuauacccauagg

SEQ ID NO: 427795 - RNA, 64 nt, Human
uugcccagugagcccugcucuucucuccccagcccccucccaccgcugccucguagagugaccu

SEQ ID NO: 427796 - RNA, 64 nt, Human
cacaugcugcgaggucuccauccuccgggccugucccucccagaugggcugggccuuugggccc

SEQ ID NO: 427797 - RNA, 64 nt, Human
gcccccgccuccuccugccgccuccgccagcccucccucccacacugccccagcagggcuggcc

SEQ ID NO: 427798 - RNA, 64 nt, Human
gcacugagauuagucgucagaucucuccccgucucccucccaacuuauacgaccugauuuccuu

SEQ ID NO: 427799 - RNA, 64 nt, Human
ggggcuggaggagagggugggggacuggcuccgucccucccagccuucugcugcccuugcuuaa

SEQ ID NO: 427800 - RNA, 64 nt, Human
caugcccggccuguggacagccagcccccgccaucccucccacccccuaccaagcaugggggug

SEQ ID NO: 427801 - RNA, 64 nt, Human
gugguggagaggccuuagcuguccuggcuggugccccucccaggcuccuuuucacccugccccc

SEQ ID NO: 427802 - RNA, 64 nt, Human
augauuacuuguuuuauauuucauguuggguuuucccucccacuauuaaacagucuguuuccgu

SEQ ID NO: 427803 - RNA, 64 nt, Human
ucaagaggccacaagagugggaccccaggggcuccccucccaucuugagcucuuccugaauaaa

SEQ ID NO: 427804 - RNA, 64 nt, Human
caaggaggcccaggcgugcucccucuuauggagccccucccauggagcucucuucccgccgcac

SEQ ID NO: 427805 - RNA, 64 nt, Human
cucauaccuguaccagguccccggccagcugggccccucccaggcacugccaggaagccccagc

SEQ ID NO: 427806 - RNA, 64 nt, Human
cguccugacccuggacagugaaggcuucucccuccccucccaccugacuucaucuacgccucgg

SEQ ID NO: 427807 - RNA, 64 nt, Human
uagaaagaaguucagccgaacccacaccccaacucccucccaagaacuucggugccuaaagccu

SEQ ID NO: 427808 - RNA, 64 nt, Human
cccugugcccccaucaucuggaccccagagccagcccucccacuaccaccaccaccaccccggg

SEQ ID NO: 427809 - RNA, 64 nt, Human
caucaauuacaagcauugaauacuccauccccuucccucccagugaauggaaugagaaaagccu

SEQ ID NO: 427810 - RNA, 64 nt, Human
caggucuucucuucugccaacuaacgugcucgcgcccucccagcacguggagagcuucaauugu

SEQ ID NO: 427811 - RNA, 64 nt, Human
gcauucgaguuaccuggugagagaccguguugcccccucccacagcucucugcccugcgcguuc

SEQ ID NO: 427812 - RNA, 64 nt, Human
cucuccacccugaaaaguucccagaaagccccuucccucccaagcagugaauuaauaaccagca

SEQ ID NO: 427813 - RNA, 64 nt, Human
guacaaucgacauccuagccccacccagagguggcccucccaggcugguauuuaucugcaaggu

SEQ ID NO: 427814 - RNA, 64 nt, Human
aaauggacuccuuuuggguccccgaggugggguccccucccagcccugcauccuccgugcccua

SEQ ID NO: 427815 - RNA, 64 nt, Human
acaagugcccucgggucuguccuccccgucuggacccucccagccacuaucccuugcuggaagg

SEQ ID NO: 427816 - RNA, 64 nt, Human
ccaguccacacuccccguagcaucauuccauugccccucccauccaugcugggacccuccuggc

SEQ ID NO: 427817 - RNA, 64 nt, Human
ugggcccggagcagcaucuuccggugcuauccuccccucccaccccucacagcucaagccaagu

SEQ ID NO: 427818 - RNA, 64 nt, Human
gugggauguaaauaucgccuuccucucccuauaucccucccaugaaaaauggcuuccuggccgg

SEQ ID NO: 427819 - RNA, 64 nt, Human
gugccuagggggugugggguuccguucucccuuccccucccacugaaguuugugcuuaaaaaac

SEQ ID NO: 427820 - RNA, 64 nt, Human
cucugaggucaggucugaggccaguauccuccagcccucccaaugccaacccccaccccguuuc

SEQ ID NO: 427821 - RNA, 64 nt, Human
gucgccccuuaccccccaccccaggccacugggccccucccacaccaccuggggagcugagaag

SEQ ID NO: 427822 - RNA, 64 nt, Human
ggcacuggccugugaccuucgcaggggucccggccccucccaccacucuagccuuucucaggcu

SEQ ID NO: 427823 - RNA, 64 nt, Human
cccugauguugcaugagaccugguaacagugucucccucccagcuccuugccaaagccucuguu

SEQ ID NO: 427824 - RNA, 64 nt, Human
ccccaaccccuguauccccaccccguacucccaccccucccacaaccccuguaccucccacccc

SEQ ID NO: 427825 - RNA, 64 nt, Human
aaugaccaauugcuuucaauucuugaccagcacucccucccaaccagagaauuacugguuugau

SEQ ID NO: 427826 - RNA, 64 nt, Human
uucagaaccauuuuaguguuuuccuauucccuaccccucccacuacuuucaaugaugaaauacc

SEQ ID NO: 427827 - RNA, 64 nt, Human
uccagcacuucucucuucaagcggcgacccccuacccucccagcgaguugcgcugggagacgcu

SEQ ID NO: 427828 - RNA, 64 nt, Human
uggggacagagagcagagcacacucgggccucaucccucccaagaugccagugagccacgucca

SEQ ID NO: 427829 - RNA, 64 nt, Human
gccuugugggugugagcagcacccauccaccguccccucccagggagcaagggcagggacaggg

SEQ ID NO: 427830 - RNA, 64 nt, Human
aggcugagcugaaagaggccaaacaggcccuccucccucccagcuccaccccgcaagcaccauc

SEQ ID NO: 427831 - RNA, 64 nt, Human
gaacagagggcaccaggcaucacacgacaucuuucccucccaucucugccaucugucugucugg

SEQ ID NO: 427832 - RNA, 64 nt, Human
guuguacccauuaaguuauuucucaucccucacccccucccaccuugucacccuucugagucuc

SEQ ID NO: 427833 - RNA, 64 nt, Human
acccgaggcucagccugagggguaugugcccaggcccucccacuucccgaguugucugccucuc

SEQ ID NO: 427834 - RNA, 64 nt, Human
aggagcacccucccugcccgucuugucccucugccccucccaccugcacaugucacacugacca

SEQ ID NO: 427835 - RNA, 64 nt, Human
ugugugaaauuccagagcuuugggggagaauccacccucccaucaucugcuucccccaaggccu

SEQ ID NO: 427836 - RNA, 64 nt, Human
ccauccagcuucccuccccuuccuccaaaacccucccucccaccuccccacacccauugaguca

SEQ ID NO: 427837 - RNA, 64 nt, Human
ugccacacugauggcucaagacaaggcuggcaaacccucccagaaacaucucuggcccagaaag

SEQ ID NO: 427838 - RNA, 64 nt, Human
gaaguggggggcugcccacuccacuccucccauccccucccagccuccuccuccggcaggaacu

SEQ ID NO: 427839 - RNA, 64 nt, Human
uucuuguuucaucccugcuucuggacuugggguacccucccaauugccacauccuaucuggucc

SEQ ID NO: 427840 - RNA, 64 nt, Human
ggguuuaguccguggacauuucagagggagaucccccucccauuuaacuguccucacaggcccu

SEQ ID NO: 427841 - RNA, 64 nt, Human
gcaagcauuccccuuuaagagcuuccacugcacccccucccaagggacacagcgguaggaaugg

SEQ ID NO: 427842 - RNA, 64 nt, Human
ucuuucuugaggguugguccuguccccaccuccacccucccacccccuggaagaggaagggccc

SEQ ID NO: 427843 - RNA, 64 nt, Human
gguggaagagcucaagggacaaggacacgcgccccccucccagaggcgucccgcaccugucuga

SEQ ID NO: 427844 - RNA, 64 nt, Human
uucacuuugguuuugcuaacacugcucucugcugcccucccauccucccuguauccauucaugc

SEQ ID NO: 427845 - RNA, 64 nt, Human
gggcuggacuugccccuccgguagccuuccuuggcccucccagcgaggggcacccuuccucugu

SEQ ID NO: 427846 - RNA, 64 nt, Human
gauccuugggcaaaaguuccuaaccccuacuuuacccucccacccucacuuuuaaauccaccau

SEQ ID NO: 427847 - RNA, 64 nt, Human
acuggcccccaugauucaauuaccucccccgggucccucccacaacacaugggaauucugagag

SEQ ID NO: 427848 - RNA, 64 nt, Human
cuggccccccugauucgaugaccucccccugggucccucccacaacaugugggaauuccagaag

SEQ ID NO: 427849 - RNA, 64 nt, Human
cauuuccugaaugagccaaugacccugagaaggucccucccaucugccaguucccugccauuga

SEQ ID NO: 427850 - RNA, 64 nt, Human
augccugaacaacuuuuccacuuuccacgugcuucccucccaccuuugguuuggcaacagguau

SEQ ID NO: 427851 - RNA, 64 nt, Human
gagcauuagguccuccacggggcugugucaaaugcccucccacauugugucaagucugcccaug

SEQ ID NO: 427852 - RNA, 64 nt, Human
agggagcugaggagcccuuacccucccaccacuccccucccaagacccagccgccgccguugag

SEQ ID NO: 427853 - RNA, 64 nt, Human
cugggaguccagggagggagcugaggagcccuuacccucccaccacuccccucccaagacccag

SEQ ID NO: 427854 - RNA, 64 nt, Human
auucacaguuuaauagagacuuccugccuuuauucccucccagggagaggcugaaggaauggaa

SEQ ID NO: 427855 - RNA, 64 nt, Human
gcagcaucagugggacaagauggacacugggccacccucccaggcaccagacacagggcacggu

SEQ ID NO: 427856 - RNA, 64 nt, Human
cuuccccaagcugccagccaggaggugauaaccacccucccagaguuucucucggcucuuuuuu

SEQ ID NO: 427857 - RNA, 64 nt, Human
uuuaaaacuugaggguaaaaauguggaaaacaaacccucccaucccuuguagauuauaaauaaa

SEQ ID NO: 427858 - RNA, 64 nt, Human
cuccaucugacugcgccgccugcccuccugcccacccucccacccacccgaccagcagagcuuu

SEQ ID NO: 427859 - RNA, 64 nt, Human
ggaaggaaguccacuucuucugcaggaucuucuucccucccaggucucccuggggagguagagg

SEQ ID NO: 427860 - RNA, 64 nt, Human
cuccugggacuuuggagcuuaccagagaugcagucccucccaggaaccuguuggagaggcagga

SEQ ID NO: 427861 - RNA, 64 nt, Human
ccccuuagcacaccugcucgucccauuuagcuuacccucccaguuggccagaaucugaggggag

SEQ ID NO: 427862 - RNA, 64 nt, Human
cagcuggggggcaccggcucaggagagggccuuccccucccagcccugagggguggacuaggcc

SEQ ID NO: 427863 - RNA, 64 nt, Human
agugacagugggcccagccaccuauuuuaacaagcccucccagugauugugauacauacuaaag

SEQ ID NO: 427864 - RNA, 64 nt, Human
ucuccaggauccucaugugccucuccucaaagcucccucccaucuguaggagauuagugaggca

SEQ ID NO: 427865 - RNA, 64 nt, Human
ucucccgcuguguucaggaggccacauauacagccccucccagccacaccugccccugcucugg

SEQ ID NO: 427866 - RNA, 64 nt, Human
aggugagcucugacccuugggccugggccucugccccucccaacccagcccucgucucccucga

SEQ ID NO: 427867 - RNA, 64 nt, Human
guuucuuguuucugucucuugcuuucgggcuccucccucccaccacuccccaacuuccccuagc

SEQ ID NO: 427868 - RNA, 64 nt, Human
aggaaaucaucaauaacucagugggcugacccaucccucccaggcgcuggggaccaaccuagca

SEQ ID NO: 427869 - RNA, 64 nt, Human
ucccucgcgcccaaaagauugaacuuaaaugccccccucccaacagcgcuuuaaaagcgaccuc

SEQ ID NO: 427870 - RNA, 64 nt, Human
cccuccagacugggucucagagccgugccacccacccucccacacagccggccacagggagaac

SEQ ID NO: 427871 - RNA, 64 nt, Human
aacaugacgcagcucaauaagggugagggucacucccucccagaagccccgucuggacgagccu

SEQ ID NO: 427872 - RNA, 64 nt, Human
aagaauucaaaagugagguagucauccagguucccccucccacaauauuuuuguaucauaaaau

SEQ ID NO: 427873 - RNA, 64 nt, Human
ucuaaucuccuccugcugugcccgccaguccuugcccucccaccaggucucugagcucaguguu

SEQ ID NO: 427874 - RNA, 64 nt, Human
ucuggggcagggcgcucccuggccgcagcagaugcccucccaggaguggaggggcuggagaggg

SEQ ID NO: 427875 - RNA, 64 nt, Human
cuguacauuugugcuccauuuuuucuucccuuuucccucccaguuuucuccaaagacucuucug

SEQ ID NO: 427876 - RNA, 64 nt, Human
accucccccuucuuugaucccagcaucucagucccccucccaacccuccauauggcucucaaug

SEQ ID NO: 427877 - RNA, 64 nt, Human
guuaaaaugaggccuccaugcaaaacacauacuucccucccauuuauuuaacuuuuuuuuucuc

SEQ ID NO: 427878 - RNA, 64 nt, Human
cuccugcucuaccuacucccuuuccccuuucccacccucccagcucaccuccccauggagcuga

SEQ ID NO: 427879 - RNA, 64 nt, Human
uggccugggcacccuccugggagcaggccuuccucccucccacccccaauguccuguugguagg

SEQ ID NO: 427880 - RNA, 64 nt, Human
gcugcccacccuaccugcccugccugccugcugccccucccagccugccaagaaaacgguaggg

SEQ ID NO: 427881 - RNA, 64 nt, Human
gccugcucgugccuucauucugcagcggcauggucccucccauucuggcuccaccugcagccuc

SEQ ID NO: 427882 - RNA, 64 nt, Human
cugcccucccucagccgucagccaucagccauggcccucccagugccuccuagccccuucuucc

SEQ ID NO: 427883 - RNA, 64 nt, Human
uaguaggaagugcauucuccauccucauccucugcccucccaggaagucagugauugucuuuuu

SEQ ID NO: 427884 - RNA, 64 nt, Human
uaccugcgcuguuugugccgccgcugccucugggcccucccagcacacgcauggucucuucacc

SEQ ID NO: 427885 - RNA, 64 nt, Human
gggcccugccccgcaucccggccuuaugcacugccccucccacccggccccgcccaggcacggc

SEQ ID NO: 427886 - RNA, 64 nt, Human
ccuuucuuuggaacgagggcucuucugucggugucccucccacccccauguaugcugcacuggg

SEQ ID NO: 427887 - RNA, 64 nt, Human
ggggugaggcagugggucccacuuccccuccuaccccucccagcugacaguccucuccaccuag

SEQ ID NO: 427888 - RNA, 64 nt, Human
ugcauccagacacugugcuggguguguugcauggcccucccaaccaauucaguauuuuucuccc

SEQ ID NO: 427889 - RNA, 64 nt, Human
gguugugggggacuggggagcugggcucuaccaucccucccauuaguagcuuuauccagccccg

SEQ ID NO: 427890 - RNA, 64 nt, Human
uccccacuggcccugagcacgacagcccuucuuacccucccaggaaugccgugaaaggagacaa

SEQ ID NO: 427891 - RNA, 64 nt, Human
guugcucuacuuuguaggaagucuuugcauauggcccucccaacuuuaaagucauaccagagug

SEQ ID NO: 427892 - RNA, 64 nt, Human
ucuacuucugcccuugccaacggagagcgccugccccucccagaacacacuccaucagcuuagg

SEQ ID NO: 427893 - RNA, 64 nt, Human
gagccaccucugccugugaucgucugaugaggcucccucccaaccugauccaaaagccagucuc

SEQ ID NO: 427894 - RNA, 64 nt, Human
guucuuuuuaucuuaccgaccuaacuucucuuuucccucccaacuuggccucccacacguucca

SEQ ID NO: 427895 - RNA, 64 nt, Human
ggaggaggcucuccacuguccacccuaacacauacccucccacccaccuuccagacccccuugg

SEQ ID NO: 427896 - RNA, 64 nt, Human
uaaacugcgggcgaagagaucuacccgucucccucccucccacaguuaccauuggccuugucau

SEQ ID NO: 427897 - RNA, 64 nt, Human
ucccaaaugccaccggaaccccagcccuuagcuccccucccaggccucugugggcccuugucgg

SEQ ID NO: 427898 - RNA, 64 nt, Human
ucaccccgggaccgugggccgaggugacugcagacccucccagggaggcugugcacagacuguc

SEQ ID NO: 427899 - RNA, 64 nt, Human
cagcaccacuuccgagguccccagacccccugagcccucccagggacccuccacgaccagcucu

SEQ ID NO: 427900 - RNA, 64 nt, Human
cgguuccuggcgguccaggacggggcgggggcuccccucccaucucgugcugggaggucucagc

SEQ ID NO: 427901 - RNA, 64 nt, Human
ccuucagucgcaagcugggugccaggccuggggccccucccaguucccccgccccaggaaacac

SEQ ID NO: 427902 - RNA, 64 nt, Human
gagucccagagcaggaggccccuggcccagcggccccucccacacacacccacacacucgcccg

SEQ ID NO: 427903 - RNA, 64 nt, Human
cugagggcagagcuccuggccgguccugagcccucccucccaggcacccagcacuuuaagccug

SEQ ID NO: 427904 - RNA, 64 nt, Human
guuggaccccuccccaagaggccaacccagugcccccucccauuuuccgcuacugaccaguuca

SEQ ID NO: 427905 - RNA, 64 nt, Human
cccccauugucuuuggugccugggcuuccagagucccucccaucaggacuaccagcuugcucag

SEQ ID NO: 427906 - RNA, 64 nt, Human
caaguccguauguaaaucagaucuccccucucaccccucccacccauuaaccuccucccaaaaa

SEQ ID NO: 427907 - RNA, 64 nt, Human
cagagccacccuguguugacaccucgccccugcucccucccaucccuucccccuuuacucauag

SEQ ID NO: 427908 - RNA, 64 nt, Human
cauguggggccugggugggcaggcaggaccugggcccucccacccaucagagcccacucaggac

SEQ ID NO: 427909 - RNA, 64 nt, Human
ccucccccuucauaaaggccucccuugucaccuucccucccaccccgucucagcccugugcucc

SEQ ID NO: 427910 - RNA, 64 nt, Human
augagggcaaugaguuagggcuccuuuuccccuucccucccaccagauugcucucccaccuuuc

SEQ ID NO: 427911 - RNA, 64 nt, Human
aggcucagcccuagggaaaggcugcucuugcucucccucccagggcuugaggcucccuauacuu

SEQ ID NO: 427912 - RNA, 64 nt, Human
uccgcaggccuccaggaguauggguccugcccugcccucccaggaguccagccaggggcugccu

SEQ ID NO: 427913 - RNA, 64 nt, Human
gucugcccagccaggcuccuguggugcugcugggcccucccacuccaucuggcacuggccugga

SEQ ID NO: 427914 - RNA, 64 nt, Human
ggccccugucuccccucccccacguuggggacgccccucccagagcccaggucaccuccgggcu

SEQ ID NO: 427915 - RNA, 64 nt, Human
ggggcagugugaggaccucccugucucccggcuccccucccaggggagccagcugcuugaccua

SEQ ID NO: 427916 - RNA, 64 nt, Human
ccgccuccggaaugcacaggcgagucccugcccucccucccaggccgcacagguccugccaagc

SEQ ID NO: 427917 - RNA, 64 nt, Human
cagagacgucccugccccuccaggaccugacagccccucccauccuggccacccgccuggaagu

SEQ ID NO: 427918 - RNA, 64 nt, Human
cugccuucugcugcagcccaagcagggagugucccccucccagaagcauaucccagaugagugg

SEQ ID NO: 427919 - RNA, 64 nt, Human
ggccccccagcucaggggcagcucauagaguccccccucccaccuccagucccccuauccuugg

SEQ ID NO: 427920 - RNA, 64 nt, Human
cugacauagcucuacaccuaaauaagggacugaacccucccaacugugggagcuccuuaaaccc

SEQ ID NO: 427921 - RNA, 64 nt, Human
cuuuacuuuacuuugucccagguuggagucccuacccucccaccucccaccugauaugcagugc

SEQ ID NO: 427922 - RNA, 64 nt, Human
guuucccagcugcuuccugcucagcugggccacccccucccacccugggguuggggaggagcag

SEQ ID NO: 427923 - RNA, 64 nt, Human
gcgaguuggaggggugggcuucucuagcccugcccccucccaggagcccagccccucuggccag

SEQ ID NO: 427924 - RNA, 64 nt, Human
gcuuuacagucaauaguguugcuuuaaauugugccccucccaacaugcuugauguuuggccuga

SEQ ID NO: 427925 - RNA, 64 nt, Human
accaauugucagaaggauguaugaugacccccuccccucccauccuucaccuccuaagcagucc

SEQ ID NO: 427926 - RNA, 64 nt, Human
uugugugacagaaguagcaaaaucugguccuccccccucccaguguagcuguggcucagaguuu

SEQ ID NO: 427927 - RNA, 64 nt, Human
aaacuguacaagacacuacgggaacaguuugccucccucccagccucaaccacaauucuuccau

SEQ ID NO: 427928 - RNA, 64 nt, Human
caucacggagaccuuuguuccugugggaaaauaucccucccaccugcaacagcugccccugcug

SEQ ID NO: 427929 - RNA, 64 nt, Human
gacagagcagaggaaggcaggggauuuaggaucgcccucccauccucucacccacuggaccccg

SEQ ID NO: 427930 - RNA, 64 nt, Human
ccacaucaguauuggaguuuuguucuuuauugcucccucccagacacucccuguggcugcccuu

SEQ ID NO: 427931 - RNA, 64 nt, Human
ugggauaggacaggcugggaacagguaaucaggccccucccagggcuucuuuccccucuggagu

SEQ ID NO: 427932 - RNA, 64 nt, Human
gcaucuguagugccuugugggguauccaggaacacccucccagcaggggaugggaacccugucc

SEQ ID NO: 427933 - RNA, 64 nt, Human
ccucccuccuggccucgaccccuaagggcuucgccccucccaggggccuguaacuaagucgggu

SEQ ID NO: 427934 - RNA, 64 nt, Human
ggccacaagcucagagcccacaucaacacugccccccucccagcaccccacagcccucacaucc

SEQ ID NO: 427935 - RNA, 64 nt, Human
aacagauaaacaaacaagcccccugcccuccucucccucccacuguuaaggacccuuuuaagca

SEQ ID NO: 427936 - RNA, 64 nt, Human
acuuguuuuauggaaguuuugauugauuuacuugcccucccaccuucuuuuuaauucaaugaaa

SEQ ID NO: 427937 - RNA, 64 nt, Human
uuucagccccucagucaugcugccuucugcugcucccucccagcaggauucacccucucauucc

SEQ ID NO: 427938 - RNA, 64 nt, Human
uuucuuuaauuaauuuaacaagugcugcaguuugcccucccauucccaucuaucccccaagucc

SEQ ID NO: 427939 - RNA, 64 nt, Human
gacaggcagggagggcuuggggcugcaccuccuacccucccaccagaacgcaccccacugggag

SEQ ID NO: 427940 - RNA, 64 nt, Human
ccaggggcaccuaugagauggccaugcucaaccccccucccagacaggcccucccugucuccag

SEQ ID NO: 427941 - RNA, 64 nt, Human
cuccugccuugaagccacgcgcuccacgccgcggcccucccauuuucugcguccucagcgggcu

SEQ ID NO: 427942 - RNA, 64 nt, Human
uccaggaagccuuccccuaccccuugucgccccucccucccagagcaccugcugucuggguggc

SEQ ID NO: 427943 - RNA, 64 nt, Human
uacggucccugcuuagccagcuucuguguguccgcccucccagcuccagcccugcaggccgucu

SEQ ID NO: 427944 - RNA, 64 nt, Human
agcuggcccaguguaaaaaugucccaaguguagccccucccaccgcagagccuguuucuaacgu

SEQ ID NO: 427945 - RNA, 64 nt, Human
gguuauggggaagcaagggccaaacauucuuuaucccucccaccccagggaaaacauuuggaaa

SEQ ID NO: 427946 - RNA, 64 nt, Human
gacccuguugucaccccagcugaauuucuuaugacccucccaaaccaaagcucagaugggguca

SEQ ID NO: 427947 - RNA, 64 nt, Human
acacccuccagaaaggagagacgcaaucuccccucccucccaucccccaccuucgcuggaacag

SEQ ID NO: 427948 - RNA, 64 nt, Human
cgggccucacgacggugcuaccuaagaaagucuucccucccaccccccgcuagccuggucagug

SEQ ID NO: 427949 - RNA, 64 nt, Human
gccuucacagccagcugugaggucaguccacguacccucccagaaauagguuuacgaugccagu

SEQ ID NO: 427950 - RNA, 64 nt, Human
caccccacacaacgcagacggugcgccugugcagcccucccagguggaguacacggcagacugu

SEQ ID NO: 427951 - RNA, 64 nt, Human
gcgggacugaagagcuggaagaaagcagucaguacccucccaacggccccccucgaaggucucc

SEQ ID NO: 427952 - RNA, 64 nt, Human
ucaaaguuugggcugauguaagacuagaggcuggcccucccagauaacagagaaaagggagccc

SEQ ID NO: 427953 - RNA, 64 nt, Human
gaauacugagcugauggugucauccagcagccuccccucccaagcaaagcuucuaaaacugggg

SEQ ID NO: 427954 - RNA, 64 nt, Human
caacccuccucuaaccugcugugucacccgcuuucccucccagcccccacauccuuaccauuuu

SEQ ID NO: 427955 - RNA, 64 nt, Human
ggcauggagaaaggugacccugaucccaaaccugcccucccaagucucugguguuggggagggc

SEQ ID NO: 427956 - RNA, 64 nt, Human
uccuuagugaugcucugaggcguggccacgaucucccucccaggugguaucgcccaccugaaaa

SEQ ID NO: 427957 - RNA, 64 nt, Human
guagaggaaguucuuucuacuuccacaggugcagcccucccaauccagucuacccucaaaggag

SEQ ID NO: 427958 - RNA, 64 nt, Human
gaacgaugguugcaucucucggacacaguguacccccucccaagcccucccugagccguucucc

SEQ ID NO: 427959 - RNA, 64 nt, Human
uucauauuuuaauuuaaucucugucaauggccaucccucccacaaaaaaacguggguuaagaga

SEQ ID NO: 427960 - RNA, 64 nt, Human
ccgaacacccgcaucccuuccuccucccaugggucccucccaguaggcaguagucagaacugga

SEQ ID NO: 427961 - RNA, 64 nt, Human
agugcucagcuacuucuccugcacuuugaaagaccccucccacuccuggccucacauuucucug

SEQ ID NO: 427962 - RNA, 64 nt, Human
cugacguccugcccaagugaacagcugcggcagccccucccagccuaccccuccugcgcugccc

SEQ ID NO: 427963 - RNA, 64 nt, Human
ugauaccaccccucacccgcagagucacugcauucccucccagccuuugaggccgggugcagug

SEQ ID NO: 427964 - RNA, 64 nt, Human
cccgcccaagagccaagagagaugucaucuuauccccucccaucugccuuggacauggcaauau

SEQ ID NO: 427965 - RNA, 64 nt, Human
uccccgauccaaguuccuagaccucauggcuguccccucccaccagucaccuccacugcacaac

SEQ ID NO: 427966 - RNA, 64 nt, Human
ccgucucacccccgagcccccuuggagacacccccccucccaaaagccauguccauccagcccu

SEQ ID NO: 427967 - RNA, 64 nt, Human
uccucuucuccccguacugaccucaacccugaaccccucccauucaacuccccaccuccagccg

SEQ ID NO: 427968 - RNA, 64 nt, Human
ugccauuuuauucacaugcucccauguucucccucccucccauuguagccuugcugcccagggg

SEQ ID NO: 427969 - RNA, 64 nt, Human
cuuuucuucccaacuucuacuuuuuggacuuucccccucccauucccaguguucaaaaucucag

SEQ ID NO: 427970 - RNA, 64 nt, Human
auaaaaagacaacccacccccugcccuuuugcuucccucccaucagucugguugacaggaagaa

SEQ ID NO: 427971 - RNA, 64 nt, Human
aucaggcuguguguuaauucugggccagucuacacccucccacgggguggaaauggccuggagg

SEQ ID NO: 427972 - RNA, 64 nt, Human
accccucccccauuauucuuucuguccagccccucccucccacuggagcagcuccagagccauu

SEQ ID NO: 427973 - RNA, 64 nt, Human
gcuaaagaguccggggggaaccaagagccugggucccucccacuacuaucuugggagggagaag

SEQ ID NO: 427974 - RNA, 64 nt, Human
cuacagagauuacuuugcugccuuaaugacauuccccucccaccucuccuuuugaggcuucucc

SEQ ID NO: 427975 - RNA, 64 nt, Human
cccagacucucuucuagggcuucccaccaucagccccucccacuugagacuggucuuugggagg

SEQ ID NO: 427976 - RNA, 64 nt, Human
uuccaaaggcugggaaaaacuaagcugucccagccccucccauuucuugggcagggcucuuuuc

SEQ ID NO: 427977 - RNA, 64 nt, Human
agcaguuuuaaaggugaaaucagagcagcacuaccccucccaccuccaaagcaucuguaaaauc

SEQ ID NO: 427978 - RNA, 64 nt, Human
ugugugugugugugugugugugugugagagagagcccucccacugccagcucagguuguucaca

SEQ ID NO: 427979 - RNA, 64 nt, Human
cauggcaggcccacagcacucugaacaggcacagcccucccaucuucccaaugaggaaacggau

SEQ ID NO: 427980 - RNA, 64 nt, Human
uguuuucauugccuuuuauggccuugacgacuuccccucccaccagcugagaauguauggaggu

SEQ ID NO: 427981 - RNA, 64 nt, Human
cugcuccccgacccccagcccggacaccucauuccccucccacuacagggaucaagugaccugg

SEQ ID NO: 427982 - RNA, 64 nt, Human
aucaggaggacacaggcugcagccuggcacccaccccucccaucuccaccccacauggaagacu

SEQ ID NO: 427983 - RNA, 64 nt, Human
uuaaguggauagauagaaugguuuuccuguuugucccucccauguuuaaaaaucuauccaaggu

SEQ ID NO: 427984 - RNA, 64 nt, Human
cuccccauccacuggccacccucacucccagguccccucccauuugguagcagcuccaacaggg

SEQ ID NO: 427985 - RNA, 64 nt, Human
ccuggagugcagaccacaggggaagcuaucuuugcccucccaacucgucugcagugcuuagccu

SEQ ID NO: 427986 - RNA, 64 nt, Human
ugguagacagguauggggagggagaaugcuuuuccccucccaguaauaaaaaaaaaaaaaaaaa

SEQ ID NO: 427987 - RNA, 64 nt, Human
aaagcgaacuguucacaaaaugaucccaucaaggcccucccauaauuaacacucaaaacuauuu

SEQ ID NO: 427988 - RNA, 64 nt, Human
uacacugcaugauucccucacuguauauccucaacccucccauaaugcaaggccuuguucauug

SEQ ID NO: 427989 - RNA, 64 nt, Human
uggacucugcuagacuccucaggagagaccccuccccucccacccacagccauagaccuacaga

SEQ ID NO: 427990 - RNA, 64 nt, Human
uuuccugugagucgccaccguucacucagucuugcccucccaugcuuuggagccagucuggugg

SEQ ID NO: 427991 - RNA, 64 nt, Human
agccucuugucccaccuuuguccccuggcugcugcccucccauucucccccuccaguaguagcu

SEQ ID NO: 427992 - RNA, 64 nt, Human
ccgugagggccaaugcaccuccccccaccccccacccucccauguccacagugggucguguguu

SEQ ID NO: 427993 - RNA, 64 nt, Human
gaaaauaaaaccaagacuggaagguccccucuaccccucccaggcccagagcuagcugacugug

SEQ ID NO: 427994 - RNA, 64 nt, Human
cuucagugaggcgugcuagaccugagcaguucuacccucccaaggcaccaguacucuaccaugg

SEQ ID NO: 427995 - RNA, 64 nt, Human
aaaaauaaguccagguauuuuuuauuaagccccccccucccauuucuguacguuuguucagucu

SEQ ID NO: 427996 - RNA, 64 nt, Human
cuuugcacggaggcuugccccaucacccucugagcccucccaacacagcacacuagucagccca

SEQ ID NO: 427997 - RNA, 64 nt, Human
agcauguuaggagcgcuggaacguuuauucucuucccucccaauuauccacucuaauggagcag

SEQ ID NO: 427998 - RNA, 64 nt, Human
uacauguaaaugcccacagcccagcauuggguuucccucccaaggccccagcaccaaccucuga

SEQ ID NO: 427999 - RNA, 64 nt, Human
auagcagaagggaggccaagcaccaguccaucaccccucccaggccagccucuguaaguuggcc

SEQ ID NO: 428000 - RNA, 50 nt, Human
ucgaccccacgaaaccauagcccucccagggcugcucaucuguuccaagc

SEQ ID NO: 428001 - RNA, 64 nt, Human
aggaagauuuacggcucaagacaggccccagauccccucccaguggcacccaugccaccugcuu

SEQ ID NO: 428002 - RNA, 64 nt, Human
uuacccuggguuuuauacaguucucuuccuucuccccucccaccuuucccuggcuuuuugccuc

SEQ ID NO: 428003 - RNA, 64 nt, Human
ugccucuucaggaaccggagcucauuacugccuucccucccagggaggccccuucagagaggag

SEQ ID NO: 428004 - RNA, 64 nt, Human
gacacacaaaucuaagucagaccauugcuccacgcccucccaccuuuucuuuagaccucaacuu

SEQ ID NO: 428005 - RNA, 64 nt, Human
guagugugacccugccugaaaaaagggucucuuacccucccagcccuggcucaacucugaagaa

SEQ ID NO: 428006 - RNA, 64 nt, Human
aguauuuaucacaggacuuuaacaccauauauuucccucccaguuuuucuccccuuuugguuua

SEQ ID NO: 428007 - RNA, 64 nt, Human
uaugggaugcuuaccaaaggauggcccucauccacccucccaagcugugcgagcaugcaaggcc

SEQ ID NO: 428008 - RNA, 64 nt, Human
uaauguaguauuggcuccaccugcucacauuucucccucccauacucauuccuucacucaucca

SEQ ID NO: 428009 - RNA, 64 nt, Human
gaaggagaagcccagccagccucuacccaucccucccucccaauuaggcugcacuggggccgaa

SEQ ID NO: 428010 - RNA, 64 nt, Human
agagcagaugggacugucaaaguugugcugcccucccucccacaaacaaaugaauccagcgugg

SEQ ID NO: 428011 - RNA, 64 nt, Human
gcaagggggacuggagccgccuccacgcugugcucccucccaacaacggccgagccugcaccga

SEQ ID NO: 428012 - RNA, 64 nt, Human
uuuauugagcacaagauguauuucagcccaugcccccucccaaaaagaaauugauaaguaaaag

SEQ ID NO: 428013 - RNA, 64 nt, Human
auucuucgcaguguggccaccacaccgcccugagcccucccacggcccaucgucccgggugggc

SEQ ID NO: 428014 - RNA, 64 nt, Human
ccacaccugccucucccgucgucucuucugggcacccucccacccggcugcauacccgggcagg

SEQ ID NO: 428015 - RNA, 64 nt, Human
gcaaagaucuucaugcccaguuccaaagugaggucccucccaaaguuguuuucgugugaggcag

SEQ ID NO: 428016 - RNA, 64 nt, Human
ugggcuucuguaagcagacaggcagagggccugccccucccaccagccaagggugccaggccua

SEQ ID NO: 428017 - RNA, 64 nt, Human
agauagcuucccacuggaaaguaaacaaaaccaucccucccaaccucaaagcuaggccacacuc

SEQ ID NO: 428018 - RNA, 64 nt, Human
cgaacuccugaccucaggugauccacccaccuugcccucccaaagugcugggauuacaggcgua

SEQ ID NO: 428019 - RNA, 64 nt, Human
uggagggaccuacccucugggaaagcccuugugucccucccagaguccuucagguaggcccucg

SEQ ID NO: 428020 - RNA, 64 nt, Human
gguuaucugggcauagaugcaggugagcccauggcccucccaguaccuccugucucuggccugu

SEQ ID NO: 428021 - RNA, 64 nt, Human
ccucaaaccuccucuucugacgugccuuuugcaccccucccauuaggacaaucaguccccuccc

SEQ ID NO: 428022 - RNA, 64 nt, Human
gccuuuugcaccccucccauuaggacaaucaguccccucccaucugggaguccccuuuucuuuu

SEQ ID NO: 428023 - RNA, 64 nt, Human
gaaagucugagcaguguuuuaccguccccagccccccucccacauggucacauguucacuugcu

SEQ ID NO: 428024 - RNA, 64 nt, Human
caaaaugaaaaaccagaaggccauuugguguccccccucccagguguccccuuguagcauaugc

SEQ ID NO: 428025 - RNA, 64 nt, Human
agagggcggagagagggggcaggcucggcaccggcccucccagcccggccagccugagcuugcu

SEQ ID NO: 428026 - RNA, 64 nt, Human
cuccaucccagugccccgaugaccaucuggucagcccucccaaccucccuuccagggggcuuac

SEQ ID NO: 428027 - RNA, 64 nt, Human
uccaccuuaggccucagcuggagggcugcagagccccucccaauauugggagaauauugaccca

SEQ ID NO: 428028 - RNA, 64 nt, Human
cccaugccccaccuuugcuuccucccucucuccucccucccagacacccuuaugcucuugguuu

SEQ ID NO: 428029 - RNA, 64 nt, Human
ugcuguucugccuugccugugagcuaugucacuccccucccacuccugaccauauuccagacac

SEQ ID NO: 428030 - RNA, 64 nt, Human
cugcugaggggcgucaggccaggcuugacccauucccucccagccuccgcucugccucccuucc

SEQ ID NO: 428031 - RNA, 64 nt, Human
acucaccuuggaggagugggcccuggaguccugucccucccagaagcccccagggugggauuuc

SEQ ID NO: 428032 - RNA, 64 nt, Human
cauccguuagcgcgagguagcagugucgccucgccccucccacugcgggcucacggggagcugg

SEQ ID NO: 428033 - RNA, 64 nt, Human
uuccugaucuccaucuuucugcccugcauaccagcccucccagcagccacaagcuugcccgccc

SEQ ID NO: 428034 - RNA, 64 nt, Human
gcucguuggcuccaaaaccagggagcagaccaugcccucccaacccuggaguugucagggaggg

SEQ ID NO: 428035 - RNA, 64 nt, Human
gggucuuagucacggcggcaggggcuuucuggcccccucccacucccguuuccaggccaugacc

SEQ ID NO: 428036 - RNA, 64 nt, Human
ccucggaacacccucuccugguggcaggccacuucccucccagugccagucuccauccacccca

SEQ ID NO: 428037 - RNA, 64 nt, Human
ucuucucuuuccccuccaaccaguucaaucucaucccucccagcagcuccccuuccaccccccg

SEQ ID NO: 428038 - RNA, 64 nt, Human
cugcucugccccugcccguccccacccagucuugcccucccauccucucaucuauucccccgcu

SEQ ID NO: 428039 - RNA, 64 nt, Human
uucccaggcugcccccaacacuccaggcccugcccccucccacucuugaagaggaggccgccuc

SEQ ID NO: 428040 - RNA, 64 nt, Human
ccccaagaccuuuuguacauuuuuacaggggugccccucccaacaguucccuuccugguuaauu

SEQ ID NO: 428041 - RNA, 64 nt, Human
cagaguguuuugccuucauguuagcuuccggcuccccucccaggcugcagacucugaccugugg

SEQ ID NO: 428042 - RNA, 64 nt, Human
ggguggggguggaagcagccgcaggagcaagggccccucccacauacacaggaggaguauuuca

SEQ ID NO: 428043 - RNA, 64 nt, Human
ugccugagccagcagugacaaccccccucggguccccucccacgccguggaagcuuuguucuuu

SEQ ID NO: 428044 - RNA, 60 nt, Human
agggcuuuggacaggaguaaccgaggccgccccucccacgccccccagcgcacauguagu

SEQ ID NO: 428045 - RNA, 64 nt, Human
gugccuuccucugucucuuucucuuuccuuugcucccucccauguuucugguggacuaaauugu

SEQ ID NO: 428046 - RNA, 64 nt, Human
cagcaccugcucugaugcaccugugcaccccuggcccucccagccaccugggaguccgaagcuu

SEQ ID NO: 428047 - RNA, 64 nt, Human
agggaaagccccuccccgaccuucggucccuccgcccucccagccccgccccgggcaggggggc

SEQ ID NO: 428048 - RNA, 64 nt, Human
ggcaaagccagaggucacaguggccugaucugggcccucccaaagcugagggcugcagcccgug

SEQ ID NO: 428049 - RNA, 64 nt, Human
acauaauggagcucugagugcugguggacagugccccucccaccuuccuucuuccccacaacag

SEQ ID NO: 428050 - RNA, 64 nt, Human
caccuggcucugaagagccacucuuaccucgguccccucccaguggucccaccuucuccacccu

SEQ ID NO: 428051 - RNA, 64 nt, Human
augacucaggguuguauaguaucuguuaccccuucccucccagaguaaccauaacucguuccgu

SEQ ID NO: 428052 - RNA, 64 nt, Human
agcugcucugguugaagcugacaagugcgagguucccucccaaagcucagcccucugggcgguc

SEQ ID NO: 428053 - RNA, 64 nt, Human
ggauccaccucuaggaccccugugggcguccccucccucccagccaccgccugccacaccacuc

SEQ ID NO: 428054 - RNA, 64 nt, Human
gcuguccucuccgcaggcagcccuggucuucagccccucccauccacggagugagcuggggcug

SEQ ID NO: 428055 - RNA, 64 nt, Human
gacacccagggguggugggcccuaacuggcuggccccucccagcgcugcccucugccguccaga

SEQ ID NO: 428056 - RNA, 64 nt, Human
ugaguuguggcaggaggaugauaaagcacgcggccccucccaaaggagcccuugagcuagggag

SEQ ID NO: 428057 - RNA, 64 nt, Human
cugcuaagggcaaauccuccgguuuuggaagcgccccucccaccuuuguagugcaguuccuagg

SEQ ID NO: 428058 - RNA, 64 nt, Human
cagcaggcgugggagucagggcugcaugcuccuccccucccaccucacaggcggccuuaggcaa

SEQ ID NO: 428059 - RNA, 64 nt, Human
cucuuccucuucuccuuuuuccgcacuucuccaccccucccacauuuacagccagaaucaacau

SEQ ID NO: 428060 - RNA, 64 nt, Human
uucuaauguuuuucuuuaucccuuuaauacagaacccucccaaacauuggcuaguacaacuuga

SEQ ID NO: 428061 - RNA, 64 nt, Human
cucuggguagagggcaacgccugcagccccucuucccucccacaugguuuaacuguaauagcgu

SEQ ID NO: 428062 - RNA, 64 nt, Human
cacagcucagcugcccaucccagucccucgccgucccucccaggucgggcaguggaggcugcug

SEQ ID NO: 428063 - RNA, 64 nt, Human
gugugucucggugacguuuucuaucagacgugcucccucccauccuccagcccugcccacccuc

SEQ ID NO: 428064 - RNA, 64 nt, Human
gccuccagcaccaagggcgggcagcacccuccgacccucccaugcgggugcacacgaaggguga

SEQ ID NO: 428065 - RNA, 64 nt, Human
ccagcuccucuaggggcagccuccgucauccaugcccucccaggacccuccacucacugcugug

SEQ ID NO: 428066 - RNA, 64 nt, Human
uggccacagcccugccuccgcccucaccuacaugcccucccagccccucccaucucuggacgag

SEQ ID NO: 428067 - RNA, 64 nt, Human
ccugccuccgcccucaccuacaugcccucccagccccucccaucucuggacgaggccuccuucc

SEQ ID NO: 428068 - RNA, 64 nt, Human
cuuccugcccuugaacccccucccugucccagggcccucccagcccauugcugccaagguggag

SEQ ID NO: 428069 - RNA, 64 nt, Human
aagaaaaacauccugggaaauccagcuaccagggcccucccaguggaggcaucuuacauuuagg

SEQ ID NO: 428070 - RNA, 64 nt, Human
ccccaaacccacacugaugcgaagcuguucuugacccucccauagcaucaacucaguucagcuc

SEQ ID NO: 428071 - RNA, 64 nt, Human
ggagcccagaguugggcacuggcaaaugucuccucccucccaugcuccuuggcuucugaaggcu

SEQ ID NO: 428072 - RNA, 64 nt, Human
ccuuaauaaaaaggacaaauggauacagccuugacccucccagugaggagaccccaauucagca

SEQ ID NO: 428073 - RNA, 64 nt, Human
aagggguguccuaaagugccucccccuguauucccccucccagggcagccccugcccagcacaa

SEQ ID NO: 428074 - RNA, 64 nt, Human
uagcaagggggcuagaggagggagauuccaccuccccucccaagugacccuccuccugccucug

SEQ ID NO: 428075 - RNA, 64 nt, Human
ugaauuccugggaucaagcaauccuuccaccuugcccucccaaaguguugggauuauaggcaug

SEQ ID NO: 428076 - RNA, 64 nt, Human
agugggcagugaagaugaagccccaugcucaguccccucccaucccccacgcagcuccacccca

SEQ ID NO: 428077 - RNA, 64 nt, Human
cugugaagcuccucaagugaccacccucuacugacccucccagggcauuccagcucaagcugcu

SEQ ID NO: 428078 - RNA, 64 nt, Human
guugguacuuaccugucucaccuacccuccaguccccucccagcuccgcucacagggcucucau

SEQ ID NO: 428079 - RNA, 64 nt, Human
uggggggaaaugccacugcuuuuagcaaaagccucccucccagaauuagccagcuugccuccug

SEQ ID NO: 428080 - RNA, 57 nt, Human
agcugggggcccgggcgugacugugcccccucccacccugcgggccaggguccuguc

SEQ ID NO: 428081 - RNA, 64 nt, Human
ugaaguacuaacuuuccaaggccugccuuccccucccucccacuggagaagccgccagccccuu

SEQ ID NO: 428082 - RNA, 64 nt, Human
ugcaaauacucuugguugacauccccuuccucagcccucccagccuacuccccaucccagcuuu

SEQ ID NO: 428083 - RNA, 64 nt, Human
ucuuccugacuucuugugugccucccuuuccuuucccucccacaaagccaacacucugugacca

SEQ ID NO: 428084 - RNA, 64 nt, Human
accccaugucaggcugucccaugguguguucugccccucccaccuguccccgccuccaacugcg

SEQ ID NO: 428085 - RNA, 64 nt, Human
guacuuacugugcugagagcuuuccucgcagaggcccucccaacgaacagcucucucagaagca

SEQ ID NO: 428086 - RNA, 64 nt, Human
acuguacucucucuccuaccugccucccugcagucccucccauggaugacucaggccucccaga

SEQ ID NO: 428087 - RNA, 64 nt, Human
gguucagaaccucugcagggaagggggaagaaaacccucccauuaggaagcaugcuuuugcagu

SEQ ID NO: 428088 - RNA, 64 nt, Human
gguggggacuugggcugggauggggacggcauaccccucccaggccucucccucugccuuucug

SEQ ID NO: 428089 - RNA, 64 nt, Human
gcaauucccaggaucucuccuucccuggaucccucccucccaggucugggcugugcaguuccuc

SEQ ID NO: 428090 - RNA, 64 nt, Human
ugcccccuucucccacacugcuaggugggccagccccucccaccacagcaggugucauauaugg

SEQ ID NO: 428091 - RNA, 64 nt, Human
aguggccuuggcaaugucugugccaccuccugagcccucccagcauguccucacaugcucaugc

SEQ ID NO: 428092 - RNA, 64 nt, Human
uuccccuaagcacacagggguuaaagcugugugucccucccaguggcuguggcagugacaguga

SEQ ID NO: 428093 - RNA, 64 nt, Human
ggaaauugcaccuuacagacaguggagggguguccccucccacaggcaagaaccagaggcccag

SEQ ID NO: 428094 - RNA, 64 nt, Human
cuucacucaauuaaaaaaaaauuauucuccaguccccucccacuuugcuucuuguaugcauugu

SEQ ID NO: 428095 - RNA, 64 nt, Human
acagcuugcucaggccccaggguggcugccucggcccucccagcucuuacacucagcuccagug

SEQ ID NO: 428096 - RNA, 64 nt, Human
agucuccccaccucuucccugaagagacaggcaccccucccagccguggucaacggagggagug

SEQ ID NO: 428097 - RNA, 64 nt, Human
ggagcugggcagagccugggcugguggggugccacccucccacaagggcugggcugagacccag

SEQ ID NO: 428098 - RNA, 64 nt, Human
guuuguguucguguuuuguuuguuucacuuguuucccucccagccccaaaccuuuuguucucuc

SEQ ID NO: 428099 - RNA, 64 nt, Human
ggaggcucuggaggcacacaggaugcagccuucccccucccaggccuggcuuauuccaagaggc

SEQ ID NO: 428100 - RNA, 64 nt, Human
auugggauggggcugaggaacaugcucccucccucccucccauaaaaugccugcucuucaccuc

SEQ ID NO: 428101 - RNA, 64 nt, Human
uauagaacuguuugaauugcagccauccccugcccccucccaggcugaagaucuguucuuuuua

SEQ ID NO: 428102 - RNA, 64 nt, Human
uccugcccccaagucauuuccguccccccccaggcccucccaccaccccauuuuauuuuauaug

SEQ ID NO: 428103 - RNA, 64 nt, Human
gccauggaugccucaucaccaacccugaccuucccccucccaacccuuuauucauccucacucc

SEQ ID NO: 428104 - RNA, 64 nt, Human
ccguccccccugucccugucccccuucccccgaccccucccagauccuggggaccaauaaagcc

SEQ ID NO: 428105 - RNA, 64 nt, Human
agagagaacgugugugugugugucggugaucacacccucccauccuuccugccuccugccccaa

SEQ ID NO: 428106 - RNA, 64 nt, Human
cucccuucagcucugggaggcaggcgcagugccccccucccaugggcuggcccaggaccguggg

SEQ ID NO: 428107 - RNA, 64 nt, Human
cugcccucagcccccgaccuuauuuauuacccuccccucccacacccccaaucuaccuggugau

SEQ ID NO: 428108 - RNA, 64 nt, Human
ggcugaauucucggugauaaaggcgcccacuggacccucccaacgcccaaugcuuugcuuuucu

SEQ ID NO: 428109 - RNA, 64 nt, Human
agacaguggucaacaggaagacccagcagcuccacccucccaagugacaggccauuuucggacg

SEQ ID NO: 428110 - RNA, 64 nt, Human
caucucaggcacuucugcaucacggaagaccuggcccucccagccguccuggggaugcucaggg

SEQ ID NO: 428111 - RNA, 64 nt, Human
uauauauauauauauauacacaaaugcacagucccccucccacuccguuaccuaacuguacguc

SEQ ID NO: 428112 - RNA, 64 nt, Human
ggccaugcugugggggaccugcuccucacagagccccucccaaggaucgggcggaagcugcugg

SEQ ID NO: 428113 - RNA, 64 nt, Human
ugucaagaggguugucauuaauacaucuaggguacccucccaugucaugaaguuaccuagucag

SEQ ID NO: 428114 - RNA, 64 nt, Human
aaggcuucucuccaagugugccaggccaggacagcccucccagccaugaauccuuacucagcua

SEQ ID NO: 428115 - RNA, 64 nt, Human
gcuccugguggggaauggcuggggcugggcaggacccucccacacaccugcacccuagcuucgu

SEQ ID NO: 428116 - RNA, 64 nt, Human
accaggcaucgagcuagcucccugcacggccgcacccucccagagaacuccuugaggagaacaa

SEQ ID NO: 428117 - RNA, 64 nt, Human
gccacaagcugaccccuucgugguuauagcccugcccucccaagucccacccucuucccauguc

SEQ ID NO: 428118 - RNA, 64 nt, Human
cugaauugcccaagcccuuggcuccccccggccucccucccaccccuucuuauuuauuuccuuu

SEQ ID NO: 428119 - RNA, 64 nt, Human
uguccaaugugaggacugccugggcagggucugccccucccaccccucucugcccugggagccc

SEQ ID NO: 428120 - RNA, 64 nt, Human
agggagggccaggaccauccuccuaccccucauacccucccagcauauacaaaaggggagguuu

SEQ ID NO: 428121 - RNA, 64 nt, Human
ugugggguacucaacugacauucccaugggguuucccucccaucugccugauccaccuccuccu

SEQ ID NO: 428122 - RNA, 64 nt, Human
cccacugguuccuucuuccugggucuucagcauucccucccaucaugcccggucccaccccucc

SEQ ID NO: 428123 - RNA, 64 nt, Human
aggcacagccagugcauuccugccugcggacaggcccucccagcagcuuugccgccucuccauc

SEQ ID NO: 428124 - RNA, 64 nt, Human
ucgccccuucccuuucaucugaaagaagauaccucccucccaguccaccucauuuagaaaacca

SEQ ID NO: 428125 - RNA, 64 nt, Human
gaaugcaagcuguaggugggugggugaguguguccccucccacacugcucucugguggguuugg

SEQ ID NO: 428126 - RNA, 64 nt, Human
uuccggguugcugugacagccgguagagccucugcccucccaaaacuaagcgggggggcguggg

SEQ ID NO: 428127 - RNA, 64 nt, Human
gaguggugggacaacugcagccagagacucucuccccucccaccaugggccccucugcccaugu

SEQ ID NO: 428128 - RNA, 64 nt, Human
aagaaaaacauccugggaaauccagcuaccauggcccucccaguggaggcaucuuacauuuagg

SEQ ID NO: 428129 - RNA, 64 nt, Human
gggcugcucucaaaccaugucccaucuucagcaucccucccaccaacuuacuccccugugguga

SEQ ID NO: 428130 - RNA, 64 nt, Human
guauacgcugaagcugacuuccgucuguguccugcccucccauccagcacucucuauggaaaua

SEQ ID NO: 428131 - RNA, 64 nt, Human
caacccaugcccgcuagaaaccugcugcgagggccccucccagaggagccccgccccuguaaga

SEQ ID NO: 428132 - RNA, 64 nt, Human
gcuguuguuugggaaacagggaagcauuggggaccccucccaacuuuucuucccaguaacgccu

SEQ ID NO: 428133 - RNA, 64 nt, Human
cagaccccagaucacaaagccaaccaugcccagccccucccagcacccccagccccacgaccau

SEQ ID NO: 428134 - RNA, 64 nt, Human; identical to SEQ ID NO: 428133

SEQ ID NO: 428135 - RNA, 64 nt, Human
gugguguacaagcauuuguuccaugccugcugugcccucccauagcacugccucuuccagggcc

SEQ ID NO: 428136 - RNA, 64 nt, Human
cagaccccagaucacaaagccaaccaugcccggccccucccagcacccccagccccacgaccau

SEQ ID NO: 428137 - RNA, 64 nt, Human
agcccaugccacccccauccugggcacaguuacacccucccaugcagugggagaaacacagacc

SEQ ID NO: 428138 - RNA, 64 nt, Human
cccacucuugcucuacgaggagcaagugccugcccccucccagcagccagcccugccaaaguug

SEQ ID NO: 428139 - RNA, 64 nt, Human
uaaaagcacacucauccccucacuugccgcgucgcccucccaggcucucaacaggggagagugu

SEQ ID NO: 428140 - RNA, 64 nt, Human
gucauucuuuucucuuggaaagguaggaggcugccccucccaugcucuccugcuuucucccugu

SEQ ID NO: 428141 - RNA, 64 nt, Human
ggggcugacccaggcuggaggacagggccagccacccucccacggccugggaggaagagaggcc

SEQ ID NO: 428142 - RNA, 64 nt, Human
uuuccuccucucuagaaccuccuucuguuggaggcccucccaucuccccgcugaaaccugcgcu

SEQ ID NO: 428143 - RNA, 50 nt, Human
gggagaccgacguccuuuagcccucccaggccccacggcagcacuuaugg

SEQ ID NO: 428144 - RNA, 64 nt, Human
ccuggaaaaggcuagggagcuggggcuggggcuccccucccaugaccaggcaguggucacccca

SEQ ID NO: 428145 - RNA, 64 nt, Human
uccuaccuccccugccugagcccucacuccacagcccucccagguaccuagcagaggcugucag

SEQ ID NO: 428146 - RNA, 64 nt, Human
ugcaccagaaauaguacucacugccucagacagucccucccacagucuacucugucuccacccc

SEQ ID NO: 428147 - RNA, 64 nt, Human
ggagcuguuccauuggguccucuuggugucguuucccucccaacagagcugggcuacccccccu

SEQ ID NO: 428148 - RNA, 64 nt, Human
aaagaaaguggcaggcaaacacaacucuugacugcccucccacccuccuaccuguucaguacuc

SEQ ID NO: 428149 - RNA, 64 nt, Human
gcccgugcucaacaccgccugggccacagcuaggcccucccaccggcucgcugcagagccgggc

SEQ ID NO: 428150 - RNA, 64 nt, Human
aauggggcagggugcucuggacucuuacccccuccccucccaucuguggcuuggcucugcugug

SEQ ID NO: 428151 - RNA, 64 nt, Human
cagggucaggagagaccccucuguauccccaggucccucccagaacugacuccuaaggucucca

SEQ ID NO: 428152 - RNA, 64 nt, Human
gaaaaugaaugugaaacuaggaaauaaaaugugccccucccagucugggaggaggauguugcag

SEQ ID NO: 428153 - RNA, 64 nt, Human
ucgcucucgcucucucucgcugcguccucauuuccccucccaauccucucuccccucugcaacc

SEQ ID NO: 428154 - RNA, 64 nt, Human
acccgggggggaagaagcaaagccaucucccacccccucccagccuucucauuucugcuuucuu

SEQ ID NO: 428155 - RNA, 64 nt, Human
gcuuccuguaaacucccuccaucccaaccuggcucccucccacccaaccaacuuuccccccaac

SEQ ID NO: 428156 - RNA, 64 nt, Human
cagaaccacaacagguuggucaucaggauggccacccucccaggaucauccuuccucuguuccu

SEQ ID NO: 428157 - RNA, 64 nt, Human
uaaaucuccuccucuucuuccuguccaugccggccccucccagcaccagcucugcucaggcccc

SEQ ID NO: 428158 - RNA, 64 nt, Human
agaaacagcauccugggaaauccagcuaccauggcccucccaguggaggcaucuuacauuuagg

SEQ ID NO: 428159 - RNA, 64 nt, Human
cuagcgagggaccuccgcugcaucucagcaaagccccucccaggguuugaucgauugagcagga

SEQ ID NO: 428160 - RNA, 64 nt, Human
cucccugccucccacccucaucucucuacccuaccccucccaucggggcugugcuggggcuugg

SEQ ID NO: 428161 - RNA, 64 nt, Human
ccgcccgcccacaggccugaggucugggaccuuucccucccaggaguccccuagguggcugggg

SEQ ID NO: 428162 - RNA, 64 nt, Human
agcccgggucaggcuggggaggaacagaacugggcccucccagagcaccuccgcuuccccccug

SEQ ID NO: 428163 - RNA, 64 nt, Human
auccugaggacagaaaaagcugggucuugcugugcccucccaggcuuaguguucccucccucaa

SEQ ID NO: 428164 - RNA, 64 nt, Human
ccuugggugcaggcagggcugggacacgcggcuucccucccagucccugccuuggcaccgucac

SEQ ID NO: 428165 - RNA, 64 nt, Human
gaagguccuuuuugggggacuuugacagccauaucccucccagcacaccaggcgccaggugagc

SEQ ID NO: 428166 - RNA, 64 nt, Human
uccccauaccaaagugcugacaggcccuccgugccccucccacccugguccgccucccuggccu

SEQ ID NO: 428167 - RNA, 64 nt, Human
gauuuuggugacuugacuuauggaggcuggaaagcccucccacuaaaauugauaaaccgaacgc

SEQ ID NO: 428168 - RNA, 64 nt, Human
gccauaguuauuuuucucaaaauuuagugaaaaucccucccauguagacauguugcacauuuuu

SEQ ID NO: 428169 - RNA, 64 nt, Human
uccaagccgucaucaucauccucaggacccaggacccucccauggccgggacagcccaucagag

SEQ ID NO: 428170 - RNA, 64 nt, Human
ugcugggugagacagugggcccucguccccuccccccucccaauucucugccccaggcuaauau

SEQ ID NO: 428171 - RNA, 64 nt, Human
ccaaaaggagaagaacaucugagaaccuccucggcccucccagucccucgcugcacaaauacuc

SEQ ID NO: 428172 - RNA, 64 nt, Human
caaccaacuaucuaaauggacauuugggggaauucccucccaaauuugauuuuguuauuagaaa

SEQ ID NO: 428173 - RNA, 64 nt, Human
gcucucuauagcaccagggcucacgugggaaccccccucccacccaccgccacaauaaagaucg

SEQ ID NO: 428174 - RNA, 55 nt, Human
aggccaagggccgccccugaaccgccccucccacagcgcuggccgggaccccgag

SEQ ID NO: 428175 - RNA, 64 nt, Human
auugccuuccacauauguaagucucugggcggcgcccucccagcucccugccucuguuucccca

SEQ ID NO: 428176 - RNA, 64 nt, Human
acaaucaacucaagguacgcccacugcaaggccucccucccaccgcggccccugccuggccacc

SEQ ID NO: 428177 - RNA, 64 nt, Human
gcaacacacccagccgccugguacuuccuccagccccucccagucagcccucccguccucgggg

SEQ ID NO: 428178 - RNA, 64 nt, Human
ggggcccugccugccgcggggccuccccacaagccccucccaaagcgccggccgacucgcuguc

SEQ ID NO: 428179 - RNA, 64 nt, Human
uuugaguccucgggcccagaaucguaucccaaagcccucccauggccuagaaaauaaauaaguu

SEQ ID NO: 428180 - RNA, 64 nt, Human
uuaacucagccgaggugggaaauggugucccugucccucccaaagcacagagcacagaaaugag

SEQ ID NO: 428181 - RNA, 64 nt, Human
agaugccugaggaccucgacaggggucacccccucccucccaccccuggacugggcugggggug

SEQ ID NO: 428182 - RNA, 64 nt, Human
ggucccuccaaaacucuggucaguucaaggaugccccucccaggcuaugcuuuucuauaacuuu

SEQ ID NO: 428183 - RNA, 64 nt, Human
gcaguggggaagggggccaagguauuggaggacucccucccagcuuuggaagccucauccgcgu

SEQ ID NO: 428184 - RNA, 64 nt, Human
uccagguuggucuugaacuccuggccucaagcaucccucccagcuugaagugucaauaaaggaa

SEQ ID NO: 428185 - RNA, 64 nt, Human
cccccucacacugaguucacagugcgcccucccucccucccaucuggggguagugccuuaugcu

SEQ ID NO: 428186 - RNA, 64 nt, Human
aacccgcccagccucccgcggggccacacacuuccccucccaacacacacacacaccugccauc

SEQ ID NO: 428187 - RNA, 64 nt, Human
gggacuugaggggggccccagggguucucaggaccccucccaccaccucccagugcuuccacgu

SEQ ID NO: 428188 - RNA, 64 nt, Human
gccuguucugagugagccccucacucagccggggcccucccaccuccaacgccccgcccacgcc

SEQ ID NO: 428189 - RNA, 64 nt, Human
accagauggaggggcccucccuggucucuggccacccucccagccucugcccagggaccccugc

SEQ ID NO: 428190 - RNA, 64 nt, Human
cggccguggcgggucccacgcgccgggcgcggcccccucccaaacugugacugguauuuauugg

SEQ ID NO: 428191 - RNA, 64 nt, Human
uccaaguccugggaaugugcggggccagucccugcccucccaggaggggugguagccguuccca

SEQ ID NO: 428192 - RNA, 64 nt, Human
cuagaagaaauggauaaauuccucaacacguacacccucccaagacuaaaccaggaagaaguug

SEQ ID NO: 428193 - RNA, 64 nt, Human
ugccaucuugccccuagccugggggcucccuagccccucccagagcaucucacccccacccuca

SEQ ID NO: 428194 - RNA, 64 nt, Human
ccccauguucuucugucuccaggaagggcagcggcccucccaucacuggaagucugcagugggg

SEQ ID NO: 428195 - RNA, 50 nt, Human
guggggaccugugugucugacccucccaccagucaugcaaccugagauuu

SEQ ID NO: 428196 - RNA, 64 nt, Human
caugagcgcacacacaagacugagggacugucggcccucccagguggugucaacacaacaucac

SEQ ID NO: 428197 - RNA, 64 nt, Human
guaaaaggaagggguuggauugcaauaucugaagcccucccagguguuaacauuccaagacucu

SEQ ID NO: 428198 - RNA, 64 nt, Human
aggcacggggaggguuuucuccucacccccucugcccucccaacuuggguuguacuuucuaaga

SEQ ID NO: 428199 - RNA, 64 nt, Human
ccucuucugagcacagauguucccccaucucgcucccucccaggacucugaccccagcauucuc

SEQ ID NO: 428200 - RNA, 64 nt, Human
ccggaaugccacccacaucuuccauuuccauguccccucccagagcugguggacccagggaaca

SEQ ID NO: 428201 - RNA, 64 nt, Human
aaugugaacguccuuccuugacugucuagccacucccucccagaaaaacuggcucugauuggaa

SEQ ID NO: 428202 - RNA, 64 nt, Human
augagggagaaaggagaaggggaggaaacuucuccccucccaccuucaccuuuagcuucuugaa

SEQ ID NO: 428203 - RNA, 64 nt, Human
ugacuugucaucaagagucaccucagcugcgccccccucccauccuuuccuaugagaagccacu

SEQ ID NO: 428204 - RNA, 64 nt, Human
cauuugcaaggugaacacuuccuucuagggagcacccucccaccccccaccccccccacacaca

SEQ ID NO: 428205 - RNA, 58 nt, Human
acaagggcuccgccgagugagccggccccccucccauggcccugcuguggcuccccag

SEQ ID NO: 428206 - RNA, 64 nt, Human
aggggagaggggccagggaaguggaugucuccuccccucccaccccacccuguuguagccccuc

SEQ ID NO: 428207 - RNA, 64 nt, Human
gagcuucccucugggacuaaaggaguguccuuuacccucccagccuccaggcucuggcagaaau

SEQ ID NO: 428208 - RNA, 64 nt, Human
ucaacuccugaccucaggugauccacccaccuugcccucccaaagugcuaggauuacaggcgug

SEQ ID NO: 428209 - RNA, 64 nt, Human
gccuuuccucuguuuuccucuuccugucuccccucccucccaccuuuuucuuuccuucccaauu

SEQ ID NO: 428210 - RNA, 64 nt, Human
gcauuccagcucugcccccgcggguucuagacgccccucccaagcguuccuggccuucugaacu

SEQ ID NO: 428211 - RNA, 64 nt, Human
agaaacugugagcaccuccacugacagaggcggccccucccacggcucccaauaaaaaugugaa

SEQ ID NO: 428212 - RNA, 64 nt, Human
uuuuuccugaugcucucccucccuucaucauccgcccucccacuacaagccccaguguguguug

SEQ ID NO: 428213 - RNA, 64 nt, Human
cagggugcacagcagggcgggguaggaccccagccccucccaaaacagccucuccuucucccau

SEQ ID NO: 428214 - RNA, 64 nt, Human
ucccagcgccacuuggccucuuccucuccuccuucccucccaucguccuccuccaccugcgccu

SEQ ID NO: 428215 - RNA, 64 nt, Human
cccaggguggucucaaacuccugugcucaagugacccucccaccucauucucaaguggcugcaa

SEQ ID NO: 428216 - RNA, 64 nt, Human
cugaaauacgucccaccugugcagcuaugugacucccucccacacacgcuuaagacaccucugc

SEQ ID NO: 428217 - RNA, 64 nt, Human
cuugggggaagggacgucagcaagguggcucugacccucccaggugacucugccaagcagcugu

SEQ ID NO: 428218 - RNA, 64 nt, Human
gcuggggaggggcacaggacccugcccucguguucccucccagcccgcaguauuucagggacag

SEQ ID NO: 428219 - RNA, 50 nt, Human
uggugggagaccacgccugacccucccaucuccccucuguacauagguca

SEQ ID NO: 428220 - RNA, 64 nt, Human
gggguggcucagagauaggacccugguuuuaaaucccucccagccuggugcuggugaugggccc

SEQ ID NO: 428221 - RNA, 64 nt, Human
gcccuggcucagcucccgcggccccgcccguccccccucccaggacuggucuguugucuuuuca

SEQ ID NO: 428222 - RNA, 64 nt, Human
ccugcauccccacacuucacagcaucuuccaucccccucccaccuucuaggcgaauagucccca

SEQ ID NO: 428223 - RNA, 64 nt, Human
ggauucccccucaccccaccucugcauggccacccccucccagcccuguggggaaacuguuccc

SEQ ID NO: 428224 - RNA, 64 nt, Human
cuugccccugaccccccugccgugccucccgcagcccucccaugccguuccacuccucccugcc

SEQ ID NO: 428225 - RNA, 64 nt, Human
aguugggagaagcccagccccucccccucgagaccccucccaugucccuuccuggccuggccgg

SEQ ID NO: 428226 - RNA, 64 nt, Human
auccugucccuccaccccacccuccaccucaauccccucccaucuuccccagaccuaccucacc

SEQ ID NO: 428227 - RNA, 64 nt, Human
uaaccucagagccaggagccuggggcuggggccucccucccaggcccuguuuagcuguuuagcu

SEQ ID NO: 428228 - RNA, 64 nt, Human
cccgaugggauggcuuggggggcuccagggggugcccucccagacccccuugcccaggccuccc

SEQ ID NO: 428229 - RNA, 64 nt, Human
gcaaacagcacaaggcgugagcccaccccgccugcccucccacccccuccccgggcagcagaga

SEQ ID NO: 428230 - RNA, 64 nt, Human
uaacugucaaugguuauggguccuauaaaaaugccccucccagauaaagcuucagcguuggccu

SEQ ID NO: 428231 - RNA, 64 nt, Human
ccgcggggcauccagcucggccccuuggccgccccccucccaggccccagcgucuucuccccag

SEQ ID NO: 428232 - RNA, 64 nt, Human
ccagugccucccucccuccuuccucuacucccaccccucccauguccccccauuccucaaaucc

SEQ ID NO: 428233 - RNA, 64 nt, Human
cuuccucuuuccccacagccccccagccccucagcccucccagcccacuucugccuguuuuaaa

SEQ ID NO: 428234 - RNA, 64 nt, Human
aggaagauucuuagguccucuucaauccagcagccccucccagaggugugaucagcaggaugcu

SEQ ID NO: 428235 - RNA, 64 nt, Human
gcaggcgagaugcccagaggugaucccugcccgccccucccaccucccuucccacacagcccau

SEQ ID NO: 428236 - RNA, 64 nt, Human
ccuuuuuccaccaacuucccaccccuguuucucccccucccagugcguucucucugugacucuc

SEQ ID NO: 428237 - RNA, 64 nt, Human
acagaagguuuauugguuccucuugggaaggguccccucccaccaccuguccagaagcugccuu

SEQ ID NO: 428238 - RNA, 64 nt, Human
caucacugggggcugcgcuagcugggcuggcauucccucccaaccugaacugcuccucagagcc

SEQ ID NO: 428239 - RNA, 64 nt, Human
ggguccaaaccugagugagggccagccaugccuccccucccauuccucuggucccugccuuggu

SEQ ID NO: 428240 - RNA, 64 nt, Human
gcgacaggaccgggacagcaggccccuugacagccccucccacaggaugugggcucugaggccu

SEQ ID NO: 428241 - RNA, 64 nt, Human
cccugaggcccugcugauccgcaccccauuccuccccucccauggccaaaaaccccacugucuc

SEQ ID NO: 428242 - RNA, 64 nt, Human
ccaggccagggauugcccaacacuccuagggcagcccucccagcgccccauggggucgcccaug

SEQ ID NO: 428243 - RNA, 64 nt, Human
cgcccgguggacgucagggacucggggggcaggccccucccaccuccugacacccuggccagcg

SEQ ID NO: 428244 - RNA, 64 nt, Human
ccaagaucuuuucccuuccccaggccccucggcucccucccagaucccacccccagccccacug

SEQ ID NO: 428245 - RNA, 64 nt, Human
ucuacauagucaccguccgcuuuuccugaguucucccucccaauuggcuccagcuuccuggggg

SEQ ID NO: 428246 - RNA, 52 nt, Human
aggagauugggcggauuugagccccucccagagauggcaauaaaacugacuc

SEQ ID NO: 428247 - RNA, 64 nt, Human
uaguuacaaagauuuuuuaaaaagcuacauaugccccucccaaaccgggaaccucaagaucucc

SEQ ID NO: 428248 - RNA, 64 nt, Human
cuaaagagccaugaguccuggaggaggagaggaccccucccaaaggacuggagacaaaacccuc

SEQ ID NO: 428249 - RNA, 64 nt, Human
uuuagggaagcuggagccaucucugcacuaacugcccucccaaauaucuugguucagacagcuc

SEQ ID NO: 428250 - RNA, 64 nt, Human
gccaugacaaacaccaggaugcaugcuccuuguccccucccacccgccucaugacccagccuca

SEQ ID NO: 428251 - RNA, 64 nt, Human
acauacagauaaagcacugaaaacaccacagugacccucccaccccccaccaauauguaauucu

SEQ ID NO: 428252 - RNA, 64 nt, Human
ccaucucggcucuuccaggcgucuccaccuacugcccucccaucuacacuugacuguagacugg

SEQ ID NO: 428253 - RNA, 64 nt, Human
gcauacaagggcucacaauuuggcuuuuuugggucccucccagcuuuagguuaugaagauuuua

SEQ ID NO: 428254 - RNA, 64 nt, Human
ccuuggcccugcgcaucauggacucucucagcuucccucccaggaucaguuucuacacaacucu

SEQ ID NO: 428255 - RNA, 64 nt, Human
uuguccaagaaggcuggacgagagaccuucuguccccucccagagggggaacccuggcacuggc

SEQ ID NO: 428256 - RNA, 64 nt, Human
gaccacagcaaccagcuccacggccugaugcagccccucccagccucucccgcuaggagagucc

SEQ ID NO: 428257 - RNA, 64 nt, Human
ucagcccuuugcugauuucaugauuucucacccucccucccauauguagggugugauucuguuu

SEQ ID NO: 428258 - RNA, 64 nt, Human
cagccugcacuggagucugaggccugggaccccccccucccacccccuaacccauguuucucau

SEQ ID NO: 428259 - RNA, 64 nt, Human
ccuggcaagcugggggcccaucgccguggggagucccucccaccacccucgccgcaggcagcug

SEQ ID NO: 428260 - RNA, 64 nt, Human
gccuggaauggcccagaccccagccuccccuccucccucccauccucacccaggccaaggccca

SEQ ID NO: 428261 - RNA, 64 nt, Human
uuugcccccacaagccuggucaucagccaggcagcccucccagugcccaagggccaccaacccc

SEQ ID NO: 428262 - RNA, 64 nt, Human
gggcucugagcuggauugauggggccagucuccccccucccaucuugaggucguucuccacauu

SEQ ID NO: 428263 - RNA, 64 nt, Human
uuauuuuuaguucaguuuaaaauguugauaccuucccucccaggcuccuuaccuuggucuuuuc

SEQ ID NO: 428264 - RNA, 64 nt, Human
gguggaauauuucauggacaaauuuuuuuuucuccccucccaaauuuaguuccucaucacaaaa

SEQ ID NO: 428265 - RNA, 64 nt, Human
gcaccucucccgcgccccagagccggaaauuucucccucccagaccccgcgcugcucuucuaac

SEQ ID NO: 428266 - RNA, 64 nt, Human
gagaagcuucucuagacuuggcuccaaacaucuccccucccaagacaucugccugcccacaggc

SEQ ID NO: 428267 - RNA, 64 nt, Human
caaauggguacaauguucccuuguggccaaauuucccucccagggagcaauuucagugcuagga

SEQ ID NO: 428268 - RNA, 64 nt, Human
gcuaaaagguaugaaguauuauguagggauacgucccucccauucugucccacagccaccaccu

SEQ ID NO: 428269 - RNA, 50 nt, Human
ucagccuccaggcuguuuagcccucccagauagcugccccugccacgcag

SEQ ID NO: 428270 - RNA, 64 nt, Human
caccaaaccuccucuugcacuuucccucuggcuucccucccagccuuccuugguuuggauguuu

SEQ ID NO: 428271 - RNA, 64 nt, Human
gucggaaaugaccagacacugaccauccacucuacccucccacccccuucucugcuccaccaca

SEQ ID NO: 428272 - RNA, 64 nt, Human
gccaccuccagccucugccagcaaugagcugucccccucccacccuacacaguagcuggucagg

SEQ ID NO: 428273 - RNA, 64 nt, Human
cuccgaggcugggccugagcugggugccccgucgcccucccaggccacuaggcucugacucuuc

SEQ ID NO: 428274 - RNA, 64 nt, Human
ucuggcuguggcucaagauuuggccccaugcagacccucccaaaggauacugccuucucaagau

SEQ ID NO: 428275 - RNA, 64 nt, Human
acccccaccuuguggcucugcacaccaaggagcccccucccagacaggaaggagaagaggcagg

SEQ ID NO: 428276 - RNA, 64 nt, Human
aagccuugcuuuuaacaccccugcaaaacccccacccucccaagauguucacaaaaggugagaa

SEQ ID NO: 428277 - RNA, 64 nt, Human
cauaauucuggggucaggccaggccuggguccugcccucccauggggugacucaugaccccucc

SEQ ID NO: 428278 - RNA, 64 nt, Human
ggauuucugucucugggacccucgcugcaccuaccccucccauugcaaagccaacuuggacugg

SEQ ID NO: 428279 - RNA, 64 nt, Human
ccggacagugccucacucaccugggacugguauccccucccaggguccaccaagggcuccugcu

SEQ ID NO: 428280 - RNA, 64 nt, Human
ggcggggggcgcagcaacgcaucguguggcccuccccucccaccucccuguguauaaauauuua

SEQ ID NO: 428281 - RNA, 64 nt, Human
cugauuuuuuagacuauuuaucuuccuucccuuccccucccaccccgcucuccucucugccccc

SEQ ID NO: 428282 - RNA, 64 nt, Human
cgugccaaauccugggcauccccagcccccuggccccucccacaucccccguguauucaggacc

SEQ ID NO: 428283 - RNA, 64 nt, Human
aggcagagcccaaucagggucucgugcugcccuucccucccacagccuggcagccauccagagg

SEQ ID NO: 428284 - RNA, 64 nt, Human
gcucugcaggaugaggaagacaggccaaucccuucccucccagaagcuggccgcccagcaggag

SEQ ID NO: 428285 - RNA, 64 nt, Human
cccugccgaggugugaccccaccugcucuuuccucccucccaguauggccccaccugcucuuuc

SEQ ID NO: 428286 - RNA, 64 nt, Human
gcggagguccugggcagccugucccugagccggccccucccaggggucugagauccaugaggug

SEQ ID NO: 428287 - RNA, 64 nt, Human
ggggagaggccuucccagggccacuccccuuacacccucccagaggccugagcaaccccucucu

SEQ ID NO: 428288 - RNA, 64 nt, Human
ucucugcguacguucgaguauacguugcccauaucccucccauauuuucuuuuugcugcuuuug

SEQ ID NO: 428289 - RNA, 64 nt, Human
gccgcuuagacaauguugcccagaguccuguuuacccucccaggguucauucuucccaagaacu

SEQ ID NO: 428290 - RNA, 64 nt, Human
ugguuaagaaguagaaaauuuaguuuagggaaagcccucccacaggugggaaauugcucucccc

SEQ ID NO: 428291 - RNA, 64 nt, Human
acagaggaccaccuccccauacagagagaggcuucccucccagccucaguuuacccguaaaugc

SEQ ID NO: 428292 - RNA, 64 nt, Human
ggggucugaggcccaggacccaccccccugccaccccucccaccccacucccugcucaguaccu

SEQ ID NO: 428293 - RNA, 64 nt, Human
agugaggccaagggguccuggccggguuggggagcccucccauaacccugucuugggcuccaac

SEQ ID NO: 428294 - RNA, 64 nt, Human
uggugggcuccacccacuagaugccaguggcacccccucccagagaugacaaacgaaaaugucu

SEQ ID NO: 428295 - RNA, 64 nt, Human
ccccagcugacccuaauuuauucucagcaccacccccucccaggucauugugucuguuuccgag

SEQ ID NO: 428296 - RNA, 64 nt, Human
cccaucugcacccccaucauagguagagaccccacccucccaucgguccuacauggggcugugc

SEQ ID NO: 428297 - RNA, 64 nt, Human
cugcugauggaguccucgcugcucaugcccacagcccucccagagugcuaugcgaguggcugcc

SEQ ID NO: 428298 - RNA, 64 nt, Human
cggcccagucugcacggcccaucugcuucaccuucccucccagccacgugccaguggccacagc

SEQ ID NO: 428299 - RNA, 64 nt, Human
cuguucccugggggccagccagggcccuuugugccccucccagcacaggccugaugcagguguc

SEQ ID NO: 428300 - RNA, 64 nt, Human
aucugagguggcccugcagccccccaccuucuggcccucccaccagaggcccagcuaccaaggc

SEQ ID NO: 428301 - RNA, 64 nt, Human
gcaguacaucuugugcaugcaaaaaugaauucaccccucccaccucuuucuucaauuaauggaa

SEQ ID NO: 428302 - RNA, 64 nt, Human
gcaugguggggccccugaccaaccuacacaaguucccucccacaaguggacaucagugucuucu

SEQ ID NO: 428303 - RNA, 64 nt, Human
aacucuuacgcucugguucagcugccucugcacccccucccacccccagcacacacacaaguug

SEQ ID NO: 428304 - RNA, 64 nt, Human
cguagcgcucauggugcggcaggcucguggccuccccucccagaagcgccucuuccccuggaag

SEQ ID NO: 428305 - RNA, 64 nt, Human
agcagcccucagcacccccucccuccccaccuggcccucccaggacagcucucgccccccacaa

SEQ ID NO: 428306 - RNA, 64 nt, Human
gggacccggggaagguuugagggcccuugcaacccccucccagcaguggcugggcacucuuugc

SEQ ID NO: 428307 - RNA, 64 nt, Human
ucugucugcucuguugucuguucuuucccugacucccucccaccgaaggccugauggcuacuca

SEQ ID NO: 428308 - RNA, 64 nt, Human
aaacugcucuuauugugccaauaugcccuccaaacccucccaggauucaaagcuagguuuggcu

SEQ ID NO: 428309 - RNA, 64 nt, Human
uuugauucucuaaggagcacgaaagggggaaugccccucccaggaguuuaugggagaagggacu

SEQ ID NO: 428310 - RNA, 64 nt, Human
gcuggccaugugagcaccccaugaagggaccgcccccucccaaggauggucccuuugggugcag

SEQ ID NO: 428311 - RNA, 64 nt, Human
uaaccgucuguccuagccccucccuaaucccuggcccucccagcugucugggacuucaguggac

SEQ ID NO: 428312 - RNA, 64 nt, Human
uuugaggcuuucuguugccauggugaugguguagcccucccacuuugcuguuccuuacuuuacu

SEQ ID NO: 428313 - RNA, 64 nt, Human
gucccgcuguuuccugugcauucgugacccgcuucccucccacccugucuccugucuccaucgu

SEQ ID NO: 428314 - RNA, 64 nt, Human
ggagcucagcguccgcuacucagcccagccaaaacccucccagacgucuccucuccugccuggg

SEQ ID NO: 428315 - RNA, 64 nt, Human
auauggaguagcugaucagcccacacuugccccgcccucccacaccugcuugggaggccagaga

SEQ ID NO: 428316 - RNA, 64 nt, Human
uucaguaaggcuggagcugcgagccaguuugcugcccucccagauccuguguccauucugaaga

SEQ ID NO: 428317 - RNA, 64 nt, Human
accaguuuuauggcuuuauuacaaacugcugggucccucccauuuucaacuugauugaugggau

SEQ ID NO: 428318 - RNA, 64 nt, Human
cuacugcccccauucauccuggcuuuccacagcccccucccacacaguuggacccgugauucuc

SEQ ID NO: 428319 - RNA, 64 nt, Human
ucuaugauauucugggaccucagugauuuugguccccucccacuucucuaguucgucauccucc

SEQ ID NO: 428320 - RNA, 64 nt, Human
agucugacagccagagcguuagaggggccagcggcccucccaggcgaucuugugucuacucuag

SEQ ID NO: 428321 - RNA, 64 nt, Human
guggugcugcugcugauccggggaccgcugucuucccucccauacgccuuucaucccuccuucu

SEQ ID NO: 428322 - RNA, 64 nt, Human
ggggagacccugcuucuaucuuggcugccaucaucccucccagccuauuucugcuccucucuuc

SEQ ID NO: 428323 - RNA, 64 nt, Human
cagcguggacccuggugucuauggugaagcugggcccucccacccugagccuuccuagacccuu

SEQ ID NO: 428324 - RNA, 64 nt, Human
agagccucugccgggggugggaugccaggacacccccucccacacucaggacagagccaacccu

SEQ ID NO: 428325 - RNA, 64 nt, Human
gcacccuuggccugaguaaacuuggaaaggggcucccucccagagaagggacuacucucuucac

SEQ ID NO: 428326 - RNA, 64 nt, Human
gugccagggggcucagcugcuucagggaaugugucccucccaccaugggccagagcuucagccc

SEQ ID NO: 428327 - RNA, 64 nt, Human
aagaccacagacgggcacacagacuggagaaaaccccucccacggugcccaaacaccagucacc

SEQ ID NO: 428328 - RNA, 64 nt, Human
uuugggggggggcggacaggagaugggugcaacucccucccauccuacucucacagaagggccu

SEQ ID NO: 428329 - RNA, 64 nt, Human
gcagcgagggggcccagcuggcgagacuguagcccccucccacucccacacucacucuugcaga

SEQ ID NO: 428330 - RNA, 64 nt, Human
uggcuagagugggaagagggggcuggccauggggcccucccagaaccucagcauuuccuuccag

SEQ ID NO: 428331 - RNA, 64 nt, Human
ggcggccugcagacccugccaggggguuugaggacccucccagguuucccacugcggaacagga

SEQ ID NO: 428332 - RNA, 64 nt, Human
agcugaccaguguccacuccucauccugacuccacccucccacuccuuggauuucuccuggagc

SEQ ID NO: 428333 - RNA, 64 nt, Human
uacagacuggcugggccccacccccugcguguggcccucccacaguauuuugugcaaugaagcc

SEQ ID NO: 428334 - RNA, 64 nt, Human
auagcuuaaaacaaagaauauacauucuuuucaccccucccagucuacccauccagccuucaug

SEQ ID NO: 428335 - RNA, 64 nt, Human
aucuucuccaggaugucaacugaccuaaaauuugcccucccaucccguuuagaguuauuuaggc

SEQ ID NO: 428336 - RNA, 64 nt, Human
ucuccuuucuuuuucuucuucccucccuaucuaacccucccauggcaccuucagacuuugcuuc

SEQ ID NO: 428337 - RNA, 64 nt, Human
cauccaggagaaaaaggcaggagcagcaagugaccccucccaagcucccaucuauggggcuuag

SEQ ID NO: 428338 - RNA, 64 nt, Human
ccaacucagagcacagccaaucuccaggcucccucccucccagauccaggaacacaugcacaca

SEQ ID NO: 428339 - RNA, 64 nt, Human
uuuacaaauuuuccccuuucccuuuaccuccuuucccucccaucuucuuucauuaaccccuccu

SEQ ID NO: 428340 - RNA, 64 nt, Human
acaaaucuuacaguccaaggcauuaaccucaaggcccucccagcaccccauucuuguauacaca

SEQ ID NO: 428341 - RNA, 64 nt, Human
gguaaauguugaaaaaagaagcaugccuccuucucccucccacccaccucaagcaguugaacac

SEQ ID NO: 428342 - RNA, 64 nt, Human
caaacuccugaccucaagagauccacucgccuugcccucccaaagugcugggauuacaggcuug

SEQ ID NO: 428343 - RNA, 64 nt, Human
aagucaaaacuauagccauauccaaaucuuuucccccucccaagaguucucagugucuacaugu

SEQ ID NO: 428344 - RNA, 64 nt, Human
ugcuucccuguccccgcccccucuguggcauugucccucccacucuuauuuuucuaccaauugc

SEQ ID NO: 428345 - RNA, 64 nt, Human
uguagugguagcgacuuuccugcuaugcaggaaucccucccaugacguguauguuuuacaugau

SEQ ID NO: 428346 - RNA, 64 nt, Human
cgccgucucauccucaucugagcggggcuccucgcccucccacuccgccaccuccguccacacc

SEQ ID NO: 428347 - RNA, 64 nt, Human
cuccccucagcccccuugcaaguucauggccugucccucccagaccccugcuccacuggcccuu

SEQ ID NO: 428348 - RNA, 64 nt, Human
uggaggguggcgcccugcguaacccucgcccugucccucccacucccugggggcgcuguuccac

SEQ ID NO: 428349 - RNA, 64 nt, Human
cccccaccaacucucgcguguuggagagaaggggcccucccagcacaaaguugcauuccucccc

SEQ ID NO: 428350 - RNA, 64 nt, Human
guggccugagggcugucgagugagcugccccagccccucccagcccuugcccagccugggggag

SEQ ID NO: 428351 - RNA, 64 nt, Human
ccugccuccaugauucaguuaccucccacugggucccucccacaacguguggcaauugugggag

SEQ ID NO: 428352 - RNA, 64 nt, Human
ugauucuuaugauugauuucucaaacuagcuuuucccucccaaguccaggacccauuaauuucc

SEQ ID NO: 428353 - RNA, 64 nt, Human
auuuuugauaccaaacaugaauuuucaguucccucccucccagccccccaauuuccugcgggcg

SEQ ID NO: 428354 - RNA, 64 nt, Human
gaccagucaggaugaggccccgccuuuucccccacccucccaugagacugcccugcccagguau

SEQ ID NO: 428355 - RNA, 64 nt, Human
guugcccaugucugauugggggcucuagccccuucccucccagcucagucaauacuugaacucc

SEQ ID NO: 428356 - RNA, 64 nt, Human
cagccccagcaccaccaggucucccgggaagccacccucccagcucugaggacugcaccauugc

SEQ ID NO: 428357 - RNA, 64 nt, Human
accaucuccugaguuuugguuuguaaucuuuugucccucccacccccacagaagauuucuaagu

SEQ ID NO: 428358 - RNA, 64 nt, Human
uaacuaauucuguggcuguugugagucuucagcacccucccauguaccuuauaucccucucuga

SEQ ID NO: 428359 - RNA, 64 nt, Human
auguggcucgcagaugcauccugcaucccagucccccucccagcacccccagccauccccccug

SEQ ID NO: 428360 - RNA, 64 nt, Human
gaggggagggugcugggccugacauggcuauauacccucccaggaguaaaagccaagcaagagg

SEQ ID NO: 428361 - RNA, 64 nt, Human
ccucaaggugccuggcuggggccucugcaccccacccucccaccugcccaccuggcccugccuu

SEQ ID NO: 428362 - RNA, 64 nt, Human
ggagggaaggcggagcugaggacagccagcuccgcccucccaaggcugugcguuccugagggcc

SEQ ID NO: 428363 - RNA, 64 nt, Human
ccccccugcuucaggaacacccgccagggcccaccccucccaccccgucccagcauucgcacuu

SEQ ID NO: 428364 - RNA, 64 nt, Human
cugcuauaagaaaagcagacgcagcagcugggaccccucccaaccucaaugcccugccauuaaa

SEQ ID NO: 428365 - RNA, 64 nt, Human
cgaccagggugagaauaaagacgucuccucaggacccucccaggagaguacauggcauugagac

SEQ ID NO: 428366 - RNA, 64 nt, Human
gccuugggcugcuaugggggauggcaccucucagcccucccaggaaacacacagagcucugggc

SEQ ID NO: 428367 - RNA, 64 nt, Human
cccgcggcgccgccuccucccuggucccucgaaaucguggcaucucacuucugagaacgaaauc

SEQ ID NO: 428368 - RNA, 64 nt, Human
ggucacacacgcgcccgguggagcacgagagaccucguggcagcaugugaucuggaaggcaggc

SEQ ID NO: 428369 - RNA, 64 nt, Human
gccggggcuugucuuauguuuccaucuguuuucuucguggcauucaauuucauuuuuuuccuuu

SEQ ID NO: 428370 - RNA, 64 nt, Human
cuuuaacaagcuauucuguuuugugucaauugguucguggcaggaagcuauuagaagucaaacg

SEQ ID NO: 428371 - RNA, 64 nt, Human
uggggaggugacuugcaugguggggacaaggcugucguggcaaccuugggaucgaguuugagac

SEQ ID NO: 428372 - RNA, 64 nt, Human
ccccugcccugcugccgccucccagccuggggggucguggcagauaaucagccucuuaaagcug

SEQ ID NO: 428373 - RNA, 64 nt, Human
guuuuugaaguguugaagcugugcuccccuuaaaucguggcaggagagauuaagguaauuacaa

SEQ ID NO: 428374 - RNA, 64 nt, Human
uaaugugaagguuuguaaauaguccaugaugaugucguggcagagucugauuucuauauagagg

SEQ ID NO: 428375 - RNA, 64 nt, Human
caccaccagguggauguggagcaggagagcuggaucguggcauuuguuucuggguucugcagcu

SEQ ID NO: 428376 - RNA, 64 nt, Human
gucucugcccaccagaugccagcacucccaccauucguggcaaccaaggaugucuccagacacu

SEQ ID NO: 428377 - RNA, 64 nt, Human
augggcuucugugagacuuaucacacauaguguaucguggcaugaagcccggcacauagcaggc

SEQ ID NO: 428378 - RNA, 64 nt, Human
gccguagauauacuuuagguuaguauuucuacauucguggcaagcauuuugguaacaccagugg

SEQ ID NO: 428379 - RNA, 64 nt, Human
uuaaacaggaaauuaaacacugcaaaaggaguguucguggcaguguuccucugaccccugaccu

SEQ ID NO: 428380 - RNA, 64 nt, Human
uuuacuguauauuuaaaauuauaaauuaauguuuucguggcauguaaauuuuuaugguacagau

SEQ ID NO: 428381 - RNA, 64 nt, Human
aacagcugaucagaggacucuaucuaaauugugaucguggcagauagagauggagucauguacu

SEQ ID NO: 428382 - RNA, 64 nt, Human
agaggguagguaccagaagacccagaaacucuuaucguggcacuguugcagcuuccucugcccu

SEQ ID NO: 428383 - RNA, 64 nt, Human
ggaagauggcuuauugguuuuaaccagauugucaucguggcacugucugugaagacggauucaa

SEQ ID NO: 428384 - RNA, 64 nt, Human
aagugaaugucagccuaagaggccaagcugcagaucguggcaacagaugagcucuguuaaccuc

SEQ ID NO: 428385 - RNA, 64 nt, Human
cuaaacaggacacaggggucugauuugaagccccucguggcagggcguuuucuguccuguggug

SEQ ID NO: 428386 - RNA, 64 nt, Human
acuuauuuucaaaggaacacugagcaauaaaguaucguggcauuuaugcaaaaaaaaaaguuaa

SEQ ID NO: 428387 - RNA, 64 nt, Human
aggcccaggucccgaaagaugcagugacuuuuugucguggcagccaguggugacuggauugacc

SEQ ID NO: 428388 - RNA, 64 nt, Human
uuaguaacacggacaaggcuccucgccaaggaacucguggcagaagagggcagcaguuggcagu

SEQ ID NO: 428389 - RNA, 64 nt, Human
caguuaccugcacaccgagucacggacuccugcaucguggcacuccucucgcaugguguggagg

SEQ ID NO: 428390 - RNA, 64 nt, Human
caucucuacuaaaauuacaaaaauuagccgggugucguggcacacaccuguaaucccagcuauu

SEQ ID NO: 428391 - RNA, 64 nt, Human
ucaacaaauugggcaaugcuugugugauucacaaucguggcauuuaaagugcacaaaguacaaa

SEQ ID NO: 428392 - RNA, 64 nt, Human
gaaccugggagguggagguuucagugagcugagaucguggcauugcacucuagccugggcaacc

SEQ ID NO: 428393 - RNA, 64 nt, Human
ucggguggcaccucgcuggccaggcucucccgagucguggcaccuccacaaugugaauuuucug

SEQ ID NO: 428394 - RNA, 64 nt, Human
uuaauuuucuuaguaaaaagaauaacagaaugcaucguggcaauccuuaagcaacauuaucuau

SEQ ID NO: 428395 - RNA, 64 nt, Human
gcccagggcaguggcuuuccugaggcagcagccuucguggcaagaacuagcgugagcccagcca

SEQ ID NO: 428396 - RNA, 64 nt, Human
gccccagcugcucuucuagggaccuauggggccuucguggcaucucugugcugugugcugggga

SEQ ID NO: 428397 - RNA, 64 nt, Human
agcauacaggaggaucaaaggaggugacggagcaucguggcacggcagucucaaugggucagaa

SEQ ID NO: 428398 - RNA, 64 nt, Human
gcagagaugaggcgggugguggacagcugggcugucguggcagggucugcacagggccaugucc

SEQ ID NO: 428399 - RNA, 64 nt, Human
guaggccaaccaagcacuucaugaagaggaggccucguggcauauucaguuuacaccugaaaua

SEQ ID NO: 428400 - RNA, 64 nt, Human
ggggcuggggcaggaggcuccuggagcgcuggauucguggcacagucugaggcccugagaggga

SEQ ID NO: 428401 - RNA, 64 nt, Human
caaugguggucuuggcaacagaaugcucagccccucguggcaggacuugacaagggcaagcuug

SEQ ID NO: 428402 - RNA, 64 nt, Human
auuccgugggucccugugacauauugcauuaagaucguggcacuugcuuuuuugucuuucacau

SEQ ID NO: 428403 - RNA, 64 nt, Human
ccgggagcccgccccgcuucccccagagacuguaucguggcaccguggcgcguggcgcuggagc

SEQ ID NO: 428404 - RNA, 64 nt, Human
ggcagcugagaaugcccagaaagugccagaagcaucguggcauuuccagaaccauggauucugc

SEQ ID NO: 428405 - RNA, 64 nt, Human
uuugcacucugucccucaacacuagaaaugcugcucguggcacaaucuaagucauuacccgaag

SEQ ID NO: 428406 - RNA, 64 nt, Human
ccacguuaauaaagccaaaagcagcgggugcuauucguggcaacacacuucacugaacccacuu

SEQ ID NO: 428407 - RNA, 64 nt, Human
uuaccuauggaagugguucuauguccauucucauucguggcauguuuugauuuguagcacugag

SEQ ID NO: 428408 - RNA, 64 nt, Human
auuggucucaaagauucagucacagcuguuguuuucguggcauuuggcaccucugucccaggug

SEQ ID NO: 428409 - RNA, 64 nt, Human
uauuauaauauugaucaguuuuaugccgcauuguucguggcaguagaccacaucuguucgucug

SEQ ID NO: 428410 - RNA, 64 nt, Human
ggacagugugggugggagaccagggcuuugcaauucguggcauccuuuaggauaagagggcugc

SEQ ID NO: 428411 - RNA, 64 nt, Human
ucgcggggauuguggggggcaguagcuggcuguuucguggcauuucuguggcucugcaguguuc

SEQ ID NO: 428412 - RNA, 64 nt, Human
acuguuccagcccaggccaagcacagggucuggcucguggcaaaccuugaauaaauauuuguug

SEQ ID NO: 428413 - RNA, 64 nt, Human
ccuggggcgcaacuggacaugccacuccccggccucguggcagugauggccccugcagaggcag

SEQ ID NO: 428414 - RNA, 64 nt, Human
ccucuucccugucuacugcucaggcucucccacuucguggcauccauguaaaguagguggcagg

SEQ ID NO: 428415 - RNA, 64 nt, Human
ccauuggauucacugucaguggagauacuaccucucguggcaaccauagagaucgagcuucagg

SEQ ID NO: 428416 - RNA, 64 nt, Human
ccugagaugcaggugaugccauuacagaaccaaaucguggcacguauugcugugucuccucuca

SEQ ID NO: 428417 - RNA, 64 nt, Human
ccacugaugcagcuuagaaccacaccccugagagucguggcaaaccuuucacaaccuggaaaau

SEQ ID NO: 428418 - RNA, 64 nt, Human
aggggugcacaguccacagcugaagagcaagguuucguggcagcacggcccggccccucacccu

SEQ ID NO: 428419 - RNA, 64 nt, Human
ugaguggcgacugccuccaccucauucccgugacucguggcaugcgcaggugcuggagcuuggc

SEQ ID NO: 428420 - RNA, 64 nt, Human
caacagucugagcaagagaccugcagccccuguuucguggcagacagcaggugccuggcgguga

SEQ ID NO: 428421 - RNA, 64 nt, Human
cagagguagacaggucaccuuacuaccuccucccucguggcagggcucaaacugaaagagugug

SEQ ID NO: 428422 - RNA, 64 nt, Human
uugaguguuacucguuacuguugaggucagugcuucguggcaaauggcuguacuggauauccca

SEQ ID NO: 428423 - RNA, 62 nt, Human
cuccaaucgaagacuauuaaaagaaguggcugucguggcaagguagaccacaaugcuggauc

SEQ ID NO: 428424 - RNA, 64 nt, Human
gguuuuuccucugugacugggccgucuuggugucucguggcacgcgucacaguggugcuagucu

SEQ ID NO: 428425 - RNA, 64 nt, Human
ccgcuacugaguacuuggaauccuguguccugucucguggcaacaaggcuauguucuguuagga

SEQ ID NO: 428426 - RNA, 64 nt, Human
cuuucaugccuacacaccccucauuaaagcagagucguggcaucucacccagggugucugugug

SEQ ID NO: 428427 - RNA, 64 nt, Human
gaggacaucucggucguuugaggggcauggccagucguggcaggccggccuucagcguccgguc

SEQ ID NO: 428428 - RNA, 64 nt, Human
acaucccagugggcucugacccccugaucucaacucguggcacuaacuuggaaaaggguugauu

SEQ ID NO: 428429 - RNA, 64 nt, Human
uguagccauuucagcugucuuuugauuaauguuuucguggcacacauauuuccauccuuuuaug

SEQ ID NO: 428430 - RNA, 64 nt, Human
uggaauaagcuggacgucggcgcaaucuugcucuucguggcagggcugaccugcaggugagugg

SEQ ID NO: 428431 - RNA, 64 nt, Human
cgccuccuccgccuccuccacgagagaaggacagucguggcagccgggggccguggccacauua

SEQ ID NO: 428432 - RNA, 64 nt, Human
aggauacguggcuuuaguaagcagaccaagcgcuucguggcagggaaagcagcgugcggggaag

SEQ ID NO: 428433 - RNA, 64 nt, Human
ccucccgccgccacugcccaaccuuuccugauaaucguggcaugcgcccuuuccucuucccugc

SEQ ID NO: 428434 - RNA, 64 nt, Human
uuggaauuuucugggcccaguucccacgugccuuucguggcagucuaaccucaggccauucucu

SEQ ID NO: 428435 - RNA, 64 nt, Human
ugugcauggcauggagaaugcagaggugagccugucguggcaggacugcaccaguguauccaca

SEQ ID NO: 428436 - RNA, 64 nt, Human
ugagauuuuaggggaauucuaauguuguacccuuucguggcagcuuugacuguuggcauagcca

SEQ ID NO: 428437 - RNA, 62 nt, Human
guagcucaccccggucacgcaugaaggcaaaagcaggucagaagcgaauacucugccauuau

SEQ ID NO: 428438 - RNA, 62 nt, Human
ugccucaccucccgcaggccgccacacuuauugcaggucagugauccuuuggaguuugaauu

SEQ ID NO: 428439 - RNA, 62 nt, Human
ggaccaaccuucagcucuggaaccuucauaaagcaggucagcguggccugauugucccagga

SEQ ID NO: 428440 - RNA, 62 nt, Human
auauaccucaggcugaaauuuggggugggauagcaggucaguugaucuucugcaggaaggug

SEQ ID NO: 428441 - RNA, 62 nt, Human
uuucuaccagggcaccagaucccuuccauggagcaggucaucucggguucacugggccaggg

SEQ ID NO: 428442 - RNA, 62 nt, Human
aaagugauuuuuaugcucgcacuauaaauauggcaggucaguucauucuuuugggaagucag

SEQ ID NO: 428443 - RNA, 62 nt, Human
auuggucuuuuauccuggcucugaaugacccugcaggucaucaugguuuucuuuuuuuauug

SEQ ID NO: 428444 - RNA, 62 nt, Human
gugccagcccucacccauacaccuccagggcugcaggucauuagccagaauaaaggaugucc

SEQ ID NO: 428445 - RNA, 62 nt, Human
agcugccuaguaggcugaagcuucaggacucugcaggucaaggauaugugaugagcaccggc

SEQ ID NO: 428446 - RNA, 62 nt, Human
ggaggccucugguuggcucucucaggaagagggcaggucagggauugggcgguguaaauuga

SEQ ID NO: 428447 - RNA, 62 nt, Human
cugccccuccaaguuggggacggagauggggagcaggucaggcccucccuaggccuguuugu

SEQ ID NO: 428448 - RNA, 62 nt, Human
ccauucaguguuuccugggccucugcucagaggcaggucaccacugggcccuguggaucaau

SEQ ID NO: 428449 - RNA, 62 nt, Human
gcuccaccaauugagucucucccaccaugcaugcaggucacugugugugugcaugugugccu

SEQ ID NO: 428450 - RNA, 62 nt, Human
ugcuuuauuaggugacuuccuuuuaggcgauggcaggucaugaaauagguacacuaauaauu

SEQ ID NO: 428451 - RNA, 62 nt, Human
cagguccagucacugcaaaagugaccaagccagcaggucacccuuaacuucagaaacaauua

SEQ ID NO: 428452 - RNA, 62 nt, Human
auguggcaacacuguuuugugauuuuauuugugcaggucaugcacacaguuuugauaaaggg

SEQ ID NO: 428453 - RNA, 62 nt, Human
cuggagucuggaguguggagccccacagucuugcaggucacaugcucuccuugcacaucugg

SEQ ID NO: 428454 - RNA, 62 nt, Human
ugaaccaaguggcagccccaggggccugcccugcaggucacagcuaaacaagucuggcagaa

SEQ ID NO: 428455 - RNA, 62 nt, Human
ggcuucccuuucuugaggaccuuguguuccuggcaggucacuugcuugugguguuuucguuu

SEQ ID NO: 428456 - RNA, 62 nt, Human
aacaauuugucuuucuguucgcugaauauauugcaggucaugcucccaugccccccuuucua

SEQ ID NO: 428457 - RNA, 62 nt, Human
gugugucagaaccaacgaguguaauggagagggcaggucaucucuuauuguuucuaaaacaa

SEQ ID NO: 428458 - RNA, 62 nt, Human
cugcaaccuucccuagcccccucaauagaugagcaggucaggcuguggcccuuaccucaccc

SEQ ID NO: 428459 - RNA, 62 nt, Human
gaugacuuauaugagggcagauucaagagccagcaggucaaaaaggccaacacaaccauaag

SEQ ID NO: 428460 - RNA, 62 nt, Human
uccaaggucccauuuucccccuguguuuucacgcaggucauauugucaguccuacaaaaaua

SEQ ID NO: 428461 - RNA, 62 nt, Human
gucuggacacugccacauggagccacugucaugcaggucauaucagaucugagugccccaca

SEQ ID NO: 428462 - RNA, 62 nt, Human
gaugcuuagggaaagacccugcucaggacccagcaggucagcaccccagagcagacugauag

SEQ ID NO: 428463 - RNA, 62 nt, Human
gucaaggguagaaguuaaaggagaaucugaaggcaggucagggaaaagaagaacuggaaaug

SEQ ID NO: 428464 - RNA, 62 nt, Human
ggagaaggaacaaggcuauuugaaaacagaaggcaggucaaggguagaaguuaaaggagaau

SEQ ID NO: 428465 - RNA, 62 nt, Human
uauccuguucuguaagaucagauguuuuuauugcaggucaauauaauacugccagagacaga

SEQ ID NO: 428466 - RNA, 62 nt, Human
ggccuggcagggggugaaggcaggaguugggggcaggucaggaccaggacccagggagaggc

SEQ ID NO: 428467 - RNA, 62 nt, Human
uagacauuuaucaaagaaguuaaaaugguguggcaggucauuaggauuaggcagaaucucuc

SEQ ID NO: 428468 - RNA, 62 nt, Human
auaagacccauaggcaaacuucgagcccaucagcaggucaacccuaugcugggaaagugagg

SEQ ID NO: 428469 - RNA, 62 nt, Human
ccccaacaguugguugucuugucuuccagggugcaggucacugagugacuuccccagggugc

SEQ ID NO: 428470 - RNA, 62 nt, Human
uccauccccuuacuuucugccauggaguuccagcaggucacucucccuggcacaccuuccag

SEQ ID NO: 428471 - RNA, 62 nt, Human
uuauuuagauacuuucuuccuucacucacccagcaggucaguuuucugugcaaacaaaccug

SEQ ID NO: 428472 - RNA, 62 nt, Human
gaugaaaauaggaagugcccuggagggggccagcaggucacggggcagaaucucucagguug

SEQ ID NO: 428473 - RNA, 62 nt, Human
auuauguauugguggggcuggguaccaaugcugcaggucaacagcuaugcugguaggcuccu

SEQ ID NO: 428474 - RNA, 62 nt, Human
ucacgauaaaaguuaaacaaagaaagcuguaugcaggucauauaugcaugagaauucaacua

SEQ ID NO: 428475 - RNA, 62 nt, Human
guaaauccuugccgccugcugaaacauggugugcaggucaacggagaauacuagcugcuccu

SEQ ID NO: 428476 - RNA, 62 nt, Human
ucuuccucuguuacauccugcuacacucauccgcaggucaccuuaguucaccuacccugagu

SEQ ID NO: 428477 - RNA, 62 nt, Human
gguaaacuaaccugguauuuuaagagaaaacugcaggucaguuuggaaugaagaaauugugg

SEQ ID NO: 428478 - RNA, 62 nt, Human
agacccuuaauugauagaccauaccagguucugcaggucagcaucauuguguaaugagagug

SEQ ID NO: 428479 - RNA, 62 nt, Human
cugggggaucaccagccccaaggucccgaagggcaggucagagggagagaggcuggagaccu

SEQ ID NO: 428480 - RNA, 62 nt, Human
ucgcggaucacaccacacugggcacgugguuugcaggucaaaggggcguuuuaaagcagcug

SEQ ID NO: 428481 - RNA, 62 nt, Human
ccggagugaccuggacguggccagaucuucucgcaggucacaagaagccagugagcccuugc

SEQ ID NO: 428482 - RNA, 62 nt, Human
gaguguucccacuggagucucugguagaauuagcaggucaugcugucaaaaucauggacaaa

SEQ ID NO: 428483 - RNA, 62 nt, Human
ugacuguccugcucacccacagccgaucugcugcaggucagcaacugugucgugagcagcug

SEQ ID NO: 428484 - RNA, 62 nt, Human
gcagggccugcugguguguuggagccugcagggcaggucaggcugguucagaggcccaugcu

SEQ ID NO: 428485 - RNA, 62 nt, Human
agaugcauauaaaggguggaaugggagccauggcaggucauagaguccucucaaugggaacc

SEQ ID NO: 428486 - RNA, 62 nt, Human
gggaaggccccuacuuuugcacuucuccaagugcaggucacaccaggggcagacccugucgc

SEQ ID NO: 428487 - RNA, 62 nt, Human
ccacccuccccuuaaacccucugccuuugaaagcaggucauguucacugcgaugcuggacac

SEQ ID NO: 428488 - RNA, 62 nt, Human
auuucaguuuuauaacagacuuuaccuuccuggcaggucauuguaguuaauuaugucucuag

SEQ ID NO: 428489 - RNA, 62 nt, Human
guuuucuguuuaaaucauuguauaaaguaauugcaggucagaauuauaccacagaacuguuu

SEQ ID NO: 428490 - RNA, 62 nt, Human
acuauguugaugauucauaucaaauucucaaugcaggucauuacuguaaguuuuccauuuuu

SEQ ID NO: 428491 - RNA, 62 nt, Human
aauugguggagagaagcucugaggcacgucaugcaggucaagaaagcuuucuuugcaguagc

SEQ ID NO: 428492 - RNA, 62 nt, Human
cgugugguggcuccaagccaagcaccuggcaugcaggucagcccuucccagcgggcguggcg

SEQ ID NO: 428493 - RNA, 62 nt, Human
cuauaucuugguagauguauuucaucccuagagcaggucagccuccuuccccuaaugcgaau

SEQ ID NO: 428494 - RNA, 62 nt, Human
agcccaaagccugaggacagaaagacccugaugcaggucagcccauggaggcagaugcccuu

SEQ ID NO: 428495 - RNA, 62 nt, Human
auuugggguaagaggaagugagaucuccgcuugcaggucagccccugccuugcagggcgggc

SEQ ID NO: 428496 - RNA, 62 nt, Human
uucugaugcaucguuuucuuugcugugccaaagcaggucagaagagggagaggaggggcugg

SEQ ID NO: 428497 - RNA, 62 nt, Human
uacaggaucuucaguuauucgaggggaaugaggcaggucaagccgaugcuagccacuaguuu

SEQ ID NO: 428498 - RNA, 62 nt, Human
ccucacucaacacuuugaauacuuauuguuuggcaggucauccacacacuucugcccccacu

SEQ ID NO: 428499 - RNA, 62 nt, Human
uugcguggggcauguaggugggggaggcgucugcaggucaccuggggggcccagcccucucc

SEQ ID NO: 428500 - RNA, 62 nt, Human
agccagcaaggggccgugccagugcccagagagcaggucagacaacaggcaacccugaggca

SEQ ID NO: 428501 - RNA, 62 nt, Human
gagguggcucgacugcucaaccucaccgagaggcaggucaagaucugguuccagaaccgcag

SEQ ID NO: 428502 - RNA, 62 nt, Human
ugcugggcaugcuucguagagggccaggagcagcaggucaugugcacaugccguugcagcac

SEQ ID NO: 428503 - RNA, 62 nt, Human
auuuaagccuacuccugacuaacuuggcauuugcaggucaagcaggaagcaguugacaagac

SEQ ID NO: 428504 - RNA, 62 nt, Human
uccuccuuccagaugcccgagcaccgugucgggcaggucagcgcgguccugacuccgucaag

SEQ ID NO: 428505 - RNA, 62 nt, Human
auccacuucaucaccuaugaguuccugcaggagcaggucaacccccaccggaccuacaaccc

SEQ ID NO: 428506 - RNA, 62 nt, Human
gcgugcacaucugcuguggucugaagugguuugcaggucagccuccucucccuaguguagag

SEQ ID NO: 428507 - RNA, 62 nt, Human
agccaagcccagaggcaguggcuggggucccugcaggucaugaggggccuaugccuuuacuc

SEQ ID NO: 428508 - RNA, 62 nt, Human
uacaugcgucaagauuuguagcaguaauaacugcaggucacuuguauguaauggaugugagg

SEQ ID NO: 428509 - RNA, 62 nt, Human
uguuuauguaacauaguccagagaacugacaugcaggucaaaagucagauacgcaaccuccu

SEQ ID NO: 428510 - RNA, 62 nt, Human
gucucuccacccugcaggggcccagacugccugcaggucaggcacaggggcaucuaccuaga

SEQ ID NO: 428511 - RNA, 62 nt, Human
ggguuaggugacuaaaagggcuucggccacaggcaggucacagaaaggcagguuucauuucu

SEQ ID NO: 428512 - RNA, 62 nt, Human
auuaaaccugcuuggcuguguuuauccgcagggcaggucacagauaggguuggcugugccac

SEQ ID NO: 428513 - RNA, 62 nt, Human
gacuuggccccuccaccugucccuaacggacggcaggucaggaaagccaggacucaggggag

SEQ ID NO: 428514 - RNA, 62 nt, Human
cuugcucaggcucagagggaccucaccccugagcaggucaggacucagaacagucuggcguc

SEQ ID NO: 428515 - RNA, 62 nt, Human
acugccccgguacgagggggcccaagacccuggcaggucaggggcccuggccaagccagauc

SEQ ID NO: 428516 - RNA, 62 nt, Human
auccuggcaagaaagcuugagucucaaggguggcaggucacugucacugccgacaucccucc

SEQ ID NO: 428517 - RNA, 62 nt, Human
aaauuugccaucaccuuuugugugguggccuggcaggucauauacuuuuuuuuggcauauac

SEQ ID NO: 428518 - RNA, 62 nt, Human
aucagugaagcagcagugaaaccaggggcucugcaggucacuugggacggacgccaccagac

SEQ ID NO: 428519 - RNA, 62 nt, Human
gcuccugcuaugguuccacagggcuucuucucgcaggucagcuccuuagagaggucucccag

SEQ ID NO: 428520 - RNA, 62 nt, Human
auauuagauuucuuuccccaagggauuauguggcaggucauuauggccuucuuuuuuuuggc

SEQ ID NO: 428521 - RNA, 62 nt, Human
aaaaggaaauccaagcccugagguaggaaugagcaggucagauucaaggcagugaggucagg

SEQ ID NO: 428522 - RNA, 51 nt, Human
ccaccucugaggucaacuaaggcaggucacucagagaucaggaccagugcu

SEQ ID NO: 428523 - RNA, 62 nt, Human
auucuugcuaacauagcaguacuuugcugugagcaggucagcaggaacccuuuucugcaguc

SEQ ID NO: 428524 - RNA, 62 nt, Human
acaacagcagugagccagaggagcacaggcgggcaggucacugcagagacugauggaaguua

SEQ ID NO: 428525 - RNA, 62 nt, Human
uguugggagguaaugcugccccacgugcuggugcaggucaguauccugggacuuggaagcug

SEQ ID NO: 428526 - RNA, 62 nt, Human
gcggagacagucgccagcagcugggcuggggugcaggucaucacaggacggcuccugggcag

SEQ ID NO: 428527 - RNA, 62 nt, Human
aaauuaaauaaacagaauguccccaggagucagcaggucacagucuggcuuugugaugguug

SEQ ID NO: 428528 - RNA, 62 nt, Human
gugggucacccccccagauccaaggagaaacugcaggucaagggcugauaacggccaugcag

SEQ ID NO: 428529 - RNA, 62 nt, Human
gacauaaggaaaguaagugcucagaaaaaugugcaggucaauaaguugcaaaaguuggggcu

SEQ ID NO: 428530 - RNA, 55 nt, Human
gcaggaguuccgauaagugaagugagcaggucaacaguaggacuggggcagaagc

SEQ ID NO: 428531 - RNA, 62 nt, Human
cgcauccgucgccugccaaacugaaggcuacugcaggucacugaguugccugccauccaaag

SEQ ID NO: 428532 - RNA, 62 nt, Human
cucaagugaaacaagguugacaaacucacuucgcaggucacaugccuauacaucacuuauua

SEQ ID NO: 428533 - RNA, 62 nt, Human
ugcacucccccggggugucgcucuccccuccugcaggucagcagcugauccugauccaccuc

SEQ ID NO: 428534 - RNA, 62 nt, Human
aaguuuuuggaccuucuguuccaaaaccuuuugcaggucaaucuuuguauuugaaaugaucc

SEQ ID NO: 428535 - RNA, 62 nt, Human
ccugaagcaagcaaagaauauggcaguguaaugcaggucauuuagaaaaaaacaauguuggg

SEQ ID NO: 428536 - RNA, 62 nt, Human
gcaucaucacuuuccauuagcuguauuggcuugcaggucacauuuuuacuaccagcuuuaga

SEQ ID NO: 428537 - RNA, 62 nt, Human
aucccaaauaggagaaccucucacaagcuggggcaggucaccuuaucuuuguaagaugagga

SEQ ID NO: 428538 - RNA, 62 nt, Human
agcuucaugccucuuccacacagcguuuccaugcaggucaggggaugggaggggucccugag

SEQ ID NO: 428539 - RNA, 62 nt, Human
auugcuguaaagauguaaguuguguauguuuggcaggucacauugaauggcagugauaauga

SEQ ID NO: 428540 - RNA, 62 nt, Human
gaccaggccauggaugaaggacaaagaccagggcaggucacggguuucccaauuccccagca

SEQ ID NO: 428541 - RNA, 62 nt, Human
augagccagguacauaacgcggcacauuuucugcaggucagcaguaagguuucaagguacag

SEQ ID NO: 428542 - RNA, 62 nt, Human
gccuuaugggcugaaguguucucuagaauccagcaggucacacugggggcuucaggugacga

SEQ ID NO: 428543 - RNA, 62 nt, Human
uuagaccuuuaauucuagcacuuugaauucgagcaggucagcgucuucucucgccacgacgg

SEQ ID NO: 428544 - RNA, 62 nt, Human
caucaguuuuguuuacucauccuccaggaacugcaggucaaguugucagguuauuuauuuua

SEQ ID NO: 428545 - RNA, 62 nt, Human
uuucuaugccugaggugcccggggaggcugcagcaggucagcgagugaguggaggggaaguc

SEQ ID NO: 428546 - RNA, 62 nt, Human
cuguuuuagucagagaccacccaacuuagcgugcaggucaccggaguggguggagggucaga

SEQ ID NO: 428547 - RNA, 62 nt, Human
auggucacucugccaucuuggugguugguggggcaggucauuuggaaauaaagaaugugaua

SEQ ID NO: 428548 - RNA, 62 nt, Human
cagguccaacuccuggcaaccgcgggcucaaggcaggucauuggaauccacguuuuggccac

SEQ ID NO: 428549 - RNA, 62 nt, Human
gggccugaggucaucggcguggcccaaggcuggcaggucaaccucgcgcuugcuggccaguc

SEQ ID NO: 428550 - RNA, 62 nt, Human
gcccgcacgggcacuuuuguuggaaacagugggcaggucauggggccuccucaucagagggu

SEQ ID NO: 428551 - RNA, 62 nt, Human
ugcaauggggaaaugacuuauaaagucacccagcaggucaacaaugggcccacgaccaagac

SEQ ID NO: 428552 - RNA, 62 nt, Human
uggucacaucagaggucaacagcagaacagaggcaggucaggguuguccgcucugauuagca

SEQ ID NO: 428553 - RNA, 62 nt, Human
gaggccugguuugucaggcaauaugcccuugagcaggucacccccugggaaugggggguacu

SEQ ID NO: 428554 - RNA, 62 nt, Human
agauaaaugcgucuuuaaaaauagucucuguggcaggucacugggggacaauguacagcauu

SEQ ID NO: 428555 - RNA, 62 nt, Human
uagaggccuauuaaacaugacguuauccaauugcaggucaacuuauaguuguagccuuacaa

SEQ ID NO: 428556 - RNA, 62 nt, Human
cuuaaagauugaaaagauaacauguaggccaggcaggucacugcacaacuaaagcaaaccag

SEQ ID NO: 428557 - RNA, 62 nt, Human
uuacacuuugccgggaccaucagggccgccaagcaggucaggggcugggggcugggggcugg

SEQ ID NO: 428558 - RNA, 62 nt, Human
aaccucauggcccgagcugaauacuugaaggagcaggucaaggugggcacaugggggccacg

SEQ ID NO: 428559 - RNA, 62 nt, Human
agcucugcugcucacuugcuguguggccucaagcaggucacuggccucucugggccucaguc

SEQ ID NO: 428560 - RNA, 62 nt, Human
ccuugcccaguggccuguggcgcccaaagcuggcaggucaggcaagcagccugcaccacccu

SEQ ID NO: 428561 - RNA, 62 nt, Human
uacugugcagacugaccaccggccucccgccugcaggucagaggcucugacacugucugguu

SEQ ID NO: 428562 - RNA, 62 nt, Human
agaggcccaagggcaauaauaagguggaauuugcaggucagcccaggaauuggcagaggaag

SEQ ID NO: 428563 - RNA, 62 nt, Human
ucacaauuacaccacuuuagacccuauguguagcaggucacaacuuacccuuguguguuuag

SEQ ID NO: 428564 - RNA, 62 nt, Human
ccuggccauagaaugauggaaagggaaggucagcaggucaaagcaggaucagccaacaaccu

SEQ ID NO: 428565 - RNA, 62 nt, Human
ccagcucuccugauacucgggauccucaggacgcaggucacauucaccugugggcagaggga

SEQ ID NO: 428566 - RNA, 62 nt, Human
cucucuugacagggagcucacuaccucacaaggcaggucauuucauugugggaucuauagaa

SEQ ID NO: 428567 - RNA, 62 nt, Human
uuacugaacaccacucugugcuaagcccuagagcaggucaaaaacauaaaaucccugccuuc

SEQ ID NO: 428568 - RNA, 62 nt, Human
ccacccuccucagaggcccggggaagggaagagcaggucaguacagagguucugucuacagg

SEQ ID NO: 428569 - RNA, 62 nt, Human
gggggcccuaagggagggacuaaggcuccaaggcaggucacuuuuccuuaggcuguucuacu

SEQ ID NO: 428570 - RNA, 62 nt, Human
aguguuuauguaauaguucuauccuuuugccugcaggucaguuguaauaaaucuaggaugug

SEQ ID NO: 428571 - RNA, 62 nt, Human
ugggcugggucuaggucccucauuaaagaacugcaggucauccagcacccuaaagucugcuu

SEQ ID NO: 428572 - RNA, 62 nt, Human
gguuucucccaguucucuagggaaggccaccugcaggucacugaaacuucaagcaccaggga

SEQ ID NO: 428573 - RNA, 62 nt, Human
agugcccgucggcgucccccgggccccccacugcaggucaccuccgaccucucgcuguagcc

SEQ ID NO: 428574 - RNA, 54 nt, Human
agcaguccacagcagucugagcuggcaggucauggagcagcccccaaagagcug

SEQ ID NO: 428575 - RNA, 62 nt, Human
cccuauauuacucuccugggaucugaguuucugcaggucauuuguauguaggaccaggagua

SEQ ID NO: 428576 - RNA, 62 nt, Human
ggggguccuggcuccccugucccugcagcccugcaggucagugcaugaucuggguucguguc

SEQ ID NO: 428577 - RNA, 62 nt, Human
gcucuggacaagccgcccuucaggcugggguagcaggucaguccaggcaggaagcagcaccu

SEQ ID NO: 428578 - RNA, 62 nt, Human
ggcuggggucuaaccuugaacccucaccacgugcaggucacacacagugaagccacuuguaa

SEQ ID NO: 428579 - RNA, 62 nt, Human
uggcacccucuggggucccccuuuucucccaggcaggucaucuuuucugggagaugcuuccc

SEQ ID NO: 428580 - RNA, 62 nt, Human
gaucucuaguuuuugugguuuaauuuuuaguagcaggucaaaaaccugcccuccugugacuu

SEQ ID NO: 428581 - RNA, 62 nt, Human
caaagcuuccuaugagaagcuucugagauguagcaggucacagaaguguucaccuguuucau

SEQ ID NO: 428582 - RNA, 62 nt, Human
acuuuccugguugcacaaaaggauuucagaaagcaggucaacuaugagguggaucggagauu

SEQ ID NO: 428583 - RNA, 62 nt, Human
acuccccaccccagagucccacauucccugaggcaggucacacgucucuuuaugaugaggau

SEQ ID NO: 428584 - RNA, 62 nt, Human
uugucugcauaacaggagcucugcaggagucugcaggucacccggagcaggacggggaggag

SEQ ID NO: 428585 - RNA, 62 nt, Human
cuaacguccacuagcuuacugaguuaucaggugcaggucagacucuuggcuacagugagagg

SEQ ID NO: 428586 - RNA, 55 nt, Human
auccaaaguuuauggacuaaaugcugcaggucagcagaaauuugcacuaauaaua

SEQ ID NO: 428587 - RNA, 62 nt, Human
gccccggugcccgcagaagacgcuuuuccccagcaggucacccacggccccggaaccgcggc

SEQ ID NO: 428588 - RNA, 62 nt, Human
ugcuccugggaggugagcgugcacaggugugugcaggucaggaggugccguccaggugugcg

SEQ ID NO: 428589 - RNA, 62 nt, Human
agauuuuaaucaaacacgaccagguccgaaaugcaggucaugagugugaaauucucaaauuu

SEQ ID NO: 428590 - RNA, 62 nt, Human
cuagaagccccucugggcaugggguggacauggcaggucagccuguggaacuugcgcaggug

SEQ ID NO: 428591 - RNA, 62 nt, Human
gggagcuggauguguugcccaaggugugcagggcaggucagggaagggcaggguccccuaag

SEQ ID NO: 428592 - RNA, 62 nt, Human
uugagcaauaggcaggcaccaccguccccagagcaggucagcgucucgagaggccccuggac

SEQ ID NO: 428593 - RNA, 62 nt, Human
ccgaauccggcuucggaugaggugagggaggagcaggucaggaggggggcccucguagggac

SEQ ID NO: 428594 - RNA, 62 nt, Human
ucauuauaaaauuuugucguaaacauuaaagugcaggucagugaacaauauucaauguauca

SEQ ID NO: 428595 - RNA, 62 nt, Human
uaaccuagaauucagaugauccuggaauuaaggcaggucagaggacuguaaugauagaauua

SEQ ID NO: 428596 - RNA, 62 nt, Human
cgugaccugccuggccuccccugucucagggagcaggucacaggucaccauggggaauucua

SEQ ID NO: 428597 - RNA, 62 nt, Human
guggcaaauuuuucagagaucguucacauauugcaggucaucggugaacucauacuggagag

SEQ ID NO: 428598 - RNA, 62 nt, Human
cgggauucgggucucuaagaugucuuaugaaugcaggucagagggucacauguuaacacuag

SEQ ID NO: 428599 - RNA, 62 nt, Human
uggagaggcaggcauaggcagggaaccgagcagcaggucagagcaggcgagcugacauucug

SEQ ID NO: 428600 - RNA, 62 nt, Human
ugguuugacuauauuguuagcugccacaguaagcaggucauuguauagguaaaugccugcac

SEQ ID NO: 428601 - RNA, 62 nt, Human
uuuaagaaguaccugcaagaaaccuacucaaagcaggucaccagccaggagcccugacccag

SEQ ID NO: 428602 - RNA, 62 nt, Human
gaacugaaggaucacuggguugcagacacauugcaggucagcuucuuccucugcccaguccu

SEQ ID NO: 428603 - RNA, 62 nt, Human
ugagaccucucuggagacccagauccccuagagcaggucagagaccauccagaaucccagaa

SEQ ID NO: 428604 - RNA, 62 nt, Human
guguuuuucuuuauuauuacuuuuuuuuuucugcaggucaguaaaaggauuuaaguugcacu

SEQ ID NO: 428605 - RNA, 62 nt, Human
cuuuucuggcaaauaacaguaaagaugguuuagcaggucaccuaguugggucagaagagucg

SEQ ID NO: 428606 - RNA, 62 nt, Human
agcgcgacccugcaggugcuggacgcggugcagcaggucacgaggcccccaugucugcaccc

SEQ ID NO: 428607 - RNA, 62 nt, Human
gguccuuacgcugggcugucuggucagcacgugcaggucagggcagguccucugagccggcg

SEQ ID NO: 428608 - RNA, 62 nt, Human
uugacuuuggcaaaugagccggagccccuugggcaggucacacaaccugucccagcgaggga

SEQ ID NO: 428609 - RNA, 62 nt, Human
aggugcaggacugucggggcgagguggccgaggcaggucaaagcugaaaaguggaaucggag

SEQ ID NO: 428610 - RNA, 62 nt, Human
ccaggggagggccccggguucggcggccagaggcaggucagggguccccucucccucucccu

SEQ ID NO: 428611 - RNA, 62 nt, Human
ggcugagcuggaggugggcagggcugcuccaggcaggucagagcagugcagggggaggagag

SEQ ID NO: 428612 - RNA, 62 nt, Human
aggccagccccgaagucgccacguggccuggggcaggucacuuuaccucuguggaccuguuu

SEQ ID NO: 428613 - RNA, 62 nt, Human
uggcauacacuguuauucaugguuaagguaaagcaggucaagggauggcauugaaaaaauau

SEQ ID NO: 428614 - RNA, 62 nt, Human
ggcuacuggcucacagaagcaccuuugguucugcaggucaugccccucccugcagggaaggg

SEQ ID NO: 428615 - RNA, 62 nt, Human
aguucucccaccuuugcucauuuguaaaaugggcaggucaaucuucccaccccaccgugugg

SEQ ID NO: 428616 - RNA, 62 nt, Human
caauaauguuagggacauuauaugauuuccacgcaggucacaccaucugggccugagguagc

SEQ ID NO: 428617 - RNA, 62 nt, Human
auaaaacagccaugcucccaggugcaugauucgcaggucagcuauuuccaggugaagugcuu

SEQ ID NO: 428618 - RNA, 62 nt, Human
cccgggcugagcccuggauuggguaucguggggcaggucacccuggccacgaugcccccggc

SEQ ID NO: 428619 - RNA, 62 nt, Human
gaccagggaggccaagcagccgagcgagagcagcaggucacgcagaaaaaacugagcagcgc

SEQ ID NO: 428620 - RNA, 62 nt, Human
ggaaaagccucuuuguuaucggccuugugucagcaggucauggucccuagagacuaccuagu

SEQ ID NO: 428621 - RNA, 62 nt, Human
uguccucuucugcagguccagcccuggcgagggcaggucagaggaagugaagaaaucaagag

SEQ ID NO: 428622 - RNA, 62 nt, Human
ucucuucagaaaacaauacugcugaccaucaagcaggucauaaacagaaacaucagaagaga

SEQ ID NO: 428623 - RNA, 64 nt, Human
guggguuccuccucccaccuggcuuugaggcugucgucgauaucauaguacuuuacauggauuc

SEQ ID NO: 428624 - RNA, 64 nt, Human
uaguaaacuguguuaauugguaaugacuauuuaucgucgauacucuguagcuguguaaguuuug

SEQ ID NO: 428625 - RNA, 64 nt, Human
ugcaacacgaagcuuccagaaccauaaaauaucccgucgauaaggaaagaaaaugucguuguug

SEQ ID NO: 428626 - RNA, 64 nt, Human
ccucccccuggaacugggacuggucucggucugcugacgucagggucagcucccccgcggagcu

SEQ ID NO: 428627 - RNA, 64 nt, Human
acaugaagcaugggaagcgcacccugucguucagugacgucauucuucuccaggcuggcccgcc

SEQ ID NO: 428628 - RNA, 64 nt, Human
gugcugugagcuguccguggugcugaauucacugugacgucacuccugucucucuuugcuuucu

SEQ ID NO: 428629 - RNA, 64 nt, Human
auccucugcccuuacacccaugacugaggaccaaugacgucauguggcuuuugcaauucacgcc

SEQ ID NO: 428630 - RNA, 64 nt, Human
aggguccccuggggccccuucugcccagucccugugacgucacacugcacacacucaccaccca

SEQ ID NO: 428631 - RNA, 64 nt, Human
ccaaguccagaaggaaggaauggagcugagcaacugacgucaaauccccaagucgacucaagag

SEQ ID NO: 428632 - RNA, 64 nt, Human
ucaccuggaaucagauuauuaagggaauaagccaugacgucaauagcagcccagggcacuucag

SEQ ID NO: 428633 - RNA, 64 nt, Human
ccauagagccugcaaauggauccuccugugagagugacgucaccuccuuuccagagccauuagu

SEQ ID NO: 428634 - RNA, 64 nt, Human
aacuccauuccucauauuaaacuauuacuucucaugacgucaccauuuuuaacugacaggauua

SEQ ID NO: 428635 - RNA, 64 nt, Human
ucuccauaccccgagagcauuugccugccuguccuggacggacuccuacacugggcaguuugcc

SEQ ID NO: 428636 - RNA, 64 nt, Human
uugaauuccucuguuccuuagagcuuguguuacuuggacggaauugccaacacccuuuuuuaua

SEQ ID NO: 428637 - RNA, 64 nt, Human
gggguggggguggauggauagauggauggauggauggacggauggggugggggaaggaaggaaa

SEQ ID NO: 428638 - RNA, 64 nt, Human
guguguaguauuuucccagucagcuuugccauacugacgucaaucauuugagagaaauuauuca

SEQ ID NO: 428639 - RNA, 64 nt, Human
aaacaacaaugagugcuugagauaaaagaaagugugacgucauggucacugguacucaggcacu

SEQ ID NO: 428640 - RNA, 64 nt, Human
aggcagcagacaaagucgucuuccuucuuuccaaugacgucaacagugugugcgaugguaccug

SEQ ID NO: 428641 - RNA, 64 nt, Human
cguagcagguggugugggugcucgggaguggaggugacgucagcagcgcucucugaccgcgggu

SEQ ID NO: 428642 - RNA, 64 nt, Human
uggcucaccgugaggcagccgcgggagggagcgcugacgucacagaagcgaaggcuugaugcug

SEQ ID NO: 428643 - RNA, 64 nt, Human
cugacaaugggacaaccagggacugcucaugcugugacgucacauccucucaccaugcguuagc

SEQ ID NO: 428644 - RNA, 64 nt, Human
cagcacuuuggcaggccgaggcagguggaucaccugacgucaguaguuugagaccagccuggcc

SEQ ID NO: 428645 - RNA, 64 nt, Human
caaggcuuuaggagacccuaaagucuguuggcugugacgucauuauaccuaaaaucugcaucau

SEQ ID NO: 428646 - RNA, 64 nt, Human
agccucaaggucucccaguccagaaacagucuggugacgucaugcccuucucaugugggcagcu

SEQ ID NO: 428647 - RNA, 64 nt, Human
gcuggcauuugaauguuuccaaaucuauuuuaucugacgucaugaacacacaggcaaugauuuu

SEQ ID NO: 428648 - RNA, 64 nt, Human
gcaucacucuccacaaaaagaacagcagcgguucugacgucauggugagugacugccgaaguaa

SEQ ID NO: 428649 - RNA, 64 nt, Human
agggaaggugaguguggguccuuccuaaucccucugacgucaugucauauagguggcugccucc

SEQ ID NO: 428650 - RNA, 64 nt, Human
ugaggauuuuauuuucucccuuacuacgcuugcuugacgucacucucucucgaccuccaaacag

SEQ ID NO: 428651 - RNA, 64 nt, Human
ugauuuacuccacuuuuuaugccuuccauugugaugacgucaaacacagugaaagccuucaguc

SEQ ID NO: 428652 - RNA, 64 nt, Human
aucugugccaacucuaccuucucacuuuuaccucugacgucauucuuuuuuucugaaagaggua

SEQ ID NO: 428653 - RNA, 64 nt, Human
gcccgccagcacaguggcggcaacauugaagacguggacggaggaggggccccgacgacaggug

SEQ ID NO: 428654 - RNA, 64 nt, Human
uuccccaguaaaaccuggggaguucugcguugaguggacggacuuauuccugugaagcggcaua

SEQ ID NO: 428655 - RNA, 64 nt, Human
gugcugcuuugcuuuucaucaccgucccgcacaguggacggagguccccgguugcuggucaggu

SEQ ID NO: 428656 - RNA, 64 nt, Human
ggagccugccaagagguacuguaauggguaauucugacgucagcgcaccaaaacuauccugauu

SEQ ID NO: 428657 - RNA, 64 nt, Human
guuugguuugcuuuugacagcuucauuuuauuuuugacgucacuuuuuggccauguaaacuauu

SEQ ID NO: 428658 - RNA, 64 nt, Human
ucuggaagcacauuugagccuccaggcuucuccuugacgucauuccucuccuuccuugcugcaa

SEQ ID NO: 428659 - RNA, 64 nt, Human
cuggcuggcccgucauguuccucaaaagcacccuugacgucaagucuccuuccccuuuccccac

SEQ ID NO: 428660 - RNA, 64 nt, Human
guuucgccauuuggccaggcuggucuugaacuccugacgucaagugaucugccugccuuggucu

SEQ ID NO: 428661 - RNA, 64 nt, Human
caugagaaagaugucuauguagcugaaaauaaaaugacgucacaagacaauuggugugucauug

SEQ ID NO: 428662 - RNA, 64 nt, Human
auuuuggcaaacauuuuagaagcuugugaacacaugacgucagaucaaagaaaacagaucuucu

SEQ ID NO: 428663 - RNA, 64 nt, Human
cccagaguucacagauguugaaguuucugaagguugacgucacuggaagucugaccacaaacaa

SEQ ID NO: 428664 - RNA, 64 nt, Human
acuauggucgguuucaggaauuucaaaagaaaucugacgucaaugcaauuauccauuauuuaaa

SEQ ID NO: 428665 - RNA, 64 nt, Human
gcucagugggugcccugagcggggucucucagacugacgucaggccuuggugggcugcacucuc

SEQ ID NO: 428666 - RNA, 64 nt, Human
uuuguucugaacuuuccuguuaccuuuucagggcugacgucacauguagguggcguguaugagu

SEQ ID NO: 428667 - RNA, 64 nt, Human
uccugugugugagauguauucccauaaucaaaguugacgucaaacaucuuacuacaaaaauuca

SEQ ID NO: 428668 - RNA, 64 nt, Human
gagauacaaagcaaggagcuggugagcccagcguugacgucaggcaggcuaugcccuuccgugg

SEQ ID NO: 428669 - RNA, 64 nt, Human
gcucugggcuggucacuccgaagaagaggauuugugacgucacuuagagaagcaccuugcuagc

SEQ ID NO: 428670 - RNA, 64 nt, Human
cccugggccuuccgcggcgauggcgcugcgcuaaugacgucauaggcccggacucgcgugagug

SEQ ID NO: 428671 - RNA, 64 nt, Human
uuguaagugaucagaaaccaucuguaucaaagucuggacggaagauuaaaggaaggggcacaau

SEQ ID NO: 428672 - RNA, 64 nt, Human
uaagaugguuacagcuauguaaccuguauuauucuggacggacuuauuaaaauacaaacagaca

SEQ ID NO: 428673 - RNA, 64 nt, Human
aguucccguguaaagcacgggacggaagugcuucuggacggaagugguggcuguggaaggcgua

SEQ ID NO: 428674 - RNA, 64 nt, Human
ccagaaucuuggaacaccuggcaugugacccuagugacgucacagaccugagaugaagauucau

SEQ ID NO: 428675 - RNA, 64 nt, Human
cguuucugguuggcucagcggguuucuagggcugugacgucauggggcagcuuucggaaaauga

SEQ ID NO: 428676 - RNA, 64 nt, Human
aguccagcucgguucauuagcgauccauguaaucugacgucaucuugucucgaagucucuuuuu

SEQ ID NO: 428677 - RNA, 64 nt, Human
cauugcuguucuacuuuuugguacagguauauuuugacgucacugauauuuuuuauacagugau

SEQ ID NO: 428678 - RNA, 64 nt, Human
cucuuuaugauauugugauagggaaaaaaaucauugacgucauagaauauucuucuuccucuca

SEQ ID NO: 428679 - RNA, 64 nt, Human
uuucaccacguuggccaggcuggucuuguacuccugacgucaggugauccacccgccucggcuu

SEQ ID NO: 428680 - RNA, 64 nt, Human
uuccaggcuccagaaaaaaugaaugaacucaccuugacgucaaugcaauugaaucaccguuguc

SEQ ID NO: 428681 - RNA, 64 nt, Human
acaggcucugccacacccgugacuucauccacacugacgucacccgcgggggcucccccugcac

SEQ ID NO: 428682 - RNA, 64 nt, Human
augaugaaucggccaacagccagcccuugccagcugacgucacagucuaagaugggaaacugug

SEQ ID NO: 428683 - RNA, 64 nt, Human
gguguuucagugcggagugccaagaguccuauccugacgucaggcucugggugucaaccucuga

SEQ ID NO: 428684 - RNA, 64 nt, Human
cuaccugcugggaugggggucagccucucuuuggugacgucacguucucugggauccugaggac

SEQ ID NO: 428685 - RNA, 64 nt, Human
cugugcgugucuggaacagucccauuaggagaggugacgucauuugcuuaaaguuuuccaagcu

SEQ ID NO: 428686 - RNA, 64 nt, Human
cccucaguggacugccugcucccacagccugggcugacgucagaggccgaggccaggaacugag

SEQ ID NO: 428687 - RNA, 64 nt, Human
acuugacaauuguauugcgauggcgugggcugcgugacgucaccuccggucgugucucuggucu

SEQ ID NO: 428688 - RNA, 64 nt, Human
ugugcucuccgagagaaaaccaaggugugucaaaugacgucaagucucuauuuaaaaauaauuu

SEQ ID NO: 428689 - RNA, 64 nt, Human
cuggaugggaagaccuggagggcagccacacagcuggacggaugcugccacaucugggcauaca

SEQ ID NO: 428690 - RNA, 64 nt, Human
uucugaaaaaaauuauuccuaaacucucuaaguguggacggagaaugagcaagccccagaagua

SEQ ID NO: 428691 - RNA, 64 nt, Human
augccuauaaucccaggacuuugggaagcugagguggacggaucauuugaggucaggaguucaa

SEQ ID NO: 428692 - RNA, 64 nt, Human
uucuccguacccgcaacguggucaucugugcccgugacgucaccugugcccgugcguggcgucc

SEQ ID NO: 428693 - RNA, 64 nt, Human
cuggcaggcuuccaaacugaggaaagcuggagccugacgucagagcuuuuaacucggacaucac

SEQ ID NO: 428694 - RNA, 64 nt, Human
ggacagaggucaauccuugaugcuccagcacaggugacgucacuaauugucacuuuccaguuug

SEQ ID NO: 428695 - RNA, 64 nt, Human
ggggauggacacccccagcugacuguuggcucucugacgucaacccaagcucuggggaugggug

SEQ ID NO: 428696 - RNA, 64 nt, Human
ggcgcaaccuggugggggcccccagcagggacacugacgucaggacccgagccuccagccugag

SEQ ID NO: 428697 - RNA, 64 nt, Human
cagcacgucgcacacagacauggggaacuuggcaugacgucacaccgagaugcagcaacgacgu

SEQ ID NO: 428698 - RNA, 64 nt, Human
ggccgcggagaugacgucacgcaagcaacggcgcugacgucacauaucaccguggugauggcgu

SEQ ID NO: 428699 - RNA, 64 nt, Human
acgaucccucacccagagcacacggccgcggagaugacgucacgcaagcaacggcgcugacguc

SEQ ID NO: 428700 - RNA, 64 nt, Human
ggagcagggacacgcccuucagagcccgucucuaugacgucaccgacagccaucaccuccuucu

SEQ ID NO: 428701 - RNA, 64 nt, Human
aucacaguaauuauugauuuguacaaaaaucacuugacgucauaaccuuaaagugacacugcuc

SEQ ID NO: 428702 - RNA, 64 nt, Human
guauuuuccacaaugaugaugauuucagcagggaugacgucaucaucacauucagggcuauuuu

SEQ ID NO: 428703 - RNA, 64 nt, Human
gacuauugcuuauuuuuguuuuuaaagaccuacuugacgucauguggacagugcacgugccuua

SEQ ID NO: 428704 - RNA, 64 nt, Human
uaggguccauuccaagauugucaguugccguuagugacgucaggcccuguaaccuguguccugu

SEQ ID NO: 428705 - RNA, 64 nt, Human
uuagagggaggagaaugagccucggccucuuccgugacgucacuggaccacugggcaaugaugg

SEQ ID NO: 428706 - RNA, 64 nt, Human
ucacuccacauugaccccucccuagccuggcaggugacgucaggguccuucacagacaaacacg

SEQ ID NO: 428707 - RNA, 64 nt, Human
ggcccggaucuccaggcccuggggagggagccucuggacggacaguggggacauuguggguuug

SEQ ID NO: 428708 - RNA, 64 nt, Human
auuauugugaugauucauuuagcauaaagagagguggacggaaggguuuuccuauguaucaaaa

SEQ ID NO: 428709 - RNA, 64 nt, Human
uuucugugaaaacauuuugcucuuuggccugguguggacggaaaggguggccaaauggauugag

SEQ ID NO: 428710 - RNA, 64 nt, Human
agccaaagugacuaucucuuaagagaagauaaugugacgucaagggaaguuggaaggcauggau

SEQ ID NO: 428711 - RNA, 64 nt, Human
caggcgagagagaaacagcuacugcgugcgugcgcgcacgcauacacacacacacacacacacu

SEQ ID NO: 428712 - RNA, 64 nt, Human
caucuccugcccucucuccuuccuccccaucucucgcacgcagucuagagauggacugagccuu

SEQ ID NO: 428713 - RNA, 64 nt, Human
cacacacacacacgcacacaugcgugugcacccgcgcacgcacauacacacacacauauagcag

SEQ ID NO: 428714 - RNA, 64 nt, Human
augaacacuuugugaaacaaaucguaaguauguacgcacgcauaucaaacuaugcucugaggau

SEQ ID NO: 428715 - RNA, 64 nt, Human
uguaugugugugugugugugugugugugugcgcgcgcacgcacgccuugagcagucagcauugc

SEQ ID NO: 428716 - RNA, 64 nt, Human
cacacaugcacgcacacacacauacacacaugcacgcacgcacgcaugcacaccaauuuauguu

SEQ ID NO: 428717 - RNA, 64 nt, Human
caugcacgcacacacacauacacacaugcacgcacgcacgcaugcacaccaauuuauguuuuua

SEQ ID NO: 428718 - RNA, 64 nt, Human
uguugcuggaacauuucuaaaagacagugaugaccgcacgcauucauaaagcaaaggaguacua

SEQ ID NO: 428719 - RNA, 64 nt, Human
gucuucaagccuggcccagugagagugaggcccccgcacgcaagccucagccacucccaggggc

SEQ ID NO: 428720 - RNA, 64 nt, Human
gcaccugguaccaaggguaacccggcuccugguauggacggaugcgcaggauuuaggauaagcu

SEQ ID NO: 428721 - RNA, 64 nt, Human
cuucuucggagaagugaaauauaacauuacucaguggacggagaaaucuguuuuguuacagaga

SEQ ID NO: 428722 - RNA, 64 nt, Human
gcuggaggaccacggacauuggacucacuguggcuggacggaggggacccguggaugggggggc

SEQ ID NO: 428723 - RNA, 64 nt, Human
acgcaugcacagauaugcuguccggacacacacacgcacgcagauaugcugccuggacacacac

SEQ ID NO: 428724 - RNA, 64 nt, Human
gcacacacgugcagauaugcuguccggauacacacgcacgcacacaugcagauaugcugccugg

SEQ ID NO: 428725 - RNA, 64 nt, Human
gcgucugcucugguaggacugucagacgcacacgcgcacgcaccuagacacacccacucaugua

SEQ ID NO: 428726 - RNA, 64 nt, Human
cccaaagcuuaagucucugcaggcguggcacgcacgcacgcacccacccacgcgcacuuacacg

SEQ ID NO: 428727 - RNA, 64 nt, Human
guaucccaaagcuuaagucucugcaggcguggcacgcacgcacgcacccacccacgcgcacuua

SEQ ID NO: 428728 - RNA, 64 nt, Human
ucagaguugugugugcaaugcacacccagacacacgcacgcacacacacgcgcgcgcacacaca

SEQ ID NO: 428729 - RNA, 64 nt, Human
aggagcgcaccaaagcgcagagcuugcugcccgccgcacgcacgcgcgccugcgugcggggaug

SEQ ID NO: 428730 - RNA, 64 nt, Human
ccacgacacacgcucgggcuucugguaugucugccgcacgcagggcguggagggggaccacugc

SEQ ID NO: 428731 - RNA, 64 nt, Human
cgggaaguccugagaguguguguugguggcugugcgcacgcacacaagacgggagucacccugu

SEQ ID NO: 428732 - RNA, 64 nt, Human
gcgucgccgauuagaggacgaggaggagagauuccgcacgcaaccgaaaggguccuucggggcu

SEQ ID NO: 428733 - RNA, 64 nt, Human
uggguucauuccccggcccuccgagccgcgccaacgcacgcaacccuugcugcugcccgcgcga

SEQ ID NO: 428734 - RNA, 64 nt, Human
caccagagcauuuccaacaccacagacacacacacgcacgcacacacacaaacacacaugcaca

SEQ ID NO: 428735 - RNA, 64 nt, Human
gccgaaccucaccauauggagccagacauugggacgcacgcaugugauugugugugcacgcaug

SEQ ID NO: 428736 - RNA, 64 nt, Human
gggagcuagaggguugugacccuucauacacacacgcacgcacgcacacaaacaugcacacacg

SEQ ID NO: 428737 - RNA, 64 nt, Human
gcuagaggguugugacccuucauacacacacgcacgcacgcacacaaacaugcacacacgcaug

SEQ ID NO: 428738 - RNA, 64 nt, Human
cccuuuccuagaagggcuacugcuccuggaagaguggacggauccauaauaaagacgucccaaa

SEQ ID NO: 428739 - RNA, 64 nt, Human
gaccuccaggcagcagucucugcuccagaaucucuggacggagcugcuggcagcuucugcgaga

SEQ ID NO: 428740 - RNA, 64 nt, Human
uccugcugaacguguauuucaguguuucacuuacuggacggauaacaagaaaaaaauccuaaca

SEQ ID NO: 428741 - RNA, 64 nt, Human
acaccccaacaugccugcaccugcagcgcgcacacgcacgcacacacacauacagagcucucug

SEQ ID NO: 428742 - RNA, 64 nt, Human
uggaaaguugcugggcccccgcccccggcucccccgcacgcaugcauccacugcggccggagga

SEQ ID NO: 428743 - RNA, 64 nt, Human
caaaagccauaagccugaagauuggcccugugcacgcacgcacacacacacacacacacacaca

SEQ ID NO: 428744 - RNA, 64 nt, Human
ucgccgauccguggggcccccugugcccgccacacgcacgcacacacucuuacacgagagcaca

SEQ ID NO: 428745 - RNA, 64 nt, Human
ggcaggggggcggcgggugggcccgccccacgcacgcacgcacacucggggacuuugugcaugc

SEQ ID NO: 428746 - RNA, 64 nt, Human
cccgggcaggggggcggcgggugggcccgccccacgcacgcacgcacacucggggacuuugugc

SEQ ID NO: 428747 - RNA, 64 nt, Human
caggccauccuagaccagccagcuccagcugauccgcacgcagccacuucggcuaccuucuacu

SEQ ID NO: 428748 - RNA, 64 nt, Human
cugggacacacacacacacacacacacacacacacgcacgcacacgcacacaucuuaccucuca

SEQ ID NO: 428749 - RNA, 64 nt, Human
cccgccccucccccaucgugcugcaugaccuccacgcacgcacguccagggacagacuggaaug

SEQ ID NO: 428750 - RNA, 64 nt, Human
ccugaacucagaaggcugugugucuucugccccacgcacgcacccguaucugcccuccuugcug

SEQ ID NO: 428751 - RNA, 64 nt, Human
cacgcagacaggucgauuugcccaggcccgcgcccgcacgcacgcacgcacacggccccgcaca

SEQ ID NO: 428752 - RNA, 64 nt, Human
cagacaggucgauuugcccaggcccgcgcccgcacgcacgcacgcacacggccccgcacacagc

SEQ ID NO: 428753 - RNA, 64 nt, Human
caggucgauuugcccaggcccgcgcccgcacgcacgcacgcacacggccccgcacacagccccg

SEQ ID NO: 428754 - RNA, 64 nt, Human
ccugcccaccacgcacucccggagagcacggaaccgcacgcacgucaggcaccggcuggggauc

SEQ ID NO: 428755 - RNA, 64 nt, Human
aggcagggagaggccggcuggagccaggcccccucgcacgcagcccccaaaucauggacgcacc

SEQ ID NO: 428756 - RNA, 64 nt, Human
uggauguaguuuuuuuuuguuuuuuuuuuguuuuuggacggagucuuagucugucacugaggcu

SEQ ID NO: 428757 - RNA, 64 nt, Human
ccacagagauacacagauauauacacacaguggauggacggacaagacaggcagagaucuauaa

SEQ ID NO: 428758 - RNA, 64 nt, Human
ucaaugagaagccuucucacugaaagagcugcccuggacggaaaaugaguagugagaugaugcu

SEQ ID NO: 428759 - RNA, 64 nt, Human
acuccuguaaucccagcacuuugguaggccgagguggacggaucacccgaggucaggaguuuga

SEQ ID NO: 428760 - RNA, 64 nt, Human
ggaugguucggcaaagcagccugaguuauuuuuguggacggaaucggaacacgcuggcuccaua

SEQ ID NO: 428761 - RNA, 64 nt, Human
cugggccuuuccagcccaacccacugucuugcaguggacggagagccuuggcgagggcagcagg

SEQ ID NO: 428762 - RNA, 64 nt, Human
accugacagccgagggacacgagcaucacucugcuggacggaccauuaggggccuugccaaggu

SEQ ID NO: 428763 - RNA, 64 nt, Human
uacuguaaguaugaaaugaaagaaaaacaaucauuggacggaaaaggacaacccauauguucca

SEQ ID NO: 428764 - RNA, 64 nt, Human
uuugguagacgcggugggggcgggguggggggucuggacggagucucuauuuaaggagaaauca

SEQ ID NO: 428765 - RNA, 64 nt, Human
gagcuggagggaggggcgggagagaggcaagggguggacggagccaaaggccgugccugguggg

SEQ ID NO: 428766 - RNA, 64 nt, Human
aggcgucuggucaacuuagcacaagggcagugccuggacggacccggagcccccgcauaucagc

SEQ ID NO: 428767 - RNA, 64 nt, Human
gagggaccuccccacaccuacuccaaagaacagcuggacggagcugagaggagacccuagcauc

SEQ ID NO: 428768 - RNA, 64 nt, Human
gaacaguagccagugucuggcaggcuccagaggguggacggagcggggcccauucucaggucaa

SEQ ID NO: 428769 - RNA, 64 nt, Human
cugaaguaggcgcccccgggacugggcuaggaguuggacggaauggaggauggaggacagcgag

SEQ ID NO: 428770 - RNA, 64 nt, Human
ccaacgaccauggagagaugggccguugccaugguggacggacucccgggcugggcuuuugaau

SEQ ID NO: 428771 - RNA, 64 nt, Human
cucugaucaaauuggcuacaaucuuggagcugcuuggacggauuccuuggcagccggguuagca

SEQ ID NO: 428772 - RNA, 64 nt, Human
uggaggagaaagccauucuggacaccaggggaccuggacggaggguccccacagcccgugcccc

SEQ ID NO: 428773 - RNA, 52 nt, Human
uggauggcugugacuucuaggauggacggaaccaugcacagcaggcugggaa

SEQ ID NO: 428774 - RNA, 64 nt, Human
accuccauuucagcauguggcucgcguggacagguggacggacgcuguggccgcauggaaccuu

SEQ ID NO: 428775 - RNA, 64 nt, Human
cugcgguuuccuauuuauguggccauguuccuccuggacggaucucccuguguguuucaagcug

SEQ ID NO: 428776 - RNA, 64 nt, Human
ccugaagccccucccugagugguccccaccuuucuggacggaaccacguacuuuuuacauacau

SEQ ID NO: 428777 - RNA, 64 nt, Human
agcuccagguccuggagccacguccagcacagaguggacggauucaccguggccgacucuuuuc

SEQ ID NO: 428778 - RNA, 64 nt, Human
cagaagccauagacgagacguagguagccguaguuggacggacgggcagggccggcggggcagc

SEQ ID NO: 428779 - RNA, 64 nt, Human
cauauggaggacagguggacaugguccugagcucuggacggagcaggcacccugaucucauucu

SEQ ID NO: 428780 - RNA, 64 nt, Human
ucgcccuccuagggccuggguacagggcaugaguuggacggaccccaggguuauuauugccuuu

SEQ ID NO: 428781 - RNA, 59 nt, Human
aauucuuccuggagaggugauggcuggccuggacggaccagccccguccacagaacucu

SEQ ID NO: 428782 - RNA, 64 nt, Human
cacauuuugcacugguuuauggcgauuguuuucuuggacggauaguguaaaauaaacuucucug

SEQ ID NO: 428783 - RNA, 64 nt, Human
ccaacagagcucaggacagcccacagggaggugguggacggacuguaauugauagauugauuau

SEQ ID NO: 428784 - RNA, 64 nt, Human
cuuuccugcccucccccaacccucccuuggcggcuggacggaggggggacuugcuaggagcgga

SEQ ID NO: 428785 - RNA, 64 nt, Human
ccugauaaaccaacuaacuuugguggaauccuuguggacggaagagcuaaagauucucagggca

SEQ ID NO: 428786 - RNA, 64 nt, Human
ucuccaccucagcauugcaucguaucaucauuuucgcuacgaauuuauuuuucaacaauaagcu

SEQ ID NO: 428787 - RNA, 64 nt, Human
caucacuugagcccaggaguuggaggcugcagugcgcuacgaucacaccacugcacaccagccu

SEQ ID NO: 428788 - RNA, 64 nt, Human
ccagacccgggaagggaaguccgcagccgacgcccgcuacgaagcagccugcaacaggcuggcc

SEQ ID NO: 428789 - RNA, 64 nt, Human
uuccagaagaaccaguggaagaauuuaaauuuggcgcuacgaucaaaacuacugaauuaguaga

SEQ ID NO: 428790 - RNA, 64 nt, Human
cccucgggggacuggacacacauccugccagaggcgcuacgaagcuuugcccagaugaagccag

SEQ ID NO: 428791 - RNA, 64 nt, Human
gaacauccggcauucaggccgcgaugacaccucccgcuacgaugagagguaagauugggcgacc

SEQ ID NO: 428792 - RNA, 64 nt, Human
ccagcagcuggagcugggccgcuuccugaggagccgcuacgaggccuuccugaguccggaguac

SEQ ID NO: 428793 - RNA, 64 nt, Human
ugauaaugcuaauuuuauuauaguaaugugacuuggauucaauuuuaaggcauauuuaacaaaa

SEQ ID NO: 428794 - RNA, 64 nt, Human
gccucccuuugguaaaucugccuuauccuucuuuaccuggcaaagagccaaucauguuaacucu

SEQ ID NO: 428795 - RNA, 64 nt, Human
ucuaacgccagcacacuauuuacaagauggacuuaccuggcagacuugcccaggucaccaagca

SEQ ID NO: 428796 - RNA, 64 nt, Human
uggauuaauagagaaauuuugauaagaauggagacgcuacgacagauguaggaagucaucuacc

SEQ ID NO: 428797 - RNA, 64 nt, Human
gcaguaaauuggcaccgugucacacuguuuccugggauucaaguaugcaaccagaacacaggag

SEQ ID NO: 428798 - RNA, 64 nt, Human
cucccuuggaggccucauuccagcgccccaaggaggauucaaacuguuggggcuggaagaacuu

SEQ ID NO: 428799 - RNA, 64 nt, Human
cgcacuggucacacaucuguaagugggagaggcaggauucaacagaucugucugucuugagucu

SEQ ID NO: 428800 - RNA, 64 nt, Human
guuaagagaauaaacuagaucuagaaucagagcuggauucaauuccuguccuucacauuuacua

SEQ ID NO: 428801 - RNA, 64 nt, Human
ugaauguaggauucuucaguauguggaaagacaaggauucaacguguggucauaugauaaauaa

SEQ ID NO: 428802 - RNA, 64 nt, Human
cuuguccagcuaacucagcuguuuauaauugaagggauucaacaaaauuaucucuagcaucagg

SEQ ID NO: 428803 - RNA, 64 nt, Human
ucgugugugugggugggggcagccuccaccuccuggauucaagagauuccaggggugcagcaag

SEQ ID NO: 428804 - RNA, 64 nt, Human
cucuccuuugcucucugcagcuguaagccagaggggauucaagguaaauaggcuuuacaggcuc

SEQ ID NO: 428805 - RNA, 64 nt, Human
uuuggcuguuuuuguaguuggauuguuuguauuaggauucaagcaaggcccauauauugcauuu

SEQ ID NO: 428806 - RNA, 64 nt, Human
uagauuccucuggugcuggucuccaggcugacaaggauucaaaguugucucugaaacuccucuu

SEQ ID NO: 428807 - RNA, 64 nt, Human
ucccgagguccagagccccaccuccuaacaccauggauucaaagugcucagggaauuugccucu

SEQ ID NO: 428808 - RNA, 64 nt, Human
uucugcugucuccgcguaggcagcuucggggcaaggauucaacuccccaggccucccacgguug

SEQ ID NO: 428809 - RNA, 63 nt, Human
augugggguugcugaagaugccuugaggugaaaugggggcaggaaagccacaucuugcucugc

SEQ ID NO: 428810 - RNA, 63 nt, Human
cauugaaauuucuugguuaaguuuaauuuucucugggggcaugaucucacaaagaauacucaa

SEQ ID NO: 428811 - RNA, 63 nt, Human
uaauggaaguggauugaauacagcagucucaacugggggcaauuuugccccccagaggacauu

SEQ ID NO: 428812 - RNA, 63 nt, Human
agaaagaagcuuuugauuagauguacaauacauugggggcagaagaucugggaucaauuaaga

SEQ ID NO: 428813 - RNA, 64 nt, Human
gggugacagagcaagacccugucuuaaaaaaagaggauucaacacauauuuuuauauuauguua

SEQ ID NO: 428814 - RNA, 64 nt, Human
ccuaaggacucagauuguaucuuuguacagaagaggauucaaaacgccacguguaguggcucau

SEQ ID NO: 428815 - RNA, 64 nt, Human
uaauuugacuguaacacauuuguuucaagucuuuggauucaaacaaccggauuguauuaaaauu

SEQ ID NO: 428816 - RNA, 64 nt, Human
uucaugaucacacagcuaauaagugguggucccaggauucaacccaagaagucuguuagaaucc

SEQ ID NO: 428817 - RNA, 64 nt, Human
caaggagcauauuuugcucuuaggauggucuuugggauucaagaauagaauaauaaauccaaac

SEQ ID NO: 428818 - RNA, 64 nt, Human
acacgagcuagcuucugcaauguuuaucuagaauggauucaacacugugcacggaaaagacaag

SEQ ID NO: 428819 - RNA, 64 nt, Human
uucugaaacucacagaagucacgugauggagagaggauucaaagccagggccucagacccucac

SEQ ID NO: 428820 - RNA, 64 nt, Human
auaagccauuuggagucaugauugguggucaaguggauucaagcuaaaauacuaagaccagcau

SEQ ID NO: 428821 - RNA, 64 nt, Human
uuugccaugcuggccaggcuggucucgaacugcuggauucaagugauccgcccaucuccgucuc

SEQ ID NO: 428822 - RNA, 64 nt, Human
gcgcgaucucagcucacugcaaccucugccucccggauucaagugauucuccugucucagccuc

SEQ ID NO: 428823 - RNA, 64 nt, Human
ucuuacucugaaacauggccuguuugggagugcgggauucaaagguggucccacggcugccccu

SEQ ID NO: 428824 - RNA, 64 nt, Human
gacuuugaaacaucucucucucucauaacucccuggauucaaguagcacauugguaauagguau

SEQ ID NO: 428825 - RNA, 64 nt, Human
caaaccuucauuccuugaaucaaggagcacuacuggauucaacugccaaaauuuuuuaaagguu

SEQ ID NO: 428826 - RNA, 64 nt, Human
uucugagaccacccagugaauaggcacuacccugggauucaagacagucuuuuguaacuggcac

SEQ ID NO: 428827 - RNA, 64 nt, Human
auccccucagucugaaucuucucauugucuuauaggauucaagaaauggaaggaugauucuugu

SEQ ID NO: 428828 - RNA, 64 nt, Human
ggaaaacagcucaguuugggaaguaucagagaugggauucaaacccagauccucugguccaagu

SEQ ID NO: 428829 - RNA, 63 nt, Human
cuccucagaucuguuugugccuuucaaaaguacugggggcagauucucaaaacucuuagauug

SEQ ID NO: 428830 - RNA, 57 nt, Human
ugcugcugccagagagaugagcugcccaccuggcaguggccgcagccuggcccucug

SEQ ID NO: 428831 - RNA, 64 nt, Human
ucauuuaacauccugaccugguaagcugccacacaccuggcaguggggagcaucgcuguuucca

SEQ ID NO: 428832 - RNA, 64 nt, Human
uuugguguuaaaaaaaaaaaccuguaagucuguaaccuggcaacauuuuacaacccuguauuuu

SEQ ID NO: 428833 - RNA, 64 nt, Human
ucccacuuccccuccccuuuccucuccagcauuaggauucaagggaaauuugcaugaagccaau

SEQ ID NO: 428834 - RNA, 64 nt, Human
ucaguuuaaagugaaagaaaaaucuguaauacaaggauucaaaauaugugagggugcauaggua

SEQ ID NO: 428835 - RNA, 64 nt, Human
cugcccaggaguggccaguguucggcguugcucgggauucaagauaccaccaguucagagcuaa

SEQ ID NO: 428836 - RNA, 64 nt, Human
acacagccagcccaagaugacuuaucuggguuuaggauucaauaguauucacuaacugcuuauu

SEQ ID NO: 428837 - RNA, 64 nt, Human
agauuuaaaggacaugcugggugcccagcaggauggauucaagggaaaccuacauuaaggaaaa

SEQ ID NO: 428838 - RNA, 64 nt, Human
gcgcgaucucggcucacugcaaccuccaccucccggauucaagcgauucuccugccucagccuc

SEQ ID NO: 428839 - RNA, 64 nt, Human
gcacuugcuuuaucuccuugggcauucguacuuaggauucaauagaaacauguacaggguaaac

SEQ ID NO: 428840 - RNA, 64 nt, Human
uguggaccugacaguuaaaaauauaaagaaccuaggauucaauuccaacuuucucuguuugccu

SEQ ID NO: 428841 - RNA, 64 nt, Human
cauuuugcaucagccuggagugaaccaugaacuuggauucaagacugucuuuucuauagcaagu

SEQ ID NO: 428842 - RNA, 64 nt, Human
uaagaccauauuguaagagucuuguuaaaaugauggauucaacuucugccucggaugagagguu

SEQ ID NO: 428843 - RNA, 64 nt, Human
auguaccccauggauuuaaucuuaucuaccccguggauucaaucuucuuaucagaagguucuuu

SEQ ID NO: 428844 - RNA, 64 nt, Human
ccggcccaguucagggacagaauuauaguguuugggauucaaaccaacagucugucaguguaca

SEQ ID NO: 428845 - RNA, 64 nt, Human
gcaugaucucagcucacugcaaccucugccuucuggauucaagugauucuugugccuuagccuc

SEQ ID NO: 428846 - RNA, 64 nt, Human
gucagcccacuguauuuguguguuccacaucuguggauucaaccaacugcagaucaaaaauauu

SEQ ID NO: 428847 - RNA, 64 nt, Human
gugcaauuucagcucacugcaaucucugccacccggauucaagcaauucuccugucucagccuc

SEQ ID NO: 428848 - RNA, 64 nt, Human
cucccuucuccaugaugugacuuccggagauaaaggauucaaaagauaaagacaaaguacgcuc

SEQ ID NO: 428849 - RNA, 64 nt, Human
uccucgcucaacuccuuggccucuucuugcuuugaccuggcagauaucagccucaacauugagu

SEQ ID NO: 428850 - RNA, 64 nt, Human
gcuguauaaagcugcagcuuucaacagguuuuaaaccuggcauuaaaauguaauggcaaaacca

SEQ ID NO: 428851 - RNA, 64 nt, Human
gggaaaggaggaacaauuaggacguggcaaugagaccuggcagggcagaguacaagcccagcac

SEQ ID NO: 428852 - RNA, 64 nt, Human
auguaaaugacgaguuaaugggugcagccaaccaaccuggcacauguauucauauguaacaaac

SEQ ID NO: 428853 - RNA, 64 nt, Human
acaguuggcccucugugguuaguuccacaucuguggauucaaccaaccaaggacggaaaaugcu

SEQ ID NO: 428854 - RNA, 64 nt, Human
uucucggccaucgacugcagaugaugaaagagcgggauucaacuuuguuuucuuuuccuguggc

SEQ ID NO: 428855 - RNA, 64 nt, Human
aaagcacaauucauuuguaaugcauauccaucuuggauucaauccaaggugcuuuagcuaucag

SEQ ID NO: 428856 - RNA, 64 nt, Human
ucuauucuugggauaaauaauaguaaauucuauaggauucaauacuuaguuugcaaaagcacuu

SEQ ID NO: 428857 - RNA, 64 nt, Human
uuaacauggaauuuaauuuaugugaaagaguucuggauucaaaugucaguucauaauauaugga

SEQ ID NO: 428858 - RNA, 64 nt, Human
augagcauuuaaaaacuguuuacagccaccauagggauucaaaagaauuuggaauaaacuuuga

SEQ ID NO: 428859 - RNA, 64 nt, Human
uuguggaggauauguguuuagagaugcgagcuggggauucaacagguaagagggagagagauca

SEQ ID NO: 428860 - RNA, 64 nt, Human
gcucuuuuaucaucagaauaggaaaaauugucauggauucaaguuauuaaaagcauaaguuugg

SEQ ID NO: 428861 - RNA, 64 nt, Human
uuacauccuagggcaugaggggaguaucuuucagggauucaaauggaauuuuuaccuguuacuu

SEQ ID NO: 428862 - RNA, 64 nt, Human
uguaacuuucugguuauauacugcuuauaucuguggauucaaguuacugaagugaauaccaaua

SEQ ID NO: 428863 - RNA, 64 nt, Human
gaagaaaaccuacgcuucaggcucagagaaaccuggauucaaauccugccucucucacuuggaa

SEQ ID NO: 428864 - RNA, 64 nt, Human
uugcaaugucagcucacugcaaccuccaccuccuggauucaagugauucucgagccuuaagcuc

SEQ ID NO: 428865 - RNA, 64 nt, Human
gccugugacucugaacagcaggaccuuggugacuggauucaacuugcuugggagggucugugcu

SEQ ID NO: 428866 - RNA, 64 nt, Human
uucuguguaaacucagauaagucaccuuucucugggauucaaauuuuugcaucaguuaaaaaaa

SEQ ID NO: 428867 - RNA, 64 nt, Human
ccccuccucagagggggcagauagaaacugggacggauucaagucacaugcacgcggauagcag

SEQ ID NO: 428868 - RNA, 64 nt, Human
accagauugucaucguggcacugucugugaagacggauucaaauguuuucauguaacuauguaa

SEQ ID NO: 428869 - RNA, 64 nt, Human
ugcuuguauuuacucacgugguuaaaaaauuauuaccuggcaaacugaguugccggucauauug

SEQ ID NO: 428870 - RNA, 64 nt, Human
cugaagguuuuccaaagggcuuggcuccagagccaccuggcagacugcccguggcccugcuguc

SEQ ID NO: 428871 - RNA, 64 nt, Human
uccucaaaaguuuuucugaucccucgccuugcacaccuggcaugcaucaggcacaucuguccua

SEQ ID NO: 428872 - RNA, 64 nt, Human
caacaauguuguuuuaagacucuuaaaauacgguaccuggcaauguuuauuucauaaagaauug

SEQ ID NO: 428873 - RNA, 64 nt, Human
aauuauuauauucuaguuuggaguacuugcuguaggauucaagcugucuuugcacuagcucuaa

SEQ ID NO: 428874 - RNA, 64 nt, Human
aucaccagcuuuuuuucauucuuaacucuuuaaaggauucaaacgcaacucaaaucugugcugg

SEQ ID NO: 428875 - RNA, 64 nt, Human
cucugacuguuggaaucccacgcaccauucaguaggauucaauucaauguggaaccauucaaca

SEQ ID NO: 428876 - RNA, 64 nt, Human
cugagggcaccuagacucuacagccaggcggccaggauucaacucccugccuggaucucaccag

SEQ ID NO: 428877 - RNA, 64 nt, Human
guccacugaacaaggcuaguuccugcaccacccaggauucaaaggaaagacgaagggagcagaa

SEQ ID NO: 428878 - RNA, 64 nt, Human
gggacuagaaauuauuugaaguuuucuuuauuacggauucaaagacuuauuuugaaaguuggaa

SEQ ID NO: 428879 - RNA, 64 nt, Human
gauaagagaggugcauguugguauuuaaaguaguggauucaaagaacuuagauuauaaauaaga

SEQ ID NO: 428880 - RNA, 64 nt, Human
gauguaaugcacauuauuggcguaucuuuaaguuggauucaaauggccauuuuucuccaauuuu

SEQ ID NO: 428881 - RNA, 64 nt, Human
gugcgaucucagcucacugcaaccucugccuccuggauucaagcgauucuccugucccagccuc

SEQ ID NO: 428882 - RNA, 64 nt, Human
gcaugaucugggcucacugcaaccuccuccuccuggauucaagcaauucucuugcuucagccuc

SEQ ID NO: 428883 - RNA, 64 nt, Human
caccucugaauccccaccaggcgccuuccuggguggauucaacaagaugauuuugcccuuuccc

SEQ ID NO: 428884 - RNA, 64 nt, Human
cuuuggaacaaaucccccccacuccaaaguccauggauucaauggacucauccauuugugagga

SEQ ID NO: 428885 - RNA, 64 nt, Human
uaucucaaaaaaaauaaaaagaauuaugaaaguuggauucaaauuuuggguauauuacuaagua

SEQ ID NO: 428886 - RNA, 64 nt, Human
aaauuugcaacauauaaaguaguuugaucuaagaggauucaacaccuuuguuuuguugcucagu

SEQ ID NO: 428887 - RNA, 64 nt, Human
gaguucccaagaaaggaaaccuuuucuuguaucuggauucaaauuuauuuccaauguuucaagc
